United States Patent 11,254,933 (CRISPR/CAS TRANSCRIPTIONAL MODULATION) - sequence listing, part 4

SEQ ID NO: 136810 - DNA, 20 bp, human
gcctggcccatagggagaag

SEQ ID NO: 136811 - DNA, 20 bp, human
ggtagctgggtgctgtccaa

SEQ ID NO: 136812 - DNA, 20 bp, human
gtaggggagcgagtcgtgac

SEQ ID NO: 136813 - DNA, 20 bp, human
gacgcacgtagtcaaacagt

SEQ ID NO: 136814 - DNA, 20 bp, human
gtatctctgggcgttcatag

SEQ ID NO: 136815 - DNA, 20 bp, human
gggcgacagggcgtcgttag

SEQ ID NO: 136816 - DNA, 20 bp, human
gagcacttgttggcctacag

SEQ ID NO: 136817 - DNA, 20 bp, human
gacagcgaggtccccgtcca

SEQ ID NO: 136818 - DNA, 20 bp, human
gtgctgggcggaggcatcag

SEQ ID NO: 136819 - DNA, 20 bp, human
gagcgtaggagagaccgaaa

SEQ ID NO: 136820 - DNA, 20 bp, human
ggactcacccacaataggta

SEQ ID NO: 136821 - DNA, 20 bp, human
gtggagcactcaccttaggg

SEQ ID NO: 136822 - DNA, 20 bp, human
gtccagatgtaggagaggta

SEQ ID NO: 136823 - DNA, 20 bp, human
gaacagagtggacggagcgt

SEQ ID NO: 136824 - DNA, 20 bp, human
gggaccgtggtcgtgctggg

SEQ ID NO: 136825 - DNA, 20 bp, human
gggcccatgcggaaacctgg

SEQ ID NO: 136826 - DNA, 20 bp, human
ggcggcctcaagcctcccag

SEQ ID NO: 136827 - DNA, 20 bp, human
gcccggggccagcttagact

SEQ ID NO: 136828 - DNA, 20 bp, human
ggctgcctgtgggcaaggag

SEQ ID NO: 136829 - DNA, 20 bp, human
gaggcgactgtcgtgcgcag

SEQ ID NO: 136830 - DNA, 20 bp, human
gtggggcgagggagaaaccc

SEQ ID NO: 136831 - DNA, 20 bp, human
ggaaggagagccaggccgga

SEQ ID NO: 136832 - DNA, 20 bp, human
ggggaagcccggtccaggaa

SEQ ID NO: 136833 - DNA, 20 bp, human
gagcttctcgctgtcggaca

SEQ ID NO: 136834 - DNA, 20 bp, human
gctcaggcgcgtccgcgggg

SEQ ID NO: 136835 - DNA, 20 bp, human
ggcgcccgatgatcgagtcc

SEQ ID NO: 136836 - DNA, 20 bp, human
gcggcgcgctgcctcatgga

SEQ ID NO: 136837 - DNA, 20 bp, human
ggtcagcaagaagttcgtgt

SEQ ID NO: 136838 - DNA, 20 bp, human
ggtgcggcagcgcgtcaagg

SEQ ID NO: 136839 - DNA, 20 bp, human
gtggccctggagctgaacgg

SEQ ID NO: 136840 - DNA, 20 bp, human
gcggcagcgcgtcaaggcgg

SEQ ID NO: 136841 - DNA, 20 bp, human
ggctggtggagaccatgctt

SEQ ID NO: 136842 - DNA, 20 bp, human
gcagctgttttccctccatg

SEQ ID NO: 136843 - DNA, 20 bp, human
gggcggcgtgctgaccccag

SEQ ID NO: 136844 - DNA, 20 bp, human
gggtggagaccatgcttcgg

SEQ ID NO: 136845 - DNA, 20 bp, human
gagctgctggtggtcggcgc

SEQ ID NO: 136846 - DNA, 20 bp, human
gcgcgggacagagggaggtc

SEQ ID NO: 136847 - DNA, 20 bp, human
ggggaacaagggcttctcgg

SEQ ID NO: 136848 - DNA, 20 bp, human
gtcaccggaggcgagcacca

SEQ ID NO: 136849 - DNA, 20 bp, human
gcccatcctcgggtcaccgg

SEQ ID NO: 136850 - DNA, 20 bp, human
gacggacgcacaaagcccag

SEQ ID NO: 136851 - DNA, 20 bp, human
gagagaggccccctcgaaca

SEQ ID NO: 136852 - DNA, 20 bp, human
gccgccggccgaaggctgtg

SEQ ID NO: 136853 - DNA, 20 bp, human
gcgttcccgcggaccctcgg

SEQ ID NO: 136854 - DNA, 20 bp, human
ggtctgtgccgacaagatgg

SEQ ID NO: 136855 - DNA, 20 bp, human
ggcgcggtcaggggagatcg

SEQ ID NO: 136856 - DNA, 20 bp, human
ggaggaagtagggagcgggg

SEQ ID NO: 136857 - DNA, 20 bp, human
gccgaggctgtctaaggagt

SEQ ID NO: 136858 - DNA, 20 bp, human
gaggctgtctaaggagtcgg

SEQ ID NO: 136859 - DNA, 20 bp, human
gtcttctcgtggttccagtg

SEQ ID NO: 136860 - DNA, 20 bp, human
gccgcagctggcgacaagtt

SEQ ID NO: 136861 - DNA, 20 bp, human
ggcgacaagttgggaatccc

SEQ ID NO: 136862 - DNA, 20 bp, human
gcgccagctgcggaccctcc

SEQ ID NO: 136863 - DNA, 20 bp, human
gcccacgccacgagcagagg

SEQ ID NO: 136864 - DNA, 20 bp, human
gtgaatgagcggagcctgga

SEQ ID NO: 136865 - DNA, 20 bp, human
gcatcgacagcattatccaa

SEQ ID NO: 136866 - DNA, 20 bp, human
gcattctggggttcgtttag

SEQ ID NO: 136867 - DNA, 20 bp, human
ggaatggcggccgcccgctc

SEQ ID NO: 136868 - DNA, 20 bp, human
gtggggtgggcaagataggt

SEQ ID NO: 136869 - DNA, 20 bp, human
gctggtggggtgggcaagat

SEQ ID NO: 136870 - DNA, 20 bp, human
gacccactagacgacaaagt

SEQ ID NO: 136871 - DNA, 20 bp, human
gccaagcagcgtgggctggt

SEQ ID NO: 136872 - DNA, 20 bp, human
gcagcacctcgggctcaggg

SEQ ID NO: 136873 - DNA, 20 bp, human
ggcagaagacacaagtggtt

SEQ ID NO: 136874 - DNA, 20 bp, human
gtgcggagagcgttggatct

SEQ ID NO: 136875 - DNA, 20 bp, human
ggcttgggacttgaaatctg

SEQ ID NO: 136876 - DNA, 20 bp, human
gttagccaggttatccccag

SEQ ID NO: 136877 - DNA, 20 bp, human
ggaagcggcgagccggaagt

SEQ ID NO: 136878 - DNA, 20 bp, human
gtagggctgggagaatcgga

SEQ ID NO: 136879 - DNA, 20 bp, human
gctaggcctagggatatggg

SEQ ID NO: 136880 - DNA, 20 bp, human
gctagggatatgggaggtgt

SEQ ID NO: 136881 - DNA, 20 bp, human
gtatgcgtcacacccggaag

SEQ ID NO: 136882 - DNA, 20 bp, human
ggtgtggggttgaatatcta

SEQ ID NO: 136883 - DNA, 20 bp, human
ggtattggagctatttggag

SEQ ID NO: 136884 - DNA, 20 bp, human
gtgggagaatcggaaggtat

SEQ ID NO: 136885 - DNA, 20 bp, human
gcatggctaaggctcaggac

SEQ ID NO: 136886 - DNA, 20 bp, human
gatgagtgcgggccagagga

SEQ ID NO: 136887 - DNA, 20 bp, human
gaggccgacgagaaccctca

SEQ ID NO: 136888 - DNA, 20 bp, human
gtcacggtcaggagagccgg

SEQ ID NO: 136889 - DNA, 20 bp, human
gtcgcgataagaagacccgg

SEQ ID NO: 136890 - DNA, 20 bp, human
gtgaccgtgagggttctcgt

SEQ ID NO: 136891 - DNA, 20 bp, human
gctcaagaggtggagaactg

SEQ ID NO: 136892 - DNA, 20 bp, human
gtactggaagtctcgagcgt

SEQ ID NO: 136893 - DNA, 20 bp, human
gggaggctcgaggtccgtct

SEQ ID NO: 136894 - DNA, 20 bp, human
ggtgaagcgccagaagacca

SEQ ID NO: 136895 - DNA, 20 bp, human
gtctggcgcttcaccaccgg

SEQ ID NO: 136896 - DNA, 20 bp, human
gttcagcccggagcagaggg

SEQ ID NO: 136897 - DNA, 20 bp, human
gggctgaagcgctctgagag

SEQ ID NO: 136898 - DNA, 20 bp, human
ggtgcgggcggtactactgg

SEQ ID NO: 136899 - DNA, 20 bp, human
gagcgtgcgggcggtactac

SEQ ID NO: 136900 - DNA, 20 bp, human
ggaccaagaaaggagttacc

SEQ ID NO: 136901 - DNA, 20 bp, human
gcgcttcagcccggagcaga

SEQ ID NO: 136902 - DNA, 20 bp, human
gggtctccgccctctgctcc

SEQ ID NO: 136903 - DNA, 20 bp, human
gacgcctctaagaccaagaa

SEQ ID NO: 136904 - DNA, 20 bp, human
ggggtcaaaggctcatctgt

SEQ ID NO: 136905 - DNA, 20 bp, human
gtctagcggggacaccgacg

SEQ ID NO: 136906 - DNA, 20 bp, human
gcccagggccaggaacgacg

SEQ ID NO: 136907 - DNA, 20 bp, human
gtgcagggcgctgataccgt

SEQ ID NO: 136908 - DNA, 20 bp, human
gccctctgctgcgccacctg

SEQ ID NO: 136909 - DNA, 20 bp, human
gggcggtgcgatgtccggag

SEQ ID NO: 136910 - DNA, 20 bp, human
ggcacaggccgccaggaact

SEQ ID NO: 136911 - DNA, 20 bp, human
gagggccaggaacgacgggg

SEQ ID NO: 136912 - DNA, 20 bp, human
gcgacggggcggatcgagac

SEQ ID NO: 136913 - DNA, 20 bp, human
gtcgagactggcaacgggga

SEQ ID NO: 136914 - DNA, 20 bp, human
ggcgctcgaagcggacggtg

SEQ ID NO: 136915 - DNA, 20 bp, human
gtggactccaccaacgccga

SEQ ID NO: 136916 - DNA, 20 bp, human
ggggcgggccgcaggctgtc

SEQ ID NO: 136917 - DNA, 20 bp, human
ggccccagcccgacagcctg

SEQ ID NO: 136918 - DNA, 20 bp, human
ggcgggagcgcggccttagg

SEQ ID NO: 136919 - DNA, 20 bp, human
gaggaggcggccggagcggt

SEQ ID NO: 136920 - DNA, 20 bp, human
gggagcgcggccttaggagg

SEQ ID NO: 136921 - DNA, 20 bp, human
gggccgcaggctgtcgggct

SEQ ID NO: 136922 - DNA, 20 bp, human
gcgcggagcgtcctgtcagg

SEQ ID NO: 136923 - DNA, 20 bp, human
gcgcgctgcgtcgctgtccc

SEQ ID NO: 136924 - DNA, 20 bp, human
gcggagcggtgggcacagct

SEQ ID NO: 136925 - DNA, 20 bp, human
gcgcccgcccggcctcgcac

SEQ ID NO: 136926 - DNA, 20 bp, human
ggtccctgggaggattggga

SEQ ID NO: 136927 - DNA, 20 bp, human
gcccaggagggtgaaactca

SEQ ID NO: 136928 - DNA, 20 bp, human
gcgagctggaggaagccccc

SEQ ID NO: 136929 - DNA, 20 bp, human
gcacggatccgggcagatcc

SEQ ID NO: 136930 - DNA, 20 bp, human
gctgagtccctcgaactggg

SEQ ID NO: 136931 - DNA, 20 bp, human
gcgagacagcagcttgaggc

SEQ ID NO: 136932 - DNA, 20 bp, human
gactcggacgccaggtccca

SEQ ID NO: 136933 - DNA, 20 bp, human
gagtcttggtcagaaatgag

SEQ ID NO: 136934 - DNA, 20 bp, human
ggggtgaaactcacggatcc

SEQ ID NO: 136935 - DNA, 20 bp, human
gcgagtctttgggtagtata

SEQ ID NO: 136936 - DNA, 20 bp, human
gccagggagcgtgtaaacag

SEQ ID NO: 136937 - DNA, 20 bp, human
gggcgtgaagttccagccag

SEQ ID NO: 136938 - DNA, 20 bp, human
gttgcaacgcctccttaaag

SEQ ID NO: 136939 - DNA, 20 bp, human
ggacttgtagatgccctcgg

SEQ ID NO: 136940 - DNA, 20 bp, human
ggtaagaatactagttagta

SEQ ID NO: 136941 - DNA, 20 bp, human
ggggggagcgggaaacatag

SEQ ID NO: 136942 - DNA, 20 bp, human
gaagagacaggacggtcgat

SEQ ID NO: 136943 - DNA, 20 bp, human
gcatgagactaaacccccga

SEQ ID NO: 136944 - DNA, 20 bp, human
gcagggaggagtcgccgatc

SEQ ID NO: 136945 - DNA, 20 bp, human
gtaggggcaatccgtccgga

SEQ ID NO: 136946 - DNA, 20 bp, human
gcccagggccgggcactcat

SEQ ID NO: 136947 - DNA, 20 bp, human
ggctgggtccagcagcgcga

SEQ ID NO: 136948 - DNA, 20 bp, human
ggcctggaggagctgtaccg

SEQ ID NO: 136949 - DNA, 20 bp, human
ggtgtgcaccgagaccccaa

SEQ ID NO: 136950 - DNA, 20 bp, human
gggacgagcgccccagggcc

SEQ ID NO: 136951 - DNA, 20 bp, human
gcaagaggacgagcgcccca

SEQ ID NO: 136952 - DNA, 20 bp, human
gggcccgtaagaagcacccg

SEQ ID NO: 136953 - DNA, 20 bp, human
gcaatgccatagagcacgga

SEQ ID NO: 136954 - DNA, 20 bp, human
gcgtggagaagtggatcgac

SEQ ID NO: 136955 - DNA, 20 bp, human
ggagcaacacacaaagactt

SEQ ID NO: 136956 - DNA, 20 bp, human
gacacacctggcagtcgtag

SEQ ID NO: 136957 - DNA, 20 bp, human
gggcagaagtgacttaggtc

SEQ ID NO: 136958 - DNA, 20 bp, human
ggggtccgaggcaacggaga

SEQ ID NO: 136959 - DNA, 20 bp, human
gcgagacagagaaagcgctt

SEQ ID NO: 136960 - DNA, 20 bp, human
ggtgacaggcgagctcacag

SEQ ID NO: 136961 - DNA, 20 bp, human
gcgcctgtcactggagtcaa

SEQ ID NO: 136962 - DNA, 20 bp, human
gtgggggcgggagtgcagag

SEQ ID NO: 136963 - DNA, 20 bp, human
gggggcagggtccgaggcaa

SEQ ID NO: 136964 - DNA, 20 bp, human
gcgcggggtgggaacacacc

SEQ ID NO: 136965 - DNA, 20 bp, human
ggccctttgactccagtgac

SEQ ID NO: 136966 - DNA, 20 bp, human
gccgcatgcgaagggctccc

SEQ ID NO: 136967 - DNA, 20 bp, human
gcccggcagccgcatgcgaa

SEQ ID NO: 136968 - DNA, 20 bp, human
ggccgctaccacctccggcc

SEQ ID NO: 136969 - DNA, 20 bp, human
gccggcgccgctaccacctc

SEQ ID NO: 136970 - DNA, 20 bp, human
gctacggctgcgaggtacct

SEQ ID NO: 136971 - DNA, 20 bp, human
ggtgctggaggaatggatcg

SEQ ID NO: 136972 - DNA, 20 bp, human
ggccaccggcgccaccccgg

SEQ ID NO: 136973 - DNA, 20 bp, human
gtcgtaaggagcttcggaag

SEQ ID NO: 136974 - DNA, 20 bp, human
gctcagtgcggcccggagga

SEQ ID NO: 136975 - DNA, 20 bp, human
gacgggcgccgagtcctccc

SEQ ID NO: 136976 - DNA, 20 bp, human
gcacagacaagcctagaggg

SEQ ID NO: 136977 - DNA, 20 bp, human
ggagctggagggctgatgtg

SEQ ID NO: 136978 - DNA, 20 bp, human
gtggctctgctcagaactgg

SEQ ID NO: 136979 - DNA, 20 bp, human
gctgtggctctgctcagaac

SEQ ID NO: 136980 - DNA, 20 bp, human
gatcttggaggagtccgggt

SEQ ID NO: 136981 - DNA, 20 bp, human
gagcatggaagtattggtct

SEQ ID NO: 136982 - DNA, 20 bp, human
gtagcacagcggatagtggg

SEQ ID NO: 136983 - DNA, 20 bp, human
gagaccttcacaggagctgg

SEQ ID NO: 136984 - DNA, 20 bp, human
gaggtagcacagcggatagt

SEQ ID NO: 136985 - DNA, 20 bp, human
ggggtatcttggaggagtcc

SEQ ID NO: 136986 - DNA, 20 bp, human
gcgtggcgacaagcgggcgc

SEQ ID NO: 136987 - DNA, 20 bp, human
ggttccgaccccttactcac

SEQ ID NO: 136988 - DNA, 20 bp, human
ggagctgcgcgtcaccccgg

SEQ ID NO: 136989 - DNA, 20 bp, human
gcagccggtgagtaaggggt

SEQ ID NO: 136990 - DNA, 20 bp, human
gttcagtctgcgagggagga

SEQ ID NO: 136991 - DNA, 20 bp, human
gggcaaccagtgtccctaga

SEQ ID NO: 136992 - DNA, 20 bp, human
gtaagatcaacaactgggat

SEQ ID NO: 136993 - DNA, 20 bp, human
gggaatcatctgccaagtag

SEQ ID NO: 136994 - DNA, 20 bp, human
gagaggacagagaaacactg

SEQ ID NO: 136995 - DNA, 20 bp, human
ggagtaactcagagtatctc

SEQ ID NO: 136996 - DNA, 20 bp, human
gcagcgaatgcggcagcggg

SEQ ID NO: 136997 - DNA, 20 bp, human
ggaagaacagcccgcgcaat

SEQ ID NO: 136998 - DNA, 20 bp, human
gacgcgataccggaaggact

SEQ ID NO: 136999 - DNA, 20 bp, human
gtgagcaacgcgataccgga

SEQ ID NO: 137000 - DNA, 20 bp, human
ggcgatcgccgagggaaaaa

SEQ ID NO: 137001 - DNA, 20 bp, human
gcagcgggcggcagaacaca

SEQ ID NO: 137002 - DNA, 20 bp, human
gccacagagggcagcgaatg

SEQ ID NO: 137003 - DNA, 20 bp, human
ggtagggccgcggcgctcag

SEQ ID NO: 137004 - DNA, 20 bp, human
gggcaaggccgagactctgt

SEQ ID NO: 137005 - DNA, 20 bp, human
ggaaccggaagcccgcccga

SEQ ID NO: 137006 - DNA, 20 bp, human
gaggtgccaacggtcaggaa

SEQ ID NO: 137007 - DNA, 20 bp, human
gactgacccgcggaagccag

SEQ ID NO: 137008 - DNA, 20 bp, human
gccgcacccggccctcgcca

SEQ ID NO: 137009 - DNA, 20 bp, human
gcgcggggcccactgacccg

SEQ ID NO: 137010 - DNA, 20 bp, human
ggccggcacgcgggcgccca

SEQ ID NO: 137011 - DNA, 20 bp, human
gcggcagccgcgtctcccga

SEQ ID NO: 137012 - DNA, 20 bp, human
ggccagcggacccacttgtg

SEQ ID NO: 137013 - DNA, 20 bp, human
gcctcagccagcaacgccca

SEQ ID NO: 137014 - DNA, 20 bp, human
gaacgcccaaggcggcccgg

SEQ ID NO: 137015 - DNA, 20 bp, human
gccggcgggacctgtgccct

SEQ ID NO: 137016 - DNA, 20 bp, human
gcacagacacagccggggtc

SEQ ID NO: 137017 - DNA, 20 bp, human
gttgcacccccggcagacgg

SEQ ID NO: 137018 - DNA, 20 bp, human
ggagcgggtgagttccccgg

SEQ ID NO: 137019 - DNA, 20 bp, human
gccgcccggcattgcacccc

SEQ ID NO: 137020 - DNA, 20 bp, human
ggggacccacagacacagcc

SEQ ID NO: 137021 - DNA, 20 bp, human
ggaccgatcttggggcgggg

SEQ ID NO: 137022 - DNA, 20 bp, human
gggagagcgggtgagttccc

SEQ ID NO: 137023 - DNA, 20 bp, human
gtaccgagagcgctaggtcc

SEQ ID NO: 137024 - DNA, 20 bp, human
gccccaagatcggtctacga

SEQ ID NO: 137025 - DNA, 20 bp, human
gatgagtccagaacagaccg

SEQ ID NO: 137026 - DNA, 20 bp, human
ggaagcgaaggcgagagaca

SEQ ID NO: 137027 - DNA, 20 bp, human
ggagagactgacttaaagta

SEQ ID NO: 137028 - DNA, 20 bp, human
gcgcagatgcagggaagcga

SEQ ID NO: 137029 - DNA, 20 bp, human
ggtgtgtgctcaccgaggct

SEQ ID NO: 137030 - DNA, 20 bp, human
ggcagcagccactgccgcag

SEQ ID NO: 137031 - DNA, 20 bp, human
gcagctggtccctagataag

SEQ ID NO: 137032 - DNA, 20 bp, human
gcctggctcctctgcggcag

SEQ ID NO: 137033 - DNA, 20 bp, human
gtagagaggtttatcttcca

SEQ ID NO: 137034 - DNA, 20 bp, human
gaccaatcagcgcagatgca

SEQ ID NO: 137035 - DNA, 20 bp, human
gtcagttactgggacaaaga

SEQ ID NO: 137036 - DNA, 20 bp, human
gtagaggagaagggaaacca

SEQ ID NO: 137037 - DNA, 20 bp, human
ggtctcagcgcgggccccaa

SEQ ID NO: 137038 - DNA, 20 bp, human
ggcgcgggccccaaaggtcc

SEQ ID NO: 137039 - DNA, 20 bp, human
gtccggattggaggcaatga

SEQ ID NO: 137040 - DNA, 20 bp, human
gaccccagggaggctagtgt

SEQ ID NO: 137041 - DNA, 20 bp, human
gggagagcgaacaggtctag

SEQ ID NO: 137042 - DNA, 20 bp, human
gtgagaggaagagtccggat

SEQ ID NO: 137043 - DNA, 20 bp, human
gcctcagcgataccccaggg

SEQ ID NO: 137044 - DNA, 20 bp, human
gagaggtgggacacaaagca

SEQ ID NO: 137045 - DNA, 20 bp, human
gggcagaggggctaaggatg

SEQ ID NO: 137046 - DNA, 20 bp, human
gactggaggcctgagacagc

SEQ ID NO: 137047 - DNA, 20 bp, human
ggggactgcagcatcaactg

SEQ ID NO: 137048 - DNA, 20 bp, human
gcaccagaggacgctgggac

SEQ ID NO: 137049 - DNA, 20 bp, human
gagaacaggcggctcatgag

SEQ ID NO: 137050 - DNA, 20 bp, human
ggttgatgctgcagtcccgg

SEQ ID NO: 137051 - DNA, 20 bp, human
gaagacaccacaaacaggta

SEQ ID NO: 137052 - DNA, 20 bp, human
gagtggacttctaagaagtc

SEQ ID NO: 137053 - DNA, 20 bp, human
ggtatgtgcagagcgaggaa

SEQ ID NO: 137054 - DNA, 20 bp, human
gtgtgcagagcgaggaaggg

SEQ ID NO: 137055 - DNA, 20 bp, human
gcccgaaagacaccacaaac

SEQ ID NO: 137056 - DNA, 20 bp, human
gcgggtgcggagccaatcgg

SEQ ID NO: 137057 - DNA, 20 bp, human
gtcggcggcggcagagtccc

SEQ ID NO: 137058 - DNA, 20 bp, human
ggcactgctaagggaggact

SEQ ID NO: 137059 - DNA, 20 bp, human
ggatgtggctccgacggtgg

SEQ ID NO: 137060 - DNA, 20 bp, human
ggtgcggagccaatcggcgg

SEQ ID NO: 137061 - DNA, 20 bp, human
gcgcggggccaggcatcgag

SEQ ID NO: 137062 - DNA, 20 bp, human
gccgcaccttgaccccgagg

SEQ ID NO: 137063 - DNA, 20 bp, human
ggaagcacagattcgagatg

SEQ ID NO: 137064 - DNA, 20 bp, human
ggagctgggagcgctgtgcc

SEQ ID NO: 137065 - DNA, 20 bp, human
gggacgagggacccctggac

SEQ ID NO: 137066 - DNA, 20 bp, human
gcggagggtgagcccggcag

SEQ ID NO: 137067 - DNA, 20 bp, human
gcagtcccaggcggagggga

SEQ ID NO: 137068 - DNA, 20 bp, human
gagagacacacgcggagagg

SEQ ID NO: 137069 - DNA, 20 bp, human
gccgcgcgccatggacccca

SEQ ID NO: 137070 - DNA, 20 bp, human
gccgagtcccgagagcctgg

SEQ ID NO: 137071 - DNA, 20 bp, human
gggcagagacacacgcggag

SEQ ID NO: 137072 - DNA, 20 bp, human
gccccaaagctgggaccgga

SEQ ID NO: 137073 - DNA, 20 bp, human
ggggcgcgggcaccgagaac

SEQ ID NO: 137074 - DNA, 20 bp, human
gggtccatggcgcgcggggt

SEQ ID NO: 137075 - DNA, 20 bp, human
gcagcccgccgcctgcgcgg

SEQ ID NO: 137076 - DNA, 20 bp, human
gggcatgtgtattagtgaag

SEQ ID NO: 137077 - DNA, 20 bp, human
gcagggcagtgggtccttca

SEQ ID NO: 137078 - DNA, 20 bp, human
gttgtgctgagaggatccaa

SEQ ID NO: 137079 - DNA, 20 bp, human
gacatcccggacaccactta

SEQ ID NO: 137080 - DNA, 20 bp, human
gtagctgctgagtgaatgct

SEQ ID NO: 137081 - DNA, 20 bp, human
gctgagaggatccaagggat

SEQ ID NO: 137082 - DNA, 20 bp, human
gccgtggatgttgaagaagg

SEQ ID NO: 137083 - DNA, 20 bp, human
gtattacgaagcactctgtg

SEQ ID NO: 137084 - DNA, 20 bp, human
gggcaagccaggcatcaccg

SEQ ID NO: 137085 - DNA, 20 bp, human
gttcaggtgcaatctgactc

SEQ ID NO: 137086 - DNA, 20 bp, human
gctgcgctggagctctaggc

SEQ ID NO: 137087 - DNA, 20 bp, human
ggccactgccacttgacccg

SEQ ID NO: 137088 - DNA, 20 bp, human
ggaatgtcgacgaggagctg

SEQ ID NO: 137089 - DNA, 20 bp, human
gccgcgagccgcgggtcaag

SEQ ID NO: 137090 - DNA, 20 bp, human
gagctgaggtgagcgctggg

SEQ ID NO: 137091 - DNA, 20 bp, human
gttacctacccagaccccag

SEQ ID NO: 137092 - DNA, 20 bp, human
gcctctcgcgatatctaggg

SEQ ID NO: 137093 - DNA, 20 bp, human
ggcgctgggagggacggcct

SEQ ID NO: 137094 - DNA, 20 bp, human
gggtcaagtggcagtggcta

SEQ ID NO: 137095 - DNA, 20 bp, human
ggccgcgggtcaagtggcag

SEQ ID NO: 137096 - DNA, 20 bp, human
gcaccccgggaacccggaag

SEQ ID NO: 137097 - DNA, 20 bp, human
gacgctcccgggaacgggtc

SEQ ID NO: 137098 - DNA, 20 bp, human
gccagacacgctcccgggaa

SEQ ID NO: 137099 - DNA, 20 bp, human
ggcaggtggaggcaccgtaa

SEQ ID NO: 137100 - DNA, 20 bp, human
gctggctcaggagtactcga

SEQ ID NO: 137101 - DNA, 20 bp, human
gtcgctgccacggcaacctg

SEQ ID NO: 137102 - DNA, 20 bp, human
gcatcgtggtctgggagtag

SEQ ID NO: 137103 - DNA, 20 bp, human
gctccacttccgggttcccg

SEQ ID NO: 137104 - DNA, 20 bp, human
ggcgacttgtcgggacctag

SEQ ID NO: 137105 - DNA, 20 bp, human
gctctaatgctggctgagaa

SEQ ID NO: 137106 - DNA, 20 bp, human
ggcgcgggccgagagtcgca

SEQ ID NO: 137107 - DNA, 20 bp, human
ggagacaggatccccgcccg

SEQ ID NO: 137108 - DNA, 20 bp, human
gctccccgcgacctaccgga

SEQ ID NO: 137109 - DNA, 20 bp, human
gtcccctcccgcgcttccca

SEQ ID NO: 137110 - DNA, 20 bp, human
gtggcacggccgagttccgg

SEQ ID NO: 137111 - DNA, 20 bp, human
ggccgcgccgtgggaagcgc

SEQ ID NO: 137112 - DNA, 20 bp, human
ggcccgtggctgggcatcat

SEQ ID NO: 137113 - DNA, 20 bp, human
gcccaggtgaggcgcaggtg

SEQ ID NO: 137114 - DNA, 20 bp, human
gcggacggggatcggcgccg

SEQ ID NO: 137115 - DNA, 20 bp, human
gtcccgcgcttcccacggcg

SEQ ID NO: 137116 - DNA, 20 bp, human
gaagctgctggtcaaatacg

SEQ ID NO: 137117 - DNA, 20 bp, human
ggccctcaagctgatctggt

SEQ ID NO: 137118 - DNA, 20 bp, human
gcagtgcagtagggtcccca

SEQ ID NO: 137119 - DNA, 20 bp, human
gcccgaccagatcagcttga

SEQ ID NO: 137120 - DNA, 20 bp, human
gatgcaaggcggccaggcct

SEQ ID NO: 137121 - DNA, 20 bp, human
gaggcatcttgggcgctgtg

SEQ ID NO: 137122 - DNA, 20 bp, human
gaagctgatctggtcgggac

SEQ ID NO: 137123 - DNA, 20 bp, human
gaggccggggctcgtccgac

SEQ ID NO: 137124 - DNA, 20 bp, human
gataagcaagtcagaggccg

SEQ ID NO: 137125 - DNA, 20 bp, human
gcagttctgctaggcatctt

SEQ ID NO: 137126 - DNA, 20 bp, human
gaggctctgaggtcggggag

SEQ ID NO: 137127 - DNA, 20 bp, human
gccccgaggcccaaccacag

SEQ ID NO: 137128 - DNA, 20 bp, human
gtgcagaggctctgaggtcg

SEQ ID NO: 137129 - DNA, 20 bp, human
gagagttaataagaaggtgt

SEQ ID NO: 137130 - DNA, 20 bp, human
ggaaagtgagaggagacatg

SEQ ID NO: 137131 - DNA, 20 bp, human
ggagtgcagccaattcccag

SEQ ID NO: 137132 - DNA, 20 bp, human
gaggactcttgggataagtg

SEQ ID NO: 137133 - DNA, 20 bp, human
gactgtcccagtggtaaatg

SEQ ID NO: 137134 - DNA, 20 bp, human
gctcccaagtccctaaacta

SEQ ID NO: 137135 - DNA, 20 bp, human
gtccgagaggtgggtatgta

SEQ ID NO: 137136 - DNA, 20 bp, human
gccccgaaggaaagggttaa

SEQ ID NO: 137137 - DNA, 20 bp, human
gtagcggcgtctaggagggg

SEQ ID NO: 137138 - DNA, 20 bp, human
gggcagggcagtgaccaggt

SEQ ID NO: 137139 - DNA, 20 bp, human
gcggtagcggcgtctaggag

SEQ ID NO: 137140 - DNA, 20 bp, human
gggctgtgtcccctgaccgt

SEQ ID NO: 137141 - DNA, 20 bp, human
gggttaacggtttccggtag

SEQ ID NO: 137142 - DNA, 20 bp, human
gagagggcagggcagtgacc

SEQ ID NO: 137143 - DNA, 20 bp, human
ggaagcggacctgggagcag

SEQ ID NO: 137144 - DNA, 20 bp, human
ggcagacgctccaacggtca

SEQ ID NO: 137145 - DNA, 20 bp, human
gggggtcgcagacgctccaa

SEQ ID NO: 137146 - DNA, 20 bp, human
gccagggcgaggccatgtac

SEQ ID NO: 137147 - DNA, 20 bp, human
gcgacgccgtatggcttcca

SEQ ID NO: 137148 - DNA, 20 bp, human
gcctcgccctggaagccata

SEQ ID NO: 137149 - DNA, 20 bp, human
gtcctcctcgcataaaactc

SEQ ID NO: 137150 - DNA, 20 bp, human
ggaggaggaagcggttaggt

SEQ ID NO: 137151 - DNA, 20 bp, human
gtaaagggcaggctcagtgt

SEQ ID NO: 137152 - DNA, 20 bp, human
gtatcctcggcgacgccgta

SEQ ID NO: 137153 - DNA, 20 bp, human
gatagggagacctactgcgg

SEQ ID NO: 137154 - DNA, 20 bp, human
gatgcgaggaggaagcggtt

SEQ ID NO: 137155 - DNA, 20 bp, human
gaactcgggcacccggtaca

SEQ ID NO: 137156 - DNA, 20 bp, human
gctaggagagcggacggagg

SEQ ID NO: 137157 - DNA, 20 bp, human
gccactaggagagcggacgg

SEQ ID NO: 137158 - DNA, 20 bp, human
gcgaccactaggagagcgga

SEQ ID NO: 137159 - DNA, 20 bp, human
gtgcagggcccggctcgagg

SEQ ID NO: 137160 - DNA, 20 bp, human
gggcgcgcttgggctcccgg

SEQ ID NO: 137161 - DNA, 20 bp, human
gggcgacgactacgaccact

SEQ ID NO: 137162 - DNA, 20 bp, human
ggaggcggcgcctgaagcgg

SEQ ID NO: 137163 - DNA, 20 bp, human
gcccgggagtcgggagggat

SEQ ID NO: 137164 - DNA, 20 bp, human
ggctaccgcgggtgaagcgg

SEQ ID NO: 137165 - DNA, 20 bp, human
gcgagagggacccgggagtc

SEQ ID NO: 137166 - DNA, 20 bp, human
gtacttcagaaggctccatt

SEQ ID NO: 137167 - DNA, 20 bp, human
ggtcaactgagtctcttctt

SEQ ID NO: 137168 - DNA, 20 bp, human
gtctgactaggtacttcaga

SEQ ID NO: 137169 - DNA, 20 bp, human
gagaactgtacgactagtag

SEQ ID NO: 137170 - DNA, 20 bp, human
gagaaggcaagtcaaacagt

SEQ ID NO: 137171 - DNA, 20 bp, human
gtccgtccctaagtcaaaag

SEQ ID NO: 137172 - DNA, 20 bp, human
gttggttgaggggagaaacc

SEQ ID NO: 137173 - DNA, 20 bp, human
gacctgaagatggggtatcc

SEQ ID NO: 137174 - DNA, 20 bp, human
gcctcgtctacttggttgag

SEQ ID NO: 137175 - DNA, 20 bp, human
gacctggataccccatcttc

SEQ ID NO: 137176 - DNA, 20 bp, human
gccctgcgggctctccgatg

SEQ ID NO: 137177 - DNA, 20 bp, human
ggagcgtcggtgtgtccggg

SEQ ID NO: 137178 - DNA, 20 bp, human
gcgatgcggcgagcgagctg

SEQ ID NO: 137179 - DNA, 20 bp, human
ggcgcttgccacaaccctgc

SEQ ID NO: 137180 - DNA, 20 bp, human
gcgtgagcgtcggtgtgtcc

SEQ ID NO: 137181 - DNA, 20 bp, human
gtctccgcggcccaaaaggt

SEQ ID NO: 137182 - DNA, 20 bp, human
ggagtcggagagtaacttgt

SEQ ID NO: 137183 - DNA, 20 bp, human
ggccgcatcggagagcccgc

SEQ ID NO: 137184 - DNA, 20 bp, human
gttggaacctgtggtctgag

SEQ ID NO: 137185 - DNA, 20 bp, human
gagcgcgactacgtgagcgt

SEQ ID NO: 137186 - DNA, 20 bp, human
gcggtcgctgggagagactg

SEQ ID NO: 137187 - DNA, 20 bp, human
gtcattaggcagagaggcgg

SEQ ID NO: 137188 - DNA, 20 bp, human
gccaggccttgcccccgcgg

SEQ ID NO: 137189 - DNA, 20 bp, human
gtgcagctcattaggcagag

SEQ ID NO: 137190 - DNA, 20 bp, human
ggagcagataagcggcctct

SEQ ID NO: 137191 - DNA, 20 bp, human
gacaaatgtcccaaagactc

SEQ ID NO: 137192 - DNA, 20 bp, human
gaagactcgggcagctgaag

SEQ ID NO: 137193 - DNA, 20 bp, human
gttcgaatttgtgcaggcag

SEQ ID NO: 137194 - DNA, 20 bp, human
gctacctggtgcagctcatt

SEQ ID NO: 137195 - DNA, 20 bp, human
ggagttgcagcgaacctacc

SEQ ID NO: 137196 - DNA, 20 bp, human
gccgagcttccgggatccca

SEQ ID NO: 137197 - DNA, 20 bp, human
gcggaccgggaaagtgggag

SEQ ID NO: 137198 - DNA, 20 bp, human
ggagcaaggtggcgaaccaa

SEQ ID NO: 137199 - DNA, 20 bp, human
ggccgccgtccaggtccgac

SEQ ID NO: 137200 - DNA, 20 bp, human
gcgccggccgtcggaagatg

SEQ ID NO: 137201 - DNA, 20 bp, human
ggcctgtcggacctggacgg

SEQ ID NO: 137202 - DNA, 20 bp, human
ggctgcctgtcggacctgga

SEQ ID NO: 137203 - DNA, 20 bp, human
gctacaggcccgcggctcca

SEQ ID NO: 137204 - DNA, 20 bp, human
gcttggaggttcttacaaga

SEQ ID NO: 137205 - DNA, 20 bp, human
ggtccgcggcgttacttaca

SEQ ID NO: 137206 - DNA, 20 bp, human
gtacgtgggcccgagcaccc

SEQ ID NO: 137207 - DNA, 20 bp, human
gacgagttctgggacaacaa

SEQ ID NO: 137208 - DNA, 20 bp, human
gggaggaaggagacccgaaa

SEQ ID NO: 137209 - DNA, 20 bp, human
gccgagcacccgggcagtgg

SEQ ID NO: 137210 - DNA, 20 bp, human
gcccacgtagagcatagtca

SEQ ID NO: 137211 - DNA, 20 bp, human
gcgacggcggaaaacaccaa

SEQ ID NO: 137212 - DNA, 20 bp, human
ggccgtgactatgctctacg

SEQ ID NO: 137213 - DNA, 20 bp, human
ggacccgaaacggcaccgga

SEQ ID NO: 137214 - DNA, 20 bp, human
ggtccaagggagtcaagccg

SEQ ID NO: 137215 - DNA, 20 bp, human
gggatccagccctgcggctc

SEQ ID NO: 137216 - DNA, 20 bp, human
gagagcagaccgctagcagg

SEQ ID NO: 137217 - DNA, 20 bp, human
gcggaggaggagccaggcga

SEQ ID NO: 137218 - DNA, 20 bp, human
gaagctgacggccagaggga

SEQ ID NO: 137219 - DNA, 20 bp, human
gctctggccgtcagcttcca

SEQ ID NO: 137220 - DNA, 20 bp, human
gcagcggcccagcctcgagg

SEQ ID NO: 137221 - DNA, 20 bp, human
gctcagagcagaccgctagc

SEQ ID NO: 137222 - DNA, 20 bp, human
gggagaggcaaagcaacggg

SEQ ID NO: 137223 - DNA, 20 bp, human
ggcgctcacgcaccgagtcg

SEQ ID NO: 137224 - DNA, 20 bp, human
ggtgagggccttggaaccgg

SEQ ID NO: 137225 - DNA, 20 bp, human
gatgtgatagtctaagaccc

SEQ ID NO: 137226 - DNA, 20 bp, human
ggccgtacgcgccatatcgg

SEQ ID NO: 137227 - DNA, 20 bp, human
ggcggcaccgacggcaccgg

SEQ ID NO: 137228 - DNA, 20 bp, human
gcgggcggcagcgaaaatgt

SEQ ID NO: 137229 - DNA, 20 bp, human
ggcggcggcaccgacggcac

SEQ ID NO: 137230 - DNA, 20 bp, human
ggtacgcgccatatcggcgg

SEQ ID NO: 137231 - DNA, 20 bp, human
gccctgtggagcccccgctg

SEQ ID NO: 137232 - DNA, 20 bp, human
gggggccgtacgcgccatat

SEQ ID NO: 137233 - DNA, 20 bp, human
gtccgcgctggccttcccat

SEQ ID NO: 137234 - DNA, 20 bp, human
gctcccggagcggtccccgg

SEQ ID NO: 137235 - DNA, 20 bp, human
gccaagcgctccagacggcc

SEQ ID NO: 137236 - DNA, 20 bp, human
gagccgcagctaaaagccgg

SEQ ID NO: 137237 - DNA, 20 bp, human
gggcagccgcagctaaaagc

SEQ ID NO: 137238 - DNA, 20 bp, human
gcggctgcccagggcgaagt

SEQ ID NO: 137239 - DNA, 20 bp, human
gggcgtcatggagcccatag

SEQ ID NO: 137240 - DNA, 20 bp, human
gaaaggagcgcgcgcggcag

SEQ ID NO: 137241 - DNA, 20 bp, human
gtcggcccgagcaagtccag

SEQ ID NO: 137242 - DNA, 20 bp, human
gaacaggcggtggcactggg

SEQ ID NO: 137243 - DNA, 20 bp, human
gtgcacacaggggaccaccg

SEQ ID NO: 137244 - DNA, 20 bp, human
gccccgaggcgagtcgcccc

SEQ ID NO: 137245 - DNA, 20 bp, human
gagacaacgtagttccactt

SEQ ID NO: 137246 - DNA, 20 bp, human
gcaccgctcgcgggacagtc

SEQ ID NO: 137247 - DNA, 20 bp, human
ggggtccctacgcagaccag

SEQ ID NO: 137248 - DNA, 20 bp, human
gccggtagctaactccagtt

SEQ ID NO: 137249 - DNA, 20 bp, human
gccagtttggtcggtttcat

SEQ ID NO: 137250 - DNA, 20 bp, human
gtaccggactgtcccgcgag

SEQ ID NO: 137251 - DNA, 20 bp, human
gtccctacgcagaccagcgg

SEQ ID NO: 137252 - DNA, 20 bp, human
gtagctaactccagtttggt

SEQ ID NO: 137253 - DNA, 20 bp, human
gactgagcctgtggcctaag

SEQ ID NO: 137254 - DNA, 20 bp, human
gaccgccgctggtctgcgta

SEQ ID NO: 137255 - DNA, 20 bp, human
gtccagatgctctaaatcac

SEQ ID NO: 137256 - DNA, 20 bp, human
gggctccgcagggtagacga

SEQ ID NO: 137257 - DNA, 20 bp, human
ggacgcaccaaacaccccta

SEQ ID NO: 137258 - DNA, 20 bp, human
ggcagacggagtggacgtct

SEQ ID NO: 137259 - DNA, 20 bp, human
gcccgcgctaagggttgcta

SEQ ID NO: 137260 - DNA, 20 bp, human
gcagccagcgaggctcgcag

SEQ ID NO: 137261 - DNA, 20 bp, human
ggcgaggctcgcagaggtca

SEQ ID NO: 137262 - DNA, 20 bp, human
gtccgagcgtcaagagaagg

SEQ ID NO: 137263 - DNA, 20 bp, human
gccccgcccgtcaatctcag

SEQ ID NO: 137264 - DNA, 20 bp, human
gtgaaccaaggagcagactc

SEQ ID NO: 137265 - DNA, 20 bp, human
ggaggagccaaaggaataat

SEQ ID NO: 137266 - DNA, 20 bp, human
gggttgggcagtcgaacagc

SEQ ID NO: 137267 - DNA, 20 bp, human
gtggcggcagccgcgaactc

SEQ ID NO: 137268 - DNA, 20 bp, human
gtagggcgcgccaaatggga

SEQ ID NO: 137269 - DNA, 20 bp, human
gaggctagagccggagttcg

SEQ ID NO: 137270 - DNA, 20 bp, human
gtgggcagtcgaacagcggg

SEQ ID NO: 137271 - DNA, 20 bp, human
gaggcactcagtcaagagtt

SEQ ID NO: 137272 - DNA, 20 bp, human
ggagcgcgctcgggacgtac

SEQ ID NO: 137273 - DNA, 20 bp, human
ggcgctcgggacgtacagga

SEQ ID NO: 137274 - DNA, 20 bp, human
gtgcttagggcgcgccaaat

SEQ ID NO: 137275 - DNA, 20 bp, human
gcaggaactgaagaaacccg

SEQ ID NO: 137276 - DNA, 20 bp, human
gagcccggcagcaaaatccc

SEQ ID NO: 137277 - DNA, 20 bp, human
gcgggttgcggtgtacccag

SEQ ID NO: 137278 - DNA, 20 bp, human
gcgccccacggtggacgcgg

SEQ ID NO: 137279 - DNA, 20 bp, human
ggctgatgggattaactcta

SEQ ID NO: 137280 - DNA, 20 bp, human
gagccgccgcgtccaccgtg

SEQ ID NO: 137281 - DNA, 20 bp, human
ggcctctggcggccaaggaa

SEQ ID NO: 137282 - DNA, 20 bp, human
gaatcccatcagccgaggtg

SEQ ID NO: 137283 - DNA, 20 bp, human
gcgcgctgcgccgtgaggag

SEQ ID NO: 137284 - DNA, 20 bp, human
gcctcacggcgcagcgcgta

SEQ ID NO: 137285 - DNA, 20 bp, human
gcacggcgcagcgcgtaggg

SEQ ID NO: 137286 - DNA, 20 bp, human
ggcggctgccggagaccgag

SEQ ID NO: 137287 - DNA, 20 bp, human
gccagcggcggctgcgagaa

SEQ ID NO: 137288 - DNA, 20 bp, human
gctccaagcgccctgtgtgt

SEQ ID NO: 137289 - DNA, 20 bp, human
gagggcagccgctcggtctc

SEQ ID NO: 137290 - DNA, 20 bp, human
gggggaggcgacccacacac

SEQ ID NO: 137291 - DNA, 20 bp, human
gagagaaagaccgaggctcg

SEQ ID NO: 137292 - DNA, 20 bp, human
gtctccggcagccgccgctc

SEQ ID NO: 137293 - DNA, 20 bp, human
gggcccgacgaggcacccaa

SEQ ID NO: 137294 - DNA, 20 bp, human
gtctggctttgcccgagcgg

SEQ ID NO: 137295 - DNA, 20 bp, human
gccgataaaagaaaccccga

SEQ ID NO: 137296 - DNA, 20 bp, human
ggagcctcagcgagcggagg

SEQ ID NO: 137297 - DNA, 20 bp, human
gctggagcctcagcgagcgg

SEQ ID NO: 137298 - DNA, 20 bp, human
ggctctggagcctcagcgag

SEQ ID NO: 137299 - DNA, 20 bp, human
gggccgacggccgagtactg

SEQ ID NO: 137300 - DNA, 20 bp, human
gagagctcggctctctgtaa

SEQ ID NO: 137301 - DNA, 20 bp, human
gagccgccgccggccaggat

SEQ ID NO: 137302 - DNA, 20 bp, human
gagcccaggagtcgagtgaa

SEQ ID NO: 137303 - DNA, 20 bp, human
ggccttggcgccagacgagg

SEQ ID NO: 137304 - DNA, 20 bp, human
gccgtgaggagggtgcaaca

SEQ ID NO: 137305 - DNA, 20 bp, human
ggagcccgccgaggaaaagg

SEQ ID NO: 137306 - DNA, 20 bp, human
ggcgtgaggcgggcctgaag

SEQ ID NO: 137307 - DNA, 20 bp, human
gggagaggccggtaggcgtg

SEQ ID NO: 137308 - DNA, 20 bp, human
gaagacaagtcgggagaggc

SEQ ID NO: 137309 - DNA, 20 bp, human
ggggaggactgagccgggta

SEQ ID NO: 137310 - DNA, 20 bp, human
gaggcccgcctcacgcctac

SEQ ID NO: 137311 - DNA, 20 bp, human
ggggaaagacaagtcgggag

SEQ ID NO: 137312 - DNA, 20 bp, human
ggaggccggtaggcgtgagg

SEQ ID NO: 137313 - DNA, 20 bp, human
gcgtcgccaggtcccacagg

SEQ ID NO: 137314 - DNA, 20 bp, human
ggctgaacgagaaccaagtg

SEQ ID NO: 137315 - DNA, 20 bp, human
gtggcggcccgatcccgatg

SEQ ID NO: 137316 - DNA, 20 bp, human
gtccctttcctgtcagactg

SEQ ID NO: 137317 - DNA, 20 bp, human
gagacgcggaggggtacctg

SEQ ID NO: 137318 - DNA, 20 bp, human
gggccgcagtctgacaggaa

SEQ ID NO: 137319 - DNA, 20 bp, human
ggcgctggccgcagtctgac

SEQ ID NO: 137320 - DNA, 20 bp, human
gtccccaagaggccattcag

SEQ ID NO: 137321 - DNA, 20 bp, human
gcagcgctgtgctgaaacgt

SEQ ID NO: 137322 - DNA, 20 bp, human
gcagaggccgccgccaatca

SEQ ID NO: 137323 - DNA, 20 bp, human
gggcggtccgcggtcctggg

SEQ ID NO: 137324 - DNA, 20 bp, human
ggaaagggacggagccaaga

SEQ ID NO: 137325 - DNA, 20 bp, human
ggctgtgctgaaacgtgggg

SEQ ID NO: 137326 - DNA, 20 bp, human
ggcagccgcaccgagtccta

SEQ ID NO: 137327 - DNA, 20 bp, human
gcgcaccgagtcctagggag

SEQ ID NO: 137328 - DNA, 20 bp, human
gaaactcacctgctcgtcag

SEQ ID NO: 137329 - DNA, 20 bp, human
ggccgcagcctccaagctgg

SEQ ID NO: 137330 - DNA, 20 bp, human
gcagaaggacgggagagcag

SEQ ID NO: 137331 - DNA, 20 bp, human
gcacctgctcgtcagaggcc

SEQ ID NO: 137332 - DNA, 20 bp, human
gcagcggcctggcgcagagt

SEQ ID NO: 137333 - DNA, 20 bp, human
gcaggaaccaccagaaggac

SEQ ID NO: 137334 - DNA, 20 bp, human
ggtgtcagtgtccccaccag

SEQ ID NO: 137335 - DNA, 20 bp, human
gggacactgacactctcaga

SEQ ID NO: 137336 - DNA, 20 bp, human
ggcgcatcagagctcgggac

SEQ ID NO: 137337 - DNA, 20 bp, human
ggtccgcctgagtcttaaga

SEQ ID NO: 137338 - DNA, 20 bp, human
gcccgacaaccgcccgggaa

SEQ ID NO: 137339 - DNA, 20 bp, human
gggcgggcgcatcagagctc

SEQ ID NO: 137340 - DNA, 20 bp, human
gaagagacgcggccacctca

SEQ ID NO: 137341 - DNA, 20 bp, human
gactagagaggtacccggga

SEQ ID NO: 137342 - DNA, 20 bp, human
gggttccccgacaaccgccc

SEQ ID NO: 137343 - DNA, 20 bp, human
gctggtcgcgtggtagagaa

SEQ ID NO: 137344 - DNA, 20 bp, human
gggaggcggtgaccagcagc

SEQ ID NO: 137345 - DNA, 20 bp, human
gctccctcgcccaagagacg

SEQ ID NO: 137346 - DNA, 20 bp, human
gcggagaaagagcacgagcg

SEQ ID NO: 137347 - DNA, 20 bp, human
ggcgactacgacagcgacgg

SEQ ID NO: 137348 - DNA, 20 bp, human
gcccgggaggcaagtggtca

SEQ ID NO: 137349 - DNA, 20 bp, human
ggagtagggtccagaggggt

SEQ ID NO: 137350 - DNA, 20 bp, human
gcgcctcgcgcagagccaca

SEQ ID NO: 137351 - DNA, 20 bp, human
gttgagggagtagggtccag

SEQ ID NO: 137352 - DNA, 20 bp, human
gctactccctcaaacccgag

SEQ ID NO: 137353 - DNA, 20 bp, human
gcccctcacctggggatggg

SEQ ID NO: 137354 - DNA, 20 bp, human
ggagccacagggcgcccctc

SEQ ID NO: 137355 - DNA, 20 bp, human
gcgtgctctttctccggcag

SEQ ID NO: 137356 - DNA, 20 bp, human
ggcgggggtagggaagctgg

SEQ ID NO: 137357 - DNA, 20 bp, human
gggcgtatcttggcacccgg

SEQ ID NO: 137358 - DNA, 20 bp, human
gtcttggcacccggaggcag

SEQ ID NO: 137359 - DNA, 20 bp, human
gctcggggcacggcgtatct

SEQ ID NO: 137360 - DNA, 20 bp, human
gtggagcggctgccaaggag

SEQ ID NO: 137361 - DNA, 20 bp, human
gcagcctcgcagaacccgag

SEQ ID NO: 137362 - DNA, 20 bp, human
ggggtgctggtcccacggga

SEQ ID NO: 137363 - DNA, 20 bp, human
gcggctgcccgctctcccag

SEQ ID NO: 137364 - DNA, 20 bp, human
gccgagctgcagtggcgaga

SEQ ID NO: 137365 - DNA, 20 bp, human
gcgggcgggaccagacccct

SEQ ID NO: 137366 - DNA, 20 bp, human
ggaccctagtgagtcctgag

SEQ ID NO: 137367 - DNA, 20 bp, human
ggtcctctcaggactcacta

SEQ ID NO: 137368 - DNA, 20 bp, human
gtcctggcctggtcaaacgg

SEQ ID NO: 137369 - DNA, 20 bp, human
gagtgattcacagcaggacg

SEQ ID NO: 137370 - DNA, 20 bp, human
ggcagactgaccgtcctctc

SEQ ID NO: 137371 - DNA, 20 bp, human
gtctctgacgagatgatacc

SEQ ID NO: 137372 - DNA, 20 bp, human
gttcagtgccgctcattggt

SEQ ID NO: 137373 - DNA, 20 bp, human
gactcacccaggacacacta

SEQ ID NO: 137374 - DNA, 20 bp, human
gtggtcctggcctggtcaaa

SEQ ID NO: 137375 - DNA, 20 bp, human
gttgcattctaggctagaaa

SEQ ID NO: 137376 - DNA, 20 bp, human
gtcgccgcagccaggcgcac

SEQ ID NO: 137377 - DNA, 20 bp, human
gccccgaagggagggcatcg

SEQ ID NO: 137378 - DNA, 20 bp, human
gggctcggccccggcttggt

SEQ ID NO: 137379 - DNA, 20 bp, human
gtgccgccgcagcctagcag

SEQ ID NO: 137380 - DNA, 20 bp, human
gcacatagctgtggtcccgc

SEQ ID NO: 137381 - DNA, 20 bp, human
gcaccgggcacggccttcaa

SEQ ID NO: 137382 - DNA, 20 bp, human
gaccacagctatgtgactga

SEQ ID NO: 137383 - DNA, 20 bp, human
gcgctgcgccgaccaagccg

SEQ ID NO: 137384 - DNA, 20 bp, human
ggctgcgtccgtgcgcccgg

SEQ ID NO: 137385 - DNA, 20 bp, human
gccttcaatgggcgaggaca

SEQ ID NO: 137386 - DNA, 20 bp, human
gatctagggtagcaagtgat

SEQ ID NO: 137387 - DNA, 20 bp, human
gggggagggtaagttatcta

SEQ ID NO: 137388 - DNA, 20 bp, human
ggagtactggtattagaaag

SEQ ID NO: 137389 - DNA, 20 bp, human
ggtaagaattgtgttctaag

SEQ ID NO: 137390 - DNA, 20 bp, human
gagcggtgtggtcctatatt

SEQ ID NO: 137391 - DNA, 20 bp, human
gaatgagcagcattctgttg

SEQ ID NO: 137392 - DNA, 20 bp, human
gtcttttcatatggagaatg

SEQ ID NO: 137393 - DNA, 20 bp, human
gctggtattagaaagcggtg

SEQ ID NO: 137394 - DNA, 20 bp, human
gtattgggttataagctatg

SEQ ID NO: 137395 - DNA, 20 bp, human
ggcataataaagtgcacgtg

SEQ ID NO: 137396 - DNA, 20 bp, human
ggactctcgggctacgaatg

SEQ ID NO: 137397 - DNA, 20 bp, human
gttgcctccaagcctccccg

SEQ ID NO: 137398 - DNA, 20 bp, human
gccccgcggcgcggactctc

SEQ ID NO: 137399 - DNA, 20 bp, human
gtcctccgcgggcgcccctg

SEQ ID NO: 137400 - DNA, 20 bp, human
ggagccgcgggcaacgaggt

SEQ ID NO: 137401 - DNA, 20 bp, human
ggcgccgcggggaggcttgg

SEQ ID NO: 137402 - DNA, 20 bp, human
gggagccctgaaaagtggga

SEQ ID NO: 137403 - DNA, 20 bp, human
ggaatgcggcgcgtgaagag

SEQ ID NO: 137404 - DNA, 20 bp, human
gtgcggcgcgtgaagagcgg

SEQ ID NO: 137405 - DNA, 20 bp, human
gggaggagccgcgggcaacg

SEQ ID NO: 137406 - DNA, 20 bp, human
ggtccggcccgcgctgctca

SEQ ID NO: 137407 - DNA, 20 bp, human
gctcagggcagcttcaaaac

SEQ ID NO: 137408 - DNA, 20 bp, human
gccgcccgggcgccttgatc

SEQ ID NO: 137409 - DNA, 20 bp, human
gccggccgcgctcccaaaca

SEQ ID NO: 137410 - DNA, 20 bp, human
gttagaggcgcggcccatgg

SEQ ID NO: 137411 - DNA, 20 bp, human
ggacgcagtgacgtgaacgc

SEQ ID NO: 137412 - DNA, 20 bp, human
gccagcgggctcgaaccccc

SEQ ID NO: 137413 - DNA, 20 bp, human
ggcgggaccagccgaccccg

SEQ ID NO: 137414 - DNA, 20 bp, human
gggccgtgctcgcatcaccg

SEQ ID NO: 137415 - DNA, 20 bp, human
gcagccggtcctgaagatga

SEQ ID NO: 137416 - DNA, 20 bp, human
gtgctgacgcctgagctggt

SEQ ID NO: 137417 - DNA, 20 bp, human
gcgccaaaggcacacgataa

SEQ ID NO: 137418 - DNA, 20 bp, human
gcccgacaaaggaggcggag

SEQ ID NO: 137419 - DNA, 20 bp, human
gggaggacaattataggtcc

SEQ ID NO: 137420 - DNA, 20 bp, human
gtagggccgggccatcccaa

SEQ ID NO: 137421 - DNA, 20 bp, human
gttcctggggcagaatctag

SEQ ID NO: 137422 - DNA, 20 bp, human
gaatataaaatggattacga

SEQ ID NO: 137423 - DNA, 20 bp, human
gagcgtgacagtaaaaaggc

SEQ ID NO: 137424 - DNA, 20 bp, human
gcccggccctaaactcctag

SEQ ID NO: 137425 - DNA, 20 bp, human
gtgaaacctcccgacaaagg

SEQ ID NO: 137426 - DNA, 20 bp, human
gtgagcgccccgcaccgaca

SEQ ID NO: 137427 - DNA, 20 bp, human
gcagggagcaagcctattaa

SEQ ID NO: 137428 - DNA, 20 bp, human
gggctgcccgaatgctgggt

SEQ ID NO: 137429 - DNA, 20 bp, human
gggactgcaagcatccgggt

SEQ ID NO: 137430 - DNA, 20 bp, human
gaccaggggctgcaaagggg

SEQ ID NO: 137431 - DNA, 20 bp, human
gggcagcgccgtggtcataa

SEQ ID NO: 137432 - DNA, 20 bp, human
ggcgaagacggccgccatgt

SEQ ID NO: 137433 - DNA, 20 bp, human
gatggcggccgtcttcgctg

SEQ ID NO: 137434 - DNA, 20 bp, human
gccccgccggccttacctgg

SEQ ID NO: 137435 - DNA, 20 bp, human
gaagctgaggggccccgagg

SEQ ID NO: 137436 - DNA, 20 bp, human
gcggccggccagcacctcag

SEQ ID NO: 137437 - DNA, 20 bp, human
gatggcagcgccctgagagg

SEQ ID NO: 137438 - DNA, 20 bp, human
ggccgcccacggagaacccc

SEQ ID NO: 137439 - DNA, 20 bp, human
gagctcccggggctgacgga

SEQ ID NO: 137440 - DNA, 20 bp, human
gctcgcctggggttctccgt

SEQ ID NO: 137441 - DNA, 20 bp, human
ggcgatggcagcgccctgag

SEQ ID NO: 137442 - DNA, 20 bp, human
gccaccttctcaagttgtag

SEQ ID NO: 137443 - DNA, 20 bp, human
gtctgggcgcgcagagcggg

SEQ ID NO: 137444 - DNA, 20 bp, human
gcgaccgctacaacttgaga

SEQ ID NO: 137445 - DNA, 20 bp, human
gcagcgccccgggcgatgag

SEQ ID NO: 137446 - DNA, 20 bp, human
gctgggactccgacccaacg

SEQ ID NO: 137447 - DNA, 20 bp, human
gggctcggctccgtgcgcac

SEQ ID NO: 137448 - DNA, 20 bp, human
gggatctccgctgaagtcct

SEQ ID NO: 137449 - DNA, 20 bp, human
gccaacgcggtgcagcgcaa

SEQ ID NO: 137450 - DNA, 20 bp, human
gccaggttctaggagcgggg

SEQ ID NO: 137451 - DNA, 20 bp, human
ggttcagggccccttcgcag

SEQ ID NO: 137452 - DNA, 20 bp, human
gcggccgtcgccctccctac

SEQ ID NO: 137453 - DNA, 20 bp, human
gggacagcacctccagtctt

SEQ ID NO: 137454 - DNA, 20 bp, human
ggggtgccaggttctaggag

SEQ ID NO: 137455 - DNA, 20 bp, human
gctggccccccaaacctcat

SEQ ID NO: 137456 - DNA, 20 bp, human
gtcgtagaagccttccccag

SEQ ID NO: 137457 - DNA, 20 bp, human
gatgcccccctgcttaaagg

SEQ ID NO: 137458 - DNA, 20 bp, human
gctgcctcctttaagcaggg

SEQ ID NO: 137459 - DNA, 20 bp, human
ggatcttaagcgcgcatctg

SEQ ID NO: 137460 - DNA, 20 bp, human
ggtgcctaaggcctgaccga

SEQ ID NO: 137461 - DNA, 20 bp, human
ggcactgagtttactcctct

SEQ ID NO: 137462 - DNA, 20 bp, human
gggctctgaatccatcacca

SEQ ID NO: 137463 - DNA, 20 bp, human
ggagtttactcctctgggga

SEQ ID NO: 137464 - DNA, 20 bp, human
gagcattccggggtgaggag

SEQ ID NO: 137465 - DNA, 20 bp, human
gtagtcctaaaatcaaagaa

SEQ ID NO: 137466 - DNA, 20 bp, human
gtggatgcggccaactccaa

SEQ ID NO: 137467 - DNA, 20 bp, human
ggaaggaccacgggctggaa

SEQ ID NO: 137468 - DNA, 20 bp, human
gaaaggcaatgggctcctta

SEQ ID NO: 137469 - DNA, 20 bp, human
gcttcagcgggaaaggcaat

SEQ ID NO: 137470 - DNA, 20 bp, human
gcactgcccagggaaggtat

SEQ ID NO: 137471 - DNA, 20 bp, human
gcccacccaataccttccct

SEQ ID NO: 137472 - DNA, 20 bp, human
ggtcaacatctagacttcag

SEQ ID NO: 137473 - DNA, 20 bp, human
ggcccagggaaggtattggg

SEQ ID NO: 137474 - DNA, 20 bp, human
gatctagacttcagcgggaa

SEQ ID NO: 137475 - DNA, 20 bp, human
gctgaatcggaaccttccgt

SEQ ID NO: 137476 - DNA, 20 bp, human
gaggctccaaggcggcggtg

SEQ ID NO: 137477 - DNA, 20 bp, human
ggcaggagacgggccgggtc

SEQ ID NO: 137478 - DNA, 20 bp, human
gcgcaggcaccgctcgaccc

SEQ ID NO: 137479 - DNA, 20 bp, human
ggcgctgcgcccgggtcgag

SEQ ID NO: 137480 - DNA, 20 bp, human
gggaagaaggaggttaccct

SEQ ID NO: 137481 - DNA, 20 bp, human
gaggagttcgggccaattgg

SEQ ID NO: 137482 - DNA, 20 bp, human
ggagtgcggccgagcaaagc

SEQ ID NO: 137483 - DNA, 20 bp, human
ggtggcgaagagacgccgag

SEQ ID NO: 137484 - DNA, 20 bp, human
gtggacgggagggtcagtct

SEQ ID NO: 137485 - DNA, 20 bp, human
ggcctgcgcggagctctggg

SEQ ID NO: 137486 - DNA, 20 bp, human
gcaccgggcggctgagtcca

SEQ ID NO: 137487 - DNA, 20 bp, human
ggcccggtgatattgacaat

SEQ ID NO: 137488 - DNA, 20 bp, human
gccgccgccgcggaaccgga

SEQ ID NO: 137489 - DNA, 20 bp, human
gaaccggagggaccccgtac

SEQ ID NO: 137490 - DNA, 20 bp, human
ggtccggccgtgaggcctag

SEQ ID NO: 137491 - DNA, 20 bp, human
gattgactgggacccaccgc

SEQ ID NO: 137492 - DNA, 20 bp, human
gagagaaaggggcattgact

SEQ ID NO: 137493 - DNA, 20 bp, human
gacccaccgcgggtagcgaa

SEQ ID NO: 137494 - DNA, 20 bp, human
ggggcgacggctgtccggta

SEQ ID NO: 137495 - DNA, 20 bp, human
gcgccgccaccggaacgctg

SEQ ID NO: 137496 - DNA, 20 bp, human
ggccgctcctccactcacca

SEQ ID NO: 137497 - DNA, 20 bp, human
gctgtgtctgccgagctcgg

SEQ ID NO: 137498 - DNA, 20 bp, human
gaggcgagcgcgggcgatcg

SEQ ID NO: 137499 - DNA, 20 bp, human
ggaataaaagaagaaccggg

SEQ ID NO: 137500 - DNA, 20 bp, human
gcggctggtggcactgacat

SEQ ID NO: 137501 - DNA, 20 bp, human
ggcggctgtgccttggtgag

SEQ ID NO: 137502 - DNA, 20 bp, human
gggactgtgtctgccgagct

SEQ ID NO: 137503 - DNA, 20 bp, human
gcgcgcagcccggagcgagt

SEQ ID NO: 137504 - DNA, 20 bp, human
gaaggcacagccgccgagct

SEQ ID NO: 137505 - DNA, 20 bp, human
gaccgctcggctggaggtct

SEQ ID NO: 137506 - DNA, 20 bp, human
ggctaacagcctcacccctt

SEQ ID NO: 137507 - DNA, 20 bp, human
gggtccgccatgttccccgg

SEQ ID NO: 137508 - DNA, 20 bp, human
gcctacagaggggctaagac

SEQ ID NO: 137509 - DNA, 20 bp, human
ggggctgaccgcgtcgtcaa

SEQ ID NO: 137510 - DNA, 20 bp, human
ggcggcgccgccggggaaca

SEQ ID NO: 137511 - DNA, 20 bp, human
gccgtggcttcctagcccaa

SEQ ID NO: 137512 - DNA, 20 bp, human
gccgcgtcgtcaaaggtgag

SEQ ID NO: 137513 - DNA, 20 bp, human
gccccggcctgaaagcaacc

SEQ ID NO: 137514 - DNA, 20 bp, human
ggaaagcaaccgggagaccg

SEQ ID NO: 137515 - DNA, 20 bp, human
gggaagcaaaacctccgccc

SEQ ID NO: 137516 - DNA, 20 bp, human
gccgcgaccgctgctaaggg

SEQ ID NO: 137517 - DNA, 20 bp, human
gcgaccgcgaccgctgctaa

SEQ ID NO: 137518 - DNA, 20 bp, human
gctccgagccctcctagggt

SEQ ID NO: 137519 - DNA, 20 bp, human
gctaagggtggcgaccggga

SEQ ID NO: 137520 - DNA, 20 bp, human
gtgggaggcgccagcggcta

SEQ ID NO: 137521 - DNA, 20 bp, human
gcgtttcccgcgggtcccag

SEQ ID NO: 137522 - DNA, 20 bp, human
gacccctccgagccctccta

SEQ ID NO: 137523 - DNA, 20 bp, human
gggctgcgcccaccctagga

SEQ ID NO: 137524 - DNA, 20 bp, human
gggcgccagcggctaaggcg

SEQ ID NO: 137525 - DNA, 20 bp, human
ggctgctaagggtggcgacc

SEQ ID NO: 137526 - DNA, 20 bp, human
ggcgctgacccgcaacctca

SEQ ID NO: 137527 - DNA, 20 bp, human
gagacggccgggaaactcgg

SEQ ID NO: 137528 - DNA, 20 bp, human
gccgcacccgacccggacgg

SEQ ID NO: 137529 - DNA, 20 bp, human
gcgtgacggactcactgcag

SEQ ID NO: 137530 - DNA, 20 bp, human
gcccggacggcggcagtagg

SEQ ID NO: 137531 - DNA, 20 bp, human
gtggtgcatcgaggaagcca

SEQ ID NO: 137532 - DNA, 20 bp, human
ggccgacccgccgagcaaaa

SEQ ID NO: 137533 - DNA, 20 bp, human
gcccccgcacccgacccgga

SEQ ID NO: 137534 - DNA, 20 bp, human
gcctcaaggcacgaaaaaag

SEQ ID NO: 137535 - DNA, 20 bp, human
ggctggctcgcaggaaacgg

SEQ ID NO: 137536 - DNA, 20 bp, human
gcggccacggctcaaagggt

SEQ ID NO: 137537 - DNA, 20 bp, human
gaacgaggccagttacccgg

SEQ ID NO: 137538 - DNA, 20 bp, human
gatgtccacaatgggaaacg

SEQ ID NO: 137539 - DNA, 20 bp, human
ggggcaacaacctgacggac

SEQ ID NO: 137540 - DNA, 20 bp, human
gggaaacgaggccagttacc

SEQ ID NO: 137541 - DNA, 20 bp, human
gcggctcaaagggtcggaga

SEQ ID NO: 137542 - DNA, 20 bp, human
ggcaacggccacggctcaaa

SEQ ID NO: 137543 - DNA, 20 bp, human
gatggtgggcaacaacctga

SEQ ID NO: 137544 - DNA, 20 bp, human
gacctggaagagctccccgt

SEQ ID NO: 137545 - DNA, 20 bp, human
ggagctgcgccacaacccgt

SEQ ID NO: 137546 - DNA, 20 bp, human
gggagatcagcgacctggac

SEQ ID NO: 137547 - DNA, 20 bp, human
gcggcggcggcggtcgaaag

SEQ ID NO: 137548 - DNA, 20 bp, human
ggcggggccggaagtaggag

SEQ ID NO: 137549 - DNA, 20 bp, human
gtcgaaagcggagtgaaaga

SEQ ID NO: 137550 - DNA, 20 bp, human
gcgtcgctgcgagctcatca

SEQ ID NO: 137551 - DNA, 20 bp, human
gaggcagggagccggagagc

SEQ ID NO: 137552 - DNA, 20 bp, human
gccggcgcgggtcagagtcg

SEQ ID NO: 137553 - DNA, 20 bp, human
ggtcaaggccctgtgcgcta

SEQ ID NO: 137554 - DNA, 20 bp, human
ggactccggttccggctctc

SEQ ID NO: 137555 - DNA, 20 bp, human
gctgctcgatctgccggtcc

SEQ ID NO: 137556 - DNA, 20 bp, human
ggccgccgcccggagaacag

SEQ ID NO: 137557 - DNA, 20 bp, human
gtggctggctgaggggacgg

SEQ ID NO: 137558 - DNA, 20 bp, human
gccggcccggcagccactca

SEQ ID NO: 137559 - DNA, 20 bp, human
gccctcccccagcggaacct

SEQ ID NO: 137560 - DNA, 20 bp, human
gggggcgaccacaagatggc

SEQ ID NO: 137561 - DNA, 20 bp, human
gcgcgcgtccaccggctccc

SEQ ID NO: 137562 - DNA, 20 bp, human
ggcgccgctccatgtagccc

SEQ ID NO: 137563 - DNA, 20 bp, human
ggtcctcctgaagcagcgag

SEQ ID NO: 137564 - DNA, 20 bp, human
ggcggtggcctggcagtccg

SEQ ID NO: 137565 - DNA, 20 bp, human
gtggccccctgttctccggg

SEQ ID NO: 137566 - DNA, 20 bp, human
gtccaggaggcgctgaaagg

SEQ ID NO: 137567 - DNA, 20 bp, human
gtcccttcgtttcccccccc

SEQ ID NO: 137568 - DNA, 20 bp, human
gaccgggggggggaaacgaa

SEQ ID NO: 137569 - DNA, 20 bp, human
gccggcacgcaggcgaccgg

SEQ ID NO: 137570 - DNA, 20 bp, human
gactcgtcccctgaacgggt

SEQ ID NO: 137571 - DNA, 20 bp, human
gcccccagcccagacgccgg

SEQ ID NO: 137572 - DNA, 20 bp, human
ggcgggagagagctgcccac

SEQ ID NO: 137573 - DNA, 20 bp, human
ggtgcgcgcggtgacgtacc

SEQ ID NO: 137574 - DNA, 20 bp, human
gtggagaaaagaggatatct

SEQ ID NO: 137575 - DNA, 20 bp, human
gcgccactcgtcccctgaac

SEQ ID NO: 137576 - DNA, 20 bp, human
ggcctcacgctcggctccag

SEQ ID NO: 137577 - DNA, 20 bp, human
ggaactggcttagggcgaca

SEQ ID NO: 137578 - DNA, 20 bp, human
gtctgaggaagggtccgaga

SEQ ID NO: 137579 - DNA, 20 bp, human
gcgcctggcagcctcacgct

SEQ ID NO: 137580 - DNA, 20 bp, human
gggcgacacggcaagagggg

SEQ ID NO: 137581 - DNA, 20 bp, human
ggccgctggagccgagcgtg

SEQ ID NO: 137582 - DNA, 20 bp, human
ggaggacccggtccgctctg

SEQ ID NO: 137583 - DNA, 20 bp, human
gccgactgagagggtcccgg

SEQ ID NO: 137584 - DNA, 20 bp, human
ggaagggtccgagagggaac

SEQ ID NO: 137585 - DNA, 20 bp, human
gcgggagcaagagcacggcc

SEQ ID NO: 137586 - DNA, 20 bp, human
gcggagcgggtgctactcag

SEQ ID NO: 137587 - DNA, 20 bp, human
ggagggcgccaccaattgtg

SEQ ID NO: 137588 - DNA, 20 bp, human
gggcggccgttgccagggta

SEQ ID NO: 137589 - DNA, 20 bp, human
gctactcagtggagagactg

SEQ ID NO: 137590 - DNA, 20 bp, human
gccaaacgtgaggcctgtag

SEQ ID NO: 137591 - DNA, 20 bp, human
ggagggcgctaccaaacgtg

SEQ ID NO: 137592 - DNA, 20 bp, human
gcgcaaagcgacccctaccc

SEQ ID NO: 137593 - DNA, 20 bp, human
ggcctgtagagggcgctacc

SEQ ID NO: 137594 - DNA, 20 bp, human
gtcagagctccatcagccgg

SEQ ID NO: 137595 - DNA, 20 bp, human
gcgctccgcacgccactcct

SEQ ID NO: 137596 - DNA, 20 bp, human
ggcgagccactgcaaggtgg

SEQ ID NO: 137597 - DNA, 20 bp, human
gacccaccaccaccttgcag

SEQ ID NO: 137598 - DNA, 20 bp, human
gtgggtaagtctgaactctg

SEQ ID NO: 137599 - DNA, 20 bp, human
gggggcgagccactgcaagg

SEQ ID NO: 137600 - DNA, 20 bp, human
gcctccaaaggcccagttag

SEQ ID NO: 137601 - DNA, 20 bp, human
gcctgcaatgcgtcaaactg

SEQ ID NO: 137602 - DNA, 20 bp, human
gtaagacgcactcagccggt

SEQ ID NO: 137603 - DNA, 20 bp, human
gaggacagcctgtgggaacg

SEQ ID NO: 137604 - DNA, 20 bp, human
ggccggtgggcgggacccct

SEQ ID NO: 137605 - DNA, 20 bp, human
gggtgccacctaacgctcag

SEQ ID NO: 137606 - DNA, 20 bp, human
gtaacaagccgcggcaacag

SEQ ID NO: 137607 - DNA, 20 bp, human
ggcagcccgaaggccagaag

SEQ ID NO: 137608 - DNA, 20 bp, human
gtccgactgcgggagaccca

SEQ ID NO: 137609 - DNA, 20 bp, human
gcgtgacgcagggaaagttc

SEQ ID NO: 137610 - DNA, 20 bp, human
gtgtcgcggcctctgtccca

SEQ ID NO: 137611 - DNA, 20 bp, human
gcgcgactggactggatacc

SEQ ID NO: 137612 - DNA, 20 bp, human
gagaggccgcgacatccctc

SEQ ID NO: 137613 - DNA, 20 bp, human
gctgcgcaggcgccactcac

SEQ ID NO: 137614 - DNA, 20 bp, human
gggccagaaggggcgaccct

SEQ ID NO: 137615 - DNA, 20 bp, human
gggcgccccacagccggaag

SEQ ID NO: 137616 - DNA, 20 bp, human
ggcctcagccgggaagacgg

SEQ ID NO: 137617 - DNA, 20 bp, human
ggcagagcccggagattgag

SEQ ID NO: 137618 - DNA, 20 bp, human
gcgcggagaggggaagacgt

SEQ ID NO: 137619 - DNA, 20 bp, human
gcgggtcctgcagagttgag

SEQ ID NO: 137620 - DNA, 20 bp, human
gcctgcgctagggggattgt

SEQ ID NO: 137621 - DNA, 20 bp, human
gtcgcactcggggctcatcg

SEQ ID NO: 137622 - DNA, 20 bp, human
gtagggggattgtgggatag

SEQ ID NO: 137623 - DNA, 20 bp, human
ggggcgtcactagtccgcgt

SEQ ID NO: 137624 - DNA, 20 bp, human
gccgtggagaggaaacccga

SEQ ID NO: 137625 - DNA, 20 bp, human
ggattgtgggatagtggcgg

SEQ ID NO: 137626 - DNA, 20 bp, human
ggcggctcgagaccgactcg

SEQ ID NO: 137627 - DNA, 20 bp, human
ggcgcagcgcctacggacac

SEQ ID NO: 137628 - DNA, 20 bp, human
gagagggtgcactaactggg

SEQ ID NO: 137629 - DNA, 20 bp, human
gcggccgtgccggtgtccgt

SEQ ID NO: 137630 - DNA, 20 bp, human
gaccgactcggggccgcggg

SEQ ID NO: 137631 - DNA, 20 bp, human
ggccgcccgcggccccgagt

SEQ ID NO: 137632 - DNA, 20 bp, human
ggcgcctacggacaccggca

SEQ ID NO: 137633 - DNA, 20 bp, human
gtccgatcgctccaaaatgg

SEQ ID NO: 137634 - DNA, 20 bp, human
gactagagggtgcactaact

SEQ ID NO: 137635 - DNA, 20 bp, human
ggggcgggccgcacacacat

SEQ ID NO: 137636 - DNA, 20 bp, human
gcccgcctgagcgcaactag

SEQ ID NO: 137637 - DNA, 20 bp, human
gagcgaagcgcccaaaatgg

SEQ ID NO: 137638 - DNA, 20 bp, human
ggcaactagcggcgggtcgt

SEQ ID NO: 137639 - DNA, 20 bp, human
gggcgcttcgctgatggtgt

SEQ ID NO: 137640 - DNA, 20 bp, human
gcaggccgcgaacgtcaacg

SEQ ID NO: 137641 - DNA, 20 bp, human
ggcgaggcgcgcccctgacc

SEQ ID NO: 137642 - DNA, 20 bp, human
ggcctgagcgcaactagcgg

SEQ ID NO: 137643 - DNA, 20 bp, human
gcccgccgctagttgcgctc

SEQ ID NO: 137644 - DNA, 20 bp, human
ggctcagggagggaacgtcc

SEQ ID NO: 137645 - DNA, 20 bp, human
gggcccccggctaacaggag

SEQ ID NO: 137646 - DNA, 20 bp, human
gcagcgatcagagcagcgct

SEQ ID NO: 137647 - DNA, 20 bp, human
ggactccgtctctccgtccc

SEQ ID NO: 137648 - DNA, 20 bp, human
gagcagcgctgggtgttcag

SEQ ID NO: 137649 - DNA, 20 bp, human
ggtgtcggaaacataacccg

SEQ ID NO: 137650 - DNA, 20 bp, human
gaggctgagacctccatgta

SEQ ID NO: 137651 - DNA, 20 bp, human
gggaccggggcccccactcg

SEQ ID NO: 137652 - DNA, 20 bp, human
gcatgtaaggatgcccagtg

SEQ ID NO: 137653 - DNA, 20 bp, human
ggagtcgcgccgcccccgag

SEQ ID NO: 137654 - DNA, 20 bp, human
gggcagaggcagcgtctcta

SEQ ID NO: 137655 - DNA, 20 bp, human
gcccgccagggtccggaccg

SEQ ID NO: 137656 - DNA, 20 bp, human
gcccgagaagcgcaggtcca

SEQ ID NO: 137657 - DNA, 20 bp, human
gagaagcgcaggtccatggc

SEQ ID NO: 137658 - DNA, 20 bp, human
gttcttgcaaaggcagtaca

SEQ ID NO: 137659 - DNA, 20 bp, human
gggtcaggctaggtgagctg

SEQ ID NO: 137660 - DNA, 20 bp, human
gtcctgacgccactactgta

SEQ ID NO: 137661 - DNA, 20 bp, human
gtggtgaagagcaacgactt

SEQ ID NO: 137662 - DNA, 20 bp, human
gctgcggctggctatatgac

SEQ ID NO: 137663 - DNA, 20 bp, human
ggccagatcaccaacggcag

SEQ ID NO: 137664 - DNA, 20 bp, human
gtgcaaaatgcgggtgtaga

SEQ ID NO: 137665 - DNA, 20 bp, human
gtcccatgccagatcaccaa

SEQ ID NO: 137666 - DNA, 20 bp, human
gccaagtctggaacccacgg

SEQ ID NO: 137667 - DNA, 20 bp, human
gcctgagaaaggggtgataa

SEQ ID NO: 137668 - DNA, 20 bp, human
gacttgggataagtaaacag

SEQ ID NO: 137669 - DNA, 20 bp, human
gcagggggcggaccagggaa

SEQ ID NO: 137670 - DNA, 20 bp, human
gatcccaagtctggaaccca

SEQ ID NO: 137671 - DNA, 20 bp, human
ggagtagggcaggagaaact

SEQ ID NO: 137672 - DNA, 20 bp, human
ggtgggtcgcttatagggag

SEQ ID NO: 137673 - DNA, 20 bp, human
gccacctggcctgggtccgt

SEQ ID NO: 137674 - DNA, 20 bp, human
gatagggaggggagtagagt

SEQ ID NO: 137675 - DNA, 20 bp, human
ggggtgataagggcatgtga

SEQ ID NO: 137676 - DNA, 20 bp, human
ggccagagcgaggtcagaag

SEQ ID NO: 137677 - DNA, 20 bp, human
gaccgcccggaacacgctag

SEQ ID NO: 137678 - DNA, 20 bp, human
gggcggcggcgactacggac

SEQ ID NO: 137679 - DNA, 20 bp, human
gccggaacacgctagtggag

SEQ ID NO: 137680 - DNA, 20 bp, human
gtcgggaaggacttccgtaa

SEQ ID NO: 137681 - DNA, 20 bp, human
gcttcttgaggaggccctta

SEQ ID NO: 137682 - DNA, 20 bp, human
gcgccgccgcccccccgagg

SEQ ID NO: 137683 - DNA, 20 bp, human
gtcgccgccgggaggaactg

SEQ ID NO: 137684 - DNA, 20 bp, human
ggtagcacgcgcccttcttg

SEQ ID NO: 137685 - DNA, 20 bp, human
gactgaagtcccggctgcag

SEQ ID NO: 137686 - DNA, 20 bp, human
gtagctgcagacatagtacc

SEQ ID NO: 137687 - DNA, 20 bp, human
gttttcagcagagacgtaga

SEQ ID NO: 137688 - DNA, 20 bp, human
ggacgatgcgaacaacatgg

SEQ ID NO: 137689 - DNA, 20 bp, human
gcgccgggacccggaggaac

SEQ ID NO: 137690 - DNA, 20 bp, human
gtctgacgatgcgaacaaca

SEQ ID NO: 137691 - DNA, 20 bp, human
ggtgtcccaggagaacgatg

SEQ ID NO: 137692 - DNA, 20 bp, human
gcgtagaaggcgccgggacc

SEQ ID NO: 137693 - DNA, 20 bp, human
gctgcgtccgctgagtagga

SEQ ID NO: 137694 - DNA, 20 bp, human
gcttgaaccctcctactcag

SEQ ID NO: 137695 - DNA, 20 bp, human
ggatgcgaacaacatggcgg

SEQ ID NO: 137696 - DNA, 20 bp, human
gcacctgcctcaggccggat

SEQ ID NO: 137697 - DNA, 20 bp, human
gggggacacagaatgaactc

SEQ ID NO: 137698 - DNA, 20 bp, human
gtgccaggtcacccacaggg

SEQ ID NO: 137699 - DNA, 20 bp, human
ggaatgaactcgggaagcca

SEQ ID NO: 137700 - DNA, 20 bp, human
ggtctagtgcccatttactc

SEQ ID NO: 137701 - DNA, 20 bp, human
gagcctgcctggggctctgg

SEQ ID NO: 137702 - DNA, 20 bp, human
gtggtctgtgcaggacgaca

SEQ ID NO: 137703 - DNA, 20 bp, human
gcaggaccttaggcctccca

SEQ ID NO: 137704 - DNA, 20 bp, human
gctgtgtctctatcgcaggg

SEQ ID NO: 137705 - DNA, 20 bp, human
gccagcaaaggcactcacac

SEQ ID NO: 137706 - DNA, 20 bp, human
gtgaaggcctcgttgagaga

SEQ ID NO: 137707 - DNA, 20 bp, human
ggtattggtaacgttggggt

SEQ ID NO: 137708 - DNA, 20 bp, human
gtttcaggctcggggagtga

SEQ ID NO: 137709 - DNA, 20 bp, human
ggtgggcccaggtatcgtag

SEQ ID NO: 137710 - DNA, 20 bp, human
ggtccccatgactgccgggt

SEQ ID NO: 137711 - DNA, 20 bp, human
gacgcactaaaagatgtaag

SEQ ID NO: 137712 - DNA, 20 bp, human
gactaaaagatgtaagaggt

SEQ ID NO: 137713 - DNA, 20 bp, human
ggtttcggggacagtagggt

SEQ ID NO: 137714 - DNA, 20 bp, human
gcggggacagtagggttggt

SEQ ID NO: 137715 - DNA, 20 bp, human
gccccgagcctgaaagtaac

SEQ ID NO: 137716 - DNA, 20 bp, human
gcgagacgcgcgcgggtcag

SEQ ID NO: 137717 - DNA, 20 bp, human
ggcgccagccgcaggacccg

SEQ ID NO: 137718 - DNA, 20 bp, human
gagcagcaccaggcacacgt

SEQ ID NO: 137719 - DNA, 20 bp, human
ggtcacagggcctagcatgg

SEQ ID NO: 137720 - DNA, 20 bp, human
gcccgatactgcgggacgta

SEQ ID NO: 137721 - DNA, 20 bp, human
ggcgcaggtaaggagcgcgg

SEQ ID NO: 137722 - DNA, 20 bp, human
gtcccgagacgctcccggag

SEQ ID NO: 137723 - DNA, 20 bp, human
ggcctggccgaggctgtcac

SEQ ID NO: 137724 - DNA, 20 bp, human
gcacccgggcggtgacccca

SEQ ID NO: 137725 - DNA, 20 bp, human
gtctcggcgtcagtccgctc

SEQ ID NO: 137726 - DNA, 20 bp, human
gtgggccctggcggcggatc

SEQ ID NO: 137727 - DNA, 20 bp, human
ggacgtggtgagccggaccg

SEQ ID NO: 137728 - DNA, 20 bp, human
gttgccacctgcccccggtc

SEQ ID NO: 137729 - DNA, 20 bp, human
gctggcggcggatctggacg

SEQ ID NO: 137730 - DNA, 20 bp, human
gcagtggccccccacctcaa

SEQ ID NO: 137731 - DNA, 20 bp, human
gcgcgccgggctgagtcacc

SEQ ID NO: 137732 - DNA, 20 bp, human
ggggcaggtggcaaacttca

SEQ ID NO: 137733 - DNA, 20 bp, human
gtgtttggagggataatgat

SEQ ID NO: 137734 - DNA, 20 bp, human
ggcgcgggccgcctgtttgg

SEQ ID NO: 137735 - DNA, 20 bp, human
gggaggagcgtcccagctcg

SEQ ID NO: 137736 - DNA, 20 bp, human
gtgggcggccgcagcgagaa

SEQ ID NO: 137737 - DNA, 20 bp, human
gccgggaaggcggaaggctt

SEQ ID NO: 137738 - DNA, 20 bp, human
gctagcacagcggagatctg

SEQ ID NO: 137739 - DNA, 20 bp, human
gggtgaactagggagcctag

SEQ ID NO: 137740 - DNA, 20 bp, human
gggcggccgagggtgaacta

SEQ ID NO: 137741 - DNA, 20 bp, human
ggccggcagcagctgcgagg

SEQ ID NO: 137742 - DNA, 20 bp, human
gctgcgccgccgaggctgag

SEQ ID NO: 137743 - DNA, 20 bp, human
gtcccgggcggatcccggga

SEQ ID NO: 137744 - DNA, 20 bp, human
ggccgcctccatagcgccac

SEQ ID NO: 137745 - DNA, 20 bp, human
ggtggtcccgggcggatccc

SEQ ID NO: 137746 - DNA, 20 bp, human
ggaactgggaggtgcacagg

SEQ ID NO: 137747 - DNA, 20 bp, human
gcaaacagagcgccactggg

SEQ ID NO: 137748 - DNA, 20 bp, human
gtgtgcacctcccagttcgg

SEQ ID NO: 137749 - DNA, 20 bp, human
gggcgccagcattattctag

SEQ ID NO: 137750 - DNA, 20 bp, human
gcagccgccctgggcagaaa

SEQ ID NO: 137751 - DNA, 20 bp, human
gagagaccggcagccgccct

SEQ ID NO: 137752 - DNA, 20 bp, human
ggtgcaaacagagcgccact

SEQ ID NO: 137753 - DNA, 20 bp, human
ggcacgccttaggctaggag

SEQ ID NO: 137754 - DNA, 20 bp, human
gcagttcgggggcagtttag

SEQ ID NO: 137755 - DNA, 20 bp, human
gcaagcaagcatcggcctaa

SEQ ID NO: 137756 - DNA, 20 bp, human
ggcggcgagagcgggtatgt

SEQ ID NO: 137757 - DNA, 20 bp, human
gcgaccagaagggacagcta

SEQ ID NO: 137758 - DNA, 20 bp, human
ggtcgcaccctaagtcacct

SEQ ID NO: 137759 - DNA, 20 bp, human
gacttagggtgcgaccagaa

SEQ ID NO: 137760 - DNA, 20 bp, human
gtgaactcgcagggtcccca

SEQ ID NO: 137761 - DNA, 20 bp, human
gcgccgacccaggtgactta

SEQ ID NO: 137762 - DNA, 20 bp, human
gctgggtcggcgctagtggg

SEQ ID NO: 137763 - DNA, 20 bp, human
gcacctgggtcggcgctagt

SEQ ID NO: 137764 - DNA, 20 bp, human
gcaccctaagtcacctgggt

SEQ ID NO: 137765 - DNA, 20 bp, human
gcgagagcgggtatgtgggc

SEQ ID NO: 137766 - DNA, 20 bp, human
gagtcgtccagggcgcgtag

SEQ ID NO: 137767 - DNA, 20 bp, human
gcggcaggatgtcggaggtg

SEQ ID NO: 137768 - DNA, 20 bp, human
gcccagaacaaagtcgtcca

SEQ ID NO: 137769 - DNA, 20 bp, human
gggtctgcaaggaagatatg

SEQ ID NO: 137770 - DNA, 20 bp, human
gctggtccagccacattaac

SEQ ID NO: 137771 - DNA, 20 bp, human
gggacgtctgcagagcgtgg

SEQ ID NO: 137772 - DNA, 20 bp, human
gctgcaaggaagatatgggg

SEQ ID NO: 137773 - DNA, 20 bp, human
ggacatcctgccggttaatg

SEQ ID NO: 137774 - DNA, 20 bp, human
gggaggatggagacaagtgt

SEQ ID NO: 137775 - DNA, 20 bp, human
gaccaggacggggaacctga

SEQ ID NO: 137776 - DNA, 20 bp, human
gacacccgagccgggctcca

SEQ ID NO: 137777 - DNA, 20 bp, human
ggctccctcccccggaagta

SEQ ID NO: 137778 - DNA, 20 bp, human
gcatcaggccctacttccgg

SEQ ID NO: 137779 - DNA, 20 bp, human
gagagcatgaggcattccag

SEQ ID NO: 137780 - DNA, 20 bp, human
gcagctgtcggtgccgcccg

SEQ ID NO: 137781 - DNA, 20 bp, human
gtaaggcagaggtcttgagt

SEQ ID NO: 137782 - DNA, 20 bp, human
gttggactcttggaggatgg

SEQ ID NO: 137783 - DNA, 20 bp, human
gcatgaggcattccagtgga

SEQ ID NO: 137784 - DNA, 20 bp, human
gtgtccagagaataactcta

SEQ ID NO: 137785 - DNA, 20 bp, human
ggagggtgtaactgaaagaa

SEQ ID NO: 137786 - DNA, 20 bp, human
ggatgggccatgggatgagt

SEQ ID NO: 137787 - DNA, 20 bp, human
gatgagtgggacccgagctg

SEQ ID NO: 137788 - DNA, 20 bp, human
gatggctgcaggcaggtgat

SEQ ID NO: 137789 - DNA, 20 bp, human
gggcaaaaaggacccgaggt

SEQ ID NO: 137790 - DNA, 20 bp, human
gcctcttccagcactcacca

SEQ ID NO: 137791 - DNA, 20 bp, human
gcaggcaggtgatgggccat

SEQ ID NO: 137792 - DNA, 20 bp, human
ggtgctcccgggcgaccaca

SEQ ID NO: 137793 - DNA, 20 bp, human
gaacttgggtgactggacgg

SEQ ID NO: 137794 - DNA, 20 bp, human
gtcgggtcccactcatccca

SEQ ID NO: 137795 - DNA, 20 bp, human
ggacagatgggactccccgg

SEQ ID NO: 137796 - DNA, 20 bp, human
gcttttgcgtctgattaccc

SEQ ID NO: 137797 - DNA, 20 bp, human
gtcacgcctgggaagcgggt

SEQ ID NO: 137798 - DNA, 20 bp, human
ggagttccggcgaggcttca

SEQ ID NO: 137799 - DNA, 20 bp, human
gacaggtcacgcctgggaag

SEQ ID NO: 137800 - DNA, 20 bp, human
gcccttggctgggtaatctc

SEQ ID NO: 137801 - DNA, 20 bp, human
gccagacgcgagttccggcg

SEQ ID NO: 137802 - DNA, 20 bp, human
gctgtggagagtggaaacac

SEQ ID NO: 137803 - DNA, 20 bp, human
gctgttgacaggtcacgcct

SEQ ID NO: 137804 - DNA, 20 bp, human
ggctgaagagaccacccccc

SEQ ID NO: 137805 - DNA, 20 bp, human
gtggccccagacgcgagttc

SEQ ID NO: 137806 - DNA, 20 bp, human
gaccagatctggactcagtt

SEQ ID NO: 137807 - DNA, 20 bp, human
gtataactctatgccatctt

SEQ ID NO: 137808 - DNA, 20 bp, human
gagtcactaatctctctgta

SEQ ID NO: 137809 - DNA, 20 bp, human
gaaatattctttattgaagg

SEQ ID NO: 137810 - DNA, 20 bp, human
gttctttattgaagggggga

SEQ ID NO: 137811 - DNA, 20 bp, human
gacctcaggaagaactaagc

SEQ ID NO: 137812 - DNA, 20 bp, human
gagctgactgtaggtcagtt

SEQ ID NO: 137813 - DNA, 20 bp, human
gataaaatattctttattga

SEQ ID NO: 137814 - DNA, 20 bp, human
gacagtcagctggtctggga

SEQ ID NO: 137815 - DNA, 20 bp, human
gaagacaaaactgcatttaa

SEQ ID NO: 137816 - DNA, 20 bp, human
gtagctgggtcagaaggagt

SEQ ID NO: 137817 - DNA, 20 bp, human
ggaaggagtgggaggcccaa

SEQ ID NO: 137818 - DNA, 20 bp, human
gctggggaggaagctcagag

SEQ ID NO: 137819 - DNA, 20 bp, human
gggcccagagacttctgatg

SEQ ID NO: 137820 - DNA, 20 bp, human
gggctcaggcatccagggta

SEQ ID NO: 137821 - DNA, 20 bp, human
gaagtctctgggccaccctt

SEQ ID NO: 137822 - DNA, 20 bp, human
gcagccccatcagaagtctc

SEQ ID NO: 137823 - DNA, 20 bp, human
gtgacccagctaaccaggtg

SEQ ID NO: 137824 - DNA, 20 bp, human
gtgcgagaccctgacaacta

SEQ ID NO: 137825 - DNA, 20 bp, human
ggacccagctaaccctaccc

SEQ ID NO: 137826 - DNA, 20 bp, human
gcattgacctccgagagtgt

SEQ ID NO: 137827 - DNA, 20 bp, human
ggagtgtccttacagagatt

SEQ ID NO: 137828 - DNA, 20 bp, human
gtaagtccctaatctctgta

SEQ ID NO: 137829 - DNA, 20 bp, human
gttctgcttggtttttcctg

SEQ ID NO: 137830 - DNA, 20 bp, human
gaaaaccaagcagaaactcc

SEQ ID NO: 137831 - DNA, 20 bp, human
gacaatcccaacactctcgg

SEQ ID NO: 137832 - DNA, 20 bp, human
gtcctttcagaattcttggt

SEQ ID NO: 137833 - DNA, 20 bp, human
gagtgttgggattgtaggca

SEQ ID NO: 137834 - DNA, 20 bp, human
gtatatcctttcagaattct

SEQ ID NO: 137835 - DNA, 20 bp, human
gtctacaaaatatttttttt

SEQ ID NO: 137836 - DNA, 20 bp, human
gttggtgaggaagcttagag

SEQ ID NO: 137837 - DNA, 20 bp, human
gtgaggagtgaggaggtcca

SEQ ID NO: 137838 - DNA, 20 bp, human
gcatcacccggggtccaccg

SEQ ID NO: 137839 - DNA, 20 bp, human
gagggcccacaggcttctaa

SEQ ID NO: 137840 - DNA, 20 bp, human
gggagtgaggaggtccaagg

SEQ ID NO: 137841 - DNA, 20 bp, human
gcacagcttggaaggtctct

SEQ ID NO: 137842 - DNA, 20 bp, human
gatgggggaaaaagttccgt

SEQ ID NO: 137843 - DNA, 20 bp, human
gagaccccagaggaaggcgg

SEQ ID NO: 137844 - DNA, 20 bp, human
gaaaggactgctcatcaccc

SEQ ID NO: 137845 - DNA, 20 bp, human
gcagagaccccagaggaagg

SEQ ID NO: 137846 - DNA, 20 bp, human
gcagagctaatagagttggg

SEQ ID NO: 137847 - DNA, 20 bp, human
gtcccagagctaatagagtt

SEQ ID NO: 137848 - DNA, 20 bp, human
ggggccaaaagtcactactc

SEQ ID NO: 137849 - DNA, 20 bp, human
gctcctaacctccaaggaac

SEQ ID NO: 137850 - DNA, 20 bp, human
gatctaaaacaatggtcatg

SEQ ID NO: 137851 - DNA, 20 bp, human
gtttatgaggatgagcctac

SEQ ID NO: 137852 - DNA, 20 bp, human
ggttttcttgcagatttatg

SEQ ID NO: 137853 - DNA, 20 bp, human
gatttaaggatctaaaacaa

SEQ ID NO: 137854 - DNA, 20 bp, human
gaaacaatggtcatgtggct

SEQ ID NO: 137855 - DNA, 20 bp, human
gatggtcatgtggctgggct

SEQ ID NO: 137856 - DNA, 20 bp, human
gcaccacgcaaggtccatgg

SEQ ID NO: 137857 - DNA, 20 bp, human
gttcagtgccattagaggag

SEQ ID NO: 137858 - DNA, 20 bp, human
gcttggaaggcctccagaca

SEQ ID NO: 137859 - DNA, 20 bp, human
ggtggggggaaaagttctgt

SEQ ID NO: 137860 - DNA, 20 bp, human
gtccctgaggagctggtgaa

SEQ ID NO: 137861 - DNA, 20 bp, human
gacaggaacctctcctctaa

SEQ ID NO: 137862 - DNA, 20 bp, human
gtggtggtgaggaagccgag

SEQ ID NO: 137863 - DNA, 20 bp, human
gggcccaggtatccaaccaa

SEQ ID NO: 137864 - DNA, 20 bp, human
ggctccgccctgcaagctcc

SEQ ID NO: 137865 - DNA, 20 bp, human
gggtggacatggccaaggct

SEQ ID NO: 137866 - DNA, 20 bp, human
gacagaaacttctcttctag

SEQ ID NO: 137867 - DNA, 20 bp, human
gcctggagctggcaaggcag

SEQ ID NO: 137868 - DNA, 20 bp, human
gggtgccagtgaggaagctc

SEQ ID NO: 137869 - DNA, 20 bp, human
gccttcctgagcttcctcac

SEQ ID NO: 137870 - DNA, 20 bp, human
gaggaggaggggcaccatgg

SEQ ID NO: 137871 - DNA, 20 bp, human
gtgacccaggtgtccaggtg

SEQ ID NO: 137872 - DNA, 20 bp, human
gcctccccacctggacacct

SEQ ID NO: 137873 - DNA, 20 bp, human
gttcatcaagatgagcatca

SEQ ID NO: 137874 - DNA, 20 bp, human
gggacagctgtttcaggagg

SEQ ID NO: 137875 - DNA, 20 bp, human
ggaggcccagaggtttctga

SEQ ID NO: 137876 - DNA, 20 bp, human
gacttagggacagagtctaa

SEQ ID NO: 137877 - DNA, 20 bp, human
ggatgggcatgttcctaagg

SEQ ID NO: 137878 - DNA, 20 bp, human
ggggcatgttcctaaggagg

SEQ ID NO: 137879 - DNA, 20 bp, human
gtcagatgggcatgttccta

SEQ ID NO: 137880 - DNA, 20 bp, human
gatgtagaagggatgagtat

SEQ ID NO: 137881 - DNA, 20 bp, human
gtgtgtgaactgtagctgaa

SEQ ID NO: 137882 - DNA, 20 bp, human
gtgattgtgagtatgtagaa

SEQ ID NO: 137883 - DNA, 20 bp, human
gactcacaatcacccactta

SEQ ID NO: 137884 - DNA, 20 bp, human
gcgagtcttgttctgaacat

SEQ ID NO: 137885 - DNA, 20 bp, human
gagaatcaagcagtagttcc

SEQ ID NO: 137886 - DNA, 20 bp, human
gacttagggacagagtctaa

SEQ ID NO: 137887 - DNA, 20 bp, human
ggatgggcgtgttcctaagg

SEQ ID NO: 137888 - DNA, 20 bp, human
ggggcgtgttcctaaggagg

SEQ ID NO: 137889 - DNA, 20 bp, human
gtcagatgggcgtgttccta

SEQ ID NO: 137890 - DNA, 20 bp, human
gatgtagaagggatgagtat

SEQ ID NO: 137891 - DNA, 20 bp, human
gtgtgtgaactgtagctgaa

SEQ ID NO: 137892 - DNA, 20 bp, human
gcgagtcttgttctgaacat

SEQ ID NO: 137893 - DNA, 20 bp, human
gtgattgtgagtatgtagaa

SEQ ID NO: 137894 - DNA, 20 bp, human
gactcacaatcacccactta

SEQ ID NO: 137895 - DNA, 20 bp, human
gagaatcaagcagtagttcc

SEQ ID NO: 137896 - DNA, 20 bp, human
gcgctggaccctggaatcag

SEQ ID NO: 137897 - DNA, 20 bp, human
gcctgaggtggtgtcaccct

SEQ ID NO: 137898 - DNA, 20 bp, human
gcaggcctccaggtttgggt

SEQ ID NO: 137899 - DNA, 20 bp, human
gagtgcactcggggccacag

SEQ ID NO: 137900 - DNA, 20 bp, human
gagctgtgatctggagctca

SEQ ID NO: 137901 - DNA, 20 bp, human
gagcactctctacagagacg

SEQ ID NO: 137902 - DNA, 20 bp, human
gtgggccgggtgccagatac

SEQ ID NO: 137903 - DNA, 20 bp, human
gccaccccacccaaacctgg

SEQ ID NO: 137904 - DNA, 20 bp, human
ggcattacctcctcatgtct

SEQ ID NO: 137905 - DNA, 20 bp, human
gcaagaggcaagtgcactcg

SEQ ID NO: 137906 - DNA, 20 bp, human
gaaattagaaactcttattg

SEQ ID NO: 137907 - DNA, 20 bp, human
gagtgcatcagcatcgatga

SEQ ID NO: 137908 - DNA, 20 bp, human
gagaatcaacagcatcttgc

SEQ ID NO: 137909 - DNA, 20 bp, human
gggggcttaggaggtgataa

SEQ ID NO: 137910 - DNA, 20 bp, human
gctctgtgctgggaggaacg

SEQ ID NO: 137911 - DNA, 20 bp, human
gggatgcagtagagaatgca

SEQ ID NO: 137912 - DNA, 20 bp, human
gctcccaactctgtgctggg

SEQ ID NO: 137913 - DNA, 20 bp, human
gatcaacagcatcttgcagg

SEQ ID NO: 137914 - DNA, 20 bp, human
ggctgatgcactgtacagca

SEQ ID NO: 137915 - DNA, 20 bp, human
gaactcttattgtggaatga

SEQ ID NO: 137916 - DNA, 20 bp, human
gggcaatccccagcagcctc

SEQ ID NO: 137917 - DNA, 20 bp, human
ggtcccccacctccagcagg

SEQ ID NO: 137918 - DNA, 20 bp, human
gggattgttgccttcttgtt

SEQ ID NO: 137919 - DNA, 20 bp, human
gaagaaggcaacaatcctca

SEQ ID NO: 137920 - DNA, 20 bp, human
gtgttgccttcttgttgggg

SEQ ID NO: 137921 - DNA, 20 bp, human
gaaggaccaccccaacaaga

SEQ ID NO: 137922 - DNA, 20 bp, human
gggacttgctgcctccttgt

SEQ ID NO: 137923 - DNA, 20 bp, human
gggaggagatcgggcacttt

SEQ ID NO: 137924 - DNA, 20 bp, human
gattgcctcctgctggaggt

SEQ ID NO: 137925 - DNA, 20 bp, human
gggaggtgcctgaggctgct

SEQ ID NO: 137926 - DNA, 20 bp, human
ggtggccttgctctacctag

SEQ ID NO: 137927 - DNA, 20 bp, human
gtcatcaatgctgatccact

SEQ ID NO: 137928 - DNA, 20 bp, human
gggatgcagtggtgaatgca

SEQ ID NO: 137929 - DNA, 20 bp, human
gtgccctcattccacaccaa

SEQ ID NO: 137930 - DNA, 20 bp, human
gtaaataaattagaagccct

SEQ ID NO: 137931 - DNA, 20 bp, human
ggaggtgatagttgtaatta

SEQ ID NO: 137932 - DNA, 20 bp, human
gatcagtagcatcttgctgg

SEQ ID NO: 137933 - DNA, 20 bp, human
gctactgattctgctgtcgg

SEQ ID NO: 137934 - DNA, 20 bp, human
gaaattagaagcccttggtg

SEQ ID NO: 137935 - DNA, 20 bp, human
gtttataaagggagctgcca

SEQ ID NO: 137936 - DNA, 20 bp, human
gatcagcagcatctcgctgg

SEQ ID NO: 137937 - DNA, 20 bp, human
ggccttgctgtacagacagt

SEQ ID NO: 137938 - DNA, 20 bp, human
gtgactgcttgggacttagg

SEQ ID NO: 137939 - DNA, 20 bp, human
gcagctgagagttcaagtga

SEQ ID NO: 137940 - DNA, 20 bp, human
ggtgccctcattccacaata

SEQ ID NO: 137941 - DNA, 20 bp, human
gagaatcagcagcatctcgc

SEQ ID NO: 137942 - DNA, 20 bp, human
ggccgactgtctgtacagca

SEQ ID NO: 137943 - DNA, 20 bp, human
gcggtgactgcttgggactt

SEQ ID NO: 137944 - DNA, 20 bp, human
ggaggtgacagtggtaatta

SEQ ID NO: 137945 - DNA, 20 bp, human
gatcatccctgtgtacttac

SEQ ID NO: 137946 - DNA, 20 bp, human
ggagcgccggtgcccggacg

SEQ ID NO: 137947 - DNA, 20 bp, human
gggctcaacggctcgcggag

SEQ ID NO: 137948 - DNA, 20 bp, human
gtcccgggcctagatcgtca

SEQ ID NO: 137949 - DNA, 20 bp, human
gctacgcggagtgacatcgc

SEQ ID NO: 137950 - DNA, 20 bp, human
gggctcgcggagcggctacg

SEQ ID NO: 137951 - DNA, 20 bp, human
gagtcatctgcgccaagcag

SEQ ID NO: 137952 - DNA, 20 bp, human
gggacgcggcagggtagtcg

SEQ ID NO: 137953 - DNA, 20 bp, human
ggcgccagcgctgaccgcct

SEQ ID NO: 137954 - DNA, 20 bp, human
ggcgctgaccgcctgggtgg

SEQ ID NO: 137955 - DNA, 20 bp, human
gcccgcaggctcagacgccc

SEQ ID NO: 137956 - DNA, 20 bp, human
gctggcgccagcatctgagg

SEQ ID NO: 137957 - DNA, 20 bp, human
gactaggagcttaagtgaag

SEQ ID NO: 137958 - DNA, 20 bp, human
gtagccccggcagaaactca

SEQ ID NO: 137959 - DNA, 20 bp, human
gccaggccgaagggcaaggg

SEQ ID NO: 137960 - DNA, 20 bp, human
gaggaggaggcggagtgact

SEQ ID NO: 137961 - DNA, 20 bp, human
gtgtgtagttgcccgggact

SEQ ID NO: 137962 - DNA, 20 bp, human
gggctgatttccaccgaaca

SEQ ID NO: 137963 - DNA, 20 bp, human
gcggcagaaactcatggcta

SEQ ID NO: 137964 - DNA, 20 bp, human
ggcgtaagcaaccagcgaca

SEQ ID NO: 137965 - DNA, 20 bp, human
gaggcctcatctgccggcaa

SEQ ID NO: 137966 - DNA, 20 bp, human
gtgtcaggctgagggccaga

SEQ ID NO: 137967 - DNA, 20 bp, human
gggatcggggaacacagact

SEQ ID NO: 137968 - DNA, 20 bp, human
gcactctgcctctgaaggga

SEQ ID NO: 137969 - DNA, 20 bp, human
gcagggggaaagtcacacta

SEQ ID NO: 137970 - DNA, 20 bp, human
ggagcctctcaaagtagggc

SEQ ID NO: 137971 - DNA, 20 bp, human
gagctgagacaggcgatcac

SEQ ID NO: 137972 - DNA, 20 bp, human
ggcagcaaggatgaggtgac

SEQ ID NO: 137973 - DNA, 20 bp, human
gaccctgagcgcctccccag

SEQ ID NO: 137974 - DNA, 20 bp, human
gtcccgggaacagtgccctc

SEQ ID NO: 137975 - DNA, 20 bp, human
gtcctggtgacaggcctgtc

SEQ ID NO: 137976 - DNA, 20 bp, human
gtctgtgggaggcaagagta

SEQ ID NO: 137977 - DNA, 20 bp, human
gaccgcaggacagacggcag

SEQ ID NO: 137978 - DNA, 20 bp, human
gacgtggatggggcagctag

SEQ ID NO: 137979 - DNA, 20 bp, human
gtcgctgggctctctgtggg

SEQ ID NO: 137980 - DNA, 20 bp, human
gcaagtctgcagaaggccac

SEQ ID NO: 137981 - DNA, 20 bp, human
gacgtcgctgggctctctgt

SEQ ID NO: 137982 - DNA, 20 bp, human
gcccaggccaagtctgcaga

SEQ ID NO: 137983 - DNA, 20 bp, human
gcattgggctatgggagtag

SEQ ID NO: 137984 - DNA, 20 bp, human
gtgcagaaggccacaggcga

SEQ ID NO: 137985 - DNA, 20 bp, human
ggccactgccgtctgtcctg

SEQ ID NO: 137986 - DNA, 20 bp, human
ggctcggcggcccatggctc

SEQ ID NO: 137987 - DNA, 20 bp, human
ggccggccggagggctatgg

SEQ ID NO: 137988 - DNA, 20 bp, human
ggaggccagcagaagcgcac

SEQ ID NO: 137989 - DNA, 20 bp, human
gaaggccggccggagggcta

SEQ ID NO: 137990 - DNA, 20 bp, human
gacagatcctaggcatcaag

SEQ ID NO: 137991 - DNA, 20 bp, human
gaccctcagagcccgggcaa

SEQ ID NO: 137992 - DNA, 20 bp, human
gcttccaacagaaggtaagg

SEQ ID NO: 137993 - DNA, 20 bp, human
gcgtcccaggcccaaccgcc

SEQ ID NO: 137994 - DNA, 20 bp, human
gtccgttgcccgggctctga

SEQ ID NO: 137995 - DNA, 20 bp, human
gctacagccgggagggatgt

SEQ ID NO: 137996 - DNA, 20 bp, human
ggtggttaggctccagatgg

SEQ ID NO: 137997 - DNA, 20 bp, human
ggtactactgatccacctgt

SEQ ID NO: 137998 - DNA, 20 bp, human
gcgggaaccctacgcccagg

SEQ ID NO: 137999 - DNA, 20 bp, human
gccaagaacggagtatcata

SEQ ID NO: 138000 - DNA, 20 bp, human
gcccggggcgacctgtgtaa

SEQ ID NO: 138001 - DNA, 20 bp, human
gggctagcactacccacggg

SEQ ID NO: 138002 - DNA, 20 bp, human
gagtctttctccccgacagg

SEQ ID NO: 138003 - DNA, 20 bp, human
gtcccgggaaccctacgccc

SEQ ID NO: 138004 - DNA, 20 bp, human
gagacccggcgctgtcctag

SEQ ID NO: 138005 - DNA, 20 bp, human
gtaggggctagcactaccca

SEQ ID NO: 138006 - DNA, 20 bp, human
gactggagggccgagtgtca

SEQ ID NO: 138007 - DNA, 20 bp, human
ggaggcaagagcagcgaccg

SEQ ID NO: 138008 - DNA, 20 bp, human
ggccctccagtgttgcggag

SEQ ID NO: 138009 - DNA, 20 bp, human
ggcctctccgcaacactgga

SEQ ID NO: 138010 - DNA, 20 bp, human
gtccgggcggacaggtgccg

SEQ ID NO: 138011 - DNA, 20 bp, human
ggtcccagctccgggcggac

SEQ ID NO: 138012 - DNA, 20 bp, human
gactcggccctccagtgttg

SEQ ID NO: 138013 - DNA, 20 bp, human
gggcgcccgcgtcccagctc

SEQ ID NO: 138014 - DNA, 20 bp, human
gtgtgggtacgaccttggta

SEQ ID NO: 138015 - DNA, 20 bp, human
ggcacagacgcgcacctcgg

SEQ ID NO: 138016 - DNA, 20 bp, human
gcggtcggttggccccggcc

SEQ ID NO: 138017 - DNA, 20 bp, human
gacttacacgacgttgggtg

SEQ ID NO: 138018 - DNA, 20 bp, human
gcccgatcctctctccctag

SEQ ID NO: 138019 - DNA, 20 bp, human
ggagcgtgcgagccactcgg

SEQ ID NO: 138020 - DNA, 20 bp, human
gctgcgcgcggcgaaggcag

SEQ ID NO: 138021 - DNA, 20 bp, human
gctatcacccctagggagag

SEQ ID NO: 138022 - DNA, 20 bp, human
gggacgaggcacctcactcg

SEQ ID NO: 138023 - DNA, 20 bp, human
gccggccgggctctgagacg

SEQ ID NO: 138024 - DNA, 20 bp, human
ggttcttcccgccgcagagt

SEQ ID NO: 138025 - DNA, 20 bp, human
gtgctgctcccactctgcgg

SEQ ID NO: 138026 - DNA, 20 bp, human
gatggagggaccccagagtg

SEQ ID NO: 138027 - DNA, 20 bp, human
gctcccggcagcataccgtg

SEQ ID NO: 138028 - DNA, 20 bp, human
gggaatcacagggtagtggg

SEQ ID NO: 138029 - DNA, 20 bp, human
gctggaacaaggtggatcag

SEQ ID NO: 138030 - DNA, 20 bp, human
gagcaggaggtgagacgatg

SEQ ID NO: 138031 - DNA, 20 bp, human
gggtatgctgccgggagaga

SEQ ID NO: 138032 - DNA, 20 bp, human
gtcttgaggaccatctctcc

SEQ ID NO: 138033 - DNA, 20 bp, human
gctcccacagtccattgagg

SEQ ID NO: 138034 - DNA, 20 bp, human
gcaagacagctggaacaagg

SEQ ID NO: 138035 - DNA, 20 bp, human
ggctggaatcacagggtagt

SEQ ID NO: 138036 - DNA, 20 bp, human
gcggcactccacgatcatca

SEQ ID NO: 138037 - DNA, 20 bp, human
gctctctggtaaaggaagag

SEQ ID NO: 138038 - DNA, 20 bp, human
gctgccagatcactaggact

SEQ ID NO: 138039 - DNA, 20 bp, human
gtaggactcggaacagcacc

SEQ ID NO: 138040 - DNA, 20 bp, human
gtagggttcaatgttgaaga

SEQ ID NO: 138041 - DNA, 20 bp, human
ggttccgagtcctagtgatc

SEQ ID NO: 138042 - DNA, 20 bp, human
gtgacagtgagaaggagtgg

SEQ ID NO: 138043 - DNA, 20 bp, human
gagaggtgagcatctcaggc

SEQ ID NO: 138044 - DNA, 20 bp, human
gcgatcatcagggatgcaat

SEQ ID NO: 138045 - DNA, 20 bp, human
gtagacagaaaggacaatgc

SEQ ID NO: 138046 - DNA, 20 bp, human
ggctccgggccgcccatgat

SEQ ID NO: 138047 - DNA, 20 bp, human
ggcacggagcccatcatggg

SEQ ID NO: 138048 - DNA, 20 bp, human
ggactgcgccagcacctcgg

SEQ ID NO: 138049 - DNA, 20 bp, human
gctgggaggaaagcgaacga

SEQ ID NO: 138050 - DNA, 20 bp, human
gtggcgcagtccttctccgg

SEQ ID NO: 138051 - DNA, 20 bp, human
gtgctggcgcagtccttctc

SEQ ID NO: 138052 - DNA, 20 bp, human
gcgacggctggactcaccgc

SEQ ID NO: 138053 - DNA, 20 bp, human
gaaggactgcgccagcacct

SEQ ID NO: 138054 - DNA, 20 bp, human
gccggcgcaatccctcctcc

SEQ ID NO: 138055 - DNA, 20 bp, human
ggggcgagaggggagcccaa

SEQ ID NO: 138056 - DNA, 20 bp, human
gagcgctcgaggggcaaccc

SEQ ID NO: 138057 - DNA, 20 bp, human
ggaccgcccgggtcgagggg

SEQ ID NO: 138058 - DNA, 20 bp, human
gtgagaccgcccgggtcgag

SEQ ID NO: 138059 - DNA, 20 bp, human
ggcagcgcgcagcgctcgag

SEQ ID NO: 138060 - DNA, 20 bp, human
gaggggcaaccccggcgcag

SEQ ID NO: 138061 - DNA, 20 bp, human
gttgccaccggccgtcgcgg

SEQ ID NO: 138062 - DNA, 20 bp, human
gtcgcggacgcctggactcg

SEQ ID NO: 138063 - DNA, 20 bp, human
gtggctgccgggaagggtcg

SEQ ID NO: 138064 - DNA, 20 bp, human
ggccacagtagaggcacagg

SEQ ID NO: 138065 - DNA, 20 bp, human
gacgttgccaccggccgtcg

SEQ ID NO: 138066 - DNA, 20 bp, human
gacaggcagcaagttcaccg

SEQ ID NO: 138067 - DNA, 20 bp, human
gccgcaccgccgggaaagga

SEQ ID NO: 138068 - DNA, 20 bp, human
gtggccccgcagcgtccagg

SEQ ID NO: 138069 - DNA, 20 bp, human
gcgggctcggtaggccactc

SEQ ID NO: 138070 - DNA, 20 bp, human
gggacgctgcggggccactc

SEQ ID NO: 138071 - DNA, 20 bp, human
gagacccgccggccctgaag

SEQ ID NO: 138072 - DNA, 20 bp, human
gggattcaaagcccccgaga

SEQ ID NO: 138073 - DNA, 20 bp, human
ggcggtggcgctcttggagg

SEQ ID NO: 138074 - DNA, 20 bp, human
ggacttcgggcgggccctga

SEQ ID NO: 138075 - DNA, 20 bp, human
gtggaggtggtgtcggaggt

SEQ ID NO: 138076 - DNA, 20 bp, human
gcccgctctgcacattccaa

SEQ ID NO: 138077 - DNA, 20 bp, human
gtgcagagcgggatcggatc

SEQ ID NO: 138078 - DNA, 20 bp, human
gtccggagcggatcgcaacc

SEQ ID NO: 138079 - DNA, 20 bp, human
gggaatgtgcagagcgggat

SEQ ID NO: 138080 - DNA, 20 bp, human
gtgctgcgcagtttccggag

SEQ ID NO: 138081 - DNA, 20 bp, human
ggcgcagggcgatcccggag

SEQ ID NO: 138082 - DNA, 20 bp, human
gcggatcgcaacccggagtc

SEQ ID NO: 138083 - DNA, 20 bp, human
ggggatcggatccggactcc

SEQ ID NO: 138084 - DNA, 20 bp, human
gcaaaggcaggtaaagctcc

SEQ ID NO: 138085 - DNA, 20 bp, human
ggaatgtaacaaagaacagt

SEQ ID NO: 138086 - DNA, 20 bp, human
ggccgacaccatgcgatcca

SEQ ID NO: 138087 - DNA, 20 bp, human
ggcttctggactcaaggagg

SEQ ID NO: 138088 - DNA, 20 bp, human
gaccatgcgatccaaggcga

SEQ ID NO: 138089 - DNA, 20 bp, human
ggccttggatcgcatggtgt

SEQ ID NO: 138090 - DNA, 20 bp, human
ggctcgggcccgggaacccg

SEQ ID NO: 138091 - DNA, 20 bp, human
gccgagcgcctgacactggt

SEQ ID NO: 138092 - DNA, 20 bp, human
ggccctcgccttggatcgca

SEQ ID NO: 138093 - DNA, 20 bp, human
ggggcccgagcgcctgacac

SEQ ID NO: 138094 - DNA, 20 bp, human
gatcgcatggtgtcggctcg

SEQ ID NO: 138095 - DNA, 20 bp, human
gagcgaaaagttgacgaaag

SEQ ID NO: 138096 - DNA, 20 bp, human
gaaataagcctcgcagagtg

SEQ ID NO: 138097 - DNA, 20 bp, human
gcattctgtacattgaggta

SEQ ID NO: 138098 - DNA, 20 bp, human
gaaagaataggcaggcaatt

SEQ ID NO: 138099 - DNA, 20 bp, human
gaaatgttcctcactctgcg

SEQ ID NO: 138100 - DNA, 20 bp, human
gctgcgaggcttatttttta

SEQ ID NO: 138101 - DNA, 20 bp, human
gcaaatagtaagagacaaca

SEQ ID NO: 138102 - DNA, 20 bp, human
gtgacctgccttctaacaag

SEQ ID NO: 138103 - DNA, 20 bp, human
gcaggtcagctcacctgctt

SEQ ID NO: 138104 - DNA, 20 bp, human
gcagtatcacagatcaagaa

SEQ ID NO: 138105 - DNA, 20 bp, human
gttacagtacatctgaaagt

SEQ ID NO: 138106 - DNA, 20 bp, human
gggcgggacgggaaacgtta

SEQ ID NO: 138107 - DNA, 20 bp, human
gctctgggccgcaccctctg

SEQ ID NO: 138108 - DNA, 20 bp, human
gccggccctcgggagaagtt

SEQ ID NO: 138109 - DNA, 20 bp, human
gaaacgcgccgcagagggtg

SEQ ID NO: 138110 - DNA, 20 bp, human
ggcatctcggggaacacctg

SEQ ID NO: 138111 - DNA, 20 bp, human
gtgccgacaccgccacccaa

SEQ ID NO: 138112 - DNA, 20 bp, human
ggccgcccaacttctcccga

SEQ ID NO: 138113 - DNA, 20 bp, human
gatccggaaacgcgccgcag

SEQ ID NO: 138114 - DNA, 20 bp, human
gcccgagatgccccaacccg

SEQ ID NO: 138115 - DNA, 20 bp, human
ggagcggcgggcgctgagag

SEQ ID NO: 138116 - DNA, 20 bp, human
gccgctgccggccggtccag

SEQ ID NO: 138117 - DNA, 20 bp, human
gcgggtggcgcagcgagtaa

SEQ ID NO: 138118 - DNA, 20 bp, human
gtagaggggagaaaccggca

SEQ ID NO: 138119 - DNA, 20 bp, human
ggcaggcagcgccacgtagg

SEQ ID NO: 138120 - DNA, 20 bp, human
gtaagcgccggtgttgagag

SEQ ID NO: 138121 - DNA, 20 bp, human
gcggtttctcccctctaccc

SEQ ID NO: 138122 - DNA, 20 bp, human
ggagaaaccggcagggaagg

SEQ ID NO: 138123 - DNA, 20 bp, human
ggtgcgaaaggtgggtgacc

SEQ ID NO: 138124 - DNA, 20 bp, human
gcccgacccgggacgaggag

SEQ ID NO: 138125 - DNA, 20 bp, human
gcctgcggcagggcgactcc

SEQ ID NO: 138126 - DNA, 20 bp, human
ggaaccaaggagccaggacg

SEQ ID NO: 138127 - DNA, 20 bp, human
gggccaagcgcagcagccca

SEQ ID NO: 138128 - DNA, 20 bp, human
gctgccagagcgtggaacca

SEQ ID NO: 138129 - DNA, 20 bp, human
gggcgctgccccgtagaact

SEQ ID NO: 138130 - DNA, 20 bp, human
gagcccacggcggttgagtc

SEQ ID NO: 138131 - DNA, 20 bp, human
gcctgcagccgagttctacg

SEQ ID NO: 138132 - DNA, 20 bp, human
gcgcccgactcaaccgccgt

SEQ ID NO: 138133 - DNA, 20 bp, human
gccgggaagctgccagagcg

SEQ ID NO: 138134 - DNA, 20 bp, human
ggctccttggttccacgctc

SEQ ID NO: 138135 - DNA, 20 bp, human
gctggcgcctgaggccaacg

SEQ ID NO: 138136 - DNA, 20 bp, human
gagcccatggtgagaagtcg

SEQ ID NO: 138137 - DNA, 20 bp, human
gaggctatgccctacacgca

SEQ ID NO: 138138 - DNA, 20 bp, human
gccatggtgagaagtcgggg

SEQ ID NO: 138139 - DNA, 20 bp, human
gtgccctacacgcagggtag

SEQ ID NO: 138140 - DNA, 20 bp, human
ggcgaagccagactcccagc

SEQ ID NO: 138141 - DNA, 20 bp, human
gagttaaacaggacacaatc

SEQ ID NO: 138142 - DNA, 20 bp, human
gttcctctaccctgcgtgta

SEQ ID NO: 138143 - DNA, 20 bp, human
gtctcctcttgggacctttc

SEQ ID NO: 138144 - DNA, 20 bp, human
gcctgctccaattctgagtg

SEQ ID NO: 138145 - DNA, 20 bp, human
gttactaatacacatcgagc

SEQ ID NO: 138146 - DNA, 20 bp, human
gcctctaggcaggcattgtc

SEQ ID NO: 138147 - DNA, 20 bp, human
gtcaggaagagcctaaaagg

SEQ ID NO: 138148 - DNA, 20 bp, human
gctggcccgtccctctaggc

SEQ ID NO: 138149 - DNA, 20 bp, human
ggccggagaagccggagact

SEQ ID NO: 138150 - DNA, 20 bp, human
gtagagggacgggccagtgg

SEQ ID NO: 138151 - DNA, 20 bp, human
gctaggcaggcattgtctgg

SEQ ID NO: 138152 - DNA, 20 bp, human
gagatggggagaaaaagatt

SEQ ID NO: 138153 - DNA, 20 bp, human
gaatgcctgcctagagggac

SEQ ID NO: 138154 - DNA, 20 bp, human
gcttctggataataaggaga

SEQ ID NO: 138155 - DNA, 20 bp, human
gacggagagagttgtacaga

SEQ ID NO: 138156 - DNA, 20 bp, human
gggtgggggtacaagagaag

SEQ ID NO: 138157 - DNA, 20 bp, human
gccgctgccgaggctccaga

SEQ ID NO: 138158 - DNA, 20 bp, human
ggagaagccatctggagcct

SEQ ID NO: 138159 - DNA, 20 bp, human
gagagggcgccagcaccccg

SEQ ID NO: 138160 - DNA, 20 bp, human
ggctactgcgggcccctcgg

SEQ ID NO: 138161 - DNA, 20 bp, human
gggccgctccctgcttctcg

SEQ ID NO: 138162 - DNA, 20 bp, human
gagcgcaaggagaagccatc

SEQ ID NO: 138163 - DNA, 20 bp, human
gtcctcggcaggctccgatt

SEQ ID NO: 138164 - DNA, 20 bp, human
gccttcatcctgggcgcgga

SEQ ID NO: 138165 - DNA, 20 bp, human
gagagcacccgcgagaagca

SEQ ID NO: 138166 - DNA, 20 bp, human
gccggccagggtgaacgccg

SEQ ID NO: 138167 - DNA, 20 bp, human
gcgccgcggcaggagagcac

SEQ ID NO: 138168 - DNA, 20 bp, human
gctcaggaggtgagatgtgg

SEQ ID NO: 138169 - DNA, 20 bp, human
gtctctcagagtccctcagg

SEQ ID NO: 138170 - DNA, 20 bp, human
ggggactctgagagaacgcc

SEQ ID NO: 138171 - DNA, 20 bp, human
gggaggtgagatgtggtgga

SEQ ID NO: 138172 - DNA, 20 bp, human
gcgttctctcagagtccctc

SEQ ID NO: 138173 - DNA, 20 bp, human
gtctgagagaacgcccggcc

SEQ ID NO: 138174 - DNA, 20 bp, human
gggaaatttggtctgtctgt

SEQ ID NO: 138175 - DNA, 20 bp, human
gtgggttgccttagggtgag

SEQ ID NO: 138176 - DNA, 20 bp, human
ggccgcgcctcactccgcag

SEQ ID NO: 138177 - DNA, 20 bp, human
gtagccagacccacacggta

SEQ ID NO: 138178 - DNA, 20 bp, human
ggacgcgcaagagctctccg

SEQ ID NO: 138179 - DNA, 20 bp, human
ggaagctccgcagctagtca

SEQ ID NO: 138180 - DNA, 20 bp, human
gggacctgtatccagactcg

SEQ ID NO: 138181 - DNA, 20 bp, human
gagatccctactggctataa

SEQ ID NO: 138182 - DNA, 20 bp, human
ggttagacgtggtcctccgt

SEQ ID NO: 138183 - DNA, 20 bp, human
gcagagggaaagttcatctt

SEQ ID NO: 138184 - DNA, 20 bp, human
gcccagacactccggaggtg

SEQ ID NO: 138185 - DNA, 20 bp, human
gctagtcaaggctcaggacc

SEQ ID NO: 138186 - DNA, 20 bp, human
ggtagaccgggtacccggga

SEQ ID NO: 138187 - DNA, 20 bp, human
gcgcagcgcgaccttgggtt

SEQ ID NO: 138188 - DNA, 20 bp, human
gcctcgtagaccgggtaccc

SEQ ID NO: 138189 - DNA, 20 bp, human
ggactgagtcagcacggcgg

SEQ ID NO: 138190 - DNA, 20 bp, human
ggccgtgctgactcagtcat

SEQ ID NO: 138191 - DNA, 20 bp, human
gcctccgggcctcgtagacc

SEQ ID NO: 138192 - DNA, 20 bp, human
gtcacttggcgctgagaacg

SEQ ID NO: 138193 - DNA, 20 bp, human
gggtcaggagagcgggtctc

SEQ ID NO: 138194 - DNA, 20 bp, human
ggtgaggcccgcacgagcag

SEQ ID NO: 138195 - DNA, 20 bp, human
gggccaaagcagcctgaagg

SEQ ID NO: 138196 - DNA, 20 bp, human
gggccattcgcccttcttgg

SEQ ID NO: 138197 - DNA, 20 bp, human
gggacggttgctccgagcgt

SEQ ID NO: 138198 - DNA, 20 bp, human
gtgctccgagcgtcggtgag

SEQ ID NO: 138199 - DNA, 20 bp, human
gacaggcgtggagacactgg

SEQ ID NO: 138200 - DNA, 20 bp, human
gccgaaagaggagggactcg

SEQ ID NO: 138201 - DNA, 20 bp, human
gcagaggcctccctccggga

SEQ ID NO: 138202 - DNA, 20 bp, human
ggcactcgggcgccacgggg

SEQ ID NO: 138203 - DNA, 20 bp, human
gcgcatggaaccttcccgga

SEQ ID NO: 138204 - DNA, 20 bp, human
gcgccatcttcagtgcactc

SEQ ID NO: 138205 - DNA, 20 bp, human
gacagccactcaccgacgct

SEQ ID NO: 138206 - DNA, 20 bp, human
gcgcggttgtagctgcccgg

SEQ ID NO: 138207 - DNA, 20 bp, human
gtgcccggcggcggcagaag

SEQ ID NO: 138208 - DNA, 20 bp, human
ggcccaagcccagattccgg

SEQ ID NO: 138209 - DNA, 20 bp, human
ggagttgtcgcggctagcag

SEQ ID NO: 138210 - DNA, 20 bp, human
gtggtgtcccgccaaagggt

SEQ ID NO: 138211 - DNA, 20 bp, human
ggaagcggcgctcgcgccaa

SEQ ID NO: 138212 - DNA, 20 bp, human
gtacccgggagaggcatccc

SEQ ID NO: 138213 - DNA, 20 bp, human
gggacaagtgtacccgggag

SEQ ID NO: 138214 - DNA, 20 bp, human
gagcgcagaaacacgtccct

SEQ ID NO: 138215 - DNA, 20 bp, human
gggcttgggcggcaccccct

SEQ ID NO: 138216 - DNA, 20 bp, human
gcacgattggcgagaaaggt

SEQ ID NO: 138217 - DNA, 20 bp, human
gggcaccgctagcggcacag

SEQ ID NO: 138218 - DNA, 20 bp, human
ggccacgagggccttctgaa

SEQ ID NO: 138219 - DNA, 20 bp, human
ggaggtgaggcccccacgat

SEQ ID NO: 138220 - DNA, 20 bp, human
gcagcgggctatatactcgt

SEQ ID NO: 138221 - DNA, 20 bp, human
gggcggtcagtctgcggcag

SEQ ID NO: 138222 - DNA, 20 bp, human
gtgcggcagcggcagcaaga

SEQ ID NO: 138223 - DNA, 20 bp, human
gacctcccgggacagtcccg

SEQ ID NO: 138224 - DNA, 20 bp, human
ggcacagcggcgacaccctg

SEQ ID NO: 138225 - DNA, 20 bp, human
gtcccttcagaaggccctcg

SEQ ID NO: 138226 - DNA, 20 bp, human
ggcatggcgacggtgatgag

SEQ ID NO: 138227 - DNA, 20 bp, human
gcggttgcttgctgtcccag

SEQ ID NO: 138228 - DNA, 20 bp, human
gtcaccgtcgccatgcccgg

SEQ ID NO: 138229 - DNA, 20 bp, human
ggctgggcaaggccacgcca

SEQ ID NO: 138230 - DNA, 20 bp, human
ggggacagcaagcaaccggt

SEQ ID NO: 138231 - DNA, 20 bp, human
gagacctccgggcatggcga

SEQ ID NO: 138232 - DNA, 20 bp, human
ggaggccaggagggatcgag

SEQ ID NO: 138233 - DNA, 20 bp, human
gaaggccacgccaaggtggg

SEQ ID NO: 138234 - DNA, 20 bp, human
gggcaaggccacgccaaggt

SEQ ID NO: 138235 - DNA, 20 bp, human
gcccggaggtctgcttctcg

SEQ ID NO: 138236 - DNA, 20 bp, human
gaggaagccgagcctcagct

SEQ ID NO: 138237 - DNA, 20 bp, human
gacggagccgagctgaggct

SEQ ID NO: 138238 - DNA, 20 bp, human
gtctgcgagaccgacttgga

SEQ ID NO: 138239 - DNA, 20 bp, human
ggggtcttcccaacagaagt

SEQ ID NO: 138240 - DNA, 20 bp, human
gcttggacggagccgagctg

SEQ ID NO: 138241 - DNA, 20 bp, human
gggcttcctgctgatggtca

SEQ ID NO: 138242 - DNA, 20 bp, human
gtgagagcgcagggccactg

SEQ ID NO: 138243 - DNA, 20 bp, human
ggaggaggcgccgccaagac

SEQ ID NO: 138244 - DNA, 20 bp, human
gcgggcgccagagctgtacc

SEQ ID NO: 138245 - DNA, 20 bp, human
gcgcgtctgcgagaccgact

SEQ ID NO: 138246 - DNA, 20 bp, human
gaggcctgcaaggtcctgaa

SEQ ID NO: 138247 - DNA, 20 bp, human
gcaccccaggaaagcgccac

SEQ ID NO: 138248 - DNA, 20 bp, human
gtcctaggtagaccttatcg

SEQ ID NO: 138249 - DNA, 20 bp, human
gggaagcggtggctactgtg

SEQ ID NO: 138250 - DNA, 20 bp, human
gtccccgataaggtctacct

SEQ ID NO: 138251 - DNA, 20 bp, human
gggactcgatatcgaatcct

SEQ ID NO: 138252 - DNA, 20 bp, human
gccctcgggcagtctcttag

SEQ ID NO: 138253 - DNA, 20 bp, human
gcctggccgcttccccgata

SEQ ID NO: 138254 - DNA, 20 bp, human
gaaggtcctgaagggaggtt

SEQ ID NO: 138255 - DNA, 20 bp, human
gtgggtaacccccaagtact

SEQ ID NO: 138256 - DNA, 20 bp, human
gcatgtggctgtccgagtgt

SEQ ID NO: 138257 - DNA, 20 bp, human
gggcagctctgagctcgcgg

SEQ ID NO: 138258 - DNA, 20 bp, human
gctgccccagctgaaagaag

SEQ ID NO: 138259 - DNA, 20 bp, human
gcacgagctgggattcccgg

SEQ ID NO: 138260 - DNA, 20 bp, human
ggggctccgcagaggcccgg

SEQ ID NO: 138261 - DNA, 20 bp, human
ggcccggaggcgcccacact

SEQ ID NO: 138262 - DNA, 20 bp, human
gaggcagcgcgggatacgga

SEQ ID NO: 138263 - DNA, 20 bp, human
gtccgagtgtgggcgcctcc

SEQ ID NO: 138264 - DNA, 20 bp, human
gaccggaaagctccacacgt

SEQ ID NO: 138265 - DNA, 20 bp, human
ggcggaggcagcgcgggata

SEQ ID NO: 138266 - DNA, 20 bp, human
gagaagatctgatctcccag

SEQ ID NO: 138267 - DNA, 20 bp, human
gcaagcacgcacacaccact

SEQ ID NO: 138268 - DNA, 20 bp, human
gggagatcagatcttctagc

SEQ ID NO: 138269 - DNA, 20 bp, human
gtccccaccccaataggatc

SEQ ID NO: 138270 - DNA, 20 bp, human
gacagctccgccgaagggag

SEQ ID NO: 138271 - DNA, 20 bp, human
gctcatttgagaggagaaag

SEQ ID NO: 138272 - DNA, 20 bp, human
gctgccacagctccgccgaa

SEQ ID NO: 138273 - DNA, 20 bp, human
gagtcacacacatcacacgg

SEQ ID NO: 138274 - DNA, 20 bp, human
gttgcagtaagcaaatatag

SEQ ID NO: 138275 - DNA, 20 bp, human
gaggctataggaaagaagtt

SEQ ID NO: 138276 - DNA, 20 bp, human
gctcccggcctcgcagacag

SEQ ID NO: 138277 - DNA, 20 bp, human
ggcggaggcagagatactta

SEQ ID NO: 138278 - DNA, 20 bp, human
gtgctggcggcggagcctgt

SEQ ID NO: 138279 - DNA, 20 bp, human
gcggccagagctagcacaaa

SEQ ID NO: 138280 - DNA, 20 bp, human
gctcgtcgcggtacacgtcg

SEQ ID NO: 138281 - DNA, 20 bp, human
gtacacgtcggggtactgaa

SEQ ID NO: 138282 - DNA, 20 bp, human
ggcagacgcccgggtagaat

SEQ ID NO: 138283 - DNA, 20 bp, human
gtgcccgggagccctctggg

SEQ ID NO: 138284 - DNA, 20 bp, human
ggcgaggacgtgcagaaagc

SEQ ID NO: 138285 - DNA, 20 bp, human
gctagaatcaatggggtcaa

SEQ ID NO: 138286 - DNA, 20 bp, human
gtctggacacaaaccagtga

SEQ ID NO: 138287 - DNA, 20 bp, human
gggctgcggaacgcagactt

SEQ ID NO: 138288 - DNA, 20 bp, human
gagaacctgaagctctcaga

SEQ ID NO: 138289 - DNA, 20 bp, human
ggaataacaaggacctgcaa

SEQ ID NO: 138290 - DNA, 20 bp, human
gtgtgggaacgtggtgatgt

SEQ ID NO: 138291 - DNA, 20 bp, human
ggccgacactagtaaaaaaa

SEQ ID NO: 138292 - DNA, 20 bp, human
ggtatgcaaggctaggatgg

SEQ ID NO: 138293 - DNA, 20 bp, human
ggacacaaaccagtgaaggc

SEQ ID NO: 138294 - DNA, 20 bp, human
ggctgcaaaccagctctagg

SEQ ID NO: 138295 - DNA, 20 bp, human
gaggcgatctgaatgcaaca

SEQ ID NO: 138296 - DNA, 20 bp, human
gctgtggccgtggtccccgt

SEQ ID NO: 138297 - DNA, 20 bp, human
ggcaccgagagggactacgt

SEQ ID NO: 138298 - DNA, 20 bp, human
gggcgacgcgacagctctgg

SEQ ID NO: 138299 - DNA, 20 bp, human
gtcgcgccgagcggcaactc

SEQ ID NO: 138300 - DNA, 20 bp, human
gcaggcgccccatcccggac

SEQ ID NO: 138301 - DNA, 20 bp, human
ggggcgcgcggaaagcgggg

SEQ ID NO: 138302 - DNA, 20 bp, human
gagcggcaactcaggcgtcc

SEQ ID NO: 138303 - DNA, 20 bp, human
ggatctcgttgaggacgcag

SEQ ID NO: 138304 - DNA, 20 bp, human
gcgcggccgcgctagaatgg

SEQ ID NO: 138305 - DNA, 20 bp, human
ggcgtcctcaacgagatctt

SEQ ID NO: 138306 - DNA, 20 bp, human
gagaccgagcgggactatgt

SEQ ID NO: 138307 - DNA, 20 bp, human
gccatgagcgaggacagccg

SEQ ID NO: 138308 - DNA, 20 bp, human
ggcacttgagcagactgggg

SEQ ID NO: 138309 - DNA, 20 bp, human
gtagggcagccgggattccc

SEQ ID NO: 138310 - DNA, 20 bp, human
gctcggcgcggctgtctccg

SEQ ID NO: 138311 - DNA, 20 bp, human
gggcgggtaaaagaaaagtg

SEQ ID NO: 138312 - DNA, 20 bp, human
gtggctgcgggaaggacgcg

SEQ ID NO: 138313 - DNA, 20 bp, human
gcagccgggattccctggac

SEQ ID NO: 138314 - DNA, 20 bp, human
gcgcaactcagtgagtctcg

SEQ ID NO: 138315 - DNA, 20 bp, human
gtgtcctcgctcatggtcgg

SEQ ID NO: 138316 - DNA, 20 bp, human
gcaggagcctcggtgaagag

SEQ ID NO: 138317 - DNA, 20 bp, human
gggaatcccgtatagagaag

SEQ ID NO: 138318 - DNA, 20 bp, human
gctatacgggattccaggta

SEQ ID NO: 138319 - DNA, 20 bp, human
gagcgtggctcgccccaggg

SEQ ID NO: 138320 - DNA, 20 bp, human
gtcgccccagggaggcaaag

SEQ ID NO: 138321 - DNA, 20 bp, human
gagagaagcggctacacaga

SEQ ID NO: 138322 - DNA, 20 bp, human
gaggccaggggaatcttcaa

SEQ ID NO: 138323 - DNA, 20 bp, human
ggctcatcccagctaggagg

SEQ ID NO: 138324 - DNA, 20 bp, human
gccacagtgggctgcctggg

SEQ ID NO: 138325 - DNA, 20 bp, human
gcctagctgggatgagccca

SEQ ID NO: 138326 - DNA, 20 bp, human
gcccaggaaggtctctgggt

SEQ ID NO: 138327 - DNA, 20 bp, human
ggttatgaggatgtcagcag

SEQ ID NO: 138328 - DNA, 20 bp, human
ggaacgcagcaaaccctgag

SEQ ID NO: 138329 - DNA, 20 bp, human
gtgggaagatctaaagaccc

SEQ ID NO: 138330 - DNA, 20 bp, human
gcaggcccggaagtaaagaa

SEQ ID NO: 138331 - DNA, 20 bp, human
gaagacccaggaaggtctct

SEQ ID NO: 138332 - DNA, 20 bp, human
gcccgcagaaggaatgtgca

SEQ ID NO: 138333 - DNA, 20 bp, human
gtagaagagccagaagtaag

SEQ ID NO: 138334 - DNA, 20 bp, human
gcttagagtcgggcagtcat

SEQ ID NO: 138335 - DNA, 20 bp, human
ggggatgtgaaagtgctcct

SEQ ID NO: 138336 - DNA, 20 bp, human
gatggtgggagggataactc

SEQ ID NO: 138337 - DNA, 20 bp, human
gttcttcccagggcctacac

SEQ ID NO: 138338 - DNA, 20 bp, human
gacagccccaagaaggacgg

SEQ ID NO: 138339 - DNA, 20 bp, human
gagtggaggtctcagactct

SEQ ID NO: 138340 - DNA, 20 bp, human
gagcagacctgtccccgcag

SEQ ID NO: 138341 - DNA, 20 bp, human
gtgatactggagagcagcaa

SEQ ID NO: 138342 - DNA, 20 bp, human
ggaagaagcagcacctcata

SEQ ID NO: 138343 - DNA, 20 bp, human
gcctcatagggcaaacacgt

SEQ ID NO: 138344 - DNA, 20 bp, human
gggagagtctagaaaaggaa

SEQ ID NO: 138345 - DNA, 20 bp, human
gccctggcacatagtataga

SEQ ID NO: 138346 - DNA, 20 bp, human
gcggtacctgaaaacaacga

SEQ ID NO: 138347 - DNA, 20 bp, human
ggcagcaacaacaggtaaat

SEQ ID NO: 138348 - DNA, 20 bp, human
gttttcagcaagggtaccta

SEQ ID NO: 138349 - DNA, 20 bp, human
gtataagactcccaggacgt

SEQ ID NO: 138350 - DNA, 20 bp, human
ggatgaaccaattagtccaa

SEQ ID NO: 138351 - DNA, 20 bp, human
gtatatcagtgcaaatacag

SEQ ID NO: 138352 - DNA, 20 bp, human
gtaaaactctagccaaagta

SEQ ID NO: 138353 - DNA, 20 bp, human
gtaatgcaagcctaagttag

SEQ ID NO: 138354 - DNA, 20 bp, human
gaacaaattgttcaacatat

SEQ ID NO: 138355 - DNA, 20 bp, human
gaacagacagcagcaacaac

SEQ ID NO: 138356 - DNA, 20 bp, human
gaggccttgatgaggaatgg

SEQ ID NO: 138357 - DNA, 20 bp, human
gatgaggccttgatgaggaa

SEQ ID NO: 138358 - DNA, 20 bp, human
gagtggatgagcattaatga

SEQ ID NO: 138359 - DNA, 20 bp, human
gcagctcaggatttaaatga

SEQ ID NO: 138360 - DNA, 20 bp, human
ggtgcaacaaataaactatg

SEQ ID NO: 138361 - DNA, 20 bp, human
gctgcagagttctcatgctg

SEQ ID NO: 138362 - DNA, 20 bp, human
gttgcattatatagagacat

SEQ ID NO: 138363 - DNA, 20 bp, human
gaataaagaattcgtactag

SEQ ID NO: 138364 - DNA, 20 bp, human
gatgaaggtaagatgaattg

SEQ ID NO: 138365 - DNA, 20 bp, human
ggggactgctgtgaaggatg

SEQ ID NO: 138366 - DNA, 20 bp, human
gaggtcttgatgaggaatga

SEQ ID NO: 138367 - DNA, 20 bp, human
ggggactgctgggaaggata

SEQ ID NO: 138368 - DNA, 20 bp, human
gtgaaggtaagccgaattgg

SEQ ID NO: 138369 - DNA, 20 bp, human
gactcatccactgtccagca

SEQ ID NO: 138370 - DNA, 20 bp, human
gacgggcgaatgctatagag

SEQ ID NO: 138371 - DNA, 20 bp, human
gtatagagacatgggactgc

SEQ ID NO: 138372 - DNA, 20 bp, human
gctgaagagttctcatgcca

SEQ ID NO: 138373 - DNA, 20 bp, human
ggtgcaatcaataaattatg

SEQ ID NO: 138374 - DNA, 20 bp, human
gagatgaaggtaagccgaat

SEQ ID NO: 138375 - DNA, 20 bp, human
gcatgtgtttatctccttca

SEQ ID NO: 138376 - DNA, 20 bp, human
gtcggtgtcgcagaagatca

SEQ ID NO: 138377 - DNA, 20 bp, human
gtgggtgtcacagactccgg

SEQ ID NO: 138378 - DNA, 20 bp, human
gttccgggcgcgctgtcggg

SEQ ID NO: 138379 - DNA, 20 bp, human
gctgcaggcggagtgcgctc

SEQ ID NO: 138380 - DNA, 20 bp, human
gtgtgacacccagactgggt

SEQ ID NO: 138381 - DNA, 20 bp, human
gtgcgacaccgacccagtct

SEQ ID NO: 138382 - DNA, 20 bp, human
ggtctgggtgtcacagactc

SEQ ID NO: 138383 - DNA, 20 bp, human
gtcagggagaaggtcataat

SEQ ID NO: 138384 - DNA, 20 bp, human
gactccggcggtgccagcga

SEQ ID NO: 138385 - DNA, 20 bp, human
gtagggccgggcaccttcgc

SEQ ID NO: 138386 - DNA, 20 bp, human
gtagcctgggcgggcaccct

SEQ ID NO: 138387 - DNA, 20 bp, human
gacccgaaccgtggccctca

SEQ ID NO: 138388 - DNA, 20 bp, human
ggctggtgctcccggaaagg

SEQ ID NO: 138389 - DNA, 20 bp, human
gccaggccagcggccgccga

SEQ ID NO: 138390 - DNA, 20 bp, human
gccctcagggtcacagtctg

SEQ ID NO: 138391 - DNA, 20 bp, human
ggacagtgagacccgaaccg

SEQ ID NO: 138392 - DNA, 20 bp, human
gtccccgctagagctccaag

SEQ ID NO: 138393 - DNA, 20 bp, human
gggagcaccagcccggtcta

SEQ ID NO: 138394 - DNA, 20 bp, human
gactgtgaccctgagggcca

SEQ ID NO: 138395 - DNA, 20 bp, human
gtcactgtcgcccagccggg

SEQ ID NO: 138396 - DNA, 20 bp, human
ggaggttcctgctcaaccta

SEQ ID NO: 138397 - DNA, 20 bp, human
ggtgcggtgagcgggagtca

SEQ ID NO: 138398 - DNA, 20 bp, human
gaacatggcgcgcccgggca

SEQ ID NO: 138399 - DNA, 20 bp, human
ggcccgggcagggtcaagcc

SEQ ID NO: 138400 - DNA, 20 bp, human
ggcgaataggtgccccacag

SEQ ID NO: 138401 - DNA, 20 bp, human
gattgtgggagggaatcctg

SEQ ID NO: 138402 - DNA, 20 bp, human
ggctcaccgcacgcccggag

SEQ ID NO: 138403 - DNA, 20 bp, human
ggcccggcttgaccctgccc

SEQ ID NO: 138404 - DNA, 20 bp, human
gcgggacccacgcgcgaaca

SEQ ID NO: 138405 - DNA, 20 bp, human
gggtgccccacagaggatct

SEQ ID NO: 138406 - DNA, 20 bp, human
gggacagcgacgcacagcga

SEQ ID NO: 138407 - DNA, 20 bp, human
gggggaccaggactccgctg

SEQ ID NO: 138408 - DNA, 20 bp, human
gaggggcctgacggcagagt

SEQ ID NO: 138409 - DNA, 20 bp, human
ggccagaccgggaaccccag

SEQ ID NO: 138410 - DNA, 20 bp, human
ggagtcggtccagaactgcc

SEQ ID NO: 138411 - DNA, 20 bp, human
gccagctggcctgttagtaa

SEQ ID NO: 138412 - DNA, 20 bp, human
gtgagaccccagcggagtcc

SEQ ID NO: 138413 - DNA, 20 bp, human
ggtgttccagtgctaggtgg

SEQ ID NO: 138414 - DNA, 20 bp, human
gacccttccaatctccccaa

SEQ ID NO: 138415 - DNA, 20 bp, human
ggaggacttagggcttgggg

SEQ ID NO: 138416 - DNA, 20 bp, human
gtaaggattaccacaggaat

SEQ ID NO: 138417 - DNA, 20 bp, human
gtggcgagttccgcgctcaa

SEQ ID NO: 138418 - DNA, 20 bp, human
ggaccacgcagaggtaggag

SEQ ID NO: 138419 - DNA, 20 bp, human
ggcaccgctgcaggtaaacg

SEQ ID NO: 138420 - DNA, 20 bp, human
gcgcggaactcgccacggta

SEQ ID NO: 138421 - DNA, 20 bp, human
gcagctcgggcagctcggtg

SEQ ID NO: 138422 - DNA, 20 bp, human
gcacgcagaggtaggagcgg

SEQ ID NO: 138423 - DNA, 20 bp, human
gcctgtggtaatccttaccg

SEQ ID NO: 138424 - DNA, 20 bp, human
gggattaccacaggaattgg

SEQ ID NO: 138425 - DNA, 20 bp, human
gtacgccccagtaaccccct

SEQ ID NO: 138426 - DNA, 20 bp, human
ggggcagacacccaggtacc

SEQ ID NO: 138427 - DNA, 20 bp, human
gagccactgttcccgggtgg

SEQ ID NO: 138428 - DNA, 20 bp, human
gctcgggaaaacacaaacgg

SEQ ID NO: 138429 - DNA, 20 bp, human
gtcccgccacccgggaacag

SEQ ID NO: 138430 - DNA, 20 bp, human
gaaactcgggaaaacacaaa

SEQ ID NO: 138431 - DNA, 20 bp, human
ggttcatatgaaaccggaag

SEQ ID NO: 138432 - DNA, 20 bp, human
gcaactcctccctggtacct

SEQ ID NO: 138433 - DNA, 20 bp, human
gatgaactctcccgccaccc

SEQ ID NO: 138434 - DNA, 20 bp, human
gtgtaggttctggctaaatg

SEQ ID NO: 138435 - DNA, 20 bp, human
gcctgcaagaattcaaactc

SEQ ID NO: 138436 - DNA, 20 bp, human
ggcccgggagcgggagatcg

SEQ ID NO: 138437 - DNA, 20 bp, human
gtgggcggaggcgtgcaaag

SEQ ID NO: 138438 - DNA, 20 bp, human
gggagcggcgtcctcgcacg

SEQ ID NO: 138439 - DNA, 20 bp, human
gagggtgcgggcggagatgg

SEQ ID NO: 138440 - DNA, 20 bp, human
gcgccaggcaaggtagcgtg

SEQ ID NO: 138441 - DNA, 20 bp, human
gattgcgcacactgcaacat

SEQ ID NO: 138442 - DNA, 20 bp, human
ggaggtccgcgttccccccg

SEQ ID NO: 138443 - DNA, 20 bp, human
gccctgggctcggggaaaag

SEQ ID NO: 138444 - DNA, 20 bp, human
gggtgcaggcaggagtcggt

SEQ ID NO: 138445 - DNA, 20 bp, human
ggtgcatgcagggtcagcga

SEQ ID NO: 138446 - DNA, 20 bp, human
ggcccaacgggtacctagaa

SEQ ID NO: 138447 - DNA, 20 bp, human
gtagtcagagcctgacacac

SEQ ID NO: 138448 - DNA, 20 bp, human
gtcccagcgcgggattctgg

SEQ ID NO: 138449 - DNA, 20 bp, human
gcgctgggagcggaagcccg

SEQ ID NO: 138450 - DNA, 20 bp, human
gggtcttcctgagagtccgc

SEQ ID NO: 138451 - DNA, 20 bp, human
gcggaagcccgcggactctc

SEQ ID NO: 138452 - DNA, 20 bp, human
ggccgggccgagcctcaggg

SEQ ID NO: 138453 - DNA, 20 bp, human
ggaaaccgcgccaggcccaa

SEQ ID NO: 138454 - DNA, 20 bp, human
gccctgatgacaggaggtta

SEQ ID NO: 138455 - DNA, 20 bp, human
gctgagggtaacccaaagaa

SEQ ID NO: 138456 - DNA, 20 bp, human
gcgtgtcacccagaatgtag

SEQ ID NO: 138457 - DNA, 20 bp, human
ggggccaagcctagtcccgc

SEQ ID NO: 138458 - DNA, 20 bp, human
gcgagaagcagaaacacgac

SEQ ID NO: 138459 - DNA, 20 bp, human
ggcgccgggcgcgatccccg

SEQ ID NO: 138460 - DNA, 20 bp, human
gagatcggccactacattct

SEQ ID NO: 138461 - DNA, 20 bp, human
gccgggcgcgatccccgggg

SEQ ID NO: 138462 - DNA, 20 bp, human
gacgaggggctgggatgcga

SEQ ID NO: 138463 - DNA, 20 bp, human
gctggaaagaagggacgcag

SEQ ID NO: 138464 - DNA, 20 bp, human
ggagagctcccgcaggatcc

SEQ ID NO: 138465 - DNA, 20 bp, human
gaggccccgcagcctacgtc

SEQ ID NO: 138466 - DNA, 20 bp, human
gcggcggcggctacgcggag

SEQ ID NO: 138467 - DNA, 20 bp, human
gctgcactgtgggtaggcgg

SEQ ID NO: 138468 - DNA, 20 bp, human
gtgagaagcagaagcacgac

SEQ ID NO: 138469 - DNA, 20 bp, human
gaggccgcgcgcgccgaaga

SEQ ID NO: 138470 - DNA, 20 bp, human
gggctacgcggagcggcagg

SEQ ID NO: 138471 - DNA, 20 bp, human
gcttgctccgacctccagaa

SEQ ID NO: 138472 - DNA, 20 bp, human
gggcccgctgcactgtgggt

SEQ ID NO: 138473 - DNA, 20 bp, human
gcgcagggcccgctgcactg

SEQ ID NO: 138474 - DNA, 20 bp, human
gagctgaggatgggcgtcct

SEQ ID NO: 138475 - DNA, 20 bp, human
gcatctgcctttctggaggt

SEQ ID NO: 138476 - DNA, 20 bp, human
gtacctgcccaggcaagccg

SEQ ID NO: 138477 - DNA, 20 bp, human
ggccgcggcaagaacgcaag

SEQ ID NO: 138478 - DNA, 20 bp, human
gagcggaagtcgctgagggg

SEQ ID NO: 138479 - DNA, 20 bp, human
gtcgctgaggggtggtgaag

SEQ ID NO: 138480 - DNA, 20 bp, human
gggaaagggaccctgagcaa

SEQ ID NO: 138481 - DNA, 20 bp, human
gttcttgccgcggcttgcct

SEQ ID NO: 138482 - DNA, 20 bp, human
gggaagcggaagtcgctgag

SEQ ID NO: 138483 - DNA, 20 bp, human
gaccctgagcaagggactcc

SEQ ID NO: 138484 - DNA, 20 bp, human
gggatgtgacgggaatctag

SEQ ID NO: 138485 - DNA, 20 bp, human
gcaaggtgcgagcggtgtgg

SEQ ID NO: 138486 - DNA, 20 bp, human
gcccgaggtgactggagtgg

SEQ ID NO: 138487 - DNA, 20 bp, human
gtcgcccgaggtgactggag

SEQ ID NO: 138488 - DNA, 20 bp, human
gggagcacaagatcatggtg

SEQ ID NO: 138489 - DNA, 20 bp, human
gggagggagcgcatcgcccg

SEQ ID NO: 138490 - DNA, 20 bp, human
gcatcagtggcccttggagg

SEQ ID NO: 138491 - DNA, 20 bp, human
gcgcaggcggccatgccccg

SEQ ID NO: 138492 - DNA, 20 bp, human
gccaaggctgcacgctccga

SEQ ID NO: 138493 - DNA, 20 bp, human
gagggaggctgaacacgctg

SEQ ID NO: 138494 - DNA, 20 bp, human
ggcccctgcgcctcgggaca

SEQ ID NO: 138495 - DNA, 20 bp, human
gagaacagccatcacatcag

SEQ ID NO: 138496 - DNA, 20 bp, human
ggcgggggcgtcacagacag

SEQ ID NO: 138497 - DNA, 20 bp, human
gagacagcggcagagatctt

SEQ ID NO: 138498 - DNA, 20 bp, human
gggaaggggacccctacagg

SEQ ID NO: 138499 - DNA, 20 bp, human
gccgcagagtaccccctgta

SEQ ID NO: 138500 - DNA, 20 bp, human
gacgccgccgccgccaagaa

SEQ ID NO: 138501 - DNA, 20 bp, human
gcagcgcagggccaagatcg

SEQ ID NO: 138502 - DNA, 20 bp, human
gttgggctgaggttcccggg

SEQ ID NO: 138503 - DNA, 20 bp, human
gcggtcatacgtgccatggt

SEQ ID NO: 138504 - DNA, 20 bp, human
gtggggcggccctaggggaa

SEQ ID NO: 138505 - DNA, 20 bp, human
ggaccgctggggccccacat

SEQ ID NO: 138506 - DNA, 20 bp, human
gaagtgtaaatgcacatgaa

SEQ ID NO: 138507 - DNA, 20 bp, human
gctgtatactggttacaagg

SEQ ID NO: 138508 - DNA, 20 bp, human
gagagtgtctatgaaataac

SEQ ID NO: 138509 - DNA, 20 bp, human
gttacttgatctgtcccata

SEQ ID NO: 138510 - DNA, 20 bp, human
gttcagctttcatcattgta

SEQ ID NO: 138511 - DNA, 20 bp, human
gtgtagttgtacctgtatac

SEQ ID NO: 138512 - DNA, 20 bp, human
gtatttcatagacactctaa

SEQ ID NO: 138513 - DNA, 20 bp, human
ggtttgaataccctgcaaac

SEQ ID NO: 138514 - DNA, 20 bp, human
gcatgatcagaaaacagctc

SEQ ID NO: 138515 - DNA, 20 bp, human
gactacagctcttcagaaat

SEQ ID NO: 138516 - DNA, 20 bp, human
gacctgggcggcatagaaac

SEQ ID NO: 138517 - DNA, 20 bp, human
gctgtagaggaaatctcctc

SEQ ID NO: 138518 - DNA, 20 bp, human
gtggacggccaggacgacct

SEQ ID NO: 138519 - DNA, 20 bp, human
ggccaagaaggacaccgagc

SEQ ID NO: 138520 - DNA, 20 bp, human
gagcgagtgtaggtactgga

SEQ ID NO: 138521 - DNA, 20 bp, human
ggtcgagcgagtgtaggtac

SEQ ID NO: 138522 - DNA, 20 bp, human
ggatgaggtcgagcgagtgt

SEQ ID NO: 138523 - DNA, 20 bp, human
gtgaggcaccaggagaccgg

SEQ ID NO: 138524 - DNA, 20 bp, human
ggcggcatagaaacaggcat

SEQ ID NO: 138525 - DNA, 20 bp, human
gggagaactggagcttgacg

SEQ ID NO: 138526 - DNA, 20 bp, human
gagccgggcgcctcttgcaa

SEQ ID NO: 138527 - DNA, 20 bp, human
ggcgcctcttgcaatggaga

SEQ ID NO: 138528 - DNA, 20 bp, human
gtcttgcaatggagacggtg

SEQ ID NO: 138529 - DNA, 20 bp, human
gctgcaagcggagatccctc

SEQ ID NO: 138530 - DNA, 20 bp, human
gtggagacggtgaggagtgc

SEQ ID NO: 138531 - DNA, 20 bp, human
gagtgcaggagggcggtcgg

SEQ ID NO: 138532 - DNA, 20 bp, human
ggatcacagaaagaccatcg

SEQ ID NO: 138533 - DNA, 20 bp, human
gggccctcccggtctcctaa

SEQ ID NO: 138534 - DNA, 20 bp, human
gtccaggagctacctgcaag

SEQ ID NO: 138535 - DNA, 20 bp, human
gggtagctcctggacctcga

SEQ ID NO: 138536 - DNA, 20 bp, human
gtccctctcgcccagaaagg

SEQ ID NO: 138537 - DNA, 20 bp, human
gctccgcggaagtccccacg

SEQ ID NO: 138538 - DNA, 20 bp, human
gtctcgcccagaaaggagga

SEQ ID NO: 138539 - DNA, 20 bp, human
gcaccctgaagccacctcgt

SEQ ID NO: 138540 - DNA, 20 bp, human
gcacctcgtggggacttccg

SEQ ID NO: 138541 - DNA, 20 bp, human
gtctgtgggaggagccgaga

SEQ ID NO: 138542 - DNA, 20 bp, human
gccggccgctgccttcggac

SEQ ID NO: 138543 - DNA, 20 bp, human
gccctccctctcgcccagaa

SEQ ID NO: 138544 - DNA, 20 bp, human
gggagacaccagaaccggga

SEQ ID NO: 138545 - DNA, 20 bp, human
gtccccacgaggtggcttca

SEQ ID NO: 138546 - DNA, 20 bp, human
ggagcaagtgtgcgacactg

SEQ ID NO: 138547 - DNA, 20 bp, human
ggcagtgcgtgctccagccc

SEQ ID NO: 138548 - DNA, 20 bp, human
gcgcactgcgcagggtatgg

SEQ ID NO: 138549 - DNA, 20 bp, human
ggctccaggaaggggtctgt

SEQ ID NO: 138550 - DNA, 20 bp, human
gcttgctctcagttggtctg

SEQ ID NO: 138551 - DNA, 20 bp, human
ggaaggggtttgggaatgta

SEQ ID NO: 138552 - DNA, 20 bp, human
ggggttctgagcatcaaggt

SEQ ID NO: 138553 - DNA, 20 bp, human
gaagaggttaggccccaggg

SEQ ID NO: 138554 - DNA, 20 bp, human
gcttcctggagcagccttgg

SEQ ID NO: 138555 - DNA, 20 bp, human
ggcacgcactgcgcagggta

SEQ ID NO: 138556 - DNA, 20 bp, human
gagagcaggcggaggaacaa

SEQ ID NO: 138557 - DNA, 20 bp, human
gccgctatcgcagagtggag

SEQ ID NO: 138558 - DNA, 20 bp, human
ggaggagcggagggacgaga

SEQ ID NO: 138559 - DNA, 20 bp, human
gcctagccgctatcgcagag

SEQ ID NO: 138560 - DNA, 20 bp, human
gggctaggcgacagctccac

SEQ ID NO: 138561 - DNA, 20 bp, human
gaaggcagaggcgtcaaggg

SEQ ID NO: 138562 - DNA, 20 bp, human
ggttgtccttcaggaaatgg

SEQ ID NO: 138563 - DNA, 20 bp, human
gagggtgagcgaagaggccg

SEQ ID NO: 138564 - DNA, 20 bp, human
gcttccaagagcgaccaggg

SEQ ID NO: 138565 - DNA, 20 bp, human
gggcgtcaagggaggccgga

SEQ ID NO: 138566 - DNA, 20 bp, human
gcagaaacgcaggtaaacaa

SEQ ID NO: 138567 - DNA, 20 bp, human
gtgcgggagaacaaatgcgg

SEQ ID NO: 138568 - DNA, 20 bp, human
gaaacaagggaagctggcgg

SEQ ID NO: 138569 - DNA, 20 bp, human
gccctcccgggacccctgac

SEQ ID NO: 138570 - DNA, 20 bp, human
gccgcgcagcgaagtcacca

SEQ ID NO: 138571 - DNA, 20 bp, human
gccccgcgtacctggatgcg

SEQ ID NO: 138572 - DNA, 20 bp, human
gggtcctgcgccccgcggtg

SEQ ID NO: 138573 - DNA, 20 bp, human
ggctggggcggcctctgcac

SEQ ID NO: 138574 - DNA, 20 bp, human
gcgccggcgaggaccctccc

SEQ ID NO: 138575 - DNA, 20 bp, human
ggggcggcgccgctgcagtg

SEQ ID NO: 138576 - DNA, 20 bp, human
gggcgcagctgcagctctcg

SEQ ID NO: 138577 - DNA, 20 bp, human
ggcggcgaaggggtcgagca

SEQ ID NO: 138578 - DNA, 20 bp, human
ggcagagcgtcgtccaggtg

SEQ ID NO: 138579 - DNA, 20 bp, human
ggcgcgccgcagggcctcca

SEQ ID NO: 138580 - DNA, 20 bp, human
ggcctggccgtggacctgtg

SEQ ID NO: 138581 - DNA, 20 bp, human
gtggaaagcggtggggtcgg

SEQ ID NO: 138582 - DNA, 20 bp, human
gcagcagtaggcgcgcccag

SEQ ID NO: 138583 - DNA, 20 bp, human
gggcgtggcctgcgccaggg

SEQ ID NO: 138584 - DNA, 20 bp, human
gcagcaagcgcggcagcagt

SEQ ID NO: 138585 - DNA, 20 bp, human
gggggccctggaaagcggtg

SEQ ID NO: 138586 - DNA, 20 bp, human
gggcggctgcccagtgacag

SEQ ID NO: 138587 - DNA, 20 bp, human
gtgcccgtcggtccccgcgg

SEQ ID NO: 138588 - DNA, 20 bp, human
gctccagaggtctagagggg

SEQ ID NO: 138589 - DNA, 20 bp, human
gcgcagagccggccaaagag

SEQ ID NO: 138590 - DNA, 20 bp, human
gcggcggccgaagggataga

SEQ ID NO: 138591 - DNA, 20 bp, human
gtgagtgagcgcggagacag

SEQ ID NO: 138592 - DNA, 20 bp, human
ggtggcggcgggcaggactg

SEQ ID NO: 138593 - DNA, 20 bp, human
gggtcggccgtggtagcgta

SEQ ID NO: 138594 - DNA, 20 bp, human
gcaccgccgccgctgtcact

SEQ ID NO: 138595 - DNA, 20 bp, human
gacgggcaggcgagctggac

SEQ ID NO: 138596 - DNA, 20 bp, human
ggcgcgtctgctccgtgtgg

SEQ ID NO: 138597 - DNA, 20 bp, human
gggcgcgcgtctgctccgtg

SEQ ID NO: 138598 - DNA, 20 bp, human
gcctcggagtcggactgcat

SEQ ID NO: 138599 - DNA, 20 bp, human
gtccgactccgaggacgggg

SEQ ID NO: 138600 - DNA, 20 bp, human
ggatgctgccagccctcccg

SEQ ID NO: 138601 - DNA, 20 bp, human
gccgcgcgcttcggccatga

SEQ ID NO: 138602 - DNA, 20 bp, human
gtcggactgcatgggctcct

SEQ ID NO: 138603 - DNA, 20 bp, human
gcaggcgcctgccgccccgg

SEQ ID NO: 138604 - DNA, 20 bp, human
gcgtctgctccgtgtggtgg

SEQ ID NO: 138605 - DNA, 20 bp, human
ggagatcccggcgggactga

SEQ ID NO: 138606 - DNA, 20 bp, human
gccccggcggaggcaagagg

SEQ ID NO: 138607 - DNA, 20 bp, human
ggcaccagcccgactctccc

SEQ ID NO: 138608 - DNA, 20 bp, human
gttcccgggcaacgactcca

SEQ ID NO: 138609 - DNA, 20 bp, human
gggcggaggcaagaggtggt

SEQ ID NO: 138610 - DNA, 20 bp, human
gggctggtgctgcgcggagc

SEQ ID NO: 138611 - DNA, 20 bp, human
gccgggctgtcagtgagcct

SEQ ID NO: 138612 - DNA, 20 bp, human
ggccacgtcctgagacgccg

SEQ ID NO: 138613 - DNA, 20 bp, human
gatctggtaggtgccgggcc

SEQ ID NO: 138614 - DNA, 20 bp, human
gggggcaggagtgcccggcc

SEQ ID NO: 138615 - DNA, 20 bp, human
ggggccggtggccgaggtcg

SEQ ID NO: 138616 - DNA, 20 bp, human
gccaagcgcagctggacgag

SEQ ID NO: 138617 - DNA, 20 bp, human
ggctgggcgagtgacagccc

SEQ ID NO: 138618 - DNA, 20 bp, human
ggccgccagagccggcgcag

SEQ ID NO: 138619 - DNA, 20 bp, human
gccggagacgcggggtccca

SEQ ID NO: 138620 - DNA, 20 bp, human
gcgagggcagcgccgcgcca

SEQ ID NO: 138621 - DNA, 20 bp, human
ggcgcgcaagatggctgacc

SEQ ID NO: 138622 - DNA, 20 bp, human
gcccggggccggcacctctc

SEQ ID NO: 138623 - DNA, 20 bp, human
ggcaccttcccgggcccccg

SEQ ID NO: 138624 - DNA, 20 bp, human
gccccgcgtctccggactcc

SEQ ID NO: 138625 - DNA, 20 bp, human
gcgcccgcaaaggcgccctc

SEQ ID NO: 138626 - DNA, 20 bp, human
gggggtcgctcgggagatgt

SEQ ID NO: 138627 - DNA, 20 bp, human
gggcacacggaagtgcgagg

SEQ ID NO: 138628 - DNA, 20 bp, human
gggagcgggagacacacggg

SEQ ID NO: 138629 - DNA, 20 bp, human
ggtgtccctccgctagacag

SEQ ID NO: 138630 - DNA, 20 bp, human
gcagggcccgggagagagtc

SEQ ID NO: 138631 - DNA, 20 bp, human
ggacagggggacggagtcac

SEQ ID NO: 138632 - DNA, 20 bp, human
gtgtgggctacagccgcctc

SEQ ID NO: 138633 - DNA, 20 bp, human
gccgggagcgggcagacaga

SEQ ID NO: 138634 - DNA, 20 bp, human
gctgcaacgggaggtaagtg

SEQ ID NO: 138635 - DNA, 20 bp, human
gggcccgggccacacctcac

SEQ ID NO: 138636 - DNA, 20 bp, human
ggagcggtcagggatcatga

SEQ ID NO: 138637 - DNA, 20 bp, human
ggcggctggaggccaaccac

SEQ ID NO: 138638 - DNA, 20 bp, human
ggcaggcagacggagcagag

SEQ ID NO: 138639 - DNA, 20 bp, human
gagacggagcagagcggtca

SEQ ID NO: 138640 - DNA, 20 bp, human
gatcatgagggagagtgcgt

SEQ ID NO: 138641 - DNA, 20 bp, human
ggaggcccctgaccgtagtg

SEQ ID NO: 138642 - DNA, 20 bp, human
ggaccttgaagagcagaacg

SEQ ID NO: 138643 - DNA, 20 bp, human
gggagagtgcgttggagcgg

SEQ ID NO: 138644 - DNA, 20 bp, human
gccggcaaaggcctcggatt

SEQ ID NO: 138645 - DNA, 20 bp, human
gtcaaacggtccccaatccg

SEQ ID NO: 138646 - DNA, 20 bp, human
gccgcgcgggctcggagtcc

SEQ ID NO: 138647 - DNA, 20 bp, human
gctgcgcccccgagccggat

SEQ ID NO: 138648 - DNA, 20 bp, human
gcgcccccgagccggatcgg

SEQ ID NO: 138649 - DNA, 20 bp, human
gggccgccgatccggctcgg

SEQ ID NO: 138650 - DNA, 20 bp, human
ggggcggggacgagaaccgg

SEQ ID NO: 138651 - DNA, 20 bp, human
ggccggagccggcgatcggg

SEQ ID NO: 138652 - DNA, 20 bp, human
ggagtgtgcgaagaggatcc

SEQ ID NO: 138653 - DNA, 20 bp, human
ggctccgctgcaagccgcgg

SEQ ID NO: 138654 - DNA, 20 bp, human
gccccgccccgcgcggtcag

SEQ ID NO: 138655 - DNA, 20 bp, human
gctccggactgcgggaaagc

SEQ ID NO: 138656 - DNA, 20 bp, human
gcagccggaggcacgggcgg

SEQ ID NO: 138657 - DNA, 20 bp, human
gagaggagctggagactcga

SEQ ID NO: 138658 - DNA, 20 bp, human
gcacagggaaattccgaggt

SEQ ID NO: 138659 - DNA, 20 bp, human
gttgcagaaagggggccctg

SEQ ID NO: 138660 - DNA, 20 bp, human
gaggcagggagcggcacccc

SEQ ID NO: 138661 - DNA, 20 bp, human
gtggagactcgaaggatcaa

SEQ ID NO: 138662 - DNA, 20 bp, human
gtgggggacgaggggactag

SEQ ID NO: 138663 - DNA, 20 bp, human
ggagccacagggaaattccg

SEQ ID NO: 138664 - DNA, 20 bp, human
ggcgtaggcgattcagaggg

SEQ ID NO: 138665 - DNA, 20 bp, human
gggcaaggcacctccaggtg

SEQ ID NO: 138666 - DNA, 20 bp, human
ggggtaggtccggctctcca

SEQ ID NO: 138667 - DNA, 20 bp, human
gaggactcgccccttctcca

SEQ ID NO: 138668 - DNA, 20 bp, human
gctcaccggacgggtaggtc

SEQ ID NO: 138669 - DNA, 20 bp, human
ggggctggggctcaccggac

SEQ ID NO: 138670 - DNA, 20 bp, human
gccgcatcggtgaggcagtg

SEQ ID NO: 138671 - DNA, 20 bp, human
gtggggctcaccggacgggt

SEQ ID NO: 138672 - DNA, 20 bp, human
gggcgcagggaccagcgggt

SEQ ID NO: 138673 - DNA, 20 bp, human
gggagggaaaagtcccacgg

SEQ ID NO: 138674 - DNA, 20 bp, human
gagagccggacctacccgtc

SEQ ID NO: 138675 - DNA, 20 bp, human
gtcctgcgcgagtccccggg

SEQ ID NO: 138676 - DNA, 20 bp, human
ggtgagtgacgaagtgatag

SEQ ID NO: 138677 - DNA, 20 bp, human
ggggcggctccggtgactca

SEQ ID NO: 138678 - DNA, 20 bp, human
gcccgcaccgccatacctgg

SEQ ID NO: 138679 - DNA, 20 bp, human
gtgcgcttgccggagaaccg

SEQ ID NO: 138680 - DNA, 20 bp, human
ggcccgggcggctgtagagg

SEQ ID NO: 138681 - DNA, 20 bp, human
ggtgacgaagtgataggggt

SEQ ID NO: 138682 - DNA, 20 bp, human
gcaggcggcggagtccccca

SEQ ID NO: 138683 - DNA, 20 bp, human
gcaaggggatgcagtactgg

SEQ ID NO: 138684 - DNA, 20 bp, human
gtagaggcggcggcgcctac

SEQ ID NO: 138685 - DNA, 20 bp, human
ggccagagtagggtccgaga

SEQ ID NO: 138686 - DNA, 20 bp, human
ggccgtgctcgctccaggta

SEQ ID NO: 138687 - DNA, 20 bp, human
ggccctacctggagcgagca

SEQ ID NO: 138688 - DNA, 20 bp, human
gtgcgggtgcgcctagaagg

SEQ ID NO: 138689 - DNA, 20 bp, human
gtctgggacgcaggtcgcac

SEQ ID NO: 138690 - DNA, 20 bp, human
gccgggtgagcaggcggagt

SEQ ID NO: 138691 - DNA, 20 bp, human
gcgcgcagtcccagcgccac

SEQ ID NO: 138692 - DNA, 20 bp, human
ggcggcgccgtgctcgctcc

SEQ ID NO: 138693 - DNA, 20 bp, human
gagtaggaaatggaaccaag

SEQ ID NO: 138694 - DNA, 20 bp, human
gagcgggcgcaagagcgcac

SEQ ID NO: 138695 - DNA, 20 bp, human
gctggaggggccgagacccg

SEQ ID NO: 138696 - DNA, 20 bp, human
gcgcggctgctggacaagag

SEQ ID NO: 138697 - DNA, 20 bp, human
gctacacgaggccggagcaa

SEQ ID NO: 138698 - DNA, 20 bp, human
gctttctgcagcaggaaccg

SEQ ID NO: 138699 - DNA, 20 bp, human
gtgtgaacgagcgggtggga

SEQ ID NO: 138700 - DNA, 20 bp, human
gtaggtgtgaacgagcgggt

SEQ ID NO: 138701 - DNA, 20 bp, human
ggctcgttcacacctacacg

SEQ ID NO: 138702 - DNA, 20 bp, human
gggcccgaaacgggttctgt

SEQ ID NO: 138703 - DNA, 20 bp, human
ggacgctctgaggcccgaaa

SEQ ID NO: 138704 - DNA, 20 bp, human
gccgaaacgggttctgtggg

SEQ ID NO: 138705 - DNA, 20 bp, human
gcgggaattgggtcacaatt

SEQ ID NO: 138706 - DNA, 20 bp, human
gcgggcctggagacatgagg

SEQ ID NO: 138707 - DNA, 20 bp, human
gctgtgcagcgcacaggcag

SEQ ID NO: 138708 - DNA, 20 bp, human
ggagcatctgtgcagcgcac

SEQ ID NO: 138709 - DNA, 20 bp, human
gtcatgtctccaggcccggg

SEQ ID NO: 138710 - DNA, 20 bp, human
ggatgctccgggcagcaaca

SEQ ID NO: 138711 - DNA, 20 bp, human
ggctggctacagcttcccgg

SEQ ID NO: 138712 - DNA, 20 bp, human
gtccaggcccgggtggtacc

SEQ ID NO: 138713 - DNA, 20 bp, human
gtcaggggaaacgcagtgag

SEQ ID NO: 138714 - DNA, 20 bp, human
gagacccaaaatgctgactc

SEQ ID NO: 138715 - DNA, 20 bp, human
gggagatgcccccgactcac

SEQ ID NO: 138716 - DNA, 20 bp, human
gaggcagcgctcaggaccga

SEQ ID NO: 138717 - DNA, 20 bp, human
ggccgacccggtcaactccg

SEQ ID NO: 138718 - DNA, 20 bp, human
gggagttccgcggagttgac

SEQ ID NO: 138719 - DNA, 20 bp, human
gtccgcggagttgaccgggt

SEQ ID NO: 138720 - DNA, 20 bp, human
gcaactccgcggaactccgg

SEQ ID NO: 138721 - DNA, 20 bp, human
gggccgaccccagggaaacc

SEQ ID NO: 138722 - DNA, 20 bp, human
ggcgcgccgccggagttccg

SEQ ID NO: 138723 - DNA, 20 bp, human
gccagggaaacccggtcccg

SEQ ID NO: 138724 - DNA, 20 bp, human
ggtccgcgggtgacgctcac

SEQ ID NO: 138725 - DNA, 20 bp, human
ggtggggccgcggcggaacg

SEQ ID NO: 138726 - DNA, 20 bp, human
gtggcgcgctcggaaggacg

SEQ ID NO: 138727 - DNA, 20 bp, human
gccaggcggcagattcttgg

SEQ ID NO: 138728 - DNA, 20 bp, human
gggcggccgcaggaccggag

SEQ ID NO: 138729 - DNA, 20 bp, human
gagtccgctgctgcccgtgg

SEQ ID NO: 138730 - DNA, 20 bp, human
gaccagtgcggcggccgctg

SEQ ID NO: 138731 - DNA, 20 bp, human
ggcgccaggcggcagattct

SEQ ID NO: 138732 - DNA, 20 bp, human
gggcggcagattcttggcgg

SEQ ID NO: 138733 - DNA, 20 bp, human
gctgtcgcggccccggtcgg

SEQ ID NO: 138734 - DNA, 20 bp, human
gtccttccgagcgcgccagg

SEQ ID NO: 138735 - DNA, 20 bp, human
gggggccgccggcactgggg

SEQ ID NO: 138736 - DNA, 20 bp, human
gcggcccaggaggaagtgtc

SEQ ID NO: 138737 - DNA, 20 bp, human
gccgccgccgacttaaactt

SEQ ID NO: 138738 - DNA, 20 bp, human
ggcctgagaggaaatctagt

SEQ ID NO: 138739 - DNA, 20 bp, human
gcctccaaagtttaagtcgg

SEQ ID NO: 138740 - DNA, 20 bp, human
gacccgaccggccaggggat

SEQ ID NO: 138741 - DNA, 20 bp, human
gctagtaggtcggggtcaca

SEQ ID NO: 138742 - DNA, 20 bp, human
ggaggaaatctagtaggtcg

SEQ ID NO: 138743 - DNA, 20 bp, human
gggctcccagaagatcagaa

SEQ ID NO: 138744 - DNA, 20 bp, human
gaaggccccttccctagagg

SEQ ID NO: 138745 - DNA, 20 bp, human
gaggagagcccgcgattcaa

SEQ ID NO: 138746 - DNA, 20 bp, human
gcgtccggagacatccagga

SEQ ID NO: 138747 - DNA, 20 bp, human
ggcggactgtgaccctccca

SEQ ID NO: 138748 - DNA, 20 bp, human
ggacatccaggagggcgacc

SEQ ID NO: 138749 - DNA, 20 bp, human
gccaggttccggaaaattcg

SEQ ID NO: 138750 - DNA, 20 bp, human
gtccggaacctggcggaggt

SEQ ID NO: 138751 - DNA, 20 bp, human
gcgctcgtccggagacatcc

SEQ ID NO: 138752 - DNA, 20 bp, human
gttcgaggtgtccacgctcc

SEQ ID NO: 138753 - DNA, 20 bp, human
ggtccgcccgctgctgaagg

SEQ ID NO: 138754 - DNA, 20 bp, human
gggtggtgctgtcgggtgag

SEQ ID NO: 138755 - DNA, 20 bp, human
ggagagtggctccgggagcg

SEQ ID NO: 138756 - DNA, 20 bp, human
gccgaggcgactacttacag

SEQ ID NO: 138757 - DNA, 20 bp, human
gcgggcgcggtggtctccag

SEQ ID NO: 138758 - DNA, 20 bp, human
gagcgtctgagtaccggacg

SEQ ID NO: 138759 - DNA, 20 bp, human
gtccgcgcggagggcaactt

SEQ ID NO: 138760 - DNA, 20 bp, human
gtccggtactcagacgctgg

SEQ ID NO: 138761 - DNA, 20 bp, human
ggcctcgctggcgcctcgtc

SEQ ID NO: 138762 - DNA, 20 bp, human
gcccgccagcgtctgagtac

SEQ ID NO: 138763 - DNA, 20 bp, human
gaggcgggcgggatcctgcg

SEQ ID NO: 138764 - DNA, 20 bp, human
ggccgccgcgtgcagttggg

SEQ ID NO: 138765 - DNA, 20 bp, human
gaccggacgaggcgccagcg

SEQ ID NO: 138766 - DNA, 20 bp, human
ggcgggactcggcggcatgg

SEQ ID NO: 138767 - DNA, 20 bp, human
gagcagggagcaacgcacac

SEQ ID NO: 138768 - DNA, 20 bp, human
gcattgctatgcagagtggg

SEQ ID NO: 138769 - DNA, 20 bp, human
gggccagggcagcaccgcag

SEQ ID NO: 138770 - DNA, 20 bp, human
ggtgaaaacgacccctaata

SEQ ID NO: 138771 - DNA, 20 bp, human
gggagcgggactcggcggca

SEQ ID NO: 138772 - DNA, 20 bp, human
gcagcggtccgcagcggaca

SEQ ID NO: 138773 - DNA, 20 bp, human
ggcaccgcagcggtccgcag

SEQ ID NO: 138774 - DNA, 20 bp, human
gcccggctccagaacgactc

SEQ ID NO: 138775 - DNA, 20 bp, human
ggcgggcgcacgcgcgggag

SEQ ID NO: 138776 - DNA, 20 bp, human
ggaggaagggcagctctaat

SEQ ID NO: 138777 - DNA, 20 bp, human
ggggcactgggagcaccgac

SEQ ID NO: 138778 - DNA, 20 bp, human
gctcacggagtgactaggag

SEQ ID NO: 138779 - DNA, 20 bp, human
gtccttgagcatgagaatct

SEQ ID NO: 138780 - DNA, 20 bp, human
ggacaagcacagcacgtgat

SEQ ID NO: 138781 - DNA, 20 bp, human
ggtattctcacggagtgact

SEQ ID NO: 138782 - DNA, 20 bp, human
gtggcgcgcgcgtattctca

SEQ ID NO: 138783 - DNA, 20 bp, human
ggtggtccgggggccgatgt

SEQ ID NO: 138784 - DNA, 20 bp, human
gcgcgggtgagcgagtgaat

SEQ ID NO: 138785 - DNA, 20 bp, human
ggaggagaggatcaaagagc

SEQ ID NO: 138786 - DNA, 20 bp, human
gccggctgggtgtggaatag

SEQ ID NO: 138787 - DNA, 20 bp, human
gcacaagcaagagaccggct

SEQ ID NO: 138788 - DNA, 20 bp, human
gccggctacgtgtgagccgg

SEQ ID NO: 138789 - DNA, 20 bp, human
gaacagcacaagcaagagac

SEQ ID NO: 138790 - DNA, 20 bp, human
ggcgcgggttagcgcgatgc

SEQ ID NO: 138791 - DNA, 20 bp, human
ggcgtttcgtgagctcctgg

SEQ ID NO: 138792 - DNA, 20 bp, human
gtctgcaccggcccccgccg

SEQ ID NO: 138793 - DNA, 20 bp, human
ggctgccggctcagtcgctc

SEQ ID NO: 138794 - DNA, 20 bp, human
ggcgttgcattcgctcggtg

SEQ ID NO: 138795 - DNA, 20 bp, human
gggtgcagaggagacacgca

SEQ ID NO: 138796 - DNA, 20 bp, human
gccgccagggaccacgagag

SEQ ID NO: 138797 - DNA, 20 bp, human
gcggtcggcgcgcccgggaa

SEQ ID NO: 138798 - DNA, 20 bp, human
gggctggaggaagagcggtg

SEQ ID NO: 138799 - DNA, 20 bp, human
gccaccgacggtgacgaggg

SEQ ID NO: 138800 - DNA, 20 bp, human
gttgcgttgctccagcgagg

SEQ ID NO: 138801 - DNA, 20 bp, human
gcggggagccggccctccag

SEQ ID NO: 138802 - DNA, 20 bp, human
gcgcccgggaagggatcgtc

SEQ ID NO: 138803 - DNA, 20 bp, human
gggcggaggtgacgctcggt

SEQ ID NO: 138804 - DNA, 20 bp, human
ggattgaagcagaagcgtag

SEQ ID NO: 138805 - DNA, 20 bp, human
gccagggaccacgagagggg

SEQ ID NO: 138806 - DNA, 20 bp, human
gtcgcaccgaggaggcggct

SEQ ID NO: 138807 - DNA, 20 bp, human
ggaggcggctgggctagcca

SEQ ID NO: 138808 - DNA, 20 bp, human
gctcggtggtcgcaccgagg

SEQ ID NO: 138809 - DNA, 20 bp, human
ggctagcccagccgcctcct

SEQ ID NO: 138810 - DNA, 20 bp, human
gggcctcggtggtcgcaccg

SEQ ID NO: 138811 - DNA, 20 bp, human
ggaaccctgaagcgctgcag

SEQ ID NO: 138812 - DNA, 20 bp, human
ggcgtctgcggctctttctt

SEQ ID NO: 138813 - DNA, 20 bp, human
gctctcacacaaggacagac

SEQ ID NO: 138814 - DNA, 20 bp, human
gcagtttcacaagcgagcgg

SEQ ID NO: 138815 - DNA, 20 bp, human
gagcttgaatcaaagcacgg

SEQ ID NO: 138816 - DNA, 20 bp, human
ggaagaggcgcaggaagcca

SEQ ID NO: 138817 - DNA, 20 bp, human
gctcgggagcagaacagctt

SEQ ID NO: 138818 - DNA, 20 bp, human
gcccgagaaggacccccgcc

SEQ ID NO: 138819 - DNA, 20 bp, human
gtgcggcccagggttcacgc

SEQ ID NO: 138820 - DNA, 20 bp, human
gacccggcccgcgtgaaccc

SEQ ID NO: 138821 - DNA, 20 bp, human
ggggctggacgctgactgcc

SEQ ID NO: 138822 - DNA, 20 bp, human
gtacggggcaaatccaggcg

SEQ ID NO: 138823 - DNA, 20 bp, human
ggtgtgtgtcctcggcggcc

SEQ ID NO: 138824 - DNA, 20 bp, human
gatcgcttgctctcgttccc

SEQ ID NO: 138825 - DNA, 20 bp, human
gggcgccggccgtcgctgta

SEQ ID NO: 138826 - DNA, 20 bp, human
gcggcccgggcccaccttcg

SEQ ID NO: 138827 - DNA, 20 bp, human
gcagcccgggagcccgccag

SEQ ID NO: 138828 - DNA, 20 bp, human
gaagccgcgagggccaggag

SEQ ID NO: 138829 - DNA, 20 bp, human
gcggcggcggtaaatcctcc

SEQ ID NO: 138830 - DNA, 20 bp, human
gccggccgctcacagcactg

SEQ ID NO: 138831 - DNA, 20 bp, human
gccagcgttggaccgagatg

SEQ ID NO: 138832 - DNA, 20 bp, human
gctggcagcgctcaccgcga

SEQ ID NO: 138833 - DNA, 20 bp, human
ggaccctgccaggtaagcgg

SEQ ID NO: 138834 - DNA, 20 bp, human
gcgggaccctgccaggtaag

SEQ ID NO: 138835 - DNA, 20 bp, human
gaaggaggcggcagcgtctc

SEQ ID NO: 138836 - DNA, 20 bp, human
ggcggaggagacccccgacg

SEQ ID NO: 138837 - DNA, 20 bp, human
ggagagcgactcccgcaagg

SEQ ID NO: 138838 - DNA, 20 bp, human
gagcagcaacggccccgagt

SEQ ID NO: 138839 - DNA, 20 bp, human
gctccggcgacagcgcctca

SEQ ID NO: 138840 - DNA, 20 bp, human
gagcgacggggacaatggct

SEQ ID NO: 138841 - DNA, 20 bp, human
ggactcccgcaaggtggcgg

SEQ ID NO: 138842 - DNA, 20 bp, human
gcgccggaccgcgcaccagg

SEQ ID NO: 138843 - DNA, 20 bp, human
ggcggagagcgactcccgca

SEQ ID NO: 138844 - DNA, 20 bp, human
gcgcactcactcacccacgg

SEQ ID NO: 138845 - DNA, 20 bp, human
gggtctcctccgccaccttg

SEQ ID NO: 138846 - DNA, 20 bp, human
gaatttaatgacagtgtaac

SEQ ID NO: 138847 - DNA, 20 bp, human
gtcaaaggatcgccatggaa

SEQ ID NO: 138848 - DNA, 20 bp, human
gtcacgaacatgaacatcaa

SEQ ID NO: 138849 - DNA, 20 bp, human
gcaggggaatcctctctcag

SEQ ID NO: 138850 - DNA, 20 bp, human
ggagacttccagatcttctc

SEQ ID NO: 138851 - DNA, 20 bp, human
ggaacatcaaaggatcgcca

SEQ ID NO: 138852 - DNA, 20 bp, human
ggcaccatagaacagaacaa

SEQ ID NO: 138853 - DNA, 20 bp, human
gtaagactcaaagagtctgt

SEQ ID NO: 138854 - DNA, 20 bp, human
ggaaccattgttctgttcta

SEQ ID NO: 138855 - DNA, 20 bp, human
gctagaaagcaattttacaa

SEQ ID NO: 138856 - DNA, 20 bp, human
gtgtgaaggctccttcaggg

SEQ ID NO: 138857 - DNA, 20 bp, human
gagggaggaagccagaagca

SEQ ID NO: 138858 - DNA, 20 bp, human
gatgtagtgggacaggacga

SEQ ID NO: 138859 - DNA, 20 bp, human
gggagaggttatggatgtag

SEQ ID NO: 138860 - DNA, 20 bp, human
gaattcgctgaacatttctg

SEQ ID NO: 138861 - DNA, 20 bp, human
ggacaccagctcataagatg

SEQ ID NO: 138862 - DNA, 20 bp, human
gcaggtctcgaagggtcacc

SEQ ID NO: 138863 - DNA, 20 bp, human
gagcccagtagttcatgtga

SEQ ID NO: 138864 - DNA, 20 bp, human
gtgcactgcagcaaattggg

SEQ ID NO: 138865 - DNA, 20 bp, human
gactgagctgaatccatggt

SEQ ID NO: 138866 - DNA, 20 bp, human
gaagagctggagcagaccat

SEQ ID NO: 138867 - DNA, 20 bp, human
gcaggcaggattgatgtcag

SEQ ID NO: 138868 - DNA, 20 bp, human
ggcccagcatcagcaggcac

SEQ ID NO: 138869 - DNA, 20 bp, human
gatctccatggagtgccgat

SEQ ID NO: 138870 - DNA, 20 bp, human
gcactcactgcggatctcca

SEQ ID NO: 138871 - DNA, 20 bp, human
gccatgggcacgtgtcccca

SEQ ID NO: 138872 - DNA, 20 bp, human
gagctgcaagtcgtacccat

SEQ ID NO: 138873 - DNA, 20 bp, human
gctgcctggtacgccagtcg

SEQ ID NO: 138874 - DNA, 20 bp, human
gaggaaagggaagtcagtct

SEQ ID NO: 138875 - DNA, 20 bp, human
gtggcctcgccagaacctct

SEQ ID NO: 138876 - DNA, 20 bp, human
ggagaccggatcaccgacgt

SEQ ID NO: 138877 - DNA, 20 bp, human
gaagcactcgcgggaagaag

SEQ ID NO: 138878 - DNA, 20 bp, human
ggccatggccacctgttcaa

SEQ ID NO: 138879 - DNA, 20 bp, human
gctgcgaggaccgtaaatag

SEQ ID NO: 138880 - DNA, 20 bp, human
gtcgaccactcggggcccca

SEQ ID NO: 138881 - DNA, 20 bp, human
gggatcaccgacgtgggcag

SEQ ID NO: 138882 - DNA, 20 bp, human
ggggccccgagtggtcgatg

SEQ ID NO: 138883 - DNA, 20 bp, human
gagtatggcaagggaagtga

SEQ ID NO: 138884 - DNA, 20 bp, human
ggaggcctctgcgctctggt

SEQ ID NO: 138885 - DNA, 20 bp, human
ggtgggcagaggactaccga

SEQ ID NO: 138886 - DNA, 20 bp, human
gcctctgagaagggacatcc

SEQ ID NO: 138887 - DNA, 20 bp, human
gcgggaggcgggcggatccc

SEQ ID NO: 138888 - DNA, 20 bp, human
gtgagaagggacatccgggc

SEQ ID NO: 138889 - DNA, 20 bp, human
gcccagaaaaccggcgtctg

SEQ ID NO: 138890 - DNA, 20 bp, human
gccccgccggctgccgactc

SEQ ID NO: 138891 - DNA, 20 bp, human
ggagctgaggccgcctccga

SEQ ID NO: 138892 - DNA, 20 bp, human
gccctgccgcgcgccgtcgg

SEQ ID NO: 138893 - DNA, 20 bp, human
gggcggcctcagctcgccat

SEQ ID NO: 138894 - DNA, 20 bp, human
ggagtacccatggcgagctg

SEQ ID NO: 138895 - DNA, 20 bp, human
gagccagagtcggcagccgg

SEQ ID NO: 138896 - DNA, 20 bp, human
gggcctgaatgctcagagca

SEQ ID NO: 138897 - DNA, 20 bp, human
gtgagcaggtggaactctgt

SEQ ID NO: 138898 - DNA, 20 bp, human
ggttccacctgctcacaggt

SEQ ID NO: 138899 - DNA, 20 bp, human
gctggtgagaccaagaaaag

SEQ ID NO: 138900 - DNA, 20 bp, human
gcctggccatggtgcaggat

SEQ ID NO: 138901 - DNA, 20 bp, human
gaggagagccatgagtaagt

SEQ ID NO: 138902 - DNA, 20 bp, human
gcagccaacctgtgagcagg

SEQ ID NO: 138903 - DNA, 20 bp, human
ggcctcccctctcaagaaca

SEQ ID NO: 138904 - DNA, 20 bp, human
gctgaggctgggagctctca

SEQ ID NO: 138905 - DNA, 20 bp, human
gtcgcggtctgtacctgggg

SEQ ID NO: 138906 - DNA, 20 bp, human
ggcagtgggccctggagtag

SEQ ID NO: 138907 - DNA, 20 bp, human
ggaccaccccaggcacagga

SEQ ID NO: 138908 - DNA, 20 bp, human
gaccggaggaggcatcgcag

SEQ ID NO: 138909 - DNA, 20 bp, human
ggcgcagacactgctctcga

SEQ ID NO: 138910 - DNA, 20 bp, human
gccatggccagtctcactat

SEQ ID NO: 138911 - DNA, 20 bp, human
ggaggctgcaccggatccac

SEQ ID NO: 138912 - DNA, 20 bp, human
gcaacagtaacaccaagggc

SEQ ID NO: 138913 - DNA, 20 bp, human
gacctctgcgatgcctcctc

SEQ ID NO: 138914 - DNA, 20 bp, human
gggtggggacgggggttagg

SEQ ID NO: 138915 - DNA, 20 bp, human
gaggtctacgagaggaccca

SEQ ID NO: 138916 - DNA, 20 bp, human
ggacaggcaacgtagaccat

SEQ ID NO: 138917 - DNA, 20 bp, human
ggtgaggggaaccagagaca

SEQ ID NO: 138918 - DNA, 20 bp, human
ggctgtgccaagctcaacac

SEQ ID NO: 138919 - DNA, 20 bp, human
gttggcacagcgggaaccca

SEQ ID NO: 138920 - DNA, 20 bp, human
gcgcaacgaaggcccaggaa

SEQ ID NO: 138921 - DNA, 20 bp, human
gtgcacacgtggggccagaa

SEQ ID NO: 138922 - DNA, 20 bp, human
gacgtggggccagaagggat

SEQ ID NO: 138923 - DNA, 20 bp, human
ggccagaagggatagggtga

SEQ ID NO: 138924 - DNA, 20 bp, human
gctgtcgccggagcagcagt

SEQ ID NO: 138925 - DNA, 20 bp, human
gcctccttgcccagagagac

SEQ ID NO: 138926 - DNA, 20 bp, human
gccgtggaccctctggtata

SEQ ID NO: 138927 - DNA, 20 bp, human
gccaggtcgatcacacccca

SEQ ID NO: 138928 - DNA, 20 bp, human
gcaaagccgcctcccgccca

SEQ ID NO: 138929 - DNA, 20 bp, human
gggctccacgtgcgggacaa

SEQ ID NO: 138930 - DNA, 20 bp, human
gcgaaggcccttggaagcta

SEQ ID NO: 138931 - DNA, 20 bp, human
gtgtgcccaggtccccgggg

SEQ ID NO: 138932 - DNA, 20 bp, human
gacggctccctagcttccaa

SEQ ID NO: 138933 - DNA, 20 bp, human
gctgggggcgtcaggagggt

SEQ ID NO: 138934 - DNA, 20 bp, human
gcccggcgggctccacgtgc

SEQ ID NO: 138935 - DNA, 20 bp, human
gccccagccctcctccacgt

SEQ ID NO: 138936 - DNA, 20 bp, human
ggggttggcgagttcacccg

SEQ ID NO: 138937 - DNA, 20 bp, human
gttggcgagttcacccgcgg

SEQ ID NO: 138938 - DNA, 20 bp, human
ggcaaagttaccctccgccg

SEQ ID NO: 138939 - DNA, 20 bp, human
gtaacagcaaccacccaccc

SEQ ID NO: 138940 - DNA, 20 bp, human
gggtcccgccgagacgccgg

SEQ ID NO: 138941 - DNA, 20 bp, human
gctgggccgcgagttcgaca

SEQ ID NO: 138942 - DNA, 20 bp, human
gtctcgatgctacacttcca

SEQ ID NO: 138943 - DNA, 20 bp, human
gcgagttcacccgcggcgga

SEQ ID NO: 138944 - DNA, 20 bp, human
gcggaggggctagggtgcct

SEQ ID NO: 138945 - DNA, 20 bp, human
ggagctgaaacacgacgtga

SEQ ID NO: 138946 - DNA, 20 bp, human
ggtgtggacgcggaactcag

SEQ ID NO: 138947 - DNA, 20 bp, human
ggggccacgcgtggacgcag

SEQ ID NO: 138948 - DNA, 20 bp, human
gcgcttgcgcgggttgaggg

SEQ ID NO: 138949 - DNA, 20 bp, human
ggccagcgcggaggggtgga

SEQ ID NO: 138950 - DNA, 20 bp, human
gtggacgcaggggcacgaga

SEQ ID NO: 138951 - DNA, 20 bp, human
ggcccctgccccgaagctcg

SEQ ID NO: 138952 - DNA, 20 bp, human
ggcaggggcacgagagggtc

SEQ ID NO: 138953 - DNA, 20 bp, human
gggagaaacgcgattgaggt

SEQ ID NO: 138954 - DNA, 20 bp, human
gaggtgggcgtggccgcgaa

SEQ ID NO: 138955 - DNA, 20 bp, human
gtccacaccgccagcgcgga

SEQ ID NO: 138956 - DNA, 20 bp, human
gcacgcgcccgggcacccta

SEQ ID NO: 138957 - DNA, 20 bp, human
gagcgtcaggcgctaccggt

SEQ ID NO: 138958 - DNA, 20 bp, human
ggaggggccagggtacccac

SEQ ID NO: 138959 - DNA, 20 bp, human
gcagacacgccgggctctcg

SEQ ID NO: 138960 - DNA, 20 bp, human
gacgatgcagatctccccca

SEQ ID NO: 138961 - DNA, 20 bp, human
gtcgaggagcaggtgacgat

SEQ ID NO: 138962 - DNA, 20 bp, human
ggcgcctggcctctgcccta

SEQ ID NO: 138963 - DNA, 20 bp, human
gtcttccaccggccccacag

SEQ ID NO: 138964 - DNA, 20 bp, human
gcccgcccgaaggcgttcct

SEQ ID NO: 138965 - DNA, 20 bp, human
ggggctcgcagggatcatga

SEQ ID NO: 138966 - DNA, 20 bp, human
gcgactcgtcccgccttctg

SEQ ID NO: 138967 - DNA, 20 bp, human
ggtccctcccgctggacacg

SEQ ID NO: 138968 - DNA, 20 bp, human
ggacagcgcgaggagaaaga

SEQ ID NO: 138969 - DNA, 20 bp, human
ggtgggagccgcgtgtccag

SEQ ID NO: 138970 - DNA, 20 bp, human
gtggcggcgatggcggtcgg

SEQ ID NO: 138971 - DNA, 20 bp, human
gaaactctaaagggccctgg

SEQ ID NO: 138972 - DNA, 20 bp, human
gagaaagatggcggcgatgg

SEQ ID NO: 138973 - DNA, 20 bp, human
gtactagtatcaaggaatcc

SEQ ID NO: 138974 - DNA, 20 bp, human
gagtcatcccggagaagcag

SEQ ID NO: 138975 - DNA, 20 bp, human
ggtatcaaggaatcccggcg

SEQ ID NO: 138976 - DNA, 20 bp, human
gaagccagtctgagacagag

SEQ ID NO: 138977 - DNA, 20 bp, human
gtgcgcaaaggagcaaggaa

SEQ ID NO: 138978 - DNA, 20 bp, human
gagtggtaggagggttctaa

SEQ ID NO: 138979 - DNA, 20 bp, human
ggctcctcaaggtgagtggt

SEQ ID NO: 138980 - DNA, 20 bp, human
gcttcccctctgtctcagac

SEQ ID NO: 138981 - DNA, 20 bp, human
ggagcaatttcagtgaagtt

SEQ ID NO: 138982 - DNA, 20 bp, human
gggtcaggaaaatgctagtg

SEQ ID NO: 138983 - DNA, 20 bp, human
gctcaaggtgagtggtagga

SEQ ID NO: 138984 - DNA, 20 bp, human
gcctcctgtgaataagaatc

SEQ ID NO: 138985 - DNA, 20 bp, human
gctcatcttccggctcctca

SEQ ID NO: 138986 - DNA, 20 bp, human
gcacgtcctgccgggaccag

SEQ ID NO: 138987 - DNA, 20 bp, human
gacaggcccgggaggtggtg

SEQ ID NO: 138988 - DNA, 20 bp, human
gccagttccgaaggataccc

SEQ ID NO: 138989 - DNA, 20 bp, human
gctacagtctccactggtcc

SEQ ID NO: 138990 - DNA, 20 bp, human
gatctggcaacaggcccggg

SEQ ID NO: 138991 - DNA, 20 bp, human
gcaggcggtaggcatcggtg

SEQ ID NO: 138992 - DNA, 20 bp, human
gaaagaaagcttgagtcggg

SEQ ID NO: 138993 - DNA, 20 bp, human
gggaggtggtgcggttcaac

SEQ ID NO: 138994 - DNA, 20 bp, human
ggccaggtgaagcagcacta

SEQ ID NO: 138995 - DNA, 20 bp, human
ggttccgaaggatacccagg

SEQ ID NO: 138996 - DNA, 20 bp, human
ggtgctggccgcggtaaaag

SEQ ID NO: 138997 - DNA, 20 bp, human
ggcgagcggagggtttcccg

SEQ ID NO: 138998 - DNA, 20 bp, human
ggtaaaagtggtagcagcgg

SEQ ID NO: 138999 - DNA, 20 bp, human
ggaactcgtggcccagttag

SEQ ID NO: 139000 - DNA, 20 bp, human
gtggtagcagcggaggcgag

SEQ ID NO: 139001 - DNA, 20 bp, human
gagcagcggaggcgagcgga

SEQ ID NO: 139002 - DNA, 20 bp, human
ggcgggacctcgcagcgtcg

SEQ ID NO: 139003 - DNA, 20 bp, human
gcacgcggaggagtccaagt

SEQ ID NO: 139004 - DNA, 20 bp, human
gcgtcgaggagcgtgctggg

SEQ ID NO: 139005 - DNA, 20 bp, human
gcccgagctgccccacgcgg

SEQ ID NO: 139006 - DNA, 20 bp, human
gggcagaagttgagaggagt

SEQ ID NO: 139007 - DNA, 20 bp, human
gccaggctgctcgcaaagtc

SEQ ID NO: 139008 - DNA, 20 bp, human
gtgcccataagagccggcaa

SEQ ID NO: 139009 - DNA, 20 bp, human
gcggatcggcagaagttgag

SEQ ID NO: 139010 - DNA, 20 bp, human
ggttgcttcgcccagcggat

SEQ ID NO: 139011 - DNA, 20 bp, human
gaacccttgccggctcttat

SEQ ID NO: 139012 - DNA, 20 bp, human
gggccgagagcaccgaggta

SEQ ID NO: 139013 - DNA, 20 bp, human
gtaaggaggcgagcgagcag

SEQ ID NO: 139014 - DNA, 20 bp, human
ggctgctcgcaaagtccggc

SEQ ID NO: 139015 - DNA, 20 bp, human
gggtgataccgagatagtag

SEQ ID NO: 139016 - DNA, 20 bp, human
ggtgcagctcgaggctccag

SEQ ID NO: 139017 - DNA, 20 bp, human
ggagagagccaaggtacgtg

SEQ ID NO: 139018 - DNA, 20 bp, human
gcacactccagagagagcca

SEQ ID NO: 139019 - DNA, 20 bp, human
gtgggggactgtgcagctcg

SEQ ID NO: 139020 - DNA, 20 bp, human
gagtggccccccacgtacct

SEQ ID NO: 139021 - DNA, 20 bp, human
gtctctctggagtgtgcctc

SEQ ID NO: 139022 - DNA, 20 bp, human
ggcggacctggctgccaaga

SEQ ID NO: 139023 - DNA, 20 bp, human
gttcataggcagaagcttaa

SEQ ID NO: 139024 - DNA, 20 bp, human
gcaggtccgcccagctatat

SEQ ID NO: 139025 - DNA, 20 bp, human
ggaggatacccagtcatcac

SEQ ID NO: 139026 - DNA, 20 bp, human
gctgcctcggtcgtgaggag

SEQ ID NO: 139027 - DNA, 20 bp, human
ggcaggtaaacgcccggggt

SEQ ID NO: 139028 - DNA, 20 bp, human
ggctggcgcccagggaactc

SEQ ID NO: 139029 - DNA, 20 bp, human
gcgaggcaggtaaacgcccg

SEQ ID NO: 139030 - DNA, 20 bp, human
gtctcctctcctcacgaccg

SEQ ID NO: 139031 - DNA, 20 bp, human
gggccctcccggagttccct

SEQ ID NO: 139032 - DNA, 20 bp, human
ggcgcccagggaactccggg

SEQ ID NO: 139033 - DNA, 20 bp, human
gactccgggagggccgccag

SEQ ID NO: 139034 - DNA, 20 bp, human
gagccagtcgctgacagccg

SEQ ID NO: 139035 - DNA, 20 bp, human
ggccgccagcgggctccgca

SEQ ID NO: 139036 - DNA, 20 bp, human
gagccctgcctgggatcccg

SEQ ID NO: 139037 - DNA, 20 bp, human
gacagtgccggcgccaccag

SEQ ID NO: 139038 - DNA, 20 bp, human
gcgccggagcagccgaacag

SEQ ID NO: 139039 - DNA, 20 bp, human
ggcgagcgcggtcagcatgg

SEQ ID NO: 139040 - DNA, 20 bp, human
gccagcggaggcgaatgcga

SEQ ID NO: 139041 - DNA, 20 bp, human
gtcggcgtcggacccctgtt

SEQ ID NO: 139042 - DNA, 20 bp, human
ggaggcgcaacaacagttca

SEQ ID NO: 139043 - DNA, 20 bp, human
ggtgccggcgccaccagcgg

SEQ ID NO: 139044 - DNA, 20 bp, human
ggactggcgtgggaccgcgg

SEQ ID NO: 139045 - DNA, 20 bp, human
gtccggcgcagacgatcgcg

SEQ ID NO: 139046 - DNA, 20 bp, human
gtggagagcagggtccggta

SEQ ID NO: 139047 - DNA, 20 bp, human
gcctggagggggactcacag

SEQ ID NO: 139048 - DNA, 20 bp, human
gaagtggcctcagagggagt

SEQ ID NO: 139049 - DNA, 20 bp, human
gatcaaggaaccctccccag

SEQ ID NO: 139050 - DNA, 20 bp, human
gctcgaactccaggctgtca

SEQ ID NO: 139051 - DNA, 20 bp, human
gccacgtggcctatccactg

SEQ ID NO: 139052 - DNA, 20 bp, human
gctccaggcaggtctatgag

SEQ ID NO: 139053 - DNA, 20 bp, human
gccctggtggccagagatca

SEQ ID NO: 139054 - DNA, 20 bp, human
gggtccggtagggtgtgcag

SEQ ID NO: 139055 - DNA, 20 bp, human
ggccaccagggctatctctg

SEQ ID NO: 139056 - DNA, 20 bp, human
gattgctcgctggacaacgg

SEQ ID NO: 139057 - DNA, 20 bp, human
gtggagcgcaagcccagtgg

SEQ ID NO: 139058 - DNA, 20 bp, human
gtcaattgctcgctggacaa

SEQ ID NO: 139059 - DNA, 20 bp, human
gcccagtctgagcgtatctg

SEQ ID NO: 139060 - DNA, 20 bp, human
gacgcattactgcctagagg

SEQ ID NO: 139061 - DNA, 20 bp, human
gtgcacgcattactgcctag

SEQ ID NO: 139062 - DNA, 20 bp, human
ggggctcaggagggtttcta

SEQ ID NO: 139063 - DNA, 20 bp, human
gatacgctcagactggggag

SEQ ID NO: 139064 - DNA, 20 bp, human
gtggggagcggagccaccac

SEQ ID NO: 139065 - DNA, 20 bp, human
gcattactgcctagaggagg

SEQ ID NO: 139066 - DNA, 20 bp, human
ggccaaggccggcgcttcaa

SEQ ID NO: 139067 - DNA, 20 bp, human
ggctcggctatcggactggg

SEQ ID NO: 139068 - DNA, 20 bp, human
gaacgctcggctatcggact

SEQ ID NO: 139069 - DNA, 20 bp, human
ggccggcgcttcaagggcag

SEQ ID NO: 139070 - DNA, 20 bp, human
gcagccgaaaggagtagggt

SEQ ID NO: 139071 - DNA, 20 bp, human
gtagggtgaaagaaagtggg

SEQ ID NO: 139072 - DNA, 20 bp, human
gctctgggggagctagtgag

SEQ ID NO: 139073 - DNA, 20 bp, human
gggtccacgggctccagcca

SEQ ID NO: 139074 - DNA, 20 bp, human
gtgatagggtgaaagaaagt

SEQ ID NO: 139075 - DNA, 20 bp, human
gagactgagggttccacccg

SEQ ID NO: 139076 - DNA, 20 bp, human
gcgagccaggaacccaggtc

SEQ ID NO: 139077 - DNA, 20 bp, human
gggtaggagaatcagcccca

SEQ ID NO: 139078 - DNA, 20 bp, human
gtagataggggtacatctag

SEQ ID NO: 139079 - DNA, 20 bp, human
gagagaagtgaggaccgtct

SEQ ID NO: 139080 - DNA, 20 bp, human
gctgagggtgatggtagata

SEQ ID NO: 139081 - DNA, 20 bp, human
gtctgggaggggcggagtct

SEQ ID NO: 139082 - DNA, 20 bp, human
gagccagacagcagcagtat

SEQ ID NO: 139083 - DNA, 20 bp, human
ggggcacatggcaagaccac

SEQ ID NO: 139084 - DNA, 20 bp, human
gagtgaggaccgtctgggag

SEQ ID NO: 139085 - DNA, 20 bp, human
gctggctagatctctctaca

SEQ ID NO: 139086 - DNA, 20 bp, human
ggacgaagcggggaatgcag

SEQ ID NO: 139087 - DNA, 20 bp, human
gcgtggacagcgggacgaag

SEQ ID NO: 139088 - DNA, 20 bp, human
gcctcagagccatggcggga

SEQ ID NO: 139089 - DNA, 20 bp, human
gggccggcgccgtggacagc

SEQ ID NO: 139090 - DNA, 20 bp, human
gccgtggccgacccacctcc

SEQ ID NO: 139091 - DNA, 20 bp, human
ggagcttcctggcctgaaac

SEQ ID NO: 139092 - DNA, 20 bp, human
gtcccgcgagcagcccgcag

SEQ ID NO: 139093 - DNA, 20 bp, human
gacggccgctgggcccgctg

SEQ ID NO: 139094 - DNA, 20 bp, human
gttggtagacatcgacaaat

SEQ ID NO: 139095 - DNA, 20 bp, human
gacctcctggcacggccgct

SEQ ID NO: 139096 - DNA, 20 bp, human
ggcccaggagcgagcccgtg

SEQ ID NO: 139097 - DNA, 20 bp, human
ggcggcagagatcggctatg

SEQ ID NO: 139098 - DNA, 20 bp, human
gcacctgtggtacatggcgt

SEQ ID NO: 139099 - DNA, 20 bp, human
gtagccgatctctgccgcac

SEQ ID NO: 139100 - DNA, 20 bp, human
ggcgttggtggcctcgtacg

SEQ ID NO: 139101 - DNA, 20 bp, human
ggccgcacgggctcgctcct

SEQ ID NO: 139102 - DNA, 20 bp, human
ggtctgcaggagcaagctca

SEQ ID NO: 139103 - DNA, 20 bp, human
gcccatcaaccccacgtacg

SEQ ID NO: 139104 - DNA, 20 bp, human
gctgtggtacatggcgttgg

SEQ ID NO: 139105 - DNA, 20 bp, human
gttggggccaagctggtgcg

SEQ ID NO: 139106 - DNA, 20 bp, human
gggactctgctgccaagagt

SEQ ID NO: 139107 - DNA, 20 bp, human
gtgccaagagtgggtgagta

SEQ ID NO: 139108 - DNA, 20 bp, human
gaacaggtccggagcatcct

SEQ ID NO: 139109 - DNA, 20 bp, human
gcacaccagggaaggttctc

SEQ ID NO: 139110 - DNA, 20 bp, human
ggctgcctccacaccaggga

SEQ ID NO: 139111 - DNA, 20 bp, human
gcactgccagcagtggtcgg

SEQ ID NO: 139112 - DNA, 20 bp, human
gacagagcacgtaacaggtc

SEQ ID NO: 139113 - DNA, 20 bp, human
ggctgggtgacagggagcga

SEQ ID NO: 139114 - DNA, 20 bp, human
gaagctggtcccccctccag

SEQ ID NO: 139115 - DNA, 20 bp, human
gctccctactcacccactct

SEQ ID NO: 139116 - DNA, 20 bp, human
gaagcgagaggcatctaagc

SEQ ID NO: 139117 - DNA, 20 bp, human
gcaccccaagtgaccatgag

SEQ ID NO: 139118 - DNA, 20 bp, human
gactcgcgtggcacctctca

SEQ ID NO: 139119 - DNA, 20 bp, human
gcacctctcatggtcacttg

SEQ ID NO: 139120 - DNA, 20 bp, human
gagcatgattgagactcgcg

SEQ ID NO: 139121 - DNA, 20 bp, human
gggaatcttcactttaccaa

SEQ ID NO: 139122 - DNA, 20 bp, human
gtcacacaaaagataagtta

SEQ ID NO: 139123 - DNA, 20 bp, human
gcaacacagtgtgaaccaaa

SEQ ID NO: 139124 - DNA, 20 bp, human
gagcccaggaaccatgcagg

SEQ ID NO: 139125 - DNA, 20 bp, human
gttgccaatccactttataa

SEQ ID NO: 139126 - DNA, 20 bp, human
gtggcgccctcgggactggg

SEQ ID NO: 139127 - DNA, 20 bp, human
ggtgaggccgtgggtgatga

SEQ ID NO: 139128 - DNA, 20 bp, human
gcatcccaggcgcgcatcag

SEQ ID NO: 139129 - DNA, 20 bp, human
gcgggagaaggtggtaataa

SEQ ID NO: 139130 - DNA, 20 bp, human
ggtgcaccaaggggcgacag

SEQ ID NO: 139131 - DNA, 20 bp, human
gggcggccgcccagtcccga

SEQ ID NO: 139132 - DNA, 20 bp, human
gcgcccccaactgcctccgg

SEQ ID NO: 139133 - DNA, 20 bp, human
ggtgatgagggagaagtaag

SEQ ID NO: 139134 - DNA, 20 bp, human
gaggtggtaataaaggtggt

SEQ ID NO: 139135 - DNA, 20 bp, human
gcggccgccggaggcagttg

SEQ ID NO: 139136 - DNA, 20 bp, human
gccagcctgaacggacacca

SEQ ID NO: 139137 - DNA, 20 bp, human
gcctcttttacggagaggta

SEQ ID NO: 139138 - DNA, 20 bp, human
gggagcgtccggatcgccct

SEQ ID NO: 139139 - DNA, 20 bp, human
gcagaggccgggatcgccct

SEQ ID NO: 139140 - DNA, 20 bp, human
gtacggagaggtagggcagc

SEQ ID NO: 139141 - DNA, 20 bp, human
gggccccaacctggtcccct

SEQ ID NO: 139142 - DNA, 20 bp, human
gtccgttcaggctggcccag

SEQ ID NO: 139143 - DNA, 20 bp, human
ggcgtccggatcgccctggg

SEQ ID NO: 139144 - DNA, 20 bp, human
gaggccgggatcgccctggg

SEQ ID NO: 139145 - DNA, 20 bp, human
gatggccctggtgtccgttc

SEQ ID NO: 139146 - DNA, 20 bp, human
ggaggcgccgagacaggtaa

SEQ ID NO: 139147 - DNA, 20 bp, human
gagcagagcgcacagaaagg

SEQ ID NO: 139148 - DNA, 20 bp, human
gcggatcgagagtcacagtg

SEQ ID NO: 139149 - DNA, 20 bp, human
gggccctctaggaccgggta

SEQ ID NO: 139150 - DNA, 20 bp, human
gtgacgcgagtccccggcag

SEQ ID NO: 139151 - DNA, 20 bp, human
gtctaggaccgggtagggta

SEQ ID NO: 139152 - DNA, 20 bp, human
gagggacatcccccacgcag

SEQ ID NO: 139153 - DNA, 20 bp, human
gccgcgctgacgcgagtccc

SEQ ID NO: 139154 - DNA, 20 bp, human
gcgattcagacgggatgcga

SEQ ID NO: 139155 - DNA, 20 bp, human
ggtcagcgcggccggagcta

SEQ ID NO: 139156 - DNA, 20 bp, human
ggctacctaaattgagtatc

SEQ ID NO: 139157 - DNA, 20 bp, human
gcttgccagatactcaattt

SEQ ID NO: 139158 - DNA, 20 bp, human
gaagaatcttctaccaaggt

SEQ ID NO: 139159 - DNA, 20 bp, human
gttcttggacttttaaattg

SEQ ID NO: 139160 - DNA, 20 bp, human
gagaccataaaatacagcag

SEQ ID NO: 139161 - DNA, 20 bp, human
gaaagaagaatcttctacca

SEQ ID NO: 139162 - DNA, 20 bp, human
gctcaagaatatcatcctca

SEQ ID NO: 139163 - DNA, 20 bp, human
gctgagatttttgggtaacg

SEQ ID NO: 139164 - DNA, 20 bp, human
gatttccattaaaagccatg

SEQ ID NO: 139165 - DNA, 20 bp, human
gagtcaatagattgtgaaat

SEQ ID NO: 139166 - DNA, 20 bp, human
gcagatggctagggtaaggg

SEQ ID NO: 139167 - DNA, 20 bp, human
gactgaggcagatccccacg

SEQ ID NO: 139168 - DNA, 20 bp, human
gtggggccgccgtaatggaa

SEQ ID NO: 139169 - DNA, 20 bp, human
gccggacggggacctaggta

SEQ ID NO: 139170 - DNA, 20 bp, human
gggcgcagatggctagggta

SEQ ID NO: 139171 - DNA, 20 bp, human
ggaggcggcgcagatggcta

SEQ ID NO: 139172 - DNA, 20 bp, human
ggtctggcgagctaagggaa

SEQ ID NO: 139173 - DNA, 20 bp, human
ggcggcggcagcggtgacta

SEQ ID NO: 139174 - DNA, 20 bp, human
gtggcgagctaagggaaggg

SEQ ID NO: 139175 - DNA, 20 bp, human
ggctctcagctctcccgccg

SEQ ID NO: 139176 - DNA, 20 bp, human
gcaagggggtcattcactca

SEQ ID NO: 139177 - DNA, 20 bp, human
gtaccttctgggaaatcacg

SEQ ID NO: 139178 - DNA, 20 bp, human
gtggcttgaggcgagggatg

SEQ ID NO: 139179 - DNA, 20 bp, human
gcccagaaggtaagtgctga

SEQ ID NO: 139180 - DNA, 20 bp, human
ggtcctctccgggcagctcc

SEQ ID NO: 139181 - DNA, 20 bp, human
ggcggaagaatgttctccaa

SEQ ID NO: 139182 - DNA, 20 bp, human
ggcaagatcctccaaacatg

SEQ ID NO: 139183 - DNA, 20 bp, human
gaacagggagccgagtacga

SEQ ID NO: 139184 - DNA, 20 bp, human
gtagctatggccctcgtact

SEQ ID NO: 139185 - DNA, 20 bp, human
gtcatccacagatgctccta

SEQ ID NO: 139186 - DNA, 20 bp, human
ggagggaacagacaagccca

SEQ ID NO: 139187 - DNA, 20 bp, human
ggaggctggagaaggatgta

SEQ ID NO: 139188 - DNA, 20 bp, human
ggcacatcccatggtagagt

SEQ ID NO: 139189 - DNA, 20 bp, human
ggtaggttgggcacatccca

SEQ ID NO: 139190 - DNA, 20 bp, human
gtcaggaacccaaacctgtc

SEQ ID NO: 139191 - DNA, 20 bp, human
ggtagaaggcggaggatctg

SEQ ID NO: 139192 - DNA, 20 bp, human
ggactcctggactccctcta

SEQ ID NO: 139193 - DNA, 20 bp, human
gcctggcgcacgaactcgag

SEQ ID NO: 139194 - DNA, 20 bp, human
gcaaatgctgaggccctcat

SEQ ID NO: 139195 - DNA, 20 bp, human
gggacagaggaagccgggct

SEQ ID NO: 139196 - DNA, 20 bp, human
gaagggagcagcatcccggt

SEQ ID NO: 139197 - DNA, 20 bp, human
gggaccccgaccaccacggt

SEQ ID NO: 139198 - DNA, 20 bp, human
gcggtgtgcgtgggtccctg

SEQ ID NO: 139199 - DNA, 20 bp, human
gagccaaagaaggggcgagt

SEQ ID NO: 139200 - DNA, 20 bp, human
gggacccacgcacaccggga

SEQ ID NO: 139201 - DNA, 20 bp, human
ggtggtggtcggggtcccag

SEQ ID NO: 139202 - DNA, 20 bp, human
gggtcactcacccaccgtgg

SEQ ID NO: 139203 - DNA, 20 bp, human
gagaaacagagcaacaggtg

SEQ ID NO: 139204 - DNA, 20 bp, human
gtcctccaagactcaggggt

SEQ ID NO: 139205 - DNA, 20 bp, human
ggacggtcactcacccaccg

SEQ ID NO: 139206 - DNA, 20 bp, human
gcgcagcacggctcagaccg

SEQ ID NO: 139207 - DNA, 20 bp, human
gtctgagccgtgctgcgcgg

SEQ ID NO: 139208 - DNA, 20 bp, human
gggctcagaccgaggcgcac

SEQ ID NO: 139209 - DNA, 20 bp, human
gagcaggcagtgcaatggtg

SEQ ID NO: 139210 - DNA, 20 bp, human
ggcgacccagcgagcctcgg

SEQ ID NO: 139211 - DNA, 20 bp, human
gccagcgacccagcgagcct

SEQ ID NO: 139212 - DNA, 20 bp, human
ggcctcggcggaacagccgg

SEQ ID NO: 139213 - DNA, 20 bp, human
gaaacagccgtggatagagc

SEQ ID NO: 139214 - DNA, 20 bp, human
ggttcttagatctgtcctgt

SEQ ID NO: 139215 - DNA, 20 bp, human
gtgttccgccgaggctcgct

SEQ ID NO: 139216 - DNA, 20 bp, human
ggctcggcgtcggtccccgg

SEQ ID NO: 139217 - DNA, 20 bp, human
gcagctctccacatcccccg

SEQ ID NO: 139218 - DNA, 20 bp, human
ggtctccccttaccatccgt

SEQ ID NO: 139219 - DNA, 20 bp, human
ggcaagtggccacgacacct

SEQ ID NO: 139220 - DNA, 20 bp, human
gtatcgaccccgaaacgacg

SEQ ID NO: 139221 - DNA, 20 bp, human
ggcgtgggaatgggtcgtca

SEQ ID NO: 139222 - DNA, 20 bp, human
gtgtcggccgagctgggagt

SEQ ID NO: 139223 - DNA, 20 bp, human
gagaagagggacacctgcgt

SEQ ID NO: 139224 - DNA, 20 bp, human
ggaggctgcgtggggacggt

SEQ ID NO: 139225 - DNA, 20 bp, human
ggcccccctcgcatccgcca

SEQ ID NO: 139226 - DNA, 20 bp, human
gcaggtgcgggtcgagagac

SEQ ID NO: 139227 - DNA, 20 bp, human
gccaggagccgggcgaagag

SEQ ID NO: 139228 - DNA, 20 bp, human
gtgcgctcagagtccacggg

SEQ ID NO: 139229 - DNA, 20 bp, human
ggagggccaggtgccgccag

SEQ ID NO: 139230 - DNA, 20 bp, human
gtctgccggccgctccacct

SEQ ID NO: 139231 - DNA, 20 bp, human
gcttcaagagctacctctgg

SEQ ID NO: 139232 - DNA, 20 bp, human
gagcaagagaggatgcgaag

SEQ ID NO: 139233 - DNA, 20 bp, human
ggaggtatccaggagtcggg

SEQ ID NO: 139234 - DNA, 20 bp, human
gacagcccccaccagctcat

SEQ ID NO: 139235 - DNA, 20 bp, human
gggtcctggtgtgggaatat

SEQ ID NO: 139236 - DNA, 20 bp, human
gacagtctgcgccagacggg

SEQ ID NO: 139237 - DNA, 20 bp, human
gcagacgggcggcggcgtga

SEQ ID NO: 139238 - DNA, 20 bp, human
gcgcgggagacccctacccc

SEQ ID NO: 139239 - DNA, 20 bp, human
gggcgggtcgggcagagagg

SEQ ID NO: 139240 - DNA, 20 bp, human
gggaacagtctgcgccagac

SEQ ID NO: 139241 - DNA, 20 bp, human
gagagggtgcgggtccgaca

SEQ ID NO: 139242 - DNA, 20 bp, human
ggtccacgccgccagcgacc

SEQ ID NO: 139243 - DNA, 20 bp, human
gcagagcgaggagcgcgcca

SEQ ID NO: 139244 - DNA, 20 bp, human
ggagtctggggctatcctgg

SEQ ID NO: 139245 - DNA, 20 bp, human
ggagggctccgggtcgctgg

SEQ ID NO: 139246 - DNA, 20 bp, human
ggaagaggagcgaagcggag

SEQ ID NO: 139247 - DNA, 20 bp, human
gtacgcggtgcagggagcag

SEQ ID NO: 139248 - DNA, 20 bp, human
ggagagggagcaggcggacc

SEQ ID NO: 139249 - DNA, 20 bp, human
gagagcgctccctcagctga

SEQ ID NO: 139250 - DNA, 20 bp, human
gctgctttccccggctgcaa

SEQ ID NO: 139251 - DNA, 20 bp, human
gagtaaatcttgttgtggag

SEQ ID NO: 139252 - DNA, 20 bp, human
gaaacacgcgagtgcacaca

SEQ ID NO: 139253 - DNA, 20 bp, human
ggaagaagaagatacttacg

SEQ ID NO: 139254 - DNA, 20 bp, human
gggcgcaaaagagctctcgc

SEQ ID NO: 139255 - DNA, 20 bp, human
gtaatacaccattgcagccg

SEQ ID NO: 139256 - DNA, 20 bp, human
gacctgactccagggaaacg

SEQ ID NO: 139257 - DNA, 20 bp, human
ggtacaagcttctgctaggt

SEQ ID NO: 139258 - DNA, 20 bp, human
gcctgaacaagtgcctggga

SEQ ID NO: 139259 - DNA, 20 bp, human
gtgctaggtgggagcagatc

SEQ ID NO: 139260 - DNA, 20 bp, human
gcccaaagaaggcccgagag

SEQ ID NO: 139261 - DNA, 20 bp, human
gtagcagaagcttgtacgga

SEQ ID NO: 139262 - DNA, 20 bp, human
gtggagtttggatccatccc

SEQ ID NO: 139263 - DNA, 20 bp, human
gttgccctggtcccaggcag

SEQ ID NO: 139264 - DNA, 20 bp, human
gcctggcaccagaggattcg

SEQ ID NO: 139265 - DNA, 20 bp, human
ggggagtctctatccagctc

SEQ ID NO: 139266 - DNA, 20 bp, human
ggagggctccacacgatgga

SEQ ID NO: 139267 - DNA, 20 bp, human
gtgagcccagactgcaatgt

SEQ ID NO: 139268 - DNA, 20 bp, human
gacctgagggctccacacga

SEQ ID NO: 139269 - DNA, 20 bp, human
gcacccggagcgctgggaca

SEQ ID NO: 139270 - DNA, 20 bp, human
ggtcctcgccctccatcgtg

SEQ ID NO: 139271 - DNA, 20 bp, human
gcgctccgggtgggaatggc

SEQ ID NO: 139272 - DNA, 20 bp, human
gagactagtctgggcactca

SEQ ID NO: 139273 - DNA, 20 bp, human
gcagcacaggcacaacagac

SEQ ID NO: 139274 - DNA, 20 bp, human
gctgggttgggcattggacg

SEQ ID NO: 139275 - DNA, 20 bp, human
gtgggcattggacgagggga

SEQ ID NO: 139276 - DNA, 20 bp, human
gcagttgttctcaggtgttt

SEQ ID NO: 139277 - DNA, 20 bp, human
gcgcggccgccggcccagtg

SEQ ID NO: 139278 - DNA, 20 bp, human
gtgagggtgacgatactcag

SEQ ID NO: 139279 - DNA, 20 bp, human
gatctaagggggcctaccag

SEQ ID NO: 139280 - DNA, 20 bp, human
gtgttgttccgtatactcag

SEQ ID NO: 139281 - DNA, 20 bp, human
gctcaacagtgagacgccaa

SEQ ID NO: 139282 - DNA, 20 bp, human
gacacctgagaacaactgac

SEQ ID NO: 139283 - DNA, 20 bp, human
gagaatagggtctgagagca

SEQ ID NO: 139284 - DNA, 20 bp, human
gtgacaggagccgcttccgg

SEQ ID NO: 139285 - DNA, 20 bp, human
gacagtgagacgccaagggt

SEQ ID NO: 139286 - DNA, 20 bp, human
gtgctgccgggactgctccg

SEQ ID NO: 139287 - DNA, 20 bp, human
ggcgcctcggagcacggtga

SEQ ID NO: 139288 - DNA, 20 bp, human
gctagcgtagcgcttcacgt

SEQ ID NO: 139289 - DNA, 20 bp, human
gagcgcttcacgtgggaatg

SEQ ID NO: 139290 - DNA, 20 bp, human
ggcgctacgctagcatcgct

SEQ ID NO: 139291 - DNA, 20 bp, human
gggccgcagccaacactcac

SEQ ID NO: 139292 - DNA, 20 bp, human
gcacagccttcagcacctaa

SEQ ID NO: 139293 - DNA, 20 bp, human
ggtctgcgacaataaacctc

SEQ ID NO: 139294 - DNA, 20 bp, human
ggcaccggagccccccccgt

SEQ ID NO: 139295 - DNA, 20 bp, human
gggagccccccccgtcggag

SEQ ID NO: 139296 - DNA, 20 bp, human
gaagtttgtgaggtgagtag

SEQ ID NO: 139297 - DNA, 20 bp, human
gggactggaattaccctctg

SEQ ID NO: 139298 - DNA, 20 bp, human
gcgttcgggctccgtctcag

SEQ ID NO: 139299 - DNA, 20 bp, human
gcggagcccgaacgttacac

SEQ ID NO: 139300 - DNA, 20 bp, human
gcggttccggtgtaacgttc

SEQ ID NO: 139301 - DNA, 20 bp, human
ggtggccccgggcccacaga

SEQ ID NO: 139302 - DNA, 20 bp, human
gctgctgcctgctcattgag

SEQ ID NO: 139303 - DNA, 20 bp, human
ggggctgcagagggaaactc

SEQ ID NO: 139304 - DNA, 20 bp, human
gactgagtccccggccacag

SEQ ID NO: 139305 - DNA, 20 bp, human
ggtagcgacggcacgccgta

SEQ ID NO: 139306 - DNA, 20 bp, human
gcgactaacgctagaaacag

SEQ ID NO: 139307 - DNA, 20 bp, human
ggaaacagtggtgcgcggag

SEQ ID NO: 139308 - DNA, 20 bp, human
ggagtgtgatggagaccacg

SEQ ID NO: 139309 - DNA, 20 bp, human
gcgcgagagtgagacgtcat

SEQ ID NO: 139310 - DNA, 20 bp, human
gtgatggagaccacggggag

SEQ ID NO: 139311 - DNA, 20 bp, human
gtagcaggatcggtccacag

SEQ ID NO: 139312 - DNA, 20 bp, human
gggcactaggcggagagagg

SEQ ID NO: 139313 - DNA, 20 bp, human
gcgctagaaacagtggtgcg

SEQ ID NO: 139314 - DNA, 20 bp, human
gcctggcactaggcggagag

SEQ ID NO: 139315 - DNA, 20 bp, human
gggtaagccgcgaggaggaa

SEQ ID NO: 139316 - DNA, 20 bp, human
ggcggaagccctttacacta

SEQ ID NO: 139317 - DNA, 20 bp, human
ggttcagaaaaagcacctag

SEQ ID NO: 139318 - DNA, 20 bp, human
gtaatactcaacacaagacg

SEQ ID NO: 139319 - DNA, 20 bp, human
gcgataggcgacgcggggag

SEQ ID NO: 139320 - DNA, 20 bp, human
gggtgtttccggcttcaaga

SEQ ID NO: 139321 - DNA, 20 bp, human
gacaagacgaggcacttagc

SEQ ID NO: 139322 - DNA, 20 bp, human
gtctgggggtggtactggaa

SEQ ID NO: 139323 - DNA, 20 bp, human
gggaaacaccgtagtgtaaa

SEQ ID NO: 139324 - DNA, 20 bp, human
gtaggcgaccatcttgaagc

SEQ ID NO: 139325 - DNA, 20 bp, human
gctcctgaccgagcgcgggt

SEQ ID NO: 139326 - DNA, 20 bp, human
ggacgacgttcgatggagta

SEQ ID NO: 139327 - DNA, 20 bp, human
gtgccggctcgccttctgcg

SEQ ID NO: 139328 - DNA, 20 bp, human
gcggaagagatcgagctccc

SEQ ID NO: 139329 - DNA, 20 bp, human
gctccacgcagaaggcgagc

SEQ ID NO: 139330 - DNA, 20 bp, human
ggcaatgtgctcccgctctg

SEQ ID NO: 139331 - DNA, 20 bp, human
gggatgttggtcaggatcat

SEQ ID NO: 139332 - DNA, 20 bp, human
gcttctgcgtggagttctcg

SEQ ID NO: 139333 - DNA, 20 bp, human
ggatctcgtccaccacctcg

SEQ ID NO: 139334 - DNA, 20 bp, human
gcggcggtctccggcaagca

SEQ ID NO: 139335 - DNA, 20 bp, human
gctcaagacctaccacgagg

SEQ ID NO: 139336 - DNA, 20 bp, human
gggcggtgaagtgccatctt

SEQ ID NO: 139337 - DNA, 20 bp, human
gcgggtttcaggccgcgctc

SEQ ID NO: 139338 - DNA, 20 bp, human
ggtgctggctgtggggacgg

SEQ ID NO: 139339 - DNA, 20 bp, human
gccgagccaggcctcaaaca

SEQ ID NO: 139340 - DNA, 20 bp, human
gaccgctccacccaacaggt

SEQ ID NO: 139341 - DNA, 20 bp, human
gagccaggcctcaaacaggg

SEQ ID NO: 139342 - DNA, 20 bp, human
gcaggcggccgtggcgcggg

SEQ ID NO: 139343 - DNA, 20 bp, human
gtccagctccgggagaagca

SEQ ID NO: 139344 - DNA, 20 bp, human
ggtgacgacctagccgaaga

SEQ ID NO: 139345 - DNA, 20 bp, human
gttgcagccgccagaggatt

SEQ ID NO: 139346 - DNA, 20 bp, human
ggagtgttcgggtttcgctg

SEQ ID NO: 139347 - DNA, 20 bp, human
gaccgtggaagaggctcgcg

SEQ ID NO: 139348 - DNA, 20 bp, human
gcgcggtggacggtctgaaa

SEQ ID NO: 139349 - DNA, 20 bp, human
gctcgcgaggaagccatgct

SEQ ID NO: 139350 - DNA, 20 bp, human
gtgaggtagtaggagttagt

SEQ ID NO: 139351 - DNA, 20 bp, human
gggtctgaaagggagtgttc

SEQ ID NO: 139352 - DNA, 20 bp, human
gtcctcgcgagcctcttcca

SEQ ID NO: 139353 - DNA, 20 bp, human
ggatcccgggctctgtaccg

SEQ ID NO: 139354 - DNA, 20 bp, human
ggggctctgtaccgtggaag

SEQ ID NO: 139355 - DNA, 20 bp, human
gttcctagacgtgaggtagt

SEQ ID NO: 139356 - DNA, 20 bp, human
gccgtccccggcctcatcgt

SEQ ID NO: 139357 - DNA, 20 bp, human
gcctcggtaagggatcagtg

SEQ ID NO: 139358 - DNA, 20 bp, human
gcagtctgagcccgacgatg

SEQ ID NO: 139359 - DNA, 20 bp, human
gttcttgttggtatgtgtag

SEQ ID NO: 139360 - DNA, 20 bp, human
gaggagacggccctcggtaa

SEQ ID NO: 139361 - DNA, 20 bp, human
ggagcccgacgatgaggccg

SEQ ID NO: 139362 - DNA, 20 bp, human
gagcccacggggaacttcca

SEQ ID NO: 139363 - DNA, 20 bp, human
gtgtctaggccaagcccacg

SEQ ID NO: 139364 - DNA, 20 bp, human
gcgtccccaggaccctgcga

SEQ ID NO: 139365 - DNA, 20 bp, human
gaaggcggcacaatgaaaaa

SEQ ID NO: 139366 - DNA, 20 bp, human
gagtggtctgaggagcaccc

SEQ ID NO: 139367 - DNA, 20 bp, human
ggcggctcttactggcgggt

SEQ ID NO: 139368 - DNA, 20 bp, human
gtcagagcggctcttactgg

SEQ ID NO: 139369 - DNA, 20 bp, human
gagagagagggcggagatga

SEQ ID NO: 139370 - DNA, 20 bp, human
ggcggcctggccaatcagag

SEQ ID NO: 139371 - DNA, 20 bp, human
ggggttcgcggagaaagatc

SEQ ID NO: 139372 - DNA, 20 bp, human
gcgagggaggccaagggtga

SEQ ID NO: 139373 - DNA, 20 bp, human
ggggccgggaccgaacacac

SEQ ID NO: 139374 - DNA, 20 bp, human
ggtcgcacaccaaatatccc

SEQ ID NO: 139375 - DNA, 20 bp, human
ggcgggggtggaggggctcg

SEQ ID NO: 139376 - DNA, 20 bp, human
gggcggctcccggacggtgg

SEQ ID NO: 139377 - DNA, 20 bp, human
gtcagatgggtccccaaaag

SEQ ID NO: 139378 - DNA, 20 bp, human
gtcccggacggtggagggta

SEQ ID NO: 139379 - DNA, 20 bp, human
ggaacttcctgactcctcgg

SEQ ID NO: 139380 - DNA, 20 bp, human
gacgcgcaccggacctgtag

SEQ ID NO: 139381 - DNA, 20 bp, human
gcgtagcgactgggtctccg

SEQ ID NO: 139382 - DNA, 20 bp, human
gccctggccgcagctcttag

SEQ ID NO: 139383 - DNA, 20 bp, human
gggcggcggctcccggacgg

SEQ ID NO: 139384 - DNA, 20 bp, human
gtacacggtcggcacatgcg

SEQ ID NO: 139385 - DNA, 20 bp, human
gttggggacacgagggtcag

SEQ ID NO: 139386 - DNA, 20 bp, human
gcgacggcgacactttgcta

SEQ ID NO: 139387 - DNA, 20 bp, human
ggcgcgggcatccctaggaa

SEQ ID NO: 139388 - DNA, 20 bp, human
gggagtgtcagcccgacctg

SEQ ID NO: 139389 - DNA, 20 bp, human
gatggtggcggcgacgacca

SEQ ID NO: 139390 - DNA, 20 bp, human
gggaatgaggcagcggaaga

SEQ ID NO: 139391 - DNA, 20 bp, human
ggcgacgaccaaggctagga

SEQ ID NO: 139392 - DNA, 20 bp, human
gttgcaggcatagaggaccc

SEQ ID NO: 139393 - DNA, 20 bp, human
gtgtcagcccgacctgagga

SEQ ID NO: 139394 - DNA, 20 bp, human
gcgaccaccttcctcaggtc

SEQ ID NO: 139395 - DNA, 20 bp, human
gctacaggagcgcagtgctt

SEQ ID NO: 139396 - DNA, 20 bp, human
gactcgggttgcgcacttcc

SEQ ID NO: 139397 - DNA, 20 bp, human
gtcgggccgagtgaccgaag

SEQ ID NO: 139398 - DNA, 20 bp, human
gctcaggagctgcccaaacg

SEQ ID NO: 139399 - DNA, 20 bp, human
gccgctaccggactacatgt

SEQ ID NO: 139400 - DNA, 20 bp, human
gcattgcgctgcggggaaag

SEQ ID NO: 139401 - DNA, 20 bp, human
gctcttgtgtgagggcctgt

SEQ ID NO: 139402 - DNA, 20 bp, human
gacgcggagcggacgcagtc

SEQ ID NO: 139403 - DNA, 20 bp, human
ggaaaggtgaggcgagagtg

SEQ ID NO: 139404 - DNA, 20 bp, human
gcgcagcagaaaggcgtccg

SEQ ID NO: 139405 - DNA, 20 bp, human
gaaagcggcctcttgtgtga

SEQ ID NO: 139406 - DNA, 20 bp, human
ggctcattgcggccaaggat

SEQ ID NO: 139407 - DNA, 20 bp, human
ggtcgaagcggccgtcgagg

SEQ ID NO: 139408 - DNA, 20 bp, human
ggccggcccggaggcccgac

SEQ ID NO: 139409 - DNA, 20 bp, human
gccggaggcccgacgggtgg

SEQ ID NO: 139410 - DNA, 20 bp, human
gcgttcgcagagctaggccg

SEQ ID NO: 139411 - DNA, 20 bp, human
ggggcggtggaccgaaggta

SEQ ID NO: 139412 - DNA, 20 bp, human
gcgctcaagcagaggtcagg

SEQ ID NO: 139413 - DNA, 20 bp, human
gaaggtacggcggtatgagg

SEQ ID NO: 139414 - DNA, 20 bp, human
gcggtggaccgaaggtacgg

SEQ ID NO: 139415 - DNA, 20 bp, human
ggcaatgagccaccacccgt

SEQ ID NO: 139416 - DNA, 20 bp, human
ggcccttcccagccaagaag

SEQ ID NO: 139417 - DNA, 20 bp, human
ggccccttcttggctgggaa

SEQ ID NO: 139418 - DNA, 20 bp, human
gaccttaacgagcccagagg

SEQ ID NO: 139419 - DNA, 20 bp, human
ggccagcgagttgaagacac

SEQ ID NO: 139420 - DNA, 20 bp, human
gggctagtgggactcgacat

SEQ ID NO: 139421 - DNA, 20 bp, human
ggcccagaggcggagactta

SEQ ID NO: 139422 - DNA, 20 bp, human
gcttgagcaggggatagtcc

SEQ ID NO: 139423 - DNA, 20 bp, human
gcaaaccttaacgagcccag

SEQ ID NO: 139424 - DNA, 20 bp, human
gccatccctatcaatgagtt

SEQ ID NO: 139425 - DNA, 20 bp, human
ggcagatggcccaagctgta

SEQ ID NO: 139426 - DNA, 20 bp, human
gagtagcaacgcaaagcgct

SEQ ID NO: 139427 - DNA, 20 bp, human
gcagagaccggaaccgaagt

SEQ ID NO: 139428 - DNA, 20 bp, human
gcccgcgagaggtaaaataa

SEQ ID NO: 139429 - DNA, 20 bp, human
gtgtgactagcctaccccac

SEQ ID NO: 139430 - DNA, 20 bp, human
gagtcaaaagatggagtgtg

SEQ ID NO: 139431 - DNA, 20 bp, human
gcggaaacagcccgtggggt

SEQ ID NO: 139432 - DNA, 20 bp, human
ggcgcttggtattgagtctg

SEQ ID NO: 139433 - DNA, 20 bp, human
gaacgtgaccctcccgcgag

SEQ ID NO: 139434 - DNA, 20 bp, human
ggcactccactaagcgatca

SEQ ID NO: 139435 - DNA, 20 bp, human
ggcaaccaggagacctggta

SEQ ID NO: 139436 - DNA, 20 bp, human
gcgtcttggccaactaccag

SEQ ID NO: 139437 - DNA, 20 bp, human
gcggcagctggatcgctcga

SEQ ID NO: 139438 - DNA, 20 bp, human
gagcgatccagctgccgctg

SEQ ID NO: 139439 - DNA, 20 bp, human
gatccagctgccgctgaggc

SEQ ID NO: 139440 - DNA, 20 bp, human
gcaacaagcttggcagagat

SEQ ID NO: 139441 - DNA, 20 bp, human
gatgctctctatagcaggtg

SEQ ID NO: 139442 - DNA, 20 bp, human
gacggagtgcctctggtagt

SEQ ID NO: 139443 - DNA, 20 bp, human
gtatgcccgacaggataaga

SEQ ID NO: 139444 - DNA, 20 bp, human
gcttggcagagattggggac

SEQ ID NO: 139445 - DNA, 20 bp, human
gggataagaaggataagagc

SEQ ID NO: 139446 - DNA, 20 bp, human
gccggaggccctgcaaccgg

SEQ ID NO: 139447 - DNA, 20 bp, human
gtggggcgcggaactccgag

SEQ ID NO: 139448 - DNA, 20 bp, human
gacagcgacagcgacgcggg

SEQ ID NO: 139449 - DNA, 20 bp, human
gagcgcggcggctagatgta

SEQ ID NO: 139450 - DNA, 20 bp, human
ggtcgccgcggtcccaggac

SEQ ID NO: 139451 - DNA, 20 bp, human
gggcaacagcgacagcgacg

SEQ ID NO: 139452 - DNA, 20 bp, human
gcgcgcctgcgaagaaaccg

SEQ ID NO: 139453 - DNA, 20 bp, human
ggcccggaagggagacgtct

SEQ ID NO: 139454 - DNA, 20 bp, human
gccaacatcgtgctgttcag

SEQ ID NO: 139455 - DNA, 20 bp, human
gggcggctagatgtagggaa

SEQ ID NO: 139456 - DNA, 20 bp, human
ggccgccgcctcagagccag

SEQ ID NO: 139457 - DNA, 20 bp, human
ggccccaggtgcaggaggtg

SEQ ID NO: 139458 - DNA, 20 bp, human
ggctcggccgctgtagtcag

SEQ ID NO: 139459 - DNA, 20 bp, human
gagtggtgtggggtgcgcaa

SEQ ID NO: 139460 - DNA, 20 bp, human
gcgctgtagtcagtggtgtg

SEQ ID NO: 139461 - DNA, 20 bp, human
gagcgcatcacagagtaagg

SEQ ID NO: 139462 - DNA, 20 bp, human
ggtgggactgcggagacgaa

SEQ ID NO: 139463 - DNA, 20 bp, human
ggtcttctcggccaactcca

SEQ ID NO: 139464 - DNA, 20 bp, human
ggggaaggcgctgagaaact

SEQ ID NO: 139465 - DNA, 20 bp, human
ggccgggcgctgcgaaggct

SEQ ID NO: 139466 - DNA, 20 bp, human
ggagaggccgccaggagacc

SEQ ID NO: 139467 - DNA, 20 bp, human
gggcctctctaggagcaaaa

SEQ ID NO: 139468 - DNA, 20 bp, human
gaaagcgccgggtctcctgg

SEQ ID NO: 139469 - DNA, 20 bp, human
gtcagggttcgactccccag

SEQ ID NO: 139470 - DNA, 20 bp, human
gggagtcgaaccctgatgat

SEQ ID NO: 139471 - DNA, 20 bp, human
gaagaaagcgccgggtctcc

SEQ ID NO: 139472 - DNA, 20 bp, human
gtgcagaaggaagaaagcgc

SEQ ID NO: 139473 - DNA, 20 bp, human
gaccacaggtcccatcatca

SEQ ID NO: 139474 - DNA, 20 bp, human
ggcgactccatgcacaagat

SEQ ID NO: 139475 - DNA, 20 bp, human
gtcagcttagggacggagaa

SEQ ID NO: 139476 - DNA, 20 bp, human
gtacgccagccacagcagag

SEQ ID NO: 139477 - DNA, 20 bp, human
ggttagatgccagcgcagaa

SEQ ID NO: 139478 - DNA, 20 bp, human
ggctcacgtcccttctgcgc

SEQ ID NO: 139479 - DNA, 20 bp, human
gcttcagcggtacctcggct

SEQ ID NO: 139480 - DNA, 20 bp, human
gttcctcttcagcggtacct

SEQ ID NO: 139481 - DNA, 20 bp, human
gaaaattgattcctcttcag

SEQ ID NO: 139482 - DNA, 20 bp, human
ggacagaatttcgacccagg

SEQ ID NO: 139483 - DNA, 20 bp, human
ggattccacgcgtcacatgt

SEQ ID NO: 139484 - DNA, 20 bp, human
gggagagaagatgtggtata

SEQ ID NO: 139485 - DNA, 20 bp, human
ggtggacagaatttcgaccc

SEQ ID NO: 139486 - DNA, 20 bp, human
gcgggggagtcgatggagtc

SEQ ID NO: 139487 - DNA, 20 bp, human
ggagaggccaatcgtagaca

SEQ ID NO: 139488 - DNA, 20 bp, human
gtaagagccgggggagtcga

SEQ ID NO: 139489 - DNA, 20 bp, human
gttactagtctaagagccgg

SEQ ID NO: 139490 - DNA, 20 bp, human
gcacttactagtctaagagc

SEQ ID NO: 139491 - DNA, 20 bp, human
gtttctttatggcgtgggag

SEQ ID NO: 139492 - DNA, 20 bp, human
gactttggctggacacgaag

SEQ ID NO: 139493 - DNA, 20 bp, human
gtatgttactcgatattgtc

SEQ ID NO: 139494 - DNA, 20 bp, human
gggggaagaagtgctcggcc

SEQ ID NO: 139495 - DNA, 20 bp, human
ggaatttttctttatggcgt

SEQ ID NO: 139496 - DNA, 20 bp, human
ggtccatgaattggccgcgg

SEQ ID NO: 139497 - DNA, 20 bp, human
gtgcaccgtgagcgcagagg

SEQ ID NO: 139498 - DNA, 20 bp, human
gggccgcggtggaaattggg

SEQ ID NO: 139499 - DNA, 20 bp, human
gcagccgccttgtgcaaaga

SEQ ID NO: 139500 - DNA, 20 bp, human
gcagccatctttgcacaagg

SEQ ID NO: 139501 - DNA, 20 bp, human
gtcctcctcctctgcgctca

SEQ ID NO: 139502 - DNA, 20 bp, human
gcgcttgcgagagaaaaggg

SEQ ID NO: 139503 - DNA, 20 bp, human
gttccaccgcggccaattca

SEQ ID NO: 139504 - DNA, 20 bp, human
ggtgcagccatctttgcaca

SEQ ID NO: 139505 - DNA, 20 bp, human
gacaggaactaccccagcgc

SEQ ID NO: 139506 - DNA, 20 bp, human
gcctgtgttaggaaccaagt

SEQ ID NO: 139507 - DNA, 20 bp, human
ggtggaagcgtctaactctt

SEQ ID NO: 139508 - DNA, 20 bp, human
gttgagggcgaagaaacaag

SEQ ID NO: 139509 - DNA, 20 bp, human
gcagggcccctccacccagg

SEQ ID NO: 139510 - DNA, 20 bp, human
gcacaggaatctagttccca

SEQ ID NO: 139511 - DNA, 20 bp, human
ggagttagacgcttccacct

SEQ ID NO: 139512 - DNA, 20 bp, human
ggagactcttgacctagcaa

SEQ ID NO: 139513 - DNA, 20 bp, human
ggcctcgaggcgaagtaaga

SEQ ID NO: 139514 - DNA, 20 bp, human
gaggcgggtgccgaagcacg

SEQ ID NO: 139515 - DNA, 20 bp, human
gtggtggggccgagactcgc

SEQ ID NO: 139516 - DNA, 20 bp, human
gaactcagcgtagatcccca

SEQ ID NO: 139517 - DNA, 20 bp, human
gtcgggccgcgggagaactg

SEQ ID NO: 139518 - DNA, 20 bp, human
gagctccgctcagacagggg

SEQ ID NO: 139519 - DNA, 20 bp, human
gcaaagctccgctcagacag

SEQ ID NO: 139520 - DNA, 20 bp, human
ggcttgacagtggatccctg

SEQ ID NO: 139521 - DNA, 20 bp, human
ggcggcgctgaagcttacag

SEQ ID NO: 139522 - DNA, 20 bp, human
gagtgatccgctgatcgagg

SEQ ID NO: 139523 - DNA, 20 bp, human
gcccgggattggagtgaaga

SEQ ID NO: 139524 - DNA, 20 bp, human
gggatcgcagagggatccag

SEQ ID NO: 139525 - DNA, 20 bp, human
gctgccaccgcctcgatcag

SEQ ID NO: 139526 - DNA, 20 bp, human
gggtcgttccgccgcccaca

SEQ ID NO: 139527 - DNA, 20 bp, human
gggggaccatagagacgaag

SEQ ID NO: 139528 - DNA, 20 bp, human
ggagcctacggagccgacag

SEQ ID NO: 139529 - DNA, 20 bp, human
gcggcctctgtcggctccgt

SEQ ID NO: 139530 - DNA, 20 bp, human
gggtagacctggcgacgacg

SEQ ID NO: 139531 - DNA, 20 bp, human
gcatagagacgaagaggtgg

SEQ ID NO: 139532 - DNA, 20 bp, human
gccgtaggctcaggtagacc

SEQ ID NO: 139533 - DNA, 20 bp, human
ggagcgcccccggcctctgt

SEQ ID NO: 139534 - DNA, 20 bp, human
gggacgacgccccttatcgg

SEQ ID NO: 139535 - DNA, 20 bp, human
gagcgtacgcctccgataag

SEQ ID NO: 139536 - DNA, 20 bp, human
ggcgcggacttggagagatc

SEQ ID NO: 139537 - DNA, 20 bp, human
gcgcggccgagagcacgaag

SEQ ID NO: 139538 - DNA, 20 bp, human
gtgcccgggtggaaggtcca

SEQ ID NO: 139539 - DNA, 20 bp, human
gccgggtggaaggtccaggg

SEQ ID NO: 139540 - DNA, 20 bp, human
gcgggtcaacctggaagccg

SEQ ID NO: 139541 - DNA, 20 bp, human
gcgcagcgcgcagcaattgg

SEQ ID NO: 139542 - DNA, 20 bp, human
gagccggggctcgagtccct

SEQ ID NO: 139543 - DNA, 20 bp, human
gttcgggaaaccagaaccct

SEQ ID NO: 139544 - DNA, 20 bp, human
ggggcgcgctcgggtcaacc

SEQ ID NO: 139545 - DNA, 20 bp, human
gaggcctcgcgcggtgaacg

SEQ ID NO: 139546 - DNA, 20 bp, human
ggtaggagcagctgcacgtc

SEQ ID NO: 139547 - DNA, 20 bp, human
gcgtcaggtgcaagagaaac

SEQ ID NO: 139548 - DNA, 20 bp, human
ggcctgatacagcagcccgg

SEQ ID NO: 139549 - DNA, 20 bp, human
gggaagcaagtggtgcctcc

SEQ ID NO: 139550 - DNA, 20 bp, human
gagacaggggtaccctggat

SEQ ID NO: 139551 - DNA, 20 bp, human
gggattacaggtacaggcag

SEQ ID NO: 139552 - DNA, 20 bp, human
gggtaccctggataggaatg

SEQ ID NO: 139553 - DNA, 20 bp, human
ggcctccgggctgctgtatc

SEQ ID NO: 139554 - DNA, 20 bp, human
gcctccagcctggagcagtc

SEQ ID NO: 139555 - DNA, 20 bp, human
gcagtgggatgagtcttgag

SEQ ID NO: 139556 - DNA, 20 bp, human
ggtagcagcgccagggacgg

SEQ ID NO: 139557 - DNA, 20 bp, human
ggccgcgtctcgggagttga

SEQ ID NO: 139558 - DNA, 20 bp, human
gcccggtccccccacatctt

SEQ ID NO: 139559 - DNA, 20 bp, human
gcagggagcgcccaagatgt

SEQ ID NO: 139560 - DNA, 20 bp, human
gctgggcgacctgaaggacg

SEQ ID NO: 139561 - DNA, 20 bp, human
gtcggctcggggctgcagac

SEQ ID NO: 139562 - DNA, 20 bp, human
gaaggaggtgagaggcgcag

SEQ ID NO: 139563 - DNA, 20 bp, human
ggagccgagcgccgcgtctc

SEQ ID NO: 139564 - DNA, 20 bp, human
gggaccccggaggggtcgaa

SEQ ID NO: 139565 - DNA, 20 bp, human
gtcggctggacaggacgagg

SEQ ID NO: 139566 - DNA, 20 bp, human
gcgcgccgctcactactgaa

SEQ ID NO: 139567 - DNA, 20 bp, human
gtgtctgtggagtaacctac

SEQ ID NO: 139568 - DNA, 20 bp, human
gccactggcaaacttaaccc

SEQ ID NO: 139569 - DNA, 20 bp, human
gcaggaacgacatttaccac

SEQ ID NO: 139570 - DNA, 20 bp, human
gtcactactgaatggggtcc

SEQ ID NO: 139571 - DNA, 20 bp, human
gaccagctccgcgacgccgc

SEQ ID NO: 139572 - DNA, 20 bp, human
gcagtagtgagcggcgcgct

SEQ ID NO: 139573 - DNA, 20 bp, human
gtatactaacagccactctc

SEQ ID NO: 139574 - DNA, 20 bp, human
gctctcacgcagcggagctg

SEQ ID NO: 139575 - DNA, 20 bp, human
gaatgggccattcgtcacca

SEQ ID NO: 139576 - DNA, 20 bp, human
gcagtcccgggagcaccccc

SEQ ID NO: 139577 - DNA, 20 bp, human
gaacccggggactcaaagag

SEQ ID NO: 139578 - DNA, 20 bp, human
ggcggcggcatgggcgggaa

SEQ ID NO: 139579 - DNA, 20 bp, human
gctgcgtcctgtccaggccg

SEQ ID NO: 139580 - DNA, 20 bp, human
gcgactcgcccacagtcgga

SEQ ID NO: 139581 - DNA, 20 bp, human
gggacccgctccgcgcacag

SEQ ID NO: 139582 - DNA, 20 bp, human
gcctcccgccgtccgactgt

SEQ ID NO: 139583 - DNA, 20 bp, human
gcggcggctgcgtcctgtcc

SEQ ID NO: 139584 - DNA, 20 bp, human
ggccgcgactcgcccacagt

SEQ ID NO: 139585 - DNA, 20 bp, human
ggagcaaagtgccaggacag

SEQ ID NO: 139586 - DNA, 20 bp, human
gcctggtgagcgttcccacc

SEQ ID NO: 139587 - DNA, 20 bp, human
gaggcgctgcctaagggagc

SEQ ID NO: 139588 - DNA, 20 bp, human
gcactgtgcggccgtcgtgg

SEQ ID NO: 139589 - DNA, 20 bp, human
gcccaatcaggtagtgagag

SEQ ID NO: 139590 - DNA, 20 bp, human
ggggatattgaggagtccgg

SEQ ID NO: 139591 - DNA, 20 bp, human
ggttcccacctgggatattg

SEQ ID NO: 139592 - DNA, 20 bp, human
gtgccgcgaggggtaggagt

SEQ ID NO: 139593 - DNA, 20 bp, human
gtacctgattgggaaactga

SEQ ID NO: 139594 - DNA, 20 bp, human
gggtggctcaggagaacggc

SEQ ID NO: 139595 - DNA, 20 bp, human
ggaggacgaaggccgataca

SEQ ID NO: 139596 - DNA, 20 bp, human
gactcctccgggaaagaaca

SEQ ID NO: 139597 - DNA, 20 bp, human
gcctccgggaaagaacaagg

SEQ ID NO: 139598 - DNA, 20 bp, human
gaggacactcagcgtatgaa

SEQ ID NO: 139599 - DNA, 20 bp, human
gtacggttcggaagagggaa

SEQ ID NO: 139600 - DNA, 20 bp, human
ggtgaggactcgctctgcta

SEQ ID NO: 139601 - DNA, 20 bp, human
gcaacaagcagcccaggttg

SEQ ID NO: 139602 - DNA, 20 bp, human
gaaagttttggagaacaacg

SEQ ID NO: 139603 - DNA, 20 bp, human
gcccagatgatgtggaaccc

SEQ ID NO: 139604 - DNA, 20 bp, human
gtcctagcctgcctcaacct

SEQ ID NO: 139605 - DNA, 20 bp, human
ggttgaggcaggctaggaga

SEQ ID NO: 139606 - DNA, 20 bp, human
gggccgtggatgaagagctg

SEQ ID NO: 139607 - DNA, 20 bp, human
gagccgtggatgagccgtgg

SEQ ID NO: 139608 - DNA, 20 bp, human
ggacatgggtgaagagccgt

SEQ ID NO: 139609 - DNA, 20 bp, human
gaagagccgtggatgagccg

SEQ ID NO: 139610 - DNA, 20 bp, human
gatgtggccaaggcaccacc

SEQ ID NO: 139611 - DNA, 20 bp, human
gttcccccacggctcatcca

SEQ ID NO: 139612 - DNA, 20 bp, human
gttcaacagctcttccccca

SEQ ID NO: 139613 - DNA, 20 bp, human
gagttgtgaatgaaaagccg

SEQ ID NO: 139614 - DNA, 20 bp, human
gtgaagagctgtggatgaac

SEQ ID NO: 139615 - DNA, 20 bp, human
gggcatggatgaaggactgt

SEQ ID NO: 139616 - DNA, 20 bp, human
gagcctcgtcaagggctcag

SEQ ID NO: 139617 - DNA, 20 bp, human
ggaggaggctcggcacaggt

SEQ ID NO: 139618 - DNA, 20 bp, human
gctaagggccctacccacct

SEQ ID NO: 139619 - DNA, 20 bp, human
gctcccctgagcccttgacg

SEQ ID NO: 139620 - DNA, 20 bp, human
gaggctcccacttagggacg

SEQ ID NO: 139621 - DNA, 20 bp, human
gccctgccccgtccctaagt

SEQ ID NO: 139622 - DNA, 20 bp, human
gcctcctggcctgtctggac

SEQ ID NO: 139623 - DNA, 20 bp, human
gaggccaggagggcggcagt

SEQ ID NO: 139624 - DNA, 20 bp, human
gcggggggcccggtccagac

SEQ ID NO: 139625 - DNA, 20 bp, human
ggggccatctggaaacctgt

SEQ ID NO: 139626 - DNA, 20 bp, human
gacggactgcggtctccggg

SEQ ID NO: 139627 - DNA, 20 bp, human
gctctcagcagcacggactg

SEQ ID NO: 139628 - DNA, 20 bp, human
ggaaggggcgaaggaccgcg

SEQ ID NO: 139629 - DNA, 20 bp, human
gagagcgccgtcgaggctat

SEQ ID NO: 139630 - DNA, 20 bp, human
gcgaggctctctcagcagca

SEQ ID NO: 139631 - DNA, 20 bp, human
gaggcccaagagcgccgtcg

SEQ ID NO: 139632 - DNA, 20 bp, human
ggggcctagcagaggacgta

SEQ ID NO: 139633 - DNA, 20 bp, human
gcagaggacgtagggagcgc

SEQ ID NO: 139634 - DNA, 20 bp, human
gtaggcgaggcgggttgggg

SEQ ID NO: 139635 - DNA, 20 bp, human
gcagcacggactgcggtctc

SEQ ID NO: 139636 - DNA, 20 bp, human
gctgcatcaggaaggcccaa

SEQ ID NO: 139637 - DNA, 20 bp, human
gcagactacggtcccccagg

SEQ ID NO: 139638 - DNA, 20 bp, human
gagcctggaagacccggcgg

SEQ ID NO: 139639 - DNA, 20 bp, human
ggcccagactacggtccccc

SEQ ID NO: 139640 - DNA, 20 bp, human
ggtggtgcctcgccggccac

SEQ ID NO: 139641 - DNA, 20 bp, human
gcgagtcctcggagctcccg

SEQ ID NO: 139642 - DNA, 20 bp, human
ggggcctagcagcggacgtg

SEQ ID NO: 139643 - DNA, 20 bp, human
gctcccggggcgcctcctgg

SEQ ID NO: 139644 - DNA, 20 bp, human
ggctgctggtggtgcctcgc

SEQ ID NO: 139645 - DNA, 20 bp, human
gccacggccgggtcccccgc

SEQ ID NO: 139646 - DNA, 20 bp, human
ggcgtccaggaccaccatgg

SEQ ID NO: 139647 - DNA, 20 bp, human
ggcgggccccgaatcccgag

SEQ ID NO: 139648 - DNA, 20 bp, human
gcggctgcccatcacctcga

SEQ ID NO: 139649 - DNA, 20 bp, human
ggcctcccggagatcggagt

SEQ ID NO: 139650 - DNA, 20 bp, human
ggggaacctcgcacgctgtg

SEQ ID NO: 139651 - DNA, 20 bp, human
ggcagcgccgtcgaggtgat

SEQ ID NO: 139652 - DNA, 20 bp, human
gaccgactccgatctccggg

SEQ ID NO: 139653 - DNA, 20 bp, human
gcgagtcctcggagctctgg

SEQ ID NO: 139654 - DNA, 20 bp, human
ggccaagcgcagccgattgg

SEQ ID NO: 139655 - DNA, 20 bp, human
gaggcgcccccagagctccg

SEQ ID NO: 139656 - DNA, 20 bp, human
gtgggagccagaggccgtag

SEQ ID NO: 139657 - DNA, 20 bp, human
gggattccggaactagagtg

SEQ ID NO: 139658 - DNA, 20 bp, human
ggctcgagccctgcccgcta

SEQ ID NO: 139659 - DNA, 20 bp, human
gtggagcacagagctctcga

SEQ ID NO: 139660 - DNA, 20 bp, human
gtggagtagagcagtccgac

SEQ ID NO: 139661 - DNA, 20 bp, human
gtgcgggggaccagctgcgt

SEQ ID NO: 139662 - DNA, 20 bp, human
gcccgccggggactcccagg

SEQ ID NO: 139663 - DNA, 20 bp, human
gcgcggaggggcgaagaccc

SEQ ID NO: 139664 - DNA, 20 bp, human
ggtgccgcgggagaccgcgt

SEQ ID NO: 139665 - DNA, 20 bp, human
ggtacccacgcggtctcccg

SEQ ID NO: 139666 - DNA, 20 bp, human
gggtcaccccaacacgggtg

SEQ ID NO: 139667 - DNA, 20 bp, human
gcagccaggtcaccccaaca

SEQ ID NO: 139668 - DNA, 20 bp, human
gtacgtggagaccagaccac

SEQ ID NO: 139669 - DNA, 20 bp, human
gaccagaagcccccgtgcag

SEQ ID NO: 139670 - DNA, 20 bp, human
gagaagcccccgtgcagagg

SEQ ID NO: 139671 - DNA, 20 bp, human
gacccatggggtggtaagtg

SEQ ID NO: 139672 - DNA, 20 bp, human
ggcagctgccccacccgtgt

SEQ ID NO: 139673 - DNA, 20 bp, human
gttcgaggcctgtgacccat

SEQ ID NO: 139674 - DNA, 20 bp, human
gccagcagccacctctgcac

SEQ ID NO: 139675 - DNA, 20 bp, human
gtgcgggccccttctcacaa

SEQ ID NO: 139676 - DNA, 20 bp, human
ggcgcagccgcagaacagta

SEQ ID NO: 139677 - DNA, 20 bp, human
ggcagaacagtaggggaaag

SEQ ID NO: 139678 - DNA, 20 bp, human
gggctgcagcgggatttgga

SEQ ID NO: 139679 - DNA, 20 bp, human
gggcatcgtgtctgcggcaa

SEQ ID NO: 139680 - DNA, 20 bp, human
gcgggatttggagggtagtg

SEQ ID NO: 139681 - DNA, 20 bp, human
gttggagggtagtgaggaag

SEQ ID NO: 139682 - DNA, 20 bp, human
ggctgtaacggaaggaggaa

SEQ ID NO: 139683 - DNA, 20 bp, human
gcgtttcggcatcgtgtctg

SEQ ID NO: 139684 - DNA, 20 bp, human
gcaatggctgcagcgggatt

SEQ ID NO: 139685 - DNA, 20 bp, human
gtaataaggtgcgaaggagg

SEQ ID NO: 139686 - DNA, 20 bp, human
gagaatgcaagactgatcca

SEQ ID NO: 139687 - DNA, 20 bp, human
gaggaccagcagcatcttga

SEQ ID NO: 139688 - DNA, 20 bp, human
gctctgcgttgagagaaaca

SEQ ID NO: 139689 - DNA, 20 bp, human
gcagaaggaccactgagagc

SEQ ID NO: 139690 - DNA, 20 bp, human
gtctcagtggacagcgatga

SEQ ID NO: 139691 - DNA, 20 bp, human
ggcacaacagatgtcatcct

SEQ ID NO: 139692 - DNA, 20 bp, human
ggcctccttcaagatgctgc

SEQ ID NO: 139693 - DNA, 20 bp, human
gtcaccctacaccactgcag

SEQ ID NO: 139694 - DNA, 20 bp, human
gaggggccatgactcttcta

SEQ ID NO: 139695 - DNA, 20 bp, human
gtcttccgctgcagtggtgt

SEQ ID NO: 139696 - DNA, 20 bp, human
gggacccgagacggaggcgc

SEQ ID NO: 139697 - DNA, 20 bp, human
gcgcgcggccagcacagacc

SEQ ID NO: 139698 - DNA, 20 bp, human
gcggctccagggcctccggg

SEQ ID NO: 139699 - DNA, 20 bp, human
gtagcccgcggacggctcag

SEQ ID NO: 139700 - DNA, 20 bp, human
gcgccgggttaatcattgca

SEQ ID NO: 139701 - DNA, 20 bp, human
gacagacccggcgcaaacgg

SEQ ID NO: 139702 - DNA, 20 bp, human
gggcgcgggacccgagacgg

SEQ ID NO: 139703 - DNA, 20 bp, human
ggcggcccctagcccgcgga

SEQ ID NO: 139704 - DNA, 20 bp, human
gccaggaacgctgccgaagg

SEQ ID NO: 139705 - DNA, 20 bp, human
gggccccgcgcctccgtctc

SEQ ID NO: 139706 - DNA, 20 bp, human
gcgcgcggccagcacagacc

SEQ ID NO: 139707 - DNA, 20 bp, human
gcggctccagggcctccggg

SEQ ID NO: 139708 - DNA, 20 bp, human
gtagcccgcggacggctcag

SEQ ID NO: 139709 - DNA, 20 bp, human
gcgccgggttaatcattgca

SEQ ID NO: 139710 - DNA, 20 bp, human
gacagacccggcgcaaacgg

SEQ ID NO: 139711 - DNA, 20 bp, human
gggcgcgggacccgagacgg

SEQ ID NO: 139712 - DNA, 20 bp, human
ggcggcccctagcccgcgga

SEQ ID NO: 139713 - DNA, 20 bp, human
gccaggaacgctgccgaagg

SEQ ID NO: 139714 - DNA, 20 bp, human
gggccccgcgcctccgtctc

SEQ ID NO: 139715 - DNA, 20 bp, human
gcggcccggggcccttggtg

SEQ ID NO: 139716 - DNA, 20 bp, human
gcggggtccgtggccaggta

SEQ ID NO: 139717 - DNA, 20 bp, human
ggtccgtggccaggtaaggc

SEQ ID NO: 139718 - DNA, 20 bp, human
gctgcccgggagccacgtcc

SEQ ID NO: 139719 - DNA, 20 bp, human
ggcagacccggcacgcaggt

SEQ ID NO: 139720 - DNA, 20 bp, human
gcgtggccaggtaaggcggg

SEQ ID NO: 139721 - DNA, 20 bp, human
gcccaggacggaagcaaaaa

SEQ ID NO: 139722 - DNA, 20 bp, human
gccaaaacgcaggctgagag

SEQ ID NO: 139723 - DNA, 20 bp, human
gcgacctaacctgagacccc

SEQ ID NO: 139724 - DNA, 20 bp, human
gacaccccaaacctacaagg

SEQ ID NO: 139725 - DNA, 20 bp, human
gcgccgccgcccgccttacc

SEQ ID NO: 139726 - DNA, 20 bp, human
gggcggccgtaagatgagag

SEQ ID NO: 139727 - DNA, 20 bp, human
gtggacgggaccccatctga

SEQ ID NO: 139728 - DNA, 20 bp, human
gccgcggagctcccacagcc

SEQ ID NO: 139729 - DNA, 20 bp, human
gagaggaaccgaggctggac

SEQ ID NO: 139730 - DNA, 20 bp, human
gaccgcgcgctaatctgacg

SEQ ID NO: 139731 - DNA, 20 bp, human
gaggcgcgcggagtctgggg

SEQ ID NO: 139732 - DNA, 20 bp, human
ggtggcgggggtaggagcta

SEQ ID NO: 139733 - DNA, 20 bp, human
gcgcgagtcaacaaacgctt

SEQ ID NO: 139734 - DNA, 20 bp, human
ggcctgcagcgtccgatcgg

SEQ ID NO: 139735 - DNA, 20 bp, human
gttgttgactcgcgctggag

SEQ ID NO: 139736 - DNA, 20 bp, human
gcggcaacacgactgcgggg

SEQ ID NO: 139737 - DNA, 20 bp, human
gcagacagtggcagcgaaag

SEQ ID NO: 139738 - DNA, 20 bp, human
gggagagcgccagtgagcga

SEQ ID NO: 139739 - DNA, 20 bp, human
ggagcgcaaccccgttgctg

SEQ ID NO: 139740 - DNA, 20 bp, human
ggagcgagggagccggaacg

SEQ ID NO: 139741 - DNA, 20 bp, human
ggcagctgaggtcgagaacc

SEQ ID NO: 139742 - DNA, 20 bp, human
gaacggttgccacagcaacg

SEQ ID NO: 139743 - DNA, 20 bp, human
gctccccggcaacacgactg

SEQ ID NO: 139744 - DNA, 20 bp, human
gggctgtgggcccgcgtcgg

SEQ ID NO: 139745 - DNA, 20 bp, human
ggcgcctccagcccagcgct

SEQ ID NO: 139746 - DNA, 20 bp, human
ggcctaaagacagagtaaca

SEQ ID NO: 139747 - DNA, 20 bp, human
ggttgaagatcaggtaagtg

SEQ ID NO: 139748 - DNA, 20 bp, human
ggctatggatgtctagacag

SEQ ID NO: 139749 - DNA, 20 bp, human
gcttcaacaagactcaacaa

SEQ ID NO: 139750 - DNA, 20 bp, human
ggatggaagaactaatggaa

SEQ ID NO: 139751 - DNA, 20 bp, human
gtggactgtgaagcccagca

SEQ ID NO: 139752 - DNA, 20 bp, human
gtggcacctgtctccaaagt

SEQ ID NO: 139753 - DNA, 20 bp, human
gttcgtagactagaagagaa

SEQ ID NO: 139754 - DNA, 20 bp, human
gagaaagtacagtccataag

SEQ ID NO: 139755 - DNA, 20 bp, human
gaaaacctgtggtaagactg

SEQ ID NO: 139756 - DNA, 20 bp, human
gcacgccgaggtaacttcca

SEQ ID NO: 139757 - DNA, 20 bp, human
gagcttggagaagacaacga

SEQ ID NO: 139758 - DNA, 20 bp, human
ggctctggccccaccttcca

SEQ ID NO: 139759 - DNA, 20 bp, human
gagagtgtggtatgataggg

SEQ ID NO: 139760 - DNA, 20 bp, human
gtgctcctgtccaaggacca

SEQ ID NO: 139761 - DNA, 20 bp, human
gagacaacgaaggcgcaccc

SEQ ID NO: 139762 - DNA, 20 bp, human
gtgaagagtgtggtatgata

SEQ ID NO: 139763 - DNA, 20 bp, human
ggcgtggtcgctgaagagtg

SEQ ID NO: 139764 - DNA, 20 bp, human
ggggacgtagaactacagct

SEQ ID NO: 139765 - DNA, 20 bp, human
gtgtggtatgatagggaggt

SEQ ID NO: 139766 - DNA, 20 bp, human
ggggcggcggttgcccggat

SEQ ID NO: 139767 - DNA, 20 bp, human
gccccgactaacggcccatc

SEQ ID NO: 139768 - DNA, 20 bp, human
gtcagccgcggagtgagcga

SEQ ID NO: 139769 - DNA, 20 bp, human
gagacgggaggagccgaacc

SEQ ID NO: 139770 - DNA, 20 bp, human
gaggagcgcagcggagggta

SEQ ID NO: 139771 - DNA, 20 bp, human
gatccgggacccgggcctag

SEQ ID NO: 139772 - DNA, 20 bp, human
gaagccaggagcgcagcgga

SEQ ID NO: 139773 - DNA, 20 bp, human
gggcgcggcccaccaccacg

SEQ ID NO: 139774 - DNA, 20 bp, human
gggagggggcccacaaatgg

SEQ ID NO: 139775 - DNA, 20 bp, human
gggagtagaggtaccggagg

SEQ ID NO: 139776 - DNA, 20 bp, human
gcaaccctgggccttacctg

SEQ ID NO: 139777 - DNA, 20 bp, human
ggtttggggcaaattaccaa

SEQ ID NO: 139778 - DNA, 20 bp, human
ggatcctcaggtaaggccca

SEQ ID NO: 139779 - DNA, 20 bp, human
ggcgattagatcctcaggta

SEQ ID NO: 139780 - DNA, 20 bp, human
ggcctgtttgataagtataa

SEQ ID NO: 139781 - DNA, 20 bp, human
gtagacgcgattagatcctc

SEQ ID NO: 139782 - DNA, 20 bp, human
gtcacctggttagacagatg

SEQ ID NO: 139783 - DNA, 20 bp, human
gggaccacatctgtctaacc

SEQ ID NO: 139784 - DNA, 20 bp, human
ggcttcaataaggtaataga

SEQ ID NO: 139785 - DNA, 20 bp, human
gttccactacagaaagagtc

SEQ ID NO: 139786 - DNA, 20 bp, human
gtgaccggtaaggaaagcga

SEQ ID NO: 139787 - DNA, 20 bp, human
gacactcaccctgaccggta

SEQ ID NO: 139788 - DNA, 20 bp, human
ggaaagctgcgaaagtgctt

SEQ ID NO: 139789 - DNA, 20 bp, human
gccaggactggggtctaggt

SEQ ID NO: 139790 - DNA, 20 bp, human
ggtcatgacgtagtacgtag

SEQ ID NO: 139791 - DNA, 20 bp, human
gctttcgcagctttccgagg

SEQ ID NO: 139792 - DNA, 20 bp, human
gtcccgctgcagaccacatg

SEQ ID NO: 139793 - DNA, 20 bp, human
gactggaaaagccgaagctg

SEQ ID NO: 139794 - DNA, 20 bp, human
gcatggggcgggtctgactc

SEQ ID NO: 139795 - DNA, 20 bp, human
gtgcagcgggagttctggac

SEQ ID NO: 139796 - DNA, 20 bp, human
gagcttgggacgtccctcat

SEQ ID NO: 139797 - DNA, 20 bp, human
gcgacgtgcggctcgcagaa

SEQ ID NO: 139798 - DNA, 20 bp, human
gagctaggctcggcagaaat

SEQ ID NO: 139799 - DNA, 20 bp, human
ggaaagcagcgctggaggaa

SEQ ID NO: 139800 - DNA, 20 bp, human
gctcgcagaacggcgagtag

SEQ ID NO: 139801 - DNA, 20 bp, human
gggacaccctccagcaccgt

SEQ ID NO: 139802 - DNA, 20 bp, human
ggccctggccggacacccac

SEQ ID NO: 139803 - DNA, 20 bp, human
gccctgcttggtgcccatga

SEQ ID NO: 139804 - DNA, 20 bp, human
gctagctggagccaggaacc

SEQ ID NO: 139805 - DNA, 20 bp, human
gagaacggcgagtagcggag

SEQ ID NO: 139806 - DNA, 20 bp, human
ggaagactccagatcaccag

SEQ ID NO: 139807 - DNA, 20 bp, human
ggctacagccagctgtgaaa

SEQ ID NO: 139808 - DNA, 20 bp, human
gtcccgcccagggcaggtaa

SEQ ID NO: 139809 - DNA, 20 bp, human
gtgggtctagggacctaagt

SEQ ID NO: 139810 - DNA, 20 bp, human
gtgacaatgagcacagaaag

SEQ ID NO: 139811 - DNA, 20 bp, human
gcgcccacctgccagaaacg

SEQ ID NO: 139812 - DNA, 20 bp, human
gaagattacgagagaggcag

SEQ ID NO: 139813 - DNA, 20 bp, human
gggcctggttaccgggagtg

SEQ ID NO: 139814 - DNA, 20 bp, human
ggggatcaggcctggttacc

SEQ ID NO: 139815 - DNA, 20 bp, human
gcaggtgctgtagacacagt

SEQ ID NO: 139816 - DNA, 20 bp, human
gtggccgacggggagcaggt

SEQ ID NO: 139817 - DNA, 20 bp, human
gacggctgggccggaccggg

SEQ ID NO: 139818 - DNA, 20 bp, human
ggcgcacttcggccctggag

SEQ ID NO: 139819 - DNA, 20 bp, human
gcgggctgcgtgcgcaaaca

SEQ ID NO: 139820 - DNA, 20 bp, human
gtcggccaagccccccggtc

SEQ ID NO: 139821 - DNA, 20 bp, human
gttgggtgtcccagtcccga

SEQ ID NO: 139822 - DNA, 20 bp, human
gccgcccacctgctccccgt

SEQ ID NO: 139823 - DNA, 20 bp, human
gctgggcccggagaacggtg

SEQ ID NO: 139824 - DNA, 20 bp, human
ggctgcgtgcgcaaacaggg

SEQ ID NO: 139825 - DNA, 20 bp, human
gggcgacggagtgggccgag

SEQ ID NO: 139826 - DNA, 20 bp, human
gaccctgccgagggctgatc

SEQ ID NO: 139827 - DNA, 20 bp, human
gccgcgcgcaaacctgggaa

SEQ ID NO: 139828 - DNA, 20 bp, human
gagccctcggcagggtcact

SEQ ID NO: 139829 - DNA, 20 bp, human
ggaggcggccgacggaggac

SEQ ID NO: 139830 - DNA, 20 bp, human
ggtcctgcctcggtccgggg

SEQ ID NO: 139831 - DNA, 20 bp, human
ggggcctggggttcgcagag

SEQ ID NO: 139832 - DNA, 20 bp, human
gcaggtgcccgatcagccct

SEQ ID NO: 139833 - DNA, 20 bp, human
ggcagcccctgagagcgcct

SEQ ID NO: 139834 - DNA, 20 bp, human
gacacaggtacgaggcctgg

SEQ ID NO: 139835 - DNA, 20 bp, human
gtgaggtcctgcctcggtcc

SEQ ID NO: 139836 - DNA, 20 bp, human
gcggccgaggacccccactc

SEQ ID NO: 139837 - DNA, 20 bp, human
ggtccctgcagccggagtgg

SEQ ID NO: 139838 - DNA, 20 bp, human
gtcggccggtgctggagtct

SEQ ID NO: 139839 - DNA, 20 bp, human
gctgcggtctcgctgggaca

SEQ ID NO: 139840 - DNA, 20 bp, human
gtggagacatgaccagatgg

SEQ ID NO: 139841 - DNA, 20 bp, human
gagggtccctgcagccggag

SEQ ID NO: 139842 - DNA, 20 bp, human
gggcatggagacatcctgtg

SEQ ID NO: 139843 - DNA, 20 bp, human
gttgcagggatggcatcatt

SEQ ID NO: 139844 - DNA, 20 bp, human
gcagatggacaatcactggc

SEQ ID NO: 139845 - DNA, 20 bp, human
gccacagctgaggaggggta

SEQ ID NO: 139846 - DNA, 20 bp, human
ggcctcagccatgaacaacg

SEQ ID NO: 139847 - DNA, 20 bp, human
gccaagtctggaacccacgg

SEQ ID NO: 139848 - DNA, 20 bp, human
gtaggtgctggggaggaaac

SEQ ID NO: 139849 - DNA, 20 bp, human
gcgatgcattaggaagatcc

SEQ ID NO: 139850 - DNA, 20 bp, human
ggcgcaggggaatgacggat

SEQ ID NO: 139851 - DNA, 20 bp, human
ggcgatccatttaggccagt

SEQ ID NO: 139852 - DNA, 20 bp, human
gcgcaacacagacccaggac

SEQ ID NO: 139853 - DNA, 20 bp, human
gatcccaagtctggaaccca

SEQ ID NO: 139854 - DNA, 20 bp, human
gagagagcgcaggggaatga

SEQ ID NO: 139855 - DNA, 20 bp, human
gtccgcgttgttcatggctg

SEQ ID NO: 139856 - DNA, 20 bp, human
gctgctgcaaaagccagcag

SEQ ID NO: 139857 - DNA, 20 bp, human
gggagggagcaagtcagcta

SEQ ID NO: 139858 - DNA, 20 bp, human
ggcactccgacaggccgact

SEQ ID NO: 139859 - DNA, 20 bp, human
gggaggcgccagcccaccga

SEQ ID NO: 139860 - DNA, 20 bp, human
gccggcgtcgaggtgagacc

SEQ ID NO: 139861 - DNA, 20 bp, human
gggcttccctcgccttcggt

SEQ ID NO: 139862 - DNA, 20 bp, human
gggcgggctgaaccatcggg

SEQ ID NO: 139863 - DNA, 20 bp, human
gcgacaggccgactgggcag

SEQ ID NO: 139864 - DNA, 20 bp, human
gagcggcagcgggagctgtc

SEQ ID NO: 139865 - DNA, 20 bp, human
ggcgggagctgtccggaggc

SEQ ID NO: 139866 - DNA, 20 bp, human
ggcgcgcaaggtgaacacgg

SEQ ID NO: 139867 - DNA, 20 bp, human
gctgccaacccaagagatgt

SEQ ID NO: 139868 - DNA, 20 bp, human
gccgagtctgagcatctcgg

SEQ ID NO: 139869 - DNA, 20 bp, human
ggacgcgcgcaaggtgaaca

SEQ ID NO: 139870 - DNA, 20 bp, human
gccagggagagaggagacgg

SEQ ID NO: 139871 - DNA, 20 bp, human
ggcacctgcggacaaggcgg

SEQ ID NO: 139872 - DNA, 20 bp, human
ggcaggtgcccacatctctt

SEQ ID NO: 139873 - DNA, 20 bp, human
gacagcctctccagcagagt

SEQ ID NO: 139874 - DNA, 20 bp, human
gatgtgggcacctgcggaca

SEQ ID NO: 139875 - DNA, 20 bp, human
ggtgcccacatctcttgggt

SEQ ID NO: 139876 - DNA, 20 bp, human
gactccgcgctccctcccag

SEQ ID NO: 139877 - DNA, 20 bp, human
ggagcaatcacacactccca

SEQ ID NO: 139878 - DNA, 20 bp, human
gtgggcacaacagagagaag

SEQ ID NO: 139879 - DNA, 20 bp, human
gaggtccggatcttcagtcg

SEQ ID NO: 139880 - DNA, 20 bp, human
gtctcgccaggctcacagcg

SEQ ID NO: 139881 - DNA, 20 bp, human
gccgcagcgctctcaccagg

SEQ ID NO: 139882 - DNA, 20 bp, human
gctaggcgaggggccgccgg

SEQ ID NO: 139883 - DNA, 20 bp, human
gtgcctgcgggagagacccc

SEQ ID NO: 139884 - DNA, 20 bp, human
gggcccgcagcgctctcacc

SEQ ID NO: 139885 - DNA, 20 bp, human
ggatccggacctccagcccc

SEQ ID NO: 139886 - DNA, 20 bp, human
ggtcactcctgagaatccac

SEQ ID NO: 139887 - DNA, 20 bp, human
gagggggtctgtgaaacgtc

SEQ ID NO: 139888 - DNA, 20 bp, human
gtccgacggagggtgctggt

SEQ ID NO: 139889 - DNA, 20 bp, human
ggagtgactaaagtttcagg

SEQ ID NO: 139890 - DNA, 20 bp, human
gactctgatgttggcaaagg

SEQ ID NO: 139891 - DNA, 20 bp, human
ggttttttggtcccagggaa

SEQ ID NO: 139892 - DNA, 20 bp, human
gtgcactcctgtggattctc

SEQ ID NO: 139893 - DNA, 20 bp, human
gataggagcctgtaattacg

SEQ ID NO: 139894 - DNA, 20 bp, human
ggcttcaagagtccgacgga

SEQ ID NO: 139895 - DNA, 20 bp, human
gactaaagtttcaggaggag

SEQ ID NO: 139896 - DNA, 20 bp, human
gctacgggcacgttctggag

SEQ ID NO: 139897 - DNA, 20 bp, human
gagtcgccgggactcaccag

SEQ ID NO: 139898 - DNA, 20 bp, human
ggcggccgcttggacagccc

SEQ ID NO: 139899 - DNA, 20 bp, human
gcacaggcggatgagaacgt

SEQ ID NO: 139900 - DNA, 20 bp, human
gggccctgcggtctcaggca

SEQ ID NO: 139901 - DNA, 20 bp, human
gtccagctacgggcacgttc

SEQ ID NO: 139902 - DNA, 20 bp, human
gagcggcaaccggcgctggg

SEQ ID NO: 139903 - DNA, 20 bp, human
gagaccatgacctccagcta

SEQ ID NO: 139904 - DNA, 20 bp, human
ggcatagccaaggaggacgc

SEQ ID NO: 139905 - DNA, 20 bp, human
gagagaggctccaaggtccg

SEQ ID NO: 139906 - DNA, 20 bp, human
gcagcacgggagccgtccgg

SEQ ID NO: 139907 - DNA, 20 bp, human
gggccgtactcaccatcctg

SEQ ID NO: 139908 - DNA, 20 bp, human
gcgccgcaggatggtgagta

SEQ ID NO: 139909 - DNA, 20 bp, human
gccgcgaggctaggaggcgg

SEQ ID NO: 139910 - DNA, 20 bp, human
gctaggaggcggcgggagct

SEQ ID NO: 139911 - DNA, 20 bp, human
ggcccgcccggcgctgacgt

SEQ ID NO: 139912 - DNA, 20 bp, human
ggagtacggccggccaggga

SEQ ID NO: 139913 - DNA, 20 bp, human
gtcggcggcaggacttctgg

SEQ ID NO: 139914 - DNA, 20 bp, human
gtggtgagtacggccggcca

SEQ ID NO: 139915 - DNA, 20 bp, human
ggcgaggcggcgccgcagga

SEQ ID NO: 139916 - DNA, 20 bp, human
gtcacgagcagctgccacaa

SEQ ID NO: 139917 - DNA, 20 bp, human
gagaggtggtaagaatggaa

SEQ ID NO: 139918 - DNA, 20 bp, human
gttgtcggccaggaacgggg

SEQ ID NO: 139919 - DNA, 20 bp, human
gtcggccaggaacggggggg

SEQ ID NO: 139920 - DNA, 20 bp, human
gcaggaacgggggggtggtt

SEQ ID NO: 139921 - DNA, 20 bp, human
ggcatttgtcggccaggaac

SEQ ID NO: 139922 - DNA, 20 bp, human
gattctaacttcaattgtct

SEQ ID NO: 139923 - DNA, 20 bp, human
ggcctgctgcttcatttcgt

SEQ ID NO: 139924 - DNA, 20 bp, human
gtggggtagagcttgtgttc

SEQ ID NO: 139925 - DNA, 20 bp, human
gtcccacgaaatgaagcagc

SEQ ID NO: 139926 - DNA, 20 bp, human
gttgccctgggataggacaa

SEQ ID NO: 139927 - DNA, 20 bp, human
gcacttacgacttgtagcag

SEQ ID NO: 139928 - DNA, 20 bp, human
gaacagtgggtggtatcagc

SEQ ID NO: 139929 - DNA, 20 bp, human
gccgggagctttgcagtcgg

SEQ ID NO: 139930 - DNA, 20 bp, human
ggctcccggccagtctgcct

SEQ ID NO: 139931 - DNA, 20 bp, human
ggagggagccaccacagaag

SEQ ID NO: 139932 - DNA, 20 bp, human
gatgcctttgtcctatccca

SEQ ID NO: 139933 - DNA, 20 bp, human
ggctacaagtcgtaagtgtg

SEQ ID NO: 139934 - DNA, 20 bp, human
gaagtggtagccagaattca

SEQ ID NO: 139935 - DNA, 20 bp, human
ggtaagatggatgggagagg

SEQ ID NO: 139936 - DNA, 20 bp, human
ggtgccagcgctgcggggtc

SEQ ID NO: 139937 - DNA, 20 bp, human
ggcaccagcggcgggaggca

SEQ ID NO: 139938 - DNA, 20 bp, human
gctgggtgggaaggtaatag

SEQ ID NO: 139939 - DNA, 20 bp, human
gcccggccggcggagaggac

SEQ ID NO: 139940 - DNA, 20 bp, human
ggagaggaccggaaaagaga

SEQ ID NO: 139941 - DNA, 20 bp, human
ggggagcgcccctaacatca

SEQ ID NO: 139942 - DNA, 20 bp, human
ggggcgctccccgaagtggt

SEQ ID NO: 139943 - DNA, 20 bp, human
gacccgcagggggcgaatgg

SEQ ID NO: 139944 - DNA, 20 bp, human
gagagaaggcgcggacgcag

SEQ ID NO: 139945 - DNA, 20 bp, human
gcagcttctcgggcttggag

SEQ ID NO: 139946 - DNA, 20 bp, human
gtggagccaagagtccccag

SEQ ID NO: 139947 - DNA, 20 bp, human
ggatggggagaactgaggtg

SEQ ID NO: 139948 - DNA, 20 bp, human
ggagattcaagcagagggat

SEQ ID NO: 139949 - DNA, 20 bp, human
ggtaaggccaaatctacaaa

SEQ ID NO: 139950 - DNA, 20 bp, human
gtcacccaggcgcctaagaa

SEQ ID NO: 139951 - DNA, 20 bp, human
gtgggcaagccagacggcca

SEQ ID NO: 139952 - DNA, 20 bp, human
gcccgaacaccatggccgtc

SEQ ID NO: 139953 - DNA, 20 bp, human
gtaagataaaggtcctcctg

SEQ ID NO: 139954 - DNA, 20 bp, human
gcaggtgaggccgggagacg

SEQ ID NO: 139955 - DNA, 20 bp, human
gaacagagtcccgaacacca

SEQ ID NO: 139956 - DNA, 20 bp, human
ggcgggtccctggaggtagg

SEQ ID NO: 139957 - DNA, 20 bp, human
gtaatgagcaccgcgatcgg

SEQ ID NO: 139958 - DNA, 20 bp, human
gttcccctagcgggactcag

SEQ ID NO: 139959 - DNA, 20 bp, human
gtccagggacccgccgatcg

SEQ ID NO: 139960 - DNA, 20 bp, human
ggcctaatgagcaccgcgat

SEQ ID NO: 139961 - DNA, 20 bp, human
gggcttcgggataccacctg

SEQ ID NO: 139962 - DNA, 20 bp, human
gagtcccgctaggggaaagt

SEQ ID NO: 139963 - DNA, 20 bp, human
gcaaggaggacgcaggtcct

SEQ ID NO: 139964 - DNA, 20 bp, human
gtcctctgcggtccgcccac

SEQ ID NO: 139965 - DNA, 20 bp, human
gcgaggcccagcctaagtct

SEQ ID NO: 139966 - DNA, 20 bp, human
ggtagagtgcgcctgtctgg

SEQ ID NO: 139967 - DNA, 20 bp, human
gtatgtctgccagtaacggg

SEQ ID NO: 139968 - DNA, 20 bp, human
ggtggtagagtgcgcctgtc

SEQ ID NO: 139969 - DNA, 20 bp, human
gcagtggtgggaatgaaatc

SEQ ID NO: 139970 - DNA, 20 bp, human
gccagccacagctcaaatat

SEQ ID NO: 139971 - DNA, 20 bp, human
gttaaccttggatgcacctg

SEQ ID NO: 139972 - DNA, 20 bp, human
gcagtaacggggggtggttg

SEQ ID NO: 139973 - DNA, 20 bp, human
gctatagctgctcttaacct

SEQ ID NO: 139974 - DNA, 20 bp, human
ggtctgccagtaacgggggg

SEQ ID NO: 139975 - DNA, 20 bp, human
ggtccacaaaataaagcagc

SEQ ID NO: 139976 - DNA, 20 bp, human
gcgggccctgcagagcacgt

SEQ ID NO: 139977 - DNA, 20 bp, human
gacacacgcgaggggaccct

SEQ ID NO: 139978 - DNA, 20 bp, human
gtgggcgccctacctgataa

SEQ ID NO: 139979 - DNA, 20 bp, human
gtggcgtggaaagtaactaa

SEQ ID NO: 139980 - DNA, 20 bp, human
ggcggcgccgttatcaggta

SEQ ID NO: 139981 - DNA, 20 bp, human
gagcaggaagtaggtgacac

SEQ ID NO: 139982 - DNA, 20 bp, human
gccgggatcgagaactctgt

SEQ ID NO: 139983 - DNA, 20 bp, human
gtaactaacggacgctggag

SEQ ID NO: 139984 - DNA, 20 bp, human
gaggaggcggcgccgttatc

SEQ ID NO: 139985 - DNA, 20 bp, human
gggacgcgcgattcctgcca

SEQ ID NO: 139986 - DNA, 20 bp, human
gtcaggggagggcacaccag

SEQ ID NO: 139987 - DNA, 20 bp, human
gagcaggctcgagagaccca

SEQ ID NO: 139988 - DNA, 20 bp, human
gaggagatgggagaacacgg

SEQ ID NO: 139989 - DNA, 20 bp, human
gcaaaacggtgcttccccag

SEQ ID NO: 139990 - DNA, 20 bp, human
gtcctgccgcaggaggtcag

SEQ ID NO: 139991 - DNA, 20 bp, human
gacgaggagatgggagaaca

SEQ ID NO: 139992 - DNA, 20 bp, human
gggcgctccagaaaccacca

SEQ ID NO: 139993 - DNA, 20 bp, human
gagtctccctgggcactgga

SEQ ID NO: 139994 - DNA, 20 bp, human
gccccagaggcaagcagcgg

SEQ ID NO: 139995 - DNA, 20 bp, human
gaccaggaccggctcctcga

SEQ ID NO: 139996 - DNA, 20 bp, human
ggcgccgctcagacaggtgt

SEQ ID NO: 139997 - DNA, 20 bp, human
gctgccctggcgaagtcctg

SEQ ID NO: 139998 - DNA, 20 bp, human
gctcgctgcgccgctcagac

SEQ ID NO: 139999 - DNA, 20 bp, human
ggcaccgcaggacttcgcca

SEQ ID NO: 140000 - DNA, 20 bp, human
gtgggtgcaggatgttggtt

SEQ ID NO: 140001 - DNA, 20 bp, human
gagcagagagagccggctct

SEQ ID NO: 140002 - DNA, 20 bp, human
gttgctcgcactcggctgtg

SEQ ID NO: 140003 - DNA, 20 bp, human
gtgagtgcgggcaccgactg

SEQ ID NO: 140004 - DNA, 20 bp, human
gctctcggcaagctgtcctt

SEQ ID NO: 140005 - DNA, 20 bp, human
gcccgtgtcctggaaccccg

SEQ ID NO: 140006 - DNA, 20 bp, human
ggcagggccgtggtcggcgg

SEQ ID NO: 140007 - DNA, 20 bp, human
gtcctcacctagagaatggg

SEQ ID NO: 140008 - DNA, 20 bp, human
gcaggcctgaggacatgagg

SEQ ID NO: 140009 - DNA, 20 bp, human
gtcggcggtggcagaagcgt

SEQ ID NO: 140010 - DNA, 20 bp, human
ggcctgtcccagggagtagg

SEQ ID NO: 140011 - DNA, 20 bp, human
gggaccccaccggcataact

SEQ ID NO: 140012 - DNA, 20 bp, human
gcacaccagtgcccgcggag

SEQ ID NO: 140013 - DNA, 20 bp, human
gcttctgccaccgccgacca

SEQ ID NO: 140014 - DNA, 20 bp, human
ggagttcacatcctgcacgt

SEQ ID NO: 140015 - DNA, 20 bp, human
gaagcgttggagcacgagcg

SEQ ID NO: 140016 - DNA, 20 bp, human
ggctggcccatgaaatgaag

SEQ ID NO: 140017 - DNA, 20 bp, human
gcctctcctgattcttggaa

SEQ ID NO: 140018 - DNA, 20 bp, human
gcttggaagggtataaggac

SEQ ID NO: 140019 - DNA, 20 bp, human
gtgattcttggaagggtata

SEQ ID NO: 140020 - DNA, 20 bp, human
gacttctagagttgaatctc

SEQ ID NO: 140021 - DNA, 20 bp, human
ggcccatgaaatgaagtggc

SEQ ID NO: 140022 - DNA, 20 bp, human
ggcctgccacttcatttcat

SEQ ID NO: 140023 - DNA, 20 bp, human
gggtgctatactggtgctct

SEQ ID NO: 140024 - DNA, 20 bp, human
gaaatgaagtggcaggcttc

SEQ ID NO: 140025 - DNA, 20 bp, human
gagttctaacttcatttgtc

SEQ ID NO: 140026 - DNA, 20 bp, human
ggacagaaggaccacggagg

SEQ ID NO: 140027 - DNA, 20 bp, human
gacagacagaaggaccacgg

SEQ ID NO: 140028 - DNA, 20 bp, human
gaggctgggctgggtaaggg

SEQ ID NO: 140029 - DNA, 20 bp, human
gaaagcctggcgcaatgtca

SEQ ID NO: 140030 - DNA, 20 bp, human
gggctccctggagcactctt

SEQ ID NO: 140031 - DNA, 20 bp, human
ggcccagggagcagtgagat

SEQ ID NO: 140032 - DNA, 20 bp, human
ggtaagggtggcactgccta

SEQ ID NO: 140033 - DNA, 20 bp, human
ggacgggctggtgtgaggat

SEQ ID NO: 140034 - DNA, 20 bp, human
gtcgaggtgtggtgaggtca

SEQ ID NO: 140035 - DNA, 20 bp, human
gtcaaggctgggctgggtaa

SEQ ID NO: 140036 - DNA, 20 bp, human
gggatttctggacagaacaa

SEQ ID NO: 140037 - DNA, 20 bp, human
gagggagcccaggtcaggtt

SEQ ID NO: 140038 - DNA, 20 bp, human
gcaggacttccgtctgagat

SEQ ID NO: 140039 - DNA, 20 bp, human
ggctttgagcagagcttcag

SEQ ID NO: 140040 - DNA, 20 bp, human
gtcctctccaaacctgacct

SEQ ID NO: 140041 - DNA, 20 bp, human
ggatgagggtgaggacgagg

SEQ ID NO: 140042 - DNA, 20 bp, human
ggtggcaggaaagggtcaat

SEQ ID NO: 140043 - DNA, 20 bp, human
gccgtctgagatgggatttc

SEQ ID NO: 140044 - DNA, 20 bp, human
ggcgccaaggtactagaagt

SEQ ID NO: 140045 - DNA, 20 bp, human
gctcaaccccagtcagcaga

SEQ ID NO: 140046 - DNA, 20 bp, human
ggagctcgccactgagactg

SEQ ID NO: 140047 - DNA, 20 bp, human
gtccccctccgcagtctcag

SEQ ID NO: 140048 - DNA, 20 bp, human
gcgccactgagactgcggag

SEQ ID NO: 140049 - DNA, 20 bp, human
gaaataaagagggtcccctc

SEQ ID NO: 140050 - DNA, 20 bp, human
ggaaaggcaggacctacccg

SEQ ID NO: 140051 - DNA, 20 bp, human
gccatctcccggccgtggtg

SEQ ID NO: 140052 - DNA, 20 bp, human
gtgcttaagcagtaccagag

SEQ ID NO: 140053 - DNA, 20 bp, human
gagagagctgcgccgcacca

SEQ ID NO: 140054 - DNA, 20 bp, human
gaaagaagctctcctcgggt

SEQ ID NO: 140055 - DNA, 20 bp, human
ggagatcagagctcccgagg

SEQ ID NO: 140056 - DNA, 20 bp, human
ggccatggcgctagagtcag

SEQ ID NO: 140057 - DNA, 20 bp, human
gatggcgctagagtcagcgg

SEQ ID NO: 140058 - DNA, 20 bp, human
gcggaggcagagccaagtga

SEQ ID NO: 140059 - DNA, 20 bp, human
gtaacctcaggggacaagag

SEQ ID NO: 140060 - DNA, 20 bp, human
gcagggagcagaccttcact

SEQ ID NO: 140061 - DNA, 20 bp, human
ggcagaaaagaccagaggac

SEQ ID NO: 140062 - DNA, 20 bp, human
gggttaccaagcatcacaag

SEQ ID NO: 140063 - DNA, 20 bp, human
ggaaggcgaggatgtatcag

SEQ ID NO: 140064 - DNA, 20 bp, human
gtgatgcttggtaacctcag

SEQ ID NO: 140065 - DNA, 20 bp, human
ggggggaaagtcacgtgcag

SEQ ID NO: 140066 - DNA, 20 bp, human
gcagctctgggcataaacag

SEQ ID NO: 140067 - DNA, 20 bp, human
gtcagggagtaagtgtcctg

SEQ ID NO: 140068 - DNA, 20 bp, human
gccctgaaatgccccaacag

SEQ ID NO: 140069 - DNA, 20 bp, human
gccttacaggacagagtaca

SEQ ID NO: 140070 - DNA, 20 bp, human
gcagcagagtgtggagcggt

SEQ ID NO: 140071 - DNA, 20 bp, human
gcacagagtttctgagacca

SEQ ID NO: 140072 - DNA, 20 bp, human
gtattctttaccttagctca

SEQ ID NO: 140073 - DNA, 20 bp, human
gagatacggaggcactccat

SEQ ID NO: 140074 - DNA, 20 bp, human
gcagtggctatggttagata

SEQ ID NO: 140075 - DNA, 20 bp, human
ggaggactgtgcctctgttg

SEQ ID NO: 140076 - DNA, 20 bp, human
ggggcccatgacggaagcag

SEQ ID NO: 140077 - DNA, 20 bp, human
ggcatggaggggaaaatcct

SEQ ID NO: 140078 - DNA, 20 bp, human
gtccatgctgggccgaccac

SEQ ID NO: 140079 - DNA, 20 bp, human
ggcaccgacagacgccccaa

SEQ ID NO: 140080 - DNA, 20 bp, human
gacgcaggcctccacgtctg

SEQ ID NO: 140081 - DNA, 20 bp, human
gtggaggggaaaatcctggg

SEQ ID NO: 140082 - DNA, 20 bp, human
gggatgggcaggcgacatgg

SEQ ID NO: 140083 - DNA, 20 bp, human
gttccgtcatgggcccactc

SEQ ID NO: 140084 - DNA, 20 bp, human
gggcgctgcctcgagcctca

SEQ ID NO: 140085 - DNA, 20 bp, human
gggagctagtcacccgctgg

SEQ ID NO: 140086 - DNA, 20 bp, human
ggaacccctctgagaatcgt

SEQ ID NO: 140087 - DNA, 20 bp, human
gccctggcccgggcagaact

SEQ ID NO: 140088 - DNA, 20 bp, human
ggccgccagaggacatgtca

SEQ ID NO: 140089 - DNA, 20 bp, human
gctgagaatcgtgggaggag

SEQ ID NO: 140090 - DNA, 20 bp, human
gcactgcgtgggaggcccgg

SEQ ID NO: 140091 - DNA, 20 bp, human
ggagcagaagccacgccagg

SEQ ID NO: 140092 - DNA, 20 bp, human
ggtgggaggagtggacgcgg

SEQ ID NO: 140093 - DNA, 20 bp, human
gcctcccacgattctcagag

SEQ ID NO: 140094 - DNA, 20 bp, human
ggaggggttcggccacacac

SEQ ID NO: 140095 - DNA, 20 bp, human
ggtatccatgacatgtcctc

SEQ ID NO: 140096 - DNA, 20 bp, human
gacccgccattggccctggg

SEQ ID NO: 140097 - DNA, 20 bp, human
gtgcggcccactgcatccaa

SEQ ID NO: 140098 - DNA, 20 bp, human
gtgggaggtgagcctccgga

SEQ ID NO: 140099 - DNA, 20 bp, human
gcatgggccatactcaccct

SEQ ID NO: 140100 - DNA, 20 bp, human
gaatgagcacgtgtgtggag

SEQ ID NO: 140101 - DNA, 20 bp, human
gcacgcacaacacacagacc

SEQ ID NO: 140102 - DNA, 20 bp, human
gggagacctcaagctaccat

SEQ ID NO: 140103 - DNA, 20 bp, human
ggtgctcattttccatccgg

SEQ ID NO: 140104 - DNA, 20 bp, human
gatttgaatgatgaatgagg

SEQ ID NO: 140105 - DNA, 20 bp, human
gactcacccttggatgcagt

SEQ ID NO: 140106 - DNA, 20 bp, human
gagaggaaagcggagatgta

SEQ ID NO: 140107 - DNA, 20 bp, human
gcccacaggccatggcaagt

SEQ ID NO: 140108 - DNA, 20 bp, human
ggacggctgataatctaatc

SEQ ID NO: 140109 - DNA, 20 bp, human
gtccgttagaaggagcattg

SEQ ID NO: 140110 - DNA, 20 bp, human
gctccttctaacggatgtgg

SEQ ID NO: 140111 - DNA, 20 bp, human
ggtacatcctcagcagactg

SEQ ID NO: 140112 - DNA, 20 bp, human
gcatgaggacagcccgacac

SEQ ID NO: 140113 - DNA, 20 bp, human
gtgaagatcccccggcccac

SEQ ID NO: 140114 - DNA, 20 bp, human
gattgaaggtaaggcttcag

SEQ ID NO: 140115 - DNA, 20 bp, human
ggacccaaacggtgtcaggg

SEQ ID NO: 140116 - DNA, 20 bp, human
gggatctcaggtgagcgcca

SEQ ID NO: 140117 - DNA, 20 bp, human
gctcaggtgagcgccagggt

SEQ ID NO: 140118 - DNA, 20 bp, human
gaggggcatctgaagtacag

SEQ ID NO: 140119 - DNA, 20 bp, human
gagcctgagaaggtcctgag

SEQ ID NO: 140120 - DNA, 20 bp, human
gtccttctgctggggatctc

SEQ ID NO: 140121 - DNA, 20 bp, human
gcgtgaaggcacagccagca

SEQ ID NO: 140122 - DNA, 20 bp, human
gttagaagggtagttaaaga

SEQ ID NO: 140123 - DNA, 20 bp, human
gacgaagatagggatcttgt

SEQ ID NO: 140124 - DNA, 20 bp, human
ggataactaaattaagtaag

SEQ ID NO: 140125 - DNA, 20 bp, human
ggcatctgaagtacaggggc

SEQ ID NO: 140126 - DNA, 20 bp, human
gcgccggccatgggttctgg

SEQ ID NO: 140127 - DNA, 20 bp, human
ggcgacctcagcctccgtcg

SEQ ID NO: 140128 - DNA, 20 bp, human
gtgccgccagaacccatggc

SEQ ID NO: 140129 - DNA, 20 bp, human
gtcgtggcgccgcctcgcag

SEQ ID NO: 140130 - DNA, 20 bp, human
gcgaggcggcgccacgacgg

SEQ ID NO: 140131 - DNA, 20 bp, human
gcgtggaaaccgctgcgagg

SEQ ID NO: 140132 - DNA, 20 bp, human
gtatccatggcgtcccagag

SEQ ID NO: 140133 - DNA, 20 bp, human
gaggtcgccggcagtatcca

SEQ ID NO: 140134 - DNA, 20 bp, human
gagcgcccgggagggacgag

SEQ ID NO: 140135 - DNA, 20 bp, human
gccacgccggccatgggttc

SEQ ID NO: 140136 - DNA, 20 bp, human
ggcaccagcgacccatcccg

SEQ ID NO: 140137 - DNA, 20 bp, human
gctgcccgcgcgcgacggtc

SEQ ID NO: 140138 - DNA, 20 bp, human
gccagcgacccatcccgggg

SEQ ID NO: 140139 - DNA, 20 bp, human
gtcggctgccaccccgggat

SEQ ID NO: 140140 - DNA, 20 bp, human
gggagggggcagacgtccgg

SEQ ID NO: 140141 - DNA, 20 bp, human
gagactccgtggggcaagga

SEQ ID NO: 140142 - DNA, 20 bp, human
gataccgctgtgagtaccag

SEQ ID NO: 140143 - DNA, 20 bp, human
gacacactggacgctctggt

SEQ ID NO: 140144 - DNA, 20 bp, human
gccttccggagagacgcagt

SEQ ID NO: 140145 - DNA, 20 bp, human
gtggtcggcgggatcagcag

SEQ ID NO: 140146 - DNA, 20 bp, human
gggttgtcgagtgacaaggg

SEQ ID NO: 140147 - DNA, 20 bp, human
gagaggttgtcgagtgacaa

SEQ ID NO: 140148 - DNA, 20 bp, human
gtagtgcctgctaacggggt

SEQ ID NO: 140149 - DNA, 20 bp, human
gcgcggtgtcagaaagagga

SEQ ID NO: 140150 - DNA, 20 bp, human
ggctgcctcgccacatccct

SEQ ID NO: 140151 - DNA, 20 bp, human
gccgttagcaggcactaccc

SEQ ID NO: 140152 - DNA, 20 bp, human
ggtccaccggaagctcaaag

SEQ ID NO: 140153 - DNA, 20 bp, human
ggcggagctataaataggag

SEQ ID NO: 140154 - DNA, 20 bp, human
gcagccgcggtgtcagaaag

SEQ ID NO: 140155 - DNA, 20 bp, human
ggaccactacgctcacccct

SEQ ID NO: 140156 - DNA, 20 bp, human
gggcggaacctggagataat

SEQ ID NO: 140157 - DNA, 20 bp, human
gtccagggcgctagtcaagc

SEQ ID NO: 140158 - DNA, 20 bp, human
gacgcgcgaacagctgatgg

SEQ ID NO: 140159 - DNA, 20 bp, human
gggactagtgaagcgggtaa

SEQ ID NO: 140160 - DNA, 20 bp, human
gagcgagccgcacccagcca

SEQ ID NO: 140161 - DNA, 20 bp, human
gtaagggacgtgcggaatcg

SEQ ID NO: 140162 - DNA, 20 bp, human
ggacccaaatggctgttcca

SEQ ID NO: 140163 - DNA, 20 bp, human
gagcggctgccaggcatgat

SEQ ID NO: 140164 - DNA, 20 bp, human
gtccaggtgtgcacgggagt

SEQ ID NO: 140165 - DNA, 20 bp, human
ggaagcgggtaagggacgtg

SEQ ID NO: 140166 - DNA, 20 bp, human
gcttgagcaggaacagttca

SEQ ID NO: 140167 - DNA, 20 bp, human
gggaccattctgaggacaag

SEQ ID NO: 140168 - DNA, 20 bp, human
gaactctgaggaccattctg

SEQ ID NO: 140169 - DNA, 20 bp, human
gcaatggaacattcttccca

SEQ ID NO: 140170 - DNA, 20 bp, human
gagttcatggacgaactctg

SEQ ID NO: 140171 - DNA, 20 bp, human
gaggcatccagtgtcatgag

SEQ ID NO: 140172 - DNA, 20 bp, human
gtcatttgcaaaaccgcggt

SEQ ID NO: 140173 - DNA, 20 bp, human
gtgttgaactctactgtgtc

SEQ ID NO: 140174 - DNA, 20 bp, human
gcatgttccactcatgacac

SEQ ID NO: 140175 - DNA, 20 bp, human
gtgaactaagctaaatgctg

SEQ ID NO: 140176 - DNA, 20 bp, human
ggagcagcaacactgagaac

SEQ ID NO: 140177 - DNA, 20 bp, human
gtagtggtccccctccaagt

SEQ ID NO: 140178 - DNA, 20 bp, human
gagttcccgtgaccagggac

SEQ ID NO: 140179 - DNA, 20 bp, human
ggttctaggcaagagcttca

SEQ ID NO: 140180 - DNA, 20 bp, human
gcctggcctctgtcaccccc

SEQ ID NO: 140181 - DNA, 20 bp, human
ggtgggcccgggggtgacag

SEQ ID NO: 140182 - DNA, 20 bp, human
gcctctgaggataaagtgtc

SEQ ID NO: 140183 - DNA, 20 bp, human
gcctctgggagaggagtccg

SEQ ID NO: 140184 - DNA, 20 bp, human
gaggctggagtggctatcct

SEQ ID NO: 140185 - DNA, 20 bp, human
gagctgagttcccgtgacca

SEQ ID NO: 140186 - DNA, 20 bp, human
ggatggagccgcagaaacaa

SEQ ID NO: 140187 - DNA, 20 bp, human
gcggaaggtggactccgagg

SEQ ID NO: 140188 - DNA, 20 bp, human
gggctcctttgacagaaggg

SEQ ID NO: 140189 - DNA, 20 bp, human
gcttcggccgggacagccaa

SEQ ID NO: 140190 - DNA, 20 bp, human
gacccggaaggtggactccg

SEQ ID NO: 140191 - DNA, 20 bp, human
ggggcaggcgtgtgtacagt

SEQ ID NO: 140192 - DNA, 20 bp, human
ggccaggtgagggctgacca

SEQ ID NO: 140193 - DNA, 20 bp, human
gccccttctcgcagcagggt

SEQ ID NO: 140194 - DNA, 20 bp, human
gcaagaactgagatataggt

SEQ ID NO: 140195 - DNA, 20 bp, human
gcgccctgcaaggtaagtcc

SEQ ID NO: 140196 - DNA, 20 bp, human
gcacggcccgaagacctctg

SEQ ID NO: 140197 - DNA, 20 bp, human
gggcttcacgggcagcatca

SEQ ID NO: 140198 - DNA, 20 bp, human
gggagggacggcctgagtca

SEQ ID NO: 140199 - DNA, 20 bp, human
gccagcctgcgtctgccatg

SEQ ID NO: 140200 - DNA, 20 bp, human
gcgagccccatggcagacgc

SEQ ID NO: 140201 - DNA, 20 bp, human
gccatggggctcgggttgag

SEQ ID NO: 140202 - DNA, 20 bp, human
gggacgtcctctgctgactg

SEQ ID NO: 140203 - DNA, 20 bp, human
gtagcggccaagacagagac

SEQ ID NO: 140204 - DNA, 20 bp, human
ggcgggaggaacggatgacg

SEQ ID NO: 140205 - DNA, 20 bp, human
ggcctgagtcagggacgagg

SEQ ID NO: 140206 - DNA, 20 bp, human
gcagagactggagctaaact

SEQ ID NO: 140207 - DNA, 20 bp, human
gaaagacgggtaacagcgag

SEQ ID NO: 140208 - DNA, 20 bp, human
gtctacagacgcctcctgtc

SEQ ID NO: 140209 - DNA, 20 bp, human
gggaacctgcctaccaaggc

SEQ ID NO: 140210 - DNA, 20 bp, human
ggcccacacatagtttagag

SEQ ID NO: 140211 - DNA, 20 bp, human
gcctttttgccagccttggt

SEQ ID NO: 140212 - DNA, 20 bp, human
gtcccctctaaactatgtgt

SEQ ID NO: 140213 - DNA, 20 bp, human
gcccaggatttctctttggt

SEQ ID NO: 140214 - DNA, 20 bp, human
gtgggaaaagcatgaaagac

SEQ ID NO: 140215 - DNA, 20 bp, human
gctccagtctctggaaaact

SEQ ID NO: 140216 - DNA, 20 bp, human
ggtatccgaagcgagcagtg

SEQ ID NO: 140217 - DNA, 20 bp, human
gaggcagggagcggccgcaa

SEQ ID NO: 140218 - DNA, 20 bp, human
gtttcttgggccccagacaa

SEQ ID NO: 140219 - DNA, 20 bp, human
gagcagtggtgggtactaag

SEQ ID NO: 140220 - DNA, 20 bp, human
ggggtgagtagggaagactc

SEQ ID NO: 140221 - DNA, 20 bp, human
gcagaatccgggctggaaag

SEQ ID NO: 140222 - DNA, 20 bp, human
gtgctcgcttcggatactcc

SEQ ID NO: 140223 - DNA, 20 bp, human
gcaagagctagggaggccgg

SEQ ID NO: 140224 - DNA, 20 bp, human
gaaggctggcctctaaggca

SEQ ID NO: 140225 - DNA, 20 bp, human
gtcccaccttggctctgtca

SEQ ID NO: 140226 - DNA, 20 bp, human
gcgaggaggcgccagactac

SEQ ID NO: 140227 - DNA, 20 bp, human
gccgccctggaggagtcaag

SEQ ID NO: 140228 - DNA, 20 bp, human
gcgggccgagccccaaaata

SEQ ID NO: 140229 - DNA, 20 bp, human
ggcgttccccgggagaaaca

SEQ ID NO: 140230 - DNA, 20 bp, human
gcagcacgcgggggtctctg

SEQ ID NO: 140231 - DNA, 20 bp, human
gaacatggccgggagcagcg

SEQ ID NO: 140232 - DNA, 20 bp, human
gaccggccggaggacacggg

SEQ ID NO: 140233 - DNA, 20 bp, human
gcgacgcctcgcccgtagtc

SEQ ID NO: 140234 - DNA, 20 bp, human
ggaactcggggtgaagggac

SEQ ID NO: 140235 - DNA, 20 bp, human
gaggcctccagagcagcacg

SEQ ID NO: 140236 - DNA, 20 bp, human
gggcgtggcgagcgtctctg

SEQ ID NO: 140237 - DNA, 20 bp, human
gggcgaggctggtgctcgga

SEQ ID NO: 140238 - DNA, 20 bp, human
ggccgctcgcgagaagcaag

SEQ ID NO: 140239 - DNA, 20 bp, human
gacaggccgcagggcgagag

SEQ ID NO: 140240 - DNA, 20 bp, human
ggcagcctggctccccgctc

SEQ ID NO: 140241 - DNA, 20 bp, human
gcgcgcggcggggtcctccg

SEQ ID NO: 140242 - DNA, 20 bp, human
gcgcggagcagcatccccgg

SEQ ID NO: 140243 - DNA, 20 bp, human
gagcgggcgcgagtgggatg

SEQ ID NO: 140244 - DNA, 20 bp, human
gccgtggtggcgctgacccc

SEQ ID NO: 140245 - DNA, 20 bp, human
gggggaaagaggaaacgatg

SEQ ID NO: 140246 - DNA, 20 bp, human
ggccagcagcacggacgcca

SEQ ID NO: 140247 - DNA, 20 bp, human
gcagcacggacgccagggca

SEQ ID NO: 140248 - DNA, 20 bp, human
gtgcaccctggaccccacca

SEQ ID NO: 140249 - DNA, 20 bp, human
gtgctggccttgctgctgag

SEQ ID NO: 140250 - DNA, 20 bp, human
gtcgggaccaacgcttgcag

SEQ ID NO: 140251 - DNA, 20 bp, human
gggaccccaccatggctcac

SEQ ID NO: 140252 - DNA, 20 bp, human
gataagaggagcttgaccgt

SEQ ID NO: 140253 - DNA, 20 bp, human
ggttggtcccgagcagtgag

SEQ ID NO: 140254 - DNA, 20 bp, human
ggaccaacgcttgcaggggt

SEQ ID NO: 140255 - DNA, 20 bp, human
gccaaaacagctcctcagga

SEQ ID NO: 140256 - DNA, 20 bp, human
gtgcctgcgggacatgtgag

SEQ ID NO: 140257 - DNA, 20 bp, human
gacccagcagcacttctcgg

SEQ ID NO: 140258 - DNA, 20 bp, human
gggccgctcacatgtcccgc

SEQ ID NO: 140259 - DNA, 20 bp, human
gcgggcggacaggggtgtgg

SEQ ID NO: 140260 - DNA, 20 bp, human
gatgtcccgcaggcagtgcg

SEQ ID NO: 140261 - DNA, 20 bp, human
gcggccgtcagcacgaagct

SEQ ID NO: 140262 - DNA, 20 bp, human
gacgttctcctcatccaggt

SEQ ID NO: 140263 - DNA, 20 bp, human
ggctcggagcccacaacgtg

SEQ ID NO: 140264 - DNA, 20 bp, human
gagggacagtggccgggcca

SEQ ID NO: 140265 - DNA, 20 bp, human
gggcagggtcgccgagggag

SEQ ID NO: 140266 - DNA, 20 bp, human
ggctctcaggcggaccccaa

SEQ ID NO: 140267 - DNA, 20 bp, human
gctcaggcggaccccaaagg

SEQ ID NO: 140268 - DNA, 20 bp, human
ggcttacgcagttcctcccg

SEQ ID NO: 140269 - DNA, 20 bp, human
gatcggcctccgaccccggg

SEQ ID NO: 140270 - DNA, 20 bp, human
gacgaagacgtgggatctgg

SEQ ID NO: 140271 - DNA, 20 bp, human
ggaaacctctcctcgaccag

SEQ ID NO: 140272 - DNA, 20 bp, human
gaggcggggagccaaaaacc

SEQ ID NO: 140273 - DNA, 20 bp, human
gcggaggccgattcgccgtg

SEQ ID NO: 140274 - DNA, 20 bp, human
gaggccgattcgccgtgtgg

SEQ ID NO: 140275 - DNA, 20 bp, human
gctagtccctgagtcccggg

SEQ ID NO: 140276 - DNA, 20 bp, human
gcgccgcagccgcctcagag

SEQ ID NO: 140277 - DNA, 20 bp, human
gccgggaaagtggcccgccg

SEQ ID NO: 140278 - DNA, 20 bp, human
gggcccaaggaagacgagcg

SEQ ID NO: 140279 - DNA, 20 bp, human
gccctgggcgagacggtcga

SEQ ID NO: 140280 - DNA, 20 bp, human
gggaacccgggtactcggag

SEQ ID NO: 140281 - DNA, 20 bp, human
ggcagtcggtcgctgcgccc

SEQ ID NO: 140282 - DNA, 20 bp, human
ggcgtatgctaatggaaagg

SEQ ID NO: 140283 - DNA, 20 bp, human
ggtcggtcgctgcgccccgg

SEQ ID NO: 140284 - DNA, 20 bp, human
gagacgaggtgcagagctga

SEQ ID NO: 140285 - DNA, 20 bp, human
gcctccaccgcaaccagacg

SEQ ID NO: 140286 - DNA, 20 bp, human
gctggagcggcagccgaaag

SEQ ID NO: 140287 - DNA, 20 bp, human
ggctggctttctaggacccg

SEQ ID NO: 140288 - DNA, 20 bp, human
gctttctaggacccgcggaa

SEQ ID NO: 140289 - DNA, 20 bp, human
ggaacggttaaacagctccg

SEQ ID NO: 140290 - DNA, 20 bp, human
gaggcgcagaccggggtcag

SEQ ID NO: 140291 - DNA, 20 bp, human
ggtgtcgcgttggggctcta

SEQ ID NO: 140292 - DNA, 20 bp, human
ggtcagcggcatcaacgtag

SEQ ID NO: 140293 - DNA, 20 bp, human
gcccctttaagcaagcctga

SEQ ID NO: 140294 - DNA, 20 bp, human
gctgccctcgcaggacgtcg

SEQ ID NO: 140295 - DNA, 20 bp, human
ggttaaacagctccgcgggc

SEQ ID NO: 140296 - DNA, 20 bp, human
gaaatacctcctccctgaag

SEQ ID NO: 140297 - DNA, 20 bp, human
gcagggccccttcagggagg

SEQ ID NO: 140298 - DNA, 20 bp, human
gacagtccgaggtcagtctg

SEQ ID NO: 140299 - DNA, 20 bp, human
gacctcggactgtgcagata

SEQ ID NO: 140300 - DNA, 20 bp, human
ggacatttagggtcacacag

SEQ ID NO: 140301 - DNA, 20 bp, human
gcctcagggccccttcaggg

SEQ ID NO: 140302 - DNA, 20 bp, human
gtcactgacacccacctcta

SEQ ID NO: 140303 - DNA, 20 bp, human
gcctgaggttgagacattta

SEQ ID NO: 140304 - DNA, 20 bp, human
gaccttatctgcacagtccg

SEQ ID NO: 140305 - DNA, 20 bp, human
ggtgtcagtgaaagaaggtt

SEQ ID NO: 140306 - DNA, 20 bp, human
gtaaaaatacctcctcctga

SEQ ID NO: 140307 - DNA, 20 bp, human
gtcagggccccttcaggagg

SEQ ID NO: 140308 - DNA, 20 bp, human
gacagtccgaggtcagtctg

SEQ ID NO: 140309 - DNA, 20 bp, human
gacctcggactgtgcagata

SEQ ID NO: 140310 - DNA, 20 bp, human
ggacatttagggtcacacag

SEQ ID NO: 140311 - DNA, 20 bp, human
gtcactgacacccacctcta

SEQ ID NO: 140312 - DNA, 20 bp, human
gcctgaggttgagacattta

SEQ ID NO: 140313 - DNA, 20 bp, human
gaccttatctgcacagtccg

SEQ ID NO: 140314 - DNA, 20 bp, human
gtcaacctcagggccccttc

SEQ ID NO: 140315 - DNA, 20 bp, human
ggtgtcagtgaaagaaggtt

SEQ ID NO: 140316 - DNA, 20 bp, human
gttagcgcctgcgctctgga

SEQ ID NO: 140317 - DNA, 20 bp, human
gcgtccatctgccccagaat

SEQ ID NO: 140318 - DNA, 20 bp, human
gcgctccgcattgcagactg

SEQ ID NO: 140319 - DNA, 20 bp, human
gtgcagactgcggagtcaga

SEQ ID NO: 140320 - DNA, 20 bp, human
gtcttgtagggtgacccctt

SEQ ID NO: 140321 - DNA, 20 bp, human
gccccaggatgagggtccca

SEQ ID NO: 140322 - DNA, 20 bp, human
ggcacaacacagctgcccaa

SEQ ID NO: 140323 - DNA, 20 bp, human
ggactccgcagtctgcaatg

SEQ ID NO: 140324 - DNA, 20 bp, human
ggggcgcacgtgatcgaggt

SEQ ID NO: 140325 - DNA, 20 bp, human
gggggtgggtgagtcttgta

SEQ ID NO: 140326 - DNA, 20 bp, human
gcctctgcagcggctcacag

SEQ ID NO: 140327 - DNA, 20 bp, human
ggctccagagtacccagcag

SEQ ID NO: 140328 - DNA, 20 bp, human
gtggtggcccccaggaggct

SEQ ID NO: 140329 - DNA, 20 bp, human
gctcaggatggccgaactgt

SEQ ID NO: 140330 - DNA, 20 bp, human
ggctgtgcacacctgtgccg

SEQ ID NO: 140331 - DNA, 20 bp, human
gtcgcagggcagagacttcg

SEQ ID NO: 140332 - DNA, 20 bp, human
gtgcaaagggctccacggtg

SEQ ID NO: 140333 - DNA, 20 bp, human
gccacggagcatgctcagga

SEQ ID NO: 140334 - DNA, 20 bp, human
gagcggcggctgctatgtcc

SEQ ID NO: 140335 - DNA, 20 bp, human
gctgaggccactctccaaag

SEQ ID NO: 140336 - DNA, 20 bp, human
gctgcagactctcaccgcag

SEQ ID NO: 140337 - DNA, 20 bp, human
gaatccgactgccacacgca

SEQ ID NO: 140338 - DNA, 20 bp, human
gcccggaccggcccaggaga

SEQ ID NO: 140339 - DNA, 20 bp, human
gaaagcgcctaggggactca

SEQ ID NO: 140340 - DNA, 20 bp, human
gcacgcacctgcagacgccc

SEQ ID NO: 140341 - DNA, 20 bp, human
gtgcctcgcaccagcagtca

SEQ ID NO: 140342 - DNA, 20 bp, human
gctggcgttcctggccgctg

SEQ ID NO: 140343 - DNA, 20 bp, human
gtgcaggtgcgtggcaccgg

SEQ ID NO: 140344 - DNA, 20 bp, human
ggaccgaacgcgtgaacggc

SEQ ID NO: 140345 - DNA, 20 bp, human
gcttggctgactcaccgccc

SEQ ID NO: 140346 - DNA, 20 bp, human
gcctagcctccgctcctcca

SEQ ID NO: 140347 - DNA, 20 bp, human
gggaagctcttggcacgacc

SEQ ID NO: 140348 - DNA, 20 bp, human
ggtgtcctgcgaggacccgg

SEQ ID NO: 140349 - DNA, 20 bp, human
gcagccttcgtggtcactgg

SEQ ID NO: 140350 - DNA, 20 bp, human
ggcacagccttcgtggtcac

SEQ ID NO: 140351 - DNA, 20 bp, human
gggccagccaaggcctcacc

SEQ ID NO: 140352 - DNA, 20 bp, human
gggccaagcctgccatcaac

SEQ ID NO: 140353 - DNA, 20 bp, human
gcagggcacacggagaggag

SEQ ID NO: 140354 - DNA, 20 bp, human
gtgggccggatgtagacccc

SEQ ID NO: 140355 - DNA, 20 bp, human
gaagccccggtcacagggga

SEQ ID NO: 140356 - DNA, 20 bp, human
gctgatcggcacgaaaccct

SEQ ID NO: 140357 - DNA, 20 bp, human
gacgaaaccctgggcgcctg

SEQ ID NO: 140358 - DNA, 20 bp, human
gaagaccgtcctgggctgat

SEQ ID NO: 140359 - DNA, 20 bp, human
ggcaccgggaagaccgtcct

SEQ ID NO: 140360 - DNA, 20 bp, human
gagacctggaagttaggatg

SEQ ID NO: 140361 - DNA, 20 bp, human
gcagggttcactgtcatgaa

SEQ ID NO: 140362 - DNA, 20 bp, human
gaaccctgcgctgaaggcgt

SEQ ID NO: 140363 - DNA, 20 bp, human
gcgtgccgatcagcccagga

SEQ ID NO: 140364 - DNA, 20 bp, human
gttcacaagacctggaagtt

SEQ ID NO: 140365 - DNA, 20 bp, human
gagtgagtatggacctgagt

SEQ ID NO: 140366 - DNA, 20 bp, human
gcgagggcggtgccaaccga

SEQ ID NO: 140367 - DNA, 20 bp, human
gccgagggcggagcctggta

SEQ ID NO: 140368 - DNA, 20 bp, human
gcgagccggcccggctctca

SEQ ID NO: 140369 - DNA, 20 bp, human
gtcgccccgcaacctggcgt

SEQ ID NO: 140370 - DNA, 20 bp, human
gtgcggggcgaccgaggggg

SEQ ID NO: 140371 - DNA, 20 bp, human
gcccggctctcacggacgca

SEQ ID NO: 140372 - DNA, 20 bp, human
ggggcggtgccaaccgaggg

SEQ ID NO: 140373 - DNA, 20 bp, human
gcacggacgcacggagtgcg

SEQ ID NO: 140374 - DNA, 20 bp, human
gccccgacagccagcgcgag

SEQ ID NO: 140375 - DNA, 20 bp, human
gcagagccgcaagaagaaaa

SEQ ID NO: 140376 - DNA, 20 bp, human
ggcgcgaacaaagaggggag

SEQ ID NO: 140377 - DNA, 20 bp, human
gggactccgcgtggtgctga

SEQ ID NO: 140378 - DNA, 20 bp, human
gcgagcagcggtgagtactg

SEQ ID NO: 140379 - DNA, 20 bp, human
ggcagcggtgagtactgagg

SEQ ID NO: 140380 - DNA, 20 bp, human
gcaggtaaaggggcctctgg

SEQ ID NO: 140381 - DNA, 20 bp, human
gggtaagacagatcccgccc

SEQ ID NO: 140382 - DNA, 20 bp, human
gagagaccataaccaggtaa

SEQ ID NO: 140383 - DNA, 20 bp, human
gcaaacaggaacacacaaag

SEQ ID NO: 140384 - DNA, 20 bp, human
gtcccctgcattgccaccag

SEQ ID NO: 140385 - DNA, 20 bp, human
ggggatctgtcttacccctg

SEQ ID NO: 140386 - DNA, 20 bp, human
gcgcggctccggcacctgaa

SEQ ID NO: 140387 - DNA, 20 bp, human
ggcacctgaagggacgcggg

SEQ ID NO: 140388 - DNA, 20 bp, human
gaggtgccggagccgcgatg

SEQ ID NO: 140389 - DNA, 20 bp, human
gccggcacctgaagggacgc

SEQ ID NO: 140390 - DNA, 20 bp, human
gcgcgggcagctccgaccgg

SEQ ID NO: 140391 - DNA, 20 bp, human
gccagcctgagggacggtgg

SEQ ID NO: 140392 - DNA, 20 bp, human
ggcagcccccaccgtccctc

SEQ ID NO: 140393 - DNA, 20 bp, human
gcggcgtctggagcatccga

SEQ ID NO: 140394 - DNA, 20 bp, human
ggggcgcgggcagctccgac

SEQ ID NO: 140395 - DNA, 20 bp, human
gcctctccacatcgcggctc

SEQ ID NO: 140396 - DNA, 20 bp, human
gtcccgggactgccgagagg

SEQ ID NO: 140397 - DNA, 20 bp, human
gctcagggcgcgagtgccgg

SEQ ID NO: 140398 - DNA, 20 bp, human
gcgccgcctctcggcagtcc

SEQ ID NO: 140399 - DNA, 20 bp, human
ggagctcaacaaagagcacg

SEQ ID NO: 140400 - DNA, 20 bp, human
gagcctcagggcgcgagtgc

SEQ ID NO: 140401 - DNA, 20 bp, human
gcctccgccagggtgcgcgc

SEQ ID NO: 140402 - DNA, 20 bp, human
gaccctggcggaggctggcg

SEQ ID NO: 140403 - DNA, 20 bp, human
gcggcggcccgcgcgcaccc

SEQ ID NO: 140404 - DNA, 20 bp, human
gtgctctttgttgagctccc

SEQ ID NO: 140405 - DNA, 20 bp, human
gcggcgccgctgttcgacgt

SEQ ID NO: 140406 - DNA, 20 bp, human
gcatccattcttgggtcctt

SEQ ID NO: 140407 - DNA, 20 bp, human
ggagctaagtgggtctgcct

SEQ ID NO: 140408 - DNA, 20 bp, human
ggctccccaagagcacttcc

SEQ ID NO: 140409 - DNA, 20 bp, human
gggaggtctgcaatagtgaa

SEQ ID NO: 140410 - DNA, 20 bp, human
gcctccaaaggacccaagaa

SEQ ID NO: 140411 - DNA, 20 bp, human
gtcggcttgcccagtgaatg

SEQ ID NO: 140412 - DNA, 20 bp, human
gcagggaagggaaacaacag

SEQ ID NO: 140413 - DNA, 20 bp, human
gggccaagccatccattctt

SEQ ID NO: 140414 - DNA, 20 bp, human
gcactattgcagacctccag

SEQ ID NO: 140415 - DNA, 20 bp, human
gacgcagtgacactcacaag

SEQ ID NO: 140416 - DNA, 20 bp, human
gctggacaaggacacacccg

SEQ ID NO: 140417 - DNA, 20 bp, human
gccgtgtgggaaaccaggag

SEQ ID NO: 140418 - DNA, 20 bp, human
ggtagccgtctgaactggag

SEQ ID NO: 140419 - DNA, 20 bp, human
gcctgagctacgagccgcgg

SEQ ID NO: 140420 - DNA, 20 bp, human
gcctgggacaggcagctccg

SEQ ID NO: 140421 - DNA, 20 bp, human
gggggtccgcggtttcacat

SEQ ID NO: 140422 - DNA, 20 bp, human
gttcagacggctactaatcc

SEQ ID NO: 140423 - DNA, 20 bp, human
ggagccggaaatgacgacaa

SEQ ID NO: 140424 - DNA, 20 bp, human
gaaacagcggctggtctgga

SEQ ID NO: 140425 - DNA, 20 bp, human
ggaacctgagctacgagccg

SEQ ID NO: 140426 - DNA, 20 bp, human
gaaactccgctggagcgcgg

SEQ ID NO: 140427 - DNA, 20 bp, human
gtgaggcgtgtagcaggcgg

SEQ ID NO: 140428 - DNA, 20 bp, human
gaggcgggcgcagggaagtg

SEQ ID NO: 140429 - DNA, 20 bp, human
ggcgcgagcggttaaagggc

SEQ ID NO: 140430 - DNA, 20 bp, human
gtggagcgcggcggcagagc

SEQ ID NO: 140431 - DNA, 20 bp, human
gcgcggcgcgagcggttaaa

SEQ ID NO: 140432 - DNA, 20 bp, human
gaggagcgctgcgcacgcag

SEQ ID NO: 140433 - DNA, 20 bp, human
gtcggcgcaacggaggtctc

SEQ ID NO: 140434 - DNA, 20 bp, human
gcgtaaactccgctggagcg

SEQ ID NO: 140435 - DNA, 20 bp, human
ggccggtgcatttaaaggag

SEQ ID NO: 140436 - DNA, 20 bp, human
ggctaaggcaccccagccgg

SEQ ID NO: 140437 - DNA, 20 bp, human
gcaggagagctcacttcctc

SEQ ID NO: 140438 - DNA, 20 bp, human
gccataactgaaagtagcta

SEQ ID NO: 140439 - DNA, 20 bp, human
gactggactagagcacccga

SEQ ID NO: 140440 - DNA, 20 bp, human
ggtagctaaggcaccccagc

SEQ ID NO: 140441 - DNA, 20 bp, human
gtgggtaaggcagatcgcta

SEQ ID NO: 140442 - DNA, 20 bp, human
gcggaagtactacctgggta

SEQ ID NO: 140443 - DNA, 20 bp, human
gagctcacttcctccggctg

SEQ ID NO: 140444 - DNA, 20 bp, human
gtagagcacccgagggaaga

SEQ ID NO: 140445 - DNA, 20 bp, human
gcccactcaaatccaggagt

SEQ ID NO: 140446 - DNA, 20 bp, human
ggcgctgagactcttcccgg

SEQ ID NO: 140447 - DNA, 20 bp, human
gtgagaagtgctccttccac

SEQ ID NO: 140448 - DNA, 20 bp, human
gtgagactcttcccggtgga

SEQ ID NO: 140449 - DNA, 20 bp, human
ggcacgcagcagagatcatg

SEQ ID NO: 140450 - DNA, 20 bp, human
gaataaaaaagccagcattt

SEQ ID NO: 140451 - DNA, 20 bp, human
ggatagtgccactgcacgcc

SEQ ID NO: 140452 - DNA, 20 bp, human
ggtctcctggagaggctcct

SEQ ID NO: 140453 - DNA, 20 bp, human
gaaaaagccagcatttaggg

SEQ ID NO: 140454 - DNA, 20 bp, human
gttttattttttagaacccc

SEQ ID NO: 140455 - DNA, 20 bp, human
gtccagaagcttccagagca

SEQ ID NO: 140456 - DNA, 20 bp, human
gaacggtaattggtgtatga

SEQ ID NO: 140457 - DNA, 20 bp, human
gactttgactgtcaacgatg

SEQ ID NO: 140458 - DNA, 20 bp, human
ggtatgaagggtgaattctg

SEQ ID NO: 140459 - DNA, 20 bp, human
gtgaagggtgaattctgggg

SEQ ID NO: 140460 - DNA, 20 bp, human
gcgttgacagtcaaagtctc

SEQ ID NO: 140461 - DNA, 20 bp, human
gagtcaaagtctctggtaag

SEQ ID NO: 140462 - DNA, 20 bp, human
ggggatttgcttttgcccat

SEQ ID NO: 140463 - DNA, 20 bp, human
gaattactacaaagcatagc

SEQ ID NO: 140464 - DNA, 20 bp, human
gcgcgaagcaagacaagtag

SEQ ID NO: 140465 - DNA, 20 bp, human
ggtctcgcctgagaaaggta

SEQ ID NO: 140466 - DNA, 20 bp, human
gtccagaagctgtctgagca

SEQ ID NO: 140467 - DNA, 20 bp, human
ggccgtgctcagacagcttc

SEQ ID NO: 140468 - DNA, 20 bp, human
gtgggcttcactgcattggc

SEQ ID NO: 140469 - DNA, 20 bp, human
gatgcgctgtgtgcaggaag

SEQ ID NO: 140470 - DNA, 20 bp, human
gcctgggagaggacaggggg

SEQ ID NO: 140471 - DNA, 20 bp, human
gggggaggaagcggagtgac

SEQ ID NO: 140472 - DNA, 20 bp, human
gtaaaagaagccagctctta

SEQ ID NO: 140473 - DNA, 20 bp, human
gcagacagcttctggatccc

SEQ ID NO: 140474 - DNA, 20 bp, human
gctgtgtgcaggaaggggct

SEQ ID NO: 140475 - DNA, 20 bp, human
gaacttcctgggagaggaca

SEQ ID NO: 140476 - DNA, 20 bp, human
gtgccgcagaggcgtctcaa

SEQ ID NO: 140477 - DNA, 20 bp, human
gcgcgggagcagcgcagcta

SEQ ID NO: 140478 - DNA, 20 bp, human
gaaaagcccggagaaagatg

SEQ ID NO: 140479 - DNA, 20 bp, human
gcagaggcgtctcaacggct

SEQ ID NO: 140480 - DNA, 20 bp, human
ggacgccaccacctgaagca

SEQ ID NO: 140481 - DNA, 20 bp, human
gcaggagcgacgccaccgag

SEQ ID NO: 140482 - DNA, 20 bp, human
gggtggtggcgtctcttcgg

SEQ ID NO: 140483 - DNA, 20 bp, human
gtcggcgcccgctagcactg

SEQ ID NO: 140484 - DNA, 20 bp, human
gcagcgcggaggcagcgcac

SEQ ID NO: 140485 - DNA, 20 bp, human
gagcgacgccaccgaggggg

SEQ ID NO: 140486 - DNA, 20 bp, human
gcgctaacgcccgagaatgg

SEQ ID NO: 140487 - DNA, 20 bp, human
ggacgctgcaggctgaccag

SEQ ID NO: 140488 - DNA, 20 bp, human
gtaacgcccgagaatggcgg

SEQ ID NO: 140489 - DNA, 20 bp, human
gcatctccgggcaatggcag

SEQ ID NO: 140490 - DNA, 20 bp, human
gcgacgctaacgcccgagaa

SEQ ID NO: 140491 - DNA, 20 bp, human
gcggctctgccggccatctc

SEQ ID NO: 140492 - DNA, 20 bp, human
gcgggcgcgagaaggcagta

SEQ ID NO: 140493 - DNA, 20 bp, human
ggccggccatctccgggcaa

SEQ ID NO: 140494 - DNA, 20 bp, human
gcctggcagacgcaaaggag

SEQ ID NO: 140495 - DNA, 20 bp, human
ggccattgcccggagatggc

SEQ ID NO: 140496 - DNA, 20 bp, human
gccgccgctcgcgggacctg

SEQ ID NO: 140497 - DNA, 20 bp, human
gttacctggcaaggacccgg

SEQ ID NO: 140498 - DNA, 20 bp, human
gcagcaggaaggtggtcccg

SEQ ID NO: 140499 - DNA, 20 bp, human
gcaggcggcgcagaggatac

SEQ ID NO: 140500 - DNA, 20 bp, human
ggctgaagggaacctcgagg

SEQ ID NO: 140501 - DNA, 20 bp, human
gcaagctgaagggaacctcg

SEQ ID NO: 140502 - DNA, 20 bp, human
gccaggtaaagcgccacgtg

SEQ ID NO: 140503 - DNA, 20 bp, human
ggtagtcatcaagagagtta

SEQ ID NO: 140504 - DNA, 20 bp, human
gtatggggtgcggcgccagc

SEQ ID NO: 140505 - DNA, 20 bp, human
gaggacccgggggtcgaact

SEQ ID NO: 140506 - DNA, 20 bp, human
ggctccccgggaagcgaaag

SEQ ID NO: 140507 - DNA, 20 bp, human
gctgaccgaggaggaagtgt

SEQ ID NO: 140508 - DNA, 20 bp, human
gattcaacgtaccatggtgg

SEQ ID NO: 140509 - DNA, 20 bp, human
gccgcactggtggtacaggt

SEQ ID NO: 140510 - DNA, 20 bp, human
gcaggcccgcgccgccacca

SEQ ID NO: 140511 - DNA, 20 bp, human
gagctcctagtgctgtgtat

SEQ ID NO: 140512 - DNA, 20 bp, human
gacgctaaggatgacaggag

SEQ ID NO: 140513 - DNA, 20 bp, human
gggcggcgcgggcctggttg

SEQ ID NO: 140514 - DNA, 20 bp, human
ggggattcaacgtaccatgg

SEQ ID NO: 140515 - DNA, 20 bp, human
ggtccaggaacacaaacctg

SEQ ID NO: 140516 - DNA, 20 bp, human
gggtaaagatggcggagcgc

SEQ ID NO: 140517 - DNA, 20 bp, human
gcttttcgctgactacattc

SEQ ID NO: 140518 - DNA, 20 bp, human
gactacgctgaagacctcga

SEQ ID NO: 140519 - DNA, 20 bp, human
gggtggcccgttccgaactc

SEQ ID NO: 140520 - DNA, 20 bp, human
gtcaagtagacctgatgcgg

SEQ ID NO: 140521 - DNA, 20 bp, human
gggctcaagtagacctgatg

SEQ ID NO: 140522 - DNA, 20 bp, human
gggtatggaaggggccctcg

SEQ ID NO: 140523 - DNA, 20 bp, human
ggcttctggagggtccagta

SEQ ID NO: 140524 - DNA, 20 bp, human
gactacattcaggtatggaa

SEQ ID NO: 140525 - DNA, 20 bp, human
ggtgcgcatgctgaaagcag

SEQ ID NO: 140526 - DNA, 20 bp, human
gggtataggggaagcgctcc

SEQ ID NO: 140527 - DNA, 20 bp, human
ggaatccctacgcgtccctt

SEQ ID NO: 140528 - DNA, 20 bp, human
gtaaacccaaagggacgcgt

SEQ ID NO: 140529 - DNA, 20 bp, human
gaccgaaagtggaaactcgt

SEQ ID NO: 140530 - DNA, 20 bp, human
gacgcaggcctagcatatag

SEQ ID NO: 140531 - DNA, 20 bp, human
gctcatcgtgctaaacccaa

SEQ ID NO: 140532 - DNA, 20 bp, human
ggcggcatcctgtggtatag

SEQ ID NO: 140533 - DNA, 20 bp, human
ggttctcttgagaaccaccg

SEQ ID NO: 140534 - DNA, 20 bp, human
gactagtttgcggcatcctg

SEQ ID NO: 140535 - DNA, 20 bp, human
gtagtaacaggcccgctcat

SEQ ID NO: 140536 - DNA, 20 bp, human
ggttattcggtgagcggtgg

SEQ ID NO: 140537 - DNA, 20 bp, human
ggtggtggtttattcttccg

SEQ ID NO: 140538 - DNA, 20 bp, human
gctggctggtgagagaccga

SEQ ID NO: 140539 - DNA, 20 bp, human
ggcaggaccgagagttgggg

SEQ ID NO: 140540 - DNA, 20 bp, human
ggcggttattcggtgagcgg

SEQ ID NO: 140541 - DNA, 20 bp, human
gtgaaagttagctctcccgg

SEQ ID NO: 140542 - DNA, 20 bp, human
gcgtaccgaactcctgagga

SEQ ID NO: 140543 - DNA, 20 bp, human
gggtcggtccgtcacagagg

SEQ ID NO: 140544 - DNA, 20 bp, human
gtgggcaggaccgagagttg

SEQ ID NO: 140545 - DNA, 20 bp, human
gtgaagacctgagatgtcca

SEQ ID NO: 140546 - DNA, 20 bp, human
gggtgccggtggagtcgtgt

SEQ ID NO: 140547 - DNA, 20 bp, human
gggacctgtcgtactcagac

SEQ ID NO: 140548 - DNA, 20 bp, human
gccaccggcacccaactcac

SEQ ID NO: 140549 - DNA, 20 bp, human
gacatggcgagggtaggagg

SEQ ID NO: 140550 - DNA, 20 bp, human
gggcagccaactcacccaca

SEQ ID NO: 140551 - DNA, 20 bp, human
gccacacggccgcagtacta

SEQ ID NO: 140552 - DNA, 20 bp, human
gcggctacgcggggattctg

SEQ ID NO: 140553 - DNA, 20 bp, human
ggcaccgagttaggacccag

SEQ ID NO: 140554 - DNA, 20 bp, human
gctaggcacgaaaagatgaa

SEQ ID NO: 140555 - DNA, 20 bp, human
ggacggcgggcgcctgagga

SEQ ID NO: 140556 - DNA, 20 bp, human
gtgcctggagcgagcagacg

SEQ ID NO: 140557 - DNA, 20 bp, human
gagggtcggctctaccaagt

SEQ ID NO: 140558 - DNA, 20 bp, human
gagtcgctgcaacttccggg

SEQ ID NO: 140559 - DNA, 20 bp, human
ggcctcacgaagccggagtc

SEQ ID NO: 140560 - DNA, 20 bp, human
gccaggcacgtaccatgaca

SEQ ID NO: 140561 - DNA, 20 bp, human
gagcagtcgctgcaacttcc

SEQ ID NO: 140562 - DNA, 20 bp, human
gtcggccccagactaaaccc

SEQ ID NO: 140563 - DNA, 20 bp, human
gtagacccaatggagagtta

SEQ ID NO: 140564 - DNA, 20 bp, human
gtgcaagagcggaagaaacg

SEQ ID NO: 140565 - DNA, 20 bp, human
ggatccctgcgtccagacgg

SEQ ID NO: 140566 - DNA, 20 bp, human
ggcctgacgccgcccgtcgc

SEQ ID NO: 140567 - DNA, 20 bp, human
ggcgcggtcgtagctcatgc

SEQ ID NO: 140568 - DNA, 20 bp, human
gtagtggcgccgggagtcgc

SEQ ID NO: 140569 - DNA, 20 bp, human
gtcgccggcagcgcaggaca

SEQ ID NO: 140570 - DNA, 20 bp, human
gggacacggcgccgagggtg

SEQ ID NO: 140571 - DNA, 20 bp, human
gcgcaggaggccgtcaagaa

SEQ ID NO: 140572 - DNA, 20 bp, human
ggcagcggcgcgggcggtca

SEQ ID NO: 140573 - DNA, 20 bp, human
gccccaagcgaggcgctgag

SEQ ID NO: 140574 - DNA, 20 bp, human
gccacgagtgcctgcagagg

SEQ ID NO: 140575 - DNA, 20 bp, human
gtcgggcgagaagacggtga

SEQ ID NO: 140576 - DNA, 20 bp, human
gccatcgcacaggactacaa

SEQ ID NO: 140577 - DNA, 20 bp, human
ggtgtggaagcgcttccggg

SEQ ID NO: 140578 - DNA, 20 bp, human
gtagcacgctgtgttggcgg

SEQ ID NO: 140579 - DNA, 20 bp, human
gcatcctaggagctcaagag

SEQ ID NO: 140580 - DNA, 20 bp, human
ggctgcagctgaggcaagcg

SEQ ID NO: 140581 - DNA, 20 bp, human
gagctacagacgcaaaacta

SEQ ID NO: 140582 - DNA, 20 bp, human
ggtcagagcggggaatagtc

SEQ ID NO: 140583 - DNA, 20 bp, human
gtgtagctaccatgaaacag

SEQ ID NO: 140584 - DNA, 20 bp, human
ggggcgcggggacttccggg

SEQ ID NO: 140585 - DNA, 20 bp, human
gctagatttgggccggaagt

SEQ ID NO: 140586 - DNA, 20 bp, human
gcagcaagtgtcggatccgc

SEQ ID NO: 140587 - DNA, 20 bp, human
ggccgtgagacagcaagtgt

SEQ ID NO: 140588 - DNA, 20 bp, human
gagcagcaaggagcacggag

SEQ ID NO: 140589 - DNA, 20 bp, human
gtgtagaggacaacatcgca

SEQ ID NO: 140590 - DNA, 20 bp, human
ggtggcgtaacgtccggtca

SEQ ID NO: 140591 - DNA, 20 bp, human
gctgccaggagccgaataca

SEQ ID NO: 140592 - DNA, 20 bp, human
ggcctgaagagggaaacaca

SEQ ID NO: 140593 - DNA, 20 bp, human
ggccgaatacatggctgtag

SEQ ID NO: 140594 - DNA, 20 bp, human
gcggggcagcgccatcacgg

SEQ ID NO: 140595 - DNA, 20 bp, human
gtccgacacttgctgtctca

SEQ ID NO: 140596 - DNA, 20 bp, human
ggggtcgcgggcggatgagt

SEQ ID NO: 140597 - DNA, 20 bp, human
ggatgagtcggccagacaag

SEQ ID NO: 140598 - DNA, 20 bp, human
gagaccgggaccaccatcgc

SEQ ID NO: 140599 - DNA, 20 bp, human
gcagacgtgaagcctagcag

SEQ ID NO: 140600 - DNA, 20 bp, human
gagggaccttgagccccggg

SEQ ID NO: 140601 - DNA, 20 bp, human
gggcttaccccggaagatga

SEQ ID NO: 140602 - DNA, 20 bp, human
gggctggcttcagcatcttg

SEQ ID NO: 140603 - DNA, 20 bp, human
gaaaggccacgagcaagcag

SEQ ID NO: 140604 - DNA, 20 bp, human
gagggtgtgttggtcgactt

SEQ ID NO: 140605 - DNA, 20 bp, human
gaggcccgcgatggtggtcc

SEQ ID NO: 140606 - DNA, 20 bp, human
gggcagtcccctgacaccca

SEQ ID NO: 140607 - DNA, 20 bp, human
gtcccagccgcagagggcag

SEQ ID NO: 140608 - DNA, 20 bp, human
gccagccgccagcccgaggc

SEQ ID NO: 140609 - DNA, 20 bp, human
gaggtgaggtgatggtccct

SEQ ID NO: 140610 - DNA, 20 bp, human
ggtgtggccactgccctctg

SEQ ID NO: 140611 - DNA, 20 bp, human
gtctgcaggatgtgtgcaag

SEQ ID NO: 140612 - DNA, 20 bp, human
gccccggtattgagacatca

SEQ ID NO: 140613 - DNA, 20 bp, human
gcctggggctgaatgaagtt

SEQ ID NO: 140614 - DNA, 20 bp, human
gcaggtagcacagtcggcag

SEQ ID NO: 140615 - DNA, 20 bp, human
gtctgcggctgggaccgctc

SEQ ID NO: 140616 - DNA, 20 bp, human
ggcccgcttccaggtctcac

SEQ ID NO: 140617 - DNA, 20 bp, human
gctctgaggtgctgtctcac

SEQ ID NO: 140618 - DNA, 20 bp, human
gaccggtgagacctggaagc

SEQ ID NO: 140619 - DNA, 20 bp, human
gctgtctcaccggtgagacc

SEQ ID NO: 140620 - DNA, 20 bp, human
gcatggtggcggaaggccag

SEQ ID NO: 140621 - DNA, 20 bp, human
gataccgatgaggtactcca

SEQ ID NO: 140622 - DNA, 20 bp, human
ggccagaaggagtttgtcgg

SEQ ID NO: 140623 - DNA, 20 bp, human
ggcctgcagcacgacttcca

SEQ ID NO: 140624 - DNA, 20 bp, human
gagcacctcagagcgaagat

SEQ ID NO: 140625 - DNA, 20 bp, human
gccaccatggagtacctcat

SEQ ID NO: 140626 - DNA, 20 bp, human
gtagactaggacagacagag

SEQ ID NO: 140627 - DNA, 20 bp, human
ggaattgctctggcgatcga

SEQ ID NO: 140628 - DNA, 20 bp, human
ggccccggtgaggaccaaga

SEQ ID NO: 140629 - DNA, 20 bp, human
gactaggacagacagagcgg

SEQ ID NO: 140630 - DNA, 20 bp, human
gtgggatgagcactgtgtgg

SEQ ID NO: 140631 - DNA, 20 bp, human
ggagagcggttgcgcagtga

SEQ ID NO: 140632 - DNA, 20 bp, human
gaccatgattgcggtgtact

SEQ ID NO: 140633 - DNA, 20 bp, human
gcccggcccagctcctgatg

SEQ ID NO: 140634 - DNA, 20 bp, human
gttataggacataatagact

SEQ ID NO: 140635 - DNA, 20 bp, human
ggtgcatagtgggatctcgg

SEQ ID NO: 140636 - DNA, 20 bp, human
gggaccccccgcccaaagtc

SEQ ID NO: 140637 - DNA, 20 bp, human
gtcctaaagagtgagaacgg

SEQ ID NO: 140638 - DNA, 20 bp, human
gctgaggtcccggtcaccat

SEQ ID NO: 140639 - DNA, 20 bp, human
gtctgctaccgtgactaaga

SEQ ID NO: 140640 - DNA, 20 bp, human
gaacgcttccatcttagtca

SEQ ID NO: 140641 - DNA, 20 bp, human
gttgagagcccgggaaggtg

SEQ ID NO: 140642 - DNA, 20 bp, human
gcagacatgctgggatccta

SEQ ID NO: 140643 - DNA, 20 bp, human
gaaatcagcgtagtcgccag

SEQ ID NO: 140644 - DNA, 20 bp, human
gtcgcggtccggactttggg

SEQ ID NO: 140645 - DNA, 20 bp, human
gcgtagcgggagggaccgtg

SEQ ID NO: 140646 - DNA, 20 bp, human
gtgcccggcctatctttgct

SEQ ID NO: 140647 - DNA, 20 bp, human
gcgcgctggttcaccggtag

SEQ ID NO: 140648 - DNA, 20 bp, human
gggggccgggggtaagtcgg

SEQ ID NO: 140649 - DNA, 20 bp, human
gagcggtctctccaacacgc

SEQ ID NO: 140650 - DNA, 20 bp, human
gtgggaggccaggcaagtcg

SEQ ID NO: 140651 - DNA, 20 bp, human
ggcaagcgccatgtctagtg

SEQ ID NO: 140652 - DNA, 20 bp, human
ggtgttggagagaccgctac

SEQ ID NO: 140653 - DNA, 20 bp, human
ggaggaaggtgaggcctctt

SEQ ID NO: 140654 - DNA, 20 bp, human
ggccgggggtaagtcggggg

SEQ ID NO: 140655 - DNA, 20 bp, human
gatggcgcttgccagcgtgt

SEQ ID NO: 140656 - DNA, 20 bp, human
ggctccccgagcagctagta

SEQ ID NO: 140657 - DNA, 20 bp, human
gggggttgagagatctggca

SEQ ID NO: 140658 - DNA, 20 bp, human
gtaccggaggagaaagatgg

SEQ ID NO: 140659 - DNA, 20 bp, human
gcggggagccgggccagcac

SEQ ID NO: 140660 - DNA, 20 bp, human
gtgctttgaggcagtaccgg

SEQ ID NO: 140661 - DNA, 20 bp, human
gagttgctttgaggcagtac

SEQ ID NO: 140662 - DNA, 20 bp, human
gggatcttgggcttaagtac

SEQ ID NO: 140663 - DNA, 20 bp, human
gagaggtaccccgaagatgg

SEQ ID NO: 140664 - DNA, 20 bp, human
gggaagataaagcctgagtg

SEQ ID NO: 140665 - DNA, 20 bp, human
gctaccttactagctgctcg

SEQ ID NO: 140666 - DNA, 20 bp, human
gctgggaccctcaagaagga

SEQ ID NO: 140667 - DNA, 20 bp, human
gtggctgctgtgtggaccag

SEQ ID NO: 140668 - DNA, 20 bp, human
gctgtggaaaccgagctggt

SEQ ID NO: 140669 - DNA, 20 bp, human
gctgctgtgtggaccagtgg

SEQ ID NO: 140670 - DNA, 20 bp, human
gccattctgctattggtctg

SEQ ID NO: 140671 - DNA, 20 bp, human
gggaggggcaagtatctgaa

SEQ ID NO: 140672 - DNA, 20 bp, human
ggttcaatgctagagggtca

SEQ ID NO: 140673 - DNA, 20 bp, human
gagaaaatgcggtcgtgaat

SEQ ID NO: 140674 - DNA, 20 bp, human
gggctcaagtgtgctctggt

SEQ ID NO: 140675 - DNA, 20 bp, human
gaagtgtgctctggtcgggt

SEQ ID NO: 140676 - DNA, 20 bp, human
gcggtgtatgctccaccagt

SEQ ID NO: 140677 - DNA, 20 bp, human
gggagaacagtgctgatggt

SEQ ID NO: 140678 - DNA, 20 bp, human
gggaccacatcgcacagcac

SEQ ID NO: 140679 - DNA, 20 bp, human
gcaagaaagcagttccgggt

SEQ ID NO: 140680 - DNA, 20 bp, human
gaccgagccgggagagacac

SEQ ID NO: 140681 - DNA, 20 bp, human
gaagagaagcctccaactgg

SEQ ID NO: 140682 - DNA, 20 bp, human
gccaagcaaggcggcacctg

SEQ ID NO: 140683 - DNA, 20 bp, human
gcgcggctagtgtgactcag

SEQ ID NO: 140684 - DNA, 20 bp, human
gaaccaagccccaagcaagg

SEQ ID NO: 140685 - DNA, 20 bp, human
gaggagacggagataaacgg

SEQ ID NO: 140686 - DNA, 20 bp, human
gtgtatgcggagccccccga

SEQ ID NO: 140687 - DNA, 20 bp, human
gcgagagcggacagatctct

SEQ ID NO: 140688 - DNA, 20 bp, human
gggcagtagggaagccccta

SEQ ID NO: 140689 - DNA, 20 bp, human
ggtgaggtgggggctcccaa

SEQ ID NO: 140690 - DNA, 20 bp, human
gtctgggtgctgggcggtca

SEQ ID NO: 140691 - DNA, 20 bp, human
gatctgtccgctctcggagg

SEQ ID NO: 140692 - DNA, 20 bp, human
gtggcgctactagatgtatg

SEQ ID NO: 140693 - DNA, 20 bp, human
gggacaaagagttacaggtg

SEQ ID NO: 140694 - DNA, 20 bp, human
gtggagggtcgcctgagagg

SEQ ID NO: 140695 - DNA, 20 bp, human
gggaagcccctagggatgca

SEQ ID NO: 140696 - DNA, 20 bp, human
gctctggtcccggacagtgg

SEQ ID NO: 140697 - DNA, 20 bp, human
gtggaaaccagtgccccagg

SEQ ID NO: 140698 - DNA, 20 bp, human
gaggagagcggtgccttgca

SEQ ID NO: 140699 - DNA, 20 bp, human
gcgggcgggagcaccaaccg

SEQ ID NO: 140700 - DNA, 20 bp, human
gcccgcccggggtaagtccc

SEQ ID NO: 140701 - DNA, 20 bp, human
gccaaccggggacttacccc

SEQ ID NO: 140702 - DNA, 20 bp, human
gaccagtgccccaggcggcg

SEQ ID NO: 140703 - DNA, 20 bp, human
gttgcagggatgctgcgggc

SEQ ID NO: 140704 - DNA, 20 bp, human
ggcgggagaagtccacaccg

SEQ ID NO: 140705 - DNA, 20 bp, human
gctggttaaatcaagaaagg

SEQ ID NO: 140706 - DNA, 20 bp, human
gagagccaggcgagccagga

SEQ ID NO: 140707 - DNA, 20 bp, human
gccagccacagggcccatca

SEQ ID NO: 140708 - DNA, 20 bp, human
gggcgaggtggtgagttgtg

SEQ ID NO: 140709 - DNA, 20 bp, human
gtggcccataaacaccctgt

SEQ ID NO: 140710 - DNA, 20 bp, human
gctcgcccgctggtccttcc

SEQ ID NO: 140711 - DNA, 20 bp, human
ggaagtggaaggggcctcat

SEQ ID NO: 140712 - DNA, 20 bp, human
gagtgccaggcgggaacaga

SEQ ID NO: 140713 - DNA, 20 bp, human
gagccgtggcctctccgaag

SEQ ID NO: 140714 - DNA, 20 bp, human
gctctccgaagtggcagatg

SEQ ID NO: 140715 - DNA, 20 bp, human
gggccagagcaagtgccagg

SEQ ID NO: 140716 - DNA, 20 bp, human
gactaagggtttctttccgc

SEQ ID NO: 140717 - DNA, 20 bp, human
gagcctgaggcgagagaaag

SEQ ID NO: 140718 - DNA, 20 bp, human
gcaagatggtgagtgactaa

SEQ ID NO: 140719 - DNA, 20 bp, human
gatcgcaccgcgacgaccag

SEQ ID NO: 140720 - DNA, 20 bp, human
gcgatcagcaaagccctggt

SEQ ID NO: 140721 - DNA, 20 bp, human
gtcggcgctgggagtttcgg

SEQ ID NO: 140722 - DNA, 20 bp, human
gcgcctctggcgggccgcag

SEQ ID NO: 140723 - DNA, 20 bp, human
gcaccactgcggcccgccag

SEQ ID NO: 140724 - DNA, 20 bp, human
ggaagtcgttagggacgcta

SEQ ID NO: 140725 - DNA, 20 bp, human
gccgcgctcaactcctcagg

SEQ ID NO: 140726 - DNA, 20 bp, human
gaggtgctgtgtaatcatta

SEQ ID NO: 140727 - DNA, 20 bp, human
gcttccgctgatcggcaccg

SEQ ID NO: 140728 - DNA, 20 bp, human
gttacctcggtgccgatcag

SEQ ID NO: 140729 - DNA, 20 bp, human
ggggaaagggaagacaccac

SEQ ID NO: 140730 - DNA, 20 bp, human
gacaccaccggaagcaagga

SEQ ID NO: 140731 - DNA, 20 bp, human
gcaggtgaccgagcaccgcc

SEQ ID NO: 140732 - DNA, 20 bp, human
gctgtgtaatcattaaggag

SEQ ID NO: 140733 - DNA, 20 bp, human
ggtccagactaaattactag

SEQ ID NO: 140734 - DNA, 20 bp, human
ggaagacaccaccggaagca

SEQ ID NO: 140735 - DNA, 20 bp, human
gagctcccggctgtcacagg

SEQ ID NO: 140736 - DNA, 20 bp, human
gggagaagatggcgaccgtg

SEQ ID NO: 140737 - DNA, 20 bp, human
gtcactggactctcaatatt

SEQ ID NO: 140738 - DNA, 20 bp, human
gtggacagtgagatcaaggt

SEQ ID NO: 140739 - DNA, 20 bp, human
gaccgtgtgggatgaggccg

SEQ ID NO: 140740 - DNA, 20 bp, human
gctgctggacagtgagatca

SEQ ID NO: 140741 - DNA, 20 bp, human
ggctcgcccggtgcccacct

SEQ ID NO: 140742 - DNA, 20 bp, human
gtgggcgcacagctcctgtg

SEQ ID NO: 140743 - DNA, 20 bp, human
gtcccccagggtgcccgatt

SEQ ID NO: 140744 - DNA, 20 bp, human
gcccgattaggaagtacgag

SEQ ID NO: 140745 - DNA, 20 bp, human
ggcaccctgggggagacatg

SEQ ID NO: 140746 - DNA, 20 bp, human
gaggtacctcaggaggatcc

SEQ ID NO: 140747 - DNA, 20 bp, human
gcgggaaaggcgatgagtaa

SEQ ID NO: 140748 - DNA, 20 bp, human
gaaaggccgggcagaagctg

SEQ ID NO: 140749 - DNA, 20 bp, human
gaagctgcggcgggaggtaa

SEQ ID NO: 140750 - DNA, 20 bp, human
gaaggcgatgagtaaaggcc

SEQ ID NO: 140751 - DNA, 20 bp, human
gctgagttgggtggcgggaa

SEQ ID NO: 140752 - DNA, 20 bp, human
gtacagcgggaacacggact

SEQ ID NO: 140753 - DNA, 20 bp, human
gcccgagcaactacaacgtc

SEQ ID NO: 140754 - DNA, 20 bp, human
gtacctcaggaggatcccgg

SEQ ID NO: 140755 - DNA, 20 bp, human
gtggagcagctggcgcaaca

SEQ ID NO: 140756 - DNA, 20 bp, human
ggaggagataggcatcttgg

SEQ ID NO: 140757 - DNA, 20 bp, human
gagcggtgacagatcatccc

SEQ ID NO: 140758 - DNA, 20 bp, human
gtggtcactatggaggagat

SEQ ID NO: 140759 - DNA, 20 bp, human
ggccggcttggtcactatgg

SEQ ID NO: 140760 - DNA, 20 bp, human
gcgtgcggccgagtgatccc

SEQ ID NO: 140761 - DNA, 20 bp, human
ggaggccggcttggtcacta

SEQ ID NO: 140762 - DNA, 20 bp, human
gatggaggagataggcatct

SEQ ID NO: 140763 - DNA, 20 bp, human
gatcttggtggagaaggctc

SEQ ID NO: 140764 - DNA, 20 bp, human
gtgggtggccgagtgatggt

SEQ ID NO: 140765 - DNA, 20 bp, human
gggccacacagaggccggct

SEQ ID NO: 140766 - DNA, 20 bp, human
gtgacggaccagagcaggta

SEQ ID NO: 140767 - DNA, 20 bp, human
ggcgatatgatatagacggg

SEQ ID NO: 140768 - DNA, 20 bp, human
ggtagaagcggagtgagtga

SEQ ID NO: 140769 - DNA, 20 bp, human
ggaagtgctctacaagcccg

SEQ ID NO: 140770 - DNA, 20 bp, human
ggacgaaggagccagcggaa

SEQ ID NO: 140771 - DNA, 20 bp, human
ggaggtgtcagtactgacga

SEQ ID NO: 140772 - DNA, 20 bp, human
gggcgctgacacagcagatc

SEQ ID NO: 140773 - DNA, 20 bp, human
gccttgccctgactcaccga

SEQ ID NO: 140774 - DNA, 20 bp, human
gcggaacggagccaaaggac

SEQ ID NO: 140775 - DNA, 20 bp, human
gaagacggctcggatgccgg

SEQ ID NO: 140776 - DNA, 20 bp, human
gtgagaagccgtctctcata

SEQ ID NO: 140777 - DNA, 20 bp, human
gcgtctctcataggggatgc

SEQ ID NO: 140778 - DNA, 20 bp, human
gccaggttagggtgcaagaa

SEQ ID NO: 140779 - DNA, 20 bp, human
ggcagtcttggtggagtccc

SEQ ID NO: 140780 - DNA, 20 bp, human
gctaggcctggtcatctcta

SEQ ID NO: 140781 - DNA, 20 bp, human
gggagtcccgggacttggag

SEQ ID NO: 140782 - DNA, 20 bp, human
ggaggatgtttcccaggtta

SEQ ID NO: 140783 - DNA, 20 bp, human
gcagaggcagaagcgagtcg

SEQ ID NO: 140784 - DNA, 20 bp, human
gtgtggagcagcactccttc

SEQ ID NO: 140785 - DNA, 20 bp, human
gggacggccatggccattcc

SEQ ID NO: 140786 - DNA, 20 bp, human
gatacactgcgcagctggaa

SEQ ID NO: 140787 - DNA, 20 bp, human
gctcagtcagtcgcctcctc

SEQ ID NO: 140788 - DNA, 20 bp, human
ggcgcacccggggagcaagg

SEQ ID NO: 140789 - DNA, 20 bp, human
gggaggcgcggtgaactgag

SEQ ID NO: 140790 - DNA, 20 bp, human
gtcacacggccaagaatggg

SEQ ID NO: 140791 - DNA, 20 bp, human
gtaagcccttctggggtcag

SEQ ID NO: 140792 - DNA, 20 bp, human
ggtcctggcgagaagcgagc

SEQ ID NO: 140793 - DNA, 20 bp, human
gacctcacacggccaagaat

SEQ ID NO: 140794 - DNA, 20 bp, human
gcccgtagccagcgcctgga

SEQ ID NO: 140795 - DNA, 20 bp, human
gcccggggagcaaggaggcg

SEQ ID NO: 140796 - DNA, 20 bp, human
ggctgggacagcgaaatgga

SEQ ID NO: 140797 - DNA, 20 bp, human
gagttgctgggacagcgaaa

SEQ ID NO: 140798 - DNA, 20 bp, human
ggggccccgaaagccacgta

SEQ ID NO: 140799 - DNA, 20 bp, human
ggagtcccgaggtgacccag

SEQ ID NO: 140800 - DNA, 20 bp, human
gcaaactgcctggcacggaa

SEQ ID NO: 140801 - DNA, 20 bp, human
gacgtcggcgaagccctacg

SEQ ID NO: 140802 - DNA, 20 bp, human
gagccggagccggcgacgtg

SEQ ID NO: 140803 - DNA, 20 bp, human
gagaaacggggcctccgcta

SEQ ID NO: 140804 - DNA, 20 bp, human
gcgcgcgacaagtagttgct

SEQ ID NO: 140805 - DNA, 20 bp, human
ggccaacgggaaaatatctg

SEQ ID NO: 140806 - DNA, 20 bp, human
gcggtgtgagagcggtaaga

SEQ ID NO: 140807 - DNA, 20 bp, human
ggccggggacggtgtgagag

SEQ ID NO: 140808 - DNA, 20 bp, human
gtgtgagagcggtaagatgg

SEQ ID NO: 140809 - DNA, 20 bp, human
gtcggtgctgagtagagact

SEQ ID NO: 140810 - DNA, 20 bp, human
gtacaggcggagggacccga

SEQ ID NO: 140811 - DNA, 20 bp, human
gccggctgctgactcacggg

SEQ ID NO: 140812 - DNA, 20 bp, human
gctcgtgcgggccagagccg

SEQ ID NO: 140813 - DNA, 20 bp, human
gtcgatggaggcctcccggt

SEQ ID NO: 140814 - DNA, 20 bp, human
ggagtagagactgggctctc

SEQ ID NO: 140815 - DNA, 20 bp, human
ggagccacgggagctacagg

SEQ ID NO: 140816 - DNA, 20 bp, human
gcagcaagggacgctcaggc

SEQ ID NO: 140817 - DNA, 20 bp, human
gcaggggctgagtcacggcg

SEQ ID NO: 140818 - DNA, 20 bp, human
gcgagtggtggccgaagcag

SEQ ID NO: 140819 - DNA, 20 bp, human
ggagccctaagtcccacgga

SEQ ID NO: 140820 - DNA, 20 bp, human
gactcgtgcaggcccaacta

SEQ ID NO: 140821 - DNA, 20 bp, human
gaacggagccctaagtccca

SEQ ID NO: 140822 - DNA, 20 bp, human
gcttccctccgtgggactta

SEQ ID NO: 140823 - DNA, 20 bp, human
gggagggtctgggaagctat

SEQ ID NO: 140824 - DNA, 20 bp, human
gcggggaccatggcggacgg

SEQ ID NO: 140825 - DNA, 20 bp, human
gcgggtgcgcgggcaacttc

SEQ ID NO: 140826 - DNA, 20 bp, human
gccggcacagaagaacaacc

SEQ ID NO: 140827 - DNA, 20 bp, human
gccccgcggtgctgacatcc

SEQ ID NO: 140828 - DNA, 20 bp, human
gggaggagcggacccttgat

SEQ ID NO: 140829 - DNA, 20 bp, human
gctgtcatgaaggacgtacc

SEQ ID NO: 140830 - DNA, 20 bp, human
gtaacgggggactgagactg

SEQ ID NO: 140831 - DNA, 20 bp, human
gtttccggcagccatccccg

SEQ ID NO: 140832 - DNA, 20 bp, human
gggcgccctcagcccatcaa

SEQ ID NO: 140833 - DNA, 20 bp, human
ggagggatgacagaccacga

SEQ ID NO: 140834 - DNA, 20 bp, human
gggctctgctgtaggaagcc

SEQ ID NO: 140835 - DNA, 20 bp, human
gtccagacggtgccacacag

SEQ ID NO: 140836 - DNA, 20 bp, human
gccgccgctgagatctggga

SEQ ID NO: 140837 - DNA, 20 bp, human
ggagaaaaaggaggcgtcgg

SEQ ID NO: 140838 - DNA, 20 bp, human
gtgtggtgacgcgaagacag

SEQ ID NO: 140839 - DNA, 20 bp, human
gcagcggcgcacacccgacg

SEQ ID NO: 140840 - DNA, 20 bp, human
ggcagaccggttaacaacta

SEQ ID NO: 140841 - DNA, 20 bp, human
gcgcggctctgtctgcaaac

SEQ ID NO: 140842 - DNA, 20 bp, human
ggagcaggcgaagagaatga

SEQ ID NO: 140843 - DNA, 20 bp, human
gttgcagacagagccgcgtc

SEQ ID NO: 140844 - DNA, 20 bp, human
gctgggtcttacctgaagac

SEQ ID NO: 140845 - DNA, 20 bp, human
gaagacaagggtccatatcg

SEQ ID NO: 140846 - DNA, 20 bp, human
gccgccgctggagactgctg

SEQ ID NO: 140847 - DNA, 20 bp, human
gctgcaccggcgccttgtcc

SEQ ID NO: 140848 - DNA, 20 bp, human
gatgccactctaggaaacgg

SEQ ID NO: 140849 - DNA, 20 bp, human
gaggctgcggggctgagtca

SEQ ID NO: 140850 - DNA, 20 bp, human
gtgaatgccactctaggaaa

SEQ ID NO: 140851 - DNA, 20 bp, human
gggaggccgggacaaggcgc

SEQ ID NO: 140852 - DNA, 20 bp, human
ggttggtctgggaaaaaggg

SEQ ID NO: 140853 - DNA, 20 bp, human
gcgagttggtctgggaaaaa

SEQ ID NO: 140854 - DNA, 20 bp, human
ggtccacctggcccctccta

SEQ ID NO: 140855 - DNA, 20 bp, human
gacgcggcggtggtgagggt

SEQ ID NO: 140856 - DNA, 20 bp, human
gacgagcgcgagatagcgtc

SEQ ID NO: 140857 - DNA, 20 bp, human
ggcgtcgggccgcacgatga

SEQ ID NO: 140858 - DNA, 20 bp, human
gagtgggagcaggtatctgg

SEQ ID NO: 140859 - DNA, 20 bp, human
gcctggagtcgggagtgtcg

SEQ ID NO: 140860 - DNA, 20 bp, human
gctcgtgtgcaggcccggct

SEQ ID NO: 140861 - DNA, 20 bp, human
gccgccggccccccaggatg

SEQ ID NO: 140862 - DNA, 20 bp, human
ggaaggcccagcgccgggaa

SEQ ID NO: 140863 - DNA, 20 bp, human
ggatcccaaagaactgaggg

SEQ ID NO: 140864 - DNA, 20 bp, human
gtgggctgccgtaccctcca

SEQ ID NO: 140865 - DNA, 20 bp, human
gacagtcaccttggagggta

SEQ ID NO: 140866 - DNA, 20 bp, human
gccgtcccggagacccggtc

SEQ ID NO: 140867 - DNA, 20 bp, human
gaaagcactatggtgtggtg

SEQ ID NO: 140868 - DNA, 20 bp, human
ggttggaaagcactatggtg

SEQ ID NO: 140869 - DNA, 20 bp, human
gacccggtcgggagggagga

SEQ ID NO: 140870 - DNA, 20 bp, human
gggagacccggtcgggaggg

SEQ ID NO: 140871 - DNA, 20 bp, human
ggtggtgaggagctacttcg

SEQ ID NO: 140872 - DNA, 20 bp, human
gcccggagacccggtcggga

SEQ ID NO: 140873 - DNA, 20 bp, human
gttaggccgtcccggagacc

SEQ ID NO: 140874 - DNA, 20 bp, human
gagggccccgggatgactca

SEQ ID NO: 140875 - DNA, 20 bp, human
gagttagagacgagggaatg

SEQ ID NO: 140876 - DNA, 20 bp, human
ggacgggagaaaacaccctg

SEQ ID NO: 140877 - DNA, 20 bp, human
gcaccctggggcactctcag

SEQ ID NO: 140878 - DNA, 20 bp, human
ggcgcgcgtagctcctccag

SEQ ID NO: 140879 - DNA, 20 bp, human
ggctttggcgctgctgagag

SEQ ID NO: 140880 - DNA, 20 bp, human
gataggtgagaggaccccgg

SEQ ID NO: 140881 - DNA, 20 bp, human
gggccagcccctgcgtcggg

SEQ ID NO: 140882 - DNA, 20 bp, human
gatcttgccccccgacgcag

SEQ ID NO: 140883 - DNA, 20 bp, human
gggaaggatcctgggttcag

SEQ ID NO: 140884 - DNA, 20 bp, human
ggctgggccagcccctgcgt

SEQ ID NO: 140885 - DNA, 20 bp, human
ggggcttgagccgaggagag

SEQ ID NO: 140886 - DNA, 20 bp, human
ggcgcacggcagcgtctccg

SEQ ID NO: 140887 - DNA, 20 bp, human
ggacacaacttggttacgac

SEQ ID NO: 140888 - DNA, 20 bp, human
gatcgcggcgaaggggacag

SEQ ID NO: 140889 - DNA, 20 bp, human
gatgccgctggagaacctgg

SEQ ID NO: 140890 - DNA, 20 bp, human
gcggctgacaggacacaact

SEQ ID NO: 140891 - DNA, 20 bp, human
gggcaagtcgaggtccccca

SEQ ID NO: 140892 - DNA, 20 bp, human
gccccaagctgcccttacag

SEQ ID NO: 140893 - DNA, 20 bp, human
ggtgccgccttcccctgtaa

SEQ ID NO: 140894 - DNA, 20 bp, human
gagagatgcagaccccgctg

SEQ ID NO: 140895 - DNA, 20 bp, human
ggcgatgccgctggagaacc

SEQ ID NO: 140896 - DNA, 20 bp, human
gactgggcctgaaagggtac

SEQ ID NO: 140897 - DNA, 20 bp, human
gcgccgccggcccagctata

SEQ ID NO: 140898 - DNA, 20 bp, human
gccctgccacacgcaaacac

SEQ ID NO: 140899 - DNA, 20 bp, human
gcggcagcagtagcggtcac

SEQ ID NO: 140900 - DNA, 20 bp, human
gagaggaactgggcctgaaa

SEQ ID NO: 140901 - DNA, 20 bp, human
ggcagccgctgctgagtcac

SEQ ID NO: 140902 - DNA, 20 bp, human
gcgtgcccgtgactcagcag

SEQ ID NO: 140903 - DNA, 20 bp, human
gcgagctggggacgcagata

SEQ ID NO: 140904 - DNA, 20 bp, human
ggctgacgaaccggaagaag

SEQ ID NO: 140905 - DNA, 20 bp, human
ggcgggaggctggatgactc

SEQ ID NO: 140906 - DNA, 20 bp, human
ggcggccgcggcggtgaacg

SEQ ID NO: 140907 - DNA, 20 bp, human
ggccgcatcacgcaagatgg

SEQ ID NO: 140908 - DNA, 20 bp, human
gggtcgactcaaggtaaagt

SEQ ID NO: 140909 - DNA, 20 bp, human
gggcgctgccgtaaatcagg

SEQ ID NO: 140910 - DNA, 20 bp, human
gggcgtcaagaagcgagaga

SEQ ID NO: 140911 - DNA, 20 bp, human
gccgggcccgcggcaacctc

SEQ ID NO: 140912 - DNA, 20 bp, human
ggccgccatcttgcgtgatg

SEQ ID NO: 140913 - DNA, 20 bp, human
gcgcggcccgggacttggtt

SEQ ID NO: 140914 - DNA, 20 bp, human
ggccaaagtgggggctcgga

SEQ ID NO: 140915 - DNA, 20 bp, human
ggccctccgagcccccactt

SEQ ID NO: 140916 - DNA, 20 bp, human
gccgtagttacggtcgactg

SEQ ID NO: 140917 - DNA, 20 bp, human
gggcctctgtcggcacaaga

SEQ ID NO: 140918 - DNA, 20 bp, human
gacgaggaagcgaggcagag

SEQ ID NO: 140919 - DNA, 20 bp, human
ggtcggacatcgtgaacccc

SEQ ID NO: 140920 - DNA, 20 bp, human
ggatgtccgacgaggaagcg

SEQ ID NO: 140921 - DNA, 20 bp, human
gccgcaagtgcggcctctgt

SEQ ID NO: 140922 - DNA, 20 bp, human
gagacccggctcccgggcta

SEQ ID NO: 140923 - DNA, 20 bp, human
gagccgggtctctggagtcg

SEQ ID NO: 140924 - DNA, 20 bp, human
gtaccccagggactccgggc

SEQ ID NO: 140925 - DNA, 20 bp, human
gtgctggaaagcgtgagtgt

SEQ ID NO: 140926 - DNA, 20 bp, human
ggccgcacaaggagtggagt

SEQ ID NO: 140927 - DNA, 20 bp, human
gcctagcgccgcacaaggag

SEQ ID NO: 140928 - DNA, 20 bp, human
gtggccatgaccgggacggg

SEQ ID NO: 140929 - DNA, 20 bp, human
ggtggagtgggcaccgcgaa

SEQ ID NO: 140930 - DNA, 20 bp, human
gagcatggccatgaccggga

SEQ ID NO: 140931 - DNA, 20 bp, human
gccctgagcatggccatgac

SEQ ID NO: 140932 - DNA, 20 bp, human
gcgcgaagggaaagcgaaag

SEQ ID NO: 140933 - DNA, 20 bp, human
gagggaaagcgaaagcggta

SEQ ID NO: 140934 - DNA, 20 bp, human
ggcccactccactccttgtg

SEQ ID NO: 140935 - DNA, 20 bp, human
ggtcctctgcaagtaggaca

SEQ ID NO: 140936 - DNA, 20 bp, human
gcgggtactgctctctgtgt

SEQ ID NO: 140937 - DNA, 20 bp, human
gggagtgaaagcgaaagccc

SEQ ID NO: 140938 - DNA, 20 bp, human
gggaagtagggttaagtcta

SEQ ID NO: 140939 - DNA, 20 bp, human
ggtctcccggctagtcgccc

SEQ ID NO: 140940 - DNA, 20 bp, human
gggcctgagccacagttcga

SEQ ID NO: 140941 - DNA, 20 bp, human
gtttccaggaggtaagtctc

SEQ ID NO: 140942 - DNA, 20 bp, human
gagcccgcaaacaggtaatg

SEQ ID NO: 140943 - DNA, 20 bp, human
gaaagcccgggcgactagcc

SEQ ID NO: 140944 - DNA, 20 bp, human
ggggaatccccgagaagtga

SEQ ID NO: 140945 - DNA, 20 bp, human
gctgctctctgtgtaggtgg

SEQ ID NO: 140946 - DNA, 20 bp, human
gtgagcggcgaaagccggga

SEQ ID NO: 140947 - DNA, 20 bp, human
gggcggacggcacagaggga

SEQ ID NO: 140948 - DNA, 20 bp, human
gtcgcgggagaggaaaatat

SEQ ID NO: 140949 - DNA, 20 bp, human
ggcagtgagtaagccagcaa

SEQ ID NO: 140950 - DNA, 20 bp, human
ggactctccatcatcagacg

SEQ ID NO: 140951 - DNA, 20 bp, human
ggggcgggcggacggcacag

SEQ ID NO: 140952 - DNA, 20 bp, human
gtgtccgcggaggtgtcccc

SEQ ID NO: 140953 - DNA, 20 bp, human
gagccgaccccgggagttgg

SEQ ID NO: 140954 - DNA, 20 bp, human
ggatcaggaagtgaagctca

SEQ ID NO: 140955 - DNA, 20 bp, human
ggtgagtaagccagcaaggg

SEQ ID NO: 140956 - DNA, 20 bp, human
gcacgcggctctcagttcgt

SEQ ID NO: 140957 - DNA, 20 bp, human
ggtcaccagcagagccggtg

SEQ ID NO: 140958 - DNA, 20 bp, human
ggctctcagttcgttggcgg

SEQ ID NO: 140959 - DNA, 20 bp, human
gccggaacctctgggcccgg

SEQ ID NO: 140960 - DNA, 20 bp, human
ggccagctgcaagtcggact

SEQ ID NO: 140961 - DNA, 20 bp, human
ggctgctgccctacgcggag

SEQ ID NO: 140962 - DNA, 20 bp, human
ggcggctctcagttcgttgg

SEQ ID NO: 140963 - DNA, 20 bp, human
gcgtctagccgctccgcgta

SEQ ID NO: 140964 - DNA, 20 bp, human
gaggcccgggcacacttacg

SEQ ID NO: 140965 - DNA, 20 bp, human
gaggaggcggagcccggaga

SEQ ID NO: 140966 - DNA, 20 bp, human
gctgtgccgtgagggactct

SEQ ID NO: 140967 - DNA, 20 bp, human
gggcaagaaccagcgcaaga

SEQ ID NO: 140968 - DNA, 20 bp, human
gtccattttggtctcaggtg

SEQ ID NO: 140969 - DNA, 20 bp, human
gttggtctcaggtgtggact

SEQ ID NO: 140970 - DNA, 20 bp, human
ggtgcagtgagccggctccg

SEQ ID NO: 140971 - DNA, 20 bp, human
ggcagcgttggtaaaacctg

SEQ ID NO: 140972 - DNA, 20 bp, human
ggttggtaaaacctgcgggt

SEQ ID NO: 140973 - DNA, 20 bp, human
gccggaagtagtcccaacag

SEQ ID NO: 140974 - DNA, 20 bp, human
gtgggagaagcggggaaatc

SEQ ID NO: 140975 - DNA, 20 bp, human
gcccaaactcagagtaccgg

SEQ ID NO: 140976 - DNA, 20 bp, human
ggccatagccgccccgtgac

SEQ ID NO: 140977 - DNA, 20 bp, human
ggaacccagccctcccacag

SEQ ID NO: 140978 - DNA, 20 bp, human
gtgtccagccggtcacgggg

SEQ ID NO: 140979 - DNA, 20 bp, human
gaagccggcgtgcggtcccg

SEQ ID NO: 140980 - DNA, 20 bp, human
ggcggccacgttcttcggag

SEQ ID NO: 140981 - DNA, 20 bp, human
ggggtgaagccgctgtggga

SEQ ID NO: 140982 - DNA, 20 bp, human
gaggtgaggcaccgggataa

SEQ ID NO: 140983 - DNA, 20 bp, human
gttgtgtccagccggtcacg

SEQ ID NO: 140984 - DNA, 20 bp, human
gtccagggtgaagccgctgt

SEQ ID NO: 140985 - DNA, 20 bp, human
ggcgccgcgggaccgcacgc

SEQ ID NO: 140986 - DNA, 20 bp, human
ggcggccctggcaagaacga

SEQ ID NO: 140987 - DNA, 20 bp, human
gcggtgccttgggagaaata

SEQ ID NO: 140988 - DNA, 20 bp, human
gggccagcagggactaaccg

SEQ ID NO: 140989 - DNA, 20 bp, human
gtccccgcagggaacgaaca

SEQ ID NO: 140990 - DNA, 20 bp, human
gccggcgcccagggactcaa

SEQ ID NO: 140991 - DNA, 20 bp, human
ggctgccctcgttcttgcca

SEQ ID NO: 140992 - DNA, 20 bp, human
gaacgaacatggtcgcagtg

SEQ ID NO: 140993 - DNA, 20 bp, human
gcagggactaaccgcggccc

SEQ ID NO: 140994 - DNA, 20 bp, human
gtcggccggaaaaaacaggg

SEQ ID NO: 140995 - DNA, 20 bp, human
gacagggaggttgtagccgg

SEQ ID NO: 140996 - DNA, 20 bp, human
gggcgccggcttggtgagcg

SEQ ID NO: 140997 - DNA, 20 bp, human
gccacttccgggcgcggcgc

SEQ ID NO: 140998 - DNA, 20 bp, human
ggaggccggccgggctactg

SEQ ID NO: 140999 - DNA, 20 bp, human
gtggtgagcgcgggtacccg

SEQ ID NO: 141000 - DNA, 20 bp, human
gccgggacccccacgacacg

SEQ ID NO: 141001 - DNA, 20 bp, human
gccccaggcgcggtctctat

SEQ ID NO: 141002 - DNA, 20 bp, human
gcgagacaggacgatcgttg

SEQ ID NO: 141003 - DNA, 20 bp, human
gcaggcgcggtctctatggg

SEQ ID NO: 141004 - DNA, 20 bp, human
gtcggcaccgcgtgtcgtgg

SEQ ID NO: 141005 - DNA, 20 bp, human
ggaggcccattcaaaagaag

SEQ ID NO: 141006 - DNA, 20 bp, human
gcctgaagcgggatgagttc

SEQ ID NO: 141007 - DNA, 20 bp, human
gtgggctccgaccgtccctc

SEQ ID NO: 141008 - DNA, 20 bp, human
gtcacggagcgcccgaggga

SEQ ID NO: 141009 - DNA, 20 bp, human
gggagcgcccgagggacggt

SEQ ID NO: 141010 - DNA, 20 bp, human
gtgacacgaagccccggcca

SEQ ID NO: 141011 - DNA, 20 bp, human
gttggtagggtcggacatct

SEQ ID NO: 141012 - DNA, 20 bp, human
ggcctccagagccttcctcg

SEQ ID NO: 141013 - DNA, 20 bp, human
gaaactgagagtgagcagta

SEQ ID NO: 141014 - DNA, 20 bp, human
ggagtgagcagtagggagtg

SEQ ID NO: 141015 - DNA, 20 bp, human
gactcatcccgcttcagggt

SEQ ID NO: 141016 - DNA, 20 bp, human
ggctgtgggccgggagccgt

SEQ ID NO: 141017 - DNA, 20 bp, human
gcctaagacatcccacgggt

SEQ ID NO: 141018 - DNA, 20 bp, human
gccgccaggcactcacgtag

SEQ ID NO: 141019 - DNA, 20 bp, human
gagcggcgaggacccgggtc

SEQ ID NO: 141020 - DNA, 20 bp, human
ggcccctccatgccgcccca

SEQ ID NO: 141021 - DNA, 20 bp, human
ggtgctcgctccatcgggtc

SEQ ID NO: 141022 - DNA, 20 bp, human
ggccgtggggcggcatggag

SEQ ID NO: 141023 - DNA, 20 bp, human
gtcccccgaagcccacccgt

SEQ ID NO: 141024 - DNA, 20 bp, human
ggcttcctaagacatcccac

SEQ ID NO: 141025 - DNA, 20 bp, human
gggatgtcttaggaagcccg

SEQ ID NO: 141026 - DNA, 20 bp, human
gggaacacagagacctctag

SEQ ID NO: 141027 - DNA, 20 bp, human
gcagagacctctagaggcgt

SEQ ID NO: 141028 - DNA, 20 bp, human
gtctcctctgagagtctggg

SEQ ID NO: 141029 - DNA, 20 bp, human
ggatggctcagtaaactgtg

SEQ ID NO: 141030 - DNA, 20 bp, human
gggatggcatctagaaggtg

SEQ ID NO: 141031 - DNA, 20 bp, human
gagagaggatggcatctaga

SEQ ID NO: 141032 - DNA, 20 bp, human
gtactcagctgacaggaatc

SEQ ID NO: 141033 - DNA, 20 bp, human
gcccacggtgaatgaggaat

SEQ ID NO: 141034 - DNA, 20 bp, human
ggctcttcctacgcctctag

SEQ ID NO: 141035 - DNA, 20 bp, human
gactgagggccctaaataag

SEQ ID NO: 141036 - DNA, 20 bp, human
gagtggggtaccccaaccag

SEQ ID NO: 141037 - DNA, 20 bp, human
gagcttccagttgaggatca

SEQ ID NO: 141038 - DNA, 20 bp, human
gcctgaggacaaagctagtg

SEQ ID NO: 141039 - DNA, 20 bp, human
ggaggatcatggctatgtac

SEQ ID NO: 141040 - DNA, 20 bp, human
ggcaaaggaccaggatcccc

SEQ ID NO: 141041 - DNA, 20 bp, human
gacctctggtgtgcaggcaa

SEQ ID NO: 141042 - DNA, 20 bp, human
ggttggggacaggaattcag

SEQ ID NO: 141043 - DNA, 20 bp, human
ggctggggtgggctgagtct

SEQ ID NO: 141044 - DNA, 20 bp, human
gtgtactggcccccaaagct

SEQ ID NO: 141045 - DNA, 20 bp, human
ggccaacctgcaacccaaag

SEQ ID NO: 141046 - DNA, 20 bp, human
ggaccgctaggtaggcgagt

SEQ ID NO: 141047 - DNA, 20 bp, human
gtgccgactcgcctacctag

SEQ ID NO: 141048 - DNA, 20 bp, human
gccacccggacgaggagatg

SEQ ID NO: 141049 - DNA, 20 bp, human
gtgcagcgggcgtgagttgg

SEQ ID NO: 141050 - DNA, 20 bp, human
gaatcaagagaccgctaggt

SEQ ID NO: 141051 - DNA, 20 bp, human
gctgcccaccgacatcacgg

SEQ ID NO: 141052 - DNA, 20 bp, human
gcacggaggaggacttcaag

SEQ ID NO: 141053 - DNA, 20 bp, human
gcagatttcccacgaagagg

SEQ ID NO: 141054 - DNA, 20 bp, human
ggggcagatttcccacgaag

SEQ ID NO: 141055 - DNA, 20 bp, human
gagctgcagcgggcgtgagt

SEQ ID NO: 141056 - DNA, 20 bp, human
gcaggacacagggtaagtcc

SEQ ID NO: 141057 - DNA, 20 bp, human
gatctcaagagagcgttcgg

SEQ ID NO: 141058 - DNA, 20 bp, human
gtgaaagttgggcgcaggga

SEQ ID NO: 141059 - DNA, 20 bp, human
gaggtgagctgtgcagaccc

SEQ ID NO: 141060 - DNA, 20 bp, human
gcagatctcaagagagcgtt

SEQ ID NO: 141061 - DNA, 20 bp, human
ggaatgatgcaatcctacac

SEQ ID NO: 141062 - DNA, 20 bp, human
ggcgcagggaaggcacaagc

SEQ ID NO: 141063 - DNA, 20 bp, human
gtcaagagagcgttcggtgg

SEQ ID NO: 141064 - DNA, 20 bp, human
gtcggcaaaatctgaaagtt

SEQ ID NO: 141065 - DNA, 20 bp, human
gttgttccaatcttgcacta

SEQ ID NO: 141066 - DNA, 20 bp, human
gagctccaacgccggaacca

SEQ ID NO: 141067 - DNA, 20 bp, human
gtgctccttggttccggcgt

SEQ ID NO: 141068 - DNA, 20 bp, human
gagactcgcgtgtggcccca

SEQ ID NO: 141069 - DNA, 20 bp, human
gtcccggaccgtgtgctcga

SEQ ID NO: 141070 - DNA, 20 bp, human
gcatccagagccctacggac

SEQ ID NO: 141071 - DNA, 20 bp, human
gcaccgtcgagcacacggtc

SEQ ID NO: 141072 - DNA, 20 bp, human
gtagggcaccgtcgagcaca

SEQ ID NO: 141073 - DNA, 20 bp, human
gtaaaagggagtccgctcaa

SEQ ID NO: 141074 - DNA, 20 bp, human
ggaacaaaccgcgagatcag

SEQ ID NO: 141075 - DNA, 20 bp, human
gccgggaagctccaatgaaa

SEQ ID NO: 141076 - DNA, 20 bp, human
gtcggccacgggaaccccac

SEQ ID NO: 141077 - DNA, 20 bp, human
gcggcagcagggcccgccgt

SEQ ID NO: 141078 - DNA, 20 bp, human
gccacgtcggtgtagcgagt

SEQ ID NO: 141079 - DNA, 20 bp, human
gtcagacgagaactctccat

SEQ ID NO: 141080 - DNA, 20 bp, human
gtccctacggccattgtgac

SEQ ID NO: 141081 - DNA, 20 bp, human
gagctggcatggaccagaca

SEQ ID NO: 141082 - DNA, 20 bp, human
gcaggacctgcccgtcacaa

SEQ ID NO: 141083 - DNA, 20 bp, human
ggtcggtgtagcgagtgggc

SEQ ID NO: 141084 - DNA, 20 bp, human
ggcccgtcacaatggccgta

SEQ ID NO: 141085 - DNA, 20 bp, human
ggcgcaggcgggcaaggggg

SEQ ID NO: 141086 - DNA, 20 bp, human
gcgtggaagataaggcggcg

SEQ ID NO: 141087 - DNA, 20 bp, human
ggtgcttcgcgtgtgatgcc

SEQ ID NO: 141088 - DNA, 20 bp, human
ggcctgttgcgtggaagata

SEQ ID NO: 141089 - DNA, 20 bp, human
gtgttgcgtggaagataagg

SEQ ID NO: 141090 - DNA, 20 bp, human
gccgggaatcagctccgagg

SEQ ID NO: 141091 - DNA, 20 bp, human
ggtgcaggccgcccccagtg

SEQ ID NO: 141092 - DNA, 20 bp, human
gtctcccgcaacctagtccc

SEQ ID NO: 141093 - DNA, 20 bp, human
gggcgcgggaagtggacaca

SEQ ID NO: 141094 - DNA, 20 bp, human
gggatacctgaggaaaggta

SEQ ID NO: 141095 - DNA, 20 bp, human
gtgggcagaatggatacctg

SEQ ID NO: 141096 - DNA, 20 bp, human
gtgctgcccggggagaccgg

SEQ ID NO: 141097 - DNA, 20 bp, human
gagaccgccgagaacatcag

SEQ ID NO: 141098 - DNA, 20 bp, human
gggggagaccggaggagtct

SEQ ID NO: 141099 - DNA, 20 bp, human
gtcatgctgcccggggagac

SEQ ID NO: 141100 - DNA, 20 bp, human
ggaggccacagaggacgcag

SEQ ID NO: 141101 - DNA, 20 bp, human
ggtcctctgtggcctccccg

SEQ ID NO: 141102 - DNA, 20 bp, human
ggagcgcccattgcttggtg

SEQ ID NO: 141103 - DNA, 20 bp, human
gccactgcgccggtaggcgg

SEQ ID NO: 141104 - DNA, 20 bp, human
gaggtgaagttcgagaaaag

SEQ ID NO: 141105 - DNA, 20 bp, human
gccccggcgagaaacgcgtc

SEQ ID NO: 141106 - DNA, 20 bp, human
ggcactgcgcgccggcacga

SEQ ID NO: 141107 - DNA, 20 bp, human
gcctcaggccgcaggaaccc

SEQ ID NO: 141108 - DNA, 20 bp, human
gacccagacaccgaaggcag

SEQ ID NO: 141109 - DNA, 20 bp, human
ggtcgaaaacaccctcgtgc

SEQ ID NO: 141110 - DNA, 20 bp, human
ggtctccagcgaaagagcaa

SEQ ID NO: 141111 - DNA, 20 bp, human
ggaccccatgtgcaaccctc

SEQ ID NO: 141112 - DNA, 20 bp, human
gtgctgcagatccgacggaa

SEQ ID NO: 141113 - DNA, 20 bp, human
ggttgaagggcatctgtgat

SEQ ID NO: 141114 - DNA, 20 bp, human
gagaaagacccagacaccga

SEQ ID NO: 141115 - DNA, 20 bp, human
gttcgctggagactatgcgc

SEQ ID NO: 141116 - DNA, 20 bp, human
gccagagaggagcttctgag

SEQ ID NO: 141117 - DNA, 20 bp, human
gaggcagccacgagccagag

SEQ ID NO: 141118 - DNA, 20 bp, human
gggacacagtctgggaccca

SEQ ID NO: 141119 - DNA, 20 bp, human
gcagctggggcatcatcctc

SEQ ID NO: 141120 - DNA, 20 bp, human
gaggagagtgagctttgccg

SEQ ID NO: 141121 - DNA, 20 bp, human
gtggcgcctggccctccatc

SEQ ID NO: 141122 - DNA, 20 bp, human
gggcactgaacaagtggagg

SEQ ID NO: 141123 - DNA, 20 bp, human
ggccgtctgcaacactcaga

SEQ ID NO: 141124 - DNA, 20 bp, human
gcatcctcaggcgtctgccg

SEQ ID NO: 141125 - DNA, 20 bp, human
gaccttcctgcgcaggcctc

SEQ ID NO: 141126 - DNA, 20 bp, human
gggccgcaggtagcacagag

SEQ ID NO: 141127 - DNA, 20 bp, human
ggtcatcgcagcgcgagtgg

SEQ ID NO: 141128 - DNA, 20 bp, human
ggcctgactgccactgcccg

SEQ ID NO: 141129 - DNA, 20 bp, human
ggcttcgcctgtgagaggag

SEQ ID NO: 141130 - DNA, 20 bp, human
gccagcagcgcgtgctcctg

SEQ ID NO: 141131 - DNA, 20 bp, human
ggacgggtctcgcctcccta

SEQ ID NO: 141132 - DNA, 20 bp, human
gtgacgcgctcactgttcaa

SEQ ID NO: 141133 - DNA, 20 bp, human
ggccgagacaccttagagtc

SEQ ID NO: 141134 - DNA, 20 bp, human
gggttgatgtcctgactcta

SEQ ID NO: 141135 - DNA, 20 bp, human
gggcacgcggtgggtagcgg

SEQ ID NO: 141136 - DNA, 20 bp, human
gcaattgccagacagcatag

SEQ ID NO: 141137 - DNA, 20 bp, human
gtcccccttacctgtagcag

SEQ ID NO: 141138 - DNA, 20 bp, human
gtgaccgtgtgtctctgtct

SEQ ID NO: 141139 - DNA, 20 bp, human
ggcccctgctacaggtaagg

SEQ ID NO: 141140 - DNA, 20 bp, human
ggctgcccctgctacaggta

SEQ ID NO: 141141 - DNA, 20 bp, human
gaggctgcacctaagcagat

SEQ ID NO: 141142 - DNA, 20 bp, human
gctgcttaggtgcagcctgg

SEQ ID NO: 141143 - DNA, 20 bp, human
gaagccgctgcccctgctac

SEQ ID NO: 141144 - DNA, 20 bp, human
gcctcagcctctatgctgtc

SEQ ID NO: 141145 - DNA, 20 bp, human
ggtcctcaggaggcaaacca

SEQ ID NO: 141146 - DNA, 20 bp, human
gtggcccacgagcccttcta

SEQ ID NO: 141147 - DNA, 20 bp, human
gaggcgcgcccgaactgtcg

SEQ ID NO: 141148 - DNA, 20 bp, human
ggaaggatgtcgacctacgg

SEQ ID NO: 141149 - DNA, 20 bp, human
gcgggcgcacacaacgatgt

SEQ ID NO: 141150 - DNA, 20 bp, human
gggcggcccggctcacgcgg

SEQ ID NO: 141151 - DNA, 20 bp, human
gaacatggccgagaccagcg

SEQ ID NO: 141152 - DNA, 20 bp, human
gcaggaaggatgtcgaccta

SEQ ID NO: 141153 - DNA, 20 bp, human
ggcccgagtaccttaaacac

SEQ ID NO: 141154 - DNA, 20 bp, human
ggaggaggcagagccgtgtc

SEQ ID NO: 141155 - DNA, 20 bp, human
ggcggcggccgcgacagttc

SEQ ID NO: 141156 - DNA, 20 bp, human
gtctataactcggagccgtt

SEQ ID NO: 141157 - DNA, 20 bp, human
gagacccgcgggggacggag

SEQ ID NO: 141158 - DNA, 20 bp, human
gacacagagcagacccgcgg

SEQ ID NO: 141159 - DNA, 20 bp, human
gggctacgcaggcgcacgag

SEQ ID NO: 141160 - DNA, 20 bp, human
gcgtgcgactcacccgtcca

SEQ ID NO: 141161 - DNA, 20 bp, human
gatagcaggaaccgacccaa

SEQ ID NO: 141162 - DNA, 20 bp, human
gtaactcggagccgttgggt

SEQ ID NO: 141163 - DNA, 20 bp, human
ggggcgcgcgagggccggac

SEQ ID NO: 141164 - DNA, 20 bp, human
gacgcgcgctggggccaacg

SEQ ID NO: 141165 - DNA, 20 bp, human
ggacgcgcgacgggctacgc

SEQ ID NO: 141166 - DNA, 20 bp, human
gtcgaaatggctcctagagg

SEQ ID NO: 141167 - DNA, 20 bp, human
gagggtcgggtcccaaggta

SEQ ID NO: 141168 - DNA, 20 bp, human
gagggggcagggacagaccg

SEQ ID NO: 141169 - DNA, 20 bp, human
gacaggcaccgctaacccaa

SEQ ID NO: 141170 - DNA, 20 bp, human
gcccaaggtacggatcgaaa

SEQ ID NO: 141171 - DNA, 20 bp, human
gctgtgagagcgagtgggat

SEQ ID NO: 141172 - DNA, 20 bp, human
ggcaccgctaacccaagggt

SEQ ID NO: 141173 - DNA, 20 bp, human
gggatcgaaatggctcctag

SEQ ID NO: 141174 - DNA, 20 bp, human
gacccaagggtcgggtccca

SEQ ID NO: 141175 - DNA, 20 bp, human
gacaagcggcgagaaaatgg

SEQ ID NO: 141176 - DNA, 20 bp, human
gagccccggccggtccgagg

SEQ ID NO: 141177 - DNA, 20 bp, human
gctcccgggtgtgtcgagta

SEQ ID NO: 141178 - DNA, 20 bp, human
gagcagaggaaagcccggtc

SEQ ID NO: 141179 - DNA, 20 bp, human
gctctccttccacctcggac

SEQ ID NO: 141180 - DNA, 20 bp, human
gcggcagcagggcggttccg

SEQ ID NO: 141181 - DNA, 20 bp, human
gacgggctaaccgcgagcag

SEQ ID NO: 141182 - DNA, 20 bp, human
gccggccggtccgaggtgga

SEQ ID NO: 141183 - DNA, 20 bp, human
gcggagccccggccggtccg

SEQ ID NO: 141184 - DNA, 20 bp, human
gtctgagaggaagtgtcggg

SEQ ID NO: 141185 - DNA, 20 bp, human
gctctccgcgggacgcgtaa

SEQ ID NO: 141186 - DNA, 20 bp, human
ggagtgtccggccccaggta

SEQ ID NO: 141187 - DNA, 20 bp, human
gtggagggtgaaggcatctg

SEQ ID NO: 141188 - DNA, 20 bp, human
gctcgcgcggtccggcacag

SEQ ID NO: 141189 - DNA, 20 bp, human
gggctgtttggactccgtgg

SEQ ID NO: 141190 - DNA, 20 bp, human
ggagtccaaacagccttacc

SEQ ID NO: 141191 - DNA, 20 bp, human
gactccaaaatggcgtcagt

SEQ ID NO: 141192 - DNA, 20 bp, human
gtaaggctgtttggactccg

SEQ ID NO: 141193 - DNA, 20 bp, human
ggctcagatgaagctccagg

SEQ ID NO: 141194 - DNA, 20 bp, human
gcagcagccctcgcgcggtc

SEQ ID NO: 141195 - DNA, 20 bp, human
ggcgtcagttggtgagtgtc

SEQ ID NO: 141196 - DNA, 20 bp, human
ggctcctgcgaggatcacac

SEQ ID NO: 141197 - DNA, 20 bp, human
gaagagactggttcgccgcg

SEQ ID NO: 141198 - DNA, 20 bp, human
gaccgggcagggctccccgt

SEQ ID NO: 141199 - DNA, 20 bp, human
gggcgcagtgcactccgacg

SEQ ID NO: 141200 - DNA, 20 bp, human
gcgggtgggcctctgaggag

SEQ ID NO: 141201 - DNA, 20 bp, human
gggcgaaccagtctcttcct

SEQ ID NO: 141202 - DNA, 20 bp, human
gttggggagagggggacccg

SEQ ID NO: 141203 - DNA, 20 bp, human
ggagacccgcccctcctcag

SEQ ID NO: 141204 - DNA, 20 bp, human
ggaggctgcagaagtccgtg

SEQ ID NO: 141205 - DNA, 20 bp, human
gttggcctgagggtccgggt

SEQ ID NO: 141206 - DNA, 20 bp, human
ggtcgtcgagagcgacaaaa

SEQ ID NO: 141207 - DNA, 20 bp, human
ggatacctccgagagggcag

SEQ ID NO: 141208 - DNA, 20 bp, human
gccggttccagtagttggta

SEQ ID NO: 141209 - DNA, 20 bp, human
gctcggaccataccaactac

SEQ ID NO: 141210 - DNA, 20 bp, human
gtcgccccggttccagtagt

SEQ ID NO: 141211 - DNA, 20 bp, human
gaaagtcacccaaggcggga

SEQ ID NO: 141212 - DNA, 20 bp, human
ggcacccacgtgcaactaga

SEQ ID NO: 141213 - DNA, 20 bp, human
ggccgcggatacctccgaga

SEQ ID NO: 141214 - DNA, 20 bp, human
gccaggccagtgagtgactt

SEQ ID NO: 141215 - DNA, 20 bp, human
gcagctcctaagtcactcac

SEQ ID NO: 141216 - DNA, 20 bp, human
gccagccgctgacgggtcgg

SEQ ID NO: 141217 - DNA, 20 bp, human
gccgcccgccgacccgtcag

SEQ ID NO: 141218 - DNA, 20 bp, human
gtggccagccgctgacgggt

SEQ ID NO: 141219 - DNA, 20 bp, human
gtctgcagagaaatcaaaga

SEQ ID NO: 141220 - DNA, 20 bp, human
gcttaagaccaggtacgcgg

SEQ ID NO: 141221 - DNA, 20 bp, human
gctggccaagcctgctgcgg

SEQ ID NO: 141222 - DNA, 20 bp, human
gggcttggccagccgctgac

SEQ ID NO: 141223 - DNA, 20 bp, human
gattgggttaaaatgagtaa

SEQ ID NO: 141224 - DNA, 20 bp, human
ggtatccgcgaagaagaccg

SEQ ID NO: 141225 - DNA, 20 bp, human
gaagggcacgcgaccgttaa

SEQ ID NO: 141226 - DNA, 20 bp, human
gcagccgagtgcaaagggaa

SEQ ID NO: 141227 - DNA, 20 bp, human
gagccaggcccgcccgacaa

SEQ ID NO: 141228 - DNA, 20 bp, human
gccctggggacgaagcagaa

SEQ ID NO: 141229 - DNA, 20 bp, human
gaccaacgtggaggagctgt

SEQ ID NO: 141230 - DNA, 20 bp, human
gcggccagtagccttcccct

SEQ ID NO: 141231 - DNA, 20 bp, human
ggcgccggccgaggtgtggt

SEQ ID NO: 141232 - DNA, 20 bp, human
ggaaggcgagcacccagacg

SEQ ID NO: 141233 - DNA, 20 bp, human
gcgaggctcgctgaaatgtg

SEQ ID NO: 141234 - DNA, 20 bp, human
gagaggaagccgaggtagag

SEQ ID NO: 141235 - DNA, 20 bp, human
ggctctctcccaccacacct

SEQ ID NO: 141236 - DNA, 20 bp, human
gcgcacagcagggctcgagg

SEQ ID NO: 141237 - DNA, 20 bp, human
gtggcccgagacgcacagca

SEQ ID NO: 141238 - DNA, 20 bp, human
gcagcaccccaggtgagtag

SEQ ID NO: 141239 - DNA, 20 bp, human
gccagcggtaccgggagacc

SEQ ID NO: 141240 - DNA, 20 bp, human
ggacatcacaaaccttgcag

SEQ ID NO: 141241 - DNA, 20 bp, human
gagacgcacagcagggctcg

SEQ ID NO: 141242 - DNA, 20 bp, human
gctgggggtgtgtaactcgg

SEQ ID NO: 141243 - DNA, 20 bp, human
gctccccctctactcacctg

SEQ ID NO: 141244 - DNA, 20 bp, human
gcccgcgtagggattcagtg

SEQ ID NO: 141245 - DNA, 20 bp, human
gggcaactgcagtccccggg

SEQ ID NO: 141246 - DNA, 20 bp, human
ggcgggcgcgcagagtctcc

SEQ ID NO: 141247 - DNA, 20 bp, human
gcccaaggccaacgacgggg

SEQ ID NO: 141248 - DNA, 20 bp, human
ggcgcccgcccaggaacacg

SEQ ID NO: 141249 - DNA, 20 bp, human
gcgctcggcgcgggttcggg

SEQ ID NO: 141250 - DNA, 20 bp, human
gacccccaaggccaacgacg

SEQ ID NO: 141251 - DNA, 20 bp, human
gcgccgaggcgaagaagaca

SEQ ID NO: 141252 - DNA, 20 bp, human
gccgcccaggaacacgagga

SEQ ID NO: 141253 - DNA, 20 bp, human
gacgcggtagggcggagtgg

SEQ ID NO: 141254 - DNA, 20 bp, human
ggcagcatcctagagcagag

SEQ ID NO: 141255 - DNA, 20 bp, human
gcagaggccgccaagctggg

SEQ ID NO: 141256 - DNA, 20 bp, human
gccccgggaaagacggtcag

SEQ ID NO: 141257 - DNA, 20 bp, human
gtccagggcaagcagaccgc

SEQ ID NO: 141258 - DNA, 20 bp, human
ggctggggcccggtcgtaga

SEQ ID NO: 141259 - DNA, 20 bp, human
gggagcccggacccaaacaa

SEQ ID NO: 141260 - DNA, 20 bp, human
ggggctccccctccgctcca

SEQ ID NO: 141261 - DNA, 20 bp, human
gcgggaaagacggtcagggg

SEQ ID NO: 141262 - DNA, 20 bp, human
gggtcgtagagggcaagctt

SEQ ID NO: 141263 - DNA, 20 bp, human
gtgcttgccctggagcggag

SEQ ID NO: 141264 - DNA, 20 bp, human
gagcttctcggagccgcagg

SEQ ID NO: 141265 - DNA, 20 bp, human
gctcctcgcggaagtcgcag

SEQ ID NO: 141266 - DNA, 20 bp, human
gtcacaccgactgcctagag

SEQ ID NO: 141267 - DNA, 20 bp, human
gcacggccatctgcaggcac

SEQ ID NO: 141268 - DNA, 20 bp, human
gtaggcagtcggtgtgacag

SEQ ID NO: 141269 - DNA, 20 bp, human
gtgggcttgggctccaccca

SEQ ID NO: 141270 - DNA, 20 bp, human
ggtggggccaggaaaccgtc

SEQ ID NO: 141271 - DNA, 20 bp, human
ggccaggagagcgttgggtg

SEQ ID NO: 141272 - DNA, 20 bp, human
gggccaggaaaccgtctggt

SEQ ID NO: 141273 - DNA, 20 bp, human
gcagatggccgtgggttcgg

SEQ ID NO: 141274 - DNA, 20 bp, human
ggaggaagaatcaatgccgt

SEQ ID NO: 141275 - DNA, 20 bp, human
gtccgacgccaggggtcctg

SEQ ID NO: 141276 - DNA, 20 bp, human
gagcgcctgcgagctggatc

SEQ ID NO: 141277 - DNA, 20 bp, human
gcagcctgtggcagaacgac

SEQ ID NO: 141278 - DNA, 20 bp, human
gaaatgaaggtgaaccacaa

SEQ ID NO: 141279 - DNA, 20 bp, human
ggctgtggctgggagcgacc

SEQ ID NO: 141280 - DNA, 20 bp, human
gcacggtgaggaaaaagacc

SEQ ID NO: 141281 - DNA, 20 bp, human
gttcagtgctagaggatctc

SEQ ID NO: 141282 - DNA, 20 bp, human
gcgagccgtgctggaaatga

SEQ ID NO: 141283 - DNA, 20 bp, human
ggtcgccctcgggctggaag

SEQ ID NO: 141284 - DNA, 20 bp, human
gtccagctcgcaggcgctcc

SEQ ID NO: 141285 - DNA, 20 bp, human
gtccaccagatccagctcgc

SEQ ID NO: 141286 - DNA, 20 bp, human
gggtagggctggacacccaa

SEQ ID NO: 141287 - DNA, 20 bp, human
gtggacatccatagaaggtg

SEQ ID NO: 141288 - DNA, 20 bp, human
ggtgggccatggccggtaca

SEQ ID NO: 141289 - DNA, 20 bp, human
gccatggcccactcggaagg

SEQ ID NO: 141290 - DNA, 20 bp, human
gcggccatggcccactcgga

SEQ ID NO: 141291 - DNA, 20 bp, human
gctggatggacatccataga

SEQ ID NO: 141292 - DNA, 20 bp, human
gagaagtagcagccatgtac

SEQ ID NO: 141293 - DNA, 20 bp, human
ggggggctcacctgtgggta

SEQ ID NO: 141294 - DNA, 20 bp, human
ggggaggggaccctatatag

SEQ ID NO: 141295 - DNA, 20 bp, human
gtctggggaggggacctctg

SEQ ID NO: 141296 - DNA, 20 bp, human
gctggcgcccagcaaaggct

SEQ ID NO: 141297 - DNA, 20 bp, human
gcggacggcaaagccgggtc

SEQ ID NO: 141298 - DNA, 20 bp, human
gtccggctattagcctactg

SEQ ID NO: 141299 - DNA, 20 bp, human
gcgagaaggccgggaccccg

SEQ ID NO: 141300 - DNA, 20 bp, human
ggccacagtaggctaatagc

SEQ ID NO: 141301 - DNA, 20 bp, human
gctgtggctagtcacccccg

SEQ ID NO: 141302 - DNA, 20 bp, human
gggccggtagaagaagtcaa

SEQ ID NO: 141303 - DNA, 20 bp, human
gcgggtctggcgcccagcaa

SEQ ID NO: 141304 - DNA, 20 bp, human
gtagcgtactgtgagacacc

SEQ ID NO: 141305 - DNA, 20 bp, human
ggaaggggcactgaggggta

SEQ ID NO: 141306 - DNA, 20 bp, human
gacagtcctggactccaaga

SEQ ID NO: 141307 - DNA, 20 bp, human
gcgcggggccggccagtaaa

SEQ ID NO: 141308 - DNA, 20 bp, human
gggactccaagacggcgaga

SEQ ID NO: 141309 - DNA, 20 bp, human
ggccgaaacgccatgcggag

SEQ ID NO: 141310 - DNA, 20 bp, human
ggccggaacccccaggtcga

SEQ ID NO: 141311 - DNA, 20 bp, human
gcggcgtcgggagctcggtc

SEQ ID NO: 141312 - DNA, 20 bp, human
gcgcgaggagcgctgggaag

SEQ ID NO: 141313 - DNA, 20 bp, human
gtgtaggtgggggagaccct

SEQ ID NO: 141314 - DNA, 20 bp, human
gagtccgaggtctacgacga

SEQ ID NO: 141315 - DNA, 20 bp, human
ggtcttaggagagcagcgcg

SEQ ID NO: 141316 - DNA, 20 bp, human
gcatggctgcagcttccgag

SEQ ID NO: 141317 - DNA, 20 bp, human
gcgagggagatgagagacgg

SEQ ID NO: 141318 - DNA, 20 bp, human
ggcgctcagttctctcctct

SEQ ID NO: 141319 - DNA, 20 bp, human
ggttagaaaagacgaagagg

SEQ ID NO: 141320 - DNA, 20 bp, human
gcgcctgtgagcagccgcgg

SEQ ID NO: 141321 - DNA, 20 bp, human
gggcggcggctggcacatcc

SEQ ID NO: 141322 - DNA, 20 bp, human
gtaaaaccggcccgggtccc

SEQ ID NO: 141323 - DNA, 20 bp, human
gaggcgctgagaggggctcc

SEQ ID NO: 141324 - DNA, 20 bp, human
gtcccgctcctggagcgggg

SEQ ID NO: 141325 - DNA, 20 bp, human
gctgcggcaggatacgcgct

SEQ ID NO: 141326 - DNA, 20 bp, human
ggcgcgttgtacccgaggta

SEQ ID NO: 141327 - DNA, 20 bp, human
gctccaagaagccttacctc

SEQ ID NO: 141328 - DNA, 20 bp, human
gggcctgccggaagttccca

SEQ ID NO: 141329 - DNA, 20 bp, human
gaggcagcgcgttgtacccg

SEQ ID NO: 141330 - DNA, 20 bp, human
ggagcaggagccggaactgt

SEQ ID NO: 141331 - DNA, 20 bp, human
gcctactgggcccacagttc

SEQ ID NO: 141332 - DNA, 20 bp, human
gggcacaggggagactaaaa

SEQ ID NO: 141333 - DNA, 20 bp, human
gtccggcaggccaacttccc

SEQ ID NO: 141334 - DNA, 20 bp, human
gccctcaagcacttaaggag

SEQ ID NO: 141335 - DNA, 20 bp, human
ggggcccagtaggaagagtg

SEQ ID NO: 141336 - DNA, 20 bp, human
gcagcaggcacgccccgtcg

SEQ ID NO: 141337 - DNA, 20 bp, human
gagcggccgcgggcactcca

SEQ ID NO: 141338 - DNA, 20 bp, human
ggcctcggtgagccagacga

SEQ ID NO: 141339 - DNA, 20 bp, human
gggccgcgggcactccaggg

SEQ ID NO: 141340 - DNA, 20 bp, human
gtcggtgagccagacgacgg

SEQ ID NO: 141341 - DNA, 20 bp, human
ggagtactgctaccgcgacg

SEQ ID NO: 141342 - DNA, 20 bp, human
ggctcgcgctgcgctgggga

SEQ ID NO: 141343 - DNA, 20 bp, human
ggcagtactcgtggagctgg

SEQ ID NO: 141344 - DNA, 20 bp, human
ggtgagccagacgacggcgg

SEQ ID NO: 141345 - DNA, 20 bp, human
ggaggccccccgaggacggc

SEQ ID NO: 141346 - DNA, 20 bp, human
gccgggtgctaaggagcccc

SEQ ID NO: 141347 - DNA, 20 bp, human
gccgcgcgcggagctgccgg

SEQ ID NO: 141348 - DNA, 20 bp, human
ggagcagagggctggagtga

SEQ ID NO: 141349 - DNA, 20 bp, human
gagactccggttctgagcgt

SEQ ID NO: 141350 - DNA, 20 bp, human
gggagtgctggctctcccta

SEQ ID NO: 141351 - DNA, 20 bp, human
gcatggcgtgcgggagcaga

SEQ ID NO: 141352 - DNA, 20 bp, human
ggccaggagttgcagtgtcg

SEQ ID NO: 141353 - DNA, 20 bp, human
gggctgcctacgctcagaac

SEQ ID NO: 141354 - DNA, 20 bp, human
gtcttcagcaccggcctcct

SEQ ID NO: 141355 - DNA, 20 bp, human
gcgcaagcacccgcagactc

SEQ ID NO: 141356 - DNA, 20 bp, human
gctgacagcagctagacaag

SEQ ID NO: 141357 - DNA, 20 bp, human
ggagccaagcagctaaggtc

SEQ ID NO: 141358 - DNA, 20 bp, human
gcaggagctgactgcctcca

SEQ ID NO: 141359 - DNA, 20 bp, human
ggctgtgggagtccaagacc

SEQ ID NO: 141360 - DNA, 20 bp, human
gctccctctgtgcccaggta

SEQ ID NO: 141361 - DNA, 20 bp, human
gagcagctaaggtccggctt

SEQ ID NO: 141362 - DNA, 20 bp, human
gggacttggtgctcagagga

SEQ ID NO: 141363 - DNA, 20 bp, human
gctccttacctgggcacaga

SEQ ID NO: 141364 - DNA, 20 bp, human
ggggctgttaccagctagga

SEQ ID NO: 141365 - DNA, 20 bp, human
gtcttctgtgggtctagaga

SEQ ID NO: 141366 - DNA, 20 bp, human
gtgtctgcgtggcccatcag

SEQ ID NO: 141367 - DNA, 20 bp, human
gcagtggtgtgggagagcga

SEQ ID NO: 141368 - DNA, 20 bp, human
gcagacacgtccacccctgt

SEQ ID NO: 141369 - DNA, 20 bp, human
ggggggtcgcgtgcccacag

SEQ ID NO: 141370 - DNA, 20 bp, human
ggggcctggtgccagtggtg

SEQ ID NO: 141371 - DNA, 20 bp, human
ggcgtcccgtctcccctgat

SEQ ID NO: 141372 - DNA, 20 bp, human
ggcagcagagcgggtgtccg

SEQ ID NO: 141373 - DNA, 20 bp, human
gggacgtgtctggctggcgt

SEQ ID NO: 141374 - DNA, 20 bp, human
ggatgggccacgcagacacc

SEQ ID NO: 141375 - DNA, 20 bp, human
gaggtgtgcaggaggagcgg

SEQ ID NO: 141376 - DNA, 20 bp, human
gtcccggagccagctcgagt

SEQ ID NO: 141377 - DNA, 20 bp, human
gcccaccccatggatctccg

SEQ ID NO: 141378 - DNA, 20 bp, human
gcctgccgcggagatccatg

SEQ ID NO: 141379 - DNA, 20 bp, human
ggctgccccaccagcgtcag

SEQ ID NO: 141380 - DNA, 20 bp, human
gccaccagcgtcagaggcaa

SEQ ID NO: 141381 - DNA, 20 bp, human
gcggagccagctcgagttgg

SEQ ID NO: 141382 - DNA, 20 bp, human
gcaacgccgccttcttctcc

SEQ ID NO: 141383 - DNA, 20 bp, human
gtaggagccgagggaccccg

SEQ ID NO: 141384 - DNA, 20 bp, human
gtcgctcgccgcagttcctg

SEQ ID NO: 141385 - DNA, 20 bp, human
gtgcatgggtagtcacgccc

SEQ ID NO: 141386 - DNA, 20 bp, human
gagagaccgcagtggagcag

SEQ ID NO: 141387 - DNA, 20 bp, human
ggatgtggggtccccatcac

SEQ ID NO: 141388 - DNA, 20 bp, human
gggagcagaggcaggtccat

SEQ ID NO: 141389 - DNA, 20 bp, human
ggcggcttgccggagagcca

SEQ ID NO: 141390 - DNA, 20 bp, human
ggtggaaccgtgggcaccca

SEQ ID NO: 141391 - DNA, 20 bp, human
gaccgtgggcacccagggtg

SEQ ID NO: 141392 - DNA, 20 bp, human
gatggacagacggtaagaca

SEQ ID NO: 141393 - DNA, 20 bp, human
gaggagccgccccaggaaga

SEQ ID NO: 141394 - DNA, 20 bp, human
gggatatggagtggaaccgt

SEQ ID NO: 141395 - DNA, 20 bp, human
gcccttacccggcactgcct

SEQ ID NO: 141396 - DNA, 20 bp, human
ggcgcgcggcgggagaccca

SEQ ID NO: 141397 - DNA, 20 bp, human
gctcggctgctgcatccgag

SEQ ID NO: 141398 - DNA, 20 bp, human
gcagcacgtggaacaaggag

SEQ ID NO: 141399 - DNA, 20 bp, human
gcagtaccactgggctgatg

SEQ ID NO: 141400 - DNA, 20 bp, human
gcagctcggtcaccagcacg

SEQ ID NO: 141401 - DNA, 20 bp, human
gcggagacgacggctcccct

SEQ ID NO: 141402 - DNA, 20 bp, human
gccgctggcggggggacgtg

SEQ ID NO: 141403 - DNA, 20 bp, human
gtgcatccgagcggcgctcg

SEQ ID NO: 141404 - DNA, 20 bp, human
gggccgggagccagagccta

SEQ ID NO: 141405 - DNA, 20 bp, human
gacccgcgccggccaaggcc

SEQ ID NO: 141406 - DNA, 20 bp, human
gcggcggcgccagggctcac

SEQ ID NO: 141407 - DNA, 20 bp, human
gctctctgggaaacctctgg

SEQ ID NO: 141408 - DNA, 20 bp, human
gagggctcactggcccggga

SEQ ID NO: 141409 - DNA, 20 bp, human
ggcgctggcgatgaacaacg

SEQ ID NO: 141410 - DNA, 20 bp, human
gtgctgctcactggtttcgt

SEQ ID NO: 141411 - DNA, 20 bp, human
gtcccagcagcggagtaggg

SEQ ID NO: 141412 - DNA, 20 bp, human
gagaagctgcccgaccaggt

SEQ ID NO: 141413 - DNA, 20 bp, human
gggaaggcgtggctccctcc

SEQ ID NO: 141414 - DNA, 20 bp, human
gggcgctcaccgacctggtc

SEQ ID NO: 141415 - DNA, 20 bp, human
gcggtcccagcagcggagta

SEQ ID NO: 141416 - DNA, 20 bp, human
gccaagcccggcagcccgag

SEQ ID NO: 141417 - DNA, 20 bp, human
gtcggggtccactctgccag

SEQ ID NO: 141418 - DNA, 20 bp, human
gggcgggtccaggacatctg

SEQ ID NO: 141419 - DNA, 20 bp, human
gttccagactgagcaggaca

SEQ ID NO: 141420 - DNA, 20 bp, human
gggccgctcctggctacctg

SEQ ID NO: 141421 - DNA, 20 bp, human
gttctcaaagccggtctcag

SEQ ID NO: 141422 - DNA, 20 bp, human
gctgccagaggctctggcct

SEQ ID NO: 141423 - DNA, 20 bp, human
ggcagcctcacgagccccca

SEQ ID NO: 141424 - DNA, 20 bp, human
gggacaaggtgaaagcaggt

SEQ ID NO: 141425 - DNA, 20 bp, human
gtcccgcagacgagaccggc

SEQ ID NO: 141426 - DNA, 20 bp, human
gccgggagtggacatgatag

SEQ ID NO: 141427 - DNA, 20 bp, human
gaggcggacgaattgacccc

SEQ ID NO: 141428 - DNA, 20 bp, human
gcaatcgcttgtccacgtag

SEQ ID NO: 141429 - DNA, 20 bp, human
ggacgaattgaccccgggag

SEQ ID NO: 141430 - DNA, 20 bp, human
gagccggtcggggctcaagg

SEQ ID NO: 141431 - DNA, 20 bp, human
ggagtggacatgatagtggc

SEQ ID NO: 141432 - DNA, 20 bp, human
gacgtagtggctgtagaaat

SEQ ID NO: 141433 - DNA, 20 bp, human
gtggctgtcaccgacctgtt

SEQ ID NO: 141434 - DNA, 20 bp, human
gtgggctgttcagccggtcg

SEQ ID NO: 141435 - DNA, 20 bp, human
gcgcctccttgagccccgac

SEQ ID NO: 141436 - DNA, 20 bp, human
ggccagcgcagctcaactgt

SEQ ID NO: 141437 - DNA, 20 bp, human
gaagccaccaggttagacag

SEQ ID NO: 141438 - DNA, 20 bp, human
gggtgtgatcagctcgacag

SEQ ID NO: 141439 - DNA, 20 bp, human
gtgccaagaactcagcccgg

SEQ ID NO: 141440 - DNA, 20 bp, human
ggagatgcctgcccacagcc

SEQ ID NO: 141441 - DNA, 20 bp, human
ggctgctcatcaccaggctg

SEQ ID NO: 141442 - DNA, 20 bp, human
gtgagagaagcaggttctgg

SEQ ID NO: 141443 - DNA, 20 bp, human
gtgctgcagagcaggaaggc

SEQ ID NO: 141444 - DNA, 20 bp, human
gctgtgagagaagcaggttc

SEQ ID NO: 141445 - DNA, 20 bp, human
gtgcagggaaagcacaaagt

SEQ ID NO: 141446 - DNA, 20 bp, human
gggcggagcgaacatggacc

SEQ ID NO: 141447 - DNA, 20 bp, human
gaggccaaggcgcacccacc

SEQ ID NO: 141448 - DNA, 20 bp, human
ggccgtgtggtacagcccca

SEQ ID NO: 141449 - DNA, 20 bp, human
ggggcgcccgtaagagaggt

SEQ ID NO: 141450 - DNA, 20 bp, human
gcctgtactgactctaggaa

SEQ ID NO: 141451 - DNA, 20 bp, human
gggcgccggcggagcgaaca

SEQ ID NO: 141452 - DNA, 20 bp, human
gccgtggctgcagctcgtaa

SEQ ID NO: 141453 - DNA, 20 bp, human
ggccctggggctgtaccaca

SEQ ID NO: 141454 - DNA, 20 bp, human
gccggctgcgcgggtggtgc

SEQ ID NO: 141455 - DNA, 20 bp, human
gaccttgaccgcctaaaggg

SEQ ID NO: 141456 - DNA, 20 bp, human
ggtgcaaacgaggggtggtg

SEQ ID NO: 141457 - DNA, 20 bp, human
gggagtcgacttctctccgg

SEQ ID NO: 141458 - DNA, 20 bp, human
ggtgcgtgcgtgcaaacgag

SEQ ID NO: 141459 - DNA, 20 bp, human
gcgtgcgtgcaaacgagggg

SEQ ID NO: 141460 - DNA, 20 bp, human
gaggaaaaggggcgcgagga

SEQ ID NO: 141461 - DNA, 20 bp, human
gcgatgcgagaaaggctagg

SEQ ID NO: 141462 - DNA, 20 bp, human
gcgcgaccggagagaaaaag

SEQ ID NO: 141463 - DNA, 20 bp, human
gaggtccaggatccttgttc

SEQ ID NO: 141464 - DNA, 20 bp, human
gcaaggaacggttcaggggt

SEQ ID NO: 141465 - DNA, 20 bp, human
gcagcggcgggctcgacctc

SEQ ID NO: 141466 - DNA, 20 bp, human
gctcccgaccatataaggag

SEQ ID NO: 141467 - DNA, 20 bp, human
gccgagggcgcgccttcccc

SEQ ID NO: 141468 - DNA, 20 bp, human
gccccaggatctaaagatag

SEQ ID NO: 141469 - DNA, 20 bp, human
gcattgcggctcccgctcca

SEQ ID NO: 141470 - DNA, 20 bp, human
gagcgggagccgcaatggca

SEQ ID NO: 141471 - DNA, 20 bp, human
gcatttagagttccaggcag

SEQ ID NO: 141472 - DNA, 20 bp, human
gtccctgtgtgtagcgtcta

SEQ ID NO: 141473 - DNA, 20 bp, human
gccacagttacagagaccag

SEQ ID NO: 141474 - DNA, 20 bp, human
gtccagggaaaagggccagg

SEQ ID NO: 141475 - DNA, 20 bp, human
gtctaaatgccaccctggag

SEQ ID NO: 141476 - DNA, 20 bp, human
gcattgcggctcccgctcca

SEQ ID NO: 141477 - DNA, 20 bp, human
gagcgggagccgcaatggca

SEQ ID NO: 141478 - DNA, 20 bp, human
gttgaggtgtggcttcatag

SEQ ID NO: 141479 - DNA, 20 bp, human
gggtgtggcttcataggggt

SEQ ID NO: 141480 - DNA, 20 bp, human
gccccaggatctaaagatag

SEQ ID NO: 141481 - DNA, 20 bp, human
gctgaagagaagttgaggtg

SEQ ID NO: 141482 - DNA, 20 bp, human
gtctaaatgccaccctggag

SEQ ID NO: 141483 - DNA, 20 bp, human
gtccagggaaaagggccagg

SEQ ID NO: 141484 - DNA, 20 bp, human
gctgtcgtaccacaaggtcc

SEQ ID NO: 141485 - DNA, 20 bp, human
gcatttagagttccaggcag

SEQ ID NO: 141486 - DNA, 20 bp, human
gttccccgggaatttaattc

SEQ ID NO: 141487 - DNA, 20 bp, human
gctcccgaccatataaggag

SEQ ID NO: 141488 - DNA, 20 bp, human
gccgagggcgcgccttcccc

SEQ ID NO: 141489 - DNA, 20 bp, human
gccccaggatctaaagatag

SEQ ID NO: 141490 - DNA, 20 bp, human
gcattgcggctcccgctcca

SEQ ID NO: 141491 - DNA, 20 bp, human
gagcgggagccgcaatggca

SEQ ID NO: 141492 - DNA, 20 bp, human
gcatttagagttccaggcag

SEQ ID NO: 141493 - DNA, 20 bp, human
gtccctgtgtgtagcgtcta

SEQ ID NO: 141494 - DNA, 20 bp, human
gccacagttacagagaccag

SEQ ID NO: 141495 - DNA, 20 bp, human
gtccagggaaaagggccagg

SEQ ID NO: 141496 - DNA, 20 bp, human
gccgcagagcagctcagaat

SEQ ID NO: 141497 - DNA, 20 bp, human
gcccgcagggaaccccgcaa

SEQ ID NO: 141498 - DNA, 20 bp, human
gagtgcgcggaggggacgag

SEQ ID NO: 141499 - DNA, 20 bp, human
gcccttagcgcggaaactgc

SEQ ID NO: 141500 - DNA, 20 bp, human
gcagcgcagctaggtgcaga

SEQ ID NO: 141501 - DNA, 20 bp, human
gcagcgcggagatcctgatc

SEQ ID NO: 141502 - DNA, 20 bp, human
gctggcggcctgggatgaca

SEQ ID NO: 141503 - DNA, 20 bp, human
gggcgccatggcacaccgag

SEQ ID NO: 141504 - DNA, 20 bp, human
gctggcagcctgggagggat

SEQ ID NO: 141505 - DNA, 20 bp, human
ggaccagattccccaagcta

SEQ ID NO: 141506 - DNA, 20 bp, human
gcacactgcctagaagaagt

SEQ ID NO: 141507 - DNA, 20 bp, human
gcagacatctgtaggataaa

SEQ ID NO: 141508 - DNA, 20 bp, human
ggtctgtgcccacttcttct

SEQ ID NO: 141509 - DNA, 20 bp, human
gttgcagtccagacatctgt

SEQ ID NO: 141510 - DNA, 20 bp, human
gagatttagacagaagtcca

SEQ ID NO: 141511 - DNA, 20 bp, human
ggccatcgccattctcatga

SEQ ID NO: 141512 - DNA, 20 bp, human
ggggagatgacttgagtggt

SEQ ID NO: 141513 - DNA, 20 bp, human
gactgcaaaggacatttgat

SEQ ID NO: 141514 - DNA, 20 bp, human
gaacctgccagacggaaaac

SEQ ID NO: 141515 - DNA, 20 bp, human
ggccttcatgagaatggcga

SEQ ID NO: 141516 - DNA, 20 bp, human
gcggggctgcacactcggat

SEQ ID NO: 141517 - DNA, 20 bp, human
gctcccggcggccaacaggt

SEQ ID NO: 141518 - DNA, 20 bp, human
gccgcttcccgaaagcagaa

SEQ ID NO: 141519 - DNA, 20 bp, human
gggctgcacactcggatcgg

SEQ ID NO: 141520 - DNA, 20 bp, human
gtggcaaagcgccggatggg

SEQ ID NO: 141521 - DNA, 20 bp, human
gtgctttcgggaagcggtcg

SEQ ID NO: 141522 - DNA, 20 bp, human
ggctccggctgctccagagt

SEQ ID NO: 141523 - DNA, 20 bp, human
gggcccggccggctggagga

SEQ ID NO: 141524 - DNA, 20 bp, human
ggccaacaggtagggagacc

SEQ ID NO: 141525 - DNA, 20 bp, human
gggtttcccgggagcagccc

SEQ ID NO: 141526 - DNA, 20 bp, human
gcgaggagcaaagcaagtga

SEQ ID NO: 141527 - DNA, 20 bp, human
gacaggcagcgagagacacg

SEQ ID NO: 141528 - DNA, 20 bp, human
gagtgaaggcacagacgcac

SEQ ID NO: 141529 - DNA, 20 bp, human
gagcctgggcaagactggag

SEQ ID NO: 141530 - DNA, 20 bp, human
gaggcacagacgcacgggac

SEQ ID NO: 141531 - DNA, 20 bp, human
gtgtctctcgctgcctgtgt

SEQ ID NO: 141532 - DNA, 20 bp, human
gagcaagagaccgagagaca

SEQ ID NO: 141533 - DNA, 20 bp, human
gactggagaggtgcggtgag

SEQ ID NO: 141534 - DNA, 20 bp, human
ggttagagggagaaaggtac

SEQ ID NO: 141535 - DNA, 20 bp, human
ggggaggacaaggacaaggg

SEQ ID NO: 141536 - DNA, 20 bp, human
ggacggcagggacctaggag

SEQ ID NO: 141537 - DNA, 20 bp, human
gggcaaggcgagaccctcgg

SEQ ID NO: 141538 - DNA, 20 bp, human
gttccacccgggccacgcag

SEQ ID NO: 141539 - DNA, 20 bp, human
gggacactcaccgcgtgcgg

SEQ ID NO: 141540 - DNA, 20 bp, human
gagcgcgacggcagggacct

SEQ ID NO: 141541 - DNA, 20 bp, human
gcggccccgccagacaaagg

SEQ ID NO: 141542 - DNA, 20 bp, human
gagtctggcccttagcgcga

SEQ ID NO: 141543 - DNA, 20 bp, human
ggtgaggaccgagggtttgt

SEQ ID NO: 141544 - DNA, 20 bp, human
ggcaggacactcaccgcgtg

SEQ ID NO: 141545 - DNA, 20 bp, human
ggccagccccgcgatggctt

SEQ ID NO: 141546 - DNA, 20 bp, human
gcccaggcagtggaaccttc

SEQ ID NO: 141547 - DNA, 20 bp, human
ggctctccaaggaactgcgg

SEQ ID NO: 141548 - DNA, 20 bp, human
gggtagaagaagaaagatcg

SEQ ID NO: 141549 - DNA, 20 bp, human
gagtcccagccgccttcccc

SEQ ID NO: 141550 - DNA, 20 bp, human
gcgcggctccaagctctcca

SEQ ID NO: 141551 - DNA, 20 bp, human
ggtgggagcaaagggcgagc

SEQ ID NO: 141552 - DNA, 20 bp, human
gtcgggaatgggcaagcggg

SEQ ID NO: 141553 - DNA, 20 bp, human
gccaggccccctcctcgggc

SEQ ID NO: 141554 - DNA, 20 bp, human
gccgggtgcaggaagctacc

SEQ ID NO: 141555 - DNA, 20 bp, human
gtctacttacaggagcccga

SEQ ID NO: 141556 - DNA, 20 bp, human
gaagctgcttcgggccccag

SEQ ID NO: 141557 - DNA, 20 bp, human
ggcttcgggagccacagtcg

SEQ ID NO: 141558 - DNA, 20 bp, human
gcgagcggctcccgcgactg

SEQ ID NO: 141559 - DNA, 20 bp, human
gcgttcacccgggctccaca

SEQ ID NO: 141560 - DNA, 20 bp, human
ggcttcgggccccagcggtg

SEQ ID NO: 141561 - DNA, 20 bp, human
gggacgcctagaagtcaccc

SEQ ID NO: 141562 - DNA, 20 bp, human
gagggtcagtgacgcgcgag

SEQ ID NO: 141563 - DNA, 20 bp, human
gtgtccccggtagctccggg

SEQ ID NO: 141564 - DNA, 20 bp, human
gtaccatgcgccgggcatag

SEQ ID NO: 141565 - DNA, 20 bp, human
gtggctcccgaagctgcttc

SEQ ID NO: 141566 - DNA, 20 bp, human
ggcggtgctgagaaagactg

SEQ ID NO: 141567 - DNA, 20 bp, human
gggcaccggggtcgcactca

SEQ ID NO: 141568 - DNA, 20 bp, human
gggtgcgggacgcagagtgc

SEQ ID NO: 141569 - DNA, 20 bp, human
gcaggtgagggggatggata

SEQ ID NO: 141570 - DNA, 20 bp, human
ggtcctgctcgcggacccag

SEQ ID NO: 141571 - DNA, 20 bp, human
ggcgaccccggtgcccggtg

SEQ ID NO: 141572 - DNA, 20 bp, human
gaattccccaccgggcaccg

SEQ ID NO: 141573 - DNA, 20 bp, human
gcggccccatccctccccaa

SEQ ID NO: 141574 - DNA, 20 bp, human
ggtgtgcgaggcgcacgcac

SEQ ID NO: 141575 - DNA, 20 bp, human
gggccaggggcgcaagaccg

SEQ ID NO: 141576 - DNA, 20 bp, human
ggagcgtcaggagcacgtcc

SEQ ID NO: 141577 - DNA, 20 bp, human
gcgtctggctgtggagctga

SEQ ID NO: 141578 - DNA, 20 bp, human
gggcgctgctgaggagttcc

SEQ ID NO: 141579 - DNA, 20 bp, human
gggtaggctttgctgtctga

SEQ ID NO: 141580 - DNA, 20 bp, human
gggagtactgggatagaccc

SEQ ID NO: 141581 - DNA, 20 bp, human
gaggtgagagtgtctcagat

SEQ ID NO: 141582 - DNA, 20 bp, human
ggcgcgggcgagcatcgcag

SEQ ID NO: 141583 - DNA, 20 bp, human
gtgcgtggaaccggagtccc

SEQ ID NO: 141584 - DNA, 20 bp, human
gactccggttccacgcaccc

SEQ ID NO: 141585 - DNA, 20 bp, human
gggagagaagtcggagtact

SEQ ID NO: 141586 - DNA, 20 bp, human
gctcctaatgaggcaaccaa

SEQ ID NO: 141587 - DNA, 20 bp, human
ggtacccggacaggattcta

SEQ ID NO: 141588 - DNA, 20 bp, human
gtccagccccactcctaatg

SEQ ID NO: 141589 - DNA, 20 bp, human
gagtgcgattgtacccggac

SEQ ID NO: 141590 - DNA, 20 bp, human
ggtgagcagactgtataaac

SEQ ID NO: 141591 - DNA, 20 bp, human
ggtataagtgcgattgtacc

SEQ ID NO: 141592 - DNA, 20 bp, human
ggcagactgtataaactgga

SEQ ID NO: 141593 - DNA, 20 bp, human
gggttgcctcattaggagtg

SEQ ID NO: 141594 - DNA, 20 bp, human
gcaagaagacgaagaaaggg

SEQ ID NO: 141595 - DNA, 20 bp, human
gacatacttacccacttcaa

SEQ ID NO: 141596 - DNA, 20 bp, human
gggactgcagaccccttaaa

SEQ ID NO: 141597 - DNA, 20 bp, human
ggtcttctgcttaccaagag

SEQ ID NO: 141598 - DNA, 20 bp, human
gtgctttaatataatagtat

SEQ ID NO: 141599 - DNA, 20 bp, human
gttgaaataaaacaggttga

SEQ ID NO: 141600 - DNA, 20 bp, human
gctagataagaatactctgc

SEQ ID NO: 141601 - DNA, 20 bp, human
gctaaagacaactgatgaat

SEQ ID NO: 141602 - DNA, 20 bp, human
gtttcagatgaggttttaaa

SEQ ID NO: 141603 - DNA, 20 bp, human
gtttgttgtaatttcagatg

SEQ ID NO: 141604 - DNA, 20 bp, human
gataccatgttgtttcttca

SEQ ID NO: 141605 - DNA, 20 bp, human
gaatggtgacttttatatat

SEQ ID NO: 141606 - DNA, 20 bp, human
ggagcgagcgagcagcgcaa

SEQ ID NO: 141607 - DNA, 20 bp, human
gggtccgcgggataggtcta

SEQ ID NO: 141608 - DNA, 20 bp, human
ggagcgagcagcgcaaagga

SEQ ID NO: 141609 - DNA, 20 bp, human
gacctatcccgcggacccta

SEQ ID NO: 141610 - DNA, 20 bp, human
gaggctgcgggcttacccta

SEQ ID NO: 141611 - DNA, 20 bp, human
gcgagcagcgcaaaggaggg

SEQ ID NO: 141612 - DNA, 20 bp, human
ggtgccttagacctatcccg

SEQ ID NO: 141613 - DNA, 20 bp, human
ggcagcctgtcccggagtgt

SEQ ID NO: 141614 - DNA, 20 bp, human
gaccctagggtccgcgggat

SEQ ID NO: 141615 - DNA, 20 bp, human
ggtaagcccgcagcctgtcc

SEQ ID NO: 141616 - DNA, 20 bp, human
gctgcggaggcgatataagg

SEQ ID NO: 141617 - DNA, 20 bp, human
ggggctgcggaggcgatata

SEQ ID NO: 141618 - DNA, 20 bp, human
gcccagcccactgcacggta

SEQ ID NO: 141619 - DNA, 20 bp, human
gcctgtggagaaccagaaag

SEQ ID NO: 141620 - DNA, 20 bp, human
ggaagctggacctgagacga

SEQ ID NO: 141621 - DNA, 20 bp, human
gtacctgaggaccccgaccg

SEQ ID NO: 141622 - DNA, 20 bp, human
gcagcagcagccgaacccga

SEQ ID NO: 141623 - DNA, 20 bp, human
gagcggtaatgaggagccgg

SEQ ID NO: 141624 - DNA, 20 bp, human
ggccagtcccagaactccca

SEQ ID NO: 141625 - DNA, 20 bp, human
gaggcagtgcggacgcccca

SEQ ID NO: 141626 - DNA, 20 bp, human
gccgcggcgcagcagcacgc

SEQ ID NO: 141627 - DNA, 20 bp, human
gggtgctggcaggcaattag

SEQ ID NO: 141628 - DNA, 20 bp, human
gagcccggccatgcccggaa

SEQ ID NO: 141629 - DNA, 20 bp, human
gctggcaggcaattagtgga

SEQ ID NO: 141630 - DNA, 20 bp, human
gaggcgtacccggcaggtgc

SEQ ID NO: 141631 - DNA, 20 bp, human
ggcacgcaccgaggcgtacc

SEQ ID NO: 141632 - DNA, 20 bp, human
gcgagtcaagtccaggactc

SEQ ID NO: 141633 - DNA, 20 bp, human
gcaagaccaacctcgcgccg

SEQ ID NO: 141634 - DNA, 20 bp, human
ggcgggttctgagaagcgcg

SEQ ID NO: 141635 - DNA, 20 bp, human
gccaccggccgagggtgctt

SEQ ID NO: 141636 - DNA, 20 bp, human
gaaacagggcagcttggaag

SEQ ID NO: 141637 - DNA, 20 bp, human
gctacggaaagtaataaaca

SEQ ID NO: 141638 - DNA, 20 bp, human
gagacttctgttcccactaa

SEQ ID NO: 141639 - DNA, 20 bp, human
gtctaataattgcctttagt

SEQ ID NO: 141640 - DNA, 20 bp, human
gaacattataaattaaggac

SEQ ID NO: 141641 - DNA, 20 bp, human
ggagagaagattgtaaatca

SEQ ID NO: 141642 - DNA, 20 bp, human
gggtgaagtaataaattagg

SEQ ID NO: 141643 - DNA, 20 bp, human
gctgctcttctggctgaaag

SEQ ID NO: 141644 - DNA, 20 bp, human
gcacacttttctggtgttaa

SEQ ID NO: 141645 - DNA, 20 bp, human
gttttccccacacacttttc

SEQ ID NO: 141646 - DNA, 20 bp, human
gctcgggacctgcaacagaa

SEQ ID NO: 141647 - DNA, 20 bp, human
ggagagtccagactgacact

SEQ ID NO: 141648 - DNA, 20 bp, human
ggcgagcggagacgatgcag

SEQ ID NO: 141649 - DNA, 20 bp, human
gaagtggctctggaacgaaa

SEQ ID NO: 141650 - DNA, 20 bp, human
gtgggacccgagtgtcagtc

SEQ ID NO: 141651 - DNA, 20 bp, human
ggcggagactggttcagcag

SEQ ID NO: 141652 - DNA, 20 bp, human
gtgagagcgggctaaaaagg

SEQ ID NO: 141653 - DNA, 20 bp, human
gaaagcctcttcaacatcaa

SEQ ID NO: 141654 - DNA, 20 bp, human
gctcctgggttcgtggaaca

SEQ ID NO: 141655 - DNA, 20 bp, human
ggctctggaacgaaagggcc

SEQ ID NO: 141656 - DNA, 20 bp, human
gcacagtggtccgggaccgg

SEQ ID NO: 141657 - DNA, 20 bp, human
ggctcacagtggtccgggac

SEQ ID NO: 141658 - DNA, 20 bp, human
ggcgaaggcagacgacgacg

SEQ ID NO: 141659 - DNA, 20 bp, human
gccgcgggctcacagtggtc

SEQ ID NO: 141660 - DNA, 20 bp, human
gcgacgcagcacggcctcga

SEQ ID NO: 141661 - DNA, 20 bp, human
gagcccgcggcgtgaggcgt

SEQ ID NO: 141662 - DNA, 20 bp, human
ggcccgggttctgggaggag

SEQ ID NO: 141663 - DNA, 20 bp, human
ggggaggcttggggaagact

SEQ ID NO: 141664 - DNA, 20 bp, human
gtgaggcgtgggaggaagcg

SEQ ID NO: 141665 - DNA, 20 bp, human
gtgggccgcggccctgaggg

SEQ ID NO: 141666 - DNA, 20 bp, human
gcgggcaggtaggtgtgcaa

SEQ ID NO: 141667 - DNA, 20 bp, human
gaggctgtggctgagtaaaa

SEQ ID NO: 141668 - DNA, 20 bp, human
gaggtgtgcaacggctccgg

SEQ ID NO: 141669 - DNA, 20 bp, human
gccgggacggcggcaagtac

SEQ ID NO: 141670 - DNA, 20 bp, human
gggtaggtgtgcaacggctc

SEQ ID NO: 141671 - DNA, 20 bp, human
ggcggcaagtacaggtaagt

SEQ ID NO: 141672 - DNA, 20 bp, human
ggctaggggtgacggtgtga

SEQ ID NO: 141673 - DNA, 20 bp, human
gactccagcgactactcctc

SEQ ID NO: 141674 - DNA, 20 bp, human
gggcaggagctgaaaccccg

SEQ ID NO: 141675 - DNA, 20 bp, human
ggctgagtaaaagggctgac

SEQ ID NO: 141676 - DNA, 20 bp, human
ggcctggtcccgggacacca

SEQ ID NO: 141677 - DNA, 20 bp, human
gggtcccgggacaccatggc

SEQ ID NO: 141678 - DNA, 20 bp, human
gcccagaggcccacatactt

SEQ ID NO: 141679 - DNA, 20 bp, human
gacctgggccccaagtatgt

SEQ ID NO: 141680 - DNA, 20 bp, human
gctggccgagagggagacgg

SEQ ID NO: 141681 - DNA, 20 bp, human
gcagggaggcccaagaaggt

SEQ ID NO: 141682 - DNA, 20 bp, human
gccgggacttgaagtcccag

SEQ ID NO: 141683 - DNA, 20 bp, human
gactcccgcagggacagtcc

SEQ ID NO: 141684 - DNA, 20 bp, human
gccgctgcgcccgcccgcca

SEQ ID NO: 141685 - DNA, 20 bp, human
gtctcggccaggtagttgtg

SEQ ID NO: 141686 - DNA, 20 bp, human
ggtgcaggcttgcggcggaa

SEQ ID NO: 141687 - DNA, 20 bp, human
gtggaacggccctggagtag

SEQ ID NO: 141688 - DNA, 20 bp, human
gcggccctggagtagtggag

SEQ ID NO: 141689 - DNA, 20 bp, human
gtagtggagaggctcgctgg

SEQ ID NO: 141690 - DNA, 20 bp, human
gaccctgaccgcgtccctgg

SEQ ID NO: 141691 - DNA, 20 bp, human
gcagccggagcccgaccccg

SEQ ID NO: 141692 - DNA, 20 bp, human
ggcggggactcggaggtact

SEQ ID NO: 141693 - DNA, 20 bp, human
gccgaccccgaggcgtcccg

SEQ ID NO: 141694 - DNA, 20 bp, human
ggtgagtacccgagagttgg

SEQ ID NO: 141695 - DNA, 20 bp, human
gtggctctcgggcccagatg

SEQ ID NO: 141696 - DNA, 20 bp, human
gcgccgcgtgagtcccccac

SEQ ID NO: 141697 - DNA, 20 bp, human
ggcagacgtgatgcccgtcg

SEQ ID NO: 141698 - DNA, 20 bp, human
gcccgcaccacacaaagagt

SEQ ID NO: 141699 - DNA, 20 bp, human
gcgtctgtggccggtatgag

SEQ ID NO: 141700 - DNA, 20 bp, human
ggcatcacgtctgcccgcgg

SEQ ID NO: 141701 - DNA, 20 bp, human
gagccagtgggggactcacg

SEQ ID NO: 141702 - DNA, 20 bp, human
gggccctcgaaactcgtctg

SEQ ID NO: 141703 - DNA, 20 bp, human
gggccacagacgagtttcga

SEQ ID NO: 141704 - DNA, 20 bp, human
ggcgccaaacaccgcccgag

SEQ ID NO: 141705 - DNA, 20 bp, human
gggcggcgcgcggaccccga

SEQ ID NO: 141706 - DNA, 20 bp, human
ggagttgagcgccaaggtac

SEQ ID NO: 141707 - DNA, 20 bp, human
ggccgcggtagctcgatccc

SEQ ID NO: 141708 - DNA, 20 bp, human
gaagcgggttcccttcccgg

SEQ ID NO: 141709 - DNA, 20 bp, human
gatgtcggagaaaagcgtgg

SEQ ID NO: 141710 - DNA, 20 bp, human
gggcagctctgctggtgcgg

SEQ ID NO: 141711 - DNA, 20 bp, human
gccagggctgcgcgaggtcc

SEQ ID NO: 141712 - DNA, 20 bp, human
gttgagcgccaaggtacggg

SEQ ID NO: 141713 - DNA, 20 bp, human
ggcccgggatcgagctaccg

SEQ ID NO: 141714 - DNA, 20 bp, human
gggatccggtcagcgaggtg

SEQ ID NO: 141715 - DNA, 20 bp, human
ggagacggaggggccctgga

SEQ ID NO: 141716 - DNA, 20 bp, human
gggttgctaccgctgagtcc

SEQ ID NO: 141717 - DNA, 20 bp, human
gggtaggtgcaaagaaagta

SEQ ID NO: 141718 - DNA, 20 bp, human
gaccagctggagagcaagac

SEQ ID NO: 141719 - DNA, 20 bp, human
gaccgctgagtccaggtacc

SEQ ID NO: 141720 - DNA, 20 bp, human
gggcagactgagcgccagag

SEQ ID NO: 141721 - DNA, 20 bp, human
gacctcgccccttgcaacaa

SEQ ID NO: 141722 - DNA, 20 bp, human
ggagtcatccgtccagaagg

SEQ ID NO: 141723 - DNA, 20 bp, human
gccagctggtagctggaaca

SEQ ID NO: 141724 - DNA, 20 bp, human
gagtaggtgtgtctctggct

SEQ ID NO: 141725 - DNA, 20 bp, human
gctgcagcgagccgggtacc

SEQ ID NO: 141726 - DNA, 20 bp, human
gggccgcggcgaccccactc

SEQ ID NO: 141727 - DNA, 20 bp, human
gcacaggggacaccccggag

SEQ ID NO: 141728 - DNA, 20 bp, human
gtgagccgtaccaagctcgg

SEQ ID NO: 141729 - DNA, 20 bp, human
ggcgtcccccgagcttggta

SEQ ID NO: 141730 - DNA, 20 bp, human
gcgccgcggccgaaccactg

SEQ ID NO: 141731 - DNA, 20 bp, human
gaggcgtgagcccgggatag

SEQ ID NO: 141732 - DNA, 20 bp, human
gaccacccttcgggccacag

SEQ ID NO: 141733 - DNA, 20 bp, human
ggaaccactgaggcgagcgg

SEQ ID NO: 141734 - DNA, 20 bp, human
ggctcccccgctcgcctcag

SEQ ID NO: 141735 - DNA, 20 bp, human
gctgccgcgggccacaaggg

SEQ ID NO: 141736 - DNA, 20 bp, human
ggacgccgggctccgaacaa

SEQ ID NO: 141737 - DNA, 20 bp, human
gcccgagcccggagcgacgg

SEQ ID NO: 141738 - DNA, 20 bp, human
gggttggccgccggaggcac

SEQ ID NO: 141739 - DNA, 20 bp, human
ggcagatgccgggcccctcg

SEQ ID NO: 141740 - DNA, 20 bp, human
gcttccgcagcgggccgggt

SEQ ID NO: 141741 - DNA, 20 bp, human
gtcgggagggactcaaaagc

SEQ ID NO: 141742 - DNA, 20 bp, human
gcgatgcgacggctactcac

SEQ ID NO: 141743 - DNA, 20 bp, human
gccacccacccggcccgctg

SEQ ID NO: 141744 - DNA, 20 bp, human
gcatacagccggtcccgagg

SEQ ID NO: 141745 - DNA, 20 bp, human
gctccgagccgctcactgca

SEQ ID NO: 141746 - DNA, 20 bp, human
ggccgctcccggacagacga

SEQ ID NO: 141747 - DNA, 20 bp, human
gtgtccgggagcggctggag

SEQ ID NO: 141748 - DNA, 20 bp, human
gaccgtcgtctgtccgggag

SEQ ID NO: 141749 - DNA, 20 bp, human
gggcgcgaggtgacgccaca

SEQ ID NO: 141750 - DNA, 20 bp, human
gcggcccggccctccttccg

SEQ ID NO: 141751 - DNA, 20 bp, human
ggcgtgagtgcgcccctccc

SEQ ID NO: 141752 - DNA, 20 bp, human
gtgtctccggcctgcactaa

SEQ ID NO: 141753 - DNA, 20 bp, human
gctgtaaccgtcgtctgtcc

SEQ ID NO: 141754 - DNA, 20 bp, human
ggacgactcccccccagcct

SEQ ID NO: 141755 - DNA, 20 bp, human
ggttccggctgcgcgcgcag

SEQ ID NO: 141756 - DNA, 20 bp, human
gactgacctggcggtccggg

SEQ ID NO: 141757 - DNA, 20 bp, human
gggcgcggaggagactgacc

SEQ ID NO: 141758 - DNA, 20 bp, human
ggcggcgccggcacgacggg

SEQ ID NO: 141759 - DNA, 20 bp, human
gcgcaggatgaactcagggt

SEQ ID NO: 141760 - DNA, 20 bp, human
gcgggcggcgccggcacgac

SEQ ID NO: 141761 - DNA, 20 bp, human
gcacgacgggtggagggctc

SEQ ID NO: 141762 - DNA, 20 bp, human
gcctgcgcaggatgaactca

SEQ ID NO: 141763 - DNA, 20 bp, human
ggaaaatgagccgtgaatgg

SEQ ID NO: 141764 - DNA, 20 bp, human
gggcagagccagatcctggg

SEQ ID NO: 141765 - DNA, 20 bp, human
gggagactgacctggcggtc

SEQ ID NO: 141766 - DNA, 20 bp, human
gcccgccggacaacgtcctg

SEQ ID NO: 141767 - DNA, 20 bp, human
gcctgggctgctccccgtgg

SEQ ID NO: 141768 - DNA, 20 bp, human
gcgtcctggggcgagcgcct

SEQ ID NO: 141769 - DNA, 20 bp, human
ggcaggggcgccccgccacg

SEQ ID NO: 141770 - DNA, 20 bp, human
gcctgctgaggccgcgtccc

SEQ ID NO: 141771 - DNA, 20 bp, human
gtgctcccgacgcgccctgg

SEQ ID NO: 141772 - DNA, 20 bp, human
gtgccccgcggagggtctgt

SEQ ID NO: 141773 - DNA, 20 bp, human
gctcgccccaggacgttgtc

SEQ ID NO: 141774 - DNA, 20 bp, human
ggccccaggacgttgtccgg

SEQ ID NO: 141775 - DNA, 20 bp, human
gagacgacttgtgacacgga

SEQ ID NO: 141776 - DNA, 20 bp, human
gtctaccgaccgcgaggggg

SEQ ID NO: 141777 - DNA, 20 bp, human
ggggcgcctgacggaagcgg

SEQ ID NO: 141778 - DNA, 20 bp, human
gtgggggacgtgggagacag

SEQ ID NO: 141779 - DNA, 20 bp, human
gatggggcgcctgacggaag

SEQ ID NO: 141780 - DNA, 20 bp, human
ggagacagcggcaggagcgt

SEQ ID NO: 141781 - DNA, 20 bp, human
ggcagcgggcagcggctctc

SEQ ID NO: 141782 - DNA, 20 bp, human
gcagcggcaggagcgtggga

SEQ ID NO: 141783 - DNA, 20 bp, human
gccccctgcgcgctgcacat

SEQ ID NO: 141784 - DNA, 20 bp, human
gctgcacatggggcgcctga

SEQ ID NO: 141785 - DNA, 20 bp, human
gggaggttaagtatagaacc

SEQ ID NO: 141786 - DNA, 20 bp, human
gcaggcgctcaggagcgcta

SEQ ID NO: 141787 - DNA, 20 bp, human
gctcctgagcgcctgcaacc

SEQ ID NO: 141788 - DNA, 20 bp, human
ggcccaggccgagctctctg

SEQ ID NO: 141789 - DNA, 20 bp, human
ggcgagcgtggggtatctcg

SEQ ID NO: 141790 - DNA, 20 bp, human
gtacaggtaaaggccgggtc

SEQ ID NO: 141791 - DNA, 20 bp, human
ggagctctctggggacccga

SEQ ID NO: 141792 - DNA, 20 bp, human
gccgggcctgggctccatga

SEQ ID NO: 141793 - DNA, 20 bp, human
ggctggcgcgagcagaaagc

SEQ ID NO: 141794 - DNA, 20 bp, human
gtccccagagagctcggcct

SEQ ID NO: 141795 - DNA, 20 bp, human
gtctgcagatctcgggccgg

SEQ ID NO: 141796 - DNA, 20 bp, human
gccaggaaggagtaccgggg

SEQ ID NO: 141797 - DNA, 20 bp, human
ggcagcgccaagggccccat

SEQ ID NO: 141798 - DNA, 20 bp, human
gcggtccaggaaggagtacc

SEQ ID NO: 141799 - DNA, 20 bp, human
gttcctagggtggtcaagag

SEQ ID NO: 141800 - DNA, 20 bp, human
gtgagctccaaggggtgcct

SEQ ID NO: 141801 - DNA, 20 bp, human
gaccgtgcccaggcacccct

SEQ ID NO: 141802 - DNA, 20 bp, human
gcctggctgcagcccaggta

SEQ ID NO: 141803 - DNA, 20 bp, human
gtggaccgcgctggaagccc

SEQ ID NO: 141804 - DNA, 20 bp, human
gagtcaagagaaggctcctg

SEQ ID NO: 141805 - DNA, 20 bp, human
gcttccagcgcggtccagga

SEQ ID NO: 141806 - DNA, 20 bp, human
ggggcttcgggcacttgaca

SEQ ID NO: 141807 - DNA, 20 bp, human
ggccggactacgcgaggaga

SEQ ID NO: 141808 - DNA, 20 bp, human
ggcacttgacatggcggcag

SEQ ID NO: 141809 - DNA, 20 bp, human
gcgctaggagagcgggcttc

SEQ ID NO: 141810 - DNA, 20 bp, human
gccgctcgcgctaggagagc

SEQ ID NO: 141811 - DNA, 20 bp, human
ggcagcagcgaaggggaatg

SEQ ID NO: 141812 - DNA, 20 bp, human
ggccctcgcgagccagcgcc

SEQ ID NO: 141813 - DNA, 20 bp, human
ggcagcggccggactacctg

SEQ ID NO: 141814 - DNA, 20 bp, human
ggccgggcgctggctcgcga

SEQ ID NO: 141815 - DNA, 20 bp, human
gctccgcgccgcaggtagtc

SEQ ID NO: 141816 - DNA, 20 bp, human
gcagggtgtagagcagcgtc

SEQ ID NO: 141817 - DNA, 20 bp, human
gggacggctagagaagtgtg

SEQ ID NO: 141818 - DNA, 20 bp, human
gggcgcgtcaagctccgcaa

SEQ ID NO: 141819 - DNA, 20 bp, human
gagctgccgaggcaaagagg

SEQ ID NO: 141820 - DNA, 20 bp, human
gcggcccgacagggacggag

SEQ ID NO: 141821 - DNA, 20 bp, human
ggtcccaggctcagggcggt

SEQ ID NO: 141822 - DNA, 20 bp, human
gagaccccagcggcccgaca

SEQ ID NO: 141823 - DNA, 20 bp, human
gtctagccgtcccaggctca

SEQ ID NO: 141824 - DNA, 20 bp, human
gcggcgcagcggcgacccgt

SEQ ID NO: 141825 - DNA, 20 bp, human
gagcgcggtggccgccatcc

SEQ ID NO: 141826 - DNA, 20 bp, human
gaagggcccgccacgctccg

SEQ ID NO: 141827 - DNA, 20 bp, human
gagctgggcggccatttacc

SEQ ID NO: 141828 - DNA, 20 bp, human
ggaagcagcagcggctaggg

SEQ ID NO: 141829 - DNA, 20 bp, human
gcccgagctggagaacagaa

SEQ ID NO: 141830 - DNA, 20 bp, human
gagcgcgacgcggcctagag

SEQ ID NO: 141831 - DNA, 20 bp, human
gcaggcgtgatgcgtagttc

SEQ ID NO: 141832 - DNA, 20 bp, human
gcggcggtagctgcaggggt

SEQ ID NO: 141833 - DNA, 20 bp, human
gccgccccggggacaaaggg

SEQ ID NO: 141834 - DNA, 20 bp, human
gtcgcgttgagagcacagac

SEQ ID NO: 141835 - DNA, 20 bp, human
ggaagggggctccgacgctg

SEQ ID NO: 141836 - DNA, 20 bp, human
ggaggaacatgacatcgcgg

SEQ ID NO: 141837 - DNA, 20 bp, human
ggcaaggagcgggtccgtcg

SEQ ID NO: 141838 - DNA, 20 bp, human
ggagccgccgagggaaccac

SEQ ID NO: 141839 - DNA, 20 bp, human
gtacctgccccgggcctgac

SEQ ID NO: 141840 - DNA, 20 bp, human
gccgcagccggaactcgggg

SEQ ID NO: 141841 - DNA, 20 bp, human
gggcctgacgggcatccccg

SEQ ID NO: 141842 - DNA, 20 bp, human
gcggggctaaccgaacgcgg

SEQ ID NO: 141843 - DNA, 20 bp, human
gccgctcgggaccggacgcg

SEQ ID NO: 141844 - DNA, 20 bp, human
gagggaaccacgggtgccag

SEQ ID NO: 141845 - DNA, 20 bp, human
ggggatgcccgtcaggcccg

SEQ ID NO: 141846 - DNA, 20 bp, human
gcgtctccgacggaggagga

SEQ ID NO: 141847 - DNA, 20 bp, human
ggggcttggcggggtcggga

SEQ ID NO: 141848 - DNA, 20 bp, human
ggcggctcgcctggtactgt

SEQ ID NO: 141849 - DNA, 20 bp, human
gtccccaccgccctaggcgg

SEQ ID NO: 141850 - DNA, 20 bp, human
gacagaggtacacaaagcac

SEQ ID NO: 141851 - DNA, 20 bp, human
gccgcagccgccgcctaggg

SEQ ID NO: 141852 - DNA, 20 bp, human
ggaggtacacaaagcactgg

SEQ ID NO: 141853 - DNA, 20 bp, human
ggcgaggccgcgcatctggg

SEQ ID NO: 141854 - DNA, 20 bp, human
gaccagccgggtgagccggg

SEQ ID NO: 141855 - DNA, 20 bp, human
gcgggtgagccgggtggtct

SEQ ID NO: 141856 - DNA, 20 bp, human
gccagcacgacggtctccag

SEQ ID NO: 141857 - DNA, 20 bp, human
ggtggtgcgagtagctccag

SEQ ID NO: 141858 - DNA, 20 bp, human
gagctccagcggccacgctg

SEQ ID NO: 141859 - DNA, 20 bp, human
ggcacggctcgccagcacga

SEQ ID NO: 141860 - DNA, 20 bp, human
gagaggcgtcgagcacagta

SEQ ID NO: 141861 - DNA, 20 bp, human
gggagctactcgcaccactg

SEQ ID NO: 141862 - DNA, 20 bp, human
ggaggcggaccggggagcta

SEQ ID NO: 141863 - DNA, 20 bp, human
ggggtgacacaccatgctca

SEQ ID NO: 141864 - DNA, 20 bp, human
ggtctcgggaccagccggta

SEQ ID NO: 141865 - DNA, 20 bp, human
gtaaggacgagagccgccct

SEQ ID NO: 141866 - DNA, 20 bp, human
ggcagcgggcgcagactcgg

SEQ ID NO: 141867 - DNA, 20 bp, human
gcaacctcgggcccaactcc

SEQ ID NO: 141868 - DNA, 20 bp, human
gggcgccctgcagatgactt

SEQ ID NO: 141869 - DNA, 20 bp, human
gctcggcggagtgagcgcag

SEQ ID NO: 141870 - DNA, 20 bp, human
gggcgcgagagtccgagcag

SEQ ID NO: 141871 - DNA, 20 bp, human
gctttccgcgcgggactccg

SEQ ID NO: 141872 - DNA, 20 bp, human
gcactccgccgagaaaaagt

SEQ ID NO: 141873 - DNA, 20 bp, human
gccaactcccggcttggacg

SEQ ID NO: 141874 - DNA, 20 bp, human
gcagggcgcccggagcgcca

SEQ ID NO: 141875 - DNA, 20 bp, human
gagcgcagcgggcgcagact

SEQ ID NO: 141876 - DNA, 20 bp, human
ggccatggctgacacctacg

SEQ ID NO: 141877 - DNA, 20 bp, human
gaccgcgtaggtgtcagcca

SEQ ID NO: 141878 - DNA, 20 bp, human
gggcacagagatgctcctgc

SEQ ID NO: 141879 - DNA, 20 bp, human
gggtcgcagtcgcggtccag

SEQ ID NO: 141880 - DNA, 20 bp, human
gccgggaggaagtgaaacgg

SEQ ID NO: 141881 - DNA, 20 bp, human
ggggccgggaggaagtgaaa

SEQ ID NO: 141882 - DNA, 20 bp, human
ggggtccccgggccacgcca

SEQ ID NO: 141883 - DNA, 20 bp, human
gacgccccggaagcgccccc

SEQ ID NO: 141884 - DNA, 20 bp, human
gaggctggaggccacgtccg

SEQ ID NO: 141885 - DNA, 20 bp, human
gccgcgactgcgaccgccag

SEQ ID NO: 141886 - DNA, 20 bp, human
gcggggacaccgagacagaa

SEQ ID NO: 141887 - DNA, 20 bp, human
gacgaggacaccgggaacga

SEQ ID NO: 141888 - DNA, 20 bp, human
gggagcgcgacgaggacacc

SEQ ID NO: 141889 - DNA, 20 bp, human
ggctgcgggcgggacaggtg

SEQ ID NO: 141890 - DNA, 20 bp, human
gtcgcgctcccggaacaacc

SEQ ID NO: 141891 - DNA, 20 bp, human
gggccgcccgccctcccctg

SEQ ID NO: 141892 - DNA, 20 bp, human
ggctggaccttgctggcccg

SEQ ID NO: 141893 - DNA, 20 bp, human
gaacacggagagaccccccg

SEQ ID NO: 141894 - DNA, 20 bp, human
ggaacaacctggctgcgggc

SEQ ID NO: 141895 - DNA, 20 bp, human
ggggtgtgcacggtccgtcc

SEQ ID NO: 141896 - DNA, 20 bp, human
gctcaggccccgcacgatcc

SEQ ID NO: 141897 - DNA, 20 bp, human
gccgacagggcttggcgtgg

SEQ ID NO: 141898 - DNA, 20 bp, human
ggctccccaagaagccgctg

SEQ ID NO: 141899 - DNA, 20 bp, human
ggcagcgccagcgctctccc

SEQ ID NO: 141900 - DNA, 20 bp, human
gcgagcagagcctgcgccgg

SEQ ID NO: 141901 - DNA, 20 bp, human
gctggagggcggtgccacag

SEQ ID NO: 141902 - DNA, 20 bp, human
gaagcgcagttagttctgga

SEQ ID NO: 141903 - DNA, 20 bp, human
ggccccgagcgagaggctag

SEQ ID NO: 141904 - DNA, 20 bp, human
gtcccaaggacccccagacc

SEQ ID NO: 141905 - DNA, 20 bp, human
gcacagcggcgtgggagcta

SEQ ID NO: 141906 - DNA, 20 bp, human
gaggcccaggtgaggaaagg

SEQ ID NO: 141907 - DNA, 20 bp, human
ggaacttcccaatgactcaa

SEQ ID NO: 141908 - DNA, 20 bp, human
gggttgcagcgggacagttg

SEQ ID NO: 141909 - DNA, 20 bp, human
gaccacacggctgctcctca

SEQ ID NO: 141910 - DNA, 20 bp, human
gagcagccgtgtggtatgat

SEQ ID NO: 141911 - DNA, 20 bp, human
gtcacagctcaggcccaccc

SEQ ID NO: 141912 - DNA, 20 bp, human
gccaactggcgaggctgctg

SEQ ID NO: 141913 - DNA, 20 bp, human
gcaagggcgggtggaggtcg

SEQ ID NO: 141914 - DNA, 20 bp, human
gtccctgaggagcagccgtg

SEQ ID NO: 141915 - DNA, 20 bp, human
gggctaggcgtggacccaac

SEQ ID NO: 141916 - DNA, 20 bp, human
gcagctttgtggcagattac

SEQ ID NO: 141917 - DNA, 20 bp, human
gagtagatgatgcacctacc

SEQ ID NO: 141918 - DNA, 20 bp, human
gcctctgggtcttggtgggg

SEQ ID NO: 141919 - DNA, 20 bp, human
gcctgactcacaggacacta

SEQ ID NO: 141920 - DNA, 20 bp, human
gcctaaatgagactggtaaa

SEQ ID NO: 141921 - DNA, 20 bp, human
ggctctgctctaaagtccct

SEQ ID NO: 141922 - DNA, 20 bp, human
ggacctttggcctgactcac

SEQ ID NO: 141923 - DNA, 20 bp, human
ggtcctgtgagtcaggccaa

SEQ ID NO: 141924 - DNA, 20 bp, human
gtaaaaggcttcttcagaaa

SEQ ID NO: 141925 - DNA, 20 bp, human
gcccatcccctaaatgagac

SEQ ID NO: 141926 - DNA, 20 bp, human
gaccacacggctgctcctca

SEQ ID NO: 141927 - DNA, 20 bp, human
gagcagccgtgtggtatgat

SEQ ID NO: 141928 - DNA, 20 bp, human
gtccctgaggagcagccgtg

SEQ ID NO: 141929 - DNA, 20 bp, human
gcaggaaccctgtggctctg

SEQ ID NO: 141930 - DNA, 20 bp, human
gcatggcacctgtaggtggt

SEQ ID NO: 141931 - DNA, 20 bp, human
gctattgggaaaaacctact

SEQ ID NO: 141932 - DNA, 20 bp, human
gtattcatggcacctgtagg

SEQ ID NO: 141933 - DNA, 20 bp, human
gcggctgctcctcagggagt

SEQ ID NO: 141934 - DNA, 20 bp, human
gtcttaccaatcataccaca

SEQ ID NO: 141935 - DNA, 20 bp, human
gaaatattcatggcacctgt

SEQ ID NO: 141936 - DNA, 20 bp, human
gaggcccaggtgaggaaagg

SEQ ID NO: 141937 - DNA, 20 bp, human
ggaacttcccaatgactcaa

SEQ ID NO: 141938 - DNA, 20 bp, human
gggttgcagcgggacagttg

SEQ ID NO: 141939 - DNA, 20 bp, human
gaccacacggctgctcctca

SEQ ID NO: 141940 - DNA, 20 bp, human
gagcagccgtgtggtatgat

SEQ ID NO: 141941 - DNA, 20 bp, human
gtcacagctcaggcccaccc

SEQ ID NO: 141942 - DNA, 20 bp, human
gccaactggcgaggctgctg

SEQ ID NO: 141943 - DNA, 20 bp, human
gtccctgaggagcagccgtg

SEQ ID NO: 141944 - DNA, 20 bp, human
gggctaggcgtggacccaac

SEQ ID NO: 141945 - DNA, 20 bp, human
gcaagggcgggtggaggtcg

SEQ ID NO: 141946 - DNA, 20 bp, human
gcagctttgtggcagattac

SEQ ID NO: 141947 - DNA, 20 bp, human
gagtagatgatgcacctacc

SEQ ID NO: 141948 - DNA, 20 bp, human
gcctctgggtcttggtgggg

SEQ ID NO: 141949 - DNA, 20 bp, human
gcctgactcacaggacacta

SEQ ID NO: 141950 - DNA, 20 bp, human
ggctctgctctaaagtccct

SEQ ID NO: 141951 - DNA, 20 bp, human
gcctaaatgagactggtaaa

SEQ ID NO: 141952 - DNA, 20 bp, human
ggacctttggcctgactcac

SEQ ID NO: 141953 - DNA, 20 bp, human
ggtcctgtgagtcaggccaa

SEQ ID NO: 141954 - DNA, 20 bp, human
gtaaaaggcttcttcagaaa

SEQ ID NO: 141955 - DNA, 20 bp, human
gcccatcccctaaatgagac

SEQ ID NO: 141956 - DNA, 20 bp, human
gaccacacggctgctcctca

SEQ ID NO: 141957 - DNA, 20 bp, human
gagcagccgtgtggtatgat

SEQ ID NO: 141958 - DNA, 20 bp, human
gtccctgaggagcagccgtg

SEQ ID NO: 141959 - DNA, 20 bp, human
gcaggaaccctgtggctctg

SEQ ID NO: 141960 - DNA, 20 bp, human
gcatggcacctgtaggtggt

SEQ ID NO: 141961 - DNA, 20 bp, human
gctattgggaaaaacctact

SEQ ID NO: 141962 - DNA, 20 bp, human
gtattcatggcacctgtagg

SEQ ID NO: 141963 - DNA, 20 bp, human
gcggctgctcctcagggagt

SEQ ID NO: 141964 - DNA, 20 bp, human
gtcttaccaatcataccaca

SEQ ID NO: 141965 - DNA, 20 bp, human
gaaatattcatggcacctgt

SEQ ID NO: 141966 - DNA, 20 bp, human
gaggaggacggacagaccgt

SEQ ID NO: 141967 - DNA, 20 bp, human
ggcggcggccagacccgtag

SEQ ID NO: 141968 - DNA, 20 bp, human
gcccattctccgggattccg

SEQ ID NO: 141969 - DNA, 20 bp, human
gcgcacaaagaagccccgtg

SEQ ID NO: 141970 - DNA, 20 bp, human
gtcccctgggcagagtccgg

SEQ ID NO: 141971 - DNA, 20 bp, human
ggcgtcccgcgtcggtccga

SEQ ID NO: 141972 - DNA, 20 bp, human
gacagaccgtcggaccgacg

SEQ ID NO: 141973 - DNA, 20 bp, human
ggctcgcagaccattcccct

SEQ ID NO: 141974 - DNA, 20 bp, human
ggcggctggcccgagcggtg

SEQ ID NO: 141975 - DNA, 20 bp, human
gggaccccggagcgcgcccg

SEQ ID NO: 141976 - DNA, 20 bp, human
gggactcaccagaaattcat

SEQ ID NO: 141977 - DNA, 20 bp, human
gccctgagagggtcacatac

SEQ ID NO: 141978 - DNA, 20 bp, human
ggtatgtaactaccctgaga

SEQ ID NO: 141979 - DNA, 20 bp, human
gtagtctataagtaggttga

SEQ ID NO: 141980 - DNA, 20 bp, human
gtacgtactaatttcctcta

SEQ ID NO: 141981 - DNA, 20 bp, human
gtggctttttggaggtgtct

SEQ ID NO: 141982 - DNA, 20 bp, human
gaccacaacttagatacctg

SEQ ID NO: 141983 - DNA, 20 bp, human
gtccccaggtatctaagttg

SEQ ID NO: 141984 - DNA, 20 bp, human
gttgctagttctttggagtt

SEQ ID NO: 141985 - DNA, 20 bp, human
gactatttaactgactatgg

SEQ ID NO: 141986 - DNA, 20 bp, human
ggggaacagcggatgactcg

SEQ ID NO: 141987 - DNA, 20 bp, human
ggggtccgagcgtcagaagg

SEQ ID NO: 141988 - DNA, 20 bp, human
gcggggcacggcctccatgg

SEQ ID NO: 141989 - DNA, 20 bp, human
gtgcagacgacggagatacg

SEQ ID NO: 141990 - DNA, 20 bp, human
gatgactcggggcagaagtc

SEQ ID NO: 141991 - DNA, 20 bp, human
gactgggtccgagcgtcaga

SEQ ID NO: 141992 - DNA, 20 bp, human
gccgggcctgaggaggtgat

SEQ ID NO: 141993 - DNA, 20 bp, human
gagtgacttccggcacgaag

SEQ ID NO: 141994 - DNA, 20 bp, human
gagatacgcggcggataggg

SEQ ID NO: 141995 - DNA, 20 bp, human
gagcagctacgggagtggcc

SEQ ID NO: 141996 - DNA, 20 bp, human
gccgtacctgcagcatccgg

SEQ ID NO: 141997 - DNA, 20 bp, human
ggcggcacggggtcctccgg

SEQ ID NO: 141998 - DNA, 20 bp, human
gactgggcatgctcagacgg

SEQ ID NO: 141999 - DNA, 20 bp, human
gggatccccgcaccacgtcg

SEQ ID NO: 142000 - DNA, 20 bp, human
gggtaggtcgcgcgtgcggg

SEQ ID NO: 142001 - DNA, 20 bp, human
gccggaggtgccggacgcac

SEQ ID NO: 142002 - DNA, 20 bp, human
gcggcgcggaagctcgctcg

SEQ ID NO: 142003 - DNA, 20 bp, human
gccaggtaggtcgcgcgtgc

SEQ ID NO: 142004 - DNA, 20 bp, human
ggcggggagctagccgagag

SEQ ID NO: 142005 - DNA, 20 bp, human
gcaggggcgggcgcaacccg

SEQ ID NO: 142006 - DNA, 20 bp, human
gtgagctggcgggtaatcct

SEQ ID NO: 142007 - DNA, 20 bp, human
gctgaggtagccccccggag

SEQ ID NO: 142008 - DNA, 20 bp, human
gacgcggctgtgatatacga

SEQ ID NO: 142009 - DNA, 20 bp, human
gtcgaggccccggcgcgcag

SEQ ID NO: 142010 - DNA, 20 bp, human
gcgcactgcgcggcgtgagc

SEQ ID NO: 142011 - DNA, 20 bp, human
ggccccccggagcggcacgg

SEQ ID NO: 142012 - DNA, 20 bp, human
ggagaacaatgttggtggtg

SEQ ID NO: 142013 - DNA, 20 bp, human
gtatcacagccgcgtcctct

SEQ ID NO: 142014 - DNA, 20 bp, human
gagtcctgagagaacaatgt

SEQ ID NO: 142015 - DNA, 20 bp, human
gttctccagccgagaggacg

SEQ ID NO: 142016 - DNA, 20 bp, human
gcggagcctgaagcccctga

SEQ ID NO: 142017 - DNA, 20 bp, human
ggcccccgtcgcatacacac

SEQ ID NO: 142018 - DNA, 20 bp, human
ggatttccaatctccctcag

SEQ ID NO: 142019 - DNA, 20 bp, human
gccgctctggccggtaagtg

SEQ ID NO: 142020 - DNA, 20 bp, human
gcttccggctccgcacacaa

SEQ ID NO: 142021 - DNA, 20 bp, human
gggggcttcaggctccggag

SEQ ID NO: 142022 - DNA, 20 bp, human
gtaccggccagagcgggctc

SEQ ID NO: 142023 - DNA, 20 bp, human
gctgggctgcatcgcctctc

SEQ ID NO: 142024 - DNA, 20 bp, human
gactggcacagacacaagca

SEQ ID NO: 142025 - DNA, 20 bp, human
gttagaggccagaaggctag

SEQ ID NO: 142026 - DNA, 20 bp, human
gccagaactgggaccaccgg

SEQ ID NO: 142027 - DNA, 20 bp, human
gggcacacatgggcatgggt

SEQ ID NO: 142028 - DNA, 20 bp, human
ggaggaggtgcagctagtct

SEQ ID NO: 142029 - DNA, 20 bp, human
gcctggatggcacaagagag

SEQ ID NO: 142030 - DNA, 20 bp, human
gaggtgcagctagtctgggc

SEQ ID NO: 142031 - DNA, 20 bp, human
gacggggaaccaggaatgag

SEQ ID NO: 142032 - DNA, 20 bp, human
gcgggccgcctcaccacccc

SEQ ID NO: 142033 - DNA, 20 bp, human
ggggagtcagcactgccacg

SEQ ID NO: 142034 - DNA, 20 bp, human
gggcccagtcgcaagaacca

SEQ ID NO: 142035 - DNA, 20 bp, human
gcggctgaggtcctgggtgg

SEQ ID NO: 142036 - DNA, 20 bp, human
gacctgatgtccccaagacg

SEQ ID NO: 142037 - DNA, 20 bp, human
ggatataagagggcatctct

SEQ ID NO: 142038 - DNA, 20 bp, human
gcaggaggcatggaggtggt

SEQ ID NO: 142039 - DNA, 20 bp, human
gtgggaccatctcctcttgg

SEQ ID NO: 142040 - DNA, 20 bp, human
gcagtctcggggtagagtaa

SEQ ID NO: 142041 - DNA, 20 bp, human
gcgggggtgttgaatcacca

SEQ ID NO: 142042 - DNA, 20 bp, human
gtccaagtgggagaaggcaa

SEQ ID NO: 142043 - DNA, 20 bp, human
gtgaacgacagcgcatggtg

SEQ ID NO: 142044 - DNA, 20 bp, human
ggaactccggggatataaga

SEQ ID NO: 142045 - DNA, 20 bp, human
gtacagaggcgggagacggg

SEQ ID NO: 142046 - DNA, 20 bp, human
gcagccaggctcctcgcggg

SEQ ID NO: 142047 - DNA, 20 bp, human
gcccagccgggccgtcctcg

SEQ ID NO: 142048 - DNA, 20 bp, human
gatttcctcccggaagagag

SEQ ID NO: 142049 - DNA, 20 bp, human
gcacagcgccacagagctcg

SEQ ID NO: 142050 - DNA, 20 bp, human
ggaagagctaacagccactc

SEQ ID NO: 142051 - DNA, 20 bp, human
gggccggctcgcgcatagtg

SEQ ID NO: 142052 - DNA, 20 bp, human
gggctcgcgcatagtgtggc

SEQ ID NO: 142053 - DNA, 20 bp, human
gctatgcgcgagccggcccc

SEQ ID NO: 142054 - DNA, 20 bp, human
ggcgggcggccgcagcgaaa

SEQ ID NO: 142055 - DNA, 20 bp, human
ggcgaggacgcagtccggga

SEQ ID NO: 142056 - DNA, 20 bp, human
ggggcgggcgacagtgatgg

SEQ ID NO: 142057 - DNA, 20 bp, human
gactgggcgggcgacagtga

SEQ ID NO: 142058 - DNA, 20 bp, human
ggcgcccgcaggcttctacc

SEQ ID NO: 142059 - DNA, 20 bp, human
gtccttctgggaccaggcca

SEQ ID NO: 142060 - DNA, 20 bp, human
gttacagccaaggccgggtc

SEQ ID NO: 142061 - DNA, 20 bp, human
ggcccgggtgggctccggaa

SEQ ID NO: 142062 - DNA, 20 bp, human
gggcttctacccggaaaaga

SEQ ID NO: 142063 - DNA, 20 bp, human
gtccccgcgacggacccgca

SEQ ID NO: 142064 - DNA, 20 bp, human
gggacgcatgcaaagttcct

SEQ ID NO: 142065 - DNA, 20 bp, human
gcggctgaggggcgactggg

SEQ ID NO: 142066 - DNA, 20 bp, human
ggagttcctgaagatcaagc

SEQ ID NO: 142067 - DNA, 20 bp, human
gctataaccgggtcggaaaa

SEQ ID NO: 142068 - DNA, 20 bp, human
gagagaaatctcaacagtat

SEQ ID NO: 142069 - DNA, 20 bp, human
gatggaggctgaattttaca

SEQ ID NO: 142070 - DNA, 20 bp, human
gttcaggaactcaggtgagt

SEQ ID NO: 142071 - DNA, 20 bp, human
gccgggtcggaaaaaggctt

SEQ ID NO: 142072 - DNA, 20 bp, human
gcagagcgtaaagaaccccg

SEQ ID NO: 142073 - DNA, 20 bp, human
gattattatataacagtctg

SEQ ID NO: 142074 - DNA, 20 bp, human
gaataaaactataaccgggt

SEQ ID NO: 142075 - DNA, 20 bp, human
gtcaaagaccagggactcct

SEQ ID NO: 142076 - DNA, 20 bp, human
ggttcttagggtaacagagg

SEQ ID NO: 142077 - DNA, 20 bp, human
gtcgtctgataagacaacag

SEQ ID NO: 142078 - DNA, 20 bp, human
gtagcaagtggtttgttctt

SEQ ID NO: 142079 - DNA, 20 bp, human
ggctagctgcatgaactgct

SEQ ID NO: 142080 - DNA, 20 bp, human
gcctgagacaacaatcttga

SEQ ID NO: 142081 - DNA, 20 bp, human
gtttgtgacaggtaagtaca

SEQ ID NO: 142082 - DNA, 20 bp, human
gatgctgtttcttagggaca

SEQ ID NO: 142083 - DNA, 20 bp, human
gggacgcatgctgtttctta

SEQ ID NO: 142084 - DNA, 20 bp, human
gaatcttgatggtttacagc

SEQ ID NO: 142085 - DNA, 20 bp, human
gatttaaatgtgttggtaac

SEQ ID NO: 142086 - DNA, 20 bp, human
ggtgggtgcccggcacggag

SEQ ID NO: 142087 - DNA, 20 bp, human
gcccatcccaagaacccggg

SEQ ID NO: 142088 - DNA, 20 bp, human
gtggaggtgggtgcccggca

SEQ ID NO: 142089 - DNA, 20 bp, human
ggtcggaacaggctaggtgg

SEQ ID NO: 142090 - DNA, 20 bp, human
gggaggggcctgcggaccaa

SEQ ID NO: 142091 - DNA, 20 bp, human
gtccgaccgcagacttcctc

SEQ ID NO: 142092 - DNA, 20 bp, human
ggtgagacctaagaggagta

SEQ ID NO: 142093 - DNA, 20 bp, human
gccaggtaagggccttccca

SEQ ID NO: 142094 - DNA, 20 bp, human
gtgagggccacaggcgtgca

SEQ ID NO: 142095 - DNA, 20 bp, human
ggcggtcggaacaggctagg

SEQ ID NO: 142096 - DNA, 20 bp, human
gtcagagcctgaaagcgggg

SEQ ID NO: 142097 - DNA, 20 bp, human
ggggctgtgaccataatgag

SEQ ID NO: 142098 - DNA, 20 bp, human
gagatcggacagactcgctg

SEQ ID NO: 142099 - DNA, 20 bp, human
ggacactgcgggatcctcct

SEQ ID NO: 142100 - DNA, 20 bp, human
gactgaggttaaccagttgg

SEQ ID NO: 142101 - DNA, 20 bp, human
gagcttggaatcactgcctc

SEQ ID NO: 142102 - DNA, 20 bp, human
ggaggatcccgcagtgtctc

SEQ ID NO: 142103 - DNA, 20 bp, human
ggcagcgtgcgcgagcagct

SEQ ID NO: 142104 - DNA, 20 bp, human
gaaacggagaggaaatggtg

SEQ ID NO: 142105 - DNA, 20 bp, human
gcaaactgaggttaaccagt

SEQ ID NO: 142106 - DNA, 20 bp, human
ggtagggggaagctgtacat

SEQ ID NO: 142107 - DNA, 20 bp, human
gtataaaatcatcttgtagg

SEQ ID NO: 142108 - DNA, 20 bp, human
gatagcttcagatctcttcg

SEQ ID NO: 142109 - DNA, 20 bp, human
gagctattgcttgtgagcca

SEQ ID NO: 142110 - DNA, 20 bp, human
gaagatgattttatagctgg

SEQ ID NO: 142111 - DNA, 20 bp, human
gtacaagatgattttatagc

SEQ ID NO: 142112 - DNA, 20 bp, human
gtcctcaagatttccctgaa

SEQ ID NO: 142113 - DNA, 20 bp, human
gattatatatattgacacct

SEQ ID NO: 142114 - DNA, 20 bp, human
gagtctttggcttggctgta

SEQ ID NO: 142115 - DNA, 20 bp, human
gcacaagcaatagctgagtg

SEQ ID NO: 142116 - DNA, 20 bp, human
gggtgcacagttccccacag

SEQ ID NO: 142117 - DNA, 20 bp, human
ggcggcgcgcccagtaccag

SEQ ID NO: 142118 - DNA, 20 bp, human
ggagcggcttcaggaaccca

SEQ ID NO: 142119 - DNA, 20 bp, human
gaagcgggcgacacagagag

SEQ ID NO: 142120 - DNA, 20 bp, human
gggcgcggggagcgcatcca

SEQ ID NO: 142121 - DNA, 20 bp, human
gcatacccgcctcgcaggtg

SEQ ID NO: 142122 - DNA, 20 bp, human
gctcggccgctgccgcggga

SEQ ID NO: 142123 - DNA, 20 bp, human
gacgcgcgctcacctcgggg

SEQ ID NO: 142124 - DNA, 20 bp, human
gcgctccggggctcagagtc

SEQ ID NO: 142125 - DNA, 20 bp, human
ggacagccgggcgccccgga

SEQ ID NO: 142126 - DNA, 20 bp, human
gtaggccggctcgatgacat

SEQ ID NO: 142127 - DNA, 20 bp, human
gcctgcacagagctggataa

SEQ ID NO: 142128 - DNA, 20 bp, human
gtttccctgacagctgagaa

SEQ ID NO: 142129 - DNA, 20 bp, human
gactgggtctgctgtgaaca

SEQ ID NO: 142130 - DNA, 20 bp, human
gctggataaaggtaactaag

SEQ ID NO: 142131 - DNA, 20 bp, human
gtaacaattgctggggacat

SEQ ID NO: 142132 - DNA, 20 bp, human
ggggaaacatggattctcca

SEQ ID NO: 142133 - DNA, 20 bp, human
gctcagtcgatagtgcactg

SEQ ID NO: 142134 - DNA, 20 bp, human
gagctctgtgcaggaaatct

SEQ ID NO: 142135 - DNA, 20 bp, human
ggtcttcccaggaagacaag

SEQ ID NO: 142136 - DNA, 20 bp, human
gtaaggtgcggtggagaggg

SEQ ID NO: 142137 - DNA, 20 bp, human
ggaggcggcggctccagctt

SEQ ID NO: 142138 - DNA, 20 bp, human
gccgacggcccctggatagg

SEQ ID NO: 142139 - DNA, 20 bp, human
gggctaaggtgcggtggaga

SEQ ID NO: 142140 - DNA, 20 bp, human
gctcctccccgctcaccccg

SEQ ID NO: 142141 - DNA, 20 bp, human
ggtcactcaccgcctatcca

SEQ ID NO: 142142 - DNA, 20 bp, human
gtccccgctagtccacccgg

SEQ ID NO: 142143 - DNA, 20 bp, human
gtaggcggtgagtgaccccc

SEQ ID NO: 142144 - DNA, 20 bp, human
ggctccgccgggtggactag

SEQ ID NO: 142145 - DNA, 20 bp, human
ggtccccccgcaagccgcta

SEQ ID NO: 142146 - DNA, 20 bp, human
gctggggacgatcctctcgg

SEQ ID NO: 142147 - DNA, 20 bp, human
gcatgttacttcctgtatgg

SEQ ID NO: 142148 - DNA, 20 bp, human
gactggccatgcctccatac

SEQ ID NO: 142149 - DNA, 20 bp, human
gaaaaaggagagagccgatc

SEQ ID NO: 142150 - DNA, 20 bp, human
gcgatcctctcggcggagaa

SEQ ID NO: 142151 - DNA, 20 bp, human
gaggcaggcagctccttcca

SEQ ID NO: 142152 - DNA, 20 bp, human
gggaacgcagagccacgctg

SEQ ID NO: 142153 - DNA, 20 bp, human
gacgctggggacgatcctct

SEQ ID NO: 142154 - DNA, 20 bp, human
gggagagagccgatcgggca

SEQ ID NO: 142155 - DNA, 20 bp, human
gaacatgtgagcatggatcc

SEQ ID NO: 142156 - DNA, 20 bp, human
gggtccccggcagtgtctgg

SEQ ID NO: 142157 - DNA, 20 bp, human
gtccagcaggtggaaggact

SEQ ID NO: 142158 - DNA, 20 bp, human
ggagtgtaaagtccagcagg

SEQ ID NO: 142159 - DNA, 20 bp, human
gatgcctccagacactgccg

SEQ ID NO: 142160 - DNA, 20 bp, human
gaggtggaaggactaggcct

SEQ ID NO: 142161 - DNA, 20 bp, human
gcacagctgtgctcacggac

SEQ ID NO: 142162 - DNA, 20 bp, human
ggcagacacgacagtgtcta

SEQ ID NO: 142163 - DNA, 20 bp, human
gcgcccagagcgggctccca

SEQ ID NO: 142164 - DNA, 20 bp, human
ggtaggagagtcttacacct

SEQ ID NO: 142165 - DNA, 20 bp, human
gagtgtctggaggcatggct

SEQ ID NO: 142166 - DNA, 20 bp, human
ggccgcatgacgcgcggagg

SEQ ID NO: 142167 - DNA, 20 bp, human
ggcgcgcggctacccggtcc

SEQ ID NO: 142168 - DNA, 20 bp, human
gtccggctgcccaggatcgg

SEQ ID NO: 142169 - DNA, 20 bp, human
gccagccgcatgacgcgcgg

SEQ ID NO: 142170 - DNA, 20 bp, human
gcccggagacatggcagcgg

SEQ ID NO: 142171 - DNA, 20 bp, human
gggccaggtaagcgccgggt

SEQ ID NO: 142172 - DNA, 20 bp, human
ggcgcggggcatgaagccgg

SEQ ID NO: 142173 - DNA, 20 bp, human
gcagggacgcggcccccccg

SEQ ID NO: 142174 - DNA, 20 bp, human
ggccccagccgcatgacgcg

SEQ ID NO: 142175 - DNA, 20 bp, human
gccgagcgtacccccccggg

SEQ ID NO: 142176 - DNA, 20 bp, human
gggtcgccaaactacctcag

SEQ ID NO: 142177 - DNA, 20 bp, human
ggtgagccaggtccccgcta

SEQ ID NO: 142178 - DNA, 20 bp, human
gagctctccatgctcggcgg

SEQ ID NO: 142179 - DNA, 20 bp, human
gggctggggacaaggatcgt

SEQ ID NO: 142180 - DNA, 20 bp, human
ggagcagcctccgccgagca

SEQ ID NO: 142181 - DNA, 20 bp, human
gggcggcagctctccatgct

SEQ ID NO: 142182 - DNA, 20 bp, human
ggggagctctctctgtccgg

SEQ ID NO: 142183 - DNA, 20 bp, human
gggtggggaacacagggtag

SEQ ID NO: 142184 - DNA, 20 bp, human
ggatttcgcggcgatccccc

SEQ ID NO: 142185 - DNA, 20 bp, human
gctcggcatggatacgactg

SEQ ID NO: 142186 - DNA, 20 bp, human
gtgatagatggcgaatggaa

SEQ ID NO: 142187 - DNA, 20 bp, human
gcagtgtctgtgcttgtggt

SEQ ID NO: 142188 - DNA, 20 bp, human
gccctggccaggatcatgaa

SEQ ID NO: 142189 - DNA, 20 bp, human
gctgccaagtgtggatacac

SEQ ID NO: 142190 - DNA, 20 bp, human
gttctcaagctagaagactg

SEQ ID NO: 142191 - DNA, 20 bp, human
ggtgcgtgatagatggcgaa

SEQ ID NO: 142192 - DNA, 20 bp, human
ggttctgtgtgcgtgataga

SEQ ID NO: 142193 - DNA, 20 bp, human
ggctccggtgtatccacact

SEQ ID NO: 142194 - DNA, 20 bp, human
ggaaaatcaaagctatctat

SEQ ID NO: 142195 - DNA, 20 bp, human
gcagacactgaaaacgaaag

SEQ ID NO: 142196 - DNA, 20 bp, human
ggggcaccgccagtcagtcg

SEQ ID NO: 142197 - DNA, 20 bp, human
gttgctccccgactgactgg

SEQ ID NO: 142198 - DNA, 20 bp, human
ggcagaagtccgaactccag

SEQ ID NO: 142199 - DNA, 20 bp, human
gcgaactccagcggctccag

SEQ ID NO: 142200 - DNA, 20 bp, human
gctcttgctccccgactgac

SEQ ID NO: 142201 - DNA, 20 bp, human
gcgctggcagagggagcgga

SEQ ID NO: 142202 - DNA, 20 bp, human
gtcccttcagccggcctgcg

SEQ ID NO: 142203 - DNA, 20 bp, human
ggaagggagcgctcacgtca

SEQ ID NO: 142204 - DNA, 20 bp, human
gcaagcccagccccgggcgg

SEQ ID NO: 142205 - DNA, 20 bp, human
gctccccggcggcggtgggt

SEQ ID NO: 142206 - DNA, 20 bp, human
gaaggacacggggtgcatgt

SEQ ID NO: 142207 - DNA, 20 bp, human
gcccggagctcggaaagatg

SEQ ID NO: 142208 - DNA, 20 bp, human
gggtggggctgggaatacgg

SEQ ID NO: 142209 - DNA, 20 bp, human
gggcgggacctaagagaatt

SEQ ID NO: 142210 - DNA, 20 bp, human
gcaggttcgggagaaggaca

SEQ ID NO: 142211 - DNA, 20 bp, human
gagggcgtctcggaggaaag

SEQ ID NO: 142212 - DNA, 20 bp, human
ggctcccgccagcgtcgctg

SEQ ID NO: 142213 - DNA, 20 bp, human
gggagccgcagcgacgctgg

SEQ ID NO: 142214 - DNA, 20 bp, human
gtggcgggagcctgccagag

SEQ ID NO: 142215 - DNA, 20 bp, human
gctggagcgaaactcggtgg

SEQ ID NO: 142216 - DNA, 20 bp, human
gggagaggcgccaccctgag

SEQ ID NO: 142217 - DNA, 20 bp, human
gggagaggcgcctctgtgag

SEQ ID NO: 142218 - DNA, 20 bp, human
gtgcatgccccctcactcag

SEQ ID NO: 142219 - DNA, 20 bp, human
gtccccccgacccctcaggg

SEQ ID NO: 142220 - DNA, 20 bp, human
gccgcgggggacggacgaag

SEQ ID NO: 142221 - DNA, 20 bp, human
gcacccagaccccctcacgg

SEQ ID NO: 142222 - DNA, 20 bp, human
gctctgtgaggggttcgggg

SEQ ID NO: 142223 - DNA, 20 bp, human
ggtcgccgcaagagcgcgag

SEQ ID NO: 142224 - DNA, 20 bp, human
gccccgcaaccccctcactg

SEQ ID NO: 142225 - DNA, 20 bp, human
gcgcaagagcgcgagaggcg

SEQ ID NO: 142226 - DNA, 20 bp, human
gcccgggcgcagaggaggaa

SEQ ID NO: 142227 - DNA, 20 bp, human
gcacgttcttggaggacccc

SEQ ID NO: 142228 - DNA, 20 bp, human
gtggaggaccccgggcgcag

SEQ ID NO: 142229 - DNA, 20 bp, human
ggggcgccgtgtatccccgt

SEQ ID NO: 142230 - DNA, 20 bp, human
gagcgtgcgcccaggctgca

SEQ ID NO: 142231 - DNA, 20 bp, human
ggactaaggatggagagggt

SEQ ID NO: 142232 - DNA, 20 bp, human
gtggggcgcgccgctcccaa

SEQ ID NO: 142233 - DNA, 20 bp, human
gggtcctccaagaacgtgcc

SEQ ID NO: 142234 - DNA, 20 bp, human
gggaaagggagcaggcgcag

SEQ ID NO: 142235 - DNA, 20 bp, human
gacctgcccacggggataca

SEQ ID NO: 142236 - DNA, 20 bp, human
ggccatcaatgtgattctac

SEQ ID NO: 142237 - DNA, 20 bp, human
ggccagtagaatcacattga

SEQ ID NO: 142238 - DNA, 20 bp, human
gctagtaccaggaacgacat

SEQ ID NO: 142239 - DNA, 20 bp, human
gaaaacaagggctaagtcat

SEQ ID NO: 142240 - DNA, 20 bp, human
gatcctagttcactgtcaca

SEQ ID NO: 142241 - DNA, 20 bp, human
gttccttgtgacagtgaact

SEQ ID NO: 142242 - DNA, 20 bp, human
gttatatcgtacctagtacc

SEQ ID NO: 142243 - DNA, 20 bp, human
gtaattgtgtacttgccaga

SEQ ID NO: 142244 - DNA, 20 bp, human
ggtctttaaatcattaatgc

SEQ ID NO: 142245 - DNA, 20 bp, human
gatgtttccaatgtcgttcc

SEQ ID NO: 142246 - DNA, 20 bp, human
gccagaagccaaggcggaga

SEQ ID NO: 142247 - DNA, 20 bp, human
gggggaacagaagcgctcag

SEQ ID NO: 142248 - DNA, 20 bp, human
ggaacagaagcgctcagagg

SEQ ID NO: 142249 - DNA, 20 bp, human
gagccaaggcggagacggca

SEQ ID NO: 142250 - DNA, 20 bp, human
gcaaggcggagacggcaggg

SEQ ID NO: 142251 - DNA, 20 bp, human
ggacagtacctgacagggaa

SEQ ID NO: 142252 - DNA, 20 bp, human
ggggttgccaggcttagagc

SEQ ID NO: 142253 - DNA, 20 bp, human
gaacaggacagtacctgaca

SEQ ID NO: 142254 - DNA, 20 bp, human
gccggagactagaagaccct

SEQ ID NO: 142255 - DNA, 20 bp, human
ggtaggaggttgcgggtaag

SEQ ID NO: 142256 - DNA, 20 bp, human
gctgttgcatgggatccgag

SEQ ID NO: 142257 - DNA, 20 bp, human
gtcgtccgcggcgtgggagg

SEQ ID NO: 142258 - DNA, 20 bp, human
gggcgcgcgagcgggagcta

SEQ ID NO: 142259 - DNA, 20 bp, human
ggtctcggaggcagccgagt

SEQ ID NO: 142260 - DNA, 20 bp, human
ggctccaaggggggtctcgg

SEQ ID NO: 142261 - DNA, 20 bp, human
gcccggggtggtgcagccgg

SEQ ID NO: 142262 - DNA, 20 bp, human
ggcggaagggatgacgtcac

SEQ ID NO: 142263 - DNA, 20 bp, human
gtgtccgggcgcagctaccg

SEQ ID NO: 142264 - DNA, 20 bp, human
gaatgcaggcgctccaaggg

SEQ ID NO: 142265 - DNA, 20 bp, human
gcgcagctaccggggcgcag

SEQ ID NO: 142266 - DNA, 20 bp, human
gcgaggcgcggcgcgaactg

SEQ ID NO: 142267 - DNA, 20 bp, human
gcagccgcgcgcacagccag

SEQ ID NO: 142268 - DNA, 20 bp, human
gggctgccgagggacgcgag

SEQ ID NO: 142269 - DNA, 20 bp, human
ggctcctgcgttccaagccg

SEQ ID NO: 142270 - DNA, 20 bp, human
ggggcgggcgcactcacctg

SEQ ID NO: 142271 - DNA, 20 bp, human
ggtccccatggccggaaccc

SEQ ID NO: 142272 - DNA, 20 bp, human
gggcccgcgcgcatccagga

SEQ ID NO: 142273 - DNA, 20 bp, human
ggcgcctcggcttggaacgc

SEQ ID NO: 142274 - DNA, 20 bp, human
gaacgcaggagcgccggctc

SEQ ID NO: 142275 - DNA, 20 bp, human
gggccggcaggaaactgaag

SEQ ID NO: 142276 - DNA, 20 bp, human
ggcgccggagaccgagactc

SEQ ID NO: 142277 - DNA, 20 bp, human
gagctacgccacgggccccg

SEQ ID NO: 142278 - DNA, 20 bp, human
ggctccggctcgcctcgggc

SEQ ID NO: 142279 - DNA, 20 bp, human
gccggctcgcgctctggact

SEQ ID NO: 142280 - DNA, 20 bp, human
gcgcagtcacgcaacacccc

SEQ ID NO: 142281 - DNA, 20 bp, human
gactccggcaggtaagcgcg

SEQ ID NO: 142282 - DNA, 20 bp, human
gtgtgtgtcggcgagtatgt

SEQ ID NO: 142283 - DNA, 20 bp, human
ggtgtcggcgagtatgttgg

SEQ ID NO: 142284 - DNA, 20 bp, human
ggagttctgtgcgcaagaaa

SEQ ID NO: 142285 - DNA, 20 bp, human
gcctgggcacgggccatggt

SEQ ID NO: 142286 - DNA, 20 bp, human
gcgggatgagatctgatcta

SEQ ID NO: 142287 - DNA, 20 bp, human
gtggggcgctatctgaagat

SEQ ID NO: 142288 - DNA, 20 bp, human
gtgtggtggaactcagagtt

SEQ ID NO: 142289 - DNA, 20 bp, human
ggaagatgggcctgtggaaa

SEQ ID NO: 142290 - DNA, 20 bp, human
gggccctaggaggacggaga

SEQ ID NO: 142291 - DNA, 20 bp, human
gggggctctgcgaggagatg

SEQ ID NO: 142292 - DNA, 20 bp, human
ggccagcacgcagcagctgt

SEQ ID NO: 142293 - DNA, 20 bp, human
gtagcagcgtgagaggccct

SEQ ID NO: 142294 - DNA, 20 bp, human
gtgagatctgatctaggggt

SEQ ID NO: 142295 - DNA, 20 bp, human
gggccggcagggtgtcgctg

SEQ ID NO: 142296 - DNA, 20 bp, human
ggagtgagaagagctcggtg

SEQ ID NO: 142297 - DNA, 20 bp, human
gacccaggcggcaaacacag

SEQ ID NO: 142298 - DNA, 20 bp, human
gagccgaggcgcatgtcctc

SEQ ID NO: 142299 - DNA, 20 bp, human
gtctcggagcgctcagaccg

SEQ ID NO: 142300 - DNA, 20 bp, human
gtgggtgagtgagaagagct

SEQ ID NO: 142301 - DNA, 20 bp, human
gccgccgcagccggcgaaag

SEQ ID NO: 142302 - DNA, 20 bp, human
gcgccggaggacatgcgcct

SEQ ID NO: 142303 - DNA, 20 bp, human
gcggcggcggcggcaagtcg

SEQ ID NO: 142304 - DNA, 20 bp, human
gtccgggatcggtgggatga

SEQ ID NO: 142305 - DNA, 20 bp, human
ggtttcagctccgggatcgg

SEQ ID NO: 142306 - DNA, 20 bp, human
gagcggcaggcggagatgga

SEQ ID NO: 142307 - DNA, 20 bp, human
ggcgcagtgcagagcatcca

SEQ ID NO: 142308 - DNA, 20 bp, human
ggagagaagcaggagcggaa

SEQ ID NO: 142309 - DNA, 20 bp, human
gggagctggagcgggagacc

SEQ ID NO: 142310 - DNA, 20 bp, human
gtcaagcacagctggaggag

SEQ ID NO: 142311 - DNA, 20 bp, human
ggtcccggtgcgcacggacg

SEQ ID NO: 142312 - DNA, 20 bp, human
gtccgtgcgcaccgggacag

SEQ ID NO: 142313 - DNA, 20 bp, human
gtccgctggggctcaggcag

SEQ ID NO: 142314 - DNA, 20 bp, human
gctcaccgtattgctcgtgg

SEQ ID NO: 142315 - DNA, 20 bp, human
ggaggagcggcaggcggaga

SEQ ID NO: 142316 - DNA, 20 bp, human
ggcggtgtcggagtgaatgg

SEQ ID NO: 142317 - DNA, 20 bp, human
gcgggacgctgtgagatcgg

SEQ ID NO: 142318 - DNA, 20 bp, human
gcccgtgggccccaacgcag

SEQ ID NO: 142319 - DNA, 20 bp, human
gggcggcaccagggaaactg

SEQ ID NO: 142320 - DNA, 20 bp, human
gctttttgggcgccggacag

SEQ ID NO: 142321 - DNA, 20 bp, human
ggcgaggctccaaaacacat

SEQ ID NO: 142322 - DNA, 20 bp, human
ggacgctgtgagatcggggg

SEQ ID NO: 142323 - DNA, 20 bp, human
ggggccccaacgcagaggag

SEQ ID NO: 142324 - DNA, 20 bp, human
gcaggccagccacctgcggg

SEQ ID NO: 142325 - DNA, 20 bp, human
gccggcacgcgacacagcgt

SEQ ID NO: 142326 - DNA, 20 bp, human
gtgaggaaaggaggtactgt

SEQ ID NO: 142327 - DNA, 20 bp, human
gtgttcgctgcccagaagaa

SEQ ID NO: 142328 - DNA, 20 bp, human
gggaggtactgtaggtaggt

SEQ ID NO: 142329 - DNA, 20 bp, human
ggaaaggaggtactgtaggt

SEQ ID NO: 142330 - DNA, 20 bp, human
gagaagggaaggcgcgagtg

SEQ ID NO: 142331 - DNA, 20 bp, human
gagctctgcgtggaaagaat

SEQ ID NO: 142332 - DNA, 20 bp, human
gcacccaggaaccccggaag

SEQ ID NO: 142333 - DNA, 20 bp, human
ggcgtgagctacctcttccg

SEQ ID NO: 142334 - DNA, 20 bp, human
gaggcctcataccctcagct

SEQ ID NO: 142335 - DNA, 20 bp, human
gtcgacagctcgaaacgctg

SEQ ID NO: 142336 - DNA, 20 bp, human
gagtattgtaccaggacctg

SEQ ID NO: 142337 - DNA, 20 bp, human
gacctgcggctccgccccag

SEQ ID NO: 142338 - DNA, 20 bp, human
gacagtcaggcccttcccaa

SEQ ID NO: 142339 - DNA, 20 bp, human
gtcccaagggcgcacctcca

SEQ ID NO: 142340 - DNA, 20 bp, human
gcagtgcacaggcggaacag

SEQ ID NO: 142341 - DNA, 20 bp, human
gaaaggccggacctactccc

SEQ ID NO: 142342 - DNA, 20 bp, human
gtgggctcgcggtaaagtgg

SEQ ID NO: 142343 - DNA, 20 bp, human
gggaggtgctgagacatcga

SEQ ID NO: 142344 - DNA, 20 bp, human
gatgcaccggggagtaggtc

SEQ ID NO: 142345 - DNA, 20 bp, human
gtttaccgcgagcccagcag

SEQ ID NO: 142346 - DNA, 20 bp, human
gtacaccaagggactcctag

SEQ ID NO: 142347 - DNA, 20 bp, human
gagatgagcacggaaggtgg

SEQ ID NO: 142348 - DNA, 20 bp, human
gaccctgtggtctacaccaa

SEQ ID NO: 142349 - DNA, 20 bp, human
gccgggaagatgagcacgga

SEQ ID NO: 142350 - DNA, 20 bp, human
ggctcgcgctgaaggagatg

SEQ ID NO: 142351 - DNA, 20 bp, human
ggctgtctgcggtgctcggc

SEQ ID NO: 142352 - DNA, 20 bp, human
gagggcgatggcccacgtct

SEQ ID NO: 142353 - DNA, 20 bp, human
ggcctccagcatcctgatgg

SEQ ID NO: 142354 - DNA, 20 bp, human
gtcccttggtgtagaccaca

SEQ ID NO: 142355 - DNA, 20 bp, human
gtctgcccctaggagtccct

SEQ ID NO: 142356 - DNA, 20 bp, human
gtgaatgggagggtcgcggg

SEQ ID NO: 142357 - DNA, 20 bp, human
gcgcgggtggttagttgagc

SEQ ID NO: 142358 - DNA, 20 bp, human
gccgcggcctcagatgaatg

SEQ ID NO: 142359 - DNA, 20 bp, human
gtaagacctgcgtgagtgaa

SEQ ID NO: 142360 - DNA, 20 bp, human
gggactgctaactggaccaa

SEQ ID NO: 142361 - DNA, 20 bp, human
gtgagtgaatgggagggtcg

SEQ ID NO: 142362 - DNA, 20 bp, human
gtaacagccgcattcatctg

SEQ ID NO: 142363 - DNA, 20 bp, human
gaggccgcggtgaacggacg

SEQ ID NO: 142364 - DNA, 20 bp, human
gtggttagttgagccggctc

SEQ ID NO: 142365 - DNA, 20 bp, human
ggcgccgcgtccgttcaccg

SEQ ID NO: 142366 - DNA, 20 bp, human
gcggtcgctctatcagtcag

SEQ ID NO: 142367 - DNA, 20 bp, human
gccactccgggcgccatggt

SEQ ID NO: 142368 - DNA, 20 bp, human
gagaccgcttgtgctggagt

SEQ ID NO: 142369 - DNA, 20 bp, human
gcgaggcgcaacctccagta

SEQ ID NO: 142370 - DNA, 20 bp, human
ggtcgcagtgaggctaaggg

SEQ ID NO: 142371 - DNA, 20 bp, human
gtagagcgaccggccgacca

SEQ ID NO: 142372 - DNA, 20 bp, human
gtctccgcccggaacagccg

SEQ ID NO: 142373 - DNA, 20 bp, human
ggcccgcgccccagccgcga

SEQ ID NO: 142374 - DNA, 20 bp, human
gactccgactccagcacaag

SEQ ID NO: 142375 - DNA, 20 bp, human
gcctcgaggagcctccgtcg

SEQ ID NO: 142376 - DNA, 20 bp, human
gtgaatgtggctgttgagag

SEQ ID NO: 142377 - DNA, 20 bp, human
gccacggtcttagatgaatg

SEQ ID NO: 142378 - DNA, 20 bp, human
gacatccttggcagccacac

SEQ ID NO: 142379 - DNA, 20 bp, human
gtccagcttcagcacatcct

SEQ ID NO: 142380 - DNA, 20 bp, human
gtctacgttgataaggaaat

SEQ ID NO: 142381 - DNA, 20 bp, human
gtagctttaggtaaggctga

SEQ ID NO: 142382 - DNA, 20 bp, human
gaagttttaacacgacgttt

SEQ ID NO: 142383 - DNA, 20 bp, human
gtctggataggcgtcatctg

SEQ ID NO: 142384 - DNA, 20 bp, human
gcaaagtctagaagattgaa

SEQ ID NO: 142385 - DNA, 20 bp, human
gaagctctccctcctcatca

SEQ ID NO: 142386 - DNA, 20 bp, human
gcataaccggcgatttcata

SEQ ID NO: 142387 - DNA, 20 bp, human
gagaggtggatatgtagtca

SEQ ID NO: 142388 - DNA, 20 bp, human
ggtgaacttacggtcctcag

SEQ ID NO: 142389 - DNA, 20 bp, human
gtggacaacgaaatagacaa

SEQ ID NO: 142390 - DNA, 20 bp, human
gtcgcaaggagatgcattgc

SEQ ID NO: 142391 - DNA, 20 bp, human
gcttacggtcctcagtggga

SEQ ID NO: 142392 - DNA, 20 bp, human
gtttctgtaacgtacataat

SEQ ID NO: 142393 - DNA, 20 bp, human
gagcacaaaacagaatcgca

SEQ ID NO: 142394 - DNA, 20 bp, human
gctgttttgagctacataac

SEQ ID NO: 142395 - DNA, 20 bp, human
ggcagtgttggccgagaact

SEQ ID NO: 142396 - DNA, 20 bp, human
gcccgactgcgccatgtcag

SEQ ID NO: 142397 - DNA, 20 bp, human
gctccgtaggctggaggaac

SEQ ID NO: 142398 - DNA, 20 bp, human
gctgtgagcaggggacggca

SEQ ID NO: 142399 - DNA, 20 bp, human
ggcaagttatacccctgaca

SEQ ID NO: 142400 - DNA, 20 bp, human
ggggtctggaagggagtcag

SEQ ID NO: 142401 - DNA, 20 bp, human
gcacccagcgcaggcccgac

SEQ ID NO: 142402 - DNA, 20 bp, human
ggtttttcgagaggctccgt

SEQ ID NO: 142403 - DNA, 20 bp, human
gacccctgacatggcgcagt

SEQ ID NO: 142404 - DNA, 20 bp, human
gctgtccgtggaccccgcgt

SEQ ID NO: 142405 - DNA, 20 bp, human
gagctgggctccactcacac

SEQ ID NO: 142406 - DNA, 20 bp, human
ggccgcccgcgctcatgggg

SEQ ID NO: 142407 - DNA, 20 bp, human
gggctcacttacgagagcta

SEQ ID NO: 142408 - DNA, 20 bp, human
gggccgcgacggacgcaaga

SEQ ID NO: 142409 - DNA, 20 bp, human
gcccagatcgcgcgagacag

SEQ ID NO: 142410 - DNA, 20 bp, human
ggcgcgcgcggaggccgcga

SEQ ID NO: 142411 - DNA, 20 bp, human
gggacgggacctgtagaaag

SEQ ID NO: 142412 - DNA, 20 bp, human
gccacggcgcacacccccgt

SEQ ID NO: 142413 - DNA, 20 bp, human
ggatcgcgcgagacagcgga

SEQ ID NO: 142414 - DNA, 20 bp, human
gcacccccgtcggcaaaggg

SEQ ID NO: 142415 - DNA, 20 bp, human
ggagggccgcccgcgctcat

SEQ ID NO: 142416 - DNA, 20 bp, human
gtgtcggagtgaaaggtaag

SEQ ID NO: 142417 - DNA, 20 bp, human
gccccccgatcttctctctc

SEQ ID NO: 142418 - DNA, 20 bp, human
ggccagagagagaagatcgg

SEQ ID NO: 142419 - DNA, 20 bp, human
gtggccacacagaagactcg

SEQ ID NO: 142420 - DNA, 20 bp, human
ggtggggtgcggatactcac

SEQ ID NO: 142421 - DNA, 20 bp, human
ggaagtcgaagaaatcgggg

SEQ ID NO: 142422 - DNA, 20 bp, human
ggccatgttgtcggagtgaa

SEQ ID NO: 142423 - DNA, 20 bp, human
gcggatactcacgggcggag

SEQ ID NO: 142424 - DNA, 20 bp, human
gtggcaacatcaatcttcgg

SEQ ID NO: 142425 - DNA, 20 bp, human
ggaatggcaacatcaatctt

SEQ ID NO: 142426 - DNA, 20 bp, human
ggcccgctcgcacaatgcag

SEQ ID NO: 142427 - DNA, 20 bp, human
gcggcggccccgcagaggga

SEQ ID NO: 142428 - DNA, 20 bp, human
gcgaaccaccgaagtaccga

SEQ ID NO: 142429 - DNA, 20 bp, human
ggaacgcggactgacttaca

SEQ ID NO: 142430 - DNA, 20 bp, human
gcggtggttcggaggaggag

SEQ ID NO: 142431 - DNA, 20 bp, human
ggccagcgggagggcggata

SEQ ID NO: 142432 - DNA, 20 bp, human
gatcggagggagaaccgggt

SEQ ID NO: 142433 - DNA, 20 bp, human
gccgaccgttgggcacacgg

SEQ ID NO: 142434 - DNA, 20 bp, human
ggacgccgccgtgtgcccaa

SEQ ID NO: 142435 - DNA, 20 bp, human
gtcgcacaatgcagggggag

SEQ ID NO: 142436 - DNA, 20 bp, human
gcgccgcagacggcaagtcg

SEQ ID NO: 142437 - DNA, 20 bp, human
gagtcgtggcagccagacgt

SEQ ID NO: 142438 - DNA, 20 bp, human
gcggcgagcggatcccgcag

SEQ ID NO: 142439 - DNA, 20 bp, human
gcagcagggaaggtcgcgag

SEQ ID NO: 142440 - DNA, 20 bp, human
ggagcggatcccgcagggga

SEQ ID NO: 142441 - DNA, 20 bp, human
gggctgagagagcaagtaaa

SEQ ID NO: 142442 - DNA, 20 bp, human
gtgccacgacttgccgtctg

SEQ ID NO: 142443 - DNA, 20 bp, human
gcgggttacgcgccgacgtc

SEQ ID NO: 142444 - DNA, 20 bp, human
ggcacacctgtcctggacag

SEQ ID NO: 142445 - DNA, 20 bp, human
gagcccgcagagcctaagtg

SEQ ID NO: 142446 - DNA, 20 bp, human
gaggtagtcgcggaactcca

SEQ ID NO: 142447 - DNA, 20 bp, human
gtcatggcggaccgagacag

SEQ ID NO: 142448 - DNA, 20 bp, human
ggcggagcgcagcatcatgg

SEQ ID NO: 142449 - DNA, 20 bp, human
gaactccacggccactgaca

SEQ ID NO: 142450 - DNA, 20 bp, human
ggcagcggagcgcagcatca

SEQ ID NO: 142451 - DNA, 20 bp, human
ggtgctcgatgaagtcgccc

SEQ ID NO: 142452 - DNA, 20 bp, human
gacagcggcagcgagcaggg

SEQ ID NO: 142453 - DNA, 20 bp, human
gtcgtgctgcagcccccctg

SEQ ID NO: 142454 - DNA, 20 bp, human
gcaggtccggcggctggctg

SEQ ID NO: 142455 - DNA, 20 bp, human
ggagctggcctccaagcggg

SEQ ID NO: 142456 - DNA, 20 bp, human
ggaggcggcggcctagaaga

SEQ ID NO: 142457 - DNA, 20 bp, human
gctcttgctcgccgccgccg

SEQ ID NO: 142458 - DNA, 20 bp, human
gagcgagtcgcggaactcgg

SEQ ID NO: 142459 - DNA, 20 bp, human
gggcggcggccggcgatgag

SEQ ID NO: 142460 - DNA, 20 bp, human
gcgcctcacgctgtccatgg

SEQ ID NO: 142461 - DNA, 20 bp, human
gggctgcacggaagtcgcgg

SEQ ID NO: 142462 - DNA, 20 bp, human
ggaagtcgcccagcgagtcg

SEQ ID NO: 142463 - DNA, 20 bp, human
gcgcgcgccggaagtggcta

SEQ ID NO: 142464 - DNA, 20 bp, human
gggcggccggcgatgagcgg

SEQ ID NO: 142465 - DNA, 20 bp, human
gacagcggcagcgagcgcgg

SEQ ID NO: 142466 - DNA, 20 bp, human
gcaggcggcggcccccgcag

SEQ ID NO: 142467 - DNA, 20 bp, human
ggccggtgtccgaagtcagg

SEQ ID NO: 142468 - DNA, 20 bp, human
gggtgtccgaagtcaggcgg

SEQ ID NO: 142469 - DNA, 20 bp, human
gcctcctgcggccgctgcgg

SEQ ID NO: 142470 - DNA, 20 bp, human
gggggccggtgtccgaagtc

SEQ ID NO: 142471 - DNA, 20 bp, human
gtggtcgtgaagggcatcgg

SEQ ID NO: 142472 - DNA, 20 bp, human
gggccccgcacccgccagga

SEQ ID NO: 142473 - DNA, 20 bp, human
ggggggccgccgcctgactt

SEQ ID NO: 142474 - DNA, 20 bp, human
ggccgccaaccggccggcag

SEQ ID NO: 142475 - DNA, 20 bp, human
gcggtggtcgtgaagggcat

SEQ ID NO: 142476 - DNA, 20 bp, human
gacccgcgtcgggaccagag

SEQ ID NO: 142477 - DNA, 20 bp, human
ggtcagccgcgtcgcgaatg

SEQ ID NO: 142478 - DNA, 20 bp, human
gagccggagccggaccacgt

SEQ ID NO: 142479 - DNA, 20 bp, human
gtcaggagtcgaggagaccc

SEQ ID NO: 142480 - DNA, 20 bp, human
gagacccgggccacccgcgt

SEQ ID NO: 142481 - DNA, 20 bp, human
gggtccgagaggttaggggt

SEQ ID NO: 142482 - DNA, 20 bp, human
gagaggttaggggtcggcag

SEQ ID NO: 142483 - DNA, 20 bp, human
gcggaccacgtgggcgaagg

SEQ ID NO: 142484 - DNA, 20 bp, human
ggcactggtagcctgcgcat

SEQ ID NO: 142485 - DNA, 20 bp, human
gagcctctctggtcccgacg

SEQ ID NO: 142486 - DNA, 20 bp, human
gccggaaggggttaaatctc

SEQ ID NO: 142487 - DNA, 20 bp, human
gttcccttcgagggccggaa

SEQ ID NO: 142488 - DNA, 20 bp, human
gaggcttgaggttagatctc

SEQ ID NO: 142489 - DNA, 20 bp, human
ggcttgcttggcgaaaactg

SEQ ID NO: 142490 - DNA, 20 bp, human
gaccccttccggccctcgaa

SEQ ID NO: 142491 - DNA, 20 bp, human
gtcatcgaaaacgagaaaag

SEQ ID NO: 142492 - DNA, 20 bp, human
ggcgggtaggtaagaggtga

SEQ ID NO: 142493 - DNA, 20 bp, human
gggtgaggcgggtaggtaag

SEQ ID NO: 142494 - DNA, 20 bp, human
gtagcaaaggaggggtgagt

SEQ ID NO: 142495 - DNA, 20 bp, human
gctctggcttactggaggag

SEQ ID NO: 142496 - DNA, 20 bp, human
ggctgccggaaagtaagtgt

SEQ ID NO: 142497 - DNA, 20 bp, human
ggagagctccagaaagtacc

SEQ ID NO: 142498 - DNA, 20 bp, human
gtgagaacccaggagtatgt

SEQ ID NO: 142499 - DNA, 20 bp, human
gtactttctgggttccacag

SEQ ID NO: 142500 - DNA, 20 bp, human
gcagcctcccacatactcct

SEQ ID NO: 142501 - DNA, 20 bp, human
gaagagggagtactgtccaa

SEQ ID NO: 142502 - DNA, 20 bp, human
gcaggcgcccgagccctcat

SEQ ID NO: 142503 - DNA, 20 bp, human
ggtggaaactcgccgcagta

SEQ ID NO: 142504 - DNA, 20 bp, human
gcaatcgtggtctgtatgta

SEQ ID NO: 142505 - DNA, 20 bp, human
ggcttcctttctcggaaacg

SEQ ID NO: 142506 - DNA, 20 bp, human
gccccggggcgggtccagtc

SEQ ID NO: 142507 - DNA, 20 bp, human
ggggaggccgcgcacttacc

SEQ ID NO: 142508 - DNA, 20 bp, human
ggctccagccgactcaccgg

SEQ ID NO: 142509 - DNA, 20 bp, human
gggccgggctcgcacacgtg

SEQ ID NO: 142510 - DNA, 20 bp, human
gtgcgctccagccgactcac

SEQ ID NO: 142511 - DNA, 20 bp, human
gagcccggccgccggtgagt

SEQ ID NO: 142512 - DNA, 20 bp, human
ggatgagccagcggctaggg

SEQ ID NO: 142513 - DNA, 20 bp, human
ggccgaagcgcaggacccac

SEQ ID NO: 142514 - DNA, 20 bp, human
gccgctggcacgatccataa

SEQ ID NO: 142515 - DNA, 20 bp, human
gtggttgggacgcaagagag

SEQ ID NO: 142516 - DNA, 20 bp, human
gcactgaaccgaggtagacg

SEQ ID NO: 142517 - DNA, 20 bp, human
gtctacctcggttcagtgga

SEQ ID NO: 142518 - DNA, 20 bp, human
gagagactgctgctgacagt

SEQ ID NO: 142519 - DNA, 20 bp, human
gaatgccttccactgaaccg

SEQ ID NO: 142520 - DNA, 20 bp, human
gaactcgaccccgtctacct

SEQ ID NO: 142521 - DNA, 20 bp, human
gctgacctggaggacagcaa

SEQ ID NO: 142522 - DNA, 20 bp, human
gcagcatcctggtagaagag

SEQ ID NO: 142523 - DNA, 20 bp, human
gttcaggcttaacgccacgt

SEQ ID NO: 142524 - DNA, 20 bp, human
gtccaaaggtgtccccgaca

SEQ ID NO: 142525 - DNA, 20 bp, human
ggagtttcttgcgcgatggt

SEQ ID NO: 142526 - DNA, 20 bp, human
ggcccagccggtggcgtcag

SEQ ID NO: 142527 - DNA, 20 bp, human
ggccggcgccgaactcatgg

SEQ ID NO: 142528 - DNA, 20 bp, human
gaggccgcctctgacgccac

SEQ ID NO: 142529 - DNA, 20 bp, human
gcagccggtggcgtcagagg

SEQ ID NO: 142530 - DNA, 20 bp, human
ggaggccggcgccgaactca

SEQ ID NO: 142531 - DNA, 20 bp, human
gaaagtcggtgcccacgtac

SEQ ID NO: 142532 - DNA, 20 bp, human
gggggtccagaactacctgg

SEQ ID NO: 142533 - DNA, 20 bp, human
gcgcgcgcgcacggagcctg

SEQ ID NO: 142534 - DNA, 20 bp, human
gctgggctccgccatgagtt

SEQ ID NO: 142535 - DNA, 20 bp, human
gagcgggcggaggttaccgg

SEQ ID NO: 142536 - DNA, 20 bp, human
gggaccaagggcgaagacca

SEQ ID NO: 142537 - DNA, 20 bp, human
gggcgcccagcgggaagtgt

SEQ ID NO: 142538 - DNA, 20 bp, human
gcaagggcgaagaccagggt

SEQ ID NO: 142539 - DNA, 20 bp, human
ggctcgtacaaggaccctgg

SEQ ID NO: 142540 - DNA, 20 bp, human
gaacgctgaggacatcaaga

SEQ ID NO: 142541 - DNA, 20 bp, human
gactcagggtccgggaccaa

SEQ ID NO: 142542 - DNA, 20 bp, human
ggggcgaagaccagggtcgg

SEQ ID NO: 142543 - DNA, 20 bp, human
gcgtccagagagctcgtaca

SEQ ID NO: 142544 - DNA, 20 bp, human
gacagacttgctgaacgctg

SEQ ID NO: 142545 - DNA, 20 bp, human
gagagctcgtacaaggaccc

SEQ ID NO: 142546 - DNA, 20 bp, human
gtccagacaagtgactggag

SEQ ID NO: 142547 - DNA, 20 bp, human
gacacggtgcgagggtgcga

SEQ ID NO: 142548 - DNA, 20 bp, human
gctccgggtggccaagagga

SEQ ID NO: 142549 - DNA, 20 bp, human
gcatcttcgggaacccaagg

SEQ ID NO: 142550 - DNA, 20 bp, human
gcccggggttggaaggaaca

SEQ ID NO: 142551 - DNA, 20 bp, human
ggacaagtgactggagcgga

SEQ ID NO: 142552 - DNA, 20 bp, human
gcgctctccgggtggccaag

SEQ ID NO: 142553 - DNA, 20 bp, human
gtggccacccggagagcggt

SEQ ID NO: 142554 - DNA, 20 bp, human
gccaaccccggggcagagat

SEQ ID NO: 142555 - DNA, 20 bp, human
gcaagtacccggcctggatg

SEQ ID NO: 142556 - DNA, 20 bp, human
gtcacccgcagtgacacaca

SEQ ID NO: 142557 - DNA, 20 bp, human
ggacgaggagacagcgcctg

SEQ ID NO: 142558 - DNA, 20 bp, human
gaccagggtccggtgcccca

SEQ ID NO: 142559 - DNA, 20 bp, human
gcacccagctaaggaatcgg

SEQ ID NO: 142560 - DNA, 20 bp, human
gggcgctgtctcctcgtcat

SEQ ID NO: 142561 - DNA, 20 bp, human
ggtctcctcgtcataggtga

SEQ ID NO: 142562 - DNA, 20 bp, human
gctgtgttgcacccagaacg

SEQ ID NO: 142563 - DNA, 20 bp, human
gcacagggaccccggaggtg

SEQ ID NO: 142564 - DNA, 20 bp, human
gcccactaccaatctgatgt

SEQ ID NO: 142565 - DNA, 20 bp, human
gacccacatcagattggtag

SEQ ID NO: 142566 - DNA, 20 bp, human
gccggcgatccgcaacaatg

SEQ ID NO: 142567 - DNA, 20 bp, human
gcgctctgcgtggaagaaga

SEQ ID NO: 142568 - DNA, 20 bp, human
gtcgccggcacccggcagag

SEQ ID NO: 142569 - DNA, 20 bp, human
gccggcacccggcagagcgg

SEQ ID NO: 142570 - DNA, 20 bp, human
gcgggccgccgccggctcag

SEQ ID NO: 142571 - DNA, 20 bp, human
gcgcgaggagaacgggtcgg

SEQ ID NO: 142572 - DNA, 20 bp, human
gagagcgagagcagcgagcg

SEQ ID NO: 142573 - DNA, 20 bp, human
gcgagcctctgagccggcgg

SEQ ID NO: 142574 - DNA, 20 bp, human
gatggccggccgtcctccga

SEQ ID NO: 142575 - DNA, 20 bp, human
gtgcgtcccgccaccctcgg

SEQ ID NO: 142576 - DNA, 20 bp, human
ggcgtcggcggcgatctcga

SEQ ID NO: 142577 - DNA, 20 bp, human
gccagctcggaaggtaaggt

SEQ ID NO: 142578 - DNA, 20 bp, human
ggaagggggcacgcgagagg

SEQ ID NO: 142579 - DNA, 20 bp, human
ggtggatcctgtgacgtcag

SEQ ID NO: 142580 - DNA, 20 bp, human
gagagaatcggacgtgtagg

SEQ ID NO: 142581 - DNA, 20 bp, human
gggcgatctcgacggcagga

SEQ ID NO: 142582 - DNA, 20 bp, human
gagacaagcaggcgtaggat

SEQ ID NO: 142583 - DNA, 20 bp, human
gtagggggtcggagtctgtg

SEQ ID NO: 142584 - DNA, 20 bp, human
gttccccagctcggaaggta

SEQ ID NO: 142585 - DNA, 20 bp, human
gtggaaaccggtgagacgag

SEQ ID NO: 142586 - DNA, 20 bp, human
ggcgcccgcaccctcagtgg

SEQ ID NO: 142587 - DNA, 20 bp, human
ggcctcgctgctccagagaa

SEQ ID NO: 142588 - DNA, 20 bp, human
gcccgcttcagcctcggcag

SEQ ID NO: 142589 - DNA, 20 bp, human
gctgagggagccgccactga

SEQ ID NO: 142590 - DNA, 20 bp, human
gacacttggccgaacgctgg

SEQ ID NO: 142591 - DNA, 20 bp, human
ggtcgctgccggctgacact

SEQ ID NO: 142592 - DNA, 20 bp, human
gctctgtggtaggtgaacct

SEQ ID NO: 142593 - DNA, 20 bp, human
gctgacacttggccgaacgc

SEQ ID NO: 142594 - DNA, 20 bp, human
ggcggctcccgcttcagcct

SEQ ID NO: 142595 - DNA, 20 bp, human
ggtcgccgacgccactgccg

SEQ ID NO: 142596 - DNA, 20 bp, human
gacgctgtggccaacaacga

SEQ ID NO: 142597 - DNA, 20 bp, human
gagctcggagctcccgatca

SEQ ID NO: 142598 - DNA, 20 bp, human
gccggctcccagggagatct

SEQ ID NO: 142599 - DNA, 20 bp, human
ggctcccagggagatctcgg

SEQ ID NO: 142600 - DNA, 20 bp, human
gcccgatcacggcttcttgg

SEQ ID NO: 142601 - DNA, 20 bp, human
gtctcggctcccagggacag

SEQ ID NO: 142602 - DNA, 20 bp, human
gacccccaagaagccgtgat

SEQ ID NO: 142603 - DNA, 20 bp, human
gcggctgggtgtgtagaacg

SEQ ID NO: 142604 - DNA, 20 bp, human
ggttccaccgagatctccct

SEQ ID NO: 142605 - DNA, 20 bp, human
gacaacgacggcagaaacct

SEQ ID NO: 142606 - DNA, 20 bp, human
gcactgctgccacacgctca

SEQ ID NO: 142607 - DNA, 20 bp, human
gtagcgggccggaaaggggt

SEQ ID NO: 142608 - DNA, 20 bp, human
gctagaaaccaggctgcata

SEQ ID NO: 142609 - DNA, 20 bp, human
gcctgagcctggagagtcaa

SEQ ID NO: 142610 - DNA, 20 bp, human
gaaaccaggctgcataggga

SEQ ID NO: 142611 - DNA, 20 bp, human
gcctggtcgctgggagacaa

SEQ ID NO: 142612 - DNA, 20 bp, human
gtgggtgctagtgaagctag

SEQ ID NO: 142613 - DNA, 20 bp, human
ggcgtgtcacgctagaaacc

SEQ ID NO: 142614 - DNA, 20 bp, human
gacgctcagggatctgcaca

SEQ ID NO: 142615 - DNA, 20 bp, human
gttcatggtcctcaagtcaa

SEQ ID NO: 142616 - DNA, 20 bp, human
gcggccgccgggttgagctg

SEQ ID NO: 142617 - DNA, 20 bp, human
gcccccgggaagtgtctctg

SEQ ID NO: 142618 - DNA, 20 bp, human
ggtgccgcagctcaacccgg

SEQ ID NO: 142619 - DNA, 20 bp, human
gcggtaagcgaacttcatca

SEQ ID NO: 142620 - DNA, 20 bp, human
gcgtgtgccgcagctcaacc

SEQ ID NO: 142621 - DNA, 20 bp, human
gtgagtatggcccaacctaa

SEQ ID NO: 142622 - DNA, 20 bp, human
ggggcacagcaccctcggga

SEQ ID NO: 142623 - DNA, 20 bp, human
gtgagaacagcagggacccg

SEQ ID NO: 142624 - DNA, 20 bp, human
gagcgtccaggtgagcggaa

SEQ ID NO: 142625 - DNA, 20 bp, human
gagcaccctcgggagggatg

SEQ ID NO: 142626 - DNA, 20 bp, human
ggagctcgcccgcagcccag

SEQ ID NO: 142627 - DNA, 20 bp, human
gcggcggcgacagcgctgct

SEQ ID NO: 142628 - DNA, 20 bp, human
gccgccgctgcagccggagt

SEQ ID NO: 142629 - DNA, 20 bp, human
gccggcggcgatgcaggaga

SEQ ID NO: 142630 - DNA, 20 bp, human
gcctccaactccggctgcag

SEQ ID NO: 142631 - DNA, 20 bp, human
gggcagccgcgcctcaggga

SEQ ID NO: 142632 - DNA, 20 bp, human
gggctcgtcggcctgaggag

SEQ ID NO: 142633 - DNA, 20 bp, human
gtgccggatggcgagactga

SEQ ID NO: 142634 - DNA, 20 bp, human
gcggtgtcgcaactgatccc

SEQ ID NO: 142635 - DNA, 20 bp, human
gtgcgggcgagctcccccgg

SEQ ID NO: 142636 - DNA, 20 bp, human
ggggtggagcaggtcgtcaa

SEQ ID NO: 142637 - DNA, 20 bp, human
gcaacagtcgaattcaacag

SEQ ID NO: 142638 - DNA, 20 bp, human
gctgggacgcggcgggagca

SEQ ID NO: 142639 - DNA, 20 bp, human
gaacggcgcgctggtggtca

SEQ ID NO: 142640 - DNA, 20 bp, human
ggcgccccgaaactcaggct

SEQ ID NO: 142641 - DNA, 20 bp, human
gctccacccgcaccggcagc

SEQ ID NO: 142642 - DNA, 20 bp, human
ggcgcggccgccactcgggg

SEQ ID NO: 142643 - DNA, 20 bp, human
ggccacccccaacccggagg

SEQ ID NO: 142644 - DNA, 20 bp, human
gttgtcgttaaagcagggga

SEQ ID NO: 142645 - DNA, 20 bp, human
gcgagcgcggccgccactcg

SEQ ID NO: 142646 - DNA, 20 bp, human
gtggatgtgtggcagtgaac

SEQ ID NO: 142647 - DNA, 20 bp, human
gtgtgtgagtaaatgtgagt

SEQ ID NO: 142648 - DNA, 20 bp, human
gtgacgtgtgtgacagtgag

SEQ ID NO: 142649 - DNA, 20 bp, human
gttttctatggaagatgaag

SEQ ID NO: 142650 - DNA, 20 bp, human
ggtggatgtctggatgtgag

SEQ ID NO: 142651 - DNA, 20 bp, human
ggtgtgagtggatgtgtgat

SEQ ID NO: 142652 - DNA, 20 bp, human
gcaatttagacgttagttaa

SEQ ID NO: 142653 - DNA, 20 bp, human
ggtgtgtgtgagagtggatg

SEQ ID NO: 142654 - DNA, 20 bp, human
gtagttaagggctttttcta

SEQ ID NO: 142655 - DNA, 20 bp, human
ggtgtgtaaatgagtgtgag

SEQ ID NO: 142656 - DNA, 20 bp, human
gtggtccagtcaccgacctg

SEQ ID NO: 142657 - DNA, 20 bp, human
ggcccgcggcgcccgttccg

SEQ ID NO: 142658 - DNA, 20 bp, human
gtcggcccgtcactccaagg

SEQ ID NO: 142659 - DNA, 20 bp, human
ggggtcggcccgtcactcca

SEQ ID NO: 142660 - DNA, 20 bp, human
gtcggaccggtcctcgggaa

SEQ ID NO: 142661 - DNA, 20 bp, human
gactccaaggaggctgcgta

SEQ ID NO: 142662 - DNA, 20 bp, human
gcccgaggaccggtccgaac

SEQ ID NO: 142663 - DNA, 20 bp, human
gccgtggccggggtcgtccg

SEQ ID NO: 142664 - DNA, 20 bp, human
gcccctgcgccagttcggac

SEQ ID NO: 142665 - DNA, 20 bp, human
gctggaccagccgggaaggg

SEQ ID NO: 142666 - DNA, 20 bp, human
gtctcccgcagggcgaacaa

SEQ ID NO: 142667 - DNA, 20 bp, human
gcacgagcgccaacaggcag

SEQ ID NO: 142668 - DNA, 20 bp, human
gccctgcgggagacgccgag

SEQ ID NO: 142669 - DNA, 20 bp, human
ggcagaagggaacctccgaa

SEQ ID NO: 142670 - DNA, 20 bp, human
gcccccacgtcccccttcgg

SEQ ID NO: 142671 - DNA, 20 bp, human
ggtccccccacgtccccctt

SEQ ID NO: 142672 - DNA, 20 bp, human
gcgcacggagccaccacggc

SEQ ID NO: 142673 - DNA, 20 bp, human
gccatggccgacggcgcgga

SEQ ID NO: 142674 - DNA, 20 bp, human
gcgtcccccgcggcactcac

SEQ ID NO: 142675 - DNA, 20 bp, human
gggagcgcaggggtgatcgg

SEQ ID NO: 142676 - DNA, 20 bp, human
gccggccaggagaaagagag

SEQ ID NO: 142677 - DNA, 20 bp, human
gggccacgcgaagaagcagc

SEQ ID NO: 142678 - DNA, 20 bp, human
gtggtctgctgtggtacctg

SEQ ID NO: 142679 - DNA, 20 bp, human
ggtggtccagcagaacagtc

SEQ ID NO: 142680 - DNA, 20 bp, human
gccagcagcgaatggagcga

SEQ ID NO: 142681 - DNA, 20 bp, human
gtcgcgtggccagcagcgaa

SEQ ID NO: 142682 - DNA, 20 bp, human
gccaccacggctcccaaact

SEQ ID NO: 142683 - DNA, 20 bp, human
gctgcttgtatacttagaag

SEQ ID NO: 142684 - DNA, 20 bp, human
gaaccctggcaggcaccacc

SEQ ID NO: 142685 - DNA, 20 bp, human
gaaagcaaaggcaccggctg

SEQ ID NO: 142686 - DNA, 20 bp, human
ggacgcgaggtaggaacccg

SEQ ID NO: 142687 - DNA, 20 bp, human
gccgcctagggacgcgaggt

SEQ ID NO: 142688 - DNA, 20 bp, human
ggggcggcgcgtgttgacag

SEQ ID NO: 142689 - DNA, 20 bp, human
gcagcggcggcggtggaacc

SEQ ID NO: 142690 - DNA, 20 bp, human
gcctagtccaaggtgagccc

SEQ ID NO: 142691 - DNA, 20 bp, human
gaaggtgctgctggacgaca

SEQ ID NO: 142692 - DNA, 20 bp, human
gcggagaccgggccacaggg

SEQ ID NO: 142693 - DNA, 20 bp, human
ggcgaacgctgaggcccgga

SEQ ID NO: 142694 - DNA, 20 bp, human
gaaagcgactccgagttggg

SEQ ID NO: 142695 - DNA, 20 bp, human
gggcggcggtggaaccgggc

SEQ ID NO: 142696 - DNA, 20 bp, human
gcccagcgccgtgccgccgg

SEQ ID NO: 142697 - DNA, 20 bp, human
ggagggcccgcccagacccg

SEQ ID NO: 142698 - DNA, 20 bp, human
gcgcccggccagcctgaggt

SEQ ID NO: 142699 - DNA, 20 bp, human
ggagcccgaggcgccgagag

SEQ ID NO: 142700 - DNA, 20 bp, human
gggccctccacgcgctggga

SEQ ID NO: 142701 - DNA, 20 bp, human
gcccctgttgggtccttggg

SEQ ID NO: 142702 - DNA, 20 bp, human
ggaggcgccgagagcggagt

SEQ ID NO: 142703 - DNA, 20 bp, human
gtcggcccgcagcctggacg

SEQ ID NO: 142704 - DNA, 20 bp, human
gcggtggggccggaaatgtc

SEQ ID NO: 142705 - DNA, 20 bp, human
gcccggcgctgaacttcccg

SEQ ID NO: 142706 - DNA, 20 bp, human
gagtcggcggcgctaccgag

SEQ ID NO: 142707 - DNA, 20 bp, human
gtaagcgcactgacagccgg

SEQ ID NO: 142708 - DNA, 20 bp, human
ggcctatagacgccacgagt

SEQ ID NO: 142709 - DNA, 20 bp, human
gcaagagggccaggctgcaa

SEQ ID NO: 142710 - DNA, 20 bp, human
gctgcgcgcagcccgcacta

SEQ ID NO: 142711 - DNA, 20 bp, human
gtatagacgccacgagtcgg

SEQ ID NO: 142712 - DNA, 20 bp, human
gcgggctgcgcgcagggtcg

SEQ ID NO: 142713 - DNA, 20 bp, human
gtccagggcaaacagcaccg

SEQ ID NO: 142714 - DNA, 20 bp, human
gggcggggctgccatagtgc

SEQ ID NO: 142715 - DNA, 20 bp, human
ggcagccccgccgcagctaa

SEQ ID NO: 142716 - DNA, 20 bp, human
gagacgagcggccccgggac

SEQ ID NO: 142717 - DNA, 20 bp, human
ggcgctagctgcccgtcccg

SEQ ID NO: 142718 - DNA, 20 bp, human
gtcgtccatggccggaccac

SEQ ID NO: 142719 - DNA, 20 bp, human
gcgcgagcctcggcccggaa

SEQ ID NO: 142720 - DNA, 20 bp, human
ggttgcggggcatagacgag

SEQ ID NO: 142721 - DNA, 20 bp, human
gtcgcggcggaaaagttgcg

SEQ ID NO: 142722 - DNA, 20 bp, human
gggtcccgtagctgacgagg

SEQ ID NO: 142723 - DNA, 20 bp, human
gctcgtccctgcagcggacg

SEQ ID NO: 142724 - DNA, 20 bp, human
ggaccacgggcgccggctca

SEQ ID NO: 142725 - DNA, 20 bp, human
ggagggtcccgtagctgacg

SEQ ID NO: 142726 - DNA, 20 bp, human
gaagtgcgcccgctgaggtt

SEQ ID NO: 142727 - DNA, 20 bp, human
gggtagcgtagtaagaatac

SEQ ID NO: 142728 - DNA, 20 bp, human
gcagaaaagtgcgcccgctg

SEQ ID NO: 142729 - DNA, 20 bp, human
gtggccagaatgtatatcca

SEQ ID NO: 142730 - DNA, 20 bp, human
gcaaccggaagcaagttact

SEQ ID NO: 142731 - DNA, 20 bp, human
gccggggccgcaccgtaaat

SEQ ID NO: 142732 - DNA, 20 bp, human
gcccatgcgtggagcgaggt

SEQ ID NO: 142733 - DNA, 20 bp, human
gatgcgtggagcgaggttgg

SEQ ID NO: 142734 - DNA, 20 bp, human
gtacggtgcggccccggacg

SEQ ID NO: 142735 - DNA, 20 bp, human
gtgtctggggaccccgtccg

SEQ ID NO: 142736 - DNA, 20 bp, human
ggagccgacttcctcctggt

SEQ ID NO: 142737 - DNA, 20 bp, human
gggtcggtaggccaagcgtg

SEQ ID NO: 142738 - DNA, 20 bp, human
gagcagctttgtttaggggt

SEQ ID NO: 142739 - DNA, 20 bp, human
ggctgcagccgccgaccagg

SEQ ID NO: 142740 - DNA, 20 bp, human
ggcttctacctggagaccta

SEQ ID NO: 142741 - DNA, 20 bp, human
gagctgctctaccggaaagg

SEQ ID NO: 142742 - DNA, 20 bp, human
ggcggggtaagcgctggtgt

SEQ ID NO: 142743 - DNA, 20 bp, human
ggggtaagcgctggtgtggg

SEQ ID NO: 142744 - DNA, 20 bp, human
gcaaagctgctctaccggaa

SEQ ID NO: 142745 - DNA, 20 bp, human
ggtggaggggaaagacgggg

SEQ ID NO: 142746 - DNA, 20 bp, human
gcggctctgcgggacgagac

SEQ ID NO: 142747 - DNA, 20 bp, human
gggccgcagcgctgaggggt

SEQ ID NO: 142748 - DNA, 20 bp, human
ggatcgagagcaagttaggg

SEQ ID NO: 142749 - DNA, 20 bp, human
gggtcccgcacccactggag

SEQ ID NO: 142750 - DNA, 20 bp, human
ggtcgggctccgggaatggt

SEQ ID NO: 142751 - DNA, 20 bp, human
gcagcgctgcggccgccacg

SEQ ID NO: 142752 - DNA, 20 bp, human
gccagtgggtgcgggaccct

SEQ ID NO: 142753 - DNA, 20 bp, human
gccgcgcacggtagctgggt

SEQ ID NO: 142754 - DNA, 20 bp, human
gtacccacccctcagcgctg

SEQ ID NO: 142755 - DNA, 20 bp, human
ggaacctccacccctccagt

SEQ ID NO: 142756 - DNA, 20 bp, human
gtatccgccgggggagaata

SEQ ID NO: 142757 - DNA, 20 bp, human
gcgggcggcgtgccgaggac

SEQ ID NO: 142758 - DNA, 20 bp, human
gccctgagcgcggacaccgt

SEQ ID NO: 142759 - DNA, 20 bp, human
gcagcgcaggggcgaacggg

SEQ ID NO: 142760 - DNA, 20 bp, human
gggaccggaagtaacgctag

SEQ ID NO: 142761 - DNA, 20 bp, human
gggacagcgcaggggcgaac

SEQ ID NO: 142762 - DNA, 20 bp, human
gcccccggcggatatctccc

SEQ ID NO: 142763 - DNA, 20 bp, human
ggtcctcgtagagggttgag

SEQ ID NO: 142764 - DNA, 20 bp, human
gggaagggcggacagcgcag

SEQ ID NO: 142765 - DNA, 20 bp, human
gaaccgcggaccatgagcgt

SEQ ID NO: 142766 - DNA, 20 bp, human
gggcgtccgaggcaacaaga

SEQ ID NO: 142767 - DNA, 20 bp, human
ggtgagcgcagcggcgtccg

SEQ ID NO: 142768 - DNA, 20 bp, human
gggatgggcggtgagcgcag

SEQ ID NO: 142769 - DNA, 20 bp, human
gcgcggcgcgtgggcttcgt

SEQ ID NO: 142770 - DNA, 20 bp, human
gagcccacgcgccgcggaga

SEQ ID NO: 142771 - DNA, 20 bp, human
gcgcgcaaagagaaaatcag

SEQ ID NO: 142772 - DNA, 20 bp, human
gcgcgccagcccctctcatg

SEQ ID NO: 142773 - DNA, 20 bp, human
gagcggagcggagacccggt

SEQ ID NO: 142774 - DNA, 20 bp, human
gcctctcatggggagcagca

SEQ ID NO: 142775 - DNA, 20 bp, human
gagccgtctccgcggcgcgt

SEQ ID NO: 142776 - DNA, 20 bp, human
gcaggccctcggaggctcag

SEQ ID NO: 142777 - DNA, 20 bp, human
gcacctgctgcaggaaaggt

SEQ ID NO: 142778 - DNA, 20 bp, human
gcccgggaaggagactgatc

SEQ ID NO: 142779 - DNA, 20 bp, human
gaccccaggagggaccctga

SEQ ID NO: 142780 - DNA, 20 bp, human
gcaggaaaggtaggacctga

SEQ ID NO: 142781 - DNA, 20 bp, human
gcaggagggaccctgaagga

SEQ ID NO: 142782 - DNA, 20 bp, human
gcttcccgggacatccccgg

SEQ ID NO: 142783 - DNA, 20 bp, human
ggatggctccaggccctcgg

SEQ ID NO: 142784 - DNA, 20 bp, human
gtgcgcctctgagcctccga

SEQ ID NO: 142785 - DNA, 20 bp, human
gaggtctgagggaggacccc

SEQ ID NO: 142786 - DNA, 20 bp, human
gcagaccgtcccccagacag

SEQ ID NO: 142787 - DNA, 20 bp, human
ggtctgtagctcctttccca

SEQ ID NO: 142788 - DNA, 20 bp, human
gagccactcctgcagctact

SEQ ID NO: 142789 - DNA, 20 bp, human
gatccctgaggggttaaggt

SEQ ID NO: 142790 - DNA, 20 bp, human
gtgatcagaacaatctccct

SEQ ID NO: 142791 - DNA, 20 bp, human
gcctgaatactaaagttgtc

SEQ ID NO: 142792 - DNA, 20 bp, human
ggaatcaaacgcatctgtct

SEQ ID NO: 142793 - DNA, 20 bp, human
ggcagggatggcagccatcc

SEQ ID NO: 142794 - DNA, 20 bp, human
gcactatccctgaggggtta

SEQ ID NO: 142795 - DNA, 20 bp, human
gagaggtagacaaggctaat

SEQ ID NO: 142796 - DNA, 20 bp, human
gcgagcgcgaccccaaggtg

SEQ ID NO: 142797 - DNA, 20 bp, human
ggcacacgcgaacgccggga

SEQ ID NO: 142798 - DNA, 20 bp, human
gggccaggcacagccgactg

SEQ ID NO: 142799 - DNA, 20 bp, human
gcagagcagctgcaccatcc

SEQ ID NO: 142800 - DNA, 20 bp, human
ggggaccggcgccctctcag

SEQ ID NO: 142801 - DNA, 20 bp, human
gtactacgagcgcgacccca

SEQ ID NO: 142802 - DNA, 20 bp, human
ggcacggccagaaagagacc

SEQ ID NO: 142803 - DNA, 20 bp, human
gcagcgggcacgggcgcaca

SEQ ID NO: 142804 - DNA, 20 bp, human
ggcgcccgtgcccgctgaga

SEQ ID NO: 142805 - DNA, 20 bp, human
gcaggcgcgggctcccagtg

SEQ ID NO: 142806 - DNA, 20 bp, human
gtgcaagggaccactctgag

SEQ ID NO: 142807 - DNA, 20 bp, human
ggcttctcctggtccgtcag

SEQ ID NO: 142808 - DNA, 20 bp, human
ggtccagaggagacgtgtct

SEQ ID NO: 142809 - DNA, 20 bp, human
gggacttcggggcaaggacc

SEQ ID NO: 142810 - DNA, 20 bp, human
ggccatggcgaagcccctga

SEQ ID NO: 142811 - DNA, 20 bp, human
gtccttgccccgaagtccag

SEQ ID NO: 142812 - DNA, 20 bp, human
gacgtgtctaggctgtgggc

SEQ ID NO: 142813 - DNA, 20 bp, human
ggggcaaggaccgggtgcaa

SEQ ID NO: 142814 - DNA, 20 bp, human
gggagacgtgtctaggctgt

SEQ ID NO: 142815 - DNA, 20 bp, human
ggacggaccaggagaagcgg

SEQ ID NO: 142816 - DNA, 20 bp, human
gggactgatggtagagggga

SEQ ID NO: 142817 - DNA, 20 bp, human
gctgatggtagaggggacgg

SEQ ID NO: 142818 - DNA, 20 bp, human
ggcgggccggactggactga

SEQ ID NO: 142819 - DNA, 20 bp, human
gaatctgagggagaaacctg

SEQ ID NO: 142820 - DNA, 20 bp, human
ggactggactgatggtagag

SEQ ID NO: 142821 - DNA, 20 bp, human
gaagaacctagagtgacgag

SEQ ID NO: 142822 - DNA, 20 bp, human
gactgcctccagccaaggag

SEQ ID NO: 142823 - DNA, 20 bp, human
gtctgacaggggccgggaca

SEQ ID NO: 142824 - DNA, 20 bp, human
ggctggggagctccactcct

SEQ ID NO: 142825 - DNA, 20 bp, human
gaggtggtcgcgcacggtat

SEQ ID NO: 142826 - DNA, 20 bp, human
ggacacaaaagcccccagac

SEQ ID NO: 142827 - DNA, 20 bp, human
gtgtgtctgcgactcgggag

SEQ ID NO: 142828 - DNA, 20 bp, human
gccagagcgggttttacagg

SEQ ID NO: 142829 - DNA, 20 bp, human
gctgtcagcggctcctgagg

SEQ ID NO: 142830 - DNA, 20 bp, human
gtgtaaaacccgctctgggg

SEQ ID NO: 142831 - DNA, 20 bp, human
gttacaggcggctccagtct

SEQ ID NO: 142832 - DNA, 20 bp, human
gacactcacagcgccctctg

SEQ ID NO: 142833 - DNA, 20 bp, human
gggagccgaggcacggccga

SEQ ID NO: 142834 - DNA, 20 bp, human
ggaggcggcggcgaagaaga

SEQ ID NO: 142835 - DNA, 20 bp, human
ggcggctgcgaggcaagcct

SEQ ID NO: 142836 - DNA, 20 bp, human
gcagactcgccgcccgccag

SEQ ID NO: 142837 - DNA, 20 bp, human
gaggctcaggtgaaaaggat

SEQ ID NO: 142838 - DNA, 20 bp, human
gggtgggtgtaatcctccag

SEQ ID NO: 142839 - DNA, 20 bp, human
gggacttgggaacctcagag

SEQ ID NO: 142840 - DNA, 20 bp, human
gcgcccagaaggggtgtcag

SEQ ID NO: 142841 - DNA, 20 bp, human
ggagcgcgcagtttgcgcgg

SEQ ID NO: 142842 - DNA, 20 bp, human
gtcacacattgaggactcta

SEQ ID NO: 142843 - DNA, 20 bp, human
gaccacaaagtgcgacgaca

SEQ ID NO: 142844 - DNA, 20 bp, human
gccccaccggacaagctgga

SEQ ID NO: 142845 - DNA, 20 bp, human
gctcaggtgaaaaggatggg

SEQ ID NO: 142846 - DNA, 20 bp, human
gccagtaaggtgagtactgt

SEQ ID NO: 142847 - DNA, 20 bp, human
gtagtcaagtgactctaaga

SEQ ID NO: 142848 - DNA, 20 bp, human
gagagtcacttgactagtgc

SEQ ID NO: 142849 - DNA, 20 bp, human
gtgccccagttgtagaataa

SEQ ID NO: 142850 - DNA, 20 bp, human
gcagtggggtgagggcagta

SEQ ID NO: 142851 - DNA, 20 bp, human
ggttgaagaaattcccagta

SEQ ID NO: 142852 - DNA, 20 bp, human
gcatactctgctttgccctg

SEQ ID NO: 142853 - DNA, 20 bp, human
gatcctttattctacaactg

SEQ ID NO: 142854 - DNA, 20 bp, human
gctctcagaaactgaaatac

SEQ ID NO: 142855 - DNA, 20 bp, human
gaatcgatattggttcttca

SEQ ID NO: 142856 - DNA, 20 bp, human
ggagcaataagtgcggaaaa

SEQ ID NO: 142857 - DNA, 20 bp, human
gtcacttgtgcggagcaggt

SEQ ID NO: 142858 - DNA, 20 bp, human
ggcagcgcgccctcccccga

SEQ ID NO: 142859 - DNA, 20 bp, human
gccgacggcagggaagttcg

SEQ ID NO: 142860 - DNA, 20 bp, human
ggaatatcgcggcggagcaa

SEQ ID NO: 142861 - DNA, 20 bp, human
gcggcggagcaacgggactc

SEQ ID NO: 142862 - DNA, 20 bp, human
gtaatgtcagagcagacatg

SEQ ID NO: 142863 - DNA, 20 bp, human
gtcttaggcgcagggaggag

SEQ ID NO: 142864 - DNA, 20 bp, human
gacggcagggaagttcgtgg

SEQ ID NO: 142865 - DNA, 20 bp, human
gcactgggagtccggcagca

SEQ ID NO: 142866 - DNA, 20 bp, human
gcacagccttgcagagacct

SEQ ID NO: 142867 - DNA, 20 bp, human
gggagaatgacaggaagact

SEQ ID NO: 142868 - DNA, 20 bp, human
gtgcctagcaaggcccagcc

SEQ ID NO: 142869 - DNA, 20 bp, human
ggagccagcaccggaatccc

SEQ ID NO: 142870 - DNA, 20 bp, human
gagtggccgaggtctctgca

SEQ ID NO: 142871 - DNA, 20 bp, human
gctgctccaccccgtgccta

SEQ ID NO: 142872 - DNA, 20 bp, human
ggcctgcctgccagatggaa

SEQ ID NO: 142873 - DNA, 20 bp, human
gggaagactaggtgagctca

SEQ ID NO: 142874 - DNA, 20 bp, human
gccctgctcagagcttggtg

SEQ ID NO: 142875 - DNA, 20 bp, human
gctcgtctccacgccgggaa

SEQ ID NO: 142876 - DNA, 20 bp, human
gagctcggccacgggtggcg

SEQ ID NO: 142877 - DNA, 20 bp, human
gtgctccactcagcatggtc

SEQ ID NO: 142878 - DNA, 20 bp, human
gccgacctacaaggccccag

SEQ ID NO: 142879 - DNA, 20 bp, human
ggcgaggctgcggtgaggcc

SEQ ID NO: 142880 - DNA, 20 bp, human
ggcaggacgggggagaccgg

SEQ ID NO: 142881 - DNA, 20 bp, human
gaccgcagcctcgccacccg

SEQ ID NO: 142882 - DNA, 20 bp, human
ggaccggggcaagaagactg

SEQ ID NO: 142883 - DNA, 20 bp, human
gggccagcgagttacctgag

SEQ ID NO: 142884 - DNA, 20 bp, human
gcagcgtgctccactcagca

SEQ ID NO: 142885 - DNA, 20 bp, human
ggtcctcgccgggcgcacag

SEQ ID NO: 142886 - DNA, 20 bp, human
gccgcccctggaacctacct

SEQ ID NO: 142887 - DNA, 20 bp, human
ggggccgagactaaatgtgg

SEQ ID NO: 142888 - DNA, 20 bp, human
gatggggccgagactaaatg

SEQ ID NO: 142889 - DNA, 20 bp, human
gcggccccatgaccgatagt

SEQ ID NO: 142890 - DNA, 20 bp, human
gctgccaaggtaggttccag

SEQ ID NO: 142891 - DNA, 20 bp, human
ggaggaactgaacccactat

SEQ ID NO: 142892 - DNA, 20 bp, human
gtaggctcccccgcccctgg

SEQ ID NO: 142893 - DNA, 20 bp, human
ggaacccactatcggtcatg

SEQ ID NO: 142894 - DNA, 20 bp, human
gagtgggttcagttcctcca

SEQ ID NO: 142895 - DNA, 20 bp, human
gagactcccaaagccgcccc

SEQ ID NO: 142896 - DNA, 20 bp, human
gtaaactcagctggtctcca

SEQ ID NO: 142897 - DNA, 20 bp, human
gttgtgagggataaatctca

SEQ ID NO: 142898 - DNA, 20 bp, human
gagactgaaacgcactctgg

SEQ ID NO: 142899 - DNA, 20 bp, human
gggtattgtaatgagtggaa

SEQ ID NO: 142900 - DNA, 20 bp, human
gagaactgttctgtgaagtt

SEQ ID NO: 142901 - DNA, 20 bp, human
gtctgtctttccgcattgtg

SEQ ID NO: 142902 - DNA, 20 bp, human
gagacaaacaagggattaac

SEQ ID NO: 142903 - DNA, 20 bp, human
gggaaaggtggcatttacaa

SEQ ID NO: 142904 - DNA, 20 bp, human
gtctgtagagtttgagtcac

SEQ ID NO: 142905 - DNA, 20 bp, human
ggagagactgaaacgcactc

SEQ ID NO: 142906 - DNA, 20 bp, human
ggacaaaccggcctttccgg

SEQ ID NO: 142907 - DNA, 20 bp, human
gaggctagtgaagagcgaca

SEQ ID NO: 142908 - DNA, 20 bp, human
ggaactggcaggacaggtag

SEQ ID NO: 142909 - DNA, 20 bp, human
gcgcgctcagtgagaggaaa

SEQ ID NO: 142910 - DNA, 20 bp, human
gcttctgctcgctcaggccg

SEQ ID NO: 142911 - DNA, 20 bp, human
gaggggtcttggctgaaggg

SEQ ID NO: 142912 - DNA, 20 bp, human
gcctatggtgagactgacac

SEQ ID NO: 142913 - DNA, 20 bp, human
gacgccgggtatccctgagt

SEQ ID NO: 142914 - DNA, 20 bp, human
gtagttctgcacaggcactg

SEQ ID NO: 142915 - DNA, 20 bp, human
gtccaagaagtggacagaca

SEQ ID NO: 142916 - DNA, 20 bp, human
ggccgggtgctggtgtacgg

SEQ ID NO: 142917 - DNA, 20 bp, human
gactcgggagagaattccaa

SEQ ID NO: 142918 - DNA, 20 bp, human
gcggggggcagtctagagga

SEQ ID NO: 142919 - DNA, 20 bp, human
ggaatgagacagcccagtcc

SEQ ID NO: 142920 - DNA, 20 bp, human
gcgagtcagggggtgcacag

SEQ ID NO: 142921 - DNA, 20 bp, human
ggacggagagagagtgtaga

SEQ ID NO: 142922 - DNA, 20 bp, human
gcgcgccgggtgctggtgta

SEQ ID NO: 142923 - DNA, 20 bp, human
gtgcaagcaacacgagtcag

SEQ ID NO: 142924 - DNA, 20 bp, human
gggtctcatgactagtaacc

SEQ ID NO: 142925 - DNA, 20 bp, human
ggtgcaaggaggtgctccgt

SEQ ID NO: 142926 - DNA, 20 bp, human
ggagcgcagtcggagcgcgg

SEQ ID NO: 142927 - DNA, 20 bp, human
gcggcgggcggagtgagctg

SEQ ID NO: 142928 - DNA, 20 bp, human
gtctgggctggtccccgccg

SEQ ID NO: 142929 - DNA, 20 bp, human
gccgcccgccggcctcgtga

SEQ ID NO: 142930 - DNA, 20 bp, human
gagctgcggagcctggaata

SEQ ID NO: 142931 - DNA, 20 bp, human
gggagcctggaatatggtcg

SEQ ID NO: 142932 - DNA, 20 bp, human
gggaagaggaggagcgcagt

SEQ ID NO: 142933 - DNA, 20 bp, human
gctgctggcgccggacgagg

SEQ ID NO: 142934 - DNA, 20 bp, human
gagggacgcgccgagccggg

SEQ ID NO: 142935 - DNA, 20 bp, human
ggaggagcgcagtcggagcg

SEQ ID NO: 142936 - DNA, 20 bp, human
ggatggcaggcggaagacac

SEQ ID NO: 142937 - DNA, 20 bp, human
ggaagacaccggcgcgtcgt

SEQ ID NO: 142938 - DNA, 20 bp, human
gctcccgctctgcctaggta

SEQ ID NO: 142939 - DNA, 20 bp, human
gccccactcgggaccctgga

SEQ ID NO: 142940 - DNA, 20 bp, human
gacccgctcccagacagact

SEQ ID NO: 142941 - DNA, 20 bp, human
ggtctgatgggggtgctgat

SEQ ID NO: 142942 - DNA, 20 bp, human
gcctgggctgcggtctgatg

SEQ ID NO: 142943 - DNA, 20 bp, human
gtgccctccagggtcccgag

SEQ ID NO: 142944 - DNA, 20 bp, human
ggagggtgcccacgacgcgc

SEQ ID NO: 142945 - DNA, 20 bp, human
gtgttctggagacgccaggg

SEQ ID NO: 142946 - DNA, 20 bp, human
ggctcagatgacgaagacgg

SEQ ID NO: 142947 - DNA, 20 bp, human
gtgaaacctgtaccagacca

SEQ ID NO: 142948 - DNA, 20 bp, human
gagcgcatgacccttaccaa

SEQ ID NO: 142949 - DNA, 20 bp, human
gtgggcctaaactcaatccg

SEQ ID NO: 142950 - DNA, 20 bp, human
gaagcggccatgcgttccgg

SEQ ID NO: 142951 - DNA, 20 bp, human
gctaaactcaatccgtggtc

SEQ ID NO: 142952 - DNA, 20 bp, human
gcggcaagagtggctccatg

SEQ ID NO: 142953 - DNA, 20 bp, human
gccgcggcccccggaacgca

SEQ ID NO: 142954 - DNA, 20 bp, human
ggacccttaccaaaggaata

SEQ ID NO: 142955 - DNA, 20 bp, human
gccgcgggcgaccccgcctg

SEQ ID NO: 142956 - DNA, 20 bp, human
gcctccaggcagggaatcac

SEQ ID NO: 142957 - DNA, 20 bp, human
gacccagctgcagaagggac

SEQ ID NO: 142958 - DNA, 20 bp, human
gagacagctgcaagtcacca

SEQ ID NO: 142959 - DNA, 20 bp, human
gcatggacgctgaaggtaaa

SEQ ID NO: 142960 - DNA, 20 bp, human
gtgttggctgctcaggacca

SEQ ID NO: 142961 - DNA, 20 bp, human
gaagtcaccatggacgctga

SEQ ID NO: 142962 - DNA, 20 bp, human
gctccttggggactcaacac

SEQ ID NO: 142963 - DNA, 20 bp, human
gggcagtgggggccggaagt

SEQ ID NO: 142964 - DNA, 20 bp, human
gggctgagacaagccagggt

SEQ ID NO: 142965 - DNA, 20 bp, human
gaggaggtggcgtctcctgg

SEQ ID NO: 142966 - DNA, 20 bp, human
gcagccctcccaggtcgtag

SEQ ID NO: 142967 - DNA, 20 bp, human
gccggctggtggagaagtat

SEQ ID NO: 142968 - DNA, 20 bp, human
gtacgcagccttggtcagcg

SEQ ID NO: 142969 - DNA, 20 bp, human
ggcaccgctacgacctggga

SEQ ID NO: 142970 - DNA, 20 bp, human
gctgtgggccaaatcccctg

SEQ ID NO: 142971 - DNA, 20 bp, human
ggtggacagctggctccgag

SEQ ID NO: 142972 - DNA, 20 bp, human
gccacagcgccgcctgcgag

SEQ ID NO: 142973 - DNA, 20 bp, human
ggtggggttggaccagggac

SEQ ID NO: 142974 - DNA, 20 bp, human
gctgccctgccagtacccca

SEQ ID NO: 142975 - DNA, 20 bp, human
gaccatgtggtggccgccgg

SEQ ID NO: 142976 - DNA, 20 bp, human
ggagagcccacagacgccat

SEQ ID NO: 142977 - DNA, 20 bp, human
gagcccacagacgccatggg

SEQ ID NO: 142978 - DNA, 20 bp, human
gggccacccatggcgtctgt

SEQ ID NO: 142979 - DNA, 20 bp, human
ggagggaagcaggcgcccag

SEQ ID NO: 142980 - DNA, 20 bp, human
gctgcgggggagaagaccag

SEQ ID NO: 142981 - DNA, 20 bp, human
gcacgacacccagatgatgt

SEQ ID NO: 142982 - DNA, 20 bp, human
gggagaacgctgggccgacc

SEQ ID NO: 142983 - DNA, 20 bp, human
gctgcagattccgcttcggg

SEQ ID NO: 142984 - DNA, 20 bp, human
gcctcggagctggagaacgc

SEQ ID NO: 142985 - DNA, 20 bp, human
ggaagaccagcggcccgtta

SEQ ID NO: 142986 - DNA, 20 bp, human
ggtgctggagcgccacgcga

SEQ ID NO: 142987 - DNA, 20 bp, human
gccagcaccccagaccgtgg

SEQ ID NO: 142988 - DNA, 20 bp, human
ggctccagcaccccagaccg

SEQ ID NO: 142989 - DNA, 20 bp, human
ggagcgccacgcgagggtcc

SEQ ID NO: 142990 - DNA, 20 bp, human
gtcgccttagggaagagcaa

SEQ ID NO: 142991 - DNA, 20 bp, human
gcatcgcatggccagaaggc

SEQ ID NO: 142992 - DNA, 20 bp, human
gtccgcatcgcatggccaga

SEQ ID NO: 142993 - DNA, 20 bp, human
gaccgctccccaagcgggtc

SEQ ID NO: 142994 - DNA, 20 bp, human
ggcgagggtcctggcgcctc

SEQ ID NO: 142995 - DNA, 20 bp, human
gtaccccggagcagttctct

SEQ ID NO: 142996 - DNA, 20 bp, human
gcgtcgctccaagaccgaca

SEQ ID NO: 142997 - DNA, 20 bp, human
gccgggaacgcgcacgtcgg

SEQ ID NO: 142998 - DNA, 20 bp, human
gagcgacgacggcagaacca

SEQ ID NO: 142999 - DNA, 20 bp, human
ggaatgtaagatggcgccca

SEQ ID NO: 143000 - DNA, 20 bp, human
gctcctagagcagagatatc

SEQ ID NO: 143001 - DNA, 20 bp, human
gagagcagagatatccgggc

SEQ ID NO: 143002 - DNA, 20 bp, human
gggcccaccccacacaacgg

SEQ ID NO: 143003 - DNA, 20 bp, human
gtgtggcccgtgggcaaccg

SEQ ID NO: 143004 - DNA, 20 bp, human
gcgcccccctcacagaggag

SEQ ID NO: 143005 - DNA, 20 bp, human
ggctgtaggcctgagacggg

SEQ ID NO: 143006 - DNA, 20 bp, human
gagggtgagcacgcacacgg

SEQ ID NO: 143007 - DNA, 20 bp, human
gggactgcaaggtagagcat

SEQ ID NO: 143008 - DNA, 20 bp, human
ggagagccaagtgaaggacc

SEQ ID NO: 143009 - DNA, 20 bp, human
gagcagctcaagcgtgtgga

SEQ ID NO: 143010 - DNA, 20 bp, human
gagcaagcagctcaagcgtg

SEQ ID NO: 143011 - DNA, 20 bp, human
gaacgccaccaaaaggccta

SEQ ID NO: 143012 - DNA, 20 bp, human
gcttgctcaggtcctccacc

SEQ ID NO: 143013 - DNA, 20 bp, human
gctctaccttgcagtccacg

SEQ ID NO: 143014 - DNA, 20 bp, human
gctcaagcgtgtggacggcc

SEQ ID NO: 143015 - DNA, 20 bp, human
gtccagctcggggaggccct

SEQ ID NO: 143016 - DNA, 20 bp, human
gcgaggtgggccaagatgcg

SEQ ID NO: 143017 - DNA, 20 bp, human
gcaccacaggagccaggcaa

SEQ ID NO: 143018 - DNA, 20 bp, human
gagggggaaaaagaggtcac

SEQ ID NO: 143019 - DNA, 20 bp, human
gatccggatggtctcggagt

SEQ ID NO: 143020 - DNA, 20 bp, human
gtggccccgcaagccccctt

SEQ ID NO: 143021 - DNA, 20 bp, human
gccaagtactcggtgttgaa

SEQ ID NO: 143022 - DNA, 20 bp, human
gatgtaacatcactagcgac

SEQ ID NO: 143023 - DNA, 20 bp, human
ggtgtaggtcgggatccgga

SEQ ID NO: 143024 - DNA, 20 bp, human
gtctgcaccgcggatctgta

SEQ ID NO: 143025 - DNA, 20 bp, human
ggtcgggatccggatggtct

SEQ ID NO: 143026 - DNA, 20 bp, human
gctacccgcgaccaccccgt

SEQ ID NO: 143027 - DNA, 20 bp, human
gtcgccctcggccagctcgg

SEQ ID NO: 143028 - DNA, 20 bp, human
ggcagtggcagctgcagtag

SEQ ID NO: 143029 - DNA, 20 bp, human
gaggcggctgatgactccta

SEQ ID NO: 143030 - DNA, 20 bp, human
gagcagcgggggatcctcca

SEQ ID NO: 143031 - DNA, 20 bp, human
gccagcctcaaggccaggta

SEQ ID NO: 143032 - DNA, 20 bp, human
gacaggaactacgcgacctc

SEQ ID NO: 143033 - DNA, 20 bp, human
gtagttcctgtccatcgtgg

SEQ ID NO: 143034 - DNA, 20 bp, human
gccgtcacacggagccctgg

SEQ ID NO: 143035 - DNA, 20 bp, human
ggctgatgactcctacgggg

SEQ ID NO: 143036 - DNA, 20 bp, human
gcgcagcgccgaggatgagg

SEQ ID NO: 143037 - DNA, 20 bp, human
ggagcgcagcgccgaggatg

SEQ ID NO: 143038 - DNA, 20 bp, human
gcaggaggcgaagaactcca

SEQ ID NO: 143039 - DNA, 20 bp, human
gtgttgcacctcctcatcct

SEQ ID NO: 143040 - DNA, 20 bp, human
gatgcagtggccgcaccagg

SEQ ID NO: 143041 - DNA, 20 bp, human
gagggacgcgctcccggagt

SEQ ID NO: 143042 - DNA, 20 bp, human
ggatgagggccaagaggaaa

SEQ ID NO: 143043 - DNA, 20 bp, human
ggacgcgctcccggagtagg

SEQ ID NO: 143044 - DNA, 20 bp, human
gacatgaaggtggtgggcgt

SEQ ID NO: 143045 - DNA, 20 bp, human
gcgctggccgaagacgtcaa

SEQ ID NO: 143046 - DNA, 20 bp, human
gccgtgtgggtgctggacag

SEQ ID NO: 143047 - DNA, 20 bp, human
gcgagtcgggtgcctctgtg

SEQ ID NO: 143048 - DNA, 20 bp, human
gggcggcacttccaacatgg

SEQ ID NO: 143049 - DNA, 20 bp, human
gggtaaggaaagaaatacgg

SEQ ID NO: 143050 - DNA, 20 bp, human
ggccggcggcacttccaaca

SEQ ID NO: 143051 - DNA, 20 bp, human
gcgcagcccgggaatcggag

SEQ ID NO: 143052 - DNA, 20 bp, human
gttgcgaccgccccagaagg

SEQ ID NO: 143053 - DNA, 20 bp, human
gcagccagggcccgccaagt

SEQ ID NO: 143054 - DNA, 20 bp, human
gtggcgcgcagcccgggaat

SEQ ID NO: 143055 - DNA, 20 bp, human
gcacgcggccgagctgttgg

SEQ ID NO: 143056 - DNA, 20 bp, human
gatccgtggggccgactcca

SEQ ID NO: 143057 - DNA, 20 bp, human
ggccccacggatcatgcggc

SEQ ID NO: 143058 - DNA, 20 bp, human
ggccgactccagggaagcct

SEQ ID NO: 143059 - DNA, 20 bp, human
ggttccgacagtcaagatgg

SEQ ID NO: 143060 - DNA, 20 bp, human
gggccttagacccagatggt

SEQ ID NO: 143061 - DNA, 20 bp, human
ggtggttccgacagtcaaga

SEQ ID NO: 143062 - DNA, 20 bp, human
gaccagccgcatgatccgtg

SEQ ID NO: 143063 - DNA, 20 bp, human
ggcacgcaggccaccatgaa

SEQ ID NO: 143064 - DNA, 20 bp, human
gatggcgggagcagctaccc

SEQ ID NO: 143065 - DNA, 20 bp, human
ggtcggccccacggatcatg

SEQ ID NO: 143066 - DNA, 20 bp, human
gcacgtggtagtgaactgtg

SEQ ID NO: 143067 - DNA, 20 bp, human
ggacggtcccaccctcccat

SEQ ID NO: 143068 - DNA, 20 bp, human
gctgattggctctgcactgg

SEQ ID NO: 143069 - DNA, 20 bp, human
gccaggtgcctagggaggtc

SEQ ID NO: 143070 - DNA, 20 bp, human
gctggctcagagattgaaga

SEQ ID NO: 143071 - DNA, 20 bp, human
gaagggaagcagaggagaca

SEQ ID NO: 143072 - DNA, 20 bp, human
gatctctgagccaggtgcct

SEQ ID NO: 143073 - DNA, 20 bp, human
gcaccctcccatgggcagtt

SEQ ID NO: 143074 - DNA, 20 bp, human
ggctgtctctggaaacacct

SEQ ID NO: 143075 - DNA, 20 bp, human
gatggagcaaagataaatcc

SEQ ID NO: 143076 - DNA, 20 bp, human
ggagagcctgtaagagagac

SEQ ID NO: 143077 - DNA, 20 bp, human
gtggcccctggggacgccga

SEQ ID NO: 143078 - DNA, 20 bp, human
gagcggcccgggtctctcta

SEQ ID NO: 143079 - DNA, 20 bp, human
ggcggctgcgacgcgccgag

SEQ ID NO: 143080 - DNA, 20 bp, human
ggtcattctcggctgaggag

SEQ ID NO: 143081 - DNA, 20 bp, human
ggggacccccggcaagtcag

SEQ ID NO: 143082 - DNA, 20 bp, human
gcggtggacgaagtcattct

SEQ ID NO: 143083 - DNA, 20 bp, human
gcggtgagtgcagcagcact

SEQ ID NO: 143084 - DNA, 20 bp, human
gcgcaacgccggcaccgaaa

SEQ ID NO: 143085 - DNA, 20 bp, human
gcagttcctcctggatccgg

SEQ ID NO: 143086 - DNA, 20 bp, human
ggaactcacaacgatactgg

SEQ ID NO: 143087 - DNA, 20 bp, human
ggggcacattcctatctctt

SEQ ID NO: 143088 - DNA, 20 bp, human
gtggttatctgagcttcagt

SEQ ID NO: 143089 - DNA, 20 bp, human
gagtatcgttgtgagttctc

SEQ ID NO: 143090 - DNA, 20 bp, human
gctttactaacccttgtact

SEQ ID NO: 143091 - DNA, 20 bp, human
gtttgcaggtaagttcttaa

SEQ ID NO: 143092 - DNA, 20 bp, human
gaggtaagttcttaacggtt

SEQ ID NO: 143093 - DNA, 20 bp, human
ggcttgtgtcttcaacactt

SEQ ID NO: 143094 - DNA, 20 bp, human
ggtaattatgtcattctcta

SEQ ID NO: 143095 - DNA, 20 bp, human
ggataaccacagtagttatt

SEQ ID NO: 143096 - DNA, 20 bp, human
gggagggtccctctcaaccg

SEQ ID NO: 143097 - DNA, 20 bp, human
gatacggggctggttgttac

SEQ ID NO: 143098 - DNA, 20 bp, human
gtagagcttcgcggagacgg

SEQ ID NO: 143099 - DNA, 20 bp, human
gatcctagcttgaggtacag

SEQ ID NO: 143100 - DNA, 20 bp, human
gggcctgacgcgcgccccag

SEQ ID NO: 143101 - DNA, 20 bp, human
ggtacagagggaggggatac

SEQ ID NO: 143102 - DNA, 20 bp, human
gtagcttgaggtacagaggg

SEQ ID NO: 143103 - DNA, 20 bp, human
gagcgaagcccggaaaccgc

SEQ ID NO: 143104 - DNA, 20 bp, human
gttcgcggagacggcggaag

SEQ ID NO: 143105 - DNA, 20 bp, human
ggggctgtgaagggagaagt

SEQ ID NO: 143106 - DNA, 20 bp, human
gcgccaaccggtagcgctaa

SEQ ID NO: 143107 - DNA, 20 bp, human
ggagcaaggcgcgttattcc

SEQ ID NO: 143108 - DNA, 20 bp, human
ggcccggacaccggctccag

SEQ ID NO: 143109 - DNA, 20 bp, human
ggctagtgcgtggtgggaag

SEQ ID NO: 143110 - DNA, 20 bp, human
gtcctccgctaggcctcgag

SEQ ID NO: 143111 - DNA, 20 bp, human
gcaagtaagagtcttacgaa

SEQ ID NO: 143112 - DNA, 20 bp, human
ggtagcgctaacggagaagg

SEQ ID NO: 143113 - DNA, 20 bp, human
gtcacatggcccccgggtgg

SEQ ID NO: 143114 - DNA, 20 bp, human
gcggtgtccgggctggtgat

SEQ ID NO: 143115 - DNA, 20 bp, human
gacccctcgaggcctagcgg

SEQ ID NO: 143116 - DNA, 20 bp, human
gtgtgcagtgagctctatag

SEQ ID NO: 143117 - DNA, 20 bp, human
gcaatgccagactaatcagc

SEQ ID NO: 143118 - DNA, 20 bp, human
ggaaatatcaaacatgtgag

SEQ ID NO: 143119 - DNA, 20 bp, human
gtctaaagcacttgccgagg

SEQ ID NO: 143120 - DNA, 20 bp, human
gtgctttagactgctctagc

SEQ ID NO: 143121 - DNA, 20 bp, human
gcagtctaaagcacttgccg

SEQ ID NO: 143122 - DNA, 20 bp, human
gcaaataccaattagcacac

SEQ ID NO: 143123 - DNA, 20 bp, human
gttgtaacttactgatagaa

SEQ ID NO: 143124 - DNA, 20 bp, human
gggtttacctgtgtgctaat

SEQ ID NO: 143125 - DNA, 20 bp, human
gcatcagtttacaggtacta

SEQ ID NO: 143126 - DNA, 20 bp, human
gtgccgggcgcgaggaaccc

SEQ ID NO: 143127 - DNA, 20 bp, human
gagccggtcccggggacgat

SEQ ID NO: 143128 - DNA, 20 bp, human
ggggcggcgggcggagacgt

SEQ ID NO: 143129 - DNA, 20 bp, human
gaacccggaaagggagaaaa

SEQ ID NO: 143130 - DNA, 20 bp, human
gcttggagcagtccttcccg

SEQ ID NO: 143131 - DNA, 20 bp, human
gggggaaccaaacccggaaa

SEQ ID NO: 143132 - DNA, 20 bp, human
ggcagcggggggcggactct

SEQ ID NO: 143133 - DNA, 20 bp, human
gccaccccgaagcactggaa

SEQ ID NO: 143134 - DNA, 20 bp, human
gggcggcggcgcgcttctgg

SEQ ID NO: 143135 - DNA, 20 bp, human
gacgatgggtcagggtcgga

SEQ ID NO: 143136 - DNA, 20 bp, human
gagtgacgggcgcccggagg

SEQ ID NO: 143137 - DNA, 20 bp, human
gcgcccggcagggccttcac

SEQ ID NO: 143138 - DNA, 20 bp, human
gcgcctccgggccgcactcg

SEQ ID NO: 143139 - DNA, 20 bp, human
ggggcggaccggggagtagg

SEQ ID NO: 143140 - DNA, 20 bp, human
gggcggggagaggatctcag

SEQ ID NO: 143141 - DNA, 20 bp, human
ggcgcggaccggggattagg

SEQ ID NO: 143142 - DNA, 20 bp, human
gcgctggagaaccccgagtg

SEQ ID NO: 143143 - DNA, 20 bp, human
gcacagcgggcgagaaggga

SEQ ID NO: 143144 - DNA, 20 bp, human
gcgggagcgaggggaacgaa

SEQ ID NO: 143145 - DNA, 20 bp, human
ggggttctccagcgcgacca

SEQ ID NO: 143146 - DNA, 20 bp, human
ggacagacaaggtagtgcaa

SEQ ID NO: 143147 - DNA, 20 bp, human
gtcaggcaggagtcaggctg

SEQ ID NO: 143148 - DNA, 20 bp, human
ggacccccagcataaaggag

SEQ ID NO: 143149 - DNA, 20 bp, human
gtgaagctcaagtgaggagg

SEQ ID NO: 143150 - DNA, 20 bp, human
ggacacaggagctatcaggc

SEQ ID NO: 143151 - DNA, 20 bp, human
gcgccccactggtaaaacat

SEQ ID NO: 143152 - DNA, 20 bp, human
gtcctggacccccagcataa

SEQ ID NO: 143153 - DNA, 20 bp, human
gccccagcataaaggagggg

SEQ ID NO: 143154 - DNA, 20 bp, human
ggaggacacgcagaatgacg

SEQ ID NO: 143155 - DNA, 20 bp, human
gagaccctgagccccgacac

SEQ ID NO: 143156 - DNA, 20 bp, human
gtccaacagtgccgacccag

SEQ ID NO: 143157 - DNA, 20 bp, human
gccggaagggacactgcggg

SEQ ID NO: 143158 - DNA, 20 bp, human
gtctggaccagagctgcatc

SEQ ID NO: 143159 - DNA, 20 bp, human
ggtacacactggcccggatg

SEQ ID NO: 143160 - DNA, 20 bp, human
ggccgccaacatggaataca

SEQ ID NO: 143161 - DNA, 20 bp, human
gtggttgtgataatccagta

SEQ ID NO: 143162 - DNA, 20 bp, human
gcactgttggagaacgctca

SEQ ID NO: 143163 - DNA, 20 bp, human
gcccagaggatgctgcctcc

SEQ ID NO: 143164 - DNA, 20 bp, human
ggccgcatagccgtgctctc

SEQ ID NO: 143165 - DNA, 20 bp, human
gccggggctggggtagcatt

SEQ ID NO: 143166 - DNA, 20 bp, human
gagagggcacggggaaaagg

SEQ ID NO: 143167 - DNA, 20 bp, human
gcgcgcacgccggcgtgaga

SEQ ID NO: 143168 - DNA, 20 bp, human
ggcctgagaacgcccgagtg

SEQ ID NO: 143169 - DNA, 20 bp, human
gggatcggtccctctcacta

SEQ ID NO: 143170 - DNA, 20 bp, human
ggtgggaaaaaggctcgaga

SEQ ID NO: 143171 - DNA, 20 bp, human
ggccggcggccccaagggat

SEQ ID NO: 143172 - DNA, 20 bp, human
ggaacgcccgagtgaggagt

SEQ ID NO: 143173 - DNA, 20 bp, human
gggggtggctcggtttcctg

SEQ ID NO: 143174 - DNA, 20 bp, human
gtcggccgggacgctcccac

SEQ ID NO: 143175 - DNA, 20 bp, human
gtttgaggaagccccgacag

SEQ ID NO: 143176 - DNA, 20 bp, human
ggcgcggccgaggagcgaaa

SEQ ID NO: 143177 - DNA, 20 bp, human
gggagcagcagtggtatctg

SEQ ID NO: 143178 - DNA, 20 bp, human
gggccgaggagcgaaagggc

SEQ ID NO: 143179 - DNA, 20 bp, human
ggtggtatctgtgggaccag

SEQ ID NO: 143180 - DNA, 20 bp, human
gggagaaggcagtccgccag

SEQ ID NO: 143181 - DNA, 20 bp, human
gacccgaaaagagagatggt

SEQ ID NO: 143182 - DNA, 20 bp, human
gccagcgaaggcctatggag

SEQ ID NO: 143183 - DNA, 20 bp, human
gagaggacgcgagctgggaa

SEQ ID NO: 143184 - DNA, 20 bp, human
gggcggggccgtagaacccg

SEQ ID NO: 143185 - DNA, 20 bp, human
ggccaggggaaggacacgca

SEQ ID NO: 143186 - DNA, 20 bp, human
ggcggtgggagaggctgtta

SEQ ID NO: 143187 - DNA, 20 bp, human
ggcccggcccgccaaatctt

SEQ ID NO: 143188 - DNA, 20 bp, human
gatgggcgtgaccaataggt

SEQ ID NO: 143189 - DNA, 20 bp, human
gcggttgaatggcctatcag

SEQ ID NO: 143190 - DNA, 20 bp, human
gaaagctccaccccctgcgg

SEQ ID NO: 143191 - DNA, 20 bp, human
ggggaaagctccaccccctg

SEQ ID NO: 143192 - DNA, 20 bp, human
gccggaagcgccaggacaat

SEQ ID NO: 143193 - DNA, 20 bp, human
gtcggtgtcctggagaaagg

SEQ ID NO: 143194 - DNA, 20 bp, human
gccgtcgggtgtttgtggtg

SEQ ID NO: 143195 - DNA, 20 bp, human
ggggaaggccggagccgacc

SEQ ID NO: 143196 - DNA, 20 bp, human
gcctgcgggccaagggcccc

SEQ ID NO: 143197 - DNA, 20 bp, human
gcggccagccgagaccatta

SEQ ID NO: 143198 - DNA, 20 bp, human
gccgtggaggccgccagtcg

SEQ ID NO: 143199 - DNA, 20 bp, human
ggccgagaccattagggaca

SEQ ID NO: 143200 - DNA, 20 bp, human
gaggctgcgctccgacacgg

SEQ ID NO: 143201 - DNA, 20 bp, human
ggtccggaggacagcagcga

SEQ ID NO: 143202 - DNA, 20 bp, human
gaggagaagatcgccgcgac

SEQ ID NO: 143203 - DNA, 20 bp, human
gcgataacactccagaagcg

SEQ ID NO: 143204 - DNA, 20 bp, human
gagaagatcgccgcgactgg

SEQ ID NO: 143205 - DNA, 20 bp, human
gccagaccgccctgccggag

SEQ ID NO: 143206 - DNA, 20 bp, human
ggccggcggctcctaacacc

SEQ ID NO: 143207 - DNA, 20 bp, human
gctggccacacggacccggg

SEQ ID NO: 143208 - DNA, 20 bp, human
gggcggctcctaacaccggg

SEQ ID NO: 143209 - DNA, 20 bp, human
gccggcgccggcgggacgtg

SEQ ID NO: 143210 - DNA, 20 bp, human
gggcgcggccaggtgatggt

SEQ ID NO: 143211 - DNA, 20 bp, human
gcggctgcggcggcacttcc

SEQ ID NO: 143212 - DNA, 20 bp, human
gccctccgcccgggtccgtg

SEQ ID NO: 143213 - DNA, 20 bp, human
ggggctgcgggcgcttggtt

SEQ ID NO: 143214 - DNA, 20 bp, human
gcagccgcccgcccggtgtt

SEQ ID NO: 143215 - DNA, 20 bp, human
gggccaggggtgcagaattg

SEQ ID NO: 143216 - DNA, 20 bp, human
gcaggatgaggagactaagg

SEQ ID NO: 143217 - DNA, 20 bp, human
gtgaggcgcggtgcgaagat

SEQ ID NO: 143218 - DNA, 20 bp, human
gaaggaggctgaggcgcctg

SEQ ID NO: 143219 - DNA, 20 bp, human
ggcggcggcgttagttctcc

SEQ ID NO: 143220 - DNA, 20 bp, human
gttagttctccgggtacctc

SEQ ID NO: 143221 - DNA, 20 bp, human
gccgaggaggccggaggccg

SEQ ID NO: 143222 - DNA, 20 bp, human
gcatgctcccgagaggctag

SEQ ID NO: 143223 - DNA, 20 bp, human
gagggcggcgaggatccggg

SEQ ID NO: 143224 - DNA, 20 bp, human
gtacgcctcggagcgcccgt

SEQ ID NO: 143225 - DNA, 20 bp, human
ggggcgcgggcggcagacaa

SEQ ID NO: 143226 - DNA, 20 bp, human
gggccgcggcgaaaatggga

SEQ ID NO: 143227 - DNA, 20 bp, human
ggagcgcagcagagccgcgg

SEQ ID NO: 143228 - DNA, 20 bp, human
ggcgcggcgcagacccagac

SEQ ID NO: 143229 - DNA, 20 bp, human
gcgccccactcgggaggacg

SEQ ID NO: 143230 - DNA, 20 bp, human
gtgtgcggccgcgaccccga

SEQ ID NO: 143231 - DNA, 20 bp, human
gcggggacgctgcagacaaa

SEQ ID NO: 143232 - DNA, 20 bp, human
gcacgcgcaggaagccgtcg

SEQ ID NO: 143233 - DNA, 20 bp, human
gcgcgtgggccgccccactc

SEQ ID NO: 143234 - DNA, 20 bp, human
gcggcgcagacccagacggg

SEQ ID NO: 143235 - DNA, 20 bp, human
ggagcccgcgtcctcccgag

SEQ ID NO: 143236 - DNA, 20 bp, human
gacccggccgcggcagaagg

SEQ ID NO: 143237 - DNA, 20 bp, human
ggcactcctcacgccactcg

SEQ ID NO: 143238 - DNA, 20 bp, human
ggcccccggcggcagctcga

SEQ ID NO: 143239 - DNA, 20 bp, human
gccagcccagcccgcagctg

SEQ ID NO: 143240 - DNA, 20 bp, human
gcggtggtggagaagacgca

SEQ ID NO: 143241 - DNA, 20 bp, human
gatgagcgagcggtgcatgg

SEQ ID NO: 143242 - DNA, 20 bp, human
gcgcggccagcggcccggtg

SEQ ID NO: 143243 - DNA, 20 bp, human
ggagaagtacagtacgtcgg

SEQ ID NO: 143244 - DNA, 20 bp, human
gcgcgagaagtacagtacgt

SEQ ID NO: 143245 - DNA, 20 bp, human
ggtgagcaccagctcgcagg

SEQ ID NO: 143246 - DNA, 20 bp, human
gagcagctactccgcagtag

SEQ ID NO: 143247 - DNA, 20 bp, human
gggcctctcggtgaaactag

SEQ ID NO: 143248 - DNA, 20 bp, human
gaggcctgcaagtccaccgt

SEQ ID NO: 143249 - DNA, 20 bp, human
ggcctcgcagaaggtgtcgt

SEQ ID NO: 143250 - DNA, 20 bp, human
gggcagcagcatcccggacg

SEQ ID NO: 143251 - DNA, 20 bp, human
gcaagggcaggtctgcccgg

SEQ ID NO: 143252 - DNA, 20 bp, human
ggccgtggcgcccttaccca

SEQ ID NO: 143253 - DNA, 20 bp, human
gaggcagggccgggggccaa

SEQ ID NO: 143254 - DNA, 20 bp, human
gccggaggaagcagcccccc

SEQ ID NO: 143255 - DNA, 20 bp, human
ggtcggtgaagcgctccatc

SEQ ID NO: 143256 - DNA, 20 bp, human
ggggagcgcccggcactggt

SEQ ID NO: 143257 - DNA, 20 bp, human
gactggtaggcgggactgga

SEQ ID NO: 143258 - DNA, 20 bp, human
ggtaggcgggactggacggt

SEQ ID NO: 143259 - DNA, 20 bp, human
gcggcactggtaggcgggac

SEQ ID NO: 143260 - DNA, 20 bp, human
gagcgcccggcactggtagg

SEQ ID NO: 143261 - DNA, 20 bp, human
gagccggagaaggaggtcac

SEQ ID NO: 143262 - DNA, 20 bp, human
gtaccaagaaaatgaggagc

SEQ ID NO: 143263 - DNA, 20 bp, human
ggttggcaaacagagcggca

SEQ ID NO: 143264 - DNA, 20 bp, human
gggtggggagcgcccggcac

SEQ ID NO: 143265 - DNA, 20 bp, human
gcggacaccgggggagccgg

SEQ ID NO: 143266 - DNA, 20 bp, human
ggctccctcagtatcttcct

SEQ ID NO: 143267 - DNA, 20 bp, human
gttacctggggggttgctgg

SEQ ID NO: 143268 - DNA, 20 bp, human
gcagcccgaggaagatactg

SEQ ID NO: 143269 - DNA, 20 bp, human
ggcgctcaccgccgacccac

SEQ ID NO: 143270 - DNA, 20 bp, human
ggaggcgccggcaggtacac

SEQ ID NO: 143271 - DNA, 20 bp, human
gatcagccggccggacacta

SEQ ID NO: 143272 - DNA, 20 bp, human
gccgtggctagcccgtgggt

SEQ ID NO: 143273 - DNA, 20 bp, human
ggcgccccgccggttgggga

SEQ ID NO: 143274 - DNA, 20 bp, human
gctccgaggcgtgcagggaa

SEQ ID NO: 143275 - DNA, 20 bp, human
ggccggcctgacaggactcc

SEQ ID NO: 143276 - DNA, 20 bp, human
gcggcacccagcgagcgagt

SEQ ID NO: 143277 - DNA, 20 bp, human
gtgcctgccgtccggaccag

SEQ ID NO: 143278 - DNA, 20 bp, human
ggaggaattgccagcccctc

SEQ ID NO: 143279 - DNA, 20 bp, human
gcatcaaaccgagaaaccgg

SEQ ID NO: 143280 - DNA, 20 bp, human
gggagtccgggataaatctc

SEQ ID NO: 143281 - DNA, 20 bp, human
gaccccacccctggtccgga

SEQ ID NO: 143282 - DNA, 20 bp, human
gctccaccatcggtaagggg

SEQ ID NO: 143283 - DNA, 20 bp, human
ggccccgctggccccagtca

SEQ ID NO: 143284 - DNA, 20 bp, human
ggccaccgcctccagccgga

SEQ ID NO: 143285 - DNA, 20 bp, human
gcggtgggaggagaaaccgg

SEQ ID NO: 143286 - DNA, 20 bp, human
gcagtccagggtcagatcct

SEQ ID NO: 143287 - DNA, 20 bp, human
gcttggcgctggggtccagt

SEQ ID NO: 143288 - DNA, 20 bp, human
gttcagggcaaagtccacag

SEQ ID NO: 143289 - DNA, 20 bp, human
ggtcagctagaagccatccc

SEQ ID NO: 143290 - DNA, 20 bp, human
ggcttctagctgacagtggg

SEQ ID NO: 143291 - DNA, 20 bp, human
gggtgaccacatgaccactg

SEQ ID NO: 143292 - DNA, 20 bp, human
gggtccagtgggcattgctc

SEQ ID NO: 143293 - DNA, 20 bp, human
ggtggtcatgtggtcacctg

SEQ ID NO: 143294 - DNA, 20 bp, human
gcccatgtgtgtataatcaa

SEQ ID NO: 143295 - DNA, 20 bp, human
ggagacaggtagcaacgctg

SEQ ID NO: 143296 - DNA, 20 bp, human
gctgtctcctgggccgcgac

SEQ ID NO: 143297 - DNA, 20 bp, human
gcggccagctgggctcggag

SEQ ID NO: 143298 - DNA, 20 bp, human
gctgggctcggagcggaacg

SEQ ID NO: 143299 - DNA, 20 bp, human
gcaggagacagcagccaccg

SEQ ID NO: 143300 - DNA, 20 bp, human
ggagcggaacggggtcagga

SEQ ID NO: 143301 - DNA, 20 bp, human
gctcggagcggaacggggtc

SEQ ID NO: 143302 - DNA, 20 bp, human
gcgggaactgtaaactgcag

SEQ ID NO: 143303 - DNA, 20 bp, human
ggccttgcctcgaacctctc

SEQ ID NO: 143304 - DNA, 20 bp, human
ggaaggtggcagacgtggag

SEQ ID NO: 143305 - DNA, 20 bp, human
ggtgcgggtcgtgacgaggg

SEQ ID NO: 143306 - DNA, 20 bp, human
gacgccaaacccgacacctg

SEQ ID NO: 143307 - DNA, 20 bp, human
gagaggtccaagagaggtat

SEQ ID NO: 143308 - DNA, 20 bp, human
gtagttctggccccaggtgt

SEQ ID NO: 143309 - DNA, 20 bp, human
gcggcgggaggacatcatcg

SEQ ID NO: 143310 - DNA, 20 bp, human
gtcccaccaagcagcgaggc

SEQ ID NO: 143311 - DNA, 20 bp, human
gcacttcccaccaagcagcg

SEQ ID NO: 143312 - DNA, 20 bp, human
gcaagacaccggaagtggaa

SEQ ID NO: 143313 - DNA, 20 bp, human
gtggccccaggtgtcgggtt

SEQ ID NO: 143314 - DNA, 20 bp, human
gctcctgcctcgctgcttgg

SEQ ID NO: 143315 - DNA, 20 bp, human
gaagccttgctgggaggcac

SEQ ID NO: 143316 - DNA, 20 bp, human
gtgttctaggggacggagta

SEQ ID NO: 143317 - DNA, 20 bp, human
ggccggcgaaccaggaaata

SEQ ID NO: 143318 - DNA, 20 bp, human
gagcgatagctgagtggcgg

SEQ ID NO: 143319 - DNA, 20 bp, human
ggagccgcccgggcctggac

SEQ ID NO: 143320 - DNA, 20 bp, human
ggacccggtccaggcccggg

SEQ ID NO: 143321 - DNA, 20 bp, human
gcccgggcggctcacccctc

SEQ ID NO: 143322 - DNA, 20 bp, human
gcccgtggcgcggagagtca

SEQ ID NO: 143323 - DNA, 20 bp, human
gcccattgtctgacgcggag

SEQ ID NO: 143324 - DNA, 20 bp, human
ggtcctagccagcgagtcag

SEQ ID NO: 143325 - DNA, 20 bp, human
ggcggctgcggcagcaaggg

SEQ ID NO: 143326 - DNA, 20 bp, human
gcactattcggggttcatgg

SEQ ID NO: 143327 - DNA, 20 bp, human
gggcggagcggccaccatct

SEQ ID NO: 143328 - DNA, 20 bp, human
gagacgggctccaaaactcc

SEQ ID NO: 143329 - DNA, 20 bp, human
ggaccagaaactatcaagac

SEQ ID NO: 143330 - DNA, 20 bp, human
gggcttgggccctttaggtc

SEQ ID NO: 143331 - DNA, 20 bp, human
gggatcgaggctgcgctgga

SEQ ID NO: 143332 - DNA, 20 bp, human
gaggctgcgctggacggcgc

SEQ ID NO: 143333 - DNA, 20 bp, human
gccagacgtggcgaccccca

SEQ ID NO: 143334 - DNA, 20 bp, human
gcgcacccggggcccagacg

SEQ ID NO: 143335 - DNA, 20 bp, human
gggggctcactcactattcg

SEQ ID NO: 143336 - DNA, 20 bp, human
gacgcccgggagctcaagag

SEQ ID NO: 143337 - DNA, 20 bp, human
gccagcaagggaggacgagt

SEQ ID NO: 143338 - DNA, 20 bp, human
gcgtccccggcggagcccca

SEQ ID NO: 143339 - DNA, 20 bp, human
gtgagctcccgggcgtccgg

SEQ ID NO: 143340 - DNA, 20 bp, human
gcgtccggaggcgaaggtcc

SEQ ID NO: 143341 - DNA, 20 bp, human
ggctgcagcggtatatggag

SEQ ID NO: 143342 - DNA, 20 bp, human
ggtgggaaaccccgagaagg

SEQ ID NO: 143343 - DNA, 20 bp, human
gcagggcggtgtggctcatg

SEQ ID NO: 143344 - DNA, 20 bp, human
gcggacacggtcagcacggt

SEQ ID NO: 143345 - DNA, 20 bp, human
gaggtcactgagtggctgag

SEQ ID NO: 143346 - DNA, 20 bp, human
gtcgggcggccgggaagcga

SEQ ID NO: 143347 - DNA, 20 bp, human
gcggccgggaagcgacggga

SEQ ID NO: 143348 - DNA, 20 bp, human
gggccccagcccaccacgtc

SEQ ID NO: 143349 - DNA, 20 bp, human
ggaggtccgcacctgcagag

SEQ ID NO: 143350 - DNA, 20 bp, human
gccaccacgtcaggcaccgg

SEQ ID NO: 143351 - DNA, 20 bp, human
gggaaggagacgccattaga

SEQ ID NO: 143352 - DNA, 20 bp, human
gctggggaatcaccaggtcg

SEQ ID NO: 143353 - DNA, 20 bp, human
gtacatccaggggaccaggg

SEQ ID NO: 143354 - DNA, 20 bp, human
gacccgaggtgtgacgtagg

SEQ ID NO: 143355 - DNA, 20 bp, human
ggccaccacggggaacactg

SEQ ID NO: 143356 - DNA, 20 bp, human
ggctggagggagggtccacg

SEQ ID NO: 143357 - DNA, 20 bp, human
gggcggctcccggaaggccg

SEQ ID NO: 143358 - DNA, 20 bp, human
ggccatggcccgggagccag

SEQ ID NO: 143359 - DNA, 20 bp, human
gggacggctcccgagctgga

SEQ ID NO: 143360 - DNA, 20 bp, human
gcgcggccggcgtcccaaga

SEQ ID NO: 143361 - DNA, 20 bp, human
ggtgcaagaggtgggcggga

SEQ ID NO: 143362 - DNA, 20 bp, human
gcggctcccgagctggaggg

SEQ ID NO: 143363 - DNA, 20 bp, human
gtttcgagagtgcaagaggt

SEQ ID NO: 143364 - DNA, 20 bp, human
gggcggcgtcccggctgcta

SEQ ID NO: 143365 - DNA, 20 bp, human
ggcgtcccggctgctaaggc

SEQ ID NO: 143366 - DNA, 20 bp, human
gctgcccactccggagagta

SEQ ID NO: 143367 - DNA, 20 bp, human
ggagtgggcaggggtatcga

SEQ ID NO: 143368 - DNA, 20 bp, human
gcggcgggtccacagatgag

SEQ ID NO: 143369 - DNA, 20 bp, human
gtcagcagcagctccgccgg

SEQ ID NO: 143370 - DNA, 20 bp, human
gagccagggctcagattgag

SEQ ID NO: 143371 - DNA, 20 bp, human
gcctggtgggcgggaaagag

SEQ ID NO: 143372 - DNA, 20 bp, human
gagctccgccgggggtggtg

SEQ ID NO: 143373 - DNA, 20 bp, human
ggtgccttactctccggagt

SEQ ID NO: 143374 - DNA, 20 bp, human
gagttccagctagagaaggt

SEQ ID NO: 143375 - DNA, 20 bp, human
gcggagagtaaggcacaacc

SEQ ID NO: 143376 - DNA, 20 bp, human
ggcccccgctgttcggcccc

SEQ ID NO: 143377 - DNA, 20 bp, human
gttgcgggagaccccaggtt

SEQ ID NO: 143378 - DNA, 20 bp, human
gtgctgggcaaggagtacgt

SEQ ID NO: 143379 - DNA, 20 bp, human
gggaatcccaaccgaacctg

SEQ ID NO: 143380 - DNA, 20 bp, human
gggagaccccaggttcggtt

SEQ ID NO: 143381 - DNA, 20 bp, human
gcggccccgggagcatgagc

SEQ ID NO: 143382 - DNA, 20 bp, human
gggccgcttcagccacgtca

SEQ ID NO: 143383 - DNA, 20 bp, human
ggggcagcgcgtggacgtca

SEQ ID NO: 143384 - DNA, 20 bp, human
gccccctcccgcgggagtcg

SEQ ID NO: 143385 - DNA, 20 bp, human
gcagcgcgtggacgtcaagg

SEQ ID NO: 143386 - DNA, 20 bp, human
ggcctagggaggatcagctc

SEQ ID NO: 143387 - DNA, 20 bp, human
gcaaggttaggcagggccta

SEQ ID NO: 143388 - DNA, 20 bp, human
ggccagagctgatcctccct

SEQ ID NO: 143389 - DNA, 20 bp, human
gtgggggccaactcaaggtt

SEQ ID NO: 143390 - DNA, 20 bp, human
gtccatgcggagccaagatg

SEQ ID NO: 143391 - DNA, 20 bp, human
ggccaactcaaggttaggca

SEQ ID NO: 143392 - DNA, 20 bp, human
ggccctgcctaaccttgagt

SEQ ID NO: 143393 - DNA, 20 bp, human
gggcaggtgggggtgctgta

SEQ ID NO: 143394 - DNA, 20 bp, human
gagttggcccccaatccctc

SEQ ID NO: 143395 - DNA, 20 bp, human
gttacccccaatgagaggag

SEQ ID NO: 143396 - DNA, 20 bp, human
ggcggcggcggcatcatccc

SEQ ID NO: 143397 - DNA, 20 bp, human
gcggacccgaacccttcccc

SEQ ID NO: 143398 - DNA, 20 bp, human
ggcgcccgccgagcccgacc

SEQ ID NO: 143399 - DNA, 20 bp, human
gcgccgccaggggaagggtt

SEQ ID NO: 143400 - DNA, 20 bp, human
gcgacgcgggaggaaccccg

SEQ ID NO: 143401 - DNA, 20 bp, human
gtggcgcccggcctgagcca

SEQ ID NO: 143402 - DNA, 20 bp, human
ggcaccgtgcaagccccacg

SEQ ID NO: 143403 - DNA, 20 bp, human
gcagggcgcggagccgacgc

SEQ ID NO: 143404 - DNA, 20 bp, human
gtggctgcgcgcccgtggag

SEQ ID NO: 143405 - DNA, 20 bp, human
gcccggcctgagccaagggt

SEQ ID NO: 143406 - DNA, 20 bp, human
gacccgagccaggcggggac

SEQ ID NO: 143407 - DNA, 20 bp, human
ggagggaggaatgaaccggg

SEQ ID NO: 143408 - DNA, 20 bp, human
gacgacccaaaaaaggccgg

SEQ ID NO: 143409 - DNA, 20 bp, human
gacccaaaaaaggccggcgg

SEQ ID NO: 143410 - DNA, 20 bp, human
gggtgggaggatgcccatca

SEQ ID NO: 143411 - DNA, 20 bp, human
ggcgcgcgaggacccgagcc

SEQ ID NO: 143412 - DNA, 20 bp, human
gcaccaaccggagggcaacc

SEQ ID NO: 143413 - DNA, 20 bp, human
gcccgagcccgcctgaagag

SEQ ID NO: 143414 - DNA, 20 bp, human
gccacctggatgcaacccgg

SEQ ID NO: 143415 - DNA, 20 bp, human
gccagaccctcaccaaccgg

SEQ ID NO: 143416 - DNA, 20 bp, human
gcccatccggagccacaggt

SEQ ID NO: 143417 - DNA, 20 bp, human
gtgcccgtcaggactgcgag

SEQ ID NO: 143418 - DNA, 20 bp, human
ggtcaggactgcgagtggca

SEQ ID NO: 143419 - DNA, 20 bp, human
ggcctgcgccgtgggaagtg

SEQ ID NO: 143420 - DNA, 20 bp, human
gccgccgcggcggactccga

SEQ ID NO: 143421 - DNA, 20 bp, human
gtccacagggcgatgagcac

SEQ ID NO: 143422 - DNA, 20 bp, human
gtccggatgggtccaaggcc

SEQ ID NO: 143423 - DNA, 20 bp, human
ggcgtgtgcaccttcgatcg

SEQ ID NO: 143424 - DNA, 20 bp, human
gagttccagggcttgggaag

SEQ ID NO: 143425 - DNA, 20 bp, human
gggatgggtccaaggccggg

SEQ ID NO: 143426 - DNA, 20 bp, human
gcgccggcaggaggtattcg

SEQ ID NO: 143427 - DNA, 20 bp, human
gctgaggccggacacgaagt

SEQ ID NO: 143428 - DNA, 20 bp, human
gtgccggcgcggagacaccg

SEQ ID NO: 143429 - DNA, 20 bp, human
ggtattcgaggagaatcact

SEQ ID NO: 143430 - DNA, 20 bp, human
gcggcgcggagacaccgggg

SEQ ID NO: 143431 - DNA, 20 bp, human
ggtgtctccgcgccggcagg

SEQ ID NO: 143432 - DNA, 20 bp, human
gcgaggactgaccttcccgg

SEQ ID NO: 143433 - DNA, 20 bp, human
gggagctggacagctctcgt

SEQ ID NO: 143434 - DNA, 20 bp, human
gaccatgtcggactctgagg

SEQ ID NO: 143435 - DNA, 20 bp, human
gcccgggcctagaagcccga

SEQ ID NO: 143436 - DNA, 20 bp, human
ggtgctggagctggtgacgt

SEQ ID NO: 143437 - DNA, 20 bp, human
gcagcactgcggaaatggag

SEQ ID NO: 143438 - DNA, 20 bp, human
gtgttcggctgggctcggtc

SEQ ID NO: 143439 - DNA, 20 bp, human
gagcggcgcggccaggaggg

SEQ ID NO: 143440 - DNA, 20 bp, human
gcgcggcggctgttattgtt

SEQ ID NO: 143441 - DNA, 20 bp, human
gctgacacccgcagagccga

SEQ ID NO: 143442 - DNA, 20 bp, human
ggtcagccgccgggagtgag

SEQ ID NO: 143443 - DNA, 20 bp, human
gcggtctgcggcccccgacc

SEQ ID NO: 143444 - DNA, 20 bp, human
gaagaaggagggaaacctag

SEQ ID NO: 143445 - DNA, 20 bp, human
gggtcgggcgctgtctccct

SEQ ID NO: 143446 - DNA, 20 bp, human
ggggcggacccggaacccag

SEQ ID NO: 143447 - DNA, 20 bp, human
ggagtggctagagaggtcgg

SEQ ID NO: 143448 - DNA, 20 bp, human
gtagagaggtcggaggtaag

SEQ ID NO: 143449 - DNA, 20 bp, human
gtatagaagtcgggcggacc

SEQ ID NO: 143450 - DNA, 20 bp, human
gggtaagtggctatagaagt

SEQ ID NO: 143451 - DNA, 20 bp, human
gtactctggaaggtgttcca

SEQ ID NO: 143452 - DNA, 20 bp, human
ggtccgggaagtccatactc

SEQ ID NO: 143453 - DNA, 20 bp, human
ggacttcccggaccagagaa

SEQ ID NO: 143454 - DNA, 20 bp, human
gagtggctatagaagtcggg

SEQ ID NO: 143455 - DNA, 20 bp, human
ggtagattgagtggctagag

SEQ ID NO: 143456 - DNA, 20 bp, human
gccgcctcaaaaaggttgag

SEQ ID NO: 143457 - DNA, 20 bp, human
gtaagtgtagcagcagcacc

SEQ ID NO: 143458 - DNA, 20 bp, human
gccttcccccgccagaggac

SEQ ID NO: 143459 - DNA, 20 bp, human
ggaatgagtcacgcacgcaa

SEQ ID NO: 143460 - DNA, 20 bp, human
gttgcgactagggaattggc

SEQ ID NO: 143461 - DNA, 20 bp, human
gttgagaggagttgcgacta

SEQ ID NO: 143462 - DNA, 20 bp, human
gggcacccgtcctctggcgg

SEQ ID NO: 143463 - DNA, 20 bp, human
ggccttgagaactaagcggg

SEQ ID NO: 143464 - DNA, 20 bp, human
gagtgctcttggaaaatctg

SEQ ID NO: 143465 - DNA, 20 bp, human
gccctctctccgcctcaaaa

SEQ ID NO: 143466 - DNA, 20 bp, human
gggcggcccagaaatagcag

SEQ ID NO: 143467 - DNA, 20 bp, human
gggcccagaaatagcagcgg

SEQ ID NO: 143468 - DNA, 20 bp, human
ggagcgggggcggaccagag

SEQ ID NO: 143469 - DNA, 20 bp, human
ggccaggactcaccccgaga

SEQ ID NO: 143470 - DNA, 20 bp, human
ggcggccacgtgacccaccg

SEQ ID NO: 143471 - DNA, 20 bp, human
gaaagagcggagtaagcccg

SEQ ID NO: 143472 - DNA, 20 bp, human
gcggagagcgaggggatcac

SEQ ID NO: 143473 - DNA, 20 bp, human
ggggcagaggcgagagacgc

SEQ ID NO: 143474 - DNA, 20 bp, human
gtcggacccggaccccggca

SEQ ID NO: 143475 - DNA, 20 bp, human
gggggaggcggagaacaggc

SEQ ID NO: 143476 - DNA, 20 bp, human
gccgggcagggggccagact

SEQ ID NO: 143477 - DNA, 20 bp, human
gccggtcaggcggcgtcagc

SEQ ID NO: 143478 - DNA, 20 bp, human
gagagagaggcccaatccaa

SEQ ID NO: 143479 - DNA, 20 bp, human
gcatgagcgctgcggctgtc

SEQ ID NO: 143480 - DNA, 20 bp, human
gtcggtggggcccagaggat

SEQ ID NO: 143481 - DNA, 20 bp, human
gccgcccgccatgagcgctg

SEQ ID NO: 143482 - DNA, 20 bp, human
gggggccagactcggagtcg

SEQ ID NO: 143483 - DNA, 20 bp, human
gggacgcggtcggctggact

SEQ ID NO: 143484 - DNA, 20 bp, human
ggagatgcgatggacgcggt

SEQ ID NO: 143485 - DNA, 20 bp, human
gtggactcggtggggcccag

SEQ ID NO: 143486 - DNA, 20 bp, human
gcggcgcacgcacacacggg

SEQ ID NO: 143487 - DNA, 20 bp, human
gagaagaccgtggaaatcga

SEQ ID NO: 143488 - DNA, 20 bp, human
ggggtcaggtccaggaaggg

SEQ ID NO: 143489 - DNA, 20 bp, human
ggaagatcaaggtgatccag

SEQ ID NO: 143490 - DNA, 20 bp, human
gatcgagggcgagaagatca

SEQ ID NO: 143491 - DNA, 20 bp, human
gcccgcagaagcggaaggtc

SEQ ID NO: 143492 - DNA, 20 bp, human
gtgattggggactccaacgt

SEQ ID NO: 143493 - DNA, 20 bp, human
ggacttcagggagaagaccg

SEQ ID NO: 143494 - DNA, 20 bp, human
gctcgggcgaggtcccctcc

SEQ ID NO: 143495 - DNA, 20 bp, human
gcgcctcgagcgcacgaacg

SEQ ID NO: 143496 - DNA, 20 bp, human
gggcttcacggcagcgcgga

SEQ ID NO: 143497 - DNA, 20 bp, human
gggcggggctgggtcagtca

SEQ ID NO: 143498 - DNA, 20 bp, human
gcccgacccgccccaaactg

SEQ ID NO: 143499 - DNA, 20 bp, human
gcagcgaccagcccacggtg

SEQ ID NO: 143500 - DNA, 20 bp, human
ggacccgccccaaactgagg

SEQ ID NO: 143501 - DNA, 20 bp, human
gggtgtcccaaccccaccgt

SEQ ID NO: 143502 - DNA, 20 bp, human
gtgatcggcgactccaatgt

SEQ ID NO: 143503 - DNA, 20 bp, human
gccgcaccgaggccacgata

SEQ ID NO: 143504 - DNA, 20 bp, human
gagcgcagaagcggtaggtc

SEQ ID NO: 143505 - DNA, 20 bp, human
ggaagcggccagcgcagaag

SEQ ID NO: 143506 - DNA, 20 bp, human
gcgccacacggggtcagtgt

SEQ ID NO: 143507 - DNA, 20 bp, human
ggggccgctctgtaatggta

SEQ ID NO: 143508 - DNA, 20 bp, human
gcccccgggccgctctgtaa

SEQ ID NO: 143509 - DNA, 20 bp, human
gtacccggctgcgccttcat

SEQ ID NO: 143510 - DNA, 20 bp, human
gggagcggccccgccacacg

SEQ ID NO: 143511 - DNA, 20 bp, human
ggaggccctgtagccggact

SEQ ID NO: 143512 - DNA, 20 bp, human
ggccgggtatagaggtgcag

SEQ ID NO: 143513 - DNA, 20 bp, human
gggagacccgacgtcatctc

SEQ ID NO: 143514 - DNA, 20 bp, human
gaaggcgcagccgggtatag

SEQ ID NO: 143515 - DNA, 20 bp, human
gtgcccacactgaccccgtg

SEQ ID NO: 143516 - DNA, 20 bp, human
gtcgtagtcccgggccatgg

SEQ ID NO: 143517 - DNA, 20 bp, human
ggctgccggagcagcccgaa

SEQ ID NO: 143518 - DNA, 20 bp, human
ggcgatccgcagctcccttc

SEQ ID NO: 143519 - DNA, 20 bp, human
gttgaccaaggtcacacgtg

SEQ ID NO: 143520 - DNA, 20 bp, human
ggtcgcgcgatctctggagt

SEQ ID NO: 143521 - DNA, 20 bp, human
ggggcgggcggggtcggtac

SEQ ID NO: 143522 - DNA, 20 bp, human
gagatcgcgcgacttgacca

SEQ ID NO: 143523 - DNA, 20 bp, human
gcctgcctcgcgctgacctt

SEQ ID NO: 143524 - DNA, 20 bp, human
gcaggcgcgatgactggacc

SEQ ID NO: 143525 - DNA, 20 bp, human
gccgcgccccaacctcccct

SEQ ID NO: 143526 - DNA, 20 bp, human
gcgggagggtcggacagagt

SEQ ID NO: 143527 - DNA, 20 bp, human
gaggaggctcgaggagtcag

SEQ ID NO: 143528 - DNA, 20 bp, human
gcgagctgactcaccagcga

SEQ ID NO: 143529 - DNA, 20 bp, human
gccgctggctcaggcggacc

SEQ ID NO: 143530 - DNA, 20 bp, human
ggttgggtgaccgggagggt

SEQ ID NO: 143531 - DNA, 20 bp, human
gcaggcagtggaagtagagt

SEQ ID NO: 143532 - DNA, 20 bp, human
gtcagaggcctggtgaagtg

SEQ ID NO: 143533 - DNA, 20 bp, human
gcagctttcacagccatcgc

SEQ ID NO: 143534 - DNA, 20 bp, human
gcccagtctgcaaaggacga

SEQ ID NO: 143535 - DNA, 20 bp, human
ggaggagtccggacagaaaa

SEQ ID NO: 143536 - DNA, 20 bp, human
ggcgccgttgccacccggga

SEQ ID NO: 143537 - DNA, 20 bp, human
gtctcgtccagggacatgac

SEQ ID NO: 143538 - DNA, 20 bp, human
gaagaagcatgggctcccgg

SEQ ID NO: 143539 - DNA, 20 bp, human
gtcgccatcccgggtggcaa

SEQ ID NO: 143540 - DNA, 20 bp, human
gggttaagcgcgcaactctc

SEQ ID NO: 143541 - DNA, 20 bp, human
gaccgaacggagactcggag

SEQ ID NO: 143542 - DNA, 20 bp, human
gtcgggggcctcgccatccc

SEQ ID NO: 143543 - DNA, 20 bp, human
gcagctgcgtctcccagagg

SEQ ID NO: 143544 - DNA, 20 bp, human
ggtccgagctacgacctcac

SEQ ID NO: 143545 - DNA, 20 bp, human
gcgtagctcggactgcaggg

SEQ ID NO: 143546 - DNA, 20 bp, human
gctgcgcacgagagagactt

SEQ ID NO: 143547 - DNA, 20 bp, human
ggacgtgccgtgcctgacca

SEQ ID NO: 143548 - DNA, 20 bp, human
gcacagtctccgggtcccag

SEQ ID NO: 143549 - DNA, 20 bp, human
ggaccagggaagcgcagcct

SEQ ID NO: 143550 - DNA, 20 bp, human
gacttggggagcgcaagtgt

SEQ ID NO: 143551 - DNA, 20 bp, human
ggcgcttccctggtcaggca

SEQ ID NO: 143552 - DNA, 20 bp, human
gcggccggtttccagtctcg

SEQ ID NO: 143553 - DNA, 20 bp, human
gcgaggcagtttttcctggt

SEQ ID NO: 143554 - DNA, 20 bp, human
gctctgggcagagagatccc

SEQ ID NO: 143555 - DNA, 20 bp, human
ggaaggaggattaaccccta

SEQ ID NO: 143556 - DNA, 20 bp, human
gggagtccccgatcacgatg

SEQ ID NO: 143557 - DNA, 20 bp, human
gcgacggtggggtcgcaggc

SEQ ID NO: 143558 - DNA, 20 bp, human
ggacaggagcggttcaggta

SEQ ID NO: 143559 - DNA, 20 bp, human
gtagggaccccggggacctt

SEQ ID NO: 143560 - DNA, 20 bp, human
ggccgcaggaatatgctgga

SEQ ID NO: 143561 - DNA, 20 bp, human
gccgccctctcgggagagag

SEQ ID NO: 143562 - DNA, 20 bp, human
ggccttccagcatattcctg

SEQ ID NO: 143563 - DNA, 20 bp, human
gacccgcgggctaagttcgg

SEQ ID NO: 143564 - DNA, 20 bp, human
gggaatatgctggaaggcgg

SEQ ID NO: 143565 - DNA, 20 bp, human
ggcggtgcccaaggtccccg

SEQ ID NO: 143566 - DNA, 20 bp, human
gggataccgcgggtcaagag

SEQ ID NO: 143567 - DNA, 20 bp, human
gtgggagcccgaagctgggt

SEQ ID NO: 143568 - DNA, 20 bp, human
gcccgaagctgggtaggccc

SEQ ID NO: 143569 - DNA, 20 bp, human
ggtccgggcccgcaagcagt

SEQ ID NO: 143570 - DNA, 20 bp, human
gatggatgctgcgctcgcaa

SEQ ID NO: 143571 - DNA, 20 bp, human
gggtcaagagaggttcaggt

SEQ ID NO: 143572 - DNA, 20 bp, human
ggctcgcaaaggtgatgaaa

SEQ ID NO: 143573 - DNA, 20 bp, human
gtggcctgggagcccgaagc

SEQ ID NO: 143574 - DNA, 20 bp, human
gtccaggagggcaacaccaa

SEQ ID NO: 143575 - DNA, 20 bp, human
gtcatcggggattccacagt

SEQ ID NO: 143576 - DNA, 20 bp, human
gtgacgtcctgcaaagggag

SEQ ID NO: 143577 - DNA, 20 bp, human
gaccccggtgcgttgatgtg

SEQ ID NO: 143578 - DNA, 20 bp, human
gtatccaggtacacaagcaa

SEQ ID NO: 143579 - DNA, 20 bp, human
gcgtcctgcaaagggagggg

SEQ ID NO: 143580 - DNA, 20 bp, human
gcacacagacccgctgacac

SEQ ID NO: 143581 - DNA, 20 bp, human
gcctttgcaggacgtcacgg

SEQ ID NO: 143582 - DNA, 20 bp, human
ggatgcaacggcgaccctag

SEQ ID NO: 143583 - DNA, 20 bp, human
gtgggggacgaggttgacta

SEQ ID NO: 143584 - DNA, 20 bp, human
gcctccgccgcagagcaggg

SEQ ID NO: 143585 - DNA, 20 bp, human
ggcaacggcgaccctagcgg

SEQ ID NO: 143586 - DNA, 20 bp, human
gtccggtcaggtcctcacag

SEQ ID NO: 143587 - DNA, 20 bp, human
ggccactgtgaggacctgac

SEQ ID NO: 143588 - DNA, 20 bp, human
ggcagccgggggagctccaa

SEQ ID NO: 143589 - DNA, 20 bp, human
ggccctcaggcgccactgtg

SEQ ID NO: 143590 - DNA, 20 bp, human
gagcgggagcctcagccctc

SEQ ID NO: 143591 - DNA, 20 bp, human
gtcctcacagtggcgcctga

SEQ ID NO: 143592 - DNA, 20 bp, human
gccggctgcccccaacgtct

SEQ ID NO: 143593 - DNA, 20 bp, human
gcagaggtggggctcaccta

SEQ ID NO: 143594 - DNA, 20 bp, human
gaggatcagggaccgatccc

SEQ ID NO: 143595 - DNA, 20 bp, human
gtcggcgggacggcaggacc

SEQ ID NO: 143596 - DNA, 20 bp, human
gggtcaagcgtgcacagtcc

SEQ ID NO: 143597 - DNA, 20 bp, human
gggaggttagggctctacgt

SEQ ID NO: 143598 - DNA, 20 bp, human
gggagcatgcaatctcgtgt

SEQ ID NO: 143599 - DNA, 20 bp, human
gacagctccagtgctgatgt

SEQ ID NO: 143600 - DNA, 20 bp, human
gcgtttccttaggcagagtg

SEQ ID NO: 143601 - DNA, 20 bp, human
gagtgccctcgctacaaagg

SEQ ID NO: 143602 - DNA, 20 bp, human
gtctctggctaggaccgcac

SEQ ID NO: 143603 - DNA, 20 bp, human
ggcgtctggcggagagaaaa

SEQ ID NO: 143604 - DNA, 20 bp, human
gaaaccccggatgccaagag

SEQ ID NO: 143605 - DNA, 20 bp, human
ggtctcttaggaagtgccag

SEQ ID NO: 143606 - DNA, 20 bp, human
gcaagccgcagcgagttcac

SEQ ID NO: 143607 - DNA, 20 bp, human
gcctcaagcctggccccgga

SEQ ID NO: 143608 - DNA, 20 bp, human
gtccgcctgtgaactcgctg

SEQ ID NO: 143609 - DNA, 20 bp, human
gtcggcagatggttagaaag

SEQ ID NO: 143610 - DNA, 20 bp, human
gaggcgggaccgactgacac

SEQ ID NO: 143611 - DNA, 20 bp, human
gaacagaggcgagccctccg

SEQ ID NO: 143612 - DNA, 20 bp, human
ggcgccccaaatctagtgaa

SEQ ID NO: 143613 - DNA, 20 bp, human
ggcgggctccgcccagaagg

SEQ ID NO: 143614 - DNA, 20 bp, human
ggacaggcgttgggaccata

SEQ ID NO: 143615 - DNA, 20 bp, human
ggcatccgagcaggtctgtg

SEQ ID NO: 143616 - DNA, 20 bp, human
gtagtgacaaggattaagta

SEQ ID NO: 143617 - DNA, 20 bp, human
gggcccggcgctcctcaaga

SEQ ID NO: 143618 - DNA, 20 bp, human
ggccccaaggcgaagacatg

SEQ ID NO: 143619 - DNA, 20 bp, human
gaagatggctgccgacagtg

SEQ ID NO: 143620 - DNA, 20 bp, human
gctcagggattggctgacgg

SEQ ID NO: 143621 - DNA, 20 bp, human
gaaagaaatcacctcactgt

SEQ ID NO: 143622 - DNA, 20 bp, human
gcactgcctcggaatgggaa

SEQ ID NO: 143623 - DNA, 20 bp, human
gggaggagacccgggaccca

SEQ ID NO: 143624 - DNA, 20 bp, human
gaagcggctaggggacgcca

SEQ ID NO: 143625 - DNA, 20 bp, human
gcagacgcgagacgcggaag

SEQ ID NO: 143626 - DNA, 20 bp, human
ggcgcagtactcggagacag

SEQ ID NO: 143627 - DNA, 20 bp, human
gggccgcgggtgacgaggga

SEQ ID NO: 143628 - DNA, 20 bp, human
ggctccagggaaccccacta

SEQ ID NO: 143629 - DNA, 20 bp, human
gcgggtgacgagggaaggaa

SEQ ID NO: 143630 - DNA, 20 bp, human
gtagagctattggggctcgg

SEQ ID NO: 143631 - DNA, 20 bp, human
gggccagagaggcacttact

SEQ ID NO: 143632 - DNA, 20 bp, human
gggagaaaagctgggtcgag

SEQ ID NO: 143633 - DNA, 20 bp, human
gtggggcttcaggacgaggt

SEQ ID NO: 143634 - DNA, 20 bp, human
gctgcttggctagagctatt

SEQ ID NO: 143635 - DNA, 20 bp, human
gagctattggggctcggtgg

SEQ ID NO: 143636 - DNA, 20 bp, human
gggtgcagggtgcgaagggt

SEQ ID NO: 143637 - DNA, 20 bp, human
ggcgtctgagacctactgac

SEQ ID NO: 143638 - DNA, 20 bp, human
gtgcagccaggagactccgg

SEQ ID NO: 143639 - DNA, 20 bp, human
gtgacgctgtcaccccggga

SEQ ID NO: 143640 - DNA, 20 bp, human
gcagtaggtctcagacgcct

SEQ ID NO: 143641 - DNA, 20 bp, human
gccgccacgtgacccgccca

SEQ ID NO: 143642 - DNA, 20 bp, human
gtgggcagccgaccgtcccg

SEQ ID NO: 143643 - DNA, 20 bp, human
gctgcccgcggccggtcagt

SEQ ID NO: 143644 - DNA, 20 bp, human
ggcgctcctgatgagctaag

SEQ ID NO: 143645 - DNA, 20 bp, human
gtcggggtgcagggtgcgaa

SEQ ID NO: 143646 - DNA, 20 bp, human
gccgccgccgtggagtgtag

SEQ ID NO: 143647 - DNA, 20 bp, human
gccgaagcagcgagaaacgg

SEQ ID NO: 143648 - DNA, 20 bp, human
gccctttccgctacactcca

SEQ ID NO: 143649 - DNA, 20 bp, human
gggcggcgggctcactacgc

SEQ ID NO: 143650 - DNA, 20 bp, human
gtttccgctacactccacgg

SEQ ID NO: 143651 - DNA, 20 bp, human
gaagcagcgagaaacggagg

SEQ ID NO: 143652 - DNA, 20 bp, human
gcagtcccgcgttccctcgg

SEQ ID NO: 143653 - DNA, 20 bp, human
ggcagccgccgagggaacgc

SEQ ID NO: 143654 - DNA, 20 bp, human
gctcctggccgactcgccag

SEQ ID NO: 143655 - DNA, 20 bp, human
ggctgctggtgggcgtcggg

SEQ ID NO: 143656 - DNA, 20 bp, human
gtccttgggacagctcggta

SEQ ID NO: 143657 - DNA, 20 bp, human
ggagcccactcaccacttaa

SEQ ID NO: 143658 - DNA, 20 bp, human
gtgggctcaggcagaagctt

SEQ ID NO: 143659 - DNA, 20 bp, human
gtgaacagccgttaggataa

SEQ ID NO: 143660 - DNA, 20 bp, human
ggagagtatacggcatgaag

SEQ ID NO: 143661 - DNA, 20 bp, human
gggtgtgggaccgtatgagt

SEQ ID NO: 143662 - DNA, 20 bp, human
gagttggctgatcccttaag

SEQ ID NO: 143663 - DNA, 20 bp, human
gtgtggagtgggggacccat

SEQ ID NO: 143664 - DNA, 20 bp, human
gaaaacctgttgagagtata

SEQ ID NO: 143665 - DNA, 20 bp, human
gcatgccgtatactctcaac

SEQ ID NO: 143666 - DNA, 20 bp, human
gccagcaaggttgtgcgcag

SEQ ID NO: 143667 - DNA, 20 bp, human
gccccgtacagtcacctggg

SEQ ID NO: 143668 - DNA, 20 bp, human
gcccggggcgctcatcgtgc

SEQ ID NO: 143669 - DNA, 20 bp, human
gtccccccaggtgactgtac

SEQ ID NO: 143670 - DNA, 20 bp, human
ggcgcacaaccttgctggtc

SEQ ID NO: 143671 - DNA, 20 bp, human
gagtccccgtacagtcacct

SEQ ID NO: 143672 - DNA, 20 bp, human
gtgtgcgcagaggcggtgcc

SEQ ID NO: 143673 - DNA, 20 bp, human
gcttgtagtcgattcccccc

SEQ ID NO: 143674 - DNA, 20 bp, human
ggaagtcgtaggcctggtcg

SEQ ID NO: 143675 - DNA, 20 bp, human
gaggattttagggacaccag

SEQ ID NO: 143676 - DNA, 20 bp, human
ggggcctcgagtggaactgg

SEQ ID NO: 143677 - DNA, 20 bp, human
gccgcaggccgggcatgggt

SEQ ID NO: 143678 - DNA, 20 bp, human
gggtaggagtcccggtccgg

SEQ ID NO: 143679 - DNA, 20 bp, human
gcagggacgccgcagcacga

SEQ ID NO: 143680 - DNA, 20 bp, human
gcccagggcgctcatcgtga

SEQ ID NO: 143681 - DNA, 20 bp, human
gggaggcgagcaaggactcg

SEQ ID NO: 143682 - DNA, 20 bp, human
ggagggtaggagtcccggtc

SEQ ID NO: 143683 - DNA, 20 bp, human
gcgcagactgcggagaagga

SEQ ID NO: 143684 - DNA, 20 bp, human
gagccccgcaggccgggcat

SEQ ID NO: 143685 - DNA, 20 bp, human
gtggaactgggggtgcaaca

SEQ ID NO: 143686 - DNA, 20 bp, human
ggcgaggctgaggtgcgccc

SEQ ID NO: 143687 - DNA, 20 bp, human
gcgccccacggcggccgagt

SEQ ID NO: 143688 - DNA, 20 bp, human
gcgttcggcggcgcttggaa

SEQ ID NO: 143689 - DNA, 20 bp, human
gcacctcgggactggagcac

SEQ ID NO: 143690 - DNA, 20 bp, human
gtccagactcggtagctcgg

SEQ ID NO: 143691 - DNA, 20 bp, human
gcgttcctgggaacgttcgg

SEQ ID NO: 143692 - DNA, 20 bp, human
gaggcgttcctgggaacgtt

SEQ ID NO: 143693 - DNA, 20 bp, human
ggccaggcaaaggcgttcct

SEQ ID NO: 143694 - DNA, 20 bp, human
ggccctggtggtgcgggaag

SEQ ID NO: 143695 - DNA, 20 bp, human
gtacgcctacagtaacggta

SEQ ID NO: 143696 - DNA, 20 bp, human
ggtgagtccgccaagaagag

SEQ ID NO: 143697 - DNA, 20 bp, human
gcaggcctcgtcgtgaccaa

SEQ ID NO: 143698 - DNA, 20 bp, human
gggcagacatcgcttcaggt

SEQ ID NO: 143699 - DNA, 20 bp, human
gcacgacgaggcctggatgg

SEQ ID NO: 143700 - DNA, 20 bp, human
gaagcctccggcctccatcc

SEQ ID NO: 143701 - DNA, 20 bp, human
ggcctccagaccaaagcctc

SEQ ID NO: 143702 - DNA, 20 bp, human
gactcggtggtggtcttacc

SEQ ID NO: 143703 - DNA, 20 bp, human
gtagagcatggcgtgaagtc

SEQ ID NO: 143704 - DNA, 20 bp, human
gagaccaccaccgagtcata

SEQ ID NO: 143705 - DNA, 20 bp, human
gctggaggctgccgaaagaa

SEQ ID NO: 143706 - DNA, 20 bp, human
gtcccgagaggccaactcag

SEQ ID NO: 143707 - DNA, 20 bp, human
gcagagaccaggaacatccc

SEQ ID NO: 143708 - DNA, 20 bp, human
gggtcccgcccggtccactg

SEQ ID NO: 143709 - DNA, 20 bp, human
gagaggccaactcagaggtc

SEQ ID NO: 143710 - DNA, 20 bp, human
ggaaaaatgactccgagcag

SEQ ID NO: 143711 - DNA, 20 bp, human
gtcccacgaacactgcgggg

SEQ ID NO: 143712 - DNA, 20 bp, human
ggttctggccccagtggacc

SEQ ID NO: 143713 - DNA, 20 bp, human
gcccaccccgcagtgttcgt

SEQ ID NO: 143714 - DNA, 20 bp, human
gaaatgactccgagcagggg

SEQ ID NO: 143715 - DNA, 20 bp, human
gggccacggcaactcccgag

SEQ ID NO: 143716 - DNA, 20 bp, human
gaacccgggtcgggctgagg

SEQ ID NO: 143717 - DNA, 20 bp, human
ggggcccggcttggcgggtc

SEQ ID NO: 143718 - DNA, 20 bp, human
ggacccgaggaaggaaaaag

SEQ ID NO: 143719 - DNA, 20 bp, human
gacgtagccaggcggcccgt

SEQ ID NO: 143720 - DNA, 20 bp, human
gagggcaagcgggtcaaggt

SEQ ID NO: 143721 - DNA, 20 bp, human
gaccggccggagctttgcgg

SEQ ID NO: 143722 - DNA, 20 bp, human
gccaggcctgctccgacccg

SEQ ID NO: 143723 - DNA, 20 bp, human
gcgcgggttcggctcccccc

SEQ ID NO: 143724 - DNA, 20 bp, human
gcacggagctgaggaccggc

SEQ ID NO: 143725 - DNA, 20 bp, human
gcgggccctccgcaaagctc

SEQ ID NO: 143726 - DNA, 20 bp, human
gcctggagagtgaccctaca

SEQ ID NO: 143727 - DNA, 20 bp, human
gatacccgcttagagggcag

SEQ ID NO: 143728 - DNA, 20 bp, human
gccttctgcggagcctgtgg

SEQ ID NO: 143729 - DNA, 20 bp, human
gtagcagatacccgcttaga

SEQ ID NO: 143730 - DNA, 20 bp, human
ggaagccactgccctctaag

SEQ ID NO: 143731 - DNA, 20 bp, human
ggcagaggatgcctgctcat

SEQ ID NO: 143732 - DNA, 20 bp, human
gggccctgtcctgccctgta

SEQ ID NO: 143733 - DNA, 20 bp, human
gttcccaagtaaggccaggg

SEQ ID NO: 143734 - DNA, 20 bp, human
gggaaggactccccatgagc

SEQ ID NO: 143735 - DNA, 20 bp, human
gggaaagcccctgccgtcaa

SEQ ID NO: 143736 - DNA, 20 bp, human
ggcagccgctgggagaccgg

SEQ ID NO: 143737 - DNA, 20 bp, human
gcggccatgtccgaaaccta

SEQ ID NO: 143738 - DNA, 20 bp, human
ggccgcagccgctgggagac

SEQ ID NO: 143739 - DNA, 20 bp, human
ggccgctgggggctcgggtg

SEQ ID NO: 143740 - DNA, 20 bp, human
ggcggtcgcggccggacgga

SEQ ID NO: 143741 - DNA, 20 bp, human
gagcccgggcctcgtaccgt

SEQ ID NO: 143742 - DNA, 20 bp, human
gtggccgtctgcgacatctt

SEQ ID NO: 143743 - DNA, 20 bp, human
ggcggagctggagtccggct

SEQ ID NO: 143744 - DNA, 20 bp, human
ggccgggggacggatctcgg

SEQ ID NO: 143745 - DNA, 20 bp, human
gacggatctcggaggtgtct

SEQ ID NO: 143746 - DNA, 20 bp, human
gggctgtagccggagtggag

SEQ ID NO: 143747 - DNA, 20 bp, human
gcagccccgccccttcactc

SEQ ID NO: 143748 - DNA, 20 bp, human
ggcggggctgactgcatgaa

SEQ ID NO: 143749 - DNA, 20 bp, human
ggggccttaatggatctggg

SEQ ID NO: 143750 - DNA, 20 bp, human
gccgggcccggggagtagga

SEQ ID NO: 143751 - DNA, 20 bp, human
gggctagagggaacactgaa

SEQ ID NO: 143752 - DNA, 20 bp, human
gatggaagctcgggaccctg

SEQ ID NO: 143753 - DNA, 20 bp, human
gtgagggagctggtcctgag

SEQ ID NO: 143754 - DNA, 20 bp, human
gggtgggccttaatggatct

SEQ ID NO: 143755 - DNA, 20 bp, human
ggtggagcggctgccagccg

SEQ ID NO: 143756 - DNA, 20 bp, human
gcggagacggagcccgacag

SEQ ID NO: 143757 - DNA, 20 bp, human
ggcagcggaagtggctccgg

SEQ ID NO: 143758 - DNA, 20 bp, human
gcggcaccgggcagcggaag

SEQ ID NO: 143759 - DNA, 20 bp, human
gcctggaggatgagtcacca

SEQ ID NO: 143760 - DNA, 20 bp, human
gcccgcagctcggcttgctg

SEQ ID NO: 143761 - DNA, 20 bp, human
gagacggagcccgacagggg

SEQ ID NO: 143762 - DNA, 20 bp, human
gccgtggtgccgcccctgtc

SEQ ID NO: 143763 - DNA, 20 bp, human
gcagtccagtgtgaggggag

SEQ ID NO: 143764 - DNA, 20 bp, human
gtggggaccgcggataacct

SEQ ID NO: 143765 - DNA, 20 bp, human
gctggaccccaggttatccg

SEQ ID NO: 143766 - DNA, 20 bp, human
gtccatcagctcggtacctg

SEQ ID NO: 143767 - DNA, 20 bp, human
gacaggcttggggccgacgg

SEQ ID NO: 143768 - DNA, 20 bp, human
gtaagcagcgctgaagaggg

SEQ ID NO: 143769 - DNA, 20 bp, human
gcgagctgatggagcccaaa

SEQ ID NO: 143770 - DNA, 20 bp, human
ggccccaggtaccgagctga

SEQ ID NO: 143771 - DNA, 20 bp, human
gcggcctgggaccccgaagt

SEQ ID NO: 143772 - DNA, 20 bp, human
gctgtttgtctgttcgacac

SEQ ID NO: 143773 - DNA, 20 bp, human
gtcctcacctcccggcaaat

SEQ ID NO: 143774 - DNA, 20 bp, human
gaatgggggtcgctgaggag

SEQ ID NO: 143775 - DNA, 20 bp, human
gcattggaagggcctgagaa

SEQ ID NO: 143776 - DNA, 20 bp, human
gggggcggcggcgttacttg

SEQ ID NO: 143777 - DNA, 20 bp, human
ggcctgggacaccgccggcg

SEQ ID NO: 143778 - DNA, 20 bp, human
gccggagcctgggacaccgc

SEQ ID NO: 143779 - DNA, 20 bp, human
gatccggagcggctgaaagg

SEQ ID NO: 143780 - DNA, 20 bp, human
gtccccgccggcggtgtccc

SEQ ID NO: 143781 - DNA, 20 bp, human
gcggatccggagcggctgaa

SEQ ID NO: 143782 - DNA, 20 bp, human
ggaagtggaggccggagcct

SEQ ID NO: 143783 - DNA, 20 bp, human
gccaggcgtcgggccatagg

SEQ ID NO: 143784 - DNA, 20 bp, human
gcctgggacaagcatactca

SEQ ID NO: 143785 - DNA, 20 bp, human
gcgtcgggccataggaggtg

SEQ ID NO: 143786 - DNA, 20 bp, human
gggccacacagatcaagaag

SEQ ID NO: 143787 - DNA, 20 bp, human
gtagtggtccagagagcgtg

SEQ ID NO: 143788 - DNA, 20 bp, human
gggactggtgctatgcaaag

SEQ ID NO: 143789 - DNA, 20 bp, human
ggtccagagagcgtgcgggt

SEQ ID NO: 143790 - DNA, 20 bp, human
gtggaccactacagctggac

SEQ ID NO: 143791 - DNA, 20 bp, human
gacagctggacgggcaatgg

SEQ ID NO: 143792 - DNA, 20 bp, human
ggcgatgcttgaggggactc

SEQ ID NO: 143793 - DNA, 20 bp, human
gattgcccgtccagctgtag

SEQ ID NO: 143794 - DNA, 20 bp, human
gagagcgtgcgggtggggac

SEQ ID NO: 143795 - DNA, 20 bp, human
gggactaaatgcgtctgtgg

SEQ ID NO: 143796 - DNA, 20 bp, human
gtcgccccgcgccgctccag

SEQ ID NO: 143797 - DNA, 20 bp, human
gcaggtctgggagccgagtg

SEQ ID NO: 143798 - DNA, 20 bp, human
gcctagctttgggaagccag

SEQ ID NO: 143799 - DNA, 20 bp, human
gacgcacgcacgccagcggc

SEQ ID NO: 143800 - DNA, 20 bp, human
gctagttccacaatgtccac

SEQ ID NO: 143801 - DNA, 20 bp, human
ggttccacaatgtccacggg

SEQ ID NO: 143802 - DNA, 20 bp, human
gaggagccaggggtgtcctc

SEQ ID NO: 143803 - DNA, 20 bp, human
gggcgggcaccgagctctct

SEQ ID NO: 143804 - DNA, 20 bp, human
gggtctctaggctgaggcgg

SEQ ID NO: 143805 - DNA, 20 bp, human
ggcgagcctctggagcggcg

SEQ ID NO: 143806 - DNA, 20 bp, human
ggagcagagcggtaagtacc

SEQ ID NO: 143807 - DNA, 20 bp, human
gcttgccagggtagaggaga

SEQ ID NO: 143808 - DNA, 20 bp, human
ggggctgctgcggtcggcac

SEQ ID NO: 143809 - DNA, 20 bp, human
gtgggcggcgggggtcgact

SEQ ID NO: 143810 - DNA, 20 bp, human
gtgggccgggggtcccaatg

SEQ ID NO: 143811 - DNA, 20 bp, human
gcctgcggctgcgtgtccgg

SEQ ID NO: 143812 - DNA, 20 bp, human
ggaggaggaggaaaaagcga

SEQ ID NO: 143813 - DNA, 20 bp, human
gagtacccggcttaatctct

SEQ ID NO: 143814 - DNA, 20 bp, human
gcccagctgcgtcccggtcc

SEQ ID NO: 143815 - DNA, 20 bp, human
gggcgcgctctttacgcccg

SEQ ID NO: 143816 - DNA, 20 bp, human
gcctgcgggagagagacgga

SEQ ID NO: 143817 - DNA, 20 bp, human
gcaggtctctgagccgggtg

SEQ ID NO: 143818 - DNA, 20 bp, human
gccaaaccgcagatgtatcc

SEQ ID NO: 143819 - DNA, 20 bp, human
gtctctgagccgggtgcgga

SEQ ID NO: 143820 - DNA, 20 bp, human
gctcccgcaggtctctgagc

SEQ ID NO: 143821 - DNA, 20 bp, human
gtttttcgtcagccggctgg

SEQ ID NO: 143822 - DNA, 20 bp, human
ggagatcccggatacatctg

SEQ ID NO: 143823 - DNA, 20 bp, human
gagcagggctcgccacagac

SEQ ID NO: 143824 - DNA, 20 bp, human
gcagccggctggaggagcat

SEQ ID NO: 143825 - DNA, 20 bp, human
gtgagccgggtgcggaagga

SEQ ID NO: 143826 - DNA, 20 bp, human
gctgggcccgctgcttaccg

SEQ ID NO: 143827 - DNA, 20 bp, human
ggccataaagcctgaggcgg

SEQ ID NO: 143828 - DNA, 20 bp, human
gttggccataaagcctgagg

SEQ ID NO: 143829 - DNA, 20 bp, human
gcgcagggccgcccaagtca

SEQ ID NO: 143830 - DNA, 20 bp, human
gccgccccggccacccgtct

SEQ ID NO: 143831 - DNA, 20 bp, human
ggagcctgcccaggaggaca

SEQ ID NO: 143832 - DNA, 20 bp, human
gacagagcgtccgagacggg

SEQ ID NO: 143833 - DNA, 20 bp, human
gcaagtcaaggaaccctctc

SEQ ID NO: 143834 - DNA, 20 bp, human
gcggcggcggtggcggaagt

SEQ ID NO: 143835 - DNA, 20 bp, human
gcgaggaggagactaaacgg

SEQ ID NO: 143836 - DNA, 20 bp, human
ggcccagacaggcggtgggt

SEQ ID NO: 143837 - DNA, 20 bp, human
gccctcttcaaactgaagtg

SEQ ID NO: 143838 - DNA, 20 bp, human
gaagtgtggtcggggatcgg

SEQ ID NO: 143839 - DNA, 20 bp, human
ggagggcgtctagggaatcg

SEQ ID NO: 143840 - DNA, 20 bp, human
gagcagcccagacaggcggt

SEQ ID NO: 143841 - DNA, 20 bp, human
gagagggtccggatccaaag

SEQ ID NO: 143842 - DNA, 20 bp, human
gcgtgacgcttgcggaggaa

SEQ ID NO: 143843 - DNA, 20 bp, human
gtcccacccaccgcctgtct

SEQ ID NO: 143844 - DNA, 20 bp, human
gctgcacgtgacgcttgcgg

SEQ ID NO: 143845 - DNA, 20 bp, human
gcgagctggggacccaagtg

SEQ ID NO: 143846 - DNA, 20 bp, human
gtaacgagcgggctgagggt

SEQ ID NO: 143847 - DNA, 20 bp, human
gagcttgaacaggtaatcgt

SEQ ID NO: 143848 - DNA, 20 bp, human
gtcggggagagagtgtaata

SEQ ID NO: 143849 - DNA, 20 bp, human
gtaggacagatcgagaggac

SEQ ID NO: 143850 - DNA, 20 bp, human
gctagcagcagccctcgaag

SEQ ID NO: 143851 - DNA, 20 bp, human
gccggcactagggagagcac

SEQ ID NO: 143852 - DNA, 20 bp, human
gctggccgcacttcccgtcg

SEQ ID NO: 143853 - DNA, 20 bp, human
ggctgctaggacagatcgag

SEQ ID NO: 143854 - DNA, 20 bp, human
gggctgggcgcgcccctgag

SEQ ID NO: 143855 - DNA, 20 bp, human
gcctagtgccggccaatggg

SEQ ID NO: 143856 - DNA, 20 bp, human
gcctctgaccggggagccag

SEQ ID NO: 143857 - DNA, 20 bp, human
gggctccccggtcagagggc

SEQ ID NO: 143858 - DNA, 20 bp, human
gctcgctccggccctctgac

SEQ ID NO: 143859 - DNA, 20 bp, human
ggagggttcggagactgaca

SEQ ID NO: 143860 - DNA, 20 bp, human
ggaccgggtagagaattggg

SEQ ID NO: 143861 - DNA, 20 bp, human
gctctgagaagcggaacagg

SEQ ID NO: 143862 - DNA, 20 bp, human
ggggcgaagggggaacttgg

SEQ ID NO: 143863 - DNA, 20 bp, human
ggtgaggctaagggcgaagg

SEQ ID NO: 143864 - DNA, 20 bp, human
gagaggcgagcgggaacgtg

SEQ ID NO: 143865 - DNA, 20 bp, human
gcaaggactaggggtattgg

SEQ ID NO: 143866 - DNA, 20 bp, human
ggagcctggctgcgctaccg

SEQ ID NO: 143867 - DNA, 20 bp, human
gcagcgcggagggaacaaca

SEQ ID NO: 143868 - DNA, 20 bp, human
ggctctgggccggcccgtct

SEQ ID NO: 143869 - DNA, 20 bp, human
gtcctcctgcgtcagagagg

SEQ ID NO: 143870 - DNA, 20 bp, human
gtgctcccgtccagcgcgga

SEQ ID NO: 143871 - DNA, 20 bp, human
gtgttccctccgcgctggac

SEQ ID NO: 143872 - DNA, 20 bp, human
gggcccgtctgggcgcaatg

SEQ ID NO: 143873 - DNA, 20 bp, human
ggaaatacacccggtcacct

SEQ ID NO: 143874 - DNA, 20 bp, human
gcacacaaacactggagaaa

SEQ ID NO: 143875 - DNA, 20 bp, human
gcagctgctcccgtccagcg

SEQ ID NO: 143876 - DNA, 20 bp, human
gtgccccattgaggacgagg

SEQ ID NO: 143877 - DNA, 20 bp, human
gctcaatggggcagcaagtg

SEQ ID NO: 143878 - DNA, 20 bp, human
gggcagctgtcaggccaccg

SEQ ID NO: 143879 - DNA, 20 bp, human
gctgccagagccgagcagag

SEQ ID NO: 143880 - DNA, 20 bp, human
gggctcgagacgctgcgcgg

SEQ ID NO: 143881 - DNA, 20 bp, human
gctcccgaggtcggagtcgg

SEQ ID NO: 143882 - DNA, 20 bp, human
gagtgcggcttggacctcgg

SEQ ID NO: 143883 - DNA, 20 bp, human
ggagaggcgcagggctccgt

SEQ ID NO: 143884 - DNA, 20 bp, human
ggcgcctctctgctcggctc

SEQ ID NO: 143885 - DNA, 20 bp, human
gcccagctcttagagctagt

SEQ ID NO: 143886 - DNA, 20 bp, human
ggccatgtctgcgtcgtgag

SEQ ID NO: 143887 - DNA, 20 bp, human
gccgaggcggaagggctgag

SEQ ID NO: 143888 - DNA, 20 bp, human
gacccctcacgacgcagaca

SEQ ID NO: 143889 - DNA, 20 bp, human
gcagcagaaagatgccgagg

SEQ ID NO: 143890 - DNA, 20 bp, human
gggtccacgaaggtgctcca

SEQ ID NO: 143891 - DNA, 20 bp, human
ggaccagcagaaagatgccg

SEQ ID NO: 143892 - DNA, 20 bp, human
gactcccggcctgcaccgga

SEQ ID NO: 143893 - DNA, 20 bp, human
gggtcttcagggtaccgggc

SEQ ID NO: 143894 - DNA, 20 bp, human
gaagcgctgctggtccacga

SEQ ID NO: 143895 - DNA, 20 bp, human
gaccggggccaacacttctg

SEQ ID NO: 143896 - DNA, 20 bp, human
ggcccagagagaaaccgcta

SEQ ID NO: 143897 - DNA, 20 bp, human
gccgccgcgcctgccatggt

SEQ ID NO: 143898 - DNA, 20 bp, human
gccgctaaggctggatccgc

SEQ ID NO: 143899 - DNA, 20 bp, human
ggaggcggaggtcggcggtc

SEQ ID NO: 143900 - DNA, 20 bp, human
ggggtgcagcgcttgcggga

SEQ ID NO: 143901 - DNA, 20 bp, human
gtccccagcgacggcagccg

SEQ ID NO: 143902 - DNA, 20 bp, human
gatttcccgctgtcaggatg

SEQ ID NO: 143903 - DNA, 20 bp, human
gtcgggtccgtctctgcccg

SEQ ID NO: 143904 - DNA, 20 bp, human
ggaggctgctgggtagcgtg

SEQ ID NO: 143905 - DNA, 20 bp, human
gcggctgcgccatgaccagg

SEQ ID NO: 143906 - DNA, 20 bp, human
gccgcgaagagatggagtgt

SEQ ID NO: 143907 - DNA, 20 bp, human
ggtttgcgctgaggcaatgg

SEQ ID NO: 143908 - DNA, 20 bp, human
gcccgagggacgctccaaga

SEQ ID NO: 143909 - DNA, 20 bp, human
gagcacccggcagagcgagt

SEQ ID NO: 143910 - DNA, 20 bp, human
ggagtccccgcgtagttagt

SEQ ID NO: 143911 - DNA, 20 bp, human
gattgcctcagcgcaaacgg

SEQ ID NO: 143912 - DNA, 20 bp, human
gagccgagaggacccggaag

SEQ ID NO: 143913 - DNA, 20 bp, human
gggccgcggacgacgatgag

SEQ ID NO: 143914 - DNA, 20 bp, human
gcgcggacgacgatgagcgg

SEQ ID NO: 143915 - DNA, 20 bp, human
ggcggtgcgctccgtcacca

SEQ ID NO: 143916 - DNA, 20 bp, human
gccccggactgcaatacctg

SEQ ID NO: 143917 - DNA, 20 bp, human
gccgtgactccaccccggag

SEQ ID NO: 143918 - DNA, 20 bp, human
gattgcagtccggggctgga

SEQ ID NO: 143919 - DNA, 20 bp, human
gctggcatggagtagaagtg

SEQ ID NO: 143920 - DNA, 20 bp, human
ggtgatagacccggtatccg

SEQ ID NO: 143921 - DNA, 20 bp, human
gccccacgtggcagttctag

SEQ ID NO: 143922 - DNA, 20 bp, human
ggcgagggtccccggatacc

SEQ ID NO: 143923 - DNA, 20 bp, human
ggcaatacctgcggcgactt

SEQ ID NO: 143924 - DNA, 20 bp, human
gccatgccaggtccattggt

SEQ ID NO: 143925 - DNA, 20 bp, human
gttctaggggataggagacg

SEQ ID NO: 143926 - DNA, 20 bp, human
gggagacggcaggtcgggta

SEQ ID NO: 143927 - DNA, 20 bp, human
gcgacgggccgagttctgag

SEQ ID NO: 143928 - DNA, 20 bp, human
ggagcctccgggacggcgag

SEQ ID NO: 143929 - DNA, 20 bp, human
gacaggcctagtgagcaatg

SEQ ID NO: 143930 - DNA, 20 bp, human
gcctccgggacggcgagcgg

SEQ ID NO: 143931 - DNA, 20 bp, human
gagcggctggattcccaaat

SEQ ID NO: 143932 - DNA, 20 bp, human
gccgtcggaaaatacccctg

SEQ ID NO: 143933 - DNA, 20 bp, human
gccggcacccacacagacag

SEQ ID NO: 143934 - DNA, 20 bp, human
gtgctctcagctccctcgac

SEQ ID NO: 143935 - DNA, 20 bp, human
gcacggctcccctcagaact

SEQ ID NO: 143936 - DNA, 20 bp, human
gggtcggcgcccttacctgg

SEQ ID NO: 143937 - DNA, 20 bp, human
gcagcggtggcggagcgaac

SEQ ID NO: 143938 - DNA, 20 bp, human
gccgccgaggcagcaatgtc

SEQ ID NO: 143939 - DNA, 20 bp, human
gcctcgggctccagcggtgg

SEQ ID NO: 143940 - DNA, 20 bp, human
gctaccccacccccaggtaa

SEQ ID NO: 143941 - DNA, 20 bp, human
gagttccctccgccctcctc

SEQ ID NO: 143942 - DNA, 20 bp, human
ggaggtggagggtggaacgc

SEQ ID NO: 143943 - DNA, 20 bp, human
gcggccacctgggagaactg

SEQ ID NO: 143944 - DNA, 20 bp, human
ggcttcagagcgcgaggtgg

SEQ ID NO: 143945 - DNA, 20 bp, human
ggccgcccgctgctacgctg

SEQ ID NO: 143946 - DNA, 20 bp, human
gtcgcccgcttcgcccgggt

SEQ ID NO: 143947 - DNA, 20 bp, human
gcagacctacccgggcgaag

SEQ ID NO: 143948 - DNA, 20 bp, human
ggcggagcccagacctaccc

SEQ ID NO: 143949 - DNA, 20 bp, human
gagcggcctggacggaaggt

SEQ ID NO: 143950 - DNA, 20 bp, human
ggctgacggagacggaatgt

SEQ ID NO: 143951 - DNA, 20 bp, human
ggacgctgcttcggagccag

SEQ ID NO: 143952 - DNA, 20 bp, human
gggctccgaagcagcgtctg

SEQ ID NO: 143953 - DNA, 20 bp, human
gaagcgggcgagcggtggtt

SEQ ID NO: 143954 - DNA, 20 bp, human
gccccggaaagcgctggtat

SEQ ID NO: 143955 - DNA, 20 bp, human
gcggctggcgctggagatcc

SEQ ID NO: 143956 - DNA, 20 bp, human
gcgggcggacccacctgcgc

SEQ ID NO: 143957 - DNA, 20 bp, human
gagacaggggaagggtccag

SEQ ID NO: 143958 - DNA, 20 bp, human
gggctcagggttcaagacag

SEQ ID NO: 143959 - DNA, 20 bp, human
gctgtgggcggagctagtag

SEQ ID NO: 143960 - DNA, 20 bp, human
gctagagcggcgccacgtcc

SEQ ID NO: 143961 - DNA, 20 bp, human
gtggtagcccttgaagtctg

SEQ ID NO: 143962 - DNA, 20 bp, human
gacccacctgcgctgggagg

SEQ ID NO: 143963 - DNA, 20 bp, human
ggctacaaggatgaacgggt

SEQ ID NO: 143964 - DNA, 20 bp, human
gttctctcctcagacttcaa

SEQ ID NO: 143965 - DNA, 20 bp, human
gcagggttcaagacagggga

SEQ ID NO: 143966 - DNA, 20 bp, human
gccggctcctaagtctaccc

SEQ ID NO: 143967 - DNA, 20 bp, human
gcgctgctgtccggatgggt

SEQ ID NO: 143968 - DNA, 20 bp, human
ggatgggttggtagcagaca

SEQ ID NO: 143969 - DNA, 20 bp, human
gagagagcagggtcagttcc

SEQ ID NO: 143970 - DNA, 20 bp, human
gttagcgctgctgtccggat

SEQ ID NO: 143971 - DNA, 20 bp, human
gcaccaggaaaccaatccta

SEQ ID NO: 143972 - DNA, 20 bp, human
gaacaggtcatgaagattac

SEQ ID NO: 143973 - DNA, 20 bp, human
gctcctttccctgttagaca

SEQ ID NO: 143974 - DNA, 20 bp, human
gggagtagggttaagcacac

SEQ ID NO: 143975 - DNA, 20 bp, human
gaggccctccctacagaaga

SEQ ID NO: 143976 - DNA, 20 bp, human
ggccgagggccgaaaccgga

SEQ ID NO: 143977 - DNA, 20 bp, human
ggcagcggcgatggaaccag

SEQ ID NO: 143978 - DNA, 20 bp, human
ggcgctcgaagcccccccgg

SEQ ID NO: 143979 - DNA, 20 bp, human
ggccacaggctcctcagcca

SEQ ID NO: 143980 - DNA, 20 bp, human
ggcccagggaagggttcccg

SEQ ID NO: 143981 - DNA, 20 bp, human
ggagcaccggccttggacgg

SEQ ID NO: 143982 - DNA, 20 bp, human
gcgccgagctgaggcccgag

SEQ ID NO: 143983 - DNA, 20 bp, human
gcggctgacactaactcgct

SEQ ID NO: 143984 - DNA, 20 bp, human
ggccgcgggaacccttccct

SEQ ID NO: 143985 - DNA, 20 bp, human
ggctcgtcgggggagactgt

SEQ ID NO: 143986 - DNA, 20 bp, human
gtagcagctgcgaggacgcg

SEQ ID NO: 143987 - DNA, 20 bp, human
gcgctctcgaaccaccccgc

SEQ ID NO: 143988 - DNA, 20 bp, human
ggatgtcctcgccatctaag

SEQ ID NO: 143989 - DNA, 20 bp, human
gggtgcgagctgggccggcg

SEQ ID NO: 143990 - DNA, 20 bp, human
ggcgaggacgcggggcgagc

SEQ ID NO: 143991 - DNA, 20 bp, human
gagtgcgctgcggtgcgagc

SEQ ID NO: 143992 - DNA, 20 bp, human
ggctgctacgcaaccgcgca

SEQ ID NO: 143993 - DNA, 20 bp, human
ggagcgcgcagagtccagac

SEQ ID NO: 143994 - DNA, 20 bp, human
gccggaagtggagtgcgctg

SEQ ID NO: 143995 - DNA, 20 bp, human
gagtccagggatgccgagga

SEQ ID NO: 143996 - DNA, 20 bp, human
ggctctcgaaccacgcccgc

SEQ ID NO: 143997 - DNA, 20 bp, human
gcacttagatggcaaggaca

SEQ ID NO: 143998 - DNA, 20 bp, human
ggcgcactccacttccggct

SEQ ID NO: 143999 - DNA, 20 bp, human
ggcgaggacgcgggccgagc

SEQ ID NO: 144000 - DNA, 20 bp, human
gagtgcgctgcggcgcgagc

SEQ ID NO: 144001 - DNA, 20 bp, human
ggctgctacgcaaccgcaca

SEQ ID NO: 144002 - DNA, 20 bp, human
ggagcgcgcagagtccagac

SEQ ID NO: 144003 - DNA, 20 bp, human
gagtccagggatgccgagga

SEQ ID NO: 144004 - DNA, 20 bp, human
gccggaagtggagtgcgctg

SEQ ID NO: 144005 - DNA, 20 bp, human
gggctcacgcctatagtcca

SEQ ID NO: 144006 - DNA, 20 bp, human
gctggatcgggtgaaggtac

SEQ ID NO: 144007 - DNA, 20 bp, human
gtactggtgttgggagactc

SEQ ID NO: 144008 - DNA, 20 bp, human
gaaagtgtctggagccccag

SEQ ID NO: 144009 - DNA, 20 bp, human
gacaggcgttaacccaggga

SEQ ID NO: 144010 - DNA, 20 bp, human
gcaagatggcgtccctggat

SEQ ID NO: 144011 - DNA, 20 bp, human
ggcgtccctggatcgggtga

SEQ ID NO: 144012 - DNA, 20 bp, human
gtaagggtacagaagttagt

SEQ ID NO: 144013 - DNA, 20 bp, human
gagtggcaagatggcgtccc

SEQ ID NO: 144014 - DNA, 20 bp, human
gccgcgaaggcaaaagaccc

SEQ ID NO: 144015 - DNA, 20 bp, human
ggcggcttaccctacctctg

SEQ ID NO: 144016 - DNA, 20 bp, human
gttcattagggggatcccgg

SEQ ID NO: 144017 - DNA, 20 bp, human
gctgacgcgccgcctcccgt

SEQ ID NO: 144018 - DNA, 20 bp, human
gcactgcccggaggaggtag

SEQ ID NO: 144019 - DNA, 20 bp, human
ggtcaggacggagctctact

SEQ ID NO: 144020 - DNA, 20 bp, human
gagtcacgaaacctaggcta

SEQ ID NO: 144021 - DNA, 20 bp, human
gaggtactgagtggcatcat

SEQ ID NO: 144022 - DNA, 20 bp, human
gagccgcagatcagacgggt

SEQ ID NO: 144023 - DNA, 20 bp, human
gagcaagccgcagatcagac

SEQ ID NO: 144024 - DNA, 20 bp, human
gcaggggcgccagtcgggat

SEQ ID NO: 144025 - DNA, 20 bp, human
gtcagcatagttgtccgccg

SEQ ID NO: 144026 - DNA, 20 bp, human
gagccggcgcggccagaggc

SEQ ID NO: 144027 - DNA, 20 bp, human
gcgagccggcgccaagatgg

SEQ ID NO: 144028 - DNA, 20 bp, human
ggactcgggaacctcagccg

SEQ ID NO: 144029 - DNA, 20 bp, human
gtccggcgcgaccgctctcc

SEQ ID NO: 144030 - DNA, 20 bp, human
gtgctccgctccggcccccg

SEQ ID NO: 144031 - DNA, 20 bp, human
gcgctcggacgtcccagccc

SEQ ID NO: 144032 - DNA, 20 bp, human
ggcccagcgcaccccacaac

SEQ ID NO: 144033 - DNA, 20 bp, human
gcagaggcgcttcgccaagg

SEQ ID NO: 144034 - DNA, 20 bp, human
gcatgaaccaggcgttgcag

SEQ ID NO: 144035 - DNA, 20 bp, human
gcgcgcgggtctccgaaccc

SEQ ID NO: 144036 - DNA, 20 bp, human
gctacgagcgctcccgagga

SEQ ID NO: 144037 - DNA, 20 bp, human
gcgcccgggccgtcagggtc

SEQ ID NO: 144038 - DNA, 20 bp, human
gcgcgggcgggcgcccccac

SEQ ID NO: 144039 - DNA, 20 bp, human
gtccatcgagagccggaacc

SEQ ID NO: 144040 - DNA, 20 bp, human
gaggccggatgtgagtggag

SEQ ID NO: 144041 - DNA, 20 bp, human
gcgggaagaaagccggaggg

SEQ ID NO: 144042 - DNA, 20 bp, human
gcgcccccaccggaccctga

SEQ ID NO: 144043 - DNA, 20 bp, human
ggggccgtcagggtccggtg

SEQ ID NO: 144044 - DNA, 20 bp, human
ggtccgggaagaaagccgga

SEQ ID NO: 144045 - DNA, 20 bp, human
gtccggctctcgatggagga

SEQ ID NO: 144046 - DNA, 20 bp, human
gccagggcggaaggatctca

SEQ ID NO: 144047 - DNA, 20 bp, human
ggcgggcgcaaggggtgtgg

SEQ ID NO: 144048 - DNA, 20 bp, human
gctgaggagcagcggtggtg

SEQ ID NO: 144049 - DNA, 20 bp, human
gtctgcgggcgcaaggggtg

SEQ ID NO: 144050 - DNA, 20 bp, human
ggtggagggtgcaggactat

SEQ ID NO: 144051 - DNA, 20 bp, human
gggagcctggagagtgtcgg

SEQ ID NO: 144052 - DNA, 20 bp, human
gctatgggtgagagtgccca

SEQ ID NO: 144053 - DNA, 20 bp, human
gcaggtcagcctggggacaa

SEQ ID NO: 144054 - DNA, 20 bp, human
gaccccagaagccatctcgg

SEQ ID NO: 144055 - DNA, 20 bp, human
gatccacagagtaaagactg

SEQ ID NO: 144056 - DNA, 20 bp, human
gcgagctgcggagaaatgcc

SEQ ID NO: 144057 - DNA, 20 bp, human
gcgcagggcgccccacactg

SEQ ID NO: 144058 - DNA, 20 bp, human
ggcggccgcgagccgagctg

SEQ ID NO: 144059 - DNA, 20 bp, human
ggcagaggccccgactccga

SEQ ID NO: 144060 - DNA, 20 bp, human
ggaaatgcccggcgccgcag

SEQ ID NO: 144061 - DNA, 20 bp, human
ggaggccccgactccgaggg

SEQ ID NO: 144062 - DNA, 20 bp, human
gctgccgccaccctcggagt

SEQ ID NO: 144063 - DNA, 20 bp, human
gtgcgccccggggtcgagga

SEQ ID NO: 144064 - DNA, 20 bp, human
gagagggtggggccggctga

SEQ ID NO: 144065 - DNA, 20 bp, human
gtgctgcccggctcccgctt

SEQ ID NO: 144066 - DNA, 20 bp, human
ggaggcgcggagcgaagtga

SEQ ID NO: 144067 - DNA, 20 bp, human
gcgctccgcgcctcacccaa

SEQ ID NO: 144068 - DNA, 20 bp, human
gccgggcctctcaaacacca

SEQ ID NO: 144069 - DNA, 20 bp, human
gtgactgaagtgagtagtgg

SEQ ID NO: 144070 - DNA, 20 bp, human
ggcggcagacgcacctggtc

SEQ ID NO: 144071 - DNA, 20 bp, human
ggcttcctatcacaatccag

SEQ ID NO: 144072 - DNA, 20 bp, human
gcgagacccacgaagtagag

SEQ ID NO: 144073 - DNA, 20 bp, human
ggctgctctgccgttgggtg

SEQ ID NO: 144074 - DNA, 20 bp, human
ggcgggacagcgggacaggc

SEQ ID NO: 144075 - DNA, 20 bp, human
gcaccccagaaaagcccgag

SEQ ID NO: 144076 - DNA, 20 bp, human
gaggcggctccgaggaaccg

SEQ ID NO: 144077 - DNA, 20 bp, human
gggagggccggtctgaagag

SEQ ID NO: 144078 - DNA, 20 bp, human
gaagtccctgaagaggagcg

SEQ ID NO: 144079 - DNA, 20 bp, human
gctccacctgcgctgagagg

SEQ ID NO: 144080 - DNA, 20 bp, human
ggccgcctcgctcctcttca

SEQ ID NO: 144081 - DNA, 20 bp, human
gctgcgctgagaggtggaaa

SEQ ID NO: 144082 - DNA, 20 bp, human
gactggcttcacttcctccg

SEQ ID NO: 144083 - DNA, 20 bp, human
ggggccggtctgaagagtgg

SEQ ID NO: 144084 - DNA, 20 bp, human
gtagttaagtgacataggtg

SEQ ID NO: 144085 - DNA, 20 bp, human
gtcagggactttgctgagaa

SEQ ID NO: 144086 - DNA, 20 bp, human
gcgaagagcggaggcgacca

SEQ ID NO: 144087 - DNA, 20 bp, human
ggggaggccgtacctccgag

SEQ ID NO: 144088 - DNA, 20 bp, human
ggggactaccctaggtgaaa

SEQ ID NO: 144089 - DNA, 20 bp, human
ggacccgcccatcccatctg

SEQ ID NO: 144090 - DNA, 20 bp, human
gggcgaccagggactaccct

SEQ ID NO: 144091 - DNA, 20 bp, human
gtcaacgccgagcctctcgg

SEQ ID NO: 144092 - DNA, 20 bp, human
gtcggcgttgagcccgggta

SEQ ID NO: 144093 - DNA, 20 bp, human
ggtggctgccctttcaccta

SEQ ID NO: 144094 - DNA, 20 bp, human
gggaggagcgacgagagccc

SEQ ID NO: 144095 - DNA, 20 bp, human
gaaatccccgctgcaggaca

SEQ ID NO: 144096 - DNA, 20 bp, human
gagcgccggaggctagtggg

SEQ ID NO: 144097 - DNA, 20 bp, human
gtggagcgccggaggctagt

SEQ ID NO: 144098 - DNA, 20 bp, human
ggctgacccccagcatcctc

SEQ ID NO: 144099 - DNA, 20 bp, human
gtcgctcccgaggatgctgg

SEQ ID NO: 144100 - DNA, 20 bp, human
gtcagccacccactagcctc

SEQ ID NO: 144101 - DNA, 20 bp, human
ggcatcctcgggagcgacca

SEQ ID NO: 144102 - DNA, 20 bp, human
gcccggaggccaccgagact

SEQ ID NO: 144103 - DNA, 20 bp, human
gtagcgcggggaatttcgag

SEQ ID NO: 144104 - DNA, 20 bp, human
gggccaccgagactcggcca

SEQ ID NO: 144105 - DNA, 20 bp, human
ggagtccatggtcgctcccg

SEQ ID NO: 144106 - DNA, 20 bp, human
gcgatttgaaccgaggattt

SEQ ID NO: 144107 - DNA, 20 bp, human
gaaggaggcgccggctgtgg

SEQ ID NO: 144108 - DNA, 20 bp, human
ggcgtggaaaaagagacgga

SEQ ID NO: 144109 - DNA, 20 bp, human
gcaggagtccggctccccga

SEQ ID NO: 144110 - DNA, 20 bp, human
gtaccgaacaagcgatgatg

SEQ ID NO: 144111 - DNA, 20 bp, human
ggcccaagctgcatgggtcc

SEQ ID NO: 144112 - DNA, 20 bp, human
gcggctccccgacggcagag

SEQ ID NO: 144113 - DNA, 20 bp, human
gatgcgggcccaagctgcat

SEQ ID NO: 144114 - DNA, 20 bp, human
ggaccgggccgcctactccg

SEQ ID NO: 144115 - DNA, 20 bp, human
gtgagccccgcacccgagtt

SEQ ID NO: 144116 - DNA, 20 bp, human
ggtgtggcgtgccagagcag

SEQ ID NO: 144117 - DNA, 20 bp, human
ggcgcattgcagacgcccag

SEQ ID NO: 144118 - DNA, 20 bp, human
gcccagcggcgccaagaacc

SEQ ID NO: 144119 - DNA, 20 bp, human
ggaacccggccaagctgact

SEQ ID NO: 144120 - DNA, 20 bp, human
gcacccggcccggaactctg

SEQ ID NO: 144121 - DNA, 20 bp, human
ggcacgccacacctcagacg

SEQ ID NO: 144122 - DNA, 20 bp, human
gcgggtgcgtgtgggaatgt

SEQ ID NO: 144123 - DNA, 20 bp, human
gaactctgaggagtcgtctg

SEQ ID NO: 144124 - DNA, 20 bp, human
gtcctcaggcgggaccctcc

SEQ ID NO: 144125 - DNA, 20 bp, human
gaggagtcgccaagtcagct

SEQ ID NO: 144126 - DNA, 20 bp, human
gcgcctgggcgctaagatgg

SEQ ID NO: 144127 - DNA, 20 bp, human
gggccaagctctccaagact

SEQ ID NO: 144128 - DNA, 20 bp, human
gtgcctgccccggaagtggt

SEQ ID NO: 144129 - DNA, 20 bp, human
ggcgcgcctgggcgctaaga

SEQ ID NO: 144130 - DNA, 20 bp, human
ggtcacaagctcggattcct

SEQ ID NO: 144131 - DNA, 20 bp, human
gggaacgtggagcccagtct

SEQ ID NO: 144132 - DNA, 20 bp, human
gtggcggggcccgagcgacg

SEQ ID NO: 144133 - DNA, 20 bp, human
gcgcgcgccgaccacttccg

SEQ ID NO: 144134 - DNA, 20 bp, human
ggctagaatcccaacgggag

SEQ ID NO: 144135 - DNA, 20 bp, human
gcccgcgagagcgctgacat

SEQ ID NO: 144136 - DNA, 20 bp, human
ggaatccgctagctcaccac

SEQ ID NO: 144137 - DNA, 20 bp, human
ggtctgcagaaggcgcgagg

SEQ ID NO: 144138 - DNA, 20 bp, human
gccgctagctcaccacagga

SEQ ID NO: 144139 - DNA, 20 bp, human
gtctcggcgagtcacgatga

SEQ ID NO: 144140 - DNA, 20 bp, human
gcggcgagtcacgatgatgg

SEQ ID NO: 144141 - DNA, 20 bp, human
gtgggggagggggcacgtct

SEQ ID NO: 144142 - DNA, 20 bp, human
gggggtcggcgagacaagca

SEQ ID NO: 144143 - DNA, 20 bp, human
gcggcagccgagctgcgcgg

SEQ ID NO: 144144 - DNA, 20 bp, human
gcagccacggagtctgcaga

SEQ ID NO: 144145 - DNA, 20 bp, human
ggcgcgcataccgtctcctc

SEQ ID NO: 144146 - DNA, 20 bp, human
gcggttgcggggtcgcattg

SEQ ID NO: 144147 - DNA, 20 bp, human
gcggggtcgcattgtggcta

SEQ ID NO: 144148 - DNA, 20 bp, human
gagggacctggagcccacaa

SEQ ID NO: 144149 - DNA, 20 bp, human
ggccgccctgcggatcacgt

SEQ ID NO: 144150 - DNA, 20 bp, human
ggcccacgtgatccgcaggg

SEQ ID NO: 144151 - DNA, 20 bp, human
gctacacctgtggagcccta

SEQ ID NO: 144152 - DNA, 20 bp, human
ggcccacaaaggcttaactg

SEQ ID NO: 144153 - DNA, 20 bp, human
gaggagcagaagcgtcccta

SEQ ID NO: 144154 - DNA, 20 bp, human
gcgtccacgccgctctcctg

SEQ ID NO: 144155 - DNA, 20 bp, human
ggaggcccacgtgatccgca

SEQ ID NO: 144156 - DNA, 20 bp, human
gaagcgccgcactctcctta

SEQ ID NO: 144157 - DNA, 20 bp, human
gccgagccctaaggagagtg

SEQ ID NO: 144158 - DNA, 20 bp, human
gggccagagaccgagcccta

SEQ ID NO: 144159 - DNA, 20 bp, human
gggcgtgaccctgggcgaga

SEQ ID NO: 144160 - DNA, 20 bp, human
ggctgcgcgcggtccgccag

SEQ ID NO: 144161 - DNA, 20 bp, human
gcagcagctgagggtcggtc

SEQ ID NO: 144162 - DNA, 20 bp, human
ggagagtgcggcgcttcccg

SEQ ID NO: 144163 - DNA, 20 bp, human
ggcagtgtgaaacccggacg

SEQ ID NO: 144164 - DNA, 20 bp, human
gtggccggtccagtgctcag

SEQ ID NO: 144165 - DNA, 20 bp, human
ggttcccagctgcacgcctc

SEQ ID NO: 144166 - DNA, 20 bp, human
gggcggagggctccgaagtc

SEQ ID NO: 144167 - DNA, 20 bp, human
gcacctcacaggccgcacca

SEQ ID NO: 144168 - DNA, 20 bp, human
gagtcatacagcccagtaag

SEQ ID NO: 144169 - DNA, 20 bp, human
ggatacttctgagcaacggg

SEQ ID NO: 144170 - DNA, 20 bp, human
gaccggagggcagcgatggt

SEQ ID NO: 144171 - DNA, 20 bp, human
gcccgcccaaaaccagactt

SEQ ID NO: 144172 - DNA, 20 bp, human
ggtggctctcactggagact

SEQ ID NO: 144173 - DNA, 20 bp, human
ggacgactggtaacaggggg

SEQ ID NO: 144174 - DNA, 20 bp, human
gcggcgacggttgtgaaggg

SEQ ID NO: 144175 - DNA, 20 bp, human
gttggacgactggtaacagg

SEQ ID NO: 144176 - DNA, 20 bp, human
gtcaggaggcgttaaagagg

SEQ ID NO: 144177 - DNA, 20 bp, human
ggaggcgttaaagaggaggt

SEQ ID NO: 144178 - DNA, 20 bp, human
gttctgagctcggccatccg

SEQ ID NO: 144179 - DNA, 20 bp, human
ggcaggcctgcatgacagag

SEQ ID NO: 144180 - DNA, 20 bp, human
ggacatgacagcgaatggaa

SEQ ID NO: 144181 - DNA, 20 bp, human
gtcctcaggaggcgttaaag

SEQ ID NO: 144182 - DNA, 20 bp, human
gggagagacatgacagcgaa

SEQ ID NO: 144183 - DNA, 20 bp, human
ggctcggccatccgcggcgt

SEQ ID NO: 144184 - DNA, 20 bp, human
gagtaatagctccaaagcag

SEQ ID NO: 144185 - DNA, 20 bp, human
gctggtgcctcgcttgtctg

SEQ ID NO: 144186 - DNA, 20 bp, human
gggtggggaaacttgaaagt

SEQ ID NO: 144187 - DNA, 20 bp, human
gtcgtgggtttcgatattgg

SEQ ID NO: 144188 - DNA, 20 bp, human
gccgcggggaaactgtgtaa

SEQ ID NO: 144189 - DNA, 20 bp, human
ggaaccccacttccccacaa

SEQ ID NO: 144190 - DNA, 20 bp, human
ggatgctgcagacccggtac

SEQ ID NO: 144191 - DNA, 20 bp, human
gggaaactgtgtaaagggtg

SEQ ID NO: 144192 - DNA, 20 bp, human
gctccaacaccacctgaagt

SEQ ID NO: 144193 - DNA, 20 bp, human
gaaacccacgagcctaggga

SEQ ID NO: 144194 - DNA, 20 bp, human
gaagttggatgctgcagacc

SEQ ID NO: 144195 - DNA, 20 bp, human
ggtactggaaagtttcatgt

SEQ ID NO: 144196 - DNA, 20 bp, human
gggcgagagaacgaagactg

SEQ ID NO: 144197 - DNA, 20 bp, human
gcaggctcacctgctaaccc

SEQ ID NO: 144198 - DNA, 20 bp, human
gtgaatggttaggagaactg

SEQ ID NO: 144199 - DNA, 20 bp, human
ggcagaatctaacggagact

SEQ ID NO: 144200 - DNA, 20 bp, human
ggagactgggctgaaggccg

SEQ ID NO: 144201 - DNA, 20 bp, human
gactgctgaggaactcctag

SEQ ID NO: 144202 - DNA, 20 bp, human
ggactcctgatggcaagctg

SEQ ID NO: 144203 - DNA, 20 bp, human
gaggtgagcctgcgatgcgc

SEQ ID NO: 144204 - DNA, 20 bp, human
gctgtaaacatggacgtggg

SEQ ID NO: 144205 - DNA, 20 bp, human
gccgcaccgctggagacagc

SEQ ID NO: 144206 - DNA, 20 bp, human
gggaggcggcaccaagggta

SEQ ID NO: 144207 - DNA, 20 bp, human
ggaggaggaggcggcaccaa

SEQ ID NO: 144208 - DNA, 20 bp, human
gcggccctctaggaatggag

SEQ ID NO: 144209 - DNA, 20 bp, human
gccagcctggaacccggaag

SEQ ID NO: 144210 - DNA, 20 bp, human
gcaacctgggcaggccccga

SEQ ID NO: 144211 - DNA, 20 bp, human
gggagccaagctctaaaaca

SEQ ID NO: 144212 - DNA, 20 bp, human
gcgcgggcctcgcacaacct

SEQ ID NO: 144213 - DNA, 20 bp, human
gctgggcgcgggaatcccgg

SEQ ID NO: 144214 - DNA, 20 bp, human
gtccggcctgcggggaacat

SEQ ID NO: 144215 - DNA, 20 bp, human
gaagcgcggccctctaggaa

SEQ ID NO: 144216 - DNA, 20 bp, human
gcacacagggagctcgatct

SEQ ID NO: 144217 - DNA, 20 bp, human
ggcccgaggcgcgtaagtgg

SEQ ID NO: 144218 - DNA, 20 bp, human
ggcagcgcgcggtgcacaca

SEQ ID NO: 144219 - DNA, 20 bp, human
gcgaggcgcgtaagtggggg

SEQ ID NO: 144220 - DNA, 20 bp, human
gcgatctaggctatggacaa

SEQ ID NO: 144221 - DNA, 20 bp, human
gcacggctagaaccaccccg

SEQ ID NO: 144222 - DNA, 20 bp, human
ggggagctcgatctaggcta

SEQ ID NO: 144223 - DNA, 20 bp, human
ggctgcccgaggcgcgtaag

SEQ ID NO: 144224 - DNA, 20 bp, human
ggttgagttgcagggagcgg

SEQ ID NO: 144225 - DNA, 20 bp, human
gtccgggcctcccgagaggt

SEQ ID NO: 144226 - DNA, 20 bp, human
ggccgcgtcacgctcccggg

SEQ ID NO: 144227 - DNA, 20 bp, human
ggcctcccgggagcgtgacg

SEQ ID NO: 144228 - DNA, 20 bp, human
gcagcagccagggtcgatcc

SEQ ID NO: 144229 - DNA, 20 bp, human
gctcacccgcgtgccccgga

SEQ ID NO: 144230 - DNA, 20 bp, human
gcacgctcccgggaggctga

SEQ ID NO: 144231 - DNA, 20 bp, human
gtgccccggaaggcgcccgg

SEQ ID NO: 144232 - DNA, 20 bp, human
ggcagcgccgggatcgaccc

SEQ ID NO: 144233 - DNA, 20 bp, human
gacgggccacgagaagtagg

SEQ ID NO: 144234 - DNA, 20 bp, human
gcgcgttccacgaagctaag

SEQ ID NO: 144235 - DNA, 20 bp, human
gacccctgcggccacgggag

SEQ ID NO: 144236 - DNA, 20 bp, human
ggatccttgagcttctccgg

SEQ ID NO: 144237 - DNA, 20 bp, human
gccggcggcgaggggatagc

SEQ ID NO: 144238 - DNA, 20 bp, human
gtcgccgccggagaagctca

SEQ ID NO: 144239 - DNA, 20 bp, human
ggggatagctggttaccaga

SEQ ID NO: 144240 - DNA, 20 bp, human
gcgagcgtcctggagagtgt

SEQ ID NO: 144241 - DNA, 20 bp, human
gccagcaaccagggcgtccc

SEQ ID NO: 144242 - DNA, 20 bp, human
gctgcgcaaagcgaccgcag

SEQ ID NO: 144243 - DNA, 20 bp, human
ggagagacccaaaagccaag

SEQ ID NO: 144244 - DNA, 20 bp, human
gccctgcaaagaagtccttc

SEQ ID NO: 144245 - DNA, 20 bp, human
gcggagcaggccaacgaggg

SEQ ID NO: 144246 - DNA, 20 bp, human
ggcgggaggttcgattgacc

SEQ ID NO: 144247 - DNA, 20 bp, human
gtaacgcgcgctttgggaac

SEQ ID NO: 144248 - DNA, 20 bp, human
ggcgcgctttgggaacagga

SEQ ID NO: 144249 - DNA, 20 bp, human
ggcgggtcggtgagtcttgg

SEQ ID NO: 144250 - DNA, 20 bp, human
gggtggagtcccagactggg

SEQ ID NO: 144251 - DNA, 20 bp, human
gtcccagtccgggtgaaggg

SEQ ID NO: 144252 - DNA, 20 bp, human
ggaaagtccgaggcccgggt

SEQ ID NO: 144253 - DNA, 20 bp, human
ggaccaagcagagattagtg

SEQ ID NO: 144254 - DNA, 20 bp, human
gacgagagattaggccaaag

SEQ ID NO: 144255 - DNA, 20 bp, human
gtaagccgagacgagagatt

SEQ ID NO: 144256 - DNA, 20 bp, human
gaacaggaggagtaagattg

SEQ ID NO: 144257 - DNA, 20 bp, human
ggagtgctgtcccttggaac

SEQ ID NO: 144258 - DNA, 20 bp, human
ggtctgagagaagaaatgtc

SEQ ID NO: 144259 - DNA, 20 bp, human
gcttactcctcctgttccaa

SEQ ID NO: 144260 - DNA, 20 bp, human
gtgtctggttcactgtatgt

SEQ ID NO: 144261 - DNA, 20 bp, human
gtggccacctcttagttaaa

SEQ ID NO: 144262 - DNA, 20 bp, human
ggttgatccatttaactaag

SEQ ID NO: 144263 - DNA, 20 bp, human
ggaagaaatgtctggtacaa

SEQ ID NO: 144264 - DNA, 20 bp, human
ggatccatttaactaagagg

SEQ ID NO: 144265 - DNA, 20 bp, human
gatacagtgaaccagacata

SEQ ID NO: 144266 - DNA, 20 bp, human
gacggccttgccgagcactg

SEQ ID NO: 144267 - DNA, 20 bp, human
gagaagagcggaagggggtt

SEQ ID NO: 144268 - DNA, 20 bp, human
ggaagggaccccggacccgg

SEQ ID NO: 144269 - DNA, 20 bp, human
gccggaggtcgcggagagct

SEQ ID NO: 144270 - DNA, 20 bp, human
gtgaagtgcctggtcacggg

SEQ ID NO: 144271 - DNA, 20 bp, human
ggcatgaagtgcctggtcac

SEQ ID NO: 144272 - DNA, 20 bp, human
ggtgtgcgacccctcctctg

SEQ ID NO: 144273 - DNA, 20 bp, human
gtcacgggcggcaacgtgaa

SEQ ID NO: 144274 - DNA, 20 bp, human
gctggaacccttggaggacg

SEQ ID NO: 144275 - DNA, 20 bp, human
gcaggccggtgtgtgaattg

SEQ ID NO: 144276 - DNA, 20 bp, human
gctcatcacgcacttcagca

SEQ ID NO: 144277 - DNA, 20 bp, human
gttcccaaacggctttacgg

SEQ ID NO: 144278 - DNA, 20 bp, human
gcccggtgacaggatggtga

SEQ ID NO: 144279 - DNA, 20 bp, human
gctacaccccaaccagcggg

SEQ ID NO: 144280 - DNA, 20 bp, human
gcacctgggccgtcgagctg

SEQ ID NO: 144281 - DNA, 20 bp, human
ggcggagcccggtgacagga

SEQ ID NO: 144282 - DNA, 20 bp, human
ggacggtggtggtgactgag

SEQ ID NO: 144283 - DNA, 20 bp, human
gaccactacaccccaaccag

SEQ ID NO: 144284 - DNA, 20 bp, human
gaaggcctggctctcgggtg

SEQ ID NO: 144285 - DNA, 20 bp, human
gcgaccaaggcctggctctc

SEQ ID NO: 144286 - DNA, 20 bp, human
gggacgaagctccccctcca

SEQ ID NO: 144287 - DNA, 20 bp, human
ggcacagccgggaaaactga

SEQ ID NO: 144288 - DNA, 20 bp, human
ggccggccccagccaacggc

SEQ ID NO: 144289 - DNA, 20 bp, human
ggccccagccaacggcgggt

SEQ ID NO: 144290 - DNA, 20 bp, human
gcgctgctcccacccgccgt

SEQ ID NO: 144291 - DNA, 20 bp, human
gcgcaccccacactcacctc

SEQ ID NO: 144292 - DNA, 20 bp, human
gcccagcctgcggggatccg

SEQ ID NO: 144293 - DNA, 20 bp, human
gctgccggcggcgcaacggg

SEQ ID NO: 144294 - DNA, 20 bp, human
gtgagcctggctgtccgcgt

SEQ ID NO: 144295 - DNA, 20 bp, human
gccaggctcaggagctctcg

SEQ ID NO: 144296 - DNA, 20 bp, human
gtcagggcagtttctaccgc

SEQ ID NO: 144297 - DNA, 20 bp, human
gagtttctaccgcaggctta

SEQ ID NO: 144298 - DNA, 20 bp, human
ggcaatgtgacccttcccag

SEQ ID NO: 144299 - DNA, 20 bp, human
gaggccctaggtgaccccta

SEQ ID NO: 144300 - DNA, 20 bp, human
gagacgccagacgtgtaagg

SEQ ID NO: 144301 - DNA, 20 bp, human
ggttgtttccgcggtagtca

SEQ ID NO: 144302 - DNA, 20 bp, human
ggctctggcgcgaaggacga

SEQ ID NO: 144303 - DNA, 20 bp, human
gtggccttaggggtcaccta

SEQ ID NO: 144304 - DNA, 20 bp, human
gagaagtactgcctgtacgg

SEQ ID NO: 144305 - DNA, 20 bp, human
gtatataggtgccaccgtac

SEQ ID NO: 144306 - DNA, 20 bp, human
ggcgcacagggctagaagtc

SEQ ID NO: 144307 - DNA, 20 bp, human
ggtctcaggaggtcatacac

SEQ ID NO: 144308 - DNA, 20 bp, human
gggatattcttcgcatactg

SEQ ID NO: 144309 - DNA, 20 bp, human
gactgtggagagtaacaggc

SEQ ID NO: 144310 - DNA, 20 bp, human
gacgtgaggaagaggatccc

SEQ ID NO: 144311 - DNA, 20 bp, human
gacacacgctgaattcctgt

SEQ ID NO: 144312 - DNA, 20 bp, human
gtgctcttaaggatgacgtg

SEQ ID NO: 144313 - DNA, 20 bp, human
gacctggagtagaaggcggg

SEQ ID NO: 144314 - DNA, 20 bp, human
gaactgggtgtaacatccca

SEQ ID NO: 144315 - DNA, 20 bp, human
ggaaacaaaagaaggcgcac

SEQ ID NO: 144316 - DNA, 20 bp, human
gcgagtggtgagagaaccag

SEQ ID NO: 144317 - DNA, 20 bp, human
gtgccgtctctaggatggag

SEQ ID NO: 144318 - DNA, 20 bp, human
gccttctgccgtctctagga

SEQ ID NO: 144319 - DNA, 20 bp, human
gagccttggcataagcggaa

SEQ ID NO: 144320 - DNA, 20 bp, human
gtcctgctggcacaaggtag

SEQ ID NO: 144321 - DNA, 20 bp, human
gcttggcataagcggaaggg

SEQ ID NO: 144322 - DNA, 20 bp, human
ggcggcggggacgctggata

SEQ ID NO: 144323 - DNA, 20 bp, human
gggataaggcagggaggacg

SEQ ID NO: 144324 - DNA, 20 bp, human
ggacgctggataaggcaggg

SEQ ID NO: 144325 - DNA, 20 bp, human
gaggaaagcaggggctcgag

SEQ ID NO: 144326 - DNA, 20 bp, human
gcagcccgtggatcacctgg

SEQ ID NO: 144327 - DNA, 20 bp, human
ggagccgccaggtgatccac

SEQ ID NO: 144328 - DNA, 20 bp, human
gggactgccgggctgcacta

SEQ ID NO: 144329 - DNA, 20 bp, human
ggaacccccggagagtggag

SEQ ID NO: 144330 - DNA, 20 bp, human
ggcccagcccgtggatcacc

SEQ ID NO: 144331 - DNA, 20 bp, human
gtggcccctccactctccgg

SEQ ID NO: 144332 - DNA, 20 bp, human
gttggggagttggatcgcag

SEQ ID NO: 144333 - DNA, 20 bp, human
ggaaaggaacccccggagag

SEQ ID NO: 144334 - DNA, 20 bp, human
gagaagcgaagcccagcccg

SEQ ID NO: 144335 - DNA, 20 bp, human
gacccggcgggaaggagacg

SEQ ID NO: 144336 - DNA, 20 bp, human
gagggctgcgagggctaggt

SEQ ID NO: 144337 - DNA, 20 bp, human
gcgggctgcactaggaatcc

SEQ ID NO: 144338 - DNA, 20 bp, human
gccccccgggaacagagctg

SEQ ID NO: 144339 - DNA, 20 bp, human
gccgccgggtccactcccca

SEQ ID NO: 144340 - DNA, 20 bp, human
ggaggcacagaagcaaagct

SEQ ID NO: 144341 - DNA, 20 bp, human
ggctgttcttgccccagtag

SEQ ID NO: 144342 - DNA, 20 bp, human
gctccttccgaaaggcgggt

SEQ ID NO: 144343 - DNA, 20 bp, human
ggctgccattggggaccagg

SEQ ID NO: 144344 - DNA, 20 bp, human
ggggacaagagatttaatca

SEQ ID NO: 144345 - DNA, 20 bp, human
gaccccagctctgttcccgg

SEQ ID NO: 144346 - DNA, 20 bp, human
gcttgggccgccatcttaga

SEQ ID NO: 144347 - DNA, 20 bp, human
gctcccgccatctaagatgg

SEQ ID NO: 144348 - DNA, 20 bp, human
gcgctaccccagggtgacaa

SEQ ID NO: 144349 - DNA, 20 bp, human
gcccgcccaacgctacccca

SEQ ID NO: 144350 - DNA, 20 bp, human
gcttagatggcgggagtaag

SEQ ID NO: 144351 - DNA, 20 bp, human
ggggccgccatcttagatgg

SEQ ID NO: 144352 - DNA, 20 bp, human
gccaggccgttgtcaccctg

SEQ ID NO: 144353 - DNA, 20 bp, human
ggcccgcgattaagactctc

SEQ ID NO: 144354 - DNA, 20 bp, human
gcgcccgagagtcttaatcg

SEQ ID NO: 144355 - DNA, 20 bp, human
gtaagaggaaaacgattgtg

SEQ ID NO: 144356 - DNA, 20 bp, human
gtacaaatcagcagaaggta

SEQ ID NO: 144357 - DNA, 20 bp, human
gtctgagaaacaagagggca

SEQ ID NO: 144358 - DNA, 20 bp, human
gcatgttctgagaaacaaga

SEQ ID NO: 144359 - DNA, 20 bp, human
gaggtaaggtgtgagactct

SEQ ID NO: 144360 - DNA, 20 bp, human
gttactcaataccaaagaga

SEQ ID NO: 144361 - DNA, 20 bp, human
gaatcaggaacataataggg

SEQ ID NO: 144362 - DNA, 20 bp, human
gtcaggtgagaaaaataatc

SEQ ID NO: 144363 - DNA, 20 bp, human
gaaatgaatactggtagttc

SEQ ID NO: 144364 - DNA, 20 bp, human
gccttcagtggccctaaact

SEQ ID NO: 144365 - DNA, 20 bp, human
gacatctcaacactttggcc

SEQ ID NO: 144366 - DNA, 20 bp, human
gtgactgcccactatgactg

SEQ ID NO: 144367 - DNA, 20 bp, human
gctgcttgccacagtcatag

SEQ ID NO: 144368 - DNA, 20 bp, human
gttctgctggcagtaaaacc

SEQ ID NO: 144369 - DNA, 20 bp, human
gttggtgtctagatagggaa

SEQ ID NO: 144370 - DNA, 20 bp, human
gtcgttctctggcctaagac

SEQ ID NO: 144371 - DNA, 20 bp, human
ggcagtgtgttagtcacaag

SEQ ID NO: 144372 - DNA, 20 bp, human
ggtatcttgcactgttaatc

SEQ ID NO: 144373 - DNA, 20 bp, human
gtggatttggtgtctagata

SEQ ID NO: 144374 - DNA, 20 bp, human
gtgttagtcacaagtggatt

SEQ ID NO: 144375 - DNA, 20 bp, human
ggaatgaagatgccacattt

SEQ ID NO: 144376 - DNA, 20 bp, human
gtgggctccgagagacgagt

SEQ ID NO: 144377 - DNA, 20 bp, human
gcgcgaggcgtcgggatcct

SEQ ID NO: 144378 - DNA, 20 bp, human
ggcgcgctgggtggagatgt

SEQ ID NO: 144379 - DNA, 20 bp, human
gtaggccgggtgatgagccg

SEQ ID NO: 144380 - DNA, 20 bp, human
ggccgggtgatgagccgagg

SEQ ID NO: 144381 - DNA, 20 bp, human
gggcgtcgggatcctaggcc

SEQ ID NO: 144382 - DNA, 20 bp, human
gacacaaagcaaggaccccg

SEQ ID NO: 144383 - DNA, 20 bp, human
ggacaccaggcaggcccggc

SEQ ID NO: 144384 - DNA, 20 bp, human
gtcggcgtccgaacccgcct

SEQ ID NO: 144385 - DNA, 20 bp, human
gtgatgagccgaggcgggtt

SEQ ID NO: 144386 - DNA, 20 bp, human
gggacccggcgcagactcca

SEQ ID NO: 144387 - DNA, 20 bp, human
gtgcgagtcgcggaggaccc

SEQ ID NO: 144388 - DNA, 20 bp, human
gccgcttccccaggaaaacg

SEQ ID NO: 144389 - DNA, 20 bp, human
gccggcggtggaccagggag

SEQ ID NO: 144390 - DNA, 20 bp, human
gcggcggccgcgttttcctg

SEQ ID NO: 144391 - DNA, 20 bp, human
gccagccggcctgcgagtcg

SEQ ID NO: 144392 - DNA, 20 bp, human
gcggcggagggagcgcgggt

SEQ ID NO: 144393 - DNA, 20 bp, human
gccgcgcactcaccccatcg

SEQ ID NO: 144394 - DNA, 20 bp, human
gggcgctccccggacccagc

SEQ ID NO: 144395 - DNA, 20 bp, human
gcgcgcggggcgaaacaggt

SEQ ID NO: 144396 - DNA, 20 bp, human
gcacgcacaaccagcagcgg

SEQ ID NO: 144397 - DNA, 20 bp, human
gcacacactcgccaggacac

SEQ ID NO: 144398 - DNA, 20 bp, human
ggacagcgactcggtgacag

SEQ ID NO: 144399 - DNA, 20 bp, human
gccccggcgcgccacacggg

SEQ ID NO: 144400 - DNA, 20 bp, human
ggggccccggcgcgccacac

SEQ ID NO: 144401 - DNA, 20 bp, human
ggactcggtgacagcggcga

SEQ ID NO: 144402 - DNA, 20 bp, human
gagctggtgcggccaccccg

SEQ ID NO: 144403 - DNA, 20 bp, human
gagctgccaccgggacgcag

SEQ ID NO: 144404 - DNA, 20 bp, human
gctggccgcgcgtcacaaag

SEQ ID NO: 144405 - DNA, 20 bp, human
gcgagtgtgctggaactctc

SEQ ID NO: 144406 - DNA, 20 bp, human
gtcgtccccgggcagaacgt

SEQ ID NO: 144407 - DNA, 20 bp, human
ggcgccccggaagtgatctg

SEQ ID NO: 144408 - DNA, 20 bp, human
gcgcagccgctcactctcgg

SEQ ID NO: 144409 - DNA, 20 bp, human
gctgcagagccgccaggagg

SEQ ID NO: 144410 - DNA, 20 bp, human
gctgctgcagagccgccagg

SEQ ID NO: 144411 - DNA, 20 bp, human
gtctccccagagcaaagcgt

SEQ ID NO: 144412 - DNA, 20 bp, human
ggaaggaggagtctgacggg

SEQ ID NO: 144413 - DNA, 20 bp, human
gcatctcgcagctcgtcccc

SEQ ID NO: 144414 - DNA, 20 bp, human
gccccggaagtgatctgtgg

SEQ ID NO: 144415 - DNA, 20 bp, human
ggggctcactcgccccacag

SEQ ID NO: 144416 - DNA, 20 bp, human
gggcgcgctctcgagaggag

SEQ ID NO: 144417 - DNA, 20 bp, human
gggggttgcctaggcgacgc

SEQ ID NO: 144418 - DNA, 20 bp, human
gcagctcaatgacaaatcgg

SEQ ID NO: 144419 - DNA, 20 bp, human
ggaaggaaccgcggctacaa

SEQ ID NO: 144420 - DNA, 20 bp, human
gctcaatgacaaatcggtgg

SEQ ID NO: 144421 - DNA, 20 bp, human
gcggcagctcaatgacaaat

SEQ ID NO: 144422 - DNA, 20 bp, human
ggccatctgcgggataggga

SEQ ID NO: 144423 - DNA, 20 bp, human
gggaagtggacggtcccgag

SEQ ID NO: 144424 - DNA, 20 bp, human
gatgacaaatcggtggagga

SEQ ID NO: 144425 - DNA, 20 bp, human
gcgggactggtccctggtaa

SEQ ID NO: 144426 - DNA, 20 bp, human
gagggacgcacggccaaggg

SEQ ID NO: 144427 - DNA, 20 bp, human
gggttcctcgggcactccag

SEQ ID NO: 144428 - DNA, 20 bp, human
gcaaacgaggacgccacgaa

SEQ ID NO: 144429 - DNA, 20 bp, human
gacgaggacgccacgaaggg

SEQ ID NO: 144430 - DNA, 20 bp, human
gaggcccgtcggccagtggg

SEQ ID NO: 144431 - DNA, 20 bp, human
gccaaggggggcgaaaactg

SEQ ID NO: 144432 - DNA, 20 bp, human
gcccgagagcaccacaaacg

SEQ ID NO: 144433 - DNA, 20 bp, human
gagccgggcggcccccagtc

SEQ ID NO: 144434 - DNA, 20 bp, human
gggggaggaacccacgccag

SEQ ID NO: 144435 - DNA, 20 bp, human
ggcgcaggctggccagagcg

SEQ ID NO: 144436 - DNA, 20 bp, human
gggacaccgttcgccaccga

SEQ ID NO: 144437 - DNA, 20 bp, human
gctctgccgtcggtggcgaa

SEQ ID NO: 144438 - DNA, 20 bp, human
gtctccctgaggccccctta

SEQ ID NO: 144439 - DNA, 20 bp, human
gcaaccttaagggggcctca

SEQ ID NO: 144440 - DNA, 20 bp, human
ggccgaaacggagacgagtg

SEQ ID NO: 144441 - DNA, 20 bp, human
ggtcatcggtgaggagcgag

SEQ ID NO: 144442 - DNA, 20 bp, human
gctccgtttcggcctctgca

SEQ ID NO: 144443 - DNA, 20 bp, human
gaaagaagcttcaaccttaa

SEQ ID NO: 144444 - DNA, 20 bp, human
gctgcgcatcgtcatcggtg

SEQ ID NO: 144445 - DNA, 20 bp, human
gagcacctgcgcatcgtcat

SEQ ID NO: 144446 - DNA, 20 bp, human
gcttcctggagacacagctg

SEQ ID NO: 144447 - DNA, 20 bp, human
ggggtccaagcccagatcca

SEQ ID NO: 144448 - DNA, 20 bp, human
gaggcgcccagcgagaatct

SEQ ID NO: 144449 - DNA, 20 bp, human
gagggcgctcctctgtgcag

SEQ ID NO: 144450 - DNA, 20 bp, human
gtctggaaacaaagccccgg

SEQ ID NO: 144451 - DNA, 20 bp, human
ggcgctcccggagaacctgg

SEQ ID NO: 144452 - DNA, 20 bp, human
gaaggtgctggacccgaaga

SEQ ID NO: 144453 - DNA, 20 bp, human
ggccacgcgaatcaaagcat

SEQ ID NO: 144454 - DNA, 20 bp, human
ggatctgggcttggaccccc

SEQ ID NO: 144455 - DNA, 20 bp, human
gcaaagcatagggtcgaggc

SEQ ID NO: 144456 - DNA, 20 bp, human
ggactctcccagggcgccaa

SEQ ID NO: 144457 - DNA, 20 bp, human
gagtggccttcgtcgtccct

SEQ ID NO: 144458 - DNA, 20 bp, human
ggggcgccaagggacgacga

SEQ ID NO: 144459 - DNA, 20 bp, human
gcccgtcagcgactctccca

SEQ ID NO: 144460 - DNA, 20 bp, human
gaacttccgactgccagggg

SEQ ID NO: 144461 - DNA, 20 bp, human
gagcttggccctggagtggg

SEQ ID NO: 144462 - DNA, 20 bp, human
gggcaacttccgactgccag

SEQ ID NO: 144463 - DNA, 20 bp, human
gccacctggcggtcaaggga

SEQ ID NO: 144464 - DNA, 20 bp, human
ggaaggccactcgagccagc

SEQ ID NO: 144465 - DNA, 20 bp, human
gatttttgggagacccacgg

SEQ ID NO: 144466 - DNA, 20 bp, human
gaggccccgacccccaccta

SEQ ID NO: 144467 - DNA, 20 bp, human
gccccgacccccacctatgg

SEQ ID NO: 144468 - DNA, 20 bp, human
gctctctcctccataggtgg

SEQ ID NO: 144469 - DNA, 20 bp, human
gggccgcgggctcacagcgg

SEQ ID NO: 144470 - DNA, 20 bp, human
ggaagctgtgcagcaccacc

SEQ ID NO: 144471 - DNA, 20 bp, human
gacgccgtgcgcctggaggt

SEQ ID NO: 144472 - DNA, 20 bp, human
gcgtccaacagtagggacca

SEQ ID NO: 144473 - DNA, 20 bp, human
gccgcgctgcgagccttcca

SEQ ID NO: 144474 - DNA, 20 bp, human
gacatgcgctgcaccatgga

SEQ ID NO: 144475 - DNA, 20 bp, human
gcagccgtggtccctactgt

SEQ ID NO: 144476 - DNA, 20 bp, human
ggcggcgcggcgcagacaat

SEQ ID NO: 144477 - DNA, 20 bp, human
ggagccggggcggaaccgag

SEQ ID NO: 144478 - DNA, 20 bp, human
gcgggacagtagggaaactg

SEQ ID NO: 144479 - DNA, 20 bp, human
gggcggagtccagagatgaa

SEQ ID NO: 144480 - DNA, 20 bp, human
gaaccccgcccgggacagta

SEQ ID NO: 144481 - DNA, 20 bp, human
gcgcccggggcacacgaagt

SEQ ID NO: 144482 - DNA, 20 bp, human
gacaatgggagcggcgctgg

SEQ ID NO: 144483 - DNA, 20 bp, human
gctcggctcacccttcccgt

SEQ ID NO: 144484 - DNA, 20 bp, human
gccggggcacacgaagttgg

SEQ ID NO: 144485 - DNA, 20 bp, human
gcgcgacgcgaggctgggga

SEQ ID NO: 144486 - DNA, 20 bp, human
ggctggagcgcgggcagacg

SEQ ID NO: 144487 - DNA, 20 bp, human
ggagcggacggttcctactg

SEQ ID NO: 144488 - DNA, 20 bp, human
gggcaaccggccagtaacca

SEQ ID NO: 144489 - DNA, 20 bp, human
gggcccgggtggctgcggta

SEQ ID NO: 144490 - DNA, 20 bp, human
ggtggtcgcccgagaaggaa

SEQ ID NO: 144491 - DNA, 20 bp, human
gcagggccatgaggaagcgg

SEQ ID NO: 144492 - DNA, 20 bp, human
gtccaagcccgagtcagcag

SEQ ID NO: 144493 - DNA, 20 bp, human
ggcgcggcgtagcatagggg

SEQ ID NO: 144494 - DNA, 20 bp, human
ggtaggaaccgtccgctcca

SEQ ID NO: 144495 - DNA, 20 bp, human
ggacggttcctactgcggct

SEQ ID NO: 144496 - DNA, 20 bp, human
ggcgggcgctgaatgagaga

SEQ ID NO: 144497 - DNA, 20 bp, human
gctcactctcctcccccgag

SEQ ID NO: 144498 - DNA, 20 bp, human
gggccgcgggttctcagagt

SEQ ID NO: 144499 - DNA, 20 bp, human
gcgacgagtgctactctagg

SEQ ID NO: 144500 - DNA, 20 bp, human
gggtcgacgagtgctactct

SEQ ID NO: 144501 - DNA, 20 bp, human
gctcctcccccgagcggcag

SEQ ID NO: 144502 - DNA, 20 bp, human
ggagagcgaggcgggttcaa

SEQ ID NO: 144503 - DNA, 20 bp, human
gtgagagacggtgactgttc

SEQ ID NO: 144504 - DNA, 20 bp, human
ggagaacccgcggccgaggg

SEQ ID NO: 144505 - DNA, 20 bp, human
gagcgcccccggcttcagga

SEQ ID NO: 144506 - DNA, 20 bp, human
ggctcccgggactccccgaa

SEQ ID NO: 144507 - DNA, 20 bp, human
gctctccgcgggccaagtct

SEQ ID NO: 144508 - DNA, 20 bp, human
ggagagcagacagggaacgc

SEQ ID NO: 144509 - DNA, 20 bp, human
gcgccccgccgcactgacag

SEQ ID NO: 144510 - DNA, 20 bp, human
gtcccaggagacagagaagg

SEQ ID NO: 144511 - DNA, 20 bp, human
gcgggagcccgagtaactct

SEQ ID NO: 144512 - DNA, 20 bp, human
ggctcgcgccgctgtcagtg

SEQ ID NO: 144513 - DNA, 20 bp, human
gccaagtctgggccagtagt

SEQ ID NO: 144514 - DNA, 20 bp, human
ggaagctgagggggcggtag

SEQ ID NO: 144515 - DNA, 20 bp, human
ggccgcactcggggacgtaa

SEQ ID NO: 144516 - DNA, 20 bp, human
gctgagagcggcaacaccag

SEQ ID NO: 144517 - DNA, 20 bp, human
gggagcctggcgcctgagag

SEQ ID NO: 144518 - DNA, 20 bp, human
gtcgtctgggctcacagcga

SEQ ID NO: 144519 - DNA, 20 bp, human
gccgagcgggagtaaaatgt

SEQ ID NO: 144520 - DNA, 20 bp, human
ggcaggtgcccctcacgctg

SEQ ID NO: 144521 - DNA, 20 bp, human
ggctgtgagcccagacgagc

SEQ ID NO: 144522 - DNA, 20 bp, human
gtgagaaggtactcaccgag

SEQ ID NO: 144523 - DNA, 20 bp, human
gcgcacacgcaagacaggca

SEQ ID NO: 144524 - DNA, 20 bp, human
gacagtatggcggtggaaga

SEQ ID NO: 144525 - DNA, 20 bp, human
gcgcctcgccagccagagtt

SEQ ID NO: 144526 - DNA, 20 bp, human
ggtggcgagcggactcgact

SEQ ID NO: 144527 - DNA, 20 bp, human
ggcgcacagcctgagaaacg

SEQ ID NO: 144528 - DNA, 20 bp, human
ggtgagtcagccctgcacac

SEQ ID NO: 144529 - DNA, 20 bp, human
gggccctgtgccgcctcccg

SEQ ID NO: 144530 - DNA, 20 bp, human
gttccaggcgggaggcccca

SEQ ID NO: 144531 - DNA, 20 bp, human
gtcggcaccgctgtgcacca

SEQ ID NO: 144532 - DNA, 20 bp, human
gcagcctgagaaacgaggtg

SEQ ID NO: 144533 - DNA, 20 bp, human
gcctgcgctggcagtcaccg

SEQ ID NO: 144534 - DNA, 20 bp, human
gggcctcccgcctggaaccg

SEQ ID NO: 144535 - DNA, 20 bp, human
ggccagccggtgtcctctag

SEQ ID NO: 144536 - DNA, 20 bp, human
gggcactgaggcgtccgtgg

SEQ ID NO: 144537 - DNA, 20 bp, human
gggcctgggtgtgagtgaca

SEQ ID NO: 144538 - DNA, 20 bp, human
gacgatggcctcgctccggg

SEQ ID NO: 144539 - DNA, 20 bp, human
gtcgggtcctagggagacgc

SEQ ID NO: 144540 - DNA, 20 bp, human
gtctccctaggacccgagtc

SEQ ID NO: 144541 - DNA, 20 bp, human
ggacgcctcagtgccgggga

SEQ ID NO: 144542 - DNA, 20 bp, human
gctgcacgatggcctcgctc

SEQ ID NO: 144543 - DNA, 20 bp, human
ggcgaggccatcgtgcagca

SEQ ID NO: 144544 - DNA, 20 bp, human
gtataggcgcccccacaccc

SEQ ID NO: 144545 - DNA, 20 bp, human
gccgcccgactcgggtccta

SEQ ID NO: 144546 - DNA, 20 bp, human
gcatggagactggagcgctg

SEQ ID NO: 144547 - DNA, 20 bp, human
gagaagaggtggaccaggtc

SEQ ID NO: 144548 - DNA, 20 bp, human
ggcccaccctgggggataag

SEQ ID NO: 144549 - DNA, 20 bp, human
gaccgagcgtgacccagctg

SEQ ID NO: 144550 - DNA, 20 bp, human
ggcctgcccaccactcacag

SEQ ID NO: 144551 - DNA, 20 bp, human
gtctggggtcgcctcagggt

SEQ ID NO: 144552 - DNA, 20 bp, human
gcctcagggtgggcgagaag

SEQ ID NO: 144553 - DNA, 20 bp, human
gggtgaaccccgaggagtgg

SEQ ID NO: 144554 - DNA, 20 bp, human
ggagcctgggaatcccgcca

SEQ ID NO: 144555 - DNA, 20 bp, human
gttgccccggagctcgggag

SEQ ID NO: 144556 - DNA, 20 bp, human
ggcggtcgctgcgcttaggg

SEQ ID NO: 144557 - DNA, 20 bp, human
ggcgcccgtccgactgaggc

SEQ ID NO: 144558 - DNA, 20 bp, human
gctgcggaggcagaggacgg

SEQ ID NO: 144559 - DNA, 20 bp, human
gctccgcgcccgtccgactg

SEQ ID NO: 144560 - DNA, 20 bp, human
gccacgtgcccgccccacaa

SEQ ID NO: 144561 - DNA, 20 bp, human
gtttccagcctcagtcggac

SEQ ID NO: 144562 - DNA, 20 bp, human
ggacgccggcgcgagagcag

SEQ ID NO: 144563 - DNA, 20 bp, human
ggcggccccgcagcccatgg

SEQ ID NO: 144564 - DNA, 20 bp, human
gcggccggaggtgtagggat

SEQ ID NO: 144565 - DNA, 20 bp, human
gcatcgcggcgttcctgcgg

SEQ ID NO: 144566 - DNA, 20 bp, human
gctagtggggagccccaagt

SEQ ID NO: 144567 - DNA, 20 bp, human
gcgcccgcaccagttcctgg

SEQ ID NO: 144568 - DNA, 20 bp, human
ggaggcgccggcgccagacg

SEQ ID NO: 144569 - DNA, 20 bp, human
ggcccaagcggggacagggt

SEQ ID NO: 144570 - DNA, 20 bp, human
gggtcgaggttcgggtcgtg

SEQ ID NO: 144571 - DNA, 20 bp, human
gccccgcgtgaccttggggt

SEQ ID NO: 144572 - DNA, 20 bp, human
ggggccggggccgttatcag

SEQ ID NO: 144573 - DNA, 20 bp, human
gagcctccaggaactggtgc

SEQ ID NO: 144574 - DNA, 20 bp, human
gcgccgcccgcaccagttcc

SEQ ID NO: 144575 - DNA, 20 bp, human
gggagcggccgtcgccacgc

SEQ ID NO: 144576 - DNA, 20 bp, human
gcggcagcgacggcagaccc

SEQ ID NO: 144577 - DNA, 20 bp, human
gtcgctgccgccatcttgga

SEQ ID NO: 144578 - DNA, 20 bp, human
gatagtagctccctccaaga

SEQ ID NO: 144579 - DNA, 20 bp, human
gcctttcaggatgtccaggg

SEQ ID NO: 144580 - DNA, 20 bp, human
ggtgaggctgaacaggccga

SEQ ID NO: 144581 - DNA, 20 bp, human
ggccctaacttggagcacct

SEQ ID NO: 144582 - DNA, 20 bp, human
gactacattggtctctccca

SEQ ID NO: 144583 - DNA, 20 bp, human
ggaaggtccggcccagcact

SEQ ID NO: 144584 - DNA, 20 bp, human
gcagcctaggataagcacgg

SEQ ID NO: 144585 - DNA, 20 bp, human
gcgggccgatacctttgtag

SEQ ID NO: 144586 - DNA, 20 bp, human
gcggctggggctcaactgtg

SEQ ID NO: 144587 - DNA, 20 bp, human
gggaaggctgctccaccgct

SEQ ID NO: 144588 - DNA, 20 bp, human
gtagtgttgccagggcaggt

SEQ ID NO: 144589 - DNA, 20 bp, human
ggcctcgcgcggctgccgag

SEQ ID NO: 144590 - DNA, 20 bp, human
gccggagcccgagaaagggg

SEQ ID NO: 144591 - DNA, 20 bp, human
gtagagccgcgccggcgacg

SEQ ID NO: 144592 - DNA, 20 bp, human
gggacgcgtctggagaccga

SEQ ID NO: 144593 - DNA, 20 bp, human
gtgaggctgcgaaggacgag

SEQ ID NO: 144594 - DNA, 20 bp, human
gtgtcccggtccccggctag

SEQ ID NO: 144595 - DNA, 20 bp, human
gtcccgccgggttcccagcg

SEQ ID NO: 144596 - DNA, 20 bp, human
ggtcctggggggacagcggt

SEQ ID NO: 144597 - DNA, 20 bp, human
gggctacggcgctgcgtcac

SEQ ID NO: 144598 - DNA, 20 bp, human
ggcgcgtgagaccagcgctc

SEQ ID NO: 144599 - DNA, 20 bp, human
gagtggtcctccgccggcta

SEQ ID NO: 144600 - DNA, 20 bp, human
ggccgccaacctggctcccg

SEQ ID NO: 144601 - DNA, 20 bp, human
gcagcaaggctgacgtggag

SEQ ID NO: 144602 - DNA, 20 bp, human
gtcgcgctgctcaggcgtca

SEQ ID NO: 144603 - DNA, 20 bp, human
ggaacttgcggcgcagccgg

SEQ ID NO: 144604 - DNA, 20 bp, human
ggaccactgtgacgaacttg

SEQ ID NO: 144605 - DNA, 20 bp, human
gcgctggtctcacgcgcctc

SEQ ID NO: 144606 - DNA, 20 bp, human
gaggtaggggaggcgccgtt

SEQ ID NO: 144607 - DNA, 20 bp, human
gcctgaggggacgcaatagg

SEQ ID NO: 144608 - DNA, 20 bp, human
gacctggcgaacgaaggtag

SEQ ID NO: 144609 - DNA, 20 bp, human
gtggcgaacgaaggtagggg

SEQ ID NO: 144610 - DNA, 20 bp, human
gtggcggacctggcgaacga

SEQ ID NO: 144611 - DNA, 20 bp, human
gcggaggacgagggcctcac

SEQ ID NO: 144612 - DNA, 20 bp, human
ggagataggcagccaggccg

SEQ ID NO: 144613 - DNA, 20 bp, human
gtctagccagacggctgcag

SEQ ID NO: 144614 - DNA, 20 bp, human
gggcgcggggccttgtggga

SEQ ID NO: 144615 - DNA, 20 bp, human
ggcttaaggaagtaaaatgg

SEQ ID NO: 144616 - DNA, 20 bp, human
gtgtgactcaaggatcacta

SEQ ID NO: 144617 - DNA, 20 bp, human
gacagagggtaactcagatc

SEQ ID NO: 144618 - DNA, 20 bp, human
gactagggcacctccttctc

SEQ ID NO: 144619 - DNA, 20 bp, human
gagtcatggtcctagcagta

SEQ ID NO: 144620 - DNA, 20 bp, human
gtgactaccataccaagaaa

SEQ ID NO: 144621 - DNA, 20 bp, human
gtctggccagtcacctaaag

SEQ ID NO: 144622 - DNA, 20 bp, human
gagccttctctaaatactgg

SEQ ID NO: 144623 - DNA, 20 bp, human
gtatttaggagaagtaacat

SEQ ID NO: 144624 - DNA, 20 bp, human
gagcagccttctctaaatac

SEQ ID NO: 144625 - DNA, 20 bp, human
ggaaggccactttaggtgac

SEQ ID NO: 144626 - DNA, 20 bp, human
gtgaggatggcactaaccac

SEQ ID NO: 144627 - DNA, 20 bp, human
gctttgacagagcgcaatgg

SEQ ID NO: 144628 - DNA, 20 bp, human
gtagctttgacagagcgcaa

SEQ ID NO: 144629 - DNA, 20 bp, human
gaccgcgtctgcaggggtgc

SEQ ID NO: 144630 - DNA, 20 bp, human
gggcggcaaccgcgtctgca

SEQ ID NO: 144631 - DNA, 20 bp, human
gctaccgcgaccgggaagga

SEQ ID NO: 144632 - DNA, 20 bp, human
gaaaagccgtcgtagcagtg

SEQ ID NO: 144633 - DNA, 20 bp, human
gggaatttgatagatgagga

SEQ ID NO: 144634 - DNA, 20 bp, human
gccgcgaccgggaaggaggg

SEQ ID NO: 144635 - DNA, 20 bp, human
ggccaggaatttgatagatg

SEQ ID NO: 144636 - DNA, 20 bp, human
ggaaacagccgcgagagcag

SEQ ID NO: 144637 - DNA, 20 bp, human
gcgcgcgcccagggagaccg

SEQ ID NO: 144638 - DNA, 20 bp, human
gaggacgactccggagactg

SEQ ID NO: 144639 - DNA, 20 bp, human
gcggccttggccccagtctc

SEQ ID NO: 144640 - DNA, 20 bp, human
gagtcgcggccgggatgtcc

SEQ ID NO: 144641 - DNA, 20 bp, human
gcaaccgccgcggtctccct

SEQ ID NO: 144642 - DNA, 20 bp, human
gggcgccggcaggacgactc

SEQ ID NO: 144643 - DNA, 20 bp, human
gcagcgcccccgggaagcag

SEQ ID NO: 144644 - DNA, 20 bp, human
gcgcccgccccggaagcagg

SEQ ID NO: 144645 - DNA, 20 bp, human
gtcggagacgcgggagtagg

SEQ ID NO: 144646 - DNA, 20 bp, human
gtcgccacctccggatccag

SEQ ID NO: 144647 - DNA, 20 bp, human
ggcaccgcggcggatgatgg

SEQ ID NO: 144648 - DNA, 20 bp, human
gcgacggccgagcgccccag

SEQ ID NO: 144649 - DNA, 20 bp, human
gccgcggtgcggagagcagg

SEQ ID NO: 144650 - DNA, 20 bp, human
gccgcggcggatgatggcgg

SEQ ID NO: 144651 - DNA, 20 bp, human
gcgtcacctgcctggaacag

SEQ ID NO: 144652 - DNA, 20 bp, human
ggtggtgctggaagcgcgtg

SEQ ID NO: 144653 - DNA, 20 bp, human
gcggcggatgatggcggagg

SEQ ID NO: 144654 - DNA, 20 bp, human
ggcaggcagaaggcgcacac

SEQ ID NO: 144655 - DNA, 20 bp, human
gccgagcgccccaggggtgg

SEQ ID NO: 144656 - DNA, 20 bp, human
ggtggcagctgcgaaaccca

SEQ ID NO: 144657 - DNA, 20 bp, human
gcacgtggcatcggctccct

SEQ ID NO: 144658 - DNA, 20 bp, human
ggagctgcaggcccacgtac

SEQ ID NO: 144659 - DNA, 20 bp, human
ggatgccacgtgacccaatg

SEQ ID NO: 144660 - DNA, 20 bp, human
gacggaccagagcctgatag

SEQ ID NO: 144661 - DNA, 20 bp, human
ggcccacgtacggggcgaag

SEQ ID NO: 144662 - DNA, 20 bp, human
gaagtccacattgggtcacg

SEQ ID NO: 144663 - DNA, 20 bp, human
ggggcggtgagaccacgcac

SEQ ID NO: 144664 - DNA, 20 bp, human
ggccgcttcgccccgtacgt

SEQ ID NO: 144665 - DNA, 20 bp, human
gcgcggccgacggttaatcc

SEQ ID NO: 144666 - DNA, 20 bp, human
gagcaggagccacggccgag

SEQ ID NO: 144667 - DNA, 20 bp, human
gaggagccacggccgagagg

SEQ ID NO: 144668 - DNA, 20 bp, human
gaggcctgcgggagaccgtc

SEQ ID NO: 144669 - DNA, 20 bp, human
gtcctccctcctctcggccg

SEQ ID NO: 144670 - DNA, 20 bp, human
ggcttgtgctatgacacctc

SEQ ID NO: 144671 - DNA, 20 bp, human
gacctcggggagctgaaggg

SEQ ID NO: 144672 - DNA, 20 bp, human
gctcaggcagtgaggtacga

SEQ ID NO: 144673 - DNA, 20 bp, human
gcgacaccgatggaacgcgg

SEQ ID NO: 144674 - DNA, 20 bp, human
gtacgagggcaccgtgtctg

SEQ ID NO: 144675 - DNA, 20 bp, human
ggccgccgccccgacaccga

SEQ ID NO: 144676 - DNA, 20 bp, human
gggctgaacgcctgacgtca

SEQ ID NO: 144677 - DNA, 20 bp, human
gctgaagagagcgggcgggt

SEQ ID NO: 144678 - DNA, 20 bp, human
gccgccgcggcttccctcag

SEQ ID NO: 144679 - DNA, 20 bp, human
ggacgcgggctgaagagagc

SEQ ID NO: 144680 - DNA, 20 bp, human
ggcgcgctgttctcccgcgg

SEQ ID NO: 144681 - DNA, 20 bp, human
ggtcgccccgcgctcccccc

SEQ ID NO: 144682 - DNA, 20 bp, human
ggcgatgtcgccttgacgtc

SEQ ID NO: 144683 - DNA, 20 bp, human
gaacagcgcgctttgcggaa

SEQ ID NO: 144684 - DNA, 20 bp, human
gaaagcgcgctgttctcccg

SEQ ID NO: 144685 - DNA, 20 bp, human
gggagaagctgcggcggacg

SEQ ID NO: 144686 - DNA, 20 bp, human
gggcgcccccacctcgaggt

SEQ ID NO: 144687 - DNA, 20 bp, human
ggcggggcgcactcacccaa

SEQ ID NO: 144688 - DNA, 20 bp, human
gcctagcgccccccagaggg

SEQ ID NO: 144689 - DNA, 20 bp, human
gccccctccccgaactgcgg

SEQ ID NO: 144690 - DNA, 20 bp, human
ggggcttgggcccctcccca

SEQ ID NO: 144691 - DNA, 20 bp, human
gagctctgctcagatgcggc

SEQ ID NO: 144692 - DNA, 20 bp, human
gcaggagcgccaccctctgg

SEQ ID NO: 144693 - DNA, 20 bp, human
gctcggcactctggtgcccg

SEQ ID NO: 144694 - DNA, 20 bp, human
gctcgaggtgggcggaaaac

SEQ ID NO: 144695 - DNA, 20 bp, human
ggcgcctggggtttagagga

SEQ ID NO: 144696 - DNA, 20 bp, human
gcccagggtccgggacccca

SEQ ID NO: 144697 - DNA, 20 bp, human
gcagggtaaagtggtcccga

SEQ ID NO: 144698 - DNA, 20 bp, human
gggtccgggaccccagggta

SEQ ID NO: 144699 - DNA, 20 bp, human
gcgtggggcgagcccatcgc

SEQ ID NO: 144700 - DNA, 20 bp, human
ggacaaggctccgtcatggt

SEQ ID NO: 144701 - DNA, 20 bp, human
gaggccacagcaagagcccc

SEQ ID NO: 144702 - DNA, 20 bp, human
gcagccagggcgggcggaca

SEQ ID NO: 144703 - DNA, 20 bp, human
gcagagccacagtgccaccc

SEQ ID NO: 144704 - DNA, 20 bp, human
gcggcggcgctgcctgcgat

SEQ ID NO: 144705 - DNA, 20 bp, human
gtgtgggtgcgtgctaccgt

SEQ ID NO: 144706 - DNA, 20 bp, human
gcaagagggccgtggtacag

SEQ ID NO: 144707 - DNA, 20 bp, human
gcctcttgcggacagccccg

SEQ ID NO: 144708 - DNA, 20 bp, human
gacacatacatgggaacctg

SEQ ID NO: 144709 - DNA, 20 bp, human
gtgtcccaacgacgtccccg

SEQ ID NO: 144710 - DNA, 20 bp, human
ggctgtccgcaagagggccg

SEQ ID NO: 144711 - DNA, 20 bp, human
gacagccccggggacgtcgt

SEQ ID NO: 144712 - DNA, 20 bp, human
gcactgaccccgctgtacca

SEQ ID NO: 144713 - DNA, 20 bp, human
gtgggctccccgccctgcac

SEQ ID NO: 144714 - DNA, 20 bp, human
ggtcagcagacccagctctc

SEQ ID NO: 144715 - DNA, 20 bp, human
gatgctatccacctccccac

SEQ ID NO: 144716 - DNA, 20 bp, human
gtctctcccgcagccaggga

SEQ ID NO: 144717 - DNA, 20 bp, human
gccccccgcgggtccctccc

SEQ ID NO: 144718 - DNA, 20 bp, human
gcagccagggagggacccgc

SEQ ID NO: 144719 - DNA, 20 bp, human
ggcgggagagacggaggtag

SEQ ID NO: 144720 - DNA, 20 bp, human
ggtgcgccgactctccccgg

SEQ ID NO: 144721 - DNA, 20 bp, human
gcccggggactggagaaatc

SEQ ID NO: 144722 - DNA, 20 bp, human
gtcgagctcagtacacgcgg

SEQ ID NO: 144723 - DNA, 20 bp, human
ggcccgcgaggcaggctccg

SEQ ID NO: 144724 - DNA, 20 bp, human
gtctcggcgtgctgcagggt

SEQ ID NO: 144725 - DNA, 20 bp, human
gcaccctcggggagcaacat

SEQ ID NO: 144726 - DNA, 20 bp, human
gaggcaccgggtgggactga

SEQ ID NO: 144727 - DNA, 20 bp, human
ggcgagcagagagagagacc

SEQ ID NO: 144728 - DNA, 20 bp, human
gggccccgtaggcaccgggt

SEQ ID NO: 144729 - DNA, 20 bp, human
ggcggctcgggcggcaccag

SEQ ID NO: 144730 - DNA, 20 bp, human
ggatgcggccccgtaggcac

SEQ ID NO: 144731 - DNA, 20 bp, human
ggtgctggagatcctggaca

SEQ ID NO: 144732 - DNA, 20 bp, human
ggctcgccctcagtcccacc

SEQ ID NO: 144733 - DNA, 20 bp, human
ggccgagccgggcggcgatg

SEQ ID NO: 144734 - DNA, 20 bp, human
gctgagggagcagcggccct

SEQ ID NO: 144735 - DNA, 20 bp, human
gcggcggcggcggcaactga

SEQ ID NO: 144736 - DNA, 20 bp, human
gcgcgtggcatgagtccccg

SEQ ID NO: 144737 - DNA, 20 bp, human
gctcgcccagtagaggctgt

SEQ ID NO: 144738 - DNA, 20 bp, human
gcgggccccgcagcagtccg

SEQ ID NO: 144739 - DNA, 20 bp, human
gagagcgcgatgggccgcgg

SEQ ID NO: 144740 - DNA, 20 bp, human
ggccccgcagcagtccgcgg

SEQ ID NO: 144741 - DNA, 20 bp, human
gctgtgggagagagcgcgat

SEQ ID NO: 144742 - DNA, 20 bp, human
ggcctgccgcggccccgtcg

SEQ ID NO: 144743 - DNA, 20 bp, human
ggccatgagagagtacaaag

SEQ ID NO: 144744 - DNA, 20 bp, human
ggagagagcgcgatgggccg

SEQ ID NO: 144745 - DNA, 20 bp, human
gtcctgcgtagctgaggaag

SEQ ID NO: 144746 - DNA, 20 bp, human
ggcttgtaagtaagggaatt

SEQ ID NO: 144747 - DNA, 20 bp, human
gactgagtctcgcaggtttc

SEQ ID NO: 144748 - DNA, 20 bp, human
ggctagacgaggcggaaggt

SEQ ID NO: 144749 - DNA, 20 bp, human
gcgtgacagagcctccccgg

SEQ ID NO: 144750 - DNA, 20 bp, human
ggctgtggcgcggctagacg

SEQ ID NO: 144751 - DNA, 20 bp, human
gcgggcagcggtaactggaa

SEQ ID NO: 144752 - DNA, 20 bp, human
ggcccccgcttctttccccg

SEQ ID NO: 144753 - DNA, 20 bp, human
gcaaggccatggccacccgc

SEQ ID NO: 144754 - DNA, 20 bp, human
gccaactcctaccagagggg

SEQ ID NO: 144755 - DNA, 20 bp, human
gggtcgtccggcctgtgaag

SEQ ID NO: 144756 - DNA, 20 bp, human
gtgcctgagaggcaccggta

SEQ ID NO: 144757 - DNA, 20 bp, human
gctgctccggaaagacgctg

SEQ ID NO: 144758 - DNA, 20 bp, human
gaatatagaccatgcctgag

SEQ ID NO: 144759 - DNA, 20 bp, human
gggaagggccctgtgtcctc

SEQ ID NO: 144760 - DNA, 20 bp, human
gttcctggaaaggaagccca

SEQ ID NO: 144761 - DNA, 20 bp, human
ggcctcacaagggaagcctg

SEQ ID NO: 144762 - DNA, 20 bp, human
ggggccaaagggattttgaa

SEQ ID NO: 144763 - DNA, 20 bp, human
gaacaaggtaagaaagccct

SEQ ID NO: 144764 - DNA, 20 bp, human
gcaactgaggaccgagtcac

SEQ ID NO: 144765 - DNA, 20 bp, human
gaatccctttggccccaggg

SEQ ID NO: 144766 - DNA, 20 bp, human
gtagtctgcttggagaggag

SEQ ID NO: 144767 - DNA, 20 bp, human
gtctggtctacaagtgtgaa

SEQ ID NO: 144768 - DNA, 20 bp, human
gtcagggtggtataagaacc

SEQ ID NO: 144769 - DNA, 20 bp, human
gcagcttaaagtgtcactac

SEQ ID NO: 144770 - DNA, 20 bp, human
gggagacgaacactgttgtt

SEQ ID NO: 144771 - DNA, 20 bp, human
ggaagactgagagctgtgtg

SEQ ID NO: 144772 - DNA, 20 bp, human
gctgctggcccataactcca

SEQ ID NO: 144773 - DNA, 20 bp, human
gagggcagagcgtgtgaatc

SEQ ID NO: 144774 - DNA, 20 bp, human
gtatagtagtctgcttggag

SEQ ID NO: 144775 - DNA, 20 bp, human
gggttagctgggattgctag

SEQ ID NO: 144776 - DNA, 20 bp, human
gcacccagccaccggcgaca

SEQ ID NO: 144777 - DNA, 20 bp, human
gggggacgccacccagccac

SEQ ID NO: 144778 - DNA, 20 bp, human
gagaggaagctgacacggtg

SEQ ID NO: 144779 - DNA, 20 bp, human
ggcgggagaggaagctgaca

SEQ ID NO: 144780 - DNA, 20 bp, human
gtgtacctggacttacccac

SEQ ID NO: 144781 - DNA, 20 bp, human
gggatccggagggtgccagt

SEQ ID NO: 144782 - DNA, 20 bp, human
ggcgccttcgtctcagacga

SEQ ID NO: 144783 - DNA, 20 bp, human
gcgaaggagccagctggcac

SEQ ID NO: 144784 - DNA, 20 bp, human
ggctccttcgtctgagacga

SEQ ID NO: 144785 - DNA, 20 bp, human
gctagctggactggctgcca

SEQ ID NO: 144786 - DNA, 20 bp, human
gcaggcgatccactcggcag

SEQ ID NO: 144787 - DNA, 20 bp, human
gtccaggcaggcgatccact

SEQ ID NO: 144788 - DNA, 20 bp, human
gcagcgaccatgttgagcgg

SEQ ID NO: 144789 - DNA, 20 bp, human
ggcgcagcgaccatgttgag

SEQ ID NO: 144790 - DNA, 20 bp, human
ggcgatccactcggcagagg

SEQ ID NO: 144791 - DNA, 20 bp, human
gggagcggagcctggagtcg

SEQ ID NO: 144792 - DNA, 20 bp, human
gaggtctgaatagccggaaa

SEQ ID NO: 144793 - DNA, 20 bp, human
gaggctccgctcctgggtgg

SEQ ID NO: 144794 - DNA, 20 bp, human
ggccgctggcaccccacgag

SEQ ID NO: 144795 - DNA, 20 bp, human
gcgcgcgccgccgctcaaca

SEQ ID NO: 144796 - DNA, 20 bp, human
gggcccggccctgtccgagt

SEQ ID NO: 144797 - DNA, 20 bp, human
ggggcgtctggaagttgggg

SEQ ID NO: 144798 - DNA, 20 bp, human
ggaagccgtcgctcaggggg

SEQ ID NO: 144799 - DNA, 20 bp, human
gcggcgccgcagcgccgtca

SEQ ID NO: 144800 - DNA, 20 bp, human
ggcccctcttcagccgagtc

SEQ ID NO: 144801 - DNA, 20 bp, human
ggagcccgcgcccacccccc

SEQ ID NO: 144802 - DNA, 20 bp, human
gccccccgggccgctgaggg

SEQ ID NO: 144803 - DNA, 20 bp, human
gttcctggcgaaggcgcgga

SEQ ID NO: 144804 - DNA, 20 bp, human
gctgtccgagtgggcacggg

SEQ ID NO: 144805 - DNA, 20 bp, human
gtcagccgagtccggcagaa

SEQ ID NO: 144806 - DNA, 20 bp, human
gtctccggccagtcgcgcgt

SEQ ID NO: 144807 - DNA, 20 bp, human
ggccagtcgcgcgtgggtag

SEQ ID NO: 144808 - DNA, 20 bp, human
ggcgcgtgggtagaggcctt

SEQ ID NO: 144809 - DNA, 20 bp, human
ggtgggtagaggccttaggc

SEQ ID NO: 144810 - DNA, 20 bp, human
gcttaggcgggcgttgcgaa

SEQ ID NO: 144811 - DNA, 20 bp, human
gcacaggcaggaagggcggt

SEQ ID NO: 144812 - DNA, 20 bp, human
gtagagttcggaccttgtta

SEQ ID NO: 144813 - DNA, 20 bp, human
gggcaccctgctggcgacaa

SEQ ID NO: 144814 - DNA, 20 bp, human
gctgctggcgacaagggcct

SEQ ID NO: 144815 - DNA, 20 bp, human
ggcctagcgccagggtccac

SEQ ID NO: 144816 - DNA, 20 bp, human
ggcgcaaggctgagaggacg

SEQ ID NO: 144817 - DNA, 20 bp, human
gcaaggctgagaggacgcgg

SEQ ID NO: 144818 - DNA, 20 bp, human
gcagctggcgggccgaacgg

SEQ ID NO: 144819 - DNA, 20 bp, human
gggcacgcggcccgaagagt

SEQ ID NO: 144820 - DNA, 20 bp, human
gtgcgcccggctctgcgctg

SEQ ID NO: 144821 - DNA, 20 bp, human
ggaacggtggcgggaggtcc

SEQ ID NO: 144822 - DNA, 20 bp, human
gtcgcagctggcgggccgaa

SEQ ID NO: 144823 - DNA, 20 bp, human
gccggcgacccctaggagag

SEQ ID NO: 144824 - DNA, 20 bp, human
gcggctgcagccggcatggg

SEQ ID NO: 144825 - DNA, 20 bp, human
gtccagtggccagtagccgg

SEQ ID NO: 144826 - DNA, 20 bp, human
gcctccgtcgcggtccccag

SEQ ID NO: 144827 - DNA, 20 bp, human
gccctaccccctggccccga

SEQ ID NO: 144828 - DNA, 20 bp, human
gcgaggctaaccactcaccg

SEQ ID NO: 144829 - DNA, 20 bp, human
gtccatccaccagccgggag

SEQ ID NO: 144830 - DNA, 20 bp, human
gtggtggatggaggtcggtg

SEQ ID NO: 144831 - DNA, 20 bp, human
gctaaccgcaccctcccagg

SEQ ID NO: 144832 - DNA, 20 bp, human
ggcgcccctggggaccgcga

SEQ ID NO: 144833 - DNA, 20 bp, human
gcatccgggtgcggtacggt

SEQ ID NO: 144834 - DNA, 20 bp, human
gcccggcccgatccccaacc

SEQ ID NO: 144835 - DNA, 20 bp, human
gttctccgacccagcaccgg

SEQ ID NO: 144836 - DNA, 20 bp, human
ggccagcctgtgggacacag

SEQ ID NO: 144837 - DNA, 20 bp, human
gaacaaaagcagcgtcgggt

SEQ ID NO: 144838 - DNA, 20 bp, human
gcagctgccccccgaaacgt

SEQ ID NO: 144839 - DNA, 20 bp, human
gggagagcaggcgccaccct

SEQ ID NO: 144840 - DNA, 20 bp, human
ggacacaggggagcccgagg

SEQ ID NO: 144841 - DNA, 20 bp, human
gcgtcgggtgggagccggaa

SEQ ID NO: 144842 - DNA, 20 bp, human
gtgggacacaggggagcccg

SEQ ID NO: 144843 - DNA, 20 bp, human
ggtgcctctaggcactcatg

SEQ ID NO: 144844 - DNA, 20 bp, human
gtagcggcccatctccgagt

SEQ ID NO: 144845 - DNA, 20 bp, human
ggcattgcaggtgtggacaa

SEQ ID NO: 144846 - DNA, 20 bp, human
gcgacgcctgcgggaaccag

SEQ ID NO: 144847 - DNA, 20 bp, human
gcgggagaggagccgtccag

SEQ ID NO: 144848 - DNA, 20 bp, human
gcatagcgagtcacgtgcgg

SEQ ID NO: 144849 - DNA, 20 bp, human
gtgagccgcggccccctgga

SEQ ID NO: 144850 - DNA, 20 bp, human
gctcccgcagcaccaatctg

SEQ ID NO: 144851 - DNA, 20 bp, human
gcgcagccttgaggcgtctg

SEQ ID NO: 144852 - DNA, 20 bp, human
ggacggccccagacgcctca

SEQ ID NO: 144853 - DNA, 20 bp, human
gtcccccaccctggacacgg

SEQ ID NO: 144854 - DNA, 20 bp, human
ggcaggcagactcacagacg

SEQ ID NO: 144855 - DNA, 20 bp, human
gaaggctgcgcgcgaagaca

SEQ ID NO: 144856 - DNA, 20 bp, human
ggcggggcccgggaactcag

SEQ ID NO: 144857 - DNA, 20 bp, human
gctagacgggagtcccctcg

SEQ ID NO: 144858 - DNA, 20 bp, human
gtagagtctcgtggcgtccg

SEQ ID NO: 144859 - DNA, 20 bp, human
gtcagcggcttcacctcgag

SEQ ID NO: 144860 - DNA, 20 bp, human
gaccactaggaagggattag

SEQ ID NO: 144861 - DNA, 20 bp, human
gctgcccgggtcaccagtcg

SEQ ID NO: 144862 - DNA, 20 bp, human
gtccaaagcggagtccggag

SEQ ID NO: 144863 - DNA, 20 bp, human
gactcccgtctagagtctcg

SEQ ID NO: 144864 - DNA, 20 bp, human
ggagaggccggtacgtacag

SEQ ID NO: 144865 - DNA, 20 bp, human
gcttagacgcggggacttca

SEQ ID NO: 144866 - DNA, 20 bp, human
gtaggaagtgagctgttcag

SEQ ID NO: 144867 - DNA, 20 bp, human
gtctgtgtgacagaagtagt

SEQ ID NO: 144868 - DNA, 20 bp, human
gctctaggtgtggaggcaaa

SEQ ID NO: 144869 - DNA, 20 bp, human
gagcctacgtgccaaaaaag

SEQ ID NO: 144870 - DNA, 20 bp, human
gggaattctggtcccccctt

SEQ ID NO: 144871 - DNA, 20 bp, human
gaagtgagctgttcagaggc

SEQ ID NO: 144872 - DNA, 20 bp, human
gtcggcacactgctcaatgt

SEQ ID NO: 144873 - DNA, 20 bp, human
ggcttatcctctaggtgtgg

SEQ ID NO: 144874 - DNA, 20 bp, human
gtgctcggccaatccagccg

SEQ ID NO: 144875 - DNA, 20 bp, human
gtgcattggtagcaagacaa

SEQ ID NO: 144876 - DNA, 20 bp, human
gagctggacggaggctaaag

SEQ ID NO: 144877 - DNA, 20 bp, human
gccagataagagctggacgg

SEQ ID NO: 144878 - DNA, 20 bp, human
gcccggcttgaagggaaact

SEQ ID NO: 144879 - DNA, 20 bp, human
ggaagcacccagataagagc

SEQ ID NO: 144880 - DNA, 20 bp, human
gctgcatgcgggtaaggggt

SEQ ID NO: 144881 - DNA, 20 bp, human
gtgctgcgcagagccaccgg

SEQ ID NO: 144882 - DNA, 20 bp, human
gtgggcggggcgcgaagctg

SEQ ID NO: 144883 - DNA, 20 bp, human
gcagcctgcaatgtaggtac

SEQ ID NO: 144884 - DNA, 20 bp, human
gatgtaggtaccggagtccg

SEQ ID NO: 144885 - DNA, 20 bp, human
gtacagccgtcgcggacccg

SEQ ID NO: 144886 - DNA, 20 bp, human
gctgctgtgggaagggaatg

SEQ ID NO: 144887 - DNA, 20 bp, human
gtggccgccgggcttgaggg

SEQ ID NO: 144888 - DNA, 20 bp, human
gtgctatgcaccaaaatgaa

SEQ ID NO: 144889 - DNA, 20 bp, human
ggcacactgactctgcaggc

SEQ ID NO: 144890 - DNA, 20 bp, human
gactccaggtgagtcaggcg

SEQ ID NO: 144891 - DNA, 20 bp, human
gtattttggggcggtcacgt

SEQ ID NO: 144892 - DNA, 20 bp, human
ggcccgacgccgggacctcg

SEQ ID NO: 144893 - DNA, 20 bp, human
gcgtcgggcagtctcttgga

SEQ ID NO: 144894 - DNA, 20 bp, human
gccccaggagccccccagta

SEQ ID NO: 144895 - DNA, 20 bp, human
gcggcggagccccgaggtcc

SEQ ID NO: 144896 - DNA, 20 bp, human
gacgccctgggatacttcag

SEQ ID NO: 144897 - DNA, 20 bp, human
ggcgctgggaggtgacacct

SEQ ID NO: 144898 - DNA, 20 bp, human
gctcggcacccgacagacac

SEQ ID NO: 144899 - DNA, 20 bp, human
ggcgcccctgaagtatccca

SEQ ID NO: 144900 - DNA, 20 bp, human
gtgcatggacgcaggaaagt

SEQ ID NO: 144901 - DNA, 20 bp, human
gggacgcaggaaagttggct

SEQ ID NO: 144902 - DNA, 20 bp, human
gcccaacggatggtccgcca

SEQ ID NO: 144903 - DNA, 20 bp, human
gacgcggtacgaggtagcac

SEQ ID NO: 144904 - DNA, 20 bp, human
ggacagacacgggctcggag

SEQ ID NO: 144905 - DNA, 20 bp, human
gggcccctgggcccggacca

SEQ ID NO: 144906 - DNA, 20 bp, human
gtgggaggacctaaacacgt

SEQ ID NO: 144907 - DNA, 20 bp, human
gggaggtgcggatcacacca

SEQ ID NO: 144908 - DNA, 20 bp, human
gcagggaaggacgtgaggag

SEQ ID NO: 144909 - DNA, 20 bp, human
gccccagtcgctaggaatgg

SEQ ID NO: 144910 - DNA, 20 bp, human
gcacgtgggagggtccggac

SEQ ID NO: 144911 - DNA, 20 bp, human
gaggcgcagggaaggacgtg

SEQ ID NO: 144912 - DNA, 20 bp, human
gcctgaagcgggaaagccaa

SEQ ID NO: 144913 - DNA, 20 bp, human
gggaatgcgctggtctcctg

SEQ ID NO: 144914 - DNA, 20 bp, human
gttcagctgcgggacggtca

SEQ ID NO: 144915 - DNA, 20 bp, human
gcgccccgcgagaagaagag

SEQ ID NO: 144916 - DNA, 20 bp, human
gggagcaccagacctcctct

SEQ ID NO: 144917 - DNA, 20 bp, human
gatgatgccacagaggaacg

SEQ ID NO: 144918 - DNA, 20 bp, human
gccatctcgaagccaagagg

SEQ ID NO: 144919 - DNA, 20 bp, human
gcactgtgccagttacgcag

SEQ ID NO: 144920 - DNA, 20 bp, human
gtcgaagccaagaggaggtc

SEQ ID NO: 144921 - DNA, 20 bp, human
ggtcagtaatgcaaagccct

SEQ ID NO: 144922 - DNA, 20 bp, human
gcatcgtttggggccgagaa

SEQ ID NO: 144923 - DNA, 20 bp, human
gtctactacatgggagtccc

SEQ ID NO: 144924 - DNA, 20 bp, human
gggagagagaaagcatcgtt

SEQ ID NO: 144925 - DNA, 20 bp, human
gggcatcatccagccttcta

SEQ ID NO: 144926 - DNA, 20 bp, human
gggagcggcacggtccctgt

SEQ ID NO: 144927 - DNA, 20 bp, human
ggaacaggaagggttgagag

SEQ ID NO: 144928 - DNA, 20 bp, human
ggatgggaggatggacgtac

SEQ ID NO: 144929 - DNA, 20 bp, human
gtggcgagtgagacgctgat

SEQ ID NO: 144930 - DNA, 20 bp, human
ggatgcggggagatagacaa

SEQ ID NO: 144931 - DNA, 20 bp, human
ggtctcactcgccaagtgga

SEQ ID NO: 144932 - DNA, 20 bp, human
gggtgtctgagtgctccgcg

SEQ ID NO: 144933 - DNA, 20 bp, human
ggcggggagatagacaaggg

SEQ ID NO: 144934 - DNA, 20 bp, human
gtgagacgctgatgggagga

SEQ ID NO: 144935 - DNA, 20 bp, human
ggaagaggaggtggattgta

SEQ ID NO: 144936 - DNA, 20 bp, human
gctgcggcgcacttccgtag

SEQ ID NO: 144937 - DNA, 20 bp, human
gcacgccatgtccacctcta

SEQ ID NO: 144938 - DNA, 20 bp, human
gacttccgtagaggtggaca

SEQ ID NO: 144939 - DNA, 20 bp, human
ggcgctccgggatccatacc

SEQ ID NO: 144940 - DNA, 20 bp, human
gtacctggcaagcaatagcg

SEQ ID NO: 144941 - DNA, 20 bp, human
gcggcgcacttccgtagagg

SEQ ID NO: 144942 - DNA, 20 bp, human
gggccggaactggcggactg

SEQ ID NO: 144943 - DNA, 20 bp, human
gtggatcccggagcgcgcag

SEQ ID NO: 144944 - DNA, 20 bp, human
gtggagcttcagaagtcctg

SEQ ID NO: 144945 - DNA, 20 bp, human
ggcttgccaggtatggatcc

SEQ ID NO: 144946 - DNA, 20 bp, human
ggccgccgcgccccctccta

SEQ ID NO: 144947 - DNA, 20 bp, human
ggagctctcagtgagtgaaa

SEQ ID NO: 144948 - DNA, 20 bp, human
ggactgaactgctcactacc

SEQ ID NO: 144949 - DNA, 20 bp, human
gaccaggcagatgagagggg

SEQ ID NO: 144950 - DNA, 20 bp, human
ggggttacgggaagccaagt

SEQ ID NO: 144951 - DNA, 20 bp, human
gggtggtgaagaagcggtgg

SEQ ID NO: 144952 - DNA, 20 bp, human
ggcctcagcagcggcaccgg

SEQ ID NO: 144953 - DNA, 20 bp, human
gtgggtggccggaactgggg

SEQ ID NO: 144954 - DNA, 20 bp, human
gctccaccaggcagatgaga

SEQ ID NO: 144955 - DNA, 20 bp, human
gaaaggggggcggggtaacg

SEQ ID NO: 144956 - DNA, 20 bp, human
ggatggaccagaatacgagg

SEQ ID NO: 144957 - DNA, 20 bp, human
gggaggagcggtcaacggta

SEQ ID NO: 144958 - DNA, 20 bp, human
gtagttggaggagcggtcaa

SEQ ID NO: 144959 - DNA, 20 bp, human
gtactggttagttggaggag

SEQ ID NO: 144960 - DNA, 20 bp, human
gctggatggaccagaatacg

SEQ ID NO: 144961 - DNA, 20 bp, human
gtaacttactggttagttgg

SEQ ID NO: 144962 - DNA, 20 bp, human
gagtcaaactgcggctacca

SEQ ID NO: 144963 - DNA, 20 bp, human
ggtggacgaaggtgactctc

SEQ ID NO: 144964 - DNA, 20 bp, human
gacgaaggtgactctctgga

SEQ ID NO: 144965 - DNA, 20 bp, human
gtccttacaggcatactacc

SEQ ID NO: 144966 - DNA, 20 bp, human
gcctcgcccggctacgcagg

SEQ ID NO: 144967 - DNA, 20 bp, human
gcacgggccgggcggcacca

SEQ ID NO: 144968 - DNA, 20 bp, human
ggctgctctccggagggagt

SEQ ID NO: 144969 - DNA, 20 bp, human
ggcagggctgcggcacgggc

SEQ ID NO: 144970 - DNA, 20 bp, human
gcctcacgccggcgcagccc

SEQ ID NO: 144971 - DNA, 20 bp, human
ggggcaagatctgtaagcgg

SEQ ID NO: 144972 - DNA, 20 bp, human
gcggcgtcgcctcgacgggg

SEQ ID NO: 144973 - DNA, 20 bp, human
gacgaccgagcccctcacgc

SEQ ID NO: 144974 - DNA, 20 bp, human
gccgcctcgcccggctacgc

SEQ ID NO: 144975 - DNA, 20 bp, human
gaggcggcagggctgcggca

SEQ ID NO: 144976 - DNA, 20 bp, human
gcggccccggtccctggtag

SEQ ID NO: 144977 - DNA, 20 bp, human
gccgccgctaccagggaccg

SEQ ID NO: 144978 - DNA, 20 bp, human
gccagcaaggatctgcggag

SEQ ID NO: 144979 - DNA, 20 bp, human
ggcagctcaggccgagcagg

SEQ ID NO: 144980 - DNA, 20 bp, human
ggcctcgggctgggtcgagt

SEQ ID NO: 144981 - DNA, 20 bp, human
gcatggcggtggaggacgag

SEQ ID NO: 144982 - DNA, 20 bp, human
gctcgccctcggccaactgg

SEQ ID NO: 144983 - DNA, 20 bp, human
gagtcggctccggggtaacg

SEQ ID NO: 144984 - DNA, 20 bp, human
gacacgcggggcacacgctc

SEQ ID NO: 144985 - DNA, 20 bp, human
gggtccccagcaaggatctg

SEQ ID NO: 144986 - DNA, 20 bp, human
ggtctggcttcccccgagcc

SEQ ID NO: 144987 - DNA, 20 bp, human
gccccggcccgccccacctg

SEQ ID NO: 144988 - DNA, 20 bp, human
gggactgggcgccgcaggtg

SEQ ID NO: 144989 - DNA, 20 bp, human
gtgggcgccgcaggtggggc

SEQ ID NO: 144990 - DNA, 20 bp, human
gccatcgcggggtcccggct

SEQ ID NO: 144991 - DNA, 20 bp, human
gcttggccatcgcggggtcc

SEQ ID NO: 144992 - DNA, 20 bp, human
ggcgatccgcggctcacgag

SEQ ID NO: 144993 - DNA, 20 bp, human
gagccagacaccggggtccg

SEQ ID NO: 144994 - DNA, 20 bp, human
gggcggggaagtgtcaccga

SEQ ID NO: 144995 - DNA, 20 bp, human
gctcgggggaagccagacac

SEQ ID NO: 144996 - DNA, 20 bp, human
gggactgggcgccgcagggg

SEQ ID NO: 144997 - DNA, 20 bp, human
gctgggcgccgcaggggggg

SEQ ID NO: 144998 - DNA, 20 bp, human
gccatcgcggggtgccggct

SEQ ID NO: 144999 - DNA, 20 bp, human
gcttggccatcgcggggtgc

SEQ ID NO: 145000 - DNA, 20 bp, human
ggcgatccgcggctcacgag

SEQ ID NO: 145001 - DNA, 20 bp, human
gagccagacaccggggtccg

SEQ ID NO: 145002 - DNA, 20 bp, human
gggtccacccacaagagcag

SEQ ID NO: 145003 - DNA, 20 bp, human
ggagcctggtgacatgccag

SEQ ID NO: 145004 - DNA, 20 bp, human
gggcggggaagtgtcaccga

SEQ ID NO: 145005 - DNA, 20 bp, human
gctcgggggaagccagacac

SEQ ID NO: 145006 - DNA, 20 bp, human
gccgtccggactctacaggt

SEQ ID NO: 145007 - DNA, 20 bp, human
ggcacgggcggcggagacaa

SEQ ID NO: 145008 - DNA, 20 bp, human
gggacgtgtgagtactcctc

SEQ ID NO: 145009 - DNA, 20 bp, human
gggggtccgttcagagtcaa

SEQ ID NO: 145010 - DNA, 20 bp, human
gtaggagccgtgctccgagc

SEQ ID NO: 145011 - DNA, 20 bp, human
gctgcatggtaggcaaggag

SEQ ID NO: 145012 - DNA, 20 bp, human
gtccgcgtgccagggcgggt

SEQ ID NO: 145013 - DNA, 20 bp, human
ggtccgttcagagtcaaggg

SEQ ID NO: 145014 - DNA, 20 bp, human
ggaacatgcgaccctctctc

SEQ ID NO: 145015 - DNA, 20 bp, human
gctcccaccgggacagccat

SEQ ID NO: 145016 - DNA, 20 bp, human
gacgcagaagaacccgggag

SEQ ID NO: 145017 - DNA, 20 bp, human
gccggcggggctgaagaagg

SEQ ID NO: 145018 - DNA, 20 bp, human
gcggctccgaggaggtggga

SEQ ID NO: 145019 - DNA, 20 bp, human
gagcggcaggcggcatccca

SEQ ID NO: 145020 - DNA, 20 bp, human
gccgcgtccaggtcctccgg

SEQ ID NO: 145021 - DNA, 20 bp, human
gccagcgccgggaacatctc

SEQ ID NO: 145022 - DNA, 20 bp, human
ggtctgaccgcgagagacgc

SEQ ID NO: 145023 - DNA, 20 bp, human
gtgtgggtccctcccgggag

SEQ ID NO: 145024 - DNA, 20 bp, human
gggcggcatcccagggtgat

SEQ ID NO: 145025 - DNA, 20 bp, human
gccagcgtggccccgaccaa

SEQ ID NO: 145026 - DNA, 20 bp, human
ggccagcggtaggaagtcag

SEQ ID NO: 145027 - DNA, 20 bp, human
gggtcaggaaaccaaggtaa

SEQ ID NO: 145028 - DNA, 20 bp, human
gaggcgcagataggacccga

SEQ ID NO: 145029 - DNA, 20 bp, human
gcagacggctgctgattctg

SEQ ID NO: 145030 - DNA, 20 bp, human
ggagggccttggagagtcga

SEQ ID NO: 145031 - DNA, 20 bp, human
gcggtaggaagtcagcggag

SEQ ID NO: 145032 - DNA, 20 bp, human
gtaggaagtcagcggagagg

SEQ ID NO: 145033 - DNA, 20 bp, human
gtggtccgtgactccttggg

SEQ ID NO: 145034 - DNA, 20 bp, human
gacgtggagttgggttccga

SEQ ID NO: 145035 - DNA, 20 bp, human
gtgcgcctcccaaggagtca

SEQ ID NO: 145036 - DNA, 20 bp, human
ggagctggtagacctcgccg

SEQ ID NO: 145037 - DNA, 20 bp, human
gtcctcggctcgtccaaggt

SEQ ID NO: 145038 - DNA, 20 bp, human
gtcctcgatggtaggcgtgt

SEQ ID NO: 145039 - DNA, 20 bp, human
ggctcggctggggttctccc

SEQ ID NO: 145040 - DNA, 20 bp, human
ggcggatggagtagaacttg

SEQ ID NO: 145041 - DNA, 20 bp, human
ggatggagtagaacttgcgg

SEQ ID NO: 145042 - DNA, 20 bp, human
ggtcctcgaagcggccggtg

SEQ ID NO: 145043 - DNA, 20 bp, human
gcgtgtaggcgtcctcgaag

SEQ ID NO: 145044 - DNA, 20 bp, human
ggcctacacgcctaccatcg

SEQ ID NO: 145045 - DNA, 20 bp, human
gcccggctcacctgtgagga

SEQ ID NO: 145046 - DNA, 20 bp, human
gtctcccagcgccggaggga

SEQ ID NO: 145047 - DNA, 20 bp, human
ggagaaagaagccgtccctc

SEQ ID NO: 145048 - DNA, 20 bp, human
gcggcgacgccagcagctga

SEQ ID NO: 145049 - DNA, 20 bp, human
ggccctcggagcccacccat

SEQ ID NO: 145050 - DNA, 20 bp, human
gcagctctcccagcgccgga

SEQ ID NO: 145051 - DNA, 20 bp, human
ggccgggcaaggaggcgcaa

SEQ ID NO: 145052 - DNA, 20 bp, human
ggggcaggtgccccatgggt

SEQ ID NO: 145053 - DNA, 20 bp, human
ggggagagctgcagagccgc

SEQ ID NO: 145054 - DNA, 20 bp, human
ggagcagctcctagagactt

SEQ ID NO: 145055 - DNA, 20 bp, human
ggtgggtgcgtgtcccaggt

SEQ ID NO: 145056 - DNA, 20 bp, human
gccccaacaggtcccgggag

SEQ ID NO: 145057 - DNA, 20 bp, human
gcgcaggaggcgctccttgg

SEQ ID NO: 145058 - DNA, 20 bp, human
gggctggacgccgaccgtga

SEQ ID NO: 145059 - DNA, 20 bp, human
gcaccgctcccgggacctgt

SEQ ID NO: 145060 - DNA, 20 bp, human
gccacgcgcgaactcctgga

SEQ ID NO: 145061 - DNA, 20 bp, human
gggccctccctggaaggacg

SEQ ID NO: 145062 - DNA, 20 bp, human
ggagcggctcccttcgacga

SEQ ID NO: 145063 - DNA, 20 bp, human
gggagcggtggggtgcgccc

SEQ ID NO: 145064 - DNA, 20 bp, human
gcgggctccaggcaccgcca

SEQ ID NO: 145065 - DNA, 20 bp, human
ggaaggtgatggcgccgtca

SEQ ID NO: 145066 - DNA, 20 bp, human
ggagctggaggtcagcggtg

SEQ ID NO: 145067 - DNA, 20 bp, human
ggggccagcaggtcatgagg

SEQ ID NO: 145068 - DNA, 20 bp, human
gccggccctgcctacctagg

SEQ ID NO: 145069 - DNA, 20 bp, human
ggaagatgtacgtcctctga

SEQ ID NO: 145070 - DNA, 20 bp, human
gcgagccgtgcctcctaggt

SEQ ID NO: 145071 - DNA, 20 bp, human
gacctccagctcggcccacg

SEQ ID NO: 145072 - DNA, 20 bp, human
ggagagggggagaatcccag

SEQ ID NO: 145073 - DNA, 20 bp, human
ggatgcagggaggttggcac

SEQ ID NO: 145074 - DNA, 20 bp, human
gagatcctcgtgggccgagc

SEQ ID NO: 145075 - DNA, 20 bp, human
gtgagggggcataaagaccc

SEQ ID NO: 145076 - DNA, 20 bp, human
gcaaatgcgaccaaaggaca

SEQ ID NO: 145077 - DNA, 20 bp, human
gcgcggcccagggatctcca

SEQ ID NO: 145078 - DNA, 20 bp, human
gacagggagctaaagcgcgc

SEQ ID NO: 145079 - DNA, 20 bp, human
gcagtcccaggtacccgcag

SEQ ID NO: 145080 - DNA, 20 bp, human
gtataaacaaggaacccgac

SEQ ID NO: 145081 - DNA, 20 bp, human
gagttacagcccgggaccgg

SEQ ID NO: 145082 - DNA, 20 bp, human
gcgcccacaaatgcgaccaa

SEQ ID NO: 145083 - DNA, 20 bp, human
gaggcctggctgcaggatca

SEQ ID NO: 145084 - DNA, 20 bp, human
gccggccgctgcgggtacct

SEQ ID NO: 145085 - DNA, 20 bp, human
gcgcagcgcgcagtagggtc

SEQ ID NO: 145086 - DNA, 20 bp, human
gtagcgggtagggtaccctg

SEQ ID NO: 145087 - DNA, 20 bp, human
ggctcttcctgccactctag

SEQ ID NO: 145088 - DNA, 20 bp, human
gtcggccgcgcaccactcac

SEQ ID NO: 145089 - DNA, 20 bp, human
gggcggcgcgcggcagagct

SEQ ID NO: 145090 - DNA, 20 bp, human
ggcggccgagggacacctgg

SEQ ID NO: 145091 - DNA, 20 bp, human
gcgcaccgggagctgcccat

SEQ ID NO: 145092 - DNA, 20 bp, human
gcgctgggagccgggcggtc

SEQ ID NO: 145093 - DNA, 20 bp, human
gagctgggtctcccgccagg

SEQ ID NO: 145094 - DNA, 20 bp, human
gaactccgggcccggcccat

SEQ ID NO: 145095 - DNA, 20 bp, human
gagcccgcacgagcgcctgg

SEQ ID NO: 145096 - DNA, 20 bp, human
gccggtgccgggcaaactga

SEQ ID NO: 145097 - DNA, 20 bp, human
gatgccgcccgaccctcctc

SEQ ID NO: 145098 - DNA, 20 bp, human
gtccgggtactggggctctg

SEQ ID NO: 145099 - DNA, 20 bp, human
gcggcatcttccgggtactg

SEQ ID NO: 145100 - DNA, 20 bp, human
gcccggcaccggaggagggt

SEQ ID NO: 145101 - DNA, 20 bp, human
gtccgcagagccccagtacc

SEQ ID NO: 145102 - DNA, 20 bp, human
ggccgggcaaactgagggac

SEQ ID NO: 145103 - DNA, 20 bp, human
gtccagcaggtaaagccccg

SEQ ID NO: 145104 - DNA, 20 bp, human
gcgcagcgcgcacggacggg

SEQ ID NO: 145105 - DNA, 20 bp, human
ggtttgcccggcaccggagg

SEQ ID NO: 145106 - DNA, 20 bp, human
ggagcgtgcgctacaacgag

SEQ ID NO: 145107 - DNA, 20 bp, human
ggcgggtgcggagggctcac

SEQ ID NO: 145108 - DNA, 20 bp, human
gtcgccggccgggacctgag

SEQ ID NO: 145109 - DNA, 20 bp, human
gcgcgaggcaggggtgagac

SEQ ID NO: 145110 - DNA, 20 bp, human
gctgagtaagaagacggccg

SEQ ID NO: 145111 - DNA, 20 bp, human
ggcccagctggctccctcga

SEQ ID NO: 145112 - DNA, 20 bp, human
ggaggtacatgcccgccggg

SEQ ID NO: 145113 - DNA, 20 bp, human
ggagccgctggcacgagaag

SEQ ID NO: 145114 - DNA, 20 bp, human
ggatcaaggctgggagaccg

SEQ ID NO: 145115 - DNA, 20 bp, human
gggcttcctgagtaagaaga

SEQ ID NO: 145116 - DNA, 20 bp, human
gagcccggcgagcccgaccg

SEQ ID NO: 145117 - DNA, 20 bp, human
gcggccctagcagatctcac

SEQ ID NO: 145118 - DNA, 20 bp, human
ggcccgccagccctcgagcc

SEQ ID NO: 145119 - DNA, 20 bp, human
ggaggctccgcggtgagtag

SEQ ID NO: 145120 - DNA, 20 bp, human
gcgtccggtgagatctgcta

SEQ ID NO: 145121 - DNA, 20 bp, human
gtcgggctcgccgggctcga

SEQ ID NO: 145122 - DNA, 20 bp, human
gcgcgaggccagagctcgtc

SEQ ID NO: 145123 - DNA, 20 bp, human
gctgccggctctctcccccc

SEQ ID NO: 145124 - DNA, 20 bp, human
ggcctgcggtgcacctcggt

SEQ ID NO: 145125 - DNA, 20 bp, human
ggctccctccccgaaacccc

SEQ ID NO: 145126 - DNA, 20 bp, human
gagacagtctgcagagccta

SEQ ID NO: 145127 - DNA, 20 bp, human
gccacgctctgaaggcagat

SEQ ID NO: 145128 - DNA, 20 bp, human
gaaggcagtgaggggacaaa

SEQ ID NO: 145129 - DNA, 20 bp, human
gtccccaggaaaccttccca

SEQ ID NO: 145130 - DNA, 20 bp, human
ggggcagctccacgctctga

SEQ ID NO: 145131 - DNA, 20 bp, human
gcctatggcacatgactatg

SEQ ID NO: 145132 - DNA, 20 bp, human
gagccatgggaaggtttcct

SEQ ID NO: 145133 - DNA, 20 bp, human
ggcctctaaagcaagactag

SEQ ID NO: 145134 - DNA, 20 bp, human
ggctgtcaatgagatcgtcc

SEQ ID NO: 145135 - DNA, 20 bp, human
gaagttggctaactgcccac

SEQ ID NO: 145136 - DNA, 20 bp, human
gtgtgtggccgcgggactca

SEQ ID NO: 145137 - DNA, 20 bp, human
gggagcagggtgtccagagg

SEQ ID NO: 145138 - DNA, 20 bp, human
gtggccgcgggactcaaggc

SEQ ID NO: 145139 - DNA, 20 bp, human
gaggccggggacctaagtgg

SEQ ID NO: 145140 - DNA, 20 bp, human
gtcaggagccggggataggg

SEQ ID NO: 145141 - DNA, 20 bp, human
gggagtgtacatgcgtggag

SEQ ID NO: 145142 - DNA, 20 bp, human
gacctccgcaaaggtcccag

SEQ ID NO: 145143 - DNA, 20 bp, human
gtggcgcgagcgcccccctc

SEQ ID NO: 145144 - DNA, 20 bp, human
gcggaggccggggacctaag

SEQ ID NO: 145145 - DNA, 20 bp, human
ggaggatgtcagcgcctgtg

SEQ ID NO: 145146 - DNA, 20 bp, human
gcgctccgggagcctcccac

SEQ ID NO: 145147 - DNA, 20 bp, human
gtctgcctctcccgggacag

SEQ ID NO: 145148 - DNA, 20 bp, human
gtcggtccgagcccggtggg

SEQ ID NO: 145149 - DNA, 20 bp, human
gcggaccgaacccctgtccc

SEQ ID NO: 145150 - DNA, 20 bp, human
ggaggcagagcgggagtctg

SEQ ID NO: 145151 - DNA, 20 bp, human
gggacccgggctcagactcg

SEQ ID NO: 145152 - DNA, 20 bp, human
gggttcggtccgagcccggt

SEQ ID NO: 145153 - DNA, 20 bp, human
gtgtctcccggggaatccgg

SEQ ID NO: 145154 - DNA, 20 bp, human
gttcggtgagtggctcggga

SEQ ID NO: 145155 - DNA, 20 bp, human
gatggccgccggcgcggggt

SEQ ID NO: 145156 - DNA, 20 bp, human
ggttctccagttacttacta

SEQ ID NO: 145157 - DNA, 20 bp, human
gctccagttacttactaggg

SEQ ID NO: 145158 - DNA, 20 bp, human
gtactagggtggttttgtcg

SEQ ID NO: 145159 - DNA, 20 bp, human
gagctgctctcggcgtgctc

SEQ ID NO: 145160 - DNA, 20 bp, human
gaaccaccctagtaagtaac

SEQ ID NO: 145161 - DNA, 20 bp, human
gctcggcgtgctccggcact

SEQ ID NO: 145162 - DNA, 20 bp, human
gttccctctggcacgataga

SEQ ID NO: 145163 - DNA, 20 bp, human
gtgaaggaaacagctgctct

SEQ ID NO: 145164 - DNA, 20 bp, human
gaataacaggttctaaaaaa

SEQ ID NO: 145165 - DNA, 20 bp, human
gtaggttcaaagtcaagttc

SEQ ID NO: 145166 - DNA, 20 bp, human
gggaggccccagctccctag

SEQ ID NO: 145167 - DNA, 20 bp, human
gcgggggtcttgcaagagta

SEQ ID NO: 145168 - DNA, 20 bp, human
gtccttcccaagcaccgagg

SEQ ID NO: 145169 - DNA, 20 bp, human
ggggagtctggagccagcta

SEQ ID NO: 145170 - DNA, 20 bp, human
gcccgtggactggaaactcc

SEQ ID NO: 145171 - DNA, 20 bp, human
gggcctccctctgcatggga

SEQ ID NO: 145172 - DNA, 20 bp, human
gggtgagaggaccctcccca

SEQ ID NO: 145173 - DNA, 20 bp, human
gctttccttcccaagcaccg

SEQ ID NO: 145174 - DNA, 20 bp, human
gctggggagatcactcgcca

SEQ ID NO: 145175 - DNA, 20 bp, human
gtcaaactccagggacaaca

SEQ ID NO: 145176 - DNA, 20 bp, human
gcccagctccagctcacggg

SEQ ID NO: 145177 - DNA, 20 bp, human
gggccctgagcacccggcca

SEQ ID NO: 145178 - DNA, 20 bp, human
gccatggtgcgcccgtcccg

SEQ ID NO: 145179 - DNA, 20 bp, human
ggcgccccagtcacgcacaa

SEQ ID NO: 145180 - DNA, 20 bp, human
gggacgggcgcaccatggcc

SEQ ID NO: 145181 - DNA, 20 bp, human
gggctcacggccgtccaggt

SEQ ID NO: 145182 - DNA, 20 bp, human
gggcaggtctcccgagccgg

SEQ ID NO: 145183 - DNA, 20 bp, human
gagtgacgcggcaggatgtc

SEQ ID NO: 145184 - DNA, 20 bp, human
gccgcacaggcgacaggaga

SEQ ID NO: 145185 - DNA, 20 bp, human
ggcgaggaggaggcgctgct

SEQ ID NO: 145186 - DNA, 20 bp, human
gggcagacagacagccgagt

SEQ ID NO: 145187 - DNA, 20 bp, human
gccgcgctggaaagcctcat

SEQ ID NO: 145188 - DNA, 20 bp, human
gagcgccggccggccatggg

SEQ ID NO: 145189 - DNA, 20 bp, human
gggagcaccgagaccggaga

SEQ ID NO: 145190 - DNA, 20 bp, human
gatagaggcacagaggctcc

SEQ ID NO: 145191 - DNA, 20 bp, human
gacgcccggggcgcctagaa

SEQ ID NO: 145192 - DNA, 20 bp, human
ggacccgcggtgctgctcga

SEQ ID NO: 145193 - DNA, 20 bp, human
gcagcaccgcgggtcggtag

SEQ ID NO: 145194 - DNA, 20 bp, human
gacccgcaggctacccccca

SEQ ID NO: 145195 - DNA, 20 bp, human
gagaggcgcggcccgtccgt

SEQ ID NO: 145196 - DNA, 20 bp, human
gcagatgcgggccgccgagg

SEQ ID NO: 145197 - DNA, 20 bp, human
gctggaggttcctaccccct

SEQ ID NO: 145198 - DNA, 20 bp, human
ggcaggcggcgcgctccgga

SEQ ID NO: 145199 - DNA, 20 bp, human
ggaggttcctaccccctcgg

SEQ ID NO: 145200 - DNA, 20 bp, human
ggcccggggggagagaagta

SEQ ID NO: 145201 - DNA, 20 bp, human
gccctgagcccgccccgact

SEQ ID NO: 145202 - DNA, 20 bp, human
gcccagctccagctctcacg

SEQ ID NO: 145203 - DNA, 20 bp, human
ggcgctccccatgacctgat

SEQ ID NO: 145204 - DNA, 20 bp, human
gtcccccgcctgcccagtcg

SEQ ID NO: 145205 - DNA, 20 bp, human
gggcgtccgggactaggagg

SEQ ID NO: 145206 - DNA, 20 bp, human
gaggtgggcaagatcatctg

SEQ ID NO: 145207 - DNA, 20 bp, human
gactccggctggctgctgcg

SEQ ID NO: 145208 - DNA, 20 bp, human
gtagaggtccgggaccgcgg

SEQ ID NO: 145209 - DNA, 20 bp, human
ggctgggagtgcgggactag

SEQ ID NO: 145210 - DNA, 20 bp, human
gtccggcgcgcaatccgaga

SEQ ID NO: 145211 - DNA, 20 bp, human
ggatgcaccaggaaacgcca

SEQ ID NO: 145212 - DNA, 20 bp, human
ggagtgcgggactagaggtc

SEQ ID NO: 145213 - DNA, 20 bp, human
ggactagaggtccgggaccg

SEQ ID NO: 145214 - DNA, 20 bp, human
gcgcgggtgcaggtagaatc

SEQ ID NO: 145215 - DNA, 20 bp, human
ggctgcctgcagaactgtca

SEQ ID NO: 145216 - DNA, 20 bp, human
gaggcgggtggcgtagacaa

SEQ ID NO: 145217 - DNA, 20 bp, human
gcagcctcaactcccgtcag

SEQ ID NO: 145218 - DNA, 20 bp, human
ggcgcccacacagcagtcgg

SEQ ID NO: 145219 - DNA, 20 bp, human
gcgacccctgacgggagttg

SEQ ID NO: 145220 - DNA, 20 bp, human
gtcgtccaagaccagaccca

SEQ ID NO: 145221 - DNA, 20 bp, human
gacaaggcgtggggagcggt

SEQ ID NO: 145222 - DNA, 20 bp, human
gcgagcgccgaggttccgca

SEQ ID NO: 145223 - DNA, 20 bp, human
gataagtgcaggtacgggcg

SEQ ID NO: 145224 - DNA, 20 bp, human
gttgaggctgaacaaggcgt

SEQ ID NO: 145225 - DNA, 20 bp, human
gctgaacaaggcgtggggag

SEQ ID NO: 145226 - DNA, 20 bp, human
ggacagtgggaagacacaaa

SEQ ID NO: 145227 - DNA, 20 bp, human
gcgctcccctgggccccgac

SEQ ID NO: 145228 - DNA, 20 bp, human
ggcggacgccgacgggtccg

SEQ ID NO: 145229 - DNA, 20 bp, human
gtggccaggttgacctcgag

SEQ ID NO: 145230 - DNA, 20 bp, human
gactgaggcaaagaaaatca

SEQ ID NO: 145231 - DNA, 20 bp, human
gagacctgcgtggccgtcca

SEQ ID NO: 145232 - DNA, 20 bp, human
gccctcggccccgcgtccag

SEQ ID NO: 145233 - DNA, 20 bp, human
gggctggcaagtctggtgag

SEQ ID NO: 145234 - DNA, 20 bp, human
gaggtcaacctggccatcct

SEQ ID NO: 145235 - DNA, 20 bp, human
gcgcccagctccgcacttgg

SEQ ID NO: 145236 - DNA, 20 bp, human
gtacggacgcgcaggactgg

SEQ ID NO: 145237 - DNA, 20 bp, human
gacacgcacgcacgcgaccg

SEQ ID NO: 145238 - DNA, 20 bp, human
gtagccgccaaccaccgccc

SEQ ID NO: 145239 - DNA, 20 bp, human
gacgcacgcgaccggggcgg

SEQ ID NO: 145240 - DNA, 20 bp, human
gggtacggctatgggcgagg

SEQ ID NO: 145241 - DNA, 20 bp, human
ggcacccagcatctaggcgg

SEQ ID NO: 145242 - DNA, 20 bp, human
gggccgcgccgggaccaggt

SEQ ID NO: 145243 - DNA, 20 bp, human
ggacgggcgggtacggctat

SEQ ID NO: 145244 - DNA, 20 bp, human
gacgcgaccggggcggtggt

SEQ ID NO: 145245 - DNA, 20 bp, human
gcatctaggcggtggaatcg

SEQ ID NO: 145246 - DNA, 20 bp, human
gtacgagtggagtgcgacaa

SEQ ID NO: 145247 - DNA, 20 bp, human
gagctcaggctcccccgaca

SEQ ID NO: 145248 - DNA, 20 bp, human
ggcccaaccgggccatgtcg

SEQ ID NO: 145249 - DNA, 20 bp, human
gtctgtggcccagatacgag

SEQ ID NO: 145250 - DNA, 20 bp, human
ggcgaagcacgggcccaacc

SEQ ID NO: 145251 - DNA, 20 bp, human
gcccgcagctcaatgagctc

SEQ ID NO: 145252 - DNA, 20 bp, human
gcccccgacatggcccggtt

SEQ ID NO: 145253 - DNA, 20 bp, human
ggtcgccgcgggtcaagtcg

SEQ ID NO: 145254 - DNA, 20 bp, human
gcccaaagccagcgaagcac

SEQ ID NO: 145255 - DNA, 20 bp, human
gacacgtggtgcgacctctg

SEQ ID NO: 145256 - DNA, 20 bp, human
gggacgagcagatccggtag

SEQ ID NO: 145257 - DNA, 20 bp, human
ggaaagaggagacaagagac

SEQ ID NO: 145258 - DNA, 20 bp, human
gaggcgaaggcaaggcgaag

SEQ ID NO: 145259 - DNA, 20 bp, human
ggacagcggacgagcagatc

SEQ ID NO: 145260 - DNA, 20 bp, human
ggaaggaaggacgcccccag

SEQ ID NO: 145261 - DNA, 20 bp, human
ggccggggtagggaccatcg

SEQ ID NO: 145262 - DNA, 20 bp, human
gcgaaggcaaggcgaagggg

SEQ ID NO: 145263 - DNA, 20 bp, human
ggagacaggcgaggattacg

SEQ ID NO: 145264 - DNA, 20 bp, human
gtacggggctgacccagccg

SEQ ID NO: 145265 - DNA, 20 bp, human
gtccacgatggtccctaccc

SEQ ID NO: 145266 - DNA, 20 bp, human
gccgcgcgccactcacttgt

SEQ ID NO: 145267 - DNA, 20 bp, human
gcgggttccccggaactctg

SEQ ID NO: 145268 - DNA, 20 bp, human
gccgggagagcctgattgag

SEQ ID NO: 145269 - DNA, 20 bp, human
gacgttcccgggacccgaaa

SEQ ID NO: 145270 - DNA, 20 bp, human
ggccccgcagagacacgtgg

SEQ ID NO: 145271 - DNA, 20 bp, human
gctgcggccgccgctcaatc

SEQ ID NO: 145272 - DNA, 20 bp, human
gtgtgcgtgtaggcgaggga

SEQ ID NO: 145273 - DNA, 20 bp, human
ggctccggccaacaagtgag

SEQ ID NO: 145274 - DNA, 20 bp, human
ggcctacacgcacaagctcc

SEQ ID NO: 145275 - DNA, 20 bp, human
ggcctggagcttgtgcgtgt

SEQ ID NO: 145276 - DNA, 20 bp, human
ggaggacacgacacatgcag

SEQ ID NO: 145277 - DNA, 20 bp, human
gcgcagcgcctgctgacccc

SEQ ID NO: 145278 - DNA, 20 bp, human
gggactgcgcgatgactgga

SEQ ID NO: 145279 - DNA, 20 bp, human
gcgggctcattgctgagagg

SEQ ID NO: 145280 - DNA, 20 bp, human
gtggcagtcctgggtcggag

SEQ ID NO: 145281 - DNA, 20 bp, human
gcgcagctccggtgcaagcg

SEQ ID NO: 145282 - DNA, 20 bp, human
ggtcgtgtcctcgcttgcac

SEQ ID NO: 145283 - DNA, 20 bp, human
ggaagcactgatcctagagt

SEQ ID NO: 145284 - DNA, 20 bp, human
gcctgcgcgctgcggccgaa

SEQ ID NO: 145285 - DNA, 20 bp, human
gcggtgagtgatgaacgagc

SEQ ID NO: 145286 - DNA, 20 bp, human
gggccatgcccggctagtgg

SEQ ID NO: 145287 - DNA, 20 bp, human
ggagccagccccgagagaag

SEQ ID NO: 145288 - DNA, 20 bp, human
gcggctagtggcggcagctt

SEQ ID NO: 145289 - DNA, 20 bp, human
gcatggccatgcccggctag

SEQ ID NO: 145290 - DNA, 20 bp, human
gccgcccggcagcaccaact

SEQ ID NO: 145291 - DNA, 20 bp, human
gtggtctgcagcagagactg

SEQ ID NO: 145292 - DNA, 20 bp, human
gctcgctccgccgggactct

SEQ ID NO: 145293 - DNA, 20 bp, human
gtgtgacctgtgcggacgag

SEQ ID NO: 145294 - DNA, 20 bp, human
ggccccgaccccgcgacgtg

SEQ ID NO: 145295 - DNA, 20 bp, human
ggctcggggtccaatagtag

SEQ ID NO: 145296 - DNA, 20 bp, human
gtcccagcccggcagagaca

SEQ ID NO: 145297 - DNA, 20 bp, human
gggctcattgaactaaaggg

SEQ ID NO: 145298 - DNA, 20 bp, human
gtaaccataaggatactcag

SEQ ID NO: 145299 - DNA, 20 bp, human
gggtcaggaactctggtaga

SEQ ID NO: 145300 - DNA, 20 bp, human
gggcctcggacctcccctac

SEQ ID NO: 145301 - DNA, 20 bp, human
gattagaaagcagaatccat

SEQ ID NO: 145302 - DNA, 20 bp, human
gtggaggtaaatgtgaccat

SEQ ID NO: 145303 - DNA, 20 bp, human
ggcgagtcactcacctgtag

SEQ ID NO: 145304 - DNA, 20 bp, human
gttcggctgaacttgcttcg

SEQ ID NO: 145305 - DNA, 20 bp, human
gggtgcagagaagggcttgg

SEQ ID NO: 145306 - DNA, 20 bp, human
gcgggaggtgcccgctcaga

SEQ ID NO: 145307 - DNA, 20 bp, human
gctgcggcctgagcaggtcg

SEQ ID NO: 145308 - DNA, 20 bp, human
gccagcctggagacccgctc

SEQ ID NO: 145309 - DNA, 20 bp, human
gggcagcccagccgtttcta

SEQ ID NO: 145310 - DNA, 20 bp, human
gggcgagcgcagcgattagg

SEQ ID NO: 145311 - DNA, 20 bp, human
gtccaggctggcgagcgccc

SEQ ID NO: 145312 - DNA, 20 bp, human
gatgcccggacggagagcgg

SEQ ID NO: 145313 - DNA, 20 bp, human
gtggggcccgtgcggagggg

SEQ ID NO: 145314 - DNA, 20 bp, human
gctgcagatggagcagactc

SEQ ID NO: 145315 - DNA, 20 bp, human
ggccccgcgctcccaagtac

SEQ ID NO: 145316 - DNA, 20 bp, human
gggagcgcgggcgtaggagt

SEQ ID NO: 145317 - DNA, 20 bp, human
gccccgcaggccgcccagag

SEQ ID NO: 145318 - DNA, 20 bp, human
gggacgagcgcgggcgtagg

SEQ ID NO: 145319 - DNA, 20 bp, human
ggcgggcgtaggaggagcgc

SEQ ID NO: 145320 - DNA, 20 bp, human
gacccaaggtgcggagagag

SEQ ID NO: 145321 - DNA, 20 bp, human
ggtccccgcgccgcactccc

SEQ ID NO: 145322 - DNA, 20 bp, human
gggacgaggtacccaaggtg

SEQ ID NO: 145323 - DNA, 20 bp, human
gaggtgagtgtggacgccac

SEQ ID NO: 145324 - DNA, 20 bp, human
gtgcggagagaggggcaacc

SEQ ID NO: 145325 - DNA, 20 bp, human
gtacttagcggcggcgatcc

SEQ ID NO: 145326 - DNA, 20 bp, human
gaagctgggcaggtctccag

SEQ ID NO: 145327 - DNA, 20 bp, human
gaagggagccatggtctgtc

SEQ ID NO: 145328 - DNA, 20 bp, human
gagtcctagcctaaggagtt

SEQ ID NO: 145329 - DNA, 20 bp, human
gttgaactgcgggattgttg

SEQ ID NO: 145330 - DNA, 20 bp, human
gcttcttcgaggctgaagct

SEQ ID NO: 145331 - DNA, 20 bp, human
gcatactagcctaactcctt

SEQ ID NO: 145332 - DNA, 20 bp, human
gtgaaagccaggaacatccg

SEQ ID NO: 145333 - DNA, 20 bp, human
gctttcagctcattagtagc

SEQ ID NO: 145334 - DNA, 20 bp, human
ggctgcttaactttgaactg

SEQ ID NO: 145335 - DNA, 20 bp, human
gtgataaaaaaaggcttcgt

SEQ ID NO: 145336 - DNA, 20 bp, human
gctggggccgaagtcgaagc

SEQ ID NO: 145337 - DNA, 20 bp, human
gggacgtgtccgttactcac

SEQ ID NO: 145338 - DNA, 20 bp, human
gagcgggggccggtgagtaa

SEQ ID NO: 145339 - DNA, 20 bp, human
gccgactgcgaagtgaggga

SEQ ID NO: 145340 - DNA, 20 bp, human
gcgacttcggccccagactt

SEQ ID NO: 145341 - DNA, 20 bp, human
gccggctcgctggtcccaga

SEQ ID NO: 145342 - DNA, 20 bp, human
ggaccaagagcgggacgtgg

SEQ ID NO: 145343 - DNA, 20 bp, human
ggcatcgccggcttcgactt

SEQ ID NO: 145344 - DNA, 20 bp, human
gtaggggcgaccacaggctt

SEQ ID NO: 145345 - DNA, 20 bp, human
ggatcgggagagaccaagag

SEQ ID NO: 145346 - DNA, 20 bp, human
gtggcaggcggtccacacag

SEQ ID NO: 145347 - DNA, 20 bp, human
gagcgctccaggctgccgaa

SEQ ID NO: 145348 - DNA, 20 bp, human
gagcgcactggccaatccaa

SEQ ID NO: 145349 - DNA, 20 bp, human
ggaccaggaagcagcgctcc

SEQ ID NO: 145350 - DNA, 20 bp, human
ggctgctgtgtgaggctggg

SEQ ID NO: 145351 - DNA, 20 bp, human
gaggagctggtgcggccctt

SEQ ID NO: 145352 - DNA, 20 bp, human
gagtgcgctcactgtagacc

SEQ ID NO: 145353 - DNA, 20 bp, human
gctcacacagcagcagttcg

SEQ ID NO: 145354 - DNA, 20 bp, human
gtgactccaaagactctctc

SEQ ID NO: 145355 - DNA, 20 bp, human
gcagcagcagttcgaggagc

SEQ ID NO: 145356 - DNA, 20 bp, human
gtcgcgcggcgacctcctca

SEQ ID NO: 145357 - DNA, 20 bp, human
ggtgtccaggctgggatcgg

SEQ ID NO: 145358 - DNA, 20 bp, human
gagcggagagagaaagcggg

SEQ ID NO: 145359 - DNA, 20 bp, human
gccagcggctgcggactcct

SEQ ID NO: 145360 - DNA, 20 bp, human
gggtactgggacggtgatag

SEQ ID NO: 145361 - DNA, 20 bp, human
gcatcttcccgggcgcccag

SEQ ID NO: 145362 - DNA, 20 bp, human
gggactcctcggaggctcca

SEQ ID NO: 145363 - DNA, 20 bp, human
ggcgcctcagagcggtcctg

SEQ ID NO: 145364 - DNA, 20 bp, human
gactccccaggaccgctctg

SEQ ID NO: 145365 - DNA, 20 bp, human
gcctggcagttgctgtcctg

SEQ ID NO: 145366 - DNA, 20 bp, human
gccgacttctgggactaagg

SEQ ID NO: 145367 - DNA, 20 bp, human
gcccgggctgcgcacgctgg

SEQ ID NO: 145368 - DNA, 20 bp, human
gagggctcggagccttcctc

SEQ ID NO: 145369 - DNA, 20 bp, human
ggggctgcgcacgctggggg

SEQ ID NO: 145370 - DNA, 20 bp, human
gaggagcgggataggaggct

SEQ ID NO: 145371 - DNA, 20 bp, human
gcactcaccttcgtactcgg

SEQ ID NO: 145372 - DNA, 20 bp, human
gcagcatcgaggccatcctg

SEQ ID NO: 145373 - DNA, 20 bp, human
gccaaggacgacgggatcct

SEQ ID NO: 145374 - DNA, 20 bp, human
ggggcgcgaaggagcgggat

SEQ ID NO: 145375 - DNA, 20 bp, human
ggcaagcgagaagctcccgt

SEQ ID NO: 145376 - DNA, 20 bp, human
gcgcagcgccaggcccgctg

SEQ ID NO: 145377 - DNA, 20 bp, human
gcggcagcgggacagatggt

SEQ ID NO: 145378 - DNA, 20 bp, human
gggtgtcccgtggaaatcga

SEQ ID NO: 145379 - DNA, 20 bp, human
gcgctgccgtcccaccaggt

SEQ ID NO: 145380 - DNA, 20 bp, human
gcccgtggaaatcgacggag

SEQ ID NO: 145381 - DNA, 20 bp, human
gaacatggctcccacctggt

SEQ ID NO: 145382 - DNA, 20 bp, human
ggccgtgacagtcacagaga

SEQ ID NO: 145383 - DNA, 20 bp, human
gagacggctgggggggctac

SEQ ID NO: 145384 - DNA, 20 bp, human
gcgatttccccggagccggg

SEQ ID NO: 145385 - DNA, 20 bp, human
ggagcgcatgccggccccag

SEQ ID NO: 145386 - DNA, 20 bp, human
ggggagccagcgagctgtgg

SEQ ID NO: 145387 - DNA, 20 bp, human
ggagctgtggaggagcgccg

SEQ ID NO: 145388 - DNA, 20 bp, human
gcgggagtcgggagaggacg

SEQ ID NO: 145389 - DNA, 20 bp, human
ggcggcatgacgcctttccg

SEQ ID NO: 145390 - DNA, 20 bp, human
gacgacgcgcgcgcacgtcg

SEQ ID NO: 145391 - DNA, 20 bp, human
gctgtggaggagcgccgggg

SEQ ID NO: 145392 - DNA, 20 bp, human
ggacaggattctgggttctt

SEQ ID NO: 145393 - DNA, 20 bp, human
gtgctcgctcacctgacgag

SEQ ID NO: 145394 - DNA, 20 bp, human
ggcctccgagcctcacaaga

SEQ ID NO: 145395 - DNA, 20 bp, human
gtgacaggtgtcgggcgggt

SEQ ID NO: 145396 - DNA, 20 bp, human
gagggccgcggacaccgccg

SEQ ID NO: 145397 - DNA, 20 bp, human
gcgaccgctgtgccagatgg

SEQ ID NO: 145398 - DNA, 20 bp, human
gcaacgccgagggctcggca

SEQ ID NO: 145399 - DNA, 20 bp, human
ggattctgaggcaacgccga

SEQ ID NO: 145400 - DNA, 20 bp, human
gcaagccgcggcggtgtccg

SEQ ID NO: 145401 - DNA, 20 bp, human
gacaataacaaaccaagccg

SEQ ID NO: 145402 - DNA, 20 bp, human
gaccgctgccgaggactagg

SEQ ID NO: 145403 - DNA, 20 bp, human
gcggcgggccctggcacggt

SEQ ID NO: 145404 - DNA, 20 bp, human
gtccgccgccgcctagtcct

SEQ ID NO: 145405 - DNA, 20 bp, human
gtgaggcaacgccgagggct

SEQ ID NO: 145406 - DNA, 20 bp, human
gtcatgtctactaattaact

SEQ ID NO: 145407 - DNA, 20 bp, human
ggccctaaaagaatttaaat

SEQ ID NO: 145408 - DNA, 20 bp, human
gattgaactgcagagtaaat

SEQ ID NO: 145409 - DNA, 20 bp, human
gcaaaaattggtcagcagcc

SEQ ID NO: 145410 - DNA, 20 bp, human
gtgagaatcaaatagcaaaa

SEQ ID NO: 145411 - DNA, 20 bp, human
gataatgaaaattatcaggt

SEQ ID NO: 145412 - DNA, 20 bp, human
ggataataatgaaaattatc

SEQ ID NO: 145413 - DNA, 20 bp, human
gctgttctctgtcttgctcc

SEQ ID NO: 145414 - DNA, 20 bp, human
ggagaaagacagacaaaaat

SEQ ID NO: 145415 - DNA, 20 bp, human
gtccaatttaaattctttta

SEQ ID NO: 145416 - DNA, 20 bp, human
ggagcagaacaaccttagtg

SEQ ID NO: 145417 - DNA, 20 bp, human
gagcgagggcagtgcagcgg

SEQ ID NO: 145418 - DNA, 20 bp, human
gacccagatccgcctccctc

SEQ ID NO: 145419 - DNA, 20 bp, human
gacctccgccacctcccgtc

SEQ ID NO: 145420 - DNA, 20 bp, human
gggctggaggttgagcgccc

SEQ ID NO: 145421 - DNA, 20 bp, human
gcagaacaaccttagtgagg

SEQ ID NO: 145422 - DNA, 20 bp, human
gctccggggctcaagctcgg

SEQ ID NO: 145423 - DNA, 20 bp, human
gccgctgtacggtgagcccg

SEQ ID NO: 145424 - DNA, 20 bp, human
gcggctccggggctcaagct

SEQ ID NO: 145425 - DNA, 20 bp, human
gccagcacctaggcgggcgc

SEQ ID NO: 145426 - DNA, 20 bp, human
gtggaggcgtccgagctcca

SEQ ID NO: 145427 - DNA, 20 bp, human
gtagcccacggaccagtcac

SEQ ID NO: 145428 - DNA, 20 bp, human
ggctctggggcagaactgtc

SEQ ID NO: 145429 - DNA, 20 bp, human
gaggacaagggaccagacag

SEQ ID NO: 145430 - DNA, 20 bp, human
ggcgtggctcaggctcgtgg

SEQ ID NO: 145431 - DNA, 20 bp, human
gccggatctaacaatccctg

SEQ ID NO: 145432 - DNA, 20 bp, human
gagggctgctcgggagacat

SEQ ID NO: 145433 - DNA, 20 bp, human
gtggtccgtgggctaactca

SEQ ID NO: 145434 - DNA, 20 bp, human
gggctgtcgggggacaaggt

SEQ ID NO: 145435 - DNA, 20 bp, human
gtccctggggagccggagac

SEQ ID NO: 145436 - DNA, 20 bp, human
gtcacctgtatacctaccac

SEQ ID NO: 145437 - DNA, 20 bp, human
ggtaccagtggtaggtatac

SEQ ID NO: 145438 - DNA, 20 bp, human
gttttagtagtaccagtggt

SEQ ID NO: 145439 - DNA, 20 bp, human
gaactttttagtagtaccag

SEQ ID NO: 145440 - DNA, 20 bp, human
gtgtaggattacagatatgg

SEQ ID NO: 145441 - DNA, 20 bp, human
gctttgtaggattacagata

SEQ ID NO: 145442 - DNA, 20 bp, human
ggccagccaagatgagacaa

SEQ ID NO: 145443 - DNA, 20 bp, human
gtggccagcagactgctact

SEQ ID NO: 145444 - DNA, 20 bp, human
gattcaaagtggctcagact

SEQ ID NO: 145445 - DNA, 20 bp, human
gacttgcctttgtctcatct

SEQ ID NO: 145446 - DNA, 20 bp, human
gccgccatggccgacaagga

SEQ ID NO: 145447 - DNA, 20 bp, human
ggtgcagtccccggtactga

SEQ ID NO: 145448 - DNA, 20 bp, human
ggccgagaaaccgatatcgg

SEQ ID NO: 145449 - DNA, 20 bp, human
gggggcgcaggaaacaatag

SEQ ID NO: 145450 - DNA, 20 bp, human
ggactgcactcggcaaactc

SEQ ID NO: 145451 - DNA, 20 bp, human
gagctccgagccttgtgggt

SEQ ID NO: 145452 - DNA, 20 bp, human
gcgacatggcctaacagtga

SEQ ID NO: 145453 - DNA, 20 bp, human
ggaggccgagaaaccgatat

SEQ ID NO: 145454 - DNA, 20 bp, human
ggagctcgggcctcctcgtc

SEQ ID NO: 145455 - DNA, 20 bp, human
ggtccccacgctcgggacag

SEQ ID NO: 145456 - DNA, 20 bp, human
gcgttgggtactggaaagga

SEQ ID NO: 145457 - DNA, 20 bp, human
ggagtcaggctgcaatctta

SEQ ID NO: 145458 - DNA, 20 bp, human
ggtggacgccgcgaagagac

SEQ ID NO: 145459 - DNA, 20 bp, human
ggcaacttgcgtctaagtgg

SEQ ID NO: 145460 - DNA, 20 bp, human
ggcttgcgccagtctcttcg

SEQ ID NO: 145461 - DNA, 20 bp, human
gggcaacaacaccttctccc

SEQ ID NO: 145462 - DNA, 20 bp, human
gggccgcccggtctcagctc

SEQ ID NO: 145463 - DNA, 20 bp, human
gcagccaggaccagagttgt

SEQ ID NO: 145464 - DNA, 20 bp, human
gaagttgctgaagccggccg

SEQ ID NO: 145465 - DNA, 20 bp, human
gacctactcgggcagaaggt

SEQ ID NO: 145466 - DNA, 20 bp, human
gttggcggtgcagtcagtag

SEQ ID NO: 145467 - DNA, 20 bp, human
ggaaatcgagaatccgccaa

SEQ ID NO: 145468 - DNA, 20 bp, human
gtccaagccaggtactatgg

SEQ ID NO: 145469 - DNA, 20 bp, human
gctcggtgagagcccccgag

SEQ ID NO: 145470 - DNA, 20 bp, human
gacctccaagccaggtacta

SEQ ID NO: 145471 - DNA, 20 bp, human
gtcggacgagcgccccactg

SEQ ID NO: 145472 - DNA, 20 bp, human
gccgcgtccgccatagtacc

SEQ ID NO: 145473 - DNA, 20 bp, human
ggggggctctcaccgagcgg

SEQ ID NO: 145474 - DNA, 20 bp, human
ggaaaacgcgcggtcggcgg

SEQ ID NO: 145475 - DNA, 20 bp, human
ggcggcgacacctccaagcc

SEQ ID NO: 145476 - DNA, 20 bp, human
gtcgcgggtaccgaggtctg

SEQ ID NO: 145477 - DNA, 20 bp, human
gagtgtgacgcgcttgggaa

SEQ ID NO: 145478 - DNA, 20 bp, human
ggaattggcgtgcggagcag

SEQ ID NO: 145479 - DNA, 20 bp, human
gtaacgagaggagtccgagg

SEQ ID NO: 145480 - DNA, 20 bp, human
gccctgggaaaagtgagagg

SEQ ID NO: 145481 - DNA, 20 bp, human
ggcacccaggcagcaagacg

SEQ ID NO: 145482 - DNA, 20 bp, human
gggcaggagcgccagcggtc

SEQ ID NO: 145483 - DNA, 20 bp, human
gagaagagcgcctcagacct

SEQ ID NO: 145484 - DNA, 20 bp, human
gactgggcgcgcgcctcgag

SEQ ID NO: 145485 - DNA, 20 bp, human
gggctaacgagaggagtccg

SEQ ID NO: 145486 - DNA, 20 bp, human
gaatcccgaggcaatctcgg

SEQ ID NO: 145487 - DNA, 20 bp, human
ggcatgcgggtaggtggaaa

SEQ ID NO: 145488 - DNA, 20 bp, human
gaagtgccgggcatgcgggt

SEQ ID NO: 145489 - DNA, 20 bp, human
gccagacccgcacgcggaac

SEQ ID NO: 145490 - DNA, 20 bp, human
gtgccgggcatgcgggtagg

SEQ ID NO: 145491 - DNA, 20 bp, human
gagagtgccaaatcctcggt

SEQ ID NO: 145492 - DNA, 20 bp, human
gcccgaggcaatctcggagg

SEQ ID NO: 145493 - DNA, 20 bp, human
gccgacccagagctccgggt

SEQ ID NO: 145494 - DNA, 20 bp, human
gtaaagcgcgggctgtccgg

SEQ ID NO: 145495 - DNA, 20 bp, human
ggtgagcacctgcagtgtag

SEQ ID NO: 145496 - DNA, 20 bp, human
gtccgcgcagaggtcgacag

SEQ ID NO: 145497 - DNA, 20 bp, human
gctccctgtgaagagcgtgg

SEQ ID NO: 145498 - DNA, 20 bp, human
gtggcctcgccctccaccct

SEQ ID NO: 145499 - DNA, 20 bp, human
gtggtccagggacctagcaa

SEQ ID NO: 145500 - DNA, 20 bp, human
gggacgtcttccctaagggg

SEQ ID NO: 145501 - DNA, 20 bp, human
gagtcccccacgctcttcac

SEQ ID NO: 145502 - DNA, 20 bp, human
gactggacgtcttccctaag

SEQ ID NO: 145503 - DNA, 20 bp, human
gggcgcagccacaggggtga

SEQ ID NO: 145504 - DNA, 20 bp, human
gggttcacaagaggataagc

SEQ ID NO: 145505 - DNA, 20 bp, human
gggggtcccgggtactcaca

SEQ ID NO: 145506 - DNA, 20 bp, human
gtgattgttcccgggaacgg

SEQ ID NO: 145507 - DNA, 20 bp, human
ggacccgcgctggggaactc

SEQ ID NO: 145508 - DNA, 20 bp, human
gctcatggcttctcctagca

SEQ ID NO: 145509 - DNA, 20 bp, human
gtctggcctcgctgcactca

SEQ ID NO: 145510 - DNA, 20 bp, human
gttccccagcgcgggtccag

SEQ ID NO: 145511 - DNA, 20 bp, human
gcagcctcggtagttcaaag

SEQ ID NO: 145512 - DNA, 20 bp, human
gctccgctggacccgcgctg

SEQ ID NO: 145513 - DNA, 20 bp, human
ggcggggatgtgaccaccca

SEQ ID NO: 145514 - DNA, 20 bp, human
gacccagccataccagccgt

SEQ ID NO: 145515 - DNA, 20 bp, human
gcagtgattgttcccgggaa

SEQ ID NO: 145516 - DNA, 20 bp, human
gcgagaagaccaagaaaggt

SEQ ID NO: 145517 - DNA, 20 bp, human
ggaggcacggtcccccccag

SEQ ID NO: 145518 - DNA, 20 bp, human
gcctctcccaggcgacccgg

SEQ ID NO: 145519 - DNA, 20 bp, human
gaggccccagttcttcgcaa

SEQ ID NO: 145520 - DNA, 20 bp, human
gtggctgtgcccatccccct

SEQ ID NO: 145521 - DNA, 20 bp, human
gcctgcgtggggcggtgaga

SEQ ID NO: 145522 - DNA, 20 bp, human
gcagttcttcgcaaggggag

SEQ ID NO: 145523 - DNA, 20 bp, human
gtggacgagaagaccaagaa

SEQ ID NO: 145524 - DNA, 20 bp, human
gcctgggaaatgctacctcc

SEQ ID NO: 145525 - DNA, 20 bp, human
gccaggccgggatcctgcgt

SEQ ID NO: 145526 - DNA, 20 bp, human
gcgccgcgccatgtgggctg

SEQ ID NO: 145527 - DNA, 20 bp, human
gctgggcgcggtattcccta

SEQ ID NO: 145528 - DNA, 20 bp, human
ggcgcaagaacgcggatgag

SEQ ID NO: 145529 - DNA, 20 bp, human
gccgggacccggagcgagca

SEQ ID NO: 145530 - DNA, 20 bp, human
gccggggacaccgcccccta

SEQ ID NO: 145531 - DNA, 20 bp, human
gccgcatgggcgcaagaacg

SEQ ID NO: 145532 - DNA, 20 bp, human
ggcatcgcggctacggaaca

SEQ ID NO: 145533 - DNA, 20 bp, human
ggcggctacggaacagggcc

SEQ ID NO: 145534 - DNA, 20 bp, human
gctggcgagctaggccgcat

SEQ ID NO: 145535 - DNA, 20 bp, human
gtagcgcagcatcgcggcta

SEQ ID NO: 145536 - DNA, 20 bp, human
ggagctgccggtacaatcat

SEQ ID NO: 145537 - DNA, 20 bp, human
gcttctcactgactacgcga

SEQ ID NO: 145538 - DNA, 20 bp, human
ggatgtcgatagctagatta

SEQ ID NO: 145539 - DNA, 20 bp, human
gcactcatcaacgccgggag

SEQ ID NO: 145540 - DNA, 20 bp, human
gtacctgaatcagtccagga

SEQ ID NO: 145541 - DNA, 20 bp, human
gctgtgtctcttcgtcgtct

SEQ ID NO: 145542 - DNA, 20 bp, human
gtagctatcgacatctctca

SEQ ID NO: 145543 - DNA, 20 bp, human
gtgcttggctcctgacagaa

SEQ ID NO: 145544 - DNA, 20 bp, human
gttgaagctaccaaaatgga

SEQ ID NO: 145545 - DNA, 20 bp, human
gacattaagagttgctgatg

SEQ ID NO: 145546 - DNA, 20 bp, human
gactcccggagctcgcccac

SEQ ID NO: 145547 - DNA, 20 bp, human
gacgccggccgagggaggaa

SEQ ID NO: 145548 - DNA, 20 bp, human
gctcacagcacgccggccga

SEQ ID NO: 145549 - DNA, 20 bp, human
ggtgagccagcgcggccggt

SEQ ID NO: 145550 - DNA, 20 bp, human
gcaagcggtcaggcaaggag

SEQ ID NO: 145551 - DNA, 20 bp, human
gcgagctccgggagtgcgag

SEQ ID NO: 145552 - DNA, 20 bp, human
gcgagctgaggcggctgatg

SEQ ID NO: 145553 - DNA, 20 bp, human
gcgccgggcccgagctgagg

SEQ ID NO: 145554 - DNA, 20 bp, human
ggagctgccggtgcccggag

SEQ ID NO: 145555 - DNA, 20 bp, human
gtcccgcttcatgccccggg

SEQ ID NO: 145556 - DNA, 20 bp, human
gatctgcctgagatatggga

SEQ ID NO: 145557 - DNA, 20 bp, human
gaattaccttaggcattcag

SEQ ID NO: 145558 - DNA, 20 bp, human
gccttaggcattcaggggtg

SEQ ID NO: 145559 - DNA, 20 bp, human
gatctcaggcagatggctga

SEQ ID NO: 145560 - DNA, 20 bp, human
gccagcacggctgctttgaa

SEQ ID NO: 145561 - DNA, 20 bp, human
gtctgctatggagttgaggg

SEQ ID NO: 145562 - DNA, 20 bp, human
ggtggaggtgtgccccagca

SEQ ID NO: 145563 - DNA, 20 bp, human
gctctctgggatctaaataa

SEQ ID NO: 145564 - DNA, 20 bp, human
gcagctgataacaataaatc

SEQ ID NO: 145565 - DNA, 20 bp, human
gggagaaaagaaacatgccg

SEQ ID NO: 145566 - DNA, 20 bp, human
gcgccttacctggtagtggg

SEQ ID NO: 145567 - DNA, 20 bp, human
gtgagcggggaggccccagt

SEQ ID NO: 145568 - DNA, 20 bp, human
ggccctgactttggactcta

SEQ ID NO: 145569 - DNA, 20 bp, human
gcacctcccactaccaggta

SEQ ID NO: 145570 - DNA, 20 bp, human
gtgggcatggcggacaggtg

SEQ ID NO: 145571 - DNA, 20 bp, human
gttgccaaggacggtccaga

SEQ ID NO: 145572 - DNA, 20 bp, human
gggccgccttacctggtagt

SEQ ID NO: 145573 - DNA, 20 bp, human
gcagaacacgaaccgtgcag

SEQ ID NO: 145574 - DNA, 20 bp, human
gacacgaaccgtgcagggga

SEQ ID NO: 145575 - DNA, 20 bp, human
ggccatagagtccaaagtca

SEQ ID NO: 145576 - DNA, 20 bp, human
ggttggatcccgagtcgcac

SEQ ID NO: 145577 - DNA, 20 bp, human
ggtagtcgccggttaccgat

SEQ ID NO: 145578 - DNA, 20 bp, human
gggcgtctggggaaccccag

SEQ ID NO: 145579 - DNA, 20 bp, human
gcagaggtcaccgtccaggt

SEQ ID NO: 145580 - DNA, 20 bp, human
gagggcagaggtcaccgtcc

SEQ ID NO: 145581 - DNA, 20 bp, human
gcagcacctttgagcgatgg

SEQ ID NO: 145582 - DNA, 20 bp, human
gagacgccgccatcgctcaa

SEQ ID NO: 145583 - DNA, 20 bp, human
gggccaagaaaggtctttgg

SEQ ID NO: 145584 - DNA, 20 bp, human
ggggggcgcaagtctttgga

SEQ ID NO: 145585 - DNA, 20 bp, human
gtaacagggccctcctgata

SEQ ID NO: 145586 - DNA, 20 bp, human
gggccgcgctcccctcgtcc

SEQ ID NO: 145587 - DNA, 20 bp, human
gggagaaaagcggaggcaga

SEQ ID NO: 145588 - DNA, 20 bp, human
gcgaggcaactacagcctag

SEQ ID NO: 145589 - DNA, 20 bp, human
gatggcagtaaagtcgtcca

SEQ ID NO: 145590 - DNA, 20 bp, human
gcggcgggacagaaaaagag

SEQ ID NO: 145591 - DNA, 20 bp, human
gcctgctgccgctcacctct

SEQ ID NO: 145592 - DNA, 20 bp, human
gaggctgtagttgcctcgga

SEQ ID NO: 145593 - DNA, 20 bp, human
ggggagcgcggccgaagccc

SEQ ID NO: 145594 - DNA, 20 bp, human
gaggagctgaacctggacga

SEQ ID NO: 145595 - DNA, 20 bp, human
gacgactttactgccatccg

SEQ ID NO: 145596 - DNA, 20 bp, human
gggcggccggacctcaggtg

SEQ ID NO: 145597 - DNA, 20 bp, human
ggggcccgcagccattcaaa

SEQ ID NO: 145598 - DNA, 20 bp, human
ggcgactggtcacctcccga

SEQ ID NO: 145599 - DNA, 20 bp, human
ggagcctcggaatagcgcag

SEQ ID NO: 145600 - DNA, 20 bp, human
ggacggcatagcgcacccct

SEQ ID NO: 145601 - DNA, 20 bp, human
gctgaggtccggccgcccag

SEQ ID NO: 145602 - DNA, 20 bp, human
gcggacctcaggtgaggtga

SEQ ID NO: 145603 - DNA, 20 bp, human
gcgcgcctcgagagactctc

SEQ ID NO: 145604 - DNA, 20 bp, human
ggacgcggctcggaaggcac

SEQ ID NO: 145605 - DNA, 20 bp, human
gcccgcccgagagtctctcg

SEQ ID NO: 145606 - DNA, 20 bp, human
ggtctgcagaagatagtgta

SEQ ID NO: 145607 - DNA, 20 bp, human
gtgtgtggcatttaaacctg

SEQ ID NO: 145608 - DNA, 20 bp, human
gtctttgccagactacagaa

SEQ ID NO: 145609 - DNA, 20 bp, human
ggagtcgggcaaataggtcc

SEQ ID NO: 145610 - DNA, 20 bp, human
gaggatgcaaagcctaacca

SEQ ID NO: 145611 - DNA, 20 bp, human
gtgcagaagatagtgtatgg

SEQ ID NO: 145612 - DNA, 20 bp, human
gggcacataaagcacccata

SEQ ID NO: 145613 - DNA, 20 bp, human
gtgagaaatcaaatggcctc

SEQ ID NO: 145614 - DNA, 20 bp, human
gtagaaagagtcgggcaaat

SEQ ID NO: 145615 - DNA, 20 bp, human
gccgctggaaaagttcagta

SEQ ID NO: 145616 - DNA, 20 bp, human
ggagcgttcgcaaggggtgt

SEQ ID NO: 145617 - DNA, 20 bp, human
gagctattagccaattcggc

SEQ ID NO: 145618 - DNA, 20 bp, human
gcaagcgcgctgccctccca

SEQ ID NO: 145619 - DNA, 20 bp, human
gggcggcagtgagtttccct

SEQ ID NO: 145620 - DNA, 20 bp, human
gcacagtcaccagctcaaaa

SEQ ID NO: 145621 - DNA, 20 bp, human
gagactggaggcagatcggg

SEQ ID NO: 145622 - DNA, 20 bp, human
ggcgacgacgagaagggagt

SEQ ID NO: 145623 - DNA, 20 bp, human
gggagatgcgcggaacggag

SEQ ID NO: 145624 - DNA, 20 bp, human
gcgcgactgggacatgggat

SEQ ID NO: 145625 - DNA, 20 bp, human
gaaaatggcgacgacgagaa

SEQ ID NO: 145626 - DNA, 20 bp, human
gattctacggccgagaccgg

SEQ ID NO: 145627 - DNA, 20 bp, human
gtgctcaggaggaggccgac

SEQ ID NO: 145628 - DNA, 20 bp, human
gctcggccgtagaatgaagt

SEQ ID NO: 145629 - DNA, 20 bp, human
gttcattctacggccgagac

SEQ ID NO: 145630 - DNA, 20 bp, human
gctgattaagggcttcccag

SEQ ID NO: 145631 - DNA, 20 bp, human
gatgttccctgctcaggagg

SEQ ID NO: 145632 - DNA, 20 bp, human
gagggaacatcctccggtct

SEQ ID NO: 145633 - DNA, 20 bp, human
gccaacaaacacggtcctgt

SEQ ID NO: 145634 - DNA, 20 bp, human
gagcccttaatcagaaacgg

SEQ ID NO: 145635 - DNA, 20 bp, human
gtccgtcccatcctgagcag

SEQ ID NO: 145636 - DNA, 20 bp, human
gaggaggtggtggctgcgtt

SEQ ID NO: 145637 - DNA, 20 bp, human
gcctgcctcgaccctttgtg

SEQ ID NO: 145638 - DNA, 20 bp, human
gtgtgaagcggcgaaggagg

SEQ ID NO: 145639 - DNA, 20 bp, human
gtcccccgtggtctgagagg

SEQ ID NO: 145640 - DNA, 20 bp, human
gtggccgtcggcccgctcag

SEQ ID NO: 145641 - DNA, 20 bp, human
gcccgccccgggccaccaag

SEQ ID NO: 145642 - DNA, 20 bp, human
gcatagcgaggactcccccg

SEQ ID NO: 145643 - DNA, 20 bp, human
gcccagcccgaacggcttcc

SEQ ID NO: 145644 - DNA, 20 bp, human
ggagcctgcgtaccgaagtg

SEQ ID NO: 145645 - DNA, 20 bp, human
gtcctccgtactcgggatgt

SEQ ID NO: 145646 - DNA, 20 bp, human
gagctcgttaggcttgagaa

SEQ ID NO: 145647 - DNA, 20 bp, human
ggcagcagcctccccaaaac

SEQ ID NO: 145648 - DNA, 20 bp, human
ggtgggcgccatcttcttct

SEQ ID NO: 145649 - DNA, 20 bp, human
gccgtttgtccggaccggag

SEQ ID NO: 145650 - DNA, 20 bp, human
gatgtcatcgtagtcagtgg

SEQ ID NO: 145651 - DNA, 20 bp, human
gcagtgagcccagaagaaga

SEQ ID NO: 145652 - DNA, 20 bp, human
gcaggagctacgctagatac

SEQ ID NO: 145653 - DNA, 20 bp, human
gtccggaccggaggggcagt

SEQ ID NO: 145654 - DNA, 20 bp, human
gctgccgagtcggacacaca

SEQ ID NO: 145655 - DNA, 20 bp, human
ggctgcaggcccagctcgtt

SEQ ID NO: 145656 - DNA, 20 bp, human
gggcaagacgtccgaacgac

SEQ ID NO: 145657 - DNA, 20 bp, human
gagtcctcctcaggaatggc

SEQ ID NO: 145658 - DNA, 20 bp, human
gcggtcgccagccattcctg

SEQ ID NO: 145659 - DNA, 20 bp, human
ggcgtccgcggcgctcgaag

SEQ ID NO: 145660 - DNA, 20 bp, human
ggtggtgaaaggtaacgcgg

SEQ ID NO: 145661 - DNA, 20 bp, human
gagccacgccccttacccgg

SEQ ID NO: 145662 - DNA, 20 bp, human
gacgaccggcagtcctcctc

SEQ ID NO: 145663 - DNA, 20 bp, human
ggacgtggtgaaaggtaacg

SEQ ID NO: 145664 - DNA, 20 bp, human
ggcggaaattgggaagtgac

SEQ ID NO: 145665 - DNA, 20 bp, human
gtcgccagccattcctgagg

SEQ ID NO: 145666 - DNA, 20 bp, human
gcggtcgccagccattcctg

SEQ ID NO: 145667 - DNA, 20 bp, human
gggcaagacgtccgaacgac

SEQ ID NO: 145668 - DNA, 20 bp, human
gacgaccggcagtcctcctc

SEQ ID NO: 145669 - DNA, 20 bp, human
gtcgccagccattcctgagg

SEQ ID NO: 145670 - DNA, 20 bp, human
ggtggtgaaaggtaacgcgg

SEQ ID NO: 145671 - DNA, 20 bp, human
gagccacgccccttacccgg

SEQ ID NO: 145672 - DNA, 20 bp, human
ggacgtggtgaaaggtaacg

SEQ ID NO: 145673 - DNA, 20 bp, human
gagtcctcctcaggaatggc

SEQ ID NO: 145674 - DNA, 20 bp, human
ggcgtccgcggcgctcgaag

SEQ ID NO: 145675 - DNA, 20 bp, human
gaggtccgggctctccagga

SEQ ID NO: 145676 - DNA, 20 bp, human
gtaggacggtgccccgagag

SEQ ID NO: 145677 - DNA, 20 bp, human
gaagcgtccgcgccgcgagg

SEQ ID NO: 145678 - DNA, 20 bp, human
ggtggtgaacgcctctctcg

SEQ ID NO: 145679 - DNA, 20 bp, human
gtgttcggcaggagctagga

SEQ ID NO: 145680 - DNA, 20 bp, human
ggtcgggcgcgggacagggt

SEQ ID NO: 145681 - DNA, 20 bp, human
gggacacccccgaagcccaa

SEQ ID NO: 145682 - DNA, 20 bp, human
gcaatgccgaggaccgaggt

SEQ ID NO: 145683 - DNA, 20 bp, human
gcgggccgtgagacatcgtc

SEQ ID NO: 145684 - DNA, 20 bp, human
gggccgcgcatttcagtgtt

SEQ ID NO: 145685 - DNA, 20 bp, human
gcacagtacaagaaaggcag

SEQ ID NO: 145686 - DNA, 20 bp, human
gccgccgccgggagctgagg

SEQ ID NO: 145687 - DNA, 20 bp, human
gccgcgctcgtttcacacag

SEQ ID NO: 145688 - DNA, 20 bp, human
ggtgtgaaacgagcgcgggg

SEQ ID NO: 145689 - DNA, 20 bp, human
ggccatcttggactccgccg

SEQ ID NO: 145690 - DNA, 20 bp, human
ggcagcggaaagaccgatag

SEQ ID NO: 145691 - DNA, 20 bp, human
gtcgtcggaggtcgtctccg

SEQ ID NO: 145692 - DNA, 20 bp, human
gggcgggttactcagctccg

SEQ ID NO: 145693 - DNA, 20 bp, human
ggcagccgcgagtatgatac

SEQ ID NO: 145694 - DNA, 20 bp, human
gagtccaagatggcggcgtg

SEQ ID NO: 145695 - DNA, 20 bp, human
gacaagtccagcagtcgagg

SEQ ID NO: 145696 - DNA, 20 bp, human
ggcccgtaggtttctcacag

SEQ ID NO: 145697 - DNA, 20 bp, human
gcggcgcacaaggcctctgg

SEQ ID NO: 145698 - DNA, 20 bp, human
gcgtaggtttctcacagcgg

SEQ ID NO: 145699 - DNA, 20 bp, human
gaggtttctcacagcggcgg

SEQ ID NO: 145700 - DNA, 20 bp, human
gccgcgccagcgccatgaag

SEQ ID NO: 145701 - DNA, 20 bp, human
ggcaaggcctcgggggaccc

SEQ ID NO: 145702 - DNA, 20 bp, human
gcggatgagccgggacacgc

SEQ ID NO: 145703 - DNA, 20 bp, human
ggacgcgcggggcgacatgc

SEQ ID NO: 145704 - DNA, 20 bp, human
ggcggcagaggagacgcgcg

SEQ ID NO: 145705 - DNA, 20 bp, human
gcgacatgccggaggcgccc

SEQ ID NO: 145706 - DNA, 20 bp, human
gctgggacctaacacgtcac

SEQ ID NO: 145707 - DNA, 20 bp, human
gggacctaacacgtcactgg

SEQ ID NO: 145708 - DNA, 20 bp, human
gccagggcttgggcaaacca

SEQ ID NO: 145709 - DNA, 20 bp, human
gggtccgaatgctcccaaag

SEQ ID NO: 145710 - DNA, 20 bp, human
gggaccattgatcacgtcaa

SEQ ID NO: 145711 - DNA, 20 bp, human
gcccaaagcggtcaaactct

SEQ ID NO: 145712 - DNA, 20 bp, human
gcccccaacgctcaccactc

SEQ ID NO: 145713 - DNA, 20 bp, human
gaagctctcgtactgaatat

SEQ ID NO: 145714 - DNA, 20 bp, human
ggctcacagatggatacacc

SEQ ID NO: 145715 - DNA, 20 bp, human
gaccgccgaaacagccttga

SEQ ID NO: 145716 - DNA, 20 bp, human
ggccctgaggactcagcgaa

SEQ ID NO: 145717 - DNA, 20 bp, human
ggctcggcggcgcggggtca

SEQ ID NO: 145718 - DNA, 20 bp, human
gtgaggactcagcgaagggt

SEQ ID NO: 145719 - DNA, 20 bp, human
gcgaggcagacatgaggagg

SEQ ID NO: 145720 - DNA, 20 bp, human
gctccgcggaaacccgccag

SEQ ID NO: 145721 - DNA, 20 bp, human
ggggccagggtcaccagagg

SEQ ID NO: 145722 - DNA, 20 bp, human
gcgccagcggcaggaggcct

SEQ ID NO: 145723 - DNA, 20 bp, human
gcaggatgcggtgcacgaga

SEQ ID NO: 145724 - DNA, 20 bp, human
gttcagcaccaaacagcccg

SEQ ID NO: 145725 - DNA, 20 bp, human
gcgcgccgccgagcgccctg

SEQ ID NO: 145726 - DNA, 20 bp, human
gctagaggtccgtctgaccg

SEQ ID NO: 145727 - DNA, 20 bp, human
gccagcgacaggacaatccg

SEQ ID NO: 145728 - DNA, 20 bp, human
gaaaccaggtcccgacgccg

SEQ ID NO: 145729 - DNA, 20 bp, human
gctggcagctggcggcattg

SEQ ID NO: 145730 - DNA, 20 bp, human
gtcccgacgccgcggtcaga

SEQ ID NO: 145731 - DNA, 20 bp, human
gttgaggcggacgcgtctag

SEQ ID NO: 145732 - DNA, 20 bp, human
ggccagaaatcgggaagcca

SEQ ID NO: 145733 - DNA, 20 bp, human
gcagctcatgcccggaaacc

SEQ ID NO: 145734 - DNA, 20 bp, human
ggtccgtctgaccgcggcgt

SEQ ID NO: 145735 - DNA, 20 bp, human
ggcgtcgggacctggtttcc

SEQ ID NO: 145736 - DNA, 20 bp, human
ggcggtagcgtgaaacttgg

SEQ ID NO: 145737 - DNA, 20 bp, human
gtccggctcggtaaagatgg

SEQ ID NO: 145738 - DNA, 20 bp, human
gagggcggtagcgtgaaact

SEQ ID NO: 145739 - DNA, 20 bp, human
gagacgctgaccagtcgtgt

SEQ ID NO: 145740 - DNA, 20 bp, human
gagggtattcgccacaaggt

SEQ ID NO: 145741 - DNA, 20 bp, human
gagccgggagctgtgaggta

SEQ ID NO: 145742 - DNA, 20 bp, human
gtgttccggctcggtaaaga

SEQ ID NO: 145743 - DNA, 20 bp, human
ggagccggaacacagtcacg

SEQ ID NO: 145744 - DNA, 20 bp, human
gccccgagaagaggtgtgtt

SEQ ID NO: 145745 - DNA, 20 bp, human
ggagcagggtattcgccaca

SEQ ID NO: 145746 - DNA, 20 bp, human
gtcgcggcgagagagctcaa

SEQ ID NO: 145747 - DNA, 20 bp, human
gcactgcaggcaactctgtc

SEQ ID NO: 145748 - DNA, 20 bp, human
ggcgccaccgggaaggacaa

SEQ ID NO: 145749 - DNA, 20 bp, human
ggacgcggaccccagcggtc

SEQ ID NO: 145750 - DNA, 20 bp, human
ggcgagagagctcaagggag

SEQ ID NO: 145751 - DNA, 20 bp, human
gcggctgctccggaccgctg

SEQ ID NO: 145752 - DNA, 20 bp, human
gagagagctcaagggagggg

SEQ ID NO: 145753 - DNA, 20 bp, human
ggggcgagcgaagttcagca

SEQ ID NO: 145754 - DNA, 20 bp, human
ggctctctcgccgcgatccc

SEQ ID NO: 145755 - DNA, 20 bp, human
gggacaccgactctgcccag

SEQ ID NO: 145756 - DNA, 20 bp, human
gtagctgtagcttccgaatt

SEQ ID NO: 145757 - DNA, 20 bp, human
gagcttccgaattgggagag

SEQ ID NO: 145758 - DNA, 20 bp, human
gcggaagctacagctacctc

SEQ ID NO: 145759 - DNA, 20 bp, human
gccatcttgagagcgtccgg

SEQ ID NO: 145760 - DNA, 20 bp, human
gcacgacccgatcgcgggag

SEQ ID NO: 145761 - DNA, 20 bp, human
gagctctaataggctggagg

SEQ ID NO: 145762 - DNA, 20 bp, human
gcgcggccgaaggaataccg

SEQ ID NO: 145763 - DNA, 20 bp, human
ggtccatcacgacccgatcg

SEQ ID NO: 145764 - DNA, 20 bp, human
gctgcgggcttgaagggagg

SEQ ID NO: 145765 - DNA, 20 bp, human
gcgctgtctgcacttccggc

SEQ ID NO: 145766 - DNA, 20 bp, human
gtcctcttcccgcaaaatgg

SEQ ID NO: 145767 - DNA, 20 bp, human
gcggatagttcctagagtct

SEQ ID NO: 145768 - DNA, 20 bp, human
gtgggcgaccctaagtgtca

SEQ ID NO: 145769 - DNA, 20 bp, human
ggcctcccccctgacgtcac

SEQ ID NO: 145770 - DNA, 20 bp, human
ggatgctccctctccagtgt

SEQ ID NO: 145771 - DNA, 20 bp, human
gcacttagggtcgcccacac

SEQ ID NO: 145772 - DNA, 20 bp, human
gtctgcccgtgacgtcaggg

SEQ ID NO: 145773 - DNA, 20 bp, human
ggcaagaaaagcagcactgc

SEQ ID NO: 145774 - DNA, 20 bp, human
gcgcatgcgcagattgggga

SEQ ID NO: 145775 - DNA, 20 bp, human
gtgacgtcacgggcagaaaa

SEQ ID NO: 145776 - DNA, 20 bp, human
gaatttgtacggtgaccggc

SEQ ID NO: 145777 - DNA, 20 bp, human
gcggcttccgaagtcgccag

SEQ ID NO: 145778 - DNA, 20 bp, human
gactcgtcttccagatccca

SEQ ID NO: 145779 - DNA, 20 bp, human
gggtctgtccctcccgccgt

SEQ ID NO: 145780 - DNA, 20 bp, human
ggaggaactccgcgcagctt

SEQ ID NO: 145781 - DNA, 20 bp, human
gcggcggccgcgaaagggtg

SEQ ID NO: 145782 - DNA, 20 bp, human
ggagcgaagtcaagtctcca

SEQ ID NO: 145783 - DNA, 20 bp, human
ggctcgcccttggcccccgg

SEQ ID NO: 145784 - DNA, 20 bp, human
gctccgcgcagcttcggctc

SEQ ID NO: 145785 - DNA, 20 bp, human
ggtcttccagatcccacggc

SEQ ID NO: 145786 - DNA, 20 bp, human
gcccaagcgcctactcgcac

SEQ ID NO: 145787 - DNA, 20 bp, human
gctggtggaggccagaccta

SEQ ID NO: 145788 - DNA, 20 bp, human
gctgcgaaagcgccagggtg

SEQ ID NO: 145789 - DNA, 20 bp, human
ggcagagacgattcactccg

SEQ ID NO: 145790 - DNA, 20 bp, human
gagtctccctggcgagcgac

SEQ ID NO: 145791 - DNA, 20 bp, human
ggcccagccgtagctggtgg

SEQ ID NO: 145792 - DNA, 20 bp, human
ggaccgggtgcctcagctgg

SEQ ID NO: 145793 - DNA, 20 bp, human
gttctgcccgtcgctcgcca

SEQ ID NO: 145794 - DNA, 20 bp, human
gtccgcggcggaacgtggaa

SEQ ID NO: 145795 - DNA, 20 bp, human
gatttgcggcctgtgcgagt

SEQ ID NO: 145796 - DNA, 20 bp, human
gaggccgaagcggtgaacgg

SEQ ID NO: 145797 - DNA, 20 bp, human
gcctccaccgcaggcacttg

SEQ ID NO: 145798 - DNA, 20 bp, human
gaccatccacagcggcccta

SEQ ID NO: 145799 - DNA, 20 bp, human
ggctgtagcggccgcgacct

SEQ ID NO: 145800 - DNA, 20 bp, human
gctcaatgggaacgattcag

SEQ ID NO: 145801 - DNA, 20 bp, human
gtaaagaaagcgaaggcgaa

SEQ ID NO: 145802 - DNA, 20 bp, human
ggtagcggccgcgacctggg

SEQ ID NO: 145803 - DNA, 20 bp, human
gaggcgaagggcagctcaat

SEQ ID NO: 145804 - DNA, 20 bp, human
gggcgggcggaggagtgtga

SEQ ID NO: 145805 - DNA, 20 bp, human
ggcccgggctgaaacagcaa

SEQ ID NO: 145806 - DNA, 20 bp, human
ggctgtgaagggaacgtgag

SEQ ID NO: 145807 - DNA, 20 bp, human
gcaggcctgaagaagagcgg

SEQ ID NO: 145808 - DNA, 20 bp, human
ggggcaggcaaggacagcga

SEQ ID NO: 145809 - DNA, 20 bp, human
gcagcccggctcactcacat

SEQ ID NO: 145810 - DNA, 20 bp, human
ggtgaatatggggactgggg

SEQ ID NO: 145811 - DNA, 20 bp, human
gccagcccaccgggcatctt

SEQ ID NO: 145812 - DNA, 20 bp, human
ggtctcctaagatgcccggt

SEQ ID NO: 145813 - DNA, 20 bp, human
gcctgttaggccccggccgg

SEQ ID NO: 145814 - DNA, 20 bp, human
ggcggcgtagtggagaccca

SEQ ID NO: 145815 - DNA, 20 bp, human
gggagaggcgccgtgaatat

SEQ ID NO: 145816 - DNA, 20 bp, human
gtcaggccggccatgagacc

SEQ ID NO: 145817 - DNA, 20 bp, human
ggtgaggacgcgagcaaact

SEQ ID NO: 145818 - DNA, 20 bp, human
gggacgcgagcaaactaggc

SEQ ID NO: 145819 - DNA, 20 bp, human
gggcggggcggtcgaggata

SEQ ID NO: 145820 - DNA, 20 bp, human
gcgcacgcgagccgaaacgc

SEQ ID NO: 145821 - DNA, 20 bp, human
ggggaggcggcccacaaata

SEQ ID NO: 145822 - DNA, 20 bp, human
gtggtgactgaaaaaggtag

SEQ ID NO: 145823 - DNA, 20 bp, human
gaagcgctatagaaacgtaa

SEQ ID NO: 145824 - DNA, 20 bp, human
ggggagggtaaagaatgata

SEQ ID NO: 145825 - DNA, 20 bp, human
ggggaaacccaaagcgcgtg

SEQ ID NO: 145826 - DNA, 20 bp, human
gcaatgtggccccctaatgg

SEQ ID NO: 145827 - DNA, 20 bp, human
gcagcgcagccaccattagg

SEQ ID NO: 145828 - DNA, 20 bp, human
gatgttctgggcttgcgcag

SEQ ID NO: 145829 - DNA, 20 bp, human
ggcgcaatgtggccccctaa

SEQ ID NO: 145830 - DNA, 20 bp, human
gcgcagtggcacaaaatgac

SEQ ID NO: 145831 - DNA, 20 bp, human
gtaacgccggcagaacaaga

SEQ ID NO: 145832 - DNA, 20 bp, human
gccgagctcgctgttcgtcc

SEQ ID NO: 145833 - DNA, 20 bp, human
ggggaacgcagggatgttct

SEQ ID NO: 145834 - DNA, 20 bp, human
gtcggaggagcacaaaaaac

SEQ ID NO: 145835 - DNA, 20 bp, human
gcatatgtcctgcgaaacgg

SEQ ID NO: 145836 - DNA, 20 bp, human
gggaggcgaagggccagctg

SEQ ID NO: 145837 - DNA, 20 bp, human
ggtaagtacgatctgcacag

SEQ ID NO: 145838 - DNA, 20 bp, human
gcaggcgccggaggtacgtg

SEQ ID NO: 145839 - DNA, 20 bp, human
gcaatagcgagggaaggcga

SEQ ID NO: 145840 - DNA, 20 bp, human
ggaatgacaatagcgaggga

SEQ ID NO: 145841 - DNA, 20 bp, human
gtacgatctgcacagcggag

SEQ ID NO: 145842 - DNA, 20 bp, human
ggcccgccaacgccagagat

SEQ ID NO: 145843 - DNA, 20 bp, human
gaggcagccttgcaaagtag

SEQ ID NO: 145844 - DNA, 20 bp, human
gcggccgccctgggagcgag

SEQ ID NO: 145845 - DNA, 20 bp, human
gggccgaacacaaagagagt

SEQ ID NO: 145846 - DNA, 20 bp, human
ggctgcagtctgggagtctt

SEQ ID NO: 145847 - DNA, 20 bp, human
ggagtccgccggaagactac

SEQ ID NO: 145848 - DNA, 20 bp, human
ggagtaagaatggccttgga

SEQ ID NO: 145849 - DNA, 20 bp, human
gtggcgcgcagctgcagtct

SEQ ID NO: 145850 - DNA, 20 bp, human
gcgcgcggcacgagtacctg

SEQ ID NO: 145851 - DNA, 20 bp, human
gaaagagaagtgtccaggag

SEQ ID NO: 145852 - DNA, 20 bp, human
gcttggaagggatgagcaaa

SEQ ID NO: 145853 - DNA, 20 bp, human
gggagtctttggagtaagaa

SEQ ID NO: 145854 - DNA, 20 bp, human
gcaagcctgtagtcttccgg

SEQ ID NO: 145855 - DNA, 20 bp, human
gcgtacacgggttgaatctg

SEQ ID NO: 145856 - DNA, 20 bp, human
gccgccaggcccgaccactc

SEQ ID NO: 145857 - DNA, 20 bp, human
gcgggccgcgataaggtgtg

SEQ ID NO: 145858 - DNA, 20 bp, human
ggggcgccgagtccactccg

SEQ ID NO: 145859 - DNA, 20 bp, human
gagcgcagcgcggcgcacgt

SEQ ID NO: 145860 - DNA, 20 bp, human
ggagtcctaattgaacacag

SEQ ID NO: 145861 - DNA, 20 bp, human
gtcggcgcgcacggcgggac

SEQ ID NO: 145862 - DNA, 20 bp, human
ggagtccccgcagcgccggt

SEQ ID NO: 145863 - DNA, 20 bp, human
ggcggggctgcgctcatggg

SEQ ID NO: 145864 - DNA, 20 bp, human
gcgggctgcagcagcatggg

SEQ ID NO: 145865 - DNA, 20 bp, human
ggggtcacaggcaccctcag

SEQ ID NO: 145866 - DNA, 20 bp, human
gagcagcggccgccatttca

SEQ ID NO: 145867 - DNA, 20 bp, human
ggtcgacaagctccctgaaa

SEQ ID NO: 145868 - DNA, 20 bp, human
ggacaagctccctgaaatgg

SEQ ID NO: 145869 - DNA, 20 bp, human
ggggcgcggtcactgaaaca

SEQ ID NO: 145870 - DNA, 20 bp, human
gatacccgactggaaaataa

SEQ ID NO: 145871 - DNA, 20 bp, human
ggagagcaggacggcggctt

SEQ ID NO: 145872 - DNA, 20 bp, human
gcttgtcgacgctgtcgcag

SEQ ID NO: 145873 - DNA, 20 bp, human
gcgactggaaaataagggcg

SEQ ID NO: 145874 - DNA, 20 bp, human
gttccgcggcctgggcctag

SEQ ID NO: 145875 - DNA, 20 bp, human
gtggaggtctttagcgaccg

SEQ ID NO: 145876 - DNA, 20 bp, human
gcggtcgccagccattcctg

SEQ ID NO: 145877 - DNA, 20 bp, human
gggcaagacgtccgaacgac

SEQ ID NO: 145878 - DNA, 20 bp, human
gacgaccggcagtcctcctc

SEQ ID NO: 145879 - DNA, 20 bp, human
gtcgccagccattcctgagg

SEQ ID NO: 145880 - DNA, 20 bp, human
ggtggtgaaaggtaacgcgg

SEQ ID NO: 145881 - DNA, 20 bp, human
gagccacgccccttacccgg

SEQ ID NO: 145882 - DNA, 20 bp, human
ggacgtggtgaaaggtaacg

SEQ ID NO: 145883 - DNA, 20 bp, human
gagtcctcctcaggaatggc

SEQ ID NO: 145884 - DNA, 20 bp, human
ggcgtccgcggcgctcgaag

SEQ ID NO: 145885 - DNA, 20 bp, human
gaggtccgggctctccagga

SEQ ID NO: 145886 - DNA, 20 bp, human
ggaggtcggctctcagtgac

SEQ ID NO: 145887 - DNA, 20 bp, human
gcggctctcagtgacgggtg

SEQ ID NO: 145888 - DNA, 20 bp, human
gtaggacggtgccccgagag

SEQ ID NO: 145889 - DNA, 20 bp, human
gaagcgtccgcgccgcgagg

SEQ ID NO: 145890 - DNA, 20 bp, human
gcacagtacaagaaaggcag

SEQ ID NO: 145891 - DNA, 20 bp, human
ggtcgggcgcgggacagggt

SEQ ID NO: 145892 - DNA, 20 bp, human
ggtggtgaacgcctctctcg

SEQ ID NO: 145893 - DNA, 20 bp, human
gtgttcggcaggagctagga

SEQ ID NO: 145894 - DNA, 20 bp, human
gggacacccccgaagcccaa

SEQ ID NO: 145895 - DNA, 20 bp, human
gggccgcgcatttcagtgtt

SEQ ID NO: 145896 - DNA, 20 bp, human
gtctcaggatgcggtttcgt

SEQ ID NO: 145897 - DNA, 20 bp, human
ggggaatgccctcccggcac

SEQ ID NO: 145898 - DNA, 20 bp, human
gacacgacaaaggagacggg

SEQ ID NO: 145899 - DNA, 20 bp, human
gcccgaggtacctacatctc

SEQ ID NO: 145900 - DNA, 20 bp, human
gttcccggcgccggagatgt

SEQ ID NO: 145901 - DNA, 20 bp, human
gctccacctgagaaaggctc

SEQ ID NO: 145902 - DNA, 20 bp, human
gctccacctccacctgagaa

SEQ ID NO: 145903 - DNA, 20 bp, human
ggacttgtctgaagagcagg

SEQ ID NO: 145904 - DNA, 20 bp, human
ggcctatttacccaagttgg

SEQ ID NO: 145905 - DNA, 20 bp, human
gtctgaagagcaggcggcaa

SEQ ID NO: 145906 - DNA, 20 bp, human
ggagcccacccggacgaagg

SEQ ID NO: 145907 - DNA, 20 bp, human
gtcatcctcgggagcccacc

SEQ ID NO: 145908 - DNA, 20 bp, human
ggagtagacagcagaaccag

SEQ ID NO: 145909 - DNA, 20 bp, human
gtaagcagagactgtagtag

SEQ ID NO: 145910 - DNA, 20 bp, human
gacagcagaaccagcggcgg

SEQ ID NO: 145911 - DNA, 20 bp, human
ggtagcggcgacagcgacga

SEQ ID NO: 145912 - DNA, 20 bp, human
gacttcctgctcaaacctgg

SEQ ID NO: 145913 - DNA, 20 bp, human
gtctcccccttcgtccgggt

SEQ ID NO: 145914 - DNA, 20 bp, human
ggaacgcttgaaggaaatgg

SEQ ID NO: 145915 - DNA, 20 bp, human
gaggcggagatggccctgta

SEQ ID NO: 145916 - DNA, 20 bp, human
ggcagaaagcccacaaccag

SEQ ID NO: 145917 - DNA, 20 bp, human
gaggggagacgcgccctcag

SEQ ID NO: 145918 - DNA, 20 bp, human
gcagtataggcccgctccag

SEQ ID NO: 145919 - DNA, 20 bp, human
ggctccagaggctcaggact

SEQ ID NO: 145920 - DNA, 20 bp, human
ggcagctcctcgacgaacgg

SEQ ID NO: 145921 - DNA, 20 bp, human
ggaagcagctcctcgacgaa

SEQ ID NO: 145922 - DNA, 20 bp, human
gcctgcgttccgctggttgt

SEQ ID NO: 145923 - DNA, 20 bp, human
gcccggagagccgtccaccc

SEQ ID NO: 145924 - DNA, 20 bp, human
gctgcacccttcccaggtgg

SEQ ID NO: 145925 - DNA, 20 bp, human
ggcgcgtctcccctccgcca

SEQ ID NO: 145926 - DNA, 20 bp, human
gggcgccactgactcggagg

SEQ ID NO: 145927 - DNA, 20 bp, human
gggtggcgccactgactcgg

SEQ ID NO: 145928 - DNA, 20 bp, human
gtccggtggcgccactgact

SEQ ID NO: 145929 - DNA, 20 bp, human
gactgactcggaggcggctg

SEQ ID NO: 145930 - DNA, 20 bp, human
gacgcggggactccgaacgg

SEQ ID NO: 145931 - DNA, 20 bp, human
gggactccgaacggcggtgt

SEQ ID NO: 145932 - DNA, 20 bp, human
gttcttgccgtggagactga

SEQ ID NO: 145933 - DNA, 20 bp, human
gagcggcggcggctttctag

SEQ ID NO: 145934 - DNA, 20 bp, human
ggcggggactctagcgagag

SEQ ID NO: 145935 - DNA, 20 bp, human
gacaggcgccgcggctgctc

SEQ ID NO: 145936 - DNA, 20 bp, human
ggcagaagcaaagagcagtg

SEQ ID NO: 145937 - DNA, 20 bp, human
ggggtgtgagacagcagcgg

SEQ ID NO: 145938 - DNA, 20 bp, human
gagcacaccaaggagtccaa

SEQ ID NO: 145939 - DNA, 20 bp, human
gcggagcaccgagccggcaa

SEQ ID NO: 145940 - DNA, 20 bp, human
gaccgagccggcaaaggctt

SEQ ID NO: 145941 - DNA, 20 bp, human
gggcccactccttcccccga

SEQ ID NO: 145942 - DNA, 20 bp, human
gcgggtcggggtgccctcgg

SEQ ID NO: 145943 - DNA, 20 bp, human
gggcgacatccaggacatct

SEQ ID NO: 145944 - DNA, 20 bp, human
ggcattcgggtggagcacca

SEQ ID NO: 145945 - DNA, 20 bp, human
gaagctggcagctctgcgag

SEQ ID NO: 145946 - DNA, 20 bp, human
gcagcgcgagcggtcccggt

SEQ ID NO: 145947 - DNA, 20 bp, human
gctgcgcgctgggaaacgag

SEQ ID NO: 145948 - DNA, 20 bp, human
gcgactggtcccctaaacgg

SEQ ID NO: 145949 - DNA, 20 bp, human
gccagtcggtcagagcgagg

SEQ ID NO: 145950 - DNA, 20 bp, human
ggccccgtcgagcagtggga

SEQ ID NO: 145951 - DNA, 20 bp, human
ggcgggggagagcggaaata

SEQ ID NO: 145952 - DNA, 20 bp, human
gcacgccgaatacacagtgg

SEQ ID NO: 145953 - DNA, 20 bp, human
gggaaacgagtggagacacg

SEQ ID NO: 145954 - DNA, 20 bp, human
gacacgaggaccagcgcgag

SEQ ID NO: 145955 - DNA, 20 bp, human
gggggggtcgtcgcaggggg

SEQ ID NO: 145956 - DNA, 20 bp, human
gggagcctcccgcatttcag

SEQ ID NO: 145957 - DNA, 20 bp, human
gacaagtcgctggacgaggt

SEQ ID NO: 145958 - DNA, 20 bp, human
gtgcccggggagagctcccg

SEQ ID NO: 145959 - DNA, 20 bp, human
gccatgctcggccccaggta

SEQ ID NO: 145960 - DNA, 20 bp, human
ggctctccccgggcacgcgg

SEQ ID NO: 145961 - DNA, 20 bp, human
gacgccccgggagctcgccc

SEQ ID NO: 145962 - DNA, 20 bp, human
ggccccaggtaaggacgccc

SEQ ID NO: 145963 - DNA, 20 bp, human
gccagcgacttgtttatggg

SEQ ID NO: 145964 - DNA, 20 bp, human
gggcgctgctcgttcagaag

SEQ ID NO: 145965 - DNA, 20 bp, human
gaaggcagcgaagttctctc

SEQ ID NO: 145966 - DNA, 20 bp, human
gtgtgtcgcataccgccctc

SEQ ID NO: 145967 - DNA, 20 bp, human
gtccctgcgaggatcaaagt

SEQ ID NO: 145968 - DNA, 20 bp, human
gccatgtgagaggctaccta

SEQ ID NO: 145969 - DNA, 20 bp, human
ggcataccgccctctggacg

SEQ ID NO: 145970 - DNA, 20 bp, human
ggataaaagggagctcagta

SEQ ID NO: 145971 - DNA, 20 bp, human
ggaccagcctacggaaataa

SEQ ID NO: 145972 - DNA, 20 bp, human
gtgagtcggtagaagtcact

SEQ ID NO: 145973 - DNA, 20 bp, human
gcggaaataaaggcacgaca

SEQ ID NO: 145974 - DNA, 20 bp, human
gaagatggcgtcgagcggcg

SEQ ID NO: 145975 - DNA, 20 bp, human
ggaataacagtccatgtgag

SEQ ID NO: 145976 - DNA, 20 bp, human
gggtcgcgtccaggctcgag

SEQ ID NO: 145977 - DNA, 20 bp, human
gaccccctcgcacctccggg

SEQ ID NO: 145978 - DNA, 20 bp, human
gtggcgcgcgagaaagggcc

SEQ ID NO: 145979 - DNA, 20 bp, human
gcgcagtgcgcctggtaaca

SEQ ID NO: 145980 - DNA, 20 bp, human
gggcgaagaagctggagggt

SEQ ID NO: 145981 - DNA, 20 bp, human
gggtctgggaagacaacggg

SEQ ID NO: 145982 - DNA, 20 bp, human
gtgagctggcgcgcgagaaa

SEQ ID NO: 145983 - DNA, 20 bp, human
gaaagggcccggtcgcgtcc

SEQ ID NO: 145984 - DNA, 20 bp, human
gggaggtctgggaagacaac

SEQ ID NO: 145985 - DNA, 20 bp, human
gctccgggtggcggcagcga

SEQ ID NO: 145986 - DNA, 20 bp, human
gagaggggctaaattacccc

SEQ ID NO: 145987 - DNA, 20 bp, human
ggctccagccggttctgtag

SEQ ID NO: 145988 - DNA, 20 bp, human
ggagaccgaagcagcagtag

SEQ ID NO: 145989 - DNA, 20 bp, human
gggtaggagacggccgtcgg

SEQ ID NO: 145990 - DNA, 20 bp, human
gaacctccaacaaggttcgg

SEQ ID NO: 145991 - DNA, 20 bp, human
gtggcggccagagactgcca

SEQ ID NO: 145992 - DNA, 20 bp, human
ggttcggcggctacacaaaa

SEQ ID NO: 145993 - DNA, 20 bp, human
ggataagcgtgaggtactgt

SEQ ID NO: 145994 - DNA, 20 bp, human
gagcgtgaggtactgtgggt

SEQ ID NO: 145995 - DNA, 20 bp, human
gaggtactgtgggtaggaga

SEQ ID NO: 145996 - DNA, 20 bp, human
gtcccgggcccttacctagg

SEQ ID NO: 145997 - DNA, 20 bp, human
gggcttcgccgcctaggtaa

SEQ ID NO: 145998 - DNA, 20 bp, human
gcagtcccgggcccttacct

SEQ ID NO: 145999 - DNA, 20 bp, human
gcgggaagaagaccaagcaa

SEQ ID NO: 146000 - DNA, 20 bp, human
gggccgagcgctgaaggcag

SEQ ID NO: 146001 - DNA, 20 bp, human
gggcgcctttgtggtagcag

SEQ ID NO: 146002 - DNA, 20 bp, human
gtctgtggcatcactaggaa

SEQ ID NO: 146003 - DNA, 20 bp, human
gccccgcgcggaggaagttc

SEQ ID NO: 146004 - DNA, 20 bp, human
ggctctgtgctcctactctt

SEQ ID NO: 146005 - DNA, 20 bp, human
gctaggcggcgaagcctcca

SEQ ID NO: 146006 - DNA, 20 bp, human
gcagggagcgtgaggacgtg

SEQ ID NO: 146007 - DNA, 20 bp, human
gccgaacccagccgcttacc

SEQ ID NO: 146008 - DNA, 20 bp, human
gcacccgtcgggtcccctga

SEQ ID NO: 146009 - DNA, 20 bp, human
gtaacctggccaaaaggtcg

SEQ ID NO: 146010 - DNA, 20 bp, human
gtcccgtggtagagatccag

SEQ ID NO: 146011 - DNA, 20 bp, human
ggaatgcgcagtgggtgcgt

SEQ ID NO: 146012 - DNA, 20 bp, human
gagccgtcaggggacccgac

SEQ ID NO: 146013 - DNA, 20 bp, human
gacccctggatctctaccac

SEQ ID NO: 146014 - DNA, 20 bp, human
gcgaaagtgacgactaaagg

SEQ ID NO: 146015 - DNA, 20 bp, human
gggcttccgtgaatgcgcag

SEQ ID NO: 146016 - DNA, 20 bp, human
gctcagacactaggtacctc

SEQ ID NO: 146017 - DNA, 20 bp, human
gggggtagagtggcctagta

SEQ ID NO: 146018 - DNA, 20 bp, human
gcctctgcgacagtttcccg

SEQ ID NO: 146019 - DNA, 20 bp, human
ggtcgtaaggatgggaatcg

SEQ ID NO: 146020 - DNA, 20 bp, human
gaaactgtcgcagaggggaa

SEQ ID NO: 146021 - DNA, 20 bp, human
gagtcaagctgaccaatcaa

SEQ ID NO: 146022 - DNA, 20 bp, human
gggatgggaatcgaggaacc

SEQ ID NO: 146023 - DNA, 20 bp, human
gatggggacggtgaggacag

SEQ ID NO: 146024 - DNA, 20 bp, human
ggagaagggagggcgtgacc

SEQ ID NO: 146025 - DNA, 20 bp, human
gctctaatccacccaagacc

SEQ ID NO: 146026 - DNA, 20 bp, human
ggtgcgcccgatgtggagag

SEQ ID NO: 146027 - DNA, 20 bp, human
gtggtgccaggcggcatctg

SEQ ID NO: 146028 - DNA, 20 bp, human
gcaagtggaaagtgcggcag

SEQ ID NO: 146029 - DNA, 20 bp, human
ggcagagggcaccccggaca

SEQ ID NO: 146030 - DNA, 20 bp, human
gggcaggagagcccgagact

SEQ ID NO: 146031 - DNA, 20 bp, human
gcctgcctctccctttccgg

SEQ ID NO: 146032 - DNA, 20 bp, human
gggctcccttccagcttcat

SEQ ID NO: 146033 - DNA, 20 bp, human
ggaagggagcctgccgtgca

SEQ ID NO: 146034 - DNA, 20 bp, human
gcagagcgcagagggcaccc

SEQ ID NO: 146035 - DNA, 20 bp, human
gtggcagccccggagcagtc

SEQ ID NO: 146036 - DNA, 20 bp, human
gagaagcgcggtgaggaatt

SEQ ID NO: 146037 - DNA, 20 bp, human
gagagatgaaggggggctgc

SEQ ID NO: 146038 - DNA, 20 bp, human
ggaattaggaatcttgagag

SEQ ID NO: 146039 - DNA, 20 bp, human
gaaaagggagaagcgcggtg

SEQ ID NO: 146040 - DNA, 20 bp, human
gtgcgaggcctgaaaagaca

SEQ ID NO: 146041 - DNA, 20 bp, human
gtgcgggcagagaatgagct

SEQ ID NO: 146042 - DNA, 20 bp, human
gcaactggttctggagttca

SEQ ID NO: 146043 - DNA, 20 bp, human
gacttctctcagtgacgtaa

SEQ ID NO: 146044 - DNA, 20 bp, human
gtagaaacaacaagaaggta

SEQ ID NO: 146045 - DNA, 20 bp, human
gagttaacagagtctgaatg

SEQ ID NO: 146046 - DNA, 20 bp, human
ggcagcaactaagctgtaca

SEQ ID NO: 146047 - DNA, 20 bp, human
gccgggactgtcaggaatag

SEQ ID NO: 146048 - DNA, 20 bp, human
gatctgggaaggctgtgtgt

SEQ ID NO: 146049 - DNA, 20 bp, human
gcagctgccggggtccactt

SEQ ID NO: 146050 - DNA, 20 bp, human
gccgaacaccatgtcactct

SEQ ID NO: 146051 - DNA, 20 bp, human
gctgtgttggaactagcgag

SEQ ID NO: 146052 - DNA, 20 bp, human
gcgtgggtcaagccatacct

SEQ ID NO: 146053 - DNA, 20 bp, human
gacgctgatcgccagaccgt

SEQ ID NO: 146054 - DNA, 20 bp, human
gtctccctcccagagtgaca

SEQ ID NO: 146055 - DNA, 20 bp, human
gcctcatcccaagtggaccc

SEQ ID NO: 146056 - DNA, 20 bp, human
ggcgcaacgagggcgaacaa

SEQ ID NO: 146057 - DNA, 20 bp, human
gtagcactactgcgcaacga

SEQ ID NO: 146058 - DNA, 20 bp, human
gtggcgctggcgctaatgat

SEQ ID NO: 146059 - DNA, 20 bp, human
ggcgaggagcgaccgcacca

SEQ ID NO: 146060 - DNA, 20 bp, human
gaccacggcgatacctgcat

SEQ ID NO: 146061 - DNA, 20 bp, human
ggccagcgccataccaatgc

SEQ ID NO: 146062 - DNA, 20 bp, human
gaccaatgcaggtatcgccg

SEQ ID NO: 146063 - DNA, 20 bp, human
gggcatgtggacttccatgc

SEQ ID NO: 146064 - DNA, 20 bp, human
gccaacgagctcggcgatag

SEQ ID NO: 146065 - DNA, 20 bp, human
gtatatctccctggagatgg

SEQ ID NO: 146066 - DNA, 20 bp, human
gaacccgaggagatgaagta

SEQ ID NO: 146067 - DNA, 20 bp, human
gccactgggggtggtccacc

SEQ ID NO: 146068 - DNA, 20 bp, human
ggcgctgcgctgcctttccc

SEQ ID NO: 146069 - DNA, 20 bp, human
gaggaatcagcgcccgggaa

SEQ ID NO: 146070 - DNA, 20 bp, human
gaggagcagcgggccactgg

SEQ ID NO: 146071 - DNA, 20 bp, human
gtagttaaagggcttcacgg

SEQ ID NO: 146072 - DNA, 20 bp, human
gagcagatggatatgaaggt

SEQ ID NO: 146073 - DNA, 20 bp, human
gctgaggaagagcaaaacta

SEQ ID NO: 146074 - DNA, 20 bp, human
gcactcaggaatcagcgccc

SEQ ID NO: 146075 - DNA, 20 bp, human
gagacagcagatggatatga

SEQ ID NO: 146076 - DNA, 20 bp, human
gtaggccaggatctctaggc

SEQ ID NO: 146077 - DNA, 20 bp, human
gcgggacagggattgactct

SEQ ID NO: 146078 - DNA, 20 bp, human
gtagacccgggtcaccgtct

SEQ ID NO: 146079 - DNA, 20 bp, human
gccgcaccggataggtgagt

SEQ ID NO: 146080 - DNA, 20 bp, human
gagtgcgcgctttggcggag

SEQ ID NO: 146081 - DNA, 20 bp, human
ggggggaatcccctagaccc

SEQ ID NO: 146082 - DNA, 20 bp, human
gcttccgtgcggactgacta

SEQ ID NO: 146083 - DNA, 20 bp, human
gagggccgtcccggcgtacg

SEQ ID NO: 146084 - DNA, 20 bp, human
gcactcagtgcgcgctttgg

SEQ ID NO: 146085 - DNA, 20 bp, human
ggtacggggcgagggaacgg

SEQ ID NO: 146086 - DNA, 20 bp, human
gtcgaacggtcggtcagtgg

SEQ ID NO: 146087 - DNA, 20 bp, human
gcctcgacgagcgagctcga

SEQ ID NO: 146088 - DNA, 20 bp, human
gtaggcgccgcctgaccagt

SEQ ID NO: 146089 - DNA, 20 bp, human
ggcgggcccgatgatgacgg

SEQ ID NO: 146090 - DNA, 20 bp, human
gcaggaacctcgggcgaccg

SEQ ID NO: 146091 - DNA, 20 bp, human
gcgagctcgaaggctgcgac

SEQ ID NO: 146092 - DNA, 20 bp, human
gagggcggctcctactggtc

SEQ ID NO: 146093 - DNA, 20 bp, human
gcggtcgaacggtcggtcag

SEQ ID NO: 146094 - DNA, 20 bp, human
gtcctgcgcggaacccgcgg

SEQ ID NO: 146095 - DNA, 20 bp, human
gggttccgcgcaggaacctc

SEQ ID NO: 146096 - DNA, 20 bp, human
gctcagggcaggcctgatga

SEQ ID NO: 146097 - DNA, 20 bp, human
gatggtgggtcagaggaagt

SEQ ID NO: 146098 - DNA, 20 bp, human
gcagggagacatgatggaag

SEQ ID NO: 146099 - DNA, 20 bp, human
gcccaatgaaaagcttctct

SEQ ID NO: 146100 - DNA, 20 bp, human
gtctcacacagaacccgtgg

SEQ ID NO: 146101 - DNA, 20 bp, human
ggaagcgcgggccgccaccg

SEQ ID NO: 146102 - DNA, 20 bp, human
gctgagaggggggtcgctgt

SEQ ID NO: 146103 - DNA, 20 bp, human
gtctgacccaccattcggca

SEQ ID NO: 146104 - DNA, 20 bp, human
ggatgggtcccgccaacccc

SEQ ID NO: 146105 - DNA, 20 bp, human
gatgtctccctgccgaatgg

SEQ ID NO: 146106 - DNA, 20 bp, human
gctggagactgccgggacag

SEQ ID NO: 146107 - DNA, 20 bp, human
ggcgtctcgggagggctcta

SEQ ID NO: 146108 - DNA, 20 bp, human
ggcaccggcagccgctgtcc

SEQ ID NO: 146109 - DNA, 20 bp, human
gcccaccacccgcgtagcac

SEQ ID NO: 146110 - DNA, 20 bp, human
ggctcgttggccctggaggt

SEQ ID NO: 146111 - DNA, 20 bp, human
gggcaggcagcgtctcggga

SEQ ID NO: 146112 - DNA, 20 bp, human
ggagccagttggccacaagc

SEQ ID NO: 146113 - DNA, 20 bp, human
gagagccccctgtccccgga

SEQ ID NO: 146114 - DNA, 20 bp, human
gccagttggccacaagcggg

SEQ ID NO: 146115 - DNA, 20 bp, human
gcgggacggctggagactgc

SEQ ID NO: 146116 - DNA, 20 bp, human
gggctgcagggagaatacac

SEQ ID NO: 146117 - DNA, 20 bp, human
ggtggccaccaccatgacaa

SEQ ID NO: 146118 - DNA, 20 bp, human
ggttcggtgagggtttgtgg

SEQ ID NO: 146119 - DNA, 20 bp, human
ggtggccactggttcggtga

SEQ ID NO: 146120 - DNA, 20 bp, human
gtggtcccttgtcatggtgg

SEQ ID NO: 146121 - DNA, 20 bp, human
gcaaaccctcaccgaaccag

SEQ ID NO: 146122 - DNA, 20 bp, human
gatggagttcaacagacctg

SEQ ID NO: 146123 - DNA, 20 bp, human
ggtggttatcagagagatgg

SEQ ID NO: 146124 - DNA, 20 bp, human
gcctgggtaaggaggagact

SEQ ID NO: 146125 - DNA, 20 bp, human
gcaagtggttatcagagaga

SEQ ID NO: 146126 - DNA, 20 bp, human
ggagagactgcttgcctgta

SEQ ID NO: 146127 - DNA, 20 bp, human
ggagcacagcaaggactctc

SEQ ID NO: 146128 - DNA, 20 bp, human
gcaggcaagcagtctctctc

SEQ ID NO: 146129 - DNA, 20 bp, human
ggaatttacctgctgtcctt

SEQ ID NO: 146130 - DNA, 20 bp, human
gtgagtgtagcggacagagt

SEQ ID NO: 146131 - DNA, 20 bp, human
gaagaattccacaaggactt

SEQ ID NO: 146132 - DNA, 20 bp, human
gagcatctgactgcagcagc

SEQ ID NO: 146133 - DNA, 20 bp, human
ggtgtagcggacagagttgg

SEQ ID NO: 146134 - DNA, 20 bp, human
gtgcctacaacttccattta

SEQ ID NO: 146135 - DNA, 20 bp, human
gtcttgtaacctggaaagat

SEQ ID NO: 146136 - DNA, 20 bp, human
gcggccttgcacacagtcca

SEQ ID NO: 146137 - DNA, 20 bp, human
gtgagaaggacaagggcgga

SEQ ID NO: 146138 - DNA, 20 bp, human
gaggttctggagggtaatgt

SEQ ID NO: 146139 - DNA, 20 bp, human
gacttgtgggggaggctcgg

SEQ ID NO: 146140 - DNA, 20 bp, human
gggtgagtgctgggacttgt

SEQ ID NO: 146141 - DNA, 20 bp, human
gaccaggcgaggatcgttca

SEQ ID NO: 146142 - DNA, 20 bp, human
gctcatcatggggacccagg

SEQ ID NO: 146143 - DNA, 20 bp, human
gaccccggctgtcagcacac

SEQ ID NO: 146144 - DNA, 20 bp, human
gttctcagctggtggacaga

SEQ ID NO: 146145 - DNA, 20 bp, human
ggcatgcccagcaggttctc

SEQ ID NO: 146146 - DNA, 20 bp, human
gcccggccgcgactcaccac

SEQ ID NO: 146147 - DNA, 20 bp, human
gcgcgactcaccaccgggag

SEQ ID NO: 146148 - DNA, 20 bp, human
gcgcgcggttcccctcccgg

SEQ ID NO: 146149 - DNA, 20 bp, human
gaagcctggccgccgagtcc

SEQ ID NO: 146150 - DNA, 20 bp, human
gtggccaagaaggaccccga

SEQ ID NO: 146151 - DNA, 20 bp, human
gggcgcgcgtggagcgaggg

SEQ ID NO: 146152 - DNA, 20 bp, human
gccgggcgcgcgtggagcga

SEQ ID NO: 146153 - DNA, 20 bp, human
gcctgcagaaagaggccctc

SEQ ID NO: 146154 - DNA, 20 bp, human
gctccacgcgcgcccggact

SEQ ID NO: 146155 - DNA, 20 bp, human
gttgcgcgcggttcccctcc

SEQ ID NO: 146156 - DNA, 20 bp, human
gtagcagcacccctactaac

SEQ ID NO: 146157 - DNA, 20 bp, human
gcagctccacacacagagac

SEQ ID NO: 146158 - DNA, 20 bp, human
ggggggctgcctgttagtag

SEQ ID NO: 146159 - DNA, 20 bp, human
gacagagacaggatgtgtaa

SEQ ID NO: 146160 - DNA, 20 bp, human
gtgtaatggccgggttacca

SEQ ID NO: 146161 - DNA, 20 bp, human
gggcggctggcaccagacct

SEQ ID NO: 146162 - DNA, 20 bp, human
gcagccaagctgatgtctgt

SEQ ID NO: 146163 - DNA, 20 bp, human
gatgggaccaagaagcagga

SEQ ID NO: 146164 - DNA, 20 bp, human
gagggcgaggccattactta

SEQ ID NO: 146165 - DNA, 20 bp, human
gtagaaatggatcccaggtc

SEQ ID NO: 146166 - DNA, 20 bp, human
ggtccaagtaccgctgaggt

SEQ ID NO: 146167 - DNA, 20 bp, human
gccatgcccgccgacctcag

SEQ ID NO: 146168 - DNA, 20 bp, human
gcgggcactcagggacggac

SEQ ID NO: 146169 - DNA, 20 bp, human
gtacatgctggccctaggta

SEQ ID NO: 146170 - DNA, 20 bp, human
gcaaggaccagcggactcgg

SEQ ID NO: 146171 - DNA, 20 bp, human
gcaagtaccgctgaggtcgg

SEQ ID NO: 146172 - DNA, 20 bp, human
ggcgggtagagacggacgtg

SEQ ID NO: 146173 - DNA, 20 bp, human
ggatcgcgggacaaacccgg

SEQ ID NO: 146174 - DNA, 20 bp, human
gcagggtccaagtaccgctg

SEQ ID NO: 146175 - DNA, 20 bp, human
gggctggacgcgggcactca

SEQ ID NO: 146176 - DNA, 20 bp, human
gtgtgacagggtaagtctga

SEQ ID NO: 146177 - DNA, 20 bp, human
ggatggcgcctgttgtgaca

SEQ ID NO: 146178 - DNA, 20 bp, human
gagagagtcgcagcgggtag

SEQ ID NO: 146179 - DNA, 20 bp, human
gcgggggtagagagtcgcag

SEQ ID NO: 146180 - DNA, 20 bp, human
gtcggacaaagcgcccaagg

SEQ ID NO: 146181 - DNA, 20 bp, human
gcggggcgaagcggcgacaa

SEQ ID NO: 146182 - DNA, 20 bp, human
gcccaaggcggcgaaacaaa

SEQ ID NO: 146183 - DNA, 20 bp, human
gcgggaaccgggaaagttgc

SEQ ID NO: 146184 - DNA, 20 bp, human
ggcgtctggcagctcacggc

SEQ ID NO: 146185 - DNA, 20 bp, human
ggtcggggggaatctcgcga

SEQ ID NO: 146186 - DNA, 20 bp, human
gactggactcgtccagaggg

SEQ ID NO: 146187 - DNA, 20 bp, human
ggccaccatggaccccgcag

SEQ ID NO: 146188 - DNA, 20 bp, human
ggcgcattcacggaattggg

SEQ ID NO: 146189 - DNA, 20 bp, human
gcagcactggactcgtccag

SEQ ID NO: 146190 - DNA, 20 bp, human
gcgaggagcaggggtgtgca

SEQ ID NO: 146191 - DNA, 20 bp, human
ggggcctcaagagagagaag

SEQ ID NO: 146192 - DNA, 20 bp, human
gggtccatggtggctccacg

SEQ ID NO: 146193 - DNA, 20 bp, human
gcactggcctcgctcagaat

SEQ ID NO: 146194 - DNA, 20 bp, human
ggcccctgcggggtccatgg

SEQ ID NO: 146195 - DNA, 20 bp, human
ggactcgtccagagggcggc

SEQ ID NO: 146196 - DNA, 20 bp, human
ggcctggagcgcgtactcag

SEQ ID NO: 146197 - DNA, 20 bp, human
ggaagtgcaagggagagacg

SEQ ID NO: 146198 - DNA, 20 bp, human
gcgcgtactcagcggctctc

SEQ ID NO: 146199 - DNA, 20 bp, human
gagacaatcgggccccggga

SEQ ID NO: 146200 - DNA, 20 bp, human
gtggctgtcgggctcgggtt

SEQ ID NO: 146201 - DNA, 20 bp, human
gggctctgggaagtccggga

SEQ ID NO: 146202 - DNA, 20 bp, human
gacgcgctccaggcaggctc

SEQ ID NO: 146203 - DNA, 20 bp, human
gacgggggtgcctagagagg

SEQ ID NO: 146204 - DNA, 20 bp, human
gtcccgcggcgagtctgcga

SEQ ID NO: 146205 - DNA, 20 bp, human
ggccgctgagtacgcgctcc

SEQ ID NO: 146206 - DNA, 20 bp, human
gggtcgcagtgaaaaggcgg

SEQ ID NO: 146207 - DNA, 20 bp, human
ggccggtcgcagtgaaaagg

SEQ ID NO: 146208 - DNA, 20 bp, human
gcgcagtgaaaaggcggagg

SEQ ID NO: 146209 - DNA, 20 bp, human
gctcgccggtcgcagtgaaa

SEQ ID NO: 146210 - DNA, 20 bp, human
gagccggacggcgagcacgg

SEQ ID NO: 146211 - DNA, 20 bp, human
gcgctcctacccgggcgaga

SEQ ID NO: 146212 - DNA, 20 bp, human
gttggcgggtgcggaaggtg

SEQ ID NO: 146213 - DNA, 20 bp, human
gacacgggccgctcctaccc

SEQ ID NO: 146214 - DNA, 20 bp, human
ggcccgcctcgagcccgaga

SEQ ID NO: 146215 - DNA, 20 bp, human
gacccacggggcagtgagag

SEQ ID NO: 146216 - DNA, 20 bp, human
gtggatgtggataccccgag

SEQ ID NO: 146217 - DNA, 20 bp, human
gccgctgttggtgccgctcg

SEQ ID NO: 146218 - DNA, 20 bp, human
gaatgcggcggtggaggatg

SEQ ID NO: 146219 - DNA, 20 bp, human
gggagtcgaagcgaatgcgg

SEQ ID NO: 146220 - DNA, 20 bp, human
gcactggagtggttgagagg

SEQ ID NO: 146221 - DNA, 20 bp, human
gcaagcgcttgagctgtcac

SEQ ID NO: 146222 - DNA, 20 bp, human
gtaccacgaaaggaagccgg

SEQ ID NO: 146223 - DNA, 20 bp, human
gatggcggcagcgatggatg

SEQ ID NO: 146224 - DNA, 20 bp, human
gtcgcgcgccagtaaggggt

SEQ ID NO: 146225 - DNA, 20 bp, human
gcgcctcgcgcgccagtaag

SEQ ID NO: 146226 - DNA, 20 bp, human
gaggacaacgagcgactggg

SEQ ID NO: 146227 - DNA, 20 bp, human
gacgaggacaacgagcgact

SEQ ID NO: 146228 - DNA, 20 bp, human
gaggcagctgtggtcgggaa

SEQ ID NO: 146229 - DNA, 20 bp, human
gggcctcagtcgggaacaat

SEQ ID NO: 146230 - DNA, 20 bp, human
gccctacaggcggcatgcag

SEQ ID NO: 146231 - DNA, 20 bp, human
gccccgacaggccctacagg

SEQ ID NO: 146232 - DNA, 20 bp, human
gaggaggccgagcaacaaga

SEQ ID NO: 146233 - DNA, 20 bp, human
gcaagccccagaacagccgg

SEQ ID NO: 146234 - DNA, 20 bp, human
gctctgctcctccgcggcag

SEQ ID NO: 146235 - DNA, 20 bp, human
gctaccccgacaggccctac

SEQ ID NO: 146236 - DNA, 20 bp, human
ggggacagccccgttggcgg

SEQ ID NO: 146237 - DNA, 20 bp, human
gggtcgctaagggccgctcc

SEQ ID NO: 146238 - DNA, 20 bp, human
ggctacagggacagccccgt

SEQ ID NO: 146239 - DNA, 20 bp, human
ggaggcccctctctctggta

SEQ ID NO: 146240 - DNA, 20 bp, human
ggcccgggccccctcaggta

SEQ ID NO: 146241 - DNA, 20 bp, human
gacagggacagccccgttgg

SEQ ID NO: 146242 - DNA, 20 bp, human
gtccgctcggccagtgtcga

SEQ ID NO: 146243 - DNA, 20 bp, human
gaactccatcgggagctaca

SEQ ID NO: 146244 - DNA, 20 bp, human
gggccagtgtcgaaggaagg

SEQ ID NO: 146245 - DNA, 20 bp, human
gctgtccctgtagctcccga

SEQ ID NO: 146246 - DNA, 20 bp, human
gttggaaaggaatctcacta

SEQ ID NO: 146247 - DNA, 20 bp, human
gactaggggcttgactgcgt

SEQ ID NO: 146248 - DNA, 20 bp, human
gctgaaccaactcactagga

SEQ ID NO: 146249 - DNA, 20 bp, human
gaacctacagcctcttggaa

SEQ ID NO: 146250 - DNA, 20 bp, human
gactaggaaggcgagagttg

SEQ ID NO: 146251 - DNA, 20 bp, human
ggaaggaacctacagcctct

SEQ ID NO: 146252 - DNA, 20 bp, human
ggcccctgaaccaactcact

SEQ ID NO: 146253 - DNA, 20 bp, human
gcgaaagtgaaaccagggta

SEQ ID NO: 146254 - DNA, 20 bp, human
gttgcctgaggaattaactg

SEQ ID NO: 146255 - DNA, 20 bp, human
gtttgccacacaggcaatca

SEQ ID NO: 146256 - DNA, 20 bp, human
ggtgctgcctcagacgcgga

SEQ ID NO: 146257 - DNA, 20 bp, human
gcgcggagggctgcgtgcag

SEQ ID NO: 146258 - DNA, 20 bp, human
gtccagccgtccccagagca

SEQ ID NO: 146259 - DNA, 20 bp, human
gacgcagccctccgcgtctg

SEQ ID NO: 146260 - DNA, 20 bp, human
gccagagcaaggcagcaccg

SEQ ID NO: 146261 - DNA, 20 bp, human
gtgcagtgggagcgggctcc

SEQ ID NO: 146262 - DNA, 20 bp, human
gaccacacaggcaaccagag

SEQ ID NO: 146263 - DNA, 20 bp, human
gcctcagagttgggagtgaa

SEQ ID NO: 146264 - DNA, 20 bp, human
gagcacagcagagtaacgaa

SEQ ID NO: 146265 - DNA, 20 bp, human
ggccttgctctggggacggc

SEQ ID NO: 146266 - DNA, 20 bp, human
ggctagcacaaggtgtggga

SEQ ID NO: 146267 - DNA, 20 bp, human
gcttggtgggagaaaatcgt

SEQ ID NO: 146268 - DNA, 20 bp, human
gctcattgcccgaggagagg

SEQ ID NO: 146269 - DNA, 20 bp, human
gtggagctagcacaaggtgt

SEQ ID NO: 146270 - DNA, 20 bp, human
ggggcctctgggagcctggt

SEQ ID NO: 146271 - DNA, 20 bp, human
gggctccccgcagccccgtc

SEQ ID NO: 146272 - DNA, 20 bp, human
gaagagggttgtacccgcca

SEQ ID NO: 146273 - DNA, 20 bp, human
gtcgcgcgcggggtctagtc

SEQ ID NO: 146274 - DNA, 20 bp, human
gcgagaagtccgggaggggt

SEQ ID NO: 146275 - DNA, 20 bp, human
gcccgcgcgcgagaagggtg

SEQ ID NO: 146276 - DNA, 20 bp, human
gagcgagcggcggtgcccac

SEQ ID NO: 146277 - DNA, 20 bp, human
gggatctccgaagctccaat

SEQ ID NO: 146278 - DNA, 20 bp, human
ggcgcagaagtgcgagcgag

SEQ ID NO: 146279 - DNA, 20 bp, human
gcctcctcttcgctgccggt

SEQ ID NO: 146280 - DNA, 20 bp, human
ggcgaagaggaggagcgcca

SEQ ID NO: 146281 - DNA, 20 bp, human
ggtgcccaccggcagcgaag

SEQ ID NO: 146282 - DNA, 20 bp, human
ggggaggtacaggagtaacg

SEQ ID NO: 146283 - DNA, 20 bp, human
gagaataggaagagtcggag

SEQ ID NO: 146284 - DNA, 20 bp, human
gggagcttcggagatccctg

SEQ ID NO: 146285 - DNA, 20 bp, human
ggccgtcccgcgggaccgca

SEQ ID NO: 146286 - DNA, 20 bp, human
gctgcgaggaggtaagaggg

SEQ ID NO: 146287 - DNA, 20 bp, human
gggcctgcgaggaggtaaga

SEQ ID NO: 146288 - DNA, 20 bp, human
gtgcgcgagtcctctggtag

SEQ ID NO: 146289 - DNA, 20 bp, human
gcaaacgcgacccctaccag

SEQ ID NO: 146290 - DNA, 20 bp, human
gccaggaggcggagcggaca

SEQ ID NO: 146291 - DNA, 20 bp, human
ggcagtaaccgctacccagg

SEQ ID NO: 146292 - DNA, 20 bp, human
gaaggctccggcctgcgagg

SEQ ID NO: 146293 - DNA, 20 bp, human
gggcggagcggacaaggctc

SEQ ID NO: 146294 - DNA, 20 bp, human
gtccgagcagatgatcaccc

SEQ ID NO: 146295 - DNA, 20 bp, human
gatgctgtcaggtaccactg

SEQ ID NO: 146296 - DNA, 20 bp, human
gagtggtcgcttcttctcct

SEQ ID NO: 146297 - DNA, 20 bp, human
gattagacccacaactccgg

SEQ ID NO: 146298 - DNA, 20 bp, human
gtttggagacagattcgcag

SEQ ID NO: 146299 - DNA, 20 bp, human
gccaaggatcacacttacca

SEQ ID NO: 146300 - DNA, 20 bp, human
gagcattagacccacaactc

SEQ ID NO: 146301 - DNA, 20 bp, human
gtatatatgggtgtcttagg

SEQ ID NO: 146302 - DNA, 20 bp, human
gcatctgatcacacttacca

SEQ ID NO: 146303 - DNA, 20 bp, human
gtgcttgccaccggagttgt

SEQ ID NO: 146304 - DNA, 20 bp, human
gtcagtagccgagcttccct

SEQ ID NO: 146305 - DNA, 20 bp, human
gtggtggatcaccggaaatc

SEQ ID NO: 146306 - DNA, 20 bp, human
gggccgacgtgcaccaaggt

SEQ ID NO: 146307 - DNA, 20 bp, human
gcgtcggccacaaggaactc

SEQ ID NO: 146308 - DNA, 20 bp, human
gtcccaggcgagacctacct

SEQ ID NO: 146309 - DNA, 20 bp, human
ggacaaaaccatcctcctcg

SEQ ID NO: 146310 - DNA, 20 bp, human
ggacctaccttggtgcacgt

SEQ ID NO: 146311 - DNA, 20 bp, human
gttgtggccgacgtgcacca

SEQ ID NO: 146312 - DNA, 20 bp, human
gatgggtctctgccgcgagg

SEQ ID NO: 146313 - DNA, 20 bp, human
gggagcgccggagttccttg

SEQ ID NO: 146314 - DNA, 20 bp, human
gggccccacgtgaagcccgg

SEQ ID NO: 146315 - DNA, 20 bp, human
gcatgctctggggcagttcg

SEQ ID NO: 146316 - DNA, 20 bp, human
ggcagcggcgcacaatggac

SEQ ID NO: 146317 - DNA, 20 bp, human
gcggccggcgacagcaggca

SEQ ID NO: 146318 - DNA, 20 bp, human
gagggtcagggtagacgggt

SEQ ID NO: 146319 - DNA, 20 bp, human
gccgcctccgcgcaacaaaa

SEQ ID NO: 146320 - DNA, 20 bp, human
ggagggagcgtgacgcgagg

SEQ ID NO: 146321 - DNA, 20 bp, human
ggggcatggtcgcggctgga

SEQ ID NO: 146322 - DNA, 20 bp, human
ggcgtcgtgagtgagggtca

SEQ ID NO: 146323 - DNA, 20 bp, human
gcggcgacagcaggcaaggc

SEQ ID NO: 146324 - DNA, 20 bp, human
ggcaacaaaagggctcggta

SEQ ID NO: 146325 - DNA, 20 bp, human
gcggcgcgcgttccagccgg

SEQ ID NO: 146326 - DNA, 20 bp, human
gggccgcacggccggcaagg

SEQ ID NO: 146327 - DNA, 20 bp, human
gtcatcactccaaccaggta

SEQ ID NO: 146328 - DNA, 20 bp, human
ggtcgaatcggagaccggcc

SEQ ID NO: 146329 - DNA, 20 bp, human
gtttaagtgtatctggtgag

SEQ ID NO: 146330 - DNA, 20 bp, human
gggacactttgcagtcgaat

SEQ ID NO: 146331 - DNA, 20 bp, human
gcacggccggcaagggggct

SEQ ID NO: 146332 - DNA, 20 bp, human
gttgcagtcgaatcggagac

SEQ ID NO: 146333 - DNA, 20 bp, human
ggggagagcgcagggacgcc

SEQ ID NO: 146334 - DNA, 20 bp, human
ggcagacaggggagagcgca

SEQ ID NO: 146335 - DNA, 20 bp, human
gctgtgcgagcaggtgtttg

SEQ ID NO: 146336 - DNA, 20 bp, human
gcacctcagtcccgggaccg

SEQ ID NO: 146337 - DNA, 20 bp, human
ggaggagtgacgcccaagac

SEQ ID NO: 146338 - DNA, 20 bp, human
gggcggccaatcaccagcaa

SEQ ID NO: 146339 - DNA, 20 bp, human
ggagtgacgcccaagacggg

SEQ ID NO: 146340 - DNA, 20 bp, human
gtgccgcggtcccgggactg

SEQ ID NO: 146341 - DNA, 20 bp, human
gcagcgggcgccgacagcca

SEQ ID NO: 146342 - DNA, 20 bp, human
gcgggtcctgagccaatccg

SEQ ID NO: 146343 - DNA, 20 bp, human
gagagcggccgcctccggaa

SEQ ID NO: 146344 - DNA, 20 bp, human
gggccaatcaccagcaaggg

SEQ ID NO: 146345 - DNA, 20 bp, human
gtcctgttggggcatgagtc

SEQ ID NO: 146346 - DNA, 20 bp, human
gggacgcgtgggcctcggag

SEQ ID NO: 146347 - DNA, 20 bp, human
gagcggccgggggcctggtt

SEQ ID NO: 146348 - DNA, 20 bp, human
gctcgggcatggcggaggag

SEQ ID NO: 146349 - DNA, 20 bp, human
gagcagggtggccagaatgg

SEQ ID NO: 146350 - DNA, 20 bp, human
gggccgctgcaaggacgcgt

SEQ ID NO: 146351 - DNA, 20 bp, human
ggagcgcggctggaataagt

SEQ ID NO: 146352 - DNA, 20 bp, human
gggcccacgcgtccttgcag

SEQ ID NO: 146353 - DNA, 20 bp, human
gcaatccgccccgcaggtgg

SEQ ID NO: 146354 - DNA, 20 bp, human
gcgaagccgaaccaggcccc

SEQ ID NO: 146355 - DNA, 20 bp, human
gaccgcgaggagcccctccg

SEQ ID NO: 146356 - DNA, 20 bp, human
ggcgggtcagggcgcaatgg

SEQ ID NO: 146357 - DNA, 20 bp, human
ggccgcgggtcagggcgcaa

SEQ ID NO: 146358 - DNA, 20 bp, human
gcggcccccctcactcctag

SEQ ID NO: 146359 - DNA, 20 bp, human
gtccagagcagcacgcacag

SEQ ID NO: 146360 - DNA, 20 bp, human
gccagcgccgccgactcggg

SEQ ID NO: 146361 - DNA, 20 bp, human
gaggcatccaggtgcgaagg

SEQ ID NO: 146362 - DNA, 20 bp, human
gcgggatggtccctacggag

SEQ ID NO: 146363 - DNA, 20 bp, human
gtccaggtgcgaaggaggcg

SEQ ID NO: 146364 - DNA, 20 bp, human
ggcggggcaaagggcaacgg

SEQ ID NO: 146365 - DNA, 20 bp, human
gagggaactcacaggcatcc

SEQ ID NO: 146366 - DNA, 20 bp, human
gttgctgccgaagtagactg

SEQ ID NO: 146367 - DNA, 20 bp, human
gcagccccgggcctgtactg

SEQ ID NO: 146368 - DNA, 20 bp, human
ggctgcgagcactatgacag

SEQ ID NO: 146369 - DNA, 20 bp, human
ggaaggatcggtggaatgtg

SEQ ID NO: 146370 - DNA, 20 bp, human
gcggtcaagagcgaggtcag

SEQ ID NO: 146371 - DNA, 20 bp, human
gcacagtggtctctgccagt

SEQ ID NO: 146372 - DNA, 20 bp, human
gcccgggaagatggcgccag

SEQ ID NO: 146373 - DNA, 20 bp, human
ggaacggaaaaccccagtac

SEQ ID NO: 146374 - DNA, 20 bp, human
gcggcgacggcccgggaaga

SEQ ID NO: 146375 - DNA, 20 bp, human
gtcagggaagagtccataga

SEQ ID NO: 146376 - DNA, 20 bp, human
gggtagacaggaccagacgt

SEQ ID NO: 146377 - DNA, 20 bp, human
gagacggagagactagacac

SEQ ID NO: 146378 - DNA, 20 bp, human
ggacgcgtctgggctgctgg

SEQ ID NO: 146379 - DNA, 20 bp, human
ggtggcggcgacaccgacgg

SEQ ID NO: 146380 - DNA, 20 bp, human
gggactcgtgactccgatgg

SEQ ID NO: 146381 - DNA, 20 bp, human
ggtggtggcggcgacaccga

SEQ ID NO: 146382 - DNA, 20 bp, human
gctcgtgactccgatggtgg

SEQ ID NO: 146383 - DNA, 20 bp, human
gaaaccacgtggacgcgtct

SEQ ID NO: 146384 - DNA, 20 bp, human
gcagcccagacgcgtccacg

SEQ ID NO: 146385 - DNA, 20 bp, human
ggacgtgagcagcccgagag

SEQ ID NO: 146386 - DNA, 20 bp, human
gaggtgtccgagggccgcct

SEQ ID NO: 146387 - DNA, 20 bp, human
ggggcggcgcaggtgtccga

SEQ ID NO: 146388 - DNA, 20 bp, human
gcggcggcagcgacagggtt

SEQ ID NO: 146389 - DNA, 20 bp, human
gtgagccccagcgccgagtt

SEQ ID NO: 146390 - DNA, 20 bp, human
ggcctgggcgagagccacgc

SEQ ID NO: 146391 - DNA, 20 bp, human
gtcccgcgtggctctcgccc

SEQ ID NO: 146392 - DNA, 20 bp, human
gggagccacgtcgccagctg

SEQ ID NO: 146393 - DNA, 20 bp, human
ggcgcgcgcggcctcgagga

SEQ ID NO: 146394 - DNA, 20 bp, human
gcagggctaaccccaggcgg

SEQ ID NO: 146395 - DNA, 20 bp, human
ggatggggccctgcccaact

SEQ ID NO: 146396 - DNA, 20 bp, human
gtccgcgggcggctacagag

SEQ ID NO: 146397 - DNA, 20 bp, human
gggcccgcggaggacaccga

SEQ ID NO: 146398 - DNA, 20 bp, human
gacaccgagggacgcgagga

SEQ ID NO: 146399 - DNA, 20 bp, human
ggcctctctgtagccgcccg

SEQ ID NO: 146400 - DNA, 20 bp, human
gccgagggacgcgaggaggg

SEQ ID NO: 146401 - DNA, 20 bp, human
gggccggctgcgatgctccg

SEQ ID NO: 146402 - DNA, 20 bp, human
gggctgcgatgctccgcggg

SEQ ID NO: 146403 - DNA, 20 bp, human
gtgggccgtgctatctcctc

SEQ ID NO: 146404 - DNA, 20 bp, human
gcatgatctgaggggtagaa

SEQ ID NO: 146405 - DNA, 20 bp, human
ggcggtgcgacgtacgttga

SEQ ID NO: 146406 - DNA, 20 bp, human
gacgtggcgaggagtgcccg

SEQ ID NO: 146407 - DNA, 20 bp, human
gcaggagttgtagttctccc

SEQ ID NO: 146408 - DNA, 20 bp, human
gggttacctaggacaggaca

SEQ ID NO: 146409 - DNA, 20 bp, human
gcagacacgggataggagaa

SEQ ID NO: 146410 - DNA, 20 bp, human
gacacgggataggagaatgg

SEQ ID NO: 146411 - DNA, 20 bp, human
gggtcaggggtcacagggat

SEQ ID NO: 146412 - DNA, 20 bp, human
gggaaagccaggcccgtctg

SEQ ID NO: 146413 - DNA, 20 bp, human
gtggaggggttacctaggac

SEQ ID NO: 146414 - DNA, 20 bp, human
gataacagggtaaagggagt

SEQ ID NO: 146415 - DNA, 20 bp, human
gtggggcgtgtccagaggtg

SEQ ID NO: 146416 - DNA, 20 bp, human
gtcactggcaccaactactc

SEQ ID NO: 146417 - DNA, 20 bp, human
gcgtcgctgggggcttgaag

SEQ ID NO: 146418 - DNA, 20 bp, human
gatcgccgccctcacttcac

SEQ ID NO: 146419 - DNA, 20 bp, human
gtcgctgctcccggagtagt

SEQ ID NO: 146420 - DNA, 20 bp, human
gccgccgccgcccccaataa

SEQ ID NO: 146421 - DNA, 20 bp, human
ggaagggccccgaggtctca

SEQ ID NO: 146422 - DNA, 20 bp, human
gaacagcagcagcaactcct

SEQ ID NO: 146423 - DNA, 20 bp, human
ggcgctcggctcgtcgctgg

SEQ ID NO: 146424 - DNA, 20 bp, human
gggcccaaacgggcagagcg

SEQ ID NO: 146425 - DNA, 20 bp, human
gcggggccgtgcgaaagtgg

SEQ ID NO: 146426 - DNA, 20 bp, human
gtcgccactgaggttaggag

SEQ ID NO: 146427 - DNA, 20 bp, human
gcagggggccccgacttcag

SEQ ID NO: 146428 - DNA, 20 bp, human
gtgtgtgcgcgaggagcgag

SEQ ID NO: 146429 - DNA, 20 bp, human
gatgagcgcaaggtccggtg

SEQ ID NO: 146430 - DNA, 20 bp, human
gcagggcgccccgaggacag

SEQ ID NO: 146431 - DNA, 20 bp, human
ggcgcacacaatgaagctgc

SEQ ID NO: 146432 - DNA, 20 bp, human
ggcaagcggcatcccgagcg

SEQ ID NO: 146433 - DNA, 20 bp, human
ggcagaagtgggggacgcaa

SEQ ID NO: 146434 - DNA, 20 bp, human
gtatgtacgcccctcagggt

SEQ ID NO: 146435 - DNA, 20 bp, human
gaagggatgagcgcaaggtc

SEQ ID NO: 146436 - DNA, 20 bp, human
ggccgggcatggtagaacag

SEQ ID NO: 146437 - DNA, 20 bp, human
ggaggaggaggctgttaata

SEQ ID NO: 146438 - DNA, 20 bp, human
gcgctactgccggagcgggg

SEQ ID NO: 146439 - DNA, 20 bp, human
gtgccggagcggggcggtta

SEQ ID NO: 146440 - DNA, 20 bp, human
ggcagcgacgacgagcacgg

SEQ ID NO: 146441 - DNA, 20 bp, human
ggaaagggcccgagttactg

SEQ ID NO: 146442 - DNA, 20 bp, human
ggactgcgctactgccggag

SEQ ID NO: 146443 - DNA, 20 bp, human
ggcactccgggagatggcag

SEQ ID NO: 146444 - DNA, 20 bp, human
gaaagaagcggcgggtggat

SEQ ID NO: 146445 - DNA, 20 bp, human
ggctgtgacactgggcgtgt

SEQ ID NO: 146446 - DNA, 20 bp, human
ggggagggaggccgacgatc

SEQ ID NO: 146447 - DNA, 20 bp, human
ggagcggtgagcggtgtatc

SEQ ID NO: 146448 - DNA, 20 bp, human
gcggcgggcacagggcgagt

SEQ ID NO: 146449 - DNA, 20 bp, human
gggccctgcgcgagagaacg

SEQ ID NO: 146450 - DNA, 20 bp, human
gtggtaaggaaagatctcag

SEQ ID NO: 146451 - DNA, 20 bp, human
gatctcagagggagagaaaa

SEQ ID NO: 146452 - DNA, 20 bp, human
gctaggacacccgggttggg

SEQ ID NO: 146453 - DNA, 20 bp, human
ggagaaaagggctttcctag

SEQ ID NO: 146454 - DNA, 20 bp, human
gcacctaggacacccgggtt

SEQ ID NO: 146455 - DNA, 20 bp, human
gcccggccgtggccagtttc

SEQ ID NO: 146456 - DNA, 20 bp, human
gcgcaggctgggctcaaggc

SEQ ID NO: 146457 - DNA, 20 bp, human
ggaagtgctggagatcgtca

SEQ ID NO: 146458 - DNA, 20 bp, human
gccccatgagtgaggaagag

SEQ ID NO: 146459 - DNA, 20 bp, human
gctgaacaccaagttctcgg

SEQ ID NO: 146460 - DNA, 20 bp, human
ggccttctccctctacgacg

SEQ ID NO: 146461 - DNA, 20 bp, human
ggagcccagcctgcggccag

SEQ ID NO: 146462 - DNA, 20 bp, human
gccccagcccggagcgaccc

SEQ ID NO: 146463 - DNA, 20 bp, human
gcgcccagccagaaggggag

SEQ ID NO: 146464 - DNA, 20 bp, human
gtcggtgtcggggaagaact

SEQ ID NO: 146465 - DNA, 20 bp, human
gggtcccctggccgcaggct

SEQ ID NO: 146466 - DNA, 20 bp, human
gtgacgctgcacctgagcag

SEQ ID NO: 146467 - DNA, 20 bp, human
gccgcctccatggttcatca

SEQ ID NO: 146468 - DNA, 20 bp, human
ggacctcagaggtaagatgg

SEQ ID NO: 146469 - DNA, 20 bp, human
ggaagctgcaggaccctcat

SEQ ID NO: 146470 - DNA, 20 bp, human
ggtaagatggaggtctcccc

SEQ ID NO: 146471 - DNA, 20 bp, human
gaggcttaggtgggtctcca

SEQ ID NO: 146472 - DNA, 20 bp, human
gggtgcagcgtcacagcagg

SEQ ID NO: 146473 - DNA, 20 bp, human
gcttccctgatgaaccatgg

SEQ ID NO: 146474 - DNA, 20 bp, human
gccatctgggtcccggaggt

SEQ ID NO: 146475 - DNA, 20 bp, human
gttctcagagaaccaaagag

SEQ ID NO: 146476 - DNA, 20 bp, human
gctagctcggagcgcatcta

SEQ ID NO: 146477 - DNA, 20 bp, human
gttggtagtgaaacgaagaa

SEQ ID NO: 146478 - DNA, 20 bp, human
ggacagtcttcactctagct

SEQ ID NO: 146479 - DNA, 20 bp, human
ggcttacctgttaagttgat

SEQ ID NO: 146480 - DNA, 20 bp, human
gttcactaccaaagacatgt

SEQ ID NO: 146481 - DNA, 20 bp, human
gggacgtatcttgctctcct

SEQ ID NO: 146482 - DNA, 20 bp, human
gatgcattccgacatgtctt

SEQ ID NO: 146483 - DNA, 20 bp, human
gtttatgttttggacagaaa

SEQ ID NO: 146484 - DNA, 20 bp, human
gtggcgcattccttctacag

SEQ ID NO: 146485 - DNA, 20 bp, human
ggacgaagctgtgtttcact

SEQ ID NO: 146486 - DNA, 20 bp, human
gctctccgcgggtgtcactc

SEQ ID NO: 146487 - DNA, 20 bp, human
gagtgcccgagtgacacccg

SEQ ID NO: 146488 - DNA, 20 bp, human
gccgagccgggtgactgccg

SEQ ID NO: 146489 - DNA, 20 bp, human
ggtcgagttgacaactcccg

SEQ ID NO: 146490 - DNA, 20 bp, human
gccggccctgcactctccgc

SEQ ID NO: 146491 - DNA, 20 bp, human
gacccaagttgcgagagggt

SEQ ID NO: 146492 - DNA, 20 bp, human
gggcagcagcttggccatga

SEQ ID NO: 146493 - DNA, 20 bp, human
gaagtcagagcgctccgggc

SEQ ID NO: 146494 - DNA, 20 bp, human
gcgtggagcccgctcagagc

SEQ ID NO: 146495 - DNA, 20 bp, human
gggggaacgcgagccctcgg

SEQ ID NO: 146496 - DNA, 20 bp, human
gtagaaagagaagccatagt

SEQ ID NO: 146497 - DNA, 20 bp, human
gccgctgcagccggcagaga

SEQ ID NO: 146498 - DNA, 20 bp, human
gtccctggagccagaatcag

SEQ ID NO: 146499 - DNA, 20 bp, human
gtggctccagggaatcccga

SEQ ID NO: 146500 - DNA, 20 bp, human
gcatcttggagcccccccag

SEQ ID NO: 146501 - DNA, 20 bp, human
gacgctggagcatcccgctc

SEQ ID NO: 146502 - DNA, 20 bp, human
gccagggaatcccgagggta

SEQ ID NO: 146503 - DNA, 20 bp, human
gcagcgttgctcgccgacta

SEQ ID NO: 146504 - DNA, 20 bp, human
gcagccatatacagaaggaa

SEQ ID NO: 146505 - DNA, 20 bp, human
gtgagctcaaccatctctgc

SEQ ID NO: 146506 - DNA, 20 bp, human
gacgcaaggactcccaccta

SEQ ID NO: 146507 - DNA, 20 bp, human
gagcagaagcagccaagagc

SEQ ID NO: 146508 - DNA, 20 bp, human
gggatggagctaccatatac

SEQ ID NO: 146509 - DNA, 20 bp, human
gtacaggaacgagaagaagg

SEQ ID NO: 146510 - DNA, 20 bp, human
ggggagagttctactgccag

SEQ ID NO: 146511 - DNA, 20 bp, human
gctctgctcctctccgtcct

SEQ ID NO: 146512 - DNA, 20 bp, human
gctgggctctgctcagagtc

SEQ ID NO: 146513 - DNA, 20 bp, human
gcatccatgcagccttccgc

SEQ ID NO: 146514 - DNA, 20 bp, human
ggagttctactgccagcgga

SEQ ID NO: 146515 - DNA, 20 bp, human
gaccatggtggaaaaccaga

SEQ ID NO: 146516 - DNA, 20 bp, human
ggacaggcgtcaggcgtcag

SEQ ID NO: 146517 - DNA, 20 bp, human
gagccgcctgggtagctccg

SEQ ID NO: 146518 - DNA, 20 bp, human
gggcgtcaggcgtcaggggt

SEQ ID NO: 146519 - DNA, 20 bp, human
gttcctcggagctacccagg

SEQ ID NO: 146520 - DNA, 20 bp, human
ggagcgcgcgacgcagccac

SEQ ID NO: 146521 - DNA, 20 bp, human
gcaaggtcactcggagggaa

SEQ ID NO: 146522 - DNA, 20 bp, human
gctcttcctcggagctaccc

SEQ ID NO: 146523 - DNA, 20 bp, human
gtgcgtcgcgcgctcttcct

SEQ ID NO: 146524 - DNA, 20 bp, human
gcgacgcagccacaggcgag

SEQ ID NO: 146525 - DNA, 20 bp, human
gctgcgcctccgctcgcctg

SEQ ID NO: 146526 - DNA, 20 bp, human
ggaccgtagcagcctagagg

SEQ ID NO: 146527 - DNA, 20 bp, human
gagtgaccgtagcagcctag

SEQ ID NO: 146528 - DNA, 20 bp, human
gactctagacactcagggat

SEQ ID NO: 146529 - DNA, 20 bp, human
ggagctgagagtgaagtcac

SEQ ID NO: 146530 - DNA, 20 bp, human
gtaagcattcggccacctct

SEQ ID NO: 146531 - DNA, 20 bp, human
ggccgaatgcttactctaat

SEQ ID NO: 146532 - DNA, 20 bp, human
gtctctgggagggatcgtgg

SEQ ID NO: 146533 - DNA, 20 bp, human
gacgagggaggtctcatcgg

SEQ ID NO: 146534 - DNA, 20 bp, human
gttcccagcccgcttaagga

SEQ ID NO: 146535 - DNA, 20 bp, human
gcttatgacacagggagggt

SEQ ID NO: 146536 - DNA, 20 bp, human
gctgtacgcggagaacgctg

SEQ ID NO: 146537 - DNA, 20 bp, human
gcgcgtacaggtggtctctt

SEQ ID NO: 146538 - DNA, 20 bp, human
gtgggagcgcgggtgatcat

SEQ ID NO: 146539 - DNA, 20 bp, human
ggtgggcgagctcatagtcc

SEQ ID NO: 146540 - DNA, 20 bp, human
gtgatcaccggggcgaacag

SEQ ID NO: 146541 - DNA, 20 bp, human
gggaagactgtgctgatcac

SEQ ID NO: 146542 - DNA, 20 bp, human
gttgggttccggtaaggcgg

SEQ ID NO: 146543 - DNA, 20 bp, human
gggaccccggcctcatgcac

SEQ ID NO: 146544 - DNA, 20 bp, human
gggtctcttgggttccggta

SEQ ID NO: 146545 - DNA, 20 bp, human
gctcttgggttccggtaagg

SEQ ID NO: 146546 - DNA, 20 bp, human
ggttgctgcagccgcccagt

SEQ ID NO: 146547 - DNA, 20 bp, human
gtgtgggggaaaccagagtc

SEQ ID NO: 146548 - DNA, 20 bp, human
gcagacttgacaaacctggg

SEQ ID NO: 146549 - DNA, 20 bp, human
gagaaaggcagtcatcaggg

SEQ ID NO: 146550 - DNA, 20 bp, human
gagacagacttgacaaacct

SEQ ID NO: 146551 - DNA, 20 bp, human
ggcagaggacagacacagac

SEQ ID NO: 146552 - DNA, 20 bp, human
ggagacaaaggtaaccaccc

SEQ ID NO: 146553 - DNA, 20 bp, human
ggccctcaggcattttggca

SEQ ID NO: 146554 - DNA, 20 bp, human
gacagacacagacaggctgt

SEQ ID NO: 146555 - DNA, 20 bp, human
gttgcagaaaggcagtcatc

SEQ ID NO: 146556 - DNA, 20 bp, human
gtagcagtagttagtgtggg

SEQ ID NO: 146557 - DNA, 20 bp, human
gccttagcagtagttagtgt

SEQ ID NO: 146558 - DNA, 20 bp, human
gcctggtttagaaggagagg

SEQ ID NO: 146559 - DNA, 20 bp, human
gctaaggccaaagtccggag

SEQ ID NO: 146560 - DNA, 20 bp, human
gactctgaggtggacctggt

SEQ ID NO: 146561 - DNA, 20 bp, human
gggccaaagtccggagtggg

SEQ ID NO: 146562 - DNA, 20 bp, human
ggtccctggtttagaaggag

SEQ ID NO: 146563 - DNA, 20 bp, human
gtacctcctgtggcgaaagc

SEQ ID NO: 146564 - DNA, 20 bp, human
ggacccaggttgcatataga

SEQ ID NO: 146565 - DNA, 20 bp, human
gcacaactctgaggtggacc

SEQ ID NO: 146566 - DNA, 20 bp, human
gaggtcacgagtccagggag

SEQ ID NO: 146567 - DNA, 20 bp, human
gcggagatcaacacagtccg

SEQ ID NO: 146568 - DNA, 20 bp, human
gggcggaggtcacgagtcca

SEQ ID NO: 146569 - DNA, 20 bp, human
gtccagggaggggatcaaca

SEQ ID NO: 146570 - DNA, 20 bp, human
gtgctcatcaggaattggtc

SEQ ID NO: 146571 - DNA, 20 bp, human
gctcaggacgggtgtcatgt

SEQ ID NO: 146572 - DNA, 20 bp, human
gcagctgggagggatgggta

SEQ ID NO: 146573 - DNA, 20 bp, human
gaacacagtccggggtgcag

SEQ ID NO: 146574 - DNA, 20 bp, human
gtagcgcttcttggggtcat

SEQ ID NO: 146575 - DNA, 20 bp, human
ggccatgttgatcccctccc

SEQ ID NO: 146576 - DNA, 20 bp, human
gttgcgcaggcgcaatgctg

SEQ ID NO: 146577 - DNA, 20 bp, human
ggaactcccagtcagcgggt

SEQ ID NO: 146578 - DNA, 20 bp, human
gagggttagccgcgcaggtg

SEQ ID NO: 146579 - DNA, 20 bp, human
gagaggtttggggaatatga

SEQ ID NO: 146580 - DNA, 20 bp, human
gtcaggcaggtgagggtctg

SEQ ID NO: 146581 - DNA, 20 bp, human
gaggttttgtcactctcgat

SEQ ID NO: 146582 - DNA, 20 bp, human
gctccggaactcccagtcag

SEQ ID NO: 146583 - DNA, 20 bp, human
gtgaacagagaatgctgtgg

SEQ ID NO: 146584 - DNA, 20 bp, human
gtccttcgcgaagagaggtt

SEQ ID NO: 146585 - DNA, 20 bp, human
gtcgcatccttcgcgaagag

SEQ ID NO: 146586 - DNA, 20 bp, human
gcgaggaaaggagaatcccg

SEQ ID NO: 146587 - DNA, 20 bp, human
gcatattgcggagctgtctg

SEQ ID NO: 146588 - DNA, 20 bp, human
gggcgcggctgcgacaggga

SEQ ID NO: 146589 - DNA, 20 bp, human
ggcgccgagcggccatattg

SEQ ID NO: 146590 - DNA, 20 bp, human
ggactccgcgccccgaggaa

SEQ ID NO: 146591 - DNA, 20 bp, human
gcggcggcgcggctgcgaca

SEQ ID NO: 146592 - DNA, 20 bp, human
gcgaggccctgcccgagtcg

SEQ ID NO: 146593 - DNA, 20 bp, human
gggcgctgggggtccgacac

SEQ ID NO: 146594 - DNA, 20 bp, human
gtccggagacgctaaggtgg

SEQ ID NO: 146595 - DNA, 20 bp, human
gtcctccggagacgctaagg

SEQ ID NO: 146596 - DNA, 20 bp, human
ggatctagtcctgcagtagg

SEQ ID NO: 146597 - DNA, 20 bp, human
ggcggcccggggccacaccg

SEQ ID NO: 146598 - DNA, 20 bp, human
gggccttgcactggcttggg

SEQ ID NO: 146599 - DNA, 20 bp, human
gtcctgcagtaggcggcccg

SEQ ID NO: 146600 - DNA, 20 bp, human
gaggcccctgggccttgcac

SEQ ID NO: 146601 - DNA, 20 bp, human
gtctaatgaggagcgaggtg

SEQ ID NO: 146602 - DNA, 20 bp, human
gcaggactagatcgcaccgc

SEQ ID NO: 146603 - DNA, 20 bp, human
gggagcgatgtcaggcccct

SEQ ID NO: 146604 - DNA, 20 bp, human
gtctgagtcggaattcttta

SEQ ID NO: 146605 - DNA, 20 bp, human
gatcgagggtgaaagaccag

SEQ ID NO: 146606 - DNA, 20 bp, human
ggctgggtccgagcatcccg

SEQ ID NO: 146607 - DNA, 20 bp, human
gtcgccatgtccgggccggg

SEQ ID NO: 146608 - DNA, 20 bp, human
gccgaagagggggcccgtgt

SEQ ID NO: 146609 - DNA, 20 bp, human
gccggacggtcgccatgtcc

SEQ ID NO: 146610 - DNA, 20 bp, human
ggtcggtgggtgacagacca

SEQ ID NO: 146611 - DNA, 20 bp, human
gcgcccagaagatcttgggg

SEQ ID NO: 146612 - DNA, 20 bp, human
gtccagagccgcgggatgct

SEQ ID NO: 146613 - DNA, 20 bp, human
ggagccgcccggcccggaca

SEQ ID NO: 146614 - DNA, 20 bp, human
gagcagcagaggcaagcgaa

SEQ ID NO: 146615 - DNA, 20 bp, human
ggtctgtcacccaccgacac

SEQ ID NO: 146616 - DNA, 20 bp, human
ggaagcccggtctaactctc

SEQ ID NO: 146617 - DNA, 20 bp, human
gagatcggagagtcggacac

SEQ ID NO: 146618 - DNA, 20 bp, human
ggtgtcggagatccgagagt

SEQ ID NO: 146619 - DNA, 20 bp, human
gtccgctactgtgaagcagg

SEQ ID NO: 146620 - DNA, 20 bp, human
ggagtcggagatcggagagt

SEQ ID NO: 146621 - DNA, 20 bp, human
gtgagaactcgggcctttag

SEQ ID NO: 146622 - DNA, 20 bp, human
gagatccgagagtcggagat

SEQ ID NO: 146623 - DNA, 20 bp, human
gggcccgagttctcagagca

SEQ ID NO: 146624 - DNA, 20 bp, human
ggtataagctaggcatccac

SEQ ID NO: 146625 - DNA, 20 bp, human
gcaggcgaacgtgcccctaa

SEQ ID NO: 146626 - DNA, 20 bp, human
gcgccaaacagggaagtggg

SEQ ID NO: 146627 - DNA, 20 bp, human
gcggcgccggaggagacccg

SEQ ID NO: 146628 - DNA, 20 bp, human
gacgtcccgcagccgctcca

SEQ ID NO: 146629 - DNA, 20 bp, human
ggggcgagaagacaccgggt

SEQ ID NO: 146630 - DNA, 20 bp, human
ggccgtggggcacagaactt

SEQ ID NO: 146631 - DNA, 20 bp, human
gcccgccactccgccaaaca

SEQ ID NO: 146632 - DNA, 20 bp, human
gagctccgagtcgctccccg

SEQ ID NO: 146633 - DNA, 20 bp, human
ggagcggctgcgggacgtgc

SEQ ID NO: 146634 - DNA, 20 bp, human
gtggctgtcggcccccgcga

SEQ ID NO: 146635 - DNA, 20 bp, human
gactccgccaaacagggaag

SEQ ID NO: 146636 - DNA, 20 bp, human
ggacggatataagattgcgt

SEQ ID NO: 146637 - DNA, 20 bp, human
ggagttggggttgtgtatag

SEQ ID NO: 146638 - DNA, 20 bp, human
ggcgctgggaattcagcttt

SEQ ID NO: 146639 - DNA, 20 bp, human
gctcaggaagacgggagaag

SEQ ID NO: 146640 - DNA, 20 bp, human
gctttggcttctctgagttg

SEQ ID NO: 146641 - DNA, 20 bp, human
gtcagagaagccaaagcgct

SEQ ID NO: 146642 - DNA, 20 bp, human
gggtggaagaacggtcgtcg

SEQ ID NO: 146643 - DNA, 20 bp, human
ggtggagatgttaattactg

SEQ ID NO: 146644 - DNA, 20 bp, human
gctagctctgtgctataccg

SEQ ID NO: 146645 - DNA, 20 bp, human
gattgaactattccaggcca

SEQ ID NO: 146646 - DNA, 20 bp, human
gggcgcgctcagtctggcgg

SEQ ID NO: 146647 - DNA, 20 bp, human
gaacgcgcgaacgccgggca

SEQ ID NO: 146648 - DNA, 20 bp, human
gaccgagctgaggaacaaag

SEQ ID NO: 146649 - DNA, 20 bp, human
gctacagcgcccggtcccag

SEQ ID NO: 146650 - DNA, 20 bp, human
ggcgctcgggggttccgtgg

SEQ ID NO: 146651 - DNA, 20 bp, human
gggctcggctaggctgcggg

SEQ ID NO: 146652 - DNA, 20 bp, human
gcggcccagccccccgcaag

SEQ ID NO: 146653 - DNA, 20 bp, human
gcagccgcggcacgttctgg

SEQ ID NO: 146654 - DNA, 20 bp, human
ggcgccaacgcgcgaacgcc

SEQ ID NO: 146655 - DNA, 20 bp, human
gccgccgccagaacgtgccg

SEQ ID NO: 146656 - DNA, 20 bp, human
ggctcctgcgcccatcctag

SEQ ID NO: 146657 - DNA, 20 bp, human
gtgatgcgggctgtgatgga

SEQ ID NO: 146658 - DNA, 20 bp, human
ggcagggacctcccctttaa

SEQ ID NO: 146659 - DNA, 20 bp, human
ggcccagcgccgccgttaaa

SEQ ID NO: 146660 - DNA, 20 bp, human
ggcttcggagaagtccaccc

SEQ ID NO: 146661 - DNA, 20 bp, human
gcctggtggtgtgagtgcgg

SEQ ID NO: 146662 - DNA, 20 bp, human
ggtgcagcagagtcacctaa

SEQ ID NO: 146663 - DNA, 20 bp, human
gctggaggggggaatattag

SEQ ID NO: 146664 - DNA, 20 bp, human
gtcccccacctagcaggtct

SEQ ID NO: 146665 - DNA, 20 bp, human
gcagcccagacctgctaggt

SEQ ID NO: 146666 - DNA, 20 bp, human
gctgcggaccaggccgccaa

SEQ ID NO: 146667 - DNA, 20 bp, human
gcaccgggcccggctcctga

SEQ ID NO: 146668 - DNA, 20 bp, human
gcccagcgccgccggagcag

SEQ ID NO: 146669 - DNA, 20 bp, human
gagcgacgtggaccaaggtg

SEQ ID NO: 146670 - DNA, 20 bp, human
gcgaggcccaggggagctgt

SEQ ID NO: 146671 - DNA, 20 bp, human
gggccgccgcgcgcacacac

SEQ ID NO: 146672 - DNA, 20 bp, human
ggagggctcccccagaccct

SEQ ID NO: 146673 - DNA, 20 bp, human
ggtgagaggcacttacacca

SEQ ID NO: 146674 - DNA, 20 bp, human
ggaagcgcgcggcctgccgt

SEQ ID NO: 146675 - DNA, 20 bp, human
gggaccaggccgccaacggc

SEQ ID NO: 146676 - DNA, 20 bp, human
ggttgcgaactccgccctgt

SEQ ID NO: 146677 - DNA, 20 bp, human
gggcgcgcccgctcccaagt

SEQ ID NO: 146678 - DNA, 20 bp, human
gccagcaccggcctacaggg

SEQ ID NO: 146679 - DNA, 20 bp, human
gccaccagcaccggcctaca

SEQ ID NO: 146680 - DNA, 20 bp, human
gcgcgccgggccaccagcac

SEQ ID NO: 146681 - DNA, 20 bp, human
gcgagtgctgcccaacccca

SEQ ID NO: 146682 - DNA, 20 bp, human
gggtcctccccacgtcccaa

SEQ ID NO: 146683 - DNA, 20 bp, human
ggcccggcgcgctggaaccg

SEQ ID NO: 146684 - DNA, 20 bp, human
ggctgtggacgtctagtggg

SEQ ID NO: 146685 - DNA, 20 bp, human
gcagaaggacgttcactcaa

SEQ ID NO: 146686 - DNA, 20 bp, human
ggtcgccgctccagtctatc

SEQ ID NO: 146687 - DNA, 20 bp, human
gagtgccggatagactggag

SEQ ID NO: 146688 - DNA, 20 bp, human
gcactaggaacagccccgag

SEQ ID NO: 146689 - DNA, 20 bp, human
gggcgactgcggcggagcag

SEQ ID NO: 146690 - DNA, 20 bp, human
gtagactggagcggcgactg

SEQ ID NO: 146691 - DNA, 20 bp, human
gctcatggccgcagacatgg

SEQ ID NO: 146692 - DNA, 20 bp, human
ggccccgcgaccctcagcct

SEQ ID NO: 146693 - DNA, 20 bp, human
ggcgcaggacagcaggaata

SEQ ID NO: 146694 - DNA, 20 bp, human
gacagccccgagcggcgaga

SEQ ID NO: 146695 - DNA, 20 bp, human
gactggagcggcgactgcgg

SEQ ID NO: 146696 - DNA, 20 bp, human
gcgagctcgcccgcggacca

SEQ ID NO: 146697 - DNA, 20 bp, human
ggcgctggaggccaagaccg

SEQ ID NO: 146698 - DNA, 20 bp, human
gggcggaagctagagagggg

SEQ ID NO: 146699 - DNA, 20 bp, human
gagctcgagcagccaacccc

SEQ ID NO: 146700 - DNA, 20 bp, human
gcccgctaggaccaatggga

SEQ ID NO: 146701 - DNA, 20 bp, human
ggcccggaaggaggcgtcgg

SEQ ID NO: 146702 - DNA, 20 bp, human
gggcgaaacgcgcaggacac

SEQ ID NO: 146703 - DNA, 20 bp, human
ggaagaaccggacttcggca

SEQ ID NO: 146704 - DNA, 20 bp, human
gaactggaagaaccggactt

SEQ ID NO: 146705 - DNA, 20 bp, human
gggtgggtgccctggtccgc

SEQ ID NO: 146706 - DNA, 20 bp, human
gcaactcagactcagccaac

SEQ ID NO: 146707 - DNA, 20 bp, human
ggctagaaagagttggttgg

SEQ ID NO: 146708 - DNA, 20 bp, human
ggtgtctcagaggaccttcc

SEQ ID NO: 146709 - DNA, 20 bp, human
gtggtctcagaaattctgag

SEQ ID NO: 146710 - DNA, 20 bp, human
gtaaagctcctacagctacc

SEQ ID NO: 146711 - DNA, 20 bp, human
gtgagttggcttctcaggcc

SEQ ID NO: 146712 - DNA, 20 bp, human
gagaagggggttctgagaga

SEQ ID NO: 146713 - DNA, 20 bp, human
gagctgtaatgaagcctcag

SEQ ID NO: 146714 - DNA, 20 bp, human
ggagtctgagttggcttctc

SEQ ID NO: 146715 - DNA, 20 bp, human
gtctcagaaattctgagagg

SEQ ID NO: 146716 - DNA, 20 bp, human
gcacttaccaacaggtaaag

SEQ ID NO: 146717 - DNA, 20 bp, human
gaagccacctcaagtggaca

SEQ ID NO: 146718 - DNA, 20 bp, human
gagaagagcatgtctaacgt

SEQ ID NO: 146719 - DNA, 20 bp, human
gatcagcatgaagaacgagt

SEQ ID NO: 146720 - DNA, 20 bp, human
gagggaagaattcagagttg

SEQ ID NO: 146721 - DNA, 20 bp, human
gtaagtgccttgtccacttg

SEQ ID NO: 146722 - DNA, 20 bp, human
gcctgacaagccacctcaag

SEQ ID NO: 146723 - DNA, 20 bp, human
ggtgggggaaaatctcacct

SEQ ID NO: 146724 - DNA, 20 bp, human
gtttggtttggggataacag

SEQ ID NO: 146725 - DNA, 20 bp, human
ggagtaggagctttatatca

SEQ ID NO: 146726 - DNA, 20 bp, human
gtgagagaagatgagaccca

SEQ ID NO: 146727 - DNA, 20 bp, human
ggcagcatccaagatacact

SEQ ID NO: 146728 - DNA, 20 bp, human
gatgacacaggagaatacat

SEQ ID NO: 146729 - DNA, 20 bp, human
gtgtctggtcaggaaagagt

SEQ ID NO: 146730 - DNA, 20 bp, human
gaacctgagacagcagcatg

SEQ ID NO: 146731 - DNA, 20 bp, human
gcctcagagctaacaagagg

SEQ ID NO: 146732 - DNA, 20 bp, human
gaatcctcagagctaacaag

SEQ ID NO: 146733 - DNA, 20 bp, human
ggagctactgcacatgacac

SEQ ID NO: 146734 - DNA, 20 bp, human
gttacctctctggtgggata

SEQ ID NO: 146735 - DNA, 20 bp, human
gggccctgcccagtgtatct

SEQ ID NO: 146736 - DNA, 20 bp, human
gttacctctctggtgagatc

SEQ ID NO: 146737 - DNA, 20 bp, human
gtgtgaggttgcccttccac

SEQ ID NO: 146738 - DNA, 20 bp, human
ggctgtactgggaggtctca

SEQ ID NO: 146739 - DNA, 20 bp, human
gcctcagagccaagaaaagg

SEQ ID NO: 146740 - DNA, 20 bp, human
gaatcctcagagccaagaaa

SEQ ID NO: 146741 - DNA, 20 bp, human
gataatacaggagaacgcat

SEQ ID NO: 146742 - DNA, 20 bp, human
gctcaccttgaacctgacac

SEQ ID NO: 146743 - DNA, 20 bp, human
gtacaggagaacgcatggga

SEQ ID NO: 146744 - DNA, 20 bp, human
ggaggcaatcgggtcactaa

SEQ ID NO: 146745 - DNA, 20 bp, human
gagatctcagggatggtcac

SEQ ID NO: 146746 - DNA, 20 bp, human
ggcgaggaggattacctgtt

SEQ ID NO: 146747 - DNA, 20 bp, human
gttggcaaccaagactctaa

SEQ ID NO: 146748 - DNA, 20 bp, human
ggcaggggcccttagagtct

SEQ ID NO: 146749 - DNA, 20 bp, human
gaaacgttgactgggaccac

SEQ ID NO: 146750 - DNA, 20 bp, human
gcctggctaatagctgacag

SEQ ID NO: 146751 - DNA, 20 bp, human
gccttcttcagtgtctccag

SEQ ID NO: 146752 - DNA, 20 bp, human
gcctcctcgcggttgatgat

SEQ ID NO: 146753 - DNA, 20 bp, human
gagagtcttggttgccaaac

SEQ ID NO: 146754 - DNA, 20 bp, human
gagctccagaaacgttgact

SEQ ID NO: 146755 - DNA, 20 bp, human
gccttcactgcaaagagcat

SEQ ID NO: 146756 - DNA, 20 bp, human
gtccaccgtacgggagccag

SEQ ID NO: 146757 - DNA, 20 bp, human
gcctgcccctggctcccgta

SEQ ID NO: 146758 - DNA, 20 bp, human
gggcgacgctgggtgacccg

SEQ ID NO: 146759 - DNA, 20 bp, human
gccggggtgcaagaattcag

SEQ ID NO: 146760 - DNA, 20 bp, human
ggcgtcgccgtccaccgtac

SEQ ID NO: 146761 - DNA, 20 bp, human
ggtgtgagccgcaaacccag

SEQ ID NO: 146762 - DNA, 20 bp, human
ggcccctggctcccgtacgg

SEQ ID NO: 146763 - DNA, 20 bp, human
ggagtgctggcccagccgag

SEQ ID NO: 146764 - DNA, 20 bp, human
ggcgccccatgaacactcac

SEQ ID NO: 146765 - DNA, 20 bp, human
ggagccgcaaacccagcgga

SEQ ID NO: 146766 - DNA, 20 bp, human
gcagacgagccattcgccag

SEQ ID NO: 146767 - DNA, 20 bp, human
gccagagggaagctgaatca

SEQ ID NO: 146768 - DNA, 20 bp, human
gacgagccattcgccagagg

SEQ ID NO: 146769 - DNA, 20 bp, human
gccctccacaccgtccatgg

SEQ ID NO: 146770 - DNA, 20 bp, human
gtcgtctgtagtgcacgccg

SEQ ID NO: 146771 - DNA, 20 bp, human
gcccgccccgcgccaccatc

SEQ ID NO: 146772 - DNA, 20 bp, human
gccagagctgcccccatgga

SEQ ID NO: 146773 - DNA, 20 bp, human
ggatgcgttctcccctaata

SEQ ID NO: 146774 - DNA, 20 bp, human
ggcaggcgcggccggattcc

SEQ ID NO: 146775 - DNA, 20 bp, human
gcatttccgcctctggcgaa

SEQ ID NO: 146776 - DNA, 20 bp, human
gcccgctgtagagtgagagg

SEQ ID NO: 146777 - DNA, 20 bp, human
gcgatcgcgggtcggacgag

SEQ ID NO: 146778 - DNA, 20 bp, human
ggccccctctcactctacag

SEQ ID NO: 146779 - DNA, 20 bp, human
gggtcggacgagcggcgcaa

SEQ ID NO: 146780 - DNA, 20 bp, human
ggaccctgaggcaaagaagg

SEQ ID NO: 146781 - DNA, 20 bp, human
ggcgtggcctgactcagaga

SEQ ID NO: 146782 - DNA, 20 bp, human
ggacgcctcgctcgaacctc

SEQ ID NO: 146783 - DNA, 20 bp, human
gacggcccgaggttcgagcg

SEQ ID NO: 146784 - DNA, 20 bp, human
ggcggccgggaggcacggtc

SEQ ID NO: 146785 - DNA, 20 bp, human
gagacactgtattagggcgt

SEQ ID NO: 146786 - DNA, 20 bp, human
gcagcccgccggctccggag

SEQ ID NO: 146787 - DNA, 20 bp, human
gcgggaaggcagagccgctc

SEQ ID NO: 146788 - DNA, 20 bp, human
ggctggggaacacagatcct

SEQ ID NO: 146789 - DNA, 20 bp, human
ggaacacagatcctcggagg

SEQ ID NO: 146790 - DNA, 20 bp, human
gggacgcggcgccctggggg

SEQ ID NO: 146791 - DNA, 20 bp, human
gcccgcactgcccagcgctg

SEQ ID NO: 146792 - DNA, 20 bp, human
gggggaacacagatcctcgg

SEQ ID NO: 146793 - DNA, 20 bp, human
gtcgatcagcccgccggctc

SEQ ID NO: 146794 - DNA, 20 bp, human
ggaggaagcgcccccgaaga

SEQ ID NO: 146795 - DNA, 20 bp, human
gggaggagggcgaagcgacg

SEQ ID NO: 146796 - DNA, 20 bp, human
ggctttgagcgtcccgggtt

SEQ ID NO: 146797 - DNA, 20 bp, human
gtcagctctcccggtatctg

SEQ ID NO: 146798 - DNA, 20 bp, human
gcgtcgcgggcccaggacca

SEQ ID NO: 146799 - DNA, 20 bp, human
gcccgggttgggcagggaac

SEQ ID NO: 146800 - DNA, 20 bp, human
ggcacctttgagggacggag

SEQ ID NO: 146801 - DNA, 20 bp, human
ggctcggtcggggcatctga

SEQ ID NO: 146802 - DNA, 20 bp, human
gcgctcaaagccccagatac

SEQ ID NO: 146803 - DNA, 20 bp, human
gcaaatggccctcgcatcct

SEQ ID NO: 146804 - DNA, 20 bp, human
ggagcgtcccgggttgggca

SEQ ID NO: 146805 - DNA, 20 bp, human
ggccagttccctgcccaacc

SEQ ID NO: 146806 - DNA, 20 bp, human
ggccgaggggcgtcgcgcag

SEQ ID NO: 146807 - DNA, 20 bp, human
ggaggggcgtcgcgcagagg

SEQ ID NO: 146808 - DNA, 20 bp, human
ggaagttccgcgggagacgg

SEQ ID NO: 146809 - DNA, 20 bp, human
gtcccggaacgtagtaggtg

SEQ ID NO: 146810 - DNA, 20 bp, human
ggaggagccacgcggagaga

SEQ ID NO: 146811 - DNA, 20 bp, human
gccgcgtggctcctccgtcc

SEQ ID NO: 146812 - DNA, 20 bp, human
gacgcccctcggccaggcct

SEQ ID NO: 146813 - DNA, 20 bp, human
gccgcgggagcgcgggaccg

SEQ ID NO: 146814 - DNA, 20 bp, human
gccttccagctccccgtggt

SEQ ID NO: 146815 - DNA, 20 bp, human
gtgggtgcacaggaaaaaga

SEQ ID NO: 146816 - DNA, 20 bp, human
gcgcggcgccgagtcgaacg

SEQ ID NO: 146817 - DNA, 20 bp, human
gcttcctcagagacacgggg

SEQ ID NO: 146818 - DNA, 20 bp, human
gccgcaccacaacctggtct

SEQ ID NO: 146819 - DNA, 20 bp, human
gacgcgaggcgggaggagtg

SEQ ID NO: 146820 - DNA, 20 bp, human
gctcggctccccgttcgact

SEQ ID NO: 146821 - DNA, 20 bp, human
gggccgcggagagcagactc

SEQ ID NO: 146822 - DNA, 20 bp, human
gagcgggatacggaccctag

SEQ ID NO: 146823 - DNA, 20 bp, human
gcgcaggctgcgcggctgtc

SEQ ID NO: 146824 - DNA, 20 bp, human
gcacggggctcggagactgg

SEQ ID NO: 146825 - DNA, 20 bp, human
ggcggaacttgcggtgtgag

SEQ ID NO: 146826 - DNA, 20 bp, human
gagcgttggcaggaataggg

SEQ ID NO: 146827 - DNA, 20 bp, human
ggccggtcaggccccaggtt

SEQ ID NO: 146828 - DNA, 20 bp, human
gtgtgtgaaaaattcaggag

SEQ ID NO: 146829 - DNA, 20 bp, human
gcgtccccaaaagcagttgg

SEQ ID NO: 146830 - DNA, 20 bp, human
gtctgaagaccctcacccta

SEQ ID NO: 146831 - DNA, 20 bp, human
gcggacccagactccaggaa

SEQ ID NO: 146832 - DNA, 20 bp, human
gcagggctttacctcggcgt

SEQ ID NO: 146833 - DNA, 20 bp, human
gaaaccgcgtccctagggtg

SEQ ID NO: 146834 - DNA, 20 bp, human
ggctttacctcggcgtggga

SEQ ID NO: 146835 - DNA, 20 bp, human
gcgcggttcccatggcacta

SEQ ID NO: 146836 - DNA, 20 bp, human
ggagggtgctgcgagctgct

SEQ ID NO: 146837 - DNA, 20 bp, human
ggtggggaggtcagaactag

SEQ ID NO: 146838 - DNA, 20 bp, human
gggacgcccacaccaggtga

SEQ ID NO: 146839 - DNA, 20 bp, human
gaccaggtgagggctaacct

SEQ ID NO: 146840 - DNA, 20 bp, human
gctggacacagacatggaca

SEQ ID NO: 146841 - DNA, 20 bp, human
gacaggcaggggctaccccg

SEQ ID NO: 146842 - DNA, 20 bp, human
gggtgtgggcgtccctggag

SEQ ID NO: 146843 - DNA, 20 bp, human
gaccccggggaactattgta

SEQ ID NO: 146844 - DNA, 20 bp, human
gctgtgattcccaggcttgt

SEQ ID NO: 146845 - DNA, 20 bp, human
gggttccggctgaaaccatg

SEQ ID NO: 146846 - DNA, 20 bp, human
gccatgcttccctcagtctg

SEQ ID NO: 146847 - DNA, 20 bp, human
ggtgtctgtcgggagaccaa

SEQ ID NO: 146848 - DNA, 20 bp, human
gtcagctggacagggaagta

SEQ ID NO: 146849 - DNA, 20 bp, human
gctctctctgagatccactg

SEQ ID NO: 146850 - DNA, 20 bp, human
gtgagctcctcaagtgcaag

SEQ ID NO: 146851 - DNA, 20 bp, human
ggtcgggagaccaaaggtac

SEQ ID NO: 146852 - DNA, 20 bp, human
gccttacgatcagctggaca

SEQ ID NO: 146853 - DNA, 20 bp, human
gaagaagggcatgggtggtt

SEQ ID NO: 146854 - DNA, 20 bp, human
gaccgcatgtggaaaagcca

SEQ ID NO: 146855 - DNA, 20 bp, human
gtgaatattaagaagggcat

SEQ ID NO: 146856 - DNA, 20 bp, human
ggagcaggagggatgagcaa

SEQ ID NO: 146857 - DNA, 20 bp, human
gactctgtctggcttcctag

SEQ ID NO: 146858 - DNA, 20 bp, human
gagcgcgacaggccagtggt

SEQ ID NO: 146859 - DNA, 20 bp, human
gtcccagcgcgacaggccag

SEQ ID NO: 146860 - DNA, 20 bp, human
gtgagaaggggcctcaggaa

SEQ ID NO: 146861 - DNA, 20 bp, human
ggaccgcgaccaactctgtc

SEQ ID NO: 146862 - DNA, 20 bp, human
gcacgtgaagaagcccctgt

SEQ ID NO: 146863 - DNA, 20 bp, human
gaggcagggttagcaaagtc

SEQ ID NO: 146864 - DNA, 20 bp, human
ggggcctaggtcccatgtgg

SEQ ID NO: 146865 - DNA, 20 bp, human
gtggggccagcaaatctgtg

SEQ ID NO: 146866 - DNA, 20 bp, human
gcacaaggcttagattccac

SEQ ID NO: 146867 - DNA, 20 bp, human
gcagtctgcaccaaacagga

SEQ ID NO: 146868 - DNA, 20 bp, human
ggggaggccacatctgttaa

SEQ ID NO: 146869 - DNA, 20 bp, human
gaaggcttagattccacagg

SEQ ID NO: 146870 - DNA, 20 bp, human
gtgaccacctcacagacgac

SEQ ID NO: 146871 - DNA, 20 bp, human
gcatgaaccattaacagatg

SEQ ID NO: 146872 - DNA, 20 bp, human
gtggaggatattcaaatcca

SEQ ID NO: 146873 - DNA, 20 bp, human
ggtgcccgtcgtctgtgagg

SEQ ID NO: 146874 - DNA, 20 bp, human
gctgggcagagtttacttgg

SEQ ID NO: 146875 - DNA, 20 bp, human
gcagctgggcagagtttact

SEQ ID NO: 146876 - DNA, 20 bp, human
ggaggctctgagctcctcta

SEQ ID NO: 146877 - DNA, 20 bp, human
ggagcgagagtgggccgcgg

SEQ ID NO: 146878 - DNA, 20 bp, human
ggcccgtccatggagcccga

SEQ ID NO: 146879 - DNA, 20 bp, human
ggccagccgcgatgcggaag

SEQ ID NO: 146880 - DNA, 20 bp, human
ggacgctgctggatctgcgg

SEQ ID NO: 146881 - DNA, 20 bp, human
gacgcatcagtacaaaaggg

SEQ ID NO: 146882 - DNA, 20 bp, human
ggacacgcatcagtacaaaa

SEQ ID NO: 146883 - DNA, 20 bp, human
gagtacaaaagggcggtgtg

SEQ ID NO: 146884 - DNA, 20 bp, human
gcatcgcggctggccgcggg

SEQ ID NO: 146885 - DNA, 20 bp, human
ggggacgcggcgcccgtcca

SEQ ID NO: 146886 - DNA, 20 bp, human
ggccggggcactgtaaatgg

SEQ ID NO: 146887 - DNA, 20 bp, human
gcggccgccgctgtcactgt

SEQ ID NO: 146888 - DNA, 20 bp, human
gcccgagcaacagggcccgg

SEQ ID NO: 146889 - DNA, 20 bp, human
gcaggtgcgcccgagcaaca

SEQ ID NO: 146890 - DNA, 20 bp, human
gagccggaggcgaagatgga

SEQ ID NO: 146891 - DNA, 20 bp, human
gcgggccggggcactgtaaa

SEQ ID NO: 146892 - DNA, 20 bp, human
ggcccggaggtcgcgaggag

SEQ ID NO: 146893 - DNA, 20 bp, human
gtgtaaatggcggcggaggg

SEQ ID NO: 146894 - DNA, 20 bp, human
ggccgaggcgggaagtctgg

SEQ ID NO: 146895 - DNA, 20 bp, human
gggggcactgtaaatggcgg

SEQ ID NO: 146896 - DNA, 20 bp, human
gcccacctggtgcagcgtct

SEQ ID NO: 146897 - DNA, 20 bp, human
gaggccgccagagtcgcccc

SEQ ID NO: 146898 - DNA, 20 bp, human
gcctggtgcagcgtctcggc

SEQ ID NO: 146899 - DNA, 20 bp, human
gcgactctggcggcctcggg

SEQ ID NO: 146900 - DNA, 20 bp, human
gccgaaacaggtcagccacg

SEQ ID NO: 146901 - DNA, 20 bp, human
ggacaaactttgggtctggg

SEQ ID NO: 146902 - DNA, 20 bp, human
gtgtggggcagtgtgtgcgg

SEQ ID NO: 146903 - DNA, 20 bp, human
gggctgcagaaccccagaaa

SEQ ID NO: 146904 - DNA, 20 bp, human
gccccttgctggccccatgg

SEQ ID NO: 146905 - DNA, 20 bp, human
ggccgtgccgggggcgactc

SEQ ID NO: 146906 - DNA, 20 bp, human
gacccctcagggccgcgggt

SEQ ID NO: 146907 - DNA, 20 bp, human
gcgagccgcggtctccctca

SEQ ID NO: 146908 - DNA, 20 bp, human
gtcccccagatgccaagcag

SEQ ID NO: 146909 - DNA, 20 bp, human
gccgcgggaaggaggacggc

SEQ ID NO: 146910 - DNA, 20 bp, human
gtgcggcccgggtggctcga

SEQ ID NO: 146911 - DNA, 20 bp, human
gcctcacggccgcgggaagg

SEQ ID NO: 146912 - DNA, 20 bp, human
gaaggaggacggcggggcac

SEQ ID NO: 146913 - DNA, 20 bp, human
ggcacctcgcagctccgcta

SEQ ID NO: 146914 - DNA, 20 bp, human
gcccgacccgcggccctgag

SEQ ID NO: 146915 - DNA, 20 bp, human
gccaactcgcagcgctgtgg

SEQ ID NO: 146916 - DNA, 20 bp, human
gcaagtcgcaggaaaggtca

SEQ ID NO: 146917 - DNA, 20 bp, human
gggctccctcctcctcggtc

SEQ ID NO: 146918 - DNA, 20 bp, human
gggctccgccaccatcgcgg

SEQ ID NO: 146919 - DNA, 20 bp, human
gcgagcaaccctccgcgctc

SEQ ID NO: 146920 - DNA, 20 bp, human
gcagcggggcgagcgtctcg

SEQ ID NO: 146921 - DNA, 20 bp, human
gggcccagctccggggaaag

SEQ ID NO: 146922 - DNA, 20 bp, human
ggttgctcgcgagcgtctgt

SEQ ID NO: 146923 - DNA, 20 bp, human
gcgcggctccgccaccatcg

SEQ ID NO: 146924 - DNA, 20 bp, human
ggcgagcgtctcggggtgtg

SEQ ID NO: 146925 - DNA, 20 bp, human
gaacagcggcacctccgcga

SEQ ID NO: 146926 - DNA, 20 bp, human
gactagcggcggagggactg

SEQ ID NO: 146927 - DNA, 20 bp, human
gtcgcgctcgctccgactag

SEQ ID NO: 146928 - DNA, 20 bp, human
ggtcggagcgagcgcgagtg

SEQ ID NO: 146929 - DNA, 20 bp, human
gaggagagccctgtcaagat

SEQ ID NO: 146930 - DNA, 20 bp, human
gcgctcgctccgactagcgg

SEQ ID NO: 146931 - DNA, 20 bp, human
gccgccctgggaggagaacc

SEQ ID NO: 146932 - DNA, 20 bp, human
gtgggctgcgcagtgtggga

SEQ ID NO: 146933 - DNA, 20 bp, human
gtcaccgggttctcctccca

SEQ ID NO: 146934 - DNA, 20 bp, human
gcgctccgactagcggcgga

SEQ ID NO: 146935 - DNA, 20 bp, human
gccagcagcctatcttgaca

SEQ ID NO: 146936 - DNA, 20 bp, human
ggttgaagtgagaagtaggt

SEQ ID NO: 146937 - DNA, 20 bp, human
gcagtgtagttccagaaaat

SEQ ID NO: 146938 - DNA, 20 bp, human
ggagcagatgagttctatca

SEQ ID NO: 146939 - DNA, 20 bp, human
gttgctgtcttgggtggtga

SEQ ID NO: 146940 - DNA, 20 bp, human
gtcttgggtggtgaaggaac

SEQ ID NO: 146941 - DNA, 20 bp, human
gtaaaaaaaagcttgtcaca

SEQ ID NO: 146942 - DNA, 20 bp, human
gcccactagttcccaaacaa

SEQ ID NO: 146943 - DNA, 20 bp, human
gactggggtagggagatgtt

SEQ ID NO: 146944 - DNA, 20 bp, human
ggccattgtttgggaactag

SEQ ID NO: 146945 - DNA, 20 bp, human
ggtatgtttatagaatatat

SEQ ID NO: 146946 - DNA, 20 bp, human
gcccggccaagtctcagtga

SEQ ID NO: 146947 - DNA, 20 bp, human
ggtctggactcacgagaagt

SEQ ID NO: 146948 - DNA, 20 bp, human
ggtctagcggaaagaggcat

SEQ ID NO: 146949 - DNA, 20 bp, human
gagaggcataggcttcagat

SEQ ID NO: 146950 - DNA, 20 bp, human
gcagataggctgggcatatg

SEQ ID NO: 146951 - DNA, 20 bp, human
ggccctgcccgcacccccca

SEQ ID NO: 146952 - DNA, 20 bp, human
gtcagtgaaggtagcggcca

SEQ ID NO: 146953 - DNA, 20 bp, human
ggacagcgtctagcggaaag

SEQ ID NO: 146954 - DNA, 20 bp, human
gggtagcggccacggccgag

SEQ ID NO: 146955 - DNA, 20 bp, human
ggtggcctgggagctccgag

SEQ ID NO: 146956 - DNA, 20 bp, human
gtggagtttcgggggagagg

SEQ ID NO: 146957 - DNA, 20 bp, human
ggagaaggagcggcgactca

SEQ ID NO: 146958 - DNA, 20 bp, human
gcgtcctgtgttggaatgtg

SEQ ID NO: 146959 - DNA, 20 bp, human
ggggagggcgcggaaggacg

SEQ ID NO: 146960 - DNA, 20 bp, human
gtgcggctgccgcgagctcg

SEQ ID NO: 146961 - DNA, 20 bp, human
gctgctgcgccgcgagctcg

SEQ ID NO: 146962 - DNA, 20 bp, human
gcggagtcaggcgctgtcca

SEQ ID NO: 146963 - DNA, 20 bp, human
ggcggcgcagcgtcctgtgt

SEQ ID NO: 146964 - DNA, 20 bp, human
gctggcggccgagcaggatc

SEQ ID NO: 146965 - DNA, 20 bp, human
gggccttcctcggtgaggag

SEQ ID NO: 146966 - DNA, 20 bp, human
gggagcccgacgcctcgcga

SEQ ID NO: 146967 - DNA, 20 bp, human
gggcccctccgaccgccccg

SEQ ID NO: 146968 - DNA, 20 bp, human
gcgcccaacgcccagggccg

SEQ ID NO: 146969 - DNA, 20 bp, human
gccaccagcgcctgcctcgg

SEQ ID NO: 146970 - DNA, 20 bp, human
gagccccggggcggtcggag

SEQ ID NO: 146971 - DNA, 20 bp, human
gattgttaggaagaccgtcc

SEQ ID NO: 146972 - DNA, 20 bp, human
gctctccaacactaaaacgg

SEQ ID NO: 146973 - DNA, 20 bp, human
gctccccggccctgggcgtt

SEQ ID NO: 146974 - DNA, 20 bp, human
gaggctcaggacgagtgtcg

SEQ ID NO: 146975 - DNA, 20 bp, human
gggcttctccgaccgccccc

SEQ ID NO: 146976 - DNA, 20 bp, human
gcggacgcgacggacactgg

SEQ ID NO: 146977 - DNA, 20 bp, human
ggggcgcgacgcacgttccg

SEQ ID NO: 146978 - DNA, 20 bp, human
ggctgctgcgcgccctgctt

SEQ ID NO: 146979 - DNA, 20 bp, human
gcagtcccgcgaccgaagca

SEQ ID NO: 146980 - DNA, 20 bp, human
gctgcccacggcaaacagaa

SEQ ID NO: 146981 - DNA, 20 bp, human
gactcacctttgcctagcag

SEQ ID NO: 146982 - DNA, 20 bp, human
ggcgaagggcaggacgcctc

SEQ ID NO: 146983 - DNA, 20 bp, human
gactgaagcgaggtaagcgc

SEQ ID NO: 146984 - DNA, 20 bp, human
gcggtcgcgggactgaagcg

SEQ ID NO: 146985 - DNA, 20 bp, human
gcggggcgcggcggacgcga

SEQ ID NO: 146986 - DNA, 20 bp, human
gtcccctgtggagcggagga

SEQ ID NO: 146987 - DNA, 20 bp, human
ggccctcccctgtggagcgg

SEQ ID NO: 146988 - DNA, 20 bp, human
gccgaccgagaaacgaactg

SEQ ID NO: 146989 - DNA, 20 bp, human
gttccgcttgaactccacca

SEQ ID NO: 146990 - DNA, 20 bp, human
gagcggggcgcacaccgccg

SEQ ID NO: 146991 - DNA, 20 bp, human
gtcccctcctccgctccaca

SEQ ID NO: 146992 - DNA, 20 bp, human
ggtggagttcaagcggaagg

SEQ ID NO: 146993 - DNA, 20 bp, human
gggccctggaccgcgagcag

SEQ ID NO: 146994 - DNA, 20 bp, human
gcagcgggagaagtacgagc

SEQ ID NO: 146995 - DNA, 20 bp, human
ggtgtacgacgaggacgact

SEQ ID NO: 146996 - DNA, 20 bp, human
gtgtcacttaccctctcggt

SEQ ID NO: 146997 - DNA, 20 bp, human
gacttgggcaagctccccaa

SEQ ID NO: 146998 - DNA, 20 bp, human
gcagagacctcactgatccc

SEQ ID NO: 146999 - DNA, 20 bp, human
gaagtgaggaccccccactt

SEQ ID NO: 147000 - DNA, 20 bp, human
gggaagatccggcccatgga

SEQ ID NO: 147001 - DNA, 20 bp, human
gtgccatggcaccagcgggg

SEQ ID NO: 147002 - DNA, 20 bp, human
gggatcttccccacagggca

SEQ ID NO: 147003 - DNA, 20 bp, human
gggaattcgtgtgccggatt

SEQ ID NO: 147004 - DNA, 20 bp, human
gcagctgtcacttaccctct

SEQ ID NO: 147005 - DNA, 20 bp, human
ggcagggctgatccagctgt

SEQ ID NO: 147006 - DNA, 20 bp, human
gtgtagaaagccctcatcag

SEQ ID NO: 147007 - DNA, 20 bp, human
gcaagcccaacccctgatga

SEQ ID NO: 147008 - DNA, 20 bp, human
gtgggcttggttgggatctt

SEQ ID NO: 147009 - DNA, 20 bp, human
gagaacagcgtcatcagtac

SEQ ID NO: 147010 - DNA, 20 bp, human
gacaaggactagccaggcaa

SEQ ID NO: 147011 - DNA, 20 bp, human
gcaagacttcaaacacgggt

SEQ ID NO: 147012 - DNA, 20 bp, human
gttggttgggatcttgggat

SEQ ID NO: 147013 - DNA, 20 bp, human
gcattcagagaaggtctaca

SEQ ID NO: 147014 - DNA, 20 bp, human
gatcagtactggatctcttt

SEQ ID NO: 147015 - DNA, 20 bp, human
gcaggacactgactctgtac

SEQ ID NO: 147016 - DNA, 20 bp, human
gccgggaatagtagtcccaa

SEQ ID NO: 147017 - DNA, 20 bp, human
gggcggagccacagtcctag

SEQ ID NO: 147018 - DNA, 20 bp, human
gacccgacgccggcgtgatg

SEQ ID NO: 147019 - DNA, 20 bp, human
gggcagccgctaccagacgt

SEQ ID NO: 147020 - DNA, 20 bp, human
gctattcccggggcctacta

SEQ ID NO: 147021 - DNA, 20 bp, human
ggagccacggggattacaag

SEQ ID NO: 147022 - DNA, 20 bp, human
gggcgtcgggtcgggtaaat

SEQ ID NO: 147023 - DNA, 20 bp, human
gggcgtgatgtggcttccgc

SEQ ID NO: 147024 - DNA, 20 bp, human
ggccacatcacgccggcgtc

SEQ ID NO: 147025 - DNA, 20 bp, human
gtaaggcccacgtctggtag

SEQ ID NO: 147026 - DNA, 20 bp, human
gcggccgcgccatgacggaa

SEQ ID NO: 147027 - DNA, 20 bp, human
gcggcggctgcgagcgtcag

SEQ ID NO: 147028 - DNA, 20 bp, human
ggcgccatgacggaagggaa

SEQ ID NO: 147029 - DNA, 20 bp, human
gggaccgcggcgctgctcag

SEQ ID NO: 147030 - DNA, 20 bp, human
ggcgcgcgcgctaaccggag

SEQ ID NO: 147031 - DNA, 20 bp, human
gttggttgccgcgagcgtgg

SEQ ID NO: 147032 - DNA, 20 bp, human
gccctcgccagggaccaggg

SEQ ID NO: 147033 - DNA, 20 bp, human
gcacacattacataacccgg

SEQ ID NO: 147034 - DNA, 20 bp, human
gggctgcgagcgtcagggga

SEQ ID NO: 147035 - DNA, 20 bp, human
ggagcgcgcgcggaacgcta

SEQ ID NO: 147036 - DNA, 20 bp, human
gccaccgccgggaatcacac

SEQ ID NO: 147037 - DNA, 20 bp, human
ggagcccgtgtgattcccgg

SEQ ID NO: 147038 - DNA, 20 bp, human
gctgccgggtcgccagtgaa

SEQ ID NO: 147039 - DNA, 20 bp, human
gcctgtcaagaaggtgccgg

SEQ ID NO: 147040 - DNA, 20 bp, human
gcgagtcttcggagcgaccc

SEQ ID NO: 147041 - DNA, 20 bp, human
gctccgaagactcgcaccac

SEQ ID NO: 147042 - DNA, 20 bp, human
ggaagccctcgagctttcgt

SEQ ID NO: 147043 - DNA, 20 bp, human
gagcaccgacgaaagctcga

SEQ ID NO: 147044 - DNA, 20 bp, human
gcacggacgcaaccactggg

SEQ ID NO: 147045 - DNA, 20 bp, human
ggcacacgcgcacacgccac

SEQ ID NO: 147046 - DNA, 20 bp, human
gttgcaccgggtcccagggt

SEQ ID NO: 147047 - DNA, 20 bp, human
gggccccagggccccctcac

SEQ ID NO: 147048 - DNA, 20 bp, human
ggggcgccccagaccaatag

SEQ ID NO: 147049 - DNA, 20 bp, human
gtgctttgcaccgggtccca

SEQ ID NO: 147050 - DNA, 20 bp, human
gccgcgggaggaagtaagga

SEQ ID NO: 147051 - DNA, 20 bp, human
ggcgtcccgagggcctccgg

SEQ ID NO: 147052 - DNA, 20 bp, human
gcgaccgcggcgccagtgag

SEQ ID NO: 147053 - DNA, 20 bp, human
gggccccgcggtgccggaag

SEQ ID NO: 147054 - DNA, 20 bp, human
gcgaccttcggcggctgtag

SEQ ID NO: 147055 - DNA, 20 bp, human
gacggccgcgggaggaagta

SEQ ID NO: 147056 - DNA, 20 bp, human
ggagccggcgcaccgtacgc

SEQ ID NO: 147057 - DNA, 20 bp, human
gcaccgtacgctgggacgtg

SEQ ID NO: 147058 - DNA, 20 bp, human
gggagccgcctagcatcacc

SEQ ID NO: 147059 - DNA, 20 bp, human
gagcgccggctgcgagactg

SEQ ID NO: 147060 - DNA, 20 bp, human
gacatctgggcggaggggta

SEQ ID NO: 147061 - DNA, 20 bp, human
gagtccacatctgggcggag

SEQ ID NO: 147062 - DNA, 20 bp, human
ggctggtcccgggtgatgct

SEQ ID NO: 147063 - DNA, 20 bp, human
gggtcccgggtgatgctagg

SEQ ID NO: 147064 - DNA, 20 bp, human
gaagggaggagtcctccgtg

SEQ ID NO: 147065 - DNA, 20 bp, human
ggtagggcttctttccacaa

SEQ ID NO: 147066 - DNA, 20 bp, human
gcccgtccaggaaaagactc

SEQ ID NO: 147067 - DNA, 20 bp, human
gtggacggggtccctgcggt

SEQ ID NO: 147068 - DNA, 20 bp, human
gacgcgtgcggggtctcttc

SEQ ID NO: 147069 - DNA, 20 bp, human
gcgcgacggagggaaagact

SEQ ID NO: 147070 - DNA, 20 bp, human
gagccccaaaagacctgtaa

SEQ ID NO: 147071 - DNA, 20 bp, human
gtcccgcagaacgcgacgga

SEQ ID NO: 147072 - DNA, 20 bp, human
gtcattcccgcagaacgcga

SEQ ID NO: 147073 - DNA, 20 bp, human
ggctgcgcagcgctccgccc

SEQ ID NO: 147074 - DNA, 20 bp, human
gaactggaaggcgctgcaag

SEQ ID NO: 147075 - DNA, 20 bp, human
ggcacgcacgctccagtccc

SEQ ID NO: 147076 - DNA, 20 bp, human
ggaatctgttatcgaggctc

SEQ ID NO: 147077 - DNA, 20 bp, human
gtgcaagaaggcgaagacag

SEQ ID NO: 147078 - DNA, 20 bp, human
gacttcgcgggagaagttgt

SEQ ID NO: 147079 - DNA, 20 bp, human
gtggcggtgggtggttccgg

SEQ ID NO: 147080 - DNA, 20 bp, human
gtggttccggaggctagcaa

SEQ ID NO: 147081 - DNA, 20 bp, human
gccccgccccccactcttgg

SEQ ID NO: 147082 - DNA, 20 bp, human
ggttgaggaatctgttatcg

SEQ ID NO: 147083 - DNA, 20 bp, human
gtctcccgcgaagtgcaaga

SEQ ID NO: 147084 - DNA, 20 bp, human
ggcactcctggtatgcaggg

SEQ ID NO: 147085 - DNA, 20 bp, human
gtcgccttcttgcacttcgc

SEQ ID NO: 147086 - DNA, 20 bp, human
gagaggaggcgcgagaatgg

SEQ ID NO: 147087 - DNA, 20 bp, human
gggaggcgcgagaatggagg

SEQ ID NO: 147088 - DNA, 20 bp, human
gcagagtaggtggccacccg

SEQ ID NO: 147089 - DNA, 20 bp, human
gacggcctgggacctcacca

SEQ ID NO: 147090 - DNA, 20 bp, human
ggtgctccggagaaactcgg

SEQ ID NO: 147091 - DNA, 20 bp, human
gggaagaggaggcgcgagaa

SEQ ID NO: 147092 - DNA, 20 bp, human
gggagaaactcgggggtcag

SEQ ID NO: 147093 - DNA, 20 bp, human
gaaaccaactaggtcagagt

SEQ ID NO: 147094 - DNA, 20 bp, human
gtgcctcgggtggcgggaag

SEQ ID NO: 147095 - DNA, 20 bp, human
gtgacaattagggctacccc

SEQ ID NO: 147096 - DNA, 20 bp, human
gccgatacttgtccacccag

SEQ ID NO: 147097 - DNA, 20 bp, human
gggacggctggactatcaca

SEQ ID NO: 147098 - DNA, 20 bp, human
gtgatagtccagccgtccca

SEQ ID NO: 147099 - DNA, 20 bp, human
gtggcagctcgagttcccgg

SEQ ID NO: 147100 - DNA, 20 bp, human
gttgtccacccagaggctca

SEQ ID NO: 147101 - DNA, 20 bp, human
ggaagcactgctcctcaggg

SEQ ID NO: 147102 - DNA, 20 bp, human
gcagcaagtgcaaaattccc

SEQ ID NO: 147103 - DNA, 20 bp, human
gaggccggcgtagccgatag

SEQ ID NO: 147104 - DNA, 20 bp, human
gccagccgtcccaaggagca

SEQ ID NO: 147105 - DNA, 20 bp, human
gcagaaatccgagcaaagag

SEQ ID NO: 147106 - DNA, 20 bp, human
gcgttccgtggcgggaactg

SEQ ID NO: 147107 - DNA, 20 bp, human
gcgggaactgaggcgactgt

SEQ ID NO: 147108 - DNA, 20 bp, human
gacctcacaaggggcatcaa

SEQ ID NO: 147109 - DNA, 20 bp, human
ggaacggcgggcgaaaagca

SEQ ID NO: 147110 - DNA, 20 bp, human
ggggcatcaagggcaggagt

SEQ ID NO: 147111 - DNA, 20 bp, human
ggtcgcctcagttcccgcca

SEQ ID NO: 147112 - DNA, 20 bp, human
gaggtggaagacctcacaag

SEQ ID NO: 147113 - DNA, 20 bp, human
gttcgcccgccgttccgtgg

SEQ ID NO: 147114 - DNA, 20 bp, human
gcagtgatcgtaagtctcct

SEQ ID NO: 147115 - DNA, 20 bp, human
ggggcctgcaagatgctgtc

SEQ ID NO: 147116 - DNA, 20 bp, human
gggtcactgtgcaggcgctt

SEQ ID NO: 147117 - DNA, 20 bp, human
gggtgacgcgacgatctcag

SEQ ID NO: 147118 - DNA, 20 bp, human
ggggtctcagggtcaggtcg

SEQ ID NO: 147119 - DNA, 20 bp, human
gcatttgccgaagaagaagg

SEQ ID NO: 147120 - DNA, 20 bp, human
gctccatggcggggagacga

SEQ ID NO: 147121 - DNA, 20 bp, human
ggcacctggtgacagcacag

SEQ ID NO: 147122 - DNA, 20 bp, human
gagtgctgaggtctccatgg

SEQ ID NO: 147123 - DNA, 20 bp, human
gctgtaagtgccagggtctc

SEQ ID NO: 147124 - DNA, 20 bp, human
ggagacgacgggaagaggtc

SEQ ID NO: 147125 - DNA, 20 bp, human
gttgcaggcgtcaggagacg

SEQ ID NO: 147126 - DNA, 20 bp, human
ggaggcggagcgaggactcg

SEQ ID NO: 147127 - DNA, 20 bp, human
gcagtagcgtcacgcggagg

SEQ ID NO: 147128 - DNA, 20 bp, human
gtctcgacacagactccagg

SEQ ID NO: 147129 - DNA, 20 bp, human
gccgcgcacgtctggagctc

SEQ ID NO: 147130 - DNA, 20 bp, human
gctcgtgcagtagcgtcacg

SEQ ID NO: 147131 - DNA, 20 bp, human
ggtgcgcggcgcctcgacgg

SEQ ID NO: 147132 - DNA, 20 bp, human
gccaggaggcgagtatctcc

SEQ ID NO: 147133 - DNA, 20 bp, human
gcccgcgtaccccccttagg

SEQ ID NO: 147134 - DNA, 20 bp, human
gtcgaggcgccgcgcacgtc

SEQ ID NO: 147135 - DNA, 20 bp, human
ggagacctgccacctaaggg

SEQ ID NO: 147136 - DNA, 20 bp, human
ggcggtcgcgacatcctcac

SEQ ID NO: 147137 - DNA, 20 bp, human
gcccagagacgccgccgcgg

SEQ ID NO: 147138 - DNA, 20 bp, human
gccccaagcgccctgcagac

SEQ ID NO: 147139 - DNA, 20 bp, human
ggtcgcgacatcctcacggg

SEQ ID NO: 147140 - DNA, 20 bp, human
gtcccggccgcggacgcctc

SEQ ID NO: 147141 - DNA, 20 bp, human
gggatgtcgcgaccgccccc

SEQ ID NO: 147142 - DNA, 20 bp, human
ggggcgcttggggataatcg

SEQ ID NO: 147143 - DNA, 20 bp, human
ggaaagcgtttcacctgtgg

SEQ ID NO: 147144 - DNA, 20 bp, human
gagccccagagacgccgccg

SEQ ID NO: 147145 - DNA, 20 bp, human
gcacctgtgggggcagtaac

SEQ ID NO: 147146 - DNA, 20 bp, human
ggcggtatttgttgggtcgg

SEQ ID NO: 147147 - DNA, 20 bp, human
ggcgcccggcggtatttgtt

SEQ ID NO: 147148 - DNA, 20 bp, human
ggagctgcgtctccgctgga

SEQ ID NO: 147149 - DNA, 20 bp, human
gccccgggccgggtcacgtg

SEQ ID NO: 147150 - DNA, 20 bp, human
gcagctcctcaggcgcccgg

SEQ ID NO: 147151 - DNA, 20 bp, human
gggtcctccgccacagacaa

SEQ ID NO: 147152 - DNA, 20 bp, human
gagcggagacgcagctcctc

SEQ ID NO: 147153 - DNA, 20 bp, human
gtcacacccggcacttactt

SEQ ID NO: 147154 - DNA, 20 bp, human
ggtccggaggccccacgccc

SEQ ID NO: 147155 - DNA, 20 bp, human
gccgagcggactgcattatg

SEQ ID NO: 147156 - DNA, 20 bp, human
ggcgctgcgagcggagaacc

SEQ ID NO: 147157 - DNA, 20 bp, human
gcctggccggagccgtgggt

SEQ ID NO: 147158 - DNA, 20 bp, human
gggacccccggcgctgcgag

SEQ ID NO: 147159 - DNA, 20 bp, human
gccccgcgcggagcctccgg

SEQ ID NO: 147160 - DNA, 20 bp, human
gtgcgagcggagaacctggc

SEQ ID NO: 147161 - DNA, 20 bp, human
gtgggccgggcctagaccct

SEQ ID NO: 147162 - DNA, 20 bp, human
gagctcagggtcgtccccgt

SEQ ID NO: 147163 - DNA, 20 bp, human
gggagcgagaaaggctcggg

SEQ ID NO: 147164 - DNA, 20 bp, human
gtcggtgaagataaacgtct

SEQ ID NO: 147165 - DNA, 20 bp, human
ggccgggcctagaccctggg

SEQ ID NO: 147166 - DNA, 20 bp, human
gactgtgctctgaactgagg

SEQ ID NO: 147167 - DNA, 20 bp, human
gccaggggaaaagtgcacaa

SEQ ID NO: 147168 - DNA, 20 bp, human
gatgggtgctgccgtgtcac

SEQ ID NO: 147169 - DNA, 20 bp, human
ggaggaagggtccattctac

SEQ ID NO: 147170 - DNA, 20 bp, human
ggaacaaaatcaggcccagt

SEQ ID NO: 147171 - DNA, 20 bp, human
gtgctgggtcaccagtagaa

SEQ ID NO: 147172 - DNA, 20 bp, human
gagggaagaaaatttccgtg

SEQ ID NO: 147173 - DNA, 20 bp, human
gctggctcaggctcagttgc

SEQ ID NO: 147174 - DNA, 20 bp, human
gttctagaagtgacaaagct

SEQ ID NO: 147175 - DNA, 20 bp, human
gacaaccttttcatgcataa

SEQ ID NO: 147176 - DNA, 20 bp, human
gacctgggcatggagcagat

SEQ ID NO: 147177 - DNA, 20 bp, human
gcgcatggcagggaacttgt

SEQ ID NO: 147178 - DNA, 20 bp, human
gtccatgcccaggttagagg

SEQ ID NO: 147179 - DNA, 20 bp, human
gcccccagcaagccaccccg

SEQ ID NO: 147180 - DNA, 20 bp, human
gcactgcctacagcacggga

SEQ ID NO: 147181 - DNA, 20 bp, human
gggattgagggcgccatcgt

SEQ ID NO: 147182 - DNA, 20 bp, human
gcctacagcacgggaaggtt

SEQ ID NO: 147183 - DNA, 20 bp, human
gggctgcgggaaatgacgtc

SEQ ID NO: 147184 - DNA, 20 bp, human
gtggcagacgcagaagtgcc

SEQ ID NO: 147185 - DNA, 20 bp, human
gcaagcctccagcgtgggac

SEQ ID NO: 147186 - DNA, 20 bp, human
ggtgattctatgtgttgtca

SEQ ID NO: 147187 - DNA, 20 bp, human
gagcctctctagctgccgat

SEQ ID NO: 147188 - DNA, 20 bp, human
gatggggattagctgctgtc

SEQ ID NO: 147189 - DNA, 20 bp, human
gtggtctggtcttgggaagg

SEQ ID NO: 147190 - DNA, 20 bp, human
gtggcccctcattccacatg

SEQ ID NO: 147191 - DNA, 20 bp, human
gtaatccccatgtggaatga

SEQ ID NO: 147192 - DNA, 20 bp, human
ggatgaagcatctcaatttt

SEQ ID NO: 147193 - DNA, 20 bp, human
gttttgtttttgacatcacc

SEQ ID NO: 147194 - DNA, 20 bp, human
ggaaaaatcatctgtgcagt

SEQ ID NO: 147195 - DNA, 20 bp, human
gtttttcctggtctggtctt

SEQ ID NO: 147196 - DNA, 20 bp, human
gtctccctggcccgcaccaa

SEQ ID NO: 147197 - DNA, 20 bp, human
gcagcgaggtgagccacggc

SEQ ID NO: 147198 - DNA, 20 bp, human
gctggagtctggaagcttag

SEQ ID NO: 147199 - DNA, 20 bp, human
gaacttcattagcacagtgg

SEQ ID NO: 147200 - DNA, 20 bp, human
gctgagacttccccttaccg

SEQ ID NO: 147201 - DNA, 20 bp, human
gccaatcagagtagatctag

SEQ ID NO: 147202 - DNA, 20 bp, human
gagtcacttcctgagcacac

SEQ ID NO: 147203 - DNA, 20 bp, human
gaacatagcctagaagagcc

SEQ ID NO: 147204 - DNA, 20 bp, human
gaaggggaagtctcagttcc

SEQ ID NO: 147205 - DNA, 20 bp, human
gctgccgttggtgcgggcca

SEQ ID NO: 147206 - DNA, 20 bp, human
gggtgggtggagacaccctc

SEQ ID NO: 147207 - DNA, 20 bp, human
gcctctggtataaaagcccc

SEQ ID NO: 147208 - DNA, 20 bp, human
gtggtataaaagcccctggc

SEQ ID NO: 147209 - DNA, 20 bp, human
gctcttccctggtaacagtt

SEQ ID NO: 147210 - DNA, 20 bp, human
ggataaggggacctcttccc

SEQ ID NO: 147211 - DNA, 20 bp, human
gacttacctaactgttacca

SEQ ID NO: 147212 - DNA, 20 bp, human
gcttgaatttcgtgagaatt

SEQ ID NO: 147213 - DNA, 20 bp, human
gcaagtgttgtctgaggcca

SEQ ID NO: 147214 - DNA, 20 bp, human
gagtgtgtctgtcatggcct

SEQ ID NO: 147215 - DNA, 20 bp, human
gaaggcgtatgagagtctag

SEQ ID NO: 147216 - DNA, 20 bp, human
gctctgccctggtaacggtt

SEQ ID NO: 147217 - DNA, 20 bp, human
gagttgcctaaccgttacca

SEQ ID NO: 147218 - DNA, 20 bp, human
ggatattgggacctctgccc

SEQ ID NO: 147219 - DNA, 20 bp, human
gattcagaaggagaaaggga

SEQ ID NO: 147220 - DNA, 20 bp, human
gtttaattcagaaggagaaa

SEQ ID NO: 147221 - DNA, 20 bp, human
gagtgtgtctgtcatggagt

SEQ ID NO: 147222 - DNA, 20 bp, human
gaaggcgtatgagaatctag

SEQ ID NO: 147223 - DNA, 20 bp, human
gattgtcaagtctcttgcct

SEQ ID NO: 147224 - DNA, 20 bp, human
gctgtatttctggaggatat

SEQ ID NO: 147225 - DNA, 20 bp, human
gagaggtgagttcaatctta

SEQ ID NO: 147226 - DNA, 20 bp, human
gtctgtagaggtagagacgt

SEQ ID NO: 147227 - DNA, 20 bp, human
ggaaactccgagaggagcag

SEQ ID NO: 147228 - DNA, 20 bp, human
gtctccgcggaaactccgag

SEQ ID NO: 147229 - DNA, 20 bp, human
ggctggaagtctccaagtca

SEQ ID NO: 147230 - DNA, 20 bp, human
gggtataacttaccttgact

SEQ ID NO: 147231 - DNA, 20 bp, human
gaaagcgcaggcgcgaacca

SEQ ID NO: 147232 - DNA, 20 bp, human
gaaacgctggtgtctctccg

SEQ ID NO: 147233 - DNA, 20 bp, human
gtggaaatagcttaaacaga

SEQ ID NO: 147234 - DNA, 20 bp, human
ggctcctctcggagtttccg

SEQ ID NO: 147235 - DNA, 20 bp, human
gggttttcggccgggcgcca

SEQ ID NO: 147236 - DNA, 20 bp, human
gagcctggcgcggaggctat

SEQ ID NO: 147237 - DNA, 20 bp, human
gtcgcgactaaacggagtgg

SEQ ID NO: 147238 - DNA, 20 bp, human
gttatcgcgactaaacggag

SEQ ID NO: 147239 - DNA, 20 bp, human
ggaggctatgggcagccagg

SEQ ID NO: 147240 - DNA, 20 bp, human
gcgcgccaggctcagacacc

SEQ ID NO: 147241 - DNA, 20 bp, human
gtgcaggaggagaccggagg

SEQ ID NO: 147242 - DNA, 20 bp, human
gcgactaaacggagtggcgg

SEQ ID NO: 147243 - DNA, 20 bp, human
gggtggaccccgcaatggag

SEQ ID NO: 147244 - DNA, 20 bp, human
gcccgaggtggaccccgcaa

SEQ ID NO: 147245 - DNA, 20 bp, human
gccctggggcaggctctcaa

SEQ ID NO: 147246 - DNA, 20 bp, human
ggcagcgagcgagagcgcgg

SEQ ID NO: 147247 - DNA, 20 bp, human
gccgcgtcggatggggacct

SEQ ID NO: 147248 - DNA, 20 bp, human
gggcgcagcgagcgagagcg

SEQ ID NO: 147249 - DNA, 20 bp, human
ggcctaccgtatgggaccgg

SEQ ID NO: 147250 - DNA, 20 bp, human
gccgcgccgcctcctctgta

SEQ ID NO: 147251 - DNA, 20 bp, human
gggacagacgcaccgatcgc

SEQ ID NO: 147252 - DNA, 20 bp, human
gtccatggggccaaacggag

SEQ ID NO: 147253 - DNA, 20 bp, human
gcccatccgacgcgggccag

SEQ ID NO: 147254 - DNA, 20 bp, human
ggacggaacacgctgcctca

SEQ ID NO: 147255 - DNA, 20 bp, human
gctcctccgccggtcccata

SEQ ID NO: 147256 - DNA, 20 bp, human
ggggtaggcgcaggacagag

SEQ ID NO: 147257 - DNA, 20 bp, human
ggccctgagcgacagaactc

SEQ ID NO: 147258 - DNA, 20 bp, human
gaccatctgggtccaaagaa

SEQ ID NO: 147259 - DNA, 20 bp, human
gccccatggcaaaatctgta

SEQ ID NO: 147260 - DNA, 20 bp, human
gaagatatattcagacatag

SEQ ID NO: 147261 - DNA, 20 bp, human
gtccagggctgctatcatca

SEQ ID NO: 147262 - DNA, 20 bp, human
gtccacttgcggtctcttca

SEQ ID NO: 147263 - DNA, 20 bp, human
gtttcttggtagtagttgag

SEQ ID NO: 147264 - DNA, 20 bp, human
ggagcgacagaactctggta

SEQ ID NO: 147265 - DNA, 20 bp, human
gttggtagtagttgagagga

SEQ ID NO: 147266 - DNA, 20 bp, human
ggcggcggcggcctcgacag

SEQ ID NO: 147267 - DNA, 20 bp, human
ggctgctacagggaccgcgg

SEQ ID NO: 147268 - DNA, 20 bp, human
gccgccgaaaccgccacgga

SEQ ID NO: 147269 - DNA, 20 bp, human
gtccctgtagcagccaaccc

SEQ ID NO: 147270 - DNA, 20 bp, human
gccgccgccgctacccgata

SEQ ID NO: 147271 - DNA, 20 bp, human
gatgagcccgttgcagaggg

SEQ ID NO: 147272 - DNA, 20 bp, human
gttggctgctacagggaccg

SEQ ID NO: 147273 - DNA, 20 bp, human
gccgtcgccgccttccgtgg

SEQ ID NO: 147274 - DNA, 20 bp, human
gcggcgggcgccaccaacac

SEQ ID NO: 147275 - DNA, 20 bp, human
ggctacagggaccgcggtgg

SEQ ID NO: 147276 - DNA, 20 bp, human
gcagttggcgtaggtgcatt

SEQ ID NO: 147277 - DNA, 20 bp, human
gcgtaggtgcattcggagtg

SEQ ID NO: 147278 - DNA, 20 bp, human
ggcttgagcggctccggaag

SEQ ID NO: 147279 - DNA, 20 bp, human
ggaagactcggtagttacct

SEQ ID NO: 147280 - DNA, 20 bp, human
gaacgccgctgaggagcccg

SEQ ID NO: 147281 - DNA, 20 bp, human
gcgcgagcccgccgaagact

SEQ ID NO: 147282 - DNA, 20 bp, human
gcccgaggctaggctctcgg

SEQ ID NO: 147283 - DNA, 20 bp, human
gcggaagtggcagttggcgt

SEQ ID NO: 147284 - DNA, 20 bp, human
ggctccttagccccgaccac

SEQ ID NO: 147285 - DNA, 20 bp, human
gtaactaccgagtcttcggc

SEQ ID NO: 147286 - DNA, 20 bp, human
ggccccggtgagggaaacgg

SEQ ID NO: 147287 - DNA, 20 bp, human
ggccatagccacggtagtcg

SEQ ID NO: 147288 - DNA, 20 bp, human
gtcgtggcgaccaagcaacc

SEQ ID NO: 147289 - DNA, 20 bp, human
gggagaagcggaggtaacca

SEQ ID NO: 147290 - DNA, 20 bp, human
ggttgccccggtgagggaaa

SEQ ID NO: 147291 - DNA, 20 bp, human
gcgcgtgacgtaactagggt

SEQ ID NO: 147292 - DNA, 20 bp, human
gaacggaggcgccatagcca

SEQ ID NO: 147293 - DNA, 20 bp, human
gcccgcgcgtgacgtaacta

SEQ ID NO: 147294 - DNA, 20 bp, human
ggcctccgtttccctcaccg

SEQ ID NO: 147295 - DNA, 20 bp, human
gggcccggccagccaccccg

SEQ ID NO: 147296 - DNA, 20 bp, human
gtggtaagtaacagtctcca

SEQ ID NO: 147297 - DNA, 20 bp, human
gacggctacagtctctatgg

SEQ ID NO: 147298 - DNA, 20 bp, human
ggctgcgtgttggtccccgt

SEQ ID NO: 147299 - DNA, 20 bp, human
gagactgttacttaccaacg

SEQ ID NO: 147300 - DNA, 20 bp, human
ggagttcgggccgggagttc

SEQ ID NO: 147301 - DNA, 20 bp, human
gcccaactcagagatctagg

SEQ ID NO: 147302 - DNA, 20 bp, human
ggctacagtctctatggcgg

SEQ ID NO: 147303 - DNA, 20 bp, human
gtcctgaggttggggcgtcc

SEQ ID NO: 147304 - DNA, 20 bp, human
gtgaaggtaagcgtgagaaa

SEQ ID NO: 147305 - DNA, 20 bp, human
gagtttgagagacgttcccg

SEQ ID NO: 147306 - DNA, 20 bp, human
ggagagggagacactcgcac

SEQ ID NO: 147307 - DNA, 20 bp, human
ggaacagagcccctcggcgg

SEQ ID NO: 147308 - DNA, 20 bp, human
gggggaacagagcccctcgg

SEQ ID NO: 147309 - DNA, 20 bp, human
gcactcgcacggggaggggt

SEQ ID NO: 147310 - DNA, 20 bp, human
gggtctcactcctgacacgg

SEQ ID NO: 147311 - DNA, 20 bp, human
gggagacactcgcacgggga

SEQ ID NO: 147312 - DNA, 20 bp, human
ggaccgaagaatattcacct

SEQ ID NO: 147313 - DNA, 20 bp, human
gtccattgtaaacaagcccg

SEQ ID NO: 147314 - DNA, 20 bp, human
gctgcgccggccgcacttca

SEQ ID NO: 147315 - DNA, 20 bp, human
gccgcacttcagggatggag

SEQ ID NO: 147316 - DNA, 20 bp, human
gggagcgagctcggagaagg

SEQ ID NO: 147317 - DNA, 20 bp, human
gagacgggtcaacttgacag

SEQ ID NO: 147318 - DNA, 20 bp, human
gcgccagtaggactaacctg

SEQ ID NO: 147319 - DNA, 20 bp, human
gaagggagcgagctcggaga

SEQ ID NO: 147320 - DNA, 20 bp, human
gaacccgacatggattccac

SEQ ID NO: 147321 - DNA, 20 bp, human
ggggggcacaaggataaagg

SEQ ID NO: 147322 - DNA, 20 bp, human
gtgagggggcacaaggataa

SEQ ID NO: 147323 - DNA, 20 bp, human
gtcctactggcggggttggg

SEQ ID NO: 147324 - DNA, 20 bp, human
gagttgggaaaagttcagac

SEQ ID NO: 147325 - DNA, 20 bp, human
gcggggttggggggatacat

SEQ ID NO: 147326 - DNA, 20 bp, human
gtggagtgaaggtggctacg

SEQ ID NO: 147327 - DNA, 20 bp, human
ggcgctgggcgtcagaaacc

SEQ ID NO: 147328 - DNA, 20 bp, human
gggagcagcgggggaagtcg

SEQ ID NO: 147329 - DNA, 20 bp, human
ggttgtgggagatgacgtag

SEQ ID NO: 147330 - DNA, 20 bp, human
gcgtaggggccggcgacgtg

SEQ ID NO: 147331 - DNA, 20 bp, human
gcaggaccttggggctgggc

SEQ ID NO: 147332 - DNA, 20 bp, human
gtgggggcgcgcctcaggat

SEQ ID NO: 147333 - DNA, 20 bp, human
gagcaacgcacgagccggct

SEQ ID NO: 147334 - DNA, 20 bp, human
gcccacaacagcccatcctg

SEQ ID NO: 147335 - DNA, 20 bp, human
gttggaaggcgactgttcag

SEQ ID NO: 147336 - DNA, 20 bp, human
gcgcgcgcggaggtgtccgg

SEQ ID NO: 147337 - DNA, 20 bp, human
gggatccccggggacagttg

SEQ ID NO: 147338 - DNA, 20 bp, human
gtcaaaggagtagcctactg

SEQ ID NO: 147339 - DNA, 20 bp, human
gtgtccggcggccaggagga

SEQ ID NO: 147340 - DNA, 20 bp, human
gcggcgcgcgcggaggtgtc

SEQ ID NO: 147341 - DNA, 20 bp, human
gcgctcggccggttccccag

SEQ ID NO: 147342 - DNA, 20 bp, human
gcagtcttcctggatccccg

SEQ ID NO: 147343 - DNA, 20 bp, human
gggaaggtgtcttccagctc

SEQ ID NO: 147344 - DNA, 20 bp, human
gaaggagtagcctactgggg

SEQ ID NO: 147345 - DNA, 20 bp, human
ggaagttaaggtacacttaa

SEQ ID NO: 147346 - DNA, 20 bp, human
gctgcagcagcacggggacc

SEQ ID NO: 147347 - DNA, 20 bp, human
ggtgagggaagagaccggga

SEQ ID NO: 147348 - DNA, 20 bp, human
gacatcaccggggagaccag

SEQ ID NO: 147349 - DNA, 20 bp, human
gcccggcagtagaaagcccc

SEQ ID NO: 147350 - DNA, 20 bp, human
gaccgggaggggaggacgaa

SEQ ID NO: 147351 - DNA, 20 bp, human
gtggcgtggagcggtgcctg

SEQ ID NO: 147352 - DNA, 20 bp, human
gcaccgcgggagaggcatgg

SEQ ID NO: 147353 - DNA, 20 bp, human
gctggggctgcagcagcacg

SEQ ID NO: 147354 - DNA, 20 bp, human
gcgcctggggaacatcaccg

SEQ ID NO: 147355 - DNA, 20 bp, human
ggtagaaagccccggggaca

SEQ ID NO: 147356 - DNA, 20 bp, human
ggtcgcggtgttgagtccgt

SEQ ID NO: 147357 - DNA, 20 bp, human
gcacccagcgcccttcccac

SEQ ID NO: 147358 - DNA, 20 bp, human
ggaaggcgcgcggcgagtac

SEQ ID NO: 147359 - DNA, 20 bp, human
gaccgcgaccagattggaaa

SEQ ID NO: 147360 - DNA, 20 bp, human
gggagcggcggtagcaggac

SEQ ID NO: 147361 - DNA, 20 bp, human
gcgtagcaaccagtcaaaca

SEQ ID NO: 147362 - DNA, 20 bp, human
gccaacgctcaagcaagtca

SEQ ID NO: 147363 - DNA, 20 bp, human
ggcacagcggcgtcatccag

SEQ ID NO: 147364 - DNA, 20 bp, human
gggacctggctacagatatg

SEQ ID NO: 147365 - DNA, 20 bp, human
gttgagcgttggagttattc

SEQ ID NO: 147366 - DNA, 20 bp, human
gttataggccgtgagaactt

SEQ ID NO: 147367 - DNA, 20 bp, human
ggaccggaccctcagcgatc

SEQ ID NO: 147368 - DNA, 20 bp, human
ggaggaagccagatcgctga

SEQ ID NO: 147369 - DNA, 20 bp, human
gggctccccataatgagtga

SEQ ID NO: 147370 - DNA, 20 bp, human
gtgcctcctgctatatccat

SEQ ID NO: 147371 - DNA, 20 bp, human
gttgctttctgtcccggcag

SEQ ID NO: 147372 - DNA, 20 bp, human
gatgagtgacggctcaacaa

SEQ ID NO: 147373 - DNA, 20 bp, human
gttccaatggatatagcagg

SEQ ID NO: 147374 - DNA, 20 bp, human
gctcacggcctataaattga

SEQ ID NO: 147375 - DNA, 20 bp, human
ggccccccaaaagtgaggaa

SEQ ID NO: 147376 - DNA, 20 bp, human
gtagcacctgcttggcctaa

SEQ ID NO: 147377 - DNA, 20 bp, human
gaaagactcaggacacgctg

SEQ ID NO: 147378 - DNA, 20 bp, human
gacacttcggaccctccggg

SEQ ID NO: 147379 - DNA, 20 bp, human
gggtaaaaggcgcctatacc

SEQ ID NO: 147380 - DNA, 20 bp, human
gacgaggagactcactcggg

SEQ ID NO: 147381 - DNA, 20 bp, human
gcaggacacgctggggtaaa

SEQ ID NO: 147382 - DNA, 20 bp, human
ggctagtttggaggatctag

SEQ ID NO: 147383 - DNA, 20 bp, human
gcggggcgccttcccggtat

SEQ ID NO: 147384 - DNA, 20 bp, human
gaaaggcgcctataccggga

SEQ ID NO: 147385 - DNA, 20 bp, human
gcttcgcgaaccaaagactc

SEQ ID NO: 147386 - DNA, 20 bp, human
gattcacagtcagtagggcg

SEQ ID NO: 147387 - DNA, 20 bp, human
gggagcgcctaccttgtgca

SEQ ID NO: 147388 - DNA, 20 bp, human
gtgagacacagagccctagg

SEQ ID NO: 147389 - DNA, 20 bp, human
gatgccaaaagcaagaggaa

SEQ ID NO: 147390 - DNA, 20 bp, human
gcctaggagggaggtaaagc

SEQ ID NO: 147391 - DNA, 20 bp, human
gaacaggaggcatctaactg

SEQ ID NO: 147392 - DNA, 20 bp, human
gtatggtatgtctctcccac

SEQ ID NO: 147393 - DNA, 20 bp, human
gggaggcatctaactgtggg

SEQ ID NO: 147394 - DNA, 20 bp, human
gttacccagagcagtaaatg

SEQ ID NO: 147395 - DNA, 20 bp, human
gtgtagaattcacagtcagt

SEQ ID NO: 147396 - DNA, 20 bp, human
gccacagccacaggatagtg

SEQ ID NO: 147397 - DNA, 20 bp, human
gctccctccacactatcctg

SEQ ID NO: 147398 - DNA, 20 bp, human
gcagccacaggatagtgtgg

SEQ ID NO: 147399 - DNA, 20 bp, human
gtgaatcgcagtgaatgtaa

SEQ ID NO: 147400 - DNA, 20 bp, human
gctgtgtggatgtccctcca

SEQ ID NO: 147401 - DNA, 20 bp, human
gactctgaagtggacagcaa

SEQ ID NO: 147402 - DNA, 20 bp, human
ggtatggggtaatgtcccca

SEQ ID NO: 147403 - DNA, 20 bp, human
gcccattagaggtgcagaca

SEQ ID NO: 147404 - DNA, 20 bp, human
gaggctgaagttgagactat

SEQ ID NO: 147405 - DNA, 20 bp, human
ggcgattcaacaatacaatg

SEQ ID NO: 147406 - DNA, 20 bp, human
gagcgggagggagcggactg

SEQ ID NO: 147407 - DNA, 20 bp, human
ggaggatgcgggcgacacgg

SEQ ID NO: 147408 - DNA, 20 bp, human
gggccacattcgccatgcgg

SEQ ID NO: 147409 - DNA, 20 bp, human
gctcgggagggaccgaagtg

SEQ ID NO: 147410 - DNA, 20 bp, human
gccgagctggaggcccaaat

SEQ ID NO: 147411 - DNA, 20 bp, human
ggacatctcgacaagcccag

SEQ ID NO: 147412 - DNA, 20 bp, human
ggcggaggatgcgggcgaca

SEQ ID NO: 147413 - DNA, 20 bp, human
gcggcgaccgcgcgaccggg

SEQ ID NO: 147414 - DNA, 20 bp, human
gactgcggcaggatctgtcg

SEQ ID NO: 147415 - DNA, 20 bp, human
gcctccgagctcgccccggt

SEQ ID NO: 147416 - DNA, 20 bp, human
gagcgcagcgccgaagggac

SEQ ID NO: 147417 - DNA, 20 bp, human
ggctggagcgcagcgccgaa

SEQ ID NO: 147418 - DNA, 20 bp, human
gggaacccgagccggtggta

SEQ ID NO: 147419 - DNA, 20 bp, human
gccagcccgggccggaaagg

SEQ ID NO: 147420 - DNA, 20 bp, human
gtccgcgcccgccctaccac

SEQ ID NO: 147421 - DNA, 20 bp, human
gagcggcggggacaggtaac

SEQ ID NO: 147422 - DNA, 20 bp, human
gggcagccggggctattcgg

SEQ ID NO: 147423 - DNA, 20 bp, human
gccagggtcacccagcgact

SEQ ID NO: 147424 - DNA, 20 bp, human
ggtctcggctctgcagatgg

SEQ ID NO: 147425 - DNA, 20 bp, human
gcgcccgcgcgggaagaccg

SEQ ID NO: 147426 - DNA, 20 bp, human
gcccgagtcgcgcgcaccgg

SEQ ID NO: 147427 - DNA, 20 bp, human
gtggcccgagtcgcgcgcac

SEQ ID NO: 147428 - DNA, 20 bp, human
gggcagatgcatgtcaggag

SEQ ID NO: 147429 - DNA, 20 bp, human
gggcgcgtgtctgtgcgctg

SEQ ID NO: 147430 - DNA, 20 bp, human
gctgtgcgctgcggtcgctc

SEQ ID NO: 147431 - DNA, 20 bp, human
gcgctgcggtcgctcgggac

SEQ ID NO: 147432 - DNA, 20 bp, human
gcggcgcctcgccccggtcc

SEQ ID NO: 147433 - DNA, 20 bp, human
gaggcaattgctgagaaagt

SEQ ID NO: 147434 - DNA, 20 bp, human
ggcgcgactcgggccacaaa

SEQ ID NO: 147435 - DNA, 20 bp, human
gggtcgctcgggaccgggac

SEQ ID NO: 147436 - DNA, 20 bp, human
gtacgcaggaccccgatgat

SEQ ID NO: 147437 - DNA, 20 bp, human
gacttcccgctggccaagaa

SEQ ID NO: 147438 - DNA, 20 bp, human
ggagggaggggaacgtgtcc

SEQ ID NO: 147439 - DNA, 20 bp, human
gcccgatgataggtcgttga

SEQ ID NO: 147440 - DNA, 20 bp, human
ggtctcagattggcggggat

SEQ ID NO: 147441 - DNA, 20 bp, human
ggatctgcagaacctgaact

SEQ ID NO: 147442 - DNA, 20 bp, human
ggggtcgggtggcaaaactg

SEQ ID NO: 147443 - DNA, 20 bp, human
gagtctagggggtctcagat

SEQ ID NO: 147444 - DNA, 20 bp, human
ggccgtcaacgacctatcat

SEQ ID NO: 147445 - DNA, 20 bp, human
gcagtctgaggcaatgtctc

SEQ ID NO: 147446 - DNA, 20 bp, human
gcggagaccgacggcaacag

SEQ ID NO: 147447 - DNA, 20 bp, human
ggctctgacctgctcgggag

SEQ ID NO: 147448 - DNA, 20 bp, human
ggtccggggccggagaccga

SEQ ID NO: 147449 - DNA, 20 bp, human
ggaagccgggaccccgaaga

SEQ ID NO: 147450 - DNA, 20 bp, human
gccgggcagggaagggacgt

SEQ ID NO: 147451 - DNA, 20 bp, human
ggcccaggtggcctggtcgt

SEQ ID NO: 147452 - DNA, 20 bp, human
gtggacacgagcccccccgg

SEQ ID NO: 147453 - DNA, 20 bp, human
gacgcgggtggtgggaggta

SEQ ID NO: 147454 - DNA, 20 bp, human
gtggcctggtcgtgggcggg

SEQ ID NO: 147455 - DNA, 20 bp, human
gggaggaggtcacgagtacg

SEQ ID NO: 147456 - DNA, 20 bp, human
gcttagggctgagatagtgg

SEQ ID NO: 147457 - DNA, 20 bp, human
gtaccagcgagtgcgaggaa

SEQ ID NO: 147458 - DNA, 20 bp, human
ggcagctccaatcccagtac

SEQ ID NO: 147459 - DNA, 20 bp, human
gagccagaggcagcgactag

SEQ ID NO: 147460 - DNA, 20 bp, human
ggcgagtgcgaggaagggtt

SEQ ID NO: 147461 - DNA, 20 bp, human
gagccctaagggacccccga

SEQ ID NO: 147462 - DNA, 20 bp, human
gccagtacaggaaggaaaag

SEQ ID NO: 147463 - DNA, 20 bp, human
gccccagtgggggagacctg

SEQ ID NO: 147464 - DNA, 20 bp, human
gtaccttcgggggtccctta

SEQ ID NO: 147465 - DNA, 20 bp, human
gccacaggtgaggggtacag

SEQ ID NO: 147466 - DNA, 20 bp, human
gcggcgcccgtccctctcag

SEQ ID NO: 147467 - DNA, 20 bp, human
gcggcgccactgagagggac

SEQ ID NO: 147468 - DNA, 20 bp, human
ggcccttccgcctcactcag

SEQ ID NO: 147469 - DNA, 20 bp, human
gcgagtccgagcggccaagg

SEQ ID NO: 147470 - DNA, 20 bp, human
gaagagctggccctggtaag

SEQ ID NO: 147471 - DNA, 20 bp, human
gggccctggtaaggggacaa

SEQ ID NO: 147472 - DNA, 20 bp, human
gcggactcagggcaccaaag

SEQ ID NO: 147473 - DNA, 20 bp, human
gcgcacagcaggcaaagagc

SEQ ID NO: 147474 - DNA, 20 bp, human
gtcagtggcgccgctgagtg

SEQ ID NO: 147475 - DNA, 20 bp, human
ggcaggcaaagagctggccc

SEQ ID NO: 147476 - DNA, 20 bp, human
ggaggcccggctgcaagact

SEQ ID NO: 147477 - DNA, 20 bp, human
gacacagggagtgtggatct

SEQ ID NO: 147478 - DNA, 20 bp, human
gaggtcagctgggatacagg

SEQ ID NO: 147479 - DNA, 20 bp, human
gctggactcagactagatgt

SEQ ID NO: 147480 - DNA, 20 bp, human
gacgggccgcaggggatcag

SEQ ID NO: 147481 - DNA, 20 bp, human
gtaaggtggccacccaggag

SEQ ID NO: 147482 - DNA, 20 bp, human
gaagactgggtgacacacac

SEQ ID NO: 147483 - DNA, 20 bp, human
gagtccagatgaggctgcgg

SEQ ID NO: 147484 - DNA, 20 bp, human
gggcaccgtgctcataccac

SEQ ID NO: 147485 - DNA, 20 bp, human
ggtatgagcacggtgccagg

SEQ ID NO: 147486 - DNA, 20 bp, human
gcagagaagcctgaggtctc

SEQ ID NO: 147487 - DNA, 20 bp, human
gaggaggtcggcagcatgtc

SEQ ID NO: 147488 - DNA, 20 bp, human
gctccagccagagaagcctg

SEQ ID NO: 147489 - DNA, 20 bp, human
ggtcatctgccggagacctc

SEQ ID NO: 147490 - DNA, 20 bp, human
gggcctcttgtgcgacgagg

SEQ ID NO: 147491 - DNA, 20 bp, human
ggatgggaaggtgagtgtca

SEQ ID NO: 147492 - DNA, 20 bp, human
gacctacctgctcctatcca

SEQ ID NO: 147493 - DNA, 20 bp, human
ggatgacagcttgaggactt

SEQ ID NO: 147494 - DNA, 20 bp, human
gccagaggcgtcgagggtga

SEQ ID NO: 147495 - DNA, 20 bp, human
gtccctggataggagcaggt

SEQ ID NO: 147496 - DNA, 20 bp, human
ggagccggcccgggagcgaa

SEQ ID NO: 147497 - DNA, 20 bp, human
gcgctgggccggggaagcac

SEQ ID NO: 147498 - DNA, 20 bp, human
ggcagcaaagctccaaatgt

SEQ ID NO: 147499 - DNA, 20 bp, human
ggggagacaactgcagagtg

SEQ ID NO: 147500 - DNA, 20 bp, human
gccaacagctaaagcgatag

SEQ ID NO: 147501 - DNA, 20 bp, human
gctccaaatgtgggcaagat

SEQ ID NO: 147502 - DNA, 20 bp, human
gcggggctgcgggagaagag

SEQ ID NO: 147503 - DNA, 20 bp, human
gttgccccggggcagacgag

SEQ ID NO: 147504 - DNA, 20 bp, human
gatgggagcaagatgagacg

SEQ ID NO: 147505 - DNA, 20 bp, human
gcgaacggccagtgcttccc

SEQ ID NO: 147506 - DNA, 20 bp, human
gcccacacggctccatctca

SEQ ID NO: 147507 - DNA, 20 bp, human
gggctcgctgctcccgccgg

SEQ ID NO: 147508 - DNA, 20 bp, human
gcccttggggacccggagag

SEQ ID NO: 147509 - DNA, 20 bp, human
gcgggaggctccgtccacct

SEQ ID NO: 147510 - DNA, 20 bp, human
gctccatctcacggcaactc

SEQ ID NO: 147511 - DNA, 20 bp, human
gtctcacggcaactcgggca

SEQ ID NO: 147512 - DNA, 20 bp, human
gaaatcacgctgcgaagaaa

SEQ ID NO: 147513 - DNA, 20 bp, human
gaggcatcgcacccacgacg

SEQ ID NO: 147514 - DNA, 20 bp, human
gcatctggcccagcattgag

SEQ ID NO: 147515 - DNA, 20 bp, human
gcgggcagggtgcccctctc

SEQ ID NO: 147516 - DNA, 20 bp, human
ggcgggcgtggacctccaag

SEQ ID NO: 147517 - DNA, 20 bp, human
gcgccggtgggtggtcgcta

SEQ ID NO: 147518 - DNA, 20 bp, human
gagccctagcgaccacccac

SEQ ID NO: 147519 - DNA, 20 bp, human
gcggcgctgctcaacctcgg

SEQ ID NO: 147520 - DNA, 20 bp, human
gctgcggcgctgctcaacct

SEQ ID NO: 147521 - DNA, 20 bp, human
gccgtccatgcaggtctcgt

SEQ ID NO: 147522 - DNA, 20 bp, human
ggctgccgcgcagagatatc

SEQ ID NO: 147523 - DNA, 20 bp, human
gcgctgctcaacctcggcgg

SEQ ID NO: 147524 - DNA, 20 bp, human
gcagccagcgtgggctcggc

SEQ ID NO: 147525 - DNA, 20 bp, human
gagatatccgggccgccggt

SEQ ID NO: 147526 - DNA, 20 bp, human
gagcgtcgcgctgcagacaa

SEQ ID NO: 147527 - DNA, 20 bp, human
ggggcgcccatgaaattcgt

SEQ ID NO: 147528 - DNA, 20 bp, human
gcgccggggagggacttcgg

SEQ ID NO: 147529 - DNA, 20 bp, human
gtcggtggccagctgtccct

SEQ ID NO: 147530 - DNA, 20 bp, human
gggccaccgaagtccctccc

SEQ ID NO: 147531 - DNA, 20 bp, human
gtgggcccgggggacgtggg

SEQ ID NO: 147532 - DNA, 20 bp, human
gcccctatcctcaaggaacg

SEQ ID NO: 147533 - DNA, 20 bp, human
gaaatctgccagcctcaagg

SEQ ID NO: 147534 - DNA, 20 bp, human
gatcctcaaggaacggggaa

SEQ ID NO: 147535 - DNA, 20 bp, human
gtgcgggaagcgttgatggg

SEQ ID NO: 147536 - DNA, 20 bp, human
gggcagtgttcagactacaa

SEQ ID NO: 147537 - DNA, 20 bp, human
gtccccaccggcttctacta

SEQ ID NO: 147538 - DNA, 20 bp, human
gtctgggagatcgggatgag

SEQ ID NO: 147539 - DNA, 20 bp, human
gagtcgccttctgggagatc

SEQ ID NO: 147540 - DNA, 20 bp, human
gtcctggcgcgatctccttc

SEQ ID NO: 147541 - DNA, 20 bp, human
gtccctagtagaagccggtg

SEQ ID NO: 147542 - DNA, 20 bp, human
ggtagagccgctgggacctc

SEQ ID NO: 147543 - DNA, 20 bp, human
gccgtcgcccgaggtcccag

SEQ ID NO: 147544 - DNA, 20 bp, human
gagaggcctccacaacaatc

SEQ ID NO: 147545 - DNA, 20 bp, human
gccccctccctggaaaggaa

SEQ ID NO: 147546 - DNA, 20 bp, human
gctcatctgcccgcccctca

SEQ ID NO: 147547 - DNA, 20 bp, human
ggacctggctaggtacgcgg

SEQ ID NO: 147548 - DNA, 20 bp, human
gacctagccaggtccctgag

SEQ ID NO: 147549 - DNA, 20 bp, human
gcatagtcgacactagggat

SEQ ID NO: 147550 - DNA, 20 bp, human
gtcagcaccttgacagggag

SEQ ID NO: 147551 - DNA, 20 bp, human
gggagctgccatgattgaag

SEQ ID NO: 147552 - DNA, 20 bp, human
ggcgggcagatgaggcctag

SEQ ID NO: 147553 - DNA, 20 bp, human
gagggacctggctaggtacg

SEQ ID NO: 147554 - DNA, 20 bp, human
gactagggatcggcacccct

SEQ ID NO: 147555 - DNA, 20 bp, human
ggcccctcagggacctggct

SEQ ID NO: 147556 - DNA, 20 bp, human
gcctcggcctggccggacgg

SEQ ID NO: 147557 - DNA, 20 bp, human
gcggcctcgacctggcgggg

SEQ ID NO: 147558 - DNA, 20 bp, human
gcgacggcctcgacctggcg

SEQ ID NO: 147559 - DNA, 20 bp, human
gcggcctcggcctggccgga

SEQ ID NO: 147560 - DNA, 20 bp, human
gccgccgccgccgtccggcc

SEQ ID NO: 147561 - DNA, 20 bp, human
gtcgaggccaccgccccgcc

SEQ ID NO: 147562 - DNA, 20 bp, human
gcggggcggtggcctcgacc

SEQ ID NO: 147563 - DNA, 20 bp, human
gcctcgacctggcggggcgg

SEQ ID NO: 147564 - DNA, 20 bp, human
gcgccgcccggccgaggcca

SEQ ID NO: 147565 - DNA, 20 bp, human
gggggagcggtacctcgcct

SEQ ID NO: 147566 - DNA, 20 bp, human
gacttgtctcatgaacgtga

SEQ ID NO: 147567 - DNA, 20 bp, human
gcagaaaacaatgttaaaca

SEQ ID NO: 147568 - DNA, 20 bp, human
gatttctagtccatgctaag

SEQ ID NO: 147569 - DNA, 20 bp, human
gctaggattagtgatagtct

SEQ ID NO: 147570 - DNA, 20 bp, human
gttccactctgagtgataac

SEQ ID NO: 147571 - DNA, 20 bp, human
gagttattctgttaatgtaa

SEQ ID NO: 147572 - DNA, 20 bp, human
gaacattgagactatataat

SEQ ID NO: 147573 - DNA, 20 bp, human
gacttgcagtcattttacaa

SEQ ID NO: 147574 - DNA, 20 bp, human
gaaataatagaataatatta

SEQ ID NO: 147575 - DNA, 20 bp, human
gttttacacacatattgctt

SEQ ID NO: 147576 - DNA, 20 bp, human
gacttgtctcatgaacgtga

SEQ ID NO: 147577 - DNA, 20 bp, human
gatttctagtccatgctaag

SEQ ID NO: 147578 - DNA, 20 bp, human
gcagaaaacaatgttaaaca

SEQ ID NO: 147579 - DNA, 20 bp, human
gctaggattagtgatagtct

SEQ ID NO: 147580 - DNA, 20 bp, human
gttccactctgagtgataac

SEQ ID NO: 147581 - DNA, 20 bp, human
gagttattctgttaatgtaa

SEQ ID NO: 147582 - DNA, 20 bp, human
gaacattgagactatataat

SEQ ID NO: 147583 - DNA, 20 bp, human
gttttacacacatattgctt

SEQ ID NO: 147584 - DNA, 20 bp, human
gacttgcagtcattttacaa

SEQ ID NO: 147585 - DNA, 20 bp, human
gaatgactgcaagttatgct

SEQ ID NO: 147586 - DNA, 20 bp, human
gagcccgagaagattagttg

SEQ ID NO: 147587 - DNA, 20 bp, human
gagccatacacaacactaaa

SEQ ID NO: 147588 - DNA, 20 bp, human
gttctcgggctcctacgccg

SEQ ID NO: 147589 - DNA, 20 bp, human
gtgccacaactaatcttctc

SEQ ID NO: 147590 - DNA, 20 bp, human
gtgaggcgcagcaaagccta

SEQ ID NO: 147591 - DNA, 20 bp, human
ggcggcggcggcctcggcgt

SEQ ID NO: 147592 - DNA, 20 bp, human
gcgccctttagtgttgtgta

SEQ ID NO: 147593 - DNA, 20 bp, human
gcatttgttttgaggttagt

SEQ ID NO: 147594 - DNA, 20 bp, human
gggggagcggtacctcgcct

SEQ ID NO: 147595 - DNA, 20 bp, human
ggatactagtataagagatc

SEQ ID NO: 147596 - DNA, 20 bp, human
gcgctggtctcacgcatctc

SEQ ID NO: 147597 - DNA, 20 bp, human
gggctacgccgctgcctcag

SEQ ID NO: 147598 - DNA, 20 bp, human
gcgctgcctcagtggctttc

SEQ ID NO: 147599 - DNA, 20 bp, human
gctcacgcatctcgggagcc

SEQ ID NO: 147600 - DNA, 20 bp, human
gcgcagggccaggtcgaggc

SEQ ID NO: 147601 - DNA, 20 bp, human
ggtcctgcgtcaacagtgtg

SEQ ID NO: 147602 - DNA, 20 bp, human
gactcatcgcgccaccaacc

SEQ ID NO: 147603 - DNA, 20 bp, human
gggcgcgatgagttgcagca

SEQ ID NO: 147604 - DNA, 20 bp, human
gaagcgcctgaaagccactg

SEQ ID NO: 147605 - DNA, 20 bp, human
gagttgcagcaaggcctacg

SEQ ID NO: 147606 - DNA, 20 bp, human
ggccggctacgcggagtcag

SEQ ID NO: 147607 - DNA, 20 bp, human
ggggagcagcgcccgtcggg

SEQ ID NO: 147608 - DNA, 20 bp, human
ggactccgcgtagccggcgg

SEQ ID NO: 147609 - DNA, 20 bp, human
ggccactgactccgcgtagc

SEQ ID NO: 147610 - DNA, 20 bp, human
gcgcggagtcagtggctttc

SEQ ID NO: 147611 - DNA, 20 bp, human
gggggcggagccctgcacgg

SEQ ID NO: 147612 - DNA, 20 bp, human
gggtacgtcgcctccgtgca

SEQ ID NO: 147613 - DNA, 20 bp, human
gactcatcgcgccaccaacc

SEQ ID NO: 147614 - DNA, 20 bp, human
gggcgcgatgagttgcagca

SEQ ID NO: 147615 - DNA, 20 bp, human
gagttgcagcaaggcctacg

SEQ ID NO: 147616 - DNA, 20 bp, human
gcctcgacccggccgggggg

SEQ ID NO: 147617 - DNA, 20 bp, human
gaggcgtcatgtctcccgag

SEQ ID NO: 147618 - DNA, 20 bp, human
ggcggcgggcgggagaccgt

SEQ ID NO: 147619 - DNA, 20 bp, human
gcggcgcttcctcttaatcc

SEQ ID NO: 147620 - DNA, 20 bp, human
ggtctcgaagagagcgacgg

SEQ ID NO: 147621 - DNA, 20 bp, human
gccacggagcagcgcccctc

SEQ ID NO: 147622 - DNA, 20 bp, human
ggtcctggggggaccgcggc

SEQ ID NO: 147623 - DNA, 20 bp, human
ggcggcggcggccgcctcga

SEQ ID NO: 147624 - DNA, 20 bp, human
ggctggcgcagtcctgtggg

SEQ ID NO: 147625 - DNA, 20 bp, human
gcacagtgggcctccgtggg

SEQ ID NO: 147626 - DNA, 20 bp, human
gacccggccggggggggagg

SEQ ID NO: 147627 - DNA, 20 bp, human
gggcctcgacccggccgggg

SEQ ID NO: 147628 - DNA, 20 bp, human
gtcgacccggccgggggggg

SEQ ID NO: 147629 - DNA, 20 bp, human
gaggcgtcatgtctcccgag

SEQ ID NO: 147630 - DNA, 20 bp, human
gggaacaagccgggattaag

SEQ ID NO: 147631 - DNA, 20 bp, human
gcggcgcttcctcttaatcc

SEQ ID NO: 147632 - DNA, 20 bp, human
gctcgctcctgggcccgtcc

SEQ ID NO: 147633 - DNA, 20 bp, human
ggcggcgggcgggagaccgt

SEQ ID NO: 147634 - DNA, 20 bp, human
gccacggagcagcgcccctc

SEQ ID NO: 147635 - DNA, 20 bp, human
ggtctcgaagagagcgacgg

SEQ ID NO: 147636 - DNA, 20 bp, human
gtgtgtatcctcggggacgt

SEQ ID NO: 147637 - DNA, 20 bp, human
ggagtgggtctggaagagag

SEQ ID NO: 147638 - DNA, 20 bp, human
gtgggtctggaagagagcgg

SEQ ID NO: 147639 - DNA, 20 bp, human
gcacagtgggcctccgtggg

SEQ ID NO: 147640 - DNA, 20 bp, human
ggccgcacgctcgtcacagt

SEQ ID NO: 147641 - DNA, 20 bp, human
ggcccactgtgacgagcgtg

SEQ ID NO: 147642 - DNA, 20 bp, human
gctgcaagccactgaagcag

SEQ ID NO: 147643 - DNA, 20 bp, human
gcagcaaggccgatgtggag

SEQ ID NO: 147644 - DNA, 20 bp, human
gcagtgctgaggcagaacgc

SEQ ID NO: 147645 - DNA, 20 bp, human
gaacgcaggttcgtcacagt

SEQ ID NO: 147646 - DNA, 20 bp, human
gcgagctccccgaagccagt

SEQ ID NO: 147647 - DNA, 20 bp, human
gtgggaagccagagacagct

SEQ ID NO: 147648 - DNA, 20 bp, human
gcccgagtccgggcacagag

SEQ ID NO: 147649 - DNA, 20 bp, human
gcagcaggatttccaaggag

SEQ ID NO: 147650 - DNA, 20 bp, human
gtggctcttgatcatctcct

SEQ ID NO: 147651 - DNA, 20 bp, human
ggcagtgtgctgcacctcac

SEQ ID NO: 147652 - DNA, 20 bp, human
ggctgggtgtccggtcccat

SEQ ID NO: 147653 - DNA, 20 bp, human
gaggacccaggccaccagtg

SEQ ID NO: 147654 - DNA, 20 bp, human
gggagggagggactttgaaa

SEQ ID NO: 147655 - DNA, 20 bp, human
ggctcgaggtgctggctgtg

SEQ ID NO: 147656 - DNA, 20 bp, human
gtttagtttagccagatcag

SEQ ID NO: 147657 - DNA, 20 bp, human
gctggcattttgtctaactt

SEQ ID NO: 147658 - DNA, 20 bp, human
gtaaatttctctaaggaata

SEQ ID NO: 147659 - DNA, 20 bp, human
gttcttctctgctaacccaa

SEQ ID NO: 147660 - DNA, 20 bp, human
gtacacaggctcataaaaat

SEQ ID NO: 147661 - DNA, 20 bp, human
gtcgtctagaagtgaatgag

SEQ ID NO: 147662 - DNA, 20 bp, human
ggagatggctgctgcgcgca

SEQ ID NO: 147663 - DNA, 20 bp, human
gctaacccaaaggaattgaa

SEQ ID NO: 147664 - DNA, 20 bp, human
gtaggagtttttctctacac

SEQ ID NO: 147665 - DNA, 20 bp, human
ggcaattaactcctctgatc

SEQ ID NO: 147666 - DNA, 20 bp, human
gggaagaaggagcagcccgg

SEQ ID NO: 147667 - DNA, 20 bp, human
ggcggaggcggagagcgtca

SEQ ID NO: 147668 - DNA, 20 bp, human
gacatcgccgcgggcgcccg

SEQ ID NO: 147669 - DNA, 20 bp, human
gcgcccgagcacaagaggga

SEQ ID NO: 147670 - DNA, 20 bp, human
gaggcggagagcgtcacgga

SEQ ID NO: 147671 - DNA, 20 bp, human
ggccgcgcccgagcacaaga

SEQ ID NO: 147672 - DNA, 20 bp, human
ggcgcggttgaacatcgccg

SEQ ID NO: 147673 - DNA, 20 bp, human
ggaagccgcttacctgacgg

SEQ ID NO: 147674 - DNA, 20 bp, human
gcttcctcctcgggcgcccg

SEQ ID NO: 147675 - DNA, 20 bp, human
ggcgaaggtgcggtacccag

SEQ ID NO: 147676 - DNA, 20 bp, human
gctcgcaccttcctcagatg

SEQ ID NO: 147677 - DNA, 20 bp, human
gaccacccgctccatctggg

SEQ ID NO: 147678 - DNA, 20 bp, human
gatgcggcatctgcgcccgg

SEQ ID NO: 147679 - DNA, 20 bp, human
gaggtctgcgaggccgggag

SEQ ID NO: 147680 - DNA, 20 bp, human
gtgggcggagggagtcgtca

SEQ ID NO: 147681 - DNA, 20 bp, human
gcgaccagggcgtgaagatg

SEQ ID NO: 147682 - DNA, 20 bp, human
gggcgcagatgccgcatctg

SEQ ID NO: 147683 - DNA, 20 bp, human
gacgaccacccgctccatct

SEQ ID NO: 147684 - DNA, 20 bp, human
gagcatgcaggaccccgacc

SEQ ID NO: 147685 - DNA, 20 bp, human
gtcgggcgccgggaaatcgg

SEQ ID NO: 147686 - DNA, 20 bp, human
gcgctcgtggagtccgacga

SEQ ID NO: 147687 - DNA, 20 bp, human
gcgggccgaagcgcccggag

SEQ ID NO: 147688 - DNA, 20 bp, human
ggcgcgcgcaacggtcgcct

SEQ ID NO: 147689 - DNA, 20 bp, human
gcacagcgcggggccccagg

SEQ ID NO: 147690 - DNA, 20 bp, human
gctggagttcgggtctcgga

SEQ ID NO: 147691 - DNA, 20 bp, human
gcccccgcgggtcccgccaa

SEQ ID NO: 147692 - DNA, 20 bp, human
gacgagcggccgctttgtta

SEQ ID NO: 147693 - DNA, 20 bp, human
gccggagacgaaagaaagag

SEQ ID NO: 147694 - DNA, 20 bp, human
gccaccgcccgcgcgcgcaa

SEQ ID NO: 147695 - DNA, 20 bp, human
gagtcaggccggcgaacaaa

SEQ ID NO: 147696 - DNA, 20 bp, human
gcttctaagttgggcaacag

SEQ ID NO: 147697 - DNA, 20 bp, human
ggaggccagagtgccatcga

SEQ ID NO: 147698 - DNA, 20 bp, human
gattaccttcgatggcactc

SEQ ID NO: 147699 - DNA, 20 bp, human
gtagcagatgctgatttcaa

SEQ ID NO: 147700 - DNA, 20 bp, human
gtctctataattaccttcga

SEQ ID NO: 147701 - DNA, 20 bp, human
gcacgtatctatgcaaagag

SEQ ID NO: 147702 - DNA, 20 bp, human
gtttcaatggtagaacttct

SEQ ID NO: 147703 - DNA, 20 bp, human
ggcatggtggactgctcgac

SEQ ID NO: 147704 - DNA, 20 bp, human
gttatttttcccagagtaaa

SEQ ID NO: 147705 - DNA, 20 bp, human
ggaggagatcaaatttagca

SEQ ID NO: 147706 - DNA, 20 bp, human
ggccatctggaagggtctag

SEQ ID NO: 147707 - DNA, 20 bp, human
gcagtggagagagcctgact

SEQ ID NO: 147708 - DNA, 20 bp, human
gggcccgcaggagccgagtc

SEQ ID NO: 147709 - DNA, 20 bp, human
gtgcccaccatggggactgt

SEQ ID NO: 147710 - DNA, 20 bp, human
gcgggagcctggtacaaccc

SEQ ID NO: 147711 - DNA, 20 bp, human
ggcgccggccagagcttgca

SEQ ID NO: 147712 - DNA, 20 bp, human
ggccagagcttgcacggtgg

SEQ ID NO: 147713 - DNA, 20 bp, human
gccggccagagcttgcacgg

SEQ ID NO: 147714 - DNA, 20 bp, human
gacgggcgcatggtgagtgt

SEQ ID NO: 147715 - DNA, 20 bp, human
gtcactgccagggttgtacc

SEQ ID NO: 147716 - DNA, 20 bp, human
gctagcttccccagatccag

SEQ ID NO: 147717 - DNA, 20 bp, human
ggggaagctagtgagctcgg

SEQ ID NO: 147718 - DNA, 20 bp, human
gcaggtctgccgctttccag

SEQ ID NO: 147719 - DNA, 20 bp, human
gggcagacctgtgacatcga

SEQ ID NO: 147720 - DNA, 20 bp, human
gcagtagtgccactggaaag

SEQ ID NO: 147721 - DNA, 20 bp, human
gccaggcgagaaacagcctc

SEQ ID NO: 147722 - DNA, 20 bp, human
gaagctagtgagctcggtgg

SEQ ID NO: 147723 - DNA, 20 bp, human
gtgtttctcgcctggctgtg

SEQ ID NO: 147724 - DNA, 20 bp, human
gggctgcccacctagaactc

SEQ ID NO: 147725 - DNA, 20 bp, human
ggggcggaggcctgtaccgc

SEQ ID NO: 147726 - DNA, 20 bp, human
gagcaggtgctagtcaactg

SEQ ID NO: 147727 - DNA, 20 bp, human
gcacgtagtaggcaggatgg

SEQ ID NO: 147728 - DNA, 20 bp, human
ggcgcagggcagcacgtagt

SEQ ID NO: 147729 - DNA, 20 bp, human
ggtgctagtcaactgcggtt

SEQ ID NO: 147730 - DNA, 20 bp, human
gtgcctggagaggtaagggg

SEQ ID NO: 147731 - DNA, 20 bp, human
gaagcagcggccgctcagtc

SEQ ID NO: 147732 - DNA, 20 bp, human
ggctagaggcttgagtagag

SEQ ID NO: 147733 - DNA, 20 bp, human
ggaagcaaaggcgcggtagc

SEQ ID NO: 147734 - DNA, 20 bp, human
gggaagtcccaccaactctt

SEQ ID NO: 147735 - DNA, 20 bp, human
ggctcagtctgggcgcttgc

SEQ ID NO: 147736 - DNA, 20 bp, human
gcccggtcgcctggaggtgt

SEQ ID NO: 147737 - DNA, 20 bp, human
gagcgcgccgatgggtccgg

SEQ ID NO: 147738 - DNA, 20 bp, human
gcggcgagcggaccgcgtcc

SEQ ID NO: 147739 - DNA, 20 bp, human
gtcagctgctgcagggaacc

SEQ ID NO: 147740 - DNA, 20 bp, human
gcgctctccgcgggaactct

SEQ ID NO: 147741 - DNA, 20 bp, human
gcccgctcccccggacccat

SEQ ID NO: 147742 - DNA, 20 bp, human
gtggccgagcgttccccggc

SEQ ID NO: 147743 - DNA, 20 bp, human
ggacctggccgagcgttccc

SEQ ID NO: 147744 - DNA, 20 bp, human
gattcaacttcccggacccg

SEQ ID NO: 147745 - DNA, 20 bp, human
ggtggccgcggcgccctgag

SEQ ID NO: 147746 - DNA, 20 bp, human
gaataatgttagccacatag

SEQ ID NO: 147747 - DNA, 20 bp, human
ggtttgtattgctataattt

SEQ ID NO: 147748 - DNA, 20 bp, human
gagtattaataaatgaacta

SEQ ID NO: 147749 - DNA, 20 bp, human
gttgtttttgaactattggg

SEQ ID NO: 147750 - DNA, 20 bp, human
gattctactatgtatatgta

SEQ ID NO: 147751 - DNA, 20 bp, human
gcttttttcaagttaataca

SEQ ID NO: 147752 - DNA, 20 bp, human
ggaggaaatgaagtacaatt

SEQ ID NO: 147753 - DNA, 20 bp, human
gcctcttgtttttgaactat

SEQ ID NO: 147754 - DNA, 20 bp, human
gcttcattttagagagaaga

SEQ ID NO: 147755 - DNA, 20 bp, human
ggtacaattttacctgattt

SEQ ID NO: 147756 - DNA, 20 bp, human
gcccggccccagccgatcgg

SEQ ID NO: 147757 - DNA, 20 bp, human
gtacagctcgaagggctgag

SEQ ID NO: 147758 - DNA, 20 bp, human
gaggccctgggtaggagcta

SEQ ID NO: 147759 - DNA, 20 bp, human
gactcctgcggcgctctgga

SEQ ID NO: 147760 - DNA, 20 bp, human
gcagtgcgcaggcgcctcgg

SEQ ID NO: 147761 - DNA, 20 bp, human
ggcctcccctacagctcgaa

SEQ ID NO: 147762 - DNA, 20 bp, human
ggcccttcgagctgtagggg

SEQ ID NO: 147763 - DNA, 20 bp, human
gaggagcccccgatcggctg

SEQ ID NO: 147764 - DNA, 20 bp, human
ggcccgcgcgctccaaggtc

SEQ ID NO: 147765 - DNA, 20 bp, human
ggcccaccagccagatgtgg

SEQ ID NO: 147766 - DNA, 20 bp, human
ggcccagccgcaaacagccg

SEQ ID NO: 147767 - DNA, 20 bp, human
gaaatgacatcagaatcctg

SEQ ID NO: 147768 - DNA, 20 bp, human
gtggacaagagcgcaggcag

SEQ ID NO: 147769 - DNA, 20 bp, human
gatgcaacgtatgaatgctg

SEQ ID NO: 147770 - DNA, 20 bp, human
ggacccatggacaagagcgc

SEQ ID NO: 147771 - DNA, 20 bp, human
gagcttacacagctactgga

SEQ ID NO: 147772 - DNA, 20 bp, human
gggcagtggccacaagagcg

SEQ ID NO: 147773 - DNA, 20 bp, human
ggctagtttcctaacgtcaa

SEQ ID NO: 147774 - DNA, 20 bp, human
gagggagacagttgatatga

SEQ ID NO: 147775 - DNA, 20 bp, human
gactagcctgagcctatgca

SEQ ID NO: 147776 - DNA, 20 bp, human
gaagtggccgaggctgggag

SEQ ID NO: 147777 - DNA, 20 bp, human
gggccggcagggtggacggt

SEQ ID NO: 147778 - DNA, 20 bp, human
ggcatgcgcacggcggacgg

SEQ ID NO: 147779 - DNA, 20 bp, human
ggcttcctccccggccggca

SEQ ID NO: 147780 - DNA, 20 bp, human
ggacgaagaaagagagttcg

SEQ ID NO: 147781 - DNA, 20 bp, human
gtatttcggaaagaccaggc

SEQ ID NO: 147782 - DNA, 20 bp, human
ggccgctcgtccggacctca

SEQ ID NO: 147783 - DNA, 20 bp, human
gtgcgtccgcgtgcgaagag

SEQ ID NO: 147784 - DNA, 20 bp, human
gagcgtatttcggaaagacc

SEQ ID NO: 147785 - DNA, 20 bp, human
gagcccaccgtccaccctgc

SEQ ID NO: 147786 - DNA, 20 bp, human
gctccagggaactaaccccg

SEQ ID NO: 147787 - DNA, 20 bp, human
gtggactgcgcgtctctgga

SEQ ID NO: 147788 - DNA, 20 bp, human
gtagttccctggagcccgga

SEQ ID NO: 147789 - DNA, 20 bp, human
gccgggccggggagaaggta

SEQ ID NO: 147790 - DNA, 20 bp, human
gtccagggcgggaagaccgg

SEQ ID NO: 147791 - DNA, 20 bp, human
gcgactgccgagggtctcag

SEQ ID NO: 147792 - DNA, 20 bp, human
gcagcgggatctggagtcag

SEQ ID NO: 147793 - DNA, 20 bp, human
gttcgggagtgggacccggt

SEQ ID NO: 147794 - DNA, 20 bp, human
gggccgcggggttagttccc

SEQ ID NO: 147795 - DNA, 20 bp, human
gcgcagcgtcccttcgggag

SEQ ID NO: 147796 - DNA, 20 bp, human
ggatatcagactccacggga

SEQ ID NO: 147797 - DNA, 20 bp, human
gatgaaaagaatctaatagt

SEQ ID NO: 147798 - DNA, 20 bp, human
gtcacacaaatgcaatgcag

SEQ ID NO: 147799 - DNA, 20 bp, human
gatatagaaaagttaccact

SEQ ID NO: 147800 - DNA, 20 bp, human
gtcatcaaactcagcgagtt

SEQ ID NO: 147801 - DNA, 20 bp, human
gagatgaattgttttccaag

SEQ ID NO: 147802 - DNA, 20 bp, human
gattttactagctattcatt

SEQ ID NO: 147803 - DNA, 20 bp, human
gcaaaggatatcagactcca

SEQ ID NO: 147804 - DNA, 20 bp, human
gagaaggaatcaagagagca

SEQ ID NO: 147805 - DNA, 20 bp, human
ggtgagtataaagagattta

SEQ ID NO: 147806 - DNA, 20 bp, human
gggtcagggcctgagcgacg

SEQ ID NO: 147807 - DNA, 20 bp, human
ggagcccgcgcgggccgtca

SEQ ID NO: 147808 - DNA, 20 bp, human
gtgaccaggcaggattccag

SEQ ID NO: 147809 - DNA, 20 bp, human
gtagcgcgcgggtccagcgc

SEQ ID NO: 147810 - DNA, 20 bp, human
gggcaggaggtaaagtccag

SEQ ID NO: 147811 - DNA, 20 bp, human
ggcgggtccagcgcgggtca

SEQ ID NO: 147812 - DNA, 20 bp, human
gccgcggtgagcctcttctc

SEQ ID NO: 147813 - DNA, 20 bp, human
gggtaggtggcggccccaca

SEQ ID NO: 147814 - DNA, 20 bp, human
gggacggcatgcccgagaag

SEQ ID NO: 147815 - DNA, 20 bp, human
ggtcataaaatccaacagga

SEQ ID NO: 147816 - DNA, 20 bp, human
gattagagtagaaagttcaa

SEQ ID NO: 147817 - DNA, 20 bp, human
gaaaagaaaagacagatcga

SEQ ID NO: 147818 - DNA, 20 bp, human
gagctactcggggggtgctg

SEQ ID NO: 147819 - DNA, 20 bp, human
gttgagatgggcagatcgca

SEQ ID NO: 147820 - DNA, 20 bp, human
gtgtactaccagatgttaaa

SEQ ID NO: 147821 - DNA, 20 bp, human
gtttaacaccatttaacatc

SEQ ID NO: 147822 - DNA, 20 bp, human
gcatttcaaaaagttagaag

SEQ ID NO: 147823 - DNA, 20 bp, human
gttaaaattttctcctggcc

SEQ ID NO: 147824 - DNA, 20 bp, human
gactcggggggtgctgaggc

SEQ ID NO: 147825 - DNA, 20 bp, human
gtccttttaaaattttctcc

SEQ ID NO: 147826 - DNA, 20 bp, human
ggcctaaggaagcagaagta

SEQ ID NO: 147827 - DNA, 20 bp, human
ggagaggtgtcaggatacag

SEQ ID NO: 147828 - DNA, 20 bp, human
gtacattaaagagaaggagt

SEQ ID NO: 147829 - DNA, 20 bp, human
gggatacagtggatgaagac

SEQ ID NO: 147830 - DNA, 20 bp, human
gtgtgatccctgctagagac

SEQ ID NO: 147831 - DNA, 20 bp, human
gaaggagtaggagaggtgtc

SEQ ID NO: 147832 - DNA, 20 bp, human
gcagctgtacattaaagaga

SEQ ID NO: 147833 - DNA, 20 bp, human
gagagacaggccacttgctt

SEQ ID NO: 147834 - DNA, 20 bp, human
ggggcctgggcttagaactt

SEQ ID NO: 147835 - DNA, 20 bp, human
ggtccttcctttcagtctaa

SEQ ID NO: 147836 - DNA, 20 bp, human
gttagcaggaagacgctcag

SEQ ID NO: 147837 - DNA, 20 bp, human
ggcgtactttgcctcttctc

SEQ ID NO: 147838 - DNA, 20 bp, human
gggaattctggagcttactt

SEQ ID NO: 147839 - DNA, 20 bp, human
ggatgcttctaatccaaaag

SEQ ID NO: 147840 - DNA, 20 bp, human
gctataaaagagacccctac

SEQ ID NO: 147841 - DNA, 20 bp, human
gaatatctttaccggagaag

SEQ ID NO: 147842 - DNA, 20 bp, human
gagcaggaaagaaatgcggc

SEQ ID NO: 147843 - DNA, 20 bp, human
gttaattaagaagcgagatg

SEQ ID NO: 147844 - DNA, 20 bp, human
gagaacagttctcaaaactg

SEQ ID NO: 147845 - DNA, 20 bp, human
gaaagtaccagcaggaattc

SEQ ID NO: 147846 - DNA, 20 bp, human
gggctgcccagtggtaacag

SEQ ID NO: 147847 - DNA, 20 bp, human
ggaagttgtacttaaagcgg

SEQ ID NO: 147848 - DNA, 20 bp, human
gtaagaagttgtacttaaag

SEQ ID NO: 147849 - DNA, 20 bp, human
gaaataaggacttatagaat

SEQ ID NO: 147850 - DNA, 20 bp, human
gactgtctagattagaaccc

SEQ ID NO: 147851 - DNA, 20 bp, human
ggccccactcatgcctggaa

SEQ ID NO: 147852 - DNA, 20 bp, human
ggaaaacttcaaaactgtct

SEQ ID NO: 147853 - DNA, 20 bp, human
ggcaagtcctttgcacattt

SEQ ID NO: 147854 - DNA, 20 bp, human
gatggagaatctttactcaa

SEQ ID NO: 147855 - DNA, 20 bp, human
gcaatacctctgttaccact

SEQ ID NO: 147856 - DNA, 20 bp, human
gacggaaactcggaaagagg

SEQ ID NO: 147857 - DNA, 20 bp, human
gcgcgggccgcggagctgaa

SEQ ID NO: 147858 - DNA, 20 bp, human
gtccgtggtggcgagcgcag

SEQ ID NO: 147859 - DNA, 20 bp, human
ggaagtggcccagtgagaca

SEQ ID NO: 147860 - DNA, 20 bp, human
ggggaccggcagcctcttgg

SEQ ID NO: 147861 - DNA, 20 bp, human
gggcggcgagagctccgcct

SEQ ID NO: 147862 - DNA, 20 bp, human
gcagcctcttgggggcggag

SEQ ID NO: 147863 - DNA, 20 bp, human
gaccggcagcctcttggggg

SEQ ID NO: 147864 - DNA, 20 bp, human
gtggagaagcccagggaacc

SEQ ID NO: 147865 - DNA, 20 bp, human
gcgcctctgcccgccccggt

SEQ ID NO: 147866 - DNA, 20 bp, human
gtccccgggagaagaagcgg

SEQ ID NO: 147867 - DNA, 20 bp, human
gagccagcgaggcggcccag

SEQ ID NO: 147868 - DNA, 20 bp, human
gtcggctggtcccagtcccc

SEQ ID NO: 147869 - DNA, 20 bp, human
gggcgcccgtagcccagccc

SEQ ID NO: 147870 - DNA, 20 bp, human
gcaagcggagcagcgaggca

SEQ ID NO: 147871 - DNA, 20 bp, human
ggccgccgcccgtgcacagg

SEQ ID NO: 147872 - DNA, 20 bp, human
gcagccctcgctctgcgcag

SEQ ID NO: 147873 - DNA, 20 bp, human
gtgagcagctagagccgggg

SEQ ID NO: 147874 - DNA, 20 bp, human
ggcgcgcaccccgcggtcca

SEQ ID NO: 147875 - DNA, 20 bp, human
gggagccgcctgtgcacggg

SEQ ID NO: 147876 - DNA, 20 bp, human
gccttagagacgagggatca

SEQ ID NO: 147877 - DNA, 20 bp, human
ggacaagcccttagagacga

SEQ ID NO: 147878 - DNA, 20 bp, human
gccagctcccgggacagggt

SEQ ID NO: 147879 - DNA, 20 bp, human
ggcggagattgggagcgcag

SEQ ID NO: 147880 - DNA, 20 bp, human
gggcgcccagggcaacaacc

SEQ ID NO: 147881 - DNA, 20 bp, human
gctggacgactgcaagatgg

SEQ ID NO: 147882 - DNA, 20 bp, human
gtagtggaagcgatgctgca

SEQ ID NO: 147883 - DNA, 20 bp, human
ggcaagcaattggctctaat

SEQ ID NO: 147884 - DNA, 20 bp, human
gggcacagctagcgcttccc

SEQ ID NO: 147885 - DNA, 20 bp, human
gcttccactagcagcgagga

SEQ ID NO: 147886 - DNA, 20 bp, human
gcccagcgcccctagaatag

SEQ ID NO: 147887 - DNA, 20 bp, human
gccacctccgccaggagcaa

SEQ ID NO: 147888 - DNA, 20 bp, human
gaggaggatggagaacacaa

SEQ ID NO: 147889 - DNA, 20 bp, human
ggttgcagccgctattctag

SEQ ID NO: 147890 - DNA, 20 bp, human
gcctgctaactgggaagaac

SEQ ID NO: 147891 - DNA, 20 bp, human
ggctctgcatctcatgaaaa

SEQ ID NO: 147892 - DNA, 20 bp, human
gcttccatcagggcctgagt

SEQ ID NO: 147893 - DNA, 20 bp, human
ggaggagttagggttgagga

SEQ ID NO: 147894 - DNA, 20 bp, human
gacacccttgctcctggcgg

SEQ ID NO: 147895 - DNA, 20 bp, human
gggcgggcttaatagctctg

SEQ ID NO: 147896 - DNA, 20 bp, human
ggctgcctggctcaagtggt

SEQ ID NO: 147897 - DNA, 20 bp, human
ggagaaactagagcctccga

SEQ ID NO: 147898 - DNA, 20 bp, human
ggcctggctcaagtggtggg

SEQ ID NO: 147899 - DNA, 20 bp, human
ggcttgctgcctggctcaag

SEQ ID NO: 147900 - DNA, 20 bp, human
gtgagacataatgggaagac

SEQ ID NO: 147901 - DNA, 20 bp, human
ggccgccgcccgctgggtgt

SEQ ID NO: 147902 - DNA, 20 bp, human
gacctcccaccacttgagcc

SEQ ID NO: 147903 - DNA, 20 bp, human
gtgaagcagcctacacccag

SEQ ID NO: 147904 - DNA, 20 bp, human
gtgtgtgcatgaacacatag

SEQ ID NO: 147905 - DNA, 20 bp, human
ggattgctttcttccctcgg

SEQ ID NO: 147906 - DNA, 20 bp, human
gaagcgtccgaggacaagag

SEQ ID NO: 147907 - DNA, 20 bp, human
gccagccctgggcgtcgacg

SEQ ID NO: 147908 - DNA, 20 bp, human
ggaagccccccaagttcgaa

SEQ ID NO: 147909 - DNA, 20 bp, human
ggcctccccgtcgacgccca

SEQ ID NO: 147910 - DNA, 20 bp, human
gcggcgcctagtgagagtca

SEQ ID NO: 147911 - DNA, 20 bp, human
ggctgcctttcgaacttggg

SEQ ID NO: 147912 - DNA, 20 bp, human
ggcaggttcagttcaggctg

SEQ ID NO: 147913 - DNA, 20 bp, human
ggccctgggcgtcgacgggg

SEQ ID NO: 147914 - DNA, 20 bp, human
gacaacctgttactcgggag

SEQ ID NO: 147915 - DNA, 20 bp, human
gcagcagtacaggccgagga

SEQ ID NO: 147916 - DNA, 20 bp, human
ggacggtcagcaccaggtgg

SEQ ID NO: 147917 - DNA, 20 bp, human
gtccgtgggtgccaactccg

SEQ ID NO: 147918 - DNA, 20 bp, human
gggagccgggctgacactag

SEQ ID NO: 147919 - DNA, 20 bp, human
gtgcggtccccatcctccgt

SEQ ID NO: 147920 - DNA, 20 bp, human
gaccgacggtcagcaccagg

SEQ ID NO: 147921 - DNA, 20 bp, human
gagcctgcttgccccggagt

SEQ ID NO: 147922 - DNA, 20 bp, human
gcagggacacctgaccccgg

SEQ ID NO: 147923 - DNA, 20 bp, human
ggaccaacgtgagcgcaacg

SEQ ID NO: 147924 - DNA, 20 bp, human
ggtgcaaggcgctgctggac

SEQ ID NO: 147925 - DNA, 20 bp, human
gcagtgactggcaatccgag

SEQ ID NO: 147926 - DNA, 20 bp, human
gaaggccttggagacatccc

SEQ ID NO: 147927 - DNA, 20 bp, human
ggacaactaaggcaagaggg

SEQ ID NO: 147928 - DNA, 20 bp, human
gactatcctcaaagatctgg

SEQ ID NO: 147929 - DNA, 20 bp, human
gtctgccagggatgtctcca

SEQ ID NO: 147930 - DNA, 20 bp, human
ggccttgagtctctcaaata

SEQ ID NO: 147931 - DNA, 20 bp, human
gcttattcataagacaacta

SEQ ID NO: 147932 - DNA, 20 bp, human
gtaacaattgggaagatgaa

SEQ ID NO: 147933 - DNA, 20 bp, human
ggccttatttgagagactca

SEQ ID NO: 147934 - DNA, 20 bp, human
gtaagacaactaaggcaaga

SEQ ID NO: 147935 - DNA, 20 bp, human
ggatctttgaggatagtaca

SEQ ID NO: 147936 - DNA, 20 bp, human
gcaggactatagccatgaga

SEQ ID NO: 147937 - DNA, 20 bp, human
gggcacactgagagcttcac

SEQ ID NO: 147938 - DNA, 20 bp, human
gagtagataagcaatacaaa

SEQ ID NO: 147939 - DNA, 20 bp, human
gtcaccaagccaacagacat

SEQ ID NO: 147940 - DNA, 20 bp, human
ggagctgctcgagaacagtc

SEQ ID NO: 147941 - DNA, 20 bp, human
gaattctacaaagagctcaa

SEQ ID NO: 147942 - DNA, 20 bp, human
gtgtgattaaggtgcttggt

SEQ ID NO: 147943 - DNA, 20 bp, human
ggagttatatcctcgtgagt

SEQ ID NO: 147944 - DNA, 20 bp, human
gaacctcatgtttgtggcaa

SEQ ID NO: 147945 - DNA, 20 bp, human
gatgatggttatgagtgcta

SEQ ID NO: 147946 - DNA, 20 bp, human
gcagccggaccaaacagacg

SEQ ID NO: 147947 - DNA, 20 bp, human
gacgtgcgcgcgaagacgtg

SEQ ID NO: 147948 - DNA, 20 bp, human
gtgctgtcgttggttgtgag

SEQ ID NO: 147949 - DNA, 20 bp, human
ggtgcggtccggcggagatg

SEQ ID NO: 147950 - DNA, 20 bp, human
ggaagacgtggggacgcagg

SEQ ID NO: 147951 - DNA, 20 bp, human
ggtgcccacactcggaggaa

SEQ ID NO: 147952 - DNA, 20 bp, human
gctcgccctagccccccggg

SEQ ID NO: 147953 - DNA, 20 bp, human
gtttccgcgtctgtttggtc

SEQ ID NO: 147954 - DNA, 20 bp, human
gttggtccggctgctgtcgt

SEQ ID NO: 147955 - DNA, 20 bp, human
ggcaagtccgagagcgggga

SEQ ID NO: 147956 - DNA, 20 bp, human
gaggcggggcgcgggaacga

SEQ ID NO: 147957 - DNA, 20 bp, human
ggggtctgcagacaaaggtg

SEQ ID NO: 147958 - DNA, 20 bp, human
gagcagcgcagtgaagaagg

SEQ ID NO: 147959 - DNA, 20 bp, human
gggaccggcagccggcgtcg

SEQ ID NO: 147960 - DNA, 20 bp, human
gggaacgacggcggccatgg

SEQ ID NO: 147961 - DNA, 20 bp, human
ggcgggaacgacggcggcca

SEQ ID NO: 147962 - DNA, 20 bp, human
gaagggaacaaattcgggta

SEQ ID NO: 147963 - DNA, 20 bp, human
gggcagccggcgtcgaggcg

SEQ ID NO: 147964 - DNA, 20 bp, human
gcagacaaaggtgtggaaca

SEQ ID NO: 147965 - DNA, 20 bp, human
gtacagtgatgacgaagatg

SEQ ID NO: 147966 - DNA, 20 bp, human
gccggtggcggatagagtag

SEQ ID NO: 147967 - DNA, 20 bp, human
ggcgcgccacccattccccg

SEQ ID NO: 147968 - DNA, 20 bp, human
gccgcgtgacccctgccgac

SEQ ID NO: 147969 - DNA, 20 bp, human
gcccggcttcccagtaaggt

SEQ ID NO: 147970 - DNA, 20 bp, human
gcgcgccagccggtcggcag

SEQ ID NO: 147971 - DNA, 20 bp, human
gtgtgcgcggaatggattca

SEQ ID NO: 147972 - DNA, 20 bp, human
ggggtggcgcgccagccggt

SEQ ID NO: 147973 - DNA, 20 bp, human
ggcagggagacggagatcgg

SEQ ID NO: 147974 - DNA, 20 bp, human
gcaactgctgactaatccgc

SEQ ID NO: 147975 - DNA, 20 bp, human
ggttcgaaccagacagatcc

SEQ ID NO: 147976 - DNA, 20 bp, human
gctcgctccagggcattccc

SEQ ID NO: 147977 - DNA, 20 bp, human
ggcgcacgcccctcgctcca

SEQ ID NO: 147978 - DNA, 20 bp, human
ggcgccgggctaggaatccg

SEQ ID NO: 147979 - DNA, 20 bp, human
ggcgggagtctagagtccgg

SEQ ID NO: 147980 - DNA, 20 bp, human
ggccggattagcagccccag

SEQ ID NO: 147981 - DNA, 20 bp, human
ggactcggcgcgggccctcc

SEQ ID NO: 147982 - DNA, 20 bp, human
gggagcgggagtctagagtc

SEQ ID NO: 147983 - DNA, 20 bp, human
ggcccccgcccaacagctga

SEQ ID NO: 147984 - DNA, 20 bp, human
ggcgccgcaaaaatagcccg

SEQ ID NO: 147985 - DNA, 20 bp, human
ggggcgactcgggaaactcc

SEQ ID NO: 147986 - DNA, 20 bp, human
ggacggggcgccagatgtag

SEQ ID NO: 147987 - DNA, 20 bp, human
gcccgggacgcaactccgtg

SEQ ID NO: 147988 - DNA, 20 bp, human
ggtgctcacccgggagaaag

SEQ ID NO: 147989 - DNA, 20 bp, human
gtaaacctccggaggaagag

SEQ ID NO: 147990 - DNA, 20 bp, human
gatgtaggggcaagacgatt

SEQ ID NO: 147991 - DNA, 20 bp, human
ggcgcctgcgagcggctggg

SEQ ID NO: 147992 - DNA, 20 bp, human
gtccgtgcggcgcctgcgag

SEQ ID NO: 147993 - DNA, 20 bp, human
gacgagcggggcaggactca

SEQ ID NO: 147994 - DNA, 20 bp, human
gggtggtgcgcggccaggaa

SEQ ID NO: 147995 - DNA, 20 bp, human
ggccgcagggaggtgagcgc

SEQ ID NO: 147996 - DNA, 20 bp, human
gtgggtagggtggaagacgg

SEQ ID NO: 147997 - DNA, 20 bp, human
gagggtcccagggaacagac

SEQ ID NO: 147998 - DNA, 20 bp, human
ggaagacgggggaacaactg

SEQ ID NO: 147999 - DNA, 20 bp, human
gtcgctttccaggatgggta

SEQ ID NO: 148000 - DNA, 20 bp, human
gggaacaactgaggagctgg

SEQ ID NO: 148001 - DNA, 20 bp, human
ggctggagaagggagagtcg

SEQ ID NO: 148002 - DNA, 20 bp, human
gggatgaggtaggtaccgag

SEQ ID NO: 148003 - DNA, 20 bp, human
gccggccaggctctatggac

SEQ ID NO: 148004 - DNA, 20 bp, human
gaccccaggagaggactgac

SEQ ID NO: 148005 - DNA, 20 bp, human
gggcaggagggccgcattgg

SEQ ID NO: 148006 - DNA, 20 bp, human
gctacccctgggagaagatg

SEQ ID NO: 148007 - DNA, 20 bp, human
ggcctagctgcattcaaaca

SEQ ID NO: 148008 - DNA, 20 bp, human
gtcctgggtgaggcgaagaa

SEQ ID NO: 148009 - DNA, 20 bp, human
gctgctacgacgaggactct

SEQ ID NO: 148010 - DNA, 20 bp, human
ggtggcaggtcactacccct

SEQ ID NO: 148011 - DNA, 20 bp, human
gtcccgaacggaagctgtag

SEQ ID NO: 148012 - DNA, 20 bp, human
gtggaaaaggagttgtcata

SEQ ID NO: 148013 - DNA, 20 bp, human
gctacgacgaggactctagg

SEQ ID NO: 148014 - DNA, 20 bp, human
ggtctagtctgggactgtct

SEQ ID NO: 148015 - DNA, 20 bp, human
gggagttgtcataagggtgt

SEQ ID NO: 148016 - DNA, 20 bp, human
gtggcagagcgggatcttca

SEQ ID NO: 148017 - DNA, 20 bp, human
ggaaggaggagggacatgtg

SEQ ID NO: 148018 - DNA, 20 bp, human
gctatgtcaggacaaggggg

SEQ ID NO: 148019 - DNA, 20 bp, human
gagggcagcgggcaacccct

SEQ ID NO: 148020 - DNA, 20 bp, human
gctggaacgcaaggaccgga

SEQ ID NO: 148021 - DNA, 20 bp, human
ggtcctatgtcaggacaagg

SEQ ID NO: 148022 - DNA, 20 bp, human
gggaggtcactccagaaggg

SEQ ID NO: 148023 - DNA, 20 bp, human
gggcggcagcaggaagtgca

SEQ ID NO: 148024 - DNA, 20 bp, human
ggctatcttcccgagggaaa

SEQ ID NO: 148025 - DNA, 20 bp, human
gcatgttgggccaggagtca

SEQ ID NO: 148026 - DNA, 20 bp, human
ggcgcactgagcccctggag

SEQ ID NO: 148027 - DNA, 20 bp, human
ggggccgcgagaagcgggaa

SEQ ID NO: 148028 - DNA, 20 bp, human
gagaagcgggaagggagcgc

SEQ ID NO: 148029 - DNA, 20 bp, human
gatcgaggagctggaacccg

SEQ ID NO: 148030 - DNA, 20 bp, human
gctccccgcggagtcctcgg

SEQ ID NO: 148031 - DNA, 20 bp, human
gaggagactcgggcgcagag

SEQ ID NO: 148032 - DNA, 20 bp, human
gggggccggggccggcccaa

SEQ ID NO: 148033 - DNA, 20 bp, human
ggcggggaccggggccatgg

SEQ ID NO: 148034 - DNA, 20 bp, human
gtggccgagacggggtccgg

SEQ ID NO: 148035 - DNA, 20 bp, human
ggagcgggggccgcgagaag

SEQ ID NO: 148036 - DNA, 20 bp, human
ggagatcgcagcccaaccca

SEQ ID NO: 148037 - DNA, 20 bp, human
ggcggcgcggctaggagacc

SEQ ID NO: 148038 - DNA, 20 bp, human
gcggctaggagacccggcca

SEQ ID NO: 148039 - DNA, 20 bp, human
gtcatagactaagtgagata

SEQ ID NO: 148040 - DNA, 20 bp, human
gcggtaccctggatcatagc

SEQ ID NO: 148041 - DNA, 20 bp, human
gtcgcagcccaacccatggc

SEQ ID NO: 148042 - DNA, 20 bp, human
gtttggcagacaattcccgg

SEQ ID NO: 148043 - DNA, 20 bp, human
gcagccgtctcgctctgagg

SEQ ID NO: 148044 - DNA, 20 bp, human
gtagtctatgagttagacaa

SEQ ID NO: 148045 - DNA, 20 bp, human
ggtctcgctctgaggtggag

SEQ ID NO: 148046 - DNA, 20 bp, human
ggagtccgcaggacccgcga

SEQ ID NO: 148047 - DNA, 20 bp, human
gcgtagcgcagagatgcccg

SEQ ID NO: 148048 - DNA, 20 bp, human
ggagatgcccggggcgtgtg

SEQ ID NO: 148049 - DNA, 20 bp, human
gcgtacggtatgctctagta

SEQ ID NO: 148050 - DNA, 20 bp, human
ggcagcgctgtgggccccgc

SEQ ID NO: 148051 - DNA, 20 bp, human
gacaggctgggcagcgctgt

SEQ ID NO: 148052 - DNA, 20 bp, human
gtcgcaacaaggcgtaatat

SEQ ID NO: 148053 - DNA, 20 bp, human
gtgtaggaaagtggccgaaa

SEQ ID NO: 148054 - DNA, 20 bp, human
gcagcgcgccggccaatcgg

SEQ ID NO: 148055 - DNA, 20 bp, human
gttaatgtgatgagactcat

SEQ ID NO: 148056 - DNA, 20 bp, human
ggagcggcagccgccagcgg

SEQ ID NO: 148057 - DNA, 20 bp, human
gcaggcggcgagacttactt

SEQ ID NO: 148058 - DNA, 20 bp, human
ggaacaccaacctccgctgg

SEQ ID NO: 148059 - DNA, 20 bp, human
ggcacccctgcagcatggcc

SEQ ID NO: 148060 - DNA, 20 bp, human
ggcctctgcagggcatgcgt

SEQ ID NO: 148061 - DNA, 20 bp, human
gaaactagtagggaaaacac

SEQ ID NO: 148062 - DNA, 20 bp, human
gtagggaaaacaccgggatg

SEQ ID NO: 148063 - DNA, 20 bp, human
gctggaacaccaacctccgc

SEQ ID NO: 148064 - DNA, 20 bp, human
gcatctcgccggcctctgca

SEQ ID NO: 148065 - DNA, 20 bp, human
gcggcgagatgcggagtccg

SEQ ID NO: 148066 - DNA, 20 bp, human
gggttgtgctggcctctcta

SEQ ID NO: 148067 - DNA, 20 bp, human
gaaaggaaagcttacattgt

SEQ ID NO: 148068 - DNA, 20 bp, human
gatgggggaatctttttcct

SEQ ID NO: 148069 - DNA, 20 bp, human
gccggcgctgcctgcccctc

SEQ ID NO: 148070 - DNA, 20 bp, human
gttccagtgttagggcccag

SEQ ID NO: 148071 - DNA, 20 bp, human
gaggcaggcttcacagaaga

SEQ ID NO: 148072 - DNA, 20 bp, human
gtcactgtgctgaaaaatca

SEQ ID NO: 148073 - DNA, 20 bp, human
gtcacaggagcaaatagcag

SEQ ID NO: 148074 - DNA, 20 bp, human
gcacagaagagggcatgccc

SEQ ID NO: 148075 - DNA, 20 bp, human
gaatctacggaagaagatgg

SEQ ID NO: 148076 - DNA, 20 bp, human
gcggccactcacccacagac

SEQ ID NO: 148077 - DNA, 20 bp, human
gctcccaggcgaggccccgg

SEQ ID NO: 148078 - DNA, 20 bp, human
gaaaagcggcggaagaaggt

SEQ ID NO: 148079 - DNA, 20 bp, human
ggaatggcgtaattaaaaag

SEQ ID NO: 148080 - DNA, 20 bp, human
gtagccggcgcccaacagcg

SEQ ID NO: 148081 - DNA, 20 bp, human
gctaccggtctgtgggtgag

SEQ ID NO: 148082 - DNA, 20 bp, human
gtggcgtaattaaaaagcgg

SEQ ID NO: 148083 - DNA, 20 bp, human
ggaggaggccgcgcggccac

SEQ ID NO: 148084 - DNA, 20 bp, human
gtcgcctgggagccgggtcg

SEQ ID NO: 148085 - DNA, 20 bp, human
gcaacagcgcggtagcagcg

SEQ ID NO: 148086 - DNA, 20 bp, human
gctcaccccgaagctgccgt

SEQ ID NO: 148087 - DNA, 20 bp, human
gctgccgtgggcaagttaga

SEQ ID NO: 148088 - DNA, 20 bp, human
gcggagactcacctacacag

SEQ ID NO: 148089 - DNA, 20 bp, human
gggctgcgggaatctcagag

SEQ ID NO: 148090 - DNA, 20 bp, human
ggagcccgaaaacgaggtca

SEQ ID NO: 148091 - DNA, 20 bp, human
ggtcagggtgtgagcaggcg

SEQ ID NO: 148092 - DNA, 20 bp, human
gtgatcacgtgggcagctcc

SEQ ID NO: 148093 - DNA, 20 bp, human
gtgctgtgttgtgatcacgt

SEQ ID NO: 148094 - DNA, 20 bp, human
gtccctgggtcgcgttccca

SEQ ID NO: 148095 - DNA, 20 bp, human
ggatagtcgcaggtgtcctg

SEQ ID NO: 148096 - DNA, 20 bp, human
gcgtccggcccgggctggta

SEQ ID NO: 148097 - DNA, 20 bp, human
ggataatacgcagccctcaa

SEQ ID NO: 148098 - DNA, 20 bp, human
gcaggtttcgcgctgaggta

SEQ ID NO: 148099 - DNA, 20 bp, human
gacgggaagaatctgagcca

SEQ ID NO: 148100 - DNA, 20 bp, human
ggaaggcttggcttcgggag

SEQ ID NO: 148101 - DNA, 20 bp, human
gcaggagctgcggccccgtc

SEQ ID NO: 148102 - DNA, 20 bp, human
gtgcggaggtcagacttcca

SEQ ID NO: 148103 - DNA, 20 bp, human
gcccaggctgtctcaccact

SEQ ID NO: 148104 - DNA, 20 bp, human
gaccgcaggccggcttgtgg

SEQ ID NO: 148105 - DNA, 20 bp, human
gtcgcctggcgtgaccagcg

SEQ ID NO: 148106 - DNA, 20 bp, human
gatccagctggagccctgag

SEQ ID NO: 148107 - DNA, 20 bp, human
gggagcccgggagcatggag

SEQ ID NO: 148108 - DNA, 20 bp, human
gcggctcataccgcccaggg

SEQ ID NO: 148109 - DNA, 20 bp, human
gggcccttgtggctgacccg

SEQ ID NO: 148110 - DNA, 20 bp, human
gaggccttcgcagcattctt

SEQ ID NO: 148111 - DNA, 20 bp, human
gagccacgggtcagccacaa

SEQ ID NO: 148112 - DNA, 20 bp, human
gcttcgcagcattcttgggt

SEQ ID NO: 148113 - DNA, 20 bp, human
gcttgggtgggagcagccac

SEQ ID NO: 148114 - DNA, 20 bp, human
ggctccagctggatgactct

SEQ ID NO: 148115 - DNA, 20 bp, human
gacccggctcataccgccca

SEQ ID NO: 148116 - DNA, 20 bp, human
gggactaacgagagaaccga

SEQ ID NO: 148117 - DNA, 20 bp, human
gaggggcacaggagactacc

SEQ ID NO: 148118 - DNA, 20 bp, human
ggtagctgaagaccagaccg

SEQ ID NO: 148119 - DNA, 20 bp, human
ggggtagcgcgagagagcga

SEQ ID NO: 148120 - DNA, 20 bp, human
ggccgcccgcggtcctccgt

SEQ ID NO: 148121 - DNA, 20 bp, human
gctgccggccggaagagtac

SEQ ID NO: 148122 - DNA, 20 bp, human
gcggccacgagcagccggtg

SEQ ID NO: 148123 - DNA, 20 bp, human
ggtcgcaaactcggagacga

SEQ ID NO: 148124 - DNA, 20 bp, human
gaccgacggaggaccgcggg

SEQ ID NO: 148125 - DNA, 20 bp, human
ggaacccttccgctcacctc

SEQ ID NO: 148126 - DNA, 20 bp, human
ggcgaggcccggagagaccc

SEQ ID NO: 148127 - DNA, 20 bp, human
gctcggcctagctctctccc

SEQ ID NO: 148128 - DNA, 20 bp, human
ggggctcgggcagcagactc

SEQ ID NO: 148129 - DNA, 20 bp, human
gagagacccgggagagagct

SEQ ID NO: 148130 - DNA, 20 bp, human
gctcgggcagcagactcggg

SEQ ID NO: 148131 - DNA, 20 bp, human
gagctccaaccagactgcgg

SEQ ID NO: 148132 - DNA, 20 bp, human
gaacagctccaaccagactg

SEQ ID NO: 148133 - DNA, 20 bp, human
ggcaagaagctggtggtggt

SEQ ID NO: 148134 - DNA, 20 bp, human
gtctgccaccgcagtctggt

SEQ ID NO: 148135 - DNA, 20 bp, human
gcagactgcggtggcagatg

SEQ ID NO: 148136 - DNA, 20 bp, human
gagagagctcgcgtctcgct

SEQ ID NO: 148137 - DNA, 20 bp, human
ggcgagggaggcccccctag

SEQ ID NO: 148138 - DNA, 20 bp, human
ggccgcccaactttgcacaa

SEQ ID NO: 148139 - DNA, 20 bp, human
gtcccagtcccgggcgagag

SEQ ID NO: 148140 - DNA, 20 bp, human
gcccagcgggtggcaagtgg

SEQ ID NO: 148141 - DNA, 20 bp, human
gcctccctcgcctctctgag

SEQ ID NO: 148142 - DNA, 20 bp, human
ggctgcctttgtgcaaagtt

SEQ ID NO: 148143 - DNA, 20 bp, human
gtctcgctcggcttcagggt

SEQ ID NO: 148144 - DNA, 20 bp, human
gtccccccggcccttgaagg

SEQ ID NO: 148145 - DNA, 20 bp, human
ggcctttgtgcaaagttggg

SEQ ID NO: 148146 - DNA, 20 bp, human
gcgccaggcgcccaatgtca

SEQ ID NO: 148147 - DNA, 20 bp, human
gccactcagaaactccggca

SEQ ID NO: 148148 - DNA, 20 bp, human
gcagtgggcggggcccgtca

SEQ ID NO: 148149 - DNA, 20 bp, human
gccggacgtgggcccaggag

SEQ ID NO: 148150 - DNA, 20 bp, human
gggcagcccaggccggacgt

SEQ ID NO: 148151 - DNA, 20 bp, human
gggcgatgctgatccggaag

SEQ ID NO: 148152 - DNA, 20 bp, human
gcaggcgcccaatgtcacgg

SEQ ID NO: 148153 - DNA, 20 bp, human
gccgtcacggctgtcgtctt

SEQ ID NO: 148154 - DNA, 20 bp, human
gctgcaagttgggacgacgc

SEQ ID NO: 148155 - DNA, 20 bp, human
gcggagcggcgcgtctgcaa

SEQ ID NO: 148156 - DNA, 20 bp, human
gggataagctgccgctactc

SEQ ID NO: 148157 - DNA, 20 bp, human
gacgcgctggagagagacaa

SEQ ID NO: 148158 - DNA, 20 bp, human
ggacagcgcgcggcgaggat

SEQ ID NO: 148159 - DNA, 20 bp, human
gaccgccgcacagccccaag

SEQ ID NO: 148160 - DNA, 20 bp, human
gccgggcactccctgagtag

SEQ ID NO: 148161 - DNA, 20 bp, human
ggcgactcggagaaaagcag

SEQ ID NO: 148162 - DNA, 20 bp, human
gctcggaacaggaagtgcgg

SEQ ID NO: 148163 - DNA, 20 bp, human
gtccgccgcgcctcctcggc

SEQ ID NO: 148164 - DNA, 20 bp, human
gccctcgcgcgcctccaccg

SEQ ID NO: 148165 - DNA, 20 bp, human
ggcttcgcggggcccccggg

SEQ ID NO: 148166 - DNA, 20 bp, human
ggcggagcggaaggtaccct

SEQ ID NO: 148167 - DNA, 20 bp, human
gacgccccagcccccagggt

SEQ ID NO: 148168 - DNA, 20 bp, human
ggccgcaggggacctagagt

SEQ ID NO: 148169 - DNA, 20 bp, human
gggaggtatggcgggaatag

SEQ ID NO: 148170 - DNA, 20 bp, human
gggggacctagagtgggatg

SEQ ID NO: 148171 - DNA, 20 bp, human
gtggggtcagtctgagcctc

SEQ ID NO: 148172 - DNA, 20 bp, human
gcagtctgagcctccggcac

SEQ ID NO: 148173 - DNA, 20 bp, human
ggagcagtggcaggccccaa

SEQ ID NO: 148174 - DNA, 20 bp, human
ggaagggaaagtgctctcct

SEQ ID NO: 148175 - DNA, 20 bp, human
gagcggaaggtaccctgggc

SEQ ID NO: 148176 - DNA, 20 bp, human
gggactgagtgaggcgacct

SEQ ID NO: 148177 - DNA, 20 bp, human
gggaggaatggcatccaccg

SEQ ID NO: 148178 - DNA, 20 bp, human
ggcctgggccgccgtcatcc

SEQ ID NO: 148179 - DNA, 20 bp, human
gcccggccccgggatgacgg

SEQ ID NO: 148180 - DNA, 20 bp, human
gccgtcaaggtggtcctggt

SEQ ID NO: 148181 - DNA, 20 bp, human
gggcacggacctgtacaccc

SEQ ID NO: 148182 - DNA, 20 bp, human
gggccctcagcggaattgtg

SEQ ID NO: 148183 - DNA, 20 bp, human
gggcctgccccgcgcagtct

SEQ ID NO: 148184 - DNA, 20 bp, human
gatctgtaaagccggaggaa

SEQ ID NO: 148185 - DNA, 20 bp, human
gcgagcggaaccgggcgagg

SEQ ID NO: 148186 - DNA, 20 bp, human
gacacggccagcgtgaccgt

SEQ ID NO: 148187 - DNA, 20 bp, human
gtccttcctgcccggaccgg

SEQ ID NO: 148188 - DNA, 20 bp, human
gccggagcccgcagcactgg

SEQ ID NO: 148189 - DNA, 20 bp, human
ggcggcgcgccgggcactag

SEQ ID NO: 148190 - DNA, 20 bp, human
gtcggtgttcgagaagtaca

SEQ ID NO: 148191 - DNA, 20 bp, human
gtacttctcgaacaccgatg

SEQ ID NO: 148192 - DNA, 20 bp, human
ggcgtagtgctgcgggagag

SEQ ID NO: 148193 - DNA, 20 bp, human
gcagcgtcccgagcacggac

SEQ ID NO: 148194 - DNA, 20 bp, human
ggagcccgcagcactggcgg

SEQ ID NO: 148195 - DNA, 20 bp, human
gagcggagccaagaggtcgg

SEQ ID NO: 148196 - DNA, 20 bp, human
ggccggcggaggctcggcga

SEQ ID NO: 148197 - DNA, 20 bp, human
gcggcgcccgcgccgagtcc

SEQ ID NO: 148198 - DNA, 20 bp, human
gagcggctccgggctcgaga

SEQ ID NO: 148199 - DNA, 20 bp, human
gggtgccctccccgaggcgg

SEQ ID NO: 148200 - DNA, 20 bp, human
ggtcacaactgccagagcag

SEQ ID NO: 148201 - DNA, 20 bp, human
ggtggggtgtcctcagaagt

SEQ ID NO: 148202 - DNA, 20 bp, human
gtcgagaaggaagtgagagc

SEQ ID NO: 148203 - DNA, 20 bp, human
ggaacggggccactgcgagc

SEQ ID NO: 148204 - DNA, 20 bp, human
gggtgtcctcagaagttggt

SEQ ID NO: 148205 - DNA, 20 bp, human
gagaaggaagtgagagcggg

SEQ ID NO: 148206 - DNA, 20 bp, human
ggagtccaccccaagatggt

SEQ ID NO: 148207 - DNA, 20 bp, human
gcagggagtccaccccaaga

SEQ ID NO: 148208 - DNA, 20 bp, human
gtggttgggttagtgtgtgt

SEQ ID NO: 148209 - DNA, 20 bp, human
gtaacccaaccatcttgggg

SEQ ID NO: 148210 - DNA, 20 bp, human
gcggcattctgcaacaggta

SEQ ID NO: 148211 - DNA, 20 bp, human
gattctcgggaacgagggag

SEQ ID NO: 148212 - DNA, 20 bp, human
ggaactgaaaatacaacagt

SEQ ID NO: 148213 - DNA, 20 bp, human
gctctgagctacctgctgta

SEQ ID NO: 148214 - DNA, 20 bp, human
gcttgttaggactgtggtga

SEQ ID NO: 148215 - DNA, 20 bp, human
gacagggggacgggggtcgg

SEQ ID NO: 148216 - DNA, 20 bp, human
gtctagcctggcaaaagata

SEQ ID NO: 148217 - DNA, 20 bp, human
gagcctggcaaaagatacgg

SEQ ID NO: 148218 - DNA, 20 bp, human
gcaacccaggacttgactgt

SEQ ID NO: 148219 - DNA, 20 bp, human
gttaccatgctggtaaagaa

SEQ ID NO: 148220 - DNA, 20 bp, human
gcgagaccctaagttcagag

SEQ ID NO: 148221 - DNA, 20 bp, human
gcatagtggtcaaacacagt

SEQ ID NO: 148222 - DNA, 20 bp, human
ggacatgtctgtatgatcca

SEQ ID NO: 148223 - DNA, 20 bp, human
gagagcagagtaaaaccctc

SEQ ID NO: 148224 - DNA, 20 bp, human
gtccagacaaacgatgcagg

SEQ ID NO: 148225 - DNA, 20 bp, human
gtctaacatggaggaaagct

SEQ ID NO: 148226 - DNA, 20 bp, human
ggcggccctcgcagggagtg

SEQ ID NO: 148227 - DNA, 20 bp, human
gcctccgcgcggccctcgca

SEQ ID NO: 148228 - DNA, 20 bp, human
gcgagccccactccctgcga

SEQ ID NO: 148229 - DNA, 20 bp, human
gccgaggcttacctgcgtag

SEQ ID NO: 148230 - DNA, 20 bp, human
gcggaggggcgcgcaggagg

SEQ ID NO: 148231 - DNA, 20 bp, human
gccaacccgggcccctcccg

SEQ ID NO: 148232 - DNA, 20 bp, human
ggggctcgggtgcgccggca

SEQ ID NO: 148233 - DNA, 20 bp, human
ggccgaggaccgcggagggg

SEQ ID NO: 148234 - DNA, 20 bp, human
gtgcgaggggagccgctgca

SEQ ID NO: 148235 - DNA, 20 bp, human
gccgcgcggcggcagcaggc

SEQ ID NO: 148236 - DNA, 20 bp, human
ggggcccaggtgaggtgaca

SEQ ID NO: 148237 - DNA, 20 bp, human
gggcctaggaacgcggagaa

SEQ ID NO: 148238 - DNA, 20 bp, human
ggctggaaggcctaggaacg

SEQ ID NO: 148239 - DNA, 20 bp, human
gcgggcggttagggctaata

SEQ ID NO: 148240 - DNA, 20 bp, human
gacagggtgagggccgccgg

SEQ ID NO: 148241 - DNA, 20 bp, human
gggaggagagaagcttcgga

SEQ ID NO: 148242 - DNA, 20 bp, human
gccacagcccgctgggccgg

SEQ ID NO: 148243 - DNA, 20 bp, human
ggagaagcttcggagggatg

SEQ ID NO: 148244 - DNA, 20 bp, human
gtccgcccgcacgcacggag

SEQ ID NO: 148245 - DNA, 20 bp, human
gagaaggacagggttcgaag

SEQ ID NO: 148246 - DNA, 20 bp, human
gagtagtccacgatgtgggt

SEQ ID NO: 148247 - DNA, 20 bp, human
gaaggcttgaggaccaggtc

SEQ ID NO: 148248 - DNA, 20 bp, human
gccgggcggcagctatgagg

SEQ ID NO: 148249 - DNA, 20 bp, human
gggacaaagagactccactg

SEQ ID NO: 148250 - DNA, 20 bp, human
gtcgtggactactcaggtag

SEQ ID NO: 148251 - DNA, 20 bp, human
gtgggtgggcaccttctccg

SEQ ID NO: 148252 - DNA, 20 bp, human
gcgctccccgacccggaacc

SEQ ID NO: 148253 - DNA, 20 bp, human
ggctccgggcggcagctatg

SEQ ID NO: 148254 - DNA, 20 bp, human
gacctgagtagtccacgatg

SEQ ID NO: 148255 - DNA, 20 bp, human
gtgcgggccgggcccccggg

SEQ ID NO: 148256 - DNA, 20 bp, human
gccgcacggccagtagacaa

SEQ ID NO: 148257 - DNA, 20 bp, human
gctgcgctgttggaggacag

SEQ ID NO: 148258 - DNA, 20 bp, human
gccaacagcgcagggcagag

SEQ ID NO: 148259 - DNA, 20 bp, human
gagtagggatgtactcggtg

SEQ ID NO: 148260 - DNA, 20 bp, human
gtggtgagctacaccaccaa

SEQ ID NO: 148261 - DNA, 20 bp, human
gcagtagacaaaggcggcca

SEQ ID NO: 148262 - DNA, 20 bp, human
gcacggccagtagacaaagg

SEQ ID NO: 148263 - DNA, 20 bp, human
gtcgtggctccgcgctccgg

SEQ ID NO: 148264 - DNA, 20 bp, human
gtcaccggagaagttgtcga

SEQ ID NO: 148265 - DNA, 20 bp, human
gtagacaaaggcggccaggg

SEQ ID NO: 148266 - DNA, 20 bp, human
ggagggcgcagaggaccccg

SEQ ID NO: 148267 - DNA, 20 bp, human
gcctggacccattcagtcag

SEQ ID NO: 148268 - DNA, 20 bp, human
gcgcagcgaagccgagaccc

SEQ ID NO: 148269 - DNA, 20 bp, human
gccgcaccagcgccacctcg

SEQ ID NO: 148270 - DNA, 20 bp, human
gaccaggacttgcactgcag

SEQ ID NO: 148271 - DNA, 20 bp, human
gggcggggagagcctgagtt

SEQ ID NO: 148272 - DNA, 20 bp, human
ggagttaggaagagcgtcct

SEQ ID NO: 148273 - DNA, 20 bp, human
gtggtgggcgacggcgccgt

SEQ ID NO: 148274 - DNA, 20 bp, human
gaggctgggaggaccccata

SEQ ID NO: 148275 - DNA, 20 bp, human
ggcccctgcagtgcaagtcc

SEQ ID NO: 148276 - DNA, 20 bp, human
ggaagaaaagggccaatagg

SEQ ID NO: 148277 - DNA, 20 bp, human
gtaataactaggcccgagta

SEQ ID NO: 148278 - DNA, 20 bp, human
gtggggtggccaaaacacag

SEQ ID NO: 148279 - DNA, 20 bp, human
gggagaagaaaagggccaat

SEQ ID NO: 148280 - DNA, 20 bp, human
gacactcaggcagtagaaca

SEQ ID NO: 148281 - DNA, 20 bp, human
gccaaaacacaggggcagtg

SEQ ID NO: 148282 - DNA, 20 bp, human
ggcggtgtgaaccacgagaa

SEQ ID NO: 148283 - DNA, 20 bp, human
gtcagcaaagctgcaagctg

SEQ ID NO: 148284 - DNA, 20 bp, human
gatggcggcatgatccccga

SEQ ID NO: 148285 - DNA, 20 bp, human
gtgggtaatatgaaccctga

SEQ ID NO: 148286 - DNA, 20 bp, human
gggggccaccacgctctcct

SEQ ID NO: 148287 - DNA, 20 bp, human
gggtcatatactggctacac

SEQ ID NO: 148288 - DNA, 20 bp, human
gggaagcagaaaagcaagag

SEQ ID NO: 148289 - DNA, 20 bp, human
gaagagaggaggtctctaag

SEQ ID NO: 148290 - DNA, 20 bp, human
gggctacactctgagagcag

SEQ ID NO: 148291 - DNA, 20 bp, human
gtggtcctgagggtgttgga

SEQ ID NO: 148292 - DNA, 20 bp, human
ggagagcagtggtagtgcag

SEQ ID NO: 148293 - DNA, 20 bp, human
gcccaacccacagcaaatag

SEQ ID NO: 148294 - DNA, 20 bp, human
ggagcaagctggtcatatac

SEQ ID NO: 148295 - DNA, 20 bp, human
gcttactgaagaggtcaaag

SEQ ID NO: 148296 - DNA, 20 bp, human
gggggccaccacgctctcct

SEQ ID NO: 148297 - DNA, 20 bp, human
gggtcatatactggctacac

SEQ ID NO: 148298 - DNA, 20 bp, human
gggaagcagaaaagcaagag

SEQ ID NO: 148299 - DNA, 20 bp, human
gaagagaggaggtctctaag

SEQ ID NO: 148300 - DNA, 20 bp, human
gggctacactctgagagcag

SEQ ID NO: 148301 - DNA, 20 bp, human
ggagcaagctggtcatatac

SEQ ID NO: 148302 - DNA, 20 bp, human
gcccaacccacagcaaatag

SEQ ID NO: 148303 - DNA, 20 bp, human
gtggtcctgagggtgttgga

SEQ ID NO: 148304 - DNA, 20 bp, human
gggaggctccataccctgag

SEQ ID NO: 148305 - DNA, 20 bp, human
ggagagcagtggtagtgcag

SEQ ID NO: 148306 - DNA, 20 bp, human
gagggccgcccgcaccacct

SEQ ID NO: 148307 - DNA, 20 bp, human
gcactcaggagggacagtcg

SEQ ID NO: 148308 - DNA, 20 bp, human
gcggaacgcgcctcgagggg

SEQ ID NO: 148309 - DNA, 20 bp, human
ggcccgcggcccaggtggtg

SEQ ID NO: 148310 - DNA, 20 bp, human
ggcgctccgcagccgggcta

SEQ ID NO: 148311 - DNA, 20 bp, human
gtccgggccgaatgagacgt

SEQ ID NO: 148312 - DNA, 20 bp, human
gcccacatccgcccagaagg

SEQ ID NO: 148313 - DNA, 20 bp, human
gcgaatgagacgtaggaggg

SEQ ID NO: 148314 - DNA, 20 bp, human
gcctccaccgagctcagagg

SEQ ID NO: 148315 - DNA, 20 bp, human
gtcatgtgagccgggaaatg

SEQ ID NO: 148316 - DNA, 20 bp, human
ggcgccagcgcagccaggaa

SEQ ID NO: 148317 - DNA, 20 bp, human
gcgctggagaaggagaacga

SEQ ID NO: 148318 - DNA, 20 bp, human
gaccagggatcgcaagcgag

SEQ ID NO: 148319 - DNA, 20 bp, human
gagcgcgtcggtcatgctag

SEQ ID NO: 148320 - DNA, 20 bp, human
gtgcgggcggaggacctgga

SEQ ID NO: 148321 - DNA, 20 bp, human
gaggaacgggtcctttcccc

SEQ ID NO: 148322 - DNA, 20 bp, human
ggccgcgggcaacagcgcgt

SEQ ID NO: 148323 - DNA, 20 bp, human
ggctcttgcaacgcgcccag

SEQ ID NO: 148324 - DNA, 20 bp, human
gggtccactaggccgggagg

SEQ ID NO: 148325 - DNA, 20 bp, human
ggccccccagccgctggaga

SEQ ID NO: 148326 - DNA, 20 bp, human
gggcaagtgacacctggaag

SEQ ID NO: 148327 - DNA, 20 bp, human
ggcacccgcgcggggagagt

SEQ ID NO: 148328 - DNA, 20 bp, human
gcagttcttgaggttcaagg

SEQ ID NO: 148329 - DNA, 20 bp, human
gtacaggctggggaaggcta

SEQ ID NO: 148330 - DNA, 20 bp, human
ggccgtacgcccgagaactg

SEQ ID NO: 148331 - DNA, 20 bp, human
gttgaggttcaaggaggcgg

SEQ ID NO: 148332 - DNA, 20 bp, human
gggaagcggcaagtgacacc

SEQ ID NO: 148333 - DNA, 20 bp, human
gccggcctggaccccttatc

SEQ ID NO: 148334 - DNA, 20 bp, human
ggcttggtacaacaggaggg

SEQ ID NO: 148335 - DNA, 20 bp, human
gagcggagagctggacggga

SEQ ID NO: 148336 - DNA, 20 bp, human
ggggagcgtctgtacctctg

SEQ ID NO: 148337 - DNA, 20 bp, human
ggctcccagtgacgccgcag

SEQ ID NO: 148338 - DNA, 20 bp, human
gatgaaacatctgagccagg

SEQ ID NO: 148339 - DNA, 20 bp, human
gactccaggcgagctcgaga

SEQ ID NO: 148340 - DNA, 20 bp, human
gcgccaacctggcaaagagg

SEQ ID NO: 148341 - DNA, 20 bp, human
gctcaggggaggagaaccgt

SEQ ID NO: 148342 - DNA, 20 bp, human
gaaggtcggctccttcggtc

SEQ ID NO: 148343 - DNA, 20 bp, human
ggctcgcctggagtcaccaa

SEQ ID NO: 148344 - DNA, 20 bp, human
ggctgtagcgcaggcaaggt

SEQ ID NO: 148345 - DNA, 20 bp, human
gggcgtcactgggagcccga

SEQ ID NO: 148346 - DNA, 20 bp, human
gacgccatgactgctcacgg

SEQ ID NO: 148347 - DNA, 20 bp, human
gcgaccaccgtgagcagtca

SEQ ID NO: 148348 - DNA, 20 bp, human
gagagcgactctctgcactg

SEQ ID NO: 148349 - DNA, 20 bp, human
gagtacgccatgactgctca

SEQ ID NO: 148350 - DNA, 20 bp, human
gggtctgtgcatcctctagg

SEQ ID NO: 148351 - DNA, 20 bp, human
gtgcagacgccagccggaac

SEQ ID NO: 148352 - DNA, 20 bp, human
ggccagcggggtaagagaga

SEQ ID NO: 148353 - DNA, 20 bp, human
gttcccggcgccgaagagta

SEQ ID NO: 148354 - DNA, 20 bp, human
ggcaggtctgtgcatcctct

SEQ ID NO: 148355 - DNA, 20 bp, human
gacgagatgagttaagccag

SEQ ID NO: 148356 - DNA, 20 bp, human
gctcagtgcctagacgatgg

SEQ ID NO: 148357 - DNA, 20 bp, human
gtctgtgggttaggtcctaa

SEQ ID NO: 148358 - DNA, 20 bp, human
gggtggaaagacgcttctgt

SEQ ID NO: 148359 - DNA, 20 bp, human
gttgctcagtgcctagacga

SEQ ID NO: 148360 - DNA, 20 bp, human
gagtgcctagacgatggtgg

SEQ ID NO: 148361 - DNA, 20 bp, human
gacggttaggaaggattcac

SEQ ID NO: 148362 - DNA, 20 bp, human
gtcaagagggaactgagtcc

SEQ ID NO: 148363 - DNA, 20 bp, human
ggggttaggtcctaacggtt

SEQ ID NO: 148364 - DNA, 20 bp, human
gagcacttgcaaaggtggag

SEQ ID NO: 148365 - DNA, 20 bp, human
gcacaggcgggtcatgagga

SEQ ID NO: 148366 - DNA, 20 bp, human
gggcgaactgcggcccggaa

SEQ ID NO: 148367 - DNA, 20 bp, human
ggcccggaacggctgaggaa

SEQ ID NO: 148368 - DNA, 20 bp, human
gctgcggcccggaacggctg

SEQ ID NO: 148369 - DNA, 20 bp, human
ggggcggggccggcgaactg

SEQ ID NO: 148370 - DNA, 20 bp, human
ggcccttcctcagccgttcc

SEQ ID NO: 148371 - DNA, 20 bp, human
gcgggtagcagggagggcgt

SEQ ID NO: 148372 - DNA, 20 bp, human
gcgcggatcctacccctctg

SEQ ID NO: 148373 - DNA, 20 bp, human
ggctgtgtcagcaagcgtag

SEQ ID NO: 148374 - DNA, 20 bp, human
ggcaaccgcccggggctcca

SEQ ID NO: 148375 - DNA, 20 bp, human
gggatccgcgtccgctgatg

SEQ ID NO: 148376 - DNA, 20 bp, human
ggcgcgaggcgtttacctgg

SEQ ID NO: 148377 - DNA, 20 bp, human
gagggcgcgctcctcatcca

SEQ ID NO: 148378 - DNA, 20 bp, human
gggagtgggcgctacagtgg

SEQ ID NO: 148379 - DNA, 20 bp, human
gtacctggaggcagcggctt

SEQ ID NO: 148380 - DNA, 20 bp, human
ggggcacagatgcacatcta

SEQ ID NO: 148381 - DNA, 20 bp, human
gccggcccggacgatgtaga

SEQ ID NO: 148382 - DNA, 20 bp, human
ggctgggaaggagcgagcgg

SEQ ID NO: 148383 - DNA, 20 bp, human
ggcacatctacggattccgg

SEQ ID NO: 148384 - DNA, 20 bp, human
ggcacctgcggccatggatg

SEQ ID NO: 148385 - DNA, 20 bp, human
ggcacgcttgagaggaggac

SEQ ID NO: 148386 - DNA, 20 bp, human
gagcgggcttacctcgtact

SEQ ID NO: 148387 - DNA, 20 bp, human
gcctgcgagccaatcctaat

SEQ ID NO: 148388 - DNA, 20 bp, human
ggggcttacctcgtactcgg

SEQ ID NO: 148389 - DNA, 20 bp, human
ggcgcagggcggaatgacag

SEQ ID NO: 148390 - DNA, 20 bp, human
gtcggaggttcttcagagag

SEQ ID NO: 148391 - DNA, 20 bp, human
gcgatcgccgccatattgac

SEQ ID NO: 148392 - DNA, 20 bp, human
gctgaaacccgtcaatatgg

SEQ ID NO: 148393 - DNA, 20 bp, human
gatatggcggcgatcggccg

SEQ ID NO: 148394 - DNA, 20 bp, human
ggttcttcagagagcggccg

SEQ ID NO: 148395 - DNA, 20 bp, human
gtgactgaaacccgtcaata

SEQ ID NO: 148396 - DNA, 20 bp, human
ggagggaggagatcggcgga

SEQ ID NO: 148397 - DNA, 20 bp, human
ggcgagatgcctcgttcccc

SEQ ID NO: 148398 - DNA, 20 bp, human
gccctcctagaccaagatgg

SEQ ID NO: 148399 - DNA, 20 bp, human
gaagctgcccgggaaagtgg

SEQ ID NO: 148400 - DNA, 20 bp, human
gagctgggaaagtcgagctc

SEQ ID NO: 148401 - DNA, 20 bp, human
gtgagggccggactcacact

SEQ ID NO: 148402 - DNA, 20 bp, human
ggcacgcgtgagtaaacagc

SEQ ID NO: 148403 - DNA, 20 bp, human
gaccgatggaaacagccccg

SEQ ID NO: 148404 - DNA, 20 bp, human
ggatggaaacagccccgcgg

SEQ ID NO: 148405 - DNA, 20 bp, human
gagtggggcgctctatagtg

SEQ ID NO: 148406 - DNA, 20 bp, human
gcatcttgctgcggtcgtca

SEQ ID NO: 148407 - DNA, 20 bp, human
gttatctgtaagaagatggg

SEQ ID NO: 148408 - DNA, 20 bp, human
ggccgcttgttcaggatgag

SEQ ID NO: 148409 - DNA, 20 bp, human
ggctgccaggcttgctgcag

SEQ ID NO: 148410 - DNA, 20 bp, human
ggcccctcatcctgaacaag

SEQ ID NO: 148411 - DNA, 20 bp, human
ggcatcctggggaaagactt

SEQ ID NO: 148412 - DNA, 20 bp, human
ggcagcccttcacatctcca

SEQ ID NO: 148413 - DNA, 20 bp, human
gagagagccgccgagagaag

SEQ ID NO: 148414 - DNA, 20 bp, human
ggagcagctgcgaaaattca

SEQ ID NO: 148415 - DNA, 20 bp, human
gacgcctagaggtccgccgg

SEQ ID NO: 148416 - DNA, 20 bp, human
gggcgtgatagctcagagac

SEQ ID NO: 148417 - DNA, 20 bp, human
gatagctcagagacaggagc

SEQ ID NO: 148418 - DNA, 20 bp, human
gacgcacagagagccatcag

SEQ ID NO: 148419 - DNA, 20 bp, human
ggtaagctgtctccttccat

SEQ ID NO: 148420 - DNA, 20 bp, human
gctgctccaggcccatcttg

SEQ ID NO: 148421 - DNA, 20 bp, human
gtacgcaggactgctactac

SEQ ID NO: 148422 - DNA, 20 bp, human
ggcaggactgctactactgg

SEQ ID NO: 148423 - DNA, 20 bp, human
gtggatccgtgaagtagtct

SEQ ID NO: 148424 - DNA, 20 bp, human
ggaatcagaactgctcgggt

SEQ ID NO: 148425 - DNA, 20 bp, human
gtctgagaataccctctcag

SEQ ID NO: 148426 - DNA, 20 bp, human
gtgggctccatgtctcccag

SEQ ID NO: 148427 - DNA, 20 bp, human
gccccgtcccagtggagggt

SEQ ID NO: 148428 - DNA, 20 bp, human
ggtcgcagccctaagcctct

SEQ ID NO: 148429 - DNA, 20 bp, human
ggtaagcgcagccccggcca

SEQ ID NO: 148430 - DNA, 20 bp, human
gccagcgcccgcaccactag

SEQ ID NO: 148431 - DNA, 20 bp, human
gcgccctaaacggcttcctg

SEQ ID NO: 148432 - DNA, 20 bp, human
gacagagcccaggcgaccta

SEQ ID NO: 148433 - DNA, 20 bp, human
gcgcgcgcagctccctgcgg

SEQ ID NO: 148434 - DNA, 20 bp, human
gcatgtctcccagaggctta

SEQ ID NO: 148435 - DNA, 20 bp, human
gagctgcgcgcggggccaca

SEQ ID NO: 148436 - DNA, 20 bp, human
gccaggacgcgcacgacctt

SEQ ID NO: 148437 - DNA, 20 bp, human
gagccgggcgcccagacccc

SEQ ID NO: 148438 - DNA, 20 bp, human
gccggcccggccctcgacag

SEQ ID NO: 148439 - DNA, 20 bp, human
ggcgcaggcggtccagctcc

SEQ ID NO: 148440 - DNA, 20 bp, human
gtcggcgctggagaagaacg

SEQ ID NO: 148441 - DNA, 20 bp, human
gctcgggcgcgacgtggtgg

SEQ ID NO: 148442 - DNA, 20 bp, human
ggtccagctcgggcgcgacg

SEQ ID NO: 148443 - DNA, 20 bp, human
gggaccgcctgcgcctggag

SEQ ID NO: 148444 - DNA, 20 bp, human
gtgtgggccacgagttcgag

SEQ ID NO: 148445 - DNA, 20 bp, human
ggctgctcccgagtgggcgg

SEQ ID NO: 148446 - DNA, 20 bp, human
gggcgtaggagggcacctac

SEQ ID NO: 148447 - DNA, 20 bp, human
gaagacagcagctccgaggt

SEQ ID NO: 148448 - DNA, 20 bp, human
ggcagctccgaggtcggcgg

SEQ ID NO: 148449 - DNA, 20 bp, human
gagctcgcggcccaacaggt

SEQ ID NO: 148450 - DNA, 20 bp, human
gcctgtgcgagaagaggaag

SEQ ID NO: 148451 - DNA, 20 bp, human
gacagcagctccgaggtcgg

SEQ ID NO: 148452 - DNA, 20 bp, human
ggaggtgagtgtgggagcga

SEQ ID NO: 148453 - DNA, 20 bp, human
ggcgcctgcggggcgtagga

SEQ ID NO: 148454 - DNA, 20 bp, human
gcccagacccccgccgacct

SEQ ID NO: 148455 - DNA, 20 bp, human
ggacagagccctccggccag

SEQ ID NO: 148456 - DNA, 20 bp, human
gcatgcaggccttcccacaa

SEQ ID NO: 148457 - DNA, 20 bp, human
gcgcccaggaggccccatca

SEQ ID NO: 148458 - DNA, 20 bp, human
ggcctgcatgatgggatctc

SEQ ID NO: 148459 - DNA, 20 bp, human
gagagataaccagcagatag

SEQ ID NO: 148460 - DNA, 20 bp, human
gtagtggatgagacatcact

SEQ ID NO: 148461 - DNA, 20 bp, human
gcactgtccacagaccatct

SEQ ID NO: 148462 - DNA, 20 bp, human
gcaaggcagaacaaacccat

SEQ ID NO: 148463 - DNA, 20 bp, human
gtgggagagtgggcaccaat

SEQ ID NO: 148464 - DNA, 20 bp, human
ggggaggaacaactgggaag

SEQ ID NO: 148465 - DNA, 20 bp, human
gtgcctgagcctccatgatg

SEQ ID NO: 148466 - DNA, 20 bp, human
ggtgtgttaaggccacccat

SEQ ID NO: 148467 - DNA, 20 bp, human
gaggtatgcccacaccccat

SEQ ID NO: 148468 - DNA, 20 bp, human
gtatgcccacaccccatggg

SEQ ID NO: 148469 - DNA, 20 bp, human
gctcctgtacttggagaaag

SEQ ID NO: 148470 - DNA, 20 bp, human
gtgtgggcatacctggtcgt

SEQ ID NO: 148471 - DNA, 20 bp, human
gcgcctgggccagacatccg

SEQ ID NO: 148472 - DNA, 20 bp, human
gggtgccccgagggaagtct

SEQ ID NO: 148473 - DNA, 20 bp, human
gaggcctgccaggcgaagtc

SEQ ID NO: 148474 - DNA, 20 bp, human
gaaggccacccatggggtgt

SEQ ID NO: 148475 - DNA, 20 bp, human
gacctggtcgtgggttcagg

SEQ ID NO: 148476 - DNA, 20 bp, human
ggggacttggtgctagtagc

SEQ ID NO: 148477 - DNA, 20 bp, human
ggtgtgttaaggccacccat

SEQ ID NO: 148478 - DNA, 20 bp, human
gaggtatgcccacaccccat

SEQ ID NO: 148479 - DNA, 20 bp, human
gtatgcccacaccccatggg

SEQ ID NO: 148480 - DNA, 20 bp, human
gcgcctgggccagacatccg

SEQ ID NO: 148481 - DNA, 20 bp, human
gtgtgggcatacctggtcgt

SEQ ID NO: 148482 - DNA, 20 bp, human
gctcctgtacttggagaaag

SEQ ID NO: 148483 - DNA, 20 bp, human
gaggcctgccaggcgaagtc

SEQ ID NO: 148484 - DNA, 20 bp, human
gggtgccccgagggaagtct

SEQ ID NO: 148485 - DNA, 20 bp, human
gaaggccacccatggggtgt

SEQ ID NO: 148486 - DNA, 20 bp, human
gcgtctgcgctccaagtggg

SEQ ID NO: 148487 - DNA, 20 bp, human
gtcacgcagctggcgctccc

SEQ ID NO: 148488 - DNA, 20 bp, human
gcagcgccgcctgcagatag

SEQ ID NO: 148489 - DNA, 20 bp, human
gaggctggcgggcggaacgg

SEQ ID NO: 148490 - DNA, 20 bp, human
gggcaggctggcgggcggaa

SEQ ID NO: 148491 - DNA, 20 bp, human
gctggaaggaggccgagcag

SEQ ID NO: 148492 - DNA, 20 bp, human
ggaccgtctgcgctccaagt

SEQ ID NO: 148493 - DNA, 20 bp, human
gcgacaaagccgggtgcccg

SEQ ID NO: 148494 - DNA, 20 bp, human
gagcttcgctggcagactga

SEQ ID NO: 148495 - DNA, 20 bp, human
gggaacgcgaggccgagatc

SEQ ID NO: 148496 - DNA, 20 bp, human
ggtgtgttaaggccacccat

SEQ ID NO: 148497 - DNA, 20 bp, human
gaggtatgcccacaccccat

SEQ ID NO: 148498 - DNA, 20 bp, human
gcgcctgggccagacatccg

SEQ ID NO: 148499 - DNA, 20 bp, human
gtatgcccacaccccatggg

SEQ ID NO: 148500 - DNA, 20 bp, human
gctcctgtacttggagaaag

SEQ ID NO: 148501 - DNA, 20 bp, human
gtgtgggcatacctggtcgt

SEQ ID NO: 148502 - DNA, 20 bp, human
gaggcctgccaggcgaagtc

SEQ ID NO: 148503 - DNA, 20 bp, human
gggtgccccgagggaagtct

SEQ ID NO: 148504 - DNA, 20 bp, human
gctagaagcaggaaaagtgt

SEQ ID NO: 148505 - DNA, 20 bp, human
gaaggccacccatggggtgt

SEQ ID NO: 148506 - DNA, 20 bp, human
gccgggccgctcgctcagta

SEQ ID NO: 148507 - DNA, 20 bp, human
gagacgcctggcgcacccgc

SEQ ID NO: 148508 - DNA, 20 bp, human
gcctggcgcacccgcgggag

SEQ ID NO: 148509 - DNA, 20 bp, human
gccacgagagccggtcgggt

SEQ ID NO: 148510 - DNA, 20 bp, human
gcccgaaggagactctgctg

SEQ ID NO: 148511 - DNA, 20 bp, human
gcagagctgggagcacatgg

SEQ ID NO: 148512 - DNA, 20 bp, human
gcgctcagtagggcgagcgg

SEQ ID NO: 148513 - DNA, 20 bp, human
gctagctgcgagacttcttg

SEQ ID NO: 148514 - DNA, 20 bp, human
ggtccggggcgagcgcgcca

SEQ ID NO: 148515 - DNA, 20 bp, human
ggctcgctcagtagggcgag

SEQ ID NO: 148516 - DNA, 20 bp, human
gaaggcgcgccctcccgagt

SEQ ID NO: 148517 - DNA, 20 bp, human
gtgaactcgcccactcggga

SEQ ID NO: 148518 - DNA, 20 bp, human
ggcaggcgagtgagggaacg

SEQ ID NO: 148519 - DNA, 20 bp, human
gcccagcccccgctaatcgg

SEQ ID NO: 148520 - DNA, 20 bp, human
gcctcgggtgtagagcagtg

SEQ ID NO: 148521 - DNA, 20 bp, human
gctacacccgagggcaacag

SEQ ID NO: 148522 - DNA, 20 bp, human
gtggatcccccgattagcgg

SEQ ID NO: 148523 - DNA, 20 bp, human
gcgcagtcggcggaggagaa

SEQ ID NO: 148524 - DNA, 20 bp, human
gccccaccgactccgcggag

SEQ ID NO: 148525 - DNA, 20 bp, human
gccgctgaactcgcccactc

SEQ ID NO: 148526 - DNA, 20 bp, human
gtgctgggcgtgcatccgaa

SEQ ID NO: 148527 - DNA, 20 bp, human
gctagggctccgctgtgagg

SEQ ID NO: 148528 - DNA, 20 bp, human
ggaagaggtcaggggaccgg

SEQ ID NO: 148529 - DNA, 20 bp, human
gcggtcaggtggctcaggtc

SEQ ID NO: 148530 - DNA, 20 bp, human
ggctagggcgaccaaaacaa

SEQ ID NO: 148531 - DNA, 20 bp, human
gactcagccgcgaggactag

SEQ ID NO: 148532 - DNA, 20 bp, human
gagtcctcgcggctgagtgt

SEQ ID NO: 148533 - DNA, 20 bp, human
gccgctagggctccgctgtg

SEQ ID NO: 148534 - DNA, 20 bp, human
ggagccagagagcgagcaga

SEQ ID NO: 148535 - DNA, 20 bp, human
gtatcatggcagtgatggac

SEQ ID NO: 148536 - DNA, 20 bp, human
ggtggagccgaaccacccta

SEQ ID NO: 148537 - DNA, 20 bp, human
gcgcgctgaggcagtgactg

SEQ ID NO: 148538 - DNA, 20 bp, human
gggcggcgcccaggccacga

SEQ ID NO: 148539 - DNA, 20 bp, human
gcatcctggccgtcatggat

SEQ ID NO: 148540 - DNA, 20 bp, human
ggagggagggcggcgaactg

SEQ ID NO: 148541 - DNA, 20 bp, human
gagcggggaggcaactccac

SEQ ID NO: 148542 - DNA, 20 bp, human
ggacacccctaaaacagccc

SEQ ID NO: 148543 - DNA, 20 bp, human
gcttcgcccgggtccgtcca

SEQ ID NO: 148544 - DNA, 20 bp, human
ggacctcagccacctcacgg

SEQ ID NO: 148545 - DNA, 20 bp, human
gcctgacctcagccacctca

SEQ ID NO: 148546 - DNA, 20 bp, human
gcggcggcgactgaaaacgg

SEQ ID NO: 148547 - DNA, 20 bp, human
gaggtctggaggaccacggg

SEQ ID NO: 148548 - DNA, 20 bp, human
ggctctggggaggggactaa

SEQ ID NO: 148549 - DNA, 20 bp, human
gacccggcggcgactgaaaa

SEQ ID NO: 148550 - DNA, 20 bp, human
gcggcgagggaggctcacgg

SEQ ID NO: 148551 - DNA, 20 bp, human
gtaggtatgtgagtgtgcag

SEQ ID NO: 148552 - DNA, 20 bp, human
gtggccatgaagcgcaacgt

SEQ ID NO: 148553 - DNA, 20 bp, human
gtggggccggggtccagaca

SEQ ID NO: 148554 - DNA, 20 bp, human
gtcctggaaagggagctgga

SEQ ID NO: 148555 - DNA, 20 bp, human
ggggcctccacaggccgagg

SEQ ID NO: 148556 - DNA, 20 bp, human
ggtgtcccgggatccaggtc

SEQ ID NO: 148557 - DNA, 20 bp, human
gggaggcggacagactgagg

SEQ ID NO: 148558 - DNA, 20 bp, human
gggagaccctggggtcccgt

SEQ ID NO: 148559 - DNA, 20 bp, human
gtgggtgcggaaggagaccc

SEQ ID NO: 148560 - DNA, 20 bp, human
gcagcagcacagcgcgcctc

SEQ ID NO: 148561 - DNA, 20 bp, human
ggcgagcgcctcgaaggagg

SEQ ID NO: 148562 - DNA, 20 bp, human
gcgcgctgtgctgctggcgg

SEQ ID NO: 148563 - DNA, 20 bp, human
gatggcgagcgcctcgaagg

SEQ ID NO: 148564 - DNA, 20 bp, human
ggctaccggacctggatccc

SEQ ID NO: 148565 - DNA, 20 bp, human
ggggaggagggcgcacgggt

SEQ ID NO: 148566 - DNA, 20 bp, human
ggaggagctccagaactcta

SEQ ID NO: 148567 - DNA, 20 bp, human
gggagacgcctgagagagga

SEQ ID NO: 148568 - DNA, 20 bp, human
gcagctgcaagccaacgcag

SEQ ID NO: 148569 - DNA, 20 bp, human
ggggcaagactcacccccgg

SEQ ID NO: 148570 - DNA, 20 bp, human
gccaaggagacgcctgagag

SEQ ID NO: 148571 - DNA, 20 bp, human
gcgagaggagggcctatccg

SEQ ID NO: 148572 - DNA, 20 bp, human
gtagagaaagtgggaaaccc

SEQ ID NO: 148573 - DNA, 20 bp, human
gagggctctccaggatgtag

SEQ ID NO: 148574 - DNA, 20 bp, human
gggccgcactgcacatgctg

SEQ ID NO: 148575 - DNA, 20 bp, human
gggaagagaatccagtccca

SEQ ID NO: 148576 - DNA, 20 bp, human
gggcagccctcataggacta

SEQ ID NO: 148577 - DNA, 20 bp, human
gggtcggcgctaatggacaa

SEQ ID NO: 148578 - DNA, 20 bp, human
ggccccaagagcgactgctg

SEQ ID NO: 148579 - DNA, 20 bp, human
gcactttatagtaaactcag

SEQ ID NO: 148580 - DNA, 20 bp, human
gaagggtaccgtagtttgag

SEQ ID NO: 148581 - DNA, 20 bp, human
ggcttccctgaagggtaaag

SEQ ID NO: 148582 - DNA, 20 bp, human
gtcagtggtggctttccgtg

SEQ ID NO: 148583 - DNA, 20 bp, human
gccaaccggtacaagtctgg

SEQ ID NO: 148584 - DNA, 20 bp, human
ggtttactataaagtgacag

SEQ ID NO: 148585 - DNA, 20 bp, human
ggacatctgtggggaggcat

SEQ ID NO: 148586 - DNA, 20 bp, human
ggagcgagagccccagagcg

SEQ ID NO: 148587 - DNA, 20 bp, human
gactccgctggacccgatgt

SEQ ID NO: 148588 - DNA, 20 bp, human
gtagccaacatcgggtccag

SEQ ID NO: 148589 - DNA, 20 bp, human
gcgcgcggaacgcggagtcc

SEQ ID NO: 148590 - DNA, 20 bp, human
gacgcgcccgaaggactctc

SEQ ID NO: 148591 - DNA, 20 bp, human
ggactctctgggacaagaag

SEQ ID NO: 148592 - DNA, 20 bp, human
ggggtccagcggagtcacca

SEQ ID NO: 148593 - DNA, 20 bp, human
ggctggtggacggattacga

SEQ ID NO: 148594 - DNA, 20 bp, human
gtgatacgggacccccaccg

SEQ ID NO: 148595 - DNA, 20 bp, human
ggaccccacggggtaagtcc

SEQ ID NO: 148596 - DNA, 20 bp, human
gatgcggtctgtggatataa

SEQ ID NO: 148597 - DNA, 20 bp, human
ggagaaggcgaagaaggctg

SEQ ID NO: 148598 - DNA, 20 bp, human
gaccggaccccgcaggtgac

SEQ ID NO: 148599 - DNA, 20 bp, human
gggagggggtaagcctgaaa

SEQ ID NO: 148600 - DNA, 20 bp, human
ggccgaggagaaggcgaaga

SEQ ID NO: 148601 - DNA, 20 bp, human
gaggggcggggtctacgcga

SEQ ID NO: 148602 - DNA, 20 bp, human
ggagctgcaccggaccccgc

SEQ ID NO: 148603 - DNA, 20 bp, human
gggagaggggcgcttctgga

SEQ ID NO: 148604 - DNA, 20 bp, human
gggctccacagccgaggaga

SEQ ID NO: 148605 - DNA, 20 bp, human
ggggcgcagaccccccacca

SEQ ID NO: 148606 - DNA, 20 bp, human
gtctcctccgagaacaggta

SEQ ID NO: 148607 - DNA, 20 bp, human
ggggccctacctgttctcgg

SEQ ID NO: 148608 - DNA, 20 bp, human
gaggcctctcctccgagaac

SEQ ID NO: 148609 - DNA, 20 bp, human
gggcctgcagtagcaggaag

SEQ ID NO: 148610 - DNA, 20 bp, human
gccagatgctcggttcctgg

SEQ ID NO: 148611 - DNA, 20 bp, human
gggcagctgcctcataccaa

SEQ ID NO: 148612 - DNA, 20 bp, human
gagcaggagacctggatcgg

SEQ ID NO: 148613 - DNA, 20 bp, human
ggttcatcaccctctctcca

SEQ ID NO: 148614 - DNA, 20 bp, human
gaggagaggcctgcagtagc

SEQ ID NO: 148615 - DNA, 20 bp, human
gtgcccaggcaagagcagga

SEQ ID NO: 148616 - DNA, 20 bp, human
gcaagaggagcgccaccttg

SEQ ID NO: 148617 - DNA, 20 bp, human
gtgcgccccgcgccgcaagg

SEQ ID NO: 148618 - DNA, 20 bp, human
gcgcaaggcgctcgtggatg

SEQ ID NO: 148619 - DNA, 20 bp, human
gatgcggctccgcaaggcgg

SEQ ID NO: 148620 - DNA, 20 bp, human
gcatgcccgacaaggtggag

SEQ ID NO: 148621 - DNA, 20 bp, human
ggaggtgcgcaaggcgctcg

SEQ ID NO: 148622 - DNA, 20 bp, human
gccgatccccaggaccacga

SEQ ID NO: 148623 - DNA, 20 bp, human
gcgaggcgagaaccaaggta

SEQ ID NO: 148624 - DNA, 20 bp, human
ggctgaccgaggaactcatc

SEQ ID NO: 148625 - DNA, 20 bp, human
gcggtcctgaagattctggt

SEQ ID NO: 148626 - DNA, 20 bp, human
gcatcgagaggaagtcgctg

SEQ ID NO: 148627 - DNA, 20 bp, human
gtcctacggcctccgaggct

SEQ ID NO: 148628 - DNA, 20 bp, human
gggcctgtggagtctggcta

SEQ ID NO: 148629 - DNA, 20 bp, human
gcagcgtggcctgtggagtc

SEQ ID NO: 148630 - DNA, 20 bp, human
gacccagcctcggaggccgt

SEQ ID NO: 148631 - DNA, 20 bp, human
gactcactacccagcctcgg

SEQ ID NO: 148632 - DNA, 20 bp, human
gggccttagccagactccac

SEQ ID NO: 148633 - DNA, 20 bp, human
gggcggtggcaccaggacag

SEQ ID NO: 148634 - DNA, 20 bp, human
ggtaactccaggtcctgcgg

SEQ ID NO: 148635 - DNA, 20 bp, human
gggtggcacagacctcccgg

SEQ ID NO: 148636 - DNA, 20 bp, human
gggcagggtggtggatctgt

SEQ ID NO: 148637 - DNA, 20 bp, human
gcgcacgtggtggccactgt

SEQ ID NO: 148638 - DNA, 20 bp, human
gccacgtgcgacgggaaaac

SEQ ID NO: 148639 - DNA, 20 bp, human
gccagagccagggcactgta

SEQ ID NO: 148640 - DNA, 20 bp, human
gcggtttagagggagactag

SEQ ID NO: 148641 - DNA, 20 bp, human
gacggccgcctacctgtcag

SEQ ID NO: 148642 - DNA, 20 bp, human
ggccgccggtagtccatgac

SEQ ID NO: 148643 - DNA, 20 bp, human
ggtcggttagcgtcactggg

SEQ ID NO: 148644 - DNA, 20 bp, human
gagagccgtacccagagcca

SEQ ID NO: 148645 - DNA, 20 bp, human
ggtcagacttccgggcgagg

SEQ ID NO: 148646 - DNA, 20 bp, human
ggaggcatctgggttcggac

SEQ ID NO: 148647 - DNA, 20 bp, human
gagcgcgtgcgcgagccatc

SEQ ID NO: 148648 - DNA, 20 bp, human
gtgtcgtcggagaggcatct

SEQ ID NO: 148649 - DNA, 20 bp, human
gacgacagccgcaaagcgta

SEQ ID NO: 148650 - DNA, 20 bp, human
gtcggactggggccgccatg

SEQ ID NO: 148651 - DNA, 20 bp, human
gtcggagaggcatctgggtt

SEQ ID NO: 148652 - DNA, 20 bp, human
gcactctgggacccgggacg

SEQ ID NO: 148653 - DNA, 20 bp, human
gcacagctggtcggaagctc

SEQ ID NO: 148654 - DNA, 20 bp, human
ggcttccgaccagctgtgaa

SEQ ID NO: 148655 - DNA, 20 bp, human
ggatctgagcaggcacactc

SEQ ID NO: 148656 - DNA, 20 bp, human
gccatctgtcacctccactc

SEQ ID NO: 148657 - DNA, 20 bp, human
ggctccgccgaggagacagg

SEQ ID NO: 148658 - DNA, 20 bp, human
gatggagggagcggaaagag

SEQ ID NO: 148659 - DNA, 20 bp, human
gcaggctccgccgaggagac

SEQ ID NO: 148660 - DNA, 20 bp, human
ggggcggctggatctcccaa

SEQ ID NO: 148661 - DNA, 20 bp, human
gggcgactggctgctgatgc

SEQ ID NO: 148662 - DNA, 20 bp, human
gcgggcagcaggctccgccg

SEQ ID NO: 148663 - DNA, 20 bp, human
gagagagccctaaccactca

SEQ ID NO: 148664 - DNA, 20 bp, human
gcgtgtcccgcctgtctcct

SEQ ID NO: 148665 - DNA, 20 bp, human
gctctcggaaagctcggaga

SEQ ID NO: 148666 - DNA, 20 bp, human
gcggagcgcggcgactccag

SEQ ID NO: 148667 - DNA, 20 bp, human
ggctctggcgccccagctgt

SEQ ID NO: 148668 - DNA, 20 bp, human
ggggcgctcccggaagtcag

SEQ ID NO: 148669 - DNA, 20 bp, human
gcgggcttcccggaaggaga

SEQ ID NO: 148670 - DNA, 20 bp, human
ggataagcagagacacctag

SEQ ID NO: 148671 - DNA, 20 bp, human
gcagccgggcgcgctcgacg

SEQ ID NO: 148672 - DNA, 20 bp, human
gcccgccggtaccggaagtc

SEQ ID NO: 148673 - DNA, 20 bp, human
gcgggcgcgctcgacgcgga

SEQ ID NO: 148674 - DNA, 20 bp, human
gcggccgcgggcttcccgga

SEQ ID NO: 148675 - DNA, 20 bp, human
ggccggtaccggaagtcggg

SEQ ID NO: 148676 - DNA, 20 bp, human
ggcgcgacacggagactagg

SEQ ID NO: 148677 - DNA, 20 bp, human
gggggccgagtgggagtccg

SEQ ID NO: 148678 - DNA, 20 bp, human
gggagcgcgacacggagact

SEQ ID NO: 148679 - DNA, 20 bp, human
ggtgcccgccggggccgagt

SEQ ID NO: 148680 - DNA, 20 bp, human
gactcccactcggccccggc

SEQ ID NO: 148681 - DNA, 20 bp, human
ggagctgcggaggcggaaac

SEQ ID NO: 148682 - DNA, 20 bp, human
gcgcaggatgacgtctgtcc

SEQ ID NO: 148683 - DNA, 20 bp, human
gaaccggctgcgcgctgcag

SEQ ID NO: 148684 - DNA, 20 bp, human
gtaaaaggcggtgcccgccg

SEQ ID NO: 148685 - DNA, 20 bp, human
gaggcggtggtgtctcggcg

SEQ ID NO: 148686 - DNA, 20 bp, human
gccgcaacactaggtcacga

SEQ ID NO: 148687 - DNA, 20 bp, human
gactccgctgctcgacaggt

SEQ ID NO: 148688 - DNA, 20 bp, human
gcacgagggcgcccattccc

SEQ ID NO: 148689 - DNA, 20 bp, human
ggtttgtggtagggaatggt

SEQ ID NO: 148690 - DNA, 20 bp, human
gctgcctacctgtcgagcag

SEQ ID NO: 148691 - DNA, 20 bp, human
ggggctccctagaggtgacg

SEQ ID NO: 148692 - DNA, 20 bp, human
gccctagaggtgacgaggtg

SEQ ID NO: 148693 - DNA, 20 bp, human
gcgacaggtaggcagtcact

SEQ ID NO: 148694 - DNA, 20 bp, human
ggcgcccgggaccatgaacg

SEQ ID NO: 148695 - DNA, 20 bp, human
gaaagaagtcagctctggtt

SEQ ID NO: 148696 - DNA, 20 bp, human
ggtcagtctctagaccaaga

SEQ ID NO: 148697 - DNA, 20 bp, human
gtcctcgatggacaccaagg

SEQ ID NO: 148698 - DNA, 20 bp, human
gtgagaacgccgagtcacag

SEQ ID NO: 148699 - DNA, 20 bp, human
gatggacaccaagggggcgg

SEQ ID NO: 148700 - DNA, 20 bp, human
ggcccccttggtgtccatcg

SEQ ID NO: 148701 - DNA, 20 bp, human
gactgtagaggcgcctataa

SEQ ID NO: 148702 - DNA, 20 bp, human
gcggaaaaagggtaacaacc

SEQ ID NO: 148703 - DNA, 20 bp, human
gtgggcgacacccctctctc

SEQ ID NO: 148704 - DNA, 20 bp, human
gtcgtcggcaaaggcgggtt

SEQ ID NO: 148705 - DNA, 20 bp, human
ggaaagtagactcaccgtct

SEQ ID NO: 148706 - DNA, 20 bp, human
gcagcagcgccagggcccat

SEQ ID NO: 148707 - DNA, 20 bp, human
ggctagacgtgcgcgatgga

SEQ ID NO: 148708 - DNA, 20 bp, human
ggggtcaggcggctcctctg

SEQ ID NO: 148709 - DNA, 20 bp, human
gtcacgggctgggagaaggt

SEQ ID NO: 148710 - DNA, 20 bp, human
gggcgacggcgggaccccat

SEQ ID NO: 148711 - DNA, 20 bp, human
gtcgacgcgggcgagttcac

SEQ ID NO: 148712 - DNA, 20 bp, human
gtgggcgccttaggacgtcc

SEQ ID NO: 148713 - DNA, 20 bp, human
ggggtgagttcgggagagag

SEQ ID NO: 148714 - DNA, 20 bp, human
gggctcgatcgcgcacgtcg

SEQ ID NO: 148715 - DNA, 20 bp, human
gtaggacgtccgggcagacg

SEQ ID NO: 148716 - DNA, 20 bp, human
ggaagcagccaggtcctcat

SEQ ID NO: 148717 - DNA, 20 bp, human
ggggaagtaggagaccccac

SEQ ID NO: 148718 - DNA, 20 bp, human
gtcccgctgggtggcaagag

SEQ ID NO: 148719 - DNA, 20 bp, human
gcttaggggaccaaagccag

SEQ ID NO: 148720 - DNA, 20 bp, human
ggtcccctcttgccacccag

SEQ ID NO: 148721 - DNA, 20 bp, human
gcagcagagtccattcttag

SEQ ID NO: 148722 - DNA, 20 bp, human
gccacccagcgggattagtg

SEQ ID NO: 148723 - DNA, 20 bp, human
gaggccagggagtgccagtg

SEQ ID NO: 148724 - DNA, 20 bp, human
gggctttggtcccctaagaa

SEQ ID NO: 148725 - DNA, 20 bp, human
gcttgagagcttcctgagag

SEQ ID NO: 148726 - DNA, 20 bp, human
gggagacgtgagcccagacc

SEQ ID NO: 148727 - DNA, 20 bp, human
gcgctgggaatgtaacccca

SEQ ID NO: 148728 - DNA, 20 bp, human
gggccatcgggcatctggag

SEQ ID NO: 148729 - DNA, 20 bp, human
gcagcgggcacgaggaacac

SEQ ID NO: 148730 - DNA, 20 bp, human
ggggagcacaaggcgcgcag

SEQ ID NO: 148731 - DNA, 20 bp, human
gctcaggccgcgcctcccac

SEQ ID NO: 148732 - DNA, 20 bp, human
gcggcttcggtggattctcc

SEQ ID NO: 148733 - DNA, 20 bp, human
gtgccagcgctcggcttcgg

SEQ ID NO: 148734 - DNA, 20 bp, human
gctgcgtatctgcgggatag

SEQ ID NO: 148735 - DNA, 20 bp, human
gatccaccgaagccgagcgc

SEQ ID NO: 148736 - DNA, 20 bp, human
gaggccggcgccgcagcaag

SEQ ID NO: 148737 - DNA, 20 bp, human
gggcaccatggagcccgaag

SEQ ID NO: 148738 - DNA, 20 bp, human
gtggatctaggcgcgctcgt

SEQ ID NO: 148739 - DNA, 20 bp, human
gtcctggccagctacatcct

SEQ ID NO: 148740 - DNA, 20 bp, human
gcgttagcccgagtggatct

SEQ ID NO: 148741 - DNA, 20 bp, human
gccggggacactgcagtctc

SEQ ID NO: 148742 - DNA, 20 bp, human
gtcgggctccatggtgccgg

SEQ ID NO: 148743 - DNA, 20 bp, human
gagcgcgcctagatccactc

SEQ ID NO: 148744 - DNA, 20 bp, human
gatgtagctggccaggaaag

SEQ ID NO: 148745 - DNA, 20 bp, human
gaactgagatctcctctaca

SEQ ID NO: 148746 - DNA, 20 bp, human
gccggagcctccgcgagtga

SEQ ID NO: 148747 - DNA, 20 bp, human
gcggttgcgggaggggtcac

SEQ ID NO: 148748 - DNA, 20 bp, human
gaggggtcacaggtcagtgc

SEQ ID NO: 148749 - DNA, 20 bp, human
gccggtggcgccatcttact

SEQ ID NO: 148750 - DNA, 20 bp, human
ggtgactgaactgtctagga

SEQ ID NO: 148751 - DNA, 20 bp, human
gctgaactgtctaggaggga

SEQ ID NO: 148752 - DNA, 20 bp, human
gtcacgtctgcggtacccag

SEQ ID NO: 148753 - DNA, 20 bp, human
gcgtcttccttcactcgcgg

SEQ ID NO: 148754 - DNA, 20 bp, human
gttcttagggccacccgaaa

SEQ ID NO: 148755 - DNA, 20 bp, human
gtcttactcggttgcgggag

SEQ ID NO: 148756 - DNA, 20 bp, human
gtgctgttagaggtgaactg

SEQ ID NO: 148757 - DNA, 20 bp, human
gggtaagaaccatcagcgtc

SEQ ID NO: 148758 - DNA, 20 bp, human
ggggtccagagagtacaagg

SEQ ID NO: 148759 - DNA, 20 bp, human
gtaaaactgtgtcaaagcaa

SEQ ID NO: 148760 - DNA, 20 bp, human
gccccgggcagcgcatcagg

SEQ ID NO: 148761 - DNA, 20 bp, human
gtcgagcaagcacctgacac

SEQ ID NO: 148762 - DNA, 20 bp, human
ggctatgagacccgctcgag

SEQ ID NO: 148763 - DNA, 20 bp, human
ggcagttaaacacagagtat

SEQ ID NO: 148764 - DNA, 20 bp, human
gggagaaagtcacccgtgtc

SEQ ID NO: 148765 - DNA, 20 bp, human
gcaggatgctccaaagtgtc

SEQ ID NO: 148766 - DNA, 20 bp, human
ggtaccaggtagccccaagg

SEQ ID NO: 148767 - DNA, 20 bp, human
gcaggtaccaggtagcccca

SEQ ID NO: 148768 - DNA, 20 bp, human
gctagagctccaggacattc

SEQ ID NO: 148769 - DNA, 20 bp, human
ggaccggaccacgcctccag

SEQ ID NO: 148770 - DNA, 20 bp, human
gtccaggacattcaggtacc

SEQ ID NO: 148771 - DNA, 20 bp, human
ggaggagctgccgacctggc

SEQ ID NO: 148772 - DNA, 20 bp, human
gacctggtacctgaatgtcc

SEQ ID NO: 148773 - DNA, 20 bp, human
ggctcctccttggggctacc

SEQ ID NO: 148774 - DNA, 20 bp, human
gggcaggtaagtcaatacct

SEQ ID NO: 148775 - DNA, 20 bp, human
gcctggcccaggcaagcccc

SEQ ID NO: 148776 - DNA, 20 bp, human
ggctgaggctccggcggtag

SEQ ID NO: 148777 - DNA, 20 bp, human
gctggtgggccgtgggaaga

SEQ ID NO: 148778 - DNA, 20 bp, human
gcccagcggtggccaaagtc

SEQ ID NO: 148779 - DNA, 20 bp, human
ggccctccgggatctcagta

SEQ ID NO: 148780 - DNA, 20 bp, human
gggaagatggcggacggaaa

SEQ ID NO: 148781 - DNA, 20 bp, human
gtcagagcaaaacgacccag

SEQ ID NO: 148782 - DNA, 20 bp, human
gccacggcccaccagcgcgt

SEQ ID NO: 148783 - DNA, 20 bp, human
ggagcaaaacgacccagcgg

SEQ ID NO: 148784 - DNA, 20 bp, human
gagggagcaagaggtgtcgg

SEQ ID NO: 148785 - DNA, 20 bp, human
gggtggccaaagtcgggcag

SEQ ID NO: 148786 - DNA, 20 bp, human
ggggccattttgagagaacg

SEQ ID NO: 148787 - DNA, 20 bp, human
gcggagccttaggaaatcgg

SEQ ID NO: 148788 - DNA, 20 bp, human
gagctcgcgcggccaccgag

SEQ ID NO: 148789 - DNA, 20 bp, human
ggtcgacaggctctttgaag

SEQ ID NO: 148790 - DNA, 20 bp, human
gcgagcaggcgctgggctag

SEQ ID NO: 148791 - DNA, 20 bp, human
gggcagcggcgactacgcca

SEQ ID NO: 148792 - DNA, 20 bp, human
gcactcaactaaaatggcag

SEQ ID NO: 148793 - DNA, 20 bp, human
ggagtgacgcgtcgtggcag

SEQ ID NO: 148794 - DNA, 20 bp, human
gacctagtaagtgaagactt

SEQ ID NO: 148795 - DNA, 20 bp, human
gtggcccgagtgacgcgtcg

SEQ ID NO: 148796 - DNA, 20 bp, human
ggatagcccatactaaagac

SEQ ID NO: 148797 - DNA, 20 bp, human
ggcagtcgcggccaaatgga

SEQ ID NO: 148798 - DNA, 20 bp, human
gactaaagactggttgagcc

SEQ ID NO: 148799 - DNA, 20 bp, human
gcagagcagtcgcggccaaa

SEQ ID NO: 148800 - DNA, 20 bp, human
gggtggaacaagaacaggcg

SEQ ID NO: 148801 - DNA, 20 bp, human
gctcaaccagtctttagtat

SEQ ID NO: 148802 - DNA, 20 bp, human
gtagtaaacagaattctagc

SEQ ID NO: 148803 - DNA, 20 bp, human
gataacatcgtccttccatt

SEQ ID NO: 148804 - DNA, 20 bp, human
gtagcaggtggaacaagaac

SEQ ID NO: 148805 - DNA, 20 bp, human
gtaaacagaattctagcagg

SEQ ID NO: 148806 - DNA, 20 bp, human
ggcagtcgcggactcatgga

SEQ ID NO: 148807 - DNA, 20 bp, human
gaagctgagtgatagcccaa

SEQ ID NO: 148808 - DNA, 20 bp, human
ggtcgcggactcatggatgg

SEQ ID NO: 148809 - DNA, 20 bp, human
gcagagcagtcgcggactca

SEQ ID NO: 148810 - DNA, 20 bp, human
gtacaaaagaccgcttgagc

SEQ ID NO: 148811 - DNA, 20 bp, human
gtttccctacccggctcaag

SEQ ID NO: 148812 - DNA, 20 bp, human
gctgcaacgtcccgacctcc

SEQ ID NO: 148813 - DNA, 20 bp, human
gggtggaaaaaaaacaggcg

SEQ ID NO: 148814 - DNA, 20 bp, human
ggcggtcttttgtatccctt

SEQ ID NO: 148815 - DNA, 20 bp, human
gtagcaggtggaaaaaaaac

SEQ ID NO: 148816 - DNA, 20 bp, human
gctgcccagccttgaaacaa

SEQ ID NO: 148817 - DNA, 20 bp, human
gggtgttgcaagccatccat

SEQ ID NO: 148818 - DNA, 20 bp, human
gaggtgtccctggctgaatg

SEQ ID NO: 148819 - DNA, 20 bp, human
ggcctcacccatagcctcgt

SEQ ID NO: 148820 - DNA, 20 bp, human
ggacttccagcccccatgga

SEQ ID NO: 148821 - DNA, 20 bp, human
gtaaggacagagataagagg

SEQ ID NO: 148822 - DNA, 20 bp, human
ggtataaatggggggccaag

SEQ ID NO: 148823 - DNA, 20 bp, human
gagcatgtacctggccatgc

SEQ ID NO: 148824 - DNA, 20 bp, human
gggtcagcacccataccgcc

SEQ ID NO: 148825 - DNA, 20 bp, human
gcacctgcgggggctcccgg

SEQ ID NO: 148826 - DNA, 20 bp, human
gtggcccggccgctcctcat

SEQ ID NO: 148827 - DNA, 20 bp, human
gcatgcctgtgcgggaccat

SEQ ID NO: 148828 - DNA, 20 bp, human
gcccggccgctcctcatggg

SEQ ID NO: 148829 - DNA, 20 bp, human
gctcccggagccgccagctc

SEQ ID NO: 148830 - DNA, 20 bp, human
gggtagcggtcaaggagagg

SEQ ID NO: 148831 - DNA, 20 bp, human
gcgctcctcatgggtggtag

SEQ ID NO: 148832 - DNA, 20 bp, human
gtgaccgcggccgcacgacc

SEQ ID NO: 148833 - DNA, 20 bp, human
gtgcggccgcggtcacatcc

SEQ ID NO: 148834 - DNA, 20 bp, human
gagcggtcaaggagaggggg

SEQ ID NO: 148835 - DNA, 20 bp, human
gagaagccaggatgtgaccg

SEQ ID NO: 148836 - DNA, 20 bp, human
ggcggccagcgaggaaggag

SEQ ID NO: 148837 - DNA, 20 bp, human
ggaggcccaacgagctccgg

SEQ ID NO: 148838 - DNA, 20 bp, human
gctcacaggagatgccgtcg

SEQ ID NO: 148839 - DNA, 20 bp, human
gcgcttacctcggagctcac

SEQ ID NO: 148840 - DNA, 20 bp, human
gagaggacgagcgcgcacac

SEQ ID NO: 148841 - DNA, 20 bp, human
gcagcaggctgcccttccac

SEQ ID NO: 148842 - DNA, 20 bp, human
ggtctgggccatgggccggg

SEQ ID NO: 148843 - DNA, 20 bp, human
gaaacctggctacccgggga

SEQ ID NO: 148844 - DNA, 20 bp, human
gtttcccgccggagctcgtt

SEQ ID NO: 148845 - DNA, 20 bp, human
gggagctcgttgggcctccc

SEQ ID NO: 148846 - DNA, 20 bp, human
ggggcggctccacgtcggaa

SEQ ID NO: 148847 - DNA, 20 bp, human
gggcgctggctgctcgactg

SEQ ID NO: 148848 - DNA, 20 bp, human
ggggctgtcagagaaggagt

SEQ ID NO: 148849 - DNA, 20 bp, human
gctacttcaggcagctacgg

SEQ ID NO: 148850 - DNA, 20 bp, human
gagctgcctgaagtagtgca

SEQ ID NO: 148851 - DNA, 20 bp, human
ggccatgacctgcaacttgc

SEQ ID NO: 148852 - DNA, 20 bp, human
ggagccggaacccactgagt

SEQ ID NO: 148853 - DNA, 20 bp, human
gccccggggcggctccacgt

SEQ ID NO: 148854 - DNA, 20 bp, human
gccccagttaaggatagtgg

SEQ ID NO: 148855 - DNA, 20 bp, human
gcttcaggcagctacggagg

SEQ ID NO: 148856 - DNA, 20 bp, human
gctggagcccgcgggtccta

SEQ ID NO: 148857 - DNA, 20 bp, human
gtatctgggtcaggacgcga

SEQ ID NO: 148858 - DNA, 20 bp, human
gacagtagccctggagcccg

SEQ ID NO: 148859 - DNA, 20 bp, human
ggtcctgacccagatagcgg

SEQ ID NO: 148860 - DNA, 20 bp, human
gacctgctggcgcgcagtgg

SEQ ID NO: 148861 - DNA, 20 bp, human
gaggacctgctggcgcgcag

SEQ ID NO: 148862 - DNA, 20 bp, human
ggtcagcgagggatgaaccc

SEQ ID NO: 148863 - DNA, 20 bp, human
ggaaataccagcgacctccg

SEQ ID NO: 148864 - DNA, 20 bp, human
ggaacccgggaagccactat

SEQ ID NO: 148865 - DNA, 20 bp, human
gacggaagccctagccccgg

SEQ ID NO: 148866 - DNA, 20 bp, human
gacccggccgccagccacca

SEQ ID NO: 148867 - DNA, 20 bp, human
gtgacagcgtgagcccgcgg

SEQ ID NO: 148868 - DNA, 20 bp, human
gggccgggtaagggtctgag

SEQ ID NO: 148869 - DNA, 20 bp, human
gccggcacgggcaccaccca

SEQ ID NO: 148870 - DNA, 20 bp, human
ggtggctggcggccgggtaa

SEQ ID NO: 148871 - DNA, 20 bp, human
gcaccctcaaggctgaaccc

SEQ ID NO: 148872 - DNA, 20 bp, human
gcactgacagcgtgagcccg

SEQ ID NO: 148873 - DNA, 20 bp, human
gggtgcagcatgtctagact

SEQ ID NO: 148874 - DNA, 20 bp, human
gtgtcagtgaccgtgacgtc

SEQ ID NO: 148875 - DNA, 20 bp, human
ggtcggggggtgtactggag

SEQ ID NO: 148876 - DNA, 20 bp, human
gagcgcgcggcaaatcgggc

SEQ ID NO: 148877 - DNA, 20 bp, human
ggcagcgcaactgtaaggac

SEQ ID NO: 148878 - DNA, 20 bp, human
gcctgggcagcgcaactgta

SEQ ID NO: 148879 - DNA, 20 bp, human
gtcgcgcaacatcggtccct

SEQ ID NO: 148880 - DNA, 20 bp, human
gggagaacttctcgccgaga

SEQ ID NO: 148881 - DNA, 20 bp, human
ggggcacaggcggtttcaca

SEQ ID NO: 148882 - DNA, 20 bp, human
ggtaaggacaggaaccgccg

SEQ ID NO: 148883 - DNA, 20 bp, human
gctgggccgagcaccgacct

SEQ ID NO: 148884 - DNA, 20 bp, human
gcgcgagcgcgcggcaaatc

SEQ ID NO: 148885 - DNA, 20 bp, human
gggggcgagcctgggagtac

SEQ ID NO: 148886 - DNA, 20 bp, human
ggtgcggcgaggcggaatgg

SEQ ID NO: 148887 - DNA, 20 bp, human
gccgccagcaccttgagtgg

SEQ ID NO: 148888 - DNA, 20 bp, human
gcggctgcggactcgttctc

SEQ ID NO: 148889 - DNA, 20 bp, human
gttctcaggcggccccgcgg

SEQ ID NO: 148890 - DNA, 20 bp, human
ggctccgccagcaccttgag

SEQ ID NO: 148891 - DNA, 20 bp, human
gatgcagggcagggtagtga

SEQ ID NO: 148892 - DNA, 20 bp, human
gtggcggccgtgtggatgca

SEQ ID NO: 148893 - DNA, 20 bp, human
gaaagttggcgggaaagcgg

SEQ ID NO: 148894 - DNA, 20 bp, human
ggaccgagaagtccccgctc

SEQ ID NO: 148895 - DNA, 20 bp, human
gctgcggactcgttctcagg

SEQ ID NO: 148896 - DNA, 20 bp, human
gcagctcgagtggtccggct

SEQ ID NO: 148897 - DNA, 20 bp, human
gcaaagggtcacagccgcac

SEQ ID NO: 148898 - DNA, 20 bp, human
gagagaagaaggaagcgcca

SEQ ID NO: 148899 - DNA, 20 bp, human
gtctccgccggaagagaaga

SEQ ID NO: 148900 - DNA, 20 bp, human
ggctgcagtagtgagaggct

SEQ ID NO: 148901 - DNA, 20 bp, human
ggtgggaccagagttcagtg

SEQ ID NO: 148902 - DNA, 20 bp, human
gaggcagttactcagttccc

SEQ ID NO: 148903 - DNA, 20 bp, human
ggcgcagccgcactgaactc

SEQ ID NO: 148904 - DNA, 20 bp, human
gttgagtttgaggaattgaa

SEQ ID NO: 148905 - DNA, 20 bp, human
gcccggaacgtgtacagtta

SEQ ID NO: 148906 - DNA, 20 bp, human
gctgcaggatctcgtgcttg

SEQ ID NO: 148907 - DNA, 20 bp, human
ggcacaagttctcaggctac

SEQ ID NO: 148908 - DNA, 20 bp, human
gttcggcccgggccccaccg

SEQ ID NO: 148909 - DNA, 20 bp, human
ggcaggacgcggcctcggtg

SEQ ID NO: 148910 - DNA, 20 bp, human
ggcagcggcgactcgccggg

SEQ ID NO: 148911 - DNA, 20 bp, human
gatctcgtgcttgaggccgc

SEQ ID NO: 148912 - DNA, 20 bp, human
gacgcggcctcggtggggcc

SEQ ID NO: 148913 - DNA, 20 bp, human
gggagaaccaggtcatcggt

SEQ ID NO: 148914 - DNA, 20 bp, human
gatgacctggttctcccggg

SEQ ID NO: 148915 - DNA, 20 bp, human
gaggagctcatcgactacac

SEQ ID NO: 148916 - DNA, 20 bp, human
gctgcggggcgaggtgagag

SEQ ID NO: 148917 - DNA, 20 bp, human
gcttccggttccgatgacag

SEQ ID NO: 148918 - DNA, 20 bp, human
ggcgaagagaacaagcccaa

SEQ ID NO: 148919 - DNA, 20 bp, human
gacagtggcgccggaagccg

SEQ ID NO: 148920 - DNA, 20 bp, human
gggccgggacctatgagtct

SEQ ID NO: 148921 - DNA, 20 bp, human
ggagcaactccccccggctg

SEQ ID NO: 148922 - DNA, 20 bp, human
gcttccggcgccactgtcat

SEQ ID NO: 148923 - DNA, 20 bp, human
gggctgaggcggctcttcgg

SEQ ID NO: 148924 - DNA, 20 bp, human
ggcttagtcgtgggtagcag

SEQ ID NO: 148925 - DNA, 20 bp, human
gcggccgctgtgcccgccct

SEQ ID NO: 148926 - DNA, 20 bp, human
ggcttggtgtctgagagaga

SEQ ID NO: 148927 - DNA, 20 bp, human
gtgtaggtcaccacctagag

SEQ ID NO: 148928 - DNA, 20 bp, human
gaaccaggcaagccataggt

SEQ ID NO: 148929 - DNA, 20 bp, human
gaggtcaccacctagagggg

SEQ ID NO: 148930 - DNA, 20 bp, human
ggaactccagctcccaccta

SEQ ID NO: 148931 - DNA, 20 bp, human
gcagcccaagaggtgttctc

SEQ ID NO: 148932 - DNA, 20 bp, human
ggcgccggaatatgacacag

SEQ ID NO: 148933 - DNA, 20 bp, human
gggcacctgagaacacctct

SEQ ID NO: 148934 - DNA, 20 bp, human
ggttgcagaagagggagcta

SEQ ID NO: 148935 - DNA, 20 bp, human
gccgggccaagaaattccag

SEQ ID NO: 148936 - DNA, 20 bp, human
gtcatggatgaatgcatact

SEQ ID NO: 148937 - DNA, 20 bp, human
gctggggttgggacttcata

SEQ ID NO: 148938 - DNA, 20 bp, human
gcccatcctcggtgaagatg

SEQ ID NO: 148939 - DNA, 20 bp, human
gatggctacagcagtcttgg

SEQ ID NO: 148940 - DNA, 20 bp, human
gagaagtggtgcaacctggc

SEQ ID NO: 148941 - DNA, 20 bp, human
gtgggctatgcaactctgac

SEQ ID NO: 148942 - DNA, 20 bp, human
gcatttcccgcttcctctcc

SEQ ID NO: 148943 - DNA, 20 bp, human
gcctcggtgaagatgaggtt

SEQ ID NO: 148944 - DNA, 20 bp, human
gttgctctgaaagagagctg

SEQ ID NO: 148945 - DNA, 20 bp, human
gacaaagaagtggtgcaacc

SEQ ID NO: 148946 - DNA, 20 bp, human
gacctagagcaggcatgggt

SEQ ID NO: 148947 - DNA, 20 bp, human
gagtgacctagagcaggcat

SEQ ID NO: 148948 - DNA, 20 bp, human
gaatagatgtaggaacctaa

SEQ ID NO: 148949 - DNA, 20 bp, human
gctgaacaggaacaggtagg

SEQ ID NO: 148950 - DNA, 20 bp, human
gtcatacagtgacctagagc

SEQ ID NO: 148951 - DNA, 20 bp, human
ggaggagcttcggtgaagaa

SEQ ID NO: 148952 - DNA, 20 bp, human
gacccacccatgcctgctct

SEQ ID NO: 148953 - DNA, 20 bp, human
gggtgacacccaaaattcta

SEQ ID NO: 148954 - DNA, 20 bp, human
gctctgaggatacatcctat

SEQ ID NO: 148955 - DNA, 20 bp, human
gtaagcgttgcctactcaca

SEQ ID NO: 148956 - DNA, 20 bp, human
gcccctctgtgggggaatag

SEQ ID NO: 148957 - DNA, 20 bp, human
gagaggcctcgaaaaatcaa

SEQ ID NO: 148958 - DNA, 20 bp, human
gtcaccattattatcatcag

SEQ ID NO: 148959 - DNA, 20 bp, human
ggagaagagatctcagactc

SEQ ID NO: 148960 - DNA, 20 bp, human
gagaacaaacccctctgtgg

SEQ ID NO: 148961 - DNA, 20 bp, human
gttacctctgatgataataa

SEQ ID NO: 148962 - DNA, 20 bp, human
gcatagccaaggaaactatc

SEQ ID NO: 148963 - DNA, 20 bp, human
gcagtctgtcagctcattga

SEQ ID NO: 148964 - DNA, 20 bp, human
gtaccactattcccccacag

SEQ ID NO: 148965 - DNA, 20 bp, human
gggggaatagtggtacctgc

SEQ ID NO: 148966 - DNA, 20 bp, human
ggagctgaagatagctgggt

SEQ ID NO: 148967 - DNA, 20 bp, human
gggctgacctgacaattctc

SEQ ID NO: 148968 - DNA, 20 bp, human
ggtagagttaaggtggttgg

SEQ ID NO: 148969 - DNA, 20 bp, human
gccaagacagtcaagagatg

SEQ ID NO: 148970 - DNA, 20 bp, human
ggacaggagctgaagatagc

SEQ ID NO: 148971 - DNA, 20 bp, human
gagattctgtggtggaccag

SEQ ID NO: 148972 - DNA, 20 bp, human
gccttaactctaccagcagg

SEQ ID NO: 148973 - DNA, 20 bp, human
ggttctcatgacccagaaag

SEQ ID NO: 148974 - DNA, 20 bp, human
gcaggggcccaaggactctt

SEQ ID NO: 148975 - DNA, 20 bp, human
gctggtagagttaaggtggt

SEQ ID NO: 148976 - DNA, 20 bp, human
gtctcacaggagctacagcg

SEQ ID NO: 148977 - DNA, 20 bp, human
gggagctacagcgcggagac

SEQ ID NO: 148978 - DNA, 20 bp, human
gcataaccaagacccgatca

SEQ ID NO: 148979 - DNA, 20 bp, human
ggcattggtgcattgctggg

SEQ ID NO: 148980 - DNA, 20 bp, human
gggacagaaggggcagcaat

SEQ ID NO: 148981 - DNA, 20 bp, human
ggaagtaactactccctgat

SEQ ID NO: 148982 - DNA, 20 bp, human
gattgcattggtgcattgct

SEQ ID NO: 148983 - DNA, 20 bp, human
gggaggtcatattgatgtgc

SEQ ID NO: 148984 - DNA, 20 bp, human
gctactccctgatcgggtct

SEQ ID NO: 148985 - DNA, 20 bp, human
gctttgcagacaggaagtaa

SEQ ID NO: 148986 - DNA, 20 bp, human
gtgcaatggtgcatcgaggg

SEQ ID NO: 148987 - DNA, 20 bp, human
gcataaccgagaccggatcg

SEQ ID NO: 148988 - DNA, 20 bp, human
ggcattgcaatggtgcatcg

SEQ ID NO: 148989 - DNA, 20 bp, human
gacagtttacgagggctcag

SEQ ID NO: 148990 - DNA, 20 bp, human
gttcagactgatgtgctgga

SEQ ID NO: 148991 - DNA, 20 bp, human
gagtgtgtcataaccgagac

SEQ ID NO: 148992 - DNA, 20 bp, human
gggcaattaacaattatcga

SEQ ID NO: 148993 - DNA, 20 bp, human
gagacccccacagtttacga

SEQ ID NO: 148994 - DNA, 20 bp, human
gctactccccgatccggtct

SEQ ID NO: 148995 - DNA, 20 bp, human
gctgttggggcttatgggtg

SEQ ID NO: 148996 - DNA, 20 bp, human
gtgtacacggacggagatgg

SEQ ID NO: 148997 - DNA, 20 bp, human
gtatgaagctaccagagagg

SEQ ID NO: 148998 - DNA, 20 bp, human
ggcctcctagggcttccctt

SEQ ID NO: 148999 - DNA, 20 bp, human
gcgaacctaagggaagccct

SEQ ID NO: 149000 - DNA, 20 bp, human
gacagaatcgccgaacctaa

SEQ ID NO: 149001 - DNA, 20 bp, human
ggctccccatcatcgtacta

SEQ ID NO: 149002 - DNA, 20 bp, human
gcgtactagggaggaagaag

SEQ ID NO: 149003 - DNA, 20 bp, human
gttgattagtaggcttggag

SEQ ID NO: 149004 - DNA, 20 bp, human
gcctccctagtacgatgatg

SEQ ID NO: 149005 - DNA, 20 bp, human
gtcctgctttgcatctaggt

SEQ ID NO: 149006 - DNA, 20 bp, human
ggaaggagaatcctagggtt

SEQ ID NO: 149007 - DNA, 20 bp, human
gggaggtagtggtcagatag

SEQ ID NO: 149008 - DNA, 20 bp, human
gtatacacacagggctcgaa

SEQ ID NO: 149009 - DNA, 20 bp, human
gttatcacatgtatacagga

SEQ ID NO: 149010 - DNA, 20 bp, human
ggcgagtagagcagtaaaga

SEQ ID NO: 149011 - DNA, 20 bp, human
gtttcagaaggagaatccta

SEQ ID NO: 149012 - DNA, 20 bp, human
gagcagtaaagacggctggg

SEQ ID NO: 149013 - DNA, 20 bp, human
gccctgtgtgtatagggaag

SEQ ID NO: 149014 - DNA, 20 bp, human
gtagagcagtaaagacggct

SEQ ID NO: 149015 - DNA, 20 bp, human
gtaacttcttgtgcagagtc

SEQ ID NO: 149016 - DNA, 20 bp, human
ggtggtgtccacgcactcct

SEQ ID NO: 149017 - DNA, 20 bp, human
ggcacgaagaccaagcgcaa

SEQ ID NO: 149018 - DNA, 20 bp, human
gtaggctgtcagatctctga

SEQ ID NO: 149019 - DNA, 20 bp, human
ggctgtgactcctgctcagt

SEQ ID NO: 149020 - DNA, 20 bp, human
gctgacagcctaggagtgcg

SEQ ID NO: 149021 - DNA, 20 bp, human
gcaaagagtgacaggcaaca

SEQ ID NO: 149022 - DNA, 20 bp, human
gggccacagggttgttgttg

SEQ ID NO: 149023 - DNA, 20 bp, human
ggttgttgttggggctgcag

SEQ ID NO: 149024 - DNA, 20 bp, human
gaagaccaagcgcaaaggtg

SEQ ID NO: 149025 - DNA, 20 bp, human
gagccccaacaacaaccctg

SEQ ID NO: 149026 - DNA, 20 bp, human
gacagtggaacagagtgagg

SEQ ID NO: 149027 - DNA, 20 bp, human
gggtcacaggccactatgta

SEQ ID NO: 149028 - DNA, 20 bp, human
gggcccatgtccctgaccat

SEQ ID NO: 149029 - DNA, 20 bp, human
gtctctcttaagggagacag

SEQ ID NO: 149030 - DNA, 20 bp, human
gcatgggtgagctcacctca

SEQ ID NO: 149031 - DNA, 20 bp, human
gtccacaacagggtgaccca

SEQ ID NO: 149032 - DNA, 20 bp, human
gccggtgccatctctcttaa

SEQ ID NO: 149033 - DNA, 20 bp, human
gcagtttgggtacttccctg

SEQ ID NO: 149034 - DNA, 20 bp, human
gaccctgggtcaccctgttg

SEQ ID NO: 149035 - DNA, 20 bp, human
ggtggatgaataggtcatca

SEQ ID NO: 149036 - DNA, 20 bp, human
gtgtacaaaggagagtagag

SEQ ID NO: 149037 - DNA, 20 bp, human
ggaataaagttagtgtacaa

SEQ ID NO: 149038 - DNA, 20 bp, human
ggaagtccaagaggtagagc

SEQ ID NO: 149039 - DNA, 20 bp, human
ggattgactctgtcattaca

SEQ ID NO: 149040 - DNA, 20 bp, human
gttatagtactaggactctc

SEQ ID NO: 149041 - DNA, 20 bp, human
ggatataatattatagtact

SEQ ID NO: 149042 - DNA, 20 bp, human
gactaactttattctcatgt

SEQ ID NO: 149043 - DNA, 20 bp, human
gttagatcatctgagaaaca

SEQ ID NO: 149044 - DNA, 20 bp, human
gtatgttgactcacagaagt

SEQ ID NO: 149045 - DNA, 20 bp, human
gtttctcctgctctacctct

SEQ ID NO: 149046 - DNA, 20 bp, human
gggagagaaggggcccaaca

SEQ ID NO: 149047 - DNA, 20 bp, human
ggcggccaaggcgactctgt

SEQ ID NO: 149048 - DNA, 20 bp, human
gcgcgccggtgacggaagtg

SEQ ID NO: 149049 - DNA, 20 bp, human
ggaagtgcggtgttgagcgc

SEQ ID NO: 149050 - DNA, 20 bp, human
gcgggaagcatttcgactcc

SEQ ID NO: 149051 - DNA, 20 bp, human
ggtcgcgtaaaggttagggg

SEQ ID NO: 149052 - DNA, 20 bp, human
ggtgcggtgttgagcgccgg

SEQ ID NO: 149053 - DNA, 20 bp, human
gccggccgagcaggaaaacg

SEQ ID NO: 149054 - DNA, 20 bp, human
ggaacccgcgagagccgcgg

SEQ ID NO: 149055 - DNA, 20 bp, human
gctcgcgcccacgctgggcc

SEQ ID NO: 149056 - DNA, 20 bp, human
gaggcgaactcaggcgacag

SEQ ID NO: 149057 - DNA, 20 bp, human
gagctggagagagacaatac

SEQ ID NO: 149058 - DNA, 20 bp, human
gctcccctccctggccctag

SEQ ID NO: 149059 - DNA, 20 bp, human
gatactgcaggagcgggtct

SEQ ID NO: 149060 - DNA, 20 bp, human
gggcatggatctcagcgagc

SEQ ID NO: 149061 - DNA, 20 bp, human
gagatctgccaggcgaggca

SEQ ID NO: 149062 - DNA, 20 bp, human
gcgtgctgggtgcgccccta

SEQ ID NO: 149063 - DNA, 20 bp, human
gcctccagatctgccaggcg

SEQ ID NO: 149064 - DNA, 20 bp, human
gagcccgaggtgtgcgtctg

SEQ ID NO: 149065 - DNA, 20 bp, human
gggcaggggacaataacaga

SEQ ID NO: 149066 - DNA, 20 bp, human
ggatgagcacctaccactag

SEQ ID NO: 149067 - DNA, 20 bp, human
gtcgcggctccgctagtggt

SEQ ID NO: 149068 - DNA, 20 bp, human
gtccctcgcggctccgctag

SEQ ID NO: 149069 - DNA, 20 bp, human
gtggccgcaggcaacgggaa

SEQ ID NO: 149070 - DNA, 20 bp, human
gggccggtggccgcaggcaa

SEQ ID NO: 149071 - DNA, 20 bp, human
ggggtcggcccaagaactgg

SEQ ID NO: 149072 - DNA, 20 bp, human
gcgcagggcgccgagtgacg

SEQ ID NO: 149073 - DNA, 20 bp, human
ggcggggtcggcccaagaac

SEQ ID NO: 149074 - DNA, 20 bp, human
gtagtgggagccaccggggt

SEQ ID NO: 149075 - DNA, 20 bp, human
gggccgctccgccagttctt

SEQ ID NO: 149076 - DNA, 20 bp, human
gaaagcgcgcaggacctctc

SEQ ID NO: 149077 - DNA, 20 bp, human
gcgacgaagcggccatcgag

SEQ ID NO: 149078 - DNA, 20 bp, human
gctggcgtcgcgtaggaggg

SEQ ID NO: 149079 - DNA, 20 bp, human
gcgctgtctacggggagagg

SEQ ID NO: 149080 - DNA, 20 bp, human
gcgtatcccacgaggccagg

SEQ ID NO: 149081 - DNA, 20 bp, human
ggccctggcgtcgcgtagga

SEQ ID NO: 149082 - DNA, 20 bp, human
gcgtcgcgtaggagggagga

SEQ ID NO: 149083 - DNA, 20 bp, human
gctcaggcaggacccacgct

SEQ ID NO: 149084 - DNA, 20 bp, human
ggcgagccctggcgtcgcgt

SEQ ID NO: 149085 - DNA, 20 bp, human
gtggacgcggtgcctctcga

SEQ ID NO: 149086 - DNA, 20 bp, human
gcgtgagtattggaagagcg

SEQ ID NO: 149087 - DNA, 20 bp, human
gggagcgacgccataaagaa

SEQ ID NO: 149088 - DNA, 20 bp, human
ggccataaagaagggagtcg

SEQ ID NO: 149089 - DNA, 20 bp, human
gagggagtcggggatcgccg

SEQ ID NO: 149090 - DNA, 20 bp, human
gtgggaggcgaggaaactct

SEQ ID NO: 149091 - DNA, 20 bp, human
gccccctgcgagggcatcct

SEQ ID NO: 149092 - DNA, 20 bp, human
gggatcgccgaggtgcaagc

SEQ ID NO: 149093 - DNA, 20 bp, human
gagcgggctcggaaagcggt

SEQ ID NO: 149094 - DNA, 20 bp, human
gggccgcaggcaggccggag

SEQ ID NO: 149095 - DNA, 20 bp, human
gactcacgccctagctacag

SEQ ID NO: 149096 - DNA, 20 bp, human
gcagcaggaggaaactgctc

SEQ ID NO: 149097 - DNA, 20 bp, human
ggacgtctcaattattcctt

SEQ ID NO: 149098 - DNA, 20 bp, human
ggggctgcaagcagtcttcc

SEQ ID NO: 149099 - DNA, 20 bp, human
ggtggactctgacagaactc

SEQ ID NO: 149100 - DNA, 20 bp, human
gaactctggaagggcactgg

SEQ ID NO: 149101 - DNA, 20 bp, human
gtactctgatgcgtcactca

SEQ ID NO: 149102 - DNA, 20 bp, human
gtgagttgagcaggtaaggc

SEQ ID NO: 149103 - DNA, 20 bp, human
gcaggctttgcggctgccaa

SEQ ID NO: 149104 - DNA, 20 bp, human
ggatccttccgggcagccaa

SEQ ID NO: 149105 - DNA, 20 bp, human
gagcagggcggagccaagaa

SEQ ID NO: 149106 - DNA, 20 bp, human
gcgcgactgaccgtggtcgt

SEQ ID NO: 149107 - DNA, 20 bp, human
gggagcaacgcgactgaccg

SEQ ID NO: 149108 - DNA, 20 bp, human
ggcccaggcaaagcaacgcc

SEQ ID NO: 149109 - DNA, 20 bp, human
gtaccttgcgaggtaaagtg

SEQ ID NO: 149110 - DNA, 20 bp, human
ggaccgtggtcgtgggcgga

SEQ ID NO: 149111 - DNA, 20 bp, human
gtcgcaaggtaactcaccgc

SEQ ID NO: 149112 - DNA, 20 bp, human
gcttggtgcacgatcctgaa

SEQ ID NO: 149113 - DNA, 20 bp, human
ggagagccacgcccccagga

SEQ ID NO: 149114 - DNA, 20 bp, human
ggctccggtgcaggcccgca

SEQ ID NO: 149115 - DNA, 20 bp, human
gtgggtcgcgaagcagagcc

SEQ ID NO: 149116 - DNA, 20 bp, human
gtggcgtgctgagacgcacc

SEQ ID NO: 149117 - DNA, 20 bp, human
gtggagggaggcagggaatc

SEQ ID NO: 149118 - DNA, 20 bp, human
gcaggtctcaggggaagcta

SEQ ID NO: 149119 - DNA, 20 bp, human
gctcaggggaagctaaggca

SEQ ID NO: 149120 - DNA, 20 bp, human
gtgcctccctccaactgagg

SEQ ID NO: 149121 - DNA, 20 bp, human
gctcctcctcagttggaggg

SEQ ID NO: 149122 - DNA, 20 bp, human
ggccagcggggcggcagaag

SEQ ID NO: 149123 - DNA, 20 bp, human
ggcgaaggattgctatccag

SEQ ID NO: 149124 - DNA, 20 bp, human
ggcagggaatctggcttgat

SEQ ID NO: 149125 - DNA, 20 bp, human
gctccagggacgcaggaagg

SEQ ID NO: 149126 - DNA, 20 bp, human
gccgctcgggccgccaacac

SEQ ID NO: 149127 - DNA, 20 bp, human
gcgagcggctgcagttgcag

SEQ ID NO: 149128 - DNA, 20 bp, human
ggcccgcgagatgccggtgt

SEQ ID NO: 149129 - DNA, 20 bp, human
ggagcagggtgagatagatg

SEQ ID NO: 149130 - DNA, 20 bp, human
ggcgcgggcccgcgagatgc

SEQ ID NO: 149131 - DNA, 20 bp, human
gtggtgggagacgcagagtg

SEQ ID NO: 149132 - DNA, 20 bp, human
ggacgcaggtccctcacccc

SEQ ID NO: 149133 - DNA, 20 bp, human
ggccaaggacgcctatcccg

SEQ ID NO: 149134 - DNA, 20 bp, human
ggcgtagccgggaccatgga

SEQ ID NO: 149135 - DNA, 20 bp, human
gtgggagaaccagagcatcc

SEQ ID NO: 149136 - DNA, 20 bp, human
ggctcggaattggacttggg

SEQ ID NO: 149137 - DNA, 20 bp, human
gggacttgggaggcgcggtg

SEQ ID NO: 149138 - DNA, 20 bp, human
ggagcgtgaaacaaagcagt

SEQ ID NO: 149139 - DNA, 20 bp, human
gaaacgcggcgcagacgagg

SEQ ID NO: 149140 - DNA, 20 bp, human
gtcggctcggaattggactt

SEQ ID NO: 149141 - DNA, 20 bp, human
gaagcggggaggcccacctc

SEQ ID NO: 149142 - DNA, 20 bp, human
gggccgcggcttccacgagg

SEQ ID NO: 149143 - DNA, 20 bp, human
gccactggccgaccccctcg

SEQ ID NO: 149144 - DNA, 20 bp, human
gcagtgggatcccagtcccg

SEQ ID NO: 149145 - DNA, 20 bp, human
gacctcggggaagcagtcct

SEQ ID NO: 149146 - DNA, 20 bp, human
gcaggtcggcctcggcccag

SEQ ID NO: 149147 - DNA, 20 bp, human
gccgacatggacaagaacag

SEQ ID NO: 149148 - DNA, 20 bp, human
ggccgaggccgacctgctcc

SEQ ID NO: 149149 - DNA, 20 bp, human
ggacggcagtcggagcggag

SEQ ID NO: 149150 - DNA, 20 bp, human
gagtgtctccgacacagcaa

SEQ ID NO: 149151 - DNA, 20 bp, human
ggcggcgacggcagtcggag

SEQ ID NO: 149152 - DNA, 20 bp, human
ggatactcgcccctgggccg

SEQ ID NO: 149153 - DNA, 20 bp, human
gtcccggagcaggtcggcct

SEQ ID NO: 149154 - DNA, 20 bp, human
gggcgactcgtcgccattcc

SEQ ID NO: 149155 - DNA, 20 bp, human
gcgccgcgaggcaggggaga

SEQ ID NO: 149156 - DNA, 20 bp, human
gcgcggccgccgctgataca

SEQ ID NO: 149157 - DNA, 20 bp, human
gtacacggttgtggagggta

SEQ ID NO: 149158 - DNA, 20 bp, human
gccgccacctccggagaccg

SEQ ID NO: 149159 - DNA, 20 bp, human
gctccacaaccgtgtatcag

SEQ ID NO: 149160 - DNA, 20 bp, human
gcacaaccgtgtatcagcgg

SEQ ID NO: 149161 - DNA, 20 bp, human
gccgcggccgcgggtcagga

SEQ ID NO: 149162 - DNA, 20 bp, human
ggtacggccgcggtctccgg

SEQ ID NO: 149163 - DNA, 20 bp, human
gcaggaggcggggatccggg

SEQ ID NO: 149164 - DNA, 20 bp, human
gcggccgcggtctccggagg

SEQ ID NO: 149165 - DNA, 20 bp, human
gagggtacggccgcggtctc

SEQ ID NO: 149166 - DNA, 20 bp, human
gcggccccgggagtctcacg

SEQ ID NO: 149167 - DNA, 20 bp, human
gggcaccacgtgagactccc

SEQ ID NO: 149168 - DNA, 20 bp, human
ggcccgcggcgctgttctgt

SEQ ID NO: 149169 - DNA, 20 bp, human
gctgcaggatctcgtgcttg

SEQ ID NO: 149170 - DNA, 20 bp, human
gaaccacccggaaacccagc

SEQ ID NO: 149171 - DNA, 20 bp, human
ggagcccgccgctcccggct

SEQ ID NO: 149172 - DNA, 20 bp, human
gaaactgccgacccccgagt

SEQ ID NO: 149173 - DNA, 20 bp, human
gatcctgcagagccacggta

SEQ ID NO: 149174 - DNA, 20 bp, human
gacgaggggcgcccactcgg

SEQ ID NO: 149175 - DNA, 20 bp, human
gcacgcgggccgccctaccg

SEQ ID NO: 149176 - DNA, 20 bp, human
gctccgcctcagcgagacgg

SEQ ID NO: 149177 - DNA, 20 bp, human
ggctgaggcggagtaggatg

SEQ ID NO: 149178 - DNA, 20 bp, human
gctactccgcctcagcgaga

SEQ ID NO: 149179 - DNA, 20 bp, human
gtgccgccgtctcgctgagg

SEQ ID NO: 149180 - DNA, 20 bp, human
ggacggcggcagccagaacg

SEQ ID NO: 149181 - DNA, 20 bp, human
ggctggggtgcgtgatctgg

SEQ ID NO: 149182 - DNA, 20 bp, human
gaccccagctccggaagatg

SEQ ID NO: 149183 - DNA, 20 bp, human
ggcccctcggcggcaccgtg

SEQ ID NO: 149184 - DNA, 20 bp, human
ggaccccacctcgccaaccg

SEQ ID NO: 149185 - DNA, 20 bp, human
gcggagtaggatgaggcccg

SEQ ID NO: 149186 - DNA, 20 bp, human
gcctagtgtcgtgctctcct

SEQ ID NO: 149187 - DNA, 20 bp, human
gggaattggttaggcggcgg

SEQ ID NO: 149188 - DNA, 20 bp, human
gggaggaattggttaggcgg

SEQ ID NO: 149189 - DNA, 20 bp, human
ggtgtcgtgctctcctcggt

SEQ ID NO: 149190 - DNA, 20 bp, human
gggtaggggaggaattggtt

SEQ ID NO: 149191 - DNA, 20 bp, human
gaggggaggaattggttagg

SEQ ID NO: 149192 - DNA, 20 bp, human
gccgcgcgtgcgcgcaacgg

SEQ ID NO: 149193 - DNA, 20 bp, human
gccggaccctggaagagaag

SEQ ID NO: 149194 - DNA, 20 bp, human
ggcgacggcgaggaggtgtt

SEQ ID NO: 149195 - DNA, 20 bp, human
gcaccgaccccagccttccg

SEQ ID NO: 149196 - DNA, 20 bp, human
gaccgggagtcagctcctcg

SEQ ID NO: 149197 - DNA, 20 bp, human
gtaggtagaaggtgaggtcg

SEQ ID NO: 149198 - DNA, 20 bp, human
ggcaggctgcggtaggtaga

SEQ ID NO: 149199 - DNA, 20 bp, human
gaaggctagcaggctgcggt

SEQ ID NO: 149200 - DNA, 20 bp, human
gaggggtccctggaaatcca

SEQ ID NO: 149201 - DNA, 20 bp, human
gtcgggggatggtatccccg

SEQ ID NO: 149202 - DNA, 20 bp, human
ggggaaacagcggcaacagt

SEQ ID NO: 149203 - DNA, 20 bp, human
gtaagatcgggaaggagagt

SEQ ID NO: 149204 - DNA, 20 bp, human
gagaccttcaaccagaggta

SEQ ID NO: 149205 - DNA, 20 bp, human
gcagggtgaagatagaagtc

SEQ ID NO: 149206 - DNA, 20 bp, human
gacggctccggaagaagcga

SEQ ID NO: 149207 - DNA, 20 bp, human
ggcggtgccacgtacggctc

SEQ ID NO: 149208 - DNA, 20 bp, human
ggcgaaacccgtgggaccag

SEQ ID NO: 149209 - DNA, 20 bp, human
gccgtgggaccagaggatat

SEQ ID NO: 149210 - DNA, 20 bp, human
gaacgtggagtgacgtgcag

SEQ ID NO: 149211 - DNA, 20 bp, human
gacccagagcccggagaaag

SEQ ID NO: 149212 - DNA, 20 bp, human
gggcgacttgagcagcgaag

SEQ ID NO: 149213 - DNA, 20 bp, human
gcttttgcttcgactcccgg

SEQ ID NO: 149214 - DNA, 20 bp, human
gcccggcggagcgcgcaacg

SEQ ID NO: 149215 - DNA, 20 bp, human
gtcgaagcaaaagacactga

SEQ ID NO: 149216 - DNA, 20 bp, human
gggagcctgagactcaaaca

SEQ ID NO: 149217 - DNA, 20 bp, human
gtgcagccagcgggtccagg

SEQ ID NO: 149218 - DNA, 20 bp, human
gcagtgcctcctggacccgc

SEQ ID NO: 149219 - DNA, 20 bp, human
gagcccaaggacacgtccat

SEQ ID NO: 149220 - DNA, 20 bp, human
ggggtccaggaggcactgcg

SEQ ID NO: 149221 - DNA, 20 bp, human
gggctgcacttgaggatggt

SEQ ID NO: 149222 - DNA, 20 bp, human
ggggaatccacagctacctg

SEQ ID NO: 149223 - DNA, 20 bp, human
gttcgagcaggacaccgaga

SEQ ID NO: 149224 - DNA, 20 bp, human
gcatcctcaagtgcagccag

SEQ ID NO: 149225 - DNA, 20 bp, human
ggaagaggaaggtgcatacc

SEQ ID NO: 149226 - DNA, 20 bp, human
gcagagcggcagcaagatgg

SEQ ID NO: 149227 - DNA, 20 bp, human
ggccgttgcgcggcgcagag

SEQ ID NO: 149228 - DNA, 20 bp, human
ggcgcagagcggcagcaaga

SEQ ID NO: 149229 - DNA, 20 bp, human
gacacgtgaagcgtcctagg

SEQ ID NO: 149230 - DNA, 20 bp, human
gcaagatggcggcgcaacag

SEQ ID NO: 149231 - DNA, 20 bp, human
gagccagaggacccacccag

SEQ ID NO: 149232 - DNA, 20 bp, human
ggcgcaacagcgggactgcg

SEQ ID NO: 149233 - DNA, 20 bp, human
gaggagcgagatgggtctca

SEQ ID NO: 149234 - DNA, 20 bp, human
ggcagctgccccgctaagac

SEQ ID NO: 149235 - DNA, 20 bp, human
ggccgctctgcgccgcgcaa

SEQ ID NO: 149236 - DNA, 20 bp, human
gaccgacgcgggctctgaag

SEQ ID NO: 149237 - DNA, 20 bp, human
ggcggtgggccgcaccgagg

SEQ ID NO: 149238 - DNA, 20 bp, human
gtagcggcctggcgagggac

SEQ ID NO: 149239 - DNA, 20 bp, human
gggcctggcgagggacgggc

SEQ ID NO: 149240 - DNA, 20 bp, human
ggtgggccgcaccgaggcgg

SEQ ID NO: 149241 - DNA, 20 bp, human
gccgcggcggagggcaaaaa

SEQ ID NO: 149242 - DNA, 20 bp, human
gacgcgggctctgaagcggt

SEQ ID NO: 149243 - DNA, 20 bp, human
gcggcggagggcaaaaatgg

SEQ ID NO: 149244 - DNA, 20 bp, human
ggccaggcccagaaacgcgg

SEQ ID NO: 149245 - DNA, 20 bp, human
gagctcgggaggtagcggcc

SEQ ID NO: 149246 - DNA, 20 bp, human
ggggcgagccgtgaagatgg

SEQ ID NO: 149247 - DNA, 20 bp, human
ggtaggaccgaagggctaag

SEQ ID NO: 149248 - DNA, 20 bp, human
ggcgtggagagcgaagtcag

SEQ ID NO: 149249 - DNA, 20 bp, human
ggtcttagggtaggaccgaa

SEQ ID NO: 149250 - DNA, 20 bp, human
gtagctgggtgtcttagggt

SEQ ID NO: 149251 - DNA, 20 bp, human
gagggaaggagctgactagg

SEQ ID NO: 149252 - DNA, 20 bp, human
gacagagagagaggtcggag

SEQ ID NO: 149253 - DNA, 20 bp, human
gtcgcgcggggactgcggtg

SEQ ID NO: 149254 - DNA, 20 bp, human
gagggggcgagccgtgaaga

SEQ ID NO: 149255 - DNA, 20 bp, human
gaggactctgtctaagccta

SEQ ID NO: 149256 - DNA, 20 bp, human
gttccgaaactgacacccgg

SEQ ID NO: 149257 - DNA, 20 bp, human
gggaaacaaacaaagtcccg

SEQ ID NO: 149258 - DNA, 20 bp, human
gaggctcggatcgggttcag

SEQ ID NO: 149259 - DNA, 20 bp, human
ggctcccaccagccccacgt

SEQ ID NO: 149260 - DNA, 20 bp, human
gcgagggccgagcctacgtg

SEQ ID NO: 149261 - DNA, 20 bp, human
gcgatccgagcctccggcaa

SEQ ID NO: 149262 - DNA, 20 bp, human
ggtgtaacggtgagtccccg

SEQ ID NO: 149263 - DNA, 20 bp, human
gatcgggttcagcggcgcag

SEQ ID NO: 149264 - DNA, 20 bp, human
gggactcaccgttacaccac

SEQ ID NO: 149265 - DNA, 20 bp, human
ggaactccctccggagtggg

SEQ ID NO: 149266 - DNA, 20 bp, human
gccttccagacacccggagt

SEQ ID NO: 149267 - DNA, 20 bp, human
ggactcccggagcccactcc

SEQ ID NO: 149268 - DNA, 20 bp, human
ggcgtggtgcagacccacaa

SEQ ID NO: 149269 - DNA, 20 bp, human
ggttgtgagccgggtcgctg

SEQ ID NO: 149270 - DNA, 20 bp, human
gccgggctagtccagtgcga

SEQ ID NO: 149271 - DNA, 20 bp, human
ggactagcccggaccgcgaa

SEQ ID NO: 149272 - DNA, 20 bp, human
gacctgcagcgcagggatct

SEQ ID NO: 149273 - DNA, 20 bp, human
ggacacccggagtgggctcc

SEQ ID NO: 149274 - DNA, 20 bp, human
gtgggagcccaaggacggcg

SEQ ID NO: 149275 - DNA, 20 bp, human
gagcagaccttccagacacc

SEQ ID NO: 149276 - DNA, 20 bp, human
ggggcgagaggcacagcgat

SEQ ID NO: 149277 - DNA, 20 bp, human
gtcgcagctgtctgggcgag

SEQ ID NO: 149278 - DNA, 20 bp, human
ggtgcggaactccagagaag

SEQ ID NO: 149279 - DNA, 20 bp, human
gagctcccgaagcccaggtg

SEQ ID NO: 149280 - DNA, 20 bp, human
ggagtgcttcgcagctgtct

SEQ ID NO: 149281 - DNA, 20 bp, human
gtcgggagctgaaagcgcaa

SEQ ID NO: 149282 - DNA, 20 bp, human
gactccagagaaggggatcc

SEQ ID NO: 149283 - DNA, 20 bp, human
gagggcccgcgcggtggcag

SEQ ID NO: 149284 - DNA, 20 bp, human
gcgggtcccgcccagagcca

SEQ ID NO: 149285 - DNA, 20 bp, human
gggtgacacaggatttcggg

SEQ ID NO: 149286 - DNA, 20 bp, human
gagcagcaaacggccggcgg

SEQ ID NO: 149287 - DNA, 20 bp, human
gagtggcagaagtaccgtcc

SEQ ID NO: 149288 - DNA, 20 bp, human
gggcggcgcggagtaggtgg

SEQ ID NO: 149289 - DNA, 20 bp, human
gctgtacatgcgggagactg

SEQ ID NO: 149290 - DNA, 20 bp, human
gggccgcgaggatcccaggt

SEQ ID NO: 149291 - DNA, 20 bp, human
gaggcgcgggacgatctcca

SEQ ID NO: 149292 - DNA, 20 bp, human
gcgggcgcgtcggccggcga

SEQ ID NO: 149293 - DNA, 20 bp, human
gcgctcacgcacggcacgca

SEQ ID NO: 149294 - DNA, 20 bp, human
gtctcgggtcgggaacgccg

SEQ ID NO: 149295 - DNA, 20 bp, human
gccgggtgaccccacatccg

SEQ ID NO: 149296 - DNA, 20 bp, human
ggagctacgtcggagccagg

SEQ ID NO: 149297 - DNA, 20 bp, human
gggagaagactggagctccg

SEQ ID NO: 149298 - DNA, 20 bp, human
gtgagcgaggagggcgtgta

SEQ ID NO: 149299 - DNA, 20 bp, human
ggcacgtagcgtcagcacac

SEQ ID NO: 149300 - DNA, 20 bp, human
gccgcggtagcggagaagac

SEQ ID NO: 149301 - DNA, 20 bp, human
gtaagcgccccgggcccgtc

SEQ ID NO: 149302 - DNA, 20 bp, human
gcacacgggagtgaaccgta

SEQ ID NO: 149303 - DNA, 20 bp, human
gggagtgaaccgtacggtgt

SEQ ID NO: 149304 - DNA, 20 bp, human
gaaagccccagagcccgacg

SEQ ID NO: 149305 - DNA, 20 bp, human
gcaggggcgctagggaactg

SEQ ID NO: 149306 - DNA, 20 bp, human
ggctcttgcagcctcaagaa

SEQ ID NO: 149307 - DNA, 20 bp, human
ggatgtgcccgaggacgttg

SEQ ID NO: 149308 - DNA, 20 bp, human
ggctagtactccgggctgtg

SEQ ID NO: 149309 - DNA, 20 bp, human
gagcccggcagccgaatctt

SEQ ID NO: 149310 - DNA, 20 bp, human
ggacagagtagcccaagatt

SEQ ID NO: 149311 - DNA, 20 bp, human
gagcagggacgacaacacct

SEQ ID NO: 149312 - DNA, 20 bp, human
gcgacctactaaagaggcga

SEQ ID NO: 149313 - DNA, 20 bp, human
ggacttctcccgcagcgacg

SEQ ID NO: 149314 - DNA, 20 bp, human
gcctagaaacggagaccgta

SEQ ID NO: 149315 - DNA, 20 bp, human
gggagaccgtagggtctgga

SEQ ID NO: 149316 - DNA, 20 bp, human
ggagcccggtccgcgagcag

SEQ ID NO: 149317 - DNA, 20 bp, human
ggcgcagctcatcgtccctc

SEQ ID NO: 149318 - DNA, 20 bp, human
ggaagcctcgaccctggctg

SEQ ID NO: 149319 - DNA, 20 bp, human
gcaggccgggctgtccacga

SEQ ID NO: 149320 - DNA, 20 bp, human
ggcgagccaggagtactaca

SEQ ID NO: 149321 - DNA, 20 bp, human
gcctggagcctggttcccac

SEQ ID NO: 149322 - DNA, 20 bp, human
gcacgggaggaagcgccccg

SEQ ID NO: 149323 - DNA, 20 bp, human
gacgacggaagcctcgaccc

SEQ ID NO: 149324 - DNA, 20 bp, human
gacagccccagccagggtcg

SEQ ID NO: 149325 - DNA, 20 bp, human
ggttccgctgaccctcctcg

SEQ ID NO: 149326 - DNA, 20 bp, human
gagctccactttgaagagag

SEQ ID NO: 149327 - DNA, 20 bp, human
gggagttatagtgccaccag

SEQ ID NO: 149328 - DNA, 20 bp, human
gagatgcatctactcaaggt

SEQ ID NO: 149329 - DNA, 20 bp, human
gaacttcataagccaggaag

SEQ ID NO: 149330 - DNA, 20 bp, human
gggtctctgagtactttgat

SEQ ID NO: 149331 - DNA, 20 bp, human
gagagagatgcatctactca

SEQ ID NO: 149332 - DNA, 20 bp, human
gtactttgatcggctgaaaa

SEQ ID NO: 149333 - DNA, 20 bp, human
gtgtaagaaattcttaaaga

SEQ ID NO: 149334 - DNA, 20 bp, human
ggatcggctgaaaatggtat

SEQ ID NO: 149335 - DNA, 20 bp, human
gcattttggatttttccctc

SEQ ID NO: 149336 - DNA, 20 bp, human
gtcggccagccacacgggaa

SEQ ID NO: 149337 - DNA, 20 bp, human
ggccagccacacgggaacgg

SEQ ID NO: 149338 - DNA, 20 bp, human
gcgtcctcggccagccacac

SEQ ID NO: 149339 - DNA, 20 bp, human
gcacatgggaaagggtcagg

SEQ ID NO: 149340 - DNA, 20 bp, human
gagccacatgggaaagggtc

SEQ ID NO: 149341 - DNA, 20 bp, human
gggcgccctggcggcaagtg

SEQ ID NO: 149342 - DNA, 20 bp, human
gatgcagccgaggtcgtcct

SEQ ID NO: 149343 - DNA, 20 bp, human
gggaactgcagcgggtaggg

SEQ ID NO: 149344 - DNA, 20 bp, human
gcccggaactgcagcgggta

SEQ ID NO: 149345 - DNA, 20 bp, human
ggccgcctgttggccatggc

SEQ ID NO: 149346 - DNA, 20 bp, human
ggcctcggctgcgaagatag

SEQ ID NO: 149347 - DNA, 20 bp, human
gggagcgccggggatctggg

SEQ ID NO: 149348 - DNA, 20 bp, human
gtaggtgagagtctccccgg

SEQ ID NO: 149349 - DNA, 20 bp, human
gtcggggtcggggtgagtag

SEQ ID NO: 149350 - DNA, 20 bp, human
gaggccttgggcgaagacgg

SEQ ID NO: 149351 - DNA, 20 bp, human
gaggccccggggcaaatgga

SEQ ID NO: 149352 - DNA, 20 bp, human
ggccgccccgggactctgag

SEQ ID NO: 149353 - DNA, 20 bp, human
ggctcctccgcccagatccc

SEQ ID NO: 149354 - DNA, 20 bp, human
gtacagcgcgcgccaggaag

SEQ ID NO: 149355 - DNA, 20 bp, human
gcaagaggcgacccctccca

SEQ ID NO: 149356 - DNA, 20 bp, human
ggaggcagcgatggccgaga

SEQ ID NO: 149357 - DNA, 20 bp, human
ggcagcgatggccgagaggg

SEQ ID NO: 149358 - DNA, 20 bp, human
gccgctcgcgtccctcgagg

SEQ ID NO: 149359 - DNA, 20 bp, human
ggaaacccagagacctcctg

SEQ ID NO: 149360 - DNA, 20 bp, human
gatagccgtcccgggacgta

SEQ ID NO: 149361 - DNA, 20 bp, human
gaaagagccggaggaagatc

SEQ ID NO: 149362 - DNA, 20 bp, human
gtcccttaccaaagagccgg

SEQ ID NO: 149363 - DNA, 20 bp, human
ggccgcctgctccacctcga

SEQ ID NO: 149364 - DNA, 20 bp, human
gaacagggtaccgtacgtcc

SEQ ID NO: 149365 - DNA, 20 bp, human
ggctctttggtaagggaaca

SEQ ID NO: 149366 - DNA, 20 bp, human
ggtcggctggcggcggtgag

SEQ ID NO: 149367 - DNA, 20 bp, human
gagggcggaactttggggtt

SEQ ID NO: 149368 - DNA, 20 bp, human
ggcggcgcgccggttgagca

SEQ ID NO: 149369 - DNA, 20 bp, human
gggcggccggaaggtacggt

SEQ ID NO: 149370 - DNA, 20 bp, human
gggcgagctgaacccagact

SEQ ID NO: 149371 - DNA, 20 bp, human
ggggcgtctctaggcctggt

SEQ ID NO: 149372 - DNA, 20 bp, human
gcagctcgccactaggcgtg

SEQ ID NO: 149373 - DNA, 20 bp, human
gaacgacgccgcacgcctag

SEQ ID NO: 149374 - DNA, 20 bp, human
gggttgagcagggcgtctct

SEQ ID NO: 149375 - DNA, 20 bp, human
gtcttcgggtgtcctagtct

SEQ ID NO: 149376 - DNA, 20 bp, human
gggctaggcctgtctccccg

SEQ ID NO: 149377 - DNA, 20 bp, human
gcaaggcatcgcgcaccctg

SEQ ID NO: 149378 - DNA, 20 bp, human
ggcgccgcggagctcacccc

SEQ ID NO: 149379 - DNA, 20 bp, human
gcacagctcagacctgcggg

SEQ ID NO: 149380 - DNA, 20 bp, human
gatcgcgcaccctgcggcag

SEQ ID NO: 149381 - DNA, 20 bp, human
gtccaggtgcgcttgaggag

SEQ ID NO: 149382 - DNA, 20 bp, human
gggcggccgaatgactgagc

SEQ ID NO: 149383 - DNA, 20 bp, human
ggtcctggagcagctagcaa

SEQ ID NO: 149384 - DNA, 20 bp, human
ggcgcgatgccttgaacctg

SEQ ID NO: 149385 - DNA, 20 bp, human
gaacccgccgggcagaagac

SEQ ID NO: 149386 - DNA, 20 bp, human
ggagcccgcgcggggagaag

SEQ ID NO: 149387 - DNA, 20 bp, human
ggcgccgcctgcgagaggca

SEQ ID NO: 149388 - DNA, 20 bp, human
gcagagcagggacgaggtca

SEQ ID NO: 149389 - DNA, 20 bp, human
gccccgcgcgggctctcggc

SEQ ID NO: 149390 - DNA, 20 bp, human
ggcgcgggctctcggcaggc

SEQ ID NO: 149391 - DNA, 20 bp, human
gactcgcgggctccgttcag

SEQ ID NO: 149392 - DNA, 20 bp, human
ggaggtcagggacacgggca

SEQ ID NO: 149393 - DNA, 20 bp, human
gagggacgaggtcagggaca

SEQ ID NO: 149394 - DNA, 20 bp, human
gagggcgggcgtcctctgaa

SEQ ID NO: 149395 - DNA, 20 bp, human
ggacgcgcgtcactctacct

SEQ ID NO: 149396 - DNA, 20 bp, human
gtgagatacaatccttggtg

SEQ ID NO: 149397 - DNA, 20 bp, human
gcagagcagagcctactcta

SEQ ID NO: 149398 - DNA, 20 bp, human
gcgtacgtaaagggttccaa

SEQ ID NO: 149399 - DNA, 20 bp, human
gctcagtgtatagtatctca

SEQ ID NO: 149400 - DNA, 20 bp, human
gtagaaatccaagttagtag

SEQ ID NO: 149401 - DNA, 20 bp, human
ggacttggaaattgaaagat

SEQ ID NO: 149402 - DNA, 20 bp, human
gacttatgagatacaatcct

SEQ ID NO: 149403 - DNA, 20 bp, human
gagaagtggagggattcctt

SEQ ID NO: 149404 - DNA, 20 bp, human
gcttatgcagccgctataag

SEQ ID NO: 149405 - DNA, 20 bp, human
ggaattgtaggtaagtggga

SEQ ID NO: 149406 - DNA, 20 bp, human
gtgtcagccgcagagcacgg

SEQ ID NO: 149407 - DNA, 20 bp, human
ggcagagcacggaggaaaga

SEQ ID NO: 149408 - DNA, 20 bp, human
gcctctccctaggtcttaag

SEQ ID NO: 149409 - DNA, 20 bp, human
ggaatggaagagctcctgtc

SEQ ID NO: 149410 - DNA, 20 bp, human
gggctgctggcacaccggac

SEQ ID NO: 149411 - DNA, 20 bp, human
gggtctccccttaagaccta

SEQ ID NO: 149412 - DNA, 20 bp, human
ggggcacagctcgccagcag

SEQ ID NO: 149413 - DNA, 20 bp, human
gtcgcgctcaccgccagtcc

SEQ ID NO: 149414 - DNA, 20 bp, human
ggagaggtctggtctaatct

SEQ ID NO: 149415 - DNA, 20 bp, human
gagctgtcagccgcagagca

SEQ ID NO: 149416 - DNA, 20 bp, human
gggtacggcacggctcacag

SEQ ID NO: 149417 - DNA, 20 bp, human
gggccgccgcagagcgccgg

SEQ ID NO: 149418 - DNA, 20 bp, human
gtagcagccggcgccggcgt

SEQ ID NO: 149419 - DNA, 20 bp, human
gggaggtgaagcgagataaa

SEQ ID NO: 149420 - DNA, 20 bp, human
ggggcgggaggagcaaacgc

SEQ ID NO: 149421 - DNA, 20 bp, human
gtccaatgctagggagaaga

SEQ ID NO: 149422 - DNA, 20 bp, human
ggtacggtcaccatcgtccg

SEQ ID NO: 149423 - DNA, 20 bp, human
gggagcctgcgacgcgatgg

SEQ ID NO: 149424 - DNA, 20 bp, human
gggccgagccccttagcagc

SEQ ID NO: 149425 - DNA, 20 bp, human
gtcccgcccccggcgctctg

SEQ ID NO: 149426 - DNA, 20 bp, human
ggagtctactctgaatacaa

SEQ ID NO: 149427 - DNA, 20 bp, human
gagcaggcatcaaagattag

SEQ ID NO: 149428 - DNA, 20 bp, human
gagcccagaactgagatacc

SEQ ID NO: 149429 - DNA, 20 bp, human
gggcatcaaagattagtgga

SEQ ID NO: 149430 - DNA, 20 bp, human
gttcctggtatctcagttct

SEQ ID NO: 149431 - DNA, 20 bp, human
gtactgcagactgcgacgca

SEQ ID NO: 149432 - DNA, 20 bp, human
gctcccaaaccgcaaagaca

SEQ ID NO: 149433 - DNA, 20 bp, human
ggcatttcttacataagcaa

SEQ ID NO: 149434 - DNA, 20 bp, human
gaaagttagctagcaaggag

SEQ ID NO: 149435 - DNA, 20 bp, human
gggtgctgcagtcgtgaccc

SEQ ID NO: 149436 - DNA, 20 bp, human
gtcaggggccggtacgtaga

SEQ ID NO: 149437 - DNA, 20 bp, human
gcagctccggccgtcaccca

SEQ ID NO: 149438 - DNA, 20 bp, human
ggagagaaaagactgcgagg

SEQ ID NO: 149439 - DNA, 20 bp, human
gacctctccggccacagctg

SEQ ID NO: 149440 - DNA, 20 bp, human
gcccggaccgagaccagctc

SEQ ID NO: 149441 - DNA, 20 bp, human
gaagcgggctcaggcggaag

SEQ ID NO: 149442 - DNA, 20 bp, human
gggaagaggctgcgcagtaa

SEQ ID NO: 149443 - DNA, 20 bp, human
ggtctcggtccgggtgcgag

SEQ ID NO: 149444 - DNA, 20 bp, human
ggtcggagcgaggccctctc

SEQ ID NO: 149445 - DNA, 20 bp, human
ggccccagcagccaaggcgg

SEQ ID NO: 149446 - DNA, 20 bp, human
gttgtctcttaatagacaaa

SEQ ID NO: 149447 - DNA, 20 bp, human
gtggccctcatcgaacgtgg

SEQ ID NO: 149448 - DNA, 20 bp, human
ggcaagatagctttgatcca

SEQ ID NO: 149449 - DNA, 20 bp, human
gggtggcacttcctgaagga

SEQ ID NO: 149450 - DNA, 20 bp, human
ggaaagggtgtctggtgtgg

SEQ ID NO: 149451 - DNA, 20 bp, human
gcgtcgaaggggtaattcta

SEQ ID NO: 149452 - DNA, 20 bp, human
gcataaagaagatagcttgt

SEQ ID NO: 149453 - DNA, 20 bp, human
gcatcggaattaggagagag

SEQ ID NO: 149454 - DNA, 20 bp, human
gcaccagacaccctttccag

SEQ ID NO: 149455 - DNA, 20 bp, human
gggctggccctcatcgaacg

SEQ ID NO: 149456 - DNA, 20 bp, human
gccggggccgggctctcgag

SEQ ID NO: 149457 - DNA, 20 bp, human
ggctcgcggcgtgttggctc

SEQ ID NO: 149458 - DNA, 20 bp, human
gccgccgccctggaagactg

SEQ ID NO: 149459 - DNA, 20 bp, human
ggagccaccagggcgaccca

SEQ ID NO: 149460 - DNA, 20 bp, human
gtcgccctggtggctcgtgg

SEQ ID NO: 149461 - DNA, 20 bp, human
gcgcccggcggagacctcga

SEQ ID NO: 149462 - DNA, 20 bp, human
gcagcccccacgagccacca

SEQ ID NO: 149463 - DNA, 20 bp, human
ggctcacccgcgtgagacat

SEQ ID NO: 149464 - DNA, 20 bp, human
gtcagggtcacgcgcgagtg

SEQ ID NO: 149465 - DNA, 20 bp, human
gctccccctagtcagctcag

SEQ ID NO: 149466 - DNA, 20 bp, human
gaccgcgctacagctgagag

SEQ ID NO: 149467 - DNA, 20 bp, human
gctcggccacggtaaagtcc

SEQ ID NO: 149468 - DNA, 20 bp, human
gggggacagtgggagcgagc

SEQ ID NO: 149469 - DNA, 20 bp, human
gtgcttcttgggcgcccggg

SEQ ID NO: 149470 - DNA, 20 bp, human
gctcgccggtggctgcgcct

SEQ ID NO: 149471 - DNA, 20 bp, human
gggtgctgcccagggtgtcc

SEQ ID NO: 149472 - DNA, 20 bp, human
ggggccccggcggataaaga

SEQ ID NO: 149473 - DNA, 20 bp, human
gccggggggcgcgggaacag

SEQ ID NO: 149474 - DNA, 20 bp, human
ggcgctcctgatctcgccgg

SEQ ID NO: 149475 - DNA, 20 bp, human
gtgggccactcacccgcgtg

SEQ ID NO: 149476 - DNA, 20 bp, human
ggctgtctagacgcagatca

SEQ ID NO: 149477 - DNA, 20 bp, human
ggtctagacagcagctccac

SEQ ID NO: 149478 - DNA, 20 bp, human
gcgcagatcatggtgagcct

SEQ ID NO: 149479 - DNA, 20 bp, human
gggtcgatccctggacaact

SEQ ID NO: 149480 - DNA, 20 bp, human
gccccaggactactaatctc

SEQ ID NO: 149481 - DNA, 20 bp, human
gccagccaggtgctgacacc

SEQ ID NO: 149482 - DNA, 20 bp, human
gcactccactcggaaagggt

SEQ ID NO: 149483 - DNA, 20 bp, human
gaatgcaggctcctgagctc

SEQ ID NO: 149484 - DNA, 20 bp, human
gggagttgggcacacatctc

SEQ ID NO: 149485 - DNA, 20 bp, human
gtgggttgcagacccccata

SEQ ID NO: 149486 - DNA, 20 bp, human
ggaaatccaagcgccctcct

SEQ ID NO: 149487 - DNA, 20 bp, human
ggcgccctcctgggcagacg

SEQ ID NO: 149488 - DNA, 20 bp, human
gggctggagcgggtgcacta

SEQ ID NO: 149489 - DNA, 20 bp, human
gcaggcgctacccagatcgt

SEQ ID NO: 149490 - DNA, 20 bp, human
gaagggttagatacgcgccg

SEQ ID NO: 149491 - DNA, 20 bp, human
gcctttgaagaagccattgg

SEQ ID NO: 149492 - DNA, 20 bp, human
ggcgctacccagatcgtggg

SEQ ID NO: 149493 - DNA, 20 bp, human
gtaggaggcaagaggctgac

SEQ ID NO: 149494 - DNA, 20 bp, human
gaccctgcacctacctccaa

SEQ ID NO: 149495 - DNA, 20 bp, human
gtagatacgcgccgcggaga

SEQ ID NO: 149496 - DNA, 20 bp, human
gcgggtgctcgctacagagg

SEQ ID NO: 149497 - DNA, 20 bp, human
ggctcgggtgctcgctacag

SEQ ID NO: 149498 - DNA, 20 bp, human
ggtgctcgctacagaggcgg

SEQ ID NO: 149499 - DNA, 20 bp, human
gctcggaccggagctccagg

SEQ ID NO: 149500 - DNA, 20 bp, human
gccgagcccgccgcggagaa

SEQ ID NO: 149501 - DNA, 20 bp, human
gaccgggagaagatgagccg

SEQ ID NO: 149502 - DNA, 20 bp, human
ggaggaaagctccctcggac

SEQ ID NO: 149503 - DNA, 20 bp, human
gtctgccggctccggatcgg

SEQ ID NO: 149504 - DNA, 20 bp, human
gcgggccgggggcgcaactg

SEQ ID NO: 149505 - DNA, 20 bp, human
gactcactgacctttctccg

SEQ ID NO: 149506 - DNA, 20 bp, human
ggacatcacgcggcctgagg

SEQ ID NO: 149507 - DNA, 20 bp, human
gtcaggccgcgtgatgtcag

SEQ ID NO: 149508 - DNA, 20 bp, human
gagcggccgctgacatcacg

SEQ ID NO: 149509 - DNA, 20 bp, human
gcccgcagcccccttggcag

SEQ ID NO: 149510 - DNA, 20 bp, human
gggcggcgcctctgccaagg

SEQ ID NO: 149511 - DNA, 20 bp, human
gggcgccgcagccgcgagga

SEQ ID NO: 149512 - DNA, 20 bp, human
gatcacgcggcctgaggcgg

SEQ ID NO: 149513 - DNA, 20 bp, human
gacccgcccaagtccggtga

SEQ ID NO: 149514 - DNA, 20 bp, human
gggctgcgggtctgggccgg

SEQ ID NO: 149515 - DNA, 20 bp, human
ggcaggggtctgggtcggga

SEQ ID NO: 149516 - DNA, 20 bp, human
gggcccctctcgacattcaa

SEQ ID NO: 149517 - DNA, 20 bp, human
gagacagatggcccatggaa

SEQ ID NO: 149518 - DNA, 20 bp, human
gtgtcgagaggggccgggaa

SEQ ID NO: 149519 - DNA, 20 bp, human
gcgggggtccccctaaaatg

SEQ ID NO: 149520 - DNA, 20 bp, human
gcgctgcgctccgctcccat

SEQ ID NO: 149521 - DNA, 20 bp, human
gacgtggaccaggaccatcc

SEQ ID NO: 149522 - DNA, 20 bp, human
gggctgcgcgcgcctttgtg

SEQ ID NO: 149523 - DNA, 20 bp, human
gtgcgcgcgcctttgtgtgg

SEQ ID NO: 149524 - DNA, 20 bp, human
gcgcgaggacgcagggcgag

SEQ ID NO: 149525 - DNA, 20 bp, human
gtggatcgccgcaggcaccg

SEQ ID NO: 149526 - DNA, 20 bp, human
ggcaggtgtactgcgcctcc

SEQ ID NO: 149527 - DNA, 20 bp, human
ggcggaacatagccatcccg

SEQ ID NO: 149528 - DNA, 20 bp, human
gcgtcagcgcggcgcagtag

SEQ ID NO: 149529 - DNA, 20 bp, human
gggtgaaccgaagcagcagt

SEQ ID NO: 149530 - DNA, 20 bp, human
gggggatgaacgcgcccaga

SEQ ID NO: 149531 - DNA, 20 bp, human
gcgcgccgcctctgccctct

SEQ ID NO: 149532 - DNA, 20 bp, human
gggctggcgcgaaggaggct

SEQ ID NO: 149533 - DNA, 20 bp, human
gaccgaagcagcagtcggac

SEQ ID NO: 149534 - DNA, 20 bp, human
gctgcctggaggtctatcac

SEQ ID NO: 149535 - DNA, 20 bp, human
gccagtccggagctgcaccg

SEQ ID NO: 149536 - DNA, 20 bp, human
gaggagcaggaggcagaacg

SEQ ID NO: 149537 - DNA, 20 bp, human
ggatagagcacccaccctgt

SEQ ID NO: 149538 - DNA, 20 bp, human
ggaccagaaagcagacgggt

SEQ ID NO: 149539 - DNA, 20 bp, human
gggacccccacgacacgggt

SEQ ID NO: 149540 - DNA, 20 bp, human
gcagtgaccagaaagcagac

SEQ ID NO: 149541 - DNA, 20 bp, human
gacgggtgggtgccaggcga

SEQ ID NO: 149542 - DNA, 20 bp, human
gggctctctgaacaccaggc

SEQ ID NO: 149543 - DNA, 20 bp, human
gagcacggccacgggctgag

SEQ ID NO: 149544 - DNA, 20 bp, human
ggagtggacccccacgacac

SEQ ID NO: 149545 - DNA, 20 bp, human
gctggcagtcactggaaact

SEQ ID NO: 149546 - DNA, 20 bp, human
gaggggacggagcctaacac

SEQ ID NO: 149547 - DNA, 20 bp, human
ggaaagggcgctgaaaggaa

SEQ ID NO: 149548 - DNA, 20 bp, human
gccctgggatcctaaaggag

SEQ ID NO: 149549 - DNA, 20 bp, human
gctggtacggggataaaacg

SEQ ID NO: 149550 - DNA, 20 bp, human
ggtgagtctgagggacggat

SEQ ID NO: 149551 - DNA, 20 bp, human
ggccgctccccacagcacag

SEQ ID NO: 149552 - DNA, 20 bp, human
gtggcggagctcaaggaggt

SEQ ID NO: 149553 - DNA, 20 bp, human
gataaaacgcggaaagggga

SEQ ID NO: 149554 - DNA, 20 bp, human
gacccgggggctcattcgag

SEQ ID NO: 149555 - DNA, 20 bp, human
gcgaggtctgcggacaaaaa

SEQ ID NO: 149556 - DNA, 20 bp, human
ggcgcccgaaaggtgaacac

SEQ ID NO: 149557 - DNA, 20 bp, human
gtgcgctgccgcaacgaata

SEQ ID NO: 149558 - DNA, 20 bp, human
gctggctgcgtaggagggac

SEQ ID NO: 149559 - DNA, 20 bp, human
gacaggaataccccggaggg

SEQ ID NO: 149560 - DNA, 20 bp, human
gcaaacaggaataccccgga

SEQ ID NO: 149561 - DNA, 20 bp, human
gctccgcggcatgaacaccg

SEQ ID NO: 149562 - DNA, 20 bp, human
gcaggcaaacaggaataccc

SEQ ID NO: 149563 - DNA, 20 bp, human
gccggctgccccgagctgag

SEQ ID NO: 149564 - DNA, 20 bp, human
gaagcaaaaaggcgctctca

SEQ ID NO: 149565 - DNA, 20 bp, human
gccagaaaccctattcgttg

SEQ ID NO: 149566 - DNA, 20 bp, human
ggcggccactcgctttgccg

SEQ ID NO: 149567 - DNA, 20 bp, human
gcgccgcggccggaggaatc

SEQ ID NO: 149568 - DNA, 20 bp, human
gagtactcgggcctcttccg

SEQ ID NO: 149569 - DNA, 20 bp, human
gcaaacgggaaacaagatgg

SEQ ID NO: 149570 - DNA, 20 bp, human
ggctgcaggtccgagtactc

SEQ ID NO: 149571 - DNA, 20 bp, human
ggacggccaggccgactcag

SEQ ID NO: 149572 - DNA, 20 bp, human
gcttcaaacgggaaacaaga

SEQ ID NO: 149573 - DNA, 20 bp, human
gggccgctgtgacgagacgg

SEQ ID NO: 149574 - DNA, 20 bp, human
gaggccgactcagaggtgct

SEQ ID NO: 149575 - DNA, 20 bp, human
gcgggcggcagcgctcgggt

SEQ ID NO: 149576 - DNA, 20 bp, human
ggctggtaggaagacctaga

SEQ ID NO: 149577 - DNA, 20 bp, human
gcagaagaaagagacagcga

SEQ ID NO: 149578 - DNA, 20 bp, human
gctgcacccgacctctaaga

SEQ ID NO: 149579 - DNA, 20 bp, human
gctggtgcactggatttcag

SEQ ID NO: 149580 - DNA, 20 bp, human
ggcagcacctgcgcctgtca

SEQ ID NO: 149581 - DNA, 20 bp, human
ggtcttcctaccagcgaatg

SEQ ID NO: 149582 - DNA, 20 bp, human
gttcctaccagcgaatgggg

SEQ ID NO: 149583 - DNA, 20 bp, human
gcggcagaggcttcgaagac

SEQ ID NO: 149584 - DNA, 20 bp, human
gcctccagccgggaggatgg

SEQ ID NO: 149585 - DNA, 20 bp, human
gcaccgaccctccagccggg

SEQ ID NO: 149586 - DNA, 20 bp, human
ggacaccgccgctccctcta

SEQ ID NO: 149587 - DNA, 20 bp, human
gcgagggcgcgaccggacgg

SEQ ID NO: 149588 - DNA, 20 bp, human
ggcggagagcggctctaggt

SEQ ID NO: 149589 - DNA, 20 bp, human
gccgcgagggcgcgaccgga

SEQ ID NO: 149590 - DNA, 20 bp, human
gacgctccgagcgaccctag

SEQ ID NO: 149591 - DNA, 20 bp, human
gggctccgcgggccccgata

SEQ ID NO: 149592 - DNA, 20 bp, human
gggccagagctaccccaaga

SEQ ID NO: 149593 - DNA, 20 bp, human
gtcgcgccctcgcggaagct

SEQ ID NO: 149594 - DNA, 20 bp, human
gtagaaaggggacgtctagt

SEQ ID NO: 149595 - DNA, 20 bp, human
gcgcactccaaattagaaag

SEQ ID NO: 149596 - DNA, 20 bp, human
ggtgagagccggatctgcgg

SEQ ID NO: 149597 - DNA, 20 bp, human
gggactggcaccccgcacgg

SEQ ID NO: 149598 - DNA, 20 bp, human
gccgcagagtccgcagaagg

SEQ ID NO: 149599 - DNA, 20 bp, human
gtctggaagatgccaccgtg

SEQ ID NO: 149600 - DNA, 20 bp, human
gaccggccctggaaagacgt

SEQ ID NO: 149601 - DNA, 20 bp, human
ggagggactggcaccccgca

SEQ ID NO: 149602 - DNA, 20 bp, human
gggagggcacagaagtgggg

SEQ ID NO: 149603 - DNA, 20 bp, human
gctcccgccccgcacaaccc

SEQ ID NO: 149604 - DNA, 20 bp, human
gcgcggggcctcgggagccg

SEQ ID NO: 149605 - DNA, 20 bp, human
ggtgcgaggatgcgagaaga

SEQ ID NO: 149606 - DNA, 20 bp, human
gcgccagcagccaggctctg

SEQ ID NO: 149607 - DNA, 20 bp, human
gcgaggcgctgtaggtgtgg

SEQ ID NO: 149608 - DNA, 20 bp, human
gaggctctgaggactcgctg

SEQ ID NO: 149609 - DNA, 20 bp, human
gctggaggttggaattacac

SEQ ID NO: 149610 - DNA, 20 bp, human
gggtcgaaaaagctgagtcc

SEQ ID NO: 149611 - DNA, 20 bp, human
gcctggagagggttcagtac

SEQ ID NO: 149612 - DNA, 20 bp, human
gcccgcctgggccaacgtgg

SEQ ID NO: 149613 - DNA, 20 bp, human
gcctggaggcgaggcgctgt

SEQ ID NO: 149614 - DNA, 20 bp, human
gatccacgtcccggagcctc

SEQ ID NO: 149615 - DNA, 20 bp, human
gaggcccgccgggcgagagg

SEQ ID NO: 149616 - DNA, 20 bp, human
gtctcctgctcagggtccga

SEQ ID NO: 149617 - DNA, 20 bp, human
ggctatcgagcagggtccga

SEQ ID NO: 149618 - DNA, 20 bp, human
gtacgggcggcgagactgag

SEQ ID NO: 149619 - DNA, 20 bp, human
gagggctgtgtcagaaggct

SEQ ID NO: 149620 - DNA, 20 bp, human
ggagccgtcggaccctgagc

SEQ ID NO: 149621 - DNA, 20 bp, human
gggagaaggcggattaccag

SEQ ID NO: 149622 - DNA, 20 bp, human
gctctgggaggtctcagaga

SEQ ID NO: 149623 - DNA, 20 bp, human
gggggccgtgtgctgtgagt

SEQ ID NO: 149624 - DNA, 20 bp, human
gctcagagaaggtgaggcat

SEQ ID NO: 149625 - DNA, 20 bp, human
gtaatctggagtgttagtac

SEQ ID NO: 149626 - DNA, 20 bp, human
gcaagcgcgccgaggagagg

SEQ ID NO: 149627 - DNA, 20 bp, human
ggcgcgcggagtctccctcc

SEQ ID NO: 149628 - DNA, 20 bp, human
gggccgccgccggccaggta

SEQ ID NO: 149629 - DNA, 20 bp, human
gctccctccgggcaccacgg

SEQ ID NO: 149630 - DNA, 20 bp, human
ggccgcacagcccctcaagt

SEQ ID NO: 149631 - DNA, 20 bp, human
ggatcgccttacctggccgg

SEQ ID NO: 149632 - DNA, 20 bp, human
gggagccgctccggctgcgg

SEQ ID NO: 149633 - DNA, 20 bp, human
gccgggagccgctccggctg

SEQ ID NO: 149634 - DNA, 20 bp, human
ggtgccatcgaggcttttgg

SEQ ID NO: 149635 - DNA, 20 bp, human
gccttcttggcgtgccatcg

SEQ ID NO: 149636 - DNA, 20 bp, human
gagggctgcacgaacggagg

SEQ ID NO: 149637 - DNA, 20 bp, human
gaaggagacagagagggtcg

SEQ ID NO: 149638 - DNA, 20 bp, human
ggagacagagagggtcgcgg

SEQ ID NO: 149639 - DNA, 20 bp, human
ggtgcccagtagaatacgga

SEQ ID NO: 149640 - DNA, 20 bp, human
gttcagcctctctcacaggg

SEQ ID NO: 149641 - DNA, 20 bp, human
ggcgtgcagggctgcacgaa

SEQ ID NO: 149642 - DNA, 20 bp, human
ggcgccttccgtattctact

SEQ ID NO: 149643 - DNA, 20 bp, human
gagtcttcccagctaaagag

SEQ ID NO: 149644 - DNA, 20 bp, human
ggtctccttacctgctccct

SEQ ID NO: 149645 - DNA, 20 bp, human
gagagcaaccttgtaggagt

SEQ ID NO: 149646 - DNA, 20 bp, human
gtgtcctgggaaggcggacc

SEQ ID NO: 149647 - DNA, 20 bp, human
ggggcgccaaagtttaggga

SEQ ID NO: 149648 - DNA, 20 bp, human
ggagcgcggtgaacagagtt

SEQ ID NO: 149649 - DNA, 20 bp, human
gcactcccagatgatagagg

SEQ ID NO: 149650 - DNA, 20 bp, human
ggctggcgttaactgtgcgg

SEQ ID NO: 149651 - DNA, 20 bp, human
gactggagtccgcgtaggag

SEQ ID NO: 149652 - DNA, 20 bp, human
gtccgcgtaggaggggtcgg

SEQ ID NO: 149653 - DNA, 20 bp, human
gatgtgactggagtccgcgt

SEQ ID NO: 149654 - DNA, 20 bp, human
ggcctctgcttctccactca

SEQ ID NO: 149655 - DNA, 20 bp, human
gctcgcacgggggatagaat

SEQ ID NO: 149656 - DNA, 20 bp, human
ggctgcagatgaggcccccg

SEQ ID NO: 149657 - DNA, 20 bp, human
gcgaccatgaggcggtggtg

SEQ ID NO: 149658 - DNA, 20 bp, human
gagcctgcgcgaccatgagg

SEQ ID NO: 149659 - DNA, 20 bp, human
gcggtgaccttgcggcacag

SEQ ID NO: 149660 - DNA, 20 bp, human
gctggccagagtgaaaagga

SEQ ID NO: 149661 - DNA, 20 bp, human
gaggtcaccgccgtccccgg

SEQ ID NO: 149662 - DNA, 20 bp, human
gagcgggcaggtgatggacc

SEQ ID NO: 149663 - DNA, 20 bp, human
ggcaaccggggacagctgta

SEQ ID NO: 149664 - DNA, 20 bp, human
gttggtgggagaggatggac

SEQ ID NO: 149665 - DNA, 20 bp, human
ggtgcgtgcaggacaacacc

SEQ ID NO: 149666 - DNA, 20 bp, human
gggagggccggagacctaga

SEQ ID NO: 149667 - DNA, 20 bp, human
gtagacggccggcgaccgga

SEQ ID NO: 149668 - DNA, 20 bp, human
gggccggagacctagacggc

SEQ ID NO: 149669 - DNA, 20 bp, human
gctcggggcccgcagccata

SEQ ID NO: 149670 - DNA, 20 bp, human
gcctgttgctggtctccgtc

SEQ ID NO: 149671 - DNA, 20 bp, human
gtccagcgcggttcccactc

SEQ ID NO: 149672 - DNA, 20 bp, human
ggcgcgctgccagcagtcgt

SEQ ID NO: 149673 - DNA, 20 bp, human
gctcctcgagcgccagaagg

SEQ ID NO: 149674 - DNA, 20 bp, human
gcgccggccgtctaggtctc

SEQ ID NO: 149675 - DNA, 20 bp, human
gccgtgcgcgtccccggcgt

SEQ ID NO: 149676 - DNA, 20 bp, human
ggctggctgaccccactgag

SEQ ID NO: 149677 - DNA, 20 bp, human
gtgacctgaaccgctcagtg

SEQ ID NO: 149678 - DNA, 20 bp, human
gaggcagaagaaaagccctg

SEQ ID NO: 149679 - DNA, 20 bp, human
gtcactgctgcaggcggtct

SEQ ID NO: 149680 - DNA, 20 bp, human
ggggctccctgaggacgagc

SEQ ID NO: 149681 - DNA, 20 bp, human
ggtcagccagctcgtcctca

SEQ ID NO: 149682 - DNA, 20 bp, human
gtccaccctggcccgatggt

SEQ ID NO: 149683 - DNA, 20 bp, human
gcaacccagatggccctgaa

SEQ ID NO: 149684 - DNA, 20 bp, human
gggaccattgcccgaagtca

SEQ ID NO: 149685 - DNA, 20 bp, human
gtgaccccactgagcggttc

SEQ ID NO: 149686 - DNA, 20 bp, human
gtaggcccatctcccagcag

SEQ ID NO: 149687 - DNA, 20 bp, human
gcggccgcacaggcaccagg

SEQ ID NO: 149688 - DNA, 20 bp, human
gtaaagcgggggagacccaa

SEQ ID NO: 149689 - DNA, 20 bp, human
ggggcaggagacagctcgag

SEQ ID NO: 149690 - DNA, 20 bp, human
gggcccggcgatattatgac

SEQ ID NO: 149691 - DNA, 20 bp, human
gcgccgctctgaggagttaa

SEQ ID NO: 149692 - DNA, 20 bp, human
gtcagagcggcggcagcgca

SEQ ID NO: 149693 - DNA, 20 bp, human
ggcacaggcaccaggaggac

SEQ ID NO: 149694 - DNA, 20 bp, human
gaggagttaaaggtacgggc

SEQ ID NO: 149695 - DNA, 20 bp, human
gtacctttaactcctcagag

SEQ ID NO: 149696 - DNA, 20 bp, human
ggcagaggccgaggagccag

SEQ ID NO: 149697 - DNA, 20 bp, human
ggccgggagggcggttgagg

SEQ ID NO: 149698 - DNA, 20 bp, human
ggaagacgctgtgcaaggtg

SEQ ID NO: 149699 - DNA, 20 bp, human
ggagcctgggttcgacgatg

SEQ ID NO: 149700 - DNA, 20 bp, human
gcccggcgatagaagccgag

SEQ ID NO: 149701 - DNA, 20 bp, human
gcctgggttcgacgatgagg

SEQ ID NO: 149702 - DNA, 20 bp, human
gttcgacgatgaggaggcgg

SEQ ID NO: 149703 - DNA, 20 bp, human
ggggttcgacgatgaggagg

SEQ ID NO: 149704 - DNA, 20 bp, human
gccgctgcggcacttagggt

SEQ ID NO: 149705 - DNA, 20 bp, human
gatcgccgggagggcggttg

SEQ ID NO: 149706 - DNA, 20 bp, human
gggcctccgcgcagaggaaa

SEQ ID NO: 149707 - DNA, 20 bp, human
gcgcggccggagcaagactc

SEQ ID NO: 149708 - DNA, 20 bp, human
gccggcgccgccgcacaata

SEQ ID NO: 149709 - DNA, 20 bp, human
gtgaggctcgccatattgtg

SEQ ID NO: 149710 - DNA, 20 bp, human
gtccgtccgcctccggagta

SEQ ID NO: 149711 - DNA, 20 bp, human
gggctcgccatattgtgcgg

SEQ ID NO: 149712 - DNA, 20 bp, human
gagctccattgcggaagctg

SEQ ID NO: 149713 - DNA, 20 bp, human
gactctggtatcagctgccg

SEQ ID NO: 149714 - DNA, 20 bp, human
ggcggtcccctcgcctccgg

SEQ ID NO: 149715 - DNA, 20 bp, human
gtatcagctgccgcggacgc

SEQ ID NO: 149716 - DNA, 20 bp, human
gtgcgagttctgttcccgcg

SEQ ID NO: 149717 - DNA, 20 bp, human
gggcctggcacagtcctgtt

SEQ ID NO: 149718 - DNA, 20 bp, human
gctgacccgcggcggagaca

SEQ ID NO: 149719 - DNA, 20 bp, human
gtacctcccagggtgctcaa

SEQ ID NO: 149720 - DNA, 20 bp, human
ggcgccagttcaaagaactt

SEQ ID NO: 149721 - DNA, 20 bp, human
gctcctttgagcaccctggg

SEQ ID NO: 149722 - DNA, 20 bp, human
ggtgctcaaaggaggcggaa

SEQ ID NO: 149723 - DNA, 20 bp, human
gtctcacccctgacccgcgg

SEQ ID NO: 149724 - DNA, 20 bp, human
gacaaggcagaacttccggg

SEQ ID NO: 149725 - DNA, 20 bp, human
gtcgcagcagttactcacca

SEQ ID NO: 149726 - DNA, 20 bp, human
gtccagggccggctactcct

SEQ ID NO: 149727 - DNA, 20 bp, human
ggtgcgggcctgaacttcca

SEQ ID NO: 149728 - DNA, 20 bp, human
gcagagtgggaaccatcgcc

SEQ ID NO: 149729 - DNA, 20 bp, human
gcagcgacagcgcaagcggg

SEQ ID NO: 149730 - DNA, 20 bp, human
ggggaggccccgcgcagagt

SEQ ID NO: 149731 - DNA, 20 bp, human
gtccccggcgcagggagaac

SEQ ID NO: 149732 - DNA, 20 bp, human
gggcacagcgggcacaccag

SEQ ID NO: 149733 - DNA, 20 bp, human
gtgggaaccatcgcccggtg

SEQ ID NO: 149734 - DNA, 20 bp, human
gggccgcgggagctcaagcg

SEQ ID NO: 149735 - DNA, 20 bp, human
ggccgctagggcccaggtta

SEQ ID NO: 149736 - DNA, 20 bp, human
gtgctcggtgcgtctcgtcg

SEQ ID NO: 149737 - DNA, 20 bp, human
ggcgctcggcccgcaggacg

SEQ ID NO: 149738 - DNA, 20 bp, human
gcgcggcagcgcgcgcatag

SEQ ID NO: 149739 - DNA, 20 bp, human
gcacgtgttgcagaagtacg

SEQ ID NO: 149740 - DNA, 20 bp, human
gttacgtgcagggctgcgag

SEQ ID NO: 149741 - DNA, 20 bp, human
gcactgcgtggacctggaat

SEQ ID NO: 149742 - DNA, 20 bp, human
gtcggtggagaacaagaggt

SEQ ID NO: 149743 - DNA, 20 bp, human
ggcggtgctggtgagcgcag

SEQ ID NO: 149744 - DNA, 20 bp, human
ggagagccgggcacactgcg

SEQ ID NO: 149745 - DNA, 20 bp, human
gacccagggccacgatgtcg

SEQ ID NO: 149746 - DNA, 20 bp, human
gccccccccagtggccacag

SEQ ID NO: 149747 - DNA, 20 bp, human
ggcttctctggtccagtcct

SEQ ID NO: 149748 - DNA, 20 bp, human
gtcagactggatgttcgggt

SEQ ID NO: 149749 - DNA, 20 bp, human
gcctcgggcccggggtcaga

SEQ ID NO: 149750 - DNA, 20 bp, human
gctgagggccaggcacgctt

SEQ ID NO: 149751 - DNA, 20 bp, human
ggacagccggcgagagttgg

SEQ ID NO: 149752 - DNA, 20 bp, human
ggacggcccgtggactccta

SEQ ID NO: 149753 - DNA, 20 bp, human
gtgccacggcggccccgtaa

SEQ ID NO: 149754 - DNA, 20 bp, human
gtgtaggagtgcccacaggt

SEQ ID NO: 149755 - DNA, 20 bp, human
ggacatgcctgccttggaag

SEQ ID NO: 149756 - DNA, 20 bp, human
ggccaggcgggcgaccgcag

SEQ ID NO: 149757 - DNA, 20 bp, human
ggctggtcccaaccttgcgt

SEQ ID NO: 149758 - DNA, 20 bp, human
gctccccgcgcagggcccga

SEQ ID NO: 149759 - DNA, 20 bp, human
gcgcgaagcccacgcaaggt

SEQ ID NO: 149760 - DNA, 20 bp, human
gcccacgcgaagcccacgca

SEQ ID NO: 149761 - DNA, 20 bp, human
gtgagaggccgcggaggtag

SEQ ID NO: 149762 - DNA, 20 bp, human
gaggagcaggggaactctga

SEQ ID NO: 149763 - DNA, 20 bp, human
ggcaggggaactctgagggg

SEQ ID NO: 149764 - DNA, 20 bp, human
gagagggcgcgtggagaagg

SEQ ID NO: 149765 - DNA, 20 bp, human
gtgcgcctgcgcaaagtcga

SEQ ID NO: 149766 - DNA, 20 bp, human
gcggcaggcggcgagctcgg

SEQ ID NO: 149767 - DNA, 20 bp, human
gcagggccccgtgacccgag

SEQ ID NO: 149768 - DNA, 20 bp, human
gccaggcccgctcgcacctg

SEQ ID NO: 149769 - DNA, 20 bp, human
gcctgtacgaatggcaacaa

SEQ ID NO: 149770 - DNA, 20 bp, human
gcggggcacggggggtgtag

SEQ ID NO: 149771 - DNA, 20 bp, human
ggaagtggccggggcacggg

SEQ ID NO: 149772 - DNA, 20 bp, human
ggccggggaacagggtcagt

SEQ ID NO: 149773 - DNA, 20 bp, human
gcacggggggtgtagtggaa

SEQ ID NO: 149774 - DNA, 20 bp, human
ggagcgggctaggatacagt

SEQ ID NO: 149775 - DNA, 20 bp, human
gcgggggccgcaggtgcgag

SEQ ID NO: 149776 - DNA, 20 bp, human
gggctgtcgccaacctcggt

SEQ ID NO: 149777 - DNA, 20 bp, human
gcccggatgactcaccatag

SEQ ID NO: 149778 - DNA, 20 bp, human
gaccaccgagcaacaggcag

SEQ ID NO: 149779 - DNA, 20 bp, human
gctggctcggctggccagtg

SEQ ID NO: 149780 - DNA, 20 bp, human
gccagtggggccactctgct

SEQ ID NO: 149781 - DNA, 20 bp, human
gcactgagccctcggcacct

SEQ ID NO: 149782 - DNA, 20 bp, human
gcatccgggagagatggcct

SEQ ID NO: 149783 - DNA, 20 bp, human
ggcaggggcctcagcctcta

SEQ ID NO: 149784 - DNA, 20 bp, human
gtgttgcctgagtcaaaagg

SEQ ID NO: 149785 - DNA, 20 bp, human
gaacctcggtgggcgcggag

SEQ ID NO: 149786 - DNA, 20 bp, human
gcgcgcccccgggaggaaag

SEQ ID NO: 149787 - DNA, 20 bp, human
gggtcctcgggcgagaacag

SEQ ID NO: 149788 - DNA, 20 bp, human
ggcccccgggaggaaagtgg

SEQ ID NO: 149789 - DNA, 20 bp, human
ggccggagccacgggtcctc

SEQ ID NO: 149790 - DNA, 20 bp, human
ggcgaccaccagcgaagcag

SEQ ID NO: 149791 - DNA, 20 bp, human
gcgggacgcacctgagcggg

SEQ ID NO: 149792 - DNA, 20 bp, human
gcgctcgtgccgccggaagt

SEQ ID NO: 149793 - DNA, 20 bp, human
gcgcacctgagcgggcggag

SEQ ID NO: 149794 - DNA, 20 bp, human
gggacgggacgcacctgagc

SEQ ID NO: 149795 - DNA, 20 bp, human
gggccatgcatgcaactccg

SEQ ID NO: 149796 - DNA, 20 bp, human
gcggcgagctggcccaacag

SEQ ID NO: 149797 - DNA, 20 bp, human
ggggcgcgggggggatcgga

SEQ ID NO: 149798 - DNA, 20 bp, human
ggcagacgaccgcccagcag

SEQ ID NO: 149799 - DNA, 20 bp, human
ggacccctggccccactgtt

SEQ ID NO: 149800 - DNA, 20 bp, human
gggtgcggggtctctaggga

SEQ ID NO: 149801 - DNA, 20 bp, human
gctctagggagggttgagag

SEQ ID NO: 149802 - DNA, 20 bp, human
ggcagcagcagcggagacgg

SEQ ID NO: 149803 - DNA, 20 bp, human
gggcccaacagtggggccag

SEQ ID NO: 149804 - DNA, 20 bp, human
ggactctcaaggcttggtgg

SEQ ID NO: 149805 - DNA, 20 bp, human
gagcgaggccgctgccggac

SEQ ID NO: 149806 - DNA, 20 bp, human
gggcgacgcggcctctctga

SEQ ID NO: 149807 - DNA, 20 bp, human
gcacccccggagctccacag

SEQ ID NO: 149808 - DNA, 20 bp, human
ggcggcttctgaggagtaag

SEQ ID NO: 149809 - DNA, 20 bp, human
ggagggaagcgcggtctccc

SEQ ID NO: 149810 - DNA, 20 bp, human
ggctagccaggcaggttcgg

SEQ ID NO: 149811 - DNA, 20 bp, human
ggccacggagctcgcagctg

SEQ ID NO: 149812 - DNA, 20 bp, human
gcctcgggtctgctgcgcga

SEQ ID NO: 149813 - DNA, 20 bp, human
gtgagggccgccgagctgag

SEQ ID NO: 149814 - DNA, 20 bp, human
gggcgaggctggagcgacaa

SEQ ID NO: 149815 - DNA, 20 bp, human
gtgcgcgagggcaacagccc

SEQ ID NO: 149816 - DNA, 20 bp, human
gcggtggtcaaagggtcgag

SEQ ID NO: 149817 - DNA, 20 bp, human
ggcgctccggctgcacctcc

SEQ ID NO: 149818 - DNA, 20 bp, human
gaaggacccggaagcagaag

SEQ ID NO: 149819 - DNA, 20 bp, human
ggccgcgccagagtacgagg

SEQ ID NO: 149820 - DNA, 20 bp, human
gagtggctcggctcgactcg

SEQ ID NO: 149821 - DNA, 20 bp, human
gcgctccggcctctccccca

SEQ ID NO: 149822 - DNA, 20 bp, human
gctcctggtgcgcgccgcgg

SEQ ID NO: 149823 - DNA, 20 bp, human
ggccgccccgagctgcatgt

SEQ ID NO: 149824 - DNA, 20 bp, human
gtgagcccccgaggcctcag

SEQ ID NO: 149825 - DNA, 20 bp, human
gagcagagcacggtgagcgg

SEQ ID NO: 149826 - DNA, 20 bp, human
gttctgcacggtctgagcca

SEQ ID NO: 149827 - DNA, 20 bp, human
gaccgcccgcggcctcacac

SEQ ID NO: 149828 - DNA, 20 bp, human
gcagtcttggcgaagagtag

SEQ ID NO: 149829 - DNA, 20 bp, human
ggcgaagagtagcggtaggt

SEQ ID NO: 149830 - DNA, 20 bp, human
ggtcggcgggacttccgtgt

SEQ ID NO: 149831 - DNA, 20 bp, human
gggcaagacaccggcctcga

SEQ ID NO: 149832 - DNA, 20 bp, human
gggcctcccatcaagaacgc

SEQ ID NO: 149833 - DNA, 20 bp, human
ggactaagaagcccgaggtg

SEQ ID NO: 149834 - DNA, 20 bp, human
gagcaaatgtggcacgtgat

SEQ ID NO: 149835 - DNA, 20 bp, human
gaagacaccggcctcgaagg

SEQ ID NO: 149836 - DNA, 20 bp, human
ggttctagcctggcacacgt

SEQ ID NO: 149837 - DNA, 20 bp, human
ggtgtgccaggctagaacaa

SEQ ID NO: 149838 - DNA, 20 bp, human
gccataaggctgtcaagaag

SEQ ID NO: 149839 - DNA, 20 bp, human
gtgatgaagataagaggcca

SEQ ID NO: 149840 - DNA, 20 bp, human
ggagcgatgatgaagataag

SEQ ID NO: 149841 - DNA, 20 bp, human
gcggggatggtggagtacag

SEQ ID NO: 149842 - DNA, 20 bp, human
gtacagaggccccgcctgga

SEQ ID NO: 149843 - DNA, 20 bp, human
gtctagggtgaaagtctcgg

SEQ ID NO: 149844 - DNA, 20 bp, human
gagagagagagtcatccctg

SEQ ID NO: 149845 - DNA, 20 bp, human
ggctggtgatagtggaggat

SEQ ID NO: 149846 - DNA, 20 bp, human
gtctccggaacagagtgtgg

SEQ ID NO: 149847 - DNA, 20 bp, human
gccatctccggaacagagtg

SEQ ID NO: 149848 - DNA, 20 bp, human
gagatgggctactgctgtgg

SEQ ID NO: 149849 - DNA, 20 bp, human
gtcattaggaattgcctcgg

SEQ ID NO: 149850 - DNA, 20 bp, human
gttaggaattgcctcggcgg

SEQ ID NO: 149851 - DNA, 20 bp, human
gtgactagttgctcacccac

SEQ ID NO: 149852 - DNA, 20 bp, human
gcggtcacactaacagcaac

SEQ ID NO: 149853 - DNA, 20 bp, human
gaatgacagagcaggtcggg

SEQ ID NO: 149854 - DNA, 20 bp, human
gtgggctactgctgtggggg

SEQ ID NO: 149855 - DNA, 20 bp, human
gtcctaatgacagagcaggt

SEQ ID NO: 149856 - DNA, 20 bp, human
gccaaccgtggccggcgagg

SEQ ID NO: 149857 - DNA, 20 bp, human
gactcacggcctcacagtga

SEQ ID NO: 149858 - DNA, 20 bp, human
gctgctctgtccaagacagg

SEQ ID NO: 149859 - DNA, 20 bp, human
ggtgccaggagtcacttctg

SEQ ID NO: 149860 - DNA, 20 bp, human
gcagagctctgtgcgggtga

SEQ ID NO: 149861 - DNA, 20 bp, human
gtgtcccggtggcactggtc

SEQ ID NO: 149862 - DNA, 20 bp, human
gagcagacactgccacggca

SEQ ID NO: 149863 - DNA, 20 bp, human
gcaggctggcgggatgacac

SEQ ID NO: 149864 - DNA, 20 bp, human
gacctgcacaggctcagggt

SEQ ID NO: 149865 - DNA, 20 bp, human
gtgacggcgtgtgactcagg

SEQ ID NO: 149866 - DNA, 20 bp, human
gggcagactgccaagaaggt

SEQ ID NO: 149867 - DNA, 20 bp, human
ggtaagagtgagggagcgga

SEQ ID NO: 149868 - DNA, 20 bp, human
gtccagccggcatcaaggtg

SEQ ID NO: 149869 - DNA, 20 bp, human
gagagttgagggaccaagaa

SEQ ID NO: 149870 - DNA, 20 bp, human
gagtatggaggggaggttaa

SEQ ID NO: 149871 - DNA, 20 bp, human
gaagaagggttgggacaggt

SEQ ID NO: 149872 - DNA, 20 bp, human
gatcatacctcccggaacct

SEQ ID NO: 149873 - DNA, 20 bp, human
gtgcaggcagagcagagttg

SEQ ID NO: 149874 - DNA, 20 bp, human
gtgcccaccaaggaggcgtc

SEQ ID NO: 149875 - DNA, 20 bp, human
gacattccagtatggagggg

SEQ ID NO: 149876 - DNA, 20 bp, human
gcgggaccgtcagcgccctg

SEQ ID NO: 149877 - DNA, 20 bp, human
ggtgagtccctcacaaaggg

SEQ ID NO: 149878 - DNA, 20 bp, human
ggcgcccaccgccaacgcgg

SEQ ID NO: 149879 - DNA, 20 bp, human
gccgtccggacagagcgcgg

SEQ ID NO: 149880 - DNA, 20 bp, human
gtgtcacctggagatcacgg

SEQ ID NO: 149881 - DNA, 20 bp, human
gcgtccgtccggacagagcg

SEQ ID NO: 149882 - DNA, 20 bp, human
gggtggcagcggcagacgtg

SEQ ID NO: 149883 - DNA, 20 bp, human
gtcacggagggaaggtgcgt

SEQ ID NO: 149884 - DNA, 20 bp, human
gtcgggcgcgccggtggcag

SEQ ID NO: 149885 - DNA, 20 bp, human
gaggctgaggagggacgcgg

SEQ ID NO: 149886 - DNA, 20 bp, human
gctgcgggccggtgaagata

SEQ ID NO: 149887 - DNA, 20 bp, human
gcgggccggtgaagatatgg

SEQ ID NO: 149888 - DNA, 20 bp, human
ggacgccgccatatcttcac

SEQ ID NO: 149889 - DNA, 20 bp, human
gaggcctctggactagatcc

SEQ ID NO: 149890 - DNA, 20 bp, human
gggaggactggtaactttgg

SEQ ID NO: 149891 - DNA, 20 bp, human
gagaaggctgaggaaagcgt

SEQ ID NO: 149892 - DNA, 20 bp, human
gaaagggggccggaactgga

SEQ ID NO: 149893 - DNA, 20 bp, human
gatgcccttagggaagtcgg

SEQ ID NO: 149894 - DNA, 20 bp, human
gctctgggaaagctggactg

SEQ ID NO: 149895 - DNA, 20 bp, human
gaggctgaggaaagcgtcgg

SEQ ID NO: 149896 - DNA, 20 bp, human
gatcagccttcagcaggtga

SEQ ID NO: 149897 - DNA, 20 bp, human
ggtggcattacaggacaact

SEQ ID NO: 149898 - DNA, 20 bp, human
ggctgactcaggttccgcag

SEQ ID NO: 149899 - DNA, 20 bp, human
ggtcgccagggacctcgact

SEQ ID NO: 149900 - DNA, 20 bp, human
gctgaaggctgatgaagtat

SEQ ID NO: 149901 - DNA, 20 bp, human
gatatgtgctgggtcgccac

SEQ ID NO: 149902 - DNA, 20 bp, human
gcatatgtgagaagattcca

SEQ ID NO: 149903 - DNA, 20 bp, human
gcgtggtcagcccagatagt

SEQ ID NO: 149904 - DNA, 20 bp, human
gcaagcccagtcgaggtccc

SEQ ID NO: 149905 - DNA, 20 bp, human
gctggggccatggctgattg

SEQ ID NO: 149906 - DNA, 20 bp, human
ggcggcgcccagcggagtag

SEQ ID NO: 149907 - DNA, 20 bp, human
gccctttgcacacaagatgg

SEQ ID NO: 149908 - DNA, 20 bp, human
ggcgcagcccctactccgct

SEQ ID NO: 149909 - DNA, 20 bp, human
ggtcttggtagagggaaagg

SEQ ID NO: 149910 - DNA, 20 bp, human
gtaagacggaagtggagtct

SEQ ID NO: 149911 - DNA, 20 bp, human
ggtcagaccgggaggagacg

SEQ ID NO: 149912 - DNA, 20 bp, human
gttgcacccaaaaggggagt

SEQ ID NO: 149913 - DNA, 20 bp, human
ggaagtgggtaagacggaag

SEQ ID NO: 149914 - DNA, 20 bp, human
gggcgctttgcacccaaaag

SEQ ID NO: 149915 - DNA, 20 bp, human
gggtgccagtccaagagtcc

SEQ ID NO: 149916 - DNA, 20 bp, human
gaagtactaggagagagggt

SEQ ID NO: 149917 - DNA, 20 bp, human
gagccagttgccactaggag

SEQ ID NO: 149918 - DNA, 20 bp, human
gcaggggctgcccgagggag

SEQ ID NO: 149919 - DNA, 20 bp, human
gagggccaactggaagtcca

SEQ ID NO: 149920 - DNA, 20 bp, human
gctggctgggaatggctgag

SEQ ID NO: 149921 - DNA, 20 bp, human
gcaggaagtactaggagaga

SEQ ID NO: 149922 - DNA, 20 bp, human
ggcccccgctccagtctccg

SEQ ID NO: 149923 - DNA, 20 bp, human
gagatcagagcgagtgggag

SEQ ID NO: 149924 - DNA, 20 bp, human
gtggcaaagggggtattcag

SEQ ID NO: 149925 - DNA, 20 bp, human
gtgcccggaatccctcctca

SEQ ID NO: 149926 - DNA, 20 bp, human
gccgcgaacaccggaaccca

SEQ ID NO: 149927 - DNA, 20 bp, human
ggaggagtcgaggcacggag

SEQ ID NO: 149928 - DNA, 20 bp, human
gtaggaccggctgccatcag

SEQ ID NO: 149929 - DNA, 20 bp, human
gggtgttcgcggaggagtcg

SEQ ID NO: 149930 - DNA, 20 bp, human
gcaggaagcgcgcggtgacg

SEQ ID NO: 149931 - DNA, 20 bp, human
ggcgttgctacggcaacggt

SEQ ID NO: 149932 - DNA, 20 bp, human
ggcgaggtcgggtcccgtag

SEQ ID NO: 149933 - DNA, 20 bp, human
gcggcaacggtgggcggcca

SEQ ID NO: 149934 - DNA, 20 bp, human
ggcggaggcgggcgttgcta

SEQ ID NO: 149935 - DNA, 20 bp, human
gtcgcggaggagtcgaggca

SEQ ID NO: 149936 - DNA, 20 bp, human
ggaaggaggtcggcagtgtg

SEQ ID NO: 149937 - DNA, 20 bp, human
gcgacctccttccctctggg

SEQ ID NO: 149938 - DNA, 20 bp, human
ggccgcgcgccaagggaccg

SEQ ID NO: 149939 - DNA, 20 bp, human
ggccctgtgcgcctcctcgg

SEQ ID NO: 149940 - DNA, 20 bp, human
ggcctgaggcagagccgcca

SEQ ID NO: 149941 - DNA, 20 bp, human
gtgccgacctccttccctct

SEQ ID NO: 149942 - DNA, 20 bp, human
gggaggagctcgagagggtc

SEQ ID NO: 149943 - DNA, 20 bp, human
gcagggcccggcgcagagag

SEQ ID NO: 149944 - DNA, 20 bp, human
ggacgctcggtcgcctcccg

SEQ ID NO: 149945 - DNA, 20 bp, human
gcgcggtaatcaccgcccag

SEQ ID NO: 149946 - DNA, 20 bp, human
gcgacccggacccaagaagt

SEQ ID NO: 149947 - DNA, 20 bp, human
gggaaccccggctccaactt

SEQ ID NO: 149948 - DNA, 20 bp, human
ggggccgcgccaggaaacga

SEQ ID NO: 149949 - DNA, 20 bp, human
ggcagtgacagtgcctaagt

SEQ ID NO: 149950 - DNA, 20 bp, human
gctcctcacccccggaaccc

SEQ ID NO: 149951 - DNA, 20 bp, human
gggcgagcagtcacaatagg

SEQ ID NO: 149952 - DNA, 20 bp, human
ggagcagtcacaataggagg

SEQ ID NO: 149953 - DNA, 20 bp, human
ggcccagcgcgccagaccac

SEQ ID NO: 149954 - DNA, 20 bp, human
gcccgtgtgatggtgccggg

SEQ ID NO: 149955 - DNA, 20 bp, human
gctgggcgagcagtcacaat

SEQ ID NO: 149956 - DNA, 20 bp, human
gcgacccggacccaagaagt

SEQ ID NO: 149957 - DNA, 20 bp, human
ggggccgcgccaggaaacga

SEQ ID NO: 149958 - DNA, 20 bp, human
gccgggccgggcccctagtg

SEQ ID NO: 149959 - DNA, 20 bp, human
ggagtcgcctaacgcctcgg

SEQ ID NO: 149960 - DNA, 20 bp, human
gacagagtcgcctaacgcct

SEQ ID NO: 149961 - DNA, 20 bp, human
ggagcagtcacaataggagg

SEQ ID NO: 149962 - DNA, 20 bp, human
gggcgagcagtcacaatagg

SEQ ID NO: 149963 - DNA, 20 bp, human
ggtcccgcaacaccgcacta

SEQ ID NO: 149964 - DNA, 20 bp, human
ggcccagcgcgccagaccac

SEQ ID NO: 149965 - DNA, 20 bp, human
ggcacgactcggaccagttc

SEQ ID NO: 149966 - DNA, 20 bp, human
gtgaagagagaggcaatccc

SEQ ID NO: 149967 - DNA, 20 bp, human
gagagaggcaatcccaggag

SEQ ID NO: 149968 - DNA, 20 bp, human
gatgcgggagtcggagagaa

SEQ ID NO: 149969 - DNA, 20 bp, human
gggcaatcccaggagagggg

SEQ ID NO: 149970 - DNA, 20 bp, human
gcgccggcggagtcccccag

SEQ ID NO: 149971 - DNA, 20 bp, human
gcagccgcacattagacctc

SEQ ID NO: 149972 - DNA, 20 bp, human
gtcaggctgcggcggggaca

SEQ ID NO: 149973 - DNA, 20 bp, human
gcctcggcgtctccccgcac

SEQ ID NO: 149974 - DNA, 20 bp, human
gtctaatgtgcggctggcgg

SEQ ID NO: 149975 - DNA, 20 bp, human
gctccctataaagcctgatg

SEQ ID NO: 149976 - DNA, 20 bp, human
gttagggggaagacccgggc

SEQ ID NO: 149977 - DNA, 20 bp, human
gtttctcgaggagctctcct

SEQ ID NO: 149978 - DNA, 20 bp, human
ggctgttagggggaagaccc

SEQ ID NO: 149979 - DNA, 20 bp, human
gaggcctccgaagcggaagt

SEQ ID NO: 149980 - DNA, 20 bp, human
gccatggccgcggcccccca

SEQ ID NO: 149981 - DNA, 20 bp, human
gcggcggcgcgaacacacaa

SEQ ID NO: 149982 - DNA, 20 bp, human
gggcggcggcatctttctcg

SEQ ID NO: 149983 - DNA, 20 bp, human
gtgggttgctgttgaggcgg

SEQ ID NO: 149984 - DNA, 20 bp, human
gcaaggtcacttggaaagtc

SEQ ID NO: 149985 - DNA, 20 bp, human
gcggcgcgaacacacaaagg

SEQ ID NO: 149986 - DNA, 20 bp, human
gccggtgaaatccaagatgg

SEQ ID NO: 149987 - DNA, 20 bp, human
ggctaggctgaccctcctgc

SEQ ID NO: 149988 - DNA, 20 bp, human
gcgtccggtgaaatccaaga

SEQ ID NO: 149989 - DNA, 20 bp, human
gtgctggatcccgtcccccc

SEQ ID NO: 149990 - DNA, 20 bp, human
ggtgagggctctggcgccgg

SEQ ID NO: 149991 - DNA, 20 bp, human
gagccgccgcggccatgtct

SEQ ID NO: 149992 - DNA, 20 bp, human
gagtgacgcccagtgacgtc

SEQ ID NO: 149993 - DNA, 20 bp, human
gagacacagagcagagatgt

SEQ ID NO: 149994 - DNA, 20 bp, human
gctctggcgccgggggggac

SEQ ID NO: 149995 - DNA, 20 bp, human
gcgcggaccttgctaaactt

SEQ ID NO: 149996 - DNA, 20 bp, human
gaggctgggacccggcacca

SEQ ID NO: 149997 - DNA, 20 bp, human
gtcccagcctctcccgggaa

SEQ ID NO: 149998 - DNA, 20 bp, human
ggcctctcccgggaagggaa

SEQ ID NO: 149999 - DNA, 20 bp, human
gtgaggcggcgacgagtggt

SEQ ID NO: 150000 - DNA, 20 bp, human
gcggcaccagggcagtactg

SEQ ID NO: 150001 - DNA, 20 bp, human
gaccggcacctgcagaactg

SEQ ID NO: 150002 - DNA, 20 bp, human
gtcccttcccttcccgggag

SEQ ID NO: 150003 - DNA, 20 bp, human
ggaggaagggagcattccgg

SEQ ID NO: 150004 - DNA, 20 bp, human
ggcaaaggatccgtctgagg

SEQ ID NO: 150005 - DNA, 20 bp, human
gcgggttgcgtagcagcggt

SEQ ID NO: 150006 - DNA, 20 bp, human
gggcccactggaatccacgg

SEQ ID NO: 150007 - DNA, 20 bp, human
gtggttgcagagtaagaagg

SEQ ID NO: 150008 - DNA, 20 bp, human
gtcgggcccactggaatcca

SEQ ID NO: 150009 - DNA, 20 bp, human
gggcacctacctgtagtatg

SEQ ID NO: 150010 - DNA, 20 bp, human
gaggcagtatctctgaatca

SEQ ID NO: 150011 - DNA, 20 bp, human
gtggacttggaaagttcgga

SEQ ID NO: 150012 - DNA, 20 bp, human
ggtttggttgcagagtaaga

SEQ ID NO: 150013 - DNA, 20 bp, human
gagcgtgattgcagtcccag

SEQ ID NO: 150014 - DNA, 20 bp, human
gtcacccccgtggattccag

SEQ ID NO: 150015 - DNA, 20 bp, human
gagtatctctgaatcatgga

SEQ ID NO: 150016 - DNA, 20 bp, human
gatgggtctgacctctgacg

SEQ ID NO: 150017 - DNA, 20 bp, human
ggccgctctcgccccgtcag

SEQ ID NO: 150018 - DNA, 20 bp, human
ggcccgctgcaagcccgcag

SEQ ID NO: 150019 - DNA, 20 bp, human
gacctctgacggggcgagag

SEQ ID NO: 150020 - DNA, 20 bp, human
gggtgacgtcatctccggga

SEQ ID NO: 150021 - DNA, 20 bp, human
gagagccagcataaccactt

SEQ ID NO: 150022 - DNA, 20 bp, human
gtaaagatggggagacccca

SEQ ID NO: 150023 - DNA, 20 bp, human
gcagggtgggcaaaaccgat

SEQ ID NO: 150024 - DNA, 20 bp, human
ggaccacgcacgtgactagt

SEQ ID NO: 150025 - DNA, 20 bp, human
gggcgagtgattggctctca

SEQ ID NO: 150026 - DNA, 20 bp, human
gtgtgtgtggccacctgtac

SEQ ID NO: 150027 - DNA, 20 bp, human
gctgcccaacgatcgtgggc

SEQ ID NO: 150028 - DNA, 20 bp, human
gaagcctgcccaacgatcgt

SEQ ID NO: 150029 - DNA, 20 bp, human
gaacgatcgtgggcaggagg

SEQ ID NO: 150030 - DNA, 20 bp, human
gaggtggtttctggtttgtt

SEQ ID NO: 150031 - DNA, 20 bp, human
ggtataacggtcgagatctg

SEQ ID NO: 150032 - DNA, 20 bp, human
gcctgtactggtgagaatcg

SEQ ID NO: 150033 - DNA, 20 bp, human
gctgtggaaagaaaggtctt

SEQ ID NO: 150034 - DNA, 20 bp, human
gtcggagggcacgttcccat

SEQ ID NO: 150035 - DNA, 20 bp, human
gcccataggtgaagcccgac

SEQ ID NO: 150036 - DNA, 20 bp, human
gcgtggctgtcgggaaagaa

SEQ ID NO: 150037 - DNA, 20 bp, human
gctccccgccgccaagtggg

SEQ ID NO: 150038 - DNA, 20 bp, human
gccagctggaggggatactc

SEQ ID NO: 150039 - DNA, 20 bp, human
gagccacgccgcccacttgg

SEQ ID NO: 150040 - DNA, 20 bp, human
gcaggcaccctagctcccga

SEQ ID NO: 150041 - DNA, 20 bp, human
gcgttacttgaggctcggtt

SEQ ID NO: 150042 - DNA, 20 bp, human
gccagcggagcgcaataaga

SEQ ID NO: 150043 - DNA, 20 bp, human
gggctcggttgggaagaggt

SEQ ID NO: 150044 - DNA, 20 bp, human
gcacgccgcccacttggcgg

SEQ ID NO: 150045 - DNA, 20 bp, human
gcgactccccgccgccaagt

SEQ ID NO: 150046 - DNA, 20 bp, human
gggcgccgcggagccgacgg

SEQ ID NO: 150047 - DNA, 20 bp, human
gccgggtggttggtgttcta

SEQ ID NO: 150048 - DNA, 20 bp, human
gggaaggcggaaggctaggg

SEQ ID NO: 150049 - DNA, 20 bp, human
ggtctccgccgtcggctccg

SEQ ID NO: 150050 - DNA, 20 bp, human
gccccggcgccggaggaacg

SEQ ID NO: 150051 - DNA, 20 bp, human
ggacgttggcttggggaagg

SEQ ID NO: 150052 - DNA, 20 bp, human
ggtgttctagggagagagac

SEQ ID NO: 150053 - DNA, 20 bp, human
ggagagagacgggcaataaa

SEQ ID NO: 150054 - DNA, 20 bp, human
gaagccaacgtctccgccgt

SEQ ID NO: 150055 - DNA, 20 bp, human
ggcctccgggagccgacctc

SEQ ID NO: 150056 - DNA, 20 bp, human
gccgcgccggtggccggagc

SEQ ID NO: 150057 - DNA, 20 bp, human
gccggagctggtgcctgcgg

SEQ ID NO: 150058 - DNA, 20 bp, human
gagaggagcgaagtgtctgt

SEQ ID NO: 150059 - DNA, 20 bp, human
ggcagccagaacctaggtca

SEQ ID NO: 150060 - DNA, 20 bp, human
gcgagcggctgaagggtctg

SEQ ID NO: 150061 - DNA, 20 bp, human
gggagaaataggggccgagt

SEQ ID NO: 150062 - DNA, 20 bp, human
gccgagcgagaccctgacct

SEQ ID NO: 150063 - DNA, 20 bp, human
gtctggcgcgagcggctgaa

SEQ ID NO: 150064 - DNA, 20 bp, human
gcggctgaagggtctgcggt

SEQ ID NO: 150065 - DNA, 20 bp, human
gcgcagcgatcgcgagcgtg

SEQ ID NO: 150066 - DNA, 20 bp, human
gccgactgaagggctggagg

SEQ ID NO: 150067 - DNA, 20 bp, human
gagctcttctctcagcccgg

SEQ ID NO: 150068 - DNA, 20 bp, human
gtctctcagcccggcggcaa

SEQ ID NO: 150069 - DNA, 20 bp, human
ggctgagagaagagcttgcg

SEQ ID NO: 150070 - DNA, 20 bp, human
ggttgatggccccgactgaa

SEQ ID NO: 150071 - DNA, 20 bp, human
ggtgcagtcaccgtgtctgg

SEQ ID NO: 150072 - DNA, 20 bp, human
gcgcgcgcgtgagaacgtcc

SEQ ID NO: 150073 - DNA, 20 bp, human
gactcttccggaatctccga

SEQ ID NO: 150074 - DNA, 20 bp, human
ggcactcgaggctcggacgt

SEQ ID NO: 150075 - DNA, 20 bp, human
gaccgaggccccgacgccac

SEQ ID NO: 150076 - DNA, 20 bp, human
gaaacgctctgggactgcaa

SEQ ID NO: 150077 - DNA, 20 bp, human
gagtgggatgtacagagcag

SEQ ID NO: 150078 - DNA, 20 bp, human
gcggatgcttgtattggaag

SEQ ID NO: 150079 - DNA, 20 bp, human
gcccaggctgcgcgggtgat

SEQ ID NO: 150080 - DNA, 20 bp, human
gtgcaccgaaatgcactcag

SEQ ID NO: 150081 - DNA, 20 bp, human
ggctgcgcgggtgattggct

SEQ ID NO: 150082 - DNA, 20 bp, human
gtcgcctgcatcacttggac

SEQ ID NO: 150083 - DNA, 20 bp, human
gagcaggccgtacataattc

SEQ ID NO: 150084 - DNA, 20 bp, human
gtactttcggatgcttgtat

SEQ ID NO: 150085 - DNA, 20 bp, human
ggaggcttcggattctttgt

SEQ ID NO: 150086 - DNA, 20 bp, human
gggggacagttcagccaccg

SEQ ID NO: 150087 - DNA, 20 bp, human
ggacgttacccggatcggag

SEQ ID NO: 150088 - DNA, 20 bp, human
gccgatccgggtaacgtcag

SEQ ID NO: 150089 - DNA, 20 bp, human
gatccgggtaacgtcagggg

SEQ ID NO: 150090 - DNA, 20 bp, human
gttacccggatcggagaggt

SEQ ID NO: 150091 - DNA, 20 bp, human
ggggatggtcggcggatggg

SEQ ID NO: 150092 - DNA, 20 bp, human
gggtgaacgttggtgaggga

SEQ ID NO: 150093 - DNA, 20 bp, human
gatgggaacatgaacgggag

SEQ ID NO: 150094 - DNA, 20 bp, human
gtgtgcaccggaccacgggg

SEQ ID NO: 150095 - DNA, 20 bp, human
ggaggttggaattcagatta

SEQ ID NO: 150096 - DNA, 20 bp, human
gcgtagctcgctggaatcta

SEQ ID NO: 150097 - DNA, 20 bp, human
gcgcccgcgccgctgactgg

SEQ ID NO: 150098 - DNA, 20 bp, human
gaaccccacccgccagtcag

SEQ ID NO: 150099 - DNA, 20 bp, human
gtggaatctaaggcactaga

SEQ ID NO: 150100 - DNA, 20 bp, human
gagggcttgacggccacgtg

SEQ ID NO: 150101 - DNA, 20 bp, human
gctggcggagaagactcgaa

SEQ ID NO: 150102 - DNA, 20 bp, human
ggcgccgctgactggcgggt

SEQ ID NO: 150103 - DNA, 20 bp, human
gcgttctcgagccagcagaa

SEQ ID NO: 150104 - DNA, 20 bp, human
ggctggctcgagaacgaagt

SEQ ID NO: 150105 - DNA, 20 bp, human
gcgtgttcgagccggctcgt

SEQ ID NO: 150106 - DNA, 20 bp, human
gcgggaaaaggcccaagaag

SEQ ID NO: 150107 - DNA, 20 bp, human
gtggcgcaggtgctgatcgt

SEQ ID NO: 150108 - DNA, 20 bp, human
gcggcccgggctttctggaa

SEQ ID NO: 150109 - DNA, 20 bp, human
ggatccgcgctgagtctctg

SEQ ID NO: 150110 - DNA, 20 bp, human
gcaaggctgaggactcaggt

SEQ ID NO: 150111 - DNA, 20 bp, human
gtctggaaaggcggccgaac

SEQ ID NO: 150112 - DNA, 20 bp, human
gagtaccccgcgctctacag

SEQ ID NO: 150113 - DNA, 20 bp, human
gcaagaaggggcgagggtgg

SEQ ID NO: 150114 - DNA, 20 bp, human
gctgcacccaagaaagtcta

SEQ ID NO: 150115 - DNA, 20 bp, human
gaagagcgctagcgccggtt

SEQ ID NO: 150116 - DNA, 20 bp, human
gagtgtgacggctggaactc

SEQ ID NO: 150117 - DNA, 20 bp, human
gcgaagtgagcccatgtcag

SEQ ID NO: 150118 - DNA, 20 bp, human
gggcccgagaggacgcacag

SEQ ID NO: 150119 - DNA, 20 bp, human
gggccgcgctaatgacggag

SEQ ID NO: 150120 - DNA, 20 bp, human
gtaacaggccgcgctaatga

SEQ ID NO: 150121 - DNA, 20 bp, human
gcggcctgttactcaacctc

SEQ ID NO: 150122 - DNA, 20 bp, human
gggctcgcccagtctggagg

SEQ ID NO: 150123 - DNA, 20 bp, human
ggcggctccagcgtcctaag

SEQ ID NO: 150124 - DNA, 20 bp, human
gcctcagtcccaaggaaaat

SEQ ID NO: 150125 - DNA, 20 bp, human
gaggcaatagacccacgcgt

SEQ ID NO: 150126 - DNA, 20 bp, human
ggaccttgacgcgaggcgct

SEQ ID NO: 150127 - DNA, 20 bp, human
gggtcgcacgacaaacctcg

SEQ ID NO: 150128 - DNA, 20 bp, human
gactggaagaagtcctccat

SEQ ID NO: 150129 - DNA, 20 bp, human
gggcgctggtgagacccgcg

SEQ ID NO: 150130 - DNA, 20 bp, human
ggaagaagtcctccatcgga

SEQ ID NO: 150131 - DNA, 20 bp, human
ggaagtcctccatcggaagg

SEQ ID NO: 150132 - DNA, 20 bp, human
gctccatcggaaggaggtta

SEQ ID NO: 150133 - DNA, 20 bp, human
gaaaaaccagcgggctgtac

SEQ ID NO: 150134 - DNA, 20 bp, human
gcacgaaagcgcgccgtcgg

SEQ ID NO: 150135 - DNA, 20 bp, human
gccccgcaaggcaccatctg

SEQ ID NO: 150136 - DNA, 20 bp, human
gcgaccgaacccttctggtc

SEQ ID NO: 150137 - DNA, 20 bp, human
ggataaggggcgactggtaa

SEQ ID NO: 150138 - DNA, 20 bp, human
gcaaccttctttccctgaag

SEQ ID NO: 150139 - DNA, 20 bp, human
gaggaaccccagccacttca

SEQ ID NO: 150140 - DNA, 20 bp, human
ggtgcctgaccagaagggtt

SEQ ID NO: 150141 - DNA, 20 bp, human
ggaagggttcggtcgccccg

SEQ ID NO: 150142 - DNA, 20 bp, human
ggttgacgctcaaggacaag

SEQ ID NO: 150143 - DNA, 20 bp, human
gcgaggcggggaaagcgagg

SEQ ID NO: 150144 - DNA, 20 bp, human
ggaactgcgccaccgaaaag

SEQ ID NO: 150145 - DNA, 20 bp, human
ggtcatagcactgcagaaaa

SEQ ID NO: 150146 - DNA, 20 bp, human
gcgagcggcgagcattcccc

SEQ ID NO: 150147 - DNA, 20 bp, human
gcggcccggccggtgagcaa

SEQ ID NO: 150148 - DNA, 20 bp, human
gcggggagtaggcccctcta

SEQ ID NO: 150149 - DNA, 20 bp, human
gcagcctgcgcggagtgcag

SEQ ID NO: 150150 - DNA, 20 bp, human
gcccgggtccctccccgacg

SEQ ID NO: 150151 - DNA, 20 bp, human
gggtccctccccgacgcggt

SEQ ID NO: 150152 - DNA, 20 bp, human
ggagacgcggaaggacggaa

SEQ ID NO: 150153 - DNA, 20 bp, human
gcagcgcaggtccaggaccg

SEQ ID NO: 150154 - DNA, 20 bp, human
ggaatgctcgccgctcgcca

SEQ ID NO: 150155 - DNA, 20 bp, human
ggctgcgtgtagaagctcac

SEQ ID NO: 150156 - DNA, 20 bp, human
gggcactaggtgaaatccat

SEQ ID NO: 150157 - DNA, 20 bp, human
gactaggtgaaatccatggg

SEQ ID NO: 150158 - DNA, 20 bp, human
gccgggggcggagaaggcga

SEQ ID NO: 150159 - DNA, 20 bp, human
gaaggcgcagggcgtctcgg

SEQ ID NO: 150160 - DNA, 20 bp, human
gaggtgaaatccatgggcgg

SEQ ID NO: 150161 - DNA, 20 bp, human
gtggacccgttcaccgacta

SEQ ID NO: 150162 - DNA, 20 bp, human
gaggccagcggacagcaggc

SEQ ID NO: 150163 - DNA, 20 bp, human
ggcgaaggcgcagggcgtct

SEQ ID NO: 150164 - DNA, 20 bp, human
ggtgagcgaggagccgtagt

SEQ ID NO: 150165 - DNA, 20 bp, human
gacggaaggcggctgagtgc

SEQ ID NO: 150166 - DNA, 20 bp, human
gcttgactctgacgtcagag

SEQ ID NO: 150167 - DNA, 20 bp, human
gcggcccggcgcctggacgg

SEQ ID NO: 150168 - DNA, 20 bp, human
gcggcgggaagatgtaagtt

SEQ ID NO: 150169 - DNA, 20 bp, human
ggacgtcagagtcaaggagc

SEQ ID NO: 150170 - DNA, 20 bp, human
ggtcatcgctgcgcgccggg

SEQ ID NO: 150171 - DNA, 20 bp, human
gtctgacgtcagagcggcgc

SEQ ID NO: 150172 - DNA, 20 bp, human
ggctgcccggcaggcccggc

SEQ ID NO: 150173 - DNA, 20 bp, human
gggcgtcctgccgggcctgc

SEQ ID NO: 150174 - DNA, 20 bp, human
gtacgtcatcgctgcgcgcc

SEQ ID NO: 150175 - DNA, 20 bp, human
gcccggcgggagggccccaa

SEQ ID NO: 150176 - DNA, 20 bp, human
gctgactgaggcatagacac

SEQ ID NO: 150177 - DNA, 20 bp, human
gggtcagcggcactgagatt

SEQ ID NO: 150178 - DNA, 20 bp, human
gcgaacaacggtgcggtcag

SEQ ID NO: 150179 - DNA, 20 bp, human
gcacatcacgaacaacggtg

SEQ ID NO: 150180 - DNA, 20 bp, human
ggcccccaagaagccaaaag

SEQ ID NO: 150181 - DNA, 20 bp, human
gagccgcagcctacctggaa

SEQ ID NO: 150182 - DNA, 20 bp, human
gcagagtgtccgttccaggt

SEQ ID NO: 150183 - DNA, 20 bp, human
gtggttgttggagtgcagaa

SEQ ID NO: 150184 - DNA, 20 bp, human
gtgcagccttgcgatcggga

SEQ ID NO: 150185 - DNA, 20 bp, human
gcagggctgcgtctgcacta

SEQ ID NO: 150186 - DNA, 20 bp, human
gttttatatgttcgggttga

SEQ ID NO: 150187 - DNA, 20 bp, human
gctacggagaaggaaaccgg

SEQ ID NO: 150188 - DNA, 20 bp, human
gaactcctacgtggtgaggg

SEQ ID NO: 150189 - DNA, 20 bp, human
gtccggacgtggagctgcta

SEQ ID NO: 150190 - DNA, 20 bp, human
ggagaatccgaactcctacg

SEQ ID NO: 150191 - DNA, 20 bp, human
gtggaaaccggagaggtgga

SEQ ID NO: 150192 - DNA, 20 bp, human
gggtggagaggtctcgaacg

SEQ ID NO: 150193 - DNA, 20 bp, human
gcgggggaaagaaaaccagt

SEQ ID NO: 150194 - DNA, 20 bp, human
ggaaatcaggacgattcggg

SEQ ID NO: 150195 - DNA, 20 bp, human
gttaacagagggtacttcaa

SEQ ID NO: 150196 - DNA, 20 bp, human
gggcggggcccgctgaaaga

SEQ ID NO: 150197 - DNA, 20 bp, human
gtaggcgtggacaagtatag

SEQ ID NO: 150198 - DNA, 20 bp, human
gcggcggggtctggatggaa

SEQ ID NO: 150199 - DNA, 20 bp, human
gctgagtgcgggaaggacac

SEQ ID NO: 150200 - DNA, 20 bp, human
gtccagagacgtcccttact

SEQ ID NO: 150201 - DNA, 20 bp, human
gtcctagtaagggacgtctc

SEQ ID NO: 150202 - DNA, 20 bp, human
gcggggtctggatggaaagg

SEQ ID NO: 150203 - DNA, 20 bp, human
ggttctgctacttcctagta

SEQ ID NO: 150204 - DNA, 20 bp, human
gcagcggggcggaagaagag

SEQ ID NO: 150205 - DNA, 20 bp, human
ggtgagagaagggcccgtcc

SEQ ID NO: 150206 - DNA, 20 bp, human
gtagggctgagagtagccat

SEQ ID NO: 150207 - DNA, 20 bp, human
ggtgctcgggacaaggacat

SEQ ID NO: 150208 - DNA, 20 bp, human
gaaagaacaagccagctagg

SEQ ID NO: 150209 - DNA, 20 bp, human
gtccatccaaggcctgctca

SEQ ID NO: 150210 - DNA, 20 bp, human
gagctggcttgttctttggg

SEQ ID NO: 150211 - DNA, 20 bp, human
ggccagcatgcacagcatcc

SEQ ID NO: 150212 - DNA, 20 bp, human
gtgctgctcctgctcatcat

SEQ ID NO: 150213 - DNA, 20 bp, human
gagctcacagtgaagaggga

SEQ ID NO: 150214 - DNA, 20 bp, human
gggccctctctcctcctagc

SEQ ID NO: 150215 - DNA, 20 bp, human
ggcccatgctcctccatcca

SEQ ID NO: 150216 - DNA, 20 bp, human
ggactccctccgggcaacaa

SEQ ID NO: 150217 - DNA, 20 bp, human
ggcggcggcgaatgcctggg

SEQ ID NO: 150218 - DNA, 20 bp, human
gccgggcccgctccgctcag

SEQ ID NO: 150219 - DNA, 20 bp, human
gccggggaaagggcgagtcg

SEQ ID NO: 150220 - DNA, 20 bp, human
gaaacaaacggagaccgccg

SEQ ID NO: 150221 - DNA, 20 bp, human
gtgaggagctgtgccagctg

SEQ ID NO: 150222 - DNA, 20 bp, human
ggctgctacggtgtccggtg

SEQ ID NO: 150223 - DNA, 20 bp, human
gcgtctacagcgcctctgag

SEQ ID NO: 150224 - DNA, 20 bp, human
gtccgtttgtttgaacagga

SEQ ID NO: 150225 - DNA, 20 bp, human
gcatgcgcagtctgccccgg

SEQ ID NO: 150226 - DNA, 20 bp, human
ggcgcgcggccggagacggg

SEQ ID NO: 150227 - DNA, 20 bp, human
gagctggctgagggactgca

SEQ ID NO: 150228 - DNA, 20 bp, human
gagcctgagtgcgggtccag

SEQ ID NO: 150229 - DNA, 20 bp, human
gtccggccgggactccaccc

SEQ ID NO: 150230 - DNA, 20 bp, human
gaggcggccggcggcgacca

SEQ ID NO: 150231 - DNA, 20 bp, human
gctccggcttcgggtctcca

SEQ ID NO: 150232 - DNA, 20 bp, human
gcaccgctggacccgcactc

SEQ ID NO: 150233 - DNA, 20 bp, human
gggagctagaggcaggcggt

SEQ ID NO: 150234 - DNA, 20 bp, human
ggccggagctggtggttcgg

SEQ ID NO: 150235 - DNA, 20 bp, human
ggagtgtgtgcgccgggagc

SEQ ID NO: 150236 - DNA, 20 bp, human
gcgccgagcgccctccccac

SEQ ID NO: 150237 - DNA, 20 bp, human
ggggccctgcctgaaagccg

SEQ ID NO: 150238 - DNA, 20 bp, human
gccgaggacagaaagattgg

SEQ ID NO: 150239 - DNA, 20 bp, human
gggtcggctcgagttcgcgg

SEQ ID NO: 150240 - DNA, 20 bp, human
gcgggaggaccggaggaccg

SEQ ID NO: 150241 - DNA, 20 bp, human
gcgcggcagccgcacactgt

SEQ ID NO: 150242 - DNA, 20 bp, human
ggacaggagcagcggccggt

SEQ ID NO: 150243 - DNA, 20 bp, human
gcaggggcgggtcccgacga

SEQ ID NO: 150244 - DNA, 20 bp, human
gagccctggaaccagactgg

SEQ ID NO: 150245 - DNA, 20 bp, human
gccgacgagggtgctagcaa

SEQ ID NO: 150246 - DNA, 20 bp, human
ggagtactgccgaggaacgt

SEQ ID NO: 150247 - DNA, 20 bp, human
ggaggcccggagtaacgcag

SEQ ID NO: 150248 - DNA, 20 bp, human
gggagtaccatggagtaccg

SEQ ID NO: 150249 - DNA, 20 bp, human
gagggcgaccggaggaactg

SEQ ID NO: 150250 - DNA, 20 bp, human
gtttcccccccggtactcca

SEQ ID NO: 150251 - DNA, 20 bp, human
gaggggcccggagttacgtg

SEQ ID NO: 150252 - DNA, 20 bp, human
gagtgcggcgcctctctctg

SEQ ID NO: 150253 - DNA, 20 bp, human
ggcaaagactgggagtacca

SEQ ID NO: 150254 - DNA, 20 bp, human
gagacccaagcaactaggga

SEQ ID NO: 150255 - DNA, 20 bp, human
ggtactcccagtctttgcgg

SEQ ID NO: 150256 - DNA, 20 bp, human
gcccgcgagcgaggtgaggt

SEQ ID NO: 150257 - DNA, 20 bp, human
gtcaggctccaggccgaatg

SEQ ID NO: 150258 - DNA, 20 bp, human
gggccggaacgcgaagaggg

SEQ ID NO: 150259 - DNA, 20 bp, human
gtctctcacggaaaacgacg

SEQ ID NO: 150260 - DNA, 20 bp, human
gcggtggccgtgggtcccta

SEQ ID NO: 150261 - DNA, 20 bp, human
gcaagggctcaggggaagta

SEQ ID NO: 150262 - DNA, 20 bp, human
ggcctacctcacctcgctcg

SEQ ID NO: 150263 - DNA, 20 bp, human
gcggggccggaacgcgaaga

SEQ ID NO: 150264 - DNA, 20 bp, human
gagagagggaagtcgaaaga

SEQ ID NO: 150265 - DNA, 20 bp, human
gcggccaccggcatctgcgg

SEQ ID NO: 150266 - DNA, 20 bp, human
ggggatataaaaatacctct

SEQ ID NO: 150267 - DNA, 20 bp, human
ggagcagtagaacctcggcg

SEQ ID NO: 150268 - DNA, 20 bp, human
gaaggagagcagtagaacct

SEQ ID NO: 150269 - DNA, 20 bp, human
gcggccgggggtgacagcag

SEQ ID NO: 150270 - DNA, 20 bp, human
gcagaggtgtggctcctcgg

SEQ ID NO: 150271 - DNA, 20 bp, human
gtacccggaggacagtggtt

SEQ ID NO: 150272 - DNA, 20 bp, human
gccggaggacagtggttggg

SEQ ID NO: 150273 - DNA, 20 bp, human
gggagaggctcagaatccag

SEQ ID NO: 150274 - DNA, 20 bp, human
ggaatcagagccctccaccg

SEQ ID NO: 150275 - DNA, 20 bp, human
gtgatgaaaaagcagaggtg

SEQ ID NO: 150276 - DNA, 20 bp, human
gcgagtcgctttgtgtaact

SEQ ID NO: 150277 - DNA, 20 bp, human
gtgctaagtggtcagctgac

SEQ ID NO: 150278 - DNA, 20 bp, human
gtgtctggacctgggataac

SEQ ID NO: 150279 - DNA, 20 bp, human
gcccttccccaaactgtgat

SEQ ID NO: 150280 - DNA, 20 bp, human
gttagctccccagttatccc

SEQ ID NO: 150281 - DNA, 20 bp, human
gtgtgattggcatcatatta

SEQ ID NO: 150282 - DNA, 20 bp, human
gtgtctctccagaaaagtgc

SEQ ID NO: 150283 - DNA, 20 bp, human
gatgatgccaatcacagttt

SEQ ID NO: 150284 - DNA, 20 bp, human
gaatcttcccttggggaaat

SEQ ID NO: 150285 - DNA, 20 bp, human
gaagtggtcagctgactggc

SEQ ID NO: 150286 - DNA, 20 bp, human
gtagggaactgcagggtcta

SEQ ID NO: 150287 - DNA, 20 bp, human
gctggcgctagggaactgca

SEQ ID NO: 150288 - DNA, 20 bp, human
gccgagcgcgtccgtagtgg

SEQ ID NO: 150289 - DNA, 20 bp, human
gataccgagcgcgtccgtag

SEQ ID NO: 150290 - DNA, 20 bp, human
ggtctagggtgttgtcggag

SEQ ID NO: 150291 - DNA, 20 bp, human
gggcgcgctgcgaggaagaa

SEQ ID NO: 150292 - DNA, 20 bp, human
gctagcgccagccgccacta

SEQ ID NO: 150293 - DNA, 20 bp, human
gtccgggaggagggctctct

SEQ ID NO: 150294 - DNA, 20 bp, human
gggatgtccggcagctccgg

SEQ ID NO: 150295 - DNA, 20 bp, human
gggaccaggctggtgaatcg

SEQ ID NO: 150296 - DNA, 20 bp, human
gggcgggcgcctcttacctt

SEQ ID NO: 150297 - DNA, 20 bp, human
gtcgcgctcgcggcatccag

SEQ ID NO: 150298 - DNA, 20 bp, human
gcgtcccggggctccctcgg

SEQ ID NO: 150299 - DNA, 20 bp, human
gtgacaagttgagcgagaga

SEQ ID NO: 150300 - DNA, 20 bp, human
gcgctgggctggagagttgg

SEQ ID NO: 150301 - DNA, 20 bp, human
gtccagaggcggccaggcgg

SEQ ID NO: 150302 - DNA, 20 bp, human
ggcgccggcgagccccgtgg

SEQ ID NO: 150303 - DNA, 20 bp, human
gtgccgtcccggggctccct

SEQ ID NO: 150304 - DNA, 20 bp, human
ggagcggcgggcgcgtcccg

SEQ ID NO: 150305 - DNA, 20 bp, human
gccgcgcgcagaacatccac

SEQ ID NO: 150306 - DNA, 20 bp, human
ggcagcggccgggagcatag

SEQ ID NO: 150307 - DNA, 20 bp, human
ggcggccgggagcatagtgg

SEQ ID NO: 150308 - DNA, 20 bp, human
ggcccatgctcctgaacgag

SEQ ID NO: 150309 - DNA, 20 bp, human
gtcggctccggccacggcaa

SEQ ID NO: 150310 - DNA, 20 bp, human
gcgcatccgggccggagaag

SEQ ID NO: 150311 - DNA, 20 bp, human
ggcccctcgttcaggagcat

SEQ ID NO: 150312 - DNA, 20 bp, human
gggagccgagcggcgcatcc

SEQ ID NO: 150313 - DNA, 20 bp, human
gccccagccagcccttgccg

SEQ ID NO: 150314 - DNA, 20 bp, human
ggagcatagtggcggcggaa

SEQ ID NO: 150315 - DNA, 20 bp, human
gcgccgctcggctccggcca

SEQ ID NO: 150316 - DNA, 20 bp, human
gttccagcaccagcagaggt

SEQ ID NO: 150317 - DNA, 20 bp, human
ggggagcgcgcggagtgtct

SEQ ID NO: 150318 - DNA, 20 bp, human
gagcgcgcggagtgtctggg

SEQ ID NO: 150319 - DNA, 20 bp, human
ggcgcccgaaaggggacaag

SEQ ID NO: 150320 - DNA, 20 bp, human
gtagctctgtctgcgcaccg

SEQ ID NO: 150321 - DNA, 20 bp, human
gcgggcaagcaaaagcgcga

SEQ ID NO: 150322 - DNA, 20 bp, human
gggcttgcgggagcagagtg

SEQ ID NO: 150323 - DNA, 20 bp, human
ggtgtgtgtgcgcccgaaag

SEQ ID NO: 150324 - DNA, 20 bp, human
gccgaaaggggacaagaggc

SEQ ID NO: 150325 - DNA, 20 bp, human
ggctcccgcaagccgagaac

SEQ ID NO: 150326 - DNA, 20 bp, human
gtgttcagttacagggagga

SEQ ID NO: 150327 - DNA, 20 bp, human
gtgacatctgtgcctgttag

SEQ ID NO: 150328 - DNA, 20 bp, human
ggccacggcgtccgcctaaa

SEQ ID NO: 150329 - DNA, 20 bp, human
gacattgtggatccgctaac

SEQ ID NO: 150330 - DNA, 20 bp, human
ggagaggggcttatacgcga

SEQ ID NO: 150331 - DNA, 20 bp, human
gtggagagagagcgctgaga

SEQ ID NO: 150332 - DNA, 20 bp, human
gatcaaaactgttaacatag

SEQ ID NO: 150333 - DNA, 20 bp, human
ggaaagaaaggcggtgtgga

SEQ ID NO: 150334 - DNA, 20 bp, human
gttttcactgttcagttaca

SEQ ID NO: 150335 - DNA, 20 bp, human
gactgttaacatagcggcgg

SEQ ID NO: 150336 - DNA, 20 bp, human
ggacagcaccgagcctcacg

SEQ ID NO: 150337 - DNA, 20 bp, human
gagaggagaaagccctgggt

SEQ ID NO: 150338 - DNA, 20 bp, human
gtctgtggggccctgtccat

SEQ ID NO: 150339 - DNA, 20 bp, human
gtggcagggagtgaaactgg

SEQ ID NO: 150340 - DNA, 20 bp, human
gccagcgaggggtcagaatg

SEQ ID NO: 150341 - DNA, 20 bp, human
gcagatctagacccagcgag

SEQ ID NO: 150342 - DNA, 20 bp, human
gggacaggccctcccaggtg

SEQ ID NO: 150343 - DNA, 20 bp, human
gggggggtaagcccacacct

SEQ ID NO: 150344 - DNA, 20 bp, human
gatgggcctcttaccccgtg

SEQ ID NO: 150345 - DNA, 20 bp, human
ggggtaagcccacacctggg

SEQ ID NO: 150346 - DNA, 20 bp, human
gccagtgcttctggactggg

SEQ ID NO: 150347 - DNA, 20 bp, human
gtaacattgggccaagtacg

SEQ ID NO: 150348 - DNA, 20 bp, human
gcccccagtgcttctggact

SEQ ID NO: 150349 - DNA, 20 bp, human
gtgtcgtcacccctctggaa

SEQ ID NO: 150350 - DNA, 20 bp, human
gtccaggagtggggtgcagc

SEQ ID NO: 150351 - DNA, 20 bp, human
ggaccctgtcgtcacccctc

SEQ ID NO: 150352 - DNA, 20 bp, human
gagatctgttgggagatggg

SEQ ID NO: 150353 - DNA, 20 bp, human
gtgtccttctcagcaggggg

SEQ ID NO: 150354 - DNA, 20 bp, human
gtggatacctcagatacttt

SEQ ID NO: 150355 - DNA, 20 bp, human
gtacacagctggtatctgat

SEQ ID NO: 150356 - DNA, 20 bp, human
gcaagctttcaagcattcaa

SEQ ID NO: 150357 - DNA, 20 bp, human
gatgagaagtggtggcaaca

SEQ ID NO: 150358 - DNA, 20 bp, human
gctgcaccacagaaatccat

SEQ ID NO: 150359 - DNA, 20 bp, human
gggctaagtattatttcaaa

SEQ ID NO: 150360 - DNA, 20 bp, human
gggagttttcttatgagaag

SEQ ID NO: 150361 - DNA, 20 bp, human
gttcttcatcacttcaccaa

SEQ ID NO: 150362 - DNA, 20 bp, human
ggtgactttatgggagtaaa

SEQ ID NO: 150363 - DNA, 20 bp, human
gggctgcctatggatttctg

SEQ ID NO: 150364 - DNA, 20 bp, human
gcaattggaggagtagctga

SEQ ID NO: 150365 - DNA, 20 bp, human
gtgttatgaaatagctctta

SEQ ID NO: 150366 - DNA, 20 bp, human
ggaaggttgctggcatagtt

SEQ ID NO: 150367 - DNA, 20 bp, human
gatacttcttatagacatct

SEQ ID NO: 150368 - DNA, 20 bp, human
gaatcaccagttattcactg

SEQ ID NO: 150369 - DNA, 20 bp, human
gagtttctttgcacgaaatg

SEQ ID NO: 150370 - DNA, 20 bp, human
gtaagggacgtttcaagttg

SEQ ID NO: 150371 - DNA, 20 bp, human
gttctcagtatgtccagcaa

SEQ ID NO: 150372 - DNA, 20 bp, human
gagaatggaacttcagtatc

SEQ ID NO: 150373 - DNA, 20 bp, human
gagcatattgtgaaggttgc

SEQ ID NO: 150374 - DNA, 20 bp, human
gtagctcaaataaatgtcac

SEQ ID NO: 150375 - DNA, 20 bp, human
ggactaccacagtgaataac

SEQ ID NO: 150376 - DNA, 20 bp, human
gccagtggctcagtccctct

SEQ ID NO: 150377 - DNA, 20 bp, human
gggtcagccagccacctgag

SEQ ID NO: 150378 - DNA, 20 bp, human
gccgaggactgtccggagga

SEQ ID NO: 150379 - DNA, 20 bp, human
gagtggccccgaggactgtc

SEQ ID NO: 150380 - DNA, 20 bp, human
gtctcccacctggacctgga

SEQ ID NO: 150381 - DNA, 20 bp, human
gaggactgtccggaggaggg

SEQ ID NO: 150382 - DNA, 20 bp, human
gagggctggccaccctcctc

SEQ ID NO: 150383 - DNA, 20 bp, human
gcctgaggccccagtccctt

SEQ ID NO: 150384 - DNA, 20 bp, human
gttgctcaccctccaggtcc

SEQ ID NO: 150385 - DNA, 20 bp, human
gggctgaccctgcgggacat

SEQ ID NO: 150386 - DNA, 20 bp, human
gctccgcgggctgggaccat

SEQ ID NO: 150387 - DNA, 20 bp, human
gcccagcccgcggagctcgt

SEQ ID NO: 150388 - DNA, 20 bp, human
gcgtggtagacagactcccc

SEQ ID NO: 150389 - DNA, 20 bp, human
gccacgacaacaaactccta

SEQ ID NO: 150390 - DNA, 20 bp, human
gtcgcggcccgagaacgagg

SEQ ID NO: 150391 - DNA, 20 bp, human
gttggccagctcactagctc

SEQ ID NO: 150392 - DNA, 20 bp, human
ggttgggtcggccccctcag

SEQ ID NO: 150393 - DNA, 20 bp, human
ggctggccaacgagctccgc

SEQ ID NO: 150394 - DNA, 20 bp, human
gcgctagagaggccgcccag

SEQ ID NO: 150395 - DNA, 20 bp, human
gcgggccgtaagggacctgg

SEQ ID NO: 150396 - DNA, 20 bp, human
ggcgtcgggccccaagtcag

SEQ ID NO: 150397 - DNA, 20 bp, human
ggattctgcttggtgccgag

SEQ ID NO: 150398 - DNA, 20 bp, human
ggccgctcgggcaacccccg

SEQ ID NO: 150399 - DNA, 20 bp, human
gtgaccgcggcgcccgacat

SEQ ID NO: 150400 - DNA, 20 bp, human
ggcctgggcgcgaggacgtg

SEQ ID NO: 150401 - DNA, 20 bp, human
gcagggagccaactgccgct

SEQ ID NO: 150402 - DNA, 20 bp, human
gtgacatgtcgtcccggcct

SEQ ID NO: 150403 - DNA, 20 bp, human
gctggagctagggaagcgca

SEQ ID NO: 150404 - DNA, 20 bp, human
gggtgcgggcgaccgatgtc

SEQ ID NO: 150405 - DNA, 20 bp, human
gcaggcgggctgctgcgggt

SEQ ID NO: 150406 - DNA, 20 bp, human
gggaagctggagctgttgcg

SEQ ID NO: 150407 - DNA, 20 bp, human
ggcgacgggggatgaacgcg

SEQ ID NO: 150408 - DNA, 20 bp, human
gtgcgcagcgcgcgggaccc

SEQ ID NO: 150409 - DNA, 20 bp, human
gtgagccgcgcgcacgtcgg

SEQ ID NO: 150410 - DNA, 20 bp, human
ggcggtgcgcgcaacttctc

SEQ ID NO: 150411 - DNA, 20 bp, human
gcaccgccaagacttccccg

SEQ ID NO: 150412 - DNA, 20 bp, human
ggcctcgcggagtagagagg

SEQ ID NO: 150413 - DNA, 20 bp, human
gcgagcctcgcggagtagag

SEQ ID NO: 150414 - DNA, 20 bp, human
gccgcgcgctgcgcagttat

SEQ ID NO: 150415 - DNA, 20 bp, human
gatcaaagggatgactggag

SEQ ID NO: 150416 - DNA, 20 bp, human
gagccagagcggcgcagtgg

SEQ ID NO: 150417 - DNA, 20 bp, human
gcgctctggctacttttctc

SEQ ID NO: 150418 - DNA, 20 bp, human
gagtagccagagcggcgcag

SEQ ID NO: 150419 - DNA, 20 bp, human
gccgccggctcccccgtatg

SEQ ID NO: 150420 - DNA, 20 bp, human
gcaggtggattcgaaagcta

SEQ ID NO: 150421 - DNA, 20 bp, human
gatggcagctcctcatacgg

SEQ ID NO: 150422 - DNA, 20 bp, human
gagcggaaaaccacagaacg

SEQ ID NO: 150423 - DNA, 20 bp, human
gggcgagcctagggtccgag

SEQ ID NO: 150424 - DNA, 20 bp, human
gaggaaggttagggagactc

SEQ ID NO: 150425 - DNA, 20 bp, human
gggctacacgcagtccccgg

SEQ ID NO: 150426 - DNA, 20 bp, human
ggcgatcacaggattcccgg

SEQ ID NO: 150427 - DNA, 20 bp, human
ggaatcctgtgatcgcagaa

SEQ ID NO: 150428 - DNA, 20 bp, human
ggcggctggcgggaaaccca

SEQ ID NO: 150429 - DNA, 20 bp, human
ggaccccgcctggataacgg

SEQ ID NO: 150430 - DNA, 20 bp, human
ggtaagcacggctagaacgg

SEQ ID NO: 150431 - DNA, 20 bp, human
gcggctagaacggaggcgac

SEQ ID NO: 150432 - DNA, 20 bp, human
gtcgggggcgcagtgatcgg

SEQ ID NO: 150433 - DNA, 20 bp, human
gtacgtaagcacggctagaa

SEQ ID NO: 150434 - DNA, 20 bp, human
gtgcaaaataaaggagtcgg

SEQ ID NO: 150435 - DNA, 20 bp, human
gctgaaggtagatgtgggag

SEQ ID NO: 150436 - DNA, 20 bp, human
gctcaggctgaggagaaggt

SEQ ID NO: 150437 - DNA, 20 bp, human
gtcgtctggggctccacgga

SEQ ID NO: 150438 - DNA, 20 bp, human
gaccaatcgaggcccgacag

SEQ ID NO: 150439 - DNA, 20 bp, human
gtcgaggcccgacagtggtt

SEQ ID NO: 150440 - DNA, 20 bp, human
gatcgtgggggtaatcagag

SEQ ID NO: 150441 - DNA, 20 bp, human
gaggcttcgagctgtccgaa

SEQ ID NO: 150442 - DNA, 20 bp, human
ggagaactcaaagccgtccg

SEQ ID NO: 150443 - DNA, 20 bp, human
gctgctgatggagcgagtgg

SEQ ID NO: 150444 - DNA, 20 bp, human
gatgaccgcgaaaccaatcg

SEQ ID NO: 150445 - DNA, 20 bp, human
gcatatactccgactgacaa

SEQ ID NO: 150446 - DNA, 20 bp, human
ggctccctgtacaaactggt

SEQ ID NO: 150447 - DNA, 20 bp, human
gcggaggtggccaccgagag

SEQ ID NO: 150448 - DNA, 20 bp, human
ggagcccaccagtttgtaca

SEQ ID NO: 150449 - DNA, 20 bp, human
gtgtgcgcgcctccagggaa

SEQ ID NO: 150450 - DNA, 20 bp, human
ggcgcgcacagacccctggg

SEQ ID NO: 150451 - DNA, 20 bp, human
gcggaaagtacacctcccag

SEQ ID NO: 150452 - DNA, 20 bp, human
gcggtcaccgggacgatcta

SEQ ID NO: 150453 - DNA, 20 bp, human
ggggtctgtgcgcgcctcca

SEQ ID NO: 150454 - DNA, 20 bp, human
ggacaaagtgcctctctcgg

SEQ ID NO: 150455 - DNA, 20 bp, human
gggagatggcggagtcgttg

SEQ ID NO: 150456 - DNA, 20 bp, human
gctggagcacgtaggtggcg

SEQ ID NO: 150457 - DNA, 20 bp, human
gagacaggcctggagcacgt

SEQ ID NO: 150458 - DNA, 20 bp, human
gcaggcctggagcacgtagg

SEQ ID NO: 150459 - DNA, 20 bp, human
gcgatctctgcggggcaaga

SEQ ID NO: 150460 - DNA, 20 bp, human
gggcggaaacgcgatctctg

SEQ ID NO: 150461 - DNA, 20 bp, human
gtagagttgggtggtccagg

SEQ ID NO: 150462 - DNA, 20 bp, human
gtcgggcacggcccttcaac

SEQ ID NO: 150463 - DNA, 20 bp, human
gggaagctggaatctggcgg

SEQ ID NO: 150464 - DNA, 20 bp, human
gcccttaccgctcaggtcaa

SEQ ID NO: 150465 - DNA, 20 bp, human
gggcacggcccttcaacggg

SEQ ID NO: 150466 - DNA, 20 bp, human
ggggagagtagtctgccgga

SEQ ID NO: 150467 - DNA, 20 bp, human
gcccagcgaagtccgccatg

SEQ ID NO: 150468 - DNA, 20 bp, human
gggcagactactctccccca

SEQ ID NO: 150469 - DNA, 20 bp, human
gcaagtgactagggcagcgt

SEQ ID NO: 150470 - DNA, 20 bp, human
gccttgcggccggcagaaga

SEQ ID NO: 150471 - DNA, 20 bp, human
gagactactctcccccatgg

SEQ ID NO: 150472 - DNA, 20 bp, human
ggccggagcgtgtccccgtc

SEQ ID NO: 150473 - DNA, 20 bp, human
ggtttcggggcaagtgacta

SEQ ID NO: 150474 - DNA, 20 bp, human
gctggccttgaacctaggac

SEQ ID NO: 150475 - DNA, 20 bp, human
gcgcgtgcgggctgcatcag

SEQ ID NO: 150476 - DNA, 20 bp, human
gctcggcgtgagtcgctgcg

SEQ ID NO: 150477 - DNA, 20 bp, human
ggcagcgtaggagatccttg

SEQ ID NO: 150478 - DNA, 20 bp, human
gcgctgcggggctgacgggg

SEQ ID NO: 150479 - DNA, 20 bp, human
gagtcgctgcggggctgacg

SEQ ID NO: 150480 - DNA, 20 bp, human
gggatctcctacgctgctcc

SEQ ID NO: 150481 - DNA, 20 bp, human
ggcacacccacgccgcaagg

SEQ ID NO: 150482 - DNA, 20 bp, human
gtcccagggaccctgcgatg

SEQ ID NO: 150483 - DNA, 20 bp, human
ggtggcagtgcggcgggtta

SEQ ID NO: 150484 - DNA, 20 bp, human
ggccccatcgcagggtccct

SEQ ID NO: 150485 - DNA, 20 bp, human
gagtgcggcgggttacggcc

SEQ ID NO: 150486 - DNA, 20 bp, human
gtacccacgagtccccggca

SEQ ID NO: 150487 - DNA, 20 bp, human
gaagcccgaccggagcccgg

SEQ ID NO: 150488 - DNA, 20 bp, human
gctagagcgtcaccccgatt

SEQ ID NO: 150489 - DNA, 20 bp, human
ggcttccgggtcctaagtga

SEQ ID NO: 150490 - DNA, 20 bp, human
gcaagttacccacgagtccc

SEQ ID NO: 150491 - DNA, 20 bp, human
gttcagagtgaggcgctcgg

SEQ ID NO: 150492 - DNA, 20 bp, human
gtgaggcgctcggtggtaca

SEQ ID NO: 150493 - DNA, 20 bp, human
gagaccacacgttacgtggg

SEQ ID NO: 150494 - DNA, 20 bp, human
ggtgtggtcttccatcactt

SEQ ID NO: 150495 - DNA, 20 bp, human
gtccaacaagcagtcaataa

SEQ ID NO: 150496 - DNA, 20 bp, human
ggcagttggtgccagaactc

SEQ ID NO: 150497 - DNA, 20 bp, human
ggtctcccagagatacttac

SEQ ID NO: 150498 - DNA, 20 bp, human
gagaactctggatcctgaac

SEQ ID NO: 150499 - DNA, 20 bp, human
gaaatctcacagtaacataa

SEQ ID NO: 150500 - DNA, 20 bp, human
gcacacactaggaaatgact

SEQ ID NO: 150501 - DNA, 20 bp, human
gttcaggtccaaattatggg

SEQ ID NO: 150502 - DNA, 20 bp, human
gtctatccagtaagtatctc

SEQ ID NO: 150503 - DNA, 20 bp, human
ggataaatgtgctatttcaa

SEQ ID NO: 150504 - DNA, 20 bp, human
ggtttgtgtgacttagcccg

SEQ ID NO: 150505 - DNA, 20 bp, human
gatttatcatgaatccatga

SEQ ID NO: 150506 - DNA, 20 bp, human
ggcagcggaaggtacgcgag

SEQ ID NO: 150507 - DNA, 20 bp, human
gggaaggtacgcgagaggcg

SEQ ID NO: 150508 - DNA, 20 bp, human
gctgctgctgctcttatccc

SEQ ID NO: 150509 - DNA, 20 bp, human
gacctagagtctccaaacta

SEQ ID NO: 150510 - DNA, 20 bp, human
ggcagcctcctgaagttctt

SEQ ID NO: 150511 - DNA, 20 bp, human
ggctgccgaagaacttcagg

SEQ ID NO: 150512 - DNA, 20 bp, human
gtggctcctttgcttccgta

SEQ ID NO: 150513 - DNA, 20 bp, human
gaagaccatggcgaaagccg

SEQ ID NO: 150514 - DNA, 20 bp, human
ggtcgcggggcgcacatctg

SEQ ID NO: 150515 - DNA, 20 bp, human
gggtggaagattatcttgat

SEQ ID NO: 150516 - DNA, 20 bp, human
gacccgggctggtgatcgat

SEQ ID NO: 150517 - DNA, 20 bp, human
gtgcttgccaggagacagtg

SEQ ID NO: 150518 - DNA, 20 bp, human
ggcggtagcgatggacactc

SEQ ID NO: 150519 - DNA, 20 bp, human
gctcgcgctgaggaggaccc

SEQ ID NO: 150520 - DNA, 20 bp, human
gcctgcaactcttaaccagg

SEQ ID NO: 150521 - DNA, 20 bp, human
gcggcgcacgtaatcgccga

SEQ ID NO: 150522 - DNA, 20 bp, human
gatgagacagatggtatagt

SEQ ID NO: 150523 - DNA, 20 bp, human
gagggcacgtgcatgccccc

SEQ ID NO: 150524 - DNA, 20 bp, human
gcaagcagctcgcgctgagg

SEQ ID NO: 150525 - DNA, 20 bp, human
gacagatctgagtgacagtc

SEQ ID NO: 150526 - DNA, 20 bp, human
ggccaggaggctgtagagga

SEQ ID NO: 150527 - DNA, 20 bp, human
gttcgccatgcggaacttgg

SEQ ID NO: 150528 - DNA, 20 bp, human
gccctacagggccgatccgg

SEQ ID NO: 150529 - DNA, 20 bp, human
gcgcggttgtagttgatctc

SEQ ID NO: 150530 - DNA, 20 bp, human
gcagccgctacgggcaacgg

SEQ ID NO: 150531 - DNA, 20 bp, human
gctcatgccacgggcagtac

SEQ ID NO: 150532 - DNA, 20 bp, human
gcagctactccgcaccgacg

SEQ ID NO: 150533 - DNA, 20 bp, human
ggttccgcatggcgaaactc

SEQ ID NO: 150534 - DNA, 20 bp, human
gttcgcggcccgcgtcggtg

SEQ ID NO: 150535 - DNA, 20 bp, human
ggaggctgtagaggacggtt

SEQ ID NO: 150536 - DNA, 20 bp, human
gtgcaatacagctgggtgag

SEQ ID NO: 150537 - DNA, 20 bp, human
gcaagagaacactcagatcg

SEQ ID NO: 150538 - DNA, 20 bp, human
ggttcagattgcctgtcagg

SEQ ID NO: 150539 - DNA, 20 bp, human
ggttctcttgcaatacagct

SEQ ID NO: 150540 - DNA, 20 bp, human
gtctctggcaaatatctcta

SEQ ID NO: 150541 - DNA, 20 bp, human
gtcaggaggttgggaaattg

SEQ ID NO: 150542 - DNA, 20 bp, human
gtggactagtttgtttaaag

SEQ ID NO: 150543 - DNA, 20 bp, human
gctggttcagattgcctgtc

SEQ ID NO: 150544 - DNA, 20 bp, human
gtaatattttgtcctgactg

SEQ ID NO: 150545 - DNA, 20 bp, human
gcactctgcagagagatctc

SEQ ID NO: 150546 - DNA, 20 bp, human
gacagttatgaataaagcaa

SEQ ID NO: 150547 - DNA, 20 bp, human
gagggcagaaaaaaacatgt

SEQ ID NO: 150548 - DNA, 20 bp, human
gagaatgaggaactaggtcc

SEQ ID NO: 150549 - DNA, 20 bp, human
ggtaggactcaaaagttcca

SEQ ID NO: 150550 - DNA, 20 bp, human
gaggaaaaagtatacatgag

SEQ ID NO: 150551 - DNA, 20 bp, human
gtggagcaacgagctcatag

SEQ ID NO: 150552 - DNA, 20 bp, human
gaagaataggatcaagtgag

SEQ ID NO: 150553 - DNA, 20 bp, human
gaaaagtatacatgagaggt

SEQ ID NO: 150554 - DNA, 20 bp, human
gctcagatggataccccaag

SEQ ID NO: 150555 - DNA, 20 bp, human
ggaggggattaaagaaatga

SEQ ID NO: 150556 - DNA, 20 bp, human
gtagctagctgcagggccag

SEQ ID NO: 150557 - DNA, 20 bp, human
ggctgtcggcgctatagcaa

SEQ ID NO: 150558 - DNA, 20 bp, human
ggtgagtacccgggaggatg

SEQ ID NO: 150559 - DNA, 20 bp, human
gagtggcacggtgagtaccc

SEQ ID NO: 150560 - DNA, 20 bp, human
gggcacggtgagtacccggg

SEQ ID NO: 150561 - DNA, 20 bp, human
gagaccctaaacctcctgag

SEQ ID NO: 150562 - DNA, 20 bp, human
gtatagcgccgacagcgtgg

SEQ ID NO: 150563 - DNA, 20 bp, human
gccctggattaggagttggt

SEQ ID NO: 150564 - DNA, 20 bp, human
gcagccgcccgccacgctgt

SEQ ID NO: 150565 - DNA, 20 bp, human
ggaggagcacgggagaaaca

SEQ ID NO: 150566 - DNA, 20 bp, human
ggtcagtggacaagggacag

SEQ ID NO: 150567 - DNA, 20 bp, human
gtctacccggcagggaaggg

SEQ ID NO: 150568 - DNA, 20 bp, human
gtggcagccgcggcagaaac

SEQ ID NO: 150569 - DNA, 20 bp, human
gccagtgagtcagtggacaa

SEQ ID NO: 150570 - DNA, 20 bp, human
ggcagtagtggtggcagccg

SEQ ID NO: 150571 - DNA, 20 bp, human
gtgtgtgagcaagggaagcg

SEQ ID NO: 150572 - DNA, 20 bp, human
gctttctacccggcagggaa

SEQ ID NO: 150573 - DNA, 20 bp, human
gacttggtttaaaagctcag

SEQ ID NO: 150574 - DNA, 20 bp, human
gcaaagccctgtgtgagcaa

SEQ ID NO: 150575 - DNA, 20 bp, human
ggaaataccactgccagaag

SEQ ID NO: 150576 - DNA, 20 bp, human
gctcgggtcacccccgacaa

SEQ ID NO: 150577 - DNA, 20 bp, human
gacccagacaggccccacca

SEQ ID NO: 150578 - DNA, 20 bp, human
gcacacagaaagagcaacgg

SEQ ID NO: 150579 - DNA, 20 bp, human
ggaccacacagaaagagcaa

SEQ ID NO: 150580 - DNA, 20 bp, human
gtcacccccgacaacggtgg

SEQ ID NO: 150581 - DNA, 20 bp, human
gacacctaccgggaacagag

SEQ ID NO: 150582 - DNA, 20 bp, human
gcccgacaacggtggtggga

SEQ ID NO: 150583 - DNA, 20 bp, human
gagagcaacggaggcaccag

SEQ ID NO: 150584 - DNA, 20 bp, human
ggggtcacccccgacaacgg

SEQ ID NO: 150585 - DNA, 20 bp, human
gacccgaggtgttccagatg

SEQ ID NO: 150586 - DNA, 20 bp, human
ggtgcacagtctgggacccg

SEQ ID NO: 150587 - DNA, 20 bp, human
gggccaagacccgcccgtag

SEQ ID NO: 150588 - DNA, 20 bp, human
gcacagtctgggacccgtgg

SEQ ID NO: 150589 - DNA, 20 bp, human
ggctgtggagaaccacgtga

SEQ ID NO: 150590 - DNA, 20 bp, human
ggcgcgcctagctcctggca

SEQ ID NO: 150591 - DNA, 20 bp, human
gggaagaggggtctaaactc

SEQ ID NO: 150592 - DNA, 20 bp, human
ggagggtgctgaagggcccg

SEQ ID NO: 150593 - DNA, 20 bp, human
gccaggagctaggcgcgccc

SEQ ID NO: 150594 - DNA, 20 bp, human
ggcatcccgacgcctcgctc

SEQ ID NO: 150595 - DNA, 20 bp, human
gttcagcaccctctacgggc

SEQ ID NO: 150596 - DNA, 20 bp, human
gaggagcgcctctttccctt

SEQ ID NO: 150597 - DNA, 20 bp, human
gcgcctctttcccttcggtg

SEQ ID NO: 150598 - DNA, 20 bp, human
ggcctgcgcatggcttatat

SEQ ID NO: 150599 - DNA, 20 bp, human
ggcttactcaccacaccgaa

SEQ ID NO: 150600 - DNA, 20 bp, human
ggtgcgttgtcggacgtgaa

SEQ ID NO: 150601 - DNA, 20 bp, human
gagacagagaacgcacacaa

SEQ ID NO: 150602 - DNA, 20 bp, human
gggacacaggcagagatacg

SEQ ID NO: 150603 - DNA, 20 bp, human
ggaaaaagagagagtcggaa

SEQ ID NO: 150604 - DNA, 20 bp, human
gtatctagcgcccgaaaatg

SEQ ID NO: 150605 - DNA, 20 bp, human
ggccgctgaaaacaattgtg

SEQ ID NO: 150606 - DNA, 20 bp, human
ggagcctccctcttccaccg

SEQ ID NO: 150607 - DNA, 20 bp, human
ggcgcggatgaacgcggata

SEQ ID NO: 150608 - DNA, 20 bp, human
gtcaggaccaactcacctca

SEQ ID NO: 150609 - DNA, 20 bp, human
gctgaaggcgcggatgaacg

SEQ ID NO: 150610 - DNA, 20 bp, human
gcgcggcgtgagaagccatg

SEQ ID NO: 150611 - DNA, 20 bp, human
gccgcgccgtgccccagggt

SEQ ID NO: 150612 - DNA, 20 bp, human
gcccaagccccggtggaaga

SEQ ID NO: 150613 - DNA, 20 bp, human
gctgcgggagagaagcgaca

SEQ ID NO: 150614 - DNA, 20 bp, human
gcaagtgagtgccgaccctg

SEQ ID NO: 150615 - DNA, 20 bp, human
gggacaccaagtagagcgac

SEQ ID NO: 150616 - DNA, 20 bp, human
gggcgacacagtaacgtcgg

SEQ ID NO: 150617 - DNA, 20 bp, human
gcatggcgacacagtaacgt

SEQ ID NO: 150618 - DNA, 20 bp, human
gcgagctggacggcgcccca

SEQ ID NO: 150619 - DNA, 20 bp, human
gccggtaacagcgagctgga

SEQ ID NO: 150620 - DNA, 20 bp, human
gcttggcatcaggaacccct

SEQ ID NO: 150621 - DNA, 20 bp, human
gaataccggtaacagcgagc

SEQ ID NO: 150622 - DNA, 20 bp, human
gccccagggtactgtagccc

SEQ ID NO: 150623 - DNA, 20 bp, human
gttgttggcacaaatacggg

SEQ ID NO: 150624 - DNA, 20 bp, human
gtcggcagaaacgagatttt

SEQ ID NO: 150625 - DNA, 20 bp, human
gcgcaccaagcttcagaacg

SEQ ID NO: 150626 - DNA, 20 bp, human
gcatggatggcgacggataa

SEQ ID NO: 150627 - DNA, 20 bp, human
gagtgctcagaagcacggtc

SEQ ID NO: 150628 - DNA, 20 bp, human
gggagccgctcctaaaacga

SEQ ID NO: 150629 - DNA, 20 bp, human
gtcggaagctgtctaaaggc

SEQ ID NO: 150630 - DNA, 20 bp, human
gatcatggcggtgagtagct

SEQ ID NO: 150631 - DNA, 20 bp, human
gcggttgctccgcttaggga

SEQ ID NO: 150632 - DNA, 20 bp, human
gggcctgccatggatggcga

SEQ ID NO: 150633 - DNA, 20 bp, human
gtaagcggagcaaccgacta

SEQ ID NO: 150634 - DNA, 20 bp, human
gggtgctaggaaaccttagt

SEQ ID NO: 150635 - DNA, 20 bp, human
gggctggcaccttccctaag

SEQ ID NO: 150636 - DNA, 20 bp, human
ggcaaagctttccccgtatg

SEQ ID NO: 150637 - DNA, 20 bp, human
ggcaacaccgggaaggtctc

SEQ ID NO: 150638 - DNA, 20 bp, human
ggcgcggacaagccagatat

SEQ ID NO: 150639 - DNA, 20 bp, human
ggcccgcacgccctagggta

SEQ ID NO: 150640 - DNA, 20 bp, human
gccgctcctccctcgggtgt

SEQ ID NO: 150641 - DNA, 20 bp, human
gagctgcccacacccgaggg

SEQ ID NO: 150642 - DNA, 20 bp, human
gtccgaaactcacaccgggg

SEQ ID NO: 150643 - DNA, 20 bp, human
ggcagctccgaaactcacac

SEQ ID NO: 150644 - DNA, 20 bp, human
gccggattcgggacgaccga

SEQ ID NO: 150645 - DNA, 20 bp, human
gtgggagcccgcacgcccta

SEQ ID NO: 150646 - DNA, 20 bp, human
gcctgcggctgcggacgaga

SEQ ID NO: 150647 - DNA, 20 bp, human
gccggccgcgcctagagccc

SEQ ID NO: 150648 - DNA, 20 bp, human
gccgcgggcacgagccccag

SEQ ID NO: 150649 - DNA, 20 bp, human
gcagccgagcggaaaggaag

SEQ ID NO: 150650 - DNA, 20 bp, human
gtttcctgcgcaggaggtga

SEQ ID NO: 150651 - DNA, 20 bp, human
gggcgctggatgatgcccaa

SEQ ID NO: 150652 - DNA, 20 bp, human
gagactgggtcctggccttt

SEQ ID NO: 150653 - DNA, 20 bp, human
gcaagccaaggcgcagccgc

SEQ ID NO: 150654 - DNA, 20 bp, human
gccaggccagcgctccgcga

SEQ ID NO: 150655 - DNA, 20 bp, human
gcagtctggagggttcgggg

SEQ ID NO: 150656 - DNA, 20 bp, human
gcctagggttggctacaatg

SEQ ID NO: 150657 - DNA, 20 bp, human
gtgcaggtatgggctccgcg

SEQ ID NO: 150658 - DNA, 20 bp, human
gctaggcctaaagagagccg

SEQ ID NO: 150659 - DNA, 20 bp, human
gaagtagcccgcgcactgag

SEQ ID NO: 150660 - DNA, 20 bp, human
ggtgtggccgggcggtctcg

SEQ ID NO: 150661 - DNA, 20 bp, human
gcatcgctgaggacacacaa

SEQ ID NO: 150662 - DNA, 20 bp, human
ggaatctgtaggaaatgccg

SEQ ID NO: 150663 - DNA, 20 bp, human
gcggccaagactctacccca

SEQ ID NO: 150664 - DNA, 20 bp, human
gtgggatccaggccggaatg

SEQ ID NO: 150665 - DNA, 20 bp, human
gctctctttaggcctagggt

SEQ ID NO: 150666 - DNA, 20 bp, human
gagctcaccttgtcgtaggg

SEQ ID NO: 150667 - DNA, 20 bp, human
gcatagctcaccttgtcgta

SEQ ID NO: 150668 - DNA, 20 bp, human
gatcccaccgccctacgaca

SEQ ID NO: 150669 - DNA, 20 bp, human
gggtctgcggatgtccctgt

SEQ ID NO: 150670 - DNA, 20 bp, human
ggagcccgggagggacagac

SEQ ID NO: 150671 - DNA, 20 bp, human
gggaatggcgacaatgccaa

SEQ ID NO: 150672 - DNA, 20 bp, human
gtgtggggcagcatacctgt

SEQ ID NO: 150673 - DNA, 20 bp, human
gcgcagaccatcgtgagata

SEQ ID NO: 150674 - DNA, 20 bp, human
gaggtaaggccgctgcctgt

SEQ ID NO: 150675 - DNA, 20 bp, human
gcgtctgaagcctacaagaa

SEQ ID NO: 150676 - DNA, 20 bp, human
gccagcggcgagtccgggaa

SEQ ID NO: 150677 - DNA, 20 bp, human
gaagggcgcgagtccgggaa

SEQ ID NO: 150678 - DNA, 20 bp, human
gagcggaggtggaggtcgag

SEQ ID NO: 150679 - DNA, 20 bp, human
gacagtaagactcaccatgt

SEQ ID NO: 150680 - DNA, 20 bp, human
gtcgcctaacgccgccaaca

SEQ ID NO: 150681 - DNA, 20 bp, human
gggtcgagcggcatggtcga

SEQ ID NO: 150682 - DNA, 20 bp, human
gcaggtccgcaaggcccaca

SEQ ID NO: 150683 - DNA, 20 bp, human
gcgcctcagcttcccagcgg

SEQ ID NO: 150684 - DNA, 20 bp, human
gcgagagccaggcgccaacc

SEQ ID NO: 150685 - DNA, 20 bp, human
gaggcccacacggcaggaca

SEQ ID NO: 150686 - DNA, 20 bp, human
gttgagcgaagatgtgatgg

SEQ ID NO: 150687 - DNA, 20 bp, human
gcatcaggtaggctgcgttg

SEQ ID NO: 150688 - DNA, 20 bp, human
gcagggtccccggacctgga

SEQ ID NO: 150689 - DNA, 20 bp, human
gtgaagaggaagacgatcaa

SEQ ID NO: 150690 - DNA, 20 bp, human
gagaggaagacgatcaaagg

SEQ ID NO: 150691 - DNA, 20 bp, human
gtccccaaggaggacctgaa

SEQ ID NO: 150692 - DNA, 20 bp, human
gggagcccaaaaggcattgt

SEQ ID NO: 150693 - DNA, 20 bp, human
ggcaggcggcgtccccaagg

SEQ ID NO: 150694 - DNA, 20 bp, human
ggacaaggcagcctaaagtg

SEQ ID NO: 150695 - DNA, 20 bp, human
ggagatgccgctgacatcac

SEQ ID NO: 150696 - DNA, 20 bp, human
gccccgggaggagaactcct

SEQ ID NO: 150697 - DNA, 20 bp, human
ggtccgcagagggacgtgat

SEQ ID NO: 150698 - DNA, 20 bp, human
gcaggagaaacactcacctc

SEQ ID NO: 150699 - DNA, 20 bp, human
gcggcgatggcaggaggatt

SEQ ID NO: 150700 - DNA, 20 bp, human
ggcccccgaagccaggatgg

SEQ ID NO: 150701 - DNA, 20 bp, human
gaagagtgttgcgtacagga

SEQ ID NO: 150702 - DNA, 20 bp, human
gggcgcccccgaagccagga

SEQ ID NO: 150703 - DNA, 20 bp, human
ggactaccgggctcctccac

SEQ ID NO: 150704 - DNA, 20 bp, human
gtgggccctcggagcaacgc

SEQ ID NO: 150705 - DNA, 20 bp, human
gccaggcggcccgcacccca

SEQ ID NO: 150706 - DNA, 20 bp, human
gcccttggtgggggaaagta

SEQ ID NO: 150707 - DNA, 20 bp, human
ggaaagtatggctgcgatga

SEQ ID NO: 150708 - DNA, 20 bp, human
ggtggaacatgaggaactgt

SEQ ID NO: 150709 - DNA, 20 bp, human
gtagtgtgcagatcaagatg

SEQ ID NO: 150710 - DNA, 20 bp, human
gtcaatgcctaaatataagg

SEQ ID NO: 150711 - DNA, 20 bp, human
ggaaagcaagcccttggtgg

SEQ ID NO: 150712 - DNA, 20 bp, human
gccacgaaatgtaagtggac

SEQ ID NO: 150713 - DNA, 20 bp, human
gattttcacggtaaatccaa

SEQ ID NO: 150714 - DNA, 20 bp, human
gcttatgccaagccccaagt

SEQ ID NO: 150715 - DNA, 20 bp, human
ggagcagccaccttatattt

SEQ ID NO: 150716 - DNA, 20 bp, human
gaggtccggaaagagagaac

SEQ ID NO: 150717 - DNA, 20 bp, human
gaccaagtggaggtactcgg

SEQ ID NO: 150718 - DNA, 20 bp, human
gcaaagcgagctcaccatga

SEQ ID NO: 150719 - DNA, 20 bp, human
gccctagcccaaaaccacgg

SEQ ID NO: 150720 - DNA, 20 bp, human
gaaaccacggcggatggcag

SEQ ID NO: 150721 - DNA, 20 bp, human
gctcggaggctgatatgact

SEQ ID NO: 150722 - DNA, 20 bp, human
gggatcgagagccgaataac

SEQ ID NO: 150723 - DNA, 20 bp, human
gttagtagatgaccaagtgg

SEQ ID NO: 150724 - DNA, 20 bp, human
gtgcccctagcccaaaacca

SEQ ID NO: 150725 - DNA, 20 bp, human
gatactggggacctactctg

SEQ ID NO: 150726 - DNA, 20 bp, human
ggcctcgggcacggtaaggc

SEQ ID NO: 150727 - DNA, 20 bp, human
gtgggtgcaacaagagaagg

SEQ ID NO: 150728 - DNA, 20 bp, human
ggtgaacggctgcgcgacag

SEQ ID NO: 150729 - DNA, 20 bp, human
gttctgcaacgtggacgtgg

SEQ ID NO: 150730 - DNA, 20 bp, human
gccaacatggcggccatcgt

SEQ ID NO: 150731 - DNA, 20 bp, human
gagcatagaggccctagccc

SEQ ID NO: 150732 - DNA, 20 bp, human
ggcgggtcttccggtagtga

SEQ ID NO: 150733 - DNA, 20 bp, human
gtggacgtgcggcattgaga

SEQ ID NO: 150734 - DNA, 20 bp, human
gctccacgcggctcccacga

SEQ ID NO: 150735 - DNA, 20 bp, human
gtgttgggtgcaacaagaga

SEQ ID NO: 150736 - DNA, 20 bp, human
gccagctcgccctcacctca

SEQ ID NO: 150737 - DNA, 20 bp, human
ggcccgggacgaaagtgctc

SEQ ID NO: 150738 - DNA, 20 bp, human
gggccgcagccatgaggtga

SEQ ID NO: 150739 - DNA, 20 bp, human
gtgtagggcaagcctagtgt

SEQ ID NO: 150740 - DNA, 20 bp, human
gggcctccgactgccgagag

SEQ ID NO: 150741 - DNA, 20 bp, human
gcacctctctcggcagtcgg

SEQ ID NO: 150742 - DNA, 20 bp, human
gccccttcgcagataatggg

SEQ ID NO: 150743 - DNA, 20 bp, human
gtgcggtgcggcaccagccg

SEQ ID NO: 150744 - DNA, 20 bp, human
ggagaggccaaaggagtgaa

SEQ ID NO: 150745 - DNA, 20 bp, human
gcgctgacgcgtgtcgacaa

SEQ ID NO: 150746 - DNA, 20 bp, human
ggccacgcgtaggccctacc

SEQ ID NO: 150747 - DNA, 20 bp, human
ggtaggccctacctggaaga

SEQ ID NO: 150748 - DNA, 20 bp, human
gctctgaggccacaaggtcg

SEQ ID NO: 150749 - DNA, 20 bp, human
ggcgcccgggagccacgcgt

SEQ ID NO: 150750 - DNA, 20 bp, human
gacactgaaaggagttagaa

SEQ ID NO: 150751 - DNA, 20 bp, human
gaacgacctctgaggccaca

SEQ ID NO: 150752 - DNA, 20 bp, human
gtgttgggtgaggacttaag

SEQ ID NO: 150753 - DNA, 20 bp, human
gtgggtggcccctctcacat

SEQ ID NO: 150754 - DNA, 20 bp, human
gtccaggtagggcctacgcg

SEQ ID NO: 150755 - DNA, 20 bp, human
gtgtcgaacacctagcgccc

SEQ ID NO: 150756 - DNA, 20 bp, human
gctaaccacaggagccatgg

SEQ ID NO: 150757 - DNA, 20 bp, human
ggcggagccatactaaccac

SEQ ID NO: 150758 - DNA, 20 bp, human
gctggagccgaggcctcacg

SEQ ID NO: 150759 - DNA, 20 bp, human
ggcagcggagttagaaaggg

SEQ ID NO: 150760 - DNA, 20 bp, human
gaacgggacctgctaccctg

SEQ ID NO: 150761 - DNA, 20 bp, human
gccgaatgcgcggctcccca

SEQ ID NO: 150762 - DNA, 20 bp, human
gagtccacggccaagactcg

SEQ ID NO: 150763 - DNA, 20 bp, human
gatggctcctgtggttagta

SEQ ID NO: 150764 - DNA, 20 bp, human
gaggctcgtgagggagatcc

SEQ ID NO: 150765 - DNA, 20 bp, human
gggacgaatccgcggaaggg

SEQ ID NO: 150766 - DNA, 20 bp, human
gcactgcgtggacctggaat

SEQ ID NO: 150767 - DNA, 20 bp, human
gtgctcggtgcgtctcgtcg

SEQ ID NO: 150768 - DNA, 20 bp, human
gttacgtgcagggctgcgag

SEQ ID NO: 150769 - DNA, 20 bp, human
ggagagccgggcacactgcg

SEQ ID NO: 150770 - DNA, 20 bp, human
ggcgctcggcccgcaggacg

SEQ ID NO: 150771 - DNA, 20 bp, human
gtcggtggagaacaagaggt

SEQ ID NO: 150772 - DNA, 20 bp, human
gcacgcgcagtgacacgcgg

SEQ ID NO: 150773 - DNA, 20 bp, human
gcgggcacactgcgtggacc

SEQ ID NO: 150774 - DNA, 20 bp, human
gtcgcggcttcgctgaccca

SEQ ID NO: 150775 - DNA, 20 bp, human
ggagcgccagagcccgaccg

SEQ ID NO: 150776 - DNA, 20 bp, human
ggtcggccgcgagagcagag

SEQ ID NO: 150777 - DNA, 20 bp, human
ggagtgagcgatgtcttggt

SEQ ID NO: 150778 - DNA, 20 bp, human
gcggtgagtgagcgatgtct

SEQ ID NO: 150779 - DNA, 20 bp, human
gggacacgcgggaaagaggg

SEQ ID NO: 150780 - DNA, 20 bp, human
gtcttggtgggagtgttgtg

SEQ ID NO: 150781 - DNA, 20 bp, human
gtcgcggccgactcgcaaga

SEQ ID NO: 150782 - DNA, 20 bp, human
gcagctgccatgaggtctag

SEQ ID NO: 150783 - DNA, 20 bp, human
gccgatggcctactctcgtc

SEQ ID NO: 150784 - DNA, 20 bp, human
gtgccactcagcactgggta

SEQ ID NO: 150785 - DNA, 20 bp, human
gccaactccactagacctca

SEQ ID NO: 150786 - DNA, 20 bp, human
gaagtcgattcaaaggacac

SEQ ID NO: 150787 - DNA, 20 bp, human
gcctggcagtgctctcgcgg

SEQ ID NO: 150788 - DNA, 20 bp, human
ggccactgcacgacagatgg

SEQ ID NO: 150789 - DNA, 20 bp, human
gaagatgtcgaagcgaggtg

SEQ ID NO: 150790 - DNA, 20 bp, human
gactgcacgacagatggtgg

SEQ ID NO: 150791 - DNA, 20 bp, human
gagcaagggttgagtcgtct

SEQ ID NO: 150792 - DNA, 20 bp, human
gactttccgtgagaatcggg

SEQ ID NO: 150793 - DNA, 20 bp, human
gtattcgcggagcgatctcg

SEQ ID NO: 150794 - DNA, 20 bp, human
ggaatagggctatcgtaatg

SEQ ID NO: 150795 - DNA, 20 bp, human
ggcagaggtcgcgcaaacca

SEQ ID NO: 150796 - DNA, 20 bp, human
gaaccacgctgcggagagag

SEQ ID NO: 150797 - DNA, 20 bp, human
gcgccgaaagcgaagaagga

SEQ ID NO: 150798 - DNA, 20 bp, human
gcacgctgcggagagagggg

SEQ ID NO: 150799 - DNA, 20 bp, human
ggacatggagctccaaccag

SEQ ID NO: 150800 - DNA, 20 bp, human
gccatcgcaaaaccacgctg

SEQ ID NO: 150801 - DNA, 20 bp, human
gcggcaggcatcatccgcca

SEQ ID NO: 150802 - DNA, 20 bp, human
gaggcatcatccgccaggga

SEQ ID NO: 150803 - DNA, 20 bp, human
gaatgtctggccctccctgg

SEQ ID NO: 150804 - DNA, 20 bp, human
gtctgcggcgcggcaatccc

SEQ ID NO: 150805 - DNA, 20 bp, human
gatccccggtaaaccagctg

SEQ ID NO: 150806 - DNA, 20 bp, human
ggtaagcggattgggaacca

SEQ ID NO: 150807 - DNA, 20 bp, human
gggtgtctacagccatgcca

SEQ ID NO: 150808 - DNA, 20 bp, human
gatgaagtaagcacgacccg

SEQ ID NO: 150809 - DNA, 20 bp, human
gccgaggatgtaagcggatt

SEQ ID NO: 150810 - DNA, 20 bp, human
gtcctcctcggagtacaaga

SEQ ID NO: 150811 - DNA, 20 bp, human
gcctcggagtacaagaaggt

SEQ ID NO: 150812 - DNA, 20 bp, human
gcatgccagggacgacagag

SEQ ID NO: 150813 - DNA, 20 bp, human
ggccaggtcggacatcagga

SEQ ID NO: 150814 - DNA, 20 bp, human
gttctgcccgaggatgtaag

SEQ ID NO: 150815 - DNA, 20 bp, human
ggtgagccaggtcggacatc

SEQ ID NO: 150816 - DNA, 20 bp, human
gccatcaccgaagcgggagc

SEQ ID NO: 150817 - DNA, 20 bp, human
gaccgaagcgggagcgggta

SEQ ID NO: 150818 - DNA, 20 bp, human
gctgggagtgaaggtaccag

SEQ ID NO: 150819 - DNA, 20 bp, human
gcaccatgcccaagaacgga

SEQ ID NO: 150820 - DNA, 20 bp, human
gcagcacccgggtctcggaa

SEQ ID NO: 150821 - DNA, 20 bp, human
gcgggccggagatggatgga

SEQ ID NO: 150822 - DNA, 20 bp, human
gaggtaccagcgggtctcct

SEQ ID NO: 150823 - DNA, 20 bp, human
gtctcctgggcggtctcctg

SEQ ID NO: 150824 - DNA, 20 bp, human
ggaagggagacactaggacc

SEQ ID NO: 150825 - DNA, 20 bp, human
gctcctggcggccagaagca

SEQ ID NO: 150826 - DNA, 20 bp, human
gctagtagccgggtgagtgg

SEQ ID NO: 150827 - DNA, 20 bp, human
gagggcagggtctcacgggg

SEQ ID NO: 150828 - DNA, 20 bp, human
gcagctagtagccgggtgag

SEQ ID NO: 150829 - DNA, 20 bp, human
gggtgaccctctacaaaggg

SEQ ID NO: 150830 - DNA, 20 bp, human
ggatagaaaaaagtagaggt

SEQ ID NO: 150831 - DNA, 20 bp, human
gtagaggtaggagggcgcgg

SEQ ID NO: 150832 - DNA, 20 bp, human
gcccaacaaaggctctacag

SEQ ID NO: 150833 - DNA, 20 bp, human
gtatctctgggactaaacgg

SEQ ID NO: 150834 - DNA, 20 bp, human
gggcgctcagtgggttacag

SEQ ID NO: 150835 - DNA, 20 bp, human
gcggagagagacggaatgaa

SEQ ID NO: 150836 - DNA, 20 bp, human
gtgccggtaagtagaagctt

SEQ ID NO: 150837 - DNA, 20 bp, human
gagggccgggtggttgctgc

SEQ ID NO: 150838 - DNA, 20 bp, human
ggcacggtcagggtgaacgt

SEQ ID NO: 150839 - DNA, 20 bp, human
gcttaccggcagcaaccacc

SEQ ID NO: 150840 - DNA, 20 bp, human
gcccaagccgcggatggcag

SEQ ID NO: 150841 - DNA, 20 bp, human
gcccggccctaccagcaaaa

SEQ ID NO: 150842 - DNA, 20 bp, human
gcctcgggcggccttgacca

SEQ ID NO: 150843 - DNA, 20 bp, human
gcgtagccgccagagaccta

SEQ ID NO: 150844 - DNA, 20 bp, human
gcgcaaagctgtcatcgtga

SEQ ID NO: 150845 - DNA, 20 bp, human
gaaggacgcagagtcccgcg

SEQ ID NO: 150846 - DNA, 20 bp, human
ggaaaccgtacaccgccacc

SEQ ID NO: 150847 - DNA, 20 bp, human
gcaccaggacactccgtgat

SEQ ID NO: 150848 - DNA, 20 bp, human
gtctgggctgccaacatggt

SEQ ID NO: 150849 - DNA, 20 bp, human
ggaaccgcgggcctaacaca

SEQ ID NO: 150850 - DNA, 20 bp, human
gttggcagcccagacgaaaa

SEQ ID NO: 150851 - DNA, 20 bp, human
ggcccaaggcccaccccgag

SEQ ID NO: 150852 - DNA, 20 bp, human
ggtagggagtggatgactag

SEQ ID NO: 150853 - DNA, 20 bp, human
gttcgtctgggctgccaaca

SEQ ID NO: 150854 - DNA, 20 bp, human
gcgatccgctcagggccgtg

SEQ ID NO: 150855 - DNA, 20 bp, human
gcgcgaggtatcggccacgg

SEQ ID NO: 150856 - DNA, 20 bp, human
gcggagatggcgaccacgcg

SEQ ID NO: 150857 - DNA, 20 bp, human
gagcgttcgtcttcctcgcg

SEQ ID NO: 150858 - DNA, 20 bp, human
gggcgacctgagacggaaag

SEQ ID NO: 150859 - DNA, 20 bp, human
gaggtcgccgctgcgaaggg

SEQ ID NO: 150860 - DNA, 20 bp, human
gggcgggactgagtgaccta

SEQ ID NO: 150861 - DNA, 20 bp, human
gcgctcacctcccttcgcag

SEQ ID NO: 150862 - DNA, 20 bp, human
gctcaggtcgccgctgcgaa

SEQ ID NO: 150863 - DNA, 20 bp, human
gggccacgctcggacagcag

SEQ ID NO: 150864 - DNA, 20 bp, human
gaggcggcgggaccgaattc

SEQ ID NO: 150865 - DNA, 20 bp, human
gactgagtgacctaaggcgg

SEQ ID NO: 150866 - DNA, 20 bp, human
ggccacccgtaagtcgcgga

SEQ ID NO: 150867 - DNA, 20 bp, human
ggatggcatcggatgccgcg

SEQ ID NO: 150868 - DNA, 20 bp, human
gcaacactcaccataagccg

SEQ ID NO: 150869 - DNA, 20 bp, human
gagtaagccgagactcgtgg

SEQ ID NO: 150870 - DNA, 20 bp, human
gcggtgcagcacgggaaata

SEQ ID NO: 150871 - DNA, 20 bp, human
gctcattctgaccagaatgg

SEQ ID NO: 150872 - DNA, 20 bp, human
gaccagaatggggggggcag

SEQ ID NO: 150873 - DNA, 20 bp, human
gtgcacctggaagacaaaag

SEQ ID NO: 150874 - DNA, 20 bp, human
gggagcaaaagctgcggggt

SEQ ID NO: 150875 - DNA, 20 bp, human
gctaggtcctaggaggggga

SEQ ID NO: 150876 - DNA, 20 bp, human
ggattcagccgtgccgacgc

SEQ ID NO: 150877 - DNA, 20 bp, human
gaaggccgaccggcctctac

SEQ ID NO: 150878 - DNA, 20 bp, human
ggacgccggtgacaatgaaa

SEQ ID NO: 150879 - DNA, 20 bp, human
ggcggacccgtaaggccgac

SEQ ID NO: 150880 - DNA, 20 bp, human
gcatcaaatcccgccggtag

SEQ ID NO: 150881 - DNA, 20 bp, human
gctgcaggtcggccagagag

SEQ ID NO: 150882 - DNA, 20 bp, human
gggccttcggagtgcaccag

SEQ ID NO: 150883 - DNA, 20 bp, human
ggtgatggtatgtgttgtaa

SEQ ID NO: 150884 - DNA, 20 bp, human
gggccagagagaggccgtaa

SEQ ID NO: 150885 - DNA, 20 bp, human
gagagagaggccgtaagggt

SEQ ID NO: 150886 - DNA, 20 bp, human
ggcccggaagacgattcacg

SEQ ID NO: 150887 - DNA, 20 bp, human
gagtgggctcctaccgaccg

SEQ ID NO: 150888 - DNA, 20 bp, human
ggcgctgcctaaacctcggt

SEQ ID NO: 150889 - DNA, 20 bp, human
gatggtggccgcaaagaaga

SEQ ID NO: 150890 - DNA, 20 bp, human
gggcagatgtgagcccacgg

SEQ ID NO: 150891 - DNA, 20 bp, human
ggcggctgctgttggtgagt

SEQ ID NO: 150892 - DNA, 20 bp, human
ggatggccggggaacgagaa

SEQ ID NO: 150893 - DNA, 20 bp, human
gggcatgctgtcacccccgt

SEQ ID NO: 150894 - DNA, 20 bp, human
gccccgcgctgcctaaacct

SEQ ID NO: 150895 - DNA, 20 bp, human
gtggagagatgtcttggcca

SEQ ID NO: 150896 - DNA, 20 bp, human
gcgcgggtgcgtgggccact

SEQ ID NO: 150897 - DNA, 20 bp, human
ggacgctgcagagtgagtat

SEQ ID NO: 150898 - DNA, 20 bp, human
ggctgcagagtgagtatggg

SEQ ID NO: 150899 - DNA, 20 bp, human
gagtatgggtggcggagtct

SEQ ID NO: 150900 - DNA, 20 bp, human
gcgggtcggaggcatctgag

SEQ ID NO: 150901 - DNA, 20 bp, human
gaggcatctgaggggcgcag

SEQ ID NO: 150902 - DNA, 20 bp, human
gcatctaaatgcaggcgaca

SEQ ID NO: 150903 - DNA, 20 bp, human
gagaaagtgaccaggcttag

SEQ ID NO: 150904 - DNA, 20 bp, human
ggcgggagccatctaaatgc

SEQ ID NO: 150905 - DNA, 20 bp, human
gcgcgtgagttcgagaccca

SEQ ID NO: 150906 - DNA, 20 bp, human
gacgcaaagccctatcaact

SEQ ID NO: 150907 - DNA, 20 bp, human
gaagggacggtggcgcgcaa

SEQ ID NO: 150908 - DNA, 20 bp, human
gggattaacacttaccgaga

SEQ ID NO: 150909 - DNA, 20 bp, human
gggcatgaacgaatacacgt

SEQ ID NO: 150910 - DNA, 20 bp, human
gaatacacgtgggccgacat

SEQ ID NO: 150911 - DNA, 20 bp, human
gggaaagacgagctgtaggt

SEQ ID NO: 150912 - DNA, 20 bp, human
gagactgcagcggaagaagc

SEQ ID NO: 150913 - DNA, 20 bp, human
gggggccgtgggacgaccag

SEQ ID NO: 150914 - DNA, 20 bp, human
gcaaagccctatcaactcgg

SEQ ID NO: 150915 - DNA, 20 bp, human
gtttccctgctaggacccag

SEQ ID NO: 150916 - DNA, 20 bp, human
gggtgagctgtggctactca

SEQ ID NO: 150917 - DNA, 20 bp, human
gaatgcagcaaagtcccggg

SEQ ID NO: 150918 - DNA, 20 bp, human
ggcgtccaaggcccatgtca

SEQ ID NO: 150919 - DNA, 20 bp, human
ggaggtgccaccaggaacaa

SEQ ID NO: 150920 - DNA, 20 bp, human
gggatggcagccgattggta

SEQ ID NO: 150921 - DNA, 20 bp, human
gtcctcggatggcagccgat

SEQ ID NO: 150922 - DNA, 20 bp, human
gaggcgtgctgtgaaaacgt

SEQ ID NO: 150923 - DNA, 20 bp, human
gagggtccggcgagttcggg

SEQ ID NO: 150924 - DNA, 20 bp, human
ggtgtccttagtctttggga

SEQ ID NO: 150925 - DNA, 20 bp, human
ggggacgttgtctgcaggta

SEQ ID NO: 150926 - DNA, 20 bp, human
ggcgcctcacagcgctcgga

SEQ ID NO: 150927 - DNA, 20 bp, human
ggccttgggcagagtaaccc

SEQ ID NO: 150928 - DNA, 20 bp, human
gtgcgcgcaggccaagatca

SEQ ID NO: 150929 - DNA, 20 bp, human
gtccgagggaaagaggaagt

SEQ ID NO: 150930 - DNA, 20 bp, human
gtgcgccggagccccaacca

SEQ ID NO: 150931 - DNA, 20 bp, human
gcgcccgctccgagggaaag

SEQ ID NO: 150932 - DNA, 20 bp, human
gggcgccgcgcagaatggtc

SEQ ID NO: 150933 - DNA, 20 bp, human
gtggtgagagctgcggaatc

SEQ ID NO: 150934 - DNA, 20 bp, human
gctcccggcgccaagcgaag

SEQ ID NO: 150935 - DNA, 20 bp, human
gggaaaccgaggcccaacgt

SEQ ID NO: 150936 - DNA, 20 bp, human
ggcgagtcgccggtgcgtat

SEQ ID NO: 150937 - DNA, 20 bp, human
gtggcggtaagagaaggacg

SEQ ID NO: 150938 - DNA, 20 bp, human
gccaagatggcggtaagaga

SEQ ID NO: 150939 - DNA, 20 bp, human
ggagtgttgcctactgataa

SEQ ID NO: 150940 - DNA, 20 bp, human
gcacaggaacaaacctactc

SEQ ID NO: 150941 - DNA, 20 bp, human
ggccgttctccgggtgtcag

SEQ ID NO: 150942 - DNA, 20 bp, human
gatcccacaaggccacgcgg

SEQ ID NO: 150943 - DNA, 20 bp, human
gaatttaactgggataaccc

SEQ ID NO: 150944 - DNA, 20 bp, human
gacaggatggaggagatgtt

SEQ ID NO: 150945 - DNA, 20 bp, human
gtcccctgacacccggagaa

SEQ ID NO: 150946 - DNA, 20 bp, human
gcggcggataccggcagtgc

SEQ ID NO: 150947 - DNA, 20 bp, human
ggatatcccggagttccgcg

SEQ ID NO: 150948 - DNA, 20 bp, human
gtcgggcgcagaactaaggg

SEQ ID NO: 150949 - DNA, 20 bp, human
gtggcgccgcgcggaactcc

SEQ ID NO: 150950 - DNA, 20 bp, human
ggcgttcgggcgcagaacta

SEQ ID NO: 150951 - DNA, 20 bp, human
ggggcttgaatggaagagat

SEQ ID NO: 150952 - DNA, 20 bp, human
gtccggatggcggcggatac

SEQ ID NO: 150953 - DNA, 20 bp, human
ggaactccgggatatctact

SEQ ID NO: 150954 - DNA, 20 bp, human
gccgggagtccggatggcgg

SEQ ID NO: 150955 - DNA, 20 bp, human
gcacggccatagggtagcgt

SEQ ID NO: 150956 - DNA, 20 bp, human
ggcgctcacgcaagcatggt

SEQ ID NO: 150957 - DNA, 20 bp, human
gcggaaagaaagaaaccgcg

SEQ ID NO: 150958 - DNA, 20 bp, human
gcccatgaggaagtgcgatc

SEQ ID NO: 150959 - DNA, 20 bp, human
ggctttagctgggtaaggta

SEQ ID NO: 150960 - DNA, 20 bp, human
gggccaggaattgaagtgat

SEQ ID NO: 150961 - DNA, 20 bp, human
ggaggcaaacggaagtatat

SEQ ID NO: 150962 - DNA, 20 bp, human
gtggtaggacttgctggtgg

SEQ ID NO: 150963 - DNA, 20 bp, human
gcatagcacgggcgacgaag

SEQ ID NO: 150964 - DNA, 20 bp, human
gcaggagcctggacccatcc

SEQ ID NO: 150965 - DNA, 20 bp, human
gctaaagggaccgggctacg

SEQ ID NO: 150966 - DNA, 20 bp, human
ggcgctcacgcaagcatggt

SEQ ID NO: 150967 - DNA, 20 bp, human
ggatcaaccctaaagggacc

SEQ ID NO: 150968 - DNA, 20 bp, human
gcccatgaggaagtgcgatc

SEQ ID NO: 150969 - DNA, 20 bp, human
ggctttagctgggtaaggta

SEQ ID NO: 150970 - DNA, 20 bp, human
gcggaaagaaagaaaccgcg

SEQ ID NO: 150971 - DNA, 20 bp, human
gggccaggaattgaagtgat

SEQ ID NO: 150972 - DNA, 20 bp, human
ggaggcaaacggaagtatat

SEQ ID NO: 150973 - DNA, 20 bp, human
gtggtaggacttgctggtgg

SEQ ID NO: 150974 - DNA, 20 bp, human
gcatagcacgggcgacgaag

SEQ ID NO: 150975 - DNA, 20 bp, human
gcaggagcctggacccatcc

SEQ ID NO: 150976 - DNA, 20 bp, human
ggctgcgaagggccaggtgt

SEQ ID NO: 150977 - DNA, 20 bp, human
gtctcggtaagctaagaacg

SEQ ID NO: 150978 - DNA, 20 bp, human
gcagctctagagaatggctg

SEQ ID NO: 150979 - DNA, 20 bp, human
gcgaaaggcgagagctgcga

SEQ ID NO: 150980 - DNA, 20 bp, human
ggagcaagggaggctcctat

SEQ ID NO: 150981 - DNA, 20 bp, human
gtacccaggattctgagcaa

SEQ ID NO: 150982 - DNA, 20 bp, human
gcacccgtcagcagcctcga

SEQ ID NO: 150983 - DNA, 20 bp, human
gaggctgtagcggctccaat

SEQ ID NO: 150984 - DNA, 20 bp, human
gagccctcgaggctgctgac

SEQ ID NO: 150985 - DNA, 20 bp, human
gcatggcggctatagaatcg

SEQ ID NO: 150986 - DNA, 20 bp, human
ggaggcacaaaggacgagga

SEQ ID NO: 150987 - DNA, 20 bp, human
gctcggccgcagaagcgaga

SEQ ID NO: 150988 - DNA, 20 bp, human
gcggccgagaccagaaagac

SEQ ID NO: 150989 - DNA, 20 bp, human
ggccggagtctgtaaagata

SEQ ID NO: 150990 - DNA, 20 bp, human
gcagagaggcacaaaggacg

SEQ ID NO: 150991 - DNA, 20 bp, human
gcgaggcaaaggacacaatg

SEQ ID NO: 150992 - DNA, 20 bp, human
gacggcgggataggtccccc

SEQ ID NO: 150993 - DNA, 20 bp, human
gcgggtagtggtctctgact

SEQ ID NO: 150994 - DNA, 20 bp, human
gtaacgtgaaatgcgggtag

SEQ ID NO: 150995 - DNA, 20 bp, human
gtctagcaccacaattacgg

SEQ ID NO: 150996 - DNA, 20 bp, human
ggcggcgacatggtgagtgt

SEQ ID NO: 150997 - DNA, 20 bp, human
gcctaggtccgagcccagaa

SEQ ID NO: 150998 - DNA, 20 bp, human
ggacctaggtcgcggcgaca

SEQ ID NO: 150999 - DNA, 20 bp, human
ggaagctccccaaggcggag

SEQ ID NO: 151000 - DNA, 20 bp, human
gggtgcgggagaagaaaaca

SEQ ID NO: 151001 - DNA, 20 bp, human
gcattgtcggaagctcccca

SEQ ID NO: 151002 - DNA, 20 bp, human
ggtggaggaacggtgtgtgg

SEQ ID NO: 151003 - DNA, 20 bp, human
gggagcgcgcggccagccct

SEQ ID NO: 151004 - DNA, 20 bp, human
gtggagacaggagagaacac

SEQ ID NO: 151005 - DNA, 20 bp, human
gtgtcggtcacacgtcagtg

SEQ ID NO: 151006 - DNA, 20 bp, human
ggtgtctctagggtgatacg

SEQ ID NO: 151007 - DNA, 20 bp, human
gaggaagcgggtgaacagag

SEQ ID NO: 151008 - DNA, 20 bp, human
gcttgctgtgagtgtctcta

SEQ ID NO: 151009 - DNA, 20 bp, human
gggtgatacgtgggtgagaa

SEQ ID NO: 151010 - DNA, 20 bp, human
gacctgcgggaaacagtcct

SEQ ID NO: 151011 - DNA, 20 bp, human
ggcctcccaaggatctcctg

SEQ ID NO: 151012 - DNA, 20 bp, human
gagggcgagagagcctccca

SEQ ID NO: 151013 - DNA, 20 bp, human
gtgggtgagaaaggtaatct

SEQ ID NO: 151014 - DNA, 20 bp, human
gctgctcacagcccgacgaa

SEQ ID NO: 151015 - DNA, 20 bp, human
gcactgccaggtgaaatctg

SEQ ID NO: 151016 - DNA, 20 bp, human
ggacttaccatggcgagcag

SEQ ID NO: 151017 - DNA, 20 bp, human
gggctcactagcttccctcc

SEQ ID NO: 151018 - DNA, 20 bp, human
gacgtggagggtaatcagga

SEQ ID NO: 151019 - DNA, 20 bp, human
ggaaatcgtggcctgactgt

SEQ ID NO: 151020 - DNA, 20 bp, human
gcgcaacgtggagggtaatc

SEQ ID NO: 151021 - DNA, 20 bp, human
ggtaatcaggagggtattgt

SEQ ID NO: 151022 - DNA, 20 bp, human
gtaagtccatcggcccccat

SEQ ID NO: 151023 - DNA, 20 bp, human
ggcggaagaacgagcttaga

SEQ ID NO: 151024 - DNA, 20 bp, human
gcttagaaggcgcttccgat

SEQ ID NO: 151025 - DNA, 20 bp, human
gagtcaggccacgatttcgg

SEQ ID NO: 151026 - DNA, 20 bp, human
ggcctccgaacgccaggtgg

SEQ ID NO: 151027 - DNA, 20 bp, human
ggcccccacctggcgttcgg

SEQ ID NO: 151028 - DNA, 20 bp, human
gagggcggcgtgagggtcac

SEQ ID NO: 151029 - DNA, 20 bp, human
gccagggcgccggtaagtaa

SEQ ID NO: 151030 - DNA, 20 bp, human
gcaaggcccctgcgacaagg

SEQ ID NO: 151031 - DNA, 20 bp, human
gcaccaaggcccctgcgaca

SEQ ID NO: 151032 - DNA, 20 bp, human
ggtccgcccaacgagcaggg

SEQ ID NO: 151033 - DNA, 20 bp, human
gctagcatccggggaaatcg

SEQ ID NO: 151034 - DNA, 20 bp, human
gcggaggcggttgcctcgct

SEQ ID NO: 151035 - DNA, 20 bp, human
gctcgcccccacctggcgtt

SEQ ID NO: 151036 - DNA, 20 bp, human
gctagccgccagaggtcgag

SEQ ID NO: 151037 - DNA, 20 bp, human
gctggtcccaccaaccatgg

SEQ ID NO: 151038 - DNA, 20 bp, human
gcctgccactcgacctctgg

SEQ ID NO: 151039 - DNA, 20 bp, human
gggccctgccactcgacctc

SEQ ID NO: 151040 - DNA, 20 bp, human
gcatggtggccgatccctga

SEQ ID NO: 151041 - DNA, 20 bp, human
gaccctggtcccaccaacca

SEQ ID NO: 151042 - DNA, 20 bp, human
gagggatcggccaccatggt

SEQ ID NO: 151043 - DNA, 20 bp, human
gacctggagaaatggactac

SEQ ID NO: 151044 - DNA, 20 bp, human
gcccctgtctgcctacagga

SEQ ID NO: 151045 - DNA, 20 bp, human
gcctcgccgctagccgccag

SEQ ID NO: 151046 - DNA, 20 bp, human
gactgggatgtgcggcgata

SEQ ID NO: 151047 - DNA, 20 bp, human
ggcaaggtggggcggtcaag

SEQ ID NO: 151048 - DNA, 20 bp, human
ggatacggcagccatcttag

SEQ ID NO: 151049 - DNA, 20 bp, human
ggaacttccactcaccatgg

SEQ ID NO: 151050 - DNA, 20 bp, human
gttactggccccgagatacg

SEQ ID NO: 151051 - DNA, 20 bp, human
gacgcgccgggaagcagtag

SEQ ID NO: 151052 - DNA, 20 bp, human
gggtgtggaactgggatgtg

SEQ ID NO: 151053 - DNA, 20 bp, human
ggccatcttagaggcaacgt

SEQ ID NO: 151054 - DNA, 20 bp, human
ggggaaggtgacatatacag

SEQ ID NO: 151055 - DNA, 20 bp, human
gtggtgagtggaagttctct

SEQ ID NO: 151056 - DNA, 20 bp, human
ggagttggcgagtagtagcg

SEQ ID NO: 151057 - DNA, 20 bp, human
ggtacacggaatcccaacgc

SEQ ID NO: 151058 - DNA, 20 bp, human
gagtagtagcgaggagacga

SEQ ID NO: 151059 - DNA, 20 bp, human
gtgccgaggtcagatgtcta

SEQ ID NO: 151060 - DNA, 20 bp, human
gagggtgcccaagagctggt

SEQ ID NO: 151061 - DNA, 20 bp, human
gggcgctaaggccgagagaa

SEQ ID NO: 151062 - DNA, 20 bp, human
ggatgtctatggattgtaca

SEQ ID NO: 151063 - DNA, 20 bp, human
gagggatgaagcttattagt

SEQ ID NO: 151064 - DNA, 20 bp, human
gagtagttcaggaggtatgg

SEQ ID NO: 151065 - DNA, 20 bp, human
gtaagtgctatgggtagaga

SEQ ID NO: 151066 - DNA, 20 bp, human
gttcccagcgtggccttaaa

SEQ ID NO: 151067 - DNA, 20 bp, human
gccgcccggtgcgcgaactt

SEQ ID NO: 151068 - DNA, 20 bp, human
ggcatccactcaccatcctg

SEQ ID NO: 151069 - DNA, 20 bp, human
gggaacgccagaatggaggg

SEQ ID NO: 151070 - DNA, 20 bp, human
ggtcgacctcagcctagctg

SEQ ID NO: 151071 - DNA, 20 bp, human
gtagctggggaacgccagaa

SEQ ID NO: 151072 - DNA, 20 bp, human
gcggtactcggaggtcgagt

SEQ ID NO: 151073 - DNA, 20 bp, human
gcgaagtactcggtactcgg

SEQ ID NO: 151074 - DNA, 20 bp, human
ggcgttccccagctaggctg

SEQ ID NO: 151075 - DNA, 20 bp, human
gactgccgtctagtgtgagg

SEQ ID NO: 151076 - DNA, 20 bp, human
gagagtggcgaagaaccgga

SEQ ID NO: 151077 - DNA, 20 bp, human
ggttcggatggcgaaggatt

SEQ ID NO: 151078 - DNA, 20 bp, human
gtcagtgcggaaccccaacg

SEQ ID NO: 151079 - DNA, 20 bp, human
ggaaccggagggagccacta

SEQ ID NO: 151080 - DNA, 20 bp, human
ggcctgtcgcagccacgttg

SEQ ID NO: 151081 - DNA, 20 bp, human
ggatgccctccaggttcgga

SEQ ID NO: 151082 - DNA, 20 bp, human
gcaagaggcgacttccggtc

SEQ ID NO: 151083 - DNA, 20 bp, human
gcaggctcagtgtcatcctc

SEQ ID NO: 151084 - DNA, 20 bp, human
ggtctcccagcgtccccgac

SEQ ID NO: 151085 - DNA, 20 bp, human
gggacccgtagcagactggt

SEQ ID NO: 151086 - DNA, 20 bp, human
ggatcctgattgaaccagag

SEQ ID NO: 151087 - DNA, 20 bp, human
gcctgattgaaccagagtgg

SEQ ID NO: 151088 - DNA, 20 bp, human
gactcactctacaccctcca

SEQ ID NO: 151089 - DNA, 20 bp, human
ggaatgtgtgtggaacccgt

SEQ ID NO: 151090 - DNA, 20 bp, human
gtagctgaaagactactgca

SEQ ID NO: 151091 - DNA, 20 bp, human
gatcccgggaacgagatgtc

SEQ ID NO: 151092 - DNA, 20 bp, human
gcgggaacgagatgtcgggt

SEQ ID NO: 151093 - DNA, 20 bp, human
gcagtggggacctgaggcta

SEQ ID NO: 151094 - DNA, 20 bp, human
gctgtaccaagcaccagcca

SEQ ID NO: 151095 - DNA, 20 bp, human
ggtgtagagtgagttgcttc

SEQ ID NO: 151096 - DNA, 20 bp, human
gtgagtgagctgtagttccg

SEQ ID NO: 151097 - DNA, 20 bp, human
gattagagccccacttggtg

SEQ ID NO: 151098 - DNA, 20 bp, human
ggaacctggctatagtgcca

SEQ ID NO: 151099 - DNA, 20 bp, human
gctgtggggccgcgactcag

SEQ ID NO: 151100 - DNA, 20 bp, human
gacagctcactcaccatctt

SEQ ID NO: 151101 - DNA, 20 bp, human
gcagaggagtcatgagtccg

SEQ ID NO: 151102 - DNA, 20 bp, human
ggcaagcccgagagacgcta

SEQ ID NO: 151103 - DNA, 20 bp, human
gggatggcagcggatacagc

SEQ ID NO: 151104 - DNA, 20 bp, human
gacaggctctagaagcaaca

SEQ ID NO: 151105 - DNA, 20 bp, human
gagcggatacagccggaacc

SEQ ID NO: 151106 - DNA, 20 bp, human
gcggagcaagagtgagtgtt

SEQ ID NO: 151107 - DNA, 20 bp, human
ggcggcgccgtagctaggag

SEQ ID NO: 151108 - DNA, 20 bp, human
ggacgccataggtgcattgt

SEQ ID NO: 151109 - DNA, 20 bp, human
gtggcgtccgctcctagcta

SEQ ID NO: 151110 - DNA, 20 bp, human
gtgggctctaggaatagaaa

SEQ ID NO: 151111 - DNA, 20 bp, human
gcacggccacagttcttcat

SEQ ID NO: 151112 - DNA, 20 bp, human
gatcacaagcggcctggctg

SEQ ID NO: 151113 - DNA, 20 bp, human
gcttggtggcggattcctgt

SEQ ID NO: 151114 - DNA, 20 bp, human
ggtgaggaggagtagcgctg

SEQ ID NO: 151115 - DNA, 20 bp, human
gaggaggagtagcgctgtgg

SEQ ID NO: 151116 - DNA, 20 bp, human
ggcggccgaaagaggaaaca

SEQ ID NO: 151117 - DNA, 20 bp, human
gtcaccagcgcggccgaaag

SEQ ID NO: 151118 - DNA, 20 bp, human
ggcctcacggaagaggatgg

SEQ ID NO: 151119 - DNA, 20 bp, human
ggccgcgctggtgaacaggt

SEQ ID NO: 151120 - DNA, 20 bp, human
gggatactgcccatgccgca

SEQ ID NO: 151121 - DNA, 20 bp, human
gcgcgcctcacggaagagga

SEQ ID NO: 151122 - DNA, 20 bp, human
gaacaggtaggtcatccttg

SEQ ID NO: 151123 - DNA, 20 bp, human
gtacatcaagggcatcgtca

SEQ ID NO: 151124 - DNA, 20 bp, human
gcaagggcatcgtcaaggtg

SEQ ID NO: 151125 - DNA, 20 bp, human
gcccatgccgcaaggccgca

SEQ ID NO: 151126 - DNA, 20 bp, human
ggatgtttctgtgctcgtgg

SEQ ID NO: 151127 - DNA, 20 bp, human
gctgcgtctactgcgaggta

SEQ ID NO: 151128 - DNA, 20 bp, human
gcctactggagactgccagg

SEQ ID NO: 151129 - DNA, 20 bp, human
gcgcccgcataggacttcca

SEQ ID NO: 151130 - DNA, 20 bp, human
ggccatcccggcaagactga

SEQ ID NO: 151131 - DNA, 20 bp, human
gcacagagctccactcctac

SEQ ID NO: 151132 - DNA, 20 bp, human
ggaggacgggagaccgacag

SEQ ID NO: 151133 - DNA, 20 bp, human
gctgtgctcgtgggggtact

SEQ ID NO: 151134 - DNA, 20 bp, human
gagacaagatgtcggaggac

SEQ ID NO: 151135 - DNA, 20 bp, human
gctttgctgcgtctactgcg

SEQ ID NO: 151136 - DNA, 20 bp, human
gggcagcggccgtcatctcg

SEQ ID NO: 151137 - DNA, 20 bp, human
ggctgagggtctactcacac

SEQ ID NO: 151138 - DNA, 20 bp, human
ggccggcgggaagcatggag

SEQ ID NO: 151139 - DNA, 20 bp, human
gctagttagatgggcgccag

SEQ ID NO: 151140 - DNA, 20 bp, human
ggcttcccgccggcgacccc

SEQ ID NO: 151141 - DNA, 20 bp, human
gccgcggtcccgggcctaag

SEQ ID NO: 151142 - DNA, 20 bp, human
gggggcaacatgaagagcag

SEQ ID NO: 151143 - DNA, 20 bp, human
gcgcccgccggccctgccta

SEQ ID NO: 151144 - DNA, 20 bp, human
gagcacacgaaccttccacg

SEQ ID NO: 151145 - DNA, 20 bp, human
gatcatcgtaagtgcagggt

SEQ ID NO: 151146 - DNA, 20 bp, human
gcacataagaggctgcgtat

SEQ ID NO: 151147 - DNA, 20 bp, human
gcggcggccgggctgcctgt

SEQ ID NO: 151148 - DNA, 20 bp, human
ggccgaaagtcaccgcccac

SEQ ID NO: 151149 - DNA, 20 bp, human
gtcagggtgcccaagcactg

SEQ ID NO: 151150 - DNA, 20 bp, human
gtgacagtcacggtgagtgc

SEQ ID NO: 151151 - DNA, 20 bp, human
ggtccgcgtggacacataag

SEQ ID NO: 151152 - DNA, 20 bp, human
gagagacgaggcacgggtca

SEQ ID NO: 151153 - DNA, 20 bp, human
gcctggagccgggaaccgca

SEQ ID NO: 151154 - DNA, 20 bp, human
gggcccgcacgtggtcccgg

SEQ ID NO: 151155 - DNA, 20 bp, human
gatagggcgggcgctcctcg

SEQ ID NO: 151156 - DNA, 20 bp, human
gctcctgccggcccatcccg

SEQ ID NO: 151157 - DNA, 20 bp, human
ggtgcgacctcggtggcgac

SEQ ID NO: 151158 - DNA, 20 bp, human
ggcgggcggagaggacgcga

SEQ ID NO: 151159 - DNA, 20 bp, human
gtccagcatgtggccggatc

SEQ ID NO: 151160 - DNA, 20 bp, human
ggaccggctcaacaaggtag

SEQ ID NO: 151161 - DNA, 20 bp, human
gactcacgcggcggcgtctg

SEQ ID NO: 151162 - DNA, 20 bp, human
gggcgacgtagcgcatcctg

SEQ ID NO: 151163 - DNA, 20 bp, human
gggtcaccacactcacgcgg

SEQ ID NO: 151164 - DNA, 20 bp, human
gagtctcacgcgtgcgacct

SEQ ID NO: 151165 - DNA, 20 bp, human
ggcagaagaatcgcctgtat

SEQ ID NO: 151166 - DNA, 20 bp, human
gtcatggaggcgccagccgc

SEQ ID NO: 151167 - DNA, 20 bp, human
ggcagtgcgccagggcgggt

SEQ ID NO: 151168 - DNA, 20 bp, human
gaggagcagaaacaagccgg

SEQ ID NO: 151169 - DNA, 20 bp, human
gctgctcttcccggtcatgg

SEQ ID NO: 151170 - DNA, 20 bp, human
gggcccaagtcccaagcaac

SEQ ID NO: 151171 - DNA, 20 bp, human
ggcactgctcttcccggtca

SEQ ID NO: 151172 - DNA, 20 bp, human
ggagggcgggcgcgcaccgg

SEQ ID NO: 151173 - DNA, 20 bp, human
gtgggcgtgcaggtgagtgt

SEQ ID NO: 151174 - DNA, 20 bp, human
gtggtcctggcgcacctggg

SEQ ID NO: 151175 - DNA, 20 bp, human
gcggggcacagggggtccgt

SEQ ID NO: 151176 - DNA, 20 bp, human
gcgggacctgctcggaggaa

SEQ ID NO: 151177 - DNA, 20 bp, human
gtccggcgggacctgctcgg

SEQ ID NO: 151178 - DNA, 20 bp, human
gggaatggcgccgccgggtg

SEQ ID NO: 151179 - DNA, 20 bp, human
gggatcgagggtccgaagga

SEQ ID NO: 151180 - DNA, 20 bp, human
gcagcccgcggctcggactc

SEQ ID NO: 151181 - DNA, 20 bp, human
gcccgcggctcggactccgg

SEQ ID NO: 151182 - DNA, 20 bp, human
gccacgcgcaactcctcacc

SEQ ID NO: 151183 - DNA, 20 bp, human
gccgagcggaagtcagcccg

SEQ ID NO: 151184 - DNA, 20 bp, human
ggactccggcgggacctgct

SEQ ID NO: 151185 - DNA, 20 bp, human
gaggagggctgcgagctggt

SEQ ID NO: 151186 - DNA, 20 bp, human
gctgcggccgagaccctacg

SEQ ID NO: 151187 - DNA, 20 bp, human
gagtccgacgaagagtgggt

SEQ ID NO: 151188 - DNA, 20 bp, human
ggtgcggtgttagccgagaa

SEQ ID NO: 151189 - DNA, 20 bp, human
gtcgccgcaaggacccgcca

SEQ ID NO: 151190 - DNA, 20 bp, human
gcctacgcggcgccgtacag

SEQ ID NO: 151191 - DNA, 20 bp, human
gtcagcgcccggggtcggag

SEQ ID NO: 151192 - DNA, 20 bp, human
gctgggcgtcacgcttcgtg

SEQ ID NO: 151193 - DNA, 20 bp, human
ggaacgtggccgagaggccc

SEQ ID NO: 151194 - DNA, 20 bp, human
gccagctgtggctgctgccg

SEQ ID NO: 151195 - DNA, 20 bp, human
gggctagtccgacgaagagt

SEQ ID NO: 151196 - DNA, 20 bp, human
gggaccgcgaggccttccag

SEQ ID NO: 151197 - DNA, 20 bp, human
ggacgtgagtgctccaacgg

SEQ ID NO: 151198 - DNA, 20 bp, human
gcaacggaggtggaagactg

SEQ ID NO: 151199 - DNA, 20 bp, human
gtcgcagactcacctggtac

SEQ ID NO: 151200 - DNA, 20 bp, human
ggtgaggcccgggacgagga

SEQ ID NO: 151201 - DNA, 20 bp, human
gaggcctcgcggtccttcac

SEQ ID NO: 151202 - DNA, 20 bp, human
gcccttgtcgcagactcacc

SEQ ID NO: 151203 - DNA, 20 bp, human
gtctgcgacaagggccccac

SEQ ID NO: 151204 - DNA, 20 bp, human
gagagacgtgagtgctccaa

SEQ ID NO: 151205 - DNA, 20 bp, human
gtgaagaggactctctgtcg

SEQ ID NO: 151206 - DNA, 20 bp, human
ggcgcccgctcgagagaagt

SEQ ID NO: 151207 - DNA, 20 bp, human
gccgagagcgctgagtagag

SEQ ID NO: 151208 - DNA, 20 bp, human
ggccggagcagcgcagacgc

SEQ ID NO: 151209 - DNA, 20 bp, human
gaggatctcggcgcacgtga

SEQ ID NO: 151210 - DNA, 20 bp, human
gaggcggcgcttgaggatct

SEQ ID NO: 151211 - DNA, 20 bp, human
gcgcgcgccatcgtcttcag

SEQ ID NO: 151212 - DNA, 20 bp, human
gcgtaaggtgcgctccgaag

SEQ ID NO: 151213 - DNA, 20 bp, human
gcggccccacttctctcgag

SEQ ID NO: 151214 - DNA, 20 bp, human
gccggagcgtacgcgaggtg

SEQ ID NO: 151215 - DNA, 20 bp, human
gggctgggacggcgcgatct

SEQ ID NO: 151216 - DNA, 20 bp, human
gctccggatcgtgcgtgagg

SEQ ID NO: 151217 - DNA, 20 bp, human
ggtgagagccggaaccgggc

SEQ ID NO: 151218 - DNA, 20 bp, human
gaggtcactcagaaactcgg

SEQ ID NO: 151219 - DNA, 20 bp, human
gaggcggcttcggtgagagc

SEQ ID NO: 151220 - DNA, 20 bp, human
gtggctccggatcgtgcgtg

SEQ ID NO: 151221 - DNA, 20 bp, human
gcaaggagcccaggataagg

SEQ ID NO: 151222 - DNA, 20 bp, human
gatcgtgcgtgaggcggctt

SEQ ID NO: 151223 - DNA, 20 bp, human
gccgcgcgccatcttggctc

SEQ ID NO: 151224 - DNA, 20 bp, human
ggggcagaggggcgctcgta

SEQ ID NO: 151225 - DNA, 20 bp, human
gccgggcccgcgcgccatct

SEQ ID NO: 151226 - DNA, 20 bp, human
gtcatgggacttcagcatgg

SEQ ID NO: 151227 - DNA, 20 bp, human
gatggcggtgtttgcagatt

SEQ ID NO: 151228 - DNA, 20 bp, human
gagccggagctggactccaa

SEQ ID NO: 151229 - DNA, 20 bp, human
gctgtcgtgagaatcaggaa

SEQ ID NO: 151230 - DNA, 20 bp, human
gcggtcatgggacttcagca

SEQ ID NO: 151231 - DNA, 20 bp, human
gcgagcgggttctgacctga

SEQ ID NO: 151232 - DNA, 20 bp, human
ggcgaagccggggcaactca

SEQ ID NO: 151233 - DNA, 20 bp, human
gtacccttggagtccagctc

SEQ ID NO: 151234 - DNA, 20 bp, human
ggggacatcccagagactct

SEQ ID NO: 151235 - DNA, 20 bp, human
ggggaactgaggcctaacga

SEQ ID NO: 151236 - DNA, 20 bp, human
gggcgcgcggggcccacgta

SEQ ID NO: 151237 - DNA, 20 bp, human
ggcccacctggaactcacga

SEQ ID NO: 151238 - DNA, 20 bp, human
gcgaatccgtggtcacctga

SEQ ID NO: 151239 - DNA, 20 bp, human
gcggcgctgcaatccagcag

SEQ ID NO: 151240 - DNA, 20 bp, human
gcacctgaaggcaacagcac

SEQ ID NO: 151241 - DNA, 20 bp, human
gccaggggcggcgtgcagtg

SEQ ID NO: 151242 - DNA, 20 bp, human
gactcacgatggcgaatccg

SEQ ID NO: 151243 - DNA, 20 bp, human
ggcccctggatcgagtacct

SEQ ID NO: 151244 - DNA, 20 bp, human
gctgggcggcccaaccggga

SEQ ID NO: 151245 - DNA, 20 bp, human
ggatcgggcccgggactctg

SEQ ID NO: 151246 - DNA, 20 bp, human
ggaggcgccgcggcacttac

SEQ ID NO: 151247 - DNA, 20 bp, human
ggtgccccgccagcggaggc

SEQ ID NO: 151248 - DNA, 20 bp, human
gcgaactgggagtgagtcca

SEQ ID NO: 151249 - DNA, 20 bp, human
gactgggagtgagtccaggg

SEQ ID NO: 151250 - DNA, 20 bp, human
gtggagggagctgttgtcag

SEQ ID NO: 151251 - DNA, 20 bp, human
gaccagggagttaggctgtg

SEQ ID NO: 151252 - DNA, 20 bp, human
gacgctgcgccggcttcggg

SEQ ID NO: 151253 - DNA, 20 bp, human
gaggttcagggccgggacca

SEQ ID NO: 151254 - DNA, 20 bp, human
gccgcggcgcctcccgaagc

SEQ ID NO: 151255 - DNA, 20 bp, human
ggactcactcccagttcggc

SEQ ID NO: 151256 - DNA, 20 bp, human
gcggccgtggtgagagcgtg

SEQ ID NO: 151257 - DNA, 20 bp, human
gcgggggcgctggagaaacg

SEQ ID NO: 151258 - DNA, 20 bp, human
ggggggcgaggccgcagcta

SEQ ID NO: 151259 - DNA, 20 bp, human
gccggtcttggatgaagcgg

SEQ ID NO: 151260 - DNA, 20 bp, human
gcccacgcggtggggccgag

SEQ ID NO: 151261 - DNA, 20 bp, human
gtcccgacgccgggaagccg

SEQ ID NO: 151262 - DNA, 20 bp, human
gccacgcttctgcaaagtct

SEQ ID NO: 151263 - DNA, 20 bp, human
ggctcccacacggtgacgat

SEQ ID NO: 151264 - DNA, 20 bp, human
gcggccgcaaaccagcaaga

SEQ ID NO: 151265 - DNA, 20 bp, human
ggggagcgggagctgcggaa

SEQ ID NO: 151266 - DNA, 20 bp, human
gaggtcgggtggccatcttg

SEQ ID NO: 151267 - DNA, 20 bp, human
gggcagggtgagaggtcggg

SEQ ID NO: 151268 - DNA, 20 bp, human
gtgggcgagaggacaatccg

SEQ ID NO: 151269 - DNA, 20 bp, human
gtcgggtggccatcttgtgg

SEQ ID NO: 151270 - DNA, 20 bp, human
ggcgcgggcggctgttactg

SEQ ID NO: 151271 - DNA, 20 bp, human
gaggggcctaggttgtatgt

SEQ ID NO: 151272 - DNA, 20 bp, human
gcaatccggggaccgtccag

SEQ ID NO: 151273 - DNA, 20 bp, human
gtgccaggggtgcgagaagg

SEQ ID NO: 151274 - DNA, 20 bp, human
gggcaagggccggagcagag

SEQ ID NO: 151275 - DNA, 20 bp, human
ggctctcgcggcagggtgag

SEQ ID NO: 151276 - DNA, 20 bp, human
gagtaaggcctcctcctcgt

SEQ ID NO: 151277 - DNA, 20 bp, human
ggctgctgctcctctggcgg

SEQ ID NO: 151278 - DNA, 20 bp, human
ggtgcaaaccgggaagatgg

SEQ ID NO: 151279 - DNA, 20 bp, human
gagcagcgcttgtgcaaacc

SEQ ID NO: 151280 - DNA, 20 bp, human
gcaaggtcacaacaattcaa

SEQ ID NO: 151281 - DNA, 20 bp, human
gctgcaattcaggacaatcc

SEQ ID NO: 151282 - DNA, 20 bp, human
gggggctctggagtcctcgt

SEQ ID NO: 151283 - DNA, 20 bp, human
gtcgtcggcctcttcggcag

SEQ ID NO: 151284 - DNA, 20 bp, human
gtccagagcccctgccgaag

SEQ ID NO: 151285 - DNA, 20 bp, human
gtcctcctcgtcggcctctt

SEQ ID NO: 151286 - DNA, 20 bp, human
gggcagagggcgggtcagta

SEQ ID NO: 151287 - DNA, 20 bp, human
gaaggaccggaggccgtcta

SEQ ID NO: 151288 - DNA, 20 bp, human
gaggccgtctaaggaggtgg

SEQ ID NO: 151289 - DNA, 20 bp, human
gccaccagggctggagcgga

SEQ ID NO: 151290 - DNA, 20 bp, human
gcggaggccgtctaaggagg

SEQ ID NO: 151291 - DNA, 20 bp, human
gcttcctcgtgaaggaccgg

SEQ ID NO: 151292 - DNA, 20 bp, human
gtgggccgtgggagtttccc

SEQ ID NO: 151293 - DNA, 20 bp, human
gcggcctccggtccttcacg

SEQ ID NO: 151294 - DNA, 20 bp, human
ggaccggaggccgtctaagg

SEQ ID NO: 151295 - DNA, 20 bp, human
gcgcagactagcgcgtgcga

SEQ ID NO: 151296 - DNA, 20 bp, human
gcggaggagcgagcaacagg

SEQ ID NO: 151297 - DNA, 20 bp, human
gaggcgcgcgaggaacccag

SEQ ID NO: 151298 - DNA, 20 bp, human
gtctcgggccgcctacccct

SEQ ID NO: 151299 - DNA, 20 bp, human
ggcgggaagcgaccgcccgg

SEQ ID NO: 151300 - DNA, 20 bp, human
gcgccacccgcgacacccac

SEQ ID NO: 151301 - DNA, 20 bp, human
ggcccggaggagcgagcaac

SEQ ID NO: 151302 - DNA, 20 bp, human
gctacccctgggcaccgggc

SEQ ID NO: 151303 - DNA, 20 bp, human
ggactgcgcgccgagacccc

SEQ ID NO: 151304 - DNA, 20 bp, human
gcctgggaaaccgcacccac

SEQ ID NO: 151305 - DNA, 20 bp, human
gcccacaggctgcgctcgtc

SEQ ID NO: 151306 - DNA, 20 bp, human
gggctgcagggtccggtacc

SEQ ID NO: 151307 - DNA, 20 bp, human
ggcggcagaccccaaaccaa

SEQ ID NO: 151308 - DNA, 20 bp, human
gagtggtaggtaggagacga

SEQ ID NO: 151309 - DNA, 20 bp, human
gtacgcagggaaggcccgga

SEQ ID NO: 151310 - DNA, 20 bp, human
gcaggcaaggaggcagtcgg

SEQ ID NO: 151311 - DNA, 20 bp, human
gatctcgcggctgtaccata

SEQ ID NO: 151312 - DNA, 20 bp, human
gtccggtaccggggctggaa

SEQ ID NO: 151313 - DNA, 20 bp, human
ggcccggaggggtaaagccc

SEQ ID NO: 151314 - DNA, 20 bp, human
gtaaagccccggcttcttga

SEQ ID NO: 151315 - DNA, 20 bp, human
gtcctttccagccccggtac

SEQ ID NO: 151316 - DNA, 20 bp, human
gggctgcagggtccggtacc

SEQ ID NO: 151317 - DNA, 20 bp, human
ggcggcagaccccaaaccaa

SEQ ID NO: 151318 - DNA, 20 bp, human
gagtggtaggtaggagacga

SEQ ID NO: 151319 - DNA, 20 bp, human
gtacgcagggaaggcccgga

SEQ ID NO: 151320 - DNA, 20 bp, human
gcaggcaaggaggcagtcgg

SEQ ID NO: 151321 - DNA, 20 bp, human
gatctcgcggctgtaccata

SEQ ID NO: 151322 - DNA, 20 bp, human
gtccggtaccggggctggaa

SEQ ID NO: 151323 - DNA, 20 bp, human
ggcccggaggggtaaagccc

SEQ ID NO: 151324 - DNA, 20 bp, human
gtaaagccccggcttcttga

SEQ ID NO: 151325 - DNA, 20 bp, human
gtcctttccagccccggtac

SEQ ID NO: 151326 - DNA, 20 bp, human
gacattcaggtgcggactcg

SEQ ID NO: 151327 - DNA, 20 bp, human
ggacgcgcccctgaaggcca

SEQ ID NO: 151328 - DNA, 20 bp, human
gggtccgccttggccttcag

SEQ ID NO: 151329 - DNA, 20 bp, human
ggactcggggttggatgcca

SEQ ID NO: 151330 - DNA, 20 bp, human
ggatggcggacattcaggtg

SEQ ID NO: 151331 - DNA, 20 bp, human
ggggctcctggcgttaatgg

SEQ ID NO: 151332 - DNA, 20 bp, human
gcctcgctgaaaggtgtcca

SEQ ID NO: 151333 - DNA, 20 bp, human
gtcaggtgcggactcggggt

SEQ ID NO: 151334 - DNA, 20 bp, human
gttcaggggcgcgtccggga

SEQ ID NO: 151335 - DNA, 20 bp, human
gggcactgtgaaggactgac

SEQ ID NO: 151336 - DNA, 20 bp, human
ggcttggggtaagttgagcg

SEQ ID NO: 151337 - DNA, 20 bp, human
gcacgcatgccggtatttaa

SEQ ID NO: 151338 - DNA, 20 bp, human
gtggggtaagttgagcgagg

SEQ ID NO: 151339 - DNA, 20 bp, human
gcaccgccatggccgaggaa

SEQ ID NO: 151340 - DNA, 20 bp, human
gctgagtgcaaggccttatg

SEQ ID NO: 151341 - DNA, 20 bp, human
gaagttgagcgaggcggcag

SEQ ID NO: 151342 - DNA, 20 bp, human
gaccggcatgcgtgcggatg

SEQ ID NO: 151343 - DNA, 20 bp, human
ggagctggcggaacaggact

SEQ ID NO: 151344 - DNA, 20 bp, human
ggcgcgactcggcggcggca

SEQ ID NO: 151345 - DNA, 20 bp, human
gccgaggaagggtgagccca

SEQ ID NO: 151346 - DNA, 20 bp, human
gatgctcccgggtgagctcg

SEQ ID NO: 151347 - DNA, 20 bp, human
gcgtgttgggtggcttcctg

SEQ ID NO: 151348 - DNA, 20 bp, human
ggaatggcgccgcagaacag

SEQ ID NO: 151349 - DNA, 20 bp, human
gtgatgccccgagctcaccc

SEQ ID NO: 151350 - DNA, 20 bp, human
gctgggacaggcccttcctg

SEQ ID NO: 151351 - DNA, 20 bp, human
gcccagcgcgctacttacag

SEQ ID NO: 151352 - DNA, 20 bp, human
ggttctgcggcgccattcct

SEQ ID NO: 151353 - DNA, 20 bp, human
gtgggaccggggagaatccg

SEQ ID NO: 151354 - DNA, 20 bp, human
gcaccccccgcccagcaatc

SEQ ID NO: 151355 - DNA, 20 bp, human
gtgagctcggggcatcaagc

SEQ ID NO: 151356 - DNA, 20 bp, human
gctggagacgacgtgcaggt

SEQ ID NO: 151357 - DNA, 20 bp, human
gcccgggcgcgacaatcggg

SEQ ID NO: 151358 - DNA, 20 bp, human
gacaatcggggggcatcctg

SEQ ID NO: 151359 - DNA, 20 bp, human
gaggcccgggcgcgacaatc

SEQ ID NO: 151360 - DNA, 20 bp, human
gcacaccggaaagagagagt

SEQ ID NO: 151361 - DNA, 20 bp, human
ggagacgacgtgcaggtagg

SEQ ID NO: 151362 - DNA, 20 bp, human
gatgatcactacaaacccat

SEQ ID NO: 151363 - DNA, 20 bp, human
ggagtctggagacgacgtgc

SEQ ID NO: 151364 - DNA, 20 bp, human
gggcttgggacgagagacgg

SEQ ID NO: 151365 - DNA, 20 bp, human
gtctcgtcccaagccccaca

SEQ ID NO: 151366 - DNA, 20 bp, human
gctgtccgggccttcatgtc

SEQ ID NO: 151367 - DNA, 20 bp, human
gaccaaagcgatctcttctg

SEQ ID NO: 151368 - DNA, 20 bp, human
gccgcgagacggtcagaggt

SEQ ID NO: 151369 - DNA, 20 bp, human
gggatggagccggataggcc

SEQ ID NO: 151370 - DNA, 20 bp, human
ggcccgatccgcgcccgcac

SEQ ID NO: 151371 - DNA, 20 bp, human
ggctggacatgtcctagtaa

SEQ ID NO: 151372 - DNA, 20 bp, human
ggcccccgcgagacggtcag

SEQ ID NO: 151373 - DNA, 20 bp, human
ggcgatctcttctgaggatc

SEQ ID NO: 151374 - DNA, 20 bp, human
gcgtctctgccgggcctatc

SEQ ID NO: 151375 - DNA, 20 bp, human
ggatggtgagtgttgcgatt

SEQ ID NO: 151376 - DNA, 20 bp, human
ggattgcaggatggcgccga

SEQ ID NO: 151377 - DNA, 20 bp, human
gatcccctgagtgcacagtc

SEQ ID NO: 151378 - DNA, 20 bp, human
gcggcccagaagatccaagt

SEQ ID NO: 151379 - DNA, 20 bp, human
gcaccggcgcggaaagatgg

SEQ ID NO: 151380 - DNA, 20 bp, human
ggatggcagacggatgaaat

SEQ ID NO: 151381 - DNA, 20 bp, human
ggccgcgctgggagcttggg

SEQ ID NO: 151382 - DNA, 20 bp, human
gactcaccggcgcggaaaga

SEQ ID NO: 151383 - DNA, 20 bp, human
gcccagcaaactgccaaccc

SEQ ID NO: 151384 - DNA, 20 bp, human
gggatggcgccgatggcaga

SEQ ID NO: 151385 - DNA, 20 bp, human
gcgcctagctgggcagtcga

SEQ ID NO: 151386 - DNA, 20 bp, human
gtcggtgggcaggaatctag

SEQ ID NO: 151387 - DNA, 20 bp, human
gaccggaaaaggaaagctag

SEQ ID NO: 151388 - DNA, 20 bp, human
ggccagacgccggatgggaa

SEQ ID NO: 151389 - DNA, 20 bp, human
gtgagtggatggaggactct

SEQ ID NO: 151390 - DNA, 20 bp, human
ggctggagccggagctcacg

SEQ ID NO: 151391 - DNA, 20 bp, human
gaggttgtctagtccacgct

SEQ ID NO: 151392 - DNA, 20 bp, human
gggggggctggcatcagcaa

SEQ ID NO: 151393 - DNA, 20 bp, human
ggggtctgggagaggtcggt

SEQ ID NO: 151394 - DNA, 20 bp, human
gacaggggccccgtgagctc

SEQ ID NO: 151395 - DNA, 20 bp, human
gggtgagccagacgccggat

SEQ ID NO: 151396 - DNA, 20 bp, human
gggcttaatgcggaagccgc

SEQ ID NO: 151397 - DNA, 20 bp, human
ggaaggcgcagagccctgtc

SEQ ID NO: 151398 - DNA, 20 bp, human
gcgctgtgtggctcccgagt

SEQ ID NO: 151399 - DNA, 20 bp, human
gagtaggctcagagcgaccg

SEQ ID NO: 151400 - DNA, 20 bp, human
gcggcccagggcctctctgt

SEQ ID NO: 151401 - DNA, 20 bp, human
gcccgctccactccgccagg

SEQ ID NO: 151402 - DNA, 20 bp, human
ggcgaagcctgttaaagctt

SEQ ID NO: 151403 - DNA, 20 bp, human
ggccccctggcggagtggag

SEQ ID NO: 151404 - DNA, 20 bp, human
gcgcggccctgcgggtggag

SEQ ID NO: 151405 - DNA, 20 bp, human
gcagagcgaccgtggccggg

SEQ ID NO: 151406 - DNA, 20 bp, human
gtccagcggcatcgcagctc

SEQ ID NO: 151407 - DNA, 20 bp, human
gaatccgtgccgtgatccag

SEQ ID NO: 151408 - DNA, 20 bp, human
gacggattccagtcttacca

SEQ ID NO: 151409 - DNA, 20 bp, human
gaccatggctgcagcacaag

SEQ ID NO: 151410 - DNA, 20 bp, human
gctgcgatgccgctggatca

SEQ ID NO: 151411 - DNA, 20 bp, human
ggttaagcctgtcacacaag

SEQ ID NO: 151412 - DNA, 20 bp, human
gtctgtggtgtgaaaaccta

SEQ ID NO: 151413 - DNA, 20 bp, human
gtcaaacagtaaggccgata

SEQ ID NO: 151414 - DNA, 20 bp, human
gcgaggaagggtcactgctc

SEQ ID NO: 151415 - DNA, 20 bp, human
gggagagcgggcccgaggaa

SEQ ID NO: 151416 - DNA, 20 bp, human
ggaggccgcacggtaagcgg

SEQ ID NO: 151417 - DNA, 20 bp, human
gggccgtgggaagtaacggg

SEQ ID NO: 151418 - DNA, 20 bp, human
gaccgagcgtgggccccggg

SEQ ID NO: 151419 - DNA, 20 bp, human
gcaggggaaagggaacgacg

SEQ ID NO: 151420 - DNA, 20 bp, human
gggagcccccgcttaccgtg

SEQ ID NO: 151421 - DNA, 20 bp, human
gtccagcgcatcctaaaccg

SEQ ID NO: 151422 - DNA, 20 bp, human
ggaagtaacggggggtacca

SEQ ID NO: 151423 - DNA, 20 bp, human
gccctcaggcacgcgctctg

SEQ ID NO: 151424 - DNA, 20 bp, human
ggcggaggccgcacggtaag

SEQ ID NO: 151425 - DNA, 20 bp, human
gcctcgcgcccggtccagct

SEQ ID NO: 151426 - DNA, 20 bp, human
gcctcacactacttccgacc

SEQ ID NO: 151427 - DNA, 20 bp, human
gggtttccgccgagacgaca

SEQ ID NO: 151428 - DNA, 20 bp, human
ggcgcaggtcccagcaccgg

SEQ ID NO: 151429 - DNA, 20 bp, human
ggaagtagtgtgaggctcgt

SEQ ID NO: 151430 - DNA, 20 bp, human
ggtagtgtgaggctcgtggg

SEQ ID NO: 151431 - DNA, 20 bp, human
gcgcagcagggcggcggaca

SEQ ID NO: 151432 - DNA, 20 bp, human
gtccaggccccgccgcagca

SEQ ID NO: 151433 - DNA, 20 bp, human
gaagggaaaggtgcccaagt

SEQ ID NO: 151434 - DNA, 20 bp, human
gggtcaggccaagccgagag

SEQ ID NO: 151435 - DNA, 20 bp, human
gcggaactcggccaagggaa

SEQ ID NO: 151436 - DNA, 20 bp, human
gattcccgccgcccacgcag

SEQ ID NO: 151437 - DNA, 20 bp, human
ggcccgctgcagcgaccaac

SEQ ID NO: 151438 - DNA, 20 bp, human
gggagagcggtcctggtcac

SEQ ID NO: 151439 - DNA, 20 bp, human
gaatccgcggacatcgggtc

SEQ ID NO: 151440 - DNA, 20 bp, human
gccccgcgagacccagacaa

SEQ ID NO: 151441 - DNA, 20 bp, human
gtcggggtcgggcccctggg

SEQ ID NO: 151442 - DNA, 20 bp, human
gcctgggcggcgccggagag

SEQ ID NO: 151443 - DNA, 20 bp, human
gcagcgggcctctgcgtggg

SEQ ID NO: 151444 - DNA, 20 bp, human
gcgtgggcggcgggaatccg

SEQ ID NO: 151445 - DNA, 20 bp, human
ggtaggtatcagccacgctc

SEQ ID NO: 151446 - DNA, 20 bp, human
gtgaggaagacgcggtcgta

SEQ ID NO: 151447 - DNA, 20 bp, human
ggcagatgccggggcgtgta

SEQ ID NO: 151448 - DNA, 20 bp, human
ggacgcggtcgtaagggctg

SEQ ID NO: 151449 - DNA, 20 bp, human
ggcgcgcaacagccatggtg

SEQ ID NO: 151450 - DNA, 20 bp, human
gatgccggggcgtgtagggg

SEQ ID NO: 151451 - DNA, 20 bp, human
ggtctgccacttctggagaa

SEQ ID NO: 151452 - DNA, 20 bp, human
gcgcaacagccatggtgagg

SEQ ID NO: 151453 - DNA, 20 bp, human
ggtgcattcgttatgcgggg

SEQ ID NO: 151454 - DNA, 20 bp, human
gcggaaaggcgctcctgaaa

SEQ ID NO: 151455 - DNA, 20 bp, human
gatggtgaggcggcagtcgg

SEQ ID NO: 151456 - DNA, 20 bp, human
gcaccgcgcgcgagagagaa

SEQ ID NO: 151457 - DNA, 20 bp, human
gtggaaaagagtaacgtcgg

SEQ ID NO: 151458 - DNA, 20 bp, human
ggacgtgacgaggtaaggac

SEQ ID NO: 151459 - DNA, 20 bp, human
gagtcacccggcagagatat

SEQ ID NO: 151460 - DNA, 20 bp, human
gaaggaagcagctagtcacc

SEQ ID NO: 151461 - DNA, 20 bp, human
ggaaagggcgcagtgagcag

SEQ ID NO: 151462 - DNA, 20 bp, human
gcacccggcagagatatcgg

SEQ ID NO: 151463 - DNA, 20 bp, human
gtgacgaggtaaggacggga

SEQ ID NO: 151464 - DNA, 20 bp, human
gttagggacgtgacgaggta

SEQ ID NO: 151465 - DNA, 20 bp, human
ggatatcggcgggcaaggag

SEQ ID NO: 151466 - DNA, 20 bp, human
gcccgtggcgccgacaggat

SEQ ID NO: 151467 - DNA, 20 bp, human
gttggtagtccatgttcctc

SEQ ID NO: 151468 - DNA, 20 bp, human
gcaggatgggtgagctgttg

SEQ ID NO: 151469 - DNA, 20 bp, human
gggcggatgcgaatagagta

SEQ ID NO: 151470 - DNA, 20 bp, human
ggcttgcagcgcccttaaac

SEQ ID NO: 151471 - DNA, 20 bp, human
gagagagaagcaccgcagga

SEQ ID NO: 151472 - DNA, 20 bp, human
gggcgagtgtcttagaagat

SEQ ID NO: 151473 - DNA, 20 bp, human
gtcaggcccgtggcgccgac

SEQ ID NO: 151474 - DNA, 20 bp, human
gtaagggtttattccaggtg

SEQ ID NO: 151475 - DNA, 20 bp, human
ggctgttgtggccggtttaa

SEQ ID NO: 151476 - DNA, 20 bp, human
gcatcatggtgagtctccct

SEQ ID NO: 151477 - DNA, 20 bp, human
gtacgcggcagatgactgca

SEQ ID NO: 151478 - DNA, 20 bp, human
gcacggatggctcggatacg

SEQ ID NO: 151479 - DNA, 20 bp, human
ggtaggcggcttgcaggtga

SEQ ID NO: 151480 - DNA, 20 bp, human
ggcagcgcctgggcgagttg

SEQ ID NO: 151481 - DNA, 20 bp, human
gtatcttcagacagccaagg

SEQ ID NO: 151482 - DNA, 20 bp, human
gcaggtgatggcagtacaag

SEQ ID NO: 151483 - DNA, 20 bp, human
gtgaagatagatcgccatca

SEQ ID NO: 151484 - DNA, 20 bp, human
ggttcctcattgggctaggt

SEQ ID NO: 151485 - DNA, 20 bp, human
ggggatagatggacactggg

SEQ ID NO: 151486 - DNA, 20 bp, human
gtcgcaatggtaagcttcag

SEQ ID NO: 151487 - DNA, 20 bp, human
gcactgggagcgacacgctc

SEQ ID NO: 151488 - DNA, 20 bp, human
gtattctccgagcttcgcaa

SEQ ID NO: 151489 - DNA, 20 bp, human
gcgcagcctcgtcaagatgt

SEQ ID NO: 151490 - DNA, 20 bp, human
gacctctctgaaagagacta

SEQ ID NO: 151491 - DNA, 20 bp, human
gagtgcgcaagtgcagcagg

SEQ ID NO: 151492 - DNA, 20 bp, human
gtccttaggcggctgtagga

SEQ ID NO: 151493 - DNA, 20 bp, human
ggctgagggcgcagtattag

SEQ ID NO: 151494 - DNA, 20 bp, human
ggttagctgccgagacctgg

SEQ ID NO: 151495 - DNA, 20 bp, human
gggaagcgctgctcagaaac

SEQ ID NO: 151496 - DNA, 20 bp, human
gggacaccgggagaatcctt

SEQ ID NO: 151497 - DNA, 20 bp, human
gtagggatctcatgctatat

SEQ ID NO: 151498 - DNA, 20 bp, human
gttccggccacaagccgcac

SEQ ID NO: 151499 - DNA, 20 bp, human
gcatggaacaaagtgcacat

SEQ ID NO: 151500 - DNA, 20 bp, human
gccggtccgtgcctccaaga

SEQ ID NO: 151501 - DNA, 20 bp, human
gggatggcggaagaaaatcg

SEQ ID NO: 151502 - DNA, 20 bp, human
gttcctggaggctgccggtg

SEQ ID NO: 151503 - DNA, 20 bp, human
gtatataggagggccctgcc

SEQ ID NO: 151504 - DNA, 20 bp, human
gggactatttagccggatgg

SEQ ID NO: 151505 - DNA, 20 bp, human
gaggagacgggcttcaagaa

SEQ ID NO: 151506 - DNA, 20 bp, human
ggtctatgcgggtggcccgt

SEQ ID NO: 151507 - DNA, 20 bp, human
gcccccactgtcacacaccg

SEQ ID NO: 151508 - DNA, 20 bp, human
gcctggaccaaagcactcac

SEQ ID NO: 151509 - DNA, 20 bp, human
gccagctgcgcagacaccag

SEQ ID NO: 151510 - DNA, 20 bp, human
gcgctttcgctcctttccgg

SEQ ID NO: 151511 - DNA, 20 bp, human
gccacccgcatagacgggag

SEQ ID NO: 151512 - DNA, 20 bp, human
ggctgcgcagacaccagggg

SEQ ID NO: 151513 - DNA, 20 bp, human
gcgcatagacgggagcggag

SEQ ID NO: 151514 - DNA, 20 bp, human
gcgagatctccgccgaaacc

SEQ ID NO: 151515 - DNA, 20 bp, human
ggctttggtccaggtttcgg

SEQ ID NO: 151516 - DNA, 20 bp, human
ggaaaccccgtgggcctgcg

SEQ ID NO: 151517 - DNA, 20 bp, human
gtacgggccgggtggtcatg

SEQ ID NO: 151518 - DNA, 20 bp, human
gcacaagagaaggcaccata

SEQ ID NO: 151519 - DNA, 20 bp, human
gagacacccaccgcagatgg

SEQ ID NO: 151520 - DNA, 20 bp, human
ggcggtgggtgtctgcactt

SEQ ID NO: 151521 - DNA, 20 bp, human
ggaagagacaggttaggtca

SEQ ID NO: 151522 - DNA, 20 bp, human
gctagctggaacccctcgag

SEQ ID NO: 151523 - DNA, 20 bp, human
gcacacgtgctcgcacccgg

SEQ ID NO: 151524 - DNA, 20 bp, human
gtcgatccgccatctgcggt

SEQ ID NO: 151525 - DNA, 20 bp, human
gctgcacttcggctgctctc

SEQ ID NO: 151526 - DNA, 20 bp, human
gggcgtgggctgcaattcag

SEQ ID NO: 151527 - DNA, 20 bp, human
gcccgatgtaaacaactcac

SEQ ID NO: 151528 - DNA, 20 bp, human
gtcagaacaaagcaaaccta

SEQ ID NO: 151529 - DNA, 20 bp, human
gcgcttccgaaagaaggcag

SEQ ID NO: 151530 - DNA, 20 bp, human
gggcctgtagtgtccgagag

SEQ ID NO: 151531 - DNA, 20 bp, human
ggtgggctgcaattcagagg

SEQ ID NO: 151532 - DNA, 20 bp, human
gagggcgcagggaagacccg

SEQ ID NO: 151533 - DNA, 20 bp, human
gcggacactacaggcccgag

SEQ ID NO: 151534 - DNA, 20 bp, human
gaatatataaggcaacaacg

SEQ ID NO: 151535 - DNA, 20 bp, human
gagcagggtactcgggtcca

SEQ ID NO: 151536 - DNA, 20 bp, human
gcagggtagaggtcacatca

SEQ ID NO: 151537 - DNA, 20 bp, human
gacagtgcacgcaggtaatc

SEQ ID NO: 151538 - DNA, 20 bp, human
gggagtggaggaagaagtaa

SEQ ID NO: 151539 - DNA, 20 bp, human
gtatcaagctggccagggtg

SEQ ID NO: 151540 - DNA, 20 bp, human
gctacgggtccccaccggag

SEQ ID NO: 151541 - DNA, 20 bp, human
gcgcacctacgggtccccac

SEQ ID NO: 151542 - DNA, 20 bp, human
ggtggaggaagaagtaaggg

SEQ ID NO: 151543 - DNA, 20 bp, human
gcggaaaggcaccgcggagt

SEQ ID NO: 151544 - DNA, 20 bp, human
ggggccgcggaaaggcaccg

SEQ ID NO: 151545 - DNA, 20 bp, human
ggtgcacgcaggtaatcggg

SEQ ID NO: 151546 - DNA, 20 bp, human
gccattacaggcctgtactg

SEQ ID NO: 151547 - DNA, 20 bp, human
ggactcccaagccacagtac

SEQ ID NO: 151548 - DNA, 20 bp, human
gggcaccagcgactcccagt

SEQ ID NO: 151549 - DNA, 20 bp, human
gttgggcagagaaggttgtg

SEQ ID NO: 151550 - DNA, 20 bp, human
gaagtagaggaggccacggg

SEQ ID NO: 151551 - DNA, 20 bp, human
gggtagtagccgtctgagtg

SEQ ID NO: 151552 - DNA, 20 bp, human
gactgtggcttgggagtccc

SEQ ID NO: 151553 - DNA, 20 bp, human
gcggctactacccgcatccc

SEQ ID NO: 151554 - DNA, 20 bp, human
gtaagcagcctagcgctcca

SEQ ID NO: 151555 - DNA, 20 bp, human
gacgagggagcacgccgact

SEQ ID NO: 151556 - DNA, 20 bp, human
gtgttcggggaggattccga

SEQ ID NO: 151557 - DNA, 20 bp, human
gcgtcaacagctgaaaccct

SEQ ID NO: 151558 - DNA, 20 bp, human
gggaaaccggcagtcggcgg

SEQ ID NO: 151559 - DNA, 20 bp, human
ggccttccctcgggaaacag

SEQ ID NO: 151560 - DNA, 20 bp, human
gcacctggcacgtcgaaggg

SEQ ID NO: 151561 - DNA, 20 bp, human
gtgctctccggaggcacacc

SEQ ID NO: 151562 - DNA, 20 bp, human
gctgccagctgcgcgctcgg

SEQ ID NO: 151563 - DNA, 20 bp, human
ggattgattgaactaggacg

SEQ ID NO: 151564 - DNA, 20 bp, human
gaagcaggcgctcacggtcg

SEQ ID NO: 151565 - DNA, 20 bp, human
gagagtacgaaggccttgtg

SEQ ID NO: 151566 - DNA, 20 bp, human
gaagaggaaggtgagcctct

SEQ ID NO: 151567 - DNA, 20 bp, human
gacccagaaacgaccagtta

SEQ ID NO: 151568 - DNA, 20 bp, human
gtcctttcagcggagcgcgg

SEQ ID NO: 151569 - DNA, 20 bp, human
gaggtgagcctctggggact

SEQ ID NO: 151570 - DNA, 20 bp, human
gcccaggacctcaacttgaa

SEQ ID NO: 151571 - DNA, 20 bp, human
gcagccaggagggcgctgtg

SEQ ID NO: 151572 - DNA, 20 bp, human
gtggcggtggattgagtgag

SEQ ID NO: 151573 - DNA, 20 bp, human
gaagtgaagcgcagagagat

SEQ ID NO: 151574 - DNA, 20 bp, human
gcggccacacagcgccctcc

SEQ ID NO: 151575 - DNA, 20 bp, human
gaccacgggataagacatga

SEQ ID NO: 151576 - DNA, 20 bp, human
gtcataaaggataaacctgc

SEQ ID NO: 151577 - DNA, 20 bp, human
gtggattagtttgtcgctga

SEQ ID NO: 151578 - DNA, 20 bp, human
gtagcatttataacaattat

SEQ ID NO: 151579 - DNA, 20 bp, human
gcagtcaaatgagttttacc

SEQ ID NO: 151580 - DNA, 20 bp, human
gattgttataaatgctaagt

SEQ ID NO: 151581 - DNA, 20 bp, human
gaggataaacctgccgggcg

SEQ ID NO: 151582 - DNA, 20 bp, human
gttataacaattataggtga

SEQ ID NO: 151583 - DNA, 20 bp, human
gtcaaatgagttttacctgg

SEQ ID NO: 151584 - DNA, 20 bp, human
gaatcattatcttagccacc

SEQ ID NO: 151585 - DNA, 20 bp, human
ggagtttcttactcgggagc

SEQ ID NO: 151586 - DNA, 20 bp, human
gtgcacccaggaacgcggcc

SEQ ID NO: 151587 - DNA, 20 bp, human
ggttggtgcacccaggaacg

SEQ ID NO: 151588 - DNA, 20 bp, human
ggagccaaaagggcggaagt

SEQ ID NO: 151589 - DNA, 20 bp, human
gttccagcgggaccaagcaa

SEQ ID NO: 151590 - DNA, 20 bp, human
gcgagaacttaggcgtacgg

SEQ ID NO: 151591 - DNA, 20 bp, human
ggagggtcggtgttgagtag

SEQ ID NO: 151592 - DNA, 20 bp, human
gaggagctcgcagattccag

SEQ ID NO: 151593 - DNA, 20 bp, human
ggggagtcgcgcgagaactt

SEQ ID NO: 151594 - DNA, 20 bp, human
ggggtcctgaatggatagaa

SEQ ID NO: 151595 - DNA, 20 bp, human
gcaagcaaaggcgagattga

SEQ ID NO: 151596 - DNA, 20 bp, human
gctaactaaacggcttacca

SEQ ID NO: 151597 - DNA, 20 bp, human
gggacgggctccagggcgaa

SEQ ID NO: 151598 - DNA, 20 bp, human
gtacgcgcaccggaagacgg

SEQ ID NO: 151599 - DNA, 20 bp, human
gggcttaccatggctgcgtt

SEQ ID NO: 151600 - DNA, 20 bp, human
gccggtgcgcgtagaaattg

SEQ ID NO: 151601 - DNA, 20 bp, human
gctgcgagcccgaggttggt

SEQ ID NO: 151602 - DNA, 20 bp, human
gcccagcgcccaccaacctc

SEQ ID NO: 151603 - DNA, 20 bp, human
gtaagagctcgctaactaaa

SEQ ID NO: 151604 - DNA, 20 bp, human
gttctacgcgcaccggaaga

SEQ ID NO: 151605 - DNA, 20 bp, human
gggccacgtatggtaaagtc

SEQ ID NO: 151606 - DNA, 20 bp, human
gtgatggaggcagatatact

SEQ ID NO: 151607 - DNA, 20 bp, human
gccatggcgaaactctgcga

SEQ ID NO: 151608 - DNA, 20 bp, human
gcaaaacggggcttgagtat

SEQ ID NO: 151609 - DNA, 20 bp, human
gccactgccgggctgcgtca

SEQ ID NO: 151610 - DNA, 20 bp, human
gcgggtaaaaagccactgcc

SEQ ID NO: 151611 - DNA, 20 bp, human
gtgctctccaagcgaatctg

SEQ ID NO: 151612 - DNA, 20 bp, human
gggcagatatactaggagtt

SEQ ID NO: 151613 - DNA, 20 bp, human
gggaactatcggtcttacca

SEQ ID NO: 151614 - DNA, 20 bp, human
gagctgtaggaactgctaac

SEQ ID NO: 151615 - DNA, 20 bp, human
gcaaggatggactcacgtga

SEQ ID NO: 151616 - DNA, 20 bp, human
ggcccttcttcaaaggatgg

SEQ ID NO: 151617 - DNA, 20 bp, human
ggacgccagagagactcgtg

SEQ ID NO: 151618 - DNA, 20 bp, human
gggatggaggcagataaatc

SEQ ID NO: 151619 - DNA, 20 bp, human
gggacgcagacgtcttacca

SEQ ID NO: 151620 - DNA, 20 bp, human
ggcgcccaggccgagcacaa

SEQ ID NO: 151621 - DNA, 20 bp, human
gagactcgtgaggttgtcaa

SEQ ID NO: 151622 - DNA, 20 bp, human
gcggaggtctgagaagagtg

SEQ ID NO: 151623 - DNA, 20 bp, human
gggttgcaccgtaaaaggag

SEQ ID NO: 151624 - DNA, 20 bp, human
gtgctgggctgcggagtcaa

SEQ ID NO: 151625 - DNA, 20 bp, human
gccatggcgaaatcccgcga

SEQ ID NO: 151626 - DNA, 20 bp, human
gcctaggatccccggccccg

SEQ ID NO: 151627 - DNA, 20 bp, human
gtctcaggtgagaccgccgc

SEQ ID NO: 151628 - DNA, 20 bp, human
ggcgccgccctggtacagac

SEQ ID NO: 151629 - DNA, 20 bp, human
gccgagtgacagagacgctc

SEQ ID NO: 151630 - DNA, 20 bp, human
gcctcttcctgtctgtacca

SEQ ID NO: 151631 - DNA, 20 bp, human
gggcaacctggacctgcgga

SEQ ID NO: 151632 - DNA, 20 bp, human
gtgtggcacaatcaacccaa

SEQ ID NO: 151633 - DNA, 20 bp, human
ggccgcggcgaggagtcaga

SEQ ID NO: 151634 - DNA, 20 bp, human
gtgacatcaaggaccacggt

SEQ ID NO: 151635 - DNA, 20 bp, human
ggaccacggtaggtaccgtg

SEQ ID NO: 151636 - DNA, 20 bp, human
gaagttggccctcttttccg

SEQ ID NO: 151637 - DNA, 20 bp, human
ggaacgcctccgaggcgcca

SEQ ID NO: 151638 - DNA, 20 bp, human
gagatgaaggtaggtgatgg

SEQ ID NO: 151639 - DNA, 20 bp, human
gccccgcggaatgactctgg

SEQ ID NO: 151640 - DNA, 20 bp, human
gtcaagatgaaggtaggtga

SEQ ID NO: 151641 - DNA, 20 bp, human
gtggtggcgagtgttagact

SEQ ID NO: 151642 - DNA, 20 bp, human
gcgaggcgccacggaaaaga

SEQ ID NO: 151643 - DNA, 20 bp, human
gcttgcttcgggagggtgaa

SEQ ID NO: 151644 - DNA, 20 bp, human
ggagaaggctcgcctttctg

SEQ ID NO: 151645 - DNA, 20 bp, human
gggaatgactctgggggcga

SEQ ID NO: 151646 - DNA, 20 bp, human
gggagggtagagtcctggaa

SEQ ID NO: 151647 - DNA, 20 bp, human
ggggcccagagccgcagacg

SEQ ID NO: 151648 - DNA, 20 bp, human
gtcctggaaaggctaggacc

SEQ ID NO: 151649 - DNA, 20 bp, human
gctgggaagccaggggatca

SEQ ID NO: 151650 - DNA, 20 bp, human
gtcccaagccgccccgtctg

SEQ ID NO: 151651 - DNA, 20 bp, human
gatggtgccgtggccctgct

SEQ ID NO: 151652 - DNA, 20 bp, human
ggtggtggccgggaccaagg

SEQ ID NO: 151653 - DNA, 20 bp, human
gcttcagggcttcaaggcaa

SEQ ID NO: 151654 - DNA, 20 bp, human
gctggcaaggggcttccagt

SEQ ID NO: 151655 - DNA, 20 bp, human
gttccccaggaagcaagtct

SEQ ID NO: 151656 - DNA, 20 bp, human
ggagcgcgaggggctcgggg

SEQ ID NO: 151657 - DNA, 20 bp, human
gcaggagaggggatcctatg

SEQ ID NO: 151658 - DNA, 20 bp, human
gcgggacgggtcctaggtgt

SEQ ID NO: 151659 - DNA, 20 bp, human
gcgagcccggatcctcacag

SEQ ID NO: 151660 - DNA, 20 bp, human
gcgaagtgctagtgccgcgg

SEQ ID NO: 151661 - DNA, 20 bp, human
gtccccgccatagccaggag

SEQ ID NO: 151662 - DNA, 20 bp, human
gcggcccagccggagcgcga

SEQ ID NO: 151663 - DNA, 20 bp, human
gcagtgggcaagagatcgga

SEQ ID NO: 151664 - DNA, 20 bp, human
gcgcacacccgggcataggg

SEQ ID NO: 151665 - DNA, 20 bp, human
ggctatggcggggaggtagt

SEQ ID NO: 151666 - DNA, 20 bp, human
gcgcgagctgcggtcacaaa

SEQ ID NO: 151667 - DNA, 20 bp, human
gggtctcggggtccacccag

SEQ ID NO: 151668 - DNA, 20 bp, human
gtggaccccgagacccgtca

SEQ ID NO: 151669 - DNA, 20 bp, human
gccggcgctggtactcgcag

SEQ ID NO: 151670 - DNA, 20 bp, human
gggtccgtgggtcctcgcgg

SEQ ID NO: 151671 - DNA, 20 bp, human
gccgcctcgccacccctggg

SEQ ID NO: 151672 - DNA, 20 bp, human
ggcgctggtactcgcagggg

SEQ ID NO: 151673 - DNA, 20 bp, human
gacggaccgcccaattacta

SEQ ID NO: 151674 - DNA, 20 bp, human
gagttactggaaagctggtc

SEQ ID NO: 151675 - DNA, 20 bp, human
gagcccggcacggcggccat

SEQ ID NO: 151676 - DNA, 20 bp, human
ggcggcggcggccccagaga

SEQ ID NO: 151677 - DNA, 20 bp, human
gacgcgagcgggatcagaac

SEQ ID NO: 151678 - DNA, 20 bp, human
gcggcgtcgagccctctctg

SEQ ID NO: 151679 - DNA, 20 bp, human
gcaggcgcgcggctttcggg

SEQ ID NO: 151680 - DNA, 20 bp, human
gagagcctcgcgcctccgct

SEQ ID NO: 151681 - DNA, 20 bp, human
ggcggacccgtggcagaaga

SEQ ID NO: 151682 - DNA, 20 bp, human
gcccgggggaaagacgcgag

SEQ ID NO: 151683 - DNA, 20 bp, human
ggggatcagaacgggccgag

SEQ ID NO: 151684 - DNA, 20 bp, human
gcgcgcgggcgtctctggcc

SEQ ID NO: 151685 - DNA, 20 bp, human
gggcgcagctggcggacccg

SEQ ID NO: 151686 - DNA, 20 bp, human
gactctggcgaggcagggcg

SEQ ID NO: 151687 - DNA, 20 bp, human
gcgtcctcgtcccccatggc

SEQ ID NO: 151688 - DNA, 20 bp, human
ggccggagccgccatgtaac

SEQ ID NO: 151689 - DNA, 20 bp, human
gagcgacccgcccgccatgg

SEQ ID NO: 151690 - DNA, 20 bp, human
ggctgtgccgggaaagggtg

SEQ ID NO: 151691 - DNA, 20 bp, human
gtcgtcgtcctcgtccccca

SEQ ID NO: 151692 - DNA, 20 bp, human
ggctgcggatcacagaaggt

SEQ ID NO: 151693 - DNA, 20 bp, human
gtgcacgcacaggaccgtgg

SEQ ID NO: 151694 - DNA, 20 bp, human
gccgggcggcgccggttaca

SEQ ID NO: 151695 - DNA, 20 bp, human
gctgaccgggcacgaggaga

SEQ ID NO: 151696 - DNA, 20 bp, human
ggtgcggcggctccagaact

SEQ ID NO: 151697 - DNA, 20 bp, human
gtagcggtgcccgccgaagg

SEQ ID NO: 151698 - DNA, 20 bp, human
gtgcccgccgaagggggagg

SEQ ID NO: 151699 - DNA, 20 bp, human
gaggcgaggagcgagccgtg

SEQ ID NO: 151700 - DNA, 20 bp, human
gcccaggagtcggggtgcgg

SEQ ID NO: 151701 - DNA, 20 bp, human
gcggtgcccgccgaaggggg

SEQ ID NO: 151702 - DNA, 20 bp, human
ggtgcccgccgctcattccc

SEQ ID NO: 151703 - DNA, 20 bp, human
ggcgagccgtgcggccagag

SEQ ID NO: 151704 - DNA, 20 bp, human
gcgcctcctcccccttcggc

SEQ ID NO: 151705 - DNA, 20 bp, human
gtactagcggtgcccgccga

SEQ ID NO: 151706 - DNA, 20 bp, human
gcgagcggcagctcttggag

SEQ ID NO: 151707 - DNA, 20 bp, human
ggtggtgagcgcgagccgag

SEQ ID NO: 151708 - DNA, 20 bp, human
gccccagccaaggtcttgag

SEQ ID NO: 151709 - DNA, 20 bp, human
gtcgccgccgggtctctcag

SEQ ID NO: 151710 - DNA, 20 bp, human
gtgggggagtcaccaccgag

SEQ ID NO: 151711 - DNA, 20 bp, human
gcgagcggctgtcgttgtgg

SEQ ID NO: 151712 - DNA, 20 bp, human
gagcagcggcgaggttagtg

SEQ ID NO: 151713 - DNA, 20 bp, human
gcagcctctgagagacccgg

SEQ ID NO: 151714 - DNA, 20 bp, human
ggcagtggaggcagcatcaa

SEQ ID NO: 151715 - DNA, 20 bp, human
gacggagagaggagaggcgt

SEQ ID NO: 151716 - DNA, 20 bp, human
gcctaagcagccggtgatgg

SEQ ID NO: 151717 - DNA, 20 bp, human
gcagccgctgccgccatcac

SEQ ID NO: 151718 - DNA, 20 bp, human
ggagcctaagcagccggtga

SEQ ID NO: 151719 - DNA, 20 bp, human
gtccctgtctcggaagtccg

SEQ ID NO: 151720 - DNA, 20 bp, human
gcgggcccatgaggcgacga

SEQ ID NO: 151721 - DNA, 20 bp, human
ggccccgagcgatctgaaga

SEQ ID NO: 151722 - DNA, 20 bp, human
ggcccatgaggcgacgaagg

SEQ ID NO: 151723 - DNA, 20 bp, human
gcgcagaggcctcacaccta

SEQ ID NO: 151724 - DNA, 20 bp, human
ggtcgcgcggcctgagacag

SEQ ID NO: 151725 - DNA, 20 bp, human
ggcctccttcgtcgcctcat

SEQ ID NO: 151726 - DNA, 20 bp, human
gtcagtgcgcggccaggtac

SEQ ID NO: 151727 - DNA, 20 bp, human
gcagggatggcagctagtag

SEQ ID NO: 151728 - DNA, 20 bp, human
ggcgcactgactgacagtcc

SEQ ID NO: 151729 - DNA, 20 bp, human
gcacccagccgaggccggag

SEQ ID NO: 151730 - DNA, 20 bp, human
gcgtcctgtgagaaaccgag

SEQ ID NO: 151731 - DNA, 20 bp, human
gaggccagctgccctcaact

SEQ ID NO: 151732 - DNA, 20 bp, human
gagaattgggaagaaaccga

SEQ ID NO: 151733 - DNA, 20 bp, human
gaaccgaggggtaagagcca

SEQ ID NO: 151734 - DNA, 20 bp, human
gccgggatctgagaaggatc

SEQ ID NO: 151735 - DNA, 20 bp, human
gtagagaccgggatctgaga

SEQ ID NO: 151736 - DNA, 20 bp, human
gctccaaggcggctccacgg

SEQ ID NO: 151737 - DNA, 20 bp, human
gcagcggcgaagcggcgagg

SEQ ID NO: 151738 - DNA, 20 bp, human
gcacccgcccgggatcatga

SEQ ID NO: 151739 - DNA, 20 bp, human
gcgggatcatgagggaaacc

SEQ ID NO: 151740 - DNA, 20 bp, human
gtccaggttccccaacgcag

SEQ ID NO: 151741 - DNA, 20 bp, human
gtggggaacctggaccgcgg

SEQ ID NO: 151742 - DNA, 20 bp, human
gccccaacgcagcggcgaag

SEQ ID NO: 151743 - DNA, 20 bp, human
gcctactacagtgaagccct

SEQ ID NO: 151744 - DNA, 20 bp, human
gacaccggcactcacccggg

SEQ ID NO: 151745 - DNA, 20 bp, human
gctggctcagagccgagggt

SEQ ID NO: 151746 - DNA, 20 bp, human
ggtgaagggccggtacgtga

SEQ ID NO: 151747 - DNA, 20 bp, human
gaggcctccccctcacgtac

SEQ ID NO: 151748 - DNA, 20 bp, human
gctcccagctcgggcaggta

SEQ ID NO: 151749 - DNA, 20 bp, human
gcggcgcgctctggcgtgaa

SEQ ID NO: 151750 - DNA, 20 bp, human
gagctgggagccgggtccgc

SEQ ID NO: 151751 - DNA, 20 bp, human
gcctgctcggccaagcccag

SEQ ID NO: 151752 - DNA, 20 bp, human
ggacccacagcctcagccgg

SEQ ID NO: 151753 - DNA, 20 bp, human
gactgggaatgggcaggacc

SEQ ID NO: 151754 - DNA, 20 bp, human
gtgctctcccaggtcccact

SEQ ID NO: 151755 - DNA, 20 bp, human
gacctgggagagcaaaggcg

SEQ ID NO: 151756 - DNA, 20 bp, human
ggctcggcaaggtaggttgg

SEQ ID NO: 151757 - DNA, 20 bp, human
gctcgccccgcagaagccat

SEQ ID NO: 151758 - DNA, 20 bp, human
gggcgctcggcaaggtaggt

SEQ ID NO: 151759 - DNA, 20 bp, human
ggcgagagcacgtcaaaatc

SEQ ID NO: 151760 - DNA, 20 bp, human
gggcgtccgaaggcaagagg

SEQ ID NO: 151761 - DNA, 20 bp, human
gagccggcgctcggcaaggt

SEQ ID NO: 151762 - DNA, 20 bp, human
gtcggacgcgcgctcagggt

SEQ ID NO: 151763 - DNA, 20 bp, human
ggtcaaaatccggcgtccga

SEQ ID NO: 151764 - DNA, 20 bp, human
ggaagccatcggaaagcaca

SEQ ID NO: 151765 - DNA, 20 bp, human
gagcaaggctcgcccctcca

SEQ ID NO: 151766 - DNA, 20 bp, human
gcgctagcaccgagtcacag

SEQ ID NO: 151767 - DNA, 20 bp, human
gcattgaggcgggtgaaggg

SEQ ID NO: 151768 - DNA, 20 bp, human
ggtgtcgctctgcattgagg

SEQ ID NO: 151769 - DNA, 20 bp, human
gtactcccgagtgcgcggtg

SEQ ID NO: 151770 - DNA, 20 bp, human
ggcgacactcacccatcgct

SEQ ID NO: 151771 - DNA, 20 bp, human
gctgggcggccgaaacccga

SEQ ID NO: 151772 - DNA, 20 bp, human
gctgcattgaggcgggtgaa

SEQ ID NO: 151773 - DNA, 20 bp, human
gggcgtctggactcctcagt

SEQ ID NO: 151774 - DNA, 20 bp, human
gatgcctgcatgtggaagcg

SEQ ID NO: 151775 - DNA, 20 bp, human
ggagaaaccgcaaagattca

SEQ ID NO: 151776 - DNA, 20 bp, human
gcggactagatagagtacat

SEQ ID NO: 151777 - DNA, 20 bp, human
gcgggtggtttgcttaggtg

SEQ ID NO: 151778 - DNA, 20 bp, human
ggagagaagtgtgagcgtaa

SEQ ID NO: 151779 - DNA, 20 bp, human
gcacccggtcactgagaaag

SEQ ID NO: 151780 - DNA, 20 bp, human
gaagtggttcggcttccggg

SEQ ID NO: 151781 - DNA, 20 bp, human
gtgagcgtaagggctccaaa

SEQ ID NO: 151782 - DNA, 20 bp, human
gaggcttccgggaagtggtt

SEQ ID NO: 151783 - DNA, 20 bp, human
gcggaagccgaaccacttcc

SEQ ID NO: 151784 - DNA, 20 bp, human
gccacgtgctaaccgcctcc

SEQ ID NO: 151785 - DNA, 20 bp, human
gctccccaccaggcgagtat

SEQ ID NO: 151786 - DNA, 20 bp, human
ggtccatacggcgttgttct

SEQ ID NO: 151787 - DNA, 20 bp, human
ggtagcacggaaaagacagg

SEQ ID NO: 151788 - DNA, 20 bp, human
gcaggtagcacggaaaagac

SEQ ID NO: 151789 - DNA, 20 bp, human
gccttcggagtcccacacgg

SEQ ID NO: 151790 - DNA, 20 bp, human
gctagccctggaaggcgcca

SEQ ID NO: 151791 - DNA, 20 bp, human
gccgtgcgggtcaggagtta

SEQ ID NO: 151792 - DNA, 20 bp, human
ggcgtccctggcgccttcca

SEQ ID NO: 151793 - DNA, 20 bp, human
gcggcggtgagtctaggccc

SEQ ID NO: 151794 - DNA, 20 bp, human
ggagttccgtgtagcgtccc

SEQ ID NO: 151795 - DNA, 20 bp, human
ggtcaggagttaaggttctc

SEQ ID NO: 151796 - DNA, 20 bp, human
gggagtcagagaggatactg

SEQ ID NO: 151797 - DNA, 20 bp, human
ggacatgcataggggagcat

SEQ ID NO: 151798 - DNA, 20 bp, human
ggcaggtaagacatgcatag

SEQ ID NO: 151799 - DNA, 20 bp, human
gatgtcttacctgcttgagg

SEQ ID NO: 151800 - DNA, 20 bp, human
ggacaaataatggatcacat

SEQ ID NO: 151801 - DNA, 20 bp, human
gagcattggtagtatctaca

SEQ ID NO: 151802 - DNA, 20 bp, human
gctaggacacattgaagtga

SEQ ID NO: 151803 - DNA, 20 bp, human
ggccttggccctaaactatt

SEQ ID NO: 151804 - DNA, 20 bp, human
gtgctccttcctcctcaagc

SEQ ID NO: 151805 - DNA, 20 bp, human
gccccagcctggtgcattat

SEQ ID NO: 151806 - DNA, 20 bp, human
gtgggggccgctaggaaatg

SEQ ID NO: 151807 - DNA, 20 bp, human
gcctcagcagttccgaagac

SEQ ID NO: 151808 - DNA, 20 bp, human
gcgagagcagggtcatcgtg

SEQ ID NO: 151809 - DNA, 20 bp, human
gcactgtagctccaaaccag

SEQ ID NO: 151810 - DNA, 20 bp, human
gggcgaaccggcaccaagag

SEQ ID NO: 151811 - DNA, 20 bp, human
gatatggcgtcctccttgat

SEQ ID NO: 151812 - DNA, 20 bp, human
gggagctttgccctctggtt

SEQ ID NO: 151813 - DNA, 20 bp, human
gtctcatcagcccatcaagg

SEQ ID NO: 151814 - DNA, 20 bp, human
gaccccaggtcccaagccac

SEQ ID NO: 151815 - DNA, 20 bp, human
gtcatgggagctttgccctc

SEQ ID NO: 151816 - DNA, 20 bp, human
gtacccgcaccgccccaccc

SEQ ID NO: 151817 - DNA, 20 bp, human
gggactgatctcggggactg

SEQ ID NO: 151818 - DNA, 20 bp, human
ggtccggagcggagcttcca

SEQ ID NO: 151819 - DNA, 20 bp, human
gaggatgcaggtgcacagta

SEQ ID NO: 151820 - DNA, 20 bp, human
ggtccccagggcgtcagctg

SEQ ID NO: 151821 - DNA, 20 bp, human
gcggagcttccagggtctct

SEQ ID NO: 151822 - DNA, 20 bp, human
ggaccctggaagctccgctc

SEQ ID NO: 151823 - DNA, 20 bp, human
gtccccgagatcagtcccca

SEQ ID NO: 151824 - DNA, 20 bp, human
gcgccccgcacaggcccggt

SEQ ID NO: 151825 - DNA, 20 bp, human
gtgctccgggctgacctgaa

SEQ ID NO: 151826 - DNA, 20 bp, human
gtgggccaccctgagcatca

SEQ ID NO: 151827 - DNA, 20 bp, human
gttggcaggaacagcacgga

SEQ ID NO: 151828 - DNA, 20 bp, human
ggggccacgaagcttatgtt

SEQ ID NO: 151829 - DNA, 20 bp, human
ggccctcgatgcacatggtg

SEQ ID NO: 151830 - DNA, 20 bp, human
gcagaaccacgagatctgtg

SEQ ID NO: 151831 - DNA, 20 bp, human
gaggcaggtgtgaggttagt

SEQ ID NO: 151832 - DNA, 20 bp, human
ggctgttcctgccaatggca

SEQ ID NO: 151833 - DNA, 20 bp, human
gagctctgccctgatgctca

SEQ ID NO: 151834 - DNA, 20 bp, human
gggcatggctgatggttacc

SEQ ID NO: 151835 - DNA, 20 bp, human
gatcgagggctcgcagggtg

SEQ ID NO: 151836 - DNA, 20 bp, human
gaagaaccctgagccatccg

SEQ ID NO: 151837 - DNA, 20 bp, human
gaaccctgagccatccgcgg

SEQ ID NO: 151838 - DNA, 20 bp, human
gcagatcgcgaccctgggag

SEQ ID NO: 151839 - DNA, 20 bp, human
ggaccgccgcggatggctca

SEQ ID NO: 151840 - DNA, 20 bp, human
gttatgtggctggaccgccg

SEQ ID NO: 151841 - DNA, 20 bp, human
gccaagtcctggtaaagcta

SEQ ID NO: 151842 - DNA, 20 bp, human
gcccgggcaagcataagaag

SEQ ID NO: 151843 - DNA, 20 bp, human
gggtaaagctagggcgccta

SEQ ID NO: 151844 - DNA, 20 bp, human
gtccggaagtcaaagtaata

SEQ ID NO: 151845 - DNA, 20 bp, human
gccgccctcgaagtaataac

SEQ ID NO: 151846 - DNA, 20 bp, human
gccagaaccggcccaaaaca

SEQ ID NO: 151847 - DNA, 20 bp, human
gtcctggctcgggagatgga

SEQ ID NO: 151848 - DNA, 20 bp, human
ggaaccggcccaaaacacgg

SEQ ID NO: 151849 - DNA, 20 bp, human
gctccttgtccaggcatcag

SEQ ID NO: 151850 - DNA, 20 bp, human
gggcatcagaggcaaccccg

SEQ ID NO: 151851 - DNA, 20 bp, human
ggtccggagataggaatggg

SEQ ID NO: 151852 - DNA, 20 bp, human
gccgccagccactccagaac

SEQ ID NO: 151853 - DNA, 20 bp, human
gtgcgtcctcgggcactggg

SEQ ID NO: 151854 - DNA, 20 bp, human
gtgcctctgatgcctggaca

SEQ ID NO: 151855 - DNA, 20 bp, human
gtctacagcggagggcaccg

SEQ ID NO: 151856 - DNA, 20 bp, human
ggagaagggcgactacaatg

SEQ ID NO: 151857 - DNA, 20 bp, human
gggcccgacgcgctccacct

SEQ ID NO: 151858 - DNA, 20 bp, human
gagggaccagaactccctag

SEQ ID NO: 151859 - DNA, 20 bp, human
gtcccagacggggagtaggt

SEQ ID NO: 151860 - DNA, 20 bp, human
gggaggggaggggtcagtaa

SEQ ID NO: 151861 - DNA, 20 bp, human
gtgggcgccgccatcttaca

SEQ ID NO: 151862 - DNA, 20 bp, human
ggcccttccttgtaagatgg

SEQ ID NO: 151863 - DNA, 20 bp, human
gcgtcgggcccctggatccg

SEQ ID NO: 151864 - DNA, 20 bp, human
ggccgccatcttacaaggaa

SEQ ID NO: 151865 - DNA, 20 bp, human
gaaggagccggtgagtccaa

SEQ ID NO: 151866 - DNA, 20 bp, human
gagtcggatggcggctacgg

SEQ ID NO: 151867 - DNA, 20 bp, human
gggagcgagccggagtcgga

SEQ ID NO: 151868 - DNA, 20 bp, human
ggcgagccggagtcggatgg

SEQ ID NO: 151869 - DNA, 20 bp, human
gcggagtcggatggcggcta

SEQ ID NO: 151870 - DNA, 20 bp, human
gcagagggccgcgaagtggg

SEQ ID NO: 151871 - DNA, 20 bp, human
gggtcagagggccgcgaagt

SEQ ID NO: 151872 - DNA, 20 bp, human
gccggggccttggagattga

SEQ ID NO: 151873 - DNA, 20 bp, human
gactggcgccctgaaactgt

SEQ ID NO: 151874 - DNA, 20 bp, human
ggcgtccggcaaggaaatag

SEQ ID NO: 151875 - DNA, 20 bp, human
gggagagaaggccgaaacgt

SEQ ID NO: 151876 - DNA, 20 bp, human
gacgcgatgaccctgaacgg

SEQ ID NO: 151877 - DNA, 20 bp, human
gaggagcgcgagcgccgtcg

SEQ ID NO: 151878 - DNA, 20 bp, human
gtagctgtctgggaatagag

SEQ ID NO: 151879 - DNA, 20 bp, human
gcggacgcgatgaccctgaa

SEQ ID NO: 151880 - DNA, 20 bp, human
gtgagggcgccgcgacctgg

SEQ ID NO: 151881 - DNA, 20 bp, human
gcacgctcaggactaggatc

SEQ ID NO: 151882 - DNA, 20 bp, human
gagcccagtgcgggctgaga

SEQ ID NO: 151883 - DNA, 20 bp, human
gaggccacgcactcgtagtc

SEQ ID NO: 151884 - DNA, 20 bp, human
ggcaggtcgcgctcgtccac

SEQ ID NO: 151885 - DNA, 20 bp, human
gctggagccagagcccagtg

SEQ ID NO: 151886 - DNA, 20 bp, human
gctgtcagtggcaacggctc

SEQ ID NO: 151887 - DNA, 20 bp, human
gggcgcggcctgcgagtccc

SEQ ID NO: 151888 - DNA, 20 bp, human
ggagcgcccgcggctgtcag

SEQ ID NO: 151889 - DNA, 20 bp, human
gaacctggtgctgaacctgt

SEQ ID NO: 151890 - DNA, 20 bp, human
gggctggagaggccgcggac

SEQ ID NO: 151891 - DNA, 20 bp, human
gccgcggctgtcagtggcaa

SEQ ID NO: 151892 - DNA, 20 bp, human
gctcccacgtccgattccta

SEQ ID NO: 151893 - DNA, 20 bp, human
gttccctaggaatcggacgt

SEQ ID NO: 151894 - DNA, 20 bp, human
gactcagatgggagcgcccg

SEQ ID NO: 151895 - DNA, 20 bp, human
ggatcgccgccggaagtggg

SEQ ID NO: 151896 - DNA, 20 bp, human
gctgcaggccaggatcacgt

SEQ ID NO: 151897 - DNA, 20 bp, human
gtggctgcggtgagatacct

SEQ ID NO: 151898 - DNA, 20 bp, human
gccccagtggacaaaggcgg

SEQ ID NO: 151899 - DNA, 20 bp, human
ggcggccccccagtggacaa

SEQ ID NO: 151900 - DNA, 20 bp, human
gggccataggcgatgagaat

SEQ ID NO: 151901 - DNA, 20 bp, human
gggccaggttcgagagataa

SEQ ID NO: 151902 - DNA, 20 bp, human
gtcggagagtcagccggcgg

SEQ ID NO: 151903 - DNA, 20 bp, human
gcgctaccaaagggacgggt

SEQ ID NO: 151904 - DNA, 20 bp, human
gagagataaaggtaaccgtg

SEQ ID NO: 151905 - DNA, 20 bp, human
gatgagaataggcagttgag

SEQ ID NO: 151906 - DNA, 20 bp, human
ggacttgggcgtggacacag

SEQ ID NO: 151907 - DNA, 20 bp, human
gaccggccacctgagaaccg

SEQ ID NO: 151908 - DNA, 20 bp, human
ggtcccatgagcagaatcct

SEQ ID NO: 151909 - DNA, 20 bp, human
ggtagcggggacgcccggga

SEQ ID NO: 151910 - DNA, 20 bp, human
ggccccgtactgcagggaca

SEQ ID NO: 151911 - DNA, 20 bp, human
gggcgtggacacagaggtcg

SEQ ID NO: 151912 - DNA, 20 bp, human
ggttctcaggtggccggtag

SEQ ID NO: 151913 - DNA, 20 bp, human
gacttggcttcagctgactt

SEQ ID NO: 151914 - DNA, 20 bp, human
gggccacctgagaaccgggg

SEQ ID NO: 151915 - DNA, 20 bp, human
gaccatgtccctgcagtacg

SEQ ID NO: 151916 - DNA, 20 bp, human
gagggggcttcgggcgcgct

SEQ ID NO: 151917 - DNA, 20 bp, human
ggcgcggcagttcctcccgg

SEQ ID NO: 151918 - DNA, 20 bp, human
gcggacagcggcacagagga

SEQ ID NO: 151919 - DNA, 20 bp, human
ggatccggacagcggcacag

SEQ ID NO: 151920 - DNA, 20 bp, human
gggaggagtcagccggagcg

SEQ ID NO: 151921 - DNA, 20 bp, human
gggaggaggatgagctggtg

SEQ ID NO: 151922 - DNA, 20 bp, human
gcgccggcggaggagtcagc

SEQ ID NO: 151923 - DNA, 20 bp, human
ggcggaggggcaaccaggat

SEQ ID NO: 151924 - DNA, 20 bp, human
gggatcggcgtcggaggagt

SEQ ID NO: 151925 - DNA, 20 bp, human
gaaggcgccaaggggaggaa

SEQ ID NO: 151926 - DNA, 20 bp, human
gcactgggagagggaatagt

SEQ ID NO: 151927 - DNA, 20 bp, human
ggcggtggcgacatgagcag

SEQ ID NO: 151928 - DNA, 20 bp, human
ggtctcggggatccccccaa

SEQ ID NO: 151929 - DNA, 20 bp, human
gaggtagtgggccctcaccc

SEQ ID NO: 151930 - DNA, 20 bp, human
gcggggcggcgtccgggaca

SEQ ID NO: 151931 - DNA, 20 bp, human
gtaagcggggtcttaggcac

SEQ ID NO: 151932 - DNA, 20 bp, human
gtagtgggccctcacccggg

SEQ ID NO: 151933 - DNA, 20 bp, human
gccttcgctaccgcctgcgg

SEQ ID NO: 151934 - DNA, 20 bp, human
gtataggagggtctcagtga

SEQ ID NO: 151935 - DNA, 20 bp, human
gagtgcttagggtccgaatg

SEQ ID NO: 151936 - DNA, 20 bp, human
ggcgctgcggagacgcgtag

SEQ ID NO: 151937 - DNA, 20 bp, human
gctgcgttcggcaggcgctg

SEQ ID NO: 151938 - DNA, 20 bp, human
ggctagagacggtaagtcag

SEQ ID NO: 151939 - DNA, 20 bp, human
ggccgaggccagagacctcc

SEQ ID NO: 151940 - DNA, 20 bp, human
gcccagacggccatttgtgg

SEQ ID NO: 151941 - DNA, 20 bp, human
gggcctcggccagagcaata

SEQ ID NO: 151942 - DNA, 20 bp, human
gctcggccagagcaataagg

SEQ ID NO: 151943 - DNA, 20 bp, human
gagaagcggggtgacggcac

SEQ ID NO: 151944 - DNA, 20 bp, human
gctccggccaggagaagtac

SEQ ID NO: 151945 - DNA, 20 bp, human
gcggcgctggaggctgcgtt

SEQ ID NO: 151946 - DNA, 20 bp, human
ggtgcgcgcgtgtggagtcg

SEQ ID NO: 151947 - DNA, 20 bp, human
gccctgcctacgccccggta

SEQ ID NO: 151948 - DNA, 20 bp, human
ggggccgttcgccagctctg

SEQ ID NO: 151949 - DNA, 20 bp, human
gagcgagcggccggagcgga

SEQ ID NO: 151950 - DNA, 20 bp, human
ggcgcgccctgcctacgccc

SEQ ID NO: 151951 - DNA, 20 bp, human
gccggagcggacggcagacg

SEQ ID NO: 151952 - DNA, 20 bp, human
ggccgcggggtccacaccac

SEQ ID NO: 151953 - DNA, 20 bp, human
gccgcggccgtgcaccatcg

SEQ ID NO: 151954 - DNA, 20 bp, human
ggagcggacggcagacgggg

SEQ ID NO: 151955 - DNA, 20 bp, human
gccgggcaagcgccgtaccg

SEQ ID NO: 151956 - DNA, 20 bp, human
ggggcttcagggagagaccg

SEQ ID NO: 151957 - DNA, 20 bp, human
gtacttatcagggtgagagg

SEQ ID NO: 151958 - DNA, 20 bp, human
ggcgtgcgggcgaggaagct

SEQ ID NO: 151959 - DNA, 20 bp, human
ggtgatgtgtctacttatca

SEQ ID NO: 151960 - DNA, 20 bp, human
gtaccgcgagtcggaatccg

SEQ ID NO: 151961 - DNA, 20 bp, human
gtgatgcgttggggaccggt

SEQ ID NO: 151962 - DNA, 20 bp, human
ggagcgagactccgagcgtg

SEQ ID NO: 151963 - DNA, 20 bp, human
gcggcggcagcgagaagtct

SEQ ID NO: 151964 - DNA, 20 bp, human
ggtctacttatcagggtgag

SEQ ID NO: 151965 - DNA, 20 bp, human
ggtcgtcccggcccccgtct

SEQ ID NO: 151966 - DNA, 20 bp, human
gaaataagagcagtgaagtg

SEQ ID NO: 151967 - DNA, 20 bp, human
gatcgaaggcttattatgaa

SEQ ID NO: 151968 - DNA, 20 bp, human
gtcaaggttggccaataata

SEQ ID NO: 151969 - DNA, 20 bp, human
gagcagttcataattatcga

SEQ ID NO: 151970 - DNA, 20 bp, human
gtaatgtgggtgaaagaata

SEQ ID NO: 151971 - DNA, 20 bp, human
gcaggataaatgacttgtca

SEQ ID NO: 151972 - DNA, 20 bp, human
gtagtgatggccattgccac

SEQ ID NO: 151973 - DNA, 20 bp, human
gccaacgagcaagccaagtc

SEQ ID NO: 151974 - DNA, 20 bp, human
ggttgcaacttacttgatta

SEQ ID NO: 151975 - DNA, 20 bp, human
ggcttgctcgttggtaaatg

SEQ ID NO: 151976 - DNA, 20 bp, human
gtaggttccaggcgctgctc

SEQ ID NO: 151977 - DNA, 20 bp, human
ggactgcggctctaaagcgc

SEQ ID NO: 151978 - DNA, 20 bp, human
gcagcctgaaggcccgaagg

SEQ ID NO: 151979 - DNA, 20 bp, human
gacgaggtgggcgagaagga

SEQ ID NO: 151980 - DNA, 20 bp, human
gtgacagagtgggaagggtt

SEQ ID NO: 151981 - DNA, 20 bp, human
ggctgctcaggggaaagaac

SEQ ID NO: 151982 - DNA, 20 bp, human
gagcgccggcgggatcgaga

SEQ ID NO: 151983 - DNA, 20 bp, human
ggtctgggcatcagctccgg

SEQ ID NO: 151984 - DNA, 20 bp, human
ggcgcagcctgaaggcccga

SEQ ID NO: 151985 - DNA, 20 bp, human
gcaggatgacaaagccgagg

SEQ ID NO: 151986 - DNA, 20 bp, human
gggggagacgcgtgtgagtg

SEQ ID NO: 151987 - DNA, 20 bp, human
gcgcggcgcgggagatttaa

SEQ ID NO: 151988 - DNA, 20 bp, human
gcggagggagagcatagtgg

SEQ ID NO: 151989 - DNA, 20 bp, human
gaggccgccgagaccctcag

SEQ ID NO: 151990 - DNA, 20 bp, human
gcctaggcggcccctcccca

SEQ ID NO: 151991 - DNA, 20 bp, human
gcagagcgagcagccaggac

SEQ ID NO: 151992 - DNA, 20 bp, human
ggggcgcgagcgggacacgg

SEQ ID NO: 151993 - DNA, 20 bp, human
gcagcccctgagggtctcgg

SEQ ID NO: 151994 - DNA, 20 bp, human
ggctgctgcgggtccgtgat

SEQ ID NO: 151995 - DNA, 20 bp, human
gggacaggacggctgggaca

SEQ ID NO: 151996 - DNA, 20 bp, human
ggaagcggccgggctggatc

SEQ ID NO: 151997 - DNA, 20 bp, human
gggagaaacccttaggccgc

SEQ ID NO: 151998 - DNA, 20 bp, human
ggtgaggcggataaacgcag

SEQ ID NO: 151999 - DNA, 20 bp, human
ggtgctgtcgtagttggagg

SEQ ID NO: 152000 - DNA, 20 bp, human
gggcggacccagcggaccag

SEQ ID NO: 152001 - DNA, 20 bp, human
gcgtagttggaggtggcctg

SEQ ID NO: 152002 - DNA, 20 bp, human
gtggccagggctccaaaaca

SEQ ID NO: 152003 - DNA, 20 bp, human
ggctccaaaacagggaagga

SEQ ID NO: 152004 - DNA, 20 bp, human
ggtctgcgcgatgggcgacc

SEQ ID NO: 152005 - DNA, 20 bp, human
ggcagactccgccgaagcta

SEQ ID NO: 152006 - DNA, 20 bp, human
ggtatctgggacgaaagctc

SEQ ID NO: 152007 - DNA, 20 bp, human
gttcgtcccagatacgcaga

SEQ ID NO: 152008 - DNA, 20 bp, human
gcgcttccttctgcgtatct

SEQ ID NO: 152009 - DNA, 20 bp, human
gctgggacgaaagctcagga

SEQ ID NO: 152010 - DNA, 20 bp, human
gcctctgcagttaagaagct

SEQ ID NO: 152011 - DNA, 20 bp, human
gggatgtgggacaaagctca

SEQ ID NO: 152012 - DNA, 20 bp, human
ggataggagcacggggtgga

SEQ ID NO: 152013 - DNA, 20 bp, human
gtgccatgagtgacgacgtt

SEQ ID NO: 152014 - DNA, 20 bp, human
gacgcgtttgccgggagatg

SEQ ID NO: 152015 - DNA, 20 bp, human
gttaactgcagaggacgaag

SEQ ID NO: 152016 - DNA, 20 bp, human
ggttagaacgcgccagaggt

SEQ ID NO: 152017 - DNA, 20 bp, human
gtcactacctggggtcgggg

SEQ ID NO: 152018 - DNA, 20 bp, human
ggtgtgcgcgcgccgacctc

SEQ ID NO: 152019 - DNA, 20 bp, human
ggcgacctgtgacgtctggg

SEQ ID NO: 152020 - DNA, 20 bp, human
gccagcatcggatcccggaa

SEQ ID NO: 152021 - DNA, 20 bp, human
gtcagcgtcagagacacgta

SEQ ID NO: 152022 - DNA, 20 bp, human
gggcgccccccagacgtcac

SEQ ID NO: 152023 - DNA, 20 bp, human
gggcccctctagccccgtgg

SEQ ID NO: 152024 - DNA, 20 bp, human
ggcgggttagaacgcgccag

SEQ ID NO: 152025 - DNA, 20 bp, human
gctgccttcccgggcttcgt

SEQ ID NO: 152026 - DNA, 20 bp, human
gtaccaggcgactccgggac

SEQ ID NO: 152027 - DNA, 20 bp, human
gcggccgagaccccctgtcc

SEQ ID NO: 152028 - DNA, 20 bp, human
ggcaccacgagggaaagcgg

SEQ ID NO: 152029 - DNA, 20 bp, human
gggacgcctgagctaggaaa

SEQ ID NO: 152030 - DNA, 20 bp, human
gagctaggaaaggggttacg

SEQ ID NO: 152031 - DNA, 20 bp, human
ggagtacatggtctactgga

SEQ ID NO: 152032 - DNA, 20 bp, human
gaccgcaccacgagggaaag

SEQ ID NO: 152033 - DNA, 20 bp, human
ggggaggagcgttctcgcag

SEQ ID NO: 152034 - DNA, 20 bp, human
gcccctgtcccggagtcgcc

SEQ ID NO: 152035 - DNA, 20 bp, human
ggactcagcgggccgcaggt

SEQ ID NO: 152036 - DNA, 20 bp, human
ggagcgtgtttctacgtccc

SEQ ID NO: 152037 - DNA, 20 bp, human
gggctacagggtatccacgt

SEQ ID NO: 152038 - DNA, 20 bp, human
gatctggagccctctctgaa

SEQ ID NO: 152039 - DNA, 20 bp, human
gcttaaatgaccggcttcca

SEQ ID NO: 152040 - DNA, 20 bp, human
gagaggaagtgaaggctaca

SEQ ID NO: 152041 - DNA, 20 bp, human
ggccacggcttagtcaacat

SEQ ID NO: 152042 - DNA, 20 bp, human
ggccatctgccgccaccgtc

SEQ ID NO: 152043 - DNA, 20 bp, human
ggaagtgacgccagaagaag

SEQ ID NO: 152044 - DNA, 20 bp, human
gtgacggccggctgaagaag

SEQ ID NO: 152045 - DNA, 20 bp, human
gacccatgttgactaagccg

SEQ ID NO: 152046 - DNA, 20 bp, human
gctcacacgtgagtccggag

SEQ ID NO: 152047 - DNA, 20 bp, human
gacacgtgagtccggagcgg

SEQ ID NO: 152048 - DNA, 20 bp, human
gccggactcacgtgtgagtg

SEQ ID NO: 152049 - DNA, 20 bp, human
gcgcttccggcgcagaaaaa

SEQ ID NO: 152050 - DNA, 20 bp, human
gggagaagaatgggtctcat

SEQ ID NO: 152051 - DNA, 20 bp, human
ggccaccggacgcaactgtc

SEQ ID NO: 152052 - DNA, 20 bp, human
gtgcgtccggtggcaaccag

SEQ ID NO: 152053 - DNA, 20 bp, human
gtcttccagcaccgacgcta

SEQ ID NO: 152054 - DNA, 20 bp, human
gcaaagtcgcccctctgaag

SEQ ID NO: 152055 - DNA, 20 bp, human
ggcgtcggtgctggaagacg

SEQ ID NO: 152056 - DNA, 20 bp, human
ggccgcgactgcacagaagg

SEQ ID NO: 152057 - DNA, 20 bp, human
gtgcagccagccgagcgctg

SEQ ID NO: 152058 - DNA, 20 bp, human
ggcgactgcacagaaggcgg

SEQ ID NO: 152059 - DNA, 20 bp, human
gcgggccgcgactgcacaga

SEQ ID NO: 152060 - DNA, 20 bp, human
gtgtgcagtcgcggcccggg

SEQ ID NO: 152061 - DNA, 20 bp, human
gtccccggccgcgcaacccg

SEQ ID NO: 152062 - DNA, 20 bp, human
ggcgcccgctggagcatccc

SEQ ID NO: 152063 - DNA, 20 bp, human
gttaaggaaacgggttgagg

SEQ ID NO: 152064 - DNA, 20 bp, human
gctggctgcagcggcaccgc

SEQ ID NO: 152065 - DNA, 20 bp, human
gaagggcatccgggaccgag

SEQ ID NO: 152066 - DNA, 20 bp, human
gtggcccgcgacctattgag

SEQ ID NO: 152067 - DNA, 20 bp, human
gcgggagctaactaccgcgc

SEQ ID NO: 152068 - DNA, 20 bp, human
ggtagcgctcggaagacgaa

SEQ ID NO: 152069 - DNA, 20 bp, human
gatcagctggcagtagcgct

SEQ ID NO: 152070 - DNA, 20 bp, human
ggttagctcccggcatcagc

SEQ ID NO: 152071 - DNA, 20 bp, human
gagaggcagacgctacacta

SEQ ID NO: 152072 - DNA, 20 bp, human
ggactgccaagttctctaag

SEQ ID NO: 152073 - DNA, 20 bp, human
gcgctactgccagctgatgc

SEQ ID NO: 152074 - DNA, 20 bp, human
ggagaacttggcagtcttac

SEQ ID NO: 152075 - DNA, 20 bp, human
ggggctgccgtgagcggaag

SEQ ID NO: 152076 - DNA, 20 bp, human
gaagtgcgccgcgcgggacc

SEQ ID NO: 152077 - DNA, 20 bp, human
gctcacctgcgtagcccagt

SEQ ID NO: 152078 - DNA, 20 bp, human
ggccgaaccgcaactcccgg

SEQ ID NO: 152079 - DNA, 20 bp, human
gatgggctcacctggacgag

SEQ ID NO: 152080 - DNA, 20 bp, human
gggctggggatacggtcctc

SEQ ID NO: 152081 - DNA, 20 bp, human
gcaggaggaagtgcgccgcg

SEQ ID NO: 152082 - DNA, 20 bp, human
gcgtccacacccgctcgtcc

SEQ ID NO: 152083 - DNA, 20 bp, human
gtcacctggacgagcgggtg

SEQ ID NO: 152084 - DNA, 20 bp, human
gctgcgtagcccagtgggct

SEQ ID NO: 152085 - DNA, 20 bp, human
gcgcgagaccgggggcggtc

SEQ ID NO: 152086 - DNA, 20 bp, human
gcagccaggggttgctagag

SEQ ID NO: 152087 - DNA, 20 bp, human
gagacctgccagaaccgacc

SEQ ID NO: 152088 - DNA, 20 bp, human
gtcgaacatgagggtcggga

SEQ ID NO: 152089 - DNA, 20 bp, human
gaccaaagcgtgacagccag

SEQ ID NO: 152090 - DNA, 20 bp, human
gtgagcgctccgacttccag

SEQ ID NO: 152091 - DNA, 20 bp, human
gcacgctttggtttccgggt

SEQ ID NO: 152092 - DNA, 20 bp, human
gcacgtgcacagcgctcctc

SEQ ID NO: 152093 - DNA, 20 bp, human
gttggtttccgggtcggttc

SEQ ID NO: 152094 - DNA, 20 bp, human
gttgcggggagggacacctg

SEQ ID NO: 152095 - DNA, 20 bp, human
gcaggccgcgaagcggacat

SEQ ID NO: 152096 - DNA, 20 bp, human
gggcagcatgtcggcaacag

SEQ ID NO: 152097 - DNA, 20 bp, human
gacaaccgtcatcccatcca

SEQ ID NO: 152098 - DNA, 20 bp, human
gccgctgctacacgcctggt

SEQ ID NO: 152099 - DNA, 20 bp, human
gagcggccgcagaactcacg

SEQ ID NO: 152100 - DNA, 20 bp, human
ggggacaggggcaaatccaa

SEQ ID NO: 152101 - DNA, 20 bp, human
gcgcctggtgggcagcatgt

SEQ ID NO: 152102 - DNA, 20 bp, human
gagtcggcctgggaattata

SEQ ID NO: 152103 - DNA, 20 bp, human
gtcccaggccgactctgcgg

SEQ ID NO: 152104 - DNA, 20 bp, human
gccgactctgcgggggacag

SEQ ID NO: 152105 - DNA, 20 bp, human
gggtggcggcaagatgaatg

SEQ ID NO: 152106 - DNA, 20 bp, human
gtggagctgcagtttgacct

SEQ ID NO: 152107 - DNA, 20 bp, human
ggcgcaccgcagcccggtcg

SEQ ID NO: 152108 - DNA, 20 bp, human
gacagtggcggcccaaactc

SEQ ID NO: 152109 - DNA, 20 bp, human
ggatgccgggatgcccaatc

SEQ ID NO: 152110 - DNA, 20 bp, human
ggtgtaagtggccgcggtcg

SEQ ID NO: 152111 - DNA, 20 bp, human
gcgcgtggaagaggcgatag

SEQ ID NO: 152112 - DNA, 20 bp, human
ggccgagccggagccatgga

SEQ ID NO: 152113 - DNA, 20 bp, human
gaccgcggccacttacacgc

SEQ ID NO: 152114 - DNA, 20 bp, human
gctcgcggcaggcgtgtggt

SEQ ID NO: 152115 - DNA, 20 bp, human
gccgggacgacaccaaagaa

SEQ ID NO: 152116 - DNA, 20 bp, human
gccagctctccagttcagta

SEQ ID NO: 152117 - DNA, 20 bp, human
gagctttggccgaggacgag

SEQ ID NO: 152118 - DNA, 20 bp, human
gagatgtcacgcaagataga

SEQ ID NO: 152119 - DNA, 20 bp, human
gaccggaatgctattgacgg

SEQ ID NO: 152120 - DNA, 20 bp, human
gggaatgctattgacggtgg

SEQ ID NO: 152121 - DNA, 20 bp, human
gtaaggtagagctttggccg

SEQ ID NO: 152122 - DNA, 20 bp, human
gggagccttctaaagttcaa

SEQ ID NO: 152123 - DNA, 20 bp, human
ggacatcttcccctcgtcct

SEQ ID NO: 152124 - DNA, 20 bp, human
gcaaaccggaatgctattga

SEQ ID NO: 152125 - DNA, 20 bp, human
gaacttttaggagtcaaagt

SEQ ID NO: 152126 - DNA, 20 bp, human
gggctgcggccacacaccgt

SEQ ID NO: 152127 - DNA, 20 bp, human
ggcccgggctcgcggctggg

SEQ ID NO: 152128 - DNA, 20 bp, human
gcagccggcggaaggaagag

SEQ ID NO: 152129 - DNA, 20 bp, human
gcgcgctgcgctgggcgcca

SEQ ID NO: 152130 - DNA, 20 bp, human
gctgcgcgcgtctcctgctc

SEQ ID NO: 152131 - DNA, 20 bp, human
gatggcgctccccggagccc

SEQ ID NO: 152132 - DNA, 20 bp, human
gcatcccagacctcgtacgg

SEQ ID NO: 152133 - DNA, 20 bp, human
gggagcccgggctcgcggct

SEQ ID NO: 152134 - DNA, 20 bp, human
gtcctgcgttctccacgcgg

SEQ ID NO: 152135 - DNA, 20 bp, human
ggcggcgcactgacccgagc

SEQ ID NO: 152136 - DNA, 20 bp, human
gccaggcatctgccacaatg

SEQ ID NO: 152137 - DNA, 20 bp, human
gggtgtaagcacccacattg

SEQ ID NO: 152138 - DNA, 20 bp, human
gagtggggtaaggcgagaag

SEQ ID NO: 152139 - DNA, 20 bp, human
ggggccagatgagaccaaag

SEQ ID NO: 152140 - DNA, 20 bp, human
ggagcagtctctgtatgcca

SEQ ID NO: 152141 - DNA, 20 bp, human
gccagatgagaccaaagagg

SEQ ID NO: 152142 - DNA, 20 bp, human
gtagttgacgctggttgggg

SEQ ID NO: 152143 - DNA, 20 bp, human
gatcaggattctcaaccact

SEQ ID NO: 152144 - DNA, 20 bp, human
ggcttcccagcaaaagcagc

SEQ ID NO: 152145 - DNA, 20 bp, human
gctggctgctagctaccaag

SEQ ID NO: 152146 - DNA, 20 bp, human
ggcgagatgtgcgcgataaa

SEQ ID NO: 152147 - DNA, 20 bp, human
gcacaggtgagataagatac

SEQ ID NO: 152148 - DNA, 20 bp, human
gcagctctgcaggattagag

SEQ ID NO: 152149 - DNA, 20 bp, human
gccgcggagccgcgcacctg

SEQ ID NO: 152150 - DNA, 20 bp, human
gcacccggcataagccgcag

SEQ ID NO: 152151 - DNA, 20 bp, human
gatctcgcggcgaggaggag

SEQ ID NO: 152152 - DNA, 20 bp, human
ggatgtgcgcgataaacggc

SEQ ID NO: 152153 - DNA, 20 bp, human
gtgagataagatacaggaga

SEQ ID NO: 152154 - DNA, 20 bp, human
gcgataaacggccggcgctc

SEQ ID NO: 152155 - DNA, 20 bp, human
gcacaggtgagtgagtgcac

SEQ ID NO: 152156 - DNA, 20 bp, human
gggaggagccggacaaagag

SEQ ID NO: 152157 - DNA, 20 bp, human
gatggctgcgcaggtcggag

SEQ ID NO: 152158 - DNA, 20 bp, human
ggcggtgcgcgtagtacggg

SEQ ID NO: 152159 - DNA, 20 bp, human
gggagcggtgcgcgtagtac

SEQ ID NO: 152160 - DNA, 20 bp, human
gcggccgcgctcaccgtcag

SEQ ID NO: 152161 - DNA, 20 bp, human
gcgcgtagtacgggcggtgg

SEQ ID NO: 152162 - DNA, 20 bp, human
ggtgcgcgtagtacgggcgg

SEQ ID NO: 152163 - DNA, 20 bp, human
gggagctgggatcaccatcg

SEQ ID NO: 152164 - DNA, 20 bp, human
gcggcagcggcccaggatgt

SEQ ID NO: 152165 - DNA, 20 bp, human
ggtgaaatggctgcgcaggt

SEQ ID NO: 152166 - DNA, 20 bp, human
gcacagtgcacggggctcgg

SEQ ID NO: 152167 - DNA, 20 bp, human
gcaacaggagcgcaaaatgg

SEQ ID NO: 152168 - DNA, 20 bp, human
gcgcggcaccggctgagaca

SEQ ID NO: 152169 - DNA, 20 bp, human
gggagagtgaacggagaagg

SEQ ID NO: 152170 - DNA, 20 bp, human
gagcgtgcagcagcgtagga

SEQ ID NO: 152171 - DNA, 20 bp, human
gcggcagcgacacagtgcac

SEQ ID NO: 152172 - DNA, 20 bp, human
gggctgagacaaggaagcgg

SEQ ID NO: 152173 - DNA, 20 bp, human
ggcctcccgggaggagaacg

SEQ ID NO: 152174 - DNA, 20 bp, human
ggccaagtcgcgcagaccta

SEQ ID NO: 152175 - DNA, 20 bp, human
ggtccggactgaggagaaga

SEQ ID NO: 152176 - DNA, 20 bp, human
gccttgagcttcctgaagaa

SEQ ID NO: 152177 - DNA, 20 bp, human
ggaattaagcaaagtaacta

SEQ ID NO: 152178 - DNA, 20 bp, human
gtttcacctagaaacatctg

SEQ ID NO: 152179 - DNA, 20 bp, human
ggcaccaatgttcttgacat

SEQ ID NO: 152180 - DNA, 20 bp, human
ggtttctaggtgaaaaggat

SEQ ID NO: 152181 - DNA, 20 bp, human
gtcagcagcacgaagaacca

SEQ ID NO: 152182 - DNA, 20 bp, human
gatgtttctacttccatcaa

SEQ ID NO: 152183 - DNA, 20 bp, human
gtctgctgaaagaagcaccc

SEQ ID NO: 152184 - DNA, 20 bp, human
ggaatatctttgtaacatag

SEQ ID NO: 152185 - DNA, 20 bp, human
gagatgaaatttgaggccct

SEQ ID NO: 152186 - DNA, 20 bp, human
gaagttgtggtgccgaggga

SEQ ID NO: 152187 - DNA, 20 bp, human
gcgatcccacaatacatcgg

SEQ ID NO: 152188 - DNA, 20 bp, human
ggaagttggggcacgaaccc

SEQ ID NO: 152189 - DNA, 20 bp, human
gggcgttgcgggctaggtgt

SEQ ID NO: 152190 - DNA, 20 bp, human
gtccaagaaggagcagacta

SEQ ID NO: 152191 - DNA, 20 bp, human
gcgcggagaagcagtccccg

SEQ ID NO: 152192 - DNA, 20 bp, human
gcggcggtgatggctcctcc

SEQ ID NO: 152193 - DNA, 20 bp, human
gcagttcaaaatggcgacgg

SEQ ID NO: 152194 - DNA, 20 bp, human
gttcaaaatggcgacggcgg

SEQ ID NO: 152195 - DNA, 20 bp, human
gcccgagccgcgaagaaccg

SEQ ID NO: 152196 - DNA, 20 bp, human
ggctaggtagccctgggagt

SEQ ID NO: 152197 - DNA, 20 bp, human
ggctgtgtgaataccctcca

SEQ ID NO: 152198 - DNA, 20 bp, human
ggccccccgggagagtcaga

SEQ ID NO: 152199 - DNA, 20 bp, human
ggcaccgcgacggggtaggg

SEQ ID NO: 152200 - DNA, 20 bp, human
ggacccccggaggtgacaag

SEQ ID NO: 152201 - DNA, 20 bp, human
gtggcgggctagaggaaagg

SEQ ID NO: 152202 - DNA, 20 bp, human
gatggctgggcaccgcgacg

SEQ ID NO: 152203 - DNA, 20 bp, human
gtccccgtcagcagtcccgg

SEQ ID NO: 152204 - DNA, 20 bp, human
gtgggcaccgcgacggggta

SEQ ID NO: 152205 - DNA, 20 bp, human
ggtcgggatctagaaggtag

SEQ ID NO: 152206 - DNA, 20 bp, human
gtgctcggcggacttccccg

SEQ ID NO: 152207 - DNA, 20 bp, human
ggtgtggcggttacctcgtg

SEQ ID NO: 152208 - DNA, 20 bp, human
gcgaggtggaaacaagatgg

SEQ ID NO: 152209 - DNA, 20 bp, human
ggaggtggaggttccagtag

SEQ ID NO: 152210 - DNA, 20 bp, human
gtcacgaggtggaaacaaga

SEQ ID NO: 152211 - DNA, 20 bp, human
ggcggctgcagaagacagcg

SEQ ID NO: 152212 - DNA, 20 bp, human
gcggtcaagcgctaatgata

SEQ ID NO: 152213 - DNA, 20 bp, human
gcacgcgcctcttcacgagg

SEQ ID NO: 152214 - DNA, 20 bp, human
ggccgctggagtcgaggtgg

SEQ ID NO: 152215 - DNA, 20 bp, human
ggcacacgcgcctcttcacg

SEQ ID NO: 152216 - DNA, 20 bp, human
gccagaccggtcttacactc

SEQ ID NO: 152217 - DNA, 20 bp, human
ggacccccggagtgtaagac

SEQ ID NO: 152218 - DNA, 20 bp, human
gatgatgtggcacctgaaag

SEQ ID NO: 152219 - DNA, 20 bp, human
ggaccggtcttacactccgg

SEQ ID NO: 152220 - DNA, 20 bp, human
gacacctagtcccaaccggt

SEQ ID NO: 152221 - DNA, 20 bp, human
gccagctaatgaaaaagtag

SEQ ID NO: 152222 - DNA, 20 bp, human
gtcccacagctggtaccaat

SEQ ID NO: 152223 - DNA, 20 bp, human
gcaccacacctagtcccaac

SEQ ID NO: 152224 - DNA, 20 bp, human
gtcataatggattggttcag

SEQ ID NO: 152225 - DNA, 20 bp, human
gtcctattggtaccagctgt

SEQ ID NO: 152226 - DNA, 20 bp, human
ggaggaacccgggccaaaca

SEQ ID NO: 152227 - DNA, 20 bp, human
ggacatccaagattcctggt

SEQ ID NO: 152228 - DNA, 20 bp, human
gtagcgcctaccaggaatct

SEQ ID NO: 152229 - DNA, 20 bp, human
gtgccgtgtccaggatagat

SEQ ID NO: 152230 - DNA, 20 bp, human
gcaaggagaaacccccgaag

SEQ ID NO: 152231 - DNA, 20 bp, human
gcgctgccaacgccacccaa

SEQ ID NO: 152232 - DNA, 20 bp, human
gctcccaggggaacaacggg

SEQ ID NO: 152233 - DNA, 20 bp, human
gctgggagggtggcttaact

SEQ ID NO: 152234 - DNA, 20 bp, human
gtgccaacgccacccaaggg

SEQ ID NO: 152235 - DNA, 20 bp, human
ggcttggcgtttgtttggtg

SEQ ID NO: 152236 - DNA, 20 bp, human
gcgcagcgcctctagcaggt

SEQ ID NO: 152237 - DNA, 20 bp, human
ggcggctgtgatccaggctg

SEQ ID NO: 152238 - DNA, 20 bp, human
gtccgagcccaggtccgaca

SEQ ID NO: 152239 - DNA, 20 bp, human
gcacagctccccaggatccc

SEQ ID NO: 152240 - DNA, 20 bp, human
ggttgctacccacctgctag

SEQ ID NO: 152241 - DNA, 20 bp, human
gggcgctgcggctgtgatcc

SEQ ID NO: 152242 - DNA, 20 bp, human
ggcgagaccatgtcggacct

SEQ ID NO: 152243 - DNA, 20 bp, human
gctcgatgggaattaacaca

SEQ ID NO: 152244 - DNA, 20 bp, human
ggggtgggggaagaacgagg

SEQ ID NO: 152245 - DNA, 20 bp, human
ggacttattcaagggcagta

SEQ ID NO: 152246 - DNA, 20 bp, human
gtcagcacgttgaagggcca

SEQ ID NO: 152247 - DNA, 20 bp, human
gtaggctgatctccctctcc

SEQ ID NO: 152248 - DNA, 20 bp, human
gacaagatggcaacaccact

SEQ ID NO: 152249 - DNA, 20 bp, human
ggcgatctcagcacgttgaa

SEQ ID NO: 152250 - DNA, 20 bp, human
gttgccttgggaagatccaa

SEQ ID NO: 152251 - DNA, 20 bp, human
ggcatctcactacgtggcct

SEQ ID NO: 152252 - DNA, 20 bp, human
ggattatcagagagagatga

SEQ ID NO: 152253 - DNA, 20 bp, human
gagcaatgggacaccagctg

SEQ ID NO: 152254 - DNA, 20 bp, human
gggcaagagatgtccccagc

SEQ ID NO: 152255 - DNA, 20 bp, human
gggggacatctcttgcctag

SEQ ID NO: 152256 - DNA, 20 bp, human
gtcctgtgtctacggtgagc

SEQ ID NO: 152257 - DNA, 20 bp, human
ggcagggagccgattcttcc

SEQ ID NO: 152258 - DNA, 20 bp, human
gtggctgtcccggcgtacgc

SEQ ID NO: 152259 - DNA, 20 bp, human
gccgcggtcctgcgtacgcc

SEQ ID NO: 152260 - DNA, 20 bp, human
gtcgctgagacagtagtcgg

SEQ ID NO: 152261 - DNA, 20 bp, human
gcgagcccggcgaggtctct

SEQ ID NO: 152262 - DNA, 20 bp, human
gcgggggcgggaaggagcaa

SEQ ID NO: 152263 - DNA, 20 bp, human
gccctgggtcccctagccca

SEQ ID NO: 152264 - DNA, 20 bp, human
gcccggctcaccgtagacac

SEQ ID NO: 152265 - DNA, 20 bp, human
gggccgggcagaccagtgca

SEQ ID NO: 152266 - DNA, 20 bp, human
gagaatggactcttcgtatt

SEQ ID NO: 152267 - DNA, 20 bp, human
gatggactcttcgtattggg

SEQ ID NO: 152268 - DNA, 20 bp, human
gttgccttgggaagatccaa

SEQ ID NO: 152269 - DNA, 20 bp, human
ggattatcagagagagatga

SEQ ID NO: 152270 - DNA, 20 bp, human
gctggcagtgttatacccga

SEQ ID NO: 152271 - DNA, 20 bp, human
ggaaaaaagcagacaaaaaa

SEQ ID NO: 152272 - DNA, 20 bp, human
gtataacactgccagtcagg

SEQ ID NO: 152273 - DNA, 20 bp, human
ggaccaaactcatagtggaa

SEQ ID NO: 152274 - DNA, 20 bp, human
gacaagatggcaacaccact

SEQ ID NO: 152275 - DNA, 20 bp, human
gattctgaccaaactcatag

SEQ ID NO: 152276 - DNA, 20 bp, human
gtcagcacgttgaagggcca

SEQ ID NO: 152277 - DNA, 20 bp, human
gacaagatggcaacaccact

SEQ ID NO: 152278 - DNA, 20 bp, human
gttgccttgggaagatccaa

SEQ ID NO: 152279 - DNA, 20 bp, human
gtaggctgatctccctctcc

SEQ ID NO: 152280 - DNA, 20 bp, human
ggattatcagagagagatga

SEQ ID NO: 152281 - DNA, 20 bp, human
ggcgatctcagcacgttgaa

SEQ ID NO: 152282 - DNA, 20 bp, human
ggcatctcactacgtggcct

SEQ ID NO: 152283 - DNA, 20 bp, human
gggcaagagatgtccccagc

SEQ ID NO: 152284 - DNA, 20 bp, human
gagcaatgggacaccagctg

SEQ ID NO: 152285 - DNA, 20 bp, human
gggggacatctcttgcctag

SEQ ID NO: 152286 - DNA, 20 bp, human
ggcagggagccgattcttct

SEQ ID NO: 152287 - DNA, 20 bp, human
gtggctgtcccggcgtaggc

SEQ ID NO: 152288 - DNA, 20 bp, human
gccgcggtcctgcctacgcc

SEQ ID NO: 152289 - DNA, 20 bp, human
gtcgctgagacagtagtcgg

SEQ ID NO: 152290 - DNA, 20 bp, human
gcgagcccggcgaggtctct

SEQ ID NO: 152291 - DNA, 20 bp, human
ggccatggctgtcccggcgt

SEQ ID NO: 152292 - DNA, 20 bp, human
gcgggggcgggaaggagcaa

SEQ ID NO: 152293 - DNA, 20 bp, human
gccctgggtcccctagccca

SEQ ID NO: 152294 - DNA, 20 bp, human
gttagaggtgagagcacctt

SEQ ID NO: 152295 - DNA, 20 bp, human
gggccgggcagaccagtgca

SEQ ID NO: 152296 - DNA, 20 bp, human
gatggactcttcgtattggc

SEQ ID NO: 152297 - DNA, 20 bp, human
gttgccttgggaagatccaa

SEQ ID NO: 152298 - DNA, 20 bp, human
ggattatcagagagagatga

SEQ ID NO: 152299 - DNA, 20 bp, human
ggaaaaaagcagacaaaaaa

SEQ ID NO: 152300 - DNA, 20 bp, human
gctggcagtgttatacccga

SEQ ID NO: 152301 - DNA, 20 bp, human
gtataacactgccagtcagg

SEQ ID NO: 152302 - DNA, 20 bp, human
gacaagatggcaacaccact

SEQ ID NO: 152303 - DNA, 20 bp, human
gcagaatggactcttcgtat

SEQ ID NO: 152304 - DNA, 20 bp, human
ggaccaaactcatagtggaa

SEQ ID NO: 152305 - DNA, 20 bp, human
gattctgaccaaactcatag

SEQ ID NO: 152306 - DNA, 20 bp, human
gaggaggtgggagctatact

SEQ ID NO: 152307 - DNA, 20 bp, human
ggcaggagccgggagacacc

SEQ ID NO: 152308 - DNA, 20 bp, human
gcccccgcagctggtctctg

SEQ ID NO: 152309 - DNA, 20 bp, human
gtcggttgcccagcaaccca

SEQ ID NO: 152310 - DNA, 20 bp, human
gccgggcacgtaacagagct

SEQ ID NO: 152311 - DNA, 20 bp, human
gcgaggagaggcgacaacaa

SEQ ID NO: 152312 - DNA, 20 bp, human
gggagaggcgacaacaaggg

SEQ ID NO: 152313 - DNA, 20 bp, human
gcaggggcgtgttatcgcgg

SEQ ID NO: 152314 - DNA, 20 bp, human
gcgcccccagacagaaccct

SEQ ID NO: 152315 - DNA, 20 bp, human
gaggaagctcttccccgccc

SEQ ID NO: 152316 - DNA, 20 bp, human
ggaaatcgcttaagagaccg

SEQ ID NO: 152317 - DNA, 20 bp, human
gccggccagacaagacctcg

SEQ ID NO: 152318 - DNA, 20 bp, human
gtggtcctgtccgactgagg

SEQ ID NO: 152319 - DNA, 20 bp, human
gccaagggctcagacgactc

SEQ ID NO: 152320 - DNA, 20 bp, human
ggtcccgcggggccacccag

SEQ ID NO: 152321 - DNA, 20 bp, human
gggcgtgaaaatatggaaga

SEQ ID NO: 152322 - DNA, 20 bp, human
gagggctcccgcggagagac

SEQ ID NO: 152323 - DNA, 20 bp, human
gggtgccgcgaggtcttgtc

SEQ ID NO: 152324 - DNA, 20 bp, human
gagactgcgggctccaagga

SEQ ID NO: 152325 - DNA, 20 bp, human
gctcgcggcaccacctcagt

SEQ ID NO: 152326 - DNA, 20 bp, human
gctcggtgctcagaaaccgg

SEQ ID NO: 152327 - DNA, 20 bp, human
gaaccggcggtgtcgacagg

SEQ ID NO: 152328 - DNA, 20 bp, human
gccaggaggcacagatctct

SEQ ID NO: 152329 - DNA, 20 bp, human
gttctgagcaccgagagagg

SEQ ID NO: 152330 - DNA, 20 bp, human
gcgctccccgcgccctccac

SEQ ID NO: 152331 - DNA, 20 bp, human
ggaaaggcttgcagacaagg

SEQ ID NO: 152332 - DNA, 20 bp, human
gtctctcggtgctcagaaac

SEQ ID NO: 152333 - DNA, 20 bp, human
gagaaaccggcggtgtcgac

SEQ ID NO: 152334 - DNA, 20 bp, human
ggctgaggctggaactctga

SEQ ID NO: 152335 - DNA, 20 bp, human
gccgcgccctccacgggtaa

SEQ ID NO: 152336 - DNA, 20 bp, human
ggctagggcggagcctgaga

SEQ ID NO: 152337 - DNA, 20 bp, human
gtcggcgtccatcaggtcag

SEQ ID NO: 152338 - DNA, 20 bp, human
ggagcttcaggtctccatgg

SEQ ID NO: 152339 - DNA, 20 bp, human
gagcggagccgctgacctga

SEQ ID NO: 152340 - DNA, 20 bp, human
gtcggaatctgaggctaggg

SEQ ID NO: 152341 - DNA, 20 bp, human
ggggcctggggacggtcaag

SEQ ID NO: 152342 - DNA, 20 bp, human
gcaactcgacgggcgttgag

SEQ ID NO: 152343 - DNA, 20 bp, human
gagcgtccagctaggcggaa

SEQ ID NO: 152344 - DNA, 20 bp, human
ggcttctcctagcaactcga

SEQ ID NO: 152345 - DNA, 20 bp, human
gcagcgaggcccgacggtcc

SEQ ID NO: 152346 - DNA, 20 bp, human
gggagcgaccggccagagta

SEQ ID NO: 152347 - DNA, 20 bp, human
gcgggtgctgcggagaacga

SEQ ID NO: 152348 - DNA, 20 bp, human
ggacggagagcaccagcgca

SEQ ID NO: 152349 - DNA, 20 bp, human
gccggtcggcgatcaggaca

SEQ ID NO: 152350 - DNA, 20 bp, human
ggcagagagcccggagcgac

SEQ ID NO: 152351 - DNA, 20 bp, human
ggggagctccggccgagcgg

SEQ ID NO: 152352 - DNA, 20 bp, human
ggagctcccagcccggagag

SEQ ID NO: 152353 - DNA, 20 bp, human
gtgcgtggggggagacagaa

SEQ ID NO: 152354 - DNA, 20 bp, human
gcagagtagggcatccgctc

SEQ ID NO: 152355 - DNA, 20 bp, human
ggtgctgccagtcgcgacgg

SEQ ID NO: 152356 - DNA, 20 bp, human
ggaggacgaagtgatccgaa

SEQ ID NO: 152357 - DNA, 20 bp, human
gaaggcagaacgctctcggg

SEQ ID NO: 152358 - DNA, 20 bp, human
gtagaaggcagaacgctctc

SEQ ID NO: 152359 - DNA, 20 bp, human
gcccgagacgtgcgcacggt

SEQ ID NO: 152360 - DNA, 20 bp, human
gcggggacggagcatcccag

SEQ ID NO: 152361 - DNA, 20 bp, human
ggaagtgatccgaagggatg

SEQ ID NO: 152362 - DNA, 20 bp, human
gaggcgcggtgctccatccc

SEQ ID NO: 152363 - DNA, 20 bp, human
gagccggtctgcatctccat

SEQ ID NO: 152364 - DNA, 20 bp, human
gagccgcttggttagcacgt

SEQ ID NO: 152365 - DNA, 20 bp, human
gttccgatggagatgcagac

SEQ ID NO: 152366 - DNA, 20 bp, human
gcgggagcccagcccaacac

SEQ ID NO: 152367 - DNA, 20 bp, human
ggcgggcgccgtcggcacag

SEQ ID NO: 152368 - DNA, 20 bp, human
gtcccgggagcaccacatag

SEQ ID NO: 152369 - DNA, 20 bp, human
gaggagaagtcccgctgctc

SEQ ID NO: 152370 - DNA, 20 bp, human
gccgcaggtagcatgttgtg

SEQ ID NO: 152371 - DNA, 20 bp, human
gcacgcctatcggatgtgag

SEQ ID NO: 152372 - DNA, 20 bp, human
gcccgcccggatcccgcctg

SEQ ID NO: 152373 - DNA, 20 bp, human
ggccatggccgctgtgccga

SEQ ID NO: 152374 - DNA, 20 bp, human
gatagacagtgcccgagcag

SEQ ID NO: 152375 - DNA, 20 bp, human
gtgtgatggcaagcgaagtg

SEQ ID NO: 152376 - DNA, 20 bp, human
gcggccgccaggtctagtga

SEQ ID NO: 152377 - DNA, 20 bp, human
gacgccctcactagacctgg

SEQ ID NO: 152378 - DNA, 20 bp, human
gcgccaggcgcgggtcggtc

SEQ ID NO: 152379 - DNA, 20 bp, human
gcttggcccaccctactcaa

SEQ ID NO: 152380 - DNA, 20 bp, human
ggcccaagggccccacgtcc

SEQ ID NO: 152381 - DNA, 20 bp, human
ggcgagccattgagtagggt

SEQ ID NO: 152382 - DNA, 20 bp, human
ggactcacccagaagggaga

SEQ ID NO: 152383 - DNA, 20 bp, human
gttcagggcgagcatgtcca

SEQ ID NO: 152384 - DNA, 20 bp, human
ggcatccgccaggcgcgggt

SEQ ID NO: 152385 - DNA, 20 bp, human
gcagaagggagagggtagca

SEQ ID NO: 152386 - DNA, 20 bp, human
gtgtgacaggtccgagagaa

SEQ ID NO: 152387 - DNA, 20 bp, human
ggggtgggctctgcgcgtaa

SEQ ID NO: 152388 - DNA, 20 bp, human
gaaagatggacgcgaggcca

SEQ ID NO: 152389 - DNA, 20 bp, human
gtccgagagaacggcaaaga

SEQ ID NO: 152390 - DNA, 20 bp, human
gcaccagaagaggttcttgg

SEQ ID NO: 152391 - DNA, 20 bp, human
gctgggcacgcggaacggga

SEQ ID NO: 152392 - DNA, 20 bp, human
ggggctggggcggtacgaag

SEQ ID NO: 152393 - DNA, 20 bp, human
ggagtaggtcaggaccccat

SEQ ID NO: 152394 - DNA, 20 bp, human
gaccggactggggccggggt

SEQ ID NO: 152395 - DNA, 20 bp, human
gcggtaccaggagccacccc

SEQ ID NO: 152396 - DNA, 20 bp, human
gtggtggctgtagggtgggt

SEQ ID NO: 152397 - DNA, 20 bp, human
ggtgtgagccagaaagggta

SEQ ID NO: 152398 - DNA, 20 bp, human
ggtcaaggctggtggctgta

SEQ ID NO: 152399 - DNA, 20 bp, human
gtcctcactagctctaggta

SEQ ID NO: 152400 - DNA, 20 bp, human
ggagctccgaggccctgatc

SEQ ID NO: 152401 - DNA, 20 bp, human
ggctgcctggcgctagaacc

SEQ ID NO: 152402 - DNA, 20 bp, human
gcaagttcggtggacgccgg

SEQ ID NO: 152403 - DNA, 20 bp, human
gaggaacgtggggcgagggg

SEQ ID NO: 152404 - DNA, 20 bp, human
ggcgcttgcacgtcaacggg

SEQ ID NO: 152405 - DNA, 20 bp, human
ggagtcgtttctttagatca

SEQ ID NO: 152406 - DNA, 20 bp, human
ggcgcgagcgatttagtctg

SEQ ID NO: 152407 - DNA, 20 bp, human
gctcgcgcgagagacccgga

SEQ ID NO: 152408 - DNA, 20 bp, human
gctgaggcgaagcttcggag

SEQ ID NO: 152409 - DNA, 20 bp, human
gagagacccggatggcacaa

SEQ ID NO: 152410 - DNA, 20 bp, human
ggtgaggcgaaaggaacgta

SEQ ID NO: 152411 - DNA, 20 bp, human
gatcgctcgcgcgagagacc

SEQ ID NO: 152412 - DNA, 20 bp, human
gagagtcccggccgctagag

SEQ ID NO: 152413 - DNA, 20 bp, human
gcggccgggactctgaacta

SEQ ID NO: 152414 - DNA, 20 bp, human
gtgttgaaagcgacaagtgg

SEQ ID NO: 152415 - DNA, 20 bp, human
gggtgaataagcgaaaatgg

SEQ ID NO: 152416 - DNA, 20 bp, human
gaggtggacatgagtgaccg

SEQ ID NO: 152417 - DNA, 20 bp, human
gggcgtgcaaccacaagctt

SEQ ID NO: 152418 - DNA, 20 bp, human
gaggtagcccctaagacgat

SEQ ID NO: 152419 - DNA, 20 bp, human
gtgcgcggggcgccgagaca

SEQ ID NO: 152420 - DNA, 20 bp, human
gcgggagaagaaccagcccg

SEQ ID NO: 152421 - DNA, 20 bp, human
gggccttcgctgccactctg

SEQ ID NO: 152422 - DNA, 20 bp, human
gccactctgaggcttcccca

SEQ ID NO: 152423 - DNA, 20 bp, human
ggttcagtgccggtgttgca

SEQ ID NO: 152424 - DNA, 20 bp, human
gccccagggttggagcgggt

SEQ ID NO: 152425 - DNA, 20 bp, human
ggagaagaaccagcccgagg

SEQ ID NO: 152426 - DNA, 20 bp, human
ggaggccgctaagacacctc

SEQ ID NO: 152427 - DNA, 20 bp, human
gtggctggattggggtctag

SEQ ID NO: 152428 - DNA, 20 bp, human
gaatccagccaacaggtgag

SEQ ID NO: 152429 - DNA, 20 bp, human
gtggcactgaagggacatag

SEQ ID NO: 152430 - DNA, 20 bp, human
gggatcctgaggtgtcttag

SEQ ID NO: 152431 - DNA, 20 bp, human
gggaaactggctgctgaaag

SEQ ID NO: 152432 - DNA, 20 bp, human
gagaccccaatccagccaac

SEQ ID NO: 152433 - DNA, 20 bp, human
gaggtgacccagagaagggc

SEQ ID NO: 152434 - DNA, 20 bp, human
gtggcccctaagccgattgt

SEQ ID NO: 152435 - DNA, 20 bp, human
ggtgggagatcctgctggat

SEQ ID NO: 152436 - DNA, 20 bp, human
gctaggtgcctgtccaatta

SEQ ID NO: 152437 - DNA, 20 bp, human
gccgggacgcccccacccat

SEQ ID NO: 152438 - DNA, 20 bp, human
gcctactgccctaattggac

SEQ ID NO: 152439 - DNA, 20 bp, human
ggttagcgtcccgaacctat

SEQ ID NO: 152440 - DNA, 20 bp, human
gagcgtcccgaacctatggg

SEQ ID NO: 152441 - DNA, 20 bp, human
gcggcgccgatggccccgag

SEQ ID NO: 152442 - DNA, 20 bp, human
gctaaccgcggggaacgctg

SEQ ID NO: 152443 - DNA, 20 bp, human
gccgaggggcatgagcccta

SEQ ID NO: 152444 - DNA, 20 bp, human
gcctcaggcgatcctcgagg

SEQ ID NO: 152445 - DNA, 20 bp, human
ggcagtaggaagaatcctga

SEQ ID NO: 152446 - DNA, 20 bp, human
ggcgccccaggcatgaacca

SEQ ID NO: 152447 - DNA, 20 bp, human
gcaggagcctgacgagaaag

SEQ ID NO: 152448 - DNA, 20 bp, human
ggccaggcctgaggtaaatc

SEQ ID NO: 152449 - DNA, 20 bp, human
gctgactccagtgtcccgag

SEQ ID NO: 152450 - DNA, 20 bp, human
gcggggctgcagcctaacta

SEQ ID NO: 152451 - DNA, 20 bp, human
gcgggagaaagaagagacgt

SEQ ID NO: 152452 - DNA, 20 bp, human
gctgcagcctaactaaggag

SEQ ID NO: 152453 - DNA, 20 bp, human
gcgtgaagctgggggatcgg

SEQ ID NO: 152454 - DNA, 20 bp, human
gcgcaggtatgggcgatcca

SEQ ID NO: 152455 - DNA, 20 bp, human
gaggtttctgaactactggg

SEQ ID NO: 152456 - DNA, 20 bp, human
gaagccggactacgcggcag

SEQ ID NO: 152457 - DNA, 20 bp, human
ggccggggacggagcacgga

SEQ ID NO: 152458 - DNA, 20 bp, human
gcggcagcggctcttcaaag

SEQ ID NO: 152459 - DNA, 20 bp, human
gtctgagaagccggactacg

SEQ ID NO: 152460 - DNA, 20 bp, human
ggagccgctgccgcgtagtc

SEQ ID NO: 152461 - DNA, 20 bp, human
ggggcggacccagtggtcag

SEQ ID NO: 152462 - DNA, 20 bp, human
ggtggtcaggggaggtccag

SEQ ID NO: 152463 - DNA, 20 bp, human
gttatagctgcgactcatgg

SEQ ID NO: 152464 - DNA, 20 bp, human
gcacgaggacaagctaagtg

SEQ ID NO: 152465 - DNA, 20 bp, human
ggagaggtccccgaaccacg

SEQ ID NO: 152466 - DNA, 20 bp, human
ggcgggacaccagatgacaa

SEQ ID NO: 152467 - DNA, 20 bp, human
gtgtcgcctggcaactgaat

SEQ ID NO: 152468 - DNA, 20 bp, human
ggaagcagaaagggctgcgg

SEQ ID NO: 152469 - DNA, 20 bp, human
ggcgactccagcagcgtccg

SEQ ID NO: 152470 - DNA, 20 bp, human
ggcctggcaactgaataggt

SEQ ID NO: 152471 - DNA, 20 bp, human
ggcccacgccgcttagaaga

SEQ ID NO: 152472 - DNA, 20 bp, human
gacgtaagcctggcatacca

SEQ ID NO: 152473 - DNA, 20 bp, human
gggacaggccacaggcctgt

SEQ ID NO: 152474 - DNA, 20 bp, human
gctcccctcacaggaacggt

SEQ ID NO: 152475 - DNA, 20 bp, human
gaccagggcttcagctatgt

SEQ ID NO: 152476 - DNA, 20 bp, human
gctggctgacagctggggac

SEQ ID NO: 152477 - DNA, 20 bp, human
gacgggtggcggccctcgac

SEQ ID NO: 152478 - DNA, 20 bp, human
gacgcggacacactgaatgt

SEQ ID NO: 152479 - DNA, 20 bp, human
gcgacccgcggccccgaggg

SEQ ID NO: 152480 - DNA, 20 bp, human
ggccagctcagagttttcgc

SEQ ID NO: 152481 - DNA, 20 bp, human
gcacgagcgcaggaaactac

SEQ ID NO: 152482 - DNA, 20 bp, human
ggcaacggaccggaagtggg

SEQ ID NO: 152483 - DNA, 20 bp, human
gggagcacaaagcaacggac

SEQ ID NO: 152484 - DNA, 20 bp, human
ggttgtggggcgggaggata

SEQ ID NO: 152485 - DNA, 20 bp, human
ggacttccacaagagcgtga

SEQ ID NO: 152486 - DNA, 20 bp, human
ggcgggccggcggagccaga

SEQ ID NO: 152487 - DNA, 20 bp, human
gcggagccagagggctgtcg

SEQ ID NO: 152488 - DNA, 20 bp, human
ggcggcagtggcggtcccac

SEQ ID NO: 152489 - DNA, 20 bp, human
gcgctgctcgacccacacaa

SEQ ID NO: 152490 - DNA, 20 bp, human
ggcgggcaagaggggagtcc

SEQ ID NO: 152491 - DNA, 20 bp, human
gactggcaggcgggcaagag

SEQ ID NO: 152492 - DNA, 20 bp, human
gccccgagcccgaggcccaa

SEQ ID NO: 152493 - DNA, 20 bp, human
gatcttccggggccagatcg

SEQ ID NO: 152494 - DNA, 20 bp, human
gccaaggcgccaagtcctcg

SEQ ID NO: 152495 - DNA, 20 bp, human
gatctggccccggaagatcg

SEQ ID NO: 152496 - DNA, 20 bp, human
ggtcctgcgatgggttgcga

SEQ ID NO: 152497 - DNA, 20 bp, human
gctgcgatgggttgcgacgg

SEQ ID NO: 152498 - DNA, 20 bp, human
gctgactcccgtcctgcgat

SEQ ID NO: 152499 - DNA, 20 bp, human
ggacgaccccagaaaacgag

SEQ ID NO: 152500 - DNA, 20 bp, human
gttgctactagtcgcaggta

SEQ ID NO: 152501 - DNA, 20 bp, human
gagaggcatgaactggtgaa

SEQ ID NO: 152502 - DNA, 20 bp, human
gacgagaggaagtaagaagg

SEQ ID NO: 152503 - DNA, 20 bp, human
gggacagtaatcttaacagg

SEQ ID NO: 152504 - DNA, 20 bp, human
gagtaagaagggggagccag

SEQ ID NO: 152505 - DNA, 20 bp, human
gctggtgaaggggccgaaga

SEQ ID NO: 152506 - DNA, 20 bp, human
ggacagaagccgaggagagg

SEQ ID NO: 152507 - DNA, 20 bp, human
gcgtcgagagacagaagccg

SEQ ID NO: 152508 - DNA, 20 bp, human
gagattcccggccggactgg

SEQ ID NO: 152509 - DNA, 20 bp, human
gcgggagccgcggaagggga

SEQ ID NO: 152510 - DNA, 20 bp, human
gccccgcagcgggagattcc

SEQ ID NO: 152511 - DNA, 20 bp, human
gcctaaccaggccgcggaat

SEQ ID NO: 152512 - DNA, 20 bp, human
ggggagattcccggccggac

SEQ ID NO: 152513 - DNA, 20 bp, human
gctcgggcaggtcgctgaag

SEQ ID NO: 152514 - DNA, 20 bp, human
gcaggcagataatcctaacc

SEQ ID NO: 152515 - DNA, 20 bp, human
gctcgtccgccagtccggcc

SEQ ID NO: 152516 - DNA, 20 bp, human
ggagtgaagtgtgactccgt

SEQ ID NO: 152517 - DNA, 20 bp, human
gtgcagctggctcggaatcg

SEQ ID NO: 152518 - DNA, 20 bp, human
gacacaggtgaggacctcag

SEQ ID NO: 152519 - DNA, 20 bp, human
gggttggagcttcccgagag

SEQ ID NO: 152520 - DNA, 20 bp, human
gggagtcacacttcactcgg

SEQ ID NO: 152521 - DNA, 20 bp, human
ggggcaggcacaactggaag

SEQ ID NO: 152522 - DNA, 20 bp, human
gtgcaggttctagagtcatg

SEQ ID NO: 152523 - DNA, 20 bp, human
gggacagctcggaggagctg

SEQ ID NO: 152524 - DNA, 20 bp, human
ggcaaagcagcccagcccta

SEQ ID NO: 152525 - DNA, 20 bp, human
ggggaaacgacgcctcatgc

SEQ ID NO: 152526 - DNA, 20 bp, human
gcctctgcggctcctgccag

SEQ ID NO: 152527 - DNA, 20 bp, human
ggcggagcgcaggacccctc

SEQ ID NO: 152528 - DNA, 20 bp, human
ggccgtcgccactccttcaa

SEQ ID NO: 152529 - DNA, 20 bp, human
gcggcccggacagttcgcgt

SEQ ID NO: 152530 - DNA, 20 bp, human
ggacaggcgtccaaagcctg

SEQ ID NO: 152531 - DNA, 20 bp, human
ggggtttcttgggaatcgag

SEQ ID NO: 152532 - DNA, 20 bp, human
gcagttcgcgttggagatgg

SEQ ID NO: 152533 - DNA, 20 bp, human
gtctccaacgcgaactgtcc

SEQ ID NO: 152534 - DNA, 20 bp, human
gctgcgactgggacttggta

SEQ ID NO: 152535 - DNA, 20 bp, human
gagctgcctgagaaactcgg

SEQ ID NO: 152536 - DNA, 20 bp, human
gcaaggggggatccactcag

SEQ ID NO: 152537 - DNA, 20 bp, human
gactcagtggagcatctgat

SEQ ID NO: 152538 - DNA, 20 bp, human
gtgtcttggagtagatcagt

SEQ ID NO: 152539 - DNA, 20 bp, human
gtgtattctgaagattggta

SEQ ID NO: 152540 - DNA, 20 bp, human
gttcttctcgggctcccgat

SEQ ID NO: 152541 - DNA, 20 bp, human
gcacggtcccagctactgac

SEQ ID NO: 152542 - DNA, 20 bp, human
gacctggaggagtcatgcaa

SEQ ID NO: 152543 - DNA, 20 bp, human
gtgacctgaaggaatcggga

SEQ ID NO: 152544 - DNA, 20 bp, human
gggcccacgtaaggaaatag

SEQ ID NO: 152545 - DNA, 20 bp, human
ggaagcatcagtcaacccat

SEQ ID NO: 152546 - DNA, 20 bp, human
gtcgccgtggctctcctcgg

SEQ ID NO: 152547 - DNA, 20 bp, human
ggctgcggctgggctcgcag

SEQ ID NO: 152548 - DNA, 20 bp, human
gcgagcgtgcactcaagcgt

SEQ ID NO: 152549 - DNA, 20 bp, human
gctgccggccgcgcagactg

SEQ ID NO: 152550 - DNA, 20 bp, human
gatcccaaaagaactcccgg

SEQ ID NO: 152551 - DNA, 20 bp, human
gccaggcggcgcgcggtgag

SEQ ID NO: 152552 - DNA, 20 bp, human
gtgaggcgcacgggaaaccc

SEQ ID NO: 152553 - DNA, 20 bp, human
gcccccaacacaaagctctg

SEQ ID NO: 152554 - DNA, 20 bp, human
gtgggctcgcagtggccgcg

SEQ ID NO: 152555 - DNA, 20 bp, human
gccaaaagaactcccggagg

SEQ ID NO: 152556 - DNA, 20 bp, human
gccacttcagtagaacccgg

SEQ ID NO: 152557 - DNA, 20 bp, human
gcatatcggctccgagtgag

SEQ ID NO: 152558 - DNA, 20 bp, human
gctcccaggcaggctcctag

SEQ ID NO: 152559 - DNA, 20 bp, human
gcggctccgagtgagaggct

SEQ ID NO: 152560 - DNA, 20 bp, human
gcgatatggggagtaaaggt

SEQ ID NO: 152561 - DNA, 20 bp, human
gaggcagcgctgtcactcag

SEQ ID NO: 152562 - DNA, 20 bp, human
ggccaggtcgcctgaggcgg

SEQ ID NO: 152563 - DNA, 20 bp, human
ggagccgatatggggagtaa

SEQ ID NO: 152564 - DNA, 20 bp, human
gggggccgaggggcagtata

SEQ ID NO: 152565 - DNA, 20 bp, human
ggccgaggggcagtataggg

SEQ ID NO: 152566 - DNA, 20 bp, human
ggccgagccgagcaccaggg

SEQ ID NO: 152567 - DNA, 20 bp, human
gcccgccgagccgagcacca

SEQ ID NO: 152568 - DNA, 20 bp, human
gggaggacctggacgaaaca

SEQ ID NO: 152569 - DNA, 20 bp, human
gggacctggacgaaacaggg

SEQ ID NO: 152570 - DNA, 20 bp, human
gcgcgctctggcggcgacgg

SEQ ID NO: 152571 - DNA, 20 bp, human
gtagcctgacccggaggacc

SEQ ID NO: 152572 - DNA, 20 bp, human
ggccgccctggtgctcggct

SEQ ID NO: 152573 - DNA, 20 bp, human
gcgcccactgcagtgagtag

SEQ ID NO: 152574 - DNA, 20 bp, human
ggaggcggcgagaatggcag

SEQ ID NO: 152575 - DNA, 20 bp, human
ggaaacagggcggaggtgag

SEQ ID NO: 152576 - DNA, 20 bp, human
gctcggagcaggcggagtaa

SEQ ID NO: 152577 - DNA, 20 bp, human
gccaaacgctcgtccccggg

SEQ ID NO: 152578 - DNA, 20 bp, human
gaaaggggaaggggaacgta

SEQ ID NO: 152579 - DNA, 20 bp, human
ggggcgttaacgccaagact

SEQ ID NO: 152580 - DNA, 20 bp, human
gtgaagccgtcagtagtcga

SEQ ID NO: 152581 - DNA, 20 bp, human
gtaaggttgtgcaggcggtg

SEQ ID NO: 152582 - DNA, 20 bp, human
gaggcggtgaggaaatagcg

SEQ ID NO: 152583 - DNA, 20 bp, human
ggctgagtcagtcagtctgt

SEQ ID NO: 152584 - DNA, 20 bp, human
gaccagctcgtgggataaaa

SEQ ID NO: 152585 - DNA, 20 bp, human
ggaacgtaaggttgtgcagg

SEQ ID NO: 152586 - DNA, 20 bp, human
gcgcagtgcaatctgtaact

SEQ ID NO: 152587 - DNA, 20 bp, human
gtccacacccagaagacgtc

SEQ ID NO: 152588 - DNA, 20 bp, human
gctgaagagttgaagtctaa

SEQ ID NO: 152589 - DNA, 20 bp, human
gacctgacgtcttctgggtg

SEQ ID NO: 152590 - DNA, 20 bp, human
gagcagatcgtgacaagaga

SEQ ID NO: 152591 - DNA, 20 bp, human
gaagtcacctgacgtcttct

SEQ ID NO: 152592 - DNA, 20 bp, human
gagaacagaacctaaacggc

SEQ ID NO: 152593 - DNA, 20 bp, human
gtcatgctgttctgtttcac

SEQ ID NO: 152594 - DNA, 20 bp, human
gagaaaaattggaaggacaa

SEQ ID NO: 152595 - DNA, 20 bp, human
gagacttcggttgaggaaac

SEQ ID NO: 152596 - DNA, 20 bp, human
gcccggcggctaaggagagc

SEQ ID NO: 152597 - DNA, 20 bp, human
ggcggctaaggagagcgggc

SEQ ID NO: 152598 - DNA, 20 bp, human
gtaaggagagcgggcaggca

SEQ ID NO: 152599 - DNA, 20 bp, human
gccagggtcgcggcggcagt

SEQ ID NO: 152600 - DNA, 20 bp, human
ggacagggcagggatctagg

SEQ ID NO: 152601 - DNA, 20 bp, human
ggaatggacagaatactgac

SEQ ID NO: 152602 - DNA, 20 bp, human
gaaagccatcccggcggcta

SEQ ID NO: 152603 - DNA, 20 bp, human
gcaggacagggcagggatct

SEQ ID NO: 152604 - DNA, 20 bp, human
gatctttgtaggcgattggt

SEQ ID NO: 152605 - DNA, 20 bp, human
ggtcaaattctgccaaacca

SEQ ID NO: 152606 - DNA, 20 bp, human
ggctccgcccggctctggct

SEQ ID NO: 152607 - DNA, 20 bp, human
gcgatgctgggccaagtcga

SEQ ID NO: 152608 - DNA, 20 bp, human
gccggccgcgggacgaggct

SEQ ID NO: 152609 - DNA, 20 bp, human
gaccctcggaccgccaccct

SEQ ID NO: 152610 - DNA, 20 bp, human
gcgaagccgtcaactttccc

SEQ ID NO: 152611 - DNA, 20 bp, human
ggccgagggtggcggtccga

SEQ ID NO: 152612 - DNA, 20 bp, human
gcggacgccctcttcatcgt

SEQ ID NO: 152613 - DNA, 20 bp, human
gcgcggccgggtccgcatcc

SEQ ID NO: 152614 - DNA, 20 bp, human
gacggcttcggcagggccga

SEQ ID NO: 152615 - DNA, 20 bp, human
gaaagttgacggcttcggca

SEQ ID NO: 152616 - DNA, 20 bp, human
ggcctaggccgacctcggag

SEQ ID NO: 152617 - DNA, 20 bp, human
gtgcaggaccgagcgatcgg

SEQ ID NO: 152618 - DNA, 20 bp, human
gcctaggcgcactccctccc

SEQ ID NO: 152619 - DNA, 20 bp, human
gcgctttccccggagctcgg

SEQ ID NO: 152620 - DNA, 20 bp, human
ggagctccggggaaagcgcc

SEQ ID NO: 152621 - DNA, 20 bp, human
gaggtgagttggagccgcag

SEQ ID NO: 152622 - DNA, 20 bp, human
gccgccgcggctgcagcaaa

SEQ ID NO: 152623 - DNA, 20 bp, human
gagtgcgcctaggccgacct

SEQ ID NO: 152624 - DNA, 20 bp, human
gtggccaacatgcttcgcaa

SEQ ID NO: 152625 - DNA, 20 bp, human
ggagcaagccgctcgccccg

SEQ ID NO: 152626 - DNA, 20 bp, human
gctgctagccgagggagagt

SEQ ID NO: 152627 - DNA, 20 bp, human
gggactgacggactctcgag

SEQ ID NO: 152628 - DNA, 20 bp, human
gtgcccaggctgctagccga

SEQ ID NO: 152629 - DNA, 20 bp, human
gtgcaaggtaagaacgccag

SEQ ID NO: 152630 - DNA, 20 bp, human
gctgctgagaacagccctgg

SEQ ID NO: 152631 - DNA, 20 bp, human
gggggaggtggggtaacctg

SEQ ID NO: 152632 - DNA, 20 bp, human
ggcgggctcagggagcgagt

SEQ ID NO: 152633 - DNA, 20 bp, human
ggagcggacagcgcagctag

SEQ ID NO: 152634 - DNA, 20 bp, human
gcccctctttcagggattga

SEQ ID NO: 152635 - DNA, 20 bp, human
gcagggcgtcccctctttca

SEQ ID NO: 152636 - DNA, 20 bp, human
ggaacacggagagtgagggt

SEQ ID NO: 152637 - DNA, 20 bp, human
ggtgagaacacggagagtga

SEQ ID NO: 152638 - DNA, 20 bp, human
gcccagagctagggacctag

SEQ ID NO: 152639 - DNA, 20 bp, human
ggagagtgagggtaggtgca

SEQ ID NO: 152640 - DNA, 20 bp, human
gtctcgtcagtagtgaggga

SEQ ID NO: 152641 - DNA, 20 bp, human
gagagctagggacctagagg

SEQ ID NO: 152642 - DNA, 20 bp, human
gatggtctcgtcagtagtga

SEQ ID NO: 152643 - DNA, 20 bp, human
gcctcctggtcttgtcgatg

SEQ ID NO: 152644 - DNA, 20 bp, human
ggcaggtgagtagcccagga

SEQ ID NO: 152645 - DNA, 20 bp, human
ggtgtcgtagttcccagtta

SEQ ID NO: 152646 - DNA, 20 bp, human
gggcagggcaccaagagtga

SEQ ID NO: 152647 - DNA, 20 bp, human
gatggtaagtacgacaccct

SEQ ID NO: 152648 - DNA, 20 bp, human
gacacagaaagagcacggat

SEQ ID NO: 152649 - DNA, 20 bp, human
gacaggttccagggtaacag

SEQ ID NO: 152650 - DNA, 20 bp, human
gccaggaggcaaggactatt

SEQ ID NO: 152651 - DNA, 20 bp, human
gggaggcaaggactatttgg

SEQ ID NO: 152652 - DNA, 20 bp, human
gacgacaccctaggaagtca

SEQ ID NO: 152653 - DNA, 20 bp, human
ggcctctgaagcctaactca

SEQ ID NO: 152654 - DNA, 20 bp, human
gctggtacacatggtcctgc

SEQ ID NO: 152655 - DNA, 20 bp, human
gagcgctgggtaggcctgag

SEQ ID NO: 152656 - DNA, 20 bp, human
gggctatggtgtgcctgggt

SEQ ID NO: 152657 - DNA, 20 bp, human
ggccctggcaggtctgtagt

SEQ ID NO: 152658 - DNA, 20 bp, human
ggggtgggtcgagctctcct

SEQ ID NO: 152659 - DNA, 20 bp, human
gggaccctgagaccagacaa

SEQ ID NO: 152660 - DNA, 20 bp, human
gcagagaaatcagtctgtgg

SEQ ID NO: 152661 - DNA, 20 bp, human
gcacaccatagccccagaga

SEQ ID NO: 152662 - DNA, 20 bp, human
gatccaggcattagctcaca

SEQ ID NO: 152663 - DNA, 20 bp, human
gttagctcacaagggtgctc

SEQ ID NO: 152664 - DNA, 20 bp, human
gctgtgtccccagccatctc

SEQ ID NO: 152665 - DNA, 20 bp, human
gccatagccccagagatggc

SEQ ID NO: 152666 - DNA, 20 bp, human
ggaatagggagccttctcca

SEQ ID NO: 152667 - DNA, 20 bp, human
ggctactctctcagcttcag

SEQ ID NO: 152668 - DNA, 20 bp, human
gtagtctggaacaaatgacg

SEQ ID NO: 152669 - DNA, 20 bp, human
gacgtggtgagaaactagaa

SEQ ID NO: 152670 - DNA, 20 bp, human
gttctggaaaaccctggaga

SEQ ID NO: 152671 - DNA, 20 bp, human
gatagctcttctgagaagag

SEQ ID NO: 152672 - DNA, 20 bp, human
gccagccaaatgctctctgt

SEQ ID NO: 152673 - DNA, 20 bp, human
gaaagactctagaggtagtc

SEQ ID NO: 152674 - DNA, 20 bp, human
gagccaggcagtctagctga

SEQ ID NO: 152675 - DNA, 20 bp, human
gtcaggtttgctcgtttctc

SEQ ID NO: 152676 - DNA, 20 bp, human
ggcgcggcagtttaattctc

SEQ ID NO: 152677 - DNA, 20 bp, human
gtgacgggacgagatggtcc

SEQ ID NO: 152678 - DNA, 20 bp, human
gccggcggctgcagattgac

SEQ ID NO: 152679 - DNA, 20 bp, human
gcatcagctggccgagatca

SEQ ID NO: 152680 - DNA, 20 bp, human
gcgctgatctcattcaggag

SEQ ID NO: 152681 - DNA, 20 bp, human
gcgcgtcccgaaggcaccag

SEQ ID NO: 152682 - DNA, 20 bp, human
ggcagattgacgggacgaga

SEQ ID NO: 152683 - DNA, 20 bp, human
gctgatgacctgtcaacgaa

SEQ ID NO: 152684 - DNA, 20 bp, human
gcggcagtttaattctccgg

SEQ ID NO: 152685 - DNA, 20 bp, human
gggtcctggcagggctcatc

SEQ ID NO: 152686 - DNA, 20 bp, human
gccaagatggccgaccggga

SEQ ID NO: 152687 - DNA, 20 bp, human
gagatggccgaccgggaagg

SEQ ID NO: 152688 - DNA, 20 bp, human
gtgcgtgccagggtcaggat

SEQ ID NO: 152689 - DNA, 20 bp, human
gagggccaccgggaacctgt

SEQ ID NO: 152690 - DNA, 20 bp, human
ggcgcagccgccttcccggt

SEQ ID NO: 152691 - DNA, 20 bp, human
gggttacgcgagctgttggc

SEQ ID NO: 152692 - DNA, 20 bp, human
gaggcggctgcgctgctggg

SEQ ID NO: 152693 - DNA, 20 bp, human
gacggccaagatggccgacc

SEQ ID NO: 152694 - DNA, 20 bp, human
gctcgcgtaacctcccggaa

SEQ ID NO: 152695 - DNA, 20 bp, human
ggccgtgtcatgtgacccag

SEQ ID NO: 152696 - DNA, 20 bp, human
gagcaacgcgcggagccgtc

SEQ ID NO: 152697 - DNA, 20 bp, human
gactacttacctgcgaatcc

SEQ ID NO: 152698 - DNA, 20 bp, human
gggagcactgcctcaaacat

SEQ ID NO: 152699 - DNA, 20 bp, human
gccacagccccctacctgga

SEQ ID NO: 152700 - DNA, 20 bp, human
ggcgcggagccgtctgggag

SEQ ID NO: 152701 - DNA, 20 bp, human
gggccccgccgtccaggtag

SEQ ID NO: 152702 - DNA, 20 bp, human
gtccagaggcctctcccaga

SEQ ID NO: 152703 - DNA, 20 bp, human
gttgggtcagaagagccact

SEQ ID NO: 152704 - DNA, 20 bp, human
gcgggcaacggtgagaagac

SEQ ID NO: 152705 - DNA, 20 bp, human
gcagccccctacctggacgg

SEQ ID NO: 152706 - DNA, 20 bp, human
gagggcctagcgttcggttt

SEQ ID NO: 152707 - DNA, 20 bp, human
gttcgggccccagttccgac

SEQ ID NO: 152708 - DNA, 20 bp, human
ggcggctgcgcggtctcggg

SEQ ID NO: 152709 - DNA, 20 bp, human
gccgctcgccttacccatgg

SEQ ID NO: 152710 - DNA, 20 bp, human
gtggccgccgagcgcctgga

SEQ ID NO: 152711 - DNA, 20 bp, human
gcgggaacgggccggaacaa

SEQ ID NO: 152712 - DNA, 20 bp, human
gtggggcccgaacccaggat

SEQ ID NO: 152713 - DNA, 20 bp, human
gacgccgagggcgggagacg

SEQ ID NO: 152714 - DNA, 20 bp, human
gggcccgctcgccttaccca

SEQ ID NO: 152715 - DNA, 20 bp, human
gctgtccagcagctccttcc

SEQ ID NO: 152716 - DNA, 20 bp, human
gagctcatctgagcagatcc

SEQ ID NO: 152717 - DNA, 20 bp, human
gtggccgtgcgcagtaagca

SEQ ID NO: 152718 - DNA, 20 bp, human
ggctttcaggaaaagggtgg

SEQ ID NO: 152719 - DNA, 20 bp, human
gtgctgagttctcataggat

SEQ ID NO: 152720 - DNA, 20 bp, human
gtaaggcagcatcagctgtg

SEQ ID NO: 152721 - DNA, 20 bp, human
gagtttgttcttaacctata

SEQ ID NO: 152722 - DNA, 20 bp, human
gcagctgatgctgccttagc

SEQ ID NO: 152723 - DNA, 20 bp, human
gacaccctgcttactgcgca

SEQ ID NO: 152724 - DNA, 20 bp, human
gttttcacttactcatatcg

SEQ ID NO: 152725 - DNA, 20 bp, human
ggttcattagtcagccattt

SEQ ID NO: 152726 - DNA, 20 bp, human
gagcccgtggccgagaagaa

SEQ ID NO: 152727 - DNA, 20 bp, human
gccgagaagaaaggtggcgg

SEQ ID NO: 152728 - DNA, 20 bp, human
gtgctgtaccccggcgatgg

SEQ ID NO: 152729 - DNA, 20 bp, human
gcagcggcaagcaccgtgag

SEQ ID NO: 152730 - DNA, 20 bp, human
gaggcccgggcgcgaatcgg

SEQ ID NO: 152731 - DNA, 20 bp, human
gcacctttcttctcggccac

SEQ ID NO: 152732 - DNA, 20 bp, human
gaccccggcgatggaggcgc

SEQ ID NO: 152733 - DNA, 20 bp, human
gcgcgccgcgctcccgccgg

SEQ ID NO: 152734 - DNA, 20 bp, human
gccgggggcacggaccgaga

SEQ ID NO: 152735 - DNA, 20 bp, human
gctccagctggcttggaccc

SEQ ID NO: 152736 - DNA, 20 bp, human
ggtgcaaggcagagtcacta

SEQ ID NO: 152737 - DNA, 20 bp, human
gaaggcagagtcactaggga

SEQ ID NO: 152738 - DNA, 20 bp, human
gtgccttgcacagcagtccc

SEQ ID NO: 152739 - DNA, 20 bp, human
ggactgagttacttcttccc

SEQ ID NO: 152740 - DNA, 20 bp, human
gcttcccaggctgtaaatcc

SEQ ID NO: 152741 - DNA, 20 bp, human
gagtcccaggatttacagcc

SEQ ID NO: 152742 - DNA, 20 bp, human
gacacagtgagttcatagcc

SEQ ID NO: 152743 - DNA, 20 bp, human
gatcctgggactgctgtgca

SEQ ID NO: 152744 - DNA, 20 bp, human
gagggaggtgggtggagcat

SEQ ID NO: 152745 - DNA, 20 bp, human
gtgggtggagcatgggattc

SEQ ID NO: 152746 - DNA, 20 bp, human
ggcagagccggtaacggtgg

SEQ ID NO: 152747 - DNA, 20 bp, human
gaagatggcggctgtcgaag

SEQ ID NO: 152748 - DNA, 20 bp, human
ggcggctgcagagccggtaa

SEQ ID NO: 152749 - DNA, 20 bp, human
ggctgcagagccggtaacgg

SEQ ID NO: 152750 - DNA, 20 bp, human
gttcgtaacctaggacgtga

SEQ ID NO: 152751 - DNA, 20 bp, human
gtaggacgtgagggcagccg

SEQ ID NO: 152752 - DNA, 20 bp, human
ggagccggtaacggtggtgg

SEQ ID NO: 152753 - DNA, 20 bp, human
gccaaaggcgaaagacgaag

SEQ ID NO: 152754 - DNA, 20 bp, human
gcagccgccaccaccgttac

SEQ ID NO: 152755 - DNA, 20 bp, human
ggtcgaagcggctgcagagc

SEQ ID NO: 152756 - DNA, 20 bp, human
ggcgatgccagagcaaaaca

SEQ ID NO: 152757 - DNA, 20 bp, human
ggctgccgcggagaaaaggg

SEQ ID NO: 152758 - DNA, 20 bp, human
gccagagcaaaacaaggccg

SEQ ID NO: 152759 - DNA, 20 bp, human
ggagcaaaacaaggccgggg

SEQ ID NO: 152760 - DNA, 20 bp, human
gagcgctgccgcggagaaaa

SEQ ID NO: 152761 - DNA, 20 bp, human
gccggggagggagctctccg

SEQ ID NO: 152762 - DNA, 20 bp, human
gggccgggcaccgggcgcaa

SEQ ID NO: 152763 - DNA, 20 bp, human
ggcaccgggcgcaaaggcag

SEQ ID NO: 152764 - DNA, 20 bp, human
gtccgcggcagcgctcagtc

SEQ ID NO: 152765 - DNA, 20 bp, human
ggcaggtgggcaccgctagt

SEQ ID NO: 152766 - DNA, 20 bp, human
gctgcggagtgtgggtggtt

SEQ ID NO: 152767 - DNA, 20 bp, human
ggggtggcacgagacaaaag

SEQ ID NO: 152768 - DNA, 20 bp, human
gccgtctgctgaggtccctc

SEQ ID NO: 152769 - DNA, 20 bp, human
gactcgtgccccagcccggg

SEQ ID NO: 152770 - DNA, 20 bp, human
gctgctgaggtccctcggga

SEQ ID NO: 152771 - DNA, 20 bp, human
gcgagacaaaaggggcacgg

SEQ ID NO: 152772 - DNA, 20 bp, human
ggatcccgctcaggcccccc

SEQ ID NO: 152773 - DNA, 20 bp, human
gactcgcacccggggactga

SEQ ID NO: 152774 - DNA, 20 bp, human
gtgtggagctcgggtgccaa

SEQ ID NO: 152775 - DNA, 20 bp, human
gaggccccccaggctccggg

SEQ ID NO: 152776 - DNA, 20 bp, human
ggtcccccgccttcagaaga

SEQ ID NO: 152777 - DNA, 20 bp, human
gacccacagtgcttcatgag

SEQ ID NO: 152778 - DNA, 20 bp, human
gccagaggtatccagcagag

SEQ ID NO: 152779 - DNA, 20 bp, human
gtgaagcactgtgggtacga

SEQ ID NO: 152780 - DNA, 20 bp, human
ggagagatgtagggctagag

SEQ ID NO: 152781 - DNA, 20 bp, human
gacctctcatgaagcactgt

SEQ ID NO: 152782 - DNA, 20 bp, human
gaccacgctgcgaaaccctg

SEQ ID NO: 152783 - DNA, 20 bp, human
gtcggagcgaaaaccaagac

SEQ ID NO: 152784 - DNA, 20 bp, human
gatgagaggtgagtacatgc

SEQ ID NO: 152785 - DNA, 20 bp, human
gcatcaccaacccacagcca

SEQ ID NO: 152786 - DNA, 20 bp, human
gcagcgtaccacacagaaag

SEQ ID NO: 152787 - DNA, 20 bp, human
ggagacagccactttctgtg

SEQ ID NO: 152788 - DNA, 20 bp, human
ggtgtggtacgctggattca

SEQ ID NO: 152789 - DNA, 20 bp, human
gcgctggattcaaggatgcc

SEQ ID NO: 152790 - DNA, 20 bp, human
gaacagagagaacacagaac

SEQ ID NO: 152791 - DNA, 20 bp, human
gtgatacatggaggggtaca

SEQ ID NO: 152792 - DNA, 20 bp, human
gtcagattatggcagaatcc

SEQ ID NO: 152793 - DNA, 20 bp, human
gggagagagttttcagatta

SEQ ID NO: 152794 - DNA, 20 bp, human
gagaacaggaggcatgagcc

SEQ ID NO: 152795 - DNA, 20 bp, human
gtcagatacaacacgctgtg

SEQ ID NO: 152796 - DNA, 20 bp, human
gcatggtgctgagaagggta

SEQ ID NO: 152797 - DNA, 20 bp, human
gtgtcgctcctcttagctgg

SEQ ID NO: 152798 - DNA, 20 bp, human
gttcagaagtcgataagacc

SEQ ID NO: 152799 - DNA, 20 bp, human
gagaagggtagggggttgtc

SEQ ID NO: 152800 - DNA, 20 bp, human
gaggaagggctagagaactt

SEQ ID NO: 152801 - DNA, 20 bp, human
gctcaccgaggtgagaatac

SEQ ID NO: 152802 - DNA, 20 bp, human
gattctctccgccagctaag

SEQ ID NO: 152803 - DNA, 20 bp, human
gccgaggtgagaataccgga

SEQ ID NO: 152804 - DNA, 20 bp, human
gatctgtcgctcctcttagc

SEQ ID NO: 152805 - DNA, 20 bp, human
gtctcttttggtggaaggaa

SEQ ID NO: 152806 - DNA, 20 bp, human
gctgactctgttggtctcgg

SEQ ID NO: 152807 - DNA, 20 bp, human
gtaacaggttcatatcttac

SEQ ID NO: 152808 - DNA, 20 bp, human
ggagcactcactgactctgt

SEQ ID NO: 152809 - DNA, 20 bp, human
gcagtctatgcagtaatagt

SEQ ID NO: 152810 - DNA, 20 bp, human
gaaagtttgcaccgcacttg

SEQ ID NO: 152811 - DNA, 20 bp, human
gtataaagtctatgtactcc

SEQ ID NO: 152812 - DNA, 20 bp, human
gtaaaactaaaacaaggttt

SEQ ID NO: 152813 - DNA, 20 bp, human
ggtcagcaaaacttcttttg

SEQ ID NO: 152814 - DNA, 20 bp, human
gctaaaacaaggtttgggta

SEQ ID NO: 152815 - DNA, 20 bp, human
gtcatacctttatgtttaac

SEQ ID NO: 152816 - DNA, 20 bp, human
gctggcgggtagggagaccc

SEQ ID NO: 152817 - DNA, 20 bp, human
ggcgggtagggagacccggg

SEQ ID NO: 152818 - DNA, 20 bp, human
gccgggtgttccaaagactc

SEQ ID NO: 152819 - DNA, 20 bp, human
ggcagtcgggctggcgggta

SEQ ID NO: 152820 - DNA, 20 bp, human
gctgatgggccaacagagtc

SEQ ID NO: 152821 - DNA, 20 bp, human
gagcgacgtgagcccggtgg

SEQ ID NO: 152822 - DNA, 20 bp, human
ggtctttggaacacccgggg

SEQ ID NO: 152823 - DNA, 20 bp, human
gctggcgatgcggcgcagtc

SEQ ID NO: 152824 - DNA, 20 bp, human
gcgttcgcagctgccacccc

SEQ ID NO: 152825 - DNA, 20 bp, human
gcgtggggcggccgcaaccg

SEQ ID NO: 152826 - DNA, 20 bp, human
gcgcggccgccccgactccg

SEQ ID NO: 152827 - DNA, 20 bp, human
gcgcataacagcggccgtca

SEQ ID NO: 152828 - DNA, 20 bp, human
gacgggaatacgcataacag

SEQ ID NO: 152829 - DNA, 20 bp, human
gcagccgggacagccacgag

SEQ ID NO: 152830 - DNA, 20 bp, human
gttctggaggatttgttctg

SEQ ID NO: 152831 - DNA, 20 bp, human
gggcgggccctggcgagtag

SEQ ID NO: 152832 - DNA, 20 bp, human
gccccggccttcccctgcgg

SEQ ID NO: 152833 - DNA, 20 bp, human
gccccgccacttgattctgg

SEQ ID NO: 152834 - DNA, 20 bp, human
gcggccccgccacttgattc

SEQ ID NO: 152835 - DNA, 20 bp, human
ggcccggccactactcgcca

SEQ ID NO: 152836 - DNA, 20 bp, human
gtcattccccgtggcactgg

SEQ ID NO: 152837 - DNA, 20 bp, human
gagagcctgggctctgtcaa

SEQ ID NO: 152838 - DNA, 20 bp, human
gcccaacccaaccccctgaa

SEQ ID NO: 152839 - DNA, 20 bp, human
ggaaggtcggcgagtaggtc

SEQ ID NO: 152840 - DNA, 20 bp, human
ggtcggcgagtaggtcggga

SEQ ID NO: 152841 - DNA, 20 bp, human
gctttcggcagccagggtgg

SEQ ID NO: 152842 - DNA, 20 bp, human
gggccgcctccagtgccacg

SEQ ID NO: 152843 - DNA, 20 bp, human
gatcattagatggcgggaag

SEQ ID NO: 152844 - DNA, 20 bp, human
gcacggggaatgaatgaatg

SEQ ID NO: 152845 - DNA, 20 bp, human
gccatgccccgctctgaaga

SEQ ID NO: 152846 - DNA, 20 bp, human
gtgccctgctagggcctgta

SEQ ID NO: 152847 - DNA, 20 bp, human
gcaggagcagaagaaaggta

SEQ ID NO: 152848 - DNA, 20 bp, human
gctccaggatcccggaactc

SEQ ID NO: 152849 - DNA, 20 bp, human
gagctgaccagtcccactct

SEQ ID NO: 152850 - DNA, 20 bp, human
gctgctagggcctgtagggc

SEQ ID NO: 152851 - DNA, 20 bp, human
gcaggccctagcagggcagg

SEQ ID NO: 152852 - DNA, 20 bp, human
gggcgaaggaccacgaacta

SEQ ID NO: 152853 - DNA, 20 bp, human
gaggaccacgaactacggac

SEQ ID NO: 152854 - DNA, 20 bp, human
gctgctctcaggctgtccga

SEQ ID NO: 152855 - DNA, 20 bp, human
gcaggaccgcctgaagcacg

SEQ ID NO: 152856 - DNA, 20 bp, human
gggccgagccctcctcacca

SEQ ID NO: 152857 - DNA, 20 bp, human
gggagccgcggacaagccca

SEQ ID NO: 152858 - DNA, 20 bp, human
gtccatcggtctacacccat

SEQ ID NO: 152859 - DNA, 20 bp, human
gggtcctcctggaaccgctc

SEQ ID NO: 152860 - DNA, 20 bp, human
gaggccggagcggttccagg

SEQ ID NO: 152861 - DNA, 20 bp, human
gggcttgtccgcggctccca

SEQ ID NO: 152862 - DNA, 20 bp, human
ggagtaaggggtaggctgga

SEQ ID NO: 152863 - DNA, 20 bp, human
gggagggcagggccagattg

SEQ ID NO: 152864 - DNA, 20 bp, human
gcagatgccctgaaaggagg

SEQ ID NO: 152865 - DNA, 20 bp, human
gttccaggaggaccctggtg

SEQ ID NO: 152866 - DNA, 20 bp, human
gcgggtgaaggcgctatatg

SEQ ID NO: 152867 - DNA, 20 bp, human
gcctcttccaggaaaattac

SEQ ID NO: 152868 - DNA, 20 bp, human
gcacagagttgtaatgacaa

SEQ ID NO: 152869 - DNA, 20 bp, human
gaccagataatcctgtctgg

SEQ ID NO: 152870 - DNA, 20 bp, human
gtggagaaaccctggagtag

SEQ ID NO: 152871 - DNA, 20 bp, human
gccctggagtagaggatgcc

SEQ ID NO: 152872 - DNA, 20 bp, human
ggtacagacatctagttggc

SEQ ID NO: 152873 - DNA, 20 bp, human
ggtagaggatgcctggtatg

SEQ ID NO: 152874 - DNA, 20 bp, human
ggttctgtgtactacatgtt

SEQ ID NO: 152875 - DNA, 20 bp, human
gcaggaaaattacgggcaga

SEQ ID NO: 152876 - DNA, 20 bp, human
ggtcccacgcgggatgaaga

SEQ ID NO: 152877 - DNA, 20 bp, human
gtcccgcagcagcctcttgg

SEQ ID NO: 152878 - DNA, 20 bp, human
ggcgccggaaaggggaaacc

SEQ ID NO: 152879 - DNA, 20 bp, human
gggagtcggcttaaactgaa

SEQ ID NO: 152880 - DNA, 20 bp, human
ggcgagacccgaggattggg

SEQ ID NO: 152881 - DNA, 20 bp, human
gaggctggaaggcgccggaa

SEQ ID NO: 152882 - DNA, 20 bp, human
gcggagggaggcgagacccg

SEQ ID NO: 152883 - DNA, 20 bp, human
ggaggcgagacccgaggatt

SEQ ID NO: 152884 - DNA, 20 bp, human
ggtcggcttaaactgaaggg

SEQ ID NO: 152885 - DNA, 20 bp, human
gcgcagcagcctcttggcgg

SEQ ID NO: 152886 - DNA, 20 bp, human
gggcagcagcacggagactg

SEQ ID NO: 152887 - DNA, 20 bp, human
gcatcgttgctaatgcaggg

SEQ ID NO: 152888 - DNA, 20 bp, human
ggttccacgggatcacacag

SEQ ID NO: 152889 - DNA, 20 bp, human
gagctcaaggctcctgacag

SEQ ID NO: 152890 - DNA, 20 bp, human
ggggctatggtgcagagatg

SEQ ID NO: 152891 - DNA, 20 bp, human
gggataaaggggggaacatg

SEQ ID NO: 152892 - DNA, 20 bp, human
gaaggctcctgacagaggta

SEQ ID NO: 152893 - DNA, 20 bp, human
gaaagggacagacgcatcag

SEQ ID NO: 152894 - DNA, 20 bp, human
gtgcggggggggataaaggg

SEQ ID NO: 152895 - DNA, 20 bp, human
gctgatttctgctaatacaa

SEQ ID NO: 152896 - DNA, 20 bp, human
ggcaggcgctgaaggcacat

SEQ ID NO: 152897 - DNA, 20 bp, human
gctgcaacgcgacccctgga

SEQ ID NO: 152898 - DNA, 20 bp, human
gccccggctcccgcagcgat

SEQ ID NO: 152899 - DNA, 20 bp, human
ggcgctgaaggcacataggt

SEQ ID NO: 152900 - DNA, 20 bp, human
gtcccgctaagggagcggag

SEQ ID NO: 152901 - DNA, 20 bp, human
ggaagacaggccctccccta

SEQ ID NO: 152902 - DNA, 20 bp, human
gtcggctgcgcccatcgctg

SEQ ID NO: 152903 - DNA, 20 bp, human
gccgccggcgcggaaggacg

SEQ ID NO: 152904 - DNA, 20 bp, human
ggaaagctctgcgcgtgact

SEQ ID NO: 152905 - DNA, 20 bp, human
gcggtggacgcagagctgaa

SEQ ID NO: 152906 - DNA, 20 bp, human
gggccaggagaacgcgcgag

SEQ ID NO: 152907 - DNA, 20 bp, human
gcgcatggtaactcaggcgc

SEQ ID NO: 152908 - DNA, 20 bp, human
gaacggccgcatggtaactc

SEQ ID NO: 152909 - DNA, 20 bp, human
gtaccatgcggccgttacta

SEQ ID NO: 152910 - DNA, 20 bp, human
gcctagtgacgatccactgg

SEQ ID NO: 152911 - DNA, 20 bp, human
gatcgtcactaggtatcctg

SEQ ID NO: 152912 - DNA, 20 bp, human
ggcagctaggacagtgcgcc

SEQ ID NO: 152913 - DNA, 20 bp, human
gagagagctgctgaagtcgg

SEQ ID NO: 152914 - DNA, 20 bp, human
gggagaacgcgcgagaggtg

SEQ ID NO: 152915 - DNA, 20 bp, human
gccgggagctaaaaccagcg

SEQ ID NO: 152916 - DNA, 20 bp, human
gtgcgctttacggaaacgag

SEQ ID NO: 152917 - DNA, 20 bp, human
gtggcagttggtgagcatca

SEQ ID NO: 152918 - DNA, 20 bp, human
gcggccgtgagacctccagg

SEQ ID NO: 152919 - DNA, 20 bp, human
gtggcaccactaacaatcca

SEQ ID NO: 152920 - DNA, 20 bp, human
gcatgcacccacacttacaa

SEQ ID NO: 152921 - DNA, 20 bp, human
gtggcaaccgttgtaagtgt

SEQ ID NO: 152922 - DNA, 20 bp, human
ggagctggaggcctcaaagt

SEQ ID NO: 152923 - DNA, 20 bp, human
gccgctaggactctggcagt

SEQ ID NO: 152924 - DNA, 20 bp, human
gcttctcccccagatctggg

SEQ ID NO: 152925 - DNA, 20 bp, human
gtccgtttccgctaggactc

SEQ ID NO: 152926 - DNA, 20 bp, human
gaggtgtctgggcgatctat

SEQ ID NO: 152927 - DNA, 20 bp, human
gcccggcgcggcagctgtct

SEQ ID NO: 152928 - DNA, 20 bp, human
gccccgaggtggagtaggac

SEQ ID NO: 152929 - DNA, 20 bp, human
ggggccacgatgacagatta

SEQ ID NO: 152930 - DNA, 20 bp, human
gccgcagctctgggcctcat

SEQ ID NO: 152931 - DNA, 20 bp, human
ggccgcccgctctcccggcg

SEQ ID NO: 152932 - DNA, 20 bp, human
ggcctgtagccgccccgagg

SEQ ID NO: 152933 - DNA, 20 bp, human
ggctgccgcgccgggagagc

SEQ ID NO: 152934 - DNA, 20 bp, human
gtcaggcctgaaaattgagt

SEQ ID NO: 152935 - DNA, 20 bp, human
gcgagtcgaacgtggaagta

SEQ ID NO: 152936 - DNA, 20 bp, human
gggggaatcagccccgtcgc

SEQ ID NO: 152937 - DNA, 20 bp, human
gcccgagggacccaggataa

SEQ ID NO: 152938 - DNA, 20 bp, human
gaccgcagccgcagttcctc

SEQ ID NO: 152939 - DNA, 20 bp, human
gctgcggctgcggttccgag

SEQ ID NO: 152940 - DNA, 20 bp, human
ggcctgaggaactgcggctg

SEQ ID NO: 152941 - DNA, 20 bp, human
ggccagctgcgcgcgacctg

SEQ ID NO: 152942 - DNA, 20 bp, human
gagggacccaggataagggt

SEQ ID NO: 152943 - DNA, 20 bp, human
ggacccaggataagggtagg

SEQ ID NO: 152944 - DNA, 20 bp, human
gctccggctgccgtctcccc

SEQ ID NO: 152945 - DNA, 20 bp, human
gagggtagggggtgtctcag

SEQ ID NO: 152946 - DNA, 20 bp, human
gtccggtaggtcgccagctg

SEQ ID NO: 152947 - DNA, 20 bp, human
ggcctcagctggcgacctac

SEQ ID NO: 152948 - DNA, 20 bp, human
ggaggaccgagccgaccgat

SEQ ID NO: 152949 - DNA, 20 bp, human
gtgccgggcacgttcccaaa

SEQ ID NO: 152950 - DNA, 20 bp, human
gggcaatcagggtgcgaggg

SEQ ID NO: 152951 - DNA, 20 bp, human
gaagccgggaagcaacgccg

SEQ ID NO: 152952 - DNA, 20 bp, human
ggaggtccccggctggagca

SEQ ID NO: 152953 - DNA, 20 bp, human
gcccccgtggcggtcaccac

SEQ ID NO: 152954 - DNA, 20 bp, human
gccatgcagccatggaaccc

SEQ ID NO: 152955 - DNA, 20 bp, human
gactgcatgcgcccatcggt

SEQ ID NO: 152956 - DNA, 20 bp, human
gaggacacagaacaacgagg

SEQ ID NO: 152957 - DNA, 20 bp, human
gttatagggtgagatctgag

SEQ ID NO: 152958 - DNA, 20 bp, human
gccgagagctcctcctgcac

SEQ ID NO: 152959 - DNA, 20 bp, human
gtggggcctgcagaaaatcg

SEQ ID NO: 152960 - DNA, 20 bp, human
gcaggaggagctctcggtcc

SEQ ID NO: 152961 - DNA, 20 bp, human
gggaaggggaagcgctgagg

SEQ ID NO: 152962 - DNA, 20 bp, human
ggcgcgggtagtcacctgag

SEQ ID NO: 152963 - DNA, 20 bp, human
gcccgcctgggcccacgtat

SEQ ID NO: 152964 - DNA, 20 bp, human
gtagggtgagatctgagggg

SEQ ID NO: 152965 - DNA, 20 bp, human
gtaacccggtccccatacgt

SEQ ID NO: 152966 - DNA, 20 bp, human
ggcgtctccctgacgcttgg

SEQ ID NO: 152967 - DNA, 20 bp, human
gtgggctgtgggctacgagc

SEQ ID NO: 152968 - DNA, 20 bp, human
gtgggacgccggtgaactcg

SEQ ID NO: 152969 - DNA, 20 bp, human
ggcaccccggccggctccga

SEQ ID NO: 152970 - DNA, 20 bp, human
gcattcacgcgcgcttgggt

SEQ ID NO: 152971 - DNA, 20 bp, human
gcggggtgccccgagttcac

SEQ ID NO: 152972 - DNA, 20 bp, human
ggccgctcctccaagcgtca

SEQ ID NO: 152973 - DNA, 20 bp, human
ggccccaccagccgcggctc

SEQ ID NO: 152974 - DNA, 20 bp, human
ggccggagccgcggctggtg

SEQ ID NO: 152975 - DNA, 20 bp, human
ggagagggccctgagccggg

SEQ ID NO: 152976 - DNA, 20 bp, human
gaatcgcatacagctcacag

SEQ ID NO: 152977 - DNA, 20 bp, human
gtgatgtgccgtgtaaacct

SEQ ID NO: 152978 - DNA, 20 bp, human
gaatgaaagtgagcaaaatt

SEQ ID NO: 152979 - DNA, 20 bp, human
gtagcaaatgacaaagaata

SEQ ID NO: 152980 - DNA, 20 bp, human
gtcttaaaagcataaatata

SEQ ID NO: 152981 - DNA, 20 bp, human
gaatcagttgctcagataga

SEQ ID NO: 152982 - DNA, 20 bp, human
gattacaactatacagaaac

SEQ ID NO: 152983 - DNA, 20 bp, human
gctatcataggtgtgcttct

SEQ ID NO: 152984 - DNA, 20 bp, human
gatattcattgaaaactcct

SEQ ID NO: 152985 - DNA, 20 bp, human
ggttcttcttagtatatgtc

SEQ ID NO: 152986 - DNA, 20 bp, human
ggaacattgtaatcaatctg

SEQ ID NO: 152987 - DNA, 20 bp, human
gctgatcaatgtcaaaggta

SEQ ID NO: 152988 - DNA, 20 bp, human
gaaagataatgacaaatacc

SEQ ID NO: 152989 - DNA, 20 bp, human
gcagctttaataacatacaa

SEQ ID NO: 152990 - DNA, 20 bp, human
gtcgttctgatcaatgtcaa

SEQ ID NO: 152991 - DNA, 20 bp, human
gagttgtaataaatatattg

SEQ ID NO: 152992 - DNA, 20 bp, human
gaaaaattactaggctgtgt

SEQ ID NO: 152993 - DNA, 20 bp, human
gtatcctcttatacctcagc

SEQ ID NO: 152994 - DNA, 20 bp, human
gaaactaaaattgtgttttg

SEQ ID NO: 152995 - DNA, 20 bp, human
gagatgcaacaaatttttca

SEQ ID NO: 152996 - DNA, 20 bp, human
gcggctctcaccagttacgg

SEQ ID NO: 152997 - DNA, 20 bp, human
ggcggttgtcaactccgggt

SEQ ID NO: 152998 - DNA, 20 bp, human
gcagcggctctcaccagtta

SEQ ID NO: 152999 - DNA, 20 bp, human
gacgcaggagttgagctcag

SEQ ID NO: 153000 - DNA, 20 bp, human
ggagccgctggcaacccacc

SEQ ID NO: 153001 - DNA, 20 bp, human
ggtgcaagtgccaccgtaac

SEQ ID NO: 153002 - DNA, 20 bp, human
gtggcgcgcagcgaacgccc

SEQ ID NO: 153003 - DNA, 20 bp, human
gctccgcggttgtcaactcc

SEQ ID NO: 153004 - DNA, 20 bp, human
gctgggtactaagcgcgtcc

SEQ ID NO: 153005 - DNA, 20 bp, human
ggggtgtctgcgtctctccg

SEQ ID NO: 153006 - DNA, 20 bp, human
gtgcagagggcacctccgaa

SEQ ID NO: 153007 - DNA, 20 bp, human
gtcagtggcctctgccagtc

SEQ ID NO: 153008 - DNA, 20 bp, human
ggcagggcatcagagattgg

SEQ ID NO: 153009 - DNA, 20 bp, human
ggtgtctgccagactggcag

SEQ ID NO: 153010 - DNA, 20 bp, human
gcgactcggctgcccaaaag

SEQ ID NO: 153011 - DNA, 20 bp, human
gctgcaagtgtctgccagac

SEQ ID NO: 153012 - DNA, 20 bp, human
ggcatagacgttgaggacag

SEQ ID NO: 153013 - DNA, 20 bp, human
gattgagtgtgggcatcgca

SEQ ID NO: 153014 - DNA, 20 bp, human
gaggcagaagtattgagtgt

SEQ ID NO: 153015 - DNA, 20 bp, human
gagcgttgctcgctactggg

SEQ ID NO: 153016 - DNA, 20 bp, human
gcccggggagggtcgacccg

SEQ ID NO: 153017 - DNA, 20 bp, human
gaggttcgcccgggacgagg

SEQ ID NO: 153018 - DNA, 20 bp, human
gggaggggtctcccgctcac

SEQ ID NO: 153019 - DNA, 20 bp, human
gggggtctcccgctcaccgg

SEQ ID NO: 153020 - DNA, 20 bp, human
gccgagcggcaggaaatgtt

SEQ ID NO: 153021 - DNA, 20 bp, human
gcacaggaacccggccggag

SEQ ID NO: 153022 - DNA, 20 bp, human
ggcgggtggcaggttcgccc

SEQ ID NO: 153023 - DNA, 20 bp, human
ggcaacaactcgccgcgccg

SEQ ID NO: 153024 - DNA, 20 bp, human
gcccgaactcacgcgaaggt

SEQ ID NO: 153025 - DNA, 20 bp, human
gggcgcccgaactcacgcga

SEQ ID NO: 153026 - DNA, 20 bp, human
gtggtactgagcagagcgac

SEQ ID NO: 153027 - DNA, 20 bp, human
gagggcagtgtgggccggtg

SEQ ID NO: 153028 - DNA, 20 bp, human
gttgtacagacgggaagtct

SEQ ID NO: 153029 - DNA, 20 bp, human
gcaagcggtcacagctagga

SEQ ID NO: 153030 - DNA, 20 bp, human
gacaaagatggctgccacat

SEQ ID NO: 153031 - DNA, 20 bp, human
gggtgctaaggccctcggga

SEQ ID NO: 153032 - DNA, 20 bp, human
gggacgggatgggcgacagc

SEQ ID NO: 153033 - DNA, 20 bp, human
ggcaaggaaaagagcaccgg

SEQ ID NO: 153034 - DNA, 20 bp, human
ggcggtcacagctaggaggg

SEQ ID NO: 153035 - DNA, 20 bp, human
gtcgcagataaagcggtcac

SEQ ID NO: 153036 - DNA, 20 bp, human
gcgcgtgcatgagagaggag

SEQ ID NO: 153037 - DNA, 20 bp, human
gcaggaatctgcctctagat

SEQ ID NO: 153038 - DNA, 20 bp, human
gtgtggactctccgatctag

SEQ ID NO: 153039 - DNA, 20 bp, human
gcagccctctgggattagtc

SEQ ID NO: 153040 - DNA, 20 bp, human
gctagcagcccggggagcac

SEQ ID NO: 153041 - DNA, 20 bp, human
ggcgtttgagacggctgtgg

SEQ ID NO: 153042 - DNA, 20 bp, human
ggtgcacgcgtgcatgagag

SEQ ID NO: 153043 - DNA, 20 bp, human
gccgtctcaaacgcactatg

SEQ ID NO: 153044 - DNA, 20 bp, human
ggattcctgactaatcccag

SEQ ID NO: 153045 - DNA, 20 bp, human
gaggatacggggatattcta

SEQ ID NO: 153046 - DNA, 20 bp, human
ggcagggagcaggaaaacgg

SEQ ID NO: 153047 - DNA, 20 bp, human
gccgccgagtgactgacgag

SEQ ID NO: 153048 - DNA, 20 bp, human
gtctcgtccggagactgtga

SEQ ID NO: 153049 - DNA, 20 bp, human
ggtccccggaaagggtgggt

SEQ ID NO: 153050 - DNA, 20 bp, human
ggagggcgcgagcttgggag

SEQ ID NO: 153051 - DNA, 20 bp, human
ggacagcaaaacacagacgc

SEQ ID NO: 153052 - DNA, 20 bp, human
ggtcagtcactcggcggagg

SEQ ID NO: 153053 - DNA, 20 bp, human
ggcttgcagggtgccagtgg

SEQ ID NO: 153054 - DNA, 20 bp, human
gccgcccctcgtcagtcact

SEQ ID NO: 153055 - DNA, 20 bp, human
gggcggggactagtctcgtc

SEQ ID NO: 153056 - DNA, 20 bp, human
gtccggacgatgcagcgagg

SEQ ID NO: 153057 - DNA, 20 bp, human
gggacgatgcagcgaggagg

SEQ ID NO: 153058 - DNA, 20 bp, human
gcgcgggcagcccccaactc

SEQ ID NO: 153059 - DNA, 20 bp, human
gctgcatcgtccggagttgg

SEQ ID NO: 153060 - DNA, 20 bp, human
ggcgcacctcgtcctcgctc

SEQ ID NO: 153061 - DNA, 20 bp, human
gctctacctgagcgaggacg

SEQ ID NO: 153062 - DNA, 20 bp, human
gactgctggctgccacgggc

SEQ ID NO: 153063 - DNA, 20 bp, human
ggcgcacgggcgcgtcccgc

SEQ ID NO: 153064 - DNA, 20 bp, human
gtcatcgcaccgccggcccg

SEQ ID NO: 153065 - DNA, 20 bp, human
gggccgacgctcctcttcgg

SEQ ID NO: 153066 - DNA, 20 bp, human
gggctggggtcggagacctc

SEQ ID NO: 153067 - DNA, 20 bp, human
ggacaccagaggcacccgcg

SEQ ID NO: 153068 - DNA, 20 bp, human
ggaggcacccgcgaggtaga

SEQ ID NO: 153069 - DNA, 20 bp, human
gtcgctaaagtcagaagaga

SEQ ID NO: 153070 - DNA, 20 bp, human
gcgaggtagatggaactgcg

SEQ ID NO: 153071 - DNA, 20 bp, human
gacgcatgctggacagagat

SEQ ID NO: 153072 - DNA, 20 bp, human
gtgagggtgtgctccctcgg

SEQ ID NO: 153073 - DNA, 20 bp, human
gtctgtagtgagaaaggtga

SEQ ID NO: 153074 - DNA, 20 bp, human
gcccacaagaaggacccccg

SEQ ID NO: 153075 - DNA, 20 bp, human
gtctgaggtcggggaacaga

SEQ ID NO: 153076 - DNA, 20 bp, human
ggcgtcagggcatccactag

SEQ ID NO: 153077 - DNA, 20 bp, human
gtctgcccggaccccgctag

SEQ ID NO: 153078 - DNA, 20 bp, human
ggcggaaccatggccgatgg

SEQ ID NO: 153079 - DNA, 20 bp, human
ggagctgcgggaaccgggag

SEQ ID NO: 153080 - DNA, 20 bp, human
ggcatccactagcggggtcc

SEQ ID NO: 153081 - DNA, 20 bp, human
gcgagccccgcggagctcgg

SEQ ID NO: 153082 - DNA, 20 bp, human
gccggggccgagcggaccgc

SEQ ID NO: 153083 - DNA, 20 bp, human
ggcgcccgggctcggacccg

SEQ ID NO: 153084 - DNA, 20 bp, human
gcgcgcgtgtggaaagctag

SEQ ID NO: 153085 - DNA, 20 bp, human
gcccgggcccggaggacgcg

SEQ ID NO: 153086 - DNA, 20 bp, human
gcggctgccgggggaagcag

SEQ ID NO: 153087 - DNA, 20 bp, human
ggcagaggcgccggaggctg

SEQ ID NO: 153088 - DNA, 20 bp, human
gtgtcagagggccgaccccg

SEQ ID NO: 153089 - DNA, 20 bp, human
ggacaaccgcgaacaaaccc

SEQ ID NO: 153090 - DNA, 20 bp, human
ggctgaagtttgggcatcaa

SEQ ID NO: 153091 - DNA, 20 bp, human
gccttcggccatggctcccg

SEQ ID NO: 153092 - DNA, 20 bp, human
ggagagcgagcggtcctagg

SEQ ID NO: 153093 - DNA, 20 bp, human
gatggctcccgaggcgtcgg

SEQ ID NO: 153094 - DNA, 20 bp, human
gcaccgggcacccggcaccg

SEQ ID NO: 153095 - DNA, 20 bp, human
gctggagagcgagcggtcct

SEQ ID NO: 153096 - DNA, 20 bp, human
ggttggcctgggcctgaggt

SEQ ID NO: 153097 - DNA, 20 bp, human
gctgaggtgggagcaggttc

SEQ ID NO: 153098 - DNA, 20 bp, human
gggttctggacagatggcca

SEQ ID NO: 153099 - DNA, 20 bp, human
gatctgggaggagtcagtca

SEQ ID NO: 153100 - DNA, 20 bp, human
gcggtcaggaagctcatggt

SEQ ID NO: 153101 - DNA, 20 bp, human
gatggccaaggttgcaaatg

SEQ ID NO: 153102 - DNA, 20 bp, human
gtcttaccccacaggaggcg

SEQ ID NO: 153103 - DNA, 20 bp, human
gggccttggcagggacttga

SEQ ID NO: 153104 - DNA, 20 bp, human
ggggacccttcccaacacct

SEQ ID NO: 153105 - DNA, 20 bp, human
ggggtggcagagactaaggc

SEQ ID NO: 153106 - DNA, 20 bp, human
gcttgacccaggaggagtag

SEQ ID NO: 153107 - DNA, 20 bp, human
gtgctgcagacggagctctc

SEQ ID NO: 153108 - DNA, 20 bp, human
gggatgtgagcatagagtgg

SEQ ID NO: 153109 - DNA, 20 bp, human
gcctggatgtgagcatagag

SEQ ID NO: 153110 - DNA, 20 bp, human
ggcccactcgggcaaagagg

SEQ ID NO: 153111 - DNA, 20 bp, human
gggggagcctggaaaaaccc

SEQ ID NO: 153112 - DNA, 20 bp, human
gatcttccaatggaaatcca

SEQ ID NO: 153113 - DNA, 20 bp, human
gcacgcccactcgggcaaag

SEQ ID NO: 153114 - DNA, 20 bp, human
gtcagatggctttcctgaag

SEQ ID NO: 153115 - DNA, 20 bp, human
gtaacctgattgaagtcaga

SEQ ID NO: 153116 - DNA, 20 bp, human
gccgccgcacgtactaagga

SEQ ID NO: 153117 - DNA, 20 bp, human
gccacgcggaccagaggagg

SEQ ID NO: 153118 - DNA, 20 bp, human
gagctgggcgagctggacgc

SEQ ID NO: 153119 - DNA, 20 bp, human
gccacccgccgcacgtacta

SEQ ID NO: 153120 - DNA, 20 bp, human
gggcggacgctgggcgagct

SEQ ID NO: 153121 - DNA, 20 bp, human
gggcccggagcactgagcag

SEQ ID NO: 153122 - DNA, 20 bp, human
gggccgggcggagctcacct

SEQ ID NO: 153123 - DNA, 20 bp, human
ggcaacgcaaacataaaggg

SEQ ID NO: 153124 - DNA, 20 bp, human
ggctcaccttggccgaggcg

SEQ ID NO: 153125 - DNA, 20 bp, human
gagggcaggggcgtgtagga

SEQ ID NO: 153126 - DNA, 20 bp, human
ggataaaggctacttaacaa

SEQ ID NO: 153127 - DNA, 20 bp, human
gcgatgttggggacagagtt

SEQ ID NO: 153128 - DNA, 20 bp, human
gctgagagtactcatggaaa

SEQ ID NO: 153129 - DNA, 20 bp, human
gacagacacagataacccga

SEQ ID NO: 153130 - DNA, 20 bp, human
gaaaggctacttaacaaagg

SEQ ID NO: 153131 - DNA, 20 bp, human
gagagtagtcaaccagaaaa

SEQ ID NO: 153132 - DNA, 20 bp, human
gaccttcaggtccaaaaacc

SEQ ID NO: 153133 - DNA, 20 bp, human
ggtctgttgtgacgatgttg

SEQ ID NO: 153134 - DNA, 20 bp, human
gactagtggtgacctccaca

SEQ ID NO: 153135 - DNA, 20 bp, human
ggtaagctccttgaaggttg

SEQ ID NO: 153136 - DNA, 20 bp, human
gcgggagcccagagacgcct

SEQ ID NO: 153137 - DNA, 20 bp, human
gtggccgcctagggtagcag

SEQ ID NO: 153138 - DNA, 20 bp, human
gggcaaggctgggccgggaa

SEQ ID NO: 153139 - DNA, 20 bp, human
ggcctcgtgggagggaactg

SEQ ID NO: 153140 - DNA, 20 bp, human
gggaggcagtgacccacgac

SEQ ID NO: 153141 - DNA, 20 bp, human
gccagtcacgacaaggccca

SEQ ID NO: 153142 - DNA, 20 bp, human
gaccctaggcggccacccca

SEQ ID NO: 153143 - DNA, 20 bp, human
gctgggctcccgggagaccg

SEQ ID NO: 153144 - DNA, 20 bp, human
gcttgctcctaggcgtctct

SEQ ID NO: 153145 - DNA, 20 bp, human
gggccttgtcgtgactggga

SEQ ID NO: 153146 - DNA, 20 bp, human
gcacttacccctcaatgcac

SEQ ID NO: 153147 - DNA, 20 bp, human
gggttcttaggtggtccaca

SEQ ID NO: 153148 - DNA, 20 bp, human
gcagtgcccttcaccactgc

SEQ ID NO: 153149 - DNA, 20 bp, human
gccttggatgggttcttagg

SEQ ID NO: 153150 - DNA, 20 bp, human
gacttgcctgagcacctctg

SEQ ID NO: 153151 - DNA, 20 bp, human
gtccacagggtagtgactgc

SEQ ID NO: 153152 - DNA, 20 bp, human
gccacattcctgtgcattga

SEQ ID NO: 153153 - DNA, 20 bp, human
gggggtaagtgcattttcct

SEQ ID NO: 153154 - DNA, 20 bp, human
gctgattataaaaccttcct

SEQ ID NO: 153155 - DNA, 20 bp, human
gaaatgcaatatcaccccag

SEQ ID NO: 153156 - DNA, 20 bp, human
gttcagctcacccttagaga

SEQ ID NO: 153157 - DNA, 20 bp, human
gctgaagcagctgcttacaa

SEQ ID NO: 153158 - DNA, 20 bp, human
gttgcaaacaccatcaaggt

SEQ ID NO: 153159 - DNA, 20 bp, human
gcccctcagtgcagggtcat

SEQ ID NO: 153160 - DNA, 20 bp, human
gctcagagctcgggttgtga

SEQ ID NO: 153161 - DNA, 20 bp, human
gggattctccaacacagtgt

SEQ ID NO: 153162 - DNA, 20 bp, human
ggctcgggttgtgaaggccc

SEQ ID NO: 153163 - DNA, 20 bp, human
gcaatggtcatgaaccaccc

SEQ ID NO: 153164 - DNA, 20 bp, human
gccccttccgaactgagtat

SEQ ID NO: 153165 - DNA, 20 bp, human
gtaacaaggcttgacctgga

SEQ ID NO: 153166 - DNA, 20 bp, human
ggtcagccatgagactcacc

SEQ ID NO: 153167 - DNA, 20 bp, human
gactcacccggcaaggagat

SEQ ID NO: 153168 - DNA, 20 bp, human
ggatctccagcctccctcca

SEQ ID NO: 153169 - DNA, 20 bp, human
gtgccgctgaggagaggtaa

SEQ ID NO: 153170 - DNA, 20 bp, human
gtgagtctcatggctgaccc

SEQ ID NO: 153171 - DNA, 20 bp, human
ggagcggttagagtgtgtgt

SEQ ID NO: 153172 - DNA, 20 bp, human
gtccaggacgggtttagtac

SEQ ID NO: 153173 - DNA, 20 bp, human
gcccacccgccgcaccccag

SEQ ID NO: 153174 - DNA, 20 bp, human
gtgacaagggtcctggaacg

SEQ ID NO: 153175 - DNA, 20 bp, human
gccatgagactcacccggca

SEQ ID NO: 153176 - DNA, 20 bp, human
gcaacaggtaaggaaaccca

SEQ ID NO: 153177 - DNA, 20 bp, human
gcagcggctgccaacaggta

SEQ ID NO: 153178 - DNA, 20 bp, human
ggcagccgctgagacaagac

SEQ ID NO: 153179 - DNA, 20 bp, human
gccaggccaacgcatctagg

SEQ ID NO: 153180 - DNA, 20 bp, human
gcagacacagtgggcaccat

SEQ ID NO: 153181 - DNA, 20 bp, human
ggccgctgagacaagacagg

SEQ ID NO: 153182 - DNA, 20 bp, human
ggtcctatagctggccccag

SEQ ID NO: 153183 - DNA, 20 bp, human
gtgtcggtcagccaacgcag

SEQ ID NO: 153184 - DNA, 20 bp, human
gctcctctggggccagctat

SEQ ID NO: 153185 - DNA, 20 bp, human
gctgtgtgggcctcagaaga

SEQ ID NO: 153186 - DNA, 20 bp, human
ggtgcagcggggaggagtcc

SEQ ID NO: 153187 - DNA, 20 bp, human
gcgatcctccccaaaaggag

SEQ ID NO: 153188 - DNA, 20 bp, human
gcggcagccgaagacctccc

SEQ ID NO: 153189 - DNA, 20 bp, human
gtaacaagggcccaacccca

SEQ ID NO: 153190 - DNA, 20 bp, human
gtggctcggtggggagatag

SEQ ID NO: 153191 - DNA, 20 bp, human
gggagaggacaaatgcgtgt

SEQ ID NO: 153192 - DNA, 20 bp, human
ggggagctgtgtcctagggg

SEQ ID NO: 153193 - DNA, 20 bp, human
gacctcccaggccgggccca

SEQ ID NO: 153194 - DNA, 20 bp, human
gatggggtccagaaggaacc

SEQ ID NO: 153195 - DNA, 20 bp, human
gagggagtgggacagattct

SEQ ID NO: 153196 - DNA, 20 bp, human
gcagaggtactcaccagacc

SEQ ID NO: 153197 - DNA, 20 bp, human
ggggtggggaggatccccgt

SEQ ID NO: 153198 - DNA, 20 bp, human
ggcccaggttgatcccacca

SEQ ID NO: 153199 - DNA, 20 bp, human
ggagtacctctgtcctgctg

SEQ ID NO: 153200 - DNA, 20 bp, human
gctctctgggccttccccct

SEQ ID NO: 153201 - DNA, 20 bp, human
ggatcaacctgggcctctct

SEQ ID NO: 153202 - DNA, 20 bp, human
gagggtgaggatttatatgt

SEQ ID NO: 153203 - DNA, 20 bp, human
gacagagagttcttccaagg

SEQ ID NO: 153204 - DNA, 20 bp, human
gtcattccagcttccctggt

SEQ ID NO: 153205 - DNA, 20 bp, human
gagagttcttccaaggggga

SEQ ID NO: 153206 - DNA, 20 bp, human
ggctaggccttagcagggag

SEQ ID NO: 153207 - DNA, 20 bp, human
ggtctgggagggctactcag

SEQ ID NO: 153208 - DNA, 20 bp, human
gggcttctagggcatctcat

SEQ ID NO: 153209 - DNA, 20 bp, human
gctgggaccgagccatccct

SEQ ID NO: 153210 - DNA, 20 bp, human
gtatccccaacacccaggga

SEQ ID NO: 153211 - DNA, 20 bp, human
gggtcgggagggtaacctca

SEQ ID NO: 153212 - DNA, 20 bp, human
gtcacctcgctggcccagtc

SEQ ID NO: 153213 - DNA, 20 bp, human
ggggagggtaacctcagggg

SEQ ID NO: 153214 - DNA, 20 bp, human
gcttaaggagccccacggtg

SEQ ID NO: 153215 - DNA, 20 bp, human
ggggtgttggggataagaag

SEQ ID NO: 153216 - DNA, 20 bp, human
gtgcagggcagaggctcatg

SEQ ID NO: 153217 - DNA, 20 bp, human
gagccagtgcagatacccac

SEQ ID NO: 153218 - DNA, 20 bp, human
ggaagaagcgctgaggagag

SEQ ID NO: 153219 - DNA, 20 bp, human
ggcgcaagctctggagattc

SEQ ID NO: 153220 - DNA, 20 bp, human
gtgcctgtgggtatctgcac

SEQ ID NO: 153221 - DNA, 20 bp, human
gaaaggcagaaggcaactgt

SEQ ID NO: 153222 - DNA, 20 bp, human
ggcagcagcccagctcgaga

SEQ ID NO: 153223 - DNA, 20 bp, human
gtacagagggcatctatcag

SEQ ID NO: 153224 - DNA, 20 bp, human
gagtgaggtggcagaggcaa

SEQ ID NO: 153225 - DNA, 20 bp, human
ggagtggatagactgagtga

SEQ ID NO: 153226 - DNA, 20 bp, human
gagatggtggagcagatcaa

SEQ ID NO: 153227 - DNA, 20 bp, human
gagaggctacgcttgaataa

SEQ ID NO: 153228 - DNA, 20 bp, human
gtcaacaaggagcagcaggg

SEQ ID NO: 153229 - DNA, 20 bp, human
gctacgcttgaataagggcc

SEQ ID NO: 153230 - DNA, 20 bp, human
gaagcgtagcctctggatcc

SEQ ID NO: 153231 - DNA, 20 bp, human
ggagagagtccagggctgag

SEQ ID NO: 153232 - DNA, 20 bp, human
ggctccaccatctgccacca

SEQ ID NO: 153233 - DNA, 20 bp, human
gcgacctcctcaaaaggccc

SEQ ID NO: 153234 - DNA, 20 bp, human
gggctgtgctattggaatcc

SEQ ID NO: 153235 - DNA, 20 bp, human
gccaccagggccttttgagg

SEQ ID NO: 153236 - DNA, 20 bp, human
ggctcctggagagaactcac

SEQ ID NO: 153237 - DNA, 20 bp, human
gagagaactcaccggtaggg

SEQ ID NO: 153238 - DNA, 20 bp, human
gtggagagaactcaccggta

SEQ ID NO: 153239 - DNA, 20 bp, human
gactagggccaaggcaagag

SEQ ID NO: 153240 - DNA, 20 bp, human
gtgcgacgcgagcggtcgag

SEQ ID NO: 153241 - DNA, 20 bp, human
gcatttggccgcctccctac

SEQ ID NO: 153242 - DNA, 20 bp, human
gggctggacccccagcgtga

SEQ ID NO: 153243 - DNA, 20 bp, human
gcgcgagcggtcgaggggat

SEQ ID NO: 153244 - DNA, 20 bp, human
ggctgagaactgtccttcag

SEQ ID NO: 153245 - DNA, 20 bp, human
gcggccaaatgcgacgcgag

SEQ ID NO: 153246 - DNA, 20 bp, human
gagatggcttgcccctacct

SEQ ID NO: 153247 - DNA, 20 bp, human
gcaaccgggaccccaacagg

SEQ ID NO: 153248 - DNA, 20 bp, human
gtagcaaccgggaccccaac

SEQ ID NO: 153249 - DNA, 20 bp, human
gtatgctgtgtcggggtccc

SEQ ID NO: 153250 - DNA, 20 bp, human
ggggaggggatttagcaacc

SEQ ID NO: 153251 - DNA, 20 bp, human
ggctccagctccacagaggg

SEQ ID NO: 153252 - DNA, 20 bp, human
gccagctccagctccacaga

SEQ ID NO: 153253 - DNA, 20 bp, human
gcagctccacagagggtgga

SEQ ID NO: 153254 - DNA, 20 bp, human
gcctagccctccaccctctg

SEQ ID NO: 153255 - DNA, 20 bp, human
ggccagggctatgctgtgtc

SEQ ID NO: 153256 - DNA, 20 bp, human
ggctctgcccccacagaggg

SEQ ID NO: 153257 - DNA, 20 bp, human
ggcatggcaggctgggcact

SEQ ID NO: 153258 - DNA, 20 bp, human
gtatccctcctccctctgtg

SEQ ID NO: 153259 - DNA, 20 bp, human
ggggaggggattcagcaact

SEQ ID NO: 153260 - DNA, 20 bp, human
gtcgtgacacttcccagttc

SEQ ID NO: 153261 - DNA, 20 bp, human
gcagcaactgggatcccaaa

SEQ ID NO: 153262 - DNA, 20 bp, human
gaaattctcagtcaatctct

SEQ ID NO: 153263 - DNA, 20 bp, human
gctgagaatttacaggtcca

SEQ ID NO: 153264 - DNA, 20 bp, human
gagattgactgagaatttac

SEQ ID NO: 153265 - DNA, 20 bp, human
gctggattcattctcctttt

SEQ ID NO: 153266 - DNA, 20 bp, human
gtgaatggtaggccagacac

SEQ ID NO: 153267 - DNA, 20 bp, human
gataggagaaagtgaatggt

SEQ ID NO: 153268 - DNA, 20 bp, human
gctagaaaaggcaaataggc

SEQ ID NO: 153269 - DNA, 20 bp, human
gtctagcagtgcccagtgtc

SEQ ID NO: 153270 - DNA, 20 bp, human
gtcaccagggctatgctgtg

SEQ ID NO: 153271 - DNA, 20 bp, human
gggactcttagccctctgtg

SEQ ID NO: 153272 - DNA, 20 bp, human
gggaggcttgctgaaccccc

SEQ ID NO: 153273 - DNA, 20 bp, human
ggcctccaaagtattcttag

SEQ ID NO: 153274 - DNA, 20 bp, human
gtgtacagatgtgggctctc

SEQ ID NO: 153275 - DNA, 20 bp, human
ggagatgatctgcccctacc

SEQ ID NO: 153276 - DNA, 20 bp, human
gctggtaagtgggactgtct

SEQ ID NO: 153277 - DNA, 20 bp, human
gtggccagggcagtacgcag

SEQ ID NO: 153278 - DNA, 20 bp, human
gtcaggtggggcaagtccgt

SEQ ID NO: 153279 - DNA, 20 bp, human
gttcagaagacctggtaagt

SEQ ID NO: 153280 - DNA, 20 bp, human
gtaagtgggactgtctgggt

SEQ ID NO: 153281 - DNA, 20 bp, human
gatgatagggatacacgtgt

SEQ ID NO: 153282 - DNA, 20 bp, human
gagtatatcagggtgaggag

SEQ ID NO: 153283 - DNA, 20 bp, human
gaaccttctggggaatccca

SEQ ID NO: 153284 - DNA, 20 bp, human
ggagtgtcctcagtatatca

SEQ ID NO: 153285 - DNA, 20 bp, human
gaagatctcagagagagccg

SEQ ID NO: 153286 - DNA, 20 bp, human
gtaggcagggccaaccaagg

SEQ ID NO: 153287 - DNA, 20 bp, human
gctctggcaaacactctgtg

SEQ ID NO: 153288 - DNA, 20 bp, human
gaagtaggcagggccaacca

SEQ ID NO: 153289 - DNA, 20 bp, human
ggcgagtgtcctgttataca

SEQ ID NO: 153290 - DNA, 20 bp, human
ggtgcaggctcggcatttat

SEQ ID NO: 153291 - DNA, 20 bp, human
gttggaaggaagttgggtca

SEQ ID NO: 153292 - DNA, 20 bp, human
gctccctccactggaatagt

SEQ ID NO: 153293 - DNA, 20 bp, human
gacagttacacaggacgaca

SEQ ID NO: 153294 - DNA, 20 bp, human
gagctcacttaccaaagccg

SEQ ID NO: 153295 - DNA, 20 bp, human
ggtcaacccaaactgcggtg

SEQ ID NO: 153296 - DNA, 20 bp, human
gctctgctgcgggtcctggg

SEQ ID NO: 153297 - DNA, 20 bp, human
gaccaggaaggggtgagaca

SEQ ID NO: 153298 - DNA, 20 bp, human
gcctgggcggcaggactggt

SEQ ID NO: 153299 - DNA, 20 bp, human
gtgcagcaaggagaccagga

SEQ ID NO: 153300 - DNA, 20 bp, human
gcgcctgcagcaaggagacc

SEQ ID NO: 153301 - DNA, 20 bp, human
ggggcggtggaagaaatata

SEQ ID NO: 153302 - DNA, 20 bp, human
ggaagaaaaaagggcctgta

SEQ ID NO: 153303 - DNA, 20 bp, human
gacacacctctagctgtcta

SEQ ID NO: 153304 - DNA, 20 bp, human
gagagacgacgcctgcagca

SEQ ID NO: 153305 - DNA, 20 bp, human
ggggagccaggattgcacat

SEQ ID NO: 153306 - DNA, 20 bp, human
gtaccaaaatcacactaacc

SEQ ID NO: 153307 - DNA, 20 bp, human
gagcctgcagagtgcagatc

SEQ ID NO: 153308 - DNA, 20 bp, human
gtctgttaggagatggtccc

SEQ ID NO: 153309 - DNA, 20 bp, human
ggtttcactattgggcaacc

SEQ ID NO: 153310 - DNA, 20 bp, human
ggagtattaatgcaaacaga

SEQ ID NO: 153311 - DNA, 20 bp, human
gggtgtgaaagataatggtc

SEQ ID NO: 153312 - DNA, 20 bp, human
gaaccaggttagtgtgattt

SEQ ID NO: 153313 - DNA, 20 bp, human
ggagtacatctgttaggaga

SEQ ID NO: 153314 - DNA, 20 bp, human
gttcttagagtacatctgtt

SEQ ID NO: 153315 - DNA, 20 bp, human
gttctagcttctaagttaca

SEQ ID NO: 153316 - DNA, 20 bp, human
gggccgagaaaatgtcccac

SEQ ID NO: 153317 - DNA, 20 bp, human
gcggaactagagacagccat

SEQ ID NO: 153318 - DNA, 20 bp, human
gcaccctggcataaaggcag

SEQ ID NO: 153319 - DNA, 20 bp, human
gcggcggtcaaggggctcag

SEQ ID NO: 153320 - DNA, 20 bp, human
gcctggcataaaggcagggg

SEQ ID NO: 153321 - DNA, 20 bp, human
ggctgtctctagttccgtca

SEQ ID NO: 153322 - DNA, 20 bp, human
gtggaagcccagccaaggaa

SEQ ID NO: 153323 - DNA, 20 bp, human
gccggcagtgctggactcag

SEQ ID NO: 153324 - DNA, 20 bp, human
gggcctgtcacaaatacact

SEQ ID NO: 153325 - DNA, 20 bp, human
gcaccctctgtgtcaatatg

SEQ ID NO: 153326 - DNA, 20 bp, human
gcagccgggccaacaccagg

SEQ ID NO: 153327 - DNA, 20 bp, human
gctcggggtaggggaggtcg

SEQ ID NO: 153328 - DNA, 20 bp, human
gtgttggcccggctgactcg

SEQ ID NO: 153329 - DNA, 20 bp, human
gccgactctcaagacgacca

SEQ ID NO: 153330 - DNA, 20 bp, human
gggcctcccaatccctccaa

SEQ ID NO: 153331 - DNA, 20 bp, human
gaagagcgggagggacgagg

SEQ ID NO: 153332 - DNA, 20 bp, human
gggcgataaaatggcgcagg

SEQ ID NO: 153333 - DNA, 20 bp, human
gcccggctgactcggggtag

SEQ ID NO: 153334 - DNA, 20 bp, human
ggacgcggcagaaaagcccg

SEQ ID NO: 153335 - DNA, 20 bp, human
gcggggagggggcgataaaa

SEQ ID NO: 153336 - DNA, 20 bp, human
gatcatagctcggagcgtag

SEQ ID NO: 153337 - DNA, 20 bp, human
ggcaggcgttggattagaga

SEQ ID NO: 153338 - DNA, 20 bp, human
gcctttcctggtgaccatcc

SEQ ID NO: 153339 - DNA, 20 bp, human
ggctcggagcgtagaggttc

SEQ ID NO: 153340 - DNA, 20 bp, human
gttcctgtgcagatgagata

SEQ ID NO: 153341 - DNA, 20 bp, human
gaacagcactactcacagca

SEQ ID NO: 153342 - DNA, 20 bp, human
gatcacggcgtggatctaag

SEQ ID NO: 153343 - DNA, 20 bp, human
ggttgaagtgtgagcctggc

SEQ ID NO: 153344 - DNA, 20 bp, human
gcagaagaaccttcaaggtg

SEQ ID NO: 153345 - DNA, 20 bp, human
gatgaactaagtgttcttta

SEQ ID NO: 153346 - DNA, 20 bp, human
gccgcagcggagcactccaa

SEQ ID NO: 153347 - DNA, 20 bp, human
gggagagcccgggatctgta

SEQ ID NO: 153348 - DNA, 20 bp, human
ggcactacgcagtcagtcgg

SEQ ID NO: 153349 - DNA, 20 bp, human
ggtggaacctacgggtgtag

SEQ ID NO: 153350 - DNA, 20 bp, human
gcgcgtagcaggcagggaac

SEQ ID NO: 153351 - DNA, 20 bp, human
gtggccagtcccgctcgccg

SEQ ID NO: 153352 - DNA, 20 bp, human
gtgacttcgcgtagcaggca

SEQ ID NO: 153353 - DNA, 20 bp, human
gagcgagccgtacagatccc

SEQ ID NO: 153354 - DNA, 20 bp, human
gccctgcttgagcgaggtag

SEQ ID NO: 153355 - DNA, 20 bp, human
ggcaggcagggaactggccg

SEQ ID NO: 153356 - DNA, 20 bp, human
gcttggcgtctgcgtcccca

SEQ ID NO: 153357 - DNA, 20 bp, human
gcgggctcggctaagtcccg

SEQ ID NO: 153358 - DNA, 20 bp, human
gttcgactggagtctttggg

SEQ ID NO: 153359 - DNA, 20 bp, human
gagccggagtcagccaggag

SEQ ID NO: 153360 - DNA, 20 bp, human
ggcagacgccaaggcccctc

SEQ ID NO: 153361 - DNA, 20 bp, human
gagaccccggtccccgagca

SEQ ID NO: 153362 - DNA, 20 bp, human
gggacttagccgagcccggc

SEQ ID NO: 153363 - DNA, 20 bp, human
gagcgcgcgtggcgacaagg

SEQ ID NO: 153364 - DNA, 20 bp, human
gtcggatcccgagacctcag

SEQ ID NO: 153365 - DNA, 20 bp, human
gccttggcttggaggctcca

SEQ ID NO: 153366 - DNA, 20 bp, human
ggacgggcaacagggactca

SEQ ID NO: 153367 - DNA, 20 bp, human
gcagggactcagggaccaga

SEQ ID NO: 153368 - DNA, 20 bp, human
gcagcgccctcagccgacgg

SEQ ID NO: 153369 - DNA, 20 bp, human
ggccgaggaagccggttccg

SEQ ID NO: 153370 - DNA, 20 bp, human
ggttccggggacgggcaaca

SEQ ID NO: 153371 - DNA, 20 bp, human
ggcccgcctctcacctccgt

SEQ ID NO: 153372 - DNA, 20 bp, human
gtacctggatgaaagtggag

SEQ ID NO: 153373 - DNA, 20 bp, human
gagtccctgttgcccgtccc

SEQ ID NO: 153374 - DNA, 20 bp, human
gctctgactcgctcgggcag

SEQ ID NO: 153375 - DNA, 20 bp, human
gcgggcggggcgcggaacca

SEQ ID NO: 153376 - DNA, 20 bp, human
gaacgccacggggaccccgg

SEQ ID NO: 153377 - DNA, 20 bp, human
ggaagagcaggccctcccgt

SEQ ID NO: 153378 - DNA, 20 bp, human
gagctgttggcaggactcgg

SEQ ID NO: 153379 - DNA, 20 bp, human
gccctcccgtaggaaccact

SEQ ID NO: 153380 - DNA, 20 bp, human
ggggaggccatgaacgccac

SEQ ID NO: 153381 - DNA, 20 bp, human
gggcctcagtcagcccccgg

SEQ ID NO: 153382 - DNA, 20 bp, human
ggccgatgaagccgtagacg

SEQ ID NO: 153383 - DNA, 20 bp, human
gatgaacgccacggggaccc

SEQ ID NO: 153384 - DNA, 20 bp, human
gcgttcatggcctcccccgg

SEQ ID NO: 153385 - DNA, 20 bp, human
ggcagtgaagagcaggctga

SEQ ID NO: 153386 - DNA, 20 bp, human
gtgcgggtggcgcacgacca

SEQ ID NO: 153387 - DNA, 20 bp, human
ggaccagggcgcagagtgag

SEQ ID NO: 153388 - DNA, 20 bp, human
gcccagcccagcgcccccaa

SEQ ID NO: 153389 - DNA, 20 bp, human
gagtcacacacagagaatca

SEQ ID NO: 153390 - DNA, 20 bp, human
ggctcacccatgctggaggt

SEQ ID NO: 153391 - DNA, 20 bp, human
gggtggggagcccaaataca

SEQ ID NO: 153392 - DNA, 20 bp, human
ggtgcaggacctgggatacg

SEQ ID NO: 153393 - DNA, 20 bp, human
gcggcagcaggactgaagta

SEQ ID NO: 153394 - DNA, 20 bp, human
ggcccaaatacagggagaca

SEQ ID NO: 153395 - DNA, 20 bp, human
gcagagtgagtggactgcac

SEQ ID NO: 153396 - DNA, 20 bp, human
gtcgctcccaagaaaccagc

SEQ ID NO: 153397 - DNA, 20 bp, human
gccttccctgctggtttctt

SEQ ID NO: 153398 - DNA, 20 bp, human
gtatactgagccttccctgc

SEQ ID NO: 153399 - DNA, 20 bp, human
ggcagccaccgctccctggc

SEQ ID NO: 153400 - DNA, 20 bp, human
gtcctccatcagtgccacgt

SEQ ID NO: 153401 - DNA, 20 bp, human
ggcataagaggatgccaacg

SEQ ID NO: 153402 - DNA, 20 bp, human
gaatagcagccaccgctccc

SEQ ID NO: 153403 - DNA, 20 bp, human
gtcaggtgaggagcacacca

SEQ ID NO: 153404 - DNA, 20 bp, human
gctacagcacagatcaggtg

SEQ ID NO: 153405 - DNA, 20 bp, human
gtgagggagtgacagtctgg

SEQ ID NO: 153406 - DNA, 20 bp, human
gccacctctccctggcagac

SEQ ID NO: 153407 - DNA, 20 bp, human
ggtgagccttgctggtctct

SEQ ID NO: 153408 - DNA, 20 bp, human
gtatttatagtgagccttgc

SEQ ID NO: 153409 - DNA, 20 bp, human
gccttgctggtctcttggga

SEQ ID NO: 153410 - DNA, 20 bp, human
gtgcgggtccctgtctgcca

SEQ ID NO: 153411 - DNA, 20 bp, human
gtcctccatcagtgccacat

SEQ ID NO: 153412 - DNA, 20 bp, human
gtcaggtgaggagcacacca

SEQ ID NO: 153413 - DNA, 20 bp, human
gctacagcacagatcaggtg

SEQ ID NO: 153414 - DNA, 20 bp, human
gtgagggagtgacagtctgg

SEQ ID NO: 153415 - DNA, 20 bp, human
ggtccctgtctgccagggag

SEQ ID NO: 153416 - DNA, 20 bp, human
gccacctctccctggcagac

SEQ ID NO: 153417 - DNA, 20 bp, human
ggtcttagaccagtttgtag

SEQ ID NO: 153418 - DNA, 20 bp, human
ggtgagccttgctggtctct

SEQ ID NO: 153419 - DNA, 20 bp, human
gtatttatagtgagccttgc

SEQ ID NO: 153420 - DNA, 20 bp, human
gccttgctggtctcttggga

SEQ ID NO: 153421 - DNA, 20 bp, human
gtcctccatcagtgccacat

SEQ ID NO: 153422 - DNA, 20 bp, human
gtgcgggtccctgtctgcca

SEQ ID NO: 153423 - DNA, 20 bp, human
gacaagttcctggatgccgg

SEQ ID NO: 153424 - DNA, 20 bp, human
gtcaggtgaggagcacacca

SEQ ID NO: 153425 - DNA, 20 bp, human
gtgagggagtgacagtctgg

SEQ ID NO: 153426 - DNA, 20 bp, human
gctggccgtggagctatagt

SEQ ID NO: 153427 - DNA, 20 bp, human
gcatctggagaaaggtccac

SEQ ID NO: 153428 - DNA, 20 bp, human
gggtcagtgctgaggagagt

SEQ ID NO: 153429 - DNA, 20 bp, human
gccagatgaaatttcagtaa

SEQ ID NO: 153430 - DNA, 20 bp, human
gttggaagaaacctcacctg

SEQ ID NO: 153431 - DNA, 20 bp, human
gctgaggagagtaggaactc

SEQ ID NO: 153432 - DNA, 20 bp, human
gcagagctgctggtatcttc

SEQ ID NO: 153433 - DNA, 20 bp, human
gcagcactgaccccgtaatg

SEQ ID NO: 153434 - DNA, 20 bp, human
gctatagttggtacctctgc

SEQ ID NO: 153435 - DNA, 20 bp, human
ggatctgggctgagaattaa

SEQ ID NO: 153436 - DNA, 20 bp, human
gccagagcgcccggcgtacc

SEQ ID NO: 153437 - DNA, 20 bp, human
ggcgggacgcgacaaagtca

SEQ ID NO: 153438 - DNA, 20 bp, human
gccgggtcgcgacaaggagg

SEQ ID NO: 153439 - DNA, 20 bp, human
gaagctgcggaggagacgac

SEQ ID NO: 153440 - DNA, 20 bp, human
gccgccgggtcgcgacaagg

SEQ ID NO: 153441 - DNA, 20 bp, human
gccgccgccgggtcgcgaca

SEQ ID NO: 153442 - DNA, 20 bp, human
gttgggaaagcaaaatagaa

SEQ ID NO: 153443 - DNA, 20 bp, human
gggatggggagcaaaacccg

SEQ ID NO: 153444 - DNA, 20 bp, human
gcggcacggccttcaagcgc

SEQ ID NO: 153445 - DNA, 20 bp, human
ggggcaggaggattcgccag

SEQ ID NO: 153446 - DNA, 20 bp, human
gcaacctacatggtaaacgt

SEQ ID NO: 153447 - DNA, 20 bp, human
gcaacccacgtttaccatgt

SEQ ID NO: 153448 - DNA, 20 bp, human
ggcagaagtggccagtgttt

SEQ ID NO: 153449 - DNA, 20 bp, human
gaagtaagcaacaacctaca

SEQ ID NO: 153450 - DNA, 20 bp, human
gggccagtgtttgggttgaa

SEQ ID NO: 153451 - DNA, 20 bp, human
gactgcttgaacacacgagt

SEQ ID NO: 153452 - DNA, 20 bp, human
gatcctttcaacccaaacac

SEQ ID NO: 153453 - DNA, 20 bp, human
gacttctagaaatagttaca

SEQ ID NO: 153454 - DNA, 20 bp, human
ggtttgggttgaaaggatcc

SEQ ID NO: 153455 - DNA, 20 bp, human
gcttcattaccttgcactca

SEQ ID NO: 153456 - DNA, 20 bp, human
gctcgcagccgggcatgagg

SEQ ID NO: 153457 - DNA, 20 bp, human
gggggctgcggggagacggt

SEQ ID NO: 153458 - DNA, 20 bp, human
gccggctgcgagctgcccgt

SEQ ID NO: 153459 - DNA, 20 bp, human
ggccacgctgctgaccgtag

SEQ ID NO: 153460 - DNA, 20 bp, human
gcagggagcgggcgacgccg

SEQ ID NO: 153461 - DNA, 20 bp, human
ggccccgcctcaccacaaag

SEQ ID NO: 153462 - DNA, 20 bp, human
ggttgcggcagggactacac

SEQ ID NO: 153463 - DNA, 20 bp, human
gggcggccgggcacatgtcc

SEQ ID NO: 153464 - DNA, 20 bp, human
gggcccgagccgcgccacta

SEQ ID NO: 153465 - DNA, 20 bp, human
gacctcggcgcgggcgatgt

SEQ ID NO: 153466 - DNA, 20 bp, human
gtcaggccggctctcctgcg

SEQ ID NO: 153467 - DNA, 20 bp, human
gtggttgtgcaggatggcga

SEQ ID NO: 153468 - DNA, 20 bp, human
gagagttgtagccgaggtgg

SEQ ID NO: 153469 - DNA, 20 bp, human
gggtagagttgtagccgagg

SEQ ID NO: 153470 - DNA, 20 bp, human
gagctgcggccgctgtgcca

SEQ ID NO: 153471 - DNA, 20 bp, human
ggttatgatgcggcccttca

SEQ ID NO: 153472 - DNA, 20 bp, human
ggtagctctgcatagaaagt

SEQ ID NO: 153473 - DNA, 20 bp, human
ggccataggccgggaaccag

SEQ ID NO: 153474 - DNA, 20 bp, human
gacaactctaccggtcaccc

SEQ ID NO: 153475 - DNA, 20 bp, human
gctcgggcgaggcctaggag

SEQ ID NO: 153476 - DNA, 20 bp, human
gaaaacgtcgcagaaattct

SEQ ID NO: 153477 - DNA, 20 bp, human
gcctgacatcagatgatgaa

SEQ ID NO: 153478 - DNA, 20 bp, human
gtttacatctgctgagatga

SEQ ID NO: 153479 - DNA, 20 bp, human
gctgctgatccagcgaccca

SEQ ID NO: 153480 - DNA, 20 bp, human
gcaggcaaccattatcagac

SEQ ID NO: 153481 - DNA, 20 bp, human
gtgactctccagtctgataa

SEQ ID NO: 153482 - DNA, 20 bp, human
gttatcctgagaacttccat

SEQ ID NO: 153483 - DNA, 20 bp, human
gactggagagtcatacttta

SEQ ID NO: 153484 - DNA, 20 bp, human
gaacagtgtggattcgctaa

SEQ ID NO: 153485 - DNA, 20 bp, human
gttctttttgaaggttcttg

SEQ ID NO: 153486 - DNA, 20 bp, human
gagctgcttgggggaggtaa

SEQ ID NO: 153487 - DNA, 20 bp, human
ggagccgcctggacccagtg

SEQ ID NO: 153488 - DNA, 20 bp, human
gtagggggagcgactgactg

SEQ ID NO: 153489 - DNA, 20 bp, human
ggaactgctgatggcactgg

SEQ ID NO: 153490 - DNA, 20 bp, human
gccgcagccgcactgggtcc

SEQ ID NO: 153491 - DNA, 20 bp, human
gtggcggtgcctggcaaccc

SEQ ID NO: 153492 - DNA, 20 bp, human
gcggtgcctggcaacccggg

SEQ ID NO: 153493 - DNA, 20 bp, human
gtagtccagcatcttgaccg

SEQ ID NO: 153494 - DNA, 20 bp, human
gtgaatttgtgggtgaggag

SEQ ID NO: 153495 - DNA, 20 bp, human
gctcccccaagcagctgcag

SEQ ID NO: 153496 - DNA, 20 bp, human
gcggttggcttgagcgggac

SEQ ID NO: 153497 - DNA, 20 bp, human
gttgagcgggaccggagctg

SEQ ID NO: 153498 - DNA, 20 bp, human
gggaggcggcacagtatgac

SEQ ID NO: 153499 - DNA, 20 bp, human
gcgcggttaggggataagag

SEQ ID NO: 153500 - DNA, 20 bp, human
gggtggcgcgcgggtccggc

SEQ ID NO: 153501 - DNA, 20 bp, human
ggaaatccgaggcccgaaag

SEQ ID NO: 153502 - DNA, 20 bp, human
ggagggccgttccgaaggat

SEQ ID NO: 153503 - DNA, 20 bp, human
gactccgggcgtgctgccgg

SEQ ID NO: 153504 - DNA, 20 bp, human
ggagctcccatccttcggaa

SEQ ID NO: 153505 - DNA, 20 bp, human
gaaggatgggagctctgaag

SEQ ID NO: 153506 - DNA, 20 bp, human
ggaatggcggagactctgtc

SEQ ID NO: 153507 - DNA, 20 bp, human
gcgcgtcccggtctctgacg

SEQ ID NO: 153508 - DNA, 20 bp, human
gtcaggctcctagcacaaaa

SEQ ID NO: 153509 - DNA, 20 bp, human
ggcccggttctgtggaaagt

SEQ ID NO: 153510 - DNA, 20 bp, human
ggacgcgagagcgccaggtc

SEQ ID NO: 153511 - DNA, 20 bp, human
gggagcggttccctcgcagg

SEQ ID NO: 153512 - DNA, 20 bp, human
gggccaaggaactctctccg

SEQ ID NO: 153513 - DNA, 20 bp, human
ggctaggagcctgataaaac

SEQ ID NO: 153514 - DNA, 20 bp, human
ggcccactttccacagaacc

SEQ ID NO: 153515 - DNA, 20 bp, human
ggcagaagcgaggcgcgctg

SEQ ID NO: 153516 - DNA, 20 bp, human
gcggcggtgtgcgactgagt

SEQ ID NO: 153517 - DNA, 20 bp, human
ggagccgctatagctgccgg

SEQ ID NO: 153518 - DNA, 20 bp, human
gcgaggtgtcgggcacccag

SEQ ID NO: 153519 - DNA, 20 bp, human
gctgagtcggtggcgaagac

SEQ ID NO: 153520 - DNA, 20 bp, human
gcggtgtgcgactgagtcgg

SEQ ID NO: 153521 - DNA, 20 bp, human
gggcccgagtcgcccgaccc

SEQ ID NO: 153522 - DNA, 20 bp, human
gcaagagcgtcctgatggag

SEQ ID NO: 153523 - DNA, 20 bp, human
gagcggaacctggacacggg

SEQ ID NO: 153524 - DNA, 20 bp, human
ggacgggaacgcgacgatgg

SEQ ID NO: 153525 - DNA, 20 bp, human
gggagcggctcaagaaggtg

SEQ ID NO: 153526 - DNA, 20 bp, human
gcgtaggccaggagcctcag

SEQ ID NO: 153527 - DNA, 20 bp, human
ggcctgaaggggcaccgctg

SEQ ID NO: 153528 - DNA, 20 bp, human
ggtgccccttcaggctcatc

SEQ ID NO: 153529 - DNA, 20 bp, human
gtcaggctcatctggcaaga

SEQ ID NO: 153530 - DNA, 20 bp, human
gtaccagcttgctcagaaca

SEQ ID NO: 153531 - DNA, 20 bp, human
ggcctcagcggtgccccttc

SEQ ID NO: 153532 - DNA, 20 bp, human
gctcctggcctacgtatgtg

SEQ ID NO: 153533 - DNA, 20 bp, human
ggcttgctcagaacaggggc

SEQ ID NO: 153534 - DNA, 20 bp, human
gctgactgtattgctcaagt

SEQ ID NO: 153535 - DNA, 20 bp, human
ggatttgtcaccaaccaggt

SEQ ID NO: 153536 - DNA, 20 bp, human
gagcaccagagtcagctaag

SEQ ID NO: 153537 - DNA, 20 bp, human
gtggcgccagcgggagaacc

SEQ ID NO: 153538 - DNA, 20 bp, human
gtcaactgcacagcgggcag

SEQ ID NO: 153539 - DNA, 20 bp, human
gttcactatcaactgcacag

SEQ ID NO: 153540 - DNA, 20 bp, human
gtgtgtggggcgccagagtc

SEQ ID NO: 153541 - DNA, 20 bp, human
gctctggtgctctctacagg

SEQ ID NO: 153542 - DNA, 20 bp, human
ggcaggaccgctggcgccag

SEQ ID NO: 153543 - DNA, 20 bp, human
gggcttggcttgtatttctg

SEQ ID NO: 153544 - DNA, 20 bp, human
gtttgcacgcgaagccatct

SEQ ID NO: 153545 - DNA, 20 bp, human
ggagcgcaaaacttctcttc

SEQ ID NO: 153546 - DNA, 20 bp, human
gctggctcaaacatcagctg

SEQ ID NO: 153547 - DNA, 20 bp, human
gccagccgcggccaagaccc

SEQ ID NO: 153548 - DNA, 20 bp, human
gtgggatccccggaaaagca

SEQ ID NO: 153549 - DNA, 20 bp, human
gttgagccagcatgtcgcgg

SEQ ID NO: 153550 - DNA, 20 bp, human
gtggccgcggctgggatccc

SEQ ID NO: 153551 - DNA, 20 bp, human
gcgggagccccatgaggcgt

SEQ ID NO: 153552 - DNA, 20 bp, human
gtgtttgagccagcatgtcg

SEQ ID NO: 153553 - DNA, 20 bp, human
gaagacccgggagccccatg

SEQ ID NO: 153554 - DNA, 20 bp, human
gggtcggattggaaatgttg

SEQ ID NO: 153555 - DNA, 20 bp, human
gcgagtggaagaagcaatcg

SEQ ID NO: 153556 - DNA, 20 bp, human
gcacccagcggcccagactg

SEQ ID NO: 153557 - DNA, 20 bp, human
ggtgtggacaggagacaacc

SEQ ID NO: 153558 - DNA, 20 bp, human
gcggagatggagatcggcag

SEQ ID NO: 153559 - DNA, 20 bp, human
gagctcaggcctgatccgtg

SEQ ID NO: 153560 - DNA, 20 bp, human
ggcgatggccgctgggtctg

SEQ ID NO: 153561 - DNA, 20 bp, human
gcaggagacaacccggcatg

SEQ ID NO: 153562 - DNA, 20 bp, human
gggcggcgaagactttcggt

SEQ ID NO: 153563 - DNA, 20 bp, human
gaggtgcggtagggtcggtc

SEQ ID NO: 153564 - DNA, 20 bp, human
gggagatgagctcaccatca

SEQ ID NO: 153565 - DNA, 20 bp, human
gcatggcgcacgaatccgag

SEQ ID NO: 153566 - DNA, 20 bp, human
gggatgcgcgcgtccgggag

SEQ ID NO: 153567 - DNA, 20 bp, human
ggggcgcaggcagcaaactt

SEQ ID NO: 153568 - DNA, 20 bp, human
gcgcggggcagcggcatcag

SEQ ID NO: 153569 - DNA, 20 bp, human
ggctccccgactccgaggag

SEQ ID NO: 153570 - DNA, 20 bp, human
gcggccgccgagagagttgt

SEQ ID NO: 153571 - DNA, 20 bp, human
gcgccgctagcagcatgtct

SEQ ID NO: 153572 - DNA, 20 bp, human
ggagctgctgccgcctgacg

SEQ ID NO: 153573 - DNA, 20 bp, human
gtgctgcctgcgccctgcgg

SEQ ID NO: 153574 - DNA, 20 bp, human
ggccgcggccccctcctcgt

SEQ ID NO: 153575 - DNA, 20 bp, human
ggcgcttccccagcccggac

SEQ ID NO: 153576 - DNA, 20 bp, human
gctttcgggagcgagaacag

SEQ ID NO: 153577 - DNA, 20 bp, human
gcgagaacagaggagcgagt

SEQ ID NO: 153578 - DNA, 20 bp, human
gcgacatggtgcgagcatcg

SEQ ID NO: 153579 - DNA, 20 bp, human
ggtggaaccaattaagtgag

SEQ ID NO: 153580 - DNA, 20 bp, human
gacgtacgcgggatcctcga

SEQ ID NO: 153581 - DNA, 20 bp, human
gcaattaggggagaaagctg

SEQ ID NO: 153582 - DNA, 20 bp, human
ggcactgagcccccaaatct

SEQ ID NO: 153583 - DNA, 20 bp, human
gaccccagccgcgccaggaa

SEQ ID NO: 153584 - DNA, 20 bp, human
gcccctggaagaccccccgg

SEQ ID NO: 153585 - DNA, 20 bp, human
gcgggatggagacgagatag

SEQ ID NO: 153586 - DNA, 20 bp, human
ggcgcgcgcccagcagaagc

SEQ ID NO: 153587 - DNA, 20 bp, human
gctacccccgccggagacgg

SEQ ID NO: 153588 - DNA, 20 bp, human
ggcgcagcgcctcggcggag

SEQ ID NO: 153589 - DNA, 20 bp, human
gttccccgcactaccaagag

SEQ ID NO: 153590 - DNA, 20 bp, human
gggcagatgcgctccaggtc

SEQ ID NO: 153591 - DNA, 20 bp, human
gggggaagcggcggacgacg

SEQ ID NO: 153592 - DNA, 20 bp, human
gaggcgctgcgccccccggg

SEQ ID NO: 153593 - DNA, 20 bp, human
gggtgtccaggatccactct

SEQ ID NO: 153594 - DNA, 20 bp, human
gtggtagtgcggggaagcgg

SEQ ID NO: 153595 - DNA, 20 bp, human
gcgcgagcgcagcgagtcga

SEQ ID NO: 153596 - DNA, 20 bp, human
gccaggctggcactacgctc

SEQ ID NO: 153597 - DNA, 20 bp, human
gacctcagctcggtgaacat

SEQ ID NO: 153598 - DNA, 20 bp, human
gggccccactgcaaaagcgg

SEQ ID NO: 153599 - DNA, 20 bp, human
gcagggacccagaggcacgg

SEQ ID NO: 153600 - DNA, 20 bp, human
gttgcagtggggccgaaagg

SEQ ID NO: 153601 - DNA, 20 bp, human
gcccctcgccgagtgcaggg

SEQ ID NO: 153602 - DNA, 20 bp, human
gcggtgaacatggggcccgc

SEQ ID NO: 153603 - DNA, 20 bp, human
gaagggcgcgctgaccccca

SEQ ID NO: 153604 - DNA, 20 bp, human
ggagtgcagggcggccggtg

SEQ ID NO: 153605 - DNA, 20 bp, human
ggtgagggggtgtcaagccg

SEQ ID NO: 153606 - DNA, 20 bp, human
gtctgcggcgacagcaaggg

SEQ ID NO: 153607 - DNA, 20 bp, human
ggggcccagggcgacgtgag

SEQ ID NO: 153608 - DNA, 20 bp, human
gcattctgcggcgacagcaa

SEQ ID NO: 153609 - DNA, 20 bp, human
gtggacggcagcgcaatgag

SEQ ID NO: 153610 - DNA, 20 bp, human
gagggcacccccaggaaggg

SEQ ID NO: 153611 - DNA, 20 bp, human
gtccgtctcggctccgacag

SEQ ID NO: 153612 - DNA, 20 bp, human
gccgagggcacccccaggaa

SEQ ID NO: 153613 - DNA, 20 bp, human
ggcggcgacagcaagggggg

SEQ ID NO: 153614 - DNA, 20 bp, human
ggccgagacggaccgggtag

SEQ ID NO: 153615 - DNA, 20 bp, human
gctgggccgggggcagacgc

SEQ ID NO: 153616 - DNA, 20 bp, human
ggctggagggagcctccgaa

SEQ ID NO: 153617 - DNA, 20 bp, human
gagagcccagcagatccctg

SEQ ID NO: 153618 - DNA, 20 bp, human
gctgcggcgttcgcgagggt

SEQ ID NO: 153619 - DNA, 20 bp, human
gtgggaagtcgggccgaggt

SEQ ID NO: 153620 - DNA, 20 bp, human
gaacgccgcagggatctgct

SEQ ID NO: 153621 - DNA, 20 bp, human
gccgggcagtcgcagatcgg

SEQ ID NO: 153622 - DNA, 20 bp, human
gatccctgcggcgttcgcga

SEQ ID NO: 153623 - DNA, 20 bp, human
gcccctgcgggtgtgctgga

SEQ ID NO: 153624 - DNA, 20 bp, human
ggcagggacaagctccgcag

SEQ ID NO: 153625 - DNA, 20 bp, human
gctcccccgtccaggtagaa

SEQ ID NO: 153626 - DNA, 20 bp, human
gacgatatcctggaaatggg

SEQ ID NO: 153627 - DNA, 20 bp, human
ggaccgcggcaggttggtcc

SEQ ID NO: 153628 - DNA, 20 bp, human
gctccaggaccaacctgccg

SEQ ID NO: 153629 - DNA, 20 bp, human
gagataagcgcagaatattt

SEQ ID NO: 153630 - DNA, 20 bp, human
ggccgcggtcacgcaaagcg

SEQ ID NO: 153631 - DNA, 20 bp, human
gatatttaggcgaaagcgag

SEQ ID NO: 153632 - DNA, 20 bp, human
ggggggaaagccggaggatc

SEQ ID NO: 153633 - DNA, 20 bp, human
ggcctcgctttgcgtgaccg

SEQ ID NO: 153634 - DNA, 20 bp, human
gttaggcgaaagcgagagga

SEQ ID NO: 153635 - DNA, 20 bp, human
gtgctttggagagacgtgaa

SEQ ID NO: 153636 - DNA, 20 bp, human
gccgcgcggggcaaacctcc

SEQ ID NO: 153637 - DNA, 20 bp, human
gcgtccggccggctgcaccg

SEQ ID NO: 153638 - DNA, 20 bp, human
gtcccacgccctgggcgcac

SEQ ID NO: 153639 - DNA, 20 bp, human
gggctaagactttcacggag

SEQ ID NO: 153640 - DNA, 20 bp, human
gttagtgtgggggctccccg

SEQ ID NO: 153641 - DNA, 20 bp, human
ggccggtctttggaaagtgg

SEQ ID NO: 153642 - DNA, 20 bp, human
gagtgagagcccacgtccgt

SEQ ID NO: 153643 - DNA, 20 bp, human
gtcgctggcgtttagtgtgg

SEQ ID NO: 153644 - DNA, 20 bp, human
gtccaaagaccggcttcccc

SEQ ID NO: 153645 - DNA, 20 bp, human
gtcacggagaggcagttcgc

SEQ ID NO: 153646 - DNA, 20 bp, human
ggcaaaggaattcaataagg

SEQ ID NO: 153647 - DNA, 20 bp, human
gaagaatatatattctgaat

SEQ ID NO: 153648 - DNA, 20 bp, human
gtttttagttgcttataggt

SEQ ID NO: 153649 - DNA, 20 bp, human
gtttctttcacaaagtaggc

SEQ ID NO: 153650 - DNA, 20 bp, human
gcttcctgtctactctctaa

SEQ ID NO: 153651 - DNA, 20 bp, human
gacaccgttagagagtagac

SEQ ID NO: 153652 - DNA, 20 bp, human
gtctctatcaatgatctaag

SEQ ID NO: 153653 - DNA, 20 bp, human
gacaaataacactgtaagtg

SEQ ID NO: 153654 - DNA, 20 bp, human
gataataagacaatgtagtg

SEQ ID NO: 153655 - DNA, 20 bp, human
ggatctaagtggtttgcagc

SEQ ID NO: 153656 - DNA, 20 bp, human
ggaccaggagacctgacggg

SEQ ID NO: 153657 - DNA, 20 bp, human
gctggaccaggagacctgac

SEQ ID NO: 153658 - DNA, 20 bp, human
gccgcggtgggaccctgagt

SEQ ID NO: 153659 - DNA, 20 bp, human
gccagagccgggggagatgg

SEQ ID NO: 153660 - DNA, 20 bp, human
gatggagggcgggggatgtg

SEQ ID NO: 153661 - DNA, 20 bp, human
gcacggagcatcctcccgtc

SEQ ID NO: 153662 - DNA, 20 bp, human
gtcgagccgctccatcccgg

SEQ ID NO: 153663 - DNA, 20 bp, human
gcagttcccggtccacccca

SEQ ID NO: 153664 - DNA, 20 bp, human
gggaagggtcccagagccgg

SEQ ID NO: 153665 - DNA, 20 bp, human
ggccccgtgcggtcccccta

SEQ ID NO: 153666 - DNA, 20 bp, human
gtcagacctagagccaccag

SEQ ID NO: 153667 - DNA, 20 bp, human
ggacctagagccaccagagg

SEQ ID NO: 153668 - DNA, 20 bp, human
gcaaatggctgaagtcccgg

SEQ ID NO: 153669 - DNA, 20 bp, human
ggagccacagccagagaccg

SEQ ID NO: 153670 - DNA, 20 bp, human
gcaggcagttcaggcctctc

SEQ ID NO: 153671 - DNA, 20 bp, human
gggccggaatcataatcctc

SEQ ID NO: 153672 - DNA, 20 bp, human
gcagccagagaccgaggaag

SEQ ID NO: 153673 - DNA, 20 bp, human
gattccggcccagatgaaga

SEQ ID NO: 153674 - DNA, 20 bp, human
gctgcaaatggctgaagtcc

SEQ ID NO: 153675 - DNA, 20 bp, human
ggaaaagctagctgacccag

SEQ ID NO: 153676 - DNA, 20 bp, human
ggaaatgcttggttacacaa

SEQ ID NO: 153677 - DNA, 20 bp, human
ggtcttgctgtctttcaatg

SEQ ID NO: 153678 - DNA, 20 bp, human
gcaaaagttctggtgatact

SEQ ID NO: 153679 - DNA, 20 bp, human
gacagtacacaggaagcata

SEQ ID NO: 153680 - DNA, 20 bp, human
ggcttggttacacaaaggct

SEQ ID NO: 153681 - DNA, 20 bp, human
gagaagtggcaatctctgtt

SEQ ID NO: 153682 - DNA, 20 bp, human
gagtggcaatctctgtttgg

SEQ ID NO: 153683 - DNA, 20 bp, human
gcaaatccgatcagtggatg

SEQ ID NO: 153684 - DNA, 20 bp, human
gatagtatgattcagatttg

SEQ ID NO: 153685 - DNA, 20 bp, human
ggatatttacggattattgc

SEQ ID NO: 153686 - DNA, 20 bp, human
ggacagccagggacatacaa

SEQ ID NO: 153687 - DNA, 20 bp, human
gagaggacaccagaatatct

SEQ ID NO: 153688 - DNA, 20 bp, human
gaggagtctagcaaaggaag

SEQ ID NO: 153689 - DNA, 20 bp, human
ggagcaggtctgcagttggt

SEQ ID NO: 153690 - DNA, 20 bp, human
ggtgttaatggtacaggatt

SEQ ID NO: 153691 - DNA, 20 bp, human
ggaagaaacctgggtgttaa

SEQ ID NO: 153692 - DNA, 20 bp, human
gcaggtctgcagttggttgg

SEQ ID NO: 153693 - DNA, 20 bp, human
gtgcatgtcaatgtggatgt

SEQ ID NO: 153694 - DNA, 20 bp, human
gttgagcagcctagatattc

SEQ ID NO: 153695 - DNA, 20 bp, human
gaaatgggatgctaggaaat

SEQ ID NO: 153696 - DNA, 20 bp, human
gcggcgcccgaggccacccc

SEQ ID NO: 153697 - DNA, 20 bp, human
gcccgagcggcgatcaccac

SEQ ID NO: 153698 - DNA, 20 bp, human
gagcggcgatcaccactgga

SEQ ID NO: 153699 - DNA, 20 bp, human
ggtgctggcgttcttaagca

SEQ ID NO: 153700 - DNA, 20 bp, human
gtcccctcacggcccgcctg

SEQ ID NO: 153701 - DNA, 20 bp, human
ggagcaccagccgttggcag

SEQ ID NO: 153702 - DNA, 20 bp, human
gcgcccgaggccaccccagg

SEQ ID NO: 153703 - DNA, 20 bp, human
gggtccgagttgccgcccag

SEQ ID NO: 153704 - DNA, 20 bp, human
ggcgcagaaaacttgcaatg

SEQ ID NO: 153705 - DNA, 20 bp, human
gcggaggagcgcgccctggg

SEQ ID NO: 153706 - DNA, 20 bp, human
gggcccctcggcaatcccga

SEQ ID NO: 153707 - DNA, 20 bp, human
ggagcttgcgggcccgagag

SEQ ID NO: 153708 - DNA, 20 bp, human
gagctgctgggacccatgaa

SEQ ID NO: 153709 - DNA, 20 bp, human
gacccatgaagggctcgagg

SEQ ID NO: 153710 - DNA, 20 bp, human
gaggaggcgactccacggga

SEQ ID NO: 153711 - DNA, 20 bp, human
gggatgtgcggggggtcctg

SEQ ID NO: 153712 - DNA, 20 bp, human
gcggtggtcggtgcgggagg

SEQ ID NO: 153713 - DNA, 20 bp, human
ggcgcgcggggctcccctca

SEQ ID NO: 153714 - DNA, 20 bp, human
gcggcctgggtcgccctgag

SEQ ID NO: 153715 - DNA, 20 bp, human
gtgacgcagcgcgacggcgg

SEQ ID NO: 153716 - DNA, 20 bp, human
ggcgcacggcctccaggata

SEQ ID NO: 153717 - DNA, 20 bp, human
gcacggcctccaggatacgg

SEQ ID NO: 153718 - DNA, 20 bp, human
gcaccgccgccgtatcctgg

SEQ ID NO: 153719 - DNA, 20 bp, human
gcggctcaagcgtgaagtag

SEQ ID NO: 153720 - DNA, 20 bp, human
gaagcagcagcggagctcgc

SEQ ID NO: 153721 - DNA, 20 bp, human
ggcgggcgccagcaccccga

SEQ ID NO: 153722 - DNA, 20 bp, human
gagcgcccaaatggcacggg

SEQ ID NO: 153723 - DNA, 20 bp, human
ggaggtgtgcaagcagatcg

SEQ ID NO: 153724 - DNA, 20 bp, human
gtcggcggcgcatccagggg

SEQ ID NO: 153725 - DNA, 20 bp, human
gccggacctggatgccatcg

SEQ ID NO: 153726 - DNA, 20 bp, human
gtatctgtagaggatatcag

SEQ ID NO: 153727 - DNA, 20 bp, human
gagacaagaagtcttcatag

SEQ ID NO: 153728 - DNA, 20 bp, human
gaaacagcagtaatacatag

SEQ ID NO: 153729 - DNA, 20 bp, human
gaactccaaaaactaagacc

SEQ ID NO: 153730 - DNA, 20 bp, human
gtctctggctgcgggttgaa

SEQ ID NO: 153731 - DNA, 20 bp, human
gtatcttaaaggaaatgctt

SEQ ID NO: 153732 - DNA, 20 bp, human
gtcttttagcctatctgtag

SEQ ID NO: 153733 - DNA, 20 bp, human
ggagaagcttctgcagttga

SEQ ID NO: 153734 - DNA, 20 bp, human
ggtttatgtgtagactttac

SEQ ID NO: 153735 - DNA, 20 bp, human
gaaggacatctttatcttaa

SEQ ID NO: 153736 - DNA, 20 bp, human
gcccggacccacctccgagt

SEQ ID NO: 153737 - DNA, 20 bp, human
gagtcagaggagcaagacct

SEQ ID NO: 153738 - DNA, 20 bp, human
gcacctccgcggtccgagtc

SEQ ID NO: 153739 - DNA, 20 bp, human
gggctcggacgccgactcgg

SEQ ID NO: 153740 - DNA, 20 bp, human
gtcggacgccgactcggagg

SEQ ID NO: 153741 - DNA, 20 bp, human
gcgcttgaggcgcttcactc

SEQ ID NO: 153742 - DNA, 20 bp, human
gtggaggccgaggaacgaga

SEQ ID NO: 153743 - DNA, 20 bp, human
gcccggaagaagagatgctc

SEQ ID NO: 153744 - DNA, 20 bp, human
gggcggctcggacgccgact

SEQ ID NO: 153745 - DNA, 20 bp, human
gagcccgactcggaccgcgg

SEQ ID NO: 153746 - DNA, 20 bp, human
gtacttttctctagcatcgt

SEQ ID NO: 153747 - DNA, 20 bp, human
gttccgttaaaaccagaatg

SEQ ID NO: 153748 - DNA, 20 bp, human
gttttctctagcatcgtagg

SEQ ID NO: 153749 - DNA, 20 bp, human
gtctcacagcaagctctaat

SEQ ID NO: 153750 - DNA, 20 bp, human
gctgaagatgctgtatgcct

SEQ ID NO: 153751 - DNA, 20 bp, human
gaattggctcagaaacagca

SEQ ID NO: 153752 - DNA, 20 bp, human
gagaaatttgcaagactact

SEQ ID NO: 153753 - DNA, 20 bp, human
gaatttcttttacatatatg

SEQ ID NO: 153754 - DNA, 20 bp, human
gttattgatgaactctccca

SEQ ID NO: 153755 - DNA, 20 bp, human
gaattacaggctaccacacc

SEQ ID NO: 153756 - DNA, 20 bp, human
gtaagtgtaattaggatagt

SEQ ID NO: 153757 - DNA, 20 bp, human
ggtctcctagccatcagaag

SEQ ID NO: 153758 - DNA, 20 bp, human
ggtgccagttgagaagcagg

SEQ ID NO: 153759 - DNA, 20 bp, human
ggtgtaattaggatagtggg

SEQ ID NO: 153760 - DNA, 20 bp, human
gcctcagaaagtcagagtac

SEQ ID NO: 153761 - DNA, 20 bp, human
gtaagcactgaagattctaa

SEQ ID NO: 153762 - DNA, 20 bp, human
ggagtaattagaaaaatcaa

SEQ ID NO: 153763 - DNA, 20 bp, human
gtagagaaacgatgcaaaca

SEQ ID NO: 153764 - DNA, 20 bp, human
gcattcctcttctgatggct

SEQ ID NO: 153765 - DNA, 20 bp, human
gagagtgccagttgagaagc

SEQ ID NO: 153766 - DNA, 20 bp, human
gtcatcgcaacggggacgct

SEQ ID NO: 153767 - DNA, 20 bp, human
gctaggctgccctgcccgaa

SEQ ID NO: 153768 - DNA, 20 bp, human
gccgaggaaaggaagacccg

SEQ ID NO: 153769 - DNA, 20 bp, human
gaggcggaggaagaagacat

SEQ ID NO: 153770 - DNA, 20 bp, human
gtcccgggactgactccccg

SEQ ID NO: 153771 - DNA, 20 bp, human
gcatggctacacctggcgtc

SEQ ID NO: 153772 - DNA, 20 bp, human
gcgggactgactccccgagg

SEQ ID NO: 153773 - DNA, 20 bp, human
gttggagggctgctcggaat

SEQ ID NO: 153774 - DNA, 20 bp, human
gaggaaaggaagacccgagg

SEQ ID NO: 153775 - DNA, 20 bp, human
gcgcaacggggacgcttgga

SEQ ID NO: 153776 - DNA, 20 bp, human
gggctggagagggaaccatg

SEQ ID NO: 153777 - DNA, 20 bp, human
gacagagcgtctgctgctga

SEQ ID NO: 153778 - DNA, 20 bp, human
gccgggagagagggtgccaa

SEQ ID NO: 153779 - DNA, 20 bp, human
gctgcctcgcagagctgccc

SEQ ID NO: 153780 - DNA, 20 bp, human
gagggcagaaggcgggtccg

SEQ ID NO: 153781 - DNA, 20 bp, human
gctcgcagagctgcccgggc

SEQ ID NO: 153782 - DNA, 20 bp, human
gcccggacgcggaacactgg

SEQ ID NO: 153783 - DNA, 20 bp, human
gcagacgctctgtcccgccc

SEQ ID NO: 153784 - DNA, 20 bp, human
gttgctctaggagcctacaa

SEQ ID NO: 153785 - DNA, 20 bp, human
gccgctgctggagccattgt

SEQ ID NO: 153786 - DNA, 20 bp, human
gagcagaaagtgcactcact

SEQ ID NO: 153787 - DNA, 20 bp, human
gccttctctgaaacattgga

SEQ ID NO: 153788 - DNA, 20 bp, human
gtaatgcacagcatcagata

SEQ ID NO: 153789 - DNA, 20 bp, human
gtcagtcataagtcaaacat

SEQ ID NO: 153790 - DNA, 20 bp, human
gcatagggtttaatgcctca

SEQ ID NO: 153791 - DNA, 20 bp, human
gtatgaaatcaccttacctt

SEQ ID NO: 153792 - DNA, 20 bp, human
gatcagataaggttgagccc

SEQ ID NO: 153793 - DNA, 20 bp, human
gtttgtcttatggtgcatat

SEQ ID NO: 153794 - DNA, 20 bp, human
ggagaaacatcaaaaaccaa

SEQ ID NO: 153795 - DNA, 20 bp, human
gacatcaaaaaccaaaggta

SEQ ID NO: 153796 - DNA, 20 bp, human
gcagagtgctagctccccgg

SEQ ID NO: 153797 - DNA, 20 bp, human
ggcagcggcgctggagtgag

SEQ ID NO: 153798 - DNA, 20 bp, human
gagtgctagctccccggcgg

SEQ ID NO: 153799 - DNA, 20 bp, human
gtccaggagccaaactccct

SEQ ID NO: 153800 - DNA, 20 bp, human
ggggcagagtgctagctccc

SEQ ID NO: 153801 - DNA, 20 bp, human
ggtccggagcctggggacgt

SEQ ID NO: 153802 - DNA, 20 bp, human
ggggacgtcggccccacaga

SEQ ID NO: 153803 - DNA, 20 bp, human
gggccgacgtccccaggctc

SEQ ID NO: 153804 - DNA, 20 bp, human
ggtccgagccgcaggagacg

SEQ ID NO: 153805 - DNA, 20 bp, human
ggcgccagccaatagacggg

SEQ ID NO: 153806 - DNA, 20 bp, human
ggagcactaagtctctcgcg

SEQ ID NO: 153807 - DNA, 20 bp, human
ggcgtctcgcaggccgtagg

SEQ ID NO: 153808 - DNA, 20 bp, human
gcgagcgtctcgcaggccgt

SEQ ID NO: 153809 - DNA, 20 bp, human
ggtcagggcgagcgtctcgc

SEQ ID NO: 153810 - DNA, 20 bp, human
ggtgctcatgctcgctgcag

SEQ ID NO: 153811 - DNA, 20 bp, human
gtcatgctcgctgcaggggt

SEQ ID NO: 153812 - DNA, 20 bp, human
ggaagacccgtagcaacagt

SEQ ID NO: 153813 - DNA, 20 bp, human
gtgagtcccgcagggtgcag

SEQ ID NO: 153814 - DNA, 20 bp, human
ggaatggacgagttctcccg

SEQ ID NO: 153815 - DNA, 20 bp, human
gagatctgcaactcgctgga

SEQ ID NO: 153816 - DNA, 20 bp, human
ggtcagtgagaggctcttag

SEQ ID NO: 153817 - DNA, 20 bp, human
gttccggcgggcaaggacca

SEQ ID NO: 153818 - DNA, 20 bp, human
gaggctcttaggggtagtag

SEQ ID NO: 153819 - DNA, 20 bp, human
gaccctcccctggagcccaa

SEQ ID NO: 153820 - DNA, 20 bp, human
gcaaggaccagggcgagccc

SEQ ID NO: 153821 - DNA, 20 bp, human
gctggtgcaagggagaccga

SEQ ID NO: 153822 - DNA, 20 bp, human
gcccagtcgctgtcccccca

SEQ ID NO: 153823 - DNA, 20 bp, human
gtccaggggagggtgcgtgg

SEQ ID NO: 153824 - DNA, 20 bp, human
gggcgctccagggctcgccc

SEQ ID NO: 153825 - DNA, 20 bp, human
gtccaggaagggctacggga

SEQ ID NO: 153826 - DNA, 20 bp, human
gactcgagcgtctcctggag

SEQ ID NO: 153827 - DNA, 20 bp, human
ggtccccatgtgacagtgag

SEQ ID NO: 153828 - DNA, 20 bp, human
gcctgcgggaggatggtgag

SEQ ID NO: 153829 - DNA, 20 bp, human
ggctccgcctctctccgctc

SEQ ID NO: 153830 - DNA, 20 bp, human
gtgcacaccaagttagacag

SEQ ID NO: 153831 - DNA, 20 bp, human
ggagggaggcggaggcgtag

SEQ ID NO: 153832 - DNA, 20 bp, human
gcaggcagcacagttgcccg

SEQ ID NO: 153833 - DNA, 20 bp, human
gcgccgcggctcatctcgtc

SEQ ID NO: 153834 - DNA, 20 bp, human
gcctcggcggggaacgggac

SEQ ID NO: 153835 - DNA, 20 bp, human
ggacgctcgagtctgcgtcc

SEQ ID NO: 153836 - DNA, 20 bp, human
gtgagccacgcccgggctgt

SEQ ID NO: 153837 - DNA, 20 bp, human
gcagcctcgccatcagactc

SEQ ID NO: 153838 - DNA, 20 bp, human
ggacagagggatggacgaag

SEQ ID NO: 153839 - DNA, 20 bp, human
ggggatggacgaagagggag

SEQ ID NO: 153840 - DNA, 20 bp, human
gcatcaaacaacgagcccag

SEQ ID NO: 153841 - DNA, 20 bp, human
ggccactgcctgtttcccct

SEQ ID NO: 153842 - DNA, 20 bp, human
gatagtgatagacagaggga

SEQ ID NO: 153843 - DNA, 20 bp, human
gagtcggcgtcttgagtcat

SEQ ID NO: 153844 - DNA, 20 bp, human
gggctatagtgatagacaga

SEQ ID NO: 153845 - DNA, 20 bp, human
gggcgaggctggaatcgagg

SEQ ID NO: 153846 - DNA, 20 bp, human
gggctgcgccccgagtcccg

SEQ ID NO: 153847 - DNA, 20 bp, human
gggggctgccgcgggactcg

SEQ ID NO: 153848 - DNA, 20 bp, human
gtgtggtgcggagcgttcgg

SEQ ID NO: 153849 - DNA, 20 bp, human
gggagcgaactgttgtggtg

SEQ ID NO: 153850 - DNA, 20 bp, human
gggcctcgagccgggaggaa

SEQ ID NO: 153851 - DNA, 20 bp, human
ggccgcgggagccgaccccg

SEQ ID NO: 153852 - DNA, 20 bp, human
gcccggcagaaggctcctcc

SEQ ID NO: 153853 - DNA, 20 bp, human
ggccctgccccgcgtccgag

SEQ ID NO: 153854 - DNA, 20 bp, human
gagaaggcgggagccggcag

SEQ ID NO: 153855 - DNA, 20 bp, human
gccccgctgccgaaagaagg

SEQ ID NO: 153856 - DNA, 20 bp, human
gcttggcggcttgtccccag

SEQ ID NO: 153857 - DNA, 20 bp, human
gtgtagggagcctgcaccaa

SEQ ID NO: 153858 - DNA, 20 bp, human
gaggcaggcgggaacactgt

SEQ ID NO: 153859 - DNA, 20 bp, human
gacaagccgccaagacccag

SEQ ID NO: 153860 - DNA, 20 bp, human
gtgactctcacgccacagta

SEQ ID NO: 153861 - DNA, 20 bp, human
gggcccttggtgaggtatgg

SEQ ID NO: 153862 - DNA, 20 bp, human
gctgggaaaggcaatcacag

SEQ ID NO: 153863 - DNA, 20 bp, human
gacacagtgaacccaactag

SEQ ID NO: 153864 - DNA, 20 bp, human
gagcccccatacctcaccaa

SEQ ID NO: 153865 - DNA, 20 bp, human
ggcgacagcagctgcatcta

SEQ ID NO: 153866 - DNA, 20 bp, human
gcccagcgcggccccacgga

SEQ ID NO: 153867 - DNA, 20 bp, human
gccgggccggcccctccgtg

SEQ ID NO: 153868 - DNA, 20 bp, human
gtagtcgctattgtcgccgt

SEQ ID NO: 153869 - DNA, 20 bp, human
ggcggcggcggctgatcccc

SEQ ID NO: 153870 - DNA, 20 bp, human
gggacgaggggaccgatccc

SEQ ID NO: 153871 - DNA, 20 bp, human
gggccgcgctgggacgcacg

SEQ ID NO: 153872 - DNA, 20 bp, human
ggtcggccggagcgaacacc

SEQ ID NO: 153873 - DNA, 20 bp, human
gcggcggctgatccccgggc

SEQ ID NO: 153874 - DNA, 20 bp, human
gcagcgcctggtgttcgctc

SEQ ID NO: 153875 - DNA, 20 bp, human
ggccgggccggggcgcgcgt

SEQ ID NO: 153876 - DNA, 20 bp, human
ggcggttctgtggggccgcg

SEQ ID NO: 153877 - DNA, 20 bp, human
ggacacgcaggcggttctgt

SEQ ID NO: 153878 - DNA, 20 bp, human
gggctcctccggcaaaacag

SEQ ID NO: 153879 - DNA, 20 bp, human
gctcagactcacggcctgag

SEQ ID NO: 153880 - DNA, 20 bp, human
gagcctcacagccctcggtg

SEQ ID NO: 153881 - DNA, 20 bp, human
gacggcctgaggggctcctc

SEQ ID NO: 153882 - DNA, 20 bp, human
ggacgcgaccctcagactca

SEQ ID NO: 153883 - DNA, 20 bp, human
gtgaggctcttccgagacag

SEQ ID NO: 153884 - DNA, 20 bp, human
gggcgagtagctggcggtcc

SEQ ID NO: 153885 - DNA, 20 bp, human
gacatccggcgagtagctgg

SEQ ID NO: 153886 - DNA, 20 bp, human
gtacggccaacgccaagtag

SEQ ID NO: 153887 - DNA, 20 bp, human
ggtctcactgacagctgaag

SEQ ID NO: 153888 - DNA, 20 bp, human
gcctgtggcactgcgtgaag

SEQ ID NO: 153889 - DNA, 20 bp, human
gacaggcagggactcagagt

SEQ ID NO: 153890 - DNA, 20 bp, human
gtccttctgggaggaccggt

SEQ ID NO: 153891 - DNA, 20 bp, human
gctcgcgccgcctaaccccg

SEQ ID NO: 153892 - DNA, 20 bp, human
gtcactcacctgcgactgga

SEQ ID NO: 153893 - DNA, 20 bp, human
gaaggggctgatgcgaactg

SEQ ID NO: 153894 - DNA, 20 bp, human
ggcacccgccggcccggaag

SEQ ID NO: 153895 - DNA, 20 bp, human
ggggaacgcaatcccctact

SEQ ID NO: 153896 - DNA, 20 bp, human
gttgggaagcaagaaggtga

SEQ ID NO: 153897 - DNA, 20 bp, human
gggcttgggatcagacagat

SEQ ID NO: 153898 - DNA, 20 bp, human
gaagcactcttagggccgag

SEQ ID NO: 153899 - DNA, 20 bp, human
gggatcagacagatgggtgg

SEQ ID NO: 153900 - DNA, 20 bp, human
ggctgggccaagcactctta

SEQ ID NO: 153901 - DNA, 20 bp, human
gagctgcatgagcaggacca

SEQ ID NO: 153902 - DNA, 20 bp, human
gctgtctgatcccaagccca

SEQ ID NO: 153903 - DNA, 20 bp, human
ggagggtaggcagacttgtg

SEQ ID NO: 153904 - DNA, 20 bp, human
gtggcaccttcgcctggtga

SEQ ID NO: 153905 - DNA, 20 bp, human
gtaacctcactgcaaagcag

SEQ ID NO: 153906 - DNA, 20 bp, human
gccggagagccggctagata

SEQ ID NO: 153907 - DNA, 20 bp, human
gcgctcgcccgcaagcaaag

SEQ ID NO: 153908 - DNA, 20 bp, human
gtggctccagctccccgccg

SEQ ID NO: 153909 - DNA, 20 bp, human
gagaggacgccatatctagc

SEQ ID NO: 153910 - DNA, 20 bp, human
gtgcgtgctttgggccccgg

SEQ ID NO: 153911 - DNA, 20 bp, human
gtcgatctggacacaaggag

SEQ ID NO: 153912 - DNA, 20 bp, human
gggaccccggactggagact

SEQ ID NO: 153913 - DNA, 20 bp, human
gtctagccggctctccggtc

SEQ ID NO: 153914 - DNA, 20 bp, human
ggcgcggcgggcggaagtcc

SEQ ID NO: 153915 - DNA, 20 bp, human
gatccacgagaaattcccat

SEQ ID NO: 153916 - DNA, 20 bp, human
gggacgccgtagggtagagg

SEQ ID NO: 153917 - DNA, 20 bp, human
gcgtagggtagaggaggcgg

SEQ ID NO: 153918 - DNA, 20 bp, human
gtccggacgccgtagggtag

SEQ ID NO: 153919 - DNA, 20 bp, human
gggtggcacgggcccatggt

SEQ ID NO: 153920 - DNA, 20 bp, human
ggaagcagcgtcaggaccat

SEQ ID NO: 153921 - DNA, 20 bp, human
ggccacccgcagcccaccat

SEQ ID NO: 153922 - DNA, 20 bp, human
ggatggctccggacgccgta

SEQ ID NO: 153923 - DNA, 20 bp, human
gccccgccgtgggcccgaca

SEQ ID NO: 153924 - DNA, 20 bp, human
gggagtgtcggcaggatcgg

SEQ ID NO: 153925 - DNA, 20 bp, human
ggaaaagagggacccgagag

SEQ ID NO: 153926 - DNA, 20 bp, human
ggtggagctccataagctaa

SEQ ID NO: 153927 - DNA, 20 bp, human
gaattagggaaggcgtagtg

SEQ ID NO: 153928 - DNA, 20 bp, human
gctaaaggtaccgtgaatcg

SEQ ID NO: 153929 - DNA, 20 bp, human
gggtaccgtgaatcggggaa

SEQ ID NO: 153930 - DNA, 20 bp, human
gggatcctggctccgacatg

SEQ ID NO: 153931 - DNA, 20 bp, human
gtcagcccttccccgattca

SEQ ID NO: 153932 - DNA, 20 bp, human
gagactggaaacatcatccc

SEQ ID NO: 153933 - DNA, 20 bp, human
gggctgcacggagaagacgt

SEQ ID NO: 153934 - DNA, 20 bp, human
gggcacaaaagagctacggc

SEQ ID NO: 153935 - DNA, 20 bp, human
gtcagcttcggacgacagac

SEQ ID NO: 153936 - DNA, 20 bp, human
gggcgcagtgcggcggtcac

SEQ ID NO: 153937 - DNA, 20 bp, human
gtccttgcttccctgagcgt

SEQ ID NO: 153938 - DNA, 20 bp, human
gcccgggtggaggagaaagt

SEQ ID NO: 153939 - DNA, 20 bp, human
gtacgcacactggcagcgaa

SEQ ID NO: 153940 - DNA, 20 bp, human
gcctcccgggccaacgctca

SEQ ID NO: 153941 - DNA, 20 bp, human
gcttccctgagcgttggccc

SEQ ID NO: 153942 - DNA, 20 bp, human
gaagggacctcgctccgccc

SEQ ID NO: 153943 - DNA, 20 bp, human
gtgcgcgtgcgtacgcacac

SEQ ID NO: 153944 - DNA, 20 bp, human
ggcactgagcacgcgtggaa

SEQ ID NO: 153945 - DNA, 20 bp, human
ggggttgccagaacatgccg

SEQ ID NO: 153946 - DNA, 20 bp, human
gtggagatgcagcctccccg

SEQ ID NO: 153947 - DNA, 20 bp, human
gtcttggaccgggaacaagg

SEQ ID NO: 153948 - DNA, 20 bp, human
gggacaactggcacataagt

SEQ ID NO: 153949 - DNA, 20 bp, human
gacccccgacgagtcagcaa

SEQ ID NO: 153950 - DNA, 20 bp, human
gggtgccatgcacaagacgt

SEQ ID NO: 153951 - DNA, 20 bp, human
gccctcagctggacatagag

SEQ ID NO: 153952 - DNA, 20 bp, human
gccatcttggaccgggaaca

SEQ ID NO: 153953 - DNA, 20 bp, human
ggtagggcctcagcactcac

SEQ ID NO: 153954 - DNA, 20 bp, human
ggcctttgctgactcgtcgg

SEQ ID NO: 153955 - DNA, 20 bp, human
gcagggggcgaacctgtagt

SEQ ID NO: 153956 - DNA, 20 bp, human
gttcttggacgaccccatag

SEQ ID NO: 153957 - DNA, 20 bp, human
gaagcggagccgggaacgtg

SEQ ID NO: 153958 - DNA, 20 bp, human
ggagtggacgtgccactatg

SEQ ID NO: 153959 - DNA, 20 bp, human
gggtcgtccaagaagcatcg

SEQ ID NO: 153960 - DNA, 20 bp, human
gcggtggcgaacgacggaag

SEQ ID NO: 153961 - DNA, 20 bp, human
gcgggggtcccggaacgcgt

SEQ ID NO: 153962 - DNA, 20 bp, human
ggaggcggccgggacgacgg

SEQ ID NO: 153963 - DNA, 20 bp, human
gccaggcagagccctccgag

SEQ ID NO: 153964 - DNA, 20 bp, human
gggctacgaggccggtgagg

SEQ ID NO: 153965 - DNA, 20 bp, human
gggcccggagcagcacgcac

SEQ ID NO: 153966 - DNA, 20 bp, human
ggcgactgcggccgaaacct

SEQ ID NO: 153967 - DNA, 20 bp, human
gtcgccgccgaggactaggg

SEQ ID NO: 153968 - DNA, 20 bp, human
gccgcctccctagtcctcgg

SEQ ID NO: 153969 - DNA, 20 bp, human
ggaacccgaggctgagtcca

SEQ ID NO: 153970 - DNA, 20 bp, human
gggcccgcctccctagtcct

SEQ ID NO: 153971 - DNA, 20 bp, human
gttatcgccgccgaggacta

SEQ ID NO: 153972 - DNA, 20 bp, human
gcgaggctgagtccaaggct

SEQ ID NO: 153973 - DNA, 20 bp, human
ggccaggacatggggacccg

SEQ ID NO: 153974 - DNA, 20 bp, human
gggcgtgagcgagagcgatg

SEQ ID NO: 153975 - DNA, 20 bp, human
gaagcgcaagatggcgactg

SEQ ID NO: 153976 - DNA, 20 bp, human
gccgtggccacctagacccg

SEQ ID NO: 153977 - DNA, 20 bp, human
gcccgcacctcgggtctagg

SEQ ID NO: 153978 - DNA, 20 bp, human
gtcgcaggcgcccgcacctc

SEQ ID NO: 153979 - DNA, 20 bp, human
ggcagcccctctgaaaccgg

SEQ ID NO: 153980 - DNA, 20 bp, human
ggccacctagacccgaggtg

SEQ ID NO: 153981 - DNA, 20 bp, human
gggagcccccggtttcagag

SEQ ID NO: 153982 - DNA, 20 bp, human
gcgcctgcgaagggcccccg

SEQ ID NO: 153983 - DNA, 20 bp, human
gcccagtgggtgggcgagaa

SEQ ID NO: 153984 - DNA, 20 bp, human
ggcgcccgcacctcgggtct

SEQ ID NO: 153985 - DNA, 20 bp, human
gcccgctcggcgcagcaaca

SEQ ID NO: 153986 - DNA, 20 bp, human
ggccactgcagcagtcagag

SEQ ID NO: 153987 - DNA, 20 bp, human
gcctcaccagaactgcccgg

SEQ ID NO: 153988 - DNA, 20 bp, human
gggatgggtcgagcaagcag

SEQ ID NO: 153989 - DNA, 20 bp, human
gggtcgagcaagcagaggaa

SEQ ID NO: 153990 - DNA, 20 bp, human
gcaagagtcttggaagggat

SEQ ID NO: 153991 - DNA, 20 bp, human
ggcagggacggagtctccca

SEQ ID NO: 153992 - DNA, 20 bp, human
gcctaggtgtcaagatgcag

SEQ ID NO: 153993 - DNA, 20 bp, human
gtgagggccactcacctaga

SEQ ID NO: 153994 - DNA, 20 bp, human
ggcatgactctagatttcta

SEQ ID NO: 153995 - DNA, 20 bp, human
gcggttcatgccgtgccccc

SEQ ID NO: 153996 - DNA, 20 bp, human
gcctctcaggctaatcccga

SEQ ID NO: 153997 - DNA, 20 bp, human
ggtttggcgctcggcttctg

SEQ ID NO: 153998 - DNA, 20 bp, human
gctgtcaaaagggaagagta

SEQ ID NO: 153999 - DNA, 20 bp, human
gtggcgctcggcttctgcgg

SEQ ID NO: 154000 - DNA, 20 bp, human
gacgattccgtgcacaggta

SEQ ID NO: 154001 - DNA, 20 bp, human
gttctgcggaggaggcgggg

SEQ ID NO: 154002 - DNA, 20 bp, human
gaggaagggtgtgaggagtt

SEQ ID NO: 154003 - DNA, 20 bp, human
ggggattagcctgagaggtc

SEQ ID NO: 154004 - DNA, 20 bp, human
gcaagtcggccgttgcagag

SEQ ID NO: 154005 - DNA, 20 bp, human
gccgcgggcactggatgacg

SEQ ID NO: 154006 - DNA, 20 bp, human
gtccggcccggccagctcag

SEQ ID NO: 154007 - DNA, 20 bp, human
gctgcggctgatcaaggtag

SEQ ID NO: 154008 - DNA, 20 bp, human
gaaggaacctcggcgagtga

SEQ ID NO: 154009 - DNA, 20 bp, human
gagtatgtcactgcagtcgg

SEQ ID NO: 154010 - DNA, 20 bp, human
gctcctggggggatgcacat

SEQ ID NO: 154011 - DNA, 20 bp, human
gtgccagcctgactgagaag

SEQ ID NO: 154012 - DNA, 20 bp, human
ggagcgtcctcttctcagtc

SEQ ID NO: 154013 - DNA, 20 bp, human
ggacatactgcggctgatca

SEQ ID NO: 154014 - DNA, 20 bp, human
gcacgccccgggaggagctc

SEQ ID NO: 154015 - DNA, 20 bp, human
gctgagaagaggacgctccc

SEQ ID NO: 154016 - DNA, 20 bp, human
ggattccggcgccgtacggg

SEQ ID NO: 154017 - DNA, 20 bp, human
gcctactctctcctcccgta

SEQ ID NO: 154018 - DNA, 20 bp, human
gtgggattccggcgccgtac

SEQ ID NO: 154019 - DNA, 20 bp, human
gcggctagctcctaaggcgt

SEQ ID NO: 154020 - DNA, 20 bp, human
ggtagccgcggcctggtaag

SEQ ID NO: 154021 - DNA, 20 bp, human
ggcgaggcgatcctctgtcc

SEQ ID NO: 154022 - DNA, 20 bp, human
gagactgtggagatatcctg

SEQ ID NO: 154023 - DNA, 20 bp, human
gctccccgagcaggttccca

SEQ ID NO: 154024 - DNA, 20 bp, human
ggccagagcggggtcgtagg

SEQ ID NO: 154025 - DNA, 20 bp, human
gcgaattcggctagctccta

SEQ ID NO: 154026 - DNA, 20 bp, human
gccccgggcaggatagaggg

SEQ ID NO: 154027 - DNA, 20 bp, human
gggcccccgggcaggataga

SEQ ID NO: 154028 - DNA, 20 bp, human
gggagcgagcgagaaagtgg

SEQ ID NO: 154029 - DNA, 20 bp, human
gcgctcccgttccccggacg

SEQ ID NO: 154030 - DNA, 20 bp, human
gggggcccagccgaaagcca

SEQ ID NO: 154031 - DNA, 20 bp, human
gaaagccagggcgactctag

SEQ ID NO: 154032 - DNA, 20 bp, human
ggggcagagacggcagcgag

SEQ ID NO: 154033 - DNA, 20 bp, human
gtggggaaggctccgggcgg

SEQ ID NO: 154034 - DNA, 20 bp, human
gggctgttgttgttgtgacg

SEQ ID NO: 154035 - DNA, 20 bp, human
gcggatgagccggccccgct

SEQ ID NO: 154036 - DNA, 20 bp, human
gggctgggctcccctctcgt

SEQ ID NO: 154037 - DNA, 20 bp, human
gcgtgggcgcagggcttcaa

SEQ ID NO: 154038 - DNA, 20 bp, human
gtaaaggggagagcgaggcg

SEQ ID NO: 154039 - DNA, 20 bp, human
ggagcccagccgccccaata

SEQ ID NO: 154040 - DNA, 20 bp, human
gagccctgcgcccacgagag

SEQ ID NO: 154041 - DNA, 20 bp, human
ggcgtttaaaggggagagcg

SEQ ID NO: 154042 - DNA, 20 bp, human
gacgcagacggaccttggag

SEQ ID NO: 154043 - DNA, 20 bp, human
ggggtgggctggtagagtag

SEQ ID NO: 154044 - DNA, 20 bp, human
ggcgggcctgaaaccaagaa

SEQ ID NO: 154045 - DNA, 20 bp, human
gtacgaagtgggcgtttaaa

SEQ ID NO: 154046 - DNA, 20 bp, human
ggagcacggcgacccaacgg

SEQ ID NO: 154047 - DNA, 20 bp, human
gtgtgagcacggcgacccaa

SEQ ID NO: 154048 - DNA, 20 bp, human
ggacgcgcaagaggcgaccg

SEQ ID NO: 154049 - DNA, 20 bp, human
gtggcagaggcggccgagag

SEQ ID NO: 154050 - DNA, 20 bp, human
gtgggtgccgcgtctgccgg

SEQ ID NO: 154051 - DNA, 20 bp, human
gcgaggcggcgaaggaccga

SEQ ID NO: 154052 - DNA, 20 bp, human
ggatggcagagaaccgagtg

SEQ ID NO: 154053 - DNA, 20 bp, human
gccctggacccgccacaagg

SEQ ID NO: 154054 - DNA, 20 bp, human
gccagcgggtgggtgcgtct

SEQ ID NO: 154055 - DNA, 20 bp, human
gccgcgcgcgggaggaaacg

SEQ ID NO: 154056 - DNA, 20 bp, human
gtagaggggtatctcaaagt

SEQ ID NO: 154057 - DNA, 20 bp, human
ggccaaaaggggggaagtaa

SEQ ID NO: 154058 - DNA, 20 bp, human
ggatacccctctatcaaggt

SEQ ID NO: 154059 - DNA, 20 bp, human
ggggaagacgaaaatgatcc

SEQ ID NO: 154060 - DNA, 20 bp, human
gaagacgaaaatgatcctgg

SEQ ID NO: 154061 - DNA, 20 bp, human
gggatggggtggcagatgat

SEQ ID NO: 154062 - DNA, 20 bp, human
gctggtggttatactcctcc

SEQ ID NO: 154063 - DNA, 20 bp, human
gtgagtttcaggttgtcatc

SEQ ID NO: 154064 - DNA, 20 bp, human
ggggttggcagacaactgat

SEQ ID NO: 154065 - DNA, 20 bp, human
gccctttacttccccccttt

SEQ ID NO: 154066 - DNA, 20 bp, human
ggcggcggcggtagtggtag

SEQ ID NO: 154067 - DNA, 20 bp, human
gggtagtggtagcggttatt

SEQ ID NO: 154068 - DNA, 20 bp, human
ggttattcggcggcccgcgg

SEQ ID NO: 154069 - DNA, 20 bp, human
ggacactcactccgaagcag

SEQ ID NO: 154070 - DNA, 20 bp, human
gcaggcggccaggtgctccg

SEQ ID NO: 154071 - DNA, 20 bp, human
gagtggtagcggttattcgg

SEQ ID NO: 154072 - DNA, 20 bp, human
gtacgggatgtaggcggcgg

SEQ ID NO: 154073 - DNA, 20 bp, human
gtcggagtgagtgtcaggcg

SEQ ID NO: 154074 - DNA, 20 bp, human
gccgggctccggacaggcgg

SEQ ID NO: 154075 - DNA, 20 bp, human
ggtttacgggatgtaggcgg

SEQ ID NO: 154076 - DNA, 20 bp, human
gggcgcgcgccatggaacag

SEQ ID NO: 154077 - DNA, 20 bp, human
ggaagcagcagcgactctaa

SEQ ID NO: 154078 - DNA, 20 bp, human
gcgcgtccgttggccgataa

SEQ ID NO: 154079 - DNA, 20 bp, human
ggctccgaggccaggtccta

SEQ ID NO: 154080 - DNA, 20 bp, human
gacgtgtggccggagatgag

SEQ ID NO: 154081 - DNA, 20 bp, human
ggcctcggagccacagtcga

SEQ ID NO: 154082 - DNA, 20 bp, human
gggccccccatcctgatcga

SEQ ID NO: 154083 - DNA, 20 bp, human
ggtaacagtgctgacacgtg

SEQ ID NO: 154084 - DNA, 20 bp, human
ggggccggaccgctcatctc

SEQ ID NO: 154085 - DNA, 20 bp, human
ggtcagggcgcacaaacccc

SEQ ID NO: 154086 - DNA, 20 bp, human
gcctgccagacacactgtga

SEQ ID NO: 154087 - DNA, 20 bp, human
gcaggctggggtgttggccg

SEQ ID NO: 154088 - DNA, 20 bp, human
gtcatagttgtgggtacatc

SEQ ID NO: 154089 - DNA, 20 bp, human
gtgacagtattcgtaagact

SEQ ID NO: 154090 - DNA, 20 bp, human
gtggtacggatgaagcgtgc

SEQ ID NO: 154091 - DNA, 20 bp, human
gacgaatactgtcatagttg

SEQ ID NO: 154092 - DNA, 20 bp, human
ggcagccgtcacagtgtgtc

SEQ ID NO: 154093 - DNA, 20 bp, human
gtctagggactggcattccg

SEQ ID NO: 154094 - DNA, 20 bp, human
gactgctgccatctagggac

SEQ ID NO: 154095 - DNA, 20 bp, human
gtcttcactgctgccatcta

SEQ ID NO: 154096 - DNA, 20 bp, human
ggctgagggccgaggaccgg

SEQ ID NO: 154097 - DNA, 20 bp, human
gaagatggcggcgggaacct

SEQ ID NO: 154098 - DNA, 20 bp, human
gtcgggaggccgaggactga

SEQ ID NO: 154099 - DNA, 20 bp, human
gcgggggagccgaggactga

SEQ ID NO: 154100 - DNA, 20 bp, human
ggggcggggactgaaggcca

SEQ ID NO: 154101 - DNA, 20 bp, human
gagcgaaccaggggtgtccg

SEQ ID NO: 154102 - DNA, 20 bp, human
ggtcgagtgctgagggccag

SEQ ID NO: 154103 - DNA, 20 bp, human
gtagtccgcgagccgcgcca

SEQ ID NO: 154104 - DNA, 20 bp, human
ggcgcccagcccccggtcct

SEQ ID NO: 154105 - DNA, 20 bp, human
gcggctcggggactcgagga

SEQ ID NO: 154106 - DNA, 20 bp, human
ggcgcctcggttgtcaaaca

SEQ ID NO: 154107 - DNA, 20 bp, human
gaccacgagaagccaggtaa

SEQ ID NO: 154108 - DNA, 20 bp, human
ggagccctcccgggccgggt

SEQ ID NO: 154109 - DNA, 20 bp, human
gcgcggagcccactggacag

SEQ ID NO: 154110 - DNA, 20 bp, human
gcctgcagcctccagcggga

SEQ ID NO: 154111 - DNA, 20 bp, human
ggggccggcacgacggtagg

SEQ ID NO: 154112 - DNA, 20 bp, human
gccggcacgacggtaggggg

SEQ ID NO: 154113 - DNA, 20 bp, human
gccggccccgcggagcccac

SEQ ID NO: 154114 - DNA, 20 bp, human
ggcccctgggcgcacccgct

SEQ ID NO: 154115 - DNA, 20 bp, human
ggcgggccggaggcgagttg

SEQ ID NO: 154116 - DNA, 20 bp, human
ggaagacagcaagcccccta

SEQ ID NO: 154117 - DNA, 20 bp, human
gcccgggctgcgctccatcg

SEQ ID NO: 154118 - DNA, 20 bp, human
gcggcgaccgagccccccag

SEQ ID NO: 154119 - DNA, 20 bp, human
gtctcgcaatcccggcctgg

SEQ ID NO: 154120 - DNA, 20 bp, human
gggatcctggatgtggaagg

SEQ ID NO: 154121 - DNA, 20 bp, human
gcagaacgcccctagatcag

SEQ ID NO: 154122 - DNA, 20 bp, human
gaatgaccggatcttgggag

SEQ ID NO: 154123 - DNA, 20 bp, human
ggctcgccggatcctggatg

SEQ ID NO: 154124 - DNA, 20 bp, human
ggtccttgcggtgccgtagg

SEQ ID NO: 154125 - DNA, 20 bp, human
gagggccgggctgctcgtag

SEQ ID NO: 154126 - DNA, 20 bp, human
ggaggttccgggagagaggt

SEQ ID NO: 154127 - DNA, 20 bp, human
ggggcactgaccacagccgg

SEQ ID NO: 154128 - DNA, 20 bp, human
gggacgcctgggtcctgcat

SEQ ID NO: 154129 - DNA, 20 bp, human
gcagagggcctgggacgcct

SEQ ID NO: 154130 - DNA, 20 bp, human
ggtgagggaaacagaatcag

SEQ ID NO: 154131 - DNA, 20 bp, human
gggcatgagccctaagtgcc

SEQ ID NO: 154132 - DNA, 20 bp, human
gaccacagccggcggccgga

SEQ ID NO: 154133 - DNA, 20 bp, human
gggtcagtgcccggcactta

SEQ ID NO: 154134 - DNA, 20 bp, human
gttagggctcatgccagcag

SEQ ID NO: 154135 - DNA, 20 bp, human
gggctgggtcggagggaggt

SEQ ID NO: 154136 - DNA, 20 bp, human
gggaccagaggcgactggag

SEQ ID NO: 154137 - DNA, 20 bp, human
gccagaggcgactggagcgg

SEQ ID NO: 154138 - DNA, 20 bp, human
gaagatggcggcggggaggt

SEQ ID NO: 154139 - DNA, 20 bp, human
ggccaaaggggcgaacccag

SEQ ID NO: 154140 - DNA, 20 bp, human
ggcccggcgctgacgaacag

SEQ ID NO: 154141 - DNA, 20 bp, human
gagcccgaaagccccacgag

SEQ ID NO: 154142 - DNA, 20 bp, human
gcctgccccgcggtccaaga

SEQ ID NO: 154143 - DNA, 20 bp, human
gtgtgaggcggaagccaaag

SEQ ID NO: 154144 - DNA, 20 bp, human
gacagaggaagcgagtacaa

SEQ ID NO: 154145 - DNA, 20 bp, human
gccgcacggccccccgaggg

SEQ ID NO: 154146 - DNA, 20 bp, human
gcccgaaacccggaagtgag

SEQ ID NO: 154147 - DNA, 20 bp, human
ggaaacccggaagtgagcgg

SEQ ID NO: 154148 - DNA, 20 bp, human
gcaagatggcgcccgaaacc

SEQ ID NO: 154149 - DNA, 20 bp, human
gagagcgggaaggaaaggtt

SEQ ID NO: 154150 - DNA, 20 bp, human
gccggaagagcgggaaggaa

SEQ ID NO: 154151 - DNA, 20 bp, human
ggggtcaccaaggggctcgg

SEQ ID NO: 154152 - DNA, 20 bp, human
gctcacctcgggcccgggtc

SEQ ID NO: 154153 - DNA, 20 bp, human
gcgcggtacagggagtcacc

SEQ ID NO: 154154 - DNA, 20 bp, human
gagggagtcacccggaagag

SEQ ID NO: 154155 - DNA, 20 bp, human
ggtcacccggaagagcggga

SEQ ID NO: 154156 - DNA, 20 bp, human
gtcatgagggagccgctccc

SEQ ID NO: 154157 - DNA, 20 bp, human
gagcggctccctcatgaccg

SEQ ID NO: 154158 - DNA, 20 bp, human
gcccggccgacccaatgctg

SEQ ID NO: 154159 - DNA, 20 bp, human
ggctctgggtcctaccccag

SEQ ID NO: 154160 - DNA, 20 bp, human
gtcactgagggcccccgtcc

SEQ ID NO: 154161 - DNA, 20 bp, human
gggagcggcgccctgtgcgt

SEQ ID NO: 154162 - DNA, 20 bp, human
ggctgctgccgcggtcatga

SEQ ID NO: 154163 - DNA, 20 bp, human
gagcagccccagcattgggt

SEQ ID NO: 154164 - DNA, 20 bp, human
gtcccgggcagcgcttcctg

SEQ ID NO: 154165 - DNA, 20 bp, human
gaatctgccggaaggttccg

SEQ ID NO: 154166 - DNA, 20 bp, human
ggccaaccaggcgggaagtg

SEQ ID NO: 154167 - DNA, 20 bp, human
gggcccccagtagcagaagg

SEQ ID NO: 154168 - DNA, 20 bp, human
gcagggcccccagtagcaga

SEQ ID NO: 154169 - DNA, 20 bp, human
gggtcgggaaggatgcagag

SEQ ID NO: 154170 - DNA, 20 bp, human
gcaacgctgctggacaggtt

SEQ ID NO: 154171 - DNA, 20 bp, human
gtgcatcttgcacgtctggt

SEQ ID NO: 154172 - DNA, 20 bp, human
ggcatattgctgggaaggtc

SEQ ID NO: 154173 - DNA, 20 bp, human
gctggccgcccatccagaca

SEQ ID NO: 154174 - DNA, 20 bp, human
ggcgtccaggggctcaacca

SEQ ID NO: 154175 - DNA, 20 bp, human
gcatcacggggccaaccagg

SEQ ID NO: 154176 - DNA, 20 bp, human
ggggcaagcgctctgatcct

SEQ ID NO: 154177 - DNA, 20 bp, human
ggcgacgcgacagacccccg

SEQ ID NO: 154178 - DNA, 20 bp, human
gtgggagaccctaggatgaa

SEQ ID NO: 154179 - DNA, 20 bp, human
gtgggtggggataaagggtc

SEQ ID NO: 154180 - DNA, 20 bp, human
ggccgggcgtacctggatgg

SEQ ID NO: 154181 - DNA, 20 bp, human
gggccgctcgggcagctccc

SEQ ID NO: 154182 - DNA, 20 bp, human
gatcagagcgcttgccccgg

SEQ ID NO: 154183 - DNA, 20 bp, human
gcccggctccgttcatccta

SEQ ID NO: 154184 - DNA, 20 bp, human
gggaggctggacagggtcta

SEQ ID NO: 154185 - DNA, 20 bp, human
ggccgttagcctgcaaccaa

SEQ ID NO: 154186 - DNA, 20 bp, human
gtgtcattcatggtggtacc

SEQ ID NO: 154187 - DNA, 20 bp, human
gacctttgcggtggaggatg

SEQ ID NO: 154188 - DNA, 20 bp, human
ggcggcggcggaccacctcc

SEQ ID NO: 154189 - DNA, 20 bp, human
gggcggaccacctccaggtg

SEQ ID NO: 154190 - DNA, 20 bp, human
gcaccgtccccacctggagg

SEQ ID NO: 154191 - DNA, 20 bp, human
gcaagtccaggcctccctat

SEQ ID NO: 154192 - DNA, 20 bp, human
gctccgcccggactcccagg

SEQ ID NO: 154193 - DNA, 20 bp, human
gagggatcgcggggccgata

SEQ ID NO: 154194 - DNA, 20 bp, human
ggaaggagccgaccgtggac

SEQ ID NO: 154195 - DNA, 20 bp, human
gctgcgccacctgggagtcc

SEQ ID NO: 154196 - DNA, 20 bp, human
gcccgagcggcggggtaaga

SEQ ID NO: 154197 - DNA, 20 bp, human
gttgggtcgctagttgtccc

SEQ ID NO: 154198 - DNA, 20 bp, human
ggagcggcggggtaagatgg

SEQ ID NO: 154199 - DNA, 20 bp, human
gccaataggcccgagccccg

SEQ ID NO: 154200 - DNA, 20 bp, human
gctgaccggaggctagggtc

SEQ ID NO: 154201 - DNA, 20 bp, human
ggtctggttagagggttctg

SEQ ID NO: 154202 - DNA, 20 bp, human
gggccccgggacgcatccgt

SEQ ID NO: 154203 - DNA, 20 bp, human
gtaccccgccgctcgggctg

SEQ ID NO: 154204 - DNA, 20 bp, human
ggatcttgagatatgtccca

SEQ ID NO: 154205 - DNA, 20 bp, human
gttgggctgaccggaggcta

SEQ ID NO: 154206 - DNA, 20 bp, human
gcagctgtctgggagagacg

SEQ ID NO: 154207 - DNA, 20 bp, human
ggacctgggaacctactgtg

SEQ ID NO: 154208 - DNA, 20 bp, human
ggcgcggagcagcgcaacct

SEQ ID NO: 154209 - DNA, 20 bp, human
gtgactccgctggctcggtc

SEQ ID NO: 154210 - DNA, 20 bp, human
gtggctcggtccggaggcgg

SEQ ID NO: 154211 - DNA, 20 bp, human
gctccgctggctcggtccgg

SEQ ID NO: 154212 - DNA, 20 bp, human
ggcgaagcagggagcgaccc

SEQ ID NO: 154213 - DNA, 20 bp, human
gagacgcgtaggccacaagg

SEQ ID NO: 154214 - DNA, 20 bp, human
ggagctacctctcgaagtgg

SEQ ID NO: 154215 - DNA, 20 bp, human
gcgtgcgctgggaggaaagt

SEQ ID NO: 154216 - DNA, 20 bp, human
gctcacgcactggctcacac

SEQ ID NO: 154217 - DNA, 20 bp, human
gctgcgaacgggactgagag

SEQ ID NO: 154218 - DNA, 20 bp, human
ggaagaggctgcgcccgaag

SEQ ID NO: 154219 - DNA, 20 bp, human
gcccccgcgccctcacgcac

SEQ ID NO: 154220 - DNA, 20 bp, human
gggcgcgaggtctatgtgac

SEQ ID NO: 154221 - DNA, 20 bp, human
ggcgaggtctatgtgaccgg

SEQ ID NO: 154222 - DNA, 20 bp, human
gtcctggttgaaggcgttga

SEQ ID NO: 154223 - DNA, 20 bp, human
gccccgcgcggcgtggactc

SEQ ID NO: 154224 - DNA, 20 bp, human
gtggctcacactggcccggc

SEQ ID NO: 154225 - DNA, 20 bp, human
ggagaggtcgcggcgaccac

SEQ ID NO: 154226 - DNA, 20 bp, human
gagtcgggccgcgcagttcg

SEQ ID NO: 154227 - DNA, 20 bp, human
gcgcaggaaccagccccgct

SEQ ID NO: 154228 - DNA, 20 bp, human
gccccgctcggcgaagacag

SEQ ID NO: 154229 - DNA, 20 bp, human
ggcgccgttctagggaacag

SEQ ID NO: 154230 - DNA, 20 bp, human
ggcggctgcggcatccaata

SEQ ID NO: 154231 - DNA, 20 bp, human
ggctgcggcatccaatatgg

SEQ ID NO: 154232 - DNA, 20 bp, human
gggcctagcagtgcccgtgg

SEQ ID NO: 154233 - DNA, 20 bp, human
gctccgcagcgacaacatgg

SEQ ID NO: 154234 - DNA, 20 bp, human
ggaggcggcggccactgcac

SEQ ID NO: 154235 - DNA, 20 bp, human
gccgagcccggcggcggaag

SEQ ID NO: 154236 - DNA, 20 bp, human
gagctgctccggcggccgca

SEQ ID NO: 154237 - DNA, 20 bp, human
gtgcacggtcgggaacgggt

SEQ ID NO: 154238 - DNA, 20 bp, human
ggcttcccgagcgagccctg

SEQ ID NO: 154239 - DNA, 20 bp, human
ggcaggagccggatggtcag

SEQ ID NO: 154240 - DNA, 20 bp, human
gcggggcgcagagaccggag

SEQ ID NO: 154241 - DNA, 20 bp, human
ggaggctggagtaggcggag

SEQ ID NO: 154242 - DNA, 20 bp, human
gcctcgaggccaggtgagag

SEQ ID NO: 154243 - DNA, 20 bp, human
gggcagtgcacggtcgggaa

SEQ ID NO: 154244 - DNA, 20 bp, human
ggagggggcagtgcacggtc

SEQ ID NO: 154245 - DNA, 20 bp, human
ggaggggccgtggaatgcgg

SEQ ID NO: 154246 - DNA, 20 bp, human
gctctgcgcctgggtcgggt

SEQ ID NO: 154247 - DNA, 20 bp, human
gtctcaggagagaaagccga

SEQ ID NO: 154248 - DNA, 20 bp, human
gctctctctgcgcctgggtc

SEQ ID NO: 154249 - DNA, 20 bp, human
ggacgtgtggaagggcgacc

SEQ ID NO: 154250 - DNA, 20 bp, human
gggattgttgagatccgggt

SEQ ID NO: 154251 - DNA, 20 bp, human
ggccgccgccgagcagatcc

SEQ ID NO: 154252 - DNA, 20 bp, human
gtgcacccggatctgctcgg

SEQ ID NO: 154253 - DNA, 20 bp, human
gtcgaaatccgacatctctc

SEQ ID NO: 154254 - DNA, 20 bp, human
gagccacacttgcttggcaa

SEQ ID NO: 154255 - DNA, 20 bp, human
gggccgaagctcaccttgaa

SEQ ID NO: 154256 - DNA, 20 bp, human
gcgcgaacgctgctgcctcc

SEQ ID NO: 154257 - DNA, 20 bp, human
gcctcgctcccggaagtgga

SEQ ID NO: 154258 - DNA, 20 bp, human
ggctgcctcgctcccggaag

SEQ ID NO: 154259 - DNA, 20 bp, human
gacgaagcgccgctgggtct

SEQ ID NO: 154260 - DNA, 20 bp, human
gctctagcgagaggcccggg

SEQ ID NO: 154261 - DNA, 20 bp, human
ggtgtagaccctccacttcc

SEQ ID NO: 154262 - DNA, 20 bp, human
gggactggagcaggtacggt

SEQ ID NO: 154263 - DNA, 20 bp, human
gggggtcttctagcacccgg

SEQ ID NO: 154264 - DNA, 20 bp, human
gaagccgacatggtgatcgg

SEQ ID NO: 154265 - DNA, 20 bp, human
gcgctaggagacttccggaa

SEQ ID NO: 154266 - DNA, 20 bp, human
ggcggttctccagccatcag

SEQ ID NO: 154267 - DNA, 20 bp, human
ggtctggatgattccctcac

SEQ ID NO: 154268 - DNA, 20 bp, human
gggcggcgcagtggagcacc

SEQ ID NO: 154269 - DNA, 20 bp, human
ggagcagcccctctacttgt

SEQ ID NO: 154270 - DNA, 20 bp, human
gccaacccagccgacccccc

SEQ ID NO: 154271 - DNA, 20 bp, human
gtttgtcagcactacctggg

SEQ ID NO: 154272 - DNA, 20 bp, human
gtagtgctgacaaagaactc

SEQ ID NO: 154273 - DNA, 20 bp, human
ggtatttggtgaagggacaa

SEQ ID NO: 154274 - DNA, 20 bp, human
gactacctggggggtcggct

SEQ ID NO: 154275 - DNA, 20 bp, human
ggctggtcacctacaagtag

SEQ ID NO: 154276 - DNA, 20 bp, human
gagagaagcggggcgaactg

SEQ ID NO: 154277 - DNA, 20 bp, human
gcgaactgaggcgagtgaag

SEQ ID NO: 154278 - DNA, 20 bp, human
gaccgctaccgccactgctg

SEQ ID NO: 154279 - DNA, 20 bp, human
gatccgtgcacagagaagcg

SEQ ID NO: 154280 - DNA, 20 bp, human
gcacgcccctgccgcagcag

SEQ ID NO: 154281 - DNA, 20 bp, human
ggatcacagctgggtcctga

SEQ ID NO: 154282 - DNA, 20 bp, human
ggccccgaaggtgcagtact

SEQ ID NO: 154283 - DNA, 20 bp, human
gtcactgtcaccccacgtgg

SEQ ID NO: 154284 - DNA, 20 bp, human
ggtgcagtacttggagccac

SEQ ID NO: 154285 - DNA, 20 bp, human
gtccttgtggcccttccggt

SEQ ID NO: 154286 - DNA, 20 bp, human
gtggagaacccgagacctcg

SEQ ID NO: 154287 - DNA, 20 bp, human
ggcgcttacctgagggatcc

SEQ ID NO: 154288 - DNA, 20 bp, human
ggctcgcgcccggatccctc

SEQ ID NO: 154289 - DNA, 20 bp, human
ggggccgcgcgcttacctga

SEQ ID NO: 154290 - DNA, 20 bp, human
gcgggccggttgctaagact

SEQ ID NO: 154291 - DNA, 20 bp, human
gtcgcgagagcgcggttcag

SEQ ID NO: 154292 - DNA, 20 bp, human
ggactgcgggacatgacctg

SEQ ID NO: 154293 - DNA, 20 bp, human
gctggggaggaaggacgcga

SEQ ID NO: 154294 - DNA, 20 bp, human
gtaaaggcgaatcagagctg

SEQ ID NO: 154295 - DNA, 20 bp, human
ggaagcagctggaggatacg

SEQ ID NO: 154296 - DNA, 20 bp, human
gccggccgcgagccgctccg

SEQ ID NO: 154297 - DNA, 20 bp, human
ggcgctgcacccgagcgatg

SEQ ID NO: 154298 - DNA, 20 bp, human
gctctgcgggagccacagat

SEQ ID NO: 154299 - DNA, 20 bp, human
ggatggagggcccaaagctc

SEQ ID NO: 154300 - DNA, 20 bp, human
ggctccgcgccgcatcgctc

SEQ ID NO: 154301 - DNA, 20 bp, human
gagggtctgacgtcacccaa

SEQ ID NO: 154302 - DNA, 20 bp, human
gtgacgtcagaccctggatc

SEQ ID NO: 154303 - DNA, 20 bp, human
gtccagaaggccggtttcca

SEQ ID NO: 154304 - DNA, 20 bp, human
gaagctcaggctccagatcc

SEQ ID NO: 154305 - DNA, 20 bp, human
ggcacccgagcgatgcggcg

SEQ ID NO: 154306 - DNA, 20 bp, human
gaccgccgcgggactcccag

SEQ ID NO: 154307 - DNA, 20 bp, human
gtcacgggtgcgggcccgag

SEQ ID NO: 154308 - DNA, 20 bp, human
gagccggaagcgaaagtctc

SEQ ID NO: 154309 - DNA, 20 bp, human
gcccggagctggagttatgg

SEQ ID NO: 154310 - DNA, 20 bp, human
gtgcaccagcgaagcgcctg

SEQ ID NO: 154311 - DNA, 20 bp, human
gacgcccggagctggagtta

SEQ ID NO: 154312 - DNA, 20 bp, human
gccgagtccgactccctcaa

SEQ ID NO: 154313 - DNA, 20 bp, human
gccgcggcgttgggactgga

SEQ ID NO: 154314 - DNA, 20 bp, human
gcctgaggcgctacgctcac

SEQ ID NO: 154315 - DNA, 20 bp, human
gtcccagtggccgccaagat

SEQ ID NO: 154316 - DNA, 20 bp, human
gacagctgcgggtgtgtctg

SEQ ID NO: 154317 - DNA, 20 bp, human
gctgtggaacccagactagt

SEQ ID NO: 154318 - DNA, 20 bp, human
gcagggtctgagctcctcag

SEQ ID NO: 154319 - DNA, 20 bp, human
ggggcccggccggaacctac

SEQ ID NO: 154320 - DNA, 20 bp, human
gcaacacagggcagttactc

SEQ ID NO: 154321 - DNA, 20 bp, human
ggaacctacgggcacagctg

SEQ ID NO: 154322 - DNA, 20 bp, human
gagcctgggtgtatgagcct

SEQ ID NO: 154323 - DNA, 20 bp, human
gtccctcgacccactagtct

SEQ ID NO: 154324 - DNA, 20 bp, human
gcacccgcagctgtgcccgt

SEQ ID NO: 154325 - DNA, 20 bp, human
gggagctgcggccgagggaa

SEQ ID NO: 154326 - DNA, 20 bp, human
gcgcgtgacggtacctgtgg

SEQ ID NO: 154327 - DNA, 20 bp, human
gggcagcacctcccaagctg

SEQ ID NO: 154328 - DNA, 20 bp, human
ggagggagggcgccacgcac

SEQ ID NO: 154329 - DNA, 20 bp, human
gacccgcgtgacggtacctg

SEQ ID NO: 154330 - DNA, 20 bp, human
gtcccggagcaactaggcca

SEQ ID NO: 154331 - DNA, 20 bp, human
gtgggaggtgctgccaccac

SEQ ID NO: 154332 - DNA, 20 bp, human
ggccgccgccgcagcttggg

SEQ ID NO: 154333 - DNA, 20 bp, human
gtctccccccgtcacaccag

SEQ ID NO: 154334 - DNA, 20 bp, human
ggcgggagggtaaaggtagg

SEQ ID NO: 154335 - DNA, 20 bp, human
gtcacaccaggggcccgcgg

SEQ ID NO: 154336 - DNA, 20 bp, human
gcgccctgcttagttcgggg

SEQ ID NO: 154337 - DNA, 20 bp, human
ggaccgccctgcttagttcg

SEQ ID NO: 154338 - DNA, 20 bp, human
gaactaagcagggcggtcgg

SEQ ID NO: 154339 - DNA, 20 bp, human
gcgaagggaggctcctccag

SEQ ID NO: 154340 - DNA, 20 bp, human
ggccgcgtcacctcacttgg

SEQ ID NO: 154341 - DNA, 20 bp, human
gtgcgtagcgcagacccggg

SEQ ID NO: 154342 - DNA, 20 bp, human
ggcacactacgcggtctgag

SEQ ID NO: 154343 - DNA, 20 bp, human
gaaatgcgaggggcccctgg

SEQ ID NO: 154344 - DNA, 20 bp, human
ggcgtgcgtagcgcagaccc

SEQ ID NO: 154345 - DNA, 20 bp, human
gtcacctgtcaaacgaaggg

SEQ ID NO: 154346 - DNA, 20 bp, human
gagacctcgcggggccccag

SEQ ID NO: 154347 - DNA, 20 bp, human
gggcatcctgcgagacagga

SEQ ID NO: 154348 - DNA, 20 bp, human
gttctgcaggcgaggctgag

SEQ ID NO: 154349 - DNA, 20 bp, human
gccccagcgggaagcgcggg

SEQ ID NO: 154350 - DNA, 20 bp, human
ggcggccggcggatcctcca

SEQ ID NO: 154351 - DNA, 20 bp, human
gcaggcggctggagctgtag

SEQ ID NO: 154352 - DNA, 20 bp, human
gggtaagggcggcctgtcgg

SEQ ID NO: 154353 - DNA, 20 bp, human
gaggagtggagggtcccgcg

SEQ ID NO: 154354 - DNA, 20 bp, human
gcaggccctgggtggagcgg

SEQ ID NO: 154355 - DNA, 20 bp, human
gatgcgcgctctgggcggcg

SEQ ID NO: 154356 - DNA, 20 bp, human
ggaatacggcccccctcctg

SEQ ID NO: 154357 - DNA, 20 bp, human
gaggcaccggcagctcctct

SEQ ID NO: 154358 - DNA, 20 bp, human
gcatctcaggcagtacctag

SEQ ID NO: 154359 - DNA, 20 bp, human
gagatgttctgaggaggcac

SEQ ID NO: 154360 - DNA, 20 bp, human
ggcgatcaggagatgttctg

SEQ ID NO: 154361 - DNA, 20 bp, human
gcagtacctagaggagctgc

SEQ ID NO: 154362 - DNA, 20 bp, human
gcagctgcagttcgcatctc

SEQ ID NO: 154363 - DNA, 20 bp, human
ggacagcatgcccaggagat

SEQ ID NO: 154364 - DNA, 20 bp, human
gctggtcctgggtagcgatc

SEQ ID NO: 154365 - DNA, 20 bp, human
gagtctcagagcaggaccac

SEQ ID NO: 154366 - DNA, 20 bp, human
gaggcacggtggatccggga

SEQ ID NO: 154367 - DNA, 20 bp, human
gccgggcacgcaggccgcag

SEQ ID NO: 154368 - DNA, 20 bp, human
gacggcgacagagacgacac

SEQ ID NO: 154369 - DNA, 20 bp, human
gaggctaggggggaacccag

SEQ ID NO: 154370 - DNA, 20 bp, human
gcacgcaggccgcagaggca

SEQ ID NO: 154371 - DNA, 20 bp, human
ggcagaggcacggtggatcc

SEQ ID NO: 154372 - DNA, 20 bp, human
gccgcgcctggcaggagacg

SEQ ID NO: 154373 - DNA, 20 bp, human
gccccagactgaggctaggg

SEQ ID NO: 154374 - DNA, 20 bp, human
gagcagcaggtccttaaggt

SEQ ID NO: 154375 - DNA, 20 bp, human
ggaggccaggcgcttcggga

SEQ ID NO: 154376 - DNA, 20 bp, human
gccagagtatcgagaaggtg

SEQ ID NO: 154377 - DNA, 20 bp, human
gaagatgtagcagcagggat

SEQ ID NO: 154378 - DNA, 20 bp, human
gggaaaccgaaaccgagtcc

SEQ ID NO: 154379 - DNA, 20 bp, human
ggcccggcccggcccgtgag

SEQ ID NO: 154380 - DNA, 20 bp, human
gcgccagggatccaactgca

SEQ ID NO: 154381 - DNA, 20 bp, human
ggtggcccgggtcttccaga

SEQ ID NO: 154382 - DNA, 20 bp, human
gagggatccaactgcaagga

SEQ ID NO: 154383 - DNA, 20 bp, human
gggccgatgctgcttctaca

SEQ ID NO: 154384 - DNA, 20 bp, human
ggtagaccagagtatcgaga

SEQ ID NO: 154385 - DNA, 20 bp, human
ggtcttcgacgcctctgcgg

SEQ ID NO: 154386 - DNA, 20 bp, human
gcccatggcaggcagctcgg

SEQ ID NO: 154387 - DNA, 20 bp, human
gaggctgccttagccccctg

SEQ ID NO: 154388 - DNA, 20 bp, human
gcccctaacggcctcaacac

SEQ ID NO: 154389 - DNA, 20 bp, human
gatccattaggcctccccag

SEQ ID NO: 154390 - DNA, 20 bp, human
gcagctcggtgggagcgctc

SEQ ID NO: 154391 - DNA, 20 bp, human
gctgctgctgctctggactc

SEQ ID NO: 154392 - DNA, 20 bp, human
ggtccgagctggaccccaaa

SEQ ID NO: 154393 - DNA, 20 bp, human
gtgaggccgttaggggaagg

SEQ ID NO: 154394 - DNA, 20 bp, human
gggggctgtggggcaaaaag

SEQ ID NO: 154395 - DNA, 20 bp, human
gggggtcagccggacatggt

SEQ ID NO: 154396 - DNA, 20 bp, human
gctgccccgcgcctcatgga

SEQ ID NO: 154397 - DNA, 20 bp, human
gggacgagaagtcacctgag

SEQ ID NO: 154398 - DNA, 20 bp, human
gcgcgagggttcagttcctg

SEQ ID NO: 154399 - DNA, 20 bp, human
ggccacgacagtgcatccca

SEQ ID NO: 154400 - DNA, 20 bp, human
ggtgtgccgtgctcccgggt

SEQ ID NO: 154401 - DNA, 20 bp, human
gttctcgtccagggttccct

SEQ ID NO: 154402 - DNA, 20 bp, human
gcagcgagagcggccggaag

SEQ ID NO: 154403 - DNA, 20 bp, human
gtccctgggatgcactgtcg

SEQ ID NO: 154404 - DNA, 20 bp, human
gagccgaaggggcccacact

SEQ ID NO: 154405 - DNA, 20 bp, human
ggacgctctgggcagtggtg

SEQ ID NO: 154406 - DNA, 20 bp, human
gcctgcgtgaggacaagaag

SEQ ID NO: 154407 - DNA, 20 bp, human
gccggggcgggtggagtcca

SEQ ID NO: 154408 - DNA, 20 bp, human
gcagggctcggggacacgta

SEQ ID NO: 154409 - DNA, 20 bp, human
ggctcgctgtggactcgtca

SEQ ID NO: 154410 - DNA, 20 bp, human
gaggcagcgaccccagtacc

SEQ ID NO: 154411 - DNA, 20 bp, human
gcgtcatggcgaccgagcag

SEQ ID NO: 154412 - DNA, 20 bp, human
ggttgctgcgccgggtactg

SEQ ID NO: 154413 - DNA, 20 bp, human
gcgcgccgaacaccaccagg

SEQ ID NO: 154414 - DNA, 20 bp, human
gcacacacatatagttaagg

SEQ ID NO: 154415 - DNA, 20 bp, human
gcgaacaccaccaggtggaa

SEQ ID NO: 154416 - DNA, 20 bp, human
gcttggcagcggataaaagg

SEQ ID NO: 154417 - DNA, 20 bp, human
gcacattcccaactcacgga

SEQ ID NO: 154418 - DNA, 20 bp, human
gagaggggagagctccgcgg

SEQ ID NO: 154419 - DNA, 20 bp, human
gaagagaggggagagctccg

SEQ ID NO: 154420 - DNA, 20 bp, human
gtcccgcgtggaggtaaggg

SEQ ID NO: 154421 - DNA, 20 bp, human
ggtgctgccttccgtgagtt

SEQ ID NO: 154422 - DNA, 20 bp, human
ggcccgcgcctgcgacccgg

SEQ ID NO: 154423 - DNA, 20 bp, human
gctgcttggcagcggataaa

SEQ ID NO: 154424 - DNA, 20 bp, human
gcggggtcgccggaggactg

SEQ ID NO: 154425 - DNA, 20 bp, human
ggggggctgaggctccggag

SEQ ID NO: 154426 - DNA, 20 bp, human
gagcccgggcagccatatgg

SEQ ID NO: 154427 - DNA, 20 bp, human
gtcgcggccgagttcagccc

SEQ ID NO: 154428 - DNA, 20 bp, human
gggagtacacggcccccaag

SEQ ID NO: 154429 - DNA, 20 bp, human
gaggtgggcgcccgcagcag

SEQ ID NO: 154430 - DNA, 20 bp, human
gccaccctcgagctccgctc

SEQ ID NO: 154431 - DNA, 20 bp, human
gtgctggcgtatcccccata

SEQ ID NO: 154432 - DNA, 20 bp, human
gtggctgcccgggctgaact

SEQ ID NO: 154433 - DNA, 20 bp, human
ggcagcggcagaacatcgtc

SEQ ID NO: 154434 - DNA, 20 bp, human
gtaggccacgctaagaccct

SEQ ID NO: 154435 - DNA, 20 bp, human
ggcggcagaacatcgtctgg

SEQ ID NO: 154436 - DNA, 20 bp, human
ggtgattccctgggaggatc

SEQ ID NO: 154437 - DNA, 20 bp, human
ggaacctagagtttattcag

SEQ ID NO: 154438 - DNA, 20 bp, human
gcctcccagggaatcactac

SEQ ID NO: 154439 - DNA, 20 bp, human
gggtgaatcctgccacacaa

SEQ ID NO: 154440 - DNA, 20 bp, human
gcagcctgtagtgattccct

SEQ ID NO: 154441 - DNA, 20 bp, human
gcactaatacagtcaggtag

SEQ ID NO: 154442 - DNA, 20 bp, human
gactccactgaataaactct

SEQ ID NO: 154443 - DNA, 20 bp, human
ggtattagtgaacagttcag

SEQ ID NO: 154444 - DNA, 20 bp, human
ggaatttattatcctttgtg

SEQ ID NO: 154445 - DNA, 20 bp, human
gactgttcactaatacagtc

SEQ ID NO: 154446 - DNA, 20 bp, human
ggtctgcctttcccgaatac

SEQ ID NO: 154447 - DNA, 20 bp, human
gagcagccagtattcgggaa

SEQ ID NO: 154448 - DNA, 20 bp, human
gcagccgggcagtggctcgt

SEQ ID NO: 154449 - DNA, 20 bp, human
gagaaactcggagacctcat

SEQ ID NO: 154450 - DNA, 20 bp, human
gaactcggagacctcatagg

SEQ ID NO: 154451 - DNA, 20 bp, human
ggcagcagcagccagtattc

SEQ ID NO: 154452 - DNA, 20 bp, human
gtggctcgtgggagccaaga

SEQ ID NO: 154453 - DNA, 20 bp, human
ggcggagcggggggatgacg

SEQ ID NO: 154454 - DNA, 20 bp, human
gaggggctcttgatgttcta

SEQ ID NO: 154455 - DNA, 20 bp, human
ggtgcgtggttcagttctcc

SEQ ID NO: 154456 - DNA, 20 bp, human
gtcgcagacttgggaaacta

SEQ ID NO: 154457 - DNA, 20 bp, human
gaggccgaccacgtgtactg

SEQ ID NO: 154458 - DNA, 20 bp, human
gccatcagggagcgtgtcag

SEQ ID NO: 154459 - DNA, 20 bp, human
ggcgccgagagcctgcactg

SEQ ID NO: 154460 - DNA, 20 bp, human
gccggaccgtggagatccta

SEQ ID NO: 154461 - DNA, 20 bp, human
ggctaatcatgtcccagcgg

SEQ ID NO: 154462 - DNA, 20 bp, human
gaacgggacatggaacacct

SEQ ID NO: 154463 - DNA, 20 bp, human
gctcaccgcttccggaaatt

SEQ ID NO: 154464 - DNA, 20 bp, human
ggtgctggccaaagtgaaac

SEQ ID NO: 154465 - DNA, 20 bp, human
gtcgagcccgacgcaattgg

SEQ ID NO: 154466 - DNA, 20 bp, human
ggagccagatacgaagccag

SEQ ID NO: 154467 - DNA, 20 bp, human
ggaagctcgcccggagaacg

SEQ ID NO: 154468 - DNA, 20 bp, human
ggctcgcccggagaacgggg

SEQ ID NO: 154469 - DNA, 20 bp, human
gcttcgtatctggctcttag

SEQ ID NO: 154470 - DNA, 20 bp, human
gttctccgggcgagcttctc

SEQ ID NO: 154471 - DNA, 20 bp, human
gagctgtccgtgtgctgaaa

SEQ ID NO: 154472 - DNA, 20 bp, human
gctgccatataaacaaaaag

SEQ ID NO: 154473 - DNA, 20 bp, human
ggacagctcctctgcttata

SEQ ID NO: 154474 - DNA, 20 bp, human
gatacccctggcttcgtatc

SEQ ID NO: 154475 - DNA, 20 bp, human
gacggcccgagaagctcgcc

SEQ ID NO: 154476 - DNA, 20 bp, human
ggagtcaagtctccaggtag

SEQ ID NO: 154477 - DNA, 20 bp, human
ggacagcgctcccctctacc

SEQ ID NO: 154478 - DNA, 20 bp, human
gggagcgctgtccgccctgt

SEQ ID NO: 154479 - DNA, 20 bp, human
gaacttcagcacccacaggg

SEQ ID NO: 154480 - DNA, 20 bp, human
ggacggtcaagggataagca

SEQ ID NO: 154481 - DNA, 20 bp, human
gagccgagcgtggaagaatg

SEQ ID NO: 154482 - DNA, 20 bp, human
gacgcggagactgcgcgcca

SEQ ID NO: 154483 - DNA, 20 bp, human
gcaagggataagcagggttg

SEQ ID NO: 154484 - DNA, 20 bp, human
gcaggatctctgacactcga

SEQ ID NO: 154485 - DNA, 20 bp, human
gtctgacactcgacggtcaa

SEQ ID NO: 154486 - DNA, 20 bp, human
gcagcccgaggagcctactg

SEQ ID NO: 154487 - DNA, 20 bp, human
gataccgcagtaggctcctc

SEQ ID NO: 154488 - DNA, 20 bp, human
gtgggggtcaggccaggaac

SEQ ID NO: 154489 - DNA, 20 bp, human
gccaaggcccataccgcagt

SEQ ID NO: 154490 - DNA, 20 bp, human
ggcggtatgggccttggtgg

SEQ ID NO: 154491 - DNA, 20 bp, human
gcaaaactgtactcaccgag

SEQ ID NO: 154492 - DNA, 20 bp, human
gccggggcggagctaagatg

SEQ ID NO: 154493 - DNA, 20 bp, human
gaggccaggaacgggcgaac

SEQ ID NO: 154494 - DNA, 20 bp, human
gctcaccgaggggcagcccg

SEQ ID NO: 154495 - DNA, 20 bp, human
gtcagacgaaggatgcgtag

SEQ ID NO: 154496 - DNA, 20 bp, human
gtcagagacggaaccagaga

SEQ ID NO: 154497 - DNA, 20 bp, human
ggtgacagcgagtttcatgg

SEQ ID NO: 154498 - DNA, 20 bp, human
gggatgctctggcccgtctc

SEQ ID NO: 154499 - DNA, 20 bp, human
gcagagagccagtgtgacca

SEQ ID NO: 154500 - DNA, 20 bp, human
gttggagtctgtccagatct

SEQ ID NO: 154501 - DNA, 20 bp, human
ggagtttcatggtggaggag

SEQ ID NO: 154502 - DNA, 20 bp, human
gacagcgagtttcatggtgg

SEQ ID NO: 154503 - DNA, 20 bp, human
gagatgagtacatccagcat

SEQ ID NO: 154504 - DNA, 20 bp, human
gagggtctctgagcactcac

SEQ ID NO: 154505 - DNA, 20 bp, human
gcaccaaggtctcagcatct

SEQ ID NO: 154506 - DNA, 20 bp, human
gccccagtggcacagactca

SEQ ID NO: 154507 - DNA, 20 bp, human
gtgagactgctggcatgaag

SEQ ID NO: 154508 - DNA, 20 bp, human
gtcacggcagatgcagaaca

SEQ ID NO: 154509 - DNA, 20 bp, human
gcagatgcagaacagggtga

SEQ ID NO: 154510 - DNA, 20 bp, human
gaatgttctggaaaccccag

SEQ ID NO: 154511 - DNA, 20 bp, human
gggagcagctaagattaagg

SEQ ID NO: 154512 - DNA, 20 bp, human
gcggtgaggcataaaatccc

SEQ ID NO: 154513 - DNA, 20 bp, human
gatcccgggattctggctgg

SEQ ID NO: 154514 - DNA, 20 bp, human
gggtcaggtcaggctggact

SEQ ID NO: 154515 - DNA, 20 bp, human
gctgcttctgtcacagaagt

SEQ ID NO: 154516 - DNA, 20 bp, human
gtctaagcaccagagatagg

SEQ ID NO: 154517 - DNA, 20 bp, human
gtgtggagccgtggagccca

SEQ ID NO: 154518 - DNA, 20 bp, human
gtgacctcgtgctcagagaa

SEQ ID NO: 154519 - DNA, 20 bp, human
gccgcgcctcctcctatctc

SEQ ID NO: 154520 - DNA, 20 bp, human
gcatcttgcccacggtgaaa

SEQ ID NO: 154521 - DNA, 20 bp, human
gcttcaacaagcacaggata

SEQ ID NO: 154522 - DNA, 20 bp, human
gttctcagccctttcaccgt

SEQ ID NO: 154523 - DNA, 20 bp, human
gttagagcttcttccgggag

SEQ ID NO: 154524 - DNA, 20 bp, human
gggtgcttagagcttcttcc

SEQ ID NO: 154525 - DNA, 20 bp, human
ggtgatttagactcagcccc

SEQ ID NO: 154526 - DNA, 20 bp, human
ggctaactaccagtgatagg

SEQ ID NO: 154527 - DNA, 20 bp, human
gccaggagaggctatgagaa

SEQ ID NO: 154528 - DNA, 20 bp, human
gagcgctaactaccagtgat

SEQ ID NO: 154529 - DNA, 20 bp, human
gcagtgataggaggaggctc

SEQ ID NO: 154530 - DNA, 20 bp, human
ggtcaaaagagtctagctgt

SEQ ID NO: 154531 - DNA, 20 bp, human
gtagctctgaacttgatgag

SEQ ID NO: 154532 - DNA, 20 bp, human
gaggtcacctattcaggctg

SEQ ID NO: 154533 - DNA, 20 bp, human
gggtagttagcgcttctgcc

SEQ ID NO: 154534 - DNA, 20 bp, human
gtcctaaccccagcctgaat

SEQ ID NO: 154535 - DNA, 20 bp, human
gagggtgagcattgtgccca

SEQ ID NO: 154536 - DNA, 20 bp, human
gctggcctccatgactacac

SEQ ID NO: 154537 - DNA, 20 bp, human
gggagcctgtgtagtcatgg

SEQ ID NO: 154538 - DNA, 20 bp, human
gagaagagggtgcatcccag

SEQ ID NO: 154539 - DNA, 20 bp, human
gaagggccagcgagaccatc

SEQ ID NO: 154540 - DNA, 20 bp, human
ggctttcacaatgagtgatt

SEQ ID NO: 154541 - DNA, 20 bp, human
gcccaacccaaagcacaaat

SEQ ID NO: 154542 - DNA, 20 bp, human
gtgttgaataagattcataa

SEQ ID NO: 154543 - DNA, 20 bp, human
gtgatcttgtgctcagaaga

SEQ ID NO: 154544 - DNA, 20 bp, human
gctgtcagtgtgtctcctga

SEQ ID NO: 154545 - DNA, 20 bp, human
gtgtctcctgatggtctcgc

SEQ ID NO: 154546 - DNA, 20 bp, human
ggaaatcaggaaataatcat

SEQ ID NO: 154547 - DNA, 20 bp, human
gacccaggcccttcacactg

SEQ ID NO: 154548 - DNA, 20 bp, human
gcatcagcagcttcatggcg

SEQ ID NO: 154549 - DNA, 20 bp, human
gttgattgtcaggaactcat

SEQ ID NO: 154550 - DNA, 20 bp, human
ggtctgtgttcagtcgtgcg

SEQ ID NO: 154551 - DNA, 20 bp, human
gggaactcatggggatccta

SEQ ID NO: 154552 - DNA, 20 bp, human
gtgaagggcctgggtgcgat

SEQ ID NO: 154553 - DNA, 20 bp, human
gtcatgggtctccttgaata

SEQ ID NO: 154554 - DNA, 20 bp, human
ggcatctacacctagaaatc

SEQ ID NO: 154555 - DNA, 20 bp, human
gagaaaccaggatgagtctc

SEQ ID NO: 154556 - DNA, 20 bp, human
gtgggtgctcacctccacag

SEQ ID NO: 154557 - DNA, 20 bp, human
gtcgcgggtggcaaggatca

SEQ ID NO: 154558 - DNA, 20 bp, human
gcatcagcaacttcatggtg

SEQ ID NO: 154559 - DNA, 20 bp, human
ggagatcagccccagtacaa

SEQ ID NO: 154560 - DNA, 20 bp, human
ggtcggtgttcagtcgcggg

SEQ ID NO: 154561 - DNA, 20 bp, human
gtgctgtcggtgttcagtcg

SEQ ID NO: 154562 - DNA, 20 bp, human
ggccccagtacaaaggctgt

SEQ ID NO: 154563 - DNA, 20 bp, human
gatcaaggaagccgctgtgg

SEQ ID NO: 154564 - DNA, 20 bp, human
gtgttcagtcgcgggtggca

SEQ ID NO: 154565 - DNA, 20 bp, human
ggaaatgaaacactcggact

SEQ ID NO: 154566 - DNA, 20 bp, human
ggaacaaacatcccacacct

SEQ ID NO: 154567 - DNA, 20 bp, human
ggggtctacttcccaggtgt

SEQ ID NO: 154568 - DNA, 20 bp, human
ggcgctggggtctacttccc

SEQ ID NO: 154569 - DNA, 20 bp, human
gcacataacaagcagcagtg

SEQ ID NO: 154570 - DNA, 20 bp, human
gaccagcggcaaccgcgctg

SEQ ID NO: 154571 - DNA, 20 bp, human
gcggttgccgctggttgttc

SEQ ID NO: 154572 - DNA, 20 bp, human
gttgccgctggttgttcggg

SEQ ID NO: 154573 - DNA, 20 bp, human
gggtgggttcatgatttcgc

SEQ ID NO: 154574 - DNA, 20 bp, human
ggcaatttgtttaaccagca

SEQ ID NO: 154575 - DNA, 20 bp, human
ggcagcagtgaggacaccaa

SEQ ID NO: 154576 - DNA, 20 bp, human
ggaagctcgccgccctcctg

SEQ ID NO: 154577 - DNA, 20 bp, human
ggtccgggacaggcccccaa

SEQ ID NO: 154578 - DNA, 20 bp, human
gggagacgctgcagggtcac

SEQ ID NO: 154579 - DNA, 20 bp, human
gtcaccggagctgcaggaca

SEQ ID NO: 154580 - DNA, 20 bp, human
gcgctgcagggtcaccggag

SEQ ID NO: 154581 - DNA, 20 bp, human
gggcgagcttcatggcgcgg

SEQ ID NO: 154582 - DNA, 20 bp, human
ggagccggtctccagacggg

SEQ ID NO: 154583 - DNA, 20 bp, human
gccaggggcggcctccatcc

SEQ ID NO: 154584 - DNA, 20 bp, human
ggaccctgcacagagttcac

SEQ ID NO: 154585 - DNA, 20 bp, human
gagacccgcctgtgtcccgg

SEQ ID NO: 154586 - DNA, 20 bp, human
ggtatggcaagtggaaccac

SEQ ID NO: 154587 - DNA, 20 bp, human
ggcaaaatccaccaagccag

SEQ ID NO: 154588 - DNA, 20 bp, human
ggcagccatcacactttgta

SEQ ID NO: 154589 - DNA, 20 bp, human
gggaagttagccaacttcca

SEQ ID NO: 154590 - DNA, 20 bp, human
gagttagccaacttccacgg

SEQ ID NO: 154591 - DNA, 20 bp, human
ggtgctttgttgaccctccg

SEQ ID NO: 154592 - DNA, 20 bp, human
gggctagagcttagatggtg

SEQ ID NO: 154593 - DNA, 20 bp, human
gcctcactgacagtggaata

SEQ ID NO: 154594 - DNA, 20 bp, human
ggttgaccctccgtggaagt

SEQ ID NO: 154595 - DNA, 20 bp, human
ggttggctaacttcctatgt

SEQ ID NO: 154596 - DNA, 20 bp, human
gcgctggcttctggcaggtc

SEQ ID NO: 154597 - DNA, 20 bp, human
ggacgacgaagaccaggcac

SEQ ID NO: 154598 - DNA, 20 bp, human
gtgcgagcgcgccatatata

SEQ ID NO: 154599 - DNA, 20 bp, human
ggtctggcagcgctttgatg

SEQ ID NO: 154600 - DNA, 20 bp, human
gtaacagacgtttggcatac

SEQ ID NO: 154601 - DNA, 20 bp, human
gatcagatagcgaaagaagc

SEQ ID NO: 154602 - DNA, 20 bp, human
ggcacactcaggtgtagacg

SEQ ID NO: 154603 - DNA, 20 bp, human
gcgtccaagcgccccagagt

SEQ ID NO: 154604 - DNA, 20 bp, human
gaccttgttaaaattctggg

SEQ ID NO: 154605 - DNA, 20 bp, human
gagtatcattaacagacgtt

SEQ ID NO: 154606 - DNA, 20 bp, human
gcagccctccgaaaccagtg

SEQ ID NO: 154607 - DNA, 20 bp, human
gcgctgatcaacctgcgcag

SEQ ID NO: 154608 - DNA, 20 bp, human
ggcaggcgcggagcatccac

SEQ ID NO: 154609 - DNA, 20 bp, human
gctgcctcactggtttcgga

SEQ ID NO: 154610 - DNA, 20 bp, human
ggctgcgcgcttcccggcac

SEQ ID NO: 154611 - DNA, 20 bp, human
ggaacgccctggtaaggcag

SEQ ID NO: 154612 - DNA, 20 bp, human
ggttcctaagcctgcctcac

SEQ ID NO: 154613 - DNA, 20 bp, human
gggctccccgcagattaaaa

SEQ ID NO: 154614 - DNA, 20 bp, human
gaaaccagtgaggcaggctt

SEQ ID NO: 154615 - DNA, 20 bp, human
gggatgccggcctcagaatc

SEQ ID NO: 154616 - DNA, 20 bp, human
ggataatgaccgggagtgag

SEQ ID NO: 154617 - DNA, 20 bp, human
gggctcactgtctctagcag

SEQ ID NO: 154618 - DNA, 20 bp, human
gctggcccagtgctgatcgg

SEQ ID NO: 154619 - DNA, 20 bp, human
gagaggcattcctcactcac

SEQ ID NO: 154620 - DNA, 20 bp, human
ggatgaagaagtctacctct

SEQ ID NO: 154621 - DNA, 20 bp, human
gatccatatgtgagcagcta

SEQ ID NO: 154622 - DNA, 20 bp, human
gggagccaccgatcagcact

SEQ ID NO: 154623 - DNA, 20 bp, human
gctccttagctgctcacata

SEQ ID NO: 154624 - DNA, 20 bp, human
gcatggtgctatgctggagg

SEQ ID NO: 154625 - DNA, 20 bp, human
gtgctgatcggtggctccca

SEQ ID NO: 154626 - DNA, 20 bp, human
gacttagcccctcccgtttc

SEQ ID NO: 154627 - DNA, 20 bp, human
gttcgcccgggcgggcaagc

SEQ ID NO: 154628 - DNA, 20 bp, human
gcggcgagttgacttcggta

SEQ ID NO: 154629 - DNA, 20 bp, human
gcctgcacgcgatgctccgg

SEQ ID NO: 154630 - DNA, 20 bp, human
ggcatcgcgtgcaggagcca

SEQ ID NO: 154631 - DNA, 20 bp, human
ggatggcaaacactataaag

SEQ ID NO: 154632 - DNA, 20 bp, human
gtagccactcgcgcccccac

SEQ ID NO: 154633 - DNA, 20 bp, human
ggcagccggcgagttgactt

SEQ ID NO: 154634 - DNA, 20 bp, human
ggccccaaaggcagccccgt

SEQ ID NO: 154635 - DNA, 20 bp, human
gcgcccgggcgaactcttcg

SEQ ID NO: 154636 - DNA, 20 bp, human
gctgagagcggcgttctacg

SEQ ID NO: 154637 - DNA, 20 bp, human
gagcggcgttctacgcggag

SEQ ID NO: 154638 - DNA, 20 bp, human
ggagtgccgcgggagcttga

SEQ ID NO: 154639 - DNA, 20 bp, human
gggagaggacaacgccaaga

SEQ ID NO: 154640 - DNA, 20 bp, human
gggctgccgtcaagctcccg

SEQ ID NO: 154641 - DNA, 20 bp, human
ggctcccgcggcactctcct

SEQ ID NO: 154642 - DNA, 20 bp, human
gcccgcggcactctcctagg

SEQ ID NO: 154643 - DNA, 20 bp, human
ggccacctaggagagtgccg

SEQ ID NO: 154644 - DNA, 20 bp, human
gtacgcggagcggcgggggt

SEQ ID NO: 154645 - DNA, 20 bp, human
gtggttgtcaagcgctccag

SEQ ID NO: 154646 - DNA, 20 bp, human
gccgcggcgagtcagcccag

SEQ ID NO: 154647 - DNA, 20 bp, human
ggcgaggtcggcctaagtca

SEQ ID NO: 154648 - DNA, 20 bp, human
gagggatgcgagcttcaagg

SEQ ID NO: 154649 - DNA, 20 bp, human
ggcgagctgtggccccgcaa

SEQ ID NO: 154650 - DNA, 20 bp, human
gctaaaggcgcgcacctctc

SEQ ID NO: 154651 - DNA, 20 bp, human
ggctcggcggccctctgaag

SEQ ID NO: 154652 - DNA, 20 bp, human
gccgcgcgggaggacgaagg

SEQ ID NO: 154653 - DNA, 20 bp, human
gaaacccgagtgacttccag

SEQ ID NO: 154654 - DNA, 20 bp, human
gagggccgccgagcccccag

SEQ ID NO: 154655 - DNA, 20 bp, human
gtcacccctggaagtcactc

SEQ ID NO: 154656 - DNA, 20 bp, human
gctgctgacatcctggatct

SEQ ID NO: 154657 - DNA, 20 bp, human
gaaggggaattggtaaacca

SEQ ID NO: 154658 - DNA, 20 bp, human
gctggttataatctaatccc

SEQ ID NO: 154659 - DNA, 20 bp, human
gacaagagcacaggattcac

SEQ ID NO: 154660 - DNA, 20 bp, human
gctagaagctgctgacatcc

SEQ ID NO: 154661 - DNA, 20 bp, human
gaaatagcttacctagatcc

SEQ ID NO: 154662 - DNA, 20 bp, human
gtgaagtacatgggataatt

SEQ ID NO: 154663 - DNA, 20 bp, human
gcagaccaagctaacaagaa

SEQ ID NO: 154664 - DNA, 20 bp, human
gattaggcagacaagagcac

SEQ ID NO: 154665 - DNA, 20 bp, human
gccaaacactgatttatgga

SEQ ID NO: 154666 - DNA, 20 bp, human
ggatggaaggtgaaattctg

SEQ ID NO: 154667 - DNA, 20 bp, human
ggcatcccaatatcaaggta

SEQ ID NO: 154668 - DNA, 20 bp, human
gagtctgcatcccaatatca

SEQ ID NO: 154669 - DNA, 20 bp, human
ggacaaacataccaacatga

SEQ ID NO: 154670 - DNA, 20 bp, human
gctccagtctatcactgcag

SEQ ID NO: 154671 - DNA, 20 bp, human
gaaacctagattctgagtat

SEQ ID NO: 154672 - DNA, 20 bp, human
gttcccccttaccttgatat

SEQ ID NO: 154673 - DNA, 20 bp, human
gttgcagtttacagaggtat

SEQ ID NO: 154674 - DNA, 20 bp, human
gttacctatactcagaatct

SEQ ID NO: 154675 - DNA, 20 bp, human
gctcagacctctaacaacga

SEQ ID NO: 154676 - DNA, 20 bp, human
gagctctctgatccactcag

SEQ ID NO: 154677 - DNA, 20 bp, human
gtcaggggtcagggcatcac

SEQ ID NO: 154678 - DNA, 20 bp, human
gcgacgcttcggaaaggtcc

SEQ ID NO: 154679 - DNA, 20 bp, human
gacgcgcgggcactccggaa

SEQ ID NO: 154680 - DNA, 20 bp, human
gcagctgtcgcccatcggag

SEQ ID NO: 154681 - DNA, 20 bp, human
gctgatccactcaggggtca

SEQ ID NO: 154682 - DNA, 20 bp, human
gggtcctggcaccggaaacc

SEQ ID NO: 154683 - DNA, 20 bp, human
ggccactcgacgcttcggaa

SEQ ID NO: 154684 - DNA, 20 bp, human
ggtagtcctgcctctccgat

SEQ ID NO: 154685 - DNA, 20 bp, human
gacaccgcggctgaaattgg

SEQ ID NO: 154686 - DNA, 20 bp, human
gcgcggcttctcaaacatgg

SEQ ID NO: 154687 - DNA, 20 bp, human
ggcgcgcggcttctcaaaca

SEQ ID NO: 154688 - DNA, 20 bp, human
gctgcaggcgaggggacggg

SEQ ID NO: 154689 - DNA, 20 bp, human
ggccggctcgcgcgatcggt

SEQ ID NO: 154690 - DNA, 20 bp, human
ggcggcggcggtgtgaagct

SEQ ID NO: 154691 - DNA, 20 bp, human
ggctgcaacccgccaagcag

SEQ ID NO: 154692 - DNA, 20 bp, human
ggcggtgtgaagctcggtgc

SEQ ID NO: 154693 - DNA, 20 bp, human
gggccccgtaaggaatggag

SEQ ID NO: 154694 - DNA, 20 bp, human
gcacgtacctccagtctcgt

SEQ ID NO: 154695 - DNA, 20 bp, human
ggacataggcgggatcgtaa

SEQ ID NO: 154696 - DNA, 20 bp, human
gaactgtgagctactaacac

SEQ ID NO: 154697 - DNA, 20 bp, human
gtgtgagctactaacacggg

SEQ ID NO: 154698 - DNA, 20 bp, human
gagactaatgcattcagcac

SEQ ID NO: 154699 - DNA, 20 bp, human
gtgtgcgttgccatagaggt

SEQ ID NO: 154700 - DNA, 20 bp, human
ggagaaagatcccgtgtcaa

SEQ ID NO: 154701 - DNA, 20 bp, human
ggctctggtgaacaagctgt

SEQ ID NO: 154702 - DNA, 20 bp, human
ggtgaacaagctgtaggtaa

SEQ ID NO: 154703 - DNA, 20 bp, human
gggaggcgtgccgttgacac

SEQ ID NO: 154704 - DNA, 20 bp, human
gaagggagatgcacaattgg

SEQ ID NO: 154705 - DNA, 20 bp, human
gggttgcatgcctacctcta

SEQ ID NO: 154706 - DNA, 20 bp, human
gtgactccggagtaaagcga

SEQ ID NO: 154707 - DNA, 20 bp, human
gggagctcaccatagaactt

SEQ ID NO: 154708 - DNA, 20 bp, human
gacggatctagatcctccag

SEQ ID NO: 154709 - DNA, 20 bp, human
gccgggtaagagctactagt

SEQ ID NO: 154710 - DNA, 20 bp, human
gcccggtgtgtgctgtagaa

SEQ ID NO: 154711 - DNA, 20 bp, human
gtttactccggagtcactgg

SEQ ID NO: 154712 - DNA, 20 bp, human
gctatctccaccagtgactc

SEQ ID NO: 154713 - DNA, 20 bp, human
gacatcacccagggccaagg

SEQ ID NO: 154714 - DNA, 20 bp, human
gtagtttcgagggatccaat

SEQ ID NO: 154715 - DNA, 20 bp, human
gctcccagcagaactgatcg

SEQ ID NO: 154716 - DNA, 20 bp, human
gatgggtccaagtcttccag

SEQ ID NO: 154717 - DNA, 20 bp, human
ggttcctgctatacccacag

SEQ ID NO: 154718 - DNA, 20 bp, human
gccagagagtcggaagtgaa

SEQ ID NO: 154719 - DNA, 20 bp, human
gcctgctatacccacagtgg

SEQ ID NO: 154720 - DNA, 20 bp, human
gggaaagcctctggaagact

SEQ ID NO: 154721 - DNA, 20 bp, human
ggaagagatgaccaccactg

SEQ ID NO: 154722 - DNA, 20 bp, human
ggaatgtcgccatagagctt

SEQ ID NO: 154723 - DNA, 20 bp, human
ggagctcataggaaagcctc

SEQ ID NO: 154724 - DNA, 20 bp, human
gctttaagactggaatccta

SEQ ID NO: 154725 - DNA, 20 bp, human
gggaagttgcccaagctcta

SEQ ID NO: 154726 - DNA, 20 bp, human
gaatgtgcaggatgacaaga

SEQ ID NO: 154727 - DNA, 20 bp, human
gtgaagaagttgaagctgtc

SEQ ID NO: 154728 - DNA, 20 bp, human
gttggtgctacaacagtcca

SEQ ID NO: 154729 - DNA, 20 bp, human
gttcaccagagaatctcttg

SEQ ID NO: 154730 - DNA, 20 bp, human
gcaccatgacaaataaaaag

SEQ ID NO: 154731 - DNA, 20 bp, human
ggtgctaatttggcatgtgt

SEQ ID NO: 154732 - DNA, 20 bp, human
gggcctctttttatttgtca

SEQ ID NO: 154733 - DNA, 20 bp, human
gaaagtgagtgttttttatc

SEQ ID NO: 154734 - DNA, 20 bp, human
gcgtcgtcatcttttttgtc

SEQ ID NO: 154735 - DNA, 20 bp, human
gttaagattttgtgctaatt

SEQ ID NO: 154736 - DNA, 20 bp, human
gtgcagtgcgcaggagaccg

SEQ ID NO: 154737 - DNA, 20 bp, human
gccgagccggagcgggaccg

SEQ ID NO: 154738 - DNA, 20 bp, human
gccggggtcggtgcacctag

SEQ ID NO: 154739 - DNA, 20 bp, human
ggcgccgcgcagccatgggg

SEQ ID NO: 154740 - DNA, 20 bp, human
ggagcgcgcccgagccggag

SEQ ID NO: 154741 - DNA, 20 bp, human
ggagtggcgctcgggacacg

SEQ ID NO: 154742 - DNA, 20 bp, human
gagtgccgcgccgaccacta

SEQ ID NO: 154743 - DNA, 20 bp, human
ggcagccgggcacatccgct

SEQ ID NO: 154744 - DNA, 20 bp, human
gagcgcagcagcccgagcag

SEQ ID NO: 154745 - DNA, 20 bp, human
gctcctgcgcactgcagcgg

SEQ ID NO: 154746 - DNA, 20 bp, human
ggaacagaaagctaaggcaa

SEQ ID NO: 154747 - DNA, 20 bp, human
gcaaaggagggaggatgctg

SEQ ID NO: 154748 - DNA, 20 bp, human
gtgttctgacagtcattcga

SEQ ID NO: 154749 - DNA, 20 bp, human
gagctgttggtctctgtctc

SEQ ID NO: 154750 - DNA, 20 bp, human
gggtaaagctttcaaagtga

SEQ ID NO: 154751 - DNA, 20 bp, human
gtctttggctttctagctgt

SEQ ID NO: 154752 - DNA, 20 bp, human
ggctgttttctaacagacat

SEQ ID NO: 154753 - DNA, 20 bp, human
gtaacatagataacaatccg

SEQ ID NO: 154754 - DNA, 20 bp, human
gtgaaagctttacctttaaa

SEQ ID NO: 154755 - DNA, 20 bp, human
ggttatattcaacacatacg

SEQ ID NO: 154756 - DNA, 20 bp, human
gagagagagggagtgtgtaa

SEQ ID NO: 154757 - DNA, 20 bp, human
gctgtgactaagtagtccca

SEQ ID NO: 154758 - DNA, 20 bp, human
ggccggccatattagagaga

SEQ ID NO: 154759 - DNA, 20 bp, human
gccctctgtgtccttgggag

SEQ ID NO: 154760 - DNA, 20 bp, human
gaaagagactgagccccgtg

SEQ ID NO: 154761 - DNA, 20 bp, human
gggctgacaattgtcaaggg

SEQ ID NO: 154762 - DNA, 20 bp, human
ggagggggcgagaactacaa

SEQ ID NO: 154763 - DNA, 20 bp, human
gtccatctctctaatatggc

SEQ ID NO: 154764 - DNA, 20 bp, human
ggtgtagccgcaatgtgaag

SEQ ID NO: 154765 - DNA, 20 bp, human
gcacatctgcatgctcccga

SEQ ID NO: 154766 - DNA, 20 bp, human
gatctcagaacaggaagcgg

SEQ ID NO: 154767 - DNA, 20 bp, human
gtgtaaattacaggaaccaa

SEQ ID NO: 154768 - DNA, 20 bp, human
gacctggtagctaggttcta

SEQ ID NO: 154769 - DNA, 20 bp, human
gatagagtgaatctcagaac

SEQ ID NO: 154770 - DNA, 20 bp, human
gaatagagcctgtctggaaa

SEQ ID NO: 154771 - DNA, 20 bp, human
gtgttatgctgtaattcata

SEQ ID NO: 154772 - DNA, 20 bp, human
ggtctggaaatggtgattta

SEQ ID NO: 154773 - DNA, 20 bp, human
gaaagaaaatagagcctgtc

SEQ ID NO: 154774 - DNA, 20 bp, human
gcctaaccatcttggatgct

SEQ ID NO: 154775 - DNA, 20 bp, human
gaccatagaacctagctacc

SEQ ID NO: 154776 - DNA, 20 bp, human
ggagccgcctgcgcatgtca

SEQ ID NO: 154777 - DNA, 20 bp, human
ggcgcaaacgagcgaggcag

SEQ ID NO: 154778 - DNA, 20 bp, human
ggacagcacacacggcctgg

SEQ ID NO: 154779 - DNA, 20 bp, human
gatcacctgccacccagggt

SEQ ID NO: 154780 - DNA, 20 bp, human
gccctgggcgcaaacgagcg

SEQ ID NO: 154781 - DNA, 20 bp, human
gtcggaacgcaaccgatcct

SEQ ID NO: 154782 - DNA, 20 bp, human
gggcgagaggtgaatcaacc

SEQ ID NO: 154783 - DNA, 20 bp, human
gagctcgcccccggatggtg

SEQ ID NO: 154784 - DNA, 20 bp, human
ggccccgctgcacctcccca

SEQ ID NO: 154785 - DNA, 20 bp, human
gggtgcggggccccgaccct

SEQ ID NO: 154786 - DNA, 20 bp, human
gggctcagagaccagaaggg

SEQ ID NO: 154787 - DNA, 20 bp, human
gtacgatgaaggtctaaggt

SEQ ID NO: 154788 - DNA, 20 bp, human
gctggccatcctcgcatcct

SEQ ID NO: 154789 - DNA, 20 bp, human
gtgagtacgatgaaggtcta

SEQ ID NO: 154790 - DNA, 20 bp, human
gccttcatcgtactcaacaa

SEQ ID NO: 154791 - DNA, 20 bp, human
ggaagggtggtgggtggcct

SEQ ID NO: 154792 - DNA, 20 bp, human
ggggggtctccgtagatcat

SEQ ID NO: 154793 - DNA, 20 bp, human
gtgagcccaggatgcgagga

SEQ ID NO: 154794 - DNA, 20 bp, human
gagcaggtgtggcggagaag

SEQ ID NO: 154795 - DNA, 20 bp, human
gcccttcacccgggagtcac

SEQ ID NO: 154796 - DNA, 20 bp, human
gtgagactggcgggctgatg

SEQ ID NO: 154797 - DNA, 20 bp, human
gcgcgctctccgcccgaggt

SEQ ID NO: 154798 - DNA, 20 bp, human
ggtcgcggggatgggatact

SEQ ID NO: 154799 - DNA, 20 bp, human
gtttcccgagccccgaccgg

SEQ ID NO: 154800 - DNA, 20 bp, human
ggcgggtctccagagttcag

SEQ ID NO: 154801 - DNA, 20 bp, human
gcctggagccgaaggtgcca

SEQ ID NO: 154802 - DNA, 20 bp, human
ggtggccgaacgccgacctc

SEQ ID NO: 154803 - DNA, 20 bp, human
gcggggctcgggaaagttag

SEQ ID NO: 154804 - DNA, 20 bp, human
gttcggccacaaagctaccc

SEQ ID NO: 154805 - DNA, 20 bp, human
gggagcacagcctatgaacc

SEQ ID NO: 154806 - DNA, 20 bp, human
gagccgcggagccgagacgg

SEQ ID NO: 154807 - DNA, 20 bp, human
ggggagcccgaacagagccg

SEQ ID NO: 154808 - DNA, 20 bp, human
ggacagcgcaccgggaaacc

SEQ ID NO: 154809 - DNA, 20 bp, human
gtgcagggatcgctcccccg

SEQ ID NO: 154810 - DNA, 20 bp, human
ggcgcaccgggaaacccgga

SEQ ID NO: 154811 - DNA, 20 bp, human
gggctggagggtatccccgg

SEQ ID NO: 154812 - DNA, 20 bp, human
gaggagcacgcagggactgg

SEQ ID NO: 154813 - DNA, 20 bp, human
ggcggcgcccgtaggatgca

SEQ ID NO: 154814 - DNA, 20 bp, human
gagcgatccctgcatcctac

SEQ ID NO: 154815 - DNA, 20 bp, human
gcccggctggagggtatccc

SEQ ID NO: 154816 - DNA, 20 bp, human
gtgcagagccacagctggtg

SEQ ID NO: 154817 - DNA, 20 bp, human
ggttagacaccgactcactg

SEQ ID NO: 154818 - DNA, 20 bp, human
ggagagtcgccccagtgagt

SEQ ID NO: 154819 - DNA, 20 bp, human
gtgcaaacacccacagacca

SEQ ID NO: 154820 - DNA, 20 bp, human
gaagagcagccgtggtctgt

SEQ ID NO: 154821 - DNA, 20 bp, human
gctcctgctggggaccctaa

SEQ ID NO: 154822 - DNA, 20 bp, human
gggaccctaagggtgtgtat

SEQ ID NO: 154823 - DNA, 20 bp, human
ggtaaatgggccccactaaa

SEQ ID NO: 154824 - DNA, 20 bp, human
gtgctcctgaagggtccctc

SEQ ID NO: 154825 - DNA, 20 bp, human
gggaggggtctctgggtcag

SEQ ID NO: 154826 - DNA, 20 bp, human
gaggcgcggccggactgcaa

SEQ ID NO: 154827 - DNA, 20 bp, human
ggccgccgggagcggatcag

SEQ ID NO: 154828 - DNA, 20 bp, human
ggcgagaagggaaacccgga

SEQ ID NO: 154829 - DNA, 20 bp, human
gtgcaaaggcgccgaggatg

SEQ ID NO: 154830 - DNA, 20 bp, human
ggagggctgcaccgcggaag

SEQ ID NO: 154831 - DNA, 20 bp, human
gcggcgggcgggactgcggt

SEQ ID NO: 154832 - DNA, 20 bp, human
gtcaggggcaagagggaaca

SEQ ID NO: 154833 - DNA, 20 bp, human
gctgcggcaaagcccctgac

SEQ ID NO: 154834 - DNA, 20 bp, human
gcggaaggggcaccaaggac

SEQ ID NO: 154835 - DNA, 20 bp, human
gagccggcttgcactgggaa

SEQ ID NO: 154836 - DNA, 20 bp, human
ggcggtcgccagcgctccag

SEQ ID NO: 154837 - DNA, 20 bp, human
gccacctggaaagaagagag

SEQ ID NO: 154838 - DNA, 20 bp, human
ggtcgccagcgctccagcgg

SEQ ID NO: 154839 - DNA, 20 bp, human
gccagcaatgggaggaagaa

SEQ ID NO: 154840 - DNA, 20 bp, human
gttccaggtggcgtaataca

SEQ ID NO: 154841 - DNA, 20 bp, human
ggcggggctgctacctccac

SEQ ID NO: 154842 - DNA, 20 bp, human
gggcgcagtctgcttgcagg

SEQ ID NO: 154843 - DNA, 20 bp, human
ggcgctccagcggcggctgt

SEQ ID NO: 154844 - DNA, 20 bp, human
gaccgggtggttccagcaat

SEQ ID NO: 154845 - DNA, 20 bp, human
ggggtggttccagcaatggg

SEQ ID NO: 154846 - DNA, 20 bp, human
gcaggccaccgtagcaagag

SEQ ID NO: 154847 - DNA, 20 bp, human
gtcagcgggataggagagag

SEQ ID NO: 154848 - DNA, 20 bp, human
gcctggaggagtggcgaaac

SEQ ID NO: 154849 - DNA, 20 bp, human
ggctgatgcttcgggatgga

SEQ ID NO: 154850 - DNA, 20 bp, human
gctctaaccgcagaaccctc

SEQ ID NO: 154851 - DNA, 20 bp, human
gtgctctggcaacaactcgg

SEQ ID NO: 154852 - DNA, 20 bp, human
ggaaatccggacgggatcag

SEQ ID NO: 154853 - DNA, 20 bp, human
gctcaagcctgagggttctg

SEQ ID NO: 154854 - DNA, 20 bp, human
gaggcgctgatgcttcggga

SEQ ID NO: 154855 - DNA, 20 bp, human
gagttacattccagaggatg

SEQ ID NO: 154856 - DNA, 20 bp, human
gcagaggagaggccgttcta

SEQ ID NO: 154857 - DNA, 20 bp, human
gccagccgcaacctgggagt

SEQ ID NO: 154858 - DNA, 20 bp, human
gttctagggaagcccagctc

SEQ ID NO: 154859 - DNA, 20 bp, human
gcctggagccagcagacctg

SEQ ID NO: 154860 - DNA, 20 bp, human
gtcgaaaggtggccctatca

SEQ ID NO: 154861 - DNA, 20 bp, human
gtgggcgcagggtgggacat

SEQ ID NO: 154862 - DNA, 20 bp, human
gcccagtccagccgcaacct

SEQ ID NO: 154863 - DNA, 20 bp, human
ggctgagacacagatcctgg

SEQ ID NO: 154864 - DNA, 20 bp, human
gggagctgagacacagatcc

SEQ ID NO: 154865 - DNA, 20 bp, human
gcagcagacctgcgggagtt

SEQ ID NO: 154866 - DNA, 20 bp, human
gggatgcgcgctgtcggcgg

SEQ ID NO: 154867 - DNA, 20 bp, human
gggtcccaggcgcctcagac

SEQ ID NO: 154868 - DNA, 20 bp, human
gagagacggcggcaaagtcc

SEQ ID NO: 154869 - DNA, 20 bp, human
ggagcgcggcgagaccgact

SEQ ID NO: 154870 - DNA, 20 bp, human
gtgcgcgctgtcggcggtgg

SEQ ID NO: 154871 - DNA, 20 bp, human
gcacggaggatgcgcgctgt

SEQ ID NO: 154872 - DNA, 20 bp, human
gcacccaagcgccctcccgt

SEQ ID NO: 154873 - DNA, 20 bp, human
gtcctggcatagagtgggcg

SEQ ID NO: 154874 - DNA, 20 bp, human
ggcggcgagaccgactggga

SEQ ID NO: 154875 - DNA, 20 bp, human
gggccgagtgttggtgacac

SEQ ID NO: 154876 - DNA, 20 bp, human
gtgagcaccgaagcatggac

SEQ ID NO: 154877 - DNA, 20 bp, human
gtggaagcagccacacgggg

SEQ ID NO: 154878 - DNA, 20 bp, human
gcacagccttcttcaggata

SEQ ID NO: 154879 - DNA, 20 bp, human
gctgccagctgcccccgcaa

SEQ ID NO: 154880 - DNA, 20 bp, human
gagccttcttcaggataagg

SEQ ID NO: 154881 - DNA, 20 bp, human
gcgaagcatggacgggagaa

SEQ ID NO: 154882 - DNA, 20 bp, human
ggaatggaagcagccacacg

SEQ ID NO: 154883 - DNA, 20 bp, human
gtcccaccttgaggtaccag

SEQ ID NO: 154884 - DNA, 20 bp, human
gcaggaacaggattgcatgg

SEQ ID NO: 154885 - DNA, 20 bp, human
gcccagcccctggtacctca

SEQ ID NO: 154886 - DNA, 20 bp, human
gcttctcccccaccacatct

SEQ ID NO: 154887 - DNA, 20 bp, human
gacccgagccgggcccaggt

SEQ ID NO: 154888 - DNA, 20 bp, human
gagggacccagcaccacttg

SEQ ID NO: 154889 - DNA, 20 bp, human
ggggcccaggttggaagggt

SEQ ID NO: 154890 - DNA, 20 bp, human
ggatgtcacagagaccccac

SEQ ID NO: 154891 - DNA, 20 bp, human
gccggacacagcacaggcct

SEQ ID NO: 154892 - DNA, 20 bp, human
ggccctgccgctgacctgtg

SEQ ID NO: 154893 - DNA, 20 bp, human
gtccaacctgggcccggctc

SEQ ID NO: 154894 - DNA, 20 bp, human
gccacttggggcaggatgtc

SEQ ID NO: 154895 - DNA, 20 bp, human
gctctccaggacgtcaccgg

SEQ ID NO: 154896 - DNA, 20 bp, human
gagggtagaaggaacagtag

SEQ ID NO: 154897 - DNA, 20 bp, human
gaagggtccaaggctcgtgc

SEQ ID NO: 154898 - DNA, 20 bp, human
gccacggcgtgggtagaccc

SEQ ID NO: 154899 - DNA, 20 bp, human
gctctcgggctagcatcccc

SEQ ID NO: 154900 - DNA, 20 bp, human
gggcccacaagagcccgcgg

SEQ ID NO: 154901 - DNA, 20 bp, human
gcccgcggtggcgctgccag

SEQ ID NO: 154902 - DNA, 20 bp, human
gaggtccacgcgactcaccc

SEQ ID NO: 154903 - DNA, 20 bp, human
gctcaccccggcagggaagg

SEQ ID NO: 154904 - DNA, 20 bp, human
gcaaggtgtcccagcatccc

SEQ ID NO: 154905 - DNA, 20 bp, human
ggccggcccacaagagcccg

SEQ ID NO: 154906 - DNA, 20 bp, human
ggccatgagcctcggagacc

SEQ ID NO: 154907 - DNA, 20 bp, human
gcaatagccagggcgccccg

SEQ ID NO: 154908 - DNA, 20 bp, human
ggaggccgcataactcgtcc

SEQ ID NO: 154909 - DNA, 20 bp, human
gcgcaaggcacgggaaatgt

SEQ ID NO: 154910 - DNA, 20 bp, human
gcgatgctggtcctagtacc

SEQ ID NO: 154911 - DNA, 20 bp, human
gaggtaaggcgcgcaagcta

SEQ ID NO: 154912 - DNA, 20 bp, human
gaggcaagaagcgccaaagt

SEQ ID NO: 154913 - DNA, 20 bp, human
gagtacccggacgagttatg

SEQ ID NO: 154914 - DNA, 20 bp, human
ggggagggtcaaaggagacc

SEQ ID NO: 154915 - DNA, 20 bp, human
gaaatcgcggggagggtcaa

SEQ ID NO: 154916 - DNA, 20 bp, human
gaggcaccgtggagctggtc

SEQ ID NO: 154917 - DNA, 20 bp, human
ggtgcgcatgcgcagctccg

SEQ ID NO: 154918 - DNA, 20 bp, human
gtcagtggaccaagcacgag

SEQ ID NO: 154919 - DNA, 20 bp, human
gccgccggctcagggaaagc

SEQ ID NO: 154920 - DNA, 20 bp, human
ggcgggcgccacacgctcac

SEQ ID NO: 154921 - DNA, 20 bp, human
ggtgcagtgagtcctcggga

SEQ ID NO: 154922 - DNA, 20 bp, human
ggggtgccctcagcaggagg

SEQ ID NO: 154923 - DNA, 20 bp, human
gcggagctgggaaactaccc

SEQ ID NO: 154924 - DNA, 20 bp, human
ggcagagctgctggtcgacg

SEQ ID NO: 154925 - DNA, 20 bp, human
ggcgggagcggaaggatcca

SEQ ID NO: 154926 - DNA, 20 bp, human
gtgaggcgccgggagaagga

SEQ ID NO: 154927 - DNA, 20 bp, human
ggtgtcccggcctgaggtgt

SEQ ID NO: 154928 - DNA, 20 bp, human
gcacttggaccaactgaccc

SEQ ID NO: 154929 - DNA, 20 bp, human
gcgcctcaagcggaaggtga

SEQ ID NO: 154930 - DNA, 20 bp, human
gtcgcagagcagccacggga

SEQ ID NO: 154931 - DNA, 20 bp, human
gtccggccgacacctcaggc

SEQ ID NO: 154932 - DNA, 20 bp, human
gcacgttctgtgggcggagt

SEQ ID NO: 154933 - DNA, 20 bp, human
gtcccggcgcctcaagcgga

SEQ ID NO: 154934 - DNA, 20 bp, human
gcccggcctgaggtgtcggc

SEQ ID NO: 154935 - DNA, 20 bp, human
gcttctcccggcgcctcaag

SEQ ID NO: 154936 - DNA, 20 bp, human
ggacgactgccggcactgac

SEQ ID NO: 154937 - DNA, 20 bp, human
gttcgggcttcagggagctc

SEQ ID NO: 154938 - DNA, 20 bp, human
ggcagccccgagataatcca

SEQ ID NO: 154939 - DNA, 20 bp, human
ggcggagtcccgaggtgtgt

SEQ ID NO: 154940 - DNA, 20 bp, human
gcagtgccggcagtcgtccg

SEQ ID NO: 154941 - DNA, 20 bp, human
ggccctggcttcgggcttca

SEQ ID NO: 154942 - DNA, 20 bp, human
gtgagagtgcgcgtgcgtag

SEQ ID NO: 154943 - DNA, 20 bp, human
gagatccttggattatctcg

SEQ ID NO: 154944 - DNA, 20 bp, human
ggtcgaagctaggagaccgg

SEQ ID NO: 154945 - DNA, 20 bp, human
gtctaaagaggtgagatcct

SEQ ID NO: 154946 - DNA, 20 bp, human
gggactagcacaggaagatg

SEQ ID NO: 154947 - DNA, 20 bp, human
gactagatggcaaggtccag

SEQ ID NO: 154948 - DNA, 20 bp, human
ggtgatgtccagctgaaaga

SEQ ID NO: 154949 - DNA, 20 bp, human
gccggaaagttcaaagtgag

SEQ ID NO: 154950 - DNA, 20 bp, human
gcagaggatggacctctggt

SEQ ID NO: 154951 - DNA, 20 bp, human
gaggtccaggggactagcac

SEQ ID NO: 154952 - DNA, 20 bp, human
gcaacccaagatcaaagcag

SEQ ID NO: 154953 - DNA, 20 bp, human
gcagctgctcacagactaga

SEQ ID NO: 154954 - DNA, 20 bp, human
ggacattaggcttcacatca

SEQ ID NO: 154955 - DNA, 20 bp, human
gggcaaggaaagccttctgc

SEQ ID NO: 154956 - DNA, 20 bp, human
gtgccgtgcggtacttgtca

SEQ ID NO: 154957 - DNA, 20 bp, human
ggctgctaaatgaggatata

SEQ ID NO: 154958 - DNA, 20 bp, human
gagcagcaaccaccgcggga

SEQ ID NO: 154959 - DNA, 20 bp, human
gctccatgacaagtaccgca

SEQ ID NO: 154960 - DNA, 20 bp, human
gcattcgtggtaggatgtaa

SEQ ID NO: 154961 - DNA, 20 bp, human
gatctaggcgtaggagagaa

SEQ ID NO: 154962 - DNA, 20 bp, human
ggcacggcagcatcagcaac

SEQ ID NO: 154963 - DNA, 20 bp, human
ggcggcgctctcccgtcccg

SEQ ID NO: 154964 - DNA, 20 bp, human
gtgctgctgggcctgaacgc

SEQ ID NO: 154965 - DNA, 20 bp, human
gcatgattggctgctaaatg

SEQ ID NO: 154966 - DNA, 20 bp, human
gcagcgagtctgtcgatccc

SEQ ID NO: 154967 - DNA, 20 bp, human
ggaaagacagagatcctctg

SEQ ID NO: 154968 - DNA, 20 bp, human
gcaacattcagagtaaattt

SEQ ID NO: 154969 - DNA, 20 bp, human
gcttaaatgctcacactcac

SEQ ID NO: 154970 - DNA, 20 bp, human
gtgggataagtcctgttgtg

SEQ ID NO: 154971 - DNA, 20 bp, human
gctcacatagttctgaggac

SEQ ID NO: 154972 - DNA, 20 bp, human
gcacactcactgggtgagtt

SEQ ID NO: 154973 - DNA, 20 bp, human
gtcatcctcacatagttctg

SEQ ID NO: 154974 - DNA, 20 bp, human
ggtctgccttgtctctggcc

SEQ ID NO: 154975 - DNA, 20 bp, human
ggaatgttgtcccacacaac

SEQ ID NO: 154976 - DNA, 20 bp, human
gcggtagatctcctccggca

SEQ ID NO: 154977 - DNA, 20 bp, human
gccccagcccgtgattcctc

SEQ ID NO: 154978 - DNA, 20 bp, human
gctgccgccggaggaatcac

SEQ ID NO: 154979 - DNA, 20 bp, human
gctccaggctgcggctgtag

SEQ ID NO: 154980 - DNA, 20 bp, human
gacttgagcatggtgcgggt

SEQ ID NO: 154981 - DNA, 20 bp, human
gggcagcggcggttccggtg

SEQ ID NO: 154982 - DNA, 20 bp, human
gtgcaaccggcacgtggagt

SEQ ID NO: 154983 - DNA, 20 bp, human
ggctcaagtgcatcccgctg

SEQ ID NO: 154984 - DNA, 20 bp, human
ggtccaccgactccacgtgc

SEQ ID NO: 154985 - DNA, 20 bp, human
gcagcccgtgattcctccgg

SEQ ID NO: 154986 - DNA, 20 bp, human
gattactgcggcgacctcgg

SEQ ID NO: 154987 - DNA, 20 bp, human
gcccacaggcacatcccagt

SEQ ID NO: 154988 - DNA, 20 bp, human
gcccagacgcggctcacctg

SEQ ID NO: 154989 - DNA, 20 bp, human
gtgccgggtccggattactg

SEQ ID NO: 154990 - DNA, 20 bp, human
ggcgccgggagtctgggtag

SEQ ID NO: 154991 - DNA, 20 bp, human
gtggcctcggcctgaagccg

SEQ ID NO: 154992 - DNA, 20 bp, human
gcgccgcagtaatccggacc

SEQ ID NO: 154993 - DNA, 20 bp, human
gtccccgagccgagtcaccc

SEQ ID NO: 154994 - DNA, 20 bp, human
gaggccccctccctactcga

SEQ ID NO: 154995 - DNA, 20 bp, human
ggcagcacccgcaccctcgg

SEQ ID NO: 154996 - DNA, 20 bp, human
gggctcgacgacgccatctg

SEQ ID NO: 154997 - DNA, 20 bp, human
ggacgacgccatctggggag

SEQ ID NO: 154998 - DNA, 20 bp, human
ggaagggccgggactcccag

SEQ ID NO: 154999 - DNA, 20 bp, human
gcaagaccccagctcggtcc

SEQ ID NO: 155000 - DNA, 20 bp, human
gccagggccgccccattggg

SEQ ID NO: 155001 - DNA, 20 bp, human
gcggcgcacacaccatggac

SEQ ID NO: 155002 - DNA, 20 bp, human
ggccgagcgtccaggagcca

SEQ ID NO: 155003 - DNA, 20 bp, human
gtgagagtctccgcccaatg

SEQ ID NO: 155004 - DNA, 20 bp, human
ggagtctccgcccaatgggg

SEQ ID NO: 155005 - DNA, 20 bp, human
gaagcagtcgcaggaacatg

SEQ ID NO: 155006 - DNA, 20 bp, human
gggtttgagcgcccagggcc

SEQ ID NO: 155007 - DNA, 20 bp, human
ggaagtgacaggtggacgga

SEQ ID NO: 155008 - DNA, 20 bp, human
gacccgaagtgacaggtgga

SEQ ID NO: 155009 - DNA, 20 bp, human
gcggcaactgatgcctccac

SEQ ID NO: 155010 - DNA, 20 bp, human
gcccagctacccgaagtgac

SEQ ID NO: 155011 - DNA, 20 bp, human
ggacagctctgcaagaacgg

SEQ ID NO: 155012 - DNA, 20 bp, human
ggcgccagtaccgtacagct

SEQ ID NO: 155013 - DNA, 20 bp, human
ggcggcggcccttcgaccaa

SEQ ID NO: 155014 - DNA, 20 bp, human
gggggaacttccgagatcaa

SEQ ID NO: 155015 - DNA, 20 bp, human
gaacccggaagacccaactg

SEQ ID NO: 155016 - DNA, 20 bp, human
gccgggcccggagaacgcgg

SEQ ID NO: 155017 - DNA, 20 bp, human
gccggagaacgcggtggcag

SEQ ID NO: 155018 - DNA, 20 bp, human
ggaagaagagggatccggag

SEQ ID NO: 155019 - DNA, 20 bp, human
ggggcaacggaggagacgca

SEQ ID NO: 155020 - DNA, 20 bp, human
gctcgcgcggcagcatccaa

SEQ ID NO: 155021 - DNA, 20 bp, human
gggaagccgggaccagagga

SEQ ID NO: 155022 - DNA, 20 bp, human
gagcatccaaaggccagagt

SEQ ID NO: 155023 - DNA, 20 bp, human
ggccgcggtgctgaagctgc

SEQ ID NO: 155024 - DNA, 20 bp, human
gagggccccgtcaccatccg

SEQ ID NO: 155025 - DNA, 20 bp, human
gaccatccgaggagcggcgg

SEQ ID NO: 155026 - DNA, 20 bp, human
ggcccgcctgagctaggcac

SEQ ID NO: 155027 - DNA, 20 bp, human
gggaccaaccgagcaaggcc

SEQ ID NO: 155028 - DNA, 20 bp, human
gtccggtgcctagctcaggc

SEQ ID NO: 155029 - DNA, 20 bp, human
gcaaaaaggaaaccccccca

SEQ ID NO: 155030 - DNA, 20 bp, human
gccccagggatgcaaagaaa

SEQ ID NO: 155031 - DNA, 20 bp, human
gcaaggccaggcatcggcgt

SEQ ID NO: 155032 - DNA, 20 bp, human
ggggaggaaaagagaaatcc

SEQ ID NO: 155033 - DNA, 20 bp, human
ggaacaggaccaaccgagca

SEQ ID NO: 155034 - DNA, 20 bp, human
gctggccacttcagaactgg

SEQ ID NO: 155035 - DNA, 20 bp, human
gctgttccggtgcctagctc

SEQ ID NO: 155036 - DNA, 20 bp, human
ggaacagcatggcctggacc

SEQ ID NO: 155037 - DNA, 20 bp, human
gggcccggcgacactcagac

SEQ ID NO: 155038 - DNA, 20 bp, human
ggggtctgctctgcccgtca

SEQ ID NO: 155039 - DNA, 20 bp, human
gagttagtcctggagctggg

SEQ ID NO: 155040 - DNA, 20 bp, human
gccgcaaggcccctttatgg

SEQ ID NO: 155041 - DNA, 20 bp, human
gtgggcatgttggaccctga

SEQ ID NO: 155042 - DNA, 20 bp, human
gtccgggcgccgccataaag

SEQ ID NO: 155043 - DNA, 20 bp, human
gcgcagagaacagcatggcc

SEQ ID NO: 155044 - DNA, 20 bp, human
gctgcgccccgaccccgcca

SEQ ID NO: 155045 - DNA, 20 bp, human
gggctccagcggctgctaca

SEQ ID NO: 155046 - DNA, 20 bp, human
gcgtgcgcgccagacgaagg

SEQ ID NO: 155047 - DNA, 20 bp, human
ggtccctccggagaagagct

SEQ ID NO: 155048 - DNA, 20 bp, human
ggcggccacctggtccgagg

SEQ ID NO: 155049 - DNA, 20 bp, human
gcatcgtgcgcgccagacga

SEQ ID NO: 155050 - DNA, 20 bp, human
ggctgcgccccgaggagcca

SEQ ID NO: 155051 - DNA, 20 bp, human
gctgcccgaggccggagaaa

SEQ ID NO: 155052 - DNA, 20 bp, human
gccggggcccgccgcaggtc

SEQ ID NO: 155053 - DNA, 20 bp, human
gcgcgcggccacctggtccg

SEQ ID NO: 155054 - DNA, 20 bp, human
gctgcaggctggggacccga

SEQ ID NO: 155055 - DNA, 20 bp, human
gtgagccacccgacctgcgg

SEQ ID NO: 155056 - DNA, 20 bp, human
ggcgcgggagcgaggaagaa

SEQ ID NO: 155057 - DNA, 20 bp, human
gagcccgagcggtggcggag

SEQ ID NO: 155058 - DNA, 20 bp, human
ggcgcggggacccgaccgac

SEQ ID NO: 155059 - DNA, 20 bp, human
gtcgggagcccgagcggtgg

SEQ ID NO: 155060 - DNA, 20 bp, human
gcgggagcggccggtcggtc

SEQ ID NO: 155061 - DNA, 20 bp, human
gtccggcggggccgcaccag

SEQ ID NO: 155062 - DNA, 20 bp, human
ggagcgaggaagaaaggcgg

SEQ ID NO: 155063 - DNA, 20 bp, human
gccaggtaagcccccgaccg

SEQ ID NO: 155064 - DNA, 20 bp, human
ggccgaggcgcggtcccgga

SEQ ID NO: 155065 - DNA, 20 bp, human
ggccgcgcccatgctcaatg

SEQ ID NO: 155066 - DNA, 20 bp, human
gtgactagcaggcgctctgg

SEQ ID NO: 155067 - DNA, 20 bp, human
gggcccgcgacccccatgga

SEQ ID NO: 155068 - DNA, 20 bp, human
gggccgggccgaaggactca

SEQ ID NO: 155069 - DNA, 20 bp, human
gtcggacccggagctgctga

SEQ ID NO: 155070 - DNA, 20 bp, human
gcaaggcgccacgaccgctg

SEQ ID NO: 155071 - DNA, 20 bp, human
gggaggcatccggaccgggg

SEQ ID NO: 155072 - DNA, 20 bp, human
gggcagaggcggcggagtgc

SEQ ID NO: 155073 - DNA, 20 bp, human
gcggcgggtgaggtcccggg

SEQ ID NO: 155074 - DNA, 20 bp, human
ggctctggaggcatccggac

SEQ ID NO: 155075 - DNA, 20 bp, human
gctcagggccccagcggtcg

SEQ ID NO: 155076 - DNA, 20 bp, human
ggcgaagctgggaattgggt

SEQ ID NO: 155077 - DNA, 20 bp, human
gggaattgggtgggattaca

SEQ ID NO: 155078 - DNA, 20 bp, human
gcgccagtagctccagccat

SEQ ID NO: 155079 - DNA, 20 bp, human
ggtggaccagcaggacaagc

SEQ ID NO: 155080 - DNA, 20 bp, human
gaagccgcgcaaggtaagga

SEQ ID NO: 155081 - DNA, 20 bp, human
ggcggctttgctgtactggg

SEQ ID NO: 155082 - DNA, 20 bp, human
ggcagaggccggcttggaga

SEQ ID NO: 155083 - DNA, 20 bp, human
ggagcgaaggacctgagaaa

SEQ ID NO: 155084 - DNA, 20 bp, human
gagcaaagccgcgcaaggta

SEQ ID NO: 155085 - DNA, 20 bp, human
gcggcctctgccagcggcgg

SEQ ID NO: 155086 - DNA, 20 bp, human
ggcagcgtggcgaaggacat

SEQ ID NO: 155087 - DNA, 20 bp, human
gaaggacatggggccggcgg

SEQ ID NO: 155088 - DNA, 20 bp, human
gggtacaggtagcggcccgg

SEQ ID NO: 155089 - DNA, 20 bp, human
gcacctcggggtacaggtag

SEQ ID NO: 155090 - DNA, 20 bp, human
gaggtgcgagatgtagctgg

SEQ ID NO: 155091 - DNA, 20 bp, human
gaggcgggcccggagtggca

SEQ ID NO: 155092 - DNA, 20 bp, human
gtgtcggaggacgaggaccg

SEQ ID NO: 155093 - DNA, 20 bp, human
gggccgctacctgtaccccg

SEQ ID NO: 155094 - DNA, 20 bp, human
gcggcgcgctgcggcctcca

SEQ ID NO: 155095 - DNA, 20 bp, human
ggtggcgaaggacatggggc

SEQ ID NO: 155096 - DNA, 20 bp, human
gcgcgccgcgtggaagaagg

SEQ ID NO: 155097 - DNA, 20 bp, human
ggcgcgcgccgcgtggaaga

SEQ ID NO: 155098 - DNA, 20 bp, human
ggggcccgccttcttccacg

SEQ ID NO: 155099 - DNA, 20 bp, human
gtgtcggaggacgaggaccg

SEQ ID NO: 155100 - DNA, 20 bp, human
gggccgctacctgtaccccg

SEQ ID NO: 155101 - DNA, 20 bp, human
gcacctcggggtacaggtag

SEQ ID NO: 155102 - DNA, 20 bp, human
gcccgaggtgagcccgctgt

SEQ ID NO: 155103 - DNA, 20 bp, human
gggtacaggtagcggcccgg

SEQ ID NO: 155104 - DNA, 20 bp, human
ggaggtgagcccgctgtcgg

SEQ ID NO: 155105 - DNA, 20 bp, human
gaccgcggcagcgacagctc

SEQ ID NO: 155106 - DNA, 20 bp, human
ggccttagctccgggtcctc

SEQ ID NO: 155107 - DNA, 20 bp, human
gttgtgtggccggaagacaa

SEQ ID NO: 155108 - DNA, 20 bp, human
ggccggaggacccggagcta

SEQ ID NO: 155109 - DNA, 20 bp, human
gccggccacacaacagctct

SEQ ID NO: 155110 - DNA, 20 bp, human
gggaccgagggaccgacagg

SEQ ID NO: 155111 - DNA, 20 bp, human
gagggcagcggggcctgaga

SEQ ID NO: 155112 - DNA, 20 bp, human
gagtgtccctaaggctgacc

SEQ ID NO: 155113 - DNA, 20 bp, human
gtacctcaaggcgagagtgg

SEQ ID NO: 155114 - DNA, 20 bp, human
ggctccgggatgagctcgaa

SEQ ID NO: 155115 - DNA, 20 bp, human
gcgtaggccgcggtcgacct

SEQ ID NO: 155116 - DNA, 20 bp, human
ggaccgacctccctcaccgg

SEQ ID NO: 155117 - DNA, 20 bp, human
gaccgaccgacctccctcac

SEQ ID NO: 155118 - DNA, 20 bp, human
gagccgccggtgagggaggt

SEQ ID NO: 155119 - DNA, 20 bp, human
ggccggcgaggagggaatgg

SEQ ID NO: 155120 - DNA, 20 bp, human
ggaaggaagaggtaagtgac

SEQ ID NO: 155121 - DNA, 20 bp, human
ggcgagagagccgccggtga

SEQ ID NO: 155122 - DNA, 20 bp, human
gagctactgtcagagaagga

SEQ ID NO: 155123 - DNA, 20 bp, human
gggagccggcgaggagggaa

SEQ ID NO: 155124 - DNA, 20 bp, human
ggaccggggacgaagagtaa

SEQ ID NO: 155125 - DNA, 20 bp, human
gtagcctgggtcaccagcca

SEQ ID NO: 155126 - DNA, 20 bp, human
ggtagtggccacagccttac

SEQ ID NO: 155127 - DNA, 20 bp, human
gaggactgcgccgtggggga

SEQ ID NO: 155128 - DNA, 20 bp, human
gccgcggccagagctctcca

SEQ ID NO: 155129 - DNA, 20 bp, human
gcggccagagctctccaagg

SEQ ID NO: 155130 - DNA, 20 bp, human
gcagaagattgtgggtgtag

SEQ ID NO: 155131 - DNA, 20 bp, human
gccggcccccagaagattgt

SEQ ID NO: 155132 - DNA, 20 bp, human
gcctgcgaggaccgactccg

SEQ ID NO: 155133 - DNA, 20 bp, human
gtggccacagccttacaggc

SEQ ID NO: 155134 - DNA, 20 bp, human
gggcgccccacaatcagcaa

SEQ ID NO: 155135 - DNA, 20 bp, human
gccccacaatcagcaagggg

SEQ ID NO: 155136 - DNA, 20 bp, human
ggcggcgcggcagacgctag

SEQ ID NO: 155137 - DNA, 20 bp, human
gacgccggtgcgggaaagca

SEQ ID NO: 155138 - DNA, 20 bp, human
ggcaggtagaaaatccaaag

SEQ ID NO: 155139 - DNA, 20 bp, human
gtggctgcagacagacttcg

SEQ ID NO: 155140 - DNA, 20 bp, human
ggacgctagaggccggatag

SEQ ID NO: 155141 - DNA, 20 bp, human
ggcagctggcagggattgcg

SEQ ID NO: 155142 - DNA, 20 bp, human
gaggtggggaacgaacccta

SEQ ID NO: 155143 - DNA, 20 bp, human
gcggcctacatcgaggaggt

SEQ ID NO: 155144 - DNA, 20 bp, human
gcacgagtccaagctgcagc

SEQ ID NO: 155145 - DNA, 20 bp, human
gccgccggcctacatcgagg

SEQ ID NO: 155146 - DNA, 20 bp, human
gagccgagcggagaggaatc

SEQ ID NO: 155147 - DNA, 20 bp, human
ggtgcggcacccaccgacag

SEQ ID NO: 155148 - DNA, 20 bp, human
gacggtgagccccgagacca

SEQ ID NO: 155149 - DNA, 20 bp, human
ggcgccgctgtcccaggcga

SEQ ID NO: 155150 - DNA, 20 bp, human
ggggccgaatccgagccgag

SEQ ID NO: 155151 - DNA, 20 bp, human
gcgagggctgcagggtccgc

SEQ ID NO: 155152 - DNA, 20 bp, human
gtgggctagcgcgggaagaa

SEQ ID NO: 155153 - DNA, 20 bp, human
gcggcacccaccgacagcgg

SEQ ID NO: 155154 - DNA, 20 bp, human
gcggctaaggaagggcctgt

SEQ ID NO: 155155 - DNA, 20 bp, human
gattataaggcggagctcgg

SEQ ID NO: 155156 - DNA, 20 bp, human
gctggcttgaaagggagcta

SEQ ID NO: 155157 - DNA, 20 bp, human
gttgccctggttgcaagcag

SEQ ID NO: 155158 - DNA, 20 bp, human
gccggtccctggggaatatg

SEQ ID NO: 155159 - DNA, 20 bp, human
gtgggagcagccggtccctg

SEQ ID NO: 155160 - DNA, 20 bp, human
gacgcaggccaccaagccca

SEQ ID NO: 155161 - DNA, 20 bp, human
ggcgcgccgcatattcccca

SEQ ID NO: 155162 - DNA, 20 bp, human
ggcctgagccgcaatcgctg

SEQ ID NO: 155163 - DNA, 20 bp, human
ggagctacggcagaagttta

SEQ ID NO: 155164 - DNA, 20 bp, human
ggcagaaaccaacaagtgag

SEQ ID NO: 155165 - DNA, 20 bp, human
gggcacgggaaaggagtccg

SEQ ID NO: 155166 - DNA, 20 bp, human
gcgccgcgcctcgggaacaa

SEQ ID NO: 155167 - DNA, 20 bp, human
gccgcccgcgaccccccctc

SEQ ID NO: 155168 - DNA, 20 bp, human
gtccccgccacggctccccg

SEQ ID NO: 155169 - DNA, 20 bp, human
gggcggccccggcttcatgg

SEQ ID NO: 155170 - DNA, 20 bp, human
gtgcagaaaggggcgctcgg

SEQ ID NO: 155171 - DNA, 20 bp, human
gcgcgcccggatccccgcca

SEQ ID NO: 155172 - DNA, 20 bp, human
gcgctcgggggagggtcgag

SEQ ID NO: 155173 - DNA, 20 bp, human
gcgacgcgctctaggctcgc

SEQ ID NO: 155174 - DNA, 20 bp, human
ggagggagcggggtcccgga

SEQ ID NO: 155175 - DNA, 20 bp, human
gcccccggctgcttcccccg

SEQ ID NO: 155176 - DNA, 20 bp, human
gtacccccaaccggacaccg

SEQ ID NO: 155177 - DNA, 20 bp, human
ggcgccccgagagcgaggag

SEQ ID NO: 155178 - DNA, 20 bp, human
gagcagcgcgaacagacggg

SEQ ID NO: 155179 - DNA, 20 bp, human
gagcagcagcgcgaacagac

SEQ ID NO: 155180 - DNA, 20 bp, human
gggagttgaagagttgacac

SEQ ID NO: 155181 - DNA, 20 bp, human
ggtcaccagggaagggacga

SEQ ID NO: 155182 - DNA, 20 bp, human
gtggcaccgcggactggaga

SEQ ID NO: 155183 - DNA, 20 bp, human
gggagaaggcgcgcaggctg

SEQ ID NO: 155184 - DNA, 20 bp, human
ggcgcgtgaagccatcccgg

SEQ ID NO: 155185 - DNA, 20 bp, human
ggggccatggcaccgcggac

SEQ ID NO: 155186 - DNA, 20 bp, human
ggcggcgagcggttccttgt

SEQ ID NO: 155187 - DNA, 20 bp, human
gtgccagtgaccggaggcgg

SEQ ID NO: 155188 - DNA, 20 bp, human
gcgagcactgggaggaaccg

SEQ ID NO: 155189 - DNA, 20 bp, human
gggcgacgccctctcctcag

SEQ ID NO: 155190 - DNA, 20 bp, human
gtccttgtgggctaggtgag

SEQ ID NO: 155191 - DNA, 20 bp, human
gtgggaggaaccgtggccag

SEQ ID NO: 155192 - DNA, 20 bp, human
gcagctctggggttcttcct

SEQ ID NO: 155193 - DNA, 20 bp, human
gcgcggagccccctgaggag

SEQ ID NO: 155194 - DNA, 20 bp, human
ggagcggttccttgtgggct

SEQ ID NO: 155195 - DNA, 20 bp, human
gtcttatcgaggagaaaaca

SEQ ID NO: 155196 - DNA, 20 bp, human
gagggaaacagattcagcag

SEQ ID NO: 155197 - DNA, 20 bp, human
gagcctcaggccagagaagt

SEQ ID NO: 155198 - DNA, 20 bp, human
gcaattccagccgaaaccag

SEQ ID NO: 155199 - DNA, 20 bp, human
gcagggctacgtttcaggga

SEQ ID NO: 155200 - DNA, 20 bp, human
gcagctcaggccgacttctc

SEQ ID NO: 155201 - DNA, 20 bp, human
ggggggccctgacccaatcc

SEQ ID NO: 155202 - DNA, 20 bp, human
gggagcagcaccttgcctgc

SEQ ID NO: 155203 - DNA, 20 bp, human
gtctccttgagcacagtcat

SEQ ID NO: 155204 - DNA, 20 bp, human
gagcagtcaagtgtgaagtg

SEQ ID NO: 155205 - DNA, 20 bp, human
gtggattccttgggagaaat

SEQ ID NO: 155206 - DNA, 20 bp, human
ggtgctcggagcggaagcag

SEQ ID NO: 155207 - DNA, 20 bp, human
gctgggcacatagcacataa

SEQ ID NO: 155208 - DNA, 20 bp, human
ggcgctttcggtgctcggag

SEQ ID NO: 155209 - DNA, 20 bp, human
gggccgaatgccgaagaagg

SEQ ID NO: 155210 - DNA, 20 bp, human
gtagctgggggagacaagac

SEQ ID NO: 155211 - DNA, 20 bp, human
gacctggactcccccttctt

SEQ ID NO: 155212 - DNA, 20 bp, human
gtcccacggaagccagcacc

SEQ ID NO: 155213 - DNA, 20 bp, human
gcgagtccagcggtccaggt

SEQ ID NO: 155214 - DNA, 20 bp, human
gtgtgagcgcccccatggca

SEQ ID NO: 155215 - DNA, 20 bp, human
ggcccggtgctggcttccgt

SEQ ID NO: 155216 - DNA, 20 bp, human
gctaggccctgggcacctcg

SEQ ID NO: 155217 - DNA, 20 bp, human
gaggcctgttgttctcggaa

SEQ ID NO: 155218 - DNA, 20 bp, human
gaggtaactacgggaatctg

SEQ ID NO: 155219 - DNA, 20 bp, human
gtcctgccgcggctgtcaca

SEQ ID NO: 155220 - DNA, 20 bp, human
gcggcgacagcagaaactct

SEQ ID NO: 155221 - DNA, 20 bp, human
gacctcggggctagggacag

SEQ ID NO: 155222 - DNA, 20 bp, human
ggaagcaggcgggcgctccc

SEQ ID NO: 155223 - DNA, 20 bp, human
gtaccctggaggagattctg

SEQ ID NO: 155224 - DNA, 20 bp, human
ggagctctgtgcgggattct

SEQ ID NO: 155225 - DNA, 20 bp, human
gccagagctgggagttacgt

SEQ ID NO: 155226 - DNA, 20 bp, human
gggcgcctggtgtctcagag

SEQ ID NO: 155227 - DNA, 20 bp, human
gcgggtagtcggtgacatgg

SEQ ID NO: 155228 - DNA, 20 bp, human
ggttcgggtagtcggtgaca

SEQ ID NO: 155229 - DNA, 20 bp, human
ggtagtcggtgacatggcgg

SEQ ID NO: 155230 - DNA, 20 bp, human
gcgccttgcacccgaagcca

SEQ ID NO: 155231 - DNA, 20 bp, human
gagaggcgccgggcgagttg

SEQ ID NO: 155232 - DNA, 20 bp, human
gtgcggagtaggtctgtccg

SEQ ID NO: 155233 - DNA, 20 bp, human
gcggacggtgcaccgacccg

SEQ ID NO: 155234 - DNA, 20 bp, human
gcaggtggcagcgctgggtg

SEQ ID NO: 155235 - DNA, 20 bp, human
gggtgtctcagagaggcttg

SEQ ID NO: 155236 - DNA, 20 bp, human
ggacctgaggaaccttccca

SEQ ID NO: 155237 - DNA, 20 bp, human
gggggctccgcgatacagtt

SEQ ID NO: 155238 - DNA, 20 bp, human
gctccgcgatacagttagga

SEQ ID NO: 155239 - DNA, 20 bp, human
gtaaccgaagcggctcagga

SEQ ID NO: 155240 - DNA, 20 bp, human
gggagaactgaattgttcta

SEQ ID NO: 155241 - DNA, 20 bp, human
ggtgcgaaaggtaaccgaag

SEQ ID NO: 155242 - DNA, 20 bp, human
gccgcccactcccggtgaca

SEQ ID NO: 155243 - DNA, 20 bp, human
gagccatcctaactgtatcg

SEQ ID NO: 155244 - DNA, 20 bp, human
ggccgcaagtaacgacaccc

SEQ ID NO: 155245 - DNA, 20 bp, human
gtagctcaccaaatattagg

SEQ ID NO: 155246 - DNA, 20 bp, human
gactgcgggcccaaagactg

SEQ ID NO: 155247 - DNA, 20 bp, human
ggacggtcgtcggggaactg

SEQ ID NO: 155248 - DNA, 20 bp, human
gagggtgtcgaggatattga

SEQ ID NO: 155249 - DNA, 20 bp, human
gagccccaacagcaccggcc

SEQ ID NO: 155250 - DNA, 20 bp, human
gggaccagaacatgtcccag

SEQ ID NO: 155251 - DNA, 20 bp, human
ggtgcgtggggccagcgact

SEQ ID NO: 155252 - DNA, 20 bp, human
gagggtggggacggtcgtcg

SEQ ID NO: 155253 - DNA, 20 bp, human
gggtgccgccaagaccggtg

SEQ ID NO: 155254 - DNA, 20 bp, human
ggggagagcgcggggaaccg

SEQ ID NO: 155255 - DNA, 20 bp, human
ggtgtcgaggatattgaggg

SEQ ID NO: 155256 - DNA, 20 bp, human
gccgccaacgggcccggatc

SEQ ID NO: 155257 - DNA, 20 bp, human
ggcgctcgggatccgaggac

SEQ ID NO: 155258 - DNA, 20 bp, human
gcccccgcccgcaagaaaga

SEQ ID NO: 155259 - DNA, 20 bp, human
gtggcctgatccgggcccgt

SEQ ID NO: 155260 - DNA, 20 bp, human
gtggcggcggagtctcgcca

SEQ ID NO: 155261 - DNA, 20 bp, human
gggtccacgcggttcagaag

SEQ ID NO: 155262 - DNA, 20 bp, human
ggagtccaaccagacccctt

SEQ ID NO: 155263 - DNA, 20 bp, human
gcgggcgcgacctcacggag

SEQ ID NO: 155264 - DNA, 20 bp, human
ggaatgccaccgggaaacgg

SEQ ID NO: 155265 - DNA, 20 bp, human
gcgtcagtgacgccgccaac

SEQ ID NO: 155266 - DNA, 20 bp, human
gcggcaacagcagacatgtc

SEQ ID NO: 155267 - DNA, 20 bp, human
gtatccgcccgggtgacctt

SEQ ID NO: 155268 - DNA, 20 bp, human
gcaccggccgctatccgccc

SEQ ID NO: 155269 - DNA, 20 bp, human
gtctgtcccgggatcgggaa

SEQ ID NO: 155270 - DNA, 20 bp, human
gagcagacatgtcgggggtc

SEQ ID NO: 155271 - DNA, 20 bp, human
ggtccctgcgccctctgtcc

SEQ ID NO: 155272 - DNA, 20 bp, human
gcacccgggcggatagcggc

SEQ ID NO: 155273 - DNA, 20 bp, human
gtgtgaccttcacccggacg

SEQ ID NO: 155274 - DNA, 20 bp, human
gtagtagatagtccgcgtcc

SEQ ID NO: 155275 - DNA, 20 bp, human
ggaggggctacctcagcccg

SEQ ID NO: 155276 - DNA, 20 bp, human
gtggcggctccgcggttcgc

SEQ ID NO: 155277 - DNA, 20 bp, human
ggcgaacgacctgcgaaccg

SEQ ID NO: 155278 - DNA, 20 bp, human
gctgtgccggctcatgaccg

SEQ ID NO: 155279 - DNA, 20 bp, human
gggagacccgccccgacgga

SEQ ID NO: 155280 - DNA, 20 bp, human
gtgcagtcaggcgagcctcc

SEQ ID NO: 155281 - DNA, 20 bp, human
gtgacgacggcgacagtcca

SEQ ID NO: 155282 - DNA, 20 bp, human
gcccggcgcgcagcagatcg

SEQ ID NO: 155283 - DNA, 20 bp, human
gacagccagcaaaggccaaa

SEQ ID NO: 155284 - DNA, 20 bp, human
gcaccggagacccgccccga

SEQ ID NO: 155285 - DNA, 20 bp, human
gtgggttgccagcctgacga

SEQ ID NO: 155286 - DNA, 20 bp, human
gccgcccggccagccgacca

SEQ ID NO: 155287 - DNA, 20 bp, human
gcagtaggctcaccaaagaa

SEQ ID NO: 155288 - DNA, 20 bp, human
gttccagaccggcacacagt

SEQ ID NO: 155289 - DNA, 20 bp, human
gcctgcaactcaggaaataa

SEQ ID NO: 155290 - DNA, 20 bp, human
gccgggcggctaggagttcc

SEQ ID NO: 155291 - DNA, 20 bp, human
gcccaagatagagaccacag

SEQ ID NO: 155292 - DNA, 20 bp, human
gctcgacttcgtcgctggtg

SEQ ID NO: 155293 - DNA, 20 bp, human
ggcaggatcggcctctccct

SEQ ID NO: 155294 - DNA, 20 bp, human
ggtgttctcgacttcgtcgc

SEQ ID NO: 155295 - DNA, 20 bp, human
gccccacctgcaccggaaac

SEQ ID NO: 155296 - DNA, 20 bp, human
gctccgccaagggttgtggc

SEQ ID NO: 155297 - DNA, 20 bp, human
gggtggtcgccctctccttg

SEQ ID NO: 155298 - DNA, 20 bp, human
gcaaccggcgcctcaaggag

SEQ ID NO: 155299 - DNA, 20 bp, human
ggagcgacctcggggttaag

SEQ ID NO: 155300 - DNA, 20 bp, human
gtacagaggcgatagtttgg

SEQ ID NO: 155301 - DNA, 20 bp, human
gtgcaggcaggctccgccaa

SEQ ID NO: 155302 - DNA, 20 bp, human
ggagagactgaggaagcata

SEQ ID NO: 155303 - DNA, 20 bp, human
gggcttggaactccaatgtc

SEQ ID NO: 155304 - DNA, 20 bp, human
gatgttcgacgggacaccgg

SEQ ID NO: 155305 - DNA, 20 bp, human
gggttgccggccacaaccct

SEQ ID NO: 155306 - DNA, 20 bp, human
gttgctgaggtgacttcagt

SEQ ID NO: 155307 - DNA, 20 bp, human
gcggccccgccacccgaggg

SEQ ID NO: 155308 - DNA, 20 bp, human
ggccagttcagatctccgga

SEQ ID NO: 155309 - DNA, 20 bp, human
gcttcagtgggactgggagt

SEQ ID NO: 155310 - DNA, 20 bp, human
gaaatcgtaggacccatggg

SEQ ID NO: 155311 - DNA, 20 bp, human
gaggtgacttcagtgggact

SEQ ID NO: 155312 - DNA, 20 bp, human
gtcgaaatcgtaggacccat

SEQ ID NO: 155313 - DNA, 20 bp, human
gcctacggagcgcaccggag

SEQ ID NO: 155314 - DNA, 20 bp, human
ggggagcagctagtgtctga

SEQ ID NO: 155315 - DNA, 20 bp, human
gcagtgaccccgaagcccta

SEQ ID NO: 155316 - DNA, 20 bp, human
gcaccctgagtcgggaaaga

SEQ ID NO: 155317 - DNA, 20 bp, human
ggcgagtggggagcattcta

SEQ ID NO: 155318 - DNA, 20 bp, human
gctggacccctagactacag

SEQ ID NO: 155319 - DNA, 20 bp, human
gactcagggtgggagcgagt

SEQ ID NO: 155320 - DNA, 20 bp, human
gcgcctaagtggttccgggt

SEQ ID NO: 155321 - DNA, 20 bp, human
ggtgggaagacccctcacct

SEQ ID NO: 155322 - DNA, 20 bp, human
gcaccaacccggaaccactt

SEQ ID NO: 155323 - DNA, 20 bp, human
ggcggtgccctaggaggccg

SEQ ID NO: 155324 - DNA, 20 bp, human
gtcaaggtcatccaccaacc

SEQ ID NO: 155325 - DNA, 20 bp, human
ggcattctagggacagtgaa

SEQ ID NO: 155326 - DNA, 20 bp, human
gccgccgcgctagctccgag

SEQ ID NO: 155327 - DNA, 20 bp, human
ggggcggcgcccgagacctc

SEQ ID NO: 155328 - DNA, 20 bp, human
ggcggccgcccagcgctgag

SEQ ID NO: 155329 - DNA, 20 bp, human
gcggcgcccgagacctccgg

SEQ ID NO: 155330 - DNA, 20 bp, human
ggcgccgcccggggtcgcga

SEQ ID NO: 155331 - DNA, 20 bp, human
gcaggcgggacggctccgag

SEQ ID NO: 155332 - DNA, 20 bp, human
gctgggcggccgctcacctc

SEQ ID NO: 155333 - DNA, 20 bp, human
gggacccctcggagctagcg

SEQ ID NO: 155334 - DNA, 20 bp, human
gagcgggcgcggccactccg

SEQ ID NO: 155335 - DNA, 20 bp, human
gagcgccgcgccggacggac

SEQ ID NO: 155336 - DNA, 20 bp, human
gtaaggagggacccccacgt

SEQ ID NO: 155337 - DNA, 20 bp, human
ggcggccagagcccaaggta

SEQ ID NO: 155338 - DNA, 20 bp, human
gcgacttctcccaaacaggg

SEQ ID NO: 155339 - DNA, 20 bp, human
gcgacccggccggatcgcag

SEQ ID NO: 155340 - DNA, 20 bp, human
gctccgacttctcccaaaca

SEQ ID NO: 155341 - DNA, 20 bp, human
gggtgtaatatgcccgggag

SEQ ID NO: 155342 - DNA, 20 bp, human
gcgggtcgccggccgagctc

SEQ ID NO: 155343 - DNA, 20 bp, human
gtccgcgcggccagagccca

SEQ ID NO: 155344 - DNA, 20 bp, human
gccagagcccaaggtaagga

SEQ ID NO: 155345 - DNA, 20 bp, human
gcagggcggcctctgcgatc

SEQ ID NO: 155346 - DNA, 20 bp, human
ggggcaccagtctccaggac

SEQ ID NO: 155347 - DNA, 20 bp, human
ggactggcagaggttcagac

SEQ ID NO: 155348 - DNA, 20 bp, human
gaactggctacgctgatcag

SEQ ID NO: 155349 - DNA, 20 bp, human
gctgaacctagggaacacag

SEQ ID NO: 155350 - DNA, 20 bp, human
ggtttggagggctccgtgaa

SEQ ID NO: 155351 - DNA, 20 bp, human
ggagcagcgacagatcagtt

SEQ ID NO: 155352 - DNA, 20 bp, human
ggccatccgggacaactcac

SEQ ID NO: 155353 - DNA, 20 bp, human
ggctcagggcaccagtctcc

SEQ ID NO: 155354 - DNA, 20 bp, human
gagcgacagatcagtttgga

SEQ ID NO: 155355 - DNA, 20 bp, human
gctgccgcatgtcagaccca

SEQ ID NO: 155356 - DNA, 20 bp, human
gcagctagggagagtgtcct

SEQ ID NO: 155357 - DNA, 20 bp, human
gcgaagaagagggtccgggg

SEQ ID NO: 155358 - DNA, 20 bp, human
ggcttctccgcggacagcta

SEQ ID NO: 155359 - DNA, 20 bp, human
gaggcgccgcccaagtccaa

SEQ ID NO: 155360 - DNA, 20 bp, human
gctgactgagctccgagcca

SEQ ID NO: 155361 - DNA, 20 bp, human
gcgggtgcctggggcagacg

SEQ ID NO: 155362 - DNA, 20 bp, human
gtcccgcccttggacttggg

SEQ ID NO: 155363 - DNA, 20 bp, human
ggcatctgactgctccacat

SEQ ID NO: 155364 - DNA, 20 bp, human
gcacccaggaccgacgacct

SEQ ID NO: 155365 - DNA, 20 bp, human
gtgcctggggcagacgaggc

SEQ ID NO: 155366 - DNA, 20 bp, human
ggggcccggccggatcacgt

SEQ ID NO: 155367 - DNA, 20 bp, human
gcgtgggtaagtccatcctc

SEQ ID NO: 155368 - DNA, 20 bp, human
gccatcctctggaagcgggt

SEQ ID NO: 155369 - DNA, 20 bp, human
gggcagaaagggagagtgct

SEQ ID NO: 155370 - DNA, 20 bp, human
ggacagtgccctcccggaag

SEQ ID NO: 155371 - DNA, 20 bp, human
gtgcgtgtgcttgtgggtga

SEQ ID NO: 155372 - DNA, 20 bp, human
gggagaccaacgtcacttcg

SEQ ID NO: 155373 - DNA, 20 bp, human
gcccagctgctgaatgccag

SEQ ID NO: 155374 - DNA, 20 bp, human
gtagtcggagattgaggact

SEQ ID NO: 155375 - DNA, 20 bp, human
ggaaagggagagtgctgggc

SEQ ID NO: 155376 - DNA, 20 bp, human
gcgcggcagacggctacagc

SEQ ID NO: 155377 - DNA, 20 bp, human
gctccaggaggcaggtccga

SEQ ID NO: 155378 - DNA, 20 bp, human
ggaaccaagtgataaagagg

SEQ ID NO: 155379 - DNA, 20 bp, human
ggtggtgatgggtagctagg

SEQ ID NO: 155380 - DNA, 20 bp, human
gggtgaatgactgagcaggg

SEQ ID NO: 155381 - DNA, 20 bp, human
ggtccagggtccccgcggaa

SEQ ID NO: 155382 - DNA, 20 bp, human
ggaggcaggtccgacggctt

SEQ ID NO: 155383 - DNA, 20 bp, human
gcgacaggtggcggtcccgg

SEQ ID NO: 155384 - DNA, 20 bp, human
gcaagctccgaactttccac

SEQ ID NO: 155385 - DNA, 20 bp, human
ggctacccatcaccacagct

SEQ ID NO: 155386 - DNA, 20 bp, human
gtgtccggggctgagaaggt

SEQ ID NO: 155387 - DNA, 20 bp, human
gtcagccccggacattccat

SEQ ID NO: 155388 - DNA, 20 bp, human
gcctggagttagacagagtg

SEQ ID NO: 155389 - DNA, 20 bp, human
ggcttcctatggaatgtccg

SEQ ID NO: 155390 - DNA, 20 bp, human
gtcttccacgtggcttccta

SEQ ID NO: 155391 - DNA, 20 bp, human
gcattccataggaagccacg

SEQ ID NO: 155392 - DNA, 20 bp, human
ggtggactgtgtcttccacg

SEQ ID NO: 155393 - DNA, 20 bp, human
gacacagtccaccccttcga

SEQ ID NO: 155394 - DNA, 20 bp, human
gcctattataggagggactt

SEQ ID NO: 155395 - DNA, 20 bp, human
gatcatgcttcacctattat

SEQ ID NO: 155396 - DNA, 20 bp, human
gcagtctgcaggaaaccacc

SEQ ID NO: 155397 - DNA, 20 bp, human
gtcctgcagactgcctgcta

SEQ ID NO: 155398 - DNA, 20 bp, human
gatcaaggcggcggcccagt

SEQ ID NO: 155399 - DNA, 20 bp, human
gcaaagtgggcgaacaaggt

SEQ ID NO: 155400 - DNA, 20 bp, human
ggtggtctgcagccgatagg

SEQ ID NO: 155401 - DNA, 20 bp, human
gtcagcgggatacctcctat

SEQ ID NO: 155402 - DNA, 20 bp, human
gcggctgcagaccaccctac

SEQ ID NO: 155403 - DNA, 20 bp, human
gggagagttcttcttccagg

SEQ ID NO: 155404 - DNA, 20 bp, human
ggtctgtgagggccgccata

SEQ ID NO: 155405 - DNA, 20 bp, human
gttacagcgtggctcaccca

SEQ ID NO: 155406 - DNA, 20 bp, human
ggatagcccacgaagagagg

SEQ ID NO: 155407 - DNA, 20 bp, human
ggtcagagccaagccagcga

SEQ ID NO: 155408 - DNA, 20 bp, human
ggtagatagcccacgaagag

SEQ ID NO: 155409 - DNA, 20 bp, human
gagagccaagccagcgaggg

SEQ ID NO: 155410 - DNA, 20 bp, human
gccaggaccaagtagcccct

SEQ ID NO: 155411 - DNA, 20 bp, human
gcagttgatccctccctcgc

SEQ ID NO: 155412 - DNA, 20 bp, human
ggacactccagtcctgaggt

SEQ ID NO: 155413 - DNA, 20 bp, human
gcctcagccccctctcttcg

SEQ ID NO: 155414 - DNA, 20 bp, human
gaatggtcccaggggctact

SEQ ID NO: 155415 - DNA, 20 bp, human
gagtgtcccgggctagcctg

SEQ ID NO: 155416 - DNA, 20 bp, human
ggccagggctgggacacctc

SEQ ID NO: 155417 - DNA, 20 bp, human
ggaccctgaagggcgagagt

SEQ ID NO: 155418 - DNA, 20 bp, human
gcaagtgaggtggacagcac

SEQ ID NO: 155419 - DNA, 20 bp, human
gcacgctggtctgggatagt

SEQ ID NO: 155420 - DNA, 20 bp, human
gcagccaaggggccagcccg

SEQ ID NO: 155421 - DNA, 20 bp, human
gctgtggagtgccaccaagg

SEQ ID NO: 155422 - DNA, 20 bp, human
gcagggaaccagctctttcc

SEQ ID NO: 155423 - DNA, 20 bp, human
gtgggttctgcctgccagag

SEQ ID NO: 155424 - DNA, 20 bp, human
gaaggctttggggacaagtg

SEQ ID NO: 155425 - DNA, 20 bp, human
gaccggctctgtccagcttc

SEQ ID NO: 155426 - DNA, 20 bp, human
gcgctctgatgcctgaggaa

SEQ ID NO: 155427 - DNA, 20 bp, human
gagaccgtgtactcatcctc

SEQ ID NO: 155428 - DNA, 20 bp, human
ggtatgagaaggggtctcag

SEQ ID NO: 155429 - DNA, 20 bp, human
ggcatcagagcggagacttc

SEQ ID NO: 155430 - DNA, 20 bp, human
ggtctccgctctgatgcctg

SEQ ID NO: 155431 - DNA, 20 bp, human
gcggctgagtgcaagcccca

SEQ ID NO: 155432 - DNA, 20 bp, human
gagctgctgcacagactata

SEQ ID NO: 155433 - DNA, 20 bp, human
gtgagctagaagccctgcca

SEQ ID NO: 155434 - DNA, 20 bp, human
gagagcagagctcgtcacac

SEQ ID NO: 155435 - DNA, 20 bp, human
gggccatctgggtcaatgta

SEQ ID NO: 155436 - DNA, 20 bp, human
ggtctagagacagcatggcg

SEQ ID NO: 155437 - DNA, 20 bp, human
ggaaagggcgcgatgaccag

SEQ ID NO: 155438 - DNA, 20 bp, human
gcagtcggagcgactccagg

SEQ ID NO: 155439 - DNA, 20 bp, human
gaggacaccggcaggggaaa

SEQ ID NO: 155440 - DNA, 20 bp, human
gtcctgagcgccccagaaac

SEQ ID NO: 155441 - DNA, 20 bp, human
ggaactactggagctcgggt

SEQ ID NO: 155442 - DNA, 20 bp, human
ggggcgcgatgaccagcggg

SEQ ID NO: 155443 - DNA, 20 bp, human
ggaccagcgggcggaactac

SEQ ID NO: 155444 - DNA, 20 bp, human
gctgattcagggcctaccgg

SEQ ID NO: 155445 - DNA, 20 bp, human
gggtggtttcgggagagacg

SEQ ID NO: 155446 - DNA, 20 bp, human
ggtccccggagaccctgcta

SEQ ID NO: 155447 - DNA, 20 bp, human
gcaccatagcagggtctccg

SEQ ID NO: 155448 - DNA, 20 bp, human
ggcccgcacgcaccatagca

SEQ ID NO: 155449 - DNA, 20 bp, human
gagggtctccggggacctag

SEQ ID NO: 155450 - DNA, 20 bp, human
gtgggtggcacagacggctg

SEQ ID NO: 155451 - DNA, 20 bp, human
ggcggggagatgagccccca

SEQ ID NO: 155452 - DNA, 20 bp, human
gctgtgccacccagagccgg

SEQ ID NO: 155453 - DNA, 20 bp, human
gtgccatggaatgtcaaatg

SEQ ID NO: 155454 - DNA, 20 bp, human
gcacgtaggcgtagaaccca

SEQ ID NO: 155455 - DNA, 20 bp, human
gcggcgggccgctaggtccc

SEQ ID NO: 155456 - DNA, 20 bp, human
gagctgccacgtccgagacc

SEQ ID NO: 155457 - DNA, 20 bp, human
gctgctccaggtctcggacg

SEQ ID NO: 155458 - DNA, 20 bp, human
ggcagccaccgccgcaatca

SEQ ID NO: 155459 - DNA, 20 bp, human
gacactcaccatgattgcgg

SEQ ID NO: 155460 - DNA, 20 bp, human
gcggtggctgctccaggtct

SEQ ID NO: 155461 - DNA, 20 bp, human
ggtactgaggaggcctagca

SEQ ID NO: 155462 - DNA, 20 bp, human
gcctagcagggtgaaggcca

SEQ ID NO: 155463 - DNA, 20 bp, human
gcattccgaggggagtccag

SEQ ID NO: 155464 - DNA, 20 bp, human
gcggacgtggcagctcccgg

SEQ ID NO: 155465 - DNA, 20 bp, human
ggtgagtgttggtactgagg

SEQ ID NO: 155466 - DNA, 20 bp, human
gcccgaccgacgggagagag

SEQ ID NO: 155467 - DNA, 20 bp, human
gagctacggtcgcggagcag

SEQ ID NO: 155468 - DNA, 20 bp, human
gggcggtcgagctacggtcg

SEQ ID NO: 155469 - DNA, 20 bp, human
gtcataccggcggctccgcg

SEQ ID NO: 155470 - DNA, 20 bp, human
gtggaaccgagactgccccg

SEQ ID NO: 155471 - DNA, 20 bp, human
gggaaccggcggtcgagcta

SEQ ID NO: 155472 - DNA, 20 bp, human
gcatcccgagcaggctcgag

SEQ ID NO: 155473 - DNA, 20 bp, human
gcgagaggcgccggactcca

SEQ ID NO: 155474 - DNA, 20 bp, human
gggccaaagccccgaccgac

SEQ ID NO: 155475 - DNA, 20 bp, human
gctccgctctcagcaaaaag

SEQ ID NO: 155476 - DNA, 20 bp, human
gcgcaggctagggccgatgg

SEQ ID NO: 155477 - DNA, 20 bp, human
ggaccaccaggaggcgagag

SEQ ID NO: 155478 - DNA, 20 bp, human
gcatcctgcggactgcgagt

SEQ ID NO: 155479 - DNA, 20 bp, human
ggctgccctgagtcatcctg

SEQ ID NO: 155480 - DNA, 20 bp, human
ggaatgctctcatcaacgag

SEQ ID NO: 155481 - DNA, 20 bp, human
gacctgggctaacccagcca

SEQ ID NO: 155482 - DNA, 20 bp, human
gctgcgagtcggcgaccacc

SEQ ID NO: 155483 - DNA, 20 bp, human
gattggaatgaggagctgta

SEQ ID NO: 155484 - DNA, 20 bp, human
gacccgctctcgcctcctgg

SEQ ID NO: 155485 - DNA, 20 bp, human
gggaatgaggagctgtaggg

SEQ ID NO: 155486 - DNA, 20 bp, human
ggaggccgctgagggcacaa

SEQ ID NO: 155487 - DNA, 20 bp, human
gcgggcggcggagggaacag

SEQ ID NO: 155488 - DNA, 20 bp, human
gtccccaggtggcaccgcca

SEQ ID NO: 155489 - DNA, 20 bp, human
gaagctctgagcagccgtgg

SEQ ID NO: 155490 - DNA, 20 bp, human
gcctcgagggtggcaaaggg

SEQ ID NO: 155491 - DNA, 20 bp, human
ggccgtggcggtgccacctg

SEQ ID NO: 155492 - DNA, 20 bp, human
ggctgggactttactccggg

SEQ ID NO: 155493 - DNA, 20 bp, human
gcctcctgcggcagcgagaa

SEQ ID NO: 155494 - DNA, 20 bp, human
ggttgcttgtgagtccccgg

SEQ ID NO: 155495 - DNA, 20 bp, human
gaaggctgggactttactcc

SEQ ID NO: 155496 - DNA, 20 bp, human
gcctcccaggcaccataggt

SEQ ID NO: 155497 - DNA, 20 bp, human
gctggctggggcttgaggag

SEQ ID NO: 155498 - DNA, 20 bp, human
gcaaagaggaaggggttaaa

SEQ ID NO: 155499 - DNA, 20 bp, human
gtggagttccggaagaccag

SEQ ID NO: 155500 - DNA, 20 bp, human
gccaggagccagaaccagag

SEQ ID NO: 155501 - DNA, 20 bp, human
gcccaaagggtcaagcccca

SEQ ID NO: 155502 - DNA, 20 bp, human
gagtcaggcttgacttgggt

SEQ ID NO: 155503 - DNA, 20 bp, human
gactcggccgctcatggtgc

SEQ ID NO: 155504 - DNA, 20 bp, human
gggtcttccggaactccagg

SEQ ID NO: 155505 - DNA, 20 bp, human
gtgcctgggagggaggaacg

SEQ ID NO: 155506 - DNA, 20 bp, human
gcggatacaaggccaggcgg

SEQ ID NO: 155507 - DNA, 20 bp, human
gtggcccaggaggcacaacc

SEQ ID NO: 155508 - DNA, 20 bp, human
gcagcggatacaaggccagg

SEQ ID NO: 155509 - DNA, 20 bp, human
gccaggcggcagcggataca

SEQ ID NO: 155510 - DNA, 20 bp, human
gcgcgggcgcagaaaggctc

SEQ ID NO: 155511 - DNA, 20 bp, human
gaggcacaaccaggcggcag

SEQ ID NO: 155512 - DNA, 20 bp, human
ggaccaacatctggcccagg

SEQ ID NO: 155513 - DNA, 20 bp, human
gaaccgcacgctggaccaga

SEQ ID NO: 155514 - DNA, 20 bp, human
gaacccggctggagccccca

SEQ ID NO: 155515 - DNA, 20 bp, human
ggaacagaggcgctctctcc

SEQ ID NO: 155516 - DNA, 20 bp, human
gcagctgtggaaggccggag

SEQ ID NO: 155517 - DNA, 20 bp, human
gtcccgccttgaacaccctg

SEQ ID NO: 155518 - DNA, 20 bp, human
gtcctggagctctctcggcc

SEQ ID NO: 155519 - DNA, 20 bp, human
gggccgcagggtgttcaagg

SEQ ID NO: 155520 - DNA, 20 bp, human
gcttccagggcacttcccct

SEQ ID NO: 155521 - DNA, 20 bp, human
ggcacgtctgtgcacaccag

SEQ ID NO: 155522 - DNA, 20 bp, human
gcattcccaaaggctcccga

SEQ ID NO: 155523 - DNA, 20 bp, human
gcgagccaggcgggcttcca

SEQ ID NO: 155524 - DNA, 20 bp, human
gggtttcgctcccgcccctc

SEQ ID NO: 155525 - DNA, 20 bp, human
ggtctgggaggaaaatggga

SEQ ID NO: 155526 - DNA, 20 bp, human
ggcagcatgagtggacaagt

SEQ ID NO: 155527 - DNA, 20 bp, human
gcaaaaggcaggccacctgg

SEQ ID NO: 155528 - DNA, 20 bp, human
gctctgtggctccctccagg

SEQ ID NO: 155529 - DNA, 20 bp, human
gtgaggggcttggtagccag

SEQ ID NO: 155530 - DNA, 20 bp, human
gcagcgacttctcctgcgat

SEQ ID NO: 155531 - DNA, 20 bp, human
gtaccaagcccctcagggtt

SEQ ID NO: 155532 - DNA, 20 bp, human
gggtgacctgagcccatcgc

SEQ ID NO: 155533 - DNA, 20 bp, human
gtgtgggcatggctaccagc

SEQ ID NO: 155534 - DNA, 20 bp, human
gactcatgctgcccatgaat

SEQ ID NO: 155535 - DNA, 20 bp, human
gcggggaagggcaggactca

SEQ ID NO: 155536 - DNA, 20 bp, human
gtcagccgccgcagccatct

SEQ ID NO: 155537 - DNA, 20 bp, human
gcgagccggatgtgccaaga

SEQ ID NO: 155538 - DNA, 20 bp, human
ggcgaaagcccacccgacgc

SEQ ID NO: 155539 - DNA, 20 bp, human
ggaaagagccagcgtaaaca

SEQ ID NO: 155540 - DNA, 20 bp, human
gctcgtcgccagcgtcgggt

SEQ ID NO: 155541 - DNA, 20 bp, human
ggcggggccaagcggtgagg

SEQ ID NO: 155542 - DNA, 20 bp, human
ggcggtgacgccggttcccg

SEQ ID NO: 155543 - DNA, 20 bp, human
ggggcgggaacgacaggatg

SEQ ID NO: 155544 - DNA, 20 bp, human
gcaggctcacgcaccgagaa

SEQ ID NO: 155545 - DNA, 20 bp, human
gcggctgagaccgatccctc

SEQ ID NO: 155546 - DNA, 20 bp, human
gaacagcaggctgtcatgat

SEQ ID NO: 155547 - DNA, 20 bp, human
ggcagcaactcctgatttag

SEQ ID NO: 155548 - DNA, 20 bp, human
gcatcgattgcccctaaatc

SEQ ID NO: 155549 - DNA, 20 bp, human
gtgttccctgggggatggaa

SEQ ID NO: 155550 - DNA, 20 bp, human
gagagtatgaaggaactcca

SEQ ID NO: 155551 - DNA, 20 bp, human
gctttaggcaggtttgatta

SEQ ID NO: 155552 - DNA, 20 bp, human
gcaacttactaaaaaacttt

SEQ ID NO: 155553 - DNA, 20 bp, human
gaaggcattaagccagcaca

SEQ ID NO: 155554 - DNA, 20 bp, human
gaaggaactccaaggagtta

SEQ ID NO: 155555 - DNA, 20 bp, human
gttccttcatactctggcaa

SEQ ID NO: 155556 - DNA, 20 bp, human
gcggggcgcgtcactcggag

SEQ ID NO: 155557 - DNA, 20 bp, human
gcgtctcgacaggtactccc

SEQ ID NO: 155558 - DNA, 20 bp, human
gggcccatgagagcttgagg

SEQ ID NO: 155559 - DNA, 20 bp, human
gtctcatgggccacctacac

SEQ ID NO: 155560 - DNA, 20 bp, human
gcggcgggtcccgtctcgac

SEQ ID NO: 155561 - DNA, 20 bp, human
gggccccacaatgcacttcg

SEQ ID NO: 155562 - DNA, 20 bp, human
gttcgaacgacccctaagaa

SEQ ID NO: 155563 - DNA, 20 bp, human
gcacttggctgtcagcatgg

SEQ ID NO: 155564 - DNA, 20 bp, human
ggattgaagacctaccccac

SEQ ID NO: 155565 - DNA, 20 bp, human
gtggctgtcagcatggtggt

SEQ ID NO: 155566 - DNA, 20 bp, human
gagtgcccgggaagtcacaa

SEQ ID NO: 155567 - DNA, 20 bp, human
gctaacaatgatcgcccgag

SEQ ID NO: 155568 - DNA, 20 bp, human
gctccggtaactgagacata

SEQ ID NO: 155569 - DNA, 20 bp, human
gaactacagggatccaacac

SEQ ID NO: 155570 - DNA, 20 bp, human
ggcgcgctgacagagacttg

SEQ ID NO: 155571 - DNA, 20 bp, human
gtcgatgcaggaggacgaac

SEQ ID NO: 155572 - DNA, 20 bp, human
gcggccacctcagcgggaag

SEQ ID NO: 155573 - DNA, 20 bp, human
gttggtgtaggagagactac

SEQ ID NO: 155574 - DNA, 20 bp, human
gggtataactgttgtcgcgg

SEQ ID NO: 155575 - DNA, 20 bp, human
ggatccaacactggcccgga

SEQ ID NO: 155576 - DNA, 20 bp, human
gtgggccgagccctcccggt

SEQ ID NO: 155577 - DNA, 20 bp, human
gcaatcttagccgaccggga

SEQ ID NO: 155578 - DNA, 20 bp, human
gcggtcggctaagattgctg

SEQ ID NO: 155579 - DNA, 20 bp, human
gctcccagttggaagagatg

SEQ ID NO: 155580 - DNA, 20 bp, human
gtcggctaagattgctgagg

SEQ ID NO: 155581 - DNA, 20 bp, human
ggctgacagatgggcgccaa

SEQ ID NO: 155582 - DNA, 20 bp, human
gagattgctgaggaggcggc

SEQ ID NO: 155583 - DNA, 20 bp, human
ggactcgcgcacgcgcacca

SEQ ID NO: 155584 - DNA, 20 bp, human
ggacctgggccgagccctcc

SEQ ID NO: 155585 - DNA, 20 bp, human
gcccaggtcaccggcagccc

SEQ ID NO: 155586 - DNA, 20 bp, human
gtccgtggcaccgcaatcag

SEQ ID NO: 155587 - DNA, 20 bp, human
ggtggcaccgcaatcagggg

SEQ ID NO: 155588 - DNA, 20 bp, human
gctgctcctgctgggcggag

SEQ ID NO: 155589 - DNA, 20 bp, human
gcagagcgaagtgggtgaga

SEQ ID NO: 155590 - DNA, 20 bp, human
gtggccccggggcaccgaga

SEQ ID NO: 155591 - DNA, 20 bp, human
ggtggcgccacccctgattg

SEQ ID NO: 155592 - DNA, 20 bp, human
gacggactgctcctgctggg

SEQ ID NO: 155593 - DNA, 20 bp, human
gcggccccggcagagcgaag

SEQ ID NO: 155594 - DNA, 20 bp, human
gcccaggagcggagacgagg

SEQ ID NO: 155595 - DNA, 20 bp, human
gggaaagatgtggaaaacgg

SEQ ID NO: 155596 - DNA, 20 bp, human
gtgcgggacgacatccgcag

SEQ ID NO: 155597 - DNA, 20 bp, human
gtgtcgtcccgcaccaggcc

SEQ ID NO: 155598 - DNA, 20 bp, human
gcggtagctaaggcgatcag

SEQ ID NO: 155599 - DNA, 20 bp, human
ggcctgcttgttgcagctgt

SEQ ID NO: 155600 - DNA, 20 bp, human
gaacagggagctgcactggt

SEQ ID NO: 155601 - DNA, 20 bp, human
ggacttcccactgagacgag

SEQ ID NO: 155602 - DNA, 20 bp, human
gggtgaggacggctctagct

SEQ ID NO: 155603 - DNA, 20 bp, human
ggaggtgagcggcttctggg

SEQ ID NO: 155604 - DNA, 20 bp, human
ggcggaacagggagctgcac

SEQ ID NO: 155605 - DNA, 20 bp, human
gggaaactggagccagaaat

SEQ ID NO: 155606 - DNA, 20 bp, human
gcctgggtgactgggatgaa

SEQ ID NO: 155607 - DNA, 20 bp, human
gtggtgtggtaccgggtacc

SEQ ID NO: 155608 - DNA, 20 bp, human
gccgagagaaaacctaacgg

SEQ ID NO: 155609 - DNA, 20 bp, human
ggagacgtgtatcggacggt

SEQ ID NO: 155610 - DNA, 20 bp, human
gcccggagacgtgtatcgga

SEQ ID NO: 155611 - DNA, 20 bp, human
gggtacccggagacgtgtat

SEQ ID NO: 155612 - DNA, 20 bp, human
gcggtttccggtcagtggtg

SEQ ID NO: 155613 - DNA, 20 bp, human
gccggtaccacaccactgac

SEQ ID NO: 155614 - DNA, 20 bp, human
gccgggaggtaataagggga

SEQ ID NO: 155615 - DNA, 20 bp, human
gcttaccgggaggtaataag

SEQ ID NO: 155616 - DNA, 20 bp, human
gacatgatgactgggttgga

SEQ ID NO: 155617 - DNA, 20 bp, human
gccgcgaacgcccggctaga

SEQ ID NO: 155618 - DNA, 20 bp, human
gcgaacgcccggctagaagg

SEQ ID NO: 155619 - DNA, 20 bp, human
gatgtcgcctcaagcagcag

SEQ ID NO: 155620 - DNA, 20 bp, human
ggccaaacctagagagaagg

SEQ ID NO: 155621 - DNA, 20 bp, human
gaagcagcagtggcacgcaa

SEQ ID NO: 155622 - DNA, 20 bp, human
gcccggacagcactcaccgt

SEQ ID NO: 155623 - DNA, 20 bp, human
gtccgcgccagaacccggta

SEQ ID NO: 155624 - DNA, 20 bp, human
ggcgccagaacccggtaagg

SEQ ID NO: 155625 - DNA, 20 bp, human
gcggggtctccctacaccaa

SEQ ID NO: 155626 - DNA, 20 bp, human
ggcggccgggtgagaggacc

SEQ ID NO: 155627 - DNA, 20 bp, human
gaacggcctcgggcgagtag

SEQ ID NO: 155628 - DNA, 20 bp, human
gcggcggctccgcttcaggg

SEQ ID NO: 155629 - DNA, 20 bp, human
gcccgccgggtcctctcacc

SEQ ID NO: 155630 - DNA, 20 bp, human
gccggcgggggccgacatga

SEQ ID NO: 155631 - DNA, 20 bp, human
ggccaccagcgccgtcatgt

SEQ ID NO: 155632 - DNA, 20 bp, human
gggatcccgcccaagttcgg

SEQ ID NO: 155633 - DNA, 20 bp, human
gccgcaccagcagaacggtg

SEQ ID NO: 155634 - DNA, 20 bp, human
gggagcgcggggcctagcac

SEQ ID NO: 155635 - DNA, 20 bp, human
gtgcgaccccaggcccgaaa

SEQ ID NO: 155636 - DNA, 20 bp, human
ggaagcaggagccggaatct

SEQ ID NO: 155637 - DNA, 20 bp, human
gatctgggccgggagacgaa

SEQ ID NO: 155638 - DNA, 20 bp, human
ggcctgggagccttgacgtt

SEQ ID NO: 155639 - DNA, 20 bp, human
gctcacccggctccagatcc

SEQ ID NO: 155640 - DNA, 20 bp, human
gcgagggtgacaacccaagg

SEQ ID NO: 155641 - DNA, 20 bp, human
gggtgaggagtggcatcggg

SEQ ID NO: 155642 - DNA, 20 bp, human
gtcctaacgtcaaggctccc

SEQ ID NO: 155643 - DNA, 20 bp, human
ggacttcgttcctaacgtca

SEQ ID NO: 155644 - DNA, 20 bp, human
gattctgggtggatagtcga

SEQ ID NO: 155645 - DNA, 20 bp, human
ggccccctcggaaccggaag

SEQ ID NO: 155646 - DNA, 20 bp, human
gcgagcgtgagtccaggcta

SEQ ID NO: 155647 - DNA, 20 bp, human
ggccgagaaagggtttgacg

SEQ ID NO: 155648 - DNA, 20 bp, human
ggccactgaggatcctaaca

SEQ ID NO: 155649 - DNA, 20 bp, human
gcaactccgagcgtgagtcc

SEQ ID NO: 155650 - DNA, 20 bp, human
gcacgctcggagttgcagct

SEQ ID NO: 155651 - DNA, 20 bp, human
ggcgggagcccggccaccga

SEQ ID NO: 155652 - DNA, 20 bp, human
ggtccaggctaaggggacgc

SEQ ID NO: 155653 - DNA, 20 bp, human
gggggcgcgcagccgagaaa

SEQ ID NO: 155654 - DNA, 20 bp, human
gggccggcgtccccttagcc

SEQ ID NO: 155655 - DNA, 20 bp, human
gcatcccaaggcaaaaggtg

SEQ ID NO: 155656 - DNA, 20 bp, human
ggctgcactaacgcaggatc

SEQ ID NO: 155657 - DNA, 20 bp, human
ggaggggcggcggcgaatgc

SEQ ID NO: 155658 - DNA, 20 bp, human
gcagcccggctactactccc

SEQ ID NO: 155659 - DNA, 20 bp, human
gggtccccgagggtgaggag

SEQ ID NO: 155660 - DNA, 20 bp, human
gcgcacctggcgaggacctt

SEQ ID NO: 155661 - DNA, 20 bp, human
gacgttggaacggaacgtgg

SEQ ID NO: 155662 - DNA, 20 bp, human
gggcccgaaaccaagactag

SEQ ID NO: 155663 - DNA, 20 bp, human
gggtgcggtccccgagggtg

SEQ ID NO: 155664 - DNA, 20 bp, human
gaaagaggtgcggtccccga

SEQ ID NO: 155665 - DNA, 20 bp, human
gtgcggctgccacgttggaa

SEQ ID NO: 155666 - DNA, 20 bp, human
gcgcgttggaggcggaatag

SEQ ID NO: 155667 - DNA, 20 bp, human
gggctcctcagtagtaatag

SEQ ID NO: 155668 - DNA, 20 bp, human
gtgtaggtatgtgataccgg

SEQ ID NO: 155669 - DNA, 20 bp, human
ggctcctccctccgcgttgg

SEQ ID NO: 155670 - DNA, 20 bp, human
gcgccagattgtgccagaat

SEQ ID NO: 155671 - DNA, 20 bp, human
gaccgcacccggagacccat

SEQ ID NO: 155672 - DNA, 20 bp, human
gggcctcacaagaaggacga

SEQ ID NO: 155673 - DNA, 20 bp, human
gccgcctccaacgcggaggg

SEQ ID NO: 155674 - DNA, 20 bp, human
gattccgcctccaacgcgga

SEQ ID NO: 155675 - DNA, 20 bp, human
gggctgtaggtatgtgatac

SEQ ID NO: 155676 - DNA, 20 bp, human
ggacctgtccgtgcgcccag

SEQ ID NO: 155677 - DNA, 20 bp, human
gcttctggggtcctaggata

SEQ ID NO: 155678 - DNA, 20 bp, human
ggttcccggggccctatcct

SEQ ID NO: 155679 - DNA, 20 bp, human
gcccagcggcatcacgttcc

SEQ ID NO: 155680 - DNA, 20 bp, human
gcggcggcagcctccgggta

SEQ ID NO: 155681 - DNA, 20 bp, human
gcatgcgcaaaggcctgtca

SEQ ID NO: 155682 - DNA, 20 bp, human
gacgggcgagacctcagtgt

SEQ ID NO: 155683 - DNA, 20 bp, human
ggcatggggtgagacagaga

SEQ ID NO: 155684 - DNA, 20 bp, human
gcgacttgaagccttcggag

SEQ ID NO: 155685 - DNA, 20 bp, human
gcagaagggaaacgtgaaga

SEQ ID NO: 155686 - DNA, 20 bp, human
gtgcggaagaccccggacaa

SEQ ID NO: 155687 - DNA, 20 bp, human
gcgcgcgagagccctgccag

SEQ ID NO: 155688 - DNA, 20 bp, human
gcaacctgtgcggaagaccc

SEQ ID NO: 155689 - DNA, 20 bp, human
gcccggacaagggtcaggcg

SEQ ID NO: 155690 - DNA, 20 bp, human
ggctaccagggaccccagac

SEQ ID NO: 155691 - DNA, 20 bp, human
gagagccggatccaattcaa

SEQ ID NO: 155692 - DNA, 20 bp, human
gcttggcagtccagtcccta

SEQ ID NO: 155693 - DNA, 20 bp, human
gcggggcgaaccaacctgtg

SEQ ID NO: 155694 - DNA, 20 bp, human
ggtgctgaccgtcctcccta

SEQ ID NO: 155695 - DNA, 20 bp, human
gggcagtccagtccctaggg

SEQ ID NO: 155696 - DNA, 20 bp, human
gctagcactgacgtgtctct

SEQ ID NO: 155697 - DNA, 20 bp, human
ggtgctagcccggcggcaag

SEQ ID NO: 155698 - DNA, 20 bp, human
ggcactgacgtgtctctcgg

SEQ ID NO: 155699 - DNA, 20 bp, human
gcacgtcagtgctagcccgg

SEQ ID NO: 155700 - DNA, 20 bp, human
gctgtgcagtggaacgcgct

SEQ ID NO: 155701 - DNA, 20 bp, human
ggtgggcagaaggcgtccct

SEQ ID NO: 155702 - DNA, 20 bp, human
gccacgacgagtgagagcag

SEQ ID NO: 155703 - DNA, 20 bp, human
gcgggcagcgtcgcctcacg

SEQ ID NO: 155704 - DNA, 20 bp, human
gatggcaagtgagtcctgta

SEQ ID NO: 155705 - DNA, 20 bp, human
ggatactcgagaagggccgg

SEQ ID NO: 155706 - DNA, 20 bp, human
gggtggcgatgagattcatg

SEQ ID NO: 155707 - DNA, 20 bp, human
gcggtagaacgcctcccgaa

SEQ ID NO: 155708 - DNA, 20 bp, human
gcgatgagattcatgaggtt

SEQ ID NO: 155709 - DNA, 20 bp, human
gaaggtccgagcccttcggg

SEQ ID NO: 155710 - DNA, 20 bp, human
ggacaaggtccgagcccttc

SEQ ID NO: 155711 - DNA, 20 bp, human
gctgggttgggcctatcgac

SEQ ID NO: 155712 - DNA, 20 bp, human
gaacttctgcatctcggaaa

SEQ ID NO: 155713 - DNA, 20 bp, human
gaccatctttgtctttgcag

SEQ ID NO: 155714 - DNA, 20 bp, human
gcagaccatggaaactccct

SEQ ID NO: 155715 - DNA, 20 bp, human
gcattaacgaaacaaaatta

SEQ ID NO: 155716 - DNA, 20 bp, human
gagccgcgggagtcgagcga

SEQ ID NO: 155717 - DNA, 20 bp, human
ggcggctcgggcctcggtac

SEQ ID NO: 155718 - DNA, 20 bp, human
gagccatgggcagtgagtag

SEQ ID NO: 155719 - DNA, 20 bp, human
ggggccggtaggatcgcgtc

SEQ ID NO: 155720 - DNA, 20 bp, human
gtgccttcgctcgactcccg

SEQ ID NO: 155721 - DNA, 20 bp, human
gtgccaaggaaagatgacga

SEQ ID NO: 155722 - DNA, 20 bp, human
ggctcccgacgcgatcctac

SEQ ID NO: 155723 - DNA, 20 bp, human
gtgacgagggaataaaaaca

SEQ ID NO: 155724 - DNA, 20 bp, human
gcatgggcagtgagtagcgg

SEQ ID NO: 155725 - DNA, 20 bp, human
gactcccgcggctcgggcct

SEQ ID NO: 155726 - DNA, 20 bp, human
gtacggagcccccgaaagac

SEQ ID NO: 155727 - DNA, 20 bp, human
gaagggccgccataccatat

SEQ ID NO: 155728 - DNA, 20 bp, human
ggcggacggatagaaagtta

SEQ ID NO: 155729 - DNA, 20 bp, human
gccagctgccggtctttcgg

SEQ ID NO: 155730 - DNA, 20 bp, human
gggcggcgggatccactgtc

SEQ ID NO: 155731 - DNA, 20 bp, human
ggggtggcaaggcgctgacg

SEQ ID NO: 155732 - DNA, 20 bp, human
gccactgtccggcagaggta

SEQ ID NO: 155733 - DNA, 20 bp, human
gaccttgcctgcaagtccgg

SEQ ID NO: 155734 - DNA, 20 bp, human
gcagctggcgagactgactc

SEQ ID NO: 155735 - DNA, 20 bp, human
gcgcaaagcaggaggagtca

SEQ ID NO: 155736 - DNA, 20 bp, human
gggccgagttggtgggatgt

SEQ ID NO: 155737 - DNA, 20 bp, human
gtgccagggacacgtagcac

SEQ ID NO: 155738 - DNA, 20 bp, human
gaccgacacctaaaatgcca

SEQ ID NO: 155739 - DNA, 20 bp, human
gctggcggaaggcagaccca

SEQ ID NO: 155740 - DNA, 20 bp, human
gctccagtgctacgtgtccc

SEQ ID NO: 155741 - DNA, 20 bp, human
ggttcgcccgtaccgaccgg

SEQ ID NO: 155742 - DNA, 20 bp, human
gagccaaccccgaagggatc

SEQ ID NO: 155743 - DNA, 20 bp, human
gttttaggtgtcggttgggt

SEQ ID NO: 155744 - DNA, 20 bp, human
gcccgttcgcccgtaccgac

SEQ ID NO: 155745 - DNA, 20 bp, human
gtccctggcattttaggtgt

SEQ ID NO: 155746 - DNA, 20 bp, human
gggcggagcggccaacatgg

SEQ ID NO: 155747 - DNA, 20 bp, human
gggtagcaaagccgagctct

SEQ ID NO: 155748 - DNA, 20 bp, human
gagacacaagaagcggatcc

SEQ ID NO: 155749 - DNA, 20 bp, human
ggtcagcgtctgcgccccag

SEQ ID NO: 155750 - DNA, 20 bp, human
gggaaggtcagcctcccctg

SEQ ID NO: 155751 - DNA, 20 bp, human
gggccaacatggcggaacgc

SEQ ID NO: 155752 - DNA, 20 bp, human
gcagacgctgacccttcccg

SEQ ID NO: 155753 - DNA, 20 bp, human
gcagagggaaccgggcggag

SEQ ID NO: 155754 - DNA, 20 bp, human
gctccacgtcagagggaacc

SEQ ID NO: 155755 - DNA, 20 bp, human
ggcgcgctggatagtggaag

SEQ ID NO: 155756 - DNA, 20 bp, human
ggtgtccaagctacgccact

SEQ ID NO: 155757 - DNA, 20 bp, human
ggttcccactgtcatcgtac

SEQ ID NO: 155758 - DNA, 20 bp, human
gggcggcgtgtccgtgagag

SEQ ID NO: 155759 - DNA, 20 bp, human
gacccgggccccgccagtgg

SEQ ID NO: 155760 - DNA, 20 bp, human
gcgcggcgtccgggatgaca

SEQ ID NO: 155761 - DNA, 20 bp, human
gaaaggccggcgggactcac

SEQ ID NO: 155762 - DNA, 20 bp, human
gtcctgaggacaatgaaggg

SEQ ID NO: 155763 - DNA, 20 bp, human
gagtggcggacgctggacac

SEQ ID NO: 155764 - DNA, 20 bp, human
gtcgcgagagctggcgacgg

SEQ ID NO: 155765 - DNA, 20 bp, human
gcgggatgacagggacggtg

SEQ ID NO: 155766 - DNA, 20 bp, human
gagatcgcggccacccggta

SEQ ID NO: 155767 - DNA, 20 bp, human
gcgtcacggaggccagcagc

SEQ ID NO: 155768 - DNA, 20 bp, human
gtcgcggcatggcgtcggag

SEQ ID NO: 155769 - DNA, 20 bp, human
ggtgggtcggatgctggtga

SEQ ID NO: 155770 - DNA, 20 bp, human
gacgggagcgccctaccggg

SEQ ID NO: 155771 - DNA, 20 bp, human
gtgtctgtccggcaagccga

SEQ ID NO: 155772 - DNA, 20 bp, human
ggcgaggtaagggccgacgg

SEQ ID NO: 155773 - DNA, 20 bp, human
gcggatgctggtgacggcac

SEQ ID NO: 155774 - DNA, 20 bp, human
gcagacgcggcgctaactgt

SEQ ID NO: 155775 - DNA, 20 bp, human
gccggcgctccccgcagtcg

SEQ ID NO: 155776 - DNA, 20 bp, human
gcccccgctcgggtccagac

SEQ ID NO: 155777 - DNA, 20 bp, human
ggtcgcggccagccagatag

SEQ ID NO: 155778 - DNA, 20 bp, human
gcgtagccgaatcggtgtcg

SEQ ID NO: 155779 - DNA, 20 bp, human
gtccgcctgggaagtaatca

SEQ ID NO: 155780 - DNA, 20 bp, human
gccggacctccgcccctatc

SEQ ID NO: 155781 - DNA, 20 bp, human
ggctggccgcgacaccgatt

SEQ ID NO: 155782 - DNA, 20 bp, human
ggctacgccactggccgagg

SEQ ID NO: 155783 - DNA, 20 bp, human
ggagccgcctcctcggccag

SEQ ID NO: 155784 - DNA, 20 bp, human
ggccagtggcgtagccgaat

SEQ ID NO: 155785 - DNA, 20 bp, human
gagcaggggagaagcggcaa

SEQ ID NO: 155786 - DNA, 20 bp, human
ggcgcgtccaggagcggacc

SEQ ID NO: 155787 - DNA, 20 bp, human
gaggcggcgtctcggacccg

SEQ ID NO: 155788 - DNA, 20 bp, human
gcgacggcgcagggaacccc

SEQ ID NO: 155789 - DNA, 20 bp, human
ggccaggctcgactcttgaa

SEQ ID NO: 155790 - DNA, 20 bp, human
ggacccggtgaggcgcggag

SEQ ID NO: 155791 - DNA, 20 bp, human
gggccgaggaccgggaaggg

SEQ ID NO: 155792 - DNA, 20 bp, human
gctcctggacgcgctcctct

SEQ ID NO: 155793 - DNA, 20 bp, human
ggtgaggccgaggaccggga

SEQ ID NO: 155794 - DNA, 20 bp, human
gatcccagaggagcgcgtcc

SEQ ID NO: 155795 - DNA, 20 bp, human
gcggggggtgacggtcccag

SEQ ID NO: 155796 - DNA, 20 bp, human
ggctcccgggctgcgaggtc

SEQ ID NO: 155797 - DNA, 20 bp, human
gccgaagaggacagtggcgg

SEQ ID NO: 155798 - DNA, 20 bp, human
ggctgcgcaggcgcacggga

SEQ ID NO: 155799 - DNA, 20 bp, human
ggagggcccggcgtaccctg

SEQ ID NO: 155800 - DNA, 20 bp, human
gcgggcccgcgcctccgaag

SEQ ID NO: 155801 - DNA, 20 bp, human
gcgggctgcgaggtctggct

SEQ ID NO: 155802 - DNA, 20 bp, human
ggcgaggtctggctaggcta

SEQ ID NO: 155803 - DNA, 20 bp, human
ggcacaagccgtgcgctccc

SEQ ID NO: 155804 - DNA, 20 bp, human
ggcccggcgtaccctgcggg

SEQ ID NO: 155805 - DNA, 20 bp, human
ggcgcaggcgcacgggaggg

SEQ ID NO: 155806 - DNA, 20 bp, human
ggggggcggatactgacccg

SEQ ID NO: 155807 - DNA, 20 bp, human
gtactgacccgaggacgccg

SEQ ID NO: 155808 - DNA, 20 bp, human
ggtggtggctgagtccgtgg

SEQ ID NO: 155809 - DNA, 20 bp, human
gttacgtgggagagaggtgt

SEQ ID NO: 155810 - DNA, 20 bp, human
ggcgaaggcgacagctctag

SEQ ID NO: 155811 - DNA, 20 bp, human
gaggcgacagctctaggggt

SEQ ID NO: 155812 - DNA, 20 bp, human
gggtcgaggaagctccactc

SEQ ID NO: 155813 - DNA, 20 bp, human
ggcggtggtggctgagtccg

SEQ ID NO: 155814 - DNA, 20 bp, human
gggaggaaggagactagagc

SEQ ID NO: 155815 - DNA, 20 bp, human
gagcaggaagagcagcggcg

SEQ ID NO: 155816 - DNA, 20 bp, human
gcctgagaagaggagctctt

SEQ ID NO: 155817 - DNA, 20 bp, human
gtggcccaagagtaaggaaa

SEQ ID NO: 155818 - DNA, 20 bp, human
gcaggcagaaactaggtgat

SEQ ID NO: 155819 - DNA, 20 bp, human
gaagggtgtgtacttgggaa

SEQ ID NO: 155820 - DNA, 20 bp, human
gaccctcatagagaactcta

SEQ ID NO: 155821 - DNA, 20 bp, human
gttgggaagggtgtgtactt

SEQ ID NO: 155822 - DNA, 20 bp, human
gcttctcttcactgtaacac

SEQ ID NO: 155823 - DNA, 20 bp, human
gtctctattaacagagacaa

SEQ ID NO: 155824 - DNA, 20 bp, human
gtttgctcaaacagcgccaa

SEQ ID NO: 155825 - DNA, 20 bp, human
gtgtacttgggaagggtgtg

SEQ ID NO: 155826 - DNA, 20 bp, human
gcacctgggataggtacccc

SEQ ID NO: 155827 - DNA, 20 bp, human
gccgcagccatggtcccgag

SEQ ID NO: 155828 - DNA, 20 bp, human
gcaggtgccgggaacgcccg

SEQ ID NO: 155829 - DNA, 20 bp, human
gcgcccggggtacctatccc

SEQ ID NO: 155830 - DNA, 20 bp, human
ggtggagtcgaggacaagaa

SEQ ID NO: 155831 - DNA, 20 bp, human
ggtaccccgggcgtggagag

SEQ ID NO: 155832 - DNA, 20 bp, human
gcgagtggcggcgtccccca

SEQ ID NO: 155833 - DNA, 20 bp, human
gcgttcccggcacctgggat

SEQ ID NO: 155834 - DNA, 20 bp, human
gcgcccggggcgcagcgacg

SEQ ID NO: 155835 - DNA, 20 bp, human
gctcgagggtaacccgaccc

SEQ ID NO: 155836 - DNA, 20 bp, human
gctatactgacctgagacag

SEQ ID NO: 155837 - DNA, 20 bp, human
gaacacaggatctctcaggt

SEQ ID NO: 155838 - DNA, 20 bp, human
ggatgctgccttaaacatca

SEQ ID NO: 155839 - DNA, 20 bp, human
ggaacagctgaacactactt

SEQ ID NO: 155840 - DNA, 20 bp, human
gaattaaagaaggaaatcgt

SEQ ID NO: 155841 - DNA, 20 bp, human
gagtgcagaacgctttataa

SEQ ID NO: 155842 - DNA, 20 bp, human
ggtcctttgcccaaaatctt

SEQ ID NO: 155843 - DNA, 20 bp, human
gtcttttcacccaaaggttt

SEQ ID NO: 155844 - DNA, 20 bp, human
gataagagcttgtacagatg

SEQ ID NO: 155845 - DNA, 20 bp, human
gtatttcaagcctaaacctt

SEQ ID NO: 155846 - DNA, 20 bp, human
gccagtcggcagcatgggta

SEQ ID NO: 155847 - DNA, 20 bp, human
gcggcagcatgggtaaggag

SEQ ID NO: 155848 - DNA, 20 bp, human
ggggatcaaagtgtaccagt

SEQ ID NO: 155849 - DNA, 20 bp, human
gtggccctcacatagtagag

SEQ ID NO: 155850 - DNA, 20 bp, human
gggagggccttccaaattag

SEQ ID NO: 155851 - DNA, 20 bp, human
gcgctccttccccggaacag

SEQ ID NO: 155852 - DNA, 20 bp, human
ggtgtaccagtcggcagcat

SEQ ID NO: 155853 - DNA, 20 bp, human
ggtcagaggccgctgttccg

SEQ ID NO: 155854 - DNA, 20 bp, human
ggcagctgggaaaatcagat

SEQ ID NO: 155855 - DNA, 20 bp, human
gcctcgctggagtacaaagt

SEQ ID NO: 155856 - DNA, 20 bp, human
ggagatacagaaaccgacag

SEQ ID NO: 155857 - DNA, 20 bp, human
gggataccgacacccgagag

SEQ ID NO: 155858 - DNA, 20 bp, human
gtccccgcttcggagccacc

SEQ ID NO: 155859 - DNA, 20 bp, human
ggcggcctgtgacgctcgaa

SEQ ID NO: 155860 - DNA, 20 bp, human
gtgctgacgaggacgaaggt

SEQ ID NO: 155861 - DNA, 20 bp, human
ggcgcccggtggctccgaag

SEQ ID NO: 155862 - DNA, 20 bp, human
ggcctgtgacgctcgaaggg

SEQ ID NO: 155863 - DNA, 20 bp, human
gagcgctacgtgtacagcgt

SEQ ID NO: 155864 - DNA, 20 bp, human
gctgagtcttgagcccggtg

SEQ ID NO: 155865 - DNA, 20 bp, human
gtctctgagccggcagtcgg

SEQ ID NO: 155866 - DNA, 20 bp, human
ggcctcttgacttagcacaa

SEQ ID NO: 155867 - DNA, 20 bp, human
ggtctcaggtccttgcccaa

SEQ ID NO: 155868 - DNA, 20 bp, human
gcagcacagcacactccctt

SEQ ID NO: 155869 - DNA, 20 bp, human
gtaggctgaaaggctcacca

SEQ ID NO: 155870 - DNA, 20 bp, human
ggaaggaccaagcaaagcca

SEQ ID NO: 155871 - DNA, 20 bp, human
ggctaagtcaagaggctcaa

SEQ ID NO: 155872 - DNA, 20 bp, human
gacccttgtgctaagtcaag

SEQ ID NO: 155873 - DNA, 20 bp, human
gttggggttgtagaggcagg

SEQ ID NO: 155874 - DNA, 20 bp, human
gcctgagaagtgatatgctt

SEQ ID NO: 155875 - DNA, 20 bp, human
gtgctcagatagaaactctt

SEQ ID NO: 155876 - DNA, 20 bp, human
ggaggcaacaggaggctcat

SEQ ID NO: 155877 - DNA, 20 bp, human
gacgtggcgcagcgactcgg

SEQ ID NO: 155878 - DNA, 20 bp, human
gccagcttgcgcatcatctg

SEQ ID NO: 155879 - DNA, 20 bp, human
gcagacgtggcgcagcgact

SEQ ID NO: 155880 - DNA, 20 bp, human
gccgctgtcggaccgggtag

SEQ ID NO: 155881 - DNA, 20 bp, human
gcagtccggccggtaggcag

SEQ ID NO: 155882 - DNA, 20 bp, human
gataggccacgagaagagtt

SEQ ID NO: 155883 - DNA, 20 bp, human
gggacaggattgggagtcat

SEQ ID NO: 155884 - DNA, 20 bp, human
gatggccccagcatccaccg

SEQ ID NO: 155885 - DNA, 20 bp, human
gggcgtactcacctctaccc

SEQ ID NO: 155886 - DNA, 20 bp, human
gccgcggatggccgtataca

SEQ ID NO: 155887 - DNA, 20 bp, human
gacggggaacagcgaccgag

SEQ ID NO: 155888 - DNA, 20 bp, human
ggtatacagggcagcgctcg

SEQ ID NO: 155889 - DNA, 20 bp, human
ggcgaccgaggggcaagagt

SEQ ID NO: 155890 - DNA, 20 bp, human
gcgaggcgcgggctccatgg

SEQ ID NO: 155891 - DNA, 20 bp, human
gacggcgccgccatgtacct

SEQ ID NO: 155892 - DNA, 20 bp, human
gtggccgcagtagcagtgcg

SEQ ID NO: 155893 - DNA, 20 bp, human
gccgccgcgcactgctactg

SEQ ID NO: 155894 - DNA, 20 bp, human
gggcgaactggccgaattgg

SEQ ID NO: 155895 - DNA, 20 bp, human
ggcggctgccgcagcggggt

SEQ ID NO: 155896 - DNA, 20 bp, human
ggtgagactgtaagcagtct

SEQ ID NO: 155897 - DNA, 20 bp, human
ggctctctgagaatagatca

SEQ ID NO: 155898 - DNA, 20 bp, human
gtaaacagcctgacactgag

SEQ ID NO: 155899 - DNA, 20 bp, human
ggactgtaagcagtctgggt

SEQ ID NO: 155900 - DNA, 20 bp, human
gagtggtatggagtaaagtc

SEQ ID NO: 155901 - DNA, 20 bp, human
gagtaaagtcaggcaggtaa

SEQ ID NO: 155902 - DNA, 20 bp, human
gtggttgaagtgagttggag

SEQ ID NO: 155903 - DNA, 20 bp, human
gccctataaattctagtagg

SEQ ID NO: 155904 - DNA, 20 bp, human
gaagccatcgtggtttacag

SEQ ID NO: 155905 - DNA, 20 bp, human
gcagcctctgtaaaccacga

SEQ ID NO: 155906 - DNA, 20 bp, human
gctcgtgggcccagaagaag

SEQ ID NO: 155907 - DNA, 20 bp, human
gcatgggacagctgcctcgt

SEQ ID NO: 155908 - DNA, 20 bp, human
gacctggggagggcaaactg

SEQ ID NO: 155909 - DNA, 20 bp, human
ggggcctgccagcagctata

SEQ ID NO: 155910 - DNA, 20 bp, human
gagtggctggaggtccccat

SEQ ID NO: 155911 - DNA, 20 bp, human
ggctggcttgcaaaaccaca

SEQ ID NO: 155912 - DNA, 20 bp, human
ggagaccccatctctaggaa

SEQ ID NO: 155913 - DNA, 20 bp, human
gaggcaggcccttggcccat

SEQ ID NO: 155914 - DNA, 20 bp, human
gggggtgccacagcagtgcc

SEQ ID NO: 155915 - DNA, 20 bp, human
gctgcagctcaagaagggcc

SEQ ID NO: 155916 - DNA, 20 bp, human
ggccggcatggtggacttcc

SEQ ID NO: 155917 - DNA, 20 bp, human
ggtccttctcgtggtagcag

SEQ ID NO: 155918 - DNA, 20 bp, human
gtagcttggaagctccacga

SEQ ID NO: 155919 - DNA, 20 bp, human
ggagcttccaagctagtgcg

SEQ ID NO: 155920 - DNA, 20 bp, human
ggttcgcgccggcccaaaga

SEQ ID NO: 155921 - DNA, 20 bp, human
gcaagctagtgcggggagtc

SEQ ID NO: 155922 - DNA, 20 bp, human
gaagtccaccatgccggcca

SEQ ID NO: 155923 - DNA, 20 bp, human
ggcgcgaaccatggccggca

SEQ ID NO: 155924 - DNA, 20 bp, human
ggagtcgggcaataagcctc

SEQ ID NO: 155925 - DNA, 20 bp, human
gtcgcagaccagacctctcc

SEQ ID NO: 155926 - DNA, 20 bp, human
gacccagacatccgcattga

SEQ ID NO: 155927 - DNA, 20 bp, human
gcctccctcaaccaatatat

SEQ ID NO: 155928 - DNA, 20 bp, human
ggcggatgtctgggtaccgc

SEQ ID NO: 155929 - DNA, 20 bp, human
gttacctatatattggttga

SEQ ID NO: 155930 - DNA, 20 bp, human
gaagagggtcgtttcagaga

SEQ ID NO: 155931 - DNA, 20 bp, human
ggttattgtaattacttagt

SEQ ID NO: 155932 - DNA, 20 bp, human
gcagaaaaagccttctatat

SEQ ID NO: 155933 - DNA, 20 bp, human
ggaaggctttttctgtaaga

SEQ ID NO: 155934 - DNA, 20 bp, human
gttatttgacccaatataga

SEQ ID NO: 155935 - DNA, 20 bp, human
gcctaaatttttatagaaag

SEQ ID NO: 155936 - DNA, 20 bp, human
gaggaggcggaaccagacgg

SEQ ID NO: 155937 - DNA, 20 bp, human
ggccctgaaggtgaagtcca

SEQ ID NO: 155938 - DNA, 20 bp, human
gtccgggccagagcgggagt

SEQ ID NO: 155939 - DNA, 20 bp, human
gggtcctcctcgggcaacaa

SEQ ID NO: 155940 - DNA, 20 bp, human
gcaggtaggagtccaagacg

SEQ ID NO: 155941 - DNA, 20 bp, human
gagcaggagtcaggaccaga

SEQ ID NO: 155942 - DNA, 20 bp, human
gggaaccagacgggggatcc

SEQ ID NO: 155943 - DNA, 20 bp, human
gcgcgtgggaaggggccccg

SEQ ID NO: 155944 - DNA, 20 bp, human
gggcctcgctggagaccgac

SEQ ID NO: 155945 - DNA, 20 bp, human
gaccctggacttcaccttca

SEQ ID NO: 155946 - DNA, 20 bp, human
ggcagacaatcaagacctca

SEQ ID NO: 155947 - DNA, 20 bp, human
ggactgccaccggctatcag

SEQ ID NO: 155948 - DNA, 20 bp, human
gtgggaagaacaatgtgcca

SEQ ID NO: 155949 - DNA, 20 bp, human
gagccaggcaccggataatg

SEQ ID NO: 155950 - DNA, 20 bp, human
gaggtgttagtgttgccatg

SEQ ID NO: 155951 - DNA, 20 bp, human
gaagctcctctgatagccgg

SEQ ID NO: 155952 - DNA, 20 bp, human
ggagttcaaggaattaaggg

SEQ ID NO: 155953 - DNA, 20 bp, human
gcccggagccgaatgaagca

SEQ ID NO: 155954 - DNA, 20 bp, human
gctggccgcacaatacagga

SEQ ID NO: 155955 - DNA, 20 bp, human
gccggggaagcagaatgaaa

SEQ ID NO: 155956 - DNA, 20 bp, human
gtcgtcccggcagaacgacg

SEQ ID NO: 155957 - DNA, 20 bp, human
gggggctgccgccgtgatcc

SEQ ID NO: 155958 - DNA, 20 bp, human
ggaaagcacgaagagaatgt

SEQ ID NO: 155959 - DNA, 20 bp, human
gactgaacggaacagagaca

SEQ ID NO: 155960 - DNA, 20 bp, human
gagggccaggcccgggatca

SEQ ID NO: 155961 - DNA, 20 bp, human
gggccaccctcctatacagg

SEQ ID NO: 155962 - DNA, 20 bp, human
gactcctcttccagatcctg

SEQ ID NO: 155963 - DNA, 20 bp, human
gctatacaggaggcatgaga

SEQ ID NO: 155964 - DNA, 20 bp, human
gaggagagccgaaggcgtgg

SEQ ID NO: 155965 - DNA, 20 bp, human
gccttgttgggggtactgaa

SEQ ID NO: 155966 - DNA, 20 bp, human
ggcacggcgggcggtgcgtg

SEQ ID NO: 155967 - DNA, 20 bp, human
gtccccagcggccccagggt

SEQ ID NO: 155968 - DNA, 20 bp, human
ggccgtcagagggtccccag

SEQ ID NO: 155969 - DNA, 20 bp, human
gctgctgcggaagtcctcgg

SEQ ID NO: 155970 - DNA, 20 bp, human
gtctggctcctagagtgaag

SEQ ID NO: 155971 - DNA, 20 bp, human
gatgctgctgcggaagtcct

SEQ ID NO: 155972 - DNA, 20 bp, human
gttcttaaaggagccgtcag

SEQ ID NO: 155973 - DNA, 20 bp, human
gaggtcttccaggccaacac

SEQ ID NO: 155974 - DNA, 20 bp, human
gtcctcggtggagtgtgaga

SEQ ID NO: 155975 - DNA, 20 bp, human
gggcgggggctgcttcttaa

SEQ ID NO: 155976 - DNA, 20 bp, human
gggtgcttgattgagcgacg

SEQ ID NO: 155977 - DNA, 20 bp, human
gagaagagctccgggtgccg

SEQ ID NO: 155978 - DNA, 20 bp, human
ggcgacgcggagaagagctc

SEQ ID NO: 155979 - DNA, 20 bp, human
gtctcagcgctgcagtgccg

SEQ ID NO: 155980 - DNA, 20 bp, human
gtcaagcacctcggagtgaa

SEQ ID NO: 155981 - DNA, 20 bp, human
gccactttccattcactccg

SEQ ID NO: 155982 - DNA, 20 bp, human
ggaacacacgcggtttgtca

SEQ ID NO: 155983 - DNA, 20 bp, human
ggctgcagtgccgcggcacc

SEQ ID NO: 155984 - DNA, 20 bp, human
gggtcgtctgggaaaaggac

SEQ ID NO: 155985 - DNA, 20 bp, human
gtaaagaaacaactcgagca

SEQ ID NO: 155986 - DNA, 20 bp, human
ggactcaagctaacctacaa

SEQ ID NO: 155987 - DNA, 20 bp, human
ggcttcaaagtgccagtgac

SEQ ID NO: 155988 - DNA, 20 bp, human
gtataaatactgggctgaaa

SEQ ID NO: 155989 - DNA, 20 bp, human
gtgttgtttcttccagtcac

SEQ ID NO: 155990 - DNA, 20 bp, human
gctcacaaaaatgagtaatt

SEQ ID NO: 155991 - DNA, 20 bp, human
gaggtgaaaatcttggcttc

SEQ ID NO: 155992 - DNA, 20 bp, human
gattcaatttgatctgcaag

SEQ ID NO: 155993 - DNA, 20 bp, human
gctgcaagtggtaaacagtt

SEQ ID NO: 155994 - DNA, 20 bp, human
gaggaaaaaggtgaaaatct

SEQ ID NO: 155995 - DNA, 20 bp, human
gcatcatcaaagcaggaaaa

SEQ ID NO: 155996 - DNA, 20 bp, human
gcagggatgcagtctgtcag

SEQ ID NO: 155997 - DNA, 20 bp, human
gggatcctgcgactcctaga

SEQ ID NO: 155998 - DNA, 20 bp, human
gggttacgcctgtcacataa

SEQ ID NO: 155999 - DNA, 20 bp, human
gacttaggacttccctccag

SEQ ID NO: 156000 - DNA, 20 bp, human
gatgtgacaggcgtaaccgg

SEQ ID NO: 156001 - DNA, 20 bp, human
gccgaagagaggacctccac

SEQ ID NO: 156002 - DNA, 20 bp, human
gacgcctgtcacataaaggt

SEQ ID NO: 156003 - DNA, 20 bp, human
gctcgcacgctgcccctgga

SEQ ID NO: 156004 - DNA, 20 bp, human
ggctgaagagcgctctagac

SEQ ID NO: 156005 - DNA, 20 bp, human
ggctctgaagactcactctt

SEQ ID NO: 156006 - DNA, 20 bp, human
gcgagcgcagcgcaggacct

SEQ ID NO: 156007 - DNA, 20 bp, human
gtgggctgcacggttcctcg

SEQ ID NO: 156008 - DNA, 20 bp, human
ggcgagcgaacgaaccgcgg

SEQ ID NO: 156009 - DNA, 20 bp, human
gagagcgagcgaacgaaccg

SEQ ID NO: 156010 - DNA, 20 bp, human
ggcacggagcggctcccgtt

SEQ ID NO: 156011 - DNA, 20 bp, human
gcccagcccgggccatggga

SEQ ID NO: 156012 - DNA, 20 bp, human
ggagtgcagcgggaaccggg

SEQ ID NO: 156013 - DNA, 20 bp, human
gcgcagcggcgagaggtcgc

SEQ ID NO: 156014 - DNA, 20 bp, human
gctagcgcggaccggcccaa

SEQ ID NO: 156015 - DNA, 20 bp, human
gcgaacgaaccgcggcggtc

SEQ ID NO: 156016 - DNA, 20 bp, human
gggccatgctggggaactga

SEQ ID NO: 156017 - DNA, 20 bp, human
gacacaaacagggcacgcag

SEQ ID NO: 156018 - DNA, 20 bp, human
gggcggccagcgggaccaga

SEQ ID NO: 156019 - DNA, 20 bp, human
gctctgcaggcaggcggcag

SEQ ID NO: 156020 - DNA, 20 bp, human
gcaggggctggtacctcggt

SEQ ID NO: 156021 - DNA, 20 bp, human
ggcctgcggctctcctaccg

SEQ ID NO: 156022 - DNA, 20 bp, human
gccgcaggcggggcacactg

SEQ ID NO: 156023 - DNA, 20 bp, human
gcacgcaggggctggtacct

SEQ ID NO: 156024 - DNA, 20 bp, human
gcaccaggccaccacttata

SEQ ID NO: 156025 - DNA, 20 bp, human
gttccccagcatggccccct

SEQ ID NO: 156026 - DNA, 20 bp, human
gattatgtagaggcccaggg

SEQ ID NO: 156027 - DNA, 20 bp, human
gcccagaggcaggggacaga

SEQ ID NO: 156028 - DNA, 20 bp, human
gcttggggaagattatgtag

SEQ ID NO: 156029 - DNA, 20 bp, human
ggcctggcctgatacttcca

SEQ ID NO: 156030 - DNA, 20 bp, human
gacacaggagcaagagacaa

SEQ ID NO: 156031 - DNA, 20 bp, human
gctccccccgcggtcgtcgt

SEQ ID NO: 156032 - DNA, 20 bp, human
gtggcctgatacttccaggg

SEQ ID NO: 156033 - DNA, 20 bp, human
gtgctgataaccaacctggt

SEQ ID NO: 156034 - DNA, 20 bp, human
ggtgctggctttggcatgat

SEQ ID NO: 156035 - DNA, 20 bp, human
gtgaaagtgacaggagagta

SEQ ID NO: 156036 - DNA, 20 bp, human
ggctgtgcgcccgagactcc

SEQ ID NO: 156037 - DNA, 20 bp, human
gcctggggacccggagtctc

SEQ ID NO: 156038 - DNA, 20 bp, human
ggggacgccgcgccggactg

SEQ ID NO: 156039 - DNA, 20 bp, human
ggtcccgggtttaggagtag

SEQ ID NO: 156040 - DNA, 20 bp, human
gacgagtcagtggacactcc

SEQ ID NO: 156041 - DNA, 20 bp, human
ggcgggaggtgcgggtgcaa

SEQ ID NO: 156042 - DNA, 20 bp, human
gtggcaacaggctccccggg

SEQ ID NO: 156043 - DNA, 20 bp, human
gggcaagggggacgagtcag

SEQ ID NO: 156044 - DNA, 20 bp, human
ggtggacactccaggaagag

SEQ ID NO: 156045 - DNA, 20 bp, human
ggcacagcctcagtccggcg

SEQ ID NO: 156046 - DNA, 20 bp, human
gcagaggcaggctgatccgg

SEQ ID NO: 156047 - DNA, 20 bp, human
ggtgagctctgcccaagccg

SEQ ID NO: 156048 - DNA, 20 bp, human
gggcaccgcagtcctcccgc

SEQ ID NO: 156049 - DNA, 20 bp, human
gggcagagctcacccgcaag

SEQ ID NO: 156050 - DNA, 20 bp, human
gtccgcacgaggcacgtccc

SEQ ID NO: 156051 - DNA, 20 bp, human
ggtggctcggccggactcac

SEQ ID NO: 156052 - DNA, 20 bp, human
gcaaggaggggacctgtcgg

SEQ ID NO: 156053 - DNA, 20 bp, human
ggctcggccggactcacggg

SEQ ID NO: 156054 - DNA, 20 bp, human
gtgagcgcccaggtcggagg

SEQ ID NO: 156055 - DNA, 20 bp, human
ggtgggaaacagggtcaagt

SEQ ID NO: 156056 - DNA, 20 bp, human
ggccgcgctggagaaagagc

SEQ ID NO: 156057 - DNA, 20 bp, human
ggctccccgcgccaccacgg

SEQ ID NO: 156058 - DNA, 20 bp, human
gcgggctccccgcgccacca

SEQ ID NO: 156059 - DNA, 20 bp, human
gccggacgcgggagggacag

SEQ ID NO: 156060 - DNA, 20 bp, human
gcgcggggagcccgagccta

SEQ ID NO: 156061 - DNA, 20 bp, human
gccctgcgaagcagccgcgg

SEQ ID NO: 156062 - DNA, 20 bp, human
gcggaggggcgcgccagcga

SEQ ID NO: 156063 - DNA, 20 bp, human
gaagcaaagggacaaagcgg

SEQ ID NO: 156064 - DNA, 20 bp, human
gcttcgcagggtctcgggag

SEQ ID NO: 156065 - DNA, 20 bp, human
gcctgacgtcaaggggaagg

SEQ ID NO: 156066 - DNA, 20 bp, human
ggccctgctgatgtggaacg

SEQ ID NO: 156067 - DNA, 20 bp, human
gaccccgttccacatcagca

SEQ ID NO: 156068 - DNA, 20 bp, human
gtaggcagaggccaagtgtg

SEQ ID NO: 156069 - DNA, 20 bp, human
gaagcggggaggagttgagt

SEQ ID NO: 156070 - DNA, 20 bp, human
gcactcctgccctgctgatg

SEQ ID NO: 156071 - DNA, 20 bp, human
gtcctgttgcgcagaggtag

SEQ ID NO: 156072 - DNA, 20 bp, human
gcaggtctccctgggaagcg

SEQ ID NO: 156073 - DNA, 20 bp, human
gagactccttagggcgacga

SEQ ID NO: 156074 - DNA, 20 bp, human
ggttgcgcagaggtagtggt

SEQ ID NO: 156075 - DNA, 20 bp, human
ggagaagggccgggagcgaa

SEQ ID NO: 156076 - DNA, 20 bp, human
gggatagcagagaggtccag

SEQ ID NO: 156077 - DNA, 20 bp, human
ggatccaggaaggagtccag

SEQ ID NO: 156078 - DNA, 20 bp, human
gagaggtccagggggtcgga

SEQ ID NO: 156079 - DNA, 20 bp, human
gggtccgggtaggtgtctct

SEQ ID NO: 156080 - DNA, 20 bp, human
gcacctgcgcgcagggactg

SEQ ID NO: 156081 - DNA, 20 bp, human
gccggggagggatagcagag

SEQ ID NO: 156082 - DNA, 20 bp, human
ggttcgggcgccaggaatgg

SEQ ID NO: 156083 - DNA, 20 bp, human
gtgtctctgggaggcgtccc

SEQ ID NO: 156084 - DNA, 20 bp, human
gggtccggtgaggagcctag

SEQ ID NO: 156085 - DNA, 20 bp, human
gcgcgcgagagcgctgaggc

SEQ ID NO: 156086 - DNA, 20 bp, human
ggccctgcgtgaggatgggg

SEQ ID NO: 156087 - DNA, 20 bp, human
gcagtcaggacagacgtccc

SEQ ID NO: 156088 - DNA, 20 bp, human
gagaggccctgcgtgaggat

SEQ ID NO: 156089 - DNA, 20 bp, human
gctggccagctacagaatga

SEQ ID NO: 156090 - DNA, 20 bp, human
gggatactcaggacaccatc

SEQ ID NO: 156091 - DNA, 20 bp, human
ggccgccccatcctcacgca

SEQ ID NO: 156092 - DNA, 20 bp, human
gacgtctgtcctgactgcag

SEQ ID NO: 156093 - DNA, 20 bp, human
gcctgagtatccatcctccc

SEQ ID NO: 156094 - DNA, 20 bp, human
gggacacgctgaccagcgtg

SEQ ID NO: 156095 - DNA, 20 bp, human
gtgcccttctggacaaccag

SEQ ID NO: 156096 - DNA, 20 bp, human
gagccgagaggacccgagtg

SEQ ID NO: 156097 - DNA, 20 bp, human
ggcctctgctcagggccccg

SEQ ID NO: 156098 - DNA, 20 bp, human
ggcgggtgcggcgcaagcta

SEQ ID NO: 156099 - DNA, 20 bp, human
ggggtcctctcggctcggtc

SEQ ID NO: 156100 - DNA, 20 bp, human
gtgagccggaccgagccgag

SEQ ID NO: 156101 - DNA, 20 bp, human
gtactggcctcggccccact

SEQ ID NO: 156102 - DNA, 20 bp, human
gccagcagcagtagcgggaa

SEQ ID NO: 156103 - DNA, 20 bp, human
gggcctctcagcctggtgta

SEQ ID NO: 156104 - DNA, 20 bp, human
gggccccactcgggtcctct

SEQ ID NO: 156105 - DNA, 20 bp, human
gtgcagcctgggcgtgtcgt

SEQ ID NO: 156106 - DNA, 20 bp, human
ggagagaccgccatcctact

SEQ ID NO: 156107 - DNA, 20 bp, human
ggccccggatccgagcgcaa

SEQ ID NO: 156108 - DNA, 20 bp, human
gtgacgaagggagaggaccg

SEQ ID NO: 156109 - DNA, 20 bp, human
gttagacctgacgaagggag

SEQ ID NO: 156110 - DNA, 20 bp, human
gcggcgtccggcgggatcga

SEQ ID NO: 156111 - DNA, 20 bp, human
gtgaggttagacctgacgaa

SEQ ID NO: 156112 - DNA, 20 bp, human
gcaccagctgcgagaggaag

SEQ ID NO: 156113 - DNA, 20 bp, human
gcagccccaggctcacgcca

SEQ ID NO: 156114 - DNA, 20 bp, human
gtgagcaaggcgaggagtgc

SEQ ID NO: 156115 - DNA, 20 bp, human
gccgagcgcaaaggtgagca

SEQ ID NO: 156116 - DNA, 20 bp, human
gaggctgcgaagcccacccg

SEQ ID NO: 156117 - DNA, 20 bp, human
gcagggagagcagccgccac

SEQ ID NO: 156118 - DNA, 20 bp, human
gaggtgctgaagaggatcct

SEQ ID NO: 156119 - DNA, 20 bp, human
gcggcgggaaagcagcgctc

SEQ ID NO: 156120 - DNA, 20 bp, human
gcccccaggcgctggatgac

SEQ ID NO: 156121 - DNA, 20 bp, human
ggcgctcgggagcgggctca

SEQ ID NO: 156122 - DNA, 20 bp, human
gggaaagcagcgctcgggag

SEQ ID NO: 156123 - DNA, 20 bp, human
ggatctacttgccgggaagg

SEQ ID NO: 156124 - DNA, 20 bp, human
gccagcagagacgaccctcg

SEQ ID NO: 156125 - DNA, 20 bp, human
gagctccgcggggcagtcct

SEQ ID NO: 156126 - DNA, 20 bp, human
ggataggaagcgtacttagg

SEQ ID NO: 156127 - DNA, 20 bp, human
ggagggcattctacagggac

SEQ ID NO: 156128 - DNA, 20 bp, human
gaaagataggaagcgtactt

SEQ ID NO: 156129 - DNA, 20 bp, human
gtgaggaggttggatggagg

SEQ ID NO: 156130 - DNA, 20 bp, human
gtgagctggcatttgggaga

SEQ ID NO: 156131 - DNA, 20 bp, human
gagcagaagcgaagggatcg

SEQ ID NO: 156132 - DNA, 20 bp, human
gacgggcaagcagaagcgaa

SEQ ID NO: 156133 - DNA, 20 bp, human
gttgggagagggcattctac

SEQ ID NO: 156134 - DNA, 20 bp, human
gaggagcttcatagatgagc

SEQ ID NO: 156135 - DNA, 20 bp, human
gtgctgacagatgcagcatg

SEQ ID NO: 156136 - DNA, 20 bp, human
gggcgctcggaacccagcag

SEQ ID NO: 156137 - DNA, 20 bp, human
ggtgacagaggagtagtgag

SEQ ID NO: 156138 - DNA, 20 bp, human
gccaatgacgagcggagaag

SEQ ID NO: 156139 - DNA, 20 bp, human
ggcggcctctccggtgacag

SEQ ID NO: 156140 - DNA, 20 bp, human
gtagtgagcggcacggggtg

SEQ ID NO: 156141 - DNA, 20 bp, human
gagtgcgcggggagcggagt

SEQ ID NO: 156142 - DNA, 20 bp, human
gcagcagcggcgctcctccg

SEQ ID NO: 156143 - DNA, 20 bp, human
gcagccgagtgcgcggggag

SEQ ID NO: 156144 - DNA, 20 bp, human
gaggagtagtgagcggcacg

SEQ ID NO: 156145 - DNA, 20 bp, human
gtactcctctgtcaccggag

SEQ ID NO: 156146 - DNA, 20 bp, human
ggtgcaagcggagaatgaaa

SEQ ID NO: 156147 - DNA, 20 bp, human
gaaggaggtcagatctacca

SEQ ID NO: 156148 - DNA, 20 bp, human
gtcccccgtgagaggtagtg

SEQ ID NO: 156149 - DNA, 20 bp, human
gggtagtgaggtgcctgtca

SEQ ID NO: 156150 - DNA, 20 bp, human
gggaagcagtcccccgtgag

SEQ ID NO: 156151 - DNA, 20 bp, human
gctgggaccttcagcatgga

SEQ ID NO: 156152 - DNA, 20 bp, human
gttcgcgacaatcggccctg

SEQ ID NO: 156153 - DNA, 20 bp, human
gagcaccccctaccagaaag

SEQ ID NO: 156154 - DNA, 20 bp, human
gacctcactacctctcacgg

SEQ ID NO: 156155 - DNA, 20 bp, human
gccaggtaatgacatagcag

SEQ ID NO: 156156 - DNA, 20 bp, human
ggcgctgtcgggagagccct

SEQ ID NO: 156157 - DNA, 20 bp, human
ggcggctggacttggaccca

SEQ ID NO: 156158 - DNA, 20 bp, human
gaagtccagccgcggatccg

SEQ ID NO: 156159 - DNA, 20 bp, human
gtactggtgagagcagagtc

SEQ ID NO: 156160 - DNA, 20 bp, human
gatcctggagcaagtacccc

SEQ ID NO: 156161 - DNA, 20 bp, human
ggatgagcgtccgaattgga

SEQ ID NO: 156162 - DNA, 20 bp, human
gttcgcgcttcccagtccag

SEQ ID NO: 156163 - DNA, 20 bp, human
gccgagccccgtaactgtac

SEQ ID NO: 156164 - DNA, 20 bp, human
gagtaccccgggcagggaag

SEQ ID NO: 156165 - DNA, 20 bp, human
gtccagccgcggatccgcgg

SEQ ID NO: 156166 - DNA, 20 bp, human
ggagctgccgagtgcgtgga

SEQ ID NO: 156167 - DNA, 20 bp, human
gcaagacctaaggagacaga

SEQ ID NO: 156168 - DNA, 20 bp, human
gtcaaggaagccaagaccta

SEQ ID NO: 156169 - DNA, 20 bp, human
gctcttgtggcgcccggtgg

SEQ ID NO: 156170 - DNA, 20 bp, human
gtcccacccccgggcacgga

SEQ ID NO: 156171 - DNA, 20 bp, human
ggacgcgcaaagggctagag

SEQ ID NO: 156172 - DNA, 20 bp, human
gctcaggttccgacccccac

SEQ ID NO: 156173 - DNA, 20 bp, human
gtcctgccgtccgtgcccgg

SEQ ID NO: 156174 - DNA, 20 bp, human
ggcaaagctggcggcttagg

SEQ ID NO: 156175 - DNA, 20 bp, human
ggtcaatccatcaggcgagc

SEQ ID NO: 156176 - DNA, 20 bp, human
gcggcacgtccgggcggagg

SEQ ID NO: 156177 - DNA, 20 bp, human
gcggaggaggcgtcatcccg

SEQ ID NO: 156178 - DNA, 20 bp, human
gagagccggctgtaacgctg

SEQ ID NO: 156179 - DNA, 20 bp, human
gtgggggcggcacgtccggg

SEQ ID NO: 156180 - DNA, 20 bp, human
gcccagggccacctaaggag

SEQ ID NO: 156181 - DNA, 20 bp, human
gtaacgctgcggcgagcgag

SEQ ID NO: 156182 - DNA, 20 bp, human
gcttcgccgtctggaaaggt

SEQ ID NO: 156183 - DNA, 20 bp, human
gctaagtcgcaccaagtccc

SEQ ID NO: 156184 - DNA, 20 bp, human
ggtccccgcgtggagcgtgt

SEQ ID NO: 156185 - DNA, 20 bp, human
ggcgctgggggcggcacgtc

SEQ ID NO: 156186 - DNA, 20 bp, human
gcgggactggtcatgatcat

SEQ ID NO: 156187 - DNA, 20 bp, human
gaaagtacaaagatgatgtt

SEQ ID NO: 156188 - DNA, 20 bp, human
gagcactattctggacaaaa

SEQ ID NO: 156189 - DNA, 20 bp, human
ggtctgagcagctttcccca

SEQ ID NO: 156190 - DNA, 20 bp, human
gtggggggtaagagttgtaa

SEQ ID NO: 156191 - DNA, 20 bp, human
gtgttgggcttcatcttgct

SEQ ID NO: 156192 - DNA, 20 bp, human
gaagagttgtaagggagctt

SEQ ID NO: 156193 - DNA, 20 bp, human
gtctagaaaagctgaagctt

SEQ ID NO: 156194 - DNA, 20 bp, human
ggaaattgggaaaattcact

SEQ ID NO: 156195 - DNA, 20 bp, human
gaataatctaagattatttg

SEQ ID NO: 156196 - DNA, 20 bp, human
gcgggactggtcatgatcat

SEQ ID NO: 156197 - DNA, 20 bp, human
gaaagtacaaagatgatgtt

SEQ ID NO: 156198 - DNA, 20 bp, human
gagcactattctggacaaaa

SEQ ID NO: 156199 - DNA, 20 bp, human
ggtctgagcagctttcccca

SEQ ID NO: 156200 - DNA, 20 bp, human
gtggggggtaagagttgtaa

SEQ ID NO: 156201 - DNA, 20 bp, human
gtgttgggcttcatcttgct

SEQ ID NO: 156202 - DNA, 20 bp, human
gaagagttgtaagggagctt

SEQ ID NO: 156203 - DNA, 20 bp, human
gtctagaaaagctgaagctt

SEQ ID NO: 156204 - DNA, 20 bp, human
ggaaattgggaaaattcact

SEQ ID NO: 156205 - DNA, 20 bp, human
gaataatctaagattatttg

SEQ ID NO: 156206 - DNA, 20 bp, human
ggtagcctaacggccaccgg

SEQ ID NO: 156207 - DNA, 20 bp, human
ggttccggttcggtgagtgg

SEQ ID NO: 156208 - DNA, 20 bp, human
gggccggaaaccccttcgca

SEQ ID NO: 156209 - DNA, 20 bp, human
gcggccaccggacagcaggg

SEQ ID NO: 156210 - DNA, 20 bp, human
gacggcctcaggtagcctaa

SEQ ID NO: 156211 - DNA, 20 bp, human
gatggcagccggttccggtt

SEQ ID NO: 156212 - DNA, 20 bp, human
gatcactcgggtctcaagga

SEQ ID NO: 156213 - DNA, 20 bp, human
gccggttccggttcggtgag

SEQ ID NO: 156214 - DNA, 20 bp, human
gaaccggctgccatgcgaag

SEQ ID NO: 156215 - DNA, 20 bp, human
gagtggcggcgggaagctgg

SEQ ID NO: 156216 - DNA, 20 bp, human
gatcagcgaccgaactctgg

SEQ ID NO: 156217 - DNA, 20 bp, human
gaagacggcgaaggcggcag

SEQ ID NO: 156218 - DNA, 20 bp, human
ggtggttaagacggcgaagg

SEQ ID NO: 156219 - DNA, 20 bp, human
gctggggacgctgtatctgt

SEQ ID NO: 156220 - DNA, 20 bp, human
gtcgctcccgccaggctgta

SEQ ID NO: 156221 - DNA, 20 bp, human
ggagctggtcgtcttcgtag

SEQ ID NO: 156222 - DNA, 20 bp, human
gagcgaccgaactctggcgg

SEQ ID NO: 156223 - DNA, 20 bp, human
ggtggtggttaagacggcga

SEQ ID NO: 156224 - DNA, 20 bp, human
gagcggcggcgacagctctg

SEQ ID NO: 156225 - DNA, 20 bp, human
gtcttcgtagcggccggtga

SEQ ID NO: 156226 - DNA, 20 bp, human
gtggatggctcggcgcacac

SEQ ID NO: 156227 - DNA, 20 bp, human
gggcccagaggcccgcatag

SEQ ID NO: 156228 - DNA, 20 bp, human
ggtgcgccaccgctgccggt

SEQ ID NO: 156229 - DNA, 20 bp, human
gcaagctcgtgggaccggac

SEQ ID NO: 156230 - DNA, 20 bp, human
gctctgggccccggttcggt

SEQ ID NO: 156231 - DNA, 20 bp, human
gaccgctgccggtgggcccg

SEQ ID NO: 156232 - DNA, 20 bp, human
gatgcaacccggcaccagtc

SEQ ID NO: 156233 - DNA, 20 bp, human
ggcacgcggcccagaagcgt

SEQ ID NO: 156234 - DNA, 20 bp, human
ggccttaagaagcccctatg

SEQ ID NO: 156235 - DNA, 20 bp, human
gggcctcgctcccaccgaac

SEQ ID NO: 156236 - DNA, 20 bp, human
ggtcgcggcagccgcttcag

SEQ ID NO: 156237 - DNA, 20 bp, human
gcgcttcagaggaagctcgg

SEQ ID NO: 156238 - DNA, 20 bp, human
ggtggccgcggcgaacaggc

SEQ ID NO: 156239 - DNA, 20 bp, human
gccgccagcgacgaggcgtc

SEQ ID NO: 156240 - DNA, 20 bp, human
gccgccttcgtcagctccaa

SEQ ID NO: 156241 - DNA, 20 bp, human
gcggccgccgtggaagtccg

SEQ ID NO: 156242 - DNA, 20 bp, human
ggcgtccggcctgttcgccg

SEQ ID NO: 156243 - DNA, 20 bp, human
gagaggaagctcggcggctg

SEQ ID NO: 156244 - DNA, 20 bp, human
ggtgcctgcgacgcacagcc

SEQ ID NO: 156245 - DNA, 20 bp, human
gcccgccgccggccccgtcg

SEQ ID NO: 156246 - DNA, 20 bp, human
gccaggcgtgaatgcatcag

SEQ ID NO: 156247 - DNA, 20 bp, human
gttcagacgggcctatacaa

SEQ ID NO: 156248 - DNA, 20 bp, human
ggcttctcaggcctctccgg

SEQ ID NO: 156249 - DNA, 20 bp, human
gcggtcgcgttcccccggag

SEQ ID NO: 156250 - DNA, 20 bp, human
gtacggcctgggacgaaggg

SEQ ID NO: 156251 - DNA, 20 bp, human
gagcgcccgtgggggaggag

SEQ ID NO: 156252 - DNA, 20 bp, human
gtataggcccgtctgaacgt

SEQ ID NO: 156253 - DNA, 20 bp, human
ggaacgagctaggggcctgg

SEQ ID NO: 156254 - DNA, 20 bp, human
gtgtccatgtggacaggggt

SEQ ID NO: 156255 - DNA, 20 bp, human
gtgctgtggcgaccgacgcg

SEQ ID NO: 156256 - DNA, 20 bp, human
gaaggggcgcgcacaatgga

SEQ ID NO: 156257 - DNA, 20 bp, human
gtgtcacctcaggacccctc

SEQ ID NO: 156258 - DNA, 20 bp, human
ggccaaccgggaagatccat

SEQ ID NO: 156259 - DNA, 20 bp, human
gctccctctccaagccggag

SEQ ID NO: 156260 - DNA, 20 bp, human
gaccgggtcttcgactccag

SEQ ID NO: 156261 - DNA, 20 bp, human
gttgcaggcgctgtcacctc

SEQ ID NO: 156262 - DNA, 20 bp, human
gggacccctccggcttggag

SEQ ID NO: 156263 - DNA, 20 bp, human
ggcccatggatcttcccggt

SEQ ID NO: 156264 - DNA, 20 bp, human
gacgcaaagtcgagaatcaa

SEQ ID NO: 156265 - DNA, 20 bp, human
gcatgggccgatgagacgca

SEQ ID NO: 156266 - DNA, 20 bp, human
gcgctttccggccaacacag

SEQ ID NO: 156267 - DNA, 20 bp, human
ggccgagacaaaccgaagtg

SEQ ID NO: 156268 - DNA, 20 bp, human
gaccgtgagagaatccgcag

SEQ ID NO: 156269 - DNA, 20 bp, human
gtgtgtaggaggataacgtg

SEQ ID NO: 156270 - DNA, 20 bp, human
gggccggaaagcgacagcta

SEQ ID NO: 156271 - DNA, 20 bp, human
ggctacggtcgcaaactcag

SEQ ID NO: 156272 - DNA, 20 bp, human
gccaacacagaggtgcctga

SEQ ID NO: 156273 - DNA, 20 bp, human
gggtgcctgaaggctggttg

SEQ ID NO: 156274 - DNA, 20 bp, human
ggttggggtggtgaggcccg

SEQ ID NO: 156275 - DNA, 20 bp, human
gtccaggtccagaatcggga

SEQ ID NO: 156276 - DNA, 20 bp, human
gagaaggacccctaagctag

SEQ ID NO: 156277 - DNA, 20 bp, human
gatcactcctactctccctg

SEQ ID NO: 156278 - DNA, 20 bp, human
gggtcctggttgaaaagggt

SEQ ID NO: 156279 - DNA, 20 bp, human
gagtgacaggtattaaataa

SEQ ID NO: 156280 - DNA, 20 bp, human
gcaccttcgcagctgccaca

SEQ ID NO: 156281 - DNA, 20 bp, human
ggaccgcagaagtaaagaag

SEQ ID NO: 156282 - DNA, 20 bp, human
ggcggggctaaaactggcga

SEQ ID NO: 156283 - DNA, 20 bp, human
gctccctgtggcagctgcga

SEQ ID NO: 156284 - DNA, 20 bp, human
ggtggacgcccctagcttag

SEQ ID NO: 156285 - DNA, 20 bp, human
ggctaaaactggcgaaggcg

SEQ ID NO: 156286 - DNA, 20 bp, human
gagggccgcctcttaaaggg

SEQ ID NO: 156287 - DNA, 20 bp, human
ggccgcctcttaaagggagg

SEQ ID NO: 156288 - DNA, 20 bp, human
gagccagggccgcctcttaa

SEQ ID NO: 156289 - DNA, 20 bp, human
gcgcaaagcgagccggtaag

SEQ ID NO: 156290 - DNA, 20 bp, human
gggacccccgcgcgcccagc

SEQ ID NO: 156291 - DNA, 20 bp, human
ggcggcgcgcggctccccgg

SEQ ID NO: 156292 - DNA, 20 bp, human
ggggaggcgcaggcttaaag

SEQ ID NO: 156293 - DNA, 20 bp, human
gccggccacctccctttaag

SEQ ID NO: 156294 - DNA, 20 bp, human
ggggaggtggccggccttaa

SEQ ID NO: 156295 - DNA, 20 bp, human
gaaagcgagccggtaagcgg

SEQ ID NO: 156296 - DNA, 20 bp, human
gccaacgcctggggctcgaa

SEQ ID NO: 156297 - DNA, 20 bp, human
gcagcggcggaaggctcctc

SEQ ID NO: 156298 - DNA, 20 bp, human
gactcaagccgtcagaccca

SEQ ID NO: 156299 - DNA, 20 bp, human
ggtgcatgccgtgggtctga

SEQ ID NO: 156300 - DNA, 20 bp, human
gtataaataagggagtccgg

SEQ ID NO: 156301 - DNA, 20 bp, human
ggacggcttgagtagcgcta

SEQ ID NO: 156302 - DNA, 20 bp, human
gtgcccggcagggaagcgag

SEQ ID NO: 156303 - DNA, 20 bp, human
gggccaggaagaggcgtccc

SEQ ID NO: 156304 - DNA, 20 bp, human
ggtcgccgaggcttccgcca

SEQ ID NO: 156305 - DNA, 20 bp, human
gactcctggcgggactgacg

SEQ ID NO: 156306 - DNA, 20 bp, human
gcgccgccagccgcagccat

SEQ ID NO: 156307 - DNA, 20 bp, human
ggggctgggacagactggag

SEQ ID NO: 156308 - DNA, 20 bp, human
ggaggggtctctatccagag

SEQ ID NO: 156309 - DNA, 20 bp, human
ggccagccgcagccatgggc

SEQ ID NO: 156310 - DNA, 20 bp, human
ggacgggagggagcacggga

SEQ ID NO: 156311 - DNA, 20 bp, human
gtccgggcccgagctggctg

SEQ ID NO: 156312 - DNA, 20 bp, human
ggtgtggggctgggacagac

SEQ ID NO: 156313 - DNA, 20 bp, human
gaggcgaacggaggccagtg

SEQ ID NO: 156314 - DNA, 20 bp, human
gcgccacgccgaggcccagg

SEQ ID NO: 156315 - DNA, 20 bp, human
gagggctccgagcagcgcca

SEQ ID NO: 156316 - DNA, 20 bp, human
gcaggccacagctccctgag

SEQ ID NO: 156317 - DNA, 20 bp, human
gagggggcaggtccagagga

SEQ ID NO: 156318 - DNA, 20 bp, human
gcttcacaaagggccgaggg

SEQ ID NO: 156319 - DNA, 20 bp, human
gcccccaggtcatcatccac

SEQ ID NO: 156320 - DNA, 20 bp, human
ggcaaagcgggtcttcacaa

SEQ ID NO: 156321 - DNA, 20 bp, human
gtcactggggatgatccacc

SEQ ID NO: 156322 - DNA, 20 bp, human
ggaagtcgctgatggcagtc

SEQ ID NO: 156323 - DNA, 20 bp, human
gggcggcgggaggcacgtac

SEQ ID NO: 156324 - DNA, 20 bp, human
gagctccctgaggggcaaag

SEQ ID NO: 156325 - DNA, 20 bp, human
gccgagggtggaacatgctc

SEQ ID NO: 156326 - DNA, 20 bp, human
gagaaaggaagcaggcccgt

SEQ ID NO: 156327 - DNA, 20 bp, human
ggaagcaggcccgttggaag

SEQ ID NO: 156328 - DNA, 20 bp, human
gcttacacaaccacttccaa

SEQ ID NO: 156329 - DNA, 20 bp, human
ggggcagagtaagaacaaac

SEQ ID NO: 156330 - DNA, 20 bp, human
ggtctgaacttaggtgtggt

SEQ ID NO: 156331 - DNA, 20 bp, human
gatctgttgtgatgttacat

SEQ ID NO: 156332 - DNA, 20 bp, human
gataagaagagtctgaactt

SEQ ID NO: 156333 - DNA, 20 bp, human
gaatagattcagaaaactgg

SEQ ID NO: 156334 - DNA, 20 bp, human
gagtgttgtagaaatgtcca

SEQ ID NO: 156335 - DNA, 20 bp, human
ggggaaaaaacccagccatt

SEQ ID NO: 156336 - DNA, 20 bp, human
gccacacgccagacacacga

SEQ ID NO: 156337 - DNA, 20 bp, human
gactcgccgcctggacggta

SEQ ID NO: 156338 - DNA, 20 bp, human
gctctcgcggttcatgacag

SEQ ID NO: 156339 - DNA, 20 bp, human
gggcgacagtggcgaataag

SEQ ID NO: 156340 - DNA, 20 bp, human
gtcgcggttcatgacagcgg

SEQ ID NO: 156341 - DNA, 20 bp, human
ggaccgcagtcggtcagcta

SEQ ID NO: 156342 - DNA, 20 bp, human
ggagggttggtgaaagatgg

SEQ ID NO: 156343 - DNA, 20 bp, human
gaggcgctgccgtaccgtcc

SEQ ID NO: 156344 - DNA, 20 bp, human
gcgctgccgtaccgtccagg

SEQ ID NO: 156345 - DNA, 20 bp, human
gggtgtcgccggcttacgtg

SEQ ID NO: 156346 - DNA, 20 bp, human
gcacctggcgatcctcatag

SEQ ID NO: 156347 - DNA, 20 bp, human
ggtgatggctggcggagtca

SEQ ID NO: 156348 - DNA, 20 bp, human
gtggcgatcctcatagaggt

SEQ ID NO: 156349 - DNA, 20 bp, human
gctgccccaccagaggaagt

SEQ ID NO: 156350 - DNA, 20 bp, human
gctccccacttcctctggtg

SEQ ID NO: 156351 - DNA, 20 bp, human
gcataggacaaggagtacgt

SEQ ID NO: 156352 - DNA, 20 bp, human
gatcctcatagaggttggtg

SEQ ID NO: 156353 - DNA, 20 bp, human
ggggcctgttctgtccacag

SEQ ID NO: 156354 - DNA, 20 bp, human
gaacaggcccaactggtcag

SEQ ID NO: 156355 - DNA, 20 bp, human
gtggggcaggaagctgagtg

SEQ ID NO: 156356 - DNA, 20 bp, human
gggccggaggcaaagcgggt

SEQ ID NO: 156357 - DNA, 20 bp, human
ggttagggccggaggcaaag

SEQ ID NO: 156358 - DNA, 20 bp, human
gtccttgaggttagggccgg

SEQ ID NO: 156359 - DNA, 20 bp, human
gtggacaagaggccgactga

SEQ ID NO: 156360 - DNA, 20 bp, human
gagccagttccttgaggtta

SEQ ID NO: 156361 - DNA, 20 bp, human
gggccctaacctcaaggaac

SEQ ID NO: 156362 - DNA, 20 bp, human
ggcggagccgaggtaaggcc

SEQ ID NO: 156363 - DNA, 20 bp, human
gtgaaggcggagccgaggta

SEQ ID NO: 156364 - DNA, 20 bp, human
gacaagaggccgactgaagg

SEQ ID NO: 156365 - DNA, 20 bp, human
gatgggcagcgggatctctg

SEQ ID NO: 156366 - DNA, 20 bp, human
ggcgccagcgtcgggacggt

SEQ ID NO: 156367 - DNA, 20 bp, human
gccgcgcccaggctccgcag

SEQ ID NO: 156368 - DNA, 20 bp, human
gggagggcagaagcaacggg

SEQ ID NO: 156369 - DNA, 20 bp, human
gcgcggcgccagcgtcggga

SEQ ID NO: 156370 - DNA, 20 bp, human
gccgcgacggggaagggaca

SEQ ID NO: 156371 - DNA, 20 bp, human
gcggctggtcccggcgacgg

SEQ ID NO: 156372 - DNA, 20 bp, human
ggggcgcgggtcacaatccc

SEQ ID NO: 156373 - DNA, 20 bp, human
gggaggctcggaagtgctca

SEQ ID NO: 156374 - DNA, 20 bp, human
gagacccacaaacaccgctg

SEQ ID NO: 156375 - DNA, 20 bp, human
gaccatggcctcctccgagg

SEQ ID NO: 156376 - DNA, 20 bp, human
gcagagcgcagccgcgaggg

SEQ ID NO: 156377 - DNA, 20 bp, human
ggagcagagcgcagccgcga

SEQ ID NO: 156378 - DNA, 20 bp, human
gagccgcgagggaggcgcga

SEQ ID NO: 156379 - DNA, 20 bp, human
ggtcggggttaggagcccag

SEQ ID NO: 156380 - DNA, 20 bp, human
gccggctgctgctagtgctc

SEQ ID NO: 156381 - DNA, 20 bp, human
gctgctcgccggcgtcccgc

SEQ ID NO: 156382 - DNA, 20 bp, human
gagatgccgctggctgccag

SEQ ID NO: 156383 - DNA, 20 bp, human
ggcggctgcgctctgctcgc

SEQ ID NO: 156384 - DNA, 20 bp, human
gtccctcgtgacagccagaa

SEQ ID NO: 156385 - DNA, 20 bp, human
gcacgagggaagaggtgcgc

SEQ ID NO: 156386 - DNA, 20 bp, human
gaccaggccctgccaggaca

SEQ ID NO: 156387 - DNA, 20 bp, human
gtgtgacacctggtggacgt

SEQ ID NO: 156388 - DNA, 20 bp, human
ggagaggctccgctgcccaa

SEQ ID NO: 156389 - DNA, 20 bp, human
gccgtcccagcaggaaactt

SEQ ID NO: 156390 - DNA, 20 bp, human
gccctgcctgggctgtaggt

SEQ ID NO: 156391 - DNA, 20 bp, human
gagcggtgcgaagagcccac

SEQ ID NO: 156392 - DNA, 20 bp, human
gacctggtggacgtgggtcc

SEQ ID NO: 156393 - DNA, 20 bp, human
gagctcctggaagctccacc

SEQ ID NO: 156394 - DNA, 20 bp, human
gagcagcctgctgtgacacc

SEQ ID NO: 156395 - DNA, 20 bp, human
gcagcggagcctctctggat

SEQ ID NO: 156396 - DNA, 20 bp, human
ggactccatggtcgtaagaa

SEQ ID NO: 156397 - DNA, 20 bp, human
gctactatgaggactaacag

SEQ ID NO: 156398 - DNA, 20 bp, human
gacaactggggacagtagaa

SEQ ID NO: 156399 - DNA, 20 bp, human
gcaaatgcctaagcctcctc

SEQ ID NO: 156400 - DNA, 20 bp, human
gctttcctttcttacgacca

SEQ ID NO: 156401 - DNA, 20 bp, human
gttcacaattctctttcaat

SEQ ID NO: 156402 - DNA, 20 bp, human
ggtgtctaaagaacttgttt

SEQ ID NO: 156403 - DNA, 20 bp, human
gaacttgtttaggtttttta

SEQ ID NO: 156404 - DNA, 20 bp, human
gttccagagtagcataccag

SEQ ID NO: 156405 - DNA, 20 bp, human
gagtagaaaggacaccagct

SEQ ID NO: 156406 - DNA, 20 bp, human
ggctcttcggcacttatcgt

SEQ ID NO: 156407 - DNA, 20 bp, human
gcggccgagcccaggctctt

SEQ ID NO: 156408 - DNA, 20 bp, human
ggggagtgcggagcgatcac

SEQ ID NO: 156409 - DNA, 20 bp, human
gtggggcgccgagtacgact

SEQ ID NO: 156410 - DNA, 20 bp, human
gtggcggcagcaccgagctg

SEQ ID NO: 156411 - DNA, 20 bp, human
gcaacttgtgcggggtacac

SEQ ID NO: 156412 - DNA, 20 bp, human
gcgagcgctgggcgggtccg

SEQ ID NO: 156413 - DNA, 20 bp, human
gcgccaaacagcccgagaac

SEQ ID NO: 156414 - DNA, 20 bp, human
gtcggtcggcgcctgttctc

SEQ ID NO: 156415 - DNA, 20 bp, human
ggcggaccgcgagcgctggg

SEQ ID NO: 156416 - DNA, 20 bp, human
gcggtgcgcgcggacagggg

SEQ ID NO: 156417 - DNA, 20 bp, human
gcaacggtgcgcgcggacag

SEQ ID NO: 156418 - DNA, 20 bp, human
gcttggagagaggcagacat

SEQ ID NO: 156419 - DNA, 20 bp, human
gagattgtctctctcgaggt

SEQ ID NO: 156420 - DNA, 20 bp, human
gcctggaggaacggagacaa

SEQ ID NO: 156421 - DNA, 20 bp, human
gtcaccgcgcgtgggctcct

SEQ ID NO: 156422 - DNA, 20 bp, human
ggagaggcagacataggacg

SEQ ID NO: 156423 - DNA, 20 bp, human
gcggctggaggcgctcctgg

SEQ ID NO: 156424 - DNA, 20 bp, human
gcgagccgaggcgaggtccc

SEQ ID NO: 156425 - DNA, 20 bp, human
gacgcgcggtgacagatgcg

SEQ ID NO: 156426 - DNA, 20 bp, human
gacagcgcccgagcgacccg

SEQ ID NO: 156427 - DNA, 20 bp, human
ggcgcccgagcgacccgcgg

SEQ ID NO: 156428 - DNA, 20 bp, human
gccgggctgcagccatggta

SEQ ID NO: 156429 - DNA, 20 bp, human
gcagcggtccgcactcgggg

SEQ ID NO: 156430 - DNA, 20 bp, human
gcctgcgctctaggacgaag

SEQ ID NO: 156431 - DNA, 20 bp, human
gccctgtgcccagggtaggt

SEQ ID NO: 156432 - DNA, 20 bp, human
ggacggcggtgctgcgaggt

SEQ ID NO: 156433 - DNA, 20 bp, human
gcgctcgggcgctgtccagg

SEQ ID NO: 156434 - DNA, 20 bp, human
gagctgacccaggcgaggat

SEQ ID NO: 156435 - DNA, 20 bp, human
ggcggctgcaaggggacccg

SEQ ID NO: 156436 - DNA, 20 bp, human
gctctgctggaagatcatgg

SEQ ID NO: 156437 - DNA, 20 bp, human
ggcccctgccagagacagaa

SEQ ID NO: 156438 - DNA, 20 bp, human
ggggctagggatcttcatta

SEQ ID NO: 156439 - DNA, 20 bp, human
ggatggtgctgggttcccgg

SEQ ID NO: 156440 - DNA, 20 bp, human
gcaacaacagcatcaaaaca

SEQ ID NO: 156441 - DNA, 20 bp, human
ggaagggggtcaaagagaaa

SEQ ID NO: 156442 - DNA, 20 bp, human
gccctgtggccccctccatg

SEQ ID NO: 156443 - DNA, 20 bp, human
gtggaagatcatgggggcta

SEQ ID NO: 156444 - DNA, 20 bp, human
gcatggaccgttcactggga

SEQ ID NO: 156445 - DNA, 20 bp, human
ggaggacaggactgaagctg

SEQ ID NO: 156446 - DNA, 20 bp, human
gggtcgacgatcccccgggt

SEQ ID NO: 156447 - DNA, 20 bp, human
gtgtggagagggcggaacgt

SEQ ID NO: 156448 - DNA, 20 bp, human
gaactggccccaagctgtgg

SEQ ID NO: 156449 - DNA, 20 bp, human
ggcgaactggccccaagctg

SEQ ID NO: 156450 - DNA, 20 bp, human
gggtccgcggccccacggtg

SEQ ID NO: 156451 - DNA, 20 bp, human
gtgtggcggcgtcgcagtcc

SEQ ID NO: 156452 - DNA, 20 bp, human
gggccagttcgcccagtcag

SEQ ID NO: 156453 - DNA, 20 bp, human
ggggcacgtcgcctacccgg

SEQ ID NO: 156454 - DNA, 20 bp, human
gcaaggtgcgtgtgtggaga

SEQ ID NO: 156455 - DNA, 20 bp, human
ggggtggacaacgcagccta

SEQ ID NO: 156456 - DNA, 20 bp, human
gggcggggcgcgacgacaag

SEQ ID NO: 156457 - DNA, 20 bp, human
gggggcgcgacgacaagcgg

SEQ ID NO: 156458 - DNA, 20 bp, human
ggcactgcccggctgacaat

SEQ ID NO: 156459 - DNA, 20 bp, human
ggcgcgacgacaagcggcgg

SEQ ID NO: 156460 - DNA, 20 bp, human
gacaatcggtgatcgcgaca

SEQ ID NO: 156461 - DNA, 20 bp, human
gacgtgcggggcgggctcgc

SEQ ID NO: 156462 - DNA, 20 bp, human
gcaaggcgctagtgtcacaa

SEQ ID NO: 156463 - DNA, 20 bp, human
gcggcggccaccatgagcac

SEQ ID NO: 156464 - DNA, 20 bp, human
gccgccggcgggggacgtgc

SEQ ID NO: 156465 - DNA, 20 bp, human
gcaggcgcggcggcactgcc

SEQ ID NO: 156466 - DNA, 20 bp, human
gaccacctggcgagctatat

SEQ ID NO: 156467 - DNA, 20 bp, human
gcaggagccaagggcacggt

SEQ ID NO: 156468 - DNA, 20 bp, human
ggagggctcggcggctccta

SEQ ID NO: 156469 - DNA, 20 bp, human
gctggcggacgcaggagcga

SEQ ID NO: 156470 - DNA, 20 bp, human
ggcagtagctcccgttgcgg

SEQ ID NO: 156471 - DNA, 20 bp, human
gcagggtgccagggacccgg

SEQ ID NO: 156472 - DNA, 20 bp, human
gtgcggtcccgggtcacaac

SEQ ID NO: 156473 - DNA, 20 bp, human
ggccacgggtgccgccgcaa

SEQ ID NO: 156474 - DNA, 20 bp, human
gacatcgcgaggagggcagt

SEQ ID NO: 156475 - DNA, 20 bp, human
gaacgggcagccgtgcgcag

SEQ ID NO: 156476 - DNA, 20 bp, human
gatccgctgctgctgaggag

SEQ ID NO: 156477 - DNA, 20 bp, human
gcgaagctgagactcaccca

SEQ ID NO: 156478 - DNA, 20 bp, human
gagccgctgaccccaagtcg

SEQ ID NO: 156479 - DNA, 20 bp, human
gtccccggccgcatccccgt

SEQ ID NO: 156480 - DNA, 20 bp, human
gcggcagaagtcccctcgtg

SEQ ID NO: 156481 - DNA, 20 bp, human
gaggcccactgccccacgag

SEQ ID NO: 156482 - DNA, 20 bp, human
gctgaggaaaggcgaaggga

SEQ ID NO: 156483 - DNA, 20 bp, human
gggagactgaggaaaggcga

SEQ ID NO: 156484 - DNA, 20 bp, human
gggctgagaccaccacgctc

SEQ ID NO: 156485 - DNA, 20 bp, human
ggcagtgggcctggctagga

SEQ ID NO: 156486 - DNA, 20 bp, human
gtgggctgggacgagcgcag

SEQ ID NO: 156487 - DNA, 20 bp, human
gggcaggtgcgaagatagag

SEQ ID NO: 156488 - DNA, 20 bp, human
ggaaggagcaaagacccgcc

SEQ ID NO: 156489 - DNA, 20 bp, human
gagctccgcaccgggcgggt

SEQ ID NO: 156490 - DNA, 20 bp, human
gtggtcggggtcgcttcctg

SEQ ID NO: 156491 - DNA, 20 bp, human
gtggcgagctccgcaccggg

SEQ ID NO: 156492 - DNA, 20 bp, human
ggccatggcgagctccgcac

SEQ ID NO: 156493 - DNA, 20 bp, human
gcattcagccgcagccgccc

SEQ ID NO: 156494 - DNA, 20 bp, human
gcggctgaatggatccaata

SEQ ID NO: 156495 - DNA, 20 bp, human
gcaaggctaacccctttcgc

SEQ ID NO: 156496 - DNA, 20 bp, human
gcgagcacagggtcctgtga

SEQ ID NO: 156497 - DNA, 20 bp, human
gtacgcgggtgcccctaaca

SEQ ID NO: 156498 - DNA, 20 bp, human
ggtgcagagctagccgccgg

SEQ ID NO: 156499 - DNA, 20 bp, human
ggcgacagcgacctcctcga

SEQ ID NO: 156500 - DNA, 20 bp, human
gacgtgggggaccctgttag

SEQ ID NO: 156501 - DNA, 20 bp, human
ggcccgcgccgcctacgtgg

SEQ ID NO: 156502 - DNA, 20 bp, human
gagggcgcgcagggtctacg

SEQ ID NO: 156503 - DNA, 20 bp, human
gacagggtcccccacgtagg

SEQ ID NO: 156504 - DNA, 20 bp, human
ggcagtgcagagctagccgc

SEQ ID NO: 156505 - DNA, 20 bp, human
ggggggcctaggggctcctc

SEQ ID NO: 156506 - DNA, 20 bp, human
gccgggcgtccgctcctcag

SEQ ID NO: 156507 - DNA, 20 bp, human
gggcttaccaataaacgact

SEQ ID NO: 156508 - DNA, 20 bp, human
gagacctagcgcgtccaggt

SEQ ID NO: 156509 - DNA, 20 bp, human
gcctagcgcgtccaggtggg

SEQ ID NO: 156510 - DNA, 20 bp, human
gtgccacatccgctgaggag

SEQ ID NO: 156511 - DNA, 20 bp, human
ggcgcagacctagcgcgtcc

SEQ ID NO: 156512 - DNA, 20 bp, human
gctaaggctcctccacccta

SEQ ID NO: 156513 - DNA, 20 bp, human
gcggcgagagccatggctcg

SEQ ID NO: 156514 - DNA, 20 bp, human
gactcggacggcgagagcca

SEQ ID NO: 156515 - DNA, 20 bp, human
gggggctgccacatccgctg

SEQ ID NO: 156516 - DNA, 20 bp, human
gcgggagccgcggaaagagt

SEQ ID NO: 156517 - DNA, 20 bp, human
gtagtcacggagagatgagg

SEQ ID NO: 156518 - DNA, 20 bp, human
gagtagggctccccagacaa

SEQ ID NO: 156519 - DNA, 20 bp, human
gcggtagtcacggagagatg

SEQ ID NO: 156520 - DNA, 20 bp, human
gcgagcccgggaagacggac

SEQ ID NO: 156521 - DNA, 20 bp, human
gcggtccgcgcgccagacgg

SEQ ID NO: 156522 - DNA, 20 bp, human
gggctcagaagtgactggtg

SEQ ID NO: 156523 - DNA, 20 bp, human
gcgtcggaccccgttgtctg

SEQ ID NO: 156524 - DNA, 20 bp, human
ggccgccgggtggagggtcc

SEQ ID NO: 156525 - DNA, 20 bp, human
gcggggtccgacgagcagtt

SEQ ID NO: 156526 - DNA, 20 bp, human
gtcggcggcgcgttcctcca

SEQ ID NO: 156527 - DNA, 20 bp, human
gtggccgggccgagagaggg

SEQ ID NO: 156528 - DNA, 20 bp, human
gtcggagctccagaaacaag

SEQ ID NO: 156529 - DNA, 20 bp, human
gaagcaggggcagaatgtgg

SEQ ID NO: 156530 - DNA, 20 bp, human
gagatggccgggccgagaga

SEQ ID NO: 156531 - DNA, 20 bp, human
ggtaaagcaggggcagaatg

SEQ ID NO: 156532 - DNA, 20 bp, human
gggggggccgtcttctcttc

SEQ ID NO: 156533 - DNA, 20 bp, human
gccggatgtgtgcctggcgc

SEQ ID NO: 156534 - DNA, 20 bp, human
gttaagaaagaaggtaaagc

SEQ ID NO: 156535 - DNA, 20 bp, human
gccgctcccggatgtgtgcc

SEQ ID NO: 156536 - DNA, 20 bp, human
ggcacaaactcgcacctgag

SEQ ID NO: 156537 - DNA, 20 bp, human
gggccgtgtccacatctccg

SEQ ID NO: 156538 - DNA, 20 bp, human
gcgttggcggagcagagggg

SEQ ID NO: 156539 - DNA, 20 bp, human
gggccgttggcggagcagag

SEQ ID NO: 156540 - DNA, 20 bp, human
gccaaacaaggaccctcctg

SEQ ID NO: 156541 - DNA, 20 bp, human
gggacacggccgccccagga

SEQ ID NO: 156542 - DNA, 20 bp, human
ggctgttgtcgggcctccag

SEQ ID NO: 156543 - DNA, 20 bp, human
gagtgacgcgccggccatgc

SEQ ID NO: 156544 - DNA, 20 bp, human
gtcaccaccgctgaccggga

SEQ ID NO: 156545 - DNA, 20 bp, human
gcatgccggcggctgttgtc

SEQ ID NO: 156546 - DNA, 20 bp, human
ggcacaaactcgcacctgag

SEQ ID NO: 156547 - DNA, 20 bp, human
gggccgtgtccacatctccg

SEQ ID NO: 156548 - DNA, 20 bp, human
gcgttggcggagcagagggg

SEQ ID NO: 156549 - DNA, 20 bp, human
gggccgttggcggagcagag

SEQ ID NO: 156550 - DNA, 20 bp, human
gccaaacaaggaccctcctg

SEQ ID NO: 156551 - DNA, 20 bp, human
gggacacggccgccccagga

SEQ ID NO: 156552 - DNA, 20 bp, human
ggctgttgtcgggcctccag

SEQ ID NO: 156553 - DNA, 20 bp, human
ggggccatgccgaccaccaa

SEQ ID NO: 156554 - DNA, 20 bp, human
gcggcatggcccgtgagtgg

SEQ ID NO: 156555 - DNA, 20 bp, human
gcatgccggcggctgttgtc

SEQ ID NO: 156556 - DNA, 20 bp, human
gacagaacgaggggacgtaa

SEQ ID NO: 156557 - DNA, 20 bp, human
ggaacgaggggacgtaacgg

SEQ ID NO: 156558 - DNA, 20 bp, human
gtagagaagggaggtcccaa

SEQ ID NO: 156559 - DNA, 20 bp, human
gcgggtcatggcgacggcag

SEQ ID NO: 156560 - DNA, 20 bp, human
gagggtgaacggaaagaaaa

SEQ ID NO: 156561 - DNA, 20 bp, human
gcaacgtccgacagaacgag

SEQ ID NO: 156562 - DNA, 20 bp, human
gggtcccgtgaagtagccgt

SEQ ID NO: 156563 - DNA, 20 bp, human
gaagggggctcggtgctcac

SEQ ID NO: 156564 - DNA, 20 bp, human
gcaaaatacggactagagaa

SEQ ID NO: 156565 - DNA, 20 bp, human
ggcctatgcctaacccggga

SEQ ID NO: 156566 - DNA, 20 bp, human
ggaggatggctgacacgaag

SEQ ID NO: 156567 - DNA, 20 bp, human
ggacccgagagaccagagga

SEQ ID NO: 156568 - DNA, 20 bp, human
gaaagcccaggcgctgtctc

SEQ ID NO: 156569 - DNA, 20 bp, human
gttcagagcggtggaaccgc

SEQ ID NO: 156570 - DNA, 20 bp, human
gcgcgggcgggaaaaagccc

SEQ ID NO: 156571 - DNA, 20 bp, human
gaggaaacaggacaacatcg

SEQ ID NO: 156572 - DNA, 20 bp, human
gcgaggtgagacctaggact

SEQ ID NO: 156573 - DNA, 20 bp, human
gtggagcgcccccagttggt

SEQ ID NO: 156574 - DNA, 20 bp, human
gggaacaagtggagacacca

SEQ ID NO: 156575 - DNA, 20 bp, human
gaggtccagggatttaacag

SEQ ID NO: 156576 - DNA, 20 bp, human
ggacagcgcggagggctcgg

SEQ ID NO: 156577 - DNA, 20 bp, human
gcgcggcgtgggcagttcag

SEQ ID NO: 156578 - DNA, 20 bp, human
gtagcgcctggaagacagcg

SEQ ID NO: 156579 - DNA, 20 bp, human
ggcggccgcgctcttcgcct

SEQ ID NO: 156580 - DNA, 20 bp, human
gtcgggctggagggctctcg

SEQ ID NO: 156581 - DNA, 20 bp, human
gcccggtcccagagctccgt

SEQ ID NO: 156582 - DNA, 20 bp, human
gcgtacccaggcgaagagcg

SEQ ID NO: 156583 - DNA, 20 bp, human
ggcctggaagacagcgcgga

SEQ ID NO: 156584 - DNA, 20 bp, human
ggcctcggaggccgcccccg

SEQ ID NO: 156585 - DNA, 20 bp, human
gctccaggcatcaggagtgt

SEQ ID NO: 156586 - DNA, 20 bp, human
ggcacgctcggctaactcag

SEQ ID NO: 156587 - DNA, 20 bp, human
ggcaggacagcttggagata

SEQ ID NO: 156588 - DNA, 20 bp, human
gcactccctcacgcctggct

SEQ ID NO: 156589 - DNA, 20 bp, human
ggtgacagcagcgcattcgc

SEQ ID NO: 156590 - DNA, 20 bp, human
gcgccgcaccaggtctgacg

SEQ ID NO: 156591 - DNA, 20 bp, human
gagatagggcccggaattgc

SEQ ID NO: 156592 - DNA, 20 bp, human
gtcacgcctggctaggtcgc

SEQ ID NO: 156593 - DNA, 20 bp, human
gtggttgggacagtagaaga

SEQ ID NO: 156594 - DNA, 20 bp, human
gctgctcctgcgacctagcc

SEQ ID NO: 156595 - DNA, 20 bp, human
gcgcaccaggtctgacgggg

SEQ ID NO: 156596 - DNA, 20 bp, human
ggcagcggatacagacaaga

SEQ ID NO: 156597 - DNA, 20 bp, human
gcacaacgtcacaagagcag

SEQ ID NO: 156598 - DNA, 20 bp, human
gatagtaaataatctcggaa

SEQ ID NO: 156599 - DNA, 20 bp, human
ggacagcgttcacgaagcag

SEQ ID NO: 156600 - DNA, 20 bp, human
ggcgcaggccatctctacaa

SEQ ID NO: 156601 - DNA, 20 bp, human
ggctgagtctgagtgacgag

SEQ ID NO: 156602 - DNA, 20 bp, human
gctgagtgacgagaggagac

SEQ ID NO: 156603 - DNA, 20 bp, human
ggggcactccctgttgggtg

SEQ ID NO: 156604 - DNA, 20 bp, human
gtgtggtgccccacccaaca

SEQ ID NO: 156605 - DNA, 20 bp, human
ggtaccccaccgaaggaaag

SEQ ID NO: 156606 - DNA, 20 bp, human
gggcagcgcgagccagactg

SEQ ID NO: 156607 - DNA, 20 bp, human
gccgaggaccgccccaagtg

SEQ ID NO: 156608 - DNA, 20 bp, human
ggagagactgagggacggac

SEQ ID NO: 156609 - DNA, 20 bp, human
gccgggagccgccgccatgg

SEQ ID NO: 156610 - DNA, 20 bp, human
ggtctctccaggtcccagga

SEQ ID NO: 156611 - DNA, 20 bp, human
ggccgagtgaaggtccagga

SEQ ID NO: 156612 - DNA, 20 bp, human
ggccagactgaggacggtaa

SEQ ID NO: 156613 - DNA, 20 bp, human
ggggaccgcagagagactga

SEQ ID NO: 156614 - DNA, 20 bp, human
ggccctcctggaccttcact

SEQ ID NO: 156615 - DNA, 20 bp, human
gccgcacccgcctcactcga

SEQ ID NO: 156616 - DNA, 20 bp, human
gctagtcaggaagcctcgca

SEQ ID NO: 156617 - DNA, 20 bp, human
ggaccggccacctccatcac

SEQ ID NO: 156618 - DNA, 20 bp, human
gtgactccccagaaacatga

SEQ ID NO: 156619 - DNA, 20 bp, human
gaggctgctttctaacacgg

SEQ ID NO: 156620 - DNA, 20 bp, human
gcccatggtgacgccagtga

SEQ ID NO: 156621 - DNA, 20 bp, human
gcgttccccgaggaacccgg

SEQ ID NO: 156622 - DNA, 20 bp, human
ggccacctagaactaaatga

SEQ ID NO: 156623 - DNA, 20 bp, human
gccgcctaagctggacctga

SEQ ID NO: 156624 - DNA, 20 bp, human
ggttcctcggggaacggaag

SEQ ID NO: 156625 - DNA, 20 bp, human
gaatgacagctcccagcgag

SEQ ID NO: 156626 - DNA, 20 bp, human
gcgggcagaatggagacgtc

SEQ ID NO: 156627 - DNA, 20 bp, human
gtccagttctagaagcttca

SEQ ID NO: 156628 - DNA, 20 bp, human
gcttaggtccaccagatgga

SEQ ID NO: 156629 - DNA, 20 bp, human
ggaacggagttccctgaggt

SEQ ID NO: 156630 - DNA, 20 bp, human
gaacacagtggcagtccaat

SEQ ID NO: 156631 - DNA, 20 bp, human
gaacactgtacaaacccgaa

SEQ ID NO: 156632 - DNA, 20 bp, human
gtcgggttaggtctgagaga

SEQ ID NO: 156633 - DNA, 20 bp, human
gtaggcttaggtccaccaga

SEQ ID NO: 156634 - DNA, 20 bp, human
gggttgaacggagttccctg

SEQ ID NO: 156635 - DNA, 20 bp, human
ggcttctgtcctcagcccat

SEQ ID NO: 156636 - DNA, 20 bp, human
ggccggacgggaagaccccg

SEQ ID NO: 156637 - DNA, 20 bp, human
gagcccgagaggctaccccg

SEQ ID NO: 156638 - DNA, 20 bp, human
gaggatcccgactgctccag

SEQ ID NO: 156639 - DNA, 20 bp, human
ggcgcctaggcgcttcgccg

SEQ ID NO: 156640 - DNA, 20 bp, human
gttcgttcaagtgtgagctg

SEQ ID NO: 156641 - DNA, 20 bp, human
gcagcctcggcgaagcgcct

SEQ ID NO: 156642 - DNA, 20 bp, human
gcttgaacgaagatcagcct

SEQ ID NO: 156643 - DNA, 20 bp, human
ggctccacgcggagtcccgg

SEQ ID NO: 156644 - DNA, 20 bp, human
gcccgctccacgcggagtcc

SEQ ID NO: 156645 - DNA, 20 bp, human
ggcaagaggcgacacgcccc

SEQ ID NO: 156646 - DNA, 20 bp, human
gaacccaaagtagatcgagg

SEQ ID NO: 156647 - DNA, 20 bp, human
gccgaacccaaagtagatcg

SEQ ID NO: 156648 - DNA, 20 bp, human
gcgtgagcgcggagtgaaag

SEQ ID NO: 156649 - DNA, 20 bp, human
gagcgcggagtgaaagagga

SEQ ID NO: 156650 - DNA, 20 bp, human
ggtccgtctagtgctgacgt

SEQ ID NO: 156651 - DNA, 20 bp, human
gctcgcagcggctccagagg

SEQ ID NO: 156652 - DNA, 20 bp, human
gcgtcgccaagacctcggta

SEQ ID NO: 156653 - DNA, 20 bp, human
ggaagatggtcgccaagcaa

SEQ ID NO: 156654 - DNA, 20 bp, human
gggcaacgtcgccaagacct

SEQ ID NO: 156655 - DNA, 20 bp, human
gcacgagccgagcctcgcag

SEQ ID NO: 156656 - DNA, 20 bp, human
ggctagccgactccagagag

SEQ ID NO: 156657 - DNA, 20 bp, human
gagagaggccgcagcccgga

SEQ ID NO: 156658 - DNA, 20 bp, human
gctctggagtcggctagccg

SEQ ID NO: 156659 - DNA, 20 bp, human
ggaggggccacgaccaacca

SEQ ID NO: 156660 - DNA, 20 bp, human
gagccatggtggccaaacag

SEQ ID NO: 156661 - DNA, 20 bp, human
ggtctgcttggcgtcctcgt

SEQ ID NO: 156662 - DNA, 20 bp, human
gctgcaggaccccgcagaag

SEQ ID NO: 156663 - DNA, 20 bp, human
gccacctgcagcgcccgggt

SEQ ID NO: 156664 - DNA, 20 bp, human
gcctctgggagtggctacct

SEQ ID NO: 156665 - DNA, 20 bp, human
gtgagagattacttccgtcc

SEQ ID NO: 156666 - DNA, 20 bp, human
gcagaacctctcgcagtgaa

SEQ ID NO: 156667 - DNA, 20 bp, human
gattcactgtcccaggtcag

SEQ ID NO: 156668 - DNA, 20 bp, human
gactgcgagaggttctggag

SEQ ID NO: 156669 - DNA, 20 bp, human
ggtggtggtgcctgaagctg

SEQ ID NO: 156670 - DNA, 20 bp, human
ggagaggtggtgaggcttat

SEQ ID NO: 156671 - DNA, 20 bp, human
gcagctcctctgtctgtcgg

SEQ ID NO: 156672 - DNA, 20 bp, human
gaaacaggacacaaccctca

SEQ ID NO: 156673 - DNA, 20 bp, human
gcttataggagacaacagac

SEQ ID NO: 156674 - DNA, 20 bp, human
gcaccaggaggtaccgaggg

SEQ ID NO: 156675 - DNA, 20 bp, human
ggaggtaccgaggggggacc

SEQ ID NO: 156676 - DNA, 20 bp, human
gctgaaccaagaaggaggag

SEQ ID NO: 156677 - DNA, 20 bp, human
ggaagggagctcagagagaa

SEQ ID NO: 156678 - DNA, 20 bp, human
ggcagcggctaggccttcct

SEQ ID NO: 156679 - DNA, 20 bp, human
ggcggctaggccttcctcgg

SEQ ID NO: 156680 - DNA, 20 bp, human
gccgctgcctgaaaggaggg

SEQ ID NO: 156681 - DNA, 20 bp, human
gacagcagggcttagagtgg

SEQ ID NO: 156682 - DNA, 20 bp, human
ggccagctcaggggaaggac

SEQ ID NO: 156683 - DNA, 20 bp, human
gaatgcccaggagctaccga

SEQ ID NO: 156684 - DNA, 20 bp, human
gggttgccgcccctccaacc

SEQ ID NO: 156685 - DNA, 20 bp, human
ggacaggggccctgaagcca

SEQ ID NO: 156686 - DNA, 20 bp, human
gaggacccaaggccacacac

SEQ ID NO: 156687 - DNA, 20 bp, human
gcacactggtaagaggcagt

SEQ ID NO: 156688 - DNA, 20 bp, human
gagacagaacctgggcagta

SEQ ID NO: 156689 - DNA, 20 bp, human
gaccttcctagacagaacct

SEQ ID NO: 156690 - DNA, 20 bp, human
gtcctggcctagactccaaa

SEQ ID NO: 156691 - DNA, 20 bp, human
ggcccaggttctgtctagga

SEQ ID NO: 156692 - DNA, 20 bp, human
gggcgaattatagacacaag

SEQ ID NO: 156693 - DNA, 20 bp, human
gttactccggcagtgagtgg

SEQ ID NO: 156694 - DNA, 20 bp, human
gtcacgttggagcccgccca

SEQ ID NO: 156695 - DNA, 20 bp, human
ggtaagaggcagtgggttac

SEQ ID NO: 156696 - DNA, 20 bp, human
ggtgcttaggagctctggtc

SEQ ID NO: 156697 - DNA, 20 bp, human
gcaagccgcctggtgagagc

SEQ ID NO: 156698 - DNA, 20 bp, human
gaagactcagagggagtaca

SEQ ID NO: 156699 - DNA, 20 bp, human
gttgcctgtgcccaaaatga

SEQ ID NO: 156700 - DNA, 20 bp, human
gtgatgcagtgctgaagacc

SEQ ID NO: 156701 - DNA, 20 bp, human
gaaagggtgcttaggagctc

SEQ ID NO: 156702 - DNA, 20 bp, human
gtggctttgatggtaaggat

SEQ ID NO: 156703 - DNA, 20 bp, human
gaccattttcctgtgggtag

SEQ ID NO: 156704 - DNA, 20 bp, human
gtactccctctgagtcttaa

SEQ ID NO: 156705 - DNA, 20 bp, human
gctgtgcccaaaatgagggc

SEQ ID NO: 156706 - DNA, 20 bp, human
ggtgtatgggcaggtgatgg

SEQ ID NO: 156707 - DNA, 20 bp, human
gaggggtggacccaaattgg

SEQ ID NO: 156708 - DNA, 20 bp, human
gtccacagggagagctccca

SEQ ID NO: 156709 - DNA, 20 bp, human
gacaatgagctggcgtgtat

SEQ ID NO: 156710 - DNA, 20 bp, human
gggcgtgtatgggcaggtga

SEQ ID NO: 156711 - DNA, 20 bp, human
gagaagtcttgggacataag

SEQ ID NO: 156712 - DNA, 20 bp, human
gtgtagcactgtccacaggt

SEQ ID NO: 156713 - DNA, 20 bp, human
gatggcctcttggaagagta

SEQ ID NO: 156714 - DNA, 20 bp, human
gtgagctggcgtgtatgggc

SEQ ID NO: 156715 - DNA, 20 bp, human
gtcacacacaaggatgactg

SEQ ID NO: 156716 - DNA, 20 bp, human
gaaaaggcacagggaatcag

SEQ ID NO: 156717 - DNA, 20 bp, human
gagcaggtccctctgagcag

SEQ ID NO: 156718 - DNA, 20 bp, human
ggcctgtggcctctgctcag

SEQ ID NO: 156719 - DNA, 20 bp, human
gagaccctgaaatcatggtg

SEQ ID NO: 156720 - DNA, 20 bp, human
gtcatggattacctgcctca

SEQ ID NO: 156721 - DNA, 20 bp, human
gaatgaccatagaggcccca

SEQ ID NO: 156722 - DNA, 20 bp, human
gcagaggatgcctctaaaaa

SEQ ID NO: 156723 - DNA, 20 bp, human
ggctgtgcatctgaccctca

SEQ ID NO: 156724 - DNA, 20 bp, human
gtactccagacagacggctt

SEQ ID NO: 156725 - DNA, 20 bp, human
ggcagccaagaacagacccc

SEQ ID NO: 156726 - DNA, 20 bp, human
gattatgggcccccagagac

SEQ ID NO: 156727 - DNA, 20 bp, human
gggcggtggagatgctcagt

SEQ ID NO: 156728 - DNA, 20 bp, human
gctgctggacaggttcacgg

SEQ ID NO: 156729 - DNA, 20 bp, human
gctggcttggggttcagaag

SEQ ID NO: 156730 - DNA, 20 bp, human
gcctttgagaatctctgtca

SEQ ID NO: 156731 - DNA, 20 bp, human
gaacctcacggagacttctg

SEQ ID NO: 156732 - DNA, 20 bp, human
gcgtgaagaatggaactagg

SEQ ID NO: 156733 - DNA, 20 bp, human
gttgagaatctctgtcaggg

SEQ ID NO: 156734 - DNA, 20 bp, human
gtgcctcagaagtctccgtg

SEQ ID NO: 156735 - DNA, 20 bp, human
gtcgcagacaatgatggtcc

SEQ ID NO: 156736 - DNA, 20 bp, human
gggagaccagattttccaag

SEQ ID NO: 156737 - DNA, 20 bp, human
ggagggggtgaaccaacttc

SEQ ID NO: 156738 - DNA, 20 bp, human
gagctgagacagccacccag

SEQ ID NO: 156739 - DNA, 20 bp, human
gtgtctcagggggttactca

SEQ ID NO: 156740 - DNA, 20 bp, human
gtggagacgagagactctag

SEQ ID NO: 156741 - DNA, 20 bp, human
ggacgagagactctagaggg

SEQ ID NO: 156742 - DNA, 20 bp, human
ggtcctggagtggaccccct

SEQ ID NO: 156743 - DNA, 20 bp, human
gtctgcaagggtctaggtca

SEQ ID NO: 156744 - DNA, 20 bp, human
gcacccagggggtccactcc

SEQ ID NO: 156745 - DNA, 20 bp, human
ggatccctccaactgctgag

SEQ ID NO: 156746 - DNA, 20 bp, human
gagtccctcgggctcagaaa

SEQ ID NO: 156747 - DNA, 20 bp, human
gccgcaaagggaggtcccca

SEQ ID NO: 156748 - DNA, 20 bp, human
ggttgccacaactggaaggg

SEQ ID NO: 156749 - DNA, 20 bp, human
gctgtgtgcacactcagcta

SEQ ID NO: 156750 - DNA, 20 bp, human
gcacatgccctcaagccctg

SEQ ID NO: 156751 - DNA, 20 bp, human
gctgccctttctgagcccga

SEQ ID NO: 156752 - DNA, 20 bp, human
gggctctgccagagttagtg

SEQ ID NO: 156753 - DNA, 20 bp, human
gataaggtcacagagctcgg

SEQ ID NO: 156754 - DNA, 20 bp, human
gcttcagtcacaccatccag

SEQ ID NO: 156755 - DNA, 20 bp, human
gtaagtaccgatgccgcaaa

SEQ ID NO: 156756 - DNA, 20 bp, human
gagctgagacagccacccag

SEQ ID NO: 156757 - DNA, 20 bp, human
gtgtctcagggggttactca

SEQ ID NO: 156758 - DNA, 20 bp, human
gtggagacgagagactctag

SEQ ID NO: 156759 - DNA, 20 bp, human
ggacgagagactctagaggg

SEQ ID NO: 156760 - DNA, 20 bp, human
ggtcctggagtggaccccct

SEQ ID NO: 156761 - DNA, 20 bp, human
gcacccagggggtccactcc

SEQ ID NO: 156762 - DNA, 20 bp, human
gtctgcaagggtctaggtca

SEQ ID NO: 156763 - DNA, 20 bp, human
ggatccctccaactgctgag

SEQ ID NO: 156764 - DNA, 20 bp, human
gacacacagctggtacaggg

SEQ ID NO: 156765 - DNA, 20 bp, human
gagggtccatgggcactggt

SEQ ID NO: 156766 - DNA, 20 bp, human
gcgcggccagcatccttcat

SEQ ID NO: 156767 - DNA, 20 bp, human
gaggtgttactcacagtctg

SEQ ID NO: 156768 - DNA, 20 bp, human
gcctcccaggccctgacccg

SEQ ID NO: 156769 - DNA, 20 bp, human
gtgttactcacagtctgcgg

SEQ ID NO: 156770 - DNA, 20 bp, human
gcagtcggcaccaccgatga

SEQ ID NO: 156771 - DNA, 20 bp, human
gggccagcatccttcatcgg

SEQ ID NO: 156772 - DNA, 20 bp, human
gggcagccagcagtgttatg

SEQ ID NO: 156773 - DNA, 20 bp, human
ggcttactgtacacatgcta

SEQ ID NO: 156774 - DNA, 20 bp, human
gacaatgcatctgctccagt

SEQ ID NO: 156775 - DNA, 20 bp, human
gggatgactcacagactccg

SEQ ID NO: 156776 - DNA, 20 bp, human
gggaggctatgattattccc

SEQ ID NO: 156777 - DNA, 20 bp, human
ggagtcccaaataaccaagt

SEQ ID NO: 156778 - DNA, 20 bp, human
gtggatagagtggtgaacaa

SEQ ID NO: 156779 - DNA, 20 bp, human
gatatggagattggatagag

SEQ ID NO: 156780 - DNA, 20 bp, human
gtcatgcttcattagatatg

SEQ ID NO: 156781 - DNA, 20 bp, human
ggggttggtatggaggatat

SEQ ID NO: 156782 - DNA, 20 bp, human
gaggggtgaaggtctaagtg

SEQ ID NO: 156783 - DNA, 20 bp, human
gacaaagggggttggtatgg

SEQ ID NO: 156784 - DNA, 20 bp, human
gcttgccaacttggttattt

SEQ ID NO: 156785 - DNA, 20 bp, human
gggactctgacttgccaact

SEQ ID NO: 156786 - DNA, 20 bp, human
gcaccaaccatgcaaggaca

SEQ ID NO: 156787 - DNA, 20 bp, human
gaccaagtaagcaagtgtca

SEQ ID NO: 156788 - DNA, 20 bp, human
ggaacctgcaaaggtgggta

SEQ ID NO: 156789 - DNA, 20 bp, human
gaagaggaacctgcaaaggt

SEQ ID NO: 156790 - DNA, 20 bp, human
gagggctcaccaaccatgca

SEQ ID NO: 156791 - DNA, 20 bp, human
ggctgctagaagcaaatgag

SEQ ID NO: 156792 - DNA, 20 bp, human
gggggaggagtattgaaata

SEQ ID NO: 156793 - DNA, 20 bp, human
gtgcagagagatcgggaatg

SEQ ID NO: 156794 - DNA, 20 bp, human
gagtgagtgagttggaggta

SEQ ID NO: 156795 - DNA, 20 bp, human
gctgatccagtccttccctc

SEQ ID NO: 156796 - DNA, 20 bp, human
ggtaaggccgggcctcggag

SEQ ID NO: 156797 - DNA, 20 bp, human
gcttacccgacaggccgccg

SEQ ID NO: 156798 - DNA, 20 bp, human
ggctgggtgcgaggtcagga

SEQ ID NO: 156799 - DNA, 20 bp, human
gaggccgccgaggcacgctc

SEQ ID NO: 156800 - DNA, 20 bp, human
gcgtgcctcggcggcctgtc

SEQ ID NO: 156801 - DNA, 20 bp, human
gagcccggagcgtgcctcgg

SEQ ID NO: 156802 - DNA, 20 bp, human
gaggtcgtctgtctccgtcg

SEQ ID NO: 156803 - DNA, 20 bp, human
gaggcccggccttacccgac

SEQ ID NO: 156804 - DNA, 20 bp, human
gggcgggggcgggggatcag

SEQ ID NO: 156805 - DNA, 20 bp, human
gccgagctgggtgcgaggtc

SEQ ID NO: 156806 - DNA, 20 bp, human
gtctcccactggagcagaat

SEQ ID NO: 156807 - DNA, 20 bp, human
gttgccaattctgctccagt

SEQ ID NO: 156808 - DNA, 20 bp, human
gctcctgtagtaagagattg

SEQ ID NO: 156809 - DNA, 20 bp, human
gagccacaatctcttactac

SEQ ID NO: 156810 - DNA, 20 bp, human
gtttatgtatctgtcaacat

SEQ ID NO: 156811 - DNA, 20 bp, human
ggagcttggcaccctgaatt

SEQ ID NO: 156812 - DNA, 20 bp, human
ggatacataaatgtgactgg

SEQ ID NO: 156813 - DNA, 20 bp, human
gtgtactagaaaaagggata

SEQ ID NO: 156814 - DNA, 20 bp, human
gctaaagagttgaagggttt

SEQ ID NO: 156815 - DNA, 20 bp, human
ggaagtttgtactagaaaaa

SEQ ID NO: 156816 - DNA, 20 bp, human
ggaagtgtgtcaatacacag

SEQ ID NO: 156817 - DNA, 20 bp, human
gagtagtgaagttcacagag

SEQ ID NO: 156818 - DNA, 20 bp, human
gcaacacatagcaattaata

SEQ ID NO: 156819 - DNA, 20 bp, human
gagtaagttaagatcttcta

SEQ ID NO: 156820 - DNA, 20 bp, human
gacagagtggcaagttagac

SEQ ID NO: 156821 - DNA, 20 bp, human
gtttaaatgcacactatcaa

SEQ ID NO: 156822 - DNA, 20 bp, human
ggctgtgcttgttgtcaaag

SEQ ID NO: 156823 - DNA, 20 bp, human
gtggagctgcgtccctcaaa

SEQ ID NO: 156824 - DNA, 20 bp, human
gaagctagtcatgcatgctg

SEQ ID NO: 156825 - DNA, 20 bp, human
gtgcataatgaaccaaatga

SEQ ID NO: 156826 - DNA, 20 bp, human
gcccaagcgtaccataccaa

SEQ ID NO: 156827 - DNA, 20 bp, human
gttgaggagcaccctaaaga

SEQ ID NO: 156828 - DNA, 20 bp, human
gatgaggtacgtgtccacta

SEQ ID NO: 156829 - DNA, 20 bp, human
gtccactagggtgctacaca

SEQ ID NO: 156830 - DNA, 20 bp, human
gtacacagggtcctaaactc

SEQ ID NO: 156831 - DNA, 20 bp, human
gtcagaccctaatcccactt

SEQ ID NO: 156832 - DNA, 20 bp, human
gcagggtgcaataagcccct

SEQ ID NO: 156833 - DNA, 20 bp, human
gtcccacttaggcaagccaa

SEQ ID NO: 156834 - DNA, 20 bp, human
gtgctcctcaacttcatgtc

SEQ ID NO: 156835 - DNA, 20 bp, human
gctctcagctgcccttggta

SEQ ID NO: 156836 - DNA, 20 bp, human
gggtggctgggcaacgaact

SEQ ID NO: 156837 - DNA, 20 bp, human
gccgtctctccaaaaacccg

SEQ ID NO: 156838 - DNA, 20 bp, human
gatctctgcaaggaaacctg

SEQ ID NO: 156839 - DNA, 20 bp, human
gcaagggctcatccccgcta

SEQ ID NO: 156840 - DNA, 20 bp, human
gaaaaggccccaaagtatgt

SEQ ID NO: 156841 - DNA, 20 bp, human
gcaaaataagaacttacctc

SEQ ID NO: 156842 - DNA, 20 bp, human
gcattgttctcaaaatacag

SEQ ID NO: 156843 - DNA, 20 bp, human
gaccactgctgaagcagatg

SEQ ID NO: 156844 - DNA, 20 bp, human
gtgtggagaactataaatta

SEQ ID NO: 156845 - DNA, 20 bp, human
gttggagagacggtggtggc

SEQ ID NO: 156846 - DNA, 20 bp, human
ggaataaccagagaacaacc

SEQ ID NO: 156847 - DNA, 20 bp, human
ggaaatacctggttgttctc

SEQ ID NO: 156848 - DNA, 20 bp, human
ggttcagacatggtaatgac

SEQ ID NO: 156849 - DNA, 20 bp, human
gagggcgagtaaaatttaag

SEQ ID NO: 156850 - DNA, 20 bp, human
gagttgttacagttcagaca

SEQ ID NO: 156851 - DNA, 20 bp, human
gatgctacaaaggtatttgt

SEQ ID NO: 156852 - DNA, 20 bp, human
ggatgtggggtgtttgtaga

SEQ ID NO: 156853 - DNA, 20 bp, human
ggttttggttaatgctacaa

SEQ ID NO: 156854 - DNA, 20 bp, human
gtctattaataccagcatga

SEQ ID NO: 156855 - DNA, 20 bp, human
ggttttgacactaaatttga

SEQ ID NO: 156856 - DNA, 20 bp, human
gtggtctacatgggctccag

SEQ ID NO: 156857 - DNA, 20 bp, human
ggtggacgagatgctccatg

SEQ ID NO: 156858 - DNA, 20 bp, human
gaggagttaggagacagtgg

SEQ ID NO: 156859 - DNA, 20 bp, human
gcgagatgctccatggggag

SEQ ID NO: 156860 - DNA, 20 bp, human
gctacagttgagggattcgg

SEQ ID NO: 156861 - DNA, 20 bp, human
gtaaaactgaatgagataat

SEQ ID NO: 156862 - DNA, 20 bp, human
gtggagcatctcgtccacca

SEQ ID NO: 156863 - DNA, 20 bp, human
gatctcgtccaccatggcca

SEQ ID NO: 156864 - DNA, 20 bp, human
gggcagcaccgaagaccaga

SEQ ID NO: 156865 - DNA, 20 bp, human
gaccttggccatctggtctt

SEQ ID NO: 156866 - DNA, 20 bp, human
gttcattgctggctacacta

SEQ ID NO: 156867 - DNA, 20 bp, human
gtgctggctacactagggct

SEQ ID NO: 156868 - DNA, 20 bp, human
gagccagcaatgaaggaaag

SEQ ID NO: 156869 - DNA, 20 bp, human
gtaaaaacactaattttgtg

SEQ ID NO: 156870 - DNA, 20 bp, human
gaccctctttccttcattgc

SEQ ID NO: 156871 - DNA, 20 bp, human
gggctacactagggctaggt

SEQ ID NO: 156872 - DNA, 20 bp, human
gctcttacctgtgttcctag

SEQ ID NO: 156873 - DNA, 20 bp, human
gtcatgttattaagctggag

SEQ ID NO: 156874 - DNA, 20 bp, human
gacactagggctaggtagga

SEQ ID NO: 156875 - DNA, 20 bp, human
gtgtgtgtctgtggaatgaa

SEQ ID NO: 156876 - DNA, 20 bp, human
gtattaatgtcctaattaga

SEQ ID NO: 156877 - DNA, 20 bp, human
gtgctggttacactagagct

SEQ ID NO: 156878 - DNA, 20 bp, human
gaatgaaagaaagataaaga

SEQ ID NO: 156879 - DNA, 20 bp, human
gggttacactagagctaggt

SEQ ID NO: 156880 - DNA, 20 bp, human
gctcttacctgtgttcctag

SEQ ID NO: 156881 - DNA, 20 bp, human
gtcatgttattaagctggag

SEQ ID NO: 156882 - DNA, 20 bp, human
gtgtgtgtctgtggaatgaa

SEQ ID NO: 156883 - DNA, 20 bp, human
gacactagagctaggtagga

SEQ ID NO: 156884 - DNA, 20 bp, human
gggcacttttaggaacacag

SEQ ID NO: 156885 - DNA, 20 bp, human
gcttagttccaagtaaacca

SEQ ID NO: 156886 - DNA, 20 bp, human
gtgtggaggcgaccgtgtct

SEQ ID NO: 156887 - DNA, 20 bp, human
ggagcacaaagacctggatg

SEQ ID NO: 156888 - DNA, 20 bp, human
ggtgcaaccgtgattcacgg

SEQ ID NO: 156889 - DNA, 20 bp, human
gggggtgcaaccgtgattca

SEQ ID NO: 156890 - DNA, 20 bp, human
ggaaaaggaacaggcaagcg

SEQ ID NO: 156891 - DNA, 20 bp, human
gactccaggtaagcaaggtg

SEQ ID NO: 156892 - DNA, 20 bp, human
gtaagcaaggtggggtagca

SEQ ID NO: 156893 - DNA, 20 bp, human
ggtgtggtacccgcaaactg

SEQ ID NO: 156894 - DNA, 20 bp, human
gcctggaaaatgcgtggaaa

SEQ ID NO: 156895 - DNA, 20 bp, human
gggaggttttggtggtagag

SEQ ID NO: 156896 - DNA, 20 bp, human
gcccaagccggacgctcgcc

SEQ ID NO: 156897 - DNA, 20 bp, human
gcccttccggagcctcgcag

SEQ ID NO: 156898 - DNA, 20 bp, human
ggcctcgcagcggcagagaa

SEQ ID NO: 156899 - DNA, 20 bp, human
gcgatcgtctccacaggtct

SEQ ID NO: 156900 - DNA, 20 bp, human
ggagcgagcgagcagaacgg

SEQ ID NO: 156901 - DNA, 20 bp, human
gccgcccggctcctaacacc

SEQ ID NO: 156902 - DNA, 20 bp, human
gacctgtggagacgatcgtg

SEQ ID NO: 156903 - DNA, 20 bp, human
gctcgggtccgcggcgtcac

SEQ ID NO: 156904 - DNA, 20 bp, human
gttcaggtcgcccagacctg

SEQ ID NO: 156905 - DNA, 20 bp, human
gacagagcggtaaggagatc

SEQ ID NO: 156906 - DNA, 20 bp, human
gtaccttactgtcttcatag

SEQ ID NO: 156907 - DNA, 20 bp, human
gctgtcttcatagaggaagt

SEQ ID NO: 156908 - DNA, 20 bp, human
gaggaagttggccgctggtt

SEQ ID NO: 156909 - DNA, 20 bp, human
gtcatagacaagctgtaagg

SEQ ID NO: 156910 - DNA, 20 bp, human
gttcctctatgaagacagta

SEQ ID NO: 156911 - DNA, 20 bp, human
gcatagaggaagttggccgc

SEQ ID NO: 156912 - DNA, 20 bp, human
gctggccagactttaaatta

SEQ ID NO: 156913 - DNA, 20 bp, human
gagaggaccattatccgatc

SEQ ID NO: 156914 - DNA, 20 bp, human
gatgccttaaataagaacac

SEQ ID NO: 156915 - DNA, 20 bp, human
gctgatttaagtggtgtcat

SEQ ID NO: 156916 - DNA, 20 bp, human
gggcctctgagcatgatcat

SEQ ID NO: 156917 - DNA, 20 bp, human
gggccaatgatcatgctcag

SEQ ID NO: 156918 - DNA, 20 bp, human
gagttttaaaggctgtccaa

SEQ ID NO: 156919 - DNA, 20 bp, human
gtccaggtcgcctccttgga

SEQ ID NO: 156920 - DNA, 20 bp, human
gtccctccaaggaggcgacc

SEQ ID NO: 156921 - DNA, 20 bp, human
gccagaaaagcatccctcca

SEQ ID NO: 156922 - DNA, 20 bp, human
gagttcactaacgaatctca

SEQ ID NO: 156923 - DNA, 20 bp, human
ggatgaaggagagcttcgaa

SEQ ID NO: 156924 - DNA, 20 bp, human
gtctgagaattcagttttaa

SEQ ID NO: 156925 - DNA, 20 bp, human
ggcttattgatgagtagacc

SEQ ID NO: 156926 - DNA, 20 bp, human
gcgtgaagcatctacaaagg

SEQ ID NO: 156927 - DNA, 20 bp, human
gatagtcaaagcagcagcgg

SEQ ID NO: 156928 - DNA, 20 bp, human
ggaagccttgccctcaatca

SEQ ID NO: 156929 - DNA, 20 bp, human
gatcagagcgaggcaaaggc

SEQ ID NO: 156930 - DNA, 20 bp, human
ggcccagacccgccctgaat

SEQ ID NO: 156931 - DNA, 20 bp, human
gaggggcagcttcctattca

SEQ ID NO: 156932 - DNA, 20 bp, human
gcccgcccggtacctggcag

SEQ ID NO: 156933 - DNA, 20 bp, human
ggtcaccccccgctcccatc

SEQ ID NO: 156934 - DNA, 20 bp, human
ggcctctgccaggtaccggg

SEQ ID NO: 156935 - DNA, 20 bp, human
gaacagacgctccctctcca

SEQ ID NO: 156936 - DNA, 20 bp, human
gaggccctagcgggagtccg

SEQ ID NO: 156937 - DNA, 20 bp, human
ggagcgcggcacggagacgg

SEQ ID NO: 156938 - DNA, 20 bp, human
gccgagactggtgactgtaa

SEQ ID NO: 156939 - DNA, 20 bp, human
ggcggcagcgctggactagg

SEQ ID NO: 156940 - DNA, 20 bp, human
ggttgctgaccccaccgaga

SEQ ID NO: 156941 - DNA, 20 bp, human
gtcgccgcggactcccgcta

SEQ ID NO: 156942 - DNA, 20 bp, human
gtcggagcgcggcacggaga

SEQ ID NO: 156943 - DNA, 20 bp, human
gcaccgagtgatgggaccgg

SEQ ID NO: 156944 - DNA, 20 bp, human
gcagcgaggagacatccggg

SEQ ID NO: 156945 - DNA, 20 bp, human
gagtgatgggaccggaggac

SEQ ID NO: 156946 - DNA, 20 bp, human
gggagtgaggaggtcctcat

SEQ ID NO: 156947 - DNA, 20 bp, human
gcagcactcacgggatccag

SEQ ID NO: 156948 - DNA, 20 bp, human
gtggccgctaatcttccaca

SEQ ID NO: 156949 - DNA, 20 bp, human
ggtggagatagtgtgatctg

SEQ ID NO: 156950 - DNA, 20 bp, human
gcagccctgtggaagattag

SEQ ID NO: 156951 - DNA, 20 bp, human
gggagtggggtggatctgag

SEQ ID NO: 156952 - DNA, 20 bp, human
gaggtcacaaaacccagtag

SEQ ID NO: 156953 - DNA, 20 bp, human
ggctccaaggggaatcccca

SEQ ID NO: 156954 - DNA, 20 bp, human
gcttaggctagggacccaag

SEQ ID NO: 156955 - DNA, 20 bp, human
gatccaggggacgctccaag

SEQ ID NO: 156956 - DNA, 20 bp, human
gccacttctcagaaacacag

SEQ ID NO: 156957 - DNA, 20 bp, human
gcagaaacacagaggtaagt

SEQ ID NO: 156958 - DNA, 20 bp, human
ggagttgacaaacttagaat

SEQ ID NO: 156959 - DNA, 20 bp, human
gaagcagccaaggtcatcag

SEQ ID NO: 156960 - DNA, 20 bp, human
gttgtcaactctcccaacaa

SEQ ID NO: 156961 - DNA, 20 bp, human
gatttttggtgtttacggat

SEQ ID NO: 156962 - DNA, 20 bp, human
gttgtgtcagttccattgtt

SEQ ID NO: 156963 - DNA, 20 bp, human
gtattaaaggttagaggggc

SEQ ID NO: 156964 - DNA, 20 bp, human
gcctgaagtattagtattaa

SEQ ID NO: 156965 - DNA, 20 bp, human
ggggaaaatacccaagagca

SEQ ID NO: 156966 - DNA, 20 bp, human
gtaagcccgaagtaagaggt

SEQ ID NO: 156967 - DNA, 20 bp, human
gccacatctggtataaaagg

SEQ ID NO: 156968 - DNA, 20 bp, human
gagagggactgagagagtca

SEQ ID NO: 156969 - DNA, 20 bp, human
gaatagcgggggatcatgga

SEQ ID NO: 156970 - DNA, 20 bp, human
ggccttaagcccgaagtaag

SEQ ID NO: 156971 - DNA, 20 bp, human
gtctcctgcagtcaccccta

SEQ ID NO: 156972 - DNA, 20 bp, human
gctagggcagggtcgaccca

SEQ ID NO: 156973 - DNA, 20 bp, human
gctgctggaggggggcgtgt

SEQ ID NO: 156974 - DNA, 20 bp, human
gcccgaagtaagaggttgga

SEQ ID NO: 156975 - DNA, 20 bp, human
gtcatggagggaggagattc

SEQ ID NO: 156976 - DNA, 20 bp, human
ggagggtcacagccggaaag

SEQ ID NO: 156977 - DNA, 20 bp, human
gatcactggacgccaccccg

SEQ ID NO: 156978 - DNA, 20 bp, human
ggtcggaggacgcagccaag

SEQ ID NO: 156979 - DNA, 20 bp, human
gtcccagctgcgggtatcac

SEQ ID NO: 156980 - DNA, 20 bp, human
gcagcgagcgcggtgagtac

SEQ ID NO: 156981 - DNA, 20 bp, human
gcctgcccgggtcccgctcg

SEQ ID NO: 156982 - DNA, 20 bp, human
gccggccgggcgcaaggtca

SEQ ID NO: 156983 - DNA, 20 bp, human
gactggacgccaccccgggg

SEQ ID NO: 156984 - DNA, 20 bp, human
ggcgctcgctggatccccag

SEQ ID NO: 156985 - DNA, 20 bp, human
gttgcgctgtggggctgccc

SEQ ID NO: 156986 - DNA, 20 bp, human
gtaggcaccatcgtgctcag

SEQ ID NO: 156987 - DNA, 20 bp, human
gcttctacaggagggtgagt

SEQ ID NO: 156988 - DNA, 20 bp, human
ggcaaggccactgagcacga

SEQ ID NO: 156989 - DNA, 20 bp, human
gacttggctgtagggaggaa

SEQ ID NO: 156990 - DNA, 20 bp, human
gagtgtgagcgtgagtagca

SEQ ID NO: 156991 - DNA, 20 bp, human
gacaagaacagagtcgagca

SEQ ID NO: 156992 - DNA, 20 bp, human
gcatgaacaaatccctgtca

SEQ ID NO: 156993 - DNA, 20 bp, human
gtgagtccaggaagtgactc

SEQ ID NO: 156994 - DNA, 20 bp, human
ggagagagccctatgtacca

SEQ ID NO: 156995 - DNA, 20 bp, human
gcttgcttgtaaacttctac

SEQ ID NO: 156996 - DNA, 20 bp, human
gcgggagctgcttccaccaa

SEQ ID NO: 156997 - DNA, 20 bp, human
ggtgcaggcttagagggact

SEQ ID NO: 156998 - DNA, 20 bp, human
gccaccaagggcagtcagga

SEQ ID NO: 156999 - DNA, 20 bp, human
gcctggcatcagagcagcca

SEQ ID NO: 157000 - DNA, 20 bp, human
gcacaggtaaagcagctccc

SEQ ID NO: 157001 - DNA, 20 bp, human
gcccgaggcaaggaggctca

SEQ ID NO: 157002 - DNA, 20 bp, human
gggagctgcagcgtatccac

SEQ ID NO: 157003 - DNA, 20 bp, human
gctcagtgtgcaggcttaga

SEQ ID NO: 157004 - DNA, 20 bp, human
ggctgctctgatgccaggga

SEQ ID NO: 157005 - DNA, 20 bp, human
gtgctggacgctggattaga

SEQ ID NO: 157006 - DNA, 20 bp, human
ggagcccgcagaggtatgag

SEQ ID NO: 157007 - DNA, 20 bp, human
gagtgaggagcacccaagtg

SEQ ID NO: 157008 - DNA, 20 bp, human
gcgcagaggtatgaggggag

SEQ ID NO: 157009 - DNA, 20 bp, human
gggccctgaggtctcaccat

SEQ ID NO: 157010 - DNA, 20 bp, human
ggtgatgctcctaagtgcag

SEQ ID NO: 157011 - DNA, 20 bp, human
ggctctgctgctgggtcaaa

SEQ ID NO: 157012 - DNA, 20 bp, human
gagcacccaagtggggccag

SEQ ID NO: 157013 - DNA, 20 bp, human
gcctgaggtctcaccatggg

SEQ ID NO: 157014 - DNA, 20 bp, human
gctggccagagtcattcact

SEQ ID NO: 157015 - DNA, 20 bp, human
gctaagtgcagaggtggctc

SEQ ID NO: 157016 - DNA, 20 bp, human
gtgcctggtgaccagaagtt

SEQ ID NO: 157017 - DNA, 20 bp, human
gagcctggaggccatctggg

SEQ ID NO: 157018 - DNA, 20 bp, human
gggcgacgtcagcggacctg

SEQ ID NO: 157019 - DNA, 20 bp, human
ggccagccggtgccgggaaa

SEQ ID NO: 157020 - DNA, 20 bp, human
gctgagtagagagtccccca

SEQ ID NO: 157021 - DNA, 20 bp, human
gtaggtttggtgctgggcag

SEQ ID NO: 157022 - DNA, 20 bp, human
gagtcccccagggtcaggga

SEQ ID NO: 157023 - DNA, 20 bp, human
gtggaaagcatggagtgaag

SEQ ID NO: 157024 - DNA, 20 bp, human
gatctgggcggcgacgtcag

SEQ ID NO: 157025 - DNA, 20 bp, human
ggggaaaacaaaacagaggg

SEQ ID NO: 157026 - DNA, 20 bp, human
gcctctgcggaaagaaacag

SEQ ID NO: 157027 - DNA, 20 bp, human
gatatagatcccgggagcag

SEQ ID NO: 157028 - DNA, 20 bp, human
ggagagcgagagtcacgtcc

SEQ ID NO: 157029 - DNA, 20 bp, human
ggtgcgcgagggagtaagag

SEQ ID NO: 157030 - DNA, 20 bp, human
gactaggtgctgtgtaaagg

SEQ ID NO: 157031 - DNA, 20 bp, human
gcctcagctggcaccatcac

SEQ ID NO: 157032 - DNA, 20 bp, human
gtgcagggacccctaaaagg

SEQ ID NO: 157033 - DNA, 20 bp, human
ggcccagcccgacccaggtg

SEQ ID NO: 157034 - DNA, 20 bp, human
gggagcgccgagcaatctgg

SEQ ID NO: 157035 - DNA, 20 bp, human
ggctgtgtaaagggggctgg

SEQ ID NO: 157036 - DNA, 20 bp, human
gacgaaagcaggaacgagag

SEQ ID NO: 157037 - DNA, 20 bp, human
gagcaggaacgagagcggag

SEQ ID NO: 157038 - DNA, 20 bp, human
ggggtccctgtagaagccag

SEQ ID NO: 157039 - DNA, 20 bp, human
gcgccaactagaggagggag

SEQ ID NO: 157040 - DNA, 20 bp, human
ggccccaggatccccaccac

SEQ ID NO: 157041 - DNA, 20 bp, human
gaggcgcctcacccattgag

SEQ ID NO: 157042 - DNA, 20 bp, human
gagctccagcatcccgtcag

SEQ ID NO: 157043 - DNA, 20 bp, human
gagggagcggaaaggtacca

SEQ ID NO: 157044 - DNA, 20 bp, human
gcagcagagacgcctgggtg

SEQ ID NO: 157045 - DNA, 20 bp, human
ggtcagcccgccccctcaat

SEQ ID NO: 157046 - DNA, 20 bp, human
gtactctactaaacattcat

SEQ ID NO: 157047 - DNA, 20 bp, human
ggaataatcagaagtcagtt

SEQ ID NO: 157048 - DNA, 20 bp, human
gctgacttctgattattcac

SEQ ID NO: 157049 - DNA, 20 bp, human
gtatgatccaaaacctgatg

SEQ ID NO: 157050 - DNA, 20 bp, human
gtcttataggactattcatc

SEQ ID NO: 157051 - DNA, 20 bp, human
gtgaatagtcctataagaac

SEQ ID NO: 157052 - DNA, 20 bp, human
gcagaagatccagttcttat

SEQ ID NO: 157053 - DNA, 20 bp, human
gtttgtggtgaaatcattta

SEQ ID NO: 157054 - DNA, 20 bp, human
gtaaaaccaatatttgtctg

SEQ ID NO: 157055 - DNA, 20 bp, human
gaaaactcacttacctcatc

SEQ ID NO: 157056 - DNA, 20 bp, human
ggaatcacagccgggaatcg

SEQ ID NO: 157057 - DNA, 20 bp, human
gaccaatcaggaaacggcgg

SEQ ID NO: 157058 - DNA, 20 bp, human
ggcggccaatcagaacgaag

SEQ ID NO: 157059 - DNA, 20 bp, human
gcggggcagacagcacgtag

SEQ ID NO: 157060 - DNA, 20 bp, human
gcactgccggaagcgagcgg

SEQ ID NO: 157061 - DNA, 20 bp, human
ggcagagaacagcccgccag

SEQ ID NO: 157062 - DNA, 20 bp, human
gtcgcttgttggctgtcctc

SEQ ID NO: 157063 - DNA, 20 bp, human
gctccactgccggaagcgag

SEQ ID NO: 157064 - DNA, 20 bp, human
ggaactgcgtctcgcgaccc

SEQ ID NO: 157065 - DNA, 20 bp, human
gcggcggcagcatcgcttgt

SEQ ID NO: 157066 - DNA, 20 bp, human
gggcgccctgaccgagcgag

SEQ ID NO: 157067 - DNA, 20 bp, human
gcgtaccgctcgctcggtca

SEQ ID NO: 157068 - DNA, 20 bp, human
ggcgcgcaggcagagaacgg

SEQ ID NO: 157069 - DNA, 20 bp, human
gccggggacggagcaggtac

SEQ ID NO: 157070 - DNA, 20 bp, human
ggccgcacgtcactcctgca

SEQ ID NO: 157071 - DNA, 20 bp, human
ggcgggagtagctgaggagt

SEQ ID NO: 157072 - DNA, 20 bp, human
ggggacggagcaggtacggg

SEQ ID NO: 157073 - DNA, 20 bp, human
ggctgggagagcccggaggg

SEQ ID NO: 157074 - DNA, 20 bp, human
ggagagcgcggggcccggac

SEQ ID NO: 157075 - DNA, 20 bp, human
gactcctgcacggcgagtgc

SEQ ID NO: 157076 - DNA, 20 bp, human
gggacccaccagtgaccggt

SEQ ID NO: 157077 - DNA, 20 bp, human
ggctccaaccggtcactggt

SEQ ID NO: 157078 - DNA, 20 bp, human
gtggagaagcgagagaacag

SEQ ID NO: 157079 - DNA, 20 bp, human
gcgaggctccaaccggtcac

SEQ ID NO: 157080 - DNA, 20 bp, human
gggcggggccgagcaaccgg

SEQ ID NO: 157081 - DNA, 20 bp, human
gcccgtccggaagacccaag

SEQ ID NO: 157082 - DNA, 20 bp, human
gtggagaagcgagagaacta

SEQ ID NO: 157083 - DNA, 20 bp, human
ggttcgccacgaccacctcc

SEQ ID NO: 157084 - DNA, 20 bp, human
gctggcgggtcgcaacgctg

SEQ ID NO: 157085 - DNA, 20 bp, human
gtgcacagcgacttggggag

SEQ ID NO: 157086 - DNA, 20 bp, human
gtaaccgtctgcagcgacgg

SEQ ID NO: 157087 - DNA, 20 bp, human
gccgtgtgcagcctgaggag

SEQ ID NO: 157088 - DNA, 20 bp, human
gggaaccgccgcctcctcta

SEQ ID NO: 157089 - DNA, 20 bp, human
gggtcccgccgccgcgactg

SEQ ID NO: 157090 - DNA, 20 bp, human
ggcgcggcgggcaagggtcc

SEQ ID NO: 157091 - DNA, 20 bp, human
ggcagcccgagcagccctag

SEQ ID NO: 157092 - DNA, 20 bp, human
gtcaccgagtggactcgcag

SEQ ID NO: 157093 - DNA, 20 bp, human
gagacggttatggtaatgag

SEQ ID NO: 157094 - DNA, 20 bp, human
gcgcggcgcacgctagccca

SEQ ID NO: 157095 - DNA, 20 bp, human
gctgtgccgaggtcaccgag

SEQ ID NO: 157096 - DNA, 20 bp, human
gagccgtcctcgggaatgtt

SEQ ID NO: 157097 - DNA, 20 bp, human
gcgcccgcgaagccgtcctc

SEQ ID NO: 157098 - DNA, 20 bp, human
gccgggagcccagatctcgg

SEQ ID NO: 157099 - DNA, 20 bp, human
ggaccgaggcaggtcaacac

SEQ ID NO: 157100 - DNA, 20 bp, human
ggcgcagtctgggcgcacgg

SEQ ID NO: 157101 - DNA, 20 bp, human
gtctcgggggagagtctggg

SEQ ID NO: 157102 - DNA, 20 bp, human
gcgcccaacattcccgagga

SEQ ID NO: 157103 - DNA, 20 bp, human
ggtggagtcaccccaagact

SEQ ID NO: 157104 - DNA, 20 bp, human
ggccgccccaggcaaggagt

SEQ ID NO: 157105 - DNA, 20 bp, human
ggagcgagggtagaccttcc

SEQ ID NO: 157106 - DNA, 20 bp, human
gaacgccggagagaacccgg

SEQ ID NO: 157107 - DNA, 20 bp, human
ggtcggagggcggcagtctc

SEQ ID NO: 157108 - DNA, 20 bp, human
ggcccttcgcccagccccat

SEQ ID NO: 157109 - DNA, 20 bp, human
ggggaacgccggagagaacc

SEQ ID NO: 157110 - DNA, 20 bp, human
gaggcttgggcgctgtcgga

SEQ ID NO: 157111 - DNA, 20 bp, human
gtcgcccagccccatcggtg

SEQ ID NO: 157112 - DNA, 20 bp, human
gccgccgcccgccgagacta

SEQ ID NO: 157113 - DNA, 20 bp, human
gcgagccagagggcacaggg

SEQ ID NO: 157114 - DNA, 20 bp, human
ggggctgatccccaccgatg

SEQ ID NO: 157115 - DNA, 20 bp, human
gaaagccccgaatggctgga

SEQ ID NO: 157116 - DNA, 20 bp, human
ggtcagagcccggcgagcgc

SEQ ID NO: 157117 - DNA, 20 bp, human
gggttctagaagctccccgg

SEQ ID NO: 157118 - DNA, 20 bp, human
ggcgagcgctggcagttccg

SEQ ID NO: 157119 - DNA, 20 bp, human
ggccccggagaggtaagcgg

SEQ ID NO: 157120 - DNA, 20 bp, human
ggccgccgcttacctctccg

SEQ ID NO: 157121 - DNA, 20 bp, human
gagagctcaaggactacctg

SEQ ID NO: 157122 - DNA, 20 bp, human
ggctgaggagcgctgggtcc

SEQ ID NO: 157123 - DNA, 20 bp, human
ggacgcggttcggggttcca

SEQ ID NO: 157124 - DNA, 20 bp, human
ggcgcgacgcccctcttccc

SEQ ID NO: 157125 - DNA, 20 bp, human
gggacacaccgactcagctc

SEQ ID NO: 157126 - DNA, 20 bp, human
gccgcagggactgagaaagg

SEQ ID NO: 157127 - DNA, 20 bp, human
ggaggctgagagggatcccc

SEQ ID NO: 157128 - DNA, 20 bp, human
gaaagtgctgcggaaggtac

SEQ ID NO: 157129 - DNA, 20 bp, human
ggcgactgcctgaaagctag

SEQ ID NO: 157130 - DNA, 20 bp, human
gggcaggaagcgaccctcgc

SEQ ID NO: 157131 - DNA, 20 bp, human
ggacagacccaagtctggag

SEQ ID NO: 157132 - DNA, 20 bp, human
gctgccagaggcgaccaccg

SEQ ID NO: 157133 - DNA, 20 bp, human
gctcaaggcgggatgtcggg

SEQ ID NO: 157134 - DNA, 20 bp, human
ggctcgtcctagcctggcgg

SEQ ID NO: 157135 - DNA, 20 bp, human
gcaactgccggaaagtgctg

SEQ ID NO: 157136 - DNA, 20 bp, human
gcttgggccggtgcagtcgg

SEQ ID NO: 157137 - DNA, 20 bp, human
gtggctggcgctgacgctag

SEQ ID NO: 157138 - DNA, 20 bp, human
ggtcggggcgttgggagcag

SEQ ID NO: 157139 - DNA, 20 bp, human
ggcagacggcgcggaggcaa

SEQ ID NO: 157140 - DNA, 20 bp, human
gccgccgccgccgactgcac

SEQ ID NO: 157141 - DNA, 20 bp, human
gtcgggccgcgggtgccgag

SEQ ID NO: 157142 - DNA, 20 bp, human
gggcgacctctcggcacccg

SEQ ID NO: 157143 - DNA, 20 bp, human
gtgctgtaccgccgtcaccc

SEQ ID NO: 157144 - DNA, 20 bp, human
gaacgctagcgaggtgcggg

SEQ ID NO: 157145 - DNA, 20 bp, human
gcggcttgggccggtgcagt

SEQ ID NO: 157146 - DNA, 20 bp, human
ggatcgccgagcgcgagtga

SEQ ID NO: 157147 - DNA, 20 bp, human
gcgcccctcgccgtaggagg

SEQ ID NO: 157148 - DNA, 20 bp, human
ggtgagagcagcgagcccgg

SEQ ID NO: 157149 - DNA, 20 bp, human
gctctcacctgaggtctcgt

SEQ ID NO: 157150 - DNA, 20 bp, human
ggggagagcgagcagcgagc

SEQ ID NO: 157151 - DNA, 20 bp, human
ggagcgagcagcgagctggc

SEQ ID NO: 157152 - DNA, 20 bp, human
ggctcctgttcgcggagggg

SEQ ID NO: 157153 - DNA, 20 bp, human
ggagagaagggaaggcgaag

SEQ ID NO: 157154 - DNA, 20 bp, human
gctcaactccaaccacgacg

SEQ ID NO: 157155 - DNA, 20 bp, human
ggcccgcccctcgccgtagg

SEQ ID NO: 157156 - DNA, 20 bp, human
gcagccggctgcaggaccga

SEQ ID NO: 157157 - DNA, 20 bp, human
gcccgcactcccggaaccgg

SEQ ID NO: 157158 - DNA, 20 bp, human
ggccggagccgccgggacat

SEQ ID NO: 157159 - DNA, 20 bp, human
gcctgcaacctcgcccggac

SEQ ID NO: 157160 - DNA, 20 bp, human
gcggcgggaagggggagacc

SEQ ID NO: 157161 - DNA, 20 bp, human
gcccggcgccccccgagcta

SEQ ID NO: 157162 - DNA, 20 bp, human
gcggaggcggcagagtcggg

SEQ ID NO: 157163 - DNA, 20 bp, human
gtaaatcggtggcgcggcgg

SEQ ID NO: 157164 - DNA, 20 bp, human
ggtgctcacccatgtcccgg

SEQ ID NO: 157165 - DNA, 20 bp, human
gccgtgggcttgggaatgaa

SEQ ID NO: 157166 - DNA, 20 bp, human
gacctcgcgcggcacctcag

SEQ ID NO: 157167 - DNA, 20 bp, human
gcttgctccgaggccaagtg

SEQ ID NO: 157168 - DNA, 20 bp, human
ggcagcggcagcgcgagacc

SEQ ID NO: 157169 - DNA, 20 bp, human
gtagggagagcgggaaggta

SEQ ID NO: 157170 - DNA, 20 bp, human
ggcacctcagcggcgcgagg

SEQ ID NO: 157171 - DNA, 20 bp, human
gcggcttcgaccccgaatcc

SEQ ID NO: 157172 - DNA, 20 bp, human
gggcgcgcgctagggagagc

SEQ ID NO: 157173 - DNA, 20 bp, human
gcgagaccgagcccgagacc

SEQ ID NO: 157174 - DNA, 20 bp, human
ggtgtgtgggagccgtggcc

SEQ ID NO: 157175 - DNA, 20 bp, human
ggggccgctggccggtgagg

SEQ ID NO: 157176 - DNA, 20 bp, human
gccgctcggccaccgtctcg

SEQ ID NO: 157177 - DNA, 20 bp, human
ggcggccgggcgggcaccat

SEQ ID NO: 157178 - DNA, 20 bp, human
gctcggccaccgtctcgggg

SEQ ID NO: 157179 - DNA, 20 bp, human
ggcccgcccaggggaccccc

SEQ ID NO: 157180 - DNA, 20 bp, human
gccggaccgggggccaggaa

SEQ ID NO: 157181 - DNA, 20 bp, human
gcgctgccgccccgagacgg

SEQ ID NO: 157182 - DNA, 20 bp, human
gtgtaagcgcggctcgggga

SEQ ID NO: 157183 - DNA, 20 bp, human
gggcgggcgcgtaattctcc

SEQ ID NO: 157184 - DNA, 20 bp, human
ggggctcccgggggtcccct

SEQ ID NO: 157185 - DNA, 20 bp, human
gcagagccgggccgagctag

SEQ ID NO: 157186 - DNA, 20 bp, human
ggaggccgcaggtccgaccg

SEQ ID NO: 157187 - DNA, 20 bp, human
ggcagctgcttcatcgggag

SEQ ID NO: 157188 - DNA, 20 bp, human
ggaccgcgcgaggccaccgt

SEQ ID NO: 157189 - DNA, 20 bp, human
ggccaagcggctcgaagtgg

SEQ ID NO: 157190 - DNA, 20 bp, human
ggccgccgcgacacgagcag

SEQ ID NO: 157191 - DNA, 20 bp, human
gccggccaagcggctcgaag

SEQ ID NO: 157192 - DNA, 20 bp, human
gaggagtaacaggcccacgg

SEQ ID NO: 157193 - DNA, 20 bp, human
gcagccgcctccgaagatgg

SEQ ID NO: 157194 - DNA, 20 bp, human
gcaacgccgggcccaaccgc

SEQ ID NO: 157195 - DNA, 20 bp, human
gggacacggcggtaaccgta

SEQ ID NO: 157196 - DNA, 20 bp, human
gaccaacccccaggcggtgg

SEQ ID NO: 157197 - DNA, 20 bp, human
ggcaccacctcgagaccggg

SEQ ID NO: 157198 - DNA, 20 bp, human
gctcgcagagctcggagacg

SEQ ID NO: 157199 - DNA, 20 bp, human
gtcaaccaacccccaggcgg

SEQ ID NO: 157200 - DNA, 20 bp, human
ggcgccacccggtctcgagg

SEQ ID NO: 157201 - DNA, 20 bp, human
gctggcaccacctcgagacc

SEQ ID NO: 157202 - DNA, 20 bp, human
gggacagcggggcaagctcg

SEQ ID NO: 157203 - DNA, 20 bp, human
gcgggagcgtgggcgccaga

SEQ ID NO: 157204 - DNA, 20 bp, human
gcccgcgccacccggtctcg

SEQ ID NO: 157205 - DNA, 20 bp, human
gcacccgagagcaggcgcga

SEQ ID NO: 157206 - DNA, 20 bp, human
gtagccgtgaggccgtccta

SEQ ID NO: 157207 - DNA, 20 bp, human
gcaggcgagcatcggacctc

SEQ ID NO: 157208 - DNA, 20 bp, human
gggcgcgctgcgtaaagctg

SEQ ID NO: 157209 - DNA, 20 bp, human
ggactctgctcccgttaccc

SEQ ID NO: 157210 - DNA, 20 bp, human
gaccaaacagccccagatga

SEQ ID NO: 157211 - DNA, 20 bp, human
gtggattgcttaaggacacc

SEQ ID NO: 157212 - DNA, 20 bp, human
gggaccgtaggacggcctca

SEQ ID NO: 157213 - DNA, 20 bp, human
gacaccgctcccgcagccat

SEQ ID NO: 157214 - DNA, 20 bp, human
ggcggtgtgtgtcggaccgt

SEQ ID NO: 157215 - DNA, 20 bp, human
gggcgcctaggtgagctagt

SEQ ID NO: 157216 - DNA, 20 bp, human
gactcgagttaggcccaacg

SEQ ID NO: 157217 - DNA, 20 bp, human
gtaggcccaacgcggcgcca

SEQ ID NO: 157218 - DNA, 20 bp, human
gcctcacgatcgggccccag

SEQ ID NO: 157219 - DNA, 20 bp, human
ggccgcccctcccccggcag

SEQ ID NO: 157220 - DNA, 20 bp, human
gggcgcacggcactcccggg

SEQ ID NO: 157221 - DNA, 20 bp, human
gagcgcctgggacaaggtaa

SEQ ID NO: 157222 - DNA, 20 bp, human
ggggccaggcccacgaccca

SEQ ID NO: 157223 - DNA, 20 bp, human
ggcaagaggcctctcctcaa

SEQ ID NO: 157224 - DNA, 20 bp, human
gtcccggccaggaaacgccg

SEQ ID NO: 157225 - DNA, 20 bp, human
gtgcggcgcacggcactccc

SEQ ID NO: 157226 - DNA, 20 bp, human
gacccaggcgaagcgtccac

SEQ ID NO: 157227 - DNA, 20 bp, human
gagcgtccacgggtgagtgg

SEQ ID NO: 157228 - DNA, 20 bp, human
ggaccgccacctgagcagga

SEQ ID NO: 157229 - DNA, 20 bp, human
gggttctgcgaacggagaag

SEQ ID NO: 157230 - DNA, 20 bp, human
gagggcacggtggccggcta

SEQ ID NO: 157231 - DNA, 20 bp, human
ggaaacgcgctcttagacca

SEQ ID NO: 157232 - DNA, 20 bp, human
gacccgtggacgcttcgcct

SEQ ID NO: 157233 - DNA, 20 bp, human
gccaggtccgacccccagag

SEQ ID NO: 157234 - DNA, 20 bp, human
ggggtgaggcgcggaggaaa

SEQ ID NO: 157235 - DNA, 20 bp, human
gttcccagcggcctctctgg

SEQ ID NO: 157236 - DNA, 20 bp, human
gagccgccgggagcacccag

SEQ ID NO: 157237 - DNA, 20 bp, human
gtccctctgggtgctcccgg

SEQ ID NO: 157238 - DNA, 20 bp, human
gcaccctccgcgcccaaagg

SEQ ID NO: 157239 - DNA, 20 bp, human
gggctgcctcccgtccctct

SEQ ID NO: 157240 - DNA, 20 bp, human
gagggtgggtgcactccgca

SEQ ID NO: 157241 - DNA, 20 bp, human
gggagtccgccggcctcaag

SEQ ID NO: 157242 - DNA, 20 bp, human
gcgagggtggatgcaggctg

SEQ ID NO: 157243 - DNA, 20 bp, human
gggtttcgcaactccgaggg

SEQ ID NO: 157244 - DNA, 20 bp, human
gcaaccggccacccgtgtag

SEQ ID NO: 157245 - DNA, 20 bp, human
gagccgcgcagccccgagct

SEQ ID NO: 157246 - DNA, 20 bp, human
ggagccggggcctcgaaata

SEQ ID NO: 157247 - DNA, 20 bp, human
gctcgcagccgcccaccgtc

SEQ ID NO: 157248 - DNA, 20 bp, human
gtgggcggctgcgagcgggc

SEQ ID NO: 157249 - DNA, 20 bp, human
ggggcctcgaaatatggctg

SEQ ID NO: 157250 - DNA, 20 bp, human
ggggcggctcaccagagccg

SEQ ID NO: 157251 - DNA, 20 bp, human
gcgcccggggcgaggcacga

SEQ ID NO: 157252 - DNA, 20 bp, human
gcctcgaaatatggctgcgg

SEQ ID NO: 157253 - DNA, 20 bp, human
ggccctcccggctgcgcggg

SEQ ID NO: 157254 - DNA, 20 bp, human
ggccgccaggccgctccgga

SEQ ID NO: 157255 - DNA, 20 bp, human
ggccaggccgctccggaggg

SEQ ID NO: 157256 - DNA, 20 bp, human
gcggtgacagagtggagcca

SEQ ID NO: 157257 - DNA, 20 bp, human
gcaagtggccggcaccggag

SEQ ID NO: 157258 - DNA, 20 bp, human
gagagtggagccatggctag

SEQ ID NO: 157259 - DNA, 20 bp, human
gaaagcgcagggcacctcca

SEQ ID NO: 157260 - DNA, 20 bp, human
ggggcaaatacctctagcca

SEQ ID NO: 157261 - DNA, 20 bp, human
gcagtgggaagggtttctgg

SEQ ID NO: 157262 - DNA, 20 bp, human
gctccactctgtcaccgcct

SEQ ID NO: 157263 - DNA, 20 bp, human
gaggtgttattgatagaagt

SEQ ID NO: 157264 - DNA, 20 bp, human
ggggtttcccgggagatccc

SEQ ID NO: 157265 - DNA, 20 bp, human
gtggagcccggcggagcagt

SEQ ID NO: 157266 - DNA, 20 bp, human
gcgcggggccgtgaccagga

SEQ ID NO: 157267 - DNA, 20 bp, human
gtgcgatccagggaacgaag

SEQ ID NO: 157268 - DNA, 20 bp, human
gggccccgcagcagacggcc

SEQ ID NO: 157269 - DNA, 20 bp, human
gcggcagcgcagcggacact

SEQ ID NO: 157270 - DNA, 20 bp, human
ggtcagtgccgaacgcaaca

SEQ ID NO: 157271 - DNA, 20 bp, human
gccccgcgccgtcctggtca

SEQ ID NO: 157272 - DNA, 20 bp, human
ggcccgctggaagcctgaag

SEQ ID NO: 157273 - DNA, 20 bp, human
ggaagaacaggcgacacatc

SEQ ID NO: 157274 - DNA, 20 bp, human
gacgcaaagcggagagcctg

SEQ ID NO: 157275 - DNA, 20 bp, human
gaacgaagcggtacttgtaa

SEQ ID NO: 157276 - DNA, 20 bp, human
gccccagactcacaactcag

SEQ ID NO: 157277 - DNA, 20 bp, human
gcaacctgggaataaaacgt

SEQ ID NO: 157278 - DNA, 20 bp, human
gaccgtcgcggtgaccggaa

SEQ ID NO: 157279 - DNA, 20 bp, human
gcgaagggataagggaggag

SEQ ID NO: 157280 - DNA, 20 bp, human
gtaggacgcacccctagaat

SEQ ID NO: 157281 - DNA, 20 bp, human
gcttgaagctggaagacggg

SEQ ID NO: 157282 - DNA, 20 bp, human
gccccgtgctacccattcta

SEQ ID NO: 157283 - DNA, 20 bp, human
gggaaaagagcgaaagcgaa

SEQ ID NO: 157284 - DNA, 20 bp, human
gaggggaggaagcgtgaaag

SEQ ID NO: 157285 - DNA, 20 bp, human
gccccgtcaggctaccgtcg

SEQ ID NO: 157286 - DNA, 20 bp, human
gactgttgtggttgagatga

SEQ ID NO: 157287 - DNA, 20 bp, human
ggcggagccaggtgaaacca

SEQ ID NO: 157288 - DNA, 20 bp, human
gctcatccccggtagaggca

SEQ ID NO: 157289 - DNA, 20 bp, human
gcttccctcatccccggtag

SEQ ID NO: 157290 - DNA, 20 bp, human
gaggcagggcgggactgttg

SEQ ID NO: 157291 - DNA, 20 bp, human
gtgagatgaaggctagtaaa

SEQ ID NO: 157292 - DNA, 20 bp, human
gtggcacccaagtgcagtcc

SEQ ID NO: 157293 - DNA, 20 bp, human
gagggtgcagccttaatgag

SEQ ID NO: 157294 - DNA, 20 bp, human
gcggctagaggaactgtcgg

SEQ ID NO: 157295 - DNA, 20 bp, human
gcctgaggttgtcaaagggg

SEQ ID NO: 157296 - DNA, 20 bp, human
gactcaaggaggcatcacgg

SEQ ID NO: 157297 - DNA, 20 bp, human
gggaagcggcaaagacgaca

SEQ ID NO: 157298 - DNA, 20 bp, human
gacgacacggccttgtggga

SEQ ID NO: 157299 - DNA, 20 bp, human
gacatccagctgctcagtcg

SEQ ID NO: 157300 - DNA, 20 bp, human
ggcttgaggagaccacgtgg

SEQ ID NO: 157301 - DNA, 20 bp, human
gccctgaagcgcagaaccgg

SEQ ID NO: 157302 - DNA, 20 bp, human
gggaggccgtcccagcgagg

SEQ ID NO: 157303 - DNA, 20 bp, human
gaaagacgacacggccttgt

SEQ ID NO: 157304 - DNA, 20 bp, human
gtgaggcgggtaaatgttcg

SEQ ID NO: 157305 - DNA, 20 bp, human
gagcagctggatgtcgcgtg

SEQ ID NO: 157306 - DNA, 20 bp, human
ggccgacgccagccagagag

SEQ ID NO: 157307 - DNA, 20 bp, human
gcctagagcggggcccggta

SEQ ID NO: 157308 - DNA, 20 bp, human
gccccgctctaggccaccag

SEQ ID NO: 157309 - DNA, 20 bp, human
ggccagccagagagcggtga

SEQ ID NO: 157310 - DNA, 20 bp, human
gagagcggggcccggtatgg

SEQ ID NO: 157311 - DNA, 20 bp, human
gctctagcccacctccatac

SEQ ID NO: 157312 - DNA, 20 bp, human
gttccgctggtggcctagag

SEQ ID NO: 157313 - DNA, 20 bp, human
ggtctcggggtggaaagtgt

SEQ ID NO: 157314 - DNA, 20 bp, human
gcgagaggcagacgagcgtg

SEQ ID NO: 157315 - DNA, 20 bp, human
gcgctaccctcaccgctctc

SEQ ID NO: 157316 - DNA, 20 bp, human
gccaggagcgccagcagcga

SEQ ID NO: 157317 - DNA, 20 bp, human
gtgattctgtcaggcgctgg

SEQ ID NO: 157318 - DNA, 20 bp, human
gttctgtcaggcgctggcgg

SEQ ID NO: 157319 - DNA, 20 bp, human
gccgtggtgctgattctgtc

SEQ ID NO: 157320 - DNA, 20 bp, human
gcggccgggtagagggagcg

SEQ ID NO: 157321 - DNA, 20 bp, human
gctcggccgggcgcgaatgg

SEQ ID NO: 157322 - DNA, 20 bp, human
gaagggaccccggcatccgg

SEQ ID NO: 157323 - DNA, 20 bp, human
gccgggtccggccgggtaga

SEQ ID NO: 157324 - DNA, 20 bp, human
gtaaagacgaggtctcggcc

SEQ ID NO: 157325 - DNA, 20 bp, human
gggggcgcggtgcttggact

SEQ ID NO: 157326 - DNA, 20 bp, human
gaagagggtcctggagacat

SEQ ID NO: 157327 - DNA, 20 bp, human
ggcctggacaccaacccaag

SEQ ID NO: 157328 - DNA, 20 bp, human
gggaaggccgtgggttgcag

SEQ ID NO: 157329 - DNA, 20 bp, human
gggagacatgggaaggccgt

SEQ ID NO: 157330 - DNA, 20 bp, human
gacacaacctctgcaaccca

SEQ ID NO: 157331 - DNA, 20 bp, human
gagccagcaggtagctgacc

SEQ ID NO: 157332 - DNA, 20 bp, human
gccctcttgggttggtgtcc

SEQ ID NO: 157333 - DNA, 20 bp, human
gctccaggaccctcttgggt

SEQ ID NO: 157334 - DNA, 20 bp, human
gcgcagggatcgggatccag

SEQ ID NO: 157335 - DNA, 20 bp, human
gcaccaggtcagctacctgc

SEQ ID NO: 157336 - DNA, 20 bp, human
ggcagcttccggagccccct

SEQ ID NO: 157337 - DNA, 20 bp, human
gccgccgggatgggaagcgg

SEQ ID NO: 157338 - DNA, 20 bp, human
ggagcgcgcgtccgcccagg

SEQ ID NO: 157339 - DNA, 20 bp, human
gtggtggctgtccaaaatcg

SEQ ID NO: 157340 - DNA, 20 bp, human
gcccgggccaaggggacgtg

SEQ ID NO: 157341 - DNA, 20 bp, human
ggggctgaccagggcgactc

SEQ ID NO: 157342 - DNA, 20 bp, human
gagctcggccagagcgaccg

SEQ ID NO: 157343 - DNA, 20 bp, human
ggagatcccgcggagtcccg

SEQ ID NO: 157344 - DNA, 20 bp, human
gaggcaccacccgccgggat

SEQ ID NO: 157345 - DNA, 20 bp, human
ggaggaacagcgagatcccg

SEQ ID NO: 157346 - DNA, 20 bp, human
gactgggagagccgaagctc

SEQ ID NO: 157347 - DNA, 20 bp, human
gtctgccccttgggatggag

SEQ ID NO: 157348 - DNA, 20 bp, human
gcgtccccaggatctgacgt

SEQ ID NO: 157349 - DNA, 20 bp, human
gtctgcccctccatcccaag

SEQ ID NO: 157350 - DNA, 20 bp, human
ggcagccagattacttagag

SEQ ID NO: 157351 - DNA, 20 bp, human
gattacttagagaggcacag

SEQ ID NO: 157352 - DNA, 20 bp, human
gagagccgaagctcgggcac

SEQ ID NO: 157353 - DNA, 20 bp, human
gagctcgggcactggagctg

SEQ ID NO: 157354 - DNA, 20 bp, human
ggcacagaggagagagatcg

SEQ ID NO: 157355 - DNA, 20 bp, human
ggctctagcggggcttgtcg

SEQ ID NO: 157356 - DNA, 20 bp, human
ggcccgccgcgtgagaggac

SEQ ID NO: 157357 - DNA, 20 bp, human
ggcgagacgcacaaagaggg

SEQ ID NO: 157358 - DNA, 20 bp, human
gcggagcccgtcctctcacg

SEQ ID NO: 157359 - DNA, 20 bp, human
gggcgcgagacgcacaaaga

SEQ ID NO: 157360 - DNA, 20 bp, human
gcgctccccgggcccaaagg

SEQ ID NO: 157361 - DNA, 20 bp, human
gacacgcgctggtagagcgg

SEQ ID NO: 157362 - DNA, 20 bp, human
gccttcgcaagcctcccggg

SEQ ID NO: 157363 - DNA, 20 bp, human
gaggccaagcgaggaaatgg

SEQ ID NO: 157364 - DNA, 20 bp, human
gacgaggcgccgggggacgg

SEQ ID NO: 157365 - DNA, 20 bp, human
gccccgctccccgggcccaa

SEQ ID NO: 157366 - DNA, 20 bp, human
gtcgtactgaccgagcgggg

SEQ ID NO: 157367 - DNA, 20 bp, human
gcgacgagctcgcaagatgg

SEQ ID NO: 157368 - DNA, 20 bp, human
gcggggaggctgtcttgagg

SEQ ID NO: 157369 - DNA, 20 bp, human
gagcgcccaggccaaccctc

SEQ ID NO: 157370 - DNA, 20 bp, human
ggctcgtcgtactgaccgag

SEQ ID NO: 157371 - DNA, 20 bp, human
ggtacgacgagctcgcaaga

SEQ ID NO: 157372 - DNA, 20 bp, human
gtgccagtccgcctcggtgt

SEQ ID NO: 157373 - DNA, 20 bp, human
ggtccgcggagcagccccgt

SEQ ID NO: 157374 - DNA, 20 bp, human
gccgctcaccgacaccgagg

SEQ ID NO: 157375 - DNA, 20 bp, human
gcaccgacaccgaggcggac

SEQ ID NO: 157376 - DNA, 20 bp, human
gggggcagaggtggaggcat

SEQ ID NO: 157377 - DNA, 20 bp, human
gggcactgtgaaaggcacta

SEQ ID NO: 157378 - DNA, 20 bp, human
gtgcggacaatgacttggtc

SEQ ID NO: 157379 - DNA, 20 bp, human
ggcaaggattatgatcccaa

SEQ ID NO: 157380 - DNA, 20 bp, human
ggccacctgagttaagaggg

SEQ ID NO: 157381 - DNA, 20 bp, human
ggtggaggcatgggtgtctc

SEQ ID NO: 157382 - DNA, 20 bp, human
gcaagggcttggaggctaaa

SEQ ID NO: 157383 - DNA, 20 bp, human
gggatcttctccccagtaat

SEQ ID NO: 157384 - DNA, 20 bp, human
gctagggcaccagagatgac

SEQ ID NO: 157385 - DNA, 20 bp, human
gtttcagtaagaacactggt

SEQ ID NO: 157386 - DNA, 20 bp, human
gtggaggtggcgaaacgagg

SEQ ID NO: 157387 - DNA, 20 bp, human
gtcgtggaggtggcgaaacg

SEQ ID NO: 157388 - DNA, 20 bp, human
gtcgccaaacgaagtcgtgg

SEQ ID NO: 157389 - DNA, 20 bp, human
ggcggccttgggctctggtg

SEQ ID NO: 157390 - DNA, 20 bp, human
gccaaacgaagtcgtggagg

SEQ ID NO: 157391 - DNA, 20 bp, human
gcgttcgccaaacgaagtcg

SEQ ID NO: 157392 - DNA, 20 bp, human
ggagtggtggttgtacctgt

SEQ ID NO: 157393 - DNA, 20 bp, human
ggcttgagctcggaatgtcg

SEQ ID NO: 157394 - DNA, 20 bp, human
gcacaaggccggacgctcac

SEQ ID NO: 157395 - DNA, 20 bp, human
gaaggccggacgctcacggg

SEQ ID NO: 157396 - DNA, 20 bp, human
gaggcccgtggggcatgtca

SEQ ID NO: 157397 - DNA, 20 bp, human
gctgccggaggcgctccctg

SEQ ID NO: 157398 - DNA, 20 bp, human
gtgaccgcagggagcgcctc

SEQ ID NO: 157399 - DNA, 20 bp, human
gcggtcacggttgctctcgg

SEQ ID NO: 157400 - DNA, 20 bp, human
gaccacaggcagctgcacgg

SEQ ID NO: 157401 - DNA, 20 bp, human
gtccagccagatgtggtgaa

SEQ ID NO: 157402 - DNA, 20 bp, human
gcgatgtccacggtgctgag

SEQ ID NO: 157403 - DNA, 20 bp, human
gccatcgacatcaacaaggt

SEQ ID NO: 157404 - DNA, 20 bp, human
gttagcttgtgcagaggcag

SEQ ID NO: 157405 - DNA, 20 bp, human
gtcacggttgctctcggagg

SEQ ID NO: 157406 - DNA, 20 bp, human
ggagttgcttccggccgtgt

SEQ ID NO: 157407 - DNA, 20 bp, human
gagtagaaaaggccgcccga

SEQ ID NO: 157408 - DNA, 20 bp, human
gctccatcttcccttagtcg

SEQ ID NO: 157409 - DNA, 20 bp, human
gccggagctgaaaaaacaaa

SEQ ID NO: 157410 - DNA, 20 bp, human
gccctcgccaacccaaagag

SEQ ID NO: 157411 - DNA, 20 bp, human
gagccgcgactaagggaaga

SEQ ID NO: 157412 - DNA, 20 bp, human
ggaaggcagggaggttctga

SEQ ID NO: 157413 - DNA, 20 bp, human
gggtaagctccgccctcggg

SEQ ID NO: 157414 - DNA, 20 bp, human
gattgagaagccgcgactaa

SEQ ID NO: 157415 - DNA, 20 bp, human
gactccagaacgcaaactaa

SEQ ID NO: 157416 - DNA, 20 bp, human
gaggccactgccccgcgtaa

SEQ ID NO: 157417 - DNA, 20 bp, human
ggcgacgagcggaagttctt

SEQ ID NO: 157418 - DNA, 20 bp, human
gtggggacgacagtgtcgag

SEQ ID NO: 157419 - DNA, 20 bp, human
gagatcgccaagactcacga

SEQ ID NO: 157420 - DNA, 20 bp, human
gcaagactcacgaaggtaag

SEQ ID NO: 157421 - DNA, 20 bp, human
ggtccactcgaacacacaga

SEQ ID NO: 157422 - DNA, 20 bp, human
gctgtcgggggtgtaagagg

SEQ ID NO: 157423 - DNA, 20 bp, human
gtcgaacacacagacggaac

SEQ ID NO: 157424 - DNA, 20 bp, human
gattcagtctgccggaaaag

SEQ ID NO: 157425 - DNA, 20 bp, human
gtgaacaaagcgcctgtcgg

SEQ ID NO: 157426 - DNA, 20 bp, human
gccgctgtaacagcttccgg

SEQ ID NO: 157427 - DNA, 20 bp, human
gtcaagcaaagaggctatag

SEQ ID NO: 157428 - DNA, 20 bp, human
gcccgaagccgagcgagctc

SEQ ID NO: 157429 - DNA, 20 bp, human
gtgacccgcacctaaggacc

SEQ ID NO: 157430 - DNA, 20 bp, human
gaacgccaggtccttaggtg

SEQ ID NO: 157431 - DNA, 20 bp, human
gtgatgtcctgcatctaacg

SEQ ID NO: 157432 - DNA, 20 bp, human
gtccgctctggggacggagg

SEQ ID NO: 157433 - DNA, 20 bp, human
gaggtgcgggtcaagcaaag

SEQ ID NO: 157434 - DNA, 20 bp, human
gatgcaggacatcaacatcc

SEQ ID NO: 157435 - DNA, 20 bp, human
gatcaacatccaggacccgc

SEQ ID NO: 157436 - DNA, 20 bp, human
gaagcggagcctggttaccc

SEQ ID NO: 157437 - DNA, 20 bp, human
gggcagcccaggcgccatag

SEQ ID NO: 157438 - DNA, 20 bp, human
gcctgcggctaagatggcga

SEQ ID NO: 157439 - DNA, 20 bp, human
gttggtcgcgcgccttcctg

SEQ ID NO: 157440 - DNA, 20 bp, human
gggcggcgggacgtcaggat

SEQ ID NO: 157441 - DNA, 20 bp, human
gctggttacccgggagactc

SEQ ID NO: 157442 - DNA, 20 bp, human
gagccgtgatggggtatata

SEQ ID NO: 157443 - DNA, 20 bp, human
ggctgcaattctgctttggg

SEQ ID NO: 157444 - DNA, 20 bp, human
gcgccttcctgcggctaaga

SEQ ID NO: 157445 - DNA, 20 bp, human
gctggccccagcttccgggt

SEQ ID NO: 157446 - DNA, 20 bp, human
gaggtaccgagggatggttg

SEQ ID NO: 157447 - DNA, 20 bp, human
gagaccggccatatggaagg

SEQ ID NO: 157448 - DNA, 20 bp, human
gggcatggatgtctccctct

SEQ ID NO: 157449 - DNA, 20 bp, human
gagtatgttggagttggtgg

SEQ ID NO: 157450 - DNA, 20 bp, human
ggccattagacctcaagaca

SEQ ID NO: 157451 - DNA, 20 bp, human
gggaccaggaggaggtaccg

SEQ ID NO: 157452 - DNA, 20 bp, human
ggagtaaatggtacaccgag

SEQ ID NO: 157453 - DNA, 20 bp, human
gtccctgtcttgaggtctaa

SEQ ID NO: 157454 - DNA, 20 bp, human
gggatggtgtggatatccaa

SEQ ID NO: 157455 - DNA, 20 bp, human
gtccctctgggtagagtaaa

SEQ ID NO: 157456 - DNA, 20 bp, human
gcgatctccgagcggaatca

SEQ ID NO: 157457 - DNA, 20 bp, human
ggaagatggaacccaaccag

SEQ ID NO: 157458 - DNA, 20 bp, human
ggcggaatcagggtaactgg

SEQ ID NO: 157459 - DNA, 20 bp, human
gaccgctgctgggagacggc

SEQ ID NO: 157460 - DNA, 20 bp, human
ggcgtgagagtgtaacggga

SEQ ID NO: 157461 - DNA, 20 bp, human
gcgagcggaatcagggtaac

SEQ ID NO: 157462 - DNA, 20 bp, human
gaacccaaccaggggaactg

SEQ ID NO: 157463 - DNA, 20 bp, human
ggaactggggaccgcggtag

SEQ ID NO: 157464 - DNA, 20 bp, human
gagcaagcgtgagagtgtaa

SEQ ID NO: 157465 - DNA, 20 bp, human
ggagagtgtaacgggaagga

SEQ ID NO: 157466 - DNA, 20 bp, human
gaggtcgaagtggcccatgt

SEQ ID NO: 157467 - DNA, 20 bp, human
gactcgtactgctcctacat

SEQ ID NO: 157468 - DNA, 20 bp, human
gcccttcgctctcaggtcag

SEQ ID NO: 157469 - DNA, 20 bp, human
gctgagagcgaaggggaaag

SEQ ID NO: 157470 - DNA, 20 bp, human
gctcctgtaaaacgctagag

SEQ ID NO: 157471 - DNA, 20 bp, human
gaggtcaggcgggactcccc

SEQ ID NO: 157472 - DNA, 20 bp, human
gggagagtgaagccaccgcg

SEQ ID NO: 157473 - DNA, 20 bp, human
gccaaaggaccggctctcca

SEQ ID NO: 157474 - DNA, 20 bp, human
gctctcaggtcagaggacgc

SEQ ID NO: 157475 - DNA, 20 bp, human
ggtccacatgaaggcaggtc

SEQ ID NO: 157476 - DNA, 20 bp, human
gctagacgcctgggaggatg

SEQ ID NO: 157477 - DNA, 20 bp, human
gacgttgggagaaaacccgg

SEQ ID NO: 157478 - DNA, 20 bp, human
ggtgcgcggatccaaatcag

SEQ ID NO: 157479 - DNA, 20 bp, human
gcggccgagcactaaagatg

SEQ ID NO: 157480 - DNA, 20 bp, human
gagaagtgggaggtattccg

SEQ ID NO: 157481 - DNA, 20 bp, human
ggcgcgagactggcgtctag

SEQ ID NO: 157482 - DNA, 20 bp, human
gagaggcgcgcgaagcgctg

SEQ ID NO: 157483 - DNA, 20 bp, human
gcccggcaaggacctcagtc

SEQ ID NO: 157484 - DNA, 20 bp, human
gggagttaagaagcaggtcc

SEQ ID NO: 157485 - DNA, 20 bp, human
gaggagcgcactagacgcct

SEQ ID NO: 157486 - DNA, 20 bp, human
ggggctgaggcgccaacggg

SEQ ID NO: 157487 - DNA, 20 bp, human
ggcgcgcgcgcgaaaactcc

SEQ ID NO: 157488 - DNA, 20 bp, human
gccctccacccgcgctccgg

SEQ ID NO: 157489 - DNA, 20 bp, human
gtccttcctgctgggttcgg

SEQ ID NO: 157490 - DNA, 20 bp, human
ggctccgactcattccaata

SEQ ID NO: 157491 - DNA, 20 bp, human
gaggcgccaacgggcggcgg

SEQ ID NO: 157492 - DNA, 20 bp, human
gtacggcgtccccttcgaag

SEQ ID NO: 157493 - DNA, 20 bp, human
gcggcggcggcggcacgttg

SEQ ID NO: 157494 - DNA, 20 bp, human
ggtgccatattggaatgagt

SEQ ID NO: 157495 - DNA, 20 bp, human
gttgcgcggccgcttcgaag

SEQ ID NO: 157496 - DNA, 20 bp, human
ggcccgcctgcttaggcgca

SEQ ID NO: 157497 - DNA, 20 bp, human
ggccgagcatgcgcacagag

SEQ ID NO: 157498 - DNA, 20 bp, human
gcccctccgcaaggacaact

SEQ ID NO: 157499 - DNA, 20 bp, human
gcacagagaggatgccatat

SEQ ID NO: 157500 - DNA, 20 bp, human
gcgctcccagcgatccccgg

SEQ ID NO: 157501 - DNA, 20 bp, human
ggtagtgggagccggaggac

SEQ ID NO: 157502 - DNA, 20 bp, human
gcgcgcccgctccggtcctc

SEQ ID NO: 157503 - DNA, 20 bp, human
gtattggaatgagctgtagt

SEQ ID NO: 157504 - DNA, 20 bp, human
gtaagcaggcgggcaccccc

SEQ ID NO: 157505 - DNA, 20 bp, human
gacacggtcgactgagccat

SEQ ID NO: 157506 - DNA, 20 bp, human
ggccggatttcgtgtgtgca

SEQ ID NO: 157507 - DNA, 20 bp, human
ggcgcgctgcacttaatagt

SEQ ID NO: 157508 - DNA, 20 bp, human
gcgcgggtagatccccgagt

SEQ ID NO: 157509 - DNA, 20 bp, human
gctctcggcgcatcggagag

SEQ ID NO: 157510 - DNA, 20 bp, human
gcgcgctctagggaaggtgg

SEQ ID NO: 157511 - DNA, 20 bp, human
ggtagatccccgagtaggtg

SEQ ID NO: 157512 - DNA, 20 bp, human
gccgagtaggtggggcgagg

SEQ ID NO: 157513 - DNA, 20 bp, human
ggggttcctaagccgagcaa

SEQ ID NO: 157514 - DNA, 20 bp, human
gtctgggagacaagcacgta

SEQ ID NO: 157515 - DNA, 20 bp, human
gaggaaccctctcggcgcat

SEQ ID NO: 157516 - DNA, 20 bp, human
gggccacctcggccaggtag

SEQ ID NO: 157517 - DNA, 20 bp, human
gagagtccggcattggtccc

SEQ ID NO: 157518 - DNA, 20 bp, human
gctggggacacacaggcggg

SEQ ID NO: 157519 - DNA, 20 bp, human
gctggacagccacctcatca

SEQ ID NO: 157520 - DNA, 20 bp, human
ggagacacagagtccggcat

SEQ ID NO: 157521 - DNA, 20 bp, human
ggtccccggcctccttgatg

SEQ ID NO: 157522 - DNA, 20 bp, human
gaggtggagactgagctcca

SEQ ID NO: 157523 - DNA, 20 bp, human
ggacagccacctcatcaagg

SEQ ID NO: 157524 - DNA, 20 bp, human
ggtagcctataagaacgtgg

SEQ ID NO: 157525 - DNA, 20 bp, human
gcatcttcaggtagaagacc

SEQ ID NO: 157526 - DNA, 20 bp, human
gagacgctcaggaaacgtgg

SEQ ID NO: 157527 - DNA, 20 bp, human
gatcggttccggagtcgtgg

SEQ ID NO: 157528 - DNA, 20 bp, human
gcgggtccctgagcaacgac

SEQ ID NO: 157529 - DNA, 20 bp, human
gagaagacgctcaggaaacg

SEQ ID NO: 157530 - DNA, 20 bp, human
gaaatggcggatgacacagg

SEQ ID NO: 157531 - DNA, 20 bp, human
gtataagacgaggacaaagg

SEQ ID NO: 157532 - DNA, 20 bp, human
ggtggtgcgctgcctactcc

SEQ ID NO: 157533 - DNA, 20 bp, human
gctatataagacgaggacaa

SEQ ID NO: 157534 - DNA, 20 bp, human
ggcttggaagagtcctgcgg

SEQ ID NO: 157535 - DNA, 20 bp, human
gtgtggtcaaggggcggtcg

SEQ ID NO: 157536 - DNA, 20 bp, human
gcggggaagcccaggtgtca

SEQ ID NO: 157537 - DNA, 20 bp, human
ggggtctccggggaactagt

SEQ ID NO: 157538 - DNA, 20 bp, human
gagcttgtagagttcaggat

SEQ ID NO: 157539 - DNA, 20 bp, human
gcggccgtaaatcgatcctg

SEQ ID NO: 157540 - DNA, 20 bp, human
gcggccaacagggactgaaa

SEQ ID NO: 157541 - DNA, 20 bp, human
gctgcaacggggggaaggag

SEQ ID NO: 157542 - DNA, 20 bp, human
gctcgggccggcagggtaac

SEQ ID NO: 157543 - DNA, 20 bp, human
ggactccacagccgactccc

SEQ ID NO: 157544 - DNA, 20 bp, human
gacggccccgcccctgccac

SEQ ID NO: 157545 - DNA, 20 bp, human
gcttccccgggagtcggctg

SEQ ID NO: 157546 - DNA, 20 bp, human
gggatgtccacgcactgagg

SEQ ID NO: 157547 - DNA, 20 bp, human
gggaggtgcggcgagcagga

SEQ ID NO: 157548 - DNA, 20 bp, human
ggggcgcgcggcactgactc

SEQ ID NO: 157549 - DNA, 20 bp, human
gacatcggcccgtaccagag

SEQ ID NO: 157550 - DNA, 20 bp, human
gcgagcaggaaggcgcgggg

SEQ ID NO: 157551 - DNA, 20 bp, human
gctgcgggctgggtgcgccc

SEQ ID NO: 157552 - DNA, 20 bp, human
gcccgacgtcgcggagaaca

SEQ ID NO: 157553 - DNA, 20 bp, human
gcggcgagcaggaaggcgcg

SEQ ID NO: 157554 - DNA, 20 bp, human
gtgcggctgtgccacaacgt

SEQ ID NO: 157555 - DNA, 20 bp, human
gcagggcgcagagccggcat

SEQ ID NO: 157556 - DNA, 20 bp, human
gggagaagcgggacaccggg

SEQ ID NO: 157557 - DNA, 20 bp, human
ggacaccgggaggacagcgc

SEQ ID NO: 157558 - DNA, 20 bp, human
gcagggccctgcagcatcgt

SEQ ID NO: 157559 - DNA, 20 bp, human
gtctggctgtgccccagcaa

SEQ ID NO: 157560 - DNA, 20 bp, human
gtgcgcttgtaggagaagtc

SEQ ID NO: 157561 - DNA, 20 bp, human
ggcagaatgagccgttgctg

SEQ ID NO: 157562 - DNA, 20 bp, human
gcggctcattctgctccccc

SEQ ID NO: 157563 - DNA, 20 bp, human
gggccacgagaccatgaagg

SEQ ID NO: 157564 - DNA, 20 bp, human
gggcgagcggcggcatctag

SEQ ID NO: 157565 - DNA, 20 bp, human
gcgcggagaagcgggacacc

SEQ ID NO: 157566 - DNA, 20 bp, human
gtcggggcgcgaacccgccc

SEQ ID NO: 157567 - DNA, 20 bp, human
ggcatccgcgtgatgttcca

SEQ ID NO: 157568 - DNA, 20 bp, human
gctggctgcgctccgagctg

SEQ ID NO: 157569 - DNA, 20 bp, human
gaagggacagcgaaagatga

SEQ ID NO: 157570 - DNA, 20 bp, human
gggactggagctgcccgggc

SEQ ID NO: 157571 - DNA, 20 bp, human
gctcggagcgcagccagcca

SEQ ID NO: 157572 - DNA, 20 bp, human
gcatgccctggaacatcacg

SEQ ID NO: 157573 - DNA, 20 bp, human
gctggccatcgagcagtacg

SEQ ID NO: 157574 - DNA, 20 bp, human
ggcgccagctctcagccttc

SEQ ID NO: 157575 - DNA, 20 bp, human
gtagggtcccgcaatggccg

SEQ ID NO: 157576 - DNA, 20 bp, human
gggcagcgcttggccagcag

SEQ ID NO: 157577 - DNA, 20 bp, human
gcggcggctgggtagagtca

SEQ ID NO: 157578 - DNA, 20 bp, human
gccgcggaggtcgcccaggt

SEQ ID NO: 157579 - DNA, 20 bp, human
ggaagacctgcgtatccgag

SEQ ID NO: 157580 - DNA, 20 bp, human
ggaggcgccaggatcagtcg

SEQ ID NO: 157581 - DNA, 20 bp, human
gtgggccggtcgagacagac

SEQ ID NO: 157582 - DNA, 20 bp, human
gcaggtcggcagggatgtca

SEQ ID NO: 157583 - DNA, 20 bp, human
ggctggagccccgaggtggg

SEQ ID NO: 157584 - DNA, 20 bp, human
gggcgcacgccggaacacct

SEQ ID NO: 157585 - DNA, 20 bp, human
ggcgcttgtagcccaccgtg

SEQ ID NO: 157586 - DNA, 20 bp, human
gatggcggcggtgttgaggt

SEQ ID NO: 157587 - DNA, 20 bp, human
gcggtgttgaggttgggtac

SEQ ID NO: 157588 - DNA, 20 bp, human
ggggccacaaaatggtggag

SEQ ID NO: 157589 - DNA, 20 bp, human
gagggaagggaaggatcgac

SEQ ID NO: 157590 - DNA, 20 bp, human
ggcggggtctttgactgaag

SEQ ID NO: 157591 - DNA, 20 bp, human
gatagcgggccacaaaatgg

SEQ ID NO: 157592 - DNA, 20 bp, human
ggatcaagcgggtgagggaa

SEQ ID NO: 157593 - DNA, 20 bp, human
gaggccaagtggaggtatca

SEQ ID NO: 157594 - DNA, 20 bp, human
gactgaaggggtaggccaag

SEQ ID NO: 157595 - DNA, 20 bp, human
ggacgagatcaagcgggtga

SEQ ID NO: 157596 - DNA, 20 bp, human
ggtttcctggtgggcgtcag

SEQ ID NO: 157597 - DNA, 20 bp, human
gaagcgagggcagacgttag

SEQ ID NO: 157598 - DNA, 20 bp, human
gaaggccagatgggagagtc

SEQ ID NO: 157599 - DNA, 20 bp, human
ggccagatgggagagtcggg

SEQ ID NO: 157600 - DNA, 20 bp, human
gccgctacggccctgtaaca

SEQ ID NO: 157601 - DNA, 20 bp, human
ggctcggccggtcctcagtg

SEQ ID NO: 157602 - DNA, 20 bp, human
gcacagaccagccggaagtc

SEQ ID NO: 157603 - DNA, 20 bp, human
ggggttcggggtttcctggt

SEQ ID NO: 157604 - DNA, 20 bp, human
gccatctggccttctgactt

SEQ ID NO: 157605 - DNA, 20 bp, human
gagctgcggcgagtcctgag

SEQ ID NO: 157606 - DNA, 20 bp, human
ggactgagctgcgagtggga

SEQ ID NO: 157607 - DNA, 20 bp, human
gcggcgcaggaggaaatccc

SEQ ID NO: 157608 - DNA, 20 bp, human
gcccggactgagctgcgagt

SEQ ID NO: 157609 - DNA, 20 bp, human
gagtgggagggtgggcgact

SEQ ID NO: 157610 - DNA, 20 bp, human
gtgcgctttagggccgggta

SEQ ID NO: 157611 - DNA, 20 bp, human
gtgggcggctgcctagcacc

SEQ ID NO: 157612 - DNA, 20 bp, human
gcaggctgccgctgaggagc

SEQ ID NO: 157613 - DNA, 20 bp, human
gagccctgcagaagaagagg

SEQ ID NO: 157614 - DNA, 20 bp, human
gagggctccgcgaagaggtc

SEQ ID NO: 157615 - DNA, 20 bp, human
gggccctaaagcgcattccc

SEQ ID NO: 157616 - DNA, 20 bp, human
gcggcccgcgctgctctaca

SEQ ID NO: 157617 - DNA, 20 bp, human
ggccatcttggacaaggcgg

SEQ ID NO: 157618 - DNA, 20 bp, human
ggcgccccttgtccaagact

SEQ ID NO: 157619 - DNA, 20 bp, human
gtccgccatcttggacaagg

SEQ ID NO: 157620 - DNA, 20 bp, human
gaggtccgccatcttggaca

SEQ ID NO: 157621 - DNA, 20 bp, human
ggcgcgcgcagcagcaacac

SEQ ID NO: 157622 - DNA, 20 bp, human
gcagcaccgagtcttggaca

SEQ ID NO: 157623 - DNA, 20 bp, human
gtggcgcaggggaaagctgg

SEQ ID NO: 157624 - DNA, 20 bp, human
gctcctgcagctggcggtgg

SEQ ID NO: 157625 - DNA, 20 bp, human
gggacagcagcaccgagtct

SEQ ID NO: 157626 - DNA, 20 bp, human
ggagcgcagtggccactatg

SEQ ID NO: 157627 - DNA, 20 bp, human
gggagacactgaagtcccgg

SEQ ID NO: 157628 - DNA, 20 bp, human
gcactgcgctcctgggatgg

SEQ ID NO: 157629 - DNA, 20 bp, human
gtagtggccactgcgctcct

SEQ ID NO: 157630 - DNA, 20 bp, human
gaggaagctggactcatagg

SEQ ID NO: 157631 - DNA, 20 bp, human
gaaacaggcctgttaaggag

SEQ ID NO: 157632 - DNA, 20 bp, human
gccatgtgagctgccaagga

SEQ ID NO: 157633 - DNA, 20 bp, human
ggccaaggagggtcaagagg

SEQ ID NO: 157634 - DNA, 20 bp, human
gttatgctaaggcttgagtg

SEQ ID NO: 157635 - DNA, 20 bp, human
gccggtggcctctccttaac

SEQ ID NO: 157636 - DNA, 20 bp, human
ggcgcccagagcgtttctag

SEQ ID NO: 157637 - DNA, 20 bp, human
gtgaaatccgagccaggcct

SEQ ID NO: 157638 - DNA, 20 bp, human
ggtctccgctagaaacgctc

SEQ ID NO: 157639 - DNA, 20 bp, human
gaagcctcctacaaggacac

SEQ ID NO: 157640 - DNA, 20 bp, human
gcgtgaagaagcctcctaca

SEQ ID NO: 157641 - DNA, 20 bp, human
gtacctggtccctaatgagt

SEQ ID NO: 157642 - DNA, 20 bp, human
gcctgggaactgggagctgt

SEQ ID NO: 157643 - DNA, 20 bp, human
gcgaggcgcgagtgcacaaa

SEQ ID NO: 157644 - DNA, 20 bp, human
gctccctgcggcctcaaaat

SEQ ID NO: 157645 - DNA, 20 bp, human
gagaccagtgtccttgtagg

SEQ ID NO: 157646 - DNA, 20 bp, human
gccctcaaggtggtcagtca

SEQ ID NO: 157647 - DNA, 20 bp, human
ggcctccaagtcagagggta

SEQ ID NO: 157648 - DNA, 20 bp, human
gcgcagcctggcccccctca

SEQ ID NO: 157649 - DNA, 20 bp, human
gagcctggcccccctcaagg

SEQ ID NO: 157650 - DNA, 20 bp, human
gttcagcagggcctacagga

SEQ ID NO: 157651 - DNA, 20 bp, human
gggccctgctgaaccctgta

SEQ ID NO: 157652 - DNA, 20 bp, human
gaccttaccctctgacttgg

SEQ ID NO: 157653 - DNA, 20 bp, human
ggaacagaccccaaaaagaa

SEQ ID NO: 157654 - DNA, 20 bp, human
gcctgactaatagcctggga

SEQ ID NO: 157655 - DNA, 20 bp, human
gaaccctgtagggatggatc

SEQ ID NO: 157656 - DNA, 20 bp, human
ggcctgaaaagaaggtaact

SEQ ID NO: 157657 - DNA, 20 bp, human
gcctccaagttagagcataa

SEQ ID NO: 157658 - DNA, 20 bp, human
gccttcaaggtgatcatcgg

SEQ ID NO: 157659 - DNA, 20 bp, human
ggacccttcaaggtgatcat

SEQ ID NO: 157660 - DNA, 20 bp, human
gaaggtaactgggcatatga

SEQ ID NO: 157661 - DNA, 20 bp, human
ggccagatccatccctacca

SEQ ID NO: 157662 - DNA, 20 bp, human
gcctgaccaaggcccaggtt

SEQ ID NO: 157663 - DNA, 20 bp, human
gaccaaggcccaggttggga

SEQ ID NO: 157664 - DNA, 20 bp, human
gccaagttagagcataaagg

SEQ ID NO: 157665 - DNA, 20 bp, human
gccctaccagggactcagca

SEQ ID NO: 157666 - DNA, 20 bp, human
gtgcctgggccacagagcgt

SEQ ID NO: 157667 - DNA, 20 bp, human
gagcaggtgtgactcagcca

SEQ ID NO: 157668 - DNA, 20 bp, human
gtgagtcacacctgctgcag

SEQ ID NO: 157669 - DNA, 20 bp, human
gtcctgtaggcaatgcccta

SEQ ID NO: 157670 - DNA, 20 bp, human
ggctttggcaccagaactca

SEQ ID NO: 157671 - DNA, 20 bp, human
gcagcaaaactgggtctaga

SEQ ID NO: 157672 - DNA, 20 bp, human
ggtggagctgcctaggagag

SEQ ID NO: 157673 - DNA, 20 bp, human
ggccaaggatgaggtggtcc

SEQ ID NO: 157674 - DNA, 20 bp, human
gggccagagcaaccttaatc

SEQ ID NO: 157675 - DNA, 20 bp, human
gcattgcctacaggaagtct

SEQ ID NO: 157676 - DNA, 20 bp, human
gggaagtagtcgatgaccag

SEQ ID NO: 157677 - DNA, 20 bp, human
gcttgacgactacttccccc

SEQ ID NO: 157678 - DNA, 20 bp, human
ggaagtagtcgtcaagcact

SEQ ID NO: 157679 - DNA, 20 bp, human
gcatgagcagcttcaagggg

SEQ ID NO: 157680 - DNA, 20 bp, human
gacacacaccctgtccacaa

SEQ ID NO: 157681 - DNA, 20 bp, human
ggtgtgtatgtgtctggata

SEQ ID NO: 157682 - DNA, 20 bp, human
ggtcaagcacttggttgcac

SEQ ID NO: 157683 - DNA, 20 bp, human
ggtttgtgtctggccggctt

SEQ ID NO: 157684 - DNA, 20 bp, human
ggcttgcagccctcacagtc

SEQ ID NO: 157685 - DNA, 20 bp, human
gtgtgtggctccccatgggt

SEQ ID NO: 157686 - DNA, 20 bp, human
gacgagctggagccagaata

SEQ ID NO: 157687 - DNA, 20 bp, human
gggcagcaaagaggtcctga

SEQ ID NO: 157688 - DNA, 20 bp, human
ggctcgcccggtggagaagg

SEQ ID NO: 157689 - DNA, 20 bp, human
gagctggagccagaataagg

SEQ ID NO: 157690 - DNA, 20 bp, human
gggagctcgcccggtggaga

SEQ ID NO: 157691 - DNA, 20 bp, human
ggagagcccgccggtgagtg

SEQ ID NO: 157692 - DNA, 20 bp, human
gcaccggcgggctctccatc

SEQ ID NO: 157693 - DNA, 20 bp, human
gccctggtcacacctgggag

SEQ ID NO: 157694 - DNA, 20 bp, human
gtaaggaggagctcgcccgg

SEQ ID NO: 157695 - DNA, 20 bp, human
gcactaagccagggaccctt

SEQ ID NO: 157696 - DNA, 20 bp, human
ggtgagtgcctgccaagcaa

SEQ ID NO: 157697 - DNA, 20 bp, human
gaggctgttggcaccaggat

SEQ ID NO: 157698 - DNA, 20 bp, human
ggtggaagagagacaaaccc

SEQ ID NO: 157699 - DNA, 20 bp, human
gggctgaggccactgaataa

SEQ ID NO: 157700 - DNA, 20 bp, human
gtagtttgcttggagctcct

SEQ ID NO: 157701 - DNA, 20 bp, human
ggaattgcccaggtcggcag

SEQ ID NO: 157702 - DNA, 20 bp, human
gtcggcagagggatatttat

SEQ ID NO: 157703 - DNA, 20 bp, human
ggagggatatttataggatg

SEQ ID NO: 157704 - DNA, 20 bp, human
ggttctggtctaggaggcat

SEQ ID NO: 157705 - DNA, 20 bp, human
gtcttctgccccttattcag

SEQ ID NO: 157706 - DNA, 20 bp, human
gggaagcggtgagtcgcggg

SEQ ID NO: 157707 - DNA, 20 bp, human
ggcgggagaagcgtttccgg

SEQ ID NO: 157708 - DNA, 20 bp, human
gaccaagatggctgcctcgg

SEQ ID NO: 157709 - DNA, 20 bp, human
gacgcgcgaggacgccgtgg

SEQ ID NO: 157710 - DNA, 20 bp, human
ggcgactcaccgcttccccc

SEQ ID NO: 157711 - DNA, 20 bp, human
gtgcgtggcgaactcgctcc

SEQ ID NO: 157712 - DNA, 20 bp, human
ggcaggcgccgaagacagcg

SEQ ID NO: 157713 - DNA, 20 bp, human
gggaaacgcttctcccgcca

SEQ ID NO: 157714 - DNA, 20 bp, human
gcgtgggcctcgtccccggt

SEQ ID NO: 157715 - DNA, 20 bp, human
gccgaggcccagcatcccgt

SEQ ID NO: 157716 - DNA, 20 bp, human
gcaaggcgggctgtaactgg

SEQ ID NO: 157717 - DNA, 20 bp, human
gtggcactcctaggcaatgg

SEQ ID NO: 157718 - DNA, 20 bp, human
gtggggattggaggtagaca

SEQ ID NO: 157719 - DNA, 20 bp, human
gttgtcccgggaccaggtaa

SEQ ID NO: 157720 - DNA, 20 bp, human
gaactggcccgggtgagagg

SEQ ID NO: 157721 - DNA, 20 bp, human
gctaggagtgccaggccgag

SEQ ID NO: 157722 - DNA, 20 bp, human
gtggcgcgaagtgcgccctg

SEQ ID NO: 157723 - DNA, 20 bp, human
ggtgctttcagctcacctca

SEQ ID NO: 157724 - DNA, 20 bp, human
gtgtcccaaggccccttacc

SEQ ID NO: 157725 - DNA, 20 bp, human
gggcgagcgccattgtccca

SEQ ID NO: 157726 - DNA, 20 bp, human
gggccctcccagccatcacg

SEQ ID NO: 157727 - DNA, 20 bp, human
gtcccgcgtgatggctggga

SEQ ID NO: 157728 - DNA, 20 bp, human
gccaagtccacagggcacaa

SEQ ID NO: 157729 - DNA, 20 bp, human
gccctccacccagcacagag

SEQ ID NO: 157730 - DNA, 20 bp, human
ggttggggggaggaatgtca

SEQ ID NO: 157731 - DNA, 20 bp, human
gtgagagcttcagagagcga

SEQ ID NO: 157732 - DNA, 20 bp, human
ggcagccatctggctgagtt

SEQ ID NO: 157733 - DNA, 20 bp, human
ggacgtcccgcgtgatggct

SEQ ID NO: 157734 - DNA, 20 bp, human
gtgacgccgaccagcaggga

SEQ ID NO: 157735 - DNA, 20 bp, human
gagacatacagacagagtgg

SEQ ID NO: 157736 - DNA, 20 bp, human
gggcgtcagaaccagaactg

SEQ ID NO: 157737 - DNA, 20 bp, human
gccgagcgttacctggtccc

SEQ ID NO: 157738 - DNA, 20 bp, human
gaaatttgcggaatgagcta

SEQ ID NO: 157739 - DNA, 20 bp, human
ggacgaccccaggaacctcg

SEQ ID NO: 157740 - DNA, 20 bp, human
gtgggagcgtaaggagacca

SEQ ID NO: 157741 - DNA, 20 bp, human
gccctccacggaggcctcaa

SEQ ID NO: 157742 - DNA, 20 bp, human
gctccgtggagggacgtcac

SEQ ID NO: 157743 - DNA, 20 bp, human
gagacgccttctgacagagg

SEQ ID NO: 157744 - DNA, 20 bp, human
ggaggtggttcgagccggag

SEQ ID NO: 157745 - DNA, 20 bp, human
ggccccgtgacgtccctcca

SEQ ID NO: 157746 - DNA, 20 bp, human
ggatcaccgagcgccaagta

SEQ ID NO: 157747 - DNA, 20 bp, human
gcccggcgcgactaggggca

SEQ ID NO: 157748 - DNA, 20 bp, human
gtccgagagggcaatctgga

SEQ ID NO: 157749 - DNA, 20 bp, human
gggactgggcccctccgaga

SEQ ID NO: 157750 - DNA, 20 bp, human
gggaggaggaaacgcaacct

SEQ ID NO: 157751 - DNA, 20 bp, human
gccggcacaactccgagagg

SEQ ID NO: 157752 - DNA, 20 bp, human
gggaggaaacgcaacctggg

SEQ ID NO: 157753 - DNA, 20 bp, human
gttcccggcacaactccgag

SEQ ID NO: 157754 - DNA, 20 bp, human
gagggtgacgttgtggtcgt

SEQ ID NO: 157755 - DNA, 20 bp, human
gccgggcccggcgcgactag

SEQ ID NO: 157756 - DNA, 20 bp, human
gacagcgactacagcatcgg

SEQ ID NO: 157757 - DNA, 20 bp, human
gccgagcgcccggcttcgag

SEQ ID NO: 157758 - DNA, 20 bp, human
ggatacagcgactacagcat

SEQ ID NO: 157759 - DNA, 20 bp, human
gccgccggtggccaatcaca

SEQ ID NO: 157760 - DNA, 20 bp, human
ggcgactacagcatcggcgg

SEQ ID NO: 157761 - DNA, 20 bp, human
ggcatcgctcgaggcgctag

SEQ ID NO: 157762 - DNA, 20 bp, human
gccgcgggtgggagaccctt

SEQ ID NO: 157763 - DNA, 20 bp, human
gcggagattgcgggcgtcag

SEQ ID NO: 157764 - DNA, 20 bp, human
gctgcagctagcgccagggg

SEQ ID NO: 157765 - DNA, 20 bp, human
gggcttcgagcggctgctca

SEQ ID NO: 157766 - DNA, 20 bp, human
gtgtggagggcccacagaag

SEQ ID NO: 157767 - DNA, 20 bp, human
gtctggactcctctcctcgt

SEQ ID NO: 157768 - DNA, 20 bp, human
gcagctcctactggcctcta

SEQ ID NO: 157769 - DNA, 20 bp, human
gccaacttgcccacgaggag

SEQ ID NO: 157770 - DNA, 20 bp, human
gggaatcctaagtccaagag

SEQ ID NO: 157771 - DNA, 20 bp, human
gcagaagagtgtctcagcca

SEQ ID NO: 157772 - DNA, 20 bp, human
gaggccccaacttgcccacg

SEQ ID NO: 157773 - DNA, 20 bp, human
ggctgggctctgggatgaag

SEQ ID NO: 157774 - DNA, 20 bp, human
gtctctgtcactcaccgggc

SEQ ID NO: 157775 - DNA, 20 bp, human
gtgggcctccccgctgaaca

SEQ ID NO: 157776 - DNA, 20 bp, human
gcccagcagcggcctcagag

SEQ ID NO: 157777 - DNA, 20 bp, human
gtggaccatctggatgctgg

SEQ ID NO: 157778 - DNA, 20 bp, human
gactcgcagttggagtgtca

SEQ ID NO: 157779 - DNA, 20 bp, human
gagtgctggtccagaatgag

SEQ ID NO: 157780 - DNA, 20 bp, human
gggtgcagtggtggaccatc

SEQ ID NO: 157781 - DNA, 20 bp, human
gcccgtggatggtgcagtgg

SEQ ID NO: 157782 - DNA, 20 bp, human
gtggtggaccatctggatgc

SEQ ID NO: 157783 - DNA, 20 bp, human
gtccagaatgaggggcacct

SEQ ID NO: 157784 - DNA, 20 bp, human
gcagttggagtgtcagggtg

SEQ ID NO: 157785 - DNA, 20 bp, human
ggctgccctggagtacagcc

SEQ ID NO: 157786 - DNA, 20 bp, human
ggctgaacggggtacgtccc

SEQ ID NO: 157787 - DNA, 20 bp, human
gagtcgggcggggagctcgg

SEQ ID NO: 157788 - DNA, 20 bp, human
gagatggcaagctgacaccg

SEQ ID NO: 157789 - DNA, 20 bp, human
gagagcctcacagctccgga

SEQ ID NO: 157790 - DNA, 20 bp, human
gctctgctggcggctgaacg

SEQ ID NO: 157791 - DNA, 20 bp, human
gtgtgccagcatcctcggcg

SEQ ID NO: 157792 - DNA, 20 bp, human
gaggatgctggcacaagcta

SEQ ID NO: 157793 - DNA, 20 bp, human
ggcctggctgatcctcggag

SEQ ID NO: 157794 - DNA, 20 bp, human
gaggtctgtgagtaccgccg

SEQ ID NO: 157795 - DNA, 20 bp, human
gaaccgcagccccagcgaga

SEQ ID NO: 157796 - DNA, 20 bp, human
gtttgtgaaacggacaagag

SEQ ID NO: 157797 - DNA, 20 bp, human
gtgaaacggacaagagaggt

SEQ ID NO: 157798 - DNA, 20 bp, human
ggcgtggaagggccgttcac

SEQ ID NO: 157799 - DNA, 20 bp, human
gtgagcagctctgaaggagg

SEQ ID NO: 157800 - DNA, 20 bp, human
gcacgccctgggatcgcggg

SEQ ID NO: 157801 - DNA, 20 bp, human
gtcagcacgccctgggatcg

SEQ ID NO: 157802 - DNA, 20 bp, human
ggaagggccgttcactggca

SEQ ID NO: 157803 - DNA, 20 bp, human
gaaaaccgcccgcgatccca

SEQ ID NO: 157804 - DNA, 20 bp, human
gcatcggccggtttgtgaaa

SEQ ID NO: 157805 - DNA, 20 bp, human
ggatcgcgggcggttttcat

SEQ ID NO: 157806 - DNA, 20 bp, human
gctgtcccgtccaagcacag

SEQ ID NO: 157807 - DNA, 20 bp, human
gggaggggaggggagaatcg

SEQ ID NO: 157808 - DNA, 20 bp, human
gggatgttgggaacaggaat

SEQ ID NO: 157809 - DNA, 20 bp, human
gttgctacagggatcgggag

SEQ ID NO: 157810 - DNA, 20 bp, human
ggatcgggagaggactaccc

SEQ ID NO: 157811 - DNA, 20 bp, human
gctgcgcccgcagagcaggg

SEQ ID NO: 157812 - DNA, 20 bp, human
gatgcaattgccccggtggt

SEQ ID NO: 157813 - DNA, 20 bp, human
gggatgagccccgcgaccac

SEQ ID NO: 157814 - DNA, 20 bp, human
ggggaggggagaatcgagga

SEQ ID NO: 157815 - DNA, 20 bp, human
gactgaaggaggggtacggt

SEQ ID NO: 157816 - DNA, 20 bp, human
gtctgtctgtggtagagctc

SEQ ID NO: 157817 - DNA, 20 bp, human
ggtagcatttctgtattatt

SEQ ID NO: 157818 - DNA, 20 bp, human
gctggcgaatgaactacagc

SEQ ID NO: 157819 - DNA, 20 bp, human
gttctgctcttaaactttag

SEQ ID NO: 157820 - DNA, 20 bp, human
gggggatgaaacatgagaca

SEQ ID NO: 157821 - DNA, 20 bp, human
ggtgcttttcttaatatcta

SEQ ID NO: 157822 - DNA, 20 bp, human
ggtattattgggcattgaat

SEQ ID NO: 157823 - DNA, 20 bp, human
gcgtgagagccctttctcca

SEQ ID NO: 157824 - DNA, 20 bp, human
gttaatttgtagaatgccaa

SEQ ID NO: 157825 - DNA, 20 bp, human
gtaaaaaccaaacgcttaag

SEQ ID NO: 157826 - DNA, 20 bp, human
ggaataggaggtggatccaa

SEQ ID NO: 157827 - DNA, 20 bp, human
gaccagagtaagcctgacgg

SEQ ID NO: 157828 - DNA, 20 bp, human
gaaagagttgagggaatagg

SEQ ID NO: 157829 - DNA, 20 bp, human
gtgccgcatgatgctgacca

SEQ ID NO: 157830 - DNA, 20 bp, human
gtgacaggtgatctctaccg

SEQ ID NO: 157831 - DNA, 20 bp, human
ggctgagtcgattgaaacag

SEQ ID NO: 157832 - DNA, 20 bp, human
ggccagtaaaacagcgaagc

SEQ ID NO: 157833 - DNA, 20 bp, human
gtcctccgtcaggcttactc

SEQ ID NO: 157834 - DNA, 20 bp, human
gttccctggtcagcatcatg

SEQ ID NO: 157835 - DNA, 20 bp, human
gcattgctaatgcctgggac

SEQ ID NO: 157836 - DNA, 20 bp, human
gctggtgcttcttcacctac

SEQ ID NO: 157837 - DNA, 20 bp, human
gtaagtggctcgctgcggag

SEQ ID NO: 157838 - DNA, 20 bp, human
ggacgcacagatgtgcacgg

SEQ ID NO: 157839 - DNA, 20 bp, human
ggcccgagattagttatcaa

SEQ ID NO: 157840 - DNA, 20 bp, human
gagggctgccaccttaacag

SEQ ID NO: 157841 - DNA, 20 bp, human
ggcacctaagtggctcgctg

SEQ ID NO: 157842 - DNA, 20 bp, human
gtgcttcttcacctacaggc

SEQ ID NO: 157843 - DNA, 20 bp, human
gggtaaaaggacaccggaat

SEQ ID NO: 157844 - DNA, 20 bp, human
ggacaggccatggatgctgc

SEQ ID NO: 157845 - DNA, 20 bp, human
gggaagtgcgtcaccaggtg

SEQ ID NO: 157846 - DNA, 20 bp, human
ggtgatgacggtgaaaactg

SEQ ID NO: 157847 - DNA, 20 bp, human
gctccccgcggtggtgatga

SEQ ID NO: 157848 - DNA, 20 bp, human
ggacgttagcgctcaaagac

SEQ ID NO: 157849 - DNA, 20 bp, human
gtagcgctcaaagaccggct

SEQ ID NO: 157850 - DNA, 20 bp, human
gctcatcctggagtaagtga

SEQ ID NO: 157851 - DNA, 20 bp, human
gtgaaaactgaggctgctaa

SEQ ID NO: 157852 - DNA, 20 bp, human
gtctttctgtctccccgcgg

SEQ ID NO: 157853 - DNA, 20 bp, human
gtagacggcttcataacgtc

SEQ ID NO: 157854 - DNA, 20 bp, human
gggcgcagcatacgccgagc

SEQ ID NO: 157855 - DNA, 20 bp, human
gttcaccgtcatcaccaccg

SEQ ID NO: 157856 - DNA, 20 bp, human
gcagagttccagcttatcag

SEQ ID NO: 157857 - DNA, 20 bp, human
gagagggaaaggaaccaggt

SEQ ID NO: 157858 - DNA, 20 bp, human
ggaacagggatagccgtctc

SEQ ID NO: 157859 - DNA, 20 bp, human
gtcagaggcatgtagcaggg

SEQ ID NO: 157860 - DNA, 20 bp, human
ggtgggacatgacatacggg

SEQ ID NO: 157861 - DNA, 20 bp, human
ggctaggctagttgaatggt

SEQ ID NO: 157862 - DNA, 20 bp, human
gggtagagcccagttatggc

SEQ ID NO: 157863 - DNA, 20 bp, human
gtggggttcataacagaaca

SEQ ID NO: 157864 - DNA, 20 bp, human
gctgggctaggctagttgaa

SEQ ID NO: 157865 - DNA, 20 bp, human
gggcatggggaaggcacata

SEQ ID NO: 157866 - DNA, 20 bp, human
gtcatggtccttctgactgg

SEQ ID NO: 157867 - DNA, 20 bp, human
gagagggcagagccgtgcat

SEQ ID NO: 157868 - DNA, 20 bp, human
gtggggagcagccccatgca

SEQ ID NO: 157869 - DNA, 20 bp, human
gggttcctgctcaggtcctg

SEQ ID NO: 157870 - DNA, 20 bp, human
ggaagggaaagaagtcgcca

SEQ ID NO: 157871 - DNA, 20 bp, human
ggattgtgcctccagtcaga

SEQ ID NO: 157872 - DNA, 20 bp, human
gttgggagccaggagcgagt

SEQ ID NO: 157873 - DNA, 20 bp, human
gagaagtcgccaaggaagaa

SEQ ID NO: 157874 - DNA, 20 bp, human
gtcctgaaattccaggccgt

SEQ ID NO: 157875 - DNA, 20 bp, human
gagcagatagttgggaggga

SEQ ID NO: 157876 - DNA, 20 bp, human
ggaacaatgctccggccggg

SEQ ID NO: 157877 - DNA, 20 bp, human
gtgcgaacaatgctccggcc

SEQ ID NO: 157878 - DNA, 20 bp, human
gcggtcgcctgtcaccccgg

SEQ ID NO: 157879 - DNA, 20 bp, human
gtggtgcccgaggtgcaggg

SEQ ID NO: 157880 - DNA, 20 bp, human
gccttctgcgaacaatgctc

SEQ ID NO: 157881 - DNA, 20 bp, human
gaggcgaccgctcgggaagt

SEQ ID NO: 157882 - DNA, 20 bp, human
ggtgcgtgcccggccgcggg

SEQ ID NO: 157883 - DNA, 20 bp, human
gggcagaagccacccgcccg

SEQ ID NO: 157884 - DNA, 20 bp, human
gcggctcggagaccgacgga

SEQ ID NO: 157885 - DNA, 20 bp, human
ggccgagcgggctacccccg

SEQ ID NO: 157886 - DNA, 20 bp, human
ggctgggaatgcttacactt

SEQ ID NO: 157887 - DNA, 20 bp, human
ggttggttaaggttgcatga

SEQ ID NO: 157888 - DNA, 20 bp, human
gtcttctgtggctaccgtaa

SEQ ID NO: 157889 - DNA, 20 bp, human
ggatcacaccatggactaca

SEQ ID NO: 157890 - DNA, 20 bp, human
gtattttggattagttaatt

SEQ ID NO: 157891 - DNA, 20 bp, human
gatggggaagggggtgttct

SEQ ID NO: 157892 - DNA, 20 bp, human
ggaagtaaaatctaggtatg

SEQ ID NO: 157893 - DNA, 20 bp, human
gcagctttccttgtagtcca

SEQ ID NO: 157894 - DNA, 20 bp, human
gttcaagaggttttgtattt

SEQ ID NO: 157895 - DNA, 20 bp, human
ggtctctttacttatcttct

SEQ ID NO: 157896 - DNA, 20 bp, human
ggccgagtgtggcgcagcag

SEQ ID NO: 157897 - DNA, 20 bp, human
gcgcaggtcccggccgagtg

SEQ ID NO: 157898 - DNA, 20 bp, human
ggagtgtggcgcagcagtgg

SEQ ID NO: 157899 - DNA, 20 bp, human
gtgtgaacccctgagaggag

SEQ ID NO: 157900 - DNA, 20 bp, human
gcccccggcgcatggcgaat

SEQ ID NO: 157901 - DNA, 20 bp, human
gcgatagtgagcttgcggtg

SEQ ID NO: 157902 - DNA, 20 bp, human
gcccgccccgcgctcgtgat

SEQ ID NO: 157903 - DNA, 20 bp, human
gagcttgcgcgaggaaccct

SEQ ID NO: 157904 - DNA, 20 bp, human
ggcttctcgacatttagagg

SEQ ID NO: 157905 - DNA, 20 bp, human
ggtcgcagcacgcccgggtg

SEQ ID NO: 157906 - DNA, 20 bp, human
gcgcgcgcccgggactccga

SEQ ID NO: 157907 - DNA, 20 bp, human
gcagcaccgcggggccaggt

SEQ ID NO: 157908 - DNA, 20 bp, human
ggcgctgtgcaaagttcaag

SEQ ID NO: 157909 - DNA, 20 bp, human
gcgcgccgggagcagcaccg

SEQ ID NO: 157910 - DNA, 20 bp, human
gagagtctgtgactccagac

SEQ ID NO: 157911 - DNA, 20 bp, human
gccgcacctacctggccccg

SEQ ID NO: 157912 - DNA, 20 bp, human
gccccgaggacccccgcgaa

SEQ ID NO: 157913 - DNA, 20 bp, human
gtttgcacagcgcgtgacgg

SEQ ID NO: 157914 - DNA, 20 bp, human
gcagcggccgtgacgcgtca

SEQ ID NO: 157915 - DNA, 20 bp, human
gcgggggctgggcggaggta

SEQ ID NO: 157916 - DNA, 20 bp, human
gagcagtaagctgtcggcag

SEQ ID NO: 157917 - DNA, 20 bp, human
gaatgggagcagtaagctgt

SEQ ID NO: 157918 - DNA, 20 bp, human
ggagtgcctagtaagatggg

SEQ ID NO: 157919 - DNA, 20 bp, human
gcagcagatttagcagagag

SEQ ID NO: 157920 - DNA, 20 bp, human
gcagcagggggaacacaccc

SEQ ID NO: 157921 - DNA, 20 bp, human
gccaccctgctgagaaccaa

SEQ ID NO: 157922 - DNA, 20 bp, human
gaggttccacccatcttact

SEQ ID NO: 157923 - DNA, 20 bp, human
gctaggggttgagacttaag

SEQ ID NO: 157924 - DNA, 20 bp, human
gattgtgcccaggaaatctg

SEQ ID NO: 157925 - DNA, 20 bp, human
gtggctgtccctcacaaggt

SEQ ID NO: 157926 - DNA, 20 bp, human
gctcccgtgggtggtcacag

SEQ ID NO: 157927 - DNA, 20 bp, human
gggcaggcggcgggcaggtc

SEQ ID NO: 157928 - DNA, 20 bp, human
gggaaggaggaggcgtcagt

SEQ ID NO: 157929 - DNA, 20 bp, human
gcgccgcggaatgaaatccg

SEQ ID NO: 157930 - DNA, 20 bp, human
gccagtgcaagtgagtcgtg

SEQ ID NO: 157931 - DNA, 20 bp, human
gcgggatccgggctcggagg

SEQ ID NO: 157932 - DNA, 20 bp, human
gtccccgctgtgaccaccca

SEQ ID NO: 157933 - DNA, 20 bp, human
ggaaagcgttcgcaccagcg

SEQ ID NO: 157934 - DNA, 20 bp, human
gtgccgcgcgcgtacctggc

SEQ ID NO: 157935 - DNA, 20 bp, human
gtggtcacagcggggaggtc

SEQ ID NO: 157936 - DNA, 20 bp, human
gcacgccgcggcctgactag

SEQ ID NO: 157937 - DNA, 20 bp, human
gcggcaacagagatcaatct

SEQ ID NO: 157938 - DNA, 20 bp, human
ggaatgagatgactgctcag

SEQ ID NO: 157939 - DNA, 20 bp, human
gcccccgaggccgcactcgg

SEQ ID NO: 157940 - DNA, 20 bp, human
gacagccgcgaggggagagt

SEQ ID NO: 157941 - DNA, 20 bp, human
gcgaggaagcatgccctggg

SEQ ID NO: 157942 - DNA, 20 bp, human
gccgcgccgtgggccgagtg

SEQ ID NO: 157943 - DNA, 20 bp, human
gccgcccccgaggccgcact

SEQ ID NO: 157944 - DNA, 20 bp, human
gtctctgttgccgctcaggg

SEQ ID NO: 157945 - DNA, 20 bp, human
gcccgggcgtcaccaccctc

SEQ ID NO: 157946 - DNA, 20 bp, human
ggcgacggcggacggtggta

SEQ ID NO: 157947 - DNA, 20 bp, human
gcggtagttccaggcgacgg

SEQ ID NO: 157948 - DNA, 20 bp, human
gacggtggtacggtcctgga

SEQ ID NO: 157949 - DNA, 20 bp, human
gcggcggtagttccaggcga

SEQ ID NO: 157950 - DNA, 20 bp, human
gtccaggcgacggcggacgg

SEQ ID NO: 157951 - DNA, 20 bp, human
gatgtggcggcggtagttcc

SEQ ID NO: 157952 - DNA, 20 bp, human
gtaggaaattagggtctcca

SEQ ID NO: 157953 - DNA, 20 bp, human
gcgcggcgagtgggactcca

SEQ ID NO: 157954 - DNA, 20 bp, human
gaggcggaaaatttcgaatg

SEQ ID NO: 157955 - DNA, 20 bp, human
gggactccaggaaggccggg

SEQ ID NO: 157956 - DNA, 20 bp, human
ggggcaaccgccaacggctg

SEQ ID NO: 157957 - DNA, 20 bp, human
gctgatggggcaaccgccaa

SEQ ID NO: 157958 - DNA, 20 bp, human
gtgccctagaaactgttcaa

SEQ ID NO: 157959 - DNA, 20 bp, human
gccggatcccggaggacaga

SEQ ID NO: 157960 - DNA, 20 bp, human
ggaagacgagccggagaccg

SEQ ID NO: 157961 - DNA, 20 bp, human
gtaaacgccacagccgttgg

SEQ ID NO: 157962 - DNA, 20 bp, human
gccgccgtcccggatcccgg

SEQ ID NO: 157963 - DNA, 20 bp, human
gccagcctctccaaacgaga

SEQ ID NO: 157964 - DNA, 20 bp, human
gagggctccttcgagaactt

SEQ ID NO: 157965 - DNA, 20 bp, human
gtgtcctccgggatccggga

SEQ ID NO: 157966 - DNA, 20 bp, human
ggccgcccatgcctaccccg

SEQ ID NO: 157967 - DNA, 20 bp, human
gctcccggaaatggctccgg

SEQ ID NO: 157968 - DNA, 20 bp, human
ggggcctccaatctcggcgg

SEQ ID NO: 157969 - DNA, 20 bp, human
gtcggaggaccagcaaatcc

SEQ ID NO: 157970 - DNA, 20 bp, human
gtctgaagggagtgcggagg

SEQ ID NO: 157971 - DNA, 20 bp, human
gccgccgccgccgagattgg

SEQ ID NO: 157972 - DNA, 20 bp, human
ggcctcgcccctcccggaaa

SEQ ID NO: 157973 - DNA, 20 bp, human
ggagccggccgggtgctcga

SEQ ID NO: 157974 - DNA, 20 bp, human
ggagggagagaaccataact

SEQ ID NO: 157975 - DNA, 20 bp, human
ggctggtcctccgacgggag

SEQ ID NO: 157976 - DNA, 20 bp, human
gtcacccggcagactccgga

SEQ ID NO: 157977 - DNA, 20 bp, human
gggcacagcgctctaccctc

SEQ ID NO: 157978 - DNA, 20 bp, human
ggccgtcacccggcagactc

SEQ ID NO: 157979 - DNA, 20 bp, human
gggcctgtggcgccgtcacc

SEQ ID NO: 157980 - DNA, 20 bp, human
gggagcgcggggacagttcg

SEQ ID NO: 157981 - DNA, 20 bp, human
gagggaggatgagaaagcgg

SEQ ID NO: 157982 - DNA, 20 bp, human
gccccaacggcgtgcggaac

SEQ ID NO: 157983 - DNA, 20 bp, human
gaacggcgtgcggaacgggc

SEQ ID NO: 157984 - DNA, 20 bp, human
gctgccgctggccaggagcg

SEQ ID NO: 157985 - DNA, 20 bp, human
gcctcgcagtcgagggtctc

SEQ ID NO: 157986 - DNA, 20 bp, human
gcggcgccggaggtaaccat

SEQ ID NO: 157987 - DNA, 20 bp, human
ggagtggcggtgccagcgga

SEQ ID NO: 157988 - DNA, 20 bp, human
gcgcggccccgggcacacca

SEQ ID NO: 157989 - DNA, 20 bp, human
ggccgagagggcgccgtccc

SEQ ID NO: 157990 - DNA, 20 bp, human
gccctggcagcgttggaggg

SEQ ID NO: 157991 - DNA, 20 bp, human
gccgcagccaacggcaaggg

SEQ ID NO: 157992 - DNA, 20 bp, human
gcaccggcccggcgtggcag

SEQ ID NO: 157993 - DNA, 20 bp, human
gaagggtgttcggacctcta

SEQ ID NO: 157994 - DNA, 20 bp, human
ggcgggagtggcggtgccag

SEQ ID NO: 157995 - DNA, 20 bp, human
gcgacgcggaagatgactca

SEQ ID NO: 157996 - DNA, 20 bp, human
gatggcagcgggggatacaa

SEQ ID NO: 157997 - DNA, 20 bp, human
gacaagggcagggcacacta

SEQ ID NO: 157998 - DNA, 20 bp, human
gcacagagaggaggacgaga

SEQ ID NO: 157999 - DNA, 20 bp, human
gcgcgctgctgctagtcctg

SEQ ID NO: 158000 - DNA, 20 bp, human
gacggggcagctcatggcgg

SEQ ID NO: 158001 - DNA, 20 bp, human
gacacccgtgaagagtctgg

SEQ ID NO: 158002 - DNA, 20 bp, human
ggcggcacgaggtaagtgta

SEQ ID NO: 158003 - DNA, 20 bp, human
gggcggctcggactcgggat

SEQ ID NO: 158004 - DNA, 20 bp, human
gtccccagagactgcagaca

SEQ ID NO: 158005 - DNA, 20 bp, human
ggggaggggatcccagagga

SEQ ID NO: 158006 - DNA, 20 bp, human
gctgcgttccgagtcccagg

SEQ ID NO: 158007 - DNA, 20 bp, human
ggcgcagcgagggagtttgg

SEQ ID NO: 158008 - DNA, 20 bp, human
ggtgcgtagcagcctctgtc

SEQ ID NO: 158009 - DNA, 20 bp, human
gcccgcaaaaagcctcaaat

SEQ ID NO: 158010 - DNA, 20 bp, human
gaggccgctggacacgaggg

SEQ ID NO: 158011 - DNA, 20 bp, human
gtgggcattgacctcccgca

SEQ ID NO: 158012 - DNA, 20 bp, human
gctacgcaccgtcaagaagg

SEQ ID NO: 158013 - DNA, 20 bp, human
gaagaggccgctggacacga

SEQ ID NO: 158014 - DNA, 20 bp, human
gcacaagaggaggtcctatc

SEQ ID NO: 158015 - DNA, 20 bp, human
gggcggccagaacaggtgtg

SEQ ID NO: 158016 - DNA, 20 bp, human
gtggctgcggagccgagcac

SEQ ID NO: 158017 - DNA, 20 bp, human
gccgcctcctgccacaccat

SEQ ID NO: 158018 - DNA, 20 bp, human
ggcagctccccgcccagtga

SEQ ID NO: 158019 - DNA, 20 bp, human
gccccgcccagtgacggcag

SEQ ID NO: 158020 - DNA, 20 bp, human
gctgtgcggggctcggaaga

SEQ ID NO: 158021 - DNA, 20 bp, human
ggccccgcacagacgtcagg

SEQ ID NO: 158022 - DNA, 20 bp, human
gggctgcgaagcaaacaagc

SEQ ID NO: 158023 - DNA, 20 bp, human
gcgccgctgccgtcactggg

SEQ ID NO: 158024 - DNA, 20 bp, human
gtcgagtcaagaaccccggg

SEQ ID NO: 158025 - DNA, 20 bp, human
gcacaccatgggcagcgcag

SEQ ID NO: 158026 - DNA, 20 bp, human
gggcgctgaggtggcccgtg

SEQ ID NO: 158027 - DNA, 20 bp, human
ggccacctcagcgccaatcc

SEQ ID NO: 158028 - DNA, 20 bp, human
gcctcagcgccaatccgggt

SEQ ID NO: 158029 - DNA, 20 bp, human
ggcacccagtcagcgctcag

SEQ ID NO: 158030 - DNA, 20 bp, human
gccgcactcacctgccccac

SEQ ID NO: 158031 - DNA, 20 bp, human
gggaagctgctaacccgacc

SEQ ID NO: 158032 - DNA, 20 bp, human
gctgctaacccgacccggat

SEQ ID NO: 158033 - DNA, 20 bp, human
ggcgctgactgggtgcgagt

SEQ ID NO: 158034 - DNA, 20 bp, human
gccgcctgaggggaacttgt

SEQ ID NO: 158035 - DNA, 20 bp, human
ggtccgaccgagggtcgtat

SEQ ID NO: 158036 - DNA, 20 bp, human
gcgcctgagaggtgagtgag

SEQ ID NO: 158037 - DNA, 20 bp, human
ggcgcaagcgcaaccgtcgg

SEQ ID NO: 158038 - DNA, 20 bp, human
gggtgcgcaagcgcaaccgt

SEQ ID NO: 158039 - DNA, 20 bp, human
gtcacccaggtagggactgg

SEQ ID NO: 158040 - DNA, 20 bp, human
gtgcccctcactcacctctc

SEQ ID NO: 158041 - DNA, 20 bp, human
ggcgccgccagtccctacct

SEQ ID NO: 158042 - DNA, 20 bp, human
ggcggttaataagagcggaa

SEQ ID NO: 158043 - DNA, 20 bp, human
gcggggatcggtcgcctgag

SEQ ID NO: 158044 - DNA, 20 bp, human
gcgcaaccgtcggtgggtcg

SEQ ID NO: 158045 - DNA, 20 bp, human
gtccgagaagccaagaggct

SEQ ID NO: 158046 - DNA, 20 bp, human
gccaggctgtgctctctctc

SEQ ID NO: 158047 - DNA, 20 bp, human
gatcgcagcactggtcgcgg

SEQ ID NO: 158048 - DNA, 20 bp, human
gtacctgagggaggacggaa

SEQ ID NO: 158049 - DNA, 20 bp, human
gggcgaggccgggtacctga

SEQ ID NO: 158050 - DNA, 20 bp, human
gtctggggtctacggcctag

SEQ ID NO: 158051 - DNA, 20 bp, human
gtggtgggttctggggtcta

SEQ ID NO: 158052 - DNA, 20 bp, human
ggggatcgcagcactggtcg

SEQ ID NO: 158053 - DNA, 20 bp, human
gtgcgggccccggtccggag

SEQ ID NO: 158054 - DNA, 20 bp, human
gagcggcgggtaccacaccc

SEQ ID NO: 158055 - DNA, 20 bp, human
gctggccagcaccgcccctg

SEQ ID NO: 158056 - DNA, 20 bp, human
gctcgtcgcgtagtgggtgg

SEQ ID NO: 158057 - DNA, 20 bp, human
gggagggtccgagccgagag

SEQ ID NO: 158058 - DNA, 20 bp, human
gctgggcgctcgtcgcgtag

SEQ ID NO: 158059 - DNA, 20 bp, human
gcgccgccggagctaacctc

SEQ ID NO: 158060 - DNA, 20 bp, human
gtccccgaggttagctccgg

SEQ ID NO: 158061 - DNA, 20 bp, human
ggcgctcgtcgcgtagtggg

SEQ ID NO: 158062 - DNA, 20 bp, human
gatatcagaactgagccagg

SEQ ID NO: 158063 - DNA, 20 bp, human
gccctaaggccggttctcta

SEQ ID NO: 158064 - DNA, 20 bp, human
gggcgcccgagaggattcct

SEQ ID NO: 158065 - DNA, 20 bp, human
gctgacgcctgcgcggaacc

SEQ ID NO: 158066 - DNA, 20 bp, human
gtagcttggatccatcccca

SEQ ID NO: 158067 - DNA, 20 bp, human
gccagagagcgtcctgagat

SEQ ID NO: 158068 - DNA, 20 bp, human
gggaacagagccgagatgtg

SEQ ID NO: 158069 - DNA, 20 bp, human
gacccttcttagggatggaa

SEQ ID NO: 158070 - DNA, 20 bp, human
gcttggatccatccccaggg

SEQ ID NO: 158071 - DNA, 20 bp, human
ggggcttccagagttgaagg

SEQ ID NO: 158072 - DNA, 20 bp, human
ggcgcctcggacccacaagg

SEQ ID NO: 158073 - DNA, 20 bp, human
gtcttccgtgcccccgtgga

SEQ ID NO: 158074 - DNA, 20 bp, human
gggagggggtgcccgagagt

SEQ ID NO: 158075 - DNA, 20 bp, human
gcacctgctgcccaaaaccc

SEQ ID NO: 158076 - DNA, 20 bp, human
gccgcgggccgcgacagtcc

SEQ ID NO: 158077 - DNA, 20 bp, human
ggcccgggcagaactggaca

SEQ ID NO: 158078 - DNA, 20 bp, human
gcaaccggcgaggctaccgt

SEQ ID NO: 158079 - DNA, 20 bp, human
gcccgcgccgttatgtaaag

SEQ ID NO: 158080 - DNA, 20 bp, human
ggggaggccggccgcgacag

SEQ ID NO: 158081 - DNA, 20 bp, human
gggcgaggctaccgtagggt

SEQ ID NO: 158082 - DNA, 20 bp, human
gtaacggcgcggggcggcat

SEQ ID NO: 158083 - DNA, 20 bp, human
gtccccaggcacaagttgag

SEQ ID NO: 158084 - DNA, 20 bp, human
gggggtgacgcgcagagccc

SEQ ID NO: 158085 - DNA, 20 bp, human
gcctgagagacaggagctct

SEQ ID NO: 158086 - DNA, 20 bp, human
gtgcctggctgcagtagcag

SEQ ID NO: 158087 - DNA, 20 bp, human
gcatggcctggtggactctt

SEQ ID NO: 158088 - DNA, 20 bp, human
gtggactcttgggcaggccg

SEQ ID NO: 158089 - DNA, 20 bp, human
gggaatgaaatccccagcga

SEQ ID NO: 158090 - DNA, 20 bp, human
gtcatactcacagcacacat

SEQ ID NO: 158091 - DNA, 20 bp, human
gcgaggaggagaactgtgca

SEQ ID NO: 158092 - DNA, 20 bp, human
gacttgagggtgggccacgg

SEQ ID NO: 158093 - DNA, 20 bp, human
gtcgcctcaatccctcgctg

SEQ ID NO: 158094 - DNA, 20 bp, human
ggccccaaaaggctctggtg

SEQ ID NO: 158095 - DNA, 20 bp, human
gatgggcctgctgagggtgt

SEQ ID NO: 158096 - DNA, 20 bp, human
gggctactcacgagacacag

SEQ ID NO: 158097 - DNA, 20 bp, human
gcacagaccgctagaggaag

SEQ ID NO: 158098 - DNA, 20 bp, human
ggaagaggtagctccacagg

SEQ ID NO: 158099 - DNA, 20 bp, human
ggaggaagaggtagctccac

SEQ ID NO: 158100 - DNA, 20 bp, human
gaaattcacccccaagtcaa

SEQ ID NO: 158101 - DNA, 20 bp, human
gttgcagggcctttacacca

SEQ ID NO: 158102 - DNA, 20 bp, human
ggagtcccacagaccgctag

SEQ ID NO: 158103 - DNA, 20 bp, human
ggagctgtcccttgacttgg

SEQ ID NO: 158104 - DNA, 20 bp, human
ggtcagatgtgtgcaagatg

SEQ ID NO: 158105 - DNA, 20 bp, human
gaagggctgcaggaagtaca

SEQ ID NO: 158106 - DNA, 20 bp, human
gcacaagggatcccagagca

SEQ ID NO: 158107 - DNA, 20 bp, human
gggccttcggatggtcaggg

SEQ ID NO: 158108 - DNA, 20 bp, human
ggtgcctagaaggagaggct

SEQ ID NO: 158109 - DNA, 20 bp, human
gggccagggggaactccatg

SEQ ID NO: 158110 - DNA, 20 bp, human
ggctggccttcggatggtca

SEQ ID NO: 158111 - DNA, 20 bp, human
gggcccctcatccctgaagt

SEQ ID NO: 158112 - DNA, 20 bp, human
gtaagtagccaaggcggcat

SEQ ID NO: 158113 - DNA, 20 bp, human
gagtcaggctggccttcgga

SEQ ID NO: 158114 - DNA, 20 bp, human
gggcttgagctcccacttca

SEQ ID NO: 158115 - DNA, 20 bp, human
gcctgaggataaaggtgaca

SEQ ID NO: 158116 - DNA, 20 bp, human
gggccagggtcaccagcgag

SEQ ID NO: 158117 - DNA, 20 bp, human
ggaagatgcctgggtaaggg

SEQ ID NO: 158118 - DNA, 20 bp, human
gggtgagcgtctccccgtag

SEQ ID NO: 158119 - DNA, 20 bp, human
gcagccacacggagtcagag

SEQ ID NO: 158120 - DNA, 20 bp, human
gagcaagtccggctcctgga

SEQ ID NO: 158121 - DNA, 20 bp, human
gtaagagcccggctcctcac

SEQ ID NO: 158122 - DNA, 20 bp, human
ggaagtggcggcagcaagtc

SEQ ID NO: 158123 - DNA, 20 bp, human
ggagatagtctgatccctaa

SEQ ID NO: 158124 - DNA, 20 bp, human
gatctcccgctcctcggcca

SEQ ID NO: 158125 - DNA, 20 bp, human
ggatgaagatgcctgggtaa

SEQ ID NO: 158126 - DNA, 20 bp, human
ggtgtagccggaatacgatg

SEQ ID NO: 158127 - DNA, 20 bp, human
gtgggtccaggcggaagctg

SEQ ID NO: 158128 - DNA, 20 bp, human
gcagcctcgtgggagccccg

SEQ ID NO: 158129 - DNA, 20 bp, human
gcacctgggcaggacccgcg

SEQ ID NO: 158130 - DNA, 20 bp, human
ggacccgcggggctcccacg

SEQ ID NO: 158131 - DNA, 20 bp, human
ggagactaggcaaaaactag

SEQ ID NO: 158132 - DNA, 20 bp, human
ggataggagggcaatgaggt

SEQ ID NO: 158133 - DNA, 20 bp, human
gcaatgaggttggagagatc

SEQ ID NO: 158134 - DNA, 20 bp, human
gggctcgcagggaggatctg

SEQ ID NO: 158135 - DNA, 20 bp, human
gagccccgcgggtcctgccc

SEQ ID NO: 158136 - DNA, 20 bp, human
gggggacctcctaaacccag

SEQ ID NO: 158137 - DNA, 20 bp, human
gtgtcgccgccggcaacccg

SEQ ID NO: 158138 - DNA, 20 bp, human
gtcagtggcccgagaaaggc

SEQ ID NO: 158139 - DNA, 20 bp, human
gccagtgagcgtcagaacca

SEQ ID NO: 158140 - DNA, 20 bp, human
gtcactggctgtgtcaaact

SEQ ID NO: 158141 - DNA, 20 bp, human
gaggagccgctgggtttagg

SEQ ID NO: 158142 - DNA, 20 bp, human
ggcccatgctcttaacacct

SEQ ID NO: 158143 - DNA, 20 bp, human
ggagaaaggcaggagccgct

SEQ ID NO: 158144 - DNA, 20 bp, human
ggaggaaatctgcacccctg

SEQ ID NO: 158145 - DNA, 20 bp, human
gccagggccgctgagaaagg

SEQ ID NO: 158146 - DNA, 20 bp, human
gccactcgcaagctggccaa

SEQ ID NO: 158147 - DNA, 20 bp, human
gcaatttgccaagatgacag

SEQ ID NO: 158148 - DNA, 20 bp, human
gtgatgtcccgagccttgag

SEQ ID NO: 158149 - DNA, 20 bp, human
gacttgcctagcttcttagg

SEQ ID NO: 158150 - DNA, 20 bp, human
gcgagtggccactcaaggct

SEQ ID NO: 158151 - DNA, 20 bp, human
ggcaaattgtgtgaagccct

SEQ ID NO: 158152 - DNA, 20 bp, human
ggctcgggacatcaaagttg

SEQ ID NO: 158153 - DNA, 20 bp, human
gtgagtggccactcgcaagc

SEQ ID NO: 158154 - DNA, 20 bp, human
gtccatccctggctctcctc

SEQ ID NO: 158155 - DNA, 20 bp, human
ggcaaaaagttcagtgagtg

SEQ ID NO: 158156 - DNA, 20 bp, human
gccgccgctcacctagccag

SEQ ID NO: 158157 - DNA, 20 bp, human
gtggccgccagaagccgtcg

SEQ ID NO: 158158 - DNA, 20 bp, human
gagccagcggctccagacac

SEQ ID NO: 158159 - DNA, 20 bp, human
ggagccgctggctaggtgag

SEQ ID NO: 158160 - DNA, 20 bp, human
gaaggcagaggcgtcccaag

SEQ ID NO: 158161 - DNA, 20 bp, human
gcccgcgcaccggcacccag

SEQ ID NO: 158162 - DNA, 20 bp, human
gggtggcgggggaacttcga

SEQ ID NO: 158163 - DNA, 20 bp, human
gcgagggagagggtctgccg

SEQ ID NO: 158164 - DNA, 20 bp, human
gaccagtgctgggcgcccct

SEQ ID NO: 158165 - DNA, 20 bp, human
ggggaagtcccgggaaacgg

SEQ ID NO: 158166 - DNA, 20 bp, human
gcccaggagagcccatgtct

SEQ ID NO: 158167 - DNA, 20 bp, human
gccaggtgatgccaagacat

SEQ ID NO: 158168 - DNA, 20 bp, human
gcaggcaacaggacccaaag

SEQ ID NO: 158169 - DNA, 20 bp, human
gggcaggtgggactctgcaa

SEQ ID NO: 158170 - DNA, 20 bp, human
gaggccctggcccaggacga

SEQ ID NO: 158171 - DNA, 20 bp, human
gggcctgagaccctcgtcct

SEQ ID NO: 158172 - DNA, 20 bp, human
gtgggatgcacgcaccagaa

SEQ ID NO: 158173 - DNA, 20 bp, human
ggccaggcagaacgcccgag

SEQ ID NO: 158174 - DNA, 20 bp, human
gtggaaggagcgggagactt

SEQ ID NO: 158175 - DNA, 20 bp, human
ggcaatctagtccttctcct

SEQ ID NO: 158176 - DNA, 20 bp, human
ggtgcgaagcgctccagagt

SEQ ID NO: 158177 - DNA, 20 bp, human
gcgacccccggatcacctgg

SEQ ID NO: 158178 - DNA, 20 bp, human
gccgccgccaggtgatccgg

SEQ ID NO: 158179 - DNA, 20 bp, human
gcgaggtagcgcagcgggac

SEQ ID NO: 158180 - DNA, 20 bp, human
gcccgagcgaggtagcgcag

SEQ ID NO: 158181 - DNA, 20 bp, human
ggtccccgcgcccccacacg

SEQ ID NO: 158182 - DNA, 20 bp, human
ggcgggaagcgctgttccag

SEQ ID NO: 158183 - DNA, 20 bp, human
ggggacggaggaggctacag

SEQ ID NO: 158184 - DNA, 20 bp, human
gctctcgaaacaggcgacac

SEQ ID NO: 158185 - DNA, 20 bp, human
gggttcccgcggccacgtgt

SEQ ID NO: 158186 - DNA, 20 bp, human
gagattgcgccagccagggt

SEQ ID NO: 158187 - DNA, 20 bp, human
gagctaccgggatcccaccc

SEQ ID NO: 158188 - DNA, 20 bp, human
gcgtgggagatgaagatggt

SEQ ID NO: 158189 - DNA, 20 bp, human
gtagcccccacctagctacc

SEQ ID NO: 158190 - DNA, 20 bp, human
ggggatcccggtagctaggt

SEQ ID NO: 158191 - DNA, 20 bp, human
ggtcagggatgtaggtccca

SEQ ID NO: 158192 - DNA, 20 bp, human
gtaccgcggcctgcacaccc

SEQ ID NO: 158193 - DNA, 20 bp, human
ggcaaagattgcgccagcca

SEQ ID NO: 158194 - DNA, 20 bp, human
gaccgggatcccaccctggc

SEQ ID NO: 158195 - DNA, 20 bp, human
gcgacgatggtcagataccg

SEQ ID NO: 158196 - DNA, 20 bp, human
gtggagcccaggtggcacga

SEQ ID NO: 158197 - DNA, 20 bp, human
gagctaccagggccccgacg

SEQ ID NO: 158198 - DNA, 20 bp, human
gcacgaaggcaactgacccg

SEQ ID NO: 158199 - DNA, 20 bp, human
gcacagcgcgggagccgtca

SEQ ID NO: 158200 - DNA, 20 bp, human
ggccgtcacggtgctcaagg

SEQ ID NO: 158201 - DNA, 20 bp, human
gcccaccttgagcaccgtga

SEQ ID NO: 158202 - DNA, 20 bp, human
gctcggccacttggacatcg

SEQ ID NO: 158203 - DNA, 20 bp, human
gcgcgtcgaacacgaaccag

SEQ ID NO: 158204 - DNA, 20 bp, human
gaccattgcttcatccggca

SEQ ID NO: 158205 - DNA, 20 bp, human
ggccttctgaatgccgggta

SEQ ID NO: 158206 - DNA, 20 bp, human
gggcgcgcgcatgcgcactc

SEQ ID NO: 158207 - DNA, 20 bp, human
gcccgggcgccgaacaggga

SEQ ID NO: 158208 - DNA, 20 bp, human
ggtcaccgaagacaaacgcg

SEQ ID NO: 158209 - DNA, 20 bp, human
gcgaggccacactgacctcc

SEQ ID NO: 158210 - DNA, 20 bp, human
gagacgcctggtcaattcct

SEQ ID NO: 158211 - DNA, 20 bp, human
gggtaacttgagtcagtagg

SEQ ID NO: 158212 - DNA, 20 bp, human
gaggggcgtcttgggcctgg

SEQ ID NO: 158213 - DNA, 20 bp, human
gcgtggccgcaccgagacga

SEQ ID NO: 158214 - DNA, 20 bp, human
gtaatgacagcataggaatt

SEQ ID NO: 158215 - DNA, 20 bp, human
gagactgacagagccttaag

SEQ ID NO: 158216 - DNA, 20 bp, human
gctcctccctccattggccc

SEQ ID NO: 158217 - DNA, 20 bp, human
gctctttccaactgtcgaaa

SEQ ID NO: 158218 - DNA, 20 bp, human
gcggagcccagtggacccct

SEQ ID NO: 158219 - DNA, 20 bp, human
ggcaagcaagtgccaggtcg

SEQ ID NO: 158220 - DNA, 20 bp, human
gcaaatcctgacagtgacac

SEQ ID NO: 158221 - DNA, 20 bp, human
gagcagcccaggggtccact

SEQ ID NO: 158222 - DNA, 20 bp, human
ggcggcgcattccctgacag

SEQ ID NO: 158223 - DNA, 20 bp, human
gacacaggcaagcaagtgcc

SEQ ID NO: 158224 - DNA, 20 bp, human
gccccaacacacccctgtca

SEQ ID NO: 158225 - DNA, 20 bp, human
ggtgaaaagggattcgagta

SEQ ID NO: 158226 - DNA, 20 bp, human
gtaggggctgaaacagcggt

SEQ ID NO: 158227 - DNA, 20 bp, human
ggatgggagatggtgctata

SEQ ID NO: 158228 - DNA, 20 bp, human
gcagcgcttagagagctcgg

SEQ ID NO: 158229 - DNA, 20 bp, human
gtacagcggtaaggagagtg

SEQ ID NO: 158230 - DNA, 20 bp, human
gggatgcatgagtcttccaa

SEQ ID NO: 158231 - DNA, 20 bp, human
ggttgtttgggtcctgaaaa

SEQ ID NO: 158232 - DNA, 20 bp, human
gcgccctaagtactgagaca

SEQ ID NO: 158233 - DNA, 20 bp, human
gatacacggatcaccatcct

SEQ ID NO: 158234 - DNA, 20 bp, human
gtcttcctctggctctacag

SEQ ID NO: 158235 - DNA, 20 bp, human
gaaacagcggttggcagaga

SEQ ID NO: 158236 - DNA, 20 bp, human
gtcccagcgatcttccccga

SEQ ID NO: 158237 - DNA, 20 bp, human
ggcctgaaaggcagacaacg

SEQ ID NO: 158238 - DNA, 20 bp, human
ggaacccagctacgagccgc

SEQ ID NO: 158239 - DNA, 20 bp, human
ggcctgaaaatggagtccga

SEQ ID NO: 158240 - DNA, 20 bp, human
ggggtaaagcgctgccgtcg

SEQ ID NO: 158241 - DNA, 20 bp, human
gtgccgtcggggaagatcgc

SEQ ID NO: 158242 - DNA, 20 bp, human
gggatctggctccctcccgg

SEQ ID NO: 158243 - DNA, 20 bp, human
gtatctgcggacccgccggg

SEQ ID NO: 158244 - DNA, 20 bp, human
gctttcaggccacgcagggt

SEQ ID NO: 158245 - DNA, 20 bp, human
ggagggcggggaggaaaggt

SEQ ID NO: 158246 - DNA, 20 bp, human
ggtcagggtcagcccggtag

SEQ ID NO: 158247 - DNA, 20 bp, human
gggtagacagacgggccggc

SEQ ID NO: 158248 - DNA, 20 bp, human
gcgcaggccgctcatgctgg

SEQ ID NO: 158249 - DNA, 20 bp, human
gagtgggatcaggctcaggg

SEQ ID NO: 158250 - DNA, 20 bp, human
gaaaccgctcccgagcacgg

SEQ ID NO: 158251 - DNA, 20 bp, human
gatgctgggggtagacagac

SEQ ID NO: 158252 - DNA, 20 bp, human
ggggagggggtcagagtgaa

SEQ ID NO: 158253 - DNA, 20 bp, human
gtgggggtagacagacgggc

SEQ ID NO: 158254 - DNA, 20 bp, human
gggatgagtcaggcttgagg

SEQ ID NO: 158255 - DNA, 20 bp, human
ggagggattatcagccacgg

SEQ ID NO: 158256 - DNA, 20 bp, human
ggtccagcctgcctctcctg

SEQ ID NO: 158257 - DNA, 20 bp, human
ggagaagtcccagcgtccta

SEQ ID NO: 158258 - DNA, 20 bp, human
ggctcttgccccggatgggt

SEQ ID NO: 158259 - DNA, 20 bp, human
gagcgccgcccacccatccg

SEQ ID NO: 158260 - DNA, 20 bp, human
gcctccaatccggtaagggg

SEQ ID NO: 158261 - DNA, 20 bp, human
gtccacttagagactcgtgg

SEQ ID NO: 158262 - DNA, 20 bp, human
gagctctgcccgagagacgg

SEQ ID NO: 158263 - DNA, 20 bp, human
gaagagccgcgccgcaggag

SEQ ID NO: 158264 - DNA, 20 bp, human
gtcctgccggggtaagagtg

SEQ ID NO: 158265 - DNA, 20 bp, human
gtaccccggcaggacttgag

SEQ ID NO: 158266 - DNA, 20 bp, human
ggggtctcgggggtctcgcg

SEQ ID NO: 158267 - DNA, 20 bp, human
gcgcgggccctgggtcgagg

SEQ ID NO: 158268 - DNA, 20 bp, human
ggcgctcggcgggtaagcct

SEQ ID NO: 158269 - DNA, 20 bp, human
ggggccaggagagcgctcgg

SEQ ID NO: 158270 - DNA, 20 bp, human
gaagccgccgcctcgaccca

SEQ ID NO: 158271 - DNA, 20 bp, human
gcacggcgggcagtgcccga

SEQ ID NO: 158272 - DNA, 20 bp, human
gagtctccggggagtctcag

SEQ ID NO: 158273 - DNA, 20 bp, human
gtcagggtcccggcaggtat

SEQ ID NO: 158274 - DNA, 20 bp, human
gtcccttgccgggggctcag

SEQ ID NO: 158275 - DNA, 20 bp, human
gacccctgagcccccggcaa

SEQ ID NO: 158276 - DNA, 20 bp, human
ggcgtcaggcctcacatgtc

SEQ ID NO: 158277 - DNA, 20 bp, human
gtggggcagccaggcgcgtc

SEQ ID NO: 158278 - DNA, 20 bp, human
gagcagcaggagtgagctgt

SEQ ID NO: 158279 - DNA, 20 bp, human
gggcctctcaaggcagacag

SEQ ID NO: 158280 - DNA, 20 bp, human
gtcacatgtctgggagatgt

SEQ ID NO: 158281 - DNA, 20 bp, human
gccagctcgggggcctctca

SEQ ID NO: 158282 - DNA, 20 bp, human
gtcacatgcggccgacaggg

SEQ ID NO: 158283 - DNA, 20 bp, human
gcctgtgcctgccagctcgg

SEQ ID NO: 158284 - DNA, 20 bp, human
ggtcggccgcatgtgatggg

SEQ ID NO: 158285 - DNA, 20 bp, human
gctggcccccgcctccctgt

SEQ ID NO: 158286 - DNA, 20 bp, human
gggctccgcgggactcacgg

SEQ ID NO: 158287 - DNA, 20 bp, human
gcgcggctccgcgggactca

SEQ ID NO: 158288 - DNA, 20 bp, human
ggccgccgccgtgagtcccg

SEQ ID NO: 158289 - DNA, 20 bp, human
gtccgcgggactcacggcgg

SEQ ID NO: 158290 - DNA, 20 bp, human
gagcggctcggcccagccgg

SEQ ID NO: 158291 - DNA, 20 bp, human
ggcacgatctgcgcccgcaa

SEQ ID NO: 158292 - DNA, 20 bp, human
gcgagccgctggccgacgag

SEQ ID NO: 158293 - DNA, 20 bp, human
gcagccccgaactcaggcgg

SEQ ID NO: 158294 - DNA, 20 bp, human
gagggccgcccgccgggaag

SEQ ID NO: 158295 - DNA, 20 bp, human
gggctccgctcgtcggccag

SEQ ID NO: 158296 - DNA, 20 bp, human
ggcacggtcggggagccgcc

SEQ ID NO: 158297 - DNA, 20 bp, human
ggactggcggccacataggg

SEQ ID NO: 158298 - DNA, 20 bp, human
gcggccggaggtatccgcat

SEQ ID NO: 158299 - DNA, 20 bp, human
gtcggcgagctgcgtctccc

SEQ ID NO: 158300 - DNA, 20 bp, human
gcccggaccacagttactgg

SEQ ID NO: 158301 - DNA, 20 bp, human
ggccacagccgggcacggtc

SEQ ID NO: 158302 - DNA, 20 bp, human
gagccgccggggccgacacc

SEQ ID NO: 158303 - DNA, 20 bp, human
gggggactggcggccacata

SEQ ID NO: 158304 - DNA, 20 bp, human
ggtctcccgggtgtcggccc

SEQ ID NO: 158305 - DNA, 20 bp, human
gtcccgggtgtcggccccgg

SEQ ID NO: 158306 - DNA, 20 bp, human
ggagaggaggtgtgagatgt

SEQ ID NO: 158307 - DNA, 20 bp, human
gtgcatcgctatctcctcca

SEQ ID NO: 158308 - DNA, 20 bp, human
ggttggagaaagccttgcta

SEQ ID NO: 158309 - DNA, 20 bp, human
ggcacaagtcagatgaggtg

SEQ ID NO: 158310 - DNA, 20 bp, human
gtcaccctctggcaccacat

SEQ ID NO: 158311 - DNA, 20 bp, human
gaggacaaactgttccagat

SEQ ID NO: 158312 - DNA, 20 bp, human
gacagcccatgtggtgccag

SEQ ID NO: 158313 - DNA, 20 bp, human
gtggtgccagagggtgagcg

SEQ ID NO: 158314 - DNA, 20 bp, human
gagccagctgacagcccatg

SEQ ID NO: 158315 - DNA, 20 bp, human
gcaccacatgggctgtcagc

SEQ ID NO: 158316 - DNA, 20 bp, human
gcggacgggaaggtaaactg

SEQ ID NO: 158317 - DNA, 20 bp, human
ggggactggtcggaatacat

SEQ ID NO: 158318 - DNA, 20 bp, human
gagaagctccgcggacggga

SEQ ID NO: 158319 - DNA, 20 bp, human
gactggtcggaatacatggg

SEQ ID NO: 158320 - DNA, 20 bp, human
ggaggctgtagagttggaag

SEQ ID NO: 158321 - DNA, 20 bp, human
gctgaggtaaggctgtgcgg

SEQ ID NO: 158322 - DNA, 20 bp, human
gttgcagcatagaagctccg

SEQ ID NO: 158323 - DNA, 20 bp, human
gagcatagaagctccgcgga

SEQ ID NO: 158324 - DNA, 20 bp, human
gggtcggaatacatgggtgg

SEQ ID NO: 158325 - DNA, 20 bp, human
gaaggagagaagttgaggta

SEQ ID NO: 158326 - DNA, 20 bp, human
ggtacaacacacaagaggaa

SEQ ID NO: 158327 - DNA, 20 bp, human
gtagtggtacaacacacaag

SEQ ID NO: 158328 - DNA, 20 bp, human
gtccccactaatcttcctag

SEQ ID NO: 158329 - DNA, 20 bp, human
gaccactaggaagattagtg

SEQ ID NO: 158330 - DNA, 20 bp, human
gctagttacatagtttactt

SEQ ID NO: 158331 - DNA, 20 bp, human
gaagctagcaggctaaaaac

SEQ ID NO: 158332 - DNA, 20 bp, human
gaagcaacaactcttacctg

SEQ ID NO: 158333 - DNA, 20 bp, human
gttagctcggctttagccac

SEQ ID NO: 158334 - DNA, 20 bp, human
gttaaagtcatagtaacgca

SEQ ID NO: 158335 - DNA, 20 bp, human
ggatattttcatttaaggga

SEQ ID NO: 158336 - DNA, 20 bp, human
gtagctaaggaaagaaagca

SEQ ID NO: 158337 - DNA, 20 bp, human
gttcacaaaggactgttcaa

SEQ ID NO: 158338 - DNA, 20 bp, human
gatcacagttcgcctgacag

SEQ ID NO: 158339 - DNA, 20 bp, human
gatagacagtaactctaaag

SEQ ID NO: 158340 - DNA, 20 bp, human
gattcagagaagcttcataa

SEQ ID NO: 158341 - DNA, 20 bp, human
gttttgagctgagtaatctg

SEQ ID NO: 158342 - DNA, 20 bp, human
gaccagaacatcgttcttca

SEQ ID NO: 158343 - DNA, 20 bp, human
gaaaagacacaatgaaggac

SEQ ID NO: 158344 - DNA, 20 bp, human
gaagatggttacgtgtcaaa

SEQ ID NO: 158345 - DNA, 20 bp, human
gaccttgaagaacgatgttc

SEQ ID NO: 158346 - DNA, 20 bp, human
gagggcgccccggaaaccat

SEQ ID NO: 158347 - DNA, 20 bp, human
gccgcgcagggtgcgacctg

SEQ ID NO: 158348 - DNA, 20 bp, human
gcccagtactcggccgtcag

SEQ ID NO: 158349 - DNA, 20 bp, human
gggcgcttgggcagaaccaa

SEQ ID NO: 158350 - DNA, 20 bp, human
gggataccgcgcgcagaagg

SEQ ID NO: 158351 - DNA, 20 bp, human
gcggaaaccatgggtaagtg

SEQ ID NO: 158352 - DNA, 20 bp, human
gtggcaggatgacctagcac

SEQ ID NO: 158353 - DNA, 20 bp, human
gcgacctgaggcaagacagt

SEQ ID NO: 158354 - DNA, 20 bp, human
gtgtccacggttgcagagag

SEQ ID NO: 158355 - DNA, 20 bp, human
gctcggggaagaggccatag

SEQ ID NO: 158356 - DNA, 20 bp, human
gccccgggctgcccggatga

SEQ ID NO: 158357 - DNA, 20 bp, human
gcggcagcatgtcggtggcg

SEQ ID NO: 158358 - DNA, 20 bp, human
gggaagaccaagggacggac

SEQ ID NO: 158359 - DNA, 20 bp, human
ggggagaggtccgcgtccct

SEQ ID NO: 158360 - DNA, 20 bp, human
gccatgcgggctccagaagc

SEQ ID NO: 158361 - DNA, 20 bp, human
gcgcgtgtcccctgccaggt

SEQ ID NO: 158362 - DNA, 20 bp, human
gggccggcaccggaagcgtg

SEQ ID NO: 158363 - DNA, 20 bp, human
gccgcaccccgcctttgcag

SEQ ID NO: 158364 - DNA, 20 bp, human
gggggaagagaggagtcccg

SEQ ID NO: 158365 - DNA, 20 bp, human
gcagcccggggcccggtact

SEQ ID NO: 158366 - DNA, 20 bp, human
gccggcggcggcacgaccag

SEQ ID NO: 158367 - DNA, 20 bp, human
gctcgcgcccatagccccgg

SEQ ID NO: 158368 - DNA, 20 bp, human
ggcggcggcacgaccagagg

SEQ ID NO: 158369 - DNA, 20 bp, human
gacgccggggacccgcggga

SEQ ID NO: 158370 - DNA, 20 bp, human
ggccctcgcgcccatagccc

SEQ ID NO: 158371 - DNA, 20 bp, human
gcacgaccagaggcggccag

SEQ ID NO: 158372 - DNA, 20 bp, human
gggcggcgagcagcgctacc

SEQ ID NO: 158373 - DNA, 20 bp, human
gcgggcgcgagatgatgcgg

SEQ ID NO: 158374 - DNA, 20 bp, human
ggcggagcctagcgggacac

SEQ ID NO: 158375 - DNA, 20 bp, human
ggcacgggcgcgagatgatg

SEQ ID NO: 158376 - DNA, 20 bp, human
gggccggtccccccgcggct

SEQ ID NO: 158377 - DNA, 20 bp, human
ggtgtgtgcgagtgtgacag

SEQ ID NO: 158378 - DNA, 20 bp, human
gcgggaggcggagacggagt

SEQ ID NO: 158379 - DNA, 20 bp, human
gggtagggaggcgcagagga

SEQ ID NO: 158380 - DNA, 20 bp, human
ggcgagtgtgacagcggctg

SEQ ID NO: 158381 - DNA, 20 bp, human
gctaggagggcgcgagggtg

SEQ ID NO: 158382 - DNA, 20 bp, human
gtcggagagattctgcggag

SEQ ID NO: 158383 - DNA, 20 bp, human
gagaaggcgccaagacgccg

SEQ ID NO: 158384 - DNA, 20 bp, human
ggaatctctccgatttacaa

SEQ ID NO: 158385 - DNA, 20 bp, human
ggggccgcctgctctctcct

SEQ ID NO: 158386 - DNA, 20 bp, human
gccacccctggggaacacta

SEQ ID NO: 158387 - DNA, 20 bp, human
ggagccggccgacctagcgg

SEQ ID NO: 158388 - DNA, 20 bp, human
ggcggagccggccgacctag

SEQ ID NO: 158389 - DNA, 20 bp, human
gcagccttagtgttccccag

SEQ ID NO: 158390 - DNA, 20 bp, human
gctggggcgcagggctagag

SEQ ID NO: 158391 - DNA, 20 bp, human
gcacaggagcactgacgtcg

SEQ ID NO: 158392 - DNA, 20 bp, human
gtgacgtcgtggtatcagaa

SEQ ID NO: 158393 - DNA, 20 bp, human
gtcctgtggcctccaccccg

SEQ ID NO: 158394 - DNA, 20 bp, human
gttcccagggagcggcggtt

SEQ ID NO: 158395 - DNA, 20 bp, human
gcgtcgtggtatcagaaagg

SEQ ID NO: 158396 - DNA, 20 bp, human
gggtcagcaagggctcaggg

SEQ ID NO: 158397 - DNA, 20 bp, human
gcccaaccagcccaaagggt

SEQ ID NO: 158398 - DNA, 20 bp, human
gctggtgccccgcagcaggt

SEQ ID NO: 158399 - DNA, 20 bp, human
gtccctcttccggtcagcaa

SEQ ID NO: 158400 - DNA, 20 bp, human
gcgagggcagcagcccggga

SEQ ID NO: 158401 - DNA, 20 bp, human
ggcccttgctgaccggaaga

SEQ ID NO: 158402 - DNA, 20 bp, human
gtcactgctggacaagggca

SEQ ID NO: 158403 - DNA, 20 bp, human
gggcaccggtgcctcgcccc

SEQ ID NO: 158404 - DNA, 20 bp, human
ggagccagcccgagcgcgca

SEQ ID NO: 158405 - DNA, 20 bp, human
gcaagggctcaggggggcag

SEQ ID NO: 158406 - DNA, 20 bp, human
gagcagcaggagtcgccccg

SEQ ID NO: 158407 - DNA, 20 bp, human
gcgcaagtgggagtgaatgg

SEQ ID NO: 158408 - DNA, 20 bp, human
ggcgggctcggcgggcacac

SEQ ID NO: 158409 - DNA, 20 bp, human
gtcgcggggagcaggaaacc

SEQ ID NO: 158410 - DNA, 20 bp, human
ggccgaggcagcgtgaaagt

SEQ ID NO: 158411 - DNA, 20 bp, human
gcctgagcagacgatcacgg

SEQ ID NO: 158412 - DNA, 20 bp, human
gcgggcacacgggcgcaagt

SEQ ID NO: 158413 - DNA, 20 bp, human
gcggcgccgacgggaacccg

SEQ ID NO: 158414 - DNA, 20 bp, human
ggggtgcgcgaggcaggcga

SEQ ID NO: 158415 - DNA, 20 bp, human
ggtccggacgggggacaccg

SEQ ID NO: 158416 - DNA, 20 bp, human
gtcccgccggacccaccggg

SEQ ID NO: 158417 - DNA, 20 bp, human
ggccctgcgaagaaactcca

SEQ ID NO: 158418 - DNA, 20 bp, human
gcgcagggctgtgatctcca

SEQ ID NO: 158419 - DNA, 20 bp, human
gcagttcccgccggacccac

SEQ ID NO: 158420 - DNA, 20 bp, human
gcgtggtggacgtggagaag

SEQ ID NO: 158421 - DNA, 20 bp, human
gaggggcaaggggccatccg

SEQ ID NO: 158422 - DNA, 20 bp, human
gactcacgtagtgcttggag

SEQ ID NO: 158423 - DNA, 20 bp, human
gcccccagcagggtcggcgg

SEQ ID NO: 158424 - DNA, 20 bp, human
ggaactggcggagcagagga

SEQ ID NO: 158425 - DNA, 20 bp, human
gtcgcgacctcacagctggg

SEQ ID NO: 158426 - DNA, 20 bp, human
ggtgcgcgccgagcgaaggg

SEQ ID NO: 158427 - DNA, 20 bp, human
ggccgcagggaggcgagtag

SEQ ID NO: 158428 - DNA, 20 bp, human
gtggagtgcgcgccgagcga

SEQ ID NO: 158429 - DNA, 20 bp, human
gggcggctcgtgctcggccc

SEQ ID NO: 158430 - DNA, 20 bp, human
gccccctactcgcctccctg

SEQ ID NO: 158431 - DNA, 20 bp, human
gggagaacgaggcaaaagcg

SEQ ID NO: 158432 - DNA, 20 bp, human
ggaacgaggcaaaagcgggg

SEQ ID NO: 158433 - DNA, 20 bp, human
gaggggacgggaagcgctgg

SEQ ID NO: 158434 - DNA, 20 bp, human
gccgcggcgcagcatcgtgg

SEQ ID NO: 158435 - DNA, 20 bp, human
gccgccgcggcgcagcatcg

SEQ ID NO: 158436 - DNA, 20 bp, human
gggagagagagaccgaccca

SEQ ID NO: 158437 - DNA, 20 bp, human
gtttgttcgcggccccgcag

SEQ ID NO: 158438 - DNA, 20 bp, human
gggagccgaggcgcgaggta

SEQ ID NO: 158439 - DNA, 20 bp, human
gtcctgcccggagaaggcag

SEQ ID NO: 158440 - DNA, 20 bp, human
gctcgccctcgggtccccgt

SEQ ID NO: 158441 - DNA, 20 bp, human
gggccgggaatcaggacctg

SEQ ID NO: 158442 - DNA, 20 bp, human
gccggcccacggggacccga

SEQ ID NO: 158443 - DNA, 20 bp, human
gttctagcccagccaagata

SEQ ID NO: 158444 - DNA, 20 bp, human
gggatggcgcggtctctctg

SEQ ID NO: 158445 - DNA, 20 bp, human
ggagagaccgacccagggcg

SEQ ID NO: 158446 - DNA, 20 bp, human
ggtgcgctgcgccctccaac

SEQ ID NO: 158447 - DNA, 20 bp, human
gggaaaggaagccggttgga

SEQ ID NO: 158448 - DNA, 20 bp, human
gtggaggaaaggaagccggt

SEQ ID NO: 158449 - DNA, 20 bp, human
ggtactggggcagcatatac

SEQ ID NO: 158450 - DNA, 20 bp, human
gcccctgctgcgcggaggag

SEQ ID NO: 158451 - DNA, 20 bp, human
ggggcagcatatacaggtag

SEQ ID NO: 158452 - DNA, 20 bp, human
gtggcagcagcggcgcttgg

SEQ ID NO: 158453 - DNA, 20 bp, human
gacctgtaaaaaccgtactg

SEQ ID NO: 158454 - DNA, 20 bp, human
ggccttctcgccaaacctct

SEQ ID NO: 158455 - DNA, 20 bp, human
gccccctcctccgcgcagca

SEQ ID NO: 158456 - DNA, 20 bp, human
gggacaggccaggcgagcga

SEQ ID NO: 158457 - DNA, 20 bp, human
gtgccgggcacgaagctcaa

SEQ ID NO: 158458 - DNA, 20 bp, human
gcaggccaggcgagcgacgg

SEQ ID NO: 158459 - DNA, 20 bp, human
ggagcgagggcgacgaggac

SEQ ID NO: 158460 - DNA, 20 bp, human
ggcgcagagcgagggcgacg

SEQ ID NO: 158461 - DNA, 20 bp, human
gagggcgacgaggacaggcc

SEQ ID NO: 158462 - DNA, 20 bp, human
ggccccgcgcgggggaccgg

SEQ ID NO: 158463 - DNA, 20 bp, human
gccggcgtggagcccgccac

SEQ ID NO: 158464 - DNA, 20 bp, human
gaggcgctgcgctcaggact

SEQ ID NO: 158465 - DNA, 20 bp, human
gagcatcgggccaccagccg

SEQ ID NO: 158466 - DNA, 20 bp, human
gcctgcggcgtgttcctcag

SEQ ID NO: 158467 - DNA, 20 bp, human
gagcgctggctggccccacg

SEQ ID NO: 158468 - DNA, 20 bp, human
gccggagccccccatacctg

SEQ ID NO: 158469 - DNA, 20 bp, human
ggccgtagcacgcaggaacc

SEQ ID NO: 158470 - DNA, 20 bp, human
gtcatgccaagggccagcac

SEQ ID NO: 158471 - DNA, 20 bp, human
gccagctggagacagccccg

SEQ ID NO: 158472 - DNA, 20 bp, human
gccagggccgctcatgccaa

SEQ ID NO: 158473 - DNA, 20 bp, human
gaacacgccgcaggtatggg

SEQ ID NO: 158474 - DNA, 20 bp, human
gccacagggccgtagcacgc

SEQ ID NO: 158475 - DNA, 20 bp, human
ggcacctgtgagctctgagt

SEQ ID NO: 158476 - DNA, 20 bp, human
gggtaggatggtacacacat

SEQ ID NO: 158477 - DNA, 20 bp, human
gcaagggcctcggccagggt

SEQ ID NO: 158478 - DNA, 20 bp, human
gaggatggtacacacatggg

SEQ ID NO: 158479 - DNA, 20 bp, human
gcctgtcctggggggatctc

SEQ ID NO: 158480 - DNA, 20 bp, human
ggctgtagccgggatatcaa

SEQ ID NO: 158481 - DNA, 20 bp, human
gttcccaagggcctcggcca

SEQ ID NO: 158482 - DNA, 20 bp, human
ggggagcggagtctgacccg

SEQ ID NO: 158483 - DNA, 20 bp, human
gcaggcagtgagttcctctg

SEQ ID NO: 158484 - DNA, 20 bp, human
gccccctgggaaactcacct

SEQ ID NO: 158485 - DNA, 20 bp, human
gcaagtttatggccacccat

SEQ ID NO: 158486 - DNA, 20 bp, human
gtgcggaggcggtcctatga

SEQ ID NO: 158487 - DNA, 20 bp, human
gggaatgtgcgtggaacccg

SEQ ID NO: 158488 - DNA, 20 bp, human
ggcaggagaggggtacctgg

SEQ ID NO: 158489 - DNA, 20 bp, human
gctgcggccccgtcccctat

SEQ ID NO: 158490 - DNA, 20 bp, human
ggctgtgccccaacccaggt

SEQ ID NO: 158491 - DNA, 20 bp, human
gcctatgacggtagtaggac

SEQ ID NO: 158492 - DNA, 20 bp, human
gaaggagccgcgggaggtaa

SEQ ID NO: 158493 - DNA, 20 bp, human
ggggcagcagtgagtacccg

SEQ ID NO: 158494 - DNA, 20 bp, human
gcccagctcttgagagggga

SEQ ID NO: 158495 - DNA, 20 bp, human
gggacggggccgcaggagag

SEQ ID NO: 158496 - DNA, 20 bp, human
ggccgggccaaggacatccg

SEQ ID NO: 158497 - DNA, 20 bp, human
gaagggggtcgagaacctgg

SEQ ID NO: 158498 - DNA, 20 bp, human
gggaagagcaggcggagacg

SEQ ID NO: 158499 - DNA, 20 bp, human
ggctgctgagtcccggtcgg

SEQ ID NO: 158500 - DNA, 20 bp, human
gggggctgctgagtcccggt

SEQ ID NO: 158501 - DNA, 20 bp, human
ggcccgctcgccctccgggg

SEQ ID NO: 158502 - DNA, 20 bp, human
gagggtccccgtctccgggg

SEQ ID NO: 158503 - DNA, 20 bp, human
gcatgccccaccgccccgga

SEQ ID NO: 158504 - DNA, 20 bp, human
gagggcgccccggatgtcct

SEQ ID NO: 158505 - DNA, 20 bp, human
ggaggacctcaccccccccg

SEQ ID NO: 158506 - DNA, 20 bp, human
gacatccagcgaggacgaga

SEQ ID NO: 158507 - DNA, 20 bp, human
gtccgaccccacggagtagt

SEQ ID NO: 158508 - DNA, 20 bp, human
ggagtagtcggagaagctct

SEQ ID NO: 158509 - DNA, 20 bp, human
gacagcaacagcatgatgtg

SEQ ID NO: 158510 - DNA, 20 bp, human
ggcttctccgactactccgt

SEQ ID NO: 158511 - DNA, 20 bp, human
gccagagcagtcaggaccgt

SEQ ID NO: 158512 - DNA, 20 bp, human
ggcccggatcgtgtcataga

SEQ ID NO: 158513 - DNA, 20 bp, human
gaaccaaagggcagaccacg

SEQ ID NO: 158514 - DNA, 20 bp, human
gtgtgaggccagcggcagca

SEQ ID NO: 158515 - DNA, 20 bp, human
gccactgcggagaagccggg

SEQ ID NO: 158516 - DNA, 20 bp, human
ggaattcgaatacagctcct

SEQ ID NO: 158517 - DNA, 20 bp, human
gcttcaggcagagacccccg

SEQ ID NO: 158518 - DNA, 20 bp, human
ggagcctccgtggtgacaca

SEQ ID NO: 158519 - DNA, 20 bp, human
gcacggcaggaaccttcccc

SEQ ID NO: 158520 - DNA, 20 bp, human
gagcaccggagggacccgca

SEQ ID NO: 158521 - DNA, 20 bp, human
ggcccggaacgacagagcac

SEQ ID NO: 158522 - DNA, 20 bp, human
gggaacgacagagcaccgga

SEQ ID NO: 158523 - DNA, 20 bp, human
gaccgcggcgaggccgtgaa

SEQ ID NO: 158524 - DNA, 20 bp, human
gcctgccgtgcgggtccctc

SEQ ID NO: 158525 - DNA, 20 bp, human
gtacagctcctgggcgcgcc

SEQ ID NO: 158526 - DNA, 20 bp, human
gacagccaagagcactgcgg

SEQ ID NO: 158527 - DNA, 20 bp, human
ggcgcccagcggcctcaccg

SEQ ID NO: 158528 - DNA, 20 bp, human
gcacggaagcgcgctcggag

SEQ ID NO: 158529 - DNA, 20 bp, human
ggcggcggagcccaagtccg

SEQ ID NO: 158530 - DNA, 20 bp, human
gctgtaaagtaggtccaggt

SEQ ID NO: 158531 - DNA, 20 bp, human
gacccaggtggcaagcggag

SEQ ID NO: 158532 - DNA, 20 bp, human
gcgctcccgggacctccaat

SEQ ID NO: 158533 - DNA, 20 bp, human
gcgactatcccagcgcctaa

SEQ ID NO: 158534 - DNA, 20 bp, human
gaagcaccggccacaactga

SEQ ID NO: 158535 - DNA, 20 bp, human
gtgtaggaaactgactccag

SEQ ID NO: 158536 - DNA, 20 bp, human
gcgacaggcgccgccgggac

SEQ ID NO: 158537 - DNA, 20 bp, human
ggcgcccgtgcccgtcccgg

SEQ ID NO: 158538 - DNA, 20 bp, human
gctgagtgtcacacacgcgg

SEQ ID NO: 158539 - DNA, 20 bp, human
gcatgagacgcgcccacgag

SEQ ID NO: 158540 - DNA, 20 bp, human
gggcctgagtgtcacacacg

SEQ ID NO: 158541 - DNA, 20 bp, human
gggaggctgcggctccgacg

SEQ ID NO: 158542 - DNA, 20 bp, human
gggaatctcgcgcccctcgt

SEQ ID NO: 158543 - DNA, 20 bp, human
gcgcgcgcccgtgcccgtcc

SEQ ID NO: 158544 - DNA, 20 bp, human
gcctcctgccggcagctctc

SEQ ID NO: 158545 - DNA, 20 bp, human
gtagcttgggcggcgctagg

SEQ ID NO: 158546 - DNA, 20 bp, human
gtgagccgccgagtggacag

SEQ ID NO: 158547 - DNA, 20 bp, human
gtcagccactgtccactcgg

SEQ ID NO: 158548 - DNA, 20 bp, human
ggcaggcgcgaggtagccag

SEQ ID NO: 158549 - DNA, 20 bp, human
gctcttgggagaatgtgtag

SEQ ID NO: 158550 - DNA, 20 bp, human
gggctgattatggagagcag

SEQ ID NO: 158551 - DNA, 20 bp, human
gagttgtctgagccgccgag

SEQ ID NO: 158552 - DNA, 20 bp, human
gtaatcagccactgtccact

SEQ ID NO: 158553 - DNA, 20 bp, human
gggcggctcagacaactctt

SEQ ID NO: 158554 - DNA, 20 bp, human
gtggacagccggagggtcgt

SEQ ID NO: 158555 - DNA, 20 bp, human
ggagatggtgttcacagata

SEQ ID NO: 158556 - DNA, 20 bp, human
gcaacgtggagcctcttctc

SEQ ID NO: 158557 - DNA, 20 bp, human
ggggcgcccagggtctaagg

SEQ ID NO: 158558 - DNA, 20 bp, human
ggatggggcctgaaactgtc

SEQ ID NO: 158559 - DNA, 20 bp, human
ggatggggaggggatcgtag

SEQ ID NO: 158560 - DNA, 20 bp, human
ggccccatccccgcccaacg

SEQ ID NO: 158561 - DNA, 20 bp, human
gtggctcccccttagaccct

SEQ ID NO: 158562 - DNA, 20 bp, human
gctctggctgagaagagaac

SEQ ID NO: 158563 - DNA, 20 bp, human
gggaagggcagctgatgatg

SEQ ID NO: 158564 - DNA, 20 bp, human
gagaggctccacgttgggcg

SEQ ID NO: 158565 - DNA, 20 bp, human
gtagcctggttggacctctg

SEQ ID NO: 158566 - DNA, 20 bp, human
ggaatggaaggagtaacgaa

SEQ ID NO: 158567 - DNA, 20 bp, human
ggaggatcgttgctaggagg

SEQ ID NO: 158568 - DNA, 20 bp, human
gggagggaccctgaggtaga

SEQ ID NO: 158569 - DNA, 20 bp, human
ggccgaggatcgttgctagg

SEQ ID NO: 158570 - DNA, 20 bp, human
gggagccccctgaagttggg

SEQ ID NO: 158571 - DNA, 20 bp, human
gagtagggcttggaacgtgt

SEQ ID NO: 158572 - DNA, 20 bp, human
gtccggggagaggggtctca

SEQ ID NO: 158573 - DNA, 20 bp, human
gcggagtttcggagaatgga

SEQ ID NO: 158574 - DNA, 20 bp, human
gcccctgaccctctacctca

SEQ ID NO: 158575 - DNA, 20 bp, human
gtcccgggagaggggttccg

SEQ ID NO: 158576 - DNA, 20 bp, human
gccgccgagtggatccggaa

SEQ ID NO: 158577 - DNA, 20 bp, human
gccgcccggaccctgcgtca

SEQ ID NO: 158578 - DNA, 20 bp, human
gccaggcgcagcgcccggtc

SEQ ID NO: 158579 - DNA, 20 bp, human
gcggccatgacgcagggtcc

SEQ ID NO: 158580 - DNA, 20 bp, human
gggactcacccgcacgacgt

SEQ ID NO: 158581 - DNA, 20 bp, human
ggcacgacgtaggagacccc

SEQ ID NO: 158582 - DNA, 20 bp, human
gcggccgcggccatgacgca

SEQ ID NO: 158583 - DNA, 20 bp, human
gccgcccgacggagcccgac

SEQ ID NO: 158584 - DNA, 20 bp, human
gcgaccccgcgccccgacag

SEQ ID NO: 158585 - DNA, 20 bp, human
gcgccgccgccgagtggatc

SEQ ID NO: 158586 - DNA, 20 bp, human
gcagctgggcgctccatcag

SEQ ID NO: 158587 - DNA, 20 bp, human
gatgcagcgagcccacggag

SEQ ID NO: 158588 - DNA, 20 bp, human
gcctcgccggacaccaagta

SEQ ID NO: 158589 - DNA, 20 bp, human
gacagcctgtcggtgagcgg

SEQ ID NO: 158590 - DNA, 20 bp, human
gggcggaggcaaggtttcgg

SEQ ID NO: 158591 - DNA, 20 bp, human
gaggctgccgggcccatcgt

SEQ ID NO: 158592 - DNA, 20 bp, human
gtggaagcatgcccctccgt

SEQ ID NO: 158593 - DNA, 20 bp, human
gggagcgggacggagagtgg

SEQ ID NO: 158594 - DNA, 20 bp, human
gcgagccactgtccccggag

SEQ ID NO: 158595 - DNA, 20 bp, human
gtccacagcctgtcggtgag

SEQ ID NO: 158596 - DNA, 20 bp, human
gaggggccgggagccgaggt

SEQ ID NO: 158597 - DNA, 20 bp, human
gctcgagagcagagttggag

SEQ ID NO: 158598 - DNA, 20 bp, human
gtcgtcgtctggtagataaa

SEQ ID NO: 158599 - DNA, 20 bp, human
gtcgctcacggccaactctt

SEQ ID NO: 158600 - DNA, 20 bp, human
ggcgagctcgagagcagagt

SEQ ID NO: 158601 - DNA, 20 bp, human
gtggacgaaggtagctccgg

SEQ ID NO: 158602 - DNA, 20 bp, human
gtctcccgacaaggattcca

SEQ ID NO: 158603 - DNA, 20 bp, human
ggtcgggagagcctagaccc

SEQ ID NO: 158604 - DNA, 20 bp, human
gactcttaggcgcagaaccc

SEQ ID NO: 158605 - DNA, 20 bp, human
gccttggacgaaggtagctc

SEQ ID NO: 158606 - DNA, 20 bp, human
gctgacgggtcgctgacggg

SEQ ID NO: 158607 - DNA, 20 bp, human
gccatggcgccggagcgcat

SEQ ID NO: 158608 - DNA, 20 bp, human
gggacagccatctaagccaa

SEQ ID NO: 158609 - DNA, 20 bp, human
gtggctgacgggtcgctgac

SEQ ID NO: 158610 - DNA, 20 bp, human
gctgacgggcggcggtctgg

SEQ ID NO: 158611 - DNA, 20 bp, human
gaaagtcgggcggtacccag

SEQ ID NO: 158612 - DNA, 20 bp, human
gccaggcctccgctcagagg

SEQ ID NO: 158613 - DNA, 20 bp, human
ggggcgtcgggaccctagga

SEQ ID NO: 158614 - DNA, 20 bp, human
ggagggagtcccccacccct

SEQ ID NO: 158615 - DNA, 20 bp, human
gcgacccaggcgccctccta

SEQ ID NO: 158616 - DNA, 20 bp, human
gtacgggacacgcagactgg

SEQ ID NO: 158617 - DNA, 20 bp, human
ggaagtgctgcaggactgta

SEQ ID NO: 158618 - DNA, 20 bp, human
gatccgggacaggaagacta

SEQ ID NO: 158619 - DNA, 20 bp, human
ggtgtccccggagacagcgg

SEQ ID NO: 158620 - DNA, 20 bp, human
gcggccgcgaccaccctgaa

SEQ ID NO: 158621 - DNA, 20 bp, human
gccgcaccatcagcccggac

SEQ ID NO: 158622 - DNA, 20 bp, human
gtggtgcggaatgagtccgc

SEQ ID NO: 158623 - DNA, 20 bp, human
ggagatggcgtcgggctcca

SEQ ID NO: 158624 - DNA, 20 bp, human
gctgcgtgtcccgtatgagg

SEQ ID NO: 158625 - DNA, 20 bp, human
gcaggccgaggacacgggag

SEQ ID NO: 158626 - DNA, 20 bp, human
ggcggttccctggagcgaca

SEQ ID NO: 158627 - DNA, 20 bp, human
gctagggcgaggggcatccg

SEQ ID NO: 158628 - DNA, 20 bp, human
ggctccgggatcccttcctg

SEQ ID NO: 158629 - DNA, 20 bp, human
ggccgagaggagcgcgacaa

SEQ ID NO: 158630 - DNA, 20 bp, human
ggacgctgctgcccgggacg

SEQ ID NO: 158631 - DNA, 20 bp, human
ggggcgaggggcatccgcgg

SEQ ID NO: 158632 - DNA, 20 bp, human
gtccgggccagcgccacctg

SEQ ID NO: 158633 - DNA, 20 bp, human
gtcctggggtcgggagatcc

SEQ ID NO: 158634 - DNA, 20 bp, human
ggcgtcccacctcccggcgg

SEQ ID NO: 158635 - DNA, 20 bp, human
ggggcggccgtgtcgctcca

SEQ ID NO: 158636 - DNA, 20 bp, human
gaccagagaggaccgagcgg

SEQ ID NO: 158637 - DNA, 20 bp, human
ggaggcggcgggagtatccc

SEQ ID NO: 158638 - DNA, 20 bp, human
ggggaccagagaggaccgag

SEQ ID NO: 158639 - DNA, 20 bp, human
ggcccagcccagacacgcag

SEQ ID NO: 158640 - DNA, 20 bp, human
gagagaggaccgagcggagg

SEQ ID NO: 158641 - DNA, 20 bp, human
gagacacgcagaggcgccag

SEQ ID NO: 158642 - DNA, 20 bp, human
gccggcgcagcgacagacgg

SEQ ID NO: 158643 - DNA, 20 bp, human
gccagtcacggggaatgcag

SEQ ID NO: 158644 - DNA, 20 bp, human
gtccccggcgcagcgacaga

SEQ ID NO: 158645 - DNA, 20 bp, human
ggcgacagacggtggacgga

SEQ ID NO: 158646 - DNA, 20 bp, human
gttactgagcggagctcctc

SEQ ID NO: 158647 - DNA, 20 bp, human
gggagctccgctcagtaaca

SEQ ID NO: 158648 - DNA, 20 bp, human
gggtctcgacccgaataagg

SEQ ID NO: 158649 - DNA, 20 bp, human
gtgagcggagctcctccggc

SEQ ID NO: 158650 - DNA, 20 bp, human
ggccccggcgggaccccccc

SEQ ID NO: 158651 - DNA, 20 bp, human
gcggggtctcgacccgaata

SEQ ID NO: 158652 - DNA, 20 bp, human
gaggcggccaggatgtccgg

SEQ ID NO: 158653 - DNA, 20 bp, human
ggccagccagactgagcgag

SEQ ID NO: 158654 - DNA, 20 bp, human
ggtgggtccgggggcgacag

SEQ ID NO: 158655 - DNA, 20 bp, human
ggaacgcaggggagcgctgg

SEQ ID NO: 158656 - DNA, 20 bp, human
ggttgcccttctcgtctaga

SEQ ID NO: 158657 - DNA, 20 bp, human
gcgtgggtgcgggaggaacc

SEQ ID NO: 158658 - DNA, 20 bp, human
gggaggaacctggtagataa

SEQ ID NO: 158659 - DNA, 20 bp, human
ggccgccatctagacgagaa

SEQ ID NO: 158660 - DNA, 20 bp, human
gtgctcttgcgggtgaacgt

SEQ ID NO: 158661 - DNA, 20 bp, human
gcaccctcgcagccatctga

SEQ ID NO: 158662 - DNA, 20 bp, human
gagacgagaagggcaacact

SEQ ID NO: 158663 - DNA, 20 bp, human
ggcctgcgcaccagacacgg

SEQ ID NO: 158664 - DNA, 20 bp, human
ggcccttctcgtctagatgg

SEQ ID NO: 158665 - DNA, 20 bp, human
gcttgcctgcgcaccagaca

SEQ ID NO: 158666 - DNA, 20 bp, human
ggcgtcggaggcggtagtga

SEQ ID NO: 158667 - DNA, 20 bp, human
gtcggaggcggtagtgacgg

SEQ ID NO: 158668 - DNA, 20 bp, human
gtatgggtccagactcacgg

SEQ ID NO: 158669 - DNA, 20 bp, human
gggctatgggtccagactca

SEQ ID NO: 158670 - DNA, 20 bp, human
ggactcaggcctccgtgtgg

SEQ ID NO: 158671 - DNA, 20 bp, human
ggaaccctcactcttcctca

SEQ ID NO: 158672 - DNA, 20 bp, human
gggtgactcaggcctccgtg

SEQ ID NO: 158673 - DNA, 20 bp, human
gatggtagcgtcagcgtcgg

SEQ ID NO: 158674 - DNA, 20 bp, human
ggccccgcgtctgtgatggt

SEQ ID NO: 158675 - DNA, 20 bp, human
ggctaacgctcacccctcag

SEQ ID NO: 158676 - DNA, 20 bp, human
gcgctgataacggaacacat

SEQ ID NO: 158677 - DNA, 20 bp, human
gggctgccggccgctgataa

SEQ ID NO: 158678 - DNA, 20 bp, human
gctgctggtatgctcgggac

SEQ ID NO: 158679 - DNA, 20 bp, human
ggcggcgggcaaggttatat

SEQ ID NO: 158680 - DNA, 20 bp, human
gtaccagcagcgaggagacg

SEQ ID NO: 158681 - DNA, 20 bp, human
gtaacggaacacatcggagt

SEQ ID NO: 158682 - DNA, 20 bp, human
gcgggactggcgtgcggacc

SEQ ID NO: 158683 - DNA, 20 bp, human
gcggaagtcatcagttccat

SEQ ID NO: 158684 - DNA, 20 bp, human
gtggcgtgcggaccgggcag

SEQ ID NO: 158685 - DNA, 20 bp, human
gaaactgcttgtaggctaaa

SEQ ID NO: 158686 - DNA, 20 bp, human
gcggccagggggctcctaag

SEQ ID NO: 158687 - DNA, 20 bp, human
gacggtggctgcacagagtc

SEQ ID NO: 158688 - DNA, 20 bp, human
ggccctgctgggcttcacgg

SEQ ID NO: 158689 - DNA, 20 bp, human
gcgcggctcgcagatcaggg

SEQ ID NO: 158690 - DNA, 20 bp, human
gcggcgcggctcgcagatca

SEQ ID NO: 158691 - DNA, 20 bp, human
gcagagtcgggcttgattcg

SEQ ID NO: 158692 - DNA, 20 bp, human
ggctcgcagatcagggaggt

SEQ ID NO: 158693 - DNA, 20 bp, human
gctgccccttaggagccccc

SEQ ID NO: 158694 - DNA, 20 bp, human
gccggggccgggctttgtgt

SEQ ID NO: 158695 - DNA, 20 bp, human
gcggctcgggaccccactcc

SEQ ID NO: 158696 - DNA, 20 bp, human
gctggtcagaaggaatatgg

SEQ ID NO: 158697 - DNA, 20 bp, human
ggccgaggcgcgcctggacc

SEQ ID NO: 158698 - DNA, 20 bp, human
gcccgacggctcggcaggta

SEQ ID NO: 158699 - DNA, 20 bp, human
gcagctgccgcagcagatgg

SEQ ID NO: 158700 - DNA, 20 bp, human
gctggccgggcggacaaaga

SEQ ID NO: 158701 - DNA, 20 bp, human
gctcgccagcgccctgctgg

SEQ ID NO: 158702 - DNA, 20 bp, human
ggaaagggcctaggaccagg

SEQ ID NO: 158703 - DNA, 20 bp, human
gggcgctggcgagcctggcc

SEQ ID NO: 158704 - DNA, 20 bp, human
gcctaagacatgaagcccta

SEQ ID NO: 158705 - DNA, 20 bp, human
ggctgccaggccctcacggg

SEQ ID NO: 158706 - DNA, 20 bp, human
ggccgaagccagtcctgcgt

SEQ ID NO: 158707 - DNA, 20 bp, human
ggacgcagctggaaagcgaa

SEQ ID NO: 158708 - DNA, 20 bp, human
gcccagcccctatctgtcac

SEQ ID NO: 158709 - DNA, 20 bp, human
gtgcgagtaccccagacagg

SEQ ID NO: 158710 - DNA, 20 bp, human
gagagctgtcagcaaccccg

SEQ ID NO: 158711 - DNA, 20 bp, human
gaggggccggggaggcgaca

SEQ ID NO: 158712 - DNA, 20 bp, human
gcgccgcggccaagtacaaa

SEQ ID NO: 158713 - DNA, 20 bp, human
gcgcgcaccatgctgactcc

SEQ ID NO: 158714 - DNA, 20 bp, human
gcatggtgcgcggggcgagt

SEQ ID NO: 158715 - DNA, 20 bp, human
gcagcgattccgcctcccca

SEQ ID NO: 158716 - DNA, 20 bp, human
gggtcgggcctcccagagaa

SEQ ID NO: 158717 - DNA, 20 bp, human
ggacggctcccgaacactga

SEQ ID NO: 158718 - DNA, 20 bp, human
gagggaccgcaggaccaagc

SEQ ID NO: 158719 - DNA, 20 bp, human
gcccgcgggtggcatggtgg

SEQ ID NO: 158720 - DNA, 20 bp, human
ggagcccaagcccctcggat

SEQ ID NO: 158721 - DNA, 20 bp, human
ggcgctcggccccactcccc

SEQ ID NO: 158722 - DNA, 20 bp, human
ggcaacacccaaggctcccg

SEQ ID NO: 158723 - DNA, 20 bp, human
gtgcccatggtggctcggat

SEQ ID NO: 158724 - DNA, 20 bp, human
gcccccagaggaggcggaag

SEQ ID NO: 158725 - DNA, 20 bp, human
gggggagggaccgatccgag

SEQ ID NO: 158726 - DNA, 20 bp, human
gggctaacatggggtgagct

SEQ ID NO: 158727 - DNA, 20 bp, human
gagggatgataacggccttg

SEQ ID NO: 158728 - DNA, 20 bp, human
gagcagcctctgcccaacag

SEQ ID NO: 158729 - DNA, 20 bp, human
gtgggacccacaccctcctt

SEQ ID NO: 158730 - DNA, 20 bp, human
ggaaagcccaggggtacagg

SEQ ID NO: 158731 - DNA, 20 bp, human
ggcagtcccagggcggggta

SEQ ID NO: 158732 - DNA, 20 bp, human
gagtggcccacgatgggaag

SEQ ID NO: 158733 - DNA, 20 bp, human
gaggagctttgttagctgta

SEQ ID NO: 158734 - DNA, 20 bp, human
gggggaaagcccaggggtac

SEQ ID NO: 158735 - DNA, 20 bp, human
gggacagagctaaagactcc

SEQ ID NO: 158736 - DNA, 20 bp, human
ggtgagcggccagtacgaca

SEQ ID NO: 158737 - DNA, 20 bp, human
gcgggcgcccggaatcccgg

SEQ ID NO: 158738 - DNA, 20 bp, human
gtagccccagcacgtctcgt

SEQ ID NO: 158739 - DNA, 20 bp, human
gggggcggccgcgagctgaa

SEQ ID NO: 158740 - DNA, 20 bp, human
ggcccgggcgcccggaatcc

SEQ ID NO: 158741 - DNA, 20 bp, human
ggagctgaacggcaccgccc

SEQ ID NO: 158742 - DNA, 20 bp, human
gcagcacgtctcgtaggtga

SEQ ID NO: 158743 - DNA, 20 bp, human
gcagcccgcggcggctgtgg

SEQ ID NO: 158744 - DNA, 20 bp, human
gtcgcggccgccccgtgcca

SEQ ID NO: 158745 - DNA, 20 bp, human
gggcgccatcgaggcgcggg

SEQ ID NO: 158746 - DNA, 20 bp, human
gtcctggtgccgttggcgcc

SEQ ID NO: 158747 - DNA, 20 bp, human
ggagggtcgacagacaccag

SEQ ID NO: 158748 - DNA, 20 bp, human
ggtgtgcagacattaggacg

SEQ ID NO: 158749 - DNA, 20 bp, human
ggctagaggccaggagtacg

SEQ ID NO: 158750 - DNA, 20 bp, human
gcgaggcgaggcgcgatgta

SEQ ID NO: 158751 - DNA, 20 bp, human
gagaggggtgtgcagacatt

SEQ ID NO: 158752 - DNA, 20 bp, human
ggacattaggacgaggagcg

SEQ ID NO: 158753 - DNA, 20 bp, human
gatcaggcgagagatgaatg

SEQ ID NO: 158754 - DNA, 20 bp, human
ggcgggagaagcgattggga

SEQ ID NO: 158755 - DNA, 20 bp, human
ggaatgcgggagaagcgatt

SEQ ID NO: 158756 - DNA, 20 bp, human
ggcgggaaggtagcgcagtc

SEQ ID NO: 158757 - DNA, 20 bp, human
gggaaggtagcgcagtcggg

SEQ ID NO: 158758 - DNA, 20 bp, human
gcatgcaccgggcgcagtag

SEQ ID NO: 158759 - DNA, 20 bp, human
gcaccgggcgcagtagcggg

SEQ ID NO: 158760 - DNA, 20 bp, human
gcggaggacgcgcccaccgg

SEQ ID NO: 158761 - DNA, 20 bp, human
ggcgggctgtactgagagcg

SEQ ID NO: 158762 - DNA, 20 bp, human
gcgggtcttggccctagcgg

SEQ ID NO: 158763 - DNA, 20 bp, human
ggcggcgcccggccatgcac

SEQ ID NO: 158764 - DNA, 20 bp, human
gagctccgaggccgcacctc

SEQ ID NO: 158765 - DNA, 20 bp, human
gccggcccggggaagatctc

SEQ ID NO: 158766 - DNA, 20 bp, human
ggatactgcgagagggctag

SEQ ID NO: 158767 - DNA, 20 bp, human
ggctaggggcggccagtccg

SEQ ID NO: 158768 - DNA, 20 bp, human
gactgcgagagggctagggg

SEQ ID NO: 158769 - DNA, 20 bp, human
gggcgagctggtgaggtgag

SEQ ID NO: 158770 - DNA, 20 bp, human
gcgcacttggcgagctggtg

SEQ ID NO: 158771 - DNA, 20 bp, human
gctcggtgaggaagcaaccg

SEQ ID NO: 158772 - DNA, 20 bp, human
ggaggagcagccgaaggacg

SEQ ID NO: 158773 - DNA, 20 bp, human
gttggccggcagccccggac

SEQ ID NO: 158774 - DNA, 20 bp, human
ggtgagagggatactgcgag

SEQ ID NO: 158775 - DNA, 20 bp, human
ggcttcggccgcgcctcgag

SEQ ID NO: 158776 - DNA, 20 bp, human
gccccgactggggaccccct

SEQ ID NO: 158777 - DNA, 20 bp, human
gcccgggaggcccccgactg

SEQ ID NO: 158778 - DNA, 20 bp, human
gcctggagaagaaggagtct

SEQ ID NO: 158779 - DNA, 20 bp, human
gggcgagaggtactgaatct

SEQ ID NO: 158780 - DNA, 20 bp, human
gccccctcccgcaggatcca

SEQ ID NO: 158781 - DNA, 20 bp, human
ggggaatccctgtccatcaa

SEQ ID NO: 158782 - DNA, 20 bp, human
gcgggtgcacacccggaagt

SEQ ID NO: 158783 - DNA, 20 bp, human
gagccgagggggtccccagt

SEQ ID NO: 158784 - DNA, 20 bp, human
gggagggatggagagggcgt

SEQ ID NO: 158785 - DNA, 20 bp, human
ggatgaatgacttccccggg

SEQ ID NO: 158786 - DNA, 20 bp, human
gggtggggccctgagaaagg

SEQ ID NO: 158787 - DNA, 20 bp, human
gcaacgagaaaagtgttcag

SEQ ID NO: 158788 - DNA, 20 bp, human
gggacgccgaagcacccccc

SEQ ID NO: 158789 - DNA, 20 bp, human
ggcgcgggccgtgttccggt

SEQ ID NO: 158790 - DNA, 20 bp, human
gaggcacattcggtatgatg

SEQ ID NO: 158791 - DNA, 20 bp, human
gctgggactggtggcaccgg

SEQ ID NO: 158792 - DNA, 20 bp, human
gagaatgcgaaggcttatcg

SEQ ID NO: 158793 - DNA, 20 bp, human
gcggcggcggcgtaggacgg

SEQ ID NO: 158794 - DNA, 20 bp, human
gggtggtggggccctgagaa

SEQ ID NO: 158795 - DNA, 20 bp, human
gcccgaagccgcccacctac

SEQ ID NO: 158796 - DNA, 20 bp, human
gagccaccaactctggtcta

SEQ ID NO: 158797 - DNA, 20 bp, human
gggctcagagctggccggaa

SEQ ID NO: 158798 - DNA, 20 bp, human
gtgctgccctagaccagagt

SEQ ID NO: 158799 - DNA, 20 bp, human
gtgccctagaccagagttgg

SEQ ID NO: 158800 - DNA, 20 bp, human
ggaagaggcagagttggcaa

SEQ ID NO: 158801 - DNA, 20 bp, human
ggcaactcggaagtcgcagg

SEQ ID NO: 158802 - DNA, 20 bp, human
gatcgcaactcggaagtcgc

SEQ ID NO: 158803 - DNA, 20 bp, human
gggcggctcgggtaagaatg

SEQ ID NO: 158804 - DNA, 20 bp, human
gctcggttgcatcatctgca

SEQ ID NO: 158805 - DNA, 20 bp, human
ggaagtacagcatcgcaact

SEQ ID NO: 158806 - DNA, 20 bp, human
gggcagcgtcgcttcttagg

SEQ ID NO: 158807 - DNA, 20 bp, human
gggctcctgacggtaactcg

SEQ ID NO: 158808 - DNA, 20 bp, human
gtaactcggggccgatgagg

SEQ ID NO: 158809 - DNA, 20 bp, human
ggggcgagcgaggaggatgg

SEQ ID NO: 158810 - DNA, 20 bp, human
gtcggccccgagttaccgtc

SEQ ID NO: 158811 - DNA, 20 bp, human
ggcggagtcggggctcctga

SEQ ID NO: 158812 - DNA, 20 bp, human
gcggtaactcggggccgatg

SEQ ID NO: 158813 - DNA, 20 bp, human
gacagcaaccaggaaagcgg

SEQ ID NO: 158814 - DNA, 20 bp, human
ggaggaggatggcggagtcg

SEQ ID NO: 158815 - DNA, 20 bp, human
gagcgtcgcttcttaggagg

SEQ ID NO: 158816 - DNA, 20 bp, human
ggaggcgccgaaccccagga

SEQ ID NO: 158817 - DNA, 20 bp, human
gccctggagccggagcgcaa

SEQ ID NO: 158818 - DNA, 20 bp, human
ggcgcgcggggccgactccg

SEQ ID NO: 158819 - DNA, 20 bp, human
ggaattcggcaccgcgagag

SEQ ID NO: 158820 - DNA, 20 bp, human
gggccgactccgtggcgagg

SEQ ID NO: 158821 - DNA, 20 bp, human
ggcctccaggacatcacgga

SEQ ID NO: 158822 - DNA, 20 bp, human
gcagacaggcagcgcatggg

SEQ ID NO: 158823 - DNA, 20 bp, human
ggaccacgtagacaatgaca

SEQ ID NO: 158824 - DNA, 20 bp, human
gtccagcctccaggacatca

SEQ ID NO: 158825 - DNA, 20 bp, human
gcgaggaggcgccgaacccc

SEQ ID NO: 158826 - DNA, 20 bp, human
gggcgccgccgagagaagca

SEQ ID NO: 158827 - DNA, 20 bp, human
gggctccctgcttctctcgg

SEQ ID NO: 158828 - DNA, 20 bp, human
ggcagcccgcgactgacgga

SEQ ID NO: 158829 - DNA, 20 bp, human
gaggagggcgctctcccgtc

SEQ ID NO: 158830 - DNA, 20 bp, human
gccatgtccagctcccggac

SEQ ID NO: 158831 - DNA, 20 bp, human
gtaacgacctgactgacccc

SEQ ID NO: 158832 - DNA, 20 bp, human
gggcgcccatgtccagctcc

SEQ ID NO: 158833 - DNA, 20 bp, human
gggggtgctgaaccagacgg

SEQ ID NO: 158834 - DNA, 20 bp, human
ggatggcccgcaggcggacg

SEQ ID NO: 158835 - DNA, 20 bp, human
gccgggcagcccgcgactga

SEQ ID NO: 158836 - DNA, 20 bp, human
ggcgcgggtcagggagataa

SEQ ID NO: 158837 - DNA, 20 bp, human
gctgcgcggccgatcaccct

SEQ ID NO: 158838 - DNA, 20 bp, human
gcgaagagcgcggacttgtg

SEQ ID NO: 158839 - DNA, 20 bp, human
gactggagctgcgcgggtca

SEQ ID NO: 158840 - DNA, 20 bp, human
gtcaccctcggcattgacct

SEQ ID NO: 158841 - DNA, 20 bp, human
ggtgcccaggtcaatgccga

SEQ ID NO: 158842 - DNA, 20 bp, human
gggaatcggtcccagcaggt

SEQ ID NO: 158843 - DNA, 20 bp, human
gctgggcaccacatctgtga

SEQ ID NO: 158844 - DNA, 20 bp, human
gagaagaagccagagagtcg

SEQ ID NO: 158845 - DNA, 20 bp, human
gctgcagactggagctgcgc

SEQ ID NO: 158846 - DNA, 20 bp, human
gtggagcccgggaagctcaa

SEQ ID NO: 158847 - DNA, 20 bp, human
gtatccccggagggacgtgg

SEQ ID NO: 158848 - DNA, 20 bp, human
ggaacgtgtaggggtccccc

SEQ ID NO: 158849 - DNA, 20 bp, human
gtccgggatcgggaagaggt

SEQ ID NO: 158850 - DNA, 20 bp, human
ggcccggcagctaggcgctg

SEQ ID NO: 158851 - DNA, 20 bp, human
gtccctccggggataaagtg

SEQ ID NO: 158852 - DNA, 20 bp, human
gtaggcgcttgggtgatgga

SEQ ID NO: 158853 - DNA, 20 bp, human
gagtggggtcgtgggaaagg

SEQ ID NO: 158854 - DNA, 20 bp, human
gccgaacatgggcttgaggt

SEQ ID NO: 158855 - DNA, 20 bp, human
gcagcgcgcgcccggcagct

SEQ ID NO: 158856 - DNA, 20 bp, human
gttgcgtggcgggaacgcgg

SEQ ID NO: 158857 - DNA, 20 bp, human
gcggcggcagtgagagcgag

SEQ ID NO: 158858 - DNA, 20 bp, human
ggacgagaactagggcgaca

SEQ ID NO: 158859 - DNA, 20 bp, human
gcagaacgggacgagaacta

SEQ ID NO: 158860 - DNA, 20 bp, human
ggggaactgccctcttccag

SEQ ID NO: 158861 - DNA, 20 bp, human
gatcgccgcaccggacgcaa

SEQ ID NO: 158862 - DNA, 20 bp, human
gccgcaccggacgcaagggc

SEQ ID NO: 158863 - DNA, 20 bp, human
ggaactctcggtgtgaggga

SEQ ID NO: 158864 - DNA, 20 bp, human
gccccacgcgcaggaactct

SEQ ID NO: 158865 - DNA, 20 bp, human
ggaactcgcctgagaaagta

SEQ ID NO: 158866 - DNA, 20 bp, human
gggacagcgcgagcccggga

SEQ ID NO: 158867 - DNA, 20 bp, human
gacggcccaggagcgcgtct

SEQ ID NO: 158868 - DNA, 20 bp, human
gcgcccccgccgcgtacctg

SEQ ID NO: 158869 - DNA, 20 bp, human
gggcgggagcctcaggtacg

SEQ ID NO: 158870 - DNA, 20 bp, human
gtccccgacggtgaacccaa

SEQ ID NO: 158871 - DNA, 20 bp, human
ggggagcctcaggtacgcgg

SEQ ID NO: 158872 - DNA, 20 bp, human
ggcgtctcggcgggagcctc

SEQ ID NO: 158873 - DNA, 20 bp, human
gcgacaaagggcaggagcgg

SEQ ID NO: 158874 - DNA, 20 bp, human
gccactggcgcaacctgacg

SEQ ID NO: 158875 - DNA, 20 bp, human
gcccaggagcgcgtctcggc

SEQ ID NO: 158876 - DNA, 20 bp, human
gcccggccgtgggatcgcaa

SEQ ID NO: 158877 - DNA, 20 bp, human
gggccgtgggatcgcaaggg

SEQ ID NO: 158878 - DNA, 20 bp, human
gacgcgcgcgccagacccgg

SEQ ID NO: 158879 - DNA, 20 bp, human
gcatgcactccgggcagtcc

SEQ ID NO: 158880 - DNA, 20 bp, human
gagttacggcgcaagttctg

SEQ ID NO: 158881 - DNA, 20 bp, human
gttaccttggtgatgaccag

SEQ ID NO: 158882 - DNA, 20 bp, human
gtgagcggcggcgccccgtg

SEQ ID NO: 158883 - DNA, 20 bp, human
gaggctcgcgcccccgggtc

SEQ ID NO: 158884 - DNA, 20 bp, human
gttcagggtgaagccccacg

SEQ ID NO: 158885 - DNA, 20 bp, human
ggcgggccagggacgctgag

SEQ ID NO: 158886 - DNA, 20 bp, human
gcttacagttaataacacgt

SEQ ID NO: 158887 - DNA, 20 bp, human
ggaaagcacttactatgctt

SEQ ID NO: 158888 - DNA, 20 bp, human
gtggtgagctgaattctgca

SEQ ID NO: 158889 - DNA, 20 bp, human
gttcactccgagaggaagaa

SEQ ID NO: 158890 - DNA, 20 bp, human
gacggtaaattaatcctcaa

SEQ ID NO: 158891 - DNA, 20 bp, human
gacagatggctaattgccaa

SEQ ID NO: 158892 - DNA, 20 bp, human
gcacagcttctctgtctctt

SEQ ID NO: 158893 - DNA, 20 bp, human
ggaaagagtaaggaagttag

SEQ ID NO: 158894 - DNA, 20 bp, human
gtggtaaatttcactccgag

SEQ ID NO: 158895 - DNA, 20 bp, human
gatcttcagagcgccactga

SEQ ID NO: 158896 - DNA, 20 bp, human
gctccagccgggagagtagg

SEQ ID NO: 158897 - DNA, 20 bp, human
gcgtctccagccgggagagt

SEQ ID NO: 158898 - DNA, 20 bp, human
ggagcgaaagaccctctgag

SEQ ID NO: 158899 - DNA, 20 bp, human
gctcccggctggagacgctc

SEQ ID NO: 158900 - DNA, 20 bp, human
gccctctgagcggcacggag

SEQ ID NO: 158901 - DNA, 20 bp, human
gtgcagacatcccctaaggg

SEQ ID NO: 158902 - DNA, 20 bp, human
gcgggagagtaggcggagca

SEQ ID NO: 158903 - DNA, 20 bp, human
gcaggtgcagacatccccta

SEQ ID NO: 158904 - DNA, 20 bp, human
gcagctgcacagggacgtac

SEQ ID NO: 158905 - DNA, 20 bp, human
ggcctgagggccccgtccag

SEQ ID NO: 158906 - DNA, 20 bp, human
gtggcagccttatccaagtc

SEQ ID NO: 158907 - DNA, 20 bp, human
ggttgtaccagacttggata

SEQ ID NO: 158908 - DNA, 20 bp, human
gatgaaataaggtaagtcta

SEQ ID NO: 158909 - DNA, 20 bp, human
ggctgccaaaataatgatca

SEQ ID NO: 158910 - DNA, 20 bp, human
gtgctatgttgtaccagact

SEQ ID NO: 158911 - DNA, 20 bp, human
gtgatcaaggaaagctgctt

SEQ ID NO: 158912 - DNA, 20 bp, human
gctttccttgatcattattt

SEQ ID NO: 158913 - DNA, 20 bp, human
ggtagtaccttgtattaaac

SEQ ID NO: 158914 - DNA, 20 bp, human
gaggtactacatatttcaaa

SEQ ID NO: 158915 - DNA, 20 bp, human
gaaaagttataatgaagagt

SEQ ID NO: 158916 - DNA, 20 bp, human
gggtcctggagtaactgcag

SEQ ID NO: 158917 - DNA, 20 bp, human
gtgtcggcccacaggattaa

SEQ ID NO: 158918 - DNA, 20 bp, human
gcgcctaggactgggaaagt

SEQ ID NO: 158919 - DNA, 20 bp, human
gccagcccgagtacaagccc

SEQ ID NO: 158920 - DNA, 20 bp, human
gcccaagggcaccactgagg

SEQ ID NO: 158921 - DNA, 20 bp, human
gctgaccgccgcctaggact

SEQ ID NO: 158922 - DNA, 20 bp, human
gcgcgccggggcttgtactc

SEQ ID NO: 158923 - DNA, 20 bp, human
gtaactgcaggggagctcgg

SEQ ID NO: 158924 - DNA, 20 bp, human
gctgcagaccgggcctcggt

SEQ ID NO: 158925 - DNA, 20 bp, human
ggtgctgccattaatcctgt

SEQ ID NO: 158926 - DNA, 20 bp, human
gtgcggggcgcgctctcgag

SEQ ID NO: 158927 - DNA, 20 bp, human
gtcccggcgccgagaccgac

SEQ ID NO: 158928 - DNA, 20 bp, human
gcgagaccgacgggacaccc

SEQ ID NO: 158929 - DNA, 20 bp, human
gcgcccaggcccggtaatgg

SEQ ID NO: 158930 - DNA, 20 bp, human
gccgggccccacttacctgt

SEQ ID NO: 158931 - DNA, 20 bp, human
gtcgaggacgcgcgaaacgg

SEQ ID NO: 158932 - DNA, 20 bp, human
gcgaccgggcggcccgactc

SEQ ID NO: 158933 - DNA, 20 bp, human
gcaggcccggtaatggcgga

SEQ ID NO: 158934 - DNA, 20 bp, human
gggctcgaggacgcgcgaaa

SEQ ID NO: 158935 - DNA, 20 bp, human
ggcccggtaatggcggaggg

SEQ ID NO: 158936 - DNA, 20 bp, human
gcccgggccccgaaccccag

SEQ ID NO: 158937 - DNA, 20 bp, human
ggggcccgcagccgagatgg

SEQ ID NO: 158938 - DNA, 20 bp, human
gcccgcagccgagatggtgg

SEQ ID NO: 158939 - DNA, 20 bp, human
gggctgttccagaagcgggt

SEQ ID NO: 158940 - DNA, 20 bp, human
gagggctctgcgcaccgctg

SEQ ID NO: 158941 - DNA, 20 bp, human
gtccagaagcgggtgggcca

SEQ ID NO: 158942 - DNA, 20 bp, human
gccggccgccgccaccatct

SEQ ID NO: 158943 - DNA, 20 bp, human
gccgctgacgcaagccccgg

SEQ ID NO: 158944 - DNA, 20 bp, human
gcgcccagcccaggtccggg

SEQ ID NO: 158945 - DNA, 20 bp, human
gccggggacggagtgtgctg

SEQ ID NO: 158946 - DNA, 20 bp, human
gctggagcggagtgtctcag

SEQ ID NO: 158947 - DNA, 20 bp, human
gtgagtccttgggccctgga

SEQ ID NO: 158948 - DNA, 20 bp, human
ggaggaagctgtgagtcctt

SEQ ID NO: 158949 - DNA, 20 bp, human
gtgttggtccgggaaggcag

SEQ ID NO: 158950 - DNA, 20 bp, human
gagaggctgcgctccttcca

SEQ ID NO: 158951 - DNA, 20 bp, human
gttgcaaacccgggtctcgg

SEQ ID NO: 158952 - DNA, 20 bp, human
gaacctgagagtggcgtggg

SEQ ID NO: 158953 - DNA, 20 bp, human
gtgggacggtgtctggaacc

SEQ ID NO: 158954 - DNA, 20 bp, human
ggggggttgttggtccggga

SEQ ID NO: 158955 - DNA, 20 bp, human
gtctcgctctctaggtgatt

SEQ ID NO: 158956 - DNA, 20 bp, human
gtcaacctgacgccacatcg

SEQ ID NO: 158957 - DNA, 20 bp, human
gcgaaagcggagccaccctg

SEQ ID NO: 158958 - DNA, 20 bp, human
gaggtcacgggtggagagta

SEQ ID NO: 158959 - DNA, 20 bp, human
ggcaggcagccgcgcatggt

SEQ ID NO: 158960 - DNA, 20 bp, human
gacctgacgccacatcgagg

SEQ ID NO: 158961 - DNA, 20 bp, human
gccgcgcccgggctcgaaag

SEQ ID NO: 158962 - DNA, 20 bp, human
gtcacgggtggagagtaggg

SEQ ID NO: 158963 - DNA, 20 bp, human
gctccactggaggtcacggg

SEQ ID NO: 158964 - DNA, 20 bp, human
gctggcagcgtgctgacgaa

SEQ ID NO: 158965 - DNA, 20 bp, human
gcacccgctcggctctgaag

SEQ ID NO: 158966 - DNA, 20 bp, human
ggccagggccgtgagaagga

SEQ ID NO: 158967 - DNA, 20 bp, human
gagacaggacacctccggga

SEQ ID NO: 158968 - DNA, 20 bp, human
ggcgtccgcccgcccttaaa

SEQ ID NO: 158969 - DNA, 20 bp, human
gaggcgagtcgcagagtgag

SEQ ID NO: 158970 - DNA, 20 bp, human
ggagtgaggggcgtgatagg

SEQ ID NO: 158971 - DNA, 20 bp, human
gcagccgcaacccgtcccgg

SEQ ID NO: 158972 - DNA, 20 bp, human
gggcggcggcgacaggagac

SEQ ID NO: 158973 - DNA, 20 bp, human
ggctcccagggtccccgcag

SEQ ID NO: 158974 - DNA, 20 bp, human
gctgggctgcgagttttccg

SEQ ID NO: 158975 - DNA, 20 bp, human
ggaaaactcgcagcccagca

SEQ ID NO: 158976 - DNA, 20 bp, human
gcgcagggcgtggaacccgt

SEQ ID NO: 158977 - DNA, 20 bp, human
gcaccaggcccggctcagga

SEQ ID NO: 158978 - DNA, 20 bp, human
ggtccgaaagcaccacgatg

SEQ ID NO: 158979 - DNA, 20 bp, human
gctcaggttcaccaagaggt

SEQ ID NO: 158980 - DNA, 20 bp, human
gaagcaccacgatgaggcgt

SEQ ID NO: 158981 - DNA, 20 bp, human
gcgctgccgacgcctcatcg

SEQ ID NO: 158982 - DNA, 20 bp, human
gcaggctgggacccctccgt

SEQ ID NO: 158983 - DNA, 20 bp, human
ggcggctcaggttcaccaag

SEQ ID NO: 158984 - DNA, 20 bp, human
gctagcggcgggttagagat

SEQ ID NO: 158985 - DNA, 20 bp, human
gaaccccgcgcgggacccac

SEQ ID NO: 158986 - DNA, 20 bp, human
gtgcatcgccaagcgcggtg

SEQ ID NO: 158987 - DNA, 20 bp, human
gatggatgcatcgccaagcg

SEQ ID NO: 158988 - DNA, 20 bp, human
gtcacagagcctaggaccac

SEQ ID NO: 158989 - DNA, 20 bp, human
ggaggtgcaagtgtgcacac

SEQ ID NO: 158990 - DNA, 20 bp, human
gcgcatcagcggccaagggt

SEQ ID NO: 158991 - DNA, 20 bp, human
ggtgtgtgagacagagcgag

SEQ ID NO: 158992 - DNA, 20 bp, human
gtgcaaggccaggaagctac

SEQ ID NO: 158993 - DNA, 20 bp, human
gctccctggggcccagcgaa

SEQ ID NO: 158994 - DNA, 20 bp, human
gtggtgctgtggacactccc

SEQ ID NO: 158995 - DNA, 20 bp, human
ggatgcatccatagcagcct

SEQ ID NO: 158996 - DNA, 20 bp, human
gagctggggcaccttctctg

SEQ ID NO: 158997 - DNA, 20 bp, human
gctcctgttgcctaagaggg

SEQ ID NO: 158998 - DNA, 20 bp, human
gacccctggggcactgagaa

SEQ ID NO: 158999 - DNA, 20 bp, human
gggcagtggactgacccctg

SEQ ID NO: 159000 - DNA, 20 bp, human
gagggtggctcgaagacaga

SEQ ID NO: 159001 - DNA, 20 bp, human
ggtcaagggagggcccaatc

SEQ ID NO: 159002 - DNA, 20 bp, human
gctggggctaaagtgcccag

SEQ ID NO: 159003 - DNA, 20 bp, human
gagaacggcagggggacaga

SEQ ID NO: 159004 - DNA, 20 bp, human
ggctggccaacccaataaga

SEQ ID NO: 159005 - DNA, 20 bp, human
gggacttctagcaggtgctg

SEQ ID NO: 159006 - DNA, 20 bp, human
gggcagtagcatctccgcat

SEQ ID NO: 159007 - DNA, 20 bp, human
gaggccctgcgcctcctatg

SEQ ID NO: 159008 - DNA, 20 bp, human
gagtagcatctccgcatagg

SEQ ID NO: 159009 - DNA, 20 bp, human
gcagagatgcacaggccctc

SEQ ID NO: 159010 - DNA, 20 bp, human
gcacagcacgaccagagaac

SEQ ID NO: 159011 - DNA, 20 bp, human
gtctctggtcgtgctgtgag

SEQ ID NO: 159012 - DNA, 20 bp, human
gcagtgactgagacaaccaa

SEQ ID NO: 159013 - DNA, 20 bp, human
gtcgtgctgtgagtggctca

SEQ ID NO: 159014 - DNA, 20 bp, human
gccctgtccagtcctgtcgg

SEQ ID NO: 159015 - DNA, 20 bp, human
gtggcagaaggggaagccga

SEQ ID NO: 159016 - DNA, 20 bp, human
ggacgttccaggccttacag

SEQ ID NO: 159017 - DNA, 20 bp, human
gagcagtcagggctccttcg

SEQ ID NO: 159018 - DNA, 20 bp, human
gagagccactctgggccccg

SEQ ID NO: 159019 - DNA, 20 bp, human
ggagagggtgtgggcgtggt

SEQ ID NO: 159020 - DNA, 20 bp, human
gtccagctgctaccaggtga

SEQ ID NO: 159021 - DNA, 20 bp, human
gggtgtgggcgtggtgggaa

SEQ ID NO: 159022 - DNA, 20 bp, human
gtaaggcctggaacgtccac

SEQ ID NO: 159023 - DNA, 20 bp, human
gatgaaggttcaaggttgtg

SEQ ID NO: 159024 - DNA, 20 bp, human
gaaggtaagttccagcttag

SEQ ID NO: 159025 - DNA, 20 bp, human
gctagaaagatgaaggttca

SEQ ID NO: 159026 - DNA, 20 bp, human
ggcagtagcatgtgtcgggt

SEQ ID NO: 159027 - DNA, 20 bp, human
gccactctcccacagagcag

SEQ ID NO: 159028 - DNA, 20 bp, human
gctctcccacagagcagggg

SEQ ID NO: 159029 - DNA, 20 bp, human
gtagccatgaactggatcgg

SEQ ID NO: 159030 - DNA, 20 bp, human
gcagcagcagtagcatgtgt

SEQ ID NO: 159031 - DNA, 20 bp, human
ggtagcatgtgtcgggttgg

SEQ ID NO: 159032 - DNA, 20 bp, human
ggtccctgcatcactctctc

SEQ ID NO: 159033 - DNA, 20 bp, human
ggaggtaagtctgttcctca

SEQ ID NO: 159034 - DNA, 20 bp, human
ggtaagccggaacattccag

SEQ ID NO: 159035 - DNA, 20 bp, human
gcagtagccatgaactggat

SEQ ID NO: 159036 - DNA, 20 bp, human
gcccagcccagtcccaggtc

SEQ ID NO: 159037 - DNA, 20 bp, human
gactcacccccccacagcag

SEQ ID NO: 159038 - DNA, 20 bp, human
ggactgggctggggccctgg

SEQ ID NO: 159039 - DNA, 20 bp, human
ggtcccaggtccggctgtca

SEQ ID NO: 159040 - DNA, 20 bp, human
gagcatgtctccatccgcca

SEQ ID NO: 159041 - DNA, 20 bp, human
gaccagtagacgtagagtgg

SEQ ID NO: 159042 - DNA, 20 bp, human
ggagtgaagccagagaccca

SEQ ID NO: 159043 - DNA, 20 bp, human
gctggacatccccaaggagg

SEQ ID NO: 159044 - DNA, 20 bp, human
ggatgccagaatggaggaca

SEQ ID NO: 159045 - DNA, 20 bp, human
ggatctccaggggtaagaga

SEQ ID NO: 159046 - DNA, 20 bp, human
gggtacagagaggacatcac

SEQ ID NO: 159047 - DNA, 20 bp, human
gtagcagacactcacctgtc

SEQ ID NO: 159048 - DNA, 20 bp, human
gtggcgtgggttctcccgac

SEQ ID NO: 159049 - DNA, 20 bp, human
gctgctggcctgcttggcgt

SEQ ID NO: 159050 - DNA, 20 bp, human
gaggtggccgagagcgggtc

SEQ ID NO: 159051 - DNA, 20 bp, human
gctgtgcccatcaaaacaca

SEQ ID NO: 159052 - DNA, 20 bp, human
gcgagcatccagaggacaat

SEQ ID NO: 159053 - DNA, 20 bp, human
gagaagggcggggagtgcat

SEQ ID NO: 159054 - DNA, 20 bp, human
ggacagtgctgatgcatggg

SEQ ID NO: 159055 - DNA, 20 bp, human
gagggtggctgcctatataa

SEQ ID NO: 159056 - DNA, 20 bp, human
gttgcagggagcaaaccaag

SEQ ID NO: 159057 - DNA, 20 bp, human
ggctccacccacatacctac

SEQ ID NO: 159058 - DNA, 20 bp, human
gcagcagagacaggctacat

SEQ ID NO: 159059 - DNA, 20 bp, human
gacctcacctgtaggtatgt

SEQ ID NO: 159060 - DNA, 20 bp, human
gacaggctgaccctgctgtg

SEQ ID NO: 159061 - DNA, 20 bp, human
gggctgtcgacctcacctgt

SEQ ID NO: 159062 - DNA, 20 bp, human
gcaaggagagacactcccat

SEQ ID NO: 159063 - DNA, 20 bp, human
gctctgaagagcagcactct

SEQ ID NO: 159064 - DNA, 20 bp, human
gggtgaggtcgacagccaat

SEQ ID NO: 159065 - DNA, 20 bp, human
gcccttcccgggaaccttca

SEQ ID NO: 159066 - DNA, 20 bp, human
gcccgaggccctgactccca

SEQ ID NO: 159067 - DNA, 20 bp, human
gtatgggacctggtgacctc

SEQ ID NO: 159068 - DNA, 20 bp, human
ggtgctgcagctatgggacc

SEQ ID NO: 159069 - DNA, 20 bp, human
gctagactcctgaggtcacc

SEQ ID NO: 159070 - DNA, 20 bp, human
gaggaaagtgctgcagctat

SEQ ID NO: 159071 - DNA, 20 bp, human
gtatgcacctttgtctacat

SEQ ID NO: 159072 - DNA, 20 bp, human
gttgtaagtctagactcctg

SEQ ID NO: 159073 - DNA, 20 bp, human
gcaccatcggcgtccagtgg

SEQ ID NO: 159074 - DNA, 20 bp, human
gtctggacaagcccctctgg

SEQ ID NO: 159075 - DNA, 20 bp, human
ggagtctagacttacaagtc

SEQ ID NO: 159076 - DNA, 20 bp, human
gggtagcatctctgaggcgg

SEQ ID NO: 159077 - DNA, 20 bp, human
gcatcagagatgcccggagg

SEQ ID NO: 159078 - DNA, 20 bp, human
ggctccaggactagccacag

SEQ ID NO: 159079 - DNA, 20 bp, human
gccaggggagaggtgccgtg

SEQ ID NO: 159080 - DNA, 20 bp, human
gtagccataaccatagtacg

SEQ ID NO: 159081 - DNA, 20 bp, human
gccccttctctgctcatgca

SEQ ID NO: 159082 - DNA, 20 bp, human
gtcctgagccagggccccta

SEQ ID NO: 159083 - DNA, 20 bp, human
gtctgtgcgtgtgatgggta

SEQ ID NO: 159084 - DNA, 20 bp, human
gtagccacaggggaaggtca

SEQ ID NO: 159085 - DNA, 20 bp, human
ggaaggggctgatgttccag

SEQ ID NO: 159086 - DNA, 20 bp, human
ggttccgtgaccgtgcaaga

SEQ ID NO: 159087 - DNA, 20 bp, human
gggcagggaatgatataagc

SEQ ID NO: 159088 - DNA, 20 bp, human
gctccccgcatcactcattc

SEQ ID NO: 159089 - DNA, 20 bp, human
gatgccctcttgcacggtca

SEQ ID NO: 159090 - DNA, 20 bp, human
ggggaatgatataagctgga

SEQ ID NO: 159091 - DNA, 20 bp, human
gtgccagaatgagtgatgcg

SEQ ID NO: 159092 - DNA, 20 bp, human
ggggtgcaatttttggtctg

SEQ ID NO: 159093 - DNA, 20 bp, human
gctgtccactgggtaggaga

SEQ ID NO: 159094 - DNA, 20 bp, human
gagtcagtctggctgtccac

SEQ ID NO: 159095 - DNA, 20 bp, human
gtgctccttctcctacccag

SEQ ID NO: 159096 - DNA, 20 bp, human
gcgccaggaagagggataag

SEQ ID NO: 159097 - DNA, 20 bp, human
gatttctttcggctagagag

SEQ ID NO: 159098 - DNA, 20 bp, human
gtctgggtttgaaggcgcca

SEQ ID NO: 159099 - DNA, 20 bp, human
ggcagcatgtctgggtttga

SEQ ID NO: 159100 - DNA, 20 bp, human
gggagggagacagacaatat

SEQ ID NO: 159101 - DNA, 20 bp, human
gtgtggccactggagcgtct

SEQ ID NO: 159102 - DNA, 20 bp, human
gaggtctcaagacttagggg

SEQ ID NO: 159103 - DNA, 20 bp, human
gccataccaagacgctccag

SEQ ID NO: 159104 - DNA, 20 bp, human
gggaggtcccgcaggaggtt

SEQ ID NO: 159105 - DNA, 20 bp, human
ggaccccttatccctcttcc

SEQ ID NO: 159106 - DNA, 20 bp, human
gccagtagccatgaactact

SEQ ID NO: 159107 - DNA, 20 bp, human
gccatgcgaggggtaggaga

SEQ ID NO: 159108 - DNA, 20 bp, human
gggtaaatccagccatgcga

SEQ ID NO: 159109 - DNA, 20 bp, human
gggtgaagcgagttggctca

SEQ ID NO: 159110 - DNA, 20 bp, human
gatccagccatgcgaggggt

SEQ ID NO: 159111 - DNA, 20 bp, human
ggaaggggccaatacagacc

SEQ ID NO: 159112 - DNA, 20 bp, human
gctgccccaggagagggctt

SEQ ID NO: 159113 - DNA, 20 bp, human
gggagcatcctggtctgtat

SEQ ID NO: 159114 - DNA, 20 bp, human
gtgccagaagaagtgatgcg

SEQ ID NO: 159115 - DNA, 20 bp, human
gctccccgcatcacttcttc

SEQ ID NO: 159116 - DNA, 20 bp, human
ggtcggctgcacagagatag

SEQ ID NO: 159117 - DNA, 20 bp, human
ggagctagcaggtcttgcag

SEQ ID NO: 159118 - DNA, 20 bp, human
ggcgactagggatcctcagt

SEQ ID NO: 159119 - DNA, 20 bp, human
ggcacagccttatgcgacta

SEQ ID NO: 159120 - DNA, 20 bp, human
ggggtggatgcactcaccta

SEQ ID NO: 159121 - DNA, 20 bp, human
ggctgaccaggtgactgacg

SEQ ID NO: 159122 - DNA, 20 bp, human
ggacctgattgtgaacccac

SEQ ID NO: 159123 - DNA, 20 bp, human
gagtcacctggtcagccaga

SEQ ID NO: 159124 - DNA, 20 bp, human
gcacagagatagcggcgtga

SEQ ID NO: 159125 - DNA, 20 bp, human
gtggtggcctaaccgacctg

SEQ ID NO: 159126 - DNA, 20 bp, human
gcccactgcagctcctcgtc

SEQ ID NO: 159127 - DNA, 20 bp, human
ggccgtgagcgcaaagcctc

SEQ ID NO: 159128 - DNA, 20 bp, human
gtctgatcgtggagctgcgg

SEQ ID NO: 159129 - DNA, 20 bp, human
gtggcgggggagcgcttcgt

SEQ ID NO: 159130 - DNA, 20 bp, human
gtggccgcgggagcccaagg

SEQ ID NO: 159131 - DNA, 20 bp, human
ggtcagggcgagccgtacca

SEQ ID NO: 159132 - DNA, 20 bp, human
ggcctggcacggcgcagctc

SEQ ID NO: 159133 - DNA, 20 bp, human
gacggcccactgcatcccgg

SEQ ID NO: 159134 - DNA, 20 bp, human
gacgagagaaggccagctcg

SEQ ID NO: 159135 - DNA, 20 bp, human
gagggcgagccgtaccacgg

SEQ ID NO: 159136 - DNA, 20 bp, human
ggcggctccgggctgacatg

SEQ ID NO: 159137 - DNA, 20 bp, human
ggaccgcgggcggagatacc

SEQ ID NO: 159138 - DNA, 20 bp, human
ggaggtgcctgggatgtcgg

SEQ ID NO: 159139 - DNA, 20 bp, human
gggcacccgagcagcgccag

SEQ ID NO: 159140 - DNA, 20 bp, human
ggctcgggtgcctactgctc

SEQ ID NO: 159141 - DNA, 20 bp, human
gcggagataccgggtgtggg

SEQ ID NO: 159142 - DNA, 20 bp, human
gggcgggtccgcgatccccg

SEQ ID NO: 159143 - DNA, 20 bp, human
gtcggccgctggcgctgctc

SEQ ID NO: 159144 - DNA, 20 bp, human
gcggacccgccccccacacc

SEQ ID NO: 159145 - DNA, 20 bp, human
gcaaggccagggaccctgcg

SEQ ID NO: 159146 - DNA, 20 bp, human
gcgagaggccgcctcactgg

SEQ ID NO: 159147 - DNA, 20 bp, human
gtgacgtcggcgcacgtcag

SEQ ID NO: 159148 - DNA, 20 bp, human
gtcgagggcacgctgggcaa

SEQ ID NO: 159149 - DNA, 20 bp, human
gtggggttctacgacatcga

SEQ ID NO: 159150 - DNA, 20 bp, human
gtgggccccgctgctagaca

SEQ ID NO: 159151 - DNA, 20 bp, human
ggccccgctgctagacacgg

SEQ ID NO: 159152 - DNA, 20 bp, human
gaggagctgcttaccgagag

SEQ ID NO: 159153 - DNA, 20 bp, human
gcaccggatcaccaagacgg

SEQ ID NO: 159154 - DNA, 20 bp, human
gctcgcctccgccagtgagg

SEQ ID NO: 159155 - DNA, 20 bp, human
gcggcaccggatcaccaaga

SEQ ID NO: 159156 - DNA, 20 bp, human
gtcactgcacaacaagatgg

SEQ ID NO: 159157 - DNA, 20 bp, human
gcgcggagctagggacacct

SEQ ID NO: 159158 - DNA, 20 bp, human
gcgtagtagccgatacgggc

SEQ ID NO: 159159 - DNA, 20 bp, human
gacgagatcgaccgcaccat

SEQ ID NO: 159160 - DNA, 20 bp, human
gtcgaccgcaccatcggcaa

SEQ ID NO: 159161 - DNA, 20 bp, human
gacggcggaactccaagcag

SEQ ID NO: 159162 - DNA, 20 bp, human
ggagggagccagccgcggcg

SEQ ID NO: 159163 - DNA, 20 bp, human
gactccaagcagggggccga

SEQ ID NO: 159164 - DNA, 20 bp, human
gttgtgcagtgaaacctccg

SEQ ID NO: 159165 - DNA, 20 bp, human
ggacccatgcccgcccgtat

SEQ ID NO: 159166 - DNA, 20 bp, human
ggcggcagatgcaactgaag

SEQ ID NO: 159167 - DNA, 20 bp, human
gggcagaagttagggctcca

SEQ ID NO: 159168 - DNA, 20 bp, human
gtctgtcaggatcttctcga

SEQ ID NO: 159169 - DNA, 20 bp, human
gaggctacgggagcacgatg

SEQ ID NO: 159170 - DNA, 20 bp, human
ggacgctgctggagaggcta

SEQ ID NO: 159171 - DNA, 20 bp, human
gtccggaccaggtcaggcag

SEQ ID NO: 159172 - DNA, 20 bp, human
gccctctgcctgacctggtc

SEQ ID NO: 159173 - DNA, 20 bp, human
gagcgcttccggaccaggtc

SEQ ID NO: 159174 - DNA, 20 bp, human
ggattctgggcactgaaggg

SEQ ID NO: 159175 - DNA, 20 bp, human
gcttgggacagcagaatgtg

SEQ ID NO: 159176 - DNA, 20 bp, human
gtgccggaggccgaaggtag

SEQ ID NO: 159177 - DNA, 20 bp, human
gcggaggccgaaggtagggg

SEQ ID NO: 159178 - DNA, 20 bp, human
gcgcggccgcctggaattgt

SEQ ID NO: 159179 - DNA, 20 bp, human
gtctgccactcggctgccgg

SEQ ID NO: 159180 - DNA, 20 bp, human
gccctcaccgcccctacctt

SEQ ID NO: 159181 - DNA, 20 bp, human
gcaaagcgggacgtccaagt

SEQ ID NO: 159182 - DNA, 20 bp, human
gccccttcttcggacagata

SEQ ID NO: 159183 - DNA, 20 bp, human
gaccagtctgtaacctctaa

SEQ ID NO: 159184 - DNA, 20 bp, human
gctcggctgccggaggccga

SEQ ID NO: 159185 - DNA, 20 bp, human
ggggagttgtgtctgccact

SEQ ID NO: 159186 - DNA, 20 bp, human
ggctataaagaagttacggg

SEQ ID NO: 159187 - DNA, 20 bp, human
gccctcgcaggctcccccgg

SEQ ID NO: 159188 - DNA, 20 bp, human
ggcagcgccaggttaacagg

SEQ ID NO: 159189 - DNA, 20 bp, human
gactggcttcgtagcaacta

SEQ ID NO: 159190 - DNA, 20 bp, human
gccagcagcgccaggttaac

SEQ ID NO: 159191 - DNA, 20 bp, human
gggcttcgtagcaactacgg

SEQ ID NO: 159192 - DNA, 20 bp, human
gtgtcgctgggttggacggt

SEQ ID NO: 159193 - DNA, 20 bp, human
gcgcagctccgcggtggtgt

SEQ ID NO: 159194 - DNA, 20 bp, human
gaagtctctcgggactccca

SEQ ID NO: 159195 - DNA, 20 bp, human
gggtggtgtgggagaggccg

SEQ ID NO: 159196 - DNA, 20 bp, human
gtgagctccgagcaacccgg

SEQ ID NO: 159197 - DNA, 20 bp, human
gggccgcacgtggacagcgg

SEQ ID NO: 159198 - DNA, 20 bp, human
ggcgcctagccacacatcgc

SEQ ID NO: 159199 - DNA, 20 bp, human
ggcctgagctccgagcaacc

SEQ ID NO: 159200 - DNA, 20 bp, human
ggcgctgcgtctccaggcac

SEQ ID NO: 159201 - DNA, 20 bp, human
ggagcccgcgatgtgtggct

SEQ ID NO: 159202 - DNA, 20 bp, human
gctgcccgcggcccactccg

SEQ ID NO: 159203 - DNA, 20 bp, human
gggtctgccataaacaaacg

SEQ ID NO: 159204 - DNA, 20 bp, human
gcggcaaggcccctccggac

SEQ ID NO: 159205 - DNA, 20 bp, human
ggcacagggagccgccagga

SEQ ID NO: 159206 - DNA, 20 bp, human
gggcggggccggcgtggcgg

SEQ ID NO: 159207 - DNA, 20 bp, human
gacccgggccaccgccacgc

SEQ ID NO: 159208 - DNA, 20 bp, human
gccgaagacccaggcagtgg

SEQ ID NO: 159209 - DNA, 20 bp, human
ggggccccgaccgaagaccc

SEQ ID NO: 159210 - DNA, 20 bp, human
gctgaagcccgagaggactg

SEQ ID NO: 159211 - DNA, 20 bp, human
gttccagccgcagtcctctc

SEQ ID NO: 159212 - DNA, 20 bp, human
gcctggcgcgcctgctgcag

SEQ ID NO: 159213 - DNA, 20 bp, human
gagacgcgcgcccccaaacg

SEQ ID NO: 159214 - DNA, 20 bp, human
gtgcagctgtgaggcgccag

SEQ ID NO: 159215 - DNA, 20 bp, human
gtcggttcctgcttctgagg

SEQ ID NO: 159216 - DNA, 20 bp, human
gaggccccgagaacggcgcg

SEQ ID NO: 159217 - DNA, 20 bp, human
gagggacacgcagtgacgag

SEQ ID NO: 159218 - DNA, 20 bp, human
gagggagggaaactccgagg

SEQ ID NO: 159219 - DNA, 20 bp, human
gttcccgggtaacagagaag

SEQ ID NO: 159220 - DNA, 20 bp, human
ggtgcccagactgggaagga

SEQ ID NO: 159221 - DNA, 20 bp, human
gggcttcccgtagagcagac

SEQ ID NO: 159222 - DNA, 20 bp, human
gagcagggaggccccgagaa

SEQ ID NO: 159223 - DNA, 20 bp, human
gttcccgtagagcagacggg

SEQ ID NO: 159224 - DNA, 20 bp, human
gggtaacagagaagcggccg

SEQ ID NO: 159225 - DNA, 20 bp, human
ggaaactccgaggggggaag

SEQ ID NO: 159226 - DNA, 20 bp, human
ggctccggcccggttctagt

SEQ ID NO: 159227 - DNA, 20 bp, human
gacggcacaacaggagtcgg

SEQ ID NO: 159228 - DNA, 20 bp, human
gccgcacaccgactagaacc

SEQ ID NO: 159229 - DNA, 20 bp, human
gcccccaaacgcctgagatt

SEQ ID NO: 159230 - DNA, 20 bp, human
gctgggaccgagctgagggg

SEQ ID NO: 159231 - DNA, 20 bp, human
gtcgggccggccagaccgag

SEQ ID NO: 159232 - DNA, 20 bp, human
gccaggcgaggagtcctgaa

SEQ ID NO: 159233 - DNA, 20 bp, human
gggcgaggagtcctgaatgg

SEQ ID NO: 159234 - DNA, 20 bp, human
ggccctgggaccgagctgag

SEQ ID NO: 159235 - DNA, 20 bp, human
ggcagggcccacaccacgtc

SEQ ID NO: 159236 - DNA, 20 bp, human
gcgtgcgccatgtccgaagt

SEQ ID NO: 159237 - DNA, 20 bp, human
gacccatcttctggaccccg

SEQ ID NO: 159238 - DNA, 20 bp, human
gacatggcgcacgctggcgg

SEQ ID NO: 159239 - DNA, 20 bp, human
gacctggtccagataggtga

SEQ ID NO: 159240 - DNA, 20 bp, human
gatctccaggaagccgttgt

SEQ ID NO: 159241 - DNA, 20 bp, human
gcgcggaacgaggggacgag

SEQ ID NO: 159242 - DNA, 20 bp, human
gtccaggaagccgttgtagg

SEQ ID NO: 159243 - DNA, 20 bp, human
gatcttcacctggtccagat

SEQ ID NO: 159244 - DNA, 20 bp, human
ggcagctccgacttcggaca

SEQ ID NO: 159245 - DNA, 20 bp, human
gaccaggtgaagatccgctt

SEQ ID NO: 159246 - DNA, 20 bp, human
ggcgggagccccagaggtac

SEQ ID NO: 159247 - DNA, 20 bp, human
ggctcccgccagtacctctg

SEQ ID NO: 159248 - DNA, 20 bp, human
ggaggccgcctaagaagaag

SEQ ID NO: 159249 - DNA, 20 bp, human
gggagccccagaggtactgg

SEQ ID NO: 159250 - DNA, 20 bp, human
gacggctggtcagagacagg

SEQ ID NO: 159251 - DNA, 20 bp, human
gcggcagcgggaccccagcg

SEQ ID NO: 159252 - DNA, 20 bp, human
ggaagaggagcctcagaata

SEQ ID NO: 159253 - DNA, 20 bp, human
gctactgtcgggcccgacag

SEQ ID NO: 159254 - DNA, 20 bp, human
gggggctcccccttattctg

SEQ ID NO: 159255 - DNA, 20 bp, human
ggactgagctggagcccgga

SEQ ID NO: 159256 - DNA, 20 bp, human
gctcagacgggctaagagac

SEQ ID NO: 159257 - DNA, 20 bp, human
ggtccgcagctggtgagccg

SEQ ID NO: 159258 - DNA, 20 bp, human
gagctggcgctgccccgcga

SEQ ID NO: 159259 - DNA, 20 bp, human
ggtccacctcgaagcccagg

SEQ ID NO: 159260 - DNA, 20 bp, human
gggccgcctgggcttcgagg

SEQ ID NO: 159261 - DNA, 20 bp, human
gcaggcggccttgaccgtcg

SEQ ID NO: 159262 - DNA, 20 bp, human
gtcaccagctgcggacgggg

SEQ ID NO: 159263 - DNA, 20 bp, human
gacgtgcgtgacgaatccct

SEQ ID NO: 159264 - DNA, 20 bp, human
gctcgcgggtctcgcagcca

SEQ ID NO: 159265 - DNA, 20 bp, human
gcgctgccccgcgacggtca

SEQ ID NO: 159266 - DNA, 20 bp, human
gggaggcaggaagccgacta

SEQ ID NO: 159267 - DNA, 20 bp, human
gtagcatccttccaggtgac

SEQ ID NO: 159268 - DNA, 20 bp, human
gaggagagcttgggaagagg

SEQ ID NO: 159269 - DNA, 20 bp, human
gatcacggctctgacaccgg

SEQ ID NO: 159270 - DNA, 20 bp, human
gtgctgcactctccactcaa

SEQ ID NO: 159271 - DNA, 20 bp, human
gcatgagcacgtcaggcaga

SEQ ID NO: 159272 - DNA, 20 bp, human
gcaaatcacggctctgacac

SEQ ID NO: 159273 - DNA, 20 bp, human
gtccatgcccgtcacctgga

SEQ ID NO: 159274 - DNA, 20 bp, human
gatgaaagcgcctgccttgg

SEQ ID NO: 159275 - DNA, 20 bp, human
ggaactgttagcatccttcc

SEQ ID NO: 159276 - DNA, 20 bp, human
gaggtaggtcataggaagta

SEQ ID NO: 159277 - DNA, 20 bp, human
gtgtaaagcaggtaggtcat

SEQ ID NO: 159278 - DNA, 20 bp, human
ggacaacgtccacaccaata

SEQ ID NO: 159279 - DNA, 20 bp, human
gcatgagtcaatcatggaca

SEQ ID NO: 159280 - DNA, 20 bp, human
ggtctaaatttcggtagcca

SEQ ID NO: 159281 - DNA, 20 bp, human
gatgagactgctcctaatca

SEQ ID NO: 159282 - DNA, 20 bp, human
gactgcagctcgccctgatt

SEQ ID NO: 159283 - DNA, 20 bp, human
gctgagtgttacctggccag

SEQ ID NO: 159284 - DNA, 20 bp, human
ggtggacgttgtctaaattt

SEQ ID NO: 159285 - DNA, 20 bp, human
gaacactttgtaaagcaggt

SEQ ID NO: 159286 - DNA, 20 bp, human
gctgtctctccccatcagga

SEQ ID NO: 159287 - DNA, 20 bp, human
gaggagagccgactggagag

SEQ ID NO: 159288 - DNA, 20 bp, human
gggacaagcctttcaaacgg

SEQ ID NO: 159289 - DNA, 20 bp, human
ggggtgaagtcctctttggg

SEQ ID NO: 159290 - DNA, 20 bp, human
gtggacagtgccctcctgat

SEQ ID NO: 159291 - DNA, 20 bp, human
gattgctcctctgtcttatg

SEQ ID NO: 159292 - DNA, 20 bp, human
gggatccttgaactttgaag

SEQ ID NO: 159293 - DNA, 20 bp, human
gcagggacaagcctttcaaa

SEQ ID NO: 159294 - DNA, 20 bp, human
ggggtcactcatgtctaccg

SEQ ID NO: 159295 - DNA, 20 bp, human
gctgactgcatgattctagg

SEQ ID NO: 159296 - DNA, 20 bp, human
gtggcggcgtctccagcgag

SEQ ID NO: 159297 - DNA, 20 bp, human
gcgcgaagcggcttggaagt

SEQ ID NO: 159298 - DNA, 20 bp, human
gctggagacgccgccagctc

SEQ ID NO: 159299 - DNA, 20 bp, human
gggtggcccgagtgacttcc

SEQ ID NO: 159300 - DNA, 20 bp, human
gccctgcagtaaaacggagt

SEQ ID NO: 159301 - DNA, 20 bp, human
gtcactcgggccaccggagc

SEQ ID NO: 159302 - DNA, 20 bp, human
gctcgcgggccccacgatcg

SEQ ID NO: 159303 - DNA, 20 bp, human
gcaggaggactcgcgcgaag

SEQ ID NO: 159304 - DNA, 20 bp, human
gacggagtaggagagcatct

SEQ ID NO: 159305 - DNA, 20 bp, human
gagctggacgccgcgatcgt

SEQ ID NO: 159306 - DNA, 20 bp, human
ggagaggaccgcgcgagcag

SEQ ID NO: 159307 - DNA, 20 bp, human
gcggccgtgagtgcgcgctc

SEQ ID NO: 159308 - DNA, 20 bp, human
gtccatggggacagattctg

SEQ ID NO: 159309 - DNA, 20 bp, human
gtccccattggaccgggcag

SEQ ID NO: 159310 - DNA, 20 bp, human
gtggagcggggaaatgacta

SEQ ID NO: 159311 - DNA, 20 bp, human
ggccccgcccgggctccaca

SEQ ID NO: 159312 - DNA, 20 bp, human
ggggctcaggcctctcagac

SEQ ID NO: 159313 - DNA, 20 bp, human
ggcccctgcccggtccaatg

SEQ ID NO: 159314 - DNA, 20 bp, human
gaatgccgagcagtaatagg

SEQ ID NO: 159315 - DNA, 20 bp, human
ggacacggagaggcgagagg

SEQ ID NO: 159316 - DNA, 20 bp, human
gcgggcattctggagacctt

SEQ ID NO: 159317 - DNA, 20 bp, human
gtagggcctcaggactggtg

SEQ ID NO: 159318 - DNA, 20 bp, human
gggccctagggcctcaggac

SEQ ID NO: 159319 - DNA, 20 bp, human
ggatcgcagactctgctctg

SEQ ID NO: 159320 - DNA, 20 bp, human
ggtgctgccaagaaaggcca

SEQ ID NO: 159321 - DNA, 20 bp, human
ggagcttactctgtggactt

SEQ ID NO: 159322 - DNA, 20 bp, human
gggcatgtcacttggcccta

SEQ ID NO: 159323 - DNA, 20 bp, human
ggtagcgtcatcagcaggaa

SEQ ID NO: 159324 - DNA, 20 bp, human
ggaggctggcacgggcattc

SEQ ID NO: 159325 - DNA, 20 bp, human
ggctcagagacaccctaaca

SEQ ID NO: 159326 - DNA, 20 bp, human
ggagctgcagcatctgacgt

SEQ ID NO: 159327 - DNA, 20 bp, human
ggctctgcgctcacacccac

SEQ ID NO: 159328 - DNA, 20 bp, human
gcagaggagccccaagtctt

SEQ ID NO: 159329 - DNA, 20 bp, human
ggagcacatggcatcttctg

SEQ ID NO: 159330 - DNA, 20 bp, human
ggccgacatcgtggagcaca

SEQ ID NO: 159331 - DNA, 20 bp, human
gctcatgggacctttctcta

SEQ ID NO: 159332 - DNA, 20 bp, human
gccggctggtcagtccctag

SEQ ID NO: 159333 - DNA, 20 bp, human
gcagcatctgacgtgggcat

SEQ ID NO: 159334 - DNA, 20 bp, human
gtcacagtagccctagagaa

SEQ ID NO: 159335 - DNA, 20 bp, human
gagcacttagtgcccctcta

SEQ ID NO: 159336 - DNA, 20 bp, human
gctgagtcgagggcatctcc

SEQ ID NO: 159337 - DNA, 20 bp, human
gatctccaggacaggcattc

SEQ ID NO: 159338 - DNA, 20 bp, human
ggcagatacagcagtaagga

SEQ ID NO: 159339 - DNA, 20 bp, human
ggaggcagggatgggcattg

SEQ ID NO: 159340 - DNA, 20 bp, human
ggctcggagcactgagtcga

SEQ ID NO: 159341 - DNA, 20 bp, human
gcacctatggtcacagggcg

SEQ ID NO: 159342 - DNA, 20 bp, human
gaataaattacaccctccag

SEQ ID NO: 159343 - DNA, 20 bp, human
gtctgcctgaatgcctgtcc

SEQ ID NO: 159344 - DNA, 20 bp, human
ggaactcagaagactacact

SEQ ID NO: 159345 - DNA, 20 bp, human
gaattacaccctccagaggc

SEQ ID NO: 159346 - DNA, 20 bp, human
gggaggactcaagacaggta

SEQ ID NO: 159347 - DNA, 20 bp, human
ggaggagggcacacaaaaat

SEQ ID NO: 159348 - DNA, 20 bp, human
ggcactgccaaggaaggtca

SEQ ID NO: 159349 - DNA, 20 bp, human
gacgctgtaagcatgaaatg

SEQ ID NO: 159350 - DNA, 20 bp, human
gaggaaaggaccaggaggat

SEQ ID NO: 159351 - DNA, 20 bp, human
ggttgtggaagccctaagaa

SEQ ID NO: 159352 - DNA, 20 bp, human
ggaggctgggacaggcattt

SEQ ID NO: 159353 - DNA, 20 bp, human
gtccagtccttgaccttcct

SEQ ID NO: 159354 - DNA, 20 bp, human
gataagcacaagcactgcca

SEQ ID NO: 159355 - DNA, 20 bp, human
gcaggggcaaggctaggtcc

SEQ ID NO: 159356 - DNA, 20 bp, human
gtccccggcgggggacgacg

SEQ ID NO: 159357 - DNA, 20 bp, human
gcagcggtggctcccgagat

SEQ ID NO: 159358 - DNA, 20 bp, human
gcagagaggcagttggaaga

SEQ ID NO: 159359 - DNA, 20 bp, human
ggccagtgccgcgcgtcgag

SEQ ID NO: 159360 - DNA, 20 bp, human
gacaagttgtcggccagcgg

SEQ ID NO: 159361 - DNA, 20 bp, human
gggggagccgccgggctgaa

SEQ ID NO: 159362 - DNA, 20 bp, human
ggaggcccaggcgactgcgg

SEQ ID NO: 159363 - DNA, 20 bp, human
gcccggcggctccccctcgg

SEQ ID NO: 159364 - DNA, 20 bp, human
gtaccgaggtgcgcagggtg

SEQ ID NO: 159365 - DNA, 20 bp, human
gcggcggcgattgggtaccg

SEQ ID NO: 159366 - DNA, 20 bp, human
gcggtcggtgacagcctcaa

SEQ ID NO: 159367 - DNA, 20 bp, human
gggtgacgggacagagcggt

SEQ ID NO: 159368 - DNA, 20 bp, human
gcgactgctctgtcccgtga

SEQ ID NO: 159369 - DNA, 20 bp, human
gcccatagcaagcgggaccg

SEQ ID NO: 159370 - DNA, 20 bp, human
gcgagggaccttagcaacca

SEQ ID NO: 159371 - DNA, 20 bp, human
gggacacagtggttggtgac

SEQ ID NO: 159372 - DNA, 20 bp, human
gggatccccgactcacggtc

SEQ ID NO: 159373 - DNA, 20 bp, human
ggattgttagaggcaaccag

SEQ ID NO: 159374 - DNA, 20 bp, human
gtacccggatccccgactca

SEQ ID NO: 159375 - DNA, 20 bp, human
gtaggagaggcgcggaacaa

SEQ ID NO: 159376 - DNA, 20 bp, human
gcacagccggagggctgccg

SEQ ID NO: 159377 - DNA, 20 bp, human
gagccaagtgcgcgggaagt

SEQ ID NO: 159378 - DNA, 20 bp, human
gcagatcagcataaagacgg

SEQ ID NO: 159379 - DNA, 20 bp, human
gacatgccgcaaaggaaaca

SEQ ID NO: 159380 - DNA, 20 bp, human
ggagcaattccgggtcacaa

SEQ ID NO: 159381 - DNA, 20 bp, human
gacccggccccacagccgga

SEQ ID NO: 159382 - DNA, 20 bp, human
ggagatgagacaccagacta

SEQ ID NO: 159383 - DNA, 20 bp, human
gcgcgcccaggtagacgtag

SEQ ID NO: 159384 - DNA, 20 bp, human
gttgaggcgtcaaagagtgt

SEQ ID NO: 159385 - DNA, 20 bp, human
gtagacgtagaggcgagtag

SEQ ID NO: 159386 - DNA, 20 bp, human
ggtgtccgtagagctgtgag

SEQ ID NO: 159387 - DNA, 20 bp, human
gatcagacggtcccactgtg

SEQ ID NO: 159388 - DNA, 20 bp, human
gcttacctctcacagctcta

SEQ ID NO: 159389 - DNA, 20 bp, human
gcccgagaccaaagggtcag

SEQ ID NO: 159390 - DNA, 20 bp, human
ggctgaacaaacacacagtc

SEQ ID NO: 159391 - DNA, 20 bp, human
gacggggtgcatgtcactag

SEQ ID NO: 159392 - DNA, 20 bp, human
gcgctgaaaacgtgcatcag

SEQ ID NO: 159393 - DNA, 20 bp, human
gctcttccaggtcccaccga

SEQ ID NO: 159394 - DNA, 20 bp, human
gggtcccaccgagggcaaag

SEQ ID NO: 159395 - DNA, 20 bp, human
gtccggtttcccgagaccaa

SEQ ID NO: 159396 - DNA, 20 bp, human
ggcgctccggacctgagcca

SEQ ID NO: 159397 - DNA, 20 bp, human
gcgtgggagactgtattcgg

SEQ ID NO: 159398 - DNA, 20 bp, human
gtcaggtccggagcgcggtc

SEQ ID NO: 159399 - DNA, 20 bp, human
ggtcgggacacagcgcctct

SEQ ID NO: 159400 - DNA, 20 bp, human
gggctcagggcctagtccct

SEQ ID NO: 159401 - DNA, 20 bp, human
gctggcagctgcaatgacca

SEQ ID NO: 159402 - DNA, 20 bp, human
gcccaggtgagccgtggctc

SEQ ID NO: 159403 - DNA, 20 bp, human
gtaatcccacccgagcaggt

SEQ ID NO: 159404 - DNA, 20 bp, human
gctgccagggtgaccgagga

SEQ ID NO: 159405 - DNA, 20 bp, human
gcatgcccacctgctcgggt

SEQ ID NO: 159406 - DNA, 20 bp, human
gaggatgtcggtgaattacg

SEQ ID NO: 159407 - DNA, 20 bp, human
gagacgcgctcacctccggg

SEQ ID NO: 159408 - DNA, 20 bp, human
gtgtcgccgtacgcggacaa

SEQ ID NO: 159409 - DNA, 20 bp, human
ggcggaagcggcctcaacaa

SEQ ID NO: 159410 - DNA, 20 bp, human
gggcaagtgcggcctcccgg

SEQ ID NO: 159411 - DNA, 20 bp, human
gtccagagccgggccaggac

SEQ ID NO: 159412 - DNA, 20 bp, human
gatgtcggtgaattacgcgg

SEQ ID NO: 159413 - DNA, 20 bp, human
gacatcctcgactgccccac

SEQ ID NO: 159414 - DNA, 20 bp, human
gggacgacaggcgcaaaggg

SEQ ID NO: 159415 - DNA, 20 bp, human
gacacacctggagaacgatt

SEQ ID NO: 159416 - DNA, 20 bp, human
gcagctgctcccgaaaccgg

SEQ ID NO: 159417 - DNA, 20 bp, human
gcgacgggcggtcccgggtg

SEQ ID NO: 159418 - DNA, 20 bp, human
gccggctgccatcgctcccc

SEQ ID NO: 159419 - DNA, 20 bp, human
gcgccgctttgcgctcggag

SEQ ID NO: 159420 - DNA, 20 bp, human
gcgcatcctgaggaaggcgg

SEQ ID NO: 159421 - DNA, 20 bp, human
gcaggtgtgcgacgacccgg

SEQ ID NO: 159422 - DNA, 20 bp, human
gcacacctgccaagacgcca

SEQ ID NO: 159423 - DNA, 20 bp, human
ggagctgcgggggaaggtcc

SEQ ID NO: 159424 - DNA, 20 bp, human
ggcgcgagggcctgaagcgg

SEQ ID NO: 159425 - DNA, 20 bp, human
ggagagcgcggacctggtaa

SEQ ID NO: 159426 - DNA, 20 bp, human
gtacgggcctgaggagggat

SEQ ID NO: 159427 - DNA, 20 bp, human
gccggagcaggagccatccg

SEQ ID NO: 159428 - DNA, 20 bp, human
gggactgtgggtcctcttag

SEQ ID NO: 159429 - DNA, 20 bp, human
gtgccagggtgagtcaactg

SEQ ID NO: 159430 - DNA, 20 bp, human
gcatccggggcagggacggt

SEQ ID NO: 159431 - DNA, 20 bp, human
gtggcagggcctccaagagt

SEQ ID NO: 159432 - DNA, 20 bp, human
gtcagcatccccaatactgg

SEQ ID NO: 159433 - DNA, 20 bp, human
ggcatccccaatactggtgg

SEQ ID NO: 159434 - DNA, 20 bp, human
gaccagcaggatccaactct

SEQ ID NO: 159435 - DNA, 20 bp, human
gccaggcctgggttatggag

SEQ ID NO: 159436 - DNA, 20 bp, human
gcgaaggggcagctccgctt

SEQ ID NO: 159437 - DNA, 20 bp, human
gtgcagggcggcgactaacc

SEQ ID NO: 159438 - DNA, 20 bp, human
ggcgggtgccgctcactgca

SEQ ID NO: 159439 - DNA, 20 bp, human
gcggggccacgtccgcgaag

SEQ ID NO: 159440 - DNA, 20 bp, human
ggccgcggctcaactccctc

SEQ ID NO: 159441 - DNA, 20 bp, human
gcggcgactaaccgggatcg

SEQ ID NO: 159442 - DNA, 20 bp, human
ggtcctgagaaagcaccagg

SEQ ID NO: 159443 - DNA, 20 bp, human
gtaaccgggatcgtggaaga

SEQ ID NO: 159444 - DNA, 20 bp, human
gaagagggcgcgggggctag

SEQ ID NO: 159445 - DNA, 20 bp, human
ggcgccctcttccacgatcc

SEQ ID NO: 159446 - DNA, 20 bp, human
gactagcagcatccaccggg

SEQ ID NO: 159447 - DNA, 20 bp, human
gggcaactagcagcatccac

SEQ ID NO: 159448 - DNA, 20 bp, human
gggaggttctggacacggaa

SEQ ID NO: 159449 - DNA, 20 bp, human
gggaggcagcaaggccttaa

SEQ ID NO: 159450 - DNA, 20 bp, human
ggaacagaaaccaagttccc

SEQ ID NO: 159451 - DNA, 20 bp, human
ggcggaaacctggagcgcct

SEQ ID NO: 159452 - DNA, 20 bp, human
gtgggcggccaaggaagaga

SEQ ID NO: 159453 - DNA, 20 bp, human
gcgggaggtcggaggcagca

SEQ ID NO: 159454 - DNA, 20 bp, human
ggcagcatccaccgggcggg

SEQ ID NO: 159455 - DNA, 20 bp, human
gcctgcgtaaagccaaacga

SEQ ID NO: 159456 - DNA, 20 bp, human
gtgagaagcgagcgagggaa

SEQ ID NO: 159457 - DNA, 20 bp, human
gtgagagccagctagacggg

SEQ ID NO: 159458 - DNA, 20 bp, human
ggaagcgagcgagggaacgg

SEQ ID NO: 159459 - DNA, 20 bp, human
ggcagggcggcaacatcgag

SEQ ID NO: 159460 - DNA, 20 bp, human
gcctgcgtgaagccgaaggt

SEQ ID NO: 159461 - DNA, 20 bp, human
gacgagtgagaagcgagcga

SEQ ID NO: 159462 - DNA, 20 bp, human
gaagctgagagccagctaga

SEQ ID NO: 159463 - DNA, 20 bp, human
gcgggcgggcgcggagcatg

SEQ ID NO: 159464 - DNA, 20 bp, human
gcggccggcgcggggacgta

SEQ ID NO: 159465 - DNA, 20 bp, human
ggacgtacggcagtgactcg

SEQ ID NO: 159466 - DNA, 20 bp, human
gcaagaagtgggaggaatag

SEQ ID NO: 159467 - DNA, 20 bp, human
gggaggaatagaggtctagg

SEQ ID NO: 159468 - DNA, 20 bp, human
gccgctactcgccagaagta

SEQ ID NO: 159469 - DNA, 20 bp, human
ggagaggaggaagggcgtaa

SEQ ID NO: 159470 - DNA, 20 bp, human
ggcgatgaggaccaggagga

SEQ ID NO: 159471 - DNA, 20 bp, human
gggtgagaatcggcgaagtt

SEQ ID NO: 159472 - DNA, 20 bp, human
gtcgctgaatcttgactcgg

SEQ ID NO: 159473 - DNA, 20 bp, human
gtaccatggactgacctgag

SEQ ID NO: 159474 - DNA, 20 bp, human
ggtcattagggcgattgcgg

SEQ ID NO: 159475 - DNA, 20 bp, human
gctgaatcttgactcggcgg

SEQ ID NO: 159476 - DNA, 20 bp, human
gcccggctccaggggaaaag

SEQ ID NO: 159477 - DNA, 20 bp, human
gtatagtatgcagcaaccgg

SEQ ID NO: 159478 - DNA, 20 bp, human
ggatggaaagcgcctcggaa

SEQ ID NO: 159479 - DNA, 20 bp, human
gcaggaggcgcaccgagaag

SEQ ID NO: 159480 - DNA, 20 bp, human
gtagagcaaagtagtgtaaa

SEQ ID NO: 159481 - DNA, 20 bp, human
gaccggaggagtcacgttgg

SEQ ID NO: 159482 - DNA, 20 bp, human
gaggagtcacgttgggggaa

SEQ ID NO: 159483 - DNA, 20 bp, human
ggctctaacagctatcttaa

SEQ ID NO: 159484 - DNA, 20 bp, human
ggcaaccggaggagtcacgt

SEQ ID NO: 159485 - DNA, 20 bp, human
gccttcctctccgctcaccc

SEQ ID NO: 159486 - DNA, 20 bp, human
gggccgtccaggaggactaa

SEQ ID NO: 159487 - DNA, 20 bp, human
gcactgcggggggcactaga

SEQ ID NO: 159488 - DNA, 20 bp, human
ggcggcggcgaccgaagagg

SEQ ID NO: 159489 - DNA, 20 bp, human
gcggagccgggaattccgag

SEQ ID NO: 159490 - DNA, 20 bp, human
gtggggaatcacactgcggg

SEQ ID NO: 159491 - DNA, 20 bp, human
gcagaagctcagtctcgggg

SEQ ID NO: 159492 - DNA, 20 bp, human
gcgtgcagaagctcagtctc

SEQ ID NO: 159493 - DNA, 20 bp, human
gtgcccaagaccatctggga

SEQ ID NO: 159494 - DNA, 20 bp, human
ggctccttcccaaatcccat

SEQ ID NO: 159495 - DNA, 20 bp, human
gcacgcgtctcctcttccag

SEQ ID NO: 159496 - DNA, 20 bp, human
ggagcccgaaccccaagccg

SEQ ID NO: 159497 - DNA, 20 bp, human
gggacgaccccgactggagg

SEQ ID NO: 159498 - DNA, 20 bp, human
gagcggacgaccccgactgg

SEQ ID NO: 159499 - DNA, 20 bp, human
gagcgggacacactaccggg

SEQ ID NO: 159500 - DNA, 20 bp, human
gatgggcagctggaacatcg

SEQ ID NO: 159501 - DNA, 20 bp, human
gggcagcgggacacactacc

SEQ ID NO: 159502 - DNA, 20 bp, human
gggaggaggtgctggctccg

SEQ ID NO: 159503 - DNA, 20 bp, human
gacacactaccgggtggcgg

SEQ ID NO: 159504 - DNA, 20 bp, human
ggggagcggacgaccccgac

SEQ ID NO: 159505 - DNA, 20 bp, human
gcttgaagcacactaccagg

SEQ ID NO: 159506 - DNA, 20 bp, human
gaagcccaggatggtgagac

SEQ ID NO: 159507 - DNA, 20 bp, human
gagtcccgtctcaccatcct

SEQ ID NO: 159508 - DNA, 20 bp, human
gctccgttggaagcccagga

SEQ ID NO: 159509 - DNA, 20 bp, human
gcctgcgctgcgctagggcg

SEQ ID NO: 159510 - DNA, 20 bp, human
gctccgccggtgagagagaa

SEQ ID NO: 159511 - DNA, 20 bp, human
gtcgatggatcccaaaccag

SEQ ID NO: 159512 - DNA, 20 bp, human
gcagtctccgttggaagccc

SEQ ID NO: 159513 - DNA, 20 bp, human
gctacctcgggcgcttccaa

SEQ ID NO: 159514 - DNA, 20 bp, human
gtctcaccggcggagtgggt

SEQ ID NO: 159515 - DNA, 20 bp, human
ggtgcgcctgcgctgcgcta

SEQ ID NO: 159516 - DNA, 20 bp, human
gagtcgccggaaactccggg

SEQ ID NO: 159517 - DNA, 20 bp, human
ggtcgataagctggaactga

SEQ ID NO: 159518 - DNA, 20 bp, human
ggttgacattccgcagaccg

SEQ ID NO: 159519 - DNA, 20 bp, human
gtaagcgccgccgcggtctg

SEQ ID NO: 159520 - DNA, 20 bp, human
gaagcgtcccaagaagggag

SEQ ID NO: 159521 - DNA, 20 bp, human
gaaagtgaaggagatctact

SEQ ID NO: 159522 - DNA, 20 bp, human
ggacattccgcagaccgcgg

SEQ ID NO: 159523 - DNA, 20 bp, human
ggaggccctccgtgctagta

SEQ ID NO: 159524 - DNA, 20 bp, human
gcggtttagacaccagacgg

SEQ ID NO: 159525 - DNA, 20 bp, human
gtccctaagcgtcccaagaa

SEQ ID NO: 159526 - DNA, 20 bp, human
gcagcgagcgctggacggag

SEQ ID NO: 159527 - DNA, 20 bp, human
ggcgccgagattcaaactag

SEQ ID NO: 159528 - DNA, 20 bp, human
ggagccgtggggttgtacat

SEQ ID NO: 159529 - DNA, 20 bp, human
gacacgcgacaagggttcct

SEQ ID NO: 159530 - DNA, 20 bp, human
gtcccgcagaagctccggat

SEQ ID NO: 159531 - DNA, 20 bp, human
ggcagagccgaggacgcgtc

SEQ ID NO: 159532 - DNA, 20 bp, human
gtaaaacggacacgcgacaa

SEQ ID NO: 159533 - DNA, 20 bp, human
gcgagattcaaactagtggc

SEQ ID NO: 159534 - DNA, 20 bp, human
ggattcaaactagtggcggg

SEQ ID NO: 159535 - DNA, 20 bp, human
gtggcgttagcgtagctccc

SEQ ID NO: 159536 - DNA, 20 bp, human
ggggaaaccctacagatgta

SEQ ID NO: 159537 - DNA, 20 bp, human
gggtcggagaccaggcaagg

SEQ ID NO: 159538 - DNA, 20 bp, human
ggcgaccgcggctgaggtac

SEQ ID NO: 159539 - DNA, 20 bp, human
ggcgacccggctgcaccgcg

SEQ ID NO: 159540 - DNA, 20 bp, human
gggactgccctacatctgta

SEQ ID NO: 159541 - DNA, 20 bp, human
gctgaggtacaggtgcctcg

SEQ ID NO: 159542 - DNA, 20 bp, human
ggagccaacggatctcctca

SEQ ID NO: 159543 - DNA, 20 bp, human
gagaccaggcaaggtggcat

SEQ ID NO: 159544 - DNA, 20 bp, human
ggccctggtcgggaggcgga

SEQ ID NO: 159545 - DNA, 20 bp, human
gacaggtcggagaccaggca

SEQ ID NO: 159546 - DNA, 20 bp, human
ggaacagcggggctacgagt

SEQ ID NO: 159547 - DNA, 20 bp, human
ggcggctgcgacctagactc

SEQ ID NO: 159548 - DNA, 20 bp, human
gcgggccggggctcacaaca

SEQ ID NO: 159549 - DNA, 20 bp, human
ggcccggattaagaacagcg

SEQ ID NO: 159550 - DNA, 20 bp, human
gcagtggggtcggcacaggg

SEQ ID NO: 159551 - DNA, 20 bp, human
gtcgggacactgccgggccg

SEQ ID NO: 159552 - DNA, 20 bp, human
gcgacctagactcaggctag

SEQ ID NO: 159553 - DNA, 20 bp, human
gcccactggctagaagacgt

SEQ ID NO: 159554 - DNA, 20 bp, human
gtagactcaggctagcggcc

SEQ ID NO: 159555 - DNA, 20 bp, human
ggctgaaaaggtgaccgacg

SEQ ID NO: 159556 - DNA, 20 bp, human
gtacaagaaggagagcgcca

SEQ ID NO: 159557 - DNA, 20 bp, human
gcgggcaggtgcagcacggg

SEQ ID NO: 159558 - DNA, 20 bp, human
gcgcacgagggcgccgagaa

SEQ ID NO: 159559 - DNA, 20 bp, human
ggagccggagcgcaccatgg

SEQ ID NO: 159560 - DNA, 20 bp, human
gggtcggacggcatgaagaa

SEQ ID NO: 159561 - DNA, 20 bp, human
ggagcgcaccatggaggcgg

SEQ ID NO: 159562 - DNA, 20 bp, human
ggctgcgagaccgtactgga

SEQ ID NO: 159563 - DNA, 20 bp, human
gaaggagagcgccaaggagg

SEQ ID NO: 159564 - DNA, 20 bp, human
ggcggcggcggctggatggc

SEQ ID NO: 159565 - DNA, 20 bp, human
gaagaaggagagcgccaagg

SEQ ID NO: 159566 - DNA, 20 bp, human
gcattggagcactatgataa

SEQ ID NO: 159567 - DNA, 20 bp, human
gctatgataatggaatgtga

SEQ ID NO: 159568 - DNA, 20 bp, human
ggtgctccaatggagaagga

SEQ ID NO: 159569 - DNA, 20 bp, human
ggaaggaagtgccaaactct

SEQ ID NO: 159570 - DNA, 20 bp, human
gtatatttactgcaaatggt

SEQ ID NO: 159571 - DNA, 20 bp, human
ggggactcagaccaacacac

SEQ ID NO: 159572 - DNA, 20 bp, human
gtttgtagctaaagcagcgg

SEQ ID NO: 159573 - DNA, 20 bp, human
ggacttcaggtctcccatct

SEQ ID NO: 159574 - DNA, 20 bp, human
gcggctacctcatcattaaa

SEQ ID NO: 159575 - DNA, 20 bp, human
gctctaggcgaaattattgg

SEQ ID NO: 159576 - DNA, 20 bp, human
gtccagtgaagtcagctcgg

SEQ ID NO: 159577 - DNA, 20 bp, human
gccggagctggagtccgact

SEQ ID NO: 159578 - DNA, 20 bp, human
ggaccagatgaaacctctcc

SEQ ID NO: 159579 - DNA, 20 bp, human
gagtgaagtcagctcggagg

SEQ ID NO: 159580 - DNA, 20 bp, human
ggaggactcgtccaccgagt

SEQ ID NO: 159581 - DNA, 20 bp, human
ggtggtggtggtgcggaggc

SEQ ID NO: 159582 - DNA, 20 bp, human
ggaagtcagctcggaggagg

SEQ ID NO: 159583 - DNA, 20 bp, human
gagaggtttcatctggtcaa

SEQ ID NO: 159584 - DNA, 20 bp, human
ggatgctctgcactgacact

SEQ ID NO: 159585 - DNA, 20 bp, human
ggaagctggtgcgcctgaat

SEQ ID NO: 159586 - DNA, 20 bp, human
gacggaccgggtcgagacca

SEQ ID NO: 159587 - DNA, 20 bp, human
gccgcgccggcacagccgaa

SEQ ID NO: 159588 - DNA, 20 bp, human
gccggcacagccgaagggag

SEQ ID NO: 159589 - DNA, 20 bp, human
gcgagaccagggcatccccg

SEQ ID NO: 159590 - DNA, 20 bp, human
ggcggcggcgggcacaggtg

SEQ ID NO: 159591 - DNA, 20 bp, human
ggcggagcgctgctggactg

SEQ ID NO: 159592 - DNA, 20 bp, human
gcctcctaggagcccgacgg

SEQ ID NO: 159593 - DNA, 20 bp, human
ggggcaccgaggcccgagta

SEQ ID NO: 159594 - DNA, 20 bp, human
gtcgctaggcgggtgttcca

SEQ ID NO: 159595 - DNA, 20 bp, human
ggcagggcgctgtagttgac

SEQ ID NO: 159596 - DNA, 20 bp, human
gctccacggcccgaaggggt

SEQ ID NO: 159597 - DNA, 20 bp, human
ggacccccctaccctcgcta

SEQ ID NO: 159598 - DNA, 20 bp, human
ggaaccccgggtggtaacag

SEQ ID NO: 159599 - DNA, 20 bp, human
gcccggactgagcgaggaag

SEQ ID NO: 159600 - DNA, 20 bp, human
gctgggatggacaggagtac

SEQ ID NO: 159601 - DNA, 20 bp, human
gtaccctagcgagggtaggg

SEQ ID NO: 159602 - DNA, 20 bp, human
gcactccgtcggaaagacga

SEQ ID NO: 159603 - DNA, 20 bp, human
ggcctggcagcccggaagtg

SEQ ID NO: 159604 - DNA, 20 bp, human
ggacagagcagaaagggctg

SEQ ID NO: 159605 - DNA, 20 bp, human
gtgggccctgcccctgaact

SEQ ID NO: 159606 - DNA, 20 bp, human
ggctcagtggataaagagcg

SEQ ID NO: 159607 - DNA, 20 bp, human
gcggggcatcgtgggtagga

SEQ ID NO: 159608 - DNA, 20 bp, human
gagctgttcagcgtgttcga

SEQ ID NO: 159609 - DNA, 20 bp, human
ggtcgcggggcatcgtgggt

SEQ ID NO: 159610 - DNA, 20 bp, human
ggagggcgactcgaccactg

SEQ ID NO: 159611 - DNA, 20 bp, human
gtcactgctcccaaaaatgg

SEQ ID NO: 159612 - DNA, 20 bp, human
gggagacaaccgcgaagatg

SEQ ID NO: 159613 - DNA, 20 bp, human
gggcgactcgaccactgcgg

SEQ ID NO: 159614 - DNA, 20 bp, human
gggcagctggcgactcaagg

SEQ ID NO: 159615 - DNA, 20 bp, human
gcctccagggtctgcagaca

SEQ ID NO: 159616 - DNA, 20 bp, human
ggacgtgggtactcacagtg

SEQ ID NO: 159617 - DNA, 20 bp, human
ggtgggagcgcggagaacca

SEQ ID NO: 159618 - DNA, 20 bp, human
gcgaagcgggagactggcag

SEQ ID NO: 159619 - DNA, 20 bp, human
ggacccaggaccctcaactg

SEQ ID NO: 159620 - DNA, 20 bp, human
gtagctccgggagccgacgg

SEQ ID NO: 159621 - DNA, 20 bp, human
gagatggacgagcttgggga

SEQ ID NO: 159622 - DNA, 20 bp, human
gcagcttgaggaacccccgt

SEQ ID NO: 159623 - DNA, 20 bp, human
gggggactggccggaagaag

SEQ ID NO: 159624 - DNA, 20 bp, human
gcctggagcgcatggcgcgg

SEQ ID NO: 159625 - DNA, 20 bp, human
gccgggcgagcggtgagcgg

SEQ ID NO: 159626 - DNA, 20 bp, human
gcgggctggaaggcgctcga

SEQ ID NO: 159627 - DNA, 20 bp, human
ggacgccagcaggatgtcgt

SEQ ID NO: 159628 - DNA, 20 bp, human
gcgtcgaaggcgaaattgtc

SEQ ID NO: 159629 - DNA, 20 bp, human
gttgggccctggcagcggac

SEQ ID NO: 159630 - DNA, 20 bp, human
gcgcagcggcgcgatgagat

SEQ ID NO: 159631 - DNA, 20 bp, human
gcactcgtgtgacacgtcga

SEQ ID NO: 159632 - DNA, 20 bp, human
ggggcccaacgacatcctgc

SEQ ID NO: 159633 - DNA, 20 bp, human
gtcacctggcccacctggtt

SEQ ID NO: 159634 - DNA, 20 bp, human
gaattgtctggcagcttggg

SEQ ID NO: 159635 - DNA, 20 bp, human
ggtcgttcctgggcgaaaac

SEQ ID NO: 159636 - DNA, 20 bp, human
gttcttcgggagaccctacc

SEQ ID NO: 159637 - DNA, 20 bp, human
ggagtagccgcccactgaac

SEQ ID NO: 159638 - DNA, 20 bp, human
gagccgggaggcgttagcga

SEQ ID NO: 159639 - DNA, 20 bp, human
gcgggaggctgacgagagcc

SEQ ID NO: 159640 - DNA, 20 bp, human
gtagggtctcccgaagaaca

SEQ ID NO: 159641 - DNA, 20 bp, human
ggcaggcttaagaccaagag

SEQ ID NO: 159642 - DNA, 20 bp, human
gaggtgaacggaacctggta

SEQ ID NO: 159643 - DNA, 20 bp, human
ggggcaggcccaaaccgcag

SEQ ID NO: 159644 - DNA, 20 bp, human
ggctgtagtggcttcgtctt

SEQ ID NO: 159645 - DNA, 20 bp, human
gggaggcctcgctgagtcgg

SEQ ID NO: 159646 - DNA, 20 bp, human
gcttgcgcgcgcagtgggga

SEQ ID NO: 159647 - DNA, 20 bp, human
gccagtggagggaacagaca

SEQ ID NO: 159648 - DNA, 20 bp, human
ggccaaagcgggaatctggg

SEQ ID NO: 159649 - DNA, 20 bp, human
gcgcgccaaagcgggaatct

SEQ ID NO: 159650 - DNA, 20 bp, human
gggctccgagcgtgctgctc

SEQ ID NO: 159651 - DNA, 20 bp, human
gtggcagaaaagcccaatta

SEQ ID NO: 159652 - DNA, 20 bp, human
gatacactgattgaaaacgg

SEQ ID NO: 159653 - DNA, 20 bp, human
ggagccttgcgcgcgcagtg

SEQ ID NO: 159654 - DNA, 20 bp, human
gtagcgggtctggctgctgg

SEQ ID NO: 159655 - DNA, 20 bp, human
ggtgcggccgcgaagcagag

SEQ ID NO: 159656 - DNA, 20 bp, human
gcaggcagccgggcttctcg

SEQ ID NO: 159657 - DNA, 20 bp, human
gttggcgagaatgtctcctc

SEQ ID NO: 159658 - DNA, 20 bp, human
gcactgggcatgactcctgt

SEQ ID NO: 159659 - DNA, 20 bp, human
ggcacagctaggaattctga

SEQ ID NO: 159660 - DNA, 20 bp, human
gcagttcttctgtgtagcat

SEQ ID NO: 159661 - DNA, 20 bp, human
gcataattctgtggagagaa

SEQ ID NO: 159662 - DNA, 20 bp, human
gcacactgcagtggctcagt

SEQ ID NO: 159663 - DNA, 20 bp, human
gggtgcccagcacactgcag

SEQ ID NO: 159664 - DNA, 20 bp, human
gccctcaaggtcgcacagct

SEQ ID NO: 159665 - DNA, 20 bp, human
ggcagtggctcagtgggtgt

SEQ ID NO: 159666 - DNA, 20 bp, human
gtaaagcccagtcccagtcg

SEQ ID NO: 159667 - DNA, 20 bp, human
gagctctgtcacagagacac

SEQ ID NO: 159668 - DNA, 20 bp, human
ggtcacagagacacaggcgt

SEQ ID NO: 159669 - DNA, 20 bp, human
gaagcacagccgagccaggg

SEQ ID NO: 159670 - DNA, 20 bp, human
gtgccgtcagaggaaacggg

SEQ ID NO: 159671 - DNA, 20 bp, human
ggtcctaggaccaaggacac

SEQ ID NO: 159672 - DNA, 20 bp, human
gcagcctgggaggatcttca

SEQ ID NO: 159673 - DNA, 20 bp, human
gccctgccccgactgggact

SEQ ID NO: 159674 - DNA, 20 bp, human
gcccaggctgagagagttct

SEQ ID NO: 159675 - DNA, 20 bp, human
gtcttggatggcctggagac

SEQ ID NO: 159676 - DNA, 20 bp, human
gagcagtcacaaagaactat

SEQ ID NO: 159677 - DNA, 20 bp, human
gaccactgtaagttacgggt

SEQ ID NO: 159678 - DNA, 20 bp, human
gtccaacccgtaacttacag

SEQ ID NO: 159679 - DNA, 20 bp, human
ggatctgaagaatcccagtt

SEQ ID NO: 159680 - DNA, 20 bp, human
gctgtgttctggctccgatt

SEQ ID NO: 159681 - DNA, 20 bp, human
ggataagtgacatatacgac

SEQ ID NO: 159682 - DNA, 20 bp, human
gtatgtggaagaactaggca

SEQ ID NO: 159683 - DNA, 20 bp, human
gtgtaattgttagaatgtgt

SEQ ID NO: 159684 - DNA, 20 bp, human
ggaagtgcatgtctgtgttc

SEQ ID NO: 159685 - DNA, 20 bp, human
gtaaaataacatcatctgtt

SEQ ID NO: 159686 - DNA, 20 bp, human
gtgtgacagctagccgatgg

SEQ ID NO: 159687 - DNA, 20 bp, human
gattgagagcagtagatcaa

SEQ ID NO: 159688 - DNA, 20 bp, human
gagagaagagactccgccat

SEQ ID NO: 159689 - DNA, 20 bp, human
ggactcagcccttatagcaa

SEQ ID NO: 159690 - DNA, 20 bp, human
gatagcagcagttagctata

SEQ ID NO: 159691 - DNA, 20 bp, human
gtagaagaaaatagtcatag

SEQ ID NO: 159692 - DNA, 20 bp, human
gtaaatgtcaaacacaatta

SEQ ID NO: 159693 - DNA, 20 bp, human
gttctgtgacagctagccga

SEQ ID NO: 159694 - DNA, 20 bp, human
gcatatgttgacttgtcaga

SEQ ID NO: 159695 - DNA, 20 bp, human
gtgtgctgcacacttacttt

SEQ ID NO: 159696 - DNA, 20 bp, human
gcccggagccggcgcagatg

SEQ ID NO: 159697 - DNA, 20 bp, human
gcggcgcagatgaggcagtt

SEQ ID NO: 159698 - DNA, 20 bp, human
gcgccagggtccccccacct

SEQ ID NO: 159699 - DNA, 20 bp, human
gcccgccgctagcaaggagg

SEQ ID NO: 159700 - DNA, 20 bp, human
gccggcgcggcgtctcctcg

SEQ ID NO: 159701 - DNA, 20 bp, human
gtgggcctcagcgccaagtc

SEQ ID NO: 159702 - DNA, 20 bp, human
gagatgaggcagttcggctg

SEQ ID NO: 159703 - DNA, 20 bp, human
gagcggcgctttggaacccg

SEQ ID NO: 159704 - DNA, 20 bp, human
gcttggcgctgaggcccaag

SEQ ID NO: 159705 - DNA, 20 bp, human
ggcgcgtccattccctcctc

SEQ ID NO: 159706 - DNA, 20 bp, human
ggcagctgctcacagatgcc

SEQ ID NO: 159707 - DNA, 20 bp, human
gagaaggaagggatcctggc

SEQ ID NO: 159708 - DNA, 20 bp, human
ggggcctgtcaccctaagac

SEQ ID NO: 159709 - DNA, 20 bp, human
ggcttcgtgtcatgcagcag

SEQ ID NO: 159710 - DNA, 20 bp, human
ggactggtcagaaaagtgac

SEQ ID NO: 159711 - DNA, 20 bp, human
gcagctgccaggctccggcc

SEQ ID NO: 159712 - DNA, 20 bp, human
gctgagtcttggaaacccaa

SEQ ID NO: 159713 - DNA, 20 bp, human
gaactgacagccagtcccta

SEQ ID NO: 159714 - DNA, 20 bp, human
gggtagaagtcttgcttgag

SEQ ID NO: 159715 - DNA, 20 bp, human
gccagtttccaaggaaatga

SEQ ID NO: 159716 - DNA, 20 bp, human
gcaagcaccagtcttcaccg

SEQ ID NO: 159717 - DNA, 20 bp, human
gactggtgcttgagaccttg

SEQ ID NO: 159718 - DNA, 20 bp, human
gcgtactgtgaacctcaggg

SEQ ID NO: 159719 - DNA, 20 bp, human
gtgctttccgcggtgaagac

SEQ ID NO: 159720 - DNA, 20 bp, human
gcgcatccaaagttgagagg

SEQ ID NO: 159721 - DNA, 20 bp, human
ggaagacaaacaggagcgat

SEQ ID NO: 159722 - DNA, 20 bp, human
ggtaccaagaccaagaaaat

SEQ ID NO: 159723 - DNA, 20 bp, human
gtatcgtactgtgaacctca

SEQ ID NO: 159724 - DNA, 20 bp, human
gagtacgatagtagatacat

SEQ ID NO: 159725 - DNA, 20 bp, human
ggaggaggtagtagtatatc

SEQ ID NO: 159726 - DNA, 20 bp, human
gtccctgggacagtcaacag

SEQ ID NO: 159727 - DNA, 20 bp, human
gctgccaaaggatatagatg

SEQ ID NO: 159728 - DNA, 20 bp, human
ggcctctggctcaactcggg

SEQ ID NO: 159729 - DNA, 20 bp, human
ggtaatacctaagagggaag

SEQ ID NO: 159730 - DNA, 20 bp, human
ggtctgagtaatacctaaga

SEQ ID NO: 159731 - DNA, 20 bp, human
gttccagagagcaatatggc

SEQ ID NO: 159732 - DNA, 20 bp, human
gaaccagccatattgctctc

SEQ ID NO: 159733 - DNA, 20 bp, human
ggaacaagatgatactatac

SEQ ID NO: 159734 - DNA, 20 bp, human
gtctaactcatggcagaacc

SEQ ID NO: 159735 - DNA, 20 bp, human
gggcagctcacaggtgagtc

SEQ ID NO: 159736 - DNA, 20 bp, human
gcagagaagcagactccaca

SEQ ID NO: 159737 - DNA, 20 bp, human
ggtttgaggagagtagcaga

SEQ ID NO: 159738 - DNA, 20 bp, human
gtgaccatctttctctggag

SEQ ID NO: 159739 - DNA, 20 bp, human
ggtcggctgtgagaatggtg

SEQ ID NO: 159740 - DNA, 20 bp, human
ggctggtttggagagaaagt

SEQ ID NO: 159741 - DNA, 20 bp, human
gtgtgagaatggtgaggacc

SEQ ID NO: 159742 - DNA, 20 bp, human
gcttctctgggaaggtaagt

SEQ ID NO: 159743 - DNA, 20 bp, human
gctgcctctccagagaaaga

SEQ ID NO: 159744 - DNA, 20 bp, human
gccaggccgagtggatgcac

SEQ ID NO: 159745 - DNA, 20 bp, human
gggatccctgcccagacgtc

SEQ ID NO: 159746 - DNA, 20 bp, human
gtgcagaagactgcattagg

SEQ ID NO: 159747 - DNA, 20 bp, human
gtactggcccagacccagtg

SEQ ID NO: 159748 - DNA, 20 bp, human
gtgactgaatcacacctctg

SEQ ID NO: 159749 - DNA, 20 bp, human
ggaagcagcagctggagaac

SEQ ID NO: 159750 - DNA, 20 bp, human
ggcaggaccgagagacacct

SEQ ID NO: 159751 - DNA, 20 bp, human
gctgtgcagaagactgcatt

SEQ ID NO: 159752 - DNA, 20 bp, human
gagtcaggctctttgtgtct

SEQ ID NO: 159753 - DNA, 20 bp, human
gtctggagttacaaggagta

SEQ ID NO: 159754 - DNA, 20 bp, human
gacacaaagagcctgactga

SEQ ID NO: 159755 - DNA, 20 bp, human
gagctgagattacgctactc

SEQ ID NO: 159756 - DNA, 20 bp, human
ggagagcgcagagtagagca

SEQ ID NO: 159757 - DNA, 20 bp, human
ggagcgcagacccgagaggt

SEQ ID NO: 159758 - DNA, 20 bp, human
gaggcccgaagacgccgagg

SEQ ID NO: 159759 - DNA, 20 bp, human
gccgaggaggcagagcaccg

SEQ ID NO: 159760 - DNA, 20 bp, human
gcgccgagcgcagacccgag

SEQ ID NO: 159761 - DNA, 20 bp, human
ggagcccgcggcctcgtcaa

SEQ ID NO: 159762 - DNA, 20 bp, human
ggtgccgacctgaccgatcc

SEQ ID NO: 159763 - DNA, 20 bp, human
ggacggaagcgcagagccga

SEQ ID NO: 159764 - DNA, 20 bp, human
gtggaggcccgaagacgccg

SEQ ID NO: 159765 - DNA, 20 bp, human
ggtgccgggatcggtcaggt

SEQ ID NO: 159766 - DNA, 20 bp, human
gcctgagaggtgattaaaga

SEQ ID NO: 159767 - DNA, 20 bp, human
gtcagccggagaacaaggag

SEQ ID NO: 159768 - DNA, 20 bp, human
gcggagtcagccggagaaca

SEQ ID NO: 159769 - DNA, 20 bp, human
gggggacatgaacctcaggt

SEQ ID NO: 159770 - DNA, 20 bp, human
gatggccagactgaagacat

SEQ ID NO: 159771 - DNA, 20 bp, human
gcttcagtctggccatgaag

SEQ ID NO: 159772 - DNA, 20 bp, human
gggagggaacagcctgggac

SEQ ID NO: 159773 - DNA, 20 bp, human
gccagcacaaaggccgtgag

SEQ ID NO: 159774 - DNA, 20 bp, human
gcagactgaagacattggac

SEQ ID NO: 159775 - DNA, 20 bp, human
gatggagttcagcaagatca

SEQ ID NO: 159776 - DNA, 20 bp, human
gattatccaacaaaccctcg

SEQ ID NO: 159777 - DNA, 20 bp, human
gacccaataggccaagatat

SEQ ID NO: 159778 - DNA, 20 bp, human
gaggtgattgcagtagttag

SEQ ID NO: 159779 - DNA, 20 bp, human
gccagggaccagcgcttctg

SEQ ID NO: 159780 - DNA, 20 bp, human
gcactacggcctggagcggg

SEQ ID NO: 159781 - DNA, 20 bp, human
ggcaccactacggcctggag

SEQ ID NO: 159782 - DNA, 20 bp, human
gccgtagtggtgctcattat

SEQ ID NO: 159783 - DNA, 20 bp, human
gagcgctggtccctgggccc

SEQ ID NO: 159784 - DNA, 20 bp, human
gccttggtgatgttctccat

SEQ ID NO: 159785 - DNA, 20 bp, human
gggaactgcctccaatatct

SEQ ID NO: 159786 - DNA, 20 bp, human
ggaggccgcctcccttccgg

SEQ ID NO: 159787 - DNA, 20 bp, human
gtaactggcagtgctaacag

SEQ ID NO: 159788 - DNA, 20 bp, human
gccagaggccgcctcccttc

SEQ ID NO: 159789 - DNA, 20 bp, human
gcgatcgcggagcagggtcg

SEQ ID NO: 159790 - DNA, 20 bp, human
gcctgacaggccgagctcgc

SEQ ID NO: 159791 - DNA, 20 bp, human
gagagcctccggaagggagg

SEQ ID NO: 159792 - DNA, 20 bp, human
gcgggtcgccggctgtggga

SEQ ID NO: 159793 - DNA, 20 bp, human
gagagctcgggcgcgaacct

SEQ ID NO: 159794 - DNA, 20 bp, human
ggctgcgcggtggctgtggc

SEQ ID NO: 159795 - DNA, 20 bp, human
ggctctgagtcactccaaga

SEQ ID NO: 159796 - DNA, 20 bp, human
gccccggagcccacgaccag

SEQ ID NO: 159797 - DNA, 20 bp, human
gccgcgaggccgctggtcgt

SEQ ID NO: 159798 - DNA, 20 bp, human
ggcgccgctgacgtgctcgg

SEQ ID NO: 159799 - DNA, 20 bp, human
gacgccgccgagcacgtcag

SEQ ID NO: 159800 - DNA, 20 bp, human
gggacacgccgctgaaccac

SEQ ID NO: 159801 - DNA, 20 bp, human
ggcccagggccgagggaacg

SEQ ID NO: 159802 - DNA, 20 bp, human
gcgttcagcccgtggttcag

SEQ ID NO: 159803 - DNA, 20 bp, human
gcagcggcgtgtcccagaac

SEQ ID NO: 159804 - DNA, 20 bp, human
gacgtgctcggcggcgtcgg

SEQ ID NO: 159805 - DNA, 20 bp, human
gccggggctcggagaccgac

SEQ ID NO: 159806 - DNA, 20 bp, human
gtgttccagtgacagtctga

SEQ ID NO: 159807 - DNA, 20 bp, human
ggaaagaacattcttcatgc

SEQ ID NO: 159808 - DNA, 20 bp, human
gttcgtagcttgaacttaca

SEQ ID NO: 159809 - DNA, 20 bp, human
gttcaagctacgaaaataaa

SEQ ID NO: 159810 - DNA, 20 bp, human
gtgtgactatagaagaagca

SEQ ID NO: 159811 - DNA, 20 bp, human
ggcatctgatgagatcttct

SEQ ID NO: 159812 - DNA, 20 bp, human
ggatcctaaaatactacaaa

SEQ ID NO: 159813 - DNA, 20 bp, human
gattttcacaaagaggtggc

SEQ ID NO: 159814 - DNA, 20 bp, human
gtagcttgaacttacaagga

SEQ ID NO: 159815 - DNA, 20 bp, human
gttctattttcacaaagagg

SEQ ID NO: 159816 - DNA, 20 bp, human
gcgcacatcaggagaccctg

SEQ ID NO: 159817 - DNA, 20 bp, human
gtggtgagtaagaacagaag

SEQ ID NO: 159818 - DNA, 20 bp, human
gcacagcttccggatctcca

SEQ ID NO: 159819 - DNA, 20 bp, human
gtaataaactgtggtaagta

SEQ ID NO: 159820 - DNA, 20 bp, human
gaaaaggcatgagcccaaac

SEQ ID NO: 159821 - DNA, 20 bp, human
ggaacagcaatagcttggac

SEQ ID NO: 159822 - DNA, 20 bp, human
gagcagccccatcatcacag

SEQ ID NO: 159823 - DNA, 20 bp, human
gcatgcacctccagtcccac

SEQ ID NO: 159824 - DNA, 20 bp, human
gggtgtccactgtgatgatg

SEQ ID NO: 159825 - DNA, 20 bp, human
gaacatcggcaacaatggct

SEQ ID NO: 159826 - DNA, 20 bp, human
gaaagacctgggggttgctc

SEQ ID NO: 159827 - DNA, 20 bp, human
gggcggctttgaggagggtt

SEQ ID NO: 159828 - DNA, 20 bp, human
ggctccggcggctttgagga

SEQ ID NO: 159829 - DNA, 20 bp, human
gagccgccggagcaaccccc

SEQ ID NO: 159830 - DNA, 20 bp, human
gagtagtagtagccagtgac

SEQ ID NO: 159831 - DNA, 20 bp, human
gtgtgagtcttggaaaggtg

SEQ ID NO: 159832 - DNA, 20 bp, human
gctgaggcgcgtggtagtga

SEQ ID NO: 159833 - DNA, 20 bp, human
gggtcagtgccccctgaaat

SEQ ID NO: 159834 - DNA, 20 bp, human
ggattgtaaagtaaagacct

SEQ ID NO: 159835 - DNA, 20 bp, human
gacctctgccggctccaccg

SEQ ID NO: 159836 - DNA, 20 bp, human
gagaccctaggctctaagaa

SEQ ID NO: 159837 - DNA, 20 bp, human
gggagtgtgagcggtgctct

SEQ ID NO: 159838 - DNA, 20 bp, human
gctcccagagtacctgaagt

SEQ ID NO: 159839 - DNA, 20 bp, human
gggtactctgggagtgtgag

SEQ ID NO: 159840 - DNA, 20 bp, human
ggggctgccggagaaggtga

SEQ ID NO: 159841 - DNA, 20 bp, human
ggcatctgtcctcacatgag

SEQ ID NO: 159842 - DNA, 20 bp, human
gcggatgggtaacagggcgt

SEQ ID NO: 159843 - DNA, 20 bp, human
gtctagactaggactcccac

SEQ ID NO: 159844 - DNA, 20 bp, human
ggaagcctctggtcccccgt

SEQ ID NO: 159845 - DNA, 20 bp, human
ggactcccacgggggaccag

SEQ ID NO: 159846 - DNA, 20 bp, human
gtatggagccctgggcgcgg

SEQ ID NO: 159847 - DNA, 20 bp, human
gagagcagcccggccccctg

SEQ ID NO: 159848 - DNA, 20 bp, human
gtgcggagctggtaaggtga

SEQ ID NO: 159849 - DNA, 20 bp, human
gggtggttgcggagctggta

SEQ ID NO: 159850 - DNA, 20 bp, human
gagctggtaaggtgagggga

SEQ ID NO: 159851 - DNA, 20 bp, human
ggcggcgtgtcaggtggttg

SEQ ID NO: 159852 - DNA, 20 bp, human
gggtcagcgcaccccgacac

SEQ ID NO: 159853 - DNA, 20 bp, human
gcgcctcgaaagaggccgac

SEQ ID NO: 159854 - DNA, 20 bp, human
ggcgggggcggcgtgtcagg

SEQ ID NO: 159855 - DNA, 20 bp, human
ggcgcgcccggcctgtgtcg

SEQ ID NO: 159856 - DNA, 20 bp, human
gcagagtttagcctgaactg

SEQ ID NO: 159857 - DNA, 20 bp, human
ggccttagtcagagtacaaa

SEQ ID NO: 159858 - DNA, 20 bp, human
gtagagaattgagtgactgg

SEQ ID NO: 159859 - DNA, 20 bp, human
gacaaagggttcctgcttgg

SEQ ID NO: 159860 - DNA, 20 bp, human
gggagtagaagtgtggaagt

SEQ ID NO: 159861 - DNA, 20 bp, human
gctaccaaatataggaggtg

SEQ ID NO: 159862 - DNA, 20 bp, human
ggtttagcctgaactgtggc

SEQ ID NO: 159863 - DNA, 20 bp, human
gattgagtgactgggggagg

SEQ ID NO: 159864 - DNA, 20 bp, human
gggttaccaggagctggtct

SEQ ID NO: 159865 - DNA, 20 bp, human
gtgcagcaaaaccaccaagc

SEQ ID NO: 159866 - DNA, 20 bp, human
gaccaaggagccttcttctg

SEQ ID NO: 159867 - DNA, 20 bp, human
ggcgtcacccaggaatatat

SEQ ID NO: 159868 - DNA, 20 bp, human
gaatgttcaacttaccacca

SEQ ID NO: 159869 - DNA, 20 bp, human
ggttacatttcctcagaaga

SEQ ID NO: 159870 - DNA, 20 bp, human
gagattctgaggagtaggtg

SEQ ID NO: 159871 - DNA, 20 bp, human
gaggtttatatttgactgtg

SEQ ID NO: 159872 - DNA, 20 bp, human
gtgtcataaagtagattctg

SEQ ID NO: 159873 - DNA, 20 bp, human
gtctcaagtaacctttcctg

SEQ ID NO: 159874 - DNA, 20 bp, human
gtcctcagaagaaggctcct

SEQ ID NO: 159875 - DNA, 20 bp, human
gtcctgggtgacgctgaagc

SEQ ID NO: 159876 - DNA, 20 bp, human
ggccaggaaagcgctaacca

SEQ ID NO: 159877 - DNA, 20 bp, human
ggaacctgcgtagagtcaca

SEQ ID NO: 159878 - DNA, 20 bp, human
gctggcagccgcatcagcag

SEQ ID NO: 159879 - DNA, 20 bp, human
ggcgtagagtcacagggccc

SEQ ID NO: 159880 - DNA, 20 bp, human
gttggtgagacagaggacgt

SEQ ID NO: 159881 - DNA, 20 bp, human
gggtgggtggaggagccagt

SEQ ID NO: 159882 - DNA, 20 bp, human
gacgctgtcagttaatgcgg

SEQ ID NO: 159883 - DNA, 20 bp, human
gagcagtggcgctagcatta

SEQ ID NO: 159884 - DNA, 20 bp, human
ggtcagttaatgcggaggga

SEQ ID NO: 159885 - DNA, 20 bp, human
ggttcagtaacaaatgtaga

SEQ ID NO: 159886 - DNA, 20 bp, human
gctagcctggacggccacag

SEQ ID NO: 159887 - DNA, 20 bp, human
gcggctgccggtggcctctg

SEQ ID NO: 159888 - DNA, 20 bp, human
gcctcccggcgacatcactg

SEQ ID NO: 159889 - DNA, 20 bp, human
gtcgcgggcgcagcatcctc

SEQ ID NO: 159890 - DNA, 20 bp, human
gccgaccccggccagtcccg

SEQ ID NO: 159891 - DNA, 20 bp, human
gagccgcgcggagatcctcc

SEQ ID NO: 159892 - DNA, 20 bp, human
ggggccgccgctagcctgga

SEQ ID NO: 159893 - DNA, 20 bp, human
ggtccacctggaaacggctc

SEQ ID NO: 159894 - DNA, 20 bp, human
gcagcatcctccggcaccga

SEQ ID NO: 159895 - DNA, 20 bp, human
ggcagtgcgggcagcacgaa

SEQ ID NO: 159896 - DNA, 20 bp, human
gccccaggcgtctctgttgt

SEQ ID NO: 159897 - DNA, 20 bp, human
gaagcgcccgctgcacaaag

SEQ ID NO: 159898 - DNA, 20 bp, human
gtgcacaaagtggcgtcccc

SEQ ID NO: 159899 - DNA, 20 bp, human
gagacgctcctccatcccca

SEQ ID NO: 159900 - DNA, 20 bp, human
ggcccacaacagagacgcct

SEQ ID NO: 159901 - DNA, 20 bp, human
gagtgcaggtcagccagtgt

SEQ ID NO: 159902 - DNA, 20 bp, human
gcagaaatctgggcacatgt

SEQ ID NO: 159903 - DNA, 20 bp, human
gaggatccgcaaggacacac

SEQ ID NO: 159904 - DNA, 20 bp, human
gggctacaacacgatcgatg

SEQ ID NO: 159905 - DNA, 20 bp, human
gcagcctggtgagccccgga

SEQ ID NO: 159906 - DNA, 20 bp, human
gcgcgcctcggcccgtccac

SEQ ID NO: 159907 - DNA, 20 bp, human
gcagcggggaggaatgcgag

SEQ ID NO: 159908 - DNA, 20 bp, human
gccccgcccggggcccacag

SEQ ID NO: 159909 - DNA, 20 bp, human
gggtgaagtgaggcatcgtg

SEQ ID NO: 159910 - DNA, 20 bp, human
gctcccctgtgggccccggg

SEQ ID NO: 159911 - DNA, 20 bp, human
gctgcagacgtggccgccca

SEQ ID NO: 159912 - DNA, 20 bp, human
gcaaggtcccgggataggtg

SEQ ID NO: 159913 - DNA, 20 bp, human
ggccggctggcctccctggg

SEQ ID NO: 159914 - DNA, 20 bp, human
gcagacgtggccgcccaggg

SEQ ID NO: 159915 - DNA, 20 bp, human
gccgagctggatgactcgga

SEQ ID NO: 159916 - DNA, 20 bp, human
gggatcaaaatcactcaccg

SEQ ID NO: 159917 - DNA, 20 bp, human
gcctgtagacagccaaggtc

SEQ ID NO: 159918 - DNA, 20 bp, human
gacaggaggtctgaagccga

SEQ ID NO: 159919 - DNA, 20 bp, human
ggagggcagtacagacatcc

SEQ ID NO: 159920 - DNA, 20 bp, human
gtagctcacaggcagtccct

SEQ ID NO: 159921 - DNA, 20 bp, human
gcccatcctgtagacagcca

SEQ ID NO: 159922 - DNA, 20 bp, human
gtagacagccaaggtctggc

SEQ ID NO: 159923 - DNA, 20 bp, human
gccagcccaccttggcctgt

SEQ ID NO: 159924 - DNA, 20 bp, human
gtgtctgagcagcttcagcc

SEQ ID NO: 159925 - DNA, 20 bp, human
gacacagttgtgtagctcac

SEQ ID NO: 159926 - DNA, 20 bp, human
gctgcaaccaggctctagga

SEQ ID NO: 159927 - DNA, 20 bp, human
gaggtccgggatcgcacaag

SEQ ID NO: 159928 - DNA, 20 bp, human
gggcggccgcggcaaggtcc

SEQ ID NO: 159929 - DNA, 20 bp, human
ggtggctgcaaccaggctct

SEQ ID NO: 159930 - DNA, 20 bp, human
gtcccgggggaagacgtcaa

SEQ ID NO: 159931 - DNA, 20 bp, human
gcggaacgcaaagtgtggag

SEQ ID NO: 159932 - DNA, 20 bp, human
gggcgtggccacgagggaaa

SEQ ID NO: 159933 - DNA, 20 bp, human
gcgcacaagtggctgcaacc

SEQ ID NO: 159934 - DNA, 20 bp, human
gggccgcggaacgcaaagtg

SEQ ID NO: 159935 - DNA, 20 bp, human
gcgaggtgaccgtgaacctg

SEQ ID NO: 159936 - DNA, 20 bp, human
ggctacagcgaacgagagag

SEQ ID NO: 159937 - DNA, 20 bp, human
gcaagtcagcccgaagccgt

SEQ ID NO: 159938 - DNA, 20 bp, human
ggcggcgaaggcgggtagag

SEQ ID NO: 159939 - DNA, 20 bp, human
gctcgctctccgctccacgg

SEQ ID NO: 159940 - DNA, 20 bp, human
gtgggttagctaaaccgagg

SEQ ID NO: 159941 - DNA, 20 bp, human
ggctaaaccgaggaggcggt

SEQ ID NO: 159942 - DNA, 20 bp, human
gacttgggttagctaaaccg

SEQ ID NO: 159943 - DNA, 20 bp, human
gacgagagagcggcgaaggc

SEQ ID NO: 159944 - DNA, 20 bp, human
ggggatagaagacctagaat

SEQ ID NO: 159945 - DNA, 20 bp, human
gctgatgtggagctcgacgg

SEQ ID NO: 159946 - DNA, 20 bp, human
gacgacagcaaggaagaggt

SEQ ID NO: 159947 - DNA, 20 bp, human
gccctgcctacaagagacag

SEQ ID NO: 159948 - DNA, 20 bp, human
ggaagctatcagatacacag

SEQ ID NO: 159949 - DNA, 20 bp, human
gacaggtgaaactgaatcag

SEQ ID NO: 159950 - DNA, 20 bp, human
ggcagggaaaactaactgga

SEQ ID NO: 159951 - DNA, 20 bp, human
gacagtctgaaacgacagca

SEQ ID NO: 159952 - DNA, 20 bp, human
gcaagcgccccactccctca

SEQ ID NO: 159953 - DNA, 20 bp, human
ggaacacagaactcattgtg

SEQ ID NO: 159954 - DNA, 20 bp, human
ggcctacaagagacagtggc

SEQ ID NO: 159955 - DNA, 20 bp, human
gtcatctgaatcctgaatcc

SEQ ID NO: 159956 - DNA, 20 bp, human
gcttgcgaagagaagcccgg

SEQ ID NO: 159957 - DNA, 20 bp, human
ggcaaggttcacctcgaatg

SEQ ID NO: 159958 - DNA, 20 bp, human
gaacgcgcctccggcaaagg

SEQ ID NO: 159959 - DNA, 20 bp, human
ggaatgaggaacaagcgggg

SEQ ID NO: 159960 - DNA, 20 bp, human
gcacgcaggctggcctgact

SEQ ID NO: 159961 - DNA, 20 bp, human
gctcgaatgaggaacaagcg

SEQ ID NO: 159962 - DNA, 20 bp, human
ggcggctctgaaacagttac

SEQ ID NO: 159963 - DNA, 20 bp, human
ggcaggagaaacctagcgag

SEQ ID NO: 159964 - DNA, 20 bp, human
gaccctgaggaagaacgacg

SEQ ID NO: 159965 - DNA, 20 bp, human
gggtcgcaggtgcagtatcc

SEQ ID NO: 159966 - DNA, 20 bp, human
gtcagctcgggtgggaccgg

SEQ ID NO: 159967 - DNA, 20 bp, human
gcgtcggcgtgagcctccac

SEQ ID NO: 159968 - DNA, 20 bp, human
ggcaccacggtgaagttggt

SEQ ID NO: 159969 - DNA, 20 bp, human
ggggccgggacggggactgt

SEQ ID NO: 159970 - DNA, 20 bp, human
gcctgccagggctcccggta

SEQ ID NO: 159971 - DNA, 20 bp, human
gcggtacggtcagctcgggt

SEQ ID NO: 159972 - DNA, 20 bp, human
gcagccgacagtccccgtcc

SEQ ID NO: 159973 - DNA, 20 bp, human
gtagccatggaaacggggag

SEQ ID NO: 159974 - DNA, 20 bp, human
gccgacgccacgggacttgg

SEQ ID NO: 159975 - DNA, 20 bp, human
gtcccactagggaccaccca

SEQ ID NO: 159976 - DNA, 20 bp, human
ggatcctggtgatctggaca

SEQ ID NO: 159977 - DNA, 20 bp, human
ggtgcaggagctcttccatg

SEQ ID NO: 159978 - DNA, 20 bp, human
gatgaggcagcccagcaggt

SEQ ID NO: 159979 - DNA, 20 bp, human
gtgtctgtggaagacctctc

SEQ ID NO: 159980 - DNA, 20 bp, human
gctcctgcacctgggacatc

SEQ ID NO: 159981 - DNA, 20 bp, human
gagcagggatcctggtgatc

SEQ ID NO: 159982 - DNA, 20 bp, human
gggtcattctccagcaagca

SEQ ID NO: 159983 - DNA, 20 bp, human
gagaatgacccagatgtccc

SEQ ID NO: 159984 - DNA, 20 bp, human
gtggaagagctcctgcacct

SEQ ID NO: 159985 - DNA, 20 bp, human
gggtaacagcatccttggtc

SEQ ID NO: 159986 - DNA, 20 bp, human
gaaaagccgggtgacaggta

SEQ ID NO: 159987 - DNA, 20 bp, human
gcagagcacccgggtgtccc

SEQ ID NO: 159988 - DNA, 20 bp, human
ggtagggagccagagcaccc

SEQ ID NO: 159989 - DNA, 20 bp, human
gcagcgtggcccaaacgtga

SEQ ID NO: 159990 - DNA, 20 bp, human
ggaaggctgggggacttggt

SEQ ID NO: 159991 - DNA, 20 bp, human
gcccgcgccgcacagagcaa

SEQ ID NO: 159992 - DNA, 20 bp, human
gggagccaggtgaatgtggg

SEQ ID NO: 159993 - DNA, 20 bp, human
gggacccgcaccccaagtac

SEQ ID NO: 159994 - DNA, 20 bp, human
gcggcgggaagggcgagcgg

SEQ ID NO: 159995 - DNA, 20 bp, human
gccggcgcgcgggtgaccgg

SEQ ID NO: 159996 - DNA, 20 bp, human
gtagccgcagctgtcttttc

SEQ ID NO: 159997 - DNA, 20 bp, human
ggccaagatatccttctccc

SEQ ID NO: 159998 - DNA, 20 bp, human
gtcgggcggagagtgcacgg

SEQ ID NO: 159999 - DNA, 20 bp, human
ggcgatccccgcgagccggg

SEQ ID NO: 160000 - DNA, 20 bp, human
ggggccggaaaagacagctg

SEQ ID NO: 160001 - DNA, 20 bp, human
ggagggagaggattgacgga

SEQ ID NO: 160002 - DNA, 20 bp, human
gccgcccgagcggagccccc

SEQ ID NO: 160003 - DNA, 20 bp, human
gagaggattgacggagggtg

SEQ ID NO: 160004 - DNA, 20 bp, human
gagcgctgcgtcctgcgggt

SEQ ID NO: 160005 - DNA, 20 bp, human
ggtgtggatgggaggaatcg

SEQ ID NO: 160006 - DNA, 20 bp, human
gggcgccgcctcactcgggt

SEQ ID NO: 160007 - DNA, 20 bp, human
gggatcctacccgagtgagg

SEQ ID NO: 160008 - DNA, 20 bp, human
gttcggatcctacccgagtg

SEQ ID NO: 160009 - DNA, 20 bp, human
gcgcgagcagagccactcca

SEQ ID NO: 160010 - DNA, 20 bp, human
gagcccagcagagcagcacc

SEQ ID NO: 160011 - DNA, 20 bp, human
gagggagagtcagacctggg

SEQ ID NO: 160012 - DNA, 20 bp, human
gcctcgcgggcggggatggt

SEQ ID NO: 160013 - DNA, 20 bp, human
ggcgggcgcgcagcaagacg

SEQ ID NO: 160014 - DNA, 20 bp, human
ggagcggggacggagcggga

SEQ ID NO: 160015 - DNA, 20 bp, human
gtccatggcgccgcctcact

SEQ ID NO: 160016 - DNA, 20 bp, human
gtgtggaggacgatgggcag

SEQ ID NO: 160017 - DNA, 20 bp, human
gccttggtgtggaggacgat

SEQ ID NO: 160018 - DNA, 20 bp, human
gctttgctgcctattctcag

SEQ ID NO: 160019 - DNA, 20 bp, human
gtgcctatcaactagatgag

SEQ ID NO: 160020 - DNA, 20 bp, human
ggctgcctattctcagggga

SEQ ID NO: 160021 - DNA, 20 bp, human
gtcctgactttaggtatgaa

SEQ ID NO: 160022 - DNA, 20 bp, human
ggaaaaccacgaagagaaat

SEQ ID NO: 160023 - DNA, 20 bp, human
ggtgaacctggagaacagac

SEQ ID NO: 160024 - DNA, 20 bp, human
gactagccatgcatgctccc

SEQ ID NO: 160025 - DNA, 20 bp, human
gttcctctcatctagttgat

SEQ ID NO: 160026 - DNA, 20 bp, human
gcgccatggagcccagtcca

SEQ ID NO: 160027 - DNA, 20 bp, human
gccaggagctgggtaacaga

SEQ ID NO: 160028 - DNA, 20 bp, human
gggctaggtgggcacacagt

SEQ ID NO: 160029 - DNA, 20 bp, human
gtaggagcgataggcccaca

SEQ ID NO: 160030 - DNA, 20 bp, human
ggcccagtccagggctaggt

SEQ ID NO: 160031 - DNA, 20 bp, human
ggagcacagataactccagg

SEQ ID NO: 160032 - DNA, 20 bp, human
gggcgatagcctcacttcca

SEQ ID NO: 160033 - DNA, 20 bp, human
gacgctgggctcctacaact

SEQ ID NO: 160034 - DNA, 20 bp, human
gccttactggggacgaggat

SEQ ID NO: 160035 - DNA, 20 bp, human
gagcctcacttccagggcag

SEQ ID NO: 160036 - DNA, 20 bp, human
ggcgggagggcgaagaccac

SEQ ID NO: 160037 - DNA, 20 bp, human
gcaggcgatcgcgctgatgg

SEQ ID NO: 160038 - DNA, 20 bp, human
ggcgcgatcgcctggcggta

SEQ ID NO: 160039 - DNA, 20 bp, human
gccgcggcaggtgcaaggga

SEQ ID NO: 160040 - DNA, 20 bp, human
gcgccaggcgatcgcgctga

SEQ ID NO: 160041 - DNA, 20 bp, human
gccaccggcagcagcgcgag

SEQ ID NO: 160042 - DNA, 20 bp, human
gatcgcctggcggtacgggc

SEQ ID NO: 160043 - DNA, 20 bp, human
gcaagaaggtgtggagcgcg

SEQ ID NO: 160044 - DNA, 20 bp, human
gcatggaagtgagatccaga

SEQ ID NO: 160045 - DNA, 20 bp, human
ggcgttaggagcgttcacag

SEQ ID NO: 160046 - DNA, 20 bp, human
gtcaaggcaaattataagta

SEQ ID NO: 160047 - DNA, 20 bp, human
ggggaaaggatgataaacgg

SEQ ID NO: 160048 - DNA, 20 bp, human
gtactaatcaagccgagagg

SEQ ID NO: 160049 - DNA, 20 bp, human
gtgcatgcggacttcaggtg

SEQ ID NO: 160050 - DNA, 20 bp, human
gtgataaacgggggcatagt

SEQ ID NO: 160051 - DNA, 20 bp, human
gcccaaaataggtcatccga

SEQ ID NO: 160052 - DNA, 20 bp, human
gagttaaggtaccacgtcct

SEQ ID NO: 160053 - DNA, 20 bp, human
gtattactaatcaagccgag

SEQ ID NO: 160054 - DNA, 20 bp, human
ggtggcttaaaggattaagg

SEQ ID NO: 160055 - DNA, 20 bp, human
gctggcctcctgctttaggt

SEQ ID NO: 160056 - DNA, 20 bp, human
gcgggcatcagaatgacgag

SEQ ID NO: 160057 - DNA, 20 bp, human
ggtgacgaacaagatcacga

SEQ ID NO: 160058 - DNA, 20 bp, human
ggccctgtaaagaatctgag

SEQ ID NO: 160059 - DNA, 20 bp, human
gagattcgattcggagccag

SEQ ID NO: 160060 - DNA, 20 bp, human
gtggcgggcgagacgagtga

SEQ ID NO: 160061 - DNA, 20 bp, human
gccgaggccatcgcgcggga

SEQ ID NO: 160062 - DNA, 20 bp, human
ggggatcggtgcccgttagt

SEQ ID NO: 160063 - DNA, 20 bp, human
gcactgtgggagattcgatt

SEQ ID NO: 160064 - DNA, 20 bp, human
gggagctccaggtgccggat

SEQ ID NO: 160065 - DNA, 20 bp, human
gccacacagatcccagcctt

SEQ ID NO: 160066 - DNA, 20 bp, human
ggaagcactctcccttgtcg

SEQ ID NO: 160067 - DNA, 20 bp, human
gttgcccacctccacgacaa

SEQ ID NO: 160068 - DNA, 20 bp, human
ggcactctcccttgtcgtgg

SEQ ID NO: 160069 - DNA, 20 bp, human
gtctcccttgtcgtggaggt

SEQ ID NO: 160070 - DNA, 20 bp, human
ggccaggaagccagctagag

SEQ ID NO: 160071 - DNA, 20 bp, human
gaccactctagctggcttcc

SEQ ID NO: 160072 - DNA, 20 bp, human
gtgggttaatcaacactatt

SEQ ID NO: 160073 - DNA, 20 bp, human
gcctgagctgatgtggaaga

SEQ ID NO: 160074 - DNA, 20 bp, human
ggcttctcaggagatggtgc

SEQ ID NO: 160075 - DNA, 20 bp, human
ggtacttacaccactctagc

SEQ ID NO: 160076 - DNA, 20 bp, human
gggaagccaagctggttata

SEQ ID NO: 160077 - DNA, 20 bp, human
gaatgatgcagggcaactca

SEQ ID NO: 160078 - DNA, 20 bp, human
gcaaagagatgagatggtac

SEQ ID NO: 160079 - DNA, 20 bp, human
gctgttggcacaatgaatgg

SEQ ID NO: 160080 - DNA, 20 bp, human
gacggtcattcaggtcctgt

SEQ ID NO: 160081 - DNA, 20 bp, human
ggaataccatgggttaatct

SEQ ID NO: 160082 - DNA, 20 bp, human
gggctggagccagcctaagg

SEQ ID NO: 160083 - DNA, 20 bp, human
gtgctccatagtgcctcctt

SEQ ID NO: 160084 - DNA, 20 bp, human
gctatacctagattaaccca

SEQ ID NO: 160085 - DNA, 20 bp, human
gaaacacccaggatgaaaac

SEQ ID NO: 160086 - DNA, 20 bp, human
gccgccgagcgtacccatgg

SEQ ID NO: 160087 - DNA, 20 bp, human
gacccagcgggtgacggcag

SEQ ID NO: 160088 - DNA, 20 bp, human
ggggtcacctcgccagccag

SEQ ID NO: 160089 - DNA, 20 bp, human
gagaggcaagacaagtgcaa

SEQ ID NO: 160090 - DNA, 20 bp, human
gggagcgggacgggacccag

SEQ ID NO: 160091 - DNA, 20 bp, human
gggcaggtcgcaggagccct

SEQ ID NO: 160092 - DNA, 20 bp, human
gcacccgccgagcgtaccca

SEQ ID NO: 160093 - DNA, 20 bp, human
gccgggcctggacgtcaggt

SEQ ID NO: 160094 - DNA, 20 bp, human
gccgagcgtacccatggcgg

SEQ ID NO: 160095 - DNA, 20 bp, human
gagaaacaccgtctaactgg

SEQ ID NO: 160096 - DNA, 20 bp, human
gcgaggtggtacctcttcaa

SEQ ID NO: 160097 - DNA, 20 bp, human
gtctggaaaggattcatggc

SEQ ID NO: 160098 - DNA, 20 bp, human
ggggaggccattcctctcag

SEQ ID NO: 160099 - DNA, 20 bp, human
gtcaagcatttggctttagt

SEQ ID NO: 160100 - DNA, 20 bp, human
ggtacctcttcaatggagac

SEQ ID NO: 160101 - DNA, 20 bp, human
gtactctgaaaagaaggact

SEQ ID NO: 160102 - DNA, 20 bp, human
gtttttctggaaaggattca

SEQ ID NO: 160103 - DNA, 20 bp, human
ggttcttcagttgggatcca

SEQ ID NO: 160104 - DNA, 20 bp, human
gcctccaaagaagccatctc

SEQ ID NO: 160105 - DNA, 20 bp, human
gatcctgcctctgagaggaa

SEQ ID NO: 160106 - DNA, 20 bp, human
ggtagagtccgggtagtgag

SEQ ID NO: 160107 - DNA, 20 bp, human
gcagtggggctagggcagga

SEQ ID NO: 160108 - DNA, 20 bp, human
ggggcaggccaggagtcata

SEQ ID NO: 160109 - DNA, 20 bp, human
gaggggagtgtaggcagtgg

SEQ ID NO: 160110 - DNA, 20 bp, human
gatgcagagacagacccagt

SEQ ID NO: 160111 - DNA, 20 bp, human
ggagtccgggtagtgagcgg

SEQ ID NO: 160112 - DNA, 20 bp, human
gtcagcctctgtccctctct

SEQ ID NO: 160113 - DNA, 20 bp, human
gcgccacgggtagaaagaag

SEQ ID NO: 160114 - DNA, 20 bp, human
gttctcaagaagccgagaga

SEQ ID NO: 160115 - DNA, 20 bp, human
gcaggaaggggcgacaaacg

SEQ ID NO: 160116 - DNA, 20 bp, human
gggcagtctcgcgagaaggg

SEQ ID NO: 160117 - DNA, 20 bp, human
gcggccagccagcctccgaa

SEQ ID NO: 160118 - DNA, 20 bp, human
ggctggcggcgtcgcatgga

SEQ ID NO: 160119 - DNA, 20 bp, human
gtggcgggcgcggccagcag

SEQ ID NO: 160120 - DNA, 20 bp, human
gcccggcagtctcgcgagaa

SEQ ID NO: 160121 - DNA, 20 bp, human
gtggagcgcgccgctttcta

SEQ ID NO: 160122 - DNA, 20 bp, human
gagtctcgcgagaagggcgg

SEQ ID NO: 160123 - DNA, 20 bp, human
gtcatgggcctcacctacct

SEQ ID NO: 160124 - DNA, 20 bp, human
ggacaggtgacccggcggcg

SEQ ID NO: 160125 - DNA, 20 bp, human
ggacgtgatgccgtagaaag

SEQ ID NO: 160126 - DNA, 20 bp, human
ggggtagtcatgtctgttac

SEQ ID NO: 160127 - DNA, 20 bp, human
gcataagttttgttcaagga

SEQ ID NO: 160128 - DNA, 20 bp, human
ggagccatctgacaaacaca

SEQ ID NO: 160129 - DNA, 20 bp, human
gtctggtggagctgtgtgag

SEQ ID NO: 160130 - DNA, 20 bp, human
gtgtactttctcatcagtta

SEQ ID NO: 160131 - DNA, 20 bp, human
gcaagcttgatagtgcaaaa

SEQ ID NO: 160132 - DNA, 20 bp, human
gagaaaactgtaagacatat

SEQ ID NO: 160133 - DNA, 20 bp, human
gtgaacaaaacttatgttag

SEQ ID NO: 160134 - DNA, 20 bp, human
ggcttgtttctacattttct

SEQ ID NO: 160135 - DNA, 20 bp, human
gggctcactgatgtctattt

SEQ ID NO: 160136 - DNA, 20 bp, human
ggctgccttataacccgccg

SEQ ID NO: 160137 - DNA, 20 bp, human
ggtactggaacaagcaaacg

SEQ ID NO: 160138 - DNA, 20 bp, human
gcgtgactggctagctgcgt

SEQ ID NO: 160139 - DNA, 20 bp, human
gtggctagctgcgtgggtac

SEQ ID NO: 160140 - DNA, 20 bp, human
gtggtgagctgcgacgtgac

SEQ ID NO: 160141 - DNA, 20 bp, human
gctggcccggccagacaaag

SEQ ID NO: 160142 - DNA, 20 bp, human
ggaccccaccagggcagcga

SEQ ID NO: 160143 - DNA, 20 bp, human
gcccgcggctcggctaagag

SEQ ID NO: 160144 - DNA, 20 bp, human
gttccacggggcccagggtc

SEQ ID NO: 160145 - DNA, 20 bp, human
gggacttccccaccgtcacc

SEQ ID NO: 160146 - DNA, 20 bp, human
gtgtctgggtaaatgactaa

SEQ ID NO: 160147 - DNA, 20 bp, human
ggtaagagagtagatagcat

SEQ ID NO: 160148 - DNA, 20 bp, human
gctctgaacttcattctgga

SEQ ID NO: 160149 - DNA, 20 bp, human
gataacatgacaacatagaa

SEQ ID NO: 160150 - DNA, 20 bp, human
gtgtttggcactaaagatta

SEQ ID NO: 160151 - DNA, 20 bp, human
ggtttctctgaacttcattc

SEQ ID NO: 160152 - DNA, 20 bp, human
ggagagtagatagcatggga

SEQ ID NO: 160153 - DNA, 20 bp, human
gagagattagtcagaattca

SEQ ID NO: 160154 - DNA, 20 bp, human
gactccaactggatatgggt

SEQ ID NO: 160155 - DNA, 20 bp, human
ggactaagggttaatgacta

SEQ ID NO: 160156 - DNA, 20 bp, human
ggctaacgaggccgaggcga

SEQ ID NO: 160157 - DNA, 20 bp, human
gtggcagtgggctcagtcgg

SEQ ID NO: 160158 - DNA, 20 bp, human
gtggcgcgcgcgaacacctc

SEQ ID NO: 160159 - DNA, 20 bp, human
ggccatgtggtgcaacgggt

SEQ ID NO: 160160 - DNA, 20 bp, human
gcccgaggcggctgtcgaga

SEQ ID NO: 160161 - DNA, 20 bp, human
gagccccccgaaccccccga

SEQ ID NO: 160162 - DNA, 20 bp, human
ggcttcagtgtcgatccccg

SEQ ID NO: 160163 - DNA, 20 bp, human
gaggcggccgcgaggacagc

SEQ ID NO: 160164 - DNA, 20 bp, human
gggaccctcggacagccccg

SEQ ID NO: 160165 - DNA, 20 bp, human
gcgccctcggggggttcggg

SEQ ID NO: 160166 - DNA, 20 bp, human
gagcggaagcacaggcgtgg

SEQ ID NO: 160167 - DNA, 20 bp, human
ggcagcgatggagcccaact

SEQ ID NO: 160168 - DNA, 20 bp, human
ggatggagcccaacttggac

SEQ ID NO: 160169 - DNA, 20 bp, human
gagccccagcccccatccgg

SEQ ID NO: 160170 - DNA, 20 bp, human
ggcctagggctggaactccc

SEQ ID NO: 160171 - DNA, 20 bp, human
gaccccgggcgagcagccag

SEQ ID NO: 160172 - DNA, 20 bp, human
gggccagacgccagtcccac

SEQ ID NO: 160173 - DNA, 20 bp, human
gcgagagagcccgtccaagt

SEQ ID NO: 160174 - DNA, 20 bp, human
gcccgccggacccccggatg

SEQ ID NO: 160175 - DNA, 20 bp, human
gtaaacagagatcaccacag

SEQ ID NO: 160176 - DNA, 20 bp, human
gcggcgcgggatgggcgcta

SEQ ID NO: 160177 - DNA, 20 bp, human
gcgccggcgagactgagccc

SEQ ID NO: 160178 - DNA, 20 bp, human
gcaggtggctggagaacgag

SEQ ID NO: 160179 - DNA, 20 bp, human
gctagggcagcggagaatgg

SEQ ID NO: 160180 - DNA, 20 bp, human
gcctctgcacaaccgtgtca

SEQ ID NO: 160181 - DNA, 20 bp, human
ggcggtggctcaggtgacac

SEQ ID NO: 160182 - DNA, 20 bp, human
ggcacaaccgtgtcagggag

SEQ ID NO: 160183 - DNA, 20 bp, human
gtcaaatgcagacttctcgg

SEQ ID NO: 160184 - DNA, 20 bp, human
ggtcccgggctcagtctcgc

SEQ ID NO: 160185 - DNA, 20 bp, human
gggagcctgggaccctaact

SEQ ID NO: 160186 - DNA, 20 bp, human
gcaccgaaccgggaccgatc

SEQ ID NO: 160187 - DNA, 20 bp, human
gtccacgaagaagaccccaa

SEQ ID NO: 160188 - DNA, 20 bp, human
gccgggccagagtctcccgg

SEQ ID NO: 160189 - DNA, 20 bp, human
gggacagagccccccgacgg

SEQ ID NO: 160190 - DNA, 20 bp, human
gtcccagccgaacaccgaac

SEQ ID NO: 160191 - DNA, 20 bp, human
ggccggggccggatcggtcc

SEQ ID NO: 160192 - DNA, 20 bp, human
gatcgcctccataggaatcg

SEQ ID NO: 160193 - DNA, 20 bp, human
gactggcgcgctccaggggt

SEQ ID NO: 160194 - DNA, 20 bp, human
gtgcaccgcgattcctatgg

SEQ ID NO: 160195 - DNA, 20 bp, human
gaggtgcggcgtccagaacc

SEQ ID NO: 160196 - DNA, 20 bp, human
gaggtgcccaaacctaacct

SEQ ID NO: 160197 - DNA, 20 bp, human
gctcgggcggtgagtatccg

SEQ ID NO: 160198 - DNA, 20 bp, human
gcccagggacccccgggaag

SEQ ID NO: 160199 - DNA, 20 bp, human
ggggaatggagcgacgccgg

SEQ ID NO: 160200 - DNA, 20 bp, human
gtccgattggaaggaagccc

SEQ ID NO: 160201 - DNA, 20 bp, human
ggctcggtgcgctctgtgag

SEQ ID NO: 160202 - DNA, 20 bp, human
gaaccagaattagccggtat

SEQ ID NO: 160203 - DNA, 20 bp, human
gctgccaaaccagaattagc

SEQ ID NO: 160204 - DNA, 20 bp, human
ggagtgaggccgcagcccag

SEQ ID NO: 160205 - DNA, 20 bp, human
gccgggcgtggagccgagtg

SEQ ID NO: 160206 - DNA, 20 bp, human
gcgcctacggtagagacccg

SEQ ID NO: 160207 - DNA, 20 bp, human
gtgccgcgggtctctaccgt

SEQ ID NO: 160208 - DNA, 20 bp, human
gccggctctgggctacccac

SEQ ID NO: 160209 - DNA, 20 bp, human
gatggagccgttgcaccagg

SEQ ID NO: 160210 - DNA, 20 bp, human
gcagcctgggcctcggacag

SEQ ID NO: 160211 - DNA, 20 bp, human
ggaacccgagcccacgccta

SEQ ID NO: 160212 - DNA, 20 bp, human
ggtcgtcctcctcaagtcca

SEQ ID NO: 160213 - DNA, 20 bp, human
ggcttccagcctcccgaagg

SEQ ID NO: 160214 - DNA, 20 bp, human
gagagcctgcggggaaaaga

SEQ ID NO: 160215 - DNA, 20 bp, human
ggagaagagcgaggctgtag

SEQ ID NO: 160216 - DNA, 20 bp, human
gcggggaggccacccataca

SEQ ID NO: 160217 - DNA, 20 bp, human
ggaggccacccatacaggga

SEQ ID NO: 160218 - DNA, 20 bp, human
gggagcggaccggcagaggc

SEQ ID NO: 160219 - DNA, 20 bp, human
gcggcggccaagcccggtcc

SEQ ID NO: 160220 - DNA, 20 bp, human
gcagggcgcggagccacctg

SEQ ID NO: 160221 - DNA, 20 bp, human
ggcgcgggctatatttggtg

SEQ ID NO: 160222 - DNA, 20 bp, human
gtaaatagctcggtccgcgg

SEQ ID NO: 160223 - DNA, 20 bp, human
gcccgagcgggccccaccga

SEQ ID NO: 160224 - DNA, 20 bp, human
gcccccggcgcggagcggac

SEQ ID NO: 160225 - DNA, 20 bp, human
gggcccgcgcgcgagcatcg

SEQ ID NO: 160226 - DNA, 20 bp, human
gaaatcgtctgagccctcct

SEQ ID NO: 160227 - DNA, 20 bp, human
gagcattgtaagagccaagg

SEQ ID NO: 160228 - DNA, 20 bp, human
gtacggaaccgattgggaga

SEQ ID NO: 160229 - DNA, 20 bp, human
gggttccaagaggttaacct

SEQ ID NO: 160230 - DNA, 20 bp, human
gagtcagctggcagggtatg

SEQ ID NO: 160231 - DNA, 20 bp, human
ggccatctggtgagcaggct

SEQ ID NO: 160232 - DNA, 20 bp, human
ggtaaagtccactagcagga

SEQ ID NO: 160233 - DNA, 20 bp, human
gtccacaagagaatattctt

SEQ ID NO: 160234 - DNA, 20 bp, human
ggtggactttacttcctgag

SEQ ID NO: 160235 - DNA, 20 bp, human
gtatgctaccttctcccaat

SEQ ID NO: 160236 - DNA, 20 bp, human
ggatgggcagggcgagagta

SEQ ID NO: 160237 - DNA, 20 bp, human
ggagtggaaaccagattccg

SEQ ID NO: 160238 - DNA, 20 bp, human
gggcagcccagaaccaggac

SEQ ID NO: 160239 - DNA, 20 bp, human
gtcgcacgggcctggcggag

SEQ ID NO: 160240 - DNA, 20 bp, human
ggcctgggcgggctcagtgg

SEQ ID NO: 160241 - DNA, 20 bp, human
gggggcagcactgcggggat

SEQ ID NO: 160242 - DNA, 20 bp, human
gggagggagggacagcggag

SEQ ID NO: 160243 - DNA, 20 bp, human
gagcactgcggggatgggca

SEQ ID NO: 160244 - DNA, 20 bp, human
gcccggggcagcccagaacc

SEQ ID NO: 160245 - DNA, 20 bp, human
ggccgcaggacgccgcgctc

SEQ ID NO: 160246 - DNA, 20 bp, human
gggcctttttttgtgatggg

SEQ ID NO: 160247 - DNA, 20 bp, human
gggccaagcctccgccttat

SEQ ID NO: 160248 - DNA, 20 bp, human
gcgcaggagcgaaatgtcag

SEQ ID NO: 160249 - DNA, 20 bp, human
gcgagcggcttataaggagg

SEQ ID NO: 160250 - DNA, 20 bp, human
ggcgccagcctggggtagga

SEQ ID NO: 160251 - DNA, 20 bp, human
ggggacgtcggaagagtcgg

SEQ ID NO: 160252 - DNA, 20 bp, human
gggtcccggaagatacctaa

SEQ ID NO: 160253 - DNA, 20 bp, human
ggaagagaataaacccccaa

SEQ ID NO: 160254 - DNA, 20 bp, human
gagcgctcgcagcacatggt

SEQ ID NO: 160255 - DNA, 20 bp, human
gccgggacccaactgtacca

SEQ ID NO: 160256 - DNA, 20 bp, human
ggcgggcgaggacacgtcag

SEQ ID NO: 160257 - DNA, 20 bp, human
ggaggtgccggctaagagga

SEQ ID NO: 160258 - DNA, 20 bp, human
gtcgctggccaactctgcgt

SEQ ID NO: 160259 - DNA, 20 bp, human
ggacagctgcccgggaactg

SEQ ID NO: 160260 - DNA, 20 bp, human
gctggctcacgggactccga

SEQ ID NO: 160261 - DNA, 20 bp, human
gcgctcctccgcacccacaa

SEQ ID NO: 160262 - DNA, 20 bp, human
gcccgtgagccagggagact

SEQ ID NO: 160263 - DNA, 20 bp, human
gaaggaggcggtggcgggaa

SEQ ID NO: 160264 - DNA, 20 bp, human
gcgagagcgtgagcacctcc

SEQ ID NO: 160265 - DNA, 20 bp, human
gccgagggctgcttccagtg

SEQ ID NO: 160266 - DNA, 20 bp, human
ggtgaagcttacccggatgg

SEQ ID NO: 160267 - DNA, 20 bp, human
gcacaacctggtcctagtgg

SEQ ID NO: 160268 - DNA, 20 bp, human
gctgctgtgagggccccggg

SEQ ID NO: 160269 - DNA, 20 bp, human
gtgggccagcagcctagaga

SEQ ID NO: 160270 - DNA, 20 bp, human
ggtgccaggagggacactcc

SEQ ID NO: 160271 - DNA, 20 bp, human
gtaagcttcaccgggagctg

SEQ ID NO: 160272 - DNA, 20 bp, human
gcacagggctacccacgtga

SEQ ID NO: 160273 - DNA, 20 bp, human
ggagacaggagggtgatccc

SEQ ID NO: 160274 - DNA, 20 bp, human
ggtgtctggcagcccccatc

SEQ ID NO: 160275 - DNA, 20 bp, human
gaggcgaccggcccaagtca

SEQ ID NO: 160276 - DNA, 20 bp, human
gctaggacgctgggcagcag

SEQ ID NO: 160277 - DNA, 20 bp, human
gcggggagggttccaaaggt

SEQ ID NO: 160278 - DNA, 20 bp, human
gaggccgggactcaggtaaa

SEQ ID NO: 160279 - DNA, 20 bp, human
gcgccgctgcgggtctgtgg

SEQ ID NO: 160280 - DNA, 20 bp, human
gcttgcggggagggttccaa

SEQ ID NO: 160281 - DNA, 20 bp, human
gtgccccgcaaagagagaca

SEQ ID NO: 160282 - DNA, 20 bp, human
ggacagcagggaaaaccccg

SEQ ID NO: 160283 - DNA, 20 bp, human
gcgggactcaggtaaagggc

SEQ ID NO: 160284 - DNA, 20 bp, human
gcaccccggccagtctgaac

SEQ ID NO: 160285 - DNA, 20 bp, human
gcgactcggagcagtaggag

SEQ ID NO: 160286 - DNA, 20 bp, human
gcgaatcaggttagtctacg

SEQ ID NO: 160287 - DNA, 20 bp, human
gcaatactgcatcctcaaaa

SEQ ID NO: 160288 - DNA, 20 bp, human
gtgaaaagcctcagaagata

SEQ ID NO: 160289 - DNA, 20 bp, human
gtccccagagggccgtaagg

SEQ ID NO: 160290 - DNA, 20 bp, human
ggaatatgccctatcttctg

SEQ ID NO: 160291 - DNA, 20 bp, human
ggcccccttacggccctctg

SEQ ID NO: 160292 - DNA, 20 bp, human
gcaatcagtgtgaggttcac

SEQ ID NO: 160293 - DNA, 20 bp, human
gtgtatgtgtggagaacata

SEQ ID NO: 160294 - DNA, 20 bp, human
gcacttttttgtcccgaatc

SEQ ID NO: 160295 - DNA, 20 bp, human
ggattccccagagggccgta

SEQ ID NO: 160296 - DNA, 20 bp, human
gggataaatagtgagccacg

SEQ ID NO: 160297 - DNA, 20 bp, human
gaggctaacttggaaaagga

SEQ ID NO: 160298 - DNA, 20 bp, human
gcagtgtccattggtaccag

SEQ ID NO: 160299 - DNA, 20 bp, human
gagtcagacggcaacaggtt

SEQ ID NO: 160300 - DNA, 20 bp, human
gttgccgtctgactgccacg

SEQ ID NO: 160301 - DNA, 20 bp, human
ggcaaggcttgagaagccac

SEQ ID NO: 160302 - DNA, 20 bp, human
ggagaagccactggtaccaa

SEQ ID NO: 160303 - DNA, 20 bp, human
gcaatgaagaccctagggca

SEQ ID NO: 160304 - DNA, 20 bp, human
gtgattagtcagactgggat

SEQ ID NO: 160305 - DNA, 20 bp, human
gtgctgtgattagtcagact

SEQ ID NO: 160306 - DNA, 20 bp, human
gtaagcttggaggaaacgct

SEQ ID NO: 160307 - DNA, 20 bp, human
gtccaagggagtaagcttgg

SEQ ID NO: 160308 - DNA, 20 bp, human
gctctgctccaaaaagtcca

SEQ ID NO: 160309 - DNA, 20 bp, human
gaggattctttgccacccta

SEQ ID NO: 160310 - DNA, 20 bp, human
gaagtccaagggagtaagct

SEQ ID NO: 160311 - DNA, 20 bp, human
gagcaacttaagccctaggg

SEQ ID NO: 160312 - DNA, 20 bp, human
gccttccacagacattaagt

SEQ ID NO: 160313 - DNA, 20 bp, human
gcttaccgacttaatgtctg

SEQ ID NO: 160314 - DNA, 20 bp, human
gattagcaacttaagcccta

SEQ ID NO: 160315 - DNA, 20 bp, human
ggtcagtaatatctccatct

SEQ ID NO: 160316 - DNA, 20 bp, human
gaagctaactaacctgaggg

SEQ ID NO: 160317 - DNA, 20 bp, human
gtgaaagctaactaacctga

SEQ ID NO: 160318 - DNA, 20 bp, human
gtaagagccctggaactaca

SEQ ID NO: 160319 - DNA, 20 bp, human
gcaatactgaattctcagag

SEQ ID NO: 160320 - DNA, 20 bp, human
gtaattctggtaagtgagaa

SEQ ID NO: 160321 - DNA, 20 bp, human
ggatgttgcattaagagccc

SEQ ID NO: 160322 - DNA, 20 bp, human
gtctcaaaagcagaatatta

SEQ ID NO: 160323 - DNA, 20 bp, human
gttaattccctgtagttcca

SEQ ID NO: 160324 - DNA, 20 bp, human
gagcttaatttgctgtttag

SEQ ID NO: 160325 - DNA, 20 bp, human
gcagaattatctcaggacac

SEQ ID NO: 160326 - DNA, 20 bp, human
gtcgtccaggggcttcgagt

SEQ ID NO: 160327 - DNA, 20 bp, human
gtccagccagctcggcccgg

SEQ ID NO: 160328 - DNA, 20 bp, human
gagcccctcgggaaccccgg

SEQ ID NO: 160329 - DNA, 20 bp, human
gactgagcggcactctgaac

SEQ ID NO: 160330 - DNA, 20 bp, human
gagcaggtgtactcgccacc

SEQ ID NO: 160331 - DNA, 20 bp, human
gcgcgaggggacattaagag

SEQ ID NO: 160332 - DNA, 20 bp, human
gtccgggccaggtctcgaac

SEQ ID NO: 160333 - DNA, 20 bp, human
gcccagtggaagaacgaact

SEQ ID NO: 160334 - DNA, 20 bp, human
ggagtgggcagcggtaccgg

SEQ ID NO: 160335 - DNA, 20 bp, human
gcaggtgcagccccaccggg

SEQ ID NO: 160336 - DNA, 20 bp, human
gcttctcagcagaatggtag

SEQ ID NO: 160337 - DNA, 20 bp, human
ggcgaacacttgcttacctg

SEQ ID NO: 160338 - DNA, 20 bp, human
gatcactcggccagatctac

SEQ ID NO: 160339 - DNA, 20 bp, human
gtgcactaaatgaacctgtc

SEQ ID NO: 160340 - DNA, 20 bp, human
ggcacccccgctccaagcaa

SEQ ID NO: 160341 - DNA, 20 bp, human
gtgttgcccattgcttggag

SEQ ID NO: 160342 - DNA, 20 bp, human
gtaatctcttaaagtagttg

SEQ ID NO: 160343 - DNA, 20 bp, human
gcttttccttctcagcagaa

SEQ ID NO: 160344 - DNA, 20 bp, human
gccgtttccgtaaaccctgg

SEQ ID NO: 160345 - DNA, 20 bp, human
ggaaacctgcttattaatgc

SEQ ID NO: 160346 - DNA, 20 bp, human
gagagagagtggagccgggt

SEQ ID NO: 160347 - DNA, 20 bp, human
ggctccgctcggggggaagg

SEQ ID NO: 160348 - DNA, 20 bp, human
gagagacccagaagtggtgg

SEQ ID NO: 160349 - DNA, 20 bp, human
gggacccccgccaggctcac

SEQ ID NO: 160350 - DNA, 20 bp, human
gtcctggcggaactccatgg

SEQ ID NO: 160351 - DNA, 20 bp, human
gggccgcgtccgggttcccg

SEQ ID NO: 160352 - DNA, 20 bp, human
gacagcgccgtcggagccca

SEQ ID NO: 160353 - DNA, 20 bp, human
gaatggacaaggctcgacca

SEQ ID NO: 160354 - DNA, 20 bp, human
ggaccccgggaacccggacg

SEQ ID NO: 160355 - DNA, 20 bp, human
ggacagagacccagaagtgg

SEQ ID NO: 160356 - DNA, 20 bp, human
gtgcctgagacagctgccac

SEQ ID NO: 160357 - DNA, 20 bp, human
ggctgcgctcagtctgagag

SEQ ID NO: 160358 - DNA, 20 bp, human
gaaggagtgaagaacgccgt

SEQ ID NO: 160359 - DNA, 20 bp, human
ggagcgtgcagcttttgcaa

SEQ ID NO: 160360 - DNA, 20 bp, human
gacttccaggtgttcaccaa

SEQ ID NO: 160361 - DNA, 20 bp, human
gtaccaagtctctcacacat

SEQ ID NO: 160362 - DNA, 20 bp, human
gcctccaaaaaagagtccaa

SEQ ID NO: 160363 - DNA, 20 bp, human
gaatacgaagctactcagaa

SEQ ID NO: 160364 - DNA, 20 bp, human
gattcccaaagaatctccca

SEQ ID NO: 160365 - DNA, 20 bp, human
gggaagtcagttctcgtgga

SEQ ID NO: 160366 - DNA, 20 bp, human
gactgacacgtggacttggg

SEQ ID NO: 160367 - DNA, 20 bp, human
ggcgcgctgggactgacacg

SEQ ID NO: 160368 - DNA, 20 bp, human
gtggggtgctcagacggcgt

SEQ ID NO: 160369 - DNA, 20 bp, human
gtgcccgggtgggtcagcct

SEQ ID NO: 160370 - DNA, 20 bp, human
ggtccggtcctggaatctca

SEQ ID NO: 160371 - DNA, 20 bp, human
gtgggcacagctgtgtcccg

SEQ ID NO: 160372 - DNA, 20 bp, human
gcgtgggacgatgctaggtg

SEQ ID NO: 160373 - DNA, 20 bp, human
ggtcccagcgcgcttccgtc

SEQ ID NO: 160374 - DNA, 20 bp, human
gccgccacacctggaccact

SEQ ID NO: 160375 - DNA, 20 bp, human
ggggactgacacgtggactt

SEQ ID NO: 160376 - DNA, 20 bp, human
ggagtgcctcacaccaacat

SEQ ID NO: 160377 - DNA, 20 bp, human
ggaggcactcagtgaggtat

SEQ ID NO: 160378 - DNA, 20 bp, human
gcacaccaacatgggctcca

SEQ ID NO: 160379 - DNA, 20 bp, human
ggtactctgttctaagccca

SEQ ID NO: 160380 - DNA, 20 bp, human
gagagggttcttccagccct

SEQ ID NO: 160381 - DNA, 20 bp, human
gtctgttctaagcccagggc

SEQ ID NO: 160382 - DNA, 20 bp, human
gggacactgttctctgaacg

SEQ ID NO: 160383 - DNA, 20 bp, human
ggttaatatgtagtagtgag

SEQ ID NO: 160384 - DNA, 20 bp, human
gagctgttagcaagacagca

SEQ ID NO: 160385 - DNA, 20 bp, human
gctacatattaacgtgacca

SEQ ID NO: 160386 - DNA, 20 bp, human
gggactgacggagcccactg

SEQ ID NO: 160387 - DNA, 20 bp, human
ggcgcgggcacggaggaccc

SEQ ID NO: 160388 - DNA, 20 bp, human
ggccaacgcccgcaccgcag

SEQ ID NO: 160389 - DNA, 20 bp, human
gcgtcccccaggccgcggaa

SEQ ID NO: 160390 - DNA, 20 bp, human
gccggagccgcccggactga

SEQ ID NO: 160391 - DNA, 20 bp, human
gtggggcggagactgcgacc

SEQ ID NO: 160392 - DNA, 20 bp, human
gggcatccggggacaccccc

SEQ ID NO: 160393 - DNA, 20 bp, human
ggtcagggagccgcgcgcac

SEQ ID NO: 160394 - DNA, 20 bp, human
gccgcgcgcaccggcatccg

SEQ ID NO: 160395 - DNA, 20 bp, human
ggccgcggaagggcgggtca

SEQ ID NO: 160396 - DNA, 20 bp, human
gtaacgggcgggcaagcggg

SEQ ID NO: 160397 - DNA, 20 bp, human
gcgtcctcggaagagcatcg

SEQ ID NO: 160398 - DNA, 20 bp, human
gcagcgtcccgggaaaggaa

SEQ ID NO: 160399 - DNA, 20 bp, human
ggcggcggccaccaagctgt

SEQ ID NO: 160400 - DNA, 20 bp, human
gcagcggcggggctaacggg

SEQ ID NO: 160401 - DNA, 20 bp, human
ggcggccaccaagctgtcgg

SEQ ID NO: 160402 - DNA, 20 bp, human
ggaaaggaaaggactccgtc

SEQ ID NO: 160403 - DNA, 20 bp, human
gaggcaagagccgacgcgag

SEQ ID NO: 160404 - DNA, 20 bp, human
gtccgaggacgcctccgcca

SEQ ID NO: 160405 - DNA, 20 bp, human
gtggaatccgcggaacctgc

SEQ ID NO: 160406 - DNA, 20 bp, human
ggaggtcgagtccaaggacg

SEQ ID NO: 160407 - DNA, 20 bp, human
ggggcctgatcgtggggttc

SEQ ID NO: 160408 - DNA, 20 bp, human
ggtccacgcaccggggatgg

SEQ ID NO: 160409 - DNA, 20 bp, human
gggcatccccgactccctgc

SEQ ID NO: 160410 - DNA, 20 bp, human
gggagcccggagaccagcgg

SEQ ID NO: 160411 - DNA, 20 bp, human
gggagccactggcactctgg

SEQ ID NO: 160412 - DNA, 20 bp, human
gtcgacctccaaggagccac

SEQ ID NO: 160413 - DNA, 20 bp, human
gagggaccacgcgcaccagg

SEQ ID NO: 160414 - DNA, 20 bp, human
gaaggctggggcctgatcgt

SEQ ID NO: 160415 - DNA, 20 bp, human
gctgcaggcagcgatccgcc

SEQ ID NO: 160416 - DNA, 20 bp, human
gcaggtaccggtggggaacg

SEQ ID NO: 160417 - DNA, 20 bp, human
gagccgccccgccgagtcgc

SEQ ID NO: 160418 - DNA, 20 bp, human
gcgagtcgcaggtaccggtg

SEQ ID NO: 160419 - DNA, 20 bp, human
gcggtacctgcgactcggcg

SEQ ID NO: 160420 - DNA, 20 bp, human
gtacctgcgactcggcgggg

SEQ ID NO: 160421 - DNA, 20 bp, human
ggactacagcgcccacaagg

SEQ ID NO: 160422 - DNA, 20 bp, human
gggctgcggcggaaagcgag

SEQ ID NO: 160423 - DNA, 20 bp, human
ggctggcagggttcacccac

SEQ ID NO: 160424 - DNA, 20 bp, human
gcactcgggaaaggctccag

SEQ ID NO: 160425 - DNA, 20 bp, human
gatgcatccagagggaaggt

SEQ ID NO: 160426 - DNA, 20 bp, human
gcgaccctagaggcgtctgt

SEQ ID NO: 160427 - DNA, 20 bp, human
ggtctgtagggtaaagctgg

SEQ ID NO: 160428 - DNA, 20 bp, human
ggatcaggcagcgaccctag

SEQ ID NO: 160429 - DNA, 20 bp, human
ggggcgaccggcctgcgggt

SEQ ID NO: 160430 - DNA, 20 bp, human
gtaccctacagacgcctcta

SEQ ID NO: 160431 - DNA, 20 bp, human
gaggctggcgaagaagccgt

SEQ ID NO: 160432 - DNA, 20 bp, human
gcggcgagtccagaacgtcc

SEQ ID NO: 160433 - DNA, 20 bp, human
ggcaggtacggggtcaggaa

SEQ ID NO: 160434 - DNA, 20 bp, human
gggccgggcacatccatccg

SEQ ID NO: 160435 - DNA, 20 bp, human
ggacaagaacctgaccgaga

SEQ ID NO: 160436 - DNA, 20 bp, human
ggatattcttacctacagaa

SEQ ID NO: 160437 - DNA, 20 bp, human
ggtgcggcaagtgagcgatt

SEQ ID NO: 160438 - DNA, 20 bp, human
gccgcgggtgcgtggtcgtg

SEQ ID NO: 160439 - DNA, 20 bp, human
gggatccaggcgctcttggt

SEQ ID NO: 160440 - DNA, 20 bp, human
ggaacgtgggatgtaaccat

SEQ ID NO: 160441 - DNA, 20 bp, human
gcgcacccgcggctgtcgga

SEQ ID NO: 160442 - DNA, 20 bp, human
gtccaaacccgggaagagag

SEQ ID NO: 160443 - DNA, 20 bp, human
gtaggtaagaatatctcggg

SEQ ID NO: 160444 - DNA, 20 bp, human
gaacagacactcccttctgt

SEQ ID NO: 160445 - DNA, 20 bp, human
gtggatccatccgacagccg

SEQ ID NO: 160446 - DNA, 20 bp, human
gcgcggtgcgcgatcccggg

SEQ ID NO: 160447 - DNA, 20 bp, human
ggccgcgtgcggctgagggt

SEQ ID NO: 160448 - DNA, 20 bp, human
gcgagcccagcgcacaatag

SEQ ID NO: 160449 - DNA, 20 bp, human
gtaaggccgagggggcatcg

SEQ ID NO: 160450 - DNA, 20 bp, human
ggcgagatgcgggtgcacag

SEQ ID NO: 160451 - DNA, 20 bp, human
gggtgcgcgatcccgggtgg

SEQ ID NO: 160452 - DNA, 20 bp, human
gcctgccacgcaaaactacc

SEQ ID NO: 160453 - DNA, 20 bp, human
gccacgcaaaactaccgggc

SEQ ID NO: 160454 - DNA, 20 bp, human
gggcatcgagggaccctgca

SEQ ID NO: 160455 - DNA, 20 bp, human
gcgctggcgcactccatgca

SEQ ID NO: 160456 - DNA, 20 bp, human
gtccgcgtcccggctctcca

SEQ ID NO: 160457 - DNA, 20 bp, human
ggctaaagggcttaccccgg

SEQ ID NO: 160458 - DNA, 20 bp, human
gccggaggcgggtggaaggg

SEQ ID NO: 160459 - DNA, 20 bp, human
gaccccggaggcgggtggaa

SEQ ID NO: 160460 - DNA, 20 bp, human
ggcctgcaaatccccagctc

SEQ ID NO: 160461 - DNA, 20 bp, human
ggaccatggcatctacggaa

SEQ ID NO: 160462 - DNA, 20 bp, human
gcggccagggagggattgca

SEQ ID NO: 160463 - DNA, 20 bp, human
gggcgctaaagggcttaccc

SEQ ID NO: 160464 - DNA, 20 bp, human
gccccagaccatggcatcta

SEQ ID NO: 160465 - DNA, 20 bp, human
gcgcgaagtgcggccgggag

SEQ ID NO: 160466 - DNA, 20 bp, human
gaattccccagcaggtacaa

SEQ ID NO: 160467 - DNA, 20 bp, human
ggcagcgcgcgtaagcaggc

SEQ ID NO: 160468 - DNA, 20 bp, human
gagaggagtagcctgaatca

SEQ ID NO: 160469 - DNA, 20 bp, human
gggatctgcttaaaagtgac

SEQ ID NO: 160470 - DNA, 20 bp, human
ggaagtgaagaccgggaaat

SEQ ID NO: 160471 - DNA, 20 bp, human
gcgacgtgagatgactaaca

SEQ ID NO: 160472 - DNA, 20 bp, human
gttagggagaagtgaagacc

SEQ ID NO: 160473 - DNA, 20 bp, human
gtgctccgttgtacctgctg

SEQ ID NO: 160474 - DNA, 20 bp, human
gatccgcagcgcgcgtaagc

SEQ ID NO: 160475 - DNA, 20 bp, human
gacgaggtgaattccccagc

SEQ ID NO: 160476 - DNA, 20 bp, human
gcatgagttatagcctccag

SEQ ID NO: 160477 - DNA, 20 bp, human
ggccaagagcttgcctggtg

SEQ ID NO: 160478 - DNA, 20 bp, human
gtccacaccaggcaagctct

SEQ ID NO: 160479 - DNA, 20 bp, human
gtggagaagagcccaagatg

SEQ ID NO: 160480 - DNA, 20 bp, human
gtcatctgataatattcccc

SEQ ID NO: 160481 - DNA, 20 bp, human
gtatcagatgaactagttgt

SEQ ID NO: 160482 - DNA, 20 bp, human
gcagtcaccgctgtcattgt

SEQ ID NO: 160483 - DNA, 20 bp, human
ggaaagccaaacctcctctt

SEQ ID NO: 160484 - DNA, 20 bp, human
gtagaaaacacaactagaat

SEQ ID NO: 160485 - DNA, 20 bp, human
gctagttgtaggtatcaaaa

SEQ ID NO: 160486 - DNA, 20 bp, human
gcgccgctccgagctagagg

SEQ ID NO: 160487 - DNA, 20 bp, human
gccataccgctagagaaagg

SEQ ID NO: 160488 - DNA, 20 bp, human
gggctggagatgatgcaaac

SEQ ID NO: 160489 - DNA, 20 bp, human
gttgcatcatctccagccgg

SEQ ID NO: 160490 - DNA, 20 bp, human
gtccgagctagaggtggcag

SEQ ID NO: 160491 - DNA, 20 bp, human
gcttgagacaaaggacggac

SEQ ID NO: 160492 - DNA, 20 bp, human
ggcgaacgcggacgcagacg

SEQ ID NO: 160493 - DNA, 20 bp, human
gaagcgccacccgggagaga

SEQ ID NO: 160494 - DNA, 20 bp, human
ggggagaacttagaacgcag

SEQ ID NO: 160495 - DNA, 20 bp, human
gtgggctctggcaaaagacg

SEQ ID NO: 160496 - DNA, 20 bp, human
gaggcggtggtctggtgtcc

SEQ ID NO: 160497 - DNA, 20 bp, human
gtctgcaggaggctaggttc

SEQ ID NO: 160498 - DNA, 20 bp, human
ggtctggtgtccgggagtag

SEQ ID NO: 160499 - DNA, 20 bp, human
gggcccctgtgtacggaagg

SEQ ID NO: 160500 - DNA, 20 bp, human
gagagccacgcggcacgccc

SEQ ID NO: 160501 - DNA, 20 bp, human
gaaacgggctcagagccacg

SEQ ID NO: 160502 - DNA, 20 bp, human
ggcgggcccctgtgtacgga

SEQ ID NO: 160503 - DNA, 20 bp, human
gcggaagctgccagggataa

SEQ ID NO: 160504 - DNA, 20 bp, human
gggctggtaaccgctactcc

SEQ ID NO: 160505 - DNA, 20 bp, human
ggttgagtgcccccagatgg

SEQ ID NO: 160506 - DNA, 20 bp, human
ggctagcacgccagcctctt

SEQ ID NO: 160507 - DNA, 20 bp, human
gtgcctcagcccggcagggt

SEQ ID NO: 160508 - DNA, 20 bp, human
gccgggctgaggcatgagta

SEQ ID NO: 160509 - DNA, 20 bp, human
gagcctccttcagccccaag

SEQ ID NO: 160510 - DNA, 20 bp, human
gcacccctttgcaggacttg

SEQ ID NO: 160511 - DNA, 20 bp, human
gctcatgcctcagcccggca

SEQ ID NO: 160512 - DNA, 20 bp, human
gtcgctcagtgagtcctcag

SEQ ID NO: 160513 - DNA, 20 bp, human
gaaccaaaatcaggtagcaa

SEQ ID NO: 160514 - DNA, 20 bp, human
ggagggcagcattgtctgag

SEQ ID NO: 160515 - DNA, 20 bp, human
gggctggcgtgctagccctg

SEQ ID NO: 160516 - DNA, 20 bp, human
ggaccggaccgtggaggcac

SEQ ID NO: 160517 - DNA, 20 bp, human
ggacgcgctatgctgcggga

SEQ ID NO: 160518 - DNA, 20 bp, human
ggccgggacgcgctatgctg

SEQ ID NO: 160519 - DNA, 20 bp, human
gcggtggcaacggctctaag

SEQ ID NO: 160520 - DNA, 20 bp, human
gcgcggggaccggaccgtgg

SEQ ID NO: 160521 - DNA, 20 bp, human
gagacccggggataactaag

SEQ ID NO: 160522 - DNA, 20 bp, human
gcactcaccggcgtccggag

SEQ ID NO: 160523 - DNA, 20 bp, human
gcgccggtgcctccacggtc

SEQ ID NO: 160524 - DNA, 20 bp, human
gtgcgctcacgtgggtgtgg

SEQ ID NO: 160525 - DNA, 20 bp, human
gacccgtggcctccgcacac

SEQ ID NO: 160526 - DNA, 20 bp, human
gggattgtggcttccctcta

SEQ ID NO: 160527 - DNA, 20 bp, human
gcccgtgtggccgccttaga

SEQ ID NO: 160528 - DNA, 20 bp, human
gacaccagtcgccagcccca

SEQ ID NO: 160529 - DNA, 20 bp, human
gcctcaagaagaagccgagg

SEQ ID NO: 160530 - DNA, 20 bp, human
gctgtccaggaggggcgtgt

SEQ ID NO: 160531 - DNA, 20 bp, human
gagacagcacagacaggatg

SEQ ID NO: 160532 - DNA, 20 bp, human
gtccctctaaggcggccaca

SEQ ID NO: 160533 - DNA, 20 bp, human
ggatgacagacagcacagac

SEQ ID NO: 160534 - DNA, 20 bp, human
ggcagctggtaataggattg

SEQ ID NO: 160535 - DNA, 20 bp, human
gctgtgctgtctgtcatcgt

SEQ ID NO: 160536 - DNA, 20 bp, human
gtaggacgcgcgagaaggag

SEQ ID NO: 160537 - DNA, 20 bp, human
gtcccaggaagcagccgcgg

SEQ ID NO: 160538 - DNA, 20 bp, human
ggcagccgcgggggtttcag

SEQ ID NO: 160539 - DNA, 20 bp, human
gccggcagccatcactccag

SEQ ID NO: 160540 - DNA, 20 bp, human
gtcggccgctgaaacccccg

SEQ ID NO: 160541 - DNA, 20 bp, human
gtagtggcgccgcctcgtaa

SEQ ID NO: 160542 - DNA, 20 bp, human
gcgggactcacgaccttccc

SEQ ID NO: 160543 - DNA, 20 bp, human
gagaaccacgcagagagcgc

SEQ ID NO: 160544 - DNA, 20 bp, human
gcgctgcgcgggctataagt

SEQ ID NO: 160545 - DNA, 20 bp, human
ggggtgctccgctggagtga

SEQ ID NO: 160546 - DNA, 20 bp, human
gctcacgctgccggctccgg

SEQ ID NO: 160547 - DNA, 20 bp, human
gactccggggtaaagagccc

SEQ ID NO: 160548 - DNA, 20 bp, human
gttgagccggagagacgcag

SEQ ID NO: 160549 - DNA, 20 bp, human
gcgcgtgccgcctccggagc

SEQ ID NO: 160550 - DNA, 20 bp, human
gggcgccgcacggcaagcga

SEQ ID NO: 160551 - DNA, 20 bp, human
gccagcgctgctccgctccg

SEQ ID NO: 160552 - DNA, 20 bp, human
gggccggcaggaaatgacga

SEQ ID NO: 160553 - DNA, 20 bp, human
gccactcacgctgccggctc

SEQ ID NO: 160554 - DNA, 20 bp, human
gggccgccgctgcgtctctc

SEQ ID NO: 160555 - DNA, 20 bp, human
gctgctggcccacgtggacc

SEQ ID NO: 160556 - DNA, 20 bp, human
gtggtggccaggctagccag

SEQ ID NO: 160557 - DNA, 20 bp, human
gcagtgcaggcgctatgaag

SEQ ID NO: 160558 - DNA, 20 bp, human
gtcatccacggtgggcatga

SEQ ID NO: 160559 - DNA, 20 bp, human
gccagaatgtcatccacggt

SEQ ID NO: 160560 - DNA, 20 bp, human
gcaggcgctatgaagtggac

SEQ ID NO: 160561 - DNA, 20 bp, human
gggcaggtggctcctgttgg

SEQ ID NO: 160562 - DNA, 20 bp, human
gtacacagctgagggcgctc

SEQ ID NO: 160563 - DNA, 20 bp, human
gtgctccagaatgtcatcca

SEQ ID NO: 160564 - DNA, 20 bp, human
gagggggtctacacagctga

SEQ ID NO: 160565 - DNA, 20 bp, human
gaggaactcccatgttacag

SEQ ID NO: 160566 - DNA, 20 bp, human
gcctgatagcaaaagaactg

SEQ ID NO: 160567 - DNA, 20 bp, human
gcagtgcaatacagccgtag

SEQ ID NO: 160568 - DNA, 20 bp, human
gacacgtgacccccaagagg

SEQ ID NO: 160569 - DNA, 20 bp, human
gcagcaacgatgaccaggaa

SEQ ID NO: 160570 - DNA, 20 bp, human
gacatgctggacaataatac

SEQ ID NO: 160571 - DNA, 20 bp, human
gcctcagatttgagtctagt

SEQ ID NO: 160572 - DNA, 20 bp, human
gctggatctggtaatgaaac

SEQ ID NO: 160573 - DNA, 20 bp, human
gtggacaataatactggatc

SEQ ID NO: 160574 - DNA, 20 bp, human
gaggagctcttgagtcaagt

SEQ ID NO: 160575 - DNA, 20 bp, human
gccattgtgcctcctcttgg

SEQ ID NO: 160576 - DNA, 20 bp, human
gcctaccttggccacgatgg

SEQ ID NO: 160577 - DNA, 20 bp, human
gtcggttccaaacagcagtt

SEQ ID NO: 160578 - DNA, 20 bp, human
gcaaggtgacgggactcgag

SEQ ID NO: 160579 - DNA, 20 bp, human
gccaccaagtgtggaccaga

SEQ ID NO: 160580 - DNA, 20 bp, human
gagctggagcgaagctgaca

SEQ ID NO: 160581 - DNA, 20 bp, human
gcagcatcggtggcctggga

SEQ ID NO: 160582 - DNA, 20 bp, human
gtgctggagaactcagaagg

SEQ ID NO: 160583 - DNA, 20 bp, human
ggccgaggcagctctgttca

SEQ ID NO: 160584 - DNA, 20 bp, human
gcatgtgtgtccagcatcgg

SEQ ID NO: 160585 - DNA, 20 bp, human
gtggtgctggagaactcaga

SEQ ID NO: 160586 - DNA, 20 bp, human
gggctcaggccagcatccta

SEQ ID NO: 160587 - DNA, 20 bp, human
ggcagctgctccagacctcc

SEQ ID NO: 160588 - DNA, 20 bp, human
gccgtgctgttgtccaggag

SEQ ID NO: 160589 - DNA, 20 bp, human
gagaggggcccacttcacaa

SEQ ID NO: 160590 - DNA, 20 bp, human
gatttggaaagtagggaatg

SEQ ID NO: 160591 - DNA, 20 bp, human
gctgaactcctggacctcgt

SEQ ID NO: 160592 - DNA, 20 bp, human
ggaccatcagagccatcgtc

SEQ ID NO: 160593 - DNA, 20 bp, human
gctcccgggaaagctgaatt

SEQ ID NO: 160594 - DNA, 20 bp, human
gtcagctttcccgggaggtc

SEQ ID NO: 160595 - DNA, 20 bp, human
gctccagacgatggctctga

SEQ ID NO: 160596 - DNA, 20 bp, human
gcctcagcctggggacacta

SEQ ID NO: 160597 - DNA, 20 bp, human
gtgactgagggcgaagagtc

SEQ ID NO: 160598 - DNA, 20 bp, human
gggtgacctgcagtgtccag

SEQ ID NO: 160599 - DNA, 20 bp, human
gaggtagtgactggcataca

SEQ ID NO: 160600 - DNA, 20 bp, human
ggagctaccctagtgtcccc

SEQ ID NO: 160601 - DNA, 20 bp, human
gctgacagacccacaaccgg

SEQ ID NO: 160602 - DNA, 20 bp, human
gtctaggaccatgaagacat

SEQ ID NO: 160603 - DNA, 20 bp, human
ggagccccaccactgtgcag

SEQ ID NO: 160604 - DNA, 20 bp, human
gtccaggtcctggctgaaat

SEQ ID NO: 160605 - DNA, 20 bp, human
ggctcagtttgtccaggtcc

SEQ ID NO: 160606 - DNA, 20 bp, human
gtgcggtcctgcctacaggg

SEQ ID NO: 160607 - DNA, 20 bp, human
gggaccgcaagccaaagcca

SEQ ID NO: 160608 - DNA, 20 bp, human
gctgggcctggattgtggtc

SEQ ID NO: 160609 - DNA, 20 bp, human
ggcccacctgaccacaatcc

SEQ ID NO: 160610 - DNA, 20 bp, human
gggttctgcttccaagggtc

SEQ ID NO: 160611 - DNA, 20 bp, human
gggcgtctggccatctcctg

SEQ ID NO: 160612 - DNA, 20 bp, human
ggaactcacgctttctggga

SEQ ID NO: 160613 - DNA, 20 bp, human
ggcttgcggtcctgcctaca

SEQ ID NO: 160614 - DNA, 20 bp, human
gctgaagcggtccctgcaga

SEQ ID NO: 160615 - DNA, 20 bp, human
gggacctttgggatgagtag

SEQ ID NO: 160616 - DNA, 20 bp, human
ggcccagcgcggcaacccct

SEQ ID NO: 160617 - DNA, 20 bp, human
gagcgcctgagagggcggtg

SEQ ID NO: 160618 - DNA, 20 bp, human
ggccggtgccgggcgcccag

SEQ ID NO: 160619 - DNA, 20 bp, human
gggcccggccggcagcgtca

SEQ ID NO: 160620 - DNA, 20 bp, human
gctccttccaccactcaagg

SEQ ID NO: 160621 - DNA, 20 bp, human
gaccccgccaccttgagtgg

SEQ ID NO: 160622 - DNA, 20 bp, human
ggccggcctcagagcctctt

SEQ ID NO: 160623 - DNA, 20 bp, human
gcgaggctctgcaaacaccg

SEQ ID NO: 160624 - DNA, 20 bp, human
gggagggcgttcgagatccg

SEQ ID NO: 160625 - DNA, 20 bp, human
ggcgcggcccgccatggagg

SEQ ID NO: 160626 - DNA, 20 bp, human
ggtggcgggaccccatggtg

SEQ ID NO: 160627 - DNA, 20 bp, human
gtcgaagtggcgggacccca

SEQ ID NO: 160628 - DNA, 20 bp, human
gcagtgcacggccgcaccat

SEQ ID NO: 160629 - DNA, 20 bp, human
gtaactcggcgcccagtgca

SEQ ID NO: 160630 - DNA, 20 bp, human
ggtcataaatcccctcgaag

SEQ ID NO: 160631 - DNA, 20 bp, human
gccgcggcagcagatgctgg

SEQ ID NO: 160632 - DNA, 20 bp, human
ggaaacgggcggccaggcac

SEQ ID NO: 160633 - DNA, 20 bp, human
gacctggtgcgtgctctccg

SEQ ID NO: 160634 - DNA, 20 bp, human
gggccagatctcactcgtag

SEQ ID NO: 160635 - DNA, 20 bp, human
gactgggcagcagccgtcta

SEQ ID NO: 160636 - DNA, 20 bp, human
ggggctaggaaggcagtcag

SEQ ID NO: 160637 - DNA, 20 bp, human
ggcagagatcgcagagacca

SEQ ID NO: 160638 - DNA, 20 bp, human
ggtgggcaccgcatctccga

SEQ ID NO: 160639 - DNA, 20 bp, human
gcggcgcgcaactgagccag

SEQ ID NO: 160640 - DNA, 20 bp, human
ggtcccgacctgctgttggg

SEQ ID NO: 160641 - DNA, 20 bp, human
gtctgcagctctgcagccgc

SEQ ID NO: 160642 - DNA, 20 bp, human
ggtcgggaccctcggagatg

SEQ ID NO: 160643 - DNA, 20 bp, human
gctgccccccaacagcaggt

SEQ ID NO: 160644 - DNA, 20 bp, human
gaacagcaggtcgggaccct

SEQ ID NO: 160645 - DNA, 20 bp, human
gaccgcagagcaagggcagg

SEQ ID NO: 160646 - DNA, 20 bp, human
gcctggagcgctcaccccac

SEQ ID NO: 160647 - DNA, 20 bp, human
gcactccgctgtgggaggta

SEQ ID NO: 160648 - DNA, 20 bp, human
ggccgcagcaggcacgtcag

SEQ ID NO: 160649 - DNA, 20 bp, human
gcttgggcacgggtgccggt

SEQ ID NO: 160650 - DNA, 20 bp, human
gaggtaaggcagagctactg

SEQ ID NO: 160651 - DNA, 20 bp, human
gcgcccggcctccaactggt

SEQ ID NO: 160652 - DNA, 20 bp, human
gcaggtactcgagcacactc

SEQ ID NO: 160653 - DNA, 20 bp, human
gcgagtacctgcctttgcag

SEQ ID NO: 160654 - DNA, 20 bp, human
ggctcagaggccgccctctc

SEQ ID NO: 160655 - DNA, 20 bp, human
gactcgagcacactccggag

SEQ ID NO: 160656 - DNA, 20 bp, human
gtgcccccaggagggaagtg

SEQ ID NO: 160657 - DNA, 20 bp, human
ggcccgagctccctgcatcc

SEQ ID NO: 160658 - DNA, 20 bp, human
gagagcgctcatcctgccgg

SEQ ID NO: 160659 - DNA, 20 bp, human
gagctccctgcatcctggac

SEQ ID NO: 160660 - DNA, 20 bp, human
gtgtgctgacgggggtccag

SEQ ID NO: 160661 - DNA, 20 bp, human
gcaggagagatccaagcagg

SEQ ID NO: 160662 - DNA, 20 bp, human
gtctgcgacggcccagatgg

SEQ ID NO: 160663 - DNA, 20 bp, human
gctgggccgtcgcagagagt

SEQ ID NO: 160664 - DNA, 20 bp, human
ggcgctaggaaggtttgagg

SEQ ID NO: 160665 - DNA, 20 bp, human
gtaggtaagcaagatgaccg

SEQ ID NO: 160666 - DNA, 20 bp, human
gcagcctggatcctctcatc

SEQ ID NO: 160667 - DNA, 20 bp, human
gcattcgggagacccctcag

SEQ ID NO: 160668 - DNA, 20 bp, human
ggacagttctgccggatgag

SEQ ID NO: 160669 - DNA, 20 bp, human
gtgagaggatccaggctgac

SEQ ID NO: 160670 - DNA, 20 bp, human
gggaggctgggacctctgag

SEQ ID NO: 160671 - DNA, 20 bp, human
gctgccggatgagaggatcc

SEQ ID NO: 160672 - DNA, 20 bp, human
ggggtctcccgaatgagagg

SEQ ID NO: 160673 - DNA, 20 bp, human
ggaggggtctcccgaatgag

SEQ ID NO: 160674 - DNA, 20 bp, human
gggaccaagggtgtacagtg

SEQ ID NO: 160675 - DNA, 20 bp, human
gagcaaggcgacagttctgc

SEQ ID NO: 160676 - DNA, 20 bp, human
gcccggagcgaggctgagag

SEQ ID NO: 160677 - DNA, 20 bp, human
ggcctcgctccgggcacgtc

SEQ ID NO: 160678 - DNA, 20 bp, human
ggtggtgggcatgatcctgc

SEQ ID NO: 160679 - DNA, 20 bp, human
gtccaggacatcgtccacgg

SEQ ID NO: 160680 - DNA, 20 bp, human
gtgctccaggacatcgtcca

SEQ ID NO: 160681 - DNA, 20 bp, human
gggacatcgtccacggtggt

SEQ ID NO: 160682 - DNA, 20 bp, human
gactcagctcggccactccg

SEQ ID NO: 160683 - DNA, 20 bp, human
gcactgggcccctgccggga

SEQ ID NO: 160684 - DNA, 20 bp, human
gctggccagaagtcaaagag

SEQ ID NO: 160685 - DNA, 20 bp, human
gcagtgtaggcgctacgagg

SEQ ID NO: 160686 - DNA, 20 bp, human
gtccgggaggcgcccgaagt

SEQ ID NO: 160687 - DNA, 20 bp, human
gaggctgggtccagagctcg

SEQ ID NO: 160688 - DNA, 20 bp, human
gagaggcgcatagagcgcgg

SEQ ID NO: 160689 - DNA, 20 bp, human
gggccatggccatagaccgg

SEQ ID NO: 160690 - DNA, 20 bp, human
gaatacagcgcggccacccc

SEQ ID NO: 160691 - DNA, 20 bp, human
gcgcagaggcgcatagagcg

SEQ ID NO: 160692 - DNA, 20 bp, human
ggcaaaggctgctgctcccg

SEQ ID NO: 160693 - DNA, 20 bp, human
gtccagagctcgcggcttcc

SEQ ID NO: 160694 - DNA, 20 bp, human
gcgggcggcggtgcgggcaa

SEQ ID NO: 160695 - DNA, 20 bp, human
gggtccggcgggtgacatgg

SEQ ID NO: 160696 - DNA, 20 bp, human
ggaatggcagactattgaac

SEQ ID NO: 160697 - DNA, 20 bp, human
ggtacaaagatcagagagca

SEQ ID NO: 160698 - DNA, 20 bp, human
gctgccattcttcttagaaa

SEQ ID NO: 160699 - DNA, 20 bp, human
ggagtttcctgataagtcaa

SEQ ID NO: 160700 - DNA, 20 bp, human
gatcataaagcaattcactt

SEQ ID NO: 160701 - DNA, 20 bp, human
gaagcccattgagactgaac

SEQ ID NO: 160702 - DNA, 20 bp, human
gtcacctgttcagtctcaat

SEQ ID NO: 160703 - DNA, 20 bp, human
gccaagaagaaagcagtgtc

SEQ ID NO: 160704 - DNA, 20 bp, human
gggtgtattttaggtcacgt

SEQ ID NO: 160705 - DNA, 20 bp, human
gccccaagtcctttaacttt

SEQ ID NO: 160706 - DNA, 20 bp, human
gcaggcctccaacttgatct

SEQ ID NO: 160707 - DNA, 20 bp, human
gaggacctcctagatcaagt

SEQ ID NO: 160708 - DNA, 20 bp, human
gacctcctagatcaagttgg

SEQ ID NO: 160709 - DNA, 20 bp, human
ggcctccaacttgatctagg

SEQ ID NO: 160710 - DNA, 20 bp, human
gcctacatgtgactaaaggc

SEQ ID NO: 160711 - DNA, 20 bp, human
ggatgaatgagcttccactg

SEQ ID NO: 160712 - DNA, 20 bp, human
gctctcttgtgtacatgacc

SEQ ID NO: 160713 - DNA, 20 bp, human
gatcacttgtccagcctcaa

SEQ ID NO: 160714 - DNA, 20 bp, human
gccacacagggctctgtatc

SEQ ID NO: 160715 - DNA, 20 bp, human
ggttctccagctgagtttga

SEQ ID NO: 160716 - DNA, 20 bp, human
ggcagcgcctcgtcgaagga

SEQ ID NO: 160717 - DNA, 20 bp, human
ggaggcggcggagtaaagag

SEQ ID NO: 160718 - DNA, 20 bp, human
gacgaggcgctgcagcgggt

SEQ ID NO: 160719 - DNA, 20 bp, human
ggggtccgcgggtcactccg

SEQ ID NO: 160720 - DNA, 20 bp, human
gcgagttcgggcgcttccag

SEQ ID NO: 160721 - DNA, 20 bp, human
gggcgtagcgccagccgccg

SEQ ID NO: 160722 - DNA, 20 bp, human
gtggcccgcggcaccagtag

SEQ ID NO: 160723 - DNA, 20 bp, human
gcgcgcctcggagtgacccg

SEQ ID NO: 160724 - DNA, 20 bp, human
gccgccgcggcacggcacaa

SEQ ID NO: 160725 - DNA, 20 bp, human
gcgctgcagcgcctcgtcga

SEQ ID NO: 160726 - DNA, 20 bp, human
gggcgcagagctgaggtcaa

SEQ ID NO: 160727 - DNA, 20 bp, human
gcccatttcaagagggactc

SEQ ID NO: 160728 - DNA, 20 bp, human
gtcaagagggactcgggcag

SEQ ID NO: 160729 - DNA, 20 bp, human
ggggctgccggagaccagag

SEQ ID NO: 160730 - DNA, 20 bp, human
gcaagggtcaagggcctcac

SEQ ID NO: 160731 - DNA, 20 bp, human
gatccctccgtggagagaag

SEQ ID NO: 160732 - DNA, 20 bp, human
ggtcctgctcaatccctccg

SEQ ID NO: 160733 - DNA, 20 bp, human
gtccggcagcccctgcacag

SEQ ID NO: 160734 - DNA, 20 bp, human
gcaatggtgtgcggaggtgg

SEQ ID NO: 160735 - DNA, 20 bp, human
ggtccctcttgaaatgggca

SEQ ID NO: 160736 - DNA, 20 bp, human
gtgtggtcccaagtgtacag

SEQ ID NO: 160737 - DNA, 20 bp, human
gggcgtccggcactcgacag

SEQ ID NO: 160738 - DNA, 20 bp, human
gggaaacaggctgaaggcgt

SEQ ID NO: 160739 - DNA, 20 bp, human
ggaagccggggaccgttcct

SEQ ID NO: 160740 - DNA, 20 bp, human
ggtagttgcaagtttcggag

SEQ ID NO: 160741 - DNA, 20 bp, human
gaaggcgttggagcgttccc

SEQ ID NO: 160742 - DNA, 20 bp, human
gcaacaacagtgtcccgctg

SEQ ID NO: 160743 - DNA, 20 bp, human
gtcagcctgtttcccaggaa

SEQ ID NO: 160744 - DNA, 20 bp, human
gggcaggctgttagaaattg

SEQ ID NO: 160745 - DNA, 20 bp, human
ggggaccgttcctgggaaac

SEQ ID NO: 160746 - DNA, 20 bp, human
gtacatagggcgcacgacca

SEQ ID NO: 160747 - DNA, 20 bp, human
gtagggcgcacgaccaggga

SEQ ID NO: 160748 - DNA, 20 bp, human
ggtcgctatcaggaacacgg

SEQ ID NO: 160749 - DNA, 20 bp, human
gccctatgtaaggccagccg

SEQ ID NO: 160750 - DNA, 20 bp, human
ggcacgaccagggaaggttg

SEQ ID NO: 160751 - DNA, 20 bp, human
gcgcggcaggaccaaggcgg

SEQ ID NO: 160752 - DNA, 20 bp, human
ggccgctctgcctgccagcg

SEQ ID NO: 160753 - DNA, 20 bp, human
ggtgttcctgatagcgaccc

SEQ ID NO: 160754 - DNA, 20 bp, human
gagagcggcgccggcgaagg

SEQ ID NO: 160755 - DNA, 20 bp, human
gaggaacacggaggacaggc

SEQ ID NO: 160756 - DNA, 20 bp, human
gcaacctcagcaagaacggg

SEQ ID NO: 160757 - DNA, 20 bp, human
gggagacctgacccttgcat

SEQ ID NO: 160758 - DNA, 20 bp, human
gggacagatcagggagaccg

SEQ ID NO: 160759 - DNA, 20 bp, human
gctgcggggaggtgaagcgg

SEQ ID NO: 160760 - DNA, 20 bp, human
ggcagacagacagaggtcct

SEQ ID NO: 160761 - DNA, 20 bp, human
gtcccggagcaacccagctg

SEQ ID NO: 160762 - DNA, 20 bp, human
gaacccagctgcggaggcaa

SEQ ID NO: 160763 - DNA, 20 bp, human
ggaaagggcagtccccactg

SEQ ID NO: 160764 - DNA, 20 bp, human
gttcttgctgaggttggcat

SEQ ID NO: 160765 - DNA, 20 bp, human
ggagaagccatcaggagcag

SEQ ID NO: 160766 - DNA, 20 bp, human
gctggctggatactagaggg

SEQ ID NO: 160767 - DNA, 20 bp, human
ggagctggctggatactaga

SEQ ID NO: 160768 - DNA, 20 bp, human
gcccggcagggcacatcggt

SEQ ID NO: 160769 - DNA, 20 bp, human
ggcacggcagccaggaagat

SEQ ID NO: 160770 - DNA, 20 bp, human
gccctgagagcagggcactg

SEQ ID NO: 160771 - DNA, 20 bp, human
gggcacccggcagggcacat

SEQ ID NO: 160772 - DNA, 20 bp, human
gggtagaggagaattctgag

SEQ ID NO: 160773 - DNA, 20 bp, human
gcagagtccaagggtctatg

SEQ ID NO: 160774 - DNA, 20 bp, human
gacctcagttgcaatggtag

SEQ ID NO: 160775 - DNA, 20 bp, human
gtttggtgggtgagcagcat

SEQ ID NO: 160776 - DNA, 20 bp, human
ggccggcagctgctgtagta

SEQ ID NO: 160777 - DNA, 20 bp, human
ggccgggtctggatccgatg

SEQ ID NO: 160778 - DNA, 20 bp, human
gcggcccctaggacagagca

SEQ ID NO: 160779 - DNA, 20 bp, human
gacacgtagcagggaccaag

SEQ ID NO: 160780 - DNA, 20 bp, human
gaggtctcagagggcactag

SEQ ID NO: 160781 - DNA, 20 bp, human
gatataagcccccctggggg

SEQ ID NO: 160782 - DNA, 20 bp, human
gctacaaaggacagattaga

SEQ ID NO: 160783 - DNA, 20 bp, human
gcaggcacctaggaatccca

SEQ ID NO: 160784 - DNA, 20 bp, human
gggcttctggcagttccctg

SEQ ID NO: 160785 - DNA, 20 bp, human
ggtatctgcctggagcaact

SEQ ID NO: 160786 - DNA, 20 bp, human
gagtcgttttggggtcagat

SEQ ID NO: 160787 - DNA, 20 bp, human
ggatgtggacccagcagcga

SEQ ID NO: 160788 - DNA, 20 bp, human
gacagttgatcctcaagtag

SEQ ID NO: 160789 - DNA, 20 bp, human
gatccagagaggttcaaaga

SEQ ID NO: 160790 - DNA, 20 bp, human
gcatttcattgtaaacgact

SEQ ID NO: 160791 - DNA, 20 bp, human
ggattctcaagagtgcatct

SEQ ID NO: 160792 - DNA, 20 bp, human
gacagtcgtcaagaagagag

SEQ ID NO: 160793 - DNA, 20 bp, human
ggttctccagcataaaatga

SEQ ID NO: 160794 - DNA, 20 bp, human
ggtcaccagcgtgacccagg

SEQ ID NO: 160795 - DNA, 20 bp, human
gtggcctttcaggacctcct

SEQ ID NO: 160796 - DNA, 20 bp, human
ggggcccaggaggacctcga

SEQ ID NO: 160797 - DNA, 20 bp, human
gtcctgagggctctagaagc

SEQ ID NO: 160798 - DNA, 20 bp, human
gagcagttcctgaggagaag

SEQ ID NO: 160799 - DNA, 20 bp, human
gcagaagtcttggagaccac

SEQ ID NO: 160800 - DNA, 20 bp, human
gacctgtgccccaaagatga

SEQ ID NO: 160801 - DNA, 20 bp, human
gctcttggccccctctcctg

SEQ ID NO: 160802 - DNA, 20 bp, human
gccaagagggctcaagactg

SEQ ID NO: 160803 - DNA, 20 bp, human
gacttaagggtccacttccc

SEQ ID NO: 160804 - DNA, 20 bp, human
gacaccccaaggatctccag

SEQ ID NO: 160805 - DNA, 20 bp, human
ggtcatcccctcttctcctc

SEQ ID NO: 160806 - DNA, 20 bp, human
gcggctgtcgcggggaccgg

SEQ ID NO: 160807 - DNA, 20 bp, human
ggaggctgcagcgggcactg

SEQ ID NO: 160808 - DNA, 20 bp, human
gggcgcccccagaaccccac

SEQ ID NO: 160809 - DNA, 20 bp, human
gctgtcgcggggaccggagg

SEQ ID NO: 160810 - DNA, 20 bp, human
ggcagccagtggggttctgg

SEQ ID NO: 160811 - DNA, 20 bp, human
gcggcggccgggctctcacc

SEQ ID NO: 160812 - DNA, 20 bp, human
gcgcagcggggaggcaaatg

SEQ ID NO: 160813 - DNA, 20 bp, human
gctcaggccgcgcagcgggg

SEQ ID NO: 160814 - DNA, 20 bp, human
gtgcccgtgcgcaccaccgg

SEQ ID NO: 160815 - DNA, 20 bp, human
gaggaggcggcggcagccag

SEQ ID NO: 160816 - DNA, 20 bp, human
ggcagccaagacaaagcgaa

SEQ ID NO: 160817 - DNA, 20 bp, human
gggagttggctgggattgag

SEQ ID NO: 160818 - DNA, 20 bp, human
gggagcccactgatcggagt

SEQ ID NO: 160819 - DNA, 20 bp, human
gcaagacaaagcgaaaggca

SEQ ID NO: 160820 - DNA, 20 bp, human
gatcctgggagcccactgat

SEQ ID NO: 160821 - DNA, 20 bp, human
ggagtaagagagtcctcctg

SEQ ID NO: 160822 - DNA, 20 bp, human
gccacatgaaaagaagctgg

SEQ ID NO: 160823 - DNA, 20 bp, human
gctgcaaagcaggagcaggt

SEQ ID NO: 160824 - DNA, 20 bp, human
gccatcctgcaaacttggat

SEQ ID NO: 160825 - DNA, 20 bp, human
ggctgggattgaggggtgat

SEQ ID NO: 160826 - DNA, 20 bp, human
gagggcaatgcagagagaca

SEQ ID NO: 160827 - DNA, 20 bp, human
gtgaggcccatgggtcagtg

SEQ ID NO: 160828 - DNA, 20 bp, human
ggagaatggggagagattca

SEQ ID NO: 160829 - DNA, 20 bp, human
gaggaaagagcccgagaatg

SEQ ID NO: 160830 - DNA, 20 bp, human
gtcagaggatacgagagagg

SEQ ID NO: 160831 - DNA, 20 bp, human
gcaatgcagagagacacggc

SEQ ID NO: 160832 - DNA, 20 bp, human
gggttcagaggatacgagag

SEQ ID NO: 160833 - DNA, 20 bp, human
gcttctctcgagccttggct

SEQ ID NO: 160834 - DNA, 20 bp, human
gcaaggctcgagagaagttg

SEQ ID NO: 160835 - DNA, 20 bp, human
gattctgtcaaccggttcag

SEQ ID NO: 160836 - DNA, 20 bp, human
ggattccataggagagctgg

SEQ ID NO: 160837 - DNA, 20 bp, human
gaggcagggtcgggtgtgaa

SEQ ID NO: 160838 - DNA, 20 bp, human
gccttgaattaggattccat

SEQ ID NO: 160839 - DNA, 20 bp, human
gcccgaccctgccttgaatt

SEQ ID NO: 160840 - DNA, 20 bp, human
ggggggctgcagggagatag

SEQ ID NO: 160841 - DNA, 20 bp, human
gtaggattccataggagagc

SEQ ID NO: 160842 - DNA, 20 bp, human
gcaaagagtgggtctgaagc

SEQ ID NO: 160843 - DNA, 20 bp, human
ggttcatggcaaggatcggg

SEQ ID NO: 160844 - DNA, 20 bp, human
gttctgctggggatacgagt

SEQ ID NO: 160845 - DNA, 20 bp, human
gtcctaattcaaggcagggt

SEQ ID NO: 160846 - DNA, 20 bp, human
gcagagcccgggcctcagag

SEQ ID NO: 160847 - DNA, 20 bp, human
gcccgggctctggctcgcac

SEQ ID NO: 160848 - DNA, 20 bp, human
gccagcccggctggcgagag

SEQ ID NO: 160849 - DNA, 20 bp, human
gcccgggcctcagagcgggt

SEQ ID NO: 160850 - DNA, 20 bp, human
gctctgcgcgtctcccccga

SEQ ID NO: 160851 - DNA, 20 bp, human
gcctggggcgcccacatcca

SEQ ID NO: 160852 - DNA, 20 bp, human
gaccgccacagcggctacag

SEQ ID NO: 160853 - DNA, 20 bp, human
ggccagtgcgagccagagcc

SEQ ID NO: 160854 - DNA, 20 bp, human
gcacctacaaacgactcagg

SEQ ID NO: 160855 - DNA, 20 bp, human
gtgctctgcaggctcacagg

SEQ ID NO: 160856 - DNA, 20 bp, human
ggagccgcagcgcccactcg

SEQ ID NO: 160857 - DNA, 20 bp, human
gcagcagaaggtccctccgg

SEQ ID NO: 160858 - DNA, 20 bp, human
ggagtaagcagcgcacaggc

SEQ ID NO: 160859 - DNA, 20 bp, human
gcgagcctgcgagagcagaa

SEQ ID NO: 160860 - DNA, 20 bp, human
gccggagccccaggataagc

SEQ ID NO: 160861 - DNA, 20 bp, human
gagggcgacgacgaggagac

SEQ ID NO: 160862 - DNA, 20 bp, human
gacccagcccgcttatcctg

SEQ ID NO: 160863 - DNA, 20 bp, human
ggccagacgcctaagcctgc

SEQ ID NO: 160864 - DNA, 20 bp, human
gacctccatgcctctgcgtg

SEQ ID NO: 160865 - DNA, 20 bp, human
gcctgccccacgcagaggca

SEQ ID NO: 160866 - DNA, 20 bp, human
gtcgacgtcggccctcccag

SEQ ID NO: 160867 - DNA, 20 bp, human
gccaggggcgagctctcccc

SEQ ID NO: 160868 - DNA, 20 bp, human
gcaggcggtgcgcgactcag

SEQ ID NO: 160869 - DNA, 20 bp, human
gcatggcccgagggcgaggt

SEQ ID NO: 160870 - DNA, 20 bp, human
ggccagagagaaagttcccg

SEQ ID NO: 160871 - DNA, 20 bp, human
gcggcgagcaggctcgacgt

SEQ ID NO: 160872 - DNA, 20 bp, human
gccggacgcacagcacacca

SEQ ID NO: 160873 - DNA, 20 bp, human
ggcggtacctgagaccctcg

SEQ ID NO: 160874 - DNA, 20 bp, human
ggcggccagagtgcaatcag

SEQ ID NO: 160875 - DNA, 20 bp, human
ggccgtctctgggagaggat

SEQ ID NO: 160876 - DNA, 20 bp, human
gggccaaacatgggcgagaa

SEQ ID NO: 160877 - DNA, 20 bp, human
gcagatgtgcagtggcccac

SEQ ID NO: 160878 - DNA, 20 bp, human
ggacaaaagggggccaaaca

SEQ ID NO: 160879 - DNA, 20 bp, human
ggcaggcctgtgaacaattt

SEQ ID NO: 160880 - DNA, 20 bp, human
gctgccccaacgtctcccaa

SEQ ID NO: 160881 - DNA, 20 bp, human
ggctaccacatacagatgaa

SEQ ID NO: 160882 - DNA, 20 bp, human
gcacaggtaggtggacattg

SEQ ID NO: 160883 - DNA, 20 bp, human
gctgttgctcggcatcctgt

SEQ ID NO: 160884 - DNA, 20 bp, human
gcagagcctaaattgttcac

SEQ ID NO: 160885 - DNA, 20 bp, human
ggaaattctctctgcaacag

SEQ ID NO: 160886 - DNA, 20 bp, human
ggaactccgcgctcggtccg

SEQ ID NO: 160887 - DNA, 20 bp, human
ggcggccggttatggtccca

SEQ ID NO: 160888 - DNA, 20 bp, human
gccagtgccgcggggaacat

SEQ ID NO: 160889 - DNA, 20 bp, human
gcggacccgaagccgccaca

SEQ ID NO: 160890 - DNA, 20 bp, human
gcgccgaccgaagtccggga

SEQ ID NO: 160891 - DNA, 20 bp, human
ggcgcctcgccgggacaacg

SEQ ID NO: 160892 - DNA, 20 bp, human
gccccgtcccggacttcggt

SEQ ID NO: 160893 - DNA, 20 bp, human
ggccgcgccgaccgaagtcc

SEQ ID NO: 160894 - DNA, 20 bp, human
gacggcccaacccggaagtg

SEQ ID NO: 160895 - DNA, 20 bp, human
gccgcccctgggaccataac

SEQ ID NO: 160896 - DNA, 20 bp, human
gaaggtcacacgcggttccc

SEQ ID NO: 160897 - DNA, 20 bp, human
ggggtcgatccgggcgagga

SEQ ID NO: 160898 - DNA, 20 bp, human
ggcagcaaaggcccatccgt

SEQ ID NO: 160899 - DNA, 20 bp, human
gccgccgggcattcgagctg

SEQ ID NO: 160900 - DNA, 20 bp, human
ggaatgcccggcggccgagg

SEQ ID NO: 160901 - DNA, 20 bp, human
gtcacacgcggttccccggg

SEQ ID NO: 160902 - DNA, 20 bp, human
gcgggctggaaggtcacacg

SEQ ID NO: 160903 - DNA, 20 bp, human
gaaacgccgcacccacggat

SEQ ID NO: 160904 - DNA, 20 bp, human
gcgcggaccgatgctgccgg

SEQ ID NO: 160905 - DNA, 20 bp, human
ggagcggccgccggcagcat

SEQ ID NO: 160906 - DNA, 20 bp, human
gggagccgagggccattgag

SEQ ID NO: 160907 - DNA, 20 bp, human
gggccattgagtggcgatgg

SEQ ID NO: 160908 - DNA, 20 bp, human
gcgccgccatcgccactcaa

SEQ ID NO: 160909 - DNA, 20 bp, human
gcggggccggcgggatagac

SEQ ID NO: 160910 - DNA, 20 bp, human
gctgcacgcagtccgacaca

SEQ ID NO: 160911 - DNA, 20 bp, human
gggggttccaggccattaaa

SEQ ID NO: 160912 - DNA, 20 bp, human
gaacttgacggacttagggg

SEQ ID NO: 160913 - DNA, 20 bp, human
ggatcgcgctgaccccgtgc

SEQ ID NO: 160914 - DNA, 20 bp, human
ggcgcgcgcggtgtcacctt

SEQ ID NO: 160915 - DNA, 20 bp, human
gcacgcagtccgacacaggg

SEQ ID NO: 160916 - DNA, 20 bp, human
ggagcacagcatggcggtca

SEQ ID NO: 160917 - DNA, 20 bp, human
gtaaggccgagggcagtggt

SEQ ID NO: 160918 - DNA, 20 bp, human
gccggcttccgagcacagca

SEQ ID NO: 160919 - DNA, 20 bp, human
ggtaaagctggggataccta

SEQ ID NO: 160920 - DNA, 20 bp, human
gtcgctcactcgctcgtccc

SEQ ID NO: 160921 - DNA, 20 bp, human
gcggtaacacgggtcagtga

SEQ ID NO: 160922 - DNA, 20 bp, human
ggaccggaggaggggatgcc

SEQ ID NO: 160923 - DNA, 20 bp, human
gtatcagtgaattgcggtgg

SEQ ID NO: 160924 - DNA, 20 bp, human
ggagcagggccgagctgtca

SEQ ID NO: 160925 - DNA, 20 bp, human
ggcatcagaaagggtgtggg

SEQ ID NO: 160926 - DNA, 20 bp, human
gggctcacttctagtcccgg

SEQ ID NO: 160927 - DNA, 20 bp, human
gtgagccagggccgacgagg

SEQ ID NO: 160928 - DNA, 20 bp, human
ggactgcgggacccactgac

SEQ ID NO: 160929 - DNA, 20 bp, human
gggcggctcacttctagtcc

SEQ ID NO: 160930 - DNA, 20 bp, human
gctggcgtttgggacccggg

SEQ ID NO: 160931 - DNA, 20 bp, human
gtcacttctagtcccggcgg

SEQ ID NO: 160932 - DNA, 20 bp, human
ggcgcgctgggaaggtagag

SEQ ID NO: 160933 - DNA, 20 bp, human
gtggctggcgtttgggaccc

SEQ ID NO: 160934 - DNA, 20 bp, human
ggggaagttggtgcctgacg

SEQ ID NO: 160935 - DNA, 20 bp, human
ggagcaggagcgcgctggga

SEQ ID NO: 160936 - DNA, 20 bp, human
gtcggacgactgggaagctg

SEQ ID NO: 160937 - DNA, 20 bp, human
gtcgggctcatcggacgact

SEQ ID NO: 160938 - DNA, 20 bp, human
gcggcggccgtgattgtaag

SEQ ID NO: 160939 - DNA, 20 bp, human
gtgacctcaggagtgacagg

SEQ ID NO: 160940 - DNA, 20 bp, human
gcagtggcgtttccgactgt

SEQ ID NO: 160941 - DNA, 20 bp, human
gtgctacccagagggtgaat

SEQ ID NO: 160942 - DNA, 20 bp, human
gccggaagcattgaaaccaa

SEQ ID NO: 160943 - DNA, 20 bp, human
gagaaggcggcctcccaggg

SEQ ID NO: 160944 - DNA, 20 bp, human
ggccagaagagtgaaagaca

SEQ ID NO: 160945 - DNA, 20 bp, human
gttccgggttggcgctgcag

SEQ ID NO: 160946 - DNA, 20 bp, human
gacccggagccgagagcggg

SEQ ID NO: 160947 - DNA, 20 bp, human
ggcgacccggagccgagagc

SEQ ID NO: 160948 - DNA, 20 bp, human
ggcgtggccgcgtccagctc

SEQ ID NO: 160949 - DNA, 20 bp, human
gagggtccggccaagaaagt

SEQ ID NO: 160950 - DNA, 20 bp, human
gggccacttaacacccacgt

SEQ ID NO: 160951 - DNA, 20 bp, human
gcgggactcggagaatctcg

SEQ ID NO: 160952 - DNA, 20 bp, human
ggccaggcgcgtctcctccc

SEQ ID NO: 160953 - DNA, 20 bp, human
ggcatggagccgcttgtgaa

SEQ ID NO: 160954 - DNA, 20 bp, human
ggccgccccagccggcgacc

SEQ ID NO: 160955 - DNA, 20 bp, human
ggcctcgcaaggaacaggtc

SEQ ID NO: 160956 - DNA, 20 bp, human
gggaccatagccggaacagg

SEQ ID NO: 160957 - DNA, 20 bp, human
gaagaggttacagcaggtca

SEQ ID NO: 160958 - DNA, 20 bp, human
gggcggggcaaagtaacacc

SEQ ID NO: 160959 - DNA, 20 bp, human
gacgggaccatagccggaac

SEQ ID NO: 160960 - DNA, 20 bp, human
gaggctgaccgccccgccgg

SEQ ID NO: 160961 - DNA, 20 bp, human
gagccggaacaggcggtgac

SEQ ID NO: 160962 - DNA, 20 bp, human
gggggcaaagtaacacccgg

SEQ ID NO: 160963 - DNA, 20 bp, human
gcaccggacgggaccatagc

SEQ ID NO: 160964 - DNA, 20 bp, human
gaggaggctgaccgccccgc

SEQ ID NO: 160965 - DNA, 20 bp, human
gttgccaacttacagaacac

SEQ ID NO: 160966 - DNA, 20 bp, human
gcagccagtggagttaggaa

SEQ ID NO: 160967 - DNA, 20 bp, human
gtgccgcagccagtggagtt

SEQ ID NO: 160968 - DNA, 20 bp, human
gtctctaggagaccaggagg

SEQ ID NO: 160969 - DNA, 20 bp, human
gctggcccggaggagaacgt

SEQ ID NO: 160970 - DNA, 20 bp, human
gcgacccggaagtggttcta

SEQ ID NO: 160971 - DNA, 20 bp, human
ggagcgggcacgtgtgaaca

SEQ ID NO: 160972 - DNA, 20 bp, human
gcaggcgggcgggtttgaga

SEQ ID NO: 160973 - DNA, 20 bp, human
gaaagatgcggaccctgagc

SEQ ID NO: 160974 - DNA, 20 bp, human
gcagtctctaggagaccagg

SEQ ID NO: 160975 - DNA, 20 bp, human
ggctcctttcctaactccac

SEQ ID NO: 160976 - DNA, 20 bp, human
gaaagtacaaggctcacggt

SEQ ID NO: 160977 - DNA, 20 bp, human
gttctggacagcatatgaca

SEQ ID NO: 160978 - DNA, 20 bp, human
ggctttaactggctagaata

SEQ ID NO: 160979 - DNA, 20 bp, human
ggtacgattgcatggcaggg

SEQ ID NO: 160980 - DNA, 20 bp, human
gtagctgagatagcagatga

SEQ ID NO: 160981 - DNA, 20 bp, human
gcagttgttgaggcactcac

SEQ ID NO: 160982 - DNA, 20 bp, human
ggccatgcaatcgtaccggg

SEQ ID NO: 160983 - DNA, 20 bp, human
ggttccttggatatatccac

SEQ ID NO: 160984 - DNA, 20 bp, human
gaagcccgtggatatatcca

SEQ ID NO: 160985 - DNA, 20 bp, human
gtgcaatcgtaccgggaggg

SEQ ID NO: 160986 - DNA, 20 bp, human
ggcgagaaggacggaggtag

SEQ ID NO: 160987 - DNA, 20 bp, human
gagggtgctggtccccgaga

SEQ ID NO: 160988 - DNA, 20 bp, human
gctggagctcaggtgctcaa

SEQ ID NO: 160989 - DNA, 20 bp, human
gcaggagaccggagcatacc

SEQ ID NO: 160990 - DNA, 20 bp, human
ggaggtagaggttactcaca

SEQ ID NO: 160991 - DNA, 20 bp, human
gcagagcacggcgaccccta

SEQ ID NO: 160992 - DNA, 20 bp, human
gcgggtgcccatgtgcccaa

SEQ ID NO: 160993 - DNA, 20 bp, human
gggaagagcctggtatgctc

SEQ ID NO: 160994 - DNA, 20 bp, human
ggcatctccagggacaccgg

SEQ ID NO: 160995 - DNA, 20 bp, human
gggttactcacacggctcgg

SEQ ID NO: 160996 - DNA, 20 bp, human
gggcggagcgtagggttgag

SEQ ID NO: 160997 - DNA, 20 bp, human
gcggcccgcggcggagcgta

SEQ ID NO: 160998 - DNA, 20 bp, human
ggtctccggggcttctacaa

SEQ ID NO: 160999 - DNA, 20 bp, human
gggctctcaccccagtgcgg

SEQ ID NO: 161000 - DNA, 20 bp, human
ggacagcgtgtgtactgact

SEQ ID NO: 161001 - DNA, 20 bp, human
gacgcccaagtgggtctccg

SEQ ID NO: 161002 - DNA, 20 bp, human
ggcgcggggaatggagttgg

SEQ ID NO: 161003 - DNA, 20 bp, human
gtgagcggcttcccccgcac

SEQ ID NO: 161004 - DNA, 20 bp, human
gtggctctaccgcctgttct

SEQ ID NO: 161005 - DNA, 20 bp, human
gcccgctgtgaggtcgatgg

SEQ ID NO: 161006 - DNA, 20 bp, human
ggctcttgacaggcagttag

SEQ ID NO: 161007 - DNA, 20 bp, human
gcggacgctgggcagaagag

SEQ ID NO: 161008 - DNA, 20 bp, human
ggccccaaagagccaggcgg

SEQ ID NO: 161009 - DNA, 20 bp, human
ggccccgcccacccaaaagt

SEQ ID NO: 161010 - DNA, 20 bp, human
gagcttccgtgagaagtcta

SEQ ID NO: 161011 - DNA, 20 bp, human
gtgcgccccaaagagccagg

SEQ ID NO: 161012 - DNA, 20 bp, human
gcagaagagactgcgggaca

SEQ ID NO: 161013 - DNA, 20 bp, human
gtgacagacggagtgacaga

SEQ ID NO: 161014 - DNA, 20 bp, human
ggtcagttctcgggccgtcc

SEQ ID NO: 161015 - DNA, 20 bp, human
gttacatcagagctcttgac

SEQ ID NO: 161016 - DNA, 20 bp, human
gagagggcagaacttcagta

SEQ ID NO: 161017 - DNA, 20 bp, human
ggcagtgcttgagcccctag

SEQ ID NO: 161018 - DNA, 20 bp, human
gggcgactgctggaaagcga

SEQ ID NO: 161019 - DNA, 20 bp, human
ggcaagtggcagagccccaa

SEQ ID NO: 161020 - DNA, 20 bp, human
gagaggcgcgagagcagagg

SEQ ID NO: 161021 - DNA, 20 bp, human
gtcgccaggcgggaggacaa

SEQ ID NO: 161022 - DNA, 20 bp, human
gtcagtaaggagacctgtct

SEQ ID NO: 161023 - DNA, 20 bp, human
gcaagcgcgttggctccctg

SEQ ID NO: 161024 - DNA, 20 bp, human
gggcgggaggacaagggagt

SEQ ID NO: 161025 - DNA, 20 bp, human
gtctgctctcgcgcctctag

SEQ ID NO: 161026 - DNA, 20 bp, human
gtcggatgggcgcagcagaa

SEQ ID NO: 161027 - DNA, 20 bp, human
gagtcgcggtggccaggcgg

SEQ ID NO: 161028 - DNA, 20 bp, human
gcagcggatgctccgatccg

SEQ ID NO: 161029 - DNA, 20 bp, human
gcggagtcgcggtggccagg

SEQ ID NO: 161030 - DNA, 20 bp, human
gctcggccagcacctaggcg

SEQ ID NO: 161031 - DNA, 20 bp, human
gggagttcaccggacatctg

SEQ ID NO: 161032 - DNA, 20 bp, human
gcgcacacgtgggagttcac

SEQ ID NO: 161033 - DNA, 20 bp, human
gagccccagcagtagggcag

SEQ ID NO: 161034 - DNA, 20 bp, human
gcgcagcagaagggagccgc

SEQ ID NO: 161035 - DNA, 20 bp, human
ggagcgcgcccggaaccgtc

SEQ ID NO: 161036 - DNA, 20 bp, human
gagccgagcggactgcgcgg

SEQ ID NO: 161037 - DNA, 20 bp, human
gcccgcagggtcagctcccg

SEQ ID NO: 161038 - DNA, 20 bp, human
gcgttaggccaaacacgagt

SEQ ID NO: 161039 - DNA, 20 bp, human
gcgcaagtgccagagccgag

SEQ ID NO: 161040 - DNA, 20 bp, human
gtccagccacaggtagtccc

SEQ ID NO: 161041 - DNA, 20 bp, human
gagccacaggtagtccctgg

SEQ ID NO: 161042 - DNA, 20 bp, human
gcccaagcccctgaactggg

SEQ ID NO: 161043 - DNA, 20 bp, human
ggcagcggcggcctcagtgg

SEQ ID NO: 161044 - DNA, 20 bp, human
gaggccaaacacgagtgggt

SEQ ID NO: 161045 - DNA, 20 bp, human
gcagagccgagcggactgcg

SEQ ID NO: 161046 - DNA, 20 bp, human
gacactgcgaggaccgagga

SEQ ID NO: 161047 - DNA, 20 bp, human
ggccgcagccgcaaccccga

SEQ ID NO: 161048 - DNA, 20 bp, human
ggcctggccgaggaagtcac

SEQ ID NO: 161049 - DNA, 20 bp, human
gcttgaggcgttgccaggag

SEQ ID NO: 161050 - DNA, 20 bp, human
gcgccgcctgagcgtaggga

SEQ ID NO: 161051 - DNA, 20 bp, human
gggaagtcacgggagatcga

SEQ ID NO: 161052 - DNA, 20 bp, human
ggccaggacgccgaggaggt

SEQ ID NO: 161053 - DNA, 20 bp, human
gcgttgccaggagaggaagg

SEQ ID NO: 161054 - DNA, 20 bp, human
gagagggtctcgtagcgcgt

SEQ ID NO: 161055 - DNA, 20 bp, human
gcgcagccctccctacgctc

SEQ ID NO: 161056 - DNA, 20 bp, human
gccagtggaagcaggtctgt

SEQ ID NO: 161057 - DNA, 20 bp, human
gaggcacagacagagcatgt

SEQ ID NO: 161058 - DNA, 20 bp, human
gcccgatgaccggcacatac

SEQ ID NO: 161059 - DNA, 20 bp, human
ggctccactgccctcaccac

SEQ ID NO: 161060 - DNA, 20 bp, human
gatcaggttgctcaagtgag

SEQ ID NO: 161061 - DNA, 20 bp, human
gaacttgctcccggtggtga

SEQ ID NO: 161062 - DNA, 20 bp, human
gagggagaggcgcattcaac

SEQ ID NO: 161063 - DNA, 20 bp, human
ggtggggtgaccgcgcggaa

SEQ ID NO: 161064 - DNA, 20 bp, human
gttagggaacttgctcccgg

SEQ ID NO: 161065 - DNA, 20 bp, human
gaaagaaaaaagccctccca

SEQ ID NO: 161066 - DNA, 20 bp, human
ggtcttcatctatcagccca

SEQ ID NO: 161067 - DNA, 20 bp, human
ggttgcccagccattaacac

SEQ ID NO: 161068 - DNA, 20 bp, human
gccataaatacaaggatgaa

SEQ ID NO: 161069 - DNA, 20 bp, human
gactcagcgccacccacaat

SEQ ID NO: 161070 - DNA, 20 bp, human
gagcgccacccacaattgga

SEQ ID NO: 161071 - DNA, 20 bp, human
gatgagcatgaacttcatca

SEQ ID NO: 161072 - DNA, 20 bp, human
gaaccactgattcctctccc

SEQ ID NO: 161073 - DNA, 20 bp, human
gtgagcccgtgttaatggct

SEQ ID NO: 161074 - DNA, 20 bp, human
gacctctttccataaataca

SEQ ID NO: 161075 - DNA, 20 bp, human
gattccatcttatagaacga

SEQ ID NO: 161076 - DNA, 20 bp, human
gccggccgcgggtccctctg

SEQ ID NO: 161077 - DNA, 20 bp, human
gctgccaggcgggcatggaa

SEQ ID NO: 161078 - DNA, 20 bp, human
gccggcagtgcgcatcggag

SEQ ID NO: 161079 - DNA, 20 bp, human
gacccggccgagccgaacga

SEQ ID NO: 161080 - DNA, 20 bp, human
gggaaggttgcgggtccacc

SEQ ID NO: 161081 - DNA, 20 bp, human
gatgtccgtcccggaggagg

SEQ ID NO: 161082 - DNA, 20 bp, human
gagccgcgcagccggacagt

SEQ ID NO: 161083 - DNA, 20 bp, human
gcgggtacctagctcggcca

SEQ ID NO: 161084 - DNA, 20 bp, human
gtccctcgttcggctcggcc

SEQ ID NO: 161085 - DNA, 20 bp, human
gtgaatgtccgtcccggagg

SEQ ID NO: 161086 - DNA, 20 bp, human
ggcctgaggcggacactacg

SEQ ID NO: 161087 - DNA, 20 bp, human
gcggcttcgaacccgacctg

SEQ ID NO: 161088 - DNA, 20 bp, human
gtgagagccggagccgacat

SEQ ID NO: 161089 - DNA, 20 bp, human
gtggctccggacaagaccca

SEQ ID NO: 161090 - DNA, 20 bp, human
ggccaggaaggaacccatgt

SEQ ID NO: 161091 - DNA, 20 bp, human
gcggaggccccgggctctct

SEQ ID NO: 161092 - DNA, 20 bp, human
ggccccgtagtgtccgcctc

SEQ ID NO: 161093 - DNA, 20 bp, human
gggtcgggtcagccccaggt

SEQ ID NO: 161094 - DNA, 20 bp, human
ggctctctgggccgcgcctg

SEQ ID NO: 161095 - DNA, 20 bp, human
ggtcggcgctgctggacggg

SEQ ID NO: 161096 - DNA, 20 bp, human
gacccgcgctggtccctcgg

SEQ ID NO: 161097 - DNA, 20 bp, human
gtgcctcgggcgggtctcgt

SEQ ID NO: 161098 - DNA, 20 bp, human
gaggcccgggctgtccgcga

SEQ ID NO: 161099 - DNA, 20 bp, human
ggcccgaggcaagagaactg

SEQ ID NO: 161100 - DNA, 20 bp, human
ggcccgggcaggcgcggtca

SEQ ID NO: 161101 - DNA, 20 bp, human
gtagacccgcgctggtccct

SEQ ID NO: 161102 - DNA, 20 bp, human
gccctgccggcaggcacgag

SEQ ID NO: 161103 - DNA, 20 bp, human
gcgcccacgagacccgcccg

SEQ ID NO: 161104 - DNA, 20 bp, human
ggcagcagctagacccgcgc

SEQ ID NO: 161105 - DNA, 20 bp, human
gtgccgccgagggaccagcg

SEQ ID NO: 161106 - DNA, 20 bp, human
gtgagccgcaacctttccaa

SEQ ID NO: 161107 - DNA, 20 bp, human
gccacactcactccctaaga

SEQ ID NO: 161108 - DNA, 20 bp, human
gttgtgtgatcgccatctta

SEQ ID NO: 161109 - DNA, 20 bp, human
gcgcaacctttccaagggag

SEQ ID NO: 161110 - DNA, 20 bp, human
gccacacccgccacaggaga

SEQ ID NO: 161111 - DNA, 20 bp, human
ggaaaggttgcggctcacag

SEQ ID NO: 161112 - DNA, 20 bp, human
gggagcgacggttagaggac

SEQ ID NO: 161113 - DNA, 20 bp, human
gctgatctcaccttccacgg

SEQ ID NO: 161114 - DNA, 20 bp, human
ggtggccgggccttctcctg

SEQ ID NO: 161115 - DNA, 20 bp, human
gggcggctgccaggttgcga

SEQ ID NO: 161116 - DNA, 20 bp, human
ggacgcggagatgccaggac

SEQ ID NO: 161117 - DNA, 20 bp, human
gcgggccaggacttacctgg

SEQ ID NO: 161118 - DNA, 20 bp, human
gtgggagggacgcacaagca

SEQ ID NO: 161119 - DNA, 20 bp, human
gccgagtgcgaagcccgtcc

SEQ ID NO: 161120 - DNA, 20 bp, human
ggttacaactgagtccgggt

SEQ ID NO: 161121 - DNA, 20 bp, human
gaatgaacgcacgagtggga

SEQ ID NO: 161122 - DNA, 20 bp, human
ggcaccggcccgacccaagg

SEQ ID NO: 161123 - DNA, 20 bp, human
ggcacgggccaggacttacc

SEQ ID NO: 161124 - DNA, 20 bp, human
gcctgcgaagtggagagcac

SEQ ID NO: 161125 - DNA, 20 bp, human
gaagcagggttgcaagcccg

SEQ ID NO: 161126 - DNA, 20 bp, human
ggtacgggagctacgatgaa

SEQ ID NO: 161127 - DNA, 20 bp, human
gtcgcgagcagggtgcgtca

SEQ ID NO: 161128 - DNA, 20 bp, human
gcatcgtactggcgagaaag

SEQ ID NO: 161129 - DNA, 20 bp, human
gaaccgctgcagcatcgtac

SEQ ID NO: 161130 - DNA, 20 bp, human
ggtcagcttcccagagaaga

SEQ ID NO: 161131 - DNA, 20 bp, human
ggcgccgggagaggctgtcg

SEQ ID NO: 161132 - DNA, 20 bp, human
gagtggctaaaaatgagtac

SEQ ID NO: 161133 - DNA, 20 bp, human
gcgccagtacgatgctgcag

SEQ ID NO: 161134 - DNA, 20 bp, human
gcttctggccggcggagtcg

SEQ ID NO: 161135 - DNA, 20 bp, human
ggccccgaggcgcggtacaa

SEQ ID NO: 161136 - DNA, 20 bp, human
gggagactctagtactgagg

SEQ ID NO: 161137 - DNA, 20 bp, human
gtactgagggggcaagaacg

SEQ ID NO: 161138 - DNA, 20 bp, human
gcacctccgggaccaacgag

SEQ ID NO: 161139 - DNA, 20 bp, human
gcctagaacggaaaagacgg

SEQ ID NO: 161140 - DNA, 20 bp, human
ggccggagactctagtactg

SEQ ID NO: 161141 - DNA, 20 bp, human
gtcctcaagactaagagagg

SEQ ID NO: 161142 - DNA, 20 bp, human
gcaaggcgcgtgagcgaagc

SEQ ID NO: 161143 - DNA, 20 bp, human
gggcataagagtcctctcgt

SEQ ID NO: 161144 - DNA, 20 bp, human
gcgggccccgagcctatgac

SEQ ID NO: 161145 - DNA, 20 bp, human
gcagggcggagactcgggag

SEQ ID NO: 161146 - DNA, 20 bp, human
gggctgcggtcaggacgtag

SEQ ID NO: 161147 - DNA, 20 bp, human
gcccggcgtcggggactggt

SEQ ID NO: 161148 - DNA, 20 bp, human
gccggcggggagctagagcc

SEQ ID NO: 161149 - DNA, 20 bp, human
gtccggcccccgccacgtga

SEQ ID NO: 161150 - DNA, 20 bp, human
gtacggcgccggcgctcggg

SEQ ID NO: 161151 - DNA, 20 bp, human
gctgaccgcagccccgaggg

SEQ ID NO: 161152 - DNA, 20 bp, human
gtaaccgccgcgggaggctg

SEQ ID NO: 161153 - DNA, 20 bp, human
gcggcgccgtagcccgggga

SEQ ID NO: 161154 - DNA, 20 bp, human
ggaggaggaagtcccggcgt

SEQ ID NO: 161155 - DNA, 20 bp, human
gcggtcaggacgtaggggtg

SEQ ID NO: 161156 - DNA, 20 bp, human
gggaccgaggccatgtctag

SEQ ID NO: 161157 - DNA, 20 bp, human
gaggccttggtacagaaggc

SEQ ID NO: 161158 - DNA, 20 bp, human
gaggccatgtctagagggta

SEQ ID NO: 161159 - DNA, 20 bp, human
gtcctggtctgacaggcctg

SEQ ID NO: 161160 - DNA, 20 bp, human
gtgtaccaaggcctcatgaa

SEQ ID NO: 161161 - DNA, 20 bp, human
gctgccggccttctgtacca

SEQ ID NO: 161162 - DNA, 20 bp, human
ggcctcacgcagcaaccagg

SEQ ID NO: 161163 - DNA, 20 bp, human
ggcaccaggtccactgctgg

SEQ ID NO: 161164 - DNA, 20 bp, human
gtgctgtggcccgagcagac

SEQ ID NO: 161165 - DNA, 20 bp, human
gtggactgctgagatagacc

SEQ ID NO: 161166 - DNA, 20 bp, human
gggcctccgcaggctacccg

SEQ ID NO: 161167 - DNA, 20 bp, human
gaagctactgcgagctccgg

SEQ ID NO: 161168 - DNA, 20 bp, human
ggagctccggtggctgcctg

SEQ ID NO: 161169 - DNA, 20 bp, human
gggctgcctggggacgctca

SEQ ID NO: 161170 - DNA, 20 bp, human
ggacgggagcacgggagtag

SEQ ID NO: 161171 - DNA, 20 bp, human
gtggcgggcgacgggagcac

SEQ ID NO: 161172 - DNA, 20 bp, human
ggctggctcgaggaaatcac

SEQ ID NO: 161173 - DNA, 20 bp, human
gctcgcagtagcttcaaccc

SEQ ID NO: 161174 - DNA, 20 bp, human
ggctcagggacgctcattcc

SEQ ID NO: 161175 - DNA, 20 bp, human
gggagtagaggagggaatcg

SEQ ID NO: 161176 - DNA, 20 bp, human
gtgcggctgcagaaagcaac

SEQ ID NO: 161177 - DNA, 20 bp, human
gatgagccagagggacacgc

SEQ ID NO: 161178 - DNA, 20 bp, human
ggcgcgccgcccttcaccag

SEQ ID NO: 161179 - DNA, 20 bp, human
gaccggcacagccctccccg

SEQ ID NO: 161180 - DNA, 20 bp, human
gaggagagctggccgagatg

SEQ ID NO: 161181 - DNA, 20 bp, human
gttcagcctctggtgaaggg

SEQ ID NO: 161182 - DNA, 20 bp, human
gggcgcgcttaggcaggcgg

SEQ ID NO: 161183 - DNA, 20 bp, human
ggagcgacccagcccgtggg

SEQ ID NO: 161184 - DNA, 20 bp, human
ggcgcagcgcgacggagagt

SEQ ID NO: 161185 - DNA, 20 bp, human
gccgccaggaccttaccctc

SEQ ID NO: 161186 - DNA, 20 bp, human
gcggtggcgcggaggatgga

SEQ ID NO: 161187 - DNA, 20 bp, human
gagctgcgcagcgggagcgt

SEQ ID NO: 161188 - DNA, 20 bp, human
gctgcgccccgccgagctgg

SEQ ID NO: 161189 - DNA, 20 bp, human
ggctccatccgccagctcgg

SEQ ID NO: 161190 - DNA, 20 bp, human
ggctgcgcgcagctgctcct

SEQ ID NO: 161191 - DNA, 20 bp, human
ggagcagctgcgcgcagcct

SEQ ID NO: 161192 - DNA, 20 bp, human
ggggacagccgagatggcgg

SEQ ID NO: 161193 - DNA, 20 bp, human
gtggacacggaggcgctagt

SEQ ID NO: 161194 - DNA, 20 bp, human
gggcggatggagctgcgcag

SEQ ID NO: 161195 - DNA, 20 bp, human
gcgagctctccccaggaccg

SEQ ID NO: 161196 - DNA, 20 bp, human
gtgaggttctgtgtatcccg

SEQ ID NO: 161197 - DNA, 20 bp, human
gctgcaggcttcagcaccgt

SEQ ID NO: 161198 - DNA, 20 bp, human
gggttctgtgtatcccgggg

SEQ ID NO: 161199 - DNA, 20 bp, human
gcaagatgtcggagacacgg

SEQ ID NO: 161200 - DNA, 20 bp, human
gagcaggatccgaaccccgg

SEQ ID NO: 161201 - DNA, 20 bp, human
gtcggatcctgctagtccag

SEQ ID NO: 161202 - DNA, 20 bp, human
gccccaagatgtcggagaca

SEQ ID NO: 161203 - DNA, 20 bp, human
gaaatcctgagcgcaccctg

SEQ ID NO: 161204 - DNA, 20 bp, human
gcttgaagaaggctaggggg

SEQ ID NO: 161205 - DNA, 20 bp, human
gtctgtgtatcccggggtgg

SEQ ID NO: 161206 - DNA, 20 bp, human
ggggtcaggcgggcccatac

SEQ ID NO: 161207 - DNA, 20 bp, human
gccagcccgcagtcctgagg

SEQ ID NO: 161208 - DNA, 20 bp, human
ggcggaccgcgcacaggcgg

SEQ ID NO: 161209 - DNA, 20 bp, human
ggcgcgcgcggaccgcgcac

SEQ ID NO: 161210 - DNA, 20 bp, human
gagggacggccgggcatcga

SEQ ID NO: 161211 - DNA, 20 bp, human
gcagatccggtgaccaagaa

SEQ ID NO: 161212 - DNA, 20 bp, human
gggtgacgtgtaaacagatc

SEQ ID NO: 161213 - DNA, 20 bp, human
gcgcgcggaccgcgcacagg

SEQ ID NO: 161214 - DNA, 20 bp, human
ggagcgggaagtaggaacgt

SEQ ID NO: 161215 - DNA, 20 bp, human
gcgacactcccggccccgaa

SEQ ID NO: 161216 - DNA, 20 bp, human
gctcccggcgacaagctcca

SEQ ID NO: 161217 - DNA, 20 bp, human
ggtgaggacctagagtgtaa

SEQ ID NO: 161218 - DNA, 20 bp, human
gagggcagggctgtccctct

SEQ ID NO: 161219 - DNA, 20 bp, human
gtccagtttggcgagagtcg

SEQ ID NO: 161220 - DNA, 20 bp, human
gctgccctggagcttgtcgc

SEQ ID NO: 161221 - DNA, 20 bp, human
gcagagtggcacctatgaag

SEQ ID NO: 161222 - DNA, 20 bp, human
ggggtcagggagactacacc

SEQ ID NO: 161223 - DNA, 20 bp, human
gggacctcccccccatgtta

SEQ ID NO: 161224 - DNA, 20 bp, human
gttgtgtctgaggaagtgct

SEQ ID NO: 161225 - DNA, 20 bp, human
gggaccacaagtagacattc

SEQ ID NO: 161226 - DNA, 20 bp, human
ggcggtgccaggccgggcgt

SEQ ID NO: 161227 - DNA, 20 bp, human
gcgtgggcgagagcacgaac

SEQ ID NO: 161228 - DNA, 20 bp, human
gacgtaaaccggctccgggt

SEQ ID NO: 161229 - DNA, 20 bp, human
gctagcgtcgcgcagggtcg

SEQ ID NO: 161230 - DNA, 20 bp, human
gggccccctagcgtcgcgca

SEQ ID NO: 161231 - DNA, 20 bp, human
gtggacctgtctctacgcag

SEQ ID NO: 161232 - DNA, 20 bp, human
gccgggcgccacccgacacc

SEQ ID NO: 161233 - DNA, 20 bp, human
gctcgacgctctcagcccgc

SEQ ID NO: 161234 - DNA, 20 bp, human
gaccgcgcggtgcaagaggc

SEQ ID NO: 161235 - DNA, 20 bp, human
gggatctggcacacgtaaac

SEQ ID NO: 161236 - DNA, 20 bp, human
ggagcgaggcgcgagaagga

SEQ ID NO: 161237 - DNA, 20 bp, human
gcgaggcgcgagaaggacgg

SEQ ID NO: 161238 - DNA, 20 bp, human
gcggaaccggagccggacag

SEQ ID NO: 161239 - DNA, 20 bp, human
gtgagagagcaacggaatgg

SEQ ID NO: 161240 - DNA, 20 bp, human
ggactgagagagcaacggaa

SEQ ID NO: 161241 - DNA, 20 bp, human
ggccagagcgaggcgcgaga

SEQ ID NO: 161242 - DNA, 20 bp, human
ggaaggacggcggcgtgagg

SEQ ID NO: 161243 - DNA, 20 bp, human
ggagcaacggaatggaggcg

SEQ ID NO: 161244 - DNA, 20 bp, human
gcggtcactgccgaccccac

SEQ ID NO: 161245 - DNA, 20 bp, human
gggcggaaacacaacctgca

SEQ ID NO: 161246 - DNA, 20 bp, human
gccatgcgggagtgtctagt

SEQ ID NO: 161247 - DNA, 20 bp, human
gtggctgtacacacgtgtat

SEQ ID NO: 161248 - DNA, 20 bp, human
gaggcccactcccctgctag

SEQ ID NO: 161249 - DNA, 20 bp, human
gacctctggtcaggactaca

SEQ ID NO: 161250 - DNA, 20 bp, human
gagcgcccatggaggaagtt

SEQ ID NO: 161251 - DNA, 20 bp, human
ggccccaccctgcttcaagg

SEQ ID NO: 161252 - DNA, 20 bp, human
gtgcgggagtgtctagtggg

SEQ ID NO: 161253 - DNA, 20 bp, human
gttccaccttgaagcagggt

SEQ ID NO: 161254 - DNA, 20 bp, human
gtggtcaggactacagggag

SEQ ID NO: 161255 - DNA, 20 bp, human
ggagcagcaaacaactgctt

SEQ ID NO: 161256 - DNA, 20 bp, human
gccgtggcggctggaggtag

SEQ ID NO: 161257 - DNA, 20 bp, human
gtggcggctggaggtagcgg

SEQ ID NO: 161258 - DNA, 20 bp, human
gggatgcagtagcccccagg

SEQ ID NO: 161259 - DNA, 20 bp, human
gcgcgtccgggccggtgagg

SEQ ID NO: 161260 - DNA, 20 bp, human
ggccccccgcgccccctcac

SEQ ID NO: 161261 - DNA, 20 bp, human
gcggtgtcaggtgtgtgagg

SEQ ID NO: 161262 - DNA, 20 bp, human
gggacagactcaggtgatgt

SEQ ID NO: 161263 - DNA, 20 bp, human
ggccggggacaaggccccag

SEQ ID NO: 161264 - DNA, 20 bp, human
ggtcgggctgaactgaggtg

SEQ ID NO: 161265 - DNA, 20 bp, human
ggctgacgcttgggcccccc

SEQ ID NO: 161266 - DNA, 20 bp, human
ggggctcgatggctacgtgg

SEQ ID NO: 161267 - DNA, 20 bp, human
gccgggcccggaagaccgcg

SEQ ID NO: 161268 - DNA, 20 bp, human
ggtccccaggtgatcgacaa

SEQ ID NO: 161269 - DNA, 20 bp, human
ggggggccgtccctactcca

SEQ ID NO: 161270 - DNA, 20 bp, human
ggaaccgggagaccggacgg

SEQ ID NO: 161271 - DNA, 20 bp, human
gtagccatcgagccccgacc

SEQ ID NO: 161272 - DNA, 20 bp, human
ggactcggggccctggagta

SEQ ID NO: 161273 - DNA, 20 bp, human
ggcacggtggcgagctccag

SEQ ID NO: 161274 - DNA, 20 bp, human
ggccccaggcccgagccacg

SEQ ID NO: 161275 - DNA, 20 bp, human
gtgcactctgggggccatag

SEQ ID NO: 161276 - DNA, 20 bp, human
gggtagcccagtcgagatgg

SEQ ID NO: 161277 - DNA, 20 bp, human
gagatggaggaagatgcgac

SEQ ID NO: 161278 - DNA, 20 bp, human
gggaacgacggatagactgg

SEQ ID NO: 161279 - DNA, 20 bp, human
gaccggtagcccagtcgaga

SEQ ID NO: 161280 - DNA, 20 bp, human
gtcccacggagtatcttgag

SEQ ID NO: 161281 - DNA, 20 bp, human
gctgtgatgagggatcacgt

SEQ ID NO: 161282 - DNA, 20 bp, human
gtcctctcaagatactccgt

SEQ ID NO: 161283 - DNA, 20 bp, human
gcaggacagaggctgcataa

SEQ ID NO: 161284 - DNA, 20 bp, human
ggggatcacgtgggtaccta

SEQ ID NO: 161285 - DNA, 20 bp, human
gggaagatgcgaccggcaga

SEQ ID NO: 161286 - DNA, 20 bp, human
ggaggtagcgtggccaccag

SEQ ID NO: 161287 - DNA, 20 bp, human
gcttcccaggggaaagatag

SEQ ID NO: 161288 - DNA, 20 bp, human
ggaactggtggctccagcag

SEQ ID NO: 161289 - DNA, 20 bp, human
ggtgcagagtacagtctcac

SEQ ID NO: 161290 - DNA, 20 bp, human
gtcctcagagcgaggatcat

SEQ ID NO: 161291 - DNA, 20 bp, human
gtggccgggctcggggatca

SEQ ID NO: 161292 - DNA, 20 bp, human
gagtgcgtgttgatctgcaa

SEQ ID NO: 161293 - DNA, 20 bp, human
gcctggaggggcccgaccat

SEQ ID NO: 161294 - DNA, 20 bp, human
gggctgggcctaccccctgg

SEQ ID NO: 161295 - DNA, 20 bp, human
ggcttgcctcttgctgacta

SEQ ID NO: 161296 - DNA, 20 bp, human
gagtcgtcacccagtggccc

SEQ ID NO: 161297 - DNA, 20 bp, human
gcgccgcggatgcatcgcag

SEQ ID NO: 161298 - DNA, 20 bp, human
gccggagcccaccaccaccg

SEQ ID NO: 161299 - DNA, 20 bp, human
gggctgccggggatatctgg

SEQ ID NO: 161300 - DNA, 20 bp, human
gcggcggcggcagtgtgcag

SEQ ID NO: 161301 - DNA, 20 bp, human
gcgataggatgagaaggaat

SEQ ID NO: 161302 - DNA, 20 bp, human
gagcacacacagcttcccgt

SEQ ID NO: 161303 - DNA, 20 bp, human
ggctgtgtgtgcttaggtcg

SEQ ID NO: 161304 - DNA, 20 bp, human
gccgtacgaaggccccacgg

SEQ ID NO: 161305 - DNA, 20 bp, human
gcagggatgaggggttactg

SEQ ID NO: 161306 - DNA, 20 bp, human
ggtggcaccaaagccctctc

SEQ ID NO: 161307 - DNA, 20 bp, human
gccccaggagaggatcgaga

SEQ ID NO: 161308 - DNA, 20 bp, human
gcaccaaagccctctcaggc

SEQ ID NO: 161309 - DNA, 20 bp, human
gaggagaggatcgagagggt

SEQ ID NO: 161310 - DNA, 20 bp, human
gggtgattgagtcactggaa

SEQ ID NO: 161311 - DNA, 20 bp, human
gggcatgggggccgctcggg

SEQ ID NO: 161312 - DNA, 20 bp, human
gaggtaacagacaggatggt

SEQ ID NO: 161313 - DNA, 20 bp, human
gggctgggagtccttggtgt

SEQ ID NO: 161314 - DNA, 20 bp, human
gtccatgaacaaggtgtggc

SEQ ID NO: 161315 - DNA, 20 bp, human
ggccatcggaggtaacagac

SEQ ID NO: 161316 - DNA, 20 bp, human
gcccgcgcagccggtgactg

SEQ ID NO: 161317 - DNA, 20 bp, human
gcgcgccgcaagaccgaagt

SEQ ID NO: 161318 - DNA, 20 bp, human
gcgccgccaggagcctccat

SEQ ID NO: 161319 - DNA, 20 bp, human
gcgccctccggcacttggag

SEQ ID NO: 161320 - DNA, 20 bp, human
ggcgggatggcagcgcacag

SEQ ID NO: 161321 - DNA, 20 bp, human
gcaactgcaagaccaccagg

SEQ ID NO: 161322 - DNA, 20 bp, human
gggccccgagatccccctgg

SEQ ID NO: 161323 - DNA, 20 bp, human
gtgccccactgactctaagt

SEQ ID NO: 161324 - DNA, 20 bp, human
ggctcgctctctctgaccgg

SEQ ID NO: 161325 - DNA, 20 bp, human
gcacctctccaagtgccgga

SEQ ID NO: 161326 - DNA, 20 bp, human
gactgctgcaggacgggact

SEQ ID NO: 161327 - DNA, 20 bp, human
gaggcagactgctgcaggac

SEQ ID NO: 161328 - DNA, 20 bp, human
gcaggctctcggcatctccg

SEQ ID NO: 161329 - DNA, 20 bp, human
ggagtctaggaaggggccgg

SEQ ID NO: 161330 - DNA, 20 bp, human
gaagtagtgagtctaggaag

SEQ ID NO: 161331 - DNA, 20 bp, human
ggctctcggcatctccgagg

SEQ ID NO: 161332 - DNA, 20 bp, human
gccccgggcctgggcgtcaa

SEQ ID NO: 161333 - DNA, 20 bp, human
ggaacagaagtcaaactggt

SEQ ID NO: 161334 - DNA, 20 bp, human
ggacctgaagtagtgagtct

SEQ ID NO: 161335 - DNA, 20 bp, human
gggagcccaaccaggaagtg

SEQ ID NO: 161336 - DNA, 20 bp, human
gtgccctggcccggtccctg

SEQ ID NO: 161337 - DNA, 20 bp, human
gctgtgaccgaccccgaggt

SEQ ID NO: 161338 - DNA, 20 bp, human
gggcgctgatgggtgagtgt

SEQ ID NO: 161339 - DNA, 20 bp, human
ggcgccggcgtcccgcagga

SEQ ID NO: 161340 - DNA, 20 bp, human
ggcgctgcgccccaacctcg

SEQ ID NO: 161341 - DNA, 20 bp, human
ggcacgctgaggccaccgta

SEQ ID NO: 161342 - DNA, 20 bp, human
gggccaccgtacggcatcaa

SEQ ID NO: 161343 - DNA, 20 bp, human
ggtgagtgtgggacgagcgt

SEQ ID NO: 161344 - DNA, 20 bp, human
gcagggcgcgcccgaatgaa

SEQ ID NO: 161345 - DNA, 20 bp, human
gacgagcgtggggaagcacc

SEQ ID NO: 161346 - DNA, 20 bp, human
ggcgccggcggcgatgggtt

SEQ ID NO: 161347 - DNA, 20 bp, human
gcggcttgctcgcagtcctg

SEQ ID NO: 161348 - DNA, 20 bp, human
gagcaagccgggacctgcgc

SEQ ID NO: 161349 - DNA, 20 bp, human
gtcgcagtcctgcggggcgc

SEQ ID NO: 161350 - DNA, 20 bp, human
gttccccaacccatcgccgc

SEQ ID NO: 161351 - DNA, 20 bp, human
gcattcagaaggtcctcttt

SEQ ID NO: 161352 - DNA, 20 bp, human
gccgagtccattttgataac

SEQ ID NO: 161353 - DNA, 20 bp, human
gttaagatctttctcatgaa

SEQ ID NO: 161354 - DNA, 20 bp, human
gcagtcctgcggggcgccgg

SEQ ID NO: 161355 - DNA, 20 bp, human
gtgcggggcgccggcggcga

SEQ ID NO: 161356 - DNA, 20 bp, human
gcagcgacagtcgcagtcac

SEQ ID NO: 161357 - DNA, 20 bp, human
gggacaggcggggtctatgg

SEQ ID NO: 161358 - DNA, 20 bp, human
gacgggaacggaagtgatag

SEQ ID NO: 161359 - DNA, 20 bp, human
ggacaagcggacggacccgg

SEQ ID NO: 161360 - DNA, 20 bp, human
ggttgtgcgtcgcttaagtg

SEQ ID NO: 161361 - DNA, 20 bp, human
ggtcgcttaagtgagggcgg

SEQ ID NO: 161362 - DNA, 20 bp, human
gcgactgtcgctgctttctg

SEQ ID NO: 161363 - DNA, 20 bp, human
gtgcgtcgcttaagtgaggg

SEQ ID NO: 161364 - DNA, 20 bp, human
gttaagtgagggcggcggat

SEQ ID NO: 161365 - DNA, 20 bp, human
gtgaatggaggataaaatca

SEQ ID NO: 161366 - DNA, 20 bp, human
ggtcctttcggtccaggcgg

SEQ ID NO: 161367 - DNA, 20 bp, human
ggacagccggagaacgggcg

SEQ ID NO: 161368 - DNA, 20 bp, human
gagccgcagggtccgtccat

SEQ ID NO: 161369 - DNA, 20 bp, human
ggggaggacagccggagaac

SEQ ID NO: 161370 - DNA, 20 bp, human
gtgccgccgcctggaccgaa

SEQ ID NO: 161371 - DNA, 20 bp, human
ggcagggcgggcagcggaac

SEQ ID NO: 161372 - DNA, 20 bp, human
gcggccgctccggggactag

SEQ ID NO: 161373 - DNA, 20 bp, human
gggggaaatgcggcacggat

SEQ ID NO: 161374 - DNA, 20 bp, human
gccgggtcgggcggggacgt

SEQ ID NO: 161375 - DNA, 20 bp, human
gagcggaacgggaggacagc

SEQ ID NO: 161376 - DNA, 20 bp, human
ggaagttgagggcttgagtg

SEQ ID NO: 161377 - DNA, 20 bp, human
ggggctgaaggtctgagata

SEQ ID NO: 161378 - DNA, 20 bp, human
gatacggccaagggtacgtg

SEQ ID NO: 161379 - DNA, 20 bp, human
gatcgcgaagtcccagagac

SEQ ID NO: 161380 - DNA, 20 bp, human
ggggaagtagcgaatgacgt

SEQ ID NO: 161381 - DNA, 20 bp, human
ggggtacacgaagcagaggg

SEQ ID NO: 161382 - DNA, 20 bp, human
gtacttcggcgtgtacgata

SEQ ID NO: 161383 - DNA, 20 bp, human
gcagcgggtacacgaagcag

SEQ ID NO: 161384 - DNA, 20 bp, human
ggtgtgttgagcccgtctct

SEQ ID NO: 161385 - DNA, 20 bp, human
gtctaccgggcggcctactt

SEQ ID NO: 161386 - DNA, 20 bp, human
gagggccctgggatgacgag

SEQ ID NO: 161387 - DNA, 20 bp, human
ggcagtgagcccagcctggt

SEQ ID NO: 161388 - DNA, 20 bp, human
gtacctgagggagtcctcac

SEQ ID NO: 161389 - DNA, 20 bp, human
gcgaggaccgcagggccctc

SEQ ID NO: 161390 - DNA, 20 bp, human
gtctcctggcgggtgtgttg

SEQ ID NO: 161391 - DNA, 20 bp, human
gggggctggcaagaccaccg

SEQ ID NO: 161392 - DNA, 20 bp, human
gcgcgagcagcggggagagt

SEQ ID NO: 161393 - DNA, 20 bp, human
gactggagctcgcacaccct

SEQ ID NO: 161394 - DNA, 20 bp, human
ggagtcctcacaggcgcgga

SEQ ID NO: 161395 - DNA, 20 bp, human
gtgtgcgagctccagtctcc

SEQ ID NO: 161396 - DNA, 20 bp, human
ggcaccttgggcggagagag

SEQ ID NO: 161397 - DNA, 20 bp, human
gcgggagcacaagctctaga

SEQ ID NO: 161398 - DNA, 20 bp, human
gctcagggaagctctcaccg

SEQ ID NO: 161399 - DNA, 20 bp, human
gggttcctaccgtcgagggt

SEQ ID NO: 161400 - DNA, 20 bp, human
ggttagggcctctcaccctg

SEQ ID NO: 161401 - DNA, 20 bp, human
gcctgagcctggtcgccaag

SEQ ID NO: 161402 - DNA, 20 bp, human
gcggtggccggagtgaccgt

SEQ ID NO: 161403 - DNA, 20 bp, human
gcgcgcttgttccgggacag

SEQ ID NO: 161404 - DNA, 20 bp, human
gaggcgccacgcccctgtcc

SEQ ID NO: 161405 - DNA, 20 bp, human
gtaagaccgggcggagttgg

SEQ ID NO: 161406 - DNA, 20 bp, human
gattcctgcggacccagctg

SEQ ID NO: 161407 - DNA, 20 bp, human
gccaagctgcatcgccgagt

SEQ ID NO: 161408 - DNA, 20 bp, human
gctgtccccggcgattcctg

SEQ ID NO: 161409 - DNA, 20 bp, human
gggccacggactcacccact

SEQ ID NO: 161410 - DNA, 20 bp, human
ggtgagtccgtggcccgcga

SEQ ID NO: 161411 - DNA, 20 bp, human
gagaagcaactagaactcca

SEQ ID NO: 161412 - DNA, 20 bp, human
gggccgcggggacccgggta

SEQ ID NO: 161413 - DNA, 20 bp, human
gagaggcgcccggttaattc

SEQ ID NO: 161414 - DNA, 20 bp, human
gctgggtccgcaggaatcgc

SEQ ID NO: 161415 - DNA, 20 bp, human
gccgctggctccggatcctg

SEQ ID NO: 161416 - DNA, 20 bp, human
gaccggcgaagagatgccgg

SEQ ID NO: 161417 - DNA, 20 bp, human
ggggcaggcccggatcacca

SEQ ID NO: 161418 - DNA, 20 bp, human
gcggccgcgggcgtttacac

SEQ ID NO: 161419 - DNA, 20 bp, human
ggggcagccgccagccagac

SEQ ID NO: 161420 - DNA, 20 bp, human
gcgcaccggcgaagagatgc

SEQ ID NO: 161421 - DNA, 20 bp, human
gcggtagaatcccagatcag

SEQ ID NO: 161422 - DNA, 20 bp, human
ggacccgagaggtgagaaga

SEQ ID NO: 161423 - DNA, 20 bp, human
gcgcacgccccgctccacgg

SEQ ID NO: 161424 - DNA, 20 bp, human
gcacctcagtcaggccacgg

SEQ ID NO: 161425 - DNA, 20 bp, human
gagaagagggaagcggacca

SEQ ID NO: 161426 - DNA, 20 bp, human
gcagagcctgtagacctgag

SEQ ID NO: 161427 - DNA, 20 bp, human
ggattgtctgctctgagggt

SEQ ID NO: 161428 - DNA, 20 bp, human
gtgaggagcttctgcaacag

SEQ ID NO: 161429 - DNA, 20 bp, human
gtctaagttctagttctaag

SEQ ID NO: 161430 - DNA, 20 bp, human
gaggcagtgtccatccactc

SEQ ID NO: 161431 - DNA, 20 bp, human
gtccatccactcaggtctac

SEQ ID NO: 161432 - DNA, 20 bp, human
gcacagagtatgtgtcaggt

SEQ ID NO: 161433 - DNA, 20 bp, human
gcatagggatgtctatatat

SEQ ID NO: 161434 - DNA, 20 bp, human
gctataaagtcagatttgag

SEQ ID NO: 161435 - DNA, 20 bp, human
ggatagattgtctgctctga

SEQ ID NO: 161436 - DNA, 20 bp, human
gagcccgggccgggcggtgt

SEQ ID NO: 161437 - DNA, 20 bp, human
gggcggtgtgggcatcttca

SEQ ID NO: 161438 - DNA, 20 bp, human
ggcgcttgcaaggctggaag

SEQ ID NO: 161439 - DNA, 20 bp, human
gtccgcgggtccccaagagg

SEQ ID NO: 161440 - DNA, 20 bp, human
ggccaggcgtggaaccgtca

SEQ ID NO: 161441 - DNA, 20 bp, human
ggtagtccgcggggcattcc

SEQ ID NO: 161442 - DNA, 20 bp, human
gctgccccagcccctcggtt

SEQ ID NO: 161443 - DNA, 20 bp, human
gactcccggggaggcctcga

SEQ ID NO: 161444 - DNA, 20 bp, human
gcagctgtcgcagccctctc

SEQ ID NO: 161445 - DNA, 20 bp, human
gggcccgggctccactcccg

SEQ ID NO: 161446 - DNA, 20 bp, human
gggcagcgcgcgcgtcgaag

SEQ ID NO: 161447 - DNA, 20 bp, human
gctcctagagccgcacctgg

SEQ ID NO: 161448 - DNA, 20 bp, human
ggcgcgcgtcgaagaggcag

SEQ ID NO: 161449 - DNA, 20 bp, human
gtctccggaaagagggccag

SEQ ID NO: 161450 - DNA, 20 bp, human
gggcaggtcagccctgtcac

SEQ ID NO: 161451 - DNA, 20 bp, human
gttagcaccgaagggattcg

SEQ ID NO: 161452 - DNA, 20 bp, human
ggggctggattagcaccgaa

SEQ ID NO: 161453 - DNA, 20 bp, human
gcgacgcgcgcgctgcctcc

SEQ ID NO: 161454 - DNA, 20 bp, human
ggcaccgaagggattcgagg

SEQ ID NO: 161455 - DNA, 20 bp, human
ggggcccgtctccggaaaga

SEQ ID NO: 161456 - DNA, 20 bp, human
ggcgctcactccgggatcag

SEQ ID NO: 161457 - DNA, 20 bp, human
gggacaacttgcgagccatg

SEQ ID NO: 161458 - DNA, 20 bp, human
gcagcaggagcagcccgcac

SEQ ID NO: 161459 - DNA, 20 bp, human
ggccgccttccggagcgtag

SEQ ID NO: 161460 - DNA, 20 bp, human
ggctagaggccgctacgctc

SEQ ID NO: 161461 - DNA, 20 bp, human
ggctcgcaagttgtccggtg

SEQ ID NO: 161462 - DNA, 20 bp, human
ggaggccgctacgctccgga

SEQ ID NO: 161463 - DNA, 20 bp, human
gccctcgggcgtcacaccag

SEQ ID NO: 161464 - DNA, 20 bp, human
gctcctgctgctcgagctag

SEQ ID NO: 161465 - DNA, 20 bp, human
gctgaaagcagctagtccac

SEQ ID NO: 161466 - DNA, 20 bp, human
ggtggtgcccaatccaaaat

SEQ ID NO: 161467 - DNA, 20 bp, human
ggtgtgaagacattatacag

SEQ ID NO: 161468 - DNA, 20 bp, human
gactgtgtctgggataatgt

SEQ ID NO: 161469 - DNA, 20 bp, human
gataatgtcttcacactggg

SEQ ID NO: 161470 - DNA, 20 bp, human
gggagcttggcattgaaagg

SEQ ID NO: 161471 - DNA, 20 bp, human
gaatgggttcagtgttaagt

SEQ ID NO: 161472 - DNA, 20 bp, human
gcgactgcccattttggatt

SEQ ID NO: 161473 - DNA, 20 bp, human
gattggagcttggcattgaa

SEQ ID NO: 161474 - DNA, 20 bp, human
gcattatacagtggtgtaga

SEQ ID NO: 161475 - DNA, 20 bp, human
gaccttgaattcttatctga

SEQ ID NO: 161476 - DNA, 20 bp, human
gagccaggcgagagccgtgt

SEQ ID NO: 161477 - DNA, 20 bp, human
gcccgcgggctaggccacaa

SEQ ID NO: 161478 - DNA, 20 bp, human
gcgggcgctgggatcccaca

SEQ ID NO: 161479 - DNA, 20 bp, human
gctgcggacgcggataccgg

SEQ ID NO: 161480 - DNA, 20 bp, human
ggcgctgcggacgcggatac

SEQ ID NO: 161481 - DNA, 20 bp, human
gcctcaggaggaaatggatg

SEQ ID NO: 161482 - DNA, 20 bp, human
gcgggcagtcaggcctcagg

SEQ ID NO: 161483 - DNA, 20 bp, human
gggctaggccacaacggctc

SEQ ID NO: 161484 - DNA, 20 bp, human
ggcagagccaggcacgccgt

SEQ ID NO: 161485 - DNA, 20 bp, human
gatcccacacggctctcgcc

SEQ ID NO: 161486 - DNA, 20 bp, human
gcagccgaaaggtgttcctg

SEQ ID NO: 161487 - DNA, 20 bp, human
gggctgctctcagactccag

SEQ ID NO: 161488 - DNA, 20 bp, human
gtgggtgagcaaagccggct

SEQ ID NO: 161489 - DNA, 20 bp, human
gaccagtgggtgagcaaagc

SEQ ID NO: 161490 - DNA, 20 bp, human
gtggggagcgggcagccgaa

SEQ ID NO: 161491 - DNA, 20 bp, human
gctgggtggggcttaccagt

SEQ ID NO: 161492 - DNA, 20 bp, human
ggcgaggcaaaggcctccga

SEQ ID NO: 161493 - DNA, 20 bp, human
ggacccaaagggctcctcag

SEQ ID NO: 161494 - DNA, 20 bp, human
ggagccctttcacacacctc

SEQ ID NO: 161495 - DNA, 20 bp, human
gtcctcagaggggaagggct

SEQ ID NO: 161496 - DNA, 20 bp, human
gacccggagcccgcatcctg

SEQ ID NO: 161497 - DNA, 20 bp, human
ggtctctgagggggctacag

SEQ ID NO: 161498 - DNA, 20 bp, human
gagcgccagcgagaccaccg

SEQ ID NO: 161499 - DNA, 20 bp, human
gcctgagagggtgaccagtt

SEQ ID NO: 161500 - DNA, 20 bp, human
gggaagatgagtagcctcta

SEQ ID NO: 161501 - DNA, 20 bp, human
gctgccgcgctccaggtcca

SEQ ID NO: 161502 - DNA, 20 bp, human
gaacgcccgaagcaccttag

SEQ ID NO: 161503 - DNA, 20 bp, human
gcccagccctggacggatcc

SEQ ID NO: 161504 - DNA, 20 bp, human
gcggcgctcggcgtgtacgt

SEQ ID NO: 161505 - DNA, 20 bp, human
gtgttgccgggatccgtcca

SEQ ID NO: 161506 - DNA, 20 bp, human
gcgggctcgcgtgagatgaa

SEQ ID NO: 161507 - DNA, 20 bp, human
ggtaggtgagagtctcgtcg

SEQ ID NO: 161508 - DNA, 20 bp, human
gacacctgctccggagcccg

SEQ ID NO: 161509 - DNA, 20 bp, human
gcagtcctgcccggaacccc

SEQ ID NO: 161510 - DNA, 20 bp, human
gcacctacgcgcaggtggac

SEQ ID NO: 161511 - DNA, 20 bp, human
gtccgctgcaggtaccgccg

SEQ ID NO: 161512 - DNA, 20 bp, human
gtatgtcctggaagaagtat

SEQ ID NO: 161513 - DNA, 20 bp, human
gcgccggtccacctgcgcgt

SEQ ID NO: 161514 - DNA, 20 bp, human
ggccggcgcgcaccatcctg

SEQ ID NO: 161515 - DNA, 20 bp, human
ggggccctctgtcccagcga

SEQ ID NO: 161516 - DNA, 20 bp, human
gttttcggaagggaggatca

SEQ ID NO: 161517 - DNA, 20 bp, human
gcccacacccgcactcctcc

SEQ ID NO: 161518 - DNA, 20 bp, human
ggcggagcgcgagagtaaca

SEQ ID NO: 161519 - DNA, 20 bp, human
gcggcgctttagctactcag

SEQ ID NO: 161520 - DNA, 20 bp, human
ggtcccagcctagcgcacgt

SEQ ID NO: 161521 - DNA, 20 bp, human
gcagcctagcgcacgtagga

SEQ ID NO: 161522 - DNA, 20 bp, human
gcctcccttccgaaaaccta

SEQ ID NO: 161523 - DNA, 20 bp, human
gaaccagacggtgccgatag

SEQ ID NO: 161524 - DNA, 20 bp, human
ggggactggggacccgacgg

SEQ ID NO: 161525 - DNA, 20 bp, human
gacccggaaggtcccgaggg

SEQ ID NO: 161526 - DNA, 20 bp, human
ggcagcgtagacagcgtgag

SEQ ID NO: 161527 - DNA, 20 bp, human
gacatgtgccaggccgagtc

SEQ ID NO: 161528 - DNA, 20 bp, human
gtgctgtctaggggcgaggg

SEQ ID NO: 161529 - DNA, 20 bp, human
gcggtgcggaccccaggtgg

SEQ ID NO: 161530 - DNA, 20 bp, human
ggccggcttcggggaaggtg

SEQ ID NO: 161531 - DNA, 20 bp, human
gcgccgggtgagcatagacc

SEQ ID NO: 161532 - DNA, 20 bp, human
gacggagccgggtctcagca

SEQ ID NO: 161533 - DNA, 20 bp, human
gctgttaccttgctgtctag

SEQ ID NO: 161534 - DNA, 20 bp, human
gggtaacagtgcgtctgtcg

SEQ ID NO: 161535 - DNA, 20 bp, human
gaccgggctggtgggttccc

SEQ ID NO: 161536 - DNA, 20 bp, human
gtccctccttgcagatggaa

SEQ ID NO: 161537 - DNA, 20 bp, human
ggtgtccacgcacgaggtgg

SEQ ID NO: 161538 - DNA, 20 bp, human
ggagccaagcgcgaacgtgc

SEQ ID NO: 161539 - DNA, 20 bp, human
gcgcccttccatctgcaagg

SEQ ID NO: 161540 - DNA, 20 bp, human
gtaggttgtgagggtaaggt

SEQ ID NO: 161541 - DNA, 20 bp, human
ggagcccagggtggcctggt

SEQ ID NO: 161542 - DNA, 20 bp, human
gccccggccagactttcgac

SEQ ID NO: 161543 - DNA, 20 bp, human
gtgtgaccacgcccccggga

SEQ ID NO: 161544 - DNA, 20 bp, human
gtacaggtggggaagtgcta

SEQ ID NO: 161545 - DNA, 20 bp, human
gctggatgcggatgaaatgg

SEQ ID NO: 161546 - DNA, 20 bp, human
ggaggccacggaccgagacg

SEQ ID NO: 161547 - DNA, 20 bp, human
gcgcaccagaaaccgcgcag

SEQ ID NO: 161548 - DNA, 20 bp, human
gggtttctcgcaggagtcgg

SEQ ID NO: 161549 - DNA, 20 bp, human
gtcagggccagcgggttcca

SEQ ID NO: 161550 - DNA, 20 bp, human
gtcctgagaaacagaatcgt

SEQ ID NO: 161551 - DNA, 20 bp, human
gccctcacagagaagaggtc

SEQ ID NO: 161552 - DNA, 20 bp, human
gtccggggcgaagcgggatg

SEQ ID NO: 161553 - DNA, 20 bp, human
gccgaaaaggtcgccccaag

SEQ ID NO: 161554 - DNA, 20 bp, human
gtaatcttcagcaccacttg

SEQ ID NO: 161555 - DNA, 20 bp, human
gagattaagcttgggtcact

SEQ ID NO: 161556 - DNA, 20 bp, human
gtggatgctgacagaaacaa

SEQ ID NO: 161557 - DNA, 20 bp, human
ggcgggactgaagaaaggag

SEQ ID NO: 161558 - DNA, 20 bp, human
gcctggagctgtcctcgaag

SEQ ID NO: 161559 - DNA, 20 bp, human
gagggcccacaacgatgtga

SEQ ID NO: 161560 - DNA, 20 bp, human
gggttataagctgcactgca

SEQ ID NO: 161561 - DNA, 20 bp, human
gagacagtagtgctgctcag

SEQ ID NO: 161562 - DNA, 20 bp, human
ggggtggccaccacagggat

SEQ ID NO: 161563 - DNA, 20 bp, human
ggcactactgtctccatggg

SEQ ID NO: 161564 - DNA, 20 bp, human
gctccatgggtggccaccac

SEQ ID NO: 161565 - DNA, 20 bp, human
gcttggcgaagaccccttcg

SEQ ID NO: 161566 - DNA, 20 bp, human
gggtcgctctcagagagaga

SEQ ID NO: 161567 - DNA, 20 bp, human
gagggaagcacacgtctctg

SEQ ID NO: 161568 - DNA, 20 bp, human
gtggagtagggcaccaccca

SEQ ID NO: 161569 - DNA, 20 bp, human
gggaggtgcaacatccttaa

SEQ ID NO: 161570 - DNA, 20 bp, human
gctggcatttggatggagta

SEQ ID NO: 161571 - DNA, 20 bp, human
gtatgtcagcctaactgggc

SEQ ID NO: 161572 - DNA, 20 bp, human
gttcttgcaatggaaagtcc

SEQ ID NO: 161573 - DNA, 20 bp, human
gtgagtatgtcagcctaact

SEQ ID NO: 161574 - DNA, 20 bp, human
gagctgggtccaacctgctt

SEQ ID NO: 161575 - DNA, 20 bp, human
gacagcagcgcacacagaag

SEQ ID NO: 161576 - DNA, 20 bp, human
gcacaagctggggtaagtaa

SEQ ID NO: 161577 - DNA, 20 bp, human
gcactgatgagttctctctg

SEQ ID NO: 161578 - DNA, 20 bp, human
ggaatcaattccacaagctg

SEQ ID NO: 161579 - DNA, 20 bp, human
gccctctggctcctcagtga

SEQ ID NO: 161580 - DNA, 20 bp, human
gggtaagtaaaggtgtttgg

SEQ ID NO: 161581 - DNA, 20 bp, human
gttctttcagtccttcactg

SEQ ID NO: 161582 - DNA, 20 bp, human
gaattagggccttcctgact

SEQ ID NO: 161583 - DNA, 20 bp, human
gcttatgctacattatagtc

SEQ ID NO: 161584 - DNA, 20 bp, human
gtataatgtagcataagaat

SEQ ID NO: 161585 - DNA, 20 bp, human
gaagtaaaggtgtttggggg

SEQ ID NO: 161586 - DNA, 20 bp, human
gtgccaaggggctaaggaaa

SEQ ID NO: 161587 - DNA, 20 bp, human
gaggtccctgtaacagcagg

SEQ ID NO: 161588 - DNA, 20 bp, human
gaaagccacctgctgttaca

SEQ ID NO: 161589 - DNA, 20 bp, human
gggcacagcttgcttcagtt

SEQ ID NO: 161590 - DNA, 20 bp, human
gctgagggctacagcaacgt

SEQ ID NO: 161591 - DNA, 20 bp, human
gtcccttctggctcacagca

SEQ ID NO: 161592 - DNA, 20 bp, human
gacccctgctgtgagccaga

SEQ ID NO: 161593 - DNA, 20 bp, human
gcgatgtgttgtgatcccta

SEQ ID NO: 161594 - DNA, 20 bp, human
ggtgtcagccctagtcattc

SEQ ID NO: 161595 - DNA, 20 bp, human
gttctgacatcagcagagac

SEQ ID NO: 161596 - DNA, 20 bp, human
gcctccgccagcgcagtcag

SEQ ID NO: 161597 - DNA, 20 bp, human
gagcgcgcggatctcagcgc

SEQ ID NO: 161598 - DNA, 20 bp, human
ggcgctggcggaggggtatg

SEQ ID NO: 161599 - DNA, 20 bp, human
gaatgtgccccggcgggaga

SEQ ID NO: 161600 - DNA, 20 bp, human
ggccagcgcagtcagcggca

SEQ ID NO: 161601 - DNA, 20 bp, human
gggaggtgcaggctcgcgag

SEQ ID NO: 161602 - DNA, 20 bp, human
ggccgtgccgctgactgcgc

SEQ ID NO: 161603 - DNA, 20 bp, human
gtggctcccgggcctaaaac

SEQ ID NO: 161604 - DNA, 20 bp, human
gcagcttccctctcccgccg

SEQ ID NO: 161605 - DNA, 20 bp, human
gatctggtcggtatcaggga

SEQ ID NO: 161606 - DNA, 20 bp, human
gtccgcccggcggcccacac

SEQ ID NO: 161607 - DNA, 20 bp, human
gcagatgtcccaggaacata

SEQ ID NO: 161608 - DNA, 20 bp, human
gtggccccagccccgagatg

SEQ ID NO: 161609 - DNA, 20 bp, human
gatgaggagggagagaacta

SEQ ID NO: 161610 - DNA, 20 bp, human
gtgtcccaggaacatagggt

SEQ ID NO: 161611 - DNA, 20 bp, human
ggggccgccgggcggaagag

SEQ ID NO: 161612 - DNA, 20 bp, human
gagcccgcgccgggcctgac

SEQ ID NO: 161613 - DNA, 20 bp, human
gcccaggaacatagggtagg

SEQ ID NO: 161614 - DNA, 20 bp, human
gccgcccggcagcgtgagaa

SEQ ID NO: 161615 - DNA, 20 bp, human
ggggctgcgctctccagctg

SEQ ID NO: 161616 - DNA, 20 bp, human
gtcgcacaggtagcctcggg

SEQ ID NO: 161617 - DNA, 20 bp, human
gcgccctgcaccggaatctg

SEQ ID NO: 161618 - DNA, 20 bp, human
ggagtcgcacaggtagcctc

SEQ ID NO: 161619 - DNA, 20 bp, human
gggtagctgtggggatcggt

SEQ ID NO: 161620 - DNA, 20 bp, human
gcggtgggaaggtcaccccg

SEQ ID NO: 161621 - DNA, 20 bp, human
gagggcggctggagtcgcac

SEQ ID NO: 161622 - DNA, 20 bp, human
gcaggccaccccctccggag

SEQ ID NO: 161623 - DNA, 20 bp, human
gccacagctaccacctggtc

SEQ ID NO: 161624 - DNA, 20 bp, human
ggttgtagtccgctccggag

SEQ ID NO: 161625 - DNA, 20 bp, human
ggaagctgatcccgaccagg

SEQ ID NO: 161626 - DNA, 20 bp, human
ggcgcacggccaggaccact

SEQ ID NO: 161627 - DNA, 20 bp, human
ggctcgggctcttccggcta

SEQ ID NO: 161628 - DNA, 20 bp, human
gctgccaagcccagtggtcc

SEQ ID NO: 161629 - DNA, 20 bp, human
gggccgtgcgccggaggcag

SEQ ID NO: 161630 - DNA, 20 bp, human
ggtagggctaacctgtggga

SEQ ID NO: 161631 - DNA, 20 bp, human
ggaaggcactgggaagcgca

SEQ ID NO: 161632 - DNA, 20 bp, human
gcagcggcgacagtaagtgc

SEQ ID NO: 161633 - DNA, 20 bp, human
ggctggtagggctaacctgt

SEQ ID NO: 161634 - DNA, 20 bp, human
gggcgacagtaagtgcgggc

SEQ ID NO: 161635 - DNA, 20 bp, human
gtctcctgggctgtgaaccg

SEQ ID NO: 161636 - DNA, 20 bp, human
gcgggccgggccgaggtaag

SEQ ID NO: 161637 - DNA, 20 bp, human
gcggccccggtccacgagcg

SEQ ID NO: 161638 - DNA, 20 bp, human
ggcggtgctcagggaggcgg

SEQ ID NO: 161639 - DNA, 20 bp, human
ggccgggccgaggtaagcgg

SEQ ID NO: 161640 - DNA, 20 bp, human
gcggaaaaagcggccgggag

SEQ ID NO: 161641 - DNA, 20 bp, human
gcgtcgccgcgctcgtggac

SEQ ID NO: 161642 - DNA, 20 bp, human
ggacccccgcgcggtgctca

SEQ ID NO: 161643 - DNA, 20 bp, human
ggtgctcgtcgccgcgctcg

SEQ ID NO: 161644 - DNA, 20 bp, human
ggttctcggaaaaagcggcc

SEQ ID NO: 161645 - DNA, 20 bp, human
ggccgaccccctccatggcg

SEQ ID NO: 161646 - DNA, 20 bp, human
gtccctggcgtgctcactcg

SEQ ID NO: 161647 - DNA, 20 bp, human
gtccccgagtgagcacgcca

SEQ ID NO: 161648 - DNA, 20 bp, human
ggggacccgcgactagcgac

SEQ ID NO: 161649 - DNA, 20 bp, human
gccgcgcgctctctggcaag

SEQ ID NO: 161650 - DNA, 20 bp, human
gggagcaggagaccaaacga

SEQ ID NO: 161651 - DNA, 20 bp, human
ggcgtgccggtcgctagtcg

SEQ ID NO: 161652 - DNA, 20 bp, human
ggtagcaacagcgagcgtgc

SEQ ID NO: 161653 - DNA, 20 bp, human
ggcaggagaccaaacgacgg

SEQ ID NO: 161654 - DNA, 20 bp, human
ggccctcccgccaggaacaa

SEQ ID NO: 161655 - DNA, 20 bp, human
gctacggtccgcgcgctctc

SEQ ID NO: 161656 - DNA, 20 bp, human
gcatggcgagcgggactcgg

SEQ ID NO: 161657 - DNA, 20 bp, human
ggcagcggcgttggggactc

SEQ ID NO: 161658 - DNA, 20 bp, human
gggccggaaagtttgtccgg

SEQ ID NO: 161659 - DNA, 20 bp, human
gcccgatcgggacttaccca

SEQ ID NO: 161660 - DNA, 20 bp, human
ggaacagctgcacttgcctg

SEQ ID NO: 161661 - DNA, 20 bp, human
gccgggcgcgcatcccccgc

SEQ ID NO: 161662 - DNA, 20 bp, human
gacccatggcgagcgggact

SEQ ID NO: 161663 - DNA, 20 bp, human
ggcgggccggaaagtttgtc

SEQ ID NO: 161664 - DNA, 20 bp, human
gaggcccacaacagcgcctg

SEQ ID NO: 161665 - DNA, 20 bp, human
ggagagtgcctgggcccgag

SEQ ID NO: 161666 - DNA, 20 bp, human
gggtcagggctgatcggcag

SEQ ID NO: 161667 - DNA, 20 bp, human
gcagcctgtgcgcggaggga

SEQ ID NO: 161668 - DNA, 20 bp, human
gccattagcaagcggtgagc

SEQ ID NO: 161669 - DNA, 20 bp, human
gcccggctgccattagcaag

SEQ ID NO: 161670 - DNA, 20 bp, human
gtggcagccggggtctccct

SEQ ID NO: 161671 - DNA, 20 bp, human
gcggaggtcttgctgtccca

SEQ ID NO: 161672 - DNA, 20 bp, human
gggtgggaaacagtctcggg

SEQ ID NO: 161673 - DNA, 20 bp, human
gggacgtcaggtcagagctg

SEQ ID NO: 161674 - DNA, 20 bp, human
ggccggcagcctgtgcgcgg

SEQ ID NO: 161675 - DNA, 20 bp, human
gcaggattgcagcgctcgga

SEQ ID NO: 161676 - DNA, 20 bp, human
gggacagccgtggagacgga

SEQ ID NO: 161677 - DNA, 20 bp, human
gtgtgggcgcgctggatgag

SEQ ID NO: 161678 - DNA, 20 bp, human
ggagtgtggggaaaaacttc

SEQ ID NO: 161679 - DNA, 20 bp, human
gaggggacccatcataccag

SEQ ID NO: 161680 - DNA, 20 bp, human
gacagggtctggtgggacgt

SEQ ID NO: 161681 - DNA, 20 bp, human
gggacccatcataccagtgg

SEQ ID NO: 161682 - DNA, 20 bp, human
gtgaccactcctgggagcgg

SEQ ID NO: 161683 - DNA, 20 bp, human
gccagtctgctgaaccagaa

SEQ ID NO: 161684 - DNA, 20 bp, human
gaagtgaccactcctgggag

SEQ ID NO: 161685 - DNA, 20 bp, human
gtctttagcatgctattatg

SEQ ID NO: 161686 - DNA, 20 bp, human
gaggctggtgctcgattcgg

SEQ ID NO: 161687 - DNA, 20 bp, human
gctgcggagttggagcccgg

SEQ ID NO: 161688 - DNA, 20 bp, human
ggtgtggagtgagacccgcc

SEQ ID NO: 161689 - DNA, 20 bp, human
gacgctgcggagttggagcc

SEQ ID NO: 161690 - DNA, 20 bp, human
gtgcaggctggtgctcgatt

SEQ ID NO: 161691 - DNA, 20 bp, human
gaagcagccggagccggacg

SEQ ID NO: 161692 - DNA, 20 bp, human
gacggccaccacgtacacga

SEQ ID NO: 161693 - DNA, 20 bp, human
ggcttgccttgcgggacata

SEQ ID NO: 161694 - DNA, 20 bp, human
gccgccgcgctccgacgctg

SEQ ID NO: 161695 - DNA, 20 bp, human
ggcaccagcctgcagagcgc

SEQ ID NO: 161696 - DNA, 20 bp, human
gtgagagtagaagtactcct

SEQ ID NO: 161697 - DNA, 20 bp, human
gaggcaggtagtccatgtcg

SEQ ID NO: 161698 - DNA, 20 bp, human
gtgcattgtgaacaaaagtc

SEQ ID NO: 161699 - DNA, 20 bp, human
gagtcagaatgggggcgtcg

SEQ ID NO: 161700 - DNA, 20 bp, human
gtacttctactctcaacagt

SEQ ID NO: 161701 - DNA, 20 bp, human
gtctggagaagagtcagaat

SEQ ID NO: 161702 - DNA, 20 bp, human
gcagaatgggggcgtcgggg

SEQ ID NO: 161703 - DNA, 20 bp, human
gaaagaaatcatcctcgaca

SEQ ID NO: 161704 - DNA, 20 bp, human
gggcaaagaacatagtaagt

SEQ ID NO: 161705 - DNA, 20 bp, human
gctagatagatcatgcttca

SEQ ID NO: 161706 - DNA, 20 bp, human
gggcagagctgcgaataaac

SEQ ID NO: 161707 - DNA, 20 bp, human
gcacaagacctggaattgac

SEQ ID NO: 161708 - DNA, 20 bp, human
gaaacaggcaggagctagtc

SEQ ID NO: 161709 - DNA, 20 bp, human
ggagctgcgaataaacaggc

SEQ ID NO: 161710 - DNA, 20 bp, human
gcttctgtcattgtactagt

SEQ ID NO: 161711 - DNA, 20 bp, human
gtgggagtcctgtcaattcc

SEQ ID NO: 161712 - DNA, 20 bp, human
gagtacaatgacagaagata

SEQ ID NO: 161713 - DNA, 20 bp, human
ggttgttctctagattaaaa

SEQ ID NO: 161714 - DNA, 20 bp, human
ggttttcaggagatagttag

SEQ ID NO: 161715 - DNA, 20 bp, human
gttaatcatgaaaactcatc

SEQ ID NO: 161716 - DNA, 20 bp, human
gtttctccacgtcctcagga

SEQ ID NO: 161717 - DNA, 20 bp, human
gagacccagagatgctgtaa

SEQ ID NO: 161718 - DNA, 20 bp, human
gagactttggatccttcctg

SEQ ID NO: 161719 - DNA, 20 bp, human
gtcacaagattgcttcaggg

SEQ ID NO: 161720 - DNA, 20 bp, human
gcaaagggtggagcctgaaa

SEQ ID NO: 161721 - DNA, 20 bp, human
gaggtaaccatatgccactg

SEQ ID NO: 161722 - DNA, 20 bp, human
gtggatccttcctgaggacg

SEQ ID NO: 161723 - DNA, 20 bp, human
gtcaaccatctcgtcctcag

SEQ ID NO: 161724 - DNA, 20 bp, human
ggttctgttcaccttatcat

SEQ ID NO: 161725 - DNA, 20 bp, human
gggctagagacgaaatgaaa

SEQ ID NO: 161726 - DNA, 20 bp, human
gccaaggacccggagagcag

SEQ ID NO: 161727 - DNA, 20 bp, human
gccaaaaggcagagtgggtc

SEQ ID NO: 161728 - DNA, 20 bp, human
gtaggcaagggggtgaaccc

SEQ ID NO: 161729 - DNA, 20 bp, human
gcgtcgggcttccaacagat

SEQ ID NO: 161730 - DNA, 20 bp, human
gcgcgccgcctactaggcaa

SEQ ID NO: 161731 - DNA, 20 bp, human
ggtcccggagtgacgtgcga

SEQ ID NO: 161732 - DNA, 20 bp, human
gtgcagggagggccgtccag

SEQ ID NO: 161733 - DNA, 20 bp, human
gttgtggctgtgggtcccat

SEQ ID NO: 161734 - DNA, 20 bp, human
gagattccaatcctaccaaa

SEQ ID NO: 161735 - DNA, 20 bp, human
gccccgctccaccagatccg

SEQ ID NO: 161736 - DNA, 20 bp, human
gcgggcggcggccggatcca

SEQ ID NO: 161737 - DNA, 20 bp, human
ggcggcggccggatccaggg

SEQ ID NO: 161738 - DNA, 20 bp, human
ggggccgggcagcctccggg

SEQ ID NO: 161739 - DNA, 20 bp, human
ggagggggcagactcagcgg

SEQ ID NO: 161740 - DNA, 20 bp, human
gcggcgcccgcctcgaaaac

SEQ ID NO: 161741 - DNA, 20 bp, human
gcgcccacggaagagccctg

SEQ ID NO: 161742 - DNA, 20 bp, human
gagggctgactctcaggacg

SEQ ID NO: 161743 - DNA, 20 bp, human
gggacacgcgcggaccgacg

SEQ ID NO: 161744 - DNA, 20 bp, human
ggcggcgtgggcaccgtcac

SEQ ID NO: 161745 - DNA, 20 bp, human
gatccgcagggctcttccgt

SEQ ID NO: 161746 - DNA, 20 bp, human
gaagtaacgcgtgcactgaa

SEQ ID NO: 161747 - DNA, 20 bp, human
gccccagcgactctccagga

SEQ ID NO: 161748 - DNA, 20 bp, human
gcgttactttggctaaaagg

SEQ ID NO: 161749 - DNA, 20 bp, human
gatggagagagaagacattc

SEQ ID NO: 161750 - DNA, 20 bp, human
gagcaggatctgtaactgaa

SEQ ID NO: 161751 - DNA, 20 bp, human
gcaacaggatcagagcatga

SEQ ID NO: 161752 - DNA, 20 bp, human
gctctccaggaaggctgcac

SEQ ID NO: 161753 - DNA, 20 bp, human
gtgttgggagggattatggt

SEQ ID NO: 161754 - DNA, 20 bp, human
gcagcaggtggtcttttata

SEQ ID NO: 161755 - DNA, 20 bp, human
gagacattctgggtgcactt

SEQ ID NO: 161756 - DNA, 20 bp, human
gtggcccctcggtggcgact

SEQ ID NO: 161757 - DNA, 20 bp, human
ggagccagatggcccctcgg

SEQ ID NO: 161758 - DNA, 20 bp, human
gcatggccgggtctctctcg

SEQ ID NO: 161759 - DNA, 20 bp, human
gagccgctgctgggagccga

SEQ ID NO: 161760 - DNA, 20 bp, human
gtcggtggcgactaggtcag

SEQ ID NO: 161761 - DNA, 20 bp, human
gtctctctcggggcgagcgg

SEQ ID NO: 161762 - DNA, 20 bp, human
ggagcggagggcgctcagac

SEQ ID NO: 161763 - DNA, 20 bp, human
gactgcggatgagctaacaa

SEQ ID NO: 161764 - DNA, 20 bp, human
gcctggttccctccagccgg

SEQ ID NO: 161765 - DNA, 20 bp, human
gccctgtcccctggcgacgg

SEQ ID NO: 161766 - DNA, 20 bp, human
gcgcagagcaggtgtcactt

SEQ ID NO: 161767 - DNA, 20 bp, human
gcttgttcaggtgggagaac

SEQ ID NO: 161768 - DNA, 20 bp, human
gcctccctggatggaatggg

SEQ ID NO: 161769 - DNA, 20 bp, human
ggcgccagccacctaaagac

SEQ ID NO: 161770 - DNA, 20 bp, human
gcccgtagctctgcacatcc

SEQ ID NO: 161771 - DNA, 20 bp, human
gggattcgggcattcttcag

SEQ ID NO: 161772 - DNA, 20 bp, human
ggccaggcagctaagtgtga

SEQ ID NO: 161773 - DNA, 20 bp, human
ggctcagacatgggccaggg

SEQ ID NO: 161774 - DNA, 20 bp, human
ggtgcagagctacgggctgt

SEQ ID NO: 161775 - DNA, 20 bp, human
ggaaacagccggtctttagg

SEQ ID NO: 161776 - DNA, 20 bp, human
gcgccaggaggccccagaag

SEQ ID NO: 161777 - DNA, 20 bp, human
ggcactcgcagggcccgtgg

SEQ ID NO: 161778 - DNA, 20 bp, human
gtcccgagggaagggatggg

SEQ ID NO: 161779 - DNA, 20 bp, human
gaggagggcgtggggtccca

SEQ ID NO: 161780 - DNA, 20 bp, human
gaacgccgatcggccagctc

SEQ ID NO: 161781 - DNA, 20 bp, human
ggatgcccgtcccgagagga

SEQ ID NO: 161782 - DNA, 20 bp, human
gcccagggcagcggcgaagg

SEQ ID NO: 161783 - DNA, 20 bp, human
gatgacgcccgaggacccag

SEQ ID NO: 161784 - DNA, 20 bp, human
gtcctcgggcgtcatgtcgg

SEQ ID NO: 161785 - DNA, 20 bp, human
gggcctcaccccgaaccagg

SEQ ID NO: 161786 - DNA, 20 bp, human
ggtctcagtgacccagctga

SEQ ID NO: 161787 - DNA, 20 bp, human
gggcatttccgtgagtgagg

SEQ ID NO: 161788 - DNA, 20 bp, human
gacatggaatgaggctatgg

SEQ ID NO: 161789 - DNA, 20 bp, human
gacagcgtctctggtagact

SEQ ID NO: 161790 - DNA, 20 bp, human
gaaatgccttggcagagtct

SEQ ID NO: 161791 - DNA, 20 bp, human
gggaggcagagtccactgga

SEQ ID NO: 161792 - DNA, 20 bp, human
gactgggccaacagcgtctc

SEQ ID NO: 161793 - DNA, 20 bp, human
gtggcagagtctggggtccc

SEQ ID NO: 161794 - DNA, 20 bp, human
gctggactgagccatcagct

SEQ ID NO: 161795 - DNA, 20 bp, human
gggtagactgggtgtgtaca

SEQ ID NO: 161796 - DNA, 20 bp, human
ggatggctgaggagctagag

SEQ ID NO: 161797 - DNA, 20 bp, human
gtgaggagctagagaggcgg

SEQ ID NO: 161798 - DNA, 20 bp, human
gctgcactcggcccggtctc

SEQ ID NO: 161799 - DNA, 20 bp, human
gtgcttgctggtctcctctg

SEQ ID NO: 161800 - DNA, 20 bp, human
gagggtcggcgaccgcgaca

SEQ ID NO: 161801 - DNA, 20 bp, human
ggtcggcgaccgcgacacgg

SEQ ID NO: 161802 - DNA, 20 bp, human
gctctgcggcggctggactg

SEQ ID NO: 161803 - DNA, 20 bp, human
gcgttcgggaaaccgctgag

SEQ ID NO: 161804 - DNA, 20 bp, human
gcgaagaaggcgcccgagac

SEQ ID NO: 161805 - DNA, 20 bp, human
gacggaggagcgcccgagtc

SEQ ID NO: 161806 - DNA, 20 bp, human
ggccggcgagacaatctggg

SEQ ID NO: 161807 - DNA, 20 bp, human
gcccgcgcgcagccacaggt

SEQ ID NO: 161808 - DNA, 20 bp, human
gacgcacagcgagatcaggt

SEQ ID NO: 161809 - DNA, 20 bp, human
gggcgcggcgcggatccgtg

SEQ ID NO: 161810 - DNA, 20 bp, human
gcagggccggcgagacaatc

SEQ ID NO: 161811 - DNA, 20 bp, human
gaggcgggtaccgggcctca

SEQ ID NO: 161812 - DNA, 20 bp, human
gtgggctgcgctcccctggg

SEQ ID NO: 161813 - DNA, 20 bp, human
gggtgaagcagagcgcggtg

SEQ ID NO: 161814 - DNA, 20 bp, human
gggcgcccggcgccgcccag

SEQ ID NO: 161815 - DNA, 20 bp, human
gaagatggtgaagcagagcg

SEQ ID NO: 161816 - DNA, 20 bp, human
gcgggcaggggtcagaatct

SEQ ID NO: 161817 - DNA, 20 bp, human
gtggcacgcggagccagagc

SEQ ID NO: 161818 - DNA, 20 bp, human
gaatctgggctgcgccccaa

SEQ ID NO: 161819 - DNA, 20 bp, human
gagcggctgacccgagacac

SEQ ID NO: 161820 - DNA, 20 bp, human
ggtgagggaacgaagataat

SEQ ID NO: 161821 - DNA, 20 bp, human
ggagctgggaccatgcagga

SEQ ID NO: 161822 - DNA, 20 bp, human
gggggcgggactccaggcat

SEQ ID NO: 161823 - DNA, 20 bp, human
gcccgagacacgggagcgct

SEQ ID NO: 161824 - DNA, 20 bp, human
gaggtgcgctcactccggcc

SEQ ID NO: 161825 - DNA, 20 bp, human
gcactccggcccggctcctg

SEQ ID NO: 161826 - DNA, 20 bp, human
gcgccctgcggggatcccgg

SEQ ID NO: 161827 - DNA, 20 bp, human
gaggcgtagccggctgtgta

SEQ ID NO: 161828 - DNA, 20 bp, human
ggacccccgggatccccgca

SEQ ID NO: 161829 - DNA, 20 bp, human
ggagcgaactgcagcgactg

SEQ ID NO: 161830 - DNA, 20 bp, human
ggcgctccgtgtggccagag

SEQ ID NO: 161831 - DNA, 20 bp, human
gcgcttcacccgaggaagtc

SEQ ID NO: 161832 - DNA, 20 bp, human
ggctgcagttcgctccactc

SEQ ID NO: 161833 - DNA, 20 bp, human
ggaccgtctaggccccaccg

SEQ ID NO: 161834 - DNA, 20 bp, human
gtagccggctgtgtagggct

SEQ ID NO: 161835 - DNA, 20 bp, human
gccggccgcctgacttcctc

SEQ ID NO: 161836 - DNA, 20 bp, human
gcccgaacctgtcagacctg

SEQ ID NO: 161837 - DNA, 20 bp, human
gcccgcggccgcaggagagt

SEQ ID NO: 161838 - DNA, 20 bp, human
ggagcggccgcggtgcggaa

SEQ ID NO: 161839 - DNA, 20 bp, human
ggcctcatccgagaagtcaa

SEQ ID NO: 161840 - DNA, 20 bp, human
gccggagcgccagttctcga

SEQ ID NO: 161841 - DNA, 20 bp, human
gccggcggcgcctacttcac

SEQ ID NO: 161842 - DNA, 20 bp, human
gactggcgctccggtgaagt

SEQ ID NO: 161843 - DNA, 20 bp, human
ggcgcctcaaatctatgcta

SEQ ID NO: 161844 - DNA, 20 bp, human
gcaagttccgaagccgctgg

SEQ ID NO: 161845 - DNA, 20 bp, human
ggctcgcgctgctccacccg

SEQ ID NO: 161846 - DNA, 20 bp, human
gggacgtcccgggctgtcag

SEQ ID NO: 161847 - DNA, 20 bp, human
gaggccgcgatcagttccgg

SEQ ID NO: 161848 - DNA, 20 bp, human
ggctgtcagcggagaccgga

SEQ ID NO: 161849 - DNA, 20 bp, human
gactaggccgcgatcagttc

SEQ ID NO: 161850 - DNA, 20 bp, human
ggtcagcggagaccggaggg

SEQ ID NO: 161851 - DNA, 20 bp, human
gccggcggcgccaggttccc

SEQ ID NO: 161852 - DNA, 20 bp, human
ggcgccgccggaactgatcg

SEQ ID NO: 161853 - DNA, 20 bp, human
ggagagggcgcgccgacccc

SEQ ID NO: 161854 - DNA, 20 bp, human
gaggcagcctgcgcgcaggg

SEQ ID NO: 161855 - DNA, 20 bp, human
gccgggaagcagcggcggta

SEQ ID NO: 161856 - DNA, 20 bp, human
gcagccaactcaccatgata

SEQ ID NO: 161857 - DNA, 20 bp, human
ggcagtggcgataacgccag

SEQ ID NO: 161858 - DNA, 20 bp, human
ggctgtgcagctccttatca

SEQ ID NO: 161859 - DNA, 20 bp, human
gcacccagaacggcttccgg

SEQ ID NO: 161860 - DNA, 20 bp, human
ggaacaggtgagggaccgaa

SEQ ID NO: 161861 - DNA, 20 bp, human
gagggaccagaactctgaag

SEQ ID NO: 161862 - DNA, 20 bp, human
gggagctgcacagctcccgc

SEQ ID NO: 161863 - DNA, 20 bp, human
gtcccgccggaagccgttct

SEQ ID NO: 161864 - DNA, 20 bp, human
ggcgcctgcggaacaggtga

SEQ ID NO: 161865 - DNA, 20 bp, human
gaaaactcgagcacccagaa

SEQ ID NO: 161866 - DNA, 20 bp, human
ggtctgtctgtgtctcgcag

SEQ ID NO: 161867 - DNA, 20 bp, human
gactgggagggtcttgaaga

SEQ ID NO: 161868 - DNA, 20 bp, human
gagagccgggagagttaagg

SEQ ID NO: 161869 - DNA, 20 bp, human
gcggaagtaagcgaattccc

SEQ ID NO: 161870 - DNA, 20 bp, human
gcggccccggacaagcgctg

SEQ ID NO: 161871 - DNA, 20 bp, human
gatggcccgaggtccagtga

SEQ ID NO: 161872 - DNA, 20 bp, human
gaggagcatgtgaactggga

SEQ ID NO: 161873 - DNA, 20 bp, human
ggtgccgggaccccgaggct

SEQ ID NO: 161874 - DNA, 20 bp, human
gtgtcggacagtatagacct

SEQ ID NO: 161875 - DNA, 20 bp, human
gcacggagccacttctagag

SEQ ID NO: 161876 - DNA, 20 bp, human
gttcagaagcaacaaggtat

SEQ ID NO: 161877 - DNA, 20 bp, human
gagtgtgaaagcatacatct

SEQ ID NO: 161878 - DNA, 20 bp, human
gcctttactctgcaacttgg

SEQ ID NO: 161879 - DNA, 20 bp, human
gctaccaacaacactgatgt

SEQ ID NO: 161880 - DNA, 20 bp, human
gtacaaaaactgcttttcta

SEQ ID NO: 161881 - DNA, 20 bp, human
gcttttctagggagacttgc

SEQ ID NO: 161882 - DNA, 20 bp, human
gcaacagccgcagctcatcc

SEQ ID NO: 161883 - DNA, 20 bp, human
gcttgttgcttctgaattgt

SEQ ID NO: 161884 - DNA, 20 bp, human
ggcctccttgcaatattacc

SEQ ID NO: 161885 - DNA, 20 bp, human
ggctacaaattgctgatgta

SEQ ID NO: 161886 - DNA, 20 bp, human
gcttgtggcggcgaagccat

SEQ ID NO: 161887 - DNA, 20 bp, human
gagtcagttggtaccggtgg

SEQ ID NO: 161888 - DNA, 20 bp, human
gtcccgcgggggccatgcta

SEQ ID NO: 161889 - DNA, 20 bp, human
gggacatcagcgaacaccga

SEQ ID NO: 161890 - DNA, 20 bp, human
gggcccccgcgggaacttgt

SEQ ID NO: 161891 - DNA, 20 bp, human
gtccagtctatggagtcagt

SEQ ID NO: 161892 - DNA, 20 bp, human
gttcgctgatgtccagtcta

SEQ ID NO: 161893 - DNA, 20 bp, human
ggcggcgcggaggcagaagg

SEQ ID NO: 161894 - DNA, 20 bp, human
gcggctccgtctgcgatgca

SEQ ID NO: 161895 - DNA, 20 bp, human
gtgcctgggtgacccggaaa

SEQ ID NO: 161896 - DNA, 20 bp, human
gggagctgaggaaagcggcg

SEQ ID NO: 161897 - DNA, 20 bp, human
gtcggagagagaggtgctag

SEQ ID NO: 161898 - DNA, 20 bp, human
ggaaagagctcgggactgga

SEQ ID NO: 161899 - DNA, 20 bp, human
gaggccgggattgaaatcca

SEQ ID NO: 161900 - DNA, 20 bp, human
gaggagaaagagctcgggac

SEQ ID NO: 161901 - DNA, 20 bp, human
gactggagggttaaagactg

SEQ ID NO: 161902 - DNA, 20 bp, human
gaaattctgagattacgagg

SEQ ID NO: 161903 - DNA, 20 bp, human
gcacccgggtgactagtccg

SEQ ID NO: 161904 - DNA, 20 bp, human
gggacggtacccatgcacag

SEQ ID NO: 161905 - DNA, 20 bp, human
gcgaggtcacaaagagtaaa

SEQ ID NO: 161906 - DNA, 20 bp, human
gggcggcggttgaactgact

SEQ ID NO: 161907 - DNA, 20 bp, human
gacctctggccggcgcccca

SEQ ID NO: 161908 - DNA, 20 bp, human
ggcgctacggtgaagagggt

SEQ ID NO: 161909 - DNA, 20 bp, human
ggccagggtagctatcgcgg

SEQ ID NO: 161910 - DNA, 20 bp, human
gagacccgagcgagcagacg

SEQ ID NO: 161911 - DNA, 20 bp, human
ggcggccagggtagctatcg

SEQ ID NO: 161912 - DNA, 20 bp, human
gcagcgccttgggagattcc

SEQ ID NO: 161913 - DNA, 20 bp, human
gccatggtgagtgcgcaggg

SEQ ID NO: 161914 - DNA, 20 bp, human
gccggccccggacctctggc

SEQ ID NO: 161915 - DNA, 20 bp, human
gtggcgcggcttgagagtgg

SEQ ID NO: 161916 - DNA, 20 bp, human
ggctctctcagggctggacc

SEQ ID NO: 161917 - DNA, 20 bp, human
gggagagaggaaatacccgg

SEQ ID NO: 161918 - DNA, 20 bp, human
gcaggcggccacggatgagg

SEQ ID NO: 161919 - DNA, 20 bp, human
gggattcagacgtgagctgg

SEQ ID NO: 161920 - DNA, 20 bp, human
gtggacatcctgaaagccga

SEQ ID NO: 161921 - DNA, 20 bp, human
gagggctggaccgggcaagc

SEQ ID NO: 161922 - DNA, 20 bp, human
gtggcgttcgaggctctctc

SEQ ID NO: 161923 - DNA, 20 bp, human
gccttgggaaggaggcggga

SEQ ID NO: 161924 - DNA, 20 bp, human
ggaaaggacagaaggacccg

SEQ ID NO: 161925 - DNA, 20 bp, human
gggagggagcgcgtgaaaga

SEQ ID NO: 161926 - DNA, 20 bp, human
gtgcctggataggtgccccc

SEQ ID NO: 161927 - DNA, 20 bp, human
gcctctggctagaggcccag

SEQ ID NO: 161928 - DNA, 20 bp, human
ggctctcgctgctatcaatg

SEQ ID NO: 161929 - DNA, 20 bp, human
gtacctgcggcgggatcgaa

SEQ ID NO: 161930 - DNA, 20 bp, human
gtgatagcagcgagagctgg

SEQ ID NO: 161931 - DNA, 20 bp, human
ggcagggctcagagcgataa

SEQ ID NO: 161932 - DNA, 20 bp, human
gcagcgagagctggaggtgt

SEQ ID NO: 161933 - DNA, 20 bp, human
gggacagcagccggcaacgg

SEQ ID NO: 161934 - DNA, 20 bp, human
gcaaggacagcagccggcaa

SEQ ID NO: 161935 - DNA, 20 bp, human
gcctcggccccccacagacg

SEQ ID NO: 161936 - DNA, 20 bp, human
ggttgggatgtgagggtcct

SEQ ID NO: 161937 - DNA, 20 bp, human
ggcagctcaatgaagcctcc

SEQ ID NO: 161938 - DNA, 20 bp, human
gcagataggacacagatgaa

SEQ ID NO: 161939 - DNA, 20 bp, human
gatgtcagtccagccaatcg

SEQ ID NO: 161940 - DNA, 20 bp, human
ggtttcctactcagagctgg

SEQ ID NO: 161941 - DNA, 20 bp, human
gtcagttctcctcagggtcc

SEQ ID NO: 161942 - DNA, 20 bp, human
gtcagtccagccaatcgcgg

SEQ ID NO: 161943 - DNA, 20 bp, human
gaaaggactcctgctccttc

SEQ ID NO: 161944 - DNA, 20 bp, human
gttagtgcaaactcgacctc

SEQ ID NO: 161945 - DNA, 20 bp, human
gtggactgacatgttatatg

SEQ ID NO: 161946 - DNA, 20 bp, human
gcatgcttgtgagaagaggt

SEQ ID NO: 161947 - DNA, 20 bp, human
ggcactgtgctgactcatcg

SEQ ID NO: 161948 - DNA, 20 bp, human
gaataaatgctatgggtcca

SEQ ID NO: 161949 - DNA, 20 bp, human
gttacccaaagggaacccac

SEQ ID NO: 161950 - DNA, 20 bp, human
gtgtgcgctgcacacatcag

SEQ ID NO: 161951 - DNA, 20 bp, human
ggggcacttatcccctaaac

SEQ ID NO: 161952 - DNA, 20 bp, human
gagagaggacaaagtcaagg

SEQ ID NO: 161953 - DNA, 20 bp, human
gtatcccctaaacaggcacg

SEQ ID NO: 161954 - DNA, 20 bp, human
gttagccttgggcccctatc

SEQ ID NO: 161955 - DNA, 20 bp, human
gggcagtgaacgtctcatcc

SEQ ID NO: 161956 - DNA, 20 bp, human
gtacacacgcaggtgacacg

SEQ ID NO: 161957 - DNA, 20 bp, human
gcagcaggcttaggacggag

SEQ ID NO: 161958 - DNA, 20 bp, human
gggatgtgaaacgagcgcag

SEQ ID NO: 161959 - DNA, 20 bp, human
gctggtgagtaccgccgccg

SEQ ID NO: 161960 - DNA, 20 bp, human
ggcgcgcaccagccaggcta

SEQ ID NO: 161961 - DNA, 20 bp, human
gacccgcagcaggcttagga

SEQ ID NO: 161962 - DNA, 20 bp, human
ggcagcgccccgggtatata

SEQ ID NO: 161963 - DNA, 20 bp, human
ggaccgtcaagctgaggaaa

SEQ ID NO: 161964 - DNA, 20 bp, human
gagctcctgtgaggctcaag

SEQ ID NO: 161965 - DNA, 20 bp, human
gaatggaagacggcagccca

SEQ ID NO: 161966 - DNA, 20 bp, human
gggtaggagctcctaggacc

SEQ ID NO: 161967 - DNA, 20 bp, human
gcctcaccacccacacaggt

SEQ ID NO: 161968 - DNA, 20 bp, human
gcacacaggtaggagctcct

SEQ ID NO: 161969 - DNA, 20 bp, human
gccccgatgacaccagatag

SEQ ID NO: 161970 - DNA, 20 bp, human
gagctcctaggaccaggctg

SEQ ID NO: 161971 - DNA, 20 bp, human
gcccagggcactaggtggag

SEQ ID NO: 161972 - DNA, 20 bp, human
gcgatgacaccagatagggg

SEQ ID NO: 161973 - DNA, 20 bp, human
ggagctcctacctgtgtggg

SEQ ID NO: 161974 - DNA, 20 bp, human
gacgcctggacctgagccca

SEQ ID NO: 161975 - DNA, 20 bp, human
gatggtcccgacttagactt

SEQ ID NO: 161976 - DNA, 20 bp, human
ggaggcgtcaggagtttgcg

SEQ ID NO: 161977 - DNA, 20 bp, human
gctgccctgactgccgggag

SEQ ID NO: 161978 - DNA, 20 bp, human
gcacagggtaggaggcgcag

SEQ ID NO: 161979 - DNA, 20 bp, human
gctctgagcatccacagggt

SEQ ID NO: 161980 - DNA, 20 bp, human
ggggggctgtcggggaacca

SEQ ID NO: 161981 - DNA, 20 bp, human
ggagccgctcccggcagtca

SEQ ID NO: 161982 - DNA, 20 bp, human
ggccccgagaggtgagaact

SEQ ID NO: 161983 - DNA, 20 bp, human
gagacccagttctcacctct

SEQ ID NO: 161984 - DNA, 20 bp, human
ggtgctccgctgcccgacag

SEQ ID NO: 161985 - DNA, 20 bp, human
gaagcctctgagcatccaca

SEQ ID NO: 161986 - DNA, 20 bp, human
gtctgcccgagcagtcgcat

SEQ ID NO: 161987 - DNA, 20 bp, human
ggtcgggatcgctgggagtc

SEQ ID NO: 161988 - DNA, 20 bp, human
ggcggacgaacggcaggata

SEQ ID NO: 161989 - DNA, 20 bp, human
gagttcctcactgaagaagg

SEQ ID NO: 161990 - DNA, 20 bp, human
gcacacacgtcggtccacac

SEQ ID NO: 161991 - DNA, 20 bp, human
ggatcagtgaagcggacgaa

SEQ ID NO: 161992 - DNA, 20 bp, human
ggaagctctgtagggatggt

SEQ ID NO: 161993 - DNA, 20 bp, human
ggccccaaccgctgccatgt

SEQ ID NO: 161994 - DNA, 20 bp, human
ggcagcggaagtgacgaacg

SEQ ID NO: 161995 - DNA, 20 bp, human
gtgagagggagcatcccgtg

SEQ ID NO: 161996 - DNA, 20 bp, human
gaccgagctggcggtggcta

SEQ ID NO: 161997 - DNA, 20 bp, human
ggcggtcgcgtaggacccag

SEQ ID NO: 161998 - DNA, 20 bp, human
gtgcgtgcggagctagtgac

SEQ ID NO: 161999 - DNA, 20 bp, human
gacgtgcggaatgtactggg

SEQ ID NO: 162000 - DNA, 20 bp, human
gtgcgggtcagcggtcgcgt

SEQ ID NO: 162001 - DNA, 20 bp, human
gctacggcgacgggagccgg

SEQ ID NO: 162002 - DNA, 20 bp, human
gtacagtgctagctaagtag

SEQ ID NO: 162003 - DNA, 20 bp, human
ggcgtaggacccagcggact

SEQ ID NO: 162004 - DNA, 20 bp, human
gcgggaacccggaaacgcct

SEQ ID NO: 162005 - DNA, 20 bp, human
gccaggctgccgagtccgct

SEQ ID NO: 162006 - DNA, 20 bp, human
gagttcggcggggaagatgg

SEQ ID NO: 162007 - DNA, 20 bp, human
gacaaggtgagtggccgtgg

SEQ ID NO: 162008 - DNA, 20 bp, human
gtggcggatgacaaggtgag

SEQ ID NO: 162009 - DNA, 20 bp, human
gggagagtgaagaccacgcc

SEQ ID NO: 162010 - DNA, 20 bp, human
gcccggaactaaaaaggtca

SEQ ID NO: 162011 - DNA, 20 bp, human
gcctcccccggacccacaca

SEQ ID NO: 162012 - DNA, 20 bp, human
gagccgcacagcccgcccag

SEQ ID NO: 162013 - DNA, 20 bp, human
gtgcgcctgcgcaacaagtt

SEQ ID NO: 162014 - DNA, 20 bp, human
ggggacatctgggggatcca

SEQ ID NO: 162015 - DNA, 20 bp, human
ggtttacacgcaccacccct

SEQ ID NO: 162016 - DNA, 20 bp, human
gtacgtggagaagctacagt

SEQ ID NO: 162017 - DNA, 20 bp, human
gcaataggcggcttagaggg

SEQ ID NO: 162018 - DNA, 20 bp, human
gggacactaaaccccaggtt

SEQ ID NO: 162019 - DNA, 20 bp, human
gcccaatccggacgtaatcg

SEQ ID NO: 162020 - DNA, 20 bp, human
gccaatggggctgtcagtat

SEQ ID NO: 162021 - DNA, 20 bp, human
gctgcaataggcggcttaga

SEQ ID NO: 162022 - DNA, 20 bp, human
ggcgcagtagggctcttcac

SEQ ID NO: 162023 - DNA, 20 bp, human
ggtgcctgcgcaatgggtgt

SEQ ID NO: 162024 - DNA, 20 bp, human
gtgtaggcgtgcgcccaatg

SEQ ID NO: 162025 - DNA, 20 bp, human
gattcctacagtacgctggg

SEQ ID NO: 162026 - DNA, 20 bp, human
ggtcgcatgcagctcctatg

SEQ ID NO: 162027 - DNA, 20 bp, human
gccggcggcaggggcctcat

SEQ ID NO: 162028 - DNA, 20 bp, human
ggccggacatcgccgaccgg

SEQ ID NO: 162029 - DNA, 20 bp, human
ggaggaaagcccgggtccag

SEQ ID NO: 162030 - DNA, 20 bp, human
gctggagacccgctcacaac

SEQ ID NO: 162031 - DNA, 20 bp, human
gacccgctcacaaccggcac

SEQ ID NO: 162032 - DNA, 20 bp, human
ggccgccggtcggcgatgtc

SEQ ID NO: 162033 - DNA, 20 bp, human
gcgcagccggtcgggcacca

SEQ ID NO: 162034 - DNA, 20 bp, human
gggatccctgtcacaggctg

SEQ ID NO: 162035 - DNA, 20 bp, human
ggaggccatgagacgcccag

SEQ ID NO: 162036 - DNA, 20 bp, human
gggagcggccagcgagccag

SEQ ID NO: 162037 - DNA, 20 bp, human
ggctcgctggccgctcctgg

SEQ ID NO: 162038 - DNA, 20 bp, human
gcagtgtggtcccctctgga

SEQ ID NO: 162039 - DNA, 20 bp, human
gtggggtggagggggaaccg

SEQ ID NO: 162040 - DNA, 20 bp, human
gctccgcccgaagctcccca

SEQ ID NO: 162041 - DNA, 20 bp, human
gcggcccccgtgctgaggcg

SEQ ID NO: 162042 - DNA, 20 bp, human
ggaccatggacgccaggtgg

SEQ ID NO: 162043 - DNA, 20 bp, human
gctgccgcgcctcagcacgg

SEQ ID NO: 162044 - DNA, 20 bp, human
ggcagccggctagcgttgga

SEQ ID NO: 162045 - DNA, 20 bp, human
gcgctttccttacagatggt

SEQ ID NO: 162046 - DNA, 20 bp, human
gcacgcgcgcagggacacat

SEQ ID NO: 162047 - DNA, 20 bp, human
gcggaaagcactctcaactc

SEQ ID NO: 162048 - DNA, 20 bp, human
ggcgcgcagggacacatagg

SEQ ID NO: 162049 - DNA, 20 bp, human
gcagcccgagggcgaaaaac

SEQ ID NO: 162050 - DNA, 20 bp, human
gggagttctcgccagcccga

SEQ ID NO: 162051 - DNA, 20 bp, human
gccgccgcggtggaaagtgc

SEQ ID NO: 162052 - DNA, 20 bp, human
gtccggggaggcgaccgccg

SEQ ID NO: 162053 - DNA, 20 bp, human
gccttctggatgaggaagat

SEQ ID NO: 162054 - DNA, 20 bp, human
gaacacaggaaaggccccga

SEQ ID NO: 162055 - DNA, 20 bp, human
gggccgggcggtttccaggg

SEQ ID NO: 162056 - DNA, 20 bp, human
gttcttggcagcgtcggtgt

SEQ ID NO: 162057 - DNA, 20 bp, human
gccagaggagaggtcccccc

SEQ ID NO: 162058 - DNA, 20 bp, human
ggtcctgccccgggctccgt

SEQ ID NO: 162059 - DNA, 20 bp, human
ggacaggacggattgctggg

SEQ ID NO: 162060 - DNA, 20 bp, human
ggatgtgctgcgcagcgaag

SEQ ID NO: 162061 - DNA, 20 bp, human
gtgggaagcagcggactcag

SEQ ID NO: 162062 - DNA, 20 bp, human
gccaggctgcccagacagga

SEQ ID NO: 162063 - DNA, 20 bp, human
gggtgttggccgcgggagaa

SEQ ID NO: 162064 - DNA, 20 bp, human
ggctcaggccgtcctgcccc

SEQ ID NO: 162065 - DNA, 20 bp, human
ggacgccccctcggatgaat

SEQ ID NO: 162066 - DNA, 20 bp, human
gcgggaaggcagcgagacgt

SEQ ID NO: 162067 - DNA, 20 bp, human
gccggcgacagagcccggga

SEQ ID NO: 162068 - DNA, 20 bp, human
gggctctgagacaagacaca

SEQ ID NO: 162069 - DNA, 20 bp, human
gagacctgtgaggggagaag

SEQ ID NO: 162070 - DNA, 20 bp, human
gggcggacggagctgagggt

SEQ ID NO: 162071 - DNA, 20 bp, human
ggacagagaagacctgtgag

SEQ ID NO: 162072 - DNA, 20 bp, human
gggagtcggcctcggatgtc

SEQ ID NO: 162073 - DNA, 20 bp, human
gctgcaacgcgagtctccgg

SEQ ID NO: 162074 - DNA, 20 bp, human
gacctactcccaccccgagg

SEQ ID NO: 162075 - DNA, 20 bp, human
gcggatgtccggaggctcct

SEQ ID NO: 162076 - DNA, 20 bp, human
gtcccagggccgaggtgagt

SEQ ID NO: 162077 - DNA, 20 bp, human
gcaggccggaatctccccac

SEQ ID NO: 162078 - DNA, 20 bp, human
gttccggcctggagctccca

SEQ ID NO: 162079 - DNA, 20 bp, human
gcaagcggaggtctgcggaa

SEQ ID NO: 162080 - DNA, 20 bp, human
ggtgccacgaggattgggag

SEQ ID NO: 162081 - DNA, 20 bp, human
gcacggccctgccctctgag

SEQ ID NO: 162082 - DNA, 20 bp, human
gacaaggaaacgtcagaggt

SEQ ID NO: 162083 - DNA, 20 bp, human
ggtctgcggaagggagctga

SEQ ID NO: 162084 - DNA, 20 bp, human
gccggcctcgcacttccggt

SEQ ID NO: 162085 - DNA, 20 bp, human
ggcaaacaaggaaacgtcag

SEQ ID NO: 162086 - DNA, 20 bp, human
ggcgcagctggcctagtctg

SEQ ID NO: 162087 - DNA, 20 bp, human
ggccaagcggggagtcgagg

SEQ ID NO: 162088 - DNA, 20 bp, human
ggttaaagccgaacaaagtt

SEQ ID NO: 162089 - DNA, 20 bp, human
ggcggggcctagcggctcgg

SEQ ID NO: 162090 - DNA, 20 bp, human
ggagttggggaccgcagact

SEQ ID NO: 162091 - DNA, 20 bp, human
gccaggggactccaggagtt

SEQ ID NO: 162092 - DNA, 20 bp, human
ggccgcctgtccccgcccag

SEQ ID NO: 162093 - DNA, 20 bp, human
ggctcccgcccaactttgtt

SEQ ID NO: 162094 - DNA, 20 bp, human
gctttggcagtcaaagtcca

SEQ ID NO: 162095 - DNA, 20 bp, human
gaaagccgaacaaagttggg

SEQ ID NO: 162096 - DNA, 20 bp, human
gtgaagcgcacggaggacag

SEQ ID NO: 162097 - DNA, 20 bp, human
gcgccggccgtcatctcctg

SEQ ID NO: 162098 - DNA, 20 bp, human
ggcggggccgcaggagatga

SEQ ID NO: 162099 - DNA, 20 bp, human
gcgggaccagtgcgcagccg

SEQ ID NO: 162100 - DNA, 20 bp, human
ggaggcgccctgtcctaggt

SEQ ID NO: 162101 - DNA, 20 bp, human
gggcgctgctgaccacctac

SEQ ID NO: 162102 - DNA, 20 bp, human
ggacagggcgcctcgcagca

SEQ ID NO: 162103 - DNA, 20 bp, human
ggccagccccggctgcgcac

SEQ ID NO: 162104 - DNA, 20 bp, human
gctgcgaggcgccctgtcct

SEQ ID NO: 162105 - DNA, 20 bp, human
ggccccgcctcacccgtagg

SEQ ID NO: 162106 - DNA, 20 bp, human
gccggcctcgccgcacccag

SEQ ID NO: 162107 - DNA, 20 bp, human
gccaggctcagaccgaaggg

SEQ ID NO: 162108 - DNA, 20 bp, human
ggcttgaagaccacgtacat

SEQ ID NO: 162109 - DNA, 20 bp, human
ggccaggcgttcttgcggtt

SEQ ID NO: 162110 - DNA, 20 bp, human
gcgcccagcgcggcggcgaa

SEQ ID NO: 162111 - DNA, 20 bp, human
ggcgccggctcggctgcaga

SEQ ID NO: 162112 - DNA, 20 bp, human
gcgcggcggcgaagggcagg

SEQ ID NO: 162113 - DNA, 20 bp, human
gtcgcgcacggggtcttctc

SEQ ID NO: 162114 - DNA, 20 bp, human
ggcgccaggctcagaccgaa

SEQ ID NO: 162115 - DNA, 20 bp, human
gccgatgagcatggtgacca

SEQ ID NO: 162116 - DNA, 20 bp, human
ggccgtcggacgggctggaa

SEQ ID NO: 162117 - DNA, 20 bp, human
gggccgctcgggcaggatgg

SEQ ID NO: 162118 - DNA, 20 bp, human
gcggtgtgtgcataggacac

SEQ ID NO: 162119 - DNA, 20 bp, human
gggccgggcgcggaacctac

SEQ ID NO: 162120 - DNA, 20 bp, human
gctggaaggggcggccgctc

SEQ ID NO: 162121 - DNA, 20 bp, human
gcggcgtcgggccgtcggac

SEQ ID NO: 162122 - DNA, 20 bp, human
gccgtggcccgcgcccaccg

SEQ ID NO: 162123 - DNA, 20 bp, human
gcgggcgcagcgagcagcag

SEQ ID NO: 162124 - DNA, 20 bp, human
gaacctaccggtgtgtgcat

SEQ ID NO: 162125 - DNA, 20 bp, human
gatgctgacgtgcgctgaca

SEQ ID NO: 162126 - DNA, 20 bp, human
ggcggggcctaagaggtgcg

SEQ ID NO: 162127 - DNA, 20 bp, human
gcctccaccgcgcacctctt

SEQ ID NO: 162128 - DNA, 20 bp, human
ggcctggagtagaacggctc

SEQ ID NO: 162129 - DNA, 20 bp, human
gtggagtagaacggctcggg

SEQ ID NO: 162130 - DNA, 20 bp, human
ggggcctaagaggtgcgcgg

SEQ ID NO: 162131 - DNA, 20 bp, human
gctggcgggcggggcctaag

SEQ ID NO: 162132 - DNA, 20 bp, human
ggacccccaggagcgaatcc

SEQ ID NO: 162133 - DNA, 20 bp, human
gccgtctgcctggagtagaa

SEQ ID NO: 162134 - DNA, 20 bp, human
ggcacactcagcatcagtac

SEQ ID NO: 162135 - DNA, 20 bp, human
ggctctggggcactgaggag

SEQ ID NO: 162136 - DNA, 20 bp, human
gcctccaccgcgcgcctctc

SEQ ID NO: 162137 - DNA, 20 bp, human
ggcctggagtagaacggccc

SEQ ID NO: 162138 - DNA, 20 bp, human
ggggcctgagaggcgcgcgg

SEQ ID NO: 162139 - DNA, 20 bp, human
ggacccccaggagcgaatcc

SEQ ID NO: 162140 - DNA, 20 bp, human
gccgtctgcctggagtagaa

SEQ ID NO: 162141 - DNA, 20 bp, human
ggcacactcagcatcagtac

SEQ ID NO: 162142 - DNA, 20 bp, human
ggcccgggccgttctactcc

SEQ ID NO: 162143 - DNA, 20 bp, human
ggctctggggcactgaggag

SEQ ID NO: 162144 - DNA, 20 bp, human
ggcggcccacaacgcccccg

SEQ ID NO: 162145 - DNA, 20 bp, human
gaatccgggcagggaaaccc

SEQ ID NO: 162146 - DNA, 20 bp, human
gcgagtagcactcttaacag

SEQ ID NO: 162147 - DNA, 20 bp, human
gtcctagctggcttacaggg

SEQ ID NO: 162148 - DNA, 20 bp, human
ggcatgcacagatcaacccc

SEQ ID NO: 162149 - DNA, 20 bp, human
gtcaccgtctgacccaggag

SEQ ID NO: 162150 - DNA, 20 bp, human
ggcgtcctagctggcttaca

SEQ ID NO: 162151 - DNA, 20 bp, human
gtagctggcttacagggcgg

SEQ ID NO: 162152 - DNA, 20 bp, human
gtaagagtgctactcgcccg

SEQ ID NO: 162153 - DNA, 20 bp, human
gctctgcagaacaacaccat

SEQ ID NO: 162154 - DNA, 20 bp, human
gacgcggcggtggagtagaa

SEQ ID NO: 162155 - DNA, 20 bp, human
gcgtgctgcggcgtcctagc

SEQ ID NO: 162156 - DNA, 20 bp, human
gcagggcagagccaaggtcg

SEQ ID NO: 162157 - DNA, 20 bp, human
gcactaggcgaggaggaaag

SEQ ID NO: 162158 - DNA, 20 bp, human
gtgtgtttccagctcagaca

SEQ ID NO: 162159 - DNA, 20 bp, human
ggtctccgatgctcaagcgt

SEQ ID NO: 162160 - DNA, 20 bp, human
ggcttgagcatcggagaccc

SEQ ID NO: 162161 - DNA, 20 bp, human
gagtggagaccacctggcac

SEQ ID NO: 162162 - DNA, 20 bp, human
ggagcacgcaggagttccca

SEQ ID NO: 162163 - DNA, 20 bp, human
gtcctgctgcgactcacgcc

SEQ ID NO: 162164 - DNA, 20 bp, human
gggagcccacgcttgagcat

SEQ ID NO: 162165 - DNA, 20 bp, human
gtcatctaaaagcataacgt

SEQ ID NO: 162166 - DNA, 20 bp, human
gagcggggcacaggctgagg

SEQ ID NO: 162167 - DNA, 20 bp, human
gtgctcaggggggatcatcg

SEQ ID NO: 162168 - DNA, 20 bp, human
gtcacggagtgagagaccga

SEQ ID NO: 162169 - DNA, 20 bp, human
gtcactccgtgagacacaga

SEQ ID NO: 162170 - DNA, 20 bp, human
ggcgttcccgggcccggaac

SEQ ID NO: 162171 - DNA, 20 bp, human
ggcgcgcactgggactggag

SEQ ID NO: 162172 - DNA, 20 bp, human
gcgggaacgcgcagaggacc

SEQ ID NO: 162173 - DNA, 20 bp, human
gcccgtcccaaaggacccgt

SEQ ID NO: 162174 - DNA, 20 bp, human
gatcatcgcggcagaggctg

SEQ ID NO: 162175 - DNA, 20 bp, human
gggcggtgctgcctgcgaag

SEQ ID NO: 162176 - DNA, 20 bp, human
gcgctgaaggagccgagcgg

SEQ ID NO: 162177 - DNA, 20 bp, human
ggggcttgacagttaatgat

SEQ ID NO: 162178 - DNA, 20 bp, human
gcgcgcaagggcgccgatgg

SEQ ID NO: 162179 - DNA, 20 bp, human
gctggcgagtctgcctccat

SEQ ID NO: 162180 - DNA, 20 bp, human
gccaccgcggaacgccccag

SEQ ID NO: 162181 - DNA, 20 bp, human
gagacgcgcaagggcgccga

SEQ ID NO: 162182 - DNA, 20 bp, human
ggggcgccggagacgcgcaa

SEQ ID NO: 162183 - DNA, 20 bp, human
gggacctcgtccctccaccg

SEQ ID NO: 162184 - DNA, 20 bp, human
ggccccagagcccctcgcgg

SEQ ID NO: 162185 - DNA, 20 bp, human
gcctaatagtgccacagggt

SEQ ID NO: 162186 - DNA, 20 bp, human
gcagacagcccccctcaggg

SEQ ID NO: 162187 - DNA, 20 bp, human
gctgcagcgcacatcctccc

SEQ ID NO: 162188 - DNA, 20 bp, human
gagccagacagcccccctca

SEQ ID NO: 162189 - DNA, 20 bp, human
gccaggatgtaggcgatcgg

SEQ ID NO: 162190 - DNA, 20 bp, human
ggcagcaacctccaagtagg

SEQ ID NO: 162191 - DNA, 20 bp, human
gctgcggagccgcgtcctgg

SEQ ID NO: 162192 - DNA, 20 bp, human
gcgcacagcctcctacttgg

SEQ ID NO: 162193 - DNA, 20 bp, human
ggttgccgcgttgctcactg

SEQ ID NO: 162194 - DNA, 20 bp, human
ggtactgctcccccaggacg

SEQ ID NO: 162195 - DNA, 20 bp, human
ggccgccgcagtgagcaacg

SEQ ID NO: 162196 - DNA, 20 bp, human
gttcccagcggcgcacccag

SEQ ID NO: 162197 - DNA, 20 bp, human
gcgcggcgcagaccctcggt

SEQ ID NO: 162198 - DNA, 20 bp, human
gcgagagcgcacagctggga

SEQ ID NO: 162199 - DNA, 20 bp, human
gccataggcaaagacagagt

SEQ ID NO: 162200 - DNA, 20 bp, human
ggcccggggcgctactcaca

SEQ ID NO: 162201 - DNA, 20 bp, human
gggattcgagagtttcccag

SEQ ID NO: 162202 - DNA, 20 bp, human
gtcacgcctgcggtgtgcta

SEQ ID NO: 162203 - DNA, 20 bp, human
ggcagctcccagacttgagg

SEQ ID NO: 162204 - DNA, 20 bp, human
gcgcctgcggtgtgctaggg

SEQ ID NO: 162205 - DNA, 20 bp, human
gcagctgcaaagggctaccc

SEQ ID NO: 162206 - DNA, 20 bp, human
gagctgccaggctgacggag

SEQ ID NO: 162207 - DNA, 20 bp, human
gcgggcagcagtgctccggg

SEQ ID NO: 162208 - DNA, 20 bp, human
gcaccggctccgcatcacag

SEQ ID NO: 162209 - DNA, 20 bp, human
gcggagaggccggcccgagt

SEQ ID NO: 162210 - DNA, 20 bp, human
gtcggtgctgaaccgtgaga

SEQ ID NO: 162211 - DNA, 20 bp, human
gcggctccgcatcacagcgg

SEQ ID NO: 162212 - DNA, 20 bp, human
ggtgccgcggggatgcggac

SEQ ID NO: 162213 - DNA, 20 bp, human
gagatcagcaccagcggctc

SEQ ID NO: 162214 - DNA, 20 bp, human
ggacgggcgggcgcgcggta

SEQ ID NO: 162215 - DNA, 20 bp, human
ggtgggcgtcggaggtgagg

SEQ ID NO: 162216 - DNA, 20 bp, human
gagggagcgggagctgacag

SEQ ID NO: 162217 - DNA, 20 bp, human
gaactccactcggcccagga

SEQ ID NO: 162218 - DNA, 20 bp, human
gaaaccgtgaaggtctctag

SEQ ID NO: 162219 - DNA, 20 bp, human
gcacgccctcctgggccgag

SEQ ID NO: 162220 - DNA, 20 bp, human
ggggacggcacagtcagcta

SEQ ID NO: 162221 - DNA, 20 bp, human
gcggcttcctcaattgccag

SEQ ID NO: 162222 - DNA, 20 bp, human
gggcccagctcctgaagacg

SEQ ID NO: 162223 - DNA, 20 bp, human
gggaagggccccgacatcac

SEQ ID NO: 162224 - DNA, 20 bp, human
gacccgctccacgccctcct

SEQ ID NO: 162225 - DNA, 20 bp, human
gttcctcaattgccagcggt

SEQ ID NO: 162226 - DNA, 20 bp, human
gtggggttcgctccagttag

SEQ ID NO: 162227 - DNA, 20 bp, human
ggccatgtcggcggacgctg

SEQ ID NO: 162228 - DNA, 20 bp, human
gcgctcgcgcaggagacccc

SEQ ID NO: 162229 - DNA, 20 bp, human
gttggacgccagcactggaa

SEQ ID NO: 162230 - DNA, 20 bp, human
gcaggagaccccgggtgacg

SEQ ID NO: 162231 - DNA, 20 bp, human
ggacgtggaaacaggagcgg

SEQ ID NO: 162232 - DNA, 20 bp, human
gcactggaagggccgtggaa

SEQ ID NO: 162233 - DNA, 20 bp, human
gctcatgtgcacaagtccag

SEQ ID NO: 162234 - DNA, 20 bp, human
gcgccgggccccgtcacccg

SEQ ID NO: 162235 - DNA, 20 bp, human
ggtctctcccagctcgtgga

SEQ ID NO: 162236 - DNA, 20 bp, human
ggcggcacgcgctctaccag

SEQ ID NO: 162237 - DNA, 20 bp, human
gccatcgcccgccggaagag

SEQ ID NO: 162238 - DNA, 20 bp, human
gcctcgagctgtcagctggg

SEQ ID NO: 162239 - DNA, 20 bp, human
ggtcctgaggccgcatctcg

SEQ ID NO: 162240 - DNA, 20 bp, human
gggagcaacacggcgaggaa

SEQ ID NO: 162241 - DNA, 20 bp, human
ggagcgcgtgccgcgagatg

SEQ ID NO: 162242 - DNA, 20 bp, human
gtgctggcgccagacggcac

SEQ ID NO: 162243 - DNA, 20 bp, human
gcgctgctgctggcgccaga

SEQ ID NO: 162244 - DNA, 20 bp, human
ggctcggtgcgggagcaaca

SEQ ID NO: 162245 - DNA, 20 bp, human
gaccagcggccggtgccgtc

SEQ ID NO: 162246 - DNA, 20 bp, human
gccctcgcctgggaaaatcg

SEQ ID NO: 162247 - DNA, 20 bp, human
gggcgctgcccggagtactg

SEQ ID NO: 162248 - DNA, 20 bp, human
gggagggccagcatcggcta

SEQ ID NO: 162249 - DNA, 20 bp, human
ggggcccagacacgcgacag

SEQ ID NO: 162250 - DNA, 20 bp, human
gtcgcctgggaaaatcgagg

SEQ ID NO: 162251 - DNA, 20 bp, human
gctgcccggagtactgcgga

SEQ ID NO: 162252 - DNA, 20 bp, human
gctgcccggccgcccgacaa

SEQ ID NO: 162253 - DNA, 20 bp, human
gcggagtactgcggagggag

SEQ ID NO: 162254 - DNA, 20 bp, human
gctgttgtgccccttaggtg

SEQ ID NO: 162255 - DNA, 20 bp, human
gaccgggacacggggacggg

SEQ ID NO: 162256 - DNA, 20 bp, human
ggtcaggctggttgaaatag

SEQ ID NO: 162257 - DNA, 20 bp, human
gcagggcacagaagaaggcc

SEQ ID NO: 162258 - DNA, 20 bp, human
gacagaagaaggcccggctt

SEQ ID NO: 162259 - DNA, 20 bp, human
gaactcctgacatccgaagc

SEQ ID NO: 162260 - DNA, 20 bp, human
gacgctgccactgttcgcaa

SEQ ID NO: 162261 - DNA, 20 bp, human
ggtaggcacatccaatgctg

SEQ ID NO: 162262 - DNA, 20 bp, human
gtgctcaacatcctcagcat

SEQ ID NO: 162263 - DNA, 20 bp, human
gcagtggcagcgttgccagc

SEQ ID NO: 162264 - DNA, 20 bp, human
gaggcccggcttcggatgtc

SEQ ID NO: 162265 - DNA, 20 bp, human
ggccaccagcaggccactgg

SEQ ID NO: 162266 - DNA, 20 bp, human
gtgctcaacgtcctcaacat

SEQ ID NO: 162267 - DNA, 20 bp, human
gataggcacatccaatgttg

SEQ ID NO: 162268 - DNA, 20 bp, human
gacagaagcaggtgcggcct

SEQ ID NO: 162269 - DNA, 20 bp, human
gaggatggcggagcagacgg

SEQ ID NO: 162270 - DNA, 20 bp, human
gcagtggcagcattgccagt

SEQ ID NO: 162271 - DNA, 20 bp, human
ggtgaggatggcggagcaga

SEQ ID NO: 162272 - DNA, 20 bp, human
gaacctggctctcaaggcag

SEQ ID NO: 162273 - DNA, 20 bp, human
gtgcggcctcggatgtcagg

SEQ ID NO: 162274 - DNA, 20 bp, human
gaggtgcggcctcggatgtc

SEQ ID NO: 162275 - DNA, 20 bp, human
gaccctctgccttgagagcc

SEQ ID NO: 162276 - DNA, 20 bp, human
gtttctcgtatggcttacca

SEQ ID NO: 162277 - DNA, 20 bp, human
gcctcattggagtgcgggtg

SEQ ID NO: 162278 - DNA, 20 bp, human
gcgagggcaggttggaaccc

SEQ ID NO: 162279 - DNA, 20 bp, human
gggccattggtggcaccaga

SEQ ID NO: 162280 - DNA, 20 bp, human
gaccagcgctgccagccctc

SEQ ID NO: 162281 - DNA, 20 bp, human
gtgtgacctcattggagtgc

SEQ ID NO: 162282 - DNA, 20 bp, human
ggtcaggcaggttgaagtag

SEQ ID NO: 162283 - DNA, 20 bp, human
gcggaggctgggtggagcgg

SEQ ID NO: 162284 - DNA, 20 bp, human
gggcaatagggaggtggaag

SEQ ID NO: 162285 - DNA, 20 bp, human
gtagcagggcaatagggagg

SEQ ID NO: 162286 - DNA, 20 bp, human
gggagcaaccaggagctata

SEQ ID NO: 162287 - DNA, 20 bp, human
ggtcaggcgggttcaagtag

SEQ ID NO: 162288 - DNA, 20 bp, human
ggcaaccaggagctataggg

SEQ ID NO: 162289 - DNA, 20 bp, human
gttagggagaaaggagctca

SEQ ID NO: 162290 - DNA, 20 bp, human
ggctatagggagggagtact

SEQ ID NO: 162291 - DNA, 20 bp, human
gggtgactgccagcctgtta

SEQ ID NO: 162292 - DNA, 20 bp, human
gactccctccctatagctcc

SEQ ID NO: 162293 - DNA, 20 bp, human
ggaggggaaatggagcaacc

SEQ ID NO: 162294 - DNA, 20 bp, human
ggccagcctgttagggagaa

SEQ ID NO: 162295 - DNA, 20 bp, human
ggcagggcagatgccaggat

SEQ ID NO: 162296 - DNA, 20 bp, human
gctgatactgaacccgggaa

SEQ ID NO: 162297 - DNA, 20 bp, human
gggctgccgggcagcaaagg

SEQ ID NO: 162298 - DNA, 20 bp, human
gatactgaacccgggaaggg

SEQ ID NO: 162299 - DNA, 20 bp, human
gacgtgatgaggtccggaag

SEQ ID NO: 162300 - DNA, 20 bp, human
ggcagcaaaggaggatggcg

SEQ ID NO: 162301 - DNA, 20 bp, human
ggggatcacgtgatgaggtc

SEQ ID NO: 162302 - DNA, 20 bp, human
ggtggcagatgctccaggtc

SEQ ID NO: 162303 - DNA, 20 bp, human
ggagatagcgcgagggacaa

SEQ ID NO: 162304 - DNA, 20 bp, human
ggatgctccaggtcaggcac

SEQ ID NO: 162305 - DNA, 20 bp, human
gcccaaccccacgaggtcaa

SEQ ID NO: 162306 - DNA, 20 bp, human
gtaagaaactgcctagagag

SEQ ID NO: 162307 - DNA, 20 bp, human
gcactgtgacagctccacta

SEQ ID NO: 162308 - DNA, 20 bp, human
gtcctgggctgccactctct

SEQ ID NO: 162309 - DNA, 20 bp, human
gccagaggccaccccaaata

SEQ ID NO: 162310 - DNA, 20 bp, human
gagccctgaggagagcccgt

SEQ ID NO: 162311 - DNA, 20 bp, human
gaggtcagcagtgaagagat

SEQ ID NO: 162312 - DNA, 20 bp, human
gaagcgctggtaggagcccg

SEQ ID NO: 162313 - DNA, 20 bp, human
gctgaggagagcccgtcgga

SEQ ID NO: 162314 - DNA, 20 bp, human
gaccccaaatatggagctaa

SEQ ID NO: 162315 - DNA, 20 bp, human
gtccacggacgtgagccctg

SEQ ID NO: 162316 - DNA, 20 bp, human
gcatgggctgagtcaagctg

SEQ ID NO: 162317 - DNA, 20 bp, human
gcaaagaggtctgctctgga

SEQ ID NO: 162318 - DNA, 20 bp, human
ggtgacaaagaggtctgctc

SEQ ID NO: 162319 - DNA, 20 bp, human
gttgcaaaaggtgcagtcat

SEQ ID NO: 162320 - DNA, 20 bp, human
gtggatcactatgtccctaa

SEQ ID NO: 162321 - DNA, 20 bp, human
gcttaagaaacaaggagctc

SEQ ID NO: 162322 - DNA, 20 bp, human
ggatcccaaaaggcacaggt

SEQ ID NO: 162323 - DNA, 20 bp, human
gggaccacatactgagtcat

SEQ ID NO: 162324 - DNA, 20 bp, human
ggctgtcagaaaagccctta

SEQ ID NO: 162325 - DNA, 20 bp, human
gtgagtcattggcaggataa

SEQ ID NO: 162326 - DNA, 20 bp, human
gtgagcctggccccacgtcc

SEQ ID NO: 162327 - DNA, 20 bp, human
gaccaggacctccaatccaa

SEQ ID NO: 162328 - DNA, 20 bp, human
ggggaggaagaagacaccat

SEQ ID NO: 162329 - DNA, 20 bp, human
gtgctctctgagggtgactg

SEQ ID NO: 162330 - DNA, 20 bp, human
gcaaagtgaacagtgtgact

SEQ ID NO: 162331 - DNA, 20 bp, human
gcagcagcaagggctaaact

SEQ ID NO: 162332 - DNA, 20 bp, human
gatgctggctcctaacccca

SEQ ID NO: 162333 - DNA, 20 bp, human
ggcctgaagtgcatgaatca

SEQ ID NO: 162334 - DNA, 20 bp, human
gtttagcccttgctgctgta

SEQ ID NO: 162335 - DNA, 20 bp, human
ggactgaggtccgttgtcca

SEQ ID NO: 162336 - DNA, 20 bp, human
gcctgacgccggccacgcag

SEQ ID NO: 162337 - DNA, 20 bp, human
gcaccaggcgcgggtccctc

SEQ ID NO: 162338 - DNA, 20 bp, human
gccgtggtcagcatccgcaa

SEQ ID NO: 162339 - DNA, 20 bp, human
gggcgggagagtgagcactc

SEQ ID NO: 162340 - DNA, 20 bp, human
ggggagagtgagcactcggg

SEQ ID NO: 162341 - DNA, 20 bp, human
gcgcgggtccctccgggcag

SEQ ID NO: 162342 - DNA, 20 bp, human
ggaggcgcgaggagctaggt

SEQ ID NO: 162343 - DNA, 20 bp, human
gccaagcgcggggcccctgg

SEQ ID NO: 162344 - DNA, 20 bp, human
ggagcctgcgccgtgactca

SEQ ID NO: 162345 - DNA, 20 bp, human
gctaggtcggtgttgtgcgt

SEQ ID NO: 162346 - DNA, 20 bp, human
gagccgctccacggagtccc

SEQ ID NO: 162347 - DNA, 20 bp, human
ggggcaacgctgggattccg

SEQ ID NO: 162348 - DNA, 20 bp, human
ggctaagggagacccggaaa

SEQ ID NO: 162349 - DNA, 20 bp, human
gtgccggggactccgtggag

SEQ ID NO: 162350 - DNA, 20 bp, human
gcccgcgcccggctccctga

SEQ ID NO: 162351 - DNA, 20 bp, human
gcgcgagcaggaagcgcccg

SEQ ID NO: 162352 - DNA, 20 bp, human
gctcggagcgccggcaccct

SEQ ID NO: 162353 - DNA, 20 bp, human
gtctgccgcgatggggacgt

SEQ ID NO: 162354 - DNA, 20 bp, human
gaggagccggcacagaacgc

SEQ ID NO: 162355 - DNA, 20 bp, human
gcagccgacaaacaacgcaa

SEQ ID NO: 162356 - DNA, 20 bp, human
gcctaaggctgagtcgacgg

SEQ ID NO: 162357 - DNA, 20 bp, human
ggtacctaaggctgagtcga

SEQ ID NO: 162358 - DNA, 20 bp, human
gtggtcccgagctcctccag

SEQ ID NO: 162359 - DNA, 20 bp, human
gaaggctgagtcgacggagg

SEQ ID NO: 162360 - DNA, 20 bp, human
gaaacgatggagaccctccc

SEQ ID NO: 162361 - DNA, 20 bp, human
gtttgcctgaccggtaccta

SEQ ID NO: 162362 - DNA, 20 bp, human
gccctcctaacacacatccg

SEQ ID NO: 162363 - DNA, 20 bp, human
gaggcgtgccgggacctcct

SEQ ID NO: 162364 - DNA, 20 bp, human
gaaccagactcccggagcca

SEQ ID NO: 162365 - DNA, 20 bp, human
gtcagccttaggtaccggtc

SEQ ID NO: 162366 - DNA, 20 bp, human
gccacggccggaggacaggc

SEQ ID NO: 162367 - DNA, 20 bp, human
ggcgcacccgagatccgcag

SEQ ID NO: 162368 - DNA, 20 bp, human
gcagcggagccaagctgacc

SEQ ID NO: 162369 - DNA, 20 bp, human
gggcttgtcgttcggaccag

SEQ ID NO: 162370 - DNA, 20 bp, human
gggcccggccccgatccatg

SEQ ID NO: 162371 - DNA, 20 bp, human
gtggagagcggcgaccactg

SEQ ID NO: 162372 - DNA, 20 bp, human
ggccaagctgacccggcgag

SEQ ID NO: 162373 - DNA, 20 bp, human
gggcgaccactgcggatctc

SEQ ID NO: 162374 - DNA, 20 bp, human
ggcctgggcgccccacccaa

SEQ ID NO: 162375 - DNA, 20 bp, human
gaccctggtcgcaccgccag

SEQ ID NO: 162376 - DNA, 20 bp, human
gccgcctcctacctgaacag

SEQ ID NO: 162377 - DNA, 20 bp, human
gccgcgcttctggcacccag

SEQ ID NO: 162378 - DNA, 20 bp, human
gctcccgcctctgttcaggt

SEQ ID NO: 162379 - DNA, 20 bp, human
gggtaggaggcggtatgcgg

SEQ ID NO: 162380 - DNA, 20 bp, human
gcgggagcccgaataggacg

SEQ ID NO: 162381 - DNA, 20 bp, human
gctcctacctgaacagaggc

SEQ ID NO: 162382 - DNA, 20 bp, human
ggcctccgggagaatacgtg

SEQ ID NO: 162383 - DNA, 20 bp, human
gggggaggggagtcacctga

SEQ ID NO: 162384 - DNA, 20 bp, human
gggactggcgcgatagaaag

SEQ ID NO: 162385 - DNA, 20 bp, human
gcaactggagcagaaggcgt

SEQ ID NO: 162386 - DNA, 20 bp, human
gaagagcgggcgcacaggag

SEQ ID NO: 162387 - DNA, 20 bp, human
ggcccccgtcagtaagggtt

SEQ ID NO: 162388 - DNA, 20 bp, human
ggagggtaaaaaccccggaa

SEQ ID NO: 162389 - DNA, 20 bp, human
gctgccgagggtaaaaaccc

SEQ ID NO: 162390 - DNA, 20 bp, human
ggaccgcgcgcgggacgggg

SEQ ID NO: 162391 - DNA, 20 bp, human
gcctccggaaataaagggaa

SEQ ID NO: 162392 - DNA, 20 bp, human
gtgcggaggccgggaaaatg

SEQ ID NO: 162393 - DNA, 20 bp, human
ggcccaacccttactgacgg

SEQ ID NO: 162394 - DNA, 20 bp, human
gatgtggcccccgtcagtaa

SEQ ID NO: 162395 - DNA, 20 bp, human
gtgcaatcggcccggaaagg

SEQ ID NO: 162396 - DNA, 20 bp, human
ggtcacaggtcccaacgtcc

SEQ ID NO: 162397 - DNA, 20 bp, human
ggattcacaggcggcccgcg

SEQ ID NO: 162398 - DNA, 20 bp, human
ggaatctccgagcccagacc

SEQ ID NO: 162399 - DNA, 20 bp, human
gccgcggcggcagctgagtt

SEQ ID NO: 162400 - DNA, 20 bp, human
gtctgggctcggagattcac

SEQ ID NO: 162401 - DNA, 20 bp, human
gggatgggcagcctgaacac

SEQ ID NO: 162402 - DNA, 20 bp, human
gggccgccgcctccaactgg

SEQ ID NO: 162403 - DNA, 20 bp, human
ggtcatagtgagaggtctag

SEQ ID NO: 162404 - DNA, 20 bp, human
gctgcggctcttccgggtct

SEQ ID NO: 162405 - DNA, 20 bp, human
gcggccgcggtcatagtgag

SEQ ID NO: 162406 - DNA, 20 bp, human
gccccaagatctctaggctg

SEQ ID NO: 162407 - DNA, 20 bp, human
gttgtctgggcgaactccgg

SEQ ID NO: 162408 - DNA, 20 bp, human
gctgcagccccaagatctct

SEQ ID NO: 162409 - DNA, 20 bp, human
ggccacagcctagagatctt

SEQ ID NO: 162410 - DNA, 20 bp, human
gcatttgtctgggcgaactc

SEQ ID NO: 162411 - DNA, 20 bp, human
ggcagcatctccgtctccgg

SEQ ID NO: 162412 - DNA, 20 bp, human
gaggtcacctaccttcacct

SEQ ID NO: 162413 - DNA, 20 bp, human
ggcctggggcgcttttccac

SEQ ID NO: 162414 - DNA, 20 bp, human
gctggtagcccatggctgag

SEQ ID NO: 162415 - DNA, 20 bp, human
gagcaccgcgaaaagttctc

SEQ ID NO: 162416 - DNA, 20 bp, human
gggagcagccctgcgagcgg

SEQ ID NO: 162417 - DNA, 20 bp, human
ggaaaggcgttctaaggcgg

SEQ ID NO: 162418 - DNA, 20 bp, human
ggtactggaaaggcgttcta

SEQ ID NO: 162419 - DNA, 20 bp, human
ggctgctagcagtactggaa

SEQ ID NO: 162420 - DNA, 20 bp, human
ggtccgccgtgtcaagggaa

SEQ ID NO: 162421 - DNA, 20 bp, human
gctggaaaggcgttctaagg

SEQ ID NO: 162422 - DNA, 20 bp, human
gtccccctaatgggaagatg

SEQ ID NO: 162423 - DNA, 20 bp, human
gggtgtcgcgcccgcgacgt

SEQ ID NO: 162424 - DNA, 20 bp, human
gcgtgcggtaacgcgtggtc

SEQ ID NO: 162425 - DNA, 20 bp, human
gtgcgagcggcgggttatag

SEQ ID NO: 162426 - DNA, 20 bp, human
gggagcagagcgaaccgcac

SEQ ID NO: 162427 - DNA, 20 bp, human
gcctcgcggttgggaacgtg

SEQ ID NO: 162428 - DNA, 20 bp, human
gggctcgggcggcacaccac

SEQ ID NO: 162429 - DNA, 20 bp, human
gtcctgaggcagggcccatg

SEQ ID NO: 162430 - DNA, 20 bp, human
gcgaaccgcaccggcccgag

SEQ ID NO: 162431 - DNA, 20 bp, human
gcgctccgctcgggccggtg

SEQ ID NO: 162432 - DNA, 20 bp, human
gcgaggggaggacccaagag

SEQ ID NO: 162433 - DNA, 20 bp, human
gctctgctcccggctgaact

SEQ ID NO: 162434 - DNA, 20 bp, human
ggtgggatgaactcccgaag

SEQ ID NO: 162435 - DNA, 20 bp, human
gccgcacaggggaatcgggt

SEQ ID NO: 162436 - DNA, 20 bp, human
gaagtcaggaaagcctgcac

SEQ ID NO: 162437 - DNA, 20 bp, human
gaaaactgcaatcaggacct

SEQ ID NO: 162438 - DNA, 20 bp, human
gtttcctgacttgtttggaa

SEQ ID NO: 162439 - DNA, 20 bp, human
gtatatctccaggttgatca

SEQ ID NO: 162440 - DNA, 20 bp, human
gtaaatcaaagctgttacac

SEQ ID NO: 162441 - DNA, 20 bp, human
gtatttatccagtcctgtgc

SEQ ID NO: 162442 - DNA, 20 bp, human
ggtaaaagaaaactgcaatc

SEQ ID NO: 162443 - DNA, 20 bp, human
ggattagtcaaaaattttgt

SEQ ID NO: 162444 - DNA, 20 bp, human
gttcttttacagataatttt

SEQ ID NO: 162445 - DNA, 20 bp, human
gaatgtttgaaaatactact

SEQ ID NO: 162446 - DNA, 20 bp, human
gtgagtggggtgtcccgagg

SEQ ID NO: 162447 - DNA, 20 bp, human
gtggcgtgcacggaggatcg

SEQ ID NO: 162448 - DNA, 20 bp, human
gagcgcctggagcatgagcc

SEQ ID NO: 162449 - DNA, 20 bp, human
gcgggtggtggcgtgcacgg

SEQ ID NO: 162450 - DNA, 20 bp, human
gggcgctgcgcacaccccag

SEQ ID NO: 162451 - DNA, 20 bp, human
gacgtcctgggcggccactg

SEQ ID NO: 162452 - DNA, 20 bp, human
gcgggacaccccactcacac

SEQ ID NO: 162453 - DNA, 20 bp, human
gttagagggtccaggagagt

SEQ ID NO: 162454 - DNA, 20 bp, human
gcgcgggaggctgccgcctc

SEQ ID NO: 162455 - DNA, 20 bp, human
gagagtgggtgagacgaacg

SEQ ID NO: 162456 - DNA, 20 bp, human
gtctggtcctaccctctgtt

SEQ ID NO: 162457 - DNA, 20 bp, human
ggtagtagccaggctattcc

SEQ ID NO: 162458 - DNA, 20 bp, human
gcatgggcagcggcatcctg

SEQ ID NO: 162459 - DNA, 20 bp, human
gcaggagcaggaccacgact

SEQ ID NO: 162460 - DNA, 20 bp, human
gggagtcccatagagaccga

SEQ ID NO: 162461 - DNA, 20 bp, human
gtcttgcctgtagctggata

SEQ ID NO: 162462 - DNA, 20 bp, human
ggaagccaaggagagaccat

SEQ ID NO: 162463 - DNA, 20 bp, human
gactgggccgaagagcgggt

SEQ ID NO: 162464 - DNA, 20 bp, human
ggccagggagggcagtcact

SEQ ID NO: 162465 - DNA, 20 bp, human
gccgggcacacattgggaca

SEQ ID NO: 162466 - DNA, 20 bp, human
gagaggctcgtagatggaac

SEQ ID NO: 162467 - DNA, 20 bp, human
ggaccgacgactggagcgca

SEQ ID NO: 162468 - DNA, 20 bp, human
gcagtgagtacataatccta

SEQ ID NO: 162469 - DNA, 20 bp, human
gtgccctgcgctccagtcgt

SEQ ID NO: 162470 - DNA, 20 bp, human
gaggggtagaggctcgtaga

SEQ ID NO: 162471 - DNA, 20 bp, human
ggaagagatgcagcgttgag

SEQ ID NO: 162472 - DNA, 20 bp, human
gagcagcatggaggcgtcct

SEQ ID NO: 162473 - DNA, 20 bp, human
gcagtcgtcggtcgcgccag

SEQ ID NO: 162474 - DNA, 20 bp, human
gtggaagctgcgaacatgat

SEQ ID NO: 162475 - DNA, 20 bp, human
gtcgtcggtcgcgccagagg

SEQ ID NO: 162476 - DNA, 20 bp, human
gctcgggaaagaatccccca

SEQ ID NO: 162477 - DNA, 20 bp, human
ggccctgagatagaaagggt

SEQ ID NO: 162478 - DNA, 20 bp, human
gggaaagaatcccccaaggt

SEQ ID NO: 162479 - DNA, 20 bp, human
gtggagccctgagatagaaa

SEQ ID NO: 162480 - DNA, 20 bp, human
gtctccggccacctaccttg

SEQ ID NO: 162481 - DNA, 20 bp, human
gggcctggagcgagaagggt

SEQ ID NO: 162482 - DNA, 20 bp, human
ggttagactaaggtcacagt

SEQ ID NO: 162483 - DNA, 20 bp, human
ggtgtctccgcagccggctc

SEQ ID NO: 162484 - DNA, 20 bp, human
gccgatcccggcctaggact

SEQ ID NO: 162485 - DNA, 20 bp, human
ggctggcgcaacagagggac

SEQ ID NO: 162486 - DNA, 20 bp, human
ggcgcccatcgaggacagag

SEQ ID NO: 162487 - DNA, 20 bp, human
ggagctgacgccaaggaagc

SEQ ID NO: 162488 - DNA, 20 bp, human
gaagggggactagaagtcgt

SEQ ID NO: 162489 - DNA, 20 bp, human
gccccgggaagtgagtcctg

SEQ ID NO: 162490 - DNA, 20 bp, human
ggaaaagcctcaccctgcca

SEQ ID NO: 162491 - DNA, 20 bp, human
gagggaatgggagacgaagg

SEQ ID NO: 162492 - DNA, 20 bp, human
gcctggggacgggtacgagg

SEQ ID NO: 162493 - DNA, 20 bp, human
gcagggagctctcactgagt

SEQ ID NO: 162494 - DNA, 20 bp, human
gaaagggggagctgacgcca

SEQ ID NO: 162495 - DNA, 20 bp, human
gagcgggcaggagcggctca

SEQ ID NO: 162496 - DNA, 20 bp, human
gccctcgggtgagagaagga

SEQ ID NO: 162497 - DNA, 20 bp, human
gcacggcgcgcgctcctcaa

SEQ ID NO: 162498 - DNA, 20 bp, human
ggtttggactaggagccccg

SEQ ID NO: 162499 - DNA, 20 bp, human
ggcaatagcctgggtcgcag

SEQ ID NO: 162500 - DNA, 20 bp, human
gctgaccctcgggtgagaga

SEQ ID NO: 162501 - DNA, 20 bp, human
gcaggccgagccttcaacct

SEQ ID NO: 162502 - DNA, 20 bp, human
ggaggtgggaaggtatccga

SEQ ID NO: 162503 - DNA, 20 bp, human
gcttctcgtctagttctccg

SEQ ID NO: 162504 - DNA, 20 bp, human
gaggaaatccgagtgtctat

SEQ ID NO: 162505 - DNA, 20 bp, human
ggaaagtcaggagtccctcg

SEQ ID NO: 162506 - DNA, 20 bp, human
gggtgaagccaaaaaggcta

SEQ ID NO: 162507 - DNA, 20 bp, human
ggccccaggatgggacctag

SEQ ID NO: 162508 - DNA, 20 bp, human
gactgaggcgacactgaggg

SEQ ID NO: 162509 - DNA, 20 bp, human
gccccaactcccgaacggag

SEQ ID NO: 162510 - DNA, 20 bp, human
gcgggtccccaactcccgaa

SEQ ID NO: 162511 - DNA, 20 bp, human
ggcccgcactcacctcgcga

SEQ ID NO: 162512 - DNA, 20 bp, human
gtcgcgagggtctcactaca

SEQ ID NO: 162513 - DNA, 20 bp, human
gccgggaccgcagactctta

SEQ ID NO: 162514 - DNA, 20 bp, human
gctggcagcggggtccatgt

SEQ ID NO: 162515 - DNA, 20 bp, human
gtggagctggagttccccta

SEQ ID NO: 162516 - DNA, 20 bp, human
gggtttggtaccgagcggag

SEQ ID NO: 162517 - DNA, 20 bp, human
ggtcggggctggttccctcg

SEQ ID NO: 162518 - DNA, 20 bp, human
ggccggggtttggtaccgag

SEQ ID NO: 162519 - DNA, 20 bp, human
gcacacggcactcgagtgtg

SEQ ID NO: 162520 - DNA, 20 bp, human
gccgcgggatcgggagccgg

SEQ ID NO: 162521 - DNA, 20 bp, human
gaggctccgccaacctccac

SEQ ID NO: 162522 - DNA, 20 bp, human
gcgaggctttggggatctgt

SEQ ID NO: 162523 - DNA, 20 bp, human
gtccgccaacctccacagga

SEQ ID NO: 162524 - DNA, 20 bp, human
gccgaagcagagcgcgtggt

SEQ ID NO: 162525 - DNA, 20 bp, human
gctttggtgaatacacgatt

SEQ ID NO: 162526 - DNA, 20 bp, human
gcccacacaccgcctaggaa

SEQ ID NO: 162527 - DNA, 20 bp, human
gagagggcaccctagtgagt

SEQ ID NO: 162528 - DNA, 20 bp, human
ggctaacagccagagcaagt

SEQ ID NO: 162529 - DNA, 20 bp, human
gcccgctgccactctctcgc

SEQ ID NO: 162530 - DNA, 20 bp, human
gtaggaagggacgaacgaag

SEQ ID NO: 162531 - DNA, 20 bp, human
ggagaaaagccaactcacta

SEQ ID NO: 162532 - DNA, 20 bp, human
gggggctgatggaagtgcag

SEQ ID NO: 162533 - DNA, 20 bp, human
gggtacgcctggagagagga

SEQ ID NO: 162534 - DNA, 20 bp, human
ggcccaaccaaaggcaccga

SEQ ID NO: 162535 - DNA, 20 bp, human
gggttaggactgtaaaagga

SEQ ID NO: 162536 - DNA, 20 bp, human
ggtggtgactaaaggagtgg

SEQ ID NO: 162537 - DNA, 20 bp, human
gtaactgtgaaatactctcc

SEQ ID NO: 162538 - DNA, 20 bp, human
gtccaggatttaaaaggctg

SEQ ID NO: 162539 - DNA, 20 bp, human
ggactgtgggctagtaacaa

SEQ ID NO: 162540 - DNA, 20 bp, human
gtcagtggtgactaaaggag

SEQ ID NO: 162541 - DNA, 20 bp, human
gatactctccaggatttaaa

SEQ ID NO: 162542 - DNA, 20 bp, human
gctcactcagtggtgactaa

SEQ ID NO: 162543 - DNA, 20 bp, human
gtccacagccttttaaatcc

SEQ ID NO: 162544 - DNA, 20 bp, human
ggggctagtaacaaaggtac

SEQ ID NO: 162545 - DNA, 20 bp, human
gtcttctgaaggtaagcact

SEQ ID NO: 162546 - DNA, 20 bp, human
gcaagacagactcaaggtgg

SEQ ID NO: 162547 - DNA, 20 bp, human
gtccatccaagacagactca

SEQ ID NO: 162548 - DNA, 20 bp, human
gatccaagacagactcaagg

SEQ ID NO: 162549 - DNA, 20 bp, human
gactcaaggtggaggaagcg

SEQ ID NO: 162550 - DNA, 20 bp, human
gagaatggggtcaggtatca

SEQ ID NO: 162551 - DNA, 20 bp, human
gagaagaaacaatggcaccc

SEQ ID NO: 162552 - DNA, 20 bp, human
gacaaagctctcagtatcct

SEQ ID NO: 162553 - DNA, 20 bp, human
ggaaaactgggtgcccacgg

SEQ ID NO: 162554 - DNA, 20 bp, human
gcaaccggcagacctgctac

SEQ ID NO: 162555 - DNA, 20 bp, human
gcggttggcctgaactccca

SEQ ID NO: 162556 - DNA, 20 bp, human
gccaggccttaactaatcag

SEQ ID NO: 162557 - DNA, 20 bp, human
ggcctggaggtcctagacat

SEQ ID NO: 162558 - DNA, 20 bp, human
gcctgctggcactcaccgtg

SEQ ID NO: 162559 - DNA, 20 bp, human
ggctagcgggagggaataca

SEQ ID NO: 162560 - DNA, 20 bp, human
ggcgcggcaccgcagctgga

SEQ ID NO: 162561 - DNA, 20 bp, human
ggcggcggcggcgatccggg

SEQ ID NO: 162562 - DNA, 20 bp, human
gagactgggccaggacgagg

SEQ ID NO: 162563 - DNA, 20 bp, human
ggaatacacggagagtccaa

SEQ ID NO: 162564 - DNA, 20 bp, human
gggacgaggcggtcacgcag

SEQ ID NO: 162565 - DNA, 20 bp, human
ggcaagactgggccaggacg

SEQ ID NO: 162566 - DNA, 20 bp, human
gagtaggtggccaatccgag

SEQ ID NO: 162567 - DNA, 20 bp, human
ggacgcagaacgcagacagt

SEQ ID NO: 162568 - DNA, 20 bp, human
gggcccggacgcagtgaggg

SEQ ID NO: 162569 - DNA, 20 bp, human
gcgctctgggcacccttctg

SEQ ID NO: 162570 - DNA, 20 bp, human
gctcaccgcaaggtcccagg

SEQ ID NO: 162571 - DNA, 20 bp, human
ggtcggcgcgcgtgtctacg

SEQ ID NO: 162572 - DNA, 20 bp, human
ggtgtccgcgcggggaatcc

SEQ ID NO: 162573 - DNA, 20 bp, human
gcaagagccgcccctcggat

SEQ ID NO: 162574 - DNA, 20 bp, human
gaggtggccaatccgagggg

SEQ ID NO: 162575 - DNA, 20 bp, human
gacgcgccgggtatatagcc

SEQ ID NO: 162576 - DNA, 20 bp, human
gcactctcgtgagtttcagg

SEQ ID NO: 162577 - DNA, 20 bp, human
gccaggagtcagaatgacaa

SEQ ID NO: 162578 - DNA, 20 bp, human
gggcagcactcaatatccca

SEQ ID NO: 162579 - DNA, 20 bp, human
gcagagatggagcaactact

SEQ ID NO: 162580 - DNA, 20 bp, human
ggcaggagtggtatcttagg

SEQ ID NO: 162581 - DNA, 20 bp, human
gccctgttggctctcactct

SEQ ID NO: 162582 - DNA, 20 bp, human
gcaggagtctgaggactagc

SEQ ID NO: 162583 - DNA, 20 bp, human
gagagcaaggtatcaggaca

SEQ ID NO: 162584 - DNA, 20 bp, human
gtgtctcctcagtgtcaagt

SEQ ID NO: 162585 - DNA, 20 bp, human
gtgaggtgagactcaggcta

SEQ ID NO: 162586 - DNA, 20 bp, human
ggtgcagcggcgccagtcgg

SEQ ID NO: 162587 - DNA, 20 bp, human
gccacagacgcggcccggag

SEQ ID NO: 162588 - DNA, 20 bp, human
gggcgccgctgcacgcccaa

SEQ ID NO: 162589 - DNA, 20 bp, human
gtcgagactgcgcggccgtt

SEQ ID NO: 162590 - DNA, 20 bp, human
gctgcacgctctcaaaccgg

SEQ ID NO: 162591 - DNA, 20 bp, human
gagtcgtccctcccccccgg

SEQ ID NO: 162592 - DNA, 20 bp, human
ggggcccctcgtccgccgac

SEQ ID NO: 162593 - DNA, 20 bp, human
ggcgccagtcggcggacgag

SEQ ID NO: 162594 - DNA, 20 bp, human
gtaaagtcgtccctcccccc

SEQ ID NO: 162595 - DNA, 20 bp, human
gcgcccagctcaccgccggg

SEQ ID NO: 162596 - DNA, 20 bp, human
gtccgggcgggacttactca

SEQ ID NO: 162597 - DNA, 20 bp, human
gcaaggctcctcccaggtgg

SEQ ID NO: 162598 - DNA, 20 bp, human
gactcaaggctcctcccagg

SEQ ID NO: 162599 - DNA, 20 bp, human
gtcgccccctgggctcacct

SEQ ID NO: 162600 - DNA, 20 bp, human
gcagctcgtgtggcaactcg

SEQ ID NO: 162601 - DNA, 20 bp, human
gcgcccagagtgatcatata

SEQ ID NO: 162602 - DNA, 20 bp, human
ggctcagggttcagcagctc

SEQ ID NO: 162603 - DNA, 20 bp, human
gggctcctcccaggtggcgg

SEQ ID NO: 162604 - DNA, 20 bp, human
ggggctctcctccgccacct

SEQ ID NO: 162605 - DNA, 20 bp, human
ggggcggggagacctggaac

SEQ ID NO: 162606 - DNA, 20 bp, human
ggaggctagtggcagtacct

SEQ ID NO: 162607 - DNA, 20 bp, human
ggagctgagtatggcgtccc

SEQ ID NO: 162608 - DNA, 20 bp, human
gagctcccagcgtgctcagt

SEQ ID NO: 162609 - DNA, 20 bp, human
gtctgccctcatgagcagga

SEQ ID NO: 162610 - DNA, 20 bp, human
gcagggcgctctggatcaag

SEQ ID NO: 162611 - DNA, 20 bp, human
gcaacacccactgagcacgc

SEQ ID NO: 162612 - DNA, 20 bp, human
gtgctcagtgggtgttgctg

SEQ ID NO: 162613 - DNA, 20 bp, human
ggatggcagagggccggcag

SEQ ID NO: 162614 - DNA, 20 bp, human
gcagggctgggggacccgtc

SEQ ID NO: 162615 - DNA, 20 bp, human
gccccagctccagcgagacc

SEQ ID NO: 162616 - DNA, 20 bp, human
gaggagacaaggacacccag

SEQ ID NO: 162617 - DNA, 20 bp, human
gtacctgatagcaggagaca

SEQ ID NO: 162618 - DNA, 20 bp, human
ggtggggtggaagtacatga

SEQ ID NO: 162619 - DNA, 20 bp, human
gctagactgtaaggtaggtg

SEQ ID NO: 162620 - DNA, 20 bp, human
gggatcgatgaccaagaaag

SEQ ID NO: 162621 - DNA, 20 bp, human
gaggccaggtcagacatcag

SEQ ID NO: 162622 - DNA, 20 bp, human
gcccccagctggaaccaaga

SEQ ID NO: 162623 - DNA, 20 bp, human
gtagtgctagactgtaaggt

SEQ ID NO: 162624 - DNA, 20 bp, human
gtcggggtgactggtccagg

SEQ ID NO: 162625 - DNA, 20 bp, human
gtccaggtgtccaggtggat

SEQ ID NO: 162626 - DNA, 20 bp, human
gtaagaagtccggctctcta

SEQ ID NO: 162627 - DNA, 20 bp, human
gccagcttcgcgaaggctag

SEQ ID NO: 162628 - DNA, 20 bp, human
gtggctgcccctcggtccgg

SEQ ID NO: 162629 - DNA, 20 bp, human
gtacagaaagaggatgctgg

SEQ ID NO: 162630 - DNA, 20 bp, human
ggccgggccgtgggacaacg

SEQ ID NO: 162631 - DNA, 20 bp, human
gctgcccggtccgcaggatc

SEQ ID NO: 162632 - DNA, 20 bp, human
ggcaggggggctacagaaag

SEQ ID NO: 162633 - DNA, 20 bp, human
gtgcggagaaccggatcctg

SEQ ID NO: 162634 - DNA, 20 bp, human
ggaaccggatcctgcggacc

SEQ ID NO: 162635 - DNA, 20 bp, human
gttgtcttccagcttcgcga

SEQ ID NO: 162636 - DNA, 20 bp, human
gccgggaaaggagaggatcc

SEQ ID NO: 162637 - DNA, 20 bp, human
gcgtccaagcaaaccgggaa

SEQ ID NO: 162638 - DNA, 20 bp, human
gagggcagtgtgggccggtg

SEQ ID NO: 162639 - DNA, 20 bp, human
ggccgtgggactgctgacct

SEQ ID NO: 162640 - DNA, 20 bp, human
gcagtcccacggccacccag

SEQ ID NO: 162641 - DNA, 20 bp, human
gtgatccctggctgagagta

SEQ ID NO: 162642 - DNA, 20 bp, human
gtgcggcatgccgctgaggg

SEQ ID NO: 162643 - DNA, 20 bp, human
gcggcccaagacatgatccc

SEQ ID NO: 162644 - DNA, 20 bp, human
gctgttctcgcgggatctaa

SEQ ID NO: 162645 - DNA, 20 bp, human
gggaatccctgggacctctt

SEQ ID NO: 162646 - DNA, 20 bp, human
gggacctgtcagagatacag

SEQ ID NO: 162647 - DNA, 20 bp, human
gacagagataaaggccacca

SEQ ID NO: 162648 - DNA, 20 bp, human
ggaaggcgtcggagaaccag

SEQ ID NO: 162649 - DNA, 20 bp, human
gcggcgctgctccgagtcag

SEQ ID NO: 162650 - DNA, 20 bp, human
ggacctgcggggcattgaag

SEQ ID NO: 162651 - DNA, 20 bp, human
gcgctgctccgagtcagagg

SEQ ID NO: 162652 - DNA, 20 bp, human
gagagcgccggagcggatcg

SEQ ID NO: 162653 - DNA, 20 bp, human
ggcagtagccctcaaacgcc

SEQ ID NO: 162654 - DNA, 20 bp, human
gcatatgtacgcaaatcctg

SEQ ID NO: 162655 - DNA, 20 bp, human
gaggctccagaaacgctgcg

SEQ ID NO: 162656 - DNA, 20 bp, human
ggccatggcagctgtagtat

SEQ ID NO: 162657 - DNA, 20 bp, human
gctgtagtatcggcgactcc

SEQ ID NO: 162658 - DNA, 20 bp, human
gcggtcgagtgcagtaccat

SEQ ID NO: 162659 - DNA, 20 bp, human
gactcgaccgggccttgacc

SEQ ID NO: 162660 - DNA, 20 bp, human
gatgggcagcaccgggtata

SEQ ID NO: 162661 - DNA, 20 bp, human
gagctgccatggccgccaag

SEQ ID NO: 162662 - DNA, 20 bp, human
gtatcggcgactccgggtca

SEQ ID NO: 162663 - DNA, 20 bp, human
gggccgcctcttggagacag

SEQ ID NO: 162664 - DNA, 20 bp, human
gagatgccacttggcggcca

SEQ ID NO: 162665 - DNA, 20 bp, human
gcccacgagaatctaatgac

SEQ ID NO: 162666 - DNA, 20 bp, human
ggacataagtcggtgagaca

SEQ ID NO: 162667 - DNA, 20 bp, human
gcacctcccttactgcagga

SEQ ID NO: 162668 - DNA, 20 bp, human
gtccaaagtgcctagactgg

SEQ ID NO: 162669 - DNA, 20 bp, human
ggcactccgaagacataagt

SEQ ID NO: 162670 - DNA, 20 bp, human
gcccaggagcccgacttcaa

SEQ ID NO: 162671 - DNA, 20 bp, human
gatgggaacggagatctgaa

SEQ ID NO: 162672 - DNA, 20 bp, human
gacctgaagcacagcaccag

SEQ ID NO: 162673 - DNA, 20 bp, human
gcaaggacagtaacaaggat

SEQ ID NO: 162674 - DNA, 20 bp, human
gcatgtaccagatctaccca

SEQ ID NO: 162675 - DNA, 20 bp, human
ggctggacgcccttgaagtc

SEQ ID NO: 162676 - DNA, 20 bp, human
gggtccgagggtccaggtag

SEQ ID NO: 162677 - DNA, 20 bp, human
gaaactgcgcggaggcacag

SEQ ID NO: 162678 - DNA, 20 bp, human
gagtagccgaaactgcgcgg

SEQ ID NO: 162679 - DNA, 20 bp, human
ggctcgcacgattatgacca

SEQ ID NO: 162680 - DNA, 20 bp, human
ggctaccggcgcagaagtgg

SEQ ID NO: 162681 - DNA, 20 bp, human
gggagccgagaagaatggtc

SEQ ID NO: 162682 - DNA, 20 bp, human
gccggtagctcgcgacaacg

SEQ ID NO: 162683 - DNA, 20 bp, human
ggcagcttgcggtcagatgg

SEQ ID NO: 162684 - DNA, 20 bp, human
gcgcagaagtggtggcacac

SEQ ID NO: 162685 - DNA, 20 bp, human
gacttggccagaggaaaagt

SEQ ID NO: 162686 - DNA, 20 bp, human
gggcggagagagctggctca

SEQ ID NO: 162687 - DNA, 20 bp, human
ggcaggtcgtccgagcctag

SEQ ID NO: 162688 - DNA, 20 bp, human
gcttatggaagcggtttggg

SEQ ID NO: 162689 - DNA, 20 bp, human
gagctgggcccggcccacgg

SEQ ID NO: 162690 - DNA, 20 bp, human
gatatggtggaaacccaggt

SEQ ID NO: 162691 - DNA, 20 bp, human
gcacgagttctggaggaatg

SEQ ID NO: 162692 - DNA, 20 bp, human
gtcagggcgtccgctaggct

SEQ ID NO: 162693 - DNA, 20 bp, human
gactgtagctgaagttggaa

SEQ ID NO: 162694 - DNA, 20 bp, human
gaagcatatggtggaaaccc

SEQ ID NO: 162695 - DNA, 20 bp, human
gtaacaggagtgcaaggaac

SEQ ID NO: 162696 - DNA, 20 bp, human
gctcacgaaaaccctggtag

SEQ ID NO: 162697 - DNA, 20 bp, human
gactgacacccagtagtgaa

SEQ ID NO: 162698 - DNA, 20 bp, human
gctggacagggacagatcca

SEQ ID NO: 162699 - DNA, 20 bp, human
gcattcggtggcctcctgga

SEQ ID NO: 162700 - DNA, 20 bp, human
ggatgccacaccttgagcac

SEQ ID NO: 162701 - DNA, 20 bp, human
gtatgtaggatccactacca

SEQ ID NO: 162702 - DNA, 20 bp, human
gcgtggctcccttcactact

SEQ ID NO: 162703 - DNA, 20 bp, human
gccagtttggggatacgggt

SEQ ID NO: 162704 - DNA, 20 bp, human
gagcaaacggaggcttgcaa

SEQ ID NO: 162705 - DNA, 20 bp, human
ggaagggtaaggtaacctac

SEQ ID NO: 162706 - DNA, 20 bp, human
gtgtagcgagccgggtgtcg

SEQ ID NO: 162707 - DNA, 20 bp, human
gcggtggcaaacgtgatctg

SEQ ID NO: 162708 - DNA, 20 bp, human
gagtatccccaaccccgagg

SEQ ID NO: 162709 - DNA, 20 bp, human
gccccgccccaggaccccac

SEQ ID NO: 162710 - DNA, 20 bp, human
gaggaggggatagggcgtcc

SEQ ID NO: 162711 - DNA, 20 bp, human
gggactcgggcccaactggt

SEQ ID NO: 162712 - DNA, 20 bp, human
gtgatctggggcagactggg

SEQ ID NO: 162713 - DNA, 20 bp, human
gccgctccgcttccacgcgg

SEQ ID NO: 162714 - DNA, 20 bp, human
gagcgtccagccgcgacacc

SEQ ID NO: 162715 - DNA, 20 bp, human
ggggccaaggaggactgtcg

SEQ ID NO: 162716 - DNA, 20 bp, human
ggaccagaccgagacaccag

SEQ ID NO: 162717 - DNA, 20 bp, human
gtggtgcccggcaccggtgg

SEQ ID NO: 162718 - DNA, 20 bp, human
ggctgagggaagctgttccg

SEQ ID NO: 162719 - DNA, 20 bp, human
ggctccggaacaggtgacca

SEQ ID NO: 162720 - DNA, 20 bp, human
ggcgggtggtgtatgagtga

SEQ ID NO: 162721 - DNA, 20 bp, human
ggcccgggaccgcttgtccg

SEQ ID NO: 162722 - DNA, 20 bp, human
gcgagcagccgtgccccctg

SEQ ID NO: 162723 - DNA, 20 bp, human
gagcttccctcagcccgagg

SEQ ID NO: 162724 - DNA, 20 bp, human
gcgcatcaggtgcgggaggg

SEQ ID NO: 162725 - DNA, 20 bp, human
gaagctgacagcccggccgt

SEQ ID NO: 162726 - DNA, 20 bp, human
gagcggcctcagacacctaa

SEQ ID NO: 162727 - DNA, 20 bp, human
gcgggtcccctcccaggcgg

SEQ ID NO: 162728 - DNA, 20 bp, human
ggccggccggtcctaccctt

SEQ ID NO: 162729 - DNA, 20 bp, human
gcgctgcggtgtgcattcag

SEQ ID NO: 162730 - DNA, 20 bp, human
ggcctcagacacctaagggt

SEQ ID NO: 162731 - DNA, 20 bp, human
ggcagcagacgcccaagctc

SEQ ID NO: 162732 - DNA, 20 bp, human
ggtaagcgcggccctgttcc

SEQ ID NO: 162733 - DNA, 20 bp, human
gttcccgccgccgcctggga

SEQ ID NO: 162734 - DNA, 20 bp, human
gtaaacacgaggggtcggag

SEQ ID NO: 162735 - DNA, 20 bp, human
gagcgcggccctgttccggg

SEQ ID NO: 162736 - DNA, 20 bp, human
gggaccgcgggcgcaagtaa

SEQ ID NO: 162737 - DNA, 20 bp, human
gaggaagagaagagtcggag

SEQ ID NO: 162738 - DNA, 20 bp, human
ggcccagcttcgcagacctc

SEQ ID NO: 162739 - DNA, 20 bp, human
gcgtcggctgagagacaccg

SEQ ID NO: 162740 - DNA, 20 bp, human
gaagctgggcttggatgaag

SEQ ID NO: 162741 - DNA, 20 bp, human
gagggtctccggctatgcgt

SEQ ID NO: 162742 - DNA, 20 bp, human
gtccccctggaagaagtgac

SEQ ID NO: 162743 - DNA, 20 bp, human
gggaagcctggcagtgtcgg

SEQ ID NO: 162744 - DNA, 20 bp, human
ggtctcctcggaagaagcgg

SEQ ID NO: 162745 - DNA, 20 bp, human
gcggccccagagggaaggag

SEQ ID NO: 162746 - DNA, 20 bp, human
gagatcagcgcccagaccta

SEQ ID NO: 162747 - DNA, 20 bp, human
gagcgcccagacctacggaa

SEQ ID NO: 162748 - DNA, 20 bp, human
ggggcgggcccgacacacgc

SEQ ID NO: 162749 - DNA, 20 bp, human
gcgggcccgacacacgccgg

SEQ ID NO: 162750 - DNA, 20 bp, human
gcgggccgttccgtaggtct

SEQ ID NO: 162751 - DNA, 20 bp, human
gcgggtgagctgcagcaggg

SEQ ID NO: 162752 - DNA, 20 bp, human
gctcactccgaggtaaactg

SEQ ID NO: 162753 - DNA, 20 bp, human
gctgtcagggtccctgggag

SEQ ID NO: 162754 - DNA, 20 bp, human
gggcgggagggcacctgtca

SEQ ID NO: 162755 - DNA, 20 bp, human
gcgacacacgccggaggagc

SEQ ID NO: 162756 - DNA, 20 bp, human
gggcgcggagcaggcgggta

SEQ ID NO: 162757 - DNA, 20 bp, human
ggaacctggcccgtgcggaa

SEQ ID NO: 162758 - DNA, 20 bp, human
ggccccggcgcggagcaggc

SEQ ID NO: 162759 - DNA, 20 bp, human
gagcaggcgggtagggcgaa

SEQ ID NO: 162760 - DNA, 20 bp, human
ggccccatggcgcccgaaag

SEQ ID NO: 162761 - DNA, 20 bp, human
gaatgcgaacctggcccgtg

SEQ ID NO: 162762 - DNA, 20 bp, human
gctaccaggaaagcctccgg

SEQ ID NO: 162763 - DNA, 20 bp, human
gtagaagttgatgcgaggaa

SEQ ID NO: 162764 - DNA, 20 bp, human
ggataacaccaacttggcag

SEQ ID NO: 162765 - DNA, 20 bp, human
gagtcctaggcgagggtcat

SEQ ID NO: 162766 - DNA, 20 bp, human
ggccagcgcacgggcatcgg

SEQ ID NO: 162767 - DNA, 20 bp, human
gaggcgccggccacatcccc

SEQ ID NO: 162768 - DNA, 20 bp, human
ggacagcgagaggtatcggg

SEQ ID NO: 162769 - DNA, 20 bp, human
ggacccggcggacggaaagg

SEQ ID NO: 162770 - DNA, 20 bp, human
gagccgcggagccagcgcac

SEQ ID NO: 162771 - DNA, 20 bp, human
ggcggctggtactcaagagg

SEQ ID NO: 162772 - DNA, 20 bp, human
gtccgcggctgccgactcaa

SEQ ID NO: 162773 - DNA, 20 bp, human
gtgcacggtgcgctcagggg

SEQ ID NO: 162774 - DNA, 20 bp, human
gaggcggcgcggctagaggc

SEQ ID NO: 162775 - DNA, 20 bp, human
gcaagaggcggcgcggctag

SEQ ID NO: 162776 - DNA, 20 bp, human
gcggaggcggctcctaccgt

SEQ ID NO: 162777 - DNA, 20 bp, human
gagaggcggcccctgaccgg

SEQ ID NO: 162778 - DNA, 20 bp, human
gaggggaggcgcggcgatct

SEQ ID NO: 162779 - DNA, 20 bp, human
gcgcggccatggaggacgag

SEQ ID NO: 162780 - DNA, 20 bp, human
gggcgacccggttagagcag

SEQ ID NO: 162781 - DNA, 20 bp, human
ggggaaactgaggcaagact

SEQ ID NO: 162782 - DNA, 20 bp, human
gctgggctcggaaaagagac

SEQ ID NO: 162783 - DNA, 20 bp, human
gggaggtcccgttatctggg

SEQ ID NO: 162784 - DNA, 20 bp, human
ggaaaaacggagcctacggt

SEQ ID NO: 162785 - DNA, 20 bp, human
gtggaggacgagcggaaaaa

SEQ ID NO: 162786 - DNA, 20 bp, human
gcgaccctcccgagtctgga

SEQ ID NO: 162787 - DNA, 20 bp, human
gcctccctccagactcggga

SEQ ID NO: 162788 - DNA, 20 bp, human
gagatctgaggtgggatagg

SEQ ID NO: 162789 - DNA, 20 bp, human
gtgaccaccacggaaccagg

SEQ ID NO: 162790 - DNA, 20 bp, human
gccctcgaccctcccgagtc

SEQ ID NO: 162791 - DNA, 20 bp, human
gacggaaccaggtggagatg

SEQ ID NO: 162792 - DNA, 20 bp, human
gtaactggcggccacccact

SEQ ID NO: 162793 - DNA, 20 bp, human
ggctgaaatggtgaccacca

SEQ ID NO: 162794 - DNA, 20 bp, human
ggcactgaccgcgcgactgg

SEQ ID NO: 162795 - DNA, 20 bp, human
ggatggggaagatctgaggt

SEQ ID NO: 162796 - DNA, 20 bp, human
gcgtctccgcgtacaggagg

SEQ ID NO: 162797 - DNA, 20 bp, human
ggccccaaggtactaagcgg

SEQ ID NO: 162798 - DNA, 20 bp, human
gcgcagagcaggtgtttcaa

SEQ ID NO: 162799 - DNA, 20 bp, human
gggcggcggctcccagtcac

SEQ ID NO: 162800 - DNA, 20 bp, human
ggcgctgcgtctccgcgtac

SEQ ID NO: 162801 - DNA, 20 bp, human
gtataggaaatgcacagata

SEQ ID NO: 162802 - DNA, 20 bp, human
ggtggccccaaggtactaag

SEQ ID NO: 162803 - DNA, 20 bp, human
gctgcgtctccgcgtacagg

SEQ ID NO: 162804 - DNA, 20 bp, human
gcgccgccgcctcctgtacg

SEQ ID NO: 162805 - DNA, 20 bp, human
gagcccctaggcaaagggag

SEQ ID NO: 162806 - DNA, 20 bp, human
gccggagactgagccatggg

SEQ ID NO: 162807 - DNA, 20 bp, human
gctcgccccagtctcaccgt

SEQ ID NO: 162808 - DNA, 20 bp, human
gtggggccctgagcagaata

SEQ ID NO: 162809 - DNA, 20 bp, human
ggtgagacgccaggtctcca

SEQ ID NO: 162810 - DNA, 20 bp, human
ggaggcctacggtgagactg

SEQ ID NO: 162811 - DNA, 20 bp, human
gctggactctgggtccctaa

SEQ ID NO: 162812 - DNA, 20 bp, human
gcagcgggacgaggatgacg

SEQ ID NO: 162813 - DNA, 20 bp, human
gacgaggatgacgaggccta

SEQ ID NO: 162814 - DNA, 20 bp, human
gcagggtccctgtaaggagg

SEQ ID NO: 162815 - DNA, 20 bp, human
ggcagagcctgcaaccagtg

SEQ ID NO: 162816 - DNA, 20 bp, human
gccacagcagcgcaagaggg

SEQ ID NO: 162817 - DNA, 20 bp, human
gccaggcgcggccaagtgga

SEQ ID NO: 162818 - DNA, 20 bp, human
gagcgcaagaggggggccag

SEQ ID NO: 162819 - DNA, 20 bp, human
ggcggcgcggccgagagcag

SEQ ID NO: 162820 - DNA, 20 bp, human
gaagtggaaggctcctgccg

SEQ ID NO: 162821 - DNA, 20 bp, human
gacatccaggcgcggccaag

SEQ ID NO: 162822 - DNA, 20 bp, human
gcccaggcgagccctcgccg

SEQ ID NO: 162823 - DNA, 20 bp, human
ggaaagccccccagcatcaa

SEQ ID NO: 162824 - DNA, 20 bp, human
ggtaaacaggccggcccgag

SEQ ID NO: 162825 - DNA, 20 bp, human
gcgccgagtagcaaaggggt

SEQ ID NO: 162826 - DNA, 20 bp, human
gaggagacggtggtacctgt

SEQ ID NO: 162827 - DNA, 20 bp, human
ggcctggtccctagtcacct

SEQ ID NO: 162828 - DNA, 20 bp, human
ggctgctgcagcatcacccg

SEQ ID NO: 162829 - DNA, 20 bp, human
gcagcagcccagcggggaca

SEQ ID NO: 162830 - DNA, 20 bp, human
gaggcccctggtcaacaaga

SEQ ID NO: 162831 - DNA, 20 bp, human
gaggcatccctgtccccgct

SEQ ID NO: 162832 - DNA, 20 bp, human
ggccctcgctaagtaaccct

SEQ ID NO: 162833 - DNA, 20 bp, human
gagacttccacgaggaacaa

SEQ ID NO: 162834 - DNA, 20 bp, human
gccccgtctcgcccctccga

SEQ ID NO: 162835 - DNA, 20 bp, human
gtcccagggttacttagcga

SEQ ID NO: 162836 - DNA, 20 bp, human
gtaagtgggctgcacaaggt

SEQ ID NO: 162837 - DNA, 20 bp, human
gctcccagggtgaggatgta

SEQ ID NO: 162838 - DNA, 20 bp, human
gcacctcctgcgtggtccta

SEQ ID NO: 162839 - DNA, 20 bp, human
gtgggagtcatgatgctcgt

SEQ ID NO: 162840 - DNA, 20 bp, human
ggaccctaggaccacgcagg

SEQ ID NO: 162841 - DNA, 20 bp, human
ggaccctacatcctcaccct

SEQ ID NO: 162842 - DNA, 20 bp, human
gactgttgtagcaggtaagt

SEQ ID NO: 162843 - DNA, 20 bp, human
gatggctctgtacctcaatg

SEQ ID NO: 162844 - DNA, 20 bp, human
gtggccatgggtagcaacag

SEQ ID NO: 162845 - DNA, 20 bp, human
gaggtggtgggctcgcagga

SEQ ID NO: 162846 - DNA, 20 bp, human
gccccacgcgcgccagccgg

SEQ ID NO: 162847 - DNA, 20 bp, human
gaggctgcaacaggagccag

SEQ ID NO: 162848 - DNA, 20 bp, human
gagccccgcgcgaatcccag

SEQ ID NO: 162849 - DNA, 20 bp, human
gccgccccggcagagcgtgt

SEQ ID NO: 162850 - DNA, 20 bp, human
gctccccccgcggagtaacc

SEQ ID NO: 162851 - DNA, 20 bp, human
gaagaaaagtctgacacggg

SEQ ID NO: 162852 - DNA, 20 bp, human
gtctccaggttactccgcgg

SEQ ID NO: 162853 - DNA, 20 bp, human
ggcgcgctcctacctggccg

SEQ ID NO: 162854 - DNA, 20 bp, human
gggcgcagccccatcccgcg

SEQ ID NO: 162855 - DNA, 20 bp, human
gccgtcggcccggcccggtc

SEQ ID NO: 162856 - DNA, 20 bp, human
ggagtgcctgcccgaggagc

SEQ ID NO: 162857 - DNA, 20 bp, human
ggaccctgtgtccagcttgt

SEQ ID NO: 162858 - DNA, 20 bp, human
ggagctgttgggtgcccgag

SEQ ID NO: 162859 - DNA, 20 bp, human
gtcttcactggccagctcct

SEQ ID NO: 162860 - DNA, 20 bp, human
gatgggtggctgtgctgata

SEQ ID NO: 162861 - DNA, 20 bp, human
gggagcccatgctccagctg

SEQ ID NO: 162862 - DNA, 20 bp, human
gtgtgtggagtggagctgtt

SEQ ID NO: 162863 - DNA, 20 bp, human
gggagaaacagtggccccct

SEQ ID NO: 162864 - DNA, 20 bp, human
gtccactgaggtcaaatcaa

SEQ ID NO: 162865 - DNA, 20 bp, human
gtgcccacaagctggacaca

SEQ ID NO: 162866 - DNA, 20 bp, human
ggtagtggcgggtaactgga

SEQ ID NO: 162867 - DNA, 20 bp, human
ggcctgaccgagaacctcag

SEQ ID NO: 162868 - DNA, 20 bp, human
gggagctgtcgccaggcggg

SEQ ID NO: 162869 - DNA, 20 bp, human
ggctcaccacgcagtatctg

SEQ ID NO: 162870 - DNA, 20 bp, human
gaccgagaacctcagcgggt

SEQ ID NO: 162871 - DNA, 20 bp, human
gcgccgcgcacgcacatgga

SEQ ID NO: 162872 - DNA, 20 bp, human
gaggggcggggcctgcgtaa

SEQ ID NO: 162873 - DNA, 20 bp, human
gggggcctgcgtaatggtag

SEQ ID NO: 162874 - DNA, 20 bp, human
ggtggcgggtaactggaggg

SEQ ID NO: 162875 - DNA, 20 bp, human
gatggcacccgccaaagggg

SEQ ID NO: 162876 - DNA, 20 bp, human
gccagtggcgagcagagcca

SEQ ID NO: 162877 - DNA, 20 bp, human
gcctgggacgaggccaccac

SEQ ID NO: 162878 - DNA, 20 bp, human
ggcccgtaggcggacagcag

SEQ ID NO: 162879 - DNA, 20 bp, human
gagccccgcatcgtagaggg

SEQ ID NO: 162880 - DNA, 20 bp, human
ggggggacaggcccaccaca

SEQ ID NO: 162881 - DNA, 20 bp, human
gaggcgtcctacggaaccgg

SEQ ID NO: 162882 - DNA, 20 bp, human
gtgaggaggagtcactcggg

SEQ ID NO: 162883 - DNA, 20 bp, human
gtcacaggcgctgcgtgccc

SEQ ID NO: 162884 - DNA, 20 bp, human
gtcgtggtgaaggcgtccta

SEQ ID NO: 162885 - DNA, 20 bp, human
gtgccagcccatcgccccgg

SEQ ID NO: 162886 - DNA, 20 bp, human
gcacgagcgcagggcatccg

SEQ ID NO: 162887 - DNA, 20 bp, human
gagggccgctgaccgaccga

SEQ ID NO: 162888 - DNA, 20 bp, human
ggccgctgaccgaccgacgg

SEQ ID NO: 162889 - DNA, 20 bp, human
ggcaggaagactgtaatcgt

SEQ ID NO: 162890 - DNA, 20 bp, human
gacaggtcgggccgtgccag

SEQ ID NO: 162891 - DNA, 20 bp, human
ggccaggctgggtacaggtc

SEQ ID NO: 162892 - DNA, 20 bp, human
gccagcgctaggcgatgact

SEQ ID NO: 162893 - DNA, 20 bp, human
ggcctccgtcggtcggtcag

SEQ ID NO: 162894 - DNA, 20 bp, human
gagggccgcggggaagccga

SEQ ID NO: 162895 - DNA, 20 bp, human
ggcatcgctgtccgccgagg

SEQ ID NO: 162896 - DNA, 20 bp, human
gaggccggcagtgggtaccg

SEQ ID NO: 162897 - DNA, 20 bp, human
gccggcagtgggtaccgcgg

SEQ ID NO: 162898 - DNA, 20 bp, human
ggtgagtaaggtggcctcag

SEQ ID NO: 162899 - DNA, 20 bp, human
gtactcactgccggcctccg

SEQ ID NO: 162900 - DNA, 20 bp, human
gcgcgacccacggacctcaa

SEQ ID NO: 162901 - DNA, 20 bp, human
gctgcggccgggtagcgcgg

SEQ ID NO: 162902 - DNA, 20 bp, human
gccgccaaagtcacccgcgg

SEQ ID NO: 162903 - DNA, 20 bp, human
gcagtgggtaccgcggaggc

SEQ ID NO: 162904 - DNA, 20 bp, human
gggcgcatgttggctcggag

SEQ ID NO: 162905 - DNA, 20 bp, human
gctcagtggcaggccggtac

SEQ ID NO: 162906 - DNA, 20 bp, human
gcagtggccctggaccatgg

SEQ ID NO: 162907 - DNA, 20 bp, human
gggcagcccccacacagaag

SEQ ID NO: 162908 - DNA, 20 bp, human
gccagtgccccggccaggaa

SEQ ID NO: 162909 - DNA, 20 bp, human
gtgcagggtagccagtgccc

SEQ ID NO: 162910 - DNA, 20 bp, human
gggctgtccattcctggccg

SEQ ID NO: 162911 - DNA, 20 bp, human
gagatggctccaggacaaat

SEQ ID NO: 162912 - DNA, 20 bp, human
gcctggaggctgtccattcc

SEQ ID NO: 162913 - DNA, 20 bp, human
gctgccaggtccagagtctg

SEQ ID NO: 162914 - DNA, 20 bp, human
ggtctctggacaatccccag

SEQ ID NO: 162915 - DNA, 20 bp, human
gggtagccagtgccccggcc

SEQ ID NO: 162916 - DNA, 20 bp, human
ggagcgcggccgagagtcac

SEQ ID NO: 162917 - DNA, 20 bp, human
gggccgtcggcacccccagg

SEQ ID NO: 162918 - DNA, 20 bp, human
ggccctgcacctgtgactct

SEQ ID NO: 162919 - DNA, 20 bp, human
ggtgccgtgacagataaccc

SEQ ID NO: 162920 - DNA, 20 bp, human
gccgtgacagataacccggg

SEQ ID NO: 162921 - DNA, 20 bp, human
ggtacctgcgagccctccca

SEQ ID NO: 162922 - DNA, 20 bp, human
ggccgagagtcacaggtgca

SEQ ID NO: 162923 - DNA, 20 bp, human
ggagggctcgcaggtacccc

SEQ ID NO: 162924 - DNA, 20 bp, human
gcagccccatggccccgtcc

SEQ ID NO: 162925 - DNA, 20 bp, human
gccccaggtggcgcccgggc

SEQ ID NO: 162926 - DNA, 20 bp, human
gctcaggcggatgtccactc

SEQ ID NO: 162927 - DNA, 20 bp, human
gctttggagtccgcacccgg

SEQ ID NO: 162928 - DNA, 20 bp, human
gtgccccctggggatactct

SEQ ID NO: 162929 - DNA, 20 bp, human
ggttgtggcagagcttccag

SEQ ID NO: 162930 - DNA, 20 bp, human
ggagcccagagtatccccag

SEQ ID NO: 162931 - DNA, 20 bp, human
ggcacccgggggtaccagag

SEQ ID NO: 162932 - DNA, 20 bp, human
gacggtagaggaatgcgtag

SEQ ID NO: 162933 - DNA, 20 bp, human
gtatccccagggggcaggag

SEQ ID NO: 162934 - DNA, 20 bp, human
gggagcggccccgaagtgtg

SEQ ID NO: 162935 - DNA, 20 bp, human
ggcggccccgaagtgtgtgg

SEQ ID NO: 162936 - DNA, 20 bp, human
gtggtcgcagagggcaccag

SEQ ID NO: 162937 - DNA, 20 bp, human
gtggtgctgtcagaacgagt

SEQ ID NO: 162938 - DNA, 20 bp, human
gctgaggctcgtgagcaggt

SEQ ID NO: 162939 - DNA, 20 bp, human
gcacgagcctcagggtccct

SEQ ID NO: 162940 - DNA, 20 bp, human
ggaacgtagctggtcgcaga

SEQ ID NO: 162941 - DNA, 20 bp, human
gcctaagggaacaggcccat

SEQ ID NO: 162942 - DNA, 20 bp, human
ggacatcctgcctcctaggt

SEQ ID NO: 162943 - DNA, 20 bp, human
gggacaagacctgaccctgt

SEQ ID NO: 162944 - DNA, 20 bp, human
ggaacgagtgggaacgtagc

SEQ ID NO: 162945 - DNA, 20 bp, human
ggcacctgtagaagccctca

SEQ ID NO: 162946 - DNA, 20 bp, human
gagcaaggtgcttattccag

SEQ ID NO: 162947 - DNA, 20 bp, human
gcagagagataagcagtaac

SEQ ID NO: 162948 - DNA, 20 bp, human
ggagataagcagtaacaggc

SEQ ID NO: 162949 - DNA, 20 bp, human
gtactaagcagagcgagtgc

SEQ ID NO: 162950 - DNA, 20 bp, human
gccagaggcgttacaaaaca

SEQ ID NO: 162951 - DNA, 20 bp, human
ggcaggttgtctcttaccgt

SEQ ID NO: 162952 - DNA, 20 bp, human
gctcttaccgtaggcagcag

SEQ ID NO: 162953 - DNA, 20 bp, human
gtctcaatatggatgcacta

SEQ ID NO: 162954 - DNA, 20 bp, human
gtcctacgacatatggacag

SEQ ID NO: 162955 - DNA, 20 bp, human
gaggggtctcctcccatctt

SEQ ID NO: 162956 - DNA, 20 bp, human
gggtccccgacgggagacgg

SEQ ID NO: 162957 - DNA, 20 bp, human
ggggcggggagctcgaaagt

SEQ ID NO: 162958 - DNA, 20 bp, human
gtggcacactcgcgcactca

SEQ ID NO: 162959 - DNA, 20 bp, human
gcgcttctggaccccaaact

SEQ ID NO: 162960 - DNA, 20 bp, human
gtgcgactgaggcagacccc

SEQ ID NO: 162961 - DNA, 20 bp, human
gtgatgcagcgggtcgaggg

SEQ ID NO: 162962 - DNA, 20 bp, human
gccggggccggtgggcgaga

SEQ ID NO: 162963 - DNA, 20 bp, human
gagcgccggagcgccgcgtg

SEQ ID NO: 162964 - DNA, 20 bp, human
gagctgatgcagcgggtcga

SEQ ID NO: 162965 - DNA, 20 bp, human
gggctcctcacgcggcgctc

SEQ ID NO: 162966 - DNA, 20 bp, human
gtggcgtcgcaagacctcag

SEQ ID NO: 162967 - DNA, 20 bp, human
ggccagacagcctcccgaaa

SEQ ID NO: 162968 - DNA, 20 bp, human
ggcttagagaccctgaaggg

SEQ ID NO: 162969 - DNA, 20 bp, human
ggtggtaccgagacaccgaa

SEQ ID NO: 162970 - DNA, 20 bp, human
gaagttgcaccggttgagga

SEQ ID NO: 162971 - DNA, 20 bp, human
gcttcttgaagtccccactg

SEQ ID NO: 162972 - DNA, 20 bp, human
gtggcacccgtagcttgaaa

SEQ ID NO: 162973 - DNA, 20 bp, human
gtgaagggcggcactatcct

SEQ ID NO: 162974 - DNA, 20 bp, human
ggctctgccggtgtccccag

SEQ ID NO: 162975 - DNA, 20 bp, human
gaccgaagggtgggtttcga

SEQ ID NO: 162976 - DNA, 20 bp, human
ggcgcgggggaaagttgagt

SEQ ID NO: 162977 - DNA, 20 bp, human
gggagactaccccctcctgg

SEQ ID NO: 162978 - DNA, 20 bp, human
gaagttgagttgggagaagt

SEQ ID NO: 162979 - DNA, 20 bp, human
gggactgaaggactatgcgg

SEQ ID NO: 162980 - DNA, 20 bp, human
gacgggactgaaggactatg

SEQ ID NO: 162981 - DNA, 20 bp, human
gctggagccagccggggagt

SEQ ID NO: 162982 - DNA, 20 bp, human
ggaaggagaggggggaactc

SEQ ID NO: 162983 - DNA, 20 bp, human
gaagtccagagcgagcgggt

SEQ ID NO: 162984 - DNA, 20 bp, human
gtaccccctcctggtggcag

SEQ ID NO: 162985 - DNA, 20 bp, human
gggagggggtagtctccccg

SEQ ID NO: 162986 - DNA, 20 bp, human
gtcgcacctgaggccgcagg

SEQ ID NO: 162987 - DNA, 20 bp, human
ggcaggaggaagtccatggc

SEQ ID NO: 162988 - DNA, 20 bp, human
gagggcatcgggatctccaa

SEQ ID NO: 162989 - DNA, 20 bp, human
gcgcagacccctcgcacctg

SEQ ID NO: 162990 - DNA, 20 bp, human
gcagggagcttgccgccatg

SEQ ID NO: 162991 - DNA, 20 bp, human
gaggaagtccatggccggca

SEQ ID NO: 162992 - DNA, 20 bp, human
gctggagctgagaccgtggg

SEQ ID NO: 162993 - DNA, 20 bp, human
gggcaggggtgaacctgaga

SEQ ID NO: 162994 - DNA, 20 bp, human
gggactggagcagctgggac

SEQ ID NO: 162995 - DNA, 20 bp, human
gaagagcttctggacctgaa

SEQ ID NO: 162996 - DNA, 20 bp, human
gtgcgctgcgagaggccgga

SEQ ID NO: 162997 - DNA, 20 bp, human
gagaggccggacggcagtcg

SEQ ID NO: 162998 - DNA, 20 bp, human
gagagagcgcgggggacatg

SEQ ID NO: 162999 - DNA, 20 bp, human
gaggagaggggagggacctt

SEQ ID NO: 163000 - DNA, 20 bp, human
gccgcgcgcgccgatcacct

SEQ ID NO: 163001 - DNA, 20 bp, human
gggtgggcagaggagtcctc

SEQ ID NO: 163002 - DNA, 20 bp, human
gcccgccccgcggtacctcg

SEQ ID NO: 163003 - DNA, 20 bp, human
gccccgctaggccccctcag

SEQ ID NO: 163004 - DNA, 20 bp, human
ggcgtggctgggcctcggag

SEQ ID NO: 163005 - DNA, 20 bp, human
ggagtgatcccgccgcccgg

SEQ ID NO: 163006 - DNA, 20 bp, human
gccccagcctccaaccccgg

SEQ ID NO: 163007 - DNA, 20 bp, human
ggcgccgggcagcgcttcgg

SEQ ID NO: 163008 - DNA, 20 bp, human
gagtttggcggcggagtgtg

SEQ ID NO: 163009 - DNA, 20 bp, human
gccgggcagcgcttcggtgg

SEQ ID NO: 163010 - DNA, 20 bp, human
ggctgccgggagggtcgatg

SEQ ID NO: 163011 - DNA, 20 bp, human
gcccgggggccgattccgta

SEQ ID NO: 163012 - DNA, 20 bp, human
gccgcccgcgcccagctcag

SEQ ID NO: 163013 - DNA, 20 bp, human
gcgccaaactggaggagcga

SEQ ID NO: 163014 - DNA, 20 bp, human
ggcaggggacttagcagtga

SEQ ID NO: 163015 - DNA, 20 bp, human
gagggtttagaggaagagtt

SEQ ID NO: 163016 - DNA, 20 bp, human
ggtggaagtagcagccaggg

SEQ ID NO: 163017 - DNA, 20 bp, human
gggattccagacttagggaa

SEQ ID NO: 163018 - DNA, 20 bp, human
gaccacatccctgaagagga

SEQ ID NO: 163019 - DNA, 20 bp, human
gagcctaggggtcagtgaca

SEQ ID NO: 163020 - DNA, 20 bp, human
ggttagggctatattatgag

SEQ ID NO: 163021 - DNA, 20 bp, human
gaggagggcatgctactcct

SEQ ID NO: 163022 - DNA, 20 bp, human
gccttcaaggccagacaaga

SEQ ID NO: 163023 - DNA, 20 bp, human
gtctattgcctaaagcctag

SEQ ID NO: 163024 - DNA, 20 bp, human
ggacatgctagaacctagaa

SEQ ID NO: 163025 - DNA, 20 bp, human
ggcagaccacatccctgaag

SEQ ID NO: 163026 - DNA, 20 bp, human
gtgggagatgtgcagcctca

SEQ ID NO: 163027 - DNA, 20 bp, human
gccacagggagcccagatga

SEQ ID NO: 163028 - DNA, 20 bp, human
ggggggaaccacctgagcag

SEQ ID NO: 163029 - DNA, 20 bp, human
gtcagcagatctctgccatg

SEQ ID NO: 163030 - DNA, 20 bp, human
ggcccagatgaaggcatcct

SEQ ID NO: 163031 - DNA, 20 bp, human
ggagcaggggctaaatccct

SEQ ID NO: 163032 - DNA, 20 bp, human
ggaacagcatcctcaaggtg

SEQ ID NO: 163033 - DNA, 20 bp, human
ggaagccaaagaacactgct

SEQ ID NO: 163034 - DNA, 20 bp, human
ggggttggcaggtacatacc

SEQ ID NO: 163035 - DNA, 20 bp, human
gggcaggtacataccagggc

SEQ ID NO: 163036 - DNA, 20 bp, human
gtggctttagtaggagagcg

SEQ ID NO: 163037 - DNA, 20 bp, human
gcgcgctgcgactgctgggc

SEQ ID NO: 163038 - DNA, 20 bp, human
gtcgttacccgggtgagtag

SEQ ID NO: 163039 - DNA, 20 bp, human
gtagtaggagagcgaggccg

SEQ ID NO: 163040 - DNA, 20 bp, human
gctgctgggctggctttagt

SEQ ID NO: 163041 - DNA, 20 bp, human
gcccaggccgccacacaaag

SEQ ID NO: 163042 - DNA, 20 bp, human
gggcgcgcgaggacaaacgt

SEQ ID NO: 163043 - DNA, 20 bp, human
gggccgccacacaaagggga

SEQ ID NO: 163044 - DNA, 20 bp, human
gagcttcaggttccacgccg

SEQ ID NO: 163045 - DNA, 20 bp, human
ggtaccgtagcggccgtcac

SEQ ID NO: 163046 - DNA, 20 bp, human
ggctgcgagagagtgacctt

SEQ ID NO: 163047 - DNA, 20 bp, human
gcgaacggcgacccccaccc

SEQ ID NO: 163048 - DNA, 20 bp, human
gcagagatgggccagatccc

SEQ ID NO: 163049 - DNA, 20 bp, human
gcgcgggccggtggctatgg

SEQ ID NO: 163050 - DNA, 20 bp, human
gcaagggatgcggcagagat

SEQ ID NO: 163051 - DNA, 20 bp, human
ggcagcccgcgccctctggt

SEQ ID NO: 163052 - DNA, 20 bp, human
gtctgctcagacccgaccag

SEQ ID NO: 163053 - DNA, 20 bp, human
ggccagcccgggacaccagg

SEQ ID NO: 163054 - DNA, 20 bp, human
gtctgagcagatcactcgaa

SEQ ID NO: 163055 - DNA, 20 bp, human
gtcctgggcgggcggcgcaa

SEQ ID NO: 163056 - DNA, 20 bp, human
gtcagaacctaggactgtac

SEQ ID NO: 163057 - DNA, 20 bp, human
gggcagtcacccctcatcta

SEQ ID NO: 163058 - DNA, 20 bp, human
gtctgaagccaggggccctc

SEQ ID NO: 163059 - DNA, 20 bp, human
gtggcagcttcatttccatg

SEQ ID NO: 163060 - DNA, 20 bp, human
ggaagcgctgggggacatat

SEQ ID NO: 163061 - DNA, 20 bp, human
gtcagaaccagtacagtcct

SEQ ID NO: 163062 - DNA, 20 bp, human
gcaaaactagactgcagagg

SEQ ID NO: 163063 - DNA, 20 bp, human
gtccccaagaccctagatga

SEQ ID NO: 163064 - DNA, 20 bp, human
gtctcaaaactagactgcag

SEQ ID NO: 163065 - DNA, 20 bp, human
gatatttctaggagcactgg

SEQ ID NO: 163066 - DNA, 20 bp, human
ggctccagagccgcaggtct

SEQ ID NO: 163067 - DNA, 20 bp, human
gagaagcagagtgctagagg

SEQ ID NO: 163068 - DNA, 20 bp, human
gaatggggccccgaagggag

SEQ ID NO: 163069 - DNA, 20 bp, human
ggatccgactctagtcgtaa

SEQ ID NO: 163070 - DNA, 20 bp, human
ggctgtaatggggccccgaa

SEQ ID NO: 163071 - DNA, 20 bp, human
ggtggtccggaaaggatgac

SEQ ID NO: 163072 - DNA, 20 bp, human
gccgactctagtcgtaatgg

SEQ ID NO: 163073 - DNA, 20 bp, human
gagtaggtcccggcaaccgc

SEQ ID NO: 163074 - DNA, 20 bp, human
gtgacttccgtggtgagaaa

SEQ ID NO: 163075 - DNA, 20 bp, human
gccattacagctcggacctc

SEQ ID NO: 163076 - DNA, 20 bp, human
gtggcccgggaagctcaagg

SEQ ID NO: 163077 - DNA, 20 bp, human
ggccagggtgtgacactcca

SEQ ID NO: 163078 - DNA, 20 bp, human
gcggccttgccccccagcgt

SEQ ID NO: 163079 - DNA, 20 bp, human
gaggtcctcagggacaacgt

SEQ ID NO: 163080 - DNA, 20 bp, human
gagttggcccgggaagctca

SEQ ID NO: 163081 - DNA, 20 bp, human
ggagaaaggtcgcagagcgg

SEQ ID NO: 163082 - DNA, 20 bp, human
gcaggcaccggggtgaggaa

SEQ ID NO: 163083 - DNA, 20 bp, human
gtgggccagtcgctgggcag

SEQ ID NO: 163084 - DNA, 20 bp, human
gtgagatagaaagttggccc

SEQ ID NO: 163085 - DNA, 20 bp, human
gcgccgccctcacttacctg

SEQ ID NO: 163086 - DNA, 20 bp, human
gtgcggcagctggacccatc

SEQ ID NO: 163087 - DNA, 20 bp, human
gaaggccagagctaccagat

SEQ ID NO: 163088 - DNA, 20 bp, human
gtttgcacttgagctctccc

SEQ ID NO: 163089 - DNA, 20 bp, human
gcaggcctgggcgtgtgcta

SEQ ID NO: 163090 - DNA, 20 bp, human
gggcagaagtcacagtccaa

SEQ ID NO: 163091 - DNA, 20 bp, human
ggcagtaacagctgtcactt

SEQ ID NO: 163092 - DNA, 20 bp, human
ggtgacagctgttactgcct

SEQ ID NO: 163093 - DNA, 20 bp, human
gccatccccaaggcaagatg

SEQ ID NO: 163094 - DNA, 20 bp, human
ggatgggtggcccaggtctt

SEQ ID NO: 163095 - DNA, 20 bp, human
ggtcaggaactcaggatccg

SEQ ID NO: 163096 - DNA, 20 bp, human
gcaaatggaccccgggacaa

SEQ ID NO: 163097 - DNA, 20 bp, human
gtggaccccgggtcctctgt

SEQ ID NO: 163098 - DNA, 20 bp, human
gcgggacaagggcacgtctc

SEQ ID NO: 163099 - DNA, 20 bp, human
ggagtgtcgcaaaagcgcta

SEQ ID NO: 163100 - DNA, 20 bp, human
gcctacccacagaggacccg

SEQ ID NO: 163101 - DNA, 20 bp, human
gaaagcgctagggttgcaag

SEQ ID NO: 163102 - DNA, 20 bp, human
gcgacactcaggacttgctg

SEQ ID NO: 163103 - DNA, 20 bp, human
gttgctgaggcaggtcgagt

SEQ ID NO: 163104 - DNA, 20 bp, human
gcatttgagggtgagcgtgt

SEQ ID NO: 163105 - DNA, 20 bp, human
gggcaggtcgagttggagag

SEQ ID NO: 163106 - DNA, 20 bp, human
gcgagtcgctgcggccccag

SEQ ID NO: 163107 - DNA, 20 bp, human
gcagggacgccacctcagtc

SEQ ID NO: 163108 - DNA, 20 bp, human
gagtggagccctcctctcca

SEQ ID NO: 163109 - DNA, 20 bp, human
gtgcgcgctccggactgagg

SEQ ID NO: 163110 - DNA, 20 bp, human
ggagccaagtcagatcccag

SEQ ID NO: 163111 - DNA, 20 bp, human
ggaaccgccacgggtgagtc

SEQ ID NO: 163112 - DNA, 20 bp, human
gaagccggcccgagtcgctg

SEQ ID NO: 163113 - DNA, 20 bp, human
gacgtacccagcgggaccgc

SEQ ID NO: 163114 - DNA, 20 bp, human
ggcgggaccgccggcaggca

SEQ ID NO: 163115 - DNA, 20 bp, human
gcgacccgactcacccgtgg

SEQ ID NO: 163116 - DNA, 20 bp, human
ggaactgaggagtcccggac

SEQ ID NO: 163117 - DNA, 20 bp, human
gtgggagacgaggtccgaag

SEQ ID NO: 163118 - DNA, 20 bp, human
gtgcagcaagcggcctgtcc

SEQ ID NO: 163119 - DNA, 20 bp, human
gagcgtgaactgaggagtcc

SEQ ID NO: 163120 - DNA, 20 bp, human
gaagactgcagcgtgaactg

SEQ ID NO: 163121 - DNA, 20 bp, human
gtatcaagtgaactcaccag

SEQ ID NO: 163122 - DNA, 20 bp, human
gctggatcctctgcagcaag

SEQ ID NO: 163123 - DNA, 20 bp, human
gcatagggtaagcacctcta

SEQ ID NO: 163124 - DNA, 20 bp, human
ggggtgaggcgtggccacaa

SEQ ID NO: 163125 - DNA, 20 bp, human
gtatatctcacaacaaacca

SEQ ID NO: 163126 - DNA, 20 bp, human
gctgccaggaaggaccaagg

SEQ ID NO: 163127 - DNA, 20 bp, human
ggaccgctggaaagtgtaag

SEQ ID NO: 163128 - DNA, 20 bp, human
gacaggccgggtgaccgcgg

SEQ ID NO: 163129 - DNA, 20 bp, human
gtggagccccaagaccaccg

SEQ ID NO: 163130 - DNA, 20 bp, human
ggcattgcgaatgagctcgt

SEQ ID NO: 163131 - DNA, 20 bp, human
gtcaacaggccgggtgaccg

SEQ ID NO: 163132 - DNA, 20 bp, human
gctgcttagagctacaggga

SEQ ID NO: 163133 - DNA, 20 bp, human
gtgagctcgtgggtctcaac

SEQ ID NO: 163134 - DNA, 20 bp, human
gtcgtgggtctcaacaggcc

SEQ ID NO: 163135 - DNA, 20 bp, human
gaccgtcaggaagcagctcc

SEQ ID NO: 163136 - DNA, 20 bp, human
gatgagcccgagggactgag

SEQ ID NO: 163137 - DNA, 20 bp, human
gctgcccagctggagtcctt

SEQ ID NO: 163138 - DNA, 20 bp, human
gggctgatgggccacaccca

SEQ ID NO: 163139 - DNA, 20 bp, human
gacacccaaggactccagct

SEQ ID NO: 163140 - DNA, 20 bp, human
gtggaggtcgctggtggagt

SEQ ID NO: 163141 - DNA, 20 bp, human
gggagtgtggaggtcgctgg

SEQ ID NO: 163142 - DNA, 20 bp, human
gctcctggtcccagtctcca

SEQ ID NO: 163143 - DNA, 20 bp, human
ggcactaggtatgagcccga

SEQ ID NO: 163144 - DNA, 20 bp, human
gccgggagtgtggaggtcgc

SEQ ID NO: 163145 - DNA, 20 bp, human
gggctcatacctagtgcctg

SEQ ID NO: 163146 - DNA, 20 bp, human
gggcgggacagtggaagact

SEQ ID NO: 163147 - DNA, 20 bp, human
gtcacctgcgtggggaccca

SEQ ID NO: 163148 - DNA, 20 bp, human
ggggctgtcagtggcttcta

SEQ ID NO: 163149 - DNA, 20 bp, human
gacccatggcatggaggggt

SEQ ID NO: 163150 - DNA, 20 bp, human
gtgcgtggggacccatggca

SEQ ID NO: 163151 - DNA, 20 bp, human
gctgccctgggggctgtcag

SEQ ID NO: 163152 - DNA, 20 bp, human
gagagtggctacctgtttgg

SEQ ID NO: 163153 - DNA, 20 bp, human
ggagccctgcatctggaata

SEQ ID NO: 163154 - DNA, 20 bp, human
gtgaagcaggatggtgcctt

SEQ ID NO: 163155 - DNA, 20 bp, human
gcagctgcagcggggattaa

SEQ ID NO: 163156 - DNA, 20 bp, human
gagcagacagctcttagcta

SEQ ID NO: 163157 - DNA, 20 bp, human
gcccccaaccaggaactctc

SEQ ID NO: 163158 - DNA, 20 bp, human
gtgtcagagacaagccgaca

SEQ ID NO: 163159 - DNA, 20 bp, human
gcttcccgagagttcctggt

SEQ ID NO: 163160 - DNA, 20 bp, human
gaagaatctggtggtggtat

SEQ ID NO: 163161 - DNA, 20 bp, human
gtcaaagaagaatctggtgg

SEQ ID NO: 163162 - DNA, 20 bp, human
ggtcagctgtcacggtcctg

SEQ ID NO: 163163 - DNA, 20 bp, human
ggtgacagctgacatgaagc

SEQ ID NO: 163164 - DNA, 20 bp, human
gctcgttgaaagaaactctc

SEQ ID NO: 163165 - DNA, 20 bp, human
ggcaacttcccgagagttcc

SEQ ID NO: 163166 - DNA, 20 bp, human
gggctcggcaccagagatgg

SEQ ID NO: 163167 - DNA, 20 bp, human
ggcaggctcggcaccagaga

SEQ ID NO: 163168 - DNA, 20 bp, human
gtcagcaggattgtcaatca

SEQ ID NO: 163169 - DNA, 20 bp, human
gccagagatgggggcccaga

SEQ ID NO: 163170 - DNA, 20 bp, human
ggctagcacagtcccaaagt

SEQ ID NO: 163171 - DNA, 20 bp, human
gaaagtctcagggggaccct

SEQ ID NO: 163172 - DNA, 20 bp, human
gatttggcttgaccttcctg

SEQ ID NO: 163173 - DNA, 20 bp, human
gaggggctggttcctggatg

SEQ ID NO: 163174 - DNA, 20 bp, human
gtctcagggggaccctaggt

SEQ ID NO: 163175 - DNA, 20 bp, human
gatattcaaggtccccagga

SEQ ID NO: 163176 - DNA, 20 bp, human
gccagaggcggggcacagag

SEQ ID NO: 163177 - DNA, 20 bp, human
gggactgggaatcctagcag

SEQ ID NO: 163178 - DNA, 20 bp, human
gtggggcactcacgagccag

SEQ ID NO: 163179 - DNA, 20 bp, human
gcggcgcggtggcctctctc

SEQ ID NO: 163180 - DNA, 20 bp, human
gggcactcacgagccagagg

SEQ ID NO: 163181 - DNA, 20 bp, human
ggcatgaccatgagaaacat

SEQ ID NO: 163182 - DNA, 20 bp, human
gagaccaggccccgtcctaa

SEQ ID NO: 163183 - DNA, 20 bp, human
gctctctctggcagacgagg

SEQ ID NO: 163184 - DNA, 20 bp, human
gcggggcacagagcggaacg

SEQ ID NO: 163185 - DNA, 20 bp, human
gccaccgcgccgttaggacg

SEQ ID NO: 163186 - DNA, 20 bp, human
gttcctgcactcctcggagg

SEQ ID NO: 163187 - DNA, 20 bp, human
gccgcactcgccgatcctcc

SEQ ID NO: 163188 - DNA, 20 bp, human
gtcgccgcctgggagccgtc

SEQ ID NO: 163189 - DNA, 20 bp, human
ggcgtgtgcgcggtccggga

SEQ ID NO: 163190 - DNA, 20 bp, human
ggctgcgccggacggctccc

SEQ ID NO: 163191 - DNA, 20 bp, human
gtagaaactgctgcgccgga

SEQ ID NO: 163192 - DNA, 20 bp, human
ggcgggaagaccggctctga

SEQ ID NO: 163193 - DNA, 20 bp, human
gctcccaggcggcgaaagca

SEQ ID NO: 163194 - DNA, 20 bp, human
gggtccgagagcgcgagccc

SEQ ID NO: 163195 - DNA, 20 bp, human
gagcgcgagcccgggcttaa

SEQ ID NO: 163196 - DNA, 20 bp, human
gcctgcagccatggccagta

SEQ ID NO: 163197 - DNA, 20 bp, human
gggatgtggtcagacaatgg

SEQ ID NO: 163198 - DNA, 20 bp, human
gggctctggggtctcagcta

SEQ ID NO: 163199 - DNA, 20 bp, human
gtgtggtcagacaatggagg

SEQ ID NO: 163200 - DNA, 20 bp, human
ggtgctggggctaaccgtac

SEQ ID NO: 163201 - DNA, 20 bp, human
gttcggatgtggtcagacaa

SEQ ID NO: 163202 - DNA, 20 bp, human
ggggctaaccgtactggcca

SEQ ID NO: 163203 - DNA, 20 bp, human
gtgggtaggtggaatcccag

SEQ ID NO: 163204 - DNA, 20 bp, human
gggagggggtatcttaaggg

SEQ ID NO: 163205 - DNA, 20 bp, human
ggatggctcatgcgtggaat

SEQ ID NO: 163206 - DNA, 20 bp, human
ggtggacaccaggagcatga

SEQ ID NO: 163207 - DNA, 20 bp, human
gagtcccaggctccgaaggt

SEQ ID NO: 163208 - DNA, 20 bp, human
ggtctccacggcctccatga

SEQ ID NO: 163209 - DNA, 20 bp, human
gccgtagtcccaggctccga

SEQ ID NO: 163210 - DNA, 20 bp, human
gatggaggccgtggagaccg

SEQ ID NO: 163211 - DNA, 20 bp, human
gtccgcacccgccctcatgg

SEQ ID NO: 163212 - DNA, 20 bp, human
gggcccaggcggtagaagac

SEQ ID NO: 163213 - DNA, 20 bp, human
gcagacagcgacaggcccac

SEQ ID NO: 163214 - DNA, 20 bp, human
ggctgctcccgtaagcccca

SEQ ID NO: 163215 - DNA, 20 bp, human
gctggcccaggcacatccag

SEQ ID NO: 163216 - DNA, 20 bp, human
gtttcccgcttccctctacg

SEQ ID NO: 163217 - DNA, 20 bp, human
gctgatagcgcatagcgtcc

SEQ ID NO: 163218 - DNA, 20 bp, human
gctgcccggtctccacacgt

SEQ ID NO: 163219 - DNA, 20 bp, human
gagcgtgagccggtgccgag

SEQ ID NO: 163220 - DNA, 20 bp, human
gctacccacgtgtggagacc

SEQ ID NO: 163221 - DNA, 20 bp, human
ggtgtggagaccgggcaggt

SEQ ID NO: 163222 - DNA, 20 bp, human
gttactgagggcggatggag

SEQ ID NO: 163223 - DNA, 20 bp, human
gccgccctcagtaaacatgg

SEQ ID NO: 163224 - DNA, 20 bp, human
ggccgagaggcaccggggag

SEQ ID NO: 163225 - DNA, 20 bp, human
gatcttaagtgcgagcggta

SEQ ID NO: 163226 - DNA, 20 bp, human
ggcgcagagttgacaggtgt

SEQ ID NO: 163227 - DNA, 20 bp, human
gcgcaggaaatgggtagagg

SEQ ID NO: 163228 - DNA, 20 bp, human
ggcaagaggctacaaagtct

SEQ ID NO: 163229 - DNA, 20 bp, human
gccaccactccaggtaggag

SEQ ID NO: 163230 - DNA, 20 bp, human
gtcggcgtctccaagaacct

SEQ ID NO: 163231 - DNA, 20 bp, human
ggtcagggcggctcctcact

SEQ ID NO: 163232 - DNA, 20 bp, human
gatgctctcccggccccctg

SEQ ID NO: 163233 - DNA, 20 bp, human
gtgacaggtgttggcgccgg

SEQ ID NO: 163234 - DNA, 20 bp, human
ggagcggggccgggcggtca

SEQ ID NO: 163235 - DNA, 20 bp, human
gaagtctgggcgcaggaaat

SEQ ID NO: 163236 - DNA, 20 bp, human
gtctacacagggagcgctct

SEQ ID NO: 163237 - DNA, 20 bp, human
ggcgtagtagatgccgatgg

SEQ ID NO: 163238 - DNA, 20 bp, human
gcacctgagcagatgagaac

SEQ ID NO: 163239 - DNA, 20 bp, human
gggagtggccgagttcgcca

SEQ ID NO: 163240 - DNA, 20 bp, human
gggcggccagcagacctcca

SEQ ID NO: 163241 - DNA, 20 bp, human
gcgaaggtgccgatgccccg

SEQ ID NO: 163242 - DNA, 20 bp, human
gcttccagcgaatctacaca

SEQ ID NO: 163243 - DNA, 20 bp, human
gttcgtggtgtgggactacg

SEQ ID NO: 163244 - DNA, 20 bp, human
gcggccatggacacgccacg

SEQ ID NO: 163245 - DNA, 20 bp, human
gttcggaggccgacacctgg

SEQ ID NO: 163246 - DNA, 20 bp, human
gcaaggagctggcagcaatg

SEQ ID NO: 163247 - DNA, 20 bp, human
ggagaggagtcaggagtcgg

SEQ ID NO: 163248 - DNA, 20 bp, human
ggtgaggctcagggcaacca

SEQ ID NO: 163249 - DNA, 20 bp, human
gctagcaggggaggtagtag

SEQ ID NO: 163250 - DNA, 20 bp, human
gcctggagcttcaggggacg

SEQ ID NO: 163251 - DNA, 20 bp, human
gaatggggcctggagcttca

SEQ ID NO: 163252 - DNA, 20 bp, human
gagtagtggtctctcagctt

SEQ ID NO: 163253 - DNA, 20 bp, human
gagggcaaccagggatggtt

SEQ ID NO: 163254 - DNA, 20 bp, human
gccatgtggctgagaaggaa

SEQ ID NO: 163255 - DNA, 20 bp, human
gctcagagttgggggccttg

SEQ ID NO: 163256 - DNA, 20 bp, human
ggtcccctgggacactcggg

SEQ ID NO: 163257 - DNA, 20 bp, human
ggagccacatgaaggagcag

SEQ ID NO: 163258 - DNA, 20 bp, human
gcccggccgcaggtaggaaa

SEQ ID NO: 163259 - DNA, 20 bp, human
gtactgcgctcccgactcct

SEQ ID NO: 163260 - DNA, 20 bp, human
gccccactggccccgcaagt

SEQ ID NO: 163261 - DNA, 20 bp, human
gctgcctcccgagtgtccca

SEQ ID NO: 163262 - DNA, 20 bp, human
gcgagacagcggagaggttg

SEQ ID NO: 163263 - DNA, 20 bp, human
gcccaggccatccgtcccct

SEQ ID NO: 163264 - DNA, 20 bp, human
ggagtgtcccaggggacgga

SEQ ID NO: 163265 - DNA, 20 bp, human
gcggatgcagcgcctgtccc

SEQ ID NO: 163266 - DNA, 20 bp, human
gcggagaaggcgctgcccct

SEQ ID NO: 163267 - DNA, 20 bp, human
gctgcccctgggcaatggga

SEQ ID NO: 163268 - DNA, 20 bp, human
ggcagccagcgcggccatga

SEQ ID NO: 163269 - DNA, 20 bp, human
ggccagcgcggccatgacgg

SEQ ID NO: 163270 - DNA, 20 bp, human
gcgcgaggtgcctggagtcg

SEQ ID NO: 163271 - DNA, 20 bp, human
gcgtgcgcactggcacaggt

SEQ ID NO: 163272 - DNA, 20 bp, human
gagcggagaacctcgactcc

SEQ ID NO: 163273 - DNA, 20 bp, human
gacaggtgggccgcgctccg

SEQ ID NO: 163274 - DNA, 20 bp, human
ggcgtggagcggaacccgag

SEQ ID NO: 163275 - DNA, 20 bp, human
gcgcggccactggaacaaca

SEQ ID NO: 163276 - DNA, 20 bp, human
gagaccggtgccctccccgt

SEQ ID NO: 163277 - DNA, 20 bp, human
gacgggtatgtgcagcacag

SEQ ID NO: 163278 - DNA, 20 bp, human
gttctgcgctgggaggaaca

SEQ ID NO: 163279 - DNA, 20 bp, human
gcctgggaagcgagactctg

SEQ ID NO: 163280 - DNA, 20 bp, human
ggcaccggtctggagacagt

SEQ ID NO: 163281 - DNA, 20 bp, human
gctggagtctctggtaagag

SEQ ID NO: 163282 - DNA, 20 bp, human
gtggttctggagggggatag

SEQ ID NO: 163283 - DNA, 20 bp, human
gactgcgtgtctgcagcggg

SEQ ID NO: 163284 - DNA, 20 bp, human
gcccttgtcctgagagtcgt

SEQ ID NO: 163285 - DNA, 20 bp, human
ggtgtgtgttggggagtgaa

SEQ ID NO: 163286 - DNA, 20 bp, human
gctgccagaggtccagtcag

SEQ ID NO: 163287 - DNA, 20 bp, human
gtctggcagcagcttcacta

SEQ ID NO: 163288 - DNA, 20 bp, human
gggagaagaattatctaagg

SEQ ID NO: 163289 - DNA, 20 bp, human
gaggggagaagaattatcta

SEQ ID NO: 163290 - DNA, 20 bp, human
ggagagagccctagattgag

SEQ ID NO: 163291 - DNA, 20 bp, human
gtgcgtctcagactgcaggt

SEQ ID NO: 163292 - DNA, 20 bp, human
gaaaagtggggatgatagat

SEQ ID NO: 163293 - DNA, 20 bp, human
gaagcgtactttctaggcga

SEQ ID NO: 163294 - DNA, 20 bp, human
gtctcagactgcaggttggt

SEQ ID NO: 163295 - DNA, 20 bp, human
gccatgggacttacaaccaa

SEQ ID NO: 163296 - DNA, 20 bp, human
gtcagccagactgcaagagg

SEQ ID NO: 163297 - DNA, 20 bp, human
gcagactgcaagaggaggcg

SEQ ID NO: 163298 - DNA, 20 bp, human
gcagccgagggagtgaacca

SEQ ID NO: 163299 - DNA, 20 bp, human
gcactctggcaggtaggaac

SEQ ID NO: 163300 - DNA, 20 bp, human
ggtggctcactctggcaggt

SEQ ID NO: 163301 - DNA, 20 bp, human
gctagcatgtggacacagtt

SEQ ID NO: 163302 - DNA, 20 bp, human
gatgtggacacagttaggag

SEQ ID NO: 163303 - DNA, 20 bp, human
gagccaccttgcccaggggt

SEQ ID NO: 163304 - DNA, 20 bp, human
gcaacctgctcacttctctg

SEQ ID NO: 163305 - DNA, 20 bp, human
gcaaggtggctcactctggc

SEQ ID NO: 163306 - DNA, 20 bp, human
ggcagctcaaaagccctggg

SEQ ID NO: 163307 - DNA, 20 bp, human
gtctgccagggaaacagcac

SEQ ID NO: 163308 - DNA, 20 bp, human
ggtttccctggcagacacac

SEQ ID NO: 163309 - DNA, 20 bp, human
gtggcaagcgcctacgctaa

SEQ ID NO: 163310 - DNA, 20 bp, human
gtacgctaagggcacaactg

SEQ ID NO: 163311 - DNA, 20 bp, human
gtctgtacaatcagggtggg

SEQ ID NO: 163312 - DNA, 20 bp, human
gccacgacgggaagaaagga

SEQ ID NO: 163313 - DNA, 20 bp, human
gcgacaggctgcacatgtaa

SEQ ID NO: 163314 - DNA, 20 bp, human
gaaggactcgctgcgtcctg

SEQ ID NO: 163315 - DNA, 20 bp, human
gtcttgctgcttccacgtcc

SEQ ID NO: 163316 - DNA, 20 bp, human
ggcgcgccaggcagatcgag

SEQ ID NO: 163317 - DNA, 20 bp, human
ggatctgtcgacgcctgaag

SEQ ID NO: 163318 - DNA, 20 bp, human
ggccagtcggacaaaaatga

SEQ ID NO: 163319 - DNA, 20 bp, human
gtaccccccacgtaggacag

SEQ ID NO: 163320 - DNA, 20 bp, human
gcggcgcatgcgcagagaat

SEQ ID NO: 163321 - DNA, 20 bp, human
gaggcgtcgacagatcggtt

SEQ ID NO: 163322 - DNA, 20 bp, human
ggaagcctagcaatctcctc

SEQ ID NO: 163323 - DNA, 20 bp, human
ggcatgcgcagagaatcggc

SEQ ID NO: 163324 - DNA, 20 bp, human
gtcagtgtcaagtgcccgag

SEQ ID NO: 163325 - DNA, 20 bp, human
gcgcagagaatcggcgggaa

SEQ ID NO: 163326 - DNA, 20 bp, human
gcgcgggattgcgaagactg

SEQ ID NO: 163327 - DNA, 20 bp, human
gccggctctgcggagcagaa

SEQ ID NO: 163328 - DNA, 20 bp, human
gtgaggaccaaggtgtgagg

SEQ ID NO: 163329 - DNA, 20 bp, human
gggacgagcgcagggtcggg

SEQ ID NO: 163330 - DNA, 20 bp, human
ggcgctgccagggcgcaggg

SEQ ID NO: 163331 - DNA, 20 bp, human
ggcagcgccgcctcacacct

SEQ ID NO: 163332 - DNA, 20 bp, human
gagaacagggaaagttgcag

SEQ ID NO: 163333 - DNA, 20 bp, human
gtggccggcccggtaaagcc

SEQ ID NO: 163334 - DNA, 20 bp, human
gggcccggtaaagccaggcg

SEQ ID NO: 163335 - DNA, 20 bp, human
ggtggcctttcggaaagcga

SEQ ID NO: 163336 - DNA, 20 bp, human
gccaggcttcagggcaaggg

SEQ ID NO: 163337 - DNA, 20 bp, human
ggcagtcttctgggacctca

SEQ ID NO: 163338 - DNA, 20 bp, human
gcagggtgcaccattgccca

SEQ ID NO: 163339 - DNA, 20 bp, human
gggcagagtcagtcccctca

SEQ ID NO: 163340 - DNA, 20 bp, human
ggagacggctctctagtgct

SEQ ID NO: 163341 - DNA, 20 bp, human
gataggtctggcacaggtat

SEQ ID NO: 163342 - DNA, 20 bp, human
gtccaaacgtcggcagaggc

SEQ ID NO: 163343 - DNA, 20 bp, human
ggtcccagaagactgcaggt

SEQ ID NO: 163344 - DNA, 20 bp, human
ggcttgtggtttccaaacgt

SEQ ID NO: 163345 - DNA, 20 bp, human
gggtttccaaacgtcggcag

SEQ ID NO: 163346 - DNA, 20 bp, human
gcggctccccaagcacggag

SEQ ID NO: 163347 - DNA, 20 bp, human
ggtggctctgacacaggtag

SEQ ID NO: 163348 - DNA, 20 bp, human
gcaccagcagcctaggaacc

SEQ ID NO: 163349 - DNA, 20 bp, human
gagccgtccagcgaccacca

SEQ ID NO: 163350 - DNA, 20 bp, human
ggcctaggaaccgggcacgg

SEQ ID NO: 163351 - DNA, 20 bp, human
gcacctcgccccaggcacct

SEQ ID NO: 163352 - DNA, 20 bp, human
gggccagcctacctcctccg

SEQ ID NO: 163353 - DNA, 20 bp, human
gacctgtgtcagagccacgg

SEQ ID NO: 163354 - DNA, 20 bp, human
gggctcgtgctgcccaaccc

SEQ ID NO: 163355 - DNA, 20 bp, human
gcaccatggtggtcgctgga

SEQ ID NO: 163356 - DNA, 20 bp, human
gtgtctaaggcgctcccggg

SEQ ID NO: 163357 - DNA, 20 bp, human
gggcacgccgaggctctgct

SEQ ID NO: 163358 - DNA, 20 bp, human
gccgcccgaacgccacacgg

SEQ ID NO: 163359 - DNA, 20 bp, human
gggcgccttggcaggctcta

SEQ ID NO: 163360 - DNA, 20 bp, human
gggcagggcgcaaggcacca

SEQ ID NO: 163361 - DNA, 20 bp, human
ggccgagacgcgccagcaga

SEQ ID NO: 163362 - DNA, 20 bp, human
gcacgccggaactcaagagt

SEQ ID NO: 163363 - DNA, 20 bp, human
gaggcgagagtgggtgaacg

SEQ ID NO: 163364 - DNA, 20 bp, human
gggcgcactcacgtgtccgg

SEQ ID NO: 163365 - DNA, 20 bp, human
ggacttctgacagccctctg

SEQ ID NO: 163366 - DNA, 20 bp, human
gcaggcgcgccgtcccaccc

SEQ ID NO: 163367 - DNA, 20 bp, human
ggccgcagcctggccaacaa

SEQ ID NO: 163368 - DNA, 20 bp, human
gcagctagctgcgtcggcgg

SEQ ID NO: 163369 - DNA, 20 bp, human
gaaccagctagctgcgtcgg

SEQ ID NO: 163370 - DNA, 20 bp, human
ggttacagaacggcacactg

SEQ ID NO: 163371 - DNA, 20 bp, human
gccaccccggctcggcttgg

SEQ ID NO: 163372 - DNA, 20 bp, human
gccacccccaagccgagccg

SEQ ID NO: 163373 - DNA, 20 bp, human
ggtagcgagttggcccacag

SEQ ID NO: 163374 - DNA, 20 bp, human
gtccgccgtacatctggcac

SEQ ID NO: 163375 - DNA, 20 bp, human
gttagacccaagttacagaa

SEQ ID NO: 163376 - DNA, 20 bp, human
gatgcgccgcacccctagta

SEQ ID NO: 163377 - DNA, 20 bp, human
gcccatgtggcgctatcggg

SEQ ID NO: 163378 - DNA, 20 bp, human
gtccaggctcagaaccgggt

SEQ ID NO: 163379 - DNA, 20 bp, human
gaagcccccgcgagatggag

SEQ ID NO: 163380 - DNA, 20 bp, human
gaggcttcgcggaacgctct

SEQ ID NO: 163381 - DNA, 20 bp, human
gggcgcatcccagatccgat

SEQ ID NO: 163382 - DNA, 20 bp, human
gtggaacttaaccctactag

SEQ ID NO: 163383 - DNA, 20 bp, human
ggtctatggctgtgactcgg

SEQ ID NO: 163384 - DNA, 20 bp, human
gtcccagatccgatcggagt

SEQ ID NO: 163385 - DNA, 20 bp, human
gggggacgcgtgggtgtcta

SEQ ID NO: 163386 - DNA, 20 bp, human
ggcgccctcgaggcacccgg

SEQ ID NO: 163387 - DNA, 20 bp, human
ggtgcatgcgccccagcggt

SEQ ID NO: 163388 - DNA, 20 bp, human
ggcgccgccgggtgcctcga

SEQ ID NO: 163389 - DNA, 20 bp, human
gaagaaacgtgggttcgagg

SEQ ID NO: 163390 - DNA, 20 bp, human
gtcgaggcggagaggaaaag

SEQ ID NO: 163391 - DNA, 20 bp, human
ggggcccgcgggtacaaata

SEQ ID NO: 163392 - DNA, 20 bp, human
gggaggtgcatgcgccccag

SEQ ID NO: 163393 - DNA, 20 bp, human
gggctggcctcgcgccctcg

SEQ ID NO: 163394 - DNA, 20 bp, human
gggttgcgctcgccagggag

SEQ ID NO: 163395 - DNA, 20 bp, human
ggccccaccgccctgcgagg

SEQ ID NO: 163396 - DNA, 20 bp, human
gcacaggcaacagactgaac

SEQ ID NO: 163397 - DNA, 20 bp, human
gttagacgagaggagtgcgg

SEQ ID NO: 163398 - DNA, 20 bp, human
ggagttgctctgggtcctag

SEQ ID NO: 163399 - DNA, 20 bp, human
gaacagactgaactggtgga

SEQ ID NO: 163400 - DNA, 20 bp, human
ggagcaactcgcctctgtac

SEQ ID NO: 163401 - DNA, 20 bp, human
gcctaggctgtagagctgag

SEQ ID NO: 163402 - DNA, 20 bp, human
gggctgtagagctgagaggt

SEQ ID NO: 163403 - DNA, 20 bp, human
gcaaatgctggctgaagccg

SEQ ID NO: 163404 - DNA, 20 bp, human
gcggtggaggcgaagataat

SEQ ID NO: 163405 - DNA, 20 bp, human
ggggttagacgagaggagtg

SEQ ID NO: 163406 - DNA, 20 bp, human
gggtcctcggggctcggcgt

SEQ ID NO: 163407 - DNA, 20 bp, human
gacaacagacacgcgaggtc

SEQ ID NO: 163408 - DNA, 20 bp, human
ggggatacggaggcacatgt

SEQ ID NO: 163409 - DNA, 20 bp, human
gagccaccccaggtaccgga

SEQ ID NO: 163410 - DNA, 20 bp, human
gcgactctcggtcccttccg

SEQ ID NO: 163411 - DNA, 20 bp, human
gccttccgcggtggtgaaag

SEQ ID NO: 163412 - DNA, 20 bp, human
gggactgagcaggcgactct

SEQ ID NO: 163413 - DNA, 20 bp, human
gccgaggaccgcaagcccag

SEQ ID NO: 163414 - DNA, 20 bp, human
gtgccgcccgcaccaagagc

SEQ ID NO: 163415 - DNA, 20 bp, human
ggtccctccggtacctgggg

SEQ ID NO: 163416 - DNA, 20 bp, human
gcccggagcgcagagagcga

SEQ ID NO: 163417 - DNA, 20 bp, human
gcgctgcgcagggacagaca

SEQ ID NO: 163418 - DNA, 20 bp, human
gccgactcagctggataaca

SEQ ID NO: 163419 - DNA, 20 bp, human
gcagagcccgaagctggtct

SEQ ID NO: 163420 - DNA, 20 bp, human
gactcagctggataacaggg

SEQ ID NO: 163421 - DNA, 20 bp, human
gagctcacctccgcaaggta

SEQ ID NO: 163422 - DNA, 20 bp, human
gcagacagctgacggacgga

SEQ ID NO: 163423 - DNA, 20 bp, human
ggcccccaacgaggcccctg

SEQ ID NO: 163424 - DNA, 20 bp, human
gtccgcaaggtagggcacga

SEQ ID NO: 163425 - DNA, 20 bp, human
ggttcgggatgtagtatgag

SEQ ID NO: 163426 - DNA, 20 bp, human
ggccgccgccgggaaggaga

SEQ ID NO: 163427 - DNA, 20 bp, human
gcggggaagagagggatagt

SEQ ID NO: 163428 - DNA, 20 bp, human
gagggatagtcggagcgagg

SEQ ID NO: 163429 - DNA, 20 bp, human
gggtcgcggcgcctcacggg

SEQ ID NO: 163430 - DNA, 20 bp, human
gtggcccgcgactccggtgg

SEQ ID NO: 163431 - DNA, 20 bp, human
gggctggcccgcgactccgg

SEQ ID NO: 163432 - DNA, 20 bp, human
gggccgccgcttgcagaccg

SEQ ID NO: 163433 - DNA, 20 bp, human
gctgaccgccgccccccgtg

SEQ ID NO: 163434 - DNA, 20 bp, human
ggagagggatagtcggagcg

SEQ ID NO: 163435 - DNA, 20 bp, human
gcccggctggcccgcgactc

SEQ ID NO: 163436 - DNA, 20 bp, human
ggcgtgctgggtccgcaccg

SEQ ID NO: 163437 - DNA, 20 bp, human
gggacccagcacgcctgggc

SEQ ID NO: 163438 - DNA, 20 bp, human
ggctgtggaagagctgcgag

SEQ ID NO: 163439 - DNA, 20 bp, human
gcgggggctgcagcatggta

SEQ ID NO: 163440 - DNA, 20 bp, human
gcgtcggtctgagtgttcgg

SEQ ID NO: 163441 - DNA, 20 bp, human
gtcgccgcaaagatcggggt

SEQ ID NO: 163442 - DNA, 20 bp, human
gttcagctccttggtgacag

SEQ ID NO: 163443 - DNA, 20 bp, human
gcgcggcacagagcctcggg

SEQ ID NO: 163444 - DNA, 20 bp, human
ggggctgcagcatggtaagg

SEQ ID NO: 163445 - DNA, 20 bp, human
gtgtctcgccgcaaagatcg

SEQ ID NO: 163446 - DNA, 20 bp, human
ggcactcaccaagccggcgg

SEQ ID NO: 163447 - DNA, 20 bp, human
ggtggaggcgacagtcgcat

SEQ ID NO: 163448 - DNA, 20 bp, human
ggagcagcgggtcaactacc

SEQ ID NO: 163449 - DNA, 20 bp, human
gctgcctgcgcggactgaat

SEQ ID NO: 163450 - DNA, 20 bp, human
ggccaaaatggactccgtgg

SEQ ID NO: 163451 - DNA, 20 bp, human
ggccgggcgggccccggagt

SEQ ID NO: 163452 - DNA, 20 bp, human
ggcgcactgctgatgaaacc

SEQ ID NO: 163453 - DNA, 20 bp, human
ggccccgctcgcccactccg

SEQ ID NO: 163454 - DNA, 20 bp, human
ggcgcccattcagtccgcgc

SEQ ID NO: 163455 - DNA, 20 bp, human
gggagccaaaatggactccg

SEQ ID NO: 163456 - DNA, 20 bp, human
gggcgctgtcccggctgcga

SEQ ID NO: 163457 - DNA, 20 bp, human
ggcggccggccggacagacg

SEQ ID NO: 163458 - DNA, 20 bp, human
ggtcaggaggaagagtccag

SEQ ID NO: 163459 - DNA, 20 bp, human
gcacggaccgacggaccgac

SEQ ID NO: 163460 - DNA, 20 bp, human
gggaccgacggaccgacggg

SEQ ID NO: 163461 - DNA, 20 bp, human
gcagccgggacagcgcccac

SEQ ID NO: 163462 - DNA, 20 bp, human
ggcgcctgcaccatcatcat

SEQ ID NO: 163463 - DNA, 20 bp, human
gtgtccggccggccgcccgt

SEQ ID NO: 163464 - DNA, 20 bp, human
gtgcgagggccgtgagctca

SEQ ID NO: 163465 - DNA, 20 bp, human
ggagcgctatgaccgcgggg

SEQ ID NO: 163466 - DNA, 20 bp, human
gagtaattagatcgctgtga

SEQ ID NO: 163467 - DNA, 20 bp, human
gcagcagtggtggaacgagg

SEQ ID NO: 163468 - DNA, 20 bp, human
ggagctggtttgtaatgata

SEQ ID NO: 163469 - DNA, 20 bp, human
gcagcagcagtggtggaacg

SEQ ID NO: 163470 - DNA, 20 bp, human
gagggcgtgctccagaacac

SEQ ID NO: 163471 - DNA, 20 bp, human
gctggtttgtaatgataggg

SEQ ID NO: 163472 - DNA, 20 bp, human
gtccagaacacgggcagcgt

SEQ ID NO: 163473 - DNA, 20 bp, human
gggagaaagtgcagctgaag

SEQ ID NO: 163474 - DNA, 20 bp, human
gccatagtagggacacacgg

SEQ ID NO: 163475 - DNA, 20 bp, human
ggagagcacgatgcatacac

SEQ ID NO: 163476 - DNA, 20 bp, human
gcctgcctatgtagctgcaa

SEQ ID NO: 163477 - DNA, 20 bp, human
gtagctgcaaaggatgttga

SEQ ID NO: 163478 - DNA, 20 bp, human
gctggatgctgtactcagca

SEQ ID NO: 163479 - DNA, 20 bp, human
gtccttgtttctggggtcag

SEQ ID NO: 163480 - DNA, 20 bp, human
ggtgtcccccaaaggtgtgt

SEQ ID NO: 163481 - DNA, 20 bp, human
ggagtgtttggatattggtg

SEQ ID NO: 163482 - DNA, 20 bp, human
gaagctgcctaagaaatgtc

SEQ ID NO: 163483 - DNA, 20 bp, human
gtcaattacaatggatagag

SEQ ID NO: 163484 - DNA, 20 bp, human
gcagccagcccaaacgcaca

SEQ ID NO: 163485 - DNA, 20 bp, human
ggtattgagctccactgcat

SEQ ID NO: 163486 - DNA, 20 bp, human
gtggtggtggcggcaaagga

SEQ ID NO: 163487 - DNA, 20 bp, human
gccggcgccgctagagcggg

SEQ ID NO: 163488 - DNA, 20 bp, human
gggagccgcgagcggaatgc

SEQ ID NO: 163489 - DNA, 20 bp, human
gcctctcccggaatgaccca

SEQ ID NO: 163490 - DNA, 20 bp, human
gatgcgggcagcctaggtct

SEQ ID NO: 163491 - DNA, 20 bp, human
gccgactgcccgcggtctgg

SEQ ID NO: 163492 - DNA, 20 bp, human
gggcgacgagctggctgcca

SEQ ID NO: 163493 - DNA, 20 bp, human
gcggagctgtctctctagct

SEQ ID NO: 163494 - DNA, 20 bp, human
gccggcgtctgccgagacct

SEQ ID NO: 163495 - DNA, 20 bp, human
gcagctccgcgcagtaagtg

SEQ ID NO: 163496 - DNA, 20 bp, human
ggctgcacagggaccggacg

SEQ ID NO: 163497 - DNA, 20 bp, human
gagcggtccccgaagtcccc

SEQ ID NO: 163498 - DNA, 20 bp, human
gcttcgcgggaccagcgagg

SEQ ID NO: 163499 - DNA, 20 bp, human
gcggcgggcgctcctcttcg

SEQ ID NO: 163500 - DNA, 20 bp, human
ggggccggcggggaactaga

SEQ ID NO: 163501 - DNA, 20 bp, human
gcgaggcgaggcgcattccg

SEQ ID NO: 163502 - DNA, 20 bp, human
gcctcttcgcgggaccagcg

SEQ ID NO: 163503 - DNA, 20 bp, human
gtggggtcgcgccaagaagg

SEQ ID NO: 163504 - DNA, 20 bp, human
gcgaagtccccgggcagagc

SEQ ID NO: 163505 - DNA, 20 bp, human
ggcccctctcccagttccag

SEQ ID NO: 163506 - DNA, 20 bp, human
gaagcctgagcggccgaact

SEQ ID NO: 163507 - DNA, 20 bp, human
gtcttggactgggctcggtg

SEQ ID NO: 163508 - DNA, 20 bp, human
ggagcacagagtcttggact

SEQ ID NO: 163509 - DNA, 20 bp, human
gcggcagctccaacccaact

SEQ ID NO: 163510 - DNA, 20 bp, human
gggcggagttaagccgagtt

SEQ ID NO: 163511 - DNA, 20 bp, human
gggagagtgcgagcaatctc

SEQ ID NO: 163512 - DNA, 20 bp, human
ggagagctgttgcaaaccta

SEQ ID NO: 163513 - DNA, 20 bp, human
gtggactgggctcggtgagg

SEQ ID NO: 163514 - DNA, 20 bp, human
gtggagatgcgcccccagag

SEQ ID NO: 163515 - DNA, 20 bp, human
ggggttggagctgccgagtt

SEQ ID NO: 163516 - DNA, 20 bp, human
ggtgctcagagcggaggcag

SEQ ID NO: 163517 - DNA, 20 bp, human
gggctcagtgctcagagcgg

SEQ ID NO: 163518 - DNA, 20 bp, human
gggccacagacagacagtgg

SEQ ID NO: 163519 - DNA, 20 bp, human
gcccgctcggtggccctgag

SEQ ID NO: 163520 - DNA, 20 bp, human
gacccctcagggccaccgag

SEQ ID NO: 163521 - DNA, 20 bp, human
gcgcgccaggcggaatgcag

SEQ ID NO: 163522 - DNA, 20 bp, human
gttgcgaggtcgggcagagt

SEQ ID NO: 163523 - DNA, 20 bp, human
gccagagccaggtgaaaccg

SEQ ID NO: 163524 - DNA, 20 bp, human
gcggcgccggcgaactgggc

SEQ ID NO: 163525 - DNA, 20 bp, human
ggcatcccaggcagcaaagg

SEQ ID NO: 163526 - DNA, 20 bp, human
gagcgcggacggctcggcgc

SEQ ID NO: 163527 - DNA, 20 bp, human
gcacactgctcgctgggccg

SEQ ID NO: 163528 - DNA, 20 bp, human
gcatgctctgcgcaccggcc

SEQ ID NO: 163529 - DNA, 20 bp, human
gcggcgcgcacactgctcgc

SEQ ID NO: 163530 - DNA, 20 bp, human
gtggggaccattatcggctc

SEQ ID NO: 163531 - DNA, 20 bp, human
gtcatcgtggggaccattat

SEQ ID NO: 163532 - DNA, 20 bp, human
gatgctggccgccaagagcg

SEQ ID NO: 163533 - DNA, 20 bp, human
ggagccgtccgcgctcttgg

SEQ ID NO: 163534 - DNA, 20 bp, human
gcctacatgctggaggtcta

SEQ ID NO: 163535 - DNA, 20 bp, human
gtcgctgggccgcggctccc

SEQ ID NO: 163536 - DNA, 20 bp, human
gcgggccactgggaggtaac

SEQ ID NO: 163537 - DNA, 20 bp, human
ggcggcgcgaccgagcatcc

SEQ ID NO: 163538 - DNA, 20 bp, human
ggcgcgaccgagcatcctgg

SEQ ID NO: 163539 - DNA, 20 bp, human
gccagcccgttacctcccag

SEQ ID NO: 163540 - DNA, 20 bp, human
gcgagtgtgagggagaccgg

SEQ ID NO: 163541 - DNA, 20 bp, human
gggggcgccacgaggagaga

SEQ ID NO: 163542 - DNA, 20 bp, human
gcccaggtgcgagggtgacc

SEQ ID NO: 163543 - DNA, 20 bp, human
gtgcgacggtgaccctgagt

SEQ ID NO: 163544 - DNA, 20 bp, human
ggagcgtgagggccgagtgt

SEQ ID NO: 163545 - DNA, 20 bp, human
gtaacgggctgggccatggg

SEQ ID NO: 163546 - DNA, 20 bp, human
gcgagcacaagagcctccgc

SEQ ID NO: 163547 - DNA, 20 bp, human
ggtcctggcggcctccatag

SEQ ID NO: 163548 - DNA, 20 bp, human
gcgaggcgcggagattacgg

SEQ ID NO: 163549 - DNA, 20 bp, human
gcgaggtggtccccaaggat

SEQ ID NO: 163550 - DNA, 20 bp, human
gtcagcggcagccactatgg

SEQ ID NO: 163551 - DNA, 20 bp, human
gggtggtccccaaggatcgg

SEQ ID NO: 163552 - DNA, 20 bp, human
gcggagtacagcggtcctgg

SEQ ID NO: 163553 - DNA, 20 bp, human
gctgctggctgtcccgtgac

SEQ ID NO: 163554 - DNA, 20 bp, human
gagccgaggcgcggagatta

SEQ ID NO: 163555 - DNA, 20 bp, human
gcgctgtactccgggtgaag

SEQ ID NO: 163556 - DNA, 20 bp, human
ggcagtgtgagcagcagtca

SEQ ID NO: 163557 - DNA, 20 bp, human
gtcagaccacagatcctgga

SEQ ID NO: 163558 - DNA, 20 bp, human
gaagtgccttccaggatctg

SEQ ID NO: 163559 - DNA, 20 bp, human
gggagaggctagtcaagcaa

SEQ ID NO: 163560 - DNA, 20 bp, human
ggctgcctccaatcatccct

SEQ ID NO: 163561 - DNA, 20 bp, human
gaaaacctagggatgattgg

SEQ ID NO: 163562 - DNA, 20 bp, human
ggtgagggatcgatagcagg

SEQ ID NO: 163563 - DNA, 20 bp, human
gctgcacagcagcaaagagg

SEQ ID NO: 163564 - DNA, 20 bp, human
gctgcttatatccaggacca

SEQ ID NO: 163565 - DNA, 20 bp, human
ggggtgaagtgggtctactt

SEQ ID NO: 163566 - DNA, 20 bp, human
gccggctgtgcagtagaacg

SEQ ID NO: 163567 - DNA, 20 bp, human
ggccactctcccgaaaccag

SEQ ID NO: 163568 - DNA, 20 bp, human
gctcccgaaaccagagggat

SEQ ID NO: 163569 - DNA, 20 bp, human
gccctctggtttcgggagag

SEQ ID NO: 163570 - DNA, 20 bp, human
ggcacagagcagaaccatcc

SEQ ID NO: 163571 - DNA, 20 bp, human
gagagaagcacgttagtgtg

SEQ ID NO: 163572 - DNA, 20 bp, human
ggaattccagccggagtcgc

SEQ ID NO: 163573 - DNA, 20 bp, human
gcacaggaggaccaccagag

SEQ ID NO: 163574 - DNA, 20 bp, human
gaaggcggaagcagaagacg

SEQ ID NO: 163575 - DNA, 20 bp, human
ggtgcctgtggtatcatcgt

SEQ ID NO: 163576 - DNA, 20 bp, human
gcggctctgcagggtcacgg

SEQ ID NO: 163577 - DNA, 20 bp, human
gggttggaccgtgcaggcac

SEQ ID NO: 163578 - DNA, 20 bp, human
gtggaccgtgcaggcacggg

SEQ ID NO: 163579 - DNA, 20 bp, human
gcaggcacgggcggtcagct

SEQ ID NO: 163580 - DNA, 20 bp, human
gttctagggttggaccgtgc

SEQ ID NO: 163581 - DNA, 20 bp, human
gtcagaatcaagtccaggta

SEQ ID NO: 163582 - DNA, 20 bp, human
gtgctcctgggcacaagaca

SEQ ID NO: 163583 - DNA, 20 bp, human
gtctgcagggtcacggagga

SEQ ID NO: 163584 - DNA, 20 bp, human
gagctgggccgcagctcctc

SEQ ID NO: 163585 - DNA, 20 bp, human
gattgtggatctgtgatgta

SEQ ID NO: 163586 - DNA, 20 bp, human
gggaagcacaaagcaggcgg

SEQ ID NO: 163587 - DNA, 20 bp, human
gggtcgctcccatcttctgt

SEQ ID NO: 163588 - DNA, 20 bp, human
gtactagcgtggaggaacgg

SEQ ID NO: 163589 - DNA, 20 bp, human
gctggtgcgtctgggcgtga

SEQ ID NO: 163590 - DNA, 20 bp, human
gacagctcccgatcaggaag

SEQ ID NO: 163591 - DNA, 20 bp, human
ggaggaagaaagggctgcta

SEQ ID NO: 163592 - DNA, 20 bp, human
ggtgcagcgccggcgcgagc

SEQ ID NO: 163593 - DNA, 20 bp, human
ggacacccagaaaaatgtgc

SEQ ID NO: 163594 - DNA, 20 bp, human
ggagcgacctcttcctgatc

SEQ ID NO: 163595 - DNA, 20 bp, human
gtgtgcttcccacagaagat

SEQ ID NO: 163596 - DNA, 20 bp, human
gagcagccaaagcttgacag

SEQ ID NO: 163597 - DNA, 20 bp, human
ggccaaagcttgacagaggt

SEQ ID NO: 163598 - DNA, 20 bp, human
gttggctgctcagtccgcat

SEQ ID NO: 163599 - DNA, 20 bp, human
gagtgagtctcagaaccccg

SEQ ID NO: 163600 - DNA, 20 bp, human
gaagcttccctgtcttgtgg

SEQ ID NO: 163601 - DNA, 20 bp, human
gttagagaaggcatcatact

SEQ ID NO: 163602 - DNA, 20 bp, human
ggttggagctagtgactaag

SEQ ID NO: 163603 - DNA, 20 bp, human
ggtgtattttaggctagggt

SEQ ID NO: 163604 - DNA, 20 bp, human
gaaaggtgctggcaatatcg

SEQ ID NO: 163605 - DNA, 20 bp, human
gcagaaccccgcggaagctg

SEQ ID NO: 163606 - DNA, 20 bp, human
gcccagacacaggaaggcgg

SEQ ID NO: 163607 - DNA, 20 bp, human
gggaccgcctgggtactggg

SEQ ID NO: 163608 - DNA, 20 bp, human
gcagagacccctgagacatg

SEQ ID NO: 163609 - DNA, 20 bp, human
ggcagaggtagagagcgcga

SEQ ID NO: 163610 - DNA, 20 bp, human
gcagccgcccgagaaccagg

SEQ ID NO: 163611 - DNA, 20 bp, human
gagcaggtccccccagcgct

SEQ ID NO: 163612 - DNA, 20 bp, human
gcagcacgcgtaccttctgt

SEQ ID NO: 163613 - DNA, 20 bp, human
gacctccataaaccagccca

SEQ ID NO: 163614 - DNA, 20 bp, human
gagggggggtgccccagacg

SEQ ID NO: 163615 - DNA, 20 bp, human
gtccctgggctggtttatgg

SEQ ID NO: 163616 - DNA, 20 bp, human
ggtcaccgcgggagacgtct

SEQ ID NO: 163617 - DNA, 20 bp, human
ggctgcgagcccacgaaccc

SEQ ID NO: 163618 - DNA, 20 bp, human
gggcgcctcaccggtcgcag

SEQ ID NO: 163619 - DNA, 20 bp, human
gccctcccgccggggttcgt

SEQ ID NO: 163620 - DNA, 20 bp, human
ggactgacatgccccggacg

SEQ ID NO: 163621 - DNA, 20 bp, human
gagcgtgcaaggcggagacc

SEQ ID NO: 163622 - DNA, 20 bp, human
gcgtgggctcgcagctgtca

SEQ ID NO: 163623 - DNA, 20 bp, human
gtgagccgctgcgaccggtg

SEQ ID NO: 163624 - DNA, 20 bp, human
gccggccgcagccgcgtccg

SEQ ID NO: 163625 - DNA, 20 bp, human
ggggaaaccccgacccagag

SEQ ID NO: 163626 - DNA, 20 bp, human
ggcccggacgggaagagtag

SEQ ID NO: 163627 - DNA, 20 bp, human
gtggcgcaaggtcggtccgg

SEQ ID NO: 163628 - DNA, 20 bp, human
gcgctggcgcaaggtcggtc

SEQ ID NO: 163629 - DNA, 20 bp, human
gggcggggcacccggactgg

SEQ ID NO: 163630 - DNA, 20 bp, human
gccagcgaagccgccagtcc

SEQ ID NO: 163631 - DNA, 20 bp, human
gggcttcgctggcgcaaggt

SEQ ID NO: 163632 - DNA, 20 bp, human
gccgacctgctaagggacag

SEQ ID NO: 163633 - DNA, 20 bp, human
gtcgcagccttccaggtccc

SEQ ID NO: 163634 - DNA, 20 bp, human
gggtccggcggccagggacc

SEQ ID NO: 163635 - DNA, 20 bp, human
ggcccggacgctgcagcagg

SEQ ID NO: 163636 - DNA, 20 bp, human
gcaggctagtccaaaagcag

SEQ ID NO: 163637 - DNA, 20 bp, human
gggtcagcaggactgaacct

SEQ ID NO: 163638 - DNA, 20 bp, human
gagtagccagctcccaaaca

SEQ ID NO: 163639 - DNA, 20 bp, human
gccctagcaggatactaaat

SEQ ID NO: 163640 - DNA, 20 bp, human
gggaggcaaagtctagggaa

SEQ ID NO: 163641 - DNA, 20 bp, human
gacagaagtactgtcaccac

SEQ ID NO: 163642 - DNA, 20 bp, human
gaggctgcagcaccgccctg

SEQ ID NO: 163643 - DNA, 20 bp, human
gtgacctggcactggaaggg

SEQ ID NO: 163644 - DNA, 20 bp, human
ggactggccccatgaggtga

SEQ ID NO: 163645 - DNA, 20 bp, human
gaagggagcaggtccccgtg

SEQ ID NO: 163646 - DNA, 20 bp, human
ggtgaaaccgggaagcggcc

SEQ ID NO: 163647 - DNA, 20 bp, human
ggactggctctcaccccctt

SEQ ID NO: 163648 - DNA, 20 bp, human
ggccctagggatagaggaag

SEQ ID NO: 163649 - DNA, 20 bp, human
gcaggatagggatagtgcaa

SEQ ID NO: 163650 - DNA, 20 bp, human
ggcgccgggctgagattccg

SEQ ID NO: 163651 - DNA, 20 bp, human
ggcccggcgctgtcacttat

SEQ ID NO: 163652 - DNA, 20 bp, human
gatagaggaaggggcaggat

SEQ ID NO: 163653 - DNA, 20 bp, human
gccagaactaaccctagccc

SEQ ID NO: 163654 - DNA, 20 bp, human
ggctgagaaggagtgaaacc

SEQ ID NO: 163655 - DNA, 20 bp, human
gaggctgggacctttggctg

SEQ ID NO: 163656 - DNA, 20 bp, human
ggagagcagcgcaccggcat

SEQ ID NO: 163657 - DNA, 20 bp, human
ggcacgtgcagggcgacgag

SEQ ID NO: 163658 - DNA, 20 bp, human
gcggctggagagcagcgcac

SEQ ID NO: 163659 - DNA, 20 bp, human
gtgaacgcgccgagggccat

SEQ ID NO: 163660 - DNA, 20 bp, human
gcctagccctgcgagcgtgg

SEQ ID NO: 163661 - DNA, 20 bp, human
gctgctgagggtacgcgcag

SEQ ID NO: 163662 - DNA, 20 bp, human
gggtaatccagcgtaaacac

SEQ ID NO: 163663 - DNA, 20 bp, human
gcggcacccatggaaccact

SEQ ID NO: 163664 - DNA, 20 bp, human
gttcagcaaggtctccgcca

SEQ ID NO: 163665 - DNA, 20 bp, human
gtccccttggcggcaaccgg

SEQ ID NO: 163666 - DNA, 20 bp, human
gtgcacgtgggcccactcga

SEQ ID NO: 163667 - DNA, 20 bp, human
ggtggccgcgcgcatcaggt

SEQ ID NO: 163668 - DNA, 20 bp, human
gagagccggactctcccggg

SEQ ID NO: 163669 - DNA, 20 bp, human
gatcggactgtagccggtac

SEQ ID NO: 163670 - DNA, 20 bp, human
gtccagagcgcgatgacgta

SEQ ID NO: 163671 - DNA, 20 bp, human
gctgtagccggtaccggcac

SEQ ID NO: 163672 - DNA, 20 bp, human
gcagtctgcggggctcggag

SEQ ID NO: 163673 - DNA, 20 bp, human
gctgggacccggcgaggacc

SEQ ID NO: 163674 - DNA, 20 bp, human
gcgcgcccagggagtccccg

SEQ ID NO: 163675 - DNA, 20 bp, human
gcggccacaacgaagccccc

SEQ ID NO: 163676 - DNA, 20 bp, human
ggtcctctctcggctcctcg

SEQ ID NO: 163677 - DNA, 20 bp, human
gggctcctcgcggctcgcgg

SEQ ID NO: 163678 - DNA, 20 bp, human
gcggctcaccacctgctggt

SEQ ID NO: 163679 - DNA, 20 bp, human
gtctccaggcagcagagccg

SEQ ID NO: 163680 - DNA, 20 bp, human
ggatgcggctcaccacctgc

SEQ ID NO: 163681 - DNA, 20 bp, human
gaggcgcacggcgttgagtg

SEQ ID NO: 163682 - DNA, 20 bp, human
ggccgttcggacccttctcc

SEQ ID NO: 163683 - DNA, 20 bp, human
ggcctggagaagggtccgaa

SEQ ID NO: 163684 - DNA, 20 bp, human
ggcggcggccgacggttcct

SEQ ID NO: 163685 - DNA, 20 bp, human
ggttcgctggacgggaagaa

SEQ ID NO: 163686 - DNA, 20 bp, human
gcacccggcggtggcttcag

SEQ ID NO: 163687 - DNA, 20 bp, human
gggcggcgctgggcacccgg

SEQ ID NO: 163688 - DNA, 20 bp, human
ggaggcgacgggagccgaac

SEQ ID NO: 163689 - DNA, 20 bp, human
gtcctgcgccgggactccga

SEQ ID NO: 163690 - DNA, 20 bp, human
gggacgcggacgttgtcggg

SEQ ID NO: 163691 - DNA, 20 bp, human
ggtcgcacgggggcccgagg

SEQ ID NO: 163692 - DNA, 20 bp, human
gttcagcggcggctcctgtt

SEQ ID NO: 163693 - DNA, 20 bp, human
gtccccgcgggagccccctc

SEQ ID NO: 163694 - DNA, 20 bp, human
gggacgttgtcgggaggcag

SEQ ID NO: 163695 - DNA, 20 bp, human
gcgccgctgaagccaccgcc

SEQ ID NO: 163696 - DNA, 20 bp, human
gccggagcgtgccatgacag

SEQ ID NO: 163697 - DNA, 20 bp, human
ggcggcacagtgacagcaag

SEQ ID NO: 163698 - DNA, 20 bp, human
ggagggagcctggagcccgt

SEQ ID NO: 163699 - DNA, 20 bp, human
ggcaggtggcgtggcactcc

SEQ ID NO: 163700 - DNA, 20 bp, human
gagtggcaggcgtccggccg

SEQ ID NO: 163701 - DNA, 20 bp, human
gtgtcactgtgccgctgtca

SEQ ID NO: 163702 - DNA, 20 bp, human
gggctggtacaggtcaggtg

SEQ ID NO: 163703 - DNA, 20 bp, human
gtgggtcggccagagagttc

SEQ ID NO: 163704 - DNA, 20 bp, human
gggagcccgtgggagcccga

SEQ ID NO: 163705 - DNA, 20 bp, human
gacagcaagtggcaggcgtc

SEQ ID NO: 163706 - DNA, 20 bp, human
ggtaggtaggagaagcccac

SEQ ID NO: 163707 - DNA, 20 bp, human
gtccacacaggggtgtaggt

SEQ ID NO: 163708 - DNA, 20 bp, human
ggcagtagcaaacaattcca

SEQ ID NO: 163709 - DNA, 20 bp, human
gtgctcattccacagatcac

SEQ ID NO: 163710 - DNA, 20 bp, human
gctccccgacttcagatgtg

SEQ ID NO: 163711 - DNA, 20 bp, human
ggggatctgatagacaggga

SEQ ID NO: 163712 - DNA, 20 bp, human
gcactggagtccttctaatg

SEQ ID NO: 163713 - DNA, 20 bp, human
gtgtggcacacatccacaca

SEQ ID NO: 163714 - DNA, 20 bp, human
gtgccacacatctgaagtcg

SEQ ID NO: 163715 - DNA, 20 bp, human
ggagtccttctaatgaggaa

SEQ ID NO: 163716 - DNA, 20 bp, human
gggcagcgcgagcagggaca

SEQ ID NO: 163717 - DNA, 20 bp, human
gcttcggccgcccccgccag

SEQ ID NO: 163718 - DNA, 20 bp, human
ggctcccaggggagaagaca

SEQ ID NO: 163719 - DNA, 20 bp, human
gccgtgcggtgccgggaggg

SEQ ID NO: 163720 - DNA, 20 bp, human
gaaatcctcagagctcccag

SEQ ID NO: 163721 - DNA, 20 bp, human
gcccaatctgaggaccgagg

SEQ ID NO: 163722 - DNA, 20 bp, human
gatggagttggggagagcgg

SEQ ID NO: 163723 - DNA, 20 bp, human
gcggccgtgcggtgccggga

SEQ ID NO: 163724 - DNA, 20 bp, human
ggggcaaaggagcctacaga

SEQ ID NO: 163725 - DNA, 20 bp, human
gaggagcctacagatggagt

SEQ ID NO: 163726 - DNA, 20 bp, human
ggcggccgccggtgaggtag

SEQ ID NO: 163727 - DNA, 20 bp, human
gcgggaggcggggggagaca

SEQ ID NO: 163728 - DNA, 20 bp, human
gcagccggcgggcagagaaa

SEQ ID NO: 163729 - DNA, 20 bp, human
gcccgcccctacctcaccgg

SEQ ID NO: 163730 - DNA, 20 bp, human
ggccgccggtgaggtagggg

SEQ ID NO: 163731 - DNA, 20 bp, human
gtagaaggggagccgaacgt

SEQ ID NO: 163732 - DNA, 20 bp, human
gactgctgccgacgccacgg

SEQ ID NO: 163733 - DNA, 20 bp, human
gcggtcggaccactccccga

SEQ ID NO: 163734 - DNA, 20 bp, human
gcagcgccaaggggctgaca

SEQ ID NO: 163735 - DNA, 20 bp, human
gggtgaggcagagaaacgcg

SEQ ID NO: 163736 - DNA, 20 bp, human
ggtgcagaaagcgcacccgg

SEQ ID NO: 163737 - DNA, 20 bp, human
gggccactccggcaggtccg

SEQ ID NO: 163738 - DNA, 20 bp, human
gtgctgccagaacccgccga

SEQ ID NO: 163739 - DNA, 20 bp, human
ggggtgctcaccatagatca

SEQ ID NO: 163740 - DNA, 20 bp, human
gagggcggggggtgtaacag

SEQ ID NO: 163741 - DNA, 20 bp, human
ggaccagcagcccgcgccgt

SEQ ID NO: 163742 - DNA, 20 bp, human
ggcgggttctggcagcaccg

SEQ ID NO: 163743 - DNA, 20 bp, human
gcggccacggccactccggc

SEQ ID NO: 163744 - DNA, 20 bp, human
gcaccgcggacctgccggag

SEQ ID NO: 163745 - DNA, 20 bp, human
gggtagcccgacccgagcca

SEQ ID NO: 163746 - DNA, 20 bp, human
gtcctggaggaggcggaaga

SEQ ID NO: 163747 - DNA, 20 bp, human
ggactggctacgtaggaggt

SEQ ID NO: 163748 - DNA, 20 bp, human
gcccgcggctccgaactcgg

SEQ ID NO: 163749 - DNA, 20 bp, human
gaggcgactggctacgtagg

SEQ ID NO: 163750 - DNA, 20 bp, human
ggaggtgggtgtggagaacc

SEQ ID NO: 163751 - DNA, 20 bp, human
gcccatcccgccctcctcgt

SEQ ID NO: 163752 - DNA, 20 bp, human
gaacccggacgacttcctgg

SEQ ID NO: 163753 - DNA, 20 bp, human
gaggaggcgactggctacgt

SEQ ID NO: 163754 - DNA, 20 bp, human
gcggaagccggaagcaaaag

SEQ ID NO: 163755 - DNA, 20 bp, human
gtggaagctccgcaggatgg

SEQ ID NO: 163756 - DNA, 20 bp, human
gccatctgaatactaagcca

SEQ ID NO: 163757 - DNA, 20 bp, human
gcagtttcaacatcagggag

SEQ ID NO: 163758 - DNA, 20 bp, human
gaggaatcccaagaagactg

SEQ ID NO: 163759 - DNA, 20 bp, human
ggatagcaaagtaccgaaac

SEQ ID NO: 163760 - DNA, 20 bp, human
gcttcacaagcattctgccc

SEQ ID NO: 163761 - DNA, 20 bp, human
gtttcaacatcagggagcgg

SEQ ID NO: 163762 - DNA, 20 bp, human
gtagataaaaacctggataa

SEQ ID NO: 163763 - DNA, 20 bp, human
gctggaggagcaatggtgta

SEQ ID NO: 163764 - DNA, 20 bp, human
gccagattgtcaaaatggta

SEQ ID NO: 163765 - DNA, 20 bp, human
gcatgaaactggaggagcaa

SEQ ID NO: 163766 - DNA, 20 bp, human
gagccacgcgccacccaggt

SEQ ID NO: 163767 - DNA, 20 bp, human
gtggcgcgtggcttacgcaa

SEQ ID NO: 163768 - DNA, 20 bp, human
gcctgcgcggaagtctatcc

SEQ ID NO: 163769 - DNA, 20 bp, human
ggggctgcgaaagaagttgt

SEQ ID NO: 163770 - DNA, 20 bp, human
gagaggagagacaatgtctg

SEQ ID NO: 163771 - DNA, 20 bp, human
gggcagaggcgagggttctg

SEQ ID NO: 163772 - DNA, 20 bp, human
gggcttacgcaacggtcact

SEQ ID NO: 163773 - DNA, 20 bp, human
gtagcgccaaagggcttgga

SEQ ID NO: 163774 - DNA, 20 bp, human
ggaacaaacaagagagatgt

SEQ ID NO: 163775 - DNA, 20 bp, human
gtggctgtccgcgccggcag

SEQ ID NO: 163776 - DNA, 20 bp, human
ggaggccccagagacactaa

SEQ ID NO: 163777 - DNA, 20 bp, human
ggcctgggtccgcgctctct

SEQ ID NO: 163778 - DNA, 20 bp, human
ggcgggtccgcaggcttctg

SEQ ID NO: 163779 - DNA, 20 bp, human
gaggcggggccgactacacg

SEQ ID NO: 163780 - DNA, 20 bp, human
gctgcagataaacggtctca

SEQ ID NO: 163781 - DNA, 20 bp, human
gaatcgggaaccccagagcg

SEQ ID NO: 163782 - DNA, 20 bp, human
gacgtcccggggcctcggag

SEQ ID NO: 163783 - DNA, 20 bp, human
gagagcgcggtggctagacc

SEQ ID NO: 163784 - DNA, 20 bp, human
gcgtcatctccgggaagact

SEQ ID NO: 163785 - DNA, 20 bp, human
gccggtccagcaggcctaca

SEQ ID NO: 163786 - DNA, 20 bp, human
gtgtgcaagtgagaagtggg

SEQ ID NO: 163787 - DNA, 20 bp, human
ggccctaggggaaagctcac

SEQ ID NO: 163788 - DNA, 20 bp, human
ggctaaccggtgcagactag

SEQ ID NO: 163789 - DNA, 20 bp, human
ggagcaagtaactgtcagtg

SEQ ID NO: 163790 - DNA, 20 bp, human
gaccagtgagctttccccta

SEQ ID NO: 163791 - DNA, 20 bp, human
gcctcaggaggagtatcccg

SEQ ID NO: 163792 - DNA, 20 bp, human
ggtggtgtgcaagtgagaag

SEQ ID NO: 163793 - DNA, 20 bp, human
ggtgaggttgcagttggtct

SEQ ID NO: 163794 - DNA, 20 bp, human
gctgaaaagtccagccctag

SEQ ID NO: 163795 - DNA, 20 bp, human
gccatggtctgccacaagaa

SEQ ID NO: 163796 - DNA, 20 bp, human
gggacctgaagggctactgg

SEQ ID NO: 163797 - DNA, 20 bp, human
gcctgtgcaaatctatgcag

SEQ ID NO: 163798 - DNA, 20 bp, human
gaccagctgaggtgagatac

SEQ ID NO: 163799 - DNA, 20 bp, human
gggcttggcatgtgactacc

SEQ ID NO: 163800 - DNA, 20 bp, human
gcaaggacctgaagggctac

SEQ ID NO: 163801 - DNA, 20 bp, human
ggaagatgccaaggacctga

SEQ ID NO: 163802 - DNA, 20 bp, human
gagcctgtcaacaaggcaca

SEQ ID NO: 163803 - DNA, 20 bp, human
gctgtagacctgcaaaacaa

SEQ ID NO: 163804 - DNA, 20 bp, human
gattttggtgtgatatcagt

SEQ ID NO: 163805 - DNA, 20 bp, human
gatattattggagatacttg

SEQ ID NO: 163806 - DNA, 20 bp, human
ggaacaaaggacatgttgtt

SEQ ID NO: 163807 - DNA, 20 bp, human
ggcatgtgaatggcaattca

SEQ ID NO: 163808 - DNA, 20 bp, human
gggcaattcaaggtgaacaa

SEQ ID NO: 163809 - DNA, 20 bp, human
gtaatcctctaaagagatag

SEQ ID NO: 163810 - DNA, 20 bp, human
gagaaattgactgaccatat

SEQ ID NO: 163811 - DNA, 20 bp, human
gttccaaatttgggagaact

SEQ ID NO: 163812 - DNA, 20 bp, human
gttggaaaccgtgagtattc

SEQ ID NO: 163813 - DNA, 20 bp, human
gctccaagttctcccaaatt

SEQ ID NO: 163814 - DNA, 20 bp, human
gatttattctttagagcaat

SEQ ID NO: 163815 - DNA, 20 bp, human
gaaaatttaacacttgttac

SEQ ID NO: 163816 - DNA, 20 bp, human
gtgtcttcttaactggatga

SEQ ID NO: 163817 - DNA, 20 bp, human
gttaacagtatataaacctg

SEQ ID NO: 163818 - DNA, 20 bp, human
gaggctcttctactcccaga

SEQ ID NO: 163819 - DNA, 20 bp, human
gggctcagaatgtaagcgtg

SEQ ID NO: 163820 - DNA, 20 bp, human
gattggcaaacataaaaaac

SEQ ID NO: 163821 - DNA, 20 bp, human
gaaaagccaactactttaag

SEQ ID NO: 163822 - DNA, 20 bp, human
gacatagtaaatattccttc

SEQ ID NO: 163823 - DNA, 20 bp, human
ggatgaaggcagccaagggt

SEQ ID NO: 163824 - DNA, 20 bp, human
ggacttgttgcagttgctgt

SEQ ID NO: 163825 - DNA, 20 bp, human
ggctgtaggattctaaatcc

SEQ ID NO: 163826 - DNA, 20 bp, human
gtaactggataagtaggagt

SEQ ID NO: 163827 - DNA, 20 bp, human
ggtcaaggtaagaaccgtcg

SEQ ID NO: 163828 - DNA, 20 bp, human
gtggataagtaggagtgggc

SEQ ID NO: 163829 - DNA, 20 bp, human
gagggctcagaacaaaagtg

SEQ ID NO: 163830 - DNA, 20 bp, human
gtcactttaactggataagt

SEQ ID NO: 163831 - DNA, 20 bp, human
gatcaaagaaatagggagcc

SEQ ID NO: 163832 - DNA, 20 bp, human
gtttaattagacaacctcga

SEQ ID NO: 163833 - DNA, 20 bp, human
ggatatttacaaggctttaa

SEQ ID NO: 163834 - DNA, 20 bp, human
gtctagaagggatatttaca

SEQ ID NO: 163835 - DNA, 20 bp, human
gggctcttctatttctagaa

SEQ ID NO: 163836 - DNA, 20 bp, human
gagacgctgcaatggattca

SEQ ID NO: 163837 - DNA, 20 bp, human
gaatggattcaaggtagaat

SEQ ID NO: 163838 - DNA, 20 bp, human
gagaaaacaagacgctgcaa

SEQ ID NO: 163839 - DNA, 20 bp, human
gtgttctttttgacagttag

SEQ ID NO: 163840 - DNA, 20 bp, human
gagaattttttgatgaataa

SEQ ID NO: 163841 - DNA, 20 bp, human
gattttaatgtacgcttcaa

SEQ ID NO: 163842 - DNA, 20 bp, human
gaagcaaataatgaacaatg

SEQ ID NO: 163843 - DNA, 20 bp, human
gacatgagatgatttggtac

SEQ ID NO: 163844 - DNA, 20 bp, human
gggtatctgtagtttaataa

SEQ ID NO: 163845 - DNA, 20 bp, human
gtttattcaaatgttgatgt

SEQ ID NO: 163846 - DNA, 20 bp, human
gaagagaagagatcgctcag

SEQ ID NO: 163847 - DNA, 20 bp, human
ggctgactgccagaaaaaag

SEQ ID NO: 163848 - DNA, 20 bp, human
ggacacaagcagaggagatt

SEQ ID NO: 163849 - DNA, 20 bp, human
ggagctgagatgcacgtcag

SEQ ID NO: 163850 - DNA, 20 bp, human
ggagagaaccaagtcttacc

SEQ ID NO: 163851 - DNA, 20 bp, human
gacgtgcatctcagctccca

SEQ ID NO: 163852 - DNA, 20 bp, human
gagaaccaagtcttacctgg

SEQ ID NO: 163853 - DNA, 20 bp, human
gctggcagtcagcagagaat

SEQ ID NO: 163854 - DNA, 20 bp, human
gacacaccacagactgaaag

SEQ ID NO: 163855 - DNA, 20 bp, human
gtcttcctccaggtaagact

SEQ ID NO: 163856 - DNA, 20 bp, human
ggggtgagaggcgaccgcgg

SEQ ID NO: 163857 - DNA, 20 bp, human
gagtggccggaggagattcg

SEQ ID NO: 163858 - DNA, 20 bp, human
gtccggcccggaagaccccg

SEQ ID NO: 163859 - DNA, 20 bp, human
gccgctccgcgaatctcctc

SEQ ID NO: 163860 - DNA, 20 bp, human
gatcggagcgcggcacagga

SEQ ID NO: 163861 - DNA, 20 bp, human
ggaagcgggtgcccagccga

SEQ ID NO: 163862 - DNA, 20 bp, human
gcggccggctcggctagtag

SEQ ID NO: 163863 - DNA, 20 bp, human
gggactaagtaatgggacag

SEQ ID NO: 163864 - DNA, 20 bp, human
gcgtcgcccggggatgagat

SEQ ID NO: 163865 - DNA, 20 bp, human
gccaagctcggcgcgtccca

SEQ ID NO: 163866 - DNA, 20 bp, human
gccgtagagccagagtgggt

SEQ ID NO: 163867 - DNA, 20 bp, human
ggatgggtgctcacagctgt

SEQ ID NO: 163868 - DNA, 20 bp, human
gcttgtccagacacaggtta

SEQ ID NO: 163869 - DNA, 20 bp, human
gtgaggccgtagagccagag

SEQ ID NO: 163870 - DNA, 20 bp, human
gctatacaaccgtggagcca

SEQ ID NO: 163871 - DNA, 20 bp, human
gaaacacttggagatacttg

SEQ ID NO: 163872 - DNA, 20 bp, human
gcaaccgtggagccagggca

SEQ ID NO: 163873 - DNA, 20 bp, human
gcagaaggagcaagtgaccc

SEQ ID NO: 163874 - DNA, 20 bp, human
gcacagcagggatgcaataa

SEQ ID NO: 163875 - DNA, 20 bp, human
ggccatggagagcaagcctg

SEQ ID NO: 163876 - DNA, 20 bp, human
gggccgcccccgtcctgccg

SEQ ID NO: 163877 - DNA, 20 bp, human
gtccagccccggcaggacgg

SEQ ID NO: 163878 - DNA, 20 bp, human
gtgctggcgcagggcacggt

SEQ ID NO: 163879 - DNA, 20 bp, human
gccccgccccgggttcgcgg

SEQ ID NO: 163880 - DNA, 20 bp, human
ggaggaggaaggggcgatcg

SEQ ID NO: 163881 - DNA, 20 bp, human
gcgccgggcggccccctcgt

SEQ ID NO: 163882 - DNA, 20 bp, human
ggctcggggactcaccaggt

SEQ ID NO: 163883 - DNA, 20 bp, human
ggccgcctggcccgacgagg

SEQ ID NO: 163884 - DNA, 20 bp, human
gaggttggcgagtggtgcag

SEQ ID NO: 163885 - DNA, 20 bp, human
gccggagcggcgagctgcag

SEQ ID NO: 163886 - DNA, 20 bp, human
ggcggccgggccctcgagac

SEQ ID NO: 163887 - DNA, 20 bp, human
gcgggccctcgagacgggga

SEQ ID NO: 163888 - DNA, 20 bp, human
ggtccccagctggatctgtg

SEQ ID NO: 163889 - DNA, 20 bp, human
gcagcccctgcccacgatgg

SEQ ID NO: 163890 - DNA, 20 bp, human
gcgcgcagcgctccacgctc

SEQ ID NO: 163891 - DNA, 20 bp, human
gcggcaggtgccgccatcgt

SEQ ID NO: 163892 - DNA, 20 bp, human
gctggcagggactgtcggag

SEQ ID NO: 163893 - DNA, 20 bp, human
gcaggaccgagcggaatcgg

SEQ ID NO: 163894 - DNA, 20 bp, human
gccgcggagctccagagttg

SEQ ID NO: 163895 - DNA, 20 bp, human
gaagcggcgcgtggctgccg

SEQ ID NO: 163896 - DNA, 20 bp, human
gggccagtggagagcgaggt

SEQ ID NO: 163897 - DNA, 20 bp, human
gggcacggcgagccagccgg

SEQ ID NO: 163898 - DNA, 20 bp, human
gactggcccgagcctcaagc

SEQ ID NO: 163899 - DNA, 20 bp, human
gcaagcggcgcaggatgtct

SEQ ID NO: 163900 - DNA, 20 bp, human
gcagacatgaagagcgccaa

SEQ ID NO: 163901 - DNA, 20 bp, human
gagcgctgcaacacacctgg

SEQ ID NO: 163902 - DNA, 20 bp, human
gctcgggccagtggagagcg

SEQ ID NO: 163903 - DNA, 20 bp, human
ggcgctcttcatgtctggat

SEQ ID NO: 163904 - DNA, 20 bp, human
gaccttgcgtgacggccaag

SEQ ID NO: 163905 - DNA, 20 bp, human
gtgctctgaagcaccggagt

SEQ ID NO: 163906 - DNA, 20 bp, human
ggctgctgcctagtcctccg

SEQ ID NO: 163907 - DNA, 20 bp, human
gcggagagggacgccgagta

SEQ ID NO: 163908 - DNA, 20 bp, human
gcgcagccgcgtgccacagg

SEQ ID NO: 163909 - DNA, 20 bp, human
gcgaaccgtccctagaggga

SEQ ID NO: 163910 - DNA, 20 bp, human
gagggacggaggagctagtc

SEQ ID NO: 163911 - DNA, 20 bp, human
gctcaagctaccgcccggag

SEQ ID NO: 163912 - DNA, 20 bp, human
gctgggctcgcggcaccctc

SEQ ID NO: 163913 - DNA, 20 bp, human
gtactgcgatgagccctact

SEQ ID NO: 163914 - DNA, 20 bp, human
gaccgtccctagagggacgg

SEQ ID NO: 163915 - DNA, 20 bp, human
ggaccccgaaccgtccctag

SEQ ID NO: 163916 - DNA, 20 bp, human
gagttgggagccgcgtgagg

SEQ ID NO: 163917 - DNA, 20 bp, human
gccgggaaggcgcctgggta

SEQ ID NO: 163918 - DNA, 20 bp, human
gaatagttgggagccgcgtg

SEQ ID NO: 163919 - DNA, 20 bp, human
gactgagctacgggaatagt

SEQ ID NO: 163920 - DNA, 20 bp, human
gaggcgcctgggtaaggcag

SEQ ID NO: 163921 - DNA, 20 bp, human
gtccccggctcctcacgcag

SEQ ID NO: 163922 - DNA, 20 bp, human
gggaggggggcactgagcta

SEQ ID NO: 163923 - DNA, 20 bp, human
gcggaggctgcctcctcacg

SEQ ID NO: 163924 - DNA, 20 bp, human
ggcctggctgagtagagcgg

SEQ ID NO: 163925 - DNA, 20 bp, human
gagggcgctcgcctaagcag

SEQ ID NO: 163926 - DNA, 20 bp, human
ggaggactcggtggccacaa

SEQ ID NO: 163927 - DNA, 20 bp, human
gcctgcctgggccaacccaa

SEQ ID NO: 163928 - DNA, 20 bp, human
gagagcgaacgtttctccta

SEQ ID NO: 163929 - DNA, 20 bp, human
ggccagcctggcgagggcgt

SEQ ID NO: 163930 - DNA, 20 bp, human
gggcccagcctgctaaggac

SEQ ID NO: 163931 - DNA, 20 bp, human
gggagaaacgttcgctctgg

SEQ ID NO: 163932 - DNA, 20 bp, human
gagccaggatgaagtctcaa

SEQ ID NO: 163933 - DNA, 20 bp, human
gcagcctgctaaggacagga

SEQ ID NO: 163934 - DNA, 20 bp, human
gtacgaacatggctcaccct

SEQ ID NO: 163935 - DNA, 20 bp, human
ggaagcccgggaaaaaacac

SEQ ID NO: 163936 - DNA, 20 bp, human
gctccagggaaacgctaagg

SEQ ID NO: 163937 - DNA, 20 bp, human
gtagctgggcccccggacag

SEQ ID NO: 163938 - DNA, 20 bp, human
gctcgacctgggcgcctcca

SEQ ID NO: 163939 - DNA, 20 bp, human
gcgcctccagggaaacgcta

SEQ ID NO: 163940 - DNA, 20 bp, human
gccgcgccccgcagaaaccg

SEQ ID NO: 163941 - DNA, 20 bp, human
ggggctagaccctgaagcac

SEQ ID NO: 163942 - DNA, 20 bp, human
gggctcttccaacttccagc

SEQ ID NO: 163943 - DNA, 20 bp, human
ggtgcactcagtggccttct

SEQ ID NO: 163944 - DNA, 20 bp, human
ggcaggaaccgaagcctaga

SEQ ID NO: 163945 - DNA, 20 bp, human
ggccaacccgctagtatata

SEQ ID NO: 163946 - DNA, 20 bp, human
gaggcccaggctacagtccg

SEQ ID NO: 163947 - DNA, 20 bp, human
gttctgaagcaggagaataa

SEQ ID NO: 163948 - DNA, 20 bp, human
gtctgtggagagtgagcccg

SEQ ID NO: 163949 - DNA, 20 bp, human
ggcagaaagcgatcaatggg

SEQ ID NO: 163950 - DNA, 20 bp, human
gggatcttcccgggagtggt

SEQ ID NO: 163951 - DNA, 20 bp, human
gagcccgcggactgtagcct

SEQ ID NO: 163952 - DNA, 20 bp, human
gagcccgagatcagtctgaa

SEQ ID NO: 163953 - DNA, 20 bp, human
gcagctctgagtgatctcta

SEQ ID NO: 163954 - DNA, 20 bp, human
gagagaaagcagaccgggat

SEQ ID NO: 163955 - DNA, 20 bp, human
gggagcaggcccgaggatag

SEQ ID NO: 163956 - DNA, 20 bp, human
gggacagtggtaatcctcaa

SEQ ID NO: 163957 - DNA, 20 bp, human
gactcaagcccagaggaacc

SEQ ID NO: 163958 - DNA, 20 bp, human
ggagggttctcatagttctg

SEQ ID NO: 163959 - DNA, 20 bp, human
gcaggagctctgatctactt

SEQ ID NO: 163960 - DNA, 20 bp, human
gatgtaggactcaagcccag

SEQ ID NO: 163961 - DNA, 20 bp, human
gaagacaagtgaggagactt

SEQ ID NO: 163962 - DNA, 20 bp, human
gctgagagaaagagatgtag

SEQ ID NO: 163963 - DNA, 20 bp, human
gccttcagataagacaagtg

SEQ ID NO: 163964 - DNA, 20 bp, human
gaatcctcaaaggctagaaa

SEQ ID NO: 163965 - DNA, 20 bp, human
gcaccttgtagctgaggcca

SEQ ID NO: 163966 - DNA, 20 bp, human
gcaaactagccgaaccccaa

SEQ ID NO: 163967 - DNA, 20 bp, human
gggagctccgcagtccccgt

SEQ ID NO: 163968 - DNA, 20 bp, human
gctgggcaggtcccacacag

SEQ ID NO: 163969 - DNA, 20 bp, human
ggcccctgcccagcgagcag

SEQ ID NO: 163970 - DNA, 20 bp, human
gccgcgggggcggaacaaac

SEQ ID NO: 163971 - DNA, 20 bp, human
gccaggtaggcgccaaccat

SEQ ID NO: 163972 - DNA, 20 bp, human
gcgagcagcggtttccgcgg

SEQ ID NO: 163973 - DNA, 20 bp, human
gcgtgccggactagacccta

SEQ ID NO: 163974 - DNA, 20 bp, human
gggcagagccaagtgcgtcc

SEQ ID NO: 163975 - DNA, 20 bp, human
gagggaaacgcggagtgtcc

SEQ ID NO: 163976 - DNA, 20 bp, human
gttctctctgagaagctcca

SEQ ID NO: 163977 - DNA, 20 bp, human
ggcaagctgcaaatccttag

SEQ ID NO: 163978 - DNA, 20 bp, human
ggctgcaaatccttagtgga

SEQ ID NO: 163979 - DNA, 20 bp, human
gcctgaggtaatagtagatg

SEQ ID NO: 163980 - DNA, 20 bp, human
gactgaaatgccgtatcctg

SEQ ID NO: 163981 - DNA, 20 bp, human
gccttgactacatgcagcag

SEQ ID NO: 163982 - DNA, 20 bp, human
ggctccaaacaataaaagaa

SEQ ID NO: 163983 - DNA, 20 bp, human
ggtgcactgttaaattctgg

SEQ ID NO: 163984 - DNA, 20 bp, human
gcactgttaaattctggagg

SEQ ID NO: 163985 - DNA, 20 bp, human
ggaaaggagttcctataatc

SEQ ID NO: 163986 - DNA, 20 bp, human
gttacccgctgggttctcct

SEQ ID NO: 163987 - DNA, 20 bp, human
gaggagcacgaaggacttaa

SEQ ID NO: 163988 - DNA, 20 bp, human
gggttctctgctctggactt

SEQ ID NO: 163989 - DNA, 20 bp, human
gcctgggcaaagaagcgcgg

SEQ ID NO: 163990 - DNA, 20 bp, human
gccacggttcaggagcacga

SEQ ID NO: 163991 - DNA, 20 bp, human
gagcagagaacctgacccgg

SEQ ID NO: 163992 - DNA, 20 bp, human
gcctgacccggcgggatccc

SEQ ID NO: 163993 - DNA, 20 bp, human
gtataagcccgggatcccgc

SEQ ID NO: 163994 - DNA, 20 bp, human
gcacctccaacgacagctag

SEQ ID NO: 163995 - DNA, 20 bp, human
gagggaaaacgacgaaatcg

SEQ ID NO: 163996 - DNA, 20 bp, human
ggggaggctatgggagctca

SEQ ID NO: 163997 - DNA, 20 bp, human
ggctcccgcgggagcatggg

SEQ ID NO: 163998 - DNA, 20 bp, human
gagagctaccggccaggggt

SEQ ID NO: 163999 - DNA, 20 bp, human
gctgaaactaggcagcgctg

SEQ ID NO: 164000 - DNA, 20 bp, human
ggccaggggtcgggaggcta

SEQ ID NO: 164001 - DNA, 20 bp, human
gacagggacggccagaacca

SEQ ID NO: 164002 - DNA, 20 bp, human
gctaccggccaggggtcggg

SEQ ID NO: 164003 - DNA, 20 bp, human
gcctgagagctaccggccag

SEQ ID NO: 164004 - DNA, 20 bp, human
gggcacactgatgaaagcta

SEQ ID NO: 164005 - DNA, 20 bp, human
ggtggctcccgcgggagcat

SEQ ID NO: 164006 - DNA, 20 bp, human
gccgcgacctcggctcgaga

SEQ ID NO: 164007 - DNA, 20 bp, human
gtcagcgtggtggctgaatt

SEQ ID NO: 164008 - DNA, 20 bp, human
gtcagcagcgagaggtgctg

SEQ ID NO: 164009 - DNA, 20 bp, human
gtggcggcctcagcagcgag

SEQ ID NO: 164010 - DNA, 20 bp, human
gggcgtgcagaggagctaaa

SEQ ID NO: 164011 - DNA, 20 bp, human
gcaagattgtaggcgtgcag

SEQ ID NO: 164012 - DNA, 20 bp, human
gggtacttaagtcagcgtgg

SEQ ID NO: 164013 - DNA, 20 bp, human
gaacgtgaggacctgaatta

SEQ ID NO: 164014 - DNA, 20 bp, human
gcactcgacgccgcagtcca

SEQ ID NO: 164015 - DNA, 20 bp, human
gcagggtacttaagtcagcg

SEQ ID NO: 164016 - DNA, 20 bp, human
ggcctccaggtgcagtcccg

SEQ ID NO: 164017 - DNA, 20 bp, human
gcctggctcgggaaagaccc

SEQ ID NO: 164018 - DNA, 20 bp, human
gggtgcctcccagcccgcag

SEQ ID NO: 164019 - DNA, 20 bp, human
gaagcccgcgggctcttcgg

SEQ ID NO: 164020 - DNA, 20 bp, human
ggagccaccgaagagcccgc

SEQ ID NO: 164021 - DNA, 20 bp, human
gcccggacggggatggtcag

SEQ ID NO: 164022 - DNA, 20 bp, human
gctgggtgggagggcaacct

SEQ ID NO: 164023 - DNA, 20 bp, human
ggggcggggaccatactcac

SEQ ID NO: 164024 - DNA, 20 bp, human
gctgctgcgaggaggaaaat

SEQ ID NO: 164025 - DNA, 20 bp, human
gcaggcactgacccgtctgt

SEQ ID NO: 164026 - DNA, 20 bp, human
gtatccactagtcagcactc

SEQ ID NO: 164027 - DNA, 20 bp, human
gtcgccggagtgctgactag

SEQ ID NO: 164028 - DNA, 20 bp, human
ggctgctgcgaagactgagt

SEQ ID NO: 164029 - DNA, 20 bp, human
gttatggccccgatcaaagt

SEQ ID NO: 164030 - DNA, 20 bp, human
gctgagtggggactgactgg

SEQ ID NO: 164031 - DNA, 20 bp, human
ggtgggctccggaagctaga

SEQ ID NO: 164032 - DNA, 20 bp, human
gcagagcgcgcggggcaact

SEQ ID NO: 164033 - DNA, 20 bp, human
gtccggcgaggaactccaag

SEQ ID NO: 164034 - DNA, 20 bp, human
ggtctcccgacagccaacga

SEQ ID NO: 164035 - DNA, 20 bp, human
gcaggctgcggcggagtcga

SEQ ID NO: 164036 - DNA, 20 bp, human
gcacgcgtcttgccccgcag

SEQ ID NO: 164037 - DNA, 20 bp, human
gcacaccatggcccccgggt

SEQ ID NO: 164038 - DNA, 20 bp, human
gcagtgagcacggcagacac

SEQ ID NO: 164039 - DNA, 20 bp, human
ggtggggcaggggtactcac

SEQ ID NO: 164040 - DNA, 20 bp, human
ggcagcaacagcagctccat

SEQ ID NO: 164041 - DNA, 20 bp, human
ggctggcgagcgtcctgagt

SEQ ID NO: 164042 - DNA, 20 bp, human
ggagggatcgtatccaggaa

SEQ ID NO: 164043 - DNA, 20 bp, human
ggggccgggttggggacctg

SEQ ID NO: 164044 - DNA, 20 bp, human
ggaatggagagagcgagcgc

SEQ ID NO: 164045 - DNA, 20 bp, human
gctccgagctgggggtctgt

SEQ ID NO: 164046 - DNA, 20 bp, human
gagccttaagaggaccgaag

SEQ ID NO: 164047 - DNA, 20 bp, human
gcagcgtgagtccttcggtc

SEQ ID NO: 164048 - DNA, 20 bp, human
gactcacgctgcccagccaa

SEQ ID NO: 164049 - DNA, 20 bp, human
gtatccaggcacgtagtgca

SEQ ID NO: 164050 - DNA, 20 bp, human
gttagggaaaagtcgagtga

SEQ ID NO: 164051 - DNA, 20 bp, human
gcggggggcgagttgtctga

SEQ ID NO: 164052 - DNA, 20 bp, human
gttcggaattacgtggaggg

SEQ ID NO: 164053 - DNA, 20 bp, human
gcgtctgggctattgcagtg

SEQ ID NO: 164054 - DNA, 20 bp, human
gaactggacagcacctcggg

SEQ ID NO: 164055 - DNA, 20 bp, human
ggggctattgcagtgcgggg

SEQ ID NO: 164056 - DNA, 20 bp, human
gcaccgagcagctagccaac

SEQ ID NO: 164057 - DNA, 20 bp, human
gagcgcgggcggcgccccca

SEQ ID NO: 164058 - DNA, 20 bp, human
gggcactgcaggccgaccgg

SEQ ID NO: 164059 - DNA, 20 bp, human
gcgcctccgggaaaagatct

SEQ ID NO: 164060 - DNA, 20 bp, human
gcccaggagcgagagcaccg

SEQ ID NO: 164061 - DNA, 20 bp, human
gcgggtgcgtgggccctccc

SEQ ID NO: 164062 - DNA, 20 bp, human
gcgcgcctcgcgcagcgggg

SEQ ID NO: 164063 - DNA, 20 bp, human
gtgcccctcgcaaggagagg

SEQ ID NO: 164064 - DNA, 20 bp, human
gtagctcgcgccgggtgcgt

SEQ ID NO: 164065 - DNA, 20 bp, human
gtgcaagaagcgttgcccgt

SEQ ID NO: 164066 - DNA, 20 bp, human
ggaaggtgaagcgataccgt

SEQ ID NO: 164067 - DNA, 20 bp, human
ggatctcaggcaaagcacga

SEQ ID NO: 164068 - DNA, 20 bp, human
ggagtgagtgtcccaggact

SEQ ID NO: 164069 - DNA, 20 bp, human
gtctcggtgctctggatcag

SEQ ID NO: 164070 - DNA, 20 bp, human
gagggtgcttgaatggtgag

SEQ ID NO: 164071 - DNA, 20 bp, human
gttgaatggtgagcggtcag

SEQ ID NO: 164072 - DNA, 20 bp, human
gatcaaaggaacctagtcct

SEQ ID NO: 164073 - DNA, 20 bp, human
gtgctctttgccctttaggt

SEQ ID NO: 164074 - DNA, 20 bp, human
gagacaccctggaaaagcaa

SEQ ID NO: 164075 - DNA, 20 bp, human
gaaatccagagactgagctc

SEQ ID NO: 164076 - DNA, 20 bp, human
ggggccgagggagatcgata

SEQ ID NO: 164077 - DNA, 20 bp, human
ggttgaggaaagagaggcgt

SEQ ID NO: 164078 - DNA, 20 bp, human
gccttacgcgcagacaggta

SEQ ID NO: 164079 - DNA, 20 bp, human
gtagggtcgtcgagtctacg

SEQ ID NO: 164080 - DNA, 20 bp, human
gtttcttttggtctcaagtg

SEQ ID NO: 164081 - DNA, 20 bp, human
gtctgcgcgtaaggggccag

SEQ ID NO: 164082 - DNA, 20 bp, human
gtgtcaccccgcagaacgga

SEQ ID NO: 164083 - DNA, 20 bp, human
gtcctggaaggagccttctt

SEQ ID NO: 164084 - DNA, 20 bp, human
gtagccgggttagaaggaga

SEQ ID NO: 164085 - DNA, 20 bp, human
gcgtagcggtcgatcctgga

SEQ ID NO: 164086 - DNA, 20 bp, human
gcgactaccgcggagagcac

SEQ ID NO: 164087 - DNA, 20 bp, human
gctctccccggtgctctccg

SEQ ID NO: 164088 - DNA, 20 bp, human
gctgcccgctccgactaccg

SEQ ID NO: 164089 - DNA, 20 bp, human
ggagaaggaagggaaaacgg

SEQ ID NO: 164090 - DNA, 20 bp, human
ggcgagcagcgcagtcccag

SEQ ID NO: 164091 - DNA, 20 bp, human
gtggggagccccggaacccg

SEQ ID NO: 164092 - DNA, 20 bp, human
ggaacccgcggtcgccaccg

SEQ ID NO: 164093 - DNA, 20 bp, human
gctctccgcggtagtcggag

SEQ ID NO: 164094 - DNA, 20 bp, human
ggcctcgcgtcctggaactc

SEQ ID NO: 164095 - DNA, 20 bp, human
gccccaggctggaggcgtcc

SEQ ID NO: 164096 - DNA, 20 bp, human
gatcagaagtaggaagtgga

SEQ ID NO: 164097 - DNA, 20 bp, human
ggctgctgttgatcagaagt

SEQ ID NO: 164098 - DNA, 20 bp, human
ggacgcggagcccaaggtaa

SEQ ID NO: 164099 - DNA, 20 bp, human
gttaaactctaggcatcggg

SEQ ID NO: 164100 - DNA, 20 bp, human
gctgattcccggtaagcggt

SEQ ID NO: 164101 - DNA, 20 bp, human
gtctcagggaaaggacgcct

SEQ ID NO: 164102 - DNA, 20 bp, human
gaccgggaatcagtacacca

SEQ ID NO: 164103 - DNA, 20 bp, human
gattacaaagaactcagcga

SEQ ID NO: 164104 - DNA, 20 bp, human
gcagcagcactcttaaagga

SEQ ID NO: 164105 - DNA, 20 bp, human
gtcgtgcagaactatttcag

SEQ ID NO: 164106 - DNA, 20 bp, human
gtgtaatgcacagctggaag

SEQ ID NO: 164107 - DNA, 20 bp, human
gcaagaaatactagaaaagg

SEQ ID NO: 164108 - DNA, 20 bp, human
gtaacaagaaatactagaaa

SEQ ID NO: 164109 - DNA, 20 bp, human
gttgagaagaaagtacgcag

SEQ ID NO: 164110 - DNA, 20 bp, human
ggtgcattacagataacgtc

SEQ ID NO: 164111 - DNA, 20 bp, human
ggttattagtcagattgcca

SEQ ID NO: 164112 - DNA, 20 bp, human
gggagaacattgctgtagct

SEQ ID NO: 164113 - DNA, 20 bp, human
gttcataaagttaaaacctc

SEQ ID NO: 164114 - DNA, 20 bp, human
gtttaactttatgaagctat

SEQ ID NO: 164115 - DNA, 20 bp, human
gtgccgtgaattttaattga

SEQ ID NO: 164116 - DNA, 20 bp, human
gctccaggccgaggctgtgt

SEQ ID NO: 164117 - DNA, 20 bp, human
ggcggcgccccagacccgag

SEQ ID NO: 164118 - DNA, 20 bp, human
gggagggagacaggcggcgg

SEQ ID NO: 164119 - DNA, 20 bp, human
gcggcggcggaggagaccct

SEQ ID NO: 164120 - DNA, 20 bp, human
ggcgcgtcccctcgggtctg

SEQ ID NO: 164121 - DNA, 20 bp, human
gcgagcggtcaggactcccg

SEQ ID NO: 164122 - DNA, 20 bp, human
gctgatccgacgggtccgag

SEQ ID NO: 164123 - DNA, 20 bp, human
gagtgcaaggaactctgtgt

SEQ ID NO: 164124 - DNA, 20 bp, human
gggcaggtgccgctcccgga

SEQ ID NO: 164125 - DNA, 20 bp, human
gaggacaggataaggaccag

SEQ ID NO: 164126 - DNA, 20 bp, human
gagggtgcgcgttcccgtgg

SEQ ID NO: 164127 - DNA, 20 bp, human
gcggcggaggtcgtgcctag

SEQ ID NO: 164128 - DNA, 20 bp, human
gccgtggcggtgcaccgggt

SEQ ID NO: 164129 - DNA, 20 bp, human
gccggcggacgagaaggtgg

SEQ ID NO: 164130 - DNA, 20 bp, human
gccgcgagggtcgcatctca

SEQ ID NO: 164131 - DNA, 20 bp, human
gctggcaaggtaagctgagg

SEQ ID NO: 164132 - DNA, 20 bp, human
gcagctcccggcggacgaga

SEQ ID NO: 164133 - DNA, 20 bp, human
gcatgggccgcctcccctca

SEQ ID NO: 164134 - DNA, 20 bp, human
ggctcaagctgcgcccgacg

SEQ ID NO: 164135 - DNA, 20 bp, human
ggggtaggagggcccttgaa

SEQ ID NO: 164136 - DNA, 20 bp, human
ggccggcggcaatgaagatc

SEQ ID NO: 164137 - DNA, 20 bp, human
gcgctggtggtcgacagcca

SEQ ID NO: 164138 - DNA, 20 bp, human
gtgccctgctcccgacccca

SEQ ID NO: 164139 - DNA, 20 bp, human
gcggcccgaagcacccggcc

SEQ ID NO: 164140 - DNA, 20 bp, human
gccgcgcggcccgaagcacc

SEQ ID NO: 164141 - DNA, 20 bp, human
gcgggctctgcgatccgggc

SEQ ID NO: 164142 - DNA, 20 bp, human
ggaagcgcgcgtgccctctc

SEQ ID NO: 164143 - DNA, 20 bp, human
gggcgcgggctctgcgatcc

SEQ ID NO: 164144 - DNA, 20 bp, human
ggagctcggagcacgtgttt

SEQ ID NO: 164145 - DNA, 20 bp, human
ggcaggagccggcgtctgga

SEQ ID NO: 164146 - DNA, 20 bp, human
gagatgtccgggtagcgcca

SEQ ID NO: 164147 - DNA, 20 bp, human
ggtagcgccaggggacaacg

SEQ ID NO: 164148 - DNA, 20 bp, human
gcggcaccctgagagatgtc

SEQ ID NO: 164149 - DNA, 20 bp, human
ggctacccggacatctctca

SEQ ID NO: 164150 - DNA, 20 bp, human
gccggcccgaggctacctca

SEQ ID NO: 164151 - DNA, 20 bp, human
gcaaccctgagtgctgtcaa

SEQ ID NO: 164152 - DNA, 20 bp, human
gcgggccccggcgacacgga

SEQ ID NO: 164153 - DNA, 20 bp, human
gcgggctgtcccccaccatg

SEQ ID NO: 164154 - DNA, 20 bp, human
gggccagggaaagtacactc

SEQ ID NO: 164155 - DNA, 20 bp, human
gcccgaggctacctcatggt

SEQ ID NO: 164156 - DNA, 20 bp, human
ggagaaacctgccatagcca

SEQ ID NO: 164157 - DNA, 20 bp, human
gcaaagacacaccctggcta

SEQ ID NO: 164158 - DNA, 20 bp, human
ggaggatcaaagacacaccc

SEQ ID NO: 164159 - DNA, 20 bp, human
gatcctgcagttacctgaag

SEQ ID NO: 164160 - DNA, 20 bp, human
gtaaggcatgctgtatccaa

SEQ ID NO: 164161 - DNA, 20 bp, human
gtggcatgaccttgacttca

SEQ ID NO: 164162 - DNA, 20 bp, human
ggtactcactttatatctta

SEQ ID NO: 164163 - DNA, 20 bp, human
gtgaaataggcaatgcccct

SEQ ID NO: 164164 - DNA, 20 bp, human
gatcctcttcaggtaactgc

SEQ ID NO: 164165 - DNA, 20 bp, human
ggacattggctttctttgaa

SEQ ID NO: 164166 - DNA, 20 bp, human
gctgggaactctggcacctt

SEQ ID NO: 164167 - DNA, 20 bp, human
gtgagggtggaatacatgtc

SEQ ID NO: 164168 - DNA, 20 bp, human
gcagagccttccacagccca

SEQ ID NO: 164169 - DNA, 20 bp, human
gtagcagaagcaaagacaca

SEQ ID NO: 164170 - DNA, 20 bp, human
gggctgcagggtcagaggtg

SEQ ID NO: 164171 - DNA, 20 bp, human
gtgacagcatggctgcatag

SEQ ID NO: 164172 - DNA, 20 bp, human
gtttcgggagacctccctga

SEQ ID NO: 164173 - DNA, 20 bp, human
ggtctcccgaaactaagctg

SEQ ID NO: 164174 - DNA, 20 bp, human
gatctgggctgcagggtcag

SEQ ID NO: 164175 - DNA, 20 bp, human
gagtcactctggtctaatct

SEQ ID NO: 164176 - DNA, 20 bp, human
ggctgccaccgcaccggtag

SEQ ID NO: 164177 - DNA, 20 bp, human
ggccgaggctgccaccgcac

SEQ ID NO: 164178 - DNA, 20 bp, human
gatggctgccgctaccggtg

SEQ ID NO: 164179 - DNA, 20 bp, human
ggaagagcagcgcgctgccg

SEQ ID NO: 164180 - DNA, 20 bp, human
ggctgccgctaccggtgcgg

SEQ ID NO: 164181 - DNA, 20 bp, human
gcgagtgggctgcagggcgg

SEQ ID NO: 164182 - DNA, 20 bp, human
ggccgttccgcaggtcccag

SEQ ID NO: 164183 - DNA, 20 bp, human
gggccggcgcggcctcccaa

SEQ ID NO: 164184 - DNA, 20 bp, human
gggcggaacttagacatcac

SEQ ID NO: 164185 - DNA, 20 bp, human
ggccgctgggacctgcggaa

SEQ ID NO: 164186 - DNA, 20 bp, human
gagattggcttggattctgt

SEQ ID NO: 164187 - DNA, 20 bp, human
gatggacttggggctagctg

SEQ ID NO: 164188 - DNA, 20 bp, human
gattctgtcggatggacttg

SEQ ID NO: 164189 - DNA, 20 bp, human
ggggcacgagtgccatgaat

SEQ ID NO: 164190 - DNA, 20 bp, human
gcttggggctagctgcggcg

SEQ ID NO: 164191 - DNA, 20 bp, human
gagatgatccgacttcagtg

SEQ ID NO: 164192 - DNA, 20 bp, human
ggaagtaaacattacgagat

SEQ ID NO: 164193 - DNA, 20 bp, human
gtggcttggattctgtcgga

SEQ ID NO: 164194 - DNA, 20 bp, human
gctgtcctgagacccattca

SEQ ID NO: 164195 - DNA, 20 bp, human
gcgcagtggccgccggaatt

SEQ ID NO: 164196 - DNA, 20 bp, human
ggcctcatcctggaaccagg

SEQ ID NO: 164197 - DNA, 20 bp, human
gcgtgctcagaagtgatgag

SEQ ID NO: 164198 - DNA, 20 bp, human
gtcacctgggtgagggatgg

SEQ ID NO: 164199 - DNA, 20 bp, human
gtcgtggcagcctggagcat

SEQ ID NO: 164200 - DNA, 20 bp, human
gaggagggtgagcctcatgg

SEQ ID NO: 164201 - DNA, 20 bp, human
gggagcaatggcctctcgct

SEQ ID NO: 164202 - DNA, 20 bp, human
gacttctgagcacggagcaa

SEQ ID NO: 164203 - DNA, 20 bp, human
ggctgtgcagctgctgctcg

SEQ ID NO: 164204 - DNA, 20 bp, human
ggccagagaggccccttgaa

SEQ ID NO: 164205 - DNA, 20 bp, human
gggtagccagcctcacatca

SEQ ID NO: 164206 - DNA, 20 bp, human
ggctctcggggactatccgg

SEQ ID NO: 164207 - DNA, 20 bp, human
gacaggagaggggcacgtac

SEQ ID NO: 164208 - DNA, 20 bp, human
gccggccaggactgtgacag

SEQ ID NO: 164209 - DNA, 20 bp, human
gcaagctctcggggactatc

SEQ ID NO: 164210 - DNA, 20 bp, human
ggccaggactgtgacagagg

SEQ ID NO: 164211 - DNA, 20 bp, human
gggggcacgtaccggcgcta

SEQ ID NO: 164212 - DNA, 20 bp, human
gggggagggctggatcgcta

SEQ ID NO: 164213 - DNA, 20 bp, human
ggccgtgacctagggtccag

SEQ ID NO: 164214 - DNA, 20 bp, human
ggcgagggccctggtgagag

SEQ ID NO: 164215 - DNA, 20 bp, human
gacccgcctccagacaggag

SEQ ID NO: 164216 - DNA, 20 bp, human
ggcgagggccctggtgagag

SEQ ID NO: 164217 - DNA, 20 bp, human
gacaggagaggggcacgtac

SEQ ID NO: 164218 - DNA, 20 bp, human
ggtgcccctctcctgtctgg

SEQ ID NO: 164219 - DNA, 20 bp, human
ggctctcggggactatccgg

SEQ ID NO: 164220 - DNA, 20 bp, human
ggggtgtagaagtccgaccg

SEQ ID NO: 164221 - DNA, 20 bp, human
gcgccgactggacagcagtc

SEQ ID NO: 164222 - DNA, 20 bp, human
ggacagcagtctggcttccg

SEQ ID NO: 164223 - DNA, 20 bp, human
gagccagactgctgtccagt

SEQ ID NO: 164224 - DNA, 20 bp, human
gacccgcctccagacaggag

SEQ ID NO: 164225 - DNA, 20 bp, human
gaggcctccccctctcacca

SEQ ID NO: 164226 - DNA, 20 bp, human
gcgccgcggcaccttcttaa

SEQ ID NO: 164227 - DNA, 20 bp, human
gccgcggcggcgccggaggt

SEQ ID NO: 164228 - DNA, 20 bp, human
gcacggctcacagcaggcga

SEQ ID NO: 164229 - DNA, 20 bp, human
gctccgttaagaaggtgccg

SEQ ID NO: 164230 - DNA, 20 bp, human
gcccccaacccggcgaccta

SEQ ID NO: 164231 - DNA, 20 bp, human
gcggtaggtacgaagcaagg

SEQ ID NO: 164232 - DNA, 20 bp, human
ggcccgcagccccgacggag

SEQ ID NO: 164233 - DNA, 20 bp, human
gcccggacggagaccaccgt

SEQ ID NO: 164234 - DNA, 20 bp, human
gggcaggagccgcactcggg

SEQ ID NO: 164235 - DNA, 20 bp, human
gctgggagtcggcacccggg

SEQ ID NO: 164236 - DNA, 20 bp, human
ggtggaaactcggactacac

SEQ ID NO: 164237 - DNA, 20 bp, human
gtactgtccagggtcactgg

SEQ ID NO: 164238 - DNA, 20 bp, human
gtcactggcggagtagtacc

SEQ ID NO: 164239 - DNA, 20 bp, human
gaaacgcgcgcggagaccct

SEQ ID NO: 164240 - DNA, 20 bp, human
gcaaagggaatgcagtagat

SEQ ID NO: 164241 - DNA, 20 bp, human
ggtacctggctgtggaaact

SEQ ID NO: 164242 - DNA, 20 bp, human
gggaatgcagtagatgggcc

SEQ ID NO: 164243 - DNA, 20 bp, human
gctcggactacacaggtagc

SEQ ID NO: 164244 - DNA, 20 bp, human
gtcacttgaaggaacatctg

SEQ ID NO: 164245 - DNA, 20 bp, human
gccaaccttcagaagcttaa

SEQ ID NO: 164246 - DNA, 20 bp, human
gggctgggcgcgagaagacg

SEQ ID NO: 164247 - DNA, 20 bp, human
ggacccaacaaagacaccag

SEQ ID NO: 164248 - DNA, 20 bp, human
ggctcctccgagcagacggg

SEQ ID NO: 164249 - DNA, 20 bp, human
gcccacgcgtgcagagacgg

SEQ ID NO: 164250 - DNA, 20 bp, human
gagcgcgaccagatcaatcc

SEQ ID NO: 164251 - DNA, 20 bp, human
ggcgcctcccgtctgctcgg

SEQ ID NO: 164252 - DNA, 20 bp, human
gcgggaggcgccatcatggg

SEQ ID NO: 164253 - DNA, 20 bp, human
gagacaccaggggagcccgg

SEQ ID NO: 164254 - DNA, 20 bp, human
gcctggagcctggattgatc

SEQ ID NO: 164255 - DNA, 20 bp, human
gacgcgtgcagagacggcgg

SEQ ID NO: 164256 - DNA, 20 bp, human
gccatcccatcggaagagga

SEQ ID NO: 164257 - DNA, 20 bp, human
gccgcccccgtcagcctggg

SEQ ID NO: 164258 - DNA, 20 bp, human
ggcggaactgaaaacactcc

SEQ ID NO: 164259 - DNA, 20 bp, human
gctgccgcccaggctgacgg

SEQ ID NO: 164260 - DNA, 20 bp, human
gggaccccccggatctgacg

SEQ ID NO: 164261 - DNA, 20 bp, human
gccgccccgtcagatccggg

SEQ ID NO: 164262 - DNA, 20 bp, human
gccctccatcccatcggaag

SEQ ID NO: 164263 - DNA, 20 bp, human
ggcccgcgggcctccagcta

SEQ ID NO: 164264 - DNA, 20 bp, human
ggggaatgggcgattggagg

SEQ ID NO: 164265 - DNA, 20 bp, human
gccgcagcggccatgtgaca

SEQ ID NO: 164266 - DNA, 20 bp, human
ggcggccgcgagactccaag

SEQ ID NO: 164267 - DNA, 20 bp, human
gcccacggcgaagagaagag

SEQ ID NO: 164268 - DNA, 20 bp, human
ggcctgctgggctggaagaa

SEQ ID NO: 164269 - DNA, 20 bp, human
ggaagaagggcgagcagaac

SEQ ID NO: 164270 - DNA, 20 bp, human
gggcggacggcagcagtgca

SEQ ID NO: 164271 - DNA, 20 bp, human
ggacggcagcagtgcagggt

SEQ ID NO: 164272 - DNA, 20 bp, human
gcaagaaactcaagaagacg

SEQ ID NO: 164273 - DNA, 20 bp, human
gtcacgatcgggggagtgaa

SEQ ID NO: 164274 - DNA, 20 bp, human
ggctgccacttggagtctcg

SEQ ID NO: 164275 - DNA, 20 bp, human
gaagggcgagcagaacgggc

SEQ ID NO: 164276 - DNA, 20 bp, human
ggcagcggcgacgacgacca

SEQ ID NO: 164277 - DNA, 20 bp, human
gcgccgctgcggtaacggag

SEQ ID NO: 164278 - DNA, 20 bp, human
gcccggggcggggaagccac

SEQ ID NO: 164279 - DNA, 20 bp, human
gcagtggcttctcgacaagt

SEQ ID NO: 164280 - DNA, 20 bp, human
ggtcgtcgccgctgcggtaa

SEQ ID NO: 164281 - DNA, 20 bp, human
gaaccgctccgttaccgcag

SEQ ID NO: 164282 - DNA, 20 bp, human
gcaagttggcagcaacaaca

SEQ ID NO: 164283 - DNA, 20 bp, human
gcctcccgaggagagcggga

SEQ ID NO: 164284 - DNA, 20 bp, human
gcccgcgcgcgcatgctcag

SEQ ID NO: 164285 - DNA, 20 bp, human
gcgtcgtcgggagcccgccc

SEQ ID NO: 164286 - DNA, 20 bp, human
gagcaccgcagtcctatcaa

SEQ ID NO: 164287 - DNA, 20 bp, human
gcgtctgggacgccctggag

SEQ ID NO: 164288 - DNA, 20 bp, human
ggcgccgtgcgcgtgtcccg

SEQ ID NO: 164289 - DNA, 20 bp, human
gagaagcgcagcgacggcgt

SEQ ID NO: 164290 - DNA, 20 bp, human
gcgcgggcgaggggaactgg

SEQ ID NO: 164291 - DNA, 20 bp, human
ggctgttaccgcccagactt

SEQ ID NO: 164292 - DNA, 20 bp, human
gacgcctccctccaaagtct

SEQ ID NO: 164293 - DNA, 20 bp, human
gccaggacccggatgaggga

SEQ ID NO: 164294 - DNA, 20 bp, human
gaggacagcgcggggtcagg

SEQ ID NO: 164295 - DNA, 20 bp, human
gcctccctccaaagtctggg

SEQ ID NO: 164296 - DNA, 20 bp, human
ggtcccagcgaggtctggcg

SEQ ID NO: 164297 - DNA, 20 bp, human
gagacctcgctgggaccccg

SEQ ID NO: 164298 - DNA, 20 bp, human
gcgagcgggggagcgatcga

SEQ ID NO: 164299 - DNA, 20 bp, human
gggtctggcgaggcagcgcc

SEQ ID NO: 164300 - DNA, 20 bp, human
ggcgggtgtcaacacatgag

SEQ ID NO: 164301 - DNA, 20 bp, human
gctggcgaggcagcgcccgg

SEQ ID NO: 164302 - DNA, 20 bp, human
ggccgagagaaagagccgcc

SEQ ID NO: 164303 - DNA, 20 bp, human
ggcccggcggctctttctct

SEQ ID NO: 164304 - DNA, 20 bp, human
gccacaaaagtgcctcccgg

SEQ ID NO: 164305 - DNA, 20 bp, human
gttttcccgcaggatccgaa

SEQ ID NO: 164306 - DNA, 20 bp, human
gggcgcccgccggggatcgg

SEQ ID NO: 164307 - DNA, 20 bp, human
ggaatcacgtcgaacaccag

SEQ ID NO: 164308 - DNA, 20 bp, human
gtcccgagtgcgctaggaat

SEQ ID NO: 164309 - DNA, 20 bp, human
gcgcggccacgacagtatct

SEQ ID NO: 164310 - DNA, 20 bp, human
gagtggcccagatactgtcg

SEQ ID NO: 164311 - DNA, 20 bp, human
gcactcgcgcgggggacacg

SEQ ID NO: 164312 - DNA, 20 bp, human
gcaagcgtgctggggaacgt

SEQ ID NO: 164313 - DNA, 20 bp, human
gcaggccccagcgcagtaag

SEQ ID NO: 164314 - DNA, 20 bp, human
gtgatgtgagggttcacccc

SEQ ID NO: 164315 - DNA, 20 bp, human
gctttgccccaaaactccaa

SEQ ID NO: 164316 - DNA, 20 bp, human
gagcagcgcgcggccgagga

SEQ ID NO: 164317 - DNA, 20 bp, human
ggggccccgggacctgtcag

SEQ ID NO: 164318 - DNA, 20 bp, human
gcagccggcgtcagtcagac

SEQ ID NO: 164319 - DNA, 20 bp, human
ggcggatgcaggcgcgagga

SEQ ID NO: 164320 - DNA, 20 bp, human
ggcgccgcgcactcactgcc

SEQ ID NO: 164321 - DNA, 20 bp, human
ggtgtgagcgcattgagtgg

SEQ ID NO: 164322 - DNA, 20 bp, human
ggctgctgcagccgctgtct

SEQ ID NO: 164323 - DNA, 20 bp, human
gtacgggcgatgaggcttcg

SEQ ID NO: 164324 - DNA, 20 bp, human
ggggccggaggggactgctc

SEQ ID NO: 164325 - DNA, 20 bp, human
gaggctccaccaaaaaaccc

SEQ ID NO: 164326 - DNA, 20 bp, human
ggccgaacgaggaccccgag

SEQ ID NO: 164327 - DNA, 20 bp, human
ggaacgaggaccccgagcgg

SEQ ID NO: 164328 - DNA, 20 bp, human
gggccagcagaggccgaacg

SEQ ID NO: 164329 - DNA, 20 bp, human
gggggcgtcgaggatctccg

SEQ ID NO: 164330 - DNA, 20 bp, human
gaggtggctgcggcgaatgt

SEQ ID NO: 164331 - DNA, 20 bp, human
ggttcctgccacggccgagg

SEQ ID NO: 164332 - DNA, 20 bp, human
gcaaccccgcgcgccacccg

SEQ ID NO: 164333 - DNA, 20 bp, human
gcccgagcggaggaagccgc

SEQ ID NO: 164334 - DNA, 20 bp, human
gcgtggcaggaaccgaaacc

SEQ ID NO: 164335 - DNA, 20 bp, human
ggtccaccccgcgttcgcag

SEQ ID NO: 164336 - DNA, 20 bp, human
gtcagcccaggaagcggcag

SEQ ID NO: 164337 - DNA, 20 bp, human
gccctcaagtccgccagagg

SEQ ID NO: 164338 - DNA, 20 bp, human
gcgaccctcaagtccgccag

SEQ ID NO: 164339 - DNA, 20 bp, human
ggctgccgctgccgcttcct

SEQ ID NO: 164340 - DNA, 20 bp, human
gccgcgggcggactcagccc

SEQ ID NO: 164341 - DNA, 20 bp, human
ggcagcggcgggaaggtcac

SEQ ID NO: 164342 - DNA, 20 bp, human
gtcaagtccgccagaggcgg

SEQ ID NO: 164343 - DNA, 20 bp, human
gggcagctggaacgggagga

SEQ ID NO: 164344 - DNA, 20 bp, human
gcgggcagagtgaacgcacc

SEQ ID NO: 164345 - DNA, 20 bp, human
gctgagtccgcccgcggtcc

SEQ ID NO: 164346 - DNA, 20 bp, human
ggcagctgccagggaaaccg

SEQ ID NO: 164347 - DNA, 20 bp, human
gccggacgcagatgaccctc

SEQ ID NO: 164348 - DNA, 20 bp, human
gggacgcaaggccagcagac

SEQ ID NO: 164349 - DNA, 20 bp, human
gaagagctgccggaagtagg

SEQ ID NO: 164350 - DNA, 20 bp, human
gccggcaccctggccatgac

SEQ ID NO: 164351 - DNA, 20 bp, human
gaggaagagctgccggaagt

SEQ ID NO: 164352 - DNA, 20 bp, human
gctggccatgacaggcaagt

SEQ ID NO: 164353 - DNA, 20 bp, human
gacgcagatgaccctctggc

SEQ ID NO: 164354 - DNA, 20 bp, human
gccgctcaggaggtgcccct

SEQ ID NO: 164355 - DNA, 20 bp, human
gatggccagggtgccggcgg

SEQ ID NO: 164356 - DNA, 20 bp, human
gccattgcctcactagtgaa

SEQ ID NO: 164357 - DNA, 20 bp, human
gcactagtgaggcaatggtc

SEQ ID NO: 164358 - DNA, 20 bp, human
gagctactccctggaggcta

SEQ ID NO: 164359 - DNA, 20 bp, human
gtactccctggaggctaagg

SEQ ID NO: 164360 - DNA, 20 bp, human
gtcactgccattcactagtg

SEQ ID NO: 164361 - DNA, 20 bp, human
gcatcaggtgtagttgtgag

SEQ ID NO: 164362 - DNA, 20 bp, human
gagtgacttggagctcaggg

SEQ ID NO: 164363 - DNA, 20 bp, human
gatcttcttagggactaacc

SEQ ID NO: 164364 - DNA, 20 bp, human
gccacaactgtcacaactcc

SEQ ID NO: 164365 - DNA, 20 bp, human
gaaacgttgctttctgagct

SEQ ID NO: 164366 - DNA, 20 bp, human
gtgggagcgggaacgagtag

SEQ ID NO: 164367 - DNA, 20 bp, human
gccaggcggcgagaaggaaa

SEQ ID NO: 164368 - DNA, 20 bp, human
gaagctccgcgggtacctgt

SEQ ID NO: 164369 - DNA, 20 bp, human
gcccgcccccgtcctccagg

SEQ ID NO: 164370 - DNA, 20 bp, human
gtgtcggcgccgaaaggtca

SEQ ID NO: 164371 - DNA, 20 bp, human
gcccgggccgtccacctctc

SEQ ID NO: 164372 - DNA, 20 bp, human
ggggccgtccacctctcagg

SEQ ID NO: 164373 - DNA, 20 bp, human
gagctttgcggggctagggg

SEQ ID NO: 164374 - DNA, 20 bp, human
gcggcgccgacaggtacccg

SEQ ID NO: 164375 - DNA, 20 bp, human
gtgagcgaaggggttggaag

SEQ ID NO: 164376 - DNA, 20 bp, human
gttgctcgcgaggagtgtgc

SEQ ID NO: 164377 - DNA, 20 bp, human
gtactctgggtgactcagag

SEQ ID NO: 164378 - DNA, 20 bp, human
ggactgcccactcaggatca

SEQ ID NO: 164379 - DNA, 20 bp, human
gcccagagtacagaaacaga

SEQ ID NO: 164380 - DNA, 20 bp, human
gcatccccttaaaagtgagg

SEQ ID NO: 164381 - DNA, 20 bp, human
gatcaaggctgtggcttgtt

SEQ ID NO: 164382 - DNA, 20 bp, human
gctgcagcggggcggccgaa

SEQ ID NO: 164383 - DNA, 20 bp, human
gtactacttcaagggggcaa

SEQ ID NO: 164384 - DNA, 20 bp, human
gaaggttgcaacacacacat

SEQ ID NO: 164385 - DNA, 20 bp, human
gggagaccaaaacaaacagg

SEQ ID NO: 164386 - DNA, 20 bp, human
gattgggagggcgactgtag

SEQ ID NO: 164387 - DNA, 20 bp, human
ggccgccgccgccaaacgag

SEQ ID NO: 164388 - DNA, 20 bp, human
gggaggcgccgggaagtcga

SEQ ID NO: 164389 - DNA, 20 bp, human
ggtcgccctcccaattacag

SEQ ID NO: 164390 - DNA, 20 bp, human
ggcagccgctgtaattggga

SEQ ID NO: 164391 - DNA, 20 bp, human
gttacagcggctgcaacaat

SEQ ID NO: 164392 - DNA, 20 bp, human
ggcgccggcggctcctggta

SEQ ID NO: 164393 - DNA, 20 bp, human
ggagctttgtccggcgaccc

SEQ ID NO: 164394 - DNA, 20 bp, human
gcgcgaggcttcccctcgtt

SEQ ID NO: 164395 - DNA, 20 bp, human
ggccggcgccgtcgacttcc

SEQ ID NO: 164396 - DNA, 20 bp, human
ggccgtgaggtaagcgccgg

SEQ ID NO: 164397 - DNA, 20 bp, human
gggtggaacctagagccccg

SEQ ID NO: 164398 - DNA, 20 bp, human
gtggaaggcgcgctctcggg

SEQ ID NO: 164399 - DNA, 20 bp, human
ggaatcacgtcgacgagggt

SEQ ID NO: 164400 - DNA, 20 bp, human
ggtcgccctcacctccatct

SEQ ID NO: 164401 - DNA, 20 bp, human
gagacgccgagatggaggtg

SEQ ID NO: 164402 - DNA, 20 bp, human
gtccaccggcgcttacctca

SEQ ID NO: 164403 - DNA, 20 bp, human
gccgcagcctcgatcgccag

SEQ ID NO: 164404 - DNA, 20 bp, human
ggcgtccgatcgccacgatc

SEQ ID NO: 164405 - DNA, 20 bp, human
ggcggaagagcagaacgttt

SEQ ID NO: 164406 - DNA, 20 bp, human
gccgctagggggttatactg

SEQ ID NO: 164407 - DNA, 20 bp, human
gcgcgtgcttgggtaagagg

SEQ ID NO: 164408 - DNA, 20 bp, human
ggggaccttccaaaacacca

SEQ ID NO: 164409 - DNA, 20 bp, human
gacactgcggggacacaaag

SEQ ID NO: 164410 - DNA, 20 bp, human
gcagctgagaggaagctgat

SEQ ID NO: 164411 - DNA, 20 bp, human
gagaggtggagtgcatgcta

SEQ ID NO: 164412 - DNA, 20 bp, human
gcctggcaggtcctttctcg

SEQ ID NO: 164413 - DNA, 20 bp, human
gcagggggcacggtagcaca

SEQ ID NO: 164414 - DNA, 20 bp, human
gcacaaaggggccaaagaag

SEQ ID NO: 164415 - DNA, 20 bp, human
gatccgcccggaagttgacg

SEQ ID NO: 164416 - DNA, 20 bp, human
gaggcctggccgctacaata

SEQ ID NO: 164417 - DNA, 20 bp, human
gtgtagcggccaggcctgaa

SEQ ID NO: 164418 - DNA, 20 bp, human
gaggcctctgggcagctata

SEQ ID NO: 164419 - DNA, 20 bp, human
gtggaggtgcaggagatccc

SEQ ID NO: 164420 - DNA, 20 bp, human
gatccaagtggagatcgtag

SEQ ID NO: 164421 - DNA, 20 bp, human
ggagtggacggttaggccac

SEQ ID NO: 164422 - DNA, 20 bp, human
gcgcagcgcttgaatacccg

SEQ ID NO: 164423 - DNA, 20 bp, human
gttaccaggcctgggatctg

SEQ ID NO: 164424 - DNA, 20 bp, human
ggtcttccgagtggacggtt

SEQ ID NO: 164425 - DNA, 20 bp, human
gctggccgctacaataaggc

SEQ ID NO: 164426 - DNA, 20 bp, human
ggcctggtcgtcgtctgcgg

SEQ ID NO: 164427 - DNA, 20 bp, human
ggccgccgcagacgacgacc

SEQ ID NO: 164428 - DNA, 20 bp, human
ggccagcgcctgcgcactga

SEQ ID NO: 164429 - DNA, 20 bp, human
ggcggcctggtcgtcgtctg

SEQ ID NO: 164430 - DNA, 20 bp, human
gcggctgaggcgccagtacc

SEQ ID NO: 164431 - DNA, 20 bp, human
ggcgcgcgctcggggctgtg

SEQ ID NO: 164432 - DNA, 20 bp, human
gcctccagctggaacttcac

SEQ ID NO: 164433 - DNA, 20 bp, human
gtgcggaccgggccgggtac

SEQ ID NO: 164434 - DNA, 20 bp, human
gctgtggggcgtggcctagt

SEQ ID NO: 164435 - DNA, 20 bp, human
gcctcgcggcgccaaaatct

SEQ ID NO: 164436 - DNA, 20 bp, human
gagaacctcggaacatacgg

SEQ ID NO: 164437 - DNA, 20 bp, human
ggagatacccctcactctgg

SEQ ID NO: 164438 - DNA, 20 bp, human
gcagagaacctcggaacata

SEQ ID NO: 164439 - DNA, 20 bp, human
gcaagagatacccctcactc

SEQ ID NO: 164440 - DNA, 20 bp, human
gctagtcgcctccagagtga

SEQ ID NO: 164441 - DNA, 20 bp, human
gggctgcagtgaagacactc

SEQ ID NO: 164442 - DNA, 20 bp, human
gtgcagccttggccttagtc

SEQ ID NO: 164443 - DNA, 20 bp, human
gccctgcccgactaaggcca

SEQ ID NO: 164444 - DNA, 20 bp, human
gtggaggcgactagccactg

SEQ ID NO: 164445 - DNA, 20 bp, human
ggatgctccctgcccgacta

SEQ ID NO: 164446 - DNA, 20 bp, human
gacgccacgagggacaacaa

SEQ ID NO: 164447 - DNA, 20 bp, human
gggtgcgcgcgggaacgacc

SEQ ID NO: 164448 - DNA, 20 bp, human
gcatgggtgcgtaggctcag

SEQ ID NO: 164449 - DNA, 20 bp, human
ggccaggctgtggggacgac

SEQ ID NO: 164450 - DNA, 20 bp, human
gcgaccgggaaacaccgcga

SEQ ID NO: 164451 - DNA, 20 bp, human
ggtccgcgccggaagagggt

SEQ ID NO: 164452 - DNA, 20 bp, human
gggcacacgagactgagcag

SEQ ID NO: 164453 - DNA, 20 bp, human
gacaccgcgagggccggggt

SEQ ID NO: 164454 - DNA, 20 bp, human
ggctgcgacgatggccgcag

SEQ ID NO: 164455 - DNA, 20 bp, human
gggacagcggtaggcgccac

SEQ ID NO: 164456 - DNA, 20 bp, human
ggggcgggacaaagggaccg

SEQ ID NO: 164457 - DNA, 20 bp, human
gacgttgtcgaactgggtca

SEQ ID NO: 164458 - DNA, 20 bp, human
gcccgagccggagaagatgg

SEQ ID NO: 164459 - DNA, 20 bp, human
gcgatggctgaggggaaggt

SEQ ID NO: 164460 - DNA, 20 bp, human
gtggcggtgcggaagaagga

SEQ ID NO: 164461 - DNA, 20 bp, human
ggggcccgagccggagaaga

SEQ ID NO: 164462 - DNA, 20 bp, human
ggagggtaggcaggatcccg

SEQ ID NO: 164463 - DNA, 20 bp, human
gcccaacgtgaagtactacg

SEQ ID NO: 164464 - DNA, 20 bp, human
gcaggagggcgatggctgag

SEQ ID NO: 164465 - DNA, 20 bp, human
gcggtgcggaagaaggacgg

SEQ ID NO: 164466 - DNA, 20 bp, human
ggagcccgaacccctcccaa

SEQ ID NO: 164467 - DNA, 20 bp, human
gctcagggcagcgagactat

SEQ ID NO: 164468 - DNA, 20 bp, human
ggccggccggccggcacggg

SEQ ID NO: 164469 - DNA, 20 bp, human
ggacatgggagtgacagggg

SEQ ID NO: 164470 - DNA, 20 bp, human
gggcagtgcgcagaaagaga

SEQ ID NO: 164471 - DNA, 20 bp, human
ggggagtcggtagagaacct

SEQ ID NO: 164472 - DNA, 20 bp, human
ggcggcctatccggtgagtg

SEQ ID NO: 164473 - DNA, 20 bp, human
ggatagagcggggcgactag

SEQ ID NO: 164474 - DNA, 20 bp, human
gcggcgccggagcctcagga

SEQ ID NO: 164475 - DNA, 20 bp, human
gcggggacatgggagtgaca

SEQ ID NO: 164476 - DNA, 20 bp, human
gcgggtcgcggtggagaagt

SEQ ID NO: 164477 - DNA, 20 bp, human
ggagcccggagtccggatcg

SEQ ID NO: 164478 - DNA, 20 bp, human
ggacgggacggagcgatgtc

SEQ ID NO: 164479 - DNA, 20 bp, human
ggcacggagtggactcgacg

SEQ ID NO: 164480 - DNA, 20 bp, human
ggtgccgcgatccggactcc

SEQ ID NO: 164481 - DNA, 20 bp, human
gcccgagtcgagttacccag

SEQ ID NO: 164482 - DNA, 20 bp, human
gggatcgcggcaccgcggga

SEQ ID NO: 164483 - DNA, 20 bp, human
gtcgcggtggagaagtggga

SEQ ID NO: 164484 - DNA, 20 bp, human
ggagtcgagttacccagagg

SEQ ID NO: 164485 - DNA, 20 bp, human
gaagcaggttctgcagcgga

SEQ ID NO: 164486 - DNA, 20 bp, human
gggacggaaagagtcaggag

SEQ ID NO: 164487 - DNA, 20 bp, human
gccgagccgagcgccgagca

SEQ ID NO: 164488 - DNA, 20 bp, human
gcggccgcccgctccctgct

SEQ ID NO: 164489 - DNA, 20 bp, human
ggtcgctcacctgctccccc

SEQ ID NO: 164490 - DNA, 20 bp, human
gcggaaagagtcaggagtgg

SEQ ID NO: 164491 - DNA, 20 bp, human
gtggggggagatacctggaa

SEQ ID NO: 164492 - DNA, 20 bp, human
gaggagtggggggagatacc

SEQ ID NO: 164493 - DNA, 20 bp, human
gccttcgccaagggccgtgg

SEQ ID NO: 164494 - DNA, 20 bp, human
ggcgccgctgcagcccggag

SEQ ID NO: 164495 - DNA, 20 bp, human
gcgggaggcgccttcgccaa

SEQ ID NO: 164496 - DNA, 20 bp, human
ggagcccagcaggactcaga

SEQ ID NO: 164497 - DNA, 20 bp, human
gcgaggaccccctacttggg

SEQ ID NO: 164498 - DNA, 20 bp, human
gtccatggggtggtgagtgg

SEQ ID NO: 164499 - DNA, 20 bp, human
ggccggccgggtctgacgcg

SEQ ID NO: 164500 - DNA, 20 bp, human
gcagcgaggaccccctactt

SEQ ID NO: 164501 - DNA, 20 bp, human
gggactctaccccccaagta

SEQ ID NO: 164502 - DNA, 20 bp, human
gtttgcatggctcttgtcag

SEQ ID NO: 164503 - DNA, 20 bp, human
ggtctgacgcgaggcgggga

SEQ ID NO: 164504 - DNA, 20 bp, human
gctcccctctgagtcctgct

SEQ ID NO: 164505 - DNA, 20 bp, human
gagggcaagcgagctggctc

SEQ ID NO: 164506 - DNA, 20 bp, human
gtcgctgcctgaaccaatgg

SEQ ID NO: 164507 - DNA, 20 bp, human
gggggcgagcgcgggacaaa

SEQ ID NO: 164508 - DNA, 20 bp, human
gcttggaaacactcacccgc

SEQ ID NO: 164509 - DNA, 20 bp, human
gagcgacctcaggaagccgt

SEQ ID NO: 164510 - DNA, 20 bp, human
gccgggtggggggtgaacca

SEQ ID NO: 164511 - DNA, 20 bp, human
gcgtgggcaaggcaggtccg

SEQ ID NO: 164512 - DNA, 20 bp, human
ggcggaagctccggacgcga

SEQ ID NO: 164513 - DNA, 20 bp, human
gggcctagcagagcgagggt

SEQ ID NO: 164514 - DNA, 20 bp, human
gaagctccggacgcgagggg

SEQ ID NO: 164515 - DNA, 20 bp, human
gcaagtgggacggaccgggt

SEQ ID NO: 164516 - DNA, 20 bp, human
ggccgtacgcccgagaactg

SEQ ID NO: 164517 - DNA, 20 bp, human
ggaactgaggtagcccgcgc

SEQ ID NO: 164518 - DNA, 20 bp, human
ggcgccggcggcagtaggac

SEQ ID NO: 164519 - DNA, 20 bp, human
ggcgggctacctcagttctc

SEQ ID NO: 164520 - DNA, 20 bp, human
gggcaagtgacacctggaag

SEQ ID NO: 164521 - DNA, 20 bp, human
gacctcagttctcgggcgta

SEQ ID NO: 164522 - DNA, 20 bp, human
gcggcgccgcggccgtcatg

SEQ ID NO: 164523 - DNA, 20 bp, human
gaggaaccccatgacggccg

SEQ ID NO: 164524 - DNA, 20 bp, human
gggaagcggcaagtgacacc

SEQ ID NO: 164525 - DNA, 20 bp, human
gccggcctggaccccttatc

SEQ ID NO: 164526 - DNA, 20 bp, human
gtaacgcgggtgaggcgtgg

SEQ ID NO: 164527 - DNA, 20 bp, human
gggaagggtcaggacctccg

SEQ ID NO: 164528 - DNA, 20 bp, human
gtgataacgcgggtgaggcg

SEQ ID NO: 164529 - DNA, 20 bp, human
ggaggcggggccgagtggaa

SEQ ID NO: 164530 - DNA, 20 bp, human
gcagggtgtcggaggagggt

SEQ ID NO: 164531 - DNA, 20 bp, human
gcgcgggcgcttgataacgc

SEQ ID NO: 164532 - DNA, 20 bp, human
gcaggacctccgaggtgggg

SEQ ID NO: 164533 - DNA, 20 bp, human
ggtcctcgccgtccacctca

SEQ ID NO: 164534 - DNA, 20 bp, human
gacaagggtcgggacccctg

SEQ ID NO: 164535 - DNA, 20 bp, human
ggggtcaggacctccgaggt

SEQ ID NO: 164536 - DNA, 20 bp, human
gaagtctggcccggcccaac

SEQ ID NO: 164537 - DNA, 20 bp, human
ggtgcgtgagcacggccggt

SEQ ID NO: 164538 - DNA, 20 bp, human
ggcgggtgttgagagcggtg

SEQ ID NO: 164539 - DNA, 20 bp, human
gtgcttgactccgggaggag

SEQ ID NO: 164540 - DNA, 20 bp, human
ggtcagggaggactccagta

SEQ ID NO: 164541 - DNA, 20 bp, human
gaagctcctccgggtcacaa

SEQ ID NO: 164542 - DNA, 20 bp, human
gaattgtgcttgactccggg

SEQ ID NO: 164543 - DNA, 20 bp, human
gtgctcgcgccgaaattcaa

SEQ ID NO: 164544 - DNA, 20 bp, human
gaccttggagtagggcgaag

SEQ ID NO: 164545 - DNA, 20 bp, human
gtctgttcgaccttggagta

SEQ ID NO: 164546 - DNA, 20 bp, human
gcagcaaccgcacggccgca

SEQ ID NO: 164547 - DNA, 20 bp, human
ggtccagcctgtggagacag

SEQ ID NO: 164548 - DNA, 20 bp, human
gccgtgcggttgctgctccg

SEQ ID NO: 164549 - DNA, 20 bp, human
gaccgcacggccgcagggtc

SEQ ID NO: 164550 - DNA, 20 bp, human
gatctccgagaggtgtggaa

SEQ ID NO: 164551 - DNA, 20 bp, human
gtttgggggaggggtcgcgt

SEQ ID NO: 164552 - DNA, 20 bp, human
gacctgaccctgcggccgtg

SEQ ID NO: 164553 - DNA, 20 bp, human
gtccctgctggcgcttgtct

SEQ ID NO: 164554 - DNA, 20 bp, human
gggagcgagcggcgctttgg

SEQ ID NO: 164555 - DNA, 20 bp, human
gcccttaccggcccatgacg

SEQ ID NO: 164556 - DNA, 20 bp, human
gggacccggagccgaaacac

SEQ ID NO: 164557 - DNA, 20 bp, human
gccggagccgaaacaccggt

SEQ ID NO: 164558 - DNA, 20 bp, human
gccgttggcagaaggaagag

SEQ ID NO: 164559 - DNA, 20 bp, human
gggacagtccactcagacca

SEQ ID NO: 164560 - DNA, 20 bp, human
gccggtaggagcggggaggt

SEQ ID NO: 164561 - DNA, 20 bp, human
ggacccggtgactagtccgt

SEQ ID NO: 164562 - DNA, 20 bp, human
ggccgaaacaccggtaggag

SEQ ID NO: 164563 - DNA, 20 bp, human
gaccagcgaaggctgagacc

SEQ ID NO: 164564 - DNA, 20 bp, human
gcattttcgagtgaaggacc

SEQ ID NO: 164565 - DNA, 20 bp, human
gctgccaacggactagtcac

SEQ ID NO: 164566 - DNA, 20 bp, human
ggtgctgctttagtgtgaca

SEQ ID NO: 164567 - DNA, 20 bp, human
gatggtccaagtcaattcca

SEQ ID NO: 164568 - DNA, 20 bp, human
gcttctgtctatcacataag

SEQ ID NO: 164569 - DNA, 20 bp, human
gtatttacgtgctgctagag

SEQ ID NO: 164570 - DNA, 20 bp, human
gaatttctatgtatccagaa

SEQ ID NO: 164571 - DNA, 20 bp, human
gatacatagaaattactgtt

SEQ ID NO: 164572 - DNA, 20 bp, human
gacagaagtattatctctgc

SEQ ID NO: 164573 - DNA, 20 bp, human
gtttaaggcctcaaaaatgt

SEQ ID NO: 164574 - DNA, 20 bp, human
gcgaagccatggaattgact

SEQ ID NO: 164575 - DNA, 20 bp, human
gaaaagacatttaaggatgt

SEQ ID NO: 164576 - DNA, 20 bp, human
ggcccggacgactgcaacag

SEQ ID NO: 164577 - DNA, 20 bp, human
gcagcacacctccacacccg

SEQ ID NO: 164578 - DNA, 20 bp, human
gaaaatcctcaagggaaccc

SEQ ID NO: 164579 - DNA, 20 bp, human
ggacttccgttcccaccgtc

SEQ ID NO: 164580 - DNA, 20 bp, human
ggcctgggctgccggacggt

SEQ ID NO: 164581 - DNA, 20 bp, human
gtacgtaggaaaatcctcaa

SEQ ID NO: 164582 - DNA, 20 bp, human
gagcgcgcggtaacagttcg

SEQ ID NO: 164583 - DNA, 20 bp, human
gggctgccggacggtgggaa

SEQ ID NO: 164584 - DNA, 20 bp, human
gtgctggccagcaggccccg

SEQ ID NO: 164585 - DNA, 20 bp, human
gaagtcgctgtgggacgctg

SEQ ID NO: 164586 - DNA, 20 bp, human
ggcgtgccggccgcaggaga

SEQ ID NO: 164587 - DNA, 20 bp, human
ggcaggcgcggttagtaccg

SEQ ID NO: 164588 - DNA, 20 bp, human
gtgaccgccgctggccccct

SEQ ID NO: 164589 - DNA, 20 bp, human
gcacagcccgggagagtctg

SEQ ID NO: 164590 - DNA, 20 bp, human
gcaggagaaggtagattccc

SEQ ID NO: 164591 - DNA, 20 bp, human
gggtagattcccgggagccc

SEQ ID NO: 164592 - DNA, 20 bp, human
gtcctgagccgcgggaaacc

SEQ ID NO: 164593 - DNA, 20 bp, human
gcctgcgggcgtctcgacct

SEQ ID NO: 164594 - DNA, 20 bp, human
gtgaccctgcctctcccggg

SEQ ID NO: 164595 - DNA, 20 bp, human
ggcgcggttagtaccgcggt

SEQ ID NO: 164596 - DNA, 20 bp, human
gcgcgtttgaatcggttccc

SEQ ID NO: 164597 - DNA, 20 bp, human
ggcaggcgcgaggatcaccc

SEQ ID NO: 164598 - DNA, 20 bp, human
gcgcaccgtgaggctcgcgt

SEQ ID NO: 164599 - DNA, 20 bp, human
gtgcgccacagtcccggcgg

SEQ ID NO: 164600 - DNA, 20 bp, human
gtcctcctgcgccacagtcc

SEQ ID NO: 164601 - DNA, 20 bp, human
gtgcagctcctcgtcagcgg

SEQ ID NO: 164602 - DNA, 20 bp, human
ggcgtccggccaccaggtca

SEQ ID NO: 164603 - DNA, 20 bp, human
ggccgcccacgcgagcctca

SEQ ID NO: 164604 - DNA, 20 bp, human
gggtcgcgggtcgcaccgtg

SEQ ID NO: 164605 - DNA, 20 bp, human
gaccgtgaggctcgcgtggg

SEQ ID NO: 164606 - DNA, 20 bp, human
gcggtcttcctctcagcaac

SEQ ID NO: 164607 - DNA, 20 bp, human
gggaagaccgcagaaaattc

SEQ ID NO: 164608 - DNA, 20 bp, human
gactgctgcctgttgctgag

SEQ ID NO: 164609 - DNA, 20 bp, human
gatagggagggagcaagcat

SEQ ID NO: 164610 - DNA, 20 bp, human
ggttgctgagggctataggg

SEQ ID NO: 164611 - DNA, 20 bp, human
gaaggttgctgagggctata

SEQ ID NO: 164612 - DNA, 20 bp, human
gaccctgatatccttgaagg

SEQ ID NO: 164613 - DNA, 20 bp, human
ggcctccttcaaggatatca

SEQ ID NO: 164614 - DNA, 20 bp, human
gagcatgggtctgctattct

SEQ ID NO: 164615 - DNA, 20 bp, human
gcttgaaggaggcaatgaaa

SEQ ID NO: 164616 - DNA, 20 bp, human
gccttctgctctgtctacag

SEQ ID NO: 164617 - DNA, 20 bp, human
gtaggtagttacctatgcac

SEQ ID NO: 164618 - DNA, 20 bp, human
gttatggttcaagacatgta

SEQ ID NO: 164619 - DNA, 20 bp, human
gcattattgctagatcatgt

SEQ ID NO: 164620 - DNA, 20 bp, human
gagataacttagggaaagtc

SEQ ID NO: 164621 - DNA, 20 bp, human
gcagggtatgttggagctag

SEQ ID NO: 164622 - DNA, 20 bp, human
gcaagacttacagttcaagg

SEQ ID NO: 164623 - DNA, 20 bp, human
gtgcttgaccccagcaaagg

SEQ ID NO: 164624 - DNA, 20 bp, human
ggaccaggacctgagtaaac

SEQ ID NO: 164625 - DNA, 20 bp, human
ggaatttaagcagataactt

SEQ ID NO: 164626 - DNA, 20 bp, human
gtgaatgtggaatctaatac

SEQ ID NO: 164627 - DNA, 20 bp, human
gatcacaaggaacatgtcat

SEQ ID NO: 164628 - DNA, 20 bp, human
gcacagcaaggtaagcaacg

SEQ ID NO: 164629 - DNA, 20 bp, human
ggtggtcctagcagttgttt

SEQ ID NO: 164630 - DNA, 20 bp, human
gtctctgctgtcttcagaga

SEQ ID NO: 164631 - DNA, 20 bp, human
ggttaggattcaagactgac

SEQ ID NO: 164632 - DNA, 20 bp, human
gaaacttcacacattcacac

SEQ ID NO: 164633 - DNA, 20 bp, human
gatactcctaaacaactgct

SEQ ID NO: 164634 - DNA, 20 bp, human
gtctgtttctcagtagtagg

SEQ ID NO: 164635 - DNA, 20 bp, human
gtgaatgtgtgaagtttaca

SEQ ID NO: 164636 - DNA, 20 bp, human
ggcggcgcccgcgggcaggt

SEQ ID NO: 164637 - DNA, 20 bp, human
gggccactgccacgtattcc

SEQ ID NO: 164638 - DNA, 20 bp, human
gcacgtattcccggcagtgg

SEQ ID NO: 164639 - DNA, 20 bp, human
ggggtgcggggcggactcag

SEQ ID NO: 164640 - DNA, 20 bp, human
ggggccccgtatgggaaggt

SEQ ID NO: 164641 - DNA, 20 bp, human
gggccgggagggccccgtat

SEQ ID NO: 164642 - DNA, 20 bp, human
ggtgcggcgccgggacagta

SEQ ID NO: 164643 - DNA, 20 bp, human
gaggcggggagcgcaagcgg

SEQ ID NO: 164644 - DNA, 20 bp, human
gtgccacgtattcccggcag

SEQ ID NO: 164645 - DNA, 20 bp, human
ggggagggccccgtatggga

SEQ ID NO: 164646 - DNA, 20 bp, human
gcatctggttcagaaggctt

SEQ ID NO: 164647 - DNA, 20 bp, human
ggcagggaagggaacccatc

SEQ ID NO: 164648 - DNA, 20 bp, human
gtctcatgactgattccagt

SEQ ID NO: 164649 - DNA, 20 bp, human
gggaacccatctggttcaga

SEQ ID NO: 164650 - DNA, 20 bp, human
gctttggcttctgatagtca

SEQ ID NO: 164651 - DNA, 20 bp, human
ggatccaagaaagcctttca

SEQ ID NO: 164652 - DNA, 20 bp, human
gacactgaatggcattgcat

SEQ ID NO: 164653 - DNA, 20 bp, human
gtctcatccaacacactgaa

SEQ ID NO: 164654 - DNA, 20 bp, human
gtgttggatgagaggattcc

SEQ ID NO: 164655 - DNA, 20 bp, human
ggcttacacatcactcctcg

SEQ ID NO: 164656 - DNA, 20 bp, human
gctcctaggacgccacaacc

SEQ ID NO: 164657 - DNA, 20 bp, human
gcgccggacgaagaagagaa

SEQ ID NO: 164658 - DNA, 20 bp, human
ggcgccgcggtagcaggatc

SEQ ID NO: 164659 - DNA, 20 bp, human
gccgagggcagaaaccgtcg

SEQ ID NO: 164660 - DNA, 20 bp, human
ggctgcccctcactgcccga

SEQ ID NO: 164661 - DNA, 20 bp, human
ggtcgcaaagaaggccgtaa

SEQ ID NO: 164662 - DNA, 20 bp, human
gagaaaccgtcgcggctcct

SEQ ID NO: 164663 - DNA, 20 bp, human
gggcgtcctaggagccgcga

SEQ ID NO: 164664 - DNA, 20 bp, human
gaacccggatcctgctaccg

SEQ ID NO: 164665 - DNA, 20 bp, human
ggaaggcaggcctccggaga

SEQ ID NO: 164666 - DNA, 20 bp, human
ggctgcctgggtccaaatag

SEQ ID NO: 164667 - DNA, 20 bp, human
ggtgccactgctgacccaac

SEQ ID NO: 164668 - DNA, 20 bp, human
gctggctgggtgtattccaa

SEQ ID NO: 164669 - DNA, 20 bp, human
ggagtgtgcaacccacaata

SEQ ID NO: 164670 - DNA, 20 bp, human
gagatccttagtaactggta

SEQ ID NO: 164671 - DNA, 20 bp, human
gtacagtaggcacttgatga

SEQ ID NO: 164672 - DNA, 20 bp, human
gcgtgccataccagttacta

SEQ ID NO: 164673 - DNA, 20 bp, human
gctagttgggaacctctatt

SEQ ID NO: 164674 - DNA, 20 bp, human
gtcccttgcctctaaaacag

SEQ ID NO: 164675 - DNA, 20 bp, human
gtggttcccaacaggccatg

SEQ ID NO: 164676 - DNA, 20 bp, human
gcaggtgtgtagaaaatggt

SEQ ID NO: 164677 - DNA, 20 bp, human
ggtgcgggtgcccgggtgag

SEQ ID NO: 164678 - DNA, 20 bp, human
gcttcccgagggcggcacga

SEQ ID NO: 164679 - DNA, 20 bp, human
ggcggctcgctggctagtat

SEQ ID NO: 164680 - DNA, 20 bp, human
gggagagccccggacctgac

SEQ ID NO: 164681 - DNA, 20 bp, human
ggcggctttcttcccgaggg

SEQ ID NO: 164682 - DNA, 20 bp, human
gcgagggcggcacgagggct

SEQ ID NO: 164683 - DNA, 20 bp, human
gactctcgcgaggcttcggg

SEQ ID NO: 164684 - DNA, 20 bp, human
gcgggcggctttcttcccga

SEQ ID NO: 164685 - DNA, 20 bp, human
gccggagcctggtaccgtcg

SEQ ID NO: 164686 - DNA, 20 bp, human
gaggaagacggaagagacgg

SEQ ID NO: 164687 - DNA, 20 bp, human
gagccggaggcgaggaaagg

SEQ ID NO: 164688 - DNA, 20 bp, human
ggaggggcgaaccaagatgg

SEQ ID NO: 164689 - DNA, 20 bp, human
gcccaagcgacccggactag

SEQ ID NO: 164690 - DNA, 20 bp, human
ggtgaggaagacggaagaga

SEQ ID NO: 164691 - DNA, 20 bp, human
ggggagccggaggcgaggaa

SEQ ID NO: 164692 - DNA, 20 bp, human
gccgcagcgctaggaactcg

SEQ ID NO: 164693 - DNA, 20 bp, human
gcggcgcccggcagccccga

SEQ ID NO: 164694 - DNA, 20 bp, human
ggagaccgggagccttactg

SEQ ID NO: 164695 - DNA, 20 bp, human
gtttgaggggcgaaccaaga

SEQ ID NO: 164696 - DNA, 20 bp, human
gagagagtcgggttacaaga

SEQ ID NO: 164697 - DNA, 20 bp, human
ggagtcgggttacaagatgg

SEQ ID NO: 164698 - DNA, 20 bp, human
gggatctgtagtagttaccg

SEQ ID NO: 164699 - DNA, 20 bp, human
gcttacgtggaggagctcaa

SEQ ID NO: 164700 - DNA, 20 bp, human
gtcctccagcaggctcgcac

SEQ ID NO: 164701 - DNA, 20 bp, human
gcactcttaggagacggtaa

SEQ ID NO: 164702 - DNA, 20 bp, human
ggagacggtaaaggcagtag

SEQ ID NO: 164703 - DNA, 20 bp, human
gggagagcaagcgagccctg

SEQ ID NO: 164704 - DNA, 20 bp, human
gatgggacgaccgaggcacc

SEQ ID NO: 164705 - DNA, 20 bp, human
gtatcggaactgtagaatag

SEQ ID NO: 164706 - DNA, 20 bp, human
gcggcggcaccaagtatccg

SEQ ID NO: 164707 - DNA, 20 bp, human
ggccagtcattccagctccg

SEQ ID NO: 164708 - DNA, 20 bp, human
gtgcttgttcagcccggggc

SEQ ID NO: 164709 - DNA, 20 bp, human
gttccagctccgcggatact

SEQ ID NO: 164710 - DNA, 20 bp, human
ggccctccacccctcggagc

SEQ ID NO: 164711 - DNA, 20 bp, human
ggcagggaggggaggcactt

SEQ ID NO: 164712 - DNA, 20 bp, human
gcgcgcccggctccgagggg

SEQ ID NO: 164713 - DNA, 20 bp, human
gcgactcgcgcttctttggg

SEQ ID NO: 164714 - DNA, 20 bp, human
gcccggctccgaggggtgga

SEQ ID NO: 164715 - DNA, 20 bp, human
gcaccaagtatccgcggagc

SEQ ID NO: 164716 - DNA, 20 bp, human
gagccgcctcacagcgatgg

SEQ ID NO: 164717 - DNA, 20 bp, human
ggcgtgagagcagccaccga

SEQ ID NO: 164718 - DNA, 20 bp, human
gggccgccatcgctgtgagg

SEQ ID NO: 164719 - DNA, 20 bp, human
gggcagccgcctcacagcga

SEQ ID NO: 164720 - DNA, 20 bp, human
gaactcgggatggaactgaa

SEQ ID NO: 164721 - DNA, 20 bp, human
gtcgggatggaactgaaagg

SEQ ID NO: 164722 - DNA, 20 bp, human
gagccaaggcccccccacag

SEQ ID NO: 164723 - DNA, 20 bp, human
gcgccgccaccggccctgct

SEQ ID NO: 164724 - DNA, 20 bp, human
gctgcggctacggccggaga

SEQ ID NO: 164725 - DNA, 20 bp, human
gcagtgttggcggtagtggt

SEQ ID NO: 164726 - DNA, 20 bp, human
gggccccagcgcctactgct

SEQ ID NO: 164727 - DNA, 20 bp, human
gctcctccccgctcggccct

SEQ ID NO: 164728 - DNA, 20 bp, human
ggctgctgctacagccgtag

SEQ ID NO: 164729 - DNA, 20 bp, human
gttcgcggcgagaaagaggg

SEQ ID NO: 164730 - DNA, 20 bp, human
gctaacccgcgagagaggta

SEQ ID NO: 164731 - DNA, 20 bp, human
ggcagcagccgcgaagatgg

SEQ ID NO: 164732 - DNA, 20 bp, human
gaggtcccggatccctccag

SEQ ID NO: 164733 - DNA, 20 bp, human
ggcgcgccgcccgtctgtgg

SEQ ID NO: 164734 - DNA, 20 bp, human
gggaaaccaccacagacggg

SEQ ID NO: 164735 - DNA, 20 bp, human
gaccttcgcggcgagaaaga

SEQ ID NO: 164736 - DNA, 20 bp, human
gtctctcaggctcctcggag

SEQ ID NO: 164737 - DNA, 20 bp, human
gcttcccgcgaagcctccgt

SEQ ID NO: 164738 - DNA, 20 bp, human
gctagcaaacccgagaccaa

SEQ ID NO: 164739 - DNA, 20 bp, human
gaagcctccgtgggtctctc

SEQ ID NO: 164740 - DNA, 20 bp, human
gtggaggagtctgatccccg

SEQ ID NO: 164741 - DNA, 20 bp, human
gcgtcccggtgcgaggaggg

SEQ ID NO: 164742 - DNA, 20 bp, human
gtggagagaaacgtccgggg

SEQ ID NO: 164743 - DNA, 20 bp, human
gcaccgaggtaagtccgggg

SEQ ID NO: 164744 - DNA, 20 bp, human
gtggcgaagccggctcgtcc

SEQ ID NO: 164745 - DNA, 20 bp, human
gacccccctgccgagcgagg

SEQ ID NO: 164746 - DNA, 20 bp, human
ggcttgcgagaccttctaat

SEQ ID NO: 164747 - DNA, 20 bp, human
ggctccctccgccctcagta

SEQ ID NO: 164748 - DNA, 20 bp, human
ggaaggtctcgcaagctcac

SEQ ID NO: 164749 - DNA, 20 bp, human
ggcggaaggtaaccgaactg

SEQ ID NO: 164750 - DNA, 20 bp, human
gtgcagaaggctgtagtcct

SEQ ID NO: 164751 - DNA, 20 bp, human
gggtggagccgaggaccctg

SEQ ID NO: 164752 - DNA, 20 bp, human
gtagagaacgctctgcacta

SEQ ID NO: 164753 - DNA, 20 bp, human
gtgggctctgaaagtcccgg

SEQ ID NO: 164754 - DNA, 20 bp, human
gctgggagcctgcctcagtt

SEQ ID NO: 164755 - DNA, 20 bp, human
gccggagggtcccctactga

SEQ ID NO: 164756 - DNA, 20 bp, human
ggctgggccgaaggaagaag

SEQ ID NO: 164757 - DNA, 20 bp, human
gagggaactgatctcagctc

SEQ ID NO: 164758 - DNA, 20 bp, human
gactgggttggcaggaatgg

SEQ ID NO: 164759 - DNA, 20 bp, human
gcgcaggacgagtcgcctga

SEQ ID NO: 164760 - DNA, 20 bp, human
gagaggaggaggatgtaacg

SEQ ID NO: 164761 - DNA, 20 bp, human
gccccgccttggccattgaa

SEQ ID NO: 164762 - DNA, 20 bp, human
ggaaaggtcgctgggacgtc

SEQ ID NO: 164763 - DNA, 20 bp, human
gggcctccccagtacttgac

SEQ ID NO: 164764 - DNA, 20 bp, human
ggggggtgcggcactgagta

SEQ ID NO: 164765 - DNA, 20 bp, human
gcgtcaattcgatactgggt

SEQ ID NO: 164766 - DNA, 20 bp, human
gagcggcccgcacctcccag

SEQ ID NO: 164767 - DNA, 20 bp, human
gggtgaagaggtctatggag

SEQ ID NO: 164768 - DNA, 20 bp, human
gtcccagcggggcaggtcgt

SEQ ID NO: 164769 - DNA, 20 bp, human
ggcgtctctgggctccgcag

SEQ ID NO: 164770 - DNA, 20 bp, human
ggccggtgggggtcagtcca

SEQ ID NO: 164771 - DNA, 20 bp, human
gtgtctggtccggaaggtgg

SEQ ID NO: 164772 - DNA, 20 bp, human
gtcttgctaagggccgggaa

SEQ ID NO: 164773 - DNA, 20 bp, human
gggcctcgctggctgagaac

SEQ ID NO: 164774 - DNA, 20 bp, human
gctcgagcctaaaaaaataa

SEQ ID NO: 164775 - DNA, 20 bp, human
ggctggctgagaactggcgg

SEQ ID NO: 164776 - DNA, 20 bp, human
ggatggacgcgggaaagtac

SEQ ID NO: 164777 - DNA, 20 bp, human
gtacgggcgggaggcctcct

SEQ ID NO: 164778 - DNA, 20 bp, human
gctagggtgggtgagcaggt

SEQ ID NO: 164779 - DNA, 20 bp, human
ggacgcgggaaagtacgggc

SEQ ID NO: 164780 - DNA, 20 bp, human
gtccgagctgcgctgcaagg

SEQ ID NO: 164781 - DNA, 20 bp, human
gccgctgactcaccgaccgt

SEQ ID NO: 164782 - DNA, 20 bp, human
gctgcatgcaggagcggagt

SEQ ID NO: 164783 - DNA, 20 bp, human
gcatccctctgtcccacggt

SEQ ID NO: 164784 - DNA, 20 bp, human
ggccagagccctgccgggaa

SEQ ID NO: 164785 - DNA, 20 bp, human
gtgggacagagggatggacg

SEQ ID NO: 164786 - DNA, 20 bp, human
gcgacggccaggtccagcag

SEQ ID NO: 164787 - DNA, 20 bp, human
gggcaggacggtagaagtcg

SEQ ID NO: 164788 - DNA, 20 bp, human
ggacaagcaatcccctggaa

SEQ ID NO: 164789 - DNA, 20 bp, human
gctccggggaccaacaccgt

SEQ ID NO: 164790 - DNA, 20 bp, human
gtcctgccggggaaaactac

SEQ ID NO: 164791 - DNA, 20 bp, human
gttactgctcccggcagcgg

SEQ ID NO: 164792 - DNA, 20 bp, human
gttggtccccggagagtcta

SEQ ID NO: 164793 - DNA, 20 bp, human
gagtagtgcactctcgtcgg

SEQ ID NO: 164794 - DNA, 20 bp, human
gagggagacaagcaatcccc

SEQ ID NO: 164795 - DNA, 20 bp, human
gagctctgggggaagtcggg

SEQ ID NO: 164796 - DNA, 20 bp, human
gtacgggaggagtgatcgct

SEQ ID NO: 164797 - DNA, 20 bp, human
ggcggcgacttccgtgctcc

SEQ ID NO: 164798 - DNA, 20 bp, human
gcggaagtcgccgcacccag

SEQ ID NO: 164799 - DNA, 20 bp, human
gctagagcgcagtccaggaa

SEQ ID NO: 164800 - DNA, 20 bp, human
ggagagagccggcggccagt

SEQ ID NO: 164801 - DNA, 20 bp, human
gtcacagggcaaggtcccgc

SEQ ID NO: 164802 - DNA, 20 bp, human
gtgatcgctagggtccaccc

SEQ ID NO: 164803 - DNA, 20 bp, human
gtgcgctctagtgactgtca

SEQ ID NO: 164804 - DNA, 20 bp, human
gggaccgggagactcacaga

SEQ ID NO: 164805 - DNA, 20 bp, human
gagaggggagctggcagatc

SEQ ID NO: 164806 - DNA, 20 bp, human
gcccaggccccctaccgctg

SEQ ID NO: 164807 - DNA, 20 bp, human
gcgcccggccgcggctgtag

SEQ ID NO: 164808 - DNA, 20 bp, human
ggccgggcgacgctgacatc

SEQ ID NO: 164809 - DNA, 20 bp, human
gggagaagccgctacagccg

SEQ ID NO: 164810 - DNA, 20 bp, human
gggcgcgtcctgcgcttcag

SEQ ID NO: 164811 - DNA, 20 bp, human
gatgagctgccccagcggta

SEQ ID NO: 164812 - DNA, 20 bp, human
gacgctgtgccacatcttgg

SEQ ID NO: 164813 - DNA, 20 bp, human
gggcgccggggcggcatggg

SEQ ID NO: 164814 - DNA, 20 bp, human
gtgtcagcgtcgcccggccg

SEQ ID NO: 164815 - DNA, 20 bp, human
ggcgcctgtagggaggacag

SEQ ID NO: 164816 - DNA, 20 bp, human
gcggcggccagaaacggcag

SEQ ID NO: 164817 - DNA, 20 bp, human
ggcaagggcaaggtagccac

SEQ ID NO: 164818 - DNA, 20 bp, human
gagggcaaggtagccacggg

SEQ ID NO: 164819 - DNA, 20 bp, human
gcggcggctgcggcagaaca

SEQ ID NO: 164820 - DNA, 20 bp, human
gctgcaggatgtcagagtcg

SEQ ID NO: 164821 - DNA, 20 bp, human
ggagcccccaggaaaaactg

SEQ ID NO: 164822 - DNA, 20 bp, human
ggtcactcgaatcaaaacag

SEQ ID NO: 164823 - DNA, 20 bp, human
ggacgggtggaggcgtatca

SEQ ID NO: 164824 - DNA, 20 bp, human
ggcccagacaacaaccgatg

SEQ ID NO: 164825 - DNA, 20 bp, human
gcttgtggctaagagtgacg

SEQ ID NO: 164826 - DNA, 20 bp, human
gatcccgtggggctatgtag

SEQ ID NO: 164827 - DNA, 20 bp, human
gtggtgtccagcagaaacgg

SEQ ID NO: 164828 - DNA, 20 bp, human
gctgcagccccgatagggta

SEQ ID NO: 164829 - DNA, 20 bp, human
gtgggtctgcagccccgata

SEQ ID NO: 164830 - DNA, 20 bp, human
gtgagcaagggagaaacgta

SEQ ID NO: 164831 - DNA, 20 bp, human
gagccccgatagggtaagga

SEQ ID NO: 164832 - DNA, 20 bp, human
gagtgggatccgatcccgtg

SEQ ID NO: 164833 - DNA, 20 bp, human
gccgggcgtgagtaagtcta

SEQ ID NO: 164834 - DNA, 20 bp, human
gcgcccaaaacggatcgacc

SEQ ID NO: 164835 - DNA, 20 bp, human
gacggcggcggcgcaaggtg

SEQ ID NO: 164836 - DNA, 20 bp, human
ggctctgcagagcccagaca

SEQ ID NO: 164837 - DNA, 20 bp, human
ggacagggtccggttgggga

SEQ ID NO: 164838 - DNA, 20 bp, human
ggcccagacagggtccggtt

SEQ ID NO: 164839 - DNA, 20 bp, human
ggtgcgctgaacaccccagg

SEQ ID NO: 164840 - DNA, 20 bp, human
gtgcgcagccgcagtcagtg

SEQ ID NO: 164841 - DNA, 20 bp, human
ggttgcagggtggtccacag

SEQ ID NO: 164842 - DNA, 20 bp, human
gcaggtgcgctgaacacccc

SEQ ID NO: 164843 - DNA, 20 bp, human
ggggagggtgagtccttcga

SEQ ID NO: 164844 - DNA, 20 bp, human
ggcccgcgggggtccctcga

SEQ ID NO: 164845 - DNA, 20 bp, human
gacgtgcgctcgtctcgctg

SEQ ID NO: 164846 - DNA, 20 bp, human
gatcctctcagacaagaggt

SEQ ID NO: 164847 - DNA, 20 bp, human
ggaatcagaaagctttagtc

SEQ ID NO: 164848 - DNA, 20 bp, human
ggtttggtctgtcttaacaa

SEQ ID NO: 164849 - DNA, 20 bp, human
gtagaagcacagctccatct

SEQ ID NO: 164850 - DNA, 20 bp, human
gcattaaggcacagatggta

SEQ ID NO: 164851 - DNA, 20 bp, human
gttctatgtgcaaatgatat

SEQ ID NO: 164852 - DNA, 20 bp, human
gtggaattcgcttttgatct

SEQ ID NO: 164853 - DNA, 20 bp, human
gataataaaatcctaccaag

SEQ ID NO: 164854 - DNA, 20 bp, human
gattcgtttcaccgcttggt

SEQ ID NO: 164855 - DNA, 20 bp, human
gtatggtttactctgaggtc

SEQ ID NO: 164856 - DNA, 20 bp, human
gccagggcggcgaggctcta

SEQ ID NO: 164857 - DNA, 20 bp, human
gggccggcaggaaatgacga

SEQ ID NO: 164858 - DNA, 20 bp, human
gctcacgctgccggctccgg

SEQ ID NO: 164859 - DNA, 20 bp, human
gatcacgcgcagcctgcggg

SEQ ID NO: 164860 - DNA, 20 bp, human
gactccggggtaaagagccc

SEQ ID NO: 164861 - DNA, 20 bp, human
gccggacgcgggggtaaggg

SEQ ID NO: 164862 - DNA, 20 bp, human
gccagcgctgctccgctccg

SEQ ID NO: 164863 - DNA, 20 bp, human
ggcctgccctcggtcccgtg

SEQ ID NO: 164864 - DNA, 20 bp, human
ggagggcgtccaggtccgct

SEQ ID NO: 164865 - DNA, 20 bp, human
ggcgggaaacggttaccgag

SEQ ID NO: 164866 - DNA, 20 bp, human
gaagccgaacaggatgctaa

SEQ ID NO: 164867 - DNA, 20 bp, human
gaggaaggcagagcttaatg

SEQ ID NO: 164868 - DNA, 20 bp, human
gtcaaggccaaccaaaggcc

SEQ ID NO: 164869 - DNA, 20 bp, human
gcccaagaagagcttatggg

SEQ ID NO: 164870 - DNA, 20 bp, human
gacagggtgctggaaacacg

SEQ ID NO: 164871 - DNA, 20 bp, human
gagagtctgtaagtgttcat

SEQ ID NO: 164872 - DNA, 20 bp, human
gtgccagccagctgcctcac

SEQ ID NO: 164873 - DNA, 20 bp, human
ggttggccttgaatgaagag

SEQ ID NO: 164874 - DNA, 20 bp, human
ggggccccactcttcattca

SEQ ID NO: 164875 - DNA, 20 bp, human
gtgagcacgttgctaggctg

SEQ ID NO: 164876 - DNA, 20 bp, human
gtcggaaaccaggttaccga

SEQ ID NO: 164877 - DNA, 20 bp, human
gaggatactgagagtcctag

SEQ ID NO: 164878 - DNA, 20 bp, human
ggggagtcaggtcaccgcaa

SEQ ID NO: 164879 - DNA, 20 bp, human
gccgggcggtcggcgggtca

SEQ ID NO: 164880 - DNA, 20 bp, human
gggcccggccgtcggtaacc

SEQ ID NO: 164881 - DNA, 20 bp, human
gcgtggagctcacagagggg

SEQ ID NO: 164882 - DNA, 20 bp, human
gggtttccgagagtgccggg

SEQ ID NO: 164883 - DNA, 20 bp, human
ggtgcgcaggttccgggaca

SEQ ID NO: 164884 - DNA, 20 bp, human
gggacatggcgtcaggcccc

SEQ ID NO: 164885 - DNA, 20 bp, human
gtccgagagtgccgggcggt

SEQ ID NO: 164886 - DNA, 20 bp, human
ggctgtgctatagggaatcg

SEQ ID NO: 164887 - DNA, 20 bp, human
gtaagaggctctctctgtag

SEQ ID NO: 164888 - DNA, 20 bp, human
gcacatactggtccatgtgg

SEQ ID NO: 164889 - DNA, 20 bp, human
gaggagctgtggacacatac

SEQ ID NO: 164890 - DNA, 20 bp, human
ggagcactcacaggagattg

SEQ ID NO: 164891 - DNA, 20 bp, human
gtgcggcggtgaccagtgag

SEQ ID NO: 164892 - DNA, 20 bp, human
gcaccgccgcagcccccaca

SEQ ID NO: 164893 - DNA, 20 bp, human
gtgagagacagagcactcac

SEQ ID NO: 164894 - DNA, 20 bp, human
gggacacatactggtccatg

SEQ ID NO: 164895 - DNA, 20 bp, human
ggagagacgtatcactgcac

SEQ ID NO: 164896 - DNA, 20 bp, human
gaagggtgctcatcccccta

SEQ ID NO: 164897 - DNA, 20 bp, human
gtcgtgcaggaaagacccaa

SEQ ID NO: 164898 - DNA, 20 bp, human
gcctgcacggaactgtactg

SEQ ID NO: 164899 - DNA, 20 bp, human
gcccaggacttcctgaaccg

SEQ ID NO: 164900 - DNA, 20 bp, human
ggaggctgcatcaggatcct

SEQ ID NO: 164901 - DNA, 20 bp, human
gtcctgcacgagaagcacag

SEQ ID NO: 164902 - DNA, 20 bp, human
gccatgtggactggaaaaac

SEQ ID NO: 164903 - DNA, 20 bp, human
ggccaaggcctcaggtggtg

SEQ ID NO: 164904 - DNA, 20 bp, human
gcaggacaggcgtccaggtg

SEQ ID NO: 164905 - DNA, 20 bp, human
gtccggctccacaccacctg

SEQ ID NO: 164906 - DNA, 20 bp, human
ggcagactcgccgccatctg

SEQ ID NO: 164907 - DNA, 20 bp, human
gggagagcgcaggagcggcc

SEQ ID NO: 164908 - DNA, 20 bp, human
gaaggggccgcactagaggt

SEQ ID NO: 164909 - DNA, 20 bp, human
ggagaagccagtctccgagt

SEQ ID NO: 164910 - DNA, 20 bp, human
gcagagccagcagcgcgtcc

SEQ ID NO: 164911 - DNA, 20 bp, human
gcagctcctggaacgtgccc

SEQ ID NO: 164912 - DNA, 20 bp, human
gcaaagcaggatctgagtcc

SEQ ID NO: 164913 - DNA, 20 bp, human
gccagctatagagtagacat

SEQ ID NO: 164914 - DNA, 20 bp, human
gggagagaccagggcgtctc

SEQ ID NO: 164915 - DNA, 20 bp, human
gagagtggcaaagcctccga

SEQ ID NO: 164916 - DNA, 20 bp, human
gtcgtgcgcctaccagacag

SEQ ID NO: 164917 - DNA, 20 bp, human
gtcgctagtctcccaggtcg

SEQ ID NO: 164918 - DNA, 20 bp, human
gaccagacagtggcggagga

SEQ ID NO: 164919 - DNA, 20 bp, human
gcgcggtacacggcgagaac

SEQ ID NO: 164920 - DNA, 20 bp, human
gcggcgctcgctagtctccc

SEQ ID NO: 164921 - DNA, 20 bp, human
ggtcgtggagagggatatga

SEQ ID NO: 164922 - DNA, 20 bp, human
gaggaaggcacgaggcggta

SEQ ID NO: 164923 - DNA, 20 bp, human
ggcctaccagacagtggcgg

SEQ ID NO: 164924 - DNA, 20 bp, human
gtgcccgggaagcagcgatt

SEQ ID NO: 164925 - DNA, 20 bp, human
gctttcaggaaggcacgagg

SEQ ID NO: 164926 - DNA, 20 bp, human
ggtacgaggacagcacgtgg

SEQ ID NO: 164927 - DNA, 20 bp, human
gtcctggccaggaggaccct

SEQ ID NO: 164928 - DNA, 20 bp, human
gaggcaccgggacatgaagt

SEQ ID NO: 164929 - DNA, 20 bp, human
gcgcccacgaaggaagtacg

SEQ ID NO: 164930 - DNA, 20 bp, human
gctccacctgagcctgtgga

SEQ ID NO: 164931 - DNA, 20 bp, human
gtgcagcgctctcaggtctg

SEQ ID NO: 164932 - DNA, 20 bp, human
gctgggagctcaggtgttgg

SEQ ID NO: 164933 - DNA, 20 bp, human
ggaagtacgaggacagcacg

SEQ ID NO: 164934 - DNA, 20 bp, human
gtccctgagcagcgctctca

SEQ ID NO: 164935 - DNA, 20 bp, human
ggtcctcgtacttccttcgt

SEQ ID NO: 164936 - DNA, 20 bp, human
gctcctgccgggctctgctg

SEQ ID NO: 164937 - DNA, 20 bp, human
gccgcgctggcttcctgttg

SEQ ID NO: 164938 - DNA, 20 bp, human
gatctcctgcacgaagtcgg

SEQ ID NO: 164939 - DNA, 20 bp, human
gtcccaaacgcggggatgac

SEQ ID NO: 164940 - DNA, 20 bp, human
gactgggcccagcagtaccc

SEQ ID NO: 164941 - DNA, 20 bp, human
ggcccggcaggagccccaac

SEQ ID NO: 164942 - DNA, 20 bp, human
gcacccaagcagcatatcag

SEQ ID NO: 164943 - DNA, 20 bp, human
gtaccccgggatcccaaacg

SEQ ID NO: 164944 - DNA, 20 bp, human
gccccgcgtttgggatcccg

SEQ ID NO: 164945 - DNA, 20 bp, human
gacgagtgtggggccagccg

SEQ ID NO: 164946 - DNA, 20 bp, human
gcatcaggccgcctcacctg

SEQ ID NO: 164947 - DNA, 20 bp, human
gccacacgtcacccagacag

SEQ ID NO: 164948 - DNA, 20 bp, human
gcaagcccatagccaggtga

SEQ ID NO: 164949 - DNA, 20 bp, human
ggctgttctgggtcctacaa

SEQ ID NO: 164950 - DNA, 20 bp, human
ggtcctacaagggcaattca

SEQ ID NO: 164951 - DNA, 20 bp, human
gagggcagcccaggtggaga

SEQ ID NO: 164952 - DNA, 20 bp, human
gggccgcctcacctgtggct

SEQ ID NO: 164953 - DNA, 20 bp, human
gagagaagtcagacttgggg

SEQ ID NO: 164954 - DNA, 20 bp, human
gctacaagggcaattcaggg

SEQ ID NO: 164955 - DNA, 20 bp, human
gcggggaagagactggaccg

SEQ ID NO: 164956 - DNA, 20 bp, human
ggggtaattagggggaccag

SEQ ID NO: 164957 - DNA, 20 bp, human
gcagagggacaaccaaggaa

SEQ ID NO: 164958 - DNA, 20 bp, human
gctgctgttcgggtaattag

SEQ ID NO: 164959 - DNA, 20 bp, human
gaccaaggaacggagagtat

SEQ ID NO: 164960 - DNA, 20 bp, human
gtggaggcgtgcccagaggg

SEQ ID NO: 164961 - DNA, 20 bp, human
gccgaagcgtccgtcagaac

SEQ ID NO: 164962 - DNA, 20 bp, human
gcgtccgtcagaaccggaag

SEQ ID NO: 164963 - DNA, 20 bp, human
gcttcggccgtaacgatgat

SEQ ID NO: 164964 - DNA, 20 bp, human
gcgtgcccagagggcggata

SEQ ID NO: 164965 - DNA, 20 bp, human
ggggcggaaggtccgcggtg

SEQ ID NO: 164966 - DNA, 20 bp, human
gccccgcgaaaggtaagcgg

SEQ ID NO: 164967 - DNA, 20 bp, human
gcgtctcgggcgaggagagg

SEQ ID NO: 164968 - DNA, 20 bp, human
ggtacagggagtccacggag

SEQ ID NO: 164969 - DNA, 20 bp, human
gcggcttcggtggtgttgag

SEQ ID NO: 164970 - DNA, 20 bp, human
ggaggaggtgaccccgcgaa

SEQ ID NO: 164971 - DNA, 20 bp, human
gtgcgggtacagggagtcca

SEQ ID NO: 164972 - DNA, 20 bp, human
gtgaccccgcgaaaggtaag

SEQ ID NO: 164973 - DNA, 20 bp, human
gaggtaagcggcggcttcgg

SEQ ID NO: 164974 - DNA, 20 bp, human
ggactcataggggaacatgg

SEQ ID NO: 164975 - DNA, 20 bp, human
ggagcccgcaaggtgagtac

SEQ ID NO: 164976 - DNA, 20 bp, human
gttaggccttagtctttaga

SEQ ID NO: 164977 - DNA, 20 bp, human
ggactaaggcctaattccac

SEQ ID NO: 164978 - DNA, 20 bp, human
gtaggaggcccaaattataa

SEQ ID NO: 164979 - DNA, 20 bp, human
gtccagaagtaagcagatac

SEQ ID NO: 164980 - DNA, 20 bp, human
gcttcaaggatggctaagaa

SEQ ID NO: 164981 - DNA, 20 bp, human
gcaaagaaaccagtggaatt

SEQ ID NO: 164982 - DNA, 20 bp, human
gagaagtcttcagaagaagc

SEQ ID NO: 164983 - DNA, 20 bp, human
gtaaagagacccacatccag

SEQ ID NO: 164984 - DNA, 20 bp, human
ggaaaatggacttaggacca

SEQ ID NO: 164985 - DNA, 20 bp, human
ggctgtcttgataaaagaga

SEQ ID NO: 164986 - DNA, 20 bp, human
gtgaggtcgaccccagggag

SEQ ID NO: 164987 - DNA, 20 bp, human
gcgcgtggcgaaaagatgga

SEQ ID NO: 164988 - DNA, 20 bp, human
gctcgggaggcagccagccg

SEQ ID NO: 164989 - DNA, 20 bp, human
ggcggcctaggtgccgcgtg

SEQ ID NO: 164990 - DNA, 20 bp, human
gggagcgcggccggctcggg

SEQ ID NO: 164991 - DNA, 20 bp, human
gcgcgttgaggtcgacccca

SEQ ID NO: 164992 - DNA, 20 bp, human
ggccccaggctgtcccggag

SEQ ID NO: 164993 - DNA, 20 bp, human
gcaggtgcctcgcgtccagg

SEQ ID NO: 164994 - DNA, 20 bp, human
gcttgccccacgcggcacct

SEQ ID NO: 164995 - DNA, 20 bp, human
gcggccccggtggatgctaa

SEQ ID NO: 164996 - DNA, 20 bp, human
gcagaccccacggggaccat

SEQ ID NO: 164997 - DNA, 20 bp, human
ggaccatgggagtcacactc

SEQ ID NO: 164998 - DNA, 20 bp, human
gggagcagcagcaaagtcac

SEQ ID NO: 164999 - DNA, 20 bp, human
gtgactcccatggtccccgt

SEQ ID NO: 165000 - DNA, 20 bp, human
ggtaagtgtgaggccacaca

SEQ ID NO: 165001 - DNA, 20 bp, human
ggtcctgagtgtgactccca

SEQ ID NO: 165002 - DNA, 20 bp, human
gcaagatccacacagtggaa

SEQ ID NO: 165003 - DNA, 20 bp, human
ggatgtgaaggtctgctgta

SEQ ID NO: 165004 - DNA, 20 bp, human
gcagcagcaaagtcacgggg

SEQ ID NO: 165005 - DNA, 20 bp, human
gtgtgaggtgctacacgtga

SEQ ID NO: 165006 - DNA, 20 bp, human
gggaccacaactccagtgag

SEQ ID NO: 165007 - DNA, 20 bp, human
gttgctatggcgatgagcag

SEQ ID NO: 165008 - DNA, 20 bp, human
gttaggccagggtgaagcag

SEQ ID NO: 165009 - DNA, 20 bp, human
gtgaagcaggggaaccactt

SEQ ID NO: 165010 - DNA, 20 bp, human
gctatggcgatgagcagcgg

SEQ ID NO: 165011 - DNA, 20 bp, human
gtcccccacaccagccagag

SEQ ID NO: 165012 - DNA, 20 bp, human
gaggctgcggaaggagagtt

SEQ ID NO: 165013 - DNA, 20 bp, human
gacccgcgggtgcgcagcgt

SEQ ID NO: 165014 - DNA, 20 bp, human
gtgatgctgtcccgaggctg

SEQ ID NO: 165015 - DNA, 20 bp, human
gtcctctctggctggtgtgg

SEQ ID NO: 165016 - DNA, 20 bp, human
gctatggcgatgagcagcgg

SEQ ID NO: 165017 - DNA, 20 bp, human
gttaggccagggtgaagcag

SEQ ID NO: 165018 - DNA, 20 bp, human
gtgaagcaggggaaccactt

SEQ ID NO: 165019 - DNA, 20 bp, human
gggaccacaactccagtgag

SEQ ID NO: 165020 - DNA, 20 bp, human
gttgctatggcgatgagcag

SEQ ID NO: 165021 - DNA, 20 bp, human
gacccgcgggtgcgcagcgt

SEQ ID NO: 165022 - DNA, 20 bp, human
gaggctgcggaaggagagtt

SEQ ID NO: 165023 - DNA, 20 bp, human
gtcccccacaccagccagag

SEQ ID NO: 165024 - DNA, 20 bp, human
gaagtcgtcactcttaagaa

SEQ ID NO: 165025 - DNA, 20 bp, human
gcatcgccatagcaaacccg

SEQ ID NO: 165026 - DNA, 20 bp, human
gcgacgacagcaaggcgacc

SEQ ID NO: 165027 - DNA, 20 bp, human
gaactcggtcggcggcgagg

SEQ ID NO: 165028 - DNA, 20 bp, human
gaggaacgccgggcactgga

SEQ ID NO: 165029 - DNA, 20 bp, human
ggccggcgctggcctccgtg

SEQ ID NO: 165030 - DNA, 20 bp, human
gcggcaaacacggcccgcag

SEQ ID NO: 165031 - DNA, 20 bp, human
gaaggcgacccggtctgaaa

SEQ ID NO: 165032 - DNA, 20 bp, human
gccccctgagggagagagta

SEQ ID NO: 165033 - DNA, 20 bp, human
gtgaaaaggaagaactcggt

SEQ ID NO: 165034 - DNA, 20 bp, human
ggccgtggctccgggatcca

SEQ ID NO: 165035 - DNA, 20 bp, human
gtccaacaggcaggctccac

SEQ ID NO: 165036 - DNA, 20 bp, human
gcagcgagctagagcaacaa

SEQ ID NO: 165037 - DNA, 20 bp, human
gccggcggggagagttcggg

SEQ ID NO: 165038 - DNA, 20 bp, human
gtcgccggcggggagagttc

SEQ ID NO: 165039 - DNA, 20 bp, human
ggccacacgcacgacctcgg

SEQ ID NO: 165040 - DNA, 20 bp, human
gccggccacacgcacgacct

SEQ ID NO: 165041 - DNA, 20 bp, human
gaaaggagccgggtcgccgg

SEQ ID NO: 165042 - DNA, 20 bp, human
ggcccgggcccggattctct

SEQ ID NO: 165043 - DNA, 20 bp, human
ggctagagcaacaaaggagc

SEQ ID NO: 165044 - DNA, 20 bp, human
gactctccccgccggcgacc

SEQ ID NO: 165045 - DNA, 20 bp, human
gtgggctctctggaatgcac

SEQ ID NO: 165046 - DNA, 20 bp, human
ggggacctggtagtagacag

SEQ ID NO: 165047 - DNA, 20 bp, human
gccccgagcgaaggaaggaa

SEQ ID NO: 165048 - DNA, 20 bp, human
gcctcatccctgagggaagg

SEQ ID NO: 165049 - DNA, 20 bp, human
ggtcatgaaccgcgcaggag

SEQ ID NO: 165050 - DNA, 20 bp, human
gctcccctccctccgcaggt

SEQ ID NO: 165051 - DNA, 20 bp, human
ggcaggtgggcgcaaagctg

SEQ ID NO: 165052 - DNA, 20 bp, human
gcggcgctagctccgctcgg

SEQ ID NO: 165053 - DNA, 20 bp, human
ggcgcggcgctagctccgct

SEQ ID NO: 165054 - DNA, 20 bp, human
ggtccaacctgctgccgcct

SEQ ID NO: 165055 - DNA, 20 bp, human
ggtagtagacagaggacaac

SEQ ID NO: 165056 - DNA, 20 bp, human
gaagaacgcggaggacctct

SEQ ID NO: 165057 - DNA, 20 bp, human
gagggcggacgcaaagaacg

SEQ ID NO: 165058 - DNA, 20 bp, human
ggcggacgcaaagaacgcgg

SEQ ID NO: 165059 - DNA, 20 bp, human
gctacctgctccagcctcgc

SEQ ID NO: 165060 - DNA, 20 bp, human
gctctccccaccgctcccgg

SEQ ID NO: 165061 - DNA, 20 bp, human
gtgcagccgggagagcccag

SEQ ID NO: 165062 - DNA, 20 bp, human
gccggcaggcgaaggctcca

SEQ ID NO: 165063 - DNA, 20 bp, human
gcgggccgccgggagcggtg

SEQ ID NO: 165064 - DNA, 20 bp, human
ggaaggctccacggcccccg

SEQ ID NO: 165065 - DNA, 20 bp, human
gtatttgacaggagcgaggg

SEQ ID NO: 165066 - DNA, 20 bp, human
ggccgccgccgggaccgtag

SEQ ID NO: 165067 - DNA, 20 bp, human
gcggctggctcgggccccta

SEQ ID NO: 165068 - DNA, 20 bp, human
gcgggcccctacggtcccgg

SEQ ID NO: 165069 - DNA, 20 bp, human
ggctcgggcccctacggtcc

SEQ ID NO: 165070 - DNA, 20 bp, human
gcctcccgcacgtagcccgg

SEQ ID NO: 165071 - DNA, 20 bp, human
gcggggccccacacaggccg

SEQ ID NO: 165072 - DNA, 20 bp, human
gagacggaggaggccgagac

SEQ ID NO: 165073 - DNA, 20 bp, human
gtaagcagtggtgtgggccg

SEQ ID NO: 165074 - DNA, 20 bp, human
gccggggtaagcagtggtgt

SEQ ID NO: 165075 - DNA, 20 bp, human
gcagccgccgcggcctgtgt

SEQ ID NO: 165076 - DNA, 20 bp, human
ggtcagccgactacagagaa

SEQ ID NO: 165077 - DNA, 20 bp, human
gcccatccaaaggagtccgg

SEQ ID NO: 165078 - DNA, 20 bp, human
gtagtcggctgactgctccg

SEQ ID NO: 165079 - DNA, 20 bp, human
gttcagcccgaggttgatgg

SEQ ID NO: 165080 - DNA, 20 bp, human
ggactacagagaagggtaat

SEQ ID NO: 165081 - DNA, 20 bp, human
gaagggtaatcgggtgtccc

SEQ ID NO: 165082 - DNA, 20 bp, human
ggaggccgaaaggagtgctg

SEQ ID NO: 165083 - DNA, 20 bp, human
ggctgaaggtgagcactgaa

SEQ ID NO: 165084 - DNA, 20 bp, human
gcaaagacatctcggagccg

SEQ ID NO: 165085 - DNA, 20 bp, human
ggcgcgacaatgccccgcta

SEQ ID NO: 165086 - DNA, 20 bp, human
ggcgccggcggcccagcaac

SEQ ID NO: 165087 - DNA, 20 bp, human
gcctccaagctcgtccccgg

SEQ ID NO: 165088 - DNA, 20 bp, human
ggcaggcggcgcgcacaggt

SEQ ID NO: 165089 - DNA, 20 bp, human
gacggaatgcccctaaggaa

SEQ ID NO: 165090 - DNA, 20 bp, human
ggatcgtggggcgggatagg

SEQ ID NO: 165091 - DNA, 20 bp, human
gccgcgcgctaggaccctgg

SEQ ID NO: 165092 - DNA, 20 bp, human
ggagctccaggggcgctagg

SEQ ID NO: 165093 - DNA, 20 bp, human
gcaagtacggaatgccccta

SEQ ID NO: 165094 - DNA, 20 bp, human
gacgcactcaccagcagttg

SEQ ID NO: 165095 - DNA, 20 bp, human
ggcttggaggaaaaggaacc

SEQ ID NO: 165096 - DNA, 20 bp, human
gctcccggccgcagatctgg

SEQ ID NO: 165097 - DNA, 20 bp, human
gctctcgcggctctcgggtc

SEQ ID NO: 165098 - DNA, 20 bp, human
gtactcaggacgggaggatg

SEQ ID NO: 165099 - DNA, 20 bp, human
gccggccgcagatctggcgg

SEQ ID NO: 165100 - DNA, 20 bp, human
ggggctcccggccgcagatc

SEQ ID NO: 165101 - DNA, 20 bp, human
gcgtcgccaggcacagcggg

SEQ ID NO: 165102 - DNA, 20 bp, human
ggggcgaaccgaggcgtgag

SEQ ID NO: 165103 - DNA, 20 bp, human
ggaggcccctagtcagtcgg

SEQ ID NO: 165104 - DNA, 20 bp, human
gtcgctctcccaggagagat

SEQ ID NO: 165105 - DNA, 20 bp, human
gtgctcggattactcaggac

SEQ ID NO: 165106 - DNA, 20 bp, human
ggcgtcgctcgcctcagaga

SEQ ID NO: 165107 - DNA, 20 bp, human
ggcgctctaggagccgggag

SEQ ID NO: 165108 - DNA, 20 bp, human
gggcccagatcgccaagcag

SEQ ID NO: 165109 - DNA, 20 bp, human
ggtggcagaagactcaaccg

SEQ ID NO: 165110 - DNA, 20 bp, human
gtgagcggcgctctaggagc

SEQ ID NO: 165111 - DNA, 20 bp, human
gatgcgcgcctgagacggtc

SEQ ID NO: 165112 - DNA, 20 bp, human
gcagggcgccggaccgtctc

SEQ ID NO: 165113 - DNA, 20 bp, human
gacgactttcggcgccgtgg

SEQ ID NO: 165114 - DNA, 20 bp, human
gcgaccaatgcagtctatca

SEQ ID NO: 165115 - DNA, 20 bp, human
ggcggtgtgggtgtaagagc

SEQ ID NO: 165116 - DNA, 20 bp, human
ggcccttggagcgcccccac

SEQ ID NO: 165117 - DNA, 20 bp, human
gtcaggcctgacggtccgag

SEQ ID NO: 165118 - DNA, 20 bp, human
gaccgtcaggcctgagggtg

SEQ ID NO: 165119 - DNA, 20 bp, human
gcgggacagcccgaacctcc

SEQ ID NO: 165120 - DNA, 20 bp, human
ggacggtccgagtggagctg

SEQ ID NO: 165121 - DNA, 20 bp, human
ggcgcggggagggcgaccaa

SEQ ID NO: 165122 - DNA, 20 bp, human
gggagcgcccccaccggcga

SEQ ID NO: 165123 - DNA, 20 bp, human
ggaaatgccctcgccggtgg

SEQ ID NO: 165124 - DNA, 20 bp, human
gctgtctccgcctcaccctc

SEQ ID NO: 165125 - DNA, 20 bp, human
ggccggtgggggcgctccaa

SEQ ID NO: 165126 - DNA, 20 bp, human
ggaacacctgtaacaggaca

SEQ ID NO: 165127 - DNA, 20 bp, human
gaggtgttccaagtcctcca

SEQ ID NO: 165128 - DNA, 20 bp, human
gccagacgccttggaggact

SEQ ID NO: 165129 - DNA, 20 bp, human
gaggacaaggagttctgctc

SEQ ID NO: 165130 - DNA, 20 bp, human
gcgacattgcgaagaggtct

SEQ ID NO: 165131 - DNA, 20 bp, human
gtggccacagaaaactactt

SEQ ID NO: 165132 - DNA, 20 bp, human
gggagttctgctcaggcacg

SEQ ID NO: 165133 - DNA, 20 bp, human
gagagctagctaattagtag

SEQ ID NO: 165134 - DNA, 20 bp, human
gggacaccgacattgcgaag

SEQ ID NO: 165135 - DNA, 20 bp, human
ggaactccttgtcctgttac

SEQ ID NO: 165136 - DNA, 20 bp, human
gcagttctcaataccgggag

SEQ ID NO: 165137 - DNA, 20 bp, human
ggaactaggcaaatactgaa

SEQ ID NO: 165138 - DNA, 20 bp, human
gtcgcagctcagaggacacc

SEQ ID NO: 165139 - DNA, 20 bp, human
gaggagcagttctcaatacc

SEQ ID NO: 165140 - DNA, 20 bp, human
gcctggccagcacagcttca

SEQ ID NO: 165141 - DNA, 20 bp, human
gtgctggccaggattacagt

SEQ ID NO: 165142 - DNA, 20 bp, human
gaatagctctgtgcctctcc

SEQ ID NO: 165143 - DNA, 20 bp, human
gggacgcagctccggcgact

SEQ ID NO: 165144 - DNA, 20 bp, human
gttgtaggcttgtaaccagt

SEQ ID NO: 165145 - DNA, 20 bp, human
ggaatacaaagctccttgga

SEQ ID NO: 165146 - DNA, 20 bp, human
gtgggaaaagtaatccttaa

SEQ ID NO: 165147 - DNA, 20 bp, human
gtggatattcaattgtatgt

SEQ ID NO: 165148 - DNA, 20 bp, human
gtcttataagaacggatcct

SEQ ID NO: 165149 - DNA, 20 bp, human
ggggtgtggctattccctta

SEQ ID NO: 165150 - DNA, 20 bp, human
gttagagttgattaacctgc

SEQ ID NO: 165151 - DNA, 20 bp, human
gaggtacatacctttgcgtg

SEQ ID NO: 165152 - DNA, 20 bp, human
gattcaattgtatgtgggtg

SEQ ID NO: 165153 - DNA, 20 bp, human
gctcagatgtactctaaaag

SEQ ID NO: 165154 - DNA, 20 bp, human
gaactttaaggaacatcaag

SEQ ID NO: 165155 - DNA, 20 bp, human
gttcttcagttaatatttcc

SEQ ID NO: 165156 - DNA, 20 bp, human
gcagatcctcacacaaaggt

SEQ ID NO: 165157 - DNA, 20 bp, human
gtaggaaaagtactagttaa

SEQ ID NO: 165158 - DNA, 20 bp, human
ggttgaaagacggcaaataa

SEQ ID NO: 165159 - DNA, 20 bp, human
gtcacacaaaggtaggtact

SEQ ID NO: 165160 - DNA, 20 bp, human
gttacagttgattaatctgc

SEQ ID NO: 165161 - DNA, 20 bp, human
gttcaaacttaatttaagaa

SEQ ID NO: 165162 - DNA, 20 bp, human
gtgtacttggatggaccgat

SEQ ID NO: 165163 - DNA, 20 bp, human
gaagaactttaaggtacatc

SEQ ID NO: 165164 - DNA, 20 bp, human
ggaaaaattctggtttttac

SEQ ID NO: 165165 - DNA, 20 bp, human
ggttgggcatttgggccaat

SEQ ID NO: 165166 - DNA, 20 bp, human
gggccgccgggagcgacccg

SEQ ID NO: 165167 - DNA, 20 bp, human
gctgggagtgtgctgcgccc

SEQ ID NO: 165168 - DNA, 20 bp, human
gggacggccagggcccggaa

SEQ ID NO: 165169 - DNA, 20 bp, human
gccgagcgggagcgcgaagg

SEQ ID NO: 165170 - DNA, 20 bp, human
gcggggaggccaggactagg

SEQ ID NO: 165171 - DNA, 20 bp, human
ggtggcagtccgggagagtg

SEQ ID NO: 165172 - DNA, 20 bp, human
ggagcgcgggtggacggcca

SEQ ID NO: 165173 - DNA, 20 bp, human
gtcgctaatggtggaaacgt

SEQ ID NO: 165174 - DNA, 20 bp, human
gctggctccgcgctccgtcc

SEQ ID NO: 165175 - DNA, 20 bp, human
ggagtgtgctgcgcccgggg

SEQ ID NO: 165176 - DNA, 20 bp, human
gagctctccgcagaatccag

SEQ ID NO: 165177 - DNA, 20 bp, human
gctccgcagaatccagggga

SEQ ID NO: 165178 - DNA, 20 bp, human
gttagacacgcgcaggccgg

SEQ ID NO: 165179 - DNA, 20 bp, human
gggcctgggacagcgggtcg

SEQ ID NO: 165180 - DNA, 20 bp, human
gcagcgggtcgcggcacctc

SEQ ID NO: 165181 - DNA, 20 bp, human
ggaccccagactgtgtgaca

SEQ ID NO: 165182 - DNA, 20 bp, human
gggtcgccggacattgtgag

SEQ ID NO: 165183 - DNA, 20 bp, human
ggaggggcctcaggattctg

SEQ ID NO: 165184 - DNA, 20 bp, human
ggagactccacgccccacag

SEQ ID NO: 165185 - DNA, 20 bp, human
gccacaggggcgctagtctg

SEQ ID NO: 165186 - DNA, 20 bp, human
gagaggccaaacctgaatct

SEQ ID NO: 165187 - DNA, 20 bp, human
gcccctgcagaggagaccaa

SEQ ID NO: 165188 - DNA, 20 bp, human
gtctgagaagcagaaggctg

SEQ ID NO: 165189 - DNA, 20 bp, human
gcggacaaccctgagatgtc

SEQ ID NO: 165190 - DNA, 20 bp, human
gtgggttctcaggagatgac

SEQ ID NO: 165191 - DNA, 20 bp, human
gatgtcagcagaactccagg

SEQ ID NO: 165192 - DNA, 20 bp, human
gggtcaaagtggaatctcag

SEQ ID NO: 165193 - DNA, 20 bp, human
gcaactgttgccttaggttc

SEQ ID NO: 165194 - DNA, 20 bp, human
gaaaaggcaccagccgagga

SEQ ID NO: 165195 - DNA, 20 bp, human
gaccaaatctgaacccaaag

SEQ ID NO: 165196 - DNA, 20 bp, human
gtcgagagcgggccagacgg

SEQ ID NO: 165197 - DNA, 20 bp, human
gcctgcagcgggacaaccag

SEQ ID NO: 165198 - DNA, 20 bp, human
ggcgcgtagtcgcagagtca

SEQ ID NO: 165199 - DNA, 20 bp, human
ggcgcgcggtcgggaacccc

SEQ ID NO: 165200 - DNA, 20 bp, human
ggagcgaagccagccacgga

SEQ ID NO: 165201 - DNA, 20 bp, human
gcctcgagcgaagccagcca

SEQ ID NO: 165202 - DNA, 20 bp, human
gagagcgcgcgggtcgagag

SEQ ID NO: 165203 - DNA, 20 bp, human
gcgtagtcgcagagtcaggg

SEQ ID NO: 165204 - DNA, 20 bp, human
gttccaggcgaaggtcccac

SEQ ID NO: 165205 - DNA, 20 bp, human
gcggccggacagcgagaagg

SEQ ID NO: 165206 - DNA, 20 bp, human
ggatctcgctacctcggagg

SEQ ID NO: 165207 - DNA, 20 bp, human
gatcttcggagtgagtcctg

SEQ ID NO: 165208 - DNA, 20 bp, human
ggcctgctcccggagagata

SEQ ID NO: 165209 - DNA, 20 bp, human
ggacatagccgtatctctcc

SEQ ID NO: 165210 - DNA, 20 bp, human
gtcctgtgggcccacctccg

SEQ ID NO: 165211 - DNA, 20 bp, human
gtgtccgccggaggtgtcgt

SEQ ID NO: 165212 - DNA, 20 bp, human
gctggccttgagggagagct

SEQ ID NO: 165213 - DNA, 20 bp, human
gacaccaacgacacctccgg

SEQ ID NO: 165214 - DNA, 20 bp, human
gacctcggaggtgggcccac

SEQ ID NO: 165215 - DNA, 20 bp, human
ggttgcgcgactggccttga

SEQ ID NO: 165216 - DNA, 20 bp, human
gggaccaggtgaggaagtag

SEQ ID NO: 165217 - DNA, 20 bp, human
gtgggaatccgggactgtgg

SEQ ID NO: 165218 - DNA, 20 bp, human
gccaaaggggccgactacta

SEQ ID NO: 165219 - DNA, 20 bp, human
gcaacttgcccccacagtcc

SEQ ID NO: 165220 - DNA, 20 bp, human
gaaggaaccggaaacgggat

SEQ ID NO: 165221 - DNA, 20 bp, human
gcaccatacaaaacctccgg

SEQ ID NO: 165222 - DNA, 20 bp, human
gacggctcccagggtcgtcg

SEQ ID NO: 165223 - DNA, 20 bp, human
gtccagtcggccggagccag

SEQ ID NO: 165224 - DNA, 20 bp, human
gggggaaaggaaccggaaac

SEQ ID NO: 165225 - DNA, 20 bp, human
gtggggtgggggaaaggaac

SEQ ID NO: 165226 - DNA, 20 bp, human
gcgggcgtccggctctgagg

SEQ ID NO: 165227 - DNA, 20 bp, human
gcggagccgtaaccttgagg

SEQ ID NO: 165228 - DNA, 20 bp, human
gtccgcggctgcccgatcgt

SEQ ID NO: 165229 - DNA, 20 bp, human
gtccgtctgacaggtacggc

SEQ ID NO: 165230 - DNA, 20 bp, human
gcgccgccgcctcaaggtta

SEQ ID NO: 165231 - DNA, 20 bp, human
ggccggccgtacctgtcaga

SEQ ID NO: 165232 - DNA, 20 bp, human
ggggggagggccgcttccaa

SEQ ID NO: 165233 - DNA, 20 bp, human
gcgcagggcgcccttggaag

SEQ ID NO: 165234 - DNA, 20 bp, human
gcctgcggggaattccgggg

SEQ ID NO: 165235 - DNA, 20 bp, human
ggcccggagccgtaaccttg

SEQ ID NO: 165236 - DNA, 20 bp, human
ggggcgccggagcagaactc

SEQ ID NO: 165237 - DNA, 20 bp, human
gcggagccgacgagtggcgg

SEQ ID NO: 165238 - DNA, 20 bp, human
gtgggcctcgccgagacgag

SEQ ID NO: 165239 - DNA, 20 bp, human
gccggggacatgtctaaccc

SEQ ID NO: 165240 - DNA, 20 bp, human
gcggcgtcccgctccctccg

SEQ ID NO: 165241 - DNA, 20 bp, human
gcacaacaaagcggcagccg

SEQ ID NO: 165242 - DNA, 20 bp, human
gcatgtctaaccccggaggc

SEQ ID NO: 165243 - DNA, 20 bp, human
gacttctccttcctcggccc

SEQ ID NO: 165244 - DNA, 20 bp, human
gcgacgactctcggcacatc

SEQ ID NO: 165245 - DNA, 20 bp, human
ggcgcctcggccgccacggc

SEQ ID NO: 165246 - DNA, 20 bp, human
gaggtgagcaaaggcttcgg

SEQ ID NO: 165247 - DNA, 20 bp, human
ggggtggtgaaggtgagcaa

SEQ ID NO: 165248 - DNA, 20 bp, human
gaccgctgagggcaaaggaa

SEQ ID NO: 165249 - DNA, 20 bp, human
gagagactgtcaggccagcg

SEQ ID NO: 165250 - DNA, 20 bp, human
gatagggagaatggagaacg

SEQ ID NO: 165251 - DNA, 20 bp, human
gcagccaagttggccagtat

SEQ ID NO: 165252 - DNA, 20 bp, human
gagtctctgagatgacaata

SEQ ID NO: 165253 - DNA, 20 bp, human
gtggaggtcttcaccgctga

SEQ ID NO: 165254 - DNA, 20 bp, human
gtcttcaccgctgagggcaa

SEQ ID NO: 165255 - DNA, 20 bp, human
ggagccacagcaaatcacac

SEQ ID NO: 165256 - DNA, 20 bp, human
ggcagctcgggcacagccgg

SEQ ID NO: 165257 - DNA, 20 bp, human
gggtgaagcagtactcgcag

SEQ ID NO: 165258 - DNA, 20 bp, human
ggagcgggaggcttggacgg

SEQ ID NO: 165259 - DNA, 20 bp, human
ggctcggagcccacatttga

SEQ ID NO: 165260 - DNA, 20 bp, human
ggcgccccgccgccaccatg

SEQ ID NO: 165261 - DNA, 20 bp, human
gccgaggccctcggccctca

SEQ ID NO: 165262 - DNA, 20 bp, human
gaccgtgagcacgtaggcat

SEQ ID NO: 165263 - DNA, 20 bp, human
gtcgttgaccgtgagcacgt

SEQ ID NO: 165264 - DNA, 20 bp, human
gcagtgcagggcgtgcagcg

SEQ ID NO: 165265 - DNA, 20 bp, human
ggccaggcgccacgtgcgag

SEQ ID NO: 165266 - DNA, 20 bp, human
gccgctgcggcaacctaggg

SEQ ID NO: 165267 - DNA, 20 bp, human
gccagcagcgggcgtctcac

SEQ ID NO: 165268 - DNA, 20 bp, human
gggacgcgggtagccgtctg

SEQ ID NO: 165269 - DNA, 20 bp, human
ggccccgctgcggcaaccta

SEQ ID NO: 165270 - DNA, 20 bp, human
gcacagctcgcgactcaggt

SEQ ID NO: 165271 - DNA, 20 bp, human
gcccgcccggacacccccct

SEQ ID NO: 165272 - DNA, 20 bp, human
gggctacccgcgtccagcag

SEQ ID NO: 165273 - DNA, 20 bp, human
gtcgcgactcaggtaggcga

SEQ ID NO: 165274 - DNA, 20 bp, human
gctgacgcgcgtgtgcccgg

SEQ ID NO: 165275 - DNA, 20 bp, human
gtacgcacccgagaaggcag

SEQ ID NO: 165276 - DNA, 20 bp, human
ggacgtggtacaggccccaa

SEQ ID NO: 165277 - DNA, 20 bp, human
ggccgagtcgaagaacgtgt

SEQ ID NO: 165278 - DNA, 20 bp, human
gctgtaccacgtctacctgg

SEQ ID NO: 165279 - DNA, 20 bp, human
gctggaggtggggttactga

SEQ ID NO: 165280 - DNA, 20 bp, human
ggcacgggttggtatcccag

SEQ ID NO: 165281 - DNA, 20 bp, human
gcagctcctggcgcgcccct

SEQ ID NO: 165282 - DNA, 20 bp, human
ggtacaggccccaagggtgt

SEQ ID NO: 165283 - DNA, 20 bp, human
ggtgcactcgccagagaccg

SEQ ID NO: 165284 - DNA, 20 bp, human
gctctggcgagtgcacgggt

SEQ ID NO: 165285 - DNA, 20 bp, human
ggactccataagccagggta

SEQ ID NO: 165286 - DNA, 20 bp, human
ggccccgagcagccacagaa

SEQ ID NO: 165287 - DNA, 20 bp, human
ggctgtatccctggaacggt

SEQ ID NO: 165288 - DNA, 20 bp, human
ggagaacacgtcgcacatgg

SEQ ID NO: 165289 - DNA, 20 bp, human
gcagggccgtagcgtccgag

SEQ ID NO: 165290 - DNA, 20 bp, human
gccacagaagggcctcccgc

SEQ ID NO: 165291 - DNA, 20 bp, human
gggccgcgcgcgggtctccg

SEQ ID NO: 165292 - DNA, 20 bp, human
gtgctgctgtatccctggaa

SEQ ID NO: 165293 - DNA, 20 bp, human
ggttaagggtcataaggcgg

SEQ ID NO: 165294 - DNA, 20 bp, human
gctcacgaaacggacttcca

SEQ ID NO: 165295 - DNA, 20 bp, human
gcagagtccaaaggccgtgg

SEQ ID NO: 165296 - DNA, 20 bp, human
gcattcattgcgccgcggca

SEQ ID NO: 165297 - DNA, 20 bp, human
gcgcagaagaaccactcgct

SEQ ID NO: 165298 - DNA, 20 bp, human
ggagcgcggcatagtggtcg

SEQ ID NO: 165299 - DNA, 20 bp, human
ggggagagtccggagtccag

SEQ ID NO: 165300 - DNA, 20 bp, human
gcgcggcacggcctagcgag

SEQ ID NO: 165301 - DNA, 20 bp, human
gcgcctctcgccggctacaa

SEQ ID NO: 165302 - DNA, 20 bp, human
gagtgccgtgtagagggcag

SEQ ID NO: 165303 - DNA, 20 bp, human
ggagctcctccgcctctcgc

SEQ ID NO: 165304 - DNA, 20 bp, human
gctgcgtggggggcacctga

SEQ ID NO: 165305 - DNA, 20 bp, human
gcggaggagctccgcaagag

SEQ ID NO: 165306 - DNA, 20 bp, human
gtcaggtgcggcagacggac

SEQ ID NO: 165307 - DNA, 20 bp, human
ggtgcggcagacggacgggc

SEQ ID NO: 165308 - DNA, 20 bp, human
gggcggtccctacagcatcg

SEQ ID NO: 165309 - DNA, 20 bp, human
gcggcgcctctgaagtcacc

SEQ ID NO: 165310 - DNA, 20 bp, human
ggtccggcgggaggacacgg

SEQ ID NO: 165311 - DNA, 20 bp, human
gaaacgggctcagttcgtaa

SEQ ID NO: 165312 - DNA, 20 bp, human
gcgtctgccgcacctgagca

SEQ ID NO: 165313 - DNA, 20 bp, human
gcccggcgcggataacggtc

SEQ ID NO: 165314 - DNA, 20 bp, human
gggcccgccgcgatgctgta

SEQ ID NO: 165315 - DNA, 20 bp, human
gggtccctacagcatcgcgg

SEQ ID NO: 165316 - DNA, 20 bp, human
gacgggcggctgtatatcag

SEQ ID NO: 165317 - DNA, 20 bp, human
gggcatgttcccctcccggg

SEQ ID NO: 165318 - DNA, 20 bp, human
ggagttccagggagacttgg

SEQ ID NO: 165319 - DNA, 20 bp, human
ggacgcagcagtccggaccc

SEQ ID NO: 165320 - DNA, 20 bp, human
ggccggcggacgcagcagtc

SEQ ID NO: 165321 - DNA, 20 bp, human
gatatcaggggtgagttcca

SEQ ID NO: 165322 - DNA, 20 bp, human
gcgtccgccggcgcttgaag

SEQ ID NO: 165323 - DNA, 20 bp, human
ggccgggactcgaccctgag

SEQ ID NO: 165324 - DNA, 20 bp, human
gcgccaggaagatgactcca

SEQ ID NO: 165325 - DNA, 20 bp, human
gtgaccccttcaagcgccgg

SEQ ID NO: 165326 - DNA, 20 bp, human
gcgaggccactcctctccgg

SEQ ID NO: 165327 - DNA, 20 bp, human
gtagggtgcagcgccaggtc

SEQ ID NO: 165328 - DNA, 20 bp, human
gggcttgaggaaggactctg

SEQ ID NO: 165329 - DNA, 20 bp, human
ggcaagggctatccaatacc

SEQ ID NO: 165330 - DNA, 20 bp, human
gaactcggacaccccaacac

SEQ ID NO: 165331 - DNA, 20 bp, human
ggcgcgcgcaggcgcgacta

SEQ ID NO: 165332 - DNA, 20 bp, human
ggtccgagttgccgccggag

SEQ ID NO: 165333 - DNA, 20 bp, human
gatgggcccggagagaggac

SEQ ID NO: 165334 - DNA, 20 bp, human
gatcactgtggtcaccatac

SEQ ID NO: 165335 - DNA, 20 bp, human
ggacaccccaacaccggacc

SEQ ID NO: 165336 - DNA, 20 bp, human
gtgaagacgaaacctcgggg

SEQ ID NO: 165337 - DNA, 20 bp, human
gacgaaacctcggggaggtc

SEQ ID NO: 165338 - DNA, 20 bp, human
ggtggagccgccgagcaggg

SEQ ID NO: 165339 - DNA, 20 bp, human
ggcagctgggcagtccgagt

SEQ ID NO: 165340 - DNA, 20 bp, human
gtaatagggttagaacgaca

SEQ ID NO: 165341 - DNA, 20 bp, human
gctgcaggttgcaactgtgg

SEQ ID NO: 165342 - DNA, 20 bp, human
gcctctgcaggttgcaactg

SEQ ID NO: 165343 - DNA, 20 bp, human
ggcaaaatggaagaaagagg

SEQ ID NO: 165344 - DNA, 20 bp, human
gggacggccatctttgatga

SEQ ID NO: 165345 - DNA, 20 bp, human
ggcattgaagacgaaacctc

SEQ ID NO: 165346 - DNA, 20 bp, human
gtaccaccatcgagtcacta

SEQ ID NO: 165347 - DNA, 20 bp, human
gccggcgcggctctcggtct

SEQ ID NO: 165348 - DNA, 20 bp, human
gcaccttagtgactcgatgg

SEQ ID NO: 165349 - DNA, 20 bp, human
gctggacggcggcggcagtg

SEQ ID NO: 165350 - DNA, 20 bp, human
gggacaggcagcagtacttg

SEQ ID NO: 165351 - DNA, 20 bp, human
gcatctggagtacttgaaga

SEQ ID NO: 165352 - DNA, 20 bp, human
ggtctcgggcgtccctccaa

SEQ ID NO: 165353 - DNA, 20 bp, human
gtacgagtccgagaaggttg

SEQ ID NO: 165354 - DNA, 20 bp, human
gcgaagcagactaatagcta

SEQ ID NO: 165355 - DNA, 20 bp, human
gcctccccgtcgtcgtcgaa

SEQ ID NO: 165356 - DNA, 20 bp, human
ggtcggctctgggactcgtc

SEQ ID NO: 165357 - DNA, 20 bp, human
gcaacaccgtcgctcacctg

SEQ ID NO: 165358 - DNA, 20 bp, human
gcgagtcccagagccgaccg

SEQ ID NO: 165359 - DNA, 20 bp, human
ggcctgcgcagtgaagaccg

SEQ ID NO: 165360 - DNA, 20 bp, human
ggcgtccctcaggtgagcga

SEQ ID NO: 165361 - DNA, 20 bp, human
ggggtcctggaggagatggt

SEQ ID NO: 165362 - DNA, 20 bp, human
ggagccgagggcggacgcta

SEQ ID NO: 165363 - DNA, 20 bp, human
ggatggagacgggatctgga

SEQ ID NO: 165364 - DNA, 20 bp, human
gtgggacccggagagaacgg

SEQ ID NO: 165365 - DNA, 20 bp, human
gcgggatctggaggggacgg

SEQ ID NO: 165366 - DNA, 20 bp, human
gcgacaggaaacctcccacc

SEQ ID NO: 165367 - DNA, 20 bp, human
gtctcccagaggaacagggt

SEQ ID NO: 165368 - DNA, 20 bp, human
gcccccaaccaaagtcatga

SEQ ID NO: 165369 - DNA, 20 bp, human
ggagctgcggctctctaggt

SEQ ID NO: 165370 - DNA, 20 bp, human
gtccaggcggggtctgatta

SEQ ID NO: 165371 - DNA, 20 bp, human
gttgcttctgggaccctgtg

SEQ ID NO: 165372 - DNA, 20 bp, human
gtggctctcccagaggaaca

SEQ ID NO: 165373 - DNA, 20 bp, human
gcagcccgtgccagggacgt

SEQ ID NO: 165374 - DNA, 20 bp, human
gcccagatagaccccacctg

SEQ ID NO: 165375 - DNA, 20 bp, human
gggagccgaaggcctccgat

SEQ ID NO: 165376 - DNA, 20 bp, human
gtcggagcgctagagagacg

SEQ ID NO: 165377 - DNA, 20 bp, human
gccgggctccgctcatcctg

SEQ ID NO: 165378 - DNA, 20 bp, human
gtccgcagaggataatccca

SEQ ID NO: 165379 - DNA, 20 bp, human
gcgcggtcgcacacatccac

SEQ ID NO: 165380 - DNA, 20 bp, human
gagctccgcggagcgctcca

SEQ ID NO: 165381 - DNA, 20 bp, human
gccgcccgccgcaggatgag

SEQ ID NO: 165382 - DNA, 20 bp, human
gacccttcctggctttggag

SEQ ID NO: 165383 - DNA, 20 bp, human
gtccgcggagcgctccaggg

SEQ ID NO: 165384 - DNA, 20 bp, human
gtactcaccccgcccctgag

SEQ ID NO: 165385 - DNA, 20 bp, human
gggcgggcggcgccgctcag

SEQ ID NO: 165386 - DNA, 20 bp, human
gctagtccgttagaggcgtg

SEQ ID NO: 165387 - DNA, 20 bp, human
ggcgggcttcggaggcgtgc

SEQ ID NO: 165388 - DNA, 20 bp, human
ggaagcccgcacgcctctaa

SEQ ID NO: 165389 - DNA, 20 bp, human
gcctctaacggactagccag

SEQ ID NO: 165390 - DNA, 20 bp, human
ggaggccgcaacaaccatca

SEQ ID NO: 165391 - DNA, 20 bp, human
gatagtggcctggctcaggg

SEQ ID NO: 165392 - DNA, 20 bp, human
gtgcgggcttcgggtgccat

SEQ ID NO: 165393 - DNA, 20 bp, human
ggaaggtccaggagtcatgg

SEQ ID NO: 165394 - DNA, 20 bp, human
gcaggtcctagaacaagact

SEQ ID NO: 165395 - DNA, 20 bp, human
gagagaggagtttagaaggg

SEQ ID NO: 165396 - DNA, 20 bp, human
gcggccccggcgcgctatct

SEQ ID NO: 165397 - DNA, 20 bp, human
ggagcttgggagctagacgt

SEQ ID NO: 165398 - DNA, 20 bp, human
ggcgcctgcctctttctgag

SEQ ID NO: 165399 - DNA, 20 bp, human
gcttcatgccgctcagaaag

SEQ ID NO: 165400 - DNA, 20 bp, human
gggtgaggcgagggctaaac

SEQ ID NO: 165401 - DNA, 20 bp, human
ggagcctcggggtaatgcgt

SEQ ID NO: 165402 - DNA, 20 bp, human
gtcgcgagcgctccaggtcg

SEQ ID NO: 165403 - DNA, 20 bp, human
ggggcataagtgaagcggag

SEQ ID NO: 165404 - DNA, 20 bp, human
gctggagcgctcgcgagaag

SEQ ID NO: 165405 - DNA, 20 bp, human
gctaggggcggggcgagctt

SEQ ID NO: 165406 - DNA, 20 bp, human
ggctacacgtagggccacct

SEQ ID NO: 165407 - DNA, 20 bp, human
gtgggactcatccctgagaa

SEQ ID NO: 165408 - DNA, 20 bp, human
gtagcccaggtctaaaccac

SEQ ID NO: 165409 - DNA, 20 bp, human
gggaaggagtggggcgaaca

SEQ ID NO: 165410 - DNA, 20 bp, human
ggccctacgtgtagcggggt

SEQ ID NO: 165411 - DNA, 20 bp, human
gcaggcagctgactccgacc

SEQ ID NO: 165412 - DNA, 20 bp, human
gtgcagcttggggtcaaaca

SEQ ID NO: 165413 - DNA, 20 bp, human
gctacgtgtagcggggtggg

SEQ ID NO: 165414 - DNA, 20 bp, human
gaccgcggcatcctcccggt

SEQ ID NO: 165415 - DNA, 20 bp, human
gtggctgaaggaagccgagg

SEQ ID NO: 165416 - DNA, 20 bp, human
gagtccctgggctgaagtgt

SEQ ID NO: 165417 - DNA, 20 bp, human
gcactgctccaggcaggcga

SEQ ID NO: 165418 - DNA, 20 bp, human
gctgctgcaagtgggcaccc

SEQ ID NO: 165419 - DNA, 20 bp, human
gccatgggcacagtggaggg

SEQ ID NO: 165420 - DNA, 20 bp, human
ggacctgtgggcctgtcata

SEQ ID NO: 165421 - DNA, 20 bp, human
gtcgctcagacaaggccacc

SEQ ID NO: 165422 - DNA, 20 bp, human
gcctcccagctgctgcaagt

SEQ ID NO: 165423 - DNA, 20 bp, human
gcacctctctgagtgtcctt

SEQ ID NO: 165424 - DNA, 20 bp, human
gcagctccacatgctttcca

SEQ ID NO: 165425 - DNA, 20 bp, human
gtgctcccagggtgggccat

SEQ ID NO: 165426 - DNA, 20 bp, human
gtctaggcgagccttcggga

SEQ ID NO: 165427 - DNA, 20 bp, human
gggtcacatagccaacctcc

SEQ ID NO: 165428 - DNA, 20 bp, human
gacctcgcaagtctagggtg

SEQ ID NO: 165429 - DNA, 20 bp, human
ggccctcagacagcacgctg

SEQ ID NO: 165430 - DNA, 20 bp, human
gtcctcagcgtgctgtctga

SEQ ID NO: 165431 - DNA, 20 bp, human
gccgacagcagcccggaggt

SEQ ID NO: 165432 - DNA, 20 bp, human
gctcgggaggaatggaggag

SEQ ID NO: 165433 - DNA, 20 bp, human
gcgggccgacagcagcccgg

SEQ ID NO: 165434 - DNA, 20 bp, human
gtcgtgacctcgcaagtcta

SEQ ID NO: 165435 - DNA, 20 bp, human
gaaggggtcggtggccagag

SEQ ID NO: 165436 - DNA, 20 bp, human
ggtccctgcccccgatacag

SEQ ID NO: 165437 - DNA, 20 bp, human
gggttccgccgctgtatcgg

SEQ ID NO: 165438 - DNA, 20 bp, human
gcctgcccccgatacagcgg

SEQ ID NO: 165439 - DNA, 20 bp, human
gggacaattcgtgatggcgg

SEQ ID NO: 165440 - DNA, 20 bp, human
ggcttcaggacaattcgtga

SEQ ID NO: 165441 - DNA, 20 bp, human
gtgcccgggagggaagttgg

SEQ ID NO: 165442 - DNA, 20 bp, human
gccgcaggtggagggttcag

SEQ ID NO: 165443 - DNA, 20 bp, human
gctctctgcaaagaggtaca

SEQ ID NO: 165444 - DNA, 20 bp, human
ggtacttggtaaatacgtag

SEQ ID NO: 165445 - DNA, 20 bp, human
gttgttcccggagctctacc

SEQ ID NO: 165446 - DNA, 20 bp, human
gggacggcgacgaccagaag

SEQ ID NO: 165447 - DNA, 20 bp, human
gaccagaaggggcccaagag

SEQ ID NO: 165448 - DNA, 20 bp, human
gtcgcgtcgccggctcacag

SEQ ID NO: 165449 - DNA, 20 bp, human
gagaaggggcccaagagagg

SEQ ID NO: 165450 - DNA, 20 bp, human
ggtcgctcgccccctctctt

SEQ ID NO: 165451 - DNA, 20 bp, human
ggagcgcacaggaagggcgg

SEQ ID NO: 165452 - DNA, 20 bp, human
gccctcgtgagcggagaact

SEQ ID NO: 165453 - DNA, 20 bp, human
gggactcaggtaagtacctg

SEQ ID NO: 165454 - DNA, 20 bp, human
gcggagttgtggagaagcag

SEQ ID NO: 165455 - DNA, 20 bp, human
gtccgctcacgagggtggaa

SEQ ID NO: 165456 - DNA, 20 bp, human
ggggacaaggaacgcagcgc

SEQ ID NO: 165457 - DNA, 20 bp, human
gcccgcgcgcgcccgttggg

SEQ ID NO: 165458 - DNA, 20 bp, human
gaccgaccgacggaccgcag

SEQ ID NO: 165459 - DNA, 20 bp, human
gtgggacctggactcacccg

SEQ ID NO: 165460 - DNA, 20 bp, human
gggcggctcaggagcgcgaa

SEQ ID NO: 165461 - DNA, 20 bp, human
gctgcctgcgataagatccc

SEQ ID NO: 165462 - DNA, 20 bp, human
gtcctgccgctgcggtccgt

SEQ ID NO: 165463 - DNA, 20 bp, human
ggccgctgcggtccgtcggt

SEQ ID NO: 165464 - DNA, 20 bp, human
gtcttatcgcaggcagggat

SEQ ID NO: 165465 - DNA, 20 bp, human
gccggagcagccgagactcg

SEQ ID NO: 165466 - DNA, 20 bp, human
ggcagggcgcgaggaacgag

SEQ ID NO: 165467 - DNA, 20 bp, human
gcggagcgcgcgagctcgca

SEQ ID NO: 165468 - DNA, 20 bp, human
gcgaataccccgacccacat

SEQ ID NO: 165469 - DNA, 20 bp, human
gggctacgcacccgagaccc

SEQ ID NO: 165470 - DNA, 20 bp, human
gcacgtccccacagccgccc

SEQ ID NO: 165471 - DNA, 20 bp, human
gcgtgtgtccgcgcccatgt

SEQ ID NO: 165472 - DNA, 20 bp, human
gggagtatgtgagtatgctc

SEQ ID NO: 165473 - DNA, 20 bp, human
gaaaatggagggagacccgg

SEQ ID NO: 165474 - DNA, 20 bp, human
gccggccccgcatccaggtg

SEQ ID NO: 165475 - DNA, 20 bp, human
gccaggccggggtggaccag

SEQ ID NO: 165476 - DNA, 20 bp, human
ggcatcggggacagccgctg

SEQ ID NO: 165477 - DNA, 20 bp, human
gagagagcaggcctgaggta

SEQ ID NO: 165478 - DNA, 20 bp, human
gggcgaggccctggctatca

SEQ ID NO: 165479 - DNA, 20 bp, human
ggtgtcagagaccgcagaca

SEQ ID NO: 165480 - DNA, 20 bp, human
gaggccctggctatcaaggt

SEQ ID NO: 165481 - DNA, 20 bp, human
gcggcgtcaataggaggcat

SEQ ID NO: 165482 - DNA, 20 bp, human
gcatgaggctaaactagggt

SEQ ID NO: 165483 - DNA, 20 bp, human
gggctcgagtgctgccgcag

SEQ ID NO: 165484 - DNA, 20 bp, human
gagaccatgaggctaaacta

SEQ ID NO: 165485 - DNA, 20 bp, human
gaggcctgaggtagggacac

SEQ ID NO: 165486 - DNA, 20 bp, human
ggtagaacgtgtggcggcgg

SEQ ID NO: 165487 - DNA, 20 bp, human
ggcgcggcgagtagaacgtg

SEQ ID NO: 165488 - DNA, 20 bp, human
gcactagacggaagcagaca

SEQ ID NO: 165489 - DNA, 20 bp, human
gtccgggaggcaaggaacaa

SEQ ID NO: 165490 - DNA, 20 bp, human
gccggacaccttgacatcag

SEQ ID NO: 165491 - DNA, 20 bp, human
gggactcgccgggcgctcac

SEQ ID NO: 165492 - DNA, 20 bp, human
gccagctgcggacggtggac

SEQ ID NO: 165493 - DNA, 20 bp, human
gcgacgaaaagtgaggaagg

SEQ ID NO: 165494 - DNA, 20 bp, human
gcggcgagtagaacgtgtgg

SEQ ID NO: 165495 - DNA, 20 bp, human
gggactggaggtgtcaatgt

SEQ ID NO: 165496 - DNA, 20 bp, human
gcggcaccgaagaacgggaa

SEQ ID NO: 165497 - DNA, 20 bp, human
gcgcagaggaaagcgccggg

SEQ ID NO: 165498 - DNA, 20 bp, human
gcccccaagcaggacgacgg

SEQ ID NO: 165499 - DNA, 20 bp, human
gacgggaagggcaccgagag

SEQ ID NO: 165500 - DNA, 20 bp, human
ggctttcctctgcggagctg

SEQ ID NO: 165501 - DNA, 20 bp, human
ggcgccgaacgggtagaagt

SEQ ID NO: 165502 - DNA, 20 bp, human
gagtgctcggcaccgaagaa

SEQ ID NO: 165503 - DNA, 20 bp, human
gccgcgcgccccaagcccca

SEQ ID NO: 165504 - DNA, 20 bp, human
gacgtagagtccggagtgct

SEQ ID NO: 165505 - DNA, 20 bp, human
ggggttactcacgtagagtc

SEQ ID NO: 165506 - DNA, 20 bp, human
gtccgggacgtggagacccg

SEQ ID NO: 165507 - DNA, 20 bp, human
gctccgccgccggctcccca

SEQ ID NO: 165508 - DNA, 20 bp, human
gcgccgccggctccccaagg

SEQ ID NO: 165509 - DNA, 20 bp, human
gacgtggagacccggggtcc

SEQ ID NO: 165510 - DNA, 20 bp, human
gtttcttagggagaaggata

SEQ ID NO: 165511 - DNA, 20 bp, human
gtgggaggtgattaacgggt

SEQ ID NO: 165512 - DNA, 20 bp, human
gggcggtgcatccccaccct

SEQ ID NO: 165513 - DNA, 20 bp, human
gtcagtctcgcacgggtcag

SEQ ID NO: 165514 - DNA, 20 bp, human
ggccagtctcagattctgtt

SEQ ID NO: 165515 - DNA, 20 bp, human
gctgttgggaggtgattaac

SEQ ID NO: 165516 - DNA, 20 bp, human
gggcggagacgggctaccac

SEQ ID NO: 165517 - DNA, 20 bp, human
gagacgggctaccaccggag

SEQ ID NO: 165518 - DNA, 20 bp, human
ggaagagcgaacgggagcga

SEQ ID NO: 165519 - DNA, 20 bp, human
gggagttagccggtaagtgg

SEQ ID NO: 165520 - DNA, 20 bp, human
gaaggcggtgaagagcgaac

SEQ ID NO: 165521 - DNA, 20 bp, human
ggcccctcaggattaagtcc

SEQ ID NO: 165522 - DNA, 20 bp, human
gaccgccgtccggaccactc

SEQ ID NO: 165523 - DNA, 20 bp, human
gacttaccggctaactcctc

SEQ ID NO: 165524 - DNA, 20 bp, human
gcgtcatttcctccagctag

SEQ ID NO: 165525 - DNA, 20 bp, human
ggggagccggcgaagacacc

SEQ ID NO: 165526 - DNA, 20 bp, human
gcgggagcgtagctgaggac

SEQ ID NO: 165527 - DNA, 20 bp, human
gctgcgtcccgagtgcgcgg

SEQ ID NO: 165528 - DNA, 20 bp, human
ggggctgctgcggggcgatc

SEQ ID NO: 165529 - DNA, 20 bp, human
ggagcgtagctgaggacggg

SEQ ID NO: 165530 - DNA, 20 bp, human
ggtccggccgccgcgcactc

SEQ ID NO: 165531 - DNA, 20 bp, human
gcgcccggctcaccatggcg

SEQ ID NO: 165532 - DNA, 20 bp, human
gtcgccccgcagcagccccg

SEQ ID NO: 165533 - DNA, 20 bp, human
ggaaggcgggagcgtagctg

SEQ ID NO: 165534 - DNA, 20 bp, human
gggcgagatccggacaaagg

SEQ ID NO: 165535 - DNA, 20 bp, human
gtaggggtccaggtgacgtc

SEQ ID NO: 165536 - DNA, 20 bp, human
ggctcgggagagcaattcgg

SEQ ID NO: 165537 - DNA, 20 bp, human
gcaattcggcggcccctgca

SEQ ID NO: 165538 - DNA, 20 bp, human
gtcacctgcggaggcttcca

SEQ ID NO: 165539 - DNA, 20 bp, human
ggctagctgggtgctcgccg

SEQ ID NO: 165540 - DNA, 20 bp, human
gtgcagggcagctgaagcca

SEQ ID NO: 165541 - DNA, 20 bp, human
gccagtggactcaggtgagg

SEQ ID NO: 165542 - DNA, 20 bp, human
gggctcgcaccactccggcc

SEQ ID NO: 165543 - DNA, 20 bp, human
ggtgggcccggagatccccg

SEQ ID NO: 165544 - DNA, 20 bp, human
gctgcaggaggcggctagct

SEQ ID NO: 165545 - DNA, 20 bp, human
gaggaaaaagagatagaccg

SEQ ID NO: 165546 - DNA, 20 bp, human
gggcgccgacaactccctcc

SEQ ID NO: 165547 - DNA, 20 bp, human
ggcggccgggagggagttgt

SEQ ID NO: 165548 - DNA, 20 bp, human
gaatcccgccgcggccgcaa

SEQ ID NO: 165549 - DNA, 20 bp, human
ggcgcccagcccggcaacag

SEQ ID NO: 165550 - DNA, 20 bp, human
gggcgagcgtccgtccgcag

SEQ ID NO: 165551 - DNA, 20 bp, human
ggggattgcggcacctcgga

SEQ ID NO: 165552 - DNA, 20 bp, human
ggcgggagccgtcactgcgg

SEQ ID NO: 165553 - DNA, 20 bp, human
gccgcgcaggcgcagctacc

SEQ ID NO: 165554 - DNA, 20 bp, human
gtcgcctgccggctgaggta

SEQ ID NO: 165555 - DNA, 20 bp, human
ggcgcggcggccgtaggcag

SEQ ID NO: 165556 - DNA, 20 bp, human
ggccgtttgcagcttgcggt

SEQ ID NO: 165557 - DNA, 20 bp, human
gacgcaggaaagacgcactg

SEQ ID NO: 165558 - DNA, 20 bp, human
gcggcgggagcagagatctg

SEQ ID NO: 165559 - DNA, 20 bp, human
gcacaggtgtgggttatgat

SEQ ID NO: 165560 - DNA, 20 bp, human
gcatggccgcggctgctcgg

SEQ ID NO: 165561 - DNA, 20 bp, human
ggtgggttgggagtgacgtg

SEQ ID NO: 165562 - DNA, 20 bp, human
gccctaccgcaagctgcaaa

SEQ ID NO: 165563 - DNA, 20 bp, human
gttgcggtagggaggcgtgg

SEQ ID NO: 165564 - DNA, 20 bp, human
gagcttgcggtagggaggcg

SEQ ID NO: 165565 - DNA, 20 bp, human
gcgccgcgccggaacgacgc

SEQ ID NO: 165566 - DNA, 20 bp, human
ggggcagagcccggctgaga

SEQ ID NO: 165567 - DNA, 20 bp, human
ggcggccctggaggagacgg

SEQ ID NO: 165568 - DNA, 20 bp, human
gtggggcgcgaagcttaaag

SEQ ID NO: 165569 - DNA, 20 bp, human
ggcggcctccgtctcctcca

SEQ ID NO: 165570 - DNA, 20 bp, human
ggcactgccagcccgcacta

SEQ ID NO: 165571 - DNA, 20 bp, human
gctgccagcccgcactaggg

SEQ ID NO: 165572 - DNA, 20 bp, human
gtggcctccctagtgcgggc

SEQ ID NO: 165573 - DNA, 20 bp, human
ggcgcttggcctccctagtg

SEQ ID NO: 165574 - DNA, 20 bp, human
gtcggcagatcgcagagcag

SEQ ID NO: 165575 - DNA, 20 bp, human
gctcccaccagcaccttcgg

SEQ ID NO: 165576 - DNA, 20 bp, human
gtacaggactcacccctccg

SEQ ID NO: 165577 - DNA, 20 bp, human
gtcgcagccgctctccacgg

SEQ ID NO: 165578 - DNA, 20 bp, human
gctcacccctccgtggagag

SEQ ID NO: 165579 - DNA, 20 bp, human
gtagcaattcggaggatatg

SEQ ID NO: 165580 - DNA, 20 bp, human
gtgaatttctgggcgacggt

SEQ ID NO: 165581 - DNA, 20 bp, human
ggagagcgaggggtggataa

SEQ ID NO: 165582 - DNA, 20 bp, human
ggagtcctgtagcaattcgg

SEQ ID NO: 165583 - DNA, 20 bp, human
gggtgagtcctgtagcaatt

SEQ ID NO: 165584 - DNA, 20 bp, human
gtagccgcgtagcagagagg

SEQ ID NO: 165585 - DNA, 20 bp, human
gggcccgcctctctgctacg

SEQ ID NO: 165586 - DNA, 20 bp, human
ggctgctcgcctgtctccgt

SEQ ID NO: 165587 - DNA, 20 bp, human
gagcttgggctcccttccga

SEQ ID NO: 165588 - DNA, 20 bp, human
gccactgcgcatgccctgga

SEQ ID NO: 165589 - DNA, 20 bp, human
gtcgcctgtctccgtcggaa

SEQ ID NO: 165590 - DNA, 20 bp, human
ggggagcccaagctttgcag

SEQ ID NO: 165591 - DNA, 20 bp, human
ggctcccttccgacggagac

SEQ ID NO: 165592 - DNA, 20 bp, human
gaggcccactgcgcatgccc

SEQ ID NO: 165593 - DNA, 20 bp, human
gcaagctttgcagaggtgag

SEQ ID NO: 165594 - DNA, 20 bp, human
gggacgagagctggattgga

SEQ ID NO: 165595 - DNA, 20 bp, human
ggaaggagcgggccccacgc

SEQ ID NO: 165596 - DNA, 20 bp, human
gcaccagatacagcgctctg

SEQ ID NO: 165597 - DNA, 20 bp, human
ggcggcagcgcggtcagtgg

SEQ ID NO: 165598 - DNA, 20 bp, human
gagagcggcagcgcggtcag

SEQ ID NO: 165599 - DNA, 20 bp, human
gattgcgtggcgcctgagag

SEQ ID NO: 165600 - DNA, 20 bp, human
gctatctcagggcagtcgag

SEQ ID NO: 165601 - DNA, 20 bp, human
ggatacagcgctctgagggg

SEQ ID NO: 165602 - DNA, 20 bp, human
gtggaaccagcggcaactct

SEQ ID NO: 165603 - DNA, 20 bp, human
gtgggctcaaaaccctgacc

SEQ ID NO: 165604 - DNA, 20 bp, human
gcagtcgagaggctgaaaac

SEQ ID NO: 165605 - DNA, 20 bp, human
gaattagagttgaggacctt

SEQ ID NO: 165606 - DNA, 20 bp, human
gctgcagcccacccgccaag

SEQ ID NO: 165607 - DNA, 20 bp, human
gggtcacctcctccaacgtc

SEQ ID NO: 165608 - DNA, 20 bp, human
ggccgccgctcctccacagg

SEQ ID NO: 165609 - DNA, 20 bp, human
gtccacctgtggaggagcgg

SEQ ID NO: 165610 - DNA, 20 bp, human
ggcgcgcgaggaactcccga

SEQ ID NO: 165611 - DNA, 20 bp, human
ggggtgggctgcagctatgg

SEQ ID NO: 165612 - DNA, 20 bp, human
gccgcttcctcttggcgggt

SEQ ID NO: 165613 - DNA, 20 bp, human
ggagggcgagcctccacctg

SEQ ID NO: 165614 - DNA, 20 bp, human
gggcgagcctccacctgtgg

SEQ ID NO: 165615 - DNA, 20 bp, human
ggccgcactggaggtcgatg

SEQ ID NO: 165616 - DNA, 20 bp, human
ggagcgaggagggcgctacg

SEQ ID NO: 165617 - DNA, 20 bp, human
ggtcgctatcggaggccgcg

SEQ ID NO: 165618 - DNA, 20 bp, human
gctgctccagtcgctatcgg

SEQ ID NO: 165619 - DNA, 20 bp, human
ggacgtggacgcccccggag

SEQ ID NO: 165620 - DNA, 20 bp, human
gacacaccgcaagggcctgt

SEQ ID NO: 165621 - DNA, 20 bp, human
gagcggccccgcaccccgtc

SEQ ID NO: 165622 - DNA, 20 bp, human
gagcgggcgacggaatcaga

SEQ ID NO: 165623 - DNA, 20 bp, human
gtagcgactggagcaggggg

SEQ ID NO: 165624 - DNA, 20 bp, human
gccgcaagggcctgtgggta

SEQ ID NO: 165625 - DNA, 20 bp, human
gtgtgggtagggaaccacga

SEQ ID NO: 165626 - DNA, 20 bp, human
gtcaggtaaggcgggagtag

SEQ ID NO: 165627 - DNA, 20 bp, human
gggagtaggggcaaggacgg

SEQ ID NO: 165628 - DNA, 20 bp, human
ggcgggagtaggggcaagga

SEQ ID NO: 165629 - DNA, 20 bp, human
ggcgacaacaaagcgtgcgt

SEQ ID NO: 165630 - DNA, 20 bp, human
ggagagttctctccgcacgc

SEQ ID NO: 165631 - DNA, 20 bp, human
gcagcagtgaccacgttaaa

SEQ ID NO: 165632 - DNA, 20 bp, human
ggaaagagaggcgggtgcag

SEQ ID NO: 165633 - DNA, 20 bp, human
gcagcccgtgcgggacagtc

SEQ ID NO: 165634 - DNA, 20 bp, human
ggccatggagtgaagtgttg

SEQ ID NO: 165635 - DNA, 20 bp, human
gttcctccgaaaaggaagtc

SEQ ID NO: 165636 - DNA, 20 bp, human
gcgggccctcaaacagccag

SEQ ID NO: 165637 - DNA, 20 bp, human
gctcgctggcgggaggccac

SEQ ID NO: 165638 - DNA, 20 bp, human
gagccaagcaaggcctaaca

SEQ ID NO: 165639 - DNA, 20 bp, human
gtagcgccgtgcctcttgac

SEQ ID NO: 165640 - DNA, 20 bp, human
ggtcacccgtgcctgtcaag

SEQ ID NO: 165641 - DNA, 20 bp, human
ggtttgagggcccggaagag

SEQ ID NO: 165642 - DNA, 20 bp, human
ggatgctcatctggcaacaa

SEQ ID NO: 165643 - DNA, 20 bp, human
ggcggcgaaacagccaagca

SEQ ID NO: 165644 - DNA, 20 bp, human
ggcacgctgggacgtctcgc

SEQ ID NO: 165645 - DNA, 20 bp, human
gtgggcggccagtccccagg

SEQ ID NO: 165646 - DNA, 20 bp, human
gcctaagtggctccaaccca

SEQ ID NO: 165647 - DNA, 20 bp, human
ggccatcagaaccgccacca

SEQ ID NO: 165648 - DNA, 20 bp, human
gagaggctaggcctctgagg

SEQ ID NO: 165649 - DNA, 20 bp, human
ggcctctgaggaggcgaatc

SEQ ID NO: 165650 - DNA, 20 bp, human
gtctgaggaggcgaatccgg

SEQ ID NO: 165651 - DNA, 20 bp, human
ggcggcgggaaatcggctgt

SEQ ID NO: 165652 - DNA, 20 bp, human
gggtagcggcggcgggaaat

SEQ ID NO: 165653 - DNA, 20 bp, human
ggcctgtgccctccttacca

SEQ ID NO: 165654 - DNA, 20 bp, human
gggtgctgcatttccggtag

SEQ ID NO: 165655 - DNA, 20 bp, human
ggagccacttagggcggtga

SEQ ID NO: 165656 - DNA, 20 bp, human
gaggcgcacgaacccaccta

SEQ ID NO: 165657 - DNA, 20 bp, human
gttcttacagtagtcggcgt

SEQ ID NO: 165658 - DNA, 20 bp, human
ggtcggcgtaggccttaggt

SEQ ID NO: 165659 - DNA, 20 bp, human
ggccccctaacgaagtccaa

SEQ ID NO: 165660 - DNA, 20 bp, human
gaccgaaacagcgaggtaga

SEQ ID NO: 165661 - DNA, 20 bp, human
ggctttcaggtgtcttccag

SEQ ID NO: 165662 - DNA, 20 bp, human
gtcatgcgaggtttgatcgt

SEQ ID NO: 165663 - DNA, 20 bp, human
gagtagtcggcgtaggcctt

SEQ ID NO: 165664 - DNA, 20 bp, human
gggtggtggcgggtaattca

SEQ ID NO: 165665 - DNA, 20 bp, human
gcgtgggctgcgttgttaca

SEQ ID NO: 165666 - DNA, 20 bp, human
ggtggggccccgaaatctga

SEQ ID NO: 165667 - DNA, 20 bp, human
gatctgggccgggtggacgg

SEQ ID NO: 165668 - DNA, 20 bp, human
gttcggggccccactcactt

SEQ ID NO: 165669 - DNA, 20 bp, human
gccgtggatgggcatctcag

SEQ ID NO: 165670 - DNA, 20 bp, human
gcgggcgtcacgtaacggag

SEQ ID NO: 165671 - DNA, 20 bp, human
gatttccgggcgtcacgtaa

SEQ ID NO: 165672 - DNA, 20 bp, human
gatgccacttacagagtcat

SEQ ID NO: 165673 - DNA, 20 bp, human
ggaacagcgcttccgtggat

SEQ ID NO: 165674 - DNA, 20 bp, human
gggctgtgcgcgtcatttcc

SEQ ID NO: 165675 - DNA, 20 bp, human
gcccatgcaggagcggagag

SEQ ID NO: 165676 - DNA, 20 bp, human
gccggaagcgcctactccag

SEQ ID NO: 165677 - DNA, 20 bp, human
ggatgaagctcgtgaggtga

SEQ ID NO: 165678 - DNA, 20 bp, human
gcgactgcagtatgaatggc

SEQ ID NO: 165679 - DNA, 20 bp, human
gtaagagggagatgtgtccc

SEQ ID NO: 165680 - DNA, 20 bp, human
ggtgtgctgtcggacccaga

SEQ ID NO: 165681 - DNA, 20 bp, human
ggatccgcgagcgacccagg

SEQ ID NO: 165682 - DNA, 20 bp, human
gcgtgtgcgcggcctgctaa

SEQ ID NO: 165683 - DNA, 20 bp, human
gcaggcccgagcacgagctg

SEQ ID NO: 165684 - DNA, 20 bp, human
gagcggcgccgtcaccctct

SEQ ID NO: 165685 - DNA, 20 bp, human
gttcctgcctagtgacttag

SEQ ID NO: 165686 - DNA, 20 bp, human
gctagcccggcctcacatga

SEQ ID NO: 165687 - DNA, 20 bp, human
ggcgtagtgaccatcatgtg

SEQ ID NO: 165688 - DNA, 20 bp, human
ggccagtcagaaccacacgg

SEQ ID NO: 165689 - DNA, 20 bp, human
gccgccggccgtgacttcgg

SEQ ID NO: 165690 - DNA, 20 bp, human
gtccgaagcgaggagcggat

SEQ ID NO: 165691 - DNA, 20 bp, human
ggtgaggccgggctaggctt

SEQ ID NO: 165692 - DNA, 20 bp, human
gaggccgggctaggcttagg

SEQ ID NO: 165693 - DNA, 20 bp, human
gcgcaggcgccaacggaagt

SEQ ID NO: 165694 - DNA, 20 bp, human
ggcgcccccgaagtcacggc

SEQ ID NO: 165695 - DNA, 20 bp, human
gggccgcgcccccgaagtca

SEQ ID NO: 165696 - DNA, 20 bp, human
ggggatcagggcttacacct

SEQ ID NO: 165697 - DNA, 20 bp, human
ggatgcactgggcgggatca

SEQ ID NO: 165698 - DNA, 20 bp, human
gtccgctgcgaaagatgcta

SEQ ID NO: 165699 - DNA, 20 bp, human
gaaggcgtgagtcaagcgaa

SEQ ID NO: 165700 - DNA, 20 bp, human
ggccgtagcatctttcgcag

SEQ ID NO: 165701 - DNA, 20 bp, human
ggcgaaagatgctacggcga

SEQ ID NO: 165702 - DNA, 20 bp, human
gcgcccgtccccagcctcac

SEQ ID NO: 165703 - DNA, 20 bp, human
ggcgtgagtcaagcgaatgg

SEQ ID NO: 165704 - DNA, 20 bp, human
gttacttccaggagctagtg

SEQ ID NO: 165705 - DNA, 20 bp, human
gtccccagcctcaccggctc

SEQ ID NO: 165706 - DNA, 20 bp, human
gcccgggggctcatgggatg

SEQ ID NO: 165707 - DNA, 20 bp, human
gaggttcgggtcagaatacg

SEQ ID NO: 165708 - DNA, 20 bp, human
ggtagttgaaccgtgatggt

SEQ ID NO: 165709 - DNA, 20 bp, human
gcccagctgggcattcgtta

SEQ ID NO: 165710 - DNA, 20 bp, human
ggaccacctccccaccatca

SEQ ID NO: 165711 - DNA, 20 bp, human
gggcctgggatagtggagta

SEQ ID NO: 165712 - DNA, 20 bp, human
gcaagactggaagaaagcgc

SEQ ID NO: 165713 - DNA, 20 bp, human
gcggttttgggaaactccag

SEQ ID NO: 165714 - DNA, 20 bp, human
gaactccagggggatgaaag

SEQ ID NO: 165715 - DNA, 20 bp, human
ggtgcgaaggcgcaggctga

SEQ ID NO: 165716 - DNA, 20 bp, human
ggcgcctcacgcggatgaat

SEQ ID NO: 165717 - DNA, 20 bp, human
gaactgcggctcgggacctg

SEQ ID NO: 165718 - DNA, 20 bp, human
gtgtagtcacgagggacggg

SEQ ID NO: 165719 - DNA, 20 bp, human
gtgctgtagtcacgagggac

SEQ ID NO: 165720 - DNA, 20 bp, human
ggtacctgctgtagtcacga

SEQ ID NO: 165721 - DNA, 20 bp, human
gaggcaggaagggccgtggt

SEQ ID NO: 165722 - DNA, 20 bp, human
gtgactacagcaggtaccgc

SEQ ID NO: 165723 - DNA, 20 bp, human
gttctggagtgtggttaagt

SEQ ID NO: 165724 - DNA, 20 bp, human
ggccgcagtttcaagagaaa

SEQ ID NO: 165725 - DNA, 20 bp, human
gaggctactctctgccgacc

SEQ ID NO: 165726 - DNA, 20 bp, human
ggctaacggagagggaacca

SEQ ID NO: 165727 - DNA, 20 bp, human
ggacattcggctaacggaga

SEQ ID NO: 165728 - DNA, 20 bp, human
gcaagacgccgggcctacag

SEQ ID NO: 165729 - DNA, 20 bp, human
gtgccttggaacgcaacgca

SEQ ID NO: 165730 - DNA, 20 bp, human
ggacagcgccgggtgaccag

SEQ ID NO: 165731 - DNA, 20 bp, human
ggatcccggcgacctcggac

SEQ ID NO: 165732 - DNA, 20 bp, human
gctctgaaggaactaaggag

SEQ ID NO: 165733 - DNA, 20 bp, human
gagccgtgcgttgcgttcca

SEQ ID NO: 165734 - DNA, 20 bp, human
ggtagcactggagatcttca

SEQ ID NO: 165735 - DNA, 20 bp, human
ggcgggacctggagactagt

SEQ ID NO: 165736 - DNA, 20 bp, human
gcagatgcgtcaggcatctc

SEQ ID NO: 165737 - DNA, 20 bp, human
gatgcgtcaggcatctccgg

SEQ ID NO: 165738 - DNA, 20 bp, human
gggtggaggtgggtacatca

SEQ ID NO: 165739 - DNA, 20 bp, human
ggtgtggcgagggtacgtgg

SEQ ID NO: 165740 - DNA, 20 bp, human
gctcctcagacagatgcgtc

SEQ ID NO: 165741 - DNA, 20 bp, human
gtgcctgacgcatctgtctg

SEQ ID NO: 165742 - DNA, 20 bp, human
ggtctcttgagagaagccac

SEQ ID NO: 165743 - DNA, 20 bp, human
gagcggacaggataccatcg

SEQ ID NO: 165744 - DNA, 20 bp, human
gggataccatcggggcagaa

SEQ ID NO: 165745 - DNA, 20 bp, human
gggtcagtgacgcgatggag

SEQ ID NO: 165746 - DNA, 20 bp, human
gggtgggcgcgggacaccga

SEQ ID NO: 165747 - DNA, 20 bp, human
ggggcatcagcatcaaaggt

SEQ ID NO: 165748 - DNA, 20 bp, human
gggctgggcaaagcgggaca

SEQ ID NO: 165749 - DNA, 20 bp, human
gaccaagcgcccagggcaga

SEQ ID NO: 165750 - DNA, 20 bp, human
ggcggggtcgtggtgtctgg

SEQ ID NO: 165751 - DNA, 20 bp, human
gcccagcggccggggtaggg

SEQ ID NO: 165752 - DNA, 20 bp, human
gcgctccgaccaagcgccca

SEQ ID NO: 165753 - DNA, 20 bp, human
gtggcagcgcgcccaggaca

SEQ ID NO: 165754 - DNA, 20 bp, human
ggccgtgtgggactacctag

SEQ ID NO: 165755 - DNA, 20 bp, human
gtcgggaccagggtcgccgt

SEQ ID NO: 165756 - DNA, 20 bp, human
gcgtctgcgaactcccggag

SEQ ID NO: 165757 - DNA, 20 bp, human
gagacgcactcggcgggagt

SEQ ID NO: 165758 - DNA, 20 bp, human
ggagagtgcgtcccgcgggg

SEQ ID NO: 165759 - DNA, 20 bp, human
gccccggcgggcgagtccgg

SEQ ID NO: 165760 - DNA, 20 bp, human
gggcacgcgggactccgctc

SEQ ID NO: 165761 - DNA, 20 bp, human
ggcatcgggaccgccaccaa

SEQ ID NO: 165762 - DNA, 20 bp, human
gagggcgctgcggcgtacaa

SEQ ID NO: 165763 - DNA, 20 bp, human
gcggtcaggatcaggcgagg

SEQ ID NO: 165764 - DNA, 20 bp, human
gtggactcgggcacctgctc

SEQ ID NO: 165765 - DNA, 20 bp, human
ggggagttcgcagacgcact

SEQ ID NO: 165766 - DNA, 20 bp, human
gactggaatgagggtagctg

SEQ ID NO: 165767 - DNA, 20 bp, human
gggctgcctgactggaatga

SEQ ID NO: 165768 - DNA, 20 bp, human
gcgcagcgcccggctctggt

SEQ ID NO: 165769 - DNA, 20 bp, human
ggccagcccggggaagatct

SEQ ID NO: 165770 - DNA, 20 bp, human
gcgggtggtgaagcaagagg

SEQ ID NO: 165771 - DNA, 20 bp, human
gcaagggcggccgcgagaac

SEQ ID NO: 165772 - DNA, 20 bp, human
ggcccgcgtccacaccgcca

SEQ ID NO: 165773 - DNA, 20 bp, human
gtggtgaagcaagaggcggg

SEQ ID NO: 165774 - DNA, 20 bp, human
ggacgcgggccaccaaagcg

SEQ ID NO: 165775 - DNA, 20 bp, human
gggagcggggccggccatgg

SEQ ID NO: 165776 - DNA, 20 bp, human
ggaggcgagggggtaatagg

SEQ ID NO: 165777 - DNA, 20 bp, human
gcccgtggcgacgacagtgg

SEQ ID NO: 165778 - DNA, 20 bp, human
gtacagcaggtgtagaggga

SEQ ID NO: 165779 - DNA, 20 bp, human
ggttcgccggatcctctgag

SEQ ID NO: 165780 - DNA, 20 bp, human
gctgcccgtggcgacgacag

SEQ ID NO: 165781 - DNA, 20 bp, human
gaccggaggggagaaggcta

SEQ ID NO: 165782 - DNA, 20 bp, human
ggctcctcgcagctaaaagg

SEQ ID NO: 165783 - DNA, 20 bp, human
ggtggcggcaaggacagcgg

SEQ ID NO: 165784 - DNA, 20 bp, human
gttaggtacagcaggtgtag

SEQ ID NO: 165785 - DNA, 20 bp, human
ggcattaggaaactcgtgca

SEQ ID NO: 165786 - DNA, 20 bp, human
ggcgcggacgcggcgcctgg

SEQ ID NO: 165787 - DNA, 20 bp, human
ggctcctccagcgtcttcta

SEQ ID NO: 165788 - DNA, 20 bp, human
gagggagcagagcggccagg

SEQ ID NO: 165789 - DNA, 20 bp, human
gaaaccttagaagacgctgg

SEQ ID NO: 165790 - DNA, 20 bp, human
ggtacctgcgcgggtgagtg

SEQ ID NO: 165791 - DNA, 20 bp, human
gaccaaaccttagaagacgc

SEQ ID NO: 165792 - DNA, 20 bp, human
gggagccggcagaggggcgc

SEQ ID NO: 165793 - DNA, 20 bp, human
gcacccgcgcaggtaccagc

SEQ ID NO: 165794 - DNA, 20 bp, human
gaggggggccggaggtgaag

SEQ ID NO: 165795 - DNA, 20 bp, human
gctccagcccagtgtcttac

SEQ ID NO: 165796 - DNA, 20 bp, human
gaggtgcgcaggtggatgtt

SEQ ID NO: 165797 - DNA, 20 bp, human
gattgggatctccttccaag

SEQ ID NO: 165798 - DNA, 20 bp, human
gccggattagggtaggtaat

SEQ ID NO: 165799 - DNA, 20 bp, human
gtaggtaataggcaccaaac

SEQ ID NO: 165800 - DNA, 20 bp, human
gggctgtatgcacagtaccc

SEQ ID NO: 165801 - DNA, 20 bp, human
gtttaaagccggattagggt

SEQ ID NO: 165802 - DNA, 20 bp, human
gcaccaaactggcaataact

SEQ ID NO: 165803 - DNA, 20 bp, human
gtcaatttaaagccggatta

SEQ ID NO: 165804 - DNA, 20 bp, human
gacctaggaaaatgcccaaa

SEQ ID NO: 165805 - DNA, 20 bp, human
gagccaagttattgccagtt

SEQ ID NO: 165806 - DNA, 20 bp, human
ggcaggtgattcgtcggccc

SEQ ID NO: 165807 - DNA, 20 bp, human
ggtcacagtccggcaccgag

SEQ ID NO: 165808 - DNA, 20 bp, human
gcagggactcacccaaaccg

SEQ ID NO: 165809 - DNA, 20 bp, human
ggcgcgtgcgacggtcacct

SEQ ID NO: 165810 - DNA, 20 bp, human
ggggcccgggctcgaaccca

SEQ ID NO: 165811 - DNA, 20 bp, human
ggccagagggagtcacagtc

SEQ ID NO: 165812 - DNA, 20 bp, human
gccggcaccgagaggcaact

SEQ ID NO: 165813 - DNA, 20 bp, human
ggggcggacctagcttccca

SEQ ID NO: 165814 - DNA, 20 bp, human
gtgccaggatgcggacccag

SEQ ID NO: 165815 - DNA, 20 bp, human
gtgcgacggtcacctcggtt

SEQ ID NO: 165816 - DNA, 20 bp, human
gcagatgcgtcaggcatctc

SEQ ID NO: 165817 - DNA, 20 bp, human
gatgcgtcaggcatctccgg

SEQ ID NO: 165818 - DNA, 20 bp, human
gggtggaggtgggtacatca

SEQ ID NO: 165819 - DNA, 20 bp, human
ggtgtggcgagggtacgtgg

SEQ ID NO: 165820 - DNA, 20 bp, human
gtgcctgacgcatctgtctg

SEQ ID NO: 165821 - DNA, 20 bp, human
gctcctcagacagatgcgtc

SEQ ID NO: 165822 - DNA, 20 bp, human
ggtctcttgagagaagccac

SEQ ID NO: 165823 - DNA, 20 bp, human
gggtcagtgacgcgatggag

SEQ ID NO: 165824 - DNA, 20 bp, human
gagcggacaggataccatcg

SEQ ID NO: 165825 - DNA, 20 bp, human
gggataccatcggggcagaa

SEQ ID NO: 165826 - DNA, 20 bp, human
gtgggatgaaaggccttgta

SEQ ID NO: 165827 - DNA, 20 bp, human
gacttccttcagtatatagg

SEQ ID NO: 165828 - DNA, 20 bp, human
ggtatataggtggccttaca

SEQ ID NO: 165829 - DNA, 20 bp, human
gaaggccacctatatactga

SEQ ID NO: 165830 - DNA, 20 bp, human
gcatgacccgggggtttaag

SEQ ID NO: 165831 - DNA, 20 bp, human
gcttaagttactgtggatga

SEQ ID NO: 165832 - DNA, 20 bp, human
ggcacaaccacttaaacccc

SEQ ID NO: 165833 - DNA, 20 bp, human
gacaacttccttcagtatat

SEQ ID NO: 165834 - DNA, 20 bp, human
gatgagatcttaagttactg

SEQ ID NO: 165835 - DNA, 20 bp, human
gatagagcaattaaactgtg

SEQ ID NO: 165836 - DNA, 20 bp, human
ggagcgggtgaactaaaccc

SEQ ID NO: 165837 - DNA, 20 bp, human
gtcgctcgcgctggaagaag

SEQ ID NO: 165838 - DNA, 20 bp, human
gaagatggcgctcaccaggt

SEQ ID NO: 165839 - DNA, 20 bp, human
gtggggtcctcgatacggaa

SEQ ID NO: 165840 - DNA, 20 bp, human
gaaaggagagagaccaccac

SEQ ID NO: 165841 - DNA, 20 bp, human
gttgattggggtcctcgata

SEQ ID NO: 165842 - DNA, 20 bp, human
gaccaggtgggttgttgatt

SEQ ID NO: 165843 - DNA, 20 bp, human
ggaagaagatggcgctcacc

SEQ ID NO: 165844 - DNA, 20 bp, human
gtctggaaagacccgcccag

SEQ ID NO: 165845 - DNA, 20 bp, human
gccccaatcaacaacccacc

SEQ ID NO: 165846 - DNA, 20 bp, human
gccccgtacggataccggaa

SEQ ID NO: 165847 - DNA, 20 bp, human
gtggatacctcggttattag

SEQ ID NO: 165848 - DNA, 20 bp, human
gccggaaaggctggatacct

SEQ ID NO: 165849 - DNA, 20 bp, human
ggaagagaacctcccccgta

SEQ ID NO: 165850 - DNA, 20 bp, human
gtatgtacctctaataaccg

SEQ ID NO: 165851 - DNA, 20 bp, human
gacctcccccgtacggatac

SEQ ID NO: 165852 - DNA, 20 bp, human
ggcctttccggtatccgtac

SEQ ID NO: 165853 - DNA, 20 bp, human
gttatgtggtattatcggag

SEQ ID NO: 165854 - DNA, 20 bp, human
gtgtggtattatcggagggg

SEQ ID NO: 165855 - DNA, 20 bp, human
gcagggttatgtggtattat

SEQ ID NO: 165856 - DNA, 20 bp, human
gcgccgcgggtggaagaaga

SEQ ID NO: 165857 - DNA, 20 bp, human
gttagggagctagccgacga

SEQ ID NO: 165858 - DNA, 20 bp, human
gggtcaaaggacggcgtcgg

SEQ ID NO: 165859 - DNA, 20 bp, human
gagatggcgtcgggtggtgg

SEQ ID NO: 165860 - DNA, 20 bp, human
gggaagaagatggcgtcggg

SEQ ID NO: 165861 - DNA, 20 bp, human
gcagggtcaaaggacggcgt

SEQ ID NO: 165862 - DNA, 20 bp, human
gctggagccggagtccgagg

SEQ ID NO: 165863 - DNA, 20 bp, human
gcaccacactgcagggtcaa

SEQ ID NO: 165864 - DNA, 20 bp, human
gagaagatggcgtcgggtgg

SEQ ID NO: 165865 - DNA, 20 bp, human
ggcgggaagagtaaagaatg

SEQ ID NO: 165866 - DNA, 20 bp, human
gcaccaggccgggtagaagg

SEQ ID NO: 165867 - DNA, 20 bp, human
gagaggtggattctagatta

SEQ ID NO: 165868 - DNA, 20 bp, human
gtggctaaaaagacaccccg

SEQ ID NO: 165869 - DNA, 20 bp, human
gacctcggctgaaaaggagg

SEQ ID NO: 165870 - DNA, 20 bp, human
gcggcggcccttctttccag

SEQ ID NO: 165871 - DNA, 20 bp, human
gttctacccggcctggtgta

SEQ ID NO: 165872 - DNA, 20 bp, human
ggcgccagccgtccgcctgt

SEQ ID NO: 165873 - DNA, 20 bp, human
ggatggagcgcgtcgatcca

SEQ ID NO: 165874 - DNA, 20 bp, human
gagggccgccgtccccacct

SEQ ID NO: 165875 - DNA, 20 bp, human
gcaggccgggtagaaggggg

SEQ ID NO: 165876 - DNA, 20 bp, human
ggtgatctggctatatggtg

SEQ ID NO: 165877 - DNA, 20 bp, human
gtacgtggacacgggagact

SEQ ID NO: 165878 - DNA, 20 bp, human
ggtggacacgggagacttgg

SEQ ID NO: 165879 - DNA, 20 bp, human
gtggctaagactgggggcaa

SEQ ID NO: 165880 - DNA, 20 bp, human
ggccgtagtaaaagactctg

SEQ ID NO: 165881 - DNA, 20 bp, human
gccacccgggattaaggcaa

SEQ ID NO: 165882 - DNA, 20 bp, human
ggcgcgggcggtgtcgctgt

SEQ ID NO: 165883 - DNA, 20 bp, human
ggtgctgttctcaggtgaga

SEQ ID NO: 165884 - DNA, 20 bp, human
gaagccgtgatctggctata

SEQ ID NO: 165885 - DNA, 20 bp, human
gtcagagcccgggcctgtag

SEQ ID NO: 165886 - DNA, 20 bp, human
gagtgaagcatggctggata

SEQ ID NO: 165887 - DNA, 20 bp, human
gaaactcctgagggagacat

SEQ ID NO: 165888 - DNA, 20 bp, human
gagcatggctggatagggtg

SEQ ID NO: 165889 - DNA, 20 bp, human
gcgcatgcgaacctcatagg

SEQ ID NO: 165890 - DNA, 20 bp, human
gcacggcagtagctgatacc

SEQ ID NO: 165891 - DNA, 20 bp, human
gctgagggagacatcggacg

SEQ ID NO: 165892 - DNA, 20 bp, human
ggaaggagagcctgggaccg

SEQ ID NO: 165893 - DNA, 20 bp, human
gcctccggccacaactgaat

SEQ ID NO: 165894 - DNA, 20 bp, human
gcgcatgcgggtgagtcacg

SEQ ID NO: 165895 - DNA, 20 bp, human
gttcggaaagatgtcggaca

SEQ ID NO: 165896 - DNA, 20 bp, human
gtaactgaggtaagcggcga

SEQ ID NO: 165897 - DNA, 20 bp, human
ggagcagttgccgccgttgg

SEQ ID NO: 165898 - DNA, 20 bp, human
gcgtcgctcttccaagatgg

SEQ ID NO: 165899 - DNA, 20 bp, human
gaggcactggcagccggagg

SEQ ID NO: 165900 - DNA, 20 bp, human
ggctccttcagtcttctccc

SEQ ID NO: 165901 - DNA, 20 bp, human
gccgcccgggagaagactga

SEQ ID NO: 165902 - DNA, 20 bp, human
ggcgtccgtcgcgagcgacc

SEQ ID NO: 165903 - DNA, 20 bp, human
gtcggcccggtcgctcgcga

SEQ ID NO: 165904 - DNA, 20 bp, human
gactgcgaaaggcgaggcac

SEQ ID NO: 165905 - DNA, 20 bp, human
gggacgtcgctcttccaaga

SEQ ID NO: 165906 - DNA, 20 bp, human
ggcggtccccagccgaccag

SEQ ID NO: 165907 - DNA, 20 bp, human
gcgcaggctgaggtcgcgtc

SEQ ID NO: 165908 - DNA, 20 bp, human
gggcgcacacagacgcctac

SEQ ID NO: 165909 - DNA, 20 bp, human
ggcggcggctaactgccggt

SEQ ID NO: 165910 - DNA, 20 bp, human
ggggagagcgagctccgcag

SEQ ID NO: 165911 - DNA, 20 bp, human
ggcctgcggcggctaactgc

SEQ ID NO: 165912 - DNA, 20 bp, human
ggcagaacagcgggtactgg

SEQ ID NO: 165913 - DNA, 20 bp, human
gggagacgaagcctcgggaa

SEQ ID NO: 165914 - DNA, 20 bp, human
gtgtgcgccgccaagtcggt

SEQ ID NO: 165915 - DNA, 20 bp, human
gtgcgggactggggaccagt

SEQ ID NO: 165916 - DNA, 20 bp, human
gtaggcggcccgagtgtcag

SEQ ID NO: 165917 - DNA, 20 bp, human
ggaggagatcagagccggga

SEQ ID NO: 165918 - DNA, 20 bp, human
ggtgatagccaacaggaacc

SEQ ID NO: 165919 - DNA, 20 bp, human
ggcccgcgtggtgacgccag

SEQ ID NO: 165920 - DNA, 20 bp, human
ggcggcccgagtgtcagggg

SEQ ID NO: 165921 - DNA, 20 bp, human
gagccaacaggaaccgggag

SEQ ID NO: 165922 - DNA, 20 bp, human
gtaactcggacgccaccacc

SEQ ID NO: 165923 - DNA, 20 bp, human
ggtgggtcccggagataact

SEQ ID NO: 165924 - DNA, 20 bp, human
gccctgtcgggagcggaacg

SEQ ID NO: 165925 - DNA, 20 bp, human
ggccggggcctggaaccctc

SEQ ID NO: 165926 - DNA, 20 bp, human
gcgcccggagtgtagtgtct

SEQ ID NO: 165927 - DNA, 20 bp, human
gacatgaaaccgagctggag

SEQ ID NO: 165928 - DNA, 20 bp, human
gggcgaaggatgacttcctg

SEQ ID NO: 165929 - DNA, 20 bp, human
gaccccaggactcaccccaa

SEQ ID NO: 165930 - DNA, 20 bp, human
gatgcccagacactacactc

SEQ ID NO: 165931 - DNA, 20 bp, human
gtacatctttaaccaccagg

SEQ ID NO: 165932 - DNA, 20 bp, human
gttgacggccgttcccggac

SEQ ID NO: 165933 - DNA, 20 bp, human
ggcgggacatgaaaccgagc

SEQ ID NO: 165934 - DNA, 20 bp, human
ggacaaaatccctaggccag

SEQ ID NO: 165935 - DNA, 20 bp, human
gggcgcccctctagttaaaa

SEQ ID NO: 165936 - DNA, 20 bp, human
gcgactctgagcaaccccgt

SEQ ID NO: 165937 - DNA, 20 bp, human
gctctggaaaacctcaggtg

SEQ ID NO: 165938 - DNA, 20 bp, human
gtcgttcgggatcgccgagg

SEQ ID NO: 165939 - DNA, 20 bp, human
ggctgcggttaaggagagtc

SEQ ID NO: 165940 - DNA, 20 bp, human
gtgggagcaactccgcatca

SEQ ID NO: 165941 - DNA, 20 bp, human
gcgagcgcgcttcccggtga

SEQ ID NO: 165942 - DNA, 20 bp, human
ggcctcccagacgcacagtg

SEQ ID NO: 165943 - DNA, 20 bp, human
gctctgagcaaccccgtggg

SEQ ID NO: 165944 - DNA, 20 bp, human
ggggggctgaggtaaagact

SEQ ID NO: 165945 - DNA, 20 bp, human
ggaggaaagaggcaaatacc

SEQ ID NO: 165946 - DNA, 20 bp, human
gaggccagtgacgcccacca

SEQ ID NO: 165947 - DNA, 20 bp, human
gaggccgcagctgccctggt

SEQ ID NO: 165948 - DNA, 20 bp, human
ggagccctgcgatccgatgt

SEQ ID NO: 165949 - DNA, 20 bp, human
ggctcccaaaatggcgagtg

SEQ ID NO: 165950 - DNA, 20 bp, human
gtaagggcctacaggagctc

SEQ ID NO: 165951 - DNA, 20 bp, human
gcttcccacatcggatcgca

SEQ ID NO: 165952 - DNA, 20 bp, human
ggcagctgcggcctagctcg

SEQ ID NO: 165953 - DNA, 20 bp, human
gctagctcggggaagcgacc

SEQ ID NO: 165954 - DNA, 20 bp, human
gcggactgtgagggccgcag

SEQ ID NO: 165955 - DNA, 20 bp, human
gagctgaagagccagtccgg

SEQ ID NO: 165956 - DNA, 20 bp, human
gagtcggcgctgcgaagtgg

SEQ ID NO: 165957 - DNA, 20 bp, human
ggaagtggaggcgctgcgag

SEQ ID NO: 165958 - DNA, 20 bp, human
ggcgcggatcacctgcacat

SEQ ID NO: 165959 - DNA, 20 bp, human
gacgccaatgtgccccccgg

SEQ ID NO: 165960 - DNA, 20 bp, human
ggcagcgagcaggacatcga

SEQ ID NO: 165961 - DNA, 20 bp, human
ggggcgcgaccggctggtcc

SEQ ID NO: 165962 - DNA, 20 bp, human
gggcggcccagcgcggcagt

SEQ ID NO: 165963 - DNA, 20 bp, human
ggagtcgggaccgccagtcg

SEQ ID NO: 165964 - DNA, 20 bp, human
ggcgagcggagccgcgcgga

SEQ ID NO: 165965 - DNA, 20 bp, human
gcggctggtccgggcagcgt

SEQ ID NO: 165966 - DNA, 20 bp, human
gcctcttcggggcctcgggg

SEQ ID NO: 165967 - DNA, 20 bp, human
gcagtcgcccaggtttacgg

SEQ ID NO: 165968 - DNA, 20 bp, human
gcggcggtcagccttcacac

SEQ ID NO: 165969 - DNA, 20 bp, human
gcgcagccgggcctgtgtga

SEQ ID NO: 165970 - DNA, 20 bp, human
gcctctgccgccgtaaacct

SEQ ID NO: 165971 - DNA, 20 bp, human
gtcgacccggaagctgtcgc

SEQ ID NO: 165972 - DNA, 20 bp, human
gctgcggagcgcagtcgccc

SEQ ID NO: 165973 - DNA, 20 bp, human
gtggtagccatggggagacg

SEQ ID NO: 165974 - DNA, 20 bp, human
ggaactgtgtctcagatatg

SEQ ID NO: 165975 - DNA, 20 bp, human
gctcagatatggggcgatct

SEQ ID NO: 165976 - DNA, 20 bp, human
gttcgggtgagcgaagatgg

SEQ ID NO: 165977 - DNA, 20 bp, human
gggacgtgcaagagacaccg

SEQ ID NO: 165978 - DNA, 20 bp, human
gccagctcgcgcagtcgttc

SEQ ID NO: 165979 - DNA, 20 bp, human
ggcccctctgaggattaggt

SEQ ID NO: 165980 - DNA, 20 bp, human
ggtgccgacctaatcctcag

SEQ ID NO: 165981 - DNA, 20 bp, human
ggatggggagggacaagtcg

SEQ ID NO: 165982 - DNA, 20 bp, human
ggccgtgcgtgctcacgtga

SEQ ID NO: 165983 - DNA, 20 bp, human
ggtgcaagagacaccgagga

SEQ ID NO: 165984 - DNA, 20 bp, human
gaccgaaccgagcattgcag

SEQ ID NO: 165985 - DNA, 20 bp, human
gtcgttcgggtgagcgaaga

SEQ ID NO: 165986 - DNA, 20 bp, human
ggctccggcgacaagccgag

SEQ ID NO: 165987 - DNA, 20 bp, human
ggtccgggaggagtgtcata

SEQ ID NO: 165988 - DNA, 20 bp, human
gaggagagctccagacacag

SEQ ID NO: 165989 - DNA, 20 bp, human
gcagggctgtgtgtgtccag

SEQ ID NO: 165990 - DNA, 20 bp, human
ggtgtgtccaggggtccggg

SEQ ID NO: 165991 - DNA, 20 bp, human
ggagaaccaagagctcgaag

SEQ ID NO: 165992 - DNA, 20 bp, human
gagaatccaggcctgttcaa

SEQ ID NO: 165993 - DNA, 20 bp, human
gagctcttggttctcagctc

SEQ ID NO: 165994 - DNA, 20 bp, human
gagctctccttagcacactg

SEQ ID NO: 165995 - DNA, 20 bp, human
gcacagccttagaggactca

SEQ ID NO: 165996 - DNA, 20 bp, human
ggaacccggccgacctccat

SEQ ID NO: 165997 - DNA, 20 bp, human
ggaggccatggcaccctggg

SEQ ID NO: 165998 - DNA, 20 bp, human
ggcccgagcggcgctctgag

SEQ ID NO: 165999 - DNA, 20 bp, human
gaggtcggccgggttctgca

SEQ ID NO: 166000 - DNA, 20 bp, human
ggcctgtcctcccgactcag

SEQ ID NO: 166001 - DNA, 20 bp, human
ggcgtcgcgcgctcccccca

SEQ ID NO: 166002 - DNA, 20 bp, human
gcgtcccacggtgcattcag

SEQ ID NO: 166003 - DNA, 20 bp, human
gcgggaggccatggcaccct

SEQ ID NO: 166004 - DNA, 20 bp, human
gcagcccatggaggtcggcc

SEQ ID NO: 166005 - DNA, 20 bp, human
ggctgtgtaccggatcccgg

SEQ ID NO: 166006 - DNA, 20 bp, human
ggtccgctccgggagagtta

SEQ ID NO: 166007 - DNA, 20 bp, human
gcccaccctcccgctctcaa

SEQ ID NO: 166008 - DNA, 20 bp, human
gctccactcggaacacctgg

SEQ ID NO: 166009 - DNA, 20 bp, human
gggcctcgggccccaccgac

SEQ ID NO: 166010 - DNA, 20 bp, human
ggagcggactgaggaccccg

SEQ ID NO: 166011 - DNA, 20 bp, human
gcgctctcaaaggcacaaag

SEQ ID NO: 166012 - DNA, 20 bp, human
gctggaagttcacatcccgt

SEQ ID NO: 166013 - DNA, 20 bp, human
gtgtgcctttgagagcggga

SEQ ID NO: 166014 - DNA, 20 bp, human
gagccctaactctcccggag

SEQ ID NO: 166015 - DNA, 20 bp, human
gccgagcgcgcggagcagct

SEQ ID NO: 166016 - DNA, 20 bp, human
gactactgtctggactgagg

SEQ ID NO: 166017 - DNA, 20 bp, human
ggacctggagcggggataca

SEQ ID NO: 166018 - DNA, 20 bp, human
ggacgggatgtagacctcca

SEQ ID NO: 166019 - DNA, 20 bp, human
gcagccgccgtgcccgggag

SEQ ID NO: 166020 - DNA, 20 bp, human
gctcttcatagcgaaaggac

SEQ ID NO: 166021 - DNA, 20 bp, human
gtggagcggggatacacggt

SEQ ID NO: 166022 - DNA, 20 bp, human
ggagctgcagtcctcggacg

SEQ ID NO: 166023 - DNA, 20 bp, human
gccgcgaagctactactgtc

SEQ ID NO: 166024 - DNA, 20 bp, human
gcgctatgaagagagcgacc

SEQ ID NO: 166025 - DNA, 20 bp, human
ggagagggttggaccccgag

SEQ ID NO: 166026 - DNA, 20 bp, human
gcccgacacgcacttcaggg

SEQ ID NO: 166027 - DNA, 20 bp, human
gctcgcccgcggcccaccga

SEQ ID NO: 166028 - DNA, 20 bp, human
gccgcccgacacgcacttca

SEQ ID NO: 166029 - DNA, 20 bp, human
gcgggcccagcgcctggtgg

SEQ ID NO: 166030 - DNA, 20 bp, human
ggccgccctgaagtgcgtgt

SEQ ID NO: 166031 - DNA, 20 bp, human
gagcgccggcgggggaccgg

SEQ ID NO: 166032 - DNA, 20 bp, human
ggcgggcgaggcatgagcgc

SEQ ID NO: 166033 - DNA, 20 bp, human
gcgggggccgctccctcggt

SEQ ID NO: 166034 - DNA, 20 bp, human
gccaggcttcagtcacaaca

SEQ ID NO: 166035 - DNA, 20 bp, human
gggcttcagtcacaacacgg

SEQ ID NO: 166036 - DNA, 20 bp, human
gtccactgcgccgggaacgg

SEQ ID NO: 166037 - DNA, 20 bp, human
gagggtagcgaggagtgcag

SEQ ID NO: 166038 - DNA, 20 bp, human
gtcgcctgctcgcaagatgg

SEQ ID NO: 166039 - DNA, 20 bp, human
gaggccggctcggagctcgg

SEQ ID NO: 166040 - DNA, 20 bp, human
gcccctcacaggaacggagg

SEQ ID NO: 166041 - DNA, 20 bp, human
gcagccgggcccctccttgt

SEQ ID NO: 166042 - DNA, 20 bp, human
gggagggcagcccacaagga

SEQ ID NO: 166043 - DNA, 20 bp, human
gcaactgcggagcatcaacg

SEQ ID NO: 166044 - DNA, 20 bp, human
ggagcgagggcgggcaactg

SEQ ID NO: 166045 - DNA, 20 bp, human
gcctggaggtgtgagtatcg

SEQ ID NO: 166046 - DNA, 20 bp, human
gcttctcgggcgactccgag

SEQ ID NO: 166047 - DNA, 20 bp, human
gaggaagcacaggggccact

SEQ ID NO: 166048 - DNA, 20 bp, human
gctatggtattgggtaaaat

SEQ ID NO: 166049 - DNA, 20 bp, human
gtcattaaaagtgcaaggga

SEQ ID NO: 166050 - DNA, 20 bp, human
gagaagtaagtttgtgtgta

SEQ ID NO: 166051 - DNA, 20 bp, human
gcccctcattaaaagtgcaa

SEQ ID NO: 166052 - DNA, 20 bp, human
gcccctctttcagttctcag

SEQ ID NO: 166053 - DNA, 20 bp, human
gtggagtctcaccgtccccc

SEQ ID NO: 166054 - DNA, 20 bp, human
ggaagaatgaatgataccct

SEQ ID NO: 166055 - DNA, 20 bp, human
gctcatcaggaaggaagcac

SEQ ID NO: 166056 - DNA, 20 bp, human
gctgcccgccgtggggacac

SEQ ID NO: 166057 - DNA, 20 bp, human
ggagccccgtgtccccacgg

SEQ ID NO: 166058 - DNA, 20 bp, human
gtccccacggcgggcagcag

SEQ ID NO: 166059 - DNA, 20 bp, human
gcggcggctgaacgcggagg

SEQ ID NO: 166060 - DNA, 20 bp, human
gaccagccctacaggaagag

SEQ ID NO: 166061 - DNA, 20 bp, human
gcagggcccctcttcctgta

SEQ ID NO: 166062 - DNA, 20 bp, human
ggccgggagcccccttgcag

SEQ ID NO: 166063 - DNA, 20 bp, human
gagaaggtgctcgaagagga

SEQ ID NO: 166064 - DNA, 20 bp, human
gccggcccgcctctgcaagg

SEQ ID NO: 166065 - DNA, 20 bp, human
ggccgctgctgcccgccgtg

SEQ ID NO: 166066 - DNA, 20 bp, human
gcgtgctgccagcggacccg

SEQ ID NO: 166067 - DNA, 20 bp, human
ggagcggagcgtctgagcgc

SEQ ID NO: 166068 - DNA, 20 bp, human
gcccaggcccacgaaggctc

SEQ ID NO: 166069 - DNA, 20 bp, human
ggatccatcatcccccccac

SEQ ID NO: 166070 - DNA, 20 bp, human
ggcagcttcggtgacaaggt

SEQ ID NO: 166071 - DNA, 20 bp, human
gccagcagcgaggaggccgt

SEQ ID NO: 166072 - DNA, 20 bp, human
ggcccgcagcttcggtgaca

SEQ ID NO: 166073 - DNA, 20 bp, human
gatggatccggagccttcgt

SEQ ID NO: 166074 - DNA, 20 bp, human
ggggagtggggccccgtgga

SEQ ID NO: 166075 - DNA, 20 bp, human
ggccggcagagaccagccgg

SEQ ID NO: 166076 - DNA, 20 bp, human
ggcgctgggaacccgacctg

SEQ ID NO: 166077 - DNA, 20 bp, human
gagtgtcttgccagagtcag

SEQ ID NO: 166078 - DNA, 20 bp, human
gggaagcccgaggccgtgaa

SEQ ID NO: 166079 - DNA, 20 bp, human
gcgcgactcagagcgaaccc

SEQ ID NO: 166080 - DNA, 20 bp, human
gctgggaacccgacctgcgg

SEQ ID NO: 166081 - DNA, 20 bp, human
gccctgggcgcaccacgtag

SEQ ID NO: 166082 - DNA, 20 bp, human
ggctctgaactcggcagcgg

SEQ ID NO: 166083 - DNA, 20 bp, human
gctgcacggttggaacgaac

SEQ ID NO: 166084 - DNA, 20 bp, human
ggccggccggggacatctac

SEQ ID NO: 166085 - DNA, 20 bp, human
gcttatccctcggctcacca

SEQ ID NO: 166086 - DNA, 20 bp, human
gccgaggaactgaccgagtg

SEQ ID NO: 166087 - DNA, 20 bp, human
ggagttacggggacgacctg

SEQ ID NO: 166088 - DNA, 20 bp, human
gacgacctgcgggagcacgc

SEQ ID NO: 166089 - DNA, 20 bp, human
ggttcctcgggcgagttacg

SEQ ID NO: 166090 - DNA, 20 bp, human
gaggatgctctcagctgacg

SEQ ID NO: 166091 - DNA, 20 bp, human
gcgtccccgtaactcgcccg

SEQ ID NO: 166092 - DNA, 20 bp, human
gagctgagagcatcctcact

SEQ ID NO: 166093 - DNA, 20 bp, human
gacgtctccatcgctctcct

SEQ ID NO: 166094 - DNA, 20 bp, human
gccgcatgattgggcatcac

SEQ ID NO: 166095 - DNA, 20 bp, human
gactgcccgcgtgctcccgc

SEQ ID NO: 166096 - DNA, 20 bp, human
gctccgctccgccagcgaga

SEQ ID NO: 166097 - DNA, 20 bp, human
gtcctcaggacgccacctcc

SEQ ID NO: 166098 - DNA, 20 bp, human
gcccaaccccggaggaagga

SEQ ID NO: 166099 - DNA, 20 bp, human
gttggggctggccacttctg

SEQ ID NO: 166100 - DNA, 20 bp, human
gacgcgagggtggtgatcgg

SEQ ID NO: 166101 - DNA, 20 bp, human
ggccgggaaaacaaggactg

SEQ ID NO: 166102 - DNA, 20 bp, human
gggtctgcgagcgccgggga

SEQ ID NO: 166103 - DNA, 20 bp, human
gggagggtctgcgagcgccg

SEQ ID NO: 166104 - DNA, 20 bp, human
gtcagagcagggtcagcgtc

SEQ ID NO: 166105 - DNA, 20 bp, human
gtgccttctcgctggcggag

SEQ ID NO: 166106 - DNA, 20 bp, human
gctctggggtcgacacggtg

SEQ ID NO: 166107 - DNA, 20 bp, human
gtccggaggtgcctgctcca

SEQ ID NO: 166108 - DNA, 20 bp, human
gggcacctccggaccccgag

SEQ ID NO: 166109 - DNA, 20 bp, human
gctgctccatggctgcagtt

SEQ ID NO: 166110 - DNA, 20 bp, human
ggccatggagcaggcacctc

SEQ ID NO: 166111 - DNA, 20 bp, human
ggggagcccagcggctccaa

SEQ ID NO: 166112 - DNA, 20 bp, human
ggaagtgtcgagactgcgaa

SEQ ID NO: 166113 - DNA, 20 bp, human
ggcccccagcccagcgtctg

SEQ ID NO: 166114 - DNA, 20 bp, human
gcctcctcggccgagcccac

SEQ ID NO: 166115 - DNA, 20 bp, human
gcaggcgctgcgggtgactg

SEQ ID NO: 166116 - DNA, 20 bp, human
gcggcctccctgcccgacgg

SEQ ID NO: 166117 - DNA, 20 bp, human
gcgacacggacgggaagcaa

SEQ ID NO: 166118 - DNA, 20 bp, human
ggcagggccgcgacacggac

SEQ ID NO: 166119 - DNA, 20 bp, human
gcgtggagcggagcaagggt

SEQ ID NO: 166120 - DNA, 20 bp, human
gcaaccgcagggccgcgaca

SEQ ID NO: 166121 - DNA, 20 bp, human
gcttgctccgctccacgagg

SEQ ID NO: 166122 - DNA, 20 bp, human
gcagccttcagtgaagacca

SEQ ID NO: 166123 - DNA, 20 bp, human
gcatccacagggattccccg

SEQ ID NO: 166124 - DNA, 20 bp, human
gtggcggcctcctcgtggag

SEQ ID NO: 166125 - DNA, 20 bp, human
gcgacgcgggactcgagcag

SEQ ID NO: 166126 - DNA, 20 bp, human
gtcggagcagccatgatggt

SEQ ID NO: 166127 - DNA, 20 bp, human
gcggagaacacccaccatca

SEQ ID NO: 166128 - DNA, 20 bp, human
gcaccagaaggcccgaacag

SEQ ID NO: 166129 - DNA, 20 bp, human
gagccgagcggcccctaggg

SEQ ID NO: 166130 - DNA, 20 bp, human
gcgcctcggagcagccatga

SEQ ID NO: 166131 - DNA, 20 bp, human
gggtcccgcgagcgaaagga

SEQ ID NO: 166132 - DNA, 20 bp, human
gcggagccgagcggccccta

SEQ ID NO: 166133 - DNA, 20 bp, human
ggtgcagcgaggaaaccgaa

SEQ ID NO: 166134 - DNA, 20 bp, human
gcgcagcccttcctccctag

SEQ ID NO: 166135 - DNA, 20 bp, human
ggctgctccgaggcgagggc

SEQ ID NO: 166136 - DNA, 20 bp, human
gcggctgggcgcgcactctc

SEQ ID NO: 166137 - DNA, 20 bp, human
gcgcgcactctcgggatgga

SEQ ID NO: 166138 - DNA, 20 bp, human
gtgggcgcgcactctcggga

SEQ ID NO: 166139 - DNA, 20 bp, human
gcgaacggaaggtcaaagtg

SEQ ID NO: 166140 - DNA, 20 bp, human
gcatcgcaggcgccctcctc

SEQ ID NO: 166141 - DNA, 20 bp, human
gacggaaggtcaaagtgcgg

SEQ ID NO: 166142 - DNA, 20 bp, human
ggagtcccgggaaacttcca

SEQ ID NO: 166143 - DNA, 20 bp, human
gaagccacagccccgccgaa

SEQ ID NO: 166144 - DNA, 20 bp, human
gcacagccccgccgaacgga

SEQ ID NO: 166145 - DNA, 20 bp, human
gggagggcgcctgcgatgcc

SEQ ID NO: 166146 - DNA, 20 bp, human
ggagcagggcaccaggaacg

SEQ ID NO: 166147 - DNA, 20 bp, human
ggagcgcgggctcacatgac

SEQ ID NO: 166148 - DNA, 20 bp, human
ggctttcccggggctctcag

SEQ ID NO: 166149 - DNA, 20 bp, human
ggtcggggcggcagctgagg

SEQ ID NO: 166150 - DNA, 20 bp, human
ggccagctgtaacctggaca

SEQ ID NO: 166151 - DNA, 20 bp, human
gccgccccgactgcagccgc

SEQ ID NO: 166152 - DNA, 20 bp, human
ggggcagcgggtccatcgcg

SEQ ID NO: 166153 - DNA, 20 bp, human
gggctctcagaggcgtcctc

SEQ ID NO: 166154 - DNA, 20 bp, human
gagagcacggggacccccaa

SEQ ID NO: 166155 - DNA, 20 bp, human
ggacgaggaggcggatcccc

SEQ ID NO: 166156 - DNA, 20 bp, human
gggagtagccgagcgcccag

SEQ ID NO: 166157 - DNA, 20 bp, human
gcaggaactgcaggagcgtg

SEQ ID NO: 166158 - DNA, 20 bp, human
ggcctgagcgtcgagactcg

SEQ ID NO: 166159 - DNA, 20 bp, human
ggccgcgcaggcaaaggcaa

SEQ ID NO: 166160 - DNA, 20 bp, human
gtgggaggctcggccgacag

SEQ ID NO: 166161 - DNA, 20 bp, human
gagccgagcgcccagcggct

SEQ ID NO: 166162 - DNA, 20 bp, human
gacccatgcccagaagggac

SEQ ID NO: 166163 - DNA, 20 bp, human
gacgctcaggcccagccgct

SEQ ID NO: 166164 - DNA, 20 bp, human
gggcccagccagtcccttct

SEQ ID NO: 166165 - DNA, 20 bp, human
gaccaccaggatcgcaccgg

SEQ ID NO: 166166 - DNA, 20 bp, human
gcagcaggaaggtcgactcc

SEQ ID NO: 166167 - DNA, 20 bp, human
ggaagctctcctggcgccca

SEQ ID NO: 166168 - DNA, 20 bp, human
gaggcgacgttgcgggccct

SEQ ID NO: 166169 - DNA, 20 bp, human
gcgtcaggcgcccgggtcac

SEQ ID NO: 166170 - DNA, 20 bp, human
ggtgacgcagcggtgctcgg

SEQ ID NO: 166171 - DNA, 20 bp, human
gtcggaggcagggggcgtag

SEQ ID NO: 166172 - DNA, 20 bp, human
gtggtgttccgcaaatctcg

SEQ ID NO: 166173 - DNA, 20 bp, human
ggcgggcacttcggccaaga

SEQ ID NO: 166174 - DNA, 20 bp, human
gcgaggctcggcgactgcag

SEQ ID NO: 166175 - DNA, 20 bp, human
gccaagcgggaagcgaggag

SEQ ID NO: 166176 - DNA, 20 bp, human
ggccacactgcgaaggaagg

SEQ ID NO: 166177 - DNA, 20 bp, human
gaaggaggcaacacgggcaa

SEQ ID NO: 166178 - DNA, 20 bp, human
gactgggaacagggcactca

SEQ ID NO: 166179 - DNA, 20 bp, human
gcctatggcctcctcaccac

SEQ ID NO: 166180 - DNA, 20 bp, human
gtccatggtgcggtctccag

SEQ ID NO: 166181 - DNA, 20 bp, human
gcaggccacactgcgaagga

SEQ ID NO: 166182 - DNA, 20 bp, human
ggctgtcacctgagctgagt

SEQ ID NO: 166183 - DNA, 20 bp, human
gagtgggacaagagctctac

SEQ ID NO: 166184 - DNA, 20 bp, human
gcccgctggagaccgcacca

SEQ ID NO: 166185 - DNA, 20 bp, human
gggggcctggtgacattact

SEQ ID NO: 166186 - DNA, 20 bp, human
ggcatgggcgcggggagcaa

SEQ ID NO: 166187 - DNA, 20 bp, human
gtagcggcggaggacgtcag

SEQ ID NO: 166188 - DNA, 20 bp, human
gcaagggccggcgcggagag

SEQ ID NO: 166189 - DNA, 20 bp, human
gtcgctcggtccgtccgcat

SEQ ID NO: 166190 - DNA, 20 bp, human
gccaccaccaccgccggcgg

SEQ ID NO: 166191 - DNA, 20 bp, human
ggcagcaggagccggagcga

SEQ ID NO: 166192 - DNA, 20 bp, human
gagccgcgcacgcacgcccg

SEQ ID NO: 166193 - DNA, 20 bp, human
ggtcacgggtaaggatagtg

SEQ ID NO: 166194 - DNA, 20 bp, human
ggtgctgatggtggcgaggc

SEQ ID NO: 166195 - DNA, 20 bp, human
gcgggagagcgcgccagccc

SEQ ID NO: 166196 - DNA, 20 bp, human
gcccgccgggaagagctccg

SEQ ID NO: 166197 - DNA, 20 bp, human
gcgccgaacagagcgagctg

SEQ ID NO: 166198 - DNA, 20 bp, human
gggctctcgcgcatgctccg

SEQ ID NO: 166199 - DNA, 20 bp, human
gcggcggacccggccctagg

SEQ ID NO: 166200 - DNA, 20 bp, human
gtactccgcggagctcttcc

SEQ ID NO: 166201 - DNA, 20 bp, human
gctccgggcagcaccgagag

SEQ ID NO: 166202 - DNA, 20 bp, human
gaaatgggctctgtactccg

SEQ ID NO: 166203 - DNA, 20 bp, human
gcggatccgttcagcctcag

SEQ ID NO: 166204 - DNA, 20 bp, human
gtccgcggagctcttcccgg

SEQ ID NO: 166205 - DNA, 20 bp, human
gggccgcagctcgctctgtt

SEQ ID NO: 166206 - DNA, 20 bp, human
gcggcggctgcgacgagact

SEQ ID NO: 166207 - DNA, 20 bp, human
gctcggcgtctggaagtgtc

SEQ ID NO: 166208 - DNA, 20 bp, human
gcggcaggtaccggtagtgg

SEQ ID NO: 166209 - DNA, 20 bp, human
ggccccgaggcaccaacccg

SEQ ID NO: 166210 - DNA, 20 bp, human
ggaagagagagtccgaaccg

SEQ ID NO: 166211 - DNA, 20 bp, human
gagggtggctgcgggcgaga

SEQ ID NO: 166212 - DNA, 20 bp, human
ggccccgaggagagttaccg

SEQ ID NO: 166213 - DNA, 20 bp, human
gagcctcccgggcggagatg

SEQ ID NO: 166214 - DNA, 20 bp, human
gtccccggtaactctcctcg

SEQ ID NO: 166215 - DNA, 20 bp, human
gcggctgcgaccctggaggt

SEQ ID NO: 166216 - DNA, 20 bp, human
ggctgcgtgcggggccgaag

SEQ ID NO: 166217 - DNA, 20 bp, human
ggatggaagccggagatccc

SEQ ID NO: 166218 - DNA, 20 bp, human
gggggccgaagcggcagcag

SEQ ID NO: 166219 - DNA, 20 bp, human
ggcggccgtgaagtccacaa

SEQ ID NO: 166220 - DNA, 20 bp, human
ggcgctcgcgggtatatagg

SEQ ID NO: 166221 - DNA, 20 bp, human
gaagcggcagcagcggagca

SEQ ID NO: 166222 - DNA, 20 bp, human
gctccctgccgggaatgacc

SEQ ID NO: 166223 - DNA, 20 bp, human
gctccgcggcggctccgact

SEQ ID NO: 166224 - DNA, 20 bp, human
ggaggggtctcgctcagtcc

SEQ ID NO: 166225 - DNA, 20 bp, human
gcggagtattccgggaacct

SEQ ID NO: 166226 - DNA, 20 bp, human
ggcggaggcgatgaccgtga

SEQ ID NO: 166227 - DNA, 20 bp, human
gtacagaagcgacaaggtga

SEQ ID NO: 166228 - DNA, 20 bp, human
gcggttgcccgggcaaatca

SEQ ID NO: 166229 - DNA, 20 bp, human
gcgaaggatgccaagattag

SEQ ID NO: 166230 - DNA, 20 bp, human
gagggagctgaacacggaag

SEQ ID NO: 166231 - DNA, 20 bp, human
ggagctgaacacggaagtgg

SEQ ID NO: 166232 - DNA, 20 bp, human
gtcgcctccgccggttccct

SEQ ID NO: 166233 - DNA, 20 bp, human
gcgggcaaatcagggaggaa

SEQ ID NO: 166234 - DNA, 20 bp, human
gcgacaaggtgagggcacga

SEQ ID NO: 166235 - DNA, 20 bp, human
ggtggcggcgcccagggaac

SEQ ID NO: 166236 - DNA, 20 bp, human
gcgcggggcggcctcatcca

SEQ ID NO: 166237 - DNA, 20 bp, human
ggtgggagcttgcgcttagt

SEQ ID NO: 166238 - DNA, 20 bp, human
gagaccacgccgctcacagt

SEQ ID NO: 166239 - DNA, 20 bp, human
gcgggcactggggcaccgag

SEQ ID NO: 166240 - DNA, 20 bp, human
ggtccccgggctccgtccgg

SEQ ID NO: 166241 - DNA, 20 bp, human
gtcgtccggggccagtagga

SEQ ID NO: 166242 - DNA, 20 bp, human
gggtgaaggccgaaggaggg

SEQ ID NO: 166243 - DNA, 20 bp, human
ggccagcccatcccagccag

SEQ ID NO: 166244 - DNA, 20 bp, human
ggcactggggcaccgagagg

SEQ ID NO: 166245 - DNA, 20 bp, human
gggctctcgatgcatttctg

SEQ ID NO: 166246 - DNA, 20 bp, human
ggagctgcgggcaacaaagg

SEQ ID NO: 166247 - DNA, 20 bp, human
gtccccggacgcttacccgg

SEQ ID NO: 166248 - DNA, 20 bp, human
gggtcgagaagagccgtccg

SEQ ID NO: 166249 - DNA, 20 bp, human
gcgagaggagaaggcgagcg

SEQ ID NO: 166250 - DNA, 20 bp, human
gctgcgggcaacaaaggcgg

SEQ ID NO: 166251 - DNA, 20 bp, human
gcgcggccgaagaggccgag

SEQ ID NO: 166252 - DNA, 20 bp, human
ggtaagcgtccggggagctc

SEQ ID NO: 166253 - DNA, 20 bp, human
gccggacgcttacccggagg

SEQ ID NO: 166254 - DNA, 20 bp, human
gggcccgagtagtggacggg

SEQ ID NO: 166255 - DNA, 20 bp, human
ggcccgcgcacccgccgaga

SEQ ID NO: 166256 - DNA, 20 bp, human
gcgcggcctctgcctcatag

SEQ ID NO: 166257 - DNA, 20 bp, human
gccccccgcccccctctatg

SEQ ID NO: 166258 - DNA, 20 bp, human
ggctcgagcgccaagcccgg

SEQ ID NO: 166259 - DNA, 20 bp, human
gggcctctgcctcatagagg

SEQ ID NO: 166260 - DNA, 20 bp, human
gcccggagcgacagcgctaa

SEQ ID NO: 166261 - DNA, 20 bp, human
ggcccccctctatgaggcag

SEQ ID NO: 166262 - DNA, 20 bp, human
gctcaggacgcggtacgaag

SEQ ID NO: 166263 - DNA, 20 bp, human
gtgcggaacaccatcagctg

SEQ ID NO: 166264 - DNA, 20 bp, human
gcggcggccgacccacgttg

SEQ ID NO: 166265 - DNA, 20 bp, human
gggccgggccgcgcgaggaa

SEQ ID NO: 166266 - DNA, 20 bp, human
gctggcctataaagtagtcg

SEQ ID NO: 166267 - DNA, 20 bp, human
gggcgtggcctagcgagtta

SEQ ID NO: 166268 - DNA, 20 bp, human
gcaccacgacagacccgcgg

SEQ ID NO: 166269 - DNA, 20 bp, human
gaggcaccacgacagacccg

SEQ ID NO: 166270 - DNA, 20 bp, human
gctggttccgaggactgcaa

SEQ ID NO: 166271 - DNA, 20 bp, human
gggacgagcacagccgctcc

SEQ ID NO: 166272 - DNA, 20 bp, human
gcgccgccgcgggtctgtcg

SEQ ID NO: 166273 - DNA, 20 bp, human
gtaaagtagtcgcggagacg

SEQ ID NO: 166274 - DNA, 20 bp, human
gaccctcaggaacgagaaca

SEQ ID NO: 166275 - DNA, 20 bp, human
ggtagtctcctgcagcgtct

SEQ ID NO: 166276 - DNA, 20 bp, human
gggcgcaggagcggcactcg

SEQ ID NO: 166277 - DNA, 20 bp, human
gggcagggcctccgcggcaa

SEQ ID NO: 166278 - DNA, 20 bp, human
gagcggcttcagcagatcgg

SEQ ID NO: 166279 - DNA, 20 bp, human
gccagggcgccgtagtcgta

SEQ ID NO: 166280 - DNA, 20 bp, human
gagcagatcggcggcatcag

SEQ ID NO: 166281 - DNA, 20 bp, human
ggtagtcgtagggcaggtcg

SEQ ID NO: 166282 - DNA, 20 bp, human
gggcagcggcttcagcagat

SEQ ID NO: 166283 - DNA, 20 bp, human
ggcgttgatgtgaggttcca

SEQ ID NO: 166284 - DNA, 20 bp, human
gcccgcggcgctgactgacc

SEQ ID NO: 166285 - DNA, 20 bp, human
gtgatctgcgcgttgatgtg

SEQ ID NO: 166286 - DNA, 20 bp, human
gtctcttggaggagctggaa

SEQ ID NO: 166287 - DNA, 20 bp, human
gggagagaaagctctcttgg

SEQ ID NO: 166288 - DNA, 20 bp, human
gcaggaacgcaggctgtccc

SEQ ID NO: 166289 - DNA, 20 bp, human
ggcactcgcgctaacagccc

SEQ ID NO: 166290 - DNA, 20 bp, human
gtctggagtgacgagaaagg

SEQ ID NO: 166291 - DNA, 20 bp, human
gggtgtcgggagccacttat

SEQ ID NO: 166292 - DNA, 20 bp, human
gctgcgttcctgggctggct

SEQ ID NO: 166293 - DNA, 20 bp, human
gcctagaaggagctcttgct

SEQ ID NO: 166294 - DNA, 20 bp, human
ggagccacttatgggacagc

SEQ ID NO: 166295 - DNA, 20 bp, human
gctgctctgaggggttagtg

SEQ ID NO: 166296 - DNA, 20 bp, human
gctcacggccggacaagaag

SEQ ID NO: 166297 - DNA, 20 bp, human
ggcggtgtcggggccgaggt

SEQ ID NO: 166298 - DNA, 20 bp, human
gcagcgccgcgttctcctca

SEQ ID NO: 166299 - DNA, 20 bp, human
gcttggcacggaccccggtg

SEQ ID NO: 166300 - DNA, 20 bp, human
ggaccgcagccccggaccgg

SEQ ID NO: 166301 - DNA, 20 bp, human
gggacggggacgcggtgtcg

SEQ ID NO: 166302 - DNA, 20 bp, human
ggcacgccgatcgctccctc

SEQ ID NO: 166303 - DNA, 20 bp, human
gcggagcccgagggagcgat

SEQ ID NO: 166304 - DNA, 20 bp, human
gcgcagctcgctgaggccga

SEQ ID NO: 166305 - DNA, 20 bp, human
gagccggactcggagcccga

SEQ ID NO: 166306 - DNA, 20 bp, human
gtgtggacagcaaagagtgg

SEQ ID NO: 166307 - DNA, 20 bp, human
ggaatgcaccctgaatacag

SEQ ID NO: 166308 - DNA, 20 bp, human
gcctgcccacgactagcaca

SEQ ID NO: 166309 - DNA, 20 bp, human
gggtgtgggaaagtcagaat

SEQ ID NO: 166310 - DNA, 20 bp, human
gaatagcaggcgaggtcttg

SEQ ID NO: 166311 - DNA, 20 bp, human
ggaagtgggaatagcaggcg

SEQ ID NO: 166312 - DNA, 20 bp, human
gggcttggctgtagaatggg

SEQ ID NO: 166313 - DNA, 20 bp, human
gtttcagaagtgggaatagc

SEQ ID NO: 166314 - DNA, 20 bp, human
gcagactgtaggaggattag

SEQ ID NO: 166315 - DNA, 20 bp, human
gcagggtgatccatccggaa

SEQ ID NO: 166316 - DNA, 20 bp, human
ggattaagcacccagtgcta

SEQ ID NO: 166317 - DNA, 20 bp, human
gagacggggttcccggggtc

SEQ ID NO: 166318 - DNA, 20 bp, human
gcagcaccaggccccctccg

SEQ ID NO: 166319 - DNA, 20 bp, human
gcccctccgtggagaaaaga

SEQ ID NO: 166320 - DNA, 20 bp, human
gggttagtaaacaactccag

SEQ ID NO: 166321 - DNA, 20 bp, human
gagcagccaaccaaacccag

SEQ ID NO: 166322 - DNA, 20 bp, human
ggtcttagtcgccttagcac

SEQ ID NO: 166323 - DNA, 20 bp, human
gaccacaaggctcagttggt

SEQ ID NO: 166324 - DNA, 20 bp, human
gaataaccacaaggctcagt

SEQ ID NO: 166325 - DNA, 20 bp, human
ggtgaagtctgcagttcaca

SEQ ID NO: 166326 - DNA, 20 bp, human
gggtgcggctgcgacgaagg

SEQ ID NO: 166327 - DNA, 20 bp, human
gccaggggctggcgagggaa

SEQ ID NO: 166328 - DNA, 20 bp, human
ggggtgcagacgagcctcag

SEQ ID NO: 166329 - DNA, 20 bp, human
gcatctcaagaaggagcggg

SEQ ID NO: 166330 - DNA, 20 bp, human
gcgggcaaaaccccaggaac

SEQ ID NO: 166331 - DNA, 20 bp, human
ggtcgcctccgcctccccaa

SEQ ID NO: 166332 - DNA, 20 bp, human
ggttttgcccgcagaagagg

SEQ ID NO: 166333 - DNA, 20 bp, human
gcgcccgccagcatccgagg

SEQ ID NO: 166334 - DNA, 20 bp, human
ggccacccggtccccagtgg

SEQ ID NO: 166335 - DNA, 20 bp, human
ggaggctcgtctgcacccgg

SEQ ID NO: 166336 - DNA, 20 bp, human
gtgctccgagccctacccgg

SEQ ID NO: 166337 - DNA, 20 bp, human
gttctggagacctccgggta

SEQ ID NO: 166338 - DNA, 20 bp, human
gggaccctcggccaccgtag

SEQ ID NO: 166339 - DNA, 20 bp, human
gtagggattctggagacctc

SEQ ID NO: 166340 - DNA, 20 bp, human
ggagtcctcgcagcaggaga

SEQ ID NO: 166341 - DNA, 20 bp, human
gcggtgctccgagccctacc

SEQ ID NO: 166342 - DNA, 20 bp, human
gggcccgcccaaggccccta

SEQ ID NO: 166343 - DNA, 20 bp, human
gcttgcatcccctgacggta

SEQ ID NO: 166344 - DNA, 20 bp, human
ggcaggagagggcaccagac

SEQ ID NO: 166345 - DNA, 20 bp, human
gccgtcaggggatgcaagtg

SEQ ID NO: 166346 - DNA, 20 bp, human
ggcgcacgtgctgggtcctg

SEQ ID NO: 166347 - DNA, 20 bp, human
gcgagatctggcagtgctcc

SEQ ID NO: 166348 - DNA, 20 bp, human
gggacccagcacgtgcgcag

SEQ ID NO: 166349 - DNA, 20 bp, human
gtcttacctggcccgagatc

SEQ ID NO: 166350 - DNA, 20 bp, human
gtgctcctggcagataattg

SEQ ID NO: 166351 - DNA, 20 bp, human
gcaggtaagaggctgtggaa

SEQ ID NO: 166352 - DNA, 20 bp, human
gagggcctggtggcacccgg

SEQ ID NO: 166353 - DNA, 20 bp, human
gtcattgtcggggaactgtg

SEQ ID NO: 166354 - DNA, 20 bp, human
ggcaccctcagaagccgggt

SEQ ID NO: 166355 - DNA, 20 bp, human
ggtggactcgcgtcctggaa

SEQ ID NO: 166356 - DNA, 20 bp, human
gcgcagtcgttccccggctc

SEQ ID NO: 166357 - DNA, 20 bp, human
ggcctggaggactagcgagg

SEQ ID NO: 166358 - DNA, 20 bp, human
gaggagttgagagaacggag

SEQ ID NO: 166359 - DNA, 20 bp, human
ggggcctacgagtagctaaa

SEQ ID NO: 166360 - DNA, 20 bp, human
ggcaggggggacccaaacag

SEQ ID NO: 166361 - DNA, 20 bp, human
gaaggaactaggcccgtccc

SEQ ID NO: 166362 - DNA, 20 bp, human
gaatccgcggaggcgagagg

SEQ ID NO: 166363 - DNA, 20 bp, human
gccgtccctggcggacaacc

SEQ ID NO: 166364 - DNA, 20 bp, human
gcaccggccggcaaaatccg

SEQ ID NO: 166365 - DNA, 20 bp, human
gcggccggcaaaatccgcgg

SEQ ID NO: 166366 - DNA, 20 bp, human
gatgggccaaatgctcttgt

SEQ ID NO: 166367 - DNA, 20 bp, human
ggctccagcgccacagctga

SEQ ID NO: 166368 - DNA, 20 bp, human
gccagtgcctactacaacac

SEQ ID NO: 166369 - DNA, 20 bp, human
ggaacctcctgtagtatcaa

SEQ ID NO: 166370 - DNA, 20 bp, human
gtgcttctttgactttttag

SEQ ID NO: 166371 - DNA, 20 bp, human
gcctcctgtagtatcaatgg

SEQ ID NO: 166372 - DNA, 20 bp, human
gacaactgcaggggattcat

SEQ ID NO: 166373 - DNA, 20 bp, human
ggacgaaatctcatgatgat

SEQ ID NO: 166374 - DNA, 20 bp, human
gtacttttagacttgaaaga

SEQ ID NO: 166375 - DNA, 20 bp, human
gtctttgtcatggatggttc

SEQ ID NO: 166376 - DNA, 20 bp, human
ggcgtgtagtgcgagtgggg

SEQ ID NO: 166377 - DNA, 20 bp, human
ggcagcgtgtagtgcgagtg

SEQ ID NO: 166378 - DNA, 20 bp, human
gatgtccgcccgtctcaggg

SEQ ID NO: 166379 - DNA, 20 bp, human
gccccagagcatccccccat

SEQ ID NO: 166380 - DNA, 20 bp, human
ggcccgcccggcgaccagca

SEQ ID NO: 166381 - DNA, 20 bp, human
gcagggtgcggaggatctgg

SEQ ID NO: 166382 - DNA, 20 bp, human
gtaccttgctggtcgccggg

SEQ ID NO: 166383 - DNA, 20 bp, human
gattgcagccaccctgagac

SEQ ID NO: 166384 - DNA, 20 bp, human
gtcctccgagcgcggaacaa

SEQ ID NO: 166385 - DNA, 20 bp, human
gagaatgtccgcccgtctca

SEQ ID NO: 166386 - DNA, 20 bp, human
gagaatagcttgggagggtc

SEQ ID NO: 166387 - DNA, 20 bp, human
ggtcaaagaatagcttggga

SEQ ID NO: 166388 - DNA, 20 bp, human
gcggatgtcaaagaatagct

SEQ ID NO: 166389 - DNA, 20 bp, human
ggtctctggattccacgctc

SEQ ID NO: 166390 - DNA, 20 bp, human
gggactctcgccacggttaa

SEQ ID NO: 166391 - DNA, 20 bp, human
gcagccgagttatccagcca

SEQ ID NO: 166392 - DNA, 20 bp, human
gcagggaaggactctcgcca

SEQ ID NO: 166393 - DNA, 20 bp, human
ggctgtgcgggagacaaggc

SEQ ID NO: 166394 - DNA, 20 bp, human
gaatccagagactaataaca

SEQ ID NO: 166395 - DNA, 20 bp, human
gacggttaacggcatcttta

SEQ ID NO: 166396 - DNA, 20 bp, human
ggctggctgaccaagtccac

SEQ ID NO: 166397 - DNA, 20 bp, human
gtgggcagccaagacaataa

SEQ ID NO: 166398 - DNA, 20 bp, human
gtcccctggaatgcagacct

SEQ ID NO: 166399 - DNA, 20 bp, human
ggcccaggtctgcattccag

SEQ ID NO: 166400 - DNA, 20 bp, human
gagccgggagaaggaagccg

SEQ ID NO: 166401 - DNA, 20 bp, human
ggcttgtgccagccgggaga

SEQ ID NO: 166402 - DNA, 20 bp, human
gccaagacaataagggatag

SEQ ID NO: 166403 - DNA, 20 bp, human
ggaactaacgataaagtgtg

SEQ ID NO: 166404 - DNA, 20 bp, human
gatataagaatgtaaagtca

SEQ ID NO: 166405 - DNA, 20 bp, human
gagagaaggcttgtgccagc

SEQ ID NO: 166406 - DNA, 20 bp, human
ggaatacagcaggagcatct

SEQ ID NO: 166407 - DNA, 20 bp, human
ggtagcaccacccagcagct

SEQ ID NO: 166408 - DNA, 20 bp, human
gcaacagttgctctatacag

SEQ ID NO: 166409 - DNA, 20 bp, human
ggttgaactcagctgcctgt

SEQ ID NO: 166410 - DNA, 20 bp, human
ggtccaatccaagtgtctga

SEQ ID NO: 166411 - DNA, 20 bp, human
ggggaaagaatcccagctgc

SEQ ID NO: 166412 - DNA, 20 bp, human
gaataaaaaatcttacctac

SEQ ID NO: 166413 - DNA, 20 bp, human
gtcagcattaacagcagccg

SEQ ID NO: 166414 - DNA, 20 bp, human
gcagccggggttgtctgcaa

SEQ ID NO: 166415 - DNA, 20 bp, human
gcggtgttccagaatacagc

SEQ ID NO: 166416 - DNA, 20 bp, human
gaacggcgccccgcagagag

SEQ ID NO: 166417 - DNA, 20 bp, human
ggccgttcccgcgccaccga

SEQ ID NO: 166418 - DNA, 20 bp, human
gcgggaagtaggacatcctg

SEQ ID NO: 166419 - DNA, 20 bp, human
gcgggtcctgggctctccac

SEQ ID NO: 166420 - DNA, 20 bp, human
ggtccctccgacctaggaag

SEQ ID NO: 166421 - DNA, 20 bp, human
gctgcggtccctcccggaca

SEQ ID NO: 166422 - DNA, 20 bp, human
gaccgggcggaacccaggta

SEQ ID NO: 166423 - DNA, 20 bp, human
gaggagttagctgccctcgg

SEQ ID NO: 166424 - DNA, 20 bp, human
gcggctgccgctgggtcccg

SEQ ID NO: 166425 - DNA, 20 bp, human
gcgagtcgctgcgcggggaa

SEQ ID NO: 166426 - DNA, 20 bp, human
gacaggggacgcactacgag

SEQ ID NO: 166427 - DNA, 20 bp, human
ggatagcgctcggtccccgg

SEQ ID NO: 166428 - DNA, 20 bp, human
ggtgccccgagcccgctcca

SEQ ID NO: 166429 - DNA, 20 bp, human
ggagcgtgcagcaaccgcca

SEQ ID NO: 166430 - DNA, 20 bp, human
gggcactggggcatccatgg

SEQ ID NO: 166431 - DNA, 20 bp, human
ggacgcactacgaggggcag

SEQ ID NO: 166432 - DNA, 20 bp, human
gtgccgagcgcgggtccgga

SEQ ID NO: 166433 - DNA, 20 bp, human
ggctcggcctcgacccctag

SEQ ID NO: 166434 - DNA, 20 bp, human
gtcgcgggagcgaagagcag

SEQ ID NO: 166435 - DNA, 20 bp, human
gggtcccagaacgaaggtgg

SEQ ID NO: 166436 - DNA, 20 bp, human
gcgcggccgggagagcagga

SEQ ID NO: 166437 - DNA, 20 bp, human
gggagagcaggagggcgctg

SEQ ID NO: 166438 - DNA, 20 bp, human
gggtgcgccatggtcgccag

SEQ ID NO: 166439 - DNA, 20 bp, human
gcgagcgagagcgcagagaa

SEQ ID NO: 166440 - DNA, 20 bp, human
gtcctcgccgggaccaggag

SEQ ID NO: 166441 - DNA, 20 bp, human
gtccccactatggtcatcag

SEQ ID NO: 166442 - DNA, 20 bp, human
gggcgcggacgaggggaccg

SEQ ID NO: 166443 - DNA, 20 bp, human
ggcggggcggcgcggacgag

SEQ ID NO: 166444 - DNA, 20 bp, human
gcagcgccggtagcccgcgg

SEQ ID NO: 166445 - DNA, 20 bp, human
gggacgaggggaccgcggcc

SEQ ID NO: 166446 - DNA, 20 bp, human
gggtagccgcagcgggatgg

SEQ ID NO: 166447 - DNA, 20 bp, human
ggaagccggagggacatcac

SEQ ID NO: 166448 - DNA, 20 bp, human
gcgcgttcctgggtgattgg

SEQ ID NO: 166449 - DNA, 20 bp, human
gcagctcctgccaagcttgg

SEQ ID NO: 166450 - DNA, 20 bp, human
ggacccacgtcgacaagagt

SEQ ID NO: 166451 - DNA, 20 bp, human
gggagccccgtccggacaag

SEQ ID NO: 166452 - DNA, 20 bp, human
gctccggccgatggttccag

SEQ ID NO: 166453 - DNA, 20 bp, human
gggcgcgaggaggagtcgcc

SEQ ID NO: 166454 - DNA, 20 bp, human
gcggcttcctctggaaccat

SEQ ID NO: 166455 - DNA, 20 bp, human
ggaaccatcggccggagcag

SEQ ID NO: 166456 - DNA, 20 bp, human
gggagaagcgccgcacgcag

SEQ ID NO: 166457 - DNA, 20 bp, human
gcacggggctaggttccggg

SEQ ID NO: 166458 - DNA, 20 bp, human
ggtgtgggggcagcaggtag

SEQ ID NO: 166459 - DNA, 20 bp, human
gggtggcgctacccagccga

SEQ ID NO: 166460 - DNA, 20 bp, human
gctggaaggcgcgggacgtt

SEQ ID NO: 166461 - DNA, 20 bp, human
ggaagcgccgcacgcagggg

SEQ ID NO: 166462 - DNA, 20 bp, human
gagccgagggtccagggcac

SEQ ID NO: 166463 - DNA, 20 bp, human
gggacgtttggtcgctctgg

SEQ ID NO: 166464 - DNA, 20 bp, human
gcggaacctagccccgtggc

SEQ ID NO: 166465 - DNA, 20 bp, human
gctctggagtgcggcctgga

SEQ ID NO: 166466 - DNA, 20 bp, human
gcgaccagggtgaataggaa

SEQ ID NO: 166467 - DNA, 20 bp, human
gcttcgcagagagctccggg

SEQ ID NO: 166468 - DNA, 20 bp, human
gcagtgcgaccagggtgaat

SEQ ID NO: 166469 - DNA, 20 bp, human
gagtggtgcctgcacctagg

SEQ ID NO: 166470 - DNA, 20 bp, human
gcccagtggtgcctgcacct

SEQ ID NO: 166471 - DNA, 20 bp, human
gcgaaccgagcgggacctgg

SEQ ID NO: 166472 - DNA, 20 bp, human
gggcggcagcagtgcgacca

SEQ ID NO: 166473 - DNA, 20 bp, human
ggcagtcgcctcctaggtgc

SEQ ID NO: 166474 - DNA, 20 bp, human
gctgcaacggatggatgcgg

SEQ ID NO: 166475 - DNA, 20 bp, human
gagtagcgttcgcccgaaca

SEQ ID NO: 166476 - DNA, 20 bp, human
gcctggctgagggtcgacgg

SEQ ID NO: 166477 - DNA, 20 bp, human
gcggcaggtgtcggcgtcgg

SEQ ID NO: 166478 - DNA, 20 bp, human
gcggcgtcggcggcattcgg

SEQ ID NO: 166479 - DNA, 20 bp, human
gtgcgccccgcgactcccgg

SEQ ID NO: 166480 - DNA, 20 bp, human
gcggcgatggagcggccctg

SEQ ID NO: 166481 - DNA, 20 bp, human
ggcattcggcggcgatggag

SEQ ID NO: 166482 - DNA, 20 bp, human
ggcagggctggggtctcctc

SEQ ID NO: 166483 - DNA, 20 bp, human
ggccatggggccagcgcgag

SEQ ID NO: 166484 - DNA, 20 bp, human
gggtcctggctgagggtcga

SEQ ID NO: 166485 - DNA, 20 bp, human
gcggcgcgctgcgacgccaa

SEQ ID NO: 166486 - DNA, 20 bp, human
gggaagctccagcgctacac

SEQ ID NO: 166487 - DNA, 20 bp, human
gtccagcgctacaccggcgg

SEQ ID NO: 166488 - DNA, 20 bp, human
gcggccgcggcggcacctca

SEQ ID NO: 166489 - DNA, 20 bp, human
gagctccagcgctacaccgg

SEQ ID NO: 166490 - DNA, 20 bp, human
gctggccacccacccgacac

SEQ ID NO: 166491 - DNA, 20 bp, human
gccgcccagaggcgccccgg

SEQ ID NO: 166492 - DNA, 20 bp, human
ggggccgcgtccgttctcca

SEQ ID NO: 166493 - DNA, 20 bp, human
ggagctcgcagcgcggaaca

SEQ ID NO: 166494 - DNA, 20 bp, human
ggctggtacctgtgtcgggt

SEQ ID NO: 166495 - DNA, 20 bp, human
ggcaggttcagttcgctagt

SEQ ID NO: 166496 - DNA, 20 bp, human
gccagcgccgccgggaaagg

SEQ ID NO: 166497 - DNA, 20 bp, human
gcacagggctcgagtccccg

SEQ ID NO: 166498 - DNA, 20 bp, human
ggcaggtcgtccctcccaca

SEQ ID NO: 166499 - DNA, 20 bp, human
ggacagcgcctccgcatcgg

SEQ ID NO: 166500 - DNA, 20 bp, human
gggaggagccgccccagaag

SEQ ID NO: 166501 - DNA, 20 bp, human
gctgcggaaggtcagtgcta

SEQ ID NO: 166502 - DNA, 20 bp, human
gctgtggaggtgactcgagt

SEQ ID NO: 166503 - DNA, 20 bp, human
gccgcaagcccgggcgaccc

SEQ ID NO: 166504 - DNA, 20 bp, human
ggccccccgagcttctaacg

SEQ ID NO: 166505 - DNA, 20 bp, human
gccgcgggctgcccccgatg

SEQ ID NO: 166506 - DNA, 20 bp, human
gcatggtaccagccagagga

SEQ ID NO: 166507 - DNA, 20 bp, human
gagcaggcagacgagacaca

SEQ ID NO: 166508 - DNA, 20 bp, human
gcagagcctgtgctactgga

SEQ ID NO: 166509 - DNA, 20 bp, human
gaaggtggcgtgccctcctc

SEQ ID NO: 166510 - DNA, 20 bp, human
ggctgcatggtaccagccag

SEQ ID NO: 166511 - DNA, 20 bp, human
gtggcgtgccctcctctggc

SEQ ID NO: 166512 - DNA, 20 bp, human
gcccctggccctccactaca

SEQ ID NO: 166513 - DNA, 20 bp, human
gctggtctccagccgagaca

SEQ ID NO: 166514 - DNA, 20 bp, human
gtgggaggcttggaagactg

SEQ ID NO: 166515 - DNA, 20 bp, human
gccttcaaattcaggtgcag

SEQ ID NO: 166516 - DNA, 20 bp, human
ggaggaagcatggtgagtag

SEQ ID NO: 166517 - DNA, 20 bp, human
gtataaagggaagcttgagg

SEQ ID NO: 166518 - DNA, 20 bp, human
gactttaaaatcactaccta

SEQ ID NO: 166519 - DNA, 20 bp, human
gcagtaacactggactggat

SEQ ID NO: 166520 - DNA, 20 bp, human
gttcattaggatgcatgcaa

SEQ ID NO: 166521 - DNA, 20 bp, human
gggagatagaaatgaatggc

SEQ ID NO: 166522 - DNA, 20 bp, human
gtgtgaataaaggatttctg

SEQ ID NO: 166523 - DNA, 20 bp, human
gcgttgaatcaagccagaaa

SEQ ID NO: 166524 - DNA, 20 bp, human
gaatgaacgccaaacctcta

SEQ ID NO: 166525 - DNA, 20 bp, human
gaacctctatggatatataa

SEQ ID NO: 166526 - DNA, 20 bp, human
gcccattggacagaatacaa

SEQ ID NO: 166527 - DNA, 20 bp, human
gggtcgccggcatcgagcag

SEQ ID NO: 166528 - DNA, 20 bp, human
gcggtggtgaaggagctcga

SEQ ID NO: 166529 - DNA, 20 bp, human
ggatggaagcaggcgcccat

SEQ ID NO: 166530 - DNA, 20 bp, human
gccgagacgccccggcccag

SEQ ID NO: 166531 - DNA, 20 bp, human
gatcgagcagcggcttgaag

SEQ ID NO: 166532 - DNA, 20 bp, human
ggttgacgaactgcttgaag

SEQ ID NO: 166533 - DNA, 20 bp, human
gcgccgggccccggccttcg

SEQ ID NO: 166534 - DNA, 20 bp, human
gcagttcgtcaacaacgtgg

SEQ ID NO: 166535 - DNA, 20 bp, human
gggaacccagggccccacca

SEQ ID NO: 166536 - DNA, 20 bp, human
gcggcagtctgcgtgagaga

SEQ ID NO: 166537 - DNA, 20 bp, human
gagaggctagagtcgcgcag

SEQ ID NO: 166538 - DNA, 20 bp, human
gaccgccgcgagctcttcaa

SEQ ID NO: 166539 - DNA, 20 bp, human
ggtgagagagggcggctccg

SEQ ID NO: 166540 - DNA, 20 bp, human
gggctagagtcgcgcagggg

SEQ ID NO: 166541 - DNA, 20 bp, human
ggcccttgaagagctcgcgg

SEQ ID NO: 166542 - DNA, 20 bp, human
gaccgactcggccctatccc

SEQ ID NO: 166543 - DNA, 20 bp, human
gtgtgaggactcgttgcgag

SEQ ID NO: 166544 - DNA, 20 bp, human
gcccgacggcaccaagtacg

SEQ ID NO: 166545 - DNA, 20 bp, human
gtcccgggatagggccgagt

SEQ ID NO: 166546 - DNA, 20 bp, human
gcatagcgacgggctcccag

SEQ ID NO: 166547 - DNA, 20 bp, human
gcagctcgcggccctgtcca

SEQ ID NO: 166548 - DNA, 20 bp, human
gcctctggcctcagacgcgt

SEQ ID NO: 166549 - DNA, 20 bp, human
gtcccgacggcggcggagtc

SEQ ID NO: 166550 - DNA, 20 bp, human
gcggagtctggcgggctcag

SEQ ID NO: 166551 - DNA, 20 bp, human
ggtacgtgcacctcaagaag

SEQ ID NO: 166552 - DNA, 20 bp, human
gttcgcggcgggtccccgga

SEQ ID NO: 166553 - DNA, 20 bp, human
gaggcggtggccgagtcctc

SEQ ID NO: 166554 - DNA, 20 bp, human
ggacggcggcggagtctggc

SEQ ID NO: 166555 - DNA, 20 bp, human
gtggcctcagacgcgtaggc

SEQ ID NO: 166556 - DNA, 20 bp, human
gtcccgttggggcccgggaa

SEQ ID NO: 166557 - DNA, 20 bp, human
gaccatggcccagctcggag

SEQ ID NO: 166558 - DNA, 20 bp, human
gtgcccttcccgggccccaa

SEQ ID NO: 166559 - DNA, 20 bp, human
ggccccaacgggagaggaac

SEQ ID NO: 166560 - DNA, 20 bp, human
gggcagctaacgctggacac

SEQ ID NO: 166561 - DNA, 20 bp, human
gcgggaagggcagctaacgc

SEQ ID NO: 166562 - DNA, 20 bp, human
gggcggcagcttcaagacca

SEQ ID NO: 166563 - DNA, 20 bp, human
gaggctgtgcctggaaccgc

SEQ ID NO: 166564 - DNA, 20 bp, human
ggaatccacgcgtgctcccg

SEQ ID NO: 166565 - DNA, 20 bp, human
ggagcggacactggtagcct

SEQ ID NO: 166566 - DNA, 20 bp, human
ggccaaggccaaccaggacc

SEQ ID NO: 166567 - DNA, 20 bp, human
ggagcatagacggccggggt

SEQ ID NO: 166568 - DNA, 20 bp, human
gtcagcggcctccaactcgg

SEQ ID NO: 166569 - DNA, 20 bp, human
gtcctgcgctcggtcctcag

SEQ ID NO: 166570 - DNA, 20 bp, human
gttcagacggagtgagacgg

SEQ ID NO: 166571 - DNA, 20 bp, human
gtcaccggcaccgcgaggag

SEQ ID NO: 166572 - DNA, 20 bp, human
ggaggctgcaacttctagca

SEQ ID NO: 166573 - DNA, 20 bp, human
ggggcggctggcgggttcac

SEQ ID NO: 166574 - DNA, 20 bp, human
ggtcctagcggagagaagaa

SEQ ID NO: 166575 - DNA, 20 bp, human
ggttgcagcctccgagttgg

SEQ ID NO: 166576 - DNA, 20 bp, human
ggccagggtggttggtggta

SEQ ID NO: 166577 - DNA, 20 bp, human
gctcaggccacggcctcgtt

SEQ ID NO: 166578 - DNA, 20 bp, human
gggccacggcctcgttagga

SEQ ID NO: 166579 - DNA, 20 bp, human
gggacctctcctccagtctg

SEQ ID NO: 166580 - DNA, 20 bp, human
gaacctccacccaaaaaagg

SEQ ID NO: 166581 - DNA, 20 bp, human
gcccaaccgtctcttggtgt

SEQ ID NO: 166582 - DNA, 20 bp, human
ggtctcgggctgtccggcca

SEQ ID NO: 166583 - DNA, 20 bp, human
gagagacggttgggaccagg

SEQ ID NO: 166584 - DNA, 20 bp, human
gtggttggtggtaaggattc

SEQ ID NO: 166585 - DNA, 20 bp, human
gtcagtcgctcagtcagtct

SEQ ID NO: 166586 - DNA, 20 bp, human
gagcccgggacccctctctc

SEQ ID NO: 166587 - DNA, 20 bp, human
gtgcggtaggagccacgagc

SEQ ID NO: 166588 - DNA, 20 bp, human
gcgcgcgcctgggagagctc

SEQ ID NO: 166589 - DNA, 20 bp, human
gccggaccccgagctctccc

SEQ ID NO: 166590 - DNA, 20 bp, human
ggcggtcgcgacaggagagg

SEQ ID NO: 166591 - DNA, 20 bp, human
gaggcgctggacacggagga

SEQ ID NO: 166592 - DNA, 20 bp, human
gggacgagagcgacccagac

SEQ ID NO: 166593 - DNA, 20 bp, human
ggctgcggtcgcgacaggag

SEQ ID NO: 166594 - DNA, 20 bp, human
ggacccctctctccggctcg

SEQ ID NO: 166595 - DNA, 20 bp, human
ggggcaagttgcaaagtcct

SEQ ID NO: 166596 - DNA, 20 bp, human
gcgccaccgctaccaccggg

SEQ ID NO: 166597 - DNA, 20 bp, human
ggcccccccggtggtagcgg

SEQ ID NO: 166598 - DNA, 20 bp, human
ggcgcgagggccaagcggga

SEQ ID NO: 166599 - DNA, 20 bp, human
gccgcgcaaaaagagcaagg

SEQ ID NO: 166600 - DNA, 20 bp, human
gcccgcccccccggtggtag

SEQ ID NO: 166601 - DNA, 20 bp, human
gggcccccggcggcgtctag

SEQ ID NO: 166602 - DNA, 20 bp, human
gcacgaacggcggaagatca

SEQ ID NO: 166603 - DNA, 20 bp, human
ggggccgtccgcatcctccg

SEQ ID NO: 166604 - DNA, 20 bp, human
gggtgtggtcgcagcacgaa

SEQ ID NO: 166605 - DNA, 20 bp, human
ggcggaagatcatggaccag

SEQ ID NO: 166606 - DNA, 20 bp, human
ggactggagaagggcgctcg

SEQ ID NO: 166607 - DNA, 20 bp, human
gttcagttccaagccgggac

SEQ ID NO: 166608 - DNA, 20 bp, human
gggagacggccgcaagccca

SEQ ID NO: 166609 - DNA, 20 bp, human
gaggcgactggacagcctag

SEQ ID NO: 166610 - DNA, 20 bp, human
ggacagcctagaggagaaag

SEQ ID NO: 166611 - DNA, 20 bp, human
gtggaacccgggcccagaac

SEQ ID NO: 166612 - DNA, 20 bp, human
gtgagagccgaagagcaggg

SEQ ID NO: 166613 - DNA, 20 bp, human
gcgcagagcaggaccgcgga

SEQ ID NO: 166614 - DNA, 20 bp, human
gagcacgggtcctggaaccc

SEQ ID NO: 166615 - DNA, 20 bp, human
gtgggtccgcagcgactccc

SEQ ID NO: 166616 - DNA, 20 bp, human
ggcagctccgggaaagccac

SEQ ID NO: 166617 - DNA, 20 bp, human
gtcgtggctcccccttcccg

SEQ ID NO: 166618 - DNA, 20 bp, human
gcgaggggagcgcagaaccc

SEQ ID NO: 166619 - DNA, 20 bp, human
gctccgggaaagccacggga

SEQ ID NO: 166620 - DNA, 20 bp, human
gatggtcccggcggctaggt

SEQ ID NO: 166621 - DNA, 20 bp, human
ggcagaaccccggctcagga

SEQ ID NO: 166622 - DNA, 20 bp, human
ggccccgggggagcgagtgg

SEQ ID NO: 166623 - DNA, 20 bp, human
gtcccggcggctaggtgggt

SEQ ID NO: 166624 - DNA, 20 bp, human
gctgcagacgagcctgggcg

SEQ ID NO: 166625 - DNA, 20 bp, human
gggctaggtgggtgggggta

SEQ ID NO: 166626 - DNA, 20 bp, human
gctggcagctgtcggaactc

SEQ ID NO: 166627 - DNA, 20 bp, human
gcagcagccgtggcagccgg

SEQ ID NO: 166628 - DNA, 20 bp, human
gtggggtcccgaagatgagg

SEQ ID NO: 166629 - DNA, 20 bp, human
gaggagcctggtagcgccat

SEQ ID NO: 166630 - DNA, 20 bp, human
gacagctgccaggcgcggat

SEQ ID NO: 166631 - DNA, 20 bp, human
ggttgggagaagccttaaga

SEQ ID NO: 166632 - DNA, 20 bp, human
ggtgccggggcaccagacag

SEQ ID NO: 166633 - DNA, 20 bp, human
gaactccggagaccacaaag

SEQ ID NO: 166634 - DNA, 20 bp, human
gtaaggcttctcccaaccca

SEQ ID NO: 166635 - DNA, 20 bp, human
ggcctggtagcgccatgggt

SEQ ID NO: 166636 - DNA, 20 bp, human
gccgcgacaggccagaacac

SEQ ID NO: 166637 - DNA, 20 bp, human
gcgacaggccagaacacggg

SEQ ID NO: 166638 - DNA, 20 bp, human
gcaagggcgagtcccgtatc

SEQ ID NO: 166639 - DNA, 20 bp, human
ggggcgagtcccgtatccgg

SEQ ID NO: 166640 - DNA, 20 bp, human
ggcctgacgcccaaaaccag

SEQ ID NO: 166641 - DNA, 20 bp, human
ggcgaggcgccggcgaacag

SEQ ID NO: 166642 - DNA, 20 bp, human
ggccatgagcagcccggatg

SEQ ID NO: 166643 - DNA, 20 bp, human
gctggtctacagcgtaccca

SEQ ID NO: 166644 - DNA, 20 bp, human
ggtctggctctggtcgtcac

SEQ ID NO: 166645 - DNA, 20 bp, human
gcgtccggcggagggttgag

SEQ ID NO: 166646 - DNA, 20 bp, human
gaggccgggagggcggatgg

SEQ ID NO: 166647 - DNA, 20 bp, human
gcggatggcggtggggacgg

SEQ ID NO: 166648 - DNA, 20 bp, human
gtgctgggtgagcggcggga

SEQ ID NO: 166649 - DNA, 20 bp, human
ggcgaggccgcgcgtgtcag

SEQ ID NO: 166650 - DNA, 20 bp, human
gagacgagtcgcgcatccgg

SEQ ID NO: 166651 - DNA, 20 bp, human
gcgggagggcggatggcggt

SEQ ID NO: 166652 - DNA, 20 bp, human
gggccgcggggaacgccagg

SEQ ID NO: 166653 - DNA, 20 bp, human
gcaagatgctgggtgagcgg

SEQ ID NO: 166654 - DNA, 20 bp, human
ggccttcatggtgtgggcaa

SEQ ID NO: 166655 - DNA, 20 bp, human
ggcatgggccccgggacacg

SEQ ID NO: 166656 - DNA, 20 bp, human
ggcccgcagcaaacttcggg

SEQ ID NO: 166657 - DNA, 20 bp, human
gggcggcggcaactccaccg

SEQ ID NO: 166658 - DNA, 20 bp, human
gcggcaggatcggccagagg

SEQ ID NO: 166659 - DNA, 20 bp, human
gctcagtcctagtcttaaag

SEQ ID NO: 166660 - DNA, 20 bp, human
gagagaggcaaactggaatc

SEQ ID NO: 166661 - DNA, 20 bp, human
gacagcccccgtcacatgga

SEQ ID NO: 166662 - DNA, 20 bp, human
ggggctccgcgaggaaaatc

SEQ ID NO: 166663 - DNA, 20 bp, human
gcggccgggccgagggtcgg

SEQ ID NO: 166664 - DNA, 20 bp, human
gaagtttgctgcgggcccgg

SEQ ID NO: 166665 - DNA, 20 bp, human
gcggcggcaggatcggccag

SEQ ID NO: 166666 - DNA, 20 bp, human
gtgctgccaagtgccaaagg

SEQ ID NO: 166667 - DNA, 20 bp, human
gggcacttggcagcacgcgg

SEQ ID NO: 166668 - DNA, 20 bp, human
gcggccgagcgggtctccgc

SEQ ID NO: 166669 - DNA, 20 bp, human
gagccgctgagagccccctt

SEQ ID NO: 166670 - DNA, 20 bp, human
ggcccggaggaaatcaatgt

SEQ ID NO: 166671 - DNA, 20 bp, human
ggcgtgctgccaagtgccaa

SEQ ID NO: 166672 - DNA, 20 bp, human
gggacactctaacttctcgg

SEQ ID NO: 166673 - DNA, 20 bp, human
ggctcctcggctcaacttcg

SEQ ID NO: 166674 - DNA, 20 bp, human
gactcctcgaagttgagccg

SEQ ID NO: 166675 - DNA, 20 bp, human
ggtccccaaaagttgcgtcg

SEQ ID NO: 166676 - DNA, 20 bp, human
gcaaatcagcaggaacccgc

SEQ ID NO: 166677 - DNA, 20 bp, human
gccagcgagtccggcgggaa

SEQ ID NO: 166678 - DNA, 20 bp, human
gccggcggcgcgaactcggg

SEQ ID NO: 166679 - DNA, 20 bp, human
ggcggtggtgcgagcggagg

SEQ ID NO: 166680 - DNA, 20 bp, human
gctgttcgagagaactcatc

SEQ ID NO: 166681 - DNA, 20 bp, human
gtcaggtgcgagaagcccgc

SEQ ID NO: 166682 - DNA, 20 bp, human
gggtggcgggggtacagacc

SEQ ID NO: 166683 - DNA, 20 bp, human
ggtagggacacccacacaag

SEQ ID NO: 166684 - DNA, 20 bp, human
gagaaggctgtacattgccg

SEQ ID NO: 166685 - DNA, 20 bp, human
ggcagcggtggtgcgagcgg

SEQ ID NO: 166686 - DNA, 20 bp, human
gagtgcggcggctcctacca

SEQ ID NO: 166687 - DNA, 20 bp, human
gtggctgccgcgctcagtgt

SEQ ID NO: 166688 - DNA, 20 bp, human
gcgctcagtgtgggagacga

SEQ ID NO: 166689 - DNA, 20 bp, human
gaaatgtgcaacaagtgcgg

SEQ ID NO: 166690 - DNA, 20 bp, human
ggtcctcgaatcacctgcca

SEQ ID NO: 166691 - DNA, 20 bp, human
gtcagcacgaggcgagagta

SEQ ID NO: 166692 - DNA, 20 bp, human
gtcgaatcacctgccatggt

SEQ ID NO: 166693 - DNA, 20 bp, human
gcagtgtgggagacgacgga

SEQ ID NO: 166694 - DNA, 20 bp, human
gcgaaaatgtgcaacaagtg

SEQ ID NO: 166695 - DNA, 20 bp, human
gcccgtggacggccaatcac

SEQ ID NO: 166696 - DNA, 20 bp, human
gaacgcgccgggtctcacca

SEQ ID NO: 166697 - DNA, 20 bp, human
ggcgccgggtctcaccacgg

SEQ ID NO: 166698 - DNA, 20 bp, human
gacatgcgtgcagagtccgg

SEQ ID NO: 166699 - DNA, 20 bp, human
gcatccgccgtggtgagacc

SEQ ID NO: 166700 - DNA, 20 bp, human
gagcgaggcaccacttatag

SEQ ID NO: 166701 - DNA, 20 bp, human
ggtgcagagtccggcggcca

SEQ ID NO: 166702 - DNA, 20 bp, human
gacgcggtaatattgtccct

SEQ ID NO: 166703 - DNA, 20 bp, human
gaggtctgaagacccagcac

SEQ ID NO: 166704 - DNA, 20 bp, human
gcctggcccacccctataag

SEQ ID NO: 166705 - DNA, 20 bp, human
gtgtccctcggcatccgccg

SEQ ID NO: 166706 - DNA, 20 bp, human
gggccgcgagaaacttgcat

SEQ ID NO: 166707 - DNA, 20 bp, human
gagaccgtgctaaagtagag

SEQ ID NO: 166708 - DNA, 20 bp, human
gagagacccgacagcgaaac

SEQ ID NO: 166709 - DNA, 20 bp, human
ggaggcgcgaggcggaattg

SEQ ID NO: 166710 - DNA, 20 bp, human
gggaatcggcactaaggagt

SEQ ID NO: 166711 - DNA, 20 bp, human
ggactctctgtgggcggaat

SEQ ID NO: 166712 - DNA, 20 bp, human
ggtgggcggaatcggcacta

SEQ ID NO: 166713 - DNA, 20 bp, human
gagaggcctgtttcgctgtc

SEQ ID NO: 166714 - DNA, 20 bp, human
ggctctttaagagtctgcac

SEQ ID NO: 166715 - DNA, 20 bp, human
ggaagggagctggtaatggc

SEQ ID NO: 166716 - DNA, 20 bp, human
gaggagacgtaaaatggcgt

SEQ ID NO: 166717 - DNA, 20 bp, human
gttacgtctccttcactgaa

SEQ ID NO: 166718 - DNA, 20 bp, human
gcagtgaaggagacgtaaaa

SEQ ID NO: 166719 - DNA, 20 bp, human
ggcccccgtcttgtaaaaag

SEQ ID NO: 166720 - DNA, 20 bp, human
ggccaccagtgtccaccctc

SEQ ID NO: 166721 - DNA, 20 bp, human
gtcccctttttacaagacgg

SEQ ID NO: 166722 - DNA, 20 bp, human
ggccgccctgttataaaatc

SEQ ID NO: 166723 - DNA, 20 bp, human
gtgtccagaggctttaaaac

SEQ ID NO: 166724 - DNA, 20 bp, human
ggtgtaaacatggagaaatt

SEQ ID NO: 166725 - DNA, 20 bp, human
gggacactggtggcaggtta

SEQ ID NO: 166726 - DNA, 20 bp, human
gagactggtcaaggagtcct

SEQ ID NO: 166727 - DNA, 20 bp, human
gttcagttggagacgatcat

SEQ ID NO: 166728 - DNA, 20 bp, human
gagttggagacgatcatagg

SEQ ID NO: 166729 - DNA, 20 bp, human
gttgcagaagccctagctaa

SEQ ID NO: 166730 - DNA, 20 bp, human
gccctttaagagactggtca

SEQ ID NO: 166731 - DNA, 20 bp, human
gaaactcctgaggtaaatca

SEQ ID NO: 166732 - DNA, 20 bp, human
gctcacttgacaggttcagt

SEQ ID NO: 166733 - DNA, 20 bp, human
gtccttgaccagtctcttaa

SEQ ID NO: 166734 - DNA, 20 bp, human
gaggtttggactcacttgac

SEQ ID NO: 166735 - DNA, 20 bp, human
gcactacccctttaagagac

SEQ ID NO: 166736 - DNA, 20 bp, human
gtctgcttccccatacggag

SEQ ID NO: 166737 - DNA, 20 bp, human
gctggtcaaaaagtgagtgt

SEQ ID NO: 166738 - DNA, 20 bp, human
ggcgaccagcctctccgtat

SEQ ID NO: 166739 - DNA, 20 bp, human
gggtcgcttggaagacatcc

SEQ ID NO: 166740 - DNA, 20 bp, human
ggcttggaagacatcctgga

SEQ ID NO: 166741 - DNA, 20 bp, human
gcaagggaaggtgaaaggct

SEQ ID NO: 166742 - DNA, 20 bp, human
gctccatctgcttccccata

SEQ ID NO: 166743 - DNA, 20 bp, human
gacatgcaagggaaggtgaa

SEQ ID NO: 166744 - DNA, 20 bp, human
gatcctggaaggaacaaaag

SEQ ID NO: 166745 - DNA, 20 bp, human
gacttctcagcacaatacaa

SEQ ID NO: 166746 - DNA, 20 bp, human
ggctgcacaggcaaatggag

SEQ ID NO: 166747 - DNA, 20 bp, human
ggcctgtgcagctgatggag

SEQ ID NO: 166748 - DNA, 20 bp, human
gttataatgaggacattcta

SEQ ID NO: 166749 - DNA, 20 bp, human
gtcccttgaggttaaatcct

SEQ ID NO: 166750 - DNA, 20 bp, human
gagatcatgaaacaactacc

SEQ ID NO: 166751 - DNA, 20 bp, human
gggagaggatgcaatgaccc

SEQ ID NO: 166752 - DNA, 20 bp, human
gggcagtggtcagattttaa

SEQ ID NO: 166753 - DNA, 20 bp, human
ggaatggtactgacaagtgt

SEQ ID NO: 166754 - DNA, 20 bp, human
gaatggagaggtggcttgct

SEQ ID NO: 166755 - DNA, 20 bp, human
gggaatgcatttagtggcag

SEQ ID NO: 166756 - DNA, 20 bp, human
ggagaatagggctcaattgt

SEQ ID NO: 166757 - DNA, 20 bp, human
gacatcttctctatgggcat

SEQ ID NO: 166758 - DNA, 20 bp, human
gttgtctcacatcttctcta

SEQ ID NO: 166759 - DNA, 20 bp, human
gcatagagaaaagtaccagc

SEQ ID NO: 166760 - DNA, 20 bp, human
gtgtgcatatttgtaagtat

SEQ ID NO: 166761 - DNA, 20 bp, human
gctgcattgtgttatttcac

SEQ ID NO: 166762 - DNA, 20 bp, human
ggcaatttaccagtgatttc

SEQ ID NO: 166763 - DNA, 20 bp, human
gatcttactctttgagaata

SEQ ID NO: 166764 - DNA, 20 bp, human
gataacttctgatagtcttc

SEQ ID NO: 166765 - DNA, 20 bp, human
gttctttaaacttattataa

SEQ ID NO: 166766 - DNA, 20 bp, human
gagtcaggtgaaacaggagt

SEQ ID NO: 166767 - DNA, 20 bp, human
gcagcccctaagtcaggtga

SEQ ID NO: 166768 - DNA, 20 bp, human
gtctagccagcccctaagtc

SEQ ID NO: 166769 - DNA, 20 bp, human
gatgataaaatcccgtagag

SEQ ID NO: 166770 - DNA, 20 bp, human
gcagtttagtcaggtgaaac

SEQ ID NO: 166771 - DNA, 20 bp, human
ggttccatcacctgacttag

SEQ ID NO: 166772 - DNA, 20 bp, human
gtgtgggccatcaaatctct

SEQ ID NO: 166773 - DNA, 20 bp, human
gttctgggagttcaggaaga

SEQ ID NO: 166774 - DNA, 20 bp, human
gttggtccttctgggagttc

SEQ ID NO: 166775 - DNA, 20 bp, human
gggaagctctctaatgtgtt

SEQ ID NO: 166776 - DNA, 20 bp, human
gcctcgccggcggactgcag

SEQ ID NO: 166777 - DNA, 20 bp, human
gcgcagtcacccaggtccag

SEQ ID NO: 166778 - DNA, 20 bp, human
gcagtccgggaccccacaaa

SEQ ID NO: 166779 - DNA, 20 bp, human
gcgcgcacggcagcccggag

SEQ ID NO: 166780 - DNA, 20 bp, human
gcccgtccgctgcagtccgc

SEQ ID NO: 166781 - DNA, 20 bp, human
gtgcgtaactccctcgccgg

SEQ ID NO: 166782 - DNA, 20 bp, human
ggtgggtgaagcaaccagtc

SEQ ID NO: 166783 - DNA, 20 bp, human
gacgcacgtcctgattctcc

SEQ ID NO: 166784 - DNA, 20 bp, human
gacgtgcgtaactccctcgc

SEQ ID NO: 166785 - DNA, 20 bp, human
gctgggtgactgcggccact

SEQ ID NO: 166786 - DNA, 20 bp, human
gccgtgtcgcaggtgctcaa

SEQ ID NO: 166787 - DNA, 20 bp, human
gcgccgccgcgcaccggcat

SEQ ID NO: 166788 - DNA, 20 bp, human
gtcatgggccgcttcacatg

SEQ ID NO: 166789 - DNA, 20 bp, human
ggccaccgcgcggcgacctc

SEQ ID NO: 166790 - DNA, 20 bp, human
gacccgaggtcgccgcgcgg

SEQ ID NO: 166791 - DNA, 20 bp, human
gcgcagtccgagaccagggg

SEQ ID NO: 166792 - DNA, 20 bp, human
gcacctgcgacacggcgtcg

SEQ ID NO: 166793 - DNA, 20 bp, human
gggaggtggtggccacacgc

SEQ ID NO: 166794 - DNA, 20 bp, human
gccacgagggtgcacacccc

SEQ ID NO: 166795 - DNA, 20 bp, human
ggggtcccggagcgaccgca

SEQ ID NO: 166796 - DNA, 20 bp, human
gtgaccgacgagcaggagaa

SEQ ID NO: 166797 - DNA, 20 bp, human
gggagtcctcggacatggtg

SEQ ID NO: 166798 - DNA, 20 bp, human
gggagttggagagccgaaag

SEQ ID NO: 166799 - DNA, 20 bp, human
ggtccgagccggagcccgac

SEQ ID NO: 166800 - DNA, 20 bp, human
gagcggagctcgaaactgac

SEQ ID NO: 166801 - DNA, 20 bp, human
gagcaggagaagggcctgtc

SEQ ID NO: 166802 - DNA, 20 bp, human
gccatgtccgaggactccgc

SEQ ID NO: 166803 - DNA, 20 bp, human
gccgcggcgagcacttagga

SEQ ID NO: 166804 - DNA, 20 bp, human
gggcgagcccgcggagtcct

SEQ ID NO: 166805 - DNA, 20 bp, human
gagccggagcccgacgggca

SEQ ID NO: 166806 - DNA, 20 bp, human
ggactcatccttaccgctca

SEQ ID NO: 166807 - DNA, 20 bp, human
gggcgatccccgccgtgaag

SEQ ID NO: 166808 - DNA, 20 bp, human
ggcaggcggcgaccagaggg

SEQ ID NO: 166809 - DNA, 20 bp, human
gaaaaacgcggacgctgacg

SEQ ID NO: 166810 - DNA, 20 bp, human
gcggcgggaggagcctcagg

SEQ ID NO: 166811 - DNA, 20 bp, human
ggggggggccgggaaaaacg

SEQ ID NO: 166812 - DNA, 20 bp, human
gagcgaacccggaccggaca

SEQ ID NO: 166813 - DNA, 20 bp, human
gacccggaccggacagggag

SEQ ID NO: 166814 - DNA, 20 bp, human
gtggagcaggcggcgaccag

SEQ ID NO: 166815 - DNA, 20 bp, human
ggaggcaagcgaacccggac

SEQ ID NO: 166816 - DNA, 20 bp, human
gggccgactgaggggctcag

SEQ ID NO: 166817 - DNA, 20 bp, human
ggcaggctgggccgactgag

SEQ ID NO: 166818 - DNA, 20 bp, human
gcaggccccaagcaggaagt

SEQ ID NO: 166819 - DNA, 20 bp, human
gaaagggttcacagatcatg

SEQ ID NO: 166820 - DNA, 20 bp, human
gtaaacatagcagttgttgg

SEQ ID NO: 166821 - DNA, 20 bp, human
gctctaaacatagcagttgt

SEQ ID NO: 166822 - DNA, 20 bp, human
ggcaatatagccagagataa

SEQ ID NO: 166823 - DNA, 20 bp, human
gtcggccgacttcctgcttg

SEQ ID NO: 166824 - DNA, 20 bp, human
gcatagcagttgttggtggc

SEQ ID NO: 166825 - DNA, 20 bp, human
gtgctatgtttagagtgtcc

SEQ ID NO: 166826 - DNA, 20 bp, human
gcaagattgggagagttaca

SEQ ID NO: 166827 - DNA, 20 bp, human
ggggatcactcctcaagatt

SEQ ID NO: 166828 - DNA, 20 bp, human
gcgttcctgcccctttccag

SEQ ID NO: 166829 - DNA, 20 bp, human
gcttcagtgcccgcaatagg

SEQ ID NO: 166830 - DNA, 20 bp, human
gaggatcagagcttaggtga

SEQ ID NO: 166831 - DNA, 20 bp, human
gagatgctagcaggcaaaac

SEQ ID NO: 166832 - DNA, 20 bp, human
gtaaatgactagaggtactt

SEQ ID NO: 166833 - DNA, 20 bp, human
gccattgtgtaaatgactag

SEQ ID NO: 166834 - DNA, 20 bp, human
gctctcagagctcagacatg

SEQ ID NO: 166835 - DNA, 20 bp, human
gcactgaaggatcagagctt

SEQ ID NO: 166836 - DNA, 20 bp, human
gtctttgactgagcaccgag

SEQ ID NO: 166837 - DNA, 20 bp, human
ggaagctgccaactgcccct

SEQ ID NO: 166838 - DNA, 20 bp, human
gccagagatgaaggacagac

SEQ ID NO: 166839 - DNA, 20 bp, human
gctacacaaagcctcagaac

SEQ ID NO: 166840 - DNA, 20 bp, human
ggggcagtgaaaatcgaatc

SEQ ID NO: 166841 - DNA, 20 bp, human
gcatctgcaaatggctggac

SEQ ID NO: 166842 - DNA, 20 bp, human
gctgtccttcatctctggta

SEQ ID NO: 166843 - DNA, 20 bp, human
gagagggttcagaggtcacg

SEQ ID NO: 166844 - DNA, 20 bp, human
gggaaccctaccagagatga

SEQ ID NO: 166845 - DNA, 20 bp, human
gtggctgttggagaaactca

SEQ ID NO: 166846 - DNA, 20 bp, human
gggccgactggggagctcat

SEQ ID NO: 166847 - DNA, 20 bp, human
ggacacccaggcagggccta

SEQ ID NO: 166848 - DNA, 20 bp, human
gggcctatgagctccccagt

SEQ ID NO: 166849 - DNA, 20 bp, human
ggacttcctgctccgggtca

SEQ ID NO: 166850 - DNA, 20 bp, human
ggcacgcaggctgggccgac

SEQ ID NO: 166851 - DNA, 20 bp, human
ggagggcagagggatgtgaa

SEQ ID NO: 166852 - DNA, 20 bp, human
gcagagggatgtgaaagggt

SEQ ID NO: 166853 - DNA, 20 bp, human
gggtaggtagtgtaatataa

SEQ ID NO: 166854 - DNA, 20 bp, human
gtgagggtgagtcagtctgt

SEQ ID NO: 166855 - DNA, 20 bp, human
gtcggccgacttcctgctcc

SEQ ID NO: 166856 - DNA, 20 bp, human
ggggaagaccccgccggcag

SEQ ID NO: 166857 - DNA, 20 bp, human
gaggaagatgtcgtaatgag

SEQ ID NO: 166858 - DNA, 20 bp, human
gagacacggggcgaacacaa

SEQ ID NO: 166859 - DNA, 20 bp, human
gggtgtcaggctctcggtgg

SEQ ID NO: 166860 - DNA, 20 bp, human
ggcctcctcagagccgaccc

SEQ ID NO: 166861 - DNA, 20 bp, human
gccccaagggtcaggaagac

SEQ ID NO: 166862 - DNA, 20 bp, human
gaggaaggcctctcagacac

SEQ ID NO: 166863 - DNA, 20 bp, human
ggcctgggcgaactatgcct

SEQ ID NO: 166864 - DNA, 20 bp, human
gtatgcctgggtcggctctg

SEQ ID NO: 166865 - DNA, 20 bp, human
gacccaggcatagttcgccc

SEQ ID NO: 166866 - DNA, 20 bp, human
gtagcggccagcagagcgag

SEQ ID NO: 166867 - DNA, 20 bp, human
gccatcgccgggcgacgacg

SEQ ID NO: 166868 - DNA, 20 bp, human
gtcgccgggcgacgacgagg

SEQ ID NO: 166869 - DNA, 20 bp, human
gccagcagagcgagcggtga

SEQ ID NO: 166870 - DNA, 20 bp, human
ggagcgttggcgcctcgggc

SEQ ID NO: 166871 - DNA, 20 bp, human
gctctgaacccgcccattgg

SEQ ID NO: 166872 - DNA, 20 bp, human
gagagcaggaaagggcgccc

SEQ ID NO: 166873 - DNA, 20 bp, human
gatgaagtctgagagggcgg

SEQ ID NO: 166874 - DNA, 20 bp, human
ggtgtcctacccccaatggg

SEQ ID NO: 166875 - DNA, 20 bp, human
gctggcttcagatccaaacc

SEQ ID NO: 166876 - DNA, 20 bp, human
gcctgttaatgcgggatgag

SEQ ID NO: 166877 - DNA, 20 bp, human
gcgagtcagccgggctcggg

SEQ ID NO: 166878 - DNA, 20 bp, human
ggcccgcggtggctcggagg

SEQ ID NO: 166879 - DNA, 20 bp, human
gaggaggctgtagctggcac

SEQ ID NO: 166880 - DNA, 20 bp, human
gcggccattcgcggaaaaag

SEQ ID NO: 166881 - DNA, 20 bp, human
gcagagcaacacccagaagg

SEQ ID NO: 166882 - DNA, 20 bp, human
ggaggcggcgaaggagactg

SEQ ID NO: 166883 - DNA, 20 bp, human
gcccgcccgcggtggctcgg

SEQ ID NO: 166884 - DNA, 20 bp, human
gcgccgccgctgtcaatcaa

SEQ ID NO: 166885 - DNA, 20 bp, human
gtgctctggagccgatgggt

SEQ ID NO: 166886 - DNA, 20 bp, human
gcaccacgggaggtcgtcgg

SEQ ID NO: 166887 - DNA, 20 bp, human
ggcgcggcgaggggcaaggg

SEQ ID NO: 166888 - DNA, 20 bp, human
ggaccggcgagaactcgtag

SEQ ID NO: 166889 - DNA, 20 bp, human
ggcagagccgccatgctcga

SEQ ID NO: 166890 - DNA, 20 bp, human
gcctgcgggatgctccacca

SEQ ID NO: 166891 - DNA, 20 bp, human
gtggatccgggattgttcgg

SEQ ID NO: 166892 - DNA, 20 bp, human
gcgggttgggtgacaactgg

SEQ ID NO: 166893 - DNA, 20 bp, human
gagcccagcgcggggtcgta

SEQ ID NO: 166894 - DNA, 20 bp, human
gtcagggccgagcccggagg

SEQ ID NO: 166895 - DNA, 20 bp, human
gggcccccgacgacctcccg

SEQ ID NO: 166896 - DNA, 20 bp, human
gcgagagggcggaggacgga

SEQ ID NO: 166897 - DNA, 20 bp, human
ggagcgactgggacaaccag

SEQ ID NO: 166898 - DNA, 20 bp, human
gcagggcgagccagacccgg

SEQ ID NO: 166899 - DNA, 20 bp, human
gactagccggtgatccagag

SEQ ID NO: 166900 - DNA, 20 bp, human
ggagagcgcgggtgagtcac

SEQ ID NO: 166901 - DNA, 20 bp, human
ggcgccggcgagctctccag

SEQ ID NO: 166902 - DNA, 20 bp, human
gccgaggaggctggaaaccg

SEQ ID NO: 166903 - DNA, 20 bp, human
gagagaggcagagccgaatg

SEQ ID NO: 166904 - DNA, 20 bp, human
gcgatggagggaaaactggg

SEQ ID NO: 166905 - DNA, 20 bp, human
gccgctcccaaggccatagg

SEQ ID NO: 166906 - DNA, 20 bp, human
ggatccctcccagcaccctc

SEQ ID NO: 166907 - DNA, 20 bp, human
gtgccgcccgccgctgctga

SEQ ID NO: 166908 - DNA, 20 bp, human
gcgagcagcagcaaggactc

SEQ ID NO: 166909 - DNA, 20 bp, human
gcacgcggcagcagtcccat

SEQ ID NO: 166910 - DNA, 20 bp, human
gaggactctggagtcagagt

SEQ ID NO: 166911 - DNA, 20 bp, human
gggagtcagagtaggactgt

SEQ ID NO: 166912 - DNA, 20 bp, human
gcccaaagaagggatcaggg

SEQ ID NO: 166913 - DNA, 20 bp, human
ggaaggctccagatccaatg

SEQ ID NO: 166914 - DNA, 20 bp, human
gtgtaggaccggagcctgag

SEQ ID NO: 166915 - DNA, 20 bp, human
gcagtcccataggcatctgt

SEQ ID NO: 166916 - DNA, 20 bp, human
gggctggacgcaggtctccc

SEQ ID NO: 166917 - DNA, 20 bp, human
gcgtacctgcgagacaaggc

SEQ ID NO: 166918 - DNA, 20 bp, human
ggagggagctacaattgtgg

SEQ ID NO: 166919 - DNA, 20 bp, human
ggcgcaggaaaaggttcgaa

SEQ ID NO: 166920 - DNA, 20 bp, human
gaaaaagatcctctgagagg

SEQ ID NO: 166921 - DNA, 20 bp, human
gatggcaacttcacttctag

SEQ ID NO: 166922 - DNA, 20 bp, human
gttacaggcaccgatttcgg

SEQ ID NO: 166923 - DNA, 20 bp, human
gataaaaaagatcctctgag

SEQ ID NO: 166924 - DNA, 20 bp, human
gagtcgccccggccaggcca

SEQ ID NO: 166925 - DNA, 20 bp, human
gtagagagactgatagcccg

SEQ ID NO: 166926 - DNA, 20 bp, human
gaatttttcgttatggcttc

SEQ ID NO: 166927 - DNA, 20 bp, human
gctatggccacgtctatact

SEQ ID NO: 166928 - DNA, 20 bp, human
gctcgtgccgagcggactcc

SEQ ID NO: 166929 - DNA, 20 bp, human
gcgggagcctggagtccgct

SEQ ID NO: 166930 - DNA, 20 bp, human
gatggggtataaatcacgag

SEQ ID NO: 166931 - DNA, 20 bp, human
gaaactgcttgggtcccgcg

SEQ ID NO: 166932 - DNA, 20 bp, human
gaatccccaaagcaatgcgg

SEQ ID NO: 166933 - DNA, 20 bp, human
ggcgggtgctcctcgcactt

SEQ ID NO: 166934 - DNA, 20 bp, human
gtccccgcgctcgtgccgag

SEQ ID NO: 166935 - DNA, 20 bp, human
gtccgctcggcacgagcgcg

SEQ ID NO: 166936 - DNA, 20 bp, human
gaccagctcggagagaaagg

SEQ ID NO: 166937 - DNA, 20 bp, human
ggaaaaacaaccggaaccgg

SEQ ID NO: 166938 - DNA, 20 bp, human
gggcaccagctcggagagaa

SEQ ID NO: 166939 - DNA, 20 bp, human
gctaggtcttggtatcggag

SEQ ID NO: 166940 - DNA, 20 bp, human
gctgagggagcagtagatgg

SEQ ID NO: 166941 - DNA, 20 bp, human
gggcagacgggtctagtcgg

SEQ ID NO: 166942 - DNA, 20 bp, human
gaagggaaaaggctaggtct

SEQ ID NO: 166943 - DNA, 20 bp, human
gatgaggctcagactatgga

SEQ ID NO: 166944 - DNA, 20 bp, human
gaaaggctaggtcttggtat

SEQ ID NO: 166945 - DNA, 20 bp, human
gggaaccggcggcaccagct

SEQ ID NO: 166946 - DNA, 20 bp, human
gcaagaaagggacaaactcg

SEQ ID NO: 166947 - DNA, 20 bp, human
gcgagaaccatgagccccag

SEQ ID NO: 166948 - DNA, 20 bp, human
gctgtcctcaggagccgcgg

SEQ ID NO: 166949 - DNA, 20 bp, human
gggccacaggatgcaagaaa

SEQ ID NO: 166950 - DNA, 20 bp, human
gcgaggcgcagtcgccgccg

SEQ ID NO: 166951 - DNA, 20 bp, human
gtacctgtcctcaggagccg

SEQ ID NO: 166952 - DNA, 20 bp, human
gggagcagcccgtgcccctg

SEQ ID NO: 166953 - DNA, 20 bp, human
gcggccccgacggccgtccg

SEQ ID NO: 166954 - DNA, 20 bp, human
ggcctggcccacgaaggcga

SEQ ID NO: 166955 - DNA, 20 bp, human
gtcatggttctcggccccga

SEQ ID NO: 166956 - DNA, 20 bp, human
gccccgcagagctgagacca

SEQ ID NO: 166957 - DNA, 20 bp, human
ggacatcttgagctgaagca

SEQ ID NO: 166958 - DNA, 20 bp, human
gaaggaggaggcagccaacc

SEQ ID NO: 166959 - DNA, 20 bp, human
gtatccctaagttgtagagg

SEQ ID NO: 166960 - DNA, 20 bp, human
ggaaagggggctcactgatc

SEQ ID NO: 166961 - DNA, 20 bp, human
gtaatatccctaagttgtag

SEQ ID NO: 166962 - DNA, 20 bp, human
gacaaggtggtggttagggt

SEQ ID NO: 166963 - DNA, 20 bp, human
gtttcaattgctgagaggat

SEQ ID NO: 166964 - DNA, 20 bp, human
gctccttctcactcccctcg

SEQ ID NO: 166965 - DNA, 20 bp, human
gtctcagcaattgaaaggtg

SEQ ID NO: 166966 - DNA, 20 bp, human
gcgcagggcgttgggaacag

SEQ ID NO: 166967 - DNA, 20 bp, human
gcaggacttagagggacgca

SEQ ID NO: 166968 - DNA, 20 bp, human
gaggaacccgtcagctacag

SEQ ID NO: 166969 - DNA, 20 bp, human
gctggtccggtcatcaacaa

SEQ ID NO: 166970 - DNA, 20 bp, human
gcggccggtgcagcagttgg

SEQ ID NO: 166971 - DNA, 20 bp, human
gggtgcagcagttggtggtg

SEQ ID NO: 166972 - DNA, 20 bp, human
gtccctctaagtcctgggga

SEQ ID NO: 166973 - DNA, 20 bp, human
gaccagggccaaagtcccgt

SEQ ID NO: 166974 - DNA, 20 bp, human
gtgacgcccctgtagctgac

SEQ ID NO: 166975 - DNA, 20 bp, human
gcactccaggcgctgaccct

SEQ ID NO: 166976 - DNA, 20 bp, human
gagcagcaaaaggacacggt

SEQ ID NO: 166977 - DNA, 20 bp, human
gcctggagcagtgacgtcac

SEQ ID NO: 166978 - DNA, 20 bp, human
gtgtttacttagttatgcag

SEQ ID NO: 166979 - DNA, 20 bp, human
gacacggtgggcacgccatc

SEQ ID NO: 166980 - DNA, 20 bp, human
ggtcactgctccaggccaga

SEQ ID NO: 166981 - DNA, 20 bp, human
ggaggggaagtgcccaacta

SEQ ID NO: 166982 - DNA, 20 bp, human
gaattggtgtctgaagtctt

SEQ ID NO: 166983 - DNA, 20 bp, human
gagggcagcaacagagttgc

SEQ ID NO: 166984 - DNA, 20 bp, human
ggtgggcacgccatctggcc

SEQ ID NO: 166985 - DNA, 20 bp, human
gagcagtgacgtcaccggca

SEQ ID NO: 166986 - DNA, 20 bp, human
ggtgccccaggccttcatta

SEQ ID NO: 166987 - DNA, 20 bp, human
ggtgccataatgaaggcctg

SEQ ID NO: 166988 - DNA, 20 bp, human
gtggagcaagtcacctggga

SEQ ID NO: 166989 - DNA, 20 bp, human
ggtcacctgggagggcttac

SEQ ID NO: 166990 - DNA, 20 bp, human
gagtctggagcaagtcacct

SEQ ID NO: 166991 - DNA, 20 bp, human
ggtattcatgatggtaacag

SEQ ID NO: 166992 - DNA, 20 bp, human
gaggcctggagaggtgataa

SEQ ID NO: 166993 - DNA, 20 bp, human
gtctggtgagacatcagtga

SEQ ID NO: 166994 - DNA, 20 bp, human
gcagtcagggagtgactcaa

SEQ ID NO: 166995 - DNA, 20 bp, human
gggcctgggtctgaatgtgg

SEQ ID NO: 166996 - DNA, 20 bp, human
gcctgagggtgaatacacga

SEQ ID NO: 166997 - DNA, 20 bp, human
gcggcggcctcttctcccat

SEQ ID NO: 166998 - DNA, 20 bp, human
gcatgtaggttgggaataag

SEQ ID NO: 166999 - DNA, 20 bp, human
gtgggaataagaggaaccca

SEQ ID NO: 167000 - DNA, 20 bp, human
gttggcaagaaactgagctc

SEQ ID NO: 167001 - DNA, 20 bp, human
gttccaggtagggccccaca

SEQ ID NO: 167002 - DNA, 20 bp, human
gggggccctacctggaatca

SEQ ID NO: 167003 - DNA, 20 bp, human
gtcattccccaaggaataaa

SEQ ID NO: 167004 - DNA, 20 bp, human
gtgaaccaggtggggagcgg

SEQ ID NO: 167005 - DNA, 20 bp, human
gctgctgagacatccctgtg

SEQ ID NO: 167006 - DNA, 20 bp, human
ggtcgcccggcccgagccag

SEQ ID NO: 167007 - DNA, 20 bp, human
gagtgcagccagagccggtg

SEQ ID NO: 167008 - DNA, 20 bp, human
ggctgcactgcaggtgctga

SEQ ID NO: 167009 - DNA, 20 bp, human
ggagcaatctgagaccattg

SEQ ID NO: 167010 - DNA, 20 bp, human
ggaagtcgcggccgccgcac

SEQ ID NO: 167011 - DNA, 20 bp, human
gtgtcgcctctggctcgggc

SEQ ID NO: 167012 - DNA, 20 bp, human
gcgagggagaaggagcgatg

SEQ ID NO: 167013 - DNA, 20 bp, human
gggaaagagggtgcctcggt

SEQ ID NO: 167014 - DNA, 20 bp, human
ggtcggagaccgaaaagaaa

SEQ ID NO: 167015 - DNA, 20 bp, human
gccccacagcccagccgcaa

SEQ ID NO: 167016 - DNA, 20 bp, human
gtgaccgcgccggtggaccc

SEQ ID NO: 167017 - DNA, 20 bp, human
gctggagttcccgggtccac

SEQ ID NO: 167018 - DNA, 20 bp, human
gggaaagagggtgcctcggt

SEQ ID NO: 167019 - DNA, 20 bp, human
gcaaggccggggaacacgcg

SEQ ID NO: 167020 - DNA, 20 bp, human
gtaaatccagctaggatcga

SEQ ID NO: 167021 - DNA, 20 bp, human
gtaagctggctacgaaatat

SEQ ID NO: 167022 - DNA, 20 bp, human
gcgagggagaaggagcgatg

SEQ ID NO: 167023 - DNA, 20 bp, human
gcaaagactgcaaacagagg

SEQ ID NO: 167024 - DNA, 20 bp, human
ggctggctacgaaatatggg

SEQ ID NO: 167025 - DNA, 20 bp, human
ggtcggagaccgaaaagaaa

SEQ ID NO: 167026 - DNA, 20 bp, human
ggaaagcacccagggtgggt

SEQ ID NO: 167027 - DNA, 20 bp, human
gcagcagggccacaaggaga

SEQ ID NO: 167028 - DNA, 20 bp, human
gagtgctcttggcagacatg

SEQ ID NO: 167029 - DNA, 20 bp, human
gggagaaggctggtgacgga

SEQ ID NO: 167030 - DNA, 20 bp, human
gacaaggagaaggctggtga

SEQ ID NO: 167031 - DNA, 20 bp, human
gggctgtgctggctttgagg

SEQ ID NO: 167032 - DNA, 20 bp, human
gtggaaacagcagggccaca

SEQ ID NO: 167033 - DNA, 20 bp, human
gtgggtacgagtctctgaac

SEQ ID NO: 167034 - DNA, 20 bp, human
gttctggcttgcagtgctct

SEQ ID NO: 167035 - DNA, 20 bp, human
ggattctggcacccagaccc

SEQ ID NO: 167036 - DNA, 20 bp, human
ggaaagcacccagggtgggt

SEQ ID NO: 167037 - DNA, 20 bp, human
gggataagaaaatggagtcg

SEQ ID NO: 167038 - DNA, 20 bp, human
gcagcagggccacaaggaga

SEQ ID NO: 167039 - DNA, 20 bp, human
gcccagcctcactccatcaa

SEQ ID NO: 167040 - DNA, 20 bp, human
gtaagaaaatggagtcgggg

SEQ ID NO: 167041 - DNA, 20 bp, human
gtgagaatgagaagtcatcc

SEQ ID NO: 167042 - DNA, 20 bp, human
gtcattctcaaaggacaatg

SEQ ID NO: 167043 - DNA, 20 bp, human
gtgatggcacttgcttccca

SEQ ID NO: 167044 - DNA, 20 bp, human
ggattctggcacccagaccc

SEQ ID NO: 167045 - DNA, 20 bp, human
gtctctgcaatggtcatctg

SEQ ID NO: 167046 - DNA, 20 bp, human
gggacaccctgggctactaa

SEQ ID NO: 167047 - DNA, 20 bp, human
gggcccacagccgtccctaa

SEQ ID NO: 167048 - DNA, 20 bp, human
ggggcccgaagcgccagaga

SEQ ID NO: 167049 - DNA, 20 bp, human
gtcttccaggaccctcacgg

SEQ ID NO: 167050 - DNA, 20 bp, human
gacggctgtgggcctgctgg

SEQ ID NO: 167051 - DNA, 20 bp, human
gtcgctgttgcccttaggga

SEQ ID NO: 167052 - DNA, 20 bp, human
gaacaggtacaggacaccct

SEQ ID NO: 167053 - DNA, 20 bp, human
gcagcgaagacgctacccaa

SEQ ID NO: 167054 - DNA, 20 bp, human
gatctcgcgagagctcccgg

SEQ ID NO: 167055 - DNA, 20 bp, human
ggctctcaggaagactgtgg

SEQ ID NO: 167056 - DNA, 20 bp, human
gtgggtgccatgcaaaggac

SEQ ID NO: 167057 - DNA, 20 bp, human
gatcaggccacggagagata

SEQ ID NO: 167058 - DNA, 20 bp, human
gcaaaggacgggagaagcat

SEQ ID NO: 167059 - DNA, 20 bp, human
gcttcttgggtgccatgcaa

SEQ ID NO: 167060 - DNA, 20 bp, human
gtggcacccaagaaggagaa

SEQ ID NO: 167061 - DNA, 20 bp, human
gtggtgagaactgcctagtg

SEQ ID NO: 167062 - DNA, 20 bp, human
gcggagagatacggaagaga

SEQ ID NO: 167063 - DNA, 20 bp, human
gtgtggcctggcccataata

SEQ ID NO: 167064 - DNA, 20 bp, human
gtagcggggacgcttaggca

SEQ ID NO: 167065 - DNA, 20 bp, human
gtggcactccacaattgtac

SEQ ID NO: 167066 - DNA, 20 bp, human
gtggtgtccgggttcagaag

SEQ ID NO: 167067 - DNA, 20 bp, human
gccggtctcgaggggaaaat

SEQ ID NO: 167068 - DNA, 20 bp, human
gtctgcggcccggtctcgag

SEQ ID NO: 167069 - DNA, 20 bp, human
gttgtggactgagcaatctg

SEQ ID NO: 167070 - DNA, 20 bp, human
gcggttctgcgggaacccaa

SEQ ID NO: 167071 - DNA, 20 bp, human
ggaacccaagggctccactg

SEQ ID NO: 167072 - DNA, 20 bp, human
ggtccacaagccagacagct

SEQ ID NO: 167073 - DNA, 20 bp, human
gctgaacccggacaccacgc

SEQ ID NO: 167074 - DNA, 20 bp, human
ggtggtccgcaaggccccag

SEQ ID NO: 167075 - DNA, 20 bp, human
ggagggtcggctaggataat

SEQ ID NO: 167076 - DNA, 20 bp, human
ggtgcccggaggaaccacat

SEQ ID NO: 167077 - DNA, 20 bp, human
ggcagccggccgggacacag

SEQ ID NO: 167078 - DNA, 20 bp, human
gcacggaccctgcgtgaagt

SEQ ID NO: 167079 - DNA, 20 bp, human
gccggctgctgacgtcacag

SEQ ID NO: 167080 - DNA, 20 bp, human
gagcgcctcggagccacaac

SEQ ID NO: 167081 - DNA, 20 bp, human
gtgtggcgcggcaaccgtga

SEQ ID NO: 167082 - DNA, 20 bp, human
gccggaggaaccacatgggc

SEQ ID NO: 167083 - DNA, 20 bp, human
gccccgggtgagccagtgga

SEQ ID NO: 167084 - DNA, 20 bp, human
gggcctgccgacttcacgca

SEQ ID NO: 167085 - DNA, 20 bp, human
gtggcagacagcctgtggcg

SEQ ID NO: 167086 - DNA, 20 bp, human
ggaacatggcgtcctcgact

SEQ ID NO: 167087 - DNA, 20 bp, human
gaggttcaaacacagacggc

SEQ ID NO: 167088 - DNA, 20 bp, human
ggaggactgagggagaccta

SEQ ID NO: 167089 - DNA, 20 bp, human
gcacgtctcagaccaagtcg

SEQ ID NO: 167090 - DNA, 20 bp, human
gcacagacggcgggtgaaca

SEQ ID NO: 167091 - DNA, 20 bp, human
ggggctgcagggtaagttca

SEQ ID NO: 167092 - DNA, 20 bp, human
gacttggtctgagacgtgat

SEQ ID NO: 167093 - DNA, 20 bp, human
ggtcagcgaggagcaagcgg

SEQ ID NO: 167094 - DNA, 20 bp, human
gtgccttctggttgaagatg

SEQ ID NO: 167095 - DNA, 20 bp, human
ggtgagggcaccgggctgca

SEQ ID NO: 167096 - DNA, 20 bp, human
gcggcctgcgagtccaccaa

SEQ ID NO: 167097 - DNA, 20 bp, human
gcgacgactcggcctccgac

SEQ ID NO: 167098 - DNA, 20 bp, human
ggagaagcggctcccgtcgg

SEQ ID NO: 167099 - DNA, 20 bp, human
gacagagaagcggctcccgt

SEQ ID NO: 167100 - DNA, 20 bp, human
gggctccccaagagctccac

SEQ ID NO: 167101 - DNA, 20 bp, human
gtccaccaagggggcgatcg

SEQ ID NO: 167102 - DNA, 20 bp, human
gggcgatcgtggcgacgact

SEQ ID NO: 167103 - DNA, 20 bp, human
gctgcgggagagagagtcgg

SEQ ID NO: 167104 - DNA, 20 bp, human
gcgtctcccgggcaacctac

SEQ ID NO: 167105 - DNA, 20 bp, human
gccctgcccgtggagctctt

SEQ ID NO: 167106 - DNA, 20 bp, human
ggactctgagggtctcggaa

SEQ ID NO: 167107 - DNA, 20 bp, human
gagcccttttagggactctg

SEQ ID NO: 167108 - DNA, 20 bp, human
gccagtaggtccgccatctt

SEQ ID NO: 167109 - DNA, 20 bp, human
gccgagtctcctggtcaccg

SEQ ID NO: 167110 - DNA, 20 bp, human
gtgacctggtctgattggta

SEQ ID NO: 167111 - DNA, 20 bp, human
gaggccagggtcgggagaag

SEQ ID NO: 167112 - DNA, 20 bp, human
gatagagctagaggtgagcg

SEQ ID NO: 167113 - DNA, 20 bp, human
gtctcctggtcaccgaggct

SEQ ID NO: 167114 - DNA, 20 bp, human
gaatcagaccaggtcagcag

SEQ ID NO: 167115 - DNA, 20 bp, human
gcgggcagctcgggaattta

SEQ ID NO: 167116 - DNA, 20 bp, human
ggatccctccgtagactcgt

SEQ ID NO: 167117 - DNA, 20 bp, human
gatggagaccaacgagtcta

SEQ ID NO: 167118 - DNA, 20 bp, human
gagaccaacgagtctacgga

SEQ ID NO: 167119 - DNA, 20 bp, human
gtacggagggatcgcggtcg

SEQ ID NO: 167120 - DNA, 20 bp, human
gtaaagccgggtcccgcaca

SEQ ID NO: 167121 - DNA, 20 bp, human
gtctatggcaacccagtagc

SEQ ID NO: 167122 - DNA, 20 bp, human
ggctctggctgcaggcataa

SEQ ID NO: 167123 - DNA, 20 bp, human
ggacagtcccaggtcggccc

SEQ ID NO: 167124 - DNA, 20 bp, human
gagcccagctccgaaggact

SEQ ID NO: 167125 - DNA, 20 bp, human
gctcaaagccaagactccca

SEQ ID NO: 167126 - DNA, 20 bp, human
gggcgtcgccggcagagggg

SEQ ID NO: 167127 - DNA, 20 bp, human
ggaggacggtgtggtgtatc

SEQ ID NO: 167128 - DNA, 20 bp, human
ggccccggcagttggtgcag

SEQ ID NO: 167129 - DNA, 20 bp, human
gcgggctgggacgggtacta

SEQ ID NO: 167130 - DNA, 20 bp, human
gccggcagttggtgcagcgg

SEQ ID NO: 167131 - DNA, 20 bp, human
ggacggtgtggtgtatcagg

SEQ ID NO: 167132 - DNA, 20 bp, human
gtccatggtggcaagcggac

SEQ ID NO: 167133 - DNA, 20 bp, human
gagttggtgcagcggcggtt

SEQ ID NO: 167134 - DNA, 20 bp, human
gatcgggcgctatgacgagg

SEQ ID NO: 167135 - DNA, 20 bp, human
ggctcatcacccagtacgag

SEQ ID NO: 167136 - DNA, 20 bp, human
gtatgtgagccacatcaagg

SEQ ID NO: 167137 - DNA, 20 bp, human
gtgctaggaaggaccttatg

SEQ ID NO: 167138 - DNA, 20 bp, human
ggaaagtatgatagcagtgt

SEQ ID NO: 167139 - DNA, 20 bp, human
gtcatggtgttgcatgaacc

SEQ ID NO: 167140 - DNA, 20 bp, human
gtggttagcagcacctcata

SEQ ID NO: 167141 - DNA, 20 bp, human
gtcatgcaacaccatgatag

SEQ ID NO: 167142 - DNA, 20 bp, human
gatttatgtgagccacatca

SEQ ID NO: 167143 - DNA, 20 bp, human
gggagccagtcatcactctc

SEQ ID NO: 167144 - DNA, 20 bp, human
gtatagattgaatcagacca

SEQ ID NO: 167145 - DNA, 20 bp, human
gctctttcaaccaggagatc

SEQ ID NO: 167146 - DNA, 20 bp, human
ggttcttcgatgtctacagt

SEQ ID NO: 167147 - DNA, 20 bp, human
gcagtgtccgcaggctgaag

SEQ ID NO: 167148 - DNA, 20 bp, human
ggccaatgaggccaacaaga

SEQ ID NO: 167149 - DNA, 20 bp, human
ggacgctcctcttcagcctg

SEQ ID NO: 167150 - DNA, 20 bp, human
ggaggccaacgaggccaatg

SEQ ID NO: 167151 - DNA, 20 bp, human
gaccgtcttgttggcctcat

SEQ ID NO: 167152 - DNA, 20 bp, human
ggaatccaacgaggccaacg

SEQ ID NO: 167153 - DNA, 20 bp, human
ggatgtctacagtaggtttt

SEQ ID NO: 167154 - DNA, 20 bp, human
gaagaaccaatatatacaat

SEQ ID NO: 167155 - DNA, 20 bp, human
gccaacaatccagtgtccgc

SEQ ID NO: 167156 - DNA, 20 bp, human
gaccgtctcattcacctcgt

SEQ ID NO: 167157 - DNA, 20 bp, human
gtccaacgaggtgaatgaga

SEQ ID NO: 167158 - DNA, 20 bp, human
gcaccaggagggtatataca

SEQ ID NO: 167159 - DNA, 20 bp, human
gaggagggtatatacaggga

SEQ ID NO: 167160 - DNA, 20 bp, human
gattggttcttcaatgtctg

SEQ ID NO: 167161 - DNA, 20 bp, human
ggttcttcaatgtctgcggc

SEQ ID NO: 167162 - DNA, 20 bp, human
ggccttgcggacaggtggtt

SEQ ID NO: 167163 - DNA, 20 bp, human
gcacctcgttggattcacag

SEQ ID NO: 167164 - DNA, 20 bp, human
gctgtccgcaaggcggacaa

SEQ ID NO: 167165 - DNA, 20 bp, human
ggcctaaccacctgtccgca

SEQ ID NO: 167166 - DNA, 20 bp, human
ggttcttcgatgtctacagt

SEQ ID NO: 167167 - DNA, 20 bp, human
gcagtgtccgcaggctgaag

SEQ ID NO: 167168 - DNA, 20 bp, human
ggccaatgaggccaacaaga

SEQ ID NO: 167169 - DNA, 20 bp, human
ggacgctcctcttcagcctg

SEQ ID NO: 167170 - DNA, 20 bp, human
ggaggccaacgaggccaatg

SEQ ID NO: 167171 - DNA, 20 bp, human
gaccgtcttgttggcctcat

SEQ ID NO: 167172 - DNA, 20 bp, human
ggaatccaacgaggccaacg

SEQ ID NO: 167173 - DNA, 20 bp, human
gaagaaccaatatatacaat

SEQ ID NO: 167174 - DNA, 20 bp, human
gccaacaatccagtgtccgc

SEQ ID NO: 167175 - DNA, 20 bp, human
ggatgtctacagtaggtttt

SEQ ID NO: 167176 - DNA, 20 bp, human
gagctctgggacatcctcct

SEQ ID NO: 167177 - DNA, 20 bp, human
gtgtattgaagcttcccagg

SEQ ID NO: 167178 - DNA, 20 bp, human
gagctgtattgaagcttccc

SEQ ID NO: 167179 - DNA, 20 bp, human
gtttcattgttggattcaca

SEQ ID NO: 167180 - DNA, 20 bp, human
gtccaacaatgaaaatgatg

SEQ ID NO: 167181 - DNA, 20 bp, human
gacctcatcattttcattgt

SEQ ID NO: 167182 - DNA, 20 bp, human
gcccacttcaagcatcaatg

SEQ ID NO: 167183 - DNA, 20 bp, human
gttgcccagcaagataccat

SEQ ID NO: 167184 - DNA, 20 bp, human
gcaatacagctgtgcaagtc

SEQ ID NO: 167185 - DNA, 20 bp, human
gaactaaagaaactttccta

SEQ ID NO: 167186 - DNA, 20 bp, human
gagctatattgaagcttgcc

SEQ ID NO: 167187 - DNA, 20 bp, human
gtatattgaagcttgccagg

SEQ ID NO: 167188 - DNA, 20 bp, human
ggctgttccatgattctgct

SEQ ID NO: 167189 - DNA, 20 bp, human
gtacaggctggggtgcttat

SEQ ID NO: 167190 - DNA, 20 bp, human
ggagctctgggacatcctcc

SEQ ID NO: 167191 - DNA, 20 bp, human
gttgcccagcaagataccat

SEQ ID NO: 167192 - DNA, 20 bp, human
gaactaaagaaactttccta

SEQ ID NO: 167193 - DNA, 20 bp, human
gctggggtgcttataggtat

SEQ ID NO: 167194 - DNA, 20 bp, human
gtttcctatggtatcttgct

SEQ ID NO: 167195 - DNA, 20 bp, human
gaataacaaaaaaaatgatg

SEQ ID NO: 167196 - DNA, 20 bp, human
gagctctgggacatcccact

SEQ ID NO: 167197 - DNA, 20 bp, human
gtatgttgaagcttcccagt

SEQ ID NO: 167198 - DNA, 20 bp, human
gatgtcattgtggtgtatct

SEQ ID NO: 167199 - DNA, 20 bp, human
ggccaacttccagcaccaat

SEQ ID NO: 167200 - DNA, 20 bp, human
ggtcttctccccattggtgc

SEQ ID NO: 167201 - DNA, 20 bp, human
gatgatgaggtaagattgtc

SEQ ID NO: 167202 - DNA, 20 bp, human
ggtggaagtctgcagtctac

SEQ ID NO: 167203 - DNA, 20 bp, human
gaataacaaaaaaaatgatg

SEQ ID NO: 167204 - DNA, 20 bp, human
gttttgttattggattcaca

SEQ ID NO: 167205 - DNA, 20 bp, human
gctttcctatcatatcttgc

SEQ ID NO: 167206 - DNA, 20 bp, human
gtctgtactaggatcttcta

SEQ ID NO: 167207 - DNA, 20 bp, human
gacagggtgggcaaaagctc

SEQ ID NO: 167208 - DNA, 20 bp, human
gtacgctggcctgtatgtag

SEQ ID NO: 167209 - DNA, 20 bp, human
ggaaagcttcaatacagctg

SEQ ID NO: 167210 - DNA, 20 bp, human
gagtatggctggctgctcgg

SEQ ID NO: 167211 - DNA, 20 bp, human
gctggcctgtatgtagcggt

SEQ ID NO: 167212 - DNA, 20 bp, human
gtacaggccagcgtacttat

SEQ ID NO: 167213 - DNA, 20 bp, human
gctgtattgaagctttccag

SEQ ID NO: 167214 - DNA, 20 bp, human
ggttgtagaatttctgtact

SEQ ID NO: 167215 - DNA, 20 bp, human
gcgcgggtcaaacagcaaca

SEQ ID NO: 167216 - DNA, 20 bp, human
gcaatatagctgtggaagtc

SEQ ID NO: 167217 - DNA, 20 bp, human
gggcaagagctctgggccac

SEQ ID NO: 167218 - DNA, 20 bp, human
ggttgttgaatgtctacagc

SEQ ID NO: 167219 - DNA, 20 bp, human
gctgcagacgcttgtggaag

SEQ ID NO: 167220 - DNA, 20 bp, human
gtttttgctgttggagtcac

SEQ ID NO: 167221 - DNA, 20 bp, human
gacctcatcatttttgctgt

SEQ ID NO: 167222 - DNA, 20 bp, human
gcttgcttggcaaagttcta

SEQ ID NO: 167223 - DNA, 20 bp, human
gtgtaagcggtggtgggatc

SEQ ID NO: 167224 - DNA, 20 bp, human
gtacagcctggggtacttac

SEQ ID NO: 167225 - DNA, 20 bp, human
gggaatactgcagacgcttg

SEQ ID NO: 167226 - DNA, 20 bp, human
gggggtcacacatacctcag

SEQ ID NO: 167227 - DNA, 20 bp, human
gactatagaagggaaaggct

SEQ ID NO: 167228 - DNA, 20 bp, human
gggttggtgcaactatagaa

SEQ ID NO: 167229 - DNA, 20 bp, human
gcaggcagagcgcgctctcc

SEQ ID NO: 167230 - DNA, 20 bp, human
gagatctggaggacagactc

SEQ ID NO: 167231 - DNA, 20 bp, human
gggaccgcgggaatgtggag

SEQ ID NO: 167232 - DNA, 20 bp, human
ggagctgacggcgtgaacgg

SEQ ID NO: 167233 - DNA, 20 bp, human
gtcacacatacctcagtggc

SEQ ID NO: 167234 - DNA, 20 bp, human
gatcagattcccaggaaagg

SEQ ID NO: 167235 - DNA, 20 bp, human
gacccctgaccgagatctgg

SEQ ID NO: 167236 - DNA, 20 bp, human
gcagcctgctagggaaatcc

SEQ ID NO: 167237 - DNA, 20 bp, human
gaggctggcctctcatgcga

SEQ ID NO: 167238 - DNA, 20 bp, human
gatgagaggccagcctgcta

SEQ ID NO: 167239 - DNA, 20 bp, human
gtctcatgcgagggctttac

SEQ ID NO: 167240 - DNA, 20 bp, human
gagcagagctaacgaggaaa

SEQ ID NO: 167241 - DNA, 20 bp, human
ggacagtctgaaatactctc

SEQ ID NO: 167242 - DNA, 20 bp, human
ggctctgcttctttgcccag

SEQ ID NO: 167243 - DNA, 20 bp, human
gcaaagaagcagagctaacg

SEQ ID NO: 167244 - DNA, 20 bp, human
gggtccagccccttacttaa

SEQ ID NO: 167245 - DNA, 20 bp, human
gctgctctgtcaactagtgg

SEQ ID NO: 167246 - DNA, 20 bp, human
ggcgcgaagcctacaaacag

SEQ ID NO: 167247 - DNA, 20 bp, human
gaccgacgggaaccaagcga

SEQ ID NO: 167248 - DNA, 20 bp, human
gcgggtaggagaaatagtac

SEQ ID NO: 167249 - DNA, 20 bp, human
ggcgcgccggagaaaaacac

SEQ ID NO: 167250 - DNA, 20 bp, human
ggccgcctggtggctcccag

SEQ ID NO: 167251 - DNA, 20 bp, human
ggagccaccaggcggcggag

SEQ ID NO: 167252 - DNA, 20 bp, human
gaagcctacaaacagcgggt

SEQ ID NO: 167253 - DNA, 20 bp, human
ggacgggaaccaagcgacgg

SEQ ID NO: 167254 - DNA, 20 bp, human
ggcttatgcggcgactcggg

SEQ ID NO: 167255 - DNA, 20 bp, human
gagtgcggagctcctgagac

SEQ ID NO: 167256 - DNA, 20 bp, human
ggatctgacgctgcaggatc

SEQ ID NO: 167257 - DNA, 20 bp, human
ggcaggatcaggaagagtgg

SEQ ID NO: 167258 - DNA, 20 bp, human
gaaactgtgtacccattcag

SEQ ID NO: 167259 - DNA, 20 bp, human
gggctgggatctgacgctgc

SEQ ID NO: 167260 - DNA, 20 bp, human
ggaggtctgatactgcaggc

SEQ ID NO: 167261 - DNA, 20 bp, human
gaagaggagttggactctcc

SEQ ID NO: 167262 - DNA, 20 bp, human
gtgtagcacagtgaaaaaac

SEQ ID NO: 167263 - DNA, 20 bp, human
ggacacttacagggggtacc

SEQ ID NO: 167264 - DNA, 20 bp, human
gttttgaggtctgatactgc

SEQ ID NO: 167265 - DNA, 20 bp, human
gaaaagagtataagaggagt

SEQ ID NO: 167266 - DNA, 20 bp, human
gcgccctcggagctagcgac

SEQ ID NO: 167267 - DNA, 20 bp, human
gagggcgcagagccaccgcc

SEQ ID NO: 167268 - DNA, 20 bp, human
gagcacccggtagcctccac

SEQ ID NO: 167269 - DNA, 20 bp, human
gtgccggtcgctagctccga

SEQ ID NO: 167270 - DNA, 20 bp, human
ggcgaccggcagggcgatcg

SEQ ID NO: 167271 - DNA, 20 bp, human
gagggcgcgcactggatccc

SEQ ID NO: 167272 - DNA, 20 bp, human
ggcgggcgcacggacctaac

SEQ ID NO: 167273 - DNA, 20 bp, human
ggagcgcgggtgaagttaca

SEQ ID NO: 167274 - DNA, 20 bp, human
gatggtgccgggtggcccag

SEQ ID NO: 167275 - DNA, 20 bp, human
ggaagccgtcttacctcctg

SEQ ID NO: 167276 - DNA, 20 bp, human
gggcctcgcagtgggacgtt

SEQ ID NO: 167277 - DNA, 20 bp, human
gcccactgcgaggcctgatc

SEQ ID NO: 167278 - DNA, 20 bp, human
ggcgagcaagcagcctgatc

SEQ ID NO: 167279 - DNA, 20 bp, human
gaccagagtggggaaggata

SEQ ID NO: 167280 - DNA, 20 bp, human
ggagccacaactgcttaggt

SEQ ID NO: 167281 - DNA, 20 bp, human
gtgacccggtgcagcggaca

SEQ ID NO: 167282 - DNA, 20 bp, human
gctgcaggcagttagaagac

SEQ ID NO: 167283 - DNA, 20 bp, human
gcattcctcattcctcgcgt

SEQ ID NO: 167284 - DNA, 20 bp, human
gcggggacagggcgaagctc

SEQ ID NO: 167285 - DNA, 20 bp, human
gatagggtgacccggtgcag

SEQ ID NO: 167286 - DNA, 20 bp, human
gacccaaggccaagagacca

SEQ ID NO: 167287 - DNA, 20 bp, human
gtcattgggctagtgagtca

SEQ ID NO: 167288 - DNA, 20 bp, human
gcagtcagggtattgaacat

SEQ ID NO: 167289 - DNA, 20 bp, human
ggcccattaagggaagaatt

SEQ ID NO: 167290 - DNA, 20 bp, human
ggtcagggtgacccccagtc

SEQ ID NO: 167291 - DNA, 20 bp, human
ggcttgcagccgggctaacg

SEQ ID NO: 167292 - DNA, 20 bp, human
gaagctaggtcgtcgactgt

SEQ ID NO: 167293 - DNA, 20 bp, human
ggaccatggccacgttagcc

SEQ ID NO: 167294 - DNA, 20 bp, human
gattgtgtcccatctaccta

SEQ ID NO: 167295 - DNA, 20 bp, human
ggaaggatcgcgtaaagggc

SEQ ID NO: 167296 - DNA, 20 bp, human
ggggctgtgctggaacctat

SEQ ID NO: 167297 - DNA, 20 bp, human
gcgagaggaatagtgagcga

SEQ ID NO: 167298 - DNA, 20 bp, human
ggcgtctcagtccacccctg

SEQ ID NO: 167299 - DNA, 20 bp, human
ggccgggttcgggaagccag

SEQ ID NO: 167300 - DNA, 20 bp, human
ggcgcggctgtcacccaggg

SEQ ID NO: 167301 - DNA, 20 bp, human
gggccaggtccgacccgagg

SEQ ID NO: 167302 - DNA, 20 bp, human
gctgtgctggaacctatggg

SEQ ID NO: 167303 - DNA, 20 bp, human
gagcccggccatagataccc

SEQ ID NO: 167304 - DNA, 20 bp, human
ggcggaaaacctgaaaagac

SEQ ID NO: 167305 - DNA, 20 bp, human
gtatgggagggcgaaccccg

SEQ ID NO: 167306 - DNA, 20 bp, human
gctgtcccataggagttctc

SEQ ID NO: 167307 - DNA, 20 bp, human
gctcaggcagcttcaatgga

SEQ ID NO: 167308 - DNA, 20 bp, human
ggtgcagcagggtcccacag

SEQ ID NO: 167309 - DNA, 20 bp, human
ggctagagaagtggtctcag

SEQ ID NO: 167310 - DNA, 20 bp, human
ggctgcctgagaactcctat

SEQ ID NO: 167311 - DNA, 20 bp, human
gggacaggaaggtcattgaa

SEQ ID NO: 167312 - DNA, 20 bp, human
gtgtgtctgtactacatcat

SEQ ID NO: 167313 - DNA, 20 bp, human
gaagtggtctcagtgggtgt

SEQ ID NO: 167314 - DNA, 20 bp, human
gtcttgctcggaaaggtgta

SEQ ID NO: 167315 - DNA, 20 bp, human
gtaccgaactggttattggt

SEQ ID NO: 167316 - DNA, 20 bp, human
gcggagaggctagagcccga

SEQ ID NO: 167317 - DNA, 20 bp, human
ggccggagccgggccccgtc

SEQ ID NO: 167318 - DNA, 20 bp, human
gcgggagcggggtaccctca

SEQ ID NO: 167319 - DNA, 20 bp, human
gtactgagaccagtacccgg

SEQ ID NO: 167320 - DNA, 20 bp, human
gtcggccgggccgtcctcgg

SEQ ID NO: 167321 - DNA, 20 bp, human
gttggccagtcgccgaagag

SEQ ID NO: 167322 - DNA, 20 bp, human
gggcagctcccgggagaatg

SEQ ID NO: 167323 - DNA, 20 bp, human
ggggaagcaagcgagaggcg

SEQ ID NO: 167324 - DNA, 20 bp, human
gcagtacccctgcagccggc

SEQ ID NO: 167325 - DNA, 20 bp, human
gcggcgactggccaaacaga

SEQ ID NO: 167326 - DNA, 20 bp, human
ggacccagcatccagcactg

SEQ ID NO: 167327 - DNA, 20 bp, human
ggcggggcagcagaaggacg

SEQ ID NO: 167328 - DNA, 20 bp, human
gggacaggccaagatcagta

SEQ ID NO: 167329 - DNA, 20 bp, human
gctcgcggcgaggcctgcac

SEQ ID NO: 167330 - DNA, 20 bp, human
gggtctcaggagcagaccgg

SEQ ID NO: 167331 - DNA, 20 bp, human
gcaggagcagaccggaggtg

SEQ ID NO: 167332 - DNA, 20 bp, human
ggagctggcactgcactgga

SEQ ID NO: 167333 - DNA, 20 bp, human
gcgcccagcatggctgctcg

SEQ ID NO: 167334 - DNA, 20 bp, human
gacagggcacagggtactat

SEQ ID NO: 167335 - DNA, 20 bp, human
gctggtgagcacctctcctg

SEQ ID NO: 167336 - DNA, 20 bp, human
gtcaggaatatccagccatg

SEQ ID NO: 167337 - DNA, 20 bp, human
gtgtgcaaggcggtgagcag

SEQ ID NO: 167338 - DNA, 20 bp, human
ggacactgtccagtagttgg

SEQ ID NO: 167339 - DNA, 20 bp, human
gggtttgagaataaggcaag

SEQ ID NO: 167340 - DNA, 20 bp, human
gaggaaaccacttataaaag

SEQ ID NO: 167341 - DNA, 20 bp, human
gaatgacactgtccagtagt

SEQ ID NO: 167342 - DNA, 20 bp, human
gatatgtctggaggccgtca

SEQ ID NO: 167343 - DNA, 20 bp, human
gctcttggaaatatctatga

SEQ ID NO: 167344 - DNA, 20 bp, human
gaagccaacaggcaaagtat

SEQ ID NO: 167345 - DNA, 20 bp, human
gttctcaaaccctaaccaca

SEQ ID NO: 167346 - DNA, 20 bp, human
gcctggacgacggttgacgg

SEQ ID NO: 167347 - DNA, 20 bp, human
gacggaggcgagggaaactg

SEQ ID NO: 167348 - DNA, 20 bp, human
gctttcttcgcgggcgggaa

SEQ ID NO: 167349 - DNA, 20 bp, human
gttggcaggagggcctagaa

SEQ ID NO: 167350 - DNA, 20 bp, human
gcgacggttgacggaggcga

SEQ ID NO: 167351 - DNA, 20 bp, human
gtccccgccctcaggatcaa

SEQ ID NO: 167352 - DNA, 20 bp, human
ggcgggaccattgatcctga

SEQ ID NO: 167353 - DNA, 20 bp, human
gccgcccgcgaagaaagcgc

SEQ ID NO: 167354 - DNA, 20 bp, human
ggaagggcggcggttgctga

SEQ ID NO: 167355 - DNA, 20 bp, human
gagagcgtctcaactcggac

SEQ ID NO: 167356 - DNA, 20 bp, human
gccgccttcgaccacccgag

SEQ ID NO: 167357 - DNA, 20 bp, human
gacggcgaggatcacccccg

SEQ ID NO: 167358 - DNA, 20 bp, human
ggatggcgacgcccctcggg

SEQ ID NO: 167359 - DNA, 20 bp, human
gtaggggtggagccaaaaag

SEQ ID NO: 167360 - DNA, 20 bp, human
gggcggaccttcctgaacca

SEQ ID NO: 167361 - DNA, 20 bp, human
gggccgggctcagtcggtag

SEQ ID NO: 167362 - DNA, 20 bp, human
gacgcccctcgggtggtcga

SEQ ID NO: 167363 - DNA, 20 bp, human
gctagccacggcccccgcat

SEQ ID NO: 167364 - DNA, 20 bp, human
gggaagatggcgacgcccct

SEQ ID NO: 167365 - DNA, 20 bp, human
gcaccattcccgagagtcaa

SEQ ID NO: 167366 - DNA, 20 bp, human
gggagtcctgaagtaggaca

SEQ ID NO: 167367 - DNA, 20 bp, human
gggccggaaggcagaggacc

SEQ ID NO: 167368 - DNA, 20 bp, human
gtccggccaaggtgagcggg

SEQ ID NO: 167369 - DNA, 20 bp, human
gtaactaagaccagccccag

SEQ ID NO: 167370 - DNA, 20 bp, human
ggccccagcggactgtctag

SEQ ID NO: 167371 - DNA, 20 bp, human
gacctctagacagtccgctg

SEQ ID NO: 167372 - DNA, 20 bp, human
gcaagcgggtagttattgat

SEQ ID NO: 167373 - DNA, 20 bp, human
gactattccctcacaaaccg

SEQ ID NO: 167374 - DNA, 20 bp, human
gggaagccatgtcctacttc

SEQ ID NO: 167375 - DNA, 20 bp, human
gggactccacaaactcatcc

SEQ ID NO: 167376 - DNA, 20 bp, human
gggaggcccgaactgatccg

SEQ ID NO: 167377 - DNA, 20 bp, human
ggctacctgtctgtccccag

SEQ ID NO: 167378 - DNA, 20 bp, human
gggcccgaactgatccgcgg

SEQ ID NO: 167379 - DNA, 20 bp, human
ggggcggagccgactcccgg

SEQ ID NO: 167380 - DNA, 20 bp, human
gcggcggccggagaccgctg

SEQ ID NO: 167381 - DNA, 20 bp, human
gcccgggcggagccgactcc

SEQ ID NO: 167382 - DNA, 20 bp, human
gcggccgccgcggatcagtt

SEQ ID NO: 167383 - DNA, 20 bp, human
ggaagcgcgtctctagagaa

SEQ ID NO: 167384 - DNA, 20 bp, human
gccaggctcgaggggtcctg

SEQ ID NO: 167385 - DNA, 20 bp, human
gctggaaggccgaggtaccc

SEQ ID NO: 167386 - DNA, 20 bp, human
gagattacgcagctccatgt

SEQ ID NO: 167387 - DNA, 20 bp, human
gacctaaacgtggacctaca

SEQ ID NO: 167388 - DNA, 20 bp, human
gatggagctgcgtaatctcc

SEQ ID NO: 167389 - DNA, 20 bp, human
gaggcccaagccaggctcct

SEQ ID NO: 167390 - DNA, 20 bp, human
gtctccagatgctaacgtga

SEQ ID NO: 167391 - DNA, 20 bp, human
ggttagcatctggagataaa

SEQ ID NO: 167392 - DNA, 20 bp, human
ggaaggcagcccctcaatcc

SEQ ID NO: 167393 - DNA, 20 bp, human
ggagggcaaacggcccctcc

SEQ ID NO: 167394 - DNA, 20 bp, human
gcccaaaggctggttcttgt

SEQ ID NO: 167395 - DNA, 20 bp, human
ggagctagcatgctgggagg

SEQ ID NO: 167396 - DNA, 20 bp, human
gagaggttgggcagacatag

SEQ ID NO: 167397 - DNA, 20 bp, human
gccatgtgaagctacctatc

SEQ ID NO: 167398 - DNA, 20 bp, human
ggaaaactatgagcttcaga

SEQ ID NO: 167399 - DNA, 20 bp, human
gccactcaagcagatgaagt

SEQ ID NO: 167400 - DNA, 20 bp, human
ggggattatttagagattgt

SEQ ID NO: 167401 - DNA, 20 bp, human
gaccacagaattactgtgtt

SEQ ID NO: 167402 - DNA, 20 bp, human
gtgggcagacataggggttc

SEQ ID NO: 167403 - DNA, 20 bp, human
gaggattgggaaacaacaac

SEQ ID NO: 167404 - DNA, 20 bp, human
ggctacctatctggctgtgg

SEQ ID NO: 167405 - DNA, 20 bp, human
ggaagctacctatctggctg

SEQ ID NO: 167406 - DNA, 20 bp, human
gtgggtcactgtggacgtag

SEQ ID NO: 167407 - DNA, 20 bp, human
gagcactaggccacacacac

SEQ ID NO: 167408 - DNA, 20 bp, human
gtaggccacacacactggtg

SEQ ID NO: 167409 - DNA, 20 bp, human
gtgcactccacagatggtct

SEQ ID NO: 167410 - DNA, 20 bp, human
gcccagtccctagtcccaaa

SEQ ID NO: 167411 - DNA, 20 bp, human
ggagatttcccatcacagaa

SEQ ID NO: 167412 - DNA, 20 bp, human
gtcagttgcttgaaggcgat

SEQ ID NO: 167413 - DNA, 20 bp, human
ggtagaggagcaataggaag

SEQ ID NO: 167414 - DNA, 20 bp, human
ggtggacgtagaggagcaat

SEQ ID NO: 167415 - DNA, 20 bp, human
gtgtgagacccttctgtgat

SEQ ID NO: 167416 - DNA, 20 bp, human
ggagcacactggaggcggag

SEQ ID NO: 167417 - DNA, 20 bp, human
gcagccaaagagcacactgg

SEQ ID NO: 167418 - DNA, 20 bp, human
gggctgggagccgtagtcag

SEQ ID NO: 167419 - DNA, 20 bp, human
gccaaagagcacactggagg

SEQ ID NO: 167420 - DNA, 20 bp, human
gcctcagccaaagagcacac

SEQ ID NO: 167421 - DNA, 20 bp, human
ggtcacccccatgcagaccg

SEQ ID NO: 167422 - DNA, 20 bp, human
ggtagtcaggggcaccgggt

SEQ ID NO: 167423 - DNA, 20 bp, human
gcaaacccccggcacctgaa

SEQ ID NO: 167424 - DNA, 20 bp, human
gtcccctgctcccaaacccc

SEQ ID NO: 167425 - DNA, 20 bp, human
gctgcatgggggtgacaggt

SEQ ID NO: 167426 - DNA, 20 bp, human
gccgtccgtggcggactcgg

SEQ ID NO: 167427 - DNA, 20 bp, human
gcagtggcttggaggatctg

SEQ ID NO: 167428 - DNA, 20 bp, human
gtccggtagggtcttacagt

SEQ ID NO: 167429 - DNA, 20 bp, human
ggcgccgtccgtggcggact

SEQ ID NO: 167430 - DNA, 20 bp, human
gtactagtgtccatccggta

SEQ ID NO: 167431 - DNA, 20 bp, human
gcggcaggaacggttcgcac

SEQ ID NO: 167432 - DNA, 20 bp, human
gctggaaggtaggagacggc

SEQ ID NO: 167433 - DNA, 20 bp, human
gggcagcttcgctggaaggt

SEQ ID NO: 167434 - DNA, 20 bp, human
ggcgggaaacgcgccgtccg

SEQ ID NO: 167435 - DNA, 20 bp, human
ggcctactgtaagaccctac

SEQ ID NO: 167436 - DNA, 20 bp, human
gtgccgccggccaggaaaaa

SEQ ID NO: 167437 - DNA, 20 bp, human
gctagctgtggcgaaagtga

SEQ ID NO: 167438 - DNA, 20 bp, human
gagcaacccagaaagcgtca

SEQ ID NO: 167439 - DNA, 20 bp, human
gaaagcgtcatggctgccgc

SEQ ID NO: 167440 - DNA, 20 bp, human
gtaccctttttcctggccgg

SEQ ID NO: 167441 - DNA, 20 bp, human
gggcagccatgacgctttct

SEQ ID NO: 167442 - DNA, 20 bp, human
ggaataaacaagatgtatcg

SEQ ID NO: 167443 - DNA, 20 bp, human
gggccagggtaggcaatctg

SEQ ID NO: 167444 - DNA, 20 bp, human
ggcacctgttgatgttcctg

SEQ ID NO: 167445 - DNA, 20 bp, human
gcaccgggggggcctaggac

SEQ ID NO: 167446 - DNA, 20 bp, human
gtgaagcgcgcacattgagt

SEQ ID NO: 167447 - DNA, 20 bp, human
ggtcggcttttctactgctt

SEQ ID NO: 167448 - DNA, 20 bp, human
gcgcctgcactggagaagtt

SEQ ID NO: 167449 - DNA, 20 bp, human
gcttggaagacatggtcaca

SEQ ID NO: 167450 - DNA, 20 bp, human
gattccgggtgggagactag

SEQ ID NO: 167451 - DNA, 20 bp, human
ggggagactagaggccgagg

SEQ ID NO: 167452 - DNA, 20 bp, human
gcggcctctagtctcccacc

SEQ ID NO: 167453 - DNA, 20 bp, human
gagggtaaagaattccgggt

SEQ ID NO: 167454 - DNA, 20 bp, human
gttttctactgcttcggcta

SEQ ID NO: 167455 - DNA, 20 bp, human
gtggagaagttaggctgaaa

SEQ ID NO: 167456 - DNA, 20 bp, human
gcagggaagggatccgagtc

SEQ ID NO: 167457 - DNA, 20 bp, human
gacagccgcggtgctggagg

SEQ ID NO: 167458 - DNA, 20 bp, human
gtggcctcggcgggacggag

SEQ ID NO: 167459 - DNA, 20 bp, human
gaggcagacgaaaccagatt

SEQ ID NO: 167460 - DNA, 20 bp, human
gcccggtctctagcgtctaa

SEQ ID NO: 167461 - DNA, 20 bp, human
ggtggcccagggagatcggt

SEQ ID NO: 167462 - DNA, 20 bp, human
gaagagcggcccttcaggga

SEQ ID NO: 167463 - DNA, 20 bp, human
gctttaagagcggcccttca

SEQ ID NO: 167464 - DNA, 20 bp, human
gagatctcgctacccgacgg

SEQ ID NO: 167465 - DNA, 20 bp, human
gtgtgcgatggctccggact

SEQ ID NO: 167466 - DNA, 20 bp, human
ggcctctgcgtggccggagt

SEQ ID NO: 167467 - DNA, 20 bp, human
gagatggggcaggaccgaag

SEQ ID NO: 167468 - DNA, 20 bp, human
ggcacggatgccgaaggtga

SEQ ID NO: 167469 - DNA, 20 bp, human
gagccagcatagcggagcag

SEQ ID NO: 167470 - DNA, 20 bp, human
ggtgaggtcgacgctcccta

SEQ ID NO: 167471 - DNA, 20 bp, human
gcgggttgaagccagcatag

SEQ ID NO: 167472 - DNA, 20 bp, human
gtcccactccggccacgcag

SEQ ID NO: 167473 - DNA, 20 bp, human
ggggcgcagactcgttgtca

SEQ ID NO: 167474 - DNA, 20 bp, human
gtgcttctccggcggaaccc

SEQ ID NO: 167475 - DNA, 20 bp, human
ggagaactggagcccgaaag

SEQ ID NO: 167476 - DNA, 20 bp, human
ggagtgtgagagacccgtcc

SEQ ID NO: 167477 - DNA, 20 bp, human
ggtgagagacccgtcccggt

SEQ ID NO: 167478 - DNA, 20 bp, human
gcaggtccctcccaccggga

SEQ ID NO: 167479 - DNA, 20 bp, human
gaagtcagggaaaaccaata

SEQ ID NO: 167480 - DNA, 20 bp, human
gcctgcgtgggcgaaaggac

SEQ ID NO: 167481 - DNA, 20 bp, human
gacaggtggagctgaattaa

SEQ ID NO: 167482 - DNA, 20 bp, human
gcagggaacgatgcctctgg

SEQ ID NO: 167483 - DNA, 20 bp, human
gagagacccgtcccggtggg

SEQ ID NO: 167484 - DNA, 20 bp, human
ggtggagctgcagatccggg

SEQ ID NO: 167485 - DNA, 20 bp, human
gacgatgcctctggaggtgg

SEQ ID NO: 167486 - DNA, 20 bp, human
gggaaaagaggagccgacgg

SEQ ID NO: 167487 - DNA, 20 bp, human
gctgctgctgcagcccccgt

SEQ ID NO: 167488 - DNA, 20 bp, human
gactggaaaagaggagccga

SEQ ID NO: 167489 - DNA, 20 bp, human
gtggcagccggagaggtaaa

SEQ ID NO: 167490 - DNA, 20 bp, human
gacaggggcccctggtgtca

SEQ ID NO: 167491 - DNA, 20 bp, human
gagccccggcagtggaggac

SEQ ID NO: 167492 - DNA, 20 bp, human
gtaggaagcgccccaagggg

SEQ ID NO: 167493 - DNA, 20 bp, human
gccagcccttagcaacggcc

SEQ ID NO: 167494 - DNA, 20 bp, human
gacactggcgactcagccag

SEQ ID NO: 167495 - DNA, 20 bp, human
gtgtcagggcgacaaattca

SEQ ID NO: 167496 - DNA, 20 bp, human
gctgcactcaggaactacat

SEQ ID NO: 167497 - DNA, 20 bp, human
gtacatgggagaagtgaagt

SEQ ID NO: 167498 - DNA, 20 bp, human
gcccagccaccggtctgaag

SEQ ID NO: 167499 - DNA, 20 bp, human
gcatgagaggcaggtggtaa

SEQ ID NO: 167500 - DNA, 20 bp, human
gcagagccccttcagaccgg

SEQ ID NO: 167501 - DNA, 20 bp, human
ggcaggactctcctgaagaa

SEQ ID NO: 167502 - DNA, 20 bp, human
gtcaggagagtcctgcactc

SEQ ID NO: 167503 - DNA, 20 bp, human
gtggtctgaacaagatgcat

SEQ ID NO: 167504 - DNA, 20 bp, human
gcacatgctcggaaccctgt

SEQ ID NO: 167505 - DNA, 20 bp, human
ggccaggcatgagaggcagg

SEQ ID NO: 167506 - DNA, 20 bp, human
gtagatgactcggaaagtaa

SEQ ID NO: 167507 - DNA, 20 bp, human
gggaaagtaaaggaactcta

SEQ ID NO: 167508 - DNA, 20 bp, human
gtgagggtagccttccactt

SEQ ID NO: 167509 - DNA, 20 bp, human
gactaggacaagcattaccc

SEQ ID NO: 167510 - DNA, 20 bp, human
gtatgggtgtgggaacaatt

SEQ ID NO: 167511 - DNA, 20 bp, human
ggctggctttcccaagtgga

SEQ ID NO: 167512 - DNA, 20 bp, human
ggactgtgataatcttagga

SEQ ID NO: 167513 - DNA, 20 bp, human
gtaccctcatctttcactaa

SEQ ID NO: 167514 - DNA, 20 bp, human
gcaggcctgcaagcttgtta

SEQ ID NO: 167515 - DNA, 20 bp, human
gctttcactaatggcagact

SEQ ID NO: 167516 - DNA, 20 bp, human
gaagggtgcggcccacggga

SEQ ID NO: 167517 - DNA, 20 bp, human
gtggcaagggtgcggcccac

SEQ ID NO: 167518 - DNA, 20 bp, human
gaggtgcagtgccctcccgt

SEQ ID NO: 167519 - DNA, 20 bp, human
gaggtctcaggaggtcatgg

SEQ ID NO: 167520 - DNA, 20 bp, human
gggagagactcagtgtgctg

SEQ ID NO: 167521 - DNA, 20 bp, human
gggacaggaagcacattgtc

SEQ ID NO: 167522 - DNA, 20 bp, human
gcatcagcgggttcacgagt

SEQ ID NO: 167523 - DNA, 20 bp, human
gagtggggactgcaccagag

SEQ ID NO: 167524 - DNA, 20 bp, human
ggcttcggcatcagatagag

SEQ ID NO: 167525 - DNA, 20 bp, human
gggagaggtccaccctggac

SEQ ID NO: 167526 - DNA, 20 bp, human
gcagccgggatgcaacagat

SEQ ID NO: 167527 - DNA, 20 bp, human
gtgggtcatctcatcctcat

SEQ ID NO: 167528 - DNA, 20 bp, human
gtgcgggggagaccagccta

SEQ ID NO: 167529 - DNA, 20 bp, human
gagcatgtgggggccatcgt

SEQ ID NO: 167530 - DNA, 20 bp, human
ggaggagaccagtcttgcgg

SEQ ID NO: 167531 - DNA, 20 bp, human
ggcctgaggcagccccacga

SEQ ID NO: 167532 - DNA, 20 bp, human
gagtgctccaaagcatgtgg

SEQ ID NO: 167533 - DNA, 20 bp, human
gcccctcgggccgtcacaca

SEQ ID NO: 167534 - DNA, 20 bp, human
ggctgataaaacaagaccct

SEQ ID NO: 167535 - DNA, 20 bp, human
gtgttgtttcttggctccga

SEQ ID NO: 167536 - DNA, 20 bp, human
gtcgtcctcgctggacaggg

SEQ ID NO: 167537 - DNA, 20 bp, human
ggcgaggacgacacctcccc

SEQ ID NO: 167538 - DNA, 20 bp, human
gggaggagctactacctcaa

SEQ ID NO: 167539 - DNA, 20 bp, human
gtccagtcacacagagtgga

SEQ ID NO: 167540 - DNA, 20 bp, human
ggagcacagcaggtcctcca

SEQ ID NO: 167541 - DNA, 20 bp, human
gtagccaccgaggcaccgac

SEQ ID NO: 167542 - DNA, 20 bp, human
gtaggccggaccatctccct

SEQ ID NO: 167543 - DNA, 20 bp, human
gcggagagcagcctgcccac

SEQ ID NO: 167544 - DNA, 20 bp, human
gccctcccaggcacccttca

SEQ ID NO: 167545 - DNA, 20 bp, human
gcagagccacatagccaccg

SEQ ID NO: 167546 - DNA, 20 bp, human
gcctgagaaccgagagccta

SEQ ID NO: 167547 - DNA, 20 bp, human
gccgagagcctagggcaaaa

SEQ ID NO: 167548 - DNA, 20 bp, human
ggaacgcacgccgcacgccg

SEQ ID NO: 167549 - DNA, 20 bp, human
gccccggaacgcgcctctgt

SEQ ID NO: 167550 - DNA, 20 bp, human
gagcaccttgagctggatgg

SEQ ID NO: 167551 - DNA, 20 bp, human
gccatctcaagcacgacctg

SEQ ID NO: 167552 - DNA, 20 bp, human
gtcactggaaacagtccacg

SEQ ID NO: 167553 - DNA, 20 bp, human
gcacggaccaacgaaccaac

SEQ ID NO: 167554 - DNA, 20 bp, human
gcgcccaggtggagggagta

SEQ ID NO: 167555 - DNA, 20 bp, human
ggctgcagcgagcctggttc

SEQ ID NO: 167556 - DNA, 20 bp, human
gcgctcccgggtctgagaag

SEQ ID NO: 167557 - DNA, 20 bp, human
gggcggcggtggctctagaa

SEQ ID NO: 167558 - DNA, 20 bp, human
gggacctcgcacagccacgg

SEQ ID NO: 167559 - DNA, 20 bp, human
ggcctcgtcgccccagctcc

SEQ ID NO: 167560 - DNA, 20 bp, human
gagctccgggctccgcgtcc

SEQ ID NO: 167561 - DNA, 20 bp, human
gggataggccggggaaacaa

SEQ ID NO: 167562 - DNA, 20 bp, human
gatgcgtaaggtcacctccg

SEQ ID NO: 167563 - DNA, 20 bp, human
gcgaggtccttagcattcgg

SEQ ID NO: 167564 - DNA, 20 bp, human
gtctggcgtgagcgtgtgtg

SEQ ID NO: 167565 - DNA, 20 bp, human
gctcagagggcgccgaggtg

SEQ ID NO: 167566 - DNA, 20 bp, human
ggcgccggctggagaaagga

SEQ ID NO: 167567 - DNA, 20 bp, human
ggcgctgccggcgcttgcag

SEQ ID NO: 167568 - DNA, 20 bp, human
ggtgaaggaatccagtccgg

SEQ ID NO: 167569 - DNA, 20 bp, human
ggagccggcgctcgacacag

SEQ ID NO: 167570 - DNA, 20 bp, human
gtgccggcgcttgcagcgga

SEQ ID NO: 167571 - DNA, 20 bp, human
ggccggagttgtgtcagtga

SEQ ID NO: 167572 - DNA, 20 bp, human
ggccagctcggcccccggac

SEQ ID NO: 167573 - DNA, 20 bp, human
gcacccagcgctccgggagg

SEQ ID NO: 167574 - DNA, 20 bp, human
gtcagtgaaggaatccagtc

SEQ ID NO: 167575 - DNA, 20 bp, human
gtggcgcggaccggacgcga

SEQ ID NO: 167576 - DNA, 20 bp, human
ggctcacctcctctatgtcg

SEQ ID NO: 167577 - DNA, 20 bp, human
gttggagcctggcgtagtca

SEQ ID NO: 167578 - DNA, 20 bp, human
ggccttccgcgacatagagg

SEQ ID NO: 167579 - DNA, 20 bp, human
ggccgccttccgcgacatag

SEQ ID NO: 167580 - DNA, 20 bp, human
gacatagaggaggtgagcca

SEQ ID NO: 167581 - DNA, 20 bp, human
gcgtggtcgcgggcccacgg

SEQ ID NO: 167582 - DNA, 20 bp, human
gtaaatataggagtctggag

SEQ ID NO: 167583 - DNA, 20 bp, human
gggtctcagggtttgaactg

SEQ ID NO: 167584 - DNA, 20 bp, human
gttaccactaaacccctggg

SEQ ID NO: 167585 - DNA, 20 bp, human
gctgctgggcgccaaccgcg

SEQ ID NO: 167586 - DNA, 20 bp, human
gagtgggcgcggatctggtg

SEQ ID NO: 167587 - DNA, 20 bp, human
gctgcgaaggtaagggagtt

SEQ ID NO: 167588 - DNA, 20 bp, human
gtagccaacagccggactct

SEQ ID NO: 167589 - DNA, 20 bp, human
ggagcctagagtccggctgt

SEQ ID NO: 167590 - DNA, 20 bp, human
gagcgtcgcagagtactggt

SEQ ID NO: 167591 - DNA, 20 bp, human
ggtccggctgttggctagag

SEQ ID NO: 167592 - DNA, 20 bp, human
ggctagagtgggcgcggatc

SEQ ID NO: 167593 - DNA, 20 bp, human
ggatgtatacaagtcacctc

SEQ ID NO: 167594 - DNA, 20 bp, human
gtgaaatcggaaagttggcg

SEQ ID NO: 167595 - DNA, 20 bp, human
gaggtttgaaatcggaaagt

SEQ ID NO: 167596 - DNA, 20 bp, human
gcgggtcggtgctccaacat

SEQ ID NO: 167597 - DNA, 20 bp, human
ggagacttaaggaccgtgag

SEQ ID NO: 167598 - DNA, 20 bp, human
ggaacagcgcagcaccgggt

SEQ ID NO: 167599 - DNA, 20 bp, human
ggggtctcccgctctcctaa

SEQ ID NO: 167600 - DNA, 20 bp, human
gcagggtaaccccaacatca

SEQ ID NO: 167601 - DNA, 20 bp, human
ggagcgggagaccctgatgt

SEQ ID NO: 167602 - DNA, 20 bp, human
gtgccagagttgtgaggtca

SEQ ID NO: 167603 - DNA, 20 bp, human
gcgagggcgaccgagactta

SEQ ID NO: 167604 - DNA, 20 bp, human
ggcccaggcccttaggagag

SEQ ID NO: 167605 - DNA, 20 bp, human
gaagcccgggagagcgatgg

SEQ ID NO: 167606 - DNA, 20 bp, human
gcgagccaaccttcccatcc

SEQ ID NO: 167607 - DNA, 20 bp, human
gcgtagaaaataagggagac

SEQ ID NO: 167608 - DNA, 20 bp, human
gggcttcagacaagtcggag

SEQ ID NO: 167609 - DNA, 20 bp, human
gtcagacaagtcggagggga

SEQ ID NO: 167610 - DNA, 20 bp, human
gcaatcggcttcagacaagt

SEQ ID NO: 167611 - DNA, 20 bp, human
ggatggacacgattaaatat

SEQ ID NO: 167612 - DNA, 20 bp, human
gtgaagtgtgatgagggcaa

SEQ ID NO: 167613 - DNA, 20 bp, human
ggccagcaagacccaaacta

SEQ ID NO: 167614 - DNA, 20 bp, human
gaaaaggccgtagaaaataa

SEQ ID NO: 167615 - DNA, 20 bp, human
gccatctcttttctcctggg

SEQ ID NO: 167616 - DNA, 20 bp, human
ggccggtccgccgccggaac

SEQ ID NO: 167617 - DNA, 20 bp, human
gcacacccaggctcccgttc

SEQ ID NO: 167618 - DNA, 20 bp, human
gccccgagggcggtcgtcag

SEQ ID NO: 167619 - DNA, 20 bp, human
gggactccacacgcacaccc

SEQ ID NO: 167620 - DNA, 20 bp, human
gtccggatcgccctcctgag

SEQ ID NO: 167621 - DNA, 20 bp, human
gacccaggctcccgttccgg

SEQ ID NO: 167622 - DNA, 20 bp, human
ggcagacggcgcggatcgca

SEQ ID NO: 167623 - DNA, 20 bp, human
ggtgtggagtccggactcgt

SEQ ID NO: 167624 - DNA, 20 bp, human
ggaggggtgcaagttccgag

SEQ ID NO: 167625 - DNA, 20 bp, human
gggaacgcgcgcaccgcaga

SEQ ID NO: 167626 - DNA, 20 bp, human
gtattgttcgaatagacctg

SEQ ID NO: 167627 - DNA, 20 bp, human
gagctcttctaaccctcaca

SEQ ID NO: 167628 - DNA, 20 bp, human
ggccattgtcagccctgtga

SEQ ID NO: 167629 - DNA, 20 bp, human
gtgttcgaatagacctgggg

SEQ ID NO: 167630 - DNA, 20 bp, human
gcagtgctgatgtccacccc

SEQ ID NO: 167631 - DNA, 20 bp, human
gtgtaagttttatcataggt

SEQ ID NO: 167632 - DNA, 20 bp, human
gaggtatgtatgtacggtat

SEQ ID NO: 167633 - DNA, 20 bp, human
gtgctatttactgtttacta

SEQ ID NO: 167634 - DNA, 20 bp, human
ggtatacctaccccattaag

SEQ ID NO: 167635 - DNA, 20 bp, human
gagtatccccttaatggggt

SEQ ID NO: 167636 - DNA, 20 bp, human
gagggaaagaccccatgcca

SEQ ID NO: 167637 - DNA, 20 bp, human
gttggaggactgggtctgtg

SEQ ID NO: 167638 - DNA, 20 bp, human
gtgggcaccaggcagctaac

SEQ ID NO: 167639 - DNA, 20 bp, human
ggctgcagtgccaacttcag

SEQ ID NO: 167640 - DNA, 20 bp, human
ggcagcaggcttggaggact

SEQ ID NO: 167641 - DNA, 20 bp, human
gcagccgcgagatgaagagt

SEQ ID NO: 167642 - DNA, 20 bp, human
gtcttcccggcccctgaagt

SEQ ID NO: 167643 - DNA, 20 bp, human
gtggcaaggcccaacctgag

SEQ ID NO: 167644 - DNA, 20 bp, human
ggcagagtgcaggaatgtgc

SEQ ID NO: 167645 - DNA, 20 bp, human
ggggtacccccacctcctgt

SEQ ID NO: 167646 - DNA, 20 bp, human
ggctcagggcgtccacattg

SEQ ID NO: 167647 - DNA, 20 bp, human
gggagttagcgtcctcaatg

SEQ ID NO: 167648 - DNA, 20 bp, human
gggatctgcgctgtgcggta

SEQ ID NO: 167649 - DNA, 20 bp, human
gccgcacagcgcagatccag

SEQ ID NO: 167650 - DNA, 20 bp, human
gagctctcgagtaagcgcct

SEQ ID NO: 167651 - DNA, 20 bp, human
gcagatgggagatacatatt

SEQ ID NO: 167652 - DNA, 20 bp, human
gacgctaactccacagtcgc

SEQ ID NO: 167653 - DNA, 20 bp, human
gaggccctaaagaaagctag

SEQ ID NO: 167654 - DNA, 20 bp, human
gtgagacgtgggacttctcg

SEQ ID NO: 167655 - DNA, 20 bp, human
gcccagtgtataagacccca

SEQ ID NO: 167656 - DNA, 20 bp, human
gtagcgggtgaaggttccag

SEQ ID NO: 167657 - DNA, 20 bp, human
gggacgggcagggccgatac

SEQ ID NO: 167658 - DNA, 20 bp, human
gcgggcagggccgataccgg

SEQ ID NO: 167659 - DNA, 20 bp, human
ggtcggtcgctagccagcag

SEQ ID NO: 167660 - DNA, 20 bp, human
ggcgggagagggccgggcaa

SEQ ID NO: 167661 - DNA, 20 bp, human
gaccgacgagcaaccgtctg

SEQ ID NO: 167662 - DNA, 20 bp, human
ggcctcagacggttgctcgt

SEQ ID NO: 167663 - DNA, 20 bp, human
gggccgggcaacggcggtca

SEQ ID NO: 167664 - DNA, 20 bp, human
gttggcgggagaccttagag

SEQ ID NO: 167665 - DNA, 20 bp, human
gaggtacctgcggaagcccg

SEQ ID NO: 167666 - DNA, 20 bp, human
ggacactatgagaagtcagg

SEQ ID NO: 167667 - DNA, 20 bp, human
gtaagacactatgagaagtc

SEQ ID NO: 167668 - DNA, 20 bp, human
gaggctttggagaagttaaa

SEQ ID NO: 167669 - DNA, 20 bp, human
gatggaggcatgggttttag

SEQ ID NO: 167670 - DNA, 20 bp, human
gtgggttttagaggataaat

SEQ ID NO: 167671 - DNA, 20 bp, human
gggatagaagtgtagcagta

SEQ ID NO: 167672 - DNA, 20 bp, human
gttagaggataaataggctt

SEQ ID NO: 167673 - DNA, 20 bp, human
gatgcacttgcctaggcccg

SEQ ID NO: 167674 - DNA, 20 bp, human
gcgtattgggtttttgtaca

SEQ ID NO: 167675 - DNA, 20 bp, human
ggtacagggaagtaatttaa

SEQ ID NO: 167676 - DNA, 20 bp, human
gtaaggctcgctgcaggagg

SEQ ID NO: 167677 - DNA, 20 bp, human
gccattcctgagctcgggta

SEQ ID NO: 167678 - DNA, 20 bp, human
gctcgctgcaggaggaggct

SEQ ID NO: 167679 - DNA, 20 bp, human
gctgggccattcctgagctc

SEQ ID NO: 167680 - DNA, 20 bp, human
gtgcgggcgcctagatggag

SEQ ID NO: 167681 - DNA, 20 bp, human
ggcgagccttacccgagctc

SEQ ID NO: 167682 - DNA, 20 bp, human
ggggtaaggctcgctgcagg

SEQ ID NO: 167683 - DNA, 20 bp, human
gcgtgcggtcgaccacccca

SEQ ID NO: 167684 - DNA, 20 bp, human
gttgcttgcgggcgcctaga

SEQ ID NO: 167685 - DNA, 20 bp, human
gtagatggaggggcccagat

SEQ ID NO: 167686 - DNA, 20 bp, human
gtcctgttctttccaaaaac

SEQ ID NO: 167687 - DNA, 20 bp, human
gattggaagtttcctgtttt

SEQ ID NO: 167688 - DNA, 20 bp, human
gctgcagaagcattacaccg

SEQ ID NO: 167689 - DNA, 20 bp, human
gcaggggcgagcaccttccg

SEQ ID NO: 167690 - DNA, 20 bp, human
ggagtggtgggacgaatctg

SEQ ID NO: 167691 - DNA, 20 bp, human
ggacgaatctgaggagtcgt

SEQ ID NO: 167692 - DNA, 20 bp, human
gagcaaaaggacctatgcgg

SEQ ID NO: 167693 - DNA, 20 bp, human
gttggaggaggagccacgga

SEQ ID NO: 167694 - DNA, 20 bp, human
gtccagcaaaaggacctatg

SEQ ID NO: 167695 - DNA, 20 bp, human
gacttcacattcctcccaca

SEQ ID NO: 167696 - DNA, 20 bp, human
gagtcctgggcccagatctg

SEQ ID NO: 167697 - DNA, 20 bp, human
gagagacagaccccagatct

SEQ ID NO: 167698 - DNA, 20 bp, human
gtggtttgatggaggaatag

SEQ ID NO: 167699 - DNA, 20 bp, human
ggtgcagggaggggaaatgc

SEQ ID NO: 167700 - DNA, 20 bp, human
ggcccattaggaaaacgtgt

SEQ ID NO: 167701 - DNA, 20 bp, human
gcccaggactttgtgcaggg

SEQ ID NO: 167702 - DNA, 20 bp, human
gttcaaggctggtttgatgg

SEQ ID NO: 167703 - DNA, 20 bp, human
gagaccccagatctgggccc

SEQ ID NO: 167704 - DNA, 20 bp, human
gttaaaccgtcagagctggg

SEQ ID NO: 167705 - DNA, 20 bp, human
gcgtgtgggaactcactcgc

SEQ ID NO: 167706 - DNA, 20 bp, human
gtcctgttctttccaaaaac

SEQ ID NO: 167707 - DNA, 20 bp, human
gattggaagtttcctgtttt

SEQ ID NO: 167708 - DNA, 20 bp, human
gctgcagaagcattacaccg

SEQ ID NO: 167709 - DNA, 20 bp, human
gcaggggcgagcaccttccg

SEQ ID NO: 167710 - DNA, 20 bp, human
ggagtggtgggacgaatctg

SEQ ID NO: 167711 - DNA, 20 bp, human
ggacgaatctgaggagtcgt

SEQ ID NO: 167712 - DNA, 20 bp, human
gagcaaaaggacctatgcgg

SEQ ID NO: 167713 - DNA, 20 bp, human
gttggaggaggagccacgga

SEQ ID NO: 167714 - DNA, 20 bp, human
gtccagcaaaaggacctatg

SEQ ID NO: 167715 - DNA, 20 bp, human
gacttcacattcctcccaca

SEQ ID NO: 167716 - DNA, 20 bp, human
gagtcctgggcccagatctg

SEQ ID NO: 167717 - DNA, 20 bp, human
gagagacagaccccagatct

SEQ ID NO: 167718 - DNA, 20 bp, human
gtggtttgatggaggaatag

SEQ ID NO: 167719 - DNA, 20 bp, human
ggcccattaggaaaacgtgt

SEQ ID NO: 167720 - DNA, 20 bp, human
gcccaggactttgtgcaggg

SEQ ID NO: 167721 - DNA, 20 bp, human
gttaaaccgtcagagctggg

SEQ ID NO: 167722 - DNA, 20 bp, human
gagaccccagatctgggccc

SEQ ID NO: 167723 - DNA, 20 bp, human
gcgtgtgggaactcactcgc

SEQ ID NO: 167724 - DNA, 20 bp, human
gttcaaggctggtttgatgg

SEQ ID NO: 167725 - DNA, 20 bp, human
gaggaaagcagcagcccatt

SEQ ID NO: 167726 - DNA, 20 bp, human
gtagaggctcgggagaagtt

SEQ ID NO: 167727 - DNA, 20 bp, human
gcacgtgtaaagaaagtctg

SEQ ID NO: 167728 - DNA, 20 bp, human
ggtctggggagcaatgaagg

SEQ ID NO: 167729 - DNA, 20 bp, human
ggcactcttctgggtcctaa

SEQ ID NO: 167730 - DNA, 20 bp, human
gctcaggaagccagggatcg

SEQ ID NO: 167731 - DNA, 20 bp, human
gccagcctagcacaacggta

SEQ ID NO: 167732 - DNA, 20 bp, human
gcgacggactcaggaagcca

SEQ ID NO: 167733 - DNA, 20 bp, human
gacggtacggtcccccgagg

SEQ ID NO: 167734 - DNA, 20 bp, human
gccttcttccagactccgtt

SEQ ID NO: 167735 - DNA, 20 bp, human
ggctctcctcctcaaacggg

SEQ ID NO: 167736 - DNA, 20 bp, human
gtgatggtaaccatagactt

SEQ ID NO: 167737 - DNA, 20 bp, human
gaaaggttggataaaagata

SEQ ID NO: 167738 - DNA, 20 bp, human
gggcaagcacaaaagagaac

SEQ ID NO: 167739 - DNA, 20 bp, human
gtatcaagttcctaagtcta

SEQ ID NO: 167740 - DNA, 20 bp, human
gctcatcctgaaagcagtct

SEQ ID NO: 167741 - DNA, 20 bp, human
gtcaaggtagtagtgctgga

SEQ ID NO: 167742 - DNA, 20 bp, human
ggctctatattcacatccat

SEQ ID NO: 167743 - DNA, 20 bp, human
gacttataaatatctctaaa

SEQ ID NO: 167744 - DNA, 20 bp, human
ggttttaaaagccatccctc

SEQ ID NO: 167745 - DNA, 20 bp, human
gttataagtattatgggaga

SEQ ID NO: 167746 - DNA, 20 bp, human
ggcgccgccgcaacccccag

SEQ ID NO: 167747 - DNA, 20 bp, human
gacaaccctcgggcccggag

SEQ ID NO: 167748 - DNA, 20 bp, human
gcggcgcggctagtactcac

SEQ ID NO: 167749 - DNA, 20 bp, human
gctcactgatgctcaggaga

SEQ ID NO: 167750 - DNA, 20 bp, human
gctccagggccgcagctgtc

SEQ ID NO: 167751 - DNA, 20 bp, human
gccgcgcacctgtcccactg

SEQ ID NO: 167752 - DNA, 20 bp, human
gtccagccatcgccgccagg

SEQ ID NO: 167753 - DNA, 20 bp, human
gccgcgtggtctgaagggat

SEQ ID NO: 167754 - DNA, 20 bp, human
ggcagcacgccttcccagaa

SEQ ID NO: 167755 - DNA, 20 bp, human
ggtccggcagtccgtcgtgg

SEQ ID NO: 167756 - DNA, 20 bp, human
ggaaggccagtgggtctcgg

SEQ ID NO: 167757 - DNA, 20 bp, human
gggcggaaaggcaagcacga

SEQ ID NO: 167758 - DNA, 20 bp, human
ggggcggtgagctcacccgg

SEQ ID NO: 167759 - DNA, 20 bp, human
gttcctgaggccggactcaa

SEQ ID NO: 167760 - DNA, 20 bp, human
gggcgcgggacacactggag

SEQ ID NO: 167761 - DNA, 20 bp, human
gcttcgccgccgagacccac

SEQ ID NO: 167762 - DNA, 20 bp, human
gagccctgctgggcgcgaag

SEQ ID NO: 167763 - DNA, 20 bp, human
gcaagcacgagggtcgcacc

SEQ ID NO: 167764 - DNA, 20 bp, human
gccagcctctcccggagcgg

SEQ ID NO: 167765 - DNA, 20 bp, human
gggcttctggaacaacccgc

SEQ ID NO: 167766 - DNA, 20 bp, human
gggagaggtttcgcttgggc

SEQ ID NO: 167767 - DNA, 20 bp, human
gttcgcttgggccgggacag

SEQ ID NO: 167768 - DNA, 20 bp, human
gggcaggcagaggcagttat

SEQ ID NO: 167769 - DNA, 20 bp, human
gctctggattaggcaggcag

SEQ ID NO: 167770 - DNA, 20 bp, human
gcagctgggacgtgagtctc

SEQ ID NO: 167771 - DNA, 20 bp, human
gtgtccctggagggagttag

SEQ ID NO: 167772 - DNA, 20 bp, human
gaagcgcctgaagggtcgtg

SEQ ID NO: 167773 - DNA, 20 bp, human
ggcttctgcagtggcgagaa

SEQ ID NO: 167774 - DNA, 20 bp, human
gctgcaccagctgtacctgt

SEQ ID NO: 167775 - DNA, 20 bp, human
ggtgagtctctggattaggc

SEQ ID NO: 167776 - DNA, 20 bp, human
gcgcgtcctcctgtagccaa

SEQ ID NO: 167777 - DNA, 20 bp, human
ggacaagggtaactcgagag

SEQ ID NO: 167778 - DNA, 20 bp, human
gactcgagagcggcagagtg

SEQ ID NO: 167779 - DNA, 20 bp, human
gaggtggcgggacggacctg

SEQ ID NO: 167780 - DNA, 20 bp, human
ggctggggtgagctgtaggg

SEQ ID NO: 167781 - DNA, 20 bp, human
gtgcctcagaccgcaggcgg

SEQ ID NO: 167782 - DNA, 20 bp, human
gtggcacaggatctccgaca

SEQ ID NO: 167783 - DNA, 20 bp, human
gtagagaagaggggacgcta

SEQ ID NO: 167784 - DNA, 20 bp, human
gggatacgcttccatagcaa

SEQ ID NO: 167785 - DNA, 20 bp, human
gccaggggcgagcgtctgag

SEQ ID NO: 167786 - DNA, 20 bp, human
gcccgccatgaagaagctgt

SEQ ID NO: 167787 - DNA, 20 bp, human
gcgcccccggagccctcacc

SEQ ID NO: 167788 - DNA, 20 bp, human
gtggaaagcttcagagtggg

SEQ ID NO: 167789 - DNA, 20 bp, human
gaagaagcgtttccaggtga

SEQ ID NO: 167790 - DNA, 20 bp, human
gcggggttgaggttggacag

SEQ ID NO: 167791 - DNA, 20 bp, human
gtgggtgaagaagcgtttcc

SEQ ID NO: 167792 - DNA, 20 bp, human
gcgggccgggcgcgatctag

SEQ ID NO: 167793 - DNA, 20 bp, human
gcctccaccgggcccagctg

SEQ ID NO: 167794 - DNA, 20 bp, human
gacccacagcttcttcatgg

SEQ ID NO: 167795 - DNA, 20 bp, human
gcggggcccggggttgaggt

SEQ ID NO: 167796 - DNA, 20 bp, human
gggggaaggcgcctgaggag

SEQ ID NO: 167797 - DNA, 20 bp, human
gtggtgcctgccgagaccac

SEQ ID NO: 167798 - DNA, 20 bp, human
gggcaggcagctggctagga

SEQ ID NO: 167799 - DNA, 20 bp, human
gcctcccccaaggctgactc

SEQ ID NO: 167800 - DNA, 20 bp, human
ggcaggagggcctggtgcca

SEQ ID NO: 167801 - DNA, 20 bp, human
gccctgcacggagaaggccc

SEQ ID NO: 167802 - DNA, 20 bp, human
gtggagtcatccaccaaaaa

SEQ ID NO: 167803 - DNA, 20 bp, human
gcactcggctgacccagctg

SEQ ID NO: 167804 - DNA, 20 bp, human
gggctgcctgtggtctcggc

SEQ ID NO: 167805 - DNA, 20 bp, human
ggaccctggggagaacctag

SEQ ID NO: 167806 - DNA, 20 bp, human
gggcagtcagtggacactgt

SEQ ID NO: 167807 - DNA, 20 bp, human
gtggacactgtcggcacggt

SEQ ID NO: 167808 - DNA, 20 bp, human
gcggtgggctgggggcgtaa

SEQ ID NO: 167809 - DNA, 20 bp, human
gggcctcggccgctcaacca

SEQ ID NO: 167810 - DNA, 20 bp, human
gggtggtcctagggacccca

SEQ ID NO: 167811 - DNA, 20 bp, human
gtgagaggggcgagcaagaa

SEQ ID NO: 167812 - DNA, 20 bp, human
ggagcggccgaggcccgagt

SEQ ID NO: 167813 - DNA, 20 bp, human
gtgtgatacgaggcccactc

SEQ ID NO: 167814 - DNA, 20 bp, human
gaagggccccggtggtccta

SEQ ID NO: 167815 - DNA, 20 bp, human
ggacagagttgcccaggtcc

SEQ ID NO: 167816 - DNA, 20 bp, human
gggcccgagagtcagaacct

SEQ ID NO: 167817 - DNA, 20 bp, human
gagggatggtctctgcacgg

SEQ ID NO: 167818 - DNA, 20 bp, human
gagggtcggcttcgggtgtg

SEQ ID NO: 167819 - DNA, 20 bp, human
ggactccggcccggacccac

SEQ ID NO: 167820 - DNA, 20 bp, human
gatgcgctgccggagcgcga

SEQ ID NO: 167821 - DNA, 20 bp, human
ggaagccgaccctcgcgctc

SEQ ID NO: 167822 - DNA, 20 bp, human
gctcgtacgaagccggcgag

SEQ ID NO: 167823 - DNA, 20 bp, human
ggaggtcccacagcgcccgt

SEQ ID NO: 167824 - DNA, 20 bp, human
gcagcatggtccgggaaacc

SEQ ID NO: 167825 - DNA, 20 bp, human
gccggagcgcggagctggtg

SEQ ID NO: 167826 - DNA, 20 bp, human
ggcgagcaattgaggcccag

SEQ ID NO: 167827 - DNA, 20 bp, human
gtgggaatgaggcatctgac

SEQ ID NO: 167828 - DNA, 20 bp, human
ggtttctctctgagcatcac

SEQ ID NO: 167829 - DNA, 20 bp, human
ggcttcccagctcatcctct

SEQ ID NO: 167830 - DNA, 20 bp, human
gataggtcctatgcagaagt

SEQ ID NO: 167831 - DNA, 20 bp, human
gtctctctgagcatcacagg

SEQ ID NO: 167832 - DNA, 20 bp, human
gaatttggccttgagtgctg

SEQ ID NO: 167833 - DNA, 20 bp, human
gaatgaggcatctgacaggc

SEQ ID NO: 167834 - DNA, 20 bp, human
gtctgcataggacctatacc

SEQ ID NO: 167835 - DNA, 20 bp, human
gaacaatatggtgtttttca

SEQ ID NO: 167836 - DNA, 20 bp, human
gccgaaagggaaggtgtcag

SEQ ID NO: 167837 - DNA, 20 bp, human
gcaccaggctgggaacctca

SEQ ID NO: 167838 - DNA, 20 bp, human
gggcgcggcccagatgagac

SEQ ID NO: 167839 - DNA, 20 bp, human
ggccctgggacacccagcaa

SEQ ID NO: 167840 - DNA, 20 bp, human
gggctggggaaggatcgggt

SEQ ID NO: 167841 - DNA, 20 bp, human
gcaatggctggggaaggatc

SEQ ID NO: 167842 - DNA, 20 bp, human
gaccgttgctgggtgtccca

SEQ ID NO: 167843 - DNA, 20 bp, human
ggggaacctcaaggccgaaa

SEQ ID NO: 167844 - DNA, 20 bp, human
gagggaggcatgtaggacca

SEQ ID NO: 167845 - DNA, 20 bp, human
gtcagggaacgcagcaactg

SEQ ID NO: 167846 - DNA, 20 bp, human
ggtgccccagctaccgccgg

SEQ ID NO: 167847 - DNA, 20 bp, human
gagtaaccgccgggccaaga

SEQ ID NO: 167848 - DNA, 20 bp, human
gggactggcaccaacagcat

SEQ ID NO: 167849 - DNA, 20 bp, human
gctgccagaaggggccctcc

SEQ ID NO: 167850 - DNA, 20 bp, human
gtcgcgagtgctgcttccgc

SEQ ID NO: 167851 - DNA, 20 bp, human
gtcggctgactgagccccaa

SEQ ID NO: 167852 - DNA, 20 bp, human
gcttccgccggcggtagctg

SEQ ID NO: 167853 - DNA, 20 bp, human
gagtgaccggaagtaaccgc

SEQ ID NO: 167854 - DNA, 20 bp, human
gatcggtagaacccgcccca

SEQ ID NO: 167855 - DNA, 20 bp, human
gaggttccggcgaaagtgac

SEQ ID NO: 167856 - DNA, 20 bp, human
ggcagcggcgcccagtgtaa

SEQ ID NO: 167857 - DNA, 20 bp, human
ggcgaggccttgggaacctc

SEQ ID NO: 167858 - DNA, 20 bp, human
ggccggtcccgaggttccca

SEQ ID NO: 167859 - DNA, 20 bp, human
gcacccaagggaccgcgcag

SEQ ID NO: 167860 - DNA, 20 bp, human
gctccgcgataggaatcgag

SEQ ID NO: 167861 - DNA, 20 bp, human
gggcgacggtcacgggacaa

SEQ ID NO: 167862 - DNA, 20 bp, human
ggcgcccagtgtaagggagt

SEQ ID NO: 167863 - DNA, 20 bp, human
ggacggtcacgggacaaggg

SEQ ID NO: 167864 - DNA, 20 bp, human
ggccccgcgcagaccccccc

SEQ ID NO: 167865 - DNA, 20 bp, human
gcatggactgttaggatgga

SEQ ID NO: 167866 - DNA, 20 bp, human
gcggagcactcgggacccac

SEQ ID NO: 167867 - DNA, 20 bp, human
gaccggtgacagccacacaa

SEQ ID NO: 167868 - DNA, 20 bp, human
ggagtctcgcgccagctgag

SEQ ID NO: 167869 - DNA, 20 bp, human
ggcggcacagggcttaaccg

SEQ ID NO: 167870 - DNA, 20 bp, human
gcgcgtggccgagcgagctt

SEQ ID NO: 167871 - DNA, 20 bp, human
gctcgtactggagcgaagag

SEQ ID NO: 167872 - DNA, 20 bp, human
gtgtgtctggggccgaatct

SEQ ID NO: 167873 - DNA, 20 bp, human
gagagcggcctcctgaagga

SEQ ID NO: 167874 - DNA, 20 bp, human
gagtcgtgtagccccaggat

SEQ ID NO: 167875 - DNA, 20 bp, human
ggcgaagagcggcctcctga

SEQ ID NO: 167876 - DNA, 20 bp, human
gaggacccgggcctggaccc

SEQ ID NO: 167877 - DNA, 20 bp, human
gtagaggcccgcgctcagga

SEQ ID NO: 167878 - DNA, 20 bp, human
gggcgggccgggaagaggca

SEQ ID NO: 167879 - DNA, 20 bp, human
gagcagcagcacggccatgt

SEQ ID NO: 167880 - DNA, 20 bp, human
gaggcccgcgctcaggaggg

SEQ ID NO: 167881 - DNA, 20 bp, human
ggaatcccgcctgcgagtag

SEQ ID NO: 167882 - DNA, 20 bp, human
gcacacacaacagacgggtt

SEQ ID NO: 167883 - DNA, 20 bp, human
ggcccagcgcccacgatcca

SEQ ID NO: 167884 - DNA, 20 bp, human
gcccacagcggccgaggacc

SEQ ID NO: 167885 - DNA, 20 bp, human
gagggttcggtcacaggcga

SEQ ID NO: 167886 - DNA, 20 bp, human
gttctgcaagccagtcaaag

SEQ ID NO: 167887 - DNA, 20 bp, human
gctggacagtataaagttca

SEQ ID NO: 167888 - DNA, 20 bp, human
gtttgctgtgccactttgac

SEQ ID NO: 167889 - DNA, 20 bp, human
gccatgtagaatgtagtaaa

SEQ ID NO: 167890 - DNA, 20 bp, human
gactaaaattgtcaattgtg

SEQ ID NO: 167891 - DNA, 20 bp, human
ggttttaaaccgaaagtgaa

SEQ ID NO: 167892 - DNA, 20 bp, human
gatggggaaaagagaatttg

SEQ ID NO: 167893 - DNA, 20 bp, human
gtacatcagattccatgctg

SEQ ID NO: 167894 - DNA, 20 bp, human
ggctttaaaatcaacagagc

SEQ ID NO: 167895 - DNA, 20 bp, human
gtggagccgcactgggctac

SEQ ID NO: 167896 - DNA, 20 bp, human
gagcggcgcgaaggcagggt

SEQ ID NO: 167897 - DNA, 20 bp, human
gcccgctggagcggactccc

SEQ ID NO: 167898 - DNA, 20 bp, human
ggccgcacaggagccacgag

SEQ ID NO: 167899 - DNA, 20 bp, human
gtgaggtccggtgcctccga

SEQ ID NO: 167900 - DNA, 20 bp, human
ggctccagtccctcagacgt

SEQ ID NO: 167901 - DNA, 20 bp, human
gctggagcgccccgctggag

SEQ ID NO: 167902 - DNA, 20 bp, human
gacggcaacctggatggctg

SEQ ID NO: 167903 - DNA, 20 bp, human
gaggccactgtagggaacgg

SEQ ID NO: 167904 - DNA, 20 bp, human
gtccgccccaggccactgta

SEQ ID NO: 167905 - DNA, 20 bp, human
gggagcaggcgcccttctca

SEQ ID NO: 167906 - DNA, 20 bp, human
ggacgccgacggcctctcag

SEQ ID NO: 167907 - DNA, 20 bp, human
gtcagggaagggccatctag

SEQ ID NO: 167908 - DNA, 20 bp, human
ggaatggaggcccaaagggt

SEQ ID NO: 167909 - DNA, 20 bp, human
gggagccactgagaggccgt

SEQ ID NO: 167910 - DNA, 20 bp, human
gaggcaaaatggagactccg

SEQ ID NO: 167911 - DNA, 20 bp, human
ggaagtgcagcgcgagatca

SEQ ID NO: 167912 - DNA, 20 bp, human
gggggtgagatggagaccca

SEQ ID NO: 167913 - DNA, 20 bp, human
gtggctcccggaggacccgg

SEQ ID NO: 167914 - DNA, 20 bp, human
ggacccggcgggcccagtgt

SEQ ID NO: 167915 - DNA, 20 bp, human
gagggagacagagtttcata

SEQ ID NO: 167916 - DNA, 20 bp, human
gcggctcctggctccaccta

SEQ ID NO: 167917 - DNA, 20 bp, human
gggcgcccagagaagaaaga

SEQ ID NO: 167918 - DNA, 20 bp, human
gcaggcgaaggataagtctg

SEQ ID NO: 167919 - DNA, 20 bp, human
gcgcctctaaggcccaggga

SEQ ID NO: 167920 - DNA, 20 bp, human
ggaagaaagacggaaagtgc

SEQ ID NO: 167921 - DNA, 20 bp, human
gagacggaaagtgcaggcga

SEQ ID NO: 167922 - DNA, 20 bp, human
ggctgtgtccgcggaaagtc

SEQ ID NO: 167923 - DNA, 20 bp, human
gcgcgccagtctggcactct

SEQ ID NO: 167924 - DNA, 20 bp, human
gccgcggacacagcttggag

SEQ ID NO: 167925 - DNA, 20 bp, human
gtctgggcgcccaccaacaa

SEQ ID NO: 167926 - DNA, 20 bp, human
gtctgcattggcccccaccg

SEQ ID NO: 167927 - DNA, 20 bp, human
gcaggggctggacggtcgtg

SEQ ID NO: 167928 - DNA, 20 bp, human
ggctggccctgcaatgtcaa

SEQ ID NO: 167929 - DNA, 20 bp, human
gggccctgcaatgtcaaggg

SEQ ID NO: 167930 - DNA, 20 bp, human
gggagtcccggtactcacag

SEQ ID NO: 167931 - DNA, 20 bp, human
gggcctgccccctgagctac

SEQ ID NO: 167932 - DNA, 20 bp, human
gccctgagctacaggagccc

SEQ ID NO: 167933 - DNA, 20 bp, human
gccgatcacagccccaccgt

SEQ ID NO: 167934 - DNA, 20 bp, human
gtactcacaggggggacgag

SEQ ID NO: 167935 - DNA, 20 bp, human
ggaccgtccagcccctgacg

SEQ ID NO: 167936 - DNA, 20 bp, human
ggaggctgcacagtaagtga

SEQ ID NO: 167937 - DNA, 20 bp, human
gggcactgagagtgagggtg

SEQ ID NO: 167938 - DNA, 20 bp, human
gaccaccatgctcgccctgg

SEQ ID NO: 167939 - DNA, 20 bp, human
gggcaccaccatgctcgccc

SEQ ID NO: 167940 - DNA, 20 bp, human
ggaggcagaaggagaccaaa

SEQ ID NO: 167941 - DNA, 20 bp, human
gaccccgggtgcaggtttgg

SEQ ID NO: 167942 - DNA, 20 bp, human
ggggcggcaaacagcccgcc

SEQ ID NO: 167943 - DNA, 20 bp, human
gagagtgagggtgaggcaga

SEQ ID NO: 167944 - DNA, 20 bp, human
gcaggaaagataggaactgg

SEQ ID NO: 167945 - DNA, 20 bp, human
ggcagcctccagggcgagca

SEQ ID NO: 167946 - DNA, 20 bp, human
gtaattgaaaatcactgaca

SEQ ID NO: 167947 - DNA, 20 bp, human
gtctgccagtatgttcttga

SEQ ID NO: 167948 - DNA, 20 bp, human
gcataagctgagaacttacc

SEQ ID NO: 167949 - DNA, 20 bp, human
ggaaacactcattaggccaa

SEQ ID NO: 167950 - DNA, 20 bp, human
gaagggttgaagtgtcttcc

SEQ ID NO: 167951 - DNA, 20 bp, human
gaatagctgcgatagtcttg

SEQ ID NO: 167952 - DNA, 20 bp, human
gataaccatcaagaacatac

SEQ ID NO: 167953 - DNA, 20 bp, human
gttcatcagagccattgcac

SEQ ID NO: 167954 - DNA, 20 bp, human
gacagtgagaaacactcatt

SEQ ID NO: 167955 - DNA, 20 bp, human
gtacaagtagcaaatctaaa

SEQ ID NO: 167956 - DNA, 20 bp, human
gcgctggctgggttaacctg

SEQ ID NO: 167957 - DNA, 20 bp, human
gtaacctgtggcgcgctccg

SEQ ID NO: 167958 - DNA, 20 bp, human
gacttcaggcgccggaaccg

SEQ ID NO: 167959 - DNA, 20 bp, human
gaagtaaggattccccaacc

SEQ ID NO: 167960 - DNA, 20 bp, human
ggaaccgcggagcgcgccac

SEQ ID NO: 167961 - DNA, 20 bp, human
gggctgcgcttcctgaagta

SEQ ID NO: 167962 - DNA, 20 bp, human
gggcggagctctggtaaccc

SEQ ID NO: 167963 - DNA, 20 bp, human
gccaccgcagctaaaacttc

SEQ ID NO: 167964 - DNA, 20 bp, human
gcaacgagccttagggacca

SEQ ID NO: 167965 - DNA, 20 bp, human
ggcgcctgaagttttagctg

SEQ ID NO: 167966 - DNA, 20 bp, human
gcgctcccggagatgccccg

SEQ ID NO: 167967 - DNA, 20 bp, human
gaccaaaccgcagggaatcc

SEQ ID NO: 167968 - DNA, 20 bp, human
gagccgcgctcggggctcta

SEQ ID NO: 167969 - DNA, 20 bp, human
gctgaggaggcggtgcgctc

SEQ ID NO: 167970 - DNA, 20 bp, human
gtaccttagagccccgagcg

SEQ ID NO: 167971 - DNA, 20 bp, human
ggctgccgcggggcatctcc

SEQ ID NO: 167972 - DNA, 20 bp, human
gggctgactgcccaatccgt

SEQ ID NO: 167973 - DNA, 20 bp, human
gcgcaacgcgggaaacggcg

SEQ ID NO: 167974 - DNA, 20 bp, human
ggttgacagtggattatccg

SEQ ID NO: 167975 - DNA, 20 bp, human
gggaccgccgagggacgcag

SEQ ID NO: 167976 - DNA, 20 bp, human
gcggggaactggggacgaga

SEQ ID NO: 167977 - DNA, 20 bp, human
ggtccgcggcgagggagcgg

SEQ ID NO: 167978 - DNA, 20 bp, human
gagtaggggccggcgaacaa

SEQ ID NO: 167979 - DNA, 20 bp, human
ggagcgacggcggaacccgt

SEQ ID NO: 167980 - DNA, 20 bp, human
gggcggcggccggggaactg

SEQ ID NO: 167981 - DNA, 20 bp, human
gatgggggcacggaggagta

SEQ ID NO: 167982 - DNA, 20 bp, human
ggcgcgtgcgccctgactgt

SEQ ID NO: 167983 - DNA, 20 bp, human
gcgggagcgcgaacgagcga

SEQ ID NO: 167984 - DNA, 20 bp, human
ggcgcgcgctaaggggccgg

SEQ ID NO: 167985 - DNA, 20 bp, human
ggtgggtcgtgagggagtgc

SEQ ID NO: 167986 - DNA, 20 bp, human
gtcacaacagtggaacctgt

SEQ ID NO: 167987 - DNA, 20 bp, human
gccactgcatcagggactgg

SEQ ID NO: 167988 - DNA, 20 bp, human
gttttcttggggcccctcct

SEQ ID NO: 167989 - DNA, 20 bp, human
ggactggtggcagcccaacg

SEQ ID NO: 167990 - DNA, 20 bp, human
ggcccaacgtggctgagggg

SEQ ID NO: 167991 - DNA, 20 bp, human
gtggccgtctacctccctgt

SEQ ID NO: 167992 - DNA, 20 bp, human
ggcagcccaacgtggctgag

SEQ ID NO: 167993 - DNA, 20 bp, human
ggccacccctcagccacgtt

SEQ ID NO: 167994 - DNA, 20 bp, human
gctgttgtgaattgtggaaa

SEQ ID NO: 167995 - DNA, 20 bp, human
ggactacagccactgcatca

SEQ ID NO: 167996 - DNA, 20 bp, human
ggactggtggaatcccgatg

SEQ ID NO: 167997 - DNA, 20 bp, human
ggaatcccgatgtggctgag

SEQ ID NO: 167998 - DNA, 20 bp, human
gggagggctagcgagccaag

SEQ ID NO: 167999 - DNA, 20 bp, human
gctgcgctacggaaagaggg

SEQ ID NO: 168000 - DNA, 20 bp, human
ggctagcgagccaagcggtg

SEQ ID NO: 168001 - DNA, 20 bp, human
gcggtgagcaacatgaaaag

SEQ ID NO: 168002 - DNA, 20 bp, human
gcttcgccacaggctcgtag

SEQ ID NO: 168003 - DNA, 20 bp, human
gcgccacaggctcgtagcgg

SEQ ID NO: 168004 - DNA, 20 bp, human
ggcggcccctcagccacatc

SEQ ID NO: 168005 - DNA, 20 bp, human
gaagctgcgctacggaaaga

SEQ ID NO: 168006 - DNA, 20 bp, human
gactagtgggagtccgatgt

SEQ ID NO: 168007 - DNA, 20 bp, human
gggagtccgatgtgggagag

SEQ ID NO: 168008 - DNA, 20 bp, human
gcggcgcagcagcgactagt

SEQ ID NO: 168009 - DNA, 20 bp, human
gtactgcaggcactcagcca

SEQ ID NO: 168010 - DNA, 20 bp, human
gctgcgctagaaaaagaagg

SEQ ID NO: 168011 - DNA, 20 bp, human
gcgcagcccctctcccacat

SEQ ID NO: 168012 - DNA, 20 bp, human
gctccgcagtgagcctatgg

SEQ ID NO: 168013 - DNA, 20 bp, human
gcaggcgaagatgaccgtgg

SEQ ID NO: 168014 - DNA, 20 bp, human
gtcagtctggctaagatctg

SEQ ID NO: 168015 - DNA, 20 bp, human
ggggcaggcgaagatgaccg

SEQ ID NO: 168016 - DNA, 20 bp, human
gcaggcggcggcaagtctct

SEQ ID NO: 168017 - DNA, 20 bp, human
gagctggcttggcttcactc

SEQ ID NO: 168018 - DNA, 20 bp, human
ggctgcagcggcaaaggcgc

SEQ ID NO: 168019 - DNA, 20 bp, human
gcggctgacgtagagatggc

SEQ ID NO: 168020 - DNA, 20 bp, human
gaggagacgacggggacgaa

SEQ ID NO: 168021 - DNA, 20 bp, human
gcatagctcagggattaaga

SEQ ID NO: 168022 - DNA, 20 bp, human
gacggcggcagaggagacga

SEQ ID NO: 168023 - DNA, 20 bp, human
gtgctgcagtaacccttcta

SEQ ID NO: 168024 - DNA, 20 bp, human
ggagccttgcacttggagaa

SEQ ID NO: 168025 - DNA, 20 bp, human
gagtctctggggagtccgcg

SEQ ID NO: 168026 - DNA, 20 bp, human
gtgaagagacgtggtaagtg

SEQ ID NO: 168027 - DNA, 20 bp, human
ggctgaagttctgcgtccag

SEQ ID NO: 168028 - DNA, 20 bp, human
ggggtcagccacatcaatag

SEQ ID NO: 168029 - DNA, 20 bp, human
ggatagactcaacagggcca

SEQ ID NO: 168030 - DNA, 20 bp, human
gtgggactggaagggtcata

SEQ ID NO: 168031 - DNA, 20 bp, human
ggcagttttcaactgacctc

SEQ ID NO: 168032 - DNA, 20 bp, human
gctgaccctttgttgggata

SEQ ID NO: 168033 - DNA, 20 bp, human
gatgtggctgaccctttgtt

SEQ ID NO: 168034 - DNA, 20 bp, human
gctcttcagaagcctgggac

SEQ ID NO: 168035 - DNA, 20 bp, human
gctctaccatatcccaacaa

SEQ ID NO: 168036 - DNA, 20 bp, human
gagacagaatggatagagta

SEQ ID NO: 168037 - DNA, 20 bp, human
gcaaggacgtacagcagtgg

SEQ ID NO: 168038 - DNA, 20 bp, human
gaacccactgacagagagga

SEQ ID NO: 168039 - DNA, 20 bp, human
ggtccttggctacagactcc

SEQ ID NO: 168040 - DNA, 20 bp, human
ggtagggcgtgagcaagtta

SEQ ID NO: 168041 - DNA, 20 bp, human
gccaccgctgacttggacta

SEQ ID NO: 168042 - DNA, 20 bp, human
gaagagtggttacctggatg

SEQ ID NO: 168043 - DNA, 20 bp, human
gtggatgaggtggctgaata

SEQ ID NO: 168044 - DNA, 20 bp, human
gaacaaaaggagggtgttag

SEQ ID NO: 168045 - DNA, 20 bp, human
gcagaaagtatgaacttcat

SEQ ID NO: 168046 - DNA, 20 bp, human
ggacacaccaggaggaaaaa

SEQ ID NO: 168047 - DNA, 20 bp, human
gaggacaaaagtgagaatac

SEQ ID NO: 168048 - DNA, 20 bp, human
gtacatttggtgttatcttc

SEQ ID NO: 168049 - DNA, 20 bp, human
gaccaaatgtatcaagataa

SEQ ID NO: 168050 - DNA, 20 bp, human
ggagaatactgggaaagatt

SEQ ID NO: 168051 - DNA, 20 bp, human
gacactctgcaacacgtcaa

SEQ ID NO: 168052 - DNA, 20 bp, human
gttctggtgagtaatttagc

SEQ ID NO: 168053 - DNA, 20 bp, human
gtgagtaatttagctggtct

SEQ ID NO: 168054 - DNA, 20 bp, human
gagagtatatgacaaaatga

SEQ ID NO: 168055 - DNA, 20 bp, human
gtcctttatcttgatacatt

SEQ ID NO: 168056 - DNA, 20 bp, human
ggtagcgctcggagcggtcc

SEQ ID NO: 168057 - DNA, 20 bp, human
gggcgcaggtaacagaccgc

SEQ ID NO: 168058 - DNA, 20 bp, human
gaccgcaggggcaagacagc

SEQ ID NO: 168059 - DNA, 20 bp, human
gcacgagcgctccctgcgag

SEQ ID NO: 168060 - DNA, 20 bp, human
ggccggctgtcttgcccctg

SEQ ID NO: 168061 - DNA, 20 bp, human
gccccagaggacctgccagg

SEQ ID NO: 168062 - DNA, 20 bp, human
gcccaagggaggagatgtgc

SEQ ID NO: 168063 - DNA, 20 bp, human
gacctgcgaaggtaactgcc

SEQ ID NO: 168064 - DNA, 20 bp, human
gaaactcaactcctcatctt

SEQ ID NO: 168065 - DNA, 20 bp, human
ggttactggcggttccccag

SEQ ID NO: 168066 - DNA, 20 bp, human
gggccagggcgattacccac

SEQ ID NO: 168067 - DNA, 20 bp, human
gcagggcgattacccactgg

SEQ ID NO: 168068 - DNA, 20 bp, human
ggctcaggctacactatccc

SEQ ID NO: 168069 - DNA, 20 bp, human
ggctgcactgagcaactatt

SEQ ID NO: 168070 - DNA, 20 bp, human
gcaggtaggtcccagctctc

SEQ ID NO: 168071 - DNA, 20 bp, human
gagcatggccgtccgccagt

SEQ ID NO: 168072 - DNA, 20 bp, human
gctcacccctgtccacaaca

SEQ ID NO: 168073 - DNA, 20 bp, human
gcggacggccatgctgatcc

SEQ ID NO: 168074 - DNA, 20 bp, human
gacccctgtccacaacaagg

SEQ ID NO: 168075 - DNA, 20 bp, human
ggcgattacccactggcgga

SEQ ID NO: 168076 - DNA, 20 bp, human
ggtatgaggcaaagagccaa

SEQ ID NO: 168077 - DNA, 20 bp, human
ggacgatgcaagtcgcctac

SEQ ID NO: 168078 - DNA, 20 bp, human
gtgcagtatgactgaactcg

SEQ ID NO: 168079 - DNA, 20 bp, human
gcattttttggcaggagtag

SEQ ID NO: 168080 - DNA, 20 bp, human
gatcttcagaactctgtgtc

SEQ ID NO: 168081 - DNA, 20 bp, human
gggagaaaagtcccttcccc

SEQ ID NO: 168082 - DNA, 20 bp, human
gaaattgctcaccttgtatg

SEQ ID NO: 168083 - DNA, 20 bp, human
gatgttgttatctttagaaa

SEQ ID NO: 168084 - DNA, 20 bp, human
gtgcatacgtaaacattttt

SEQ ID NO: 168085 - DNA, 20 bp, human
gggcagaagcactgacactg

SEQ ID NO: 168086 - DNA, 20 bp, human
gagacggcaatagcttatct

SEQ ID NO: 168087 - DNA, 20 bp, human
gtcacaccctttcttactat

SEQ ID NO: 168088 - DNA, 20 bp, human
gttcttgcctatagtaagaa

SEQ ID NO: 168089 - DNA, 20 bp, human
gagagaaattgccaaagata

SEQ ID NO: 168090 - DNA, 20 bp, human
gtttcattactcaaaggttt

SEQ ID NO: 168091 - DNA, 20 bp, human
gtctaggaatagtcaatttg

SEQ ID NO: 168092 - DNA, 20 bp, human
ggctgaaaatgccaagcgag

SEQ ID NO: 168093 - DNA, 20 bp, human
ggttaagaaaagtaaacagt

SEQ ID NO: 168094 - DNA, 20 bp, human
gcacaagaacaaaattgcgt

SEQ ID NO: 168095 - DNA, 20 bp, human
gatctaatgattaatattct

SEQ ID NO: 168096 - DNA, 20 bp, human
gagttagctcactcagatca

SEQ ID NO: 168097 - DNA, 20 bp, human
gctgacacaatgaaactgtc

SEQ ID NO: 168098 - DNA, 20 bp, human
ggcaactagtagttagaatc

SEQ ID NO: 168099 - DNA, 20 bp, human
gaggctgctttgtccagctg

SEQ ID NO: 168100 - DNA, 20 bp, human
gtccagttcagtataaatat

SEQ ID NO: 168101 - DNA, 20 bp, human
gcattatagggatgattcac

SEQ ID NO: 168102 - DNA, 20 bp, human
gtattctaggcatgtacgaa

SEQ ID NO: 168103 - DNA, 20 bp, human
gaaactgcataggactcatg

SEQ ID NO: 168104 - DNA, 20 bp, human
ggtgatgacgacaatggtta

SEQ ID NO: 168105 - DNA, 20 bp, human
gaacaaccaatacatcctcc

SEQ ID NO: 168106 - DNA, 20 bp, human
ggaccactgtacagagcaga

SEQ ID NO: 168107 - DNA, 20 bp, human
gtccagcatgaagatcactg

SEQ ID NO: 168108 - DNA, 20 bp, human
gtgaccccttacctgggata

SEQ ID NO: 168109 - DNA, 20 bp, human
gtcgaccatatcccaggtaa

SEQ ID NO: 168110 - DNA, 20 bp, human
ggctgcatcgaccatatccc

SEQ ID NO: 168111 - DNA, 20 bp, human
gcttcccaaatcagtttggg

SEQ ID NO: 168112 - DNA, 20 bp, human
gtccttgaaagtgaagacat

SEQ ID NO: 168113 - DNA, 20 bp, human
gtagcagctcaggtaagtta

SEQ ID NO: 168114 - DNA, 20 bp, human
gtctatgttcatatggacac

SEQ ID NO: 168115 - DNA, 20 bp, human
ggtatctttgcactaagaaa

SEQ ID NO: 168116 - DNA, 20 bp, human
gcatggaggtagctagaaca

SEQ ID NO: 168117 - DNA, 20 bp, human
gattgcaaaggccatccaca

SEQ ID NO: 168118 - DNA, 20 bp, human
gaacagtagggaatctctga

SEQ ID NO: 168119 - DNA, 20 bp, human
gagaaactcattagactatg

SEQ ID NO: 168120 - DNA, 20 bp, human
gcatggtgacagaagaactg

SEQ ID NO: 168121 - DNA, 20 bp, human
gcataactcaccaattgcaa

SEQ ID NO: 168122 - DNA, 20 bp, human
gagatttactgcagaaaatg

SEQ ID NO: 168123 - DNA, 20 bp, human
ggtagactcagatattattc

SEQ ID NO: 168124 - DNA, 20 bp, human
gcatgcttatagttaacagt

SEQ ID NO: 168125 - DNA, 20 bp, human
gggtagtaacctggcatttt

SEQ ID NO: 168126 - DNA, 20 bp, human
ggccaaggcagtcagatgta

SEQ ID NO: 168127 - DNA, 20 bp, human
gagagccaagagtaggacta

SEQ ID NO: 168128 - DNA, 20 bp, human
gagtgagctggacggacacc

SEQ ID NO: 168129 - DNA, 20 bp, human
ggcatgagctattagtacaa

SEQ ID NO: 168130 - DNA, 20 bp, human
ggtagggaaaagaagtgacc

SEQ ID NO: 168131 - DNA, 20 bp, human
ggtggttgaaaattctaggg

SEQ ID NO: 168132 - DNA, 20 bp, human
gacagccatagtcctactct

SEQ ID NO: 168133 - DNA, 20 bp, human
gtgctctcatagtactgaag

SEQ ID NO: 168134 - DNA, 20 bp, human
gatcaattgtttggcaccat

SEQ ID NO: 168135 - DNA, 20 bp, human
gaacattacaatcaattgtt

SEQ ID NO: 168136 - DNA, 20 bp, human
gggtgacctgagaagaaggg

SEQ ID NO: 168137 - DNA, 20 bp, human
gagctctccgagcaccgggt

SEQ ID NO: 168138 - DNA, 20 bp, human
ggccaagttgcagttctggg

SEQ ID NO: 168139 - DNA, 20 bp, human
ggcgcacgcagtcccagccc

SEQ ID NO: 168140 - DNA, 20 bp, human
gcacagaagccacaaggcga

SEQ ID NO: 168141 - DNA, 20 bp, human
ggcgggcctctgggttccga

SEQ ID NO: 168142 - DNA, 20 bp, human
gtgatcagcccgggagactt

SEQ ID NO: 168143 - DNA, 20 bp, human
gacggacaggcggaccgcta

SEQ ID NO: 168144 - DNA, 20 bp, human
gtgtgcacgctcggcctcca

SEQ ID NO: 168145 - DNA, 20 bp, human
gtggcgtcctccccgcggtc

SEQ ID NO: 168146 - DNA, 20 bp, human
gcatcgcgcgccgagaaggc

SEQ ID NO: 168147 - DNA, 20 bp, human
gcgcgttgggaggtgtagcg

SEQ ID NO: 168148 - DNA, 20 bp, human
gacccgcccggccctcaccg

SEQ ID NO: 168149 - DNA, 20 bp, human
gcgccgcctgcgacactcaa

SEQ ID NO: 168150 - DNA, 20 bp, human
ggcgagtgaggagcagaccc

SEQ ID NO: 168151 - DNA, 20 bp, human
ggaggctcgggggtcaacgg

SEQ ID NO: 168152 - DNA, 20 bp, human
gggccgggcgggtaggctgg

SEQ ID NO: 168153 - DNA, 20 bp, human
gggccgttgagtgtcgcagg

SEQ ID NO: 168154 - DNA, 20 bp, human
ggcggctctgaacgcgctga

SEQ ID NO: 168155 - DNA, 20 bp, human
ggcgacctccgcgcgttggg

SEQ ID NO: 168156 - DNA, 20 bp, human
gcatggtgccactcagccag

SEQ ID NO: 168157 - DNA, 20 bp, human
gtagttctgatcgaagctct

SEQ ID NO: 168158 - DNA, 20 bp, human
gatcagaactagcacgaggt

SEQ ID NO: 168159 - DNA, 20 bp, human
gatccggtaaggtaagaaat

SEQ ID NO: 168160 - DNA, 20 bp, human
gaaggggccttcaatgtctg

SEQ ID NO: 168161 - DNA, 20 bp, human
gtccctaaaatggcaacccc

SEQ ID NO: 168162 - DNA, 20 bp, human
ggggccttcaatgtctgggg

SEQ ID NO: 168163 - DNA, 20 bp, human
gcgaggttggtatgaaatgt

SEQ ID NO: 168164 - DNA, 20 bp, human
gattgactctcaatccggta

SEQ ID NO: 168165 - DNA, 20 bp, human
gtagcatcttaatttcacaa

SEQ ID NO: 168166 - DNA, 20 bp, human
gcccagcttggcagacttca

SEQ ID NO: 168167 - DNA, 20 bp, human
gcaagggactaagtgtctat

SEQ ID NO: 168168 - DNA, 20 bp, human
gcttagaagaaatcccagct

SEQ ID NO: 168169 - DNA, 20 bp, human
gcccaatacataatcatcaa

SEQ ID NO: 168170 - DNA, 20 bp, human
gcctcaaaggtatgaagcta

SEQ ID NO: 168171 - DNA, 20 bp, human
gtgaataccctgttattggg

SEQ ID NO: 168172 - DNA, 20 bp, human
gcacttagtcccttgactca

SEQ ID NO: 168173 - DNA, 20 bp, human
gttaacaccacccaataaca

SEQ ID NO: 168174 - DNA, 20 bp, human
gaaattgcggagaagatatg

SEQ ID NO: 168175 - DNA, 20 bp, human
gcatgaaaggaagaccttcc

SEQ ID NO: 168176 - DNA, 20 bp, human
gcgcggccgagcgcacacgg

SEQ ID NO: 168177 - DNA, 20 bp, human
gggagacccccgggaggatc

SEQ ID NO: 168178 - DNA, 20 bp, human
gcctgagccatcccgcgggt

SEQ ID NO: 168179 - DNA, 20 bp, human
ggaccaggcgagtgcccggg

SEQ ID NO: 168180 - DNA, 20 bp, human
gggcactcgcctggtcccgg

SEQ ID NO: 168181 - DNA, 20 bp, human
gccgcagcactggtagcaca

SEQ ID NO: 168182 - DNA, 20 bp, human
gcagccgcaggatctcctcc

SEQ ID NO: 168183 - DNA, 20 bp, human
gagatccgcgtctggaggga

SEQ ID NO: 168184 - DNA, 20 bp, human
gatccggcggggacccgcag

SEQ ID NO: 168185 - DNA, 20 bp, human
gagccgcctgagccatcccg

SEQ ID NO: 168186 - DNA, 20 bp, human
gtccgggtcccgcagagaag

SEQ ID NO: 168187 - DNA, 20 bp, human
gggcgcgcgggaggcgatga

SEQ ID NO: 168188 - DNA, 20 bp, human
gggatctcccgctccagaac

SEQ ID NO: 168189 - DNA, 20 bp, human
gaggcgcggctgcatggacg

SEQ ID NO: 168190 - DNA, 20 bp, human
gagtgggagggagggagctc

SEQ ID NO: 168191 - DNA, 20 bp, human
gccaggctgaccctgcgcgg

SEQ ID NO: 168192 - DNA, 20 bp, human
gcgggagatccccttctctg

SEQ ID NO: 168193 - DNA, 20 bp, human
ggctgcgaccggttctggag

SEQ ID NO: 168194 - DNA, 20 bp, human
gcggcagccctggaagcaca

SEQ ID NO: 168195 - DNA, 20 bp, human
gcgtgggccgtgtgcttcca

SEQ ID NO: 168196 - DNA, 20 bp, human
ggctgtgggagcaggcgggt

SEQ ID NO: 168197 - DNA, 20 bp, human
ggggaaggacagggccccaa

SEQ ID NO: 168198 - DNA, 20 bp, human
gttgccccagcctcgggagg

SEQ ID NO: 168199 - DNA, 20 bp, human
gccgaggctggggcaagact

SEQ ID NO: 168200 - DNA, 20 bp, human
gccggagaagcagaacacgc

SEQ ID NO: 168201 - DNA, 20 bp, human
gatcagccgagccggtaaga

SEQ ID NO: 168202 - DNA, 20 bp, human
ggtggggtaggggcctcagt

SEQ ID NO: 168203 - DNA, 20 bp, human
gtaagagggtgagacttggt

SEQ ID NO: 168204 - DNA, 20 bp, human
gagcaagagctgggacctgc

SEQ ID NO: 168205 - DNA, 20 bp, human
gtgtgagcctgagaactcaa

SEQ ID NO: 168206 - DNA, 20 bp, human
gcagcccgggcgctgcacca

SEQ ID NO: 168207 - DNA, 20 bp, human
gtgcagcgggctcctacccc

SEQ ID NO: 168208 - DNA, 20 bp, human
gctgccgtggtgcagcgccc

SEQ ID NO: 168209 - DNA, 20 bp, human
gccctcgcaggtgggatcgt

SEQ ID NO: 168210 - DNA, 20 bp, human
gtgaccggctttaagcaaca

SEQ ID NO: 168211 - DNA, 20 bp, human
gggctcccgcgtcacatgac

SEQ ID NO: 168212 - DNA, 20 bp, human
gaggaggatggaccgaacac

SEQ ID NO: 168213 - DNA, 20 bp, human
ggccacccctcacccggggt

SEQ ID NO: 168214 - DNA, 20 bp, human
gggaagtgcgcccggagacg

SEQ ID NO: 168215 - DNA, 20 bp, human
gccgaggtcccggaccagga

SEQ ID NO: 168216 - DNA, 20 bp, human
gcgaggcgcagcgagctgag

SEQ ID NO: 168217 - DNA, 20 bp, human
gcatcctggtcgggccccgt

SEQ ID NO: 168218 - DNA, 20 bp, human
gcggagcgcaggagccgacg

SEQ ID NO: 168219 - DNA, 20 bp, human
gcccgaccaggatggtgcag

SEQ ID NO: 168220 - DNA, 20 bp, human
ggccactgcaccatcctggt

SEQ ID NO: 168221 - DNA, 20 bp, human
gggctgcgcagctactgcaa

SEQ ID NO: 168222 - DNA, 20 bp, human
gatgaggtgcagacgctgtc

SEQ ID NO: 168223 - DNA, 20 bp, human
gcccaagctgaggatggcgg

SEQ ID NO: 168224 - DNA, 20 bp, human
ggagcacgttgcccaagctg

SEQ ID NO: 168225 - DNA, 20 bp, human
gtgcctggaatgcgcctcgg

SEQ ID NO: 168226 - DNA, 20 bp, human
gtcatcctggcgccagtctc

SEQ ID NO: 168227 - DNA, 20 bp, human
ggcagctcttggcctgagac

SEQ ID NO: 168228 - DNA, 20 bp, human
gcaagagctgcaggctggca

SEQ ID NO: 168229 - DNA, 20 bp, human
gccacgtaggccctccacgg

SEQ ID NO: 168230 - DNA, 20 bp, human
gatggctggggggatgtcag

SEQ ID NO: 168231 - DNA, 20 bp, human
gaggtgagaacaccagagat

SEQ ID NO: 168232 - DNA, 20 bp, human
gaggttgatgtagcagagga

SEQ ID NO: 168233 - DNA, 20 bp, human
gagctgtgctcgaatcgggg

SEQ ID NO: 168234 - DNA, 20 bp, human
gttgatgtagcagaggacgg

SEQ ID NO: 168235 - DNA, 20 bp, human
gggcccaggagcagaaagat

SEQ ID NO: 168236 - DNA, 20 bp, human
ggcacgcagccacgccccaa

SEQ ID NO: 168237 - DNA, 20 bp, human
gaagggcgcagcctaggaca

SEQ ID NO: 168238 - DNA, 20 bp, human
gacgaggcctcgggccccat

SEQ ID NO: 168239 - DNA, 20 bp, human
gtcgggccccataggtgcaa

SEQ ID NO: 168240 - DNA, 20 bp, human
gcctcagcctcaacactagg

SEQ ID NO: 168241 - DNA, 20 bp, human
ggccactctgtagaaaagtc

SEQ ID NO: 168242 - DNA, 20 bp, human
gcccttctagaacgttccag

SEQ ID NO: 168243 - DNA, 20 bp, human
ggcagggagcccccaactgg

SEQ ID NO: 168244 - DNA, 20 bp, human
gcagcagggactccctgtgt

SEQ ID NO: 168245 - DNA, 20 bp, human
gcccaacctataaggatctt

SEQ ID NO: 168246 - DNA, 20 bp, human
gccctctgggacctgacaca

SEQ ID NO: 168247 - DNA, 20 bp, human
gcatccgcaccaggtcgtag

SEQ ID NO: 168248 - DNA, 20 bp, human
gtgagcccaggaggctctcc

SEQ ID NO: 168249 - DNA, 20 bp, human
ggatgggtgaggggatgtag

SEQ ID NO: 168250 - DNA, 20 bp, human
ggagctcccgaaggctgtgg

SEQ ID NO: 168251 - DNA, 20 bp, human
ggtggcctgagagtggaaga

SEQ ID NO: 168252 - DNA, 20 bp, human
ggatgtcaccccctacgacc

SEQ ID NO: 168253 - DNA, 20 bp, human
gcaccccctacgacctggtg

SEQ ID NO: 168254 - DNA, 20 bp, human
gacccacgacaggaacaagt

SEQ ID NO: 168255 - DNA, 20 bp, human
ggccttgtgtcaggtcccag

SEQ ID NO: 168256 - DNA, 20 bp, human
ggatgccgccctcctatcag

SEQ ID NO: 168257 - DNA, 20 bp, human
gtcgctgcgggctcacaaag

SEQ ID NO: 168258 - DNA, 20 bp, human
gcgccgggaaggctgatcgc

SEQ ID NO: 168259 - DNA, 20 bp, human
gaaagcggccagacgctcgg

SEQ ID NO: 168260 - DNA, 20 bp, human
gcgcactcccacagacggtg

SEQ ID NO: 168261 - DNA, 20 bp, human
ggcggccagacgctcggcgg

SEQ ID NO: 168262 - DNA, 20 bp, human
gcaagcccctgataggaggg

SEQ ID NO: 168263 - DNA, 20 bp, human
gcacgccgcactcccacaga

SEQ ID NO: 168264 - DNA, 20 bp, human
gggctgccgtccaactacag

SEQ ID NO: 168265 - DNA, 20 bp, human
ggagacctcagggcgctcaa

SEQ ID NO: 168266 - DNA, 20 bp, human
ggttcggggattgagctccg

SEQ ID NO: 168267 - DNA, 20 bp, human
gtcctccatgaaattgccgg

SEQ ID NO: 168268 - DNA, 20 bp, human
gctgccaaggcagagacccg

SEQ ID NO: 168269 - DNA, 20 bp, human
gtcgcggctgaaatgtgacc

SEQ ID NO: 168270 - DNA, 20 bp, human
gccggtgactggcggagagt

SEQ ID NO: 168271 - DNA, 20 bp, human
gtgagtccgcagggctgcca

SEQ ID NO: 168272 - DNA, 20 bp, human
gcagcggcaagatcaagcac

SEQ ID NO: 168273 - DNA, 20 bp, human
gagtcaccggaggcagaccg

SEQ ID NO: 168274 - DNA, 20 bp, human
ggtctgcctccggtgactgg

SEQ ID NO: 168275 - DNA, 20 bp, human
ggctgaaatgtgacctggtt

SEQ ID NO: 168276 - DNA, 20 bp, human
gggagctgcgagcacagtgc

SEQ ID NO: 168277 - DNA, 20 bp, human
gtgacaaggaagtcggacag

SEQ ID NO: 168278 - DNA, 20 bp, human
gtagcaacgacgagggtaga

SEQ ID NO: 168279 - DNA, 20 bp, human
gggagaggagacacaacggg

SEQ ID NO: 168280 - DNA, 20 bp, human
gagtggacggctcgagacgg

SEQ ID NO: 168281 - DNA, 20 bp, human
gctgagtggacggctcgaga

SEQ ID NO: 168282 - DNA, 20 bp, human
ggctgcacacacacacagta

SEQ ID NO: 168283 - DNA, 20 bp, human
gaaggtgatgtgccaggaag

SEQ ID NO: 168284 - DNA, 20 bp, human
gcatgcattagcaacgacga

SEQ ID NO: 168285 - DNA, 20 bp, human
gggcatgtcagtgtcaaata

SEQ ID NO: 168286 - DNA, 20 bp, human
ggccgggcggccacttaccg

SEQ ID NO: 168287 - DNA, 20 bp, human
gtccacgcggaggctgaact

SEQ ID NO: 168288 - DNA, 20 bp, human
ggccctgggcgcgcaggata

SEQ ID NO: 168289 - DNA, 20 bp, human
ggggcacggtctccgagtcg

SEQ ID NO: 168290 - DNA, 20 bp, human
gagccgggaaccagctaccg

SEQ ID NO: 168291 - DNA, 20 bp, human
gtcccggcttgtagaagtcg

SEQ ID NO: 168292 - DNA, 20 bp, human
gggggtcgccctccacgcgg

SEQ ID NO: 168293 - DNA, 20 bp, human
gggccagcagtgccggagtc

SEQ ID NO: 168294 - DNA, 20 bp, human
gcccagggcacgcggcgcga

SEQ ID NO: 168295 - DNA, 20 bp, human
gcccgaagtggtcccgacga

SEQ ID NO: 168296 - DNA, 20 bp, human
ggccggcctcgggcttaaat

SEQ ID NO: 168297 - DNA, 20 bp, human
gccgcgcgctggcaccgtcg

SEQ ID NO: 168298 - DNA, 20 bp, human
gcaccgtcgtggcagcctcg

SEQ ID NO: 168299 - DNA, 20 bp, human
gcgagaggcagataggacgt

SEQ ID NO: 168300 - DNA, 20 bp, human
ggctccgcaaagctctcctg

SEQ ID NO: 168301 - DNA, 20 bp, human
gaggccccgggtccctgcga

SEQ ID NO: 168302 - DNA, 20 bp, human
ggacggcgaaggcatcccgg

SEQ ID NO: 168303 - DNA, 20 bp, human
gtggaaagccgagagggctg

SEQ ID NO: 168304 - DNA, 20 bp, human
gagctttgcggagcagggag

SEQ ID NO: 168305 - DNA, 20 bp, human
gctctcggctttccaccccg

SEQ ID NO: 168306 - DNA, 20 bp, human
gggatgttgcggacagtatg

SEQ ID NO: 168307 - DNA, 20 bp, human
gcaggcgacagctcagtatt

SEQ ID NO: 168308 - DNA, 20 bp, human
gcccactcacctgagagcgg

SEQ ID NO: 168309 - DNA, 20 bp, human
gctgtcgcctgcggcgagat

SEQ ID NO: 168310 - DNA, 20 bp, human
ggcggtgttgcagggacctg

SEQ ID NO: 168311 - DNA, 20 bp, human
gcgcaacatccgggacctgc

SEQ ID NO: 168312 - DNA, 20 bp, human
ggatggggctgggaaatgat

SEQ ID NO: 168313 - DNA, 20 bp, human
gccccccactcacctgagag

SEQ ID NO: 168314 - DNA, 20 bp, human
ggtatttggcaagggggatg

SEQ ID NO: 168315 - DNA, 20 bp, human
gtgtgtatcggcggtcccgc

SEQ ID NO: 168316 - DNA, 20 bp, human
gagcccagacgggcccgcgg

SEQ ID NO: 168317 - DNA, 20 bp, human
gtccgggacccagagagcag

SEQ ID NO: 168318 - DNA, 20 bp, human
gcggaagccggagcccagac

SEQ ID NO: 168319 - DNA, 20 bp, human
gccccgccgcgggcccgtct

SEQ ID NO: 168320 - DNA, 20 bp, human
ggcaggaggccgccggtcta

SEQ ID NO: 168321 - DNA, 20 bp, human
gcccccggctctccgtagac

SEQ ID NO: 168322 - DNA, 20 bp, human
gccgcccagcacgtccaggt

SEQ ID NO: 168323 - DNA, 20 bp, human
gccggctctccgtagaccgg

SEQ ID NO: 168324 - DNA, 20 bp, human
gcggggctggagtcgtaact

SEQ ID NO: 168325 - DNA, 20 bp, human
ggagctcgccgcccgagcag

SEQ ID NO: 168326 - DNA, 20 bp, human
gaggcagagcacagcatcgt

SEQ ID NO: 168327 - DNA, 20 bp, human
gtcgggaccagactcgtctc

SEQ ID NO: 168328 - DNA, 20 bp, human
gactgaagctgtaccttggt

SEQ ID NO: 168329 - DNA, 20 bp, human
gtgcaggtctcctggaacaa

SEQ ID NO: 168330 - DNA, 20 bp, human
ggcaaactgaagctgtacct

SEQ ID NO: 168331 - DNA, 20 bp, human
gggtcggcgtttggctgaga

SEQ ID NO: 168332 - DNA, 20 bp, human
gcttggttgtcagcagcagc

SEQ ID NO: 168333 - DNA, 20 bp, human
gcgttcttttgaggacccag

SEQ ID NO: 168334 - DNA, 20 bp, human
gctgtaccttggtcggcgtt

SEQ ID NO: 168335 - DNA, 20 bp, human
gataggtataattattccaa

SEQ ID NO: 168336 - DNA, 20 bp, human
ggttaagccatccacagatg

SEQ ID NO: 168337 - DNA, 20 bp, human
gccatgtggccacagcatct

SEQ ID NO: 168338 - DNA, 20 bp, human
gagcccaaatggcctgagtg

SEQ ID NO: 168339 - DNA, 20 bp, human
gaagtttaaaaatacctgtg

SEQ ID NO: 168340 - DNA, 20 bp, human
gtctgcttctgagatgggtc

SEQ ID NO: 168341 - DNA, 20 bp, human
gacacagagagaagccaaca

SEQ ID NO: 168342 - DNA, 20 bp, human
ggatgaaagaaggcattgcc

SEQ ID NO: 168343 - DNA, 20 bp, human
gtttcatcagaagagaatcc

SEQ ID NO: 168344 - DNA, 20 bp, human
gtatttttcagcctcatctg

SEQ ID NO: 168345 - DNA, 20 bp, human
gagccacactcaggccattt

SEQ ID NO: 168346 - DNA, 20 bp, human
ggcacagtgagacaagacac

SEQ ID NO: 168347 - DNA, 20 bp, human
ggacaaaaggcagacagcat

SEQ ID NO: 168348 - DNA, 20 bp, human
gctggacacgcaagcacatg

SEQ ID NO: 168349 - DNA, 20 bp, human
gtatccaatgaactgacaaa

SEQ ID NO: 168350 - DNA, 20 bp, human
ggataaagacagctcctctt

SEQ ID NO: 168351 - DNA, 20 bp, human
gctgagggcatcccttaagg

SEQ ID NO: 168352 - DNA, 20 bp, human
ggcactgagggcatccctta

SEQ ID NO: 168353 - DNA, 20 bp, human
gagtcgtacactgggaaacc

SEQ ID NO: 168354 - DNA, 20 bp, human
gtactggtcttgctcaggta

SEQ ID NO: 168355 - DNA, 20 bp, human
gctgccttttgtcagttcat

SEQ ID NO: 168356 - DNA, 20 bp, human
gcaatgggcgggaaccgagt

SEQ ID NO: 168357 - DNA, 20 bp, human
gctccgtggccggaccggac

SEQ ID NO: 168358 - DNA, 20 bp, human
gtgggcgggaaccgagtggg

SEQ ID NO: 168359 - DNA, 20 bp, human
gccggggccgccctactctg

SEQ ID NO: 168360 - DNA, 20 bp, human
gtggaccgccgctgctacag

SEQ ID NO: 168361 - DNA, 20 bp, human
gtggccggaccggaccggac

SEQ ID NO: 168362 - DNA, 20 bp, human
gcgggcggccgggctacgac

SEQ ID NO: 168363 - DNA, 20 bp, human
gcctaccgcaaaaagatcag

SEQ ID NO: 168364 - DNA, 20 bp, human
gagaggaagtcgcgctgctg

SEQ ID NO: 168365 - DNA, 20 bp, human
ggatgagtaatggaaagagg

SEQ ID NO: 168366 - DNA, 20 bp, human
gtccgccgtccccgcgttgt

SEQ ID NO: 168367 - DNA, 20 bp, human
gcggtgcccgccgcaaccaa

SEQ ID NO: 168368 - DNA, 20 bp, human
gcgggcaccggccgacatgg

SEQ ID NO: 168369 - DNA, 20 bp, human
gtgggccgcgaggagcagaa

SEQ ID NO: 168370 - DNA, 20 bp, human
gcggcgggcaccggccgaca

SEQ ID NO: 168371 - DNA, 20 bp, human
gccggccgacatggcggcag

SEQ ID NO: 168372 - DNA, 20 bp, human
gggacagacccgcaaggtca

SEQ ID NO: 168373 - DNA, 20 bp, human
ggcaactggagaccccgaaa

SEQ ID NO: 168374 - DNA, 20 bp, human
ggcagaaccggaggatggag

SEQ ID NO: 168375 - DNA, 20 bp, human
ggctgggaaacatctgccgt

SEQ ID NO: 168376 - DNA, 20 bp, human
gtgaggaggaggaagcccac

SEQ ID NO: 168377 - DNA, 20 bp, human
gcacggtgctgatgaggagg

SEQ ID NO: 168378 - DNA, 20 bp, human
gccgtggccgggggaaagta

SEQ ID NO: 168379 - DNA, 20 bp, human
gtcagggccaaggtgcccac

SEQ ID NO: 168380 - DNA, 20 bp, human
gtggagcatagccacaggga

SEQ ID NO: 168381 - DNA, 20 bp, human
gcccggccacggtgctgatg

SEQ ID NO: 168382 - DNA, 20 bp, human
gccttggtgccatcatacag

SEQ ID NO: 168383 - DNA, 20 bp, human
gggatggtgaggtctgccag

SEQ ID NO: 168384 - DNA, 20 bp, human
gctactgcaacatctgcggg

SEQ ID NO: 168385 - DNA, 20 bp, human
gcagtgctcagacaccaccc

SEQ ID NO: 168386 - DNA, 20 bp, human
gctgcagcggagcccacgag

SEQ ID NO: 168387 - DNA, 20 bp, human
gccatggcgctgcctctcgt

SEQ ID NO: 168388 - DNA, 20 bp, human
gaggggggcgctaggcgatg

SEQ ID NO: 168389 - DNA, 20 bp, human
gtgggctccgctgcaggctg

SEQ ID NO: 168390 - DNA, 20 bp, human
gggcggagcagacctactcg

SEQ ID NO: 168391 - DNA, 20 bp, human
gggcgctaggcgatgaggcg

SEQ ID NO: 168392 - DNA, 20 bp, human
gctcggcgggtgtgatcgag

SEQ ID NO: 168393 - DNA, 20 bp, human
gtctcggcctccctcacccg

SEQ ID NO: 168394 - DNA, 20 bp, human
gggcggcgcggagaacaagg

SEQ ID NO: 168395 - DNA, 20 bp, human
gccccgcactcaccacgagt

SEQ ID NO: 168396 - DNA, 20 bp, human
gactcaagctggaacaacta

SEQ ID NO: 168397 - DNA, 20 bp, human
gcggagaacaggagcatgga

SEQ ID NO: 168398 - DNA, 20 bp, human
gtagcccttaaattccccag

SEQ ID NO: 168399 - DNA, 20 bp, human
gggcgctggcacccgagacc

SEQ ID NO: 168400 - DNA, 20 bp, human
gagcttgcgggcgaagaaca

SEQ ID NO: 168401 - DNA, 20 bp, human
gggaagtgggcgctcacatg

SEQ ID NO: 168402 - DNA, 20 bp, human
gacagcagcgaggccaggag

SEQ ID NO: 168403 - DNA, 20 bp, human
ggagcatgcgtcccagccgg

SEQ ID NO: 168404 - DNA, 20 bp, human
gcaacgcgggtaagaccccg

SEQ ID NO: 168405 - DNA, 20 bp, human
gcagcttgagtagcaagtgg

SEQ ID NO: 168406 - DNA, 20 bp, human
gctcgcggctcccctctctc

SEQ ID NO: 168407 - DNA, 20 bp, human
ggagcaacagcagcaccgag

SEQ ID NO: 168408 - DNA, 20 bp, human
gctcctcacgcccgagagag

SEQ ID NO: 168409 - DNA, 20 bp, human
gcggcgaggcgggagatggt

SEQ ID NO: 168410 - DNA, 20 bp, human
ggtcggcgggcggagaaccc

SEQ ID NO: 168411 - DNA, 20 bp, human
gtgcccagccaagggatccg

SEQ ID NO: 168412 - DNA, 20 bp, human
ggaagaggctggggtcgcca

SEQ ID NO: 168413 - DNA, 20 bp, human
gcggccaggaaggagtcggc

SEQ ID NO: 168414 - DNA, 20 bp, human
gggggcaggatcccgagaag

SEQ ID NO: 168415 - DNA, 20 bp, human
gccacccggccggagaagag

SEQ ID NO: 168416 - DNA, 20 bp, human
gagcagaggtgagctgaagg

SEQ ID NO: 168417 - DNA, 20 bp, human
ggagactgaatcatatatgg

SEQ ID NO: 168418 - DNA, 20 bp, human
gaggacagataggtaacctc

SEQ ID NO: 168419 - DNA, 20 bp, human
gtgctgacctgagaaccagc

SEQ ID NO: 168420 - DNA, 20 bp, human
gctcgggctccacaatgtag

SEQ ID NO: 168421 - DNA, 20 bp, human
ggtgtctatcaacagaccag

SEQ ID NO: 168422 - DNA, 20 bp, human
gtttcagaaagaggcatgag

SEQ ID NO: 168423 - DNA, 20 bp, human
gctaaaagcaggcaccagaa

SEQ ID NO: 168424 - DNA, 20 bp, human
gaaccctcggatgactcatc

SEQ ID NO: 168425 - DNA, 20 bp, human
gtaccggatgagtcatccga

SEQ ID NO: 168426 - DNA, 20 bp, human
gcctggacgacagggtgcgg

SEQ ID NO: 168427 - DNA, 20 bp, human
ggcctgtggcctggacgaca

SEQ ID NO: 168428 - DNA, 20 bp, human
gggttgagggaacattccat

SEQ ID NO: 168429 - DNA, 20 bp, human
gacgacagggtgcggaggca

SEQ ID NO: 168430 - DNA, 20 bp, human
gtggacgtgagagatgaagt

SEQ ID NO: 168431 - DNA, 20 bp, human
gcaggcacccagctgtgagg

SEQ ID NO: 168432 - DNA, 20 bp, human
gctcaaaccctgctctccca

SEQ ID NO: 168433 - DNA, 20 bp, human
gacgtgagagatgaagttgg

SEQ ID NO: 168434 - DNA, 20 bp, human
gtggccatggggttgaaggt

SEQ ID NO: 168435 - DNA, 20 bp, human
gttgctagcttagggtgcag

SEQ ID NO: 168436 - DNA, 20 bp, human
gcagctgacggcctgctcag

SEQ ID NO: 168437 - DNA, 20 bp, human
gcccagggaggcctcttcag

SEQ ID NO: 168438 - DNA, 20 bp, human
ggatctcggcctgagggtgt

SEQ ID NO: 168439 - DNA, 20 bp, human
gagcaggacacccatgcaag

SEQ ID NO: 168440 - DNA, 20 bp, human
gtcaagttgttggagcaaag

SEQ ID NO: 168441 - DNA, 20 bp, human
ggtgggtctctcacggatct

SEQ ID NO: 168442 - DNA, 20 bp, human
gctgaaggcagccccttctt

SEQ ID NO: 168443 - DNA, 20 bp, human
gccccccaacatccaaggac

SEQ ID NO: 168444 - DNA, 20 bp, human
gctcacggatctcggcctga

SEQ ID NO: 168445 - DNA, 20 bp, human
ggaggcctcttcagcgggat

SEQ ID NO: 168446 - DNA, 20 bp, human
gcagagacttacctggtata

SEQ ID NO: 168447 - DNA, 20 bp, human
ggccttcacaccaaacccaa

SEQ ID NO: 168448 - DNA, 20 bp, human
gttgcaatcagagacttacc

SEQ ID NO: 168449 - DNA, 20 bp, human
gcctggtatacggagcagaa

SEQ ID NO: 168450 - DNA, 20 bp, human
gaatgggagatagagaatag

SEQ ID NO: 168451 - DNA, 20 bp, human
gggagccctaaccatctcta

SEQ ID NO: 168452 - DNA, 20 bp, human
gtctgctatgaacttcccat

SEQ ID NO: 168453 - DNA, 20 bp, human
gtttgttaagtaagtacgtt

SEQ ID NO: 168454 - DNA, 20 bp, human
ggttcaatgactatctactg

SEQ ID NO: 168455 - DNA, 20 bp, human
ggtctctgattgcaacaaac

SEQ ID NO: 168456 - DNA, 20 bp, human
gtgctggagtgaccgttgaa

SEQ ID NO: 168457 - DNA, 20 bp, human
ggctcctgagcctctgcgta

SEQ ID NO: 168458 - DNA, 20 bp, human
gcccttaccctcattctgga

SEQ ID NO: 168459 - DNA, 20 bp, human
gtagggtgttcagtatccag

SEQ ID NO: 168460 - DNA, 20 bp, human
gtcataagcagaatggagta

SEQ ID NO: 168461 - DNA, 20 bp, human
gaaggagcgattatgattca

SEQ ID NO: 168462 - DNA, 20 bp, human
gtgctaactgcagggtcaat

SEQ ID NO: 168463 - DNA, 20 bp, human
ggcagggtcaataggcaaat

SEQ ID NO: 168464 - DNA, 20 bp, human
ggtgacagcatgctaactgc

SEQ ID NO: 168465 - DNA, 20 bp, human
gtgttgctcgggtgcatttg

SEQ ID NO: 168466 - DNA, 20 bp, human
gccaagtaaagagactcacc

SEQ ID NO: 168467 - DNA, 20 bp, human
gaagagaggaatactctgta

SEQ ID NO: 168468 - DNA, 20 bp, human
gaggtccacagcacttaccc

SEQ ID NO: 168469 - DNA, 20 bp, human
gctgtatggtcccttagaac

SEQ ID NO: 168470 - DNA, 20 bp, human
gttctgtgtcagcaagaagg

SEQ ID NO: 168471 - DNA, 20 bp, human
gaaaatgaagatattcctag

SEQ ID NO: 168472 - DNA, 20 bp, human
ggggataatgactagaaccc

SEQ ID NO: 168473 - DNA, 20 bp, human
gagagtctccttggcattct

SEQ ID NO: 168474 - DNA, 20 bp, human
gttaaaagtgttcatactgt

SEQ ID NO: 168475 - DNA, 20 bp, human
gtgatcaaattcaataatga

SEQ ID NO: 168476 - DNA, 20 bp, human
gctggtggccggctcctcaa

SEQ ID NO: 168477 - DNA, 20 bp, human
gagcagctgaaaactagctc

SEQ ID NO: 168478 - DNA, 20 bp, human
gcatacgcagaatgggatag

SEQ ID NO: 168479 - DNA, 20 bp, human
gccagagccatgccacccca

SEQ ID NO: 168480 - DNA, 20 bp, human
gagtctctgaatgaagctga

SEQ ID NO: 168481 - DNA, 20 bp, human
ggagtgactattgaagggca

SEQ ID NO: 168482 - DNA, 20 bp, human
gtgggactcatacgcagaat

SEQ ID NO: 168483 - DNA, 20 bp, human
gtaggggattcagcatctgg

SEQ ID NO: 168484 - DNA, 20 bp, human
ggaatttaatgggggtataa

SEQ ID NO: 168485 - DNA, 20 bp, human
ggtgctggagtgactattga

SEQ ID NO: 168486 - DNA, 20 bp, human
gatcagtgctcaggtaccag

SEQ ID NO: 168487 - DNA, 20 bp, human
gagtccaagtgggctgactt

SEQ ID NO: 168488 - DNA, 20 bp, human
gtgcacgactcttaaacccc

SEQ ID NO: 168489 - DNA, 20 bp, human
ggacttgggcatagagcaaa

SEQ ID NO: 168490 - DNA, 20 bp, human
gatacaggtaggtatccata

SEQ ID NO: 168491 - DNA, 20 bp, human
gatagagcaaagggctgctc

SEQ ID NO: 168492 - DNA, 20 bp, human
gatgcccaagtcagcccact

SEQ ID NO: 168493 - DNA, 20 bp, human
gtttaagagtcgtgcagcag

SEQ ID NO: 168494 - DNA, 20 bp, human
gatctgttataaagtccaag

SEQ ID NO: 168495 - DNA, 20 bp, human
gatagcatattagattgccc

SEQ ID NO: 168496 - DNA, 20 bp, human
gagtcccaatggcttgactt

SEQ ID NO: 168497 - DNA, 20 bp, human
gaaattaacatcttcatgaa

SEQ ID NO: 168498 - DNA, 20 bp, human
gatctgttgtaaagtcccaa

SEQ ID NO: 168499 - DNA, 20 bp, human
gacttagtggatggaaatac

SEQ ID NO: 168500 - DNA, 20 bp, human
gtgtgcccaagtcaagccat

SEQ ID NO: 168501 - DNA, 20 bp, human
gtattcaaacctatgatcat

SEQ ID NO: 168502 - DNA, 20 bp, human
gtaccaggagtttaggagtt

SEQ ID NO: 168503 - DNA, 20 bp, human
ggcaaaaagaacagaactca

SEQ ID NO: 168504 - DNA, 20 bp, human
gttaataggaaagctttggt

SEQ ID NO: 168505 - DNA, 20 bp, human
gccatcaaacccatgatcat

SEQ ID NO: 168506 - DNA, 20 bp, human
gaaagccccagtgggctgat

SEQ ID NO: 168507 - DNA, 20 bp, human
gtcacaagttcagatactct

SEQ ID NO: 168508 - DNA, 20 bp, human
gctgatgggcaaagagcaaa

SEQ ID NO: 168509 - DNA, 20 bp, human
gacttagtggatggaacctt

SEQ ID NO: 168510 - DNA, 20 bp, human
ggattaaattcaacttttga

SEQ ID NO: 168511 - DNA, 20 bp, human
gtcattatgatctaatccta

SEQ ID NO: 168512 - DNA, 20 bp, human
gaaaactgtcatcagaggtt

SEQ ID NO: 168513 - DNA, 20 bp, human
gtctttgcccatcagcccac

SEQ ID NO: 168514 - DNA, 20 bp, human
gcagttttgacactacttag

SEQ ID NO: 168515 - DNA, 20 bp, human
gaatctgaagacagaaagta

SEQ ID NO: 168516 - DNA, 20 bp, human
gttcaggtcacaaagaactg

SEQ ID NO: 168517 - DNA, 20 bp, human
gtcaaggactcacactcacc

SEQ ID NO: 168518 - DNA, 20 bp, human
gatctgtagtaaagtcccag

SEQ ID NO: 168519 - DNA, 20 bp, human
gtggcttgtgagattgctca

SEQ ID NO: 168520 - DNA, 20 bp, human
gatacagttaggtgtccata

SEQ ID NO: 168521 - DNA, 20 bp, human
ggacttgagcacagaacaaa

SEQ ID NO: 168522 - DNA, 20 bp, human
ggtgctcaagtcaacccact

SEQ ID NO: 168523 - DNA, 20 bp, human
gctaagtagaatcaaaccca

SEQ ID NO: 168524 - DNA, 20 bp, human
ggtttaagagttgtgcagca

SEQ ID NO: 168525 - DNA, 20 bp, human
gaagacaccaggaaaacatg

SEQ ID NO: 168526 - DNA, 20 bp, human
gagcaccagtgggttgactt

SEQ ID NO: 168527 - DNA, 20 bp, human
gggttaaattcaacacttca

SEQ ID NO: 168528 - DNA, 20 bp, human
ggatccaaacctgtgatcat

SEQ ID NO: 168529 - DNA, 20 bp, human
ggtacaattatatgtccata

SEQ ID NO: 168530 - DNA, 20 bp, human
gcaccaaacttgctggattc

SEQ ID NO: 168531 - DNA, 20 bp, human
gccatcaaacctatgatcac

SEQ ID NO: 168532 - DNA, 20 bp, human
gaaacctatgatcacaggtt

SEQ ID NO: 168533 - DNA, 20 bp, human
gcctgaagatgtcattttca

SEQ ID NO: 168534 - DNA, 20 bp, human
gaacctttgaaaaggatacc

SEQ ID NO: 168535 - DNA, 20 bp, human
gacttagttgatggaactac

SEQ ID NO: 168536 - DNA, 20 bp, human
gtcacaagttcagataccca

SEQ ID NO: 168537 - DNA, 20 bp, human
gtagcttgtgagatagccct

SEQ ID NO: 168538 - DNA, 20 bp, human
gccaaggcagatcggtgctt

SEQ ID NO: 168539 - DNA, 20 bp, human
ggtgcctatgtcaacccact

SEQ ID NO: 168540 - DNA, 20 bp, human
gtggacagagaagttagtta

SEQ ID NO: 168541 - DNA, 20 bp, human
gatctgttgtaaaatcccag

SEQ ID NO: 168542 - DNA, 20 bp, human
gacagagttaggtgttcata

SEQ ID NO: 168543 - DNA, 20 bp, human
gtttcttttagtacagagtt

SEQ ID NO: 168544 - DNA, 20 bp, human
gcacacagaaaacgactgtt

SEQ ID NO: 168545 - DNA, 20 bp, human
gacttagtggatggaaattt

SEQ ID NO: 168546 - DNA, 20 bp, human
gtggtgttagggtctaacct

SEQ ID NO: 168547 - DNA, 20 bp, human
gtcaaagatctacaactgaa

SEQ ID NO: 168548 - DNA, 20 bp, human
gtcattaaaactggtaacta

SEQ ID NO: 168549 - DNA, 20 bp, human
gtgtgctcttatcttccatg

SEQ ID NO: 168550 - DNA, 20 bp, human
ggcacagatttgtttggtat

SEQ ID NO: 168551 - DNA, 20 bp, human
gatgaaggtgatgaggaacc

SEQ ID NO: 168552 - DNA, 20 bp, human
gcttggagtgcaatctcctt

SEQ ID NO: 168553 - DNA, 20 bp, human
gacagccagctcattaaaac

SEQ ID NO: 168554 - DNA, 20 bp, human
gtaaattggttaaaataaac

SEQ ID NO: 168555 - DNA, 20 bp, human
gcttgcacttggatggtgtt

SEQ ID NO: 168556 - DNA, 20 bp, human
gtgctgtgcagagaaggtcg

SEQ ID NO: 168557 - DNA, 20 bp, human
gactcttcaccagatcccag

SEQ ID NO: 168558 - DNA, 20 bp, human
gctcacctgctgtgcagaga

SEQ ID NO: 168559 - DNA, 20 bp, human
gatcatgctgtggcaaaacg

SEQ ID NO: 168560 - DNA, 20 bp, human
gtgctgtggcaaaacgagga

SEQ ID NO: 168561 - DNA, 20 bp, human
gtattaaggtgttcctaatg

SEQ ID NO: 168562 - DNA, 20 bp, human
ggaacttaggatcagaaaag

SEQ ID NO: 168563 - DNA, 20 bp, human
gaggagagtgctcttgaagt

SEQ ID NO: 168564 - DNA, 20 bp, human
ggaaagcaagtatcatgctg

SEQ ID NO: 168565 - DNA, 20 bp, human
gaatatagaaggcactacat

SEQ ID NO: 168566 - DNA, 20 bp, human
gagctgaggtggtggggtaa

SEQ ID NO: 168567 - DNA, 20 bp, human
ggcatcaaggtccctgacca

SEQ ID NO: 168568 - DNA, 20 bp, human
gaaggagccatgccactcaa

SEQ ID NO: 168569 - DNA, 20 bp, human
gacaccaaggtccctgaacc

SEQ ID NO: 168570 - DNA, 20 bp, human
gggtaaaggtctgcttctgc

SEQ ID NO: 168571 - DNA, 20 bp, human
ggctttgtgtagcctggcac

SEQ ID NO: 168572 - DNA, 20 bp, human
gggcatggctccttggttgt

SEQ ID NO: 168573 - DNA, 20 bp, human
gctttggtgtatccttgctc

SEQ ID NO: 168574 - DNA, 20 bp, human
ggtccttcaacggtcactcc

SEQ ID NO: 168575 - DNA, 20 bp, human
gtgggaacaaatatttcctg

SEQ ID NO: 168576 - DNA, 20 bp, human
gacaagctggaccccaggag

SEQ ID NO: 168577 - DNA, 20 bp, human
gtggctctgcctgtggacaa

SEQ ID NO: 168578 - DNA, 20 bp, human
ggtcatactgagcaatggtg

SEQ ID NO: 168579 - DNA, 20 bp, human
gactgagcaatggtgcggaa

SEQ ID NO: 168580 - DNA, 20 bp, human
gtgttctcctgggatttgtg

SEQ ID NO: 168581 - DNA, 20 bp, human
gaaagcgccccacaaatccc

SEQ ID NO: 168582 - DNA, 20 bp, human
ggggtccagcttgtcgcctc

SEQ ID NO: 168583 - DNA, 20 bp, human
gtcttggcctagcggctcaa

SEQ ID NO: 168584 - DNA, 20 bp, human
gcttccaggtgtatgcaaac

SEQ ID NO: 168585 - DNA, 20 bp, human
gaataagtcatactgagcaa

SEQ ID NO: 168586 - DNA, 20 bp, human
gggaccgtcggactagagaa

SEQ ID NO: 168587 - DNA, 20 bp, human
ggagatgccggctctcgaga

SEQ ID NO: 168588 - DNA, 20 bp, human
gggaagacagaaacacgccg

SEQ ID NO: 168589 - DNA, 20 bp, human
ggagagaaaaccagggccgg

SEQ ID NO: 168590 - DNA, 20 bp, human
gtctagtccgacggtcccag

SEQ ID NO: 168591 - DNA, 20 bp, human
gactagctcctaggagatgc

SEQ ID NO: 168592 - DNA, 20 bp, human
gagccgcctagccgaggacc

SEQ ID NO: 168593 - DNA, 20 bp, human
gaccccaagccgcctagccg

SEQ ID NO: 168594 - DNA, 20 bp, human
gtcgagtgggagaaaaggta

SEQ ID NO: 168595 - DNA, 20 bp, human
gaggaccaggactagctcct

SEQ ID NO: 168596 - DNA, 20 bp, human
gcactctgcaaagcacgcag

SEQ ID NO: 168597 - DNA, 20 bp, human
gctgttccttatccagggca

SEQ ID NO: 168598 - DNA, 20 bp, human
gttgcagagcggtctcactc

SEQ ID NO: 168599 - DNA, 20 bp, human
gctgtagctgttccttatcc

SEQ ID NO: 168600 - DNA, 20 bp, human
gcttcgcataaaggcattaa

SEQ ID NO: 168601 - DNA, 20 bp, human
gctagcccctcttcgcataa

SEQ ID NO: 168602 - DNA, 20 bp, human
ggcgaagaggggctagcact

SEQ ID NO: 168603 - DNA, 20 bp, human
gttagcagtgggaatgctac

SEQ ID NO: 168604 - DNA, 20 bp, human
gaatgcctttatgcgaagag

SEQ ID NO: 168605 - DNA, 20 bp, human
gaaatgtctacggaaggaaa

SEQ ID NO: 168606 - DNA, 20 bp, human
gtgcggcgcgcagctctcgg

SEQ ID NO: 168607 - DNA, 20 bp, human
gcgcagcgctagcggaggag

SEQ ID NO: 168608 - DNA, 20 bp, human
gcgcgccgcagcgctagcgg

SEQ ID NO: 168609 - DNA, 20 bp, human
gcaagaggccgaagcgccaa

SEQ ID NO: 168610 - DNA, 20 bp, human
gtgcagactgggcgttgtgg

SEQ ID NO: 168611 - DNA, 20 bp, human
ggctctcggcggtgcagact

SEQ ID NO: 168612 - DNA, 20 bp, human
gctgcgcgccgcagcgctag

SEQ ID NO: 168613 - DNA, 20 bp, human
gtcctggcagatgagcgaat

SEQ ID NO: 168614 - DNA, 20 bp, human
gccaacttccgagcaatcgg

SEQ ID NO: 168615 - DNA, 20 bp, human
gtggtgcaaagccgcgatca

SEQ ID NO: 168616 - DNA, 20 bp, human
ggggcgagtcaaacctgtag

SEQ ID NO: 168617 - DNA, 20 bp, human
gctccttcactggcaggcag

SEQ ID NO: 168618 - DNA, 20 bp, human
gagagacagcacaggatggc

SEQ ID NO: 168619 - DNA, 20 bp, human
gtggagaaacctaaagactg

SEQ ID NO: 168620 - DNA, 20 bp, human
ggcgcgcgcgcccaagcgcg

SEQ ID NO: 168621 - DNA, 20 bp, human
gagatcctttgagccagatg

SEQ ID NO: 168622 - DNA, 20 bp, human
gtactttgtatagattttac

SEQ ID NO: 168623 - DNA, 20 bp, human
gctccactgcctgccagtga

SEQ ID NO: 168624 - DNA, 20 bp, human
ggaagaactaatgccccatc

SEQ ID NO: 168625 - DNA, 20 bp, human
gtgaatgaaaactccttcac

SEQ ID NO: 168626 - DNA, 20 bp, human
gcgcgtcgcggctcagagag

SEQ ID NO: 168627 - DNA, 20 bp, human
ggctgagggaaggaacactg

SEQ ID NO: 168628 - DNA, 20 bp, human
gaggccagaggcaaactccc

SEQ ID NO: 168629 - DNA, 20 bp, human
ggcccaggggtcggaaacgg

SEQ ID NO: 168630 - DNA, 20 bp, human
gggttgcaacatcgccgcgg

SEQ ID NO: 168631 - DNA, 20 bp, human
gagacgccggtcggaggaac

SEQ ID NO: 168632 - DNA, 20 bp, human
gcgggcttggcaatgcccag

SEQ ID NO: 168633 - DNA, 20 bp, human
ggggcttcccgagtctcaga

SEQ ID NO: 168634 - DNA, 20 bp, human
gccggcgtctgcgagtacag

SEQ ID NO: 168635 - DNA, 20 bp, human
gagtggttgcaacatcgccg

SEQ ID NO: 168636 - DNA, 20 bp, human
gccacgtggcccagaagagt

SEQ ID NO: 168637 - DNA, 20 bp, human
ggagaggcctatggatgagg

SEQ ID NO: 168638 - DNA, 20 bp, human
ggctgagaggcctatggatg

SEQ ID NO: 168639 - DNA, 20 bp, human
gcggccgaagagcttgtgtg

SEQ ID NO: 168640 - DNA, 20 bp, human
ggcttgtgtgcggagctgag

SEQ ID NO: 168641 - DNA, 20 bp, human
gccgcgtcctcctcatccat

SEQ ID NO: 168642 - DNA, 20 bp, human
gcccggtaggcggggatcgg

SEQ ID NO: 168643 - DNA, 20 bp, human
gcagaagagtaggcacctgt

SEQ ID NO: 168644 - DNA, 20 bp, human
gaggacgcggcggccccggt

SEQ ID NO: 168645 - DNA, 20 bp, human
ggctccgcacacaagctctt

SEQ ID NO: 168646 - DNA, 20 bp, human
gcaatcgtttggctccccag

SEQ ID NO: 168647 - DNA, 20 bp, human
gaacaggggctagaacccta

SEQ ID NO: 168648 - DNA, 20 bp, human
gggcgtgcccggttcatcca

SEQ ID NO: 168649 - DNA, 20 bp, human
gcatgatacacgagcaacta

SEQ ID NO: 168650 - DNA, 20 bp, human
ggttcatccaaggcgcaaga

SEQ ID NO: 168651 - DNA, 20 bp, human
ggaatatatcaccagcccta

SEQ ID NO: 168652 - DNA, 20 bp, human
gggaaggaaaagacccgaga

SEQ ID NO: 168653 - DNA, 20 bp, human
gggctgtgtctgtaagcggg

SEQ ID NO: 168654 - DNA, 20 bp, human
ggaggcaactcccaatcgtt

SEQ ID NO: 168655 - DNA, 20 bp, human
gggtgatatattcagatatg

SEQ ID NO: 168656 - DNA, 20 bp, human
gggcaggagacggagctgag

SEQ ID NO: 168657 - DNA, 20 bp, human
gtgtcgcctcggtctaggga

SEQ ID NO: 168658 - DNA, 20 bp, human
gcgaggacgtgtgacatctc

SEQ ID NO: 168659 - DNA, 20 bp, human
gcgcctcggtctagggacgg

SEQ ID NO: 168660 - DNA, 20 bp, human
ggcagtgtcgcctcggtcta

SEQ ID NO: 168661 - DNA, 20 bp, human
gctcggtctagggacggcgg

SEQ ID NO: 168662 - DNA, 20 bp, human
ggacaagtccggacctcggg

SEQ ID NO: 168663 - DNA, 20 bp, human
gatagacaagtccggacctc

SEQ ID NO: 168664 - DNA, 20 bp, human
gggacgtgtgacatctccgg

SEQ ID NO: 168665 - DNA, 20 bp, human
gctagggacggcggcggagt

SEQ ID NO: 168666 - DNA, 20 bp, human
gtaggcggcgcggggcacct

SEQ ID NO: 168667 - DNA, 20 bp, human
gcccgagcgcgacttctgtg

SEQ ID NO: 168668 - DNA, 20 bp, human
gaccccctgccctgcagcgg

SEQ ID NO: 168669 - DNA, 20 bp, human
gacctgggaccccgatgggt

SEQ ID NO: 168670 - DNA, 20 bp, human
gctccctcgccgcggctcct

SEQ ID NO: 168671 - DNA, 20 bp, human
ggccggtcgcccacccatcg

SEQ ID NO: 168672 - DNA, 20 bp, human
ggggcacctgggaccccgat

SEQ ID NO: 168673 - DNA, 20 bp, human
gcacccactcggtcccccag

SEQ ID NO: 168674 - DNA, 20 bp, human
gagtacgggatggggactcg

SEQ ID NO: 168675 - DNA, 20 bp, human
gcccggagccaccgcgggag

SEQ ID NO: 168676 - DNA, 20 bp, human
ggaagtcaaccgaggttcgg

SEQ ID NO: 168677 - DNA, 20 bp, human
gagggctgggaagtcaaccg

SEQ ID NO: 168678 - DNA, 20 bp, human
gcaagccctcgggacaggag

SEQ ID NO: 168679 - DNA, 20 bp, human
gtccatgggccagacagctc

SEQ ID NO: 168680 - DNA, 20 bp, human
gttccgcccggctccttcag

SEQ ID NO: 168681 - DNA, 20 bp, human
gcaggagaggtcagggtaca

SEQ ID NO: 168682 - DNA, 20 bp, human
ggttgacttcccagccctgg

SEQ ID NO: 168683 - DNA, 20 bp, human
gcatggaggtgaggagctag

SEQ ID NO: 168684 - DNA, 20 bp, human
gtacagggcctgtggcgtgg

SEQ ID NO: 168685 - DNA, 20 bp, human
gcgccgctgcccccgaacct

SEQ ID NO: 168686 - DNA, 20 bp, human
gaccggatcgagagctcctc

SEQ ID NO: 168687 - DNA, 20 bp, human
ggctctcgatccggtcccgc

SEQ ID NO: 168688 - DNA, 20 bp, human
gtcgctccggggcggaaagt

SEQ ID NO: 168689 - DNA, 20 bp, human
ggccctccggagaggaacaa

SEQ ID NO: 168690 - DNA, 20 bp, human
ggaaggctaggcgggaaccc

SEQ ID NO: 168691 - DNA, 20 bp, human
gcgcccagagcccgagacgt

SEQ ID NO: 168692 - DNA, 20 bp, human
gggaaccccggagctggcga

SEQ ID NO: 168693 - DNA, 20 bp, human
gtaggcgggaaccccggagc

SEQ ID NO: 168694 - DNA, 20 bp, human
ggggcacgggccgacgtctc

SEQ ID NO: 168695 - DNA, 20 bp, human
gcggccctggaaggctaggc

SEQ ID NO: 168696 - DNA, 20 bp, human
gctgcagctgaaagccgatc

SEQ ID NO: 168697 - DNA, 20 bp, human
gccatcctgcagcgcagagg

SEQ ID NO: 168698 - DNA, 20 bp, human
gtgcaggatggcctggagtt

SEQ ID NO: 168699 - DNA, 20 bp, human
gccccaggatcgcttcagta

SEQ ID NO: 168700 - DNA, 20 bp, human
gcgtcctcacggctgatgcc

SEQ ID NO: 168701 - DNA, 20 bp, human
gggccaggggcgcgtcctca

SEQ ID NO: 168702 - DNA, 20 bp, human
gggagcgttcttggcgaagt

SEQ ID NO: 168703 - DNA, 20 bp, human
gctgccgggcatcagccgtg

SEQ ID NO: 168704 - DNA, 20 bp, human
gaggccatcctgcagcgcag

SEQ ID NO: 168705 - DNA, 20 bp, human
gcaagaacgctcctaactcc

SEQ ID NO: 168706 - DNA, 20 bp, human
gggagactcacgttgttact

SEQ ID NO: 168707 - DNA, 20 bp, human
gcagagtagcaattatactt

SEQ ID NO: 168708 - DNA, 20 bp, human
gtatacttaggaggaataat

SEQ ID NO: 168709 - DNA, 20 bp, human
gctctgtgaattgccattac

SEQ ID NO: 168710 - DNA, 20 bp, human
gttcctaaaggtttagaacc

SEQ ID NO: 168711 - DNA, 20 bp, human
gagtagcaattatacttagg

SEQ ID NO: 168712 - DNA, 20 bp, human
gagaaacgttaagtatgtgg

SEQ ID NO: 168713 - DNA, 20 bp, human
ggattctaggaccaagcaag

SEQ ID NO: 168714 - DNA, 20 bp, human
gacccagtaatgacttaagt

SEQ ID NO: 168715 - DNA, 20 bp, human
gatagaattagatcattaca

SEQ ID NO: 168716 - DNA, 20 bp, human
gagtgaacggtgtggagcgg

SEQ ID NO: 168717 - DNA, 20 bp, human
gcgctgcggagtgaacggtg

SEQ ID NO: 168718 - DNA, 20 bp, human
gcggagtgaacggtgtggag

SEQ ID NO: 168719 - DNA, 20 bp, human
gcacctgccgcagccggatg

SEQ ID NO: 168720 - DNA, 20 bp, human
gctacccgctgcggagtgaa

SEQ ID NO: 168721 - DNA, 20 bp, human
ggaggggtgctgaaggaccg

SEQ ID NO: 168722 - DNA, 20 bp, human
gaaggaccgaggagcctccg

SEQ ID NO: 168723 - DNA, 20 bp, human
gactccgcagcgggtagtgg

SEQ ID NO: 168724 - DNA, 20 bp, human
ggtgggtgcgtcgggccgag

SEQ ID NO: 168725 - DNA, 20 bp, human
gccacgcgccacaaaagcag

SEQ ID NO: 168726 - DNA, 20 bp, human
gcggagagtccgtcaccccg

SEQ ID NO: 168727 - DNA, 20 bp, human
gagggcccagaggaccgggt

SEQ ID NO: 168728 - DNA, 20 bp, human
gcggcagcagcgatgtcccc

SEQ ID NO: 168729 - DNA, 20 bp, human
gacgcgcggcgccagctcaa

SEQ ID NO: 168730 - DNA, 20 bp, human
gctgcggcaaagatcatccc

SEQ ID NO: 168731 - DNA, 20 bp, human
gatatctctgggcgggtccg

SEQ ID NO: 168732 - DNA, 20 bp, human
gaccccggggcgcagggaga

SEQ ID NO: 168733 - DNA, 20 bp, human
gtctgggcgggtccgcggct

SEQ ID NO: 168734 - DNA, 20 bp, human
gaccccggcctgggagcgaa

SEQ ID NO: 168735 - DNA, 20 bp, human
gggcccccgcttcagtccca

SEQ ID NO: 168736 - DNA, 20 bp, human
ggctcacaggacgggaccag

SEQ ID NO: 168737 - DNA, 20 bp, human
ggcagcctgcacggcaacag

SEQ ID NO: 168738 - DNA, 20 bp, human
gggcaggctctgcggtgagg

SEQ ID NO: 168739 - DNA, 20 bp, human
gggaggcagccccagtgagt

SEQ ID NO: 168740 - DNA, 20 bp, human
gccgggtcgcgggtgctcat

SEQ ID NO: 168741 - DNA, 20 bp, human
gtcggatgatgcgggacgag

SEQ ID NO: 168742 - DNA, 20 bp, human
gcatccccgggaggtaggta

SEQ ID NO: 168743 - DNA, 20 bp, human
ggatgatgcgggacgagggg

SEQ ID NO: 168744 - DNA, 20 bp, human
gcgaggggcggcaggctctg

SEQ ID NO: 168745 - DNA, 20 bp, human
gcagtgggcgctgctgcgca

SEQ ID NO: 168746 - DNA, 20 bp, human
gaaggaggacgcgagagcga

SEQ ID NO: 168747 - DNA, 20 bp, human
gggatctcgggaaacctcgt

SEQ ID NO: 168748 - DNA, 20 bp, human
gggtccaaggtccttaacca

SEQ ID NO: 168749 - DNA, 20 bp, human
gcggcagtgtcattagagga

SEQ ID NO: 168750 - DNA, 20 bp, human
gtcgtcggcagtgtcattag

SEQ ID NO: 168751 - DNA, 20 bp, human
gagcaggcagcagttcacct

SEQ ID NO: 168752 - DNA, 20 bp, human
gggactggaggtgcccggag

SEQ ID NO: 168753 - DNA, 20 bp, human
gaggtgaggtgtccgaaccg

SEQ ID NO: 168754 - DNA, 20 bp, human
gttagcgtctgagtggtcta

SEQ ID NO: 168755 - DNA, 20 bp, human
gggaggtgcccggagaggaa

SEQ ID NO: 168756 - DNA, 20 bp, human
gtgtgactcagtgacccgga

SEQ ID NO: 168757 - DNA, 20 bp, human
gaacacgggatcacactcag

SEQ ID NO: 168758 - DNA, 20 bp, human
gcgggtcactgagtcacaca

SEQ ID NO: 168759 - DNA, 20 bp, human
gacactcagaggatgacaca

SEQ ID NO: 168760 - DNA, 20 bp, human
gtgcggggcgactgctatga

SEQ ID NO: 168761 - DNA, 20 bp, human
ggtgtagtcacactgtaaca

SEQ ID NO: 168762 - DNA, 20 bp, human
gatagggtgtgggacgtgtg

SEQ ID NO: 168763 - DNA, 20 bp, human
gacgtgtgaggtgtgctaca

SEQ ID NO: 168764 - DNA, 20 bp, human
gcagcctgtacgatagggtg

SEQ ID NO: 168765 - DNA, 20 bp, human
ggaagctgtgcgtgatgtgt

SEQ ID NO: 168766 - DNA, 20 bp, human
ggagggaggcaaagggtcga

SEQ ID NO: 168767 - DNA, 20 bp, human
ggtggcgcggaagctagacc

SEQ ID NO: 168768 - DNA, 20 bp, human
gcagcggacgccgacaggga

SEQ ID NO: 168769 - DNA, 20 bp, human
gactgcgcgtgggcctcggg

SEQ ID NO: 168770 - DNA, 20 bp, human
gtgcacggctgcactcgcga

SEQ ID NO: 168771 - DNA, 20 bp, human
gtgggctgcggtggcatcag

SEQ ID NO: 168772 - DNA, 20 bp, human
ggccgggtgtgactgcgcgt

SEQ ID NO: 168773 - DNA, 20 bp, human
ggcgcagtcacacccggccg

SEQ ID NO: 168774 - DNA, 20 bp, human
gcgcggaagctagaccgggt

SEQ ID NO: 168775 - DNA, 20 bp, human
gtgcactcgcgagggcacgg

SEQ ID NO: 168776 - DNA, 20 bp, human
gatggctccctaaacctgga

SEQ ID NO: 168777 - DNA, 20 bp, human
gtggagggcatgcagattag

SEQ ID NO: 168778 - DNA, 20 bp, human
ggagatggcccctctaccag

SEQ ID NO: 168779 - DNA, 20 bp, human
ggggatgaggagctgctgga

SEQ ID NO: 168780 - DNA, 20 bp, human
gggcggcccagctggacgga

SEQ ID NO: 168781 - DNA, 20 bp, human
gtccagctgggccgcctctg

SEQ ID NO: 168782 - DNA, 20 bp, human
gggccgcctctgtggaaccc

SEQ ID NO: 168783 - DNA, 20 bp, human
ggcacgctggctcaagggga

SEQ ID NO: 168784 - DNA, 20 bp, human
gtccacagaggcggcccagc

SEQ ID NO: 168785 - DNA, 20 bp, human
gggtcagccccacagtcccc

SEQ ID NO: 168786 - DNA, 20 bp, human
ggacggacgataaaacggag

SEQ ID NO: 168787 - DNA, 20 bp, human
gacggagtggtgaaaatgag

SEQ ID NO: 168788 - DNA, 20 bp, human
gcgctgggactagaagctcc

SEQ ID NO: 168789 - DNA, 20 bp, human
ggctcggtcacgcccagact

SEQ ID NO: 168790 - DNA, 20 bp, human
gttcgtctgggaaggtccta

SEQ ID NO: 168791 - DNA, 20 bp, human
ggagtggaacaccttcgtct

SEQ ID NO: 168792 - DNA, 20 bp, human
gcggcagtccttccagcaag

SEQ ID NO: 168793 - DNA, 20 bp, human
gagcaagaggcaccgagtct

SEQ ID NO: 168794 - DNA, 20 bp, human
ggtcccagcggttgagtgta

SEQ ID NO: 168795 - DNA, 20 bp, human
gccagcggttgagtgtaggg

SEQ ID NO: 168796 - DNA, 20 bp, human
ggcaaggcaggctctgtagg

SEQ ID NO: 168797 - DNA, 20 bp, human
ggccattcgcccgcaccgtg

SEQ ID NO: 168798 - DNA, 20 bp, human
gaggcaggctctgtaggcgg

SEQ ID NO: 168799 - DNA, 20 bp, human
gctccaggcgcggagaggtg

SEQ ID NO: 168800 - DNA, 20 bp, human
gggctccggccgcatcttcc

SEQ ID NO: 168801 - DNA, 20 bp, human
gctccgggagtaagacctcc

SEQ ID NO: 168802 - DNA, 20 bp, human
ggcccttgggcggctcccac

SEQ ID NO: 168803 - DNA, 20 bp, human
gaagacctccaggcgcggag

SEQ ID NO: 168804 - DNA, 20 bp, human
gggagtaagacctccaggcg

SEQ ID NO: 168805 - DNA, 20 bp, human
gcgtggcgaacggggaagta

SEQ ID NO: 168806 - DNA, 20 bp, human
gggaatagtgaaggaagccc

SEQ ID NO: 168807 - DNA, 20 bp, human
gtggggactgaacaacccag

SEQ ID NO: 168808 - DNA, 20 bp, human
ggggagagtgcctcttacct

SEQ ID NO: 168809 - DNA, 20 bp, human
gcgtcaaaatgtgaactcca

SEQ ID NO: 168810 - DNA, 20 bp, human
gccagtggcaaagtgtgagg

SEQ ID NO: 168811 - DNA, 20 bp, human
gaagtgacagagcccgggac

SEQ ID NO: 168812 - DNA, 20 bp, human
gtccccagaaggagccagca

SEQ ID NO: 168813 - DNA, 20 bp, human
gcctgcttccgaaactgtaa

SEQ ID NO: 168814 - DNA, 20 bp, human
gtaaaggagattgtccatgc

SEQ ID NO: 168815 - DNA, 20 bp, human
gccatggctaaccctggagg

SEQ ID NO: 168816 - DNA, 20 bp, human
gggggctttaggacgtgagc

SEQ ID NO: 168817 - DNA, 20 bp, human
ggtgtgagctgcatcgcggg

SEQ ID NO: 168818 - DNA, 20 bp, human
gccgcctcctacaggaacag

SEQ ID NO: 168819 - DNA, 20 bp, human
gtgacgtgtgagctgcatcg

SEQ ID NO: 168820 - DNA, 20 bp, human
ggaagtgcaggcgacacaca

SEQ ID NO: 168821 - DNA, 20 bp, human
gcgccgtgaccagcaggtac

SEQ ID NO: 168822 - DNA, 20 bp, human
gtgtgagtcgctggacccaa

SEQ ID NO: 168823 - DNA, 20 bp, human
gtcctggaggaaatctccga

SEQ ID NO: 168824 - DNA, 20 bp, human
gcatcgcgggaggcgcatgg

SEQ ID NO: 168825 - DNA, 20 bp, human
ggctcacacgtcagtctgtc

SEQ ID NO: 168826 - DNA, 20 bp, human
gtggggaggagccaaagcct

SEQ ID NO: 168827 - DNA, 20 bp, human
ggggcagagagggattgtat

SEQ ID NO: 168828 - DNA, 20 bp, human
gagttgggtgtatctccctg

SEQ ID NO: 168829 - DNA, 20 bp, human
ggggaagctcgcagcagctg

SEQ ID NO: 168830 - DNA, 20 bp, human
gcgactcaggaaaatatcat

SEQ ID NO: 168831 - DNA, 20 bp, human
gagtagcttatgggcagaga

SEQ ID NO: 168832 - DNA, 20 bp, human
ggcggcttaggtgagcgccg

SEQ ID NO: 168833 - DNA, 20 bp, human
gtaggtgagcgccgaggctt

SEQ ID NO: 168834 - DNA, 20 bp, human
gtgtataggagcacggaact

SEQ ID NO: 168835 - DNA, 20 bp, human
gctaactccgggaggctccc

SEQ ID NO: 168836 - DNA, 20 bp, human
gggccgaggcgggagagact

SEQ ID NO: 168837 - DNA, 20 bp, human
gctgacagcgcacctaaccg

SEQ ID NO: 168838 - DNA, 20 bp, human
gctgggccaggcactcggaa

SEQ ID NO: 168839 - DNA, 20 bp, human
ggctcccgaggcagtgcagt

SEQ ID NO: 168840 - DNA, 20 bp, human
gggctgcccagaagttccat

SEQ ID NO: 168841 - DNA, 20 bp, human
gctctcccggagccgatagg

SEQ ID NO: 168842 - DNA, 20 bp, human
ggccggaagtggtcccgcag

SEQ ID NO: 168843 - DNA, 20 bp, human
ggtagctgggcgcctcggtt

SEQ ID NO: 168844 - DNA, 20 bp, human
gggtgggagtggggctcccg

SEQ ID NO: 168845 - DNA, 20 bp, human
ggcgggcagacggcatagga

SEQ ID NO: 168846 - DNA, 20 bp, human
ggcatctcagacagccttgt

SEQ ID NO: 168847 - DNA, 20 bp, human
gtaaggcaatggtaatccta

SEQ ID NO: 168848 - DNA, 20 bp, human
gttgggagatgatgtttagg

SEQ ID NO: 168849 - DNA, 20 bp, human
gagctggccatcaggacaga

SEQ ID NO: 168850 - DNA, 20 bp, human
gaagtcagagaccaaagtta

SEQ ID NO: 168851 - DNA, 20 bp, human
gggatcaggagtagggttaa

SEQ ID NO: 168852 - DNA, 20 bp, human
ggagatgatgtttaggtgga

SEQ ID NO: 168853 - DNA, 20 bp, human
gctgttgttctgtaacttga

SEQ ID NO: 168854 - DNA, 20 bp, human
gttgatgaggatcaggagta

SEQ ID NO: 168855 - DNA, 20 bp, human
gaatttgggagatgatgttt

SEQ ID NO: 168856 - DNA, 20 bp, human
ggggcgtgcgacggttactc

SEQ ID NO: 168857 - DNA, 20 bp, human
gatgctggtgaggaagccgt

SEQ ID NO: 168858 - DNA, 20 bp, human
gggagcctggcggcgagtgg

SEQ ID NO: 168859 - DNA, 20 bp, human
ggagggtcacagaaacacct

SEQ ID NO: 168860 - DNA, 20 bp, human
gcaccagcatccctcgcggg

SEQ ID NO: 168861 - DNA, 20 bp, human
gacggttactctggttactg

SEQ ID NO: 168862 - DNA, 20 bp, human
gcagcggccggaaggcacgg

SEQ ID NO: 168863 - DNA, 20 bp, human
gggcctcggactcaagagtg

SEQ ID NO: 168864 - DNA, 20 bp, human
gctcggcactgggggaaacg

SEQ ID NO: 168865 - DNA, 20 bp, human
gagcaggtgccctttcagaa

SEQ ID NO: 168866 - DNA, 20 bp, human
gaccgtcctggagcgggagt

SEQ ID NO: 168867 - DNA, 20 bp, human
gcccgggtaagaggcatccg

SEQ ID NO: 168868 - DNA, 20 bp, human
ggcgccaacgcagtgaccga

SEQ ID NO: 168869 - DNA, 20 bp, human
ggagccttcggtcactgcgt

SEQ ID NO: 168870 - DNA, 20 bp, human
gaaacgctgttggcacccag

SEQ ID NO: 168871 - DNA, 20 bp, human
ggagacccagaagggagcga

SEQ ID NO: 168872 - DNA, 20 bp, human
gggagaggccaacccgcgag

SEQ ID NO: 168873 - DNA, 20 bp, human
ggtgacagtcaacaggtgga

SEQ ID NO: 168874 - DNA, 20 bp, human
gcactgcgcgtgggacagag

SEQ ID NO: 168875 - DNA, 20 bp, human
gccaggccttgagacccaga

SEQ ID NO: 168876 - DNA, 20 bp, human
ggccagctcgccgctcgcta

SEQ ID NO: 168877 - DNA, 20 bp, human
gcccagaaggtaggccttca

SEQ ID NO: 168878 - DNA, 20 bp, human
ggccggcctggtgactggag

SEQ ID NO: 168879 - DNA, 20 bp, human
gtcctccttgcccagaaggt

SEQ ID NO: 168880 - DNA, 20 bp, human
gcttctgggcaaggaggacg

SEQ ID NO: 168881 - DNA, 20 bp, human
gatggcgtcgctcaccgtga

SEQ ID NO: 168882 - DNA, 20 bp, human
gcagcgtcggccccctgggg

SEQ ID NO: 168883 - DNA, 20 bp, human
gcggcgagctggcggaaaac

SEQ ID NO: 168884 - DNA, 20 bp, human
ggcggcggctgcgaccggga

SEQ ID NO: 168885 - DNA, 20 bp, human
ggcttccaggcgcactaccg

SEQ ID NO: 168886 - DNA, 20 bp, human
gggctcactgcagatatcag

SEQ ID NO: 168887 - DNA, 20 bp, human
gtggcgcacctgggcgtcgg

SEQ ID NO: 168888 - DNA, 20 bp, human
gcctggtacgcggcactcag

SEQ ID NO: 168889 - DNA, 20 bp, human
gtatcaggggcgcgggacac

SEQ ID NO: 168890 - DNA, 20 bp, human
gcaggggcgcgggacactgg

SEQ ID NO: 168891 - DNA, 20 bp, human
gaagcttgcgccctgagggg

SEQ ID NO: 168892 - DNA, 20 bp, human
gctctcgctgtcctggtacg

SEQ ID NO: 168893 - DNA, 20 bp, human
gacaaagcttgcgccctgag

SEQ ID NO: 168894 - DNA, 20 bp, human
gggggaaggggcgcctgcgt

SEQ ID NO: 168895 - DNA, 20 bp, human
gcgcaggggtcggaaggcgg

SEQ ID NO: 168896 - DNA, 20 bp, human
ggagcgcagccggcgggcta

SEQ ID NO: 168897 - DNA, 20 bp, human
gaacctgagcagcagagaag

SEQ ID NO: 168898 - DNA, 20 bp, human
gtctccttaaggagccctcg

SEQ ID NO: 168899 - DNA, 20 bp, human
ggcagcccgtatgagaactg

SEQ ID NO: 168900 - DNA, 20 bp, human
gcggagctgtacgtgaagcc

SEQ ID NO: 168901 - DNA, 20 bp, human
gcccaggatggatcccccag

SEQ ID NO: 168902 - DNA, 20 bp, human
gggccaagcggaagtggaga

SEQ ID NO: 168903 - DNA, 20 bp, human
gccgcaggcaacaaggaacg

SEQ ID NO: 168904 - DNA, 20 bp, human
gacctagtgccctagcccgc

SEQ ID NO: 168905 - DNA, 20 bp, human
ggccgggtgagcgcagccgg

SEQ ID NO: 168906 - DNA, 20 bp, human
gacccgcaagacgaccgcca

SEQ ID NO: 168907 - DNA, 20 bp, human
ggaaggtgcggtggcactca

SEQ ID NO: 168908 - DNA, 20 bp, human
gcgggaaccggaaggtgcgg

SEQ ID NO: 168909 - DNA, 20 bp, human
gggtcttctgacgtgccggg

SEQ ID NO: 168910 - DNA, 20 bp, human
gggtggcactcacggaatct

SEQ ID NO: 168911 - DNA, 20 bp, human
gtctgacgtgccgggcggga

SEQ ID NO: 168912 - DNA, 20 bp, human
ggtcacgaggtagctaggag

SEQ ID NO: 168913 - DNA, 20 bp, human
gacttccggcgggaaccgga

SEQ ID NO: 168914 - DNA, 20 bp, human
gtcgggtcttctgacgtgcc

SEQ ID NO: 168915 - DNA, 20 bp, human
ggaggtgtcacgaggtagct

SEQ ID NO: 168916 - DNA, 20 bp, human
gggcagacggacgcacggga

SEQ ID NO: 168917 - DNA, 20 bp, human
ggcgggacgtccagcgggac

SEQ ID NO: 168918 - DNA, 20 bp, human
gcggaccgcgggacgtccag

SEQ ID NO: 168919 - DNA, 20 bp, human
gcaccggcagacggacgcac

SEQ ID NO: 168920 - DNA, 20 bp, human
gggcgggcgggcgggctcac

SEQ ID NO: 168921 - DNA, 20 bp, human
gagctcgctggcttctctgg

SEQ ID NO: 168922 - DNA, 20 bp, human
gccaggccggaatggattcc

SEQ ID NO: 168923 - DNA, 20 bp, human
ggcacgggagggcggaccgc

SEQ ID NO: 168924 - DNA, 20 bp, human
gtccattccggcctgggagc

SEQ ID NO: 168925 - DNA, 20 bp, human
gagacctggcccgggggcta

SEQ ID NO: 168926 - DNA, 20 bp, human
gagcatttccgggcctcctg

SEQ ID NO: 168927 - DNA, 20 bp, human
gtcagtccgtcgggagggct

SEQ ID NO: 168928 - DNA, 20 bp, human
gagcgattccgagcgagtgg

SEQ ID NO: 168929 - DNA, 20 bp, human
gccatagagacagactgagg

SEQ ID NO: 168930 - DNA, 20 bp, human
gcgcagcaccccgggaaggt

SEQ ID NO: 168931 - DNA, 20 bp, human
ggattccgagcgagtggtgg

SEQ ID NO: 168932 - DNA, 20 bp, human
ggcgcgcagtcagccgtcat

SEQ ID NO: 168933 - DNA, 20 bp, human
gtttggtgaggcctcgggag

SEQ ID NO: 168934 - DNA, 20 bp, human
ggatagcgattccgagcgag

SEQ ID NO: 168935 - DNA, 20 bp, human
gcgcagtcagccgtcatggg

SEQ ID NO: 168936 - DNA, 20 bp, human
gcggggtggaccagctggga

SEQ ID NO: 168937 - DNA, 20 bp, human
ggagtgctgggaccagagaa

SEQ ID NO: 168938 - DNA, 20 bp, human
gtcccaagcccggcgcacag

SEQ ID NO: 168939 - DNA, 20 bp, human
gggcggggcgagggatgctg

SEQ ID NO: 168940 - DNA, 20 bp, human
gccgccggggtggaccagct

SEQ ID NO: 168941 - DNA, 20 bp, human
gcccgggcgagaggagtgct

SEQ ID NO: 168942 - DNA, 20 bp, human
gtggggaacgctccgtccca

SEQ ID NO: 168943 - DNA, 20 bp, human
gagcccgcgaggcggcgaga

SEQ ID NO: 168944 - DNA, 20 bp, human
gggacggagcgttccccatc

SEQ ID NO: 168945 - DNA, 20 bp, human
gcccgcgcccccgcccgatg

SEQ ID NO: 168946 - DNA, 20 bp, human
gctgtccctaaggtcggatg

SEQ ID NO: 168947 - DNA, 20 bp, human
gagacaaagtgattcgatct

SEQ ID NO: 168948 - DNA, 20 bp, human
gcatagctccgcctccacct

SEQ ID NO: 168949 - DNA, 20 bp, human
gcctcctcctaaacttccag

SEQ ID NO: 168950 - DNA, 20 bp, human
gttcttgctgtccctaaggt

SEQ ID NO: 168951 - DNA, 20 bp, human
gcctgggtgccctttttctg

SEQ ID NO: 168952 - DNA, 20 bp, human
gctgtccccatccgacctta

SEQ ID NO: 168953 - DNA, 20 bp, human
gggaggtggccggcaccagc

SEQ ID NO: 168954 - DNA, 20 bp, human
gagtgactgaatcaaggtga

SEQ ID NO: 168955 - DNA, 20 bp, human
gcagcagccagaaggggctt

SEQ ID NO: 168956 - DNA, 20 bp, human
gggaggggcggctaccggag

SEQ ID NO: 168957 - DNA, 20 bp, human
gggacgccgggccgggagta

SEQ ID NO: 168958 - DNA, 20 bp, human
gctgccgggactctgcagaa

SEQ ID NO: 168959 - DNA, 20 bp, human
gccgggccgggagtagggta

SEQ ID NO: 168960 - DNA, 20 bp, human
gggggcggctaccggagggg

SEQ ID NO: 168961 - DNA, 20 bp, human
gacgttaccgatgcccgtag

SEQ ID NO: 168962 - DNA, 20 bp, human
gctgcagagtcccggcagtg

SEQ ID NO: 168963 - DNA, 20 bp, human
gaccggagtcccgcactgcc

SEQ ID NO: 168964 - DNA, 20 bp, human
gtcccggcagtgcgggactc

SEQ ID NO: 168965 - DNA, 20 bp, human
gcagaaagggttctcaagtc

SEQ ID NO: 168966 - DNA, 20 bp, human
gcggccaccggcgaggaaca

SEQ ID NO: 168967 - DNA, 20 bp, human
gtacaaggccagtgccccaa

SEQ ID NO: 168968 - DNA, 20 bp, human
gcgcgcaccgaggaacgcca

SEQ ID NO: 168969 - DNA, 20 bp, human
gggcgctgtgaggaacgcgg

SEQ ID NO: 168970 - DNA, 20 bp, human
ggcaccgaggaacgccaagg

SEQ ID NO: 168971 - DNA, 20 bp, human
gacgccaaggaggcagcgtg

SEQ ID NO: 168972 - DNA, 20 bp, human
ggccgcgctctcttctggga

SEQ ID NO: 168973 - DNA, 20 bp, human
gccgcgggcaccgcgaagga

SEQ ID NO: 168974 - DNA, 20 bp, human
ggtcccaggtggcccgaaga

SEQ ID NO: 168975 - DNA, 20 bp, human
ggccccaagggcgaccaaag

SEQ ID NO: 168976 - DNA, 20 bp, human
ggccatggctccctgggcgg

SEQ ID NO: 168977 - DNA, 20 bp, human
gccgctagcccgcggaagag

SEQ ID NO: 168978 - DNA, 20 bp, human
ggctagtggccgctcttccg

SEQ ID NO: 168979 - DNA, 20 bp, human
gtgcgcccgggaacccgcca

SEQ ID NO: 168980 - DNA, 20 bp, human
ggctcgcgggcagccagcag

SEQ ID NO: 168981 - DNA, 20 bp, human
gcgtcccgctaggctgagac

SEQ ID NO: 168982 - DNA, 20 bp, human
gacgcgggccatggctccct

SEQ ID NO: 168983 - DNA, 20 bp, human
gcggagccacgcagcagccg

SEQ ID NO: 168984 - DNA, 20 bp, human
gccggtgcgccgcgcgctag

SEQ ID NO: 168985 - DNA, 20 bp, human
gcgcggacgccgagggagag

SEQ ID NO: 168986 - DNA, 20 bp, human
ggaaccagggaggctcggtg

SEQ ID NO: 168987 - DNA, 20 bp, human
ggacgctagcgcgggaacca

SEQ ID NO: 168988 - DNA, 20 bp, human
gacacgaacgcgcggagcgg

SEQ ID NO: 168989 - DNA, 20 bp, human
ggcgccggcgaaaagttcct

SEQ ID NO: 168990 - DNA, 20 bp, human
gaggacacgaacgcgcggag

SEQ ID NO: 168991 - DNA, 20 bp, human
gcctcgtacggcccttccta

SEQ ID NO: 168992 - DNA, 20 bp, human
gctcagaggcggcccggcgc

SEQ ID NO: 168993 - DNA, 20 bp, human
gaagccgcctcgctgaaggg

SEQ ID NO: 168994 - DNA, 20 bp, human
ggcgcgttcgtgtcctgccc

SEQ ID NO: 168995 - DNA, 20 bp, human
ggcgcccgtgggggagacaa

SEQ ID NO: 168996 - DNA, 20 bp, human
ggcgccttgacaggtgaagt

SEQ ID NO: 168997 - DNA, 20 bp, human
ggtcggcgcggggaggggta

SEQ ID NO: 168998 - DNA, 20 bp, human
gaacggcctggacgccccaa

SEQ ID NO: 168999 - DNA, 20 bp, human
gtaggcaggggtgctgaata

SEQ ID NO: 169000 - DNA, 20 bp, human
ggcgccgacttcacctgtca

SEQ ID NO: 169001 - DNA, 20 bp, human
gctgaatagggcagacgctg

SEQ ID NO: 169002 - DNA, 20 bp, human
gcaagggcgggcgcagatcg

SEQ ID NO: 169003 - DNA, 20 bp, human
gcggggaggggtagggccaa

SEQ ID NO: 169004 - DNA, 20 bp, human
gggcgcgccgcagcgctcaa

SEQ ID NO: 169005 - DNA, 20 bp, human
gaggggtagggccaacggcc

SEQ ID NO: 169006 - DNA, 20 bp, human
gccggcaccgcctcaccgac

SEQ ID NO: 169007 - DNA, 20 bp, human
ggccgggcgatggacgacag

SEQ ID NO: 169008 - DNA, 20 bp, human
ggtggcacccgtcggtgagg

SEQ ID NO: 169009 - DNA, 20 bp, human
gtgaccctgggagacatcga

SEQ ID NO: 169010 - DNA, 20 bp, human
gatcccacggcctcccggag

SEQ ID NO: 169011 - DNA, 20 bp, human
ggggcgcaacgcaaacatgg

SEQ ID NO: 169012 - DNA, 20 bp, human
gcgggaggccgtgggatctg

SEQ ID NO: 169013 - DNA, 20 bp, human
gggcggcgggtggcacccgt

SEQ ID NO: 169014 - DNA, 20 bp, human
gcgggtggcacccgtcggtg

SEQ ID NO: 169015 - DNA, 20 bp, human
gggagcggcgcagctgggtc

SEQ ID NO: 169016 - DNA, 20 bp, human
ggtctacgacgcgtcagcga

SEQ ID NO: 169017 - DNA, 20 bp, human
gtcgggatgaacagcggcgg

SEQ ID NO: 169018 - DNA, 20 bp, human
gcagcgaacacaagtcccgg

SEQ ID NO: 169019 - DNA, 20 bp, human
gagtcccggaggcacagaaa

SEQ ID NO: 169020 - DNA, 20 bp, human
gtagacgttggggagcggga

SEQ ID NO: 169021 - DNA, 20 bp, human
gggatcgggatgaacagcgg

SEQ ID NO: 169022 - DNA, 20 bp, human
gccgactaaggagagcagga

SEQ ID NO: 169023 - DNA, 20 bp, human
ggagcaggacggcggaaccc

SEQ ID NO: 169024 - DNA, 20 bp, human
ggggtgccctaatcaaatat

SEQ ID NO: 169025 - DNA, 20 bp, human
gagcgggaaggcaacggcag

SEQ ID NO: 169026 - DNA, 20 bp, human
gcagcaccctcgctacggtc

SEQ ID NO: 169027 - DNA, 20 bp, human
ggaacaaggcacagtcaaag

SEQ ID NO: 169028 - DNA, 20 bp, human
gcccgccagctgtgagaaca

SEQ ID NO: 169029 - DNA, 20 bp, human
gtgtaactgtaggcctaagg

SEQ ID NO: 169030 - DNA, 20 bp, human
gcgcaagggagggtagggta

SEQ ID NO: 169031 - DNA, 20 bp, human
gagggagagactgtaactgt

SEQ ID NO: 169032 - DNA, 20 bp, human
gcgcagcagcaccctcgcta

SEQ ID NO: 169033 - DNA, 20 bp, human
gccgaagggagcgcaaggga

SEQ ID NO: 169034 - DNA, 20 bp, human
gccctcgctacggtcgggaa

SEQ ID NO: 169035 - DNA, 20 bp, human
ggcctgtacgcctctagcga

SEQ ID NO: 169036 - DNA, 20 bp, human
gccgcgggggccctctacag

SEQ ID NO: 169037 - DNA, 20 bp, human
ggcggccgcggcagcgatag

SEQ ID NO: 169038 - DNA, 20 bp, human
ggcagcggcggcaaccaccc

SEQ ID NO: 169039 - DNA, 20 bp, human
ggccctagcagacggacagg

SEQ ID NO: 169040 - DNA, 20 bp, human
gtcgatgcaggagggcggac

SEQ ID NO: 169041 - DNA, 20 bp, human
gggtcggcccgggcgtgcag

SEQ ID NO: 169042 - DNA, 20 bp, human
gggacacgcggggctaacgg

SEQ ID NO: 169043 - DNA, 20 bp, human
ggcgagggcgactcggagtc

SEQ ID NO: 169044 - DNA, 20 bp, human
ggcctgagcgagatggagat

SEQ ID NO: 169045 - DNA, 20 bp, human
ggactcggagtcgggcgagg

SEQ ID NO: 169046 - DNA, 20 bp, human
gccggttcacgtgcaggcag

SEQ ID NO: 169047 - DNA, 20 bp, human
gtgagcgccgaggaacctat

SEQ ID NO: 169048 - DNA, 20 bp, human
ggttcacgtgcaggcagcgg

SEQ ID NO: 169049 - DNA, 20 bp, human
gtattgaggttcagagttcc

SEQ ID NO: 169050 - DNA, 20 bp, human
ggagagaccggttcacgtgc

SEQ ID NO: 169051 - DNA, 20 bp, human
ggcgtcgccacgcccctcaa

SEQ ID NO: 169052 - DNA, 20 bp, human
ggaccgaaaagggaaattac

SEQ ID NO: 169053 - DNA, 20 bp, human
gcagccgcggtctgagagac

SEQ ID NO: 169054 - DNA, 20 bp, human
gactctgaacctcaataacg

SEQ ID NO: 169055 - DNA, 20 bp, human
gggcgctcacctcgttattg

SEQ ID NO: 169056 - DNA, 20 bp, human
gggagacctaaactccgccg

SEQ ID NO: 169057 - DNA, 20 bp, human
gccacacgcaggcaatccag

SEQ ID NO: 169058 - DNA, 20 bp, human
gccagcggccgtagaggaag

SEQ ID NO: 169059 - DNA, 20 bp, human
ggctccgtcggtaatcccag

SEQ ID NO: 169060 - DNA, 20 bp, human
gcgacgctcagacgcgccct

SEQ ID NO: 169061 - DNA, 20 bp, human
gaatcccaggggatccccgg

SEQ ID NO: 169062 - DNA, 20 bp, human
ggtccccgctgctgctgaga

SEQ ID NO: 169063 - DNA, 20 bp, human
ggacgtcccccgccactcgc

SEQ ID NO: 169064 - DNA, 20 bp, human
gcagcgccgacccgagggaa

SEQ ID NO: 169065 - DNA, 20 bp, human
ggcccgcccagcggccgtag

SEQ ID NO: 169066 - DNA, 20 bp, human
ggaatgtaaagtgaaagata

SEQ ID NO: 169067 - DNA, 20 bp, human
gaggactaggaaccgatagg

SEQ ID NO: 169068 - DNA, 20 bp, human
ggagaggactaggaaccgat

SEQ ID NO: 169069 - DNA, 20 bp, human
gcacaggtcccgagccaacg

SEQ ID NO: 169070 - DNA, 20 bp, human
ggcggatggacactgatcaa

SEQ ID NO: 169071 - DNA, 20 bp, human
gctcgacaggaccatctcac

SEQ ID NO: 169072 - DNA, 20 bp, human
gagcaaggaaacagatcctt

SEQ ID NO: 169073 - DNA, 20 bp, human
gagaaggactctcctcctat

SEQ ID NO: 169074 - DNA, 20 bp, human
ggttaggagcaccagagatg

SEQ ID NO: 169075 - DNA, 20 bp, human
gtggtcctgtcgagaggact

SEQ ID NO: 169076 - DNA, 20 bp, human
gtcagaccagaggcaccgaa

SEQ ID NO: 169077 - DNA, 20 bp, human
ggctccggtgaacacaaggc

SEQ ID NO: 169078 - DNA, 20 bp, human
gagtccagccttgtgttcac

SEQ ID NO: 169079 - DNA, 20 bp, human
gttaagctccggtgaacaca

SEQ ID NO: 169080 - DNA, 20 bp, human
gtccagtgaggatcaaagcc

SEQ ID NO: 169081 - DNA, 20 bp, human
ggctggctgcacgaccaaag

SEQ ID NO: 169082 - DNA, 20 bp, human
gctagtgacgtgagcagtgg

SEQ ID NO: 169083 - DNA, 20 bp, human
gtgctgcaacgcttaagctc

SEQ ID NO: 169084 - DNA, 20 bp, human
ggaccagaggcaccgaaggg

SEQ ID NO: 169085 - DNA, 20 bp, human
gacacacacacatccacgag

SEQ ID NO: 169086 - DNA, 20 bp, human
gtgggagagctagactaagt

SEQ ID NO: 169087 - DNA, 20 bp, human
ggacaccccccaacagtcaa

SEQ ID NO: 169088 - DNA, 20 bp, human
ggatgtagacacttaggggt

SEQ ID NO: 169089 - DNA, 20 bp, human
ggattccagaaccaggatga

SEQ ID NO: 169090 - DNA, 20 bp, human
ggaagctactcaaatgcagt

SEQ ID NO: 169091 - DNA, 20 bp, human
gggcacctttgactgttggg

SEQ ID NO: 169092 - DNA, 20 bp, human
gcatttcctaatcaagaagt

SEQ ID NO: 169093 - DNA, 20 bp, human
ggcacgccaacttcttgatt

SEQ ID NO: 169094 - DNA, 20 bp, human
gaaatgcagtcggcttgtcc

SEQ ID NO: 169095 - DNA, 20 bp, human
gattttgggatgaaaatgtg

SEQ ID NO: 169096 - DNA, 20 bp, human
gtggattgcagcgcacccat

SEQ ID NO: 169097 - DNA, 20 bp, human
gctggaagtagttcgaacat

SEQ ID NO: 169098 - DNA, 20 bp, human
gggatcttgttggattcacc

SEQ ID NO: 169099 - DNA, 20 bp, human
gaaggtcagtcctcagacgg

SEQ ID NO: 169100 - DNA, 20 bp, human
gctcagacgggggatcttgt

SEQ ID NO: 169101 - DNA, 20 bp, human
gtcgggcaggttatcctacg

SEQ ID NO: 169102 - DNA, 20 bp, human
gggtacctggctctccgcgt

SEQ ID NO: 169103 - DNA, 20 bp, human
gttatcctacgcggagagcc

SEQ ID NO: 169104 - DNA, 20 bp, human
gaaagtccacttacggaaaa

SEQ ID NO: 169105 - DNA, 20 bp, human
gactgacctttttccgtaag

SEQ ID NO: 169106 - DNA, 20 bp, human
gctgcagcatggcgtacccg

SEQ ID NO: 169107 - DNA, 20 bp, human
ggaggcaaccaagaaggcgg

SEQ ID NO: 169108 - DNA, 20 bp, human
ggtcagcacttaccccgcct

SEQ ID NO: 169109 - DNA, 20 bp, human
gcgccggcgccaggatgccc

SEQ ID NO: 169110 - DNA, 20 bp, human
gccggcggcgggtactaccc

SEQ ID NO: 169111 - DNA, 20 bp, human
gtgactgttgttgctctggg

SEQ ID NO: 169112 - DNA, 20 bp, human
ggaagggacggggaaacgtg

SEQ ID NO: 169113 - DNA, 20 bp, human
gcggagaggcctggcgcaca

SEQ ID NO: 169114 - DNA, 20 bp, human
ggccgaaccccaggggccta

SEQ ID NO: 169115 - DNA, 20 bp, human
gggcgggtactacccaggcg

SEQ ID NO: 169116 - DNA, 20 bp, human
gtccatagctgggaaatcag

SEQ ID NO: 169117 - DNA, 20 bp, human
gagaagctggtgatccttag

SEQ ID NO: 169118 - DNA, 20 bp, human
ggcaagaaggcaatcctcta

SEQ ID NO: 169119 - DNA, 20 bp, human
gtcttgagttgaagtcttat

SEQ ID NO: 169120 - DNA, 20 bp, human
gaagtcttataggtagaagc

SEQ ID NO: 169121 - DNA, 20 bp, human
gagacttcaactcaagatgc

SEQ ID NO: 169122 - DNA, 20 bp, human
gatttggccactctgcaaga

SEQ ID NO: 169123 - DNA, 20 bp, human
gtattcatattgcagctctg

SEQ ID NO: 169124 - DNA, 20 bp, human
gggattgccttcttgcagag

SEQ ID NO: 169125 - DNA, 20 bp, human
gtttcccagctatggaaaag

SEQ ID NO: 169126 - DNA, 20 bp, human
gcacctggtgggatataagg

SEQ ID NO: 169127 - DNA, 20 bp, human
ggccctcaaagtcgagacgg

SEQ ID NO: 169128 - DNA, 20 bp, human
gtcccacctggtgggatata

SEQ ID NO: 169129 - DNA, 20 bp, human
gttctcaggacaagcaggta

SEQ ID NO: 169130 - DNA, 20 bp, human
gaggcccggggaaaagagaa

SEQ ID NO: 169131 - DNA, 20 bp, human
gcggacaaaatagcacagtc

SEQ ID NO: 169132 - DNA, 20 bp, human
gtgagaacaggagcgaggcc

SEQ ID NO: 169133 - DNA, 20 bp, human
gcaggaaggccagaggaagt

SEQ ID NO: 169134 - DNA, 20 bp, human
gctggtgggatataaggcgg

SEQ ID NO: 169135 - DNA, 20 bp, human
gggtgaccctcccacctggt

SEQ ID NO: 169136 - DNA, 20 bp, human
ggtagcgcgagcgccggtgg

SEQ ID NO: 169137 - DNA, 20 bp, human
ggcgcggcgccgcagcacaa

SEQ ID NO: 169138 - DNA, 20 bp, human
gcccagggaggcggtgtgag

SEQ ID NO: 169139 - DNA, 20 bp, human
gccgcgccgcaacctaaccc

SEQ ID NO: 169140 - DNA, 20 bp, human
gacaccgcctccctgggctg

SEQ ID NO: 169141 - DNA, 20 bp, human
gtgagggctgacacgtggag

SEQ ID NO: 169142 - DNA, 20 bp, human
ggactgcgggctggcctctt

SEQ ID NO: 169143 - DNA, 20 bp, human
ggcggaagacgaggatgtcc

SEQ ID NO: 169144 - DNA, 20 bp, human
gcggcgtggagaggcccgtg

SEQ ID NO: 169145 - DNA, 20 bp, human
gctccacgccgggacccaag

SEQ ID NO: 169146 - DNA, 20 bp, human
gccagacgccaaggaggtcg

SEQ ID NO: 169147 - DNA, 20 bp, human
gcaaggaggtcgaggacagg

SEQ ID NO: 169148 - DNA, 20 bp, human
gcgccaaggaggtcgaggac

SEQ ID NO: 169149 - DNA, 20 bp, human
gtgcactccagacgccaagg

SEQ ID NO: 169150 - DNA, 20 bp, human
gcggtgcactccagacgcca

SEQ ID NO: 169151 - DNA, 20 bp, human
ggcgagcccggaagaggaac

SEQ ID NO: 169152 - DNA, 20 bp, human
gcccagcgtggtgaccccgg

SEQ ID NO: 169153 - DNA, 20 bp, human
gggaggcacacggttcccac

SEQ ID NO: 169154 - DNA, 20 bp, human
ggctggacaccgggtcccac

SEQ ID NO: 169155 - DNA, 20 bp, human
gcggccctgcggtcactcag

SEQ ID NO: 169156 - DNA, 20 bp, human
gcggaagtcccgcccagcct

SEQ ID NO: 169157 - DNA, 20 bp, human
ggccttgacgcggcaggacg

SEQ ID NO: 169158 - DNA, 20 bp, human
gacagggtggggaaaggtag

SEQ ID NO: 169159 - DNA, 20 bp, human
ggaatgtgctcagtacaggg

SEQ ID NO: 169160 - DNA, 20 bp, human
gctcagtacagggtggggaa

SEQ ID NO: 169161 - DNA, 20 bp, human
ggttggagagcgagcaggta

SEQ ID NO: 169162 - DNA, 20 bp, human
gtccagaagtgccggacgtc

SEQ ID NO: 169163 - DNA, 20 bp, human
gcttccggctctcactgcta

SEQ ID NO: 169164 - DNA, 20 bp, human
gcgcggcagacagactccgg

SEQ ID NO: 169165 - DNA, 20 bp, human
gttaccagaagcaacctagg

SEQ ID NO: 169166 - DNA, 20 bp, human
gagaaacccggcagaaaccc

SEQ ID NO: 169167 - DNA, 20 bp, human
gcattctggaggccgcggag

SEQ ID NO: 169168 - DNA, 20 bp, human
gaacccggcagaaacccggg

SEQ ID NO: 169169 - DNA, 20 bp, human
gcagaaacccgggaggaacc

SEQ ID NO: 169170 - DNA, 20 bp, human
gtcttgggcaggacttccgg

SEQ ID NO: 169171 - DNA, 20 bp, human
ggggcccgtacagagcgagt

SEQ ID NO: 169172 - DNA, 20 bp, human
gggacgcggaaccatttctt

SEQ ID NO: 169173 - DNA, 20 bp, human
gaggcggtgggtcctccgaa

SEQ ID NO: 169174 - DNA, 20 bp, human
gggacttccggcggaaaagc

SEQ ID NO: 169175 - DNA, 20 bp, human
ggcggaaaagcgggctgtct

SEQ ID NO: 169176 - DNA, 20 bp, human
gtcggaagacaactcaaaag

SEQ ID NO: 169177 - DNA, 20 bp, human
gcccgccccagactacggag

SEQ ID NO: 169178 - DNA, 20 bp, human
ggctccccctccgtagtctg

SEQ ID NO: 169179 - DNA, 20 bp, human
gctggtgggagttgacgacg

SEQ ID NO: 169180 - DNA, 20 bp, human
gcgttggtcttccagctggt

SEQ ID NO: 169181 - DNA, 20 bp, human
gaggttcgctggcactccgt

SEQ ID NO: 169182 - DNA, 20 bp, human
gctaaagccgtggccctgag

SEQ ID NO: 169183 - DNA, 20 bp, human
gcattgggcggaaggttcgc

SEQ ID NO: 169184 - DNA, 20 bp, human
gtcccgaactagataaagta

SEQ ID NO: 169185 - DNA, 20 bp, human
gactacggagggggagcgag

SEQ ID NO: 169186 - DNA, 20 bp, human
gagaagcaggtcccaggcgg

SEQ ID NO: 169187 - DNA, 20 bp, human
gccagtggcactgggatatc

SEQ ID NO: 169188 - DNA, 20 bp, human
ggcagagcaagacgggatag

SEQ ID NO: 169189 - DNA, 20 bp, human
ggacaactgcggggcaccag

SEQ ID NO: 169190 - DNA, 20 bp, human
ggtcttgctctgcggcgcag

SEQ ID NO: 169191 - DNA, 20 bp, human
ggagcaagacgggatagggg

SEQ ID NO: 169192 - DNA, 20 bp, human
gctaggtccgtttcttccag

SEQ ID NO: 169193 - DNA, 20 bp, human
gctccaactggacaactgcg

SEQ ID NO: 169194 - DNA, 20 bp, human
gtctgagcaccaaaaggtaa

SEQ ID NO: 169195 - DNA, 20 bp, human
gaagatggctgctgagaagc

SEQ ID NO: 169196 - DNA, 20 bp, human
gcctccaagatggcgagcgg

SEQ ID NO: 169197 - DNA, 20 bp, human
gtctcctccaagatggcgag

SEQ ID NO: 169198 - DNA, 20 bp, human
gtaccctccgcgggaagcga

SEQ ID NO: 169199 - DNA, 20 bp, human
ggccatcttggaggagacga

SEQ ID NO: 169200 - DNA, 20 bp, human
gggtgtcagtacctgcgctg

SEQ ID NO: 169201 - DNA, 20 bp, human
gagatggcgagcggcggcag

SEQ ID NO: 169202 - DNA, 20 bp, human
gcccctcgtctcctccaaga

SEQ ID NO: 169203 - DNA, 20 bp, human
gcctcggagatcctgttccg

SEQ ID NO: 169204 - DNA, 20 bp, human
gagccgggcggacaatagac

SEQ ID NO: 169205 - DNA, 20 bp, human
gtcgcgcgggaggcacggga

SEQ ID NO: 169206 - DNA, 20 bp, human
ggtccaatggagcgaggcgt

SEQ ID NO: 169207 - DNA, 20 bp, human
ggggctgctgggactcgcgt

SEQ ID NO: 169208 - DNA, 20 bp, human
gaggaggcgccgccatcttg

SEQ ID NO: 169209 - DNA, 20 bp, human
ggatggcgggaagacatcct

SEQ ID NO: 169210 - DNA, 20 bp, human
gtgctgggactcgcgtcggt

SEQ ID NO: 169211 - DNA, 20 bp, human
gtcactgggccgctagatca

SEQ ID NO: 169212 - DNA, 20 bp, human
gtaaaggaagctgagggact

SEQ ID NO: 169213 - DNA, 20 bp, human
gtttagggctgagatgaacc

SEQ ID NO: 169214 - DNA, 20 bp, human
gcccagtgaggccctgaagc

SEQ ID NO: 169215 - DNA, 20 bp, human
ggggctggggcccaaagcag

SEQ ID NO: 169216 - DNA, 20 bp, human
gttttgggccgcggcgggag

SEQ ID NO: 169217 - DNA, 20 bp, human
ggtctcaccatggagcggaa

SEQ ID NO: 169218 - DNA, 20 bp, human
gtaccggtctcaccatggag

SEQ ID NO: 169219 - DNA, 20 bp, human
ggcgattaccggtctcacca

SEQ ID NO: 169220 - DNA, 20 bp, human
ggcaggcgcctggcgattac

SEQ ID NO: 169221 - DNA, 20 bp, human
gcgcctgcgcactcgagtgg

SEQ ID NO: 169222 - DNA, 20 bp, human
gcggcgaccattgcccctcg

SEQ ID NO: 169223 - DNA, 20 bp, human
gggaaaggtgagcggtggag

SEQ ID NO: 169224 - DNA, 20 bp, human
gggagcggaaaggtgagcgg

SEQ ID NO: 169225 - DNA, 20 bp, human
gaggcgcctgcgcactcgag

SEQ ID NO: 169226 - DNA, 20 bp, human
gcggccggcggagcgagtgg

SEQ ID NO: 169227 - DNA, 20 bp, human
ggcgggcgccgagacgagct

SEQ ID NO: 169228 - DNA, 20 bp, human
gtcccggccggcggagcgag

SEQ ID NO: 169229 - DNA, 20 bp, human
gtcgaggctccgtgatgcta

SEQ ID NO: 169230 - DNA, 20 bp, human
gggccggttccctagcatca

SEQ ID NO: 169231 - DNA, 20 bp, human
gggcttcgcgacggcgacgc

SEQ ID NO: 169232 - DNA, 20 bp, human
gccgagcgccagcgtcccgg

SEQ ID NO: 169233 - DNA, 20 bp, human
ggttctcgtctcctcccggc

SEQ ID NO: 169234 - DNA, 20 bp, human
gcgcggttctcgtctcctcc

SEQ ID NO: 169235 - DNA, 20 bp, human
gctcgtctcctcccggccgg

SEQ ID NO: 169236 - DNA, 20 bp, human
gtaaagggaaaaagctccag

SEQ ID NO: 169237 - DNA, 20 bp, human
ggattcgcagtacttctgtt

SEQ ID NO: 169238 - DNA, 20 bp, human
ggtgcatgctgcagctgatc

SEQ ID NO: 169239 - DNA, 20 bp, human
ggctgtcacacatgaaccag

SEQ ID NO: 169240 - DNA, 20 bp, human
ggtattgaagatgtgtattg

SEQ ID NO: 169241 - DNA, 20 bp, human
ggattcaatggtgctataaa

SEQ ID NO: 169242 - DNA, 20 bp, human
gggcctcattctgaacaaaa

SEQ ID NO: 169243 - DNA, 20 bp, human
gatataaggcttgaaagcaa

SEQ ID NO: 169244 - DNA, 20 bp, human
gaagcaagggcaggcaatct

SEQ ID NO: 169245 - DNA, 20 bp, human
gcatgtgtgacagctgttga

SEQ ID NO: 169246 - DNA, 20 bp, human
gggatgagcgccagcacggg

SEQ ID NO: 169247 - DNA, 20 bp, human
ggcggcagtagcagcaggta

SEQ ID NO: 169248 - DNA, 20 bp, human
gtgggcatgagagacgccag

SEQ ID NO: 169249 - DNA, 20 bp, human
ggcagctccggtgccccggg

SEQ ID NO: 169250 - DNA, 20 bp, human
gagcaggtagggctcggctg

SEQ ID NO: 169251 - DNA, 20 bp, human
ggccagcacgggcggtggtg

SEQ ID NO: 169252 - DNA, 20 bp, human
gtcccagcagagccagacgg

SEQ ID NO: 169253 - DNA, 20 bp, human
ggtcgccgatcttcacaggg

SEQ ID NO: 169254 - DNA, 20 bp, human
gcccaatctacatctcccct

SEQ ID NO: 169255 - DNA, 20 bp, human
gcggcgacgtgttcaatggg

SEQ ID NO: 169256 - DNA, 20 bp, human
gcgaacgcggcctgaattcc

SEQ ID NO: 169257 - DNA, 20 bp, human
ggagcggaggagaatcccaa

SEQ ID NO: 169258 - DNA, 20 bp, human
gcgcttggcgcagcaggaag

SEQ ID NO: 169259 - DNA, 20 bp, human
ggctagagttgagacaccag

SEQ ID NO: 169260 - DNA, 20 bp, human
ggtgaagaagtcgagcatgg

SEQ ID NO: 169261 - DNA, 20 bp, human
gcaggaagcggcggcgaacg

SEQ ID NO: 169262 - DNA, 20 bp, human
ggcgggacacgtcacaccag

SEQ ID NO: 169263 - DNA, 20 bp, human
gagctgctggggataaatag

SEQ ID NO: 169264 - DNA, 20 bp, human
ggttgagacaccagaggcgg

SEQ ID NO: 169265 - DNA, 20 bp, human
gggataaatagagggagcgg

SEQ ID NO: 169266 - DNA, 20 bp, human
gcgcgccgggtggcagatgg

SEQ ID NO: 169267 - DNA, 20 bp, human
ggccacccggcgcgagtccg

SEQ ID NO: 169268 - DNA, 20 bp, human
ggccgcaaggtgtctaggta

SEQ ID NO: 169269 - DNA, 20 bp, human
gaccgccgccatctgccacc

SEQ ID NO: 169270 - DNA, 20 bp, human
gagcgcgctcaagcgtaaca

SEQ ID NO: 169271 - DNA, 20 bp, human
gcgcgagtccgcggaagcca

SEQ ID NO: 169272 - DNA, 20 bp, human
gaagccatggatgagacgcg

SEQ ID NO: 169273 - DNA, 20 bp, human
ggtctcatccatggcttccg

SEQ ID NO: 169274 - DNA, 20 bp, human
gtccgcggactcgcgccggg

SEQ ID NO: 169275 - DNA, 20 bp, human
gaccaggacgttaactccgg

SEQ ID NO: 169276 - DNA, 20 bp, human
gagcgcagcgcgcttcccgg

SEQ ID NO: 169277 - DNA, 20 bp, human
gcccgagcgaagggtcccaa

SEQ ID NO: 169278 - DNA, 20 bp, human
gcaggagaccgaagagacca

SEQ ID NO: 169279 - DNA, 20 bp, human
ggcttcccaggtaggatcgg

SEQ ID NO: 169280 - DNA, 20 bp, human
gccgctagcacgcagtccct

SEQ ID NO: 169281 - DNA, 20 bp, human
ggagcctcctacaccgaaaa

SEQ ID NO: 169282 - DNA, 20 bp, human
ggcgccccgcgcctggagat

SEQ ID NO: 169283 - DNA, 20 bp, human
gcttcgctcgggatagaggg

SEQ ID NO: 169284 - DNA, 20 bp, human
gagcagcgcgggccgatgtg

SEQ ID NO: 169285 - DNA, 20 bp, human
gagggctcccgtcgccgcga

SEQ ID NO: 169286 - DNA, 20 bp, human
gtccgtctgctgcagaagag

SEQ ID NO: 169287 - DNA, 20 bp, human
ggaagggttttagaaagatg

SEQ ID NO: 169288 - DNA, 20 bp, human
gtgtgtttgcagtcaggtca

SEQ ID NO: 169289 - DNA, 20 bp, human
gccggaggccgggacagacc

SEQ ID NO: 169290 - DNA, 20 bp, human
ggaagagggggaagtgtgaa

SEQ ID NO: 169291 - DNA, 20 bp, human
gataaggagacccagaactt

SEQ ID NO: 169292 - DNA, 20 bp, human
gtgtggacgtcgtaacatct

SEQ ID NO: 169293 - DNA, 20 bp, human
gaccaggagccactcgttct

SEQ ID NO: 169294 - DNA, 20 bp, human
gggggaagtgtgaatggcac

SEQ ID NO: 169295 - DNA, 20 bp, human
gggcagtgttaacagaatcc

SEQ ID NO: 169296 - DNA, 20 bp, human
ggaacgacggtggccgcgct

SEQ ID NO: 169297 - DNA, 20 bp, human
ggcgcggcgccggtgagctg

SEQ ID NO: 169298 - DNA, 20 bp, human
ggtgtccacgacaacagcaa

SEQ ID NO: 169299 - DNA, 20 bp, human
gctgcgcgtgcgcagaggtg

SEQ ID NO: 169300 - DNA, 20 bp, human
ggcagcagccgcgaagatgg

SEQ ID NO: 169301 - DNA, 20 bp, human
ggtcgttcggaaagggaggg

SEQ ID NO: 169302 - DNA, 20 bp, human
gcctggcctaaggtgtccag

SEQ ID NO: 169303 - DNA, 20 bp, human
gaccgtcgttcggaaaggga

SEQ ID NO: 169304 - DNA, 20 bp, human
ggcgccgcgggccattactt

SEQ ID NO: 169305 - DNA, 20 bp, human
gcccgcccctctggaaccgg

SEQ ID NO: 169306 - DNA, 20 bp, human
gcgctgacgtcagagaccaa

SEQ ID NO: 169307 - DNA, 20 bp, human
gagctgcggcgctggaatcc

SEQ ID NO: 169308 - DNA, 20 bp, human
gcgtcagagaccaatggctg

SEQ ID NO: 169309 - DNA, 20 bp, human
ggcggcgctggaatcctggc

SEQ ID NO: 169310 - DNA, 20 bp, human
gcggagttcgagtctgacag

SEQ ID NO: 169311 - DNA, 20 bp, human
gcgccgcggccgtcgagccg

SEQ ID NO: 169312 - DNA, 20 bp, human
ggtggctcagaattgcccat

SEQ ID NO: 169313 - DNA, 20 bp, human
ggtgcttcgtcgcatctggg

SEQ ID NO: 169314 - DNA, 20 bp, human
ggggcgcaaagattccatca

SEQ ID NO: 169315 - DNA, 20 bp, human
gctccgcggctcgacggccg

SEQ ID NO: 169316 - DNA, 20 bp, human
gcggcggcgcggtgtaccct

SEQ ID NO: 169317 - DNA, 20 bp, human
gcgctcggctttccctccgc

SEQ ID NO: 169318 - DNA, 20 bp, human
gggaggaggaagtcccgagt

SEQ ID NO: 169319 - DNA, 20 bp, human
gcggcagggcagggagaata

SEQ ID NO: 169320 - DNA, 20 bp, human
gaaagccctaaggtcactgg

SEQ ID NO: 169321 - DNA, 20 bp, human
gaggccaaaggaaagcccta

SEQ ID NO: 169322 - DNA, 20 bp, human
gggaggaggagactgcgcag

SEQ ID NO: 169323 - DNA, 20 bp, human
gcgaggcggcaagatggacg

SEQ ID NO: 169324 - DNA, 20 bp, human
ggacggtggccggaaaatgg

SEQ ID NO: 169325 - DNA, 20 bp, human
gaggaaagccctaaggtcac

SEQ ID NO: 169326 - DNA, 20 bp, human
gtgaggaagcgaggaggcgt

SEQ ID NO: 169327 - DNA, 20 bp, human
gtcgcgaacccgagtacagg

SEQ ID NO: 169328 - DNA, 20 bp, human
gtgcaggaaggccacctcgg

SEQ ID NO: 169329 - DNA, 20 bp, human
gccgcgcgcgacaggaacgg

SEQ ID NO: 169330 - DNA, 20 bp, human
gagcccgcgcgcgacaggaa

SEQ ID NO: 169331 - DNA, 20 bp, human
gcgctcgcgaacccgagtac

SEQ ID NO: 169332 - DNA, 20 bp, human
ggcgcagttggagcccgttg

SEQ ID NO: 169333 - DNA, 20 bp, human
gagcgaggaggcgtcggcgt

SEQ ID NO: 169334 - DNA, 20 bp, human
gtgcggcccctgaggaagcg

SEQ ID NO: 169335 - DNA, 20 bp, human
gcgcccctcccccatgacaa

SEQ ID NO: 169336 - DNA, 20 bp, human
gcaagcggcggcagcacccg

SEQ ID NO: 169337 - DNA, 20 bp, human
gccagcatttcagcaagcgg

SEQ ID NO: 169338 - DNA, 20 bp, human
gcaactcagcccagactagg

SEQ ID NO: 169339 - DNA, 20 bp, human
gaccatggcctagtccatga

SEQ ID NO: 169340 - DNA, 20 bp, human
ggtcctgcccatgaccccaa

SEQ ID NO: 169341 - DNA, 20 bp, human
gctagtccatgagggtgcca

SEQ ID NO: 169342 - DNA, 20 bp, human
ggggagcctgcagaccacgg

SEQ ID NO: 169343 - DNA, 20 bp, human
gggacagcgcaccgccaccg

SEQ ID NO: 169344 - DNA, 20 bp, human
gccgggctgccgcctagtct

SEQ ID NO: 169345 - DNA, 20 bp, human
gcccagcgcccggtagatcg

SEQ ID NO: 169346 - DNA, 20 bp, human
gagcctctgcgccccaagaa

SEQ ID NO: 169347 - DNA, 20 bp, human
gagagaagaggcgacggggt

SEQ ID NO: 169348 - DNA, 20 bp, human
gccaggagagaagaggcgac

SEQ ID NO: 169349 - DNA, 20 bp, human
gggcttgcgggccgtgatac

SEQ ID NO: 169350 - DNA, 20 bp, human
gtggcgaggaaccttcaaag

SEQ ID NO: 169351 - DNA, 20 bp, human
gccagctcccggctctgtcc

SEQ ID NO: 169352 - DNA, 20 bp, human
gtggcgacaatgatgctctc

SEQ ID NO: 169353 - DNA, 20 bp, human
gaagggagggctggctttct

SEQ ID NO: 169354 - DNA, 20 bp, human
gtgggagagatcggagttca

SEQ ID NO: 169355 - DNA, 20 bp, human
ggtccgggtgaaacccagag

SEQ ID NO: 169356 - DNA, 20 bp, human
gcctgggagcaggaacctgt

SEQ ID NO: 169357 - DNA, 20 bp, human
gagtatgtcgtaggggtcaa

SEQ ID NO: 169358 - DNA, 20 bp, human
ggagcctctggcgatgtcaa

SEQ ID NO: 169359 - DNA, 20 bp, human
gggcagcgcttgagggtagc

SEQ ID NO: 169360 - DNA, 20 bp, human
gaccctcaagcgctgcctac

SEQ ID NO: 169361 - DNA, 20 bp, human
gggacccttctagtcaggag

SEQ ID NO: 169362 - DNA, 20 bp, human
gagcagctgcaagcgcgcgt

SEQ ID NO: 169363 - DNA, 20 bp, human
gaaggcagccctctgctgta

SEQ ID NO: 169364 - DNA, 20 bp, human
gtgacctttgacatcgccag

SEQ ID NO: 169365 - DNA, 20 bp, human
gtgtcgtaggggtcaaaggc

SEQ ID NO: 169366 - DNA, 20 bp, human
gtgggtgccagagacatact

SEQ ID NO: 169367 - DNA, 20 bp, human
ggtaggacacctggcagaag

SEQ ID NO: 169368 - DNA, 20 bp, human
gtgagatgccaccagcggag

SEQ ID NO: 169369 - DNA, 20 bp, human
gctcttaggtgaagacatgg

SEQ ID NO: 169370 - DNA, 20 bp, human
gctgctggccatgcctggtc

SEQ ID NO: 169371 - DNA, 20 bp, human
gtgggctttgaagatctctt

SEQ ID NO: 169372 - DNA, 20 bp, human
gacagccggggtaggacacc

SEQ ID NO: 169373 - DNA, 20 bp, human
gctgctgggccggttagaag

SEQ ID NO: 169374 - DNA, 20 bp, human
gcgacgtgagatgccaccag

SEQ ID NO: 169375 - DNA, 20 bp, human
ggatctcttaggtgaagaca

SEQ ID NO: 169376 - DNA, 20 bp, human
gagacggagctcttgagtag

SEQ ID NO: 169377 - DNA, 20 bp, human
gtgagtagagggccgaagag

SEQ ID NO: 169378 - DNA, 20 bp, human
gcccatggcacggtctgagg

SEQ ID NO: 169379 - DNA, 20 bp, human
gagtggtgcaaaaggacgag

SEQ ID NO: 169380 - DNA, 20 bp, human
gaacaaaagtgggacaaccg

SEQ ID NO: 169381 - DNA, 20 bp, human
gaagtgggacaaccggggat

SEQ ID NO: 169382 - DNA, 20 bp, human
ggaagagaggcgaacaaaag

SEQ ID NO: 169383 - DNA, 20 bp, human
gcggggagaggcggtaggag

SEQ ID NO: 169384 - DNA, 20 bp, human
ggaggaaccggggtccacgg

SEQ ID NO: 169385 - DNA, 20 bp, human
gtgcgtcacccacgcctccg

SEQ ID NO: 169386 - DNA, 20 bp, human
ggctcggcgcacggatatgg

SEQ ID NO: 169387 - DNA, 20 bp, human
gggagacgtggtgccgctgc

SEQ ID NO: 169388 - DNA, 20 bp, human
gcggcagagcgagcccgcag

SEQ ID NO: 169389 - DNA, 20 bp, human
gccgtgcgccgagctgataa

SEQ ID NO: 169390 - DNA, 20 bp, human
gtcccaccaagcctagcgca

SEQ ID NO: 169391 - DNA, 20 bp, human
gcccatgcaggagtcgagta

SEQ ID NO: 169392 - DNA, 20 bp, human
gtcccgcggcccctccaaaa

SEQ ID NO: 169393 - DNA, 20 bp, human
gagcggcaccacgtctcccg

SEQ ID NO: 169394 - DNA, 20 bp, human
gggccttaacatagagaacg

SEQ ID NO: 169395 - DNA, 20 bp, human
gtgggctccggggacgtcca

SEQ ID NO: 169396 - DNA, 20 bp, human
gctcggccgggcgcactaac

SEQ ID NO: 169397 - DNA, 20 bp, human
gaaaccgtccgcggctcagg

SEQ ID NO: 169398 - DNA, 20 bp, human
gcgcaggtagcgggacatgg

SEQ ID NO: 169399 - DNA, 20 bp, human
gcagctagagggctctgcta

SEQ ID NO: 169400 - DNA, 20 bp, human
gggacgcaggtagcgggaca

SEQ ID NO: 169401 - DNA, 20 bp, human
ggcggcggcgtgtctcggcc

SEQ ID NO: 169402 - DNA, 20 bp, human
gcgcggcccggcgaaggcag

SEQ ID NO: 169403 - DNA, 20 bp, human
gtcgggtcgcggaaaggccg

SEQ ID NO: 169404 - DNA, 20 bp, human
gtgaacttcaaatcaatggg

SEQ ID NO: 169405 - DNA, 20 bp, human
ggaagtctcgcgagaagagt

SEQ ID NO: 169406 - DNA, 20 bp, human
gcaggacgctaggccggcac

SEQ ID NO: 169407 - DNA, 20 bp, human
gccggcaccggcaacggaaa

SEQ ID NO: 169408 - DNA, 20 bp, human
gtaattccaggacgctaggc

SEQ ID NO: 169409 - DNA, 20 bp, human
gccacgttcagactaggaga

SEQ ID NO: 169410 - DNA, 20 bp, human
gagtttagggagacaagtag

SEQ ID NO: 169411 - DNA, 20 bp, human
gtaatgtgaaatggaaggac

SEQ ID NO: 169412 - DNA, 20 bp, human
gtatatagcttacccagcaa

SEQ ID NO: 169413 - DNA, 20 bp, human
ggtcgtcagcaccagcgcct

SEQ ID NO: 169414 - DNA, 20 bp, human
gcgtttaacgggcttaagag

SEQ ID NO: 169415 - DNA, 20 bp, human
gatagcttacccagcaaagg

SEQ ID NO: 169416 - DNA, 20 bp, human
gcccggggaagcagcgacag

SEQ ID NO: 169417 - DNA, 20 bp, human
gcggattgcgggagagagga

SEQ ID NO: 169418 - DNA, 20 bp, human
gcggcggggcggagaaacgg

SEQ ID NO: 169419 - DNA, 20 bp, human
ggaaccggattgcgggagag

SEQ ID NO: 169420 - DNA, 20 bp, human
gcggggcggagaaacggcgg

SEQ ID NO: 169421 - DNA, 20 bp, human
ggcgttagcaggaacagtga

SEQ ID NO: 169422 - DNA, 20 bp, human
gggcggcaccgaggtaatcc

SEQ ID NO: 169423 - DNA, 20 bp, human
gccgggccaggctgcttgag

SEQ ID NO: 169424 - DNA, 20 bp, human
gaagcagcgacaggggccta

SEQ ID NO: 169425 - DNA, 20 bp, human
gggaagaggaaccggattgc

SEQ ID NO: 169426 - DNA, 20 bp, human
ggccggcggagctcctgtgg

SEQ ID NO: 169427 - DNA, 20 bp, human
gactactccgcggcccaggg

SEQ ID NO: 169428 - DNA, 20 bp, human
gggagacggagcgagtccag

SEQ ID NO: 169429 - DNA, 20 bp, human
gcaggctgcgccacttgggg

SEQ ID NO: 169430 - DNA, 20 bp, human
ggggccgcggagtagtccga

SEQ ID NO: 169431 - DNA, 20 bp, human
ggagccctcggactactccg

SEQ ID NO: 169432 - DNA, 20 bp, human
gcggctgcggtgctgaaccg

SEQ ID NO: 169433 - DNA, 20 bp, human
gctaccgctgctaccaccac

SEQ ID NO: 169434 - DNA, 20 bp, human
gtgaaagctggccgggaggg

SEQ ID NO: 169435 - DNA, 20 bp, human
gcggcgggccgtgggacacg

SEQ ID NO: 169436 - DNA, 20 bp, human
gcggaaggcaactgcctgag

SEQ ID NO: 169437 - DNA, 20 bp, human
ggccgcagaacagcacggac

SEQ ID NO: 169438 - DNA, 20 bp, human
ggcccgtccgtgctgttctg

SEQ ID NO: 169439 - DNA, 20 bp, human
ggcgcacctgagtaacaact

SEQ ID NO: 169440 - DNA, 20 bp, human
gactcaggtgcgctagcctg

SEQ ID NO: 169441 - DNA, 20 bp, human
gcacctgagtaacaactggg

SEQ ID NO: 169442 - DNA, 20 bp, human
gccttccgcgtggggacact

SEQ ID NO: 169443 - DNA, 20 bp, human
gcagcgtgtcgggcgaggtg

SEQ ID NO: 169444 - DNA, 20 bp, human
gcagcacggacgggctccgc

SEQ ID NO: 169445 - DNA, 20 bp, human
gcgcgacgctgaggacgcta

SEQ ID NO: 169446 - DNA, 20 bp, human
ggggctcccggcccatcgga

SEQ ID NO: 169447 - DNA, 20 bp, human
ggccgggtgagtgagagagt

SEQ ID NO: 169448 - DNA, 20 bp, human
gggtgagtgagagagttggt

SEQ ID NO: 169449 - DNA, 20 bp, human
gtaatatgaactgaaaggtc

SEQ ID NO: 169450 - DNA, 20 bp, human
gagcttcccaattaaatgag

SEQ ID NO: 169451 - DNA, 20 bp, human
gcgagttgtattccaggtca

SEQ ID NO: 169452 - DNA, 20 bp, human
ggaactgaaaggtccggtct

SEQ ID NO: 169453 - DNA, 20 bp, human
ggactaggaaaccctccgat

SEQ ID NO: 169454 - DNA, 20 bp, human
gtgtgacgttcagcacgggg

SEQ ID NO: 169455 - DNA, 20 bp, human
ggaaagtaaggtgactacgg

SEQ ID NO: 169456 - DNA, 20 bp, human
ggggcaaagcgagagcacgg

SEQ ID NO: 169457 - DNA, 20 bp, human
ggcaggcgcagtgggaaccg

SEQ ID NO: 169458 - DNA, 20 bp, human
gcgaggcgccgccactatgg

SEQ ID NO: 169459 - DNA, 20 bp, human
gccaggctccgccatagtgg

SEQ ID NO: 169460 - DNA, 20 bp, human
gtggccaggctccgccatag

SEQ ID NO: 169461 - DNA, 20 bp, human
ggcccgccgccgcctaaggg

SEQ ID NO: 169462 - DNA, 20 bp, human
ggagaaggaaagcccgagtg

SEQ ID NO: 169463 - DNA, 20 bp, human
gccccgaggcgccgccacta

SEQ ID NO: 169464 - DNA, 20 bp, human
ggacggacgcagccgaaccc

SEQ ID NO: 169465 - DNA, 20 bp, human
gcccagccccccttaggcgg

SEQ ID NO: 169466 - DNA, 20 bp, human
gtaagtcctggtctgcgtgg

SEQ ID NO: 169467 - DNA, 20 bp, human
gatggcggcggtggaatcaa

SEQ ID NO: 169468 - DNA, 20 bp, human
ggcgtagacgagttaagtcc

SEQ ID NO: 169469 - DNA, 20 bp, human
gaagtgcgtcagttgtggag

SEQ ID NO: 169470 - DNA, 20 bp, human
gcctggacacgtagaatagt

SEQ ID NO: 169471 - DNA, 20 bp, human
gtggcgctccacaaaatgga

SEQ ID NO: 169472 - DNA, 20 bp, human
gacaggtccgtagtctgcga

SEQ ID NO: 169473 - DNA, 20 bp, human
gagcaaagtcagggagatcc

SEQ ID NO: 169474 - DNA, 20 bp, human
ggctctggcgctccacaaaa

SEQ ID NO: 169475 - DNA, 20 bp, human
gccagcaacccccttctcgg

SEQ ID NO: 169476 - DNA, 20 bp, human
gctcgcaccgcccctaggta

SEQ ID NO: 169477 - DNA, 20 bp, human
ggagggccggacaaccgcgg

SEQ ID NO: 169478 - DNA, 20 bp, human
gcggccgcccctgtggtgtg

SEQ ID NO: 169479 - DNA, 20 bp, human
gacgaagccgtacctagggg

SEQ ID NO: 169480 - DNA, 20 bp, human
gtccacgaagccgtacctag

SEQ ID NO: 169481 - DNA, 20 bp, human
ggcgcgcgcgcgccattgtg

SEQ ID NO: 169482 - DNA, 20 bp, human
gctggctaacgactcccccg

SEQ ID NO: 169483 - DNA, 20 bp, human
gtggcggcgggaactctcca

SEQ ID NO: 169484 - DNA, 20 bp, human
gaacacgcgcctcacaccac

SEQ ID NO: 169485 - DNA, 20 bp, human
gagggcctcaaagatggcga

SEQ ID NO: 169486 - DNA, 20 bp, human
ggtatttcagcaggatctgc

SEQ ID NO: 169487 - DNA, 20 bp, human
ggtaatggaacttttttcaa

SEQ ID NO: 169488 - DNA, 20 bp, human
gagaaatagctcctaatact

SEQ ID NO: 169489 - DNA, 20 bp, human
gaattaatacttttaagtaa

SEQ ID NO: 169490 - DNA, 20 bp, human
gttttttttagtatttcagc

SEQ ID NO: 169491 - DNA, 20 bp, human
gagcaataaattactcagtt

SEQ ID NO: 169492 - DNA, 20 bp, human
gttcagcaggatctgctggc

SEQ ID NO: 169493 - DNA, 20 bp, human
ggaatacttaaggctttaga

SEQ ID NO: 169494 - DNA, 20 bp, human
gaaggggcagataaagactt

SEQ ID NO: 169495 - DNA, 20 bp, human
gtttgagctttgaatactta

SEQ ID NO: 169496 - DNA, 20 bp, human
gcgggactcttggcgggtga

SEQ ID NO: 169497 - DNA, 20 bp, human
gtgccgccgggactcttggc

SEQ ID NO: 169498 - DNA, 20 bp, human
ggtagtgccgccgggactct

SEQ ID NO: 169499 - DNA, 20 bp, human
gctttagcaagcagcgccca

SEQ ID NO: 169500 - DNA, 20 bp, human
ggcacgccagacgaagccgg

SEQ ID NO: 169501 - DNA, 20 bp, human
gcgcacattgaggaccgtgg

SEQ ID NO: 169502 - DNA, 20 bp, human
gtggcagccgccgccgaggg

SEQ ID NO: 169503 - DNA, 20 bp, human
gaaatggcagccgccgccga

SEQ ID NO: 169504 - DNA, 20 bp, human
gttgcgcacattgaggaccg

SEQ ID NO: 169505 - DNA, 20 bp, human
gctgaggaaatgcgccacca

SEQ ID NO: 169506 - DNA, 20 bp, human
gcagaggcggcggctacgga

SEQ ID NO: 169507 - DNA, 20 bp, human
ggcggcaggtccagaggcgg

SEQ ID NO: 169508 - DNA, 20 bp, human
ggcagagcgagagctagtgg

SEQ ID NO: 169509 - DNA, 20 bp, human
gcgaccggctgtaaggagat

SEQ ID NO: 169510 - DNA, 20 bp, human
ggatgcagagcgagagctag

SEQ ID NO: 169511 - DNA, 20 bp, human
ggcagccgatctcgctatag

SEQ ID NO: 169512 - DNA, 20 bp, human
ggctacagggaatctcgcta

SEQ ID NO: 169513 - DNA, 20 bp, human
gacctgccccgcagccgcca

SEQ ID NO: 169514 - DNA, 20 bp, human
gcccagacttcgagtgagac

SEQ ID NO: 169515 - DNA, 20 bp, human
ggacggcggagccgcagcta

SEQ ID NO: 169516 - DNA, 20 bp, human
gaacgcggagcggaagcgaa

SEQ ID NO: 169517 - DNA, 20 bp, human
gaggggtcggcggaggcaaa

SEQ ID NO: 169518 - DNA, 20 bp, human
gccctcacgggtggaggatg

SEQ ID NO: 169519 - DNA, 20 bp, human
gcctcacggcgccccctcac

SEQ ID NO: 169520 - DNA, 20 bp, human
ggcggaagcgaaggggtcgg

SEQ ID NO: 169521 - DNA, 20 bp, human
ggaggcggcggcggcgacgt

SEQ ID NO: 169522 - DNA, 20 bp, human
gcacggcgccccctcacggg

SEQ ID NO: 169523 - DNA, 20 bp, human
gctcaggcaccgaggaggag

SEQ ID NO: 169524 - DNA, 20 bp, human
ggacgtgcgcgagaaggact

SEQ ID NO: 169525 - DNA, 20 bp, human
gccgtgaggggtctgcgcgg

SEQ ID NO: 169526 - DNA, 20 bp, human
gtgcgtgcaggaggaacgct

SEQ ID NO: 169527 - DNA, 20 bp, human
gcttgagcaaggagggaatt

SEQ ID NO: 169528 - DNA, 20 bp, human
gcgcggcggcggcgacgatg

SEQ ID NO: 169529 - DNA, 20 bp, human
ggctcaggctctccaccggg

SEQ ID NO: 169530 - DNA, 20 bp, human
gttcctcacttgagcaagga

SEQ ID NO: 169531 - DNA, 20 bp, human
ggagccccgcgcgagtctgg

SEQ ID NO: 169532 - DNA, 20 bp, human
ggggagtccagccaaccgga

SEQ ID NO: 169533 - DNA, 20 bp, human
ggccggatgagcacgctcag

SEQ ID NO: 169534 - DNA, 20 bp, human
gagcctcgtggacacgatcc

SEQ ID NO: 169535 - DNA, 20 bp, human
gccgaagccctccctccggt

SEQ ID NO: 169536 - DNA, 20 bp, human
gagagtgcgacaaaattgaa

SEQ ID NO: 169537 - DNA, 20 bp, human
gcaagcagctgggataccag

SEQ ID NO: 169538 - DNA, 20 bp, human
gaaatggccattcttccagg

SEQ ID NO: 169539 - DNA, 20 bp, human
ggattgcattgtcaaaaaca

SEQ ID NO: 169540 - DNA, 20 bp, human
gcgtgtggtctcgcgatcag

SEQ ID NO: 169541 - DNA, 20 bp, human
ggcatcttcgccttccgacg

SEQ ID NO: 169542 - DNA, 20 bp, human
ggttaacgtaacaaagaatc

SEQ ID NO: 169543 - DNA, 20 bp, human
gatctggtagaagtgagttt

SEQ ID NO: 169544 - DNA, 20 bp, human
gttataagtatcgacctcgt

SEQ ID NO: 169545 - DNA, 20 bp, human
gaacagtaaaggcaacgtcc

SEQ ID NO: 169546 - DNA, 20 bp, human
ggacttgccgatagtggtga

SEQ ID NO: 169547 - DNA, 20 bp, human
ggctcgggacttgccgatag

SEQ ID NO: 169548 - DNA, 20 bp, human
gggcgacgccaaagtaactc

SEQ ID NO: 169549 - DNA, 20 bp, human
gcgggtgaacggcaaactgg

SEQ ID NO: 169550 - DNA, 20 bp, human
gttgccgatagtggtgacgg

SEQ ID NO: 169551 - DNA, 20 bp, human
ggacggcggcaacatgtctg

SEQ ID NO: 169552 - DNA, 20 bp, human
gggaagggcgtgtgtcggac

SEQ ID NO: 169553 - DNA, 20 bp, human
gggcaagtcccgagcgctcc

SEQ ID NO: 169554 - DNA, 20 bp, human
gacacacgcccttccctgag

SEQ ID NO: 169555 - DNA, 20 bp, human
gagggcgtgtgtcggaccgg

SEQ ID NO: 169556 - DNA, 20 bp, human
gcagcccgtggtcatcgagg

SEQ ID NO: 169557 - DNA, 20 bp, human
gtatccacctcgatgaccac

SEQ ID NO: 169558 - DNA, 20 bp, human
ggtcatcgaggtggatactc

SEQ ID NO: 169559 - DNA, 20 bp, human
ggacgcgaaggccacggaca

SEQ ID NO: 169560 - DNA, 20 bp, human
gcgggcagacgcgaaggcca

SEQ ID NO: 169561 - DNA, 20 bp, human
gcttggccgggcagacgcga

SEQ ID NO: 169562 - DNA, 20 bp, human
gcggccaagaggcaaagggg

SEQ ID NO: 169563 - DNA, 20 bp, human
ggcgctgtcccccgagtccg

SEQ ID NO: 169564 - DNA, 20 bp, human
gcggccgcgagccccgacgg

SEQ ID NO: 169565 - DNA, 20 bp, human
gtggggcgcgcgggtccctc

SEQ ID NO: 169566 - DNA, 20 bp, human
gttggcggtcgtggttccgg

SEQ ID NO: 169567 - DNA, 20 bp, human
ggagagaagtcgggatcccg

SEQ ID NO: 169568 - DNA, 20 bp, human
gggtggccttcgtaccggac

SEQ ID NO: 169569 - DNA, 20 bp, human
gcgacatcccgaggaacctc

SEQ ID NO: 169570 - DNA, 20 bp, human
ggaaggccaccgacatcccg

SEQ ID NO: 169571 - DNA, 20 bp, human
gatgtcggtggccttcgtac

SEQ ID NO: 169572 - DNA, 20 bp, human
gcgtaggccccacctatcgt

SEQ ID NO: 169573 - DNA, 20 bp, human
gcctcccagctgactgtgaa

SEQ ID NO: 169574 - DNA, 20 bp, human
gcgtggttccggaggttcct

SEQ ID NO: 169575 - DNA, 20 bp, human
gcgtgggtcgagttgcttgg

SEQ ID NO: 169576 - DNA, 20 bp, human
gcggtgagactagaaggcgg

SEQ ID NO: 169577 - DNA, 20 bp, human
gcttcggtgagactagaagg

SEQ ID NO: 169578 - DNA, 20 bp, human
gtccgcggttgcttagagac

SEQ ID NO: 169579 - DNA, 20 bp, human
gcagctcttgcggcctgggt

SEQ ID NO: 169580 - DNA, 20 bp, human
gagccttcggtgagactaga

SEQ ID NO: 169581 - DNA, 20 bp, human
gtaggctccacagaaccctc

SEQ ID NO: 169582 - DNA, 20 bp, human
gtggtgcccaggcagttccg

SEQ ID NO: 169583 - DNA, 20 bp, human
gaagaagatggggaccgtcc

SEQ ID NO: 169584 - DNA, 20 bp, human
gcccacagaagccgcgccac

SEQ ID NO: 169585 - DNA, 20 bp, human
gctcggcctgaacgtgagga

SEQ ID NO: 169586 - DNA, 20 bp, human
gctgctcgggttagatcgtc

SEQ ID NO: 169587 - DNA, 20 bp, human
gggacaccctttaccgaaga

SEQ ID NO: 169588 - DNA, 20 bp, human
ggggttagatcgtcaggtga

SEQ ID NO: 169589 - DNA, 20 bp, human
ggctagccagccacaccata

SEQ ID NO: 169590 - DNA, 20 bp, human
gccagccacaccatagggag

SEQ ID NO: 169591 - DNA, 20 bp, human
ggccagcgcgaaggaagtgc

SEQ ID NO: 169592 - DNA, 20 bp, human
ggaagggatagccagcgcga

SEQ ID NO: 169593 - DNA, 20 bp, human
gccggaagtgatcccctgcg

SEQ ID NO: 169594 - DNA, 20 bp, human
ggtggcgccatcttcggtaa

SEQ ID NO: 169595 - DNA, 20 bp, human
gggatcacttccggcgcaca

SEQ ID NO: 169596 - DNA, 20 bp, human
ggcctggctgtcggacggga

SEQ ID NO: 169597 - DNA, 20 bp, human
ggtcagtctcgcgcgttgcc

SEQ ID NO: 169598 - DNA, 20 bp, human
ggcacaagcatgtacggcaa

SEQ ID NO: 169599 - DNA, 20 bp, human
gaggcgcgcagtgggaatgt

SEQ ID NO: 169600 - DNA, 20 bp, human
ggcaccacacgcccccatcg

SEQ ID NO: 169601 - DNA, 20 bp, human
gccgggcctggctgtcggac

SEQ ID NO: 169602 - DNA, 20 bp, human
ggttgacaggtgcgtgacag

SEQ ID NO: 169603 - DNA, 20 bp, human
ggattgagggaaataacccg

SEQ ID NO: 169604 - DNA, 20 bp, human
gagggaccgggtgtgttgag

SEQ ID NO: 169605 - DNA, 20 bp, human
gtgcgcgcgtgtgaaggcgg

SEQ ID NO: 169606 - DNA, 20 bp, human
gtgagctccaagtagaccag

SEQ ID NO: 169607 - DNA, 20 bp, human
ggctccaagtagaccagcgg

SEQ ID NO: 169608 - DNA, 20 bp, human
gtcgcccgggtagccacgtt

SEQ ID NO: 169609 - DNA, 20 bp, human
gccgccgccgctggtctact

SEQ ID NO: 169610 - DNA, 20 bp, human
gggccgccacttgcaaaata

SEQ ID NO: 169611 - DNA, 20 bp, human
gcttggagctcaaccgaacg

SEQ ID NO: 169612 - DNA, 20 bp, human
gcaaccgaacgtggctaccc

SEQ ID NO: 169613 - DNA, 20 bp, human
ggagcgcggagccagcgcct

SEQ ID NO: 169614 - DNA, 20 bp, human
gggcaacgtcccgcgatgga

SEQ ID NO: 169615 - DNA, 20 bp, human
gagccctattttgcaagtgg

SEQ ID NO: 169616 - DNA, 20 bp, human
gacagcccgcgcggaggaaa

SEQ ID NO: 169617 - DNA, 20 bp, human
ggagctccagacggccgcgg

SEQ ID NO: 169618 - DNA, 20 bp, human
gcccggaacagcccgcgcgg

SEQ ID NO: 169619 - DNA, 20 bp, human
gggcaccgcgcggggcacgt

SEQ ID NO: 169620 - DNA, 20 bp, human
ggcagcatgtacgccaaggg

SEQ ID NO: 169621 - DNA, 20 bp, human
gccaatctcgtgcccctcgg

SEQ ID NO: 169622 - DNA, 20 bp, human
gcaactccggcgacccctca

SEQ ID NO: 169623 - DNA, 20 bp, human
gccgcccgcgccggagccca

SEQ ID NO: 169624 - DNA, 20 bp, human
gggggagctccagacggccg

SEQ ID NO: 169625 - DNA, 20 bp, human
gggcgtccgcgctcttccgt

SEQ ID NO: 169626 - DNA, 20 bp, human
gggacaagctaaggggtcag

SEQ ID NO: 169627 - DNA, 20 bp, human
gaggcaggccaagaccctca

SEQ ID NO: 169628 - DNA, 20 bp, human
gatcctcagaagggatgtca

SEQ ID NO: 169629 - DNA, 20 bp, human
gctggagaaagggccacccc

SEQ ID NO: 169630 - DNA, 20 bp, human
ggagatcccccgcagggtca

SEQ ID NO: 169631 - DNA, 20 bp, human
ggccctggctgcaaccatga

SEQ ID NO: 169632 - DNA, 20 bp, human
gtgaaaggggaaggagagcg

SEQ ID NO: 169633 - DNA, 20 bp, human
gcctaaactggacaagctaa

SEQ ID NO: 169634 - DNA, 20 bp, human
gtaggccccccgagtcccca

SEQ ID NO: 169635 - DNA, 20 bp, human
gaatggatcactcaccaagg

SEQ ID NO: 169636 - DNA, 20 bp, human
gggccgggcgctgacagcaa

SEQ ID NO: 169637 - DNA, 20 bp, human
ggaggctctcccagaactcg

SEQ ID NO: 169638 - DNA, 20 bp, human
ggaccctgcgcgagacaagg

SEQ ID NO: 169639 - DNA, 20 bp, human
gggagagcctcgggcacggt

SEQ ID NO: 169640 - DNA, 20 bp, human
gaactcgtggcaggcgccca

SEQ ID NO: 169641 - DNA, 20 bp, human
gccggaccctgcgcgagaca

SEQ ID NO: 169642 - DNA, 20 bp, human
gcgggcgctgacagcaaggg

SEQ ID NO: 169643 - DNA, 20 bp, human
gtcgggcacggtaggccgag

SEQ ID NO: 169644 - DNA, 20 bp, human
gggagagtctcgtgcgccct

SEQ ID NO: 169645 - DNA, 20 bp, human
gggcgcctgccacgagttct

SEQ ID NO: 169646 - DNA, 20 bp, human
gatcctgcagacactcccag

SEQ ID NO: 169647 - DNA, 20 bp, human
ggcggtgtgacccctatcgg

SEQ ID NO: 169648 - DNA, 20 bp, human
gctctagctcgagacgtctg

SEQ ID NO: 169649 - DNA, 20 bp, human
gtggctgcggcgcggtgcga

SEQ ID NO: 169650 - DNA, 20 bp, human
gtatgcagtgcgacccctct

SEQ ID NO: 169651 - DNA, 20 bp, human
gccgccgtaggaacagagcc

SEQ ID NO: 169652 - DNA, 20 bp, human
gcaaagtcgccccccgatag

SEQ ID NO: 169653 - DNA, 20 bp, human
gcgcacagctccccaagaca

SEQ ID NO: 169654 - DNA, 20 bp, human
gtgtgcggtgtgacccctat

SEQ ID NO: 169655 - DNA, 20 bp, human
gtcgcacggtcaccccggtc

SEQ ID NO: 169656 - DNA, 20 bp, human
ggccgactgacgctccgaac

SEQ ID NO: 169657 - DNA, 20 bp, human
ggcccgttcggagcgtcagt

SEQ ID NO: 169658 - DNA, 20 bp, human
gtcggcgacagtctggtggt

SEQ ID NO: 169659 - DNA, 20 bp, human
ggcgtcagtcggcgacagtc

SEQ ID NO: 169660 - DNA, 20 bp, human
gtcagtcggcgacagtctgg

SEQ ID NO: 169661 - DNA, 20 bp, human
gtcgcggcagccgagtgcca

SEQ ID NO: 169662 - DNA, 20 bp, human
gcctgtggcatgcctcccta

SEQ ID NO: 169663 - DNA, 20 bp, human
gcgcgccgcttcccaggcct

SEQ ID NO: 169664 - DNA, 20 bp, human
ggctaggtgctcagggtgat

SEQ ID NO: 169665 - DNA, 20 bp, human
gcgcccgcccgccgcccgtt

SEQ ID NO: 169666 - DNA, 20 bp, human
ggccccttccctcaaccccg

SEQ ID NO: 169667 - DNA, 20 bp, human
gagccaggccgcgagcacct

SEQ ID NO: 169668 - DNA, 20 bp, human
ggccggggcagcaactgcgt

SEQ ID NO: 169669 - DNA, 20 bp, human
gaaggccaggtcggctgggt

SEQ ID NO: 169670 - DNA, 20 bp, human
gcagtccacgccccaccggg

SEQ ID NO: 169671 - DNA, 20 bp, human
gtcaaccccgcggacagtcc

SEQ ID NO: 169672 - DNA, 20 bp, human
gactggggtgggaagacgat

SEQ ID NO: 169673 - DNA, 20 bp, human
gttaagggccgcccccgagg

SEQ ID NO: 169674 - DNA, 20 bp, human
gaggacgcgctcccaagccg

SEQ ID NO: 169675 - DNA, 20 bp, human
ggcccaaggccaggtcggct

SEQ ID NO: 169676 - DNA, 20 bp, human
gtctgagcaaggagtcatca

SEQ ID NO: 169677 - DNA, 20 bp, human
gggatctacctcccaaaata

SEQ ID NO: 169678 - DNA, 20 bp, human
ggagagagatatattgggaa

SEQ ID NO: 169679 - DNA, 20 bp, human
gcaaagcaggaagctcccta

SEQ ID NO: 169680 - DNA, 20 bp, human
gtaaagggataaagatgact

SEQ ID NO: 169681 - DNA, 20 bp, human
ggtcctgatgttcttctcta

SEQ ID NO: 169682 - DNA, 20 bp, human
gtctggagaatccaggaata

SEQ ID NO: 169683 - DNA, 20 bp, human
gcttctctagggcttctgtc

SEQ ID NO: 169684 - DNA, 20 bp, human
gatcttattctggagaatcc

SEQ ID NO: 169685 - DNA, 20 bp, human
gcacaatttacaggtattgg

SEQ ID NO: 169686 - DNA, 20 bp, human
gtgccggcagatccaggagg

SEQ ID NO: 169687 - DNA, 20 bp, human
gagaggagctgtgccagaag

SEQ ID NO: 169688 - DNA, 20 bp, human
gcgcagcgaggcgggtccag

SEQ ID NO: 169689 - DNA, 20 bp, human
ggagctgtgccagaagcggg

SEQ ID NO: 169690 - DNA, 20 bp, human
gctgtgccggcagatccagg

SEQ ID NO: 169691 - DNA, 20 bp, human
gtatgcctgggggccgggag

SEQ ID NO: 169692 - DNA, 20 bp, human
ggacagcgctgcttccgcgg

SEQ ID NO: 169693 - DNA, 20 bp, human
gaccatgacccagcagggcg

SEQ ID NO: 169694 - DNA, 20 bp, human
ggcttccgcggcggttgggg

SEQ ID NO: 169695 - DNA, 20 bp, human
ggccgcgccctgctgggtca

SEQ ID NO: 169696 - DNA, 20 bp, human
gacgacatggagccgaagaa

SEQ ID NO: 169697 - DNA, 20 bp, human
ggcagccacgcggccagcag

SEQ ID NO: 169698 - DNA, 20 bp, human
gcctggtattcgaattatgg

SEQ ID NO: 169699 - DNA, 20 bp, human
ggcatcgccgtgaccgtggt

SEQ ID NO: 169700 - DNA, 20 bp, human
ggagccgaagaagggcacgg

SEQ ID NO: 169701 - DNA, 20 bp, human
gggcgagcagcagcgggaac

SEQ ID NO: 169702 - DNA, 20 bp, human
gagctcctccctgctagtca

SEQ ID NO: 169703 - DNA, 20 bp, human
ggaagagtgaacccggggaa

SEQ ID NO: 169704 - DNA, 20 bp, human
gtccatgtcgtcgggcccag

SEQ ID NO: 169705 - DNA, 20 bp, human
gagccgtgcgccgcgctcca

SEQ ID NO: 169706 - DNA, 20 bp, human
gccccgagggaagagatggt

SEQ ID NO: 169707 - DNA, 20 bp, human
gtccacctccacaggagaca

SEQ ID NO: 169708 - DNA, 20 bp, human
gcctacaaggagggccccga

SEQ ID NO: 169709 - DNA, 20 bp, human
gaaacatgggggcacagaca

SEQ ID NO: 169710 - DNA, 20 bp, human
gggccttggccatcaggcag

SEQ ID NO: 169711 - DNA, 20 bp, human
ggacgccctctcaccctaca

SEQ ID NO: 169712 - DNA, 20 bp, human
gtcctccacctggacaccca

SEQ ID NO: 169713 - DNA, 20 bp, human
gaaggaactgagcaaaacat

SEQ ID NO: 169714 - DNA, 20 bp, human
gccctccttgtagggtgaga

SEQ ID NO: 169715 - DNA, 20 bp, human
ggccctctcaccctacaagg

SEQ ID NO: 169716 - DNA, 20 bp, human
gttccgtcggctaaggctct

SEQ ID NO: 169717 - DNA, 20 bp, human
ggtggccgctccgggtcctg

SEQ ID NO: 169718 - DNA, 20 bp, human
gcgtcggctaaggctctcgg

SEQ ID NO: 169719 - DNA, 20 bp, human
gcggaaactggacactggac

SEQ ID NO: 169720 - DNA, 20 bp, human
gccgcctcggaacaagacag

SEQ ID NO: 169721 - DNA, 20 bp, human
ggccgacggaaactggacac

SEQ ID NO: 169722 - DNA, 20 bp, human
gaagcgggggaggagtctca

SEQ ID NO: 169723 - DNA, 20 bp, human
gtcggcggctccggcggtaa

SEQ ID NO: 169724 - DNA, 20 bp, human
gaggagcggccagaactgga

SEQ ID NO: 169725 - DNA, 20 bp, human
gccacgaagcaaggtcgccc

SEQ ID NO: 169726 - DNA, 20 bp, human
gtggctccggaaaggcgttt

SEQ ID NO: 169727 - DNA, 20 bp, human
gatgccaacggtaagtccgg

SEQ ID NO: 169728 - DNA, 20 bp, human
gaagcctccggacttaccgt

SEQ ID NO: 169729 - DNA, 20 bp, human
gtagggcgtccgaacgggag

SEQ ID NO: 169730 - DNA, 20 bp, human
gcgcccgtgggaccaagaaa

SEQ ID NO: 169731 - DNA, 20 bp, human
ggggatgccaacggtaagtc

SEQ ID NO: 169732 - DNA, 20 bp, human
gaggcttagggcgtccgaac

SEQ ID NO: 169733 - DNA, 20 bp, human
ggctgcagggtgaagatggt

SEQ ID NO: 169734 - DNA, 20 bp, human
ggaagccccgggatgcccac

SEQ ID NO: 169735 - DNA, 20 bp, human
gtccgagatcggccgaaatc

SEQ ID NO: 169736 - DNA, 20 bp, human
gaacgtagagccggccgcca

SEQ ID NO: 169737 - DNA, 20 bp, human
ggccgccggctagtcgggct

SEQ ID NO: 169738 - DNA, 20 bp, human
ggctccgccatggctcctaa

SEQ ID NO: 169739 - DNA, 20 bp, human
gggagctgcaggcgagaaca

SEQ ID NO: 169740 - DNA, 20 bp, human
gctgcctttaggagccatgg

SEQ ID NO: 169741 - DNA, 20 bp, human
gtccaaacagcagtctgagg

SEQ ID NO: 169742 - DNA, 20 bp, human
gtcctgtgcagcactcgggg

SEQ ID NO: 169743 - DNA, 20 bp, human
gggacttggccgagagattg

SEQ ID NO: 169744 - DNA, 20 bp, human
gagttaaccaccttctcctg

SEQ ID NO: 169745 - DNA, 20 bp, human
gaggtggttaactagttctg

SEQ ID NO: 169746 - DNA, 20 bp, human
gagcgacgcgtaagtggcag

SEQ ID NO: 169747 - DNA, 20 bp, human
ggagctcccatgaacacgag

SEQ ID NO: 169748 - DNA, 20 bp, human
ggcgatcgcggccaaaaacg

SEQ ID NO: 169749 - DNA, 20 bp, human
gtggcggcgatggcatctct

SEQ ID NO: 169750 - DNA, 20 bp, human
gtcgcctcttctctgcctag

SEQ ID NO: 169751 - DNA, 20 bp, human
gagggacctcagtgaggaga

SEQ ID NO: 169752 - DNA, 20 bp, human
gaaggccgcctgcctctcgg

SEQ ID NO: 169753 - DNA, 20 bp, human
ggagccacataagctaggaa

SEQ ID NO: 169754 - DNA, 20 bp, human
ggagcggggcgagttagatg

SEQ ID NO: 169755 - DNA, 20 bp, human
gtgaacacgaggggcaaacg

SEQ ID NO: 169756 - DNA, 20 bp, human
ggcctgtgtacggcttccgg

SEQ ID NO: 169757 - DNA, 20 bp, human
gcacgcgggaaaagcttccc

SEQ ID NO: 169758 - DNA, 20 bp, human
gaacgagcagcggaacccca

SEQ ID NO: 169759 - DNA, 20 bp, human
gcctctctgtggcctgtgta

SEQ ID NO: 169760 - DNA, 20 bp, human
ggcgtcgggttgggtgtcag

SEQ ID NO: 169761 - DNA, 20 bp, human
ggccatggctcccgccggag

SEQ ID NO: 169762 - DNA, 20 bp, human
gtccatgtcgagggtcccgt

SEQ ID NO: 169763 - DNA, 20 bp, human
ggccaccggaagccgtacac

SEQ ID NO: 169764 - DNA, 20 bp, human
gtgcccgagggtccaggtcc

SEQ ID NO: 169765 - DNA, 20 bp, human
ggccagagcgggcgtcgggt

SEQ ID NO: 169766 - DNA, 20 bp, human
gacggagctggtgaggacct

SEQ ID NO: 169767 - DNA, 20 bp, human
ggtgagcccggcggtgacaa

SEQ ID NO: 169768 - DNA, 20 bp, human
gacggcaacatggccctgaa

SEQ ID NO: 169769 - DNA, 20 bp, human
gtagaggcccgagaacagta

SEQ ID NO: 169770 - DNA, 20 bp, human
gtgtggctgtgaggtacggg

SEQ ID NO: 169771 - DNA, 20 bp, human
gcttggaggaggatcgtcta

SEQ ID NO: 169772 - DNA, 20 bp, human
gtacgggaggcagcccactc

SEQ ID NO: 169773 - DNA, 20 bp, human
gcgagaacagtagggctgag

SEQ ID NO: 169774 - DNA, 20 bp, human
ggccctgaacggagctggtg

SEQ ID NO: 169775 - DNA, 20 bp, human
gatcgcatctcccggctcat

SEQ ID NO: 169776 - DNA, 20 bp, human
gccgctttaggagcgaggtt

SEQ ID NO: 169777 - DNA, 20 bp, human
gaagtccctggctgctgccg

SEQ ID NO: 169778 - DNA, 20 bp, human
ggagtggctggtcaaactct

SEQ ID NO: 169779 - DNA, 20 bp, human
gagaatccgggagacgtcga

SEQ ID NO: 169780 - DNA, 20 bp, human
ggatcagcaggcagcagcga

SEQ ID NO: 169781 - DNA, 20 bp, human
ggaccgactgcgcttatcat

SEQ ID NO: 169782 - DNA, 20 bp, human
gagccagcgcgcactggagg

SEQ ID NO: 169783 - DNA, 20 bp, human
ggcgcagtcggtcacagttc

SEQ ID NO: 169784 - DNA, 20 bp, human
gtgccgcggggaagcaggta

SEQ ID NO: 169785 - DNA, 20 bp, human
gggcgccgcgaaagccgagc

SEQ ID NO: 169786 - DNA, 20 bp, human
gggcacaggcgaccgtggag

SEQ ID NO: 169787 - DNA, 20 bp, human
ggcccgggcacaggcgaccg

SEQ ID NO: 169788 - DNA, 20 bp, human
gccagagccgcgccagttaa

SEQ ID NO: 169789 - DNA, 20 bp, human
gggaccttgagcgagggcca

SEQ ID NO: 169790 - DNA, 20 bp, human
ggcacggcacagccattaac

SEQ ID NO: 169791 - DNA, 20 bp, human
gcagctgggatgttccccaa

SEQ ID NO: 169792 - DNA, 20 bp, human
gcgcctgtgcccgggcaccc

SEQ ID NO: 169793 - DNA, 20 bp, human
gtgcaggcaagcggtcgggt

SEQ ID NO: 169794 - DNA, 20 bp, human
gggcgaaatgcgtcccagaa

SEQ ID NO: 169795 - DNA, 20 bp, human
gagaacgggaccttgagcga

SEQ ID NO: 169796 - DNA, 20 bp, human
gctggctgggccagtcccag

SEQ ID NO: 169797 - DNA, 20 bp, human
gtaagctcaggcactcggat

SEQ ID NO: 169798 - DNA, 20 bp, human
gcggcgccaagcctcagact

SEQ ID NO: 169799 - DNA, 20 bp, human
gcgcaccgggacctaagctc

SEQ ID NO: 169800 - DNA, 20 bp, human
gagagcggagaatcacgcac

SEQ ID NO: 169801 - DNA, 20 bp, human
gagtgcctgagcttaggtcc

SEQ ID NO: 169802 - DNA, 20 bp, human
gaccccaaaaggcacaagag

SEQ ID NO: 169803 - DNA, 20 bp, human
gtagtaggaatgaacgacaa

SEQ ID NO: 169804 - DNA, 20 bp, human
ggggagcgagaagcgcactt

SEQ ID NO: 169805 - DNA, 20 bp, human
gtgtcggagaccggagctag

SEQ ID NO: 169806 - DNA, 20 bp, human
gcccagggcactcctaacta

SEQ ID NO: 169807 - DNA, 20 bp, human
gccgcaagcggtctagaagt

SEQ ID NO: 169808 - DNA, 20 bp, human
gtcagggccggagaccagat

SEQ ID NO: 169809 - DNA, 20 bp, human
gtgacagggagaagacgaga

SEQ ID NO: 169810 - DNA, 20 bp, human
gagaggagacacgggtgaga

SEQ ID NO: 169811 - DNA, 20 bp, human
ggccggagaccagatgggag

SEQ ID NO: 169812 - DNA, 20 bp, human
gcctaactagggtccccaca

SEQ ID NO: 169813 - DNA, 20 bp, human
ggggaacctgagcccgcaag

SEQ ID NO: 169814 - DNA, 20 bp, human
ggaggctctgtggacagccg

SEQ ID NO: 169815 - DNA, 20 bp, human
gtgatgagagatgcgtgaca

SEQ ID NO: 169816 - DNA, 20 bp, human
ggcccttcctcgcccccggg

SEQ ID NO: 169817 - DNA, 20 bp, human
ggagggggcgctcatgacca

SEQ ID NO: 169818 - DNA, 20 bp, human
gccggggggcagcgtcgagg

SEQ ID NO: 169819 - DNA, 20 bp, human
gcggccgacgaggccacgaa

SEQ ID NO: 169820 - DNA, 20 bp, human
gggcacagcacggagccgaa

SEQ ID NO: 169821 - DNA, 20 bp, human
gctgcgccagagagctcggg

SEQ ID NO: 169822 - DNA, 20 bp, human
ggcccgccgcccgagctctc

SEQ ID NO: 169823 - DNA, 20 bp, human
gaggatcacgaagatgacca

SEQ ID NO: 169824 - DNA, 20 bp, human
gcacggagccgaagggccag

SEQ ID NO: 169825 - DNA, 20 bp, human
gagcaccgcgcggcacagca

SEQ ID NO: 169826 - DNA, 20 bp, human
gggggccggcgccctcggca

SEQ ID NO: 169827 - DNA, 20 bp, human
gcagagcctgacgcacccca

SEQ ID NO: 169828 - DNA, 20 bp, human
ggtgcaccactgccaggtag

SEQ ID NO: 169829 - DNA, 20 bp, human
gctctgcaagagaagaaggg

SEQ ID NO: 169830 - DNA, 20 bp, human
gctgttgtcaccgcctccag

SEQ ID NO: 169831 - DNA, 20 bp, human
gcaggctctgcaagagaaga

SEQ ID NO: 169832 - DNA, 20 bp, human
gccagctgggcgtggaggct

SEQ ID NO: 169833 - DNA, 20 bp, human
gacaccagcaggtacagcac

SEQ ID NO: 169834 - DNA, 20 bp, human
ggaccaggcggcacaggacg

SEQ ID NO: 169835 - DNA, 20 bp, human
ggggaggaggcgttccagct

SEQ ID NO: 169836 - DNA, 20 bp, human
gggcggcgccctctgaacgg

SEQ ID NO: 169837 - DNA, 20 bp, human
gcgggcggcactcacctggg

SEQ ID NO: 169838 - DNA, 20 bp, human
gcagtgccgcgcggacatcg

SEQ ID NO: 169839 - DNA, 20 bp, human
ggcggcactcacctgggcgg

SEQ ID NO: 169840 - DNA, 20 bp, human
gcccccgtcgtggggaggag

SEQ ID NO: 169841 - DNA, 20 bp, human
gtcggggctcccccgttcag

SEQ ID NO: 169842 - DNA, 20 bp, human
gggagtggatggaacgggag

SEQ ID NO: 169843 - DNA, 20 bp, human
gccaggagccagccccgctg

SEQ ID NO: 169844 - DNA, 20 bp, human
gagcggcgcggtgggcagag

SEQ ID NO: 169845 - DNA, 20 bp, human
gcagtggggataacagccga

SEQ ID NO: 169846 - DNA, 20 bp, human
gggaagcgccgcggtagggt

SEQ ID NO: 169847 - DNA, 20 bp, human
gagcagagcgcgcggggaca

SEQ ID NO: 169848 - DNA, 20 bp, human
gggagtgcgggtctctgctg

SEQ ID NO: 169849 - DNA, 20 bp, human
ggggccagggggaaccgggg

SEQ ID NO: 169850 - DNA, 20 bp, human
gctgcactcggcgaggccgg

SEQ ID NO: 169851 - DNA, 20 bp, human
ggcggcggccgcaaatcccg

SEQ ID NO: 169852 - DNA, 20 bp, human
gtctctgctgcggacgccgg

SEQ ID NO: 169853 - DNA, 20 bp, human
gttccgcgcgaacaaaatgg

SEQ ID NO: 169854 - DNA, 20 bp, human
gcgggtgggcatcacaggga

SEQ ID NO: 169855 - DNA, 20 bp, human
gtgagcgtcacggcgccaag

SEQ ID NO: 169856 - DNA, 20 bp, human
gatgggaggcctaacatcag

SEQ ID NO: 169857 - DNA, 20 bp, human
gcactcacccctccatccgg

SEQ ID NO: 169858 - DNA, 20 bp, human
gcacagtgatgaccaggaaa

SEQ ID NO: 169859 - DNA, 20 bp, human
gtagaacagctcacactggc

SEQ ID NO: 169860 - DNA, 20 bp, human
gtctcccatgaagccaaaag

SEQ ID NO: 169861 - DNA, 20 bp, human
gatcgctctggtacccatca

SEQ ID NO: 169862 - DNA, 20 bp, human
gagtgatgaccaggaaacgg

SEQ ID NO: 169863 - DNA, 20 bp, human
gggagtcagagacccccgga

SEQ ID NO: 169864 - DNA, 20 bp, human
gtccttgcagagaccttgat

SEQ ID NO: 169865 - DNA, 20 bp, human
gcatgatggtgaagaggcag

SEQ ID NO: 169866 - DNA, 20 bp, human
gaggctggcctctgccgcct

SEQ ID NO: 169867 - DNA, 20 bp, human
gtaaaaaaaattagtgaggg

SEQ ID NO: 169868 - DNA, 20 bp, human
ggtcccagggccgaggcgga

SEQ ID NO: 169869 - DNA, 20 bp, human
ggtagacccaaggccgaggc

SEQ ID NO: 169870 - DNA, 20 bp, human
gggtgcacttctgtagtccc

SEQ ID NO: 169871 - DNA, 20 bp, human
gatccttccgcctcggccct

SEQ ID NO: 169872 - DNA, 20 bp, human
gagacaaagcagtggttgcg

SEQ ID NO: 169873 - DNA, 20 bp, human
gatacaggcctgtagaccca

SEQ ID NO: 169874 - DNA, 20 bp, human
gaacaggggtgggataatac

SEQ ID NO: 169875 - DNA, 20 bp, human
ggcgaggtcggcagcagtgg

SEQ ID NO: 169876 - DNA, 20 bp, human
ggaaacctgcggaggccggg

SEQ ID NO: 169877 - DNA, 20 bp, human
gtgcggagcgctctgacccg

SEQ ID NO: 169878 - DNA, 20 bp, human
gggagccccaaaccctctct

SEQ ID NO: 169879 - DNA, 20 bp, human
gcgcgcgcggaggtgagagc

SEQ ID NO: 169880 - DNA, 20 bp, human
gggagcctcccgccgaacaa

SEQ ID NO: 169881 - DNA, 20 bp, human
gggctgcagagtctcagcag

SEQ ID NO: 169882 - DNA, 20 bp, human
gtggaagagaaccccgatag

SEQ ID NO: 169883 - DNA, 20 bp, human
ggccgggctaggacgccgag

SEQ ID NO: 169884 - DNA, 20 bp, human
gcgagcagcgcggggacgtg

SEQ ID NO: 169885 - DNA, 20 bp, human
gtcacggcccccgggagcgg

SEQ ID NO: 169886 - DNA, 20 bp, human
gccgtgcgtactcttgagta

SEQ ID NO: 169887 - DNA, 20 bp, human
gatggcggttagaaactgac

SEQ ID NO: 169888 - DNA, 20 bp, human
gcttaagaaatttgggcctg

SEQ ID NO: 169889 - DNA, 20 bp, human
gaagaaatttgggcctgggg

SEQ ID NO: 169890 - DNA, 20 bp, human
ggatcttctcacctaggcct

SEQ ID NO: 169891 - DNA, 20 bp, human
gcaggaaagatttaagatgg

SEQ ID NO: 169892 - DNA, 20 bp, human
gtgacaggaaagatttaaga

SEQ ID NO: 169893 - DNA, 20 bp, human
gcactcaaatctttcctgct

SEQ ID NO: 169894 - DNA, 20 bp, human
gaaatttgggcctggggtgg

SEQ ID NO: 169895 - DNA, 20 bp, human
gcgccagtgcactcccgact

SEQ ID NO: 169896 - DNA, 20 bp, human
gtagggacagaaccttccca

SEQ ID NO: 169897 - DNA, 20 bp, human
ggaaccttcccaaggcgggg

SEQ ID NO: 169898 - DNA, 20 bp, human
gcctcccccccgccttggga

SEQ ID NO: 169899 - DNA, 20 bp, human
gggacagaaccttcccaagg

SEQ ID NO: 169900 - DNA, 20 bp, human
gcgaaagcgtccccttggat

SEQ ID NO: 169901 - DNA, 20 bp, human
gcactttggaggcccacagg

SEQ ID NO: 169902 - DNA, 20 bp, human
gcaagcgatccaccacctgt

SEQ ID NO: 169903 - DNA, 20 bp, human
gcagcactttggaggcccac

SEQ ID NO: 169904 - DNA, 20 bp, human
gatttaaagtagccaatcca

SEQ ID NO: 169905 - DNA, 20 bp, human
ggaagtgcaccacggcggag

SEQ ID NO: 169906 - DNA, 20 bp, human
gtcaggacctttggtgctct

SEQ ID NO: 169907 - DNA, 20 bp, human
gcctgaggctggaaagactc

SEQ ID NO: 169908 - DNA, 20 bp, human
ggaagtgcaccacggcggag

SEQ ID NO: 169909 - DNA, 20 bp, human
gggacctttggtgctctggg

SEQ ID NO: 169910 - DNA, 20 bp, human
gcaagcgatccaccacctgt

SEQ ID NO: 169911 - DNA, 20 bp, human
gcactttggaggcccacagg

SEQ ID NO: 169912 - DNA, 20 bp, human
gcgcatgcttaccctgattg

SEQ ID NO: 169913 - DNA, 20 bp, human
gttagataagaagtgcacca

SEQ ID NO: 169914 - DNA, 20 bp, human
ggcaccaaaggtcctgaggc

SEQ ID NO: 169915 - DNA, 20 bp, human
gtgattgtggaagaatcaaa

SEQ ID NO: 169916 - DNA, 20 bp, human
ggcgtaggccttgggactag

SEQ ID NO: 169917 - DNA, 20 bp, human
ggtcccaaggcctacgcgag

SEQ ID NO: 169918 - DNA, 20 bp, human
gaggggaggggtagtaagaa

SEQ ID NO: 169919 - DNA, 20 bp, human
ggataacaaatgcaccacag

SEQ ID NO: 169920 - DNA, 20 bp, human
gacaaatgcaccacagagga

SEQ ID NO: 169921 - DNA, 20 bp, human
gttaagttactagagttccc

SEQ ID NO: 169922 - DNA, 20 bp, human
gctagtaacttaacaaattt

SEQ ID NO: 169923 - DNA, 20 bp, human
ggtgtgcacctctagtccca

SEQ ID NO: 169924 - DNA, 20 bp, human
gatgcaccacagaggagggg

SEQ ID NO: 169925 - DNA, 20 bp, human
gaacaaatttgggccgggta

SEQ ID NO: 169926 - DNA, 20 bp, human
ggcggctcctgtactaccca

SEQ ID NO: 169927 - DNA, 20 bp, human
ggtggtgggcgaaactgggg

SEQ ID NO: 169928 - DNA, 20 bp, human
gtcgcccaagatacacccct

SEQ ID NO: 169929 - DNA, 20 bp, human
ggcaccctgaggttgcccag

SEQ ID NO: 169930 - DNA, 20 bp, human
gcaggcctgaggaccgttgg

SEQ ID NO: 169931 - DNA, 20 bp, human
gttctttgcccgggaaaggg

SEQ ID NO: 169932 - DNA, 20 bp, human
gcgcgagccttgggtagtac

SEQ ID NO: 169933 - DNA, 20 bp, human
gaaagggaggcaacttcgag

SEQ ID NO: 169934 - DNA, 20 bp, human
gtgagtagagctcaacgccc

SEQ ID NO: 169935 - DNA, 20 bp, human
gacccaggcctgaggaccgt

SEQ ID NO: 169936 - DNA, 20 bp, human
ggcccagcgcgcccgaccgg

SEQ ID NO: 169937 - DNA, 20 bp, human
gagagagcgcgccagggcga

SEQ ID NO: 169938 - DNA, 20 bp, human
ggcgcaggcggcgggattcc

SEQ ID NO: 169939 - DNA, 20 bp, human
gagggcgcaggaaggcccag

SEQ ID NO: 169940 - DNA, 20 bp, human
gcagggaaagaaaggaccga

SEQ ID NO: 169941 - DNA, 20 bp, human
gcggtccggtaccaaaggtc

SEQ ID NO: 169942 - DNA, 20 bp, human
gggagcgatcgggcccgcaa

SEQ ID NO: 169943 - DNA, 20 bp, human
gcaggcccagcgcgcccgac

SEQ ID NO: 169944 - DNA, 20 bp, human
ggagggcaccgccgccggtc

SEQ ID NO: 169945 - DNA, 20 bp, human
gcgagctctgggcgcacagg

SEQ ID NO: 169946 - DNA, 20 bp, human
ggtagacgttcgccaggtaa

SEQ ID NO: 169947 - DNA, 20 bp, human
gcaggggaatactagaggta

SEQ ID NO: 169948 - DNA, 20 bp, human
gccatagaatcagaacgcag

SEQ ID NO: 169949 - DNA, 20 bp, human
gaacctttttgtagggagaa

SEQ ID NO: 169950 - DNA, 20 bp, human
ggtggaaggtgctatcacat

SEQ ID NO: 169951 - DNA, 20 bp, human
gtgcccttctccctacaaaa

SEQ ID NO: 169952 - DNA, 20 bp, human
gtctatggaacctttttgta

SEQ ID NO: 169953 - DNA, 20 bp, human
gttaactgaatgtgacctca

SEQ ID NO: 169954 - DNA, 20 bp, human
gcaggcactggtttttgcgt

SEQ ID NO: 169955 - DNA, 20 bp, human
gaggtgctatcacattggct

SEQ ID NO: 169956 - DNA, 20 bp, human
gaggtgccggtgaagaagct

SEQ ID NO: 169957 - DNA, 20 bp, human
ggcaggtccgggattcgggg

SEQ ID NO: 169958 - DNA, 20 bp, human
gcccgcgccgtaggagggag

SEQ ID NO: 169959 - DNA, 20 bp, human
ggaatcccggacctgcgctg

SEQ ID NO: 169960 - DNA, 20 bp, human
gtacagggccgaccctcggt

SEQ ID NO: 169961 - DNA, 20 bp, human
ggaagcagcacgaacagccg

SEQ ID NO: 169962 - DNA, 20 bp, human
gtgaggaggcggttcatctg

SEQ ID NO: 169963 - DNA, 20 bp, human
gctcgctctcgcagcaacaa

SEQ ID NO: 169964 - DNA, 20 bp, human
gtcccggacctgcgctgagg

SEQ ID NO: 169965 - DNA, 20 bp, human
gctgggccccggctccatcg

SEQ ID NO: 169966 - DNA, 20 bp, human
gacgtcccggaggatccctc

SEQ ID NO: 169967 - DNA, 20 bp, human
gccggtggcggaggacgtcc

SEQ ID NO: 169968 - DNA, 20 bp, human
gcccgaccagagggatcctc

SEQ ID NO: 169969 - DNA, 20 bp, human
gtacccgccgagagcggacc

SEQ ID NO: 169970 - DNA, 20 bp, human
gcagccaggtccgctctcgg

SEQ ID NO: 169971 - DNA, 20 bp, human
gtggctggctacacaaagcc

SEQ ID NO: 169972 - DNA, 20 bp, human
gcgctctcggcgggtactcg

SEQ ID NO: 169973 - DNA, 20 bp, human
gagccagccaggtccgctct

SEQ ID NO: 169974 - DNA, 20 bp, human
gggtactcgtggtcttgctc

SEQ ID NO: 169975 - DNA, 20 bp, human
gccaaccgctgcatagacgt

SEQ ID NO: 169976 - DNA, 20 bp, human
gggttcggaggagaatacag

SEQ ID NO: 169977 - DNA, 20 bp, human
gctggacccgggaactgaag

SEQ ID NO: 169978 - DNA, 20 bp, human
gacccgggaactgaaggggt

SEQ ID NO: 169979 - DNA, 20 bp, human
ggcaaagtgtcgaaactgtc

SEQ ID NO: 169980 - DNA, 20 bp, human
gggtcgccgctgccaaggaa

SEQ ID NO: 169981 - DNA, 20 bp, human
gtagtgggctccgccggcgg

SEQ ID NO: 169982 - DNA, 20 bp, human
gggctggagccgaggaagcg

SEQ ID NO: 169983 - DNA, 20 bp, human
gagagccctagaccggaggg

SEQ ID NO: 169984 - DNA, 20 bp, human
gcaaagagccctagaccgga

SEQ ID NO: 169985 - DNA, 20 bp, human
ggaagaccccgggattctag

SEQ ID NO: 169986 - DNA, 20 bp, human
gagctaacgggtccggacga

SEQ ID NO: 169987 - DNA, 20 bp, human
gttgccgggctggaacgggc

SEQ ID NO: 169988 - DNA, 20 bp, human
gtaacgggtccggacgacgg

SEQ ID NO: 169989 - DNA, 20 bp, human
gggagggttgggccaggcaa

SEQ ID NO: 169990 - DNA, 20 bp, human
gggactggaagtcgggacca

SEQ ID NO: 169991 - DNA, 20 bp, human
gagcggtacgaactagggag

SEQ ID NO: 169992 - DNA, 20 bp, human
gagctgcgagctaacgggtc

SEQ ID NO: 169993 - DNA, 20 bp, human
gcaagggcgggactagccca

SEQ ID NO: 169994 - DNA, 20 bp, human
ggagagagctgcgagctaac

SEQ ID NO: 169995 - DNA, 20 bp, human
gcgggtccggacgacggcgg

SEQ ID NO: 169996 - DNA, 20 bp, human
ggggtgaacgggagggtcga

SEQ ID NO: 169997 - DNA, 20 bp, human
ggagaaggctgcgggtgaac

SEQ ID NO: 169998 - DNA, 20 bp, human
gcccacagcgcggccgaggt

SEQ ID NO: 169999 - DNA, 20 bp, human
gtaagacgatcctccgcccg

SEQ ID NO: 170000 - DNA, 20 bp, human
gtgaggaggcctccggccca

SEQ ID NO: 170001 - DNA, 20 bp, human
gatcctccgcccgaggctga

SEQ ID NO: 170002 - DNA, 20 bp, human
gaagcacttccgtcagcctc

SEQ ID NO: 170003 - DNA, 20 bp, human
gtgacggaagtgcttcgccg

SEQ ID NO: 170004 - DNA, 20 bp, human
gagtagctggccagacctgg

SEQ ID NO: 170005 - DNA, 20 bp, human
gcttagtagctggccagacc

SEQ ID NO: 170006 - DNA, 20 bp, human
ggagcggcgaccgttattcg

SEQ ID NO: 170007 - DNA, 20 bp, human
ggatggctgaccgcgaataa

SEQ ID NO: 170008 - DNA, 20 bp, human
gcgccgctgcgtccccacta

SEQ ID NO: 170009 - DNA, 20 bp, human
gcgccatagtggggacgcag

SEQ ID NO: 170010 - DNA, 20 bp, human
gcatgggcgccgccatagtg

SEQ ID NO: 170011 - DNA, 20 bp, human
gacaacgcgctgggctgcat

SEQ ID NO: 170012 - DNA, 20 bp, human
gcacagcagggcccgaatga

SEQ ID NO: 170013 - DNA, 20 bp, human
ggcgggagcccacaacgcgc

SEQ ID NO: 170014 - DNA, 20 bp, human
gcacccaggagaggtcatcc

SEQ ID NO: 170015 - DNA, 20 bp, human
gcccagcccgaaggacgact

SEQ ID NO: 170016 - DNA, 20 bp, human
gtcactccaagggaacggag

SEQ ID NO: 170017 - DNA, 20 bp, human
gccctgcgcccggactgaag

SEQ ID NO: 170018 - DNA, 20 bp, human
gcgctaggcgcaccgaccgg

SEQ ID NO: 170019 - DNA, 20 bp, human
gcaagtgctggacctgaccg

SEQ ID NO: 170020 - DNA, 20 bp, human
gcgcagggctgggggattgg

SEQ ID NO: 170021 - DNA, 20 bp, human
gctggcgcgacggctcgact

SEQ ID NO: 170022 - DNA, 20 bp, human
gatccgctaggcgcaccgac

SEQ ID NO: 170023 - DNA, 20 bp, human
gcgtgagggtgagtacgcgg

SEQ ID NO: 170024 - DNA, 20 bp, human
ggcgtactcaccctcacggg

SEQ ID NO: 170025 - DNA, 20 bp, human
gcaagggaacggagaggatc

SEQ ID NO: 170026 - DNA, 20 bp, human
gctctcgcgcccattcagct

SEQ ID NO: 170027 - DNA, 20 bp, human
ggcccccgcgacgccgagga

SEQ ID NO: 170028 - DNA, 20 bp, human
ggtgtacgcggtagagggtg

SEQ ID NO: 170029 - DNA, 20 bp, human
gcggcggcccccagctgaat

SEQ ID NO: 170030 - DNA, 20 bp, human
gctgcgccacgtacctcggc

SEQ ID NO: 170031 - DNA, 20 bp, human
gggcgggacccgacacccgg

SEQ ID NO: 170032 - DNA, 20 bp, human
gctcctccgcatctgagcgg

SEQ ID NO: 170033 - DNA, 20 bp, human
gcccagggcacgacaccctc

SEQ ID NO: 170034 - DNA, 20 bp, human
gggcggggaaagggccactg

SEQ ID NO: 170035 - DNA, 20 bp, human
gtcccacgcaggtgtgtacg

SEQ ID NO: 170036 - DNA, 20 bp, human
gaggctgcgggtctcccgga

SEQ ID NO: 170037 - DNA, 20 bp, human
gccaggagcgacgaccgcag

SEQ ID NO: 170038 - DNA, 20 bp, human
gcgaggccggcagaaaccaa

SEQ ID NO: 170039 - DNA, 20 bp, human
ggaggaaggtgcaaagtggt

SEQ ID NO: 170040 - DNA, 20 bp, human
gcgccccgcccgaaaggtag

SEQ ID NO: 170041 - DNA, 20 bp, human
gggaggcgtaaagggaccat

SEQ ID NO: 170042 - DNA, 20 bp, human
ggaaggtgcaaagtggtggg

SEQ ID NO: 170043 - DNA, 20 bp, human
ggccgcccccaaattcgagg

SEQ ID NO: 170044 - DNA, 20 bp, human
gccggctgctgcctctctcg

SEQ ID NO: 170045 - DNA, 20 bp, human
gcggcaagagtgacccgccg

SEQ ID NO: 170046 - DNA, 20 bp, human
ggcggcagaagtaaacactg

SEQ ID NO: 170047 - DNA, 20 bp, human
gcgaggccggcagaaaccaa

SEQ ID NO: 170048 - DNA, 20 bp, human
gcgccccgcccgaaaggtag

SEQ ID NO: 170049 - DNA, 20 bp, human
gccaggagcgacgaccgcag

SEQ ID NO: 170050 - DNA, 20 bp, human
gaggctgcgggtctcccgga

SEQ ID NO: 170051 - DNA, 20 bp, human
gcgagcgcctccggagtcgc

SEQ ID NO: 170052 - DNA, 20 bp, human
ggagcttcccgcgactccgg

SEQ ID NO: 170053 - DNA, 20 bp, human
ggctggcgccagttgcacgg

SEQ ID NO: 170054 - DNA, 20 bp, human
ggccgcccccaaattcgagg

SEQ ID NO: 170055 - DNA, 20 bp, human
ggaggaaggtgcaaagtggt

SEQ ID NO: 170056 - DNA, 20 bp, human
gctgcgaggagcgccacgaa

SEQ ID NO: 170057 - DNA, 20 bp, human
ggccacgaaaggtcagagga

SEQ ID NO: 170058 - DNA, 20 bp, human
gggaagctcgcagcaggtat

SEQ ID NO: 170059 - DNA, 20 bp, human
gcagccggctagggagccca

SEQ ID NO: 170060 - DNA, 20 bp, human
gcagcgggactttcaggtaa

SEQ ID NO: 170061 - DNA, 20 bp, human
gctgcggtgtgagaatggag

SEQ ID NO: 170062 - DNA, 20 bp, human
gcgcccgcctagcgaggaca

SEQ ID NO: 170063 - DNA, 20 bp, human
gttcaggtaagggcagctcc

SEQ ID NO: 170064 - DNA, 20 bp, human
gtaagaactacaaacaccac

SEQ ID NO: 170065 - DNA, 20 bp, human
gggattctattagcttaagg

SEQ ID NO: 170066 - DNA, 20 bp, human
gggagctggggaccccacta

SEQ ID NO: 170067 - DNA, 20 bp, human
ggtccgctggggaagaacgg

SEQ ID NO: 170068 - DNA, 20 bp, human
gtcgaaagaggggtccgctg

SEQ ID NO: 170069 - DNA, 20 bp, human
gcagaagacgcacagtggaa

SEQ ID NO: 170070 - DNA, 20 bp, human
gctagggagtctcgaaagag

SEQ ID NO: 170071 - DNA, 20 bp, human
gggggacagaagacgcacag

SEQ ID NO: 170072 - DNA, 20 bp, human
gcagaaaacgcgctcggcaa

SEQ ID NO: 170073 - DNA, 20 bp, human
ggagtgcagcgagtgagtag

SEQ ID NO: 170074 - DNA, 20 bp, human
ggggcgcgggaggatagcgg

SEQ ID NO: 170075 - DNA, 20 bp, human
gcactgcccggcgttaacaa

SEQ ID NO: 170076 - DNA, 20 bp, human
gctgtagggcggcacaacca

SEQ ID NO: 170077 - DNA, 20 bp, human
gataggaggaggttcctgta

SEQ ID NO: 170078 - DNA, 20 bp, human
gctgatagcttaataggagg

SEQ ID NO: 170079 - DNA, 20 bp, human
gacggagaggggaaccccaa

SEQ ID NO: 170080 - DNA, 20 bp, human
gggtgggacccccacacata

SEQ ID NO: 170081 - DNA, 20 bp, human
gtaattgaacccacggagag

SEQ ID NO: 170082 - DNA, 20 bp, human
gtttctgatagcttaatagg

SEQ ID NO: 170083 - DNA, 20 bp, human
gggtcagaaagaagttctgg

SEQ ID NO: 170084 - DNA, 20 bp, human
gatcatcaaggatgctgcag

SEQ ID NO: 170085 - DNA, 20 bp, human
gtccctacacagggacttgg

SEQ ID NO: 170086 - DNA, 20 bp, human
gctgcgggatcacctctccg

SEQ ID NO: 170087 - DNA, 20 bp, human
gggtggctcggcctcaaagc

SEQ ID NO: 170088 - DNA, 20 bp, human
gcggcagctgcaagcgcggg

SEQ ID NO: 170089 - DNA, 20 bp, human
gggcggcggggcacagcggg

SEQ ID NO: 170090 - DNA, 20 bp, human
ggaaccgccgcctctccccg

SEQ ID NO: 170091 - DNA, 20 bp, human
gcccgcggccagaggaaccg

SEQ ID NO: 170092 - DNA, 20 bp, human
gcgcgctgcccgaaacaatg

SEQ ID NO: 170093 - DNA, 20 bp, human
gcccgcgctcccgtcccagg

SEQ ID NO: 170094 - DNA, 20 bp, human
gcccgccggcgagcgcaggc

SEQ ID NO: 170095 - DNA, 20 bp, human
gggaggaggactcgagcctg

SEQ ID NO: 170096 - DNA, 20 bp, human
gtgggtcgggttctagagga

SEQ ID NO: 170097 - DNA, 20 bp, human
ggtggtgggtcgggttctag

SEQ ID NO: 170098 - DNA, 20 bp, human
gcctggccaggaaacctgag

SEQ ID NO: 170099 - DNA, 20 bp, human
gggacatgtccagatactgt

SEQ ID NO: 170100 - DNA, 20 bp, human
ggtgggcaaccaagacgcat

SEQ ID NO: 170101 - DNA, 20 bp, human
gaggcaggacctcatggtgg

SEQ ID NO: 170102 - DNA, 20 bp, human
gcctctgggactgtgagtaa

SEQ ID NO: 170103 - DNA, 20 bp, human
ggacctcatggtggtgggtc

SEQ ID NO: 170104 - DNA, 20 bp, human
ggaacagaaagggtggcagt

SEQ ID NO: 170105 - DNA, 20 bp, human
gaggaaggttctgcatgtcc

SEQ ID NO: 170106 - DNA, 20 bp, human
ggcgggtcgccagtgcacag

SEQ ID NO: 170107 - DNA, 20 bp, human
gggaggacttcaccaacaag

SEQ ID NO: 170108 - DNA, 20 bp, human
ggagggcgcaggggcgacca

SEQ ID NO: 170109 - DNA, 20 bp, human
gtcaccaacaaggggcaccg

SEQ ID NO: 170110 - DNA, 20 bp, human
gtgccgagcgcagagcggga

SEQ ID NO: 170111 - DNA, 20 bp, human
gcctgggacgtcagcggacg

SEQ ID NO: 170112 - DNA, 20 bp, human
gtccgggcagcgcgaggtca

SEQ ID NO: 170113 - DNA, 20 bp, human
gaggggtccacgcggaggtt

SEQ ID NO: 170114 - DNA, 20 bp, human
gcagcggccggagccaggta

SEQ ID NO: 170115 - DNA, 20 bp, human
ggcagcgcgaggtcaaggct

SEQ ID NO: 170116 - DNA, 20 bp, human
gtgcagactgttggctccag

SEQ ID NO: 170117 - DNA, 20 bp, human
gtaatggggatggtagggag

SEQ ID NO: 170118 - DNA, 20 bp, human
gagcaggaggcaggaatggt

SEQ ID NO: 170119 - DNA, 20 bp, human
gtgaaggagctgcagactgt

SEQ ID NO: 170120 - DNA, 20 bp, human
gggcggcgcagcttacaccg

SEQ ID NO: 170121 - DNA, 20 bp, human
gtttggatctgcgggaatgt

SEQ ID NO: 170122 - DNA, 20 bp, human
ggccgaataatggggatggt

SEQ ID NO: 170123 - DNA, 20 bp, human
gggctgtgtgccgaataatg

SEQ ID NO: 170124 - DNA, 20 bp, human
gcaatgcaggcgcgagcagg

SEQ ID NO: 170125 - DNA, 20 bp, human
gtggaggctggtaccacggc

SEQ ID NO: 170126 - DNA, 20 bp, human
gtccgccgctcggagctcca

SEQ ID NO: 170127 - DNA, 20 bp, human
gcccccgggccgggccgact

SEQ ID NO: 170128 - DNA, 20 bp, human
gaggtcacccatcaggtctg

SEQ ID NO: 170129 - DNA, 20 bp, human
ggccatggagctccgagcgg

SEQ ID NO: 170130 - DNA, 20 bp, human
gtcggagctccatggccccc

SEQ ID NO: 170131 - DNA, 20 bp, human
gcacacggtctgcaagaaca

SEQ ID NO: 170132 - DNA, 20 bp, human
gggacttccagggaacgcag

SEQ ID NO: 170133 - DNA, 20 bp, human
gtagagaggtaggatggatg

SEQ ID NO: 170134 - DNA, 20 bp, human
ggtcccccgggtagagaggt

SEQ ID NO: 170135 - DNA, 20 bp, human
ggatcagcttccagcccagt

SEQ ID NO: 170136 - DNA, 20 bp, human
gctctcgccggagatctagg

SEQ ID NO: 170137 - DNA, 20 bp, human
ggcaggagcgatggaggagt

SEQ ID NO: 170138 - DNA, 20 bp, human
gtccggcgagaggtccgagg

SEQ ID NO: 170139 - DNA, 20 bp, human
ggagccaggatgggaactcg

SEQ ID NO: 170140 - DNA, 20 bp, human
ggacctctcgccggagatct

SEQ ID NO: 170141 - DNA, 20 bp, human
ggatcgctgagagactacga

SEQ ID NO: 170142 - DNA, 20 bp, human
ggccggagatctaggaggcg

SEQ ID NO: 170143 - DNA, 20 bp, human
gctgagagactacgagggtc

SEQ ID NO: 170144 - DNA, 20 bp, human
gccgcgggacccgggaagcg

SEQ ID NO: 170145 - DNA, 20 bp, human
gcagagctggagaatcggga

SEQ ID NO: 170146 - DNA, 20 bp, human
gatggatgcgggtcccccgg

SEQ ID NO: 170147 - DNA, 20 bp, human
gctcccggcgccatgtgagg

SEQ ID NO: 170148 - DNA, 20 bp, human
gccccaccaggtggacgcac

SEQ ID NO: 170149 - DNA, 20 bp, human
ggcgtgggaggagggctcca

SEQ ID NO: 170150 - DNA, 20 bp, human
gtgacggcggcgctaggacc

SEQ ID NO: 170151 - DNA, 20 bp, human
ggcccccgagccccctcaca

SEQ ID NO: 170152 - DNA, 20 bp, human
ggcccgtgcgtccacctggt

SEQ ID NO: 170153 - DNA, 20 bp, human
gcggctcccggcgccatgtg

SEQ ID NO: 170154 - DNA, 20 bp, human
gggaccccgcgacagaccct

SEQ ID NO: 170155 - DNA, 20 bp, human
ggccatgtgagggggctcgg

SEQ ID NO: 170156 - DNA, 20 bp, human
gcggcagacaccaagagccg

SEQ ID NO: 170157 - DNA, 20 bp, human
gagagaggagcgctgaaaca

SEQ ID NO: 170158 - DNA, 20 bp, human
gccgggccggtgaatcatcc

SEQ ID NO: 170159 - DNA, 20 bp, human
gcaccagcgacgcagcaggg

SEQ ID NO: 170160 - DNA, 20 bp, human
gctacccgccagcaacgcgg

SEQ ID NO: 170161 - DNA, 20 bp, human
gagctgctccagaaagcccg

SEQ ID NO: 170162 - DNA, 20 bp, human
gcgctgaaacatggctgaag

SEQ ID NO: 170163 - DNA, 20 bp, human
gacatggctgaagcggccac

SEQ ID NO: 170164 - DNA, 20 bp, human
ggaccaccagcgacgcagca

SEQ ID NO: 170165 - DNA, 20 bp, human
gagcaacgcggcggcttagg

SEQ ID NO: 170166 - DNA, 20 bp, human
gggagacgctccaacagctg

SEQ ID NO: 170167 - DNA, 20 bp, human
gtctacggaggagccggtaa

SEQ ID NO: 170168 - DNA, 20 bp, human
gctcctggcgcctgcgatag

SEQ ID NO: 170169 - DNA, 20 bp, human
gcggctgtcgtggagataac

SEQ ID NO: 170170 - DNA, 20 bp, human
gtgcgatagcggcaagatgg

SEQ ID NO: 170171 - DNA, 20 bp, human
gaacgaggacataagagaga

SEQ ID NO: 170172 - DNA, 20 bp, human
ggagaggaccagacctcctg

SEQ ID NO: 170173 - DNA, 20 bp, human
ggaccttaagagttctacgg

SEQ ID NO: 170174 - DNA, 20 bp, human
ggggccaggagagatgtcgg

SEQ ID NO: 170175 - DNA, 20 bp, human
gtgggtgaagccgcagctgt

SEQ ID NO: 170176 - DNA, 20 bp, human
ggcaggagcatcgctcggag

SEQ ID NO: 170177 - DNA, 20 bp, human
gcgcagccccggcgtcccag

SEQ ID NO: 170178 - DNA, 20 bp, human
gcatcgctcggaggggacaa

SEQ ID NO: 170179 - DNA, 20 bp, human
gagcacaaagctaggcgaag

SEQ ID NO: 170180 - DNA, 20 bp, human
gccccgcccctgggacgccg

SEQ ID NO: 170181 - DNA, 20 bp, human
gtaggcgaagtggcagcgga

SEQ ID NO: 170182 - DNA, 20 bp, human
gaggggacaaggggacgcca

SEQ ID NO: 170183 - DNA, 20 bp, human
gcagcgcccgccttctgcag

SEQ ID NO: 170184 - DNA, 20 bp, human
gctcctaaacatgtggcccg

SEQ ID NO: 170185 - DNA, 20 bp, human
gtctccgagtgcgcagagag

SEQ ID NO: 170186 - DNA, 20 bp, human
gcagcggcagcgacaggcag

SEQ ID NO: 170187 - DNA, 20 bp, human
gctgcgctccggacgagtcc

SEQ ID NO: 170188 - DNA, 20 bp, human
ggtagctccgctggagagat

SEQ ID NO: 170189 - DNA, 20 bp, human
gtggagagatggggacggtt

SEQ ID NO: 170190 - DNA, 20 bp, human
gccgccggcccggactcgtc

SEQ ID NO: 170191 - DNA, 20 bp, human
gctccagcggagctacagcg

SEQ ID NO: 170192 - DNA, 20 bp, human
ggggcagacaccctgcgctc

SEQ ID NO: 170193 - DNA, 20 bp, human
ggcacacaaagggggtcgga

SEQ ID NO: 170194 - DNA, 20 bp, human
gcggggcgcggcgcacacaa

SEQ ID NO: 170195 - DNA, 20 bp, human
gggcaggggttgctcaggcg

SEQ ID NO: 170196 - DNA, 20 bp, human
ggagagcagcgggaccccgt

SEQ ID NO: 170197 - DNA, 20 bp, human
gagcgggaccccgtaggcag

SEQ ID NO: 170198 - DNA, 20 bp, human
gcccgagggcactaacacag

SEQ ID NO: 170199 - DNA, 20 bp, human
gcccaagtacgccagcccgg

SEQ ID NO: 170200 - DNA, 20 bp, human
gcacagaggcccgcactcac

SEQ ID NO: 170201 - DNA, 20 bp, human
ggggctggcgtacttgggag

SEQ ID NO: 170202 - DNA, 20 bp, human
ggggaaatcggtccattgag

SEQ ID NO: 170203 - DNA, 20 bp, human
gccccgcgcgcccctgccta

SEQ ID NO: 170204 - DNA, 20 bp, human
gcgagctgctggccgctcaa

SEQ ID NO: 170205 - DNA, 20 bp, human
gtatctggcccaaagagtct

SEQ ID NO: 170206 - DNA, 20 bp, human
gacaccttgtgcattggagg

SEQ ID NO: 170207 - DNA, 20 bp, human
gcttctgcagctgggttcgg

SEQ ID NO: 170208 - DNA, 20 bp, human
gaccaggagacgcaactcat

SEQ ID NO: 170209 - DNA, 20 bp, human
gggcagagctggcgcaaaca

SEQ ID NO: 170210 - DNA, 20 bp, human
gtgggtgcccgagaaagtcc

SEQ ID NO: 170211 - DNA, 20 bp, human
gggcagcgttcgaggaccag

SEQ ID NO: 170212 - DNA, 20 bp, human
ggatcccgggatcagatcac

SEQ ID NO: 170213 - DNA, 20 bp, human
gaacagggcgagaggtcgct

SEQ ID NO: 170214 - DNA, 20 bp, human
ggggcaaccaggactttctc

SEQ ID NO: 170215 - DNA, 20 bp, human
gctgggttcgggggcgtcac

SEQ ID NO: 170216 - DNA, 20 bp, human
gtggaggtaaaggtacccgg

SEQ ID NO: 170217 - DNA, 20 bp, human
ggcgcatcccgccctctcaa

SEQ ID NO: 170218 - DNA, 20 bp, human
gccctccgcggggaaatcgg

SEQ ID NO: 170219 - DNA, 20 bp, human
gcaccggcgcctggaggtaa

SEQ ID NO: 170220 - DNA, 20 bp, human
gcgcggccactgccacccgg

SEQ ID NO: 170221 - DNA, 20 bp, human
gtggcaggaactacattaag

SEQ ID NO: 170222 - DNA, 20 bp, human
gtgctgcaacagatcctgta

SEQ ID NO: 170223 - DNA, 20 bp, human
ggtggcagggagctctgccg

SEQ ID NO: 170224 - DNA, 20 bp, human
gggagctctgccgcggccag

SEQ ID NO: 170225 - DNA, 20 bp, human
gatcggcggctacccggcac

SEQ ID NO: 170226 - DNA, 20 bp, human
gtgggcggcttgggggtccg

SEQ ID NO: 170227 - DNA, 20 bp, human
gggcgggtgggtgggttacc

SEQ ID NO: 170228 - DNA, 20 bp, human
ggcgcacccacagcgttcac

SEQ ID NO: 170229 - DNA, 20 bp, human
gtcggagctgctgcgggctc

SEQ ID NO: 170230 - DNA, 20 bp, human
gccacccggcagagtctccg

SEQ ID NO: 170231 - DNA, 20 bp, human
gcacccacagcgttcacagg

SEQ ID NO: 170232 - DNA, 20 bp, human
gcagcagctccgagcgcctc

SEQ ID NO: 170233 - DNA, 20 bp, human
gttcaggtgaccccgcgcgg

SEQ ID NO: 170234 - DNA, 20 bp, human
ggttcacaggcggcagcgag

SEQ ID NO: 170235 - DNA, 20 bp, human
gcggggcgcggccggcgggt

SEQ ID NO: 170236 - DNA, 20 bp, human
ggctgtccaggacagagtcg

SEQ ID NO: 170237 - DNA, 20 bp, human
ggtagggaatgagctctagg

SEQ ID NO: 170238 - DNA, 20 bp, human
ggtgcagctgaagtgtacag

SEQ ID NO: 170239 - DNA, 20 bp, human
gtaggaggcaggcacagcac

SEQ ID NO: 170240 - DNA, 20 bp, human
ggcctccgtctgggccagaa

SEQ ID NO: 170241 - DNA, 20 bp, human
ggggccccgccatggctggt

SEQ ID NO: 170242 - DNA, 20 bp, human
gagagtgggaggaggccccg

SEQ ID NO: 170243 - DNA, 20 bp, human
ggccagcggtgggaacaggg

SEQ ID NO: 170244 - DNA, 20 bp, human
ggcccttctggcccagacgg

SEQ ID NO: 170245 - DNA, 20 bp, human
gaggacagagtcggggcgta

SEQ ID NO: 170246 - DNA, 20 bp, human
gtacaggaagagcaacaagt

SEQ ID NO: 170247 - DNA, 20 bp, human
gctagatcgaaccaggagat

SEQ ID NO: 170248 - DNA, 20 bp, human
gctccccagctgaaaccaca

SEQ ID NO: 170249 - DNA, 20 bp, human
gcagcggggcgcttcagtac

SEQ ID NO: 170250 - DNA, 20 bp, human
gaagatggtgcatcacaatt

SEQ ID NO: 170251 - DNA, 20 bp, human
gaagtgggttagcacacctt

SEQ ID NO: 170252 - DNA, 20 bp, human
gtagcacaccttcggaaaga

SEQ ID NO: 170253 - DNA, 20 bp, human
gatgggtaaagggtgaaatc

SEQ ID NO: 170254 - DNA, 20 bp, human
gtgatgcaccatctttccga

SEQ ID NO: 170255 - DNA, 20 bp, human
gccaatttcaccaagactcc

SEQ ID NO: 170256 - DNA, 20 bp, human
gcacgcccgtgctagatagg

SEQ ID NO: 170257 - DNA, 20 bp, human
gcgtgagcagcgggtcctac

SEQ ID NO: 170258 - DNA, 20 bp, human
gtcggcgcctcggcgaggat

SEQ ID NO: 170259 - DNA, 20 bp, human
gcgggaaggctgggtccaca

SEQ ID NO: 170260 - DNA, 20 bp, human
gggctcccggaggaacagcg

SEQ ID NO: 170261 - DNA, 20 bp, human
gagacttgctagttagccca

SEQ ID NO: 170262 - DNA, 20 bp, human
gggcgaggatgggagtcccc

SEQ ID NO: 170263 - DNA, 20 bp, human
gtaggacttgaacgtccggt

SEQ ID NO: 170264 - DNA, 20 bp, human
gaacggtgttgggctcccgg

SEQ ID NO: 170265 - DNA, 20 bp, human
gggagggcacgtcggcgcct

SEQ ID NO: 170266 - DNA, 20 bp, human
gagagggtgccgagatccga

SEQ ID NO: 170267 - DNA, 20 bp, human
gcatggttcggggagagggg

SEQ ID NO: 170268 - DNA, 20 bp, human
gccgacggcaggcccaccgc

SEQ ID NO: 170269 - DNA, 20 bp, human
ggcaggagcgggacgacccc

SEQ ID NO: 170270 - DNA, 20 bp, human
gcgtgccgggggctaactgg

SEQ ID NO: 170271 - DNA, 20 bp, human
ggacctcctaaatcaaagtt

SEQ ID NO: 170272 - DNA, 20 bp, human
ggaggcccgcgtgaccactg

SEQ ID NO: 170273 - DNA, 20 bp, human
gtgggcctgccgtcggatct

SEQ ID NO: 170274 - DNA, 20 bp, human
gctcctaaatcaaagttggg

SEQ ID NO: 170275 - DNA, 20 bp, human
gaagttgggcggcgaggact

SEQ ID NO: 170276 - DNA, 20 bp, human
gggcaggctgggacagaact

SEQ ID NO: 170277 - DNA, 20 bp, human
gtagctggtgtgaacacagg

SEQ ID NO: 170278 - DNA, 20 bp, human
gactaggcacagggccccca

SEQ ID NO: 170279 - DNA, 20 bp, human
gaggtctacaaatagcgact

SEQ ID NO: 170280 - DNA, 20 bp, human
gtctgtcccagcctgcctca

SEQ ID NO: 170281 - DNA, 20 bp, human
ggggctcaagaaaaaagtag

SEQ ID NO: 170282 - DNA, 20 bp, human
gtgaagggaatgaagtagta

SEQ ID NO: 170283 - DNA, 20 bp, human
gggaatgaagtagtaaggga

SEQ ID NO: 170284 - DNA, 20 bp, human
ggcctcctgccttggtgtca

SEQ ID NO: 170285 - DNA, 20 bp, human
ggtgaacacagggggtactg

SEQ ID NO: 170286 - DNA, 20 bp, human
gatcctaacccgccatctgg

SEQ ID NO: 170287 - DNA, 20 bp, human
gtgcccggagagacgtctgt

SEQ ID NO: 170288 - DNA, 20 bp, human
gagacgtctgtgggcgcggt

SEQ ID NO: 170289 - DNA, 20 bp, human
gcaccgcggccagcagaggg

SEQ ID NO: 170290 - DNA, 20 bp, human
gcgcccacagacgtctctcc

SEQ ID NO: 170291 - DNA, 20 bp, human
ggcgggggccgcgccttcaa

SEQ ID NO: 170292 - DNA, 20 bp, human
ggaaaatgccaccagatggc

SEQ ID NO: 170293 - DNA, 20 bp, human
gaagtctgcagcggcgccat

SEQ ID NO: 170294 - DNA, 20 bp, human
gcggccagcagagggcggtc

SEQ ID NO: 170295 - DNA, 20 bp, human
gtgccaccagatggcgggtt

SEQ ID NO: 170296 - DNA, 20 bp, human
gaactgctggggaaggcgat

SEQ ID NO: 170297 - DNA, 20 bp, human
gagtcgggcctcggaaggga

SEQ ID NO: 170298 - DNA, 20 bp, human
gcgcagatctccggatccag

SEQ ID NO: 170299 - DNA, 20 bp, human
gcgcgctggagatgatgggg

SEQ ID NO: 170300 - DNA, 20 bp, human
gccgaagtcgggcctcggaa

SEQ ID NO: 170301 - DNA, 20 bp, human
gcatctccagcgcgtggtgg

SEQ ID NO: 170302 - DNA, 20 bp, human
ggtgtggagtgaaaacgcac

SEQ ID NO: 170303 - DNA, 20 bp, human
gcgtggtgggggaactgctg

SEQ ID NO: 170304 - DNA, 20 bp, human
ggctggagatgatggggcgg

SEQ ID NO: 170305 - DNA, 20 bp, human
ggcatgggcggaggggggaa

SEQ ID NO: 170306 - DNA, 20 bp, human
ggtccctgagtagaattcga

SEQ ID NO: 170307 - DNA, 20 bp, human
gtcagggacggaagctcccg

SEQ ID NO: 170308 - DNA, 20 bp, human
gtagcgacttggggggagaa

SEQ ID NO: 170309 - DNA, 20 bp, human
gccccaccgctctagaaccg

SEQ ID NO: 170310 - DNA, 20 bp, human
gcaccctcgaattctactca

SEQ ID NO: 170311 - DNA, 20 bp, human
gattcgagggtgtaaagaag

SEQ ID NO: 170312 - DNA, 20 bp, human
ggttggggtagcgacttggg

SEQ ID NO: 170313 - DNA, 20 bp, human
gccatggctgccccccatgg

SEQ ID NO: 170314 - DNA, 20 bp, human
gtcccgcggttctagagcgg

SEQ ID NO: 170315 - DNA, 20 bp, human
gcccccctcagcgtacacag

SEQ ID NO: 170316 - DNA, 20 bp, human
gcccgccgctgcccttccgg

SEQ ID NO: 170317 - DNA, 20 bp, human
gtggaggcgccatgagaata

SEQ ID NO: 170318 - DNA, 20 bp, human
ggggcgcctgtgtggaaggt

SEQ ID NO: 170319 - DNA, 20 bp, human
ggaatctttcgcccccggaa

SEQ ID NO: 170320 - DNA, 20 bp, human
gcagggaaggtccccacctc

SEQ ID NO: 170321 - DNA, 20 bp, human
gttcgcccccggaagggcag

SEQ ID NO: 170322 - DNA, 20 bp, human
gacccgagggacctgaggtg

SEQ ID NO: 170323 - DNA, 20 bp, human
gccacctggaatggaacagg

SEQ ID NO: 170324 - DNA, 20 bp, human
gggtggccagagacacccga

SEQ ID NO: 170325 - DNA, 20 bp, human
ggcccccggaagggcagcgg

SEQ ID NO: 170326 - DNA, 20 bp, human
ggtaggatggaagactcctc

SEQ ID NO: 170327 - DNA, 20 bp, human
gaacagagaccgactctaca

SEQ ID NO: 170328 - DNA, 20 bp, human
ggtcgcggaccctgtagagt

SEQ ID NO: 170329 - DNA, 20 bp, human
gggccttgagctaggactgt

SEQ ID NO: 170330 - DNA, 20 bp, human
ggctgctgccgcggttggtg

SEQ ID NO: 170331 - DNA, 20 bp, human
gtgccgcggttggtggggtt

SEQ ID NO: 170332 - DNA, 20 bp, human
ggtgagcgtgcagtccggtg

SEQ ID NO: 170333 - DNA, 20 bp, human
ggggtcctgaatgcaggcag

SEQ ID NO: 170334 - DNA, 20 bp, human
gtcctgatcgaagggattgg

SEQ ID NO: 170335 - DNA, 20 bp, human
gacatcctgatcgaagggat

SEQ ID NO: 170336 - DNA, 20 bp, human
gctacccgccgggtgacccg

SEQ ID NO: 170337 - DNA, 20 bp, human
gggagcggtctagggagccg

SEQ ID NO: 170338 - DNA, 20 bp, human
ggcggccgcgggtcacccgg

SEQ ID NO: 170339 - DNA, 20 bp, human
ggacggaggccgaagcggag

SEQ ID NO: 170340 - DNA, 20 bp, human
gagctagacagcagcgacta

SEQ ID NO: 170341 - DNA, 20 bp, human
ggccgcggccgcgggtcacc

SEQ ID NO: 170342 - DNA, 20 bp, human
ggccgaagcggagcggtcta

SEQ ID NO: 170343 - DNA, 20 bp, human
gtgtccggctagaaagtggg

SEQ ID NO: 170344 - DNA, 20 bp, human
gaggggttggcggtgaacaa

SEQ ID NO: 170345 - DNA, 20 bp, human
gcacacagcagtccaggacc

SEQ ID NO: 170346 - DNA, 20 bp, human
gtcatccgcggggaaaggtg

SEQ ID NO: 170347 - DNA, 20 bp, human
gccccgcggatgacacccgg

SEQ ID NO: 170348 - DNA, 20 bp, human
gaagggtcccgggaacgtgg

SEQ ID NO: 170349 - DNA, 20 bp, human
gggaccgagggggaaatacg

SEQ ID NO: 170350 - DNA, 20 bp, human
ggcggcgtaaaggaccgagg

SEQ ID NO: 170351 - DNA, 20 bp, human
gccgagggggaaatacgagg

SEQ ID NO: 170352 - DNA, 20 bp, human
gggagggggcgtatacagta

SEQ ID NO: 170353 - DNA, 20 bp, human
gaacctccgggtgtcatccg

SEQ ID NO: 170354 - DNA, 20 bp, human
ggcaggccccacactcacgg

SEQ ID NO: 170355 - DNA, 20 bp, human
gcagggcctccgagcgtggt

SEQ ID NO: 170356 - DNA, 20 bp, human
gcacgggctgcggacaccaa

SEQ ID NO: 170357 - DNA, 20 bp, human
gcggcgcgcgccaggccacg

SEQ ID NO: 170358 - DNA, 20 bp, human
gcacggccgaggcaaacgag

SEQ ID NO: 170359 - DNA, 20 bp, human
gtctccaaggctgcaaccca

SEQ ID NO: 170360 - DNA, 20 bp, human
gggccacacggcagccacgg

SEQ ID NO: 170361 - DNA, 20 bp, human
gcgttgcagcggggtgatac

SEQ ID NO: 170362 - DNA, 20 bp, human
gtgagagcgcgcaccggacg

SEQ ID NO: 170363 - DNA, 20 bp, human
gcgggaccggacgctgccag

SEQ ID NO: 170364 - DNA, 20 bp, human
gccggacgctgccagcggaa

SEQ ID NO: 170365 - DNA, 20 bp, human
gggtcggccggcctgcgcgt

SEQ ID NO: 170366 - DNA, 20 bp, human
gaggttttttattaatcaag

SEQ ID NO: 170367 - DNA, 20 bp, human
gatcaagcggtcaggatacc

SEQ ID NO: 170368 - DNA, 20 bp, human
gaacagaggttgtaatatta

SEQ ID NO: 170369 - DNA, 20 bp, human
ggccatcatacccctctctt

SEQ ID NO: 170370 - DNA, 20 bp, human
gtcctggaagatcctgcgag

SEQ ID NO: 170371 - DNA, 20 bp, human
gataatatgtataataacag

SEQ ID NO: 170372 - DNA, 20 bp, human
gctctctttggtgtgtggtt

SEQ ID NO: 170373 - DNA, 20 bp, human
gaccaaagagaggggtatga

SEQ ID NO: 170374 - DNA, 20 bp, human
gtacccctctctttggtgtg

SEQ ID NO: 170375 - DNA, 20 bp, human
gtgccttttcctctcacaga

SEQ ID NO: 170376 - DNA, 20 bp, human
gacatcgggagagacagacg

SEQ ID NO: 170377 - DNA, 20 bp, human
gagctggggcacccactgga

SEQ ID NO: 170378 - DNA, 20 bp, human
ggaagaccctggctccgtca

SEQ ID NO: 170379 - DNA, 20 bp, human
gccttaggcttggggacacg

SEQ ID NO: 170380 - DNA, 20 bp, human
gcctgtgaccgggtaaggtg

SEQ ID NO: 170381 - DNA, 20 bp, human
gtaggcttggggacacgggg

SEQ ID NO: 170382 - DNA, 20 bp, human
gggagccagggtcttccgcc

SEQ ID NO: 170383 - DNA, 20 bp, human
gctccccactcgccaagggg

SEQ ID NO: 170384 - DNA, 20 bp, human
ggtgccgcagctccccacgg

SEQ ID NO: 170385 - DNA, 20 bp, human
ggtgaaggcaggacaccctt

SEQ ID NO: 170386 - DNA, 20 bp, human
gaaagattggagtcctggag

SEQ ID NO: 170387 - DNA, 20 bp, human
ggacgcagaacaccaggtcc

SEQ ID NO: 170388 - DNA, 20 bp, human
gcccaggttcacccagtaag

SEQ ID NO: 170389 - DNA, 20 bp, human
gaagggtgagcgctgcggga

SEQ ID NO: 170390 - DNA, 20 bp, human
gggccagctctcagcggatg

SEQ ID NO: 170391 - DNA, 20 bp, human
gtgcgggaaggaggcgatga

SEQ ID NO: 170392 - DNA, 20 bp, human
gcacaactaggatcagaatt

SEQ ID NO: 170393 - DNA, 20 bp, human
gttttcccctcggaagaagt

SEQ ID NO: 170394 - DNA, 20 bp, human
ggaaggaggcgatgaggggt

SEQ ID NO: 170395 - DNA, 20 bp, human
ggactcagaggcgaagcttg

SEQ ID NO: 170396 - DNA, 20 bp, human
gcggcgtggggactgcgtat

SEQ ID NO: 170397 - DNA, 20 bp, human
ggccagtccctgggtcccga

SEQ ID NO: 170398 - DNA, 20 bp, human
gcccccagcctagccgggag

SEQ ID NO: 170399 - DNA, 20 bp, human
gcccgtcgggacccagggac

SEQ ID NO: 170400 - DNA, 20 bp, human
ggggcgcccgtcgggaccca

SEQ ID NO: 170401 - DNA, 20 bp, human
gtctcctgggtcctccgcgg

SEQ ID NO: 170402 - DNA, 20 bp, human
ggactgcgtatgggacgcgg

SEQ ID NO: 170403 - DNA, 20 bp, human
gcagctgcccgggagacccg

SEQ ID NO: 170404 - DNA, 20 bp, human
gggctccgacaacgtcgacg

SEQ ID NO: 170405 - DNA, 20 bp, human
gcctcggggtccccctcccg

SEQ ID NO: 170406 - DNA, 20 bp, human
ggacagacggcaacagccac

SEQ ID NO: 170407 - DNA, 20 bp, human
gggcacctgactgaacatct

SEQ ID NO: 170408 - DNA, 20 bp, human
ggggtctgttgagctgtcct

SEQ ID NO: 170409 - DNA, 20 bp, human
gtgccacctcagtctgcctg

SEQ ID NO: 170410 - DNA, 20 bp, human
ggaatccggctcatcctgta

SEQ ID NO: 170411 - DNA, 20 bp, human
gttcaaagttacgggtagtg

SEQ ID NO: 170412 - DNA, 20 bp, human
ggtgagtggccggcagtgga

SEQ ID NO: 170413 - DNA, 20 bp, human
gctgatggcgtgctagaatc

SEQ ID NO: 170414 - DNA, 20 bp, human
gcaaggtgagtggccggcag

SEQ ID NO: 170415 - DNA, 20 bp, human
gctgttgagctgtcctgggc

SEQ ID NO: 170416 - DNA, 20 bp, human
gcctcagtagcgcctcagag

SEQ ID NO: 170417 - DNA, 20 bp, human
gcaaccgcagtccggctccg

SEQ ID NO: 170418 - DNA, 20 bp, human
gtgaggcgctactgaggccg

SEQ ID NO: 170419 - DNA, 20 bp, human
gggggaggggtcggaatctg

SEQ ID NO: 170420 - DNA, 20 bp, human
gtccatgtcagccacggccc

SEQ ID NO: 170421 - DNA, 20 bp, human
gtcccgccccaaccgcagtc

SEQ ID NO: 170422 - DNA, 20 bp, human
gctctcgggggcggactcag

SEQ ID NO: 170423 - DNA, 20 bp, human
gacctgctccatgtcagcca

SEQ ID NO: 170424 - DNA, 20 bp, human
gctcccctcagttaagacgg

SEQ ID NO: 170425 - DNA, 20 bp, human
ggttggggcgggaagagccg

SEQ ID NO: 170426 - DNA, 20 bp, human
ggaaacccagcctaccttaa

SEQ ID NO: 170427 - DNA, 20 bp, human
ggtcctgcgcgagcctccag

SEQ ID NO: 170428 - DNA, 20 bp, human
gccctgaggagtccccggtg

SEQ ID NO: 170429 - DNA, 20 bp, human
gcccagcctaccttaacggg

SEQ ID NO: 170430 - DNA, 20 bp, human
gcccaagaaggaccaagaat

SEQ ID NO: 170431 - DNA, 20 bp, human
ggcgtgggttgtccagacac

SEQ ID NO: 170432 - DNA, 20 bp, human
gggccaggaaccacccgtta

SEQ ID NO: 170433 - DNA, 20 bp, human
gcccgggaactgcggatccg

SEQ ID NO: 170434 - DNA, 20 bp, human
gaggaaccacccgttaaggt

SEQ ID NO: 170435 - DNA, 20 bp, human
ggtgactgggtgtaatgcgt

SEQ ID NO: 170436 - DNA, 20 bp, human
gccagcggtgacttacaagt

SEQ ID NO: 170437 - DNA, 20 bp, human
gtccagttggctgcgaccag

SEQ ID NO: 170438 - DNA, 20 bp, human
gctgaggtgaagcaaggacg

SEQ ID NO: 170439 - DNA, 20 bp, human
ggctgctgtcgcctgcgcat

SEQ ID NO: 170440 - DNA, 20 bp, human
gtgagcagtactgttgagag

SEQ ID NO: 170441 - DNA, 20 bp, human
gaaggacgtggaagcagcta

SEQ ID NO: 170442 - DNA, 20 bp, human
ggctgtcgcctgcgcatcgg

SEQ ID NO: 170443 - DNA, 20 bp, human
gataggtgagcggcgcgcag

SEQ ID NO: 170444 - DNA, 20 bp, human
gtcccggcccgccgatgcgc

SEQ ID NO: 170445 - DNA, 20 bp, human
gcaggtccagaagacgcacc

SEQ ID NO: 170446 - DNA, 20 bp, human
ggccacagcctcgctcatct

SEQ ID NO: 170447 - DNA, 20 bp, human
ggctcccgacgcaatggacc

SEQ ID NO: 170448 - DNA, 20 bp, human
ggcgccgggtccattgcgtc

SEQ ID NO: 170449 - DNA, 20 bp, human
gagcgcagctcccgacgcaa

SEQ ID NO: 170450 - DNA, 20 bp, human
gtcgcgggtgttatgagcgg

SEQ ID NO: 170451 - DNA, 20 bp, human
gctggcagcccagatgagcg

SEQ ID NO: 170452 - DNA, 20 bp, human
gccctctcaatcgggtccag

SEQ ID NO: 170453 - DNA, 20 bp, human
gcgagaagatgctccagtac

SEQ ID NO: 170454 - DNA, 20 bp, human
gcatctgggctgccagcgcc

SEQ ID NO: 170455 - DNA, 20 bp, human
ggaagatgctccagtaccgg

SEQ ID NO: 170456 - DNA, 20 bp, human
gacttcttgggcagtttgtt

SEQ ID NO: 170457 - DNA, 20 bp, human
gtgcagatagatggacttca

SEQ ID NO: 170458 - DNA, 20 bp, human
ggttataatcgagatacatc

SEQ ID NO: 170459 - DNA, 20 bp, human
gtaatcgagatacatcaggc

SEQ ID NO: 170460 - DNA, 20 bp, human
gtagccagtacactacagac

SEQ ID NO: 170461 - DNA, 20 bp, human
gaagataactgtttccagta

SEQ ID NO: 170462 - DNA, 20 bp, human
gtttgacagctaattatttg

SEQ ID NO: 170463 - DNA, 20 bp, human
gagttatctttttctcaaag

SEQ ID NO: 170464 - DNA, 20 bp, human
gataattagctgtcaaatgc

SEQ ID NO: 170465 - DNA, 20 bp, human
gttttctgttccaggtgcag

SEQ ID NO: 170466 - DNA, 20 bp, human
gcgggcgcgagcggagatga

SEQ ID NO: 170467 - DNA, 20 bp, human
gggatgctctggaagcgggg

SEQ ID NO: 170468 - DNA, 20 bp, human
ggctgtgacggaggttggaa

SEQ ID NO: 170469 - DNA, 20 bp, human
ggtgcgcatgcgcggcagtg

SEQ ID NO: 170470 - DNA, 20 bp, human
gtggaaaaactggagctgtg

SEQ ID NO: 170471 - DNA, 20 bp, human
ggcaggccggcgccatgttg

SEQ ID NO: 170472 - DNA, 20 bp, human
gttgtgtgtgagaggctccg

SEQ ID NO: 170473 - DNA, 20 bp, human
gtggccgagaatagctgtga

SEQ ID NO: 170474 - DNA, 20 bp, human
gggtcgcgacccctgctgga

SEQ ID NO: 170475 - DNA, 20 bp, human
gagaggctccggggtgtgag

SEQ ID NO: 170476 - DNA, 20 bp, human
gctcctcggcgacctccagc

SEQ ID NO: 170477 - DNA, 20 bp, human
ggtgcctggtgtagcagtcg

SEQ ID NO: 170478 - DNA, 20 bp, human
gaggtcgccgaggagccaca

SEQ ID NO: 170479 - DNA, 20 bp, human
ggcgcaggcccgtgacgaag

SEQ ID NO: 170480 - DNA, 20 bp, human
ggcgtgagctctcggagtag

SEQ ID NO: 170481 - DNA, 20 bp, human
gtggcagtcgcggaaggcgc

SEQ ID NO: 170482 - DNA, 20 bp, human
gtgaccgactctcccctcag

SEQ ID NO: 170483 - DNA, 20 bp, human
gaggcggcatgctcccgcgg

SEQ ID NO: 170484 - DNA, 20 bp, human
gaacgccgccatcaaggcag

SEQ ID NO: 170485 - DNA, 20 bp, human
gcgcgtgtggcagtcgcgga

SEQ ID NO: 170486 - DNA, 20 bp, human
gcatgagccggccccgcgag

SEQ ID NO: 170487 - DNA, 20 bp, human
gcggagagcagcggttgccg

SEQ ID NO: 170488 - DNA, 20 bp, human
gcgggaggcgcccgctgtcg

SEQ ID NO: 170489 - DNA, 20 bp, human
gaagatccaggaagcaacag

SEQ ID NO: 170490 - DNA, 20 bp, human
gagaactggttaagtgacaa

SEQ ID NO: 170491 - DNA, 20 bp, human
gtggccttccaggaggcggg

SEQ ID NO: 170492 - DNA, 20 bp, human
gcccatcccgctgctcaggg

SEQ ID NO: 170493 - DNA, 20 bp, human
ggcgcctcccgcctcctgga

SEQ ID NO: 170494 - DNA, 20 bp, human
gctcatggagcgcagggacc

SEQ ID NO: 170495 - DNA, 20 bp, human
gacgtccagcagaggcatgg

SEQ ID NO: 170496 - DNA, 20 bp, human
gggagtacccatgaggactg

SEQ ID NO: 170497 - DNA, 20 bp, human
ggagctgacccgctggactt

SEQ ID NO: 170498 - DNA, 20 bp, human
gtgccacaacccaagtccag

SEQ ID NO: 170499 - DNA, 20 bp, human
gacccgctggacttgggttg

SEQ ID NO: 170500 - DNA, 20 bp, human
gcgccagcgacgctcaccca

SEQ ID NO: 170501 - DNA, 20 bp, human
gattcagcctcagtcctcat

SEQ ID NO: 170502 - DNA, 20 bp, human
gcgggttgggcctttgagaa

SEQ ID NO: 170503 - DNA, 20 bp, human
ggggcttgggagtacccatg

SEQ ID NO: 170504 - DNA, 20 bp, human
gcaggagtttcgagggacgg

SEQ ID NO: 170505 - DNA, 20 bp, human
gctgccagcaggagtttcga

SEQ ID NO: 170506 - DNA, 20 bp, human
ggcaggaaagcgaaactacc

SEQ ID NO: 170507 - DNA, 20 bp, human
gctgcgcagagtctgcggag

SEQ ID NO: 170508 - DNA, 20 bp, human
gctgccaggcgcgatccccc

SEQ ID NO: 170509 - DNA, 20 bp, human
gctgcgcgcaggatccggaa

SEQ ID NO: 170510 - DNA, 20 bp, human
gggggctcggctgcaccggg

SEQ ID NO: 170511 - DNA, 20 bp, human
gaactacccggcaggagaaa

SEQ ID NO: 170512 - DNA, 20 bp, human
gcccggcacccggaacctca

SEQ ID NO: 170513 - DNA, 20 bp, human
ggacccagcgcgctcgggag

SEQ ID NO: 170514 - DNA, 20 bp, human
gcagaccccagaccgagcag

SEQ ID NO: 170515 - DNA, 20 bp, human
gaaagtgacggtaaatggga

SEQ ID NO: 170516 - DNA, 20 bp, human
gcgcgaccagagccattgga

SEQ ID NO: 170517 - DNA, 20 bp, human
gccgagctcatactagggac

SEQ ID NO: 170518 - DNA, 20 bp, human
gagtacccgagctcatacta

SEQ ID NO: 170519 - DNA, 20 bp, human
gcagtccccgcgccctccaa

SEQ ID NO: 170520 - DNA, 20 bp, human
gcagggcccgtacctgatta

SEQ ID NO: 170521 - DNA, 20 bp, human
gaagtcgcgaccagagccat

SEQ ID NO: 170522 - DNA, 20 bp, human
gccgcgccctccaatggctc

SEQ ID NO: 170523 - DNA, 20 bp, human
gggggactgcaaccctaatc

SEQ ID NO: 170524 - DNA, 20 bp, human
ggctggacagaagaagatcg

SEQ ID NO: 170525 - DNA, 20 bp, human
gtcaggtacgggccctgaga

SEQ ID NO: 170526 - DNA, 20 bp, human
gccagggagcaggaaatcgg

SEQ ID NO: 170527 - DNA, 20 bp, human
gggatcctggacaggcaccc

SEQ ID NO: 170528 - DNA, 20 bp, human
gagggcctctccgagccgag

SEQ ID NO: 170529 - DNA, 20 bp, human
ggttgcggcggcaggagtga

SEQ ID NO: 170530 - DNA, 20 bp, human
gccccaaccggatcctggac

SEQ ID NO: 170531 - DNA, 20 bp, human
gcgctcgagggggcaccgtg

SEQ ID NO: 170532 - DNA, 20 bp, human
gacaggagcgggcctcggaa

SEQ ID NO: 170533 - DNA, 20 bp, human
gtcacgccgacggggatcac

SEQ ID NO: 170534 - DNA, 20 bp, human
ggcgagggcgcactcggttg

SEQ ID NO: 170535 - DNA, 20 bp, human
gtggcgctgtctctccccct

SEQ ID NO: 170536 - DNA, 20 bp, human
gcctagcgctctctcagcac

SEQ ID NO: 170537 - DNA, 20 bp, human
gcgtgccagggcgcatctgt

SEQ ID NO: 170538 - DNA, 20 bp, human
gcccgcagggagattcgccc

SEQ ID NO: 170539 - DNA, 20 bp, human
gccatcaaagccacagtcac

SEQ ID NO: 170540 - DNA, 20 bp, human
ggcacaggaaagcctcaagt

SEQ ID NO: 170541 - DNA, 20 bp, human
gctacggcagccggtgactg

SEQ ID NO: 170542 - DNA, 20 bp, human
gctactgatgatggcgtcag

SEQ ID NO: 170543 - DNA, 20 bp, human
gcgtcagcggctttctccta

SEQ ID NO: 170544 - DNA, 20 bp, human
gccgcggagaacccgtgcca

SEQ ID NO: 170545 - DNA, 20 bp, human
gtttctcctagggactgtga

SEQ ID NO: 170546 - DNA, 20 bp, human
gcctcataagtaactaggct

SEQ ID NO: 170547 - DNA, 20 bp, human
gcatctaaactcaaccctga

SEQ ID NO: 170548 - DNA, 20 bp, human
gggcactagtgcacagatgg

SEQ ID NO: 170549 - DNA, 20 bp, human
gcacgacggctcccactcga

SEQ ID NO: 170550 - DNA, 20 bp, human
gacttgggcgctcccctctt

SEQ ID NO: 170551 - DNA, 20 bp, human
ggacaggggtcggggatgaa

SEQ ID NO: 170552 - DNA, 20 bp, human
gtgggggagcagccgaagag

SEQ ID NO: 170553 - DNA, 20 bp, human
ggtcctggcacgcctcggag

SEQ ID NO: 170554 - DNA, 20 bp, human
gcagaaaccgggcccgaggt

SEQ ID NO: 170555 - DNA, 20 bp, human
gccgcggtccagggataggt

SEQ ID NO: 170556 - DNA, 20 bp, human
ggcgcccgaggggccgagcg

SEQ ID NO: 170557 - DNA, 20 bp, human
gcggccggagccgtcacccc

SEQ ID NO: 170558 - DNA, 20 bp, human
ggaccccgcgccgaccccat

SEQ ID NO: 170559 - DNA, 20 bp, human
gggaggctgagggcaatgcg

SEQ ID NO: 170560 - DNA, 20 bp, human
ggcggcgcggccctgacggg

SEQ ID NO: 170561 - DNA, 20 bp, human
gcggagccgtcaccccgggc

SEQ ID NO: 170562 - DNA, 20 bp, human
gcagcgcaggcaactccgcg

SEQ ID NO: 170563 - DNA, 20 bp, human
gcgcggcccgggagtgatgg

SEQ ID NO: 170564 - DNA, 20 bp, human
gccgggcggggacccagcgc

SEQ ID NO: 170565 - DNA, 20 bp, human
gccctgagctcctatggggt

SEQ ID NO: 170566 - DNA, 20 bp, human
gctgcttacactgaagaggg

SEQ ID NO: 170567 - DNA, 20 bp, human
gcggaggcaacccctcacct

SEQ ID NO: 170568 - DNA, 20 bp, human
gaggagaagccggaaacagc

SEQ ID NO: 170569 - DNA, 20 bp, human
gggacagagctacagaccta

SEQ ID NO: 170570 - DNA, 20 bp, human
gggaccatccacccagccag

SEQ ID NO: 170571 - DNA, 20 bp, human
gagccggaaacagcgggctg

SEQ ID NO: 170572 - DNA, 20 bp, human
ggtgaaaacgtgacccatgg

SEQ ID NO: 170573 - DNA, 20 bp, human
gccactgcttacactgaaga

SEQ ID NO: 170574 - DNA, 20 bp, human
gtggaagtgcccgctgagaa

SEQ ID NO: 170575 - DNA, 20 bp, human
ggtggatggtccccaagaga

SEQ ID NO: 170576 - DNA, 20 bp, human
gtatttccttgtctacgtac

SEQ ID NO: 170577 - DNA, 20 bp, human
gtagtctcatcttgagtaaa

SEQ ID NO: 170578 - DNA, 20 bp, human
gagatgccagtacgtagaca

SEQ ID NO: 170579 - DNA, 20 bp, human
ggatgatgtgctaccctaga

SEQ ID NO: 170580 - DNA, 20 bp, human
ggagaaatgatgaccttctt

SEQ ID NO: 170581 - DNA, 20 bp, human
gaaatatgaacttcgaataa

SEQ ID NO: 170582 - DNA, 20 bp, human
gttaccttcagatcctaaga

SEQ ID NO: 170583 - DNA, 20 bp, human
gttaaatacattggccctct

SEQ ID NO: 170584 - DNA, 20 bp, human
gtgaccttcttaggatctga

SEQ ID NO: 170585 - DNA, 20 bp, human
ggttccatcaggagagaagt

SEQ ID NO: 170586 - DNA, 20 bp, human
gctgctccgagctcgtcccc

SEQ ID NO: 170587 - DNA, 20 bp, human
ggcgggagccgagagagacg

SEQ ID NO: 170588 - DNA, 20 bp, human
ggcggctgccgcgtctctct

SEQ ID NO: 170589 - DNA, 20 bp, human
ggggaggcggtcaaaggaag

SEQ ID NO: 170590 - DNA, 20 bp, human
gtcagggcgccccgaggcga

SEQ ID NO: 170591 - DNA, 20 bp, human
ggtgccacaaacaggtgctg

SEQ ID NO: 170592 - DNA, 20 bp, human
gcctcaccggtgccacaaac

SEQ ID NO: 170593 - DNA, 20 bp, human
gggccccgcgggctagagag

SEQ ID NO: 170594 - DNA, 20 bp, human
gaaacgctgaagagccgctc

SEQ ID NO: 170595 - DNA, 20 bp, human
gagcccggcaggaagtgacg

SEQ ID NO: 170596 - DNA, 20 bp, human
gaggaggccgggccaagtgg

SEQ ID NO: 170597 - DNA, 20 bp, human
ggtggtagcggccggaagag

SEQ ID NO: 170598 - DNA, 20 bp, human
gggcgagtgcagccacggtg

SEQ ID NO: 170599 - DNA, 20 bp, human
gaggtaaataccctcatcgg

SEQ ID NO: 170600 - DNA, 20 bp, human
gtcccggacgcccccgatga

SEQ ID NO: 170601 - DNA, 20 bp, human
ggggaggctggggttctagg

SEQ ID NO: 170602 - DNA, 20 bp, human
gggtcggggagacaggaacg

SEQ ID NO: 170603 - DNA, 20 bp, human
gccacccttggcagacgagg

SEQ ID NO: 170604 - DNA, 20 bp, human
gttgcagacggctccaacat

SEQ ID NO: 170605 - DNA, 20 bp, human
gacgacacaggtgtcctgag

SEQ ID NO: 170606 - DNA, 20 bp, human
ggcggccgcaggagactaca

SEQ ID NO: 170607 - DNA, 20 bp, human
gaccagcagggcggaccaga

SEQ ID NO: 170608 - DNA, 20 bp, human
gaccagcctgggaaaccgag

SEQ ID NO: 170609 - DNA, 20 bp, human
gcagtccctgtagtctcctg

SEQ ID NO: 170610 - DNA, 20 bp, human
ggacggcgcccatggctgag

SEQ ID NO: 170611 - DNA, 20 bp, human
gccccctccaaccagcaggg

SEQ ID NO: 170612 - DNA, 20 bp, human
ggcgcgggcgctgagggact

SEQ ID NO: 170613 - DNA, 20 bp, human
gagaccccctccaaccagca

SEQ ID NO: 170614 - DNA, 20 bp, human
ggcggaccagacggcgccca

SEQ ID NO: 170615 - DNA, 20 bp, human
gactacagggactgggaccg

SEQ ID NO: 170616 - DNA, 20 bp, human
ggcagcagcggaggcaccgg

SEQ ID NO: 170617 - DNA, 20 bp, human
gagccccaggaaatcccgag

SEQ ID NO: 170618 - DNA, 20 bp, human
gtaagcagcaaacccaagag

SEQ ID NO: 170619 - DNA, 20 bp, human
gacacagttgcaaaagggag

SEQ ID NO: 170620 - DNA, 20 bp, human
gcccaggaaatcccgagtgg

SEQ ID NO: 170621 - DNA, 20 bp, human
ggagtggcggctcaaaactc

SEQ ID NO: 170622 - DNA, 20 bp, human
gtcgctgcttcttgcacctc

SEQ ID NO: 170623 - DNA, 20 bp, human
gcttcactcaagccaggaga

SEQ ID NO: 170624 - DNA, 20 bp, human
gatccctgggtgcagctctt

SEQ ID NO: 170625 - DNA, 20 bp, human
gtgggggagaaaccgctctt

SEQ ID NO: 170626 - DNA, 20 bp, human
gcccgcagccgggagctact

SEQ ID NO: 170627 - DNA, 20 bp, human
ggcgccctcccgtagctctc

SEQ ID NO: 170628 - DNA, 20 bp, human
gctctccggagagctacggg

SEQ ID NO: 170629 - DNA, 20 bp, human
ggcggccgcggctcggatag

SEQ ID NO: 170630 - DNA, 20 bp, human
gagtttgcgtggccctgggt

SEQ ID NO: 170631 - DNA, 20 bp, human
ggcactcgcggcgctgctaa

SEQ ID NO: 170632 - DNA, 20 bp, human
gctccggagagcatgtgacc

SEQ ID NO: 170633 - DNA, 20 bp, human
gcgccgcgagtgcccggcaa

SEQ ID NO: 170634 - DNA, 20 bp, human
gggcctggtcacatgctctc

SEQ ID NO: 170635 - DNA, 20 bp, human
gagccgggagctactgggag

SEQ ID NO: 170636 - DNA, 20 bp, human
gccgcacctctgggcagcag

SEQ ID NO: 170637 - DNA, 20 bp, human
gtcaagctaaggcgaagagt

SEQ ID NO: 170638 - DNA, 20 bp, human
gggctgccgctgctgcccag

SEQ ID NO: 170639 - DNA, 20 bp, human
gcgcgtggggcccgcacctc

SEQ ID NO: 170640 - DNA, 20 bp, human
gcgcctgagcctccagagcg

SEQ ID NO: 170641 - DNA, 20 bp, human
gccccagagccgcgcataag

SEQ ID NO: 170642 - DNA, 20 bp, human
gacaacccagctgggctgga

SEQ ID NO: 170643 - DNA, 20 bp, human
ggagcctccaagccagctgc

SEQ ID NO: 170644 - DNA, 20 bp, human
ggggagagccagggactcac

SEQ ID NO: 170645 - DNA, 20 bp, human
gttagcttgaccgtgagtct

SEQ ID NO: 170646 - DNA, 20 bp, human
ggcgtggggccggcacctcc

SEQ ID NO: 170647 - DNA, 20 bp, human
ggtcaagctacggcgaggag

SEQ ID NO: 170648 - DNA, 20 bp, human
gtcacggtcaagctacggcg

SEQ ID NO: 170649 - DNA, 20 bp, human
gaagcctccaagcctgctgc

SEQ ID NO: 170650 - DNA, 20 bp, human
ggggggagccagggactcag

SEQ ID NO: 170651 - DNA, 20 bp, human
gccagctgggctggaagaca

SEQ ID NO: 170652 - DNA, 20 bp, human
ggagtagggccagtgttcta

SEQ ID NO: 170653 - DNA, 20 bp, human
gacactggccctactctttc

SEQ ID NO: 170654 - DNA, 20 bp, human
gggcggccctcctgggcgag

SEQ ID NO: 170655 - DNA, 20 bp, human
gcttctcgtgacctggacgg

SEQ ID NO: 170656 - DNA, 20 bp, human
gggactgcacctccgactgg

SEQ ID NO: 170657 - DNA, 20 bp, human
gggagcgcgaaagaaggtag

SEQ ID NO: 170658 - DNA, 20 bp, human
gtacggactgcacctccgac

SEQ ID NO: 170659 - DNA, 20 bp, human
gccctgcaaccgccagtcgg

SEQ ID NO: 170660 - DNA, 20 bp, human
gagctggagtgcgaccgccg

SEQ ID NO: 170661 - DNA, 20 bp, human
gagcggcgccgactccccaa

SEQ ID NO: 170662 - DNA, 20 bp, human
ggaggaggagggggaatcag

SEQ ID NO: 170663 - DNA, 20 bp, human
gcggtgagggcgcagaatcg

SEQ ID NO: 170664 - DNA, 20 bp, human
gtgtcccagcaggaaaggac

SEQ ID NO: 170665 - DNA, 20 bp, human
ggtagcagggagactatcaa

SEQ ID NO: 170666 - DNA, 20 bp, human
gcgcccggcggcagagaaac

SEQ ID NO: 170667 - DNA, 20 bp, human
ggcaaccgggcgggcgtctc

SEQ ID NO: 170668 - DNA, 20 bp, human
gccgccgctcggagcgaccg

SEQ ID NO: 170669 - DNA, 20 bp, human
ggagggtacactcacctctg

SEQ ID NO: 170670 - DNA, 20 bp, human
gcggctgcgaagggactggg

SEQ ID NO: 170671 - DNA, 20 bp, human
gtggccagcggtcccaaagg

SEQ ID NO: 170672 - DNA, 20 bp, human
gtagggaaggaaggcacacg

SEQ ID NO: 170673 - DNA, 20 bp, human
ggtcccttcgcagccgaaca

SEQ ID NO: 170674 - DNA, 20 bp, human
gggcgcagcacgcagccccg

SEQ ID NO: 170675 - DNA, 20 bp, human
gacaggtcccgtgtgcccca

SEQ ID NO: 170676 - DNA, 20 bp, human
gctccaaggtctcagatccg

SEQ ID NO: 170677 - DNA, 20 bp, human
gaggaagcgtccagcgccaa

SEQ ID NO: 170678 - DNA, 20 bp, human
gagtgacccacctgagggag

SEQ ID NO: 170679 - DNA, 20 bp, human
gtgagggagaggcgcttcca

SEQ ID NO: 170680 - DNA, 20 bp, human
gggggcgcccatcaaaaagt

SEQ ID NO: 170681 - DNA, 20 bp, human
gggcccgcggcgcgcaccgt

SEQ ID NO: 170682 - DNA, 20 bp, human
ggggagaggcgcttccaagg

SEQ ID NO: 170683 - DNA, 20 bp, human
gcgcgggccgggcgggtaga

SEQ ID NO: 170684 - DNA, 20 bp, human
ggcgaaaagtgacccacctg

SEQ ID NO: 170685 - DNA, 20 bp, human
gaagcgcctctccctcaggt

SEQ ID NO: 170686 - DNA, 20 bp, human
gtcactcatggcccagacta

SEQ ID NO: 170687 - DNA, 20 bp, human
gatggtgacgtcataacctg

SEQ ID NO: 170688 - DNA, 20 bp, human
ggatgaactcagggtcaaca

SEQ ID NO: 170689 - DNA, 20 bp, human
gcctgactctcacccctcat

SEQ ID NO: 170690 - DNA, 20 bp, human
gtcatgccaagtgtagaaag

SEQ ID NO: 170691 - DNA, 20 bp, human
ggaatcatccactcacacag

SEQ ID NO: 170692 - DNA, 20 bp, human
ggtctgctgctccctagtct

SEQ ID NO: 170693 - DNA, 20 bp, human
gcccctcatgggcagaggca

SEQ ID NO: 170694 - DNA, 20 bp, human
ggttatgacgtcaccatgct

SEQ ID NO: 170695 - DNA, 20 bp, human
gccctgagttcatctgaggt

SEQ ID NO: 170696 - DNA, 20 bp, human
gccccgcctctgggacgttg

SEQ ID NO: 170697 - DNA, 20 bp, human
gccagaggcggggccggagt

SEQ ID NO: 170698 - DNA, 20 bp, human
gcgcgaccccaacgtcccag

SEQ ID NO: 170699 - DNA, 20 bp, human
gggagcgccaccgccgactc

SEQ ID NO: 170700 - DNA, 20 bp, human
gctgtttgcagggtaggagc

SEQ ID NO: 170701 - DNA, 20 bp, human
ggagggcggaacccactaca

SEQ ID NO: 170702 - DNA, 20 bp, human
ggtgtgagccagaaattgtg

SEQ ID NO: 170703 - DNA, 20 bp, human
gtgacgagaaggggagctag

SEQ ID NO: 170704 - DNA, 20 bp, human
gcgcaacttccgcggagctg

SEQ ID NO: 170705 - DNA, 20 bp, human
gaccccaacgtcccagaggc

SEQ ID NO: 170706 - DNA, 20 bp, human
gaggcgacaacagcctgacc

SEQ ID NO: 170707 - DNA, 20 bp, human
gccagcaggcggacgcacac

SEQ ID NO: 170708 - DNA, 20 bp, human
ggtctccgcgggcacagaag

SEQ ID NO: 170709 - DNA, 20 bp, human
gtctagagctgtctaaacag

SEQ ID NO: 170710 - DNA, 20 bp, human
gggctcctcaggtccaacag

SEQ ID NO: 170711 - DNA, 20 bp, human
gtccaacagtgggtccgccg

SEQ ID NO: 170712 - DNA, 20 bp, human
gggacccactgttggacctg

SEQ ID NO: 170713 - DNA, 20 bp, human
ggcctgggcacgggactggg

SEQ ID NO: 170714 - DNA, 20 bp, human
ggccccggcggacccactgt

SEQ ID NO: 170715 - DNA, 20 bp, human
ggccgcctgggcacgggact

SEQ ID NO: 170716 - DNA, 20 bp, human
gatagcccggcgctcatgac

SEQ ID NO: 170717 - DNA, 20 bp, human
ggcctccggagctctgatcc

SEQ ID NO: 170718 - DNA, 20 bp, human
ggccgggatcagagctccgg

SEQ ID NO: 170719 - DNA, 20 bp, human
gggacccccaacccgtgcag

SEQ ID NO: 170720 - DNA, 20 bp, human
gctggtcccatcggcaccgg

SEQ ID NO: 170721 - DNA, 20 bp, human
gtcagacacgggctcccgcc

SEQ ID NO: 170722 - DNA, 20 bp, human
gggaggccgccggtgccgat

SEQ ID NO: 170723 - DNA, 20 bp, human
ggggctcggccggcagcgat

SEQ ID NO: 170724 - DNA, 20 bp, human
gggtggggggtagaaaggta

SEQ ID NO: 170725 - DNA, 20 bp, human
ggctgggccaggagtcgagg

SEQ ID NO: 170726 - DNA, 20 bp, human
gcggtggccaggccgcggta

SEQ ID NO: 170727 - DNA, 20 bp, human
gtccatagcgcagcgcggtc

SEQ ID NO: 170728 - DNA, 20 bp, human
gggtcccggtagcttctagt

SEQ ID NO: 170729 - DNA, 20 bp, human
gccctgaaggcgtcccgagg

SEQ ID NO: 170730 - DNA, 20 bp, human
gtctagtaggttccagaagg

SEQ ID NO: 170731 - DNA, 20 bp, human
gtgcggttgggaacgcggag

SEQ ID NO: 170732 - DNA, 20 bp, human
gggacggattcgattcaacg

SEQ ID NO: 170733 - DNA, 20 bp, human
gtccggaccgcgctgcgcta

SEQ ID NO: 170734 - DNA, 20 bp, human
ggcggctgcgggccatgttg

SEQ ID NO: 170735 - DNA, 20 bp, human
gctcgtggctaagtcccgag

SEQ ID NO: 170736 - DNA, 20 bp, human
gcccagggcacacttgaccg

SEQ ID NO: 170737 - DNA, 20 bp, human
gggcacacttgaccgaggtc

SEQ ID NO: 170738 - DNA, 20 bp, human
gggtagacaggcgcaggatg

SEQ ID NO: 170739 - DNA, 20 bp, human
ggagccaggctggccgggtc

SEQ ID NO: 170740 - DNA, 20 bp, human
gcgaggggctccggaaggaa

SEQ ID NO: 170741 - DNA, 20 bp, human
gacgaggtgtgggagatcgt

SEQ ID NO: 170742 - DNA, 20 bp, human
gcgcgtcgaggggctccgga

SEQ ID NO: 170743 - DNA, 20 bp, human
gtgcgaggccggcacaaggg

SEQ ID NO: 170744 - DNA, 20 bp, human
ggggatgcctgagccggacc

SEQ ID NO: 170745 - DNA, 20 bp, human
gtggccggacgcgcgtcgag

SEQ ID NO: 170746 - DNA, 20 bp, human
gtgtcgggcgcggaaggggg

SEQ ID NO: 170747 - DNA, 20 bp, human
ggggagggaggtaaacaaga

SEQ ID NO: 170748 - DNA, 20 bp, human
gcggcccgcgacccccaagg

SEQ ID NO: 170749 - DNA, 20 bp, human
gcggccaacagctccgctca

SEQ ID NO: 170750 - DNA, 20 bp, human
gaagatggcggcggcgtgtc

SEQ ID NO: 170751 - DNA, 20 bp, human
gcgccccgcgcctcactcgc

SEQ ID NO: 170752 - DNA, 20 bp, human
ggccccggcgaccaccttgg

SEQ ID NO: 170753 - DNA, 20 bp, human
gcccggggcgcccgcgagtg

SEQ ID NO: 170754 - DNA, 20 bp, human
gcgggccccggcgaccacct

SEQ ID NO: 170755 - DNA, 20 bp, human
gggcggcggcgtgtcgggcg

SEQ ID NO: 170756 - DNA, 20 bp, human
gccgctcacccgcggactca

SEQ ID NO: 170757 - DNA, 20 bp, human
gtcacccgcggactcagggc

SEQ ID NO: 170758 - DNA, 20 bp, human
gaggaaggaccgctcacccg

SEQ ID NO: 170759 - DNA, 20 bp, human
ggaagggaagtcggaacaca

SEQ ID NO: 170760 - DNA, 20 bp, human
gggccgggccgggccagtca

SEQ ID NO: 170761 - DNA, 20 bp, human
ggggtgttaagaggaagtaa

SEQ ID NO: 170762 - DNA, 20 bp, human
ggcaagcgggccaagctcat

SEQ ID NO: 170763 - DNA, 20 bp, human
gtccagctcagggtgttaag

SEQ ID NO: 170764 - DNA, 20 bp, human
gcacctccatgctggaccca

SEQ ID NO: 170765 - DNA, 20 bp, human
gcgcggctggtagatgacct

SEQ ID NO: 170766 - DNA, 20 bp, human
gctggtaggaggaccagacg

SEQ ID NO: 170767 - DNA, 20 bp, human
ggcccggcgcctatcaatga

SEQ ID NO: 170768 - DNA, 20 bp, human
gtacgactggtagggtcacc

SEQ ID NO: 170769 - DNA, 20 bp, human
ggtaggaggaccagacgggg

SEQ ID NO: 170770 - DNA, 20 bp, human
gcaggcaaaggacactgtaa

SEQ ID NO: 170771 - DNA, 20 bp, human
gtggcactaccgcccacctg

SEQ ID NO: 170772 - DNA, 20 bp, human
gcaaccggaagtccactcac

SEQ ID NO: 170773 - DNA, 20 bp, human
gaggaccagacggggaggtt

SEQ ID NO: 170774 - DNA, 20 bp, human
gagagtcatggagttacgac

SEQ ID NO: 170775 - DNA, 20 bp, human
gtgtaagggcgaacaaacct

SEQ ID NO: 170776 - DNA, 20 bp, human
gctgcactgccggactgacc

SEQ ID NO: 170777 - DNA, 20 bp, human
ggctctgggctcctagaccg

SEQ ID NO: 170778 - DNA, 20 bp, human
ggcagggcccaccccggtct

SEQ ID NO: 170779 - DNA, 20 bp, human
gctaccgaagagctcgtcca

SEQ ID NO: 170780 - DNA, 20 bp, human
gtgtcagcactgcttccggt

SEQ ID NO: 170781 - DNA, 20 bp, human
ggctccgtcgccagcttcag

SEQ ID NO: 170782 - DNA, 20 bp, human
gcagcactgcttccggtcgg

SEQ ID NO: 170783 - DNA, 20 bp, human
gggtcggtggcgcttctctc

SEQ ID NO: 170784 - DNA, 20 bp, human
gtgggctcctagaccggggt

SEQ ID NO: 170785 - DNA, 20 bp, human
gagagctcgtccagggtgag

SEQ ID NO: 170786 - DNA, 20 bp, human
gtgggtgccgacggcaagta

SEQ ID NO: 170787 - DNA, 20 bp, human
gactgcggcaggcagactac

SEQ ID NO: 170788 - DNA, 20 bp, human
ggaccggcactaggagccgg

SEQ ID NO: 170789 - DNA, 20 bp, human
gccgagcagccggagggtca

SEQ ID NO: 170790 - DNA, 20 bp, human
gcgcggcggcgaggctgaag

SEQ ID NO: 170791 - DNA, 20 bp, human
ggacgcgcggggcgggacgt

SEQ ID NO: 170792 - DNA, 20 bp, human
gcgcccccggctcctagtgc

SEQ ID NO: 170793 - DNA, 20 bp, human
gggctcctagtgccggtccg

SEQ ID NO: 170794 - DNA, 20 bp, human
gccgcggcgccggcacttat

SEQ ID NO: 170795 - DNA, 20 bp, human
gttcactccgagcagccgga

SEQ ID NO: 170796 - DNA, 20 bp, human
gtgactcctggcgacagcag

SEQ ID NO: 170797 - DNA, 20 bp, human
gcagcaatcagccacctcag

SEQ ID NO: 170798 - DNA, 20 bp, human
gctccagccgcaaagcggag

SEQ ID NO: 170799 - DNA, 20 bp, human
ggcagtcccgggagaacctg

SEQ ID NO: 170800 - DNA, 20 bp, human
gctggagtccgggttccctg

SEQ ID NO: 170801 - DNA, 20 bp, human
ggactccgccgcccctgagg

SEQ ID NO: 170802 - DNA, 20 bp, human
gaacggcgatgccccagacg

SEQ ID NO: 170803 - DNA, 20 bp, human
gcttctcgtgaagtgactcc

SEQ ID NO: 170804 - DNA, 20 bp, human
gagggccgacggttgtgacc

SEQ ID NO: 170805 - DNA, 20 bp, human
gggacagcggccccctggag

SEQ ID NO: 170806 - DNA, 20 bp, human
gatggtaccggggaaggggt

SEQ ID NO: 170807 - DNA, 20 bp, human
gggtcggccacggtcctgtc

SEQ ID NO: 170808 - DNA, 20 bp, human
gagccgcgcgcgccgaccct

SEQ ID NO: 170809 - DNA, 20 bp, human
gggctcctcagcacgatggg

SEQ ID NO: 170810 - DNA, 20 bp, human
gcgaccctgggcagataaat

SEQ ID NO: 170811 - DNA, 20 bp, human
gccgaccggcagctggtgag

SEQ ID NO: 170812 - DNA, 20 bp, human
gaagtcccgcaggtagtaca

SEQ ID NO: 170813 - DNA, 20 bp, human
gccgggatatgagctggaag

SEQ ID NO: 170814 - DNA, 20 bp, human
gcccggtaccataaaatccc

SEQ ID NO: 170815 - DNA, 20 bp, human
gtccattcctaccccttccc

SEQ ID NO: 170816 - DNA, 20 bp, human
gggctccagcccagcagtag

SEQ ID NO: 170817 - DNA, 20 bp, human
gggcggaagcagcaacttgg

SEQ ID NO: 170818 - DNA, 20 bp, human
ggcgcccactccggctccag

SEQ ID NO: 170819 - DNA, 20 bp, human
gcaacttggcggtatccaca

SEQ ID NO: 170820 - DNA, 20 bp, human
gctggccgctggagccggag

SEQ ID NO: 170821 - DNA, 20 bp, human
ggggccgggatgcgcgaccg

SEQ ID NO: 170822 - DNA, 20 bp, human
gccgggatgcgcgaccgggg

SEQ ID NO: 170823 - DNA, 20 bp, human
ggcctgcccggcatgcaggt

SEQ ID NO: 170824 - DNA, 20 bp, human
ggcccggccgggacccgcca

SEQ ID NO: 170825 - DNA, 20 bp, human
gagcgtagggggacgccgtg

SEQ ID NO: 170826 - DNA, 20 bp, human
gccactgcgagggacaccag

SEQ ID NO: 170827 - DNA, 20 bp, human
ggcccgcgaagcaacggtgg

SEQ ID NO: 170828 - DNA, 20 bp, human
gccagcccgcgaagcaacgg

SEQ ID NO: 170829 - DNA, 20 bp, human
gctgagaccgacctccgggg

SEQ ID NO: 170830 - DNA, 20 bp, human
ggcgaccggagaaagcccgg

SEQ ID NO: 170831 - DNA, 20 bp, human
gggtctcagatgactgaact

SEQ ID NO: 170832 - DNA, 20 bp, human
gcatctgagaccgacctccg

SEQ ID NO: 170833 - DNA, 20 bp, human
ggccgcccccacctcttcca

SEQ ID NO: 170834 - DNA, 20 bp, human
gctcccagcccgcgaagcaa

SEQ ID NO: 170835 - DNA, 20 bp, human
gctaacgcccaggctcccgg

SEQ ID NO: 170836 - DNA, 20 bp, human
gcgagcctagggcaccacag

SEQ ID NO: 170837 - DNA, 20 bp, human
gggcgcgtggaaagtcgggt

SEQ ID NO: 170838 - DNA, 20 bp, human
gcaccggccggccgagccta

SEQ ID NO: 170839 - DNA, 20 bp, human
ggcctggcgcgtggaaagtc

SEQ ID NO: 170840 - DNA, 20 bp, human
gcgcggagttacgggaaagt

SEQ ID NO: 170841 - DNA, 20 bp, human
gcctcgcccgtggacagacg

SEQ ID NO: 170842 - DNA, 20 bp, human
gagatccgccgcggagttac

SEQ ID NO: 170843 - DNA, 20 bp, human
gcacgggcgaggggacctga

SEQ ID NO: 170844 - DNA, 20 bp, human
gcgaaggccgaaaggaggaa

SEQ ID NO: 170845 - DNA, 20 bp, human
gtcccgccgcgtctgtccac

SEQ ID NO: 170846 - DNA, 20 bp, human
gtgaccctggacccacatac

SEQ ID NO: 170847 - DNA, 20 bp, human
ggggccgaaagtccagtatg

SEQ ID NO: 170848 - DNA, 20 bp, human
gggcatctggcacccctctg

SEQ ID NO: 170849 - DNA, 20 bp, human
ggccgcccgccaccccagag

SEQ ID NO: 170850 - DNA, 20 bp, human
gagtccagtatgtgggtcca

SEQ ID NO: 170851 - DNA, 20 bp, human
gagctctagaagagtgaccc

SEQ ID NO: 170852 - DNA, 20 bp, human
gagccgctgcacgtgtgcta

SEQ ID NO: 170853 - DNA, 20 bp, human
ggctgcacgtgtgctacggc

SEQ ID NO: 170854 - DNA, 20 bp, human
ggcacgtgtgctacggcggg

SEQ ID NO: 170855 - DNA, 20 bp, human
ggcgtgagcttcgaccgcaa

SEQ ID NO: 170856 - DNA, 20 bp, human
gccgccgcttccgggcagat

SEQ ID NO: 170857 - DNA, 20 bp, human
gctgggttgagacaagtgag

SEQ ID NO: 170858 - DNA, 20 bp, human
gggttgagacaagtgagtgg

SEQ ID NO: 170859 - DNA, 20 bp, human
gaggctgcgagcgccgggct

SEQ ID NO: 170860 - DNA, 20 bp, human
gggagcgatgctttcatcca

SEQ ID NO: 170861 - DNA, 20 bp, human
ggaaaaggcacctatctgcc

SEQ ID NO: 170862 - DNA, 20 bp, human
gtgggaagctaggaagtgca

SEQ ID NO: 170863 - DNA, 20 bp, human
gtcgctccgagcctcatggg

SEQ ID NO: 170864 - DNA, 20 bp, human
gatcgagactaggtgagtgg

SEQ ID NO: 170865 - DNA, 20 bp, human
ggcatcgctccgagcctcat

SEQ ID NO: 170866 - DNA, 20 bp, human
gtcgcgccggggccaacgtg

SEQ ID NO: 170867 - DNA, 20 bp, human
gcgctcctcgccggctacag

SEQ ID NO: 170868 - DNA, 20 bp, human
gcgcagggctcggccgaggg

SEQ ID NO: 170869 - DNA, 20 bp, human
gggcagcaacggcggaatat

SEQ ID NO: 170870 - DNA, 20 bp, human
ggcggccgggcatgtagcag

SEQ ID NO: 170871 - DNA, 20 bp, human
gcatgtagcagcggcagcaa

SEQ ID NO: 170872 - DNA, 20 bp, human
gaggaaggtaagagagcgag

SEQ ID NO: 170873 - DNA, 20 bp, human
gcattctcgtcaaacacggg

SEQ ID NO: 170874 - DNA, 20 bp, human
gccgggcgggcactggagta

SEQ ID NO: 170875 - DNA, 20 bp, human
gcctcgccggctacagcggg

SEQ ID NO: 170876 - DNA, 20 bp, human
gcgccgtgcgctcttctggg

SEQ ID NO: 170877 - DNA, 20 bp, human
gccgggagcggcagtggtag

SEQ ID NO: 170878 - DNA, 20 bp, human
ggcccgccgtgcgctcttct

SEQ ID NO: 170879 - DNA, 20 bp, human
ggggccgcgcgctattgcag

SEQ ID NO: 170880 - DNA, 20 bp, human
gaagccgtcccggacaccgg

SEQ ID NO: 170881 - DNA, 20 bp, human
gcaaggaggacggtgagtgc

SEQ ID NO: 170882 - DNA, 20 bp, human
gcaccgcccagaagagcgca

SEQ ID NO: 170883 - DNA, 20 bp, human
ggcgctcgcaatctacgggg

SEQ ID NO: 170884 - DNA, 20 bp, human
gccagcgctcgcaatctacg

SEQ ID NO: 170885 - DNA, 20 bp, human
ggtggtagcgggagcgctcg

SEQ ID NO: 170886 - DNA, 20 bp, human
gtcgcccctccagaccctcg

SEQ ID NO: 170887 - DNA, 20 bp, human
gtgaaggggtggtggtcgac

SEQ ID NO: 170888 - DNA, 20 bp, human
gctctggacggaggagtgag

SEQ ID NO: 170889 - DNA, 20 bp, human
ggggcaagtagagaccgcga

SEQ ID NO: 170890 - DNA, 20 bp, human
ggcccgcggccttgaagggg

SEQ ID NO: 170891 - DNA, 20 bp, human
gagtagagaccgcgagggtc

SEQ ID NO: 170892 - DNA, 20 bp, human
ggaaggtgcacgggactcca

SEQ ID NO: 170893 - DNA, 20 bp, human
gccgcgcccgcggccttgaa

SEQ ID NO: 170894 - DNA, 20 bp, human
gtaaggctgcctctggacgg

SEQ ID NO: 170895 - DNA, 20 bp, human
gcgcggccttgaaggggtgg

SEQ ID NO: 170896 - DNA, 20 bp, human
gagacggtggagatgaaccg

SEQ ID NO: 170897 - DNA, 20 bp, human
gccggcagcgagatacccag

SEQ ID NO: 170898 - DNA, 20 bp, human
ggccgcgcgaggacaaacag

SEQ ID NO: 170899 - DNA, 20 bp, human
gaccgcagggcagtggacgg

SEQ ID NO: 170900 - DNA, 20 bp, human
gtgagcccggaattctgcac

SEQ ID NO: 170901 - DNA, 20 bp, human
gagcccgcagagcaaccgca

SEQ ID NO: 170902 - DNA, 20 bp, human
ggcgcgaggacaaacagcgg

SEQ ID NO: 170903 - DNA, 20 bp, human
gccggctggtaaccccccag

SEQ ID NO: 170904 - DNA, 20 bp, human
gggccccaggagacactcgg

SEQ ID NO: 170905 - DNA, 20 bp, human
gtactgtggggtaagtgtgt

SEQ ID NO: 170906 - DNA, 20 bp, human
gtagcccagcgcatgagtca

SEQ ID NO: 170907 - DNA, 20 bp, human
gggaaggacggcgcccgcag

SEQ ID NO: 170908 - DNA, 20 bp, human
gtggtggagacctcgctgaa

SEQ ID NO: 170909 - DNA, 20 bp, human
ggcccgggccatggatccgg

SEQ ID NO: 170910 - DNA, 20 bp, human
gggagacctcgctgaaaggt

SEQ ID NO: 170911 - DNA, 20 bp, human
gggaaggccaggaacagtgt

SEQ ID NO: 170912 - DNA, 20 bp, human
ggccagctccacgttctcgg

SEQ ID NO: 170913 - DNA, 20 bp, human
gagcacgaagctgaggccgg

SEQ ID NO: 170914 - DNA, 20 bp, human
gagatcgggcgcggcagcta

SEQ ID NO: 170915 - DNA, 20 bp, human
gtcggccgccaccggatcca

SEQ ID NO: 170916 - DNA, 20 bp, human
gcatctgggacgcctagttg

SEQ ID NO: 170917 - DNA, 20 bp, human
gtggacggcggaccacacat

SEQ ID NO: 170918 - DNA, 20 bp, human
gggacagttccacaacatct

SEQ ID NO: 170919 - DNA, 20 bp, human
ggtgaagagctatagatcca

SEQ ID NO: 170920 - DNA, 20 bp, human
ggagatggggctaaacgcca

SEQ ID NO: 170921 - DNA, 20 bp, human
gaggctaggttgaaagagta

SEQ ID NO: 170922 - DNA, 20 bp, human
gggccaagggacggattccc

SEQ ID NO: 170923 - DNA, 20 bp, human
gcaaaggagcagggttggtt

SEQ ID NO: 170924 - DNA, 20 bp, human
gctccaagctcctcaggcca

SEQ ID NO: 170925 - DNA, 20 bp, human
gcgccagggaatccgtccct

SEQ ID NO: 170926 - DNA, 20 bp, human
gtgtggagagggccaacaag

SEQ ID NO: 170927 - DNA, 20 bp, human
gcgggatggagtgaagacgg

SEQ ID NO: 170928 - DNA, 20 bp, human
gcgcgagcgctgaggggcca

SEQ ID NO: 170929 - DNA, 20 bp, human
gaagcccaagaaggagtcgg

SEQ ID NO: 170930 - DNA, 20 bp, human
gcagggatctcggtcatcac

SEQ ID NO: 170931 - DNA, 20 bp, human
gaaggggcatctggagacgg

SEQ ID NO: 170932 - DNA, 20 bp, human
gcaacgagccaaagacggga

SEQ ID NO: 170933 - DNA, 20 bp, human
gggcagggagcagacaaagg

SEQ ID NO: 170934 - DNA, 20 bp, human
gggttacgggtgaggacaac

SEQ ID NO: 170935 - DNA, 20 bp, human
gtcgagactactggccgaag

SEQ ID NO: 170936 - DNA, 20 bp, human
gcggccgcgggcgcgaccgg

SEQ ID NO: 170937 - DNA, 20 bp, human
gtcggctggagggcacggga

SEQ ID NO: 170938 - DNA, 20 bp, human
gccggctgcggtccgtgcgg

SEQ ID NO: 170939 - DNA, 20 bp, human
ggcacgggacgggagcgctg

SEQ ID NO: 170940 - DNA, 20 bp, human
gtcctggctctgggtgacat

SEQ ID NO: 170941 - DNA, 20 bp, human
gcggccggctgcggtccgtg

SEQ ID NO: 170942 - DNA, 20 bp, human
gccggaggcaggtgagttcg

SEQ ID NO: 170943 - DNA, 20 bp, human
ggcgctggggctacccggag

SEQ ID NO: 170944 - DNA, 20 bp, human
gcggcctcgccggaatctca

SEQ ID NO: 170945 - DNA, 20 bp, human
gacgggcgcccggccggctg

SEQ ID NO: 170946 - DNA, 20 bp, human
gcgccgaagccagctaggag

SEQ ID NO: 170947 - DNA, 20 bp, human
ggccggccgagaggtgtcgg

SEQ ID NO: 170948 - DNA, 20 bp, human
gtgcgccggccgagaggtgt

SEQ ID NO: 170949 - DNA, 20 bp, human
gtagctggcttcggcgggga

SEQ ID NO: 170950 - DNA, 20 bp, human
gcctcgccgccgacacctct

SEQ ID NO: 170951 - DNA, 20 bp, human
gagggcgtgcgccggccgag

SEQ ID NO: 170952 - DNA, 20 bp, human
gggtgtcggcggcgaggcaa

SEQ ID NO: 170953 - DNA, 20 bp, human
ggagcaagggaggccgagct

SEQ ID NO: 170954 - DNA, 20 bp, human
gcaagtggaaggtcgtccgt

SEQ ID NO: 170955 - DNA, 20 bp, human
gaggaggttatcggtcagtg

SEQ ID NO: 170956 - DNA, 20 bp, human
gagcagtgagcgggtctggg

SEQ ID NO: 170957 - DNA, 20 bp, human
gtccaagcagggactcacgg

SEQ ID NO: 170958 - DNA, 20 bp, human
gtggagcagtgagcgggtct

SEQ ID NO: 170959 - DNA, 20 bp, human
ggctggcagcgccatggaga

SEQ ID NO: 170960 - DNA, 20 bp, human
gctatccaagcagggactca

SEQ ID NO: 170961 - DNA, 20 bp, human
gggccactggctaagaggac

SEQ ID NO: 170962 - DNA, 20 bp, human
gttagccagtggcccctcac

SEQ ID NO: 170963 - DNA, 20 bp, human
gggctcaggaggtccgcggg

SEQ ID NO: 170964 - DNA, 20 bp, human
ggcagggactcacggaggtg

SEQ ID NO: 170965 - DNA, 20 bp, human
ggcggctgctggcagcgcca

SEQ ID NO: 170966 - DNA, 20 bp, human
gttggtagatacacttgatg

SEQ ID NO: 170967 - DNA, 20 bp, human
gttgaagtgttgactctctg

SEQ ID NO: 170968 - DNA, 20 bp, human
gaataaacactgatctcaga

SEQ ID NO: 170969 - DNA, 20 bp, human
gtgattatacttgagaagtg

SEQ ID NO: 170970 - DNA, 20 bp, human
ggactttaccaaaaaaaccc

SEQ ID NO: 170971 - DNA, 20 bp, human
gggagtttttatgatgtcat

SEQ ID NO: 170972 - DNA, 20 bp, human
gttctgttgatatcaagtta

SEQ ID NO: 170973 - DNA, 20 bp, human
gacgaacatctcatatgcca

SEQ ID NO: 170974 - DNA, 20 bp, human
gattgtaattgtataaacat

SEQ ID NO: 170975 - DNA, 20 bp, human
gagttaaggcagttttgact

SEQ ID NO: 170976 - DNA, 20 bp, human
ggcggcgccgcagccatgga

SEQ ID NO: 170977 - DNA, 20 bp, human
ggcgccgcagccatggaggg

SEQ ID NO: 170978 - DNA, 20 bp, human
gcggcgccgccacctgacaa

SEQ ID NO: 170979 - DNA, 20 bp, human
gcctcgcgccgggtaccggg

SEQ ID NO: 170980 - DNA, 20 bp, human
ggaccacccggcgaaggtga

SEQ ID NO: 170981 - DNA, 20 bp, human
gccgcctccctccatggctg

SEQ ID NO: 170982 - DNA, 20 bp, human
ggggtgactctaggcaaagc

SEQ ID NO: 170983 - DNA, 20 bp, human
gccacttcccagagctgcgg

SEQ ID NO: 170984 - DNA, 20 bp, human
ggcggggactgaagctcccg

SEQ ID NO: 170985 - DNA, 20 bp, human
gtctggctggattcacacgc

SEQ ID NO: 170986 - DNA, 20 bp, human
gccagcaagagggacgcggt

SEQ ID NO: 170987 - DNA, 20 bp, human
gcggctcggactgagcaggt

SEQ ID NO: 170988 - DNA, 20 bp, human
gctaaagccgctggtccctg

SEQ ID NO: 170989 - DNA, 20 bp, human
ggcacaaaagcgccaaacag

SEQ ID NO: 170990 - DNA, 20 bp, human
gacggtcgcagggagggtcg

SEQ ID NO: 170991 - DNA, 20 bp, human
gaccgcagctggtgattgag

SEQ ID NO: 170992 - DNA, 20 bp, human
gcaggcggctcggactgagc

SEQ ID NO: 170993 - DNA, 20 bp, human
gcaggggacggtcgcaggga

SEQ ID NO: 170994 - DNA, 20 bp, human
gccgtcgaggagacaatagg

SEQ ID NO: 170995 - DNA, 20 bp, human
gtgtgcgcgcccgggtctgt

SEQ ID NO: 170996 - DNA, 20 bp, human
gaagggtccggctacagcag

SEQ ID NO: 170997 - DNA, 20 bp, human
ggtggcgaaggcaaagggtc

SEQ ID NO: 170998 - DNA, 20 bp, human
gaggactcaatcgtgagggg

SEQ ID NO: 170999 - DNA, 20 bp, human
gcgagagagaagactgaata

SEQ ID NO: 171000 - DNA, 20 bp, human
gattaggactcaatcgtgag

SEQ ID NO: 171001 - DNA, 20 bp, human
ggagcagtggcgaaggcaaa

SEQ ID NO: 171002 - DNA, 20 bp, human
gtggtaacacaggaccagga

SEQ ID NO: 171003 - DNA, 20 bp, human
ggtagagccgacggagaacg

SEQ ID NO: 171004 - DNA, 20 bp, human
ggggtaagttgccctcctat

SEQ ID NO: 171005 - DNA, 20 bp, human
gcatttaaggcaaacagtta

SEQ ID NO: 171006 - DNA, 20 bp, human
ggctggagaggcgcaagtgg

SEQ ID NO: 171007 - DNA, 20 bp, human
gcgtgggctcgcgaccgggt

SEQ ID NO: 171008 - DNA, 20 bp, human
gtctggcggacccagatctc

SEQ ID NO: 171009 - DNA, 20 bp, human
gcggtcgcgagcccacgccc

SEQ ID NO: 171010 - DNA, 20 bp, human
ggtccgccagagccttcgtg

SEQ ID NO: 171011 - DNA, 20 bp, human
gggctcccagacccgggcgt

SEQ ID NO: 171012 - DNA, 20 bp, human
gccgtggccccggagcctac

SEQ ID NO: 171013 - DNA, 20 bp, human
gggcggcgggatctgagcag

SEQ ID NO: 171014 - DNA, 20 bp, human
gcgtccggcgacccgagatc

SEQ ID NO: 171015 - DNA, 20 bp, human
gggcttgcaacgcgcagggt

SEQ ID NO: 171016 - DNA, 20 bp, human
gccagggtaccactaattga

SEQ ID NO: 171017 - DNA, 20 bp, human
gaccactaattgagggagtg

SEQ ID NO: 171018 - DNA, 20 bp, human
gtgatgttgagagaagccca

SEQ ID NO: 171019 - DNA, 20 bp, human
gagagcagctcgcttctaac

SEQ ID NO: 171020 - DNA, 20 bp, human
ggagagcttcccacttgaaa

SEQ ID NO: 171021 - DNA, 20 bp, human
ggaagaaaaggtaaaaacac

SEQ ID NO: 171022 - DNA, 20 bp, human
gtacagtggggagaagcgag

SEQ ID NO: 171023 - DNA, 20 bp, human
gccacttgaaagggatcttc

SEQ ID NO: 171024 - DNA, 20 bp, human
gtcctcactccctcaattag

SEQ ID NO: 171025 - DNA, 20 bp, human
ggcgctcggccaaggggtga

SEQ ID NO: 171026 - DNA, 20 bp, human
ggcgcagtagcaggggcgta

SEQ ID NO: 171027 - DNA, 20 bp, human
gtaagcgcgggaagtgggag

SEQ ID NO: 171028 - DNA, 20 bp, human
gcgcaggagcgcgggaccac

SEQ ID NO: 171029 - DNA, 20 bp, human
gcgcccgagcgcagtagcag

SEQ ID NO: 171030 - DNA, 20 bp, human
ggtgtacgcgcgcccaagaa

SEQ ID NO: 171031 - DNA, 20 bp, human
gtcgaggctagttaacaggt

SEQ ID NO: 171032 - DNA, 20 bp, human
gcgcgggaagtgggagaggc

SEQ ID NO: 171033 - DNA, 20 bp, human
gtgtcttaaccgggactaga

SEQ ID NO: 171034 - DNA, 20 bp, human
gacagcagccaagcccgcgg

SEQ ID NO: 171035 - DNA, 20 bp, human
gcttcccgcgcttaaacccc

SEQ ID NO: 171036 - DNA, 20 bp, human
gctcctcagggcattcccgg

SEQ ID NO: 171037 - DNA, 20 bp, human
ggatgccaagccccatgcca

SEQ ID NO: 171038 - DNA, 20 bp, human
gggtttggcaacgaggacgg

SEQ ID NO: 171039 - DNA, 20 bp, human
gagccgccgggaatgccctg

SEQ ID NO: 171040 - DNA, 20 bp, human
gcgcggactaggaaacgcag

SEQ ID NO: 171041 - DNA, 20 bp, human
gtggctcctcagggcattcc

SEQ ID NO: 171042 - DNA, 20 bp, human
ggccgagaagcggcacacac

SEQ ID NO: 171043 - DNA, 20 bp, human
ggatagtgcagccctggcat

SEQ ID NO: 171044 - DNA, 20 bp, human
ggggcagcatggccgagaag

SEQ ID NO: 171045 - DNA, 20 bp, human
gggctccccgactccttcaa

SEQ ID NO: 171046 - DNA, 20 bp, human
gagcggtcaaaatcacccag

SEQ ID NO: 171047 - DNA, 20 bp, human
gtaagagccgaggacaaatg

SEQ ID NO: 171048 - DNA, 20 bp, human
gagccatgctcggcaggtct

SEQ ID NO: 171049 - DNA, 20 bp, human
ggctcggcaggtctgggtac

SEQ ID NO: 171050 - DNA, 20 bp, human
gtcctgtcaaaagccatgct

SEQ ID NO: 171051 - DNA, 20 bp, human
ggaaaccgaggtctaggcag

SEQ ID NO: 171052 - DNA, 20 bp, human
gaccgaggtctaggcagagg

SEQ ID NO: 171053 - DNA, 20 bp, human
ggccgtcgcaccctacgagg

SEQ ID NO: 171054 - DNA, 20 bp, human
ggaccctagggagggcggat

SEQ ID NO: 171055 - DNA, 20 bp, human
gaccgggccggccgactcct

SEQ ID NO: 171056 - DNA, 20 bp, human
gaaaggctcgggtaggcttc

SEQ ID NO: 171057 - DNA, 20 bp, human
gctcgtctcgttggttccgg

SEQ ID NO: 171058 - DNA, 20 bp, human
gaccaacgagacgagcggag

SEQ ID NO: 171059 - DNA, 20 bp, human
gcacaggctccaggatccgg

SEQ ID NO: 171060 - DNA, 20 bp, human
ggattctccgaggatcctga

SEQ ID NO: 171061 - DNA, 20 bp, human
gttggttccggaggtcgctg

SEQ ID NO: 171062 - DNA, 20 bp, human
gccaccgccgcagcgacctc

SEQ ID NO: 171063 - DNA, 20 bp, human
gtgcggcacgaacagtacca

SEQ ID NO: 171064 - DNA, 20 bp, human
gggattgccccgaaacaccg

SEQ ID NO: 171065 - DNA, 20 bp, human
gagcggaactgcaagaggaa

SEQ ID NO: 171066 - DNA, 20 bp, human
gttacacagcaatattttac

SEQ ID NO: 171067 - DNA, 20 bp, human
gggagctaagtgtgaagaac

SEQ ID NO: 171068 - DNA, 20 bp, human
gactcagatgtgcttgggag

SEQ ID NO: 171069 - DNA, 20 bp, human
gcagcaactcagatgtgctt

SEQ ID NO: 171070 - DNA, 20 bp, human
gagggagttcactaaagaga

SEQ ID NO: 171071 - DNA, 20 bp, human
ggagttgtagcattatagac

SEQ ID NO: 171072 - DNA, 20 bp, human
gccagggtaactacccctta

SEQ ID NO: 171073 - DNA, 20 bp, human
gatacttggcaatttttcat

SEQ ID NO: 171074 - DNA, 20 bp, human
gtctgtatgaaatccttctc

SEQ ID NO: 171075 - DNA, 20 bp, human
gaagaatgagatggattcta

SEQ ID NO: 171076 - DNA, 20 bp, human
gcccaggggacagagacggg

SEQ ID NO: 171077 - DNA, 20 bp, human
gagagacacagagaccccga

SEQ ID NO: 171078 - DNA, 20 bp, human
gctgggaccccccctctcca

SEQ ID NO: 171079 - DNA, 20 bp, human
gcagccacaccaggaggcgg

SEQ ID NO: 171080 - DNA, 20 bp, human
gctggtggcccgggtccgag

SEQ ID NO: 171081 - DNA, 20 bp, human
ggagctgaggtaccagggag

SEQ ID NO: 171082 - DNA, 20 bp, human
ggaccccgagggaggcgtga

SEQ ID NO: 171083 - DNA, 20 bp, human
gggctggctgcggccagaat

SEQ ID NO: 171084 - DNA, 20 bp, human
gccgcagagggatggcctcc

SEQ ID NO: 171085 - DNA, 20 bp, human
ggcccctcacgcctccctcg

SEQ ID NO: 171086 - DNA, 20 bp, human
gatctctctggacctccggg

SEQ ID NO: 171087 - DNA, 20 bp, human
gcccaaagtccaccacccgg

SEQ ID NO: 171088 - DNA, 20 bp, human
gtggatctctctggacctcc

SEQ ID NO: 171089 - DNA, 20 bp, human
gacagacctggtcacagtct

SEQ ID NO: 171090 - DNA, 20 bp, human
gagtcccaaagtccaccacc

SEQ ID NO: 171091 - DNA, 20 bp, human
gctttgggactggacagacc

SEQ ID NO: 171092 - DNA, 20 bp, human
gcctgacaccagcaaggcat

SEQ ID NO: 171093 - DNA, 20 bp, human
gaggacccctgacaccagca

SEQ ID NO: 171094 - DNA, 20 bp, human
gacctccgggtggtggactt

SEQ ID NO: 171095 - DNA, 20 bp, human
ggcaaggcattggatctctc

SEQ ID NO: 171096 - DNA, 20 bp, human
gtgcctggcagattaaccaa

SEQ ID NO: 171097 - DNA, 20 bp, human
ggattaaccaacggcaagag

SEQ ID NO: 171098 - DNA, 20 bp, human
gcctgcgagtgggcaggaaa

SEQ ID NO: 171099 - DNA, 20 bp, human
gtacggtagacttgggtcca

SEQ ID NO: 171100 - DNA, 20 bp, human
ggagatcttagaatcctaag

SEQ ID NO: 171101 - DNA, 20 bp, human
ggagtaggggtatggtagta

SEQ ID NO: 171102 - DNA, 20 bp, human
gctggtgggtggcaatcaca

SEQ ID NO: 171103 - DNA, 20 bp, human
gaagcatcttgggaacctta

SEQ ID NO: 171104 - DNA, 20 bp, human
gcactccttaccctgcgagt

SEQ ID NO: 171105 - DNA, 20 bp, human
gtgccgttggttaatctgcc

SEQ ID NO: 171106 - DNA, 20 bp, human
gtcgccgaggccctgcgttg

SEQ ID NO: 171107 - DNA, 20 bp, human
gggctacgacgccgctcgct

SEQ ID NO: 171108 - DNA, 20 bp, human
ggctcgctcggcgggaggat

SEQ ID NO: 171109 - DNA, 20 bp, human
ggccgggagcccgcaacgca

SEQ ID NO: 171110 - DNA, 20 bp, human
gtacgacgccgctcgctcgg

SEQ ID NO: 171111 - DNA, 20 bp, human
gagcccgcaacgcagggcct

SEQ ID NO: 171112 - DNA, 20 bp, human
gccgactgcgcgcgggtccg

SEQ ID NO: 171113 - DNA, 20 bp, human
gccctggagctccgttcccc

SEQ ID NO: 171114 - DNA, 20 bp, human
gggccgggccatgctttcgc

SEQ ID NO: 171115 - DNA, 20 bp, human
gggatcggccgactgcgcgc

SEQ ID NO: 171116 - DNA, 20 bp, human
ggcgcggaacggctattgaa

SEQ ID NO: 171117 - DNA, 20 bp, human
gggaaccgcgttctaactta

SEQ ID NO: 171118 - DNA, 20 bp, human
gggacctgaatgcagcgtag

SEQ ID NO: 171119 - DNA, 20 bp, human
gccacctgcgccaaccccaa

SEQ ID NO: 171120 - DNA, 20 bp, human
ggctgccttaagttagaacg

SEQ ID NO: 171121 - DNA, 20 bp, human
ggtgggaacggggagatctg

SEQ ID NO: 171122 - DNA, 20 bp, human
gaggtccacagctctttaga

SEQ ID NO: 171123 - DNA, 20 bp, human
gcttacaccgggactccaga

SEQ ID NO: 171124 - DNA, 20 bp, human
gggctggcggtgacttacac

SEQ ID NO: 171125 - DNA, 20 bp, human
gcaaaggaagctaaagccag

SEQ ID NO: 171126 - DNA, 20 bp, human
ggctgaggccccgaggatcg

SEQ ID NO: 171127 - DNA, 20 bp, human
ggcgctccttcatccgtcta

SEQ ID NO: 171128 - DNA, 20 bp, human
gtctacggcgggcacgaccc

SEQ ID NO: 171129 - DNA, 20 bp, human
ggcctgctgtggatcttggg

SEQ ID NO: 171130 - DNA, 20 bp, human
ggaggccccgaggatcgggg

SEQ ID NO: 171131 - DNA, 20 bp, human
gtgtagacgccgacgaggag

SEQ ID NO: 171132 - DNA, 20 bp, human
ggcccgccgtagacggatga

SEQ ID NO: 171133 - DNA, 20 bp, human
ggacctgccgccccgatcct

SEQ ID NO: 171134 - DNA, 20 bp, human
gcagcaggccctctcaatat

SEQ ID NO: 171135 - DNA, 20 bp, human
ggatcttgggaggtacaaaa

SEQ ID NO: 171136 - DNA, 20 bp, human
gcggtcgctatggcacccac

SEQ ID NO: 171137 - DNA, 20 bp, human
gcggtcccggcagctgaatc

SEQ ID NO: 171138 - DNA, 20 bp, human
gccatagcgaccgggaggtt

SEQ ID NO: 171139 - DNA, 20 bp, human
gtctggccagcccaacctcc

SEQ ID NO: 171140 - DNA, 20 bp, human
gcagctgccgggaccggacc

SEQ ID NO: 171141 - DNA, 20 bp, human
gcgagtgcgcaaaagttggg

SEQ ID NO: 171142 - DNA, 20 bp, human
ggacgcaggggcaactccca

SEQ ID NO: 171143 - DNA, 20 bp, human
ggagctaggtggagccccga

SEQ ID NO: 171144 - DNA, 20 bp, human
gaggacacgccccgacgcag

SEQ ID NO: 171145 - DNA, 20 bp, human
ggggtgccatagcgaccggg

SEQ ID NO: 171146 - DNA, 20 bp, human
gtaggatccaggacccacat

SEQ ID NO: 171147 - DNA, 20 bp, human
gggtgcacgccaccaaaatt

SEQ ID NO: 171148 - DNA, 20 bp, human
gagcggagcaggctgaagat

SEQ ID NO: 171149 - DNA, 20 bp, human
gggaagccgacaccagtctg

SEQ ID NO: 171150 - DNA, 20 bp, human
gagccgacaccagtctgagg

SEQ ID NO: 171151 - DNA, 20 bp, human
ggcagcactgaggcccatgt

SEQ ID NO: 171152 - DNA, 20 bp, human
ggaggcagagctcctgtgac

SEQ ID NO: 171153 - DNA, 20 bp, human
gtcgcctgctgcttcaggaa

SEQ ID NO: 171154 - DNA, 20 bp, human
gggcctcctcagactggtgt

SEQ ID NO: 171155 - DNA, 20 bp, human
ggctctgtggtaaagtagag

SEQ ID NO: 171156 - DNA, 20 bp, human
gatccggcttccggaaggtg

SEQ ID NO: 171157 - DNA, 20 bp, human
gccggaaggtgagggccgga

SEQ ID NO: 171158 - DNA, 20 bp, human
gttgaggctgcggtcatgga

SEQ ID NO: 171159 - DNA, 20 bp, human
ggagatgaggccccaggacg

SEQ ID NO: 171160 - DNA, 20 bp, human
ggctggatccggcttccgga

SEQ ID NO: 171161 - DNA, 20 bp, human
gtccaagccggcgaagagag

SEQ ID NO: 171162 - DNA, 20 bp, human
ggcgagacaccagcccacga

SEQ ID NO: 171163 - DNA, 20 bp, human
gcgcggggcggggttccggt

SEQ ID NO: 171164 - DNA, 20 bp, human
gttccggtgggcgcgcgttg

SEQ ID NO: 171165 - DNA, 20 bp, human
gctggtgtctcgcagctggt

SEQ ID NO: 171166 - DNA, 20 bp, human
gacaccagaagggaggccca

SEQ ID NO: 171167 - DNA, 20 bp, human
gtctgtgggtctgtctaggt

SEQ ID NO: 171168 - DNA, 20 bp, human
gacatcgatgagccccaggg

SEQ ID NO: 171169 - DNA, 20 bp, human
gccacagaggactactccta

SEQ ID NO: 171170 - DNA, 20 bp, human
gtcccttctggtgtgtctgt

SEQ ID NO: 171171 - DNA, 20 bp, human
gccactacagatgtgaaaag

SEQ ID NO: 171172 - DNA, 20 bp, human
ggactgaatgaaccccagag

SEQ ID NO: 171173 - DNA, 20 bp, human
ggcagtgcggagctggccgt

SEQ ID NO: 171174 - DNA, 20 bp, human
gtgaaagggtaggcagccca

SEQ ID NO: 171175 - DNA, 20 bp, human
gtagtcctctgtggccccgg

SEQ ID NO: 171176 - DNA, 20 bp, human
ggctatggggaagattgatg

SEQ ID NO: 171177 - DNA, 20 bp, human
gcctgagcgaccctaggtca

SEQ ID NO: 171178 - DNA, 20 bp, human
ggcaccaagatgacacagag

SEQ ID NO: 171179 - DNA, 20 bp, human
gcgtgttgctggggacctag

SEQ ID NO: 171180 - DNA, 20 bp, human
gtaaagccctgagcgaccct

SEQ ID NO: 171181 - DNA, 20 bp, human
gtcatcttggtgcgaggata

SEQ ID NO: 171182 - DNA, 20 bp, human
ggaaaaaatgtagtcctggg

SEQ ID NO: 171183 - DNA, 20 bp, human
gctgcgtgacagccagaaat

SEQ ID NO: 171184 - DNA, 20 bp, human
gcccatagctgcaaggcaga

SEQ ID NO: 171185 - DNA, 20 bp, human
gaaaggttgaggcaggtcag

SEQ ID NO: 171186 - DNA, 20 bp, human
gcggcgcggcagtaaaactg

SEQ ID NO: 171187 - DNA, 20 bp, human
gcgcggcagtaaaactgagg

SEQ ID NO: 171188 - DNA, 20 bp, human
gggcggagccaagacggtcg

SEQ ID NO: 171189 - DNA, 20 bp, human
gcttccaggtggggaaccta

SEQ ID NO: 171190 - DNA, 20 bp, human
gctgcctgaacaggacaaac

SEQ ID NO: 171191 - DNA, 20 bp, human
gcccacctggaagtcctagg

SEQ ID NO: 171192 - DNA, 20 bp, human
ggtcagcccaaagtgcgcgg

SEQ ID NO: 171193 - DNA, 20 bp, human
gcaagcagccccgaccgtct

SEQ ID NO: 171194 - DNA, 20 bp, human
gctcccagcaaccggtctgg

SEQ ID NO: 171195 - DNA, 20 bp, human
gcccctcccagcaaccggtc

SEQ ID NO: 171196 - DNA, 20 bp, human
gcaacccggcaggcaccact

SEQ ID NO: 171197 - DNA, 20 bp, human
gccgctagggtaaagacggg

SEQ ID NO: 171198 - DNA, 20 bp, human
gccgagctgcactggcgcag

SEQ ID NO: 171199 - DNA, 20 bp, human
gtcgccgctagggtaaagac

SEQ ID NO: 171200 - DNA, 20 bp, human
gggaactctgcaccagtccc

SEQ ID NO: 171201 - DNA, 20 bp, human
ggcaagaatgcggcccgagg

SEQ ID NO: 171202 - DNA, 20 bp, human
gcagtgcagctcgggctcag

SEQ ID NO: 171203 - DNA, 20 bp, human
gagagcgcggccaaaggtga

SEQ ID NO: 171204 - DNA, 20 bp, human
ggggagccgtggcaagaatg

SEQ ID NO: 171205 - DNA, 20 bp, human
gccagtcccaggctacccgc

SEQ ID NO: 171206 - DNA, 20 bp, human
ggaaaagaagggcaatccgg

SEQ ID NO: 171207 - DNA, 20 bp, human
ggggcaatccggtggcaccg

SEQ ID NO: 171208 - DNA, 20 bp, human
ggtgtggacgctgtgaatcg

SEQ ID NO: 171209 - DNA, 20 bp, human
gtggggagaagcggagaacc

SEQ ID NO: 171210 - DNA, 20 bp, human
gacagcgtccacaccggcat

SEQ ID NO: 171211 - DNA, 20 bp, human
gccgcaatcctggtcctcga

SEQ ID NO: 171212 - DNA, 20 bp, human
gcagcaagcaacagtcgacg

SEQ ID NO: 171213 - DNA, 20 bp, human
gcttcctgccgatgccggtg

SEQ ID NO: 171214 - DNA, 20 bp, human
gagcaacagtcgacgaggga

SEQ ID NO: 171215 - DNA, 20 bp, human
gggacgctgtgaatcgtggc

SEQ ID NO: 171216 - DNA, 20 bp, human
ggtccccgcgaaggtgagga

SEQ ID NO: 171217 - DNA, 20 bp, human
gcggctcctctgcccagcgg

SEQ ID NO: 171218 - DNA, 20 bp, human
gcggggtcccggccgatcag

SEQ ID NO: 171219 - DNA, 20 bp, human
gagccgccgccgctgggcag

SEQ ID NO: 171220 - DNA, 20 bp, human
gtccgtcccggaagacctcc

SEQ ID NO: 171221 - DNA, 20 bp, human
ggtcccggccgatcagggga

SEQ ID NO: 171222 - DNA, 20 bp, human
gaggtgttggaggacattgg

SEQ ID NO: 171223 - DNA, 20 bp, human
gccgcttcgggcaagggcag

SEQ ID NO: 171224 - DNA, 20 bp, human
ggaggagccggagacgcgag

SEQ ID NO: 171225 - DNA, 20 bp, human
ggctggggagaggcttcggg

SEQ ID NO: 171226 - DNA, 20 bp, human
gctgtaaggagagaaaccag

SEQ ID NO: 171227 - DNA, 20 bp, human
gagggaatgaggcccagtag

SEQ ID NO: 171228 - DNA, 20 bp, human
ggtgtgggatagccaggtga

SEQ ID NO: 171229 - DNA, 20 bp, human
gaggggccagagtcactgta

SEQ ID NO: 171230 - DNA, 20 bp, human
gggtagggaactgtgctcag

SEQ ID NO: 171231 - DNA, 20 bp, human
gaagtgaacactggtaccgg

SEQ ID NO: 171232 - DNA, 20 bp, human
gaataaccagaactcacctc

SEQ ID NO: 171233 - DNA, 20 bp, human
gggatagccaggtgagggca

SEQ ID NO: 171234 - DNA, 20 bp, human
gaaggagagaccagggtcca

SEQ ID NO: 171235 - DNA, 20 bp, human
gtccaagtgaacactggtac

SEQ ID NO: 171236 - DNA, 20 bp, human
ggagccggcagtcggcggtc

SEQ ID NO: 171237 - DNA, 20 bp, human
gagatggagccggcagtcgg

SEQ ID NO: 171238 - DNA, 20 bp, human
gtcccctgggccccgactgt

SEQ ID NO: 171239 - DNA, 20 bp, human
gtgtgcgcgagttaagctgg

SEQ ID NO: 171240 - DNA, 20 bp, human
ggcccacagtcggggcccag

SEQ ID NO: 171241 - DNA, 20 bp, human
gaccagcagtcgccggccac

SEQ ID NO: 171242 - DNA, 20 bp, human
ggaggccacgcccacagtcg

SEQ ID NO: 171243 - DNA, 20 bp, human
gagaggtcaggagcttcggg

SEQ ID NO: 171244 - DNA, 20 bp, human
gctcgaggccctagcccctg

SEQ ID NO: 171245 - DNA, 20 bp, human
ggggcggcggagctagagca

SEQ ID NO: 171246 - DNA, 20 bp, human
gtggtcagcggctcccctca

SEQ ID NO: 171247 - DNA, 20 bp, human
gaagcgagctgaaccctgag

SEQ ID NO: 171248 - DNA, 20 bp, human
gccgccgcgcctgggaccgg

SEQ ID NO: 171249 - DNA, 20 bp, human
ggagccgctgaccagcagca

SEQ ID NO: 171250 - DNA, 20 bp, human
gaccccgccgcgcctgggac

SEQ ID NO: 171251 - DNA, 20 bp, human
gcaaatggcaatggcaacgg

SEQ ID NO: 171252 - DNA, 20 bp, human
gagatgagcgcggtattgag

SEQ ID NO: 171253 - DNA, 20 bp, human
gctagaaagcccccaacccg

SEQ ID NO: 171254 - DNA, 20 bp, human
ggggcccccggtcccaggcg

SEQ ID NO: 171255 - DNA, 20 bp, human
gggaggaccccgccgcgcct

SEQ ID NO: 171256 - DNA, 20 bp, human
gcaggaagtgcaggatcccc

SEQ ID NO: 171257 - DNA, 20 bp, human
gctgccccggcgcccagcag

SEQ ID NO: 171258 - DNA, 20 bp, human
gtggcggccgcagatacccg

SEQ ID NO: 171259 - DNA, 20 bp, human
gggatgggcggcagcaaagg

SEQ ID NO: 171260 - DNA, 20 bp, human
gacggggctccgggtgggat

SEQ ID NO: 171261 - DNA, 20 bp, human
gggacccgcctgctcgtcca

SEQ ID NO: 171262 - DNA, 20 bp, human
ggtgagaacagggtcgaggt

SEQ ID NO: 171263 - DNA, 20 bp, human
gatccccgggagactgtact

SEQ ID NO: 171264 - DNA, 20 bp, human
gctgcaggtaaagaccctcc

SEQ ID NO: 171265 - DNA, 20 bp, human
ggcagctccccgggtatctg

SEQ ID NO: 171266 - DNA, 20 bp, human
ggccggggccccacacacaa

SEQ ID NO: 171267 - DNA, 20 bp, human
ggcagcagtacactatcccg

SEQ ID NO: 171268 - DNA, 20 bp, human
gtccgagggagcgggtcccg

SEQ ID NO: 171269 - DNA, 20 bp, human
ggatgtagtgcagtatcccc

SEQ ID NO: 171270 - DNA, 20 bp, human
gcaacctgagcagcacaggt

SEQ ID NO: 171271 - DNA, 20 bp, human
gtcgcccggggggaacggag

SEQ ID NO: 171272 - DNA, 20 bp, human
gcaatggacgagcttgccgg

SEQ ID NO: 171273 - DNA, 20 bp, human
ggcgcactgggaggtggaac

SEQ ID NO: 171274 - DNA, 20 bp, human
gggcaggccccgagctgtcc

SEQ ID NO: 171275 - DNA, 20 bp, human
gggttccgctcggcctccca

SEQ ID NO: 171276 - DNA, 20 bp, human
gcccggggcctccatgatgg

SEQ ID NO: 171277 - DNA, 20 bp, human
gggatccccggcaggctcag

SEQ ID NO: 171278 - DNA, 20 bp, human
gtccatgatggaggagcgag

SEQ ID NO: 171279 - DNA, 20 bp, human
ggccgctcgctcctccatca

SEQ ID NO: 171280 - DNA, 20 bp, human
ggtcccggagggcgagtgag

SEQ ID NO: 171281 - DNA, 20 bp, human
gggccattgctccaagatgg

SEQ ID NO: 171282 - DNA, 20 bp, human
gggaccgcgacggtcccgga

SEQ ID NO: 171283 - DNA, 20 bp, human
gtcgccctccgggaccgtcg

SEQ ID NO: 171284 - DNA, 20 bp, human
gcctcaggacacccctcgga

SEQ ID NO: 171285 - DNA, 20 bp, human
ggagtgaggggccgtccgag

SEQ ID NO: 171286 - DNA, 20 bp, human
ggaggttgcagtgattgagt

SEQ ID NO: 171287 - DNA, 20 bp, human
gtgcttgggcagataatgtg

SEQ ID NO: 171288 - DNA, 20 bp, human
gggccaacagcactgtgctt

SEQ ID NO: 171289 - DNA, 20 bp, human
ggaatagacgcttaccttaa

SEQ ID NO: 171290 - DNA, 20 bp, human
gttgggcagataatgtgagg

SEQ ID NO: 171291 - DNA, 20 bp, human
gttggcctgcttcaaagcag

SEQ ID NO: 171292 - DNA, 20 bp, human
gctgcaacctcactacagct

SEQ ID NO: 171293 - DNA, 20 bp, human
gtgcagtgattgagtaggat

SEQ ID NO: 171294 - DNA, 20 bp, human
gctgtctaaaaggtggagtg

SEQ ID NO: 171295 - DNA, 20 bp, human
ggaacaagacaacacatgtt

SEQ ID NO: 171296 - DNA, 20 bp, human
gtcagcggcgcacccaaccc

SEQ ID NO: 171297 - DNA, 20 bp, human
gccgcgctgaggggtatcag

SEQ ID NO: 171298 - DNA, 20 bp, human
gccctcagccatccgttcag

SEQ ID NO: 171299 - DNA, 20 bp, human
ggggtgcgccgctgaacgga

SEQ ID NO: 171300 - DNA, 20 bp, human
gtgggacccgctggaacgac

SEQ ID NO: 171301 - DNA, 20 bp, human
gttgcagtctgggaaactag

SEQ ID NO: 171302 - DNA, 20 bp, human
ggccgctgaacggatggctg

SEQ ID NO: 171303 - DNA, 20 bp, human
gtagggagggagggtaaggt

SEQ ID NO: 171304 - DNA, 20 bp, human
gcccgctggaacgaccggaa

SEQ ID NO: 171305 - DNA, 20 bp, human
gcgctgaggggtatcagagg

SEQ ID NO: 171306 - DNA, 20 bp, human
gcagcacccctcgcaccagg

SEQ ID NO: 171307 - DNA, 20 bp, human
gccgccgccggggcacaaca

SEQ ID NO: 171308 - DNA, 20 bp, human
ggccaagtcgaggagagctg

SEQ ID NO: 171309 - DNA, 20 bp, human
gccgccggggcacaacatgg

SEQ ID NO: 171310 - DNA, 20 bp, human
ggcggcgaggcacttaccac

SEQ ID NO: 171311 - DNA, 20 bp, human
gagagctagacccgccgccg

SEQ ID NO: 171312 - DNA, 20 bp, human
ggcggcgcggggccaagtcg

SEQ ID NO: 171313 - DNA, 20 bp, human
ggcccagtgcgcgcacaagg

SEQ ID NO: 171314 - DNA, 20 bp, human
gaagtcgaggagagctgcgg

SEQ ID NO: 171315 - DNA, 20 bp, human
gcgccgccgcctggtgcgag

SEQ ID NO: 171316 - DNA, 20 bp, human
ggcgctgggctcgagaacca

SEQ ID NO: 171317 - DNA, 20 bp, human
ggccgggtgccggagaacga

SEQ ID NO: 171318 - DNA, 20 bp, human
gccgggcccgagcggatcgc

SEQ ID NO: 171319 - DNA, 20 bp, human
gtaggacctggggtcctcaa

SEQ ID NO: 171320 - DNA, 20 bp, human
gccgaggacacgccccgaag

SEQ ID NO: 171321 - DNA, 20 bp, human
gggccgaaagtacccggagg

SEQ ID NO: 171322 - DNA, 20 bp, human
gggcggaaccccaggtggtc

SEQ ID NO: 171323 - DNA, 20 bp, human
ggggctcgagaaccacggct

SEQ ID NO: 171324 - DNA, 20 bp, human
gagggtgcgatgctggatgg

SEQ ID NO: 171325 - DNA, 20 bp, human
gccgagcccgcgatccgctc

SEQ ID NO: 171326 - DNA, 20 bp, human
gtcgagagccggaccgccag

SEQ ID NO: 171327 - DNA, 20 bp, human
gctcgatggtggcgtgacgg

SEQ ID NO: 171328 - DNA, 20 bp, human
gcgcagcgaggtgcagaagg

SEQ ID NO: 171329 - DNA, 20 bp, human
gcggcgcgttctcctcggtt

SEQ ID NO: 171330 - DNA, 20 bp, human
ggctggttccctcccaaccg

SEQ ID NO: 171331 - DNA, 20 bp, human
gtccgcacgtcgggcctccg

SEQ ID NO: 171332 - DNA, 20 bp, human
gtgcacctcgctgcgggcag

SEQ ID NO: 171333 - DNA, 20 bp, human
gggtggcggcgcgttctcct

SEQ ID NO: 171334 - DNA, 20 bp, human
gcagcgctggtacagcccgc

SEQ ID NO: 171335 - DNA, 20 bp, human
gcctcccggcctgggttcgc

SEQ ID NO: 171336 - DNA, 20 bp, human
gccgaggctgagttcctcca

SEQ ID NO: 171337 - DNA, 20 bp, human
gagccggcggcgcccagatg

SEQ ID NO: 171338 - DNA, 20 bp, human
gccgctcccggcgcctcctg

SEQ ID NO: 171339 - DNA, 20 bp, human
gcctgttgcgcgactcccgg

SEQ ID NO: 171340 - DNA, 20 bp, human
gactcagcctcggccgcagg

SEQ ID NO: 171341 - DNA, 20 bp, human
gcagggcgcgcgtcccctgt

SEQ ID NO: 171342 - DNA, 20 bp, human
gtgtttccgaaggtgcccag

SEQ ID NO: 171343 - DNA, 20 bp, human
gcccgtgcgcggagagatcg

SEQ ID NO: 171344 - DNA, 20 bp, human
gcgccgccgcggccgcatct

SEQ ID NO: 171345 - DNA, 20 bp, human
gtgcgcggagagatcgggga

SEQ ID NO: 171346 - DNA, 20 bp, human
ggcaggctgacggagaaact

SEQ ID NO: 171347 - DNA, 20 bp, human
ggctgcttccggtaggagag

SEQ ID NO: 171348 - DNA, 20 bp, human
ggccgccagccgggacccgc

SEQ ID NO: 171349 - DNA, 20 bp, human
ggacttgacagcccgagggt

SEQ ID NO: 171350 - DNA, 20 bp, human
gctctacaccgctctcctac

SEQ ID NO: 171351 - DNA, 20 bp, human
gtcagcctgcgggtcccggc

SEQ ID NO: 171352 - DNA, 20 bp, human
ggtgcagcggcaacatccag

SEQ ID NO: 171353 - DNA, 20 bp, human
gtccgtcagcctgcgggtcc

SEQ ID NO: 171354 - DNA, 20 bp, human
gccagccgggccctgcgtcc

SEQ ID NO: 171355 - DNA, 20 bp, human
gcccgggcctgacagattgg

SEQ ID NO: 171356 - DNA, 20 bp, human
gatggagggagccggagaag

SEQ ID NO: 171357 - DNA, 20 bp, human
gtgagctgcagtcagatccg

SEQ ID NO: 171358 - DNA, 20 bp, human
gtcccagtctagagccggat

SEQ ID NO: 171359 - DNA, 20 bp, human
gacagcacggaaacggtccg

SEQ ID NO: 171360 - DNA, 20 bp, human
gactccctgagaccccccgg

SEQ ID NO: 171361 - DNA, 20 bp, human
gctgcagtcagatccgggga

SEQ ID NO: 171362 - DNA, 20 bp, human
gcgggaccacagcacggaaa

SEQ ID NO: 171363 - DNA, 20 bp, human
ggcttggggcctggactcga

SEQ ID NO: 171364 - DNA, 20 bp, human
ggcttacgagccaaagttag

SEQ ID NO: 171365 - DNA, 20 bp, human
ggtctgactccccctaccca

SEQ ID NO: 171366 - DNA, 20 bp, human
gcaccatggcgctcgcactt

SEQ ID NO: 171367 - DNA, 20 bp, human
ggcgccccggcgggaggtaa

SEQ ID NO: 171368 - DNA, 20 bp, human
ggcgctcgaggccggtcggt

SEQ ID NO: 171369 - DNA, 20 bp, human
ggagggcccgacgcccccaa

SEQ ID NO: 171370 - DNA, 20 bp, human
ggaggtaaggggctctctgg

SEQ ID NO: 171371 - DNA, 20 bp, human
gggcccgacgcccccaaagg

SEQ ID NO: 171372 - DNA, 20 bp, human
gcgcaggcgcaggagcgacg

SEQ ID NO: 171373 - DNA, 20 bp, human
gcgaccggcctcgagcgccc

SEQ ID NO: 171374 - DNA, 20 bp, human
gctgcgccgtgcccaccgac

SEQ ID NO: 171375 - DNA, 20 bp, human
gaggcccaccaagcctgtga

SEQ ID NO: 171376 - DNA, 20 bp, human
gggtcgccggctgcttacgt

SEQ ID NO: 171377 - DNA, 20 bp, human
gacgtgggcgggcctagtgt

SEQ ID NO: 171378 - DNA, 20 bp, human
gagggtgcgggtcgctatgg

SEQ ID NO: 171379 - DNA, 20 bp, human
ggcaccctcagccccacact

SEQ ID NO: 171380 - DNA, 20 bp, human
gctgcggcgacagggattgg

SEQ ID NO: 171381 - DNA, 20 bp, human
gggcaggaccagtccttcag

SEQ ID NO: 171382 - DNA, 20 bp, human
ggggcctagtgtggggctga

SEQ ID NO: 171383 - DNA, 20 bp, human
gcgccggctgcttacgtggg

SEQ ID NO: 171384 - DNA, 20 bp, human
gtccagccgggcccgcgaag

SEQ ID NO: 171385 - DNA, 20 bp, human
ggtcccccttcctcaaaata

SEQ ID NO: 171386 - DNA, 20 bp, human
ggacatgctgactgggatct

SEQ ID NO: 171387 - DNA, 20 bp, human
gggcaggactccaacaccgc

SEQ ID NO: 171388 - DNA, 20 bp, human
gacttcacacctggagaatc

SEQ ID NO: 171389 - DNA, 20 bp, human
ggtatccatagactgacatc

SEQ ID NO: 171390 - DNA, 20 bp, human
gtaaagaataggcgtctaac

SEQ ID NO: 171391 - DNA, 20 bp, human
gtattactgacatgctgact

SEQ ID NO: 171392 - DNA, 20 bp, human
ggtaaccagatgtcagtcta

SEQ ID NO: 171393 - DNA, 20 bp, human
gatgtgaacaaatcagctac

SEQ ID NO: 171394 - DNA, 20 bp, human
gtttgctcagatttggaccg

SEQ ID NO: 171395 - DNA, 20 bp, human
gaggactccaacaccgcagg

SEQ ID NO: 171396 - DNA, 20 bp, human
gctcaccgtgcggagctcct

SEQ ID NO: 171397 - DNA, 20 bp, human
gatgctcccgggagtggcag

SEQ ID NO: 171398 - DNA, 20 bp, human
gagcatgaaggaccgaaccc

SEQ ID NO: 171399 - DNA, 20 bp, human
ggcacgggaggtcagagatg

SEQ ID NO: 171400 - DNA, 20 bp, human
gcgcgcatgcggggctcaca

SEQ ID NO: 171401 - DNA, 20 bp, human
gagagaaagggcctgctctg

SEQ ID NO: 171402 - DNA, 20 bp, human
gccggcgccgctgccactcc

SEQ ID NO: 171403 - DNA, 20 bp, human
ggccactcccgggagcatga

SEQ ID NO: 171404 - DNA, 20 bp, human
gtacaccgagggggcacggg

SEQ ID NO: 171405 - DNA, 20 bp, human
gaccgcggtgggaacctcct

SEQ ID NO: 171406 - DNA, 20 bp, human
gcggcacagggtaggatgga

SEQ ID NO: 171407 - DNA, 20 bp, human
gtgcggctgcggcacagggt

SEQ ID NO: 171408 - DNA, 20 bp, human
ggggcgaaggatgagatcgg

SEQ ID NO: 171409 - DNA, 20 bp, human
ggctgcggcacagggtagga

SEQ ID NO: 171410 - DNA, 20 bp, human
gtcaggcgcctgaagatact

SEQ ID NO: 171411 - DNA, 20 bp, human
gggcgggaccccaatattgg

SEQ ID NO: 171412 - DNA, 20 bp, human
gatgcgggagccgagcgcgg

SEQ ID NO: 171413 - DNA, 20 bp, human
gggttcactggagagacatc

SEQ ID NO: 171414 - DNA, 20 bp, human
ggagccaagcggagatgcta

SEQ ID NO: 171415 - DNA, 20 bp, human
gggagcgcgcaaggagcagg

SEQ ID NO: 171416 - DNA, 20 bp, human
ggggggtcccgggagtccta

SEQ ID NO: 171417 - DNA, 20 bp, human
gttcctgggcggagtcctca

SEQ ID NO: 171418 - DNA, 20 bp, human
gcggctgccagacctgacgg

SEQ ID NO: 171419 - DNA, 20 bp, human
gggagccacgctcgaagagg

SEQ ID NO: 171420 - DNA, 20 bp, human
gcggggcctgaggcggagac

SEQ ID NO: 171421 - DNA, 20 bp, human
gcccgggagtcctagggtgg

SEQ ID NO: 171422 - DNA, 20 bp, human
gggctgcgggcagggtctca

SEQ ID NO: 171423 - DNA, 20 bp, human
gcgccctgaggactccgccc

SEQ ID NO: 171424 - DNA, 20 bp, human
gcagggagccacgctcgaag

SEQ ID NO: 171425 - DNA, 20 bp, human
gaggccagtgggctccggct

SEQ ID NO: 171426 - DNA, 20 bp, human
gtagctaggaggagcgtccg

SEQ ID NO: 171427 - DNA, 20 bp, human
gggaggagcgtccgaggcca

SEQ ID NO: 171428 - DNA, 20 bp, human
ggcggcggccgctagctagg

SEQ ID NO: 171429 - DNA, 20 bp, human
gcgggcacatgaccccgcag

SEQ ID NO: 171430 - DNA, 20 bp, human
gtgcctagcgatgaatcacc

SEQ ID NO: 171431 - DNA, 20 bp, human
gccgcctgcggcgaaactca

SEQ ID NO: 171432 - DNA, 20 bp, human
gtggagcgcgaggcgccggt

SEQ ID NO: 171433 - DNA, 20 bp, human
gcacatgaccccgcagggga

SEQ ID NO: 171434 - DNA, 20 bp, human
ggcgcctcgcgctccaaatc

SEQ ID NO: 171435 - DNA, 20 bp, human
gcgcttccggcagctcacct

SEQ ID NO: 171436 - DNA, 20 bp, human
gcgaccccggggacccccca

SEQ ID NO: 171437 - DNA, 20 bp, human
gtggtcttcgggatagggag

SEQ ID NO: 171438 - DNA, 20 bp, human
gcccccaaggttccacaggt

SEQ ID NO: 171439 - DNA, 20 bp, human
gcttaccccgcaggacccac

SEQ ID NO: 171440 - DNA, 20 bp, human
gggcctttcgaggcagtggg

SEQ ID NO: 171441 - DNA, 20 bp, human
gaagagccgcagcgaaacgg

SEQ ID NO: 171442 - DNA, 20 bp, human
gtgagacaggtgagacgcca

SEQ ID NO: 171443 - DNA, 20 bp, human
gtgcctcgaaaggcctctgg

SEQ ID NO: 171444 - DNA, 20 bp, human
gtcttcgggatagggagggg

SEQ ID NO: 171445 - DNA, 20 bp, human
gcacctcgcgggggccgtgt

SEQ ID NO: 171446 - DNA, 20 bp, human
ggtctttggtcgggtttcgg

SEQ ID NO: 171447 - DNA, 20 bp, human
gcctccgggagggccagtga

SEQ ID NO: 171448 - DNA, 20 bp, human
gccggtgagattggaagtgg

SEQ ID NO: 171449 - DNA, 20 bp, human
gtcggcggcttcagtgctcg

SEQ ID NO: 171450 - DNA, 20 bp, human
gcggccggtgagattggaag

SEQ ID NO: 171451 - DNA, 20 bp, human
gccgcttccagtctttggtc

SEQ ID NO: 171452 - DNA, 20 bp, human
ggaggggccgaaggaaaccg

SEQ ID NO: 171453 - DNA, 20 bp, human
gcgtggccgcttccagtctt

SEQ ID NO: 171454 - DNA, 20 bp, human
gggtccgtcactggccctcc

SEQ ID NO: 171455 - DNA, 20 bp, human
gggaaaccgcggaaacgaaa

SEQ ID NO: 171456 - DNA, 20 bp, human
gcggtccaggtagggatgga

SEQ ID NO: 171457 - DNA, 20 bp, human
gtgagcgagtgctggaccag

SEQ ID NO: 171458 - DNA, 20 bp, human
gactcgggcgccggccccct

SEQ ID NO: 171459 - DNA, 20 bp, human
gtggcttcacggtccaggta

SEQ ID NO: 171460 - DNA, 20 bp, human
gagcaccactggccgaatcc

SEQ ID NO: 171461 - DNA, 20 bp, human
gcactgcgagaagacctagg

SEQ ID NO: 171462 - DNA, 20 bp, human
ggagtccgggattcggccag

SEQ ID NO: 171463 - DNA, 20 bp, human
ggctccaccggaggaagagg

SEQ ID NO: 171464 - DNA, 20 bp, human
gcttcgggaggagccgggac

SEQ ID NO: 171465 - DNA, 20 bp, human
gttcacggtccaggtaggga

SEQ ID NO: 171466 - DNA, 20 bp, human
gtgagggctccggggtaggt

SEQ ID NO: 171467 - DNA, 20 bp, human
gtgacggcggtcggaggtgt

SEQ ID NO: 171468 - DNA, 20 bp, human
gcccctgggcagagctccgg

SEQ ID NO: 171469 - DNA, 20 bp, human
gtctgcagcaggcactcggg

SEQ ID NO: 171470 - DNA, 20 bp, human
gcggggtaggtgggtgacgg

SEQ ID NO: 171471 - DNA, 20 bp, human
ggctggcggagcgcaccccg

SEQ ID NO: 171472 - DNA, 20 bp, human
ggcaattctcagctgatggg

SEQ ID NO: 171473 - DNA, 20 bp, human
gcggcggtcggaggtgtagg

SEQ ID NO: 171474 - DNA, 20 bp, human
gagctctgcccaggggaccg

SEQ ID NO: 171475 - DNA, 20 bp, human
gagggcgccagagccggctg

SEQ ID NO: 171476 - DNA, 20 bp, human
gcctcacccgggactcacca

SEQ ID NO: 171477 - DNA, 20 bp, human
gagagcaggaagagtccgag

SEQ ID NO: 171478 - DNA, 20 bp, human
ggcaggaagagtccgagcgg

SEQ ID NO: 171479 - DNA, 20 bp, human
ggaagagtccgagcggcggg

SEQ ID NO: 171480 - DNA, 20 bp, human
gctagctccaaaaccaggat

SEQ ID NO: 171481 - DNA, 20 bp, human
gccgggactcaccaggggtc

SEQ ID NO: 171482 - DNA, 20 bp, human
gcaggatggcaccggacccc

SEQ ID NO: 171483 - DNA, 20 bp, human
gtgagggcggcggtgcgtgg

SEQ ID NO: 171484 - DNA, 20 bp, human
gggaagcccggcctccccga

SEQ ID NO: 171485 - DNA, 20 bp, human
gccacacttggtccttgcaa

SEQ ID NO: 171486 - DNA, 20 bp, human
gccagcgcgcccacctgagg

SEQ ID NO: 171487 - DNA, 20 bp, human
gccgccccgcagccgcgcta

SEQ ID NO: 171488 - DNA, 20 bp, human
gagggctggggtgaaacatg

SEQ ID NO: 171489 - DNA, 20 bp, human
gcgtcagtcggtccctagcg

SEQ ID NO: 171490 - DNA, 20 bp, human
gacagggaccgcgaggaagg

SEQ ID NO: 171491 - DNA, 20 bp, human
gctagggaccgactgacgcg

SEQ ID NO: 171492 - DNA, 20 bp, human
gaccgactgacgcgcggact

SEQ ID NO: 171493 - DNA, 20 bp, human
ggagacagggaccgcgagga

SEQ ID NO: 171494 - DNA, 20 bp, human
ggcccagtccgcgcgtcagt

SEQ ID NO: 171495 - DNA, 20 bp, human
gtgttgtcggagagagtaag

SEQ ID NO: 171496 - DNA, 20 bp, human
gtaagccgggcaaagttcag

SEQ ID NO: 171497 - DNA, 20 bp, human
gccctcggggctgaaggcgg

SEQ ID NO: 171498 - DNA, 20 bp, human
gcgctgaccagagccctagg

SEQ ID NO: 171499 - DNA, 20 bp, human
gacacacccggaagcggcgg

SEQ ID NO: 171500 - DNA, 20 bp, human
ggggcgccatcttccccgag

SEQ ID NO: 171501 - DNA, 20 bp, human
ggagcacctgaccctcgagg

SEQ ID NO: 171502 - DNA, 20 bp, human
ggaaagtgagtgcctctccg

SEQ ID NO: 171503 - DNA, 20 bp, human
gggattcttggggcctccta

SEQ ID NO: 171504 - DNA, 20 bp, human
gttctggcaccggagagcag

SEQ ID NO: 171505 - DNA, 20 bp, human
gtgagcgctcacagcaccta

SEQ ID NO: 171506 - DNA, 20 bp, human
ggccgccggtggcagagagg

SEQ ID NO: 171507 - DNA, 20 bp, human
gcaccccaacgccgcttctg

SEQ ID NO: 171508 - DNA, 20 bp, human
gccgcttctgcggccaaagt

SEQ ID NO: 171509 - DNA, 20 bp, human
gcaactggtggagcgcggac

SEQ ID NO: 171510 - DNA, 20 bp, human
gaaagtaggttgggagtgga

SEQ ID NO: 171511 - DNA, 20 bp, human
gctggtgctggcaaggaata

SEQ ID NO: 171512 - DNA, 20 bp, human
gcgcggccgagggcacgcac

SEQ ID NO: 171513 - DNA, 20 bp, human
ggagagacatccccaactgg

SEQ ID NO: 171514 - DNA, 20 bp, human
gttctgcggccaaagtaggt

SEQ ID NO: 171515 - DNA, 20 bp, human
gcgccatcttcccgacactg

SEQ ID NO: 171516 - DNA, 20 bp, human
ggccgggtcgagacaaaggc

SEQ ID NO: 171517 - DNA, 20 bp, human
gggcaagcttgcacgcggac

SEQ ID NO: 171518 - DNA, 20 bp, human
gaggccgggttgccagatta

SEQ ID NO: 171519 - DNA, 20 bp, human
gggctgccgggtcgagacaa

SEQ ID NO: 171520 - DNA, 20 bp, human
gccactgggcaagttgtaag

SEQ ID NO: 171521 - DNA, 20 bp, human
ggcttgcagtcgggctacgg

SEQ ID NO: 171522 - DNA, 20 bp, human
gggggaagccgactgcccac

SEQ ID NO: 171523 - DNA, 20 bp, human
gggtggcagcgcttgcagtc

SEQ ID NO: 171524 - DNA, 20 bp, human
gcagtcgggctacggaggcc

SEQ ID NO: 171525 - DNA, 20 bp, human
gttctggcgagaagcgaagt

SEQ ID NO: 171526 - DNA, 20 bp, human
gacagagagccggcgacccc

SEQ ID NO: 171527 - DNA, 20 bp, human
ggcggcccgcgctgtaaccg

SEQ ID NO: 171528 - DNA, 20 bp, human
gcggccgcaagaaacctggg

SEQ ID NO: 171529 - DNA, 20 bp, human
gtgtgtgcgaggccgagcgg

SEQ ID NO: 171530 - DNA, 20 bp, human
gcgagggcgggccggtccag

SEQ ID NO: 171531 - DNA, 20 bp, human
gactgcgacgacaagagcgg

SEQ ID NO: 171532 - DNA, 20 bp, human
gcggcgcggggacccacacc

SEQ ID NO: 171533 - DNA, 20 bp, human
gaccgcggaaacggaggagt

SEQ ID NO: 171534 - DNA, 20 bp, human
gcagcagccgcgccaagcag

SEQ ID NO: 171535 - DNA, 20 bp, human
ggtaccgcagcccggctcct

SEQ ID NO: 171536 - DNA, 20 bp, human
gcgccaggcgccgcgaccag

SEQ ID NO: 171537 - DNA, 20 bp, human
gcggcgcctggcgctctccg

SEQ ID NO: 171538 - DNA, 20 bp, human
gtgccagcccgggaagctga

SEQ ID NO: 171539 - DNA, 20 bp, human
gtaggacctcggagagcgcc

SEQ ID NO: 171540 - DNA, 20 bp, human
ggggctccggccgcttctct

SEQ ID NO: 171541 - DNA, 20 bp, human
gggccgaggtaggcgggctc

SEQ ID NO: 171542 - DNA, 20 bp, human
ggcttcacgtcccccgagag

SEQ ID NO: 171543 - DNA, 20 bp, human
ggcacggcagccgctctcgg

SEQ ID NO: 171544 - DNA, 20 bp, human
gggagcctgactgctcggtt

SEQ ID NO: 171545 - DNA, 20 bp, human
gggccggagcccgcctacct

SEQ ID NO: 171546 - DNA, 20 bp, human
ggcacaacgggtcccagggt

SEQ ID NO: 171547 - DNA, 20 bp, human
gcggcggcgagccagcaccc

SEQ ID NO: 171548 - DNA, 20 bp, human
ggccgcgcgcgaaaagggag

SEQ ID NO: 171549 - DNA, 20 bp, human
gccgttgtgcgggcagtatt

SEQ ID NO: 171550 - DNA, 20 bp, human
gtattgggcaagccgcagaa

SEQ ID NO: 171551 - DNA, 20 bp, human
ggaggggagccaggcggtca

SEQ ID NO: 171552 - DNA, 20 bp, human
gccaggcgccccaacagccg

SEQ ID NO: 171553 - DNA, 20 bp, human
gaggaaatcgctccgttctg

SEQ ID NO: 171554 - DNA, 20 bp, human
gagcacgaggctcctccccg

SEQ ID NO: 171555 - DNA, 20 bp, human
ggcacaaagcagctgcgccg

SEQ ID NO: 171556 - DNA, 20 bp, human
gcggaaaccggagtgaccag

SEQ ID NO: 171557 - DNA, 20 bp, human
gcctctccaggaataaacag

SEQ ID NO: 171558 - DNA, 20 bp, human
gccgatggcaccggcccagt

SEQ ID NO: 171559 - DNA, 20 bp, human
gatggcaccggcccagtcgg

SEQ ID NO: 171560 - DNA, 20 bp, human
gcggaggggaaataatgaca

SEQ ID NO: 171561 - DNA, 20 bp, human
gaaccggagtgaccagagga

SEQ ID NO: 171562 - DNA, 20 bp, human
ggggaaataatgacagggtt

SEQ ID NO: 171563 - DNA, 20 bp, human
gcactaccgtgtccctcctc

SEQ ID NO: 171564 - DNA, 20 bp, human
gagggacacggtagtgaacg

SEQ ID NO: 171565 - DNA, 20 bp, human
ggtagtgaacggggtatggg

SEQ ID NO: 171566 - DNA, 20 bp, human
gagccagcccgagggtcggc

SEQ ID NO: 171567 - DNA, 20 bp, human
ggtcccagtgactccagcag

SEQ ID NO: 171568 - DNA, 20 bp, human
gaggggtacggagactctgg

SEQ ID NO: 171569 - DNA, 20 bp, human
gctgggcggcctgaggggta

SEQ ID NO: 171570 - DNA, 20 bp, human
gctgaggggtacggagactc

SEQ ID NO: 171571 - DNA, 20 bp, human
gcggccggagccacagggag

SEQ ID NO: 171572 - DNA, 20 bp, human
gagggcgcccgtacaggtgg

SEQ ID NO: 171573 - DNA, 20 bp, human
gggaggcagggcgcccgtac

SEQ ID NO: 171574 - DNA, 20 bp, human
ggagaggacgagcaactcag

SEQ ID NO: 171575 - DNA, 20 bp, human
gctctccagaccccgcggag

SEQ ID NO: 171576 - DNA, 20 bp, human
gaaacgacggcccggatctg

SEQ ID NO: 171577 - DNA, 20 bp, human
gcatagtcgcgcagccgggg

SEQ ID NO: 171578 - DNA, 20 bp, human
ggaaagctgtgggaccatcc

SEQ ID NO: 171579 - DNA, 20 bp, human
gaggtcgccattatcagcag

SEQ ID NO: 171580 - DNA, 20 bp, human
gtcactaaacctgaacccaa

SEQ ID NO: 171581 - DNA, 20 bp, human
gccaagttgcagagaccctt

SEQ ID NO: 171582 - DNA, 20 bp, human
gggaccgtcagagcactgcc

SEQ ID NO: 171583 - DNA, 20 bp, human
ggtgacaccactgctgataa

SEQ ID NO: 171584 - DNA, 20 bp, human
gccgaccgcaggtcccccac

SEQ ID NO: 171585 - DNA, 20 bp, human
ggggccatctcctcagatcc

SEQ ID NO: 171586 - DNA, 20 bp, human
gtgggggccccgaggagtag

SEQ ID NO: 171587 - DNA, 20 bp, human
gcgcgagcgaacgaccaaga

SEQ ID NO: 171588 - DNA, 20 bp, human
gtagcagtcgaacaccctct

SEQ ID NO: 171589 - DNA, 20 bp, human
ggcggcggcctgcctaggtg

SEQ ID NO: 171590 - DNA, 20 bp, human
gcgtccccgggacaatgcgg

SEQ ID NO: 171591 - DNA, 20 bp, human
ggcggggcgctctggagact

SEQ ID NO: 171592 - DNA, 20 bp, human
ggacagagaaccggaagtga

SEQ ID NO: 171593 - DNA, 20 bp, human
gcgaggggaagggggaggta

SEQ ID NO: 171594 - DNA, 20 bp, human
gagtcgcggggagagagtcg

SEQ ID NO: 171595 - DNA, 20 bp, human
ggctctggagactgggagag

SEQ ID NO: 171596 - DNA, 20 bp, human
ggatagcaccgtgaactaca

SEQ ID NO: 171597 - DNA, 20 bp, human
gtggcaaccggcattcactc

SEQ ID NO: 171598 - DNA, 20 bp, human
gctggagccagagtgaatgc

SEQ ID NO: 171599 - DNA, 20 bp, human
gtacagggtgtagttgaaaa

SEQ ID NO: 171600 - DNA, 20 bp, human
ggaaaatggcttctcaccta

SEQ ID NO: 171601 - DNA, 20 bp, human
gagcttccgctgcttcaaaa

SEQ ID NO: 171602 - DNA, 20 bp, human
ggccagaaagcaaatcatgt

SEQ ID NO: 171603 - DNA, 20 bp, human
gctgcttcaaaacggcgtgc

SEQ ID NO: 171604 - DNA, 20 bp, human
gaaagcagtgccatggcaac

SEQ ID NO: 171605 - DNA, 20 bp, human
gtattcctaacgcagagctc

SEQ ID NO: 171606 - DNA, 20 bp, human
gtggttccgaagggtggcca

SEQ ID NO: 171607 - DNA, 20 bp, human
gacggggtccgactcagaaa

SEQ ID NO: 171608 - DNA, 20 bp, human
gagcctgccgtagaacatgg

SEQ ID NO: 171609 - DNA, 20 bp, human
gcgaggccggtggttccgaa

SEQ ID NO: 171610 - DNA, 20 bp, human
ggcaggtgggctctgagtgg

SEQ ID NO: 171611 - DNA, 20 bp, human
gggccggtggttccgaaggg

SEQ ID NO: 171612 - DNA, 20 bp, human
gactagcctgccgtagaaca

SEQ ID NO: 171613 - DNA, 20 bp, human
ggtcagagccgcgcaaacat

SEQ ID NO: 171614 - DNA, 20 bp, human
gaccgtgccagacgccggaa

SEQ ID NO: 171615 - DNA, 20 bp, human
ggtcgcccgagggccttgca

SEQ ID NO: 171616 - DNA, 20 bp, human
gaccatggtagcgatgtcag

SEQ ID NO: 171617 - DNA, 20 bp, human
gctgcgcgacaggagacggg

SEQ ID NO: 171618 - DNA, 20 bp, human
ggtagcgatgtcagcggcag

SEQ ID NO: 171619 - DNA, 20 bp, human
gacatcgctaccatggtctc

SEQ ID NO: 171620 - DNA, 20 bp, human
gaagctgcgcgacaggagac

SEQ ID NO: 171621 - DNA, 20 bp, human
ggtactggctggactcacgg

SEQ ID NO: 171622 - DNA, 20 bp, human
gggtgacaaatgacaggatg

SEQ ID NO: 171623 - DNA, 20 bp, human
ggagtcggggacccctacgg

SEQ ID NO: 171624 - DNA, 20 bp, human
gacagtactggctggactca

SEQ ID NO: 171625 - DNA, 20 bp, human
gccccgcggtgacaaatgac

SEQ ID NO: 171626 - DNA, 20 bp, human
gccgggtcccaggtgagcgt

SEQ ID NO: 171627 - DNA, 20 bp, human
gaactcggcacggggcagta

SEQ ID NO: 171628 - DNA, 20 bp, human
gccggcctgcgctgctacgg

SEQ ID NO: 171629 - DNA, 20 bp, human
gagctgacaataaaacctca

SEQ ID NO: 171630 - DNA, 20 bp, human
gccatcttaaacaggaaact

SEQ ID NO: 171631 - DNA, 20 bp, human
gttcccggcctgcgctgcta

SEQ ID NO: 171632 - DNA, 20 bp, human
gagtctgcgcgggcagacag

SEQ ID NO: 171633 - DNA, 20 bp, human
gccgcgtcacctcccgaagt

SEQ ID NO: 171634 - DNA, 20 bp, human
gggagaccaagagtagcagg

SEQ ID NO: 171635 - DNA, 20 bp, human
gtcggcacggggcagtaggg

SEQ ID NO: 171636 - DNA, 20 bp, human
gctggcagagttcctgtcaa

SEQ ID NO: 171637 - DNA, 20 bp, human
ggaagacttgatcccttgac

SEQ ID NO: 171638 - DNA, 20 bp, human
gtgtccagtggcacaacact

SEQ ID NO: 171639 - DNA, 20 bp, human
gagaagctatatccagctgc

SEQ ID NO: 171640 - DNA, 20 bp, human
gaacagaatggtaagctaca

SEQ ID NO: 171641 - DNA, 20 bp, human
gggtgacctgtgagcaatta

SEQ ID NO: 171642 - DNA, 20 bp, human
gcctctcagtgtataaagta

SEQ ID NO: 171643 - DNA, 20 bp, human
gtgattgtttcaaatcattt

SEQ ID NO: 171644 - DNA, 20 bp, human
ggaaaaccttaattgctcac

SEQ ID NO: 171645 - DNA, 20 bp, human
gaggccagatttccttctaa

SEQ ID NO: 171646 - DNA, 20 bp, human
gggcgcttcacaggactccg

SEQ ID NO: 171647 - DNA, 20 bp, human
ggcggacaggggcgcttcac

SEQ ID NO: 171648 - DNA, 20 bp, human
gctctctgagggccccacag

SEQ ID NO: 171649 - DNA, 20 bp, human
gtgagtagccgcgacgacaa

SEQ ID NO: 171650 - DNA, 20 bp, human
gcggcgggcggggaggatat

SEQ ID NO: 171651 - DNA, 20 bp, human
gtgaccagggggtgtgacct

SEQ ID NO: 171652 - DNA, 20 bp, human
gcgtgaggggagtaaatggg

SEQ ID NO: 171653 - DNA, 20 bp, human
gtcccgtgaggggagtaaat

SEQ ID NO: 171654 - DNA, 20 bp, human
gcgacaagggagttcccgtg

SEQ ID NO: 171655 - DNA, 20 bp, human
gcccacagaggcgcggacag

SEQ ID NO: 171656 - DNA, 20 bp, human
ggtctgcctagcagtgtccg

SEQ ID NO: 171657 - DNA, 20 bp, human
gcagcccccaactcgaggac

SEQ ID NO: 171658 - DNA, 20 bp, human
gactcgaggaccggcagcca

SEQ ID NO: 171659 - DNA, 20 bp, human
gccgctactccagcacggat

SEQ ID NO: 171660 - DNA, 20 bp, human
ggcccccgagtactaccccg

SEQ ID NO: 171661 - DNA, 20 bp, human
ggtcgagtgtaacgcaccca

SEQ ID NO: 171662 - DNA, 20 bp, human
gtcctcggggtagtactcgg

SEQ ID NO: 171663 - DNA, 20 bp, human
gggctgccgcggacactgct

SEQ ID NO: 171664 - DNA, 20 bp, human
gggagtagcggggaagccct

SEQ ID NO: 171665 - DNA, 20 bp, human
gtcgaccgtgatggggagag

SEQ ID NO: 171666 - DNA, 20 bp, human
gagactccccgaggcgatgg

SEQ ID NO: 171667 - DNA, 20 bp, human
gcaccctctggcagactcgg

SEQ ID NO: 171668 - DNA, 20 bp, human
ggccagcgggcggactcggt

SEQ ID NO: 171669 - DNA, 20 bp, human
ggcggcggcgacagcctggg

SEQ ID NO: 171670 - DNA, 20 bp, human
gcctctggcagactcggcgg

SEQ ID NO: 171671 - DNA, 20 bp, human
ggccgccccgaggcaccctc

SEQ ID NO: 171672 - DNA, 20 bp, human
gaggcaccctctggcagact

SEQ ID NO: 171673 - DNA, 20 bp, human
gtcggcggcggcgacagcct

SEQ ID NO: 171674 - DNA, 20 bp, human
gcggctggtcagggtaaagg

SEQ ID NO: 171675 - DNA, 20 bp, human
gcgggactgcacgccatcta

SEQ ID NO: 171676 - DNA, 20 bp, human
ggacggacccgaggagtcag

SEQ ID NO: 171677 - DNA, 20 bp, human
ggctgaagcgagggatccac

SEQ ID NO: 171678 - DNA, 20 bp, human
gacccaggcggccgcctgag

SEQ ID NO: 171679 - DNA, 20 bp, human
gtcctcagcaaaccaagcgg

SEQ ID NO: 171680 - DNA, 20 bp, human
gccagctgcgacgaaaagag

SEQ ID NO: 171681 - DNA, 20 bp, human
gcaaggcttgcagcaaagtg

SEQ ID NO: 171682 - DNA, 20 bp, human
ggacgcgggaaagtgtgtca

SEQ ID NO: 171683 - DNA, 20 bp, human
ggacgcacggatctccgtag

SEQ ID NO: 171684 - DNA, 20 bp, human
gaaagcgggacacaggccag

SEQ ID NO: 171685 - DNA, 20 bp, human
gtataacagggccccttaag

SEQ ID NO: 171686 - DNA, 20 bp, human
gcccgctcgggaggagataa

SEQ ID NO: 171687 - DNA, 20 bp, human
ggaatgggcagccagtaaag

SEQ ID NO: 171688 - DNA, 20 bp, human
gtctgcgggcgaggaaatgg

SEQ ID NO: 171689 - DNA, 20 bp, human
ggcgtccgcgagtctctggg

SEQ ID NO: 171690 - DNA, 20 bp, human
ggctgaaccggttctaaaga

SEQ ID NO: 171691 - DNA, 20 bp, human
ggcggcgctgcggagaccgt

SEQ ID NO: 171692 - DNA, 20 bp, human
gttggcctcccagagactcg

SEQ ID NO: 171693 - DNA, 20 bp, human
gctcggagcggcccccgctc

SEQ ID NO: 171694 - DNA, 20 bp, human
gcgtcggtgggtggctcccg

SEQ ID NO: 171695 - DNA, 20 bp, human
gcctgcgcaccaggactcgg

SEQ ID NO: 171696 - DNA, 20 bp, human
ggccggagctgctactatca

SEQ ID NO: 171697 - DNA, 20 bp, human
gcaacagcgactacgaggga

SEQ ID NO: 171698 - DNA, 20 bp, human
gcagcgactacgagggatgg

SEQ ID NO: 171699 - DNA, 20 bp, human
ggcagcaacagcgactacga

SEQ ID NO: 171700 - DNA, 20 bp, human
ggctcccctaagaagagtgg

SEQ ID NO: 171701 - DNA, 20 bp, human
gcaccgccggacagggaccc

SEQ ID NO: 171702 - DNA, 20 bp, human
gcccccttgggcggtggtgg

SEQ ID NO: 171703 - DNA, 20 bp, human
gctcactagccaaggaaagg

SEQ ID NO: 171704 - DNA, 20 bp, human
gctccccgcaccgccggaca

SEQ ID NO: 171705 - DNA, 20 bp, human
gaagagcctgggtccctgtc

SEQ ID NO: 171706 - DNA, 20 bp, human
gcagaggagcagagataagg

SEQ ID NO: 171707 - DNA, 20 bp, human
gcgagggcagcgaggatcag

SEQ ID NO: 171708 - DNA, 20 bp, human
gagccgccccggcccgacac

SEQ ID NO: 171709 - DNA, 20 bp, human
gtcggcaactaggaaacccc

SEQ ID NO: 171710 - DNA, 20 bp, human
gtaggaaaccccaggcgcag

SEQ ID NO: 171711 - DNA, 20 bp, human
ggaccgtcgctaatgaatct

SEQ ID NO: 171712 - DNA, 20 bp, human
gcatgactctcccccttcgg

SEQ ID NO: 171713 - DNA, 20 bp, human
gcggcgctcctcggaggtca

SEQ ID NO: 171714 - DNA, 20 bp, human
gggcggcttgatcggcaact

SEQ ID NO: 171715 - DNA, 20 bp, human
ggaatcttggggccggtgtc

SEQ ID NO: 171716 - DNA, 20 bp, human
gtcgagtggggattaagaga

SEQ ID NO: 171717 - DNA, 20 bp, human
ggtacaaacgcggctcccaa

SEQ ID NO: 171718 - DNA, 20 bp, human
gtgcttgtagaggatagata

SEQ ID NO: 171719 - DNA, 20 bp, human
ggtgtcatcacattcgagtg

SEQ ID NO: 171720 - DNA, 20 bp, human
gatacaacggggatatgaaa

SEQ ID NO: 171721 - DNA, 20 bp, human
gatatgaaaaggtacaaacg

SEQ ID NO: 171722 - DNA, 20 bp, human
gggatagataaggctgagaa

SEQ ID NO: 171723 - DNA, 20 bp, human
gactatgctaaaagagagag

SEQ ID NO: 171724 - DNA, 20 bp, human
gctgttttgagtatacaacg

SEQ ID NO: 171725 - DNA, 20 bp, human
gcgtgtttcaacagatggtt

SEQ ID NO: 171726 - DNA, 20 bp, human
gcgagtccggaggcatcggg

SEQ ID NO: 171727 - DNA, 20 bp, human
gcgaagtccagctccggacg

SEQ ID NO: 171728 - DNA, 20 bp, human
gggagagttgaaacagatgt

SEQ ID NO: 171729 - DNA, 20 bp, human
gcgcggccagccgagtccgg

SEQ ID NO: 171730 - DNA, 20 bp, human
gtgccgtgtccgcgggtcag

SEQ ID NO: 171731 - DNA, 20 bp, human
ggagcagcagcgctcgccgg

SEQ ID NO: 171732 - DNA, 20 bp, human
ggacacggcacaccgagcac

SEQ ID NO: 171733 - DNA, 20 bp, human
gcgcgcggagggctcgagga

SEQ ID NO: 171734 - DNA, 20 bp, human
gcccttgggtctaaacccta

SEQ ID NO: 171735 - DNA, 20 bp, human
gcgcccctgacccgcggaca

SEQ ID NO: 171736 - DNA, 20 bp, human
gtaaccaggcaggatgatga

SEQ ID NO: 171737 - DNA, 20 bp, human
gttgcaatgctgcaccaggt

SEQ ID NO: 171738 - DNA, 20 bp, human
gtcctaggtccactgtggga

SEQ ID NO: 171739 - DNA, 20 bp, human
gggtttcctaggtccactgt

SEQ ID NO: 171740 - DNA, 20 bp, human
gggtcttgcaatgctgcacc

SEQ ID NO: 171741 - DNA, 20 bp, human
gttccagaagctgaggcctc

SEQ ID NO: 171742 - DNA, 20 bp, human
ggacacagtggaacggccca

SEQ ID NO: 171743 - DNA, 20 bp, human
gtttgtttttttccccgggg

SEQ ID NO: 171744 - DNA, 20 bp, human
gagggggattcacgcaggcc

SEQ ID NO: 171745 - DNA, 20 bp, human
ggcaagacctggcctccccg

SEQ ID NO: 171746 - DNA, 20 bp, human
gtcagcaaaaggaggatcct

SEQ ID NO: 171747 - DNA, 20 bp, human
gagggcgtcctgggccattc

SEQ ID NO: 171748 - DNA, 20 bp, human
gggtgagtgacacaccggaa

SEQ ID NO: 171749 - DNA, 20 bp, human
gtatccaggcaggatggtga

SEQ ID NO: 171750 - DNA, 20 bp, human
gtgacacaccggaatggccc

SEQ ID NO: 171751 - DNA, 20 bp, human
ggggtttcttaggtcagtgt

SEQ ID NO: 171752 - DNA, 20 bp, human
gaggggtgttgtctgtgctg

SEQ ID NO: 171753 - DNA, 20 bp, human
gttcttaggtcagtgtggga

SEQ ID NO: 171754 - DNA, 20 bp, human
ggggggattcaggccggccg

SEQ ID NO: 171755 - DNA, 20 bp, human
gtttttaaaactatccaggc

SEQ ID NO: 171756 - DNA, 20 bp, human
ggtgtggtgtagggagtgta

SEQ ID NO: 171757 - DNA, 20 bp, human
gctgcaggcaaggagagaac

SEQ ID NO: 171758 - DNA, 20 bp, human
gtggaccttcaaaaccctca

SEQ ID NO: 171759 - DNA, 20 bp, human
gctgagtatgggtgtggtgt

SEQ ID NO: 171760 - DNA, 20 bp, human
gagggctgctctctgccctg

SEQ ID NO: 171761 - DNA, 20 bp, human
gacccatactcagcccctgc

SEQ ID NO: 171762 - DNA, 20 bp, human
gaggaaaagaaggaacgcag

SEQ ID NO: 171763 - DNA, 20 bp, human
ggctcaggtgagtgacacgt

SEQ ID NO: 171764 - DNA, 20 bp, human
gggttttgaaggtccagtgt

SEQ ID NO: 171765 - DNA, 20 bp, human
gagcagggtgaaggtgccct

SEQ ID NO: 171766 - DNA, 20 bp, human
gccgcggcggaactcaggga

SEQ ID NO: 171767 - DNA, 20 bp, human
ggcggcgtacaggggcatca

SEQ ID NO: 171768 - DNA, 20 bp, human
gtcagggaaggagctagctg

SEQ ID NO: 171769 - DNA, 20 bp, human
gaactgcgggcggcgtacag

SEQ ID NO: 171770 - DNA, 20 bp, human
gatctccgcggcggaactca

SEQ ID NO: 171771 - DNA, 20 bp, human
ggcgtacaggggcatcaggg

SEQ ID NO: 171772 - DNA, 20 bp, human
gcaggctgggttccagcata

SEQ ID NO: 171773 - DNA, 20 bp, human
gggtggaatgcaggagagag

SEQ ID NO: 171774 - DNA, 20 bp, human
gtccagcatagggctcttgg

SEQ ID NO: 171775 - DNA, 20 bp, human
gcgccgcccgcagtttgagt

SEQ ID NO: 171776 - DNA, 20 bp, human
ggccacactgcactatcaga

SEQ ID NO: 171777 - DNA, 20 bp, human
ggccctctgatagtgcagtg

SEQ ID NO: 171778 - DNA, 20 bp, human
ggtgtggtggcacacttggg

SEQ ID NO: 171779 - DNA, 20 bp, human
ggcagtgtggcagttggggt

SEQ ID NO: 171780 - DNA, 20 bp, human
gcaggtgtggtggcacactt

SEQ ID NO: 171781 - DNA, 20 bp, human
ggtaagtgttaagggaaagg

SEQ ID NO: 171782 - DNA, 20 bp, human
gtagtgcagtgtggcagttg

SEQ ID NO: 171783 - DNA, 20 bp, human
ggggtcatgtccaggcatgg

SEQ ID NO: 171784 - DNA, 20 bp, human
gtgggccatcggctcagtgc

SEQ ID NO: 171785 - DNA, 20 bp, human
gaagtcctgcactgagccga

SEQ ID NO: 171786 - DNA, 20 bp, human
ggcaactaagctggtaccag

SEQ ID NO: 171787 - DNA, 20 bp, human
gctgtgctgaggaagctcta

SEQ ID NO: 171788 - DNA, 20 bp, human
gagaggagcgcactgggtgg

SEQ ID NO: 171789 - DNA, 20 bp, human
gcacatgtgaggggcatgag

SEQ ID NO: 171790 - DNA, 20 bp, human
gagcgcggggcccagatatc

SEQ ID NO: 171791 - DNA, 20 bp, human
gatgtggaaacctcccaggc

SEQ ID NO: 171792 - DNA, 20 bp, human
gcaatgggctgtgtttgttc

SEQ ID NO: 171793 - DNA, 20 bp, human
gcatgaggggggctcaagga

SEQ ID NO: 171794 - DNA, 20 bp, human
ggtgactgaaaggtgcggcc

SEQ ID NO: 171795 - DNA, 20 bp, human
gggggcatgaggggggctca

SEQ ID NO: 171796 - DNA, 20 bp, human
gtagtgggtcagggaaggtc

SEQ ID NO: 171797 - DNA, 20 bp, human
ggtctccagccctgagtagt

SEQ ID NO: 171798 - DNA, 20 bp, human
gagccctgagtagtgggtca

SEQ ID NO: 171799 - DNA, 20 bp, human
ggacccagccatgcacctga

SEQ ID NO: 171800 - DNA, 20 bp, human
gttccctgacccactactca

SEQ ID NO: 171801 - DNA, 20 bp, human
gacctgggtgagccagatac

SEQ ID NO: 171802 - DNA, 20 bp, human
gctgggggtaagggaagtgg

SEQ ID NO: 171803 - DNA, 20 bp, human
gcttgaggtcaatgatccag

SEQ ID NO: 171804 - DNA, 20 bp, human
gatgatccaggggaaccctc

SEQ ID NO: 171805 - DNA, 20 bp, human
ggacctagagaagtgtaacc

SEQ ID NO: 171806 - DNA, 20 bp, human
gcggagcctgagccagacca

SEQ ID NO: 171807 - DNA, 20 bp, human
ggccagaccagggggatcca

SEQ ID NO: 171808 - DNA, 20 bp, human
ggcaggcccctggatccccc

SEQ ID NO: 171809 - DNA, 20 bp, human
gcccctggatccccctggtc

SEQ ID NO: 171810 - DNA, 20 bp, human
gtggatggtctgggcgcaca

SEQ ID NO: 171811 - DNA, 20 bp, human
gggtccccccgaggaatgga

SEQ ID NO: 171812 - DNA, 20 bp, human
gtcaggctccgcgtcatcaa

SEQ ID NO: 171813 - DNA, 20 bp, human
gggacctcacctggatggtc

SEQ ID NO: 171814 - DNA, 20 bp, human
gtccaggtgaggtccccccg

SEQ ID NO: 171815 - DNA, 20 bp, human
ggtgaggtccccccgaggaa

SEQ ID NO: 171816 - DNA, 20 bp, human
ggtgtggtgtagggagtgta

SEQ ID NO: 171817 - DNA, 20 bp, human
gctgcaggcaaggagagaac

SEQ ID NO: 171818 - DNA, 20 bp, human
gtggaccttcaaaaccctca

SEQ ID NO: 171819 - DNA, 20 bp, human
gctgagtatgggtgtggtgt

SEQ ID NO: 171820 - DNA, 20 bp, human
gagggctgctctctgccctg

SEQ ID NO: 171821 - DNA, 20 bp, human
ggctcaggtgagtgacacgt

SEQ ID NO: 171822 - DNA, 20 bp, human
gaggaaaagaaggaacgcag

SEQ ID NO: 171823 - DNA, 20 bp, human
gacccatactcagcccctgc

SEQ ID NO: 171824 - DNA, 20 bp, human
gagcagggtgaaggtgccct

SEQ ID NO: 171825 - DNA, 20 bp, human
gggttttgaaggtccagtgt

SEQ ID NO: 171826 - DNA, 20 bp, human
ggccacactgcactatcaga

SEQ ID NO: 171827 - DNA, 20 bp, human
ggccctctgatagtgcagtg

SEQ ID NO: 171828 - DNA, 20 bp, human
ggcagtgtggcagttggggt

SEQ ID NO: 171829 - DNA, 20 bp, human
ggtgtggtggcacacttggg

SEQ ID NO: 171830 - DNA, 20 bp, human
gcaggtgtggtggcacactt

SEQ ID NO: 171831 - DNA, 20 bp, human
gtagtgcagtgtggcagttg

SEQ ID NO: 171832 - DNA, 20 bp, human
ggggtcatgtccaggcatgg

SEQ ID NO: 171833 - DNA, 20 bp, human
ggtaagtgttaagggaaagg

SEQ ID NO: 171834 - DNA, 20 bp, human
gggatggggttcgccatgtt

SEQ ID NO: 171835 - DNA, 20 bp, human
gtgggccatcggctcagtgc

SEQ ID NO: 171836 - DNA, 20 bp, human
gtagtgggtcagggaaggtc

SEQ ID NO: 171837 - DNA, 20 bp, human
ggtctccagccctgagtagt

SEQ ID NO: 171838 - DNA, 20 bp, human
gagccctgagtagtgggtca

SEQ ID NO: 171839 - DNA, 20 bp, human
ggacccagccatgcacctga

SEQ ID NO: 171840 - DNA, 20 bp, human
gacctgggtgagccagatac

SEQ ID NO: 171841 - DNA, 20 bp, human
gttccctgacccactactca

SEQ ID NO: 171842 - DNA, 20 bp, human
gctgggggtaagggaagtgg

SEQ ID NO: 171843 - DNA, 20 bp, human
gcttgaggtcaatgatccag

SEQ ID NO: 171844 - DNA, 20 bp, human
gatgatccaggggaaccctc

SEQ ID NO: 171845 - DNA, 20 bp, human
ggacctagagaagtgtaacc

SEQ ID NO: 171846 - DNA, 20 bp, human
ggagtaaccatgggaaacgg

SEQ ID NO: 171847 - DNA, 20 bp, human
gtaaccatgggaaacggtgg

SEQ ID NO: 171848 - DNA, 20 bp, human
gagtaggactggatgaagga

SEQ ID NO: 171849 - DNA, 20 bp, human
ggaaccaccaccgtttccca

SEQ ID NO: 171850 - DNA, 20 bp, human
gggcaggcaatggggagcac

SEQ ID NO: 171851 - DNA, 20 bp, human
ggtggttctggcaggcaatg

SEQ ID NO: 171852 - DNA, 20 bp, human
gattctggagtgcaccttaa

SEQ ID NO: 171853 - DNA, 20 bp, human
gagctgctgtagagtaacca

SEQ ID NO: 171854 - DNA, 20 bp, human
gtgaagcatgcaaggaatgg

SEQ ID NO: 171855 - DNA, 20 bp, human
gacaaagggattaaattgtg

SEQ ID NO: 171856 - DNA, 20 bp, human
gagggtcacatgagtgatca

SEQ ID NO: 171857 - DNA, 20 bp, human
gggtatttgcacagcagtca

SEQ ID NO: 171858 - DNA, 20 bp, human
gggcccactcaagggtcagt

SEQ ID NO: 171859 - DNA, 20 bp, human
gtactgtgtcagagttacgg

SEQ ID NO: 171860 - DNA, 20 bp, human
gagctcaaaggcccactcaa

SEQ ID NO: 171861 - DNA, 20 bp, human
gcataagaggagggctgtca

SEQ ID NO: 171862 - DNA, 20 bp, human
gagggtcagtgggcacggaa

SEQ ID NO: 171863 - DNA, 20 bp, human
ggagacagagatagtattac

SEQ ID NO: 171864 - DNA, 20 bp, human
gcaatggctggcataagagg

SEQ ID NO: 171865 - DNA, 20 bp, human
gatttgggaaaagatcaggg

SEQ ID NO: 171866 - DNA, 20 bp, human
ggccattgggaatctgggat

SEQ ID NO: 171867 - DNA, 20 bp, human
gacccatcccagattcccaa

SEQ ID NO: 171868 - DNA, 20 bp, human
gctggctttttttccatcgt

SEQ ID NO: 171869 - DNA, 20 bp, human
gcaacaaattgaaagaccta

SEQ ID NO: 171870 - DNA, 20 bp, human
gtcttcgccattgggaatct

SEQ ID NO: 171871 - DNA, 20 bp, human
gtatgctatgggttctggaa

SEQ ID NO: 171872 - DNA, 20 bp, human
ggagaaaaacgctcccacga

SEQ ID NO: 171873 - DNA, 20 bp, human
gccatgatgttaaacagttc

SEQ ID NO: 171874 - DNA, 20 bp, human
gtggcaacttacccaaagtc

SEQ ID NO: 171875 - DNA, 20 bp, human
gtatatttgatgtatgctat

SEQ ID NO: 171876 - DNA, 20 bp, human
gctaatggccttacacgaca

SEQ ID NO: 171877 - DNA, 20 bp, human
gaccctgctggccagcaaac

SEQ ID NO: 171878 - DNA, 20 bp, human
gatggccttacacgacatgg

SEQ ID NO: 171879 - DNA, 20 bp, human
gatggctgcgttgtggatag

SEQ ID NO: 171880 - DNA, 20 bp, human
gtaagtgtcaactacgtgaa

SEQ ID NO: 171881 - DNA, 20 bp, human
gggctaaggaaagttactag

SEQ ID NO: 171882 - DNA, 20 bp, human
gaactctggacagagtgata

SEQ ID NO: 171883 - DNA, 20 bp, human
gctaaagcaggtaggtggaa

SEQ ID NO: 171884 - DNA, 20 bp, human
ggctagagggctggatagtg

SEQ ID NO: 171885 - DNA, 20 bp, human
gcattagtgtaagaaatcag

SEQ ID NO: 171886 - DNA, 20 bp, human
gtaaggggtcttgcaaatag

SEQ ID NO: 171887 - DNA, 20 bp, human
gttgcaagaccccttatcac

SEQ ID NO: 171888 - DNA, 20 bp, human
gttcacaggatcaactaaac

SEQ ID NO: 171889 - DNA, 20 bp, human
gtttgtgttcctgtgataag

SEQ ID NO: 171890 - DNA, 20 bp, human
gaacattccaaatgcagaag

SEQ ID NO: 171891 - DNA, 20 bp, human
gagcacttttaagatagcaa

SEQ ID NO: 171892 - DNA, 20 bp, human
gatgagaaaataaagcaagc

SEQ ID NO: 171893 - DNA, 20 bp, human
gaagcaagcagggtagaagg

SEQ ID NO: 171894 - DNA, 20 bp, human
gtatatctcttcaaatacca

SEQ ID NO: 171895 - DNA, 20 bp, human
gtgcagcttaagatctgcct

SEQ ID NO: 171896 - DNA, 20 bp, human
gtagccaccgctggaggctg

SEQ ID NO: 171897 - DNA, 20 bp, human
gtgttcagaggggtaatcta

SEQ ID NO: 171898 - DNA, 20 bp, human
gcaactgtagccaccgctgg

SEQ ID NO: 171899 - DNA, 20 bp, human
ggtaggatgagtgttcagag

SEQ ID NO: 171900 - DNA, 20 bp, human
gaggtattaggagaatccac

SEQ ID NO: 171901 - DNA, 20 bp, human
gctcttcctgcgtggtgtga

SEQ ID NO: 171902 - DNA, 20 bp, human
gacttaccccaaatcaggta

SEQ ID NO: 171903 - DNA, 20 bp, human
gtgaaaccctcacaccacgc

SEQ ID NO: 171904 - DNA, 20 bp, human
gtttcaactgtagccaccgc

SEQ ID NO: 171905 - DNA, 20 bp, human
ggtgtttgtttggtggcagt

SEQ ID NO: 171906 - DNA, 20 bp, human
gggctcggcgggcccgtcca

SEQ ID NO: 171907 - DNA, 20 bp, human
gtgaggcccggagagcgaca

SEQ ID NO: 171908 - DNA, 20 bp, human
gagagcgacagggacacccc

SEQ ID NO: 171909 - DNA, 20 bp, human
gcgacagcgtctgccacctg

SEQ ID NO: 171910 - DNA, 20 bp, human
gcccacaagcccgggatctg

SEQ ID NO: 171911 - DNA, 20 bp, human
gcggcgggcccgtccatggc

SEQ ID NO: 171912 - DNA, 20 bp, human
gacaccccaggcatccccac

SEQ ID NO: 171913 - DNA, 20 bp, human
gtataggtccctcctgagaa

SEQ ID NO: 171914 - DNA, 20 bp, human
gcacggagtaggcacctggc

SEQ ID NO: 171915 - DNA, 20 bp, human
gtactccgtgcccggcccaa

SEQ ID NO: 171916 - DNA, 20 bp, human
gcgagcatcgggagagcggt

SEQ ID NO: 171917 - DNA, 20 bp, human
ggagacccccagcaccccgg

SEQ ID NO: 171918 - DNA, 20 bp, human
gcccgcagggatccgagcat

SEQ ID NO: 171919 - DNA, 20 bp, human
gcaaataggctccatctcca

SEQ ID NO: 171920 - DNA, 20 bp, human
gggtcagagaccttcgggag

SEQ ID NO: 171921 - DNA, 20 bp, human
gggctccatctccacggaag

SEQ ID NO: 171922 - DNA, 20 bp, human
gcctgcagcgccggccaaat

SEQ ID NO: 171923 - DNA, 20 bp, human
gcggaaggggccgctcccga

SEQ ID NO: 171924 - DNA, 20 bp, human
gttctcatctggggaaacca

SEQ ID NO: 171925 - DNA, 20 bp, human
gaactcccccggggtgctgg

SEQ ID NO: 171926 - DNA, 20 bp, human
ggggctgagacgctgactcg

SEQ ID NO: 171927 - DNA, 20 bp, human
ggagcgcatcccgggataag

SEQ ID NO: 171928 - DNA, 20 bp, human
ggagggcaccagggaaccgg

SEQ ID NO: 171929 - DNA, 20 bp, human
gcactgccttaattcactgg

SEQ ID NO: 171930 - DNA, 20 bp, human
gcggcccggccgccagacca

SEQ ID NO: 171931 - DNA, 20 bp, human
gcaaatgtgcaatgctgggt

SEQ ID NO: 171932 - DNA, 20 bp, human
ggatgcgctccagggaatcg

SEQ ID NO: 171933 - DNA, 20 bp, human
ggggcatgtggaggatagtc

SEQ ID NO: 171934 - DNA, 20 bp, human
gtcgctaggcggccgtggtc

SEQ ID NO: 171935 - DNA, 20 bp, human
gactcgcctccagtgaatta

SEQ ID NO: 171936 - DNA, 20 bp, human
ggaggacgagacccagctca

SEQ ID NO: 171937 - DNA, 20 bp, human
gcatggctgcgcccgcacta

SEQ ID NO: 171938 - DNA, 20 bp, human
gggcaaagcaaggcactagt

SEQ ID NO: 171939 - DNA, 20 bp, human
ggagaaggaactcctcatac

SEQ ID NO: 171940 - DNA, 20 bp, human
gcatggcccgcgggacaaca

SEQ ID NO: 171941 - DNA, 20 bp, human
gagcaaggcactagtaggaa

SEQ ID NO: 171942 - DNA, 20 bp, human
gcacacaccagccctagtgc

SEQ ID NO: 171943 - DNA, 20 bp, human
gctagtaggaagggaagtaa

SEQ ID NO: 171944 - DNA, 20 bp, human
gtaaatggagtcttccggtg

SEQ ID NO: 171945 - DNA, 20 bp, human
ggggccccgtacccggagag

SEQ ID NO: 171946 - DNA, 20 bp, human
gcgaccaggagcgacagcag

SEQ ID NO: 171947 - DNA, 20 bp, human
gcgcggcagtcctgatggcc

SEQ ID NO: 171948 - DNA, 20 bp, human
ggctgcgccgcgtacaccca

SEQ ID NO: 171949 - DNA, 20 bp, human
gagcagcggtaacccatgcc

SEQ ID NO: 171950 - DNA, 20 bp, human
gtaacccatgccgggccatc

SEQ ID NO: 171951 - DNA, 20 bp, human
ggcgccctcatgcaccgcag

SEQ ID NO: 171952 - DNA, 20 bp, human
gttccgggatgcggctgcag

SEQ ID NO: 171953 - DNA, 20 bp, human
gctgccgctgcggtgcatga

SEQ ID NO: 171954 - DNA, 20 bp, human
gatcccggaagccggcagaa

SEQ ID NO: 171955 - DNA, 20 bp, human
gctaaggctctctcccgtca

SEQ ID NO: 171956 - DNA, 20 bp, human
gtggctcatctaggaagtag

SEQ ID NO: 171957 - DNA, 20 bp, human
gttcttcccttagggtcaca

SEQ ID NO: 171958 - DNA, 20 bp, human
gtccagggacatgtttttgg

SEQ ID NO: 171959 - DNA, 20 bp, human
ggtctgagatacacaattgc

SEQ ID NO: 171960 - DNA, 20 bp, human
gcctcaccctgtgaccctaa

SEQ ID NO: 171961 - DNA, 20 bp, human
gtaaagagaaatggagatgg

SEQ ID NO: 171962 - DNA, 20 bp, human
gtggagatggtggctcatct

SEQ ID NO: 171963 - DNA, 20 bp, human
gcctgagtgtcagtaactct

SEQ ID NO: 171964 - DNA, 20 bp, human
gtgacatccagtgacagtgt

SEQ ID NO: 171965 - DNA, 20 bp, human
gggcctcccctaaagagaaa

SEQ ID NO: 171966 - DNA, 20 bp, human
gcgacccgggagaaagaagt

SEQ ID NO: 171967 - DNA, 20 bp, human
gtgagggaggccgccaccaa

SEQ ID NO: 171968 - DNA, 20 bp, human
ggaagtgacgcgaggcgtag

SEQ ID NO: 171969 - DNA, 20 bp, human
gcgggctgggagccatccaa

SEQ ID NO: 171970 - DNA, 20 bp, human
ggggaggccgccaccaaagg

SEQ ID NO: 171971 - DNA, 20 bp, human
gcaaaggcggtggggtacgg

SEQ ID NO: 171972 - DNA, 20 bp, human
ggctctgcacctagtcgacc

SEQ ID NO: 171973 - DNA, 20 bp, human
gaagaagtgggacgacatga

SEQ ID NO: 171974 - DNA, 20 bp, human
ggagggagaggagccgacta

SEQ ID NO: 171975 - DNA, 20 bp, human
gcctctggaaggagacggac

SEQ ID NO: 171976 - DNA, 20 bp, human
ggctttcccgggccccccac

SEQ ID NO: 171977 - DNA, 20 bp, human
ggccgcggccggccccgtgg

SEQ ID NO: 171978 - DNA, 20 bp, human
ggacccaccagccccgaacg

SEQ ID NO: 171979 - DNA, 20 bp, human
gggccaagaatccccgttcg

SEQ ID NO: 171980 - DNA, 20 bp, human
gcgaggcgccagccaatggg

SEQ ID NO: 171981 - DNA, 20 bp, human
ggagttgggcgggcagaaag

SEQ ID NO: 171982 - DNA, 20 bp, human
ggcgccgggcgcgagttggg

SEQ ID NO: 171983 - DNA, 20 bp, human
gcgcgtgaggaggggcgtta

SEQ ID NO: 171984 - DNA, 20 bp, human
gtgcgcgccgggcgcgagtt

SEQ ID NO: 171985 - DNA, 20 bp, human
gccggcggcgagctcacctt

SEQ ID NO: 171986 - DNA, 20 bp, human
ggcagcgcggggcccgacac

SEQ ID NO: 171987 - DNA, 20 bp, human
gctgctggggcgggatccga

SEQ ID NO: 171988 - DNA, 20 bp, human
gcttgggcgggcccacttag

SEQ ID NO: 171989 - DNA, 20 bp, human
gaccagcaatgactcaggag

SEQ ID NO: 171990 - DNA, 20 bp, human
ggccccgcgcacagttgcgg

SEQ ID NO: 171991 - DNA, 20 bp, human
gcgcttcggggacactgctg

SEQ ID NO: 171992 - DNA, 20 bp, human
gttaggggcggggctctaga

SEQ ID NO: 171993 - DNA, 20 bp, human
gagcgggcgagtcacgctct

SEQ ID NO: 171994 - DNA, 20 bp, human
ggcccgacaccgggcgctca

SEQ ID NO: 171995 - DNA, 20 bp, human
gcgggtgcgccgggatttgg

SEQ ID NO: 171996 - DNA, 20 bp, human
gaggtgacagcggtggatga

SEQ ID NO: 171997 - DNA, 20 bp, human
ggagggtgcgtgcacatcct

SEQ ID NO: 171998 - DNA, 20 bp, human
gttggtgggcaaccaatcag

SEQ ID NO: 171999 - DNA, 20 bp, human
gtgtttcaacagcctacggg

SEQ ID NO: 172000 - DNA, 20 bp, human
gcgttggccatggtgaacac

SEQ ID NO: 172001 - DNA, 20 bp, human
gtgctgctcgtgtactcgtt

SEQ ID NO: 172002 - DNA, 20 bp, human
gctcgtgtactcgttaggtg

SEQ ID NO: 172003 - DNA, 20 bp, human
ggcttcacaaaagaggtggc

SEQ ID NO: 172004 - DNA, 20 bp, human
ggcttcactgacaatccccg

SEQ ID NO: 172005 - DNA, 20 bp, human
gatgtgtttcaacagcctac

SEQ ID NO: 172006 - DNA, 20 bp, human
ggccccgccgctacttccag

SEQ ID NO: 172007 - DNA, 20 bp, human
gtcccagcccctggaagtag

SEQ ID NO: 172008 - DNA, 20 bp, human
gcagacgaggcctgaggcgg

SEQ ID NO: 172009 - DNA, 20 bp, human
ggcgtcttctcgggcctggg

SEQ ID NO: 172010 - DNA, 20 bp, human
gggcctgggcggcgcagacg

SEQ ID NO: 172011 - DNA, 20 bp, human
gggccgaggcctgagaacgc

SEQ ID NO: 172012 - DNA, 20 bp, human
gcccgcaacggggtccaggc

SEQ ID NO: 172013 - DNA, 20 bp, human
ggcggcgcagacgaggcctg

SEQ ID NO: 172014 - DNA, 20 bp, human
ggtgggcagagcgtcttctc

SEQ ID NO: 172015 - DNA, 20 bp, human
gcacgaccgccagggtctcc

SEQ ID NO: 172016 - DNA, 20 bp, human
gagtgtgtgccggagaacac

SEQ ID NO: 172017 - DNA, 20 bp, human
gtctccggcacacactgggg

SEQ ID NO: 172018 - DNA, 20 bp, human
gacgtgtagcccgtgttctc

SEQ ID NO: 172019 - DNA, 20 bp, human
ggtttgtgagaacgtatcag

SEQ ID NO: 172020 - DNA, 20 bp, human
gtctgcagtatggtttgaag

SEQ ID NO: 172021 - DNA, 20 bp, human
gcgccaccgcgacagcgagt

SEQ ID NO: 172022 - DNA, 20 bp, human
gtggtttgaagtggtgaaca

SEQ ID NO: 172023 - DNA, 20 bp, human
gtgttgagaagatgtctctg

SEQ ID NO: 172024 - DNA, 20 bp, human
gggcttcgaccccacccagg

SEQ ID NO: 172025 - DNA, 20 bp, human
gtttcccgccctctgcagta

SEQ ID NO: 172026 - DNA, 20 bp, human
gcgccctcccggctgaccag

SEQ ID NO: 172027 - DNA, 20 bp, human
gccagcacgtcccggagagg

SEQ ID NO: 172028 - DNA, 20 bp, human
gctgcgcgagtggggccggg

SEQ ID NO: 172029 - DNA, 20 bp, human
gggcgggcgggcggacaatg

SEQ ID NO: 172030 - DNA, 20 bp, human
ggcggcgacgcgggacaagg

SEQ ID NO: 172031 - DNA, 20 bp, human
gaggcccgcgctgcgcgagt

SEQ ID NO: 172032 - DNA, 20 bp, human
gcccgggtggaggctggatc

SEQ ID NO: 172033 - DNA, 20 bp, human
gtctgcgggcgggacttccc

SEQ ID NO: 172034 - DNA, 20 bp, human
ggcgccactggtcagccggg

SEQ ID NO: 172035 - DNA, 20 bp, human
ggtgcgggcgagctcaggag

SEQ ID NO: 172036 - DNA, 20 bp, human
gggcattgtctgggcgtgga

SEQ ID NO: 172037 - DNA, 20 bp, human
gagagatatccaaaagctaa

SEQ ID NO: 172038 - DNA, 20 bp, human
ggtcagtgggtgagatttaa

SEQ ID NO: 172039 - DNA, 20 bp, human
gaatatgtatggctgttgaa

SEQ ID NO: 172040 - DNA, 20 bp, human
gaattctatgacaaccataa

SEQ ID NO: 172041 - DNA, 20 bp, human
gaaaatgtatggcattgtct

SEQ ID NO: 172042 - DNA, 20 bp, human
gaaataaactatgagctgct

SEQ ID NO: 172043 - DNA, 20 bp, human
gtgatttctccattagcttt

SEQ ID NO: 172044 - DNA, 20 bp, human
gccataaaggaaaagtcagt

SEQ ID NO: 172045 - DNA, 20 bp, human
gaatggagaaatcaaaatgg

SEQ ID NO: 172046 - DNA, 20 bp, human
gcaagaagaaacacccgtgg

SEQ ID NO: 172047 - DNA, 20 bp, human
gcttcaagaagaaacacccg

SEQ ID NO: 172048 - DNA, 20 bp, human
ggagcaacgtctaaaaaaca

SEQ ID NO: 172049 - DNA, 20 bp, human
gaaagggagaaaatactgtc

SEQ ID NO: 172050 - DNA, 20 bp, human
ggcgaatgggtaggtaaaca

SEQ ID NO: 172051 - DNA, 20 bp, human
gatcatgagtggaaaaacaa

SEQ ID NO: 172052 - DNA, 20 bp, human
gggcaatgctttgttatcag

SEQ ID NO: 172053 - DNA, 20 bp, human
gaatcctgatgcgaatgggt

SEQ ID NO: 172054 - DNA, 20 bp, human
ggataacaaagcattgccac

SEQ ID NO: 172055 - DNA, 20 bp, human
ggtaggtaaacatggcagaa

SEQ ID NO: 172056 - DNA, 20 bp, human
ggaggacggggaacacggtg

SEQ ID NO: 172057 - DNA, 20 bp, human
gccctgtccttggagatgag

SEQ ID NO: 172058 - DNA, 20 bp, human
gtgtgccgggaaatgcacag

SEQ ID NO: 172059 - DNA, 20 bp, human
gcagggctccttgaggaccg

SEQ ID NO: 172060 - DNA, 20 bp, human
gagatgggaactctgggagc

SEQ ID NO: 172061 - DNA, 20 bp, human
gggaacggagcacatcagac

SEQ ID NO: 172062 - DNA, 20 bp, human
gcaccaagaccagagaggtt

SEQ ID NO: 172063 - DNA, 20 bp, human
gtccacttggcacttttcag

SEQ ID NO: 172064 - DNA, 20 bp, human
gcagaccccggaggtgagga

SEQ ID NO: 172065 - DNA, 20 bp, human
gaggagactggtatgaaaga

SEQ ID NO: 172066 - DNA, 20 bp, human
ggacccggtaaggagactgg

SEQ ID NO: 172067 - DNA, 20 bp, human
ggaagacactggacccggta

SEQ ID NO: 172068 - DNA, 20 bp, human
ggaccagagcagtgcaggta

SEQ ID NO: 172069 - DNA, 20 bp, human
gtaatggtcccatggcccag

SEQ ID NO: 172070 - DNA, 20 bp, human
gattgcagtgctgaagacac

SEQ ID NO: 172071 - DNA, 20 bp, human
ggctctggtctagtacaaac

SEQ ID NO: 172072 - DNA, 20 bp, human
gctcgagaactcgcagagct

SEQ ID NO: 172073 - DNA, 20 bp, human
gagcacccagacagaaggag

SEQ ID NO: 172074 - DNA, 20 bp, human
gccacccccagtctccttac

SEQ ID NO: 172075 - DNA, 20 bp, human
gcatcacctgcaccaacggg

SEQ ID NO: 172076 - DNA, 20 bp, human
gcgagaatcacgcgaggtcc

SEQ ID NO: 172077 - DNA, 20 bp, human
gacgtgaccacggagtagga

SEQ ID NO: 172078 - DNA, 20 bp, human
ggagcgagtgcgtgagaaca

SEQ ID NO: 172079 - DNA, 20 bp, human
gcaagacgtgaccacggagt

SEQ ID NO: 172080 - DNA, 20 bp, human
gggcgggaagagactgcgag

SEQ ID NO: 172081 - DNA, 20 bp, human
gtctcttcccgccctagaag

SEQ ID NO: 172082 - DNA, 20 bp, human
gcgagaaacagggttattat

SEQ ID NO: 172083 - DNA, 20 bp, human
gcgggtcattgggagagtgc

SEQ ID NO: 172084 - DNA, 20 bp, human
gcaggacagggtgaatgcgg

SEQ ID NO: 172085 - DNA, 20 bp, human
ggatgttgcctcttctaggg

SEQ ID NO: 172086 - DNA, 20 bp, human
gtgcagcactgagccgccga

SEQ ID NO: 172087 - DNA, 20 bp, human
gccccagagacccggcaggc

SEQ ID NO: 172088 - DNA, 20 bp, human
ggaagtgcggccgccggaac

SEQ ID NO: 172089 - DNA, 20 bp, human
gtcgccgctaggccccaaga

SEQ ID NO: 172090 - DNA, 20 bp, human
ggagcccgctggaggaagac

SEQ ID NO: 172091 - DNA, 20 bp, human
gcactgagccgccgacgggg

SEQ ID NO: 172092 - DNA, 20 bp, human
gctacgggagatggcttcca

SEQ ID NO: 172093 - DNA, 20 bp, human
gacaaccgtcatctccacag

SEQ ID NO: 172094 - DNA, 20 bp, human
gcaaagcccacccgccccgt

SEQ ID NO: 172095 - DNA, 20 bp, human
gcaccaacagccagttccgg

SEQ ID NO: 172096 - DNA, 20 bp, human
gtcccgcgaggagaatgtgg

SEQ ID NO: 172097 - DNA, 20 bp, human
gacgctcggcagcggaacca

SEQ ID NO: 172098 - DNA, 20 bp, human
gccaaaagggaggagtcgag

SEQ ID NO: 172099 - DNA, 20 bp, human
gcgcccacccgccaaaaggg

SEQ ID NO: 172100 - DNA, 20 bp, human
gagcgcagcagtgcctccaa

SEQ ID NO: 172101 - DNA, 20 bp, human
ggcgtagaccacgaagaccc

SEQ ID NO: 172102 - DNA, 20 bp, human
gagacgtcagagagccggga

SEQ ID NO: 172103 - DNA, 20 bp, human
gggacacgcttggaaagggg

SEQ ID NO: 172104 - DNA, 20 bp, human
gggtcgtctaggtagtgtgg

SEQ ID NO: 172105 - DNA, 20 bp, human
gtctacgccggagtgttgaa

SEQ ID NO: 172106 - DNA, 20 bp, human
gcgttggagccgaaagacac

SEQ ID NO: 172107 - DNA, 20 bp, human
gcagggccatcttcgccgat

SEQ ID NO: 172108 - DNA, 20 bp, human
gccctgagtagactagagaa

SEQ ID NO: 172109 - DNA, 20 bp, human
gcgccgatgggaagaacaac

SEQ ID NO: 172110 - DNA, 20 bp, human
ggcagatgccgcaggtcctt

SEQ ID NO: 172111 - DNA, 20 bp, human
ggctgagtgagtagtcggaa

SEQ ID NO: 172112 - DNA, 20 bp, human
gtctaagcgccggaagtggt

SEQ ID NO: 172113 - DNA, 20 bp, human
gctctagtctactcagggtc

SEQ ID NO: 172114 - DNA, 20 bp, human
gacgttcggtgaacttacgt

SEQ ID NO: 172115 - DNA, 20 bp, human
gccgctgctgagtgagtagt

SEQ ID NO: 172116 - DNA, 20 bp, human
ggtgcagaggtggcagttcc

SEQ ID NO: 172117 - DNA, 20 bp, human
gcctgccggaagcgccctaa

SEQ ID NO: 172118 - DNA, 20 bp, human
gcagcagctggtaccgaagg

SEQ ID NO: 172119 - DNA, 20 bp, human
ggtaagtgcgtgtgcagagg

SEQ ID NO: 172120 - DNA, 20 bp, human
gcagctggtaccgaaggcgg

SEQ ID NO: 172121 - DNA, 20 bp, human
ggaacagcagctggtaccga

SEQ ID NO: 172122 - DNA, 20 bp, human
gcgggcagaaaggcccctgt

SEQ ID NO: 172123 - DNA, 20 bp, human
gcagcagcagcggaagatgt

SEQ ID NO: 172124 - DNA, 20 bp, human
ggacaggactccgggcagaa

SEQ ID NO: 172125 - DNA, 20 bp, human
gaacccctcgagcctcccac

SEQ ID NO: 172126 - DNA, 20 bp, human
ggagtcgtcgaaccgagact

SEQ ID NO: 172127 - DNA, 20 bp, human
gtggcggcggaggggccgtg

SEQ ID NO: 172128 - DNA, 20 bp, human
gatagtacggacccaccgca

SEQ ID NO: 172129 - DNA, 20 bp, human
gagactgggaaaagatagta

SEQ ID NO: 172130 - DNA, 20 bp, human
gccggaacccgtgaatcggg

SEQ ID NO: 172131 - DNA, 20 bp, human
gctagggcctggtcacgtaa

SEQ ID NO: 172132 - DNA, 20 bp, human
gaacctgcggagagaaggac

SEQ ID NO: 172133 - DNA, 20 bp, human
gtagcacgttgacgcagcag

SEQ ID NO: 172134 - DNA, 20 bp, human
gcctggtcacgtaagggaag

SEQ ID NO: 172135 - DNA, 20 bp, human
gaagcccccaccgaggaaaa

SEQ ID NO: 172136 - DNA, 20 bp, human
gccgtgaccgaggaaacccc

SEQ ID NO: 172137 - DNA, 20 bp, human
gcggctgtctggacctcgag

SEQ ID NO: 172138 - DNA, 20 bp, human
gaatgcccaagtccctccag

SEQ ID NO: 172139 - DNA, 20 bp, human
ggacgcagcagtgaatagtg

SEQ ID NO: 172140 - DNA, 20 bp, human
gtaaaggccagccagaccgg

SEQ ID NO: 172141 - DNA, 20 bp, human
gctggacctgaaccgagaca

SEQ ID NO: 172142 - DNA, 20 bp, human
gtgagaagaagcgcttccgg

SEQ ID NO: 172143 - DNA, 20 bp, human
gcgtcgcagagcgggctggg

SEQ ID NO: 172144 - DNA, 20 bp, human
gccttgcctcaggcctctcg

SEQ ID NO: 172145 - DNA, 20 bp, human
gtgaggtcgcctgacgttca

SEQ ID NO: 172146 - DNA, 20 bp, human
ggcacgggagaaggacatcg

SEQ ID NO: 172147 - DNA, 20 bp, human
gccgcaggttctacactgtc

SEQ ID NO: 172148 - DNA, 20 bp, human
ggggagccgagcccacaata

SEQ ID NO: 172149 - DNA, 20 bp, human
ggaaggaggcagacactgag

SEQ ID NO: 172150 - DNA, 20 bp, human
gtgggacctcggatccccag

SEQ ID NO: 172151 - DNA, 20 bp, human
gcgagcccacaatagggcac

SEQ ID NO: 172152 - DNA, 20 bp, human
gggcgcagccgcggacacgg

SEQ ID NO: 172153 - DNA, 20 bp, human
ggtgcgggaactactgaggg

SEQ ID NO: 172154 - DNA, 20 bp, human
gcacaatagggcacgggaga

SEQ ID NO: 172155 - DNA, 20 bp, human
gggtgtgtgagcccctcaaa

SEQ ID NO: 172156 - DNA, 20 bp, human
ggcggggccgggtgcgatgg

SEQ ID NO: 172157 - DNA, 20 bp, human
gggtggctgcgttgcagctg

SEQ ID NO: 172158 - DNA, 20 bp, human
gtgtaacaggggaacgacca

SEQ ID NO: 172159 - DNA, 20 bp, human
gcgagccttctctgtaacag

SEQ ID NO: 172160 - DNA, 20 bp, human
ggcagatgcctcctgcgtcc

SEQ ID NO: 172161 - DNA, 20 bp, human
gaacgcgagaggtagctcct

SEQ ID NO: 172162 - DNA, 20 bp, human
gggctgtgatccaggcgcct

SEQ ID NO: 172163 - DNA, 20 bp, human
gctgaggacgctcctccagg

SEQ ID NO: 172164 - DNA, 20 bp, human
ggacaacccttcaaagtgca

SEQ ID NO: 172165 - DNA, 20 bp, human
gcgtcccggaagcgcccgcg

SEQ ID NO: 172166 - DNA, 20 bp, human
gagctccaggtctacacccg

SEQ ID NO: 172167 - DNA, 20 bp, human
gtcgcccggcaactcgctca

SEQ ID NO: 172168 - DNA, 20 bp, human
ggcatagtcgaaggccgggg

SEQ ID NO: 172169 - DNA, 20 bp, human
ggagggcgcggcgggatcag

SEQ ID NO: 172170 - DNA, 20 bp, human
gcccagcaccaagaacccgt

SEQ ID NO: 172171 - DNA, 20 bp, human
gtggtgctgggcacgatgtg

SEQ ID NO: 172172 - DNA, 20 bp, human
ggccgccgcggaccacctac

SEQ ID NO: 172173 - DNA, 20 bp, human
gcggccatgagcgagttgcc

SEQ ID NO: 172174 - DNA, 20 bp, human
ggagttgccgggcgacgtgc

SEQ ID NO: 172175 - DNA, 20 bp, human
gtcgcagaacctggagccgg

SEQ ID NO: 172176 - DNA, 20 bp, human
ggagtcggcctcccagcgca

SEQ ID NO: 172177 - DNA, 20 bp, human
gctccacaggaagtgcccgg

SEQ ID NO: 172178 - DNA, 20 bp, human
gggccgccgggcacttcctg

SEQ ID NO: 172179 - DNA, 20 bp, human
gcttcctgtggaggccgcag

SEQ ID NO: 172180 - DNA, 20 bp, human
gtcggcgcccgcacccgctg

SEQ ID NO: 172181 - DNA, 20 bp, human
gctcgctggctctcgcccgt

SEQ ID NO: 172182 - DNA, 20 bp, human
gggcctccacaggaagtgcc

SEQ ID NO: 172183 - DNA, 20 bp, human
gggccggcctcgctccgcgt

SEQ ID NO: 172184 - DNA, 20 bp, human
gtgtgggaacaaggagtcag

SEQ ID NO: 172185 - DNA, 20 bp, human
gtgggccagaacgacctgat

SEQ ID NO: 172186 - DNA, 20 bp, human
ggcgagtagagaggccatgg

SEQ ID NO: 172187 - DNA, 20 bp, human
gggaaggtgtgagtcgtgaa

SEQ ID NO: 172188 - DNA, 20 bp, human
gccgccggaaaccaccacac

SEQ ID NO: 172189 - DNA, 20 bp, human
ggcgtccttggcgagtagag

SEQ ID NO: 172190 - DNA, 20 bp, human
gagaggccatggcggagacc

SEQ ID NO: 172191 - DNA, 20 bp, human
gtgtgagtcgtgaacggccc

SEQ ID NO: 172192 - DNA, 20 bp, human
ggtcgcacgcgcagcgggga

SEQ ID NO: 172193 - DNA, 20 bp, human
ggtgagagtcgcacgcgcag

SEQ ID NO: 172194 - DNA, 20 bp, human
gctctgcaggtaggcgtcct

SEQ ID NO: 172195 - DNA, 20 bp, human
gttggccaggctctgcaggt

SEQ ID NO: 172196 - DNA, 20 bp, human
gaggagctcagagaagcggg

SEQ ID NO: 172197 - DNA, 20 bp, human
gggtgcagagataaggctac

SEQ ID NO: 172198 - DNA, 20 bp, human
gggccaggccgccttaaaac

SEQ ID NO: 172199 - DNA, 20 bp, human
gccaggccccgacaagagga

SEQ ID NO: 172200 - DNA, 20 bp, human
ggataaggctacaggcgccg

SEQ ID NO: 172201 - DNA, 20 bp, human
gcggccgttggagatcggca

SEQ ID NO: 172202 - DNA, 20 bp, human
gcgcgccggccgttggagat

SEQ ID NO: 172203 - DNA, 20 bp, human
gaagcccaggccccgacaag

SEQ ID NO: 172204 - DNA, 20 bp, human
gcggcggcgccggaagccgc

SEQ ID NO: 172205 - DNA, 20 bp, human
gccgttggagatcggcaagg

SEQ ID NO: 172206 - DNA, 20 bp, human
gggattgtgggtcctcatca

SEQ ID NO: 172207 - DNA, 20 bp, human
gacagggcgggatcacggag

SEQ ID NO: 172208 - DNA, 20 bp, human
ggacagacggggacacagaa

SEQ ID NO: 172209 - DNA, 20 bp, human
ggtgggtcctcatcagggtg

SEQ ID NO: 172210 - DNA, 20 bp, human
gctgaatccaggaaagtcta

SEQ ID NO: 172211 - DNA, 20 bp, human
gcctgggctgacatccctct

SEQ ID NO: 172212 - DNA, 20 bp, human
gtgtgtccccagccctgaca

SEQ ID NO: 172213 - DNA, 20 bp, human
gtcgcctgccaaaggtcctg

SEQ ID NO: 172214 - DNA, 20 bp, human
gccgtgatcccgccctgtca

SEQ ID NO: 172215 - DNA, 20 bp, human
gcagcctgggaccagtgtcc

SEQ ID NO: 172216 - DNA, 20 bp, human
gctcgccttgccacggaggg

SEQ ID NO: 172217 - DNA, 20 bp, human
ggggcggccgccaccctccg

SEQ ID NO: 172218 - DNA, 20 bp, human
gtggcaaggcgaggccccgg

SEQ ID NO: 172219 - DNA, 20 bp, human
ggccttgccacggagggtgg

SEQ ID NO: 172220 - DNA, 20 bp, human
gcggagcctgcggcgtggag

SEQ ID NO: 172221 - DNA, 20 bp, human
ggagtgagcccggcttgtgg

SEQ ID NO: 172222 - DNA, 20 bp, human
ggcgcatcctgcgcgctccg

SEQ ID NO: 172223 - DNA, 20 bp, human
gcagaccccgccaagcgcct

SEQ ID NO: 172224 - DNA, 20 bp, human
ggggcctcgccttgccacgg

SEQ ID NO: 172225 - DNA, 20 bp, human
gtcacctgtgcggttccctg

SEQ ID NO: 172226 - DNA, 20 bp, human
gcagaggtcgcgcacagatg

SEQ ID NO: 172227 - DNA, 20 bp, human
ggcacagatgcgggttagac

SEQ ID NO: 172228 - DNA, 20 bp, human
gtcgctcgctcgcgcagcgg

SEQ ID NO: 172229 - DNA, 20 bp, human
gcagatgcgggttagactgg

SEQ ID NO: 172230 - DNA, 20 bp, human
ggtctcgctcgctcgcgcag

SEQ ID NO: 172231 - DNA, 20 bp, human
gcagcacgcgcagcatccca

SEQ ID NO: 172232 - DNA, 20 bp, human
gatgcgggttagactggcgg

SEQ ID NO: 172233 - DNA, 20 bp, human
ggcacagctgctgaatcccg

SEQ ID NO: 172234 - DNA, 20 bp, human
gctgcatgcatgagacccac

SEQ ID NO: 172235 - DNA, 20 bp, human
ggcgagcgagacggaagctt

SEQ ID NO: 172236 - DNA, 20 bp, human
ggagaccttaggaaagccag

SEQ ID NO: 172237 - DNA, 20 bp, human
gccctcggcagtcatggtcc

SEQ ID NO: 172238 - DNA, 20 bp, human
gcccgccgctggctttccta

SEQ ID NO: 172239 - DNA, 20 bp, human
ggcaggcgggctgggtccct

SEQ ID NO: 172240 - DNA, 20 bp, human
gcggcgctaagggagggtcc

SEQ ID NO: 172241 - DNA, 20 bp, human
gaggttctagggcaccttag

SEQ ID NO: 172242 - DNA, 20 bp, human
gctgggtccctcggcagtca

SEQ ID NO: 172243 - DNA, 20 bp, human
ggggccagcggactcgggtg

SEQ ID NO: 172244 - DNA, 20 bp, human
gacgcgctcggcgctaaggg

SEQ ID NO: 172245 - DNA, 20 bp, human
gcggactcgggtgagggctc

SEQ ID NO: 172246 - DNA, 20 bp, human
gtagccgtggggaaagatgg

SEQ ID NO: 172247 - DNA, 20 bp, human
gcgttagccgtggggaaaga

SEQ ID NO: 172248 - DNA, 20 bp, human
gaatgggtaacggtcaccag

SEQ ID NO: 172249 - DNA, 20 bp, human
gtctcgcgtggacaccgaat

SEQ ID NO: 172250 - DNA, 20 bp, human
gccacgcgagacgccggaag

SEQ ID NO: 172251 - DNA, 20 bp, human
gcccacggctaacgacattc

SEQ ID NO: 172252 - DNA, 20 bp, human
gcggaaggggagggaagata

SEQ ID NO: 172253 - DNA, 20 bp, human
ggtggacaccgaatgggtaa

SEQ ID NO: 172254 - DNA, 20 bp, human
gcgcgagacgccggaagggg

SEQ ID NO: 172255 - DNA, 20 bp, human
gcggtgtccacgcgagacgc

SEQ ID NO: 172256 - DNA, 20 bp, human
ggccgaggcgcgaggaggtg

SEQ ID NO: 172257 - DNA, 20 bp, human
gcgcgctcgaaccaccacaa

SEQ ID NO: 172258 - DNA, 20 bp, human
gccccggttggaggtccggg

SEQ ID NO: 172259 - DNA, 20 bp, human
gtgaaagctctacaagatgg

SEQ ID NO: 172260 - DNA, 20 bp, human
ggaatgaaagctctacaaga

SEQ ID NO: 172261 - DNA, 20 bp, human
gcagcggcctgggggaggat

SEQ ID NO: 172262 - DNA, 20 bp, human
gcccgggcctttgaagtggg

SEQ ID NO: 172263 - DNA, 20 bp, human
ggcgcccgggcctttgaagt

SEQ ID NO: 172264 - DNA, 20 bp, human
ggaggccgccacgggagacg

SEQ ID NO: 172265 - DNA, 20 bp, human
gcaagctcccaaggcccggg

SEQ ID NO: 172266 - DNA, 20 bp, human
ggaggacgcccgggaaccgg

SEQ ID NO: 172267 - DNA, 20 bp, human
ggacgcccgggaaccggagg

SEQ ID NO: 172268 - DNA, 20 bp, human
ggcagcggggcgatgaggtg

SEQ ID NO: 172269 - DNA, 20 bp, human
ggcgcggccccgcatcgcag

SEQ ID NO: 172270 - DNA, 20 bp, human
ggcagggcagcggggcgatg

SEQ ID NO: 172271 - DNA, 20 bp, human
gccaggcggctcaccggggg

SEQ ID NO: 172272 - DNA, 20 bp, human
ggggtccaggcggctcaccg

SEQ ID NO: 172273 - DNA, 20 bp, human
gcggcgcaggcggtgagtcg

SEQ ID NO: 172274 - DNA, 20 bp, human
gctgcccggccgctgcgatg

SEQ ID NO: 172275 - DNA, 20 bp, human
gctcaccgggggcggcgacg

SEQ ID NO: 172276 - DNA, 20 bp, human
gcgcggggctggggccgtga

SEQ ID NO: 172277 - DNA, 20 bp, human
gcgagagccgaaggaggctg

SEQ ID NO: 172278 - DNA, 20 bp, human
gcgggtgaggaagcacagga

SEQ ID NO: 172279 - DNA, 20 bp, human
ggcgaggggccgggagacgt

SEQ ID NO: 172280 - DNA, 20 bp, human
gggcccgggtgaggaagcac

SEQ ID NO: 172281 - DNA, 20 bp, human
gggcctggagggtgaggtca

SEQ ID NO: 172282 - DNA, 20 bp, human
gctgtgggaggtgttggcgg

SEQ ID NO: 172283 - DNA, 20 bp, human
gcacctcccacagcctcctt

SEQ ID NO: 172284 - DNA, 20 bp, human
ggtgaaggggctcagagatc

SEQ ID NO: 172285 - DNA, 20 bp, human
gggcgcctggacacgaggag

SEQ ID NO: 172286 - DNA, 20 bp, human
gccggcgggtagctggcggg

SEQ ID NO: 172287 - DNA, 20 bp, human
gaggctccggcggaccgagg

SEQ ID NO: 172288 - DNA, 20 bp, human
gcggcggcgggagctgtgga

SEQ ID NO: 172289 - DNA, 20 bp, human
ggcgggggctgcggtgttac

SEQ ID NO: 172290 - DNA, 20 bp, human
gccgcccggcgggtagctgg

SEQ ID NO: 172291 - DNA, 20 bp, human
gccggcggaccgagggggga

SEQ ID NO: 172292 - DNA, 20 bp, human
gggcttcgggggttcggcgg

SEQ ID NO: 172293 - DNA, 20 bp, human
gcctggacgtgctccatttt

SEQ ID NO: 172294 - DNA, 20 bp, human
ggctctccggggccgcccgg

SEQ ID NO: 172295 - DNA, 20 bp, human
ggcggagcgaggccagggta

SEQ ID NO: 172296 - DNA, 20 bp, human
gtccccgggtaaggagtccc

SEQ ID NO: 172297 - DNA, 20 bp, human
gccttcggagattaacgtgg

SEQ ID NO: 172298 - DNA, 20 bp, human
gggtctaggttccccgggta

SEQ ID NO: 172299 - DNA, 20 bp, human
gaggagtcccgggcgaggac

SEQ ID NO: 172300 - DNA, 20 bp, human
gcacctggtctaggttcccc

SEQ ID NO: 172301 - DNA, 20 bp, human
gtccccttcggagattaacg

SEQ ID NO: 172302 - DNA, 20 bp, human
ggtggggggacgtcaaggtg

SEQ ID NO: 172303 - DNA, 20 bp, human
ggcccgggactccttacccg

SEQ ID NO: 172304 - DNA, 20 bp, human
gtaatctccgaaggggatag

SEQ ID NO: 172305 - DNA, 20 bp, human
gggtgacgatcccctctcta

SEQ ID NO: 172306 - DNA, 20 bp, human
gggcagagcagcgtccgccc

SEQ ID NO: 172307 - DNA, 20 bp, human
gacgcggagctgggcgatcc

SEQ ID NO: 172308 - DNA, 20 bp, human
gcgtgcagctccggctaacg

SEQ ID NO: 172309 - DNA, 20 bp, human
gttgaaagcggcctccccaa

SEQ ID NO: 172310 - DNA, 20 bp, human
gctgctctgcctgcatccgg

SEQ ID NO: 172311 - DNA, 20 bp, human
gatgcaggtgtgacacccgc

SEQ ID NO: 172312 - DNA, 20 bp, human
ggcagccccgcgtgcagctc

SEQ ID NO: 172313 - DNA, 20 bp, human
gagcccaggcaggcgagtct

SEQ ID NO: 172314 - DNA, 20 bp, human
ggcagcggctaggaagctta

SEQ ID NO: 172315 - DNA, 20 bp, human
gtcctgggtcctctactcag

SEQ ID NO: 172316 - DNA, 20 bp, human
gagcggcgcccgcactgagg

SEQ ID NO: 172317 - DNA, 20 bp, human
gccggggaagcgagccggag

SEQ ID NO: 172318 - DNA, 20 bp, human
gtcgccgctgacacgctcag

SEQ ID NO: 172319 - DNA, 20 bp, human
gagagggaccaggaaagtag

SEQ ID NO: 172320 - DNA, 20 bp, human
ggtgaccccagggttcgcta

SEQ ID NO: 172321 - DNA, 20 bp, human
ggcagtgctgacaccactca

SEQ ID NO: 172322 - DNA, 20 bp, human
gcctaccctagcgaaccctg

SEQ ID NO: 172323 - DNA, 20 bp, human
gcagcgcccggccaccagtc

SEQ ID NO: 172324 - DNA, 20 bp, human
gtcgcctgcagcgcgcggag

SEQ ID NO: 172325 - DNA, 20 bp, human
ggcaaagttgcgcttccgaa

SEQ ID NO: 172326 - DNA, 20 bp, human
ggcagctcgggaactccgga

SEQ ID NO: 172327 - DNA, 20 bp, human
gtcgggaactccggagggaa

SEQ ID NO: 172328 - DNA, 20 bp, human
gcccgctcctggcgacgaag

SEQ ID NO: 172329 - DNA, 20 bp, human
gcggagttcccgagctgctg

SEQ ID NO: 172330 - DNA, 20 bp, human
gggagcagagtggagcggct

SEQ ID NO: 172331 - DNA, 20 bp, human
gcgcggtctcggggaagagg

SEQ ID NO: 172332 - DNA, 20 bp, human
ggtcagatgaaagggcgctg

SEQ ID NO: 172333 - DNA, 20 bp, human
gctggagcttgtcttcctgg

SEQ ID NO: 172334 - DNA, 20 bp, human
ggatggcagggatctcttgg

SEQ ID NO: 172335 - DNA, 20 bp, human
ggacgaacatgagctcgctg

SEQ ID NO: 172336 - DNA, 20 bp, human
gtcagcctcgaggacactag

SEQ ID NO: 172337 - DNA, 20 bp, human
gcccaggctgaagtgtcctc

SEQ ID NO: 172338 - DNA, 20 bp, human
gggtggagccatccattact

SEQ ID NO: 172339 - DNA, 20 bp, human
gctctgactgcgtcctcccc

SEQ ID NO: 172340 - DNA, 20 bp, human
ggctccaccgaggccaggtt

SEQ ID NO: 172341 - DNA, 20 bp, human
gcaaatccacatgaaacctg

SEQ ID NO: 172342 - DNA, 20 bp, human
gcatcaaaagctggattcga

SEQ ID NO: 172343 - DNA, 20 bp, human
gcagtgaagcaacttcacat

SEQ ID NO: 172344 - DNA, 20 bp, human
gaggctgaacttccccaacc

SEQ ID NO: 172345 - DNA, 20 bp, human
gtcgtcccctagtgtcctcg

SEQ ID NO: 172346 - DNA, 20 bp, human
gcccggccgggagagcgata

SEQ ID NO: 172347 - DNA, 20 bp, human
ggccagtggcgagctcgtca

SEQ ID NO: 172348 - DNA, 20 bp, human
ggagctcgtcagggcggacc

SEQ ID NO: 172349 - DNA, 20 bp, human
ggccctgacgagctcgccac

SEQ ID NO: 172350 - DNA, 20 bp, human
gctcgggcgacagagcgagt

SEQ ID NO: 172351 - DNA, 20 bp, human
ggcgcgccggctctcgggga

SEQ ID NO: 172352 - DNA, 20 bp, human
ggtgtgggccccgggaaagt

SEQ ID NO: 172353 - DNA, 20 bp, human
gcctgagcgaaactctggag

SEQ ID NO: 172354 - DNA, 20 bp, human
gagcgcgcggaggtgagacg

SEQ ID NO: 172355 - DNA, 20 bp, human
gagttggacagccacacccc

SEQ ID NO: 172356 - DNA, 20 bp, human
ggggcaagcgcggaggacca

SEQ ID NO: 172357 - DNA, 20 bp, human
gcagcttgagaaccctgacc

SEQ ID NO: 172358 - DNA, 20 bp, human
gtgagaaccctgaccgggtc

SEQ ID NO: 172359 - DNA, 20 bp, human
gcctgggccggacccggtca

SEQ ID NO: 172360 - DNA, 20 bp, human
ggctgcgccggatcttcata

SEQ ID NO: 172361 - DNA, 20 bp, human
gtacgcgtgggacattccgg

SEQ ID NO: 172362 - DNA, 20 bp, human
gaggaaaacacagccccata

SEQ ID NO: 172363 - DNA, 20 bp, human
gagggcgccggcgcacgcag

SEQ ID NO: 172364 - DNA, 20 bp, human
gcctgcgccaccaggtacaa

SEQ ID NO: 172365 - DNA, 20 bp, human
gccggcgccctatgaagatc

SEQ ID NO: 172366 - DNA, 20 bp, human
gaagatgcagtggaagccat

SEQ ID NO: 172367 - DNA, 20 bp, human
gtggctttggaaaatttcag

SEQ ID NO: 172368 - DNA, 20 bp, human
gggaagctgtctgttctcac

SEQ ID NO: 172369 - DNA, 20 bp, human
gaccatgaaagtatctggga

SEQ ID NO: 172370 - DNA, 20 bp, human
ggttctcactggcttggctt

SEQ ID NO: 172371 - DNA, 20 bp, human
gttgggcaagtatttctggg

SEQ ID NO: 172372 - DNA, 20 bp, human
gcattcaaatcccctggcta

SEQ ID NO: 172373 - DNA, 20 bp, human
gatgagagtcttgaagcaga

SEQ ID NO: 172374 - DNA, 20 bp, human
ggtactctttgccatagcca

SEQ ID NO: 172375 - DNA, 20 bp, human
gacccagttgagcagcatgg

SEQ ID NO: 172376 - DNA, 20 bp, human
ggaaggctgaggatcgtgac

SEQ ID NO: 172377 - DNA, 20 bp, human
gaatacggggggtcagtggt

SEQ ID NO: 172378 - DNA, 20 bp, human
gccccaggctcaatttccga

SEQ ID NO: 172379 - DNA, 20 bp, human
gtaaaaacaagttaatacgg

SEQ ID NO: 172380 - DNA, 20 bp, human
gagttaatacggggggtcag

SEQ ID NO: 172381 - DNA, 20 bp, human
ggctcaatttccgaaggctg

SEQ ID NO: 172382 - DNA, 20 bp, human
gctgtggctctgcggtcccc

SEQ ID NO: 172383 - DNA, 20 bp, human
gttccaccagggaagctgtt

SEQ ID NO: 172384 - DNA, 20 bp, human
ggccttcggaaattgagcct

SEQ ID NO: 172385 - DNA, 20 bp, human
gtaatctcacctttaacctg

SEQ ID NO: 172386 - DNA, 20 bp, human
gtggcccgaaggcaaggggg

SEQ ID NO: 172387 - DNA, 20 bp, human
gcactcgaccaggaccacag

SEQ ID NO: 172388 - DNA, 20 bp, human
ggcatggcccgaaggcaagg

SEQ ID NO: 172389 - DNA, 20 bp, human
gtgtggctgcggaggttgag

SEQ ID NO: 172390 - DNA, 20 bp, human
gagttcccgcgggtctccca

SEQ ID NO: 172391 - DNA, 20 bp, human
gcagtccctgggagacccgc

SEQ ID NO: 172392 - DNA, 20 bp, human
gggttctgcccagcgacctt

SEQ ID NO: 172393 - DNA, 20 bp, human
gggagctgctcaaagccatc

SEQ ID NO: 172394 - DNA, 20 bp, human
ggagcgcgccggggagggtc

SEQ ID NO: 172395 - DNA, 20 bp, human
ggggcagaaagtggattctg

SEQ ID NO: 172396 - DNA, 20 bp, human
gctggcccggtgcacctgag

SEQ ID NO: 172397 - DNA, 20 bp, human
gcgggccaggaactctgacc

SEQ ID NO: 172398 - DNA, 20 bp, human
gtcctagagaggaatccgag

SEQ ID NO: 172399 - DNA, 20 bp, human
gagtcggagagcgacctctc

SEQ ID NO: 172400 - DNA, 20 bp, human
gtctgggaagggagagtctg

SEQ ID NO: 172401 - DNA, 20 bp, human
gcagtaccccgtcctcacag

SEQ ID NO: 172402 - DNA, 20 bp, human
ggtgaggacggggtactgtg

SEQ ID NO: 172403 - DNA, 20 bp, human
gccagcccaaagtcacccgg

SEQ ID NO: 172404 - DNA, 20 bp, human
gagggaggtcggacttcggg

SEQ ID NO: 172405 - DNA, 20 bp, human
gtctgacccggagtgtgaac

SEQ ID NO: 172406 - DNA, 20 bp, human
gtgaggcgggtgctaaccag

SEQ ID NO: 172407 - DNA, 20 bp, human
gggcgggtgctaaccagggg

SEQ ID NO: 172408 - DNA, 20 bp, human
ggtgctaaccaggggcggtg

SEQ ID NO: 172409 - DNA, 20 bp, human
gagcagcaaaggcggtccgg

SEQ ID NO: 172410 - DNA, 20 bp, human
gagagctacgcggcgaatgg

SEQ ID NO: 172411 - DNA, 20 bp, human
ggcgaatggcggagacgctg

SEQ ID NO: 172412 - DNA, 20 bp, human
gtgagagcccatccaatgat

SEQ ID NO: 172413 - DNA, 20 bp, human
gcgactccaggtaaccgtgg

SEQ ID NO: 172414 - DNA, 20 bp, human
gctgggaacgagccaccgat

SEQ ID NO: 172415 - DNA, 20 bp, human
gggtagacaagccaatggag

SEQ ID NO: 172416 - DNA, 20 bp, human
gggtgcgttgacgttttgct

SEQ ID NO: 172417 - DNA, 20 bp, human
gtttgcatttacttcctccg

SEQ ID NO: 172418 - DNA, 20 bp, human
gccgccggcgctggtaaggt

SEQ ID NO: 172419 - DNA, 20 bp, human
gccggcggcagtggcaactc

SEQ ID NO: 172420 - DNA, 20 bp, human
gactgccgccggcgctggta

SEQ ID NO: 172421 - DNA, 20 bp, human
gcgggtcacggtgtaggtga

SEQ ID NO: 172422 - DNA, 20 bp, human
gaccgcagaactgctgatac

SEQ ID NO: 172423 - DNA, 20 bp, human
gagtgttcgggtcacggtgt

SEQ ID NO: 172424 - DNA, 20 bp, human
gtggtaaggtaggaactgcg

SEQ ID NO: 172425 - DNA, 20 bp, human
gcttggggcgggggacgagg

SEQ ID NO: 172426 - DNA, 20 bp, human
gcagagaccgcagcgagcac

SEQ ID NO: 172427 - DNA, 20 bp, human
gcgactcccagggagatgtc

SEQ ID NO: 172428 - DNA, 20 bp, human
gaggcaaccagtgctcgctg

SEQ ID NO: 172429 - DNA, 20 bp, human
gccctgggagtcgcgcagag

SEQ ID NO: 172430 - DNA, 20 bp, human
gggagatgtccggaagtcgg

SEQ ID NO: 172431 - DNA, 20 bp, human
ggacttccggacatctccct

SEQ ID NO: 172432 - DNA, 20 bp, human
gccgcgagcgggatgttccg

SEQ ID NO: 172433 - DNA, 20 bp, human
gtctccgggtcgggagagat

SEQ ID NO: 172434 - DNA, 20 bp, human
gctggggatcgggaccgcgg

SEQ ID NO: 172435 - DNA, 20 bp, human
gcgccccagggccgtcccag

SEQ ID NO: 172436 - DNA, 20 bp, human
gcggagcccagagcaatcgg

SEQ ID NO: 172437 - DNA, 20 bp, human
ggggcagtgcgggcactgga

SEQ ID NO: 172438 - DNA, 20 bp, human
ggatggggaggtggtactgg

SEQ ID NO: 172439 - DNA, 20 bp, human
gtcctgaaactgggactgtg

SEQ ID NO: 172440 - DNA, 20 bp, human
gggagatggggaggtggtac

SEQ ID NO: 172441 - DNA, 20 bp, human
gaggcagggtcactgacacg

SEQ ID NO: 172442 - DNA, 20 bp, human
gcatccgcgactgggaaaag

SEQ ID NO: 172443 - DNA, 20 bp, human
ggaggaggcacctgcgagca

SEQ ID NO: 172444 - DNA, 20 bp, human
ggagttgagatccaggagat

SEQ ID NO: 172445 - DNA, 20 bp, human
gtaaggagcgcggggcagtg

SEQ ID NO: 172446 - DNA, 20 bp, human
ggcaaagcacaggagagata

SEQ ID NO: 172447 - DNA, 20 bp, human
gtcacacagctgataggatt

SEQ ID NO: 172448 - DNA, 20 bp, human
gctctcggtgacctaatgtt

SEQ ID NO: 172449 - DNA, 20 bp, human
gagggtattgtagactggga

SEQ ID NO: 172450 - DNA, 20 bp, human
gcaagagctgctgtctctct

SEQ ID NO: 172451 - DNA, 20 bp, human
ggtgcagatcacccaacatt

SEQ ID NO: 172452 - DNA, 20 bp, human
gggtgatctgcacagcaaca

SEQ ID NO: 172453 - DNA, 20 bp, human
gagatagggtattgtagact

SEQ ID NO: 172454 - DNA, 20 bp, human
ggcctcacaaaaatcccgtg

SEQ ID NO: 172455 - DNA, 20 bp, human
gatctcacctgtgtatgcag

SEQ ID NO: 172456 - DNA, 20 bp, human
ggggaggtccctgacatcga

SEQ ID NO: 172457 - DNA, 20 bp, human
gcagcgagggtgcctcggga

SEQ ID NO: 172458 - DNA, 20 bp, human
gccctcgctggcgagctgag

SEQ ID NO: 172459 - DNA, 20 bp, human
gcactggaggctccctcccg

SEQ ID NO: 172460 - DNA, 20 bp, human
gtgtccacggctcctgcggt

SEQ ID NO: 172461 - DNA, 20 bp, human
gtcgccagcgagggtgcctc

SEQ ID NO: 172462 - DNA, 20 bp, human
ggaaggccggaggtagtggt

SEQ ID NO: 172463 - DNA, 20 bp, human
gctgagaaggccggaggtag

SEQ ID NO: 172464 - DNA, 20 bp, human
ggagctgagaggaaatggcg

SEQ ID NO: 172465 - DNA, 20 bp, human
ggctggttctagggagagga

SEQ ID NO: 172466 - DNA, 20 bp, human
gtggcgccctcgacctcagg

SEQ ID NO: 172467 - DNA, 20 bp, human
ggaagagagcgagagtccag

SEQ ID NO: 172468 - DNA, 20 bp, human
gggtgaatgacgggtgagag

SEQ ID NO: 172469 - DNA, 20 bp, human
gaagccgcggtggaggccta

SEQ ID NO: 172470 - DNA, 20 bp, human
gcccgagagtggggtctgtg

SEQ ID NO: 172471 - DNA, 20 bp, human
ggcgccatggcggtgaatga

SEQ ID NO: 172472 - DNA, 20 bp, human
gggccggcgagggagaggta

SEQ ID NO: 172473 - DNA, 20 bp, human
gactcgccgcctgaggtcga

SEQ ID NO: 172474 - DNA, 20 bp, human
gggaggcctagggcagacgc

SEQ ID NO: 172475 - DNA, 20 bp, human
ggaggtcgagggcgccatgg

SEQ ID NO: 172476 - DNA, 20 bp, human
gtggagcgacagggagtacg

SEQ ID NO: 172477 - DNA, 20 bp, human
gaaggcgggaaaatacggaa

SEQ ID NO: 172478 - DNA, 20 bp, human
gaatacggaatggagcgaca

SEQ ID NO: 172479 - DNA, 20 bp, human
ggcagagggtgcgagcttga

SEQ ID NO: 172480 - DNA, 20 bp, human
ggcccgccccacgcgcgaga

SEQ ID NO: 172481 - DNA, 20 bp, human
gcggacagataggcagggaa

SEQ ID NO: 172482 - DNA, 20 bp, human
ggcgggcggacagataggca

SEQ ID NO: 172483 - DNA, 20 bp, human
gagggtgcgagcttgaaggc

SEQ ID NO: 172484 - DNA, 20 bp, human
gccctgactgacgcactgac

SEQ ID NO: 172485 - DNA, 20 bp, human
gacatggcgcgtggccggaa

SEQ ID NO: 172486 - DNA, 20 bp, human
gccgcgctccggtcctgctc

SEQ ID NO: 172487 - DNA, 20 bp, human
gttcctcaagcggccgctgg

SEQ ID NO: 172488 - DNA, 20 bp, human
gagcggccgcttgaggaaca

SEQ ID NO: 172489 - DNA, 20 bp, human
gtccagcttggcccgcgctc

SEQ ID NO: 172490 - DNA, 20 bp, human
gagcggccttgttcctcaag

SEQ ID NO: 172491 - DNA, 20 bp, human
ggggcatccctctcgaggag

SEQ ID NO: 172492 - DNA, 20 bp, human
gcaccgcgaacgctaggaca

SEQ ID NO: 172493 - DNA, 20 bp, human
gagcgaggccgcgcccccct

SEQ ID NO: 172494 - DNA, 20 bp, human
gacaaggccgctcctcgaga

SEQ ID NO: 172495 - DNA, 20 bp, human
gccgtcagggcgcgttggga

SEQ ID NO: 172496 - DNA, 20 bp, human
ggcgcaaggcacggaggcaa

SEQ ID NO: 172497 - DNA, 20 bp, human
gccctgggcgcaaggcacgg

SEQ ID NO: 172498 - DNA, 20 bp, human
gcccagttggagggcaggta

SEQ ID NO: 172499 - DNA, 20 bp, human
gggcacggaggcaagggcca

SEQ ID NO: 172500 - DNA, 20 bp, human
gccgtccgagtgcttgaggt

SEQ ID NO: 172501 - DNA, 20 bp, human
ggaggcggggcaggcgccct

SEQ ID NO: 172502 - DNA, 20 bp, human
ggagtgcttgaggtcggcgg

SEQ ID NO: 172503 - DNA, 20 bp, human
ggcgccctgggcgcaaggca

SEQ ID NO: 172504 - DNA, 20 bp, human
gcgcggggccaccacaagtg

SEQ ID NO: 172505 - DNA, 20 bp, human
gtccaggcgcgggtaggtgc

SEQ ID NO: 172506 - DNA, 20 bp, human
gcgggcggctggcagttcaa

SEQ ID NO: 172507 - DNA, 20 bp, human
gcacggggctctcgctacag

SEQ ID NO: 172508 - DNA, 20 bp, human
gcgcggtaagcgacgttgta

SEQ ID NO: 172509 - DNA, 20 bp, human
gtgagcggcccggagcgcgt

SEQ ID NO: 172510 - DNA, 20 bp, human
gagcgtggcagcgggcggta

SEQ ID NO: 172511 - DNA, 20 bp, human
gtgctacatacggtctatga

SEQ ID NO: 172512 - DNA, 20 bp, human
gacgtcgcttaccgcggagt

SEQ ID NO: 172513 - DNA, 20 bp, human
gagcgggcggtagggcgaaa

SEQ ID NO: 172514 - DNA, 20 bp, human
gccacgcgaactgctacata

SEQ ID NO: 172515 - DNA, 20 bp, human
gcccaaaagaaaacagcgga

SEQ ID NO: 172516 - DNA, 20 bp, human
gcgacgctcggcggcatagg

SEQ ID NO: 172517 - DNA, 20 bp, human
gcgcgtgggcgactcggtca

SEQ ID NO: 172518 - DNA, 20 bp, human
gggaggcgtccgcgtagtgt

SEQ ID NO: 172519 - DNA, 20 bp, human
ggcgcgtcgccggcccgagg

SEQ ID NO: 172520 - DNA, 20 bp, human
gcgctcggcggcataggggg

SEQ ID NO: 172521 - DNA, 20 bp, human
gactctgctcaacctgcctg

SEQ ID NO: 172522 - DNA, 20 bp, human
gaggcgagcagcggtcccca

SEQ ID NO: 172523 - DNA, 20 bp, human
gggcgctgcggcggtccctg

SEQ ID NO: 172524 - DNA, 20 bp, human
gcggctccaccgacactacg

SEQ ID NO: 172525 - DNA, 20 bp, human
ggcagagttgcgacgctcgg

SEQ ID NO: 172526 - DNA, 20 bp, human
gtacactccgagcaaaccca

SEQ ID NO: 172527 - DNA, 20 bp, human
gcacacaggccaaaccacct

SEQ ID NO: 172528 - DNA, 20 bp, human
gtctctgagcgaacacctca

SEQ ID NO: 172529 - DNA, 20 bp, human
gactccgagcaaacccaagg

SEQ ID NO: 172530 - DNA, 20 bp, human
ggctgccgaaagagccctgg

SEQ ID NO: 172531 - DNA, 20 bp, human
gacgcagcaaggtggaaaga

SEQ ID NO: 172532 - DNA, 20 bp, human
gcgagcgcaacaaagctgag

SEQ ID NO: 172533 - DNA, 20 bp, human
ggtgagtgcgtgcgcccagg

SEQ ID NO: 172534 - DNA, 20 bp, human
gcggcagaacctgagcccca

SEQ ID NO: 172535 - DNA, 20 bp, human
ggcggtgagtgacccccgaa

SEQ ID NO: 172536 - DNA, 20 bp, human
gggtctcggaaaatgaacac

SEQ ID NO: 172537 - DNA, 20 bp, human
gcacaagcgcgcttcacctg

SEQ ID NO: 172538 - DNA, 20 bp, human
ggcggagaaggggccacctc

SEQ ID NO: 172539 - DNA, 20 bp, human
gcagaagcgtcgcggagaag

SEQ ID NO: 172540 - DNA, 20 bp, human
gagacgcgcggagcgaggta

SEQ ID NO: 172541 - DNA, 20 bp, human
gtacatcgaggaaccacgaa

SEQ ID NO: 172542 - DNA, 20 bp, human
gcgcgcttgtggaggagttg

SEQ ID NO: 172543 - DNA, 20 bp, human
ggaaccacgaaaggcgccct

SEQ ID NO: 172544 - DNA, 20 bp, human
gcagggccttgagcaggata

SEQ ID NO: 172545 - DNA, 20 bp, human
ggcctctgacgagaaaacgg

SEQ ID NO: 172546 - DNA, 20 bp, human
gtcgcccacgacaggaaatg

SEQ ID NO: 172547 - DNA, 20 bp, human
gccctccaggccctcagtcg

SEQ ID NO: 172548 - DNA, 20 bp, human
gagaaggttttcctgagtag

SEQ ID NO: 172549 - DNA, 20 bp, human
ggggacactggggcccagtc

SEQ ID NO: 172550 - DNA, 20 bp, human
gcgcaccccgctgcagactg

SEQ ID NO: 172551 - DNA, 20 bp, human
gtagcggctcggccatgctg

SEQ ID NO: 172552 - DNA, 20 bp, human
gggccccgaggacagacggt

SEQ ID NO: 172553 - DNA, 20 bp, human
gcggccccgcaggcgggaga

SEQ ID NO: 172554 - DNA, 20 bp, human
gccagggccccgaggacaga

SEQ ID NO: 172555 - DNA, 20 bp, human
gagacggtgggggggatcag

SEQ ID NO: 172556 - DNA, 20 bp, human
ggccgcgcgcccgagtcagg

SEQ ID NO: 172557 - DNA, 20 bp, human
gctccaggctgcaaggacca

SEQ ID NO: 172558 - DNA, 20 bp, human
gacgagcccccgccacgtgg

SEQ ID NO: 172559 - DNA, 20 bp, human
ggcctggatcagcagataat

SEQ ID NO: 172560 - DNA, 20 bp, human
gacgacctgccccctgactc

SEQ ID NO: 172561 - DNA, 20 bp, human
gcccgccgcgcgcccgagtc

SEQ ID NO: 172562 - DNA, 20 bp, human
gtccctgaaagggcttcccg

SEQ ID NO: 172563 - DNA, 20 bp, human
gtccgcagctggcctccccg

SEQ ID NO: 172564 - DNA, 20 bp, human
ggcgacagctggatcaggtg

SEQ ID NO: 172565 - DNA, 20 bp, human
gaccccgctggatccctgaa

SEQ ID NO: 172566 - DNA, 20 bp, human
ggaagagagaaaggttgtga

SEQ ID NO: 172567 - DNA, 20 bp, human
ggcggctatagctgcatccg

SEQ ID NO: 172568 - DNA, 20 bp, human
gcggtgggtggaactcacct

SEQ ID NO: 172569 - DNA, 20 bp, human
gctatcttgttgccggaagt

SEQ ID NO: 172570 - DNA, 20 bp, human
gccgggagctgcacctgatg

SEQ ID NO: 172571 - DNA, 20 bp, human
gtctgtcagacgcagtggtg

SEQ ID NO: 172572 - DNA, 20 bp, human
gaaaacccccggtgtacggt

SEQ ID NO: 172573 - DNA, 20 bp, human
gcaacaaaacccccggtgta

SEQ ID NO: 172574 - DNA, 20 bp, human
ggttggtctgtcagacgcag

SEQ ID NO: 172575 - DNA, 20 bp, human
gagtccccgccggtccccac

SEQ ID NO: 172576 - DNA, 20 bp, human
gaccgtgcggaaagtgaccc

SEQ ID NO: 172577 - DNA, 20 bp, human
gaagtgacccgggcacccca

SEQ ID NO: 172578 - DNA, 20 bp, human
ggagacgcgggattgggatc

SEQ ID NO: 172579 - DNA, 20 bp, human
gccaatcccgcgtctcccga

SEQ ID NO: 172580 - DNA, 20 bp, human
gggacggaggtcagaccgtg

SEQ ID NO: 172581 - DNA, 20 bp, human
gcgccaggtgaggcgagggc

SEQ ID NO: 172582 - DNA, 20 bp, human
ggcctgggcggaggggacgg

SEQ ID NO: 172583 - DNA, 20 bp, human
gtgaggaagagccgcgggcc

SEQ ID NO: 172584 - DNA, 20 bp, human
gagcgcgaggaagtcgatct

SEQ ID NO: 172585 - DNA, 20 bp, human
gcacctggcgcaggtaggtg

SEQ ID NO: 172586 - DNA, 20 bp, human
gcagagagaaagcacaagac

SEQ ID NO: 172587 - DNA, 20 bp, human
ggctgggcagtatagaatgt

SEQ ID NO: 172588 - DNA, 20 bp, human
gcacagatgcgcagagcctg

SEQ ID NO: 172589 - DNA, 20 bp, human
gagtggcataggttatagga

SEQ ID NO: 172590 - DNA, 20 bp, human
gatgcgcagagcctgaggtt

SEQ ID NO: 172591 - DNA, 20 bp, human
gaatgttagcggcagaggag

SEQ ID NO: 172592 - DNA, 20 bp, human
ggcaaagtggcataggttat

SEQ ID NO: 172593 - DNA, 20 bp, human
ggcttaaagcaaagtggcat

SEQ ID NO: 172594 - DNA, 20 bp, human
gtctgtgggtgtctgtagga

SEQ ID NO: 172595 - DNA, 20 bp, human
gggaagaatgttagcggcag

SEQ ID NO: 172596 - DNA, 20 bp, human
gggcgacgaacggaagatgg

SEQ ID NO: 172597 - DNA, 20 bp, human
ggcactagggagccaaggaa

SEQ ID NO: 172598 - DNA, 20 bp, human
gaaggaagggtcctgagcaa

SEQ ID NO: 172599 - DNA, 20 bp, human
gaggaagaggcactgctgag

SEQ ID NO: 172600 - DNA, 20 bp, human
gcccgaagcgggaaagcgca

SEQ ID NO: 172601 - DNA, 20 bp, human
ggggggcgcgaggggaacgg

SEQ ID NO: 172602 - DNA, 20 bp, human
gcaccgttcccggcgacgaa

SEQ ID NO: 172603 - DNA, 20 bp, human
gggagttagccaagccgaat

SEQ ID NO: 172604 - DNA, 20 bp, human
gcccggcgacgaacggaaga

SEQ ID NO: 172605 - DNA, 20 bp, human
gaggccagggcggctgttag

SEQ ID NO: 172606 - DNA, 20 bp, human
gcgctgcccaccgcagactg

SEQ ID NO: 172607 - DNA, 20 bp, human
gggagcacagctgcgctctc

SEQ ID NO: 172608 - DNA, 20 bp, human
gcgctgcctcagtctgcggt

SEQ ID NO: 172609 - DNA, 20 bp, human
ggcggtcaagcagaccacgg

SEQ ID NO: 172610 - DNA, 20 bp, human
gaacgcggtcaagcagacca

SEQ ID NO: 172611 - DNA, 20 bp, human
gccaccttcagcgagcaggt

SEQ ID NO: 172612 - DNA, 20 bp, human
ggcgaccccggaggacctct

SEQ ID NO: 172613 - DNA, 20 bp, human
gccgcccacctgctcgctga

SEQ ID NO: 172614 - DNA, 20 bp, human
gcgacgagccgcacaccgac

SEQ ID NO: 172615 - DNA, 20 bp, human
gactgccgagaggtcctccg

SEQ ID NO: 172616 - DNA, 20 bp, human
gccgcgcgaacaccgtcggt

SEQ ID NO: 172617 - DNA, 20 bp, human
gcagaccccgcagacagcag

SEQ ID NO: 172618 - DNA, 20 bp, human
gaccccgcagacagcagcgg

SEQ ID NO: 172619 - DNA, 20 bp, human
gactgaggcggctgaggcgt

SEQ ID NO: 172620 - DNA, 20 bp, human
gccccccgcgcgaacaccgt

SEQ ID NO: 172621 - DNA, 20 bp, human
gataagctgctgcccaccga

SEQ ID NO: 172622 - DNA, 20 bp, human
gctgggccaggcaacccgcg

SEQ ID NO: 172623 - DNA, 20 bp, human
gcgcctcgccgggaccggag

SEQ ID NO: 172624 - DNA, 20 bp, human
gtctgcggggtctggtgccg

SEQ ID NO: 172625 - DNA, 20 bp, human
gtacggcgcgggcgcctagg

SEQ ID NO: 172626 - DNA, 20 bp, human
ggccgcgccgaggcaccacc

SEQ ID NO: 172627 - DNA, 20 bp, human
ggagctcccgggacccggag

SEQ ID NO: 172628 - DNA, 20 bp, human
gggacccggagcggatcgac

SEQ ID NO: 172629 - DNA, 20 bp, human
gtgaggggtctggggaccta

SEQ ID NO: 172630 - DNA, 20 bp, human
gcccggagcggatcgactgg

SEQ ID NO: 172631 - DNA, 20 bp, human
gcacagagccggagctccag

SEQ ID NO: 172632 - DNA, 20 bp, human
ggggaaaccaggaaccgcag

SEQ ID NO: 172633 - DNA, 20 bp, human
gtaaggcaggtcctaggagc

SEQ ID NO: 172634 - DNA, 20 bp, human
gcaaggcaacaggtcatgag

SEQ ID NO: 172635 - DNA, 20 bp, human
gccggcgcagagcagaggtc

SEQ ID NO: 172636 - DNA, 20 bp, human
ggccggccgggatccggtgt

SEQ ID NO: 172637 - DNA, 20 bp, human
gttaacccttccaggcgagt

SEQ ID NO: 172638 - DNA, 20 bp, human
gtcggttgcagctggcagtg

SEQ ID NO: 172639 - DNA, 20 bp, human
ggcgcgggcgccggagcgag

SEQ ID NO: 172640 - DNA, 20 bp, human
ggccggagcgaggggcccgc

SEQ ID NO: 172641 - DNA, 20 bp, human
gtggctgcgcgaccccgggc

SEQ ID NO: 172642 - DNA, 20 bp, human
ggccatggctgcgcgacccc

SEQ ID NO: 172643 - DNA, 20 bp, human
gtgccagctgcaaccgacac

SEQ ID NO: 172644 - DNA, 20 bp, human
gggcccggctattaataacg

SEQ ID NO: 172645 - DNA, 20 bp, human
gtattaatagccgggcccgc

SEQ ID NO: 172646 - DNA, 20 bp, human
gagaaagagaggagccgact

SEQ ID NO: 172647 - DNA, 20 bp, human
gggatcgggtttgctgccag

SEQ ID NO: 172648 - DNA, 20 bp, human
gggcggacagaggctagtgg

SEQ ID NO: 172649 - DNA, 20 bp, human
ggccgactcggcagggactg

SEQ ID NO: 172650 - DNA, 20 bp, human
gcgggccgcggcctactccc

SEQ ID NO: 172651 - DNA, 20 bp, human
gggagcgtgcgagccagaag

SEQ ID NO: 172652 - DNA, 20 bp, human
gcggccgaagctcacgccgc

SEQ ID NO: 172653 - DNA, 20 bp, human
gaccgcagcagcacatggaa

SEQ ID NO: 172654 - DNA, 20 bp, human
ggagaggagccgactcggca

SEQ ID NO: 172655 - DNA, 20 bp, human
gccgcgagcggcttcagagt

SEQ ID NO: 172656 - DNA, 20 bp, human
gcaccccgggagacgcgaag

SEQ ID NO: 172657 - DNA, 20 bp, human
gcctccgggacaaggtgacc

SEQ ID NO: 172658 - DNA, 20 bp, human
gccgagaactgagagcgtag

SEQ ID NO: 172659 - DNA, 20 bp, human
gcgctcgctcgggagagtcg

SEQ ID NO: 172660 - DNA, 20 bp, human
gtcggagcgcgcagacccgg

SEQ ID NO: 172661 - DNA, 20 bp, human
ggcgagcgtgcggggcggtg

SEQ ID NO: 172662 - DNA, 20 bp, human
gtggcgcccgcggtaagtcc

SEQ ID NO: 172663 - DNA, 20 bp, human
ggggtctgcgcgctccgagg

SEQ ID NO: 172664 - DNA, 20 bp, human
gggaggtctggacttacctc

SEQ ID NO: 172665 - DNA, 20 bp, human
gctcggcaagcgaagaggag

SEQ ID NO: 172666 - DNA, 20 bp, human
ggggcacgggagccctctcg

SEQ ID NO: 172667 - DNA, 20 bp, human
gagagcccctagccccgaga

SEQ ID NO: 172668 - DNA, 20 bp, human
gagggacgaagtgcaagcct

SEQ ID NO: 172669 - DNA, 20 bp, human
gcggtcgcggtggaactccc

SEQ ID NO: 172670 - DNA, 20 bp, human
gcgcaaggtgcggccaagca

SEQ ID NO: 172671 - DNA, 20 bp, human
gcgcagagctaggcacggag

SEQ ID NO: 172672 - DNA, 20 bp, human
gcttggcggagcgcaaggtg

SEQ ID NO: 172673 - DNA, 20 bp, human
ggcggggcccggccaggatg

SEQ ID NO: 172674 - DNA, 20 bp, human
gagagcaggggagccctcct

SEQ ID NO: 172675 - DNA, 20 bp, human
gtcccgggagccccgcatcc

SEQ ID NO: 172676 - DNA, 20 bp, human
gcccgggcagtggaaaccgt

SEQ ID NO: 172677 - DNA, 20 bp, human
gcgcgaccggttcctcctcc

SEQ ID NO: 172678 - DNA, 20 bp, human
gacaggagcagtagatgcgt

SEQ ID NO: 172679 - DNA, 20 bp, human
gcagctcctccaggcagcgg

SEQ ID NO: 172680 - DNA, 20 bp, human
gcccccagcgagcagccggg

SEQ ID NO: 172681 - DNA, 20 bp, human
gcgcaggcttccctacctcc

SEQ ID NO: 172682 - DNA, 20 bp, human
gaaggccgtgcatctccagg

SEQ ID NO: 172683 - DNA, 20 bp, human
gaggaggaaccggtcgcgga

SEQ ID NO: 172684 - DNA, 20 bp, human
gctgctcctgtcgggaagga

SEQ ID NO: 172685 - DNA, 20 bp, human
gtcgggaaggaaggtcgccc

SEQ ID NO: 172686 - DNA, 20 bp, human
gtctctgcgcccaggctcgg

SEQ ID NO: 172687 - DNA, 20 bp, human
gacaggagcagtagatgcgt

SEQ ID NO: 172688 - DNA, 20 bp, human
gcgcgaccggttcctcctcc

SEQ ID NO: 172689 - DNA, 20 bp, human
gctgctcctgtcgggaagga

SEQ ID NO: 172690 - DNA, 20 bp, human
gtcgggaaggaaggtcgccc

SEQ ID NO: 172691 - DNA, 20 bp, human
gctgggcgcagagagccggg

SEQ ID NO: 172692 - DNA, 20 bp, human
gcccccagcgagcagccggg

SEQ ID NO: 172693 - DNA, 20 bp, human
gcacatctcctgggctccaa

SEQ ID NO: 172694 - DNA, 20 bp, human
gtctactgctcctgtcggga

SEQ ID NO: 172695 - DNA, 20 bp, human
gccaggccggttcagcctct

SEQ ID NO: 172696 - DNA, 20 bp, human
gggtgcgccccggagagagt

SEQ ID NO: 172697 - DNA, 20 bp, human
gccggacctgaaaaagcgag

SEQ ID NO: 172698 - DNA, 20 bp, human
gctttccgagcgccaaggag

SEQ ID NO: 172699 - DNA, 20 bp, human
gcaggtccggccgaaggctc

SEQ ID NO: 172700 - DNA, 20 bp, human
gggattggagcgagcgccag

SEQ ID NO: 172701 - DNA, 20 bp, human
gtggagcgagcgccagcggg

SEQ ID NO: 172702 - DNA, 20 bp, human
gggcgccgtaaacttgtcag

SEQ ID NO: 172703 - DNA, 20 bp, human
gagagacaaacgccacccgc

SEQ ID NO: 172704 - DNA, 20 bp, human
gtcggaccccggcatcgggt

SEQ ID NO: 172705 - DNA, 20 bp, human
gaaggggcgggggcgagaga

SEQ ID NO: 172706 - DNA, 20 bp, human
ggatgcccaggcatggatga

SEQ ID NO: 172707 - DNA, 20 bp, human
ggccccaggacgactttgac

SEQ ID NO: 172708 - DNA, 20 bp, human
ggactttgacaggagcgtgg

SEQ ID NO: 172709 - DNA, 20 bp, human
gtcctgtcaaagtcgtcctg

SEQ ID NO: 172710 - DNA, 20 bp, human
gacagccttcatccatgcct

SEQ ID NO: 172711 - DNA, 20 bp, human
gtaggaaacctgaggtctga

SEQ ID NO: 172712 - DNA, 20 bp, human
ggggagaccgaggtatgcag

SEQ ID NO: 172713 - DNA, 20 bp, human
gtatctgtgaaaggcaacgg

SEQ ID NO: 172714 - DNA, 20 bp, human
ggccaggctgtgggagaccg

SEQ ID NO: 172715 - DNA, 20 bp, human
gtgcacgggtcccccctgca

SEQ ID NO: 172716 - DNA, 20 bp, human
gcaggcccgggtgactccag

SEQ ID NO: 172717 - DNA, 20 bp, human
gtctgggacacccttgtcta

SEQ ID NO: 172718 - DNA, 20 bp, human
gagccaagtctagggcccag

SEQ ID NO: 172719 - DNA, 20 bp, human
gtctagggaagaggtcttac

SEQ ID NO: 172720 - DNA, 20 bp, human
ggcctcctcgccgcccaatg

SEQ ID NO: 172721 - DNA, 20 bp, human
gtccgcgacctaggaaccgt

SEQ ID NO: 172722 - DNA, 20 bp, human
gccaccgggagcacctagag

SEQ ID NO: 172723 - DNA, 20 bp, human
gggcctggggacacaaagtc

SEQ ID NO: 172724 - DNA, 20 bp, human
gggcaggctgccgcattggg

SEQ ID NO: 172725 - DNA, 20 bp, human
gcaggaacctgggaatccga

SEQ ID NO: 172726 - DNA, 20 bp, human
gtaagagccaacggcagcag

SEQ ID NO: 172727 - DNA, 20 bp, human
ggagggataggggtagataa

SEQ ID NO: 172728 - DNA, 20 bp, human
ggggtagataagggatggag

SEQ ID NO: 172729 - DNA, 20 bp, human
gattggaggccagagggata

SEQ ID NO: 172730 - DNA, 20 bp, human
ggtgggaaggtagaaggatt

SEQ ID NO: 172731 - DNA, 20 bp, human
gtgggagcaaccgggaagga

SEQ ID NO: 172732 - DNA, 20 bp, human
ggaaagaaagcgccagaaag

SEQ ID NO: 172733 - DNA, 20 bp, human
gcaggaaatgggccttgaaa

SEQ ID NO: 172734 - DNA, 20 bp, human
ggccatatggggggcaacag

SEQ ID NO: 172735 - DNA, 20 bp, human
gccccttcagaggtacgtgg

SEQ ID NO: 172736 - DNA, 20 bp, human
ggaccccaacgggcccccgg

SEQ ID NO: 172737 - DNA, 20 bp, human
gtgagcaaaggcggcgcgcc

SEQ ID NO: 172738 - DNA, 20 bp, human
gctggaggtcacagcaatcg

SEQ ID NO: 172739 - DNA, 20 bp, human
ggtgcagccacgatggaagg

SEQ ID NO: 172740 - DNA, 20 bp, human
gctgccggaccagggtgtag

SEQ ID NO: 172741 - DNA, 20 bp, human
gacggagcgggcaaagccgg

SEQ ID NO: 172742 - DNA, 20 bp, human
gaggggggcgcacgaaccgg

SEQ ID NO: 172743 - DNA, 20 bp, human
gcgggtgcagccacgatgga

SEQ ID NO: 172744 - DNA, 20 bp, human
gcgacccctacaccctggtc

SEQ ID NO: 172745 - DNA, 20 bp, human
ggaggtcacagcaatcgggg

SEQ ID NO: 172746 - DNA, 20 bp, human
gccgccgccgcggaacgcag

SEQ ID NO: 172747 - DNA, 20 bp, human
gcctacggcgcggccaaggc

SEQ ID NO: 172748 - DNA, 20 bp, human
ggcgtgcgggccacctgtcc

SEQ ID NO: 172749 - DNA, 20 bp, human
gccggtgaactccccaatct

SEQ ID NO: 172750 - DNA, 20 bp, human
ggttcctctgcgttccgcgg

SEQ ID NO: 172751 - DNA, 20 bp, human
gagcccacgagcgcgacagg

SEQ ID NO: 172752 - DNA, 20 bp, human
gggcaggggcccgctccctg

SEQ ID NO: 172753 - DNA, 20 bp, human
gcccctgcctcgctggcagt

SEQ ID NO: 172754 - DNA, 20 bp, human
ggggtgtccggatctccgca

SEQ ID NO: 172755 - DNA, 20 bp, human
gacagcgggacagactgtgg

SEQ ID NO: 172756 - DNA, 20 bp, human
gagacccggggaggaggtag

SEQ ID NO: 172757 - DNA, 20 bp, human
gtaggggtagaggcgaccgg

SEQ ID NO: 172758 - DNA, 20 bp, human
ggccggagagggaccttgag

SEQ ID NO: 172759 - DNA, 20 bp, human
ggaccggcggtgacctctca

SEQ ID NO: 172760 - DNA, 20 bp, human
gggccggccggacggacagg

SEQ ID NO: 172761 - DNA, 20 bp, human
gcctgaaggtcgcgaggcag

SEQ ID NO: 172762 - DNA, 20 bp, human
gccctcctccgcccgcaggt

SEQ ID NO: 172763 - DNA, 20 bp, human
gggcggacagaaggcgccag

SEQ ID NO: 172764 - DNA, 20 bp, human
gcgcccgggccggccatgga

SEQ ID NO: 172765 - DNA, 20 bp, human
gcaggacgcgacccggagca

SEQ ID NO: 172766 - DNA, 20 bp, human
gggagaacccaggtatctca

SEQ ID NO: 172767 - DNA, 20 bp, human
gccattccaggtccttaaag

SEQ ID NO: 172768 - DNA, 20 bp, human
ggctcctgggtcacaagacg

SEQ ID NO: 172769 - DNA, 20 bp, human
ggattggccctccagagaag

SEQ ID NO: 172770 - DNA, 20 bp, human
gttgggcgagagggctgtca

SEQ ID NO: 172771 - DNA, 20 bp, human
gtccttctgtgagaggacac

SEQ ID NO: 172772 - DNA, 20 bp, human
gggagaccgcgattctaaga

SEQ ID NO: 172773 - DNA, 20 bp, human
gggctaccttcttagaatcg

SEQ ID NO: 172774 - DNA, 20 bp, human
gtggccctccagagaagggg

SEQ ID NO: 172775 - DNA, 20 bp, human
gggactttctggggactagg

SEQ ID NO: 172776 - DNA, 20 bp, human
gctgctgcggccagacccac

SEQ ID NO: 172777 - DNA, 20 bp, human
gacgctgcggaggcagagac

SEQ ID NO: 172778 - DNA, 20 bp, human
gcccagccggcggtagcccg

SEQ ID NO: 172779 - DNA, 20 bp, human
gctgccgtccccccagccgg

SEQ ID NO: 172780 - DNA, 20 bp, human
ggctcccgctgacgctgcgg

SEQ ID NO: 172781 - DNA, 20 bp, human
gcgaggagccccagtcgggt

SEQ ID NO: 172782 - DNA, 20 bp, human
gtcccgggggtggcgatgaa

SEQ ID NO: 172783 - DNA, 20 bp, human
gcggaggcagagactggtct

SEQ ID NO: 172784 - DNA, 20 bp, human
gcgtcagcgggagcggtgag

SEQ ID NO: 172785 - DNA, 20 bp, human
gccgagtcgtgactcttccc

SEQ ID NO: 172786 - DNA, 20 bp, human
ggcagcgacgcccggaggag

SEQ ID NO: 172787 - DNA, 20 bp, human
ggcggcgcaaagtgaaactc

SEQ ID NO: 172788 - DNA, 20 bp, human
gcggggccacgtcctcccga

SEQ ID NO: 172789 - DNA, 20 bp, human
ggccggagatccccgtggag

SEQ ID NO: 172790 - DNA, 20 bp, human
ggggactcgagagagcactc

SEQ ID NO: 172791 - DNA, 20 bp, human
gcccgcgccgccagaggata

SEQ ID NO: 172792 - DNA, 20 bp, human
gtcgcgggcagcgcgccctc

SEQ ID NO: 172793 - DNA, 20 bp, human
gaggccggccgcccctccac

SEQ ID NO: 172794 - DNA, 20 bp, human
gctgggccggtggcgcacgg

SEQ ID NO: 172795 - DNA, 20 bp, human
gtggctgtttgaatgaagtg

SEQ ID NO: 172796 - DNA, 20 bp, human
gggtgaaggtgaatcaatct

SEQ ID NO: 172797 - DNA, 20 bp, human
gcactccagctgacccaagt

SEQ ID NO: 172798 - DNA, 20 bp, human
gcgggcaggccacaacctag

SEQ ID NO: 172799 - DNA, 20 bp, human
gctcgtctggcttcctactt

SEQ ID NO: 172800 - DNA, 20 bp, human
gaccgaaaccgctgtgctgt

SEQ ID NO: 172801 - DNA, 20 bp, human
gccccgaggccaggtgaatc

SEQ ID NO: 172802 - DNA, 20 bp, human
gactaaacggtccctcatag

SEQ ID NO: 172803 - DNA, 20 bp, human
gggagggatagaacaggcaa

SEQ ID NO: 172804 - DNA, 20 bp, human
ggggtcatatctgacagtag

SEQ ID NO: 172805 - DNA, 20 bp, human
gcagcctcgagacccggaaa

SEQ ID NO: 172806 - DNA, 20 bp, human
gggtgaaggtgaatcaatct

SEQ ID NO: 172807 - DNA, 20 bp, human
gcactccagctgacccaagt

SEQ ID NO: 172808 - DNA, 20 bp, human
gcgggcaggccacaacctag

SEQ ID NO: 172809 - DNA, 20 bp, human
gctcgtctggcttcctactt

SEQ ID NO: 172810 - DNA, 20 bp, human
gaccgaaaccgctgtgctgt

SEQ ID NO: 172811 - DNA, 20 bp, human
gccccgaggccaggtgaatc

SEQ ID NO: 172812 - DNA, 20 bp, human
gactaaacggtccctcatag

SEQ ID NO: 172813 - DNA, 20 bp, human
gggagggatagaacaggcaa

SEQ ID NO: 172814 - DNA, 20 bp, human
ggggtcatatctgacagtag

SEQ ID NO: 172815 - DNA, 20 bp, human
gcagcctcgagacccggaaa

SEQ ID NO: 172816 - DNA, 20 bp, human
gcgagaccgggacaagacca

SEQ ID NO: 172817 - DNA, 20 bp, human
gcggcgaggccggagcgtcg

SEQ ID NO: 172818 - DNA, 20 bp, human
gggagagcccaggcacttag

SEQ ID NO: 172819 - DNA, 20 bp, human
gccccggaggcccgcagact

SEQ ID NO: 172820 - DNA, 20 bp, human
gccggagcgtcgcggcggag

SEQ ID NO: 172821 - DNA, 20 bp, human
gcgaggccggagcgtcgcgg

SEQ ID NO: 172822 - DNA, 20 bp, human
gtcccagtctgcgggcctcc

SEQ ID NO: 172823 - DNA, 20 bp, human
gacccagctcggcgtccagg

SEQ ID NO: 172824 - DNA, 20 bp, human
gccgctcgcgtcccagtctg

SEQ ID NO: 172825 - DNA, 20 bp, human
gtcctgccctggtcttgtcc

SEQ ID NO: 172826 - DNA, 20 bp, human
gggagcagcccgctaggcgg

SEQ ID NO: 172827 - DNA, 20 bp, human
gcagccccaggcttacaggt

SEQ ID NO: 172828 - DNA, 20 bp, human
gcccggagcagcccgctagg

SEQ ID NO: 172829 - DNA, 20 bp, human
ggcagcccgctaggcggtgg

SEQ ID NO: 172830 - DNA, 20 bp, human
gcttgcggggaggggcgcaa

SEQ ID NO: 172831 - DNA, 20 bp, human
gccgcaagcggatcagggcg

SEQ ID NO: 172832 - DNA, 20 bp, human
ggaatagcgcaggtgggaag

SEQ ID NO: 172833 - DNA, 20 bp, human
ggccgggaagctaccctcct

SEQ ID NO: 172834 - DNA, 20 bp, human
gcctccccgcaagcggatca

SEQ ID NO: 172835 - DNA, 20 bp, human
gcgccaccgccaccgcctag

SEQ ID NO: 172836 - DNA, 20 bp, human
gagccaggaaaatcccacat

SEQ ID NO: 172837 - DNA, 20 bp, human
gcacatcggcagcaacatga

SEQ ID NO: 172838 - DNA, 20 bp, human
gggcgagcgcaatctgactg

SEQ ID NO: 172839 - DNA, 20 bp, human
gagactgccagacctcctct

SEQ ID NO: 172840 - DNA, 20 bp, human
ggaggacagactaagatcag

SEQ ID NO: 172841 - DNA, 20 bp, human
gacagactaagatcagaggg

SEQ ID NO: 172842 - DNA, 20 bp, human
gcatataccccaagccacaa

SEQ ID NO: 172843 - DNA, 20 bp, human
gttgttctcctcccaagagg

SEQ ID NO: 172844 - DNA, 20 bp, human
ggagtaagatgagcacccgg

SEQ ID NO: 172845 - DNA, 20 bp, human
gaggagaacaatctagactt

SEQ ID NO: 172846 - DNA, 20 bp, human
gctgccgaggacgcaagact

SEQ ID NO: 172847 - DNA, 20 bp, human
gcagggcgcccctccagtca

SEQ ID NO: 172848 - DNA, 20 bp, human
gaatgggctcattctcaagg

SEQ ID NO: 172849 - DNA, 20 bp, human
gggacctgaacgaagtgtca

SEQ ID NO: 172850 - DNA, 20 bp, human
gcgcacaaattcgcagcagg

SEQ ID NO: 172851 - DNA, 20 bp, human
ggacagacgaagcttgggtg

SEQ ID NO: 172852 - DNA, 20 bp, human
ggacaacaagcaagacactg

SEQ ID NO: 172853 - DNA, 20 bp, human
gcgaagcttgggtgcggtag

SEQ ID NO: 172854 - DNA, 20 bp, human
gcagcttcgggcgcctgccg

SEQ ID NO: 172855 - DNA, 20 bp, human
gaaattcgcagcaggcggct

SEQ ID NO: 172856 - DNA, 20 bp, human
gcggacaggaagcccagacg

SEQ ID NO: 172857 - DNA, 20 bp, human
ggtccccaggagagaagttg

SEQ ID NO: 172858 - DNA, 20 bp, human
gaggtgctcgaaccccgtct

SEQ ID NO: 172859 - DNA, 20 bp, human
gtcagggaaagggaacccaa

SEQ ID NO: 172860 - DNA, 20 bp, human
gaggagcaggacagccggac

SEQ ID NO: 172861 - DNA, 20 bp, human
ggggagtagcgtctgaccac

SEQ ID NO: 172862 - DNA, 20 bp, human
ggatcctgggaagagatgtg

SEQ ID NO: 172863 - DNA, 20 bp, human
gagggagagcccctgaaatg

SEQ ID NO: 172864 - DNA, 20 bp, human
ggagtttgaacagtgtcccc

SEQ ID NO: 172865 - DNA, 20 bp, human
ggacactgttcaaactccgg

SEQ ID NO: 172866 - DNA, 20 bp, human
gatgctgagaaaggcggtgt

SEQ ID NO: 172867 - DNA, 20 bp, human
gtcttggctgatgggctcaa

SEQ ID NO: 172868 - DNA, 20 bp, human
gtgaggggctcttggctgat

SEQ ID NO: 172869 - DNA, 20 bp, human
gggcatgtatgtgtgagtca

SEQ ID NO: 172870 - DNA, 20 bp, human
ggggctttaaaaggcgtggg

SEQ ID NO: 172871 - DNA, 20 bp, human
gtctggggtctagaatggag

SEQ ID NO: 172872 - DNA, 20 bp, human
gagagctgtagaaaactcat

SEQ ID NO: 172873 - DNA, 20 bp, human
gggcttggctgaggggctct

SEQ ID NO: 172874 - DNA, 20 bp, human
ggtcatagctggcttggctg

SEQ ID NO: 172875 - DNA, 20 bp, human
gcaatagtaatggttatagt

SEQ ID NO: 172876 - DNA, 20 bp, human
gaagcgagtcagcgaggggt

SEQ ID NO: 172877 - DNA, 20 bp, human
ggagcccacccgctaacgct

SEQ ID NO: 172878 - DNA, 20 bp, human
gccgggaacccagcgcgtcg

SEQ ID NO: 172879 - DNA, 20 bp, human
gggcagggtagatacaacag

SEQ ID NO: 172880 - DNA, 20 bp, human
gagggctcgcaggaaggcaa

SEQ ID NO: 172881 - DNA, 20 bp, human
gagcgaagcgagtcagcgag

SEQ ID NO: 172882 - DNA, 20 bp, human
ggagcccagcgttagcgggt

SEQ ID NO: 172883 - DNA, 20 bp, human
gacccggaaggtgcccgcag

SEQ ID NO: 172884 - DNA, 20 bp, human
gctgctactcaccaattcca

SEQ ID NO: 172885 - DNA, 20 bp, human
gggcagccagctatcaggtg

SEQ ID NO: 172886 - DNA, 20 bp, human
ggcgagcgcgcgcccagtgt

SEQ ID NO: 172887 - DNA, 20 bp, human
gaggcagctaggactaggag

SEQ ID NO: 172888 - DNA, 20 bp, human
gcggcaggtcgggagcaaga

SEQ ID NO: 172889 - DNA, 20 bp, human
gctgacagctgctgataagg

SEQ ID NO: 172890 - DNA, 20 bp, human
gaggactaggagcggagtcg

SEQ ID NO: 172891 - DNA, 20 bp, human
ggctgctgataaggtggcgg

SEQ ID NO: 172892 - DNA, 20 bp, human
gttcggaggcagctaggact

SEQ ID NO: 172893 - DNA, 20 bp, human
gcgcgcgcccagtgtgggag

SEQ ID NO: 172894 - DNA, 20 bp, human
gcagggacccaggccgaaag

SEQ ID NO: 172895 - DNA, 20 bp, human
gaagaccctggtcgcttcgg

SEQ ID NO: 172896 - DNA, 20 bp, human
gcggcggcgggctctgtcca

SEQ ID NO: 172897 - DNA, 20 bp, human
ggacatggacgtggtgaatc

SEQ ID NO: 172898 - DNA, 20 bp, human
gatagagcgacagaaggtgt

SEQ ID NO: 172899 - DNA, 20 bp, human
gggtacgcgctccagcaccg

SEQ ID NO: 172900 - DNA, 20 bp, human
gctgctggcggacatggacg

SEQ ID NO: 172901 - DNA, 20 bp, human
gcccggcctaggcagccggg

SEQ ID NO: 172902 - DNA, 20 bp, human
gacagagactgtacccccat

SEQ ID NO: 172903 - DNA, 20 bp, human
gcgggaggctcggctagcaa

SEQ ID NO: 172904 - DNA, 20 bp, human
gaaggggtggtcgcctatgg

SEQ ID NO: 172905 - DNA, 20 bp, human
gtctgcggcaggtgaagggg

SEQ ID NO: 172906 - DNA, 20 bp, human
gagagagagtcaggacgacg

SEQ ID NO: 172907 - DNA, 20 bp, human
gtcggccgcctggctcccag

SEQ ID NO: 172908 - DNA, 20 bp, human
gcgagaccagagcagcccgg

SEQ ID NO: 172909 - DNA, 20 bp, human
ggcagcccggtggcgaggaa

SEQ ID NO: 172910 - DNA, 20 bp, human
gcagaggggagctccggtgt

SEQ ID NO: 172911 - DNA, 20 bp, human
gactccacggggacacccag

SEQ ID NO: 172912 - DNA, 20 bp, human
ggagagtcaggacgacgggg

SEQ ID NO: 172913 - DNA, 20 bp, human
ggctccactgcctcccgcag

SEQ ID NO: 172914 - DNA, 20 bp, human
ggtgggagggtggctcccct

SEQ ID NO: 172915 - DNA, 20 bp, human
gggggagctccggtgtggga

SEQ ID NO: 172916 - DNA, 20 bp, human
gcagcagaaagcccccgact

SEQ ID NO: 172917 - DNA, 20 bp, human
gccgacatctaggtggagag

SEQ ID NO: 172918 - DNA, 20 bp, human
ggtgcagcccgacatctagg

SEQ ID NO: 172919 - DNA, 20 bp, human
gcctggaccgcgtgtgagtg

SEQ ID NO: 172920 - DNA, 20 bp, human
ggagcgcacgccacgtgacc

SEQ ID NO: 172921 - DNA, 20 bp, human
gcgagtaggcggtccacctg

SEQ ID NO: 172922 - DNA, 20 bp, human
gccagcgcagccccacgagt

SEQ ID NO: 172923 - DNA, 20 bp, human
gctcacacgcggtccagggg

SEQ ID NO: 172924 - DNA, 20 bp, human
gggccgccgcggtgccccgc

SEQ ID NO: 172925 - DNA, 20 bp, human
gtgctgccggcggggcaccg

SEQ ID NO: 172926 - DNA, 20 bp, human
gaaagctccagcgaccacgg

SEQ ID NO: 172927 - DNA, 20 bp, human
ggcggcaggagcggctgcgt

SEQ ID NO: 172928 - DNA, 20 bp, human
gtctgcgacaggatcagcag

SEQ ID NO: 172929 - DNA, 20 bp, human
ggcgctgacagacaggacca

SEQ ID NO: 172930 - DNA, 20 bp, human
gcagttccgcagctacgtgt

SEQ ID NO: 172931 - DNA, 20 bp, human
ggaacatctggtccagcgag

SEQ ID NO: 172932 - DNA, 20 bp, human
gcccagcgagccgtaataca

SEQ ID NO: 172933 - DNA, 20 bp, human
gtccggggaaagcagcggag

SEQ ID NO: 172934 - DNA, 20 bp, human
gaggagggactggaaccaag

SEQ ID NO: 172935 - DNA, 20 bp, human
gcgggtcccacacgtagctg

SEQ ID NO: 172936 - DNA, 20 bp, human
gcggcagcagcagttagcag

SEQ ID NO: 172937 - DNA, 20 bp, human
gggtgggagtctgagaccta

SEQ ID NO: 172938 - DNA, 20 bp, human
gcccgggcaagtccccaggg

SEQ ID NO: 172939 - DNA, 20 bp, human
gcacccggggatccctccct

SEQ ID NO: 172940 - DNA, 20 bp, human
gagttagcagcggcaacttg

SEQ ID NO: 172941 - DNA, 20 bp, human
ggggagtctgagacctaggg

SEQ ID NO: 172942 - DNA, 20 bp, human
ggcaccccgggcaagtcccc

SEQ ID NO: 172943 - DNA, 20 bp, human
gtctcacaataggccacccg

SEQ ID NO: 172944 - DNA, 20 bp, human
gggtaaggaagcgggactgg

SEQ ID NO: 172945 - DNA, 20 bp, human
ggcagcctgcaacacaaaag

SEQ ID NO: 172946 - DNA, 20 bp, human
ggaggcagtcaggcaaacct

SEQ ID NO: 172947 - DNA, 20 bp, human
gtgacttacgagccatctgt

SEQ ID NO: 172948 - DNA, 20 bp, human
gatctatcacaaggatgaat

SEQ ID NO: 172949 - DNA, 20 bp, human
gtgcatgcatatctatcaca

SEQ ID NO: 172950 - DNA, 20 bp, human
gaagggccaggcttcccaaa

SEQ ID NO: 172951 - DNA, 20 bp, human
ggagtttcaagcaggaataa

SEQ ID NO: 172952 - DNA, 20 bp, human
ggaaatcaaatccccacaga

SEQ ID NO: 172953 - DNA, 20 bp, human
ggcaaacttgttctactgta

SEQ ID NO: 172954 - DNA, 20 bp, human
gagcttcttacaagaaatat

SEQ ID NO: 172955 - DNA, 20 bp, human
gaaactagagcaagattctg

SEQ ID NO: 172956 - DNA, 20 bp, human
gagagttggcgcaaacctcg

SEQ ID NO: 172957 - DNA, 20 bp, human
ggctcgcgcggcgggagagt

SEQ ID NO: 172958 - DNA, 20 bp, human
gcgcgctggaactagagacc

SEQ ID NO: 172959 - DNA, 20 bp, human
gtggagtgggagaagtgctc

SEQ ID NO: 172960 - DNA, 20 bp, human
gctagcgcgcggggtcccag

SEQ ID NO: 172961 - DNA, 20 bp, human
gctggctgcccctgtcccga

SEQ ID NO: 172962 - DNA, 20 bp, human
gtgctcgggcatcttccctc

SEQ ID NO: 172963 - DNA, 20 bp, human
ggcgcctcggctcgctcgcg

SEQ ID NO: 172964 - DNA, 20 bp, human
gccgccatggggccaacgtg

SEQ ID NO: 172965 - DNA, 20 bp, human
gggaagcagcacaggtaacc

SEQ ID NO: 172966 - DNA, 20 bp, human
ggagcgcagctgacaactag

SEQ ID NO: 172967 - DNA, 20 bp, human
ggaagggggaaggtatccag

SEQ ID NO: 172968 - DNA, 20 bp, human
gcagctcttaagatgctccg

SEQ ID NO: 172969 - DNA, 20 bp, human
ggctgacagtgcaccataca

SEQ ID NO: 172970 - DNA, 20 bp, human
ggctgtagagctctaggtca

SEQ ID NO: 172971 - DNA, 20 bp, human
gactggtcctgatgagaggt

SEQ ID NO: 172972 - DNA, 20 bp, human
ggaaccctcggtcagtaccg

SEQ ID NO: 172973 - DNA, 20 bp, human
ggcctgagccacaccgaggg

SEQ ID NO: 172974 - DNA, 20 bp, human
ggacgcctcctgcgacggtc

SEQ ID NO: 172975 - DNA, 20 bp, human
ggcagctgacaactaggggc

SEQ ID NO: 172976 - DNA, 20 bp, human
gcaagcgcgtccgggatcca

SEQ ID NO: 172977 - DNA, 20 bp, human
gcgggatcgcaccctgatcg

SEQ ID NO: 172978 - DNA, 20 bp, human
ggagcccggcgacactgcag

SEQ ID NO: 172979 - DNA, 20 bp, human
ggatctccggctcggacccc

SEQ ID NO: 172980 - DNA, 20 bp, human
ggagtggccgggccgggtaa

SEQ ID NO: 172981 - DNA, 20 bp, human
gtcagggcgtccctggatcc

SEQ ID NO: 172982 - DNA, 20 bp, human
gctgcgtgcgtccgcgatca

SEQ ID NO: 172983 - DNA, 20 bp, human
ggcggggtgcgtactcaccc

SEQ ID NO: 172984 - DNA, 20 bp, human
gctgctcctggggtccgagc

SEQ ID NO: 172985 - DNA, 20 bp, human
gtgggagcgtgcccggactg

SEQ ID NO: 172986 - DNA, 20 bp, human
gcgcgttggaggacaggtca

SEQ ID NO: 172987 - DNA, 20 bp, human
gccggcccggggaaggtgag

SEQ ID NO: 172988 - DNA, 20 bp, human
ggccagcagcgagacctaaa

SEQ ID NO: 172989 - DNA, 20 bp, human
gcagcgagacctaaagggag

SEQ ID NO: 172990 - DNA, 20 bp, human
ggaggggacagcagacgcgt

SEQ ID NO: 172991 - DNA, 20 bp, human
ggcacatgcaccccaagaag

SEQ ID NO: 172992 - DNA, 20 bp, human
gtggcgcccagcgcgatcac

SEQ ID NO: 172993 - DNA, 20 bp, human
gacggctgcgaggacgtcag

SEQ ID NO: 172994 - DNA, 20 bp, human
gctgaaggagaattagggag

SEQ ID NO: 172995 - DNA, 20 bp, human
gcagctgcagagggggaact

SEQ ID NO: 172996 - DNA, 20 bp, human
gggtaagtggaggctgacag

SEQ ID NO: 172997 - DNA, 20 bp, human
gaggagcgaggggccacggg

SEQ ID NO: 172998 - DNA, 20 bp, human
ggtccatggcgagcgcatca

SEQ ID NO: 172999 - DNA, 20 bp, human
gatggaccgcaccaactgga

SEQ ID NO: 173000 - DNA, 20 bp, human
gctcagtttggcaggaaggt

SEQ ID NO: 173001 - DNA, 20 bp, human
ggagccccccgccagctggg

SEQ ID NO: 173002 - DNA, 20 bp, human
gcctgcagaccccacgggac

SEQ ID NO: 173003 - DNA, 20 bp, human
ggaggccggcaaaaccacga

SEQ ID NO: 173004 - DNA, 20 bp, human
ggctgcccccgccatccagt

SEQ ID NO: 173005 - DNA, 20 bp, human
gggcaaaaccacgaaggccg

SEQ ID NO: 173006 - DNA, 20 bp, human
gtccaaccgctggccacctg

SEQ ID NO: 173007 - DNA, 20 bp, human
gcgcatttgcgggacctagg

SEQ ID NO: 173008 - DNA, 20 bp, human
gcagccccagccgcccagac

SEQ ID NO: 173009 - DNA, 20 bp, human
gggctcgcttacccgccatg

SEQ ID NO: 173010 - DNA, 20 bp, human
gcagcgtctgagcacccccg

SEQ ID NO: 173011 - DNA, 20 bp, human
gagtgctggaagggtcgcag

SEQ ID NO: 173012 - DNA, 20 bp, human
gcctcggcgcgctcttggag

SEQ ID NO: 173013 - DNA, 20 bp, human
ggtgagggccagcagcaacg

SEQ ID NO: 173014 - DNA, 20 bp, human
ggccatggggctgctcccgc

SEQ ID NO: 173015 - DNA, 20 bp, human
gtaggggagttggtgcgacg

SEQ ID NO: 173016 - DNA, 20 bp, human
ggtatctggtgatgggtctg

SEQ ID NO: 173017 - DNA, 20 bp, human
ggacaatgattggagtcaag

SEQ ID NO: 173018 - DNA, 20 bp, human
gctgaggttgtaactttaac

SEQ ID NO: 173019 - DNA, 20 bp, human
gtctgtaggtatctggtgat

SEQ ID NO: 173020 - DNA, 20 bp, human
gtgatccacttcaagaaaca

SEQ ID NO: 173021 - DNA, 20 bp, human
gtgaagaacaagacaatgat

SEQ ID NO: 173022 - DNA, 20 bp, human
gttctcttcctggatatctc

SEQ ID NO: 173023 - DNA, 20 bp, human
ggacatcagatagctggcca

SEQ ID NO: 173024 - DNA, 20 bp, human
gtcataaacccgagatatcc

SEQ ID NO: 173025 - DNA, 20 bp, human
ggtgttggccatggcgtctc

SEQ ID NO: 173026 - DNA, 20 bp, human
gcgcctgggcaagcagcccg

SEQ ID NO: 173027 - DNA, 20 bp, human
gccaggctggaataaggccg

SEQ ID NO: 173028 - DNA, 20 bp, human
ggaataaggccggggcgcct

SEQ ID NO: 173029 - DNA, 20 bp, human
gaatggcgtacatccaggta

SEQ ID NO: 173030 - DNA, 20 bp, human
gaggctgggggcaaggtccg

SEQ ID NO: 173031 - DNA, 20 bp, human
ggactggcgtggctgatgag

SEQ ID NO: 173032 - DNA, 20 bp, human
gcgcgcgctcccagccggag

SEQ ID NO: 173033 - DNA, 20 bp, human
gccccaccgaggcgctcccc

SEQ ID NO: 173034 - DNA, 20 bp, human
gcaaggtccggggtgcgggt

SEQ ID NO: 173035 - DNA, 20 bp, human
ggcgaaaatggcgtacatcc

SEQ ID NO: 173036 - DNA, 20 bp, human
gcgcgggttgctgcagagag

SEQ ID NO: 173037 - DNA, 20 bp, human
gctcgactcagtagcaggaa

SEQ ID NO: 173038 - DNA, 20 bp, human
gtcagcaagtcttgcggcaa

SEQ ID NO: 173039 - DNA, 20 bp, human
gtcggggagtcggacccgag

SEQ ID NO: 173040 - DNA, 20 bp, human
gccggagagcgacccgaagg

SEQ ID NO: 173041 - DNA, 20 bp, human
gttagcagtctgcgccgagg

SEQ ID NO: 173042 - DNA, 20 bp, human
gtccatacccccgccggtgg

SEQ ID NO: 173043 - DNA, 20 bp, human
gaggaggcgggagagatccg

SEQ ID NO: 173044 - DNA, 20 bp, human
ggggtcccgagaggtgagta

SEQ ID NO: 173045 - DNA, 20 bp, human
ggaggagccggctcctctga

SEQ ID NO: 173046 - DNA, 20 bp, human
gaggagccgagccggcaccg

SEQ ID NO: 173047 - DNA, 20 bp, human
ggacctgcgacagtggcgag

SEQ ID NO: 173048 - DNA, 20 bp, human
ggggtcccaagacgcttcag

SEQ ID NO: 173049 - DNA, 20 bp, human
gagccgcggacctgcgacag

SEQ ID NO: 173050 - DNA, 20 bp, human
gcggcgctgcaggatctgct

SEQ ID NO: 173051 - DNA, 20 bp, human
gctgcagcccggaggcatta

SEQ ID NO: 173052 - DNA, 20 bp, human
ggcgctctctggccaccccg

SEQ ID NO: 173053 - DNA, 20 bp, human
gccccgcgctggggatcggt

SEQ ID NO: 173054 - DNA, 20 bp, human
gagggggtcccgaaacacct

SEQ ID NO: 173055 - DNA, 20 bp, human
gggggaggagcggactcacc

SEQ ID NO: 173056 - DNA, 20 bp, human
gggagagagataccaaggaa

SEQ ID NO: 173057 - DNA, 20 bp, human
gttcagggagagagatacca

SEQ ID NO: 173058 - DNA, 20 bp, human
ggccaaaacaggaaccgagg

SEQ ID NO: 173059 - DNA, 20 bp, human
gagagccaaaacaggaaccg

SEQ ID NO: 173060 - DNA, 20 bp, human
gaacaacagcgcagagccca

SEQ ID NO: 173061 - DNA, 20 bp, human
ggtggcaaatcactgtgcga

SEQ ID NO: 173062 - DNA, 20 bp, human
gccaccagccgggaagaatt

SEQ ID NO: 173063 - DNA, 20 bp, human
gaagccggcgcttgagatcc

SEQ ID NO: 173064 - DNA, 20 bp, human
ggtctccgagactccagacg

SEQ ID NO: 173065 - DNA, 20 bp, human
ggggcaccagctcctggaac

SEQ ID NO: 173066 - DNA, 20 bp, human
gggctggacgggacactccc

SEQ ID NO: 173067 - DNA, 20 bp, human
gacactcccgggagacgccg

SEQ ID NO: 173068 - DNA, 20 bp, human
gacctgctcggcggctggac

SEQ ID NO: 173069 - DNA, 20 bp, human
gagaggcagcgtggagaccg

SEQ ID NO: 173070 - DNA, 20 bp, human
gtagggatgcggatgcggat

SEQ ID NO: 173071 - DNA, 20 bp, human
ggcggagagacagggatctg

SEQ ID NO: 173072 - DNA, 20 bp, human
gagacagaggccaggcgata

SEQ ID NO: 173073 - DNA, 20 bp, human
ggatgcgtggagagaccaac

SEQ ID NO: 173074 - DNA, 20 bp, human
gtggggacgcgagacaggta

SEQ ID NO: 173075 - DNA, 20 bp, human
gctgcctcttgaccccacat

SEQ ID NO: 173076 - DNA, 20 bp, human
gcccaagggtgccccgtcct

SEQ ID NO: 173077 - DNA, 20 bp, human
gggtcgcgtcccctccatgg

SEQ ID NO: 173078 - DNA, 20 bp, human
gcaggacggatatccaggaa

SEQ ID NO: 173079 - DNA, 20 bp, human
gcagccaggagagacccgaa

SEQ ID NO: 173080 - DNA, 20 bp, human
gccagcccctcccccatgga

SEQ ID NO: 173081 - DNA, 20 bp, human
ggagaggcctggagataatg

SEQ ID NO: 173082 - DNA, 20 bp, human
gcggcgtctccggggagtcg

SEQ ID NO: 173083 - DNA, 20 bp, human
gcggggcgggagggagtact

SEQ ID NO: 173084 - DNA, 20 bp, human
gccgcagtagtaatacagga

SEQ ID NO: 173085 - DNA, 20 bp, human
gccccggaccctccagatat

SEQ ID NO: 173086 - DNA, 20 bp, human
gccgggggcgcgggatcgag

SEQ ID NO: 173087 - DNA, 20 bp, human
ggcggctcggcgctgttcgg

SEQ ID NO: 173088 - DNA, 20 bp, human
gtgtccgcccggagccgcac

SEQ ID NO: 173089 - DNA, 20 bp, human
gagccgcacgggctccccca

SEQ ID NO: 173090 - DNA, 20 bp, human
gcgcccggccccatgcccag

SEQ ID NO: 173091 - DNA, 20 bp, human
ggcgcgggatcgagcggcag

SEQ ID NO: 173092 - DNA, 20 bp, human
gacccctgggggagcccgtg

SEQ ID NO: 173093 - DNA, 20 bp, human
ggaggcggctcggcgctgtt

SEQ ID NO: 173094 - DNA, 20 bp, human
gcggggctgggatgacccct

SEQ ID NO: 173095 - DNA, 20 bp, human
gggcagtgtccagactgcgg

SEQ ID NO: 173096 - DNA, 20 bp, human
gggctgctgctagtcagatg

SEQ ID NO: 173097 - DNA, 20 bp, human
gccagggacaaggagtccgt

SEQ ID NO: 173098 - DNA, 20 bp, human
ggagccgctcctcaccaggt

SEQ ID NO: 173099 - DNA, 20 bp, human
ggcaaggaggcagcacgggg

SEQ ID NO: 173100 - DNA, 20 bp, human
gagaggggtctgcagggtca

SEQ ID NO: 173101 - DNA, 20 bp, human
gtgctagtcagatggggtag

SEQ ID NO: 173102 - DNA, 20 bp, human
gggaatcccacaactcacag

SEQ ID NO: 173103 - DNA, 20 bp, human
ggagcagggctggctgtcgg

SEQ ID NO: 173104 - DNA, 20 bp, human
gggcactgggagagactggt

SEQ ID NO: 173105 - DNA, 20 bp, human
gacaaggagtccgtgggtct

SEQ ID NO: 173106 - DNA, 20 bp, human
ggccgcctggagggacctaa

SEQ ID NO: 173107 - DNA, 20 bp, human
gagagctgcatgcaaccggt

SEQ ID NO: 173108 - DNA, 20 bp, human
gagccggcccggcctcccac

SEQ ID NO: 173109 - DNA, 20 bp, human
ggagagaaagcctgaccgac

SEQ ID NO: 173110 - DNA, 20 bp, human
gctgaggcagaacagcgacg

SEQ ID NO: 173111 - DNA, 20 bp, human
gtctgcctcaggccccggtg

SEQ ID NO: 173112 - DNA, 20 bp, human
gccagggacctgccgagaaa

SEQ ID NO: 173113 - DNA, 20 bp, human
ggcccttaggtccctccagg

SEQ ID NO: 173114 - DNA, 20 bp, human
ggctgcatgcaaccggtggg

SEQ ID NO: 173115 - DNA, 20 bp, human
gtccctccaggcggcggtgg

SEQ ID NO: 173116 - DNA, 20 bp, human
gaccgggagaagagccgtga

SEQ ID NO: 173117 - DNA, 20 bp, human
gcctgaaactcggctgccag

SEQ ID NO: 173118 - DNA, 20 bp, human
gtctcccggtccctgaaact

SEQ ID NO: 173119 - DNA, 20 bp, human
gacctgtaggggtccagtat

SEQ ID NO: 173120 - DNA, 20 bp, human
gtatgggaggacaccttcgc

SEQ ID NO: 173121 - DNA, 20 bp, human
gcccctctcctaccaaccag

SEQ ID NO: 173122 - DNA, 20 bp, human
ggagctggagccacctgcga

SEQ ID NO: 173123 - DNA, 20 bp, human
gtccctcacggctcttctcc

SEQ ID NO: 173124 - DNA, 20 bp, human
gtgtaggggtccagtatggg

SEQ ID NO: 173125 - DNA, 20 bp, human
gagtcagccttcttccctca

SEQ ID NO: 173126 - DNA, 20 bp, human
gcactgtggtacctgagcat

SEQ ID NO: 173127 - DNA, 20 bp, human
gtggtctggggagaactgtg

SEQ ID NO: 173128 - DNA, 20 bp, human
gagcctaggcctccaccgcc

SEQ ID NO: 173129 - DNA, 20 bp, human
ggggaccccagcctggtctg

SEQ ID NO: 173130 - DNA, 20 bp, human
gggaggaggttgcctcagac

SEQ ID NO: 173131 - DNA, 20 bp, human
gctgtgtggccagaacagag

SEQ ID NO: 173132 - DNA, 20 bp, human
gcacttggccttcctgtctg

SEQ ID NO: 173133 - DNA, 20 bp, human
gtgggctgctgcgctagcct

SEQ ID NO: 173134 - DNA, 20 bp, human
gtttctttccggagtcactg

SEQ ID NO: 173135 - DNA, 20 bp, human
ggcggcagttacctcaggag

SEQ ID NO: 173136 - DNA, 20 bp, human
ggcgtccgtcgggagagtga

SEQ ID NO: 173137 - DNA, 20 bp, human
ggaagctgggatgcccgggt

SEQ ID NO: 173138 - DNA, 20 bp, human
gcggcgcgttaccttccccc

SEQ ID NO: 173139 - DNA, 20 bp, human
gctctcccgacggacgctgg

SEQ ID NO: 173140 - DNA, 20 bp, human
gacagtgccgggcgacaccc

SEQ ID NO: 173141 - DNA, 20 bp, human
ggagtgggccaagtagagac

SEQ ID NO: 173142 - DNA, 20 bp, human
gcgtgccgccagcgtccgtc

SEQ ID NO: 173143 - DNA, 20 bp, human
gcgagccttcactctcccga

SEQ ID NO: 173144 - DNA, 20 bp, human
ggcagaaccctcgcctaccc

SEQ ID NO: 173145 - DNA, 20 bp, human
gcggcactgtcaacgcagag

SEQ ID NO: 173146 - DNA, 20 bp, human
gatgcgaaggtaggatgaga

SEQ ID NO: 173147 - DNA, 20 bp, human
gttctctgcagagccggctc

SEQ ID NO: 173148 - DNA, 20 bp, human
gttgaagcagatgcgaaggt

SEQ ID NO: 173149 - DNA, 20 bp, human
gagcctgtgcccgacaggaa

SEQ ID NO: 173150 - DNA, 20 bp, human
gtctcttgaagcagatgcga

SEQ ID NO: 173151 - DNA, 20 bp, human
gacctccaaacgagaaatta

SEQ ID NO: 173152 - DNA, 20 bp, human
gctaaaacgacctgctgcaa

SEQ ID NO: 173153 - DNA, 20 bp, human
ggcgtcagcctgtgcccgac

SEQ ID NO: 173154 - DNA, 20 bp, human
gtttatgacattgaaaaggt

SEQ ID NO: 173155 - DNA, 20 bp, human
gacactatccaaaagctata

SEQ ID NO: 173156 - DNA, 20 bp, human
gctcacgccctgcagatgag

SEQ ID NO: 173157 - DNA, 20 bp, human
gacgccctgcagatgagcgg

SEQ ID NO: 173158 - DNA, 20 bp, human
ggttgccagtgaaataggag

SEQ ID NO: 173159 - DNA, 20 bp, human
gctgagaagggtcctaacga

SEQ ID NO: 173160 - DNA, 20 bp, human
gacgaagcccagcagcaggt

SEQ ID NO: 173161 - DNA, 20 bp, human
gaacgtagaggacgctcagg

SEQ ID NO: 173162 - DNA, 20 bp, human
gcagcaaacttaccgcccaa

SEQ ID NO: 173163 - DNA, 20 bp, human
gctaaacgtagaggacgctc

SEQ ID NO: 173164 - DNA, 20 bp, human
gcaggcggttcaaaacacag

SEQ ID NO: 173165 - DNA, 20 bp, human
ggctccctctcctatttcac

SEQ ID NO: 173166 - DNA, 20 bp, human
ggaagatcgcaacccagctc

SEQ ID NO: 173167 - DNA, 20 bp, human
gcctcccgggagggtgagaa

SEQ ID NO: 173168 - DNA, 20 bp, human
gccgggagggtgagaagggc

SEQ ID NO: 173169 - DNA, 20 bp, human
ggtcccagtgccggtttcaa

SEQ ID NO: 173170 - DNA, 20 bp, human
ggccagtcagccacaggtaa

SEQ ID NO: 173171 - DNA, 20 bp, human
gggggagccgaagaggagag

SEQ ID NO: 173172 - DNA, 20 bp, human
gcccgcgaggggagccgaag

SEQ ID NO: 173173 - DNA, 20 bp, human
gggagaccctcccttgaaac

SEQ ID NO: 173174 - DNA, 20 bp, human
gattagtgctgggtgggtca

SEQ ID NO: 173175 - DNA, 20 bp, human
ggtaggtccgaagagagtgc

SEQ ID NO: 173176 - DNA, 20 bp, human
gtgctccaagtagttcacaa

SEQ ID NO: 173177 - DNA, 20 bp, human
gtagattgtgggaatatgag

SEQ ID NO: 173178 - DNA, 20 bp, human
ggtgagaggtttatatagag

SEQ ID NO: 173179 - DNA, 20 bp, human
gctgaagagtgagtgcctcc

SEQ ID NO: 173180 - DNA, 20 bp, human
gaaggttagaatgtttttat

SEQ ID NO: 173181 - DNA, 20 bp, human
gtagtcttaccttaatctga

SEQ ID NO: 173182 - DNA, 20 bp, human
gttgacccttgtgaactact

SEQ ID NO: 173183 - DNA, 20 bp, human
gtgttatatagagatgtgag

SEQ ID NO: 173184 - DNA, 20 bp, human
gaatgcatatttgttcctgg

SEQ ID NO: 173185 - DNA, 20 bp, human
gcacacaaactgtagaatgc

SEQ ID NO: 173186 - DNA, 20 bp, human
gcaccggcgtctgaggtctc

SEQ ID NO: 173187 - DNA, 20 bp, human
ggttgcgggcgtcgcaggca

SEQ ID NO: 173188 - DNA, 20 bp, human
gggagtgttgttaaccggag

SEQ ID NO: 173189 - DNA, 20 bp, human
ggtgacagctgtgttagggt

SEQ ID NO: 173190 - DNA, 20 bp, human
ggcagtcgcgcggattgagc

SEQ ID NO: 173191 - DNA, 20 bp, human
ggccggtgacagctgtgtta

SEQ ID NO: 173192 - DNA, 20 bp, human
gccgactccggagacctcaa

SEQ ID NO: 173193 - DNA, 20 bp, human
gccgaagttccggttcgcag

SEQ ID NO: 173194 - DNA, 20 bp, human
ggcgactgcggctgcccctc

SEQ ID NO: 173195 - DNA, 20 bp, human
gagagcagcagcgggacggg

SEQ ID NO: 173196 - DNA, 20 bp, human
ggcttcaaagcgcaggcgcg

SEQ ID NO: 173197 - DNA, 20 bp, human
ggaggcgcgcttcaaagcgc

SEQ ID NO: 173198 - DNA, 20 bp, human
gtcatcggaaagagtcacag

SEQ ID NO: 173199 - DNA, 20 bp, human
ggggcttgcgcggaccaagg

SEQ ID NO: 173200 - DNA, 20 bp, human
gctcgggccacaaggctcat

SEQ ID NO: 173201 - DNA, 20 bp, human
gcgggacggacacaccatgt

SEQ ID NO: 173202 - DNA, 20 bp, human
gagggaggcgcaccaggcaa

SEQ ID NO: 173203 - DNA, 20 bp, human
gggcagacagcggggtaagg

SEQ ID NO: 173204 - DNA, 20 bp, human
gtgacgcgcgcgttagtggg

SEQ ID NO: 173205 - DNA, 20 bp, human
ggcccggccctgccatggga

SEQ ID NO: 173206 - DNA, 20 bp, human
ggccgaggtagcgaggtcag

SEQ ID NO: 173207 - DNA, 20 bp, human
ggcagtttcaatgggcaaca

SEQ ID NO: 173208 - DNA, 20 bp, human
gagcccggaaggcccgacta

SEQ ID NO: 173209 - DNA, 20 bp, human
ggcaggaaccggaagttggt

SEQ ID NO: 173210 - DNA, 20 bp, human
gcccagcaggaaccggaagt

SEQ ID NO: 173211 - DNA, 20 bp, human
gtgggccccgagatccgagg

SEQ ID NO: 173212 - DNA, 20 bp, human
gacccctgacctcgctacct

SEQ ID NO: 173213 - DNA, 20 bp, human
ggcgccggcccgggccagtg

SEQ ID NO: 173214 - DNA, 20 bp, human
gccacccccagacctagagg

SEQ ID NO: 173215 - DNA, 20 bp, human
gccgcaggggtaccatagtc

SEQ ID NO: 173216 - DNA, 20 bp, human
gggaccccgcgcgggaatca

SEQ ID NO: 173217 - DNA, 20 bp, human
gtggagagttgaggcatcgg

SEQ ID NO: 173218 - DNA, 20 bp, human
ggaaggtccgcgcgcagaga

SEQ ID NO: 173219 - DNA, 20 bp, human
ggagaacagcactactactg

SEQ ID NO: 173220 - DNA, 20 bp, human
gccggcgtcgggtgtccccg

SEQ ID NO: 173221 - DNA, 20 bp, human
gggaggacacttctcagaag

SEQ ID NO: 173222 - DNA, 20 bp, human
ggaactgcgcgtgggcctgg

SEQ ID NO: 173223 - DNA, 20 bp, human
gcccaaggctctactagtgt

SEQ ID NO: 173224 - DNA, 20 bp, human
gagggcggcggccaagagca

SEQ ID NO: 173225 - DNA, 20 bp, human
gggctctcaccatctggaaa

SEQ ID NO: 173226 - DNA, 20 bp, human
gtaaactgtacagggaagca

SEQ ID NO: 173227 - DNA, 20 bp, human
gttctggagctaaacttcaa

SEQ ID NO: 173228 - DNA, 20 bp, human
gcagatctcaccatactgta

SEQ ID NO: 173229 - DNA, 20 bp, human
gcccagaagaaagtccacag

SEQ ID NO: 173230 - DNA, 20 bp, human
gatcagattgccaacgagtg

SEQ ID NO: 173231 - DNA, 20 bp, human
gacagcatagtagcggtcaa

SEQ ID NO: 173232 - DNA, 20 bp, human
gaaaagggcatcattcctga

SEQ ID NO: 173233 - DNA, 20 bp, human
ggagcaccattaaactgtac

SEQ ID NO: 173234 - DNA, 20 bp, human
gctggtcatgccttacagta

SEQ ID NO: 173235 - DNA, 20 bp, human
gtaattctgaccacactcgt

SEQ ID NO: 173236 - DNA, 20 bp, human
gaggtccccccataactcaa

SEQ ID NO: 173237 - DNA, 20 bp, human
gtggccgtaggcagagccaa

SEQ ID NO: 173238 - DNA, 20 bp, human
gcacacatggatgggacctc

SEQ ID NO: 173239 - DNA, 20 bp, human
gacgcccaagcagtggccgt

SEQ ID NO: 173240 - DNA, 20 bp, human
gctggtcattagaagaaact

SEQ ID NO: 173241 - DNA, 20 bp, human
gtgagcccttgagttatggg

SEQ ID NO: 173242 - DNA, 20 bp, human
gatctcaaccacacatggat

SEQ ID NO: 173243 - DNA, 20 bp, human
gtgctctgtgtgatctccgt

SEQ ID NO: 173244 - DNA, 20 bp, human
ggctctgatgagacagccat

SEQ ID NO: 173245 - DNA, 20 bp, human
gtgtagatgaaatataaccc

SEQ ID NO: 173246 - DNA, 20 bp, human
ggtggccagttctcagacag

SEQ ID NO: 173247 - DNA, 20 bp, human
gggggtcacagatggcacag

SEQ ID NO: 173248 - DNA, 20 bp, human
gggtgctgaagagcaccctg

SEQ ID NO: 173249 - DNA, 20 bp, human
ggtcacagatggcacagtgg

SEQ ID NO: 173250 - DNA, 20 bp, human
gaactggccaccttctccac

SEQ ID NO: 173251 - DNA, 20 bp, human
gcagaagagggtgtccaggt

SEQ ID NO: 173252 - DNA, 20 bp, human
gtgagagctgtcttcatcca

SEQ ID NO: 173253 - DNA, 20 bp, human
ggagagcagcaggaagttgg

SEQ ID NO: 173254 - DNA, 20 bp, human
gatggcacagtggcggtcaa

SEQ ID NO: 173255 - DNA, 20 bp, human
ggtccaggtaggtgtgcagg

SEQ ID NO: 173256 - DNA, 20 bp, human
gccgggatcccggcgagaag

SEQ ID NO: 173257 - DNA, 20 bp, human
gcagatacggtgaacttggt

SEQ ID NO: 173258 - DNA, 20 bp, human
gtcctgcccctcatgtacag

SEQ ID NO: 173259 - DNA, 20 bp, human
gtgtgctacgcgaacgtgaa

SEQ ID NO: 173260 - DNA, 20 bp, human
gagcaattcatccctgctgg

SEQ ID NO: 173261 - DNA, 20 bp, human
gcaaattcctgacacagata

SEQ ID NO: 173262 - DNA, 20 bp, human
ggagaaggggattttcacac

SEQ ID NO: 173263 - DNA, 20 bp, human
gtgccacatcacagcaggtg

SEQ ID NO: 173264 - DNA, 20 bp, human
ggtgcagctgcttgaaatgg

SEQ ID NO: 173265 - DNA, 20 bp, human
gaccgctgtacatgaggggc

SEQ ID NO: 173266 - DNA, 20 bp, human
gcccgggacccaggagaata

SEQ ID NO: 173267 - DNA, 20 bp, human
gtacgtgagaggcagaatcc

SEQ ID NO: 173268 - DNA, 20 bp, human
gcaaagctgcacaacaggtt

SEQ ID NO: 173269 - DNA, 20 bp, human
gcatagcaaagctgcacaac

SEQ ID NO: 173270 - DNA, 20 bp, human
gtttgctatgaggatgtgaa

SEQ ID NO: 173271 - DNA, 20 bp, human
ggccgtgtacagaattaccc

SEQ ID NO: 173272 - DNA, 20 bp, human
ggcagatgaagcacaagtgg

SEQ ID NO: 173273 - DNA, 20 bp, human
gcaaattcccgacacagaca

SEQ ID NO: 173274 - DNA, 20 bp, human
gtcccgggtaattctgtaca

SEQ ID NO: 173275 - DNA, 20 bp, human
ggatgcagatgaagcacaag

SEQ ID NO: 173276 - DNA, 20 bp, human
gcggcgtagaggatagatcg

SEQ ID NO: 173277 - DNA, 20 bp, human
gatcgaggacctggcgagta

SEQ ID NO: 173278 - DNA, 20 bp, human
gagaggatagatcgaggacc

SEQ ID NO: 173279 - DNA, 20 bp, human
gacttggttggataggtcag

SEQ ID NO: 173280 - DNA, 20 bp, human
gcagacctcactgtgctgaa

SEQ ID NO: 173281 - DNA, 20 bp, human
gcagcacagccccaaaacca

SEQ ID NO: 173282 - DNA, 20 bp, human
ggatgcccttcagcacagtg

SEQ ID NO: 173283 - DNA, 20 bp, human
gacagtaaacttggttggat

SEQ ID NO: 173284 - DNA, 20 bp, human
gggatgtgtcaaaacatgta

SEQ ID NO: 173285 - DNA, 20 bp, human
gaacaatttctcccaagctg

SEQ ID NO: 173286 - DNA, 20 bp, human
gcctggcctcgggaacgagg

SEQ ID NO: 173287 - DNA, 20 bp, human
ggagcttgctgcagagtgtg

SEQ ID NO: 173288 - DNA, 20 bp, human
gctccaagatggcggcgcag

SEQ ID NO: 173289 - DNA, 20 bp, human
gtgcagtaagcggtacactg

SEQ ID NO: 173290 - DNA, 20 bp, human
gcatcttggaggaacccctg

SEQ ID NO: 173291 - DNA, 20 bp, human
gacgccggggatgcagtaag

SEQ ID NO: 173292 - DNA, 20 bp, human
ggagccagaagggaacacgg

SEQ ID NO: 173293 - DNA, 20 bp, human
gcaccccaccacggagaggg

SEQ ID NO: 173294 - DNA, 20 bp, human
gggaggcgggcgctcccgca

SEQ ID NO: 173295 - DNA, 20 bp, human
gtccccgcagagcagcgagt

SEQ ID NO: 173296 - DNA, 20 bp, human
gctaggagagccccgggtgg

SEQ ID NO: 173297 - DNA, 20 bp, human
gactcaggggcgggggtttt

SEQ ID NO: 173298 - DNA, 20 bp, human
gccgcacgggcctcgcgagg

SEQ ID NO: 173299 - DNA, 20 bp, human
gccctgccgggtggaaccgg

SEQ ID NO: 173300 - DNA, 20 bp, human
ggagccccttccagacggag

SEQ ID NO: 173301 - DNA, 20 bp, human
ggagccggagctgaggattg

SEQ ID NO: 173302 - DNA, 20 bp, human
gtgcagcagatcaaaaacga

SEQ ID NO: 173303 - DNA, 20 bp, human
gagaagcgaacgccccgcac

SEQ ID NO: 173304 - DNA, 20 bp, human
gggctgggtcgccccgccgg

SEQ ID NO: 173305 - DNA, 20 bp, human
gatcaaaaacgacggctggg

SEQ ID NO: 173306 - DNA, 20 bp, human
gctgcacggcgcgtaccctg

SEQ ID NO: 173307 - DNA, 20 bp, human
gcctagggtccggcgaggaa

SEQ ID NO: 173308 - DNA, 20 bp, human
ggcttaaagccggtccacag

SEQ ID NO: 173309 - DNA, 20 bp, human
gaccctgtgcctgagacggt

SEQ ID NO: 173310 - DNA, 20 bp, human
gcttggtcccccaaacggag

SEQ ID NO: 173311 - DNA, 20 bp, human
gttccccgcccgaaccccca

SEQ ID NO: 173312 - DNA, 20 bp, human
gctccgcaatgcctagggtc

SEQ ID NO: 173313 - DNA, 20 bp, human
gagagtgagcctctgtggac

SEQ ID NO: 173314 - DNA, 20 bp, human
gccggaccccccgcgggagt

SEQ ID NO: 173315 - DNA, 20 bp, human
ggcccgagcagggacgtcgg

SEQ ID NO: 173316 - DNA, 20 bp, human
ggcggcagctaccgagagtg

SEQ ID NO: 173317 - DNA, 20 bp, human
ggctcggacctccttcccgg

SEQ ID NO: 173318 - DNA, 20 bp, human
ggctgcggcgagggacagtg

SEQ ID NO: 173319 - DNA, 20 bp, human
ggctggtcgctccgcactct

SEQ ID NO: 173320 - DNA, 20 bp, human
gcgcgctcggacctccttcc

SEQ ID NO: 173321 - DNA, 20 bp, human
gacgcaagcgaaaggagagg

SEQ ID NO: 173322 - DNA, 20 bp, human
gtcttggttcatccgttgtg

SEQ ID NO: 173323 - DNA, 20 bp, human
gtcggtagctgccgccggga

SEQ ID NO: 173324 - DNA, 20 bp, human
gagtctcacctgtaccggtt

SEQ ID NO: 173325 - DNA, 20 bp, human
gctgcgacggacagtcccgc

SEQ ID NO: 173326 - DNA, 20 bp, human
gtcccctgctcccctatcag

SEQ ID NO: 173327 - DNA, 20 bp, human
gagatggcagcctctgatag

SEQ ID NO: 173328 - DNA, 20 bp, human
gacaggagccagcgtcagga

SEQ ID NO: 173329 - DNA, 20 bp, human
gcggcagcaccagtgtgtga

SEQ ID NO: 173330 - DNA, 20 bp, human
ggagtggaggggatctagga

SEQ ID NO: 173331 - DNA, 20 bp, human
gtgcaaagagagaaaccgag

SEQ ID NO: 173332 - DNA, 20 bp, human
gtctctctttgcaggagcac

SEQ ID NO: 173333 - DNA, 20 bp, human
gacagagctgctccacaggt

SEQ ID NO: 173334 - DNA, 20 bp, human
ggcagggaaactaagcccaa

SEQ ID NO: 173335 - DNA, 20 bp, human
gggaccagagctggcaccag

SEQ ID NO: 173336 - DNA, 20 bp, human
ggctccttgagtgtagatag

SEQ ID NO: 173337 - DNA, 20 bp, human
gggaaggaccagaaaacagg

SEQ ID NO: 173338 - DNA, 20 bp, human
ggatcagttaagctgaagga

SEQ ID NO: 173339 - DNA, 20 bp, human
ggagctgtccgtgtgcactg

SEQ ID NO: 173340 - DNA, 20 bp, human
ggggataatcggcagtgcag

SEQ ID NO: 173341 - DNA, 20 bp, human
ggacgagggcaggggataat

SEQ ID NO: 173342 - DNA, 20 bp, human
gtggggatcagttaagctga

SEQ ID NO: 173343 - DNA, 20 bp, human
ggattcaaggctatgagccc

SEQ ID NO: 173344 - DNA, 20 bp, human
ggttgtctgactctctacca

SEQ ID NO: 173345 - DNA, 20 bp, human
gatagccttgaatctaccca

SEQ ID NO: 173346 - DNA, 20 bp, human
gcttcccggctagtggagcc

SEQ ID NO: 173347 - DNA, 20 bp, human
gcccgagggcgaccccgagg

SEQ ID NO: 173348 - DNA, 20 bp, human
gccccgtgcagtgggcgaaa

SEQ ID NO: 173349 - DNA, 20 bp, human
gcgggaagacgcccgtcctg

SEQ ID NO: 173350 - DNA, 20 bp, human
ggggcccgagggcgaccccg

SEQ ID NO: 173351 - DNA, 20 bp, human
ggcagtgggcgaaatggacg

SEQ ID NO: 173352 - DNA, 20 bp, human
gggggccgccggcgaggacg

SEQ ID NO: 173353 - DNA, 20 bp, human
gcagcaagcgtttccagcag

SEQ ID NO: 173354 - DNA, 20 bp, human
gcagcagaggtctagcagcc

SEQ ID NO: 173355 - DNA, 20 bp, human
gggacgtggtctgcggtacg

SEQ ID NO: 173356 - DNA, 20 bp, human
ggttgcacaggcattaggaa

SEQ ID NO: 173357 - DNA, 20 bp, human
gggccgccccgagtctcccg

SEQ ID NO: 173358 - DNA, 20 bp, human
gagcgccggtgtggtccgaa

SEQ ID NO: 173359 - DNA, 20 bp, human
gggcgacactaacaaagccc

SEQ ID NO: 173360 - DNA, 20 bp, human
ggccagggcacagcgaggat

SEQ ID NO: 173361 - DNA, 20 bp, human
gctcctccccgggagactcg

SEQ ID NO: 173362 - DNA, 20 bp, human
ggccggcgcgcgcccgagtg

SEQ ID NO: 173363 - DNA, 20 bp, human
ggccagcgacctgaacctgg

SEQ ID NO: 173364 - DNA, 20 bp, human
gctctgcacccccggcacag

SEQ ID NO: 173365 - DNA, 20 bp, human
ggcgtgcgcggctctgcccg

SEQ ID NO: 173366 - DNA, 20 bp, human
gcagctgcgggcatccgtgg

SEQ ID NO: 173367 - DNA, 20 bp, human
ggggagctggggccctagaa

SEQ ID NO: 173368 - DNA, 20 bp, human
gagcgccggtgtggtccgaa

SEQ ID NO: 173369 - DNA, 20 bp, human
ggccagggcacagcgaggat

SEQ ID NO: 173370 - DNA, 20 bp, human
ggttgcacaggcattaggaa

SEQ ID NO: 173371 - DNA, 20 bp, human
ggccagcgacctgaacctgg

SEQ ID NO: 173372 - DNA, 20 bp, human
ggctcttctcttaaaccccc

SEQ ID NO: 173373 - DNA, 20 bp, human
gcggtcccggcgaggcggga

SEQ ID NO: 173374 - DNA, 20 bp, human
ggccggcgcgcgcccgagtg

SEQ ID NO: 173375 - DNA, 20 bp, human
gggccgccccgagtctcccg

SEQ ID NO: 173376 - DNA, 20 bp, human
ggtccgcgtctgctccacgc

SEQ ID NO: 173377 - DNA, 20 bp, human
ggcgcgccggcggccatcaa

SEQ ID NO: 173378 - DNA, 20 bp, human
gagggctagaagcgcgacgg

SEQ ID NO: 173379 - DNA, 20 bp, human
ggccgcgcgaaggcaaccgt

SEQ ID NO: 173380 - DNA, 20 bp, human
gtcaagggctagaagcgcga

SEQ ID NO: 173381 - DNA, 20 bp, human
gagagctgggccaagaccga

SEQ ID NO: 173382 - DNA, 20 bp, human
gaggagagcaaagcacctcg

SEQ ID NO: 173383 - DNA, 20 bp, human
ggctgggccaagaccgacgg

SEQ ID NO: 173384 - DNA, 20 bp, human
gcccaggacggaggccggaa

SEQ ID NO: 173385 - DNA, 20 bp, human
gaggtgggcgaccgagagac

SEQ ID NO: 173386 - DNA, 20 bp, human
gtagctttggccaggttctt

SEQ ID NO: 173387 - DNA, 20 bp, human
gggccagccacacactgtac

SEQ ID NO: 173388 - DNA, 20 bp, human
gaacctggccaaagctatga

SEQ ID NO: 173389 - DNA, 20 bp, human
ggtgtgacctgtacagtgtg

SEQ ID NO: 173390 - DNA, 20 bp, human
ggcgtctgtggatcccgcag

SEQ ID NO: 173391 - DNA, 20 bp, human
gaccaagaaagcaggcccta

SEQ ID NO: 173392 - DNA, 20 bp, human
gcaagaaccatcggacagag

SEQ ID NO: 173393 - DNA, 20 bp, human
gaatgtgccacccaagaacc

SEQ ID NO: 173394 - DNA, 20 bp, human
gcacctgttgcggagtgagg

SEQ ID NO: 173395 - DNA, 20 bp, human
gagcaggccctagggcaacc

SEQ ID NO: 173396 - DNA, 20 bp, human
gaccccgcggccgcctgtgc

SEQ ID NO: 173397 - DNA, 20 bp, human
ggcagcggccctgcttaggc

SEQ ID NO: 173398 - DNA, 20 bp, human
ggtgccgcggggacagtgta

SEQ ID NO: 173399 - DNA, 20 bp, human
gccggtcacctgagatccaa

SEQ ID NO: 173400 - DNA, 20 bp, human
ggaggctgcgggcactgaga

SEQ ID NO: 173401 - DNA, 20 bp, human
gaaaggcttgggcccgcccg

SEQ ID NO: 173402 - DNA, 20 bp, human
gcagtgctgggtgaccgtca

SEQ ID NO: 173403 - DNA, 20 bp, human
gcaacaagtggtccaaagtc

SEQ ID NO: 173404 - DNA, 20 bp, human
gtgaccctacactgtccccg

SEQ ID NO: 173405 - DNA, 20 bp, human
gtgcagcgtcctgcccggag

SEQ ID NO: 173406 - DNA, 20 bp, human
ggtgcccgcgaaactgcagg

SEQ ID NO: 173407 - DNA, 20 bp, human
gcccggctcgcagactccca

SEQ ID NO: 173408 - DNA, 20 bp, human
gagggtggaaggctttttct

SEQ ID NO: 173409 - DNA, 20 bp, human
ggaggtgcccgcgaaactgc

SEQ ID NO: 173410 - DNA, 20 bp, human
gcttctaaagccagacagga

SEQ ID NO: 173411 - DNA, 20 bp, human
gttcctagaactgtgaccgg

SEQ ID NO: 173412 - DNA, 20 bp, human
gccgccgcctgcagtttcgc

SEQ ID NO: 173413 - DNA, 20 bp, human
gaggaattcagagccaccgc

SEQ ID NO: 173414 - DNA, 20 bp, human
gagccttccaccctcctgtc

SEQ ID NO: 173415 - DNA, 20 bp, human
gagagccaccgcgggcaggc

SEQ ID NO: 173416 - DNA, 20 bp, human
gtagcctgtgtgccaggaga

SEQ ID NO: 173417 - DNA, 20 bp, human
gccaccctgggcgcctccca

SEQ ID NO: 173418 - DNA, 20 bp, human
gaagccgtctcctggcacac

SEQ ID NO: 173419 - DNA, 20 bp, human
gttgcagggaagccgtctcc

SEQ ID NO: 173420 - DNA, 20 bp, human
ggagggcgatcaccacgagg

SEQ ID NO: 173421 - DNA, 20 bp, human
gtgggcgcctcccagggact

SEQ ID NO: 173422 - DNA, 20 bp, human
gcgggggcgaggcctcatgg

SEQ ID NO: 173423 - DNA, 20 bp, human
ggtgaggccgatgacgctgt

SEQ ID NO: 173424 - DNA, 20 bp, human
gagacggcttccctgcaaaa

SEQ ID NO: 173425 - DNA, 20 bp, human
ggtccggccccgcccccatg

SEQ ID NO: 173426 - DNA, 20 bp, human
gggcagggaagctgcagcga

SEQ ID NO: 173427 - DNA, 20 bp, human
ggcttccctgccgttctctg

SEQ ID NO: 173428 - DNA, 20 bp, human
gggaccagcccaggtcactc

SEQ ID NO: 173429 - DNA, 20 bp, human
ggaggagcagatgccaagcg

SEQ ID NO: 173430 - DNA, 20 bp, human
gtttgcctgagacctaggag

SEQ ID NO: 173431 - DNA, 20 bp, human
gtggcacatcaggagagcct

SEQ ID NO: 173432 - DNA, 20 bp, human
gagaagtctggccggaagga

SEQ ID NO: 173433 - DNA, 20 bp, human
gcggcttgcagcccaaagcc

SEQ ID NO: 173434 - DNA, 20 bp, human
gtctggagtccacaggtcaa

SEQ ID NO: 173435 - DNA, 20 bp, human
gagatcagaggaatgcacag

SEQ ID NO: 173436 - DNA, 20 bp, human
gcacgggggcagttgagact

SEQ ID NO: 173437 - DNA, 20 bp, human
gcggcaccaaagtgaccagg

SEQ ID NO: 173438 - DNA, 20 bp, human
gggcagtcccagcgcggaag

SEQ ID NO: 173439 - DNA, 20 bp, human
gcagaaacctggatagacgg

SEQ ID NO: 173440 - DNA, 20 bp, human
ggacggctgcacgaactggt

SEQ ID NO: 173441 - DNA, 20 bp, human
ggctgccggggcggccacgg

SEQ ID NO: 173442 - DNA, 20 bp, human
ggggggcagttgagactggg

SEQ ID NO: 173443 - DNA, 20 bp, human
gtgcaactgctggaccaagc

SEQ ID NO: 173444 - DNA, 20 bp, human
gctgcacgaactggttggtg

SEQ ID NO: 173445 - DNA, 20 bp, human
gagcgaggcggtcaggttca

SEQ ID NO: 173446 - DNA, 20 bp, human
gggggccccgagccatggtg

SEQ ID NO: 173447 - DNA, 20 bp, human
ggtcgcagtcggggtcgtag

SEQ ID NO: 173448 - DNA, 20 bp, human
ggaggcgcggggactcgtcg

SEQ ID NO: 173449 - DNA, 20 bp, human
gcgccagtgcaaccagacgt

SEQ ID NO: 173450 - DNA, 20 bp, human
gccgcgataggatcagaaca

SEQ ID NO: 173451 - DNA, 20 bp, human
gacgcgctcgtggacaacga

SEQ ID NO: 173452 - DNA, 20 bp, human
ggctggtgcgtgaactcggt

SEQ ID NO: 173453 - DNA, 20 bp, human
ggcaccagcacaccgacgtc

SEQ ID NO: 173454 - DNA, 20 bp, human
ggaccccgagggccgcttca

SEQ ID NO: 173455 - DNA, 20 bp, human
ggcactggcgcgccttgaag

SEQ ID NO: 173456 - DNA, 20 bp, human
gggcgacgcgggcgtctccg

SEQ ID NO: 173457 - DNA, 20 bp, human
gcttccgccgagttggtttt

SEQ ID NO: 173458 - DNA, 20 bp, human
gggatgcgggaggctgactt

SEQ ID NO: 173459 - DNA, 20 bp, human
gggccgggcggtctgcggtc

SEQ ID NO: 173460 - DNA, 20 bp, human
ggcggtcgggctgagacacg

SEQ ID NO: 173461 - DNA, 20 bp, human
gccctctggctggacgcgta

SEQ ID NO: 173462 - DNA, 20 bp, human
gctgggcgcccgggagacat

SEQ ID NO: 173463 - DNA, 20 bp, human
ggcttctcccgccccaccca

SEQ ID NO: 173464 - DNA, 20 bp, human
gctgtgcagcctggagtccg

SEQ ID NO: 173465 - DNA, 20 bp, human
gaggaggcccggtctctcca

SEQ ID NO: 173466 - DNA, 20 bp, human
gaatgggcaacgctggtcag

SEQ ID NO: 173467 - DNA, 20 bp, human
gctgcgcctcagctctaaca

SEQ ID NO: 173468 - DNA, 20 bp, human
gctagcaggccccccaaagt

SEQ ID NO: 173469 - DNA, 20 bp, human
ggcgcgcacgcaaagcccgg

SEQ ID NO: 173470 - DNA, 20 bp, human
gagggggtctcggcgaggtg

SEQ ID NO: 173471 - DNA, 20 bp, human
gcggaggcgcgcgcgaccgg

SEQ ID NO: 173472 - DNA, 20 bp, human
gaccgccctcccccacagag

SEQ ID NO: 173473 - DNA, 20 bp, human
gctctttggcgcggattagg

SEQ ID NO: 173474 - DNA, 20 bp, human
gttaccgggagaaggaagtg

SEQ ID NO: 173475 - DNA, 20 bp, human
gggtagagctacgcgctcca

SEQ ID NO: 173476 - DNA, 20 bp, human
gacggcgcctgcgtactgag

SEQ ID NO: 173477 - DNA, 20 bp, human
ggccggccgagaagcactcg

SEQ ID NO: 173478 - DNA, 20 bp, human
gcagctggtagccgtggtag

SEQ ID NO: 173479 - DNA, 20 bp, human
ggcgcgcccgattacaggag

SEQ ID NO: 173480 - DNA, 20 bp, human
ggtccaccagctggtagccg

SEQ ID NO: 173481 - DNA, 20 bp, human
gtgcgtactgaggggggacg

SEQ ID NO: 173482 - DNA, 20 bp, human
gtggacgccatcgagcagtt

SEQ ID NO: 173483 - DNA, 20 bp, human
gtcccggctagggcactgga

SEQ ID NO: 173484 - DNA, 20 bp, human
gctggtagccgtggtagcgg

SEQ ID NO: 173485 - DNA, 20 bp, human
gccgaagccgaactgctcga

SEQ ID NO: 173486 - DNA, 20 bp, human
gcccgcccatagccagttcc

SEQ ID NO: 173487 - DNA, 20 bp, human
gaaggatgggggtacagaac

SEQ ID NO: 173488 - DNA, 20 bp, human
gtcctcgctgcggcctccta

SEQ ID NO: 173489 - DNA, 20 bp, human
gagcgccaggagctgcgggt

SEQ ID NO: 173490 - DNA, 20 bp, human
gcccatagccagttccgggg

SEQ ID NO: 173491 - DNA, 20 bp, human
gcagaaccggaagaaacgaa

SEQ ID NO: 173492 - DNA, 20 bp, human
gagggtgtccctagagaacg

SEQ ID NO: 173493 - DNA, 20 bp, human
gactgaactgggctcttgac

SEQ ID NO: 173494 - DNA, 20 bp, human
gggcggttgctcacatcgac

SEQ ID NO: 173495 - DNA, 20 bp, human
gacctccctgggatgttctg

SEQ ID NO: 173496 - DNA, 20 bp, human
ggcgacgaagattccgctgg

SEQ ID NO: 173497 - DNA, 20 bp, human
gccaggggcgcagggaatag

SEQ ID NO: 173498 - DNA, 20 bp, human
ggctctgccgaccagacagt

SEQ ID NO: 173499 - DNA, 20 bp, human
gatgtgtcctactgtctggt

SEQ ID NO: 173500 - DNA, 20 bp, human
gctccaagcaggttacgggt

SEQ ID NO: 173501 - DNA, 20 bp, human
ggcagccgggtcccatagac

SEQ ID NO: 173502 - DNA, 20 bp, human
gcagggcagcgatgtcagag

SEQ ID NO: 173503 - DNA, 20 bp, human
gggtgggaagccatctcagt

SEQ ID NO: 173504 - DNA, 20 bp, human
gtgctcaggcagcgagaaca

SEQ ID NO: 173505 - DNA, 20 bp, human
ggaaaatgggccgcctccag

SEQ ID NO: 173506 - DNA, 20 bp, human
gccggcccgatgagctgcag

SEQ ID NO: 173507 - DNA, 20 bp, human
gggagccgctgcagctcatc

SEQ ID NO: 173508 - DNA, 20 bp, human
gtagatatggccccctccgg

SEQ ID NO: 173509 - DNA, 20 bp, human
gctcatcgggccggtgggag

SEQ ID NO: 173510 - DNA, 20 bp, human
gaaggcgtgctggacaccac

SEQ ID NO: 173511 - DNA, 20 bp, human
gtactgccgagcgcggccaa

SEQ ID NO: 173512 - DNA, 20 bp, human
ggagggggccatatctaacg

SEQ ID NO: 173513 - DNA, 20 bp, human
gtgagggccgggacgggtga

SEQ ID NO: 173514 - DNA, 20 bp, human
gccagcaaaatgagacacag

SEQ ID NO: 173515 - DNA, 20 bp, human
gccgccgacaccggagctgg

SEQ ID NO: 173516 - DNA, 20 bp, human
ggagatcgcggagatgcctg

SEQ ID NO: 173517 - DNA, 20 bp, human
gacgacaggaagtaagatcc

SEQ ID NO: 173518 - DNA, 20 bp, human
gtggaggggagaggagatcg

SEQ ID NO: 173519 - DNA, 20 bp, human
gcatcacggataggattgga

SEQ ID NO: 173520 - DNA, 20 bp, human
gggcatcgtccatcacggat

SEQ ID NO: 173521 - DNA, 20 bp, human
gcgtccatcacggataggat

SEQ ID NO: 173522 - DNA, 20 bp, human
gtcgtgggcatcgtccatca

SEQ ID NO: 173523 - DNA, 20 bp, human
gagtgctggttcggttccag

SEQ ID NO: 173524 - DNA, 20 bp, human
gcgacaaaggtggagagaca

SEQ ID NO: 173525 - DNA, 20 bp, human
ggacaccgatggaatcccag

SEQ ID NO: 173526 - DNA, 20 bp, human
gtgagacgaacgcttcactg

SEQ ID NO: 173527 - DNA, 20 bp, human
ggagggccgcgcagtcggac

SEQ ID NO: 173528 - DNA, 20 bp, human
ggaacggggcgtgaagacac

SEQ ID NO: 173529 - DNA, 20 bp, human
gggctccggagaggtaaaag

SEQ ID NO: 173530 - DNA, 20 bp, human
gggcgtgaagacacaggctc

SEQ ID NO: 173531 - DNA, 20 bp, human
gagtggagcggtgaggactt

SEQ ID NO: 173532 - DNA, 20 bp, human
ggcagtctctgcatatcatg

SEQ ID NO: 173533 - DNA, 20 bp, human
ggagcggtgccggaagtagt

SEQ ID NO: 173534 - DNA, 20 bp, human
gtgggaagggactgactgag

SEQ ID NO: 173535 - DNA, 20 bp, human
gaggtaaaagtggagcggtg

SEQ ID NO: 173536 - DNA, 20 bp, human
gccggcaggacgctgtgagt

SEQ ID NO: 173537 - DNA, 20 bp, human
gagagacggtcactcaccgt

SEQ ID NO: 173538 - DNA, 20 bp, human
gtgtgagttggcgtgctagt

SEQ ID NO: 173539 - DNA, 20 bp, human
gagttggcgtgctagtggga

SEQ ID NO: 173540 - DNA, 20 bp, human
gcgcgtcaccggaagtgagg

SEQ ID NO: 173541 - DNA, 20 bp, human
gccgcgcgtcaccggaagtg

SEQ ID NO: 173542 - DNA, 20 bp, human
gggaagtagtgtaaccagct

SEQ ID NO: 173543 - DNA, 20 bp, human
gagggttacgggcttactta

SEQ ID NO: 173544 - DNA, 20 bp, human
gactccttcgggctcagtag

SEQ ID NO: 173545 - DNA, 20 bp, human
ggtcaccggaagtgaggcgg

SEQ ID NO: 173546 - DNA, 20 bp, human
ggcggccggagctgtactga

SEQ ID NO: 173547 - DNA, 20 bp, human
gctcgctgaaagatccgagg

SEQ ID NO: 173548 - DNA, 20 bp, human
ggccgccctcagtacagctc

SEQ ID NO: 173549 - DNA, 20 bp, human
gcgcggccgttagtcatgtc

SEQ ID NO: 173550 - DNA, 20 bp, human
gacctacccgacatgactaa

SEQ ID NO: 173551 - DNA, 20 bp, human
ggccgttagtcatgtcgggt

SEQ ID NO: 173552 - DNA, 20 bp, human
ggctccccggctgcaaatca

SEQ ID NO: 173553 - DNA, 20 bp, human
gtgcctccagttcaacatgg

SEQ ID NO: 173554 - DNA, 20 bp, human
gaacgaatacgaaagccagg

SEQ ID NO: 173555 - DNA, 20 bp, human
ggcgtgcctccagttcaaca

SEQ ID NO: 173556 - DNA, 20 bp, human
gcaggcgctaaacctggttt

SEQ ID NO: 173557 - DNA, 20 bp, human
gtatgagcaggcgctaaacc

SEQ ID NO: 173558 - DNA, 20 bp, human
gtcccaccggaagacgagtt

SEQ ID NO: 173559 - DNA, 20 bp, human
ggaaccacgggcgatatctg

SEQ ID NO: 173560 - DNA, 20 bp, human
ggctgcagcaggcgtatcgt

SEQ ID NO: 173561 - DNA, 20 bp, human
gagcaggaggagttacgagc

SEQ ID NO: 173562 - DNA, 20 bp, human
gaaacctggtttaggtattt

SEQ ID NO: 173563 - DNA, 20 bp, human
gctgaaaacacgtgatgggt

SEQ ID NO: 173564 - DNA, 20 bp, human
gatttaggcagcgcgcggcc

SEQ ID NO: 173565 - DNA, 20 bp, human
gctgcctaaatacctaaacc

SEQ ID NO: 173566 - DNA, 20 bp, human
ggccgcgatggacctcgagg

SEQ ID NO: 173567 - DNA, 20 bp, human
gggcgccgcgatggacctcg

SEQ ID NO: 173568 - DNA, 20 bp, human
gccggctgtggaagctcccg

SEQ ID NO: 173569 - DNA, 20 bp, human
gcagccgggacccgttaccc

SEQ ID NO: 173570 - DNA, 20 bp, human
ggcctcctcgaggtccatcg

SEQ ID NO: 173571 - DNA, 20 bp, human
gggacctcgaggaggcggta

SEQ ID NO: 173572 - DNA, 20 bp, human
gtctcgaggatgagccctgt

SEQ ID NO: 173573 - DNA, 20 bp, human
gaccgacaggggttacccgg

SEQ ID NO: 173574 - DNA, 20 bp, human
ggcgctcgctacccgggtaa

SEQ ID NO: 173575 - DNA, 20 bp, human
gcgaggatgagccctgtggg

SEQ ID NO: 173576 - DNA, 20 bp, human
gactgcgcgtgttcgaggag

SEQ ID NO: 173577 - DNA, 20 bp, human
ggtccaaaccggaagaccgt

SEQ ID NO: 173578 - DNA, 20 bp, human
gggaagaccgtgggtagctg

SEQ ID NO: 173579 - DNA, 20 bp, human
gcagctttggcactcgggac

SEQ ID NO: 173580 - DNA, 20 bp, human
ggccccgccgcagctaccca

SEQ ID NO: 173581 - DNA, 20 bp, human
gggacccgcagatgtaggag

SEQ ID NO: 173582 - DNA, 20 bp, human
gaagccggccggggaagtcg

SEQ ID NO: 173583 - DNA, 20 bp, human
gccacaaaagccctcagaca

SEQ ID NO: 173584 - DNA, 20 bp, human
gaccgtgggtagctgcggcg

SEQ ID NO: 173585 - DNA, 20 bp, human
gcgtgatgctcgccggaccc

SEQ ID NO: 173586 - DNA, 20 bp, human
gccgcacggttggaggaggt

SEQ ID NO: 173587 - DNA, 20 bp, human
gctggttatcgggagttgga

SEQ ID NO: 173588 - DNA, 20 bp, human
gtcttccgcacggttggagg

SEQ ID NO: 173589 - DNA, 20 bp, human
gccgtgcggaagaaaagggt

SEQ ID NO: 173590 - DNA, 20 bp, human
gccaaccgtgcggaagaaaa

SEQ ID NO: 173591 - DNA, 20 bp, human
gaggaggtcggctggttatc

SEQ ID NO: 173592 - DNA, 20 bp, human
gtcggctggttatcgggagt

SEQ ID NO: 173593 - DNA, 20 bp, human
gacggttggaggaggtcggc

SEQ ID NO: 173594 - DNA, 20 bp, human
gatcctccggaccaacgaag

SEQ ID NO: 173595 - DNA, 20 bp, human
ggaaaaccggcgcgagtaat

SEQ ID NO: 173596 - DNA, 20 bp, human
gtgagatgggataagatcaa

SEQ ID NO: 173597 - DNA, 20 bp, human
gactgaacataaggcatgtg

SEQ ID NO: 173598 - DNA, 20 bp, human
gtatctattagtgagtatat

SEQ ID NO: 173599 - DNA, 20 bp, human
ggaattgtctcagatatact

SEQ ID NO: 173600 - DNA, 20 bp, human
gaatttagaagcagaggatc

SEQ ID NO: 173601 - DNA, 20 bp, human
gcacaaccctaaaactcagt

SEQ ID NO: 173602 - DNA, 20 bp, human
gttccttctggtcttccccg

SEQ ID NO: 173603 - DNA, 20 bp, human
gattcagttgaaggataggg

SEQ ID NO: 173604 - DNA, 20 bp, human
gaatatatccactgaacata

SEQ ID NO: 173605 - DNA, 20 bp, human
gagaaacaatttagaagcag

SEQ ID NO: 173606 - DNA, 20 bp, human
gccctggtccaaaaagatgt

SEQ ID NO: 173607 - DNA, 20 bp, human
gtctccactttcagacacac

SEQ ID NO: 173608 - DNA, 20 bp, human
gcacacaggtaatagcatct

SEQ ID NO: 173609 - DNA, 20 bp, human
gttacctgtgtgtctgaaag

SEQ ID NO: 173610 - DNA, 20 bp, human
gggaagcgtaacacttttcc

SEQ ID NO: 173611 - DNA, 20 bp, human
gatacaggaagagcagatcc

SEQ ID NO: 173612 - DNA, 20 bp, human
gggaccaatgaagaaggata

SEQ ID NO: 173613 - DNA, 20 bp, human
gcaggaagagcagatccagg

SEQ ID NO: 173614 - DNA, 20 bp, human
ggaagagcagatccaggagg

SEQ ID NO: 173615 - DNA, 20 bp, human
ggcggagtgctcggagaaag

SEQ ID NO: 173616 - DNA, 20 bp, human
ggccgggaagccaagctccg

SEQ ID NO: 173617 - DNA, 20 bp, human
gtggtagcttcgagcccttg

SEQ ID NO: 173618 - DNA, 20 bp, human
ggagatgctcctctccgcaa

SEQ ID NO: 173619 - DNA, 20 bp, human
gcgggctctacaccagtcag

SEQ ID NO: 173620 - DNA, 20 bp, human
ggcttcgagcccttgcggag

SEQ ID NO: 173621 - DNA, 20 bp, human
gcgctgacgtcggaggtcag

SEQ ID NO: 173622 - DNA, 20 bp, human
gtgggcctgggaaacctagt

SEQ ID NO: 173623 - DNA, 20 bp, human
gggcttcctagggggatacg

SEQ ID NO: 173624 - DNA, 20 bp, human
ggacagaagcttgtcgacgg

SEQ ID NO: 173625 - DNA, 20 bp, human
ggcttctaggagctagtcga

SEQ ID NO: 173626 - DNA, 20 bp, human
ggatgtgcgagagttactcc

SEQ ID NO: 173627 - DNA, 20 bp, human
gtcgttgttgagggtctcgg

SEQ ID NO: 173628 - DNA, 20 bp, human
gaggcggagcgagtccaaaa

SEQ ID NO: 173629 - DNA, 20 bp, human
gggctgccccggcaagtcaa

SEQ ID NO: 173630 - DNA, 20 bp, human
gcggagcgagtccaaaatgg

SEQ ID NO: 173631 - DNA, 20 bp, human
gagtggaagcccagggacgt

SEQ ID NO: 173632 - DNA, 20 bp, human
ggtgcgggatgcacaccccg

SEQ ID NO: 173633 - DNA, 20 bp, human
gaaagggtcccccggacccc

SEQ ID NO: 173634 - DNA, 20 bp, human
gtaccgggctgggtgcggga

SEQ ID NO: 173635 - DNA, 20 bp, human
gtgctgctggggctttgagg

SEQ ID NO: 173636 - DNA, 20 bp, human
ggcggcgggctcggatctgc

SEQ ID NO: 173637 - DNA, 20 bp, human
ggtcttcttcaacagcgagg

SEQ ID NO: 173638 - DNA, 20 bp, human
gggcggccgaggaaaaaaga

SEQ ID NO: 173639 - DNA, 20 bp, human
gcaggcgcgctcggcccgag

SEQ ID NO: 173640 - DNA, 20 bp, human
gcgagcgcgcctgggcgagg

SEQ ID NO: 173641 - DNA, 20 bp, human
ggaggaggaggttccgactg

SEQ ID NO: 173642 - DNA, 20 bp, human
ggcccagcgcccgccccagt

SEQ ID NO: 173643 - DNA, 20 bp, human
gcgggctgccgctcacaaca

SEQ ID NO: 173644 - DNA, 20 bp, human
gggcggcggcctcagcttcg

SEQ ID NO: 173645 - DNA, 20 bp, human
ggccgcccgccgcgaagctg

SEQ ID NO: 173646 - DNA, 20 bp, human
gccgcgtggctatataaaca

SEQ ID NO: 173647 - DNA, 20 bp, human
ggcggcagccgactccggtg

SEQ ID NO: 173648 - DNA, 20 bp, human
ggaggaagctgcgagaggtc

SEQ ID NO: 173649 - DNA, 20 bp, human
gcctctcgcagcttcctcag

SEQ ID NO: 173650 - DNA, 20 bp, human
gggcgcgcggcagccgactc

SEQ ID NO: 173651 - DNA, 20 bp, human
gggccggcgggcatccccca

SEQ ID NO: 173652 - DNA, 20 bp, human
gcgtgccaatcgcgcgtagg

SEQ ID NO: 173653 - DNA, 20 bp, human
gatcgcgcgtagggggctgt

SEQ ID NO: 173654 - DNA, 20 bp, human
gacccgaaccgcaccggagt

SEQ ID NO: 173655 - DNA, 20 bp, human
ggtggctatataaacatggc

SEQ ID NO: 173656 - DNA, 20 bp, human
gctggcggaggagcagacgg

SEQ ID NO: 173657 - DNA, 20 bp, human
ggcgctgtccacctctcccg

SEQ ID NO: 173658 - DNA, 20 bp, human
ggcagcgttggcggtccctc

SEQ ID NO: 173659 - DNA, 20 bp, human
gggccgtgctgcagttccta

SEQ ID NO: 173660 - DNA, 20 bp, human
gcggcggagacagccaccgt

SEQ ID NO: 173661 - DNA, 20 bp, human
gcggtcaagctagagcctga

SEQ ID NO: 173662 - DNA, 20 bp, human
gctccagcagcccggcctca

SEQ ID NO: 173663 - DNA, 20 bp, human
gctgcggcccccgaccctcc

SEQ ID NO: 173664 - DNA, 20 bp, human
ggggacccccaagcccacgg

SEQ ID NO: 173665 - DNA, 20 bp, human
gcctgcggaggtagcagcgt

SEQ ID NO: 173666 - DNA, 20 bp, human
gccgtcggagtgagaccctg

SEQ ID NO: 173667 - DNA, 20 bp, human
ggctccatgactgactgaca

SEQ ID NO: 173668 - DNA, 20 bp, human
ggctccgtgtcagtcagtca

SEQ ID NO: 173669 - DNA, 20 bp, human
ggaccctgcggcagagacga

SEQ ID NO: 173670 - DNA, 20 bp, human
gcggcgtggcctgcagtcgg

SEQ ID NO: 173671 - DNA, 20 bp, human
ggaggcgcctcgcccattgg

SEQ ID NO: 173672 - DNA, 20 bp, human
gtgcgcgttggaggcccgag

SEQ ID NO: 173673 - DNA, 20 bp, human
gtcggcggctacacctggac

SEQ ID NO: 173674 - DNA, 20 bp, human
gagcaacccgatcccggagg

SEQ ID NO: 173675 - DNA, 20 bp, human
gggaagcaacccgatcccgg

SEQ ID NO: 173676 - DNA, 20 bp, human
gagccgagacgctgctcacc

SEQ ID NO: 173677 - DNA, 20 bp, human
gggtctgagtggtaccccgg

SEQ ID NO: 173678 - DNA, 20 bp, human
ggggagcaggaaaactctag

SEQ ID NO: 173679 - DNA, 20 bp, human
gcgccgggtgagcagcgtct

SEQ ID NO: 173680 - DNA, 20 bp, human
gaggacctgctcccacgagg

SEQ ID NO: 173681 - DNA, 20 bp, human
gcgggtattgaaggattcgt

SEQ ID NO: 173682 - DNA, 20 bp, human
ggattcgtaggagttcgcca

SEQ ID NO: 173683 - DNA, 20 bp, human
gcttcaaagggtctcctccg

SEQ ID NO: 173684 - DNA, 20 bp, human
ggatctcctcagatcagtgg

SEQ ID NO: 173685 - DNA, 20 bp, human
gccccgggcagcgcgaaagg

SEQ ID NO: 173686 - DNA, 20 bp, human
ggctgctaccgagacgacgg

SEQ ID NO: 173687 - DNA, 20 bp, human
gaaggctgctaccgagacga

SEQ ID NO: 173688 - DNA, 20 bp, human
ggcgggtctagggtcaccaa

SEQ ID NO: 173689 - DNA, 20 bp, human
gccagcgcgaaaggcacgga

SEQ ID NO: 173690 - DNA, 20 bp, human
gcctgctcacctgaagaccc

SEQ ID NO: 173691 - DNA, 20 bp, human
gtcacctgaagaccccggcg

SEQ ID NO: 173692 - DNA, 20 bp, human
gtccaccagcgcgaaaggca

SEQ ID NO: 173693 - DNA, 20 bp, human
gagcagccttcgccacgccg

SEQ ID NO: 173694 - DNA, 20 bp, human
ggaagaccccggcgtggcga

SEQ ID NO: 173695 - DNA, 20 bp, human
gtgagtgtgagctcgtgagt

SEQ ID NO: 173696 - DNA, 20 bp, human
gatttcgcgctgcccatccc

SEQ ID NO: 173697 - DNA, 20 bp, human
gcctcgccggccctccgtcc

SEQ ID NO: 173698 - DNA, 20 bp, human
gggtaggcgacccggacgga

SEQ ID NO: 173699 - DNA, 20 bp, human
ggtgccgctgccggacaacg

SEQ ID NO: 173700 - DNA, 20 bp, human
ggtccggcagcggcacctag

SEQ ID NO: 173701 - DNA, 20 bp, human
gggcagcggcacctagaggt

SEQ ID NO: 173702 - DNA, 20 bp, human
gtctccgcgttgtccggcag

SEQ ID NO: 173703 - DNA, 20 bp, human
ggctgggtaggcgacccgga

SEQ ID NO: 173704 - DNA, 20 bp, human
gagctagctagctagggaac

SEQ ID NO: 173705 - DNA, 20 bp, human
gagcgcgaaatcttgccgag

SEQ ID NO: 173706 - DNA, 20 bp, human
ggctcccgcgcggaacgtag

SEQ ID NO: 173707 - DNA, 20 bp, human
gttccggacgaaccgcgcgt

SEQ ID NO: 173708 - DNA, 20 bp, human
gggcgcctggacagtaaaag

SEQ ID NO: 173709 - DNA, 20 bp, human
ggaacgtagaggcgaacgct

SEQ ID NO: 173710 - DNA, 20 bp, human
gccgcgcgtgggctcccgcg

SEQ ID NO: 173711 - DNA, 20 bp, human
gactggcgccgacaccgaaa

SEQ ID NO: 173712 - DNA, 20 bp, human
ggccccggggataaggatgg

SEQ ID NO: 173713 - DNA, 20 bp, human
gagcccacgcgcggttcgtc

SEQ ID NO: 173714 - DNA, 20 bp, human
gacctgcgtctctggtctgt

SEQ ID NO: 173715 - DNA, 20 bp, human
gtaaagcgagatggaactag

SEQ ID NO: 173716 - DNA, 20 bp, human
gggtggctccggaacggtaa

SEQ ID NO: 173717 - DNA, 20 bp, human
gcttcctgcccttaccgttc

SEQ ID NO: 173718 - DNA, 20 bp, human
gcagaacaagatggccgacg

SEQ ID NO: 173719 - DNA, 20 bp, human
gaggtgaccgcgaggagagg

SEQ ID NO: 173720 - DNA, 20 bp, human
gacactacgccagaacaaga

SEQ ID NO: 173721 - DNA, 20 bp, human
ggctccggaacggtaagggc

SEQ ID NO: 173722 - DNA, 20 bp, human
gccgtaggcgccccctcctt

SEQ ID NO: 173723 - DNA, 20 bp, human
ggccagtcggagctcatgat

SEQ ID NO: 173724 - DNA, 20 bp, human
gctcggagccgagagagttt

SEQ ID NO: 173725 - DNA, 20 bp, human
gaacaagatggccgacgcgg

SEQ ID NO: 173726 - DNA, 20 bp, human
gcacggaggcctaaggagtg

SEQ ID NO: 173727 - DNA, 20 bp, human
gcccggccgcgcgccctgac

SEQ ID NO: 173728 - DNA, 20 bp, human
gacatcctgctcaccggtca

SEQ ID NO: 173729 - DNA, 20 bp, human
ggaggcgcccgaagccgtcg

SEQ ID NO: 173730 - DNA, 20 bp, human
gtcaacgccgagcctctcgg

SEQ ID NO: 173731 - DNA, 20 bp, human
ggcgcccgaagccgtcgcgg

SEQ ID NO: 173732 - DNA, 20 bp, human
gccgcgagggtcggctcccg

SEQ ID NO: 173733 - DNA, 20 bp, human
gtacggcccacggaggccta

SEQ ID NO: 173734 - DNA, 20 bp, human
gctcggccggcctctgaaga

SEQ ID NO: 173735 - DNA, 20 bp, human
ggggaggccgtacctccgag

SEQ ID NO: 173736 - DNA, 20 bp, human
gctctcggagcgttcttggg

SEQ ID NO: 173737 - DNA, 20 bp, human
gtcgtcatccgcggagacag

SEQ ID NO: 173738 - DNA, 20 bp, human
gaaccctggacgcggagtca

SEQ ID NO: 173739 - DNA, 20 bp, human
gggctggataacatggagtc

SEQ ID NO: 173740 - DNA, 20 bp, human
gcagatagctagagacgagg

SEQ ID NO: 173741 - DNA, 20 bp, human
gcacttaccaaggcatctct

SEQ ID NO: 173742 - DNA, 20 bp, human
gtcagggccgtcaggaggag

SEQ ID NO: 173743 - DNA, 20 bp, human
gagcatcagaaccctggacg

SEQ ID NO: 173744 - DNA, 20 bp, human
gtggctgtggcggcgggtta

SEQ ID NO: 173745 - DNA, 20 bp, human
gaggagagaggagagctcgc

SEQ ID NO: 173746 - DNA, 20 bp, human
gaccggatgtaaaagaactc

SEQ ID NO: 173747 - DNA, 20 bp, human
ggctctgcattataagcgaa

SEQ ID NO: 173748 - DNA, 20 bp, human
gccggtgagctgtaaagaat

SEQ ID NO: 173749 - DNA, 20 bp, human
gctggctagagaccctccaa

SEQ ID NO: 173750 - DNA, 20 bp, human
gcacaggtcactcagatcac

SEQ ID NO: 173751 - DNA, 20 bp, human
gtctctcccagtggactaga

SEQ ID NO: 173752 - DNA, 20 bp, human
gggagagagagagaccgagc

SEQ ID NO: 173753 - DNA, 20 bp, human
gatgtgaagggagaccggct

SEQ ID NO: 173754 - DNA, 20 bp, human
gatatgccagctgtcgtagt

SEQ ID NO: 173755 - DNA, 20 bp, human
gagagcatgtgaagggagac

SEQ ID NO: 173756 - DNA, 20 bp, human
gcactcacaaggcttcctca

SEQ ID NO: 173757 - DNA, 20 bp, human
gctccttcctgcgagccctg

SEQ ID NO: 173758 - DNA, 20 bp, human
gtggggcttggagggaagtt

SEQ ID NO: 173759 - DNA, 20 bp, human
gggttcggacagacaggatg

SEQ ID NO: 173760 - DNA, 20 bp, human
gcccagccaatgcactcaca

SEQ ID NO: 173761 - DNA, 20 bp, human
ggcactagccaagtcatccg

SEQ ID NO: 173762 - DNA, 20 bp, human
gggacaccgtgctccaacac

SEQ ID NO: 173763 - DNA, 20 bp, human
gggagtgaagacttgtgtct

SEQ ID NO: 173764 - DNA, 20 bp, human
gccatgctgactgagagggt

SEQ ID NO: 173765 - DNA, 20 bp, human
gaggcttcctcagggctcgc

SEQ ID NO: 173766 - DNA, 20 bp, human
gtggcccaggactcacaggg

SEQ ID NO: 173767 - DNA, 20 bp, human
ggattggcccaggactcaca

SEQ ID NO: 173768 - DNA, 20 bp, human
ggtctggctgaagaatggcg

SEQ ID NO: 173769 - DNA, 20 bp, human
ggctcacagggcccactgag

SEQ ID NO: 173770 - DNA, 20 bp, human
gtgagtggcaccctgggcta

SEQ ID NO: 173771 - DNA, 20 bp, human
gcccccagcgccctagccca

SEQ ID NO: 173772 - DNA, 20 bp, human
ggcgcttgggcttccaggtc

SEQ ID NO: 173773 - DNA, 20 bp, human
gtgtgggccgcccagaccgt

SEQ ID NO: 173774 - DNA, 20 bp, human
ggcccgcacacagcagggat

SEQ ID NO: 173775 - DNA, 20 bp, human
ggcccaagcgcccacggtct

SEQ ID NO: 173776 - DNA, 20 bp, human
gagagcggcgcactgactca

SEQ ID NO: 173777 - DNA, 20 bp, human
gcagcgagctcggggatcaa

SEQ ID NO: 173778 - DNA, 20 bp, human
gtgaacggtgagcaggtcgg

SEQ ID NO: 173779 - DNA, 20 bp, human
ggagcaggtcgggggtacgg

SEQ ID NO: 173780 - DNA, 20 bp, human
ggctctccagcccgcttgaa

SEQ ID NO: 173781 - DNA, 20 bp, human
ggacaggacctgacagcacg

SEQ ID NO: 173782 - DNA, 20 bp, human
ggcttgaacggtgagcaggt

SEQ ID NO: 173783 - DNA, 20 bp, human
gggcgcactgactcaaggca

SEQ ID NO: 173784 - DNA, 20 bp, human
gcacgacccggggtcactcg

SEQ ID NO: 173785 - DNA, 20 bp, human
gcgtctggagcagggactca

SEQ ID NO: 173786 - DNA, 20 bp, human
gctccggctccctgcagacg

SEQ ID NO: 173787 - DNA, 20 bp, human
gtgcctcgcgcctggaagaa

SEQ ID NO: 173788 - DNA, 20 bp, human
gtgcagacggggctgggata

SEQ ID NO: 173789 - DNA, 20 bp, human
ggaagggagatgtaatgcta

SEQ ID NO: 173790 - DNA, 20 bp, human
gggcccagcagcagcaaaga

SEQ ID NO: 173791 - DNA, 20 bp, human
gggctgcagttcaacatgaa

SEQ ID NO: 173792 - DNA, 20 bp, human
gttccagagatggctaacag

SEQ ID NO: 173793 - DNA, 20 bp, human
gaaagaagagaagacacgcg

SEQ ID NO: 173794 - DNA, 20 bp, human
ggctctatgtctcaccggga

SEQ ID NO: 173795 - DNA, 20 bp, human
gaggcagaaacgatgagatc

SEQ ID NO: 173796 - DNA, 20 bp, human
ggatagtcccgggcctggat

SEQ ID NO: 173797 - DNA, 20 bp, human
ggctgccgctacaccgcgaa

SEQ ID NO: 173798 - DNA, 20 bp, human
gctatcccttcgcggtgtag

SEQ ID NO: 173799 - DNA, 20 bp, human
gaagcagggaggtgtctacg

SEQ ID NO: 173800 - DNA, 20 bp, human
gtccccgaccaaccagtcca

SEQ ID NO: 173801 - DNA, 20 bp, human
gggcctctcagcgaaaaagg

SEQ ID NO: 173802 - DNA, 20 bp, human
gaggaagaggatgcacaccc

SEQ ID NO: 173803 - DNA, 20 bp, human
gcctccaactgggatcggtc

SEQ ID NO: 173804 - DNA, 20 bp, human
gccactccgccggaaagggg

SEQ ID NO: 173805 - DNA, 20 bp, human
ggagtttccaggaaagatag

SEQ ID NO: 173806 - DNA, 20 bp, human
gagggtccagccccacagaa

SEQ ID NO: 173807 - DNA, 20 bp, human
gtgtgcggggctgaccaagt

SEQ ID NO: 173808 - DNA, 20 bp, human
gagtgcggacaggaccacac

SEQ ID NO: 173809 - DNA, 20 bp, human
gtgagaactgtgggcggcgt

SEQ ID NO: 173810 - DNA, 20 bp, human
gctaaaggacacaggcacac

SEQ ID NO: 173811 - DNA, 20 bp, human
gctgaccaagtcggcttctg

SEQ ID NO: 173812 - DNA, 20 bp, human
ggtgagtgggaggctcctcc

SEQ ID NO: 173813 - DNA, 20 bp, human
gtccctgctgagaacaccaa

SEQ ID NO: 173814 - DNA, 20 bp, human
gaaatgcgcgaggctgtggt

SEQ ID NO: 173815 - DNA, 20 bp, human
gacgcacctctaaaggacac

SEQ ID NO: 173816 - DNA, 20 bp, human
gaaataccagggagcggtgg

SEQ ID NO: 173817 - DNA, 20 bp, human
ggacagccagagccacacta

SEQ ID NO: 173818 - DNA, 20 bp, human
gcttcacaaataccagggag

SEQ ID NO: 173819 - DNA, 20 bp, human
gcacaaataccagggagcgg

SEQ ID NO: 173820 - DNA, 20 bp, human
gcatgcaaaagtctgtccac

SEQ ID NO: 173821 - DNA, 20 bp, human
ggccacactaaggaatgtgg

SEQ ID NO: 173822 - DNA, 20 bp, human
gtgaattctagcttcctggg

SEQ ID NO: 173823 - DNA, 20 bp, human
gagcctgcaacaaacgggag

SEQ ID NO: 173824 - DNA, 20 bp, human
gcaggaactcaaacatgacc

SEQ ID NO: 173825 - DNA, 20 bp, human
gtgctcaggggaacattctg

SEQ ID NO: 173826 - DNA, 20 bp, human
ggctcgacatagcaagaccg

SEQ ID NO: 173827 - DNA, 20 bp, human
gggctgaccccagctcctca

SEQ ID NO: 173828 - DNA, 20 bp, human
gcccagcaccgagcccctca

SEQ ID NO: 173829 - DNA, 20 bp, human
gagcaagaccgaggggtctg

SEQ ID NO: 173830 - DNA, 20 bp, human
gctcacccgtgaagcgtcag

SEQ ID NO: 173831 - DNA, 20 bp, human
gagctggggtcagccgtgag

SEQ ID NO: 173832 - DNA, 20 bp, human
ggggcagccgtgaggagctg

SEQ ID NO: 173833 - DNA, 20 bp, human
gaagaccgaggggtctgcgg

SEQ ID NO: 173834 - DNA, 20 bp, human
gccatcctctgacgcttcac

SEQ ID NO: 173835 - DNA, 20 bp, human
gggtcggccgtgagggagca

SEQ ID NO: 173836 - DNA, 20 bp, human
gcggggaacagacaccgggt

SEQ ID NO: 173837 - DNA, 20 bp, human
ggacaccgggtaggcggttt

SEQ ID NO: 173838 - DNA, 20 bp, human
ggttgggccacgaagagcag

SEQ ID NO: 173839 - DNA, 20 bp, human
ggagaagacgcagcccagat

SEQ ID NO: 173840 - DNA, 20 bp, human
gacgcagcccagataggctc

SEQ ID NO: 173841 - DNA, 20 bp, human
gcgcccacccgagcctatct

SEQ ID NO: 173842 - DNA, 20 bp, human
gagcccagataggctcgggt

SEQ ID NO: 173843 - DNA, 20 bp, human
gcagacgctgcagagctcgt

SEQ ID NO: 173844 - DNA, 20 bp, human
gatggggtcgaggctaacag

SEQ ID NO: 173845 - DNA, 20 bp, human
gccgactctgaaggaatcga

SEQ ID NO: 173846 - DNA, 20 bp, human
ggccggaggagaggcagccg

SEQ ID NO: 173847 - DNA, 20 bp, human
gcccaccacaccggttccag

SEQ ID NO: 173848 - DNA, 20 bp, human
ggaaccgcgcaaggaaggtg

SEQ ID NO: 173849 - DNA, 20 bp, human
ggcctcccctggaaccggtg

SEQ ID NO: 173850 - DNA, 20 bp, human
gccgggccttggtctctcgg

SEQ ID NO: 173851 - DNA, 20 bp, human
gcgagggctacagagaaggc

SEQ ID NO: 173852 - DNA, 20 bp, human
gtgggaaccgggaacgcttg

SEQ ID NO: 173853 - DNA, 20 bp, human
gggagaagggaaaggcgtgt

SEQ ID NO: 173854 - DNA, 20 bp, human
gggaccgagccggcctcccc

SEQ ID NO: 173855 - DNA, 20 bp, human
gaccacaccggttccagggg

SEQ ID NO: 173856 - DNA, 20 bp, human
gcaagatgctgcttactggt

SEQ ID NO: 173857 - DNA, 20 bp, human
ggtctcaagatgctgcttac

SEQ ID NO: 173858 - DNA, 20 bp, human
ggtcgtaaaaacaggtcaag

SEQ ID NO: 173859 - DNA, 20 bp, human
gccttccccaaagagtgcct

SEQ ID NO: 173860 - DNA, 20 bp, human
gcaatcctaggcactctttg

SEQ ID NO: 173861 - DNA, 20 bp, human
gtcaggaatagtcgaaagaa

SEQ ID NO: 173862 - DNA, 20 bp, human
gatgaaattattgcaatcct

SEQ ID NO: 173863 - DNA, 20 bp, human
gttgagactattccgaaaca

SEQ ID NO: 173864 - DNA, 20 bp, human
ggaaatcaagtcgtaaaaac

SEQ ID NO: 173865 - DNA, 20 bp, human
ggaacacttgaatgcgtatc

SEQ ID NO: 173866 - DNA, 20 bp, human
gcgcggcacccggaagtcgg

SEQ ID NO: 173867 - DNA, 20 bp, human
gaggccggccgggccactag

SEQ ID NO: 173868 - DNA, 20 bp, human
ggccgggccactagcggagt

SEQ ID NO: 173869 - DNA, 20 bp, human
gtagcggagtcggccagccc

SEQ ID NO: 173870 - DNA, 20 bp, human
ggcagcaggccgcgggtagg

SEQ ID NO: 173871 - DNA, 20 bp, human
ggcagggtgacagctaatgt

SEQ ID NO: 173872 - DNA, 20 bp, human
ggggcgcggcacccggaagt

SEQ ID NO: 173873 - DNA, 20 bp, human
gtcggccttggccagcatca

SEQ ID NO: 173874 - DNA, 20 bp, human
gccgctggcacgggatgcga

SEQ ID NO: 173875 - DNA, 20 bp, human
ggagctgcgtggtccctgca

SEQ ID NO: 173876 - DNA, 20 bp, human
gggtcccgaggcgggcctaa

SEQ ID NO: 173877 - DNA, 20 bp, human
gcctgagcgggtcgcgagcg

SEQ ID NO: 173878 - DNA, 20 bp, human
ggccgccgccatgttaagtg

SEQ ID NO: 173879 - DNA, 20 bp, human
ggctggacccgggactctca

SEQ ID NO: 173880 - DNA, 20 bp, human
gcccagctccagagagggta

SEQ ID NO: 173881 - DNA, 20 bp, human
gccgctcaggcgcctcggca

SEQ ID NO: 173882 - DNA, 20 bp, human
gtctgccacacttaacatgg

SEQ ID NO: 173883 - DNA, 20 bp, human
gaggctctgggcacactatg

SEQ ID NO: 173884 - DNA, 20 bp, human
ggcgcacgctgcggaaggca

SEQ ID NO: 173885 - DNA, 20 bp, human
gtagccgcgtgagggcgcag

SEQ ID NO: 173886 - DNA, 20 bp, human
gcaggcgccggcgacctgag

SEQ ID NO: 173887 - DNA, 20 bp, human
gtctctcccgaagggaagtc

SEQ ID NO: 173888 - DNA, 20 bp, human
gccggcgacctgaggggaga

SEQ ID NO: 173889 - DNA, 20 bp, human
gaggcagtctctctcccgaa

SEQ ID NO: 173890 - DNA, 20 bp, human
ggagagaagccgaggagcag

SEQ ID NO: 173891 - DNA, 20 bp, human
gctggccgagtgactccaac

SEQ ID NO: 173892 - DNA, 20 bp, human
ggagtcactcggccaggcgc

SEQ ID NO: 173893 - DNA, 20 bp, human
gtgctttgcccgggaaatgg

SEQ ID NO: 173894 - DNA, 20 bp, human
gggtgagcagtggaccctcc

SEQ ID NO: 173895 - DNA, 20 bp, human
gtcaagggagggactcgtcc

SEQ ID NO: 173896 - DNA, 20 bp, human
gacagaggaatagtctacaa

SEQ ID NO: 173897 - DNA, 20 bp, human
ggggtccctagccaagacca

SEQ ID NO: 173898 - DNA, 20 bp, human
gactgtcttcatctttacag

SEQ ID NO: 173899 - DNA, 20 bp, human
ggcagcattgttagagcctg

SEQ ID NO: 173900 - DNA, 20 bp, human
ggacttgtaacctggagaag

SEQ ID NO: 173901 - DNA, 20 bp, human
gactatgacgttaactacaa

SEQ ID NO: 173902 - DNA, 20 bp, human
ggttgtaaagtgttttccac

SEQ ID NO: 173903 - DNA, 20 bp, human
gtcctaggttaagaatcagt

SEQ ID NO: 173904 - DNA, 20 bp, human
gtcacatagcaagagtaaga

SEQ ID NO: 173905 - DNA, 20 bp, human
gcaaaggaagacttgtaacc

SEQ ID NO: 173906 - DNA, 20 bp, human
ggcggcttgctggggctcgg

SEQ ID NO: 173907 - DNA, 20 bp, human
gcaagctctgcaacaagggg

SEQ ID NO: 173908 - DNA, 20 bp, human
gtgggctgggcggcttgctg

SEQ ID NO: 173909 - DNA, 20 bp, human
gcggtagccgctaccctgga

SEQ ID NO: 173910 - DNA, 20 bp, human
gtccacacacaggcccgagt

SEQ ID NO: 173911 - DNA, 20 bp, human
gcctgtcggcgaaagggtaa

SEQ ID NO: 173912 - DNA, 20 bp, human
gtcctgagggtcaccggaag

SEQ ID NO: 173913 - DNA, 20 bp, human
gcaacccagtctccctgtga

SEQ ID NO: 173914 - DNA, 20 bp, human
ggctctgcaacaaggggcgg

SEQ ID NO: 173915 - DNA, 20 bp, human
gaggaaggtgtggccctcac

SEQ ID NO: 173916 - DNA, 20 bp, human
gcgagaccggggctgtggtg

SEQ ID NO: 173917 - DNA, 20 bp, human
gcggatactggtgcacgcag

SEQ ID NO: 173918 - DNA, 20 bp, human
ggggagaccgggacgagacc

SEQ ID NO: 173919 - DNA, 20 bp, human
gggggctgtggtgcggagag

SEQ ID NO: 173920 - DNA, 20 bp, human
gcaattccaagatggagacc

SEQ ID NO: 173921 - DNA, 20 bp, human
gctctcacgccggggtccga

SEQ ID NO: 173922 - DNA, 20 bp, human
gttccaagatggagaccggg

SEQ ID NO: 173923 - DNA, 20 bp, human
gcgggacgagaccggggctg

SEQ ID NO: 173924 - DNA, 20 bp, human
gcagagacccaggtttagag

SEQ ID NO: 173925 - DNA, 20 bp, human
gacgcccggggaatgaaccc

SEQ ID NO: 173926 - DNA, 20 bp, human
ggaggtgcggctcctgccag

SEQ ID NO: 173927 - DNA, 20 bp, human
gccgaggcagtggctctgag

SEQ ID NO: 173928 - DNA, 20 bp, human
gactgtggagaggagacccc

SEQ ID NO: 173929 - DNA, 20 bp, human
gggctcgacagtgcagactg

SEQ ID NO: 173930 - DNA, 20 bp, human
gtggagaggagaccccggga

SEQ ID NO: 173931 - DNA, 20 bp, human
gagtggagaggactccgaga

SEQ ID NO: 173932 - DNA, 20 bp, human
gccgccgctgctgctgtccg

SEQ ID NO: 173933 - DNA, 20 bp, human
gccgggagggaccgggacag

SEQ ID NO: 173934 - DNA, 20 bp, human
gaggagaggggactccgaga

SEQ ID NO: 173935 - DNA, 20 bp, human
gcggtgcgattggccacccc

SEQ ID NO: 173936 - DNA, 20 bp, human
gtgaaggtgctgatagcctg

SEQ ID NO: 173937 - DNA, 20 bp, human
gtaagttataagaacacccc

SEQ ID NO: 173938 - DNA, 20 bp, human
gtactgtgagtaagtgtcat

SEQ ID NO: 173939 - DNA, 20 bp, human
ggcatttaccttagttattc

SEQ ID NO: 173940 - DNA, 20 bp, human
gtatgttgaactggaaatat

SEQ ID NO: 173941 - DNA, 20 bp, human
gacttcctttctcgggatga

SEQ ID NO: 173942 - DNA, 20 bp, human
gtgattgttgtagctaaata

SEQ ID NO: 173943 - DNA, 20 bp, human
gaatcaacctcaaaagtcat

SEQ ID NO: 173944 - DNA, 20 bp, human
gtcagctggactttgagcta

SEQ ID NO: 173945 - DNA, 20 bp, human
gtctttctcctgaataacta

SEQ ID NO: 173946 - DNA, 20 bp, human
gggagcttcaggccccaccg

SEQ ID NO: 173947 - DNA, 20 bp, human
ggactctccgcgccccggtg

SEQ ID NO: 173948 - DNA, 20 bp, human
gccgccagtaggggaggact

SEQ ID NO: 173949 - DNA, 20 bp, human
gcagccagagcacggcccag

SEQ ID NO: 173950 - DNA, 20 bp, human
ggacacctagagctagccat

SEQ ID NO: 173951 - DNA, 20 bp, human
gtgcgagagaagctccgggg

SEQ ID NO: 173952 - DNA, 20 bp, human
gagaagctccggggaggcag

SEQ ID NO: 173953 - DNA, 20 bp, human
gctcccccagccgccagtag

SEQ ID NO: 173954 - DNA, 20 bp, human
gaggcagggagaggcgagaa

SEQ ID NO: 173955 - DNA, 20 bp, human
ggtgctatccgcggacccgg

SEQ ID NO: 173956 - DNA, 20 bp, human
gcagagccggtagcgaggtt

SEQ ID NO: 173957 - DNA, 20 bp, human
gcctggccgagcgtagctgg

SEQ ID NO: 173958 - DNA, 20 bp, human
ggtagctggcggaccagagc

SEQ ID NO: 173959 - DNA, 20 bp, human
gctcagggagacagtcaggg

SEQ ID NO: 173960 - DNA, 20 bp, human
gtcggccagggcgggcgtca

SEQ ID NO: 173961 - DNA, 20 bp, human
gaggtccagggtctcaggtc

SEQ ID NO: 173962 - DNA, 20 bp, human
gagctacgctcggccagggc

SEQ ID NO: 173963 - DNA, 20 bp, human
gttactcaggagagctctca

SEQ ID NO: 173964 - DNA, 20 bp, human
gggatgagcaccggttactc

SEQ ID NO: 173965 - DNA, 20 bp, human
ggcgctgaagcagaagtccc

SEQ ID NO: 173966 - DNA, 20 bp, human
gagcagagacagggacttca

SEQ ID NO: 173967 - DNA, 20 bp, human
ggtggaggcgacagaggtag

SEQ ID NO: 173968 - DNA, 20 bp, human
ggtcactgccggatctaaag

SEQ ID NO: 173969 - DNA, 20 bp, human
gtgtacacggtgagtctcta

SEQ ID NO: 173970 - DNA, 20 bp, human
ggccggatctaaagaggagg

SEQ ID NO: 173971 - DNA, 20 bp, human
gtagggacgcgagtgaggag

SEQ ID NO: 173972 - DNA, 20 bp, human
gagtccaggagggcgcggta

SEQ ID NO: 173973 - DNA, 20 bp, human
gctgtctctgctcctcgctg

SEQ ID NO: 173974 - DNA, 20 bp, human
gctccaaagggcggcatgag

SEQ ID NO: 173975 - DNA, 20 bp, human
gctgttgcgccagggaccgg

SEQ ID NO: 173976 - DNA, 20 bp, human
ggtcggcagcagagggaaca

SEQ ID NO: 173977 - DNA, 20 bp, human
gcgccttctaagcccaacag

SEQ ID NO: 173978 - DNA, 20 bp, human
gccctcctgtgtgcccatgg

SEQ ID NO: 173979 - DNA, 20 bp, human
gctgcagacggcttcacaca

SEQ ID NO: 173980 - DNA, 20 bp, human
ggcagcctccatgggcacac

SEQ ID NO: 173981 - DNA, 20 bp, human
ggagccactgtcctacagag

SEQ ID NO: 173982 - DNA, 20 bp, human
gccagtgagtctgggagtcg

SEQ ID NO: 173983 - DNA, 20 bp, human
gctccctccacacacactat

SEQ ID NO: 173984 - DNA, 20 bp, human
gcgggcctcgcaagcagcgt

SEQ ID NO: 173985 - DNA, 20 bp, human
gtctaagcccaacaggggaa

SEQ ID NO: 173986 - DNA, 20 bp, human
gcggccgcagaccccttcta

SEQ ID NO: 173987 - DNA, 20 bp, human
gccgcccgaggaactgtcaa

SEQ ID NO: 173988 - DNA, 20 bp, human
gcggccgttgacagttcctc

SEQ ID NO: 173989 - DNA, 20 bp, human
gcagtctgcgaggtgtccgg

SEQ ID NO: 173990 - DNA, 20 bp, human
gacgcggccgctccgggaga

SEQ ID NO: 173991 - DNA, 20 bp, human
gccgccgccttctcccggag

SEQ ID NO: 173992 - DNA, 20 bp, human
gggagcctcggcagcctcgg

SEQ ID NO: 173993 - DNA, 20 bp, human
gtgttgtgctcggaacatgg

SEQ ID NO: 173994 - DNA, 20 bp, human
gggccaggtgtgccctagaa

SEQ ID NO: 173995 - DNA, 20 bp, human
gcgagggcgatgcaaggacc

SEQ ID NO: 173996 - DNA, 20 bp, human
gggcgcgcgaggtggctgca

SEQ ID NO: 173997 - DNA, 20 bp, human
gggcgctcggcaaatggagt

SEQ ID NO: 173998 - DNA, 20 bp, human
gcaccggcccgggctcccaa

SEQ ID NO: 173999 - DNA, 20 bp, human
gacggctgctagcacttcca

SEQ ID NO: 174000 - DNA, 20 bp, human
gggctcccaaaggaaggcgc

SEQ ID NO: 174001 - DNA, 20 bp, human
ggcgcacgcatcgcacacgc

SEQ ID NO: 174002 - DNA, 20 bp, human
gcgcgcaggctccgcagcag

SEQ ID NO: 174003 - DNA, 20 bp, human
gtcggcgcacgcgcacgtag

SEQ ID NO: 174004 - DNA, 20 bp, human
ggcaggcgcgctcccggagg

SEQ ID NO: 174005 - DNA, 20 bp, human
gtctacgcggccggacccca

SEQ ID NO: 174006 - DNA, 20 bp, human
gccaaatgcactgaatgtgg

SEQ ID NO: 174007 - DNA, 20 bp, human
gcgcgtggaggctgcagtca

SEQ ID NO: 174008 - DNA, 20 bp, human
gccctaccggccgcgactcc

SEQ ID NO: 174009 - DNA, 20 bp, human
ggtggaggctgcagtcacgg

SEQ ID NO: 174010 - DNA, 20 bp, human
gcactaccccaaagcaaggg

SEQ ID NO: 174011 - DNA, 20 bp, human
gatacacagccgacgagcta

SEQ ID NO: 174012 - DNA, 20 bp, human
gttgttcccggcaagcactg

SEQ ID NO: 174013 - DNA, 20 bp, human
gatcgtgcccaccttaactg

SEQ ID NO: 174014 - DNA, 20 bp, human
gcggcaagcactggggcagt

SEQ ID NO: 174015 - DNA, 20 bp, human
gtgtgtattggggcgcgtgg

SEQ ID NO: 174016 - DNA, 20 bp, human
gggaagtcagccgtgagacc

SEQ ID NO: 174017 - DNA, 20 bp, human
gcggcctagcgggtgagtcg

SEQ ID NO: 174018 - DNA, 20 bp, human
ggcagaagccgaggcaccta

SEQ ID NO: 174019 - DNA, 20 bp, human
ggcccgcgcgtgccagccga

SEQ ID NO: 174020 - DNA, 20 bp, human
gaggactaggcccggtctca

SEQ ID NO: 174021 - DNA, 20 bp, human
gcacccgctaggccgctgct

SEQ ID NO: 174022 - DNA, 20 bp, human
gccattttgtgggagcgaag

SEQ ID NO: 174023 - DNA, 20 bp, human
gtacggcgtcctcagtgaga

SEQ ID NO: 174024 - DNA, 20 bp, human
gcggcccgaggcagacgcag

SEQ ID NO: 174025 - DNA, 20 bp, human
gggcccgcggcgacaggtcc

SEQ ID NO: 174026 - DNA, 20 bp, human
gctctcccaccccagagtgt

SEQ ID NO: 174027 - DNA, 20 bp, human
gccacagatgggagaagagc

SEQ ID NO: 174028 - DNA, 20 bp, human
gcccaagacggactctggga

SEQ ID NO: 174029 - DNA, 20 bp, human
ggccctcccagagtccgtct

SEQ ID NO: 174030 - DNA, 20 bp, human
gagaacccaagacggactct

SEQ ID NO: 174031 - DNA, 20 bp, human
gcaatgaagccaggtggtgg

SEQ ID NO: 174032 - DNA, 20 bp, human
gagcagcttagggatcatga

SEQ ID NO: 174033 - DNA, 20 bp, human
ggtaagccaatgaagccagg

SEQ ID NO: 174034 - DNA, 20 bp, human
gtggaactggtgggatagtt

SEQ ID NO: 174035 - DNA, 20 bp, human
gtttggcttactgagcacac

SEQ ID NO: 174036 - DNA, 20 bp, human
ggagttgggcaaaaaaatca

SEQ ID NO: 174037 - DNA, 20 bp, human
gcaaagggagattcttataa

SEQ ID NO: 174038 - DNA, 20 bp, human
gagcatgggagacattacta

SEQ ID NO: 174039 - DNA, 20 bp, human
gggaaaagttctgactccta

SEQ ID NO: 174040 - DNA, 20 bp, human
gtgcaatgtaaagaagggat

SEQ ID NO: 174041 - DNA, 20 bp, human
gcatggtgaaatctccagag

SEQ ID NO: 174042 - DNA, 20 bp, human
gattcttataaaggcttctc

SEQ ID NO: 174043 - DNA, 20 bp, human
gatcttttggtgaccaaata

SEQ ID NO: 174044 - DNA, 20 bp, human
gaaatcaaggtatttggtcc

SEQ ID NO: 174045 - DNA, 20 bp, human
gttttggtgaccaaataagg

SEQ ID NO: 174046 - DNA, 20 bp, human
ggaggagccaagaggcgggt

SEQ ID NO: 174047 - DNA, 20 bp, human
gaagcgacggcctagaggag

SEQ ID NO: 174048 - DNA, 20 bp, human
gaggagaggagccaagaggc

SEQ ID NO: 174049 - DNA, 20 bp, human
gcccgaaagcgacggcctag

SEQ ID NO: 174050 - DNA, 20 bp, human
gaccagctgatgcaatcgaa

SEQ ID NO: 174051 - DNA, 20 bp, human
ggagacagaatcagaatctt

SEQ ID NO: 174052 - DNA, 20 bp, human
gtctaactactgtagatgtg

SEQ ID NO: 174053 - DNA, 20 bp, human
ggaagcggccgggaccgcgt

SEQ ID NO: 174054 - DNA, 20 bp, human
gtgagagaacccgaaagcga

SEQ ID NO: 174055 - DNA, 20 bp, human
gtgggaggtgggctagcgcc

SEQ ID NO: 174056 - DNA, 20 bp, human
gcaccgccacctctgataca

SEQ ID NO: 174057 - DNA, 20 bp, human
ggaacatggccctgtatcag

SEQ ID NO: 174058 - DNA, 20 bp, human
gggccctgtatcagaggtgg

SEQ ID NO: 174059 - DNA, 20 bp, human
ggcactggtgtgaaggaaca

SEQ ID NO: 174060 - DNA, 20 bp, human
gaggtggtgccagactagag

SEQ ID NO: 174061 - DNA, 20 bp, human
gctggggactcggaggacca

SEQ ID NO: 174062 - DNA, 20 bp, human
gtgtttgaggatgtaggcac

SEQ ID NO: 174063 - DNA, 20 bp, human
gtctgccaaccagcgtggag

SEQ ID NO: 174064 - DNA, 20 bp, human
ggtcgacacaactgcctgga

SEQ ID NO: 174065 - DNA, 20 bp, human
gaggggtcgacacaactgcc

SEQ ID NO: 174066 - DNA, 20 bp, human
gcgccatcgcggcctccctc

SEQ ID NO: 174067 - DNA, 20 bp, human
gcgggcaccccgctcggcgt

SEQ ID NO: 174068 - DNA, 20 bp, human
gcagcgcacggcagaagaca

SEQ ID NO: 174069 - DNA, 20 bp, human
gcgagacggtgcgcaccgaa

SEQ ID NO: 174070 - DNA, 20 bp, human
ggctcggcgtcggtgcctga

SEQ ID NO: 174071 - DNA, 20 bp, human
gcctccgcctggcagctgta

SEQ ID NO: 174072 - DNA, 20 bp, human
ggtgcccgcgactgcggcga

SEQ ID NO: 174073 - DNA, 20 bp, human
gggccggcgcacaggtaacc

SEQ ID NO: 174074 - DNA, 20 bp, human
ggacgcggacactcagcgca

SEQ ID NO: 174075 - DNA, 20 bp, human
gagcggggtgcccgcgactg

SEQ ID NO: 174076 - DNA, 20 bp, human
gggtggccaggcctaagcaa

SEQ ID NO: 174077 - DNA, 20 bp, human
gaggagaagactccgtgcta

SEQ ID NO: 174078 - DNA, 20 bp, human
gaggcctggccacctaggta

SEQ ID NO: 174079 - DNA, 20 bp, human
gtgccaggaggtaatctccg

SEQ ID NO: 174080 - DNA, 20 bp, human
gcaggaggtaatctccgggg

SEQ ID NO: 174081 - DNA, 20 bp, human
gtccgtgctatggcaggcaa

SEQ ID NO: 174082 - DNA, 20 bp, human
ggaagactccgtgctatggc

SEQ ID NO: 174083 - DNA, 20 bp, human
ggcagacagccagaatggag

SEQ ID NO: 174084 - DNA, 20 bp, human
ggcctttgcctgccatagca

SEQ ID NO: 174085 - DNA, 20 bp, human
gtgtcacacagggtcacctc

SEQ ID NO: 174086 - DNA, 20 bp, human
gggagtgagtctccagtgtg

SEQ ID NO: 174087 - DNA, 20 bp, human
gcacccaggaggtaatcccc

SEQ ID NO: 174088 - DNA, 20 bp, human
ggggcctccctgaggactag

SEQ ID NO: 174089 - DNA, 20 bp, human
ggggaggccccgtataatat

SEQ ID NO: 174090 - DNA, 20 bp, human
gatgcccctagtcctcaggg

SEQ ID NO: 174091 - DNA, 20 bp, human
gtccatgcccctagtcctca

SEQ ID NO: 174092 - DNA, 20 bp, human
ggggaagtgatggtctcagg

SEQ ID NO: 174093 - DNA, 20 bp, human
gagactcactccttgcacat

SEQ ID NO: 174094 - DNA, 20 bp, human
gctggctcccaaggacccac

SEQ ID NO: 174095 - DNA, 20 bp, human
ggcatggatccagaataagg

SEQ ID NO: 174096 - DNA, 20 bp, human
gccatgtgaggccccagtcg

SEQ ID NO: 174097 - DNA, 20 bp, human
gggcagaggcaacttccaac

SEQ ID NO: 174098 - DNA, 20 bp, human
ggcaggtggctgccccgact

SEQ ID NO: 174099 - DNA, 20 bp, human
gctccgagcacgtatcaaag

SEQ ID NO: 174100 - DNA, 20 bp, human
ggaggagatcaacaacaagt

SEQ ID NO: 174101 - DNA, 20 bp, human
ggccgtttgaggagaacctg

SEQ ID NO: 174102 - DNA, 20 bp, human
gacgtgctcggagcctgtgg

SEQ ID NO: 174103 - DNA, 20 bp, human
gtacagaggtgggacggcct

SEQ ID NO: 174104 - DNA, 20 bp, human
gagccacctgccgtgcctgt

SEQ ID NO: 174105 - DNA, 20 bp, human
gtgtgcaccaggtacagagg

SEQ ID NO: 174106 - DNA, 20 bp, human
gagtcatcacaggcaaataa

SEQ ID NO: 174107 - DNA, 20 bp, human
gttagatcaggactcctctg

SEQ ID NO: 174108 - DNA, 20 bp, human
gtagctttcaaagtcatcac

SEQ ID NO: 174109 - DNA, 20 bp, human
gggaagaagactaacaataa

SEQ ID NO: 174110 - DNA, 20 bp, human
ggttctgagacagtcaaata

SEQ ID NO: 174111 - DNA, 20 bp, human
gctgagacagtcaaataagg

SEQ ID NO: 174112 - DNA, 20 bp, human
gaactgccagacaagaaaga

SEQ ID NO: 174113 - DNA, 20 bp, human
gcacagaaaaatggctccgc

SEQ ID NO: 174114 - DNA, 20 bp, human
ggatctccttctttcttgtc

SEQ ID NO: 174115 - DNA, 20 bp, human
ggatggcttttgcattttac

SEQ ID NO: 174116 - DNA, 20 bp, human
gtgcagaatgaggcatatat

SEQ ID NO: 174117 - DNA, 20 bp, human
gttgaagagcagaacaaata

SEQ ID NO: 174118 - DNA, 20 bp, human
gcgattggctttattctcac

SEQ ID NO: 174119 - DNA, 20 bp, human
ggcatatattggctgctcga

SEQ ID NO: 174120 - DNA, 20 bp, human
gatatgctacgtgtagtgga

SEQ ID NO: 174121 - DNA, 20 bp, human
ggcagatatgctacgtgtag

SEQ ID NO: 174122 - DNA, 20 bp, human
gtattcaattaggttaccgg

SEQ ID NO: 174123 - DNA, 20 bp, human
gtaccggaggcatatatatt

SEQ ID NO: 174124 - DNA, 20 bp, human
gtggtaatcaatcaagtatg

SEQ ID NO: 174125 - DNA, 20 bp, human
gaaccagagaaatatgtagt

SEQ ID NO: 174126 - DNA, 20 bp, human
ggacataaatatcttagcta

SEQ ID NO: 174127 - DNA, 20 bp, human
gcttggcaatctccagaatt

SEQ ID NO: 174128 - DNA, 20 bp, human
gagagtgaagatactcggca

SEQ ID NO: 174129 - DNA, 20 bp, human
ggaactccactggacactca

SEQ ID NO: 174130 - DNA, 20 bp, human
ggaaggaagaagaactccac

SEQ ID NO: 174131 - DNA, 20 bp, human
gttacaagagtgaagatact

SEQ ID NO: 174132 - DNA, 20 bp, human
gcacatccttgagtgtccag

SEQ ID NO: 174133 - DNA, 20 bp, human
ggatatttatgtcttcacca

SEQ ID NO: 174134 - DNA, 20 bp, human
gctccagaattgggctgatc

SEQ ID NO: 174135 - DNA, 20 bp, human
gtcccagatcagcccaattc

SEQ ID NO: 174136 - DNA, 20 bp, human
gtgctcttacaggcaatggg

SEQ ID NO: 174137 - DNA, 20 bp, human
ggcagtgatattagacattg

SEQ ID NO: 174138 - DNA, 20 bp, human
gggcatgctcttacaggcaa

SEQ ID NO: 174139 - DNA, 20 bp, human
gcattggggcatgctcttac

SEQ ID NO: 174140 - DNA, 20 bp, human
gctaaagtggagggttaaaa

SEQ ID NO: 174141 - DNA, 20 bp, human
gaagtggagggttaaaaagg

SEQ ID NO: 174142 - DNA, 20 bp, human
ggtgctgcttcttgtgactt

SEQ ID NO: 174143 - DNA, 20 bp, human
gttttctctacctaaagtgg

SEQ ID NO: 174144 - DNA, 20 bp, human
gttagtgtctggttagctac

SEQ ID NO: 174145 - DNA, 20 bp, human
gaagggaagaaagatctctt

SEQ ID NO: 174146 - DNA, 20 bp, human
gagaagacagtgagttggat

SEQ ID NO: 174147 - DNA, 20 bp, human
gagattcagagtctttgtcc

SEQ ID NO: 174148 - DNA, 20 bp, human
gtgatgagaatcatgtccac

SEQ ID NO: 174149 - DNA, 20 bp, human
gcaatttccaggtagagaat

SEQ ID NO: 174150 - DNA, 20 bp, human
ggcccagcactgcaacaatt

SEQ ID NO: 174151 - DNA, 20 bp, human
gtgtttccctggatattact

SEQ ID NO: 174152 - DNA, 20 bp, human
ggctgtttaaccagaatgta

SEQ ID NO: 174153 - DNA, 20 bp, human
gaccgtgttctactgcatca

SEQ ID NO: 174154 - DNA, 20 bp, human
gcaggaacccattctctacc

SEQ ID NO: 174155 - DNA, 20 bp, human
gctctcgcttctgtctacag

SEQ ID NO: 174156 - DNA, 20 bp, human
ggttaacatctggatgttaa

SEQ ID NO: 174157 - DNA, 20 bp, human
gattgttgcttctaatgcct

SEQ ID NO: 174158 - DNA, 20 bp, human
gaaacacagttgcataccaa

SEQ ID NO: 174159 - DNA, 20 bp, human
gctgggtcatgttattcctt

SEQ ID NO: 174160 - DNA, 20 bp, human
gccagtcaatgacatttact

SEQ ID NO: 174161 - DNA, 20 bp, human
gtgtttaattctgctttata

SEQ ID NO: 174162 - DNA, 20 bp, human
gtgaacagataaaaaaatgc

SEQ ID NO: 174163 - DNA, 20 bp, human
gttacaaatcagaaatacca

SEQ ID NO: 174164 - DNA, 20 bp, human
gaaatggttcgttacagccc

SEQ ID NO: 174165 - DNA, 20 bp, human
gactcttaattctcttcttt

SEQ ID NO: 174166 - DNA, 20 bp, human
gacacacgtatataaatgtg

SEQ ID NO: 174167 - DNA, 20 bp, human
gagttctggtgatagtgttg

SEQ ID NO: 174168 - DNA, 20 bp, human
gaaatgattggttactgccc

SEQ ID NO: 174169 - DNA, 20 bp, human
gtagtggttgcatttattct

SEQ ID NO: 174170 - DNA, 20 bp, human
ggcaataatttgatcagctg

SEQ ID NO: 174171 - DNA, 20 bp, human
gatcttttgtctcttgaccc

SEQ ID NO: 174172 - DNA, 20 bp, human
ggatcaaattattgctgctc

SEQ ID NO: 174173 - DNA, 20 bp, human
gtgtggacagaagaatgtga

SEQ ID NO: 174174 - DNA, 20 bp, human
gatgtgaaggaaacgtaact

SEQ ID NO: 174175 - DNA, 20 bp, human
gagccagatgctgaaatgat

SEQ ID NO: 174176 - DNA, 20 bp, human
gcttgagccagaggaatgtg

SEQ ID NO: 174177 - DNA, 20 bp, human
gctcaagtggagagtttcta

SEQ ID NO: 174178 - DNA, 20 bp, human
gagaatcaggaacaccccct

SEQ ID NO: 174179 - DNA, 20 bp, human
gacatgatgggactcaccga

SEQ ID NO: 174180 - DNA, 20 bp, human
gagtttctagggtgatggta

SEQ ID NO: 174181 - DNA, 20 bp, human
ggcctaattgctgacatgat

SEQ ID NO: 174182 - DNA, 20 bp, human
gtcccatcatgtcagcaatt

SEQ ID NO: 174183 - DNA, 20 bp, human
gatcctcaagagtgccaggg

SEQ ID NO: 174184 - DNA, 20 bp, human
gatgatcctcaagagtgcca

SEQ ID NO: 174185 - DNA, 20 bp, human
gtgatggtatggatgctgtt

SEQ ID NO: 174186 - DNA, 20 bp, human
gaaggaaaaattgcaaacac

SEQ ID NO: 174187 - DNA, 20 bp, human
gttagcgacttcagttgctt

SEQ ID NO: 174188 - DNA, 20 bp, human
gcaccatctgttcttgttat

SEQ ID NO: 174189 - DNA, 20 bp, human
gagcctataacaagaacaga

SEQ ID NO: 174190 - DNA, 20 bp, human
gctaaagacaaatgatggag

SEQ ID NO: 174191 - DNA, 20 bp, human
gagtcgctaaagacaaatga

SEQ ID NO: 174192 - DNA, 20 bp, human
gatgatggagaggttacaca

SEQ ID NO: 174193 - DNA, 20 bp, human
gaatgctggtgtaatatcac

SEQ ID NO: 174194 - DNA, 20 bp, human
ggtgatttctgacttgacac

SEQ ID NO: 174195 - DNA, 20 bp, human
gaatataaccactattagaa

SEQ ID NO: 174196 - DNA, 20 bp, human
gataatgtctgggcagtaac

SEQ ID NO: 174197 - DNA, 20 bp, human
gaatagaaccactaccacac

SEQ ID NO: 174198 - DNA, 20 bp, human
gaaaaaaattgttttaatgc

SEQ ID NO: 174199 - DNA, 20 bp, human
gtcattctggtgatgctgtt

SEQ ID NO: 174200 - DNA, 20 bp, human
gtgtctcttgacccgctcaa

SEQ ID NO: 174201 - DNA, 20 bp, human
gaaccggccatttcagcaac

SEQ ID NO: 174202 - DNA, 20 bp, human
gattttttccagtgtggtag

SEQ ID NO: 174203 - DNA, 20 bp, human
gttggtaaattccattgagc

SEQ ID NO: 174204 - DNA, 20 bp, human
gctggtgttgtgtccggagt

SEQ ID NO: 174205 - DNA, 20 bp, human
ggacaagccaaaaatagtaa

SEQ ID NO: 174206 - DNA, 20 bp, human
gcaggcagcaagccagaggt

SEQ ID NO: 174207 - DNA, 20 bp, human
gggagcagtaaagcaggctg

SEQ ID NO: 174208 - DNA, 20 bp, human
gtctgcactgggtggcaacc

SEQ ID NO: 174209 - DNA, 20 bp, human
gtgggatgtagtgaagaggc

SEQ ID NO: 174210 - DNA, 20 bp, human
ggacttcataggacacagtg

SEQ ID NO: 174211 - DNA, 20 bp, human
gtttacctttctgcactggg

SEQ ID NO: 174212 - DNA, 20 bp, human
ggttggctaatctaaagacc

SEQ ID NO: 174213 - DNA, 20 bp, human
gggtaagctggatagcactc

SEQ ID NO: 174214 - DNA, 20 bp, human
gtctacttctcttctctagt

SEQ ID NO: 174215 - DNA, 20 bp, human
gccagcttgccaagcagatc

SEQ ID NO: 174216 - DNA, 20 bp, human
ggtctgcccatcaaatgcta

SEQ ID NO: 174217 - DNA, 20 bp, human
ggagccaggcagcaaaccac

SEQ ID NO: 174218 - DNA, 20 bp, human
gcctcagtttgaggaaaagg

SEQ ID NO: 174219 - DNA, 20 bp, human
ggctgaatgggttcaaaata

SEQ ID NO: 174220 - DNA, 20 bp, human
gcatctccctagcatttgat

SEQ ID NO: 174221 - DNA, 20 bp, human
gaaaagggggtaggagaaat

SEQ ID NO: 174222 - DNA, 20 bp, human
gtccacaagtggcaggatcc

SEQ ID NO: 174223 - DNA, 20 bp, human
gcttagggaggttgagctga

SEQ ID NO: 174224 - DNA, 20 bp, human
gaattactggattgataccc

SEQ ID NO: 174225 - DNA, 20 bp, human
ggcttctctttggtgtctgg

SEQ ID NO: 174226 - DNA, 20 bp, human
gagcgtgatgtacaggcaag

SEQ ID NO: 174227 - DNA, 20 bp, human
gagcagcctggggatctttg

SEQ ID NO: 174228 - DNA, 20 bp, human
ggaagcatctttactcattg

SEQ ID NO: 174229 - DNA, 20 bp, human
gggagatattccgcttcagc

SEQ ID NO: 174230 - DNA, 20 bp, human
gcgtctcttcaaatacggaa

SEQ ID NO: 174231 - DNA, 20 bp, human
gattgaggattcagcagttg

SEQ ID NO: 174232 - DNA, 20 bp, human
gagtcccagcataagaaacc

SEQ ID NO: 174233 - DNA, 20 bp, human
gaacagaatcctatcagaag

SEQ ID NO: 174234 - DNA, 20 bp, human
gtttggactcgagcagtgtc

SEQ ID NO: 174235 - DNA, 20 bp, human
gtttgaagagacgaagtaga

SEQ ID NO: 174236 - DNA, 20 bp, human
gtcttcatcaggaagaacaa

SEQ ID NO: 174237 - DNA, 20 bp, human
gggatcaaagagaatggcaa

SEQ ID NO: 174238 - DNA, 20 bp, human
ggcgcagaaacctgaaagtc

SEQ ID NO: 174239 - DNA, 20 bp, human
gcaggcagcaaaccagagat

SEQ ID NO: 174240 - DNA, 20 bp, human
gcataatgcggtcaccagtg

SEQ ID NO: 174241 - DNA, 20 bp, human
gcagagcagttacccattct

SEQ ID NO: 174242 - DNA, 20 bp, human
gaggtttctgcgccaagaat

SEQ ID NO: 174243 - DNA, 20 bp, human
gcttctcaggctgtcagtgt

SEQ ID NO: 174244 - DNA, 20 bp, human
gccggaatagagtgcatcac

SEQ ID NO: 174245 - DNA, 20 bp, human
gggggcaaaacactccccac

SEQ ID NO: 174246 - DNA, 20 bp, human
gcagctgcaaaaccagaagg

SEQ ID NO: 174247 - DNA, 20 bp, human
ggagccagggcacccaccct

SEQ ID NO: 174248 - DNA, 20 bp, human
gtaatgaggatcatatccaa

SEQ ID NO: 174249 - DNA, 20 bp, human
ggcagggagtggctgcgata

SEQ ID NO: 174250 - DNA, 20 bp, human
gcaggaagtgccagtgtaga

SEQ ID NO: 174251 - DNA, 20 bp, human
gggttatgatgaaggagatc

SEQ ID NO: 174252 - DNA, 20 bp, human
gtgggtgccctggctcctgt

SEQ ID NO: 174253 - DNA, 20 bp, human
gagaaggtcgagtactctgg

SEQ ID NO: 174254 - DNA, 20 bp, human
gcaccttcctgtggctgaag

SEQ ID NO: 174255 - DNA, 20 bp, human
gaatccccagaagactcagc

SEQ ID NO: 174256 - DNA, 20 bp, human
gctggagatggccaccgaat

SEQ ID NO: 174257 - DNA, 20 bp, human
gattcatcatcagcatgctg

SEQ ID NO: 174258 - DNA, 20 bp, human
ggaagggatcaagaaccaaa

SEQ ID NO: 174259 - DNA, 20 bp, human
ggtttttcctagtctatatg

SEQ ID NO: 174260 - DNA, 20 bp, human
gtatataccacatatagact

SEQ ID NO: 174261 - DNA, 20 bp, human
gcttaggcaggtggcaagcc

SEQ ID NO: 174262 - DNA, 20 bp, human
ggggaatgtgttcattggac

SEQ ID NO: 174263 - DNA, 20 bp, human
gaagattttgtccaattcgg

SEQ ID NO: 174264 - DNA, 20 bp, human
ggactaatcacttgacaacc

SEQ ID NO: 174265 - DNA, 20 bp, human
ggtcagctgagaagaccttt

SEQ ID NO: 174266 - DNA, 20 bp, human
gaatgtaaccactaccagac

SEQ ID NO: 174267 - DNA, 20 bp, human
gactactgcttataatatct

SEQ ID NO: 174268 - DNA, 20 bp, human
gcattctggtgatgttgttg

SEQ ID NO: 174269 - DNA, 20 bp, human
gattttttccagtctggtag

SEQ ID NO: 174270 - DNA, 20 bp, human
gctgggtattattattaaac

SEQ ID NO: 174271 - DNA, 20 bp, human
gcttctacactattaaaagc

SEQ ID NO: 174272 - DNA, 20 bp, human
gtaaatgctggtgttgtgtc

SEQ ID NO: 174273 - DNA, 20 bp, human
gagcaaataaaatatgctga

SEQ ID NO: 174274 - DNA, 20 bp, human
ggatcaaccatttcagcaac

SEQ ID NO: 174275 - DNA, 20 bp, human
gcccatcattttttccagtc

SEQ ID NO: 174276 - DNA, 20 bp, human
gaattactgcttacaatgtc

SEQ ID NO: 174277 - DNA, 20 bp, human
gatatgaaggaaacatgact

SEQ ID NO: 174278 - DNA, 20 bp, human
ggacaaaccaaaaatagcaa

SEQ ID NO: 174279 - DNA, 20 bp, human
gaaacatgaatcagattata

SEQ ID NO: 174280 - DNA, 20 bp, human
gttgttctggtgatactatt

SEQ ID NO: 174281 - DNA, 20 bp, human
gtgtctcttgaaccactcaa

SEQ ID NO: 174282 - DNA, 20 bp, human
gtagtggttacatttgtgat

SEQ ID NO: 174283 - DNA, 20 bp, human
gaatgtaaccactattagaa

SEQ ID NO: 174284 - DNA, 20 bp, human
gattttttccattctaatag

SEQ ID NO: 174285 - DNA, 20 bp, human
gctgggtattagtattaaat

SEQ ID NO: 174286 - DNA, 20 bp, human
ggacagattacggaaggacg

SEQ ID NO: 174287 - DNA, 20 bp, human
gtggctgaggtcagatcccc

SEQ ID NO: 174288 - DNA, 20 bp, human
gctcgcttgaagacagatta

SEQ ID NO: 174289 - DNA, 20 bp, human
gcttgaagacagattacgga

SEQ ID NO: 174290 - DNA, 20 bp, human
gctggtagtgataacacacc

SEQ ID NO: 174291 - DNA, 20 bp, human
gaagtaggccgggcgatcga

SEQ ID NO: 174292 - DNA, 20 bp, human
gactaagatagcgaagccaa

SEQ ID NO: 174293 - DNA, 20 bp, human
gaaggtggcaaaccataagc

SEQ ID NO: 174294 - DNA, 20 bp, human
gagactgaacagctgtgatg

SEQ ID NO: 174295 - DNA, 20 bp, human
gggtaagccaggccagctta

SEQ ID NO: 174296 - DNA, 20 bp, human
gaatcacaaccagtgatatt

SEQ ID NO: 174297 - DNA, 20 bp, human
gcatcttcttgtggcaaaca

SEQ ID NO: 174298 - DNA, 20 bp, human
gattacttcttataatgcct

SEQ ID NO: 174299 - DNA, 20 bp, human
gactggtaaatttcattgac

SEQ ID NO: 174300 - DNA, 20 bp, human
gaatgcaagcctaatatcac

SEQ ID NO: 174301 - DNA, 20 bp, human
gaaatgaagaaaaagaaggt

SEQ ID NO: 174302 - DNA, 20 bp, human
gtctttttcttcatttaaag

SEQ ID NO: 174303 - DNA, 20 bp, human
gtttttttcaattctaataa

SEQ ID NO: 174304 - DNA, 20 bp, human
gttggggactttgatatttt

SEQ ID NO: 174305 - DNA, 20 bp, human
gtcatttaaagaggagagtt

SEQ ID NO: 174306 - DNA, 20 bp, human
gcaggtagaggaccataagg

SEQ ID NO: 174307 - DNA, 20 bp, human
gagccaggtagaggaccata

SEQ ID NO: 174308 - DNA, 20 bp, human
gtgtccaccagagagatgaa

SEQ ID NO: 174309 - DNA, 20 bp, human
ggacaagaaggccatcatct

SEQ ID NO: 174310 - DNA, 20 bp, human
gcagagctgaagagcatcca

SEQ ID NO: 174311 - DNA, 20 bp, human
ggatgctcttcagctctgta

SEQ ID NO: 174312 - DNA, 20 bp, human
ggctaaagcacaagttgtct

SEQ ID NO: 174313 - DNA, 20 bp, human
ggttgtctgggtggctacca

SEQ ID NO: 174314 - DNA, 20 bp, human
gtctctctggtggacaagat

SEQ ID NO: 174315 - DNA, 20 bp, human
gacagaagcgagaggcccct

SEQ ID NO: 174316 - DNA, 20 bp, human
gcttcatccagaggaaaagt

SEQ ID NO: 174317 - DNA, 20 bp, human
gatgaagtggagaattgaca

SEQ ID NO: 174318 - DNA, 20 bp, human
ggatttcctggattctactg

SEQ ID NO: 174319 - DNA, 20 bp, human
gacgcaccccagtagaatcc

SEQ ID NO: 174320 - DNA, 20 bp, human
gaaaatctaagaagcaggtg

SEQ ID NO: 174321 - DNA, 20 bp, human
ggtggatgtcaaactccatc

SEQ ID NO: 174322 - DNA, 20 bp, human
gtaccagtggcatagacatc

SEQ ID NO: 174323 - DNA, 20 bp, human
gtagtttctagttgacctga

SEQ ID NO: 174324 - DNA, 20 bp, human
ggtgaggattaaatcaatgg

SEQ ID NO: 174325 - DNA, 20 bp, human
gattctcatttctttaccag

SEQ ID NO: 174326 - DNA, 20 bp, human
ggagtgatacctgaaatgtt

SEQ ID NO: 174327 - DNA, 20 bp, human
gggcgataactaaattggta

SEQ ID NO: 174328 - DNA, 20 bp, human
ggtaaggatgtagtcaactg

SEQ ID NO: 174329 - DNA, 20 bp, human
gactagtcaactggattgac

SEQ ID NO: 174330 - DNA, 20 bp, human
gattctggcgataactaaat

SEQ ID NO: 174331 - DNA, 20 bp, human
gtaactggagaattcatact

SEQ ID NO: 174332 - DNA, 20 bp, human
gaatctctttgaatttgcat

SEQ ID NO: 174333 - DNA, 20 bp, human
gacactgatcaaacaaattc

SEQ ID NO: 174334 - DNA, 20 bp, human
ggaggagagctgaacacttc

SEQ ID NO: 174335 - DNA, 20 bp, human
gatttgtttgatcagtgtaa

SEQ ID NO: 174336 - DNA, 20 bp, human
gggcatgccaagtgcaatag

SEQ ID NO: 174337 - DNA, 20 bp, human
ggagtaaatagaagatactg

SEQ ID NO: 174338 - DNA, 20 bp, human
gcagatacattgttcttcac

SEQ ID NO: 174339 - DNA, 20 bp, human
gaactatatcatggtctaag

SEQ ID NO: 174340 - DNA, 20 bp, human
ggataaagacaactatatca

SEQ ID NO: 174341 - DNA, 20 bp, human
gctgaagctaaagatcaaca

SEQ ID NO: 174342 - DNA, 20 bp, human
gcatgcttgcgattcttctg

SEQ ID NO: 174343 - DNA, 20 bp, human
gacacacagcagacagattc

SEQ ID NO: 174344 - DNA, 20 bp, human
gaaaaatgggtgcgatatat

SEQ ID NO: 174345 - DNA, 20 bp, human
gagcagacagattctggaga

SEQ ID NO: 174346 - DNA, 20 bp, human
gcgcggacagcgtgggaaag

SEQ ID NO: 174347 - DNA, 20 bp, human
gcctagagcgaccaagacta

SEQ ID NO: 174348 - DNA, 20 bp, human
ggaaggctcggggctgaagc

SEQ ID NO: 174349 - DNA, 20 bp, human
gggacgccaagccggagatg

SEQ ID NO: 174350 - DNA, 20 bp, human
gactacttccggtgcagtga

SEQ ID NO: 174351 - DNA, 20 bp, human
gaggcctgatgagagtcctg

SEQ ID NO: 174352 - DNA, 20 bp, human
gacgggcgggtgactacttc

SEQ ID NO: 174353 - DNA, 20 bp, human
ggaccaagactagggaacta

SEQ ID NO: 174354 - DNA, 20 bp, human
ggacccgcaggactctcatc

SEQ ID NO: 174355 - DNA, 20 bp, human
gccccgagccttcactgcac

SEQ ID NO: 174356 - DNA, 20 bp, human
gcctgtcaaagaagagctaa

SEQ ID NO: 174357 - DNA, 20 bp, human
gcttctttgacaggttacag

SEQ ID NO: 174358 - DNA, 20 bp, human
gttcggggttggcttcttgg

SEQ ID NO: 174359 - DNA, 20 bp, human
ggcccaagctgatcaggcag

SEQ ID NO: 174360 - DNA, 20 bp, human
gctaagggagctttcggggt

SEQ ID NO: 174361 - DNA, 20 bp, human
gagagctaagggagctttcg

SEQ ID NO: 174362 - DNA, 20 bp, human
gaccactgcctgatcagctt

SEQ ID NO: 174363 - DNA, 20 bp, human
gagcatggttaagctttgac

SEQ ID NO: 174364 - DNA, 20 bp, human
ggaacccattctacttaagt

SEQ ID NO: 174365 - DNA, 20 bp, human
gtggataggctcgcatggaa

SEQ ID NO: 174366 - DNA, 20 bp, human
ggcactggcctaggaacaca

SEQ ID NO: 174367 - DNA, 20 bp, human
ggacaagtcagaaagaccca

SEQ ID NO: 174368 - DNA, 20 bp, human
gagggccgggaggtgcacgt

SEQ ID NO: 174369 - DNA, 20 bp, human
ggttagtgagcgcctcaagt

SEQ ID NO: 174370 - DNA, 20 bp, human
gtcccgggcgtcggtcacca

SEQ ID NO: 174371 - DNA, 20 bp, human
ggcggtcagcctctccgcca

SEQ ID NO: 174372 - DNA, 20 bp, human
gtcagaaagacccaagggcg

SEQ ID NO: 174373 - DNA, 20 bp, human
ggaggtgcacgtgggatgaa

SEQ ID NO: 174374 - DNA, 20 bp, human
gtggtgatgacagtacaact

SEQ ID NO: 174375 - DNA, 20 bp, human
ggtgaattggtccccagaag

SEQ ID NO: 174376 - DNA, 20 bp, human
gccgcagggctcgttccgga

SEQ ID NO: 174377 - DNA, 20 bp, human
ggcaggccggagagcgacag

SEQ ID NO: 174378 - DNA, 20 bp, human
gcgggccaggcggggctgta

SEQ ID NO: 174379 - DNA, 20 bp, human
ggtagcgctgggcaaagtga

SEQ ID NO: 174380 - DNA, 20 bp, human
gggagtggtcgcagttcggg

SEQ ID NO: 174381 - DNA, 20 bp, human
gcgtagccccggaagcgctt

SEQ ID NO: 174382 - DNA, 20 bp, human
ggtggtcgcagttcgggcgg

SEQ ID NO: 174383 - DNA, 20 bp, human
ggcatctccgaagtagcgct

SEQ ID NO: 174384 - DNA, 20 bp, human
ggccggagtggtcgcagttc

SEQ ID NO: 174385 - DNA, 20 bp, human
gagggctcgttccggagggc

SEQ ID NO: 174386 - DNA, 20 bp, human
gtctgctggccggtctaaag

SEQ ID NO: 174387 - DNA, 20 bp, human
ggaccgcttcccacaaagag

SEQ ID NO: 174388 - DNA, 20 bp, human
gacgcggtcaaagtccgggg

SEQ ID NO: 174389 - DNA, 20 bp, human
gcatacgcggtcaaagtccg

SEQ ID NO: 174390 - DNA, 20 bp, human
gcaatgcgagcggctggcgt

SEQ ID NO: 174391 - DNA, 20 bp, human
gaggaggtgagagccccgag

SEQ ID NO: 174392 - DNA, 20 bp, human
gcgccggggcgcaatgcgag

SEQ ID NO: 174393 - DNA, 20 bp, human
ggcggctggcgtaggcttgg

SEQ ID NO: 174394 - DNA, 20 bp, human
gggaaaaacaggccagccaa

SEQ ID NO: 174395 - DNA, 20 bp, human
ggagccccgaggggaaaaac

SEQ ID NO: 174396 - DNA, 20 bp, human
gatgatagcaactaatggag

SEQ ID NO: 174397 - DNA, 20 bp, human
gatgaataagcagctaatct

SEQ ID NO: 174398 - DNA, 20 bp, human
ggtatatgtcaatgtagttg

SEQ ID NO: 174399 - DNA, 20 bp, human
gtaacaatgatagcaactaa

SEQ ID NO: 174400 - DNA, 20 bp, human
gttatgcttgttttaggatt

SEQ ID NO: 174401 - DNA, 20 bp, human
gatatttgtaattgctcttt

SEQ ID NO: 174402 - DNA, 20 bp, human
ggcttattcatctaaaataa

SEQ ID NO: 174403 - DNA, 20 bp, human
gatagcaactaatggagtgg

SEQ ID NO: 174404 - DNA, 20 bp, human
gataaactactgaaacatca

SEQ ID NO: 174405 - DNA, 20 bp, human
gtaggatttggatgatgtgt

SEQ ID NO: 174406 - DNA, 20 bp, human
gagtggcggaagaggttcgg

SEQ ID NO: 174407 - DNA, 20 bp, human
gggtagtggcggaagaggtt

SEQ ID NO: 174408 - DNA, 20 bp, human
gtaggcggtagtggcggaag

SEQ ID NO: 174409 - DNA, 20 bp, human
gaggtgtagccggtctttgg

SEQ ID NO: 174410 - DNA, 20 bp, human
gtgggggtaggcggtagtgg

SEQ ID NO: 174411 - DNA, 20 bp, human
gctttgggggtaggcggtag

SEQ ID NO: 174412 - DNA, 20 bp, human
gccaggcccctacagtacag

SEQ ID NO: 174413 - DNA, 20 bp, human
ggaggttcggcggctgatgg

SEQ ID NO: 174414 - DNA, 20 bp, human
gcacgcggtgggaggcccgt

SEQ ID NO: 174415 - DNA, 20 bp, human
gtgtccaaggctaaactctg

SEQ ID NO: 174416 - DNA, 20 bp, human
ggcgctgggcgaccagagca

SEQ ID NO: 174417 - DNA, 20 bp, human
gtgctgccggcttctcggag

SEQ ID NO: 174418 - DNA, 20 bp, human
ggccggcagcagagtacccg

SEQ ID NO: 174419 - DNA, 20 bp, human
gcagcgccgctccgagaagc

SEQ ID NO: 174420 - DNA, 20 bp, human
gagcgcactcaccaccacgg

SEQ ID NO: 174421 - DNA, 20 bp, human
gggacatctcgaccctgctc

SEQ ID NO: 174422 - DNA, 20 bp, human
gaccggctggcccgggatgt

SEQ ID NO: 174423 - DNA, 20 bp, human
ggcaagcgcactcaccacca

SEQ ID NO: 174424 - DNA, 20 bp, human
gggcctccgtgtccccagac

SEQ ID NO: 174425 - DNA, 20 bp, human
ggactcatggacgtcgggat

SEQ ID NO: 174426 - DNA, 20 bp, human
ggtcgaggtcgcagacctag

SEQ ID NO: 174427 - DNA, 20 bp, human
gtccgtgcgcgggccagtca

SEQ ID NO: 174428 - DNA, 20 bp, human
gcggccggaggtgggactta

SEQ ID NO: 174429 - DNA, 20 bp, human
ggcgtcgtcatgggcttggt

SEQ ID NO: 174430 - DNA, 20 bp, human
gtactctggcggggaaggag

SEQ ID NO: 174431 - DNA, 20 bp, human
gccgtgggcgcgctgcggaa

SEQ ID NO: 174432 - DNA, 20 bp, human
gcggaggtgggacttagggt

SEQ ID NO: 174433 - DNA, 20 bp, human
gctgcggaacgggaggaaac

SEQ ID NO: 174434 - DNA, 20 bp, human
gccagggtccaggtgagcgg

SEQ ID NO: 174435 - DNA, 20 bp, human
gcgccggggtcacaggccgt

SEQ ID NO: 174436 - DNA, 20 bp, human
gccaaagcagtaggtgccag

SEQ ID NO: 174437 - DNA, 20 bp, human
gtggtctctgggaaaaaact

SEQ ID NO: 174438 - DNA, 20 bp, human
gcaggtgggcccactgccag

SEQ ID NO: 174439 - DNA, 20 bp, human
gggatgccagctccctgata

SEQ ID NO: 174440 - DNA, 20 bp, human
gtggggtcctcaatgcccgg

SEQ ID NO: 174441 - DNA, 20 bp, human
gctctttctggtttcagata

SEQ ID NO: 174442 - DNA, 20 bp, human
gggagctggcatccatttga

SEQ ID NO: 174443 - DNA, 20 bp, human
ggcctttggactgaaggagg

SEQ ID NO: 174444 - DNA, 20 bp, human
gggatcaccagttctttctg

SEQ ID NO: 174445 - DNA, 20 bp, human
gttcagagctcctcaggaag

SEQ ID NO: 174446 - DNA, 20 bp, human
gctggaggcgaggggaagac

SEQ ID NO: 174447 - DNA, 20 bp, human
gggaccgagtggggagatcc

SEQ ID NO: 174448 - DNA, 20 bp, human
gcgaggccagggtctctcgg

SEQ ID NO: 174449 - DNA, 20 bp, human
gtcccctccgcggccaggcg

SEQ ID NO: 174450 - DNA, 20 bp, human
gaccctgctggctcctctcg

SEQ ID NO: 174451 - DNA, 20 bp, human
gacaggtaaggcgcttcctg

SEQ ID NO: 174452 - DNA, 20 bp, human
gggagcagcagccgaagagg

SEQ ID NO: 174453 - DNA, 20 bp, human
gccaggagcagcagccgaag

SEQ ID NO: 174454 - DNA, 20 bp, human
gagctccccggggaccgagt

SEQ ID NO: 174455 - DNA, 20 bp, human
gaccctggcctcgcgtccgt

SEQ ID NO: 174456 - DNA, 20 bp, human
gtcgtcggtggttgcggcgt

SEQ ID NO: 174457 - DNA, 20 bp, human
gctgggatggcgaagagcaa

SEQ ID NO: 174458 - DNA, 20 bp, human
ggaagagcaacggagagaat

SEQ ID NO: 174459 - DNA, 20 bp, human
ggcccgtccgccccctgggt

SEQ ID NO: 174460 - DNA, 20 bp, human
gggaagtaggactgcgaagg

SEQ ID NO: 174461 - DNA, 20 bp, human
gagcgggtcagtctgtccgg

SEQ ID NO: 174462 - DNA, 20 bp, human
gcgccccctgggtcggaagt

SEQ ID NO: 174463 - DNA, 20 bp, human
gcagtctgtccggagggtgg

SEQ ID NO: 174464 - DNA, 20 bp, human
ggtcctacttccgacccagg

SEQ ID NO: 174465 - DNA, 20 bp, human
gagtaggactgcgaaggggg

SEQ ID NO: 174466 - DNA, 20 bp, human
ggcagactcgccgaagacag

SEQ ID NO: 174467 - DNA, 20 bp, human
gccgggacctccagtgacta

SEQ ID NO: 174468 - DNA, 20 bp, human
gtcgagggctctggccgcag

SEQ ID NO: 174469 - DNA, 20 bp, human
ggtgtgcgcaggcgcgaggt

SEQ ID NO: 174470 - DNA, 20 bp, human
ggcgaggccagccgagaaag

SEQ ID NO: 174471 - DNA, 20 bp, human
gccgaagtggccgtagtcac

SEQ ID NO: 174472 - DNA, 20 bp, human
gggcgcggcggggccaccag

SEQ ID NO: 174473 - DNA, 20 bp, human
gtggcgcggagccggctctg

SEQ ID NO: 174474 - DNA, 20 bp, human
gggctcgcccccaagcagga

SEQ ID NO: 174475 - DNA, 20 bp, human
gtgcgcaggcgcgaggtcgg

SEQ ID NO: 174476 - DNA, 20 bp, human
ggaaaagccaggcctctgtc

SEQ ID NO: 174477 - DNA, 20 bp, human
gcgggagtggcccctcacac

SEQ ID NO: 174478 - DNA, 20 bp, human
gggaggtgaggtgctgcggg

SEQ ID NO: 174479 - DNA, 20 bp, human
gccggggccttcgatgccac

SEQ ID NO: 174480 - DNA, 20 bp, human
gctgagggctgaattctgga

SEQ ID NO: 174481 - DNA, 20 bp, human
gtcagcagagccagggtaag

SEQ ID NO: 174482 - DNA, 20 bp, human
gtggcggaatgctgggacag

SEQ ID NO: 174483 - DNA, 20 bp, human
gtgagggctggcggaatgct

SEQ ID NO: 174484 - DNA, 20 bp, human
gatcgccaggccgaccgcta

SEQ ID NO: 174485 - DNA, 20 bp, human
ggcggtcggcctggcgatat

SEQ ID NO: 174486 - DNA, 20 bp, human
gggaggcaaagaaggactac

SEQ ID NO: 174487 - DNA, 20 bp, human
ggctcgggctccaaacaccg

SEQ ID NO: 174488 - DNA, 20 bp, human
gggcacgaaggcatgaccaa

SEQ ID NO: 174489 - DNA, 20 bp, human
gccctcggcagccccacgat

SEQ ID NO: 174490 - DNA, 20 bp, human
gcaggcaggcgtccgatcgt

SEQ ID NO: 174491 - DNA, 20 bp, human
gggacccaccatctgggggt

SEQ ID NO: 174492 - DNA, 20 bp, human
gcttggccagagaacagctc

SEQ ID NO: 174493 - DNA, 20 bp, human
gggtgggtctgggaacgttg

SEQ ID NO: 174494 - DNA, 20 bp, human
gcctccggacccaccatctg

SEQ ID NO: 174495 - DNA, 20 bp, human
gcctcgtcagcctcctccgg

SEQ ID NO: 174496 - DNA, 20 bp, human
gctgcacaagagccggtaag

SEQ ID NO: 174497 - DNA, 20 bp, human
ggggaagcgcgggtgtggcc

SEQ ID NO: 174498 - DNA, 20 bp, human
ggcagaagcagtgacatcag

SEQ ID NO: 174499 - DNA, 20 bp, human
ggtgcacttggagagagtac

SEQ ID NO: 174500 - DNA, 20 bp, human
gggctgcaggaacgacggag

SEQ ID NO: 174501 - DNA, 20 bp, human
ggagagagtacgggagcagg

SEQ ID NO: 174502 - DNA, 20 bp, human
gtctggatgaggaagactca

SEQ ID NO: 174503 - DNA, 20 bp, human
ggagcagggggatcaaaagg

SEQ ID NO: 174504 - DNA, 20 bp, human
gctgtgggctgcaggaacga

SEQ ID NO: 174505 - DNA, 20 bp, human
gctcttgtgcagacttgaca

SEQ ID NO: 174506 - DNA, 20 bp, human
ggcggctccgacgccatccc

SEQ ID NO: 174507 - DNA, 20 bp, human
gcccccggaagagggacagc

SEQ ID NO: 174508 - DNA, 20 bp, human
gaggacgccgggcacgcggt

SEQ ID NO: 174509 - DNA, 20 bp, human
gccgggcacgcggtaggcag

SEQ ID NO: 174510 - DNA, 20 bp, human
gagcagcccgcggcgaacag

SEQ ID NO: 174511 - DNA, 20 bp, human
gaggctcccggcctgagaag

SEQ ID NO: 174512 - DNA, 20 bp, human
gctcgcgcgacgaggacgcc

SEQ ID NO: 174513 - DNA, 20 bp, human
gcgccccggaggccccgtaa

SEQ ID NO: 174514 - DNA, 20 bp, human
ggactcggcggccctcgcgg

SEQ ID NO: 174515 - DNA, 20 bp, human
gggcgactctcgggactcgg

SEQ ID NO: 174516 - DNA, 20 bp, human
ggtgttgtgagcgggaaggt

SEQ ID NO: 174517 - DNA, 20 bp, human
ggcacgcgcaggaaacatgg

SEQ ID NO: 174518 - DNA, 20 bp, human
gacggcctccaggaagacct

SEQ ID NO: 174519 - DNA, 20 bp, human
ggcgggtgttgtgagcggga

SEQ ID NO: 174520 - DNA, 20 bp, human
gagccggctctataactccg

SEQ ID NO: 174521 - DNA, 20 bp, human
gcaggcacgcgcaggaaaca

SEQ ID NO: 174522 - DNA, 20 bp, human
gagaaaagccgaggtcttcc

SEQ ID NO: 174523 - DNA, 20 bp, human
gccgtcccagagaaaagccg

SEQ ID NO: 174524 - DNA, 20 bp, human
gtctgtaggagaagactggg

SEQ ID NO: 174525 - DNA, 20 bp, human
ggaggagctgaatagatgct

SEQ ID NO: 174526 - DNA, 20 bp, human
ggcgaatccggcccccgcag

SEQ ID NO: 174527 - DNA, 20 bp, human
gccccgccgcgcctcactgg

SEQ ID NO: 174528 - DNA, 20 bp, human
gcgccgcgcctcactggcgg

SEQ ID NO: 174529 - DNA, 20 bp, human
gccccgcagcgggacccggg

SEQ ID NO: 174530 - DNA, 20 bp, human
gacccacccgggtcccgctg

SEQ ID NO: 174531 - DNA, 20 bp, human
gccggtccaccgctccagac

SEQ ID NO: 174532 - DNA, 20 bp, human
gagacggatgagaacttgtg

SEQ ID NO: 174533 - DNA, 20 bp, human
ggctgaatcggcggagcaga

SEQ ID NO: 174534 - DNA, 20 bp, human
gctcggagccggcgcgaatc

SEQ ID NO: 174535 - DNA, 20 bp, human
gccggaatgggcctaattcg

SEQ ID NO: 174536 - DNA, 20 bp, human
gtgtcctagggtaaggaggg

SEQ ID NO: 174537 - DNA, 20 bp, human
gctgcactgggctcctgtag

SEQ ID NO: 174538 - DNA, 20 bp, human
gacgtcattgtcctagggta

SEQ ID NO: 174539 - DNA, 20 bp, human
gcttcggcggcgactatgga

SEQ ID NO: 174540 - DNA, 20 bp, human
ggtgtgggaactggaatgag

SEQ ID NO: 174541 - DNA, 20 bp, human
gcattgtcctagggtaagga

SEQ ID NO: 174542 - DNA, 20 bp, human
gggctacagggtaagcactg

SEQ ID NO: 174543 - DNA, 20 bp, human
gaaacaccacctgagttggg

SEQ ID NO: 174544 - DNA, 20 bp, human
gcgctggttccccccaactc

SEQ ID NO: 174545 - DNA, 20 bp, human
gccagcctggggagccaata

SEQ ID NO: 174546 - DNA, 20 bp, human
gggctaccgggtcccactca

SEQ ID NO: 174547 - DNA, 20 bp, human
gcagcttgcaccggacaggg

SEQ ID NO: 174548 - DNA, 20 bp, human
gagtgtcactggccctgagt

SEQ ID NO: 174549 - DNA, 20 bp, human
ggcggagcgaacgggctacc

SEQ ID NO: 174550 - DNA, 20 bp, human
gactggccctgagtgggacc

SEQ ID NO: 174551 - DNA, 20 bp, human
gttgcaccggacagggaggt

SEQ ID NO: 174552 - DNA, 20 bp, human
gggtcccggagaagtgtcac

SEQ ID NO: 174553 - DNA, 20 bp, human
ggcacagcttgcaccggaca

SEQ ID NO: 174554 - DNA, 20 bp, human
ggaggagtcccagtgtaata

SEQ ID NO: 174555 - DNA, 20 bp, human
gcggcaggcctgggtaagtg

SEQ ID NO: 174556 - DNA, 20 bp, human
gcaaatctcggagactcggc

SEQ ID NO: 174557 - DNA, 20 bp, human
ggagactgcggagggacgag

SEQ ID NO: 174558 - DNA, 20 bp, human
gtaaggcggacgctgaggag

SEQ ID NO: 174559 - DNA, 20 bp, human
gtcggcgggcagcttcccaa

SEQ ID NO: 174560 - DNA, 20 bp, human
gagaggtcgatgctgtccaa

SEQ ID NO: 174561 - DNA, 20 bp, human
gcgctgccagccggagactg

SEQ ID NO: 174562 - DNA, 20 bp, human
gttcccaaagggagacacct

SEQ ID NO: 174563 - DNA, 20 bp, human
ggcagactcttcggacccag

SEQ ID NO: 174564 - DNA, 20 bp, human
gtgccagccggagactgcgg

SEQ ID NO: 174565 - DNA, 20 bp, human
ggggacaaatctcggagact

SEQ ID NO: 174566 - DNA, 20 bp, human
ggcgccgctggccgacggag

SEQ ID NO: 174567 - DNA, 20 bp, human
gggagcctgccgatgccgag

SEQ ID NO: 174568 - DNA, 20 bp, human
gcgtagcacccgctcggcat

SEQ ID NO: 174569 - DNA, 20 bp, human
ggaagacgcggctccgaccg

SEQ ID NO: 174570 - DNA, 20 bp, human
ggagcgggtgctacgtcccg

SEQ ID NO: 174571 - DNA, 20 bp, human
ggggtgccgagctgacccga

SEQ ID NO: 174572 - DNA, 20 bp, human
ggcccagggcacgtctgatg

SEQ ID NO: 174573 - DNA, 20 bp, human
gtccagatggaagaaagccg

SEQ ID NO: 174574 - DNA, 20 bp, human
ggcacccgctcggcatcggc

SEQ ID NO: 174575 - DNA, 20 bp, human
ggggtgctacgtcccgcggt

SEQ ID NO: 174576 - DNA, 20 bp, human
gtggtcccagtgccaaccag

SEQ ID NO: 174577 - DNA, 20 bp, human
ggccggctctgttcaagtgt

SEQ ID NO: 174578 - DNA, 20 bp, human
gggagcagccagttcctcct

SEQ ID NO: 174579 - DNA, 20 bp, human
gggctctgttcaagtgtggg

SEQ ID NO: 174580 - DNA, 20 bp, human
gggagatgggttgcattccc

SEQ ID NO: 174581 - DNA, 20 bp, human
gaaaggattaagcatcacta

SEQ ID NO: 174582 - DNA, 20 bp, human
gtgttcaagtgtgggaggtc

SEQ ID NO: 174583 - DNA, 20 bp, human
gatgcaacccatctccgaaa

SEQ ID NO: 174584 - DNA, 20 bp, human
gccaagtgagttctgatcag

SEQ ID NO: 174585 - DNA, 20 bp, human
gaacatagaaggtggagcaa

SEQ ID NO: 174586 - DNA, 20 bp, human
gagcagtgaggggccacccg

SEQ ID NO: 174587 - DNA, 20 bp, human
gtggagtcccgggagcagtg

SEQ ID NO: 174588 - DNA, 20 bp, human
gcacaggaaagggccgctag

SEQ ID NO: 174589 - DNA, 20 bp, human
gatcgaggcttgcaaggacg

SEQ ID NO: 174590 - DNA, 20 bp, human
gctctaggctctggagtccc

SEQ ID NO: 174591 - DNA, 20 bp, human
ggtggctgcacgtaggatcg

SEQ ID NO: 174592 - DNA, 20 bp, human
gcgtaggcacaacttccgga

SEQ ID NO: 174593 - DNA, 20 bp, human
ggaggcttgcaaggacgagg

SEQ ID NO: 174594 - DNA, 20 bp, human
gggaaagggccgctagggga

SEQ ID NO: 174595 - DNA, 20 bp, human
gaggaggcggaagagcttct

SEQ ID NO: 174596 - DNA, 20 bp, human
ggctgggagcgggtgaccgg

SEQ ID NO: 174597 - DNA, 20 bp, human
gggtgtagaccggggtctgg

SEQ ID NO: 174598 - DNA, 20 bp, human
gtcaggaggggtgacctcag

SEQ ID NO: 174599 - DNA, 20 bp, human
gcaggacgctgagagggata

SEQ ID NO: 174600 - DNA, 20 bp, human
gtggatgtgggtgtagaccg

SEQ ID NO: 174601 - DNA, 20 bp, human
gcccagaccccgcaatctga

SEQ ID NO: 174602 - DNA, 20 bp, human
ggggacgccatcttggatgt

SEQ ID NO: 174603 - DNA, 20 bp, human
gcagggattaggatctggaa

SEQ ID NO: 174604 - DNA, 20 bp, human
gtgagcccaggacgctgaga

SEQ ID NO: 174605 - DNA, 20 bp, human
gaggggtgacctcagcggga

SEQ ID NO: 174606 - DNA, 20 bp, human
gacgtggacgtcaacagcaa

SEQ ID NO: 174607 - DNA, 20 bp, human
gagccgtcgccgctcgacgt

SEQ ID NO: 174608 - DNA, 20 bp, human
gtggacgtcaacagcaatgg

SEQ ID NO: 174609 - DNA, 20 bp, human
gcgccgctcgacgttggcag

SEQ ID NO: 174610 - DNA, 20 bp, human
ggcgtcggcatggaacggag

SEQ ID NO: 174611 - DNA, 20 bp, human
gcctcaggcgaaggtcgcag

SEQ ID NO: 174612 - DNA, 20 bp, human
gcccagctggcagaggggta

SEQ ID NO: 174613 - DNA, 20 bp, human
gagtcccgccccagtccctt

SEQ ID NO: 174614 - DNA, 20 bp, human
gcagtcccttgggcagaacc

SEQ ID NO: 174615 - DNA, 20 bp, human
gcgccgctgccaacgtcgag

SEQ ID NO: 174616 - DNA, 20 bp, human
ggggccgctgcaggtccaca

SEQ ID NO: 174617 - DNA, 20 bp, human
ggaaagcggcgcgcggaggt

SEQ ID NO: 174618 - DNA, 20 bp, human
ggtgcgcagaaaggccggcg

SEQ ID NO: 174619 - DNA, 20 bp, human
ggggtcggaaatcctcttgg

SEQ ID NO: 174620 - DNA, 20 bp, human
gcccagggcatggtgtcgtc

SEQ ID NO: 174621 - DNA, 20 bp, human
ggcagggtcggaaatcctct

SEQ ID NO: 174622 - DNA, 20 bp, human
gggcgtgtgtcatccctggg

SEQ ID NO: 174623 - DNA, 20 bp, human
gggagacggaaagcgcccca

SEQ ID NO: 174624 - DNA, 20 bp, human
gagcacgcgcgtgcgcagaa

SEQ ID NO: 174625 - DNA, 20 bp, human
gctgcggcttggcctacggg

SEQ ID NO: 174626 - DNA, 20 bp, human
gtgcgccccggcacgaggtg

SEQ ID NO: 174627 - DNA, 20 bp, human
gggcgtgggactgaaaatag

SEQ ID NO: 174628 - DNA, 20 bp, human
gagccgccgaggcatcccag

SEQ ID NO: 174629 - DNA, 20 bp, human
gtacagtagagtgtgcgccg

SEQ ID NO: 174630 - DNA, 20 bp, human
ggcgggtccgagtcaaggtg

SEQ ID NO: 174631 - DNA, 20 bp, human
ggccccggcacgaggtgggg

SEQ ID NO: 174632 - DNA, 20 bp, human
ggtggtgcgggtccgagtca

SEQ ID NO: 174633 - DNA, 20 bp, human
ggcgttagcgacgtaccttg

SEQ ID NO: 174634 - DNA, 20 bp, human
ggactgaaaatagagggacg

SEQ ID NO: 174635 - DNA, 20 bp, human
ggtcagccgtcaccctgaga

SEQ ID NO: 174636 - DNA, 20 bp, human
gatagagacggcaagtggac

SEQ ID NO: 174637 - DNA, 20 bp, human
gagacggcaagtggacaggt

SEQ ID NO: 174638 - DNA, 20 bp, human
gtctagggccacagagacca

SEQ ID NO: 174639 - DNA, 20 bp, human
gtcaggggccagaaaaccct

SEQ ID NO: 174640 - DNA, 20 bp, human
gctccctccaccacacccat

SEQ ID NO: 174641 - DNA, 20 bp, human
gtgacctggtggactctgtg

SEQ ID NO: 174642 - DNA, 20 bp, human
gtcttagagataagacatag

SEQ ID NO: 174643 - DNA, 20 bp, human
gccagggcatgcacagggca

SEQ ID NO: 174644 - DNA, 20 bp, human
gactgggatggaactcctat

SEQ ID NO: 174645 - DNA, 20 bp, human
gcatcccagtggctctttca

SEQ ID NO: 174646 - DNA, 20 bp, human
gatcagtgacctcctcctgt

SEQ ID NO: 174647 - DNA, 20 bp, human
gcgagtattcctggggggga

SEQ ID NO: 174648 - DNA, 20 bp, human
gtctcctggtcaaagaggct

SEQ ID NO: 174649 - DNA, 20 bp, human
gagtcctagagaacacctgg

SEQ ID NO: 174650 - DNA, 20 bp, human
gcctgtggggaccaagctta

SEQ ID NO: 174651 - DNA, 20 bp, human
gtgggacccactggacacat

SEQ ID NO: 174652 - DNA, 20 bp, human
gaaagaacaagagaacgctg

SEQ ID NO: 174653 - DNA, 20 bp, human
gagaatgggacgctgcagga

SEQ ID NO: 174654 - DNA, 20 bp, human
gaggaccagacagagagaat

SEQ ID NO: 174655 - DNA, 20 bp, human
gcggaaggcaaggcctctag

SEQ ID NO: 174656 - DNA, 20 bp, human
gatagagacggcaagcggac

SEQ ID NO: 174657 - DNA, 20 bp, human
gctggccctgaaagagctac

SEQ ID NO: 174658 - DNA, 20 bp, human
gagacggcaagcggacaggt

SEQ ID NO: 174659 - DNA, 20 bp, human
gtcaggggccagaaaaccct

SEQ ID NO: 174660 - DNA, 20 bp, human
gccagggcatgcacagggca

SEQ ID NO: 174661 - DNA, 20 bp, human
gagagaccagggcatgcaca

SEQ ID NO: 174662 - DNA, 20 bp, human
gtcttagagataagacatag

SEQ ID NO: 174663 - DNA, 20 bp, human
gtgacctggtggactctgtg

SEQ ID NO: 174664 - DNA, 20 bp, human
gggtacagtcattacctggt

SEQ ID NO: 174665 - DNA, 20 bp, human
gcaccaggtcagtgcagaac

SEQ ID NO: 174666 - DNA, 20 bp, human
gctgtcaccagccccatgag

SEQ ID NO: 174667 - DNA, 20 bp, human
gccaccgggagtgccggaag

SEQ ID NO: 174668 - DNA, 20 bp, human
ggcccttagcccttctctgt

SEQ ID NO: 174669 - DNA, 20 bp, human
gggggctggaggaacagcgg

SEQ ID NO: 174670 - DNA, 20 bp, human
ggcccagtgttctgcactcg

SEQ ID NO: 174671 - DNA, 20 bp, human
ggtgttctgcactcggggaa

SEQ ID NO: 174672 - DNA, 20 bp, human
gtggtcttgggttgtgatgt

SEQ ID NO: 174673 - DNA, 20 bp, human
gaagatgttgcggggagcct

SEQ ID NO: 174674 - DNA, 20 bp, human
gggggctgcagcccctcatg

SEQ ID NO: 174675 - DNA, 20 bp, human
gggaaggggaagatgttgcg

SEQ ID NO: 174676 - DNA, 20 bp, human
gggccagactggaacatggg

SEQ ID NO: 174677 - DNA, 20 bp, human
gcatggtaggaccctcggga

SEQ ID NO: 174678 - DNA, 20 bp, human
gagggcccgtaagcctcccc

SEQ ID NO: 174679 - DNA, 20 bp, human
ggacccatggtaggaccctc

SEQ ID NO: 174680 - DNA, 20 bp, human
gcaacctgccaccctcccga

SEQ ID NO: 174681 - DNA, 20 bp, human
gacgtccacatgaaacctgc

SEQ ID NO: 174682 - DNA, 20 bp, human
gctggggagattcagggacc

SEQ ID NO: 174683 - DNA, 20 bp, human
gccaaaagctggggagattc

SEQ ID NO: 174684 - DNA, 20 bp, human
ggttgcctggggaggcttac

SEQ ID NO: 174685 - DNA, 20 bp, human
gcatgttccagtctggccca

SEQ ID NO: 174686 - DNA, 20 bp, human
ggctaccgcgcgccaaccgt

SEQ ID NO: 174687 - DNA, 20 bp, human
gcacagcgcgggagccgtca

SEQ ID NO: 174688 - DNA, 20 bp, human
ggccgtcacggtgctcaagg

SEQ ID NO: 174689 - DNA, 20 bp, human
gcgcgtcgaacacgaaccag

SEQ ID NO: 174690 - DNA, 20 bp, human
gggatggcgcaagccagtgg

SEQ ID NO: 174691 - DNA, 20 bp, human
ggggcgcgggcgcctacggt

SEQ ID NO: 174692 - DNA, 20 bp, human
gctggcctaagcccagatag

SEQ ID NO: 174693 - DNA, 20 bp, human
gtggcgcaagccagtggcgg

SEQ ID NO: 174694 - DNA, 20 bp, human
gcccaccttgagcaccgtga

SEQ ID NO: 174695 - DNA, 20 bp, human
gagctaccagggccccgacg

SEQ ID NO: 174696 - DNA, 20 bp, human
gaactactggcaggaaagaa

SEQ ID NO: 174697 - DNA, 20 bp, human
gtaaatagctgtgaaactac

SEQ ID NO: 174698 - DNA, 20 bp, human
gtagctgtgaaactactggc

SEQ ID NO: 174699 - DNA, 20 bp, human
gcttgaaatgtgcatggaag

SEQ ID NO: 174700 - DNA, 20 bp, human
gctgggaccttgttacttat

SEQ ID NO: 174701 - DNA, 20 bp, human
gtcagtgatttgaaaagata

SEQ ID NO: 174702 - DNA, 20 bp, human
gacagtagcaccaaagggag

SEQ ID NO: 174703 - DNA, 20 bp, human
gtactcaactgtgattagga

SEQ ID NO: 174704 - DNA, 20 bp, human
gtgaaggtgccatggagaac

SEQ ID NO: 174705 - DNA, 20 bp, human
gaacatacctataagtaaca

SEQ ID NO: 174706 - DNA, 20 bp, human
ggagccgggtgaggacccca

SEQ ID NO: 174707 - DNA, 20 bp, human
gccagcaggcatctgcagtg

SEQ ID NO: 174708 - DNA, 20 bp, human
gagggtcacggggacttacg

SEQ ID NO: 174709 - DNA, 20 bp, human
gcctagacggagtcaggcta

SEQ ID NO: 174710 - DNA, 20 bp, human
gtgaggcaggagatcgctcg

SEQ ID NO: 174711 - DNA, 20 bp, human
gcagagctccccggcctaga

SEQ ID NO: 174712 - DNA, 20 bp, human
gggcaggagatcgctcgagg

SEQ ID NO: 174713 - DNA, 20 bp, human
gtagcggggaccgagacgga

SEQ ID NO: 174714 - DNA, 20 bp, human
ggggtcctcacccggctcca

SEQ ID NO: 174715 - DNA, 20 bp, human
gcgcggtgccccgcaccagg

SEQ ID NO: 174716 - DNA, 20 bp, human
ggaagcttgcccacgaccgc

SEQ ID NO: 174717 - DNA, 20 bp, human
gaaccgtcccagcgccttcc

SEQ ID NO: 174718 - DNA, 20 bp, human
gtacgtgccagggacactag

SEQ ID NO: 174719 - DNA, 20 bp, human
gcgctgggacggttacccag

SEQ ID NO: 174720 - DNA, 20 bp, human
gcaaggagagcggcaagata

SEQ ID NO: 174721 - DNA, 20 bp, human
gggtatcccgctagtgtccc

SEQ ID NO: 174722 - DNA, 20 bp, human
ggcgggccgccggcggtcgt

SEQ ID NO: 174723 - DNA, 20 bp, human
gccatgcagagcactgacct

SEQ ID NO: 174724 - DNA, 20 bp, human
gtgccgggaaggcgctggga

SEQ ID NO: 174725 - DNA, 20 bp, human
gacctaggcaacaaggagag

SEQ ID NO: 174726 - DNA, 20 bp, human
ggagaaatgggccatcctgt

SEQ ID NO: 174727 - DNA, 20 bp, human
gtggtcctcgctggagaaat

SEQ ID NO: 174728 - DNA, 20 bp, human
gtgaggtctgctggtactga

SEQ ID NO: 174729 - DNA, 20 bp, human
ggtcgttcccagggataccg

SEQ ID NO: 174730 - DNA, 20 bp, human
gtgatgggaggacccgacga

SEQ ID NO: 174731 - DNA, 20 bp, human
gcgctcgccgcggtatccct

SEQ ID NO: 174732 - DNA, 20 bp, human
ggatgctgcaggcgatgctg

SEQ ID NO: 174733 - DNA, 20 bp, human
ggtggacgtttgattccaac

SEQ ID NO: 174734 - DNA, 20 bp, human
gcgcggcttttgctcggacc

SEQ ID NO: 174735 - DNA, 20 bp, human
gacccagccccggctacgtg

SEQ ID NO: 174736 - DNA, 20 bp, human
gggtgctgggaagggatctg

SEQ ID NO: 174737 - DNA, 20 bp, human
gggctcgcggctaaagacct

SEQ ID NO: 174738 - DNA, 20 bp, human
gtccctcagggatcacagga

SEQ ID NO: 174739 - DNA, 20 bp, human
gatggagactgggctaggtc

SEQ ID NO: 174740 - DNA, 20 bp, human
gtgtagccctaggagaacgg

SEQ ID NO: 174741 - DNA, 20 bp, human
gtcccctcacgggacagtga

SEQ ID NO: 174742 - DNA, 20 bp, human
ggtgagggctgtagctctag

SEQ ID NO: 174743 - DNA, 20 bp, human
gtgtagctctaggggaatgg

SEQ ID NO: 174744 - DNA, 20 bp, human
gtggctgggctcctcttacc

SEQ ID NO: 174745 - DNA, 20 bp, human
gccccgttctgggcatctca

SEQ ID NO: 174746 - DNA, 20 bp, human
gggtgctgggaagggatctg

SEQ ID NO: 174747 - DNA, 20 bp, human
gggctcgcggctaaagacct

SEQ ID NO: 174748 - DNA, 20 bp, human
gtccctcagggatcacagga

SEQ ID NO: 174749 - DNA, 20 bp, human
gatggagactgggctaggtc

SEQ ID NO: 174750 - DNA, 20 bp, human
gtgtagccctaggagaacgg

SEQ ID NO: 174751 - DNA, 20 bp, human
gtcccctcacgggacagtga

SEQ ID NO: 174752 - DNA, 20 bp, human
ggtgagggctgtagctctag

SEQ ID NO: 174753 - DNA, 20 bp, human
gtgtagctctaggggaatgg

SEQ ID NO: 174754 - DNA, 20 bp, human
gtggctgggctcctcttacc

SEQ ID NO: 174755 - DNA, 20 bp, human
gccccgttctgggcatctca

SEQ ID NO: 174756 - DNA, 20 bp, human
gggtgctgggaagggatctg

SEQ ID NO: 174757 - DNA, 20 bp, human
gggctcgcggctaaagacct

SEQ ID NO: 174758 - DNA, 20 bp, human
gtccctcagggatcacagga

SEQ ID NO: 174759 - DNA, 20 bp, human
gatggagactgggctaggtc

SEQ ID NO: 174760 - DNA, 20 bp, human
gtgtagccctaggagaacgg

SEQ ID NO: 174761 - DNA, 20 bp, human
gtcccctcacgggacagtga

SEQ ID NO: 174762 - DNA, 20 bp, human
ggtgagggctgtagctctag

SEQ ID NO: 174763 - DNA, 20 bp, human
gtgtagctctaggggaatgg

SEQ ID NO: 174764 - DNA, 20 bp, human
gtggctgggctcctcttacc

SEQ ID NO: 174765 - DNA, 20 bp, human
gccccgttctgggcatctca

SEQ ID NO: 174766 - DNA, 20 bp, human
gcggccgccgcgctcgcctg

SEQ ID NO: 174767 - DNA, 20 bp, human
gaccacgccgagggtccccg

SEQ ID NO: 174768 - DNA, 20 bp, human
gcatcctgaatgcagctggg

SEQ ID NO: 174769 - DNA, 20 bp, human
gcataactctcgcctcacca

SEQ ID NO: 174770 - DNA, 20 bp, human
gtgtctgccccaggcgagcg

SEQ ID NO: 174771 - DNA, 20 bp, human
ggctgcagcgctggagccgg

SEQ ID NO: 174772 - DNA, 20 bp, human
gggtcagaggaccacgccga

SEQ ID NO: 174773 - DNA, 20 bp, human
gccttctgcgcgggagtggg

SEQ ID NO: 174774 - DNA, 20 bp, human
gcgggaagccaagcgataag

SEQ ID NO: 174775 - DNA, 20 bp, human
gcctcaccagggcaccgcgg

SEQ ID NO: 174776 - DNA, 20 bp, human
gcgagcgccctgcagactga

SEQ ID NO: 174777 - DNA, 20 bp, human
gtgcccgccagggagctgaa

SEQ ID NO: 174778 - DNA, 20 bp, human
gcccgacctgaaagagaaca

SEQ ID NO: 174779 - DNA, 20 bp, human
gtgcagggcgctcgcggaag

SEQ ID NO: 174780 - DNA, 20 bp, human
gtctagaccccgacctcctg

SEQ ID NO: 174781 - DNA, 20 bp, human
gtccgaggcgcacaaacggg

SEQ ID NO: 174782 - DNA, 20 bp, human
ggcgggaacgactgcatgtg

SEQ ID NO: 174783 - DNA, 20 bp, human
gaagagaacagggcgggagg

SEQ ID NO: 174784 - DNA, 20 bp, human
gccctcccgtgagaaggcgg

SEQ ID NO: 174785 - DNA, 20 bp, human
gtgtcctgaggctgagtggg

SEQ ID NO: 174786 - DNA, 20 bp, human
gacccagacggtcatctttt

SEQ ID NO: 174787 - DNA, 20 bp, human
gtttgtctcccgggccgtct

SEQ ID NO: 174788 - DNA, 20 bp, human
ggcgcgcgcccagacggccc

SEQ ID NO: 174789 - DNA, 20 bp, human
gacgagtcctgcgggaagga

SEQ ID NO: 174790 - DNA, 20 bp, human
gtgggtgtccttagacaaca

SEQ ID NO: 174791 - DNA, 20 bp, human
gagggacgagtcctgcggga

SEQ ID NO: 174792 - DNA, 20 bp, human
gggcggtcggtcagcgcaca

SEQ ID NO: 174793 - DNA, 20 bp, human
ggggaggcggcggggtacct

SEQ ID NO: 174794 - DNA, 20 bp, human
ggaccacttagtctcaaccc

SEQ ID NO: 174795 - DNA, 20 bp, human
gctggagttgatgtcacgtc

SEQ ID NO: 174796 - DNA, 20 bp, human
gcccgctcgagaggcgacgg

SEQ ID NO: 174797 - DNA, 20 bp, human
ggagcccgctcgagaggcga

SEQ ID NO: 174798 - DNA, 20 bp, human
gtgagccgagcccgctcgag

SEQ ID NO: 174799 - DNA, 20 bp, human
gagagcgctgggcaccggcc

SEQ ID NO: 174800 - DNA, 20 bp, human
gcgggctcccgtcgaggtgg

SEQ ID NO: 174801 - DNA, 20 bp, human
gccgcgggctcccgtcgagg

SEQ ID NO: 174802 - DNA, 20 bp, human
gtcccgggctgcgtcgccag

SEQ ID NO: 174803 - DNA, 20 bp, human
gctcccgcgggctcccgtcg

SEQ ID NO: 174804 - DNA, 20 bp, human
gatgtggctcaagcccgagg

SEQ ID NO: 174805 - DNA, 20 bp, human
gctcggctcacagcgaccgg

SEQ ID NO: 174806 - DNA, 20 bp, human
gctgcctacgtgggagagaa

SEQ ID NO: 174807 - DNA, 20 bp, human
gcctcaggcgacagcagctc

SEQ ID NO: 174808 - DNA, 20 bp, human
gcgcctgaggaagatttggt

SEQ ID NO: 174809 - DNA, 20 bp, human
gcctacgtgggagagaaggg

SEQ ID NO: 174810 - DNA, 20 bp, human
gccatgggaagcgacaaggt

SEQ ID NO: 174811 - DNA, 20 bp, human
gatcgtgggcggagggactg

SEQ ID NO: 174812 - DNA, 20 bp, human
gctgtcgcctgaggaagatt

SEQ ID NO: 174813 - DNA, 20 bp, human
gctaggtcactgctcccggg

SEQ ID NO: 174814 - DNA, 20 bp, human
gaacagcgaacacagcccag

SEQ ID NO: 174815 - DNA, 20 bp, human
gcggcgtcggggctacgggg

SEQ ID NO: 174816 - DNA, 20 bp, human
ggtgccaggccgggcgtctg

SEQ ID NO: 174817 - DNA, 20 bp, human
gccgctgcaggatgaagtat

SEQ ID NO: 174818 - DNA, 20 bp, human
ggcaagcagcatcctccccg

SEQ ID NO: 174819 - DNA, 20 bp, human
ggcgctgtggatcaccgaga

SEQ ID NO: 174820 - DNA, 20 bp, human
gtcatcctgcagcggaggaa

SEQ ID NO: 174821 - DNA, 20 bp, human
ggcgacaggcgcgcactcct

SEQ ID NO: 174822 - DNA, 20 bp, human
gtgcaggatgaagtatgggt

SEQ ID NO: 174823 - DNA, 20 bp, human
gcggccgcagacgcccggcc

SEQ ID NO: 174824 - DNA, 20 bp, human
gagccgggctgcagagtgcc

SEQ ID NO: 174825 - DNA, 20 bp, human
gagcggaggaagggccacgc

SEQ ID NO: 174826 - DNA, 20 bp, human
gctccgctccgggacgccga

SEQ ID NO: 174827 - DNA, 20 bp, human
ggcggccaagtggagaccgg

SEQ ID NO: 174828 - DNA, 20 bp, human
gtgcgagcggctccgcgatg

SEQ ID NO: 174829 - DNA, 20 bp, human
ggctcgcgggcgccgaatcc

SEQ ID NO: 174830 - DNA, 20 bp, human
gcggcgggctctcctcaggt

SEQ ID NO: 174831 - DNA, 20 bp, human
ggccgccccaagccgacctg

SEQ ID NO: 174832 - DNA, 20 bp, human
gtcgcggagccgctcgcacc

SEQ ID NO: 174833 - DNA, 20 bp, human
gggggcggccaagtggagac

SEQ ID NO: 174834 - DNA, 20 bp, human
ggccaagtggagaccggcgg

SEQ ID NO: 174835 - DNA, 20 bp, human
gctttcggcggtgagatccc

SEQ ID NO: 174836 - DNA, 20 bp, human
gccggcgtggtgaagcggta

SEQ ID NO: 174837 - DNA, 20 bp, human
gccgcgggcgccgagaaacc

SEQ ID NO: 174838 - DNA, 20 bp, human
ggagcggccagtgagcggag

SEQ ID NO: 174839 - DNA, 20 bp, human
gggccaagttcagcaaggag

SEQ ID NO: 174840 - DNA, 20 bp, human
gaatcagagcggccagtgag

SEQ ID NO: 174841 - DNA, 20 bp, human
gctcggcgcccgcggtggga

SEQ ID NO: 174842 - DNA, 20 bp, human
gctcttccggcaaatcagag

SEQ ID NO: 174843 - DNA, 20 bp, human
gccatgaggtgacgaagagg

SEQ ID NO: 174844 - DNA, 20 bp, human
ggatttgccggaagagtcgg

SEQ ID NO: 174845 - DNA, 20 bp, human
gaactgcggagccccgggtg

SEQ ID NO: 174846 - DNA, 20 bp, human
ggagctcgcccagtccgcga

SEQ ID NO: 174847 - DNA, 20 bp, human
gctcggctctctccgcgcag

SEQ ID NO: 174848 - DNA, 20 bp, human
ggtgcttcgccaaaagaggg

SEQ ID NO: 174849 - DNA, 20 bp, human
ggagagagccgagcccgagg

SEQ ID NO: 174850 - DNA, 20 bp, human
gctgcggagcgggtgtgagg

SEQ ID NO: 174851 - DNA, 20 bp, human
gtaggtgcttcgccaaaaga

SEQ ID NO: 174852 - DNA, 20 bp, human
gcgcgctgcaggcatccgca

SEQ ID NO: 174853 - DNA, 20 bp, human
gaatccgacggtccagaggg

SEQ ID NO: 174854 - DNA, 20 bp, human
gtgatgaaaacggtcaccgt

SEQ ID NO: 174855 - DNA, 20 bp, human
ggaggggccggggagtgact

SEQ ID NO: 174856 - DNA, 20 bp, human
ggcagcagcggagcaactga

SEQ ID NO: 174857 - DNA, 20 bp, human
gcaactgacggactccatat

SEQ ID NO: 174858 - DNA, 20 bp, human
gccgctgctgctgtcaggac

SEQ ID NO: 174859 - DNA, 20 bp, human
ggctgtcaggaccggagaca

SEQ ID NO: 174860 - DNA, 20 bp, human
gaggaagcttgaagccaata

SEQ ID NO: 174861 - DNA, 20 bp, human
ggctcgctcccgaacaaagg

SEQ ID NO: 174862 - DNA, 20 bp, human
gccctgccgcaggtcgtaag

SEQ ID NO: 174863 - DNA, 20 bp, human
gcttggccgagcggcgccgg

SEQ ID NO: 174864 - DNA, 20 bp, human
ggccgctcgctcccgaacaa

SEQ ID NO: 174865 - DNA, 20 bp, human
gccaggagccgcgtctactt

SEQ ID NO: 174866 - DNA, 20 bp, human
gccccggcgcacccagtgcg

SEQ ID NO: 174867 - DNA, 20 bp, human
gagttaggcgaggaagacct

SEQ ID NO: 174868 - DNA, 20 bp, human
gcgcggttacctgctaatgc

SEQ ID NO: 174869 - DNA, 20 bp, human
gacgctcacgctgacagggt

SEQ ID NO: 174870 - DNA, 20 bp, human
gagaatggagggctcatctc

SEQ ID NO: 174871 - DNA, 20 bp, human
gagggctcatctctgggatc

SEQ ID NO: 174872 - DNA, 20 bp, human
gtaacccacaccgccctccc

SEQ ID NO: 174873 - DNA, 20 bp, human
ggagcggcgcctgcattagc

SEQ ID NO: 174874 - DNA, 20 bp, human
gggcccagcgagcggacgcc

SEQ ID NO: 174875 - DNA, 20 bp, human
gcgagacgcggtaagcgcga

SEQ ID NO: 174876 - DNA, 20 bp, human
gggtacagcggccgaatgag

SEQ ID NO: 174877 - DNA, 20 bp, human
gccagctacgctccgaatga

SEQ ID NO: 174878 - DNA, 20 bp, human
ggtctgatgtacacctgtcg

SEQ ID NO: 174879 - DNA, 20 bp, human
gggctcagacttgggaggag

SEQ ID NO: 174880 - DNA, 20 bp, human
gctgcgatgagcaaaatcgg

SEQ ID NO: 174881 - DNA, 20 bp, human
ggggtctcaccactaagaag

SEQ ID NO: 174882 - DNA, 20 bp, human
gacttaggctcagacttggg

SEQ ID NO: 174883 - DNA, 20 bp, human
gggcttccaccgcttcttag

SEQ ID NO: 174884 - DNA, 20 bp, human
gcaaaatcggggggaagatg

SEQ ID NO: 174885 - DNA, 20 bp, human
gggaacagttattccacgac

SEQ ID NO: 174886 - DNA, 20 bp, human
ggcgcggcgctggaagcgtt

SEQ ID NO: 174887 - DNA, 20 bp, human
ggaagcgttcggcgagagcg

SEQ ID NO: 174888 - DNA, 20 bp, human
gaagccagggatgaaggatg

SEQ ID NO: 174889 - DNA, 20 bp, human
gggcccgcgggaccgcgcac

SEQ ID NO: 174890 - DNA, 20 bp, human
gcgggccacggtccccccaa

SEQ ID NO: 174891 - DNA, 20 bp, human
ggagcgggcacgggtcccaa

SEQ ID NO: 174892 - DNA, 20 bp, human
gcgctagagcgcgaaagcca

SEQ ID NO: 174893 - DNA, 20 bp, human
gggaaggccgcgccccacca

SEQ ID NO: 174894 - DNA, 20 bp, human
gggtcccgcgggccgtggtg

SEQ ID NO: 174895 - DNA, 20 bp, human
ggcctgcgggaggtgcacgg

SEQ ID NO: 174896 - DNA, 20 bp, human
gagcctcaagcttcgctgct

SEQ ID NO: 174897 - DNA, 20 bp, human
ggctgggcagttggctggag

SEQ ID NO: 174898 - DNA, 20 bp, human
ggaacacctggagtctccgc

SEQ ID NO: 174899 - DNA, 20 bp, human
gggacgaggctgttcctcta

SEQ ID NO: 174900 - DNA, 20 bp, human
gtaactgattcggaaggacg

SEQ ID NO: 174901 - DNA, 20 bp, human
gcgaagcttgaggctctggc

SEQ ID NO: 174902 - DNA, 20 bp, human
gcctccaccggagtgaggta

SEQ ID NO: 174903 - DNA, 20 bp, human
gggacttcctacagcacttc

SEQ ID NO: 174904 - DNA, 20 bp, human
gctctggccggaagtgctgt

SEQ ID NO: 174905 - DNA, 20 bp, human
gtaggaagtcccgcctccac

SEQ ID NO: 174906 - DNA, 20 bp, human
ggctccggcggccagagtgg

SEQ ID NO: 174907 - DNA, 20 bp, human
gccgggtcaatgcaggacac

SEQ ID NO: 174908 - DNA, 20 bp, human
ggcggagctgggagggtctt

SEQ ID NO: 174909 - DNA, 20 bp, human
gcatcctccctctagcccca

SEQ ID NO: 174910 - DNA, 20 bp, human
gtcagcctcgggcctggtcc

SEQ ID NO: 174911 - DNA, 20 bp, human
gttcacctagtcccccactc

SEQ ID NO: 174912 - DNA, 20 bp, human
ggtgctgggataggacactc

SEQ ID NO: 174913 - DNA, 20 bp, human
gggccgggaaagctgcttcc

SEQ ID NO: 174914 - DNA, 20 bp, human
gctccgcgcctcggctccag

SEQ ID NO: 174915 - DNA, 20 bp, human
ggctgcttccgggtcaatgc

SEQ ID NO: 174916 - DNA, 20 bp, human
gggcgggctgtagctaggga

SEQ ID NO: 174917 - DNA, 20 bp, human
ggaaaggcgggctgtagcta

SEQ ID NO: 174918 - DNA, 20 bp, human
gctggtgcactaagccgtag

SEQ ID NO: 174919 - DNA, 20 bp, human
ggacagtacctatcagcaag

SEQ ID NO: 174920 - DNA, 20 bp, human
gtcgcgagccaagtcagcca

SEQ ID NO: 174921 - DNA, 20 bp, human
gcaggctgaggggagggtag

SEQ ID NO: 174922 - DNA, 20 bp, human
gtgagtcgtttgggaaccgt

SEQ ID NO: 174923 - DNA, 20 bp, human
gtagatagagaaccgagctg

SEQ ID NO: 174924 - DNA, 20 bp, human
gtgtggagccgcttgctgat

SEQ ID NO: 174925 - DNA, 20 bp, human
gaccttcgcggaacccggcg

SEQ ID NO: 174926 - DNA, 20 bp, human
gagtgtcctgagtctcgagg

SEQ ID NO: 174927 - DNA, 20 bp, human
gggaagtgtcctgagtctcg

SEQ ID NO: 174928 - DNA, 20 bp, human
gcgacctgcatcccgtccgg

SEQ ID NO: 174929 - DNA, 20 bp, human
ggcccgcgcgaccattccac

SEQ ID NO: 174930 - DNA, 20 bp, human
gcaccgccggcgggctcccg

SEQ ID NO: 174931 - DNA, 20 bp, human
gggatgctgagtcagagcgg

SEQ ID NO: 174932 - DNA, 20 bp, human
gacgcagccggggtcctgga

SEQ ID NO: 174933 - DNA, 20 bp, human
gcgcggcctcctcgagactc

SEQ ID NO: 174934 - DNA, 20 bp, human
ggtgtcgacgctcggaaaga

SEQ ID NO: 174935 - DNA, 20 bp, human
ggcgcggcggagacccggct

SEQ ID NO: 174936 - DNA, 20 bp, human
gggctcccgaaagcaggagt

SEQ ID NO: 174937 - DNA, 20 bp, human
ggacgcccctgcgaccccga

SEQ ID NO: 174938 - DNA, 20 bp, human
gagacagacggccctgtcca

SEQ ID NO: 174939 - DNA, 20 bp, human
gtgggcagggtggcacgtcc

SEQ ID NO: 174940 - DNA, 20 bp, human
gaatggggaaccctacgagg

SEQ ID NO: 174941 - DNA, 20 bp, human
ggccagggagaggggtacca

SEQ ID NO: 174942 - DNA, 20 bp, human
gcagctctgggccttccttg

SEQ ID NO: 174943 - DNA, 20 bp, human
gtaagccaggccggcagcag

SEQ ID NO: 174944 - DNA, 20 bp, human
gagtgccttcggggtcgcag

SEQ ID NO: 174945 - DNA, 20 bp, human
ggagtggggcagcgaccagg

SEQ ID NO: 174946 - DNA, 20 bp, human
gcacggacagtgacctccac

SEQ ID NO: 174947 - DNA, 20 bp, human
gcgagtcccggagagagcgc

SEQ ID NO: 174948 - DNA, 20 bp, human
gagagggcgggacagcggga

SEQ ID NO: 174949 - DNA, 20 bp, human
gcgagcagcgcaacttgtgg

SEQ ID NO: 174950 - DNA, 20 bp, human
gtcgcggcagctccccgtgg

SEQ ID NO: 174951 - DNA, 20 bp, human
gccgcacggccgggactcgg

SEQ ID NO: 174952 - DNA, 20 bp, human
gccagccaggaggaccgcca

SEQ ID NO: 174953 - DNA, 20 bp, human
gacagcgggagggactggca

SEQ ID NO: 174954 - DNA, 20 bp, human
ggtgagtgcgcagggctcgg

SEQ ID NO: 174955 - DNA, 20 bp, human
gccgcccctggaactcctgt

SEQ ID NO: 174956 - DNA, 20 bp, human
gcccggccgcccccactcca

SEQ ID NO: 174957 - DNA, 20 bp, human
gtcccccctcccgggaatgg

SEQ ID NO: 174958 - DNA, 20 bp, human
gccaaaataacccctccggg

SEQ ID NO: 174959 - DNA, 20 bp, human
gtgcctctcaccccccggag

SEQ ID NO: 174960 - DNA, 20 bp, human
ggctcagacactcaacactg

SEQ ID NO: 174961 - DNA, 20 bp, human
gaggtaaaagctgttactaa

SEQ ID NO: 174962 - DNA, 20 bp, human
gactcgcgcccatccccccg

SEQ ID NO: 174963 - DNA, 20 bp, human
gcgcgggggaagggcgcgag

SEQ ID NO: 174964 - DNA, 20 bp, human
gtataaccccagcgagcgga

SEQ ID NO: 174965 - DNA, 20 bp, human
gaacggttcggagcagccaa

SEQ ID NO: 174966 - DNA, 20 bp, human
gtaccgcagcacttggacta

SEQ ID NO: 174967 - DNA, 20 bp, human
ggctagcagcgcaactgtgg

SEQ ID NO: 174968 - DNA, 20 bp, human
gcaattcgcgctcgggagtg

SEQ ID NO: 174969 - DNA, 20 bp, human
gctgcgtctccaggagttcg

SEQ ID NO: 174970 - DNA, 20 bp, human
gagagggcgggactgcacgg

SEQ ID NO: 174971 - DNA, 20 bp, human
gtggactcaacaataccggg

SEQ ID NO: 174972 - DNA, 20 bp, human
gcaccctagtccaagtgctg

SEQ ID NO: 174973 - DNA, 20 bp, human
gggcgagcggagcgtctgga

SEQ ID NO: 174974 - DNA, 20 bp, human
gcggcggctgcagcgacaga

SEQ ID NO: 174975 - DNA, 20 bp, human
gccctggactcaacaatacc

SEQ ID NO: 174976 - DNA, 20 bp, human
ggcgtactcactagctgagg

SEQ ID NO: 174977 - DNA, 20 bp, human
ggccgcttgaggctccccaa

SEQ ID NO: 174978 - DNA, 20 bp, human
gcgcagtaaggggcccaggt

SEQ ID NO: 174979 - DNA, 20 bp, human
gtggggcccggcgactccat

SEQ ID NO: 174980 - DNA, 20 bp, human
ggggttaggcgcacctcctg

SEQ ID NO: 174981 - DNA, 20 bp, human
ggggccgcgcacgcacgcgg

SEQ ID NO: 174982 - DNA, 20 bp, human
gcgcaggtcggaccacgagg

SEQ ID NO: 174983 - DNA, 20 bp, human
ggcgggactggctccaacct

SEQ ID NO: 174984 - DNA, 20 bp, human
gaggtgcgcctaacccggca

SEQ ID NO: 174985 - DNA, 20 bp, human
gcgcagatgtcggagctcat

SEQ ID NO: 174986 - DNA, 20 bp, human
gaggcgcctgtcatcgacat

SEQ ID NO: 174987 - DNA, 20 bp, human
gagcgggaagggagtgatgt

SEQ ID NO: 174988 - DNA, 20 bp, human
gttagggaagtcctctgggg

SEQ ID NO: 174989 - DNA, 20 bp, human
gcacaccaggtccctaggga

SEQ ID NO: 174990 - DNA, 20 bp, human
ggacttccctaaaaagcaca

SEQ ID NO: 174991 - DNA, 20 bp, human
gacccttcaggctccagatg

SEQ ID NO: 174992 - DNA, 20 bp, human
gacattggcattgctaacac

SEQ ID NO: 174993 - DNA, 20 bp, human
gcaatgccaatgtcgatgac

SEQ ID NO: 174994 - DNA, 20 bp, human
ggatgaccaagcgggaggat

SEQ ID NO: 174995 - DNA, 20 bp, human
gctcaacctgagaggaacaa

SEQ ID NO: 174996 - DNA, 20 bp, human
gcgagaagccggctatgggg

SEQ ID NO: 174997 - DNA, 20 bp, human
ggaccagaagtcccgatgag

SEQ ID NO: 174998 - DNA, 20 bp, human
gggcagccaccgccgcgtga

SEQ ID NO: 174999 - DNA, 20 bp, human
gagccaccgccgcgtgaggg

SEQ ID NO: 175000 - DNA, 20 bp, human
gctgaaacctgctagggtcc

SEQ ID NO: 175001 - DNA, 20 bp, human
gcagaagtcccgatgagggg

SEQ ID NO: 175002 - DNA, 20 bp, human
ggctaacctccctcacgcgg

SEQ ID NO: 175003 - DNA, 20 bp, human
gccgccgggagcagcagcgt

SEQ ID NO: 175004 - DNA, 20 bp, human
gggtgctaacctccctcacg

SEQ ID NO: 175005 - DNA, 20 bp, human
gagccggctatggggtggag

SEQ ID NO: 175006 - DNA, 20 bp, human
ggaacggcggcagcacgaaa

SEQ ID NO: 175007 - DNA, 20 bp, human
gtcactgcaaagatcactat

SEQ ID NO: 175008 - DNA, 20 bp, human
ggccaggggttcagtgaggt

SEQ ID NO: 175009 - DNA, 20 bp, human
ggacagggcagggtaaactt

SEQ ID NO: 175010 - DNA, 20 bp, human
gaggtcgggcaggttcgctg

SEQ ID NO: 175011 - DNA, 20 bp, human
gaacatggagaagaagcgga

SEQ ID NO: 175012 - DNA, 20 bp, human
ggcgcgccaggggttcagtg

SEQ ID NO: 175013 - DNA, 20 bp, human
gccgttacaggccggaacgg

SEQ ID NO: 175014 - DNA, 20 bp, human
gagcgaagttaaacagccgg

SEQ ID NO: 175015 - DNA, 20 bp, human
gctgaagccgagggcagaac

SEQ ID NO: 175016 - DNA, 20 bp, human
gagacggagtccgagcctcg

SEQ ID NO: 175017 - DNA, 20 bp, human
gccgttgctaggagcccccg

SEQ ID NO: 175018 - DNA, 20 bp, human
gtcggtaacgctcccaggta

SEQ ID NO: 175019 - DNA, 20 bp, human
gtaaccccctaggcgaccct

SEQ ID NO: 175020 - DNA, 20 bp, human
gcggtccggtggccgaggga

SEQ ID NO: 175021 - DNA, 20 bp, human
gggagggctcagttctgaag

SEQ ID NO: 175022 - DNA, 20 bp, human
gtcctagcaacgggccgggg

SEQ ID NO: 175023 - DNA, 20 bp, human
gtgttgttccgggtgcgagg

SEQ ID NO: 175024 - DNA, 20 bp, human
gtcgcctagggggttaccgt

SEQ ID NO: 175025 - DNA, 20 bp, human
ggcgttaccgagcctggtgt

SEQ ID NO: 175026 - DNA, 20 bp, human
gaggccatttatgagcctgg

SEQ ID NO: 175027 - DNA, 20 bp, human
gagggcgcgagagaagcgtt

SEQ ID NO: 175028 - DNA, 20 bp, human
gctgcccccaggctcataaa

SEQ ID NO: 175029 - DNA, 20 bp, human
gccagtgcgccgctcaggtg

SEQ ID NO: 175030 - DNA, 20 bp, human
gctgcaggaacctgggccga

SEQ ID NO: 175031 - DNA, 20 bp, human
gtgggaagggccatgtaatc

SEQ ID NO: 175032 - DNA, 20 bp, human
gtatgagcctgggggcagcg

SEQ ID NO: 175033 - DNA, 20 bp, human
gtcggaacccgctccggcca

SEQ ID NO: 175034 - DNA, 20 bp, human
gcccttggcacaggaccggg

SEQ ID NO: 175035 - DNA, 20 bp, human
gaaccagaacaacctgggaa

SEQ ID NO: 175036 - DNA, 20 bp, human
gcgggtggtgggccatgtag

SEQ ID NO: 175037 - DNA, 20 bp, human
ggactccaaggactcaccag

SEQ ID NO: 175038 - DNA, 20 bp, human
gaccacccggtcatcaccaa

SEQ ID NO: 175039 - DNA, 20 bp, human
gttaaaaaccagggacggga

SEQ ID NO: 175040 - DNA, 20 bp, human
gtaccccggccagcacggac

SEQ ID NO: 175041 - DNA, 20 bp, human
gctcggatccgcctgaatgt

SEQ ID NO: 175042 - DNA, 20 bp, human
gcagagaccccgtccaagac

SEQ ID NO: 175043 - DNA, 20 bp, human
gtggccggggtacgggaaca

SEQ ID NO: 175044 - DNA, 20 bp, human
ggagcatgatagaaggagaa

SEQ ID NO: 175045 - DNA, 20 bp, human
gaccagcaaatgcttctcaa

SEQ ID NO: 175046 - DNA, 20 bp, human
gggaccatgagcctgctgga

SEQ ID NO: 175047 - DNA, 20 bp, human
gctctaggaatctagctctc

SEQ ID NO: 175048 - DNA, 20 bp, human
ggtcagccctgggaacgtcc

SEQ ID NO: 175049 - DNA, 20 bp, human
ggagacacccgcaaccgaac

SEQ ID NO: 175050 - DNA, 20 bp, human
ggaggggaccggctgaacgt

SEQ ID NO: 175051 - DNA, 20 bp, human
gccgcaaccgaacgggctcc

SEQ ID NO: 175052 - DNA, 20 bp, human
ggttcccagggctgaccgca

SEQ ID NO: 175053 - DNA, 20 bp, human
gctagcggaatcgggcctct

SEQ ID NO: 175054 - DNA, 20 bp, human
gacaccgggacgtaacttcc

SEQ ID NO: 175055 - DNA, 20 bp, human
gtggccctgcggtcagccct

SEQ ID NO: 175056 - DNA, 20 bp, human
gggcggcggatggaggtcag

SEQ ID NO: 175057 - DNA, 20 bp, human
gggtcatggacggtcaacag

SEQ ID NO: 175058 - DNA, 20 bp, human
ggttccggggacagttaggg

SEQ ID NO: 175059 - DNA, 20 bp, human
gcggcgctccgagtgacgta

SEQ ID NO: 175060 - DNA, 20 bp, human
gatggttccggggacagtta

SEQ ID NO: 175061 - DNA, 20 bp, human
gcagttagggcggcggatgg

SEQ ID NO: 175062 - DNA, 20 bp, human
gcatggacggtcaacagggg

SEQ ID NO: 175063 - DNA, 20 bp, human
gcttgtggcacggggagaag

SEQ ID NO: 175064 - DNA, 20 bp, human
gccgccgccctaactgtccc

SEQ ID NO: 175065 - DNA, 20 bp, human
gagagaggaagcgtgcgcac

SEQ ID NO: 175066 - DNA, 20 bp, human
gtcgcgcgggccgtacgggt

SEQ ID NO: 175067 - DNA, 20 bp, human
ggcggccggcgcaaacgggt

SEQ ID NO: 175068 - DNA, 20 bp, human
gccggtgaagaagaacgcga

SEQ ID NO: 175069 - DNA, 20 bp, human
gccgcaggccggccccgagg

SEQ ID NO: 175070 - DNA, 20 bp, human
gcaccaaggccggcaggtca

SEQ ID NO: 175071 - DNA, 20 bp, human
gcagcgcggcgcccgccact

SEQ ID NO: 175072 - DNA, 20 bp, human
gctagagatgaaggcgctgt

SEQ ID NO: 175073 - DNA, 20 bp, human
gcggcggagatcatgacccg

SEQ ID NO: 175074 - DNA, 20 bp, human
gcgcccggcgccgacccgta

SEQ ID NO: 175075 - DNA, 20 bp, human
gcgagagctgcgtgagccac

SEQ ID NO: 175076 - DNA, 20 bp, human
gggacagcacagcccgagag

SEQ ID NO: 175077 - DNA, 20 bp, human
gccgagagtggcttggagaa

SEQ ID NO: 175078 - DNA, 20 bp, human
gtctcaccttcggagaccag

SEQ ID NO: 175079 - DNA, 20 bp, human
gctggacccctggtctccga

SEQ ID NO: 175080 - DNA, 20 bp, human
gctaaggtctgagatcccaa

SEQ ID NO: 175081 - DNA, 20 bp, human
gccaggggtccagctcgagt

SEQ ID NO: 175082 - DNA, 20 bp, human
gaggtccttcacaagagggt

SEQ ID NO: 175083 - DNA, 20 bp, human
gacctgccatggagacagag

SEQ ID NO: 175084 - DNA, 20 bp, human
ggaggtgccgagtggacgag

SEQ ID NO: 175085 - DNA, 20 bp, human
gcccggaacagcctggtccc

SEQ ID NO: 175086 - DNA, 20 bp, human
ggggcaaggcagggcgtcaa

SEQ ID NO: 175087 - DNA, 20 bp, human
gtcggacgaggctgagactg

SEQ ID NO: 175088 - DNA, 20 bp, human
gccctgccttgccccaacat

SEQ ID NO: 175089 - DNA, 20 bp, human
gaggcagggcgtcaatggca

SEQ ID NO: 175090 - DNA, 20 bp, human
gggcccactcggagacacgg

SEQ ID NO: 175091 - DNA, 20 bp, human
gcagtcgccggtcgcgggtg

SEQ ID NO: 175092 - DNA, 20 bp, human
gagcagctgggccagcgtag

SEQ ID NO: 175093 - DNA, 20 bp, human
ggcgggcccactcggagaca

SEQ ID NO: 175094 - DNA, 20 bp, human
gtaggggcgcaggtcggatc

SEQ ID NO: 175095 - DNA, 20 bp, human
gctagctcctcacccgcgac

SEQ ID NO: 175096 - DNA, 20 bp, human
gtggaagtgctgacagatca

SEQ ID NO: 175097 - DNA, 20 bp, human
gggatggccgagaagcgaag

SEQ ID NO: 175098 - DNA, 20 bp, human
gcgccagagaggactaacat

SEQ ID NO: 175099 - DNA, 20 bp, human
gttccaggcaggagagcggt

SEQ ID NO: 175100 - DNA, 20 bp, human
gactctgtggacacaaatta

SEQ ID NO: 175101 - DNA, 20 bp, human
gatgggtaaaaaacactctg

SEQ ID NO: 175102 - DNA, 20 bp, human
gtgtgttgggatccaggaac

SEQ ID NO: 175103 - DNA, 20 bp, human
gtctcggtggaggcgctgat

SEQ ID NO: 175104 - DNA, 20 bp, human
ggcgcacgctttctcggtgg

SEQ ID NO: 175105 - DNA, 20 bp, human
gatatgagagaggggcgggc

SEQ ID NO: 175106 - DNA, 20 bp, human
gttcccgaagggtagttgag

SEQ ID NO: 175107 - DNA, 20 bp, human
ggggcaagcgtcccagaccc

SEQ ID NO: 175108 - DNA, 20 bp, human
ggaaccgctcaactaccctt

SEQ ID NO: 175109 - DNA, 20 bp, human
ggcgtcccagaccccggcgg

SEQ ID NO: 175110 - DNA, 20 bp, human
gccttggcagagaaatcaag

SEQ ID NO: 175111 - DNA, 20 bp, human
gcaagtcccaagcccgggag

SEQ ID NO: 175112 - DNA, 20 bp, human
ggcttgcccgacggagtcag

SEQ ID NO: 175113 - DNA, 20 bp, human
gcacccgctgggcctccgca

SEQ ID NO: 175114 - DNA, 20 bp, human
gtccggcccggcccaaaaga

SEQ ID NO: 175115 - DNA, 20 bp, human
gggaaacttggtttcccgaa

SEQ ID NO: 175116 - DNA, 20 bp, human
ggagcggagagaagataccc

SEQ ID NO: 175117 - DNA, 20 bp, human
gacaggttggtggcataatg

SEQ ID NO: 175118 - DNA, 20 bp, human
gcctggaggatgcacctctc

SEQ ID NO: 175119 - DNA, 20 bp, human
gggtgtcatcctaggagctt

SEQ ID NO: 175120 - DNA, 20 bp, human
gcctgccagcccacgcgggg

SEQ ID NO: 175121 - DNA, 20 bp, human
gcaactaaagcttaacaggt

SEQ ID NO: 175122 - DNA, 20 bp, human
gagccctgccagcccacgcg

SEQ ID NO: 175123 - DNA, 20 bp, human
gcctctctggcagagattca

SEQ ID NO: 175124 - DNA, 20 bp, human
gagggaaaaaggcgacccta

SEQ ID NO: 175125 - DNA, 20 bp, human
gtctgccgccccgcgtgggc

SEQ ID NO: 175126 - DNA, 20 bp, human
ggcgagtgccgggaagaagg

SEQ ID NO: 175127 - DNA, 20 bp, human
gagcgcgagtgccgggaaga

SEQ ID NO: 175128 - DNA, 20 bp, human
gagcgcaggggatccgagct

SEQ ID NO: 175129 - DNA, 20 bp, human
gaccagtcgcgcgtggtccc

SEQ ID NO: 175130 - DNA, 20 bp, human
ggccggggaccacgcgcgac

SEQ ID NO: 175131 - DNA, 20 bp, human
gcgccagaaaggcggacatg

SEQ ID NO: 175132 - DNA, 20 bp, human
gtgcgccgccgccagaaagg

SEQ ID NO: 175133 - DNA, 20 bp, human
ggcctggctcgttagcgcag

SEQ ID NO: 175134 - DNA, 20 bp, human
gcgcggtggacggacgaccc

SEQ ID NO: 175135 - DNA, 20 bp, human
ggggcggcagcgcgagtgcc

SEQ ID NO: 175136 - DNA, 20 bp, human
gggagcgcggcgcggaacta

SEQ ID NO: 175137 - DNA, 20 bp, human
gagagccgcagagacttcga

SEQ ID NO: 175138 - DNA, 20 bp, human
ggagggcccaccgagcacta

SEQ ID NO: 175139 - DNA, 20 bp, human
gtgccgtccagattccccaa

SEQ ID NO: 175140 - DNA, 20 bp, human
gcgcagggcagcgagcgcca

SEQ ID NO: 175141 - DNA, 20 bp, human
gagcgcggctgctaggacgc

SEQ ID NO: 175142 - DNA, 20 bp, human
gggtggccaccagccgagcg

SEQ ID NO: 175143 - DNA, 20 bp, human
ggctgctaggacgctggcgt

SEQ ID NO: 175144 - DNA, 20 bp, human
gcagcacgcggtcctggcca

SEQ ID NO: 175145 - DNA, 20 bp, human
gggcccaccgagcactacgg

SEQ ID NO: 175146 - DNA, 20 bp, human
gggcgtaggctccaaggaag

SEQ ID NO: 175147 - DNA, 20 bp, human
ggtgccagcccgccccggat

SEQ ID NO: 175148 - DNA, 20 bp, human
gtggcttctacgccctcgtc

SEQ ID NO: 175149 - DNA, 20 bp, human
gccgcgcgcctgccggacga

SEQ ID NO: 175150 - DNA, 20 bp, human
gcggctccgggtagaagtag

SEQ ID NO: 175151 - DNA, 20 bp, human
gcaggcgcgcggcagctctc

SEQ ID NO: 175152 - DNA, 20 bp, human
gtgacagcggcccgctggag

SEQ ID NO: 175153 - DNA, 20 bp, human
ggctgcgactctagtgacag

SEQ ID NO: 175154 - DNA, 20 bp, human
gggtcgcggcgggtaggcgt

SEQ ID NO: 175155 - DNA, 20 bp, human
ggctccacgatgcccatccg

SEQ ID NO: 175156 - DNA, 20 bp, human
gtagttaacaggagaggaag

SEQ ID NO: 175157 - DNA, 20 bp, human
gtagtgatagttaacaggag

SEQ ID NO: 175158 - DNA, 20 bp, human
gttagggagctagggagcaa

SEQ ID NO: 175159 - DNA, 20 bp, human
gatgcagccagaaggctccc

SEQ ID NO: 175160 - DNA, 20 bp, human
gaacatggtcagtaaggcag

SEQ ID NO: 175161 - DNA, 20 bp, human
gctaggagagggactattgc

SEQ ID NO: 175162 - DNA, 20 bp, human
gttagtgggacatcagtaca

SEQ ID NO: 175163 - DNA, 20 bp, human
gacccataacatggtcagta

SEQ ID NO: 175164 - DNA, 20 bp, human
ggccagagcacaagagaacg

SEQ ID NO: 175165 - DNA, 20 bp, human
ggatcttgtttagggagcta

SEQ ID NO: 175166 - DNA, 20 bp, human
ggacgcccggtgaattctag

SEQ ID NO: 175167 - DNA, 20 bp, human
gcggtgaattctagaggcgg

SEQ ID NO: 175168 - DNA, 20 bp, human
gacgccaccagcgagaaaga

SEQ ID NO: 175169 - DNA, 20 bp, human
gtcggcggctctagaaggtc

SEQ ID NO: 175170 - DNA, 20 bp, human
gtgatagcgctggtagaagg

SEQ ID NO: 175171 - DNA, 20 bp, human
ggaattctagaggcggcgga

SEQ ID NO: 175172 - DNA, 20 bp, human
ggctagacccggctttaaca

SEQ ID NO: 175173 - DNA, 20 bp, human
gtctgctcggcggctctaga

SEQ ID NO: 175174 - DNA, 20 bp, human
gtcaccgggcgtctgctcgg

SEQ ID NO: 175175 - DNA, 20 bp, human
gtctgcagctgtgctagacc

SEQ ID NO: 175176 - DNA, 20 bp, human
ggtgcagccttggagatcaa

SEQ ID NO: 175177 - DNA, 20 bp, human
ggggatgtgtccagccccga

SEQ ID NO: 175178 - DNA, 20 bp, human
gagcgggcccttgatctcca

SEQ ID NO: 175179 - DNA, 20 bp, human
gacacatcccggctctggag

SEQ ID NO: 175180 - DNA, 20 bp, human
gactccgcgccgctgggtca

SEQ ID NO: 175181 - DNA, 20 bp, human
gaagggcccgctccagagcc

SEQ ID NO: 175182 - DNA, 20 bp, human
gacccggggaagaacttcag

SEQ ID NO: 175183 - DNA, 20 bp, human
gggctcgtgccccaactact

SEQ ID NO: 175184 - DNA, 20 bp, human
gccgcaattagggtgagtgt

SEQ ID NO: 175185 - DNA, 20 bp, human
ggccaccgctccgcctgtca

SEQ ID NO: 175186 - DNA, 20 bp, human
gaggagggaacccgcaagga

SEQ ID NO: 175187 - DNA, 20 bp, human
gcagccgtcgggtagaagtc

SEQ ID NO: 175188 - DNA, 20 bp, human
gcccaggtccacagcctgaa

SEQ ID NO: 175189 - DNA, 20 bp, human
gtccacagcctgaagggagg

SEQ ID NO: 175190 - DNA, 20 bp, human
gcgccgccgcggagcaggta

SEQ ID NO: 175191 - DNA, 20 bp, human
ggcctgaagggaggaggcga

SEQ ID NO: 175192 - DNA, 20 bp, human
gtagggctgcgccagccgtc

SEQ ID NO: 175193 - DNA, 20 bp, human
gacggaaagacggacacagg

SEQ ID NO: 175194 - DNA, 20 bp, human
gacgcccgacttctacccga

SEQ ID NO: 175195 - DNA, 20 bp, human
gctggaggagggaacccgca

SEQ ID NO: 175196 - DNA, 20 bp, human
ggcacgtacctcccagctca

SEQ ID NO: 175197 - DNA, 20 bp, human
ggtacctcccagctcaaggt

SEQ ID NO: 175198 - DNA, 20 bp, human
gcattgagcacagatggtct

SEQ ID NO: 175199 - DNA, 20 bp, human
ggaggactgaggggggaaat

SEQ ID NO: 175200 - DNA, 20 bp, human
ggaagaggtgggatagttgg

SEQ ID NO: 175201 - DNA, 20 bp, human
gctgggccaccaagcaaaat

SEQ ID NO: 175202 - DNA, 20 bp, human
gtgcgctccaaagaagaggt

SEQ ID NO: 175203 - DNA, 20 bp, human
ggattcagcaagactaagac

SEQ ID NO: 175204 - DNA, 20 bp, human
gaagaagacctggcctaaag

SEQ ID NO: 175205 - DNA, 20 bp, human
gcacaaaccaaccttgagct

SEQ ID NO: 175206 - DNA, 20 bp, human
gctcctagcagggaagccgg

SEQ ID NO: 175207 - DNA, 20 bp, human
ggcggtaggtgcgccctagt

SEQ ID NO: 175208 - DNA, 20 bp, human
gcggctactgctgcctacta

SEQ ID NO: 175209 - DNA, 20 bp, human
gcagtgggagctagttggat

SEQ ID NO: 175210 - DNA, 20 bp, human
gtactgcttacccagaatag

SEQ ID NO: 175211 - DNA, 20 bp, human
ggtaaaccccgcataaaccc

SEQ ID NO: 175212 - DNA, 20 bp, human
gaaatagcctccaagagcac

SEQ ID NO: 175213 - DNA, 20 bp, human
gacccccagggagggaaagt

SEQ ID NO: 175214 - DNA, 20 bp, human
gcagtactttgtgagcatcg

SEQ ID NO: 175215 - DNA, 20 bp, human
gagcaagcgcacagcagagg

SEQ ID NO: 175216 - DNA, 20 bp, human
ggcgaggcgtcagaagctgt

SEQ ID NO: 175217 - DNA, 20 bp, human
gagccggggctccccaccgt

SEQ ID NO: 175218 - DNA, 20 bp, human
gtcgcgccagggtttcccga

SEQ ID NO: 175219 - DNA, 20 bp, human
gtcggcttgattgatcccca

SEQ ID NO: 175220 - DNA, 20 bp, human
gagggaagcagcgtgaacag

SEQ ID NO: 175221 - DNA, 20 bp, human
ggagcgccttcgaactttgg

SEQ ID NO: 175222 - DNA, 20 bp, human
gcttctgacgcctcgcgcca

SEQ ID NO: 175223 - DNA, 20 bp, human
gtccccagcgcgggaccttc

SEQ ID NO: 175224 - DNA, 20 bp, human
gcagctggtccccgttccca

SEQ ID NO: 175225 - DNA, 20 bp, human
gtcccgaaggtcccgcgctg

SEQ ID NO: 175226 - DNA, 20 bp, human
gtaagccgagctgggacggg

SEQ ID NO: 175227 - DNA, 20 bp, human
ggacggagagagcgagccgc

SEQ ID NO: 175228 - DNA, 20 bp, human
ggctcgagcgggacctccca

SEQ ID NO: 175229 - DNA, 20 bp, human
ggcgcgggatccagccaggt

SEQ ID NO: 175230 - DNA, 20 bp, human
gccacccgccgggccacaca

SEQ ID NO: 175231 - DNA, 20 bp, human
ggcatcccgccctaagccag

SEQ ID NO: 175232 - DNA, 20 bp, human
gactgctctggtgtgagccc

SEQ ID NO: 175233 - DNA, 20 bp, human
ggtgtggcagggatcgagtg

SEQ ID NO: 175234 - DNA, 20 bp, human
gcctccaggccgcgacccca

SEQ ID NO: 175235 - DNA, 20 bp, human
gagcagggcagggccagcgc

SEQ ID NO: 175236 - DNA, 20 bp, human
gcagagcacggttcccataa

SEQ ID NO: 175237 - DNA, 20 bp, human
gagcacggttcccataaggg

SEQ ID NO: 175238 - DNA, 20 bp, human
ggacgctgtcacagtcccta

SEQ ID NO: 175239 - DNA, 20 bp, human
gcgtgctctgcaggtagaaa

SEQ ID NO: 175240 - DNA, 20 bp, human
ggaggtgaggagatatgacg

SEQ ID NO: 175241 - DNA, 20 bp, human
gctgatctcgccgcccttat

SEQ ID NO: 175242 - DNA, 20 bp, human
ggtggtcttccagatgagac

SEQ ID NO: 175243 - DNA, 20 bp, human
ggtgccatggcggggtatgt

SEQ ID NO: 175244 - DNA, 20 bp, human
ggtgacggtggccctgtcag

SEQ ID NO: 175245 - DNA, 20 bp, human
gctgtcacagtccctagggc

SEQ ID NO: 175246 - DNA, 20 bp, human
gcccagaggcagtggttcgg

SEQ ID NO: 175247 - DNA, 20 bp, human
gcaatcacatcagcaccaaa

SEQ ID NO: 175248 - DNA, 20 bp, human
gtcggatctggttccaaatg

SEQ ID NO: 175249 - DNA, 20 bp, human
gtggcacctctgaaaccagt

SEQ ID NO: 175250 - DNA, 20 bp, human
gaacagagggtgattccctt

SEQ ID NO: 175251 - DNA, 20 bp, human
gtgctgtgtagggagactca

SEQ ID NO: 175252 - DNA, 20 bp, human
gtagttgtggttcttcagtc

SEQ ID NO: 175253 - DNA, 20 bp, human
gtgatgatttgaggacccac

SEQ ID NO: 175254 - DNA, 20 bp, human
gccgagctgagtgagtccca

SEQ ID NO: 175255 - DNA, 20 bp, human
gcagagcatcctgagccatt

SEQ ID NO: 175256 - DNA, 20 bp, human
ggcggccggttacctgctgg

SEQ ID NO: 175257 - DNA, 20 bp, human
gggttacctgctggaggcag

SEQ ID NO: 175258 - DNA, 20 bp, human
gggaagcgcggtggtctgga

SEQ ID NO: 175259 - DNA, 20 bp, human
gggtggtctggagggcacca

SEQ ID NO: 175260 - DNA, 20 bp, human
gggcgtcgctgaggagacgt

SEQ ID NO: 175261 - DNA, 20 bp, human
gtcgccccgtcgcccacccc

SEQ ID NO: 175262 - DNA, 20 bp, human
gccacctggcagctcgctca

SEQ ID NO: 175263 - DNA, 20 bp, human
gggtgggcggctctgcctag

SEQ ID NO: 175264 - DNA, 20 bp, human
ggcgacagctggaagcgcgg

SEQ ID NO: 175265 - DNA, 20 bp, human
gctccaccgtccccggtcac

SEQ ID NO: 175266 - DNA, 20 bp, human
gcccttctggtgtactgggt

SEQ ID NO: 175267 - DNA, 20 bp, human
gagcgcgccgagacccctca

SEQ ID NO: 175268 - DNA, 20 bp, human
ggaaggtgcagcagttacca

SEQ ID NO: 175269 - DNA, 20 bp, human
gggccggtaagaaggcggag

SEQ ID NO: 175270 - DNA, 20 bp, human
gcccaagggcctgcaaggaa

SEQ ID NO: 175271 - DNA, 20 bp, human
gagggcggccggtaagaagg

SEQ ID NO: 175272 - DNA, 20 bp, human
ggggtgctgacgtcagctag

SEQ ID NO: 175273 - DNA, 20 bp, human
ggcgcgtccgaacagccctg

SEQ ID NO: 175274 - DNA, 20 bp, human
ggacccttgccagaactgta

SEQ ID NO: 175275 - DNA, 20 bp, human
gtggcaagggtccgacgcga

SEQ ID NO: 175276 - DNA, 20 bp, human
gtgagacctaccaccagcag

SEQ ID NO: 175277 - DNA, 20 bp, human
gcctggctgatgatgcggat

SEQ ID NO: 175278 - DNA, 20 bp, human
gttctgcccagaaggcctcc

SEQ ID NO: 175279 - DNA, 20 bp, human
ggcaggaagaatgccccatg

SEQ ID NO: 175280 - DNA, 20 bp, human
gggaggagaactgtgagcgc

SEQ ID NO: 175281 - DNA, 20 bp, human
ggtccacacggcccgaggag

SEQ ID NO: 175282 - DNA, 20 bp, human
ggagaactgtgagcgccggg

SEQ ID NO: 175283 - DNA, 20 bp, human
ggccctggagaaatttctgg

SEQ ID NO: 175284 - DNA, 20 bp, human
gtgggtgtcctcctcatgca

SEQ ID NO: 175285 - DNA, 20 bp, human
gtgatgcggatgggcatcct

SEQ ID NO: 175286 - DNA, 20 bp, human
gggcaccagcgagcagggac

SEQ ID NO: 175287 - DNA, 20 bp, human
gttacgaacgaagcccgcgg

SEQ ID NO: 175288 - DNA, 20 bp, human
gagcgagcgggtcctaacgc

SEQ ID NO: 175289 - DNA, 20 bp, human
gtacacggcaccagcgagca

SEQ ID NO: 175290 - DNA, 20 bp, human
ggcttcgttcgtaaggaagg

SEQ ID NO: 175291 - DNA, 20 bp, human
gaggcgggcgtcgggctagt

SEQ ID NO: 175292 - DNA, 20 bp, human
ggcgggcccggctcccagac

SEQ ID NO: 175293 - DNA, 20 bp, human
gcgggcccggacaccctccc

SEQ ID NO: 175294 - DNA, 20 bp, human
gctggaaatacaagagcgag

SEQ ID NO: 175295 - DNA, 20 bp, human
ggcccgcctggcgggaacat

SEQ ID NO: 175296 - DNA, 20 bp, human
ggagactaaccgggacgcag

SEQ ID NO: 175297 - DNA, 20 bp, human
gccggggttgcgggagtgaa

SEQ ID NO: 175298 - DNA, 20 bp, human
gctgctcctgaggcgatgat

SEQ ID NO: 175299 - DNA, 20 bp, human
gtccccggcagagactaacc

SEQ ID NO: 175300 - DNA, 20 bp, human
ggttgcgggagtgaacggca

SEQ ID NO: 175301 - DNA, 20 bp, human
gcaaggtccaggcctgatcg

SEQ ID NO: 175302 - DNA, 20 bp, human
gaggggtctcggccacgggt

SEQ ID NO: 175303 - DNA, 20 bp, human
ggccgcggacgacagacccc

SEQ ID NO: 175304 - DNA, 20 bp, human
gggccaaggaaggagtcgac

SEQ ID NO: 175305 - DNA, 20 bp, human
gccgcagccgggcaggaccc

SEQ ID NO: 175306 - DNA, 20 bp, human
gggcagcagtagggcctcgg

SEQ ID NO: 175307 - DNA, 20 bp, human
ggggcacaggggcagcagta

SEQ ID NO: 175308 - DNA, 20 bp, human
ggcaggaggcgcgaaggcgg

SEQ ID NO: 175309 - DNA, 20 bp, human
ggggcgtcgcgggccaacat

SEQ ID NO: 175310 - DNA, 20 bp, human
gggccaggaagaacacggtg

SEQ ID NO: 175311 - DNA, 20 bp, human
gaccctgggcagctagtgca

SEQ ID NO: 175312 - DNA, 20 bp, human
ggggatcgtgcgggtcccgg

SEQ ID NO: 175313 - DNA, 20 bp, human
gtgcgtggcccaggacgcca

SEQ ID NO: 175314 - DNA, 20 bp, human
gggacgccagggggatcgtg

SEQ ID NO: 175315 - DNA, 20 bp, human
ggtgaaccctacacgtccaa

SEQ ID NO: 175316 - DNA, 20 bp, human
gtaggggagcgtgcaggcag

SEQ ID NO: 175317 - DNA, 20 bp, human
gtctcgaccaaagggtaata

SEQ ID NO: 175318 - DNA, 20 bp, human
gtaatagggagatggtggac

SEQ ID NO: 175319 - DNA, 20 bp, human
gtggctggtgcccagaaagt

SEQ ID NO: 175320 - DNA, 20 bp, human
ggcacgctcccctagctctc

SEQ ID NO: 175321 - DNA, 20 bp, human
gaggacgaagcttgacgcag

SEQ ID NO: 175322 - DNA, 20 bp, human
gaccgggacgagagggactt

SEQ ID NO: 175323 - DNA, 20 bp, human
ggtctgtacccccctcccgg

SEQ ID NO: 175324 - DNA, 20 bp, human
gaagagaacccgagagctag

SEQ ID NO: 175325 - DNA, 20 bp, human
gggcgctgcctagtaacccg

SEQ ID NO: 175326 - DNA, 20 bp, human
gggagatcaagtgtttccat

SEQ ID NO: 175327 - DNA, 20 bp, human
gctgtgtcccccttccccgg

SEQ ID NO: 175328 - DNA, 20 bp, human
gtggaggactcagtgcaagg

SEQ ID NO: 175329 - DNA, 20 bp, human
gcaaaaatgaggtggcgctg

SEQ ID NO: 175330 - DNA, 20 bp, human
gggcgcccggacccgaccgc

SEQ ID NO: 175331 - DNA, 20 bp, human
ggatctccgcaaaaatgagg

SEQ ID NO: 175332 - DNA, 20 bp, human
ggggtgtagattgtgagaag

SEQ ID NO: 175333 - DNA, 20 bp, human
ggcaggttgcctccggggaa

SEQ ID NO: 175334 - DNA, 20 bp, human
gcgagccaggcttgcttcgg

SEQ ID NO: 175335 - DNA, 20 bp, human
ggggggatgcggagtcgcgg

SEQ ID NO: 175336 - DNA, 20 bp, human
gaacacgggcaagagagttg

SEQ ID NO: 175337 - DNA, 20 bp, human
gcagtacctcaagcaatata

SEQ ID NO: 175338 - DNA, 20 bp, human
gcagggaggatcaaagacag

SEQ ID NO: 175339 - DNA, 20 bp, human
gagagttgaggaaccgttaa

SEQ ID NO: 175340 - DNA, 20 bp, human
gaagaacagccaccgcacga

SEQ ID NO: 175341 - DNA, 20 bp, human
gccagaagtagcttgtattc

SEQ ID NO: 175342 - DNA, 20 bp, human
gaagccagagagtgcgggaa

SEQ ID NO: 175343 - DNA, 20 bp, human
gagaatttgacaacatggct

SEQ ID NO: 175344 - DNA, 20 bp, human
gctggctctctttcactgtc

SEQ ID NO: 175345 - DNA, 20 bp, human
gaagaaaagccagagagtgc

SEQ ID NO: 175346 - DNA, 20 bp, human
gggcgctgccggcggaacca

SEQ ID NO: 175347 - DNA, 20 bp, human
gctggcagtaggagtaggga

SEQ ID NO: 175348 - DNA, 20 bp, human
gtggggtgcgggggatgtag

SEQ ID NO: 175349 - DNA, 20 bp, human
gctggaaatggagtacgggg

SEQ ID NO: 175350 - DNA, 20 bp, human
gtgccggcggaaccacggaa

SEQ ID NO: 175351 - DNA, 20 bp, human
ggagcggtcggaggcaaggg

SEQ ID NO: 175352 - DNA, 20 bp, human
gggtggctggcagtaggagt

SEQ ID NO: 175353 - DNA, 20 bp, human
ggcgccaggaccggaccgca

SEQ ID NO: 175354 - DNA, 20 bp, human
gccgggagactggtgaggag

SEQ ID NO: 175355 - DNA, 20 bp, human
ggaaggcacaggcctgtccc

SEQ ID NO: 175356 - DNA, 20 bp, human
gacccagccgcggggacaga

SEQ ID NO: 175357 - DNA, 20 bp, human
gagagggcaggcactcggac

SEQ ID NO: 175358 - DNA, 20 bp, human
gtctgcacgggcgcagatgt

SEQ ID NO: 175359 - DNA, 20 bp, human
gcggctccaaaatggacgga

SEQ ID NO: 175360 - DNA, 20 bp, human
ggtggggcggtggaactcct

SEQ ID NO: 175361 - DNA, 20 bp, human
gtggctgagggggagcacgt

SEQ ID NO: 175362 - DNA, 20 bp, human
gcgccccagtagtgagacag

SEQ ID NO: 175363 - DNA, 20 bp, human
gagcagacgagacccagccg

SEQ ID NO: 175364 - DNA, 20 bp, human
gctcgtctgctccggttcct

SEQ ID NO: 175365 - DNA, 20 bp, human
ggcattcacgtgatctgcac

SEQ ID NO: 175366 - DNA, 20 bp, human
ggggctggctcattacctca

SEQ ID NO: 175367 - DNA, 20 bp, human
gtacctcaaggagtataaag

SEQ ID NO: 175368 - DNA, 20 bp, human
gaaggaatggcttcaaacca

SEQ ID NO: 175369 - DNA, 20 bp, human
ggcttcaaaccaaggaaaga

SEQ ID NO: 175370 - DNA, 20 bp, human
ggccaaaagaaaaactaata

SEQ ID NO: 175371 - DNA, 20 bp, human
gggcctctttatactccttg

SEQ ID NO: 175372 - DNA, 20 bp, human
gctggctttctctcgtcttg

SEQ ID NO: 175373 - DNA, 20 bp, human
ggacaatatggctaaggtgc

SEQ ID NO: 175374 - DNA, 20 bp, human
gccagagtacaagttacttc

SEQ ID NO: 175375 - DNA, 20 bp, human
gcagcccttgtttcactccc

SEQ ID NO: 175376 - DNA, 20 bp, human
gggaactcgagagaggtcaa

SEQ ID NO: 175377 - DNA, 20 bp, human
gacagggatctggtacctgg

SEQ ID NO: 175378 - DNA, 20 bp, human
gtacaagccggggacccctg

SEQ ID NO: 175379 - DNA, 20 bp, human
gggggggcggaactcgagag

SEQ ID NO: 175380 - DNA, 20 bp, human
gaaggcagacttcagactga

SEQ ID NO: 175381 - DNA, 20 bp, human
gtgtgttgggcaagaggtat

SEQ ID NO: 175382 - DNA, 20 bp, human
gcggcttgtaccgacctgca

SEQ ID NO: 175383 - DNA, 20 bp, human
ggccggggacccctgaggta

SEQ ID NO: 175384 - DNA, 20 bp, human
gcagatccctgtttccgtgg

SEQ ID NO: 175385 - DNA, 20 bp, human
gtccctgtttccgtggagga

SEQ ID NO: 175386 - DNA, 20 bp, human
gagtgaccaggcgcctacgt

SEQ ID NO: 175387 - DNA, 20 bp, human
gtgagacaggttgcctccgg

SEQ ID NO: 175388 - DNA, 20 bp, human
gtgggagcggattgtgagag

SEQ ID NO: 175389 - DNA, 20 bp, human
gtttgtgccccttcccccgg

SEQ ID NO: 175390 - DNA, 20 bp, human
gggtgctcacgtgagtgacc

SEQ ID NO: 175391 - DNA, 20 bp, human
gtggcctagctcccgtgacg

SEQ ID NO: 175392 - DNA, 20 bp, human
ggtgaaacacagacttattc

SEQ ID NO: 175393 - DNA, 20 bp, human
gaggcgagccaggttcgctt

SEQ ID NO: 175394 - DNA, 20 bp, human
ggcaccgcgtcacgggagct

SEQ ID NO: 175395 - DNA, 20 bp, human
gctctttgtgccccttcccc

SEQ ID NO: 175396 - DNA, 20 bp, human
ggcttgtctgcagggcagta

SEQ ID NO: 175397 - DNA, 20 bp, human
gggagaaaggctgaaatccc

SEQ ID NO: 175398 - DNA, 20 bp, human
gccttggccacaagcacgca

SEQ ID NO: 175399 - DNA, 20 bp, human
gaaagaagcccgggaatata

SEQ ID NO: 175400 - DNA, 20 bp, human
gcgcgggacggggcgaagga

SEQ ID NO: 175401 - DNA, 20 bp, human
gactgaccccgggggtccag

SEQ ID NO: 175402 - DNA, 20 bp, human
gcacccactactgaccccgg

SEQ ID NO: 175403 - DNA, 20 bp, human
ggacccccggggtcagtagt

SEQ ID NO: 175404 - DNA, 20 bp, human
gcccgggaatataaggactt

SEQ ID NO: 175405 - DNA, 20 bp, human
gctcactcaatgccggcctg

SEQ ID NO: 175406 - DNA, 20 bp, human
gagcagaaagcaagcggggc

SEQ ID NO: 175407 - DNA, 20 bp, human
gataaacgtgggcgctgact

SEQ ID NO: 175408 - DNA, 20 bp, human
ggcaataaggagctgctaca

SEQ ID NO: 175409 - DNA, 20 bp, human
gaaacaggccctggactata

SEQ ID NO: 175410 - DNA, 20 bp, human
gactaacctgaaaggatctt

SEQ ID NO: 175411 - DNA, 20 bp, human
gctgcttgcagaaaaacggt

SEQ ID NO: 175412 - DNA, 20 bp, human
gcggggttgccataaaagga

SEQ ID NO: 175413 - DNA, 20 bp, human
gagactagtacctggatcac

SEQ ID NO: 175414 - DNA, 20 bp, human
gcagaagtccttatagtcca

SEQ ID NO: 175415 - DNA, 20 bp, human
gcatggcctagaatcatgaa

SEQ ID NO: 175416 - DNA, 20 bp, human
ggggcttccgctgggaataa

SEQ ID NO: 175417 - DNA, 20 bp, human
ggttctccgtgggcactggg

SEQ ID NO: 175418 - DNA, 20 bp, human
gtaatggtgacccctagtaa

SEQ ID NO: 175419 - DNA, 20 bp, human
ggagaaacgatgccaaatgt

SEQ ID NO: 175420 - DNA, 20 bp, human
gctgtcgaggtcgccagagt

SEQ ID NO: 175421 - DNA, 20 bp, human
gggcgagcccttattcccag

SEQ ID NO: 175422 - DNA, 20 bp, human
gcagagtgggctgaaccctc

SEQ ID NO: 175423 - DNA, 20 bp, human
ggtgatcggaagttctccgt

SEQ ID NO: 175424 - DNA, 20 bp, human
ggcgacctcgacagtcggag

SEQ ID NO: 175425 - DNA, 20 bp, human
gctagtaaaggtgcagcgag

SEQ ID NO: 175426 - DNA, 20 bp, human
ggaggaactaccgccctggg

SEQ ID NO: 175427 - DNA, 20 bp, human
gctgagtgctgggaacgagg

SEQ ID NO: 175428 - DNA, 20 bp, human
gctccagactgcaacctcgt

SEQ ID NO: 175429 - DNA, 20 bp, human
gtcagaggaactaccgccct

SEQ ID NO: 175430 - DNA, 20 bp, human
gggtcagaggaccctaccca

SEQ ID NO: 175431 - DNA, 20 bp, human
gctgtggcccagaggcgcga

SEQ ID NO: 175432 - DNA, 20 bp, human
ggcgccaacagcagctacca

SEQ ID NO: 175433 - DNA, 20 bp, human
ggggtaggggcacccaacaa

SEQ ID NO: 175434 - DNA, 20 bp, human
gggcccagaggcgcgagggc

SEQ ID NO: 175435 - DNA, 20 bp, human
gtacccacggctgtaatctc

SEQ ID NO: 175436 - DNA, 20 bp, human
gggactgacgagtgagtctc

SEQ ID NO: 175437 - DNA, 20 bp, human
gtaggggctgtggcagtacg

SEQ ID NO: 175438 - DNA, 20 bp, human
gcgactgccccggaacccac

SEQ ID NO: 175439 - DNA, 20 bp, human
ggcagaaaggaaaagcgaca

SEQ ID NO: 175440 - DNA, 20 bp, human
gaagcgagagacctctccct

SEQ ID NO: 175441 - DNA, 20 bp, human
gcttctaggcggggaaggaa

SEQ ID NO: 175442 - DNA, 20 bp, human
gactaatctgagcggacacg

SEQ ID NO: 175443 - DNA, 20 bp, human
gttccccgcctagaagggaa

SEQ ID NO: 175444 - DNA, 20 bp, human
gacacgaggaacaagcagaa

SEQ ID NO: 175445 - DNA, 20 bp, human
ggtacgcggggacccggctg

SEQ ID NO: 175446 - DNA, 20 bp, human
ggccggcgcgtcgaggggag

SEQ ID NO: 175447 - DNA, 20 bp, human
gccacgcccgctcaccatcg

SEQ ID NO: 175448 - DNA, 20 bp, human
gggagaggcagcagccgcga

SEQ ID NO: 175449 - DNA, 20 bp, human
gcggagcctgcccaagatgg

SEQ ID NO: 175450 - DNA, 20 bp, human
gcagcagccgcgatggtgag

SEQ ID NO: 175451 - DNA, 20 bp, human
gagcagcggctgtacaaggt

SEQ ID NO: 175452 - DNA, 20 bp, human
gaacggatgtcccagtcccg

SEQ ID NO: 175453 - DNA, 20 bp, human
gaactgaagcgcatcgtcga

SEQ ID NO: 175454 - DNA, 20 bp, human
gatgcggagcctgcccaaga

SEQ ID NO: 175455 - DNA, 20 bp, human
gcgctcgccgcggggatctc

SEQ ID NO: 175456 - DNA, 20 bp, human
gcgcgagcccagttccggcg

SEQ ID NO: 175457 - DNA, 20 bp, human
ggtcggtgagggccccgtaa

SEQ ID NO: 175458 - DNA, 20 bp, human
gacagcgatggcggcggagt

SEQ ID NO: 175459 - DNA, 20 bp, human
gaggcaccgggaggccaacg

SEQ ID NO: 175460 - DNA, 20 bp, human
gagcggcgcggactccccag

SEQ ID NO: 175461 - DNA, 20 bp, human
ggccacggagcgcctctggg

SEQ ID NO: 175462 - DNA, 20 bp, human
ggagcccagttccggcgagg

SEQ ID NO: 175463 - DNA, 20 bp, human
ggagtcggcgctccaagttg

SEQ ID NO: 175464 - DNA, 20 bp, human
gctgcgggagagcgtgcccg

SEQ ID NO: 175465 - DNA, 20 bp, human
gcgggaggccaacgaggcgg

SEQ ID NO: 175466 - DNA, 20 bp, human
ggcaacaaagaatgaagctc

SEQ ID NO: 175467 - DNA, 20 bp, human
gccaagagctaagagggtca

SEQ ID NO: 175468 - DNA, 20 bp, human
gctgcgggacaggaagtctg

SEQ ID NO: 175469 - DNA, 20 bp, human
ggcctgggatgggctacata

SEQ ID NO: 175470 - DNA, 20 bp, human
gcatcccaggctgacactca

SEQ ID NO: 175471 - DNA, 20 bp, human
gaaactgcagaggtcactcc

SEQ ID NO: 175472 - DNA, 20 bp, human
ggccttatgtagcccatccc

SEQ ID NO: 175473 - DNA, 20 bp, human
ggcaggcgtcgctgtcccgg

SEQ ID NO: 175474 - DNA, 20 bp, human
gcaggccacttggtctggaa

SEQ ID NO: 175475 - DNA, 20 bp, human
gggtcgcagctctgtctttg

SEQ ID NO: 175476 - DNA, 20 bp, human
ggctgcggccgcacatcccg

SEQ ID NO: 175477 - DNA, 20 bp, human
ggcggcccggtggaagaagc

SEQ ID NO: 175478 - DNA, 20 bp, human
gcggcggcacaggcagtctg

SEQ ID NO: 175479 - DNA, 20 bp, human
ggctctgtccgagctcgggg

SEQ ID NO: 175480 - DNA, 20 bp, human
gagcaccagcttcttccacc

SEQ ID NO: 175481 - DNA, 20 bp, human
gtgctcgtggaccgaaacac

SEQ ID NO: 175482 - DNA, 20 bp, human
ggccacttggtctggaacgc

SEQ ID NO: 175483 - DNA, 20 bp, human
gcactacgctgcgcgcagtg

SEQ ID NO: 175484 - DNA, 20 bp, human
gtggaagaagctggtgctcg

SEQ ID NO: 175485 - DNA, 20 bp, human
ggagctcggggcggcggcac

SEQ ID NO: 175486 - DNA, 20 bp, human
ggctgcggccgcacatcccg

SEQ ID NO: 175487 - DNA, 20 bp, human
ggcggcccggtggaagaagc

SEQ ID NO: 175488 - DNA, 20 bp, human
gcggcggcacaggcagtctg

SEQ ID NO: 175489 - DNA, 20 bp, human
ggctctgtccgagctcgggg

SEQ ID NO: 175490 - DNA, 20 bp, human
gagcaccagcttcttccacc

SEQ ID NO: 175491 - DNA, 20 bp, human
gtgctcgtggaccgaaacac

SEQ ID NO: 175492 - DNA, 20 bp, human
ggccacttggtctggaacgc

SEQ ID NO: 175493 - DNA, 20 bp, human
gcactacgctgcgcgcagtg

SEQ ID NO: 175494 - DNA, 20 bp, human
gtggaagaagctggtgctcg

SEQ ID NO: 175495 - DNA, 20 bp, human
ggagctcggggcggcggcac

SEQ ID NO: 175496 - DNA, 20 bp, human
ggctgcggccgcacatcccg

SEQ ID NO: 175497 - DNA, 20 bp, human
ggcggcccggtggaagaagc

SEQ ID NO: 175498 - DNA, 20 bp, human
gcggcggcacaggcagtctg

SEQ ID NO: 175499 - DNA, 20 bp, human
ggctctgtccgagctcgggg

SEQ ID NO: 175500 - DNA, 20 bp, human
gagcaccagcttcttccacc

SEQ ID NO: 175501 - DNA, 20 bp, human
gtgctcgtggaccgaaacac

SEQ ID NO: 175502 - DNA, 20 bp, human
ggccacttggtctggaacgc

SEQ ID NO: 175503 - DNA, 20 bp, human
gcactacgctgcgcgcagtg

SEQ ID NO: 175504 - DNA, 20 bp, human
gtggaagaagctggtgctcg

SEQ ID NO: 175505 - DNA, 20 bp, human
ggagctcggggcggcggcac

SEQ ID NO: 175506 - DNA, 20 bp, human
ggcccgggccgggaccgcat

SEQ ID NO: 175507 - DNA, 20 bp, human
ggagtgaacgattcaacccg

SEQ ID NO: 175508 - DNA, 20 bp, human
gtgaacgcggccctctgtaa

SEQ ID NO: 175509 - DNA, 20 bp, human
gctcaggtcggccgagacgg

SEQ ID NO: 175510 - DNA, 20 bp, human
gacgcggccctctgtaatgg

SEQ ID NO: 175511 - DNA, 20 bp, human
gccaataggagacgtcgggt

SEQ ID NO: 175512 - DNA, 20 bp, human
gccgagacggaggcgacacg

SEQ ID NO: 175513 - DNA, 20 bp, human
gccacgctccgccattacag

SEQ ID NO: 175514 - DNA, 20 bp, human
gacccgggggagctcaggta

SEQ ID NO: 175515 - DNA, 20 bp, human
gctagccaataggagacgtc

SEQ ID NO: 175516 - DNA, 20 bp, human
gagtctggcgcagagggcag

SEQ ID NO: 175517 - DNA, 20 bp, human
gtacatccccgcgctgacgg

SEQ ID NO: 175518 - DNA, 20 bp, human
gccggcaccatccagaccca

SEQ ID NO: 175519 - DNA, 20 bp, human
gcgtccatcggccagaggag

SEQ ID NO: 175520 - DNA, 20 bp, human
gccgaggcgagcagcaccgg

SEQ ID NO: 175521 - DNA, 20 bp, human
ggcaccatccagacccaggg

SEQ ID NO: 175522 - DNA, 20 bp, human
gcgccgccggcccagcatct

SEQ ID NO: 175523 - DNA, 20 bp, human
ggagccaagtgagttcgctc

SEQ ID NO: 175524 - DNA, 20 bp, human
gacccgggccgaggcgggac

SEQ ID NO: 175525 - DNA, 20 bp, human
gggcgggcgcccgagatgct

SEQ ID NO: 175526 - DNA, 20 bp, human
gccccccgaatagaacttgt

SEQ ID NO: 175527 - DNA, 20 bp, human
gccgagtcgggcaccgaacg

SEQ ID NO: 175528 - DNA, 20 bp, human
gacccacaagttctattcgg

SEQ ID NO: 175529 - DNA, 20 bp, human
gctgggcgccggcccgagtc

SEQ ID NO: 175530 - DNA, 20 bp, human
gcactccggcagggacgcgg

SEQ ID NO: 175531 - DNA, 20 bp, human
gacttgtgggtctcttcagg

SEQ ID NO: 175532 - DNA, 20 bp, human
ggggaccgacagcccgcccc

SEQ ID NO: 175533 - DNA, 20 bp, human
gggtttcgcgctgtacaaag

SEQ ID NO: 175534 - DNA, 20 bp, human
ggtggttggatgcggagacg

SEQ ID NO: 175535 - DNA, 20 bp, human
gagtgaaccgagccgctggg

SEQ ID NO: 175536 - DNA, 20 bp, human
gggatatatgtcttggagag

SEQ ID NO: 175537 - DNA, 20 bp, human
gagaattgctgcccattcca

SEQ ID NO: 175538 - DNA, 20 bp, human
gtgctgcccattccagggac

SEQ ID NO: 175539 - DNA, 20 bp, human
gcttatcctgtccctggaat

SEQ ID NO: 175540 - DNA, 20 bp, human
gctttttactaaaatctgtg

SEQ ID NO: 175541 - DNA, 20 bp, human
gctttgatgtattactacaa

SEQ ID NO: 175542 - DNA, 20 bp, human
gcctgtgtggatatatgtct

SEQ ID NO: 175543 - DNA, 20 bp, human
gcatatatccacacaggcaa

SEQ ID NO: 175544 - DNA, 20 bp, human
gagtactatgcattcacaca

SEQ ID NO: 175545 - DNA, 20 bp, human
gacacatggatctactcaaa

SEQ ID NO: 175546 - DNA, 20 bp, human
ggcagcagcgcgaacgccat

SEQ ID NO: 175547 - DNA, 20 bp, human
gcgcggcgcacggagggacg

SEQ ID NO: 175548 - DNA, 20 bp, human
ggtgcgccgcgtcccagcgt

SEQ ID NO: 175549 - DNA, 20 bp, human
gcgcggccgacgctgggacg

SEQ ID NO: 175550 - DNA, 20 bp, human
gctgggacgcggcgcacgga

SEQ ID NO: 175551 - DNA, 20 bp, human
gcgtggtggtggtgcgacag

SEQ ID NO: 175552 - DNA, 20 bp, human
ggggcgactcggccgacgac

SEQ ID NO: 175553 - DNA, 20 bp, human
gaagcacggctgcccgtcgt

SEQ ID NO: 175554 - DNA, 20 bp, human
gtcgcgctgctgcggcccgt

SEQ ID NO: 175555 - DNA, 20 bp, human
ggtgctgctgctgggcgact

SEQ ID NO: 175556 - DNA, 20 bp, human
gcaagaagccggggccagga

SEQ ID NO: 175557 - DNA, 20 bp, human
gggaattccgaaggaggggt

SEQ ID NO: 175558 - DNA, 20 bp, human
ggggattggccagaagatcg

SEQ ID NO: 175559 - DNA, 20 bp, human
gaggcgctgcccgcgcgcag

SEQ ID NO: 175560 - DNA, 20 bp, human
ggcccgggaattccgaagga

SEQ ID NO: 175561 - DNA, 20 bp, human
gtagagaagccgggaagtag

SEQ ID NO: 175562 - DNA, 20 bp, human
gcaagcaggagtgctctatt

SEQ ID NO: 175563 - DNA, 20 bp, human
ggcagcgcctacccctcctt

SEQ ID NO: 175564 - DNA, 20 bp, human
gcgggaccccttgggctcct

SEQ ID NO: 175565 - DNA, 20 bp, human
gcaaacagatgcagcaacgt

SEQ ID NO: 175566 - DNA, 20 bp, human
gggcgtggatcccagagatg

SEQ ID NO: 175567 - DNA, 20 bp, human
ggatgttctgaggccactag

SEQ ID NO: 175568 - DNA, 20 bp, human
ggccctgtggcccaagcgat

SEQ ID NO: 175569 - DNA, 20 bp, human
gtggcgcttcaaccacccag

SEQ ID NO: 175570 - DNA, 20 bp, human
gctggctgcacctatcgctt

SEQ ID NO: 175571 - DNA, 20 bp, human
gatcacacaggtcggccctg

SEQ ID NO: 175572 - DNA, 20 bp, human
gtaggtgcagccagccccgg

SEQ ID NO: 175573 - DNA, 20 bp, human
ggtctaaacttggcctctag

SEQ ID NO: 175574 - DNA, 20 bp, human
gggaccaaaaagggtcagtc

SEQ ID NO: 175575 - DNA, 20 bp, human
gaggagcctggcctcatctc

SEQ ID NO: 175576 - DNA, 20 bp, human
gtccacaagggacccaacag

SEQ ID NO: 175577 - DNA, 20 bp, human
ggttggtactgagcactccc

SEQ ID NO: 175578 - DNA, 20 bp, human
ggcctgtggcaggggctgat

SEQ ID NO: 175579 - DNA, 20 bp, human
gacaggcaaagattccacaa

SEQ ID NO: 175580 - DNA, 20 bp, human
gtggcaggggctgatgggac

SEQ ID NO: 175581 - DNA, 20 bp, human
gctggttaccagttaagagt

SEQ ID NO: 175582 - DNA, 20 bp, human
gagtatgaaggacacaatgt

SEQ ID NO: 175583 - DNA, 20 bp, human
gggccagtggcctgtggcag

SEQ ID NO: 175584 - DNA, 20 bp, human
gggatgagctggatgctggt

SEQ ID NO: 175585 - DNA, 20 bp, human
gcagactggctaaaacgctg

SEQ ID NO: 175586 - DNA, 20 bp, human
ggagtcgtggccgtagagga

SEQ ID NO: 175587 - DNA, 20 bp, human
ggctcgctcaccctcctcta

SEQ ID NO: 175588 - DNA, 20 bp, human
ggttgtgagaaggaaccccg

SEQ ID NO: 175589 - DNA, 20 bp, human
gccgaggacttctgcagcag

SEQ ID NO: 175590 - DNA, 20 bp, human
ggagtggggaaacagagagc

SEQ ID NO: 175591 - DNA, 20 bp, human
gctctcctcggtgctctcgt

SEQ ID NO: 175592 - DNA, 20 bp, human
gggccgccgcggcccttctg

SEQ ID NO: 175593 - DNA, 20 bp, human
ggagcgagcgctgaggaatt

SEQ ID NO: 175594 - DNA, 20 bp, human
ggagctccaactgcgagaat

SEQ ID NO: 175595 - DNA, 20 bp, human
gacttccaacgagagcaccg

SEQ ID NO: 175596 - DNA, 20 bp, human
gagtgaggctgtaccatcag

SEQ ID NO: 175597 - DNA, 20 bp, human
gagaaacacagtgcctgagg

SEQ ID NO: 175598 - DNA, 20 bp, human
gaggacaaggcaggacccgt

SEQ ID NO: 175599 - DNA, 20 bp, human
gctgcagaggggtccagggg

SEQ ID NO: 175600 - DNA, 20 bp, human
gggagcaaacaggactgagt

SEQ ID NO: 175601 - DNA, 20 bp, human
gggaatggtaatactgagtg

SEQ ID NO: 175602 - DNA, 20 bp, human
gagcagaaacacagtgcctg

SEQ ID NO: 175603 - DNA, 20 bp, human
gccattcctgcccaagagag

SEQ ID NO: 175604 - DNA, 20 bp, human
gtgatgccttggagtctaag

SEQ ID NO: 175605 - DNA, 20 bp, human
ggtggggtggcatgtcacag

SEQ ID NO: 175606 - DNA, 20 bp, human
gcgaccggctaaggcaggtc

SEQ ID NO: 175607 - DNA, 20 bp, human
gtgtgtgctccgaccggcta

SEQ ID NO: 175608 - DNA, 20 bp, human
gaggacctggcccaccggag

SEQ ID NO: 175609 - DNA, 20 bp, human
gccggctaaggcaggtcggg

SEQ ID NO: 175610 - DNA, 20 bp, human
gccgacgccgcggaaaacca

SEQ ID NO: 175611 - DNA, 20 bp, human
gcaccggagaggctacgccg

SEQ ID NO: 175612 - DNA, 20 bp, human
gtggcgtgaaaggccgaggg

SEQ ID NO: 175613 - DNA, 20 bp, human
gcactcagccgctccaggaa

SEQ ID NO: 175614 - DNA, 20 bp, human
gacccggcacgcacgagagg

SEQ ID NO: 175615 - DNA, 20 bp, human
gtaagggtcccccgctcctc

SEQ ID NO: 175616 - DNA, 20 bp, human
gggagggcccggcgcgacat

SEQ ID NO: 175617 - DNA, 20 bp, human
ggtcgcgccgggccctccgg

SEQ ID NO: 175618 - DNA, 20 bp, human
ggaccacgacgtctggagag

SEQ ID NO: 175619 - DNA, 20 bp, human
gcgggccgcggagttagact

SEQ ID NO: 175620 - DNA, 20 bp, human
gaccgaacgaccacgacgtc

SEQ ID NO: 175621 - DNA, 20 bp, human
ggttctaaccccggtgaggt

SEQ ID NO: 175622 - DNA, 20 bp, human
gtccctctctccagacgtcg

SEQ ID NO: 175623 - DNA, 20 bp, human
ggggttgtgatgccaggggt

SEQ ID NO: 175624 - DNA, 20 bp, human
gccgggggcgcagggaagga

SEQ ID NO: 175625 - DNA, 20 bp, human
ggaaggaagcgcagaaaact

SEQ ID NO: 175626 - DNA, 20 bp, human
gctcccgccgcaggaagatg

SEQ ID NO: 175627 - DNA, 20 bp, human
gccgcaggaagatgaggcag

SEQ ID NO: 175628 - DNA, 20 bp, human
gtagcgggccggagccgacg

SEQ ID NO: 175629 - DNA, 20 bp, human
gcaggaagatgaggcagcgg

SEQ ID NO: 175630 - DNA, 20 bp, human
ggcggcggctgcgggcgtag

SEQ ID NO: 175631 - DNA, 20 bp, human
gccctgggcacaaagcacgg

SEQ ID NO: 175632 - DNA, 20 bp, human
gccccggcgccgcgcgaagt

SEQ ID NO: 175633 - DNA, 20 bp, human
ggtcgcggccgggcccccga

SEQ ID NO: 175634 - DNA, 20 bp, human
gcccggacaaaggtgcgtcg

SEQ ID NO: 175635 - DNA, 20 bp, human
gggctgcgggcgtagcgggc

SEQ ID NO: 175636 - DNA, 20 bp, human
gcctccccggagaagagagt

SEQ ID NO: 175637 - DNA, 20 bp, human
gtgtgtctgcggatctgtag

SEQ ID NO: 175638 - DNA, 20 bp, human
ggtctgcggatctgtagtgg

SEQ ID NO: 175639 - DNA, 20 bp, human
gtgcggatctgtagtggcgg

SEQ ID NO: 175640 - DNA, 20 bp, human
ggtcctcggtccctccgagg

SEQ ID NO: 175641 - DNA, 20 bp, human
ggcgcgcgggcggtaggtac

SEQ ID NO: 175642 - DNA, 20 bp, human
gccctccgagggggcatcaa

SEQ ID NO: 175643 - DNA, 20 bp, human
gtagggtgctggacaattag

SEQ ID NO: 175644 - DNA, 20 bp, human
gccccttgatgccccctcgg

SEQ ID NO: 175645 - DNA, 20 bp, human
gagagttggtgttaagagtc

SEQ ID NO: 175646 - DNA, 20 bp, human
gggaggctgcaagcacaggg

SEQ ID NO: 175647 - DNA, 20 bp, human
gaggccccggagtgcaccag

SEQ ID NO: 175648 - DNA, 20 bp, human
gtggcgggtcggaacatcaa

SEQ ID NO: 175649 - DNA, 20 bp, human
ggaccaggtaggtgaggcac

SEQ ID NO: 175650 - DNA, 20 bp, human
gcggcggcgcagggatcccg

SEQ ID NO: 175651 - DNA, 20 bp, human
gaggaggcggcagaacccag

SEQ ID NO: 175652 - DNA, 20 bp, human
ggcgcgggctgactccgcct

SEQ ID NO: 175653 - DNA, 20 bp, human
gcaaggaggctgcaagcaca

SEQ ID NO: 175654 - DNA, 20 bp, human
gctcacctacctggtcaagg

SEQ ID NO: 175655 - DNA, 20 bp, human
gtgcgcgctggagaccccga

SEQ ID NO: 175656 - DNA, 20 bp, human
gtccccttccaggacgaggg

SEQ ID NO: 175657 - DNA, 20 bp, human
ggcgcagcgggacctagacg

SEQ ID NO: 175658 - DNA, 20 bp, human
gtccggcagcgccgagccta

SEQ ID NO: 175659 - DNA, 20 bp, human
gggacgacttgacctcgtct

SEQ ID NO: 175660 - DNA, 20 bp, human
ggcccccctcgtcctggaag

SEQ ID NO: 175661 - DNA, 20 bp, human
gcagctcggactcggaggta

SEQ ID NO: 175662 - DNA, 20 bp, human
gagcagcagctcggactcgg

SEQ ID NO: 175663 - DNA, 20 bp, human
gtctaggtcccgctgcgccg

SEQ ID NO: 175664 - DNA, 20 bp, human
gtcgtccctggtcaacgagt

SEQ ID NO: 175665 - DNA, 20 bp, human
gcggcggcggtggcgagttg

SEQ ID NO: 175666 - DNA, 20 bp, human
gggatcgaaatccggaggaa

SEQ ID NO: 175667 - DNA, 20 bp, human
gggagcggagattattgaca

SEQ ID NO: 175668 - DNA, 20 bp, human
gcggaggaacggagtagtct

SEQ ID NO: 175669 - DNA, 20 bp, human
ggaacggagtagtctgggag

SEQ ID NO: 175670 - DNA, 20 bp, human
gaagggggatcgaaatccgg

SEQ ID NO: 175671 - DNA, 20 bp, human
gaaatgccgcagctgaacgg

SEQ ID NO: 175672 - DNA, 20 bp, human
gattgacagatagaaaaagg

SEQ ID NO: 175673 - DNA, 20 bp, human
ggcggtggaggggatgacct

SEQ ID NO: 175674 - DNA, 20 bp, human
gcaagaaaaagacgagtcca

SEQ ID NO: 175675 - DNA, 20 bp, human
ggggaagccgaagatacagg

SEQ ID NO: 175676 - DNA, 20 bp, human
gcgctgtgcgcggcactcag

SEQ ID NO: 175677 - DNA, 20 bp, human
gggcacagcacggggtacac

SEQ ID NO: 175678 - DNA, 20 bp, human
gccggcgcagagtagtgctc

SEQ ID NO: 175679 - DNA, 20 bp, human
gactctgcgccggccacagc

SEQ ID NO: 175680 - DNA, 20 bp, human
ggtcggccgccagcgcggac

SEQ ID NO: 175681 - DNA, 20 bp, human
gagcctggtggagatgacgg

SEQ ID NO: 175682 - DNA, 20 bp, human
gcacagccggcgcgccgttg

SEQ ID NO: 175683 - DNA, 20 bp, human
gcgcagagtagtgctcgggc

SEQ ID NO: 175684 - DNA, 20 bp, human
ggcgcggcgcggcccaacgg

SEQ ID NO: 175685 - DNA, 20 bp, human
gagagtagtgctcgggccgg

SEQ ID NO: 175686 - DNA, 20 bp, human
ggacttacccacttcaccag

SEQ ID NO: 175687 - DNA, 20 bp, human
gcttcttcctctggtgaagt

SEQ ID NO: 175688 - DNA, 20 bp, human
gcagtgcttgctgacaccac

SEQ ID NO: 175689 - DNA, 20 bp, human
ggaccacgatcccacagaat

SEQ ID NO: 175690 - DNA, 20 bp, human
ggctccaaccataagaagat

SEQ ID NO: 175691 - DNA, 20 bp, human
gtgggtaagtcccattctgt

SEQ ID NO: 175692 - DNA, 20 bp, human
ggcaagtgtactgggtaact

SEQ ID NO: 175693 - DNA, 20 bp, human
gcaccacaggcaagtgtact

SEQ ID NO: 175694 - DNA, 20 bp, human
gcactgtcgacttcttcctc

SEQ ID NO: 175695 - DNA, 20 bp, human
gatcatgtgtggctctgata

SEQ ID NO: 175696 - DNA, 20 bp, human
gcgagagcaggtagaacgtg

SEQ ID NO: 175697 - DNA, 20 bp, human
gtagcctcctgcggttagga

SEQ ID NO: 175698 - DNA, 20 bp, human
gctgctctcgcttgtgaact

SEQ ID NO: 175699 - DNA, 20 bp, human
gttaccacctgcaaacatag

SEQ ID NO: 175700 - DNA, 20 bp, human
gaagttagcaaagcttctag

SEQ ID NO: 175701 - DNA, 20 bp, human
gcatctgcttgagcatactt

SEQ ID NO: 175702 - DNA, 20 bp, human
gataccctcctaaccgcagg

SEQ ID NO: 175703 - DNA, 20 bp, human
ggattgcaagaggatttcaa

SEQ ID NO: 175704 - DNA, 20 bp, human
gaggtagaacgtggggcagc

SEQ ID NO: 175705 - DNA, 20 bp, human
ggcatgaatattattcaaca

SEQ ID NO: 175706 - DNA, 20 bp, human
ggttgccggtgcaaacaggg

SEQ ID NO: 175707 - DNA, 20 bp, human
gccggcaacgagcccgacga

SEQ ID NO: 175708 - DNA, 20 bp, human
ggattggccacccacaaggt

SEQ ID NO: 175709 - DNA, 20 bp, human
gctcgttgccggtgcaaaca

SEQ ID NO: 175710 - DNA, 20 bp, human
ggctcccgtaaagccgccag

SEQ ID NO: 175711 - DNA, 20 bp, human
gagacgcgctacagcaacgc

SEQ ID NO: 175712 - DNA, 20 bp, human
gtgggtggccaatccgggac

SEQ ID NO: 175713 - DNA, 20 bp, human
ggcgtctgggaattacaccg

SEQ ID NO: 175714 - DNA, 20 bp, human
ggaaccggggcggcagtcag

SEQ ID NO: 175715 - DNA, 20 bp, human
gggtgcaaagactgatccac

SEQ ID NO: 175716 - DNA, 20 bp, human
gctgcccggaaaggagtgag

SEQ ID NO: 175717 - DNA, 20 bp, human
ggtgagcggcgcctagtccc

SEQ ID NO: 175718 - DNA, 20 bp, human
gggccacggaggatccccaa

SEQ ID NO: 175719 - DNA, 20 bp, human
gcggcaggggcactcacccc

SEQ ID NO: 175720 - DNA, 20 bp, human
gcacggaggatccccaaggg

SEQ ID NO: 175721 - DNA, 20 bp, human
gtcccctccagatgatggga

SEQ ID NO: 175722 - DNA, 20 bp, human
gcgcggcgcgcagcacaccc

SEQ ID NO: 175723 - DNA, 20 bp, human
gctcccgccagcccgggact

SEQ ID NO: 175724 - DNA, 20 bp, human
ggaatgggtccctccctcca

SEQ ID NO: 175725 - DNA, 20 bp, human
gccgggcaggcgggacgacg

SEQ ID NO: 175726 - DNA, 20 bp, human
gaccagcgagcggccttgag

SEQ ID NO: 175727 - DNA, 20 bp, human
gactcggccatggcgtcctc

SEQ ID NO: 175728 - DNA, 20 bp, human
gcatcccagggaccagcgag

SEQ ID NO: 175729 - DNA, 20 bp, human
ggagtgcccgacactcgggg

SEQ ID NO: 175730 - DNA, 20 bp, human
ggggtcggccccacatccca

SEQ ID NO: 175731 - DNA, 20 bp, human
gctggctcttgcttcttagg

SEQ ID NO: 175732 - DNA, 20 bp, human
gtgagtcctcgcccttccta

SEQ ID NO: 175733 - DNA, 20 bp, human
ggactgcctccccgagtgtc

SEQ ID NO: 175734 - DNA, 20 bp, human
ggccgagtgcccgacactcg

SEQ ID NO: 175735 - DNA, 20 bp, human
ggcttgggatgccctaggaa

SEQ ID NO: 175736 - DNA, 20 bp, human
gccccccgtaaagggaccac

SEQ ID NO: 175737 - DNA, 20 bp, human
ggctacacgtgtgagcctag

SEQ ID NO: 175738 - DNA, 20 bp, human
gagacgcacagaagcttcgg

SEQ ID NO: 175739 - DNA, 20 bp, human
gggatccacagacggccagg

SEQ ID NO: 175740 - DNA, 20 bp, human
gccccaccgcggtcccacac

SEQ ID NO: 175741 - DNA, 20 bp, human
gccgaggttaaggtagctca

SEQ ID NO: 175742 - DNA, 20 bp, human
gtggccgtctgtggatccag

SEQ ID NO: 175743 - DNA, 20 bp, human
gcccggttgcagacttgcca

SEQ ID NO: 175744 - DNA, 20 bp, human
gagtgagtcctgggcacgag

SEQ ID NO: 175745 - DNA, 20 bp, human
gccaggaacaccccccgtaa

SEQ ID NO: 175746 - DNA, 20 bp, human
gacagtaagagccccactag

SEQ ID NO: 175747 - DNA, 20 bp, human
gcacaccagctgcccctagt

SEQ ID NO: 175748 - DNA, 20 bp, human
gcaacattctggtacactgt

SEQ ID NO: 175749 - DNA, 20 bp, human
gaatagggagttacttggta

SEQ ID NO: 175750 - DNA, 20 bp, human
ggccaactatgcgagatttg

SEQ ID NO: 175751 - DNA, 20 bp, human
gacatgaatagggagttact

SEQ ID NO: 175752 - DNA, 20 bp, human
ggagccccactaggggcagc

SEQ ID NO: 175753 - DNA, 20 bp, human
gaccacaaatctcgcatagt

SEQ ID NO: 175754 - DNA, 20 bp, human
gttgaaaagtcacatgaata

SEQ ID NO: 175755 - DNA, 20 bp, human
gccacatacgaaactggaat

SEQ ID NO: 175756 - DNA, 20 bp, human
ggaagctgcgtctctcggag

SEQ ID NO: 175757 - DNA, 20 bp, human
ggaatcgggaaagactcctg

SEQ ID NO: 175758 - DNA, 20 bp, human
gggaaagaggcacaggatag

SEQ ID NO: 175759 - DNA, 20 bp, human
ggggccctcactgagatgtg

SEQ ID NO: 175760 - DNA, 20 bp, human
gggtcaggagagcctcagca

SEQ ID NO: 175761 - DNA, 20 bp, human
gaccccactaaggacccagg

SEQ ID NO: 175762 - DNA, 20 bp, human
gactgggcctgacacagaaa

SEQ ID NO: 175763 - DNA, 20 bp, human
ggacaggaagctgcgtctct

SEQ ID NO: 175764 - DNA, 20 bp, human
gtgccctagccaccccacta

SEQ ID NO: 175765 - DNA, 20 bp, human
gaattaacggagatcttgtc

SEQ ID NO: 175766 - DNA, 20 bp, human
ggagggccgcgtgcaagatg

SEQ ID NO: 175767 - DNA, 20 bp, human
gcggccgggggtcgcgggta

SEQ ID NO: 175768 - DNA, 20 bp, human
gtatggccgaggccaggaag

SEQ ID NO: 175769 - DNA, 20 bp, human
ggcagatggtggtagatcag

SEQ ID NO: 175770 - DNA, 20 bp, human
gtgcaagatgtggagatcag

SEQ ID NO: 175771 - DNA, 20 bp, human
gaggaagggcgtggaggtaa

SEQ ID NO: 175772 - DNA, 20 bp, human
gccagaaagtgtgctcgcag

SEQ ID NO: 175773 - DNA, 20 bp, human
ggccacgtggcgggagactt

SEQ ID NO: 175774 - DNA, 20 bp, human
gtgtggcgcgcgaggtctaa

SEQ ID NO: 175775 - DNA, 20 bp, human
ggcagagcctagccacgtgg

SEQ ID NO: 175776 - DNA, 20 bp, human
gagctcctgggacatcgctc

SEQ ID NO: 175777 - DNA, 20 bp, human
gcgtacccgagcgatgtccc

SEQ ID NO: 175778 - DNA, 20 bp, human
gcgatgtcccaggagctact

SEQ ID NO: 175779 - DNA, 20 bp, human
ggtggatgtggtgtccgggg

SEQ ID NO: 175780 - DNA, 20 bp, human
gaggtaaaggagagaaacga

SEQ ID NO: 175781 - DNA, 20 bp, human
gcctcgctgtgggaaaagtg

SEQ ID NO: 175782 - DNA, 20 bp, human
gcgggaggcccgctttcccg

SEQ ID NO: 175783 - DNA, 20 bp, human
gcgcggcagggttttgagac

SEQ ID NO: 175784 - DNA, 20 bp, human
ggccccagagaacggcgggt

SEQ ID NO: 175785 - DNA, 20 bp, human
ggaccggcaacgcgtggatg

SEQ ID NO: 175786 - DNA, 20 bp, human
gcaggaatcagggtcccacc

SEQ ID NO: 175787 - DNA, 20 bp, human
ggaatcagggtcccacctgg

SEQ ID NO: 175788 - DNA, 20 bp, human
gagagttagtcccaccaggt

SEQ ID NO: 175789 - DNA, 20 bp, human
ggtggatgggagccaggatg

SEQ ID NO: 175790 - DNA, 20 bp, human
ggccggtgagctgacctctg

SEQ ID NO: 175791 - DNA, 20 bp, human
gaagtccaatgacagaccac

SEQ ID NO: 175792 - DNA, 20 bp, human
gataagtgggatcgtgatag

SEQ ID NO: 175793 - DNA, 20 bp, human
gggtacagcccttcactgca

SEQ ID NO: 175794 - DNA, 20 bp, human
gtgtccctgtggtctgtcat

SEQ ID NO: 175795 - DNA, 20 bp, human
gcttcctcaccagaccctgt

SEQ ID NO: 175796 - DNA, 20 bp, human
gagggcttggggacaactgt

SEQ ID NO: 175797 - DNA, 20 bp, human
gggcccagatgatctgatcc

SEQ ID NO: 175798 - DNA, 20 bp, human
gcactggggtgtcccctcag

SEQ ID NO: 175799 - DNA, 20 bp, human
gtggcttcctaaaacggaca

SEQ ID NO: 175800 - DNA, 20 bp, human
ggagcagcggacagttccaa

SEQ ID NO: 175801 - DNA, 20 bp, human
gtcctaaaacggacagggca

SEQ ID NO: 175802 - DNA, 20 bp, human
gctgccaggatcagatcatc

SEQ ID NO: 175803 - DNA, 20 bp, human
gagtctccgcggggaaggaa

SEQ ID NO: 175804 - DNA, 20 bp, human
gcccaacagtcactactgcc

SEQ ID NO: 175805 - DNA, 20 bp, human
gtctctggatatgaggcagg

SEQ ID NO: 175806 - DNA, 20 bp, human
gcagactccaccaagagctt

SEQ ID NO: 175807 - DNA, 20 bp, human
ggggcaagaatcgcacactc

SEQ ID NO: 175808 - DNA, 20 bp, human
gtgatgttcatggaaaactc

SEQ ID NO: 175809 - DNA, 20 bp, human
gatacatcaggcctctcacc

SEQ ID NO: 175810 - DNA, 20 bp, human
gattctggacttgagacaca

SEQ ID NO: 175811 - DNA, 20 bp, human
gcaaagcatctatatgactc

SEQ ID NO: 175812 - DNA, 20 bp, human
ggctttgagggagcagaaca

SEQ ID NO: 175813 - DNA, 20 bp, human
gctctgtgggctgatgttca

SEQ ID NO: 175814 - DNA, 20 bp, human
gggacttgagacacacggcc

SEQ ID NO: 175815 - DNA, 20 bp, human
ggtatcactcacgctccggg

SEQ ID NO: 175816 - DNA, 20 bp, human
gcacttgggccggaacacac

SEQ ID NO: 175817 - DNA, 20 bp, human
gtaaacctgagcaggcactt

SEQ ID NO: 175818 - DNA, 20 bp, human
gcagcacggcgacccccaga

SEQ ID NO: 175819 - DNA, 20 bp, human
ggcctgctcaggtttaaagg

SEQ ID NO: 175820 - DNA, 20 bp, human
gccgtgctgtgtaatgcggg

SEQ ID NO: 175821 - DNA, 20 bp, human
ggagcacagcaggatttagt

SEQ ID NO: 175822 - DNA, 20 bp, human
ggtgttgcgtgagaagtgtt

SEQ ID NO: 175823 - DNA, 20 bp, human
ggatttagtagggccgtctg

SEQ ID NO: 175824 - DNA, 20 bp, human
gagagcaggaaacgtgttcc

SEQ ID NO: 175825 - DNA, 20 bp, human
ggcgtgagaagtgtttggtt

SEQ ID NO: 175826 - DNA, 20 bp, human
gggcctggagcgtaccaccg

SEQ ID NO: 175827 - DNA, 20 bp, human
gctggagcgtaccaccgcgg

SEQ ID NO: 175828 - DNA, 20 bp, human
gcccgccgcgggtcatccac

SEQ ID NO: 175829 - DNA, 20 bp, human
ggcgtaccaccgcggcggag

SEQ ID NO: 175830 - DNA, 20 bp, human
gcgcacggtgagaaaggccg

SEQ ID NO: 175831 - DNA, 20 bp, human
gagtcgccaggatatttcgg

SEQ ID NO: 175832 - DNA, 20 bp, human
ggacgccagtggatgacccg

SEQ ID NO: 175833 - DNA, 20 bp, human
gggcgcagggcgggaagcgt

SEQ ID NO: 175834 - DNA, 20 bp, human
ggaggagcggaagtcgagag

SEQ ID NO: 175835 - DNA, 20 bp, human
gacagaagtggagcgctggg

SEQ ID NO: 175836 - DNA, 20 bp, human
gctcccagcccgactcgggt

SEQ ID NO: 175837 - DNA, 20 bp, human
ggaggcgccagcccaatata

SEQ ID NO: 175838 - DNA, 20 bp, human
gagtggcagggccgggagta

SEQ ID NO: 175839 - DNA, 20 bp, human
gccgagaggacagcctcgag

SEQ ID NO: 175840 - DNA, 20 bp, human
gaccgctgcccacccgagtc

SEQ ID NO: 175841 - DNA, 20 bp, human
gcggtcctcccagcccgact

SEQ ID NO: 175842 - DNA, 20 bp, human
gcgcatccctcgccacgcgg

SEQ ID NO: 175843 - DNA, 20 bp, human
gagggagaacgccgactccg

SEQ ID NO: 175844 - DNA, 20 bp, human
gggcctaggctggacacaag

SEQ ID NO: 175845 - DNA, 20 bp, human
gccgggagtaggggaggacg

SEQ ID NO: 175846 - DNA, 20 bp, human
gcctgctggacaggtaccag

SEQ ID NO: 175847 - DNA, 20 bp, human
gacggcgacggagtgacccc

SEQ ID NO: 175848 - DNA, 20 bp, human
gagcggcatcccgccatcag

SEQ ID NO: 175849 - DNA, 20 bp, human
gaggatggagttccgagata

SEQ ID NO: 175850 - DNA, 20 bp, human
gacggagtgaccccgggtca

SEQ ID NO: 175851 - DNA, 20 bp, human
gtccagcaggatttaaacag

SEQ ID NO: 175852 - DNA, 20 bp, human
gcccagagagccctgacccg

SEQ ID NO: 175853 - DNA, 20 bp, human
gcacgtagacaagaggagaa

SEQ ID NO: 175854 - DNA, 20 bp, human
ggacaagaggagaacggcga

SEQ ID NO: 175855 - DNA, 20 bp, human
gggtgaccggccaggtccaa

SEQ ID NO: 175856 - DNA, 20 bp, human
ggcttcgctagcagacgcag

SEQ ID NO: 175857 - DNA, 20 bp, human
gaggccgccagtcgaggacg

SEQ ID NO: 175858 - DNA, 20 bp, human
gccgccagtcgaggacgagg

SEQ ID NO: 175859 - DNA, 20 bp, human
gtgagggaccagggtcgcga

SEQ ID NO: 175860 - DNA, 20 bp, human
gagggtcgcgagggctgtgg

SEQ ID NO: 175861 - DNA, 20 bp, human
ggaggcgaggccgccagtcg

SEQ ID NO: 175862 - DNA, 20 bp, human
ggttctcaaaggaacaacta

SEQ ID NO: 175863 - DNA, 20 bp, human
gctgctgcctgagtccaggc

SEQ ID NO: 175864 - DNA, 20 bp, human
gagggctcaaaggttctcaa

SEQ ID NO: 175865 - DNA, 20 bp, human
ggctagcagacgcagaggcg

SEQ ID NO: 175866 - DNA, 20 bp, human
gccgccagtcgaggacgagg

SEQ ID NO: 175867 - DNA, 20 bp, human
ggcttcgctagcagacgcag

SEQ ID NO: 175868 - DNA, 20 bp, human
gaggccgccagtcgaggacg

SEQ ID NO: 175869 - DNA, 20 bp, human
gtgagggaccagggtcgcga

SEQ ID NO: 175870 - DNA, 20 bp, human
gagggtcgcgagggctgtgg

SEQ ID NO: 175871 - DNA, 20 bp, human
ggaggcgaggccgccagtcg

SEQ ID NO: 175872 - DNA, 20 bp, human
gagggctcaaaggttctcaa

SEQ ID NO: 175873 - DNA, 20 bp, human
ggttctcaaaggaacaacta

SEQ ID NO: 175874 - DNA, 20 bp, human
gctgctgcctgagtccaggc

SEQ ID NO: 175875 - DNA, 20 bp, human
gattaagtaccagggctcaa

SEQ ID NO: 175876 - DNA, 20 bp, human
ggtggggcgagggccagtca

SEQ ID NO: 175877 - DNA, 20 bp, human
gcatggcggagtcctggtct

SEQ ID NO: 175878 - DNA, 20 bp, human
gggtgacagtaccccgggtg

SEQ ID NO: 175879 - DNA, 20 bp, human
ggccagtcatggcggagtcc

SEQ ID NO: 175880 - DNA, 20 bp, human
gactacggtgacagtacccc

SEQ ID NO: 175881 - DNA, 20 bp, human
gctggccctcgccccacccg

SEQ ID NO: 175882 - DNA, 20 bp, human
gaccaggactccgccatgac

SEQ ID NO: 175883 - DNA, 20 bp, human
gctggcgtaaaatggtatgg

SEQ ID NO: 175884 - DNA, 20 bp, human
ggcgtgcgtggtggggacta

SEQ ID NO: 175885 - DNA, 20 bp, human
gttgcaggctctgccggcca

SEQ ID NO: 175886 - DNA, 20 bp, human
gtgggtgtccccactcccgg

SEQ ID NO: 175887 - DNA, 20 bp, human
gggagaagcctagggcccca

SEQ ID NO: 175888 - DNA, 20 bp, human
ggagcgggtgaggcgacctc

SEQ ID NO: 175889 - DNA, 20 bp, human
ggccccgataagggagaccg

SEQ ID NO: 175890 - DNA, 20 bp, human
gccagagggggccccgataa

SEQ ID NO: 175891 - DNA, 20 bp, human
gctgcgtgaggcgagcgccg

SEQ ID NO: 175892 - DNA, 20 bp, human
gggctgggtgtccccactcc

SEQ ID NO: 175893 - DNA, 20 bp, human
ggtgaggcgacctccgggag

SEQ ID NO: 175894 - DNA, 20 bp, human
gcgtagggcgtggaggagag

SEQ ID NO: 175895 - DNA, 20 bp, human
gagggcgtggggtctcccgt

SEQ ID NO: 175896 - DNA, 20 bp, human
gttgaccgccggcggtgaag

SEQ ID NO: 175897 - DNA, 20 bp, human
gctcccacctgcgcctcgta

SEQ ID NO: 175898 - DNA, 20 bp, human
ggccctagccagtcccgcga

SEQ ID NO: 175899 - DNA, 20 bp, human
gtaccgtacgaggcgcaggt

SEQ ID NO: 175900 - DNA, 20 bp, human
gggtgacgcctaggaaagaa

SEQ ID NO: 175901 - DNA, 20 bp, human
ggccctcgcgggactggcta

SEQ ID NO: 175902 - DNA, 20 bp, human
gtagggcgtttgaccgccgg

SEQ ID NO: 175903 - DNA, 20 bp, human
gcggtaggaagtgcccgcca

SEQ ID NO: 175904 - DNA, 20 bp, human
gaccgccggcggtgaagggg

SEQ ID NO: 175905 - DNA, 20 bp, human
gtgagtgcggagactgctag

SEQ ID NO: 175906 - DNA, 20 bp, human
gcgccggctgaatgaagcct

SEQ ID NO: 175907 - DNA, 20 bp, human
ggcactctccctggactctg

SEQ ID NO: 175908 - DNA, 20 bp, human
gactctgaggccggtctcca

SEQ ID NO: 175909 - DNA, 20 bp, human
ggaagaccgccccgggtcag

SEQ ID NO: 175910 - DNA, 20 bp, human
gtctgcagtgccggaggtct

SEQ ID NO: 175911 - DNA, 20 bp, human
ggacctccaggtcccaactc

SEQ ID NO: 175912 - DNA, 20 bp, human
gcatgggtgcggccagccac

SEQ ID NO: 175913 - DNA, 20 bp, human
ggagagatcggggccaagta

SEQ ID NO: 175914 - DNA, 20 bp, human
gagccacaggaagaccgccc

SEQ ID NO: 175915 - DNA, 20 bp, human
gacccggggcggtcttcctg

SEQ ID NO: 175916 - DNA, 20 bp, human
ggcccggcgcccaaacactg

SEQ ID NO: 175917 - DNA, 20 bp, human
ggctcgcgatgaaggcctag

SEQ ID NO: 175918 - DNA, 20 bp, human
gtcgagcgcgctggtctgag

SEQ ID NO: 175919 - DNA, 20 bp, human
gcgccgggcgcgtcttaggg

SEQ ID NO: 175920 - DNA, 20 bp, human
gcgcgatggcgtcctgagta

SEQ ID NO: 175921 - DNA, 20 bp, human
ggcagaggcgggtagaggac

SEQ ID NO: 175922 - DNA, 20 bp, human
gaagcgggtggggtcccctg

SEQ ID NO: 175923 - DNA, 20 bp, human
gaaacactgaggaagcgggt

SEQ ID NO: 175924 - DNA, 20 bp, human
gggcaggaagccactcgcgt

SEQ ID NO: 175925 - DNA, 20 bp, human
ggatggacgtggccatgccg

SEQ ID NO: 175926 - DNA, 20 bp, human
gcaaagcctgcgggtgactc

SEQ ID NO: 175927 - DNA, 20 bp, human
gagggagtttcgggagcaga

SEQ ID NO: 175928 - DNA, 20 bp, human
ggccaccctagagtagatct

SEQ ID NO: 175929 - DNA, 20 bp, human
gtccacccagatctactcta

SEQ ID NO: 175930 - DNA, 20 bp, human
gcagggctggaaggatctgt

SEQ ID NO: 175931 - DNA, 20 bp, human
gcaggtgcctgagggagttt

SEQ ID NO: 175932 - DNA, 20 bp, human
gtccttccagagaagtcggg

SEQ ID NO: 175933 - DNA, 20 bp, human
ggacaggaggctgctaggac

SEQ ID NO: 175934 - DNA, 20 bp, human
ggctccttctctgggcacta

SEQ ID NO: 175935 - DNA, 20 bp, human
gccgactgagctccttctct

SEQ ID NO: 175936 - DNA, 20 bp, human
gcccagcgaggcccgcgaca

SEQ ID NO: 175937 - DNA, 20 bp, human
gggcctcgctgggactccct

SEQ ID NO: 175938 - DNA, 20 bp, human
gcaacgcgctgtccatgtcg

SEQ ID NO: 175939 - DNA, 20 bp, human
ggcagcccaggagcaccacc

SEQ ID NO: 175940 - DNA, 20 bp, human
ggagggcctcaactccaccg

SEQ ID NO: 175941 - DNA, 20 bp, human
gggcctaccccagtcacgga

SEQ ID NO: 175942 - DNA, 20 bp, human
gggtctcccgccgctcctgg

SEQ ID NO: 175943 - DNA, 20 bp, human
gtaccccagtcacggacggt

SEQ ID NO: 175944 - DNA, 20 bp, human
gtccatgtcgcgggcctcgc

SEQ ID NO: 175945 - DNA, 20 bp, human
gaccccggcggtgacgacag

SEQ ID NO: 175946 - DNA, 20 bp, human
gccctggtcggagacaccga

SEQ ID NO: 175947 - DNA, 20 bp, human
ggcgttcgcttgcaagatgg

SEQ ID NO: 175948 - DNA, 20 bp, human
gcggtcagcgcgtccctggt

SEQ ID NO: 175949 - DNA, 20 bp, human
gccttcctgggttctaatga

SEQ ID NO: 175950 - DNA, 20 bp, human
gagggacacggtcacaccct

SEQ ID NO: 175951 - DNA, 20 bp, human
gttcgcttgcaagatggcgg

SEQ ID NO: 175952 - DNA, 20 bp, human
gcgactcccgaagctcccgg

SEQ ID NO: 175953 - DNA, 20 bp, human
gggacattcggataaaagga

SEQ ID NO: 175954 - DNA, 20 bp, human
gctggcagtgctgcaggacg

SEQ ID NO: 175955 - DNA, 20 bp, human
gtcgtgtctgagtccttcct

SEQ ID NO: 175956 - DNA, 20 bp, human
gtgcaggagcgcgagctgtg

SEQ ID NO: 175957 - DNA, 20 bp, human
ggagagtagggaccactgta

SEQ ID NO: 175958 - DNA, 20 bp, human
gggaccactgtagggagtcc

SEQ ID NO: 175959 - DNA, 20 bp, human
gcgagggagtcacgagagta

SEQ ID NO: 175960 - DNA, 20 bp, human
gagtacgacacagagtgagt

SEQ ID NO: 175961 - DNA, 20 bp, human
gcggaggcctacgtcggacc

SEQ ID NO: 175962 - DNA, 20 bp, human
ggtgcctggactccctacag

SEQ ID NO: 175963 - DNA, 20 bp, human
ggctgcagctccaaagacgt

SEQ ID NO: 175964 - DNA, 20 bp, human
ggcaatgcgattggagaccg

SEQ ID NO: 175965 - DNA, 20 bp, human
gggtgcgcatggggcattca

SEQ ID NO: 175966 - DNA, 20 bp, human
ggctggcagtacccagacag

SEQ ID NO: 175967 - DNA, 20 bp, human
ggagacctgggcccgatggc

SEQ ID NO: 175968 - DNA, 20 bp, human
gggggacggtagaagcctgg

SEQ ID NO: 175969 - DNA, 20 bp, human
gtctgggtactgccagccat

SEQ ID NO: 175970 - DNA, 20 bp, human
gccagcagtgaggggcgcaa

SEQ ID NO: 175971 - DNA, 20 bp, human
ggcggtggtggtggaggtcg

SEQ ID NO: 175972 - DNA, 20 bp, human
gaagacaaccccagagacct

SEQ ID NO: 175973 - DNA, 20 bp, human
gacagaaagggggtccgtgg

SEQ ID NO: 175974 - DNA, 20 bp, human
gacgcgggcaggtaataccg

SEQ ID NO: 175975 - DNA, 20 bp, human
gggctgctctgagggttacc

SEQ ID NO: 175976 - DNA, 20 bp, human
gggaaaaacagcagtgcggt

SEQ ID NO: 175977 - DNA, 20 bp, human
ggatggcccgcttctcttac

SEQ ID NO: 175978 - DNA, 20 bp, human
gctcatacctgtaagagaag

SEQ ID NO: 175979 - DNA, 20 bp, human
ggaaattcgttttccccaga

SEQ ID NO: 175980 - DNA, 20 bp, human
gtgctagagattgccagctt

SEQ ID NO: 175981 - DNA, 20 bp, human
gaaagacctggaatttcaca

SEQ ID NO: 175982 - DNA, 20 bp, human
ggcggttggcagctctttta

SEQ ID NO: 175983 - DNA, 20 bp, human
gttacttctaactttgccat

SEQ ID NO: 175984 - DNA, 20 bp, human
gagtaaccatgtgaaattcc

SEQ ID NO: 175985 - DNA, 20 bp, human
gagaacattacttcctaagc

SEQ ID NO: 175986 - DNA, 20 bp, human
gcactgtctgagaagcacgg

SEQ ID NO: 175987 - DNA, 20 bp, human
gggaactacctgcatgtaag

SEQ ID NO: 175988 - DNA, 20 bp, human
gagcacggaggtttgactct

SEQ ID NO: 175989 - DNA, 20 bp, human
gtaagtggcagggtccttac

SEQ ID NO: 175990 - DNA, 20 bp, human
ggaccctgccacttacatgc

SEQ ID NO: 175991 - DNA, 20 bp, human
gaaaaatgggcacccactca

SEQ ID NO: 175992 - DNA, 20 bp, human
gagaattgagtgcctaacaa

SEQ ID NO: 175993 - DNA, 20 bp, human
ggggtttggtgtccattgtt

SEQ ID NO: 175994 - DNA, 20 bp, human
ggtgccttttcaccatgagt

SEQ ID NO: 175995 - DNA, 20 bp, human
ggcagggtccttacagggtt

SEQ ID NO: 175996 - DNA, 20 bp, human
ggccgaaggggcgggatccg

SEQ ID NO: 175997 - DNA, 20 bp, human
gcagtataggaggacggtca

SEQ ID NO: 175998 - DNA, 20 bp, human
ggccgcccaacacgtacctg

SEQ ID NO: 175999 - DNA, 20 bp, human
ggtgcgcctcaggtacgtgt

SEQ ID NO: 176000 - DNA, 20 bp, human
gagtgggcgcggactcggtg

SEQ ID NO: 176001 - DNA, 20 bp, human
gcgggatccgaggcaagcgt

SEQ ID NO: 176002 - DNA, 20 bp, human
gtcagaacgtgaggaagtga

SEQ ID NO: 176003 - DNA, 20 bp, human
gcctgaggcgctgtgatcgg

SEQ ID NO: 176004 - DNA, 20 bp, human
gggtacgtgttgggcggcag

SEQ ID NO: 176005 - DNA, 20 bp, human
gcgcgcagttcaaaccctgg

SEQ ID NO: 176006 - DNA, 20 bp, human
gtaaaggggcggtgcagagg

SEQ ID NO: 176007 - DNA, 20 bp, human
gcatcgtccgcccagctcca

SEQ ID NO: 176008 - DNA, 20 bp, human
gggcggcaggaagatggagt

SEQ ID NO: 176009 - DNA, 20 bp, human
gcgggagccagtccgcacgg

SEQ ID NO: 176010 - DNA, 20 bp, human
ggctccaccgacctaggtaa

SEQ ID NO: 176011 - DNA, 20 bp, human
gcaggacgcgcagggctacc

SEQ ID NO: 176012 - DNA, 20 bp, human
ggagcgggagccagtccgca

SEQ ID NO: 176013 - DNA, 20 bp, human
gctccaagctgcgtagccag

SEQ ID NO: 176014 - DNA, 20 bp, human
gtccaccggaggctcgaagt

SEQ ID NO: 176015 - DNA, 20 bp, human
gcctgttccgcttaaagggg

SEQ ID NO: 176016 - DNA, 20 bp, human
ggcggcagggctcccagcat

SEQ ID NO: 176017 - DNA, 20 bp, human
ggtgcagggcgcatcccagg

SEQ ID NO: 176018 - DNA, 20 bp, human
gtggaggcgagggaagtgca

SEQ ID NO: 176019 - DNA, 20 bp, human
gaggccaggagggcgcactg

SEQ ID NO: 176020 - DNA, 20 bp, human
ggaagtgcagggcgcatccc

SEQ ID NO: 176021 - DNA, 20 bp, human
gggatccgaacctgtctctg

SEQ ID NO: 176022 - DNA, 20 bp, human
ggggcgcatcccaggcggca

SEQ ID NO: 176023 - DNA, 20 bp, human
gacgcctgggaaccctgacc

SEQ ID NO: 176024 - DNA, 20 bp, human
gttcctataggaggaaagta

SEQ ID NO: 176025 - DNA, 20 bp, human
gggagagggcctgcatgaag

SEQ ID NO: 176026 - DNA, 20 bp, human
gtggcccgcgagacgaggta

SEQ ID NO: 176027 - DNA, 20 bp, human
gcgagagccacggtgtcctc

SEQ ID NO: 176028 - DNA, 20 bp, human
gggaggcgccagccgcggag

SEQ ID NO: 176029 - DNA, 20 bp, human
ggcgcgtggcccgcgagacg

SEQ ID NO: 176030 - DNA, 20 bp, human
gaccagagaggaccgagcgg

SEQ ID NO: 176031 - DNA, 20 bp, human
gcggcgcacgtgacactcct

SEQ ID NO: 176032 - DNA, 20 bp, human
ggaggcggcgggagtatccc

SEQ ID NO: 176033 - DNA, 20 bp, human
ggggaccagagaggaccgag

SEQ ID NO: 176034 - DNA, 20 bp, human
gtgcagacgcgggctgtcgg

SEQ ID NO: 176035 - DNA, 20 bp, human
gccgccgcctccgagagcca

SEQ ID NO: 176036 - DNA, 20 bp, human
ggcgtgcgcgggcatccggt

SEQ ID NO: 176037 - DNA, 20 bp, human
ggcagggatcccgcagcgag

SEQ ID NO: 176038 - DNA, 20 bp, human
gtcgggcctcccgcacccac

SEQ ID NO: 176039 - DNA, 20 bp, human
ggaggcaatgcgctccgtcc

SEQ ID NO: 176040 - DNA, 20 bp, human
ggcccaggcgctaaaggtgg

SEQ ID NO: 176041 - DNA, 20 bp, human
ggagggaaggaacgcactcg

SEQ ID NO: 176042 - DNA, 20 bp, human
gcgacggtaggggacttcca

SEQ ID NO: 176043 - DNA, 20 bp, human
gccctcgcggaccccggggt

SEQ ID NO: 176044 - DNA, 20 bp, human
ggaccacgtggtccacccaa

SEQ ID NO: 176045 - DNA, 20 bp, human
ggcctcacccgcgacggtag

SEQ ID NO: 176046 - DNA, 20 bp, human
gccgccatcttgggccctag

SEQ ID NO: 176047 - DNA, 20 bp, human
ggccgccgccattagaggta

SEQ ID NO: 176048 - DNA, 20 bp, human
gccatacataaacggagctg

SEQ ID NO: 176049 - DNA, 20 bp, human
gagaatctctgctgcgggtc

SEQ ID NO: 176050 - DNA, 20 bp, human
ggagccgccgccgccattag

SEQ ID NO: 176051 - DNA, 20 bp, human
gccgagtctcccgccatctt

SEQ ID NO: 176052 - DNA, 20 bp, human
gcaggctaaccatacataaa

SEQ ID NO: 176053 - DNA, 20 bp, human
gggccaaagcccctgtaggt

SEQ ID NO: 176054 - DNA, 20 bp, human
gttaccaagaatctctgctg

SEQ ID NO: 176055 - DNA, 20 bp, human
gcactgtgtcatacacaccc

SEQ ID NO: 176056 - DNA, 20 bp, human
gtctggtcggctctgcaact

SEQ ID NO: 176057 - DNA, 20 bp, human
ggccgcctccaggggaccta

SEQ ID NO: 176058 - DNA, 20 bp, human
gtacggccgctcagaaaacg

SEQ ID NO: 176059 - DNA, 20 bp, human
gtcccaggcgggttggtaag

SEQ ID NO: 176060 - DNA, 20 bp, human
gggcgttgtcccaggcgggt

SEQ ID NO: 176061 - DNA, 20 bp, human
gacctcctcgcgactttcca

SEQ ID NO: 176062 - DNA, 20 bp, human
gcacaccaggccggccccta

SEQ ID NO: 176063 - DNA, 20 bp, human
gaccttggaaagtcgcgagg

SEQ ID NO: 176064 - DNA, 20 bp, human
gtagctgcttaggccggggg

SEQ ID NO: 176065 - DNA, 20 bp, human
ggccggcgcggcgttgtccc

SEQ ID NO: 176066 - DNA, 20 bp, human
gcgggccgagtagagattag

SEQ ID NO: 176067 - DNA, 20 bp, human
gtcccatccgaagccttcag

SEQ ID NO: 176068 - DNA, 20 bp, human
gtagggggccctctccgaat

SEQ ID NO: 176069 - DNA, 20 bp, human
ggcccctgaaggcttcggat

SEQ ID NO: 176070 - DNA, 20 bp, human
ggaaccaggactaggaacta

SEQ ID NO: 176071 - DNA, 20 bp, human
gttcctgcgccgattcggag

SEQ ID NO: 176072 - DNA, 20 bp, human
gaggttgcagagagccgcca

SEQ ID NO: 176073 - DNA, 20 bp, human
ggggccccctaatctctact

SEQ ID NO: 176074 - DNA, 20 bp, human
ggttcccgaggagcccctga

SEQ ID NO: 176075 - DNA, 20 bp, human
gccgccccctacctggtcta

SEQ ID NO: 176076 - DNA, 20 bp, human
gaccgggtcttaccagtccg

SEQ ID NO: 176077 - DNA, 20 bp, human
gcgacctcgggcggttggag

SEQ ID NO: 176078 - DNA, 20 bp, human
gtccgtggcgggagtcccgg

SEQ ID NO: 176079 - DNA, 20 bp, human
ggccacggactggtaagacc

SEQ ID NO: 176080 - DNA, 20 bp, human
gccggaagcgcgacctcggg

SEQ ID NO: 176081 - DNA, 20 bp, human
gtgcccggaagcgcgacctc

SEQ ID NO: 176082 - DNA, 20 bp, human
gtcctccgggactcccgcca

SEQ ID NO: 176083 - DNA, 20 bp, human
gcccccgtcgagggtcctcc

SEQ ID NO: 176084 - DNA, 20 bp, human
gggcggttggaggggctacc

SEQ ID NO: 176085 - DNA, 20 bp, human
ggtcccggaggaccctcgac

SEQ ID NO: 176086 - DNA, 20 bp, human
ggccgtgggcccccggaacg

SEQ ID NO: 176087 - DNA, 20 bp, human
gccacggcgcagagcttccg

SEQ ID NO: 176088 - DNA, 20 bp, human
ggggcccctggcggagacgg

SEQ ID NO: 176089 - DNA, 20 bp, human
ggtgcggggaaaccgaaagt

SEQ ID NO: 176090 - DNA, 20 bp, human
gcgttcacgcgggagtcgga

SEQ ID NO: 176091 - DNA, 20 bp, human
gggagatgcggaccaggaag

SEQ ID NO: 176092 - DNA, 20 bp, human
ggcgcacctgggtcaccggt

SEQ ID NO: 176093 - DNA, 20 bp, human
gcggggaaaccgaaagtggg

SEQ ID NO: 176094 - DNA, 20 bp, human
ggacaggtgccgggcgacgt

SEQ ID NO: 176095 - DNA, 20 bp, human
gtgattcccaagccgcgggg

SEQ ID NO: 176096 - DNA, 20 bp, human
gcccaactgccgggtctccg

SEQ ID NO: 176097 - DNA, 20 bp, human
gcccgacgcgcggcccagag

SEQ ID NO: 176098 - DNA, 20 bp, human
gagggacccctgaccgtcca

SEQ ID NO: 176099 - DNA, 20 bp, human
gccgcggcgggaacaggcga

SEQ ID NO: 176100 - DNA, 20 bp, human
gcggcgggaacaggcgacgg

SEQ ID NO: 176101 - DNA, 20 bp, human
gagcttccgcagcatcctca

SEQ ID NO: 176102 - DNA, 20 bp, human
ggcccagagcggtgcctgta

SEQ ID NO: 176103 - DNA, 20 bp, human
gagtgaccactcgccctgga

SEQ ID NO: 176104 - DNA, 20 bp, human
gcactcgccctggacggtca

SEQ ID NO: 176105 - DNA, 20 bp, human
ggagccccgcgagagggcac

SEQ ID NO: 176106 - DNA, 20 bp, human
gctgtggtggtgtgagtggg

SEQ ID NO: 176107 - DNA, 20 bp, human
gaggcaaagtgatatacgga

SEQ ID NO: 176108 - DNA, 20 bp, human
ggctggggtgaggcgcgagg

SEQ ID NO: 176109 - DNA, 20 bp, human
gccggcggggctcactgtgg

SEQ ID NO: 176110 - DNA, 20 bp, human
gcgcgaggcggcgcactcga

SEQ ID NO: 176111 - DNA, 20 bp, human
ggctgtgagacgccgctcgg

SEQ ID NO: 176112 - DNA, 20 bp, human
ggtgggaaagacagggtcat

SEQ ID NO: 176113 - DNA, 20 bp, human
gaagagtctgaactgactca

SEQ ID NO: 176114 - DNA, 20 bp, human
gaggcgaggatggagaccga

SEQ ID NO: 176115 - DNA, 20 bp, human
ggcagctctcagtctcaaaa

SEQ ID NO: 176116 - DNA, 20 bp, human
ggagccgcaggcagagcgtc

SEQ ID NO: 176117 - DNA, 20 bp, human
ggggtccacgcggaccacag

SEQ ID NO: 176118 - DNA, 20 bp, human
gcgggtgaggaagcagctag

SEQ ID NO: 176119 - DNA, 20 bp, human
gccgcaggcagagcgtccgg

SEQ ID NO: 176120 - DNA, 20 bp, human
gctgcaagcggcgagaacgc

SEQ ID NO: 176121 - DNA, 20 bp, human
gacgtccgctcgggtcacca

SEQ ID NO: 176122 - DNA, 20 bp, human
ggaagcagctaggggcgggt

SEQ ID NO: 176123 - DNA, 20 bp, human
gcccgctaggtgcccgagtg

SEQ ID NO: 176124 - DNA, 20 bp, human
gagtcggagaacttgacccg

SEQ ID NO: 176125 - DNA, 20 bp, human
gggcagtccgggagtaagtg

SEQ ID NO: 176126 - DNA, 20 bp, human
gaggctcggctcggctcagg

SEQ ID NO: 176127 - DNA, 20 bp, human
ggcgagtccgaggcaaactt

SEQ ID NO: 176128 - DNA, 20 bp, human
gtccctgggccgaggtaagt

SEQ ID NO: 176129 - DNA, 20 bp, human
gggcgctgcggtggctccct

SEQ ID NO: 176130 - DNA, 20 bp, human
ggaatgttcggaatgaggac

SEQ ID NO: 176131 - DNA, 20 bp, human
ggagcgatgctaagaatgtt

SEQ ID NO: 176132 - DNA, 20 bp, human
gccgggcaccgagcagaggg

SEQ ID NO: 176133 - DNA, 20 bp, human
ggcgctccgggcaaaggtgg

SEQ ID NO: 176134 - DNA, 20 bp, human
gcaggagcggtgctaggcag

SEQ ID NO: 176135 - DNA, 20 bp, human
gtcggactcgccgggcgctg

SEQ ID NO: 176136 - DNA, 20 bp, human
gcccaggccgggaggtagga

SEQ ID NO: 176137 - DNA, 20 bp, human
gctcccctcggccaccccag

SEQ ID NO: 176138 - DNA, 20 bp, human
gaccagagagaggggtccag

SEQ ID NO: 176139 - DNA, 20 bp, human
ggccgcaggcaccctaactc

SEQ ID NO: 176140 - DNA, 20 bp, human
gcagtgaggagtgggaactc

SEQ ID NO: 176141 - DNA, 20 bp, human
gcggagaagggagggcctct

SEQ ID NO: 176142 - DNA, 20 bp, human
gccgggaggtaggaaggcgc

SEQ ID NO: 176143 - DNA, 20 bp, human
gaagccccgtaacctcccct

SEQ ID NO: 176144 - DNA, 20 bp, human
gtggccgaggggaggttacg

SEQ ID NO: 176145 - DNA, 20 bp, human
gccttcttacggagaaggga

SEQ ID NO: 176146 - DNA, 20 bp, human
ggagttggtccgggaaggtg

SEQ ID NO: 176147 - DNA, 20 bp, human
gggaatgtgcggaatgagcc

SEQ ID NO: 176148 - DNA, 20 bp, human
gccccgcgacggggacgagt

SEQ ID NO: 176149 - DNA, 20 bp, human
gcccgagcggggcctcctcc

SEQ ID NO: 176150 - DNA, 20 bp, human
gcccgagggagccgcaaggg

SEQ ID NO: 176151 - DNA, 20 bp, human
ggggacgagttggtccggga

SEQ ID NO: 176152 - DNA, 20 bp, human
ggaccaactcgtccccgtcg

SEQ ID NO: 176153 - DNA, 20 bp, human
gtgtgcggaatgagccgggc

SEQ ID NO: 176154 - DNA, 20 bp, human
gacctggtccgagctcgcgg

SEQ ID NO: 176155 - DNA, 20 bp, human
gtcggaccaggtaagccggg

SEQ ID NO: 176156 - DNA, 20 bp, human
gctccctcccgggacgagac

SEQ ID NO: 176157 - DNA, 20 bp, human
gcttaccggtcccagggtgc

SEQ ID NO: 176158 - DNA, 20 bp, human
gtcgcacactcgaggccagg

SEQ ID NO: 176159 - DNA, 20 bp, human
gtggcctcgagtgtgcgagg

SEQ ID NO: 176160 - DNA, 20 bp, human
gctcacctggcgggacgcgg

SEQ ID NO: 176161 - DNA, 20 bp, human
gcacactcgaggccaggggg

SEQ ID NO: 176162 - DNA, 20 bp, human
gggaagagcgaggcacgtgg

SEQ ID NO: 176163 - DNA, 20 bp, human
ggcgggcgcctctcacctgg

SEQ ID NO: 176164 - DNA, 20 bp, human
gcgtcctcctcgcacactcg

SEQ ID NO: 176165 - DNA, 20 bp, human
ggtcggagcgcagaggtcca

SEQ ID NO: 176166 - DNA, 20 bp, human
gcgccgcccaacccgaaagg

SEQ ID NO: 176167 - DNA, 20 bp, human
gcgctcactgcggcacggag

SEQ ID NO: 176168 - DNA, 20 bp, human
gcagtctgcgccgcggagtc

SEQ ID NO: 176169 - DNA, 20 bp, human
gggcgggtgttccttaggag

SEQ ID NO: 176170 - DNA, 20 bp, human
gactctggggcgctaggctc

SEQ ID NO: 176171 - DNA, 20 bp, human
gggcgggacggggagatcag

SEQ ID NO: 176172 - DNA, 20 bp, human
gcccgcactgacctctccta

SEQ ID NO: 176173 - DNA, 20 bp, human
gggatgagcgcggcaagagg

SEQ ID NO: 176174 - DNA, 20 bp, human
ggccgcgcttcagccaggta

SEQ ID NO: 176175 - DNA, 20 bp, human
gtccttcccggaccgaagag

SEQ ID NO: 176176 - DNA, 20 bp, human
gaatacccagggagagggat

SEQ ID NO: 176177 - DNA, 20 bp, human
ggggcggggcgaagtcgcgg

SEQ ID NO: 176178 - DNA, 20 bp, human
ggccgggcggggcgaagtcg

SEQ ID NO: 176179 - DNA, 20 bp, human
gagtcgcggtggtaggtcct

SEQ ID NO: 176180 - DNA, 20 bp, human
gcccagggagagggataggc

SEQ ID NO: 176181 - DNA, 20 bp, human
gtggtaggtcctcggcgtcc

SEQ ID NO: 176182 - DNA, 20 bp, human
ggccagcgagctactgtagt

SEQ ID NO: 176183 - DNA, 20 bp, human
gtcttgcccggtccccggga

SEQ ID NO: 176184 - DNA, 20 bp, human
gggggaccgggcaagagggt

SEQ ID NO: 176185 - DNA, 20 bp, human
gcctctccctgggtattgat

SEQ ID NO: 176186 - DNA, 20 bp, human
gggggccgacgagtccggag

SEQ ID NO: 176187 - DNA, 20 bp, human
gagggacgcgggctgcgagt

SEQ ID NO: 176188 - DNA, 20 bp, human
gcgccggtgggcggatgtaa

SEQ ID NO: 176189 - DNA, 20 bp, human
gccggcggggccgacgagtc

SEQ ID NO: 176190 - DNA, 20 bp, human
ggcagcccctccggactcgt

SEQ ID NO: 176191 - DNA, 20 bp, human
gggtccgcagcggggaacag

SEQ ID NO: 176192 - DNA, 20 bp, human
gaccgcgggcgagggagacg

SEQ ID NO: 176193 - DNA, 20 bp, human
gtgggcggatgtaagggacg

SEQ ID NO: 176194 - DNA, 20 bp, human
gtgcccagggaacaggctcc

SEQ ID NO: 176195 - DNA, 20 bp, human
gggcagccgggatgcagggt

SEQ ID NO: 176196 - DNA, 20 bp, human
gaccagaaagtggggtcccg

SEQ ID NO: 176197 - DNA, 20 bp, human
gggagccatgaagcattacg

SEQ ID NO: 176198 - DNA, 20 bp, human
gtgcggttgcgagcgctgta

SEQ ID NO: 176199 - DNA, 20 bp, human
gtcatggctccctcccacgg

SEQ ID NO: 176200 - DNA, 20 bp, human
gccgtcaccagcgtaggaag

SEQ ID NO: 176201 - DNA, 20 bp, human
gagcagtagccgccgtggga

SEQ ID NO: 176202 - DNA, 20 bp, human
gtccctcggattgggagcaa

SEQ ID NO: 176203 - DNA, 20 bp, human
gctgcaactcagcccgctgg

SEQ ID NO: 176204 - DNA, 20 bp, human
gcgcagcgatagactaaacg

SEQ ID NO: 176205 - DNA, 20 bp, human
gacccttgctcccaatccga

SEQ ID NO: 176206 - DNA, 20 bp, human
gcattgtgtgaactaagagg

SEQ ID NO: 176207 - DNA, 20 bp, human
gaggcacaagtccctcgctt

SEQ ID NO: 176208 - DNA, 20 bp, human
gctcttgcgttccgaagcga

SEQ ID NO: 176209 - DNA, 20 bp, human
gcctgttcaccacaaaatta

SEQ ID NO: 176210 - DNA, 20 bp, human
gctgctggagttggtcttag

SEQ ID NO: 176211 - DNA, 20 bp, human
gtaaaactgaactcttggaa

SEQ ID NO: 176212 - DNA, 20 bp, human
gactttcccaaagagctaca

SEQ ID NO: 176213 - DNA, 20 bp, human
ggctacacggttcatactga

SEQ ID NO: 176214 - DNA, 20 bp, human
gtatgaaccgtgtagctctt

SEQ ID NO: 176215 - DNA, 20 bp, human
gtgcatcagttaaatactgc

SEQ ID NO: 176216 - DNA, 20 bp, human
ggaaagagacccaaattcta

SEQ ID NO: 176217 - DNA, 20 bp, human
ggatctactccactagcaca

SEQ ID NO: 176218 - DNA, 20 bp, human
gattggaaccacaattgtaa

SEQ ID NO: 176219 - DNA, 20 bp, human
gtgatcactgatttccatta

SEQ ID NO: 176220 - DNA, 20 bp, human
ggcacctgcccttacaattg

SEQ ID NO: 176221 - DNA, 20 bp, human
gcttatttcggccaaaaact

SEQ ID NO: 176222 - DNA, 20 bp, human
gttcatcattccttagaatt

SEQ ID NO: 176223 - DNA, 20 bp, human
gccagcttgccctgtgctag

SEQ ID NO: 176224 - DNA, 20 bp, human
gaatgatgaataattcatcc

SEQ ID NO: 176225 - DNA, 20 bp, human
gatgctaactgagagcttta

SEQ ID NO: 176226 - DNA, 20 bp, human
gttagtcctgcactagagac

SEQ ID NO: 176227 - DNA, 20 bp, human
gaccggttcagagagaagta

SEQ ID NO: 176228 - DNA, 20 bp, human
gggttcagagagaagtaagg

SEQ ID NO: 176229 - DNA, 20 bp, human
gctctgaaccggttccctaa

SEQ ID NO: 176230 - DNA, 20 bp, human
gtcactaacctgttctgtag

SEQ ID NO: 176231 - DNA, 20 bp, human
ggtttcaggattgcgtagag

SEQ ID NO: 176232 - DNA, 20 bp, human
gtttctggcttaccaagatt

SEQ ID NO: 176233 - DNA, 20 bp, human
gcctccagcctctacagaac

SEQ ID NO: 176234 - DNA, 20 bp, human
gactagagcccttagggaac

SEQ ID NO: 176235 - DNA, 20 bp, human
gacttacctgtctctagtgc

SEQ ID NO: 176236 - DNA, 20 bp, human
gcagcctctacagtccggag

SEQ ID NO: 176237 - DNA, 20 bp, human
ggcagccagcctctacagtc

SEQ ID NO: 176238 - DNA, 20 bp, human
gcatcctctccggactgtag

SEQ ID NO: 176239 - DNA, 20 bp, human
gccggagaggatgaaacagt

SEQ ID NO: 176240 - DNA, 20 bp, human
gtggaagcgtcaatgacaca

SEQ ID NO: 176241 - DNA, 20 bp, human
ggcgctgagaggcaaaaagt

SEQ ID NO: 176242 - DNA, 20 bp, human
gaaagtggggctcataccgt

SEQ ID NO: 176243 - DNA, 20 bp, human
gggagcacacgattttgcag

SEQ ID NO: 176244 - DNA, 20 bp, human
gtgagaagcaatggtgacga

SEQ ID NO: 176245 - DNA, 20 bp, human
gaatgaaaagttaaaatcaa

SEQ ID NO: 176246 - DNA, 20 bp, human
gctaggcccacacacctctg

SEQ ID NO: 176247 - DNA, 20 bp, human
ggaactcgagaggcctgtga

SEQ ID NO: 176248 - DNA, 20 bp, human
gggtgtgtgggcctagaaaa

SEQ ID NO: 176249 - DNA, 20 bp, human
gtcgtagatgatcaggacca

SEQ ID NO: 176250 - DNA, 20 bp, human
gtgctgcctcagaggtgtgt

SEQ ID NO: 176251 - DNA, 20 bp, human
gggacaggcctgtattccat

SEQ ID NO: 176252 - DNA, 20 bp, human
gagagtgaggaggatgaaca

SEQ ID NO: 176253 - DNA, 20 bp, human
gagcgtgaagagcaatactc

SEQ ID NO: 176254 - DNA, 20 bp, human
gcttcacgcttcagtcggac

SEQ ID NO: 176255 - DNA, 20 bp, human
gccaagggcatgatactcaa

SEQ ID NO: 176256 - DNA, 20 bp, human
gccgctgcagctgccgacac

SEQ ID NO: 176257 - DNA, 20 bp, human
ggcgcagtagctgcccgtgt

SEQ ID NO: 176258 - DNA, 20 bp, human
gcacggctccggcccatctc

SEQ ID NO: 176259 - DNA, 20 bp, human
ggcagctgcagcgggtcgca

SEQ ID NO: 176260 - DNA, 20 bp, human
gcccgcccgccccccgagat

SEQ ID NO: 176261 - DNA, 20 bp, human
gggctccggcccatctcggg

SEQ ID NO: 176262 - DNA, 20 bp, human
gctactgcgcaggcgcccaa

SEQ ID NO: 176263 - DNA, 20 bp, human
gagcagtggtccagcggagg

SEQ ID NO: 176264 - DNA, 20 bp, human
ggcagcgggtcgcacggctc

SEQ ID NO: 176265 - DNA, 20 bp, human
gggacatcgtgccccggact

SEQ ID NO: 176266 - DNA, 20 bp, human
gcttgctccagggagttcag

SEQ ID NO: 176267 - DNA, 20 bp, human
ggcagggacttgaggacctc

SEQ ID NO: 176268 - DNA, 20 bp, human
gaggacctcaggcatgtcca

SEQ ID NO: 176269 - DNA, 20 bp, human
ggcaggaggtgcttgctcca

SEQ ID NO: 176270 - DNA, 20 bp, human
gctctgcaccctgagaccaa

SEQ ID NO: 176271 - DNA, 20 bp, human
gccagggagggtctcagcag

SEQ ID NO: 176272 - DNA, 20 bp, human
gacaggtgctgtgctcatgt

SEQ ID NO: 176273 - DNA, 20 bp, human
gccagtgtgtggccactgac

SEQ ID NO: 176274 - DNA, 20 bp, human
ggccacccccagcgtacagg

SEQ ID NO: 176275 - DNA, 20 bp, human
gttctcagtggcccctgcca

SEQ ID NO: 176276 - DNA, 20 bp, human
gctcttcacggcgggaggta

SEQ ID NO: 176277 - DNA, 20 bp, human
gcgcaggaaccggaagtcaa

SEQ ID NO: 176278 - DNA, 20 bp, human
gacgggtggctcctcagagt

SEQ ID NO: 176279 - DNA, 20 bp, human
gagcgggtctgtcctcttca

SEQ ID NO: 176280 - DNA, 20 bp, human
ggaaccatccgcccactctg

SEQ ID NO: 176281 - DNA, 20 bp, human
gggtggctcctcagagtggg

SEQ ID NO: 176282 - DNA, 20 bp, human
gctgtcctcttcacggcggg

SEQ ID NO: 176283 - DNA, 20 bp, human
gggtctgtcctcttcacggc

SEQ ID NO: 176284 - DNA, 20 bp, human
gattcaacttggagatgagc

SEQ ID NO: 176285 - DNA, 20 bp, human
gtggaatacggcgggaggta

SEQ ID NO: 176286 - DNA, 20 bp, human
ggaaggaacagcacagaagc

SEQ ID NO: 176287 - DNA, 20 bp, human
gcgtcttgtttacaagttag

SEQ ID NO: 176288 - DNA, 20 bp, human
ggatcctttcaaaaacccag

SEQ ID NO: 176289 - DNA, 20 bp, human
gtagccagcttagttctctg

SEQ ID NO: 176290 - DNA, 20 bp, human
gcgtagtaggacgatgctaa

SEQ ID NO: 176291 - DNA, 20 bp, human
gagtgctgatgaacaagggg

SEQ ID NO: 176292 - DNA, 20 bp, human
gtggaaggattgaaatgcaa

SEQ ID NO: 176293 - DNA, 20 bp, human
gcaaggggtggctgtagcaa

SEQ ID NO: 176294 - DNA, 20 bp, human
gagcttgctcctttctggta

SEQ ID NO: 176295 - DNA, 20 bp, human
gcatcagtgctgatgaacaa

SEQ ID NO: 176296 - DNA, 20 bp, human
gcactacgcaagctcgggat

SEQ ID NO: 176297 - DNA, 20 bp, human
ggaactgccttcctcagaca

SEQ ID NO: 176298 - DNA, 20 bp, human
ggagctggaagctccagttg

SEQ ID NO: 176299 - DNA, 20 bp, human
gcactcccatctctacccta

SEQ ID NO: 176300 - DNA, 20 bp, human
gcagaccttagggtagagat

SEQ ID NO: 176301 - DNA, 20 bp, human
gggagcctccttaccccaac

SEQ ID NO: 176302 - DNA, 20 bp, human
gccagaggcccctaagagca

SEQ ID NO: 176303 - DNA, 20 bp, human
gcttgcgtagtggttctgtg

SEQ ID NO: 176304 - DNA, 20 bp, human
ggaggtggggacctaaatta

SEQ ID NO: 176305 - DNA, 20 bp, human
gagaaccactacgcaagctc

SEQ ID NO: 176306 - DNA, 20 bp, human
ggagagcgaagcgggaaagg

SEQ ID NO: 176307 - DNA, 20 bp, human
gacactggagctcagagcgg

SEQ ID NO: 176308 - DNA, 20 bp, human
gaaccggtggtgccaaacac

SEQ ID NO: 176309 - DNA, 20 bp, human
gcgaagcgggaaaggaggta

SEQ ID NO: 176310 - DNA, 20 bp, human
ggcggagagcgaagcgggaa

SEQ ID NO: 176311 - DNA, 20 bp, human
gacagtaggcgagggcggag

SEQ ID NO: 176312 - DNA, 20 bp, human
ggtccccgtgggggatctaa

SEQ ID NO: 176313 - DNA, 20 bp, human
gcggtccagcgcggaggaag

SEQ ID NO: 176314 - DNA, 20 bp, human
gggccttcccctccaacagt

SEQ ID NO: 176315 - DNA, 20 bp, human
gaagatcaacaaggcatggt

SEQ ID NO: 176316 - DNA, 20 bp, human
gtggtctgggccccagtcga

SEQ ID NO: 176317 - DNA, 20 bp, human
gggccagcaccgcagtggaa

SEQ ID NO: 176318 - DNA, 20 bp, human
gcacctgcagccctcgactg

SEQ ID NO: 176319 - DNA, 20 bp, human
ggagaccactcacctgtcgg

SEQ ID NO: 176320 - DNA, 20 bp, human
gcagatctgcagccacgggg

SEQ ID NO: 176321 - DNA, 20 bp, human
gagcgagaccactcacctgt

SEQ ID NO: 176322 - DNA, 20 bp, human
gaggtgcctgtggatttgta

SEQ ID NO: 176323 - DNA, 20 bp, human
gaaggcacagcgctgctaac

SEQ ID NO: 176324 - DNA, 20 bp, human
gtacgaggaaaccaacgtct

SEQ ID NO: 176325 - DNA, 20 bp, human
ggcacctcccacccagacgt

SEQ ID NO: 176326 - DNA, 20 bp, human
ggtcagcggggcagctccaa

SEQ ID NO: 176327 - DNA, 20 bp, human
gcagcctagtgcggtcagcg

SEQ ID NO: 176328 - DNA, 20 bp, human
gcgaccgcgaccagtcggag

SEQ ID NO: 176329 - DNA, 20 bp, human
gggttgcggtcagcctagtg

SEQ ID NO: 176330 - DNA, 20 bp, human
gatggagaagggcacctctg

SEQ ID NO: 176331 - DNA, 20 bp, human
gcgcgccctggacgccacag

SEQ ID NO: 176332 - DNA, 20 bp, human
gcgaccagtcggagcggcag

SEQ ID NO: 176333 - DNA, 20 bp, human
gctgccccgctgaccgcact

SEQ ID NO: 176334 - DNA, 20 bp, human
gacgacgtggcccgtaacac

SEQ ID NO: 176335 - DNA, 20 bp, human
gtcctccagcaggtacttgg

SEQ ID NO: 176336 - DNA, 20 bp, human
gactcagctcaaggagccaa

SEQ ID NO: 176337 - DNA, 20 bp, human
gcgagtggggctcatgaggg

SEQ ID NO: 176338 - DNA, 20 bp, human
gagggcacctgccggaacct

SEQ ID NO: 176339 - DNA, 20 bp, human
ggctgacggatgactccatg

SEQ ID NO: 176340 - DNA, 20 bp, human
gtcgggcaaaactcagctca

SEQ ID NO: 176341 - DNA, 20 bp, human
gggtactggtgctctcgtcc

SEQ ID NO: 176342 - DNA, 20 bp, human
gagagtgcggagcgcagtgt

SEQ ID NO: 176343 - DNA, 20 bp, human
gttgggaccacagtaactgg

SEQ ID NO: 176344 - DNA, 20 bp, human
ggctgagttttgcccgagtg

SEQ ID NO: 176345 - DNA, 20 bp, human
gggtacccgggcaggtagta

SEQ ID NO: 176346 - DNA, 20 bp, human
ggccccgagcacgagttcct

SEQ ID NO: 176347 - DNA, 20 bp, human
ggtccgggcgaggctcccgc

SEQ ID NO: 176348 - DNA, 20 bp, human
ggcctctcagcgcgaatctg

SEQ ID NO: 176349 - DNA, 20 bp, human
gccgcggagacccgccccag

SEQ ID NO: 176350 - DNA, 20 bp, human
gcgggagccgggtccaggtc

SEQ ID NO: 176351 - DNA, 20 bp, human
gctccctgagcggtgagagg

SEQ ID NO: 176352 - DNA, 20 bp, human
gtctcagcgcgaatctgcgg

SEQ ID NO: 176353 - DNA, 20 bp, human
gcggctccctgagcggtgag

SEQ ID NO: 176354 - DNA, 20 bp, human
gattcgcgctgagaggcccg

SEQ ID NO: 176355 - DNA, 20 bp, human
gtaagctgttggtttctaag

SEQ ID NO: 176356 - DNA, 20 bp, human
gacagcggcccagacagagg

SEQ ID NO: 176357 - DNA, 20 bp, human
ggacatcgccccctctgtct

SEQ ID NO: 176358 - DNA, 20 bp, human
gaccggccccagccacgacg

SEQ ID NO: 176359 - DNA, 20 bp, human
gaggccgcggggtaagaggg

SEQ ID NO: 176360 - DNA, 20 bp, human
gggcgacgcctagaacaggt

SEQ ID NO: 176361 - DNA, 20 bp, human
gagggccacggagaaagaag

SEQ ID NO: 176362 - DNA, 20 bp, human
gctccgaaatgagagtggtc

SEQ ID NO: 176363 - DNA, 20 bp, human
gtcatttcggagaggcctag

SEQ ID NO: 176364 - DNA, 20 bp, human
gggcctctccgaaatgagag

SEQ ID NO: 176365 - DNA, 20 bp, human
gtttggcgcgtgagtgacag

SEQ ID NO: 176366 - DNA, 20 bp, human
gaggctgtctggctggtgtg

SEQ ID NO: 176367 - DNA, 20 bp, human
gggagggtaggctgtctggc

SEQ ID NO: 176368 - DNA, 20 bp, human
gcagggcctgaacaatgctg

SEQ ID NO: 176369 - DNA, 20 bp, human
gtcctgcagtgaggcacctg

SEQ ID NO: 176370 - DNA, 20 bp, human
gacagcctaccctccgccca

SEQ ID NO: 176371 - DNA, 20 bp, human
gagccgcttcccctgggcgg

SEQ ID NO: 176372 - DNA, 20 bp, human
ggggcttcctggaagcggcc

SEQ ID NO: 176373 - DNA, 20 bp, human
ggtaggagtgcccaccagct

SEQ ID NO: 176374 - DNA, 20 bp, human
gggaagcggctgcctccgcc

SEQ ID NO: 176375 - DNA, 20 bp, human
gagcagccgggccgcaagca

SEQ ID NO: 176376 - DNA, 20 bp, human
gtactcgtgcagggtctccc

SEQ ID NO: 176377 - DNA, 20 bp, human
gtcactctcatcagaagaac

SEQ ID NO: 176378 - DNA, 20 bp, human
gcaatagccagagtagaaag

SEQ ID NO: 176379 - DNA, 20 bp, human
gtctataaatggctatttgt

SEQ ID NO: 176380 - DNA, 20 bp, human
gagacagtcatacaactcca

SEQ ID NO: 176381 - DNA, 20 bp, human
ggagcttgcttaatcagaga

SEQ ID NO: 176382 - DNA, 20 bp, human
gccaaaagtcaagcatgaaa

SEQ ID NO: 176383 - DNA, 20 bp, human
gcttctgatgagagtgaaga

SEQ ID NO: 176384 - DNA, 20 bp, human
gtatggattatgcatgaatt

SEQ ID NO: 176385 - DNA, 20 bp, human
gatagccatttatagactga

SEQ ID NO: 176386 - DNA, 20 bp, human
gcagtcctcactgtccagag

SEQ ID NO: 176387 - DNA, 20 bp, human
ggaaccaagggtctgctgta

SEQ ID NO: 176388 - DNA, 20 bp, human
ggacaccgctctttgaccag

SEQ ID NO: 176389 - DNA, 20 bp, human
ggcgtcctctggtcaaagag

SEQ ID NO: 176390 - DNA, 20 bp, human
gggcttgtaagtggactatg

SEQ ID NO: 176391 - DNA, 20 bp, human
gcgctacacaagctcctctc

SEQ ID NO: 176392 - DNA, 20 bp, human
gtaggccttcagagtctcac

SEQ ID NO: 176393 - DNA, 20 bp, human
gatctaagtgagaaacccaa

SEQ ID NO: 176394 - DNA, 20 bp, human
gagagtctcactggagctgt

SEQ ID NO: 176395 - DNA, 20 bp, human
gggatttctgtgtgggcacg

SEQ ID NO: 176396 - DNA, 20 bp, human
gacctcacgtatagcaggtg

SEQ ID NO: 176397 - DNA, 20 bp, human
ggagatagaaagccaccggt

SEQ ID NO: 176398 - DNA, 20 bp, human
gaatgtctcgctggaactgt

SEQ ID NO: 176399 - DNA, 20 bp, human
ggcctcacctgctatacgtg

SEQ ID NO: 176400 - DNA, 20 bp, human
gcgcagacaatgaggagtgc

SEQ ID NO: 176401 - DNA, 20 bp, human
gggacttctgtgtgggtacc

SEQ ID NO: 176402 - DNA, 20 bp, human
ggcaccaatgtgcccaccgg

SEQ ID NO: 176403 - DNA, 20 bp, human
gacattggtgccccaggcac

SEQ ID NO: 176404 - DNA, 20 bp, human
gggcaacagagtgaaggatt

SEQ ID NO: 176405 - DNA, 20 bp, human
gaccaagagcagacgagaga

SEQ ID NO: 176406 - DNA, 20 bp, human
ggcagcctgcagccacggta

SEQ ID NO: 176407 - DNA, 20 bp, human
gcaatcccgaggcttctggg

SEQ ID NO: 176408 - DNA, 20 bp, human
gggatcacgccgccttaccg

SEQ ID NO: 176409 - DNA, 20 bp, human
gagggttcgggtagctcacg

SEQ ID NO: 176410 - DNA, 20 bp, human
ggcagtgctggcagggacgc

SEQ ID NO: 176411 - DNA, 20 bp, human
gtagctcacgcggctgccga

SEQ ID NO: 176412 - DNA, 20 bp, human
gagggcgcgggtggccgaag

SEQ ID NO: 176413 - DNA, 20 bp, human
gagctacccgaaccctgccc

SEQ ID NO: 176414 - DNA, 20 bp, human
gccgcgccgccgagagagag

SEQ ID NO: 176415 - DNA, 20 bp, human
gccaaccccccagaagcctc

SEQ ID NO: 176416 - DNA, 20 bp, human
gattctgccggtgggaaggg

SEQ ID NO: 176417 - DNA, 20 bp, human
ggaatcggacgccccaggtc

SEQ ID NO: 176418 - DNA, 20 bp, human
gcggaccctaccttagactg

SEQ ID NO: 176419 - DNA, 20 bp, human
ggcccatcgaaaggggacag

SEQ ID NO: 176420 - DNA, 20 bp, human
ggaaggagaggtgtacagct

SEQ ID NO: 176421 - DNA, 20 bp, human
gggaagcagaaacttcgctc

SEQ ID NO: 176422 - DNA, 20 bp, human
gcacagggcaaggaagtaag

SEQ ID NO: 176423 - DNA, 20 bp, human
gtggattctgccggtgggaa

SEQ ID NO: 176424 - DNA, 20 bp, human
gcctgtgtgcccatcgaaag

SEQ ID NO: 176425 - DNA, 20 bp, human
ggcccagcgccctagaccca

SEQ ID NO: 176426 - DNA, 20 bp, human
gtcgcagcggagggtctcag

SEQ ID NO: 176427 - DNA, 20 bp, human
ggcggatgagcgctcgagag

SEQ ID NO: 176428 - DNA, 20 bp, human
ggccaggtctgggtcacgtc

SEQ ID NO: 176429 - DNA, 20 bp, human
ggagggtctcagcggctacg

SEQ ID NO: 176430 - DNA, 20 bp, human
gtctcagcggctacgcggtg

SEQ ID NO: 176431 - DNA, 20 bp, human
gctccctacccgccaggtct

SEQ ID NO: 176432 - DNA, 20 bp, human
gccggggaccccatatctgg

SEQ ID NO: 176433 - DNA, 20 bp, human
gtcacttacagggagtcgaa

SEQ ID NO: 176434 - DNA, 20 bp, human
ggcccgacgtgacccagacc

SEQ ID NO: 176435 - DNA, 20 bp, human
gaggcgggcagcagggatag

SEQ ID NO: 176436 - DNA, 20 bp, human
gccgattagctgggagtccg

SEQ ID NO: 176437 - DNA, 20 bp, human
gagcgagccatttaacatgg

SEQ ID NO: 176438 - DNA, 20 bp, human
gcccctccctcggcgacgta

SEQ ID NO: 176439 - DNA, 20 bp, human
ggcggaggatgtttcctcag

SEQ ID NO: 176440 - DNA, 20 bp, human
gcgttgctcggcgcctgaag

SEQ ID NO: 176441 - DNA, 20 bp, human
gaccatccgcacagccccgc

SEQ ID NO: 176442 - DNA, 20 bp, human
ggctgggagtccgaggctcc

SEQ ID NO: 176443 - DNA, 20 bp, human
ggagccatttaacatggcgg

SEQ ID NO: 176444 - DNA, 20 bp, human
gtccctacgtcgccgaggga

SEQ ID NO: 176445 - DNA, 20 bp, human
gtgctgacaacgggcgaacc

SEQ ID NO: 176446 - DNA, 20 bp, human
gagtagcgacggcagcgggc

SEQ ID NO: 176447 - DNA, 20 bp, human
ggaggaggcgggagtagcga

SEQ ID NO: 176448 - DNA, 20 bp, human
gctgggagagaagacatcgt

SEQ ID NO: 176449 - DNA, 20 bp, human
gggcgtcgtgcgtgacccag

SEQ ID NO: 176450 - DNA, 20 bp, human
gatggccgcgggagccggga

SEQ ID NO: 176451 - DNA, 20 bp, human
gagatccgggacatcatgca

SEQ ID NO: 176452 - DNA, 20 bp, human
ggcgcggcgatcggacacga

SEQ ID NO: 176453 - DNA, 20 bp, human
gctgtctgaagtccccgtac

SEQ ID NO: 176454 - DNA, 20 bp, human
ggaccgggagtcgggactgg

SEQ ID NO: 176455 - DNA, 20 bp, human
gcggggacttcagacagatc

SEQ ID NO: 176456 - DNA, 20 bp, human
gttcgcggcagaggcgtctg

SEQ ID NO: 176457 - DNA, 20 bp, human
gtgtgccaggcgctcgcgag

SEQ ID NO: 176458 - DNA, 20 bp, human
gctgcgtggagcgcaacgag

SEQ ID NO: 176459 - DNA, 20 bp, human
gcgacgctcatcctgcacgg

SEQ ID NO: 176460 - DNA, 20 bp, human
ggccgcagcggcacgccggg

SEQ ID NO: 176461 - DNA, 20 bp, human
gggagccgcagcggcacgcc

SEQ ID NO: 176462 - DNA, 20 bp, human
gccgcctcggcggcggacac

SEQ ID NO: 176463 - DNA, 20 bp, human
gtccttcacgtaggtaagga

SEQ ID NO: 176464 - DNA, 20 bp, human
gtccgtgaaggcgatccgcc

SEQ ID NO: 176465 - DNA, 20 bp, human
gtccgcccggcgtgccgctg

SEQ ID NO: 176466 - DNA, 20 bp, human
gcggccccgccctctcctcg

SEQ ID NO: 176467 - DNA, 20 bp, human
ggagcagcgcaggcgactca

SEQ ID NO: 176468 - DNA, 20 bp, human
gggtggcccgagtgctgcag

SEQ ID NO: 176469 - DNA, 20 bp, human
gtcaggcaggacacctgcgg

SEQ ID NO: 176470 - DNA, 20 bp, human
gtcgcgccgcgaggagaggg

SEQ ID NO: 176471 - DNA, 20 bp, human
gtcgggccaccagctccttc

SEQ ID NO: 176472 - DNA, 20 bp, human
ggcggggccgcggaaaggaa

SEQ ID NO: 176473 - DNA, 20 bp, human
gcagcagggagcgcacggct

SEQ ID NO: 176474 - DNA, 20 bp, human
ggtgtcctgcctgaaggagc

SEQ ID NO: 176475 - DNA, 20 bp, human
gcgcggcgcgaagaacgtgc

SEQ ID NO: 176476 - DNA, 20 bp, human
gcccgctgcggcggactggg

SEQ ID NO: 176477 - DNA, 20 bp, human
gctgggcggcggaagttcga

SEQ ID NO: 176478 - DNA, 20 bp, human
gtgcgaacacgggaaacctg

SEQ ID NO: 176479 - DNA, 20 bp, human
ggaaacctgcggaactcccg

SEQ ID NO: 176480 - DNA, 20 bp, human
ggagcacctcctctacccag

SEQ ID NO: 176481 - DNA, 20 bp, human
gaggcccgctgcggcggact

SEQ ID NO: 176482 - DNA, 20 bp, human
gccgccagctccccacactc

SEQ ID NO: 176483 - DNA, 20 bp, human
gccggctccgctgcgaacac

SEQ ID NO: 176484 - DNA, 20 bp, human
gccggacccgggaacaaagg

SEQ ID NO: 176485 - DNA, 20 bp, human
gcagtctcacggaatcccag

SEQ ID NO: 176486 - DNA, 20 bp, human
gccccggccagggagttccc

SEQ ID NO: 176487 - DNA, 20 bp, human
ggggccagtccgaagctgag

SEQ ID NO: 176488 - DNA, 20 bp, human
ggctgcggcgaggagctccg

SEQ ID NO: 176489 - DNA, 20 bp, human
gcggccccacgcggaacccg

SEQ ID NO: 176490 - DNA, 20 bp, human
gactggcttcggctgcgcag

SEQ ID NO: 176491 - DNA, 20 bp, human
ggactggcccgggaactccc

SEQ ID NO: 176492 - DNA, 20 bp, human
gggagcggggcctcatataa

SEQ ID NO: 176493 - DNA, 20 bp, human
ggtccgcagtcccccggcca

SEQ ID NO: 176494 - DNA, 20 bp, human
ggggccggggtccccaacag

SEQ ID NO: 176495 - DNA, 20 bp, human
gtccccggtccgcagtcccc

SEQ ID NO: 176496 - DNA, 20 bp, human
gggccgcggagcctgatccc

SEQ ID NO: 176497 - DNA, 20 bp, human
gcactgcgcggagaagatcg

SEQ ID NO: 176498 - DNA, 20 bp, human
gctgatccccggcggctaag

SEQ ID NO: 176499 - DNA, 20 bp, human
ggcgctgcggagagcccggt

SEQ ID NO: 176500 - DNA, 20 bp, human
ggcgggtccaggatcttcgg

SEQ ID NO: 176501 - DNA, 20 bp, human
gggagagcccggtaggagga

SEQ ID NO: 176502 - DNA, 20 bp, human
gccgcggcaagccagcccgc

SEQ ID NO: 176503 - DNA, 20 bp, human
gggggcgggtccaggatctt

SEQ ID NO: 176504 - DNA, 20 bp, human
ggaccgggcggtggcggtga

SEQ ID NO: 176505 - DNA, 20 bp, human
gcgggcctggagaggtgccg

SEQ ID NO: 176506 - DNA, 20 bp, human
gccgaccagcgaagccaaca

SEQ ID NO: 176507 - DNA, 20 bp, human
gcgcacccgacgggacccct

SEQ ID NO: 176508 - DNA, 20 bp, human
gggacctctgggaagccgag

SEQ ID NO: 176509 - DNA, 20 bp, human
gggacccctcggcttcccag

SEQ ID NO: 176510 - DNA, 20 bp, human
ggaagccgaggggtcccgtc

SEQ ID NO: 176511 - DNA, 20 bp, human
ggaggtccccctctcagcgg

SEQ ID NO: 176512 - DNA, 20 bp, human
gctcctctgccccggagcag

SEQ ID NO: 176513 - DNA, 20 bp, human
gtgcctgcgcgggcaagagg

SEQ ID NO: 176514 - DNA, 20 bp, human
gcgtccgccgccgctgagag

SEQ ID NO: 176515 - DNA, 20 bp, human
gggacgggggtcacaaaccc

SEQ ID NO: 176516 - DNA, 20 bp, human
ggctgggccgaggccttcac

SEQ ID NO: 176517 - DNA, 20 bp, human
ggctgttgcctgctcaaaag

SEQ ID NO: 176518 - DNA, 20 bp, human
ggccgaggccttcacaggtg

SEQ ID NO: 176519 - DNA, 20 bp, human
gaatcaggctgtcaagtcaa

SEQ ID NO: 176520 - DNA, 20 bp, human
gagaactttgcaggtgagaa

SEQ ID NO: 176521 - DNA, 20 bp, human
gtgcctaggagaacgatgct

SEQ ID NO: 176522 - DNA, 20 bp, human
gggtgatgctaggagaaaga

SEQ ID NO: 176523 - DNA, 20 bp, human
gcccacacctgtgaaggcct

SEQ ID NO: 176524 - DNA, 20 bp, human
gtaacatcgaaaagttctca

SEQ ID NO: 176525 - DNA, 20 bp, human
gagttgtcgaagctgggccg

SEQ ID NO: 176526 - DNA, 20 bp, human
ggcacgaggtctaggaatag

SEQ ID NO: 176527 - DNA, 20 bp, human
gtaagactccaatctaaagg

SEQ ID NO: 176528 - DNA, 20 bp, human
gctcttcagcaagaatgatc

SEQ ID NO: 176529 - DNA, 20 bp, human
ggggggaagtcaggggagta

SEQ ID NO: 176530 - DNA, 20 bp, human
gagactggctgcaggattgc

SEQ ID NO: 176531 - DNA, 20 bp, human
gggcctaaagattagaagta

SEQ ID NO: 176532 - DNA, 20 bp, human
gcaggattgcgggtaagtgc

SEQ ID NO: 176533 - DNA, 20 bp, human
gagtcaggggagtaggggtc

SEQ ID NO: 176534 - DNA, 20 bp, human
gcaatctaaagggggaagtc

SEQ ID NO: 176535 - DNA, 20 bp, human
ggagtggatggggaatagtt

SEQ ID NO: 176536 - DNA, 20 bp, human
gtctcccgctgcctcagggg

SEQ ID NO: 176537 - DNA, 20 bp, human
ggctcggcgcgggctggatg

SEQ ID NO: 176538 - DNA, 20 bp, human
gtggccgggtcacattccca

SEQ ID NO: 176539 - DNA, 20 bp, human
gccccgccaggtcagccccc

SEQ ID NO: 176540 - DNA, 20 bp, human
ggccccagcttcactccctg

SEQ ID NO: 176541 - DNA, 20 bp, human
gggcagacccgggagtagag

SEQ ID NO: 176542 - DNA, 20 bp, human
gcactccctgaggtctgtcc

SEQ ID NO: 176543 - DNA, 20 bp, human
gactgtgcagggtccagcga

SEQ ID NO: 176544 - DNA, 20 bp, human
gaaccgactcctcacctcgg

SEQ ID NO: 176545 - DNA, 20 bp, human
gccgggagtagaggggccag

SEQ ID NO: 176546 - DNA, 20 bp, human
gcgggaaaccggctcgtcgg

SEQ ID NO: 176547 - DNA, 20 bp, human
gcggctcgtcggaggcacaa

SEQ ID NO: 176548 - DNA, 20 bp, human
gtactggagcctcttcaaca

SEQ ID NO: 176549 - DNA, 20 bp, human
gggaggagagccggcggtag

SEQ ID NO: 176550 - DNA, 20 bp, human
gcaatccagcagttgcagtc

SEQ ID NO: 176551 - DNA, 20 bp, human
ggagacccgactgcaactgc

SEQ ID NO: 176552 - DNA, 20 bp, human
gaggctgagggacgagaacg

SEQ ID NO: 176553 - DNA, 20 bp, human
gacttacacgaaagaaacag

SEQ ID NO: 176554 - DNA, 20 bp, human
ggtggcagcggcgagagctt

SEQ ID NO: 176555 - DNA, 20 bp, human
gcgcggcgctcgcgaggagg

SEQ ID NO: 176556 - DNA, 20 bp, human
ggaaaaggccaccagatcgt

SEQ ID NO: 176557 - DNA, 20 bp, human
ggcacctctgagctgaggag

SEQ ID NO: 176558 - DNA, 20 bp, human
ggtgctaagggccccataag

SEQ ID NO: 176559 - DNA, 20 bp, human
gctggaagatgcccacgatc

SEQ ID NO: 176560 - DNA, 20 bp, human
gaggccactcctcagctcag

SEQ ID NO: 176561 - DNA, 20 bp, human
ggtagaccaaaagcccgact

SEQ ID NO: 176562 - DNA, 20 bp, human
gacaggggcaggccctcttg

SEQ ID NO: 176563 - DNA, 20 bp, human
ggcaatgctcagggcactct

SEQ ID NO: 176564 - DNA, 20 bp, human
gccctcttggggagagatct

SEQ ID NO: 176565 - DNA, 20 bp, human
gcagccactcgaggtagtca

SEQ ID NO: 176566 - DNA, 20 bp, human
ggcgcacgctgttgccccgt

SEQ ID NO: 176567 - DNA, 20 bp, human
gaggggccctgatttccggg

SEQ ID NO: 176568 - DNA, 20 bp, human
gccagaggcgaacacaccat

SEQ ID NO: 176569 - DNA, 20 bp, human
ggacctcaggctctagctcc

SEQ ID NO: 176570 - DNA, 20 bp, human
gagctagagcctgaggtcgg

SEQ ID NO: 176571 - DNA, 20 bp, human
gacgcggccgcgtgaggacg

SEQ ID NO: 176572 - DNA, 20 bp, human
gaaggagacgcggccgcgtg

SEQ ID NO: 176573 - DNA, 20 bp, human
ggaccagagtcggggaagtg

SEQ ID NO: 176574 - DNA, 20 bp, human
gaagcccgagaagacaagcg

SEQ ID NO: 176575 - DNA, 20 bp, human
gtgcggagcttcaggtgact

SEQ ID NO: 176576 - DNA, 20 bp, human
gaaaggtcagaaggatcctg

SEQ ID NO: 176577 - DNA, 20 bp, human
gccttagccaagctcaccag

SEQ ID NO: 176578 - DNA, 20 bp, human
ggcctttcaatcaggctcag

SEQ ID NO: 176579 - DNA, 20 bp, human
gtgtcgctggatgctatgta

SEQ ID NO: 176580 - DNA, 20 bp, human
gagccaagggacaggcttgg

SEQ ID NO: 176581 - DNA, 20 bp, human
gatgcgggaactgaagatgg

SEQ ID NO: 176582 - DNA, 20 bp, human
ggatgctatgtagggacggt

SEQ ID NO: 176583 - DNA, 20 bp, human
gccaggggcagcgctagatg

SEQ ID NO: 176584 - DNA, 20 bp, human
gccctctgagcctgattgaa

SEQ ID NO: 176585 - DNA, 20 bp, human
gcaggagggcaaaagctcct

SEQ ID NO: 176586 - DNA, 20 bp, human
ggcgttccgggcctcaactt

SEQ ID NO: 176587 - DNA, 20 bp, human
gtaagggacccctgagactg

SEQ ID NO: 176588 - DNA, 20 bp, human
gggtccctgagagaatgtaa

SEQ ID NO: 176589 - DNA, 20 bp, human
ggcgtcgtgagattcttgtg

SEQ ID NO: 176590 - DNA, 20 bp, human
gtgtagggatcgaggagtct

SEQ ID NO: 176591 - DNA, 20 bp, human
gctggctctgaggggaacga

SEQ ID NO: 176592 - DNA, 20 bp, human
gtaagagaatgccaagcccg

SEQ ID NO: 176593 - DNA, 20 bp, human
gcccagatcctggctctgag

SEQ ID NO: 176594 - DNA, 20 bp, human
gtcctgatcctgaagttgga

SEQ ID NO: 176595 - DNA, 20 bp, human
gcccggggagaaggcgttcc

SEQ ID NO: 176596 - DNA, 20 bp, human
ggagagcagggcggcattgg

SEQ ID NO: 176597 - DNA, 20 bp, human
gcctcgtgcgctgtggacgg

SEQ ID NO: 176598 - DNA, 20 bp, human
gggagagagcagggcggcat

SEQ ID NO: 176599 - DNA, 20 bp, human
ggggcaggaaggggtagaat

SEQ ID NO: 176600 - DNA, 20 bp, human
gcgtcctcgtgcgctgtgga

SEQ ID NO: 176601 - DNA, 20 bp, human
ggtggtttagtgggcaggaa

SEQ ID NO: 176602 - DNA, 20 bp, human
gtctcaaggcgaacgaagat

SEQ ID NO: 176603 - DNA, 20 bp, human
ggaactgctcgtcgctctca

SEQ ID NO: 176604 - DNA, 20 bp, human
gggaggagtatggggagttg

SEQ ID NO: 176605 - DNA, 20 bp, human
gtgaggagtatggggagcgg

SEQ ID NO: 176606 - DNA, 20 bp, human
gccaaggccaatgtacttcg

SEQ ID NO: 176607 - DNA, 20 bp, human
ggcgagggagtgaagacccc

SEQ ID NO: 176608 - DNA, 20 bp, human
gtcctcgtcagcgaacgcga

SEQ ID NO: 176609 - DNA, 20 bp, human
gcccataccgcgaagtacat

SEQ ID NO: 176610 - DNA, 20 bp, human
ggtagggaggaagtgcggag

SEQ ID NO: 176611 - DNA, 20 bp, human
gagatccaggcctggtggac

SEQ ID NO: 176612 - DNA, 20 bp, human
ggaagagggagaagactaga

SEQ ID NO: 176613 - DNA, 20 bp, human
gtggggcggaaacaacagta

SEQ ID NO: 176614 - DNA, 20 bp, human
ggcctaagatggcagagcca

SEQ ID NO: 176615 - DNA, 20 bp, human
ggtacattggccttggggtg

SEQ ID NO: 176616 - DNA, 20 bp, human
ggacaagctgagggccatac

SEQ ID NO: 176617 - DNA, 20 bp, human
gttcgggcgtgttaagacag

SEQ ID NO: 176618 - DNA, 20 bp, human
gaagctgagggccatactgg

SEQ ID NO: 176619 - DNA, 20 bp, human
ggaagactcagggccaacgt

SEQ ID NO: 176620 - DNA, 20 bp, human
gttaacacgcccgaagagag

SEQ ID NO: 176621 - DNA, 20 bp, human
gggcgggagaagatggatga

SEQ ID NO: 176622 - DNA, 20 bp, human
gcgtgttaagacagcggggt

SEQ ID NO: 176623 - DNA, 20 bp, human
gcggtcttgtcagagcgggt

SEQ ID NO: 176624 - DNA, 20 bp, human
gggatgaggggaggggctaa

SEQ ID NO: 176625 - DNA, 20 bp, human
gttccggcatagcaacgtgg

SEQ ID NO: 176626 - DNA, 20 bp, human
gttcccgcagagccctagga

SEQ ID NO: 176627 - DNA, 20 bp, human
gaacacgcctgaagagaggg

SEQ ID NO: 176628 - DNA, 20 bp, human
ggcttaacacgcctgaagag

SEQ ID NO: 176629 - DNA, 20 bp, human
ggtggcctctttccctccta

SEQ ID NO: 176630 - DNA, 20 bp, human
gcttcaggcgtgttaagcag

SEQ ID NO: 176631 - DNA, 20 bp, human
gggagggtcttgtcagaggt

SEQ ID NO: 176632 - DNA, 20 bp, human
ggcgtgttaagcagcggggt

SEQ ID NO: 176633 - DNA, 20 bp, human
gtgcgggaaaagaagcctca

SEQ ID NO: 176634 - DNA, 20 bp, human
ggggcggagaagacagatga

SEQ ID NO: 176635 - DNA, 20 bp, human
ggtgccggaacccactactg

SEQ ID NO: 176636 - DNA, 20 bp, human
gacgactcccgggaagacgt

SEQ ID NO: 176637 - DNA, 20 bp, human
gcaaggcccggagccccgtg

SEQ ID NO: 176638 - DNA, 20 bp, human
gctcccgggaagacgtgggt

SEQ ID NO: 176639 - DNA, 20 bp, human
gggcccacaatccctcgcga

SEQ ID NO: 176640 - DNA, 20 bp, human
gattgtgggccagcccccaa

SEQ ID NO: 176641 - DNA, 20 bp, human
gcgccctcgcgagggattgt

SEQ ID NO: 176642 - DNA, 20 bp, human
ggcggactgatccctcccag

SEQ ID NO: 176643 - DNA, 20 bp, human
gggcttcacctaacaggcca

SEQ ID NO: 176644 - DNA, 20 bp, human
gtgcgcaaagctgcaaggcc

SEQ ID NO: 176645 - DNA, 20 bp, human
ggagggcgggaaaagcaatg

SEQ ID NO: 176646 - DNA, 20 bp, human
gtcaccagggacaacttctg

SEQ ID NO: 176647 - DNA, 20 bp, human
gccagggacaacttctgagg

SEQ ID NO: 176648 - DNA, 20 bp, human
gctatacctgaaacatacag

SEQ ID NO: 176649 - DNA, 20 bp, human
gcaaagacccaagactgatg

SEQ ID NO: 176650 - DNA, 20 bp, human
gaggaggaggcagaattaga

SEQ ID NO: 176651 - DNA, 20 bp, human
gcaatcttgggctcacaaca

SEQ ID NO: 176652 - DNA, 20 bp, human
ggggacaacttctgaggagg

SEQ ID NO: 176653 - DNA, 20 bp, human
gagtactgcaggcttaaatg

SEQ ID NO: 176654 - DNA, 20 bp, human
ggttaatgattcacaatctt

SEQ ID NO: 176655 - DNA, 20 bp, human
gattgtgctgttcttactaa

SEQ ID NO: 176656 - DNA, 20 bp, human
gatggtgagatctcccgagg

SEQ ID NO: 176657 - DNA, 20 bp, human
gtcgggagatctcaccatcc

SEQ ID NO: 176658 - DNA, 20 bp, human
gccacatgaacagagacacc

SEQ ID NO: 176659 - DNA, 20 bp, human
gaggaggggtctcggagaca

SEQ ID NO: 176660 - DNA, 20 bp, human
ggaggaggcagagcccattt

SEQ ID NO: 176661 - DNA, 20 bp, human
gagaaccttagggaacctga

SEQ ID NO: 176662 - DNA, 20 bp, human
gggagacacggcctggtgct

SEQ ID NO: 176663 - DNA, 20 bp, human
ggggtctcggagacacggcc

SEQ ID NO: 176664 - DNA, 20 bp, human
ggtttccctcaggttcccta

SEQ ID NO: 176665 - DNA, 20 bp, human
gagcggggccaggattcctc

SEQ ID NO: 176666 - DNA, 20 bp, human
ggcgccggcatagtacaatg

SEQ ID NO: 176667 - DNA, 20 bp, human
ggtcgcgcggccgggagcac

SEQ ID NO: 176668 - DNA, 20 bp, human
gcggcagggcagcaggaccg

SEQ ID NO: 176669 - DNA, 20 bp, human
ggcgactccggcttcggctg

SEQ ID NO: 176670 - DNA, 20 bp, human
ggctcccggccgcgcgactc

SEQ ID NO: 176671 - DNA, 20 bp, human
gccggtgccccagccgaagc

SEQ ID NO: 176672 - DNA, 20 bp, human
gagggcagcaggaccgcggc

SEQ ID NO: 176673 - DNA, 20 bp, human
ggatggctcgggctcgactc

SEQ ID NO: 176674 - DNA, 20 bp, human
gcgcgcaaactagaggaaaa

SEQ ID NO: 176675 - DNA, 20 bp, human
gggccgcgcgactccggctt

SEQ ID NO: 176676 - DNA, 20 bp, human
ggcacgtaagggctccgggc

SEQ ID NO: 176677 - DNA, 20 bp, human
ggagtacaccgcggcttgag

SEQ ID NO: 176678 - DNA, 20 bp, human
ggggccgctggagtacaccg

SEQ ID NO: 176679 - DNA, 20 bp, human
gaagccgcggtgtactccag

SEQ ID NO: 176680 - DNA, 20 bp, human
ggccttctcaaacgttccag

SEQ ID NO: 176681 - DNA, 20 bp, human
gcctgtggcctctccatccg

SEQ ID NO: 176682 - DNA, 20 bp, human
gggagagggcgggcacgtaa

SEQ ID NO: 176683 - DNA, 20 bp, human
ggcggcttgagggggcccaa

SEQ ID NO: 176684 - DNA, 20 bp, human
gagacccgccgcggatggag

SEQ ID NO: 176685 - DNA, 20 bp, human
gtacgcccggggcgaaggaa

SEQ ID NO: 176686 - DNA, 20 bp, human
gtatatggggatcgggactc

SEQ ID NO: 176687 - DNA, 20 bp, human
gggaagtgcctggctaagag

SEQ ID NO: 176688 - DNA, 20 bp, human
gatggaacagcctgggccca

SEQ ID NO: 176689 - DNA, 20 bp, human
ggagagggatccggagccct

SEQ ID NO: 176690 - DNA, 20 bp, human
gcttacttggctggaggttg

SEQ ID NO: 176691 - DNA, 20 bp, human
gctcaactgaggaaaagacg

SEQ ID NO: 176692 - DNA, 20 bp, human
gccaaggaaaacagggccaa

SEQ ID NO: 176693 - DNA, 20 bp, human
gcagagtctgctgtcttact

SEQ ID NO: 176694 - DNA, 20 bp, human
gaggaaaagacggggagtca

SEQ ID NO: 176695 - DNA, 20 bp, human
gcgatccccatataggatct

SEQ ID NO: 176696 - DNA, 20 bp, human
gtagcggtccgcagacgcgg

SEQ ID NO: 176697 - DNA, 20 bp, human
gcggcaggcccgcgaagagt

SEQ ID NO: 176698 - DNA, 20 bp, human
gcgaagagtgggagccgcag

SEQ ID NO: 176699 - DNA, 20 bp, human
gtccggcactgcccgagaaa

SEQ ID NO: 176700 - DNA, 20 bp, human
gggtgtcacagagtccgctc

SEQ ID NO: 176701 - DNA, 20 bp, human
gagagagcagggagcatgaa

SEQ ID NO: 176702 - DNA, 20 bp, human
gtgaagggccagaggcgcaa

SEQ ID NO: 176703 - DNA, 20 bp, human
gtggcagcccggcctgaccg

SEQ ID NO: 176704 - DNA, 20 bp, human
gggcctgcgcgcttcggctc

SEQ ID NO: 176705 - DNA, 20 bp, human
gtgcggaccgctaaccgctg

SEQ ID NO: 176706 - DNA, 20 bp, human
ggatcggcgtccgcagcggg

SEQ ID NO: 176707 - DNA, 20 bp, human
gaggaggtgggcgaagagaa

SEQ ID NO: 176708 - DNA, 20 bp, human
gaggagaggcatacccactg

SEQ ID NO: 176709 - DNA, 20 bp, human
ggggctgcccggaagagtag

SEQ ID NO: 176710 - DNA, 20 bp, human
gggacgccgatccgcgcagg

SEQ ID NO: 176711 - DNA, 20 bp, human
gacgtgcgtggggctccgtg

SEQ ID NO: 176712 - DNA, 20 bp, human
gcccagacctacgccccagt

SEQ ID NO: 176713 - DNA, 20 bp, human
gcctggccgaggccagctgt

SEQ ID NO: 176714 - DNA, 20 bp, human
gcctcagcagccgcccgctg

SEQ ID NO: 176715 - DNA, 20 bp, human
gcgcggatcggcgtccgcag

SEQ ID NO: 176716 - DNA, 20 bp, human
gggtcggtaggtcacctcag

SEQ ID NO: 176717 - DNA, 20 bp, human
gggtaggtcacctcagaggt

SEQ ID NO: 176718 - DNA, 20 bp, human
ggcagaacatgggaacccaa

SEQ ID NO: 176719 - DNA, 20 bp, human
ggctggcaccaccggacatg

SEQ ID NO: 176720 - DNA, 20 bp, human
gccagcactagcccccatgt

SEQ ID NO: 176721 - DNA, 20 bp, human
gttctctgagaccgacatgg

SEQ ID NO: 176722 - DNA, 20 bp, human
gtgaaatgccccatgtccgg

SEQ ID NO: 176723 - DNA, 20 bp, human
ggggctagtgctggcaccac

SEQ ID NO: 176724 - DNA, 20 bp, human
ggaatgaaccctggtaacta

SEQ ID NO: 176725 - DNA, 20 bp, human
gatgcgagttctgggtcggt

SEQ ID NO: 176726 - DNA, 20 bp, human
gtcccacagtccatagtgag

SEQ ID NO: 176727 - DNA, 20 bp, human
ggagtgggactgagaggcac

SEQ ID NO: 176728 - DNA, 20 bp, human
ggaccccctgtccgcgccag

SEQ ID NO: 176729 - DNA, 20 bp, human
ggctgcagctgacagatgaa

SEQ ID NO: 176730 - DNA, 20 bp, human
gggaagtgaagaactctccg

SEQ ID NO: 176731 - DNA, 20 bp, human
gctctgtctgccgctcacta

SEQ ID NO: 176732 - DNA, 20 bp, human
gggtcccagacctggctagg

SEQ ID NO: 176733 - DNA, 20 bp, human
gggcggctcacaccaggagg

SEQ ID NO: 176734 - DNA, 20 bp, human
gagaggcacaggtggctgag

SEQ ID NO: 176735 - DNA, 20 bp, human
gctctcagtcccactccacg

SEQ ID NO: 176736 - DNA, 20 bp, human
gcgcgggcgtcactcctcag

SEQ ID NO: 176737 - DNA, 20 bp, human
ggtagccgaacgctgtggcg

SEQ ID NO: 176738 - DNA, 20 bp, human
gaccgccgtcactcccttca

SEQ ID NO: 176739 - DNA, 20 bp, human
ggtagcctcggagttgagag

SEQ ID NO: 176740 - DNA, 20 bp, human
gccgcgggcaccgaacttag

SEQ ID NO: 176741 - DNA, 20 bp, human
gagttgagaggggtcgaccg

SEQ ID NO: 176742 - DNA, 20 bp, human
gttacccgggaaggcaaaag

SEQ ID NO: 176743 - DNA, 20 bp, human
gcgagccagtcacccgggac

SEQ ID NO: 176744 - DNA, 20 bp, human
ggcgtcgtagccgaacgctg

SEQ ID NO: 176745 - DNA, 20 bp, human
ggccaccgccgcacttaccc

SEQ ID NO: 176746 - DNA, 20 bp, human
gggacgtacagagctgccgt

SEQ ID NO: 176747 - DNA, 20 bp, human
gaactactggtgaagaccaa

SEQ ID NO: 176748 - DNA, 20 bp, human
gcacaggacttcaccaggtg

SEQ ID NO: 176749 - DNA, 20 bp, human
ggcttcagcacacatcagtg

SEQ ID NO: 176750 - DNA, 20 bp, human
gactggtgaagaccaatgga

SEQ ID NO: 176751 - DNA, 20 bp, human
ggggaaggtaagtccagtct

SEQ ID NO: 176752 - DNA, 20 bp, human
ggagctgccgtgggcacgtc

SEQ ID NO: 176753 - DNA, 20 bp, human
gcttcccagcaaccatccat

SEQ ID NO: 176754 - DNA, 20 bp, human
gtgaggctccgaaaagacac

SEQ ID NO: 176755 - DNA, 20 bp, human
gttggtcaaagagggcggga

SEQ ID NO: 176756 - DNA, 20 bp, human
gcatctaaccagcagggcta

SEQ ID NO: 176757 - DNA, 20 bp, human
gctcttggccgacatgatgg

SEQ ID NO: 176758 - DNA, 20 bp, human
gggatgaggagcactgccaa

SEQ ID NO: 176759 - DNA, 20 bp, human
gtggtcccaggggctgttgt

SEQ ID NO: 176760 - DNA, 20 bp, human
gttggccgacatgatggagg

SEQ ID NO: 176761 - DNA, 20 bp, human
gggcccacatctaaccagca

SEQ ID NO: 176762 - DNA, 20 bp, human
gaacttacaggtcaaggtga

SEQ ID NO: 176763 - DNA, 20 bp, human
ggcagcctctcagtctggaa

SEQ ID NO: 176764 - DNA, 20 bp, human
ggccctcttggccgacatga

SEQ ID NO: 176765 - DNA, 20 bp, human
gctaggcaacttacaggtca

SEQ ID NO: 176766 - DNA, 20 bp, human
gaggctgagaagtaaagatc

SEQ ID NO: 176767 - DNA, 20 bp, human
gtcataagctctacacgtct

SEQ ID NO: 176768 - DNA, 20 bp, human
gcacccacgtggcatgagaa

SEQ ID NO: 176769 - DNA, 20 bp, human
gctctccaggaagctgaatg

SEQ ID NO: 176770 - DNA, 20 bp, human
gtgcttagtggacattcacg

SEQ ID NO: 176771 - DNA, 20 bp, human
gcaaggatgggagatgggta

SEQ ID NO: 176772 - DNA, 20 bp, human
gccataagctctacatgtct

SEQ ID NO: 176773 - DNA, 20 bp, human
gtcagacaaggatgggagat

SEQ ID NO: 176774 - DNA, 20 bp, human
ggggtgtggtcaacagtctg

SEQ ID NO: 176775 - DNA, 20 bp, human
gcccatccttgtctgaaggt

SEQ ID NO: 176776 - DNA, 20 bp, human
gccctggcagaagaagcggt

SEQ ID NO: 176777 - DNA, 20 bp, human
gagcaacaggactctccatg

SEQ ID NO: 176778 - DNA, 20 bp, human
gaggactctccatgtggcaa

SEQ ID NO: 176779 - DNA, 20 bp, human
gcaggagcgtcgtcttgccc

SEQ ID NO: 176780 - DNA, 20 bp, human
gcagcacttcccctggatag

SEQ ID NO: 176781 - DNA, 20 bp, human
gattcacaggggagtatcca

SEQ ID NO: 176782 - DNA, 20 bp, human
gtagaggaaggcccaggcct

SEQ ID NO: 176783 - DNA, 20 bp, human
gacttcccctggatagagga

SEQ ID NO: 176784 - DNA, 20 bp, human
gactcccctgtgaatcaagg

SEQ ID NO: 176785 - DNA, 20 bp, human
gggcagtgggacacagcaac

SEQ ID NO: 176786 - DNA, 20 bp, human
ggcagatgggctgactggct

SEQ ID NO: 176787 - DNA, 20 bp, human
ggcattctggagactctgat

SEQ ID NO: 176788 - DNA, 20 bp, human
ggtacctggccgatggctct

SEQ ID NO: 176789 - DNA, 20 bp, human
gctccccagagccatcggcc

SEQ ID NO: 176790 - DNA, 20 bp, human
gggaggagcacttactccca

SEQ ID NO: 176791 - DNA, 20 bp, human
gaagcgcaggtcctcctgtt

SEQ ID NO: 176792 - DNA, 20 bp, human
ggcttggggacaaacactca

SEQ ID NO: 176793 - DNA, 20 bp, human
gtgtatggattcccaacagg

SEQ ID NO: 176794 - DNA, 20 bp, human
gctatcacagctgaatggaa

SEQ ID NO: 176795 - DNA, 20 bp, human
ggaaggccctttgcatggat

SEQ ID NO: 176796 - DNA, 20 bp, human
gcctcgcagacctcggacag

SEQ ID NO: 176797 - DNA, 20 bp, human
ggtggcgtctgggtccgttg

SEQ ID NO: 176798 - DNA, 20 bp, human
gacaggcctcgagacgagaa

SEQ ID NO: 176799 - DNA, 20 bp, human
gcccgagtcggaccaagggt

SEQ ID NO: 176800 - DNA, 20 bp, human
gcattagcaagacccgcggg

SEQ ID NO: 176801 - DNA, 20 bp, human
ggtctgcgagggcttcgacg

SEQ ID NO: 176802 - DNA, 20 bp, human
gggagacgtcttactttcga

SEQ ID NO: 176803 - DNA, 20 bp, human
ggcgagggcttcgacgagga

SEQ ID NO: 176804 - DNA, 20 bp, human
gctgtgggccacatacaagg

SEQ ID NO: 176805 - DNA, 20 bp, human
gtagcgacactcgggacctg

SEQ ID NO: 176806 - DNA, 20 bp, human
ggggcgaagtctgtgtctca

SEQ ID NO: 176807 - DNA, 20 bp, human
gcgcagtcgccgaagatggc

SEQ ID NO: 176808 - DNA, 20 bp, human
ggacttcgccccgccatctt

SEQ ID NO: 176809 - DNA, 20 bp, human
gtcacggtcagttcaactcc

SEQ ID NO: 176810 - DNA, 20 bp, human
gcggaacccagacgctcccc

SEQ ID NO: 176811 - DNA, 20 bp, human
ggcgtcgcagtcgccgaaga

SEQ ID NO: 176812 - DNA, 20 bp, human
gggtcgggtccaggtgtaga

SEQ ID NO: 176813 - DNA, 20 bp, human
gaggctcctggggagcgtct

SEQ ID NO: 176814 - DNA, 20 bp, human
ggactgcgacgcggttaccg

SEQ ID NO: 176815 - DNA, 20 bp, human
gatataagtaagaaattcgg

SEQ ID NO: 176816 - DNA, 20 bp, human
ggcgccgcacccggaagatg

SEQ ID NO: 176817 - DNA, 20 bp, human
gggaagatgaggctcgccgt

SEQ ID NO: 176818 - DNA, 20 bp, human
gggagttcggacttgacaag

SEQ ID NO: 176819 - DNA, 20 bp, human
ggagcctcatcttccgggtg

SEQ ID NO: 176820 - DNA, 20 bp, human
ggcgtagagaggcaatggaa

SEQ ID NO: 176821 - DNA, 20 bp, human
gccaggggtggggcgtagag

SEQ ID NO: 176822 - DNA, 20 bp, human
gggacatcagcctctgaaag

SEQ ID NO: 176823 - DNA, 20 bp, human
gaggacatctacagctccca

SEQ ID NO: 176824 - DNA, 20 bp, human
ggcgcgggccagcgactctg

SEQ ID NO: 176825 - DNA, 20 bp, human
gtcagaggctgatgtcccct

SEQ ID NO: 176826 - DNA, 20 bp, human
gtgtggtctggtgcctgtct

SEQ ID NO: 176827 - DNA, 20 bp, human
gtctacatagcgggcaagtg

SEQ ID NO: 176828 - DNA, 20 bp, human
gcctctctccatggccctga

SEQ ID NO: 176829 - DNA, 20 bp, human
gggagggtttgtctacatag

SEQ ID NO: 176830 - DNA, 20 bp, human
gactacaatagtaagtggtg

SEQ ID NO: 176831 - DNA, 20 bp, human
gagaaaactacaatagtaag

SEQ ID NO: 176832 - DNA, 20 bp, human
gagtaggaggtgctcagaga

SEQ ID NO: 176833 - DNA, 20 bp, human
ggttggctagcacgcctctg

SEQ ID NO: 176834 - DNA, 20 bp, human
gtagaggccaggaggtgaaa

SEQ ID NO: 176835 - DNA, 20 bp, human
gccagagcttgcaaagtagg

SEQ ID NO: 176836 - DNA, 20 bp, human
gctcttattcctcccccgca

SEQ ID NO: 176837 - DNA, 20 bp, human
ggaacccgcgtgcgaccctc

SEQ ID NO: 176838 - DNA, 20 bp, human
ggatgggagaagcgagtgga

SEQ ID NO: 176839 - DNA, 20 bp, human
ggagggatgggagaagcgag

SEQ ID NO: 176840 - DNA, 20 bp, human
gactcggcgcgaattcgcag

SEQ ID NO: 176841 - DNA, 20 bp, human
gcgagtggagggtagcaaga

SEQ ID NO: 176842 - DNA, 20 bp, human
gcgggcatgataacacacgc

SEQ ID NO: 176843 - DNA, 20 bp, human
gacgccggagggtcgcacgc

SEQ ID NO: 176844 - DNA, 20 bp, human
ggccactagcgaggcactat

SEQ ID NO: 176845 - DNA, 20 bp, human
gcaagcgggcctacctgaag

SEQ ID NO: 176846 - DNA, 20 bp, human
ggccgccgctaagaaaagag

SEQ ID NO: 176847 - DNA, 20 bp, human
gctctctgcgctctctcctt

SEQ ID NO: 176848 - DNA, 20 bp, human
gcggcgtctggcgaatcaca

SEQ ID NO: 176849 - DNA, 20 bp, human
gacactgagactcccgtcaa

SEQ ID NO: 176850 - DNA, 20 bp, human
gaatcgagcgtgaagcggag

SEQ ID NO: 176851 - DNA, 20 bp, human
gagtgtagcaaatcggagtg

SEQ ID NO: 176852 - DNA, 20 bp, human
ggtctggcgaatcacaggga

SEQ ID NO: 176853 - DNA, 20 bp, human
ggagtctcagtgtagcaaat

SEQ ID NO: 176854 - DNA, 20 bp, human
gccaggaacgctgcccagcg

SEQ ID NO: 176855 - DNA, 20 bp, human
gctcaatgcagtccattgac

SEQ ID NO: 176856 - DNA, 20 bp, human
gtgccggcggtgagcgcagg

SEQ ID NO: 176857 - DNA, 20 bp, human
ggcaaagtgctggctgccgg

SEQ ID NO: 176858 - DNA, 20 bp, human
gttgggtgcgagaccgagag

SEQ ID NO: 176859 - DNA, 20 bp, human
gccagagagtagctccactt

SEQ ID NO: 176860 - DNA, 20 bp, human
gctgggtgagcgcaaagtgc

SEQ ID NO: 176861 - DNA, 20 bp, human
gctcctcctgcgctcaccgc

SEQ ID NO: 176862 - DNA, 20 bp, human
ggataacacgaggagtgcac

SEQ ID NO: 176863 - DNA, 20 bp, human
gcgcagctggttgcaaggag

SEQ ID NO: 176864 - DNA, 20 bp, human
gccagctgcgaaacgcgggt

SEQ ID NO: 176865 - DNA, 20 bp, human
gggacacgagcttcaaagta

SEQ ID NO: 176866 - DNA, 20 bp, human
gtggcagcctggtctctagg

SEQ ID NO: 176867 - DNA, 20 bp, human
ggagattctgataaagtcag

SEQ ID NO: 176868 - DNA, 20 bp, human
gcatgtgaggagcagatgtc

SEQ ID NO: 176869 - DNA, 20 bp, human
gccaggctgccatcatgctc

SEQ ID NO: 176870 - DNA, 20 bp, human
gagctctaaggtgcatctgg

SEQ ID NO: 176871 - DNA, 20 bp, human
gcccgagtctgttacaaatg

SEQ ID NO: 176872 - DNA, 20 bp, human
gtgatggcagcctggtctct

SEQ ID NO: 176873 - DNA, 20 bp, human
gatcagagcttaaaagggtg

SEQ ID NO: 176874 - DNA, 20 bp, human
gttaagtgtggaagagaatt

SEQ ID NO: 176875 - DNA, 20 bp, human
gaagtacgaagatatctatg

SEQ ID NO: 176876 - DNA, 20 bp, human
ggcggtcttgacactcgcgg

SEQ ID NO: 176877 - DNA, 20 bp, human
gggagcggtcttgacactcg

SEQ ID NO: 176878 - DNA, 20 bp, human
gtcgccaggacacactgttc

SEQ ID NO: 176879 - DNA, 20 bp, human
gcccgcagaaatggactaag

SEQ ID NO: 176880 - DNA, 20 bp, human
ggtcactggacacgcatcgg

SEQ ID NO: 176881 - DNA, 20 bp, human
gggagccctggcctctcggt

SEQ ID NO: 176882 - DNA, 20 bp, human
gtccaggcctcgttcccgag

SEQ ID NO: 176883 - DNA, 20 bp, human
gcgggtcactggacacgcat

SEQ ID NO: 176884 - DNA, 20 bp, human
gtggatcccgtcccaccgag

SEQ ID NO: 176885 - DNA, 20 bp, human
ggcgcccgaacagtgtgtcc

SEQ ID NO: 176886 - DNA, 20 bp, human
gtatagattagagacagggg

SEQ ID NO: 176887 - DNA, 20 bp, human
gtgacatctgtcgccaggga

SEQ ID NO: 176888 - DNA, 20 bp, human
ggcaaggagctatctgatcc

SEQ ID NO: 176889 - DNA, 20 bp, human
gtcgtggactagtcccggaa

SEQ ID NO: 176890 - DNA, 20 bp, human
gcaatatagattagagacag

SEQ ID NO: 176891 - DNA, 20 bp, human
gaagtacaaaatctgttcca

SEQ ID NO: 176892 - DNA, 20 bp, human
gtttcgggggaagttaagga

SEQ ID NO: 176893 - DNA, 20 bp, human
ggaaaggtagttgacatgtt

SEQ ID NO: 176894 - DNA, 20 bp, human
gggcagagagttgccctccc

SEQ ID NO: 176895 - DNA, 20 bp, human
gcggcatcgtggactagtcc

SEQ ID NO: 176896 - DNA, 20 bp, human
gccatggaggcaggacggac

SEQ ID NO: 176897 - DNA, 20 bp, human
gagcaggctacgctcagagg

SEQ ID NO: 176898 - DNA, 20 bp, human
gttcccgggcgggtccatgg

SEQ ID NO: 176899 - DNA, 20 bp, human
gtggagcaggctacgctcag

SEQ ID NO: 176900 - DNA, 20 bp, human
gacccagccgggatcctagt

SEQ ID NO: 176901 - DNA, 20 bp, human
gtcgttagcgcgggacagga

SEQ ID NO: 176902 - DNA, 20 bp, human
gccgagactactcaccatgg

SEQ ID NO: 176903 - DNA, 20 bp, human
gggcccgagactactcacca

SEQ ID NO: 176904 - DNA, 20 bp, human
ggcgctaacgaaatctcgga

SEQ ID NO: 176905 - DNA, 20 bp, human
gaggctcctgcgcccgcggg

SEQ ID NO: 176906 - DNA, 20 bp, human
gatcggccggtcccagatgc

SEQ ID NO: 176907 - DNA, 20 bp, human
gccggacggaggtgcagaat

SEQ ID NO: 176908 - DNA, 20 bp, human
gcggtcccagatgctggcgg

SEQ ID NO: 176909 - DNA, 20 bp, human
gcgcctgcagcggacaaaag

SEQ ID NO: 176910 - DNA, 20 bp, human
gaaagggcagcgccggacgg

SEQ ID NO: 176911 - DNA, 20 bp, human
ggatggaaatccgaatcaaa

SEQ ID NO: 176912 - DNA, 20 bp, human
gccgtcccggcagctaagaa

SEQ ID NO: 176913 - DNA, 20 bp, human
ggactgctgcagaaccacgt

SEQ ID NO: 176914 - DNA, 20 bp, human
ggccgccgccgccagcatct

SEQ ID NO: 176915 - DNA, 20 bp, human
gccaaggaaggagggtcccg

SEQ ID NO: 176916 - DNA, 20 bp, human
ggacactggggagacatccg

SEQ ID NO: 176917 - DNA, 20 bp, human
gtggtgcttgccgcgtatca

SEQ ID NO: 176918 - DNA, 20 bp, human
gcggaggcagccatgatacg

SEQ ID NO: 176919 - DNA, 20 bp, human
ggagcggcggtgaaggtcct

SEQ ID NO: 176920 - DNA, 20 bp, human
gtaaatgccaagctccctag

SEQ ID NO: 176921 - DNA, 20 bp, human
gctgcgcgtttctttcggag

SEQ ID NO: 176922 - DNA, 20 bp, human
gggctacacccccccgaacg

SEQ ID NO: 176923 - DNA, 20 bp, human
gatgccaagctccctagggg

SEQ ID NO: 176924 - DNA, 20 bp, human
gcgtgggcaacggagggaga

SEQ ID NO: 176925 - DNA, 20 bp, human
ggaggaacctgcgagaccta

SEQ ID NO: 176926 - DNA, 20 bp, human
gactaggtgattcttggagc

SEQ ID NO: 176927 - DNA, 20 bp, human
gagctgcactaggtgattct

SEQ ID NO: 176928 - DNA, 20 bp, human
gccacgcagggtatcccacg

SEQ ID NO: 176929 - DNA, 20 bp, human
ggcgtccgggccaggtcaag

SEQ ID NO: 176930 - DNA, 20 bp, human
ggccggcgaggaaccactgt

SEQ ID NO: 176931 - DNA, 20 bp, human
gtactgctggagtgcaatcc

SEQ ID NO: 176932 - DNA, 20 bp, human
gagcctgcgcatgcgaacag

SEQ ID NO: 176933 - DNA, 20 bp, human
gtatctaaaatagcaccccg

SEQ ID NO: 176934 - DNA, 20 bp, human
gacttccgcttgacctggcc

SEQ ID NO: 176935 - DNA, 20 bp, human
gactacagtgaaccccacgc

SEQ ID NO: 176936 - DNA, 20 bp, human
gggaagggcctggcgagtct

SEQ ID NO: 176937 - DNA, 20 bp, human
ggaaggagaaagtccagcac

SEQ ID NO: 176938 - DNA, 20 bp, human
gacgaactctcaagaggagt

SEQ ID NO: 176939 - DNA, 20 bp, human
gggtgaccggaagtgatcgt

SEQ ID NO: 176940 - DNA, 20 bp, human
ggagagagcgagacctggga

SEQ ID NO: 176941 - DNA, 20 bp, human
gggaaagaggacgccatgat

SEQ ID NO: 176942 - DNA, 20 bp, human
gtcctcttgagagttcgtag

SEQ ID NO: 176943 - DNA, 20 bp, human
gccccagcgccaaccaatca

SEQ ID NO: 176944 - DNA, 20 bp, human
gcccccacggcctggaaaca

SEQ ID NO: 176945 - DNA, 20 bp, human
gagaggacgccatgattggt

SEQ ID NO: 176946 - DNA, 20 bp, human
ggggcgcgccgaggacccag

SEQ ID NO: 176947 - DNA, 20 bp, human
gaggagccctcgcagacata

SEQ ID NO: 176948 - DNA, 20 bp, human
gtcctcccaggcggcagaga

SEQ ID NO: 176949 - DNA, 20 bp, human
ggtctgcgagggctcctccc

SEQ ID NO: 176950 - DNA, 20 bp, human
gcgatacgcgggggagagga

SEQ ID NO: 176951 - DNA, 20 bp, human
gcggcagcaagcgcagacgc

SEQ ID NO: 176952 - DNA, 20 bp, human
gccgcgtatcggagaagcag

SEQ ID NO: 176953 - DNA, 20 bp, human
gactcccagcgcgccgaccg

SEQ ID NO: 176954 - DNA, 20 bp, human
gtccgcccctggacgtccaa

SEQ ID NO: 176955 - DNA, 20 bp, human
gcaactccggcagctacctg

SEQ ID NO: 176956 - DNA, 20 bp, human
gcgggacgcggggctcaccc

SEQ ID NO: 176957 - DNA, 20 bp, human
gccggcccgacgctcggcca

SEQ ID NO: 176958 - DNA, 20 bp, human
gcgcggcgcggtgacgtggg

SEQ ID NO: 176959 - DNA, 20 bp, human
ggcgcgcggcgcggtgacgt

SEQ ID NO: 176960 - DNA, 20 bp, human
ggcgccccacgctggaggtg

SEQ ID NO: 176961 - DNA, 20 bp, human
gtcccggcgccactcggccc

SEQ ID NO: 176962 - DNA, 20 bp, human
ggtcacgccggcccgacgct

SEQ ID NO: 176963 - DNA, 20 bp, human
gctcaccctggccgagcgtc

SEQ ID NO: 176964 - DNA, 20 bp, human
gcccgcgtcccggcgccact

SEQ ID NO: 176965 - DNA, 20 bp, human
ggacgctgctgtcggccggg

SEQ ID NO: 176966 - DNA, 20 bp, human
gaggcatgcttccttagacc

SEQ ID NO: 176967 - DNA, 20 bp, human
gatctctcttacctggtcta

SEQ ID NO: 176968 - DNA, 20 bp, human
gcaaactgatctctcttacc

SEQ ID NO: 176969 - DNA, 20 bp, human
gactacagggttatgtatgg

SEQ ID NO: 176970 - DNA, 20 bp, human
gagtctttgttaccattcag

SEQ ID NO: 176971 - DNA, 20 bp, human
gcagtttgtttctcactgct

SEQ ID NO: 176972 - DNA, 20 bp, human
gtggaaaaaatgtttagtta

SEQ ID NO: 176973 - DNA, 20 bp, human
gcttattttattaactactg

SEQ ID NO: 176974 - DNA, 20 bp, human
gggaactaaagcagcagttg

SEQ ID NO: 176975 - DNA, 20 bp, human
gtaattttaaaggtacttca

SEQ ID NO: 176976 - DNA, 20 bp, human
ggagcctgcccaaagatgaa

SEQ ID NO: 176977 - DNA, 20 bp, human
ggggagagggcggacgaaat

SEQ ID NO: 176978 - DNA, 20 bp, human
gaaacagatgggactcgtgg

SEQ ID NO: 176979 - DNA, 20 bp, human
gtcggtagcgatctcggctg

SEQ ID NO: 176980 - DNA, 20 bp, human
ggactcgtgggggaacaagg

SEQ ID NO: 176981 - DNA, 20 bp, human
gacgaaatcggtagcgatct

SEQ ID NO: 176982 - DNA, 20 bp, human
gcagagtcgaaagcagagga

SEQ ID NO: 176983 - DNA, 20 bp, human
gagcgcgggcgccacagaag

SEQ ID NO: 176984 - DNA, 20 bp, human
ggcccaaagatgaagggtca

SEQ ID NO: 176985 - DNA, 20 bp, human
gaacccaggtctaaacagat

SEQ ID NO: 176986 - DNA, 20 bp, human
gctcacggcagccctacact

SEQ ID NO: 176987 - DNA, 20 bp, human
gcgttacgccacgcacctca

SEQ ID NO: 176988 - DNA, 20 bp, human
gttcttccaggccgagtgta

SEQ ID NO: 176989 - DNA, 20 bp, human
gggcagccctacactcggcc

SEQ ID NO: 176990 - DNA, 20 bp, human
gcgtctttccatgaaggtct

SEQ ID NO: 176991 - DNA, 20 bp, human
gcagctcgcccaccacttcc

SEQ ID NO: 176992 - DNA, 20 bp, human
gggtgtgaacggccacgggg

SEQ ID NO: 176993 - DNA, 20 bp, human
gtgctggtcaatgttgacac

SEQ ID NO: 176994 - DNA, 20 bp, human
ggcagcatcaaacatccctg

SEQ ID NO: 176995 - DNA, 20 bp, human
ggaagaaaaacaattcttcc

SEQ ID NO: 176996 - DNA, 20 bp, human
gccgcgcagtgctagctcca

SEQ ID NO: 176997 - DNA, 20 bp, human
gccccgctagacgcagtcaa

SEQ ID NO: 176998 - DNA, 20 bp, human
gctagccttggaggacgtcg

SEQ ID NO: 176999 - DNA, 20 bp, human
gcggggcgcccgtcttgggg

SEQ ID NO: 177000 - DNA, 20 bp, human
gaggcggcagtggcgagctg

SEQ ID NO: 177001 - DNA, 20 bp, human
gcgtcttgggggggcaccta

SEQ ID NO: 177002 - DNA, 20 bp, human
gcccaggggcctgatctcgg

SEQ ID NO: 177003 - DNA, 20 bp, human
gcacctaaggaatccggcag

SEQ ID NO: 177004 - DNA, 20 bp, human
gggccactgccggattcctt

SEQ ID NO: 177005 - DNA, 20 bp, human
gggggggcacctaaggaatc

SEQ ID NO: 177006 - DNA, 20 bp, human
ggcgcggggctcggtgacag

SEQ ID NO: 177007 - DNA, 20 bp, human
ggggcggacggactgcgggt

SEQ ID NO: 177008 - DNA, 20 bp, human
ggtgggtcccggagacaggt

SEQ ID NO: 177009 - DNA, 20 bp, human
ggtcccggagacaggtggga

SEQ ID NO: 177010 - DNA, 20 bp, human
gccggcccgcgcctgaaggg

SEQ ID NO: 177011 - DNA, 20 bp, human
ggccgagccgggagccccct

SEQ ID NO: 177012 - DNA, 20 bp, human
gtccctggcccctatcccgt

SEQ ID NO: 177013 - DNA, 20 bp, human
gcctcccgcccggttacata

SEQ ID NO: 177014 - DNA, 20 bp, human
gagcgaggtgagcgggaccg

SEQ ID NO: 177015 - DNA, 20 bp, human
gtccgggacccacgggatag

SEQ ID NO: 177016 - DNA, 20 bp, human
ggaggactgtctcccagtcg

SEQ ID NO: 177017 - DNA, 20 bp, human
ggccagagggtgtaaatgaa

SEQ ID NO: 177018 - DNA, 20 bp, human
gagttcttggtgccacgact

SEQ ID NO: 177019 - DNA, 20 bp, human
ggtctcccagagctgagttg

SEQ ID NO: 177020 - DNA, 20 bp, human
gtgggagacggagccaaatg

SEQ ID NO: 177021 - DNA, 20 bp, human
gtcagggagctcactgtccg

SEQ ID NO: 177022 - DNA, 20 bp, human
gacccggaaccaagatacct

SEQ ID NO: 177023 - DNA, 20 bp, human
gtcggttagaacgcagttct

SEQ ID NO: 177024 - DNA, 20 bp, human
ggcaccattggcttccctcg

SEQ ID NO: 177025 - DNA, 20 bp, human
gagatacctgggtccccatt

SEQ ID NO: 177026 - DNA, 20 bp, human
gcatatgcaccatgccagaa

SEQ ID NO: 177027 - DNA, 20 bp, human
gggcatggtgcatatgttat

SEQ ID NO: 177028 - DNA, 20 bp, human
gttactttggttgtcccttc

SEQ ID NO: 177029 - DNA, 20 bp, human
gtgctggtaggtaactaaac

SEQ ID NO: 177030 - DNA, 20 bp, human
gacggctagatcgtttactt

SEQ ID NO: 177031 - DNA, 20 bp, human
ggggaagagggattataatt

SEQ ID NO: 177032 - DNA, 20 bp, human
ggttacctaccagcaatgag

SEQ ID NO: 177033 - DNA, 20 bp, human
gttggttgtcccttctggca

SEQ ID NO: 177034 - DNA, 20 bp, human
gccaaagtattcattactca

SEQ ID NO: 177035 - DNA, 20 bp, human
gtgcatatgttatgggaaga

SEQ ID NO: 177036 - DNA, 20 bp, human
gaccccgagtcagggatgag

SEQ ID NO: 177037 - DNA, 20 bp, human
gagcatggacaccaggacca

SEQ ID NO: 177038 - DNA, 20 bp, human
gggcctctcatccctgactc

SEQ ID NO: 177039 - DNA, 20 bp, human
ggaggaggcaatggccacca

SEQ ID NO: 177040 - DNA, 20 bp, human
gcaaaggcgaccccgagtca

SEQ ID NO: 177041 - DNA, 20 bp, human
gtgggagggtctgcccctgg

SEQ ID NO: 177042 - DNA, 20 bp, human
ggcaggtggagagtaactca

SEQ ID NO: 177043 - DNA, 20 bp, human
gggtggagagtaactcaggg

SEQ ID NO: 177044 - DNA, 20 bp, human
ggagggccagcatggacacc

SEQ ID NO: 177045 - DNA, 20 bp, human
gtgcctcctctctgctccaa

SEQ ID NO: 177046 - DNA, 20 bp, human
gggacccaaggccaagatcc

SEQ ID NO: 177047 - DNA, 20 bp, human
gcggcgagacgcccagctcc

SEQ ID NO: 177048 - DNA, 20 bp, human
gaggccaagatccaggcgag

SEQ ID NO: 177049 - DNA, 20 bp, human
ggatttgccactgctcagga

SEQ ID NO: 177050 - DNA, 20 bp, human
gacaaaaccctcctagagga

SEQ ID NO: 177051 - DNA, 20 bp, human
gagagggggaatggctataa

SEQ ID NO: 177052 - DNA, 20 bp, human
gggcacatagccccaggacg

SEQ ID NO: 177053 - DNA, 20 bp, human
gagcagggagagagtcaccc

SEQ ID NO: 177054 - DNA, 20 bp, human
gtgttcaccctcctctagga

SEQ ID NO: 177055 - DNA, 20 bp, human
gaggagggcattcccaccaa

SEQ ID NO: 177056 - DNA, 20 bp, human
gtggcagccatgaccaccgt

SEQ ID NO: 177057 - DNA, 20 bp, human
gcccagcatgcagagcgctc

SEQ ID NO: 177058 - DNA, 20 bp, human
gtgcgtcccggagcccacgg

SEQ ID NO: 177059 - DNA, 20 bp, human
gtactcctcagcagagctgg

SEQ ID NO: 177060 - DNA, 20 bp, human
ggctctgctgaggagtacgt

SEQ ID NO: 177061 - DNA, 20 bp, human
ggatggctatggggtcatag

SEQ ID NO: 177062 - DNA, 20 bp, human
gcctgccaccggggcagtca

SEQ ID NO: 177063 - DNA, 20 bp, human
ggtcagggcagtactcacac

SEQ ID NO: 177064 - DNA, 20 bp, human
gccatgaccaccgtgggctc

SEQ ID NO: 177065 - DNA, 20 bp, human
gctatggggtcataggggat

SEQ ID NO: 177066 - DNA, 20 bp, human
ggtccacgcgcaataaggag

SEQ ID NO: 177067 - DNA, 20 bp, human
ggcaggtgggggaagaacag

SEQ ID NO: 177068 - DNA, 20 bp, human
gtcagcggagacctgcggag

SEQ ID NO: 177069 - DNA, 20 bp, human
gctcgcgtccgcccattcag

SEQ ID NO: 177070 - DNA, 20 bp, human
gaggaggccgggagactagg

SEQ ID NO: 177071 - DNA, 20 bp, human
gtacccgaaggagctcggaa

SEQ ID NO: 177072 - DNA, 20 bp, human
ggccggcgcccaatacccga

SEQ ID NO: 177073 - DNA, 20 bp, human
ggaaggagctcggaagggtg

SEQ ID NO: 177074 - DNA, 20 bp, human
gtcggaggcactgtgggaag

SEQ ID NO: 177075 - DNA, 20 bp, human
gccgcgacgccccagtccag

SEQ ID NO: 177076 - DNA, 20 bp, human
gccgggttctggtgtaggag

SEQ ID NO: 177077 - DNA, 20 bp, human
ggccgtgctcacctgtccga

SEQ ID NO: 177078 - DNA, 20 bp, human
gtgcttccgggttctggtgt

SEQ ID NO: 177079 - DNA, 20 bp, human
ggctctgccgaggcacggag

SEQ ID NO: 177080 - DNA, 20 bp, human
gggagcggcgtcttctcgcg

SEQ ID NO: 177081 - DNA, 20 bp, human
ggtttgagccctatgagcag

SEQ ID NO: 177082 - DNA, 20 bp, human
gccagaacccggaagcaccg

SEQ ID NO: 177083 - DNA, 20 bp, human
gtctgaagcatgaaaactaa

SEQ ID NO: 177084 - DNA, 20 bp, human
gcctatgagcagtggaacct

SEQ ID NO: 177085 - DNA, 20 bp, human
gggcagagctgtctacgaaa

SEQ ID NO: 177086 - DNA, 20 bp, human
gaaagagggagcctcagagt

SEQ ID NO: 177087 - DNA, 20 bp, human
gagtcggcttcagagatcac

SEQ ID NO: 177088 - DNA, 20 bp, human
gtactagcagtgaaagagcg

SEQ ID NO: 177089 - DNA, 20 bp, human
gatctctgaagccgactctg

SEQ ID NO: 177090 - DNA, 20 bp, human
gagaggcaaagaactgatag

SEQ ID NO: 177091 - DNA, 20 bp, human
gttactctgtttacagggaa

SEQ ID NO: 177092 - DNA, 20 bp, human
gctgtctgttagagcaaaga

SEQ ID NO: 177093 - DNA, 20 bp, human
gaatgctgagaactcaagtt

SEQ ID NO: 177094 - DNA, 20 bp, human
gggctagacagtatattgcc

SEQ ID NO: 177095 - DNA, 20 bp, human
gccttccaggtattgaagac

SEQ ID NO: 177096 - DNA, 20 bp, human
gggcagggtccgtagtctag

SEQ ID NO: 177097 - DNA, 20 bp, human
ggcccccgtacaggaactgg

SEQ ID NO: 177098 - DNA, 20 bp, human
ggtcaggcgtagctcctagg

SEQ ID NO: 177099 - DNA, 20 bp, human
ggcagaatcgacagccccag

SEQ ID NO: 177100 - DNA, 20 bp, human
gcgtccgagaaagcgcctgg

SEQ ID NO: 177101 - DNA, 20 bp, human
gcgagaaagcgcctggcggg

SEQ ID NO: 177102 - DNA, 20 bp, human
ggtggtcaggcgtagctcct

SEQ ID NO: 177103 - DNA, 20 bp, human
gtctcggacgccttgcccag

SEQ ID NO: 177104 - DNA, 20 bp, human
ggtctcctgcccctagacta

SEQ ID NO: 177105 - DNA, 20 bp, human
gggagcggccagatacctgt

SEQ ID NO: 177106 - DNA, 20 bp, human
gtagcaggatcggtccacag

SEQ ID NO: 177107 - DNA, 20 bp, human
gggcactaggcggagagagg

SEQ ID NO: 177108 - DNA, 20 bp, human
gggtaagccgcgaggaggaa

SEQ ID NO: 177109 - DNA, 20 bp, human
gcctggcactaggcggagag

SEQ ID NO: 177110 - DNA, 20 bp, human
ggaggcggtaagccgcgagg

SEQ ID NO: 177111 - DNA, 20 bp, human
ggagcagagagaagggtatg

SEQ ID NO: 177112 - DNA, 20 bp, human
gtgtgggtgctgcgaagggt

SEQ ID NO: 177113 - DNA, 20 bp, human
ggaggtcgcggagatggaat

SEQ ID NO: 177114 - DNA, 20 bp, human
gagagaggcggtaagccgcg

SEQ ID NO: 177115 - DNA, 20 bp, human
ggtcagggcttgaaccctgt

SEQ ID NO: 177116 - DNA, 20 bp, human
gtcttggtggtgacagacat

SEQ ID NO: 177117 - DNA, 20 bp, human
gcgtaggccttaggtctcag

SEQ ID NO: 177118 - DNA, 20 bp, human
gcaagtagctctgaagagga

SEQ ID NO: 177119 - DNA, 20 bp, human
gcaccccaggacctgcgctc

SEQ ID NO: 177120 - DNA, 20 bp, human
gtcacctgagcgcaggtcct

SEQ ID NO: 177121 - DNA, 20 bp, human
ggtgatcagagtccccgcca

SEQ ID NO: 177122 - DNA, 20 bp, human
gcgaaggacttggatcacat

SEQ ID NO: 177123 - DNA, 20 bp, human
gacaagtcatggtcctccct

SEQ ID NO: 177124 - DNA, 20 bp, human
gagacctaaggcctacgctg

SEQ ID NO: 177125 - DNA, 20 bp, human
ggtgggcggggcctcagcgt

SEQ ID NO: 177126 - DNA, 20 bp, human
gcagccatagggagccgcac

SEQ ID NO: 177127 - DNA, 20 bp, human
ggatggcggcccctaaccgg

SEQ ID NO: 177128 - DNA, 20 bp, human
gctcagagcgtcgggatatc

SEQ ID NO: 177129 - DNA, 20 bp, human
gagagcgtcgggatatcggg

SEQ ID NO: 177130 - DNA, 20 bp, human
gggatgaagggaggacacga

SEQ ID NO: 177131 - DNA, 20 bp, human
ggggctgagagcgacagtgg

SEQ ID NO: 177132 - DNA, 20 bp, human
gatcgggtggcggctcggga

SEQ ID NO: 177133 - DNA, 20 bp, human
gcgaggacccgaagtccccg

SEQ ID NO: 177134 - DNA, 20 bp, human
ggccagccccgcaggatgaa

SEQ ID NO: 177135 - DNA, 20 bp, human
ggacgcgctagtgtgagtgc

SEQ ID NO: 177136 - DNA, 20 bp, human
gtccctggccaggggaccta

SEQ ID NO: 177137 - DNA, 20 bp, human
ggtgaagatctccaggacca

SEQ ID NO: 177138 - DNA, 20 bp, human
gaggaaaatggccctggtcc

SEQ ID NO: 177139 - DNA, 20 bp, human
gttatggatgacacagactt

SEQ ID NO: 177140 - DNA, 20 bp, human
gctgccctgggccttcgaac

SEQ ID NO: 177141 - DNA, 20 bp, human
ggggtgtcggccaatatctt

SEQ ID NO: 177142 - DNA, 20 bp, human
ggcacctgttcgaaggccca

SEQ ID NO: 177143 - DNA, 20 bp, human
gcagactttggaatagctaa

SEQ ID NO: 177144 - DNA, 20 bp, human
gctaaggggataaaaaccca

SEQ ID NO: 177145 - DNA, 20 bp, human
gataaaagctccctggccag

SEQ ID NO: 177146 - DNA, 20 bp, human
gacccctcaggtgatctgaa

SEQ ID NO: 177147 - DNA, 20 bp, human
gcaggtgagtgatacccctc

SEQ ID NO: 177148 - DNA, 20 bp, human
gggcgggaactggctgagac

SEQ ID NO: 177149 - DNA, 20 bp, human
gctcaggtgatctgaaggga

SEQ ID NO: 177150 - DNA, 20 bp, human
ggcaatacccagatacctca

SEQ ID NO: 177151 - DNA, 20 bp, human
ggtgcacaaaggcactatgt

SEQ ID NO: 177152 - DNA, 20 bp, human
ggaggttccctgaggtatct

SEQ ID NO: 177153 - DNA, 20 bp, human
gtgcctaatgatgctggtga

SEQ ID NO: 177154 - DNA, 20 bp, human
gagccttcaccagcatcatt

SEQ ID NO: 177155 - DNA, 20 bp, human
gtcagggaacctcctctgga

SEQ ID NO: 177156 - DNA, 20 bp, human
gaaccgtggggtcttcccgg

SEQ ID NO: 177157 - DNA, 20 bp, human
ggcgtgttgggaggaaccgt

SEQ ID NO: 177158 - DNA, 20 bp, human
gagccgccgggaagacccca

SEQ ID NO: 177159 - DNA, 20 bp, human
gcgatgggccctgtacatat

SEQ ID NO: 177160 - DNA, 20 bp, human
gcctagtaccgtaaagagta

SEQ ID NO: 177161 - DNA, 20 bp, human
gggtgctctaggctggaggt

SEQ ID NO: 177162 - DNA, 20 bp, human
gagcacctccggccacagaa

SEQ ID NO: 177163 - DNA, 20 bp, human
gacgcactcaaggagtgaca

SEQ ID NO: 177164 - DNA, 20 bp, human
gatgtcggcggcgtgttggg

SEQ ID NO: 177165 - DNA, 20 bp, human
gatgtacagggcccatcgtg

SEQ ID NO: 177166 - DNA, 20 bp, human
gcactcgggcaccgcaggta

SEQ ID NO: 177167 - DNA, 20 bp, human
gggcgagctgtccagccgag

SEQ ID NO: 177168 - DNA, 20 bp, human
ggccgtgcgtgagaacacct

SEQ ID NO: 177169 - DNA, 20 bp, human
gtacgtacccagagcgaaca

SEQ ID NO: 177170 - DNA, 20 bp, human
ggcccgtaaaatggtcccct

SEQ ID NO: 177171 - DNA, 20 bp, human
gccgccgggcggaaatagga

SEQ ID NO: 177172 - DNA, 20 bp, human
ggcgagtagtctcaatgggt

SEQ ID NO: 177173 - DNA, 20 bp, human
gagactgggccgcctcggaa

SEQ ID NO: 177174 - DNA, 20 bp, human
ggtctacacgccagcgacgc

SEQ ID NO: 177175 - DNA, 20 bp, human
gcaatgggttggcgcctggg

SEQ ID NO: 177176 - DNA, 20 bp, human
gccgcgcctccggctcccag

SEQ ID NO: 177177 - DNA, 20 bp, human
gagggagcaagcgtccccgg

SEQ ID NO: 177178 - DNA, 20 bp, human
gtggcccagggcgcgaaggg

SEQ ID NO: 177179 - DNA, 20 bp, human
gagatggcccagggcgcgaa

SEQ ID NO: 177180 - DNA, 20 bp, human
gcgtccccggcggcaaaggg

SEQ ID NO: 177181 - DNA, 20 bp, human
ggcgacgctgccccgcgagg

SEQ ID NO: 177182 - DNA, 20 bp, human
gccgggtcggcgactcccga

SEQ ID NO: 177183 - DNA, 20 bp, human
gcggagcagccagacagcga

SEQ ID NO: 177184 - DNA, 20 bp, human
ggcctgagggacgccgtgta

SEQ ID NO: 177185 - DNA, 20 bp, human
gtgtctggctgctccgcgga

SEQ ID NO: 177186 - DNA, 20 bp, human
gcggggaccgggaaagtaga

SEQ ID NO: 177187 - DNA, 20 bp, human
gtagagggcacgggaaagtc

SEQ ID NO: 177188 - DNA, 20 bp, human
gcactcacccaggtcctcca

SEQ ID NO: 177189 - DNA, 20 bp, human
ggccccgccatggaggacct

SEQ ID NO: 177190 - DNA, 20 bp, human
gcggtggcgcggggcgaaca

SEQ ID NO: 177191 - DNA, 20 bp, human
ggatccggccccactcaccc

SEQ ID NO: 177192 - DNA, 20 bp, human
gccgggaaagtagagggcac

SEQ ID NO: 177193 - DNA, 20 bp, human
ggcccggccgtgaccatgta

SEQ ID NO: 177194 - DNA, 20 bp, human
gcatctgccgcagcctggga

SEQ ID NO: 177195 - DNA, 20 bp, human
ggtgaggggccacggacccg

SEQ ID NO: 177196 - DNA, 20 bp, human
gcaccccctgcggatcacaa

SEQ ID NO: 177197 - DNA, 20 bp, human
gcccagccagggtgtcgcaa

SEQ ID NO: 177198 - DNA, 20 bp, human
gctgcccggctgcagacagg

SEQ ID NO: 177199 - DNA, 20 bp, human
gctctcagcgccgcagtgga

SEQ ID NO: 177200 - DNA, 20 bp, human
ggcagaaggttcgctccgag

SEQ ID NO: 177201 - DNA, 20 bp, human
gctgccgttgtgatccgcag

SEQ ID NO: 177202 - DNA, 20 bp, human
gcggttgcgttcaccccctg

SEQ ID NO: 177203 - DNA, 20 bp, human
gttgctcgcttagggtaggt

SEQ ID NO: 177204 - DNA, 20 bp, human
gcgcgacggctgatcgtctg

SEQ ID NO: 177205 - DNA, 20 bp, human
gtgatcgtctgtggctgggt

SEQ ID NO: 177206 - DNA, 20 bp, human
gctggcccagctaaaggtgg

SEQ ID NO: 177207 - DNA, 20 bp, human
gcccagccaatgaagacgag

SEQ ID NO: 177208 - DNA, 20 bp, human
gagatcaccagtgagtaggt

SEQ ID NO: 177209 - DNA, 20 bp, human
gcagttgctggcccagctaa

SEQ ID NO: 177210 - DNA, 20 bp, human
gagcagagagtcaagtccaa

SEQ ID NO: 177211 - DNA, 20 bp, human
ggagcaggcgtgccgtgaac

SEQ ID NO: 177212 - DNA, 20 bp, human
gcaggacacacttgtctctc

SEQ ID NO: 177213 - DNA, 20 bp, human
gttgctggcccagctaaagg

SEQ ID NO: 177214 - DNA, 20 bp, human
ggtcatttagaaagcccccg

SEQ ID NO: 177215 - DNA, 20 bp, human
gctaaaggtgggggcagtac

SEQ ID NO: 177216 - DNA, 20 bp, human
ggagcgagctagcgaccgac

SEQ ID NO: 177217 - DNA, 20 bp, human
gcacgaagagcgccatggag

SEQ ID NO: 177218 - DNA, 20 bp, human
gaccatggagggaaagcggg

SEQ ID NO: 177219 - DNA, 20 bp, human
gtagcgaccgacgggcaagc

SEQ ID NO: 177220 - DNA, 20 bp, human
ggcggaaggtcaggtagtcg

SEQ ID NO: 177221 - DNA, 20 bp, human
gaggccgccgctttgtagaa

SEQ ID NO: 177222 - DNA, 20 bp, human
gagccgagccgcctggccag

SEQ ID NO: 177223 - DNA, 20 bp, human
gtcggagcgcaagccgctgg

SEQ ID NO: 177224 - DNA, 20 bp, human
gcgctttgtagaagggagtg

SEQ ID NO: 177225 - DNA, 20 bp, human
gaggaccatggagggaaagc

SEQ ID NO: 177226 - DNA, 20 bp, human
gtccgtgtacagctgagtgg

SEQ ID NO: 177227 - DNA, 20 bp, human
gaggacagggtgtcagttag

SEQ ID NO: 177228 - DNA, 20 bp, human
gagctgaggcctgagatgga

SEQ ID NO: 177229 - DNA, 20 bp, human
gacgagaccctgggagtcgt

SEQ ID NO: 177230 - DNA, 20 bp, human
gctgcccagtagggaacggg

SEQ ID NO: 177231 - DNA, 20 bp, human
ggactcccagggtctcgtaa

SEQ ID NO: 177232 - DNA, 20 bp, human
ggagtccagcacttcctagg

SEQ ID NO: 177233 - DNA, 20 bp, human
gagggagtccagcacttcct

SEQ ID NO: 177234 - DNA, 20 bp, human
ggtggatccaacgactccca

SEQ ID NO: 177235 - DNA, 20 bp, human
ggtgtacagctgagtggtgg

SEQ ID NO: 177236 - DNA, 20 bp, human
gggtggcggcgggaccatgg

SEQ ID NO: 177237 - DNA, 20 bp, human
gggcgaggcgaggtttgctg

SEQ ID NO: 177238 - DNA, 20 bp, human
gcggagtcgtccgaggtccg

SEQ ID NO: 177239 - DNA, 20 bp, human
gtccccggggaggtggagtc

SEQ ID NO: 177240 - DNA, 20 bp, human
gcgctcgggactccccgggg

SEQ ID NO: 177241 - DNA, 20 bp, human
gagtgggcgagggccagggg

SEQ ID NO: 177242 - DNA, 20 bp, human
gaagagcaggagcgagccag

SEQ ID NO: 177243 - DNA, 20 bp, human
gagtcgggcggagtcgtccg

SEQ ID NO: 177244 - DNA, 20 bp, human
gggacgtgtccggctgcccg

SEQ ID NO: 177245 - DNA, 20 bp, human
gaaccgcaagcggggagcgg

SEQ ID NO: 177246 - DNA, 20 bp, human
ggcccgactgtcaagcgcag

SEQ ID NO: 177247 - DNA, 20 bp, human
gactgtcaagcgcagcggag

SEQ ID NO: 177248 - DNA, 20 bp, human
ggcgtgcacccgctcgggac

SEQ ID NO: 177249 - DNA, 20 bp, human
ggggaagctgcacaggagtc

SEQ ID NO: 177250 - DNA, 20 bp, human
ggtccggctcctgtcccgag

SEQ ID NO: 177251 - DNA, 20 bp, human
gcggccgagggaagctgcac

SEQ ID NO: 177252 - DNA, 20 bp, human
gtccacaggacgatgtgcag

SEQ ID NO: 177253 - DNA, 20 bp, human
gacccgctcgggacaggagc

SEQ ID NO: 177254 - DNA, 20 bp, human
gcaccgcacgttcagaagtc

SEQ ID NO: 177255 - DNA, 20 bp, human
gcaagcgcagcggagaggcg

SEQ ID NO: 177256 - DNA, 20 bp, human
gcttcccagcgagtgaagga

SEQ ID NO: 177257 - DNA, 20 bp, human
gagtgaaggagggcagtcgg

SEQ ID NO: 177258 - DNA, 20 bp, human
gcagcactgcgcatcgccgg

SEQ ID NO: 177259 - DNA, 20 bp, human
gccggtggccagcggtgcgt

SEQ ID NO: 177260 - DNA, 20 bp, human
ggccaccggtgcctgctccc

SEQ ID NO: 177261 - DNA, 20 bp, human
gccaaggccggaggtcctgg

SEQ ID NO: 177262 - DNA, 20 bp, human
gtcggaggcggtgtgtccag

SEQ ID NO: 177263 - DNA, 20 bp, human
gcgcgcagggaaagtggccg

SEQ ID NO: 177264 - DNA, 20 bp, human
gctggccggtaagtaggcac

SEQ ID NO: 177265 - DNA, 20 bp, human
gagcaggcaccggtggccag

SEQ ID NO: 177266 - DNA, 20 bp, human
gagggcttcgccagcttcgg

SEQ ID NO: 177267 - DNA, 20 bp, human
gtgtcggccgggacctcgag

SEQ ID NO: 177268 - DNA, 20 bp, human
ggcttcggaggcttctctag

SEQ ID NO: 177269 - DNA, 20 bp, human
gtgggctgtgcgagtcccag

SEQ ID NO: 177270 - DNA, 20 bp, human
gctgaagctgtccgacacag

SEQ ID NO: 177271 - DNA, 20 bp, human
gggacaccaggggcggatgg

SEQ ID NO: 177272 - DNA, 20 bp, human
gaagctggcgaagccctccc

SEQ ID NO: 177273 - DNA, 20 bp, human
gggggacggaggcgccatca

SEQ ID NO: 177274 - DNA, 20 bp, human
gcgtgcaggtggggaccccg

SEQ ID NO: 177275 - DNA, 20 bp, human
gtccgcccctggtgtccccg

SEQ ID NO: 177276 - DNA, 20 bp, human
gtgcgctggggcaggtgtag

SEQ ID NO: 177277 - DNA, 20 bp, human
gcgccccacgtgacgggaag

SEQ ID NO: 177278 - DNA, 20 bp, human
gcaagtggctatacacttgg

SEQ ID NO: 177279 - DNA, 20 bp, human
gtccctgaagctccccgcag

SEQ ID NO: 177280 - DNA, 20 bp, human
gccccggaaaacccaaatca

SEQ ID NO: 177281 - DNA, 20 bp, human
ggccgctgcggggagcttca

SEQ ID NO: 177282 - DNA, 20 bp, human
gggcggccgccccacgtgac

SEQ ID NO: 177283 - DNA, 20 bp, human
gatgaagtgtgcacgggtgt

SEQ ID NO: 177284 - DNA, 20 bp, human
ggtgcaccggggccacgaca

SEQ ID NO: 177285 - DNA, 20 bp, human
gcgccgcttcccgtcacgtg

SEQ ID NO: 177286 - DNA, 20 bp, human
ggagcaggagcagggaacaa

SEQ ID NO: 177287 - DNA, 20 bp, human
ggcagggccagtagagttcg

SEQ ID NO: 177288 - DNA, 20 bp, human
gagggaacaaaggagcggag

SEQ ID NO: 177289 - DNA, 20 bp, human
gggtgcgccgagcaggagca

SEQ ID NO: 177290 - DNA, 20 bp, human
gcagcatgagagcccctggg

SEQ ID NO: 177291 - DNA, 20 bp, human
gggcgctgtcagagtgagag

SEQ ID NO: 177292 - DNA, 20 bp, human
gctccagcatgagagcccct

SEQ ID NO: 177293 - DNA, 20 bp, human
gacaaaggagcggagagggg

SEQ ID NO: 177294 - DNA, 20 bp, human
ggccaggagcggggacacag

SEQ ID NO: 177295 - DNA, 20 bp, human
gcagaggcggctgtctcgtg

SEQ ID NO: 177296 - DNA, 20 bp, human
gtccctgtcggagagatcgg

SEQ ID NO: 177297 - DNA, 20 bp, human
gccgcgcgctcactcaggtc

SEQ ID NO: 177298 - DNA, 20 bp, human
ggaagctgggccccccacca

SEQ ID NO: 177299 - DNA, 20 bp, human
gacctgcccggcctgacact

SEQ ID NO: 177300 - DNA, 20 bp, human
ggagtgtcgggaccagctag

SEQ ID NO: 177301 - DNA, 20 bp, human
ggcaggatcggccctctcct

SEQ ID NO: 177302 - DNA, 20 bp, human
gagctgtcaggccgagtgtc

SEQ ID NO: 177303 - DNA, 20 bp, human
gcactcggcctgacagctcg

SEQ ID NO: 177304 - DNA, 20 bp, human
ggagagggccgatcctgcac

SEQ ID NO: 177305 - DNA, 20 bp, human
gtaggatcccaccccaggag

SEQ ID NO: 177306 - DNA, 20 bp, human
ggagtgtcgggaccagctag

SEQ ID NO: 177307 - DNA, 20 bp, human
gtccctgtcggagagatcgg

SEQ ID NO: 177308 - DNA, 20 bp, human
gtggctgcaggtggcgtcgt

SEQ ID NO: 177309 - DNA, 20 bp, human
ggtcgtgggagtctgtagga

SEQ ID NO: 177310 - DNA, 20 bp, human
gagtctgtaggagggtgtac

SEQ ID NO: 177311 - DNA, 20 bp, human
gctccgaactgggcccggag

SEQ ID NO: 177312 - DNA, 20 bp, human
gttggttcccacccctactc

SEQ ID NO: 177313 - DNA, 20 bp, human
gctggtcccgacactccccc

SEQ ID NO: 177314 - DNA, 20 bp, human
ggggtcggcgaggaatcgtc

SEQ ID NO: 177315 - DNA, 20 bp, human
ggtgggcgggtacagaagtt

SEQ ID NO: 177316 - DNA, 20 bp, human
gtcagccgggccgtccgcag

SEQ ID NO: 177317 - DNA, 20 bp, human
ggcggcctccatattccaag

SEQ ID NO: 177318 - DNA, 20 bp, human
gcgataagcctcttggaata

SEQ ID NO: 177319 - DNA, 20 bp, human
gatatggaggccgctgcgga

SEQ ID NO: 177320 - DNA, 20 bp, human
ggagccactttagaaagcat

SEQ ID NO: 177321 - DNA, 20 bp, human
ggcatgggcaggtctgtaag

SEQ ID NO: 177322 - DNA, 20 bp, human
gcagtcgcggaggatcttaa

SEQ ID NO: 177323 - DNA, 20 bp, human
gcgactggatgtataagcat

SEQ ID NO: 177324 - DNA, 20 bp, human
gttgcttctcttcttctgaa

SEQ ID NO: 177325 - DNA, 20 bp, human
gccggctgagacccaaagcc

SEQ ID NO: 177326 - DNA, 20 bp, human
gtcagccgggccgtctgcag

SEQ ID NO: 177327 - DNA, 20 bp, human
ggcggcctccatattcaaag

SEQ ID NO: 177328 - DNA, 20 bp, human
gatatggaggccgctgcaga

SEQ ID NO: 177329 - DNA, 20 bp, human
gcgataagcctctttgaata

SEQ ID NO: 177330 - DNA, 20 bp, human
ggagccactttagaaagcat

SEQ ID NO: 177331 - DNA, 20 bp, human
ggcatgggcaggtctgtaag

SEQ ID NO: 177332 - DNA, 20 bp, human
gactgagttaggacaaaggt

SEQ ID NO: 177333 - DNA, 20 bp, human
gcagtcgcggaggatcttaa

SEQ ID NO: 177334 - DNA, 20 bp, human
gcgactggatgtataagcat

SEQ ID NO: 177335 - DNA, 20 bp, human
gccggctgagacccaaagcc

SEQ ID NO: 177336 - DNA, 20 bp, human
gaccgcagtactgagtcctg

SEQ ID NO: 177337 - DNA, 20 bp, human
gcctgcggcatccagtctgt

SEQ ID NO: 177338 - DNA, 20 bp, human
ggccccaggactcagtactg

SEQ ID NO: 177339 - DNA, 20 bp, human
gtcggcaccacagtacccgt

SEQ ID NO: 177340 - DNA, 20 bp, human
gggctgagatggaacaggtc

SEQ ID NO: 177341 - DNA, 20 bp, human
gtggaacaggtcaggatgga

SEQ ID NO: 177342 - DNA, 20 bp, human
gagactgcagagctagcagg

SEQ ID NO: 177343 - DNA, 20 bp, human
gaggtcaggatggatgggac

SEQ ID NO: 177344 - DNA, 20 bp, human
gtgctagctctgcagtctag

SEQ ID NO: 177345 - DNA, 20 bp, human
ggctagcaggtggacggacc

SEQ ID NO: 177346 - DNA, 20 bp, human
gctccaagtgcgaccactgg

SEQ ID NO: 177347 - DNA, 20 bp, human
gaccctccaagtgcgaccac

SEQ ID NO: 177348 - DNA, 20 bp, human
ggcactgccgaggcggagag

SEQ ID NO: 177349 - DNA, 20 bp, human
gcggcagtgccagccgccag

SEQ ID NO: 177350 - DNA, 20 bp, human
ggggtctcgccgccagtgga

SEQ ID NO: 177351 - DNA, 20 bp, human
ggtcctcagtcagtcagtgg

SEQ ID NO: 177352 - DNA, 20 bp, human
gtactgtcctggcggaccac

SEQ ID NO: 177353 - DNA, 20 bp, human
gtggagggtctcgccgccag

SEQ ID NO: 177354 - DNA, 20 bp, human
gcgtgtcctcagtcagtcag

SEQ ID NO: 177355 - DNA, 20 bp, human
ggcctggcctcagaacactt

SEQ ID NO: 177356 - DNA, 20 bp, human
gggcagaggaaggcgaaaca

SEQ ID NO: 177357 - DNA, 20 bp, human
ggccaaagcagacaggactc

SEQ ID NO: 177358 - DNA, 20 bp, human
ggaggaaggcgaaacatggc

SEQ ID NO: 177359 - DNA, 20 bp, human
gagaggcggctctttctcag

SEQ ID NO: 177360 - DNA, 20 bp, human
gacggacagtgctgacagac

SEQ ID NO: 177361 - DNA, 20 bp, human
ggcacatctcagaactacca

SEQ ID NO: 177362 - DNA, 20 bp, human
gattttagggtgctagccag

SEQ ID NO: 177363 - DNA, 20 bp, human
gctggccttcagagccccca

SEQ ID NO: 177364 - DNA, 20 bp, human
gctggacatcgcatctcctt

SEQ ID NO: 177365 - DNA, 20 bp, human
gtctgctttggctttacggg

SEQ ID NO: 177366 - DNA, 20 bp, human
gccacacagtcggtcctcag

SEQ ID NO: 177367 - DNA, 20 bp, human
gttgcaggagagaatctgaa

SEQ ID NO: 177368 - DNA, 20 bp, human
gtcagagatagagtcttccc

SEQ ID NO: 177369 - DNA, 20 bp, human
gccgactgtgtggaagcacc

SEQ ID NO: 177370 - DNA, 20 bp, human
ggcaccagggccacaagtca

SEQ ID NO: 177371 - DNA, 20 bp, human
gcacagtcggtcctcagggg

SEQ ID NO: 177372 - DNA, 20 bp, human
gtagggccagctggctgaag

SEQ ID NO: 177373 - DNA, 20 bp, human
ggagtcttccctggcattgc

SEQ ID NO: 177374 - DNA, 20 bp, human
gatctgtccactgatcgaga

SEQ ID NO: 177375 - DNA, 20 bp, human
gcagaaagcaagcagcacca

SEQ ID NO: 177376 - DNA, 20 bp, human
gagaggcaggtgggactcac

SEQ ID NO: 177377 - DNA, 20 bp, human
gggcaggtgggactcaccgg

SEQ ID NO: 177378 - DNA, 20 bp, human
gccctgggaggctttctgag

SEQ ID NO: 177379 - DNA, 20 bp, human
gtgggaacctttgtcaacac

SEQ ID NO: 177380 - DNA, 20 bp, human
gccactgaggttgttctcag

SEQ ID NO: 177381 - DNA, 20 bp, human
gctcagtgggaatagcagga

SEQ ID NO: 177382 - DNA, 20 bp, human
gcagaaccctgggccatgta

SEQ ID NO: 177383 - DNA, 20 bp, human
gtgtcaacactggcaaggaa

SEQ ID NO: 177384 - DNA, 20 bp, human
ggagcgaagccagggtgagt

SEQ ID NO: 177385 - DNA, 20 bp, human
gagcgaccggatctgcccaa

SEQ ID NO: 177386 - DNA, 20 bp, human
gcacgccagggacctcacca

SEQ ID NO: 177387 - DNA, 20 bp, human
ggtctgtggctgggtcagtc

SEQ ID NO: 177388 - DNA, 20 bp, human
gcactctgctgacgtagacg

SEQ ID NO: 177389 - DNA, 20 bp, human
ggtaagctccagctttgcag

SEQ ID NO: 177390 - DNA, 20 bp, human
ggagactgacgccagaatgt

SEQ ID NO: 177391 - DNA, 20 bp, human
gacatgggtaaggggtagat

SEQ ID NO: 177392 - DNA, 20 bp, human
ggcagggggcaactgtgagt

SEQ ID NO: 177393 - DNA, 20 bp, human
gagtggtgtgtgccatggtg

SEQ ID NO: 177394 - DNA, 20 bp, human
gtccctccccgggcacgcca

SEQ ID NO: 177395 - DNA, 20 bp, human
ggggtgaaagagggaccctc

SEQ ID NO: 177396 - DNA, 20 bp, human
gggagcatcccaggaaccgg

SEQ ID NO: 177397 - DNA, 20 bp, human
ggaaggggaagtagacactc

SEQ ID NO: 177398 - DNA, 20 bp, human
gtccccacagaacagctggg

SEQ ID NO: 177399 - DNA, 20 bp, human
ggaaccaggagacagcgtag

SEQ ID NO: 177400 - DNA, 20 bp, human
gaccgcccagctgttctgtg

SEQ ID NO: 177401 - DNA, 20 bp, human
gcaagggggttggaaactag

SEQ ID NO: 177402 - DNA, 20 bp, human
ggctaccatggcccaaggta

SEQ ID NO: 177403 - DNA, 20 bp, human
gaggcagctaccatggccca

SEQ ID NO: 177404 - DNA, 20 bp, human
gtccatagccaggtgggaca

SEQ ID NO: 177405 - DNA, 20 bp, human
gtgcctgaaaaaggagggat

SEQ ID NO: 177406 - DNA, 20 bp, human
ggtgcaccgtcaggacagtg

SEQ ID NO: 177407 - DNA, 20 bp, human
gagtccagctggccttcaca

SEQ ID NO: 177408 - DNA, 20 bp, human
gtgcctcggaggactgaagg

SEQ ID NO: 177409 - DNA, 20 bp, human
ggacgtttctgggcatagtt

SEQ ID NO: 177410 - DNA, 20 bp, human
gtgggaattgtggcctgcgt

SEQ ID NO: 177411 - DNA, 20 bp, human
gctgtgcctcggaggactga

SEQ ID NO: 177412 - DNA, 20 bp, human
gggacaccagggctcatgag

SEQ ID NO: 177413 - DNA, 20 bp, human
ggcaccccatgcacattcca

SEQ ID NO: 177414 - DNA, 20 bp, human
gcagcagtgtgtgcaccgtc

SEQ ID NO: 177415 - DNA, 20 bp, human
gctatgcccagaaacgtctc

SEQ ID NO: 177416 - DNA, 20 bp, human
gagcaccacacgcaggagat

SEQ ID NO: 177417 - DNA, 20 bp, human
ggcaggagatgggcgtcaag

SEQ ID NO: 177418 - DNA, 20 bp, human
gcggccagcccttctacctc

SEQ ID NO: 177419 - DNA, 20 bp, human
gccaggacaagactttcagg

SEQ ID NO: 177420 - DNA, 20 bp, human
gtgggacagggcaaactcac

SEQ ID NO: 177421 - DNA, 20 bp, human
ggacgcccatctcctgcgtg

SEQ ID NO: 177422 - DNA, 20 bp, human
ggccgcaaggttgccactag

SEQ ID NO: 177423 - DNA, 20 bp, human
gaacaaggagcaccacacgc

SEQ ID NO: 177424 - DNA, 20 bp, human
gtgtcgacctgcagagctcc

SEQ ID NO: 177425 - DNA, 20 bp, human
gacagggtcctgagcatgag

SEQ ID NO: 177426 - DNA, 20 bp, human
gcaggggagaagctggacaa

SEQ ID NO: 177427 - DNA, 20 bp, human
gtggacaagggagaggtcta

SEQ ID NO: 177428 - DNA, 20 bp, human
ggagaggtctagggtctgag

SEQ ID NO: 177429 - DNA, 20 bp, human
gtgacttagcacctccgaaa

SEQ ID NO: 177430 - DNA, 20 bp, human
gggccttgaccgacaggaga

SEQ ID NO: 177431 - DNA, 20 bp, human
gggaggtgctaagtcaagag

SEQ ID NO: 177432 - DNA, 20 bp, human
ggatggatcagggtgagtac

SEQ ID NO: 177433 - DNA, 20 bp, human
gggagagggtagaggatgta

SEQ ID NO: 177434 - DNA, 20 bp, human
gggggcagcaactctcagtg

SEQ ID NO: 177435 - DNA, 20 bp, human
gttgaagggccttgaccgac

SEQ ID NO: 177436 - DNA, 20 bp, human
ggagacgcgcgcagcagggg

SEQ ID NO: 177437 - DNA, 20 bp, human
ggtcctcctgaacgtcgcag

SEQ ID NO: 177438 - DNA, 20 bp, human
ggcgacgttcaggaggacca

SEQ ID NO: 177439 - DNA, 20 bp, human
ggcgctatccgagcaggatg

SEQ ID NO: 177440 - DNA, 20 bp, human
gtcgcgagagcattagaggg

SEQ ID NO: 177441 - DNA, 20 bp, human
gcgccgctgcgacgttcagg

SEQ ID NO: 177442 - DNA, 20 bp, human
ggcaagagtgggatgcggga

SEQ ID NO: 177443 - DNA, 20 bp, human
gctccgcactcgacttgcta

SEQ ID NO: 177444 - DNA, 20 bp, human
gcctgcccaggtgagaatgg

SEQ ID NO: 177445 - DNA, 20 bp, human
ggcggaagcgctatccgagc

SEQ ID NO: 177446 - DNA, 20 bp, human
gcgcccgcaagccctggatg

SEQ ID NO: 177447 - DNA, 20 bp, human
gtggatgaggagatagaaac

SEQ ID NO: 177448 - DNA, 20 bp, human
gcagcgtccgggctagttcc

SEQ ID NO: 177449 - DNA, 20 bp, human
gggagatagaaactggcccg

SEQ ID NO: 177450 - DNA, 20 bp, human
ggccagaacatctgaccctt

SEQ ID NO: 177451 - DNA, 20 bp, human
gacttccggcggcagcgtcc

SEQ ID NO: 177452 - DNA, 20 bp, human
gaccctcagacatgacggag

SEQ ID NO: 177453 - DNA, 20 bp, human
ggaccactccgtcatgtctg

SEQ ID NO: 177454 - DNA, 20 bp, human
gctcgcgccgggaactagcc

SEQ ID NO: 177455 - DNA, 20 bp, human
gtaagtctccagtaaccgag

SEQ ID NO: 177456 - DNA, 20 bp, human
gccaccacgccacaggccaa

SEQ ID NO: 177457 - DNA, 20 bp, human
gcagctcagacacggccctg

SEQ ID NO: 177458 - DNA, 20 bp, human
gagagaggtcggcctaagag

SEQ ID NO: 177459 - DNA, 20 bp, human
gccaggctggggagtagcag

SEQ ID NO: 177460 - DNA, 20 bp, human
gcaggccaagggcttccgca

SEQ ID NO: 177461 - DNA, 20 bp, human
gacggccctgcggaagccct

SEQ ID NO: 177462 - DNA, 20 bp, human
gcacgacccccgagagaggt

SEQ ID NO: 177463 - DNA, 20 bp, human
gcatccacgccgcgtcccag

SEQ ID NO: 177464 - DNA, 20 bp, human
gggacgcggcgtggatgtgg

SEQ ID NO: 177465 - DNA, 20 bp, human
gcccacacgacccccgagag

SEQ ID NO: 177466 - DNA, 20 bp, human
gggccccttgcagagcgcac

SEQ ID NO: 177467 - DNA, 20 bp, human
gtggcagcacaggccgtggg

SEQ ID NO: 177468 - DNA, 20 bp, human
gaagcccgtgcgctctgcaa

SEQ ID NO: 177469 - DNA, 20 bp, human
gtcccgggcggacagcaggc

SEQ ID NO: 177470 - DNA, 20 bp, human
ggggagccggggtcacccag

SEQ ID NO: 177471 - DNA, 20 bp, human
gaggtgcggtcggccagcat

SEQ ID NO: 177472 - DNA, 20 bp, human
gctcccgggccccgccaagg

SEQ ID NO: 177473 - DNA, 20 bp, human
gggcagcagtccctgcgcgt

SEQ ID NO: 177474 - DNA, 20 bp, human
gggtcgcgcggcatagggcg

SEQ ID NO: 177475 - DNA, 20 bp, human
gctgggtgcactggaacacg

SEQ ID NO: 177476 - DNA, 20 bp, human
gcaggcgcctggtccagtcc

SEQ ID NO: 177477 - DNA, 20 bp, human
ggcctcggagacgccgtaga

SEQ ID NO: 177478 - DNA, 20 bp, human
ggcagtaagtgggacctagg

SEQ ID NO: 177479 - DNA, 20 bp, human
gggcgtctgagaagagtcgc

SEQ ID NO: 177480 - DNA, 20 bp, human
gctgcttccgggactggacc

SEQ ID NO: 177481 - DNA, 20 bp, human
gtagaaggagacctgcttcc

SEQ ID NO: 177482 - DNA, 20 bp, human
gcgaatcctggcgataccaa

SEQ ID NO: 177483 - DNA, 20 bp, human
gtggagtcgaggaatgacag

SEQ ID NO: 177484 - DNA, 20 bp, human
gccggtcgctaaggtctcca

SEQ ID NO: 177485 - DNA, 20 bp, human
gtggaccgcgctgcgagcct

SEQ ID NO: 177486 - DNA, 20 bp, human
gtgcagtcctgctccgccta

SEQ ID NO: 177487 - DNA, 20 bp, human
gaagtgaagtgcctgaggac

SEQ ID NO: 177488 - DNA, 20 bp, human
gatcgggcggcggttcccag

SEQ ID NO: 177489 - DNA, 20 bp, human
gccgagaacgcgcgatcggg

SEQ ID NO: 177490 - DNA, 20 bp, human
gcggtgggaaacgcccgaca

SEQ ID NO: 177491 - DNA, 20 bp, human
ggcgccgagaacgcgcgatc

SEQ ID NO: 177492 - DNA, 20 bp, human
ggcacccctcgcgagaggtg

SEQ ID NO: 177493 - DNA, 20 bp, human
gctgccgccgcagaaggcag

SEQ ID NO: 177494 - DNA, 20 bp, human
gccgtctcccatctccaaga

SEQ ID NO: 177495 - DNA, 20 bp, human
gtgcctgaggaccggaagga

SEQ ID NO: 177496 - DNA, 20 bp, human
gccgccccggcacctaagag

SEQ ID NO: 177497 - DNA, 20 bp, human
ggacccggagtggacaggtg

SEQ ID NO: 177498 - DNA, 20 bp, human
gcttccggtgaccagaggta

SEQ ID NO: 177499 - DNA, 20 bp, human
gctgcaccgggtgcccgccc

SEQ ID NO: 177500 - DNA, 20 bp, human
gcgccacttccggtgaccag

SEQ ID NO: 177501 - DNA, 20 bp, human
gatcccgacccggagtggac

SEQ ID NO: 177502 - DNA, 20 bp, human
gctgcgaggagcgtgcccaa

SEQ ID NO: 177503 - DNA, 20 bp, human
gctcctcacctgtccactcc

SEQ ID NO: 177504 - DNA, 20 bp, human
ggacacgcgaggagagctcc

SEQ ID NO: 177505 - DNA, 20 bp, human
gtctggggcccccaatggga

SEQ ID NO: 177506 - DNA, 20 bp, human
gcccgcctgcgctcgggagt

SEQ ID NO: 177507 - DNA, 20 bp, human
gcggtccttcgcggcgtccc

SEQ ID NO: 177508 - DNA, 20 bp, human
gcgcgcagcgggaagatggt

SEQ ID NO: 177509 - DNA, 20 bp, human
gggcggccgcaagacctaca

SEQ ID NO: 177510 - DNA, 20 bp, human
gtggcctgtggtgggctgga

SEQ ID NO: 177511 - DNA, 20 bp, human
gctgtctacagtggcctgaa

SEQ ID NO: 177512 - DNA, 20 bp, human
gtggctgcccgcctgcgctc

SEQ ID NO: 177513 - DNA, 20 bp, human
gccggcaggaagcgtattct

SEQ ID NO: 177514 - DNA, 20 bp, human
ggcctgactgctgtctacag

SEQ ID NO: 177515 - DNA, 20 bp, human
gtgtcgcgtgccggcgtcag

SEQ ID NO: 177516 - DNA, 20 bp, human
gcggggtgcagacctcctct

SEQ ID NO: 177517 - DNA, 20 bp, human
gtgagcgaggaggcaagccg

SEQ ID NO: 177518 - DNA, 20 bp, human
gtaacagccagatacggagt

SEQ ID NO: 177519 - DNA, 20 bp, human
gctgctcctcctcccagagg

SEQ ID NO: 177520 - DNA, 20 bp, human
gcgggctgttaccctatccg

SEQ ID NO: 177521 - DNA, 20 bp, human
gtgggagtcgctggagtcgg

SEQ ID NO: 177522 - DNA, 20 bp, human
gcgccccgggccgagtgagg

SEQ ID NO: 177523 - DNA, 20 bp, human
gtaaggatacagctcttccg

SEQ ID NO: 177524 - DNA, 20 bp, human
gcgataataacagccagata

SEQ ID NO: 177525 - DNA, 20 bp, human
gcccggggcggtggatctgg

SEQ ID NO: 177526 - DNA, 20 bp, human
gggcagaggctggacaatcg

SEQ ID NO: 177527 - DNA, 20 bp, human
gtcaaggcccggtctaacag

SEQ ID NO: 177528 - DNA, 20 bp, human
ggactaagctctcacgatta

SEQ ID NO: 177529 - DNA, 20 bp, human
ggcgcctcagtagagaccta

SEQ ID NO: 177530 - DNA, 20 bp, human
gccgaaagcagagaacaatt

SEQ ID NO: 177531 - DNA, 20 bp, human
gttagtcgtgagagcggagt

SEQ ID NO: 177532 - DNA, 20 bp, human
ggagagcggagtgggaagaa

SEQ ID NO: 177533 - DNA, 20 bp, human
ggagagcttagtcgtgagag

SEQ ID NO: 177534 - DNA, 20 bp, human
gtccctgcccaggttacctg

SEQ ID NO: 177535 - DNA, 20 bp, human
gcgcccttaggtctctactg

SEQ ID NO: 177536 - DNA, 20 bp, human
gcgccgcgcgcggtcctgaa

SEQ ID NO: 177537 - DNA, 20 bp, human
ggcgggggctgcagcgacca

SEQ ID NO: 177538 - DNA, 20 bp, human
gtgaagggagcccggcacct

SEQ ID NO: 177539 - DNA, 20 bp, human
gaggacgcatagccactcac

SEQ ID NO: 177540 - DNA, 20 bp, human
ggaagcagctcaccttccac

SEQ ID NO: 177541 - DNA, 20 bp, human
gcggcatctcgagccaggcc

SEQ ID NO: 177542 - DNA, 20 bp, human
gtggctgcccccaacaaaga

SEQ ID NO: 177543 - DNA, 20 bp, human
gggtccccgcctcttaccgg

SEQ ID NO: 177544 - DNA, 20 bp, human
gactgccaggacgcccctgg

SEQ ID NO: 177545 - DNA, 20 bp, human
gccgggtccccgcctcttac

SEQ ID NO: 177546 - DNA, 20 bp, human
ggcgcccggcccagagacgg

SEQ ID NO: 177547 - DNA, 20 bp, human
ggaggcgcccggcccagaga

SEQ ID NO: 177548 - DNA, 20 bp, human
ggcgccgtacggcaagatgg

SEQ ID NO: 177549 - DNA, 20 bp, human
gcgcgcagggcggacccagg

SEQ ID NO: 177550 - DNA, 20 bp, human
ggcgacacggctcgggacgt

SEQ ID NO: 177551 - DNA, 20 bp, human
ggcgtacctgtggaaggaga

SEQ ID NO: 177552 - DNA, 20 bp, human
gggccgtgaactgctccaac

SEQ ID NO: 177553 - DNA, 20 bp, human
gtcgcgcgcagggcggaccc

SEQ ID NO: 177554 - DNA, 20 bp, human
gcgcggcggcgacacggctc

SEQ ID NO: 177555 - DNA, 20 bp, human
ggccctgcgcgcgatcgatc

SEQ ID NO: 177556 - DNA, 20 bp, human
gaatgctagcgcaggcgcag

SEQ ID NO: 177557 - DNA, 20 bp, human
gctgtggcgcatcctcagtg

SEQ ID NO: 177558 - DNA, 20 bp, human
gagtgagtcgacagacgagg

SEQ ID NO: 177559 - DNA, 20 bp, human
gctcgagaggcctggacctg

SEQ ID NO: 177560 - DNA, 20 bp, human
gccgcggcaagacggaggga

SEQ ID NO: 177561 - DNA, 20 bp, human
ggaggatgcgccacaggtcc

SEQ ID NO: 177562 - DNA, 20 bp, human
gtcgcccgcggcaagacgga

SEQ ID NO: 177563 - DNA, 20 bp, human
gcccgcgaggtaggtcgcat

SEQ ID NO: 177564 - DNA, 20 bp, human
gggaagtgagtcgacagacg

SEQ ID NO: 177565 - DNA, 20 bp, human
gagcagtcctcgcgcaagaa

SEQ ID NO: 177566 - DNA, 20 bp, human
gctgcgactaacgtcaacga

SEQ ID NO: 177567 - DNA, 20 bp, human
gaccgtgaggacaaaaagta

SEQ ID NO: 177568 - DNA, 20 bp, human
gggttcccggggctacgagg

SEQ ID NO: 177569 - DNA, 20 bp, human
ggctaacggtaataactctt

SEQ ID NO: 177570 - DNA, 20 bp, human
gtagttccatgaggtcatgg

SEQ ID NO: 177571 - DNA, 20 bp, human
gcaggctccccgccaccgga

SEQ ID NO: 177572 - DNA, 20 bp, human
ggaactaacaagactggtgg

SEQ ID NO: 177573 - DNA, 20 bp, human
gctcatggaactaacaagac

SEQ ID NO: 177574 - DNA, 20 bp, human
ggagagggaggacccgtcac

SEQ ID NO: 177575 - DNA, 20 bp, human
gtctccaggctccccgccac

SEQ ID NO: 177576 - DNA, 20 bp, human
ggacttcggcggcgcagcaa

SEQ ID NO: 177577 - DNA, 20 bp, human
ggacgcggcatctgggaaag

SEQ ID NO: 177578 - DNA, 20 bp, human
gtcgggtcgcaactgcgtag

SEQ ID NO: 177579 - DNA, 20 bp, human
gtcccaagaaggacaacccg

SEQ ID NO: 177580 - DNA, 20 bp, human
gacccctcgcgagacttcgg

SEQ ID NO: 177581 - DNA, 20 bp, human
gtgaggaggcttgaacctgt

SEQ ID NO: 177582 - DNA, 20 bp, human
gcaccgcccgggcacagacg

SEQ ID NO: 177583 - DNA, 20 bp, human
ggccgccgaagtctcgcgag

SEQ ID NO: 177584 - DNA, 20 bp, human
ggaggcttgaacctgtgggt

SEQ ID NO: 177585 - DNA, 20 bp, human
gtcgcagggaggtctcgtgg

SEQ ID NO: 177586 - DNA, 20 bp, human
gctgacccggcaaaactcag

SEQ ID NO: 177587 - DNA, 20 bp, human
gacccggcaaaactcagcgg

SEQ ID NO: 177588 - DNA, 20 bp, human
gtcggcgccctgcagtactt

SEQ ID NO: 177589 - DNA, 20 bp, human
gagcgagccgaagagtgaaa

SEQ ID NO: 177590 - DNA, 20 bp, human
gactccacggacgtcacgtg

SEQ ID NO: 177591 - DNA, 20 bp, human
gcccaggcggcccgcagtgt

SEQ ID NO: 177592 - DNA, 20 bp, human
gcaaagtgcagccgctgacc

SEQ ID NO: 177593 - DNA, 20 bp, human
gtcagatggctcaaatgcgt

SEQ ID NO: 177594 - DNA, 20 bp, human
ggggatgtaagaagtgaagt

SEQ ID NO: 177595 - DNA, 20 bp, human
gtaagaagtgaagtcggtgc

SEQ ID NO: 177596 - DNA, 20 bp, human
gtagccgcagagtcaacggg

SEQ ID NO: 177597 - DNA, 20 bp, human
ggtcgtagccgcagagtcaa

SEQ ID NO: 177598 - DNA, 20 bp, human
ggcgagaaccggctattcag

SEQ ID NO: 177599 - DNA, 20 bp, human
gcggtaggcggtgcgagaac

SEQ ID NO: 177600 - DNA, 20 bp, human
ggctgtcgcgggaaccccga

SEQ ID NO: 177601 - DNA, 20 bp, human
ggtgaggaggccgaaaggga

SEQ ID NO: 177602 - DNA, 20 bp, human
gtcgcgggaaccccgaaggt

SEQ ID NO: 177603 - DNA, 20 bp, human
ggctccgcccgttgactctg

SEQ ID NO: 177604 - DNA, 20 bp, human
gctctccttaaagcggtagg

SEQ ID NO: 177605 - DNA, 20 bp, human
gcgggtgctgcagcccactg

SEQ ID NO: 177606 - DNA, 20 bp, human
ggtcagaggctgcctcgcag

SEQ ID NO: 177607 - DNA, 20 bp, human
ggcagcggcaagaagtgtct

SEQ ID NO: 177608 - DNA, 20 bp, human
gcagctgcaggccgatccag

SEQ ID NO: 177609 - DNA, 20 bp, human
gtggccgatccgcatgtcag

SEQ ID NO: 177610 - DNA, 20 bp, human
gtgtctgggctgggacggac

SEQ ID NO: 177611 - DNA, 20 bp, human
gtggggtcgccgcagccggg

SEQ ID NO: 177612 - DNA, 20 bp, human
gccgcagagccgcagccggg

SEQ ID NO: 177613 - DNA, 20 bp, human
gtgctactgaacggcgacgg

SEQ ID NO: 177614 - DNA, 20 bp, human
gcaggagaggctgtcgccat

SEQ ID NO: 177615 - DNA, 20 bp, human
gcccctgcgcggcttccagt

SEQ ID NO: 177616 - DNA, 20 bp, human
ggctggcggccgaccaacac

SEQ ID NO: 177617 - DNA, 20 bp, human
ggtctcgcacatgcacgagt

SEQ ID NO: 177618 - DNA, 20 bp, human
ggtaggagcccggctggtcg

SEQ ID NO: 177619 - DNA, 20 bp, human
gtcgacgagtgcgaaaacgg

SEQ ID NO: 177620 - DNA, 20 bp, human
gcatgtgcgagaccggctac

SEQ ID NO: 177621 - DNA, 20 bp, human
gtcctcgcaccggtgttggt

SEQ ID NO: 177622 - DNA, 20 bp, human
gtgcgagaccggctaccggc

SEQ ID NO: 177623 - DNA, 20 bp, human
gctctgaagcacgggtccac

SEQ ID NO: 177624 - DNA, 20 bp, human
ggggaggttgtggcacaccc

SEQ ID NO: 177625 - DNA, 20 bp, human
gacatgcacgagtaggagcc

SEQ ID NO: 177626 - DNA, 20 bp, human
ggcctgtgcgtccggagtag

SEQ ID NO: 177627 - DNA, 20 bp, human
gccaggagcaacctctactc

SEQ ID NO: 177628 - DNA, 20 bp, human
gtgaactcgcaggccagctc

SEQ ID NO: 177629 - DNA, 20 bp, human
gcaggccagctcgggcgcag

SEQ ID NO: 177630 - DNA, 20 bp, human
gacctctactccggacgcac

SEQ ID NO: 177631 - DNA, 20 bp, human
gacaggagccctgaactcgc

SEQ ID NO: 177632 - DNA, 20 bp, human
gccctggagtgctgatacaa

SEQ ID NO: 177633 - DNA, 20 bp, human
ggcagcggctggcaaggcgg

SEQ ID NO: 177634 - DNA, 20 bp, human
gacatccacctggagcgctg

SEQ ID NO: 177635 - DNA, 20 bp, human
ggccctgaagagtcctccag

SEQ ID NO: 177636 - DNA, 20 bp, human
gtctgtcacctgtggaggag

SEQ ID NO: 177637 - DNA, 20 bp, human
gtggggtccttggtcaccat

SEQ ID NO: 177638 - DNA, 20 bp, human
gacgccggcaaagcagggat

SEQ ID NO: 177639 - DNA, 20 bp, human
gtctgttctgtcacctgtgg

SEQ ID NO: 177640 - DNA, 20 bp, human
ggacagtcacagtaaatggt

SEQ ID NO: 177641 - DNA, 20 bp, human
gttctgtacccctcctccac

SEQ ID NO: 177642 - DNA, 20 bp, human
gagtgcccagcatggcagta

SEQ ID NO: 177643 - DNA, 20 bp, human
ggagagacagtcacagtaaa

SEQ ID NO: 177644 - DNA, 20 bp, human
gtagctagtacacttcacgc

SEQ ID NO: 177645 - DNA, 20 bp, human
gagatgtcccatggtgacca

SEQ ID NO: 177646 - DNA, 20 bp, human
gctctgctggagcgagagac

SEQ ID NO: 177647 - DNA, 20 bp, human
ggttccggaccgagtcagaa

SEQ ID NO: 177648 - DNA, 20 bp, human
ggcagccacaaccctcagag

SEQ ID NO: 177649 - DNA, 20 bp, human
ggcagtgcaggatgctccgg

SEQ ID NO: 177650 - DNA, 20 bp, human
ggaccgagtcagaaaggcgc

SEQ ID NO: 177651 - DNA, 20 bp, human
gacgtggccgagcggctccc

SEQ ID NO: 177652 - DNA, 20 bp, human
ggttctcgaactctaagaag

SEQ ID NO: 177653 - DNA, 20 bp, human
gtccggtggacgtggccgag

SEQ ID NO: 177654 - DNA, 20 bp, human
gagcgtttacccgggttccc

SEQ ID NO: 177655 - DNA, 20 bp, human
gtcgattcttaacttaaggt

SEQ ID NO: 177656 - DNA, 20 bp, human
gtcagccggctcactacccc

SEQ ID NO: 177657 - DNA, 20 bp, human
gagcatctgtaggcacccta

SEQ ID NO: 177658 - DNA, 20 bp, human
gcaagtagcagagaacatgt

SEQ ID NO: 177659 - DNA, 20 bp, human
gctgagaggcatggagacgc

SEQ ID NO: 177660 - DNA, 20 bp, human
gcctgccaggggtagtgagc

SEQ ID NO: 177661 - DNA, 20 bp, human
gggagacgcaggaacttcgg

SEQ ID NO: 177662 - DNA, 20 bp, human
gggcagatgtgaaaaagcaa

SEQ ID NO: 177663 - DNA, 20 bp, human
gtgtaggcaccctagggtct

SEQ ID NO: 177664 - DNA, 20 bp, human
gctgaaggtgggcgtactgt

SEQ ID NO: 177665 - DNA, 20 bp, human
gtggctgcccaaggacaggg

SEQ ID NO: 177666 - DNA, 20 bp, human
gaggcttcttctggcccgac

SEQ ID NO: 177667 - DNA, 20 bp, human
gcggccgccggcccatccag

SEQ ID NO: 177668 - DNA, 20 bp, human
gccgactggcagctgaactg

SEQ ID NO: 177669 - DNA, 20 bp, human
gacgtgggccacctctggat

SEQ ID NO: 177670 - DNA, 20 bp, human
gactggcagctgaactgcgg

SEQ ID NO: 177671 - DNA, 20 bp, human
gccgctacgtgggccacctc

SEQ ID NO: 177672 - DNA, 20 bp, human
gcctggggagatccccgggg

SEQ ID NO: 177673 - DNA, 20 bp, human
ggagcctgccgcgccttcag

SEQ ID NO: 177674 - DNA, 20 bp, human
ggcttaggtgacgggaactc

SEQ ID NO: 177675 - DNA, 20 bp, human
gccacctctggatgggccgg

SEQ ID NO: 177676 - DNA, 20 bp, human
gcagcccggacgccgagcac

SEQ ID NO: 177677 - DNA, 20 bp, human
ggccgagcacgggtcacctg

SEQ ID NO: 177678 - DNA, 20 bp, human
gtgacccgtgctcggcgtcc

SEQ ID NO: 177679 - DNA, 20 bp, human
ggccgcaggtgacccgtgct

SEQ ID NO: 177680 - DNA, 20 bp, human
gtagccaccgctgcaggacc

SEQ ID NO: 177681 - DNA, 20 bp, human
ggcaaggccacaggagcaca

SEQ ID NO: 177682 - DNA, 20 bp, human
gtccccgccgtgcggtgctg

SEQ ID NO: 177683 - DNA, 20 bp, human
gccgtgcgttgaacctcggt

SEQ ID NO: 177684 - DNA, 20 bp, human
ggctttgattgggcccggga

SEQ ID NO: 177685 - DNA, 20 bp, human
gcgggccgtgcgttgaacct

SEQ ID NO: 177686 - DNA, 20 bp, human
gcccttcctgcgaggagaca

SEQ ID NO: 177687 - DNA, 20 bp, human
ggagcagacccaggtcacaa

SEQ ID NO: 177688 - DNA, 20 bp, human
gtctccagggaggaggatca

SEQ ID NO: 177689 - DNA, 20 bp, human
ggaagggacgctgtggtaag

SEQ ID NO: 177690 - DNA, 20 bp, human
gggccagagaaggacagtgg

SEQ ID NO: 177691 - DNA, 20 bp, human
gcctgcccggaaacaagcct

SEQ ID NO: 177692 - DNA, 20 bp, human
gggagggctcctcagatgtg

SEQ ID NO: 177693 - DNA, 20 bp, human
gatcttacatggggagatcc

SEQ ID NO: 177694 - DNA, 20 bp, human
gtcggaccctgtctcctcgc

SEQ ID NO: 177695 - DNA, 20 bp, human
gccagagaaggaggtagctg

SEQ ID NO: 177696 - DNA, 20 bp, human
gggaagggaccggtgtatgg

SEQ ID NO: 177697 - DNA, 20 bp, human
gggaccagaagacccagaag

SEQ ID NO: 177698 - DNA, 20 bp, human
gctggctcgctgctcccgag

SEQ ID NO: 177699 - DNA, 20 bp, human
gtttgggtgccgggagagtg

SEQ ID NO: 177700 - DNA, 20 bp, human
gctgggaagggaccggtgta

SEQ ID NO: 177701 - DNA, 20 bp, human
gcctgctgtcccccatacac

SEQ ID NO: 177702 - DNA, 20 bp, human
gtgccgggagagtgaggccg

SEQ ID NO: 177703 - DNA, 20 bp, human
ggacattcctgaaatcaggt

SEQ ID NO: 177704 - DNA, 20 bp, human
ggccccctgggcgggcgaaa

SEQ ID NO: 177705 - DNA, 20 bp, human
gcacccaaatgtgtctgtgg

SEQ ID NO: 177706 - DNA, 20 bp, human
ggctgctgatcagcaattac

SEQ ID NO: 177707 - DNA, 20 bp, human
gttgtgtaaggccctgtcat

SEQ ID NO: 177708 - DNA, 20 bp, human
gagagtagattccgaatgag

SEQ ID NO: 177709 - DNA, 20 bp, human
gccaactcctgagatgtcat

SEQ ID NO: 177710 - DNA, 20 bp, human
gtgtcataggcacaagtgat

SEQ ID NO: 177711 - DNA, 20 bp, human
gtagtcaactcactctcgtc

SEQ ID NO: 177712 - DNA, 20 bp, human
ggctcttctcacctctcatt

SEQ ID NO: 177713 - DNA, 20 bp, human
gagcatctctgcatttttag

SEQ ID NO: 177714 - DNA, 20 bp, human
gcaggtggttaacgtgctag

SEQ ID NO: 177715 - DNA, 20 bp, human
gctctcaattatatataaga

SEQ ID NO: 177716 - DNA, 20 bp, human
gcctgggcaaccagtcggga

SEQ ID NO: 177717 - DNA, 20 bp, human
gtgcgcctgggcaaccagtc

SEQ ID NO: 177718 - DNA, 20 bp, human
gcgggactcaccctcccgac

SEQ ID NO: 177719 - DNA, 20 bp, human
ggaggaacccgaggaggtca

SEQ ID NO: 177720 - DNA, 20 bp, human
ggccgtccgaggtgaccgat

SEQ ID NO: 177721 - DNA, 20 bp, human
ggagggggagatcattactg

SEQ ID NO: 177722 - DNA, 20 bp, human
gtagggagcgtggggctcat

SEQ ID NO: 177723 - DNA, 20 bp, human
gtctctgcgcgatacgataa

SEQ ID NO: 177724 - DNA, 20 bp, human
gagagagcttgaggagtccg

SEQ ID NO: 177725 - DNA, 20 bp, human
gcgcgcgcgacagaagcttc

SEQ ID NO: 177726 - DNA, 20 bp, human
gggggcccaaggcgataacc

SEQ ID NO: 177727 - DNA, 20 bp, human
gaggtagagtgcgccgtcca

SEQ ID NO: 177728 - DNA, 20 bp, human
ggcaggcgccggcctactgg

SEQ ID NO: 177729 - DNA, 20 bp, human
gagctcacctgggcaccaca

SEQ ID NO: 177730 - DNA, 20 bp, human
gtagagcaagcgcggccccg

SEQ ID NO: 177731 - DNA, 20 bp, human
gagggcagcataagcaacag

SEQ ID NO: 177732 - DNA, 20 bp, human
ggacccgagctggtgagtct

SEQ ID NO: 177733 - DNA, 20 bp, human
gtcagcatggctccgggccg

SEQ ID NO: 177734 - DNA, 20 bp, human
gggactcagaaacacgcctg

SEQ ID NO: 177735 - DNA, 20 bp, human
gtcagaataaaagctcacct

SEQ ID NO: 177736 - DNA, 20 bp, human
ggtagtctgagtcccacagg

SEQ ID NO: 177737 - DNA, 20 bp, human
gcagagagctaggcgaggct

SEQ ID NO: 177738 - DNA, 20 bp, human
gaaaggcgccgagcatctgt

SEQ ID NO: 177739 - DNA, 20 bp, human
ggcaggtgggcagtgttcgg

SEQ ID NO: 177740 - DNA, 20 bp, human
gagtctgggcaggatacggg

SEQ ID NO: 177741 - DNA, 20 bp, human
ggagccagatgcaggtctcc

SEQ ID NO: 177742 - DNA, 20 bp, human
gtctttcagagagctaggcg

SEQ ID NO: 177743 - DNA, 20 bp, human
gggatccaaatgctgaggca

SEQ ID NO: 177744 - DNA, 20 bp, human
gctgcttggatggagggtct

SEQ ID NO: 177745 - DNA, 20 bp, human
gccagccctgcttggatgga

SEQ ID NO: 177746 - DNA, 20 bp, human
ggcagcaggtccaagtccga

SEQ ID NO: 177747 - DNA, 20 bp, human
gggcgggtgcgcacctcgaa

SEQ ID NO: 177748 - DNA, 20 bp, human
ggcgccgcggacaccggcac

SEQ ID NO: 177749 - DNA, 20 bp, human
gagcagccccagcatagcgg

SEQ ID NO: 177750 - DNA, 20 bp, human
gggcaccgtaaccagcgccg

SEQ ID NO: 177751 - DNA, 20 bp, human
ggaccgcgcgttctacctgg

SEQ ID NO: 177752 - DNA, 20 bp, human
ggtgtccgcggcgctggtta

SEQ ID NO: 177753 - DNA, 20 bp, human
ggcgccggtgccggtgtccg

SEQ ID NO: 177754 - DNA, 20 bp, human
gagccccagcatagcggcgg

SEQ ID NO: 177755 - DNA, 20 bp, human
gcggggtcctgcggagtccg

SEQ ID NO: 177756 - DNA, 20 bp, human
ggagctactccaccccactc

SEQ ID NO: 177757 - DNA, 20 bp, human
ggacctcaggaccctaccca

SEQ ID NO: 177758 - DNA, 20 bp, human
gtctgggacagacagaaata

SEQ ID NO: 177759 - DNA, 20 bp, human
gcaggtctacaaactaccca

SEQ ID NO: 177760 - DNA, 20 bp, human
ggagaaactagacaggactc

SEQ ID NO: 177761 - DNA, 20 bp, human
gttctagccagtaaaggtat

SEQ ID NO: 177762 - DNA, 20 bp, human
gggtagggtcctgaggtcaa

SEQ ID NO: 177763 - DNA, 20 bp, human
gcccagggttctagaaatcc

SEQ ID NO: 177764 - DNA, 20 bp, human
gggtggagtagctctatgtg

SEQ ID NO: 177765 - DNA, 20 bp, human
ggagaggggagaaactagac

SEQ ID NO: 177766 - DNA, 20 bp, human
gctctttggctggtgggtag

SEQ ID NO: 177767 - DNA, 20 bp, human
gctaaacactgaaggctcca

SEQ ID NO: 177768 - DNA, 20 bp, human
gctaatcccagcatagagag

SEQ ID NO: 177769 - DNA, 20 bp, human
gtgtagaaaataagggatcc

SEQ ID NO: 177770 - DNA, 20 bp, human
ggcaggcacgcattatgcct

SEQ ID NO: 177771 - DNA, 20 bp, human
gggattagaatgctaattgc

SEQ ID NO: 177772 - DNA, 20 bp, human
gtcctctcctgtagaaaata

SEQ ID NO: 177773 - DNA, 20 bp, human
ggctgtacctttgatcagag

SEQ ID NO: 177774 - DNA, 20 bp, human
gcccttattttctacaggag

SEQ ID NO: 177775 - DNA, 20 bp, human
gaatgggccactctctatgc

SEQ ID NO: 177776 - DNA, 20 bp, human
gacgcagccacgaccaccag

SEQ ID NO: 177777 - DNA, 20 bp, human
gcagagagccgcggggacca

SEQ ID NO: 177778 - DNA, 20 bp, human
gatgcagccgggccactcct

SEQ ID NO: 177779 - DNA, 20 bp, human
gcgaagtcctgcagcggcac

SEQ ID NO: 177780 - DNA, 20 bp, human
gaccggctccatggtccccg

SEQ ID NO: 177781 - DNA, 20 bp, human
gcagccgggccactcctagg

SEQ ID NO: 177782 - DNA, 20 bp, human
ggggagggaggcggggtcca

SEQ ID NO: 177783 - DNA, 20 bp, human
ggtggccccgcggtgcgcat

SEQ ID NO: 177784 - DNA, 20 bp, human
gtgcagcggcaccggctcca

SEQ ID NO: 177785 - DNA, 20 bp, human
ggcagacccgcagcacgcgc

SEQ ID NO: 177786 - DNA, 20 bp, human
gtggggcgcctgtaaagtta

SEQ ID NO: 177787 - DNA, 20 bp, human
gcgtctcagagtgatggaaa

SEQ ID NO: 177788 - DNA, 20 bp, human
gcggtgagcgagctcgactc

SEQ ID NO: 177789 - DNA, 20 bp, human
ggtgatggaaatggtggcca

SEQ ID NO: 177790 - DNA, 20 bp, human
gtctacacgcggaaaggaaa

SEQ ID NO: 177791 - DNA, 20 bp, human
ggtctctgttcacttaacac

SEQ ID NO: 177792 - DNA, 20 bp, human
gcgcgaagagaacacttccg

SEQ ID NO: 177793 - DNA, 20 bp, human
ggcgatgtgctcccgtgatg

SEQ ID NO: 177794 - DNA, 20 bp, human
gcatggtcgcccccaatctc

SEQ ID NO: 177795 - DNA, 20 bp, human
gtaggacagtgcctgaacgc

SEQ ID NO: 177796 - DNA, 20 bp, human
ggacccggaggaccgcccaa

SEQ ID NO: 177797 - DNA, 20 bp, human
ggtacctgcagctagctccc

SEQ ID NO: 177798 - DNA, 20 bp, human
gcgctggccgccgcaggcac

SEQ ID NO: 177799 - DNA, 20 bp, human
gaggcgcagagccgacccgg

SEQ ID NO: 177800 - DNA, 20 bp, human
gagcaggcgcagagccgacc

SEQ ID NO: 177801 - DNA, 20 bp, human
ggaggaagagtcccgacccg

SEQ ID NO: 177802 - DNA, 20 bp, human
gcggaggaccgcccaagggg

SEQ ID NO: 177803 - DNA, 20 bp, human
gaggcgcagagtccactgcg

SEQ ID NO: 177804 - DNA, 20 bp, human
gcgcagagtccactgcgcgg

SEQ ID NO: 177805 - DNA, 20 bp, human
gttcctggagaacgacctag

SEQ ID NO: 177806 - DNA, 20 bp, human
ggagccgacggcacccctag

SEQ ID NO: 177807 - DNA, 20 bp, human
ggggcggcctaaatcctcaa

SEQ ID NO: 177808 - DNA, 20 bp, human
gcgaggcccggtgcgcagca

SEQ ID NO: 177809 - DNA, 20 bp, human
ggtgcgcacattcgcagccc

SEQ ID NO: 177810 - DNA, 20 bp, human
ggcagaccccgggctctctg

SEQ ID NO: 177811 - DNA, 20 bp, human
ggtcatcccgccaaggaggg

SEQ ID NO: 177812 - DNA, 20 bp, human
gccgtcagggacgcggactc

SEQ ID NO: 177813 - DNA, 20 bp, human
ggtccgagcgccggaaccaa

SEQ ID NO: 177814 - DNA, 20 bp, human
gtaggggtggaggcagaccc

SEQ ID NO: 177815 - DNA, 20 bp, human
gcaccgcaccgtcagggacg

SEQ ID NO: 177816 - DNA, 20 bp, human
gggcgtcggagacatcttct

SEQ ID NO: 177817 - DNA, 20 bp, human
gcgggcaaactgaagagcgg

SEQ ID NO: 177818 - DNA, 20 bp, human
ggctgctgaagggggagggt

SEQ ID NO: 177819 - DNA, 20 bp, human
gaactgaagagcggcggcgt

SEQ ID NO: 177820 - DNA, 20 bp, human
gaggcgccgcagcgcagtgg

SEQ ID NO: 177821 - DNA, 20 bp, human
gccgctccgggccccgtcgg

SEQ ID NO: 177822 - DNA, 20 bp, human
gccagcagtagtctgcaggt

SEQ ID NO: 177823 - DNA, 20 bp, human
ggtagctcagaaggctaggg

SEQ ID NO: 177824 - DNA, 20 bp, human
gaggtgtctcgagaagggga

SEQ ID NO: 177825 - DNA, 20 bp, human
gacggtgagctgtagagggg

SEQ ID NO: 177826 - DNA, 20 bp, human
gctgcactctcacctgtagt

SEQ ID NO: 177827 - DNA, 20 bp, human
ggagtttcgaactcggggag

SEQ ID NO: 177828 - DNA, 20 bp, human
ggcagagtggataaagaact

SEQ ID NO: 177829 - DNA, 20 bp, human
gggcttctgctactagtgag

SEQ ID NO: 177830 - DNA, 20 bp, human
gtgtggtggttcccgcagag

SEQ ID NO: 177831 - DNA, 20 bp, human
ggcgggaaccaccacagccg

SEQ ID NO: 177832 - DNA, 20 bp, human
ggctactagtgagaggaaga

SEQ ID NO: 177833 - DNA, 20 bp, human
ggtgagatcaagcgaagagg

SEQ ID NO: 177834 - DNA, 20 bp, human
ggctcgcgtgctacacatcc

SEQ ID NO: 177835 - DNA, 20 bp, human
gcgggcgtggatggtcgtct

SEQ ID NO: 177836 - DNA, 20 bp, human
gagcaagacgcgcgagttcc

SEQ ID NO: 177837 - DNA, 20 bp, human
gccacggggccatcgagccg

SEQ ID NO: 177838 - DNA, 20 bp, human
gcaccttggcgctgtgcgcc

SEQ ID NO: 177839 - DNA, 20 bp, human
gcatgcgcccggaagagcga

SEQ ID NO: 177840 - DNA, 20 bp, human
gagaggggccgtcgctcttc

SEQ ID NO: 177841 - DNA, 20 bp, human
gcgttgggccagagcggccc

SEQ ID NO: 177842 - DNA, 20 bp, human
gtccacggcgcagtcagtcc

SEQ ID NO: 177843 - DNA, 20 bp, human
gaacactgcagcagcctcca

SEQ ID NO: 177844 - DNA, 20 bp, human
ggaggggccgtggtgaagtg

SEQ ID NO: 177845 - DNA, 20 bp, human
ggtagtgggagagcgaatgg

SEQ ID NO: 177846 - DNA, 20 bp, human
gccggggaccgcgggtagtg

SEQ ID NO: 177847 - DNA, 20 bp, human
gtacaaagaccggacctgaa

SEQ ID NO: 177848 - DNA, 20 bp, human
gcctcacagctccaagaacc

SEQ ID NO: 177849 - DNA, 20 bp, human
gtaataaacggtagtagagg

SEQ ID NO: 177850 - DNA, 20 bp, human
ggggagtaagccactgccgg

SEQ ID NO: 177851 - DNA, 20 bp, human
gaccgggagtaagccactgc

SEQ ID NO: 177852 - DNA, 20 bp, human
gtagaggtggtaagttgatc

SEQ ID NO: 177853 - DNA, 20 bp, human
gccatagagaaccggaagta

SEQ ID NO: 177854 - DNA, 20 bp, human
ggcgatcagcacctcagtcc

SEQ ID NO: 177855 - DNA, 20 bp, human
ggcatcctcaggcttcacgt

SEQ ID NO: 177856 - DNA, 20 bp, human
gcgcgggcgcggaagacggg

SEQ ID NO: 177857 - DNA, 20 bp, human
gaggccttacgtgcctagag

SEQ ID NO: 177858 - DNA, 20 bp, human
ggcgcccgcgcagaacctcg

SEQ ID NO: 177859 - DNA, 20 bp, human
gctgcgcgggcgcggaagac

SEQ ID NO: 177860 - DNA, 20 bp, human
ggcggcgcgtggcggaaggc

SEQ ID NO: 177861 - DNA, 20 bp, human
gccaggcaaaacagggctca

SEQ ID NO: 177862 - DNA, 20 bp, human
gcgaaggcggtagggcgcca

SEQ ID NO: 177863 - DNA, 20 bp, human
gggactcagactctgaccag

SEQ ID NO: 177864 - DNA, 20 bp, human
ggaagacgggcggcgcgtgg

SEQ ID NO: 177865 - DNA, 20 bp, human
gctgagggcgtggccaagag

SEQ ID NO: 177866 - DNA, 20 bp, human
ggcggcggcgcaagctgagg

SEQ ID NO: 177867 - DNA, 20 bp, human
gcgcaagctgaggcggcggt

SEQ ID NO: 177868 - DNA, 20 bp, human
ggtgggctgggaacacacgt

SEQ ID NO: 177869 - DNA, 20 bp, human
gacggctagaagcggtgcaa

SEQ ID NO: 177870 - DNA, 20 bp, human
gctagaagcggtgcaagggc

SEQ ID NO: 177871 - DNA, 20 bp, human
gcacacgtgggtggccgaga

SEQ ID NO: 177872 - DNA, 20 bp, human
gaagcggtgcaagggcgggt

SEQ ID NO: 177873 - DNA, 20 bp, human
ggctcccatggcgtgcgcgg

SEQ ID NO: 177874 - DNA, 20 bp, human
gggggcctcaccgtcagtca

SEQ ID NO: 177875 - DNA, 20 bp, human
gccatgggagccgtgactga

SEQ ID NO: 177876 - DNA, 20 bp, human
gacggccgcctgaggaccaa

SEQ ID NO: 177877 - DNA, 20 bp, human
gggcggcgcgcgcacaggga

SEQ ID NO: 177878 - DNA, 20 bp, human
ggggcccgacccatccggaa

SEQ ID NO: 177879 - DNA, 20 bp, human
gggccccgtggcggaccctg

SEQ ID NO: 177880 - DNA, 20 bp, human
ggatgggtcgggccccgtgg

SEQ ID NO: 177881 - DNA, 20 bp, human
ggactggagtcgttaaatca

SEQ ID NO: 177882 - DNA, 20 bp, human
ggcgaccccgggaggagcga

SEQ ID NO: 177883 - DNA, 20 bp, human
gctccccagggtccgccacg

SEQ ID NO: 177884 - DNA, 20 bp, human
gagaggatcgaagataggga

SEQ ID NO: 177885 - DNA, 20 bp, human
gtggcgcttcccttccggat

SEQ ID NO: 177886 - DNA, 20 bp, human
gtgggtaggaagacatgtgg

SEQ ID NO: 177887 - DNA, 20 bp, human
gctgctggccactcaccggg

SEQ ID NO: 177888 - DNA, 20 bp, human
gccactcaccgggtggagaa

SEQ ID NO: 177889 - DNA, 20 bp, human
gaggaagacatgtggcggtg

SEQ ID NO: 177890 - DNA, 20 bp, human
gtacccatctgctccccaga

SEQ ID NO: 177891 - DNA, 20 bp, human
gcaggacccaagtgcacagc

SEQ ID NO: 177892 - DNA, 20 bp, human
gcaggcaaactggaacctac

SEQ ID NO: 177893 - DNA, 20 bp, human
gagagagggagctgcactta

SEQ ID NO: 177894 - DNA, 20 bp, human
gggcgcaaggagagggtaat

SEQ ID NO: 177895 - DNA, 20 bp, human
gaagccagggcgcaaggaga

SEQ ID NO: 177896 - DNA, 20 bp, human
gggccgggcgggccctccag

SEQ ID NO: 177897 - DNA, 20 bp, human
gtggcgtccgagcctccccc

SEQ ID NO: 177898 - DNA, 20 bp, human
gcagcagactggccggacag

SEQ ID NO: 177899 - DNA, 20 bp, human
gtgctgggggcgtccatggg

SEQ ID NO: 177900 - DNA, 20 bp, human
gccgggaatgcgcagcagac

SEQ ID NO: 177901 - DNA, 20 bp, human
ggtccgagcctccccctgga

SEQ ID NO: 177902 - DNA, 20 bp, human
gactcacacccgggcgcagg

SEQ ID NO: 177903 - DNA, 20 bp, human
ggctcgtgacagggtcactg

SEQ ID NO: 177904 - DNA, 20 bp, human
ggagctccggcggccggcaa

SEQ ID NO: 177905 - DNA, 20 bp, human
ggcgcaccgtaaacaaaccg

SEQ ID NO: 177906 - DNA, 20 bp, human
gaacggagcccgctcagaag

SEQ ID NO: 177907 - DNA, 20 bp, human
gcgctgggcgcgctgtgggg

SEQ ID NO: 177908 - DNA, 20 bp, human
ggctgcagctgcgatctctg

SEQ ID NO: 177909 - DNA, 20 bp, human
ggcgcctctgatggaagtta

SEQ ID NO: 177910 - DNA, 20 bp, human
gagacgctgggcgcgctgtg

SEQ ID NO: 177911 - DNA, 20 bp, human
gggccaggggaagacctaaa

SEQ ID NO: 177912 - DNA, 20 bp, human
gcgatctctgtggtaggccc

SEQ ID NO: 177913 - DNA, 20 bp, human
gctgccctaacttccatcag

SEQ ID NO: 177914 - DNA, 20 bp, human
gctggttcggtcttctccta

SEQ ID NO: 177915 - DNA, 20 bp, human
gcgtcgccgtcgtcggagag

SEQ ID NO: 177916 - DNA, 20 bp, human
ggcggtgcccgaacacgaga

SEQ ID NO: 177917 - DNA, 20 bp, human
gggagctacggagtggacag

SEQ ID NO: 177918 - DNA, 20 bp, human
gggcggcaggctgggagcta

SEQ ID NO: 177919 - DNA, 20 bp, human
ggctacggagtggacagtgg

SEQ ID NO: 177920 - DNA, 20 bp, human
ggcacctcctcccagatccg

SEQ ID NO: 177921 - DNA, 20 bp, human
gggctctgttccaatcgcag

SEQ ID NO: 177922 - DNA, 20 bp, human
gacggagcgtcgcaagaacc

SEQ ID NO: 177923 - DNA, 20 bp, human
gaaggaaggcgcacatcctc

SEQ ID NO: 177924 - DNA, 20 bp, human
ggcccggggaaggtagcctg

SEQ ID NO: 177925 - DNA, 20 bp, human
gctcctgctccgcgggctcg

SEQ ID NO: 177926 - DNA, 20 bp, human
gcggtcagcaggcagttctt

SEQ ID NO: 177927 - DNA, 20 bp, human
gtggtagaccttggacacta

SEQ ID NO: 177928 - DNA, 20 bp, human
ggctgcataccggtccatga

SEQ ID NO: 177929 - DNA, 20 bp, human
gtggcctgccactcctcccg

SEQ ID NO: 177930 - DNA, 20 bp, human
gaagtaggtgtagagatcag

SEQ ID NO: 177931 - DNA, 20 bp, human
gagaccttggacactaggga

SEQ ID NO: 177932 - DNA, 20 bp, human
ggccttgagcatggtgaagt

SEQ ID NO: 177933 - DNA, 20 bp, human
gccggtccatgacggtcagc

SEQ ID NO: 177934 - DNA, 20 bp, human
gtggcaggcagcgaagagaa

SEQ ID NO: 177935 - DNA, 20 bp, human
gcgcttggttagcacctgca

SEQ ID NO: 177936 - DNA, 20 bp, human
gggcggacgggaaggctcag

SEQ ID NO: 177937 - DNA, 20 bp, human
gggcgcgtggcgaggcggac

SEQ ID NO: 177938 - DNA, 20 bp, human
ggggtcagggcgtgcagtct

SEQ ID NO: 177939 - DNA, 20 bp, human
gactcttggaggctcctctg

SEQ ID NO: 177940 - DNA, 20 bp, human
ggggcgtgcagtctgggacg

SEQ ID NO: 177941 - DNA, 20 bp, human
gcgtgccgcgagactcttgg

SEQ ID NO: 177942 - DNA, 20 bp, human
gggaaggctcaggggcggcg

SEQ ID NO: 177943 - DNA, 20 bp, human
gagacggtcctcattaagga

SEQ ID NO: 177944 - DNA, 20 bp, human
gactgcacgccctgaccccg

SEQ ID NO: 177945 - DNA, 20 bp, human
ggcagcaaccccaggccgtc

SEQ ID NO: 177946 - DNA, 20 bp, human
gcttctgggagaccttctgt

SEQ ID NO: 177947 - DNA, 20 bp, human
ggagttgcgttcaagtccta

SEQ ID NO: 177948 - DNA, 20 bp, human
ggggggtccaggcaaaagca

SEQ ID NO: 177949 - DNA, 20 bp, human
ggcacagcacacagctccca

SEQ ID NO: 177950 - DNA, 20 bp, human
gctgagagaccccatgaaat

SEQ ID NO: 177951 - DNA, 20 bp, human
gtaacattgttcatttccat

SEQ ID NO: 177952 - DNA, 20 bp, human
gaatgggaaaccatgatgct

SEQ ID NO: 177953 - DNA, 20 bp, human
gtcatggtttcccatttcat

SEQ ID NO: 177954 - DNA, 20 bp, human
gttaaagtaagtgatcttaa

SEQ ID NO: 177955 - DNA, 20 bp, human
gtgtgctgtgctgagtggct

SEQ ID NO: 177956 - DNA, 20 bp, human
gacgttggtctgatccagta

SEQ ID NO: 177957 - DNA, 20 bp, human
gagttagatgcaggcttatc

SEQ ID NO: 177958 - DNA, 20 bp, human
gtcgatcagcaggaactgct

SEQ ID NO: 177959 - DNA, 20 bp, human
gcaatgctgccaggttgatc

SEQ ID NO: 177960 - DNA, 20 bp, human
ggtaaggacaagttagatgc

SEQ ID NO: 177961 - DNA, 20 bp, human
ggctgtgattcaattcacgt

SEQ ID NO: 177962 - DNA, 20 bp, human
gttatctggtctcgatcagc

SEQ ID NO: 177963 - DNA, 20 bp, human
gggaatctgatgtgtcagtt

SEQ ID NO: 177964 - DNA, 20 bp, human
gatttattgaggtgaaaggc

SEQ ID NO: 177965 - DNA, 20 bp, human
ggtgatattgctttatatta

SEQ ID NO: 177966 - DNA, 20 bp, human
gattctgcgaggaatggcag

SEQ ID NO: 177967 - DNA, 20 bp, human
gtcttccacagatagagggt

SEQ ID NO: 177968 - DNA, 20 bp, human
ggcagaatggcaggtcccgg

SEQ ID NO: 177969 - DNA, 20 bp, human
gacggctctggaccctggag

SEQ ID NO: 177970 - DNA, 20 bp, human
ggccgcctgcagccactcca

SEQ ID NO: 177971 - DNA, 20 bp, human
gcctgccattctgcgaggaa

SEQ ID NO: 177972 - DNA, 20 bp, human
ggagagcgcgtctaacacca

SEQ ID NO: 177973 - DNA, 20 bp, human
gctgtggaagactggtaagt

SEQ ID NO: 177974 - DNA, 20 bp, human
gaccagtcttccacagatag

SEQ ID NO: 177975 - DNA, 20 bp, human
ggccacattaaggagctggt

SEQ ID NO: 177976 - DNA, 20 bp, human
gccagcgtctggcaacccgg

SEQ ID NO: 177977 - DNA, 20 bp, human
gtgccagacgctggaatggg

SEQ ID NO: 177978 - DNA, 20 bp, human
gcagtgtgcggagaccctct

SEQ ID NO: 177979 - DNA, 20 bp, human
gggcaacccggcggcgactc

SEQ ID NO: 177980 - DNA, 20 bp, human
gtgtgcggagaccctctagg

SEQ ID NO: 177981 - DNA, 20 bp, human
gggttgccagacgctggaat

SEQ ID NO: 177982 - DNA, 20 bp, human
ggaccacccattccagcgtc

SEQ ID NO: 177983 - DNA, 20 bp, human
ggagcaccgacctcatgcaa

SEQ ID NO: 177984 - DNA, 20 bp, human
gcggtcccgttgcatgaggt

SEQ ID NO: 177985 - DNA, 20 bp, human
gctgcccggggcgcagtgtg

SEQ ID NO: 177986 - DNA, 20 bp, human
ggtcccgcgaggagactctc

SEQ ID NO: 177987 - DNA, 20 bp, human
gcctcgcgggacccacagag

SEQ ID NO: 177988 - DNA, 20 bp, human
gctgctacactaccggccag

SEQ ID NO: 177989 - DNA, 20 bp, human
gaagcccgagagtctcctcg

SEQ ID NO: 177990 - DNA, 20 bp, human
gccctggaaaaacttatgag

SEQ ID NO: 177991 - DNA, 20 bp, human
gcctcgcgagtgtatggcgt

SEQ ID NO: 177992 - DNA, 20 bp, human
ggcccagggcttgattgagg

SEQ ID NO: 177993 - DNA, 20 bp, human
gaaggtgacccggtactcca

SEQ ID NO: 177994 - DNA, 20 bp, human
gtaccggccagcggaacttc

SEQ ID NO: 177995 - DNA, 20 bp, human
ggtgagccagtagcctcctg

SEQ ID NO: 177996 - DNA, 20 bp, human
gatggtgtgcgcaaactgag

SEQ ID NO: 177997 - DNA, 20 bp, human
gttcgcgccggcgatagacg

SEQ ID NO: 177998 - DNA, 20 bp, human
gctgcgagcgtctcaggact

SEQ ID NO: 177999 - DNA, 20 bp, human
gagctagagcccgggctaca

SEQ ID NO: 178000 - DNA, 20 bp, human
ggtcggcgtgacggctgtag

SEQ ID NO: 178001 - DNA, 20 bp, human
gccaggctgagtagtctgct

SEQ ID NO: 178002 - DNA, 20 bp, human
ggagggatggctgctggtat

SEQ ID NO: 178003 - DNA, 20 bp, human
gtggcgtcctcgtctatcgc

SEQ ID NO: 178004 - DNA, 20 bp, human
gcgaagtctgcgagcgtctc

SEQ ID NO: 178005 - DNA, 20 bp, human
gcagtttgcgcacaccatgg

SEQ ID NO: 178006 - DNA, 20 bp, human
gggaggcgcgtggagagcca

SEQ ID NO: 178007 - DNA, 20 bp, human
ggcctgagccgccatgtcgg

SEQ ID NO: 178008 - DNA, 20 bp, human
gcgtcgcgtggaacagagag

SEQ ID NO: 178009 - DNA, 20 bp, human
gcagcctcaggcccggaccc

SEQ ID NO: 178010 - DNA, 20 bp, human
gccacgcgcctccgacatgg

SEQ ID NO: 178011 - DNA, 20 bp, human
gtctccacgcgcctccgaca

SEQ ID NO: 178012 - DNA, 20 bp, human
gcaggccagattctaattac

SEQ ID NO: 178013 - DNA, 20 bp, human
gccgaggccacgtgacccga

SEQ ID NO: 178014 - DNA, 20 bp, human
gccgcgtccacgactggggt

SEQ ID NO: 178015 - DNA, 20 bp, human
gagaatcgggcgccagcctc

SEQ ID NO: 178016 - DNA, 20 bp, human
gacagggcccgggaatccta

SEQ ID NO: 178017 - DNA, 20 bp, human
gcaagaggccaatggagtgt

SEQ ID NO: 178018 - DNA, 20 bp, human
ggctggcggccggtaactgg

SEQ ID NO: 178019 - DNA, 20 bp, human
ggagctgaaagggtcttcgc

SEQ ID NO: 178020 - DNA, 20 bp, human
gcctgaccgcaagaggccaa

SEQ ID NO: 178021 - DNA, 20 bp, human
ggcccgggaatcctagggag

SEQ ID NO: 178022 - DNA, 20 bp, human
gcacagcacaaggacattat

SEQ ID NO: 178023 - DNA, 20 bp, human
gaactggcggcggttgggaa

SEQ ID NO: 178024 - DNA, 20 bp, human
gcccaaccgccgccagttac

SEQ ID NO: 178025 - DNA, 20 bp, human
gcttcaggcggatctcgtgg

SEQ ID NO: 178026 - DNA, 20 bp, human
gagctgggtgcagcaaccgg

SEQ ID NO: 178027 - DNA, 20 bp, human
gggaagaccccagtccaggt

SEQ ID NO: 178028 - DNA, 20 bp, human
ggtgcagcaaccggaggcgg

SEQ ID NO: 178029 - DNA, 20 bp, human
gtgggtgcagcaaccggagg

SEQ ID NO: 178030 - DNA, 20 bp, human
ggctggggcgctggagaaca

SEQ ID NO: 178031 - DNA, 20 bp, human
gagcccgccgcgaggtcacc

SEQ ID NO: 178032 - DNA, 20 bp, human
gccgagctgggtgcagcaac

SEQ ID NO: 178033 - DNA, 20 bp, human
gaggaggacggatgaaactg

SEQ ID NO: 178034 - DNA, 20 bp, human
gtggaggatggcgagctaga

SEQ ID NO: 178035 - DNA, 20 bp, human
gaacccagctcgcagaggcg

SEQ ID NO: 178036 - DNA, 20 bp, human
gcactctgcagactcgactg

SEQ ID NO: 178037 - DNA, 20 bp, human
gcccgcgcagagcgagatgg

SEQ ID NO: 178038 - DNA, 20 bp, human
gtgcacagcctgcggcgcag

SEQ ID NO: 178039 - DNA, 20 bp, human
gctgcccctaggctgcacaa

SEQ ID NO: 178040 - DNA, 20 bp, human
gcggacgattctggaatcaa

SEQ ID NO: 178041 - DNA, 20 bp, human
gcgcccaccaagcgccgcgg

SEQ ID NO: 178042 - DNA, 20 bp, human
gctgtgcagcgcgacccccg

SEQ ID NO: 178043 - DNA, 20 bp, human
ggacccccgcggcgcttggt

SEQ ID NO: 178044 - DNA, 20 bp, human
ggttcaggtgagctgcccct

SEQ ID NO: 178045 - DNA, 20 bp, human
gaaacccgcgcagagcgaga

SEQ ID NO: 178046 - DNA, 20 bp, human
gtaattgccgccggaggagg

SEQ ID NO: 178047 - DNA, 20 bp, human
gaaaccccaatacaagatgg

SEQ ID NO: 178048 - DNA, 20 bp, human
gactaaaccgcccggcccag

SEQ ID NO: 178049 - DNA, 20 bp, human
ggggcccgtggcgagagcaa

SEQ ID NO: 178050 - DNA, 20 bp, human
gagtgaagggattaattgag

SEQ ID NO: 178051 - DNA, 20 bp, human
ggctcgccgccatcttgtat

SEQ ID NO: 178052 - DNA, 20 bp, human
ggtgtaattgccgccggagg

SEQ ID NO: 178053 - DNA, 20 bp, human
ggaggaggcggagtaacctc

SEQ ID NO: 178054 - DNA, 20 bp, human
gcgatttgggaggtagtgaa

SEQ ID NO: 178055 - DNA, 20 bp, human
gcccagactcacagagtctt

SEQ ID NO: 178056 - DNA, 20 bp, human
gacagctgcatccctgagag

SEQ ID NO: 178057 - DNA, 20 bp, human
gacgctgagacaaagagggt

SEQ ID NO: 178058 - DNA, 20 bp, human
gccaccccacacgagaggga

SEQ ID NO: 178059 - DNA, 20 bp, human
ggggctcccaagaacgactc

SEQ ID NO: 178060 - DNA, 20 bp, human
gtaacacgctgagacaaaga

SEQ ID NO: 178061 - DNA, 20 bp, human
gggttcttaagaatgaggtg

SEQ ID NO: 178062 - DNA, 20 bp, human
gggggctgtagtggtagctg

SEQ ID NO: 178063 - DNA, 20 bp, human
gaaactcaacttgagaggga

SEQ ID NO: 178064 - DNA, 20 bp, human
ggtgccttccctctcgtgtg

SEQ ID NO: 178065 - DNA, 20 bp, human
gagacgctggtgaggagagc

SEQ ID NO: 178066 - DNA, 20 bp, human
ggtccacgccgccctggtca

SEQ ID NO: 178067 - DNA, 20 bp, human
gtgcccgtcgtcttccatca

SEQ ID NO: 178068 - DNA, 20 bp, human
gacactgcgctccaaccagg

SEQ ID NO: 178069 - DNA, 20 bp, human
gtggagcgcagtgtccggag

SEQ ID NO: 178070 - DNA, 20 bp, human
gccgaagccgggactctagg

SEQ ID NO: 178071 - DNA, 20 bp, human
gcggagcgatcccgggacaa

SEQ ID NO: 178072 - DNA, 20 bp, human
gtggtcctggaaatgagaga

SEQ ID NO: 178073 - DNA, 20 bp, human
gcaccatgatggaagacgac

SEQ ID NO: 178074 - DNA, 20 bp, human
gcgggtactcacagagtccg

SEQ ID NO: 178075 - DNA, 20 bp, human
gagagcccgagagcagggtt

SEQ ID NO: 178076 - DNA, 20 bp, human
gagagctgcgcgcccgacgg

SEQ ID NO: 178077 - DNA, 20 bp, human
gttggcgcccgcagccccag

SEQ ID NO: 178078 - DNA, 20 bp, human
gcccagtgtgcgggagacgg

SEQ ID NO: 178079 - DNA, 20 bp, human
gcgattggcagaccacgagc

SEQ ID NO: 178080 - DNA, 20 bp, human
gtgcagagctgcgcgcccga

SEQ ID NO: 178081 - DNA, 20 bp, human
ggggccctgacagctccgat

SEQ ID NO: 178082 - DNA, 20 bp, human
gggaggtcagcgctgacctg

SEQ ID NO: 178083 - DNA, 20 bp, human
gaatgacagcgtccggacgt

SEQ ID NO: 178084 - DNA, 20 bp, human
gagagcagcgccgccgccgt

SEQ ID NO: 178085 - DNA, 20 bp, human
gccacgagcgggttcgagcg

SEQ ID NO: 178086 - DNA, 20 bp, human
gtacccacagaggaatgtgg

SEQ ID NO: 178087 - DNA, 20 bp, human
ggcctctctgggaccttagg

SEQ ID NO: 178088 - DNA, 20 bp, human
gtgtgtgctctatcagtatg

SEQ ID NO: 178089 - DNA, 20 bp, human
gtctgggaccttaggtggag

SEQ ID NO: 178090 - DNA, 20 bp, human
gtcattcatacacagagccc

SEQ ID NO: 178091 - DNA, 20 bp, human
gaccttcagccagctcattc

SEQ ID NO: 178092 - DNA, 20 bp, human
gcaggaggtcctatttggtc

SEQ ID NO: 178093 - DNA, 20 bp, human
gaggcacttgtatatctcaa

SEQ ID NO: 178094 - DNA, 20 bp, human
gtcattcatccagaatgagc

SEQ ID NO: 178095 - DNA, 20 bp, human
ggctgcatcctctccaccta

SEQ ID NO: 178096 - DNA, 20 bp, human
gcggcctccactagatggta

SEQ ID NO: 178097 - DNA, 20 bp, human
gctggacggcctccactaga

SEQ ID NO: 178098 - DNA, 20 bp, human
gtagatccaagagaaggtcc

SEQ ID NO: 178099 - DNA, 20 bp, human
gaaacccgagcatgaggagg

SEQ ID NO: 178100 - DNA, 20 bp, human
gggcctatagatccaagaga

SEQ ID NO: 178101 - DNA, 20 bp, human
gccgcagaagaccctgggag

SEQ ID NO: 178102 - DNA, 20 bp, human
ggatgaccgcagaagaccct

SEQ ID NO: 178103 - DNA, 20 bp, human
gcaaaaacccgagcatgagg

SEQ ID NO: 178104 - DNA, 20 bp, human
gtaatccagagaagccctgg

SEQ ID NO: 178105 - DNA, 20 bp, human
ggatccctaccatctagtgg

SEQ ID NO: 178106 - DNA, 20 bp, human
gtcagcgcgctacggtccgc

SEQ ID NO: 178107 - DNA, 20 bp, human
ggcggcgcgcttccttccca

SEQ ID NO: 178108 - DNA, 20 bp, human
gccgcaccggggccctaaga

SEQ ID NO: 178109 - DNA, 20 bp, human
ggcagccccggatccctggt

SEQ ID NO: 178110 - DNA, 20 bp, human
ggggaggggtcaggctgtcg

SEQ ID NO: 178111 - DNA, 20 bp, human
gggtgtcagggagaaattca

SEQ ID NO: 178112 - DNA, 20 bp, human
gcccggatccctggtaggtg

SEQ ID NO: 178113 - DNA, 20 bp, human
gcagcgccctcagcgcgcta

SEQ ID NO: 178114 - DNA, 20 bp, human
gctggggaggatcccgacag

SEQ ID NO: 178115 - DNA, 20 bp, human
ggcttctgcggagttgcccg

SEQ ID NO: 178116 - DNA, 20 bp, human
ggacaagcggcgacctccaa

SEQ ID NO: 178117 - DNA, 20 bp, human
gaggcaagtaccgggcgcta

SEQ ID NO: 178118 - DNA, 20 bp, human
gcggtccagctgtgagtcag

SEQ ID NO: 178119 - DNA, 20 bp, human
ggcagcgccacgtcccgggt

SEQ ID NO: 178120 - DNA, 20 bp, human
gcgctctcgctgggccagaa

SEQ ID NO: 178121 - DNA, 20 bp, human
ggcccagcgagagcgcccag

SEQ ID NO: 178122 - DNA, 20 bp, human
ggcagcagtccggcctcgag

SEQ ID NO: 178123 - DNA, 20 bp, human
gccacggcaaagcagcagtc

SEQ ID NO: 178124 - DNA, 20 bp, human
gaaaagccgcgggctgactg

SEQ ID NO: 178125 - DNA, 20 bp, human
ggtgggcgccaacagcagtc

SEQ ID NO: 178126 - DNA, 20 bp, human
gtcgtcccaggctgcaacgg

SEQ ID NO: 178127 - DNA, 20 bp, human
gtggccccgcccctcgtccc

SEQ ID NO: 178128 - DNA, 20 bp, human
gggcagagccaacgcctcgc

SEQ ID NO: 178129 - DNA, 20 bp, human
gcggcatcccgagaaggcgg

SEQ ID NO: 178130 - DNA, 20 bp, human
gcggccgcggcatcccgaga

SEQ ID NO: 178131 - DNA, 20 bp, human
gccgcggcatcccgagaagg

SEQ ID NO: 178132 - DNA, 20 bp, human
gacgcgttggagtgcgtacg

SEQ ID NO: 178133 - DNA, 20 bp, human
gcccggatgcgttcttctcc

SEQ ID NO: 178134 - DNA, 20 bp, human
gcgggatcagagcgaccctc

SEQ ID NO: 178135 - DNA, 20 bp, human
gctgatcccgaatctcccac

SEQ ID NO: 178136 - DNA, 20 bp, human
gccgaatcggcaactcagat

SEQ ID NO: 178137 - DNA, 20 bp, human
gggcggcggcacggccgata

SEQ ID NO: 178138 - DNA, 20 bp, human
gcccaaaggaaagcagtgag

SEQ ID NO: 178139 - DNA, 20 bp, human
gccctgaaggaagggactaa

SEQ ID NO: 178140 - DNA, 20 bp, human
gtcgtgggcgacgtgatctc

SEQ ID NO: 178141 - DNA, 20 bp, human
ggacgctgctagactaccag

SEQ ID NO: 178142 - DNA, 20 bp, human
gggaagggactaagggacgg

SEQ ID NO: 178143 - DNA, 20 bp, human
gtccgcaggatcggcttcgt

SEQ ID NO: 178144 - DNA, 20 bp, human
gtctagcagcgtctccatca

SEQ ID NO: 178145 - DNA, 20 bp, human
ggcccacgaagccgatcctg

SEQ ID NO: 178146 - DNA, 20 bp, human
gccgccagaccatactccag

SEQ ID NO: 178147 - DNA, 20 bp, human
gcggcctctggagtatggtc

SEQ ID NO: 178148 - DNA, 20 bp, human
gaggccagccaggacgagct

SEQ ID NO: 178149 - DNA, 20 bp, human
ggacccacactgaccaacac

SEQ ID NO: 178150 - DNA, 20 bp, human
gatactccagaggccgaccc

SEQ ID NO: 178151 - DNA, 20 bp, human
ggacgaaagtctaaacacaa

SEQ ID NO: 178152 - DNA, 20 bp, human
ggcccacagcatctgacccc

SEQ ID NO: 178153 - DNA, 20 bp, human
ggcctggggtcagatgctgt

SEQ ID NO: 178154 - DNA, 20 bp, human
gtctaaacacaatggagacg

SEQ ID NO: 178155 - DNA, 20 bp, human
gtcagtgtgggtcggtgctg

SEQ ID NO: 178156 - DNA, 20 bp, human
ggacgtgctctgccagccag

SEQ ID NO: 178157 - DNA, 20 bp, human
ggggagcgcgggaggatcgg

SEQ ID NO: 178158 - DNA, 20 bp, human
ggccgccccgcaagtacctg

SEQ ID NO: 178159 - DNA, 20 bp, human
gcgcgggagcgcgggaggat

SEQ ID NO: 178160 - DNA, 20 bp, human
gctcagagcgaggggaatcg

SEQ ID NO: 178161 - DNA, 20 bp, human
gaccgctgcgctctttacaa

SEQ ID NO: 178162 - DNA, 20 bp, human
ggcctttgtaaagagcgcag

SEQ ID NO: 178163 - DNA, 20 bp, human
gcgggtaagtgtgagccccg

SEQ ID NO: 178164 - DNA, 20 bp, human
gtctcccggctcagagcgag

SEQ ID NO: 178165 - DNA, 20 bp, human
ggaggggaatcgaggagact

SEQ ID NO: 178166 - DNA, 20 bp, human
gagggctgggagggctccta

SEQ ID NO: 178167 - DNA, 20 bp, human
gcagctgtgagctcttgaga

SEQ ID NO: 178168 - DNA, 20 bp, human
ggaccctgaaagaatccctc

SEQ ID NO: 178169 - DNA, 20 bp, human
gctggttggagcagagagta

SEQ ID NO: 178170 - DNA, 20 bp, human
gctcccagaaactaatatca

SEQ ID NO: 178171 - DNA, 20 bp, human
gcagccaggcctgacagcat

SEQ ID NO: 178172 - DNA, 20 bp, human
gcccaaaggctggatttgta

SEQ ID NO: 178173 - DNA, 20 bp, human
ggagagggagtaggctggtt

SEQ ID NO: 178174 - DNA, 20 bp, human
gcagatgtgccccggcaata

SEQ ID NO: 178175 - DNA, 20 bp, human
gggctggtttgggtagggct

SEQ ID NO: 178176 - DNA, 20 bp, human
gggccaggacacgctccctt

SEQ ID NO: 178177 - DNA, 20 bp, human
gacacgctcccttaggagag

SEQ ID NO: 178178 - DNA, 20 bp, human
gcgcagagggctggactcag

SEQ ID NO: 178179 - DNA, 20 bp, human
gatctcgggacgccagctca

SEQ ID NO: 178180 - DNA, 20 bp, human
gcgggcgggtcacaaggacc

SEQ ID NO: 178181 - DNA, 20 bp, human
gctcagggcggctgcgcaga

SEQ ID NO: 178182 - DNA, 20 bp, human
ggacccgcccgctctcctaa

SEQ ID NO: 178183 - DNA, 20 bp, human
gagagtgcgtcccgcactgg

SEQ ID NO: 178184 - DNA, 20 bp, human
gtcgcggcgccactgtacta

SEQ ID NO: 178185 - DNA, 20 bp, human
gctggactcagcggcggagc

SEQ ID NO: 178186 - DNA, 20 bp, human
gtacagtggctagaactccc

SEQ ID NO: 178187 - DNA, 20 bp, human
gggacttctccagaaataca

SEQ ID NO: 178188 - DNA, 20 bp, human
gctagaactccctggctcat

SEQ ID NO: 178189 - DNA, 20 bp, human
gcctacacccagaagtactt

SEQ ID NO: 178190 - DNA, 20 bp, human
gtgtgttgcgcaaatgccac

SEQ ID NO: 178191 - DNA, 20 bp, human
gttggaaatgtctaccatca

SEQ ID NO: 178192 - DNA, 20 bp, human
gaaactgaccaaagtacttc

SEQ ID NO: 178193 - DNA, 20 bp, human
gaaaagccccgagcattcaa

SEQ ID NO: 178194 - DNA, 20 bp, human
gcgatagtatctttttacag

SEQ ID NO: 178195 - DNA, 20 bp, human
ggaatcagacttgtgacatt

SEQ ID NO: 178196 - DNA, 20 bp, human
gatgggcgccacgaccccga

SEQ ID NO: 178197 - DNA, 20 bp, human
gagtcctgaggggagcgaga

SEQ ID NO: 178198 - DNA, 20 bp, human
gggcgacggtcagtcctgag

SEQ ID NO: 178199 - DNA, 20 bp, human
ggtgcacgagcgacaaaggg

SEQ ID NO: 178200 - DNA, 20 bp, human
gggcggcgacagcagaacag

SEQ ID NO: 178201 - DNA, 20 bp, human
ggacatactccgggtcgagg

SEQ ID NO: 178202 - DNA, 20 bp, human
gcaggtgcacgagcgacaaa

SEQ ID NO: 178203 - DNA, 20 bp, human
gtagcctccctctcaggacc

SEQ ID NO: 178204 - DNA, 20 bp, human
gtgagagggaggctaggcga

SEQ ID NO: 178205 - DNA, 20 bp, human
gccgagggcagagcggaccg

SEQ ID NO: 178206 - DNA, 20 bp, human
ggagggctccccaggcacgg

SEQ ID NO: 178207 - DNA, 20 bp, human
gagaggcaccggctagagct

SEQ ID NO: 178208 - DNA, 20 bp, human
ggcccctgcctggtcttgag

SEQ ID NO: 178209 - DNA, 20 bp, human
gagagctgggagcttgcgga

SEQ ID NO: 178210 - DNA, 20 bp, human
ggtcatccggaaaaagaaag

SEQ ID NO: 178211 - DNA, 20 bp, human
gccgtgagctggtgccggga

SEQ ID NO: 178212 - DNA, 20 bp, human
gccttcttcgtgctctccgg

SEQ ID NO: 178213 - DNA, 20 bp, human
gcagctcacggtctgttggg

SEQ ID NO: 178214 - DNA, 20 bp, human
gaccacatccgggactccgg

SEQ ID NO: 178215 - DNA, 20 bp, human
gtcagggatgccgggcccgg

SEQ ID NO: 178216 - DNA, 20 bp, human
gggatgagcgggccagacag

SEQ ID NO: 178217 - DNA, 20 bp, human
gcccgcggggtacatggctg

SEQ ID NO: 178218 - DNA, 20 bp, human
ggccaggaaccaggcgtaca

SEQ ID NO: 178219 - DNA, 20 bp, human
gccatcgagcgcgtcaaggg

SEQ ID NO: 178220 - DNA, 20 bp, human
ggccgcagccatgtaccccg

SEQ ID NO: 178221 - DNA, 20 bp, human
gcactcagcgcaagaagatg

SEQ ID NO: 178222 - DNA, 20 bp, human
gaggccatcgagcgcgtcaa

SEQ ID NO: 178223 - DNA, 20 bp, human
gatgcggctggccaacgagg

SEQ ID NO: 178224 - DNA, 20 bp, human
gtgccccgccccgagcggct

SEQ ID NO: 178225 - DNA, 20 bp, human
gccacacgcccagccgctcg

SEQ ID NO: 178226 - DNA, 20 bp, human
gggccggggcgtcccaccgc

SEQ ID NO: 178227 - DNA, 20 bp, human
gctcctccgcccgggacctc

SEQ ID NO: 178228 - DNA, 20 bp, human
gtggggcgttcaggtaacag

SEQ ID NO: 178229 - DNA, 20 bp, human
ggacgtggctctgaaaggtg

SEQ ID NO: 178230 - DNA, 20 bp, human
gtgccggcggtgggacgccc

SEQ ID NO: 178231 - DNA, 20 bp, human
gacccacacgaactgctcaa

SEQ ID NO: 178232 - DNA, 20 bp, human
ggcttggagcgggtctagta

SEQ ID NO: 178233 - DNA, 20 bp, human
gagctgtggctgccggcggt

SEQ ID NO: 178234 - DNA, 20 bp, human
ggcgggtctagtaaggcgaa

SEQ ID NO: 178235 - DNA, 20 bp, human
gtgcttccggccagaggtcc

SEQ ID NO: 178236 - DNA, 20 bp, human
gaagtgacgctttccgaggg

SEQ ID NO: 178237 - DNA, 20 bp, human
gctccagggtcgaagccata

SEQ ID NO: 178238 - DNA, 20 bp, human
gagcgggtctggatactcgg

SEQ ID NO: 178239 - DNA, 20 bp, human
gcttccccggcggtagggaa

SEQ ID NO: 178240 - DNA, 20 bp, human
gctgggaggcgacccttacc

SEQ ID NO: 178241 - DNA, 20 bp, human
gaaactgctgtcttccccgg

SEQ ID NO: 178242 - DNA, 20 bp, human
ggggaagacagcagtttctc

SEQ ID NO: 178243 - DNA, 20 bp, human
gcagccacgcagaacagacg

SEQ ID NO: 178244 - DNA, 20 bp, human
gcgggagcctcgccgggtaa

SEQ ID NO: 178245 - DNA, 20 bp, human
gtaacccttccctaccgccg

SEQ ID NO: 178246 - DNA, 20 bp, human
gcccctgggcccagatcagg

SEQ ID NO: 178247 - DNA, 20 bp, human
gttctgcccagagggcctac

SEQ ID NO: 178248 - DNA, 20 bp, human
gtgcagtcggctactttcag

SEQ ID NO: 178249 - DNA, 20 bp, human
gtctgggcagaagcatgcgc

SEQ ID NO: 178250 - DNA, 20 bp, human
gctgcttcctgtaggccctc

SEQ ID NO: 178251 - DNA, 20 bp, human
gtggtgtctcctcctgatct

SEQ ID NO: 178252 - DNA, 20 bp, human
ggctcccctcgcctcaggta

SEQ ID NO: 178253 - DNA, 20 bp, human
gaggccttacctgaggcgag

SEQ ID NO: 178254 - DNA, 20 bp, human
gagacttgggtgcttgtgta

SEQ ID NO: 178255 - DNA, 20 bp, human
gtagccgactgcagatagga

SEQ ID NO: 178256 - DNA, 20 bp, human
ggacagagaccctccacaga

SEQ ID NO: 178257 - DNA, 20 bp, human
ggataaacctctgtgtaaca

SEQ ID NO: 178258 - DNA, 20 bp, human
ggtcctgccttgttacacag

SEQ ID NO: 178259 - DNA, 20 bp, human
gatagacagactcctgggtc

SEQ ID NO: 178260 - DNA, 20 bp, human
gtatccagagactggtctgg

SEQ ID NO: 178261 - DNA, 20 bp, human
gttgacggttgaccggaccc

SEQ ID NO: 178262 - DNA, 20 bp, human
gggttctttggacattttga

SEQ ID NO: 178263 - DNA, 20 bp, human
gatatgaataacacccatag

SEQ ID NO: 178264 - DNA, 20 bp, human
gtcaccagaacaaattctcc

SEQ ID NO: 178265 - DNA, 20 bp, human
gtaagtggtcagataaattg

SEQ ID NO: 178266 - DNA, 20 bp, human
ggttctgttggcacccaatg

SEQ ID NO: 178267 - DNA, 20 bp, human
gtagttccaagggaagaatt

SEQ ID NO: 178268 - DNA, 20 bp, human
gaggcgttccttagttccaa

SEQ ID NO: 178269 - DNA, 20 bp, human
gtccaagggaagaattgggt

SEQ ID NO: 178270 - DNA, 20 bp, human
gaattgggtggggtccatgt

SEQ ID NO: 178271 - DNA, 20 bp, human
ggtattagtgctgctgggaa

SEQ ID NO: 178272 - DNA, 20 bp, human
gagcagcactaatacaaatc

SEQ ID NO: 178273 - DNA, 20 bp, human
gagcattacatacatcagtc

SEQ ID NO: 178274 - DNA, 20 bp, human
gcgcagattaggtagataga

SEQ ID NO: 178275 - DNA, 20 bp, human
gaaatatgaattctgagtag

SEQ ID NO: 178276 - DNA, 20 bp, human
gccggtgagacccgggaacg

SEQ ID NO: 178277 - DNA, 20 bp, human
gaacgcggcgcgggagacta

SEQ ID NO: 178278 - DNA, 20 bp, human
gtccgaagtggaactccctc

SEQ ID NO: 178279 - DNA, 20 bp, human
gcccctggctctaaaccggg

SEQ ID NO: 178280 - DNA, 20 bp, human
gagaagcccggaggagccac

SEQ ID NO: 178281 - DNA, 20 bp, human
ggatcctttcgaagctatgg

SEQ ID NO: 178282 - DNA, 20 bp, human
gagccaccggccctctggcg

SEQ ID NO: 178283 - DNA, 20 bp, human
ggcctgcgcgaagagcgagg

SEQ ID NO: 178284 - DNA, 20 bp, human
ggcgggagacccaagctgtg

SEQ ID NO: 178285 - DNA, 20 bp, human
gagcagtggtcggaattcac

SEQ ID NO: 178286 - DNA, 20 bp, human
gcagaagttggggtctccgt

SEQ ID NO: 178287 - DNA, 20 bp, human
gctggggctagaggatacag

SEQ ID NO: 178288 - DNA, 20 bp, human
ggcctcccgagaggctccag

SEQ ID NO: 178289 - DNA, 20 bp, human
gcagggcgccagaccaccac

SEQ ID NO: 178290 - DNA, 20 bp, human
gaggtgacctccaggaactg

SEQ ID NO: 178291 - DNA, 20 bp, human
ggcttccgctggagcctctc

SEQ ID NO: 178292 - DNA, 20 bp, human
gggctccagcggaagcacgt

SEQ ID NO: 178293 - DNA, 20 bp, human
gatcctctagccccaggggt

SEQ ID NO: 178294 - DNA, 20 bp, human
ggaggatacagaggactcac

SEQ ID NO: 178295 - DNA, 20 bp, human
gtgaggttagtggcccgtgg

SEQ ID NO: 178296 - DNA, 20 bp, human
gcgccggtggcgtgatggag

SEQ ID NO: 178297 - DNA, 20 bp, human
ggccagaggtacgggaagtg

SEQ ID NO: 178298 - DNA, 20 bp, human
ggcctcctagaaggaagata

SEQ ID NO: 178299 - DNA, 20 bp, human
gcgagaagctgaaacggaag

SEQ ID NO: 178300 - DNA, 20 bp, human
gcgagctctggacgctgagg

SEQ ID NO: 178301 - DNA, 20 bp, human
gaaaggaggcggacccgaca

SEQ ID NO: 178302 - DNA, 20 bp, human
gcggcaccgagaagctgaaa

SEQ ID NO: 178303 - DNA, 20 bp, human
ggagggtcgtgggaaggcca

SEQ ID NO: 178304 - DNA, 20 bp, human
gctgaaacggaagtggcgta

SEQ ID NO: 178305 - DNA, 20 bp, human
gtgccgctccatcacgccac

SEQ ID NO: 178306 - DNA, 20 bp, human
ggagccgaagccgccctcca

SEQ ID NO: 178307 - DNA, 20 bp, human
gggcgcacgcggcctcggtc

SEQ ID NO: 178308 - DNA, 20 bp, human
gccgcgacgtcggcccccag

SEQ ID NO: 178309 - DNA, 20 bp, human
ggcgcgtgcgcagactaacg

SEQ ID NO: 178310 - DNA, 20 bp, human
gcgtgcgcagactaacgggg

SEQ ID NO: 178311 - DNA, 20 bp, human
gggcgcagttagttacgagt

SEQ ID NO: 178312 - DNA, 20 bp, human
ggagccatggagggcggctt

SEQ ID NO: 178313 - DNA, 20 bp, human
gctgccggagcccccgaaat

SEQ ID NO: 178314 - DNA, 20 bp, human
ggagggcctagattcgaggg

SEQ ID NO: 178315 - DNA, 20 bp, human
gcgcaaagtcaaccggaccg

SEQ ID NO: 178316 - DNA, 20 bp, human
gacagggctaagaagccgac

SEQ ID NO: 178317 - DNA, 20 bp, human
gccggcatcactcgcggcat

SEQ ID NO: 178318 - DNA, 20 bp, human
gacagcggtgaagctcacca

SEQ ID NO: 178319 - DNA, 20 bp, human
gggagtacgcgcgagagcct

SEQ ID NO: 178320 - DNA, 20 bp, human
gcctggacaagggagaagga

SEQ ID NO: 178321 - DNA, 20 bp, human
ggcttgcccggcatcactcg

SEQ ID NO: 178322 - DNA, 20 bp, human
ggtcacctcgacgaacaggg

SEQ ID NO: 178323 - DNA, 20 bp, human
gtgttcgtcgaggtgacctt

SEQ ID NO: 178324 - DNA, 20 bp, human
gactgagcaaggcgagacgg

SEQ ID NO: 178325 - DNA, 20 bp, human
gcgcggcattggagtcaaga

SEQ ID NO: 178326 - DNA, 20 bp, human
gtccagttactttcaggctc

SEQ ID NO: 178327 - DNA, 20 bp, human
gatgagaccttctctcaacg

SEQ ID NO: 178328 - DNA, 20 bp, human
gacgctcgggagccctggta

SEQ ID NO: 178329 - DNA, 20 bp, human
gggagtacgctcgggagccc

SEQ ID NO: 178330 - DNA, 20 bp, human
gggagccctggtacggcaat

SEQ ID NO: 178331 - DNA, 20 bp, human
gctggtacggcaatgggcac

SEQ ID NO: 178332 - DNA, 20 bp, human
ggcgacctgggaaaaaccac

SEQ ID NO: 178333 - DNA, 20 bp, human
gggacggtggatgcttcccg

SEQ ID NO: 178334 - DNA, 20 bp, human
gtggttgtggcccctcataa

SEQ ID NO: 178335 - DNA, 20 bp, human
gaatgacaggaaccgagtgg

SEQ ID NO: 178336 - DNA, 20 bp, human
gataggcttgagtacgtgtc

SEQ ID NO: 178337 - DNA, 20 bp, human
gcgtatcccagttaagagcg

SEQ ID NO: 178338 - DNA, 20 bp, human
gactattcccaggaagacgg

SEQ ID NO: 178339 - DNA, 20 bp, human
ggaagcccacatctcaaact

SEQ ID NO: 178340 - DNA, 20 bp, human
gttcccaggtgactttgcga

SEQ ID NO: 178341 - DNA, 20 bp, human
ggacgatgctaactacaatt

SEQ ID NO: 178342 - DNA, 20 bp, human
gtgactttgcgaaggcatgg

SEQ ID NO: 178343 - DNA, 20 bp, human
gtgactccaagaatacatct

SEQ ID NO: 178344 - DNA, 20 bp, human
gctgtgaatgtcagcccaga

SEQ ID NO: 178345 - DNA, 20 bp, human
gagcccccgaaaagcaaagg

SEQ ID NO: 178346 - DNA, 20 bp, human
gggctcggcccctgagacag

SEQ ID NO: 178347 - DNA, 20 bp, human
gcggcggccgcccccaatgc

SEQ ID NO: 178348 - DNA, 20 bp, human
gtgggcagcgactgtcatgg

SEQ ID NO: 178349 - DNA, 20 bp, human
gaaggacgcgagggttgctt

SEQ ID NO: 178350 - DNA, 20 bp, human
ggcttgggcagcgactgtca

SEQ ID NO: 178351 - DNA, 20 bp, human
gcggccgcccccaatgccgg

SEQ ID NO: 178352 - DNA, 20 bp, human
gtactgcagcggagcttcgg

SEQ ID NO: 178353 - DNA, 20 bp, human
ggcagcgactgtcatggcgg

SEQ ID NO: 178354 - DNA, 20 bp, human
ggtctcaggggccgagcctc

SEQ ID NO: 178355 - DNA, 20 bp, human
gggcggaacccgctgtctca

SEQ ID NO: 178356 - DNA, 20 bp, human
gcagcgtgtgaagtaggcgc

SEQ ID NO: 178357 - DNA, 20 bp, human
ggggttacccgctgttattg

SEQ ID NO: 178358 - DNA, 20 bp, human
gggcgtcccgcgtaagtatg

SEQ ID NO: 178359 - DNA, 20 bp, human
gcgcgagtccaggtcaatca

SEQ ID NO: 178360 - DNA, 20 bp, human
gaagtaggcgctggcaacgc

SEQ ID NO: 178361 - DNA, 20 bp, human
gacggcccagcggaccaccc

SEQ ID NO: 178362 - DNA, 20 bp, human
gccgctgcctcaagcctggg

SEQ ID NO: 178363 - DNA, 20 bp, human
gttgaggagtaacggcccag

SEQ ID NO: 178364 - DNA, 20 bp, human
ggaaggtcagcgtgtgaagt

SEQ ID NO: 178365 - DNA, 20 bp, human
gaagggccacggatctcctg

SEQ ID NO: 178366 - DNA, 20 bp, human
ggggttacccgctgttattg

SEQ ID NO: 178367 - DNA, 20 bp, human
gggcgtcccgcgtaagtatg

SEQ ID NO: 178368 - DNA, 20 bp, human
ggaaggtcagcgtgtgaagt

SEQ ID NO: 178369 - DNA, 20 bp, human
gcgcgagtccaggtcaatca

SEQ ID NO: 178370 - DNA, 20 bp, human
gacggcccagcggaccaccc

SEQ ID NO: 178371 - DNA, 20 bp, human
gttgaggagtaacggcccag

SEQ ID NO: 178372 - DNA, 20 bp, human
gcagcgtgtgaagtaggcgc

SEQ ID NO: 178373 - DNA, 20 bp, human
ggaagtaggcgctggcaacg

SEQ ID NO: 178374 - DNA, 20 bp, human
gaagggccacggatctcctg

SEQ ID NO: 178375 - DNA, 20 bp, human
gccgctgcctcaagcctggg

SEQ ID NO: 178376 - DNA, 20 bp, human
ggtcacacgattctccaaca

SEQ ID NO: 178377 - DNA, 20 bp, human
ggccgctcacccgtggacag

SEQ ID NO: 178378 - DNA, 20 bp, human
gcccgtggaaaaaagtagag

SEQ ID NO: 178379 - DNA, 20 bp, human
gatgctctcggtagagaact

SEQ ID NO: 178380 - DNA, 20 bp, human
gcggcaccagccactccgca

SEQ ID NO: 178381 - DNA, 20 bp, human
gccacgggtgagcggcggtg

SEQ ID NO: 178382 - DNA, 20 bp, human
gacacgattctccaacatgg

SEQ ID NO: 178383 - DNA, 20 bp, human
gcgattctccaacatggcgg

SEQ ID NO: 178384 - DNA, 20 bp, human
gggagagagaatggtagccg

SEQ ID NO: 178385 - DNA, 20 bp, human
gcgatgcgcgggacctggga

SEQ ID NO: 178386 - DNA, 20 bp, human
gtccgggacgcctcacctca

SEQ ID NO: 178387 - DNA, 20 bp, human
ggcgtcccggaacccccaag

SEQ ID NO: 178388 - DNA, 20 bp, human
gtggcgtcagcgcaagatgg

SEQ ID NO: 178389 - DNA, 20 bp, human
gaagatggcggcctcggcag

SEQ ID NO: 178390 - DNA, 20 bp, human
gcagcgcaagatggcggcct

SEQ ID NO: 178391 - DNA, 20 bp, human
gtaactcccacggccagact

SEQ ID NO: 178392 - DNA, 20 bp, human
gtgggtctctgtcaacatgg

SEQ ID NO: 178393 - DNA, 20 bp, human
gggagtcccagtctggccgt

SEQ ID NO: 178394 - DNA, 20 bp, human
ggcgtggcgtcagcgcaaga

SEQ ID NO: 178395 - DNA, 20 bp, human
gctgagtggtcactgaaacg

SEQ ID NO: 178396 - DNA, 20 bp, human
gtaacatctcaacggcacct

SEQ ID NO: 178397 - DNA, 20 bp, human
gaaggctgggcgcaacggca

SEQ ID NO: 178398 - DNA, 20 bp, human
ggaaagtgctgggtgtccag

SEQ ID NO: 178399 - DNA, 20 bp, human
gaaacccgccgcggaggaag

SEQ ID NO: 178400 - DNA, 20 bp, human
gctcacgggggcggtcccag

SEQ ID NO: 178401 - DNA, 20 bp, human
ggcctagccggatgggagaa

SEQ ID NO: 178402 - DNA, 20 bp, human
gaagcttggtcgccctggga

SEQ ID NO: 178403 - DNA, 20 bp, human
gcccgcggtacaaggacaga

SEQ ID NO: 178404 - DNA, 20 bp, human
gctgcaagcttggtcgccct

SEQ ID NO: 178405 - DNA, 20 bp, human
gtcgggtgcctgaaagtgct

SEQ ID NO: 178406 - DNA, 20 bp, human
ggcgagcctgaggcgaacaa

SEQ ID NO: 178407 - DNA, 20 bp, human
ggctcactggtgctcgatcc

SEQ ID NO: 178408 - DNA, 20 bp, human
gagcctgaggcgaacaatgg

SEQ ID NO: 178409 - DNA, 20 bp, human
gctgggcgaagccgatgaag

SEQ ID NO: 178410 - DNA, 20 bp, human
ggttagccggcgacatgact

SEQ ID NO: 178411 - DNA, 20 bp, human
gctggacccctagactacag

SEQ ID NO: 178412 - DNA, 20 bp, human
gcgctcggaggtctgtacac

SEQ ID NO: 178413 - DNA, 20 bp, human
gactaccggtcaccagggac

SEQ ID NO: 178414 - DNA, 20 bp, human
gtgagcactaccggtcacca

SEQ ID NO: 178415 - DNA, 20 bp, human
ggccggcgacatgactgggc

SEQ ID NO: 178416 - DNA, 20 bp, human
gggaggccgccgcacgtacc

SEQ ID NO: 178417 - DNA, 20 bp, human
gccagatgggaaagaacacg

SEQ ID NO: 178418 - DNA, 20 bp, human
gggttgagccttgggaggga

SEQ ID NO: 178419 - DNA, 20 bp, human
gtaaaggaggatcttccccc

SEQ ID NO: 178420 - DNA, 20 bp, human
gggagccgcggccgccagat

SEQ ID NO: 178421 - DNA, 20 bp, human
gagggtctggacaggagccg

SEQ ID NO: 178422 - DNA, 20 bp, human
gcgggaaccccggattctca

SEQ ID NO: 178423 - DNA, 20 bp, human
gcacccccaacccggatctg

SEQ ID NO: 178424 - DNA, 20 bp, human
gggaaggtctgcacccgacc

SEQ ID NO: 178425 - DNA, 20 bp, human
ggggacggttgagccttggg

SEQ ID NO: 178426 - DNA, 20 bp, human
gtctggcagagggttaacct

SEQ ID NO: 178427 - DNA, 20 bp, human
gaagcggtgtcctgcagcgt

SEQ ID NO: 178428 - DNA, 20 bp, human
gtagggtgtgaagtggggta

SEQ ID NO: 178429 - DNA, 20 bp, human
gttccaaggactccaaagcg

SEQ ID NO: 178430 - DNA, 20 bp, human
gggtgtcctaaggctgaccc

SEQ ID NO: 178431 - DNA, 20 bp, human
gagctccgcggtgccggtgg

SEQ ID NO: 178432 - DNA, 20 bp, human
ggccatggaggtgccgccac

SEQ ID NO: 178433 - DNA, 20 bp, human
gaatagggctctgggacgta

SEQ ID NO: 178434 - DNA, 20 bp, human
ggggagagcgtaactgtacg

SEQ ID NO: 178435 - DNA, 20 bp, human
gaggactccaaagcgaggcc

SEQ ID NO: 178436 - DNA, 20 bp, human
ggcgcccagagagacaccag

SEQ ID NO: 178437 - DNA, 20 bp, human
gcccgggccctgcttacctc

SEQ ID NO: 178438 - DNA, 20 bp, human
ggagacaccagaggtaagca

SEQ ID NO: 178439 - DNA, 20 bp, human
ggctggatctgcggcgatgg

SEQ ID NO: 178440 - DNA, 20 bp, human
ggcggatgtcaggggttcta

SEQ ID NO: 178441 - DNA, 20 bp, human
gttacctctggtgtctctct

SEQ ID NO: 178442 - DNA, 20 bp, human
gtctctgggcgctggatctg

SEQ ID NO: 178443 - DNA, 20 bp, human
ggggagtttggaggttgaag

SEQ ID NO: 178444 - DNA, 20 bp, human
gggcagggcctgagcgctag

SEQ ID NO: 178445 - DNA, 20 bp, human
gccaagctgcagcccagctc

SEQ ID NO: 178446 - DNA, 20 bp, human
gccgccatggagagtgtctg

SEQ ID NO: 178447 - DNA, 20 bp, human
gtagacgaaccggatgtcag

SEQ ID NO: 178448 - DNA, 20 bp, human
gaggggatgccgctgacatc

SEQ ID NO: 178449 - DNA, 20 bp, human
gtgtctgcggatacttccac

SEQ ID NO: 178450 - DNA, 20 bp, human
gcccgggaaggatctcccgt

SEQ ID NO: 178451 - DNA, 20 bp, human
gagggacacagaatagccag

SEQ ID NO: 178452 - DNA, 20 bp, human
gaatgagaaactcctcgctg

SEQ ID NO: 178453 - DNA, 20 bp, human
ggggccattccctaaatcgt

SEQ ID NO: 178454 - DNA, 20 bp, human
gtgagctgccaagctgccaa

SEQ ID NO: 178455 - DNA, 20 bp, human
gccccagggactggttggtg

SEQ ID NO: 178456 - DNA, 20 bp, human
gtgcagatgtaggtaaggag

SEQ ID NO: 178457 - DNA, 20 bp, human
ggcggcgctgcggttctcgg

SEQ ID NO: 178458 - DNA, 20 bp, human
gcagcgcccggaccccccag

SEQ ID NO: 178459 - DNA, 20 bp, human
ggtccgggcgctgctcgcgg

SEQ ID NO: 178460 - DNA, 20 bp, human
ggcctgttgcgggtgcaccg

SEQ ID NO: 178461 - DNA, 20 bp, human
ggggcgtctgcgaaccctcg

SEQ ID NO: 178462 - DNA, 20 bp, human
gacatccgtagaaggcagcg

SEQ ID NO: 178463 - DNA, 20 bp, human
gcgagcggcgctgcggttct

SEQ ID NO: 178464 - DNA, 20 bp, human
gtccccggtgcacccgcaac

SEQ ID NO: 178465 - DNA, 20 bp, human
gcgttttgcaatgcagatgt

SEQ ID NO: 178466 - DNA, 20 bp, human
gactgcagcgctgcttaggg

SEQ ID NO: 178467 - DNA, 20 bp, human
ggcgcacggcaactttggag

SEQ ID NO: 178468 - DNA, 20 bp, human
ggcgctggcgcaggactcgg

SEQ ID NO: 178469 - DNA, 20 bp, human
gcaggagcgcttaccgatgt

SEQ ID NO: 178470 - DNA, 20 bp, human
gagcgctgcttagggaggca

SEQ ID NO: 178471 - DNA, 20 bp, human
gggcctcccggcgaaggagc

SEQ ID NO: 178472 - DNA, 20 bp, human
gtcggcgctggcgcaggact

SEQ ID NO: 178473 - DNA, 20 bp, human
gccggcgggcgagcgagctc

SEQ ID NO: 178474 - DNA, 20 bp, human
gctgcagcgtggggctcggg

SEQ ID NO: 178475 - DNA, 20 bp, human
gagttgcagaaggcgtcctg

SEQ ID NO: 178476 - DNA, 20 bp, human
gcctggggcgaggggcacaa

SEQ ID NO: 178477 - DNA, 20 bp, human
gggccacctcataaagcctg

SEQ ID NO: 178478 - DNA, 20 bp, human
gggagtgagggaggtcgcta

SEQ ID NO: 178479 - DNA, 20 bp, human
gggactggacggccccagca

SEQ ID NO: 178480 - DNA, 20 bp, human
ggacctcacaggctcagtcg

SEQ ID NO: 178481 - DNA, 20 bp, human
gggactcaccaagtgccgag

SEQ ID NO: 178482 - DNA, 20 bp, human
gagtatggccggagtgaggg

SEQ ID NO: 178483 - DNA, 20 bp, human
gtgcagtatggccggagtga

SEQ ID NO: 178484 - DNA, 20 bp, human
gtcataaagcctggggcgag

SEQ ID NO: 178485 - DNA, 20 bp, human
gatgcctcacccagccccgg

SEQ ID NO: 178486 - DNA, 20 bp, human
gactcaggtggagagaacta

SEQ ID NO: 178487 - DNA, 20 bp, human
gggagaagcccacaaggcta

SEQ ID NO: 178488 - DNA, 20 bp, human
ggccttggtatccagaaggt

SEQ ID NO: 178489 - DNA, 20 bp, human
gagaactaaggtcaccctca

SEQ ID NO: 178490 - DNA, 20 bp, human
gcaaagagaagtggacctag

SEQ ID NO: 178491 - DNA, 20 bp, human
gcacagccttggtatccaga

SEQ ID NO: 178492 - DNA, 20 bp, human
ggaacatccaggctctcatg

SEQ ID NO: 178493 - DNA, 20 bp, human
gccaatacccttagccttgt

SEQ ID NO: 178494 - DNA, 20 bp, human
ggctgccttcaagatactga

SEQ ID NO: 178495 - DNA, 20 bp, human
ggactagaattcaggttcca

SEQ ID NO: 178496 - DNA, 20 bp, human
gccctacctggtgaaggtgt

SEQ ID NO: 178497 - DNA, 20 bp, human
gcggcggtcgcagagccagg

SEQ ID NO: 178498 - DNA, 20 bp, human
gccctgcctaggtcagggag

SEQ ID NO: 178499 - DNA, 20 bp, human
gggtgtacccaaaagaccgg

SEQ ID NO: 178500 - DNA, 20 bp, human
gacctaggcagggaccttca

SEQ ID NO: 178501 - DNA, 20 bp, human
ggtgtgggccctggctatag

SEQ ID NO: 178502 - DNA, 20 bp, human
ggcccacaccttcaccaggt

SEQ ID NO: 178503 - DNA, 20 bp, human
gtagccagggcccacacact

SEQ ID NO: 178504 - DNA, 20 bp, human
ggcaggggagcgtccctacc

SEQ ID NO: 178505 - DNA, 20 bp, human
gcttgactttgagcgtccgg

SEQ ID NO: 178506 - DNA, 20 bp, human
gaccctcgggctcgagacag

SEQ ID NO: 178507 - DNA, 20 bp, human
gccggaagtgaggcaccctc

SEQ ID NO: 178508 - DNA, 20 bp, human
gagaagctgaccgtctccag

SEQ ID NO: 178509 - DNA, 20 bp, human
gcggtagcgaaccaagccag

SEQ ID NO: 178510 - DNA, 20 bp, human
ggggcaagggaagctagtag

SEQ ID NO: 178511 - DNA, 20 bp, human
ggccgctgtctcgagcccga

SEQ ID NO: 178512 - DNA, 20 bp, human
gcctatagtgcgggatccca

SEQ ID NO: 178513 - DNA, 20 bp, human
ggacccagtgccactggaga

SEQ ID NO: 178514 - DNA, 20 bp, human
gggatgcgagcacctgacaa

SEQ ID NO: 178515 - DNA, 20 bp, human
gccgacagaccggagcgaca

SEQ ID NO: 178516 - DNA, 20 bp, human
ggctccgggagggcactgag

SEQ ID NO: 178517 - DNA, 20 bp, human
gggaccacagagccgcgacg

SEQ ID NO: 178518 - DNA, 20 bp, human
gcttaggcacttagagcctg

SEQ ID NO: 178519 - DNA, 20 bp, human
ggcgctcgcactccccgcta

SEQ ID NO: 178520 - DNA, 20 bp, human
gcaggtaaagggctccggga

SEQ ID NO: 178521 - DNA, 20 bp, human
gaccctgacgaacggggaag

SEQ ID NO: 178522 - DNA, 20 bp, human
gctctgtggtccctagacgt

SEQ ID NO: 178523 - DNA, 20 bp, human
ggacgcggcgagccgcgcac

SEQ ID NO: 178524 - DNA, 20 bp, human
gatcgaggtgacaggcgagc

SEQ ID NO: 178525 - DNA, 20 bp, human
gccacttaaagcagagatcg

SEQ ID NO: 178526 - DNA, 20 bp, human
ggcgatactcgggaactcct

SEQ ID NO: 178527 - DNA, 20 bp, human
gggaactcctggggcgagaa

SEQ ID NO: 178528 - DNA, 20 bp, human
gcacctcacgcagaaaacac

SEQ ID NO: 178529 - DNA, 20 bp, human
gatgaagttgaagagagggt

SEQ ID NO: 178530 - DNA, 20 bp, human
ggcacccaagggggacatcg

SEQ ID NO: 178531 - DNA, 20 bp, human
gggcggggaacgaggatgag

SEQ ID NO: 178532 - DNA, 20 bp, human
gttctgcgtgaggtgagagc

SEQ ID NO: 178533 - DNA, 20 bp, human
ggagccagatggaagagcca

SEQ ID NO: 178534 - DNA, 20 bp, human
gtaccccaggcttctgtccg

SEQ ID NO: 178535 - DNA, 20 bp, human
ggttgaagagagggtaggcg

SEQ ID NO: 178536 - DNA, 20 bp, human
gtgcttcagcttattccttg

SEQ ID NO: 178537 - DNA, 20 bp, human
gttattccttgtggcctctg

SEQ ID NO: 178538 - DNA, 20 bp, human
gaacggctcggaagcctagg

SEQ ID NO: 178539 - DNA, 20 bp, human
ggaataagctgaagcagcgg

SEQ ID NO: 178540 - DNA, 20 bp, human
ggcggggccgggcatggtaa

SEQ ID NO: 178541 - DNA, 20 bp, human
gtaagctgaagcagcggcgg

SEQ ID NO: 178542 - DNA, 20 bp, human
gcggcggatgtggagaagtg

SEQ ID NO: 178543 - DNA, 20 bp, human
gcctccgcctcagggaaaag

SEQ ID NO: 178544 - DNA, 20 bp, human
gtggaagccgtggatcatca

SEQ ID NO: 178545 - DNA, 20 bp, human
gggtaacggctcggaagcct

SEQ ID NO: 178546 - DNA, 20 bp, human
gcagggcaaggccggaccag

SEQ ID NO: 178547 - DNA, 20 bp, human
ggcgggcccagttgcgatga

SEQ ID NO: 178548 - DNA, 20 bp, human
gcggagcagagaagaacgtg

SEQ ID NO: 178549 - DNA, 20 bp, human
gtagggtcagggacctatcg

SEQ ID NO: 178550 - DNA, 20 bp, human
gggcattacaccacagtcat

SEQ ID NO: 178551 - DNA, 20 bp, human
gggcaaggccggaccagagg

SEQ ID NO: 178552 - DNA, 20 bp, human
gatgacaacccgaagagcag

SEQ ID NO: 178553 - DNA, 20 bp, human
ggccccaccgagagccgcag

SEQ ID NO: 178554 - DNA, 20 bp, human
gcgtgttgcgggtgccagaa

SEQ ID NO: 178555 - DNA, 20 bp, human
ggtgcgcgccgcctctggtc

SEQ ID NO: 178556 - DNA, 20 bp, human
gctagtagagtgggatagtg

SEQ ID NO: 178557 - DNA, 20 bp, human
gggtccagtggcagccctag

SEQ ID NO: 178558 - DNA, 20 bp, human
gtggccggccagatacagtc

SEQ ID NO: 178559 - DNA, 20 bp, human
gggcctgccccgcggcaaga

SEQ ID NO: 178560 - DNA, 20 bp, human
gatgccgggcagatctgcta

SEQ ID NO: 178561 - DNA, 20 bp, human
ggggctgccactggacccta

SEQ ID NO: 178562 - DNA, 20 bp, human
gaatggagtaaggtccgagg

SEQ ID NO: 178563 - DNA, 20 bp, human
ggagagatctggaggatgcc

SEQ ID NO: 178564 - DNA, 20 bp, human
gcggcggaaagtttgttgtg

SEQ ID NO: 178565 - DNA, 20 bp, human
gtggccggccagaggggaaa

SEQ ID NO: 178566 - DNA, 20 bp, human
gtggggaacaggcgagatag

SEQ ID NO: 178567 - DNA, 20 bp, human
ggaggacggctgttggagaa

SEQ ID NO: 178568 - DNA, 20 bp, human
gtggctgaggtcagactcac

SEQ ID NO: 178569 - DNA, 20 bp, human
ggcagttagcgacagactca

SEQ ID NO: 178570 - DNA, 20 bp, human
gcaccccagggcaggttagc

SEQ ID NO: 178571 - DNA, 20 bp, human
gctcaggcaaaaagcctctc

SEQ ID NO: 178572 - DNA, 20 bp, human
gcagcctggcagcagtgttt

SEQ ID NO: 178573 - DNA, 20 bp, human
ggatgggagaaagcccctga

SEQ ID NO: 178574 - DNA, 20 bp, human
ggtgtgcagtgtgtcccctt

SEQ ID NO: 178575 - DNA, 20 bp, human
ggcactccccctgccaacca

SEQ ID NO: 178576 - DNA, 20 bp, human
ggccggcgccggcaactcag

SEQ ID NO: 178577 - DNA, 20 bp, human
gcggcggccgccaaggaacg

SEQ ID NO: 178578 - DNA, 20 bp, human
gcctcggacccgaaactccg

SEQ ID NO: 178579 - DNA, 20 bp, human
gacgcgggccagatgccggt

SEQ ID NO: 178580 - DNA, 20 bp, human
ggccgcggaggcgctcacct

SEQ ID NO: 178581 - DNA, 20 bp, human
ggacagccgccagcgaggga

SEQ ID NO: 178582 - DNA, 20 bp, human
gcggttcccgggaagttacg

SEQ ID NO: 178583 - DNA, 20 bp, human
gggcgcccggccgccgtact

SEQ ID NO: 178584 - DNA, 20 bp, human
gagcgccgcgcgaggctcct

SEQ ID NO: 178585 - DNA, 20 bp, human
ggctggaagccggctctcag

SEQ ID NO: 178586 - DNA, 20 bp, human
ggggtcggcaccccggcggt

SEQ ID NO: 178587 - DNA, 20 bp, human
gtgcgggtcagagcactgtc

SEQ ID NO: 178588 - DNA, 20 bp, human
ggggtcagagcactgtccgg

SEQ ID NO: 178589 - DNA, 20 bp, human
gtcacttgggctggagatta

SEQ ID NO: 178590 - DNA, 20 bp, human
gccgcgggtcggcaccccgg

SEQ ID NO: 178591 - DNA, 20 bp, human
gatccggacgtgggacgcag

SEQ ID NO: 178592 - DNA, 20 bp, human
ggagattaaggcgcgagtag

SEQ ID NO: 178593 - DNA, 20 bp, human
gccaaccgcgcggcacaagg

SEQ ID NO: 178594 - DNA, 20 bp, human
gtgatgactcgtggcctccg

SEQ ID NO: 178595 - DNA, 20 bp, human
gtccccgcgggtcggcaccc

SEQ ID NO: 178596 - DNA, 20 bp, human
gaagctccccgggaatggga

SEQ ID NO: 178597 - DNA, 20 bp, human
gtatacgggagcagccgcgg

SEQ ID NO: 178598 - DNA, 20 bp, human
gtaatatacgggagcagccg

SEQ ID NO: 178599 - DNA, 20 bp, human
gcgcctgcacaaacgaccca

SEQ ID NO: 178600 - DNA, 20 bp, human
ggggaatgggagggcgccag

SEQ ID NO: 178601 - DNA, 20 bp, human
gactctgcagagaaacctag

SEQ ID NO: 178602 - DNA, 20 bp, human
gcgggaagctccccgggaat

SEQ ID NO: 178603 - DNA, 20 bp, human
gggccaaagtcgggacagga

SEQ ID NO: 178604 - DNA, 20 bp, human
gcccgaatcacaataatata

SEQ ID NO: 178605 - DNA, 20 bp, human
gaaacgggttgacatcccct

SEQ ID NO: 178606 - DNA, 20 bp, human
gcgggagctgcggagctgga

SEQ ID NO: 178607 - DNA, 20 bp, human
gcaggtgcagccgggagctg

SEQ ID NO: 178608 - DNA, 20 bp, human
gcaggcgagtaaccctccaa

SEQ ID NO: 178609 - DNA, 20 bp, human
gagccctgcggtattaaagg

SEQ ID NO: 178610 - DNA, 20 bp, human
gggatttgaacccagccctg

SEQ ID NO: 178611 - DNA, 20 bp, human
ggcgagtaaccctccaaggg

SEQ ID NO: 178612 - DNA, 20 bp, human
gttaaaggaggccggtcctg

SEQ ID NO: 178613 - DNA, 20 bp, human
ggagagtcacagcgggctga

SEQ ID NO: 178614 - DNA, 20 bp, human
gcacgttacacacagcatag

SEQ ID NO: 178615 - DNA, 20 bp, human
gtcacagcgggctgagggcc

SEQ ID NO: 178616 - DNA, 20 bp, human
ggtcgcaaggtgccctcacg

SEQ ID NO: 178617 - DNA, 20 bp, human
ggccctcacgtgggagcaac

SEQ ID NO: 178618 - DNA, 20 bp, human
gtcttgtggtggcaacaggg

SEQ ID NO: 178619 - DNA, 20 bp, human
gctgtggtcgtcagttccac

SEQ ID NO: 178620 - DNA, 20 bp, human
gtgggtggaaaagcacagtg

SEQ ID NO: 178621 - DNA, 20 bp, human
ggacacagggagacggacca

SEQ ID NO: 178622 - DNA, 20 bp, human
ggaggcaggtcccctgccag

SEQ ID NO: 178623 - DNA, 20 bp, human
gactgacgaccacagacaca

SEQ ID NO: 178624 - DNA, 20 bp, human
gtcgtcagttccactggcag

SEQ ID NO: 178625 - DNA, 20 bp, human
ggtccgtctccctgtgtctg

SEQ ID NO: 178626 - DNA, 20 bp, human
gacggccttggagagtactc

SEQ ID NO: 178627 - DNA, 20 bp, human
gcggtcggcgcgggaaccag

SEQ ID NO: 178628 - DNA, 20 bp, human
gcctcctggactgaattcaa

SEQ ID NO: 178629 - DNA, 20 bp, human
ggggttcgtgaacttcccgg

SEQ ID NO: 178630 - DNA, 20 bp, human
gcctggactgaattcaaggg

SEQ ID NO: 178631 - DNA, 20 bp, human
gcaccccaggcgggagctgt

SEQ ID NO: 178632 - DNA, 20 bp, human
gctcgggttcgtgaacttcc

SEQ ID NO: 178633 - DNA, 20 bp, human
ggggaaccaggggcttactg

SEQ ID NO: 178634 - DNA, 20 bp, human
gggctgtgctggtccttcta

SEQ ID NO: 178635 - DNA, 20 bp, human
gccaggggcttactgcggga

SEQ ID NO: 178636 - DNA, 20 bp, human
ggccgggcgagcggatccag

SEQ ID NO: 178637 - DNA, 20 bp, human
gcggccacagcagcatagcc

SEQ ID NO: 178638 - DNA, 20 bp, human
gtcgcacaagaaggaacccc

SEQ ID NO: 178639 - DNA, 20 bp, human
gagcagcatagccgggcgag

SEQ ID NO: 178640 - DNA, 20 bp, human
gcgagcggatccagaggccc

SEQ ID NO: 178641 - DNA, 20 bp, human
gggagtaggtgggcgcatag

SEQ ID NO: 178642 - DNA, 20 bp, human
gccccaaggtcgaaagaatc

SEQ ID NO: 178643 - DNA, 20 bp, human
gatcgggacaggaaatgggt

SEQ ID NO: 178644 - DNA, 20 bp, human
gcgaggggccgggagtaggt

SEQ ID NO: 178645 - DNA, 20 bp, human
gcgcgccgactcgcacaaga

SEQ ID NO: 178646 - DNA, 20 bp, human
ggagatagcggctgctcccg

SEQ ID NO: 178647 - DNA, 20 bp, human
gcggttggccgtgtccttca

SEQ ID NO: 178648 - DNA, 20 bp, human
ggaggcgcacggaggaccag

SEQ ID NO: 178649 - DNA, 20 bp, human
gcggggaccgggcgcacacg

SEQ ID NO: 178650 - DNA, 20 bp, human
ggcacactcgccctacgccc

SEQ ID NO: 178651 - DNA, 20 bp, human
ggccggcctgaggcgcacgg

SEQ ID NO: 178652 - DNA, 20 bp, human
gcgggccaccttcctcgtct

SEQ ID NO: 178653 - DNA, 20 bp, human
ggtccccgcctgccgcacca

SEQ ID NO: 178654 - DNA, 20 bp, human
ggatccgcgtggggaagagc

SEQ ID NO: 178655 - DNA, 20 bp, human
ggctgcgagatgcctagacg

SEQ ID NO: 178656 - DNA, 20 bp, human
gctgtcagagggctctgtat

SEQ ID NO: 178657 - DNA, 20 bp, human
gtagatgctggcgaaggcca

SEQ ID NO: 178658 - DNA, 20 bp, human
gggagacggggagctgtcag

SEQ ID NO: 178659 - DNA, 20 bp, human
gtcagagggctctgtatggg

SEQ ID NO: 178660 - DNA, 20 bp, human
gtataagctggacaaccttg

SEQ ID NO: 178661 - DNA, 20 bp, human
ggctgacgtgagatggtgtg

SEQ ID NO: 178662 - DNA, 20 bp, human
gcagtggggccgggtcactc

SEQ ID NO: 178663 - DNA, 20 bp, human
ggagggttcttgagggatgg

SEQ ID NO: 178664 - DNA, 20 bp, human
gaggatgtatagctgcggag

SEQ ID NO: 178665 - DNA, 20 bp, human
ggaggaaggagggttcttga

SEQ ID NO: 178666 - DNA, 20 bp, human
gcttcagacgccggagacgt

SEQ ID NO: 178667 - DNA, 20 bp, human
gacgccggagacgtaggagt

SEQ ID NO: 178668 - DNA, 20 bp, human
gaggaggccagacctgacag

SEQ ID NO: 178669 - DNA, 20 bp, human
gtggccgtgggtaaattgag

SEQ ID NO: 178670 - DNA, 20 bp, human
ggccattagtccaacccctt

SEQ ID NO: 178671 - DNA, 20 bp, human
gagacccactcctacgtctc

SEQ ID NO: 178672 - DNA, 20 bp, human
ggggtcttcagactccaaag

SEQ ID NO: 178673 - DNA, 20 bp, human
gcccggtcgagcaccctaga

SEQ ID NO: 178674 - DNA, 20 bp, human
gccggcgtctgaagagcgaa

SEQ ID NO: 178675 - DNA, 20 bp, human
gatctccagttgggagacaa

SEQ ID NO: 178676 - DNA, 20 bp, human
gggattcgccatctcccata

SEQ ID NO: 178677 - DNA, 20 bp, human
ggtacctaatccctgaccta

SEQ ID NO: 178678 - DNA, 20 bp, human
gcctgcacggtcttcacgtc

SEQ ID NO: 178679 - DNA, 20 bp, human
gacgtggcaacagggtccct

SEQ ID NO: 178680 - DNA, 20 bp, human
gccggtagctggccttgtca

SEQ ID NO: 178681 - DNA, 20 bp, human
gctgccgcggtgggttgtgg

SEQ ID NO: 178682 - DNA, 20 bp, human
ggcacccccacaacccaccg

SEQ ID NO: 178683 - DNA, 20 bp, human
ggtgagctggccagaaccag

SEQ ID NO: 178684 - DNA, 20 bp, human
gcatgtggaatggcttatac

SEQ ID NO: 178685 - DNA, 20 bp, human
ggcaacagggtccctaggtc

SEQ ID NO: 178686 - DNA, 20 bp, human
gttcccagaacagacctagg

SEQ ID NO: 178687 - DNA, 20 bp, human
ggggaaccgggatccctctc

SEQ ID NO: 178688 - DNA, 20 bp, human
ggcccgccagtgagcgatgg

SEQ ID NO: 178689 - DNA, 20 bp, human
gctgactgggaagctaagag

SEQ ID NO: 178690 - DNA, 20 bp, human
gctctcgggccagtccaggc

SEQ ID NO: 178691 - DNA, 20 bp, human
gaggagccaaggggcctaga

SEQ ID NO: 178692 - DNA, 20 bp, human
gagaggcggccggcctggac

SEQ ID NO: 178693 - DNA, 20 bp, human
gtaggaggcggcctcgaggg

SEQ ID NO: 178694 - DNA, 20 bp, human
gatccctctcgggccagtcc

SEQ ID NO: 178695 - DNA, 20 bp, human
gcgcgcacgtgcacgggtag

SEQ ID NO: 178696 - DNA, 20 bp, human
gcatctgagggtacagtgac

SEQ ID NO: 178697 - DNA, 20 bp, human
gcgcgctctcggccgggact

SEQ ID NO: 178698 - DNA, 20 bp, human
gggaaacgggttcccagtcc

SEQ ID NO: 178699 - DNA, 20 bp, human
ggagtccgggtcggtcccct

SEQ ID NO: 178700 - DNA, 20 bp, human
gggcgccgaggggaccgacc

SEQ ID NO: 178701 - DNA, 20 bp, human
gcggcgcccgcgctctcggc

SEQ ID NO: 178702 - DNA, 20 bp, human
gggttgcggggagtccgggt

SEQ ID NO: 178703 - DNA, 20 bp, human
gggggtcggcggccatctga

SEQ ID NO: 178704 - DNA, 20 bp, human
gtggccgccgaccccatcca

SEQ ID NO: 178705 - DNA, 20 bp, human
ggagagcaggctgtgcgcca

SEQ ID NO: 178706 - DNA, 20 bp, human
ggtccggtccagcagcccac

SEQ ID NO: 178707 - DNA, 20 bp, human
ggctctcgagaggagcccgt

SEQ ID NO: 178708 - DNA, 20 bp, human
gtgtagacgcggaaagggag

SEQ ID NO: 178709 - DNA, 20 bp, human
gagactcgcctcctccgtgg

SEQ ID NO: 178710 - DNA, 20 bp, human
gagcccgtgggctgctggac

SEQ ID NO: 178711 - DNA, 20 bp, human
gtgtggtcaaggtaagaggg

SEQ ID NO: 178712 - DNA, 20 bp, human
ggaccggaccggacagcacc

SEQ ID NO: 178713 - DNA, 20 bp, human
gtcgcagtgagctgacccag

SEQ ID NO: 178714 - DNA, 20 bp, human
ggcctgtgtagacgcggaaa

SEQ ID NO: 178715 - DNA, 20 bp, human
gaggccagccgtgttgaagg

SEQ ID NO: 178716 - DNA, 20 bp, human
gggaagaagagacctctcaa

SEQ ID NO: 178717 - DNA, 20 bp, human
gcagccgagtgtaacgccag

SEQ ID NO: 178718 - DNA, 20 bp, human
gccgagtgtaacgccagcgg

SEQ ID NO: 178719 - DNA, 20 bp, human
gcgttacactcggctggtaa

SEQ ID NO: 178720 - DNA, 20 bp, human
gctatcagcgcttccttcct

SEQ ID NO: 178721 - DNA, 20 bp, human
gctgcaaggtcattgtgtgg

SEQ ID NO: 178722 - DNA, 20 bp, human
gggactgactcaggaacatg

SEQ ID NO: 178723 - DNA, 20 bp, human
gccatctctcagcccttgag

SEQ ID NO: 178724 - DNA, 20 bp, human
gcctgctccaaggttctcaa

SEQ ID NO: 178725 - DNA, 20 bp, human
gaggattcactcactgccca

SEQ ID NO: 178726 - DNA, 20 bp, human
gtcgccctgcacggccggac

SEQ ID NO: 178727 - DNA, 20 bp, human
gttaatgtaagcggcgcgag

SEQ ID NO: 178728 - DNA, 20 bp, human
gtctgtgccccgcgtcccgg

SEQ ID NO: 178729 - DNA, 20 bp, human
ggggtccggagcggccggtc

SEQ ID NO: 178730 - DNA, 20 bp, human
ggtaagcggcgcgagaggcg

SEQ ID NO: 178731 - DNA, 20 bp, human
gaaccgcgtgttaatgtaag

SEQ ID NO: 178732 - DNA, 20 bp, human
gccagagtagtcacagcggt

SEQ ID NO: 178733 - DNA, 20 bp, human
gcgccgcttacattaacacg

SEQ ID NO: 178734 - DNA, 20 bp, human
gtactctgtgccccgcgtcc

SEQ ID NO: 178735 - DNA, 20 bp, human
ggcggcgccctgatgctccc

SEQ ID NO: 178736 - DNA, 20 bp, human
ggcagccggcgcagaaggtc

SEQ ID NO: 178737 - DNA, 20 bp, human
ggggtgtgggggaaacgtca

SEQ ID NO: 178738 - DNA, 20 bp, human
ggctgcccgaagaaagaggg

SEQ ID NO: 178739 - DNA, 20 bp, human
gatggaggcggcaagagtgg

SEQ ID NO: 178740 - DNA, 20 bp, human
ggaggctgcccgaagaaaga

SEQ ID NO: 178741 - DNA, 20 bp, human
gcgccaccgaaacccggccg

SEQ ID NO: 178742 - DNA, 20 bp, human
gcgccgcggccgggtttcgg

SEQ ID NO: 178743 - DNA, 20 bp, human
gtcggcaggatgtaccccca

SEQ ID NO: 178744 - DNA, 20 bp, human
gcaggatgtacccccaggga

SEQ ID NO: 178745 - DNA, 20 bp, human
ggagggggcccccagtgtcc

SEQ ID NO: 178746 - DNA, 20 bp, human
gggtcgtgattccgagagcg

SEQ ID NO: 178747 - DNA, 20 bp, human
gcgaaagtcaccagcgggta

SEQ ID NO: 178748 - DNA, 20 bp, human
gcacacacagacaggcgaag

SEQ ID NO: 178749 - DNA, 20 bp, human
ggaggaactccgggctcagt

SEQ ID NO: 178750 - DNA, 20 bp, human
gtgtggtatccgtaggtccg

SEQ ID NO: 178751 - DNA, 20 bp, human
gccgagaccggggagctcta

SEQ ID NO: 178752 - DNA, 20 bp, human
gtcctccccggccctgggaa

SEQ ID NO: 178753 - DNA, 20 bp, human
ggtctgtgtgtggtatccgt

SEQ ID NO: 178754 - DNA, 20 bp, human
ggctcgcggcgagaagagga

SEQ ID NO: 178755 - DNA, 20 bp, human
ggcgagagcagttccaaata

SEQ ID NO: 178756 - DNA, 20 bp, human
gcacccggccgggaaagtgc

SEQ ID NO: 178757 - DNA, 20 bp, human
gagcgagaggagctgccggc

SEQ ID NO: 178758 - DNA, 20 bp, human
gctaacaacacgctctgtgt

SEQ ID NO: 178759 - DNA, 20 bp, human
ggggacgcagagcgagcgag

SEQ ID NO: 178760 - DNA, 20 bp, human
gttgttagagctgtgctgag

SEQ ID NO: 178761 - DNA, 20 bp, human
gttcccggccgggtgagcgg

SEQ ID NO: 178762 - DNA, 20 bp, human
gagaaagatcattcattcgg

SEQ ID NO: 178763 - DNA, 20 bp, human
gactttcccggccgggtgag

SEQ ID NO: 178764 - DNA, 20 bp, human
ggagacctcttccgaaccaa

SEQ ID NO: 178765 - DNA, 20 bp, human
gcggccgccgctcacccggc

SEQ ID NO: 178766 - DNA, 20 bp, human
gtaagtgaggacaggaccta

SEQ ID NO: 178767 - DNA, 20 bp, human
gcctcaccgggcggaagctg

SEQ ID NO: 178768 - DNA, 20 bp, human
gactcacgtccctcaccggg

SEQ ID NO: 178769 - DNA, 20 bp, human
gtcccaggcctcaccctagg

SEQ ID NO: 178770 - DNA, 20 bp, human
gaccccagcctcctagggtg

SEQ ID NO: 178771 - DNA, 20 bp, human
gggcaactcacgtccctcac

SEQ ID NO: 178772 - DNA, 20 bp, human
gcaggacctagggaacgcat

SEQ ID NO: 178773 - DNA, 20 bp, human
gttgccaggcgtgttctagg

SEQ ID NO: 178774 - DNA, 20 bp, human
ggtcaaatggcccccggtgg

SEQ ID NO: 178775 - DNA, 20 bp, human
ggttagccaggtgcattagg

SEQ ID NO: 178776 - DNA, 20 bp, human
gaggaaaccgagaagagggg

SEQ ID NO: 178777 - DNA, 20 bp, human
ggggaggaaaccgagaagag

SEQ ID NO: 178778 - DNA, 20 bp, human
ggagcccggggttggagacg

SEQ ID NO: 178779 - DNA, 20 bp, human
ggcagcggcggcaacggcac

SEQ ID NO: 178780 - DNA, 20 bp, human
gcggccgaggacacttccgc

SEQ ID NO: 178781 - DNA, 20 bp, human
gccgcccgcggaagtgtcct

SEQ ID NO: 178782 - DNA, 20 bp, human
ggctcctgcgcctccggtag

SEQ ID NO: 178783 - DNA, 20 bp, human
gtcacacgccgccatccggg

SEQ ID NO: 178784 - DNA, 20 bp, human
ggggggccgacgcactgcag

SEQ ID NO: 178785 - DNA, 20 bp, human
ggagcgagcgggcgcgccag

SEQ ID NO: 178786 - DNA, 20 bp, human
gccggagccggccccgagct

SEQ ID NO: 178787 - DNA, 20 bp, human
gaggagagacgggggccccc

SEQ ID NO: 178788 - DNA, 20 bp, human
gccgggcgggggaggactcc

SEQ ID NO: 178789 - DNA, 20 bp, human
gaccgtcctggggacccctt

SEQ ID NO: 178790 - DNA, 20 bp, human
ggccaaaggggtccccagga

SEQ ID NO: 178791 - DNA, 20 bp, human
gtgcgacctgggcccagctc

SEQ ID NO: 178792 - DNA, 20 bp, human
gggggaggactccaggcctg

SEQ ID NO: 178793 - DNA, 20 bp, human
gcccgggcccgggcccgcgt

SEQ ID NO: 178794 - DNA, 20 bp, human
ggcggccggaggagagacgg

SEQ ID NO: 178795 - DNA, 20 bp, human
gcaggctcctcaggccaaag

SEQ ID NO: 178796 - DNA, 20 bp, human
gtggctaggggcccacgggt

SEQ ID NO: 178797 - DNA, 20 bp, human
ggccgccgggacagtagaga

SEQ ID NO: 178798 - DNA, 20 bp, human
gtaaggaactctgcactcgg

SEQ ID NO: 178799 - DNA, 20 bp, human
gtcccccggaggaaaaggag

SEQ ID NO: 178800 - DNA, 20 bp, human
gctgcactcggaggcgggga

SEQ ID NO: 178801 - DNA, 20 bp, human
gggcagccagaaggacgacc

SEQ ID NO: 178802 - DNA, 20 bp, human
gaggaggggacgggacccag

SEQ ID NO: 178803 - DNA, 20 bp, human
gtgctcttctccccacccgg

SEQ ID NO: 178804 - DNA, 20 bp, human
gcgcagggagaagttggcta

SEQ ID NO: 178805 - DNA, 20 bp, human
gaacttctccctgcgactgg

SEQ ID NO: 178806 - DNA, 20 bp, human
gccgggcaagtagctccgag

SEQ ID NO: 178807 - DNA, 20 bp, human
ggttgcctcgacgaagacag

SEQ ID NO: 178808 - DNA, 20 bp, human
ggcgccccctgtcttcgtcg

SEQ ID NO: 178809 - DNA, 20 bp, human
gccccagcggcggcacctac

SEQ ID NO: 178810 - DNA, 20 bp, human
gttctgcgggacttccccag

SEQ ID NO: 178811 - DNA, 20 bp, human
gcgacccttgcaaagccggt

SEQ ID NO: 178812 - DNA, 20 bp, human
gtgcgggacttccccagcgg

SEQ ID NO: 178813 - DNA, 20 bp, human
ggcggcggctgcgagtgtgg

SEQ ID NO: 178814 - DNA, 20 bp, human
gcaaccgggaagcagccgct

SEQ ID NO: 178815 - DNA, 20 bp, human
ggcacctaccggctttgcaa

SEQ ID NO: 178816 - DNA, 20 bp, human
gccgagggcgacccgagaag

SEQ ID NO: 178817 - DNA, 20 bp, human
gtggccgagagagtgtcgaa

SEQ ID NO: 178818 - DNA, 20 bp, human
gcgagagagtgtcgaaggga

SEQ ID NO: 178819 - DNA, 20 bp, human
ggggcgaggccggagcccga

SEQ ID NO: 178820 - DNA, 20 bp, human
gggcgacccgagaagcggcg

SEQ ID NO: 178821 - DNA, 20 bp, human
gctagcctgaaagggaactc

SEQ ID NO: 178822 - DNA, 20 bp, human
ggacgttcccaggacggaag

SEQ ID NO: 178823 - DNA, 20 bp, human
ggggtccgtttaggaatcaa

SEQ ID NO: 178824 - DNA, 20 bp, human
gtagctgatagcgggcatgt

SEQ ID NO: 178825 - DNA, 20 bp, human
ggacccgagaagcggcgggg

SEQ ID NO: 178826 - DNA, 20 bp, human
ggaagctgccctaacagtat

SEQ ID NO: 178827 - DNA, 20 bp, human
gcataccgccaatactgtta

SEQ ID NO: 178828 - DNA, 20 bp, human
ggctgccctaacagtattgg

SEQ ID NO: 178829 - DNA, 20 bp, human
gtgtgtgcgccactgcaacg

SEQ ID NO: 178830 - DNA, 20 bp, human
gggtgcctgaggcacaaact

SEQ ID NO: 178831 - DNA, 20 bp, human
gactgggcaaggtaggtcat

SEQ ID NO: 178832 - DNA, 20 bp, human
ggtaatcacaagtctcacag

SEQ ID NO: 178833 - DNA, 20 bp, human
ggagcataatcctcatgcat

SEQ ID NO: 178834 - DNA, 20 bp, human
gggcacaaactgggcaaggt

SEQ ID NO: 178835 - DNA, 20 bp, human
gggtagtgtctgatctaaga

SEQ ID NO: 178836 - DNA, 20 bp, human
gaggagctgagggccctatg

SEQ ID NO: 178837 - DNA, 20 bp, human
gagcagggagaattcctcag

SEQ ID NO: 178838 - DNA, 20 bp, human
gccttcgcgagaggagctga

SEQ ID NO: 178839 - DNA, 20 bp, human
ggggcccagggagtcggaaa

SEQ ID NO: 178840 - DNA, 20 bp, human
gaggcgttagctgttaagga

SEQ ID NO: 178841 - DNA, 20 bp, human
gagcaggcgatcaggcacag

SEQ ID NO: 178842 - DNA, 20 bp, human
gcagctaacgccttcgcgag

SEQ ID NO: 178843 - DNA, 20 bp, human
ggcgaaggcgttagctgtta

SEQ ID NO: 178844 - DNA, 20 bp, human
gtagccacaggagtccctaa

SEQ ID NO: 178845 - DNA, 20 bp, human
gtactgcaagaggaagcagc

SEQ ID NO: 178846 - DNA, 20 bp, human
gacagacaagcaggttgtct

SEQ ID NO: 178847 - DNA, 20 bp, human
gataagtcagttactcccgg

SEQ ID NO: 178848 - DNA, 20 bp, human
gccaaatggaacagacaagc

SEQ ID NO: 178849 - DNA, 20 bp, human
ggttattcccagaggagtgt

SEQ ID NO: 178850 - DNA, 20 bp, human
ggatataagtcagttactcc

SEQ ID NO: 178851 - DNA, 20 bp, human
gtttcttacagactgccaaa

SEQ ID NO: 178852 - DNA, 20 bp, human
ggaatacaaatggcgggatt

SEQ ID NO: 178853 - DNA, 20 bp, human
gcaacaactagcagctgctc

SEQ ID NO: 178854 - DNA, 20 bp, human
ggttactgtgtagtttgtac

SEQ ID NO: 178855 - DNA, 20 bp, human
gtataagcaaatcacacacg

SEQ ID NO: 178856 - DNA, 20 bp, human
gtgagagagtgcaagccgtg

SEQ ID NO: 178857 - DNA, 20 bp, human
gagctaaggttcttacccca

SEQ ID NO: 178858 - DNA, 20 bp, human
gtcgttgacacggtcagaat

SEQ ID NO: 178859 - DNA, 20 bp, human
ggtcagaattggctgcagga

SEQ ID NO: 178860 - DNA, 20 bp, human
gcgtggatgattcgttgaca

SEQ ID NO: 178861 - DNA, 20 bp, human
gctctgctggatgaaacctt

SEQ ID NO: 178862 - DNA, 20 bp, human
gcagaggttaacatacgctg

SEQ ID NO: 178863 - DNA, 20 bp, human
gtgcagatgcttgagagcgt

SEQ ID NO: 178864 - DNA, 20 bp, human
gaaagtaggggcagatctga

SEQ ID NO: 178865 - DNA, 20 bp, human
ggaacttttcaacggggtaa

SEQ ID NO: 178866 - DNA, 20 bp, human
ggcgagaaagcgcagccagg

SEQ ID NO: 178867 - DNA, 20 bp, human
gccccagcggaagctctccg

SEQ ID NO: 178868 - DNA, 20 bp, human
gcagcccagccgcagcccat

SEQ ID NO: 178869 - DNA, 20 bp, human
gcgggctctgcaggaccctc

SEQ ID NO: 178870 - DNA, 20 bp, human
gacacggaaagggagcccga

SEQ ID NO: 178871 - DNA, 20 bp, human
gggctgctcggcgttctctc

SEQ ID NO: 178872 - DNA, 20 bp, human
gggggcctgcaaggttggaa

SEQ ID NO: 178873 - DNA, 20 bp, human
gctccgcggcaacccccccg

SEQ ID NO: 178874 - DNA, 20 bp, human
ggactgctcggagttctccc

SEQ ID NO: 178875 - DNA, 20 bp, human
ggggagcgcacgacgtacct

SEQ ID NO: 178876 - DNA, 20 bp, human
gatttcatcagggaagtgtg

SEQ ID NO: 178877 - DNA, 20 bp, human
gaaacacattagggaagcta

SEQ ID NO: 178878 - DNA, 20 bp, human
gagggatatgatatgggcat

SEQ ID NO: 178879 - DNA, 20 bp, human
gatgaacaccttcacttact

SEQ ID NO: 178880 - DNA, 20 bp, human
gttcatttcacgttcttact

SEQ ID NO: 178881 - DNA, 20 bp, human
gtttgctagcagaatgcatg

SEQ ID NO: 178882 - DNA, 20 bp, human
gtgttagttttattggctgg

SEQ ID NO: 178883 - DNA, 20 bp, human
gacctggaaaaaacacatta

SEQ ID NO: 178884 - DNA, 20 bp, human
gacttccctgatgaaatgtc

SEQ ID NO: 178885 - DNA, 20 bp, human
gctggaggggagacaggagc

SEQ ID NO: 178886 - DNA, 20 bp, human
gcgcgaggcagacatcatcc

SEQ ID NO: 178887 - DNA, 20 bp, human
gcattgttacagggcactag

SEQ ID NO: 178888 - DNA, 20 bp, human
gtagcgagccacgcattcac

SEQ ID NO: 178889 - DNA, 20 bp, human
gtctgaccgagcagtttctg

SEQ ID NO: 178890 - DNA, 20 bp, human
gcactagaggcagccattgg

SEQ ID NO: 178891 - DNA, 20 bp, human
gcagtggccctgtgaatgcg

SEQ ID NO: 178892 - DNA, 20 bp, human
gggagaggaaggccatggct

SEQ ID NO: 178893 - DNA, 20 bp, human
gaagcagtgaggatgatgcc

SEQ ID NO: 178894 - DNA, 20 bp, human
ggaagttctgggcagaagtg

SEQ ID NO: 178895 - DNA, 20 bp, human
ggcgaaaactagtctcagac

SEQ ID NO: 178896 - DNA, 20 bp, human
ggcgcggggaggcgtcccag

SEQ ID NO: 178897 - DNA, 20 bp, human
gctgcagggcgctcacctct

SEQ ID NO: 178898 - DNA, 20 bp, human
gagagcgccgcctagtgagg

SEQ ID NO: 178899 - DNA, 20 bp, human
ggagccaaccgtggcgcagg

SEQ ID NO: 178900 - DNA, 20 bp, human
ggccgggggccctaagtcgt

SEQ ID NO: 178901 - DNA, 20 bp, human
gtgcctcttccacagggtgg

SEQ ID NO: 178902 - DNA, 20 bp, human
gctcgcgccgcctcactagg

SEQ ID NO: 178903 - DNA, 20 bp, human
gcagagagcgccgcctagtg

SEQ ID NO: 178904 - DNA, 20 bp, human
ggagcgccctgcagcggcag

SEQ ID NO: 178905 - DNA, 20 bp, human
gctcctcccggacgcaaaag

SEQ ID NO: 178906 - DNA, 20 bp, human
gtaaataggtgccatatcag

SEQ ID NO: 178907 - DNA, 20 bp, human
gttacagtgacaaacgacaa

SEQ ID NO: 178908 - DNA, 20 bp, human
gtcttctgaaaaagagatct

SEQ ID NO: 178909 - DNA, 20 bp, human
ggcgcttgtggtgataatta

SEQ ID NO: 178910 - DNA, 20 bp, human
gtcctgctcgtgaaattcaa

SEQ ID NO: 178911 - DNA, 20 bp, human
gcggtaccttagaaacagat

SEQ ID NO: 178912 - DNA, 20 bp, human
gttcttaaagttgagtaaag

SEQ ID NO: 178913 - DNA, 20 bp, human
gctgtggctttttcacatta

SEQ ID NO: 178914 - DNA, 20 bp, human
gcattcattatataggaaat

SEQ ID NO: 178915 - DNA, 20 bp, human
gtgctaaccattcattatat

SEQ ID NO: 178916 - DNA, 20 bp, human
gctcagaagactccagatat

SEQ ID NO: 178917 - DNA, 20 bp, human
ggcccatctcaagctgatct

SEQ ID NO: 178918 - DNA, 20 bp, human
gcactccatgccatcaagaa

SEQ ID NO: 178919 - DNA, 20 bp, human
gcatggagtgatcctatatc

SEQ ID NO: 178920 - DNA, 20 bp, human
gcttccaaaatggaatgtag

SEQ ID NO: 178921 - DNA, 20 bp, human
ggccaagatcagcttgagat

SEQ ID NO: 178922 - DNA, 20 bp, human
ggtgtagtcacaaagactac

SEQ ID NO: 178923 - DNA, 20 bp, human
gctgttataaggaagtgggg

SEQ ID NO: 178924 - DNA, 20 bp, human
gtagttggaaactccagggc

SEQ ID NO: 178925 - DNA, 20 bp, human
ggtcttctgagatgaagtga

SEQ ID NO: 178926 - DNA, 20 bp, human
gcggccacctcctgcataga

SEQ ID NO: 178927 - DNA, 20 bp, human
ggtaccctctatgcaggagg

SEQ ID NO: 178928 - DNA, 20 bp, human
gtcttccagaacaacagggt

SEQ ID NO: 178929 - DNA, 20 bp, human
gtctgcgctgctgcaagtta

SEQ ID NO: 178930 - DNA, 20 bp, human
gatggtaccctctatgcagg

SEQ ID NO: 178931 - DNA, 20 bp, human
gagaatggtaccctctatgc

SEQ ID NO: 178932 - DNA, 20 bp, human
gatcctcttccagaacaaca

SEQ ID NO: 178933 - DNA, 20 bp, human
gtggaagaggatattgtctc

SEQ ID NO: 178934 - DNA, 20 bp, human
gaactggaaatattacttac

SEQ ID NO: 178935 - DNA, 20 bp, human
gtttgctaaagaaatagaag

SEQ ID NO: 178936 - DNA, 20 bp, human
ggcagcggctcagagaatag

SEQ ID NO: 178937 - DNA, 20 bp, human
gagactggacagcagctaca

SEQ ID NO: 178938 - DNA, 20 bp, human
ggaaggatgcttcacactcg

SEQ ID NO: 178939 - DNA, 20 bp, human
gagtgtccccagggccatgt

SEQ ID NO: 178940 - DNA, 20 bp, human
ggcttctccagagggtctgg

SEQ ID NO: 178941 - DNA, 20 bp, human
gactcgaggtcccttcccac

SEQ ID NO: 178942 - DNA, 20 bp, human
ggagggtctggcgggcagac

SEQ ID NO: 178943 - DNA, 20 bp, human
gtgtcacccacatggccctg

SEQ ID NO: 178944 - DNA, 20 bp, human
gggggcttctccagagggtc

SEQ ID NO: 178945 - DNA, 20 bp, human
gtgacgggttgtcacccaca

SEQ ID NO: 178946 - DNA, 20 bp, human
ggaggcgcctacacttacgg

SEQ ID NO: 178947 - DNA, 20 bp, human
gccgggacctccagtaccat

SEQ ID NO: 178948 - DNA, 20 bp, human
ggcctccaggacggagaata

SEQ ID NO: 178949 - DNA, 20 bp, human
ggctcctccagcccccgtcg

SEQ ID NO: 178950 - DNA, 20 bp, human
gtgcaggagccagagataga

SEQ ID NO: 178951 - DNA, 20 bp, human
gcgagcgagcagccggagcg

SEQ ID NO: 178952 - DNA, 20 bp, human
gtcggaggcgcctacactta

SEQ ID NO: 178953 - DNA, 20 bp, human
gagggacggagaccaagact

SEQ ID NO: 178954 - DNA, 20 bp, human
ggggccagcatggagcacct

SEQ ID NO: 178955 - DNA, 20 bp, human
gtcctcaacagcccggacca

SEQ ID NO: 178956 - DNA, 20 bp, human
gagggacggagaccaagact

SEQ ID NO: 178957 - DNA, 20 bp, human
gtgcaggagccagagataga

SEQ ID NO: 178958 - DNA, 20 bp, human
gccacaaggcgtctgaggaa

SEQ ID NO: 178959 - DNA, 20 bp, human
gttgaggagattctccagtt

SEQ ID NO: 178960 - DNA, 20 bp, human
gagaagaggggaacaaggcg

SEQ ID NO: 178961 - DNA, 20 bp, human
ggaacaaggcgaggcttaaa

SEQ ID NO: 178962 - DNA, 20 bp, human
ggtctccgtccctctatctc

SEQ ID NO: 178963 - DNA, 20 bp, human
gccagcccacaaggcgtctg

SEQ ID NO: 178964 - DNA, 20 bp, human
gcatatagccagttgttcat

SEQ ID NO: 178965 - DNA, 20 bp, human
gggcctgggctccatacctg

SEQ ID NO: 178966 - DNA, 20 bp, human
gccgctgcccaagtcccggg

SEQ ID NO: 178967 - DNA, 20 bp, human
gccctctccacccgggactt

SEQ ID NO: 178968 - DNA, 20 bp, human
ggcggccccgaaaccccagg

SEQ ID NO: 178969 - DNA, 20 bp, human
gtggccaaccctctccaccc

SEQ ID NO: 178970 - DNA, 20 bp, human
ggtctaggcctgggtcgcgg

SEQ ID NO: 178971 - DNA, 20 bp, human
gaggcctagaccgccccctg

SEQ ID NO: 178972 - DNA, 20 bp, human
gggagagggttggccagctc

SEQ ID NO: 178973 - DNA, 20 bp, human
gagcgccagaagcccagcgg

SEQ ID NO: 178974 - DNA, 20 bp, human
gtgagcggccccgaaacccc

SEQ ID NO: 178975 - DNA, 20 bp, human
gcgttctcgggtggatacca

SEQ ID NO: 178976 - DNA, 20 bp, human
gggcggctgggtccccgtta

SEQ ID NO: 178977 - DNA, 20 bp, human
gcgggtagcgcgcttggcag

SEQ ID NO: 178978 - DNA, 20 bp, human
gccgccaaggctggagaccg

SEQ ID NO: 178979 - DNA, 20 bp, human
ggtagcgcgcttggcagagg

SEQ ID NO: 178980 - DNA, 20 bp, human
gtcagtgcgacgagaggcgc

SEQ ID NO: 178981 - DNA, 20 bp, human
gtgtcgggcccgcgcactct

SEQ ID NO: 178982 - DNA, 20 bp, human
gccatggccgcgccgtaacg

SEQ ID NO: 178983 - DNA, 20 bp, human
gaaagtttcagtgcgacgag

SEQ ID NO: 178984 - DNA, 20 bp, human
gccgacggcgccagctacct

SEQ ID NO: 178985 - DNA, 20 bp, human
gaccgtgggcacggagggca

SEQ ID NO: 178986 - DNA, 20 bp, human
gggaagtggcgagaaagtgt

SEQ ID NO: 178987 - DNA, 20 bp, human
gccgtgacggccagactcgt

SEQ ID NO: 178988 - DNA, 20 bp, human
gccggagcagacggaccaga

SEQ ID NO: 178989 - DNA, 20 bp, human
gcacaggacaccaacgagtc

SEQ ID NO: 178990 - DNA, 20 bp, human
gtctgctccggaggccgtga

SEQ ID NO: 178991 - DNA, 20 bp, human
ggacggaccagacggccagg

SEQ ID NO: 178992 - DNA, 20 bp, human
gagtgactgagacgaaccac

SEQ ID NO: 178993 - DNA, 20 bp, human
gggagaacacccccccatgg

SEQ ID NO: 178994 - DNA, 20 bp, human
gcatggaggcgaggtagagt

SEQ ID NO: 178995 - DNA, 20 bp, human
gcagccctagccagtcctga

SEQ ID NO: 178996 - DNA, 20 bp, human
gctccggaacgacctcagag

SEQ ID NO: 178997 - DNA, 20 bp, human
gcggcctcaaccacaacccc

SEQ ID NO: 178998 - DNA, 20 bp, human
ggcctgaccacgcagttctt

SEQ ID NO: 178999 - DNA, 20 bp, human
ggggtgtgccaggaatatat

SEQ ID NO: 179000 - DNA, 20 bp, human
gatcttcccgggcacaggag

SEQ ID NO: 179001 - DNA, 20 bp, human
ggtgctgcgagctgggaata

SEQ ID NO: 179002 - DNA, 20 bp, human
ggcacgggctgtgagaaacc

SEQ ID NO: 179003 - DNA, 20 bp, human
ggaggatgaccggagagtgg

SEQ ID NO: 179004 - DNA, 20 bp, human
gggtaagagcagaggatgac

SEQ ID NO: 179005 - DNA, 20 bp, human
gcacagacccaagaactgcg

SEQ ID NO: 179006 - DNA, 20 bp, human
gcagcacgcgacacaaggcg

SEQ ID NO: 179007 - DNA, 20 bp, human
gcaggcgctggcaagatggc

SEQ ID NO: 179008 - DNA, 20 bp, human
gcacgcgacacaaggcgcgg

SEQ ID NO: 179009 - DNA, 20 bp, human
ggaggggtgctcccgctgag

SEQ ID NO: 179010 - DNA, 20 bp, human
ggccggcaacgagggaccga

SEQ ID NO: 179011 - DNA, 20 bp, human
ggctggcaagatggcgggag

SEQ ID NO: 179012 - DNA, 20 bp, human
gaagagcagcacgcgacaca

SEQ ID NO: 179013 - DNA, 20 bp, human
gtcaggtcagccggcaacga

SEQ ID NO: 179014 - DNA, 20 bp, human
ggctgctcatgaaaacctca

SEQ ID NO: 179015 - DNA, 20 bp, human
ggcgaggaggccgggcccac

SEQ ID NO: 179016 - DNA, 20 bp, human
gtgaaagtgtgcccttctgg

SEQ ID NO: 179017 - DNA, 20 bp, human
gccacacgaagcggctgagg

SEQ ID NO: 179018 - DNA, 20 bp, human
gttagccgcgatgcacagga

SEQ ID NO: 179019 - DNA, 20 bp, human
gtttaagaggtagcaggaat

SEQ ID NO: 179020 - DNA, 20 bp, human
ggattatacaaaagcgagat

SEQ ID NO: 179021 - DNA, 20 bp, human
gcggctgaggtggttttcgg

SEQ ID NO: 179022 - DNA, 20 bp, human
gagatgaaagtgtgcccttc

SEQ ID NO: 179023 - DNA, 20 bp, human
gagaaaagaaccacacgaag

SEQ ID NO: 179024 - DNA, 20 bp, human
ggaaccacacgaagcggctg

SEQ ID NO: 179025 - DNA, 20 bp, human
ggcagaccaccatgtgctat

SEQ ID NO: 179026 - DNA, 20 bp, human
gtcatattcatgaggagacg

SEQ ID NO: 179027 - DNA, 20 bp, human
gttctaagcagggcaaaatg

SEQ ID NO: 179028 - DNA, 20 bp, human
gtatttcacactgagattgt

SEQ ID NO: 179029 - DNA, 20 bp, human
gcggaatcagcaaacaactt

SEQ ID NO: 179030 - DNA, 20 bp, human
gtcatgaggagacggggaat

SEQ ID NO: 179031 - DNA, 20 bp, human
gacactgagattgtcggctg

SEQ ID NO: 179032 - DNA, 20 bp, human
gattacttctactagttaca

SEQ ID NO: 179033 - DNA, 20 bp, human
gctcccgcaggttctaagca

SEQ ID NO: 179034 - DNA, 20 bp, human
gaaatggggtctcggaagtg

SEQ ID NO: 179035 - DNA, 20 bp, human
gatcatggtaagtatgaatt

SEQ ID NO: 179036 - DNA, 20 bp, human
gaacagtaagtaccaggcag

SEQ ID NO: 179037 - DNA, 20 bp, human
ggctggtaacagtaagtacc

SEQ ID NO: 179038 - DNA, 20 bp, human
ggccctcctggaaagagtcc

SEQ ID NO: 179039 - DNA, 20 bp, human
gaggctgcgtcttcagagtg

SEQ ID NO: 179040 - DNA, 20 bp, human
ggtgtcatggaagcacatgg

SEQ ID NO: 179041 - DNA, 20 bp, human
gggaggaacctaatcctatc

SEQ ID NO: 179042 - DNA, 20 bp, human
ggctccagggctggacctga

SEQ ID NO: 179043 - DNA, 20 bp, human
gggcaggggcatccaactta

SEQ ID NO: 179044 - DNA, 20 bp, human
ggcttctgccagataggatt

SEQ ID NO: 179045 - DNA, 20 bp, human
gtgatggacgatgagatact

SEQ ID NO: 179046 - DNA, 20 bp, human
gagcaggtcatggtcacccc

SEQ ID NO: 179047 - DNA, 20 bp, human
gcatccttcgcagcaggtca

SEQ ID NO: 179048 - DNA, 20 bp, human
gaaggatggacatcctgcaa

SEQ ID NO: 179049 - DNA, 20 bp, human
gtgacaacgtttctgagcca

SEQ ID NO: 179050 - DNA, 20 bp, human
ggtggtataggatagagagc

SEQ ID NO: 179051 - DNA, 20 bp, human
gattggtcatcagtgaagaa

SEQ ID NO: 179052 - DNA, 20 bp, human
gtgaccatgacctgctgcga

SEQ ID NO: 179053 - DNA, 20 bp, human
gggtggttcccaggaattat

SEQ ID NO: 179054 - DNA, 20 bp, human
gtgctggttctactgctgtt

SEQ ID NO: 179055 - DNA, 20 bp, human
gtcacatttctgtacaggta

SEQ ID NO: 179056 - DNA, 20 bp, human
gagaagctgaagcaactcca

SEQ ID NO: 179057 - DNA, 20 bp, human
gcttcacggggcctcttcaa

SEQ ID NO: 179058 - DNA, 20 bp, human
ggacacagttcacagaaatt

SEQ ID NO: 179059 - DNA, 20 bp, human
gagcggtgtcttggtgagta

SEQ ID NO: 179060 - DNA, 20 bp, human
ggaacagggagatatttagt

SEQ ID NO: 179061 - DNA, 20 bp, human
gaccccagaatgtgcactgg

SEQ ID NO: 179062 - DNA, 20 bp, human
ggcccccagtgcacattctg

SEQ ID NO: 179063 - DNA, 20 bp, human
ggaagcttaaaatcccccta

SEQ ID NO: 179064 - DNA, 20 bp, human
ggggaatgagggtccccccc

SEQ ID NO: 179065 - DNA, 20 bp, human
gatcaggtacttattgaaca

SEQ ID NO: 179066 - DNA, 20 bp, human
gacatgctccctacccggta

SEQ ID NO: 179067 - DNA, 20 bp, human
gagagctcccctaccgggta

SEQ ID NO: 179068 - DNA, 20 bp, human
gcagtggggacagggaggac

SEQ ID NO: 179069 - DNA, 20 bp, human
gcattcagcttgggaccctg

SEQ ID NO: 179070 - DNA, 20 bp, human
gcccaagctgaatgtctgtg

SEQ ID NO: 179071 - DNA, 20 bp, human
gggagctctttagagcagtg

SEQ ID NO: 179072 - DNA, 20 bp, human
gctctggacctgggaaccac

SEQ ID NO: 179073 - DNA, 20 bp, human
ggcaggacatgctccctacc

SEQ ID NO: 179074 - DNA, 20 bp, human
ggttggccacaatgcagacg

SEQ ID NO: 179075 - DNA, 20 bp, human
ggtgagtgaaagtaagccag

SEQ ID NO: 179076 - DNA, 20 bp, human
ggacagcacgaagaccccgg

SEQ ID NO: 179077 - DNA, 20 bp, human
gagggacagcacgaagaccc

SEQ ID NO: 179078 - DNA, 20 bp, human
gaagaccccggtggccgcag

SEQ ID NO: 179079 - DNA, 20 bp, human
gcccagcgggatgcggtgaa

SEQ ID NO: 179080 - DNA, 20 bp, human
ggccaggtggttgaagacat

SEQ ID NO: 179081 - DNA, 20 bp, human
gtattgacgcctgtgacccc

SEQ ID NO: 179082 - DNA, 20 bp, human
ggcgcctggccagactaggg

SEQ ID NO: 179083 - DNA, 20 bp, human
gcccgcgcctggccagacta

SEQ ID NO: 179084 - DNA, 20 bp, human
ggctgcgatgagtgcctctg

SEQ ID NO: 179085 - DNA, 20 bp, human
gagtgcctctgcggccaccg

SEQ ID NO: 179086 - DNA, 20 bp, human
gagcggcgggatgtccatag

SEQ ID NO: 179087 - DNA, 20 bp, human
gggcgggatgtccatagcgg

SEQ ID NO: 179088 - DNA, 20 bp, human
gagcggcggctgctggaccc

SEQ ID NO: 179089 - DNA, 20 bp, human
gagccccgacgcgttctcca

SEQ ID NO: 179090 - DNA, 20 bp, human
ggcgctcggctcctcgttgg

SEQ ID NO: 179091 - DNA, 20 bp, human
gagggcgctcggctcctcgt

SEQ ID NO: 179092 - DNA, 20 bp, human
gcgatcttgccggccagcgg

SEQ ID NO: 179093 - DNA, 20 bp, human
gtaggttccaaagtcaccaa

SEQ ID NO: 179094 - DNA, 20 bp, human
ggagctttggagggtttctg

SEQ ID NO: 179095 - DNA, 20 bp, human
ggggacttccggttagaggg

SEQ ID NO: 179096 - DNA, 20 bp, human
gtctgtcctgggcgtaacag

SEQ ID NO: 179097 - DNA, 20 bp, human
gggagggcccctgggtaatg

SEQ ID NO: 179098 - DNA, 20 bp, human
ggcgggtgaactaagagcgg

SEQ ID NO: 179099 - DNA, 20 bp, human
gcatctcctgggaaatgggg

SEQ ID NO: 179100 - DNA, 20 bp, human
gccgctccgccggagagaga

SEQ ID NO: 179101 - DNA, 20 bp, human
ggcaggaggagggtcttcga

SEQ ID NO: 179102 - DNA, 20 bp, human
ggacgcctgggaagggaact

SEQ ID NO: 179103 - DNA, 20 bp, human
gtaagatggacgcctgggaa

SEQ ID NO: 179104 - DNA, 20 bp, human
ggtccatctcctgggaaatg

SEQ ID NO: 179105 - DNA, 20 bp, human
gcagcgcacagtgagccctg

SEQ ID NO: 179106 - DNA, 20 bp, human
gtgctaggctgacagacccc

SEQ ID NO: 179107 - DNA, 20 bp, human
gtgggtggtgagtccagaac

SEQ ID NO: 179108 - DNA, 20 bp, human
gaagaggaaacctctcgctg

SEQ ID NO: 179109 - DNA, 20 bp, human
gctgcagctgctggtcgtag

SEQ ID NO: 179110 - DNA, 20 bp, human
gcctcgcccacgctatcccg

SEQ ID NO: 179111 - DNA, 20 bp, human
gtccagcgagggtaaggtcg

SEQ ID NO: 179112 - DNA, 20 bp, human
gccgggctgggcccacgcca

SEQ ID NO: 179113 - DNA, 20 bp, human
gggcgttggtacacgctggg

SEQ ID NO: 179114 - DNA, 20 bp, human
gcgaggtcaaaatccgccag

SEQ ID NO: 179115 - DNA, 20 bp, human
gtaggctgacagacccctgg

SEQ ID NO: 179116 - DNA, 20 bp, human
gagctcgcgatgagtggtct

SEQ ID NO: 179117 - DNA, 20 bp, human
ggtgggggaggacggcggac

SEQ ID NO: 179118 - DNA, 20 bp, human
gtctggaggacgctgagggg

SEQ ID NO: 179119 - DNA, 20 bp, human
ggaggcgagctcgcgatgag

SEQ ID NO: 179120 - DNA, 20 bp, human
gaagtctggaggacgctgag

SEQ ID NO: 179121 - DNA, 20 bp, human
gcttcgggaagggtgagcca

SEQ ID NO: 179122 - DNA, 20 bp, human
gtcggcaggctcttcgggaa

SEQ ID NO: 179123 - DNA, 20 bp, human
gcaggagcaaggcggaagtc

SEQ ID NO: 179124 - DNA, 20 bp, human
gaaaccccggcggccgatgg

SEQ ID NO: 179125 - DNA, 20 bp, human
gggaacaaggcgccccgaca

SEQ ID NO: 179126 - DNA, 20 bp, human
ggaccccagcaggagcccaa

SEQ ID NO: 179127 - DNA, 20 bp, human
gcaaccccgtagaagtcggt

SEQ ID NO: 179128 - DNA, 20 bp, human
gagcccaaaggcagctacgg

SEQ ID NO: 179129 - DNA, 20 bp, human
gtgcctttgggctcctgctg

SEQ ID NO: 179130 - DNA, 20 bp, human
gtatcaggattggcaaccac

SEQ ID NO: 179131 - DNA, 20 bp, human
ggttcgaggcacctgacctg

SEQ ID NO: 179132 - DNA, 20 bp, human
gtagaggccccgggccagac

SEQ ID NO: 179133 - DNA, 20 bp, human
gcacagcggcgcggtagcgg

SEQ ID NO: 179134 - DNA, 20 bp, human
gcggtagcggcgggttggag

SEQ ID NO: 179135 - DNA, 20 bp, human
gtgggagcaagtggagccag

SEQ ID NO: 179136 - DNA, 20 bp, human
gttcctggcccgcgccggag

SEQ ID NO: 179137 - DNA, 20 bp, human
ggcccccagaaggctagttc

SEQ ID NO: 179138 - DNA, 20 bp, human
gagtctcggagacgactaca

SEQ ID NO: 179139 - DNA, 20 bp, human
gacaaggccgccagagataa

SEQ ID NO: 179140 - DNA, 20 bp, human
ggaaagggcaatcaaaccta

SEQ ID NO: 179141 - DNA, 20 bp, human
gaccgaggtggagacaacac

SEQ ID NO: 179142 - DNA, 20 bp, human
gggccggcttcctttatctc

SEQ ID NO: 179143 - DNA, 20 bp, human
gaaggaagccggcccccaga

SEQ ID NO: 179144 - DNA, 20 bp, human
gacttggcccgcaagacggg

SEQ ID NO: 179145 - DNA, 20 bp, human
gagagcgacgagtgcaaggt

SEQ ID NO: 179146 - DNA, 20 bp, human
ggggcgcggacagacgcacg

SEQ ID NO: 179147 - DNA, 20 bp, human
gctggcggagcaggaacctt

SEQ ID NO: 179148 - DNA, 20 bp, human
gaggaaccttgggagcgtgg

SEQ ID NO: 179149 - DNA, 20 bp, human
gccaaccggaaggagtcctc

SEQ ID NO: 179150 - DNA, 20 bp, human
gagaccctgtcactcgggag

SEQ ID NO: 179151 - DNA, 20 bp, human
gtccgccaggcccaaccgga

SEQ ID NO: 179152 - DNA, 20 bp, human
gctgctccgccaggcccaac

SEQ ID NO: 179153 - DNA, 20 bp, human
ggaaggagaccctgtcactc

SEQ ID NO: 179154 - DNA, 20 bp, human
ggcggccgattcgcatccac

SEQ ID NO: 179155 - DNA, 20 bp, human
ggcccggtggtgccccactg

SEQ ID NO: 179156 - DNA, 20 bp, human
gggtgagtgaaggagactcc

SEQ ID NO: 179157 - DNA, 20 bp, human
ggggctctgaaaaggatctg

SEQ ID NO: 179158 - DNA, 20 bp, human
ggagcagggtctggacgtga

SEQ ID NO: 179159 - DNA, 20 bp, human
ggctggagcggggccctccg

SEQ ID NO: 179160 - DNA, 20 bp, human
ggggtctggacgtgacgggg

SEQ ID NO: 179161 - DNA, 20 bp, human
ggatcctgggataccccgga

SEQ ID NO: 179162 - DNA, 20 bp, human
gctgagggctacctctgact

SEQ ID NO: 179163 - DNA, 20 bp, human
gcgtggatccaagatggcga

SEQ ID NO: 179164 - DNA, 20 bp, human
gcgggagggggtcttcagag

SEQ ID NO: 179165 - DNA, 20 bp, human
gccgtttcggaggaagacct

SEQ ID NO: 179166 - DNA, 20 bp, human
ggcaggtctggctgtccgtt

SEQ ID NO: 179167 - DNA, 20 bp, human
ggacgcggtctcagttaacg

SEQ ID NO: 179168 - DNA, 20 bp, human
ggagtctacccaggccagag

SEQ ID NO: 179169 - DNA, 20 bp, human
ggacccaaccggaacaggag

SEQ ID NO: 179170 - DNA, 20 bp, human
gtagtgactagcgagaagtt

SEQ ID NO: 179171 - DNA, 20 bp, human
gggcttctcaggcgccacgt

SEQ ID NO: 179172 - DNA, 20 bp, human
gactcggacgcggaactcta

SEQ ID NO: 179173 - DNA, 20 bp, human
gctacttcctgggggaaacc

SEQ ID NO: 179174 - DNA, 20 bp, human
ggccacgtgggattcggccc

SEQ ID NO: 179175 - DNA, 20 bp, human
ggagcttaaaagcccaacac

SEQ ID NO: 179176 - DNA, 20 bp, human
ggcgggcgcggaggcactgg

SEQ ID NO: 179177 - DNA, 20 bp, human
gtaagtgttccggaaccgtg

SEQ ID NO: 179178 - DNA, 20 bp, human
gcgagacctcgcagttcagg

SEQ ID NO: 179179 - DNA, 20 bp, human
ggccgtccccgcagtcctca

SEQ ID NO: 179180 - DNA, 20 bp, human
ggccgcgaaggtaagtgttc

SEQ ID NO: 179181 - DNA, 20 bp, human
gtgagcacctattgggatga

SEQ ID NO: 179182 - DNA, 20 bp, human
gcctattgggatgagggcgc

SEQ ID NO: 179183 - DNA, 20 bp, human
ggcctctccccaggaagata

SEQ ID NO: 179184 - DNA, 20 bp, human
gtccggaacacttaccttcg

SEQ ID NO: 179185 - DNA, 20 bp, human
gtcggcccccacttacccaa

SEQ ID NO: 179186 - DNA, 20 bp, human
gcccgagtggccagctgtgt

SEQ ID NO: 179187 - DNA, 20 bp, human
gaggaacgctccgtctggaa

SEQ ID NO: 179188 - DNA, 20 bp, human
gaggccaggaacgctccgtc

SEQ ID NO: 179189 - DNA, 20 bp, human
ggaggacttgcaacactccg

SEQ ID NO: 179190 - DNA, 20 bp, human
gcaccgcccacagtccccaa

SEQ ID NO: 179191 - DNA, 20 bp, human
ggataggccctgcgacagag

SEQ ID NO: 179192 - DNA, 20 bp, human
gttgcctgcgccgttccaga

SEQ ID NO: 179193 - DNA, 20 bp, human
gcggcgccgttggggactgt

SEQ ID NO: 179194 - DNA, 20 bp, human
ggccctcagctggtgagaag

SEQ ID NO: 179195 - DNA, 20 bp, human
ggagtgttgcaagtcctccg

SEQ ID NO: 179196 - DNA, 20 bp, human
gcgaggagcgagggtaccgg

SEQ ID NO: 179197 - DNA, 20 bp, human
gtagtggaccgggaccggta

SEQ ID NO: 179198 - DNA, 20 bp, human
gatggcaacagcacccctac

SEQ ID NO: 179199 - DNA, 20 bp, human
ggggcgccgcggtgtaggaa

SEQ ID NO: 179200 - DNA, 20 bp, human
gtcgaggacgacttcaacta

SEQ ID NO: 179201 - DNA, 20 bp, human
gtacaccgcggcgcccgctg

SEQ ID NO: 179202 - DNA, 20 bp, human
ggatcgaggagcgagggtac

SEQ ID NO: 179203 - DNA, 20 bp, human
gaggggtgctgttgccatca

SEQ ID NO: 179204 - DNA, 20 bp, human
ggcggttagtggaccgggac

SEQ ID NO: 179205 - DNA, 20 bp, human
ggtcctcgatcgaggagcga

SEQ ID NO: 179206 - DNA, 20 bp, human
ggcgctggtaggccttggag

SEQ ID NO: 179207 - DNA, 20 bp, human
gttggagaggcgggttagga

SEQ ID NO: 179208 - DNA, 20 bp, human
gggccttggagaggcgggtt

SEQ ID NO: 179209 - DNA, 20 bp, human
gtagaagcgctggtaggcct

SEQ ID NO: 179210 - DNA, 20 bp, human
gcggtgttagaagcgctggt

SEQ ID NO: 179211 - DNA, 20 bp, human
ggtacgtctgaacctagtac

SEQ ID NO: 179212 - DNA, 20 bp, human
gcgaacagcaatcggatggg

SEQ ID NO: 179213 - DNA, 20 bp, human
gagccgaacagcaatcggat

SEQ ID NO: 179214 - DNA, 20 bp, human
gacctagtactgggcgaact

SEQ ID NO: 179215 - DNA, 20 bp, human
ggaccagactcgggaaaaca

SEQ ID NO: 179216 - DNA, 20 bp, human
gctgggactatcctaactgg

SEQ ID NO: 179217 - DNA, 20 bp, human
gctgtttcccatctactcag

SEQ ID NO: 179218 - DNA, 20 bp, human
gtgtagcagtagaaaagtag

SEQ ID NO: 179219 - DNA, 20 bp, human
gaatttcagcaactcctgga

SEQ ID NO: 179220 - DNA, 20 bp, human
gaaactgggactatcctaac

SEQ ID NO: 179221 - DNA, 20 bp, human
ggtgattagggaatatctca

SEQ ID NO: 179222 - DNA, 20 bp, human
gctcataatgatgccaggta

SEQ ID NO: 179223 - DNA, 20 bp, human
gatgttaacacaccacacat

SEQ ID NO: 179224 - DNA, 20 bp, human
gacagaaatctcccccagtt

SEQ ID NO: 179225 - DNA, 20 bp, human
gttcggtgaaatcagaaaac

SEQ ID NO: 179226 - DNA, 20 bp, human
gaactatgtatttaacatac

SEQ ID NO: 179227 - DNA, 20 bp, human
gttagaagctatcctataac

SEQ ID NO: 179228 - DNA, 20 bp, human
gagctatcctataactggct

SEQ ID NO: 179229 - DNA, 20 bp, human
gataactttttcttccccct

SEQ ID NO: 179230 - DNA, 20 bp, human
gttttcatttcctatgtgtc

SEQ ID NO: 179231 - DNA, 20 bp, human
gcaagactctgtctccaagg

SEQ ID NO: 179232 - DNA, 20 bp, human
gttaacatactggcttaatt

SEQ ID NO: 179233 - DNA, 20 bp, human
gttaatgttgaagccaaatt

SEQ ID NO: 179234 - DNA, 20 bp, human
ggcttaatttggtttaattt

SEQ ID NO: 179235 - DNA, 20 bp, human
gtcaattatacttatttcac

SEQ ID NO: 179236 - DNA, 20 bp, human
gagtcagggatagcagagaa

SEQ ID NO: 179237 - DNA, 20 bp, human
ggtctttctgagaggtataa

SEQ ID NO: 179238 - DNA, 20 bp, human
gagaggaagcaggtaaagtc

SEQ ID NO: 179239 - DNA, 20 bp, human
gcaaaatcaagactgtctgt

SEQ ID NO: 179240 - DNA, 20 bp, human
ggacactatgtctttctgag

SEQ ID NO: 179241 - DNA, 20 bp, human
gtgacaataggtcactgctg

SEQ ID NO: 179242 - DNA, 20 bp, human
gactttgcttaactcataaa

SEQ ID NO: 179243 - DNA, 20 bp, human
gtttttgggtgacatcctgg

SEQ ID NO: 179244 - DNA, 20 bp, human
gtaaaggtatttgaaaactt

SEQ ID NO: 179245 - DNA, 20 bp, human
gctgggggtgtcctgtcaga

SEQ ID NO: 179246 - DNA, 20 bp, human
gaggcagagaggacctgcga

SEQ ID NO: 179247 - DNA, 20 bp, human
gcgcgggtggagaggtgaca

SEQ ID NO: 179248 - DNA, 20 bp, human
gggcacggaagccagagcga

SEQ ID NO: 179249 - DNA, 20 bp, human
gcgcctcgtggcacccggtg

SEQ ID NO: 179250 - DNA, 20 bp, human
ggaagccagagcgagggcac

SEQ ID NO: 179251 - DNA, 20 bp, human
gcagagtggggcagtggtaa

SEQ ID NO: 179252 - DNA, 20 bp, human
gaggagaaagcgcgacgaga

SEQ ID NO: 179253 - DNA, 20 bp, human
gtccagctggtgactcaccc

SEQ ID NO: 179254 - DNA, 20 bp, human
ggggcatcagtccctcacgg

SEQ ID NO: 179255 - DNA, 20 bp, human
ggctgtccgctcctggaagg

SEQ ID NO: 179256 - DNA, 20 bp, human
gggccagagagctaggaagt

SEQ ID NO: 179257 - DNA, 20 bp, human
gcttcttcctgagaactagc

SEQ ID NO: 179258 - DNA, 20 bp, human
gcctcagcaacgggcatggg

SEQ ID NO: 179259 - DNA, 20 bp, human
gcaggcaaaggtctgttccg

SEQ ID NO: 179260 - DNA, 20 bp, human
gctaggaagttggcaggcaa

SEQ ID NO: 179261 - DNA, 20 bp, human
gaggatggcaacctcagcaa

SEQ ID NO: 179262 - DNA, 20 bp, human
gccagccataaagccaggtt

SEQ ID NO: 179263 - DNA, 20 bp, human
gagagagctaggaagttggc

SEQ ID NO: 179264 - DNA, 20 bp, human
gaggcatcccagcgctatag

SEQ ID NO: 179265 - DNA, 20 bp, human
gggttgtggtacaactagga

SEQ ID NO: 179266 - DNA, 20 bp, human
ggtggaaccctcctactcca

SEQ ID NO: 179267 - DNA, 20 bp, human
gcaggctgggctgtctctag

SEQ ID NO: 179268 - DNA, 20 bp, human
gccctctagctcaggagtgt

SEQ ID NO: 179269 - DNA, 20 bp, human
gacactgccccaggtaaggg

SEQ ID NO: 179270 - DNA, 20 bp, human
gaggcttctgattccaaggt

SEQ ID NO: 179271 - DNA, 20 bp, human
gatggaagaaaacccgacct

SEQ ID NO: 179272 - DNA, 20 bp, human
gtctgagggctaaagagaga

SEQ ID NO: 179273 - DNA, 20 bp, human
gggggccagccaccccctag

SEQ ID NO: 179274 - DNA, 20 bp, human
ggtaggagggttccacgctt

SEQ ID NO: 179275 - DNA, 20 bp, human
gtaggtgggagtcctgctgg

SEQ ID NO: 179276 - DNA, 20 bp, human
ggggaagccacgaagatcac

SEQ ID NO: 179277 - DNA, 20 bp, human
gactcaagcagataacccta

SEQ ID NO: 179278 - DNA, 20 bp, human
gttaaggcgacacggcagag

SEQ ID NO: 179279 - DNA, 20 bp, human
gtcgcggactcagtagacag

SEQ ID NO: 179280 - DNA, 20 bp, human
gaatcccacagttagacctg

SEQ ID NO: 179281 - DNA, 20 bp, human
gagcagtctttaaggcgaca

SEQ ID NO: 179282 - DNA, 20 bp, human
gctatcttggtcacacgtct

SEQ ID NO: 179283 - DNA, 20 bp, human
gggtgcagctgtgatggtag

SEQ ID NO: 179284 - DNA, 20 bp, human
gtagccagggcggcataaaa

SEQ ID NO: 179285 - DNA, 20 bp, human
gagacgagggtacagaattg

SEQ ID NO: 179286 - DNA, 20 bp, human
gcaagagccgccgggaactg

SEQ ID NO: 179287 - DNA, 20 bp, human
gggagtggcaaagggcccca

SEQ ID NO: 179288 - DNA, 20 bp, human
gtctcggctctccttgccaa

SEQ ID NO: 179289 - DNA, 20 bp, human
gcagagcggctgcaactctg

SEQ ID NO: 179290 - DNA, 20 bp, human
gcgagcgccagggcacgggg

SEQ ID NO: 179291 - DNA, 20 bp, human
ggctctccttgccaagggag

SEQ ID NO: 179292 - DNA, 20 bp, human
ggagccgagacctcagttcc

SEQ ID NO: 179293 - DNA, 20 bp, human
gccgagacctcagttcccgg

SEQ ID NO: 179294 - DNA, 20 bp, human
ggggccctttgccactccct

SEQ ID NO: 179295 - DNA, 20 bp, human
gaagggccccaggggcgact

SEQ ID NO: 179296 - DNA, 20 bp, human
gcgcgccccgcgctcctcag

SEQ ID NO: 179297 - DNA, 20 bp, human
gcggccatgagcgagtccag

SEQ ID NO: 179298 - DNA, 20 bp, human
gctgcagtctggaccgtggt

SEQ ID NO: 179299 - DNA, 20 bp, human
ggtgcgccctcggaccccag

SEQ ID NO: 179300 - DNA, 20 bp, human
gagaactgcagtctggaccg

SEQ ID NO: 179301 - DNA, 20 bp, human
gatcccggctccgcgaggga

SEQ ID NO: 179302 - DNA, 20 bp, human
gctggaagacaaacccacca

SEQ ID NO: 179303 - DNA, 20 bp, human
gggacacgagaactgcagtc

SEQ ID NO: 179304 - DNA, 20 bp, human
ggcggtccatccaggtaggg

SEQ ID NO: 179305 - DNA, 20 bp, human
gccggcggtccatccaggta

SEQ ID NO: 179306 - DNA, 20 bp, human
gcagctcacctggggaccta

SEQ ID NO: 179307 - DNA, 20 bp, human
gtgagaaggggactcctcca

SEQ ID NO: 179308 - DNA, 20 bp, human
ggggcacagaaagtctggac

SEQ ID NO: 179309 - DNA, 20 bp, human
ggcaggagtcgtctgagaag

SEQ ID NO: 179310 - DNA, 20 bp, human
ggacctagggaccaagtccc

SEQ ID NO: 179311 - DNA, 20 bp, human
gaggtgagctggatgtccag

SEQ ID NO: 179312 - DNA, 20 bp, human
gatggggtgaaagatccaaa

SEQ ID NO: 179313 - DNA, 20 bp, human
gagccacaggtcctcatcag

SEQ ID NO: 179314 - DNA, 20 bp, human
gtgagctggatgtccagtgg

SEQ ID NO: 179315 - DNA, 20 bp, human
ggccagctagagccctgcaa

SEQ ID NO: 179316 - DNA, 20 bp, human
gctgctgtgaggagaacaag

SEQ ID NO: 179317 - DNA, 20 bp, human
ggatggacacacaaccccag

SEQ ID NO: 179318 - DNA, 20 bp, human
gaggccctggagccactgag

SEQ ID NO: 179319 - DNA, 20 bp, human
gcgaccaccgcccctctcag

SEQ ID NO: 179320 - DNA, 20 bp, human
gtgtcctcacacccgctcgt

SEQ ID NO: 179321 - DNA, 20 bp, human
gggcgctgcttcccacgagc

SEQ ID NO: 179322 - DNA, 20 bp, human
gtctggaagatggagtaagg

SEQ ID NO: 179323 - DNA, 20 bp, human
ggggtctggaagatggagta

SEQ ID NO: 179324 - DNA, 20 bp, human
gacaagtggcgagttgcgac

SEQ ID NO: 179325 - DNA, 20 bp, human
gcttcccacgagcgggtgtg

SEQ ID NO: 179326 - DNA, 20 bp, human
ggcggtggcggtgactgagg

SEQ ID NO: 179327 - DNA, 20 bp, human
ggggcttcaacctcgaacgg

SEQ ID NO: 179328 - DNA, 20 bp, human
ggaggccccgtgggatgctg

SEQ ID NO: 179329 - DNA, 20 bp, human
gcagcggaatgagccgggaa

SEQ ID NO: 179330 - DNA, 20 bp, human
gtcccgcgccggggctgagg

SEQ ID NO: 179331 - DNA, 20 bp, human
gtcccgctcgcggcctgtcg

SEQ ID NO: 179332 - DNA, 20 bp, human
ggggacgccatggcgatcga

SEQ ID NO: 179333 - DNA, 20 bp, human
ggggggcgctcactcaccgg

SEQ ID NO: 179334 - DNA, 20 bp, human
gccccaggtcaaaatgacag

SEQ ID NO: 179335 - DNA, 20 bp, human
gatgctgggggtcgagtcct

SEQ ID NO: 179336 - DNA, 20 bp, human
gcgaagacaggtcacagtcg

SEQ ID NO: 179337 - DNA, 20 bp, human
gcgacctggggagcgaagac

SEQ ID NO: 179338 - DNA, 20 bp, human
gcttaaaggcgggtgaggga

SEQ ID NO: 179339 - DNA, 20 bp, human
gacaggtcacagtcgaggct

SEQ ID NO: 179340 - DNA, 20 bp, human
gggagaagggagacaacccc

SEQ ID NO: 179341 - DNA, 20 bp, human
gcggccgggcaggtcctagt

SEQ ID NO: 179342 - DNA, 20 bp, human
gtaggttgcgcgctcgccgc

SEQ ID NO: 179343 - DNA, 20 bp, human
gtgccgcaaagccgcgaccg

SEQ ID NO: 179344 - DNA, 20 bp, human
ggcaggctgcgcgtcaggcg

SEQ ID NO: 179345 - DNA, 20 bp, human
ggtgagggaggggcgagaag

SEQ ID NO: 179346 - DNA, 20 bp, human
ggcctgctggatctctctaa

SEQ ID NO: 179347 - DNA, 20 bp, human
gtccctgctgccctgcccgt

SEQ ID NO: 179348 - DNA, 20 bp, human
gtactccaataaccacctgg

SEQ ID NO: 179349 - DNA, 20 bp, human
ggagcagtgagcagtgtcac

SEQ ID NO: 179350 - DNA, 20 bp, human
gcggctggccagctgagtcc

SEQ ID NO: 179351 - DNA, 20 bp, human
gactgtcgttcagaaagaca

SEQ ID NO: 179352 - DNA, 20 bp, human
gcccaagataaagcacagat

SEQ ID NO: 179353 - DNA, 20 bp, human
ggctgtcagcttcctccagg

SEQ ID NO: 179354 - DNA, 20 bp, human
ggtcaagatgaagtccaagg

SEQ ID NO: 179355 - DNA, 20 bp, human
gcacccacttgagtctggtg

SEQ ID NO: 179356 - DNA, 20 bp, human
gttagctcggaggatcgggg

SEQ ID NO: 179357 - DNA, 20 bp, human
gtcctccgagctaaaagggt

SEQ ID NO: 179358 - DNA, 20 bp, human
gctaaaagggtgggcgtcgg

SEQ ID NO: 179359 - DNA, 20 bp, human
ggctgtgctcgggatcaccc

SEQ ID NO: 179360 - DNA, 20 bp, human
gcaggtccgcctgcccctca

SEQ ID NO: 179361 - DNA, 20 bp, human
gtgatcccgagcacagccgg

SEQ ID NO: 179362 - DNA, 20 bp, human
ggcatagcgcgcggggacct

SEQ ID NO: 179363 - DNA, 20 bp, human
ggatcccagaaccgcagcct

SEQ ID NO: 179364 - DNA, 20 bp, human
gctgccgcgccgcgagccac

SEQ ID NO: 179365 - DNA, 20 bp, human
gagcagagcgcgggccgtcg

SEQ ID NO: 179366 - DNA, 20 bp, human
gtcggtggtggcggagtcta

SEQ ID NO: 179367 - DNA, 20 bp, human
ggagttggtctgttactcgg

SEQ ID NO: 179368 - DNA, 20 bp, human
gttggtctgttactcggtgg

SEQ ID NO: 179369 - DNA, 20 bp, human
ggtctgttactcggtggtgg

SEQ ID NO: 179370 - DNA, 20 bp, human
gtcagagttggtctgttact

SEQ ID NO: 179371 - DNA, 20 bp, human
ggggaaagcgctctacagcc

SEQ ID NO: 179372 - DNA, 20 bp, human
gaggaaaagtgaagcgaaaa

SEQ ID NO: 179373 - DNA, 20 bp, human
gtgcacggctctgctcgcag

SEQ ID NO: 179374 - DNA, 20 bp, human
gctgcactctcacccgccag

SEQ ID NO: 179375 - DNA, 20 bp, human
ggatcagtccccgggaggaa

SEQ ID NO: 179376 - DNA, 20 bp, human
ggagagagagagactctaag

SEQ ID NO: 179377 - DNA, 20 bp, human
gatgcccaaagcctaattgg

SEQ ID NO: 179378 - DNA, 20 bp, human
gaaactggtggcagcaatat

SEQ ID NO: 179379 - DNA, 20 bp, human
gttgccaacttaagagacaa

SEQ ID NO: 179380 - DNA, 20 bp, human
gagatcatgcagatgtgcaa

SEQ ID NO: 179381 - DNA, 20 bp, human
gtgcatgatcttaaaactgg

SEQ ID NO: 179382 - DNA, 20 bp, human
ggttagggggagtagtctgg

SEQ ID NO: 179383 - DNA, 20 bp, human
gtgagttagggggagtagtc

SEQ ID NO: 179384 - DNA, 20 bp, human
gtaattggtggagattttca

SEQ ID NO: 179385 - DNA, 20 bp, human
gtttatgcccaaagcctaat

SEQ ID NO: 179386 - DNA, 20 bp, human
gggaggccgggagtccggga

SEQ ID NO: 179387 - DNA, 20 bp, human
gctggcgttggaccccgcag

SEQ ID NO: 179388 - DNA, 20 bp, human
gcccttcccaggcgggacca

SEQ ID NO: 179389 - DNA, 20 bp, human
ggggatgcaaggaagccctc

SEQ ID NO: 179390 - DNA, 20 bp, human
gcaccaggcccgtccatccg

SEQ ID NO: 179391 - DNA, 20 bp, human
ggaaagagccccggatggac

SEQ ID NO: 179392 - DNA, 20 bp, human
ggagccaaggccctcgcaga

SEQ ID NO: 179393 - DNA, 20 bp, human
gctgaggcgccaggacccga

SEQ ID NO: 179394 - DNA, 20 bp, human
gcttccttgcatcccttccc

SEQ ID NO: 179395 - DNA, 20 bp, human
gtggtgctcaccgggacgca

SEQ ID NO: 179396 - DNA, 20 bp, human
gacgctggtcaaggtcagag

SEQ ID NO: 179397 - DNA, 20 bp, human
ggcggctgcgaaggcaaagg

SEQ ID NO: 179398 - DNA, 20 bp, human
ggaggcggctgcgaaggcaa

SEQ ID NO: 179399 - DNA, 20 bp, human
gcgcagccgcctccaggtaa

SEQ ID NO: 179400 - DNA, 20 bp, human
gcactggacccaccaggaag

SEQ ID NO: 179401 - DNA, 20 bp, human
gggcgtggaggggccacgtg

SEQ ID NO: 179402 - DNA, 20 bp, human
gtggtcaaggtcagagagga

SEQ ID NO: 179403 - DNA, 20 bp, human
gcaaatgaggacgctggtca

SEQ ID NO: 179404 - DNA, 20 bp, human
gcctccggggcccccttacc

SEQ ID NO: 179405 - DNA, 20 bp, human
gggcggcctgggcttagggc

SEQ ID NO: 179406 - DNA, 20 bp, human
gtagggtataatcagaacac

SEQ ID NO: 179407 - DNA, 20 bp, human
gcacgggcagaagaatcaaa

SEQ ID NO: 179408 - DNA, 20 bp, human
gaattgactagggaaggatc

SEQ ID NO: 179409 - DNA, 20 bp, human
gctcagaagctaattgacta

SEQ ID NO: 179410 - DNA, 20 bp, human
ggaagctaattgactaggga

SEQ ID NO: 179411 - DNA, 20 bp, human
gaagacacatcaaaaagggg

SEQ ID NO: 179412 - DNA, 20 bp, human
ggctttccataaagccccat

SEQ ID NO: 179413 - DNA, 20 bp, human
gcaggatacagagataatgc

SEQ ID NO: 179414 - DNA, 20 bp, human
gcctgactgtatctttaata

SEQ ID NO: 179415 - DNA, 20 bp, human
gtaatagatatagtcagaga

SEQ ID NO: 179416 - DNA, 20 bp, human
gccctgccgtcggctccaca

SEQ ID NO: 179417 - DNA, 20 bp, human
gcccacggtctgcggggtgg

SEQ ID NO: 179418 - DNA, 20 bp, human
ggcagccacaacgctcccag

SEQ ID NO: 179419 - DNA, 20 bp, human
gtgccgtcggctccacatgg

SEQ ID NO: 179420 - DNA, 20 bp, human
gtacgcccctgggagcgttg

SEQ ID NO: 179421 - DNA, 20 bp, human
ggcaggaggaggaaagccga

SEQ ID NO: 179422 - DNA, 20 bp, human
gctcccaggggcgtagaaga

SEQ ID NO: 179423 - DNA, 20 bp, human
gccgctggcgccagactccc

SEQ ID NO: 179424 - DNA, 20 bp, human
gtgccatcttctacgcccct

SEQ ID NO: 179425 - DNA, 20 bp, human
gcggggaaaccgaggtgagg

SEQ ID NO: 179426 - DNA, 20 bp, human
gagggtgacccggatgatgg

SEQ ID NO: 179427 - DNA, 20 bp, human
gattagtagccacaaggcca

SEQ ID NO: 179428 - DNA, 20 bp, human
gtggctactaatgccaccag

SEQ ID NO: 179429 - DNA, 20 bp, human
ggctagagtaagagatccag

SEQ ID NO: 179430 - DNA, 20 bp, human
gtgcagaccagagggtgacc

SEQ ID NO: 179431 - DNA, 20 bp, human
gcagagggtgacccggatga

SEQ ID NO: 179432 - DNA, 20 bp, human
gtagccacaaggccagggct

SEQ ID NO: 179433 - DNA, 20 bp, human
ggctactcggcggagctcat

SEQ ID NO: 179434 - DNA, 20 bp, human
gagggagcctctgagaggac

SEQ ID NO: 179435 - DNA, 20 bp, human
ggcgccggccgccatcatcc

SEQ ID NO: 179436 - DNA, 20 bp, human
gcaccttgaggtggctgcgc

SEQ ID NO: 179437 - DNA, 20 bp, human
ggcgcggttgaggccttcgg

SEQ ID NO: 179438 - DNA, 20 bp, human
ggagactcgttcaccaccga

SEQ ID NO: 179439 - DNA, 20 bp, human
gccccgcgacaggcaaccag

SEQ ID NO: 179440 - DNA, 20 bp, human
gcgggagcgcaaaggacgtg

SEQ ID NO: 179441 - DNA, 20 bp, human
gggtcagaggtgagtcacgt

SEQ ID NO: 179442 - DNA, 20 bp, human
gctccgtgaggagattcaca

SEQ ID NO: 179443 - DNA, 20 bp, human
gtggcctcccgggagcgcaa

SEQ ID NO: 179444 - DNA, 20 bp, human
gccaatgccgcaccttgagg

SEQ ID NO: 179445 - DNA, 20 bp, human
gtgagtcacgtgggtccccc

SEQ ID NO: 179446 - DNA, 20 bp, human
gtcagcaagcgtcaccatgg

SEQ ID NO: 179447 - DNA, 20 bp, human
gatgggcctcatcttcgagg

SEQ ID NO: 179448 - DNA, 20 bp, human
gtgaggccgaagccaggacc

SEQ ID NO: 179449 - DNA, 20 bp, human
gggtggctgagaaggcagcg

SEQ ID NO: 179450 - DNA, 20 bp, human
gtaggcggcggtggctgaga

SEQ ID NO: 179451 - DNA, 20 bp, human
gggccacggcgacctcctaa

SEQ ID NO: 179452 - DNA, 20 bp, human
ggaagccaggacccggactg

SEQ ID NO: 179453 - DNA, 20 bp, human
gatgccgaaggagcccccaa

SEQ ID NO: 179454 - DNA, 20 bp, human
gctggtggcgcaggcggaag

SEQ ID NO: 179455 - DNA, 20 bp, human
gaggggcggagcttaggcgg

SEQ ID NO: 179456 - DNA, 20 bp, human
gacgggaccgagagcatcat

SEQ ID NO: 179457 - DNA, 20 bp, human
gcatcctcctaggacccggt

SEQ ID NO: 179458 - DNA, 20 bp, human
gggccaggctcgtctcgggt

SEQ ID NO: 179459 - DNA, 20 bp, human
gctaccgaccgggtcctagg

SEQ ID NO: 179460 - DNA, 20 bp, human
gggatgtaaggggatagacg

SEQ ID NO: 179461 - DNA, 20 bp, human
gcgagccgcggccctcgaga

SEQ ID NO: 179462 - DNA, 20 bp, human
gtggggcgacgactaccgac

SEQ ID NO: 179463 - DNA, 20 bp, human
gcgggtcctaggaggatgta

SEQ ID NO: 179464 - DNA, 20 bp, human
gtgcatggggtgggagtccc

SEQ ID NO: 179465 - DNA, 20 bp, human
gtcgggcgctgcgcccccgg

SEQ ID NO: 179466 - DNA, 20 bp, human
ggcggagaggcggcccacta

SEQ ID NO: 179467 - DNA, 20 bp, human
ggcctctgcgggcgatgggg

SEQ ID NO: 179468 - DNA, 20 bp, human
gaatgtgcgcaggcgcttag

SEQ ID NO: 179469 - DNA, 20 bp, human
gtgggcctctgcgggcgatg

SEQ ID NO: 179470 - DNA, 20 bp, human
gagtcacgaccggccctagt

SEQ ID NO: 179471 - DNA, 20 bp, human
gtgcccaggccaggggtcga

SEQ ID NO: 179472 - DNA, 20 bp, human
ggaggcgcgatggcaggtgt

SEQ ID NO: 179473 - DNA, 20 bp, human
gtggaagtgaaggaccccga

SEQ ID NO: 179474 - DNA, 20 bp, human
gggaccccgacggcaaggta

SEQ ID NO: 179475 - DNA, 20 bp, human
ggcagacacatagtcacgac

SEQ ID NO: 179476 - DNA, 20 bp, human
gtctccagcgaggccttcag

SEQ ID NO: 179477 - DNA, 20 bp, human
gtggagtctgaagaaactcc

SEQ ID NO: 179478 - DNA, 20 bp, human
gagtctgaagaaactccagg

SEQ ID NO: 179479 - DNA, 20 bp, human
ggtgcagctgggttaaagga

SEQ ID NO: 179480 - DNA, 20 bp, human
gtccaaagggtagggactct

SEQ ID NO: 179481 - DNA, 20 bp, human
gcgtggttgacagggaaatc

SEQ ID NO: 179482 - DNA, 20 bp, human
gcagctgggttaaaggaagg

SEQ ID NO: 179483 - DNA, 20 bp, human
ggacggccctggtggtgaag

SEQ ID NO: 179484 - DNA, 20 bp, human
gccagaaggagcacggggaa

SEQ ID NO: 179485 - DNA, 20 bp, human
ggcccagagtccctaccctt

SEQ ID NO: 179486 - DNA, 20 bp, human
gcagaggaggctccagaaag

SEQ ID NO: 179487 - DNA, 20 bp, human
gggtgactggccatactggg

SEQ ID NO: 179488 - DNA, 20 bp, human
gggtccccagagccacttag

SEQ ID NO: 179489 - DNA, 20 bp, human
ggcccagccccaaagagcaa

SEQ ID NO: 179490 - DNA, 20 bp, human
gtgattacctcttcagggag

SEQ ID NO: 179491 - DNA, 20 bp, human
gggccatgctcaaagccatg

SEQ ID NO: 179492 - DNA, 20 bp, human
ggatcagctccacggaagag

SEQ ID NO: 179493 - DNA, 20 bp, human
gaggcaccccgtctgcccca

SEQ ID NO: 179494 - DNA, 20 bp, human
gcaacaggagctaaaacata

SEQ ID NO: 179495 - DNA, 20 bp, human
gcaaagccatggggcagacg

SEQ ID NO: 179496 - DNA, 20 bp, human
ggcgcagacgggcggacctg

SEQ ID NO: 179497 - DNA, 20 bp, human
gcctgatacctggaactcca

SEQ ID NO: 179498 - DNA, 20 bp, human
gcctgagagggtcggaagtg

SEQ ID NO: 179499 - DNA, 20 bp, human
gtctacgaggacatcgctca

SEQ ID NO: 179500 - DNA, 20 bp, human
ggtccctgggccccaactcg

SEQ ID NO: 179501 - DNA, 20 bp, human
gggaaaaggcctgagagggt

SEQ ID NO: 179502 - DNA, 20 bp, human
gcgggatcagagcgaccctc

SEQ ID NO: 179503 - DNA, 20 bp, human
gcagacgggcggacctgggg

SEQ ID NO: 179504 - DNA, 20 bp, human
gtcctgtgaggggcgcagac

SEQ ID NO: 179505 - DNA, 20 bp, human
gcggcatcccgagaaggcgg

SEQ ID NO: 179506 - DNA, 20 bp, human
gttagcctttcggggggtga

SEQ ID NO: 179507 - DNA, 20 bp, human
ggctctgctgtgtatctttg

SEQ ID NO: 179508 - DNA, 20 bp, human
ggcgcagacgggcggacctg

SEQ ID NO: 179509 - DNA, 20 bp, human
gcgggatcagagcgaccctc

SEQ ID NO: 179510 - DNA, 20 bp, human
gcctgatacctggaactcca

SEQ ID NO: 179511 - DNA, 20 bp, human
ggtccctgggccccaactcg

SEQ ID NO: 179512 - DNA, 20 bp, human
gtctacgaggacatcgctca

SEQ ID NO: 179513 - DNA, 20 bp, human
gcctgagagggtcggaagtg

SEQ ID NO: 179514 - DNA, 20 bp, human
gcagacgggcggacctgggg

SEQ ID NO: 179515 - DNA, 20 bp, human
gtcctgtgaggggcgcagac

SEQ ID NO: 179516 - DNA, 20 bp, human
ggacaagcggcgacctccaa

SEQ ID NO: 179517 - DNA, 20 bp, human
gaggcaagtaccgggcgcta

SEQ ID NO: 179518 - DNA, 20 bp, human
gcggtccagctgtgagtcag

SEQ ID NO: 179519 - DNA, 20 bp, human
ggcagcgccacgtcccgggt

SEQ ID NO: 179520 - DNA, 20 bp, human
gcgctctcgctgggccagaa

SEQ ID NO: 179521 - DNA, 20 bp, human
ggcccagcgagagcgcccag

SEQ ID NO: 179522 - DNA, 20 bp, human
ggcagcagtccggcctcgag

SEQ ID NO: 179523 - DNA, 20 bp, human
gccacggcaaagcagcagtc

SEQ ID NO: 179524 - DNA, 20 bp, human
gaaaagccgcgggctgactg

SEQ ID NO: 179525 - DNA, 20 bp, human
ggtgggcgccaacagcagtc

SEQ ID NO: 179526 - DNA, 20 bp, human
ggaagctgaagaggcgccag

SEQ ID NO: 179527 - DNA, 20 bp, human
gaggccagtagggttcgggt

SEQ ID NO: 179528 - DNA, 20 bp, human
gtgcccaaatggtagtgaca

SEQ ID NO: 179529 - DNA, 20 bp, human
gagatctcagaaaggaagcg

SEQ ID NO: 179530 - DNA, 20 bp, human
gctgtttccggagccactcg

SEQ ID NO: 179531 - DNA, 20 bp, human
gccgcggagcggacccacct

SEQ ID NO: 179532 - DNA, 20 bp, human
ggcctcagggccccgcacca

SEQ ID NO: 179533 - DNA, 20 bp, human
gagatgtgattagcagacgg

SEQ ID NO: 179534 - DNA, 20 bp, human
ggacatctgcagcccgcgca

SEQ ID NO: 179535 - DNA, 20 bp, human
ggccgccagccgaccctggg

SEQ ID NO: 179536 - DNA, 20 bp, human
ggtaccagccggccaccccg

SEQ ID NO: 179537 - DNA, 20 bp, human
ggtgaaggacccagaggaca

SEQ ID NO: 179538 - DNA, 20 bp, human
gaacatgccaagccccgggg

SEQ ID NO: 179539 - DNA, 20 bp, human
gcagcgggaggagtaccagc

SEQ ID NO: 179540 - DNA, 20 bp, human
gaccatggtcataggtgcgg

SEQ ID NO: 179541 - DNA, 20 bp, human
gcgtgctgctcgtccggccc

SEQ ID NO: 179542 - DNA, 20 bp, human
gtcagctctctagagccggg

SEQ ID NO: 179543 - DNA, 20 bp, human
gccagcccggttccgggccg

SEQ ID NO: 179544 - DNA, 20 bp, human
gacaaacatgccaagccccg

SEQ ID NO: 179545 - DNA, 20 bp, human
gcttccctcaaggaaactac

SEQ ID NO: 179546 - DNA, 20 bp, human
ggtccaggggcaccagtcat

SEQ ID NO: 179547 - DNA, 20 bp, human
gccgaccgcagggaccacga

SEQ ID NO: 179548 - DNA, 20 bp, human
gcggctgcggcgcccatgac

SEQ ID NO: 179549 - DNA, 20 bp, human
gtgcgcttcccgccgtccag

SEQ ID NO: 179550 - DNA, 20 bp, human
gagccggagcggcgcctcag

SEQ ID NO: 179551 - DNA, 20 bp, human
gcggctgctaggaggcaccg

SEQ ID NO: 179552 - DNA, 20 bp, human
ggagggaggcggcaacggag

SEQ ID NO: 179553 - DNA, 20 bp, human
gagcagcagaaggcgagcgg

SEQ ID NO: 179554 - DNA, 20 bp, human
gcaacggccacggacacaaa

SEQ ID NO: 179555 - DNA, 20 bp, human
ggcggcgctcgggacggagt

SEQ ID NO: 179556 - DNA, 20 bp, human
gggcggcagagctcgagagg

SEQ ID NO: 179557 - DNA, 20 bp, human
ggcgggcggcagagctcgag

SEQ ID NO: 179558 - DNA, 20 bp, human
gggtgctgtgggagtccccg

SEQ ID NO: 179559 - DNA, 20 bp, human
ggagtccaggggcagacgag

SEQ ID NO: 179560 - DNA, 20 bp, human
gggcagacgagtggagcccg

SEQ ID NO: 179561 - DNA, 20 bp, human
gctacgatgagtagcatgac

SEQ ID NO: 179562 - DNA, 20 bp, human
gccaaacgccagagggatgc

SEQ ID NO: 179563 - DNA, 20 bp, human
gagctcgagaggcggctgcc

SEQ ID NO: 179564 - DNA, 20 bp, human
ggcagctggacactttgcga

SEQ ID NO: 179565 - DNA, 20 bp, human
gtctgccgcccgcatccctc

SEQ ID NO: 179566 - DNA, 20 bp, human
ggagcagggaagaaccagtg

SEQ ID NO: 179567 - DNA, 20 bp, human
gtggagttcctgcttctttc

SEQ ID NO: 179568 - DNA, 20 bp, human
gccagaagttagggtgtcat

SEQ ID NO: 179569 - DNA, 20 bp, human
gtttactatagggtctgctc

SEQ ID NO: 179570 - DNA, 20 bp, human
gcaacagtgattaattagtt

SEQ ID NO: 179571 - DNA, 20 bp, human
gggaaagacaagcgtcattt

SEQ ID NO: 179572 - DNA, 20 bp, human
ggacaccctaacttctggtg

SEQ ID NO: 179573 - DNA, 20 bp, human
gactggcctcaccagaagtt

SEQ ID NO: 179574 - DNA, 20 bp, human
gaatggattgcctctctccg

SEQ ID NO: 179575 - DNA, 20 bp, human
gtcccagaagttggacgaag

SEQ ID NO: 179576 - DNA, 20 bp, human
gcccaagggtgaatctctct

SEQ ID NO: 179577 - DNA, 20 bp, human
gatgtaccgcgggaccaaca

SEQ ID NO: 179578 - DNA, 20 bp, human
gtccatgtgaagagagtcac

SEQ ID NO: 179579 - DNA, 20 bp, human
ggaacaggaagcatgtaccg

SEQ ID NO: 179580 - DNA, 20 bp, human
ggatgactatccacagtaaa

SEQ ID NO: 179581 - DNA, 20 bp, human
gtgtcagtcacagcagggtg

SEQ ID NO: 179582 - DNA, 20 bp, human
gacaggagcagccaacttta

SEQ ID NO: 179583 - DNA, 20 bp, human
gcaatgcagtaaggagcatg

SEQ ID NO: 179584 - DNA, 20 bp, human
gaactttagggaagactgat

SEQ ID NO: 179585 - DNA, 20 bp, human
gaaaagccttgttggtcccg

SEQ ID NO: 179586 - DNA, 20 bp, human
gggagcctgtgggaactcaa

SEQ ID NO: 179587 - DNA, 20 bp, human
gcaacgaggacagaatgaag

SEQ ID NO: 179588 - DNA, 20 bp, human
gtcgacgccatcttgggaaa

SEQ ID NO: 179589 - DNA, 20 bp, human
gccaagatggcgtcgaagat

SEQ ID NO: 179590 - DNA, 20 bp, human
gccatgtcgaaatacaggta

SEQ ID NO: 179591 - DNA, 20 bp, human
ggtcgaagataggttcgaga

SEQ ID NO: 179592 - DNA, 20 bp, human
gcggcagggggcggtgatgt

SEQ ID NO: 179593 - DNA, 20 bp, human
gaaccagactcccctcccat

SEQ ID NO: 179594 - DNA, 20 bp, human
ggaagataggttcgagacgg

SEQ ID NO: 179595 - DNA, 20 bp, human
gcgggagtggggaagcaacg

SEQ ID NO: 179596 - DNA, 20 bp, human
gtatgggaagcagtaagggt

SEQ ID NO: 179597 - DNA, 20 bp, human
gcccttatgggaagcagtaa

SEQ ID NO: 179598 - DNA, 20 bp, human
gtgtaggggcgtggccacgt

SEQ ID NO: 179599 - DNA, 20 bp, human
gtctgcggcttcccccttat

SEQ ID NO: 179600 - DNA, 20 bp, human
gggcgtggctgaaaatgtag

SEQ ID NO: 179601 - DNA, 20 bp, human
ggaagaggcttattagtctg

SEQ ID NO: 179602 - DNA, 20 bp, human
gtgcggaaaacacggaaggg

SEQ ID NO: 179603 - DNA, 20 bp, human
gccggtgaaccagttcatgg

SEQ ID NO: 179604 - DNA, 20 bp, human
gtccgtgagcggccgagctg

SEQ ID NO: 179605 - DNA, 20 bp, human
gggggcactcccccagactg

SEQ ID NO: 179606 - DNA, 20 bp, human
ggacgggtcgggataggttg

SEQ ID NO: 179607 - DNA, 20 bp, human
gttccttgggctcccatgtg

SEQ ID NO: 179608 - DNA, 20 bp, human
ggcagcggaccggcgggaga

SEQ ID NO: 179609 - DNA, 20 bp, human
gcagcgcgcgcgaaaaaggt

SEQ ID NO: 179610 - DNA, 20 bp, human
gaggcggcagacagttcctt

SEQ ID NO: 179611 - DNA, 20 bp, human
gccggcagcagcggaccggc

SEQ ID NO: 179612 - DNA, 20 bp, human
gtggggaaccctaagagagt

SEQ ID NO: 179613 - DNA, 20 bp, human
gtgtctgccgcctctgccta

SEQ ID NO: 179614 - DNA, 20 bp, human
gggtgctggacagctggcgc

SEQ ID NO: 179615 - DNA, 20 bp, human
gaccccagagcgtggaaagg

SEQ ID NO: 179616 - DNA, 20 bp, human
gctacccaggaggacgagag

SEQ ID NO: 179617 - DNA, 20 bp, human
gtggccgggctactgctacc

SEQ ID NO: 179618 - DNA, 20 bp, human
gtccaggtaagagggagatg

SEQ ID NO: 179619 - DNA, 20 bp, human
ggacagtggggccaaggact

SEQ ID NO: 179620 - DNA, 20 bp, human
gccccaccaggctctgctgt

SEQ ID NO: 179621 - DNA, 20 bp, human
ggtagcccggccaccccacc

SEQ ID NO: 179622 - DNA, 20 bp, human
gtctccccagcccggaactg

SEQ ID NO: 179623 - DNA, 20 bp, human
ggagcctggggtcagtgcgg

SEQ ID NO: 179624 - DNA, 20 bp, human
gcaggtggcatcagctctct

SEQ ID NO: 179625 - DNA, 20 bp, human
gaggaggggccccctaggaa

SEQ ID NO: 179626 - DNA, 20 bp, human
gtggggagaagggcctctaa

SEQ ID NO: 179627 - DNA, 20 bp, human
gcgacagaaacggaagagag

SEQ ID NO: 179628 - DNA, 20 bp, human
ggggcctctaagggcagagt

SEQ ID NO: 179629 - DNA, 20 bp, human
gagtaggtataaagggtcta

SEQ ID NO: 179630 - DNA, 20 bp, human
gctagggagggccttacccg

SEQ ID NO: 179631 - DNA, 20 bp, human
ggacctccgaaaggtaaagt

SEQ ID NO: 179632 - DNA, 20 bp, human
gggtataaagggtctaggga

SEQ ID NO: 179633 - DNA, 20 bp, human
gaggctcctcagccgcacga

SEQ ID NO: 179634 - DNA, 20 bp, human
gacgactgcagcgacagaaa

SEQ ID NO: 179635 - DNA, 20 bp, human
gcgcacgagggcgagacttc

SEQ ID NO: 179636 - DNA, 20 bp, human
ggcggacagggccgaggaca

SEQ ID NO: 179637 - DNA, 20 bp, human
gtcgtggagtccacagtccc

SEQ ID NO: 179638 - DNA, 20 bp, human
ggggcctagaggcaacccag

SEQ ID NO: 179639 - DNA, 20 bp, human
gagccgggcctgacaaggag

SEQ ID NO: 179640 - DNA, 20 bp, human
gggctgcttcggcgcggaca

SEQ ID NO: 179641 - DNA, 20 bp, human
gcggggcgctgcgcagtccc

SEQ ID NO: 179642 - DNA, 20 bp, human
gccccgtcccagctctacgg

SEQ ID NO: 179643 - DNA, 20 bp, human
gcacgtccggggtcgctcac

SEQ ID NO: 179644 - DNA, 20 bp, human
gtagaggcaacccagaggta

SEQ ID NO: 179645 - DNA, 20 bp, human
ggggaggggtaggataacga

SEQ ID NO: 179646 - DNA, 20 bp, human
ggccgctccgccgaccgaag

SEQ ID NO: 179647 - DNA, 20 bp, human
gtggcgggtaagaggagagt

SEQ ID NO: 179648 - DNA, 20 bp, human
ggcctcttcggtcggcggag

SEQ ID NO: 179649 - DNA, 20 bp, human
gcccagggcggtgaggatcg

SEQ ID NO: 179650 - DNA, 20 bp, human
gacttaccagcctcttcggt

SEQ ID NO: 179651 - DNA, 20 bp, human
gcaagctggcaggtggtcgg

SEQ ID NO: 179652 - DNA, 20 bp, human
gactcccggcagctcctctc

SEQ ID NO: 179653 - DNA, 20 bp, human
ggaggacttaccagcctctt

SEQ ID NO: 179654 - DNA, 20 bp, human
gtaccagcctcttcggtcgg

SEQ ID NO: 179655 - DNA, 20 bp, human
gatcgaggcaggtgcgtgaa

SEQ ID NO: 179656 - DNA, 20 bp, human
gacaagggcggcggtctctg

SEQ ID NO: 179657 - DNA, 20 bp, human
gtggccctcggggacaaggg

SEQ ID NO: 179658 - DNA, 20 bp, human
gccatggccctcggggacaa

SEQ ID NO: 179659 - DNA, 20 bp, human
gcggggtggccagaacgaag

SEQ ID NO: 179660 - DNA, 20 bp, human
ggccagaacgaagaggtggt

SEQ ID NO: 179661 - DNA, 20 bp, human
gggagcgtcaggaagcgaga

SEQ ID NO: 179662 - DNA, 20 bp, human
gggtggccagaacgaagagg

SEQ ID NO: 179663 - DNA, 20 bp, human
gactaggaccactcagagat

SEQ ID NO: 179664 - DNA, 20 bp, human
gacccaagagggtaagacac

SEQ ID NO: 179665 - DNA, 20 bp, human
gtcccaggacagcaacatac

SEQ ID NO: 179666 - DNA, 20 bp, human
ggcgctccggctccctccga

SEQ ID NO: 179667 - DNA, 20 bp, human
gtacctcgggagaagcgctc

SEQ ID NO: 179668 - DNA, 20 bp, human
gcccggagcgccgcttacct

SEQ ID NO: 179669 - DNA, 20 bp, human
ggcttgccgggacccagcat

SEQ ID NO: 179670 - DNA, 20 bp, human
gccctccaggcgggaaacaa

SEQ ID NO: 179671 - DNA, 20 bp, human
ggacccagcatgggaaggac

SEQ ID NO: 179672 - DNA, 20 bp, human
gggaaggtgcctgagaggat

SEQ ID NO: 179673 - DNA, 20 bp, human
gaaggactggggggacgccc

SEQ ID NO: 179674 - DNA, 20 bp, human
gcgtcaggagcgctggacct

SEQ ID NO: 179675 - DNA, 20 bp, human
ggcgcttctcccgaggtaag

SEQ ID NO: 179676 - DNA, 20 bp, human
gcgcacgtgaaggatagcag

SEQ ID NO: 179677 - DNA, 20 bp, human
gaaacccgcgcctcaactcg

SEQ ID NO: 179678 - DNA, 20 bp, human
ggccgtgggtcggggttcgg

SEQ ID NO: 179679 - DNA, 20 bp, human
gctcggctcgagcccttcgg

SEQ ID NO: 179680 - DNA, 20 bp, human
gaaaccagcgccccgagttg

SEQ ID NO: 179681 - DNA, 20 bp, human
gaggcctggagagtccgagt

SEQ ID NO: 179682 - DNA, 20 bp, human
gaggtccggcagaggtggag

SEQ ID NO: 179683 - DNA, 20 bp, human
ggatagcagtggcctgagaa

SEQ ID NO: 179684 - DNA, 20 bp, human
gcagaggtggagcggctccc

SEQ ID NO: 179685 - DNA, 20 bp, human
ggcgtcgctggcaaggaacg

SEQ ID NO: 179686 - DNA, 20 bp, human
gcgagagaggtgagatccaa

SEQ ID NO: 179687 - DNA, 20 bp, human
ggaaggaggcgtcttggccc

SEQ ID NO: 179688 - DNA, 20 bp, human
gtagctgcccgcgggccgat

SEQ ID NO: 179689 - DNA, 20 bp, human
ggcgcgtgcccaggcgggaa

SEQ ID NO: 179690 - DNA, 20 bp, human
gccgccttggcgcgagacgt

SEQ ID NO: 179691 - DNA, 20 bp, human
gcaagatggccgcttgggga

SEQ ID NO: 179692 - DNA, 20 bp, human
gtagccgggctgagtaaggt

SEQ ID NO: 179693 - DNA, 20 bp, human
ggatggccgcttggggaagg

SEQ ID NO: 179694 - DNA, 20 bp, human
ggccccagacgtgtagagga

SEQ ID NO: 179695 - DNA, 20 bp, human
gtaccctcgccgggcatact

SEQ ID NO: 179696 - DNA, 20 bp, human
gtctggaggccacagcgagt

SEQ ID NO: 179697 - DNA, 20 bp, human
gggcggccgggcggaggtac

SEQ ID NO: 179698 - DNA, 20 bp, human
ggccacagcgagtaggtgag

SEQ ID NO: 179699 - DNA, 20 bp, human
gcgggatcccaagcctgagc

SEQ ID NO: 179700 - DNA, 20 bp, human
gcgggcggaggtaccggctc

SEQ ID NO: 179701 - DNA, 20 bp, human
gacccagcctgggtttgcgg

SEQ ID NO: 179702 - DNA, 20 bp, human
gatcccggctgcgggtttgg

SEQ ID NO: 179703 - DNA, 20 bp, human
gctgggtattcctgcactag

SEQ ID NO: 179704 - DNA, 20 bp, human
gggaggtaccggctcaggct

SEQ ID NO: 179705 - DNA, 20 bp, human
gctcgggctacccctagtgc

SEQ ID NO: 179706 - DNA, 20 bp, human
gctgggaccccccgaccctc

SEQ ID NO: 179707 - DNA, 20 bp, human
gggcggccgggcggaggtac

SEQ ID NO: 179708 - DNA, 20 bp, human
gtctggaggccacagcgagt

SEQ ID NO: 179709 - DNA, 20 bp, human
ggccacagcgagtaggtgag

SEQ ID NO: 179710 - DNA, 20 bp, human
gcgggatcccaagcctgagc

SEQ ID NO: 179711 - DNA, 20 bp, human
gcgggcggaggtaccggctc

SEQ ID NO: 179712 - DNA, 20 bp, human
gacccagcctgggtttgcgg

SEQ ID NO: 179713 - DNA, 20 bp, human
gatcccggctgcgggtttgg

SEQ ID NO: 179714 - DNA, 20 bp, human
gctgggtattcctgcactag

SEQ ID NO: 179715 - DNA, 20 bp, human
gggaggtaccggctcaggct

SEQ ID NO: 179716 - DNA, 20 bp, human
gccatcaggatcaggctgag

SEQ ID NO: 179717 - DNA, 20 bp, human
gcagcagaatagagcgaggg

SEQ ID NO: 179718 - DNA, 20 bp, human
ggatcagcagaatagagcga

SEQ ID NO: 179719 - DNA, 20 bp, human
gtgggcacctacctccaaag

SEQ ID NO: 179720 - DNA, 20 bp, human
gtaggtgcccaccctgccta

SEQ ID NO: 179721 - DNA, 20 bp, human
gatcagttggaagagatgag

SEQ ID NO: 179722 - DNA, 20 bp, human
gcccaaaaaccatcaggatc

SEQ ID NO: 179723 - DNA, 20 bp, human
ggggatcccagggcctcgtg

SEQ ID NO: 179724 - DNA, 20 bp, human
gtctcttctaagccatgcat

SEQ ID NO: 179725 - DNA, 20 bp, human
ggaaccctcagcaaacgagg

SEQ ID NO: 179726 - DNA, 20 bp, human
gagccaggagccaggccgag

SEQ ID NO: 179727 - DNA, 20 bp, human
gttgactcgggtacagaacg

SEQ ID NO: 179728 - DNA, 20 bp, human
gccccccgagagaagaggta

SEQ ID NO: 179729 - DNA, 20 bp, human
ggtcggccccccgagagaag

SEQ ID NO: 179730 - DNA, 20 bp, human
gtcggcctgagaaaagggtc

SEQ ID NO: 179731 - DNA, 20 bp, human
gcggctgtcggcctgagaaa

SEQ ID NO: 179732 - DNA, 20 bp, human
gagctgaccaggcttgactc

SEQ ID NO: 179733 - DNA, 20 bp, human
gtgcgcctgcgcgtccccgg

SEQ ID NO: 179734 - DNA, 20 bp, human
gggactaggacgaggccccg

SEQ ID NO: 179735 - DNA, 20 bp, human
gtcggggggccgacaaacag

SEQ ID NO: 179736 - DNA, 20 bp, human
gtcatcttcgaaggagagga

SEQ ID NO: 179737 - DNA, 20 bp, human
gagaagcgccaagtgcgcat

SEQ ID NO: 179738 - DNA, 20 bp, human
gggagcctgactgagaataa

SEQ ID NO: 179739 - DNA, 20 bp, human
gcaactgcctgacggcccaa

SEQ ID NO: 179740 - DNA, 20 bp, human
gtaggccttgtcatcttcga

SEQ ID NO: 179741 - DNA, 20 bp, human
gggcaggaagaaacgatggt

SEQ ID NO: 179742 - DNA, 20 bp, human
gtcctcaagcggagcaggaa

SEQ ID NO: 179743 - DNA, 20 bp, human
ggggaccgagtgactacctg

SEQ ID NO: 179744 - DNA, 20 bp, human
ggcgtgccttcagcacacaa

SEQ ID NO: 179745 - DNA, 20 bp, human
ggagcaggaacggaactggg

SEQ ID NO: 179746 - DNA, 20 bp, human
gaagggcagaggagactccc

SEQ ID NO: 179747 - DNA, 20 bp, human
ggtggcagccgggacacggg

SEQ ID NO: 179748 - DNA, 20 bp, human
gcgggcgaaaggctcttggt

SEQ ID NO: 179749 - DNA, 20 bp, human
ggaagcgcggcgagacgggc

SEQ ID NO: 179750 - DNA, 20 bp, human
gcgcggtcgagcacagccct

SEQ ID NO: 179751 - DNA, 20 bp, human
ggcggcctcgctgggaagcg

SEQ ID NO: 179752 - DNA, 20 bp, human
ggaggtggcagccgggacac

SEQ ID NO: 179753 - DNA, 20 bp, human
ggaggcgccggagaattcgg

SEQ ID NO: 179754 - DNA, 20 bp, human
gcagtgtgtgtgcagagata

SEQ ID NO: 179755 - DNA, 20 bp, human
ggcactcgcgggcagtgacg

SEQ ID NO: 179756 - DNA, 20 bp, human
gcgccgaatggagcgagagt

SEQ ID NO: 179757 - DNA, 20 bp, human
ggttccttggcgtacaggac

SEQ ID NO: 179758 - DNA, 20 bp, human
gactgggtgctcccgccgaa

SEQ ID NO: 179759 - DNA, 20 bp, human
gtggaagagagagtccgtgc

SEQ ID NO: 179760 - DNA, 20 bp, human
ggagtccgtgctggtgcccg

SEQ ID NO: 179761 - DNA, 20 bp, human
gcccccactctcgctccatt

SEQ ID NO: 179762 - DNA, 20 bp, human
gttgtcctgtgtgcagggat

SEQ ID NO: 179763 - DNA, 20 bp, human
gcacccagtcctgtacgcca

SEQ ID NO: 179764 - DNA, 20 bp, human
ggggccatgagagtgctgtt

SEQ ID NO: 179765 - DNA, 20 bp, human
gagcgagagtggggggcacc

SEQ ID NO: 179766 - DNA, 20 bp, human
gcagcgccagtagccagtag

SEQ ID NO: 179767 - DNA, 20 bp, human
gggccgcctgagtcacacac

SEQ ID NO: 179768 - DNA, 20 bp, human
gagtagccagtagtggagga

SEQ ID NO: 179769 - DNA, 20 bp, human
gagtcgcccagcgggcccgg

SEQ ID NO: 179770 - DNA, 20 bp, human
gttgctgagtggctgaccca

SEQ ID NO: 179771 - DNA, 20 bp, human
gctggcgtcactgccaaggg

SEQ ID NO: 179772 - DNA, 20 bp, human
gctgcgccgtcctccactac

SEQ ID NO: 179773 - DNA, 20 bp, human
gcccgcaggcagtcgcccag

SEQ ID NO: 179774 - DNA, 20 bp, human
gcgcctgagtcacacacggg

SEQ ID NO: 179775 - DNA, 20 bp, human
gcgacctcggcttccaatga

SEQ ID NO: 179776 - DNA, 20 bp, human
ggctcgccgaccgccctcgg

SEQ ID NO: 179777 - DNA, 20 bp, human
gcgtggagcagagagccagt

SEQ ID NO: 179778 - DNA, 20 bp, human
ggaacagctggtgcctccga

SEQ ID NO: 179779 - DNA, 20 bp, human
gtggtgcctccgagggcggt

SEQ ID NO: 179780 - DNA, 20 bp, human
gtgggagggcggcggaagag

SEQ ID NO: 179781 - DNA, 20 bp, human
gggaagagggggctgcgacc

SEQ ID NO: 179782 - DNA, 20 bp, human
gtgaagcgccgggtgatggg

SEQ ID NO: 179783 - DNA, 20 bp, human
gtgcgacccggcgccccacg

SEQ ID NO: 179784 - DNA, 20 bp, human
gcctagggagtgccccggag

SEQ ID NO: 179785 - DNA, 20 bp, human
gcgcgctcgccgaccgccct

SEQ ID NO: 179786 - DNA, 20 bp, human
gggagcggcgcagcatctgc

SEQ ID NO: 179787 - DNA, 20 bp, human
gcaggagacccaggacaggt

SEQ ID NO: 179788 - DNA, 20 bp, human
gacgccccgcggctcagacc

SEQ ID NO: 179789 - DNA, 20 bp, human
ggcggcgcagcatctgcggg

SEQ ID NO: 179790 - DNA, 20 bp, human
gcagacctggcacagactct

SEQ ID NO: 179791 - DNA, 20 bp, human
gctgcgtggggaagcctcgg

SEQ ID NO: 179792 - DNA, 20 bp, human
gtctgagccgcggggcgtgg

SEQ ID NO: 179793 - DNA, 20 bp, human
ggcccgggcagtgaagggcc

SEQ ID NO: 179794 - DNA, 20 bp, human
gctgtgccaggtctgagccg

SEQ ID NO: 179795 - DNA, 20 bp, human
ggtctctgcttgtccccccg

SEQ ID NO: 179796 - DNA, 20 bp, human
gtgaccacgctggtgatcat

SEQ ID NO: 179797 - DNA, 20 bp, human
ggctacgtggccgtgtgggt

SEQ ID NO: 179798 - DNA, 20 bp, human
gctgcgctacgtggccgtgt

SEQ ID NO: 179799 - DNA, 20 bp, human
gcgcggagaccgcgcctggt

SEQ ID NO: 179800 - DNA, 20 bp, human
gccggcgagctcgaaacctg

SEQ ID NO: 179801 - DNA, 20 bp, human
ggcctggtgggaagcacgcg

SEQ ID NO: 179802 - DNA, 20 bp, human
ggaccggaggagacaagatc

SEQ ID NO: 179803 - DNA, 20 bp, human
gaccagggcccgcgcaagat

SEQ ID NO: 179804 - DNA, 20 bp, human
gcggccgccggttcgcgcat

SEQ ID NO: 179805 - DNA, 20 bp, human
gacctcggcgcccacccaca

SEQ ID NO: 179806 - DNA, 20 bp, human
gccccccgaatgaccaaata

SEQ ID NO: 179807 - DNA, 20 bp, human
gttgttccgagggcaggatg

SEQ ID NO: 179808 - DNA, 20 bp, human
gaccaaatagggcgcaggag

SEQ ID NO: 179809 - DNA, 20 bp, human
gaccccgcccggtcacctct

SEQ ID NO: 179810 - DNA, 20 bp, human
ggacccagaggtgaccgggc

SEQ ID NO: 179811 - DNA, 20 bp, human
ggcgttcggccagacacacg

SEQ ID NO: 179812 - DNA, 20 bp, human
gcgtcagccccgttcgtggg

SEQ ID NO: 179813 - DNA, 20 bp, human
gcaggatgcggcagcctcgt

SEQ ID NO: 179814 - DNA, 20 bp, human
ggcgctgcctcccacgaacg

SEQ ID NO: 179815 - DNA, 20 bp, human
ggtgtctggccgaacgctcg

SEQ ID NO: 179816 - DNA, 20 bp, human
gcacagactggatcctactg

SEQ ID NO: 179817 - DNA, 20 bp, human
ggctcacctgagtgcaggtt

SEQ ID NO: 179818 - DNA, 20 bp, human
gaaggcagggccgagcaggt

SEQ ID NO: 179819 - DNA, 20 bp, human
gtgctggatccgatccgaga

SEQ ID NO: 179820 - DNA, 20 bp, human
gctgcagaggagtctccggg

SEQ ID NO: 179821 - DNA, 20 bp, human
gaggacagggcagaagacgt

SEQ ID NO: 179822 - DNA, 20 bp, human
gggcaggtgaagtgtctccc

SEQ ID NO: 179823 - DNA, 20 bp, human
gcgagaaggcagggccgagc

SEQ ID NO: 179824 - DNA, 20 bp, human
gggaggacagatacctcgtc

SEQ ID NO: 179825 - DNA, 20 bp, human
gctcaggtgagcctgccggg

SEQ ID NO: 179826 - DNA, 20 bp, human
gataaggtactggtattccg

SEQ ID NO: 179827 - DNA, 20 bp, human
ggccacgccggagttcactg

SEQ ID NO: 179828 - DNA, 20 bp, human
gcaaaggccacagtgaactc

SEQ ID NO: 179829 - DNA, 20 bp, human
gactccggcgtggctgagga

SEQ ID NO: 179830 - DNA, 20 bp, human
ggccacagtgaactccggcg

SEQ ID NO: 179831 - DNA, 20 bp, human
ggcctttgctcaaattacct

SEQ ID NO: 179832 - DNA, 20 bp, human
gctgagagataggcagtgtg

SEQ ID NO: 179833 - DNA, 20 bp, human
gtggaagagctctgagagat

SEQ ID NO: 179834 - DNA, 20 bp, human
gtgtcaggagaagcacgacg

SEQ ID NO: 179835 - DNA, 20 bp, human
ggtgaactccggcgtggctg

SEQ ID NO: 179836 - DNA, 20 bp, human
gggtaggcggaaatccgaag

SEQ ID NO: 179837 - DNA, 20 bp, human
ggattcaggtgtggtgccgg

SEQ ID NO: 179838 - DNA, 20 bp, human
ggcgcttcctcagttcccac

SEQ ID NO: 179839 - DNA, 20 bp, human
gaagccaagggattcaggtg

SEQ ID NO: 179840 - DNA, 20 bp, human
gatctagccagaggaagcgt

SEQ ID NO: 179841 - DNA, 20 bp, human
gctgaggaagcgcccaaggt

SEQ ID NO: 179842 - DNA, 20 bp, human
gggtgttcgggtatgaggct

SEQ ID NO: 179843 - DNA, 20 bp, human
ggtcacatgagccaccaaaa

SEQ ID NO: 179844 - DNA, 20 bp, human
gatggtggtgttcgggtatg

SEQ ID NO: 179845 - DNA, 20 bp, human
gagccttcccacgcttcctc

SEQ ID NO: 179846 - DNA, 20 bp, human
gttgacaccagaggataggg

SEQ ID NO: 179847 - DNA, 20 bp, human
gagggctgcgggaattcggg

SEQ ID NO: 179848 - DNA, 20 bp, human
gagccgagaagcccgtgact

SEQ ID NO: 179849 - DNA, 20 bp, human
ggataggggggtgggacccg

SEQ ID NO: 179850 - DNA, 20 bp, human
ggcagagcctgacagtccgg

SEQ ID NO: 179851 - DNA, 20 bp, human
ggtcccacccccctatcctc

SEQ ID NO: 179852 - DNA, 20 bp, human
ggagcaaagacccggagtca

SEQ ID NO: 179853 - DNA, 20 bp, human
ggggttgacaccagaggata

SEQ ID NO: 179854 - DNA, 20 bp, human
gctgggcagactcgagtggg

SEQ ID NO: 179855 - DNA, 20 bp, human
ggaggaagccggaagtgcat

SEQ ID NO: 179856 - DNA, 20 bp, human
ggcccgcgaggagtccatct

SEQ ID NO: 179857 - DNA, 20 bp, human
gaccaagatggactcctcgc

SEQ ID NO: 179858 - DNA, 20 bp, human
ggccgccccgaggttctcag

SEQ ID NO: 179859 - DNA, 20 bp, human
gggcctcggcgtccggcagg

SEQ ID NO: 179860 - DNA, 20 bp, human
gcaggaggaggaatcgccgc

SEQ ID NO: 179861 - DNA, 20 bp, human
gcggcccggcgtcaccctcg

SEQ ID NO: 179862 - DNA, 20 bp, human
ggtaccgccccgaaatgcga

SEQ ID NO: 179863 - DNA, 20 bp, human
gcttccgtcgcatttcgggg

SEQ ID NO: 179864 - DNA, 20 bp, human
gctcgcctctgagaacctcg

SEQ ID NO: 179865 - DNA, 20 bp, human
gcgcacatcattgtacactg

SEQ ID NO: 179866 - DNA, 20 bp, human
gtagctcgacagcttcccgg

SEQ ID NO: 179867 - DNA, 20 bp, human
gcacacggcgaacaccagat

SEQ ID NO: 179868 - DNA, 20 bp, human
gccgcccgcggggcactcta

SEQ ID NO: 179869 - DNA, 20 bp, human
ggagagtgaaggtcacctcg

SEQ ID NO: 179870 - DNA, 20 bp, human
gcgcaactgacgctactggg

SEQ ID NO: 179871 - DNA, 20 bp, human
ggcacctgtgcattgagcac

SEQ ID NO: 179872 - DNA, 20 bp, human
gcccgccgcgtggaactcgt

SEQ ID NO: 179873 - DNA, 20 bp, human
gtgcgcgatggacagccccg

SEQ ID NO: 179874 - DNA, 20 bp, human
gagcacaggtggggaaactt

SEQ ID NO: 179875 - DNA, 20 bp, human
gcagggccggccgagaagag

SEQ ID NO: 179876 - DNA, 20 bp, human
gggtggaagcaggaatccag

SEQ ID NO: 179877 - DNA, 20 bp, human
gtggagctcgagaactgcgg

SEQ ID NO: 179878 - DNA, 20 bp, human
gcacccccgcgcggtttcca

SEQ ID NO: 179879 - DNA, 20 bp, human
ggagcgggagaagcgtgggg

SEQ ID NO: 179880 - DNA, 20 bp, human
gcatggtccccaggcatcga

SEQ ID NO: 179881 - DNA, 20 bp, human
gtagcgggtgcatggtcccc

SEQ ID NO: 179882 - DNA, 20 bp, human
gagcgtggggcggacgcgga

SEQ ID NO: 179883 - DNA, 20 bp, human
gtgccctggaaaccgcgcgg

SEQ ID NO: 179884 - DNA, 20 bp, human
gccgggagcagggattgcgg

SEQ ID NO: 179885 - DNA, 20 bp, human
gactgcggcggtcgctcctc

SEQ ID NO: 179886 - DNA, 20 bp, human
gacaagcagtcggagcggag

SEQ ID NO: 179887 - DNA, 20 bp, human
gctggtgatgaccctcgtag

SEQ ID NO: 179888 - DNA, 20 bp, human
gcgcctacaagcagtcggag

SEQ ID NO: 179889 - DNA, 20 bp, human
gggcatcgcctacaagcagt

SEQ ID NO: 179890 - DNA, 20 bp, human
ggggcggccatactggaaac

SEQ ID NO: 179891 - DNA, 20 bp, human
gcgcgccgcagccactacga

SEQ ID NO: 179892 - DNA, 20 bp, human
ggcggcgccgggagcgacaa

SEQ ID NO: 179893 - DNA, 20 bp, human
gtgagcgagagtgtcagtca

SEQ ID NO: 179894 - DNA, 20 bp, human
ggccgtgcccgtttccagta

SEQ ID NO: 179895 - DNA, 20 bp, human
ggaaggtgggtgtcccccgg

SEQ ID NO: 179896 - DNA, 20 bp, human
gggctgcaattcccagacaa

SEQ ID NO: 179897 - DNA, 20 bp, human
ggctgggggcaggttcccga

SEQ ID NO: 179898 - DNA, 20 bp, human
ggttcagtccgagaacccaa

SEQ ID NO: 179899 - DNA, 20 bp, human
gcaatggagcgggagcagtg

SEQ ID NO: 179900 - DNA, 20 bp, human
gggcagagccaggggccgta

SEQ ID NO: 179901 - DNA, 20 bp, human
gccccagccactcgccccta

SEQ ID NO: 179902 - DNA, 20 bp, human
ggccgggtcgtgcaaggtga

SEQ ID NO: 179903 - DNA, 20 bp, human
gtgacctctcacgacgtcca

SEQ ID NO: 179904 - DNA, 20 bp, human
gaaggtgaaggaagccttag

SEQ ID NO: 179905 - DNA, 20 bp, human
gatggccggtcgcacaacag

SEQ ID NO: 179906 - DNA, 20 bp, human
gcccccggtgcagacagcag

SEQ ID NO: 179907 - DNA, 20 bp, human
ggcctcagctccagactcta

SEQ ID NO: 179908 - DNA, 20 bp, human
ggtgcaaccaggacagggat

SEQ ID NO: 179909 - DNA, 20 bp, human
gaaggctcagggggcatcca

SEQ ID NO: 179910 - DNA, 20 bp, human
ggcctggtgcaaccaggaca

SEQ ID NO: 179911 - DNA, 20 bp, human
gggtggaaaggtctagcagg

SEQ ID NO: 179912 - DNA, 20 bp, human
gagactctacgggaaatgtt

SEQ ID NO: 179913 - DNA, 20 bp, human
ggggatgggaccagacccaa

SEQ ID NO: 179914 - DNA, 20 bp, human
gcccgtagagtctggagctg

SEQ ID NO: 179915 - DNA, 20 bp, human
gacagcagtggtgtccattc

SEQ ID NO: 179916 - DNA, 20 bp, human
gggcggctcggcacccgcag

SEQ ID NO: 179917 - DNA, 20 bp, human
gccgcagaggcgctgttgat

SEQ ID NO: 179918 - DNA, 20 bp, human
ggcgctgctgggcaaaggta

SEQ ID NO: 179919 - DNA, 20 bp, human
gcgcccttctggattagggg

SEQ ID NO: 179920 - DNA, 20 bp, human
gagccgcccctaatccagaa

SEQ ID NO: 179921 - DNA, 20 bp, human
ggtgagggcagccgaagcga

SEQ ID NO: 179922 - DNA, 20 bp, human
gggagcgcccttctggatta

SEQ ID NO: 179923 - DNA, 20 bp, human
ggccgaagcgaggggtgcgg

SEQ ID NO: 179924 - DNA, 20 bp, human
gctgggcaaaggtaaggccg

SEQ ID NO: 179925 - DNA, 20 bp, human
ggccgggatccgggcaagtt

SEQ ID NO: 179926 - DNA, 20 bp, human
gtccaggcgcagggctccgg

SEQ ID NO: 179927 - DNA, 20 bp, human
gggaaaggaaataccccctg

SEQ ID NO: 179928 - DNA, 20 bp, human
gctgcgcgcgtgttggactc

SEQ ID NO: 179929 - DNA, 20 bp, human
gggactccggagagcaactc

SEQ ID NO: 179930 - DNA, 20 bp, human
gtcgctcgggtaaacaggaa

SEQ ID NO: 179931 - DNA, 20 bp, human
gcccctccttgggccaccgg

SEQ ID NO: 179932 - DNA, 20 bp, human
gcgctccggcacccaaagtt

SEQ ID NO: 179933 - DNA, 20 bp, human
gtgttggggtcgaaggaggg

SEQ ID NO: 179934 - DNA, 20 bp, human
gtgcaggctccggagacgcg

SEQ ID NO: 179935 - DNA, 20 bp, human
gaggcggctcggagcccccc

SEQ ID NO: 179936 - DNA, 20 bp, human
gagagacgccaaacccggag

SEQ ID NO: 179937 - DNA, 20 bp, human
gcgagcccggcgccagaaaa

SEQ ID NO: 179938 - DNA, 20 bp, human
ggcgccgcgacacttaccgt

SEQ ID NO: 179939 - DNA, 20 bp, human
ggtgggcgagtagcgctgag

SEQ ID NO: 179940 - DNA, 20 bp, human
ggaccagagagtgcaattcg

SEQ ID NO: 179941 - DNA, 20 bp, human
gacaccctcggagccggtgg

SEQ ID NO: 179942 - DNA, 20 bp, human
ggcccggcgccagaaaaggg

SEQ ID NO: 179943 - DNA, 20 bp, human
gctgagacagccgggcgcca

SEQ ID NO: 179944 - DNA, 20 bp, human
ggacgccaaacccggagtgg

SEQ ID NO: 179945 - DNA, 20 bp, human
gcggcaggcgccactggagg

SEQ ID NO: 179946 - DNA, 20 bp, human
gctgcgaatcaacaggagac

SEQ ID NO: 179947 - DNA, 20 bp, human
gtgcttgaggcaaagctctg

SEQ ID NO: 179948 - DNA, 20 bp, human
gggtcctacgcagtgatgtg

SEQ ID NO: 179949 - DNA, 20 bp, human
ggaaggtaacaaaaaagggt

SEQ ID NO: 179950 - DNA, 20 bp, human
gaggtcacgaaaaagaacac

SEQ ID NO: 179951 - DNA, 20 bp, human
gatactttgactaaagtcag

SEQ ID NO: 179952 - DNA, 20 bp, human
ggaaaagggtatcattcatg

SEQ ID NO: 179953 - DNA, 20 bp, human
ggggttctaaatgctaaaga

SEQ ID NO: 179954 - DNA, 20 bp, human
gtgacctcacatcactgcgt

SEQ ID NO: 179955 - DNA, 20 bp, human
gtcagaggcagaccaattta

SEQ ID NO: 179956 - DNA, 20 bp, human
gggtgtgtgggcgcagatgg

SEQ ID NO: 179957 - DNA, 20 bp, human
ggcggcgacgctgggtgtgt

SEQ ID NO: 179958 - DNA, 20 bp, human
gtcatggccccggcccgctc

SEQ ID NO: 179959 - DNA, 20 bp, human
ggctggctggggcccggtat

SEQ ID NO: 179960 - DNA, 20 bp, human
gggcggagccagggtcggag

SEQ ID NO: 179961 - DNA, 20 bp, human
gcgagtagccaggatgagtg

SEQ ID NO: 179962 - DNA, 20 bp, human
gctgggtgtgtgggcgcaga

SEQ ID NO: 179963 - DNA, 20 bp, human
gtgacgaggacaagcagtcc

SEQ ID NO: 179964 - DNA, 20 bp, human
gcgggggcagggggttaggt

SEQ ID NO: 179965 - DNA, 20 bp, human
gccctcccggttcccatacc

SEQ ID NO: 179966 - DNA, 20 bp, human
gggaacagcgcggagaagac

SEQ ID NO: 179967 - DNA, 20 bp, human
ggctgagggccgccatgacg

SEQ ID NO: 179968 - DNA, 20 bp, human
ggccatgacgaggaacagcg

SEQ ID NO: 179969 - DNA, 20 bp, human
gacagcgcggagaagacagg

SEQ ID NO: 179970 - DNA, 20 bp, human
ggcaggaagggtgccaagtg

SEQ ID NO: 179971 - DNA, 20 bp, human
gtgcagttggtgctcccgag

SEQ ID NO: 179972 - DNA, 20 bp, human
gtccgcgctgttcctcgtca

SEQ ID NO: 179973 - DNA, 20 bp, human
ggaaggagacccggcaggaa

SEQ ID NO: 179974 - DNA, 20 bp, human
gagtctggaagatgggccgg

SEQ ID NO: 179975 - DNA, 20 bp, human
ggatctcatagcagttatga

SEQ ID NO: 179976 - DNA, 20 bp, human
ggaacgggagaaaccaggag

SEQ ID NO: 179977 - DNA, 20 bp, human
ggccagccacgcctgctcca

SEQ ID NO: 179978 - DNA, 20 bp, human
gcagctcccggcccggatcg

SEQ ID NO: 179979 - DNA, 20 bp, human
ggaaggccatcgcggctcag

SEQ ID NO: 179980 - DNA, 20 bp, human
ggccagtctggccctggaac

SEQ ID NO: 179981 - DNA, 20 bp, human
ggcgccgagcggttacctgg

SEQ ID NO: 179982 - DNA, 20 bp, human
gcagggccagactggcgagg

SEQ ID NO: 179983 - DNA, 20 bp, human
gttcgcgccgagcggttacc

SEQ ID NO: 179984 - DNA, 20 bp, human
gggccaccgacgctccgaaa

SEQ ID NO: 179985 - DNA, 20 bp, human
gtcccgttccagggccagac

SEQ ID NO: 179986 - DNA, 20 bp, human
ggaggtgagagtgattgacg

SEQ ID NO: 179987 - DNA, 20 bp, human
gctgctgacttgagacctgg

SEQ ID NO: 179988 - DNA, 20 bp, human
gaagggaaggcggcaggtag

SEQ ID NO: 179989 - DNA, 20 bp, human
gtgccctaggtacaaaggga

SEQ ID NO: 179990 - DNA, 20 bp, human
gaggaggaacgggagttagg

SEQ ID NO: 179991 - DNA, 20 bp, human
ggatggtggcctatgagtag

SEQ ID NO: 179992 - DNA, 20 bp, human
gtgtcatgcggacatcgtcc

SEQ ID NO: 179993 - DNA, 20 bp, human
gagagtgattgacgaggagt

SEQ ID NO: 179994 - DNA, 20 bp, human
gtggagaagaaacgccgagg

SEQ ID NO: 179995 - DNA, 20 bp, human
gacttggagaagaaacgccg

SEQ ID NO: 179996 - DNA, 20 bp, human
gcaggtgtgggtgcgagggt

SEQ ID NO: 179997 - DNA, 20 bp, human
gcagccactgggctacctcc

SEQ ID NO: 179998 - DNA, 20 bp, human
gctggagcatgggctaacac

SEQ ID NO: 179999 - DNA, 20 bp, human
gggagggagaaagtgcacac

SEQ ID NO: 180000 - DNA, 20 bp, human
ggagcatgggctaacaccgg

SEQ ID NO: 180001 - DNA, 20 bp, human
gagcgacgaacttctgagac

SEQ ID NO: 180002 - DNA, 20 bp, human
gcgaacttctgagacaggtg

SEQ ID NO: 180003 - DNA, 20 bp, human
gctgtagaaagtagatgggg

SEQ ID NO: 180004 - DNA, 20 bp, human
gcaggcgcaccaaagccaca

SEQ ID NO: 180005 - DNA, 20 bp, human
gtgggaccgaggtgtgagga

SEQ ID NO: 180006 - DNA, 20 bp, human
gggagtggaagggaaatggc

SEQ ID NO: 180007 - DNA, 20 bp, human
gcacgactgcgaaggcaagg

SEQ ID NO: 180008 - DNA, 20 bp, human
gatgccgaagagtggaagga

SEQ ID NO: 180009 - DNA, 20 bp, human
gggcagatgcagtcctgagc

SEQ ID NO: 180010 - DNA, 20 bp, human
gcgcagtgtgtacaaggaca

SEQ ID NO: 180011 - DNA, 20 bp, human
gagaagcaggaaatcagggt

SEQ ID NO: 180012 - DNA, 20 bp, human
gtacaaggtagtagacgtct

SEQ ID NO: 180013 - DNA, 20 bp, human
gggcaagggggcaccagctc

SEQ ID NO: 180014 - DNA, 20 bp, human
gtccacataggggaactcac

SEQ ID NO: 180015 - DNA, 20 bp, human
gttactaggcacgactgcga

SEQ ID NO: 180016 - DNA, 20 bp, human
gtgccaagcacccggtgaga

SEQ ID NO: 180017 - DNA, 20 bp, human
gtgccaaccatggtgaactt

SEQ ID NO: 180018 - DNA, 20 bp, human
ggccacggcgtcgtccaccc

SEQ ID NO: 180019 - DNA, 20 bp, human
gcccagaccggccttctcac

SEQ ID NO: 180020 - DNA, 20 bp, human
gtcccgggtggacgacgccg

SEQ ID NO: 180021 - DNA, 20 bp, human
ggggctcagggcgtccgggt

SEQ ID NO: 180022 - DNA, 20 bp, human
gggtgaacttgggtctgtcc

SEQ ID NO: 180023 - DNA, 20 bp, human
gaacttgggtctgtcccggg

SEQ ID NO: 180024 - DNA, 20 bp, human
gaccgggtgcttggcagcca

SEQ ID NO: 180025 - DNA, 20 bp, human
gtcacaggtaggctgcgtcc

SEQ ID NO: 180026 - DNA, 20 bp, human
gcgcagtccaacgttcgccg

SEQ ID NO: 180027 - DNA, 20 bp, human
gaaggtgagggagaaatcgg

SEQ ID NO: 180028 - DNA, 20 bp, human
gtcgagctttggctaaggtg

SEQ ID NO: 180029 - DNA, 20 bp, human
gttccccggagcctaaacag

SEQ ID NO: 180030 - DNA, 20 bp, human
gatgctgcatgtgacccggg

SEQ ID NO: 180031 - DNA, 20 bp, human
gctggacccccagacccccc

SEQ ID NO: 180032 - DNA, 20 bp, human
gcatggctagaccctttccc

SEQ ID NO: 180033 - DNA, 20 bp, human
ggacagtcgagctttggcta

SEQ ID NO: 180034 - DNA, 20 bp, human
gggggtcaaaggccatctag

SEQ ID NO: 180035 - DNA, 20 bp, human
gtctggagggtgggacgtgg

SEQ ID NO: 180036 - DNA, 20 bp, human
ggatcgcgccggcgctgagt

SEQ ID NO: 180037 - DNA, 20 bp, human
gctccacactggcacgtagt

SEQ ID NO: 180038 - DNA, 20 bp, human
ggcgccggcgctgagtagga

SEQ ID NO: 180039 - DNA, 20 bp, human
ggagggaatgagtcaggctc

SEQ ID NO: 180040 - DNA, 20 bp, human
gcgtagtgggcggatcgcgc

SEQ ID NO: 180041 - DNA, 20 bp, human
gggccgcccccagcacgtag

SEQ ID NO: 180042 - DNA, 20 bp, human
gtactcactgcgttccgggc

SEQ ID NO: 180043 - DNA, 20 bp, human
gtcactgcgttccgggctgg

SEQ ID NO: 180044 - DNA, 20 bp, human
ggctccttcctactcagcgc

SEQ ID NO: 180045 - DNA, 20 bp, human
gcgcccactacgtgccagtg

SEQ ID NO: 180046 - DNA, 20 bp, human
ggtcctgagcgggagtgtgg

SEQ ID NO: 180047 - DNA, 20 bp, human
ggtgcagaggtggtgctgaa

SEQ ID NO: 180048 - DNA, 20 bp, human
gaggtctggccgcgacccta

SEQ ID NO: 180049 - DNA, 20 bp, human
gtccgctccggctcccgcac

SEQ ID NO: 180050 - DNA, 20 bp, human
gcgcactggcccggcaatgg

SEQ ID NO: 180051 - DNA, 20 bp, human
gtcccgcactggcccggcaa

SEQ ID NO: 180052 - DNA, 20 bp, human
gtcccggagtccgccaggag

SEQ ID NO: 180053 - DNA, 20 bp, human
gggttgtaggagggacgttg

SEQ ID NO: 180054 - DNA, 20 bp, human
ggaggctaaggggagccgta

SEQ ID NO: 180055 - DNA, 20 bp, human
ggagagtcagagtttgggaa

SEQ ID NO: 180056 - DNA, 20 bp, human
gtccgccggctctttcgcca

SEQ ID NO: 180057 - DNA, 20 bp, human
ggtctccgggagcgggtctc

SEQ ID NO: 180058 - DNA, 20 bp, human
ggggcgcggataggcaacgg

SEQ ID NO: 180059 - DNA, 20 bp, human
gcgagggcggtcccaccgtg

SEQ ID NO: 180060 - DNA, 20 bp, human
gggcgtcaggatacctagag

SEQ ID NO: 180061 - DNA, 20 bp, human
gctggccgtggcgaaagagc

SEQ ID NO: 180062 - DNA, 20 bp, human
ggatcgcgaggcggcgtctc

SEQ ID NO: 180063 - DNA, 20 bp, human
gcagtgcggagtcccgaggg

SEQ ID NO: 180064 - DNA, 20 bp, human
gcggcctgtgagtgcgggaa

SEQ ID NO: 180065 - DNA, 20 bp, human
gtcccagtgcggagtcccga

SEQ ID NO: 180066 - DNA, 20 bp, human
ggagtgggacagcgctggtg

SEQ ID NO: 180067 - DNA, 20 bp, human
gagacggctgggcgccgagt

SEQ ID NO: 180068 - DNA, 20 bp, human
gaagcgcggtacctggagtc

SEQ ID NO: 180069 - DNA, 20 bp, human
ggtgccctccaagagctcaa

SEQ ID NO: 180070 - DNA, 20 bp, human
gcaccaccccagatccagga

SEQ ID NO: 180071 - DNA, 20 bp, human
ggcgccgagtgggacagcgc

SEQ ID NO: 180072 - DNA, 20 bp, human
gctacccttgagctcttgga

SEQ ID NO: 180073 - DNA, 20 bp, human
gggccagctgccgccaagcg

SEQ ID NO: 180074 - DNA, 20 bp, human
ggagactgcttccggactcc

SEQ ID NO: 180075 - DNA, 20 bp, human
gctccaggtaccgcgcttgg

SEQ ID NO: 180076 - DNA, 20 bp, human
gaggcccgcggagtccacta

SEQ ID NO: 180077 - DNA, 20 bp, human
gcacagcagccaggtctctc

SEQ ID NO: 180078 - DNA, 20 bp, human
gtcgcgtttccggagagacc

SEQ ID NO: 180079 - DNA, 20 bp, human
gcgcggcttgcgctccgtag

SEQ ID NO: 180080 - DNA, 20 bp, human
gccgacctgccgaaggcccg

SEQ ID NO: 180081 - DNA, 20 bp, human
gcgctccgtagtggactccg

SEQ ID NO: 180082 - DNA, 20 bp, human
ggcccacagttcttaactcg

SEQ ID NO: 180083 - DNA, 20 bp, human
ggactccgcgggccttcggc

SEQ ID NO: 180084 - DNA, 20 bp, human
gacctgcaccgacctgccga

SEQ ID NO: 180085 - DNA, 20 bp, human
gggagaaaggcgggacgtcg

SEQ ID NO: 180086 - DNA, 20 bp, human
gtcgagacggcaccgagtaa

SEQ ID NO: 180087 - DNA, 20 bp, human
gggtgtcgccggaaatgcag

SEQ ID NO: 180088 - DNA, 20 bp, human
gaggccccggctgtctacaa

SEQ ID NO: 180089 - DNA, 20 bp, human
gcggcgggcgctctccgtcc

SEQ ID NO: 180090 - DNA, 20 bp, human
gctttgcctcaggagcccag

SEQ ID NO: 180091 - DNA, 20 bp, human
ggcgctctccgtcccggtgg

SEQ ID NO: 180092 - DNA, 20 bp, human
ggcgcccttgtagacagccg

SEQ ID NO: 180093 - DNA, 20 bp, human
ggcgcagtgtaccgggagag

SEQ ID NO: 180094 - DNA, 20 bp, human
ggtcgccggaaatgcagcgg

SEQ ID NO: 180095 - DNA, 20 bp, human
gaccggtctcacgaaggccc

SEQ ID NO: 180096 - DNA, 20 bp, human
gcctgctgcagtctcctgtc

SEQ ID NO: 180097 - DNA, 20 bp, human
ggtctgggtaaattgatgag

SEQ ID NO: 180098 - DNA, 20 bp, human
gcaaagccaagccagtataa

SEQ ID NO: 180099 - DNA, 20 bp, human
gagacatagctacaactgac

SEQ ID NO: 180100 - DNA, 20 bp, human
gcagccatcacggaatccaa

SEQ ID NO: 180101 - DNA, 20 bp, human
gctgctttaggtgggatcag

SEQ ID NO: 180102 - DNA, 20 bp, human
gcccacaggtgcctttatac

SEQ ID NO: 180103 - DNA, 20 bp, human
gtaaaggcacctgtgggcca

SEQ ID NO: 180104 - DNA, 20 bp, human
gtcagtggttatgcaaaagt

SEQ ID NO: 180105 - DNA, 20 bp, human
ggaatccagcagaaggggac

SEQ ID NO: 180106 - DNA, 20 bp, human
gcgagggccgcagctagagt

SEQ ID NO: 180107 - DNA, 20 bp, human
gtagagtcggcgccacgagg

SEQ ID NO: 180108 - DNA, 20 bp, human
gaccctgctcggccccctcg

SEQ ID NO: 180109 - DNA, 20 bp, human
ggaacaccctctggcactgg

SEQ ID NO: 180110 - DNA, 20 bp, human
gagcccagtacgcacctccc

SEQ ID NO: 180111 - DNA, 20 bp, human
gccctcggagcagccctgaa

SEQ ID NO: 180112 - DNA, 20 bp, human
gccggcgtgctgagagacgc

SEQ ID NO: 180113 - DNA, 20 bp, human
ggcgtgctgagagacgcagg

SEQ ID NO: 180114 - DNA, 20 bp, human
ggtggcgccgactctagctg

SEQ ID NO: 180115 - DNA, 20 bp, human
gcggaccgtaacatctggaa

SEQ ID NO: 180116 - DNA, 20 bp, human
gaagctatgagggagcccag

SEQ ID NO: 180117 - DNA, 20 bp, human
gcaccggccacgggtaggtt

SEQ ID NO: 180118 - DNA, 20 bp, human
gaggatccttccagaagcta

SEQ ID NO: 180119 - DNA, 20 bp, human
gggaattaggccccactcac

SEQ ID NO: 180120 - DNA, 20 bp, human
gagcagccctagcttctgga

SEQ ID NO: 180121 - DNA, 20 bp, human
ggcttctggaaggatccttc

SEQ ID NO: 180122 - DNA, 20 bp, human
gttgggtgtctggagcctga

SEQ ID NO: 180123 - DNA, 20 bp, human
gcaggggaatccctgtctgt

SEQ ID NO: 180124 - DNA, 20 bp, human
gcagacacccaacctacccg

SEQ ID NO: 180125 - DNA, 20 bp, human
ggaaagcccaggtgatccta

SEQ ID NO: 180126 - DNA, 20 bp, human
gccgccgcaccagagcaggt

SEQ ID NO: 180127 - DNA, 20 bp, human
gcagcccctcgaggcgacag

SEQ ID NO: 180128 - DNA, 20 bp, human
ggggccgctgtcgcctcgag

SEQ ID NO: 180129 - DNA, 20 bp, human
ggcagcagtagcggcgggta

SEQ ID NO: 180130 - DNA, 20 bp, human
gggacacctgtcaaaggacg

SEQ ID NO: 180131 - DNA, 20 bp, human
ggcagaagcccgagacccag

SEQ ID NO: 180132 - DNA, 20 bp, human
ggggtggggacacctgtcaa

SEQ ID NO: 180133 - DNA, 20 bp, human
ggggctgtgacctgctgcgg

SEQ ID NO: 180134 - DNA, 20 bp, human
ggcgccgcgcctacctgctc

SEQ ID NO: 180135 - DNA, 20 bp, human
gccccggcaagtccaggagt

SEQ ID NO: 180136 - DNA, 20 bp, human
gctgggcaccgggcatgata

SEQ ID NO: 180137 - DNA, 20 bp, human
ggccgagcggacgcccccgg

SEQ ID NO: 180138 - DNA, 20 bp, human
gggcaccgggcatgataggg

SEQ ID NO: 180139 - DNA, 20 bp, human
gggccaggcactgacgtcac

SEQ ID NO: 180140 - DNA, 20 bp, human
gggcactgacgtcacaggac

SEQ ID NO: 180141 - DNA, 20 bp, human
ggggcgtccgctcggctcag

SEQ ID NO: 180142 - DNA, 20 bp, human
gacgggcgaggctggatgag

SEQ ID NO: 180143 - DNA, 20 bp, human
gtgataggggggagcacgga

SEQ ID NO: 180144 - DNA, 20 bp, human
gagcacggagggctgcgacg

SEQ ID NO: 180145 - DNA, 20 bp, human
gctgcggcactgggacgcgt

SEQ ID NO: 180146 - DNA, 20 bp, human
ggctcggctcagacaaaagg

SEQ ID NO: 180147 - DNA, 20 bp, human
gtgtcaccttgaggccctcg

SEQ ID NO: 180148 - DNA, 20 bp, human
ggagctcaggacctcccggg

SEQ ID NO: 180149 - DNA, 20 bp, human
gccagctcggctcagacaaa

SEQ ID NO: 180150 - DNA, 20 bp, human
ggagggccccgcccgagagg

SEQ ID NO: 180151 - DNA, 20 bp, human
ggacgagggccccgcccgag

SEQ ID NO: 180152 - DNA, 20 bp, human
gctcagacaaaaggcggcgg

SEQ ID NO: 180153 - DNA, 20 bp, human
gaggcggagcggcgccgcga

SEQ ID NO: 180154 - DNA, 20 bp, human
gaaagggcaccgggagtaag

SEQ ID NO: 180155 - DNA, 20 bp, human
gacgcgtgcgatgggggatg

SEQ ID NO: 180156 - DNA, 20 bp, human
gatcaccagggcgaagacta

SEQ ID NO: 180157 - DNA, 20 bp, human
gtgtccgctcgcctcggcag

SEQ ID NO: 180158 - DNA, 20 bp, human
gggaacgagcgcgatcacca

SEQ ID NO: 180159 - DNA, 20 bp, human
gccgaggcgagcggacatgc

SEQ ID NO: 180160 - DNA, 20 bp, human
gtcccaggagtaggaagtgg

SEQ ID NO: 180161 - DNA, 20 bp, human
gcgaagactagggctgcgcg

SEQ ID NO: 180162 - DNA, 20 bp, human
gaggctacagaactctgccg

SEQ ID NO: 180163 - DNA, 20 bp, human
gtacagaactctgccgggga

SEQ ID NO: 180164 - DNA, 20 bp, human
gccttcccaggagtaggaag

SEQ ID NO: 180165 - DNA, 20 bp, human
ggcagccctagtcttcgccc

SEQ ID NO: 180166 - DNA, 20 bp, human
gcggcgcctccagcatggag

SEQ ID NO: 180167 - DNA, 20 bp, human
gcgcgttcgggtgccaggga

SEQ ID NO: 180168 - DNA, 20 bp, human
gccgcgaggacggagaatcg

SEQ ID NO: 180169 - DNA, 20 bp, human
gttcgggtgccagggacggt

SEQ ID NO: 180170 - DNA, 20 bp, human
gaggctcgcggtgcaccgag

SEQ ID NO: 180171 - DNA, 20 bp, human
gcgaggacggagaatcgagg

SEQ ID NO: 180172 - DNA, 20 bp, human
ggcgtctccgctcctgtggg

SEQ ID NO: 180173 - DNA, 20 bp, human
gagttcccactccatgctgg

SEQ ID NO: 180174 - DNA, 20 bp, human
gcagggacggtgggtgtatg

SEQ ID NO: 180175 - DNA, 20 bp, human
gagcggtgtgacccgagtgc

SEQ ID NO: 180176 - DNA, 20 bp, human
gtaccatgaatgtactgcaa

SEQ ID NO: 180177 - DNA, 20 bp, human
ggcagagataaacttaaagc

SEQ ID NO: 180178 - DNA, 20 bp, human
gttcccttgcagtacattca

SEQ ID NO: 180179 - DNA, 20 bp, human
ggccacaaataatttaagga

SEQ ID NO: 180180 - DNA, 20 bp, human
gtaattaagtactatgaatt

SEQ ID NO: 180181 - DNA, 20 bp, human
gttttggacacatgctgcat

SEQ ID NO: 180182 - DNA, 20 bp, human
gaaaaattagtgtcagctag

SEQ ID NO: 180183 - DNA, 20 bp, human
gaatatttcaagacaccgaa

SEQ ID NO: 180184 - DNA, 20 bp, human
gtttatctctgcagcacttt

SEQ ID NO: 180185 - DNA, 20 bp, human
gcaattatatactcaccttt

SEQ ID NO: 180186 - DNA, 20 bp, human
ggagcagcgcggcagcccaa

SEQ ID NO: 180187 - DNA, 20 bp, human
gcgttgactgaagcattgga

SEQ ID NO: 180188 - DNA, 20 bp, human
ggctgccgcgctgctctgcg

SEQ ID NO: 180189 - DNA, 20 bp, human
ggcgcctgccaagcccgcag

SEQ ID NO: 180190 - DNA, 20 bp, human
ggtgcaacatcagcgtgcag

SEQ ID NO: 180191 - DNA, 20 bp, human
ggggccggcgagctcacggt

SEQ ID NO: 180192 - DNA, 20 bp, human
gattggagggcaccccgagg

SEQ ID NO: 180193 - DNA, 20 bp, human
ggccgaggccagcagccgcg

SEQ ID NO: 180194 - DNA, 20 bp, human
ggcgatgggctcgtccgcgg

SEQ ID NO: 180195 - DNA, 20 bp, human
gagcccaagggccccggcgc

SEQ ID NO: 180196 - DNA, 20 bp, human
gttgcaggcgaagcgaagag

SEQ ID NO: 180197 - DNA, 20 bp, human
gtcgcctgcaaacgcggtgg

SEQ ID NO: 180198 - DNA, 20 bp, human
ggccccttacactaaccccg

SEQ ID NO: 180199 - DNA, 20 bp, human
ggcttcgcctgcaaacgcgg

SEQ ID NO: 180200 - DNA, 20 bp, human
gtccccaggttccccagaaa

SEQ ID NO: 180201 - DNA, 20 bp, human
gagaggggtctagccacccg

SEQ ID NO: 180202 - DNA, 20 bp, human
gcgtcgaggcaaacctccct

SEQ ID NO: 180203 - DNA, 20 bp, human
gccagaaaggggcacagtct

SEQ ID NO: 180204 - DNA, 20 bp, human
gccccggggcagaaagctac

SEQ ID NO: 180205 - DNA, 20 bp, human
gcccctttctggggaacctg

SEQ ID NO: 180206 - DNA, 20 bp, human
ggacctccggaagcgaagac

SEQ ID NO: 180207 - DNA, 20 bp, human
gcggccgtagtgcgaatcat

SEQ ID NO: 180208 - DNA, 20 bp, human
gccggaagcgaagacgggca

SEQ ID NO: 180209 - DNA, 20 bp, human
gccgtagtgcgaatcatggg

SEQ ID NO: 180210 - DNA, 20 bp, human
gctcgcgtgggaccttgatg

SEQ ID NO: 180211 - DNA, 20 bp, human
gagcgcaggtgcccgcagag

SEQ ID NO: 180212 - DNA, 20 bp, human
gtagtgcgaatcatgggagg

SEQ ID NO: 180213 - DNA, 20 bp, human
gatgggaggcggctggtggt

SEQ ID NO: 180214 - DNA, 20 bp, human
gacgaggaccccgggtaacg

SEQ ID NO: 180215 - DNA, 20 bp, human
gcggcaggcgcgattctacg

SEQ ID NO: 180216 - DNA, 20 bp, human
gcccggagccctaggccggt

SEQ ID NO: 180217 - DNA, 20 bp, human
gacgcggtgcactcacccac

SEQ ID NO: 180218 - DNA, 20 bp, human
gcatgacgcgtgcgagaacg

SEQ ID NO: 180219 - DNA, 20 bp, human
ggagcgtcccgcgaagtggg

SEQ ID NO: 180220 - DNA, 20 bp, human
gagtgcccggagccctaggc

SEQ ID NO: 180221 - DNA, 20 bp, human
ggcactcacccaccggccta

SEQ ID NO: 180222 - DNA, 20 bp, human
gcggcgggagttgtacccag

SEQ ID NO: 180223 - DNA, 20 bp, human
gggacctccgagggagtcgg

SEQ ID NO: 180224 - DNA, 20 bp, human
ggacccccgatggatcctgt

SEQ ID NO: 180225 - DNA, 20 bp, human
ggaggctctgagggattcgg

SEQ ID NO: 180226 - DNA, 20 bp, human
ggtctctcggctcaaggacc

SEQ ID NO: 180227 - DNA, 20 bp, human
ggggcaggagtgacaacggt

SEQ ID NO: 180228 - DNA, 20 bp, human
gtctcggctcaaggaccggg

SEQ ID NO: 180229 - DNA, 20 bp, human
ggactgccccggcaactcca

SEQ ID NO: 180230 - DNA, 20 bp, human
gtcaaggaccgggaggtaag

SEQ ID NO: 180231 - DNA, 20 bp, human
ggcagaagaggtgactgacc

SEQ ID NO: 180232 - DNA, 20 bp, human
gacccggcaaggtcaactct

SEQ ID NO: 180233 - DNA, 20 bp, human
gagacaccctggagttgccg

SEQ ID NO: 180234 - DNA, 20 bp, human
gtcgctgtttgagagtctct

SEQ ID NO: 180235 - DNA, 20 bp, human
gcagtaaatgggccatgaac

SEQ ID NO: 180236 - DNA, 20 bp, human
ggtgccggccgcagaaggtg

SEQ ID NO: 180237 - DNA, 20 bp, human
ggaacgccgctagccgagag

SEQ ID NO: 180238 - DNA, 20 bp, human
ggcggggctgcggatcccgg

SEQ ID NO: 180239 - DNA, 20 bp, human
ggtcggcctgaaggcagctg

SEQ ID NO: 180240 - DNA, 20 bp, human
gatgcccgcggccggctcca

SEQ ID NO: 180241 - DNA, 20 bp, human
ggaaggaaccgcagccgagg

SEQ ID NO: 180242 - DNA, 20 bp, human
gcgttctcgccgggaagtcg

SEQ ID NO: 180243 - DNA, 20 bp, human
gagggaaggaaccgcagccg

SEQ ID NO: 180244 - DNA, 20 bp, human
ggagcggccagttcagcgac

SEQ ID NO: 180245 - DNA, 20 bp, human
gctgcggcgctggatgcccg

SEQ ID NO: 180246 - DNA, 20 bp, human
ggcagtggcgaagcaagcag

SEQ ID NO: 180247 - DNA, 20 bp, human
gtctccagtggccaccaacg

SEQ ID NO: 180248 - DNA, 20 bp, human
ggacacgcggaggcaaggag

SEQ ID NO: 180249 - DNA, 20 bp, human
ggcgaaccgggagccaaaag

SEQ ID NO: 180250 - DNA, 20 bp, human
gaggagacccggcagtgctg

SEQ ID NO: 180251 - DNA, 20 bp, human
gggagcagtagcccgatccg

SEQ ID NO: 180252 - DNA, 20 bp, human
gccctcggggcttcactcac

SEQ ID NO: 180253 - DNA, 20 bp, human
gggctggaggggcccgtcgg

SEQ ID NO: 180254 - DNA, 20 bp, human
ggacaaggacggctctaaat

SEQ ID NO: 180255 - DNA, 20 bp, human
gagtgctgcggcagcgaacc

SEQ ID NO: 180256 - DNA, 20 bp, human
gcggcgcccgtcctctccgg

SEQ ID NO: 180257 - DNA, 20 bp, human
ggctcggcgcccgtcctctc

SEQ ID NO: 180258 - DNA, 20 bp, human
ggaggacgggcgccgagccg

SEQ ID NO: 180259 - DNA, 20 bp, human
gggtgcaagcagcgggagtg

SEQ ID NO: 180260 - DNA, 20 bp, human
gtctccggcggcggctaaac

SEQ ID NO: 180261 - DNA, 20 bp, human
ggcagtcagcaccatccggg

SEQ ID NO: 180262 - DNA, 20 bp, human
gggagcagtcagcaccatcc

SEQ ID NO: 180263 - DNA, 20 bp, human
gaggtgagcgggccgggatg

SEQ ID NO: 180264 - DNA, 20 bp, human
gcggcccgctcacctcgacc

SEQ ID NO: 180265 - DNA, 20 bp, human
gaggcctggagcctggtact

SEQ ID NO: 180266 - DNA, 20 bp, human
gcagccacatcacccttccg

SEQ ID NO: 180267 - DNA, 20 bp, human
gggcatcgccggcctcgcta

SEQ ID NO: 180268 - DNA, 20 bp, human
gcggctggagagggcgagaa

SEQ ID NO: 180269 - DNA, 20 bp, human
ggcctcgctatggtaagaag

SEQ ID NO: 180270 - DNA, 20 bp, human
gcaccagagtaaagccccta

SEQ ID NO: 180271 - DNA, 20 bp, human
gaagcccctagggcgagata

SEQ ID NO: 180272 - DNA, 20 bp, human
gtccggggctcaggcggaag

SEQ ID NO: 180273 - DNA, 20 bp, human
ggcctcttccgcctgagccc

SEQ ID NO: 180274 - DNA, 20 bp, human
gcacccttccggggctcagg

SEQ ID NO: 180275 - DNA, 20 bp, human
gccgaggaagactgctgggt

SEQ ID NO: 180276 - DNA, 20 bp, human
gccgggttcagtggtaatag

SEQ ID NO: 180277 - DNA, 20 bp, human
gctgggactgacctctccaa

SEQ ID NO: 180278 - DNA, 20 bp, human
gcggatcgggaagtgtcaag

SEQ ID NO: 180279 - DNA, 20 bp, human
gaacccgtagaggagtatag

SEQ ID NO: 180280 - DNA, 20 bp, human
gagtcacctcggcccggatc

SEQ ID NO: 180281 - DNA, 20 bp, human
ggtagggggtccgggttcag

SEQ ID NO: 180282 - DNA, 20 bp, human
gggtaatagcggcggagatg

SEQ ID NO: 180283 - DNA, 20 bp, human
gggttcagtggtaatagcgg

SEQ ID NO: 180284 - DNA, 20 bp, human
gggccagccgccatgacgaa

SEQ ID NO: 180285 - DNA, 20 bp, human
gggccctctcaacaaaacta

SEQ ID NO: 180286 - DNA, 20 bp, human
ggatttcggcggcggaaaca

SEQ ID NO: 180287 - DNA, 20 bp, human
gcgctaatacaggccagtgt

SEQ ID NO: 180288 - DNA, 20 bp, human
ggtcgcggccgggccggtaa

SEQ ID NO: 180289 - DNA, 20 bp, human
gttcggcggcggaaacatgg

SEQ ID NO: 180290 - DNA, 20 bp, human
ggtaccgtcgcggatttcgg

SEQ ID NO: 180291 - DNA, 20 bp, human
gggagaacgcgaccacaacg

SEQ ID NO: 180292 - DNA, 20 bp, human
gccgccgccgaaatccgcga

SEQ ID NO: 180293 - DNA, 20 bp, human
ggcgacggccgagtcaggta

SEQ ID NO: 180294 - DNA, 20 bp, human
gacccttgcgaaatacggag

SEQ ID NO: 180295 - DNA, 20 bp, human
gggcggaaacatggcggtcg

SEQ ID NO: 180296 - DNA, 20 bp, human
gtagctgagggggagaaatg

SEQ ID NO: 180297 - DNA, 20 bp, human
ggttctgctccgggaggatg

SEQ ID NO: 180298 - DNA, 20 bp, human
gggagcggttctgctccggg

SEQ ID NO: 180299 - DNA, 20 bp, human
gtccgccagcgtcggtccct

SEQ ID NO: 180300 - DNA, 20 bp, human
ggcccgggaaagagagtgaa

SEQ ID NO: 180301 - DNA, 20 bp, human
gctccctcccgaaggatgaa

SEQ ID NO: 180302 - DNA, 20 bp, human
gccgcaacctccgccagcgt

SEQ ID NO: 180303 - DNA, 20 bp, human
gatccttcgggagggagccc

SEQ ID NO: 180304 - DNA, 20 bp, human
gggcggaggttgcggacagc

SEQ ID NO: 180305 - DNA, 20 bp, human
gcggcaggcgggcgcagcga

SEQ ID NO: 180306 - DNA, 20 bp, human
ggactagcccgtgtctgagg

SEQ ID NO: 180307 - DNA, 20 bp, human
gccttgcgcggcacagagat

SEQ ID NO: 180308 - DNA, 20 bp, human
gaagcgcggcagctgacgtg

SEQ ID NO: 180309 - DNA, 20 bp, human
gggcatggagctgccggatc

SEQ ID NO: 180310 - DNA, 20 bp, human
gtcagacacgggctagtctg

SEQ ID NO: 180311 - DNA, 20 bp, human
ggacaatgatgggccttgcg

SEQ ID NO: 180312 - DNA, 20 bp, human
ggtttctccgggacaatgat

SEQ ID NO: 180313 - DNA, 20 bp, human
gggagcaccacgcggagacc

SEQ ID NO: 180314 - DNA, 20 bp, human
gcgaggctccgtggttccca

SEQ ID NO: 180315 - DNA, 20 bp, human
gctagtctgcgggcgctccg

SEQ ID NO: 180316 - DNA, 20 bp, human
ggctggaggtgacgctgagg

SEQ ID NO: 180317 - DNA, 20 bp, human
gggaccgccgaagaagtgat

SEQ ID NO: 180318 - DNA, 20 bp, human
gagcgcccgaagtgcggtag

SEQ ID NO: 180319 - DNA, 20 bp, human
gccggctggaggtgacgctg

SEQ ID NO: 180320 - DNA, 20 bp, human
gggagccccggagtcccgct

SEQ ID NO: 180321 - DNA, 20 bp, human
gtcttcggcggtccctgagg

SEQ ID NO: 180322 - DNA, 20 bp, human
gactcggggcgcccacagca

SEQ ID NO: 180323 - DNA, 20 bp, human
gcgtacctgggaaggagcag

SEQ ID NO: 180324 - DNA, 20 bp, human
ggcagagggaagtagagttg

SEQ ID NO: 180325 - DNA, 20 bp, human
gagcacggcccccctcccgg

SEQ ID NO: 180326 - DNA, 20 bp, human
gccgccggaggacggagacg

SEQ ID NO: 180327 - DNA, 20 bp, human
ggtgtcggcgacccgagggc

SEQ ID NO: 180328 - DNA, 20 bp, human
gccgcagcctccaccagcgg

SEQ ID NO: 180329 - DNA, 20 bp, human
gtcgagtgtcggcgacccga

SEQ ID NO: 180330 - DNA, 20 bp, human
gcgcccggcacccgaggaga

SEQ ID NO: 180331 - DNA, 20 bp, human
gccaggaggccggtgctgat

SEQ ID NO: 180332 - DNA, 20 bp, human
gcgcccctcggggaagatga

SEQ ID NO: 180333 - DNA, 20 bp, human
gatgagctgggccctgtcgg

SEQ ID NO: 180334 - DNA, 20 bp, human
ggtcccgcgtctccgtcctc

SEQ ID NO: 180335 - DNA, 20 bp, human
ggcgggtgcgcggctcctcc

SEQ ID NO: 180336 - DNA, 20 bp, human
gccaggacgcgcggtgggta

SEQ ID NO: 180337 - DNA, 20 bp, human
gtggctgaccgcgctgctgt

SEQ ID NO: 180338 - DNA, 20 bp, human
ggcgcaagcaacagccggag

SEQ ID NO: 180339 - DNA, 20 bp, human
ggcgcagccgaggccgcgtg

SEQ ID NO: 180340 - DNA, 20 bp, human
gggaaaaccaataggagtgt

SEQ ID NO: 180341 - DNA, 20 bp, human
gccctctccaacactcctat

SEQ ID NO: 180342 - DNA, 20 bp, human
gccgcaccaggacgcgcggt

SEQ ID NO: 180343 - DNA, 20 bp, human
ggctcgcagggacgcaggtt

SEQ ID NO: 180344 - DNA, 20 bp, human
gccctccgcaccaggacgcg

SEQ ID NO: 180345 - DNA, 20 bp, human
gtttggggagtttaagtgta

SEQ ID NO: 180346 - DNA, 20 bp, human
gagagcagccagtgtccggg

SEQ ID NO: 180347 - DNA, 20 bp, human
gggtgcccagccactcccag

SEQ ID NO: 180348 - DNA, 20 bp, human
ggctgctctggatgatgacg

SEQ ID NO: 180349 - DNA, 20 bp, human
gaaagtgtgacctaggaggg

SEQ ID NO: 180350 - DNA, 20 bp, human
gtcttagagacacctctagg

SEQ ID NO: 180351 - DNA, 20 bp, human
gatccagagcagccagtgtc

SEQ ID NO: 180352 - DNA, 20 bp, human
gctgaaaagtgtgacctagg

SEQ ID NO: 180353 - DNA, 20 bp, human
gcgctgagacaggagctttg

SEQ ID NO: 180354 - DNA, 20 bp, human
gactcaggcccagctcatca

SEQ ID NO: 180355 - DNA, 20 bp, human
gcacgccccaccaagaccca

SEQ ID NO: 180356 - DNA, 20 bp, human
ggtgagcccacaaggagcaa

SEQ ID NO: 180357 - DNA, 20 bp, human
ggacagggaagtcctccaag

SEQ ID NO: 180358 - DNA, 20 bp, human
gctgctccattgctccttgt

SEQ ID NO: 180359 - DNA, 20 bp, human
ggacggagaacacattgaca

SEQ ID NO: 180360 - DNA, 20 bp, human
gcccatggaaggtgatgggt

SEQ ID NO: 180361 - DNA, 20 bp, human
ggtggccccatggaaggtga

SEQ ID NO: 180362 - DNA, 20 bp, human
gctctccactctaagaagca

SEQ ID NO: 180363 - DNA, 20 bp, human
ggggatgtactgcaccacag

SEQ ID NO: 180364 - DNA, 20 bp, human
gtgggctggatcaaatacca

SEQ ID NO: 180365 - DNA, 20 bp, human
gctcaccctgcttcttagag

SEQ ID NO: 180366 - DNA, 20 bp, human
gccggccgggctgactcaag

SEQ ID NO: 180367 - DNA, 20 bp, human
gtggggcagtgaccagtagt

SEQ ID NO: 180368 - DNA, 20 bp, human
gacctgggcgggaatcgcct

SEQ ID NO: 180369 - DNA, 20 bp, human
ggaccagtagtgggagccgt

SEQ ID NO: 180370 - DNA, 20 bp, human
gctggggcgctgaactacct

SEQ ID NO: 180371 - DNA, 20 bp, human
gggctgtcaagctcccggcc

SEQ ID NO: 180372 - DNA, 20 bp, human
gggcgctaacagcaaacggg

SEQ ID NO: 180373 - DNA, 20 bp, human
gggcgctgaactacctgggc

SEQ ID NO: 180374 - DNA, 20 bp, human
gcttccggctgtcaagctcc

SEQ ID NO: 180375 - DNA, 20 bp, human
ggcgcgcggaacagtcgccg

SEQ ID NO: 180376 - DNA, 20 bp, human
ggagcctgcggactgtggag

SEQ ID NO: 180377 - DNA, 20 bp, human
gccacaggcagccaaggact

SEQ ID NO: 180378 - DNA, 20 bp, human
gctgcagaggaagccaggtg

SEQ ID NO: 180379 - DNA, 20 bp, human
gctcctcgggacctgcgagc

SEQ ID NO: 180380 - DNA, 20 bp, human
gtccaggaaggggactgcag

SEQ ID NO: 180381 - DNA, 20 bp, human
gcgcagcgcggtccttcacg

SEQ ID NO: 180382 - DNA, 20 bp, human
gcgcccgctcgcaggtcccg

SEQ ID NO: 180383 - DNA, 20 bp, human
gtgggacaggaccgagtcct

SEQ ID NO: 180384 - DNA, 20 bp, human
gggtatccggagcgcagccg

SEQ ID NO: 180385 - DNA, 20 bp, human
gggaggtaggtcaaaagccg

SEQ ID NO: 180386 - DNA, 20 bp, human
gagcccgcggccgagcagag

SEQ ID NO: 180387 - DNA, 20 bp, human
gcaggagccaccccaccgta

SEQ ID NO: 180388 - DNA, 20 bp, human
gtggctggagccctacggtg

SEQ ID NO: 180389 - DNA, 20 bp, human
gtcccggaggactgcaggtg

SEQ ID NO: 180390 - DNA, 20 bp, human
gctcgtgacagagggtcctg

SEQ ID NO: 180391 - DNA, 20 bp, human
ggagcctgcggactgtggag

SEQ ID NO: 180392 - DNA, 20 bp, human
gcgcagcgcggtccttcacg

SEQ ID NO: 180393 - DNA, 20 bp, human
gctgcagaggaagccaggtg

SEQ ID NO: 180394 - DNA, 20 bp, human
gcggggctggggaaagcgtc

SEQ ID NO: 180395 - DNA, 20 bp, human
ggaccctggctggagcccta

SEQ ID NO: 180396 - DNA, 20 bp, human
gcacatgtaggcgttccgag

SEQ ID NO: 180397 - DNA, 20 bp, human
gagcgcacggacgagcggga

SEQ ID NO: 180398 - DNA, 20 bp, human
gagcgggagggacccttctc

SEQ ID NO: 180399 - DNA, 20 bp, human
gatgtaggcgttccgagcgg

SEQ ID NO: 180400 - DNA, 20 bp, human
ggtcgcatcaggccggagaa

SEQ ID NO: 180401 - DNA, 20 bp, human
gggtgagcgcacggacgagc

SEQ ID NO: 180402 - DNA, 20 bp, human
gccctgccgcgcgcacatgt

SEQ ID NO: 180403 - DNA, 20 bp, human
gtaggcgttccgagcggcgg

SEQ ID NO: 180404 - DNA, 20 bp, human
gccgcagcgcgatggcccta

SEQ ID NO: 180405 - DNA, 20 bp, human
gcggtaacgcgttcagactg

SEQ ID NO: 180406 - DNA, 20 bp, human
gagcagccggcgccccagcg

SEQ ID NO: 180407 - DNA, 20 bp, human
gcgggaagccatggagccgc

SEQ ID NO: 180408 - DNA, 20 bp, human
gcggcgcgcgagcccaccgg

SEQ ID NO: 180409 - DNA, 20 bp, human
ggagccgcgggcgctcgtca

SEQ ID NO: 180410 - DNA, 20 bp, human
gccgagtaggtggcgaagag

SEQ ID NO: 180411 - DNA, 20 bp, human
gggactgtggatcggaggta

SEQ ID NO: 180412 - DNA, 20 bp, human
gagcagaggagcaaatgagt

SEQ ID NO: 180413 - DNA, 20 bp, human
gaagtagggacagggttaag

SEQ ID NO: 180414 - DNA, 20 bp, human
gggaggaagtgctacttcct

SEQ ID NO: 180415 - DNA, 20 bp, human
ggaaaagtcgggggaaagta

SEQ ID NO: 180416 - DNA, 20 bp, human
gcgcttggcggctacaccat

SEQ ID NO: 180417 - DNA, 20 bp, human
gccggtggcacttcctccag

SEQ ID NO: 180418 - DNA, 20 bp, human
ggaatgagggcggcgatctc

SEQ ID NO: 180419 - DNA, 20 bp, human
gcgccgcacccggaacaaag

SEQ ID NO: 180420 - DNA, 20 bp, human
gttccgggtgcggcgaggga

SEQ ID NO: 180421 - DNA, 20 bp, human
gggtgcggcgagggaaggcg

SEQ ID NO: 180422 - DNA, 20 bp, human
gttcctccagaggcccatgt

SEQ ID NO: 180423 - DNA, 20 bp, human
ggtgtagagcagtaaccttc

SEQ ID NO: 180424 - DNA, 20 bp, human
gcgccaggaagcacagggac

SEQ ID NO: 180425 - DNA, 20 bp, human
gggaggaagtgccaccggca

SEQ ID NO: 180426 - DNA, 20 bp, human
ggagctgcctgagagacgga

SEQ ID NO: 180427 - DNA, 20 bp, human
gtgagcgccatggccggccc

SEQ ID NO: 180428 - DNA, 20 bp, human
ggcaggcgcactgagcgaaa

SEQ ID NO: 180429 - DNA, 20 bp, human
gcctctgcaagggacacgag

SEQ ID NO: 180430 - DNA, 20 bp, human
ggcgagtccctccgtctctc

SEQ ID NO: 180431 - DNA, 20 bp, human
gggacacgaggggtaagtgg

SEQ ID NO: 180432 - DNA, 20 bp, human
gggactcgcgcgcctccccg

SEQ ID NO: 180433 - DNA, 20 bp, human
gctcgcgcgcctccccgggg

SEQ ID NO: 180434 - DNA, 20 bp, human
gagacaaagggcggtctgag

SEQ ID NO: 180435 - DNA, 20 bp, human
gcgtctctcaggcagctccg

SEQ ID NO: 180436 - DNA, 20 bp, human
gacggccccgcacaggaagg

SEQ ID NO: 180437 - DNA, 20 bp, human
gctgctgcacagccttactg

SEQ ID NO: 180438 - DNA, 20 bp, human
gcgtgcctcaccaggtccac

SEQ ID NO: 180439 - DNA, 20 bp, human
gcggcgcttcctggtggtca

SEQ ID NO: 180440 - DNA, 20 bp, human
gagcgtcttaaagcactagg

SEQ ID NO: 180441 - DNA, 20 bp, human
ggagcagcagcaagcccggt

SEQ ID NO: 180442 - DNA, 20 bp, human
gtaaagcactaggtggagtc

SEQ ID NO: 180443 - DNA, 20 bp, human
gagctcgacgcgctgcagcc

SEQ ID NO: 180444 - DNA, 20 bp, human
gtgggtccgagtcatcgccg

SEQ ID NO: 180445 - DNA, 20 bp, human
gccatggcgccctgaccacc

SEQ ID NO: 180446 - DNA, 20 bp, human
ggtaggccccacagagcacc

SEQ ID NO: 180447 - DNA, 20 bp, human
ggtaaccaccagttcggggg

SEQ ID NO: 180448 - DNA, 20 bp, human
ggcctggccagaatccacag

SEQ ID NO: 180449 - DNA, 20 bp, human
gtggccagaatccacagagg

SEQ ID NO: 180450 - DNA, 20 bp, human
gctggccaggccgggttcgg

SEQ ID NO: 180451 - DNA, 20 bp, human
gattctggccaggccgggtt

SEQ ID NO: 180452 - DNA, 20 bp, human
gcggcggttgctgtgagagc

SEQ ID NO: 180453 - DNA, 20 bp, human
gagggcagatctcacgagag

SEQ ID NO: 180454 - DNA, 20 bp, human
gctgcgcacgctcctccaca

SEQ ID NO: 180455 - DNA, 20 bp, human
gtcacagcaaccgccgaacc

SEQ ID NO: 180456 - DNA, 20 bp, human
gccggcgaagcctaatccca

SEQ ID NO: 180457 - DNA, 20 bp, human
ggcttcgccggctacgattg

SEQ ID NO: 180458 - DNA, 20 bp, human
gcttcgggcgggcccagcat

SEQ ID NO: 180459 - DNA, 20 bp, human
ggaagaagcggggttcaagg

SEQ ID NO: 180460 - DNA, 20 bp, human
ggagagttgtgtggtccggg

SEQ ID NO: 180461 - DNA, 20 bp, human
gcgaagcctaatcccacggc

SEQ ID NO: 180462 - DNA, 20 bp, human
ggagctgtgcaataataccg

SEQ ID NO: 180463 - DNA, 20 bp, human
ggcgcctgcgcgcacttcta

SEQ ID NO: 180464 - DNA, 20 bp, human
gatccgtgccattagcataa

SEQ ID NO: 180465 - DNA, 20 bp, human
ggtctcaccgcaatcgtagc

SEQ ID NO: 180466 - DNA, 20 bp, human
gggacggggagcagggatac

SEQ ID NO: 180467 - DNA, 20 bp, human
gggcgcaggcggcgacacaa

SEQ ID NO: 180468 - DNA, 20 bp, human
ggatgaccgctactacaggt

SEQ ID NO: 180469 - DNA, 20 bp, human
ggggcaggttcctggattca

SEQ ID NO: 180470 - DNA, 20 bp, human
gagcggcgggaccgggaccc

SEQ ID NO: 180471 - DNA, 20 bp, human
ggtcggggcggggatctggg

SEQ ID NO: 180472 - DNA, 20 bp, human
ggggcgcggagcctacggat

SEQ ID NO: 180473 - DNA, 20 bp, human
gtgagctcgctgcagagcgg

SEQ ID NO: 180474 - DNA, 20 bp, human
gaaatcggcccttcgcccgg

SEQ ID NO: 180475 - DNA, 20 bp, human
gggctcccgcctccccggaa

SEQ ID NO: 180476 - DNA, 20 bp, human
gctcaggcatagaccatcta

SEQ ID NO: 180477 - DNA, 20 bp, human
gtctggtctcaggcaaggtg

SEQ ID NO: 180478 - DNA, 20 bp, human
ggagactgtaatctcaactc

SEQ ID NO: 180479 - DNA, 20 bp, human
gtgctacctggcagctccgc

SEQ ID NO: 180480 - DNA, 20 bp, human
gagcaccggccacgcacccg

SEQ ID NO: 180481 - DNA, 20 bp, human
gagagggggcgggtgctacc

SEQ ID NO: 180482 - DNA, 20 bp, human
ggcgcgcctgcgcagagaga

SEQ ID NO: 180483 - DNA, 20 bp, human
gcagcagggtctgtacccag

SEQ ID NO: 180484 - DNA, 20 bp, human
gctatcgttggaggacagga

SEQ ID NO: 180485 - DNA, 20 bp, human
gcctcctagcacaactccat

SEQ ID NO: 180486 - DNA, 20 bp, human
gccatgaagggttcttctgg

SEQ ID NO: 180487 - DNA, 20 bp, human
gtgaaatcagagaatagtag

SEQ ID NO: 180488 - DNA, 20 bp, human
ggcttcttgcaactgaagtg

SEQ ID NO: 180489 - DNA, 20 bp, human
gtaaatatcgctatcttctt

SEQ ID NO: 180490 - DNA, 20 bp, human
ggatttcaagagcatacata

SEQ ID NO: 180491 - DNA, 20 bp, human
gcgtcacttttcaccatgaa

SEQ ID NO: 180492 - DNA, 20 bp, human
gcatgtccttaaaaatttac

SEQ ID NO: 180493 - DNA, 20 bp, human
gtggagtgtctatttcttca

SEQ ID NO: 180494 - DNA, 20 bp, human
ggctactgagcttcattatt

SEQ ID NO: 180495 - DNA, 20 bp, human
gttcaaaatagtgatgcaca

SEQ ID NO: 180496 - DNA, 20 bp, human
gtgtgttgcagtgaccgtgg

SEQ ID NO: 180497 - DNA, 20 bp, human
gctcgcgagaacataggtcc

SEQ ID NO: 180498 - DNA, 20 bp, human
gcgcctgctccggccgaggt

SEQ ID NO: 180499 - DNA, 20 bp, human
gatgttctcgcgagagttag

SEQ ID NO: 180500 - DNA, 20 bp, human
gaggcctcttccttgagggt

SEQ ID NO: 180501 - DNA, 20 bp, human
ggcaccaaccctcaaggaag

SEQ ID NO: 180502 - DNA, 20 bp, human
gggaagacgctgacgagaga

SEQ ID NO: 180503 - DNA, 20 bp, human
ggcgagcgctcacctcggca

SEQ ID NO: 180504 - DNA, 20 bp, human
gagagaaggcctcttccttg

SEQ ID NO: 180505 - DNA, 20 bp, human
gtcgcggcatgagtctttaa

SEQ ID NO: 180506 - DNA, 20 bp, human
gtgtgttgcagtgaccgtgg

SEQ ID NO: 180507 - DNA, 20 bp, human
gcgcctgctccggccgaggt

SEQ ID NO: 180508 - DNA, 20 bp, human
gctcgcgagaacataggtcc

SEQ ID NO: 180509 - DNA, 20 bp, human
gaggcctcttccttgagggt

SEQ ID NO: 180510 - DNA, 20 bp, human
gatgttctcgcgagagttag

SEQ ID NO: 180511 - DNA, 20 bp, human
gatgccgcgaagacagaact

SEQ ID NO: 180512 - DNA, 20 bp, human
ggcaccaaccctcaaggaag

SEQ ID NO: 180513 - DNA, 20 bp, human
gggaagacgctgacgagaga

SEQ ID NO: 180514 - DNA, 20 bp, human
ggcgagcgctcacctcggca

SEQ ID NO: 180515 - DNA, 20 bp, human
gagagaaggcctcttccttg

SEQ ID NO: 180516 - DNA, 20 bp, human
gcaactggaggccccactgt

SEQ ID NO: 180517 - DNA, 20 bp, human
gcaagcctgagactcggagt

SEQ ID NO: 180518 - DNA, 20 bp, human
gcagggagcctgcttcttag

SEQ ID NO: 180519 - DNA, 20 bp, human
gggccttgccgcacccacag

SEQ ID NO: 180520 - DNA, 20 bp, human
ggagatggaacaggcaccca

SEQ ID NO: 180521 - DNA, 20 bp, human
gcaaagaccgtcttccagtg

SEQ ID NO: 180522 - DNA, 20 bp, human
gggccaggcctccctggact

SEQ ID NO: 180523 - DNA, 20 bp, human
ggcctccagggaagcctagc

SEQ ID NO: 180524 - DNA, 20 bp, human
gggtgtgcagccaccctcat

SEQ ID NO: 180525 - DNA, 20 bp, human
gaggtgcttcctgccagcaa

SEQ ID NO: 180526 - DNA, 20 bp, human
ggctgcccgccgctgtgagg

SEQ ID NO: 180527 - DNA, 20 bp, human
gtgctgccgcctcctcacag

SEQ ID NO: 180528 - DNA, 20 bp, human
ggcccgccgctgtgaggagg

SEQ ID NO: 180529 - DNA, 20 bp, human
gctcaggtgaaggcaagtat

SEQ ID NO: 180530 - DNA, 20 bp, human
gcatctggagccaggatggg

SEQ ID NO: 180531 - DNA, 20 bp, human
gcaggagcaatcatctctca

SEQ ID NO: 180532 - DNA, 20 bp, human
gtgccgcctcctcacagcgg

SEQ ID NO: 180533 - DNA, 20 bp, human
gctgggcgtgtacgggtcgg

SEQ ID NO: 180534 - DNA, 20 bp, human
gtcacagcggcgggcagcct

SEQ ID NO: 180535 - DNA, 20 bp, human
gacccgtacacgcccagggc

SEQ ID NO: 180536 - DNA, 20 bp, human
ggccgcggctgcactccact

SEQ ID NO: 180537 - DNA, 20 bp, human
ggagggaggcggatggacca

SEQ ID NO: 180538 - DNA, 20 bp, human
gagggagcgggcacacccac

SEQ ID NO: 180539 - DNA, 20 bp, human
ggcggagaggaggcacgggt

SEQ ID NO: 180540 - DNA, 20 bp, human
gcactgggcccgggacgcgc

SEQ ID NO: 180541 - DNA, 20 bp, human
gccgccccgcccgcagagtc

SEQ ID NO: 180542 - DNA, 20 bp, human
gggagctgcccccgccacgt

SEQ ID NO: 180543 - DNA, 20 bp, human
ggcccagtggagtgcagccg

SEQ ID NO: 180544 - DNA, 20 bp, human
gccgggcggggagggcacta

SEQ ID NO: 180545 - DNA, 20 bp, human
gtgtaatcggacctgtccgg

SEQ ID NO: 180546 - DNA, 20 bp, human
gcacgggacctcccctacag

SEQ ID NO: 180547 - DNA, 20 bp, human
gggtcccgtgcgaaagaatg

SEQ ID NO: 180548 - DNA, 20 bp, human
gacagcgccggtccaggagg

SEQ ID NO: 180549 - DNA, 20 bp, human
ggccttgggttccgctgtag

SEQ ID NO: 180550 - DNA, 20 bp, human
gtcgattccgctagtaggta

SEQ ID NO: 180551 - DNA, 20 bp, human
gctggggccttacctactag

SEQ ID NO: 180552 - DNA, 20 bp, human
ggacacagcgccggtccagg

SEQ ID NO: 180553 - DNA, 20 bp, human
gaaagaatgaggagatcctg

SEQ ID NO: 180554 - DNA, 20 bp, human
gtcccctacagcggaaccca

SEQ ID NO: 180555 - DNA, 20 bp, human
gcagggcgatccccaggtga

SEQ ID NO: 180556 - DNA, 20 bp, human
ggagccccgtcctgccccaa

SEQ ID NO: 180557 - DNA, 20 bp, human
gccgcagcgcggactcccgg

SEQ ID NO: 180558 - DNA, 20 bp, human
ggttcccttggggcaggacg

SEQ ID NO: 180559 - DNA, 20 bp, human
ggggagcagcagcgtggacg

SEQ ID NO: 180560 - DNA, 20 bp, human
ggaagttgggacaccaatga

SEQ ID NO: 180561 - DNA, 20 bp, human
gtacggaagcccggaaggag

SEQ ID NO: 180562 - DNA, 20 bp, human
gcacagcctgcgccttacag

SEQ ID NO: 180563 - DNA, 20 bp, human
gaagcaccgggcacgggagg

SEQ ID NO: 180564 - DNA, 20 bp, human
ggaaccgagacgaagaagtt

SEQ ID NO: 180565 - DNA, 20 bp, human
gtgaaagcaccgggcacggg

SEQ ID NO: 180566 - DNA, 20 bp, human
gagcggcgaagcggagaggc

SEQ ID NO: 180567 - DNA, 20 bp, human
ggacgcttccaggcgactcc

SEQ ID NO: 180568 - DNA, 20 bp, human
gtgatgccgtccaggcggag

SEQ ID NO: 180569 - DNA, 20 bp, human
gagcggcccgcgaccttggg

SEQ ID NO: 180570 - DNA, 20 bp, human
ggcgctgctgactccccaag

SEQ ID NO: 180571 - DNA, 20 bp, human
gaccaggaggaggttcggag

SEQ ID NO: 180572 - DNA, 20 bp, human
gatgcgtgtggggcccgaag

SEQ ID NO: 180573 - DNA, 20 bp, human
gccaagcggcccgcgacctt

SEQ ID NO: 180574 - DNA, 20 bp, human
gtctgcgacagggtggagag

SEQ ID NO: 180575 - DNA, 20 bp, human
gggacgaccaggaggaggtt

SEQ ID NO: 180576 - DNA, 20 bp, human
gcgggtggcgagccttgagg

SEQ ID NO: 180577 - DNA, 20 bp, human
ggatccgtgggaggaagctc

SEQ ID NO: 180578 - DNA, 20 bp, human
ggccatggtaaggaggcggg

SEQ ID NO: 180579 - DNA, 20 bp, human
gtggtggggccatggtaagg

SEQ ID NO: 180580 - DNA, 20 bp, human
ggccccaacacgtagcacaa

SEQ ID NO: 180581 - DNA, 20 bp, human
ggccacccgcctccttacca

SEQ ID NO: 180582 - DNA, 20 bp, human
gtgcgcatgtgacccaagga

SEQ ID NO: 180583 - DNA, 20 bp, human
gggccggtgggatttacttc

SEQ ID NO: 180584 - DNA, 20 bp, human
gcacaagggtattactaggt

SEQ ID NO: 180585 - DNA, 20 bp, human
ggtagcacaagggtattact

SEQ ID NO: 180586 - DNA, 20 bp, human
gaggccagctatcaccatac

SEQ ID NO: 180587 - DNA, 20 bp, human
gtagaggaggcgaaacgtgg

SEQ ID NO: 180588 - DNA, 20 bp, human
gtcccccagcgaggcgagtg

SEQ ID NO: 180589 - DNA, 20 bp, human
ggcctcactcgcctcgctgg

SEQ ID NO: 180590 - DNA, 20 bp, human
ggtgaggcgaaatacccgta

SEQ ID NO: 180591 - DNA, 20 bp, human
gcgcccgggcggcctcctag

SEQ ID NO: 180592 - DNA, 20 bp, human
gttcaaatctccgaaaaggg

SEQ ID NO: 180593 - DNA, 20 bp, human
gcggtgagcacttacagtat

SEQ ID NO: 180594 - DNA, 20 bp, human
ggatctaccagatctaccgg

SEQ ID NO: 180595 - DNA, 20 bp, human
gccacaggctctgacaggac

SEQ ID NO: 180596 - DNA, 20 bp, human
gagagcgcaccgggccgatc

SEQ ID NO: 180597 - DNA, 20 bp, human
gcggcagggccgcggaaccg

SEQ ID NO: 180598 - DNA, 20 bp, human
gcgacaaacggagctcccat

SEQ ID NO: 180599 - DNA, 20 bp, human
gatcgggcgagtggccatgg

SEQ ID NO: 180600 - DNA, 20 bp, human
gcccatcggacccgcagata

SEQ ID NO: 180601 - DNA, 20 bp, human
ggagctccctgggcgacaaa

SEQ ID NO: 180602 - DNA, 20 bp, human
gcatggcgggcgccgagaac

SEQ ID NO: 180603 - DNA, 20 bp, human
gaccgggccgatcgggcgag

SEQ ID NO: 180604 - DNA, 20 bp, human
gcgccgccagcagagcgcac

SEQ ID NO: 180605 - DNA, 20 bp, human
gcacaaccgagaatgccccg

SEQ ID NO: 180606 - DNA, 20 bp, human
gcgccgccagcagagcgcac

SEQ ID NO: 180607 - DNA, 20 bp, human
gttctggcttgggttcggaa

SEQ ID NO: 180608 - DNA, 20 bp, human
gagagcgcaccgggccgatc

SEQ ID NO: 180609 - DNA, 20 bp, human
gcgacaaacggagctcccat

SEQ ID NO: 180610 - DNA, 20 bp, human
gatcgggcgagtggccatgg

SEQ ID NO: 180611 - DNA, 20 bp, human
gcccatcggacccgcagata

SEQ ID NO: 180612 - DNA, 20 bp, human
ggagctccctgggcgacaaa

SEQ ID NO: 180613 - DNA, 20 bp, human
gcatggcgggcgccgagaac

SEQ ID NO: 180614 - DNA, 20 bp, human
gcggcagggccgcggaaccg

SEQ ID NO: 180615 - DNA, 20 bp, human
gaccgggccgatcgggcgag

SEQ ID NO: 180616 - DNA, 20 bp, human
gccggctggacctgacccta

SEQ ID NO: 180617 - DNA, 20 bp, human
gtccttccggaaactcctac

SEQ ID NO: 180618 - DNA, 20 bp, human
gtaggccagcggctgcaaag

SEQ ID NO: 180619 - DNA, 20 bp, human
ggccagtaggagtttccgga

SEQ ID NO: 180620 - DNA, 20 bp, human
gggagagctccaattcatat

SEQ ID NO: 180621 - DNA, 20 bp, human
ggatgtcgcctagctcacgt

SEQ ID NO: 180622 - DNA, 20 bp, human
gctagcgcctcgcccgctgt

SEQ ID NO: 180623 - DNA, 20 bp, human
ggagcaaagcccgcgcctcc

SEQ ID NO: 180624 - DNA, 20 bp, human
ggcgggcgaggcgctagagg

SEQ ID NO: 180625 - DNA, 20 bp, human
gtaggcgacatccccctaag

SEQ ID NO: 180626 - DNA, 20 bp, human
gtctggggaggtgacatgtt

SEQ ID NO: 180627 - DNA, 20 bp, human
gcagcggctgctcactccat

SEQ ID NO: 180628 - DNA, 20 bp, human
gcaggagcaggcccagcgct

SEQ ID NO: 180629 - DNA, 20 bp, human
ggagcagccgctgaaatact

SEQ ID NO: 180630 - DNA, 20 bp, human
ggctgtgggatcccagcgct

SEQ ID NO: 180631 - DNA, 20 bp, human
gtcttcccacagtggcccca

SEQ ID NO: 180632 - DNA, 20 bp, human
gcagacggaaatggaatcca

SEQ ID NO: 180633 - DNA, 20 bp, human
ggatctgggctcccctccct

SEQ ID NO: 180634 - DNA, 20 bp, human
gtgaaatactgggtcaccca

SEQ ID NO: 180635 - DNA, 20 bp, human
gccatgggtagaagaatccc

SEQ ID NO: 180636 - DNA, 20 bp, human
gtggttgaggctctcgctct

SEQ ID NO: 180637 - DNA, 20 bp, human
gtggcaggcgtcacaatggg

SEQ ID NO: 180638 - DNA, 20 bp, human
gtaaccgagatggtcgccag

SEQ ID NO: 180639 - DNA, 20 bp, human
gcgggctggatcacaatggg

SEQ ID NO: 180640 - DNA, 20 bp, human
gagtgccatctgcagtgtgg

SEQ ID NO: 180641 - DNA, 20 bp, human
gatgcaggcaagttgaagat

SEQ ID NO: 180642 - DNA, 20 bp, human
ggcaagtgccatctgcagtg

SEQ ID NO: 180643 - DNA, 20 bp, human
gggctggcaggcgtcacaat

SEQ ID NO: 180644 - DNA, 20 bp, human
gctccggccggcgtgagaag

SEQ ID NO: 180645 - DNA, 20 bp, human
gtagcgggctggatcacaat

SEQ ID NO: 180646 - DNA, 20 bp, human
gtaccgggcttctggaggaa

SEQ ID NO: 180647 - DNA, 20 bp, human
gcggagcagcagcatgagct

SEQ ID NO: 180648 - DNA, 20 bp, human
gagggacggggaggcaacaa

SEQ ID NO: 180649 - DNA, 20 bp, human
gtctggaggaacgggtgtca

SEQ ID NO: 180650 - DNA, 20 bp, human
gtgggcggggcggggaatgt

SEQ ID NO: 180651 - DNA, 20 bp, human
ggcccctactaaacacctca

SEQ ID NO: 180652 - DNA, 20 bp, human
gggaccctgaggtgtttagt

SEQ ID NO: 180653 - DNA, 20 bp, human
gctaggggcggggcttgtaa

SEQ ID NO: 180654 - DNA, 20 bp, human
ggcaacaagggcgaggacaa

SEQ ID NO: 180655 - DNA, 20 bp, human
ggctctgagggctagaatag

SEQ ID NO: 180656 - DNA, 20 bp, human
gcgtgagtgcacggaggcgg

SEQ ID NO: 180657 - DNA, 20 bp, human
gagaggcttacaggtccagg

SEQ ID NO: 180658 - DNA, 20 bp, human
gctccggcgtcgggaaatgg

SEQ ID NO: 180659 - DNA, 20 bp, human
gcttacaggtccaggtggag

SEQ ID NO: 180660 - DNA, 20 bp, human
gttcgcggccagaggcttac

SEQ ID NO: 180661 - DNA, 20 bp, human
ggccagcctgggacccccgg

SEQ ID NO: 180662 - DNA, 20 bp, human
gttccgctcggacgtcccag

SEQ ID NO: 180663 - DNA, 20 bp, human
gccgcggccgcagtcgccaa

SEQ ID NO: 180664 - DNA, 20 bp, human
gaggcctccccgggcacagg

SEQ ID NO: 180665 - DNA, 20 bp, human
gcagaaggtggcgagtttcg

SEQ ID NO: 180666 - DNA, 20 bp, human
gaggtggcttgaggcaacca

SEQ ID NO: 180667 - DNA, 20 bp, human
gagggcccgggaccaactgc

SEQ ID NO: 180668 - DNA, 20 bp, human
gggtaaggcacgtgaggagg

SEQ ID NO: 180669 - DNA, 20 bp, human
gtggcttgaggcaaccatgg

SEQ ID NO: 180670 - DNA, 20 bp, human
gggttgagaagcagtcctgg

SEQ ID NO: 180671 - DNA, 20 bp, human
gcttttggcggagacaggaa

SEQ ID NO: 180672 - DNA, 20 bp, human
gccgttactctgcagaaggg

SEQ ID NO: 180673 - DNA, 20 bp, human
gggagttagttgctggggta

SEQ ID NO: 180674 - DNA, 20 bp, human
gatgaaagtggcggtctcgc

SEQ ID NO: 180675 - DNA, 20 bp, human
ggagggccgccggcgtagtg

SEQ ID NO: 180676 - DNA, 20 bp, human
gcagcggagccggtccccta

SEQ ID NO: 180677 - DNA, 20 bp, human
gactgccaggcgagagacta

SEQ ID NO: 180678 - DNA, 20 bp, human
gcgtgcgacccgagccctag

SEQ ID NO: 180679 - DNA, 20 bp, human
gccggctccgctgcgaggag

SEQ ID NO: 180680 - DNA, 20 bp, human
ggccaaagagcgcgccctca

SEQ ID NO: 180681 - DNA, 20 bp, human
gccacttccgctcctcgcag

SEQ ID NO: 180682 - DNA, 20 bp, human
ggcgcggccccatttcgtta

SEQ ID NO: 180683 - DNA, 20 bp, human
gggcaccgcgaggcccactg

SEQ ID NO: 180684 - DNA, 20 bp, human
ggacccgagccctaggggac

SEQ ID NO: 180685 - DNA, 20 bp, human
ggctgacccctaacgaaatg

SEQ ID NO: 180686 - DNA, 20 bp, human
gtctatccagcggagagggg

SEQ ID NO: 180687 - DNA, 20 bp, human
gaagcccagaaaggagccac

SEQ ID NO: 180688 - DNA, 20 bp, human
ggagaggtgacgaacgggag

SEQ ID NO: 180689 - DNA, 20 bp, human
gtgcttcccggagatccaaa

SEQ ID NO: 180690 - DNA, 20 bp, human
gcaaaggagaggtgacgaac

SEQ ID NO: 180691 - DNA, 20 bp, human
gaccgcagcaacagaaatcc

SEQ ID NO: 180692 - DNA, 20 bp, human
gcgcattgccacgaaaacaa

SEQ ID NO: 180693 - DNA, 20 bp, human
gtttctgggcttctatccag

SEQ ID NO: 180694 - DNA, 20 bp, human
gacggggagaagcggaggta

SEQ ID NO: 180695 - DNA, 20 bp, human
gccctgtgaaagggtctagt

SEQ ID NO: 180696 - DNA, 20 bp, human
gcgggctgtgcagggtggta

SEQ ID NO: 180697 - DNA, 20 bp, human
ggccagaggagtctccgagg

SEQ ID NO: 180698 - DNA, 20 bp, human
gtgagtgacgtcaggagcag

SEQ ID NO: 180699 - DNA, 20 bp, human
gtcgggccgccccagaaccg

SEQ ID NO: 180700 - DNA, 20 bp, human
gcgggagtcggggggatgaa

SEQ ID NO: 180701 - DNA, 20 bp, human
gtggccgtgggcatctccct

SEQ ID NO: 180702 - DNA, 20 bp, human
ggaaggcgccggggagaatt

SEQ ID NO: 180703 - DNA, 20 bp, human
gtgcgcccgctctaccccct

SEQ ID NO: 180704 - DNA, 20 bp, human
gccatcagcaccaaaggccg

SEQ ID NO: 180705 - DNA, 20 bp, human
gccgcgcggcaacaccaacg

SEQ ID NO: 180706 - DNA, 20 bp, human
gtgggaccaggcgggccaag

SEQ ID NO: 180707 - DNA, 20 bp, human
gccggagagccggctagata

SEQ ID NO: 180708 - DNA, 20 bp, human
gtggctccagctccccgccg

SEQ ID NO: 180709 - DNA, 20 bp, human
gcgctcgcccgcaagcaaag

SEQ ID NO: 180710 - DNA, 20 bp, human
gcagatgctggtgcagatcc

SEQ ID NO: 180711 - DNA, 20 bp, human
gggaccccggactggagact

SEQ ID NO: 180712 - DNA, 20 bp, human
gtcgatctggacacaaggag

SEQ ID NO: 180713 - DNA, 20 bp, human
gatccacgagaaattcccat

SEQ ID NO: 180714 - DNA, 20 bp, human
gtgggagttaagaaagtggg

SEQ ID NO: 180715 - DNA, 20 bp, human
gcgctggggaagaagcacaa

SEQ ID NO: 180716 - DNA, 20 bp, human
ggctgccagttgagtacgag

SEQ ID NO: 180717 - DNA, 20 bp, human
gcgccgggagcagaaaaggt

SEQ ID NO: 180718 - DNA, 20 bp, human
ggcgggcgccggcaatcgag

SEQ ID NO: 180719 - DNA, 20 bp, human
gggtccagatctcctctcca

SEQ ID NO: 180720 - DNA, 20 bp, human
gtccccgcagtggcccccga

SEQ ID NO: 180721 - DNA, 20 bp, human
gccgagggcagcaaacgagg

SEQ ID NO: 180722 - DNA, 20 bp, human
gaactcaggtgcctacacag

SEQ ID NO: 180723 - DNA, 20 bp, human
gtctggacccgaggacgcca

SEQ ID NO: 180724 - DNA, 20 bp, human
ggctgccgctcgtactcaac

SEQ ID NO: 180725 - DNA, 20 bp, human
ggagaggagatctggacccg

SEQ ID NO: 180726 - DNA, 20 bp, human
gcaggagctgtcgggacgtc

SEQ ID NO: 180727 - DNA, 20 bp, human
gggacgtcgggcgcctctgg

SEQ ID NO: 180728 - DNA, 20 bp, human
gctctggaggcggacgaaga

SEQ ID NO: 180729 - DNA, 20 bp, human
gcgtcgggcgcctctggagg

SEQ ID NO: 180730 - DNA, 20 bp, human
gcagctcctggagtgagacc

SEQ ID NO: 180731 - DNA, 20 bp, human
ggacaaaagggaccgggaac

SEQ ID NO: 180732 - DNA, 20 bp, human
gggccaccgcagccgaaacc

SEQ ID NO: 180733 - DNA, 20 bp, human
gcctctgtgagcaccggcag

SEQ ID NO: 180734 - DNA, 20 bp, human
gagaggcgacccgaccccca

SEQ ID NO: 180735 - DNA, 20 bp, human
gacgaagaaggcggcagggt

SEQ ID NO: 180736 - DNA, 20 bp, human
gccctcccgttcccccaggc

SEQ ID NO: 180737 - DNA, 20 bp, human
ggagcctccgcgcgcggact

SEQ ID NO: 180738 - DNA, 20 bp, human
gttccccagcccgcaaccgg

SEQ ID NO: 180739 - DNA, 20 bp, human
gagagccgcccgggtctcca

SEQ ID NO: 180740 - DNA, 20 bp, human
gcgtcggcccactacctcca

SEQ ID NO: 180741 - DNA, 20 bp, human
gggccccagcatcttctgtc

SEQ ID NO: 180742 - DNA, 20 bp, human
gggaaagggctgcaaactca

SEQ ID NO: 180743 - DNA, 20 bp, human
gcccgagccgtggaggtagt

SEQ ID NO: 180744 - DNA, 20 bp, human
gggtgaccttgctggagccg

SEQ ID NO: 180745 - DNA, 20 bp, human
gcatcgcttcaagccagaac

SEQ ID NO: 180746 - DNA, 20 bp, human
gcccgaggcccaagacccgc

SEQ ID NO: 180747 - DNA, 20 bp, human
ggcggcccaagcgagagacg

SEQ ID NO: 180748 - DNA, 20 bp, human
ggccgcccgggaaaatccgg

SEQ ID NO: 180749 - DNA, 20 bp, human
gccgcagagcgcccagacga

SEQ ID NO: 180750 - DNA, 20 bp, human
gctggagacgcggcagctgg

SEQ ID NO: 180751 - DNA, 20 bp, human
ggcgagagacgcggccctcg

SEQ ID NO: 180752 - DNA, 20 bp, human
gaggtgcggaggagccccga

SEQ ID NO: 180753 - DNA, 20 bp, human
ggccgccagggatctccaag

SEQ ID NO: 180754 - DNA, 20 bp, human
gcttgcggaccggacgcagg

SEQ ID NO: 180755 - DNA, 20 bp, human
ggccgcttggagatccctgg

SEQ ID NO: 180756 - DNA, 20 bp, human
gtcttcgggcccctcatcat

SEQ ID NO: 180757 - DNA, 20 bp, human
gcggccaacagcagtagcag

SEQ ID NO: 180758 - DNA, 20 bp, human
gcggtccaggagccacccta

SEQ ID NO: 180759 - DNA, 20 bp, human
ggaagctgtgctccatctca

SEQ ID NO: 180760 - DNA, 20 bp, human
gagcaccaggatcccacaga

SEQ ID NO: 180761 - DNA, 20 bp, human
gaagaggcgcaagaacgacg

SEQ ID NO: 180762 - DNA, 20 bp, human
ggccaccctagggctccagg

SEQ ID NO: 180763 - DNA, 20 bp, human
gcgcaagaacgacgtggtgg

SEQ ID NO: 180764 - DNA, 20 bp, human
gaccccctggagccctaggg

SEQ ID NO: 180765 - DNA, 20 bp, human
gtagcagtggcagcaaaaac

SEQ ID NO: 180766 - DNA, 20 bp, human
gccacgcggagagccatgga

SEQ ID NO: 180767 - DNA, 20 bp, human
gccttccacgcggagagcca

SEQ ID NO: 180768 - DNA, 20 bp, human
gggcctgccgtccttccacg

SEQ ID NO: 180769 - DNA, 20 bp, human
gagcgcgctcactccctcca

SEQ ID NO: 180770 - DNA, 20 bp, human
gctgctggcccgctgcccca

SEQ ID NO: 180771 - DNA, 20 bp, human
ggctgcggagtcgagtggag

SEQ ID NO: 180772 - DNA, 20 bp, human
ggcggggactccgggaacgt

SEQ ID NO: 180773 - DNA, 20 bp, human
gtacaaagcggcgaaggtca

SEQ ID NO: 180774 - DNA, 20 bp, human
gggctggagccggtgcgcac

SEQ ID NO: 180775 - DNA, 20 bp, human
gaggggcggcccgtgcgcac

SEQ ID NO: 180776 - DNA, 20 bp, human
gtcaggactgtggaaagtca

SEQ ID NO: 180777 - DNA, 20 bp, human
gtaggaggctaaaactacag

SEQ ID NO: 180778 - DNA, 20 bp, human
gactgccaagatggagcgaa

SEQ ID NO: 180779 - DNA, 20 bp, human
ggatgcagagacaaattccg

SEQ ID NO: 180780 - DNA, 20 bp, human
ggggtgaccctggggatcag

SEQ ID NO: 180781 - DNA, 20 bp, human
gcatggcgatcagcattagg

SEQ ID NO: 180782 - DNA, 20 bp, human
ggaaataccaaagggtgagg

SEQ ID NO: 180783 - DNA, 20 bp, human
gtttgggaacctcaggactg

SEQ ID NO: 180784 - DNA, 20 bp, human
ggccatgtccccactgaact

SEQ ID NO: 180785 - DNA, 20 bp, human
gtgcctcgatgtcatgccaa

SEQ ID NO: 180786 - DNA, 20 bp, human
gctagggacgcgccctgtgg

SEQ ID NO: 180787 - DNA, 20 bp, human
gccgacccgggactcaaccc

SEQ ID NO: 180788 - DNA, 20 bp, human
gcgaggcgggcgttcacggg

SEQ ID NO: 180789 - DNA, 20 bp, human
ggatcgaggcgggcgttcac

SEQ ID NO: 180790 - DNA, 20 bp, human
ggcccgtcagcggcgaagaa

SEQ ID NO: 180791 - DNA, 20 bp, human
ggcatggcgtccgatcgagg

SEQ ID NO: 180792 - DNA, 20 bp, human
ggcggccagggttgagtccc

SEQ ID NO: 180793 - DNA, 20 bp, human
gaagaggcgcacggacacga

SEQ ID NO: 180794 - DNA, 20 bp, human
gggggcatggcgtccgatcg

SEQ ID NO: 180795 - DNA, 20 bp, human
ggacacgatggtggtgaagt

SEQ ID NO: 180796 - DNA, 20 bp, human
gaggcgagctctgcgcacac

SEQ ID NO: 180797 - DNA, 20 bp, human
ggcgccgccccgaggatgag

SEQ ID NO: 180798 - DNA, 20 bp, human
gaggataaggccgggccgag

SEQ ID NO: 180799 - DNA, 20 bp, human
gcgcctcggggcccatccca

SEQ ID NO: 180800 - DNA, 20 bp, human
gaggcgagcagcttcagcac

SEQ ID NO: 180801 - DNA, 20 bp, human
gcacacctggaccatcccat

SEQ ID NO: 180802 - DNA, 20 bp, human
gtcaccactcatcctcgggg

SEQ ID NO: 180803 - DNA, 20 bp, human
gcactgctgcaggcgagaag

SEQ ID NO: 180804 - DNA, 20 bp, human
gggcgcgggcggaggcccat

SEQ ID NO: 180805 - DNA, 20 bp, human
gtgctgcctgggcccctgtg

SEQ ID NO: 180806 - DNA, 20 bp, human
gggcgggacgaattattggt

SEQ ID NO: 180807 - DNA, 20 bp, human
ggggaggcgggacgaattat

SEQ ID NO: 180808 - DNA, 20 bp, human
gaagacctagggctatgatc

SEQ ID NO: 180809 - DNA, 20 bp, human
gggacaccgatcccaccgtt

SEQ ID NO: 180810 - DNA, 20 bp, human
ggaagatcccgaaagccccg

SEQ ID NO: 180811 - DNA, 20 bp, human
ggtgtcctcgggatgagatt

SEQ ID NO: 180812 - DNA, 20 bp, human
gtccgagaacagaggcgtcg

SEQ ID NO: 180813 - DNA, 20 bp, human
ggtgctgcggattgaggtcc

SEQ ID NO: 180814 - DNA, 20 bp, human
ggagatttagggtttcctcg

SEQ ID NO: 180815 - DNA, 20 bp, human
gcggttcctaacggtgggat

SEQ ID NO: 180816 - DNA, 20 bp, human
gaggcgaaaccggtccggag

SEQ ID NO: 180817 - DNA, 20 bp, human
gccggtaggtccaggtgcag

SEQ ID NO: 180818 - DNA, 20 bp, human
gtcgcggagccggtaggtcc

SEQ ID NO: 180819 - DNA, 20 bp, human
gccgcgaggcgaaaccggtc

SEQ ID NO: 180820 - DNA, 20 bp, human
ggcgcacggacgcagcactg

SEQ ID NO: 180821 - DNA, 20 bp, human
ggtgcagaggagcggcccag

SEQ ID NO: 180822 - DNA, 20 bp, human
gttcgcctcgcggagccggt

SEQ ID NO: 180823 - DNA, 20 bp, human
gctgggacgcccctccggac

SEQ ID NO: 180824 - DNA, 20 bp, human
gggcgccggggaccctactc

SEQ ID NO: 180825 - DNA, 20 bp, human
gatggccgaggtccggagta

SEQ ID NO: 180826 - DNA, 20 bp, human
ggacacagaacaaaatgcta

SEQ ID NO: 180827 - DNA, 20 bp, human
gggtactctgaggtactctg

SEQ ID NO: 180828 - DNA, 20 bp, human
ggaggtgacactgaaaagtc

SEQ ID NO: 180829 - DNA, 20 bp, human
gaactgtcaagcatcaagta

SEQ ID NO: 180830 - DNA, 20 bp, human
gcctatcgttgagatcgctg

SEQ ID NO: 180831 - DNA, 20 bp, human
ggacagtcaacttaggatag

SEQ ID NO: 180832 - DNA, 20 bp, human
gtctgggttaaggttttcag

SEQ ID NO: 180833 - DNA, 20 bp, human
gtagcaatagaactaattga

SEQ ID NO: 180834 - DNA, 20 bp, human
gtcttgtattcactggtcag

SEQ ID NO: 180835 - DNA, 20 bp, human
gtttaaaggacagtcaactt

SEQ ID NO: 180836 - DNA, 20 bp, human
gtatggggtgggccagagcg

SEQ ID NO: 180837 - DNA, 20 bp, human
gtacccagcccgggaaacac

SEQ ID NO: 180838 - DNA, 20 bp, human
gagactaccacgggatccag

SEQ ID NO: 180839 - DNA, 20 bp, human
gcaatcactaagcaccacat

SEQ ID NO: 180840 - DNA, 20 bp, human
gaggctaacgactcttccaa

SEQ ID NO: 180841 - DNA, 20 bp, human
gctaccacgggatccagagg

SEQ ID NO: 180842 - DNA, 20 bp, human
ggccagaccgtgctagagct

SEQ ID NO: 180843 - DNA, 20 bp, human
gagtgcatgagctgccgatg

SEQ ID NO: 180844 - DNA, 20 bp, human
gcctaaagccagactaccac

SEQ ID NO: 180845 - DNA, 20 bp, human
gcgaggcaaatacccagccc

SEQ ID NO: 180846 - DNA, 20 bp, human
gcgcctagccacatccccct

SEQ ID NO: 180847 - DNA, 20 bp, human
gtgcgcatgcccagagagag

SEQ ID NO: 180848 - DNA, 20 bp, human
gtcctctggccggaaaacgc

SEQ ID NO: 180849 - DNA, 20 bp, human
gggtggtgagcggagtaaga

SEQ ID NO: 180850 - DNA, 20 bp, human
gaggctcgcgccactctctc

SEQ ID NO: 180851 - DNA, 20 bp, human
gagggcacgtacttatgatg

SEQ ID NO: 180852 - DNA, 20 bp, human
ggttttccggccagaggaca

SEQ ID NO: 180853 - DNA, 20 bp, human
gcccgcgtagattccaagac

SEQ ID NO: 180854 - DNA, 20 bp, human
gagggaagaaagaagcaata

SEQ ID NO: 180855 - DNA, 20 bp, human
ggcacgtacttatgatgggg

SEQ ID NO: 180856 - DNA, 20 bp, human
gggacacaggccagggaccg

SEQ ID NO: 180857 - DNA, 20 bp, human
ggcccaaggggccaccacgc

SEQ ID NO: 180858 - DNA, 20 bp, human
ggtccttctggtggctacca

SEQ ID NO: 180859 - DNA, 20 bp, human
ggcccttcttgcaagaccaa

SEQ ID NO: 180860 - DNA, 20 bp, human
gttgcaagaccaagggccca

SEQ ID NO: 180861 - DNA, 20 bp, human
gccgtcagaggtgtgcagtg

SEQ ID NO: 180862 - DNA, 20 bp, human
gaaggggtgcgtgaaccctg

SEQ ID NO: 180863 - DNA, 20 bp, human
gagggctttaccccctgggt

SEQ ID NO: 180864 - DNA, 20 bp, human
gtgccctggtagccaccaga

SEQ ID NO: 180865 - DNA, 20 bp, human
gggctgggagtggagtgcgg

SEQ ID NO: 180866 - DNA, 20 bp, human
gccgggtggagcacagaact

SEQ ID NO: 180867 - DNA, 20 bp, human
gctaatgttgagcagtgtgt

SEQ ID NO: 180868 - DNA, 20 bp, human
gtccacgcctacagagacag

SEQ ID NO: 180869 - DNA, 20 bp, human
gccggagcccctgtctctgt

SEQ ID NO: 180870 - DNA, 20 bp, human
gatgccaaaggagaaggtcg

SEQ ID NO: 180871 - DNA, 20 bp, human
ggcagtgtgtgggtagctct

SEQ ID NO: 180872 - DNA, 20 bp, human
gcgaagccactgggacactc

SEQ ID NO: 180873 - DNA, 20 bp, human
gaggcagtatcgctgaccta

SEQ ID NO: 180874 - DNA, 20 bp, human
gtctctgtaggcgtggagtg

SEQ ID NO: 180875 - DNA, 20 bp, human
gagctggctcaccaagtcac

SEQ ID NO: 180876 - DNA, 20 bp, human
gaaaatgaagggcctctacc

SEQ ID NO: 180877 - DNA, 20 bp, human
gccccagagtaacaagaatc

SEQ ID NO: 180878 - DNA, 20 bp, human
gccaaggcctcaagccacca

SEQ ID NO: 180879 - DNA, 20 bp, human
gaagaatccggccagcagcc

SEQ ID NO: 180880 - DNA, 20 bp, human
ggccggattcttgttactct

SEQ ID NO: 180881 - DNA, 20 bp, human
gggatcctcagtgtatgctc

SEQ ID NO: 180882 - DNA, 20 bp, human
gcactccatcctgtgaacca

SEQ ID NO: 180883 - DNA, 20 bp, human
gaaggcttgtaagaaaagac

SEQ ID NO: 180884 - DNA, 20 bp, human
gcaagccttggttcacagga

SEQ ID NO: 180885 - DNA, 20 bp, human
gagaaatcaatgttccaagg

SEQ ID NO: 180886 - DNA, 20 bp, human
gttgtggcaaaggccaagag

SEQ ID NO: 180887 - DNA, 20 bp, human
gtgcaggtgagccggtcctg

SEQ ID NO: 180888 - DNA, 20 bp, human
gcggcacaactccgcaggac

SEQ ID NO: 180889 - DNA, 20 bp, human
gtgccgagcaagccgagtgg

SEQ ID NO: 180890 - DNA, 20 bp, human
gtggaaagcaactctgccag

SEQ ID NO: 180891 - DNA, 20 bp, human
gtgagtcgactcccacctgc

SEQ ID NO: 180892 - DNA, 20 bp, human
gtggcctttgccacaaagaa

SEQ ID NO: 180893 - DNA, 20 bp, human
gacctgccgagcaagccgag

SEQ ID NO: 180894 - DNA, 20 bp, human
gatactcaattcctcagcta

SEQ ID NO: 180895 - DNA, 20 bp, human
ggcactcggcacaactccgc

SEQ ID NO: 180896 - DNA, 20 bp, human
gggaagtggccgaggaggga

SEQ ID NO: 180897 - DNA, 20 bp, human
ggaggagacgtggcagagtg

SEQ ID NO: 180898 - DNA, 20 bp, human
gcgagccatggcgaccaaga

SEQ ID NO: 180899 - DNA, 20 bp, human
gcgggaggcagacagctcca

SEQ ID NO: 180900 - DNA, 20 bp, human
ggggcagggcgggtactcac

SEQ ID NO: 180901 - DNA, 20 bp, human
ggaactgagagtctgaggac

SEQ ID NO: 180902 - DNA, 20 bp, human
gaggcagacagctccaggga

SEQ ID NO: 180903 - DNA, 20 bp, human
ggcgccggaccggaaagccg

SEQ ID NO: 180904 - DNA, 20 bp, human
gccatggcgaccaagacggc

SEQ ID NO: 180905 - DNA, 20 bp, human
gtgacacatgaccctggcca

SEQ ID NO: 180906 - DNA, 20 bp, human
gcagcagtgcccgtcggtcc

SEQ ID NO: 180907 - DNA, 20 bp, human
gtgcacagcaccgggaccga

SEQ ID NO: 180908 - DNA, 20 bp, human
ggaagcaagtcggagacaaa

SEQ ID NO: 180909 - DNA, 20 bp, human
gcatcggggaggtggaacct

SEQ ID NO: 180910 - DNA, 20 bp, human
gaggagggagcactgagtct

SEQ ID NO: 180911 - DNA, 20 bp, human
gggctccgcttgcacagcac

SEQ ID NO: 180912 - DNA, 20 bp, human
gctctcccagcagtgcccgt

SEQ ID NO: 180913 - DNA, 20 bp, human
gcacggactctgcatcgggg

SEQ ID NO: 180914 - DNA, 20 bp, human
gggtcccggtgctgtgcaag

SEQ ID NO: 180915 - DNA, 20 bp, human
gtcccccacggactctgcat

SEQ ID NO: 180916 - DNA, 20 bp, human
ggcgccatcttcagtccccg

SEQ ID NO: 180917 - DNA, 20 bp, human
gccgcgaggtgagattccgg

SEQ ID NO: 180918 - DNA, 20 bp, human
ggctgctccgggagccgctg

SEQ ID NO: 180919 - DNA, 20 bp, human
gaatgggaccggccactcag

SEQ ID NO: 180920 - DNA, 20 bp, human
gccagcgactcacacacctc

SEQ ID NO: 180921 - DNA, 20 bp, human
gtcacggtgattcctaggaa

SEQ ID NO: 180922 - DNA, 20 bp, human
gctggttgctgataatgagg

SEQ ID NO: 180923 - DNA, 20 bp, human
gggtgattcctaggaaagga

SEQ ID NO: 180924 - DNA, 20 bp, human
gtgagggggcgagggtacgg

SEQ ID NO: 180925 - DNA, 20 bp, human
ggcgccgcgaggtgagattc

SEQ ID NO: 180926 - DNA, 20 bp, human
gggcttgcgcagctcaccaa

SEQ ID NO: 180927 - DNA, 20 bp, human
gagccgaccggtaacgtcag

SEQ ID NO: 180928 - DNA, 20 bp, human
gagctgggactgcctggtgg

SEQ ID NO: 180929 - DNA, 20 bp, human
ggccacagaggccagaagac

SEQ ID NO: 180930 - DNA, 20 bp, human
gagctgcgcaagccgtggac

SEQ ID NO: 180931 - DNA, 20 bp, human
ggtggacgggccgaccaatt

SEQ ID NO: 180932 - DNA, 20 bp, human
gcgggcctggggcgccacag

SEQ ID NO: 180933 - DNA, 20 bp, human
gcgttaccggtcggcttcag

SEQ ID NO: 180934 - DNA, 20 bp, human
gcgcagctcaccaatggcag

SEQ ID NO: 180935 - DNA, 20 bp, human
gagcccctgacgttaccggt

SEQ ID NO: 180936 - DNA, 20 bp, human
gaggtgtgagtagagcctgg

SEQ ID NO: 180937 - DNA, 20 bp, human
gtctgaagacgagacatggg

SEQ ID NO: 180938 - DNA, 20 bp, human
gtggaacgcgccggaatctg

SEQ ID NO: 180939 - DNA, 20 bp, human
gggagagtggatccaggtga

SEQ ID NO: 180940 - DNA, 20 bp, human
gcttagggcgaatcacaagt

SEQ ID NO: 180941 - DNA, 20 bp, human
gaagtaaaccagagccccgt

SEQ ID NO: 180942 - DNA, 20 bp, human
gggccttgggtccagatcag

SEQ ID NO: 180943 - DNA, 20 bp, human
gcccgtgggctggaacgcgc

SEQ ID NO: 180944 - DNA, 20 bp, human
ggaagcttagagttcaagtg

SEQ ID NO: 180945 - DNA, 20 bp, human
gtccagatcagcggtaaggg

SEQ ID NO: 180946 - DNA, 20 bp, human
gccgctcgtgacgtcgcggg

SEQ ID NO: 180947 - DNA, 20 bp, human
gcttacccctcggggccggg

SEQ ID NO: 180948 - DNA, 20 bp, human
gagatcctcaaaaccgggta

SEQ ID NO: 180949 - DNA, 20 bp, human
ggcggactttaacacaggag

SEQ ID NO: 180950 - DNA, 20 bp, human
gcacgagcggggccgcgagg

SEQ ID NO: 180951 - DNA, 20 bp, human
ggccgctcgctcttacccct

SEQ ID NO: 180952 - DNA, 20 bp, human
gaagggagccacggaaatgt

SEQ ID NO: 180953 - DNA, 20 bp, human
gctcaaaaccgggtaaggcg

SEQ ID NO: 180954 - DNA, 20 bp, human
gggccccgctcgtgacgtcg

SEQ ID NO: 180955 - DNA, 20 bp, human
gggctcgcggactttaacac

SEQ ID NO: 180956 - DNA, 20 bp, human
gtagacgggggagaaagtgg

SEQ ID NO: 180957 - DNA, 20 bp, human
gccccaaggcaccgaaaccg

SEQ ID NO: 180958 - DNA, 20 bp, human
gccgggcggagcgacggcca

SEQ ID NO: 180959 - DNA, 20 bp, human
gggaagcgagtcccatacca

SEQ ID NO: 180960 - DNA, 20 bp, human
gcaaggcaccgaaaccgagg

SEQ ID NO: 180961 - DNA, 20 bp, human
ggcggaaccagccccttcca

SEQ ID NO: 180962 - DNA, 20 bp, human
gcgcgcgtggaacttcccag

SEQ ID NO: 180963 - DNA, 20 bp, human
gtgaatgggtcgctgagtgg

SEQ ID NO: 180964 - DNA, 20 bp, human
gggcaccgaaaccgaggcgg

SEQ ID NO: 180965 - DNA, 20 bp, human
gatccgcgtctcttagacgg

SEQ ID NO: 180966 - DNA, 20 bp, human
gccggctgcgaccagcaccc

SEQ ID NO: 180967 - DNA, 20 bp, human
gcccaggtggccacagagcg

SEQ ID NO: 180968 - DNA, 20 bp, human
gcccggagcccccgtccgtc

SEQ ID NO: 180969 - DNA, 20 bp, human
gggggtcgccagacggacgg

SEQ ID NO: 180970 - DNA, 20 bp, human
gcccgggctgccagaggacg

SEQ ID NO: 180971 - DNA, 20 bp, human
gggaatccgagggtcctcag

SEQ ID NO: 180972 - DNA, 20 bp, human
gctgggggtcgccagacgga

SEQ ID NO: 180973 - DNA, 20 bp, human
gtcgcggagattcggcgtcc

SEQ ID NO: 180974 - DNA, 20 bp, human
gtgggctgggggtcgccaga

SEQ ID NO: 180975 - DNA, 20 bp, human
gcccagcacgagcaccagcg

SEQ ID NO: 180976 - DNA, 20 bp, human
ggaagtggaggcgccgacgg

SEQ ID NO: 180977 - DNA, 20 bp, human
gtagccagggagagagttgt

SEQ ID NO: 180978 - DNA, 20 bp, human
ggagccccttatcggatctg

SEQ ID NO: 180979 - DNA, 20 bp, human
gcggacatgaagcaatatca

SEQ ID NO: 180980 - DNA, 20 bp, human
gagcaatatcaaggctccgg

SEQ ID NO: 180981 - DNA, 20 bp, human
gagaagagggagccccttat

SEQ ID NO: 180982 - DNA, 20 bp, human
gcaggaaagggcaagtggct

SEQ ID NO: 180983 - DNA, 20 bp, human
gtctcctcagatccgataag

SEQ ID NO: 180984 - DNA, 20 bp, human
gtgtccgtctcggccgccgt

SEQ ID NO: 180985 - DNA, 20 bp, human
gctcacgtgagcaccgggat

SEQ ID NO: 180986 - DNA, 20 bp, human
gatacaggcagggagagtca

SEQ ID NO: 180987 - DNA, 20 bp, human
gccgtgggccatcgcctcca

SEQ ID NO: 180988 - DNA, 20 bp, human
ggaagccccaccccggaagt

SEQ ID NO: 180989 - DNA, 20 bp, human
gcgcccgccactctcggata

SEQ ID NO: 180990 - DNA, 20 bp, human
gcatggccagccgacttccg

SEQ ID NO: 180991 - DNA, 20 bp, human
ggcagcgtcgtgccttgcag

SEQ ID NO: 180992 - DNA, 20 bp, human
gactccctatccgagagtgg

SEQ ID NO: 180993 - DNA, 20 bp, human
gagcacggctagcagccccg

SEQ ID NO: 180994 - DNA, 20 bp, human
gcgcggagcgcaggtcgaag

SEQ ID NO: 180995 - DNA, 20 bp, human
ggacacgaccttccctatac

SEQ ID NO: 180996 - DNA, 20 bp, human
gagagacgggtggaaaggaa

SEQ ID NO: 180997 - DNA, 20 bp, human
gtactctagaaagagacggg

SEQ ID NO: 180998 - DNA, 20 bp, human
gctgatagataacggaagtg

SEQ ID NO: 180999 - DNA, 20 bp, human
gtagataacggaagtgagga

SEQ ID NO: 181000 - DNA, 20 bp, human
gaccttctggccaaagagca

SEQ ID NO: 181001 - DNA, 20 bp, human
gtcaggactgccaactgcca

SEQ ID NO: 181002 - DNA, 20 bp, human
gcagaaaataatgggtacac

SEQ ID NO: 181003 - DNA, 20 bp, human
gcagggcaacacatcatcca

SEQ ID NO: 181004 - DNA, 20 bp, human
gactgtactctagaaagaga

SEQ ID NO: 181005 - DNA, 20 bp, human
gcaaggactgtggttcatct

SEQ ID NO: 181006 - DNA, 20 bp, human
gctccccgccatgggctcgg

SEQ ID NO: 181007 - DNA, 20 bp, human
gagtagcgcctggcccgcta

SEQ ID NO: 181008 - DNA, 20 bp, human
gagctccgcgcacccggcag

SEQ ID NO: 181009 - DNA, 20 bp, human
gacagcctccgagcccatgg

SEQ ID NO: 181010 - DNA, 20 bp, human
ggtgcatcccgtagaagtag

SEQ ID NO: 181011 - DNA, 20 bp, human
ggaggctgtccgaacgcccg

SEQ ID NO: 181012 - DNA, 20 bp, human
gggagcgacgtggacagcga

SEQ ID NO: 181013 - DNA, 20 bp, human
gccacgtcgctccccgccat

SEQ ID NO: 181014 - DNA, 20 bp, human
ggtgggccgaggggtagagg

SEQ ID NO: 181015 - DNA, 20 bp, human
ggaaggtgtacctgcagcag

SEQ ID NO: 181016 - DNA, 20 bp, human
gggaggaaaggagcccccgg

SEQ ID NO: 181017 - DNA, 20 bp, human
ggcggcactcacccatagta

SEQ ID NO: 181018 - DNA, 20 bp, human
ggcctctctgcgggcatagg

SEQ ID NO: 181019 - DNA, 20 bp, human
gtgcagcgcatccgtactat

SEQ ID NO: 181020 - DNA, 20 bp, human
gggacggtgaggggaagact

SEQ ID NO: 181021 - DNA, 20 bp, human
gcggcggaaaggcctctctg

SEQ ID NO: 181022 - DNA, 20 bp, human
ggcctttccgccgcccagag

SEQ ID NO: 181023 - DNA, 20 bp, human
ggggcatagggggcacctac

SEQ ID NO: 181024 - DNA, 20 bp, human
gcggagctgccggcccctcg

SEQ ID NO: 181025 - DNA, 20 bp, human
ggggccggcagctccgaccg

SEQ ID NO: 181026 - DNA, 20 bp, human
gaggccctcagccacatcca

SEQ ID NO: 181027 - DNA, 20 bp, human
gcagccgaggagaagtgaaa

SEQ ID NO: 181028 - DNA, 20 bp, human
ggtggctgagggcctagggt

SEQ ID NO: 181029 - DNA, 20 bp, human
ggggagaagtctccacaggt

SEQ ID NO: 181030 - DNA, 20 bp, human
gctcaagctgacaacctgtg

SEQ ID NO: 181031 - DNA, 20 bp, human
gcggtaagatggacagatca

SEQ ID NO: 181032 - DNA, 20 bp, human
gctctactcagagaccctgg

SEQ ID NO: 181033 - DNA, 20 bp, human
gcgaggagaagtgaaagggc

SEQ ID NO: 181034 - DNA, 20 bp, human
ggagaccctggtggtcagag

SEQ ID NO: 181035 - DNA, 20 bp, human
gctgacttgtgccgtggatg

SEQ ID NO: 181036 - DNA, 20 bp, human
gcctggcaaggtctgaagac

SEQ ID NO: 181037 - DNA, 20 bp, human
ggctccgagtcatccgtgtg

SEQ ID NO: 181038 - DNA, 20 bp, human
gaggagaataacgtatgtag

SEQ ID NO: 181039 - DNA, 20 bp, human
ggacacgcccagagcccgag

SEQ ID NO: 181040 - DNA, 20 bp, human
gtgtagaggcgcgtaatgcc

SEQ ID NO: 181041 - DNA, 20 bp, human
gaggtgctgagggagtttgg

SEQ ID NO: 181042 - DNA, 20 bp, human
gaaagaggccaactgtgcca

SEQ ID NO: 181043 - DNA, 20 bp, human
ggaggccaactgtgccaggg

SEQ ID NO: 181044 - DNA, 20 bp, human
ggggatcagtgcgccggaag

SEQ ID NO: 181045 - DNA, 20 bp, human
gctggcgcggcgctccggta

SEQ ID NO: 181046 - DNA, 20 bp, human
gtgagttaaagagggcggta

SEQ ID NO: 181047 - DNA, 20 bp, human
gcaggcactccgcgagccgg

SEQ ID NO: 181048 - DNA, 20 bp, human
gcgagccgggggaccaagtt

SEQ ID NO: 181049 - DNA, 20 bp, human
gtgcctgcgagcggtgctca

SEQ ID NO: 181050 - DNA, 20 bp, human
ggcagagtcggggatagggt

SEQ ID NO: 181051 - DNA, 20 bp, human
ggaagccaaacttggtcccc

SEQ ID NO: 181052 - DNA, 20 bp, human
gaaccacgcaccgaaacgag

SEQ ID NO: 181053 - DNA, 20 bp, human
gctcgcggagtgcctgcgag

SEQ ID NO: 181054 - DNA, 20 bp, human
gcggtctccacggcaaccga

SEQ ID NO: 181055 - DNA, 20 bp, human
gcgccttcaaccggctgcaa

SEQ ID NO: 181056 - DNA, 20 bp, human
gcacggttgctagggagacg

SEQ ID NO: 181057 - DNA, 20 bp, human
gggttgctagggagacgcgg

SEQ ID NO: 181058 - DNA, 20 bp, human
gtcttccggcaaccattaaa

SEQ ID NO: 181059 - DNA, 20 bp, human
ggctccgaggaagctagtag

SEQ ID NO: 181060 - DNA, 20 bp, human
ggagggagccgataacccgc

SEQ ID NO: 181061 - DNA, 20 bp, human
gttaaagggcacggttgcta

SEQ ID NO: 181062 - DNA, 20 bp, human
gagcctacccggtgagatcc

SEQ ID NO: 181063 - DNA, 20 bp, human
gttctggccgggatctcacc

SEQ ID NO: 181064 - DNA, 20 bp, human
gggccgggatctcaccgggt

SEQ ID NO: 181065 - DNA, 20 bp, human
gcggcaaccattaaagggca

SEQ ID NO: 181066 - DNA, 20 bp, human
gccagcggctcagagcgcag

SEQ ID NO: 181067 - DNA, 20 bp, human
gtctgagccgctgggaacca

SEQ ID NO: 181068 - DNA, 20 bp, human
gccaggataagcgagtccag

SEQ ID NO: 181069 - DNA, 20 bp, human
ggcagcggtgagtgattaag

SEQ ID NO: 181070 - DNA, 20 bp, human
gagccgctgggaaccaaggc

SEQ ID NO: 181071 - DNA, 20 bp, human
gacagaggatgtgtgaagac

SEQ ID NO: 181072 - DNA, 20 bp, human
ggaaccaaggctggttgcta

SEQ ID NO: 181073 - DNA, 20 bp, human
gggtcctgcttcagatgatt

SEQ ID NO: 181074 - DNA, 20 bp, human
gctgcttagactcttaggag

SEQ ID NO: 181075 - DNA, 20 bp, human
gtggttgctaaggacgctgt

SEQ ID NO: 181076 - DNA, 20 bp, human
gtaggggcgtactgagacat

SEQ ID NO: 181077 - DNA, 20 bp, human
gagtaccacgaggagtgcag

SEQ ID NO: 181078 - DNA, 20 bp, human
gcctagcccggacttcaaga

SEQ ID NO: 181079 - DNA, 20 bp, human
gtgagagcccgagaaaggtg

SEQ ID NO: 181080 - DNA, 20 bp, human
gcagggctctgagtaccacg

SEQ ID NO: 181081 - DNA, 20 bp, human
ggagcctcgccacaagccgg

SEQ ID NO: 181082 - DNA, 20 bp, human
ggaggagcgcacggtctgtg

SEQ ID NO: 181083 - DNA, 20 bp, human
gagctctgagagcccgagaa

SEQ ID NO: 181084 - DNA, 20 bp, human
gactgagacatgggcgaggc

SEQ ID NO: 181085 - DNA, 20 bp, human
ggcgtactgagacatgggcg

SEQ ID NO: 181086 - DNA, 20 bp, human
gtgggcggccgtttggggtg

SEQ ID NO: 181087 - DNA, 20 bp, human
gaggaaatgaattcgaggcg

SEQ ID NO: 181088 - DNA, 20 bp, human
gtcccggaagtagaagacag

SEQ ID NO: 181089 - DNA, 20 bp, human
gggtcgggaaatccatggaa

SEQ ID NO: 181090 - DNA, 20 bp, human
gcgggaaatccatggaaggg

SEQ ID NO: 181091 - DNA, 20 bp, human
ggccgaggcgaagagagcga

SEQ ID NO: 181092 - DNA, 20 bp, human
gcggaggcccgcttcagcag

SEQ ID NO: 181093 - DNA, 20 bp, human
gtggtggccgctctgtgggg

SEQ ID NO: 181094 - DNA, 20 bp, human
gctacccagagacgccgcca

SEQ ID NO: 181095 - DNA, 20 bp, human
gcgggttcatgagccgacct

SEQ ID NO: 181096 - DNA, 20 bp, human
gtgagtgactggacaggcag

SEQ ID NO: 181097 - DNA, 20 bp, human
gaggccggccttgctggagg

SEQ ID NO: 181098 - DNA, 20 bp, human
ggaacgtgcccagggacccg

SEQ ID NO: 181099 - DNA, 20 bp, human
ggagccgcgcggcgaacctg

SEQ ID NO: 181100 - DNA, 20 bp, human
gtgcttccaggagcacgggt

SEQ ID NO: 181101 - DNA, 20 bp, human
gtcagcgaccgcagagaggt

SEQ ID NO: 181102 - DNA, 20 bp, human
gatgccccctccagcaaggc

SEQ ID NO: 181103 - DNA, 20 bp, human
gaagcataggagcctggcac

SEQ ID NO: 181104 - DNA, 20 bp, human
gcagaggccggccttgctgg

SEQ ID NO: 181105 - DNA, 20 bp, human
gcctatgcttccaggagcac

SEQ ID NO: 181106 - DNA, 20 bp, human
gcctcaggatggcttctgga

SEQ ID NO: 181107 - DNA, 20 bp, human
gggagaaagcggcaaactct

SEQ ID NO: 181108 - DNA, 20 bp, human
gagagggagtcccaggttct

SEQ ID NO: 181109 - DNA, 20 bp, human
gcagtcaaagagggagtccc

SEQ ID NO: 181110 - DNA, 20 bp, human
gagcaagctgccaagaacct

SEQ ID NO: 181111 - DNA, 20 bp, human
gtgctgcccacagtcaaaga

SEQ ID NO: 181112 - DNA, 20 bp, human
gagcttgcttttcctcagga

SEQ ID NO: 181113 - DNA, 20 bp, human
gaccgcctaccaaggaacaa

SEQ ID NO: 181114 - DNA, 20 bp, human
gagagtcactaacgcaacat

SEQ ID NO: 181115 - DNA, 20 bp, human
gggaaggctcattaagttcg

SEQ ID NO: 181116 - DNA, 20 bp, human
gcccgggcctcagatgagtg

SEQ ID NO: 181117 - DNA, 20 bp, human
gggcgtcccacaggtcccgg

SEQ ID NO: 181118 - DNA, 20 bp, human
gacgagctgggaatcactaa

SEQ ID NO: 181119 - DNA, 20 bp, human
gagcggcctccgggacctgt

SEQ ID NO: 181120 - DNA, 20 bp, human
ggggaccgaactcccggagt

SEQ ID NO: 181121 - DNA, 20 bp, human
gctcccggagtgggagagag

SEQ ID NO: 181122 - DNA, 20 bp, human
ggcgcgcgcgatcgatccca

SEQ ID NO: 181123 - DNA, 20 bp, human
ggctacagacctctcctcgg

SEQ ID NO: 181124 - DNA, 20 bp, human
ggcgcgtcggcctcgagagg

SEQ ID NO: 181125 - DNA, 20 bp, human
gacgacgcctcactcatctg

SEQ ID NO: 181126 - DNA, 20 bp, human
gagcggtgtgcgcctcgcag

SEQ ID NO: 181127 - DNA, 20 bp, human
gtctctctgggcgccagcgg

SEQ ID NO: 181128 - DNA, 20 bp, human
gggcggcgggcgccgaccag

SEQ ID NO: 181129 - DNA, 20 bp, human
gacagagagcggccatgggg

SEQ ID NO: 181130 - DNA, 20 bp, human
ggcccagagagagcgttccg

SEQ ID NO: 181131 - DNA, 20 bp, human
gcaccccggaacgctctctc

SEQ ID NO: 181132 - DNA, 20 bp, human
gcgctctctctgggcgccag

SEQ ID NO: 181133 - DNA, 20 bp, human
gagcacaggtgcatacgtgg

SEQ ID NO: 181134 - DNA, 20 bp, human
ggggacctgctcatctactc

SEQ ID NO: 181135 - DNA, 20 bp, human
gaagctctcccgccgctggt

SEQ ID NO: 181136 - DNA, 20 bp, human
gagggcccgggcagacagaa

SEQ ID NO: 181137 - DNA, 20 bp, human
ggaatgctgaccaaagtggg

SEQ ID NO: 181138 - DNA, 20 bp, human
gtacctatggagcaggtcaa

SEQ ID NO: 181139 - DNA, 20 bp, human
gacctgctccataggtaagt

SEQ ID NO: 181140 - DNA, 20 bp, human
gatggagcaggtcaaaggtg

SEQ ID NO: 181141 - DNA, 20 bp, human
ggctgctgcccacttaccta

SEQ ID NO: 181142 - DNA, 20 bp, human
ggcactaggactgacaatcc

SEQ ID NO: 181143 - DNA, 20 bp, human
gccagaatgctgaccaaagt

SEQ ID NO: 181144 - DNA, 20 bp, human
ggccgggtcatggagagagg

SEQ ID NO: 181145 - DNA, 20 bp, human
ggtttgctgggtgggtatgg

SEQ ID NO: 181146 - DNA, 20 bp, human
ggggtggggctacagaatta

SEQ ID NO: 181147 - DNA, 20 bp, human
gagggactgggacttacctc

SEQ ID NO: 181148 - DNA, 20 bp, human
gaccactggatccagctcgg

SEQ ID NO: 181149 - DNA, 20 bp, human
gggctacagaattagggact

SEQ ID NO: 181150 - DNA, 20 bp, human
gagcaggtggcgccacaccg

SEQ ID NO: 181151 - DNA, 20 bp, human
gggagggcaccagtgtgcgt

SEQ ID NO: 181152 - DNA, 20 bp, human
ggcggccacgacaggccaca

SEQ ID NO: 181153 - DNA, 20 bp, human
ggtggagacagataccatcg

SEQ ID NO: 181154 - DNA, 20 bp, human
ggccatgcactcttcaccac

SEQ ID NO: 181155 - DNA, 20 bp, human
gctggtcagcctgggtcacg

SEQ ID NO: 181156 - DNA, 20 bp, human
gcatcgcagggaggacccga

SEQ ID NO: 181157 - DNA, 20 bp, human
gaggggagcgcaggccgcac

SEQ ID NO: 181158 - DNA, 20 bp, human
ggccgcacgggcggtaaaca

SEQ ID NO: 181159 - DNA, 20 bp, human
gagaggagcgtagggagtgt

SEQ ID NO: 181160 - DNA, 20 bp, human
gagccgagcgcatcgcaggg

SEQ ID NO: 181161 - DNA, 20 bp, human
ggaagcgctgacctctgcgg

SEQ ID NO: 181162 - DNA, 20 bp, human
ggtcgtgatggtgagcggag

SEQ ID NO: 181163 - DNA, 20 bp, human
gggagcgtaggccttggtag

SEQ ID NO: 181164 - DNA, 20 bp, human
gcgcgctccgctccgccctc

SEQ ID NO: 181165 - DNA, 20 bp, human
gcgtcggtcgtgatggtgag

SEQ ID NO: 181166 - DNA, 20 bp, human
gggtgcctgcccaaatcccc

SEQ ID NO: 181167 - DNA, 20 bp, human
ggagccacgtggccgtctct

SEQ ID NO: 181168 - DNA, 20 bp, human
gcaccgtggatccccgagaa

SEQ ID NO: 181169 - DNA, 20 bp, human
gcaggaaacggggacagtac

SEQ ID NO: 181170 - DNA, 20 bp, human
gaaagcacggtacatctcca

SEQ ID NO: 181171 - DNA, 20 bp, human
gggcggcggccaggggattt

SEQ ID NO: 181172 - DNA, 20 bp, human
gggaggcagcgattgcacgt

SEQ ID NO: 181173 - DNA, 20 bp, human
ggcgtgaggaggtctctggt

SEQ ID NO: 181174 - DNA, 20 bp, human
gccgcccagagacggccacg

SEQ ID NO: 181175 - DNA, 20 bp, human
gggcagcgattgcacgtggg

SEQ ID NO: 181176 - DNA, 20 bp, human
ggacagcgggcgctgcaact

SEQ ID NO: 181177 - DNA, 20 bp, human
gtccgtccccaactgggccc

SEQ ID NO: 181178 - DNA, 20 bp, human
gccgtcaccgcagaaccggg

SEQ ID NO: 181179 - DNA, 20 bp, human
gaggccgagcactcacaccg

SEQ ID NO: 181180 - DNA, 20 bp, human
ggagtctggcggcccaggga

SEQ ID NO: 181181 - DNA, 20 bp, human
gctcagagcgggatgtgtgt

SEQ ID NO: 181182 - DNA, 20 bp, human
gagacgatggcaatcagaaa

SEQ ID NO: 181183 - DNA, 20 bp, human
gttggggacggacgcactag

SEQ ID NO: 181184 - DNA, 20 bp, human
gatgagctccagggtctcac

SEQ ID NO: 181185 - DNA, 20 bp, human
ggaatgacccaaggaaccag

SEQ ID NO: 181186 - DNA, 20 bp, human
ggcgggcgcgggaccaatat

SEQ ID NO: 181187 - DNA, 20 bp, human
ggcagctgctcaagatgagg

SEQ ID NO: 181188 - DNA, 20 bp, human
ggaacgcgggccagatgcgt

SEQ ID NO: 181189 - DNA, 20 bp, human
gactttgctaccaggaccta

SEQ ID NO: 181190 - DNA, 20 bp, human
gtgcagcaggagtacggtct

SEQ ID NO: 181191 - DNA, 20 bp, human
gctgccctctggcggagtcc

SEQ ID NO: 181192 - DNA, 20 bp, human
gtcccgcgcccgccaaacct

SEQ ID NO: 181193 - DNA, 20 bp, human
gcgctggcgccagggatggg

SEQ ID NO: 181194 - DNA, 20 bp, human
gcagcccggactccgccaga

SEQ ID NO: 181195 - DNA, 20 bp, human
gtggccgcgccggggagagt

SEQ ID NO: 181196 - DNA, 20 bp, human
ggtgctaggcagcaactgaa

SEQ ID NO: 181197 - DNA, 20 bp, human
gggagtaattgaaaagctca

SEQ ID NO: 181198 - DNA, 20 bp, human
gtattcggaggtaagctctc

SEQ ID NO: 181199 - DNA, 20 bp, human
gtacacatcctacgtcaagg

SEQ ID NO: 181200 - DNA, 20 bp, human
ggtcatcgctataaggagtg

SEQ ID NO: 181201 - DNA, 20 bp, human
gatgtacacatcctacgtca

SEQ ID NO: 181202 - DNA, 20 bp, human
gaaatggcctctctgtcagt

SEQ ID NO: 181203 - DNA, 20 bp, human
gtggtaatagggcaatataa

SEQ ID NO: 181204 - DNA, 20 bp, human
gtccagatgtcatcgctata

SEQ ID NO: 181205 - DNA, 20 bp, human
gtccttatagcgatgacatc

SEQ ID NO: 181206 - DNA, 20 bp, human
ggaggaacgatggccgacgg

SEQ ID NO: 181207 - DNA, 20 bp, human
gcgtagtcgacgaagcagag

SEQ ID NO: 181208 - DNA, 20 bp, human
gggctgtggcggaggaacga

SEQ ID NO: 181209 - DNA, 20 bp, human
ggcagcgcggccaggacgat

SEQ ID NO: 181210 - DNA, 20 bp, human
ggcggaggaacgatggccga

SEQ ID NO: 181211 - DNA, 20 bp, human
gcaggcttggcgcgtcctta

SEQ ID NO: 181212 - DNA, 20 bp, human
ggtgcaggcgctgcagccag

SEQ ID NO: 181213 - DNA, 20 bp, human
ggcgtcagcgagctcttgaa

SEQ ID NO: 181214 - DNA, 20 bp, human
ggaggcagtagaggccgtac

SEQ ID NO: 181215 - DNA, 20 bp, human
gtccttagggccgccgccgt

SEQ ID NO: 181216 - DNA, 20 bp, human
ggagaccgcggcccccaaag

SEQ ID NO: 181217 - DNA, 20 bp, human
ggccacagctggcacaagca

SEQ ID NO: 181218 - DNA, 20 bp, human
gacatggcccgcctgagcaa

SEQ ID NO: 181219 - DNA, 20 bp, human
gcgagctggtcgccccaacc

SEQ ID NO: 181220 - DNA, 20 bp, human
gggatggttgagtgtctcgg

SEQ ID NO: 181221 - DNA, 20 bp, human
gccaccgcgccagaagggct

SEQ ID NO: 181222 - DNA, 20 bp, human
ggcccgaggcgcactgcccg

SEQ ID NO: 181223 - DNA, 20 bp, human
ggctggctagctcatcccgg

SEQ ID NO: 181224 - DNA, 20 bp, human
gccggagatggcgcctccac

SEQ ID NO: 181225 - DNA, 20 bp, human
ggcgcagctggcgcaggcaa

SEQ ID NO: 181226 - DNA, 20 bp, human
gaccagaacgctgccaggtg

SEQ ID NO: 181227 - DNA, 20 bp, human
gcaaggaaaggaccccaagt

SEQ ID NO: 181228 - DNA, 20 bp, human
gaccaggaagagggctatgg

SEQ ID NO: 181229 - DNA, 20 bp, human
gttgctgggtggataggacc

SEQ ID NO: 181230 - DNA, 20 bp, human
gcaggctgtggaatctggtg

SEQ ID NO: 181231 - DNA, 20 bp, human
ggatgtcttgtgaccccacc

SEQ ID NO: 181232 - DNA, 20 bp, human
ggggaccaggaagagggcta

SEQ ID NO: 181233 - DNA, 20 bp, human
gctatccacccagcaaggaa

SEQ ID NO: 181234 - DNA, 20 bp, human
gtgtgatggtggccaggctg

SEQ ID NO: 181235 - DNA, 20 bp, human
gcccctgacggaataggcgg

SEQ ID NO: 181236 - DNA, 20 bp, human
ggccggagcccgaactgagg

SEQ ID NO: 181237 - DNA, 20 bp, human
ggttgccggagcccgaactg

SEQ ID NO: 181238 - DNA, 20 bp, human
gggagcccgaactgaggcgg

SEQ ID NO: 181239 - DNA, 20 bp, human
gaggcctcggctccagacgt

SEQ ID NO: 181240 - DNA, 20 bp, human
gcaaggccggcagggaaccc

SEQ ID NO: 181241 - DNA, 20 bp, human
gagtgggcaaaccccagtgt

SEQ ID NO: 181242 - DNA, 20 bp, human
gcgaagaccagacgccaacc

SEQ ID NO: 181243 - DNA, 20 bp, human
gggaagtcccgccatctcca

SEQ ID NO: 181244 - DNA, 20 bp, human
gtggcgtctggtcttcgcgt

SEQ ID NO: 181245 - DNA, 20 bp, human
gggcctggtccccccacact

SEQ ID NO: 181246 - DNA, 20 bp, human
gaggcccgcttcagaccccg

SEQ ID NO: 181247 - DNA, 20 bp, human
ggtctgaagcgggcctaccg

SEQ ID NO: 181248 - DNA, 20 bp, human
gacacactggacccagcagt

SEQ ID NO: 181249 - DNA, 20 bp, human
gccgcttcagaccccgggga

SEQ ID NO: 181250 - DNA, 20 bp, human
ggtgtgtggtcctcagggta

SEQ ID NO: 181251 - DNA, 20 bp, human
gggtctgtggctgcctagct

SEQ ID NO: 181252 - DNA, 20 bp, human
gtctctccagctcaggccta

SEQ ID NO: 181253 - DNA, 20 bp, human
ggaggacggaacacacacac

SEQ ID NO: 181254 - DNA, 20 bp, human
gtgcaggctcaagagcccat

SEQ ID NO: 181255 - DNA, 20 bp, human
gcgggcctaccggggcctgg

SEQ ID NO: 181256 - DNA, 20 bp, human
gcacgaacggcaaagcccaa

SEQ ID NO: 181257 - DNA, 20 bp, human
ggcgaaggcacggacacgaa

SEQ ID NO: 181258 - DNA, 20 bp, human
ggcccgcagggacttcgaga

SEQ ID NO: 181259 - DNA, 20 bp, human
gcggagagaagggcactcgg

SEQ ID NO: 181260 - DNA, 20 bp, human
gggaagaggagagggtcgga

SEQ ID NO: 181261 - DNA, 20 bp, human
gcctgcgggaccgacgagac

SEQ ID NO: 181262 - DNA, 20 bp, human
gcatgctggccgacatgatg

SEQ ID NO: 181263 - DNA, 20 bp, human
gacctgagcagttgctccgg

SEQ ID NO: 181264 - DNA, 20 bp, human
gcgcagggacttcgagaggg

SEQ ID NO: 181265 - DNA, 20 bp, human
ggccgccggagcaactgctc

SEQ ID NO: 181266 - DNA, 20 bp, human
gactgcggcggcatccggga

SEQ ID NO: 181267 - DNA, 20 bp, human
gtccgccggcgaccgctgac

SEQ ID NO: 181268 - DNA, 20 bp, human
ggcccgtcagcggtcgccgg

SEQ ID NO: 181269 - DNA, 20 bp, human
gtctcagagcgggtctccgg

SEQ ID NO: 181270 - DNA, 20 bp, human
ggagcctgcttgcaaagctg

SEQ ID NO: 181271 - DNA, 20 bp, human
gtcagctctgaataatcggg

SEQ ID NO: 181272 - DNA, 20 bp, human
gctttgcaagcaggctccgc

SEQ ID NO: 181273 - DNA, 20 bp, human
gagcgcccgtcagcggtcgc

SEQ ID NO: 181274 - DNA, 20 bp, human
gccgctctgagaacctgacc

SEQ ID NO: 181275 - DNA, 20 bp, human
gggttctcagagcgggtctc

SEQ ID NO: 181276 - DNA, 20 bp, human
gtcagggtgctgggttccta

SEQ ID NO: 181277 - DNA, 20 bp, human
gcaggcagagggaccaagaa

SEQ ID NO: 181278 - DNA, 20 bp, human
gagcgacttacatgtcccat

SEQ ID NO: 181279 - DNA, 20 bp, human
gcattctcttggagcaagca

SEQ ID NO: 181280 - DNA, 20 bp, human
gttctagacagacagcccat

SEQ ID NO: 181281 - DNA, 20 bp, human
gatgtaagtcgctccatagt

SEQ ID NO: 181282 - DNA, 20 bp, human
gcccagaggcagaagcaaat

SEQ ID NO: 181283 - DNA, 20 bp, human
gggtttgtgatccttctgag

SEQ ID NO: 181284 - DNA, 20 bp, human
gtagacaggtacgtgctgac

SEQ ID NO: 181285 - DNA, 20 bp, human
gacctgtctactgtggccac

SEQ ID NO: 181286 - DNA, 20 bp, human
gctgggtcctaggtctccta

SEQ ID NO: 181287 - DNA, 20 bp, human
gtagctgcttcagactaggt

SEQ ID NO: 181288 - DNA, 20 bp, human
gtaggttctgaatgggagga

SEQ ID NO: 181289 - DNA, 20 bp, human
gtctgaagcagctactccaa

SEQ ID NO: 181290 - DNA, 20 bp, human
gggagtagctgcttcagact

SEQ ID NO: 181291 - DNA, 20 bp, human
gagcagctactccaaaggga

SEQ ID NO: 181292 - DNA, 20 bp, human
ggagctaggttctgaatggg

SEQ ID NO: 181293 - DNA, 20 bp, human
gcaaagggatgggacccagc

SEQ ID NO: 181294 - DNA, 20 bp, human
ggcagacgacaaacttgtcc

SEQ ID NO: 181295 - DNA, 20 bp, human
gactgagctaggttctgaat

SEQ ID NO: 181296 - DNA, 20 bp, human
gggtgttgcagccatggcta

SEQ ID NO: 181297 - DNA, 20 bp, human
gagactgcctcgctgaaagt

SEQ ID NO: 181298 - DNA, 20 bp, human
gcttgctggacggaaatagg

SEQ ID NO: 181299 - DNA, 20 bp, human
gcatggctgcaacacctccc

SEQ ID NO: 181300 - DNA, 20 bp, human
gctgaagcgcgctcccgggg

SEQ ID NO: 181301 - DNA, 20 bp, human
gggcctgccaagtcagaata

SEQ ID NO: 181302 - DNA, 20 bp, human
gcgctgaaagtaggtcgcgc

SEQ ID NO: 181303 - DNA, 20 bp, human
gaagtcggaggccagcaatg

SEQ ID NO: 181304 - DNA, 20 bp, human
gccgcgcgctaggagcggag

SEQ ID NO: 181305 - DNA, 20 bp, human
ggtgtagtagccaaagctga

SEQ ID NO: 181306 - DNA, 20 bp, human
gcgcagagcatcctactccg

SEQ ID NO: 181307 - DNA, 20 bp, human
gggaccgagagaggcaaccg

SEQ ID NO: 181308 - DNA, 20 bp, human
gggctgcagctcgcaaccag

SEQ ID NO: 181309 - DNA, 20 bp, human
gggcacacacccgcactccg

SEQ ID NO: 181310 - DNA, 20 bp, human
gagagaggcaaccgcggagt

SEQ ID NO: 181311 - DNA, 20 bp, human
gctctcggaaggaccgagag

SEQ ID NO: 181312 - DNA, 20 bp, human
ggtgtctctcagctctcgga

SEQ ID NO: 181313 - DNA, 20 bp, human
gctgcagcgggagcgacgtg

SEQ ID NO: 181314 - DNA, 20 bp, human
gtagcggcccttccttcggg

SEQ ID NO: 181315 - DNA, 20 bp, human
gcggagcgccaagcttgcgt

SEQ ID NO: 181316 - DNA, 20 bp, human
gcaaagacagagctcgaagg

SEQ ID NO: 181317 - DNA, 20 bp, human
gggccccgggagagccgggt

SEQ ID NO: 181318 - DNA, 20 bp, human
gggcctcgggatgcagccgc

SEQ ID NO: 181319 - DNA, 20 bp, human
gggaataaacggaagagatg

SEQ ID NO: 181320 - DNA, 20 bp, human
ggctcctggcggcgggactg

SEQ ID NO: 181321 - DNA, 20 bp, human
gttccaaagacagagctcga

SEQ ID NO: 181322 - DNA, 20 bp, human
gcccggaaaatggtgtaggt

SEQ ID NO: 181323 - DNA, 20 bp, human
gtggtgtaggttggaataaa

SEQ ID NO: 181324 - DNA, 20 bp, human
gagagctcgaaggaggcgga

SEQ ID NO: 181325 - DNA, 20 bp, human
gctcataataaaacgtaaca

SEQ ID NO: 181326 - DNA, 20 bp, human
gggacaaggcgcccaagcgg

SEQ ID NO: 181327 - DNA, 20 bp, human
gtccggacaaggcgcccaag

SEQ ID NO: 181328 - DNA, 20 bp, human
ggctgtagaacaggacgcac

SEQ ID NO: 181329 - DNA, 20 bp, human
gtacttcacctccttcccgt

SEQ ID NO: 181330 - DNA, 20 bp, human
gctgactcgtgggtctacga

SEQ ID NO: 181331 - DNA, 20 bp, human
gaggtgaagtaactgcgctg

SEQ ID NO: 181332 - DNA, 20 bp, human
ggattggtgggaacacgctc

SEQ ID NO: 181333 - DNA, 20 bp, human
gttcccagatgcctacggga

SEQ ID NO: 181334 - DNA, 20 bp, human
ggcgtcctgttctacagcta

SEQ ID NO: 181335 - DNA, 20 bp, human
gccggccatagctgtagaac

SEQ ID NO: 181336 - DNA, 20 bp, human
gctgggagactgcattctgt

SEQ ID NO: 181337 - DNA, 20 bp, human
gctctgttgcctaataatta

SEQ ID NO: 181338 - DNA, 20 bp, human
gaaatagcaatatccagctg

SEQ ID NO: 181339 - DNA, 20 bp, human
gctatttccgaatatacctg

SEQ ID NO: 181340 - DNA, 20 bp, human
gtggccctacaaatgacaaa

SEQ ID NO: 181341 - DNA, 20 bp, human
gaaacagaatatagtcagtg

SEQ ID NO: 181342 - DNA, 20 bp, human
ggattttaaataaaatagtc

SEQ ID NO: 181343 - DNA, 20 bp, human
gagacatacagatatgttct

SEQ ID NO: 181344 - DNA, 20 bp, human
gtataactgtaacaagcaag

SEQ ID NO: 181345 - DNA, 20 bp, human
gacttagccacaggtatatt

SEQ ID NO: 181346 - DNA, 20 bp, human
gtggccagagatctgtacag

SEQ ID NO: 181347 - DNA, 20 bp, human
gcgccaccggaagaacacgt

SEQ ID NO: 181348 - DNA, 20 bp, human
gtggccaagtgcctgagagt

SEQ ID NO: 181349 - DNA, 20 bp, human
gtcgcgagctgagaaaccta

SEQ ID NO: 181350 - DNA, 20 bp, human
ggtgtgggtcagaccccgag

SEQ ID NO: 181351 - DNA, 20 bp, human
gaaatggtgagagcgttgag

SEQ ID NO: 181352 - DNA, 20 bp, human
gtagccttcgcggggcaaaa

SEQ ID NO: 181353 - DNA, 20 bp, human
gtgaagcacttccaactctc

SEQ ID NO: 181354 - DNA, 20 bp, human
gtgccgacgtgttcttccgg

SEQ ID NO: 181355 - DNA, 20 bp, human
gtaatccgccgctccgccac

SEQ ID NO: 181356 - DNA, 20 bp, human
gcgggaggccgtgaggagag

SEQ ID NO: 181357 - DNA, 20 bp, human
gccgcagccggacgagaaag

SEQ ID NO: 181358 - DNA, 20 bp, human
ggaggccgtgaggagagcgg

SEQ ID NO: 181359 - DNA, 20 bp, human
gcggacgagaaagcggaaga

SEQ ID NO: 181360 - DNA, 20 bp, human
ggggagagccctaatcggta

SEQ ID NO: 181361 - DNA, 20 bp, human
gtcggaggtagcagacttgg

SEQ ID NO: 181362 - DNA, 20 bp, human
gtggcgctcgctgtccccag

SEQ ID NO: 181363 - DNA, 20 bp, human
gggtcgcgcacgttgatgag

SEQ ID NO: 181364 - DNA, 20 bp, human
gcgctggggtcaagggtcgg

SEQ ID NO: 181365 - DNA, 20 bp, human
gggccaggggtcgcggtcgg

SEQ ID NO: 181366 - DNA, 20 bp, human
gggcgcaggcaaggggacgt

SEQ ID NO: 181367 - DNA, 20 bp, human
ggcgcaagcagccagtaccg

SEQ ID NO: 181368 - DNA, 20 bp, human
ggcgcggcagaggctacaaa

SEQ ID NO: 181369 - DNA, 20 bp, human
gcacgcccggcagggtcctg

SEQ ID NO: 181370 - DNA, 20 bp, human
gctgccgcgcttgaacttga

SEQ ID NO: 181371 - DNA, 20 bp, human
ggtgctccggccagcatgga

SEQ ID NO: 181372 - DNA, 20 bp, human
ggtgcgccctcgctttcccg

SEQ ID NO: 181373 - DNA, 20 bp, human
ggagggtgagcgcagtctcc

SEQ ID NO: 181374 - DNA, 20 bp, human
ggagggcgcacggggcccta

SEQ ID NO: 181375 - DNA, 20 bp, human
gagcaggaacagcaaccgag

SEQ ID NO: 181376 - DNA, 20 bp, human
gtagtgcgctgtgcacaggg

SEQ ID NO: 181377 - DNA, 20 bp, human
gccaagaacccggtgcgaca

SEQ ID NO: 181378 - DNA, 20 bp, human
ggagacgagcgcagcttgtg

SEQ ID NO: 181379 - DNA, 20 bp, human
gctccccccggtaccgaagg

SEQ ID NO: 181380 - DNA, 20 bp, human
gaaaggtgcggtccaacccg

SEQ ID NO: 181381 - DNA, 20 bp, human
gaacccgcggaggctcgacc

SEQ ID NO: 181382 - DNA, 20 bp, human
gtgcgctcgtctctcggctg

SEQ ID NO: 181383 - DNA, 20 bp, human
gagggtgaaggtgaacactg

SEQ ID NO: 181384 - DNA, 20 bp, human
gctcgacccggaagccgccg

SEQ ID NO: 181385 - DNA, 20 bp, human
gcagtggcgaccgagggaga

SEQ ID NO: 181386 - DNA, 20 bp, human
ggcgccggaaagcagaatgc

SEQ ID NO: 181387 - DNA, 20 bp, human
ggcgtaaacgacgcaccgga

SEQ ID NO: 181388 - DNA, 20 bp, human
ggcccccaccacctgaccag

SEQ ID NO: 181389 - DNA, 20 bp, human
gaggccgagttccagagcat

SEQ ID NO: 181390 - DNA, 20 bp, human
gcaaccgagaccccatgctc

SEQ ID NO: 181391 - DNA, 20 bp, human
gggggcacctcaaacaaggt

SEQ ID NO: 181392 - DNA, 20 bp, human
gggaactcggcctcaacctt

SEQ ID NO: 181393 - DNA, 20 bp, human
gccgggaggcgcagtgatat

SEQ ID NO: 181394 - DNA, 20 bp, human
gggtgggggcacctcaaaca

SEQ ID NO: 181395 - DNA, 20 bp, human
gggaaacggagcagccacgt

SEQ ID NO: 181396 - DNA, 20 bp, human
gtgacagagttcagcatgaa

SEQ ID NO: 181397 - DNA, 20 bp, human
gtttcagggtggaaaacaca

SEQ ID NO: 181398 - DNA, 20 bp, human
gccacaacattctttcaggg

SEQ ID NO: 181399 - DNA, 20 bp, human
gtgttgtggcttgaaagttg

SEQ ID NO: 181400 - DNA, 20 bp, human
ggtaatgcaactcaaactaa

SEQ ID NO: 181401 - DNA, 20 bp, human
ggcagccacaacattctttc

SEQ ID NO: 181402 - DNA, 20 bp, human
gcttagtatcagaacagctc

SEQ ID NO: 181403 - DNA, 20 bp, human
gaatttcaaggctacatacc

SEQ ID NO: 181404 - DNA, 20 bp, human
gatgctgaactctgtcaacc

SEQ ID NO: 181405 - DNA, 20 bp, human
ggatttttcagactctgttt

SEQ ID NO: 181406 - DNA, 20 bp, human
gcccgccggctgaccctgac

SEQ ID NO: 181407 - DNA, 20 bp, human
ggaccacccagggggcccgc

SEQ ID NO: 181408 - DNA, 20 bp, human
gtctacagcggaggtggctg

SEQ ID NO: 181409 - DNA, 20 bp, human
gcgcctcttccgctctacag

SEQ ID NO: 181410 - DNA, 20 bp, human
gtccgcgagatcgaggtgag

SEQ ID NO: 181411 - DNA, 20 bp, human
gctccgctgtagagcggaag

SEQ ID NO: 181412 - DNA, 20 bp, human
gcgctgggaaagaagtggag

SEQ ID NO: 181413 - DNA, 20 bp, human
gagaagtggagtgggcgcgt

SEQ ID NO: 181414 - DNA, 20 bp, human
gggagttggcgttgctcggg

SEQ ID NO: 181415 - DNA, 20 bp, human
gccgtgccagccgtaaggat

SEQ ID NO: 181416 - DNA, 20 bp, human
gggcccgcgcagaagaagag

SEQ ID NO: 181417 - DNA, 20 bp, human
ggtttcccgccagctcaggt

SEQ ID NO: 181418 - DNA, 20 bp, human
gctaaactcacctgtgacgg

SEQ ID NO: 181419 - DNA, 20 bp, human
gagctggagtacgactatac

SEQ ID NO: 181420 - DNA, 20 bp, human
gacgactatacaggcgaccc

SEQ ID NO: 181421 - DNA, 20 bp, human
gcctgtgacggaggcagagg

SEQ ID NO: 181422 - DNA, 20 bp, human
gcgacccgcgagcagtcccc

SEQ ID NO: 181423 - DNA, 20 bp, human
gggtgtgggcactgctcgta

SEQ ID NO: 181424 - DNA, 20 bp, human
ggtaccaggcgcacgagcag

SEQ ID NO: 181425 - DNA, 20 bp, human
gatacaggcgacccgggcac

SEQ ID NO: 181426 - DNA, 20 bp, human
gggatgtcccagcaacaaaa

SEQ ID NO: 181427 - DNA, 20 bp, human
gaatagctctacagtaacaa

SEQ ID NO: 181428 - DNA, 20 bp, human
gggtgggactagagtcaacc

SEQ ID NO: 181429 - DNA, 20 bp, human
ggttgctgggacatccatac

SEQ ID NO: 181430 - DNA, 20 bp, human
gttcgacacagctaaagagg

SEQ ID NO: 181431 - DNA, 20 bp, human
gttgcgggttgcaggagttc

SEQ ID NO: 181432 - DNA, 20 bp, human
gacaggctgcaggcagttgc

SEQ ID NO: 181433 - DNA, 20 bp, human
gtccaaggtaggcattgaga

SEQ ID NO: 181434 - DNA, 20 bp, human
ggttactgtagagctattcc

SEQ ID NO: 181435 - DNA, 20 bp, human
ggacacagctaaagaggggg

SEQ ID NO: 181436 - DNA, 20 bp, human
gggcaataacctggagccgg

SEQ ID NO: 181437 - DNA, 20 bp, human
gagttccggcagggtgcatc

SEQ ID NO: 181438 - DNA, 20 bp, human
gtccagaaagacgggagcga

SEQ ID NO: 181439 - DNA, 20 bp, human
ggagcgaaggtggagcttcg

SEQ ID NO: 181440 - DNA, 20 bp, human
ggaactctgagcctccacca

SEQ ID NO: 181441 - DNA, 20 bp, human
ggtgcgagggcagggtagtc

SEQ ID NO: 181442 - DNA, 20 bp, human
gtggagccggcggcgtaggt

SEQ ID NO: 181443 - DNA, 20 bp, human
gcgcaccgccgagatcaaag

SEQ ID NO: 181444 - DNA, 20 bp, human
ggaccccgaacggcccccaa

SEQ ID NO: 181445 - DNA, 20 bp, human
gggcgctgtggtaagtgcga

SEQ ID NO: 181446 - DNA, 20 bp, human
gcagttagcacagggagagc

SEQ ID NO: 181447 - DNA, 20 bp, human
gaggtgcaggcagttagcac

SEQ ID NO: 181448 - DNA, 20 bp, human
ggctagaatgacaaagggag

SEQ ID NO: 181449 - DNA, 20 bp, human
gagctggggggacgctgcgg

SEQ ID NO: 181450 - DNA, 20 bp, human
ggcctgcaccttggacagag

SEQ ID NO: 181451 - DNA, 20 bp, human
gtgcgcacccgctctgtcca

SEQ ID NO: 181452 - DNA, 20 bp, human
ggccactgaatgccagttgg

SEQ ID NO: 181453 - DNA, 20 bp, human
gaggcagctagaatgacaaa

SEQ ID NO: 181454 - DNA, 20 bp, human
gggatgccatggggtcgcca

SEQ ID NO: 181455 - DNA, 20 bp, human
gaaggatgcctacagtgaga

SEQ ID NO: 181456 - DNA, 20 bp, human
gggagcagctggagcgatcg

SEQ ID NO: 181457 - DNA, 20 bp, human
gcctcgggagcagctatgtg

SEQ ID NO: 181458 - DNA, 20 bp, human
ggcccctgcggagaagtccc

SEQ ID NO: 181459 - DNA, 20 bp, human
gggcgcagcatgactgccgt

SEQ ID NO: 181460 - DNA, 20 bp, human
ggcagtcatgctgcgcccgg

SEQ ID NO: 181461 - DNA, 20 bp, human
gcgctccagctgctccgctg

SEQ ID NO: 181462 - DNA, 20 bp, human
gccgtcggcgtgcaggtagc

SEQ ID NO: 181463 - DNA, 20 bp, human
gaaactgaccagtaagtcac

SEQ ID NO: 181464 - DNA, 20 bp, human
ggaggcaggcaggccccccg

SEQ ID NO: 181465 - DNA, 20 bp, human
gaaatgaggcgcgtctgggg

SEQ ID NO: 181466 - DNA, 20 bp, human
gcccaggacgatgaagctgg

SEQ ID NO: 181467 - DNA, 20 bp, human
ggcctgccgggtgccacccg

SEQ ID NO: 181468 - DNA, 20 bp, human
ggtcagagctgcaggaactt

SEQ ID NO: 181469 - DNA, 20 bp, human
gaggcaggcgctagaatcgt

SEQ ID NO: 181470 - DNA, 20 bp, human
gtgcgcgggtttagaggagg

SEQ ID NO: 181471 - DNA, 20 bp, human
ggcgtgcgcgggtttagagg

SEQ ID NO: 181472 - DNA, 20 bp, human
ggaggcgtgcgcgggtttag

SEQ ID NO: 181473 - DNA, 20 bp, human
ggctcgggggtcgcagagag

SEQ ID NO: 181474 - DNA, 20 bp, human
ggacgatgaagctgggggag

SEQ ID NO: 181475 - DNA, 20 bp, human
gaggattgcatcgtgggagt

SEQ ID NO: 181476 - DNA, 20 bp, human
gcgctcgcgcggtgaggagt

SEQ ID NO: 181477 - DNA, 20 bp, human
gaggctctagtactcctcaa

SEQ ID NO: 181478 - DNA, 20 bp, human
ggcgcggtgaggagtaggag

SEQ ID NO: 181479 - DNA, 20 bp, human
ggtaggagagggcacagccg

SEQ ID NO: 181480 - DNA, 20 bp, human
gctctagtactcctcaaagg

SEQ ID NO: 181481 - DNA, 20 bp, human
gagatggggaaacagcgtgg

SEQ ID NO: 181482 - DNA, 20 bp, human
ggccctgctcgcccaggcta

SEQ ID NO: 181483 - DNA, 20 bp, human
ggcggcaaccgaagcagccg

SEQ ID NO: 181484 - DNA, 20 bp, human
gtccccgcgctcgcgcggtg

SEQ ID NO: 181485 - DNA, 20 bp, human
ggacttactgagtgcagatg

SEQ ID NO: 181486 - DNA, 20 bp, human
gtccgcggtaatggaggcta

SEQ ID NO: 181487 - DNA, 20 bp, human
gactggtccctaagagaagt

SEQ ID NO: 181488 - DNA, 20 bp, human
ggaggtgagagtatgcggtg

SEQ ID NO: 181489 - DNA, 20 bp, human
ggtgctgaagtatcaggctc

SEQ ID NO: 181490 - DNA, 20 bp, human
gcagactggaccccaggtaa

SEQ ID NO: 181491 - DNA, 20 bp, human
gtccctagcctccattaccg

SEQ ID NO: 181492 - DNA, 20 bp, human
ggggcggggtccctagaaag

SEQ ID NO: 181493 - DNA, 20 bp, human
ggtgagagtatgcggtgtgg

SEQ ID NO: 181494 - DNA, 20 bp, human
gtcgcggctggggcagaccg

SEQ ID NO: 181495 - DNA, 20 bp, human
ggagggagttcccttacctg

SEQ ID NO: 181496 - DNA, 20 bp, human
ggctcctgcgggcaatatgt

SEQ ID NO: 181497 - DNA, 20 bp, human
gcgctaagggtggagattct

SEQ ID NO: 181498 - DNA, 20 bp, human
gcctgcgggcaatatgtcgg

SEQ ID NO: 181499 - DNA, 20 bp, human
gaatatgtcggaggcgacgg

SEQ ID NO: 181500 - DNA, 20 bp, human
ggtggcttcagcgctaaggg

SEQ ID NO: 181501 - DNA, 20 bp, human
gtcgtcggggctagaaaggg

SEQ ID NO: 181502 - DNA, 20 bp, human
gggcgaagcggagagcaccg

SEQ ID NO: 181503 - DNA, 20 bp, human
gatattgcccgcaggagctg

SEQ ID NO: 181504 - DNA, 20 bp, human
gggagcgcgcggctgatacc

SEQ ID NO: 181505 - DNA, 20 bp, human
gggcaatatgtcggaggcga

SEQ ID NO: 181506 - DNA, 20 bp, human
ggtggtccttcagcttgtct

SEQ ID NO: 181507 - DNA, 20 bp, human
gcagcttgtctgggcagcaa

SEQ ID NO: 181508 - DNA, 20 bp, human
ggagctctgtgtagactatg

SEQ ID NO: 181509 - DNA, 20 bp, human
ggaacctaacagcttaggag

SEQ ID NO: 181510 - DNA, 20 bp, human
gccacaggtaatgggacatg

SEQ ID NO: 181511 - DNA, 20 bp, human
gttaggttccataacagtga

SEQ ID NO: 181512 - DNA, 20 bp, human
ggtgccttcagagatctagc

SEQ ID NO: 181513 - DNA, 20 bp, human
gacctaccatggccaagtat

SEQ ID NO: 181514 - DNA, 20 bp, human
gcaccaccatcagtgactac

SEQ ID NO: 181515 - DNA, 20 bp, human
gcctcccctgaagtagagac

SEQ ID NO: 181516 - DNA, 20 bp, human
gcgtggcgggaatccgggtt

SEQ ID NO: 181517 - DNA, 20 bp, human
gggcaaatccacccaaccaa

SEQ ID NO: 181518 - DNA, 20 bp, human
gccgagaagcgggcgcatgt

SEQ ID NO: 181519 - DNA, 20 bp, human
gggagtgcaagtgagcttct

SEQ ID NO: 181520 - DNA, 20 bp, human
gggcctgactgggacctgtg

SEQ ID NO: 181521 - DNA, 20 bp, human
gctcggacagaagggtggat

SEQ ID NO: 181522 - DNA, 20 bp, human
ggcagccggcgaagaccaga

SEQ ID NO: 181523 - DNA, 20 bp, human
gagactgggctccaccgagg

SEQ ID NO: 181524 - DNA, 20 bp, human
gcgggttcgggtcagaggaa

SEQ ID NO: 181525 - DNA, 20 bp, human
ggcatgtcggctccgcaccc

SEQ ID NO: 181526 - DNA, 20 bp, human
ggcgggagcagagaccgtgg

SEQ ID NO: 181527 - DNA, 20 bp, human
gcgctgggctgaggtcgtct

SEQ ID NO: 181528 - DNA, 20 bp, human
gccacggctagagccacttc

SEQ ID NO: 181529 - DNA, 20 bp, human
gcgcgactctccgagaatag

SEQ ID NO: 181530 - DNA, 20 bp, human
gggaggttgcagtactcgct

SEQ ID NO: 181531 - DNA, 20 bp, human
gtagcctgtggtgggcgctg

SEQ ID NO: 181532 - DNA, 20 bp, human
ggaggtcgtctcgggtgagg

SEQ ID NO: 181533 - DNA, 20 bp, human
ggctgaggtcgtctcgggtg

SEQ ID NO: 181534 - DNA, 20 bp, human
ggactctccgagaatagcgg

SEQ ID NO: 181535 - DNA, 20 bp, human
gttactacgccgaagcgcca

SEQ ID NO: 181536 - DNA, 20 bp, human
ggcggcgctgcggtcagctg

SEQ ID NO: 181537 - DNA, 20 bp, human
ggggccccggcgggacagac

SEQ ID NO: 181538 - DNA, 20 bp, human
gtaccacctacactggacga

SEQ ID NO: 181539 - DNA, 20 bp, human
gacggtgtcagcaggcaaca

SEQ ID NO: 181540 - DNA, 20 bp, human
ggggtacgcggtcgcggaca

SEQ ID NO: 181541 - DNA, 20 bp, human
ggagggtttggcgtgattag

SEQ ID NO: 181542 - DNA, 20 bp, human
gagcaggcaacatggccgag

SEQ ID NO: 181543 - DNA, 20 bp, human
ggaattccgcgggggtgtca

SEQ ID NO: 181544 - DNA, 20 bp, human
gtctacgacgtgggagggag

SEQ ID NO: 181545 - DNA, 20 bp, human
gcggacacggcgccgcccgg

SEQ ID NO: 181546 - DNA, 20 bp, human
gtcctggaaactatacggtc

SEQ ID NO: 181547 - DNA, 20 bp, human
gcgcctcgcgctgttcagct

SEQ ID NO: 181548 - DNA, 20 bp, human
gctggacgcgacctcagaga

SEQ ID NO: 181549 - DNA, 20 bp, human
gagcgagccgggtcccacca

SEQ ID NO: 181550 - DNA, 20 bp, human
gagggccccaaggtacagga

SEQ ID NO: 181551 - DNA, 20 bp, human
gtaggaagtgggctgacgac

SEQ ID NO: 181552 - DNA, 20 bp, human
gcgctgttcagctaggaagt

SEQ ID NO: 181553 - DNA, 20 bp, human
gcaggccgcgagatgagcag

SEQ ID NO: 181554 - DNA, 20 bp, human
gtcacattcgcggccatggt

SEQ ID NO: 181555 - DNA, 20 bp, human
ggagagggcgccagtccctt

SEQ ID NO: 181556 - DNA, 20 bp, human
gggccgagcgcaccgaccgc

SEQ ID NO: 181557 - DNA, 20 bp, human
gctccctctcggaaacctag

SEQ ID NO: 181558 - DNA, 20 bp, human
gcggaacggaacccagagaa

SEQ ID NO: 181559 - DNA, 20 bp, human
ggctcagtaataggatccaa

SEQ ID NO: 181560 - DNA, 20 bp, human
gcaccgaccgcgggcagaga

SEQ ID NO: 181561 - DNA, 20 bp, human
gtgggctgtgagccaaaggg

SEQ ID NO: 181562 - DNA, 20 bp, human
gggaggaggcgcagatccac

SEQ ID NO: 181563 - DNA, 20 bp, human
ggaaggagatgcagacgcgg

SEQ ID NO: 181564 - DNA, 20 bp, human
gcctcctctaggtttccgag

SEQ ID NO: 181565 - DNA, 20 bp, human
gtcccacgcacagggaagct

SEQ ID NO: 181566 - DNA, 20 bp, human
ggcgagaaggagaggacgtg

SEQ ID NO: 181567 - DNA, 20 bp, human
gggacgtgctcggctgacgt

SEQ ID NO: 181568 - DNA, 20 bp, human
gacggaagagaagggagcga

SEQ ID NO: 181569 - DNA, 20 bp, human
gttagtgaaacggaagagaa

SEQ ID NO: 181570 - DNA, 20 bp, human
gctgacgtcggcccgcgagg

SEQ ID NO: 181571 - DNA, 20 bp, human
gaataagtggcgagaaggag

SEQ ID NO: 181572 - DNA, 20 bp, human
gagctgtgcggcctcctcgc

SEQ ID NO: 181573 - DNA, 20 bp, human
gccagcttaaaatcagacag

SEQ ID NO: 181574 - DNA, 20 bp, human
gcccttgatgaagagaaagc

SEQ ID NO: 181575 - DNA, 20 bp, human
gacgtctcgcattgggtggg

SEQ ID NO: 181576 - DNA, 20 bp, human
gagccagatggcatccccgg

SEQ ID NO: 181577 - DNA, 20 bp, human
gttcccctcaccgggcaacg

SEQ ID NO: 181578 - DNA, 20 bp, human
gcccgcagggggctcgaacc

SEQ ID NO: 181579 - DNA, 20 bp, human
gtgccgcgttgcccggtgag

SEQ ID NO: 181580 - DNA, 20 bp, human
ggggggctcgaacctggagg

SEQ ID NO: 181581 - DNA, 20 bp, human
gaggggtgaaggctgcgcta

SEQ ID NO: 181582 - DNA, 20 bp, human
ggtgaaggctgcgctagggg

SEQ ID NO: 181583 - DNA, 20 bp, human
gtgtcgcggaagcccagctg

SEQ ID NO: 181584 - DNA, 20 bp, human
gggagggctcgaagggagag

SEQ ID NO: 181585 - DNA, 20 bp, human
gaggaggttccgactcgcag

SEQ ID NO: 181586 - DNA, 20 bp, human
gcgacagcggcgcccaggaa

SEQ ID NO: 181587 - DNA, 20 bp, human
gccggccgggtgtgggtcgt

SEQ ID NO: 181588 - DNA, 20 bp, human
ggcggcggggcggacgacag

SEQ ID NO: 181589 - DNA, 20 bp, human
ggcccgccgaagccattcct

SEQ ID NO: 181590 - DNA, 20 bp, human
ggctgccgacgacccacacc

SEQ ID NO: 181591 - DNA, 20 bp, human
gagcccgaccagcttcaagg

SEQ ID NO: 181592 - DNA, 20 bp, human
ggggagccggacctcccgaa

SEQ ID NO: 181593 - DNA, 20 bp, human
gtggcgctgtgtctggacct

SEQ ID NO: 181594 - DNA, 20 bp, human
gcgcctggcgtcctcgcctg

SEQ ID NO: 181595 - DNA, 20 bp, human
gcgccgcaggcgaggacgcc

SEQ ID NO: 181596 - DNA, 20 bp, human
gagagaatccgcgacaccgg

SEQ ID NO: 181597 - DNA, 20 bp, human
gtggctcgagaggctgtagg

SEQ ID NO: 181598 - DNA, 20 bp, human
gcctgactggaagcccgagt

SEQ ID NO: 181599 - DNA, 20 bp, human
gctttccgcccgctccatgg

SEQ ID NO: 181600 - DNA, 20 bp, human
ggaaagagaatccgcgacac

SEQ ID NO: 181601 - DNA, 20 bp, human
gtcggacgccgccggtgtcg

SEQ ID NO: 181602 - DNA, 20 bp, human
gacgcggccgaggtaggact

SEQ ID NO: 181603 - DNA, 20 bp, human
gcgcccgaagaagacgtggt

SEQ ID NO: 181604 - DNA, 20 bp, human
gcgtcagccgcatcccactc

SEQ ID NO: 181605 - DNA, 20 bp, human
gtgagatctgggtaagaatg

SEQ ID NO: 181606 - DNA, 20 bp, human
ggcgccgccggacccaggag

SEQ ID NO: 181607 - DNA, 20 bp, human
ggctgcatccgggtgtctgg

SEQ ID NO: 181608 - DNA, 20 bp, human
gctgtgaagtgggggatcgg

SEQ ID NO: 181609 - DNA, 20 bp, human
gcaagccgaagccccgagaa

SEQ ID NO: 181610 - DNA, 20 bp, human
gactgctgcatccgggtgtc

SEQ ID NO: 181611 - DNA, 20 bp, human
gggagaggagaggtccgcgg

SEQ ID NO: 181612 - DNA, 20 bp, human
gccaggagaggagaggtccg

SEQ ID NO: 181613 - DNA, 20 bp, human
gcggccagctccctcagcga

SEQ ID NO: 181614 - DNA, 20 bp, human
gccggaaccactgcacgacg

SEQ ID NO: 181615 - DNA, 20 bp, human
gcgcgactgagccgggtgga

SEQ ID NO: 181616 - DNA, 20 bp, human
gcgccgcgcgagaaggtgaa

SEQ ID NO: 181617 - DNA, 20 bp, human
gctgcgcgcgcgcctgaagt

SEQ ID NO: 181618 - DNA, 20 bp, human
gccccaggaacgcaacctga

SEQ ID NO: 181619 - DNA, 20 bp, human
gacccgcaagcagcccgggg

SEQ ID NO: 181620 - DNA, 20 bp, human
ggaaggtgaaaggcacgaga

SEQ ID NO: 181621 - DNA, 20 bp, human
gcaaccctgccggcgtcccg

SEQ ID NO: 181622 - DNA, 20 bp, human
ggccggacagggcccgacga

SEQ ID NO: 181623 - DNA, 20 bp, human
ggcgacccgcaagcagcccg

SEQ ID NO: 181624 - DNA, 20 bp, human
ggcgccggagacccacagac

SEQ ID NO: 181625 - DNA, 20 bp, human
gcagaaggccgggccggaca

SEQ ID NO: 181626 - DNA, 20 bp, human
gagccgagggaacgcagtgg

SEQ ID NO: 181627 - DNA, 20 bp, human
gcctctcagggaccgggttg

SEQ ID NO: 181628 - DNA, 20 bp, human
gcggcggctgagactcaccc

SEQ ID NO: 181629 - DNA, 20 bp, human
ggcttcctgcgtccccaacc

SEQ ID NO: 181630 - DNA, 20 bp, human
ggagggcgcactgccctctc

SEQ ID NO: 181631 - DNA, 20 bp, human
gcggctgagactcacccggg

SEQ ID NO: 181632 - DNA, 20 bp, human
gctgagactcacccgggagg

SEQ ID NO: 181633 - DNA, 20 bp, human
gagcgcgccgcgggaagcag

SEQ ID NO: 181634 - DNA, 20 bp, human
gccccttacacggccctgtg

SEQ ID NO: 181635 - DNA, 20 bp, human
gctggccaggcgcggtgccc

SEQ ID NO: 181636 - DNA, 20 bp, human
gtggacgctcacccaagaag

SEQ ID NO: 181637 - DNA, 20 bp, human
gtccgagagaggtcaggccg

SEQ ID NO: 181638 - DNA, 20 bp, human
gaggccggggtccccttctt

SEQ ID NO: 181639 - DNA, 20 bp, human
ggcgcgcgggcaatggatgg

SEQ ID NO: 181640 - DNA, 20 bp, human
gccgagggcagatctccaag

SEQ ID NO: 181641 - DNA, 20 bp, human
ggcgcgcaagaacccggaat

SEQ ID NO: 181642 - DNA, 20 bp, human
ggggagtgcaaacccgaagt

SEQ ID NO: 181643 - DNA, 20 bp, human
gttgaattccgagagaggtc

SEQ ID NO: 181644 - DNA, 20 bp, human
gagggcagatctccaagggg

SEQ ID NO: 181645 - DNA, 20 bp, human
gcgggagcctgccctgctga

SEQ ID NO: 181646 - DNA, 20 bp, human
gacgccgcccgacccacctg

SEQ ID NO: 181647 - DNA, 20 bp, human
ggagcagcctgtggcacgtg

SEQ ID NO: 181648 - DNA, 20 bp, human
gagcagccgcagtccgcggg

SEQ ID NO: 181649 - DNA, 20 bp, human
gcgtgcgtccgacggttctg

SEQ ID NO: 181650 - DNA, 20 bp, human
ggactgggcgacagcggagg

SEQ ID NO: 181651 - DNA, 20 bp, human
gcccgacttactggtccgag

SEQ ID NO: 181652 - DNA, 20 bp, human
gaggttggagcaaagcccgg

SEQ ID NO: 181653 - DNA, 20 bp, human
ggaggcggcctggtgaggta

SEQ ID NO: 181654 - DNA, 20 bp, human
ggcgccacctgtggggacaa

SEQ ID NO: 181655 - DNA, 20 bp, human
gctggccccgccctatgggg

SEQ ID NO: 181656 - DNA, 20 bp, human
gtaggtcaagaagtaaaata

SEQ ID NO: 181657 - DNA, 20 bp, human
gcgctggagtactctggtga

SEQ ID NO: 181658 - DNA, 20 bp, human
gaacagccagagcgagtagg

SEQ ID NO: 181659 - DNA, 20 bp, human
gaataacagccagagcgagt

SEQ ID NO: 181660 - DNA, 20 bp, human
gctccagcgtgactgttgca

SEQ ID NO: 181661 - DNA, 20 bp, human
gcaccctgcaacagtcacgc

SEQ ID NO: 181662 - DNA, 20 bp, human
gtggctttgaggatggtcaa

SEQ ID NO: 181663 - DNA, 20 bp, human
gtgtctcctcctactcgctc

SEQ ID NO: 181664 - DNA, 20 bp, human
gcaaaaggaagtaaatgtgg

SEQ ID NO: 181665 - DNA, 20 bp, human
gctctggctgttattttcta

SEQ ID NO: 181666 - DNA, 20 bp, human
ggccagggaggaacactctg

SEQ ID NO: 181667 - DNA, 20 bp, human
gggacctgagcaccccggac

SEQ ID NO: 181668 - DNA, 20 bp, human
gcccaggaggcgcccgggtg

SEQ ID NO: 181669 - DNA, 20 bp, human
gggcatggacctgagcaccc

SEQ ID NO: 181670 - DNA, 20 bp, human
gggtgcgcaagcgggagttc

SEQ ID NO: 181671 - DNA, 20 bp, human
gcctgccagaccctatgagg

SEQ ID NO: 181672 - DNA, 20 bp, human
gccaagcgagcagctgactc

SEQ ID NO: 181673 - DNA, 20 bp, human
ggcgcacccgtgcctcaccc

SEQ ID NO: 181674 - DNA, 20 bp, human
gcgcaagcgggagttccggc

SEQ ID NO: 181675 - DNA, 20 bp, human
gcagagcacgggtctccagc

SEQ ID NO: 181676 - DNA, 20 bp, human
gccgcaggaaaggcaagaga

SEQ ID NO: 181677 - DNA, 20 bp, human
gcgggctccgggcgggaagt

SEQ ID NO: 181678 - DNA, 20 bp, human
gcggcctcgtagtaagttag

SEQ ID NO: 181679 - DNA, 20 bp, human
gtcgtgcgcctccgcaggaa

SEQ ID NO: 181680 - DNA, 20 bp, human
ggaaaggcaagagagggcga

SEQ ID NO: 181681 - DNA, 20 bp, human
gccgaggcgcagacacatgt

SEQ ID NO: 181682 - DNA, 20 bp, human
gggagccgcgctgaagccgg

SEQ ID NO: 181683 - DNA, 20 bp, human
gtgcgggtgtcttctcgatg

SEQ ID NO: 181684 - DNA, 20 bp, human
gggagccccttgtaagggtg

SEQ ID NO: 181685 - DNA, 20 bp, human
gctcagtgctccgctcctgt

SEQ ID NO: 181686 - DNA, 20 bp, human
gtgcggcctcggcggagtgg

SEQ ID NO: 181687 - DNA, 20 bp, human
gaccctgcggagaagctatc

SEQ ID NO: 181688 - DNA, 20 bp, human
gtcccgggccctcccggagg

SEQ ID NO: 181689 - DNA, 20 bp, human
gccatcagcagccatgactg

SEQ ID NO: 181690 - DNA, 20 bp, human
gggttgcggcctcggcggag

SEQ ID NO: 181691 - DNA, 20 bp, human
gagtgggatgctgacagcag

SEQ ID NO: 181692 - DNA, 20 bp, human
gagtagccaccactccgccg

SEQ ID NO: 181693 - DNA, 20 bp, human
ggaaagcagccccagaggta

SEQ ID NO: 181694 - DNA, 20 bp, human
ggggcccgggatgtgtcaca

SEQ ID NO: 181695 - DNA, 20 bp, human
gtgcggagaagctatcaggc

SEQ ID NO: 181696 - DNA, 20 bp, human
gcgccctggggacccggtag

SEQ ID NO: 181697 - DNA, 20 bp, human
gcgcgaccacagcctaggga

SEQ ID NO: 181698 - DNA, 20 bp, human
gccacagcctagggacggaa

SEQ ID NO: 181699 - DNA, 20 bp, human
gggaagcctcgcccagtcac

SEQ ID NO: 181700 - DNA, 20 bp, human
gtaatcgcgaccacagccta

SEQ ID NO: 181701 - DNA, 20 bp, human
gcggcgacggcagaggcgaa

SEQ ID NO: 181702 - DNA, 20 bp, human
gctgtggtcgcgattacgga

SEQ ID NO: 181703 - DNA, 20 bp, human
gcctggggacccggtagcgg

SEQ ID NO: 181704 - DNA, 20 bp, human
gcccgccccggcttaccctg

SEQ ID NO: 181705 - DNA, 20 bp, human
gtcggagggcttctcataat

SEQ ID NO: 181706 - DNA, 20 bp, human
gcttggaggtgcagtcgcgg

SEQ ID NO: 181707 - DNA, 20 bp, human
gccgcttggaggtgcagtcg

SEQ ID NO: 181708 - DNA, 20 bp, human
gctccaggcgcaggagctct

SEQ ID NO: 181709 - DNA, 20 bp, human
gcctttaaggagcagctctg

SEQ ID NO: 181710 - DNA, 20 bp, human
gtaacccgagcccgcagtcc

SEQ ID NO: 181711 - DNA, 20 bp, human
gcgcccggtgagatgctcac

SEQ ID NO: 181712 - DNA, 20 bp, human
gtcgcgcccgcccggactgc

SEQ ID NO: 181713 - DNA, 20 bp, human
ggccgcggcacccctctccg

SEQ ID NO: 181714 - DNA, 20 bp, human
gtctcggccgcgctaggcca

SEQ ID NO: 181715 - DNA, 20 bp, human
gccgagcccgcagtccgggc

SEQ ID NO: 181716 - DNA, 20 bp, human
gcttggaggtgcagtcgcgg

SEQ ID NO: 181717 - DNA, 20 bp, human
gccgcttggaggtgcagtcg

SEQ ID NO: 181718 - DNA, 20 bp, human
gcgcccggtgagatgctcac

SEQ ID NO: 181719 - DNA, 20 bp, human
gtaacccgagcccgcagtcc

SEQ ID NO: 181720 - DNA, 20 bp, human
gtcgcgcccgcccggactgc

SEQ ID NO: 181721 - DNA, 20 bp, human
gcctttaaggagcagctctg

SEQ ID NO: 181722 - DNA, 20 bp, human
gctccaggcgcaggagctct

SEQ ID NO: 181723 - DNA, 20 bp, human
gccgagcccgcagtccgggc

SEQ ID NO: 181724 - DNA, 20 bp, human
ggccgcggcacccctctccg

SEQ ID NO: 181725 - DNA, 20 bp, human
gtcacctgtgccgggtcccg

SEQ ID NO: 181726 - DNA, 20 bp, human
gcatggagccagcacccggg

SEQ ID NO: 181727 - DNA, 20 bp, human
gtctgtgtgaccggcctcag

SEQ ID NO: 181728 - DNA, 20 bp, human
gggcctggactctacccctg

SEQ ID NO: 181729 - DNA, 20 bp, human
gcagctgaggtgagagacgg

SEQ ID NO: 181730 - DNA, 20 bp, human
ggggagggggtagcacgggg

SEQ ID NO: 181731 - DNA, 20 bp, human
ggcgggcccggcgcttccaa

SEQ ID NO: 181732 - DNA, 20 bp, human
gagcggaaccggatcaccga

SEQ ID NO: 181733 - DNA, 20 bp, human
gggcccggcgcttccaacgg

SEQ ID NO: 181734 - DNA, 20 bp, human
ggagccagcacccgggggga

SEQ ID NO: 181735 - DNA, 20 bp, human
ggctccgccgccccctaaag

SEQ ID NO: 181736 - DNA, 20 bp, human
gcagttgggtcctcacccag

SEQ ID NO: 181737 - DNA, 20 bp, human
gtcacccagaggctcccctt

SEQ ID NO: 181738 - DNA, 20 bp, human
gtgtcccccagcctatcaca

SEQ ID NO: 181739 - DNA, 20 bp, human
ggcgccgaaggggagcctct

SEQ ID NO: 181740 - DNA, 20 bp, human
gcccttgcacacctacccta

SEQ ID NO: 181741 - DNA, 20 bp, human
gagcggcgggagccccagtt

SEQ ID NO: 181742 - DNA, 20 bp, human
ggcacacctaccctaaggta

SEQ ID NO: 181743 - DNA, 20 bp, human
gtggggtgcaggcaggatta

SEQ ID NO: 181744 - DNA, 20 bp, human
gacgggccctaccttagggt

SEQ ID NO: 181745 - DNA, 20 bp, human
gtcctgcactaccctgtgat

SEQ ID NO: 181746 - DNA, 20 bp, human
gtggccgggcggaacgcggg

SEQ ID NO: 181747 - DNA, 20 bp, human
gggacgcgggatctctccga

SEQ ID NO: 181748 - DNA, 20 bp, human
ggatctctccagtagttgac

SEQ ID NO: 181749 - DNA, 20 bp, human
gtcaggcctgagggagctgg

SEQ ID NO: 181750 - DNA, 20 bp, human
ggccatggccgggcggaacg

SEQ ID NO: 181751 - DNA, 20 bp, human
gccaagcactcccccatcag

SEQ ID NO: 181752 - DNA, 20 bp, human
ggggatctctccgaaggagg

SEQ ID NO: 181753 - DNA, 20 bp, human
ggcacgcgcctcacctgcga

SEQ ID NO: 181754 - DNA, 20 bp, human
gaccccagcccgtcaactac

SEQ ID NO: 181755 - DNA, 20 bp, human
gtgcgtgtccccgagctggg

SEQ ID NO: 181756 - DNA, 20 bp, human
gccgcctcctcaaacgactg

SEQ ID NO: 181757 - DNA, 20 bp, human
gggcgccgcgagccgactgt

SEQ ID NO: 181758 - DNA, 20 bp, human
gctaccgcagtcgtttgagg

SEQ ID NO: 181759 - DNA, 20 bp, human
gcgggacgctcccctttcat

SEQ ID NO: 181760 - DNA, 20 bp, human
ggagcgtcctgaagttccag

SEQ ID NO: 181761 - DNA, 20 bp, human
gcggcgtacggtgcgggcta

SEQ ID NO: 181762 - DNA, 20 bp, human
ggagaaccagccccggatgt

SEQ ID NO: 181763 - DNA, 20 bp, human
ggggcttacagcccatgaaa

SEQ ID NO: 181764 - DNA, 20 bp, human
gggtctcctgatgcttccgt

SEQ ID NO: 181765 - DNA, 20 bp, human
gttctgcaaacaccgacagt

SEQ ID NO: 181766 - DNA, 20 bp, human
ggagctgcccgaggacgcgg

SEQ ID NO: 181767 - DNA, 20 bp, human
ggcgggcgtcaccaccggag

SEQ ID NO: 181768 - DNA, 20 bp, human
gcgatggccctgccccaggt

SEQ ID NO: 181769 - DNA, 20 bp, human
gctggggcagggccatcggg

SEQ ID NO: 181770 - DNA, 20 bp, human
ggcaaggtcgacgacagaag

SEQ ID NO: 181771 - DNA, 20 bp, human
gacctctcctccgcgtcctc

SEQ ID NO: 181772 - DNA, 20 bp, human
ggtggggcgggcgtcaccac

SEQ ID NO: 181773 - DNA, 20 bp, human
ggggctctgaggctgccgtg

SEQ ID NO: 181774 - DNA, 20 bp, human
gaggggctgagtgcccgtaa

SEQ ID NO: 181775 - DNA, 20 bp, human
gcaggaggcgcgggtgttag

SEQ ID NO: 181776 - DNA, 20 bp, human
gcacttgcgcggccagagag

SEQ ID NO: 181777 - DNA, 20 bp, human
gcgggaggcaggtgcagatc

SEQ ID NO: 181778 - DNA, 20 bp, human
gtctggccgcgcaagtgact

SEQ ID NO: 181779 - DNA, 20 bp, human
gtcctgcgcgggatcagcga

SEQ ID NO: 181780 - DNA, 20 bp, human
ggtgctgggcggcggctgac

SEQ ID NO: 181781 - DNA, 20 bp, human
ggcagtgctggctctcaggg

SEQ ID NO: 181782 - DNA, 20 bp, human
ggtgcagatcgggcaccgtg

SEQ ID NO: 181783 - DNA, 20 bp, human
ggagacagcaacatcttctg

SEQ ID NO: 181784 - DNA, 20 bp, human
ggaggccgcaccctgcgcca

SEQ ID NO: 181785 - DNA, 20 bp, human
ggccctgcgacaatagagtc

SEQ ID NO: 181786 - DNA, 20 bp, human
gctgtcccctgtacctgcgg

SEQ ID NO: 181787 - DNA, 20 bp, human
gcccagcccggcctcgtata

SEQ ID NO: 181788 - DNA, 20 bp, human
gcccctgtcccctgtacctg

SEQ ID NO: 181789 - DNA, 20 bp, human
ggctcctcggaccctatacg

SEQ ID NO: 181790 - DNA, 20 bp, human
ggcgcacgtcccgggaaagg

SEQ ID NO: 181791 - DNA, 20 bp, human
gcacccaggaacagcccgag

SEQ ID NO: 181792 - DNA, 20 bp, human
gtcccctgtacctgcggcgg

SEQ ID NO: 181793 - DNA, 20 bp, human
gcctcctcaggactccgcca

SEQ ID NO: 181794 - DNA, 20 bp, human
gggcgggacccagcagcgcg

SEQ ID NO: 181795 - DNA, 20 bp, human
gcctgcggcggcggcgtgtc

SEQ ID NO: 181796 - DNA, 20 bp, human
gtggctctgccagcactggt

SEQ ID NO: 181797 - DNA, 20 bp, human
gaggacaaggcagacgttca

SEQ ID NO: 181798 - DNA, 20 bp, human
gccatttccggagcagaaag

SEQ ID NO: 181799 - DNA, 20 bp, human
gacagtggggatgccaccaa

SEQ ID NO: 181800 - DNA, 20 bp, human
gccctggagcacaggacaac

SEQ ID NO: 181801 - DNA, 20 bp, human
gtgcaggttcccaccagtgc

SEQ ID NO: 181802 - DNA, 20 bp, human
gctggagctgtggcagtcca

SEQ ID NO: 181803 - DNA, 20 bp, human
gcctttggctctgccagcac

SEQ ID NO: 181804 - DNA, 20 bp, human
ggtctatgagcaggacagtg

SEQ ID NO: 181805 - DNA, 20 bp, human
gtcatcgcgcctgtcttccc

SEQ ID NO: 181806 - DNA, 20 bp, human
gcacctctgggtcccgcagg

SEQ ID NO: 181807 - DNA, 20 bp, human
gcccgcaggaggttgaaggg

SEQ ID NO: 181808 - DNA, 20 bp, human
gggagaagagtggcactcgg

SEQ ID NO: 181809 - DNA, 20 bp, human
gcggccgcggcagtgtatgg

SEQ ID NO: 181810 - DNA, 20 bp, human
gggtcccgcaggaggttgaa

SEQ ID NO: 181811 - DNA, 20 bp, human
gagccccggggagatcccaa

SEQ ID NO: 181812 - DNA, 20 bp, human
gcggggagatcccaaagggt

SEQ ID NO: 181813 - DNA, 20 bp, human
gccaggcgcagactcggctc

SEQ ID NO: 181814 - DNA, 20 bp, human
gaacctcctgcgggacccag

SEQ ID NO: 181815 - DNA, 20 bp, human
gggggacgcgcacctgcacc

SEQ ID NO: 181816 - DNA, 20 bp, human
gagagccccggggaatccct

SEQ ID NO: 181817 - DNA, 20 bp, human
gcccacccagggattccccg

SEQ ID NO: 181818 - DNA, 20 bp, human
gaagccacgccctcccgggt

SEQ ID NO: 181819 - DNA, 20 bp, human
gggtgctgaggacgcaaatg

SEQ ID NO: 181820 - DNA, 20 bp, human
ggctcaggccaccctttcct

SEQ ID NO: 181821 - DNA, 20 bp, human
gctgagaccttgcattggga

SEQ ID NO: 181822 - DNA, 20 bp, human
gcactgggttgggggaacgg

SEQ ID NO: 181823 - DNA, 20 bp, human
gctggtcgggccgggaagaa

SEQ ID NO: 181824 - DNA, 20 bp, human
gctagcttgtacccaggaaa

SEQ ID NO: 181825 - DNA, 20 bp, human
gtagtagaccggtcttcact

SEQ ID NO: 181826 - DNA, 20 bp, human
gtagaagggcgcggagtcag

SEQ ID NO: 181827 - DNA, 20 bp, human
gctgcgtccgctcagagggt

SEQ ID NO: 181828 - DNA, 20 bp, human
gggaccgtggcgctccagat

SEQ ID NO: 181829 - DNA, 20 bp, human
gtgggagacggcccgtagaa

SEQ ID NO: 181830 - DNA, 20 bp, human
ggtgggctccgtgggtgctg

SEQ ID NO: 181831 - DNA, 20 bp, human
gaagggcgcggagtcagcgg

SEQ ID NO: 181832 - DNA, 20 bp, human
ggcgaaccgggcgccatgaa

SEQ ID NO: 181833 - DNA, 20 bp, human
gcgggcggccccgggagtgg

SEQ ID NO: 181834 - DNA, 20 bp, human
gcgaagcctcgggcggaccg

SEQ ID NO: 181835 - DNA, 20 bp, human
ggagcgccacggtccgcccg

SEQ ID NO: 181836 - DNA, 20 bp, human
gccgccgccgctacccctag

SEQ ID NO: 181837 - DNA, 20 bp, human
gccctagcggcagcagaagt

SEQ ID NO: 181838 - DNA, 20 bp, human
ggcctggcaggaggacctcg

SEQ ID NO: 181839 - DNA, 20 bp, human
gctgctgccgctaggggtag

SEQ ID NO: 181840 - DNA, 20 bp, human
gtggcaggaggacctcgggg

SEQ ID NO: 181841 - DNA, 20 bp, human
gctgccgctaggggtagcgg

SEQ ID NO: 181842 - DNA, 20 bp, human
ggctgaggcgagaaggagct

SEQ ID NO: 181843 - DNA, 20 bp, human
ggaagtggggacggaacagg

SEQ ID NO: 181844 - DNA, 20 bp, human
gggacagcgcccggagaggg

SEQ ID NO: 181845 - DNA, 20 bp, human
gggcagcagaagtgggaacg

SEQ ID NO: 181846 - DNA, 20 bp, human
ggctacaccgctacccctgg

SEQ ID NO: 181847 - DNA, 20 bp, human
gacgcctacgggccgaacct

SEQ ID NO: 181848 - DNA, 20 bp, human
ggcagctacaccgctacccc

SEQ ID NO: 181849 - DNA, 20 bp, human
gccgcagcggcagtgacgta

SEQ ID NO: 181850 - DNA, 20 bp, human
ggggtagggactgctcgagt

SEQ ID NO: 181851 - DNA, 20 bp, human
gggcaaattccgggagtccg

SEQ ID NO: 181852 - DNA, 20 bp, human
gcctggcggcggcgaaggaa

SEQ ID NO: 181853 - DNA, 20 bp, human
gcgggctgccagacgcctac

SEQ ID NO: 181854 - DNA, 20 bp, human
gtagggactgctcgagtggg

SEQ ID NO: 181855 - DNA, 20 bp, human
gccagggtcgttccagccca

SEQ ID NO: 181856 - DNA, 20 bp, human
gtccttgtggagctaaccag

SEQ ID NO: 181857 - DNA, 20 bp, human
gcacggcccgggcggataag

SEQ ID NO: 181858 - DNA, 20 bp, human
gaccatggcgacgcgcggtg

SEQ ID NO: 181859 - DNA, 20 bp, human
ggcttccagcgtcggtacca

SEQ ID NO: 181860 - DNA, 20 bp, human
gccacaaggaacacacgaga

SEQ ID NO: 181861 - DNA, 20 bp, human
ggctgtgaggcttccagcgt

SEQ ID NO: 181862 - DNA, 20 bp, human
ggccccaccgcgcgtcgcca

SEQ ID NO: 181863 - DNA, 20 bp, human
gccgcaaaccgtcttacctc

SEQ ID NO: 181864 - DNA, 20 bp, human
gggcctgtaagaagcgaggg

SEQ ID NO: 181865 - DNA, 20 bp, human
gaggaacgcggtcacggccc

SEQ ID NO: 181866 - DNA, 20 bp, human
gagcctagaggcctctacag

SEQ ID NO: 181867 - DNA, 20 bp, human
gggcgacagaagctcttcgg

SEQ ID NO: 181868 - DNA, 20 bp, human
gggatcagtggccaaggggg

SEQ ID NO: 181869 - DNA, 20 bp, human
ggggggatcagtggccaagg

SEQ ID NO: 181870 - DNA, 20 bp, human
gaagctcttcgggggatcag

SEQ ID NO: 181871 - DNA, 20 bp, human
ggcgtctctagcctctgtag

SEQ ID NO: 181872 - DNA, 20 bp, human
ggctctcctttaccctagag

SEQ ID NO: 181873 - DNA, 20 bp, human
gagccactgggcaagcctag

SEQ ID NO: 181874 - DNA, 20 bp, human
ggaagagactggggattccg

SEQ ID NO: 181875 - DNA, 20 bp, human
gacgcacctcggataggcgg

SEQ ID NO: 181876 - DNA, 20 bp, human
gcagcccaggtccactggaa

SEQ ID NO: 181877 - DNA, 20 bp, human
gtggagacgcgggcactctc

SEQ ID NO: 181878 - DNA, 20 bp, human
gtggaaagcacgtgccacag

SEQ ID NO: 181879 - DNA, 20 bp, human
ggccggaagtgcctttccag

SEQ ID NO: 181880 - DNA, 20 bp, human
gacttcgctgtggctccatc

SEQ ID NO: 181881 - DNA, 20 bp, human
gttcagccctcaggaagtag

SEQ ID NO: 181882 - DNA, 20 bp, human
gtttatccatagacacggaa

SEQ ID NO: 181883 - DNA, 20 bp, human
gaacaacagcccaggtccac

SEQ ID NO: 181884 - DNA, 20 bp, human
gctggttgccagccattaca

SEQ ID NO: 181885 - DNA, 20 bp, human
gcacgtgctttccaactagt

SEQ ID NO: 181886 - DNA, 20 bp, human
gagtccacgactgcgagaca

SEQ ID NO: 181887 - DNA, 20 bp, human
gtcgacccggacgccggaga

SEQ ID NO: 181888 - DNA, 20 bp, human
ggcatcacgcgggtgacgag

SEQ ID NO: 181889 - DNA, 20 bp, human
gacttgtgcggcagtcgggt

SEQ ID NO: 181890 - DNA, 20 bp, human
ggaaggcgcgcggctcccga

SEQ ID NO: 181891 - DNA, 20 bp, human
gtctgcaagccccgcagagg

SEQ ID NO: 181892 - DNA, 20 bp, human
ggctccagccacggacacct

SEQ ID NO: 181893 - DNA, 20 bp, human
gccgctgctggaggacgccc

SEQ ID NO: 181894 - DNA, 20 bp, human
gctccgcgagtccaggagaa

SEQ ID NO: 181895 - DNA, 20 bp, human
gcttctaagcttctactcaa

SEQ ID NO: 181896 - DNA, 20 bp, human
gagtgcttagaagaatctac

SEQ ID NO: 181897 - DNA, 20 bp, human
gtgaggactgagcagttcct

SEQ ID NO: 181898 - DNA, 20 bp, human
gtgtgcacagcaatgtgcgt

SEQ ID NO: 181899 - DNA, 20 bp, human
gagcttcctgtggttgacag

SEQ ID NO: 181900 - DNA, 20 bp, human
gctttgtcaattggaagaag

SEQ ID NO: 181901 - DNA, 20 bp, human
gcttttgctgcaggatttat

SEQ ID NO: 181902 - DNA, 20 bp, human
gaaacagcctgcgtaaccag

SEQ ID NO: 181903 - DNA, 20 bp, human
ggctgggaactccctttgga

SEQ ID NO: 181904 - DNA, 20 bp, human
ggcagaagtctcttaataaa

SEQ ID NO: 181905 - DNA, 20 bp, human
gtgaaatacgaagcttcctg

SEQ ID NO: 181906 - DNA, 20 bp, human
gcctcaggcagccctatctg

SEQ ID NO: 181907 - DNA, 20 bp, human
gacacccttgtgtaggtagg

SEQ ID NO: 181908 - DNA, 20 bp, human
gcgaacacccttgtgtaggt

SEQ ID NO: 181909 - DNA, 20 bp, human
gggtgttcgggagcatctca

SEQ ID NO: 181910 - DNA, 20 bp, human
ggtgcagtggggtgagccta

SEQ ID NO: 181911 - DNA, 20 bp, human
gcctggccgaggtgtgaata

SEQ ID NO: 181912 - DNA, 20 bp, human
gggccaggactggtttggga

SEQ ID NO: 181913 - DNA, 20 bp, human
ggcagcctcctacctacaca

SEQ ID NO: 181914 - DNA, 20 bp, human
ggatccagcacccagccctc

SEQ ID NO: 181915 - DNA, 20 bp, human
ggggcaggcagcaaagtctt

SEQ ID NO: 181916 - DNA, 20 bp, human
gggagccgagcggcgtgcag

SEQ ID NO: 181917 - DNA, 20 bp, human
gtcgcacagggcgcatccag

SEQ ID NO: 181918 - DNA, 20 bp, human
gcccacccggcggagccgag

SEQ ID NO: 181919 - DNA, 20 bp, human
ggcgggcgctgcccacccgg

SEQ ID NO: 181920 - DNA, 20 bp, human
gaccgcgcgctctcccggca

SEQ ID NO: 181921 - DNA, 20 bp, human
ggtgccgtagctggtgattg

SEQ ID NO: 181922 - DNA, 20 bp, human
gggcaaggctgatctcgggg

SEQ ID NO: 181923 - DNA, 20 bp, human
gaggctacaagtgccgtagc

SEQ ID NO: 181924 - DNA, 20 bp, human
gcagcaggcgccgaggaatc

SEQ ID NO: 181925 - DNA, 20 bp, human
ggctctcccggcacggttcc

SEQ ID NO: 181926 - DNA, 20 bp, human
gaggagaccgtcccgaccta

SEQ ID NO: 181927 - DNA, 20 bp, human
gcgcgccgcgcggagctgta

SEQ ID NO: 181928 - DNA, 20 bp, human
gcgaggtccttaggtcggga

SEQ ID NO: 181929 - DNA, 20 bp, human
ggcctgggcttagggaactg

SEQ ID NO: 181930 - DNA, 20 bp, human
ggccgcgcggagctgtacgg

SEQ ID NO: 181931 - DNA, 20 bp, human
ggctcaagggcgccacctga

SEQ ID NO: 181932 - DNA, 20 bp, human
gctctccgaggtccttaggt

SEQ ID NO: 181933 - DNA, 20 bp, human
gcagcccccaggtaggaccc

SEQ ID NO: 181934 - DNA, 20 bp, human
gggacctcggagaggacccg

SEQ ID NO: 181935 - DNA, 20 bp, human
ggacccggggtcctacctgg

SEQ ID NO: 181936 - DNA, 20 bp, human
gagttgccagaactaactct

SEQ ID NO: 181937 - DNA, 20 bp, human
gacggacagtgtacccactg

SEQ ID NO: 181938 - DNA, 20 bp, human
gaaagggccgagcatcacat

SEQ ID NO: 181939 - DNA, 20 bp, human
gtaagctttggccgcctcag

SEQ ID NO: 181940 - DNA, 20 bp, human
gttagttctggcaacttccc

SEQ ID NO: 181941 - DNA, 20 bp, human
gcgcaagggtttggagaagc

SEQ ID NO: 181942 - DNA, 20 bp, human
gaagaggcttggctcaaacg

SEQ ID NO: 181943 - DNA, 20 bp, human
gcaagattctagacacacag

SEQ ID NO: 181944 - DNA, 20 bp, human
gtgctgcccagagttagttc

SEQ ID NO: 181945 - DNA, 20 bp, human
gtatgcaagctggaaatctt

SEQ ID NO: 181946 - DNA, 20 bp, human
gcccgcggcgaggtgagctc

SEQ ID NO: 181947 - DNA, 20 bp, human
gtctcggaggcgagtctctc

SEQ ID NO: 181948 - DNA, 20 bp, human
gtcgcctccgagaggaggaa

SEQ ID NO: 181949 - DNA, 20 bp, human
gctctcaggcaggacggctg

SEQ ID NO: 181950 - DNA, 20 bp, human
gggcaggacggctgaggcac

SEQ ID NO: 181951 - DNA, 20 bp, human
ggagactcgcctccgagagg

SEQ ID NO: 181952 - DNA, 20 bp, human
gtgccgggatcgcgacggac

SEQ ID NO: 181953 - DNA, 20 bp, human
ggaggctgccgggatcgcga

SEQ ID NO: 181954 - DNA, 20 bp, human
gggggcttccgggcttgcag

SEQ ID NO: 181955 - DNA, 20 bp, human
gctcgctcacgtagagacgg

SEQ ID NO: 181956 - DNA, 20 bp, human
gtaggtgtagtcaccaccaa

SEQ ID NO: 181957 - DNA, 20 bp, human
gataaacaggtgaggccaca

SEQ ID NO: 181958 - DNA, 20 bp, human
gctcccaaggacaaaactag

SEQ ID NO: 181959 - DNA, 20 bp, human
gcaggtagaaggccaacccc

SEQ ID NO: 181960 - DNA, 20 bp, human
gtctgaccaactggatctgt

SEQ ID NO: 181961 - DNA, 20 bp, human
gaggccacaggtgacagtac

SEQ ID NO: 181962 - DNA, 20 bp, human
gagcatcccacagatccagt

SEQ ID NO: 181963 - DNA, 20 bp, human
gaaggaggagaccgtctgtg

SEQ ID NO: 181964 - DNA, 20 bp, human
ggaggagaccgtctgtgagg

SEQ ID NO: 181965 - DNA, 20 bp, human
gtgtagtcaccaccaaaggc

SEQ ID NO: 181966 - DNA, 20 bp, human
gaggctagagccccactcga

SEQ ID NO: 181967 - DNA, 20 bp, human
ggcacggggacccccaccag

SEQ ID NO: 181968 - DNA, 20 bp, human
ggaggctggggctccttccg

SEQ ID NO: 181969 - DNA, 20 bp, human
gagagccccactcgagggag

SEQ ID NO: 181970 - DNA, 20 bp, human
gtcattggtagggtcagagg

SEQ ID NO: 181971 - DNA, 20 bp, human
gcttacgcagacctggccgg

SEQ ID NO: 181972 - DNA, 20 bp, human
ggcggcgacccgaaaaggag

SEQ ID NO: 181973 - DNA, 20 bp, human
ggcctcccctccctcgagtg

SEQ ID NO: 181974 - DNA, 20 bp, human
gccccagggaatgtggctgg

SEQ ID NO: 181975 - DNA, 20 bp, human
gagaacatggcagccccgga

SEQ ID NO: 181976 - DNA, 20 bp, human
gccgcctacgcggaactctg

SEQ ID NO: 181977 - DNA, 20 bp, human
gtcgcggcccgggagaggga

SEQ ID NO: 181978 - DNA, 20 bp, human
gggaccacagggaggcgtgg

SEQ ID NO: 181979 - DNA, 20 bp, human
gcggccgcagagttccgcgt

SEQ ID NO: 181980 - DNA, 20 bp, human
gcgcccacggccaggtaagc

SEQ ID NO: 181981 - DNA, 20 bp, human
gaggtattgtccgtccctcc

SEQ ID NO: 181982 - DNA, 20 bp, human
gacgattctacaaagcccgg

SEQ ID NO: 181983 - DNA, 20 bp, human
ggggctagctgacagaaccc

SEQ ID NO: 181984 - DNA, 20 bp, human
gctggcagcggtgacgtcac

SEQ ID NO: 181985 - DNA, 20 bp, human
gacagtgaccggggacacca

SEQ ID NO: 181986 - DNA, 20 bp, human
gctggtcctcgggaatccag

SEQ ID NO: 181987 - DNA, 20 bp, human
gacgggcaggcacttgacca

SEQ ID NO: 181988 - DNA, 20 bp, human
gcatggacgctggcaaagcg

SEQ ID NO: 181989 - DNA, 20 bp, human
gccccagagcgacctaatct

SEQ ID NO: 181990 - DNA, 20 bp, human
gccagggcccaaccaactca

SEQ ID NO: 181991 - DNA, 20 bp, human
ggacctaatctgggagcgag

SEQ ID NO: 181992 - DNA, 20 bp, human
gagccactcgctcccagatt

SEQ ID NO: 181993 - DNA, 20 bp, human
gatcaggccagcatggacgc

SEQ ID NO: 181994 - DNA, 20 bp, human
ggcttggggacatgacccac

SEQ ID NO: 181995 - DNA, 20 bp, human
gggagctgctgtccttgagt

SEQ ID NO: 181996 - DNA, 20 bp, human
gtaggctagcgggaatgtaa

SEQ ID NO: 181997 - DNA, 20 bp, human
ggctttcggtaggcactcca

SEQ ID NO: 181998 - DNA, 20 bp, human
gacggctgtgaagatggcgg

SEQ ID NO: 181999 - DNA, 20 bp, human
gtctgaacctagaggagcaa

SEQ ID NO: 182000 - DNA, 20 bp, human
gagggtgaaatgctttcggt

SEQ ID NO: 182001 - DNA, 20 bp, human
gggccacttcagcaacagaa

SEQ ID NO: 182002 - DNA, 20 bp, human
gggcgggacgaaccggaaga

SEQ ID NO: 182003 - DNA, 20 bp, human
gggaagaaggcgggacgaac

SEQ ID NO: 182004 - DNA, 20 bp, human
gcactaacgtctgaacctag

SEQ ID NO: 182005 - DNA, 20 bp, human
gagcagagccggaagaaggc

SEQ ID NO: 182006 - DNA, 20 bp, human
gcaggagcccggctaccgag

SEQ ID NO: 182007 - DNA, 20 bp, human
gaaacccggccaggaccggg

SEQ ID NO: 182008 - DNA, 20 bp, human
gctcctgtgctggaccccgg

SEQ ID NO: 182009 - DNA, 20 bp, human
gggctcagggagggtatcag

SEQ ID NO: 182010 - DNA, 20 bp, human
gcgtgcagctgggagatgcc

SEQ ID NO: 182011 - DNA, 20 bp, human
ggaccgggaggcagggctta

SEQ ID NO: 182012 - DNA, 20 bp, human
gggctggatcaggaatctct

SEQ ID NO: 182013 - DNA, 20 bp, human
gagttggcggcgagacgtgg

SEQ ID NO: 182014 - DNA, 20 bp, human
gacgacgtaagtggagtgtc

SEQ ID NO: 182015 - DNA, 20 bp, human
gcgccgccaactccacatcc

SEQ ID NO: 182016 - DNA, 20 bp, human
ggccatggcggatgtccccg

SEQ ID NO: 182017 - DNA, 20 bp, human
gcgcaggcccaacagtccag

SEQ ID NO: 182018 - DNA, 20 bp, human
gctgggagcgcaggaactgt

SEQ ID NO: 182019 - DNA, 20 bp, human
gaacagtccagggggtcccg

SEQ ID NO: 182020 - DNA, 20 bp, human
gaggaatccggtgaccagta

SEQ ID NO: 182021 - DNA, 20 bp, human
gggatccaggcgggccatgg

SEQ ID NO: 182022 - DNA, 20 bp, human
gggcacgaggagcaggaatc

SEQ ID NO: 182023 - DNA, 20 bp, human
ggcaggtgcgcggtgcaagg

SEQ ID NO: 182024 - DNA, 20 bp, human
gaccagcaggagaagattga

SEQ ID NO: 182025 - DNA, 20 bp, human
ggcagccaccagcagattct

SEQ ID NO: 182026 - DNA, 20 bp, human
ggcacaggctcaccctcgag

SEQ ID NO: 182027 - DNA, 20 bp, human
ggaccaccctgggcacgtca

SEQ ID NO: 182028 - DNA, 20 bp, human
gcgagtggcacaggaatccc

SEQ ID NO: 182029 - DNA, 20 bp, human
gggctctgggacagacatca

SEQ ID NO: 182030 - DNA, 20 bp, human
gggcggtgctcaatgcagag

SEQ ID NO: 182031 - DNA, 20 bp, human
gaatcccaggtagacgacgg

SEQ ID NO: 182032 - DNA, 20 bp, human
gaggaatcccaggtagacga

SEQ ID NO: 182033 - DNA, 20 bp, human
gaccagcaggaaggctgcgg

SEQ ID NO: 182034 - DNA, 20 bp, human
gcggggttaaaggtcttcca

SEQ ID NO: 182035 - DNA, 20 bp, human
gctagccagggtccacggtc

SEQ ID NO: 182036 - DNA, 20 bp, human
gaggggtctcgaccaggcgt

SEQ ID NO: 182037 - DNA, 20 bp, human
ggtgtggacacagggacaat

SEQ ID NO: 182038 - DNA, 20 bp, human
gaggccagtgtggacccatg

SEQ ID NO: 182039 - DNA, 20 bp, human
ggccccacctggtaccagag

SEQ ID NO: 182040 - DNA, 20 bp, human
gtaccagaggggtctcgacc

SEQ ID NO: 182041 - DNA, 20 bp, human
gagtgccagggccggaaccc

SEQ ID NO: 182042 - DNA, 20 bp, human
gggtctcgaccaggcgtggg

SEQ ID NO: 182043 - DNA, 20 bp, human
gggaggcagacgtcaccagc

SEQ ID NO: 182044 - DNA, 20 bp, human
gctgccccatgggtccacac

SEQ ID NO: 182045 - DNA, 20 bp, human
ggtggacatgggttccacga

SEQ ID NO: 182046 - DNA, 20 bp, human
ggccgggccatgggcgccgg

SEQ ID NO: 182047 - DNA, 20 bp, human
gcgagcgcggagccatgggc

SEQ ID NO: 182048 - DNA, 20 bp, human
gccggctacagcgggaagag

SEQ ID NO: 182049 - DNA, 20 bp, human
ggtggcccaaccccgatcgg

SEQ ID NO: 182050 - DNA, 20 bp, human
gcggggaccggccgggccat

SEQ ID NO: 182051 - DNA, 20 bp, human
gctcccagagcgcccaggtc

SEQ ID NO: 182052 - DNA, 20 bp, human
gcgtgtcctaggggtcgagg

SEQ ID NO: 182053 - DNA, 20 bp, human
gactgtgcacccccaacccg

SEQ ID NO: 182054 - DNA, 20 bp, human
gctgcctccgccggctacag

SEQ ID NO: 182055 - DNA, 20 bp, human
gcccgatcgggggaccgagg

SEQ ID NO: 182056 - DNA, 20 bp, human
gcggcgataaccaggccccg

SEQ ID NO: 182057 - DNA, 20 bp, human
gttcaggcctgggcgactcc

SEQ ID NO: 182058 - DNA, 20 bp, human
gtgggtaggagttcaggcct

SEQ ID NO: 182059 - DNA, 20 bp, human
gggcggcctcgacttgacgt

SEQ ID NO: 182060 - DNA, 20 bp, human
gggcagagtatgagagatag

SEQ ID NO: 182061 - DNA, 20 bp, human
gacagcagcaatagggctgg

SEQ ID NO: 182062 - DNA, 20 bp, human
gcaggggctggggccgatgt

SEQ ID NO: 182063 - DNA, 20 bp, human
ggggattgggataggacgag

SEQ ID NO: 182064 - DNA, 20 bp, human
gtaagcaaacactgggaatg

SEQ ID NO: 182065 - DNA, 20 bp, human
gcgagggccgaggccgggat

SEQ ID NO: 182066 - DNA, 20 bp, human
gcagcacaggagcacgaagt

SEQ ID NO: 182067 - DNA, 20 bp, human
gtgtcccaggtccccagcac

SEQ ID NO: 182068 - DNA, 20 bp, human
gcccaggcttggtctcacac

SEQ ID NO: 182069 - DNA, 20 bp, human
gcatcagagccctgcccaaa

SEQ ID NO: 182070 - DNA, 20 bp, human
gtggccaccagcgtccccat

SEQ ID NO: 182071 - DNA, 20 bp, human
ggggaaggccagctcccttt

SEQ ID NO: 182072 - DNA, 20 bp, human
gtgaaacagcaggcccaggt

SEQ ID NO: 182073 - DNA, 20 bp, human
gtgatcccagagcaacttcc

SEQ ID NO: 182074 - DNA, 20 bp, human
gcagcatcgcggccaagagg

SEQ ID NO: 182075 - DNA, 20 bp, human
ggcaacttcctggcacagat

SEQ ID NO: 182076 - DNA, 20 bp, human
ggcagatggcaggccccagt

SEQ ID NO: 182077 - DNA, 20 bp, human
ggagcaggtggagagtaggg

SEQ ID NO: 182078 - DNA, 20 bp, human
gccagagtctggagggcata

SEQ ID NO: 182079 - DNA, 20 bp, human
gcagcgctggccatgtacca

SEQ ID NO: 182080 - DNA, 20 bp, human
gtggagggcatatggctgtg

SEQ ID NO: 182081 - DNA, 20 bp, human
gtggaagggcccaacgagac

SEQ ID NO: 182082 - DNA, 20 bp, human
gccggggactcctgaatggt

SEQ ID NO: 182083 - DNA, 20 bp, human
gccagtgggctccagcgggc

SEQ ID NO: 182084 - DNA, 20 bp, human
gggactcctgaatggtgggc

SEQ ID NO: 182085 - DNA, 20 bp, human
gtacacagggaaccagggga

SEQ ID NO: 182086 - DNA, 20 bp, human
ggtctacagggctgactcag

SEQ ID NO: 182087 - DNA, 20 bp, human
gagatacggagtcggagaag

SEQ ID NO: 182088 - DNA, 20 bp, human
gcttaaccatccggccaagt

SEQ ID NO: 182089 - DNA, 20 bp, human
gggagagccggagagttggg

SEQ ID NO: 182090 - DNA, 20 bp, human
ggtcagccctgtagacaggg

SEQ ID NO: 182091 - DNA, 20 bp, human
gacacctggaaaaagagata

SEQ ID NO: 182092 - DNA, 20 bp, human
gtcagagccgggccttgaga

SEQ ID NO: 182093 - DNA, 20 bp, human
gcagcgggcttgtaggttcg

SEQ ID NO: 182094 - DNA, 20 bp, human
gcatccggccaagtgggaat

SEQ ID NO: 182095 - DNA, 20 bp, human
gcggcagaggggtcctcgag

SEQ ID NO: 182096 - DNA, 20 bp, human
ggaggagaaagcggcaaccg

SEQ ID NO: 182097 - DNA, 20 bp, human
gcgcacttaacggttaggag

SEQ ID NO: 182098 - DNA, 20 bp, human
gccgttaagtgcgctaaggt

SEQ ID NO: 182099 - DNA, 20 bp, human
ggaagctgccatgttgagtg

SEQ ID NO: 182100 - DNA, 20 bp, human
gaaccggggttgtagttcat

SEQ ID NO: 182101 - DNA, 20 bp, human
gagcccatgaactacaaccc

SEQ ID NO: 182102 - DNA, 20 bp, human
gtcctcagccacactcaaca

SEQ ID NO: 182103 - DNA, 20 bp, human
gcacagagagctcttcggtg

SEQ ID NO: 182104 - DNA, 20 bp, human
gagagcgagtacaaagctag

SEQ ID NO: 182105 - DNA, 20 bp, human
gctagccacgcccaaaatgg

SEQ ID NO: 182106 - DNA, 20 bp, human
gccagacccccgggagtcgt

SEQ ID NO: 182107 - DNA, 20 bp, human
gaggcttggggaccttccag

SEQ ID NO: 182108 - DNA, 20 bp, human
gggcctgggctcacgaggaa

SEQ ID NO: 182109 - DNA, 20 bp, human
ggaaggccctggagaatccg

SEQ ID NO: 182110 - DNA, 20 bp, human
gctgccaccgaggatccaag

SEQ ID NO: 182111 - DNA, 20 bp, human
ggaccttccagggggatcgt

SEQ ID NO: 182112 - DNA, 20 bp, human
ggaggaaatcggctcagtca

SEQ ID NO: 182113 - DNA, 20 bp, human
gtccccaactccaggaccca

SEQ ID NO: 182114 - DNA, 20 bp, human
gccctcctccggcagagctt

SEQ ID NO: 182115 - DNA, 20 bp, human
ggcgccccttggatcctcgg

SEQ ID NO: 182116 - DNA, 20 bp, human
gcccataggtggagagaagt

SEQ ID NO: 182117 - DNA, 20 bp, human
gtctacacaggaaagctcag

SEQ ID NO: 182118 - DNA, 20 bp, human
ggataagctgaggctaataa

SEQ ID NO: 182119 - DNA, 20 bp, human
gacccaagcttgggacatcc

SEQ ID NO: 182120 - DNA, 20 bp, human
ggagctggaaggataagctg

SEQ ID NO: 182121 - DNA, 20 bp, human
ggccaggatgtcccaagctt

SEQ ID NO: 182122 - DNA, 20 bp, human
gaccacaggatccccctcag

SEQ ID NO: 182123 - DNA, 20 bp, human
gagccccgccttctctacac

SEQ ID NO: 182124 - DNA, 20 bp, human
gcaggtgtccaaagctcagg

SEQ ID NO: 182125 - DNA, 20 bp, human
gcgaggcggggccccatagg

SEQ ID NO: 182126 - DNA, 20 bp, human
gctccacatgaggaccactg

SEQ ID NO: 182127 - DNA, 20 bp, human
gaggtaggaccagacatcca

SEQ ID NO: 182128 - DNA, 20 bp, human
gtcccccagtggtcctcatg

SEQ ID NO: 182129 - DNA, 20 bp, human
gacagagtcctgagggtcat

SEQ ID NO: 182130 - DNA, 20 bp, human
gagggctgcagagcattcct

SEQ ID NO: 182131 - DNA, 20 bp, human
gttcatggacacctcatctg

SEQ ID NO: 182132 - DNA, 20 bp, human
gccagaacctgggctgatga

SEQ ID NO: 182133 - DNA, 20 bp, human
gtggaggctggcactaggcg

SEQ ID NO: 182134 - DNA, 20 bp, human
gtcatgtggaggctggcact

SEQ ID NO: 182135 - DNA, 20 bp, human
gggaccagacatccagggat

SEQ ID NO: 182136 - DNA, 20 bp, human
gcccaaccgacagactatgg

SEQ ID NO: 182137 - DNA, 20 bp, human
ggaggcgcgtgggtctggga

SEQ ID NO: 182138 - DNA, 20 bp, human
gcagcgggccgggataagag

SEQ ID NO: 182139 - DNA, 20 bp, human
ggacccgctgatgtgagaag

SEQ ID NO: 182140 - DNA, 20 bp, human
ggcccctcttctcacatcag

SEQ ID NO: 182141 - DNA, 20 bp, human
gggcgcccctcacctcgact

SEQ ID NO: 182142 - DNA, 20 bp, human
gggcggcgaccgaggcgcgt

SEQ ID NO: 182143 - DNA, 20 bp, human
gaggcccaaccgacagacta

SEQ ID NO: 182144 - DNA, 20 bp, human
ggcgggaaaccttaaaccca

SEQ ID NO: 182145 - DNA, 20 bp, human
gcggagcccccatagtctgt

SEQ ID NO: 182146 - DNA, 20 bp, human
gagcatgccgggaagcgccg

SEQ ID NO: 182147 - DNA, 20 bp, human
gggctggattcctagggccg

SEQ ID NO: 182148 - DNA, 20 bp, human
gtgtggttctggaaccggag

SEQ ID NO: 182149 - DNA, 20 bp, human
gggcggggctcacccacctc

SEQ ID NO: 182150 - DNA, 20 bp, human
gccccgccgatggcaaagtc

SEQ ID NO: 182151 - DNA, 20 bp, human
ggcagtcgcgggatgcgccc

SEQ ID NO: 182152 - DNA, 20 bp, human
gcgcgcccggactttgccat

SEQ ID NO: 182153 - DNA, 20 bp, human
gccatcggcggggcagtcgc

SEQ ID NO: 182154 - DNA, 20 bp, human
gacagagtgggcgtcctggg

SEQ ID NO: 182155 - DNA, 20 bp, human
gtccctcccggggacagagt

SEQ ID NO: 182156 - DNA, 20 bp, human
gccgcctccggaactaaacg

SEQ ID NO: 182157 - DNA, 20 bp, human
ggcagcctgctagaaggaga

SEQ ID NO: 182158 - DNA, 20 bp, human
gctctaacgttggaaaacgg

SEQ ID NO: 182159 - DNA, 20 bp, human
gtcaccccgtttagttccgg

SEQ ID NO: 182160 - DNA, 20 bp, human
ggaagatgccagagaatgag

SEQ ID NO: 182161 - DNA, 20 bp, human
ggagggtagagtacagaaaa

SEQ ID NO: 182162 - DNA, 20 bp, human
gtatctctaacgttggaaaa

SEQ ID NO: 182163 - DNA, 20 bp, human
ggcggcggcggaagtttcgg

SEQ ID NO: 182164 - DNA, 20 bp, human
gcaggcccagatatccgctc

SEQ ID NO: 182165 - DNA, 20 bp, human
ggacgcggcggcggaagttt

SEQ ID NO: 182166 - DNA, 20 bp, human
gagggaggccacgcccacga

SEQ ID NO: 182167 - DNA, 20 bp, human
gctgtggtcaggaggcgcgt

SEQ ID NO: 182168 - DNA, 20 bp, human
gtggtcaggaggcgcgtggg

SEQ ID NO: 182169 - DNA, 20 bp, human
gtcgcgtccagacggaagtg

SEQ ID NO: 182170 - DNA, 20 bp, human
ggcccctcccgactgcccgg

SEQ ID NO: 182171 - DNA, 20 bp, human
gcctgaccacagcaccccgt

SEQ ID NO: 182172 - DNA, 20 bp, human
ggggctgctgtccggactgt

SEQ ID NO: 182173 - DNA, 20 bp, human
ggatgcccaccgccagtcaa

SEQ ID NO: 182174 - DNA, 20 bp, human
gccaccgccagtcaaagggt

SEQ ID NO: 182175 - DNA, 20 bp, human
gtccgcaaggccggtggtag

SEQ ID NO: 182176 - DNA, 20 bp, human
gcggccgagggtaacatccc

SEQ ID NO: 182177 - DNA, 20 bp, human
ggagcccgggatgttaccct

SEQ ID NO: 182178 - DNA, 20 bp, human
gcgcacagctgagacgaagg

SEQ ID NO: 182179 - DNA, 20 bp, human
gggttaagtggtgtagagag

SEQ ID NO: 182180 - DNA, 20 bp, human
ggccactgccggctgaggag

SEQ ID NO: 182181 - DNA, 20 bp, human
gaacatcccgggctcgcggg

SEQ ID NO: 182182 - DNA, 20 bp, human
gcgtctcagctgtgcgggaa

SEQ ID NO: 182183 - DNA, 20 bp, human
gggctcgcgggaggctgtcg

SEQ ID NO: 182184 - DNA, 20 bp, human
gagcaagcgcatgcgcacat

SEQ ID NO: 182185 - DNA, 20 bp, human
gttgatgcaggcaggttaag

SEQ ID NO: 182186 - DNA, 20 bp, human
ggcgcgggaacctgacaccg

SEQ ID NO: 182187 - DNA, 20 bp, human
gaccagggaccctaagagtg

SEQ ID NO: 182188 - DNA, 20 bp, human
gtccaccgcagcgatggcgg

SEQ ID NO: 182189 - DNA, 20 bp, human
gcgatctcccgggaaggagg

SEQ ID NO: 182190 - DNA, 20 bp, human
gggtccctggtctgatggaa

SEQ ID NO: 182191 - DNA, 20 bp, human
ggcgaggcacaccccgagtg

SEQ ID NO: 182192 - DNA, 20 bp, human
ggtgcccttccatcagacca

SEQ ID NO: 182193 - DNA, 20 bp, human
gggcgccgcccagcacgcag

SEQ ID NO: 182194 - DNA, 20 bp, human
ggcctgcggcccgatctccc

SEQ ID NO: 182195 - DNA, 20 bp, human
gctgagagatccagtctccc

SEQ ID NO: 182196 - DNA, 20 bp, human
ggacaggggaggagtagagt

SEQ ID NO: 182197 - DNA, 20 bp, human
gggaggagtagagtaggtat

SEQ ID NO: 182198 - DNA, 20 bp, human
gtcagagctcaagaggtaag

SEQ ID NO: 182199 - DNA, 20 bp, human
ggcagaggaacagttggcca

SEQ ID NO: 182200 - DNA, 20 bp, human
ggtcccaggcgtgccctgac

SEQ ID NO: 182201 - DNA, 20 bp, human
gcaggcttgtctgccagaaa

SEQ ID NO: 182202 - DNA, 20 bp, human
gctcctgtcagggcacgcct

SEQ ID NO: 182203 - DNA, 20 bp, human
gcagcttctcagagctcaag

SEQ ID NO: 182204 - DNA, 20 bp, human
gatttagggttttcaggcag

SEQ ID NO: 182205 - DNA, 20 bp, human
gatgaaacttactcctgtca

SEQ ID NO: 182206 - DNA, 20 bp, human
gggccaggaatggggtcccc

SEQ ID NO: 182207 - DNA, 20 bp, human
gcaggccaggctggtatgta

SEQ ID NO: 182208 - DNA, 20 bp, human
gcagcaagagtggggttcag

SEQ ID NO: 182209 - DNA, 20 bp, human
gagatctggggtgagtatct

SEQ ID NO: 182210 - DNA, 20 bp, human
gaggcccagcaccatgcccg

SEQ ID NO: 182211 - DNA, 20 bp, human
gagatctggagaagggtatt

SEQ ID NO: 182212 - DNA, 20 bp, human
ggtatcctaggggccctcag

SEQ ID NO: 182213 - DNA, 20 bp, human
gcaggctagagcaagaggga

SEQ ID NO: 182214 - DNA, 20 bp, human
gtccccaggctagagcaaga

SEQ ID NO: 182215 - DNA, 20 bp, human
gtgcccggggaccccattcc

SEQ ID NO: 182216 - DNA, 20 bp, human
gaagcaaggagagtctcggg

SEQ ID NO: 182217 - DNA, 20 bp, human
ggatcagcgtgaggccggat

SEQ ID NO: 182218 - DNA, 20 bp, human
gttccaagcaaggagagtct

SEQ ID NO: 182219 - DNA, 20 bp, human
gccccatgggtgctacgggt

SEQ ID NO: 182220 - DNA, 20 bp, human
gcctagcgctcaggaagagc

SEQ ID NO: 182221 - DNA, 20 bp, human
gaaggcaaaaggcgggtgaa

SEQ ID NO: 182222 - DNA, 20 bp, human
ggtggggccgacagttttgg

SEQ ID NO: 182223 - DNA, 20 bp, human
gctgcacggccggaaggagt

SEQ ID NO: 182224 - DNA, 20 bp, human
gccagcccgctcgggcccag

SEQ ID NO: 182225 - DNA, 20 bp, human
gcctgagcgctaggcccatc

SEQ ID NO: 182226 - DNA, 20 bp, human
gtatggctgaggccccggag

SEQ ID NO: 182227 - DNA, 20 bp, human
gctttggtccatcacttctg

SEQ ID NO: 182228 - DNA, 20 bp, human
ggcggtgcggaggtccagag

SEQ ID NO: 182229 - DNA, 20 bp, human
gccccagaggcaacccgagg

SEQ ID NO: 182230 - DNA, 20 bp, human
gggctggacgagctcccggg

SEQ ID NO: 182231 - DNA, 20 bp, human
gggcggaggccgcggtgctc

SEQ ID NO: 182232 - DNA, 20 bp, human
ggtgcggaggtccagagcgg

SEQ ID NO: 182233 - DNA, 20 bp, human
gggcggcgggcagatggacg

SEQ ID NO: 182234 - DNA, 20 bp, human
gtgaacgcgagaaggacccg

SEQ ID NO: 182235 - DNA, 20 bp, human
ggcgggcagatggacgcggg

SEQ ID NO: 182236 - DNA, 20 bp, human
gagcggggccgggagaacag

SEQ ID NO: 182237 - DNA, 20 bp, human
ggtcagtccgtcagccccgg

SEQ ID NO: 182238 - DNA, 20 bp, human
gacaggaaggggaaaagtgg

SEQ ID NO: 182239 - DNA, 20 bp, human
ggccgtcagtccgtcagccc

SEQ ID NO: 182240 - DNA, 20 bp, human
gtccgtcagccccggtggag

SEQ ID NO: 182241 - DNA, 20 bp, human
ggagctcaccaaacatgcac

SEQ ID NO: 182242 - DNA, 20 bp, human
gggaggatgctccgcgacat

SEQ ID NO: 182243 - DNA, 20 bp, human
gggatgctccgcgacatggg

SEQ ID NO: 182244 - DNA, 20 bp, human
ggagcgcggcgatcaacagg

SEQ ID NO: 182245 - DNA, 20 bp, human
gcggccgaccgcccatgtcg

SEQ ID NO: 182246 - DNA, 20 bp, human
gagctgctggcgggtgggtc

SEQ ID NO: 182247 - DNA, 20 bp, human
gctacagggcggtcgagtga

SEQ ID NO: 182248 - DNA, 20 bp, human
gacccaccgcacctacaggg

SEQ ID NO: 182249 - DNA, 20 bp, human
ggagggagctgctggcgggt

SEQ ID NO: 182250 - DNA, 20 bp, human
gggtctggcaactctttggg

SEQ ID NO: 182251 - DNA, 20 bp, human
gggaacccaccgcacctaca

SEQ ID NO: 182252 - DNA, 20 bp, human
gcgggccgcgggtgattcac

SEQ ID NO: 182253 - DNA, 20 bp, human
gggagtcgcaccggccatgg

SEQ ID NO: 182254 - DNA, 20 bp, human
gggtgggtctggcaactctt

SEQ ID NO: 182255 - DNA, 20 bp, human
gcccgccggtccgcccgcgt

SEQ ID NO: 182256 - DNA, 20 bp, human
ggacagacctactgacacag

SEQ ID NO: 182257 - DNA, 20 bp, human
gccccacctaccagtcctgg

SEQ ID NO: 182258 - DNA, 20 bp, human
ggggaggtgaccaccaggac

SEQ ID NO: 182259 - DNA, 20 bp, human
ggaaggtgacaccagaccaa

SEQ ID NO: 182260 - DNA, 20 bp, human
gggttgggggaagggtagta

SEQ ID NO: 182261 - DNA, 20 bp, human
gaccaccaggactggtaggt

SEQ ID NO: 182262 - DNA, 20 bp, human
gaagggctcggagcagttgg

SEQ ID NO: 182263 - DNA, 20 bp, human
gcaaagcaagggacagatta

SEQ ID NO: 182264 - DNA, 20 bp, human
gtgagagcccggtgggagat

SEQ ID NO: 182265 - DNA, 20 bp, human
gcttccccacctaccagtcc

SEQ ID NO: 182266 - DNA, 20 bp, human
gcgtcactggagaagtccgg

SEQ ID NO: 182267 - DNA, 20 bp, human
gcctcctgcctgtagtgtgt

SEQ ID NO: 182268 - DNA, 20 bp, human
ggccggagccgagcagccgt

SEQ ID NO: 182269 - DNA, 20 bp, human
gccagagccgaggaccgggg

SEQ ID NO: 182270 - DNA, 20 bp, human
gctgcccgggaagagcgctg

SEQ ID NO: 182271 - DNA, 20 bp, human
gctctacctgcagcacctca

SEQ ID NO: 182272 - DNA, 20 bp, human
ggccccagagccgaggaccg

SEQ ID NO: 182273 - DNA, 20 bp, human
gcagcccacacactacaggc

SEQ ID NO: 182274 - DNA, 20 bp, human
gagcagccgtcggcagggta

SEQ ID NO: 182275 - DNA, 20 bp, human
gggagcggaacaaaaactcg

SEQ ID NO: 182276 - DNA, 20 bp, human
gtggatccaagcgcaaaggg

SEQ ID NO: 182277 - DNA, 20 bp, human
ggatcaacgatggcatcccc

SEQ ID NO: 182278 - DNA, 20 bp, human
ggccctgccccgatcaacga

SEQ ID NO: 182279 - DNA, 20 bp, human
gctggcgaggcgaataggtg

SEQ ID NO: 182280 - DNA, 20 bp, human
gcagggctggcgaggcgaat

SEQ ID NO: 182281 - DNA, 20 bp, human
gtcgcttgtgcgttccgctc

SEQ ID NO: 182282 - DNA, 20 bp, human
gagcgaccgagctgcctgga

SEQ ID NO: 182283 - DNA, 20 bp, human
gcggggcgtgcacagttggt

SEQ ID NO: 182284 - DNA, 20 bp, human
ggcaccaactgggaaagcga

SEQ ID NO: 182285 - DNA, 20 bp, human
gtccaagcgcaaagggcggc

SEQ ID NO: 182286 - DNA, 20 bp, human
gccacaaggacccaccataa

SEQ ID NO: 182287 - DNA, 20 bp, human
gtagatgtattagaagtcta

SEQ ID NO: 182288 - DNA, 20 bp, human
gttagaaagttgagttcagt

SEQ ID NO: 182289 - DNA, 20 bp, human
gtgtaagaggactgctagtg

SEQ ID NO: 182290 - DNA, 20 bp, human
gccgatacatcatgtacagg

SEQ ID NO: 182291 - DNA, 20 bp, human
gtattacattgtgtcttaat

SEQ ID NO: 182292 - DNA, 20 bp, human
gactgctagtgaggtgtctt

SEQ ID NO: 182293 - DNA, 20 bp, human
gttaccgatacatcatgtac

SEQ ID NO: 182294 - DNA, 20 bp, human
ggctagtgaggtgtctttgg

SEQ ID NO: 182295 - DNA, 20 bp, human
gtggtggattcaatctgcac

SEQ ID NO: 182296 - DNA, 20 bp, human
gatggcagtatcaggtataa

SEQ ID NO: 182297 - DNA, 20 bp, human
gacgataacgatgacaatgc

SEQ ID NO: 182298 - DNA, 20 bp, human
gggtaaaggggacttcactg

SEQ ID NO: 182299 - DNA, 20 bp, human
ggcagtatcaggtataacgg

SEQ ID NO: 182300 - DNA, 20 bp, human
gagtcaaaagctgcgtcaga

SEQ ID NO: 182301 - DNA, 20 bp, human
gtgattgttatggcagtatc

SEQ ID NO: 182302 - DNA, 20 bp, human
gaaaaaccaagctccaacac

SEQ ID NO: 182303 - DNA, 20 bp, human
gttcactggggagagcaagt

SEQ ID NO: 182304 - DNA, 20 bp, human
gtaattgacctgaaatctta

SEQ ID NO: 182305 - DNA, 20 bp, human
ggaacattatgtacaggtaa

SEQ ID NO: 182306 - DNA, 20 bp, human
gtgttgtagagagcaggtag

SEQ ID NO: 182307 - DNA, 20 bp, human
gttgggtgggagtcatactg

SEQ ID NO: 182308 - DNA, 20 bp, human
gtgtagagagcaggtagcgg

SEQ ID NO: 182309 - DNA, 20 bp, human
gtttactgcaatctttgggt

SEQ ID NO: 182310 - DNA, 20 bp, human
gcaggaaaccaaaaatgctg

SEQ ID NO: 182311 - DNA, 20 bp, human
gctatcgatgtcagaacttt

SEQ ID NO: 182312 - DNA, 20 bp, human
gattatttttcattcacagg

SEQ ID NO: 182313 - DNA, 20 bp, human
gaaacacaagtgtatatgac

SEQ ID NO: 182314 - DNA, 20 bp, human
ggacaggtttgtctccatgc

SEQ ID NO: 182315 - DNA, 20 bp, human
gcatattatttttcattcac

SEQ ID NO: 182316 - DNA, 20 bp, human
gaatctcaaagcagttgagt

SEQ ID NO: 182317 - DNA, 20 bp, human
ggctagcaataaaactgtaa

SEQ ID NO: 182318 - DNA, 20 bp, human
ggagagtcattcatttgagt

SEQ ID NO: 182319 - DNA, 20 bp, human
gctatagttgaggacaaagg

SEQ ID NO: 182320 - DNA, 20 bp, human
gtgttgtttggaacttttcg

SEQ ID NO: 182321 - DNA, 20 bp, human
gcatttcgaaaagtggtgtg

SEQ ID NO: 182322 - DNA, 20 bp, human
gattttaatccttaatgaag

SEQ ID NO: 182323 - DNA, 20 bp, human
gtgtgcaacatttcgaaaag

SEQ ID NO: 182324 - DNA, 20 bp, human
gtacgtgtgatctatagttg

SEQ ID NO: 182325 - DNA, 20 bp, human
gttactatatcttacagtat

SEQ ID NO: 182326 - DNA, 20 bp, human
ggcaatgaagagtcctgtga

SEQ ID NO: 182327 - DNA, 20 bp, human
gtgtagacctcgaccttcac

SEQ ID NO: 182328 - DNA, 20 bp, human
gctggttggcaatgatgtat

SEQ ID NO: 182329 - DNA, 20 bp, human
gagagctggattcacacact

SEQ ID NO: 182330 - DNA, 20 bp, human
gggatacaacaaaagaggac

SEQ ID NO: 182331 - DNA, 20 bp, human
gaacagtatgagccacacca

SEQ ID NO: 182332 - DNA, 20 bp, human
gatctacacattccttggtg

SEQ ID NO: 182333 - DNA, 20 bp, human
ggctctatcaatgactttgt

SEQ ID NO: 182334 - DNA, 20 bp, human
gtgtgggctgaattgaagtg

SEQ ID NO: 182335 - DNA, 20 bp, human
gaggtttctacacaatgtaa

SEQ ID NO: 182336 - DNA, 20 bp, human
gcatcatgaacccaggactg

SEQ ID NO: 182337 - DNA, 20 bp, human
gtcagcaggttaggacttgg

SEQ ID NO: 182338 - DNA, 20 bp, human
gtgaacaacagaggccaatg

SEQ ID NO: 182339 - DNA, 20 bp, human
gacgcgtacatcatgaaccc

SEQ ID NO: 182340 - DNA, 20 bp, human
gagacaggtagtacagatgt

SEQ ID NO: 182341 - DNA, 20 bp, human
gcctgctgatacagatcaga

SEQ ID NO: 182342 - DNA, 20 bp, human
ggtatcagcaggttaggact

SEQ ID NO: 182343 - DNA, 20 bp, human
gtctcagtaaaggttatcag

SEQ ID NO: 182344 - DNA, 20 bp, human
gaaaaatgtataccatgcta

SEQ ID NO: 182345 - DNA, 20 bp, human
ggcttattgatgtatattct

SEQ ID NO: 182346 - DNA, 20 bp, human
gccgcgtgcccagggcgggt

SEQ ID NO: 182347 - DNA, 20 bp, human
gctcaccagcctccaaaatg

SEQ ID NO: 182348 - DNA, 20 bp, human
gccttccagagggcgagtag

SEQ ID NO: 182349 - DNA, 20 bp, human
gcgtccgcaagaggctccgg

SEQ ID NO: 182350 - DNA, 20 bp, human
gagcctccaaaatgcggctg

SEQ ID NO: 182351 - DNA, 20 bp, human
gcccagagacaggcacgaac

SEQ ID NO: 182352 - DNA, 20 bp, human
ggcgtggcgctgttgtttgt

SEQ ID NO: 182353 - DNA, 20 bp, human
ggttgaaagggagggctatt

SEQ ID NO: 182354 - DNA, 20 bp, human
gaaacaacagcgccacgctc

SEQ ID NO: 182355 - DNA, 20 bp, human
ggccggtctagaaactgctt

SEQ ID NO: 182356 - DNA, 20 bp, human
gtcgaggagaagatccatct

SEQ ID NO: 182357 - DNA, 20 bp, human
ggcatgtagggtaaaggagt

SEQ ID NO: 182358 - DNA, 20 bp, human
gctggcttctcaggcatgta

SEQ ID NO: 182359 - DNA, 20 bp, human
ggtctgtgagcactcctgcc

SEQ ID NO: 182360 - DNA, 20 bp, human
gctggctggtgagcacccca

SEQ ID NO: 182361 - DNA, 20 bp, human
gggctatgtggctgagtcgt

SEQ ID NO: 182362 - DNA, 20 bp, human
gggccagcccccaccaaatg

SEQ ID NO: 182363 - DNA, 20 bp, human
gagtagcttcaaactagaag

SEQ ID NO: 182364 - DNA, 20 bp, human
ggaagatccatcttggtccc

SEQ ID NO: 182365 - DNA, 20 bp, human
ggattcccaatcggcaaagt

SEQ ID NO: 182366 - DNA, 20 bp, human
gactacagagaagtacatga

SEQ ID NO: 182367 - DNA, 20 bp, human
ggactggtatgcatgtagac

SEQ ID NO: 182368 - DNA, 20 bp, human
ggcacagagcactaccaata

SEQ ID NO: 182369 - DNA, 20 bp, human
gacaactcacttacactgac

SEQ ID NO: 182370 - DNA, 20 bp, human
gtgagttgtgtatgtctctt

SEQ ID NO: 182371 - DNA, 20 bp, human
ggttcccttcagagaatatt

SEQ ID NO: 182372 - DNA, 20 bp, human
ggtatcctgcctgacaatca

SEQ ID NO: 182373 - DNA, 20 bp, human
ggaggtaagtcacatggagt

SEQ ID NO: 182374 - DNA, 20 bp, human
ggctgcaaacatgatttcat

SEQ ID NO: 182375 - DNA, 20 bp, human
gcccaacgaggtaagtcaca

SEQ ID NO: 182376 - DNA, 20 bp, human
gcgagccgggaccctggtac

SEQ ID NO: 182377 - DNA, 20 bp, human
gctggagcgcggcaggtgag

SEQ ID NO: 182378 - DNA, 20 bp, human
gcgtggagggcaggcggact

SEQ ID NO: 182379 - DNA, 20 bp, human
gtggtggaagagagtccccc

SEQ ID NO: 182380 - DNA, 20 bp, human
ggcgcaccggtgctcccagg

SEQ ID NO: 182381 - DNA, 20 bp, human
gcgcgatgccaagccaacag

SEQ ID NO: 182382 - DNA, 20 bp, human
gcgagtccctagccagttgg

SEQ ID NO: 182383 - DNA, 20 bp, human
gactctcccagcaccccggg

SEQ ID NO: 182384 - DNA, 20 bp, human
gagggcgggccgggccgagt

SEQ ID NO: 182385 - DNA, 20 bp, human
ggtgagcggcgccggtacca

SEQ ID NO: 182386 - DNA, 20 bp, human
ggcaccacggaagagatagt

SEQ ID NO: 182387 - DNA, 20 bp, human
gggaaggaccgggcaccgga

SEQ ID NO: 182388 - DNA, 20 bp, human
gtggcctactatctcttccg

SEQ ID NO: 182389 - DNA, 20 bp, human
gaccgggcaccggacggctc

SEQ ID NO: 182390 - DNA, 20 bp, human
gaaaaatgtagatggcacca

SEQ ID NO: 182391 - DNA, 20 bp, human
ggattggttggacaaacaat

SEQ ID NO: 182392 - DNA, 20 bp, human
gcgcaaaaaagcaatggaaa

SEQ ID NO: 182393 - DNA, 20 bp, human
gggtcatgcccgtgtgagcc

SEQ ID NO: 182394 - DNA, 20 bp, human
ggtaggtgtaccacacgcac

SEQ ID NO: 182395 - DNA, 20 bp, human
gagccctttcctggctcaca

SEQ ID NO: 182396 - DNA, 20 bp, human
gtcctggaatacacagagag

SEQ ID NO: 182397 - DNA, 20 bp, human
gtagtcgggaaggacagccc

SEQ ID NO: 182398 - DNA, 20 bp, human
gcatggcaatggaggaagag

SEQ ID NO: 182399 - DNA, 20 bp, human
gtgctgggcgtgagggacca

SEQ ID NO: 182400 - DNA, 20 bp, human
ggagccagcatggtgagtgt

SEQ ID NO: 182401 - DNA, 20 bp, human
gcccaagacacaggaagggt

SEQ ID NO: 182402 - DNA, 20 bp, human
gaggctacagggagaccggg

SEQ ID NO: 182403 - DNA, 20 bp, human
gagctgagattgtcacccca

SEQ ID NO: 182404 - DNA, 20 bp, human
ggccagccaggacctgtgtg

SEQ ID NO: 182405 - DNA, 20 bp, human
gtaccgggctggggtgtgag

SEQ ID NO: 182406 - DNA, 20 bp, human
gtaaagcctcagggtctact

SEQ ID NO: 182407 - DNA, 20 bp, human
gtgaggtggagcagtacatg

SEQ ID NO: 182408 - DNA, 20 bp, human
gtaggctagcacatgagctt

SEQ ID NO: 182409 - DNA, 20 bp, human
gcattgcctagtagaccctg

SEQ ID NO: 182410 - DNA, 20 bp, human
ggtgaggccagtttattcag

SEQ ID NO: 182411 - DNA, 20 bp, human
gtcaatgctggcctgagaac

SEQ ID NO: 182412 - DNA, 20 bp, human
ggcactgttgtaaagcctca

SEQ ID NO: 182413 - DNA, 20 bp, human
gcaccagcctagaatcccaa

SEQ ID NO: 182414 - DNA, 20 bp, human
gacagtgccactgaccccta

SEQ ID NO: 182415 - DNA, 20 bp, human
gtaaagggcagtccctgggg

SEQ ID NO: 182416 - DNA, 20 bp, human
ggaccacgcagggtgacacc

SEQ ID NO: 182417 - DNA, 20 bp, human
gggaggggagggaccacgca

SEQ ID NO: 182418 - DNA, 20 bp, human
ggtcctgcgaggcaggggta

SEQ ID NO: 182419 - DNA, 20 bp, human
gccttggcctggacaaacag

SEQ ID NO: 182420 - DNA, 20 bp, human
gctgcgaggcaggggtaggg

SEQ ID NO: 182421 - DNA, 20 bp, human
gaggagttccatggagcctg

SEQ ID NO: 182422 - DNA, 20 bp, human
gggacaagggccagacaccc

SEQ ID NO: 182423 - DNA, 20 bp, human
gagatcccggtcccctgtcc

SEQ ID NO: 182424 - DNA, 20 bp, human
gtagggtggacactgtcact

SEQ ID NO: 182425 - DNA, 20 bp, human
gtcagtgagcagaaggtgag

SEQ ID NO: 182426 - DNA, 20 bp, human
gggctgtgtagaatgaggaa

SEQ ID NO: 182427 - DNA, 20 bp, human
gtgactggctgtgtagaatg

SEQ ID NO: 182428 - DNA, 20 bp, human
ggacgtacccagtatatagc

SEQ ID NO: 182429 - DNA, 20 bp, human
gatgaacttgacacaatgac

SEQ ID NO: 182430 - DNA, 20 bp, human
gtacacatacgtagctggaa

SEQ ID NO: 182431 - DNA, 20 bp, human
gtaaaattatcccaaggagg

SEQ ID NO: 182432 - DNA, 20 bp, human
gaggactgtataaatattag

SEQ ID NO: 182433 - DNA, 20 bp, human
ggtgtgtacacatacgtagc

SEQ ID NO: 182434 - DNA, 20 bp, human
ggttttgattaccactttat

SEQ ID NO: 182435 - DNA, 20 bp, human
gctccattgttaagcgacac

SEQ ID NO: 182436 - DNA, 20 bp, human
gctcgtgcccaggacaacca

SEQ ID NO: 182437 - DNA, 20 bp, human
gcagcacgcggcatccagag

SEQ ID NO: 182438 - DNA, 20 bp, human
gtgagccatggagcccactg

SEQ ID NO: 182439 - DNA, 20 bp, human
gggtgtacgtcagccacagt

SEQ ID NO: 182440 - DNA, 20 bp, human
gtccagagcggggacttcct

SEQ ID NO: 182441 - DNA, 20 bp, human
gtcccagggtgaggacgaca

SEQ ID NO: 182442 - DNA, 20 bp, human
gctggccgctcgacagcacg

SEQ ID NO: 182443 - DNA, 20 bp, human
ggatgccgcgtgctgtcgag

SEQ ID NO: 182444 - DNA, 20 bp, human
gttacccaaaaggactccca

SEQ ID NO: 182445 - DNA, 20 bp, human
ggaatcaaagggcagtgtct

SEQ ID NO: 182446 - DNA, 20 bp, human
ggtgggagcaccaggatctc

SEQ ID NO: 182447 - DNA, 20 bp, human
ggctggggcgcgggagaccg

SEQ ID NO: 182448 - DNA, 20 bp, human
ggccctgggaccgagaagag

SEQ ID NO: 182449 - DNA, 20 bp, human
gcgagactgcacggtgagtg

SEQ ID NO: 182450 - DNA, 20 bp, human
gggctcggaacgagactgca

SEQ ID NO: 182451 - DNA, 20 bp, human
gatccgaccacaccctgggt

SEQ ID NO: 182452 - DNA, 20 bp, human
gccggatccgaccacaccct

SEQ ID NO: 182453 - DNA, 20 bp, human
ggccccaaggccgaggatct

SEQ ID NO: 182454 - DNA, 20 bp, human
gagcaccaggatctcgggct

SEQ ID NO: 182455 - DNA, 20 bp, human
gcgggacgcgcccagatcct

SEQ ID NO: 182456 - DNA, 20 bp, human
gcctggtccggagcgagtct

SEQ ID NO: 182457 - DNA, 20 bp, human
gcgggaacgctaacctggtc

SEQ ID NO: 182458 - DNA, 20 bp, human
ggtcggaggcttagaggatg

SEQ ID NO: 182459 - DNA, 20 bp, human
gctgagacccagactcgctc

SEQ ID NO: 182460 - DNA, 20 bp, human
gtcgggagccagaggagccg

SEQ ID NO: 182461 - DNA, 20 bp, human
gctgcaggtcggaggcttag

SEQ ID NO: 182462 - DNA, 20 bp, human
ggaatgaggaccaagcccca

SEQ ID NO: 182463 - DNA, 20 bp, human
gagccagaggagccgaggtt

SEQ ID NO: 182464 - DNA, 20 bp, human
gctcgtgaaaggctgttcgc

SEQ ID NO: 182465 - DNA, 20 bp, human
gcggcatcgagcgcagaagg

SEQ ID NO: 182466 - DNA, 20 bp, human
ggctactgctagcaagactc

SEQ ID NO: 182467 - DNA, 20 bp, human
gtgcaggggaacaggatcgc

SEQ ID NO: 182468 - DNA, 20 bp, human
ggccgaggcggaaggggatg

SEQ ID NO: 182469 - DNA, 20 bp, human
ggagccggcgcggcgtcaag

SEQ ID NO: 182470 - DNA, 20 bp, human
gctcgggagctggctggcgg

SEQ ID NO: 182471 - DNA, 20 bp, human
ggggctgaggccgacaggca

SEQ ID NO: 182472 - DNA, 20 bp, human
gccgcagccgtgacttcctt

SEQ ID NO: 182473 - DNA, 20 bp, human
gtagcgagtgcttcgcagag

SEQ ID NO: 182474 - DNA, 20 bp, human
ggagctcggacgcacggacc

SEQ ID NO: 182475 - DNA, 20 bp, human
gaccggatgcctgaaacacg

SEQ ID NO: 182476 - DNA, 20 bp, human
gcgggaaggctaacctggtg

SEQ ID NO: 182477 - DNA, 20 bp, human
gcgcggtagctgcaggtcag

SEQ ID NO: 182478 - DNA, 20 bp, human
gcggcgccccagaaagacaa

SEQ ID NO: 182479 - DNA, 20 bp, human
gtgcagggctctgggcggga

SEQ ID NO: 182480 - DNA, 20 bp, human
gtaacggccacgggagggaa

SEQ ID NO: 182481 - DNA, 20 bp, human
gcagtctaacggccacggga

SEQ ID NO: 182482 - DNA, 20 bp, human
gccttaaagcggccagtccg

SEQ ID NO: 182483 - DNA, 20 bp, human
ggccccacaaggcccattcc

SEQ ID NO: 182484 - DNA, 20 bp, human
gactcgtgaaaggccgtacg

SEQ ID NO: 182485 - DNA, 20 bp, human
gtgggtctcagccccgcgta

SEQ ID NO: 182486 - DNA, 20 bp, human
gaccccgcccgacaactcgg

SEQ ID NO: 182487 - DNA, 20 bp, human
gccgcccgacaactcggtgg

SEQ ID NO: 182488 - DNA, 20 bp, human
gcctggggctcaccgaagcg

SEQ ID NO: 182489 - DNA, 20 bp, human
ggcctcctcccagcctcgga

SEQ ID NO: 182490 - DNA, 20 bp, human
ggaggctgggaggaggctcg

SEQ ID NO: 182491 - DNA, 20 bp, human
ggtactcgtgcgcctcgctt

SEQ ID NO: 182492 - DNA, 20 bp, human
gcgcaccccgcccgacaact

SEQ ID NO: 182493 - DNA, 20 bp, human
ggcagccgtccgaggctggg

SEQ ID NO: 182494 - DNA, 20 bp, human
gcgcgcagccgtccgaggct

SEQ ID NO: 182495 - DNA, 20 bp, human
gttcccggggagaaccactc

SEQ ID NO: 182496 - DNA, 20 bp, human
gcacccgccccgctgtctct

SEQ ID NO: 182497 - DNA, 20 bp, human
gtcccagcccagagacagcg

SEQ ID NO: 182498 - DNA, 20 bp, human
gcaagccaagagcgagcgtg

SEQ ID NO: 182499 - DNA, 20 bp, human
gtctacacggtattccacaa

SEQ ID NO: 182500 - DNA, 20 bp, human
gttgcggaggaaaagctgca

SEQ ID NO: 182501 - DNA, 20 bp, human
gtcttcctcacgctcgctct

SEQ ID NO: 182502 - DNA, 20 bp, human
gcgcgggaagaattcgggag

SEQ ID NO: 182503 - DNA, 20 bp, human
gatctttagaaaggctgggt

SEQ ID NO: 182504 - DNA, 20 bp, human
gctgggtgggagcggccggt

SEQ ID NO: 182505 - DNA, 20 bp, human
gtttgcagccaacaaacacg

SEQ ID NO: 182506 - DNA, 20 bp, human
ggtacagagacccggacagg

SEQ ID NO: 182507 - DNA, 20 bp, human
gcactttggattgctcccta

SEQ ID NO: 182508 - DNA, 20 bp, human
gatgtctgacaaacctggta

SEQ ID NO: 182509 - DNA, 20 bp, human
gcgaaacagcaggggacgga

SEQ ID NO: 182510 - DNA, 20 bp, human
gcagccatgtctgacaaacc

SEQ ID NO: 182511 - DNA, 20 bp, human
gagcgcgaaacagcagggga

SEQ ID NO: 182512 - DNA, 20 bp, human
gcgctcaaggagcagatagt

SEQ ID NO: 182513 - DNA, 20 bp, human
ggcctgcgttgtttgcagag

SEQ ID NO: 182514 - DNA, 20 bp, human
gtgagaaacagccacctgtc

SEQ ID NO: 182515 - DNA, 20 bp, human
gggctggcttggaagagaat

SEQ ID NO: 182516 - DNA, 20 bp, human
gagacgcccgggagaggcca

SEQ ID NO: 182517 - DNA, 20 bp, human
gggaccgcacaccctcccgg

SEQ ID NO: 182518 - DNA, 20 bp, human
gagggacgggcggagggtag

SEQ ID NO: 182519 - DNA, 20 bp, human
gcagggagcggccgtagcac

SEQ ID NO: 182520 - DNA, 20 bp, human
gctccgcccgtccctcggac

SEQ ID NO: 182521 - DNA, 20 bp, human
gggtgaggacgcagagcggc

SEQ ID NO: 182522 - DNA, 20 bp, human
gccatgcccgagcccccctc

SEQ ID NO: 182523 - DNA, 20 bp, human
ggatgccagacgcccgggag

SEQ ID NO: 182524 - DNA, 20 bp, human
gtagcacaggcagcttgccc

SEQ ID NO: 182525 - DNA, 20 bp, human
gccgccgccgggagggtgtg

SEQ ID NO: 182526 - DNA, 20 bp, human
gctcagggtgttgagataca

SEQ ID NO: 182527 - DNA, 20 bp, human
gggctcggctcccagcgcga

SEQ ID NO: 182528 - DNA, 20 bp, human
ggggcgtcctaggtgaggag

SEQ ID NO: 182529 - DNA, 20 bp, human
gcccagagcccggcttggtc

SEQ ID NO: 182530 - DNA, 20 bp, human
gctaggtgaggagtgggact

SEQ ID NO: 182531 - DNA, 20 bp, human
gcagagggaccggaccaagc

SEQ ID NO: 182532 - DNA, 20 bp, human
gctctccaccgccttccctc

SEQ ID NO: 182533 - DNA, 20 bp, human
ggttggtgagcagcgctctg

SEQ ID NO: 182534 - DNA, 20 bp, human
ggtggattggaaggacccga

SEQ ID NO: 182535 - DNA, 20 bp, human
ggggagccgagccggaggga

SEQ ID NO: 182536 - DNA, 20 bp, human
gtaagactgcgacggtaccg

SEQ ID NO: 182537 - DNA, 20 bp, human
ggcggggaaggaccgagagg

SEQ ID NO: 182538 - DNA, 20 bp, human
ggactgcgacggtaccgggg

SEQ ID NO: 182539 - DNA, 20 bp, human
gggctcaggcgcctgcaaac

SEQ ID NO: 182540 - DNA, 20 bp, human
gcatattgggaggaattgag

SEQ ID NO: 182541 - DNA, 20 bp, human
gcaaactggtggcctgaacg

SEQ ID NO: 182542 - DNA, 20 bp, human
gcgcccccaaacgaggatca

SEQ ID NO: 182543 - DNA, 20 bp, human
gtaaagtcaaggctctagag

SEQ ID NO: 182544 - DNA, 20 bp, human
gacgaggtagaccatgactg

SEQ ID NO: 182545 - DNA, 20 bp, human
gagaggaggtaaggcgctcc

SEQ ID NO: 182546 - DNA, 20 bp, human
gccgggtgcggaaactctgg

SEQ ID NO: 182547 - DNA, 20 bp, human
gagagtttccgcacccggga

SEQ ID NO: 182548 - DNA, 20 bp, human
gctgcggcgcgtccccggag

SEQ ID NO: 182549 - DNA, 20 bp, human
gcgggagggagatgcggccg

SEQ ID NO: 182550 - DNA, 20 bp, human
ggccccgcgcgttacctgca

SEQ ID NO: 182551 - DNA, 20 bp, human
gtccccctgccaggtccggg

SEQ ID NO: 182552 - DNA, 20 bp, human
gtgcggggctcgggacacgg

SEQ ID NO: 182553 - DNA, 20 bp, human
gggagatgcggccggggctc

SEQ ID NO: 182554 - DNA, 20 bp, human
gcccctgagcttctccgccc

SEQ ID NO: 182555 - DNA, 20 bp, human
gctggccgcggcgcaggcga

SEQ ID NO: 182556 - DNA, 20 bp, human
gagacacactggggtgaagt

SEQ ID NO: 182557 - DNA, 20 bp, human
gagctccatcgcggcccctc

SEQ ID NO: 182558 - DNA, 20 bp, human
gccgcccggaagtgcccgag

SEQ ID NO: 182559 - DNA, 20 bp, human
gcggcccctcgggcacttcc

SEQ ID NO: 182560 - DNA, 20 bp, human
gaggtgaaccgtaacgcggg

SEQ ID NO: 182561 - DNA, 20 bp, human
gttcacctaaaccccacccg

SEQ ID NO: 182562 - DNA, 20 bp, human
ggtggctccagattgcccag

SEQ ID NO: 182563 - DNA, 20 bp, human
gcagagaagccggtaccctg

SEQ ID NO: 182564 - DNA, 20 bp, human
gggcggggtgggcgcggtca

SEQ ID NO: 182565 - DNA, 20 bp, human
gtcccctcaaccccactccg

SEQ ID NO: 182566 - DNA, 20 bp, human
gtacggacagggtagatcac

SEQ ID NO: 182567 - DNA, 20 bp, human
gggagtagggtcggctaagg

SEQ ID NO: 182568 - DNA, 20 bp, human
gtgaggagtagggtcggcta

SEQ ID NO: 182569 - DNA, 20 bp, human
ggacagagcaaagacccctg

SEQ ID NO: 182570 - DNA, 20 bp, human
ggtgataagaccagttgtcc

SEQ ID NO: 182571 - DNA, 20 bp, human
gtgcggtcacggtacggaca

SEQ ID NO: 182572 - DNA, 20 bp, human
gtgggcccacccgaaccgaa

SEQ ID NO: 182573 - DNA, 20 bp, human
ggacacagggaactctcgtg

SEQ ID NO: 182574 - DNA, 20 bp, human
gacaactggtcttatcacgg

SEQ ID NO: 182575 - DNA, 20 bp, human
ggtgaccgcacggtgaggag

SEQ ID NO: 182576 - DNA, 20 bp, human
gaccgcgctccctgtgaggt

SEQ ID NO: 182577 - DNA, 20 bp, human
gtcacgggtaagagacgagg

SEQ ID NO: 182578 - DNA, 20 bp, human
gcgccgcttgcccacctcac

SEQ ID NO: 182579 - DNA, 20 bp, human
gaggtgggcaagcggcgaaa

SEQ ID NO: 182580 - DNA, 20 bp, human
gtgcgaccgcgctccctgtg

SEQ ID NO: 182581 - DNA, 20 bp, human
gcgctcgctccgcaactcgg

SEQ ID NO: 182582 - DNA, 20 bp, human
gtggggagctgcagaagtcg

SEQ ID NO: 182583 - DNA, 20 bp, human
ggcccacctcacagggagcg

SEQ ID NO: 182584 - DNA, 20 bp, human
ggaagaaacttaacattcac

SEQ ID NO: 182585 - DNA, 20 bp, human
gcattcacgggtaagagacg

SEQ ID NO: 182586 - DNA, 20 bp, human
gcggcgagcagtggccgtta

SEQ ID NO: 182587 - DNA, 20 bp, human
ggttacggccgaaaagatgg

SEQ ID NO: 182588 - DNA, 20 bp, human
gcgagccatcgtgaaagtcg

SEQ ID NO: 182589 - DNA, 20 bp, human
ggccgaaaagatggcggtct

SEQ ID NO: 182590 - DNA, 20 bp, human
gaatacacgagagcaattag

SEQ ID NO: 182591 - DNA, 20 bp, human
ggacagaaggtagtaaggtt

SEQ ID NO: 182592 - DNA, 20 bp, human
gctcagagaggtaaacccca

SEQ ID NO: 182593 - DNA, 20 bp, human
ggggccgacagaaggtagta

SEQ ID NO: 182594 - DNA, 20 bp, human
gctgttgggccgttgtgcat

SEQ ID NO: 182595 - DNA, 20 bp, human
ggccgttacggccgaaaaga

SEQ ID NO: 182596 - DNA, 20 bp, human
gaaacggagccgacccggag

SEQ ID NO: 182597 - DNA, 20 bp, human
ggacgctgccgggaatgggt

SEQ ID NO: 182598 - DNA, 20 bp, human
gccggaccaatgctggacgt

SEQ ID NO: 182599 - DNA, 20 bp, human
gagcaccgcgctaactacgg

SEQ ID NO: 182600 - DNA, 20 bp, human
gccgcctgcccgcccggaaa

SEQ ID NO: 182601 - DNA, 20 bp, human
gcagcattggtccggcacag

SEQ ID NO: 182602 - DNA, 20 bp, human
gccaatgctggacgtgggaa

SEQ ID NO: 182603 - DNA, 20 bp, human
gtctgcgccacaggtaatgg

SEQ ID NO: 182604 - DNA, 20 bp, human
gcattggtccggcacagcgg

SEQ ID NO: 182605 - DNA, 20 bp, human
ggcccgcccggaaagggaaa

SEQ ID NO: 182606 - DNA, 20 bp, human
ggcctagcggcgcagactgg

SEQ ID NO: 182607 - DNA, 20 bp, human
gaaggaagcgggagacgcaa

SEQ ID NO: 182608 - DNA, 20 bp, human
gagtctgcgccgctaggcgt

SEQ ID NO: 182609 - DNA, 20 bp, human
gtaagaggtggcgtcctccg

SEQ ID NO: 182610 - DNA, 20 bp, human
gccaccccgcctacgcctag

SEQ ID NO: 182611 - DNA, 20 bp, human
gtgttggcaagcctggtccg

SEQ ID NO: 182612 - DNA, 20 bp, human
gggcaagcggcgataagagg

SEQ ID NO: 182613 - DNA, 20 bp, human
gtgggctcaacctaaaaccc

SEQ ID NO: 182614 - DNA, 20 bp, human
ggacgcccgcgaggacactg

SEQ ID NO: 182615 - DNA, 20 bp, human
ggcttccttgaaaaacccgg

SEQ ID NO: 182616 - DNA, 20 bp, human
gtatctgcgcgcgggagagg

SEQ ID NO: 182617 - DNA, 20 bp, human
gtacacgcccccgcctccgt

SEQ ID NO: 182618 - DNA, 20 bp, human
gaatcagccagactagaagt

SEQ ID NO: 182619 - DNA, 20 bp, human
ggtgtatctgcgcgcgggag

SEQ ID NO: 182620 - DNA, 20 bp, human
ggctgcctttgtgcccacgg

SEQ ID NO: 182621 - DNA, 20 bp, human
ggcgaggcgtcccattacag

SEQ ID NO: 182622 - DNA, 20 bp, human
gtatataagccagccaaagt

SEQ ID NO: 182623 - DNA, 20 bp, human
gtttgtgcccacggaggcgg

SEQ ID NO: 182624 - DNA, 20 bp, human
gggcgtcccattacagagga

SEQ ID NO: 182625 - DNA, 20 bp, human
gtaaggatctctagtgatga

SEQ ID NO: 182626 - DNA, 20 bp, human
gagatgtgcgctgataggga

SEQ ID NO: 182627 - DNA, 20 bp, human
gctgcctggcagcttgtcag

SEQ ID NO: 182628 - DNA, 20 bp, human
gggcgctccccaagaagaca

SEQ ID NO: 182629 - DNA, 20 bp, human
gtggagtgatcggcccccag

SEQ ID NO: 182630 - DNA, 20 bp, human
gggaaatggagacgcaagag

SEQ ID NO: 182631 - DNA, 20 bp, human
gcaggggatgtggcgtctga

SEQ ID NO: 182632 - DNA, 20 bp, human
ggcgcctgccacgatcagga

SEQ ID NO: 182633 - DNA, 20 bp, human
gggtggcgcctgccacgatc

SEQ ID NO: 182634 - DNA, 20 bp, human
gctgagggttgttttcaggg

SEQ ID NO: 182635 - DNA, 20 bp, human
gtgggagagtggatgaaggc

SEQ ID NO: 182636 - DNA, 20 bp, human
gacagcttgggactgctgag

SEQ ID NO: 182637 - DNA, 20 bp, human
gggcggctgcaggctagggg

SEQ ID NO: 182638 - DNA, 20 bp, human
ggcaggcggctgcaggctag

SEQ ID NO: 182639 - DNA, 20 bp, human
gaagctgagggctagagtgg

SEQ ID NO: 182640 - DNA, 20 bp, human
gcggctctcaccgtccccgg

SEQ ID NO: 182641 - DNA, 20 bp, human
gcagccgcggaggtggaaag

SEQ ID NO: 182642 - DNA, 20 bp, human
gggctgggcagcactccggg

SEQ ID NO: 182643 - DNA, 20 bp, human
gggatgtgagctcacagctt

SEQ ID NO: 182644 - DNA, 20 bp, human
ggtcagacacggaggacggc

SEQ ID NO: 182645 - DNA, 20 bp, human
gctctcagctgggtggccag

SEQ ID NO: 182646 - DNA, 20 bp, human
gaatggacgtgtggaagcgg

SEQ ID NO: 182647 - DNA, 20 bp, human
ggcggcggggaatggacgtg

SEQ ID NO: 182648 - DNA, 20 bp, human
gtggctcgccttccccgtca

SEQ ID NO: 182649 - DNA, 20 bp, human
ggtggacatcagccctgacg

SEQ ID NO: 182650 - DNA, 20 bp, human
ggcccgggtgtcctcatcgg

SEQ ID NO: 182651 - DNA, 20 bp, human
gtcccccgatgaggacaccc

SEQ ID NO: 182652 - DNA, 20 bp, human
gcggcctggcctcggggtag

SEQ ID NO: 182653 - DNA, 20 bp, human
gggaaggcgagccaggtcag

SEQ ID NO: 182654 - DNA, 20 bp, human
gcgtgcccgggtgtcctcat

SEQ ID NO: 182655 - DNA, 20 bp, human
ggaggtcacttaccgtgtcc

SEQ ID NO: 182656 - DNA, 20 bp, human
ggcgagcttggagcccgcgg

SEQ ID NO: 182657 - DNA, 20 bp, human
gcagtctgcagtcttcgtgg

SEQ ID NO: 182658 - DNA, 20 bp, human
gtcgggctcaccgcagtcaa

SEQ ID NO: 182659 - DNA, 20 bp, human
ggcgcagtctgcagtcttcg

SEQ ID NO: 182660 - DNA, 20 bp, human
ggctcgctcgctggcagggt

SEQ ID NO: 182661 - DNA, 20 bp, human
gcaagcgagcttggagcccg

SEQ ID NO: 182662 - DNA, 20 bp, human
gcccgcatacaactgaaacg

SEQ ID NO: 182663 - DNA, 20 bp, human
ggtagacggtgccagcccgg

SEQ ID NO: 182664 - DNA, 20 bp, human
gagggctgcgggtgcatgtt

SEQ ID NO: 182665 - DNA, 20 bp, human
gaagtcccaagtcctggtca

SEQ ID NO: 182666 - DNA, 20 bp, human
gtgaagtaacagcctgttag

SEQ ID NO: 182667 - DNA, 20 bp, human
gcagatgtagtagtacagtg

SEQ ID NO: 182668 - DNA, 20 bp, human
gtttgtgagcagcccctaac

SEQ ID NO: 182669 - DNA, 20 bp, human
gtgggaagacactcaaggat

SEQ ID NO: 182670 - DNA, 20 bp, human
gacaagaggctcatgagtga

SEQ ID NO: 182671 - DNA, 20 bp, human
gaaaagcgtatgtattccaa

SEQ ID NO: 182672 - DNA, 20 bp, human
ggcttaggaaagatagcctt

SEQ ID NO: 182673 - DNA, 20 bp, human
gtacttatttctcttgctat

SEQ ID NO: 182674 - DNA, 20 bp, human
gaattgacattctcaacaag

SEQ ID NO: 182675 - DNA, 20 bp, human
gattctttaaatcatggaga

SEQ ID NO: 182676 - DNA, 20 bp, human
ggagccggcgggagaaaagg

SEQ ID NO: 182677 - DNA, 20 bp, human
gggtcgccctgaataggtaa

SEQ ID NO: 182678 - DNA, 20 bp, human
ggagttctctgctctctcgg

SEQ ID NO: 182679 - DNA, 20 bp, human
gtgaggctcacggcaggagg

SEQ ID NO: 182680 - DNA, 20 bp, human
gttagagccggcgggagaaa

SEQ ID NO: 182681 - DNA, 20 bp, human
ggccaagcgcgggttagagc

SEQ ID NO: 182682 - DNA, 20 bp, human
gtctaacccgcgcttggcta

SEQ ID NO: 182683 - DNA, 20 bp, human
gttaagaggtcgccctgaat

SEQ ID NO: 182684 - DNA, 20 bp, human
gaagcgcgggttagagccgg

SEQ ID NO: 182685 - DNA, 20 bp, human
gcgcgcttggctaaggtccg

SEQ ID NO: 182686 - DNA, 20 bp, human
gcgaactaggcccatttcct

SEQ ID NO: 182687 - DNA, 20 bp, human
ggtccgtccagccgcctccg

SEQ ID NO: 182688 - DNA, 20 bp, human
gcaacggccccggcccacgg

SEQ ID NO: 182689 - DNA, 20 bp, human
gcggccccggcccacggagg

SEQ ID NO: 182690 - DNA, 20 bp, human
gaccgcctggaatgccctca

SEQ ID NO: 182691 - DNA, 20 bp, human
gcggctggacggacccccga

SEQ ID NO: 182692 - DNA, 20 bp, human
ggcggccctacagttaaagg

SEQ ID NO: 182693 - DNA, 20 bp, human
gcccccgacggttggacgta

SEQ ID NO: 182694 - DNA, 20 bp, human
gaccctgagggcattccagg

SEQ ID NO: 182695 - DNA, 20 bp, human
gcgagatgcgctgaaatggg

SEQ ID NO: 182696 - DNA, 20 bp, human
gggccaggccagaggatcat

SEQ ID NO: 182697 - DNA, 20 bp, human
gagctttccgggaacatcca

SEQ ID NO: 182698 - DNA, 20 bp, human
gcacccagcacagcaggtga

SEQ ID NO: 182699 - DNA, 20 bp, human
gaggccagaggatcataggg

SEQ ID NO: 182700 - DNA, 20 bp, human
gtcccggaaagcttacagaa

SEQ ID NO: 182701 - DNA, 20 bp, human
gctgggtaacaggaaggcca

SEQ ID NO: 182702 - DNA, 20 bp, human
gtagactttaggggtaatgg

SEQ ID NO: 182703 - DNA, 20 bp, human
gggaggaaggaaggctcaca

SEQ ID NO: 182704 - DNA, 20 bp, human
gccagagggagagtatggcc

SEQ ID NO: 182705 - DNA, 20 bp, human
gtaggcggggctcaaggggt

SEQ ID NO: 182706 - DNA, 20 bp, human
gggccaggccagaggatcat

SEQ ID NO: 182707 - DNA, 20 bp, human
gagctttccgggaacatcca

SEQ ID NO: 182708 - DNA, 20 bp, human
gcacccagcacagcaggtga

SEQ ID NO: 182709 - DNA, 20 bp, human
gaggccagaggatcataggg

SEQ ID NO: 182710 - DNA, 20 bp, human
gtcccggaaagcttacagaa

SEQ ID NO: 182711 - DNA, 20 bp, human
gctgggtaacaggaaggcca

SEQ ID NO: 182712 - DNA, 20 bp, human
gtagactttaggggtaatgg

SEQ ID NO: 182713 - DNA, 20 bp, human
gggaggaaggaaggctcaca

SEQ ID NO: 182714 - DNA, 20 bp, human
gccagagggagagtatggcc

SEQ ID NO: 182715 - DNA, 20 bp, human
gtaggcggggctcaaggggt

SEQ ID NO: 182716 - DNA, 20 bp, human
gcccttccaggccaagactg

SEQ ID NO: 182717 - DNA, 20 bp, human
gcgcgcgcccaagtgcaatg

SEQ ID NO: 182718 - DNA, 20 bp, human
gtcgcctcgcgcgcaggcac

SEQ ID NO: 182719 - DNA, 20 bp, human
ggtcttggcctggaaggggt

SEQ ID NO: 182720 - DNA, 20 bp, human
gtgaccgccgcaggtaccta

SEQ ID NO: 182721 - DNA, 20 bp, human
gcgcgacggcccaggcgggt

SEQ ID NO: 182722 - DNA, 20 bp, human
gattccggggagcagagcga

SEQ ID NO: 182723 - DNA, 20 bp, human
gcgcggcccctaggtacctg

SEQ ID NO: 182724 - DNA, 20 bp, human
gggcccctaggtacctgcgg

SEQ ID NO: 182725 - DNA, 20 bp, human
ggaggctggggcatgaaatc

SEQ ID NO: 182726 - DNA, 20 bp, human
gcaccagctagagtacatct

SEQ ID NO: 182727 - DNA, 20 bp, human
gaggcgctcggtggacggat

SEQ ID NO: 182728 - DNA, 20 bp, human
ggtgctgtcccatggaggta

SEQ ID NO: 182729 - DNA, 20 bp, human
gactcgcccggtagtgacgg

SEQ ID NO: 182730 - DNA, 20 bp, human
ggagcgctccctacctccat

SEQ ID NO: 182731 - DNA, 20 bp, human
gcttgtggcggggcatgtcc

SEQ ID NO: 182732 - DNA, 20 bp, human
gggcaggaggagcccgtcgt

SEQ ID NO: 182733 - DNA, 20 bp, human
gtgcaggtgagtccccaccg

SEQ ID NO: 182734 - DNA, 20 bp, human
ggctgcttcttggattgacc

SEQ ID NO: 182735 - DNA, 20 bp, human
gcccaggcaggaccgcggtg

SEQ ID NO: 182736 - DNA, 20 bp, human
gggcaagacgcaccagtcgt

SEQ ID NO: 182737 - DNA, 20 bp, human
gagagatgggtccccgggtt

SEQ ID NO: 182738 - DNA, 20 bp, human
gaaagtagatcgggcatcgt

SEQ ID NO: 182739 - DNA, 20 bp, human
ggcggcgacaacgagcacaa

SEQ ID NO: 182740 - DNA, 20 bp, human
gggacacataaatcagcacg

SEQ ID NO: 182741 - DNA, 20 bp, human
ggtcgctcctgcccaacccg

SEQ ID NO: 182742 - DNA, 20 bp, human
gtatagtctctcaggcccgt

SEQ ID NO: 182743 - DNA, 20 bp, human
gttgtgggcgcagagattgc

SEQ ID NO: 182744 - DNA, 20 bp, human
gtcagcccttaaagtagatc

SEQ ID NO: 182745 - DNA, 20 bp, human
gacgcaccagtcgtcggagt

SEQ ID NO: 182746 - DNA, 20 bp, human
ggctgccccgagcccgcgaa

SEQ ID NO: 182747 - DNA, 20 bp, human
gcccagagttccctaacggt

SEQ ID NO: 182748 - DNA, 20 bp, human
gtgagttcgtgcgcgtggag

SEQ ID NO: 182749 - DNA, 20 bp, human
gccgcctctctgctccctcg

SEQ ID NO: 182750 - DNA, 20 bp, human
ggcccggccgcaggtgacca

SEQ ID NO: 182751 - DNA, 20 bp, human
gaaaatctatcagaaatcgt

SEQ ID NO: 182752 - DNA, 20 bp, human
gggcgtcgggaaccatacca

SEQ ID NO: 182753 - DNA, 20 bp, human
ggccccgagcccgcgaaggg

SEQ ID NO: 182754 - DNA, 20 bp, human
gacagctgcactgccagaat

SEQ ID NO: 182755 - DNA, 20 bp, human
gagtttgaccagagatgcaa

SEQ ID NO: 182756 - DNA, 20 bp, human
ggtatggaggaaccctacag

SEQ ID NO: 182757 - DNA, 20 bp, human
gtcaggagagagcaggcggt

SEQ ID NO: 182758 - DNA, 20 bp, human
gcaagcgagtctcacgctgg

SEQ ID NO: 182759 - DNA, 20 bp, human
gacccacccggggagtatgg

SEQ ID NO: 182760 - DNA, 20 bp, human
gggacaagcgagtctcacgc

SEQ ID NO: 182761 - DNA, 20 bp, human
gaaaatgggtgagagtccaa

SEQ ID NO: 182762 - DNA, 20 bp, human
gagggctgagaacccacccg

SEQ ID NO: 182763 - DNA, 20 bp, human
gcaggcccagaacccagcgg

SEQ ID NO: 182764 - DNA, 20 bp, human
gctggtcatcaggagagagc

SEQ ID NO: 182765 - DNA, 20 bp, human
gtcctccatactccccgggt

SEQ ID NO: 182766 - DNA, 20 bp, human
ggaccgcggcggagactcac

SEQ ID NO: 182767 - DNA, 20 bp, human
gcgccgcacgggacagccag

SEQ ID NO: 182768 - DNA, 20 bp, human
gtcggagtcaggggaagagt

SEQ ID NO: 182769 - DNA, 20 bp, human
gtgcacgcgcacaaactacg

SEQ ID NO: 182770 - DNA, 20 bp, human
gagcgtcgggaaccagacca

SEQ ID NO: 182771 - DNA, 20 bp, human
gaggagggcccaggttgtgt

SEQ ID NO: 182772 - DNA, 20 bp, human
ggcagagcgcgcgctccccc

SEQ ID NO: 182773 - DNA, 20 bp, human
gggaggagcacgttctattc

SEQ ID NO: 182774 - DNA, 20 bp, human
gcgcgcgctctgctccctcg

SEQ ID NO: 182775 - DNA, 20 bp, human
gcctgctcgagcgctcgagg

SEQ ID NO: 182776 - DNA, 20 bp, human
gcagcagcgcgaacagcggg

SEQ ID NO: 182777 - DNA, 20 bp, human
gcgcgcccgctgggccacag

SEQ ID NO: 182778 - DNA, 20 bp, human
gcaaagcctgcggctaagag

SEQ ID NO: 182779 - DNA, 20 bp, human
gcccggcgcaagcgcttagt

SEQ ID NO: 182780 - DNA, 20 bp, human
gccgcgggagacagcgccgt

SEQ ID NO: 182781 - DNA, 20 bp, human
gacagaggccgctgaggccg

SEQ ID NO: 182782 - DNA, 20 bp, human
gcggaggccgtgggaagctg

SEQ ID NO: 182783 - DNA, 20 bp, human
gggctcctctcggaaggcgg

SEQ ID NO: 182784 - DNA, 20 bp, human
ggccagcctgtcccgcgcca

SEQ ID NO: 182785 - DNA, 20 bp, human
gaggcgcttccagagttgga

SEQ ID NO: 182786 - DNA, 20 bp, human
gtggtccccggaaacctcag

SEQ ID NO: 182787 - DNA, 20 bp, human
ggatagtatggactacatga

SEQ ID NO: 182788 - DNA, 20 bp, human
gctcaggggcttggaggcgg

SEQ ID NO: 182789 - DNA, 20 bp, human
gtataacgtgatgagcgcac

SEQ ID NO: 182790 - DNA, 20 bp, human
gcaagcccctgaggtttccg

SEQ ID NO: 182791 - DNA, 20 bp, human
gctaaccccaagcctctcct

SEQ ID NO: 182792 - DNA, 20 bp, human
ggcgtaaaaggacaccctag

SEQ ID NO: 182793 - DNA, 20 bp, human
gtctcctgggagggagcgag

SEQ ID NO: 182794 - DNA, 20 bp, human
ggtgatgagcgcacgggctg

SEQ ID NO: 182795 - DNA, 20 bp, human
ggcgctcgtggtaagtccct

SEQ ID NO: 182796 - DNA, 20 bp, human
ggggcgcaggacgtgcacta

SEQ ID NO: 182797 - DNA, 20 bp, human
gggacgtgcactatggctcg

SEQ ID NO: 182798 - DNA, 20 bp, human
gggatgtttagtctaggaag

SEQ ID NO: 182799 - DNA, 20 bp, human
gaggccgtcgagaggcacta

SEQ ID NO: 182800 - DNA, 20 bp, human
gctcgctgcgccggttgctg

SEQ ID NO: 182801 - DNA, 20 bp, human
gccccagcctggtccgtaca

SEQ ID NO: 182802 - DNA, 20 bp, human
gcccaactcgtcgatcactg

SEQ ID NO: 182803 - DNA, 20 bp, human
ggggctagttagaccctgta

SEQ ID NO: 182804 - DNA, 20 bp, human
ggttagaccctgtacggacc

SEQ ID NO: 182805 - DNA, 20 bp, human
ggccccagtgatcgacgagt

SEQ ID NO: 182806 - DNA, 20 bp, human
ggcgctcctcctggtccaca

SEQ ID NO: 182807 - DNA, 20 bp, human
gcccaggccactcattactc

SEQ ID NO: 182808 - DNA, 20 bp, human
gcgaggtggccggagccgtg

SEQ ID NO: 182809 - DNA, 20 bp, human
gaagcatcctgagtaatgag

SEQ ID NO: 182810 - DNA, 20 bp, human
gccggagcaggcgaggtggc

SEQ ID NO: 182811 - DNA, 20 bp, human
gaggagcgctgtgagtagcc

SEQ ID NO: 182812 - DNA, 20 bp, human
gtccgtgacagaagccactg

SEQ ID NO: 182813 - DNA, 20 bp, human
gctggaccttgcaaccccca

SEQ ID NO: 182814 - DNA, 20 bp, human
gctactcacagcgctcctcc

SEQ ID NO: 182815 - DNA, 20 bp, human
ggcgctgtgagtagccgggc

SEQ ID NO: 182816 - DNA, 20 bp, human
gcggcggcgtcggcaccatg

SEQ ID NO: 182817 - DNA, 20 bp, human
ggcacaagctgcggggactg

SEQ ID NO: 182818 - DNA, 20 bp, human
gagggctgaaaggaccctgt

SEQ ID NO: 182819 - DNA, 20 bp, human
ggcagcttgtgcggcggcgt

SEQ ID NO: 182820 - DNA, 20 bp, human
ggctgcttcgggaggggaca

SEQ ID NO: 182821 - DNA, 20 bp, human
gcaccatgaggcgagggccc

SEQ ID NO: 182822 - DNA, 20 bp, human
gcgtcggcaccatgaggcga

SEQ ID NO: 182823 - DNA, 20 bp, human
gagcactcggccgggacgca

SEQ ID NO: 182824 - DNA, 20 bp, human
gcgagggccccggagcctgc

SEQ ID NO: 182825 - DNA, 20 bp, human
gctccggggccctcgcctca

SEQ ID NO: 182826 - DNA, 20 bp, human
gcagctgcccgtggacggag

SEQ ID NO: 182827 - DNA, 20 bp, human
gcccacatccggccaaatgg

SEQ ID NO: 182828 - DNA, 20 bp, human
gggaggaggtctgctgggta

SEQ ID NO: 182829 - DNA, 20 bp, human
gcggatgtgggcacttctgg

SEQ ID NO: 182830 - DNA, 20 bp, human
ggcaggatgaactccagcag

SEQ ID NO: 182831 - DNA, 20 bp, human
gccatgcctcaggctcagac

SEQ ID NO: 182832 - DNA, 20 bp, human
gagcaggtgacccaactccc

SEQ ID NO: 182833 - DNA, 20 bp, human
gcactgggctcaccacagtg

SEQ ID NO: 182834 - DNA, 20 bp, human
gtggacgccggagccagcaa

SEQ ID NO: 182835 - DNA, 20 bp, human
gctcaccagctgcccgtgga

SEQ ID NO: 182836 - DNA, 20 bp, human
ggctcttgctgcatttgctc

SEQ ID NO: 182837 - DNA, 20 bp, human
gaacgctgacatgttagagg

SEQ ID NO: 182838 - DNA, 20 bp, human
gctgcttcgtgggttcttac

SEQ ID NO: 182839 - DNA, 20 bp, human
gtgaacttcgcctgcttcgt

SEQ ID NO: 182840 - DNA, 20 bp, human
gagatattacttgtccttcc

SEQ ID NO: 182841 - DNA, 20 bp, human
gaataacgctgacatgttag

SEQ ID NO: 182842 - DNA, 20 bp, human
gtgcttgaacgattattcat

SEQ ID NO: 182843 - DNA, 20 bp, human
gttcagagaatcaacataat

SEQ ID NO: 182844 - DNA, 20 bp, human
gtcttgaatcaaaaagagaa

SEQ ID NO: 182845 - DNA, 20 bp, human
gggggctgtctgtgtcttcg

SEQ ID NO: 182846 - DNA, 20 bp, human
ggtgggagcgccctcaagag

SEQ ID NO: 182847 - DNA, 20 bp, human
gagcagcgccaggccgcaca

SEQ ID NO: 182848 - DNA, 20 bp, human
gcgcggaagccgggatgggt

SEQ ID NO: 182849 - DNA, 20 bp, human
ggctgaggtctaaggagggt

SEQ ID NO: 182850 - DNA, 20 bp, human
gggcgtgtccaactggctgt

SEQ ID NO: 182851 - DNA, 20 bp, human
gggctcttgaaacccgagca

SEQ ID NO: 182852 - DNA, 20 bp, human
ggcagcgggagccttccgga

SEQ ID NO: 182853 - DNA, 20 bp, human
ggcacccgggacccccggtg

SEQ ID NO: 182854 - DNA, 20 bp, human
gtggcacagcacggggcgat

SEQ ID NO: 182855 - DNA, 20 bp, human
gcccgtgctgtgccatgctc

SEQ ID NO: 182856 - DNA, 20 bp, human
gcgcggagcagtcctggtta

SEQ ID NO: 182857 - DNA, 20 bp, human
gacccagcggggatccacca

SEQ ID NO: 182858 - DNA, 20 bp, human
ggccggagcccgaggctcag

SEQ ID NO: 182859 - DNA, 20 bp, human
ggccgggctacgggagagcg

SEQ ID NO: 182860 - DNA, 20 bp, human
gagtggaggcggccgcccta

SEQ ID NO: 182861 - DNA, 20 bp, human
ggcagggcgcggggttgcat

SEQ ID NO: 182862 - DNA, 20 bp, human
gcacggtgtgcacgctggac

SEQ ID NO: 182863 - DNA, 20 bp, human
gcgcgacctggactcctatc

SEQ ID NO: 182864 - DNA, 20 bp, human
gatatcccggataggagtcc

SEQ ID NO: 182865 - DNA, 20 bp, human
gtgacaggcggcgaggcggt

SEQ ID NO: 182866 - DNA, 20 bp, human
gacagtccacaacacagctt

SEQ ID NO: 182867 - DNA, 20 bp, human
gatcagttgctgaacatcaa

SEQ ID NO: 182868 - DNA, 20 bp, human
gtggttcccaagctgtgttg

SEQ ID NO: 182869 - DNA, 20 bp, human
gagccactcagcccaagcat

SEQ ID NO: 182870 - DNA, 20 bp, human
ggagtctgtggactaggagg

SEQ ID NO: 182871 - DNA, 20 bp, human
gaaagagtctgtggactagg

SEQ ID NO: 182872 - DNA, 20 bp, human
ggagaaactaagttgctgaa

SEQ ID NO: 182873 - DNA, 20 bp, human
ggattcactgatcagattac

SEQ ID NO: 182874 - DNA, 20 bp, human
gaattaaccatgcagatcaa

SEQ ID NO: 182875 - DNA, 20 bp, human
ggttgctgaacatcaaaggc

SEQ ID NO: 182876 - DNA, 20 bp, human
gtgaatggggaaccccacac

SEQ ID NO: 182877 - DNA, 20 bp, human
gctgccctgagcccaaatgg

SEQ ID NO: 182878 - DNA, 20 bp, human
gttgtccctggtctcaccag

SEQ ID NO: 182879 - DNA, 20 bp, human
ggaaccccaaaggccagaac

SEQ ID NO: 182880 - DNA, 20 bp, human
gccagtggcagcagcaggtc

SEQ ID NO: 182881 - DNA, 20 bp, human
ggcgcagcccctactccaaa

SEQ ID NO: 182882 - DNA, 20 bp, human
gcagcccctactccaaaagg

SEQ ID NO: 182883 - DNA, 20 bp, human
gggcccatgccagacagcta

SEQ ID NO: 182884 - DNA, 20 bp, human
gcagttgagggttgagactc

SEQ ID NO: 182885 - DNA, 20 bp, human
gtcctgcccgggcctggtcc

SEQ ID NO: 182886 - DNA, 20 bp, human
gtgcgctcgcggaggaacca

SEQ ID NO: 182887 - DNA, 20 bp, human
gcgagggctagcgagcgcag

SEQ ID NO: 182888 - DNA, 20 bp, human
ggtcacgacgcgggtaagag

SEQ ID NO: 182889 - DNA, 20 bp, human
gccgggcccggagtccccag

SEQ ID NO: 182890 - DNA, 20 bp, human
gcgggtaagaggggcttcgg

SEQ ID NO: 182891 - DNA, 20 bp, human
gggctttcgctttcagtcga

SEQ ID NO: 182892 - DNA, 20 bp, human
gtgactcgcgcggcccacgg

SEQ ID NO: 182893 - DNA, 20 bp, human
gcccggcacacgtgcgctcg

SEQ ID NO: 182894 - DNA, 20 bp, human
gcttacccgcgtcgtgacag

SEQ ID NO: 182895 - DNA, 20 bp, human
gtgcgctcggggcacaactc

SEQ ID NO: 182896 - DNA, 20 bp, human
gggagcccgggagcacatgc

SEQ ID NO: 182897 - DNA, 20 bp, human
ggaggccagtgagagctcaa

SEQ ID NO: 182898 - DNA, 20 bp, human
gccaccggctgggcagtatg

SEQ ID NO: 182899 - DNA, 20 bp, human
ggcttccatgggaacatcag

SEQ ID NO: 182900 - DNA, 20 bp, human
gttagctcctgggggagtca

SEQ ID NO: 182901 - DNA, 20 bp, human
ggcagcacatctgagctgtc

SEQ ID NO: 182902 - DNA, 20 bp, human
gtgagccggcatgtgctccc

SEQ ID NO: 182903 - DNA, 20 bp, human
gagcctaaattagctcctgg

SEQ ID NO: 182904 - DNA, 20 bp, human
ggtacacacacgctcctcca

SEQ ID NO: 182905 - DNA, 20 bp, human
gtgggccagtgcatagaact

SEQ ID NO: 182906 - DNA, 20 bp, human
gctccgctgcccagactggt

SEQ ID NO: 182907 - DNA, 20 bp, human
ggtccctcgccgaccagtct

SEQ ID NO: 182908 - DNA, 20 bp, human
gcagcggctgaggagaacca

SEQ ID NO: 182909 - DNA, 20 bp, human
gctgctcggagaggtcccca

SEQ ID NO: 182910 - DNA, 20 bp, human
ggcggcaagggaggctctag

SEQ ID NO: 182911 - DNA, 20 bp, human
gatgcggctgcaggaggcga

SEQ ID NO: 182912 - DNA, 20 bp, human
gggtcggcgagggactgagt

SEQ ID NO: 182913 - DNA, 20 bp, human
gtgtggctcggcgggcgatg

SEQ ID NO: 182914 - DNA, 20 bp, human
gagggagcccgcgatcatcg

SEQ ID NO: 182915 - DNA, 20 bp, human
gcggcgagggactgagtcgg

SEQ ID NO: 182916 - DNA, 20 bp, human
gctgaaggcggaaccacgac

SEQ ID NO: 182917 - DNA, 20 bp, human
gtcggagggctatggagcag

SEQ ID NO: 182918 - DNA, 20 bp, human
gccacgacgggcagagagca

SEQ ID NO: 182919 - DNA, 20 bp, human
gccctccgacgggcgcccag

SEQ ID NO: 182920 - DNA, 20 bp, human
ggaagcccctgggcgcccgt

SEQ ID NO: 182921 - DNA, 20 bp, human
gtggaggggaaacttgtgag

SEQ ID NO: 182922 - DNA, 20 bp, human
gcacacaccaggcttcggag

SEQ ID NO: 182923 - DNA, 20 bp, human
ggcccctgggcgcccgtcgg

SEQ ID NO: 182924 - DNA, 20 bp, human
gctcgttaaaggctcctcca

SEQ ID NO: 182925 - DNA, 20 bp, human
ggggcagaaggggtgcccat

SEQ ID NO: 182926 - DNA, 20 bp, human
gggaggagcagagccgcaca

SEQ ID NO: 182927 - DNA, 20 bp, human
ggcaaggaaaacccagactc

SEQ ID NO: 182928 - DNA, 20 bp, human
gacacagtggagccccgtca

SEQ ID NO: 182929 - DNA, 20 bp, human
ggaagcccggcccgcacgga

SEQ ID NO: 182930 - DNA, 20 bp, human
gtctgctgcaggcaacggga

SEQ ID NO: 182931 - DNA, 20 bp, human
gtgcagccgctcccagaaca

SEQ ID NO: 182932 - DNA, 20 bp, human
ggcacaccgtgttctgggag

SEQ ID NO: 182933 - DNA, 20 bp, human
gccgggcttctacaacgacg

SEQ ID NO: 182934 - DNA, 20 bp, human
gcagagacgaggatgtgcgt

SEQ ID NO: 182935 - DNA, 20 bp, human
gaggaggggtcgccacgcac

SEQ ID NO: 182936 - DNA, 20 bp, human
ggtgcgcgaagaagccggtg

SEQ ID NO: 182937 - DNA, 20 bp, human
gtgtagggcagcagcaggat

SEQ ID NO: 182938 - DNA, 20 bp, human
gcggcaggcacggttgtggg

SEQ ID NO: 182939 - DNA, 20 bp, human
gctggcgggacgcagagaca

SEQ ID NO: 182940 - DNA, 20 bp, human
ggtgccggctgtacgcggag

SEQ ID NO: 182941 - DNA, 20 bp, human
gaggaggtggcatgtcggtc

SEQ ID NO: 182942 - DNA, 20 bp, human
gtgcggggagcgtgaggagg

SEQ ID NO: 182943 - DNA, 20 bp, human
ggaagaagccggtgcggcag

SEQ ID NO: 182944 - DNA, 20 bp, human
gctgcacaaaggtgcctggg

SEQ ID NO: 182945 - DNA, 20 bp, human
gtctgcgtcccgccaggggt

SEQ ID NO: 182946 - DNA, 20 bp, human
gtccagagcccggacagtgt

SEQ ID NO: 182947 - DNA, 20 bp, human
gtggggtgcgtgggacgcaa

SEQ ID NO: 182948 - DNA, 20 bp, human
ggcgctacgagccttcccac

SEQ ID NO: 182949 - DNA, 20 bp, human
gggtgcgtgggacgcaaggg

SEQ ID NO: 182950 - DNA, 20 bp, human
gcaagcagcgaagaaaaaag

SEQ ID NO: 182951 - DNA, 20 bp, human
gactaaggctgaaacctcgg

SEQ ID NO: 182952 - DNA, 20 bp, human
gccgtcacccgcttacctgt

SEQ ID NO: 182953 - DNA, 20 bp, human
gggaatatgctagcacccac

SEQ ID NO: 182954 - DNA, 20 bp, human
gatttgatacgggagaacta

SEQ ID NO: 182955 - DNA, 20 bp, human
ggcagagatgactcaggaaa

SEQ ID NO: 182956 - DNA, 20 bp, human
gcaaggagtggaaagttctc

SEQ ID NO: 182957 - DNA, 20 bp, human
gtgcagaagcctgaagacca

SEQ ID NO: 182958 - DNA, 20 bp, human
gcggcagccctgagatctca

SEQ ID NO: 182959 - DNA, 20 bp, human
gtacaaagagaatctgtcag

SEQ ID NO: 182960 - DNA, 20 bp, human
gggacagaccttgagatctc

SEQ ID NO: 182961 - DNA, 20 bp, human
gcaggcttctgcagctcgag

SEQ ID NO: 182962 - DNA, 20 bp, human
gttgtatggtaacaaaacta

SEQ ID NO: 182963 - DNA, 20 bp, human
gtgggtgggggcactgagaa

SEQ ID NO: 182964 - DNA, 20 bp, human
gtgcagctcgagaggacttc

SEQ ID NO: 182965 - DNA, 20 bp, human
gtccatctgggggagtgggt

SEQ ID NO: 182966 - DNA, 20 bp, human
gctatgatggaggtccaggg

SEQ ID NO: 182967 - DNA, 20 bp, human
gacagcagtcagactctgac

SEQ ID NO: 182968 - DNA, 20 bp, human
gtggctatgatggaggtcca

SEQ ID NO: 182969 - DNA, 20 bp, human
gtgactgctgtaagtcagcc

SEQ ID NO: 182970 - DNA, 20 bp, human
gagcaggaaagtcttcagag

SEQ ID NO: 182971 - DNA, 20 bp, human
gtccaggggggacccagcct

SEQ ID NO: 182972 - DNA, 20 bp, human
gaggatcatggctatgatgg

SEQ ID NO: 182973 - DNA, 20 bp, human
ggacaggatcatggctatga

SEQ ID NO: 182974 - DNA, 20 bp, human
gctaagtgcagttacacaac

SEQ ID NO: 182975 - DNA, 20 bp, human
ggcagtgcactcagtcttcg

SEQ ID NO: 182976 - DNA, 20 bp, human
gccaaagccgggctccaagt

SEQ ID NO: 182977 - DNA, 20 bp, human
gtgtctgcggccaactccgg

SEQ ID NO: 182978 - DNA, 20 bp, human
gtgcggcggagcctcgacgt

SEQ ID NO: 182979 - DNA, 20 bp, human
gaagtcggcgccccacgtcg

SEQ ID NO: 182980 - DNA, 20 bp, human
ggttggccgcagacaagaag

SEQ ID NO: 182981 - DNA, 20 bp, human
gtcttgtctgcggccaactc

SEQ ID NO: 182982 - DNA, 20 bp, human
gacttggaaactgagtctgg

SEQ ID NO: 182983 - DNA, 20 bp, human
ggagcttgcatattccggaa

SEQ ID NO: 182984 - DNA, 20 bp, human
ggctctgaaatagaagaaca

SEQ ID NO: 182985 - DNA, 20 bp, human
gggaatatgcaagctctggg

SEQ ID NO: 182986 - DNA, 20 bp, human
gccgggacccgagggatcgg

SEQ ID NO: 182987 - DNA, 20 bp, human
gctccgacgggcggccatgg

SEQ ID NO: 182988 - DNA, 20 bp, human
ggaggaggaccaggacccgt

SEQ ID NO: 182989 - DNA, 20 bp, human
ggcccacgcccactcaccga

SEQ ID NO: 182990 - DNA, 20 bp, human
gcgcccgtcggagccagagg

SEQ ID NO: 182991 - DNA, 20 bp, human
gcctcgggtcccgggatggg

SEQ ID NO: 182992 - DNA, 20 bp, human
gccgcgtgggctgaaggcaa

SEQ ID NO: 182993 - DNA, 20 bp, human
gccgctgcgcaccccttctt

SEQ ID NO: 182994 - DNA, 20 bp, human
gatccctcgggtcccgggat

SEQ ID NO: 182995 - DNA, 20 bp, human
gcagcccacgcggcccccag

SEQ ID NO: 182996 - DNA, 20 bp, human
gccgggacccgagggatcgg

SEQ ID NO: 182997 - DNA, 20 bp, human
gctccgacgggcggccatgg

SEQ ID NO: 182998 - DNA, 20 bp, human
ggaggaggaccaggacccgt

SEQ ID NO: 182999 - DNA, 20 bp, human
ggcccacgcccactcaccga

SEQ ID NO: 183000 - DNA, 20 bp, human
gcgcccgtcggagccagagg

SEQ ID NO: 183001 - DNA, 20 bp, human
gcctcgggtcccgggatggg

SEQ ID NO: 183002 - DNA, 20 bp, human
gccgcgtgggctgaaggcaa

SEQ ID NO: 183003 - DNA, 20 bp, human
gccgctgcgcaccccttctt

SEQ ID NO: 183004 - DNA, 20 bp, human
gatccctcgggtcccgggat

SEQ ID NO: 183005 - DNA, 20 bp, human
gcagcccacgcggcccccag

SEQ ID NO: 183006 - DNA, 20 bp, human
ggcagtgcgcaggaaccctg

SEQ ID NO: 183007 - DNA, 20 bp, human
gggcgcggccattccaggaa

SEQ ID NO: 183008 - DNA, 20 bp, human
gatgaggctggcatgagctg

SEQ ID NO: 183009 - DNA, 20 bp, human
gcagccagcaccaacactca

SEQ ID NO: 183010 - DNA, 20 bp, human
ggctccgggagactctgcca

SEQ ID NO: 183011 - DNA, 20 bp, human
gtgttcctcctgggtgtcac

SEQ ID NO: 183012 - DNA, 20 bp, human
gctgccctccaggatttgtt

SEQ ID NO: 183013 - DNA, 20 bp, human
gggcctccaggcaacatggg

SEQ ID NO: 183014 - DNA, 20 bp, human
gcaagagagggtctccggtt

SEQ ID NO: 183015 - DNA, 20 bp, human
gtagcccccaaagggcctcc

SEQ ID NO: 183016 - DNA, 20 bp, human
ggtagaaagacaccaccgtg

SEQ ID NO: 183017 - DNA, 20 bp, human
gctgtcttgctgcctcacgg

SEQ ID NO: 183018 - DNA, 20 bp, human
gccaggtggccgccctgcaa

SEQ ID NO: 183019 - DNA, 20 bp, human
ggccctgcagctctgcccgg

SEQ ID NO: 183020 - DNA, 20 bp, human
gctggccaggtccccttgca

SEQ ID NO: 183021 - DNA, 20 bp, human
gttcagggtccagaagaaac

SEQ ID NO: 183022 - DNA, 20 bp, human
gtcaggataactctcctgag

SEQ ID NO: 183023 - DNA, 20 bp, human
gctggctgcaaccttgctgc

SEQ ID NO: 183024 - DNA, 20 bp, human
ggtggtgtctttctaccagg

SEQ ID NO: 183025 - DNA, 20 bp, human
ggaagctccagctgtcaccg

SEQ ID NO: 183026 - DNA, 20 bp, human
ggagcagggctgacacgcct

SEQ ID NO: 183027 - DNA, 20 bp, human
ggccctgctccagacacctt

SEQ ID NO: 183028 - DNA, 20 bp, human
gggctgtgcacgctgcggac

SEQ ID NO: 183029 - DNA, 20 bp, human
ggcccaaggtgtctggagca

SEQ ID NO: 183030 - DNA, 20 bp, human
gcgtgcagtgtggcccgggt

SEQ ID NO: 183031 - DNA, 20 bp, human
gctctgaggttgaaggaccc

SEQ ID NO: 183032 - DNA, 20 bp, human
ggctgcggacaggcacccgt

SEQ ID NO: 183033 - DNA, 20 bp, human
gtgcctgtgagtgggaccgg

SEQ ID NO: 183034 - DNA, 20 bp, human
gcatggaggagagtgtcgta

SEQ ID NO: 183035 - DNA, 20 bp, human
gtaggggacgaagtatgcta

SEQ ID NO: 183036 - DNA, 20 bp, human
gggagcatggccgaggatct

SEQ ID NO: 183037 - DNA, 20 bp, human
gaggagtcagaggtgcctcc

SEQ ID NO: 183038 - DNA, 20 bp, human
ggcctgcagctgccgtgctc

SEQ ID NO: 183039 - DNA, 20 bp, human
gaagctcagtcccagatcct

SEQ ID NO: 183040 - DNA, 20 bp, human
gtggaaatgctgccagagca

SEQ ID NO: 183041 - DNA, 20 bp, human
gtatccccacagtaaaagaa

SEQ ID NO: 183042 - DNA, 20 bp, human
gaggaaatgtagagtgggag

SEQ ID NO: 183043 - DNA, 20 bp, human
ggtggactctctgcagtgag

SEQ ID NO: 183044 - DNA, 20 bp, human
gtggctgacaagcaggtatg

SEQ ID NO: 183045 - DNA, 20 bp, human
gggggtggagaggttcaatt

SEQ ID NO: 183046 - DNA, 20 bp, human
gtggttaagccaattgacag

SEQ ID NO: 183047 - DNA, 20 bp, human
ggagttcttgaatggcttaa

SEQ ID NO: 183048 - DNA, 20 bp, human
gtccacaggcccctgtcaat

SEQ ID NO: 183049 - DNA, 20 bp, human
gagctccttgagttcttgaa

SEQ ID NO: 183050 - DNA, 20 bp, human
gggaaggaaaaatactccac

SEQ ID NO: 183051 - DNA, 20 bp, human
gtctccaattagaggtaagg

SEQ ID NO: 183052 - DNA, 20 bp, human
ggcgtttgaagtttatctaa

SEQ ID NO: 183053 - DNA, 20 bp, human
gttgcctccttacctctaat

SEQ ID NO: 183054 - DNA, 20 bp, human
gacaaaaattcacaagtgat

SEQ ID NO: 183055 - DNA, 20 bp, human
gataaagattagccaactga

SEQ ID NO: 183056 - DNA, 20 bp, human
gtcccagggccagagataaa

SEQ ID NO: 183057 - DNA, 20 bp, human
ggagaagtgcaggcagatgt

SEQ ID NO: 183058 - DNA, 20 bp, human
gccacagcaatcgtaaagtg

SEQ ID NO: 183059 - DNA, 20 bp, human
gagccaggccaagattcgag

SEQ ID NO: 183060 - DNA, 20 bp, human
ggtgggaaaacagcgcccag

SEQ ID NO: 183061 - DNA, 20 bp, human
gcccagtccctgaattacag

SEQ ID NO: 183062 - DNA, 20 bp, human
gaacccctggaagagaatgt

SEQ ID NO: 183063 - DNA, 20 bp, human
gctgaagagcagagaagtgc

SEQ ID NO: 183064 - DNA, 20 bp, human
gtcaggtaagatgcaccact

SEQ ID NO: 183065 - DNA, 20 bp, human
gatggaaagggtccaacccc

SEQ ID NO: 183066 - DNA, 20 bp, human
gagagatggaagcaagacat

SEQ ID NO: 183067 - DNA, 20 bp, human
ggatggaagcaagacatagg

SEQ ID NO: 183068 - DNA, 20 bp, human
gaaggaaatatgtaacactg

SEQ ID NO: 183069 - DNA, 20 bp, human
gtgagtgcattcaccagtct

SEQ ID NO: 183070 - DNA, 20 bp, human
gtatagtcctggcacagaga

SEQ ID NO: 183071 - DNA, 20 bp, human
gtcatggtgagtgatctcta

SEQ ID NO: 183072 - DNA, 20 bp, human
ggaattagcttctatagtcc

SEQ ID NO: 183073 - DNA, 20 bp, human
gccagcaagctgtacaactg

SEQ ID NO: 183074 - DNA, 20 bp, human
gctggtggttggggtcacat

SEQ ID NO: 183075 - DNA, 20 bp, human
gggacacatggctccattca

SEQ ID NO: 183076 - DNA, 20 bp, human
gcatgtgccggcgggctccg

SEQ ID NO: 183077 - DNA, 20 bp, human
gaggcgagaggcggcagcaa

SEQ ID NO: 183078 - DNA, 20 bp, human
gagtggccaccgtgaagaca

SEQ ID NO: 183079 - DNA, 20 bp, human
gggctgcagcaagcactcaa

SEQ ID NO: 183080 - DNA, 20 bp, human
gctgtgccttgtcttcacgg

SEQ ID NO: 183081 - DNA, 20 bp, human
gtatggtgttggtcgttcag

SEQ ID NO: 183082 - DNA, 20 bp, human
gtatataaagaatggaccca

SEQ ID NO: 183083 - DNA, 20 bp, human
gaaactagctacagagaagg

SEQ ID NO: 183084 - DNA, 20 bp, human
gctgcacacaacttaatccc

SEQ ID NO: 183085 - DNA, 20 bp, human
gcagcaagcactcaacggaa

SEQ ID NO: 183086 - DNA, 20 bp, human
gtctagcaccgaggccgggg

SEQ ID NO: 183087 - DNA, 20 bp, human
ggggtccagtgaagcgtcag

SEQ ID NO: 183088 - DNA, 20 bp, human
gcagggcccaaggcagtacg

SEQ ID NO: 183089 - DNA, 20 bp, human
gtacagatgaggtgtcgtag

SEQ ID NO: 183090 - DNA, 20 bp, human
gccggggagaggagacccac

SEQ ID NO: 183091 - DNA, 20 bp, human
gggagaatgggagccccggt

SEQ ID NO: 183092 - DNA, 20 bp, human
gtcggtgctagatggagaat

SEQ ID NO: 183093 - DNA, 20 bp, human
gagccccggacacggcccag

SEQ ID NO: 183094 - DNA, 20 bp, human
gccggccgggagtgtagaac

SEQ ID NO: 183095 - DNA, 20 bp, human
gagaggccggcgggatcgtc

SEQ ID NO: 183096 - DNA, 20 bp, human
gcgatcggctaagggcgctg

SEQ ID NO: 183097 - DNA, 20 bp, human
gcccgagcagcggtgcgtgt

SEQ ID NO: 183098 - DNA, 20 bp, human
gtgagcgccccgatcggcta

SEQ ID NO: 183099 - DNA, 20 bp, human
gacgcgagtgaaatagacca

SEQ ID NO: 183100 - DNA, 20 bp, human
ggacatggcgagcgactccc

SEQ ID NO: 183101 - DNA, 20 bp, human
gccctccccctgctgagtgg

SEQ ID NO: 183102 - DNA, 20 bp, human
gtcaccctaacccaaaccac

SEQ ID NO: 183103 - DNA, 20 bp, human
gcgagtgaaatagaccaagg

SEQ ID NO: 183104 - DNA, 20 bp, human
gtgcgtgggtgtatttaaat

SEQ ID NO: 183105 - DNA, 20 bp, human
gtttgcttgtgcgtggatgg

SEQ ID NO: 183106 - DNA, 20 bp, human
ggccccccgtagcactccta

SEQ ID NO: 183107 - DNA, 20 bp, human
ggccctaggagtgctacggg

SEQ ID NO: 183108 - DNA, 20 bp, human
gggggtagcacgcctgggaa

SEQ ID NO: 183109 - DNA, 20 bp, human
gtagagagcgcagaccctcc

SEQ ID NO: 183110 - DNA, 20 bp, human
gaggagccctaggagtgcta

SEQ ID NO: 183111 - DNA, 20 bp, human
gcagcgccgcccgcacccgg

SEQ ID NO: 183112 - DNA, 20 bp, human
gcagccccgaatccagggac

SEQ ID NO: 183113 - DNA, 20 bp, human
ggcgtccagccccgaatcca

SEQ ID NO: 183114 - DNA, 20 bp, human
ggcctgggaacggcgtgggg

SEQ ID NO: 183115 - DNA, 20 bp, human
gccgaggacgaggaagtgcc

SEQ ID NO: 183116 - DNA, 20 bp, human
ggaagggcaggagaatacga

SEQ ID NO: 183117 - DNA, 20 bp, human
gagggtgtgtgcaccagggg

SEQ ID NO: 183118 - DNA, 20 bp, human
ggagccgaggagccttcata

SEQ ID NO: 183119 - DNA, 20 bp, human
gtagtcactcacctggggaa

SEQ ID NO: 183120 - DNA, 20 bp, human
gtacgagggtgtgtgcacca

SEQ ID NO: 183121 - DNA, 20 bp, human
ggcagaagcacagtgagccg

SEQ ID NO: 183122 - DNA, 20 bp, human
gcaggtgagtgactagatgg

SEQ ID NO: 183123 - DNA, 20 bp, human
gcagggatctgacacaacac

SEQ ID NO: 183124 - DNA, 20 bp, human
gggctgggagcccaagacct

SEQ ID NO: 183125 - DNA, 20 bp, human
gtcatagggacagccgcccc

SEQ ID NO: 183126 - DNA, 20 bp, human
ggtacgagggcgggtaccag

SEQ ID NO: 183127 - DNA, 20 bp, human
gccagatgcgccaggtacga

SEQ ID NO: 183128 - DNA, 20 bp, human
ggatgcgccaggtacgaggg

SEQ ID NO: 183129 - DNA, 20 bp, human
gggagcgagagtgcgtgtgg

SEQ ID NO: 183130 - DNA, 20 bp, human
ggcggccgccgggtcctggg

SEQ ID NO: 183131 - DNA, 20 bp, human
ggcgggagcgagagtgcgtg

SEQ ID NO: 183132 - DNA, 20 bp, human
gcatggctgtaggcccgccc

SEQ ID NO: 183133 - DNA, 20 bp, human
gcttccgggagcagctgcga

SEQ ID NO: 183134 - DNA, 20 bp, human
gtcgggtcctgggggtgata

SEQ ID NO: 183135 - DNA, 20 bp, human
ggcagcgcgtccactaggga

SEQ ID NO: 183136 - DNA, 20 bp, human
gaacagaagtgactgtggat

SEQ ID NO: 183137 - DNA, 20 bp, human
gtgggttaaaagcaatgtac

SEQ ID NO: 183138 - DNA, 20 bp, human
gttcagccttccagttctgt

SEQ ID NO: 183139 - DNA, 20 bp, human
gagttctacggagcataaag

SEQ ID NO: 183140 - DNA, 20 bp, human
gaaaggaatttaagccccgt

SEQ ID NO: 183141 - DNA, 20 bp, human
gccaggaaaaacagcttcca

SEQ ID NO: 183142 - DNA, 20 bp, human
gtgctccgtagaactttctg

SEQ ID NO: 183143 - DNA, 20 bp, human
gacattgcttttaacccacg

SEQ ID NO: 183144 - DNA, 20 bp, human
ggcattgatggcatttctag

SEQ ID NO: 183145 - DNA, 20 bp, human
gagttataagcactgcaact

SEQ ID NO: 183146 - DNA, 20 bp, human
ggcaggctgccagtacccag

SEQ ID NO: 183147 - DNA, 20 bp, human
ggagggtccggaccgagcag

SEQ ID NO: 183148 - DNA, 20 bp, human
gcttccgccttgaccaggtg

SEQ ID NO: 183149 - DNA, 20 bp, human
gcgggtccaggagtgtgcta

SEQ ID NO: 183150 - DNA, 20 bp, human
gcgcaggtggactcagaacc

SEQ ID NO: 183151 - DNA, 20 bp, human
ggctgcctgggctaaatccg

SEQ ID NO: 183152 - DNA, 20 bp, human
gcgcagggccgggtccccca

SEQ ID NO: 183153 - DNA, 20 bp, human
gctcggtccggaccctcacc

SEQ ID NO: 183154 - DNA, 20 bp, human
gccttgaccaggtgagggtc

SEQ ID NO: 183155 - DNA, 20 bp, human
gaaggcggaagcggcgactg

SEQ ID NO: 183156 - DNA, 20 bp, human
gagcagccacagggaaccag

SEQ ID NO: 183157 - DNA, 20 bp, human
gcccagccgctggttccctg

SEQ ID NO: 183158 - DNA, 20 bp, human
gcctggagacatggagacgg

SEQ ID NO: 183159 - DNA, 20 bp, human
ggagcagctccaggcacgga

SEQ ID NO: 183160 - DNA, 20 bp, human
gctagactcagtcagagctg

SEQ ID NO: 183161 - DNA, 20 bp, human
gagggactgaagaaacaagg

SEQ ID NO: 183162 - DNA, 20 bp, human
gcagcggctggggccaacgg

SEQ ID NO: 183163 - DNA, 20 bp, human
gctaggctcagtccttctca

SEQ ID NO: 183164 - DNA, 20 bp, human
ggacacagcacgaaacatct

SEQ ID NO: 183165 - DNA, 20 bp, human
ggccacagggaaccagcggc

SEQ ID NO: 183166 - DNA, 20 bp, human
ggcaccagcacttgactgag

SEQ ID NO: 183167 - DNA, 20 bp, human
gacagctggccggtctggca

SEQ ID NO: 183168 - DNA, 20 bp, human
gtgagggaccccgccagtga

SEQ ID NO: 183169 - DNA, 20 bp, human
gtttccacagctggccggtc

SEQ ID NO: 183170 - DNA, 20 bp, human
gctccccgtcaagccctcac

SEQ ID NO: 183171 - DNA, 20 bp, human
gcccgtcaagccctcactgg

SEQ ID NO: 183172 - DNA, 20 bp, human
gggactgctggggactggtt

SEQ ID NO: 183173 - DNA, 20 bp, human
gagcagagctttcctcacgc

SEQ ID NO: 183174 - DNA, 20 bp, human
gcccccccgagcagtcactg

SEQ ID NO: 183175 - DNA, 20 bp, human
ggcctgtacacagtgagtgg

SEQ ID NO: 183176 - DNA, 20 bp, human
gtaggggagtccgaagatgg

SEQ ID NO: 183177 - DNA, 20 bp, human
gtgctaggggagtccgaaga

SEQ ID NO: 183178 - DNA, 20 bp, human
ggccaagctcgatccagggg

SEQ ID NO: 183179 - DNA, 20 bp, human
ggagctgttgttgatgatgg

SEQ ID NO: 183180 - DNA, 20 bp, human
gctggagctgttgttgatga

SEQ ID NO: 183181 - DNA, 20 bp, human
gttggcggagagccccgagg

SEQ ID NO: 183182 - DNA, 20 bp, human
gtcggggaagaagaggacga

SEQ ID NO: 183183 - DNA, 20 bp, human
gtccgccaagctcgatccag

SEQ ID NO: 183184 - DNA, 20 bp, human
gagctcgatccaggggagga

SEQ ID NO: 183185 - DNA, 20 bp, human
gtagaaaccgctgggaccac

SEQ ID NO: 183186 - DNA, 20 bp, human
gggcgtgccgaaggagccgg

SEQ ID NO: 183187 - DNA, 20 bp, human
gcagccggcgaacagacggt

SEQ ID NO: 183188 - DNA, 20 bp, human
gcgtcccgcggtgacggcgg

SEQ ID NO: 183189 - DNA, 20 bp, human
gcttcgtcccgcggtgacgg

SEQ ID NO: 183190 - DNA, 20 bp, human
ggcagacgtcgatcaggtgg

SEQ ID NO: 183191 - DNA, 20 bp, human
gtggcttcgtcccgcggtga

SEQ ID NO: 183192 - DNA, 20 bp, human
gtcgcagtggcttcgtcccg

SEQ ID NO: 183193 - DNA, 20 bp, human
gatcggggccccgagccgag

SEQ ID NO: 183194 - DNA, 20 bp, human
gtgggctgcagacgtcgatc

SEQ ID NO: 183195 - DNA, 20 bp, human
gggcggtcgggcgaaggagg

SEQ ID NO: 183196 - DNA, 20 bp, human
gaccctccttgagagcgggg

SEQ ID NO: 183197 - DNA, 20 bp, human
gggtaggacggccccgctgg

SEQ ID NO: 183198 - DNA, 20 bp, human
ggcctccccgctctcaagga

SEQ ID NO: 183199 - DNA, 20 bp, human
ggcggggccgtcctacccaa

SEQ ID NO: 183200 - DNA, 20 bp, human
gcccacagtgccccttgggt

SEQ ID NO: 183201 - DNA, 20 bp, human
gtctaacagaggcagagtgt

SEQ ID NO: 183202 - DNA, 20 bp, human
gggttaggagataagagttg

SEQ ID NO: 183203 - DNA, 20 bp, human
gtttgagtagacacctccag

SEQ ID NO: 183204 - DNA, 20 bp, human
gtgtctgtgaatcacctcac

SEQ ID NO: 183205 - DNA, 20 bp, human
ggatgaaagtgtctactctc

SEQ ID NO: 183206 - DNA, 20 bp, human
gtccgggtcctgaaacgacg

SEQ ID NO: 183207 - DNA, 20 bp, human
ggggtcctgaaacgacgcgg

SEQ ID NO: 183208 - DNA, 20 bp, human
gggacgtggaacgagtcaag

SEQ ID NO: 183209 - DNA, 20 bp, human
ggtgaacagccgcgacacgg

SEQ ID NO: 183210 - DNA, 20 bp, human
gaggctggtgacgcctgaga

SEQ ID NO: 183211 - DNA, 20 bp, human
gcgctggccccggttacctg

SEQ ID NO: 183212 - DNA, 20 bp, human
gcgtttcaggacccggacgg

SEQ ID NO: 183213 - DNA, 20 bp, human
ggggcagggagcccagcgag

SEQ ID NO: 183214 - DNA, 20 bp, human
gaaggtgaacagccgcgaca

SEQ ID NO: 183215 - DNA, 20 bp, human
ggcagcgcgaatccgccgtc

SEQ ID NO: 183216 - DNA, 20 bp, human
ggactgagagaccactgctg

SEQ ID NO: 183217 - DNA, 20 bp, human
ggtcggctaacagatgccag

SEQ ID NO: 183218 - DNA, 20 bp, human
gcattagaaagtggaatcaa

SEQ ID NO: 183219 - DNA, 20 bp, human
gagcaagcacttctggccgg

SEQ ID NO: 183220 - DNA, 20 bp, human
gaacaggacaattagagtta

SEQ ID NO: 183221 - DNA, 20 bp, human
ggacagtcttcacaattctc

SEQ ID NO: 183222 - DNA, 20 bp, human
gtctcagtcctctcaaagca

SEQ ID NO: 183223 - DNA, 20 bp, human
gtctggaggattctttgcca

SEQ ID NO: 183224 - DNA, 20 bp, human
gagtcttcacaattctctgg

SEQ ID NO: 183225 - DNA, 20 bp, human
gataaattcagcttctcctc

SEQ ID NO: 183226 - DNA, 20 bp, human
gcagcaagtaccaaggtctg

SEQ ID NO: 183227 - DNA, 20 bp, human
gggagcagcagcattggaag

SEQ ID NO: 183228 - DNA, 20 bp, human
gggacgaccagcaagtacca

SEQ ID NO: 183229 - DNA, 20 bp, human
gcaaggagagacgagaacca

SEQ ID NO: 183230 - DNA, 20 bp, human
gcaggaggagaccggctcac

SEQ ID NO: 183231 - DNA, 20 bp, human
gtaccaaggtctgcggcagg

SEQ ID NO: 183232 - DNA, 20 bp, human
gactggcactcttacctggg

SEQ ID NO: 183233 - DNA, 20 bp, human
gagactggagtataatacta

SEQ ID NO: 183234 - DNA, 20 bp, human
gatgagaaggaacatcttaa

SEQ ID NO: 183235 - DNA, 20 bp, human
ggcaactggcactcttacct

SEQ ID NO: 183236 - DNA, 20 bp, human
gagcatggatgacatctaca

SEQ ID NO: 183237 - DNA, 20 bp, human
gaaggctgcggtgagggaca

SEQ ID NO: 183238 - DNA, 20 bp, human
ggatgacatctacaaggctg

SEQ ID NO: 183239 - DNA, 20 bp, human
gcatctacaaggctgcggtg

SEQ ID NO: 183240 - DNA, 20 bp, human
ggtgagaagcagaatgtgag

SEQ ID NO: 183241 - DNA, 20 bp, human
gcagctgagtgagcccccag

SEQ ID NO: 183242 - DNA, 20 bp, human
ggggactcagacagctcagg

SEQ ID NO: 183243 - DNA, 20 bp, human
ggacagggctgggtagggct

SEQ ID NO: 183244 - DNA, 20 bp, human
gatggggactcagacagctc

SEQ ID NO: 183245 - DNA, 20 bp, human
ggggacagggagacagtaat

SEQ ID NO: 183246 - DNA, 20 bp, human
gaggaggcgacctgcaacag

SEQ ID NO: 183247 - DNA, 20 bp, human
gtcccggtcaccagcaacca

SEQ ID NO: 183248 - DNA, 20 bp, human
ggagcaggccaggtcatctt

SEQ ID NO: 183249 - DNA, 20 bp, human
gaccatggtaaggacaagag

SEQ ID NO: 183250 - DNA, 20 bp, human
gtagcccccgggatttgtag

SEQ ID NO: 183251 - DNA, 20 bp, human
ggtgcccctacaaatcccgg

SEQ ID NO: 183252 - DNA, 20 bp, human
ggtcaccagcaaccatggta

SEQ ID NO: 183253 - DNA, 20 bp, human
ggcctcccgtcttctggagg

SEQ ID NO: 183254 - DNA, 20 bp, human
gagagtgctcccgtgagtaa

SEQ ID NO: 183255 - DNA, 20 bp, human
gccatgatgataggagggtt

SEQ ID NO: 183256 - DNA, 20 bp, human
gcctcacagtctgcagtcta

SEQ ID NO: 183257 - DNA, 20 bp, human
gggagggagagcgcacccag

SEQ ID NO: 183258 - DNA, 20 bp, human
gcagtctgcagtctacggcg

SEQ ID NO: 183259 - DNA, 20 bp, human
ggctccacgaggactgaaca

SEQ ID NO: 183260 - DNA, 20 bp, human
gccctgggatcagagagcca

SEQ ID NO: 183261 - DNA, 20 bp, human
ggcagtctacggcgaggcac

SEQ ID NO: 183262 - DNA, 20 bp, human
gtcagatgtaggttgatccc

SEQ ID NO: 183263 - DNA, 20 bp, human
gttaccttgttcagtcctcg

SEQ ID NO: 183264 - DNA, 20 bp, human
gcaggagagatgccattctg

SEQ ID NO: 183265 - DNA, 20 bp, human
gagcccagaacttcagatgt

SEQ ID NO: 183266 - DNA, 20 bp, human
gttagtgccagggctaagag

SEQ ID NO: 183267 - DNA, 20 bp, human
ggagaggagagggagtccgt

SEQ ID NO: 183268 - DNA, 20 bp, human
gccagggctaagagaggaga

SEQ ID NO: 183269 - DNA, 20 bp, human
ggttcaggggccccactgag

SEQ ID NO: 183270 - DNA, 20 bp, human
ggtctgtgctcacccctcag

SEQ ID NO: 183271 - DNA, 20 bp, human
gaggaacgcacttagtgcca

SEQ ID NO: 183272 - DNA, 20 bp, human
ggggcccctgaactgggcat

SEQ ID NO: 183273 - DNA, 20 bp, human
gcagcatgggggatggacca

SEQ ID NO: 183274 - DNA, 20 bp, human
gggctgggatgccgtcccca

SEQ ID NO: 183275 - DNA, 20 bp, human
gagcctgccgtccttccctg

SEQ ID NO: 183276 - DNA, 20 bp, human
gtgggcctcacctagaatct

SEQ ID NO: 183277 - DNA, 20 bp, human
ggctgggagcgaggtcaggc

SEQ ID NO: 183278 - DNA, 20 bp, human
ggctgtccccgagggagggt

SEQ ID NO: 183279 - DNA, 20 bp, human
ggggaggcagctgtagcgag

SEQ ID NO: 183280 - DNA, 20 bp, human
gacctagaatctgggcagca

SEQ ID NO: 183281 - DNA, 20 bp, human
gcacgggtccgggagtgaga

SEQ ID NO: 183282 - DNA, 20 bp, human
gtccccgagggagggtggga

SEQ ID NO: 183283 - DNA, 20 bp, human
gccccagaggtgaagcctgg

SEQ ID NO: 183284 - DNA, 20 bp, human
gcccatcccaccctccctcg

SEQ ID NO: 183285 - DNA, 20 bp, human
gaggccggcagcggcgagtt

SEQ ID NO: 183286 - DNA, 20 bp, human
ggggctcctgaggccatgat

SEQ ID NO: 183287 - DNA, 20 bp, human
gtgtcccagtgcaaggtctg

SEQ ID NO: 183288 - DNA, 20 bp, human
ggcagagaagcagaactacc

SEQ ID NO: 183289 - DNA, 20 bp, human
ggcaggcagcacctgaaggt

SEQ ID NO: 183290 - DNA, 20 bp, human
gaaggaggagagccgccgtg

SEQ ID NO: 183291 - DNA, 20 bp, human
gctggccccagaccttgcac

SEQ ID NO: 183292 - DNA, 20 bp, human
ggcccgcaggcagcacctga

SEQ ID NO: 183293 - DNA, 20 bp, human
gctgcttctctgcctcacgg

SEQ ID NO: 183294 - DNA, 20 bp, human
ggcccgccgctgcatatccc

SEQ ID NO: 183295 - DNA, 20 bp, human
gtccgggaccagcagagcct

SEQ ID NO: 183296 - DNA, 20 bp, human
ggcagcccggaggagactga

SEQ ID NO: 183297 - DNA, 20 bp, human
ggccgcccgggtgaccttca

SEQ ID NO: 183298 - DNA, 20 bp, human
gagcgatgcggtgagagcag

SEQ ID NO: 183299 - DNA, 20 bp, human
ggaggagactgacggtccct

SEQ ID NO: 183300 - DNA, 20 bp, human
gaccctgaaggtcacccggg

SEQ ID NO: 183301 - DNA, 20 bp, human
gggtaggcgtagggactctt

SEQ ID NO: 183302 - DNA, 20 bp, human
gggctgcttgagactccccg

SEQ ID NO: 183303 - DNA, 20 bp, human
gctgagactcaggccgggaa

SEQ ID NO: 183304 - DNA, 20 bp, human
gatgggtgagtgatgcccca

SEQ ID NO: 183305 - DNA, 20 bp, human
gagagcagcgggctaaggcg

SEQ ID NO: 183306 - DNA, 20 bp, human
gctgtcactgcacttgaact

SEQ ID NO: 183307 - DNA, 20 bp, human
gttggaatattgctgaatgt

SEQ ID NO: 183308 - DNA, 20 bp, human
ggcaatctctagttgcaaga

SEQ ID NO: 183309 - DNA, 20 bp, human
gctgataactaacaactcat

SEQ ID NO: 183310 - DNA, 20 bp, human
gataacttgaagaactgccc

SEQ ID NO: 183311 - DNA, 20 bp, human
gtttctgtaacattatacca

SEQ ID NO: 183312 - DNA, 20 bp, human
gtaattaccagtacaagttt

SEQ ID NO: 183313 - DNA, 20 bp, human
gtgaagaacccattcgatat

SEQ ID NO: 183314 - DNA, 20 bp, human
gtatattatccaatatcgaa

SEQ ID NO: 183315 - DNA, 20 bp, human
gttgaaccatattacactta

SEQ ID NO: 183316 - DNA, 20 bp, human
gtcagacacagcctaggtaa

SEQ ID NO: 183317 - DNA, 20 bp, human
ggagggtatcaggaattggg

SEQ ID NO: 183318 - DNA, 20 bp, human
ggccccctcccccaaggaca

SEQ ID NO: 183319 - DNA, 20 bp, human
gggaggtctgggaacttgag

SEQ ID NO: 183320 - DNA, 20 bp, human
gctgataccctcagagtctg

SEQ ID NO: 183321 - DNA, 20 bp, human
gcttggaggtcaaacaatct

SEQ ID NO: 183322 - DNA, 20 bp, human
gggagaaatggtgcagaggt

SEQ ID NO: 183323 - DNA, 20 bp, human
ggggggtctcagaagaaatt

SEQ ID NO: 183324 - DNA, 20 bp, human
gggatagaggggaaaatact

SEQ ID NO: 183325 - DNA, 20 bp, human
gtgagaggctcagactttag

SEQ ID NO: 183326 - DNA, 20 bp, human
ggacgctccagacccggaga

SEQ ID NO: 183327 - DNA, 20 bp, human
ggagagggaagagacgtgag

SEQ ID NO: 183328 - DNA, 20 bp, human
gggagtgtggcactttggcg

SEQ ID NO: 183329 - DNA, 20 bp, human
gcgaggagacgctccagacc

SEQ ID NO: 183330 - DNA, 20 bp, human
gtcccctcccaagagctcct

SEQ ID NO: 183331 - DNA, 20 bp, human
gacgcccaggagctcttggg

SEQ ID NO: 183332 - DNA, 20 bp, human
gagggcgggcgagggcccga

SEQ ID NO: 183333 - DNA, 20 bp, human
gtggcactttggcggggaag

SEQ ID NO: 183334 - DNA, 20 bp, human
gaccggctccggctcttcgg

SEQ ID NO: 183335 - DNA, 20 bp, human
gtggcagagccaggtaaccg

SEQ ID NO: 183336 - DNA, 20 bp, human
gagacgcctccaggatctgt

SEQ ID NO: 183337 - DNA, 20 bp, human
gcagctgctgttctgaggta

SEQ ID NO: 183338 - DNA, 20 bp, human
gctgttctgaggtaaggctc

SEQ ID NO: 183339 - DNA, 20 bp, human
gagcagctgccgacagatcc

SEQ ID NO: 183340 - DNA, 20 bp, human
gaggacaggttgccaggtct

SEQ ID NO: 183341 - DNA, 20 bp, human
ggcctgctctaaatacaatg

SEQ ID NO: 183342 - DNA, 20 bp, human
ggacctgactggaaaggtat

SEQ ID NO: 183343 - DNA, 20 bp, human
gtggtagccattggagacta

SEQ ID NO: 183344 - DNA, 20 bp, human
gttgtatttagagcaggcag

SEQ ID NO: 183345 - DNA, 20 bp, human
gcctggaacaagcaatttag

SEQ ID NO: 183346 - DNA, 20 bp, human
gtgcgggtcgagtgtgagaa

SEQ ID NO: 183347 - DNA, 20 bp, human
gagctccctgtggacagcac

SEQ ID NO: 183348 - DNA, 20 bp, human
gtcacactcgacccgcaggt

SEQ ID NO: 183349 - DNA, 20 bp, human
gtcgacccgcaggtgggtat

SEQ ID NO: 183350 - DNA, 20 bp, human
gtcctgcctatacccacctg

SEQ ID NO: 183351 - DNA, 20 bp, human
gcgtcggccccagtcctggg

SEQ ID NO: 183352 - DNA, 20 bp, human
gaagctggcaacctaagccc

SEQ ID NO: 183353 - DNA, 20 bp, human
gcccgcaggtgggtataggc

SEQ ID NO: 183354 - DNA, 20 bp, human
ggcagccggtgctgtccaca

SEQ ID NO: 183355 - DNA, 20 bp, human
gggagcggccacccaggact

SEQ ID NO: 183356 - DNA, 20 bp, human
ggacagcacgaggggctggt

SEQ ID NO: 183357 - DNA, 20 bp, human
gcccggtgtgacccagtccc

SEQ ID NO: 183358 - DNA, 20 bp, human
gatggccctagaggagtctg

SEQ ID NO: 183359 - DNA, 20 bp, human
gttacagaggatggccctag

SEQ ID NO: 183360 - DNA, 20 bp, human
gcagctgggaggacagcacg

SEQ ID NO: 183361 - DNA, 20 bp, human
gagcagctgcaccggcatgt

SEQ ID NO: 183362 - DNA, 20 bp, human
ggctgtcttccaggcaacgg

SEQ ID NO: 183363 - DNA, 20 bp, human
gtggtgggcagcctgggact

SEQ ID NO: 183364 - DNA, 20 bp, human
ggccatcctctgtaaggagg

SEQ ID NO: 183365 - DNA, 20 bp, human
gcagccgtggcagttacaag

SEQ ID NO: 183366 - DNA, 20 bp, human
gagagccgatctcctcacaa

SEQ ID NO: 183367 - DNA, 20 bp, human
gccgctgggggctcacaagt

SEQ ID NO: 183368 - DNA, 20 bp, human
gggaggagattgccaaactt

SEQ ID NO: 183369 - DNA, 20 bp, human
ggccgcaaattaaagagtca

SEQ ID NO: 183370 - DNA, 20 bp, human
gtgacggtgagtgagggatg

SEQ ID NO: 183371 - DNA, 20 bp, human
gtaagttctgccaaaatgag

SEQ ID NO: 183372 - DNA, 20 bp, human
gtgctgtgtgaagcgcacca

SEQ ID NO: 183373 - DNA, 20 bp, human
ggactcccttgtgaggagat

SEQ ID NO: 183374 - DNA, 20 bp, human
gcattccataggctcctctc

SEQ ID NO: 183375 - DNA, 20 bp, human
gagagctgcctccaagaggg

SEQ ID NO: 183376 - DNA, 20 bp, human
gtaggaggccacgtttggag

SEQ ID NO: 183377 - DNA, 20 bp, human
ggagtctgggtgtccatagg

SEQ ID NO: 183378 - DNA, 20 bp, human
gaagctaggcctgctgggag

SEQ ID NO: 183379 - DNA, 20 bp, human
gggtgtacaaaaccaagacg

SEQ ID NO: 183380 - DNA, 20 bp, human
gttgctatggagctgagtgt

SEQ ID NO: 183381 - DNA, 20 bp, human
gataggaaggctgtgagtct

SEQ ID NO: 183382 - DNA, 20 bp, human
gaaaccaagacgcggagctc

SEQ ID NO: 183383 - DNA, 20 bp, human
gctgtaaagctaggcctgct

SEQ ID NO: 183384 - DNA, 20 bp, human
ggctcaggtaccctttaagg

SEQ ID NO: 183385 - DNA, 20 bp, human
gtacacctgctggatcctct

SEQ ID NO: 183386 - DNA, 20 bp, human
gttccactcatactccatct

SEQ ID NO: 183387 - DNA, 20 bp, human
gcacggacagtgaaacccgg

SEQ ID NO: 183388 - DNA, 20 bp, human
gggccggtctcggaggatgg

SEQ ID NO: 183389 - DNA, 20 bp, human
gcagcagcagcagacgctgg

SEQ ID NO: 183390 - DNA, 20 bp, human
gtggcggccaggcctcggaa

SEQ ID NO: 183391 - DNA, 20 bp, human
gcccgcgcccggacccaggg

SEQ ID NO: 183392 - DNA, 20 bp, human
gtcccccgcgcccggaccca

SEQ ID NO: 183393 - DNA, 20 bp, human
ggtggaaacctgacgagcaa

SEQ ID NO: 183394 - DNA, 20 bp, human
ggcgcccggacccagggagg

SEQ ID NO: 183395 - DNA, 20 bp, human
ggtcggctccttgcgctcgg

SEQ ID NO: 183396 - DNA, 20 bp, human
ggaggcctttacgcatgcct

SEQ ID NO: 183397 - DNA, 20 bp, human
ggacgggatttgtagttcca

SEQ ID NO: 183398 - DNA, 20 bp, human
gaggagcagttgggattccg

SEQ ID NO: 183399 - DNA, 20 bp, human
gttccgctggactgaaacct

SEQ ID NO: 183400 - DNA, 20 bp, human
ggtgcagaaagccgccacca

SEQ ID NO: 183401 - DNA, 20 bp, human
gacaccctaaaggagcagtt

SEQ ID NO: 183402 - DNA, 20 bp, human
gatcgcggaagacaccctaa

SEQ ID NO: 183403 - DNA, 20 bp, human
gtgaccctcgagagaggcag

SEQ ID NO: 183404 - DNA, 20 bp, human
ggccctgccgataacaaagt

SEQ ID NO: 183405 - DNA, 20 bp, human
gccgaggtagccagttccgc

SEQ ID NO: 183406 - DNA, 20 bp, human
gcggttgggcccgatcctcc

SEQ ID NO: 183407 - DNA, 20 bp, human
gagagactcgcgcggaagga

SEQ ID NO: 183408 - DNA, 20 bp, human
ggcgaggatcgggtgtgtgt

SEQ ID NO: 183409 - DNA, 20 bp, human
gtcggagccaggccatgtcg

SEQ ID NO: 183410 - DNA, 20 bp, human
ggcttctccagagactcgcg

SEQ ID NO: 183411 - DNA, 20 bp, human
ggcggcggcaactcgcgctg

SEQ ID NO: 183412 - DNA, 20 bp, human
gtctagctgccaggaggatc

SEQ ID NO: 183413 - DNA, 20 bp, human
gctgcttggggcctgattgg

SEQ ID NO: 183414 - DNA, 20 bp, human
gacgcaagccggggccaaga

SEQ ID NO: 183415 - DNA, 20 bp, human
ggaaccgagcagagcttagg

SEQ ID NO: 183416 - DNA, 20 bp, human
gcagtgaggaagcgcgaagg

SEQ ID NO: 183417 - DNA, 20 bp, human
ggctcctttccgctgggatc

SEQ ID NO: 183418 - DNA, 20 bp, human
ggatggcgccagtcagggag

SEQ ID NO: 183419 - DNA, 20 bp, human
gggccgtggcccagacagtg

SEQ ID NO: 183420 - DNA, 20 bp, human
ggaggagatggcgccagtca

SEQ ID NO: 183421 - DNA, 20 bp, human
gctggtaacggccaaagagg

SEQ ID NO: 183422 - DNA, 20 bp, human
ggagcaaccgaggaatcctc

SEQ ID NO: 183423 - DNA, 20 bp, human
ggggaggagctgctgtcgtg

SEQ ID NO: 183424 - DNA, 20 bp, human
gttcggtgaggggcccagag

SEQ ID NO: 183425 - DNA, 20 bp, human
gcagggcagaaggctctccg

SEQ ID NO: 183426 - DNA, 20 bp, human
ggaggagacgggcagaccca

SEQ ID NO: 183427 - DNA, 20 bp, human
ggcaggaaccgactgtgcta

SEQ ID NO: 183428 - DNA, 20 bp, human
ggcagaacacacagatacac

SEQ ID NO: 183429 - DNA, 20 bp, human
gctctgacgtgaaagagagg

SEQ ID NO: 183430 - DNA, 20 bp, human
gaagctgtcagggctacggg

SEQ ID NO: 183431 - DNA, 20 bp, human
gtgcatctcatagctctcct

SEQ ID NO: 183432 - DNA, 20 bp, human
ggtaattccttgggtcagag

SEQ ID NO: 183433 - DNA, 20 bp, human
ggctcaacacccagaggaga

SEQ ID NO: 183434 - DNA, 20 bp, human
gtacgggtggaaggagaatg

SEQ ID NO: 183435 - DNA, 20 bp, human
gcctcccagaataggaggaa

SEQ ID NO: 183436 - DNA, 20 bp, human
ggggccggcaggctgaccgg

SEQ ID NO: 183437 - DNA, 20 bp, human
gaggggcaggcgtggttggg

SEQ ID NO: 183438 - DNA, 20 bp, human
gtccaatcccgggctgtata

SEQ ID NO: 183439 - DNA, 20 bp, human
gcgggctgtatatggagatt

SEQ ID NO: 183440 - DNA, 20 bp, human
ggctccggcgacaacgactc

SEQ ID NO: 183441 - DNA, 20 bp, human
ggcgggcaaaaagtgtgagg

SEQ ID NO: 183442 - DNA, 20 bp, human
gtaaaaagcggggagctcgg

SEQ ID NO: 183443 - DNA, 20 bp, human
gcaaccacgcctgcccctcg

SEQ ID NO: 183444 - DNA, 20 bp, human
gcgagaggaacttgaaaggg

SEQ ID NO: 183445 - DNA, 20 bp, human
gggggatccccgctactgtc

SEQ ID NO: 183446 - DNA, 20 bp, human
gagcgggtcggtgtagaaaa

SEQ ID NO: 183447 - DNA, 20 bp, human
gtcgcgccggggccggatgg

SEQ ID NO: 183448 - DNA, 20 bp, human
gcgtgaaaacggagctgctg

SEQ ID NO: 183449 - DNA, 20 bp, human
gccgcagggcccgcaacccg

SEQ ID NO: 183450 - DNA, 20 bp, human
gcgccgcgggaccgcagtcc

SEQ ID NO: 183451 - DNA, 20 bp, human
ggaaaatggcgctggtgcag

SEQ ID NO: 183452 - DNA, 20 bp, human
gtaaagtgcacgagcaagtg

SEQ ID NO: 183453 - DNA, 20 bp, human
gctccccgcggcgctgcgga

SEQ ID NO: 183454 - DNA, 20 bp, human
gcgccgaggcccgaagtctc

SEQ ID NO: 183455 - DNA, 20 bp, human
gggaacaagggcctccctcc

SEQ ID NO: 183456 - DNA, 20 bp, human
ggctgcaaggcgaaacggga

SEQ ID NO: 183457 - DNA, 20 bp, human
gcgtcgtaggggggactgag

SEQ ID NO: 183458 - DNA, 20 bp, human
gtgctgctgcaaggcgaaac

SEQ ID NO: 183459 - DNA, 20 bp, human
ggcttctccgcagactatgg

SEQ ID NO: 183460 - DNA, 20 bp, human
gccctcgactcaaatctcgg

SEQ ID NO: 183461 - DNA, 20 bp, human
gtggaggcgacgtcgtaggg

SEQ ID NO: 183462 - DNA, 20 bp, human
gactatggaggcgacgtcgt

SEQ ID NO: 183463 - DNA, 20 bp, human
gcgcccctcgactcaaatct

SEQ ID NO: 183464 - DNA, 20 bp, human
gtcggcgagggcgcccccgg

SEQ ID NO: 183465 - DNA, 20 bp, human
ggggtccccgtgctgctgca

SEQ ID NO: 183466 - DNA, 20 bp, human
gagcctcgatgcaggcgtag

SEQ ID NO: 183467 - DNA, 20 bp, human
gggcagctgtgcacgcgagg

SEQ ID NO: 183468 - DNA, 20 bp, human
ggcctctcgctacaacatgt

SEQ ID NO: 183469 - DNA, 20 bp, human
ggccaggcgagcctcgatgc

SEQ ID NO: 183470 - DNA, 20 bp, human
ggtctcctaggagggttggg

SEQ ID NO: 183471 - DNA, 20 bp, human
gcgaggtggcgtctcctagg

SEQ ID NO: 183472 - DNA, 20 bp, human
gggtgccgcccaaccctcct

SEQ ID NO: 183473 - DNA, 20 bp, human
gtgcctctacgcctgcatcg

SEQ ID NO: 183474 - DNA, 20 bp, human
ggccgacatgttgtagcgag

SEQ ID NO: 183475 - DNA, 20 bp, human
gggcgtctcctaggagggtt

SEQ ID NO: 183476 - DNA, 20 bp, human
gtgtgtccaggcagggagcg

SEQ ID NO: 183477 - DNA, 20 bp, human
gtgaagacaggggactgaca

SEQ ID NO: 183478 - DNA, 20 bp, human
ggacaggggactgacaaggt

SEQ ID NO: 183479 - DNA, 20 bp, human
ggctggtttcccccagaaga

SEQ ID NO: 183480 - DNA, 20 bp, human
gggttctggcagggatgtct

SEQ ID NO: 183481 - DNA, 20 bp, human
gcacagatcagattaggaga

SEQ ID NO: 183482 - DNA, 20 bp, human
gatcagattaggagaaggtg

SEQ ID NO: 183483 - DNA, 20 bp, human
gcacagaaacatctgaagac

SEQ ID NO: 183484 - DNA, 20 bp, human
ggcagaggagccactaagtc

SEQ ID NO: 183485 - DNA, 20 bp, human
gcaagaccacagatcagatt

SEQ ID NO: 183486 - DNA, 20 bp, human
gtaggctatgagctacagga

SEQ ID NO: 183487 - DNA, 20 bp, human
ggggagcctgaggcgcggtc

SEQ ID NO: 183488 - DNA, 20 bp, human
gcaggctcccccaggtactg

SEQ ID NO: 183489 - DNA, 20 bp, human
ggctatgagctacaggaggg

SEQ ID NO: 183490 - DNA, 20 bp, human
gcccgaaacaaagaggaccg

SEQ ID NO: 183491 - DNA, 20 bp, human
gagccgctccggaaagccta

SEQ ID NO: 183492 - DNA, 20 bp, human
gggtatttcaggggcttcta

SEQ ID NO: 183493 - DNA, 20 bp, human
gcctgaggcgcggtccggca

SEQ ID NO: 183494 - DNA, 20 bp, human
gccagcttcgccggagtccg

SEQ ID NO: 183495 - DNA, 20 bp, human
ggccggggaaggaggaaacg

SEQ ID NO: 183496 - DNA, 20 bp, human
gctacctggtgtccacaggt

SEQ ID NO: 183497 - DNA, 20 bp, human
gtcccaggagccagtagtga

SEQ ID NO: 183498 - DNA, 20 bp, human
gagagtccaggtgaagagtc

SEQ ID NO: 183499 - DNA, 20 bp, human
gcagggctcagagtgaaggt

SEQ ID NO: 183500 - DNA, 20 bp, human
gccaagacgactcagagtcc

SEQ ID NO: 183501 - DNA, 20 bp, human
gagactgttgccttcactac

SEQ ID NO: 183502 - DNA, 20 bp, human
ggccttcactactggctcct

SEQ ID NO: 183503 - DNA, 20 bp, human
gtctgagtcgtcttggtccc

SEQ ID NO: 183504 - DNA, 20 bp, human
gcactctgagccctgagaaa

SEQ ID NO: 183505 - DNA, 20 bp, human
gaagaataaaggcacctacc

SEQ ID NO: 183506 - DNA, 20 bp, human
gtcggcagcgacagtgagga

SEQ ID NO: 183507 - DNA, 20 bp, human
ggatctcggcagcgacagtg

SEQ ID NO: 183508 - DNA, 20 bp, human
gcacaaccgactgtggatct

SEQ ID NO: 183509 - DNA, 20 bp, human
gcacttgtcccctgcaacag

SEQ ID NO: 183510 - DNA, 20 bp, human
gcgctgccgagatccacagt

SEQ ID NO: 183511 - DNA, 20 bp, human
ggactccgggagtcagatgg

SEQ ID NO: 183512 - DNA, 20 bp, human
gccgggagggcggcgtctca

SEQ ID NO: 183513 - DNA, 20 bp, human
gtgggatgcagacaactgag

SEQ ID NO: 183514 - DNA, 20 bp, human
ggagtcagatggtggaacca

SEQ ID NO: 183515 - DNA, 20 bp, human
ggggtgggcagtatgtgtca

SEQ ID NO: 183516 - DNA, 20 bp, human
ggtgtagcgggcgcactacg

SEQ ID NO: 183517 - DNA, 20 bp, human
ggccgtccccgagctcccga

SEQ ID NO: 183518 - DNA, 20 bp, human
gccgagctcccgagggccca

SEQ ID NO: 183519 - DNA, 20 bp, human
gggcagaaggagcgaagctc

SEQ ID NO: 183520 - DNA, 20 bp, human
gggcgccccgagatacttac

SEQ ID NO: 183521 - DNA, 20 bp, human
gggcgcactacggggacgct

SEQ ID NO: 183522 - DNA, 20 bp, human
gccctcggagccgctcccct

SEQ ID NO: 183523 - DNA, 20 bp, human
gggcgcgtcgggctcgtcct

SEQ ID NO: 183524 - DNA, 20 bp, human
ggcagcccgtaagtatctcg

SEQ ID NO: 183525 - DNA, 20 bp, human
gggccgggcaccgggctgtg

SEQ ID NO: 183526 - DNA, 20 bp, human
gctcactcgggtctccgcgg

SEQ ID NO: 183527 - DNA, 20 bp, human
gccgtgcgcagggttgctaa

SEQ ID NO: 183528 - DNA, 20 bp, human
gtcactcactcgggtctccg

SEQ ID NO: 183529 - DNA, 20 bp, human
gtgttggctgaggcaagccg

SEQ ID NO: 183530 - DNA, 20 bp, human
gccccgcgtcgcccgagcca

SEQ ID NO: 183531 - DNA, 20 bp, human
ggcgcaacggcagacggtat

SEQ ID NO: 183532 - DNA, 20 bp, human
gcgcgctcaggccaccctgg

SEQ ID NO: 183533 - DNA, 20 bp, human
gggagggacgcatcacgcag

SEQ ID NO: 183534 - DNA, 20 bp, human
gcggcggcggggcgctctac

SEQ ID NO: 183535 - DNA, 20 bp, human
ggtggaagaggtagtccggc

SEQ ID NO: 183536 - DNA, 20 bp, human
gcatcggtaaattcccagag

SEQ ID NO: 183537 - DNA, 20 bp, human
gtgaagacagcagaacacgg

SEQ ID NO: 183538 - DNA, 20 bp, human
ggactcaggcgggagacgag

SEQ ID NO: 183539 - DNA, 20 bp, human
gtcccgcctgagtcgtctgt

SEQ ID NO: 183540 - DNA, 20 bp, human
gcctgaaccgcgccaggaga

SEQ ID NO: 183541 - DNA, 20 bp, human
gacccacagacgactcaggc

SEQ ID NO: 183542 - DNA, 20 bp, human
gtgtagtctggagctcataa

SEQ ID NO: 183543 - DNA, 20 bp, human
gcgggagacgagcggtgtca

SEQ ID NO: 183544 - DNA, 20 bp, human
gccggagccgcggtgtacaa

SEQ ID NO: 183545 - DNA, 20 bp, human
gggcgcggttcaggcagtcg

SEQ ID NO: 183546 - DNA, 20 bp, human
gtgacaactgtctccgtcgc

SEQ ID NO: 183547 - DNA, 20 bp, human
gcactcagcgcgggccggtg

SEQ ID NO: 183548 - DNA, 20 bp, human
gggctgtcagctgactgtgg

SEQ ID NO: 183549 - DNA, 20 bp, human
gggcggctgtcagctgactg

SEQ ID NO: 183550 - DNA, 20 bp, human
gctccgtcgcaggctccggc

SEQ ID NO: 183551 - DNA, 20 bp, human
gcggggcccgcctccatctg

SEQ ID NO: 183552 - DNA, 20 bp, human
gggagacagttgtcacctcg

SEQ ID NO: 183553 - DNA, 20 bp, human
gccgcgctgagtgctgacgg

SEQ ID NO: 183554 - DNA, 20 bp, human
gggcaggccccgctccccaa

SEQ ID NO: 183555 - DNA, 20 bp, human
gtgagctcaccgccgtgccg

SEQ ID NO: 183556 - DNA, 20 bp, human
gttgctgtcagctgattccc

SEQ ID NO: 183557 - DNA, 20 bp, human
gcgccgctgccaccaacccc

SEQ ID NO: 183558 - DNA, 20 bp, human
gtgctggggtccccaatcga

SEQ ID NO: 183559 - DNA, 20 bp, human
ggtcccactggagagctgaa

SEQ ID NO: 183560 - DNA, 20 bp, human
gtccgggtgcctagtcacgg

SEQ ID NO: 183561 - DNA, 20 bp, human
ggtcagctgattcccggggt

SEQ ID NO: 183562 - DNA, 20 bp, human
ggcctccgggtgcctagtca

SEQ ID NO: 183563 - DNA, 20 bp, human
ggaccccagcagacgcacat

SEQ ID NO: 183564 - DNA, 20 bp, human
ggtgcctagtcacggaggca

SEQ ID NO: 183565 - DNA, 20 bp, human
gcgtcacgtgacgcactcgg

SEQ ID NO: 183566 - DNA, 20 bp, human
gggaggtcgcgtagggatcc

SEQ ID NO: 183567 - DNA, 20 bp, human
gcctatgaggtggcccacgg

SEQ ID NO: 183568 - DNA, 20 bp, human
gggcccacggaggtcgcgta

SEQ ID NO: 183569 - DNA, 20 bp, human
gcggccctctggcgctacca

SEQ ID NO: 183570 - DNA, 20 bp, human
ggtcgggagccggagagcgg

SEQ ID NO: 183571 - DNA, 20 bp, human
gtgactcttgccaaacgcca

SEQ ID NO: 183572 - DNA, 20 bp, human
gggagtcgggagccggagag

SEQ ID NO: 183573 - DNA, 20 bp, human
gatccctacgcgacctccgt

SEQ ID NO: 183574 - DNA, 20 bp, human
gacgccatggtagcgccaga

SEQ ID NO: 183575 - DNA, 20 bp, human
gggccacctcataggtaagg

SEQ ID NO: 183576 - DNA, 20 bp, human
gggagtccggcgggttacag

SEQ ID NO: 183577 - DNA, 20 bp, human
gggcaagtgtcagtcaggac

SEQ ID NO: 183578 - DNA, 20 bp, human
ggttacagcggaggcctagg

SEQ ID NO: 183579 - DNA, 20 bp, human
gcctgcccgtgggatagcac

SEQ ID NO: 183580 - DNA, 20 bp, human
ggtccggcgggttacagcgg

SEQ ID NO: 183581 - DNA, 20 bp, human
gaaggcccagcccccccggg

SEQ ID NO: 183582 - DNA, 20 bp, human
ggtcagtcaggacgggagtc

SEQ ID NO: 183583 - DNA, 20 bp, human
gagtcaggacgggagtccgg

SEQ ID NO: 183584 - DNA, 20 bp, human
gctcggcgttccagagagtg

SEQ ID NO: 183585 - DNA, 20 bp, human
gggtgccggtgctatcccac

SEQ ID NO: 183586 - DNA, 20 bp, human
gagctgcgccgaccgctctg

SEQ ID NO: 183587 - DNA, 20 bp, human
ggttcctggcccgcggccgt

SEQ ID NO: 183588 - DNA, 20 bp, human
gcggcgcagctcacacccga

SEQ ID NO: 183589 - DNA, 20 bp, human
ggcgggccaggaacacagaa

SEQ ID NO: 183590 - DNA, 20 bp, human
gggcactagagcccccggag

SEQ ID NO: 183591 - DNA, 20 bp, human
gccaaaatggaattcctacg

SEQ ID NO: 183592 - DNA, 20 bp, human
gtgcacggctaaagtgtctg

SEQ ID NO: 183593 - DNA, 20 bp, human
gtgacccctcctgtgaaggg

SEQ ID NO: 183594 - DNA, 20 bp, human
ggcgtggtgcggccctcaat

SEQ ID NO: 183595 - DNA, 20 bp, human
gtacggggcactagagcccc

SEQ ID NO: 183596 - DNA, 20 bp, human
gcgcccaacgctcggcttgt

SEQ ID NO: 183597 - DNA, 20 bp, human
gacggagggcatccgaccgc

SEQ ID NO: 183598 - DNA, 20 bp, human
gggaggagggagcggacgga

SEQ ID NO: 183599 - DNA, 20 bp, human
gggcggccaagaggcggagg

SEQ ID NO: 183600 - DNA, 20 bp, human
gccggcccgcgcccaacgct

SEQ ID NO: 183601 - DNA, 20 bp, human
gaaggcgccacaggccgccg

SEQ ID NO: 183602 - DNA, 20 bp, human
ggctcagtagacgcaggtcc

SEQ ID NO: 183603 - DNA, 20 bp, human
gacagtgagtgggaccgagg

SEQ ID NO: 183604 - DNA, 20 bp, human
gcaggtagctcagtagacgc

SEQ ID NO: 183605 - DNA, 20 bp, human
ggtctactgagctacctgtg

SEQ ID NO: 183606 - DNA, 20 bp, human
ggatccgcgtggtacgggat

SEQ ID NO: 183607 - DNA, 20 bp, human
gtgtgggatccgcgtggtac

SEQ ID NO: 183608 - DNA, 20 bp, human
ggcggcagccatgactgtag

SEQ ID NO: 183609 - DNA, 20 bp, human
ggactggggttcccctgcac

SEQ ID NO: 183610 - DNA, 20 bp, human
gcctgcaccggcagcagcga

SEQ ID NO: 183611 - DNA, 20 bp, human
gccggtgtcccctacagtca

SEQ ID NO: 183612 - DNA, 20 bp, human
gccgagccccactggagcta

SEQ ID NO: 183613 - DNA, 20 bp, human
ggacaccggaagcggaaagg

SEQ ID NO: 183614 - DNA, 20 bp, human
ggtacgggatcggagcgaag

SEQ ID NO: 183615 - DNA, 20 bp, human
ggcccaaggtcacccaacac

SEQ ID NO: 183616 - DNA, 20 bp, human
gggtgtgccgcaccacacgg

SEQ ID NO: 183617 - DNA, 20 bp, human
ggaaggtgtgccgcaccaca

SEQ ID NO: 183618 - DNA, 20 bp, human
gcttaggatgggggccaaca

SEQ ID NO: 183619 - DNA, 20 bp, human
gcttctcagggctcagaacg

SEQ ID NO: 183620 - DNA, 20 bp, human
ggtgccgcaccacacggggg

SEQ ID NO: 183621 - DNA, 20 bp, human
gaggatgccggagtcggaag

SEQ ID NO: 183622 - DNA, 20 bp, human
ggagctcctccacagagtct

SEQ ID NO: 183623 - DNA, 20 bp, human
ggccggcgcttgcgcccgga

SEQ ID NO: 183624 - DNA, 20 bp, human
gaccttccgggcgcaagcgc

SEQ ID NO: 183625 - DNA, 20 bp, human
gaacgaggcctaaataactt

SEQ ID NO: 183626 - DNA, 20 bp, human
gagtgccaccggaagtgcaa

SEQ ID NO: 183627 - DNA, 20 bp, human
gctcacccttgcacttccgg

SEQ ID NO: 183628 - DNA, 20 bp, human
ggcgatggcctggatctcgg

SEQ ID NO: 183629 - DNA, 20 bp, human
gccaggccatcgcagcccag

SEQ ID NO: 183630 - DNA, 20 bp, human
gggccatcgcagcccagcgg

SEQ ID NO: 183631 - DNA, 20 bp, human
gctgctaggggagaggtcag

SEQ ID NO: 183632 - DNA, 20 bp, human
gccccatggtcgcctgctag

SEQ ID NO: 183633 - DNA, 20 bp, human
gcgccagtgagaaccggggc

SEQ ID NO: 183634 - DNA, 20 bp, human
gcctggatctcgggggaagg

SEQ ID NO: 183635 - DNA, 20 bp, human
gagcactaggaggtgatgtt

SEQ ID NO: 183636 - DNA, 20 bp, human
gaccccggtcatcttgatgg

SEQ ID NO: 183637 - DNA, 20 bp, human
gctcatggagagacaaccct

SEQ ID NO: 183638 - DNA, 20 bp, human
gagtcctctggactaaaatg

SEQ ID NO: 183639 - DNA, 20 bp, human
ggccgaggttagcctgtgaa

SEQ ID NO: 183640 - DNA, 20 bp, human
gtggggagccggataatggg

SEQ ID NO: 183641 - DNA, 20 bp, human
ggggtgagagatcaaagatg

SEQ ID NO: 183642 - DNA, 20 bp, human
gtagggaaggagagcactca

SEQ ID NO: 183643 - DNA, 20 bp, human
gggcggggcaaagtccccat

SEQ ID NO: 183644 - DNA, 20 bp, human
ggcagcatgatggtctgaga

SEQ ID NO: 183645 - DNA, 20 bp, human
ggttctgccatcactcaaga

SEQ ID NO: 183646 - DNA, 20 bp, human
ggacgtggattgtcccgtgc

SEQ ID NO: 183647 - DNA, 20 bp, human
gccctcaatccggaacatcg

SEQ ID NO: 183648 - DNA, 20 bp, human
gcgccgcgctctgctctcca

SEQ ID NO: 183649 - DNA, 20 bp, human
gcggcgcgaggccctcaatc

SEQ ID NO: 183650 - DNA, 20 bp, human
gcagcggggagctcaccgac

SEQ ID NO: 183651 - DNA, 20 bp, human
gcgcgctctgctctccacgg

SEQ ID NO: 183652 - DNA, 20 bp, human
ggctgtgactgtgagaccag

SEQ ID NO: 183653 - DNA, 20 bp, human
gggcactgaagtgcacgtgg

SEQ ID NO: 183654 - DNA, 20 bp, human
ggcgccgaagctggacccgg

SEQ ID NO: 183655 - DNA, 20 bp, human
gaggtctgcgggtcagggtc

SEQ ID NO: 183656 - DNA, 20 bp, human
ggcgctcaccgggacagtgc

SEQ ID NO: 183657 - DNA, 20 bp, human
gcagctaaagcactagtcca

SEQ ID NO: 183658 - DNA, 20 bp, human
gatggcttccagcactgtcc

SEQ ID NO: 183659 - DNA, 20 bp, human
ggtaatgtcaccctgatcaa

SEQ ID NO: 183660 - DNA, 20 bp, human
gctcggtggaggaaccgtat

SEQ ID NO: 183661 - DNA, 20 bp, human
gagcttcgcatgggcctcgg

SEQ ID NO: 183662 - DNA, 20 bp, human
gcgagccagcagcgctcacc

SEQ ID NO: 183663 - DNA, 20 bp, human
gcatgcgaagctttccacta

SEQ ID NO: 183664 - DNA, 20 bp, human
gctggccagggatctcagtg

SEQ ID NO: 183665 - DNA, 20 bp, human
ggccggaagtgccagaccgg

SEQ ID NO: 183666 - DNA, 20 bp, human
ggagccagtttgccattcgc

SEQ ID NO: 183667 - DNA, 20 bp, human
ggagggttggatgaccccag

SEQ ID NO: 183668 - DNA, 20 bp, human
gacggccgtgtggcgcaggg

SEQ ID NO: 183669 - DNA, 20 bp, human
gcccccgacggccaaaaatg

SEQ ID NO: 183670 - DNA, 20 bp, human
gcgccacacggccgtcgcca

SEQ ID NO: 183671 - DNA, 20 bp, human
gcacttaggaccacatggag

SEQ ID NO: 183672 - DNA, 20 bp, human
gtcgggaatccgaaagggaa

SEQ ID NO: 183673 - DNA, 20 bp, human
gttacagcaaccacagcgtc

SEQ ID NO: 183674 - DNA, 20 bp, human
ggcgacggccgtgtggcgca

SEQ ID NO: 183675 - DNA, 20 bp, human
gcatatttctcgggattgta

SEQ ID NO: 183676 - DNA, 20 bp, human
ggggtgtgagtaggagtctt

SEQ ID NO: 183677 - DNA, 20 bp, human
ggcgtgcgaaggaagaccga

SEQ ID NO: 183678 - DNA, 20 bp, human
gggcgctcaagagatccgag

SEQ ID NO: 183679 - DNA, 20 bp, human
ggcgaacggaagaccccgga

SEQ ID NO: 183680 - DNA, 20 bp, human
ggcgaaggaagaccgaggga

SEQ ID NO: 183681 - DNA, 20 bp, human
ggtgagcaccgggaccttca

SEQ ID NO: 183682 - DNA, 20 bp, human
ggagagcggacgacagaaaa

SEQ ID NO: 183683 - DNA, 20 bp, human
gctcccggagctcggtacag

SEQ ID NO: 183684 - DNA, 20 bp, human
gaagcagccccaggccgtag

SEQ ID NO: 183685 - DNA, 20 bp, human
gatgagcgagcgagcacgct

SEQ ID NO: 183686 - DNA, 20 bp, human
gctcggatcgccgcgggatc

SEQ ID NO: 183687 - DNA, 20 bp, human
ggcttcgccgtaagttcctc

SEQ ID NO: 183688 - DNA, 20 bp, human
gggcgtagcggcctaggcgg

SEQ ID NO: 183689 - DNA, 20 bp, human
gggggtccccgaggaactta

SEQ ID NO: 183690 - DNA, 20 bp, human
gctccgcgcccccggaggaa

SEQ ID NO: 183691 - DNA, 20 bp, human
ggcgggaagtccggatcccg

SEQ ID NO: 183692 - DNA, 20 bp, human
gcggcgcagcgcgggaagtc

SEQ ID NO: 183693 - DNA, 20 bp, human
gggcgatccgagcatgagcc

SEQ ID NO: 183694 - DNA, 20 bp, human
gagcgcgctgacgaccctct

SEQ ID NO: 183695 - DNA, 20 bp, human
gcagtgctgctccagagcct

SEQ ID NO: 183696 - DNA, 20 bp, human
gaggtggtccccactcatgt

SEQ ID NO: 183697 - DNA, 20 bp, human
gtcaggcagcgtcgccgccg

SEQ ID NO: 183698 - DNA, 20 bp, human
gacgctgcctgactgccggg

SEQ ID NO: 183699 - DNA, 20 bp, human
ggcaggcggcccctcaccgg

SEQ ID NO: 183700 - DNA, 20 bp, human
gctagcgagccgatctactc

SEQ ID NO: 183701 - DNA, 20 bp, human
gacccgggggtggccacaga

SEQ ID NO: 183702 - DNA, 20 bp, human
ggccgcctgccggagtagat

SEQ ID NO: 183703 - DNA, 20 bp, human
gacggctgaggctgctacca

SEQ ID NO: 183704 - DNA, 20 bp, human
gggctgttacacaactgctg

SEQ ID NO: 183705 - DNA, 20 bp, human
gtgagcccaaatgcgaactt

SEQ ID NO: 183706 - DNA, 20 bp, human
ggcctgggcctcaacactgt

SEQ ID NO: 183707 - DNA, 20 bp, human
ggctctgacgctgctcgggg

SEQ ID NO: 183708 - DNA, 20 bp, human
gctggcagatgcgcgtggtg

SEQ ID NO: 183709 - DNA, 20 bp, human
gagggcagtggagccaggta

SEQ ID NO: 183710 - DNA, 20 bp, human
gcttgggtaggtccagaaag

SEQ ID NO: 183711 - DNA, 20 bp, human
ggctcgcgcaggacgcagaa

SEQ ID NO: 183712 - DNA, 20 bp, human
gggggagtggcaggcctcgt

SEQ ID NO: 183713 - DNA, 20 bp, human
ggagcccgggacaccccggg

SEQ ID NO: 183714 - DNA, 20 bp, human
ggcctcaacactgtagggtt

SEQ ID NO: 183715 - DNA, 20 bp, human
gccctacagtgttgaggccc

SEQ ID NO: 183716 - DNA, 20 bp, human
gacgcgcgtctgtggagaag

SEQ ID NO: 183717 - DNA, 20 bp, human
gggcggccagagagatgccc

SEQ ID NO: 183718 - DNA, 20 bp, human
gggagaagcggcttggtcgg

SEQ ID NO: 183719 - DNA, 20 bp, human
gcgtgacgggtgaagctctg

SEQ ID NO: 183720 - DNA, 20 bp, human
gaaccgggaatggagaatat

SEQ ID NO: 183721 - DNA, 20 bp, human
gaccctgaaagcgactaaac

SEQ ID NO: 183722 - DNA, 20 bp, human
gccacagacgcgcgtcggtt

SEQ ID NO: 183723 - DNA, 20 bp, human
gtgtggagaagcggcttggt

SEQ ID NO: 183724 - DNA, 20 bp, human
gtctaggggcaggagtccgt

SEQ ID NO: 183725 - DNA, 20 bp, human
gggatccactacgggaccaa

SEQ ID NO: 183726 - DNA, 20 bp, human
gggtgttatgccggacaaga

SEQ ID NO: 183727 - DNA, 20 bp, human
gccatcgcgaagatccggag

SEQ ID NO: 183728 - DNA, 20 bp, human
gccggctgccctcaaactcg

SEQ ID NO: 183729 - DNA, 20 bp, human
ggaaagcagggagcgaccgg

SEQ ID NO: 183730 - DNA, 20 bp, human
ggcgctaggcccgggcgacg

SEQ ID NO: 183731 - DNA, 20 bp, human
gagggaggtgaccgtggcgg

SEQ ID NO: 183732 - DNA, 20 bp, human
ggtgcggcgagtggagcggt

SEQ ID NO: 183733 - DNA, 20 bp, human
ggtcggcgcggctaggagtg

SEQ ID NO: 183734 - DNA, 20 bp, human
gcgccgcgcctcgagtttga

SEQ ID NO: 183735 - DNA, 20 bp, human
gccagccgagcccgctgagg

SEQ ID NO: 183736 - DNA, 20 bp, human
gaagttccacgccaagatac

SEQ ID NO: 183737 - DNA, 20 bp, human
ggctcggtgggcctccctta

SEQ ID NO: 183738 - DNA, 20 bp, human
gactggattcggtgctgagg

SEQ ID NO: 183739 - DNA, 20 bp, human
gcagctgcgtgccttaaggg

SEQ ID NO: 183740 - DNA, 20 bp, human
gccgagcgggacagcgtggt

SEQ ID NO: 183741 - DNA, 20 bp, human
gtcagtgactgaagctccaa

SEQ ID NO: 183742 - DNA, 20 bp, human
gcttaaggcacgcagctgat

SEQ ID NO: 183743 - DNA, 20 bp, human
ggatactggattcggtgctg

SEQ ID NO: 183744 - DNA, 20 bp, human
gcggctgccggcgcatcctg

SEQ ID NO: 183745 - DNA, 20 bp, human
gcagccaccggagcgcgtag

SEQ ID NO: 183746 - DNA, 20 bp, human
gatcggtgcggtacacaccc

SEQ ID NO: 183747 - DNA, 20 bp, human
gcgcaccgcggatccagctc

SEQ ID NO: 183748 - DNA, 20 bp, human
gcggctggacccggaaatag

SEQ ID NO: 183749 - DNA, 20 bp, human
gctcgcccggcggctcagaa

SEQ ID NO: 183750 - DNA, 20 bp, human
gggtagccgccccgggaaca

SEQ ID NO: 183751 - DNA, 20 bp, human
ggagagtatcacccccgcca

SEQ ID NO: 183752 - DNA, 20 bp, human
gctgcgggaccctcgcccgg

SEQ ID NO: 183753 - DNA, 20 bp, human
gctcacccacagccgcaccg

SEQ ID NO: 183754 - DNA, 20 bp, human
gggttgtcggtagccgcccc

SEQ ID NO: 183755 - DNA, 20 bp, human
gcgggaacaaggaccggagc

SEQ ID NO: 183756 - DNA, 20 bp, human
gggcagtaggtacctccagg

SEQ ID NO: 183757 - DNA, 20 bp, human
gagctcgcaggaacccaccg

SEQ ID NO: 183758 - DNA, 20 bp, human
ggagggcagtaggtacctcc

SEQ ID NO: 183759 - DNA, 20 bp, human
gggcctagaagcagcaaagg

SEQ ID NO: 183760 - DNA, 20 bp, human
gcgaggcctagaagcagcaa

SEQ ID NO: 183761 - DNA, 20 bp, human
gggagcacgctgaggtacaa

SEQ ID NO: 183762 - DNA, 20 bp, human
ggcagcgtttgcaccgcggt

SEQ ID NO: 183763 - DNA, 20 bp, human
gggctaaaggtaagtgatcg

SEQ ID NO: 183764 - DNA, 20 bp, human
gcccctctgcaccagctcgc

SEQ ID NO: 183765 - DNA, 20 bp, human
gcgcaaggcgtcaggtggag

SEQ ID NO: 183766 - DNA, 20 bp, human
gtctccgggcggcgagtcgg

SEQ ID NO: 183767 - DNA, 20 bp, human
gggcatcgcgaaccccagtt

SEQ ID NO: 183768 - DNA, 20 bp, human
gggctccaacgaggtaagtg

SEQ ID NO: 183769 - DNA, 20 bp, human
gtaggggcggcgccgagtcg

SEQ ID NO: 183770 - DNA, 20 bp, human
gagaccccgaggctccaacg

SEQ ID NO: 183771 - DNA, 20 bp, human
gacagccccctcccccgact

SEQ ID NO: 183772 - DNA, 20 bp, human
gaagcaaacgctggagaacc

SEQ ID NO: 183773 - DNA, 20 bp, human
gatggtcttggccctgcata

SEQ ID NO: 183774 - DNA, 20 bp, human
ggcgcggttggcgcgaaagt

SEQ ID NO: 183775 - DNA, 20 bp, human
gggacgcgctggccgcaggg

SEQ ID NO: 183776 - DNA, 20 bp, human
gaagaggcggagtcgaggtg

SEQ ID NO: 183777 - DNA, 20 bp, human
gcgcctgggaggttactgta

SEQ ID NO: 183778 - DNA, 20 bp, human
gcgtatcctccaggaagagg

SEQ ID NO: 183779 - DNA, 20 bp, human
gctagaaagaaaaccagtgg

SEQ ID NO: 183780 - DNA, 20 bp, human
gctggcagccaccgcctggg

SEQ ID NO: 183781 - DNA, 20 bp, human
ggtacgcctatctccttagt

SEQ ID NO: 183782 - DNA, 20 bp, human
gctcgtgcccggctaaaaga

SEQ ID NO: 183783 - DNA, 20 bp, human
gggagtgaaatgcttaattc

SEQ ID NO: 183784 - DNA, 20 bp, human
gactgggcccgcaggcggaa

SEQ ID NO: 183785 - DNA, 20 bp, human
gcgggcccagtgagtcgaca

SEQ ID NO: 183786 - DNA, 20 bp, human
ggtcggcgcgagaacaagca

SEQ ID NO: 183787 - DNA, 20 bp, human
gggcgcgagaacaagcaggg

SEQ ID NO: 183788 - DNA, 20 bp, human
gtagggctgggttaagacca

SEQ ID NO: 183789 - DNA, 20 bp, human
gtagccgggagggtaggctg

SEQ ID NO: 183790 - DNA, 20 bp, human
ggagccttagccgggagggt

SEQ ID NO: 183791 - DNA, 20 bp, human
gcgggtccgggcatgaagct

SEQ ID NO: 183792 - DNA, 20 bp, human
gggctccaccgcctgcacca

SEQ ID NO: 183793 - DNA, 20 bp, human
gatggcactagggccgggtt

SEQ ID NO: 183794 - DNA, 20 bp, human
gggctgggttaagaccaggg

SEQ ID NO: 183795 - DNA, 20 bp, human
gggctgcaccggttcgcggt

SEQ ID NO: 183796 - DNA, 20 bp, human
gagacacaccatgggcccag

SEQ ID NO: 183797 - DNA, 20 bp, human
gccttcggtctaggcagcgg

SEQ ID NO: 183798 - DNA, 20 bp, human
gctaccttcggtctaggcag

SEQ ID NO: 183799 - DNA, 20 bp, human
ggtcttgagggctgtgagag

SEQ ID NO: 183800 - DNA, 20 bp, human
gcgtgaaggcctgcagaaaa

SEQ ID NO: 183801 - DNA, 20 bp, human
gggcggcacaagtccagagg

SEQ ID NO: 183802 - DNA, 20 bp, human
ggggcgctctgcccaacatc

SEQ ID NO: 183803 - DNA, 20 bp, human
gcgcgtactaccttcggtct

SEQ ID NO: 183804 - DNA, 20 bp, human
gtgagtgctgctgctgaagg

SEQ ID NO: 183805 - DNA, 20 bp, human
gtggtcgtgtggagcgaccc

SEQ ID NO: 183806 - DNA, 20 bp, human
ggtcatatgggcggggaccc

SEQ ID NO: 183807 - DNA, 20 bp, human
ggagcggagagaatactcga

SEQ ID NO: 183808 - DNA, 20 bp, human
gaccgctcggctgcacccag

SEQ ID NO: 183809 - DNA, 20 bp, human
ggacgacattcgggccgcgg

SEQ ID NO: 183810 - DNA, 20 bp, human
ggcggcccgaatgtcgtcca

SEQ ID NO: 183811 - DNA, 20 bp, human
gttgtgcggtacgaaggtgg

SEQ ID NO: 183812 - DNA, 20 bp, human
ggggaccctggacgacattc

SEQ ID NO: 183813 - DNA, 20 bp, human
gtcgtaaaactgttagtatc

SEQ ID NO: 183814 - DNA, 20 bp, human
gcggtacgaaggtgggggtg

SEQ ID NO: 183815 - DNA, 20 bp, human
gcatttgtgcggtacgaagg

SEQ ID NO: 183816 - DNA, 20 bp, human
gctggggcagccccacgatc

SEQ ID NO: 183817 - DNA, 20 bp, human
gcgagtgctgccgcgaggag

SEQ ID NO: 183818 - DNA, 20 bp, human
gttctgcgggcttcgaggag

SEQ ID NO: 183819 - DNA, 20 bp, human
ggttcgcgggaacgcagaag

SEQ ID NO: 183820 - DNA, 20 bp, human
ggcccgtggcatctagacgg

SEQ ID NO: 183821 - DNA, 20 bp, human
ggcgcgcgcgagctgtgggt

SEQ ID NO: 183822 - DNA, 20 bp, human
gtcccgttccttgggatcac

SEQ ID NO: 183823 - DNA, 20 bp, human
gaggaacgggagctttagaa

SEQ ID NO: 183824 - DNA, 20 bp, human
ggttcccgcgaacggttccg

SEQ ID NO: 183825 - DNA, 20 bp, human
gatctggagactgtttgcga

SEQ ID NO: 183826 - DNA, 20 bp, human
gtgaggcccgagctcgttgt

SEQ ID NO: 183827 - DNA, 20 bp, human
gtcgggcctcacccggatgg

SEQ ID NO: 183828 - DNA, 20 bp, human
gagctcgggcctcacccgga

SEQ ID NO: 183829 - DNA, 20 bp, human
gcagccagcagaacccttgg

SEQ ID NO: 183830 - DNA, 20 bp, human
gaacgagctcgggcctcacc

SEQ ID NO: 183831 - DNA, 20 bp, human
gctgaggcctctctccaggt

SEQ ID NO: 183832 - DNA, 20 bp, human
gggaatggcctggccgtcaa

SEQ ID NO: 183833 - DNA, 20 bp, human
ggcccaagaacttccaccaa

SEQ ID NO: 183834 - DNA, 20 bp, human
ggagttgcagttcccgggcg

SEQ ID NO: 183835 - DNA, 20 bp, human
gactgccccacaacgagctc

SEQ ID NO: 183836 - DNA, 20 bp, human
gcccgagctgcgggaccatc

SEQ ID NO: 183837 - DNA, 20 bp, human
gtaagggagcctggctaggc

SEQ ID NO: 183838 - DNA, 20 bp, human
gctgaccgccccgggcttaa

SEQ ID NO: 183839 - DNA, 20 bp, human
gcccagatgtcgccccggac

SEQ ID NO: 183840 - DNA, 20 bp, human
gccccgcccacagccggtac

SEQ ID NO: 183841 - DNA, 20 bp, human
ggcggagcagagtgcgatcc

SEQ ID NO: 183842 - DNA, 20 bp, human
gacagtcgtcgggccacacc

SEQ ID NO: 183843 - DNA, 20 bp, human
gtccggctgccggcctagcc

SEQ ID NO: 183844 - DNA, 20 bp, human
gccaggctcccttaagcccg

SEQ ID NO: 183845 - DNA, 20 bp, human
gtggggcaagggcggtgatg

SEQ ID NO: 183846 - DNA, 20 bp, human
gccagctgcaggtagggggt

SEQ ID NO: 183847 - DNA, 20 bp, human
gggagccccccggagactag

SEQ ID NO: 183848 - DNA, 20 bp, human
ggagcggccggccggagtag

SEQ ID NO: 183849 - DNA, 20 bp, human
ggcaggaaatgcgcctccca

SEQ ID NO: 183850 - DNA, 20 bp, human
ggagtcgtcgaaggagtcag

SEQ ID NO: 183851 - DNA, 20 bp, human
ggaggggcagcgacacctgt

SEQ ID NO: 183852 - DNA, 20 bp, human
ggccccccggagactagtgg

SEQ ID NO: 183853 - DNA, 20 bp, human
gtgggccgtctcccaaggag

SEQ ID NO: 183854 - DNA, 20 bp, human
gagtgttctggagcgtgtgg

SEQ ID NO: 183855 - DNA, 20 bp, human
ggctccagaacacttggcgg

SEQ ID NO: 183856 - DNA, 20 bp, human
ggcttagacggaacagagtg

SEQ ID NO: 183857 - DNA, 20 bp, human
gtattgtggagtagctccgg

SEQ ID NO: 183858 - DNA, 20 bp, human
gaacgccccccggcaaacct

SEQ ID NO: 183859 - DNA, 20 bp, human
gcacaaacggatgtgaggga

SEQ ID NO: 183860 - DNA, 20 bp, human
gcggaacagagtgaggtgtc

SEQ ID NO: 183861 - DNA, 20 bp, human
gtcaagcagcaagaacacgg

SEQ ID NO: 183862 - DNA, 20 bp, human
gttagccgcgaacagcagga

SEQ ID NO: 183863 - DNA, 20 bp, human
gagggagaaggtcccagaca

SEQ ID NO: 183864 - DNA, 20 bp, human
gcggctaaggatccctgcct

SEQ ID NO: 183865 - DNA, 20 bp, human
ggccaaacaccgcgattgtg

SEQ ID NO: 183866 - DNA, 20 bp, human
gtacaggcggacgtccatgg

SEQ ID NO: 183867 - DNA, 20 bp, human
ggggtacaggcggacgtcca

SEQ ID NO: 183868 - DNA, 20 bp, human
ggggcgccgaggggtacagg

SEQ ID NO: 183869 - DNA, 20 bp, human
ggctcccgcgggcagtgcct

SEQ ID NO: 183870 - DNA, 20 bp, human
gcacccgtgcgacgacacag

SEQ ID NO: 183871 - DNA, 20 bp, human
gcgcgggcgccgaggggtac

SEQ ID NO: 183872 - DNA, 20 bp, human
gacgtccatggcgggcgcgg

SEQ ID NO: 183873 - DNA, 20 bp, human
ggtgcctggccgcctgcgtg

SEQ ID NO: 183874 - DNA, 20 bp, human
gcccgcccaggcactgcccg

SEQ ID NO: 183875 - DNA, 20 bp, human
ggacgtccgcctgtacccct

SEQ ID NO: 183876 - DNA, 20 bp, human
gcgcagtgcctggggtacta

SEQ ID NO: 183877 - DNA, 20 bp, human
gccctcgacggtggatctag

SEQ ID NO: 183878 - DNA, 20 bp, human
gccgcggccgccgcacacaa

SEQ ID NO: 183879 - DNA, 20 bp, human
gctcctcagtccgcccgggg

SEQ ID NO: 183880 - DNA, 20 bp, human
gcactgcgcgaagtccaggc

SEQ ID NO: 183881 - DNA, 20 bp, human
gcagcttcggcatggatgtg

SEQ ID NO: 183882 - DNA, 20 bp, human
ggatgtgaggttctaccccg

SEQ ID NO: 183883 - DNA, 20 bp, human
gccggccccgggcccagctt

SEQ ID NO: 183884 - DNA, 20 bp, human
gctcagtccgcccggggagg

SEQ ID NO: 183885 - DNA, 20 bp, human
ggctgtagccgtagtacccc

SEQ ID NO: 183886 - DNA, 20 bp, human
ggagtgttgtcagaatgtca

SEQ ID NO: 183887 - DNA, 20 bp, human
ggaggagagagagcggggtt

SEQ ID NO: 183888 - DNA, 20 bp, human
ggatgagggtctgagacggt

SEQ ID NO: 183889 - DNA, 20 bp, human
gtagggcctgaggcagcggt

SEQ ID NO: 183890 - DNA, 20 bp, human
gacggcagttccgagtccag

SEQ ID NO: 183891 - DNA, 20 bp, human
ggggcggacccggaacccag

SEQ ID NO: 183892 - DNA, 20 bp, human
ggggtctgagacggtgggag

SEQ ID NO: 183893 - DNA, 20 bp, human
gtcgccttcaaggctcgggc

SEQ ID NO: 183894 - DNA, 20 bp, human
gcacgtccttgcggaagtga

SEQ ID NO: 183895 - DNA, 20 bp, human
gaggaacctgatagctaaga

SEQ ID NO: 183896 - DNA, 20 bp, human
gccctacgcccagcaccggg

SEQ ID NO: 183897 - DNA, 20 bp, human
gagtctagagccaccgtcca

SEQ ID NO: 183898 - DNA, 20 bp, human
gcagggagcaggtagctgct

SEQ ID NO: 183899 - DNA, 20 bp, human
gtggctagagggatcatcat

SEQ ID NO: 183900 - DNA, 20 bp, human
ggagccaccgtccagggagc

SEQ ID NO: 183901 - DNA, 20 bp, human
gcaggagcttacccaatcca

SEQ ID NO: 183902 - DNA, 20 bp, human
ggattccctacgcccagcac

SEQ ID NO: 183903 - DNA, 20 bp, human
gcagctcgggaaaatcgctg

SEQ ID NO: 183904 - DNA, 20 bp, human
ggggaagcgtgtcaccgtcg

SEQ ID NO: 183905 - DNA, 20 bp, human
ggagagcccgtgactcagag

SEQ ID NO: 183906 - DNA, 20 bp, human
gggaccctccgactcctagg

SEQ ID NO: 183907 - DNA, 20 bp, human
gggctcaggacgcacagcat

SEQ ID NO: 183908 - DNA, 20 bp, human
gtgccccgcaaggagcccag

SEQ ID NO: 183909 - DNA, 20 bp, human
gtgcgtcctgagccacactt

SEQ ID NO: 183910 - DNA, 20 bp, human
gcacggaccctccgactcct

SEQ ID NO: 183911 - DNA, 20 bp, human
gcaggaggagaccatttcca

SEQ ID NO: 183912 - DNA, 20 bp, human
gctgcgggcctgccaaggac

SEQ ID NO: 183913 - DNA, 20 bp, human
gtggcaggcccgcagtggtg

SEQ ID NO: 183914 - DNA, 20 bp, human
ggtcggagggtccgtggaaa

SEQ ID NO: 183915 - DNA, 20 bp, human
gtctcagggagcgagcccat

SEQ ID NO: 183916 - DNA, 20 bp, human
gggcgacctagggatcgatc

SEQ ID NO: 183917 - DNA, 20 bp, human
gtggcgacagcggcgaccta

SEQ ID NO: 183918 - DNA, 20 bp, human
gacctagggatcgatctgga

SEQ ID NO: 183919 - DNA, 20 bp, human
gatcgatctggagggacttg

SEQ ID NO: 183920 - DNA, 20 bp, human
ggttggagggccctaaggag

SEQ ID NO: 183921 - DNA, 20 bp, human
gtagaggcgccagaaggacg

SEQ ID NO: 183922 - DNA, 20 bp, human
gggaaagggtgtctacgaga

SEQ ID NO: 183923 - DNA, 20 bp, human
ggggagagaagaggttagga

SEQ ID NO: 183924 - DNA, 20 bp, human
gtgtgacgtgacgggaaagg

SEQ ID NO: 183925 - DNA, 20 bp, human
gtccctcgcgctcgagctag

SEQ ID NO: 183926 - DNA, 20 bp, human
ggttctaagatcaaaaccag

SEQ ID NO: 183927 - DNA, 20 bp, human
gtgcccgaggtctccatcct

SEQ ID NO: 183928 - DNA, 20 bp, human
gctcaccagggactcaaggc

SEQ ID NO: 183929 - DNA, 20 bp, human
gaggctgcgcagtattggag

SEQ ID NO: 183930 - DNA, 20 bp, human
gagccttccagagcactccc

SEQ ID NO: 183931 - DNA, 20 bp, human
gctggaaggctgcgcagtat

SEQ ID NO: 183932 - DNA, 20 bp, human
ggaactgtcaaccccttctt

SEQ ID NO: 183933 - DNA, 20 bp, human
ggtttccctgtccttgcccc

SEQ ID NO: 183934 - DNA, 20 bp, human
gccagggactcaaggccgga

SEQ ID NO: 183935 - DNA, 20 bp, human
gagtgagatgggtctccctc

SEQ ID NO: 183936 - DNA, 20 bp, human
gccggccgggccccctgacg

SEQ ID NO: 183937 - DNA, 20 bp, human
gtcgacgctcgtgacggtcg

SEQ ID NO: 183938 - DNA, 20 bp, human
ggtctcttcgacgctcgtga

SEQ ID NO: 183939 - DNA, 20 bp, human
gggattagttggtttcggag

SEQ ID NO: 183940 - DNA, 20 bp, human
gcgagctgaggtgccccgga

SEQ ID NO: 183941 - DNA, 20 bp, human
gggcccgacccgggattagt

SEQ ID NO: 183942 - DNA, 20 bp, human
ggaagcgggtggccagactg

SEQ ID NO: 183943 - DNA, 20 bp, human
gctcggctggggcccgaccc

SEQ ID NO: 183944 - DNA, 20 bp, human
gcggcgagaccctaacctcg

SEQ ID NO: 183945 - DNA, 20 bp, human
ggcgcccacagccgtcgtgg

SEQ ID NO: 183946 - DNA, 20 bp, human
ggccctgggccggagaaccc

SEQ ID NO: 183947 - DNA, 20 bp, human
gcgcgcaggggagacggaag

SEQ ID NO: 183948 - DNA, 20 bp, human
ggcttgtgcgcggaaccgag

SEQ ID NO: 183949 - DNA, 20 bp, human
gtgtgcgcggaaccgagagg

SEQ ID NO: 183950 - DNA, 20 bp, human
ggcgaggggagagcgcgcag

SEQ ID NO: 183951 - DNA, 20 bp, human
gcgggcgccccgggacatct

SEQ ID NO: 183952 - DNA, 20 bp, human
gagcccgctgggaccccagg

SEQ ID NO: 183953 - DNA, 20 bp, human
gggtaagccccggccgcgca

SEQ ID NO: 183954 - DNA, 20 bp, human
gcgccagactcggtaagccc

SEQ ID NO: 183955 - DNA, 20 bp, human
gggaaaccgagtcagaggga

SEQ ID NO: 183956 - DNA, 20 bp, human
ggcgagaacagagcgggact

SEQ ID NO: 183957 - DNA, 20 bp, human
gggacccaggagcctcgcga

SEQ ID NO: 183958 - DNA, 20 bp, human
ggaggaggcgccattccaag

SEQ ID NO: 183959 - DNA, 20 bp, human
ggaagcagttggggcgaagg

SEQ ID NO: 183960 - DNA, 20 bp, human
gcctccgcaggtaggagccc

SEQ ID NO: 183961 - DNA, 20 bp, human
ggctgccaggagaagcagtt

SEQ ID NO: 183962 - DNA, 20 bp, human
gctcctacctgcggaggcag

SEQ ID NO: 183963 - DNA, 20 bp, human
gcggtccagccatcacctgt

SEQ ID NO: 183964 - DNA, 20 bp, human
gaccggcagaggtcctcaga

SEQ ID NO: 183965 - DNA, 20 bp, human
gaggactgaggaaccggcag

SEQ ID NO: 183966 - DNA, 20 bp, human
ggccgcctggtgcatgggag

SEQ ID NO: 183967 - DNA, 20 bp, human
gcgcaggagccagaaccact

SEQ ID NO: 183968 - DNA, 20 bp, human
gtcccctcccatgcaccagg

SEQ ID NO: 183969 - DNA, 20 bp, human
gaggcggccgaggacttccc

SEQ ID NO: 183970 - DNA, 20 bp, human
gccgggtccgcggcagacca

SEQ ID NO: 183971 - DNA, 20 bp, human
gctgctccgcgaggatacag

SEQ ID NO: 183972 - DNA, 20 bp, human
gaggagtaagtaactcatac

SEQ ID NO: 183973 - DNA, 20 bp, human
gggaggcagaggcagtcctg

SEQ ID NO: 183974 - DNA, 20 bp, human
gctcctgcctgggaagtcct

SEQ ID NO: 183975 - DNA, 20 bp, human
gtcccacccggaacacagat

SEQ ID NO: 183976 - DNA, 20 bp, human
gcctgggcgcagcgacccga

SEQ ID NO: 183977 - DNA, 20 bp, human
gcgcggacagaggctgacag

SEQ ID NO: 183978 - DNA, 20 bp, human
gggacagaggctgacagagg

SEQ ID NO: 183979 - DNA, 20 bp, human
gcgccgaggaccgacccact

SEQ ID NO: 183980 - DNA, 20 bp, human
gcagaggctgacagaggcgg

SEQ ID NO: 183981 - DNA, 20 bp, human
gcctcgttcaggtacccaga

SEQ ID NO: 183982 - DNA, 20 bp, human
gcacccagtgggtcggtcct

SEQ ID NO: 183983 - DNA, 20 bp, human
gccccccccggcacttacgt

SEQ ID NO: 183984 - DNA, 20 bp, human
ggttcaggtacccagacggc

SEQ ID NO: 183985 - DNA, 20 bp, human
ggcagcgctgcggccccaac

SEQ ID NO: 183986 - DNA, 20 bp, human
gcgccggcggagacagacaa

SEQ ID NO: 183987 - DNA, 20 bp, human
ggccgtgagccccgccgcag

SEQ ID NO: 183988 - DNA, 20 bp, human
gaagcgacccgagcctgtgg

SEQ ID NO: 183989 - DNA, 20 bp, human
ggcggctaccgggtcacggg

SEQ ID NO: 183990 - DNA, 20 bp, human
gcggggctcacggcacaaat

SEQ ID NO: 183991 - DNA, 20 bp, human
gaggccggtaccgcccccac

SEQ ID NO: 183992 - DNA, 20 bp, human
ggcacagactcaaagccccg

SEQ ID NO: 183993 - DNA, 20 bp, human
ggggcccagccccgacacag

SEQ ID NO: 183994 - DNA, 20 bp, human
gcccggtagccgctgtgtcg

SEQ ID NO: 183995 - DNA, 20 bp, human
ggcatcgccgggactcgcgg

SEQ ID NO: 183996 - DNA, 20 bp, human
ggggttcagaggcagattag

SEQ ID NO: 183997 - DNA, 20 bp, human
ggattagaggatcagagatg

SEQ ID NO: 183998 - DNA, 20 bp, human
gggatagtgtgagacatgta

SEQ ID NO: 183999 - DNA, 20 bp, human
gaccctgagcccttactgga

SEQ ID NO: 184000 - DNA, 20 bp, human
gggtatggggaccaggagtg

SEQ ID NO: 184001 - DNA, 20 bp, human
gccacagagtaccgccccca

SEQ ID NO: 184002 - DNA, 20 bp, human
gcgcccccaaggcagaagga

SEQ ID NO: 184003 - DNA, 20 bp, human
ggagctgcttaggcctggaa

SEQ ID NO: 184004 - DNA, 20 bp, human
gaatgagccagatcagggac

SEQ ID NO: 184005 - DNA, 20 bp, human
gaggctgcacaggctctacc

SEQ ID NO: 184006 - DNA, 20 bp, human
gtcggccggcgtagtagctc

SEQ ID NO: 184007 - DNA, 20 bp, human
gatccagcttcggagcgcag

SEQ ID NO: 184008 - DNA, 20 bp, human
gcgccgagcagtcatggcgg

SEQ ID NO: 184009 - DNA, 20 bp, human
gctgttgcgccgagcagtca

SEQ ID NO: 184010 - DNA, 20 bp, human
gaaaggccggacaccgcaga

SEQ ID NO: 184011 - DNA, 20 bp, human
gtcagagacagctgatcggt

SEQ ID NO: 184012 - DNA, 20 bp, human
gggcgcggcttggcagacgg

SEQ ID NO: 184013 - DNA, 20 bp, human
gggccgccgccatgactgct

SEQ ID NO: 184014 - DNA, 20 bp, human
ggtcgccgcgctggtaaggt

SEQ ID NO: 184015 - DNA, 20 bp, human
ggcggccagagctactacgc

SEQ ID NO: 184016 - DNA, 20 bp, human
gaagctataggacaatccca

SEQ ID NO: 184017 - DNA, 20 bp, human
gtgacaataatgttaaccat

SEQ ID NO: 184018 - DNA, 20 bp, human
gataaaatctataacaaatt

SEQ ID NO: 184019 - DNA, 20 bp, human
gtgtaccatccaggaatcaa

SEQ ID NO: 184020 - DNA, 20 bp, human
gttcatggagattaacgctc

SEQ ID NO: 184021 - DNA, 20 bp, human
gtatgttctttataagctat

SEQ ID NO: 184022 - DNA, 20 bp, human
gttatagattttatttggaa

SEQ ID NO: 184023 - DNA, 20 bp, human
gatatcctttgattcctgga

SEQ ID NO: 184024 - DNA, 20 bp, human
gaacatatctctttattttg

SEQ ID NO: 184025 - DNA, 20 bp, human
gcaacaagttcttctattca

SEQ ID NO: 184026 - DNA, 20 bp, human
ggctctgagcccatcaccag

SEQ ID NO: 184027 - DNA, 20 bp, human
gcaggcctgacttccagact

SEQ ID NO: 184028 - DNA, 20 bp, human
gggggagactaagaccagaa

SEQ ID NO: 184029 - DNA, 20 bp, human
gagcccatcaccagaggcaa

SEQ ID NO: 184030 - DNA, 20 bp, human
gagactaggctctgccccta

SEQ ID NO: 184031 - DNA, 20 bp, human
gtccacgggcgccacagagg

SEQ ID NO: 184032 - DNA, 20 bp, human
gagaaaggtgatttccttag

SEQ ID NO: 184033 - DNA, 20 bp, human
gacgctgggtgcagatgagg

SEQ ID NO: 184034 - DNA, 20 bp, human
gagctccacgggcgccacag

SEQ ID NO: 184035 - DNA, 20 bp, human
gccagggtctgggatacgct

SEQ ID NO: 184036 - DNA, 20 bp, human
gtaagggtctcggggtgggg

SEQ ID NO: 184037 - DNA, 20 bp, human
gtcatattgtaagggtctcg

SEQ ID NO: 184038 - DNA, 20 bp, human
gtattgtaagggtctcgggg

SEQ ID NO: 184039 - DNA, 20 bp, human
ggactcaatttagtgaggta

SEQ ID NO: 184040 - DNA, 20 bp, human
ggcccagactcaatttagtg

SEQ ID NO: 184041 - DNA, 20 bp, human
gtaagtagattcatattgta

SEQ ID NO: 184042 - DNA, 20 bp, human
ggggggggttggcaaaatcc

SEQ ID NO: 184043 - DNA, 20 bp, human
gctaatatatacccaactat

SEQ ID NO: 184044 - DNA, 20 bp, human
gatgctgctgtcctttcttc

SEQ ID NO: 184045 - DNA, 20 bp, human
gatttgcaaaacattacatt

SEQ ID NO: 184046 - DNA, 20 bp, human
ggccaaagacagccccgcag

SEQ ID NO: 184047 - DNA, 20 bp, human
gggctcgcgcgcccgcgaag

SEQ ID NO: 184048 - DNA, 20 bp, human
gctgggacaaggcgacacag

SEQ ID NO: 184049 - DNA, 20 bp, human
gccgttgggagggtaacccc

SEQ ID NO: 184050 - DNA, 20 bp, human
gaggggacgcagcgaaaccg

SEQ ID NO: 184051 - DNA, 20 bp, human
gcggagcccggggtggagag

SEQ ID NO: 184052 - DNA, 20 bp, human
gtaaccccgggaagaggccg

SEQ ID NO: 184053 - DNA, 20 bp, human
gtcgcagctccgaagctggg

SEQ ID NO: 184054 - DNA, 20 bp, human
gcgggcatcggcgtccgtcc

SEQ ID NO: 184055 - DNA, 20 bp, human
gttcgctgcgtccccttcgc

SEQ ID NO: 184056 - DNA, 20 bp, human
ggctggggtgcgaagagagt

SEQ ID NO: 184057 - DNA, 20 bp, human
ggtgcaggaaggaacgggag

SEQ ID NO: 184058 - DNA, 20 bp, human
gcgggaagtcgtcgctactc

SEQ ID NO: 184059 - DNA, 20 bp, human
gagagtcggcgcccgcaacg

SEQ ID NO: 184060 - DNA, 20 bp, human
ggagagggagaagtttggta

SEQ ID NO: 184061 - DNA, 20 bp, human
gcatcctaaccgggacctgg

SEQ ID NO: 184062 - DNA, 20 bp, human
gggacctggtggagaggtct

SEQ ID NO: 184063 - DNA, 20 bp, human
gagtgggactcggggtacag

SEQ ID NO: 184064 - DNA, 20 bp, human
gcatcctcgggtggagagta

SEQ ID NO: 184065 - DNA, 20 bp, human
gtaaccgggacctggtggag

SEQ ID NO: 184066 - DNA, 20 bp, human
gtccgggctccgagccgagt

SEQ ID NO: 184067 - DNA, 20 bp, human
gaggccggcgcgcagggcga

SEQ ID NO: 184068 - DNA, 20 bp, human
ggggcaagaggggtcagacg

SEQ ID NO: 184069 - DNA, 20 bp, human
ggaagcagtagcactggaag

SEQ ID NO: 184070 - DNA, 20 bp, human
gggccgcgcgcagcaccgtc

SEQ ID NO: 184071 - DNA, 20 bp, human
gcgtcgggcggcacgtcccg

SEQ ID NO: 184072 - DNA, 20 bp, human
ggcgcgcagcaccgtcaggt

SEQ ID NO: 184073 - DNA, 20 bp, human
gtgaggttgcgcgcgtcggg

SEQ ID NO: 184074 - DNA, 20 bp, human
ggccgccgaagcagtagcac

SEQ ID NO: 184075 - DNA, 20 bp, human
gcgcgcaacctcaccatcgt

SEQ ID NO: 184076 - DNA, 20 bp, human
ggggttgcggcgcagcactc

SEQ ID NO: 184077 - DNA, 20 bp, human
gcggcgcagcactctggtgt

SEQ ID NO: 184078 - DNA, 20 bp, human
gcagggagaagagcgaggga

SEQ ID NO: 184079 - DNA, 20 bp, human
ggcgccagggagaagagcga

SEQ ID NO: 184080 - DNA, 20 bp, human
gggtcgccctaagaagtcgg

SEQ ID NO: 184081 - DNA, 20 bp, human
ggcagtggctgaagtggcgg

SEQ ID NO: 184082 - DNA, 20 bp, human
gtggctgggagcccacgtga

SEQ ID NO: 184083 - DNA, 20 bp, human
gcttagggcgaccctcacgt

SEQ ID NO: 184084 - DNA, 20 bp, human
gctcctgtggggtcacctaa

SEQ ID NO: 184085 - DNA, 20 bp, human
gacttcagccactgccacca

SEQ ID NO: 184086 - DNA, 20 bp, human
gtcggccctggtgagccgcc

SEQ ID NO: 184087 - DNA, 20 bp, human
ggcgcctgcgcagtgaagct

SEQ ID NO: 184088 - DNA, 20 bp, human
gcggtgttctgagggcgagt

SEQ ID NO: 184089 - DNA, 20 bp, human
gagggtcgggtccagcgcgt

SEQ ID NO: 184090 - DNA, 20 bp, human
gtcagaagctcaagccccga

SEQ ID NO: 184091 - DNA, 20 bp, human
gtcgggatcaggacgcgaca

SEQ ID NO: 184092 - DNA, 20 bp, human
gcaggtggccggttccctcg

SEQ ID NO: 184093 - DNA, 20 bp, human
ggtgaagctgggcgccttcg

SEQ ID NO: 184094 - DNA, 20 bp, human
gcagcaaaaacgccagggac

SEQ ID NO: 184095 - DNA, 20 bp, human
ggcgacagtcgggaagtatg

SEQ ID NO: 184096 - DNA, 20 bp, human
gtgctgcagaggacacgagg

SEQ ID NO: 184097 - DNA, 20 bp, human
ggggcgatccgagccgggac

SEQ ID NO: 184098 - DNA, 20 bp, human
ggttctgggaggtggcgaag

SEQ ID NO: 184099 - DNA, 20 bp, human
ggcgaaggggctagcgtcag

SEQ ID NO: 184100 - DNA, 20 bp, human
gaccgcggcgagcaaggtga

SEQ ID NO: 184101 - DNA, 20 bp, human
gggccccaggatgccagatc

SEQ ID NO: 184102 - DNA, 20 bp, human
ggggctggagacatggaccg

SEQ ID NO: 184103 - DNA, 20 bp, human
gacttcgcgggagtcgccgg

SEQ ID NO: 184104 - DNA, 20 bp, human
ggcgccgtgctcccttcacg

SEQ ID NO: 184105 - DNA, 20 bp, human
gccgcgcccgacgcctctgg

SEQ ID NO: 184106 - DNA, 20 bp, human
gagagggtagagcattccac

SEQ ID NO: 184107 - DNA, 20 bp, human
gggcgactggctgcggaaga

SEQ ID NO: 184108 - DNA, 20 bp, human
gtcgcgagcgctgcgcggag

SEQ ID NO: 184109 - DNA, 20 bp, human
gaaccagaagcggctagtgg

SEQ ID NO: 184110 - DNA, 20 bp, human
gcgcgaggttgggaaggcca

SEQ ID NO: 184111 - DNA, 20 bp, human
gccccgagagtcaggtcctg

SEQ ID NO: 184112 - DNA, 20 bp, human
gggtaaccagaagcggctag

SEQ ID NO: 184113 - DNA, 20 bp, human
gtctgctctgggaagcacca

SEQ ID NO: 184114 - DNA, 20 bp, human
gccccactccctcaagggaa

SEQ ID NO: 184115 - DNA, 20 bp, human
gtgggaaggccaggggcgac

SEQ ID NO: 184116 - DNA, 20 bp, human
ggctatgggagccgagcggg

SEQ ID NO: 184117 - DNA, 20 bp, human
gcaagagcagggcacggggt

SEQ ID NO: 184118 - DNA, 20 bp, human
gccgctggctagtgtgtacg

SEQ ID NO: 184119 - DNA, 20 bp, human
ggtacgcggcgagcttctcc

SEQ ID NO: 184120 - DNA, 20 bp, human
gccgctgtcgcgggcgctat

SEQ ID NO: 184121 - DNA, 20 bp, human
gacccaaactacgggagcaa

SEQ ID NO: 184122 - DNA, 20 bp, human
gggcggagtccatgttcggg

SEQ ID NO: 184123 - DNA, 20 bp, human
gcggctcccgagcagagaag

SEQ ID NO: 184124 - DNA, 20 bp, human
gacgaaacgccgcggagctg

SEQ ID NO: 184125 - DNA, 20 bp, human
ggcgccagggaaccacacct

SEQ ID NO: 184126 - DNA, 20 bp, human
gaggcctcaccgccttggta

SEQ ID NO: 184127 - DNA, 20 bp, human
ggtcgtcaactcaactgtca

SEQ ID NO: 184128 - DNA, 20 bp, human
gtgtctcagccctaccaagg

SEQ ID NO: 184129 - DNA, 20 bp, human
ggctagcgtgtctacttcac

SEQ ID NO: 184130 - DNA, 20 bp, human
gccaggacagagacctctgt

SEQ ID NO: 184131 - DNA, 20 bp, human
ggagggatccatggcccagc

SEQ ID NO: 184132 - DNA, 20 bp, human
gacgctgtggggaactcaag

SEQ ID NO: 184133 - DNA, 20 bp, human
ggcaggtggagtcagatttc

SEQ ID NO: 184134 - DNA, 20 bp, human
ggggaactcaagaggaagtt

SEQ ID NO: 184135 - DNA, 20 bp, human
gagtcagatttcaggcggga

SEQ ID NO: 184136 - DNA, 20 bp, human
gcgccgcccgggataccgac

SEQ ID NO: 184137 - DNA, 20 bp, human
gcgcccgggataccgactgg

SEQ ID NO: 184138 - DNA, 20 bp, human
gacccgcagcgccggcgcag

SEQ ID NO: 184139 - DNA, 20 bp, human
gtgcgctcgcctgtaaacgg

SEQ ID NO: 184140 - DNA, 20 bp, human
gcgctgtccgtgaaaccggc

SEQ ID NO: 184141 - DNA, 20 bp, human
gccgtgaaaccggccggcgg

SEQ ID NO: 184142 - DNA, 20 bp, human
ggggatggatcggacaaggt

SEQ ID NO: 184143 - DNA, 20 bp, human
gcggcaagcggtaccaccgc

SEQ ID NO: 184144 - DNA, 20 bp, human
gtgtccgtgaaaccggccgg

SEQ ID NO: 184145 - DNA, 20 bp, human
ggcctgcgctcgcctgtaaa

SEQ ID NO: 184146 - DNA, 20 bp, human
gtcgcgagccatggaggagg

SEQ ID NO: 184147 - DNA, 20 bp, human
gtcgcggtcgcgagccatgg

SEQ ID NO: 184148 - DNA, 20 bp, human
gcggtcgcgagccatggagg

SEQ ID NO: 184149 - DNA, 20 bp, human
gacctggagaagctgaccct

SEQ ID NO: 184150 - DNA, 20 bp, human
gggctgagaatgcctcctag

SEQ ID NO: 184151 - DNA, 20 bp, human
ggaacacagcaagcacctga

SEQ ID NO: 184152 - DNA, 20 bp, human
gggaggaggcatcgtccccg

SEQ ID NO: 184153 - DNA, 20 bp, human
gcagcaagcacctgacggtt

SEQ ID NO: 184154 - DNA, 20 bp, human
gagttggatctccccctagg

SEQ ID NO: 184155 - DNA, 20 bp, human
gggaagttggatctccccct

SEQ ID NO: 184156 - DNA, 20 bp, human
gacggctctggggtatagaa

SEQ ID NO: 184157 - DNA, 20 bp, human
ggtgcagtgaaaaactcgaa

SEQ ID NO: 184158 - DNA, 20 bp, human
gcgagtggtgttgagtccca

SEQ ID NO: 184159 - DNA, 20 bp, human
gagaagtacttacggctctg

SEQ ID NO: 184160 - DNA, 20 bp, human
ggtgataagtaaccagccac

SEQ ID NO: 184161 - DNA, 20 bp, human
gtaaccagccacaggacgga

SEQ ID NO: 184162 - DNA, 20 bp, human
ggctgaaatagaagtactta

SEQ ID NO: 184163 - DNA, 20 bp, human
gaacctgataagaaatctct

SEQ ID NO: 184164 - DNA, 20 bp, human
gggctaacacatatagagca

SEQ ID NO: 184165 - DNA, 20 bp, human
gcaccaagagatttcttatc

SEQ ID NO: 184166 - DNA, 20 bp, human
ggcagcagggggtactagag

SEQ ID NO: 184167 - DNA, 20 bp, human
gatggagagaagaggaagac

SEQ ID NO: 184168 - DNA, 20 bp, human
gggggcgctgtccagaaccc

SEQ ID NO: 184169 - DNA, 20 bp, human
gaaaggagcccggggatggg

SEQ ID NO: 184170 - DNA, 20 bp, human
gccgaagagcatcagctact

SEQ ID NO: 184171 - DNA, 20 bp, human
gtaaatactgggcacggaga

SEQ ID NO: 184172 - DNA, 20 bp, human
gtcgggcactgctgaatcca

SEQ ID NO: 184173 - DNA, 20 bp, human
gtgtaaactgaagggggtgt

SEQ ID NO: 184174 - DNA, 20 bp, human
gagaggggcagtagcagcgc

SEQ ID NO: 184175 - DNA, 20 bp, human
gctttacttatggagagaag

SEQ ID NO: 184176 - DNA, 20 bp, human
ggtggcagcgccctctcccg

SEQ ID NO: 184177 - DNA, 20 bp, human
gcgcggcgctctatataagt

SEQ ID NO: 184178 - DNA, 20 bp, human
gcaggcgacggggttaggag

SEQ ID NO: 184179 - DNA, 20 bp, human
gctgtgcccgccaggcgacg

SEQ ID NO: 184180 - DNA, 20 bp, human
gccccgtcggtgcgtcgagg

SEQ ID NO: 184181 - DNA, 20 bp, human
gagtcgttcaggttgccgaa

SEQ ID NO: 184182 - DNA, 20 bp, human
gcccggggccaccttcctcc

SEQ ID NO: 184183 - DNA, 20 bp, human
gaggagtctggggctacgtg

SEQ ID NO: 184184 - DNA, 20 bp, human
gtccgcgcggacctgatgca

SEQ ID NO: 184185 - DNA, 20 bp, human
gaacgggcggaagcagagtc

SEQ ID NO: 184186 - DNA, 20 bp, human
ggctgtaggcgagccgtggc

SEQ ID NO: 184187 - DNA, 20 bp, human
gttttagcccccgggacgcg

SEQ ID NO: 184188 - DNA, 20 bp, human
gagcagtcgcacttacacaa

SEQ ID NO: 184189 - DNA, 20 bp, human
ggcctgcgatctccagtctg

SEQ ID NO: 184190 - DNA, 20 bp, human
ggccacagactggagatcgc

SEQ ID NO: 184191 - DNA, 20 bp, human
gatgggttcgcggagagagg

SEQ ID NO: 184192 - DNA, 20 bp, human
gcacttacacaatggctggt

SEQ ID NO: 184193 - DNA, 20 bp, human
ggtcgcacttacacaatggc

SEQ ID NO: 184194 - DNA, 20 bp, human
ggaacctggggagcgagagg

SEQ ID NO: 184195 - DNA, 20 bp, human
gcgtcagtgacactaaaccg

SEQ ID NO: 184196 - DNA, 20 bp, human
gccgcgaaatcaagtcctag

SEQ ID NO: 184197 - DNA, 20 bp, human
ggcggaggccgacaagaagg

SEQ ID NO: 184198 - DNA, 20 bp, human
gatggcgtccatggtggcgg

SEQ ID NO: 184199 - DNA, 20 bp, human
ggagcgccgggactcgagcc

SEQ ID NO: 184200 - DNA, 20 bp, human
gctagaggcgctttattctc

SEQ ID NO: 184201 - DNA, 20 bp, human
ggcgctttattctcaggact

SEQ ID NO: 184202 - DNA, 20 bp, human
gcggctggatccccaccccg

SEQ ID NO: 184203 - DNA, 20 bp, human
ggggtgccaggctcgagtcc

SEQ ID NO: 184204 - DNA, 20 bp, human
ggggcgcgcgtctggaaaga

SEQ ID NO: 184205 - DNA, 20 bp, human
gtccccaccccgaggactcg

SEQ ID NO: 184206 - DNA, 20 bp, human
gaagctgagggagaccgtaa

SEQ ID NO: 184207 - DNA, 20 bp, human
ggcgcgagctggaccacgag

SEQ ID NO: 184208 - DNA, 20 bp, human
gcgccatcgcgccggacggt

SEQ ID NO: 184209 - DNA, 20 bp, human
ggcgcacctgggccagctgg

SEQ ID NO: 184210 - DNA, 20 bp, human
ggcgccgccatcgcacagag

SEQ ID NO: 184211 - DNA, 20 bp, human
gccagaggcgcatcctcccg

SEQ ID NO: 184212 - DNA, 20 bp, human
gatcgcgccggacggtaggc

SEQ ID NO: 184213 - DNA, 20 bp, human
gggcggtgcgcaggaagatc

SEQ ID NO: 184214 - DNA, 20 bp, human
gcgccggacggtaggcgggc

SEQ ID NO: 184215 - DNA, 20 bp, human
gaggctcaggagaacaggcc

SEQ ID NO: 184216 - DNA, 20 bp, human
gggtgaggaccggacggact

SEQ ID NO: 184217 - DNA, 20 bp, human
gagcggactgggtgcaccgg

SEQ ID NO: 184218 - DNA, 20 bp, human
ggaccaaccgcgctctgcaa

SEQ ID NO: 184219 - DNA, 20 bp, human
ggcaggcggtgaggaccgga

SEQ ID NO: 184220 - DNA, 20 bp, human
gctgggctgggtgagcggac

SEQ ID NO: 184221 - DNA, 20 bp, human
ggtgagcggactgggtgcac

SEQ ID NO: 184222 - DNA, 20 bp, human
gcggtggcaggcgaggagga

SEQ ID NO: 184223 - DNA, 20 bp, human
gggtgcaccggtggcaggcg

SEQ ID NO: 184224 - DNA, 20 bp, human
gcttccccaggctattgtag

SEQ ID NO: 184225 - DNA, 20 bp, human
gggaccggacggactgggct

SEQ ID NO: 184226 - DNA, 20 bp, human
ggcgtagcaggcggaagtaa

SEQ ID NO: 184227 - DNA, 20 bp, human
gggacaccaagcggacgagg

SEQ ID NO: 184228 - DNA, 20 bp, human
ggcgggcccgggaacaggta

SEQ ID NO: 184229 - DNA, 20 bp, human
ggagatggtgaggctcatga

SEQ ID NO: 184230 - DNA, 20 bp, human
gccacaccccaaaccccgta

SEQ ID NO: 184231 - DNA, 20 bp, human
gggatctcggaggatgggtg

SEQ ID NO: 184232 - DNA, 20 bp, human
gggtgagttccggtatttca

SEQ ID NO: 184233 - DNA, 20 bp, human
gccgggaacaggtacggaga

SEQ ID NO: 184234 - DNA, 20 bp, human
gtatttcagggcgtagcagg

SEQ ID NO: 184235 - DNA, 20 bp, human
ggggcaggcgctggagtatc

SEQ ID NO: 184236 - DNA, 20 bp, human
gcggccaagcgggaaatggg

SEQ ID NO: 184237 - DNA, 20 bp, human
ggccggcctcaactccctgg

SEQ ID NO: 184238 - DNA, 20 bp, human
gagaggcgcacgggcagcgg

SEQ ID NO: 184239 - DNA, 20 bp, human
gcgcagaggcgcacgggcag

SEQ ID NO: 184240 - DNA, 20 bp, human
gtccgggtggagaagtggag

SEQ ID NO: 184241 - DNA, 20 bp, human
gaggacggcggaggaagtag

SEQ ID NO: 184242 - DNA, 20 bp, human
gatggccggcctcaactccc

SEQ ID NO: 184243 - DNA, 20 bp, human
gggagggggtgagcgatctc

SEQ ID NO: 184244 - DNA, 20 bp, human
ggcctccagggagttgaggc

SEQ ID NO: 184245 - DNA, 20 bp, human
ggtccgagggcgtaaaaagg

SEQ ID NO: 184246 - DNA, 20 bp, human
ggtgcgcggcgggctctgtg

SEQ ID NO: 184247 - DNA, 20 bp, human
gacacctgcgggaggatagg

SEQ ID NO: 184248 - DNA, 20 bp, human
gcccggagcggcccagcgga

SEQ ID NO: 184249 - DNA, 20 bp, human
ggcgctggcgtgggggacgt

SEQ ID NO: 184250 - DNA, 20 bp, human
ggtgtctgcgacccccaact

SEQ ID NO: 184251 - DNA, 20 bp, human
gcatggctgggcgctggcgt

SEQ ID NO: 184252 - DNA, 20 bp, human
gcagacacctgcgggaggat

SEQ ID NO: 184253 - DNA, 20 bp, human
gccaactgggctccagaccc

SEQ ID NO: 184254 - DNA, 20 bp, human
gctggaagaggggtgacgat

SEQ ID NO: 184255 - DNA, 20 bp, human
gcccggccttccgcacagag

SEQ ID NO: 184256 - DNA, 20 bp, human
gaagcgaggtaggctcactc

SEQ ID NO: 184257 - DNA, 20 bp, human
gaaccagctgtaagcgaggt

SEQ ID NO: 184258 - DNA, 20 bp, human
gcggcaaccagctgtaagcg

SEQ ID NO: 184259 - DNA, 20 bp, human
gcccctggggacgtcattgg

SEQ ID NO: 184260 - DNA, 20 bp, human
gaggctcactcgggcgcgga

SEQ ID NO: 184261 - DNA, 20 bp, human
gccgcccctggggacgtcat

SEQ ID NO: 184262 - DNA, 20 bp, human
gaggtaggctcactcgggcg

SEQ ID NO: 184263 - DNA, 20 bp, human
gggaggcgtacccgcccctg

SEQ ID NO: 184264 - DNA, 20 bp, human
gagcctacctcgcttacagc

SEQ ID NO: 184265 - DNA, 20 bp, human
ggcggaaactgggaataacg

SEQ ID NO: 184266 - DNA, 20 bp, human
gagtccctggaaggcaatta

SEQ ID NO: 184267 - DNA, 20 bp, human
gcaggactcacatgttccag

SEQ ID NO: 184268 - DNA, 20 bp, human
ggcgccttaattgccttcca

SEQ ID NO: 184269 - DNA, 20 bp, human
gagtcgccgtccatgtcagg

SEQ ID NO: 184270 - DNA, 20 bp, human
gggaacatgtgagtcctgta

SEQ ID NO: 184271 - DNA, 20 bp, human
ggagaagaggaaaaaaggtc

SEQ ID NO: 184272 - DNA, 20 bp, human
ggactcacatgttccagcgg

SEQ ID NO: 184273 - DNA, 20 bp, human
gtcttctcttaggctttctg

SEQ ID NO: 184274 - DNA, 20 bp, human
gctgtgagggtcgctcactg

SEQ ID NO: 184275 - DNA, 20 bp, human
ggggccattatagcaggtat

SEQ ID NO: 184276 - DNA, 20 bp, human
gtgacagcagatccgcggaa

SEQ ID NO: 184277 - DNA, 20 bp, human
gtgagagggctcgggagaaa

SEQ ID NO: 184278 - DNA, 20 bp, human
gcgggagaaagggatcacgt

SEQ ID NO: 184279 - DNA, 20 bp, human
gatccgcggaagggcagaat

SEQ ID NO: 184280 - DNA, 20 bp, human
gtcacatgacagcagatccg

SEQ ID NO: 184281 - DNA, 20 bp, human
ggctcctaggatcctcccca

SEQ ID NO: 184282 - DNA, 20 bp, human
gaagctaggaccaggacagt

SEQ ID NO: 184283 - DNA, 20 bp, human
gcgttggagggagcacacat

SEQ ID NO: 184284 - DNA, 20 bp, human
ggagcacacattgggagggt

SEQ ID NO: 184285 - DNA, 20 bp, human
gcacatgaggtgaatgatag

SEQ ID NO: 184286 - DNA, 20 bp, human
gggccatggacgcaggatgg

SEQ ID NO: 184287 - DNA, 20 bp, human
ggcccgccaaggggactcaa

SEQ ID NO: 184288 - DNA, 20 bp, human
gagggcccggaccccaggtt

SEQ ID NO: 184289 - DNA, 20 bp, human
gggtggccatggacgcagga

SEQ ID NO: 184290 - DNA, 20 bp, human
ggcacagtgccagggtcgct

SEQ ID NO: 184291 - DNA, 20 bp, human
ggggtgggcagcaccggggt

SEQ ID NO: 184292 - DNA, 20 bp, human
ggtcagagccaggcgcggga

SEQ ID NO: 184293 - DNA, 20 bp, human
gggctcctcagtcgcagcgg

SEQ ID NO: 184294 - DNA, 20 bp, human
gaggagaccgtgaaaaggga

SEQ ID NO: 184295 - DNA, 20 bp, human
gcggcaggagaccgtgaaaa

SEQ ID NO: 184296 - DNA, 20 bp, human
ggtcgcgcgcggccgagtcg

SEQ ID NO: 184297 - DNA, 20 bp, human
gcgcgcgacccggtgctcag

SEQ ID NO: 184298 - DNA, 20 bp, human
gtcgagtcccgagctgggga

SEQ ID NO: 184299 - DNA, 20 bp, human
gcggttcgagtcccgagctg

SEQ ID NO: 184300 - DNA, 20 bp, human
gccctattcccaggcctagg

SEQ ID NO: 184301 - DNA, 20 bp, human
ggtccgggaagggggctcgg

SEQ ID NO: 184302 - DNA, 20 bp, human
gacaggtctgtcaccgtctc

SEQ ID NO: 184303 - DNA, 20 bp, human
gaccggcggccccctaggcc

SEQ ID NO: 184304 - DNA, 20 bp, human
ggccccgcccagcccggtcc

SEQ ID NO: 184305 - DNA, 20 bp, human
gtgaagtcactgcccgcagc

SEQ ID NO: 184306 - DNA, 20 bp, human
gtagctgaccatggcatcag

SEQ ID NO: 184307 - DNA, 20 bp, human
gccaccatccgggtactcta

SEQ ID NO: 184308 - DNA, 20 bp, human
ggaagggtcagaccaccatc

SEQ ID NO: 184309 - DNA, 20 bp, human
gtaagtgtgtgcagatatgt

SEQ ID NO: 184310 - DNA, 20 bp, human
ggagaaaggagagagcaaca

SEQ ID NO: 184311 - DNA, 20 bp, human
gccaagctgtgcaaagactg

SEQ ID NO: 184312 - DNA, 20 bp, human
ggtaccttagagtacccgga

SEQ ID NO: 184313 - DNA, 20 bp, human
gggtcggggagggcagtcgt

SEQ ID NO: 184314 - DNA, 20 bp, human
gggaggactgtggagtaatg

SEQ ID NO: 184315 - DNA, 20 bp, human
gggcagaaaaaacattccat

SEQ ID NO: 184316 - DNA, 20 bp, human
gtgacatgggagacagacct

SEQ ID NO: 184317 - DNA, 20 bp, human
ggagtagaggagagaagcga

SEQ ID NO: 184318 - DNA, 20 bp, human
gacagctctccagtaagagg

SEQ ID NO: 184319 - DNA, 20 bp, human
gactaaacgcgggggaatag

SEQ ID NO: 184320 - DNA, 20 bp, human
gttgacagctctccagtaag

SEQ ID NO: 184321 - DNA, 20 bp, human
gctcgagccggaatcaatat

SEQ ID NO: 184322 - DNA, 20 bp, human
ggaatcaatataggctacaa

SEQ ID NO: 184323 - DNA, 20 bp, human
ggccaagacccagactccca

SEQ ID NO: 184324 - DNA, 20 bp, human
gcgaggaggttgatgaccct

SEQ ID NO: 184325 - DNA, 20 bp, human
gtaggggtagacagacactg

SEQ ID NO: 184326 - DNA, 20 bp, human
gatggacgcgggagaccagg

SEQ ID NO: 184327 - DNA, 20 bp, human
gccgatggacgcgggagacc

SEQ ID NO: 184328 - DNA, 20 bp, human
gcgacgcaggaatggaccga

SEQ ID NO: 184329 - DNA, 20 bp, human
gtcccacccgggagccggca

SEQ ID NO: 184330 - DNA, 20 bp, human
gtccctgccggctcccgggt

SEQ ID NO: 184331 - DNA, 20 bp, human
gggaatggaccgatggacgc

SEQ ID NO: 184332 - DNA, 20 bp, human
gtgcagtcccacccgggagc

SEQ ID NO: 184333 - DNA, 20 bp, human
gccgcgaggtagaagcccat

SEQ ID NO: 184334 - DNA, 20 bp, human
gggacagaacgacgcaggaa

SEQ ID NO: 184335 - DNA, 20 bp, human
gtggaaagggtcccaacctc

SEQ ID NO: 184336 - DNA, 20 bp, human
gacttcggtcgcgggcggtg

SEQ ID NO: 184337 - DNA, 20 bp, human
ggaaacgctgccgctgaggg

SEQ ID NO: 184338 - DNA, 20 bp, human
gaaatcgagtccaccctcag

SEQ ID NO: 184339 - DNA, 20 bp, human
gcgcccgccggagactcccg

SEQ ID NO: 184340 - DNA, 20 bp, human
gcagggttcgtagcttccaa

SEQ ID NO: 184341 - DNA, 20 bp, human
gggagtcgagcccaaaacca

SEQ ID NO: 184342 - DNA, 20 bp, human
ggctgaaacgctgccgctga
